United States Patent 7,374,927 (METHODS OF ANALYSIS OF DEGRADED NUCLEIC ACID SAMPLES) - sequence listing, part 16

SEQ ID NO: 601670 - DNA, 25 bp, Homo sapien
gactgtaaatatctctagtttagga

SEQ ID NO: 601671 - DNA, 25 bp, Homo sapien
taggatctagtgtttatacttgcct

SEQ ID NO: 601672 - DNA, 25 bp, Homo sapien
gagcagcagctctacacccaggagc

SEQ ID NO: 601673 - DNA, 25 bp, Homo sapien
agcagcagctctacacccaggagca

SEQ ID NO: 601674 - DNA, 25 bp, Homo sapien
aggagcagctcttcgaccgcacgtg

SEQ ID NO: 601675 - DNA, 25 bp, Homo sapien
gctcttcgaccgcacgtgcatgatg

SEQ ID NO: 601676 - DNA, 25 bp, Homo sapien
tcttcgaccgcacgtgcatgatgct

SEQ ID NO: 601677 - DNA, 25 bp, Homo sapien
tcgaccgcacgtgcatgatgctcgg

SEQ ID NO: 601678 - DNA, 25 bp, Homo sapien
gggccgggtagccgagcagctgtgc

SEQ ID NO: 601679 - DNA, 25 bp, Homo sapien
gctgtgctccgggtagatcactatg

SEQ ID NO: 601680 - DNA, 25 bp, Homo sapien
tgtgctccgggtagatcactatggg

SEQ ID NO: 601681 - DNA, 25 bp, Homo sapien
tcactatgggggctcaggacgacct

SEQ ID NO: 601682 - DNA, 25 bp, Homo sapien
ggaaggtcacccagagtgcctacgc

SEQ ID NO: 601683 - DNA, 25 bp, Homo sapien
tcagttctggacttagtctcccttt

SEQ ID NO: 601684 - DNA, 25 bp, Homo sapien
tggacttagtctcccttttcttcct

SEQ ID NO: 601685 - DNA, 25 bp, Homo sapien
aaagtggaattagctcctaggcata

SEQ ID NO: 601686 - DNA, 25 bp, Homo sapien
tagctcctaggcatagggaaagtgc

SEQ ID NO: 601687 - DNA, 25 bp, Homo sapien
aagtgcagaatattgccgtgttgtc

SEQ ID NO: 601688 - DNA, 25 bp, Homo sapien
attgccgtgttgtcatttacagttc

SEQ ID NO: 601689 - DNA, 25 bp, Homo sapien
ccgtgttgtcatttacagttctgtt

SEQ ID NO: 601690 - DNA, 25 bp, Homo sapien
gttgatgtcgataacgtttgtgggt

SEQ ID NO: 601691 - DNA, 25 bp, Homo sapien
taacgtttgtgggtgtaattggtag

SEQ ID NO: 601692 - DNA, 25 bp, Homo sapien
gtaattggtagtgttctgtccctcc

SEQ ID NO: 601693 - DNA, 25 bp, Homo sapien
attggtagtgttctgtccctccaag

SEQ ID NO: 601694 - DNA, 25 bp, Homo sapien
gaaacgtcatgagctctctctagat

SEQ ID NO: 601695 - DNA, 25 bp, Homo sapien
acgtcatgagctctctctagatcct

SEQ ID NO: 601696 - DNA, 25 bp, Homo sapien
ggaaaatcagatcggcagaaaccaa

SEQ ID NO: 601697 - DNA, 25 bp, Homo sapien
cagatcggcagaaaccaaatgttga

SEQ ID NO: 601698 - DNA, 25 bp, Homo sapien
tacagattaagtatccctacaatgg

SEQ ID NO: 601699 - DNA, 25 bp, Homo sapien
ttaagtatccctacaatggaatatt

SEQ ID NO: 601700 - DNA, 25 bp, Homo sapien
aagaaatgaagtatggacccatgca

SEQ ID NO: 601701 - DNA, 25 bp, Homo sapien
tatggacccatgcatggaaggatgc

SEQ ID NO: 601702 - DNA, 25 bp, Homo sapien
tacagcatagaaggaccttgaaaac

SEQ ID NO: 601703 - DNA, 25 bp, Homo sapien
aaacacagggctaagtgagaggagc

SEQ ID NO: 601704 - DNA, 25 bp, Homo sapien
gagccggacaggaaggatcatgtat

SEQ ID NO: 601705 - DNA, 25 bp, Homo sapien
cctggctgagaacccctcagggcag

SEQ ID NO: 601706 - DNA, 25 bp, Homo sapien
cctcagggcagatagctggctcaga

SEQ ID NO: 601707 - DNA, 25 bp, Homo sapien
agatagctggctcagagtcctcatg

SEQ ID NO: 601708 - DNA, 25 bp, Homo sapien
tcagagtcctcatggtcttgttgat

SEQ ID NO: 601709 - DNA, 25 bp, Homo sapien
gaaacactggtatgttccttcctga

SEQ ID NO: 601710 - DNA, 25 bp, Homo sapien
ttgaggagcctctaggacacgttcc

SEQ ID NO: 601711 - DNA, 25 bp, Homo sapien
gacacgttccatgtggttgggactt

SEQ ID NO: 601712 - DNA, 25 bp, Homo sapien
tggttgggactttgtaatgccagat

SEQ ID NO: 601713 - DNA, 25 bp, Homo sapien
gttttaacattcctccatccatcat

SEQ ID NO: 601714 - DNA, 25 bp, Homo sapien
atctacccatctacctttcatctat

SEQ ID NO: 601715 - DNA, 25 bp, Homo sapien
atctacctttcatctatttctctcc

SEQ ID NO: 601716 - DNA, 25 bp, Homo sapien
aaagcttcaagatccaaaactcgtc

SEQ ID NO: 601717 - DNA, 25 bp, Homo sapien
agatccaaaactcgtctcaaatccc

SEQ ID NO: 601718 - DNA, 25 bp, Homo sapien
aactcgtctcaaatcccaactactg

SEQ ID NO: 601719 - DNA, 25 bp, Homo sapien
aaacatttctatgtggtgactgctg

SEQ ID NO: 601720 - DNA, 25 bp, Homo sapien
tgactgctgccaacaggttaaggaa

SEQ ID NO: 601721 - DNA, 25 bp, Homo sapien
gaaatttccaacttctccctaatct

SEQ ID NO: 601722 - DNA, 25 bp, Homo sapien
cttcaactctgctgctccaatgggt

SEQ ID NO: 601723 - DNA, 25 bp, Homo sapien
ctgctgctccaatgggtccagaaat

SEQ ID NO: 601724 - DNA, 25 bp, Homo sapien
gctccaatgggtccagaaattactg

SEQ ID NO: 601725 - DNA, 25 bp, Homo sapien
atttggcttttggtattattgattc

SEQ ID NO: 601726 - DNA, 25 bp, Homo sapien
gtaaatggttatggctgctgcttcc

SEQ ID NO: 601727 - DNA, 25 bp, Homo sapien
gagataccactacaacctactaaac

SEQ ID NO: 601728 - DNA, 25 bp, Homo sapien
gataccactacaacctactaaactg

SEQ ID NO: 601729 - DNA, 25 bp, Homo sapien
tacaacctactaaactgactaaaat

SEQ ID NO: 601730 - DNA, 25 bp, Homo sapien
aattaatcagactaaccaggtgttg

SEQ ID NO: 601731 - DNA, 25 bp, Homo sapien
cagactaaccaggtgttggcaagaa

SEQ ID NO: 601732 - DNA, 25 bp, Homo sapien
taaccaggtgttggcaagaaacagg

SEQ ID NO: 601733 - DNA, 25 bp, Homo sapien
aaacagggacactgagactctcaca

SEQ ID NO: 601734 - DNA, 25 bp, Homo sapien
acactgagactctcacactgctgga

SEQ ID NO: 601735 - DNA, 25 bp, Homo sapien
atgagttcagtaactttttaaacag

SEQ ID NO: 601736 - DNA, 25 bp, Homo sapien
ttaaacagttgaaaatagacctatc

SEQ ID NO: 601737 - DNA, 25 bp, Homo sapien
aatagacctatcatgcaaaccagca

SEQ ID NO: 601738 - DNA, 25 bp, Homo sapien
gggactttccctgcaggtgtcctgg

SEQ ID NO: 601739 - DNA, 25 bp, Homo sapien
ggtgtgcactcctcggttggccgct

SEQ ID NO: 601740 - DNA, 25 bp, Homo sapien
tcggttggccgctgatgaacgcaga

SEQ ID NO: 601741 - DNA, 25 bp, Homo sapien
gagggaacagcctttgtaacccaga

SEQ ID NO: 601742 - DNA, 25 bp, Homo sapien
taacccagagtgtatgggcggccct

SEQ ID NO: 601743 - DNA, 25 bp, Homo sapien
tatgggcggccctctaagcgcacca

SEQ ID NO: 601744 - DNA, 25 bp, Homo sapien
taagcgcaccaggagcactgggaaa

SEQ ID NO: 601745 - DNA, 25 bp, Homo sapien
ctcctttgggcatggaaaattaaca

SEQ ID NO: 601746 - DNA, 25 bp, Homo sapien
aaattaacaacatcacctctaagga

SEQ ID NO: 601747 - DNA, 25 bp, Homo sapien
atcacctctaaggatgaacacagaa

SEQ ID NO: 601748 - DNA, 25 bp, Homo sapien
gaacacagaatacctgctgcttttg

SEQ ID NO: 601749 - DNA, 25 bp, Homo sapien
aagaatctccagagggccatatccc

SEQ ID NO: 601750 - DNA, 25 bp, Homo sapien
ccatatcccgaaacctcatgcagag

SEQ ID NO: 601751 - DNA, 25 bp, Homo sapien
actctcagagtcctggatctgcaca

SEQ ID NO: 601752 - DNA, 25 bp, Homo sapien
ggatctgcacagtcttctaagtcac

SEQ ID NO: 601753 - DNA, 25 bp, Homo sapien
ttattctcacaaatccaggcatatg

SEQ ID NO: 601754 - DNA, 25 bp, Homo sapien
ggatagtagaatcgccactgtctgc

SEQ ID NO: 601755 - DNA, 25 bp, Homo sapien
aagcatttcccacttggcgaaggac

SEQ ID NO: 601756 - DNA, 25 bp, Homo sapien
tgattttggaggctggtcatcgcat

SEQ ID NO: 601757 - DNA, 25 bp, Homo sapien
ggtcatcgcatgtcagctggccagg

SEQ ID NO: 601758 - DNA, 25 bp, Homo sapien
ggtgatcaccatggctgcagggtct

SEQ ID NO: 601759 - DNA, 25 bp, Homo sapien
tggctgcagggtcttccatgaagaa

SEQ ID NO: 601760 - DNA, 25 bp, Homo sapien
gccagatcggccgagccaagcgagt

SEQ ID NO: 601761 - DNA, 25 bp, Homo sapien
ccagatcggccgagccaagcgagtg

SEQ ID NO: 601762 - DNA, 25 bp, Homo sapien
tcggccgagccaagcgagtggtgat

SEQ ID NO: 601763 - DNA, 25 bp, Homo sapien
agccaagcgagtggtgatcgaggat

SEQ ID NO: 601764 - DNA, 25 bp, Homo sapien
tgatcgaggatgaccggatagacga

SEQ ID NO: 601765 - DNA, 25 bp, Homo sapien
aggatgaccggatagacgacgtgct

SEQ ID NO: 601766 - DNA, 25 bp, Homo sapien
gatgaccggatagacgacgtgctga

SEQ ID NO: 601767 - DNA, 25 bp, Homo sapien
atgaccggatagacgacgtgctgaa

SEQ ID NO: 601768 - DNA, 25 bp, Homo sapien
gggagaagccgccgtccggagtgta

SEQ ID NO: 601769 - DNA, 25 bp, Homo sapien
tccggagtgtagacgcgccggctcg

SEQ ID NO: 601770 - DNA, 25 bp, Homo sapien
ggcactccggagctgtccgcttcag

SEQ ID NO: 601771 - DNA, 25 bp, Homo sapien
gaaggttcccttgtctcacgattat

SEQ ID NO: 601772 - DNA, 25 bp, Homo sapien
tgtctcacgattatctcccacctta

SEQ ID NO: 601773 - DNA, 25 bp, Homo sapien
cccaccttacagatgccaaaattta

SEQ ID NO: 601774 - DNA, 25 bp, Homo sapien
tattaataaggccacgtaccttttg

SEQ ID NO: 601775 - DNA, 25 bp, Homo sapien
ttgttgtgaggttctgtcccctgtg

SEQ ID NO: 601776 - DNA, 25 bp, Homo sapien
tcccctgtgttgtaggacgttgagc

SEQ ID NO: 601777 - DNA, 25 bp, Homo sapien
agcatccctagcctctgcttgctgg

SEQ ID NO: 601778 - DNA, 25 bp, Homo sapien
ctctgcttgctggaagcctacagta

SEQ ID NO: 601779 - DNA, 25 bp, Homo sapien
ggaagcctacagtagcactgtccct

SEQ ID NO: 601780 - DNA, 25 bp, Homo sapien
cccatccaaggaccactagaagtga

SEQ ID NO: 601781 - DNA, 25 bp, Homo sapien
caaaatatggctttgaaggttccct

SEQ ID NO: 601782 - DNA, 25 bp, Homo sapien
ggttaactgaaatcaccttatatta

SEQ ID NO: 601783 - DNA, 25 bp, Homo sapien
tttgcctcctgaacatctgggagca

SEQ ID NO: 601784 - DNA, 25 bp, Homo sapien
tgcctcctgaacatctgggagcata

SEQ ID NO: 601785 - DNA, 25 bp, Homo sapien
tcctgaacatctgggagcataggcc

SEQ ID NO: 601786 - DNA, 25 bp, Homo sapien
ggagcataggcccagatattcctta

SEQ ID NO: 601787 - DNA, 25 bp, Homo sapien
gcataggcccagatattccttacta

SEQ ID NO: 601788 - DNA, 25 bp, Homo sapien
taggcccagatattccttactagtc

SEQ ID NO: 601789 - DNA, 25 bp, Homo sapien
gcccagatattccttactagtccta

SEQ ID NO: 601790 - DNA, 25 bp, Homo sapien
cagatattccttactagtcctataa

SEQ ID NO: 601791 - DNA, 25 bp, Homo sapien
gatattccttactagtcctataatt

SEQ ID NO: 601792 - DNA, 25 bp, Homo sapien
ttactagtcctataattttatcttc

SEQ ID NO: 601793 - DNA, 25 bp, Homo sapien
atgatatgtgtgctcattccacttt

SEQ ID NO: 601794 - DNA, 25 bp, Homo sapien
tgatatgtgtgctcattccactttt

SEQ ID NO: 601795 - DNA, 25 bp, Homo sapien
gatatgtgtgctcattccacttttc

SEQ ID NO: 601796 - DNA, 25 bp, Homo sapien
atatgtgtgctcattccacttttct

SEQ ID NO: 601797 - DNA, 25 bp, Homo sapien
tatgtgtgctcattccacttttctt

SEQ ID NO: 601798 - DNA, 25 bp, Homo sapien
atgtgtgctcattccacttttcttt

SEQ ID NO: 601799 - DNA, 25 bp, Homo sapien
tgtgtgctcattccacttttctttt

SEQ ID NO: 601800 - DNA, 25 bp, Homo sapien
gtgtgctcattccacttttcttttg

SEQ ID NO: 601801 - DNA, 25 bp, Homo sapien
tgtgctcattccacttttcttttgt

SEQ ID NO: 601802 - DNA, 25 bp, Homo sapien
acagaaggctctcactgatgaaagt

SEQ ID NO: 601803 - DNA, 25 bp, Homo sapien
cagaaggctctcactgatgaaagtg

SEQ ID NO: 601804 - DNA, 25 bp, Homo sapien
agaaggctctcactgatgaaagtgc

SEQ ID NO: 601805 - DNA, 25 bp, Homo sapien
gaaggctctcactgatgaaagtgcc

SEQ ID NO: 601806 - DNA, 25 bp, Homo sapien
aaggctctcactgatgaaagtgcca

SEQ ID NO: 601807 - DNA, 25 bp, Homo sapien
aggctctcactgatgaaagtgccag

SEQ ID NO: 601808 - DNA, 25 bp, Homo sapien
ggctctcactgatgaaagtgccagg

SEQ ID NO: 601809 - DNA, 25 bp, Homo sapien
gctctcactgatgaaagtgccagga

SEQ ID NO: 601810 - DNA, 25 bp, Homo sapien
ctctcactgatgaaagtgccaggaa

SEQ ID NO: 601811 - DNA, 25 bp, Homo sapien
tctcactgatgaaagtgccaggaag

SEQ ID NO: 601812 - DNA, 25 bp, Homo sapien
tatcaccacgtgttagaatcaacaa

SEQ ID NO: 601813 - DNA, 25 bp, Homo sapien
atcaccacgtgttagaatcaacaaa

SEQ ID NO: 601814 - DNA, 25 bp, Homo sapien
tcaccacgtgttagaatcaacaaaa

SEQ ID NO: 601815 - DNA, 25 bp, Homo sapien
caccacgtgttagaatcaacaaaat

SEQ ID NO: 601816 - DNA, 25 bp, Homo sapien
accacgtgttagaatcaacaaaata

SEQ ID NO: 601817 - DNA, 25 bp, Homo sapien
ccacgtgttagaatcaacaaaataa

SEQ ID NO: 601818 - DNA, 25 bp, Homo sapien
cacgtgttagaatcaacaaaataag

SEQ ID NO: 601819 - DNA, 25 bp, Homo sapien
gttagaatcaacaaaataaggccag

SEQ ID NO: 601820 - DNA, 25 bp, Homo sapien
ttagaatcaacaaaataaggccagg

SEQ ID NO: 601821 - DNA, 25 bp, Homo sapien
tagaatcaacaaaataaggccaggc

SEQ ID NO: 601822 - DNA, 25 bp, Homo sapien
aaaaccctgtctctgctgaaaacac

SEQ ID NO: 601823 - DNA, 25 bp, Homo sapien
caggccaggcgcggcggctcactcc

SEQ ID NO: 601824 - DNA, 25 bp, Homo sapien
aggccaggcgcggcggctcactcct

SEQ ID NO: 601825 - DNA, 25 bp, Homo sapien
ggaggttgcagtgaggtaagatggc

SEQ ID NO: 601826 - DNA, 25 bp, Homo sapien
gaggtaagatggcaccactacactc

SEQ ID NO: 601827 - DNA, 25 bp, Homo sapien
aggtaagatggcaccactacactcc

SEQ ID NO: 601828 - DNA, 25 bp, Homo sapien
ggtaagatggcaccactacactcca

SEQ ID NO: 601829 - DNA, 25 bp, Homo sapien
gtaagatggcaccactacactccag

SEQ ID NO: 601830 - DNA, 25 bp, Homo sapien
taagatggcaccactacactccagc

SEQ ID NO: 601831 - DNA, 25 bp, Homo sapien
agcgggcagcggagcggagcgcacg

SEQ ID NO: 601832 - DNA, 25 bp, Homo sapien
gcgggcagcggagcggagcgcacgg

SEQ ID NO: 601833 - DNA, 25 bp, Homo sapien
tccccggggacgtacctggctcagg

SEQ ID NO: 601834 - DNA, 25 bp, Homo sapien
tggctcaggagagccgccgggagtg

SEQ ID NO: 601835 - DNA, 25 bp, Homo sapien
agagccgccgggagtgcttaggcca

SEQ ID NO: 601836 - DNA, 25 bp, Homo sapien
gagccgccgggagtgcttaggccag

SEQ ID NO: 601837 - DNA, 25 bp, Homo sapien
agccgccgggagtgcttaggccagt

SEQ ID NO: 601838 - DNA, 25 bp, Homo sapien
gccgccgggagtgcttaggccagtt

SEQ ID NO: 601839 - DNA, 25 bp, Homo sapien
ccgccgggagtgcttaggccagttg

SEQ ID NO: 601840 - DNA, 25 bp, Homo sapien
gccgggagtgcttaggccagttgct

SEQ ID NO: 601841 - DNA, 25 bp, Homo sapien
ccgggagtgcttaggccagttgctg

SEQ ID NO: 601842 - DNA, 25 bp, Homo sapien
gtggaacttgagtcatgtctcccag

SEQ ID NO: 601843 - DNA, 25 bp, Homo sapien
acttgagtcatgtctcccagatttt

SEQ ID NO: 601844 - DNA, 25 bp, Homo sapien
tctcccagattttgtgacacaaccc

SEQ ID NO: 601845 - DNA, 25 bp, Homo sapien
tttgtgacacaaccccaaatcagag

SEQ ID NO: 601846 - DNA, 25 bp, Homo sapien
agtcattaccaccaaagctggtttt

SEQ ID NO: 601847 - DNA, 25 bp, Homo sapien
cagcaaggttggactatgagttggc

SEQ ID NO: 601848 - DNA, 25 bp, Homo sapien
aggttcataaggcactgttggataa

SEQ ID NO: 601849 - DNA, 25 bp, Homo sapien
tcaaagaaacccaatacctcaacct

SEQ ID NO: 601850 - DNA, 25 bp, Homo sapien
ggcttccaactccaaccttggaaat

SEQ ID NO: 601851 - DNA, 25 bp, Homo sapien
actccaaccttggaaatgacgtcca

SEQ ID NO: 601852 - DNA, 25 bp, Homo sapien
gaaatgacgtccaatgaagaagaag

SEQ ID NO: 601853 - DNA, 25 bp, Homo sapien
ttaaaccatcccctagattaagtat

SEQ ID NO: 601854 - DNA, 25 bp, Homo sapien
aaccatcccctagattaagtataat

SEQ ID NO: 601855 - DNA, 25 bp, Homo sapien
gccccaacagccctctaggttaaag

SEQ ID NO: 601856 - DNA, 25 bp, Homo sapien
gttttgatggcctaatacacactga

SEQ ID NO: 601857 - DNA, 25 bp, Homo sapien
cacactgacgtgtgtacagtcatcc

SEQ ID NO: 601858 - DNA, 25 bp, Homo sapien
cagtcatcccctctcatgaaatggg

SEQ ID NO: 601859 - DNA, 25 bp, Homo sapien
tccaggaccccgtagacaccagaat

SEQ ID NO: 601860 - DNA, 25 bp, Homo sapien
gtagacaccagaatccgcagacggt

SEQ ID NO: 601861 - DNA, 25 bp, Homo sapien
accagaatccgcagacggtcaagtc

SEQ ID NO: 601862 - DNA, 25 bp, Homo sapien
tgcatacaccttcccagatatttaa

SEQ ID NO: 601863 - DNA, 25 bp, Homo sapien
agatatttaaaccatcccctagatt

SEQ ID NO: 601864 - DNA, 25 bp, Homo sapien
attcaacccataacaacttgtctga

SEQ ID NO: 601865 - DNA, 25 bp, Homo sapien
aacttgtctgatcttgtgcatgcta

SEQ ID NO: 601866 - DNA, 25 bp, Homo sapien
ttgtctgatcttgtgcatgctaccc

SEQ ID NO: 601867 - DNA, 25 bp, Homo sapien
tgatcttgtgcatgctaccctagga

SEQ ID NO: 601868 - DNA, 25 bp, Homo sapien
atcttgtgcatgctaccctaggaag

SEQ ID NO: 601869 - DNA, 25 bp, Homo sapien
gtgcatgctaccctaggaagcccac

SEQ ID NO: 601870 - DNA, 25 bp, Homo sapien
tagcttgcccttttacacagtgaaa

SEQ ID NO: 601871 - DNA, 25 bp, Homo sapien
gcttgcccttttacacagtgaaacc

SEQ ID NO: 601872 - DNA, 25 bp, Homo sapien
ttgcccttttacacagtgaaacctc

SEQ ID NO: 601873 - DNA, 25 bp, Homo sapien
ggtgtattctaagatatggatgtta

SEQ ID NO: 601874 - DNA, 25 bp, Homo sapien
ggatgttaagacttcaatatttctt

SEQ ID NO: 601875 - DNA, 25 bp, Homo sapien
acatgcacacatgcaaagacacgca

SEQ ID NO: 601876 - DNA, 25 bp, Homo sapien
acgcatgcaggcacacgcagagaca

SEQ ID NO: 601877 - DNA, 25 bp, Homo sapien
gcaggcacacgcagagacacacatg

SEQ ID NO: 601878 - DNA, 25 bp, Homo sapien
gagacacacatgcagatacacatgc

SEQ ID NO: 601879 - DNA, 25 bp, Homo sapien
actggcccgtttttctgtggtgtca

SEQ ID NO: 601880 - DNA, 25 bp, Homo sapien
ctgtggtgtcactgggtgccagcaa

SEQ ID NO: 601881 - DNA, 25 bp, Homo sapien
tgggtgccagcaactcggtatctcc

SEQ ID NO: 601882 - DNA, 25 bp, Homo sapien
ccacccctaaattcctgatggatga

SEQ ID NO: 601883 - DNA, 25 bp, Homo sapien
aaattcctgatggatgaacctagag

SEQ ID NO: 601884 - DNA, 25 bp, Homo sapien
caggccggactgacgtagcctatgg

SEQ ID NO: 601885 - DNA, 25 bp, Homo sapien
gacgtagcctatgggcccagcaggt

SEQ ID NO: 601886 - DNA, 25 bp, Homo sapien
tgctgaatgattaagtgacttatcc

SEQ ID NO: 601887 - DNA, 25 bp, Homo sapien
gattaagtgacttatccaagaccac

SEQ ID NO: 601888 - DNA, 25 bp, Homo sapien
tgacttatccaagaccacagggctt

SEQ ID NO: 601889 - DNA, 25 bp, Homo sapien
gacttatccaagaccacagggcttg

SEQ ID NO: 601890 - DNA, 25 bp, Homo sapien
acttatccaagaccacagggcttgc

SEQ ID NO: 601891 - DNA, 25 bp, Homo sapien
ttatccaagaccacagggcttgcaa

SEQ ID NO: 601892 - DNA, 25 bp, Homo sapien
atccaagaccacagggcttgcaaat

SEQ ID NO: 601893 - DNA, 25 bp, Homo sapien
tccaagaccacagggcttgcaaatg

SEQ ID NO: 601894 - DNA, 25 bp, Homo sapien
agaccacagggcttgcaaatggcaa

SEQ ID NO: 601895 - DNA, 25 bp, Homo sapien
accacagggcttgcaaatggcaagt

SEQ ID NO: 601896 - DNA, 25 bp, Homo sapien
cttgcaaatggcaagtgggaggatt

SEQ ID NO: 601897 - DNA, 25 bp, Homo sapien
agacaaaccagacacaccagcttct

SEQ ID NO: 601898 - DNA, 25 bp, Homo sapien
accagacacaccagcttctgtcttt

SEQ ID NO: 601899 - DNA, 25 bp, Homo sapien
gtctttccccatttcagtgggtgaa

SEQ ID NO: 601900 - DNA, 25 bp, Homo sapien
atttcagtgggtgaacctggaacca

SEQ ID NO: 601901 - DNA, 25 bp, Homo sapien
agtgggtgaacctggaaccacccag

SEQ ID NO: 601902 - DNA, 25 bp, Homo sapien
gggctagaagttgacagtcattctc

SEQ ID NO: 601903 - DNA, 25 bp, Homo sapien
agccaggcaggtccttagcttccac

SEQ ID NO: 601904 - DNA, 25 bp, Homo sapien
acctcctgaatctctgacctgaatt

SEQ ID NO: 601905 - DNA, 25 bp, Homo sapien
ggaatactacgtcaaaatttatggg

SEQ ID NO: 601906 - DNA, 25 bp, Homo sapien
cagctaaagcaatccttaaaggaaa

SEQ ID NO: 601907 - DNA, 25 bp, Homo sapien
gaaaactagcttgtgcttatatggg

SEQ ID NO: 601908 - DNA, 25 bp, Homo sapien
ttgtttgaaagcttagttcatcttg

SEQ ID NO: 601909 - DNA, 25 bp, Homo sapien
gccatcagctttgtgtgaacaggtc

SEQ ID NO: 601910 - DNA, 25 bp, Homo sapien
gaagtgtttatgcaaattcggaggc

SEQ ID NO: 601911 - DNA, 25 bp, Homo sapien
aaattcggaggcaacttttctagag

SEQ ID NO: 601912 - DNA, 25 bp, Homo sapien
gattgattttaatttctagagggac

SEQ ID NO: 601913 - DNA, 25 bp, Homo sapien
ggactaaaatctttgcccctatgcc

SEQ ID NO: 601914 - DNA, 25 bp, Homo sapien
ctatgcccaaaccaactgctttatt

SEQ ID NO: 601915 - DNA, 25 bp, Homo sapien
tctctacccaaatttgtcatctagc

SEQ ID NO: 601916 - DNA, 25 bp, Homo sapien
gatgatttgacacaagttcttcctt

SEQ ID NO: 601917 - DNA, 25 bp, Homo sapien
atttcatcttttggtcagattccac

SEQ ID NO: 601918 - DNA, 25 bp, Homo sapien
ggtcagattccactttgtttgaaag

SEQ ID NO: 601919 - DNA, 25 bp, Homo sapien
cttttaagtggcattcaagtcttgc

SEQ ID NO: 601920 - DNA, 25 bp, Homo sapien
tttaagtggcattcaagtcttgcta

SEQ ID NO: 601921 - DNA, 25 bp, Homo sapien
gaataatatggcaaagtccaccctc

SEQ ID NO: 601922 - DNA, 25 bp, Homo sapien
aatatggcaaagtccaccctcaggc

SEQ ID NO: 601923 - DNA, 25 bp, Homo sapien
atatggcaaagtccaccctcaggcc

SEQ ID NO: 601924 - DNA, 25 bp, Homo sapien
atggcaaagtccaccctcaggcctt

SEQ ID NO: 601925 - DNA, 25 bp, Homo sapien
caccctcaggccttataatacataa

SEQ ID NO: 601926 - DNA, 25 bp, Homo sapien
cctcaggccttataatacataaaat

SEQ ID NO: 601927 - DNA, 25 bp, Homo sapien
accagttccaaaccttaattgaatg

SEQ ID NO: 601928 - DNA, 25 bp, Homo sapien
gttccaaaccttaattgaatgtaag

SEQ ID NO: 601929 - DNA, 25 bp, Homo sapien
attcatattggacagaaattttata

SEQ ID NO: 601930 - DNA, 25 bp, Homo sapien
aaaactgtagaagataacattggaa

SEQ ID NO: 601931 - DNA, 25 bp, Homo sapien
tggaaaaaatccttctagacattgg

SEQ ID NO: 601932 - DNA, 25 bp, Homo sapien
gaggagagaacacttgcttctcatt

SEQ ID NO: 601933 - DNA, 25 bp, Homo sapien
tgcttctcattttatgaggctaatc

SEQ ID NO: 601934 - DNA, 25 bp, Homo sapien
ctcattttatgaggctaatcttatc

SEQ ID NO: 601935 - DNA, 25 bp, Homo sapien
taccaaaatcaaagacatcacaagg

SEQ ID NO: 601936 - DNA, 25 bp, Homo sapien
gacatcacaaggaaagagggctaca

SEQ ID NO: 601937 - DNA, 25 bp, Homo sapien
atcacaaggaaagagggctacagac

SEQ ID NO: 601938 - DNA, 25 bp, Homo sapien
aggaaagagggctacagaccaaaat

SEQ ID NO: 601939 - DNA, 25 bp, Homo sapien
ggatatagatgcaaaaattctcaat

SEQ ID NO: 601940 - DNA, 25 bp, Homo sapien
ttctcaataaagtattagcaaactg

SEQ ID NO: 601941 - DNA, 25 bp, Homo sapien
cagcagaagttgttgaccttacctt

SEQ ID NO: 601942 - DNA, 25 bp, Homo sapien
agttgttgaccttaccttggatgag

SEQ ID NO: 601943 - DNA, 25 bp, Homo sapien
cttggatgaggatagcaggcgtaaa

SEQ ID NO: 601944 - DNA, 25 bp, Homo sapien
ctactgtaatacaatgtcactgtgt

SEQ ID NO: 601945 - DNA, 25 bp, Homo sapien
gtcactgtgtttcctctgcactgtt

SEQ ID NO: 601946 - DNA, 25 bp, Homo sapien
ttcctcatcctctttgtgacatgga

SEQ ID NO: 601947 - DNA, 25 bp, Homo sapien
atcctctttgtgacatggaagttca

SEQ ID NO: 601948 - DNA, 25 bp, Homo sapien
agttcattgtcatagcttcagcttc

SEQ ID NO: 601949 - DNA, 25 bp, Homo sapien
attgtcatagcttcagcttcagaag

SEQ ID NO: 601950 - DNA, 25 bp, Homo sapien
agctgtttgtggcatttgtaggatt

SEQ ID NO: 601951 - DNA, 25 bp, Homo sapien
aactcatggaaaattccctcctctt

SEQ ID NO: 601952 - DNA, 25 bp, Homo sapien
taaatcttctgatccatgaccagag

SEQ ID NO: 601953 - DNA, 25 bp, Homo sapien
gatccatgaccagagttatcttgcc

SEQ ID NO: 601954 - DNA, 25 bp, Homo sapien
catgaccagagttatcttgccattt

SEQ ID NO: 601955 - DNA, 25 bp, Homo sapien
gaccagagttatcttgccatttatt

SEQ ID NO: 601956 - DNA, 25 bp, Homo sapien
cagagttatcttgccatttatttaa

SEQ ID NO: 601957 - DNA, 25 bp, Homo sapien
tcttgccatttatttaaagcttctt

SEQ ID NO: 601958 - DNA, 25 bp, Homo sapien
aagcttctttaatacagttcaactg

SEQ ID NO: 601959 - DNA, 25 bp, Homo sapien
gttttcagtttataagtcttgtact

SEQ ID NO: 601960 - DNA, 25 bp, Homo sapien
tataagtcttgtacttcttttgtaa

SEQ ID NO: 601961 - DNA, 25 bp, Homo sapien
ttttgttctttttgatgctaatgta

SEQ ID NO: 601962 - DNA, 25 bp, Homo sapien
gttcattgctagtgtatagagatac

SEQ ID NO: 601963 - DNA, 25 bp, Homo sapien
tgaggatgtcaactggcttctccgc

SEQ ID NO: 601964 - DNA, 25 bp, Homo sapien
tcaggttccctgtgagaatgtgatg

SEQ ID NO: 601965 - DNA, 25 bp, Homo sapien
gaatgtgatgatccgttaccctgtg

SEQ ID NO: 601966 - DNA, 25 bp, Homo sapien
accctgtgcccagtgagtgggtgaa

SEQ ID NO: 601967 - DNA, 25 bp, Homo sapien
aagttttggctccactagtgtttct

SEQ ID NO: 601968 - DNA, 25 bp, Homo sapien
gagcctgtcatgagagtaactctgg

SEQ ID NO: 601969 - DNA, 25 bp, Homo sapien
gagtaactctgggaactgccaagta

SEQ ID NO: 601970 - DNA, 25 bp, Homo sapien
tgccaagtacgagcatgccttcaac

SEQ ID NO: 601971 - DNA, 25 bp, Homo sapien
catgccttcaactccattgtgtgga

SEQ ID NO: 601972 - DNA, 25 bp, Homo sapien
tgtggaggataaaccgactgccgga

SEQ ID NO: 601973 - DNA, 25 bp, Homo sapien
cgactgccggacaaaaactcagctt

SEQ ID NO: 601974 - DNA, 25 bp, Homo sapien
gcatcttagtattaggagtgttctt

SEQ ID NO: 601975 - DNA, 25 bp, Homo sapien
gaaccctcatatattgacgatggga

SEQ ID NO: 601976 - DNA, 25 bp, Homo sapien
gatgggaatataaactggctcagcc

SEQ ID NO: 601977 - DNA, 25 bp, Homo sapien
tggctcagccactttagtaaacagt

SEQ ID NO: 601978 - DNA, 25 bp, Homo sapien
ccactttagtaaacagtctggcagt

SEQ ID NO: 601979 - DNA, 25 bp, Homo sapien
ccatttgactcagaaatctcacttc

SEQ ID NO: 601980 - DNA, 25 bp, Homo sapien
aaatctcacttctacatatacaccc

SEQ ID NO: 601981 - DNA, 25 bp, Homo sapien
ctcacttctacatatacacccaaga

SEQ ID NO: 601982 - DNA, 25 bp, Homo sapien
gttcacatgcaaacttgtacacaga

SEQ ID NO: 601983 - DNA, 25 bp, Homo sapien
gtacacagattgttcacagtagtat

SEQ ID NO: 601984 - DNA, 25 bp, Homo sapien
cagtagtattgttcatagtagccaa

SEQ ID NO: 601985 - DNA, 25 bp, Homo sapien
gagctcttctccgtaattcaaagat

SEQ ID NO: 601986 - DNA, 25 bp, Homo sapien
gatcattctccttgatgaagccacc

SEQ ID NO: 601987 - DNA, 25 bp, Homo sapien
ttgatgaagccaccgcctctatgga

SEQ ID NO: 601988 - DNA, 25 bp, Homo sapien
tatggactccaagactgacaccctg

SEQ ID NO: 601989 - DNA, 25 bp, Homo sapien
tgacaccctggttcagaacaccatc

SEQ ID NO: 601990 - DNA, 25 bp, Homo sapien
aagatgccttcaagggctgcactgt

SEQ ID NO: 601991 - DNA, 25 bp, Homo sapien
aacacagttctcaactgcgatcacg

SEQ ID NO: 601992 - DNA, 25 bp, Homo sapien
ctgcgatcacgtcctggttatggaa

SEQ ID NO: 601993 - DNA, 25 bp, Homo sapien
gtttgacaagcctgaagtccttgca

SEQ ID NO: 601994 - DNA, 25 bp, Homo sapien
aagccagattctgcatttgcgatgt

SEQ ID NO: 601995 - DNA, 25 bp, Homo sapien
tcagattgtagaggtcctggcggct

SEQ ID NO: 601996 - DNA, 25 bp, Homo sapien
agtaaatgtgatttaactccaaaat

SEQ ID NO: 601997 - DNA, 25 bp, Homo sapien
atgtgatttaactccaaaatttaat

SEQ ID NO: 601998 - DNA, 25 bp, Homo sapien
aaaatgcatttagttttgatacttg

SEQ ID NO: 601999 - DNA, 25 bp, Homo sapien
aaatgcatttagttttgatacttgt

SEQ ID NO: 602000 - DNA, 25 bp, Homo sapien
aatgcatttagttttgatacttgta

SEQ ID NO: 602001 - DNA, 25 bp, Homo sapien
atgcatttagttttgatacttgtaa

SEQ ID NO: 602002 - DNA, 25 bp, Homo sapien
tgcatttagttttgatacttgtaaa

SEQ ID NO: 602003 - DNA, 25 bp, Homo sapien
gcatttagttttgatacttgtaaaa

SEQ ID NO: 602004 - DNA, 25 bp, Homo sapien
atgaaatctcatagttttgtggctt

SEQ ID NO: 602005 - DNA, 25 bp, Homo sapien
ctcatagttttgtggctttataaga

SEQ ID NO: 602006 - DNA, 25 bp, Homo sapien
tggctttataagaagcagtttaaaa

SEQ ID NO: 602007 - DNA, 25 bp, Homo sapien
tactcaccatgttacaaccagctac

SEQ ID NO: 602008 - DNA, 25 bp, Homo sapien
ttcagtacactgagggccatacagt

SEQ ID NO: 602009 - DNA, 25 bp, Homo sapien
gagggccatacagttttgtagccta

SEQ ID NO: 602010 - DNA, 25 bp, Homo sapien
ttttgtagcctaagtgcaacacgtt

SEQ ID NO: 602011 - DNA, 25 bp, Homo sapien
gcaacacgttataccatttagccag

SEQ ID NO: 602012 - DNA, 25 bp, Homo sapien
cagggtgtgtagaaggctgtacctt

SEQ ID NO: 602013 - DNA, 25 bp, Homo sapien
gctgtaccttcttggtttgtgtgaa

SEQ ID NO: 602014 - DNA, 25 bp, Homo sapien
atttctcagaaggtatccctgccgt

SEQ ID NO: 602015 - DNA, 25 bp, Homo sapien
atccctgccgttaagtgatgcttgg

SEQ ID NO: 602016 - DNA, 25 bp, Homo sapien
atatggtattgtgtgcctgggctct

SEQ ID NO: 602017 - DNA, 25 bp, Homo sapien
gcctgggctcttagacctagcatag

SEQ ID NO: 602018 - DNA, 25 bp, Homo sapien
gcatcagaatcaccttggacacttt

SEQ ID NO: 602019 - DNA, 25 bp, Homo sapien
catcagaatcaccttggacactttt

SEQ ID NO: 602020 - DNA, 25 bp, Homo sapien
atcagaatcaccttggacacttttt

SEQ ID NO: 602021 - DNA, 25 bp, Homo sapien
tcagaatcaccttggacacttttta

SEQ ID NO: 602022 - DNA, 25 bp, Homo sapien
cagaatcaccttggacactttttaa

SEQ ID NO: 602023 - DNA, 25 bp, Homo sapien
ctttttaaaacaatgcccttggctg

SEQ ID NO: 602024 - DNA, 25 bp, Homo sapien
ttttaaaacaatgcccttggctggg

SEQ ID NO: 602025 - DNA, 25 bp, Homo sapien
taaaacaatgcccttggctgggcgc

SEQ ID NO: 602026 - DNA, 25 bp, Homo sapien
ccaggcttggtagtgggctcctgta

SEQ ID NO: 602027 - DNA, 25 bp, Homo sapien
caggcttggtagtgggctcctgtag

SEQ ID NO: 602028 - DNA, 25 bp, Homo sapien
aggcttggtagtgggctcctgtagt

SEQ ID NO: 602029 - DNA, 25 bp, Homo sapien
atagtgagacctgccccctatctct

SEQ ID NO: 602030 - DNA, 25 bp, Homo sapien
tagtgagacctgccccctatctcta

SEQ ID NO: 602031 - DNA, 25 bp, Homo sapien
tgagacctgccccctatctctacaa

SEQ ID NO: 602032 - DNA, 25 bp, Homo sapien
gagacctgccccctatctctacaaa

SEQ ID NO: 602033 - DNA, 25 bp, Homo sapien
agacctgccccctatctctacaaaa

SEQ ID NO: 602034 - DNA, 25 bp, Homo sapien
gacctgccccctatctctacaaaaa

SEQ ID NO: 602035 - DNA, 25 bp, Homo sapien
agctactggtgaggctgaggctgga

SEQ ID NO: 602036 - DNA, 25 bp, Homo sapien
gctactggtgaggctgaggctggag

SEQ ID NO: 602037 - DNA, 25 bp, Homo sapien
ctactggtgaggctgaggctggagg

SEQ ID NO: 602038 - DNA, 25 bp, Homo sapien
gctggaggatcactggagttcgagg

SEQ ID NO: 602039 - DNA, 25 bp, Homo sapien
gaggatcactggagttcgaggctgc

SEQ ID NO: 602040 - DNA, 25 bp, Homo sapien
cattctgggcaaaactcagtgctgt

SEQ ID NO: 602041 - DNA, 25 bp, Homo sapien
aaaactcagtgctgtcacccctggc

SEQ ID NO: 602042 - DNA, 25 bp, Homo sapien
atcacgccttgtagcgcggcagagg

SEQ ID NO: 602043 - DNA, 25 bp, Homo sapien
tagcgcggcagaggcagtctccttg

SEQ ID NO: 602044 - DNA, 25 bp, Homo sapien
tccttggagactgcgctgaccgaga

SEQ ID NO: 602045 - DNA, 25 bp, Homo sapien
actgcgctgaccgagaataaatgat

SEQ ID NO: 602046 - DNA, 25 bp, Homo sapien
aatgatgagcagcagagcctcctgg

SEQ ID NO: 602047 - DNA, 25 bp, Homo sapien
tggcactctgcacaggactgccact

SEQ ID NO: 602048 - DNA, 25 bp, Homo sapien
gcacaggactgccactctggaagaa

SEQ ID NO: 602049 - DNA, 25 bp, Homo sapien
gaccaaaaaactgtttgtgacacca

SEQ ID NO: 602050 - DNA, 25 bp, Homo sapien
acattaaaatgcacattatcccctt

SEQ ID NO: 602051 - DNA, 25 bp, Homo sapien
gttgagagctttaactcacgggata

SEQ ID NO: 602052 - DNA, 25 bp, Homo sapien
ctcacgggatagttctcatcagctt

SEQ ID NO: 602053 - DNA, 25 bp, Homo sapien
gttctcatcagctttggtgttgcca

SEQ ID NO: 602054 - DNA, 25 bp, Homo sapien
tcagctttggtgttgccacaggaat

SEQ ID NO: 602055 - DNA, 25 bp, Homo sapien
gtgttgccacaggaatatgataata

SEQ ID NO: 602056 - DNA, 25 bp, Homo sapien
tgactagtgtttgtcatgtgccagg

SEQ ID NO: 602057 - DNA, 25 bp, Homo sapien
atgtgccaggcgttttcagagtttc

SEQ ID NO: 602058 - DNA, 25 bp, Homo sapien
caggcgttttcagagtttccctgtt

SEQ ID NO: 602059 - DNA, 25 bp, Homo sapien
tggctgtaagccacatttcgaacca

SEQ ID NO: 602060 - DNA, 25 bp, Homo sapien
gtaagccacatttcgaaccagacac

SEQ ID NO: 602061 - DNA, 25 bp, Homo sapien
atttcgaaccagacacagagagatt

SEQ ID NO: 602062 - DNA, 25 bp, Homo sapien
gggcacaggagcctactaaacctac

SEQ ID NO: 602063 - DNA, 25 bp, Homo sapien
ggagcctactaaacctacgtgaccg

SEQ ID NO: 602064 - DNA, 25 bp, Homo sapien
tacgtgaccgccgtggtagctgctc

SEQ ID NO: 602065 - DNA, 25 bp, Homo sapien
tagctgctccacacgcagcaaagga

SEQ ID NO: 602066 - DNA, 25 bp, Homo sapien
gggagaggccaaatcgaatatggaa

SEQ ID NO: 602067 - DNA, 25 bp, Homo sapien
aatggcaaaatatcccgttcacagt

SEQ ID NO: 602068 - DNA, 25 bp, Homo sapien
atcccgttcacagtttcatacgagc

SEQ ID NO: 602069 - DNA, 25 bp, Homo sapien
tacgagcaacacactgaaataggat

SEQ ID NO: 602070 - DNA, 25 bp, Homo sapien
atgagccagtggaagtatccctttc

SEQ ID NO: 602071 - DNA, 25 bp, Homo sapien
agaagcagaaaaccagtctccccta

SEQ ID NO: 602072 - DNA, 25 bp, Homo sapien
accagtctcccctactctgggtggg

SEQ ID NO: 602073 - DNA, 25 bp, Homo sapien
ataccttggaaagccgactggatct

SEQ ID NO: 602074 - DNA, 25 bp, Homo sapien
gactggatctctcagccaagcaaaa

SEQ ID NO: 602075 - DNA, 25 bp, Homo sapien
ccagaaatacgaatggccttgtttg

SEQ ID NO: 602076 - DNA, 25 bp, Homo sapien
gaatggccttgtttggtgctaacac

SEQ ID NO: 602077 - DNA, 25 bp, Homo sapien
ggtgctaacaccaacagaaagttct

SEQ ID NO: 602078 - DNA, 25 bp, Homo sapien
gtgttgaaccactaaaccataaaag

SEQ ID NO: 602079 - DNA, 25 bp, Homo sapien
aactagtagtgtttcctcctctttg

SEQ ID NO: 602080 - DNA, 25 bp, Homo sapien
tttcctcctctttgatgctctgata

SEQ ID NO: 602081 - DNA, 25 bp, Homo sapien
gatgctctgatactgttctgttttt

SEQ ID NO: 602082 - DNA, 25 bp, Homo sapien
tttcttcacgaaataccctttggat

SEQ ID NO: 602083 - DNA, 25 bp, Homo sapien
aataccctttggatagctaaagtgt

SEQ ID NO: 602084 - DNA, 25 bp, Homo sapien
gtatcagttgcccagtttcccagaa

SEQ ID NO: 602085 - DNA, 25 bp, Homo sapien
agtttcccagaacccaaatcatcca

SEQ ID NO: 602086 - DNA, 25 bp, Homo sapien
cagaatcccaggagagccaagagga

SEQ ID NO: 602087 - DNA, 25 bp, Homo sapien
attatgccacgctcaacttcccagg

SEQ ID NO: 602088 - DNA, 25 bp, Homo sapien
ggcacccaggcggattatgcagaag

SEQ ID NO: 602089 - DNA, 25 bp, Homo sapien
ggcggattatgcagaagtcaagttc

SEQ ID NO: 602090 - DNA, 25 bp, Homo sapien
agtcaagttccaatgagggtctctt

SEQ ID NO: 602091 - DNA, 25 bp, Homo sapien
tgagggtctcttaggctttaggact

SEQ ID NO: 602092 - DNA, 25 bp, Homo sapien
tctcttaggctttaggactgggact

SEQ ID NO: 602093 - DNA, 25 bp, Homo sapien
aggctttaggactgggacttcggct

SEQ ID NO: 602094 - DNA, 25 bp, Homo sapien
ctttaggactgggacttcggctagg

SEQ ID NO: 602095 - DNA, 25 bp, Homo sapien
ttaaactctccataagtagaaaggt

SEQ ID NO: 602096 - DNA, 25 bp, Homo sapien
tagaaaggtaaacactaacttctgg

SEQ ID NO: 602097 - DNA, 25 bp, Homo sapien
aagagatttctcaagtttccttctc

SEQ ID NO: 602098 - DNA, 25 bp, Homo sapien
gatttctcaagtttccttctcaagt

SEQ ID NO: 602099 - DNA, 25 bp, Homo sapien
ttctcaagtttccttctcaagtctt

SEQ ID NO: 602100 - DNA, 25 bp, Homo sapien
aagtttccttctcaagtctttgtgg

SEQ ID NO: 602101 - DNA, 25 bp, Homo sapien
gtttccttctcaagtctttgtggag

SEQ ID NO: 602102 - DNA, 25 bp, Homo sapien
caagtctttgtggagagctgagttt

SEQ ID NO: 602103 - DNA, 25 bp, Homo sapien
ctttgtggagagctgagtttttaga

SEQ ID NO: 602104 - DNA, 25 bp, Homo sapien
tgagctgaaatccaccatcaagaga

SEQ ID NO: 602105 - DNA, 25 bp, Homo sapien
gctgaaatccaccatcaagagagaa

SEQ ID NO: 602106 - DNA, 25 bp, Homo sapien
ataaaggggcattctggcccttcaa

SEQ ID NO: 602107 - DNA, 25 bp, Homo sapien
ctggcccttcaaaacaatgatcttc

SEQ ID NO: 602108 - DNA, 25 bp, Homo sapien
ggcccttcaaaacaatgatcttcaa

SEQ ID NO: 602109 - DNA, 25 bp, Homo sapien
ttcaaaacaatgatcttcaacagta

SEQ ID NO: 602110 - DNA, 25 bp, Homo sapien
caatgatcttcaacagtaaatgcaa

SEQ ID NO: 602111 - DNA, 25 bp, Homo sapien
gatcttcaacagtaaatgcaagcac

SEQ ID NO: 602112 - DNA, 25 bp, Homo sapien
cttcaacagtaaatgcaagcacaag

SEQ ID NO: 602113 - DNA, 25 bp, Homo sapien
aaatgcaagcacaagaaggctccag

SEQ ID NO: 602114 - DNA, 25 bp, Homo sapien
tgcaagcacaagaaggctccaggct

SEQ ID NO: 602115 - DNA, 25 bp, Homo sapien
gaaggctccaggcttgggaggccaa

SEQ ID NO: 602116 - DNA, 25 bp, Homo sapien
aattgcttgaagtccagaggtgagg

SEQ ID NO: 602117 - DNA, 25 bp, Homo sapien
gtactccacgtgctgtcctggtcca

SEQ ID NO: 602118 - DNA, 25 bp, Homo sapien
ctgctgacctctagccggacctgag

SEQ ID NO: 602119 - DNA, 25 bp, Homo sapien
tagccggacctgagcttcagaccct

SEQ ID NO: 602120 - DNA, 25 bp, Homo sapien
tgcagactcggcctgttcccagact

SEQ ID NO: 602121 - DNA, 25 bp, Homo sapien
cttctcctcctgtgtttaagtggat

SEQ ID NO: 602122 - DNA, 25 bp, Homo sapien
cctgtgtttaagtggatggcccctc

SEQ ID NO: 602123 - DNA, 25 bp, Homo sapien
aggtcccatgccaagaaccagtgat

SEQ ID NO: 602124 - DNA, 25 bp, Homo sapien
gaaccagtgattctagtggcccacc

SEQ ID NO: 602125 - DNA, 25 bp, Homo sapien
ttatacctgttcagcctcctaaaga

SEQ ID NO: 602126 - DNA, 25 bp, Homo sapien
agagggacaaactctgtctctgcgt

SEQ ID NO: 602127 - DNA, 25 bp, Homo sapien
agggacaaactctgtctctgcgtgc

SEQ ID NO: 602128 - DNA, 25 bp, Homo sapien
tttattatatgagagggtgaaacct

SEQ ID NO: 602129 - DNA, 25 bp, Homo sapien
gaaatcagacccttgtcttacacca

SEQ ID NO: 602130 - DNA, 25 bp, Homo sapien
atcagacccttgtcttacaccataa

SEQ ID NO: 602131 - DNA, 25 bp, Homo sapien
agacccttgtcttacaccataaaca

SEQ ID NO: 602132 - DNA, 25 bp, Homo sapien
tcttattcaatacctaggtaggtag

SEQ ID NO: 602133 - DNA, 25 bp, Homo sapien
gtaggtagatgctagattctggaaa

SEQ ID NO: 602134 - DNA, 25 bp, Homo sapien
ataaaatatgagtctcaagtggtcc

SEQ ID NO: 602135 - DNA, 25 bp, Homo sapien
ctctctcccaatcaaattctgaatc

SEQ ID NO: 602136 - DNA, 25 bp, Homo sapien
tcaaattctgaatctagttggcaag

SEQ ID NO: 602137 - DNA, 25 bp, Homo sapien
tctagttggcaagattctgaaatca

SEQ ID NO: 602138 - DNA, 25 bp, Homo sapien
gaaatcaaggcatataatcagtaat

SEQ ID NO: 602139 - DNA, 25 bp, Homo sapien
ttctgccctgactgggaagggtgcc

SEQ ID NO: 602140 - DNA, 25 bp, Homo sapien
gcctggctccctaaaacaatgtcaa

SEQ ID NO: 602141 - DNA, 25 bp, Homo sapien
aatgtcaaagccagtcctgctgttc

SEQ ID NO: 602142 - DNA, 25 bp, Homo sapien
agtcctgctgttctctgttgccagg

SEQ ID NO: 602143 - DNA, 25 bp, Homo sapien
tgggccaaccacgtttgttatcatg

SEQ ID NO: 602144 - DNA, 25 bp, Homo sapien
acgtttgttatcatggctgctgcct

SEQ ID NO: 602145 - DNA, 25 bp, Homo sapien
tggctgctgccttctggacagctgc

SEQ ID NO: 602146 - DNA, 25 bp, Homo sapien
ccagctctgccttgagaggttgtgg

SEQ ID NO: 602147 - DNA, 25 bp, Homo sapien
ggttgtgggacctctggatccagct

SEQ ID NO: 602148 - DNA, 25 bp, Homo sapien
tctggatccagctgacctgacaggt

SEQ ID NO: 602149 - DNA, 25 bp, Homo sapien
aggtcatctactcagggaggagccc

SEQ ID NO: 602150 - DNA, 25 bp, Homo sapien
gaggttccagtgaacaaagtgtgcc

SEQ ID NO: 602151 - DNA, 25 bp, Homo sapien
aggttccagtgaacaaagtgtgcca

SEQ ID NO: 602152 - DNA, 25 bp, Homo sapien
gtgaacaaagtgtgccacacgccag

SEQ ID NO: 602153 - DNA, 25 bp, Homo sapien
tgaacaaagtgtgccacacgccagc

SEQ ID NO: 602154 - DNA, 25 bp, Homo sapien
acaaagtgtgccacacgccagcctg

SEQ ID NO: 602155 - DNA, 25 bp, Homo sapien
aatacaggctttctaagtgaaaagg

SEQ ID NO: 602156 - DNA, 25 bp, Homo sapien
ggctttctaagtgaaaaggtgttct

SEQ ID NO: 602157 - DNA, 25 bp, Homo sapien
tctaagtgaaaaggtgttctggaat

SEQ ID NO: 602158 - DNA, 25 bp, Homo sapien
gcaaaaccctgtgaatatatctaaa

SEQ ID NO: 602159 - DNA, 25 bp, Homo sapien
caaaaccctgtgaatatatctaaaa

SEQ ID NO: 602160 - DNA, 25 bp, Homo sapien
ttatggtatgtgaataacatttcaa

SEQ ID NO: 602161 - DNA, 25 bp, Homo sapien
ggactctcagcaggtccgatacctg

SEQ ID NO: 602162 - DNA, 25 bp, Homo sapien
ggtccgatacctggaaattagctta

SEQ ID NO: 602163 - DNA, 25 bp, Homo sapien
attagcttagtacacaagactccca

SEQ ID NO: 602164 - DNA, 25 bp, Homo sapien
gtacacaagactcccaattactatt

SEQ ID NO: 602165 - DNA, 25 bp, Homo sapien
acaagactcccaattactattttct

SEQ ID NO: 602166 - DNA, 25 bp, Homo sapien
ttcccagctcttcaggcagtgcaag

SEQ ID NO: 602167 - DNA, 25 bp, Homo sapien
cccagctcttcaggcagtgcaagga

SEQ ID NO: 602168 - DNA, 25 bp, Homo sapien
tatgcccacatgctcaagcccagaa

SEQ ID NO: 602169 - DNA, 25 bp, Homo sapien
gaaggcagaatcaagctttgctttc

SEQ ID NO: 602170 - DNA, 25 bp, Homo sapien
agaatcaagctttgctttctagaag

SEQ ID NO: 602171 - DNA, 25 bp, Homo sapien
gctttgctttctagaagacgctcaa

SEQ ID NO: 602172 - DNA, 25 bp, Homo sapien
tgaagaaccaggcaccgctcatcgt

SEQ ID NO: 602173 - DNA, 25 bp, Homo sapien
aagaaccaggcaccgctcatcgtgc

SEQ ID NO: 602174 - DNA, 25 bp, Homo sapien
ccgctcatcgtgcatctccacaagg

SEQ ID NO: 602175 - DNA, 25 bp, Homo sapien
tgtgtgacttcatgcaagccgctca

SEQ ID NO: 602176 - DNA, 25 bp, Homo sapien
tgtgacttcatgcaagccgctcaac

SEQ ID NO: 602177 - DNA, 25 bp, Homo sapien
tgacttcatgcaagccgctcaacct

SEQ ID NO: 602178 - DNA, 25 bp, Homo sapien
acgtccttgtccacaggggcagagt

SEQ ID NO: 602179 - DNA, 25 bp, Homo sapien
tgaatggaggctgaggtccctctca

SEQ ID NO: 602180 - DNA, 25 bp, Homo sapien
aggtccctctcagcttgggtggtgt

SEQ ID NO: 602181 - DNA, 25 bp, Homo sapien
ccctctcagcttgggtggtgtggca

SEQ ID NO: 602182 - DNA, 25 bp, Homo sapien
ttaacgcctaagcataaagagtcgg

SEQ ID NO: 602183 - DNA, 25 bp, Homo sapien
agtgacgtggtcaacatcctgtccc

SEQ ID NO: 602184 - DNA, 25 bp, Homo sapien
ctggcctcatttcaagcactgaagg

SEQ ID NO: 602185 - DNA, 25 bp, Homo sapien
catttcaagcactgaaggaggcccc

SEQ ID NO: 602186 - DNA, 25 bp, Homo sapien
gaaggaggccccactccctttgaga

SEQ ID NO: 602187 - DNA, 25 bp, Homo sapien
aagctggctcagcaccttgtgtccc

SEQ ID NO: 602188 - DNA, 25 bp, Homo sapien
gaattgccttcatcggctactttgt

SEQ ID NO: 602189 - DNA, 25 bp, Homo sapien
tgccttcatcggctactttgtagaa

SEQ ID NO: 602190 - DNA, 25 bp, Homo sapien
tcggctactttgtagaaaagcctcc

SEQ ID NO: 602191 - DNA, 25 bp, Homo sapien
agcctccaaatgctgcagcgctgga

SEQ ID NO: 602192 - DNA, 25 bp, Homo sapien
aggacctgatccagtgtgccgtggt

SEQ ID NO: 602193 - DNA, 25 bp, Homo sapien
aaactacctgctgatgggccacagt

SEQ ID NO: 602194 - DNA, 25 bp, Homo sapien
tatggactcccgttcatcctcagac

SEQ ID NO: 602195 - DNA, 25 bp, Homo sapien
atcctcagacctacaagctgttggc

SEQ ID NO: 602196 - DNA, 25 bp, Homo sapien
gcaacatttccatgctttgtgtcac

SEQ ID NO: 602197 - DNA, 25 bp, Homo sapien
atttccatgctttgtgtcacagcct

SEQ ID NO: 602198 - DNA, 25 bp, Homo sapien
tggtgagtacccatgtccccaggtg

SEQ ID NO: 602199 - DNA, 25 bp, Homo sapien
tacccatgtccccaggtgaaaaaga

SEQ ID NO: 602200 - DNA, 25 bp, Homo sapien
aaagcagctaactaactctgcccaa

SEQ ID NO: 602201 - DNA, 25 bp, Homo sapien
taactctgcccaatcctaaatctgc

SEQ ID NO: 602202 - DNA, 25 bp, Homo sapien
ctaaatctgcctcaaccctcaagaa

SEQ ID NO: 602203 - DNA, 25 bp, Homo sapien
tttggagtaaatatgacttgccttt

SEQ ID NO: 602204 - DNA, 25 bp, Homo sapien
cttgccttttgttggtttcatgcaa

SEQ ID NO: 602205 - DNA, 25 bp, Homo sapien
ggcaatgccagaaccgacagtgtca

SEQ ID NO: 602206 - DNA, 25 bp, Homo sapien
gacagtgtcaccagtaaatgcttca

SEQ ID NO: 602207 - DNA, 25 bp, Homo sapien
aatgcttcagatatccactggtctt

SEQ ID NO: 602208 - DNA, 25 bp, Homo sapien
agatatccactggtcttcttctagt

SEQ ID NO: 602209 - DNA, 25 bp, Homo sapien
ggtcttcttctagtctaccagatag

SEQ ID NO: 602210 - DNA, 25 bp, Homo sapien
gggcattcatcctgttagttttaat

SEQ ID NO: 602211 - DNA, 25 bp, Homo sapien
gaattgttctcatctgtgtctggtg

SEQ ID NO: 602212 - DNA, 25 bp, Homo sapien
gtatttcaggaagctctcaaaggga

SEQ ID NO: 602213 - DNA, 25 bp, Homo sapien
aagggagactgcgatcactggctca

SEQ ID NO: 602214 - DNA, 25 bp, Homo sapien
actggctcagggaattcttagggca

SEQ ID NO: 602215 - DNA, 25 bp, Homo sapien
aattcttagggcactgggaggcaat

SEQ ID NO: 602216 - DNA, 25 bp, Homo sapien
aggtccgatacctggaaattagctt

SEQ ID NO: 602217 - DNA, 25 bp, Homo sapien
gtccgatacctggaaattagcttag

SEQ ID NO: 602218 - DNA, 25 bp, Homo sapien
cgatacctggaaattagcttagtac

SEQ ID NO: 602219 - DNA, 25 bp, Homo sapien
attagcttagtacacaagactccca

SEQ ID NO: 602220 - DNA, 25 bp, Homo sapien
tagcttagtacacaagactcccaat

SEQ ID NO: 602221 - DNA, 25 bp, Homo sapien
agcttagtacacaagactcccaatt

SEQ ID NO: 602222 - DNA, 25 bp, Homo sapien
gcttagtacacaagactcccaatta

SEQ ID NO: 602223 - DNA, 25 bp, Homo sapien
ttagtacacaagactcccaattact

SEQ ID NO: 602224 - DNA, 25 bp, Homo sapien
gtacacaagactcccaattactatt

SEQ ID NO: 602225 - DNA, 25 bp, Homo sapien
acacaagactcccaattactatttt

SEQ ID NO: 602226 - DNA, 25 bp, Homo sapien
acaagactcccaattactattttct

SEQ ID NO: 602227 - DNA, 25 bp, Homo sapien
tatggactcccgttcatcctcagac

SEQ ID NO: 602228 - DNA, 25 bp, Homo sapien
cgttcatcctcagacctacaagctg

SEQ ID NO: 602229 - DNA, 25 bp, Homo sapien
ggatgagctggagacaaatcagcaa

SEQ ID NO: 602230 - DNA, 25 bp, Homo sapien
gagctggagacaaatcagcaacatt

SEQ ID NO: 602231 - DNA, 25 bp, Homo sapien
ctggagacaaatcagcaacatttcc

SEQ ID NO: 602232 - DNA, 25 bp, Homo sapien
gcaacatttccatgctttgtgtcac

SEQ ID NO: 602233 - DNA, 25 bp, Homo sapien
caacatttccatgctttgtgtcaca

SEQ ID NO: 602234 - DNA, 25 bp, Homo sapien
aacatttccatgctttgtgtcacag

SEQ ID NO: 602235 - DNA, 25 bp, Homo sapien
acatttccatgctttgtgtcacagc

SEQ ID NO: 602236 - DNA, 25 bp, Homo sapien
catttccatgctttgtgtcacagcc

SEQ ID NO: 602237 - DNA, 25 bp, Homo sapien
atttccatgctttgtgtcacagcct

SEQ ID NO: 602238 - DNA, 25 bp, Homo sapien
acatttatgtaaacaatttcagagc

SEQ ID NO: 602239 - DNA, 25 bp, Homo sapien
aatttcagagctgaacatgccattc

SEQ ID NO: 602240 - DNA, 25 bp, Homo sapien
accctgcttctcttacagttttgtg

SEQ ID NO: 602241 - DNA, 25 bp, Homo sapien
cctgcttctcttacagttttgtgta

SEQ ID NO: 602242 - DNA, 25 bp, Homo sapien
tgtgtaacttggtttttgatgccac

SEQ ID NO: 602243 - DNA, 25 bp, Homo sapien
cttcctctcatgcacctccaatatt

SEQ ID NO: 602244 - DNA, 25 bp, Homo sapien
aatttggaaatgtctcttcattctt

SEQ ID NO: 602245 - DNA, 25 bp, Homo sapien
ggaaatgtctcttcattcttacttc

SEQ ID NO: 602246 - DNA, 25 bp, Homo sapien
atgtctcttcattcttacttctatt

SEQ ID NO: 602247 - DNA, 25 bp, Homo sapien
gtctcttcattcttacttctattat

SEQ ID NO: 602248 - DNA, 25 bp, Homo sapien
tctcttcattcttacttctattatt

SEQ ID NO: 602249 - DNA, 25 bp, Homo sapien
cctgaactgggcctaaggagagtgc

SEQ ID NO: 602250 - DNA, 25 bp, Homo sapien
gagagtgcagctcagttcgcacaca

SEQ ID NO: 602251 - DNA, 25 bp, Homo sapien
tgcagctcagttcgcacacaacagc

SEQ ID NO: 602252 - DNA, 25 bp, Homo sapien
tgggcagttccctcaacagagctct

SEQ ID NO: 602253 - DNA, 25 bp, Homo sapien
agctgctggctcaaagctgggacta

SEQ ID NO: 602254 - DNA, 25 bp, Homo sapien
ctggctcaaagctgggactacatga

SEQ ID NO: 602255 - DNA, 25 bp, Homo sapien
caaagctgggactacatgaaagtct

SEQ ID NO: 602256 - DNA, 25 bp, Homo sapien
tggacgcacgtgtgggaggccgttt

SEQ ID NO: 602257 - DNA, 25 bp, Homo sapien
ggaggccgttttgtgcagcgccatt

SEQ ID NO: 602258 - DNA, 25 bp, Homo sapien
gccgttttgtgcagcgccattgtgc

SEQ ID NO: 602259 - DNA, 25 bp, Homo sapien
gtgcagcgccattgtgctccccggg

SEQ ID NO: 602260 - DNA, 25 bp, Homo sapien
cgcgaagtgaagcacacagttttag

SEQ ID NO: 602261 - DNA, 25 bp, Homo sapien
tagatttttgcaggacctggatatg

SEQ ID NO: 602262 - DNA, 25 bp, Homo sapien
aggacctggatatgaactgcacata

SEQ ID NO: 602263 - DNA, 25 bp, Homo sapien
atgaaattcccagtatccaatggca

SEQ ID NO: 602264 - DNA, 25 bp, Homo sapien
ttcccagtatccaatggcaagatga

SEQ ID NO: 602265 - DNA, 25 bp, Homo sapien
gatgaaatggttaaccctgtaagaa

SEQ ID NO: 602266 - DNA, 25 bp, Homo sapien
gaaaacttattctacattctgaaag

SEQ ID NO: 602267 - DNA, 25 bp, Homo sapien
tattctacattctgaaagcacaatt

SEQ ID NO: 602268 - DNA, 25 bp, Homo sapien
tggatgtaaacttttatccccgact

SEQ ID NO: 602269 - DNA, 25 bp, Homo sapien
gcattatgtaatgcttgctttacta

SEQ ID NO: 602270 - DNA, 25 bp, Homo sapien
gtaatgcttgctttactaaaattta

SEQ ID NO: 602271 - DNA, 25 bp, Homo sapien
gaatgtgatgtaacagatcatatca

SEQ ID NO: 602272 - DNA, 25 bp, Homo sapien
tatcacctaatatatatttcaccat

SEQ ID NO: 602273 - DNA, 25 bp, Homo sapien
atttcaccatacatcagtgcacagc

SEQ ID NO: 602274 - DNA, 25 bp, Homo sapien
ttcaccatacatcagtgcacagcac

SEQ ID NO: 602275 - DNA, 25 bp, Homo sapien
agtgcacagcacaaagtacgtttta

SEQ ID NO: 602276 - DNA, 25 bp, Homo sapien
gcacagcacaaagtacgttttacaa

SEQ ID NO: 602277 - DNA, 25 bp, Homo sapien
gtacgttttacaacataatccagca

SEQ ID NO: 602278 - DNA, 25 bp, Homo sapien
gttttacaacataatccagcacaca

SEQ ID NO: 602279 - DNA, 25 bp, Homo sapien
gttcacaaataacatgtactttaac

SEQ ID NO: 602280 - DNA, 25 bp, Homo sapien
atgtactttaactccatgaggccgg

SEQ ID NO: 602281 - DNA, 25 bp, Homo sapien
tgtactttaactccatgaggccggg

SEQ ID NO: 602282 - DNA, 25 bp, Homo sapien
gtacaagctatagccacttttcctc

SEQ ID NO: 602283 - DNA, 25 bp, Homo sapien
agacatgcacttaaggtaggaccca

SEQ ID NO: 602284 - DNA, 25 bp, Homo sapien
ggtaggacccagaaattctgcttct

SEQ ID NO: 602285 - DNA, 25 bp, Homo sapien
gaaattctgcttctaggcagactta

SEQ ID NO: 602286 - DNA, 25 bp, Homo sapien
ggcagacttatgtccaccaaaggct

SEQ ID NO: 602287 - DNA, 25 bp, Homo sapien
gttcatgcagacatcctcataattg

SEQ ID NO: 602288 - DNA, 25 bp, Homo sapien
attgccaaaagccagaaacagccca

SEQ ID NO: 602289 - DNA, 25 bp, Homo sapien
gaaacagcccaatagccatcaatgg

SEQ ID NO: 602290 - DNA, 25 bp, Homo sapien
atcaatttacacaatggcgcatcca

SEQ ID NO: 602291 - DNA, 25 bp, Homo sapien
aagaacaaactacctgtgcacacca

SEQ ID NO: 602292 - DNA, 25 bp, Homo sapien
tgtgcacaccacagcatagatgaat

SEQ ID NO: 602293 - DNA, 25 bp, Homo sapien
gaggttaagtgggttgctcaaggct

SEQ ID NO: 602294 - DNA, 25 bp, Homo sapien
aggttaagtgggttgctcaaggctg

SEQ ID NO: 602295 - DNA, 25 bp, Homo sapien
ggttaagtgggttgctcaaggctgg

SEQ ID NO: 602296 - DNA, 25 bp, Homo sapien
gttaagtgggttgctcaaggctggg

SEQ ID NO: 602297 - DNA, 25 bp, Homo sapien
ttaagtgggttgctcaaggctgggt

SEQ ID NO: 602298 - DNA, 25 bp, Homo sapien
taagtgggttgctcaaggctgggtg

SEQ ID NO: 602299 - DNA, 25 bp, Homo sapien
aagtgggttgctcaaggctgggtgt

SEQ ID NO: 602300 - DNA, 25 bp, Homo sapien
agtgggttgctcaaggctgggtgtg

SEQ ID NO: 602301 - DNA, 25 bp, Homo sapien
gtgggttgctcaaggctgggtgtgg

SEQ ID NO: 602302 - DNA, 25 bp, Homo sapien
tgggttgctcaaggctgggtgtggt

SEQ ID NO: 602303 - DNA, 25 bp, Homo sapien
gggttgctcaaggctgggtgtggtg

SEQ ID NO: 602304 - DNA, 25 bp, Homo sapien
atgcgttttgcattcatgtctttgc

SEQ ID NO: 602305 - DNA, 25 bp, Homo sapien
gtctttgcagtacaaatctgtatct

SEQ ID NO: 602306 - DNA, 25 bp, Homo sapien
ctttcattttgggagtgactgtcat

SEQ ID NO: 602307 - DNA, 25 bp, Homo sapien
acaccagggccagattgcgtgggtt

SEQ ID NO: 602308 - DNA, 25 bp, Homo sapien
tgcgtgggttctagctagggaccta

SEQ ID NO: 602309 - DNA, 25 bp, Homo sapien
ggacctagagctggttacttgattt

SEQ ID NO: 602310 - DNA, 25 bp, Homo sapien
ttacttgatttctctctgttccatt

SEQ ID NO: 602311 - DNA, 25 bp, Homo sapien
tctctctgttccatttactatctgt

SEQ ID NO: 602312 - DNA, 25 bp, Homo sapien
ttatttcatagagttgctgtgagca

SEQ ID NO: 602313 - DNA, 25 bp, Homo sapien
gggcttaaaagtgcttggtacatag

SEQ ID NO: 602314 - DNA, 25 bp, Homo sapien
taagtactaggtgtcagctattgtc

SEQ ID NO: 602315 - DNA, 25 bp, Homo sapien
tagacagagagcatgtgcctggaga

SEQ ID NO: 602316 - DNA, 25 bp, Homo sapien
ggtttcatctcaaggtgaccacaca

SEQ ID NO: 602317 - DNA, 25 bp, Homo sapien
aggtgaccacacaatcattgggaag

SEQ ID NO: 602318 - DNA, 25 bp, Homo sapien
aaaggagggtctgagggcttcatcc

SEQ ID NO: 602319 - DNA, 25 bp, Homo sapien
tgagggcttcatccaggtttacagc

SEQ ID NO: 602320 - DNA, 25 bp, Homo sapien
tcatccaggtttacagcccaagaaa

SEQ ID NO: 602321 - DNA, 25 bp, Homo sapien
agcccaagaaagtcctgcccacaga

SEQ ID NO: 602322 - DNA, 25 bp, Homo sapien
atctgtgctggtcccgtcatgagta

SEQ ID NO: 602323 - DNA, 25 bp, Homo sapien
gctggtcccgtcatgagtaaatctt

SEQ ID NO: 602324 - DNA, 25 bp, Homo sapien
agtaaatcttgcctgcttgagctgg

SEQ ID NO: 602325 - DNA, 25 bp, Homo sapien
tcttgcctgcttgagctggcgagga

SEQ ID NO: 602326 - DNA, 25 bp, Homo sapien
cagacgtggggcactgtcagcatca

SEQ ID NO: 602327 - DNA, 25 bp, Homo sapien
cactgtcagcatcagcctcataaga

SEQ ID NO: 602328 - DNA, 25 bp, Homo sapien
actgtcagcatcagcctcataagaa

SEQ ID NO: 602329 - DNA, 25 bp, Homo sapien
ctgtcagcatcagcctcataagaaa

SEQ ID NO: 602330 - DNA, 25 bp, Homo sapien
tgtcagcatcagcctcataagaaaa

SEQ ID NO: 602331 - DNA, 25 bp, Homo sapien
agcatcagcctcataagaaaaccag

SEQ ID NO: 602332 - DNA, 25 bp, Homo sapien
tcataagaaaaccaggccaagtgtg

SEQ ID NO: 602333 - DNA, 25 bp, Homo sapien
agaccctgcctctttgaaaaataca

SEQ ID NO: 602334 - DNA, 25 bp, Homo sapien
aattagctggatgtgatgcctcatg

SEQ ID NO: 602335 - DNA, 25 bp, Homo sapien
attagctggatgtgatgcctcatgc

SEQ ID NO: 602336 - DNA, 25 bp, Homo sapien
gatgtgatgcctcatgcctatagtc

SEQ ID NO: 602337 - DNA, 25 bp, Homo sapien
gtgatttcgatttacatttgcctaa

SEQ ID NO: 602338 - DNA, 25 bp, Homo sapien
cgatttacatttgcctaatggccaa

SEQ ID NO: 602339 - DNA, 25 bp, Homo sapien
acatttgcctaatggccaatgatgt

SEQ ID NO: 602340 - DNA, 25 bp, Homo sapien
aacattccatgttcttcttaggtca

SEQ ID NO: 602341 - DNA, 25 bp, Homo sapien
attccatgttcttcttaggtcattg

SEQ ID NO: 602342 - DNA, 25 bp, Homo sapien
gttcttcttaggtcattggtatgtc

SEQ ID NO: 602343 - DNA, 25 bp, Homo sapien
cttaggtcattggtatgtcttcttt

SEQ ID NO: 602344 - DNA, 25 bp, Homo sapien
taagtacttcaaaattgagctattt

SEQ ID NO: 602345 - DNA, 25 bp, Homo sapien
tttttcttcttattagtgagttgta

SEQ ID NO: 602346 - DNA, 25 bp, Homo sapien
tgtactagatagaagacctgtgtca

SEQ ID NO: 602347 - DNA, 25 bp, Homo sapien
caaatatttggcttgtcttttactt

SEQ ID NO: 602348 - DNA, 25 bp, Homo sapien
gtcaccgacacagggctgaccagtt

SEQ ID NO: 602349 - DNA, 25 bp, Homo sapien
gctgaccagttctgccgaagtgtac

SEQ ID NO: 602350 - DNA, 25 bp, Homo sapien
tctgccgaagtgtacagcatcacag

SEQ ID NO: 602351 - DNA, 25 bp, Homo sapien
acagacaacaagtgggcacccttcg

SEQ ID NO: 602352 - DNA, 25 bp, Homo sapien
tcgaggccttcccacaggagcgtag

SEQ ID NO: 602353 - DNA, 25 bp, Homo sapien
aggagcgtagctcactcagcctggt

SEQ ID NO: 602354 - DNA, 25 bp, Homo sapien
tggtcagcctggtgggtaccctcta

SEQ ID NO: 602355 - DNA, 25 bp, Homo sapien
tgggtaccctctatgccattggtgg

SEQ ID NO: 602356 - DNA, 25 bp, Homo sapien
ccattggtggctttgccacactgga

SEQ ID NO: 602357 - DNA, 25 bp, Homo sapien
agtctggagagctggttcccacaga

SEQ ID NO: 602358 - DNA, 25 bp, Homo sapien
tggttcccacagagctcaatgacat

SEQ ID NO: 602359 - DNA, 25 bp, Homo sapien
cggagtctagcacggggcccaggct

SEQ ID NO: 602360 - DNA, 25 bp, Homo sapien
agtggcgtgagctcactacaatctc

SEQ ID NO: 602361 - DNA, 25 bp, Homo sapien
tcactacaatctctggcttctggtt

SEQ ID NO: 602362 - DNA, 25 bp, Homo sapien
cactacaatctctggcttctggttc

SEQ ID NO: 602363 - DNA, 25 bp, Homo sapien
tacaatctctggcttctggttcggg

SEQ ID NO: 602364 - DNA, 25 bp, Homo sapien
acaatctctggcttctggttcgggt

SEQ ID NO: 602365 - DNA, 25 bp, Homo sapien
aatctctggcttctggttcgggtga

SEQ ID NO: 602366 - DNA, 25 bp, Homo sapien
atctctggcttctggttcgggtgag

SEQ ID NO: 602367 - DNA, 25 bp, Homo sapien
ctggcttctggttcgggtgagtctc

SEQ ID NO: 602368 - DNA, 25 bp, Homo sapien
tctggttcgggtgagtctcctgcct

SEQ ID NO: 602369 - DNA, 25 bp, Homo sapien
agccgagttcgtggtcactgcactc

SEQ ID NO: 602370 - DNA, 25 bp, Homo sapien
gggccctactgctttttagcagtcc

SEQ ID NO: 602371 - DNA, 25 bp, Homo sapien
tgctttttagcagtcctggccgtgt

SEQ ID NO: 602372 - DNA, 25 bp, Homo sapien
tggatgtcgaaacccaggtacccca

SEQ ID NO: 602373 - DNA, 25 bp, Homo sapien
aggtaccccagtgggtgatcaccat

SEQ ID NO: 602374 - DNA, 25 bp, Homo sapien
gtgatcaccataatcatctggcttt

SEQ ID NO: 602375 - DNA, 25 bp, Homo sapien
tggcttttcttcctgcagtgctgca

SEQ ID NO: 602376 - DNA, 25 bp, Homo sapien
acccctatgtctatggctacatgca

SEQ ID NO: 602377 - DNA, 25 bp, Homo sapien
ggctacatgcacaagaccattaaga

SEQ ID NO: 602378 - DNA, 25 bp, Homo sapien
ccccgaaagaagatagccacccaga

SEQ ID NO: 602379 - DNA, 25 bp, Homo sapien
aaggcaagattgtcccttcctacga

SEQ ID NO: 602380 - DNA, 25 bp, Homo sapien
ctacgattctgctacttttccttga

SEQ ID NO: 602381 - DNA, 25 bp, Homo sapien
aataatcttgtaaagcattccatac

SEQ ID NO: 602382 - DNA, 25 bp, Homo sapien
aaagcattccatacaagttttgagc

SEQ ID NO: 602383 - DNA, 25 bp, Homo sapien
acaagttttgagcatgggaaggaca

SEQ ID NO: 602384 - DNA, 25 bp, Homo sapien
gaaaattaatttccttgctgacaga

SEQ ID NO: 602385 - DNA, 25 bp, Homo sapien
atttccttgctgacagaagatttta

SEQ ID NO: 602386 - DNA, 25 bp, Homo sapien
gagattactgcgaaagtatttgtgt

SEQ ID NO: 602387 - DNA, 25 bp, Homo sapien
aatgattatatcttaaactgggcga

SEQ ID NO: 602388 - DNA, 25 bp, Homo sapien
cttaaactgggcgattgtgggaatg

SEQ ID NO: 602389 - DNA, 25 bp, Homo sapien
gggacagagaaccttaagaactata

SEQ ID NO: 602390 - DNA, 25 bp, Homo sapien
gtttgttcagctattcagctggaat

SEQ ID NO: 602391 - DNA, 25 bp, Homo sapien
attcagctggaatgaccgggagaaa

SEQ ID NO: 602392 - DNA, 25 bp, Homo sapien
gtaacattggtatacatgatgcccc

SEQ ID NO: 602393 - DNA, 25 bp, Homo sapien
acattggtatacatgatgcccctgc

SEQ ID NO: 602394 - DNA, 25 bp, Homo sapien
attggtatacatgatgcccctgcag

SEQ ID NO: 602395 - DNA, 25 bp, Homo sapien
tggtatacatgatgcccctgcagtt

SEQ ID NO: 602396 - DNA, 25 bp, Homo sapien
tacatgatgcccctgcagttccttt

SEQ ID NO: 602397 - DNA, 25 bp, Homo sapien
atgatgcccctgcagttccttttct

SEQ ID NO: 602398 - DNA, 25 bp, Homo sapien
tttctgtttggtagtttgtgactct

SEQ ID NO: 602399 - DNA, 25 bp, Homo sapien
tctgtttggtagtttgtgactctaa

SEQ ID NO: 602400 - DNA, 25 bp, Homo sapien
gtagtttgtgactctaagatttcca

SEQ ID NO: 602401 - DNA, 25 bp, Homo sapien
ctaagatttccactgttatgtgtgt

SEQ ID NO: 602402 - DNA, 25 bp, Homo sapien
agatttccactgttatgtgtgttaa

SEQ ID NO: 602403 - DNA, 25 bp, Homo sapien
gtggatgttatgtggcttcctgttc

SEQ ID NO: 602404 - DNA, 25 bp, Homo sapien
gatgttatgtggcttcctgttcagt

SEQ ID NO: 602405 - DNA, 25 bp, Homo sapien
gttatgtggcttcctgttcagtggt

SEQ ID NO: 602406 - DNA, 25 bp, Homo sapien
atgtggcttcctgttcagtggtgct

SEQ ID NO: 602407 - DNA, 25 bp, Homo sapien
tgctgattctgcttggtgtcaaaca

SEQ ID NO: 602408 - DNA, 25 bp, Homo sapien
ctgattctgcttggtgtcaaacatc

SEQ ID NO: 602409 - DNA, 25 bp, Homo sapien
gattctgcttggtgtcaaacatcag

SEQ ID NO: 602410 - DNA, 25 bp, Homo sapien
ttctgcttggtgtcaaacatcagat

SEQ ID NO: 602411 - DNA, 25 bp, Homo sapien
gcttggtgtcaaacatcagatttca

SEQ ID NO: 602412 - DNA, 25 bp, Homo sapien
ggtgtcaaacatcagatttcatcac

SEQ ID NO: 602413 - DNA, 25 bp, Homo sapien
caaacatcagatttcatcacagtcg

SEQ ID NO: 602414 - DNA, 25 bp, Homo sapien
tgacttcaaacaagtcactccacct

SEQ ID NO: 602415 - DNA, 25 bp, Homo sapien
acattggattctcatgtgtgaaatg

SEQ ID NO: 602416 - DNA, 25 bp, Homo sapien
tgtgtgaaatgggatacttgtaaac

SEQ ID NO: 602417 - DNA, 25 bp, Homo sapien
aaacaagatgcttatagtggaaggc

SEQ ID NO: 602418 - DNA, 25 bp, Homo sapien
gatgcttatagtggaaggcattatt

SEQ ID NO: 602419 - DNA, 25 bp, Homo sapien
ggaaggcattattggtattattaat

SEQ ID NO: 602420 - DNA, 25 bp, Homo sapien
aattattaggacaaagctcttactc

SEQ ID NO: 602421 - DNA, 25 bp, Homo sapien
attaggacaaagctcttactcagga

SEQ ID NO: 602422 - DNA, 25 bp, Homo sapien
aggacaaagctcttactcaggagtt

SEQ ID NO: 602423 - DNA, 25 bp, Homo sapien
gacaaagctcttactcaggagttca

SEQ ID NO: 602424 - DNA, 25 bp, Homo sapien
acaaagctcttactcaggagttcaa

SEQ ID NO: 602425 - DNA, 25 bp, Homo sapien
tctactcctgtagtgactgtcaact

SEQ ID NO: 602426 - DNA, 25 bp, Homo sapien
ctgtagtgactgtcaactttttgga

SEQ ID NO: 602427 - DNA, 25 bp, Homo sapien
ttggatttcagaaagccaaaccagc

SEQ ID NO: 602428 - DNA, 25 bp, Homo sapien
ggtagaggtgtctctcctacacaca

SEQ ID NO: 602429 - DNA, 25 bp, Homo sapien
taccccagggtctgagatgacatcc

SEQ ID NO: 602430 - DNA, 25 bp, Homo sapien
gatgacatcccaaatcaaacccggt

SEQ ID NO: 602431 - DNA, 25 bp, Homo sapien
tcaaacccggtattctgcagagata

SEQ ID NO: 602432 - DNA, 25 bp, Homo sapien
gcagagatacacaaaggttcaaact

SEQ ID NO: 602433 - DNA, 25 bp, Homo sapien
aaactacagacagccttgtatcagc

SEQ ID NO: 602434 - DNA, 25 bp, Homo sapien
cagacagccttgtatcagctgtaaa

SEQ ID NO: 602435 - DNA, 25 bp, Homo sapien
gggccagattttgctgcaaaagaaa

SEQ ID NO: 602436 - DNA, 25 bp, Homo sapien
cggagtctagcacggggcccaggct

SEQ ID NO: 602437 - DNA, 25 bp, Homo sapien
ggagtctagcacggggcccaggcta

SEQ ID NO: 602438 - DNA, 25 bp, Homo sapien
gagtctagcacggggcccaggctag

SEQ ID NO: 602439 - DNA, 25 bp, Homo sapien
agtctagcacggggcccaggctaga

SEQ ID NO: 602440 - DNA, 25 bp, Homo sapien
gtctagcacggggcccaggctagag

SEQ ID NO: 602441 - DNA, 25 bp, Homo sapien
tctagcacggggcccaggctagagt

SEQ ID NO: 602442 - DNA, 25 bp, Homo sapien
tcactacaatctctggcttctggtt

SEQ ID NO: 602443 - DNA, 25 bp, Homo sapien
cactacaatctctggcttctggttc

SEQ ID NO: 602444 - DNA, 25 bp, Homo sapien
tttgtttgggatcactatacttcca

SEQ ID NO: 602445 - DNA, 25 bp, Homo sapien
atacttccaacttactgtatagtta

SEQ ID NO: 602446 - DNA, 25 bp, Homo sapien
gactggagtataaagattctagatc

SEQ ID NO: 602447 - DNA, 25 bp, Homo sapien
tggaagaaaagactaacccgcttag

SEQ ID NO: 602448 - DNA, 25 bp, Homo sapien
taacccgcttagtgaactgcccatt

SEQ ID NO: 602449 - DNA, 25 bp, Homo sapien
gtgaactgcccattgaattagaaag

SEQ ID NO: 602450 - DNA, 25 bp, Homo sapien
gaaagtttggaatgcccataccctg

SEQ ID NO: 602451 - DNA, 25 bp, Homo sapien
ggaatgcccataccctgatttgaaa

SEQ ID NO: 602452 - DNA, 25 bp, Homo sapien
tgcccataccctgatttgaaatctt

SEQ ID NO: 602453 - DNA, 25 bp, Homo sapien
gtgataagataaaactgagtcctgt

SEQ ID NO: 602454 - DNA, 25 bp, Homo sapien
ctgagtcctgtgtagacttttgaca

SEQ ID NO: 602455 - DNA, 25 bp, Homo sapien
ccggcctcacttatcattattaaac

SEQ ID NO: 602456 - DNA, 25 bp, Homo sapien
aactctaacatgtgttgatcactta

SEQ ID NO: 602457 - DNA, 25 bp, Homo sapien
tgatcacttaaaactctcgagttgt

SEQ ID NO: 602458 - DNA, 25 bp, Homo sapien
aactctcgagttgtactgtgtgaca

SEQ ID NO: 602459 - DNA, 25 bp, Homo sapien
ctgtgtgacatgtgatagctacctt

SEQ ID NO: 602460 - DNA, 25 bp, Homo sapien
tgtgatagctaccttatttcattac

SEQ ID NO: 602461 - DNA, 25 bp, Homo sapien
cattacttcatttattccctcgagg

SEQ ID NO: 602462 - DNA, 25 bp, Homo sapien
atttattccctcgaggcttggagac

SEQ ID NO: 602463 - DNA, 25 bp, Homo sapien
attccctcgaggcttggagactgat

SEQ ID NO: 602464 - DNA, 25 bp, Homo sapien
cctcgaggcttggagactgatgtgt

SEQ ID NO: 602465 - DNA, 25 bp, Homo sapien
atgggagctgggtgcgtggctgtcc

SEQ ID NO: 602466 - DNA, 25 bp, Homo sapien
aaccaaacagacctacgagtgccct

SEQ ID NO: 602467 - DNA, 25 bp, Homo sapien
agacctacgagtgccctgtgtatag

SEQ ID NO: 602468 - DNA, 25 bp, Homo sapien
gagtgccctgtgtatagaaccaaac

SEQ ID NO: 602469 - DNA, 25 bp, Homo sapien
gaaccaaactgagaggccccagcta

SEQ ID NO: 602470 - DNA, 25 bp, Homo sapien
gctacatctggaccttcaggctgaa

SEQ ID NO: 602471 - DNA, 25 bp, Homo sapien
aagactgcaaaatgggttctggctg

SEQ ID NO: 602472 - DNA, 25 bp, Homo sapien
gcttctagaagcgtaaggtaacact

SEQ ID NO: 602473 - DNA, 25 bp, Homo sapien
aacactggcattcctctagcctctg

SEQ ID NO: 602474 - DNA, 25 bp, Homo sapien
ttcctctagcctctgctggagtgca

SEQ ID NO: 602475 - DNA, 25 bp, Homo sapien
tggagtgcagtgaggattttctagc

SEQ ID NO: 602476 - DNA, 25 bp, Homo sapien
ggattttctagcatgttgctgcact

SEQ ID NO: 602477 - DNA, 25 bp, Homo sapien
acagctgagcctggaactgaccctt

SEQ ID NO: 602478 - DNA, 25 bp, Homo sapien
gctgtcctccagaaagcaccaagga

SEQ ID NO: 602479 - DNA, 25 bp, Homo sapien
tgacagcaaacagatcactaggcct

SEQ ID NO: 602480 - DNA, 25 bp, Homo sapien
atcactaggcctctgaccacaggtg

SEQ ID NO: 602481 - DNA, 25 bp, Homo sapien
tctgaccacaggtgctgagtactca

SEQ ID NO: 602482 - DNA, 25 bp, Homo sapien
gagtactcagcagccctcatataat

SEQ ID NO: 602483 - DNA, 25 bp, Homo sapien
gatgaaacaaccgtatacctgagaa

SEQ ID NO: 602484 - DNA, 25 bp, Homo sapien
gagaaataacttgctctggtgtcaa

SEQ ID NO: 602485 - DNA, 25 bp, Homo sapien
tctggtgtcaattcgctattcgcca

SEQ ID NO: 602486 - DNA, 25 bp, Homo sapien
gctattcgccagcagacatcagaac

SEQ ID NO: 602487 - DNA, 25 bp, Homo sapien
tcagaacacaccgagtttccagatg

SEQ ID NO: 602488 - DNA, 25 bp, Homo sapien
tgctcagtctcgttagtcctcagag

SEQ ID NO: 602489 - DNA, 25 bp, Homo sapien
gtcctcagaggagggtccagtcttc

SEQ ID NO: 602490 - DNA, 25 bp, Homo sapien
tggaactccacacagcatctcgctt

SEQ ID NO: 602491 - DNA, 25 bp, Homo sapien
cagcatctcgcttggagaaagcact

SEQ ID NO: 602492 - DNA, 25 bp, Homo sapien
agaaagcactggctggttccttgtt

SEQ ID NO: 602493 - DNA, 25 bp, Homo sapien
tcaaatgacacacggcacagtccaa

SEQ ID NO: 602494 - DNA, 25 bp, Homo sapien
tttaattaactcgacacctctactg

SEQ ID NO: 602495 - DNA, 25 bp, Homo sapien
attaactcgacacctctactgagca

SEQ ID NO: 602496 - DNA, 25 bp, Homo sapien
gctacccgctggtcataagcatgca

SEQ ID NO: 602497 - DNA, 25 bp, Homo sapien
ctggtcataagcatgcagcagtaaa

SEQ ID NO: 602498 - DNA, 25 bp, Homo sapien
gcagcagtaaacgaagagaccttcc

SEQ ID NO: 602499 - DNA, 25 bp, Homo sapien
ttctctgggtgaaaacaacatacat

SEQ ID NO: 602500 - DNA, 25 bp, Homo sapien
tctgggtgaaaacaacatacattat

SEQ ID NO: 602501 - DNA, 25 bp, Homo sapien
aaacaacatacattatcatttctaa

SEQ ID NO: 602502 - DNA, 25 bp, Homo sapien
taataactttaatggatgctgctgc

SEQ ID NO: 602503 - DNA, 25 bp, Homo sapien
ataactttaatggatgctgctgctt

SEQ ID NO: 602504 - DNA, 25 bp, Homo sapien
taactttaatggatgctgctgcttt

SEQ ID NO: 602505 - DNA, 25 bp, Homo sapien
ttttggcccccaagatactcagaga

SEQ ID NO: 602506 - DNA, 25 bp, Homo sapien
ttggcccccaagatactcagagata

SEQ ID NO: 602507 - DNA, 25 bp, Homo sapien
ggcccccaagatactcagagataaa

SEQ ID NO: 602508 - DNA, 25 bp, Homo sapien
gatactcagagataaacttgaaact

SEQ ID NO: 602509 - DNA, 25 bp, Homo sapien
aacttgaaactcaactataggtggg

SEQ ID NO: 602510 - DNA, 25 bp, Homo sapien
tgaagaaccaggcaccgctcatcgt

SEQ ID NO: 602511 - DNA, 25 bp, Homo sapien
aagaaccaggcaccgctcatcgtgc

SEQ ID NO: 602512 - DNA, 25 bp, Homo sapien
atctccacaaggcactgtgtgactt

SEQ ID NO: 602513 - DNA, 25 bp, Homo sapien
tgtgtgacttcatgcaagccgctca

SEQ ID NO: 602514 - DNA, 25 bp, Homo sapien
tgacttcatgcaagccgctcaacct

SEQ ID NO: 602515 - DNA, 25 bp, Homo sapien
acgtccttgtccacaggggcagagt

SEQ ID NO: 602516 - DNA, 25 bp, Homo sapien
tgaatggaggctgaggtccctctca

SEQ ID NO: 602517 - DNA, 25 bp, Homo sapien
aggtccctctcagcttgggtggtgt

SEQ ID NO: 602518 - DNA, 25 bp, Homo sapien
ccctctcagcttgggtggtgtggca

SEQ ID NO: 602519 - DNA, 25 bp, Homo sapien
tctgtgcaattgacaaacgtcctgg

SEQ ID NO: 602520 - DNA, 25 bp, Homo sapien
ttaacgcctaagcataaagagtcgg

SEQ ID NO: 602521 - DNA, 25 bp, Homo sapien
aaggtgcagcactgagactcgaatc

SEQ ID NO: 602522 - DNA, 25 bp, Homo sapien
ggtgcagcactgagactcgaatcca

SEQ ID NO: 602523 - DNA, 25 bp, Homo sapien
agcactgagactcgaatccacacag

SEQ ID NO: 602524 - DNA, 25 bp, Homo sapien
tgagactcgaatccacacagcttgg

SEQ ID NO: 602525 - DNA, 25 bp, Homo sapien
actcgaatccacacagcttggctta

SEQ ID NO: 602526 - DNA, 25 bp, Homo sapien
gaatccacacagcttggcttaagtc

SEQ ID NO: 602527 - DNA, 25 bp, Homo sapien
acacagcttggcttaagtctaccat

SEQ ID NO: 602528 - DNA, 25 bp, Homo sapien
agcttggcttaagtctaccattaaa

SEQ ID NO: 602529 - DNA, 25 bp, Homo sapien
ggcttaagtctaccattaaatttgc

SEQ ID NO: 602530 - DNA, 25 bp, Homo sapien
ttaaatttgcctgtcctggccgggt

SEQ ID NO: 602531 - DNA, 25 bp, Homo sapien
aaatttgcctgtcctggccgggtgc

SEQ ID NO: 602532 - DNA, 25 bp, Homo sapien
agtttcagctcacgctctagccctt

SEQ ID NO: 602533 - DNA, 25 bp, Homo sapien
ttgttcccagtcaccaagagtgact

SEQ ID NO: 602534 - DNA, 25 bp, Homo sapien
tcaccaagagtgactacaaatgcgg

SEQ ID NO: 602535 - DNA, 25 bp, Homo sapien
acaggaggacctgaaacttcatgga

SEQ ID NO: 602536 - DNA, 25 bp, Homo sapien
aagccatgctcagaggcagcctagg

SEQ ID NO: 602537 - DNA, 25 bp, Homo sapien
gttctgatgccaggaaatccagcta

SEQ ID NO: 602538 - DNA, 25 bp, Homo sapien
caggaaatccagctactactgtgta

SEQ ID NO: 602539 - DNA, 25 bp, Homo sapien
ctactactgtgtagcctaaagcggg

SEQ ID NO: 602540 - DNA, 25 bp, Homo sapien
agaacttcaatgaactcttttggaa

SEQ ID NO: 602541 - DNA, 25 bp, Homo sapien
gaagcccacttgtcagggctgttgt

SEQ ID NO: 602542 - DNA, 25 bp, Homo sapien
aaatgtgatcatgtatgtacctagt

SEQ ID NO: 602543 - DNA, 25 bp, Homo sapien
taaatataattatcaccagcagaag

SEQ ID NO: 602544 - DNA, 25 bp, Homo sapien
attatcaccagcagaagttctatga

SEQ ID NO: 602545 - DNA, 25 bp, Homo sapien
atcaccagcagaagttctatgagat

SEQ ID NO: 602546 - DNA, 25 bp, Homo sapien
cagcagaagttctatgagatgaagt

SEQ ID NO: 602547 - DNA, 25 bp, Homo sapien
gattctaatgtaacaccctaataag

SEQ ID NO: 602548 - DNA, 25 bp, Homo sapien
taatgtaacaccctaataagctgtg

SEQ ID NO: 602549 - DNA, 25 bp, Homo sapien
ataagctgtgttaactcacctttca

SEQ ID NO: 602550 - DNA, 25 bp, Homo sapien
agctgtgttaactcacctttcagaa

SEQ ID NO: 602551 - DNA, 25 bp, Homo sapien
ctgtgttaactcacctttcagaagg

SEQ ID NO: 602552 - DNA, 25 bp, Homo sapien
tgttaactcacctttcagaaggagg

SEQ ID NO: 602553 - DNA, 25 bp, Homo sapien
ggctggggggacatacatcacaaca

SEQ ID NO: 602554 - DNA, 25 bp, Homo sapien
attggtgcaaaattaaaccctctca

SEQ ID NO: 602555 - DNA, 25 bp, Homo sapien
attaaaccctctcagctgaccgttg

SEQ ID NO: 602556 - DNA, 25 bp, Homo sapien
agctgaccgttgctggataggatca

SEQ ID NO: 602557 - DNA, 25 bp, Homo sapien
gaatgcaggaaaagagcctctatgg

SEQ ID NO: 602558 - DNA, 25 bp, Homo sapien
gcctctatggcaatacgattgtcct

SEQ ID NO: 602559 - DNA, 25 bp, Homo sapien
ggcaatacgattgtccttttttcgt

SEQ ID NO: 602560 - DNA, 25 bp, Homo sapien
ttgtccttttttcgtttcagagtca

SEQ ID NO: 602561 - DNA, 25 bp, Homo sapien
gttaacttgcattacatactgtacc

SEQ ID NO: 602562 - DNA, 25 bp, Homo sapien
ggaagacaaacattggacgccatta

SEQ ID NO: 602563 - DNA, 25 bp, Homo sapien
cattggacgccattatacatgaaaa

SEQ ID NO: 602564 - DNA, 25 bp, Homo sapien
aattaatcatttcattggaagcaag

SEQ ID NO: 602565 - DNA, 25 bp, Homo sapien
aacgcgcagtagtggagacaattct

SEQ ID NO: 602566 - DNA, 25 bp, Homo sapien
agaagagatgctgcccgtgactatg

SEQ ID NO: 602567 - DNA, 25 bp, Homo sapien
agatgctgcccgtgactatgtcaaa

SEQ ID NO: 602568 - DNA, 25 bp, Homo sapien
gcccgtgactatgtcaaagcatgaa

SEQ ID NO: 602569 - DNA, 25 bp, Homo sapien
aactatcttaatttttatcactcaa

SEQ ID NO: 602570 - DNA, 25 bp, Homo sapien
tttttatcactcaacgacagcatta

SEQ ID NO: 602571 - DNA, 25 bp, Homo sapien
gacagcattaattcagaacaggcct

SEQ ID NO: 602572 - DNA, 25 bp, Homo sapien
taattcagaacaggcctatcaggct

SEQ ID NO: 602573 - DNA, 25 bp, Homo sapien
gaacaggcctatcaggctcagaaag

SEQ ID NO: 602574 - DNA, 25 bp, Homo sapien
ataaaatacacgatacctctcccca

SEQ ID NO: 602575 - DNA, 25 bp, Homo sapien
atttgttgaagttagccagctgctt

SEQ ID NO: 602576 - DNA, 25 bp, Homo sapien
cccaagcaggaaccattgttgaagc

SEQ ID NO: 602577 - DNA, 25 bp, Homo sapien
aagcaggaaccattgttgaagcccg

SEQ ID NO: 602578 - DNA, 25 bp, Homo sapien
agcaggaaccattgttgaagcccgt

SEQ ID NO: 602579 - DNA, 25 bp, Homo sapien
gcaggaaccattgttgaagcccgtc

SEQ ID NO: 602580 - DNA, 25 bp, Homo sapien
caggaaccattgttgaagcccgtct

SEQ ID NO: 602581 - DNA, 25 bp, Homo sapien
aggaaccattgttgaagcccgtctc

SEQ ID NO: 602582 - DNA, 25 bp, Homo sapien
ggaaccattgttgaagcccgtctca

SEQ ID NO: 602583 - DNA, 25 bp, Homo sapien
gaaccattgttgaagcccgtctcaa

SEQ ID NO: 602584 - DNA, 25 bp, Homo sapien
aaccattgttgaagcccgtctcaag

SEQ ID NO: 602585 - DNA, 25 bp, Homo sapien
accattgttgaagcccgtctcaagg

SEQ ID NO: 602586 - DNA, 25 bp, Homo sapien
cattgttgaagcccgtctcaaggag

SEQ ID NO: 602587 - DNA, 25 bp, Homo sapien
gatttgctcaaagcaatcccagtga

SEQ ID NO: 602588 - DNA, 25 bp, Homo sapien
aagcaatcccagtgagcatccacgt

SEQ ID NO: 602589 - DNA, 25 bp, Homo sapien
tgagcatccacgtcaatgtcattct

SEQ ID NO: 602590 - DNA, 25 bp, Homo sapien
gtcaatgtcattctcttctctgcca

SEQ ID NO: 602591 - DNA, 25 bp, Homo sapien
ttctctgccatccttattgtgttaa

SEQ ID NO: 602592 - DNA, 25 bp, Homo sapien
tccttattgtgttaaccatggtggg

SEQ ID NO: 602593 - DNA, 25 bp, Homo sapien
gggacagccttcttcatgtacaatg

SEQ ID NO: 602594 - DNA, 25 bp, Homo sapien
agccttcttcatgtacaatgctttt

SEQ ID NO: 602595 - DNA, 25 bp, Homo sapien
ttttgaaactctgcatggtccccta

SEQ ID NO: 602596 - DNA, 25 bp, Homo sapien
catggtcccctagggctgtaccttt

SEQ ID NO: 602597 - DNA, 25 bp, Homo sapien
tcatttcaggctcctgtggctgtct

SEQ ID NO: 602598 - DNA, 25 bp, Homo sapien
tttctcgattggtgacattgggtct

SEQ ID NO: 602599 - DNA, 25 bp, Homo sapien
gtgacattgggtctgtgtgttctct

SEQ ID NO: 602600 - DNA, 25 bp, Homo sapien
gtgtgttctctcctgtatctagaac

SEQ ID NO: 602601 - DNA, 25 bp, Homo sapien
gttctctcctgtatctagaacagtg

SEQ ID NO: 602602 - DNA, 25 bp, Homo sapien
gccctcagtaaggactagttgaatg

SEQ ID NO: 602603 - DNA, 25 bp, Homo sapien
tctcctgaatccctgctggtagcat

SEQ ID NO: 602604 - DNA, 25 bp, Homo sapien
gaatccctgctggtagcatattaaa

SEQ ID NO: 602605 - DNA, 25 bp, Homo sapien
ctcctttccatattgcattttcttt

SEQ ID NO: 602606 - DNA, 25 bp, Homo sapien
gattttatctcttttaaggcttatg

SEQ ID NO: 602607 - DNA, 25 bp, Homo sapien
aaggcttatgtggttgtatcttaaa

SEQ ID NO: 602608 - DNA, 25 bp, Homo sapien
taatttgtatttctcgattggtgac

SEQ ID NO: 602609 - DNA, 25 bp, Homo sapien
agcaggcctgtcagttctctcttac

SEQ ID NO: 602610 - DNA, 25 bp, Homo sapien
ttctgttctcttttacctaagtaga

SEQ ID NO: 602611 - DNA, 25 bp, Homo sapien
agtggcttttctattcttgatctcc

SEQ ID NO: 602612 - DNA, 25 bp, Homo sapien
ttctattcttgatctccaaccatgc

SEQ ID NO: 602613 - DNA, 25 bp, Homo sapien
tgccctaagacatatggtaacacag

SEQ ID NO: 602614 - DNA, 25 bp, Homo sapien
tggtaacacagactgaggattctct

SEQ ID NO: 602615 - DNA, 25 bp, Homo sapien
gaggattctctgacggcagggcttt

SEQ ID NO: 602616 - DNA, 25 bp, Homo sapien
tgacggcagggctttgtctcattcc

SEQ ID NO: 602617 - DNA, 25 bp, Homo sapien
gtctcattcctttttggaacaagca

SEQ ID NO: 602618 - DNA, 25 bp, Homo sapien
catatgtttgtatctgaagtgtcac

SEQ ID NO: 602619 - DNA, 25 bp, Homo sapien
atctgaagtgtcactgatggcattt

SEQ ID NO: 602620 - DNA, 25 bp, Homo sapien
gtctagtcagcagagtcccaaagaa

SEQ ID NO: 602621 - DNA, 25 bp, Homo sapien
gcagagtcccaaagaagcttgtcat

SEQ ID NO: 602622 - DNA, 25 bp, Homo sapien
gagtcccaaagaagcttgtcattct

SEQ ID NO: 602623 - DNA, 25 bp, Homo sapien
aagaagcttgtcattctctaggcat

SEQ ID NO: 602624 - DNA, 25 bp, Homo sapien
aagcttgtcattctctaggcatttg

SEQ ID NO: 602625 - DNA, 25 bp, Homo sapien
gcttgtcattctctaggcatttgtg

SEQ ID NO: 602626 - DNA, 25 bp, Homo sapien
ttacattctgatgggcctaatagca

SEQ ID NO: 602627 - DNA, 25 bp, Homo sapien
gagatttctactggtcatgacctcc

SEQ ID NO: 602628 - DNA, 25 bp, Homo sapien
gatttctactggtcatgacctccat

SEQ ID NO: 602629 - DNA, 25 bp, Homo sapien
ttctactggtcatgacctccatctt

SEQ ID NO: 602630 - DNA, 25 bp, Homo sapien
tactggtcatgacctccatcttctc

SEQ ID NO: 602631 - DNA, 25 bp, Homo sapien
ggaggtagcagtgagtcaagatcgt

SEQ ID NO: 602632 - DNA, 25 bp, Homo sapien
gcagatcacatgaggttagaagttt

SEQ ID NO: 602633 - DNA, 25 bp, Homo sapien
cagatcacatgaggttagaagtttg

SEQ ID NO: 602634 - DNA, 25 bp, Homo sapien
agatcacatgaggttagaagtttga

SEQ ID NO: 602635 - DNA, 25 bp, Homo sapien
gatcacatgaggttagaagtttgag

SEQ ID NO: 602636 - DNA, 25 bp, Homo sapien
tcacatgaggttagaagtttgagac

SEQ ID NO: 602637 - DNA, 25 bp, Homo sapien
cacatgaggttagaagtttgagacc

SEQ ID NO: 602638 - DNA, 25 bp, Homo sapien
agccagacacggtggcacacgcctg

SEQ ID NO: 602639 - DNA, 25 bp, Homo sapien
cagacacggtggcacacgcctgtag

SEQ ID NO: 602640 - DNA, 25 bp, Homo sapien
agacacggtggcacacgcctgtagt

SEQ ID NO: 602641 - DNA, 25 bp, Homo sapien
gacacggtggcacacgcctgtagtc

SEQ ID NO: 602642 - DNA, 25 bp, Homo sapien
ttgtgatcagtccagccctgggcaa

SEQ ID NO: 602643 - DNA, 25 bp, Homo sapien
agccctgggcaagtactatgtattt

SEQ ID NO: 602644 - DNA, 25 bp, Homo sapien
tatttgattcatactatagcctggt

SEQ ID NO: 602645 - DNA, 25 bp, Homo sapien
tactatagcctggtatggatttgag

SEQ ID NO: 602646 - DNA, 25 bp, Homo sapien
ttcactggttaagacacaaggtttc

SEQ ID NO: 602647 - DNA, 25 bp, Homo sapien
gagtgtaagttttcctagattcatc

SEQ ID NO: 602648 - DNA, 25 bp, Homo sapien
gttttcctagattcatcattcaaga

SEQ ID NO: 602649 - DNA, 25 bp, Homo sapien
aagagactaacttttgcaagacagt

SEQ ID NO: 602650 - DNA, 25 bp, Homo sapien
gacagtaccttagttggtgttcgat

SEQ ID NO: 602651 - DNA, 25 bp, Homo sapien
ggtgttcgataccagcaaagcagtg

SEQ ID NO: 602652 - DNA, 25 bp, Homo sapien
ggtatccactgtttcttctgattga

SEQ ID NO: 602653 - DNA, 25 bp, Homo sapien
gtgatagcaggcgcctgtggttcca

SEQ ID NO: 602654 - DNA, 25 bp, Homo sapien
tgatagcaggcgcctgtggttccag

SEQ ID NO: 602655 - DNA, 25 bp, Homo sapien
gatagcaggcgcctgtggttccagc

SEQ ID NO: 602656 - DNA, 25 bp, Homo sapien
atagcaggcgcctgtggttccagct

SEQ ID NO: 602657 - DNA, 25 bp, Homo sapien
ctgtggttccagctatgggaggctg

SEQ ID NO: 602658 - DNA, 25 bp, Homo sapien
gcaggagaatcagatgagcctggga

SEQ ID NO: 602659 - DNA, 25 bp, Homo sapien
agaatcagatgagcctgggagacgg

SEQ ID NO: 602660 - DNA, 25 bp, Homo sapien
gaatcagatgagcctgggagacgga

SEQ ID NO: 602661 - DNA, 25 bp, Homo sapien
aatcagatgagcctgggagacggag

SEQ ID NO: 602662 - DNA, 25 bp, Homo sapien
atcagatgagcctgggagacggagg

SEQ ID NO: 602663 - DNA, 25 bp, Homo sapien
acggaggttgcagtgggctgggatc

SEQ ID NO: 602664 - DNA, 25 bp, Homo sapien
tgagccgtcacagcgggcgatgtct

SEQ ID NO: 602665 - DNA, 25 bp, Homo sapien
cacagcgggcgatgtctgagaccaa

SEQ ID NO: 602666 - DNA, 25 bp, Homo sapien
ctgagaccaagacacaactattaag

SEQ ID NO: 602667 - DNA, 25 bp, Homo sapien
acaactattaagacgatgaaggcat

SEQ ID NO: 602668 - DNA, 25 bp, Homo sapien
atgaaggcatcgacagtattaatgt

SEQ ID NO: 602669 - DNA, 25 bp, Homo sapien
gtgatctgaaataaactcccgtaac

SEQ ID NO: 602670 - DNA, 25 bp, Homo sapien
ttccattaacttgatcccattatga

SEQ ID NO: 602671 - DNA, 25 bp, Homo sapien
acttgatcccattatgaacagccac

SEQ ID NO: 602672 - DNA, 25 bp, Homo sapien
acagccacattacacaatcaacttc

SEQ ID NO: 602673 - DNA, 25 bp, Homo sapien
ttcaaccccaatagaagagagctga

SEQ ID NO: 602674 - DNA, 25 bp, Homo sapien
gaagagagctgatcatattctgtgt

SEQ ID NO: 602675 - DNA, 25 bp, Homo sapien
tcctggcaggtaaggctgcttcctg

SEQ ID NO: 602676 - DNA, 25 bp, Homo sapien
agatggcagccgcaccacccagctg

SEQ ID NO: 602677 - DNA, 25 bp, Homo sapien
gcaccacccagctgatctccagcag

SEQ ID NO: 602678 - DNA, 25 bp, Homo sapien
gaagaatctgcatggcacgctgttg

SEQ ID NO: 602679 - DNA, 25 bp, Homo sapien
aagaatctgcatggcacgctgttgt

SEQ ID NO: 602680 - DNA, 25 bp, Homo sapien
gaatctgcatggcacgctgttgtct

SEQ ID NO: 602681 - DNA, 25 bp, Homo sapien
tctcctggaattctttaccattcag

SEQ ID NO: 602682 - DNA, 25 bp, Homo sapien
tcctggaattctttaccattcagaa

SEQ ID NO: 602683 - DNA, 25 bp, Homo sapien
ctggaattctttaccattcagaaac

SEQ ID NO: 602684 - DNA, 25 bp, Homo sapien
gaattctttaccattcagaaaccag

SEQ ID NO: 602685 - DNA, 25 bp, Homo sapien
tctttaccattcagaaaccagcctc

SEQ ID NO: 602686 - DNA, 25 bp, Homo sapien
agattatggcctattgaacaaaatg

SEQ ID NO: 602687 - DNA, 25 bp, Homo sapien
gaaactgggagtccacaaagacata

SEQ ID NO: 602688 - DNA, 25 bp, Homo sapien
gaaagatgaagtacctcctgacaga

SEQ ID NO: 602689 - DNA, 25 bp, Homo sapien
gaagtacctcctgacagagcaagaa

SEQ ID NO: 602690 - DNA, 25 bp, Homo sapien
cagagcaagaatggcactgaacaat

SEQ ID NO: 602691 - DNA, 25 bp, Homo sapien
gaacaatgttatatggacaatggct

SEQ ID NO: 602692 - DNA, 25 bp, Homo sapien
gacaatggctattttattcaagact

SEQ ID NO: 602693 - DNA, 25 bp, Homo sapien
gagactaggactcagtctgaactga

SEQ ID NO: 602694 - DNA, 25 bp, Homo sapien
gatcacacaccgtatgtgtttgcta

SEQ ID NO: 602695 - DNA, 25 bp, Homo sapien
tgtttgctaactggctttacccaaa

SEQ ID NO: 602696 - DNA, 25 bp, Homo sapien
tgctaactggctttacccaaaagaa

SEQ ID NO: 602697 - DNA, 25 bp, Homo sapien
ttttccttttacttctcagttgact

SEQ ID NO: 602698 - DNA, 25 bp, Homo sapien
tttccttttacttctcagttgactg

SEQ ID NO: 602699 - DNA, 25 bp, Homo sapien
actcttgggttaaggaagaatgtag

SEQ ID NO: 602700 - DNA, 25 bp, Homo sapien
gaagaatgtagtttcgttttatgtt

SEQ ID NO: 602701 - DNA, 25 bp, Homo sapien
gtttcgttttatgtttaatatcgct

SEQ ID NO: 602702 - DNA, 25 bp, Homo sapien
ttcgttttatgtttaatatcgctca

SEQ ID NO: 602703 - DNA, 25 bp, Homo sapien
tcgttttatgtttaatatcgctcaa

SEQ ID NO: 602704 - DNA, 25 bp, Homo sapien
cgttttatgtttaatatcgctcaaa

SEQ ID NO: 602705 - DNA, 25 bp, Homo sapien
gttttatgtttaatatcgctcaaag

SEQ ID NO: 602706 - DNA, 25 bp, Homo sapien
ttatgtttaatatcgctcaaagaaa

SEQ ID NO: 602707 - DNA, 25 bp, Homo sapien
gtttaatatcgctcaaagaaaaata

SEQ ID NO: 602708 - DNA, 25 bp, Homo sapien
ttatggtaaagaggatgtcgcatct

SEQ ID NO: 602709 - DNA, 25 bp, Homo sapien
ggatgtcgcatctttagaatttcaa

SEQ ID NO: 602710 - DNA, 25 bp, Homo sapien
ttcaatagcttgcagttgttggaca

SEQ ID NO: 602711 - DNA, 25 bp, Homo sapien
gtggtgggttatatataactgccaa

SEQ ID NO: 602712 - DNA, 25 bp, Homo sapien
taactgccaagtatagaacctttac

SEQ ID NO: 602713 - DNA, 25 bp, Homo sapien
gtatagaacctttactgagaatatt

SEQ ID NO: 602714 - DNA, 25 bp, Homo sapien
taaagtgaagtggtacttgcctcac

SEQ ID NO: 602715 - DNA, 25 bp, Homo sapien
gtggtacttgcctcactttaactta

SEQ ID NO: 602716 - DNA, 25 bp, Homo sapien
tacttgcctcactttaacttaccaa

SEQ ID NO: 602717 - DNA, 25 bp, Homo sapien
tgcctcactttaacttaccaaatat

SEQ ID NO: 602718 - DNA, 25 bp, Homo sapien
aacttaccatatttataaactgagg

SEQ ID NO: 602719 - DNA, 25 bp, Homo sapien
aagagtgacctatttagtatagcct

SEQ ID NO: 602720 - DNA, 25 bp, Homo sapien
gagtgacctatttagtatagccttc

SEQ ID NO: 602721 - DNA, 25 bp, Homo sapien
gtgacctatttagtatagccttcca

SEQ ID NO: 602722 - DNA, 25 bp, Homo sapien
gacctatttagtatagccttccagc

SEQ ID NO: 602723 - DNA, 25 bp, Homo sapien
ctatttagtatagccttccagcttt

SEQ ID NO: 602724 - DNA, 25 bp, Homo sapien
tttagtatagccttccagctttttt

SEQ ID NO: 602725 - DNA, 25 bp, Homo sapien
tagtatagccttccagctttttttt

SEQ ID NO: 602726 - DNA, 25 bp, Homo sapien
taggtgggacacgtgcgtttgcctc

SEQ ID NO: 602727 - DNA, 25 bp, Homo sapien
ggtgggacacgtgcgtttgcctcca

SEQ ID NO: 602728 - DNA, 25 bp, Homo sapien
tgggacacgtgcgtttgcctccatg

SEQ ID NO: 602729 - DNA, 25 bp, Homo sapien
gacacgtgcgtttgcctccatgcct

SEQ ID NO: 602730 - DNA, 25 bp, Homo sapien
caaagccagacttttctaataacca

SEQ ID NO: 602731 - DNA, 25 bp, Homo sapien
catactctacaattcgcccatttaa

SEQ ID NO: 602732 - DNA, 25 bp, Homo sapien
gcccatttaaaacgtacgattcaat

SEQ ID NO: 602733 - DNA, 25 bp, Homo sapien
gattcaatgggtttagtaagtcctc

SEQ ID NO: 602734 - DNA, 25 bp, Homo sapien
gtaagtcctcagatatgtgcaacca

SEQ ID NO: 602735 - DNA, 25 bp, Homo sapien
agatatgtgcaaccatcgccacagt

SEQ ID NO: 602736 - DNA, 25 bp, Homo sapien
gcaaccatcgccacagtcaatttta

SEQ ID NO: 602737 - DNA, 25 bp, Homo sapien
gaacattttcctcacgctcaaaaga

SEQ ID NO: 602738 - DNA, 25 bp, Homo sapien
ttcctcacgctcaaaagaaaccctg

SEQ ID NO: 602739 - DNA, 25 bp, Homo sapien
gtagactttagttatcaccctccat

SEQ ID NO: 602740 - DNA, 25 bp, Homo sapien
actttagttatcaccctccatcact

SEQ ID NO: 602741 - DNA, 25 bp, Homo sapien
cttttcaagggcaaagatttgacct

SEQ ID NO: 602742 - DNA, 25 bp, Homo sapien
gggcaaagatttgacctttacatat

SEQ ID NO: 602743 - DNA, 25 bp, Homo sapien
catcttgatattctttaacacaata

SEQ ID NO: 602744 - DNA, 25 bp, Homo sapien
ttaacacaatattggacatacacag

SEQ ID NO: 602745 - DNA, 25 bp, Homo sapien
tacacagtaggtgctacctaatttt

SEQ ID NO: 602746 - DNA, 25 bp, Homo sapien
gtaggtgctacctaatttttcttga

SEQ ID NO: 602747 - DNA, 25 bp, Homo sapien
gaactctttattagaattctccaat

SEQ ID NO: 602748 - DNA, 25 bp, Homo sapien
atatatcttagatctgttttgatta

SEQ ID NO: 602749 - DNA, 25 bp, Homo sapien
atacattttcatatcaggaagtatg

SEQ ID NO: 602750 - DNA, 25 bp, Homo sapien
aagtatgagactttcaactttcttc

SEQ ID NO: 602751 - DNA, 25 bp, Homo sapien
ccctaaatttgttttgattattcag

SEQ ID NO: 602752 - DNA, 25 bp, Homo sapien
ggctagttcatcaaccattagttta

SEQ ID NO: 602753 - DNA, 25 bp, Homo sapien
ataaaatcagagtggccaagagaga

SEQ ID NO: 602754 - DNA, 25 bp, Homo sapien
agaggaaagcagctaaaaccctggg

SEQ ID NO: 602755 - DNA, 25 bp, Homo sapien
gggtcacggtactagcatttgttat

SEQ ID NO: 602756 - DNA, 25 bp, Homo sapien
atttgttatttcatggttaccgtat

SEQ ID NO: 602757 - DNA, 25 bp, Homo sapien
catggttaccgtatacagttgatat

SEQ ID NO: 602758 - DNA, 25 bp, Homo sapien
aattgatgcctttatgggcttcctg

SEQ ID NO: 602759 - DNA, 25 bp, Homo sapien
tgacccctgcctatatctatgaaat

SEQ ID NO: 602760 - DNA, 25 bp, Homo sapien
gaaatttgctgttggagtgcttatt

SEQ ID NO: 602761 - DNA, 25 bp, Homo sapien
gccatgaatcctttgatttatgctc

SEQ ID NO: 602762 - DNA, 25 bp, Homo sapien
tttatccttggtttaggaaagccat

SEQ ID NO: 602763 - DNA, 25 bp, Homo sapien
tggagaacctctgacctgcccaggt

SEQ ID NO: 602764 - DNA, 25 bp, Homo sapien
tgcccaggtcattgtgcaccagggt

SEQ ID NO: 602765 - DNA, 25 bp, Homo sapien
cattgtgcaccagggttttgcctaa

SEQ ID NO: 602766 - DNA, 25 bp, Homo sapien
caccagggttttgcctaaacatgcc

SEQ ID NO: 602767 - DNA, 25 bp, Homo sapien
gcccatggtgaaaaatttcatccct

SEQ ID NO: 602768 - DNA, 25 bp, Homo sapien
gaaaaatttcatcccttaacacatg

SEQ ID NO: 602769 - DNA, 25 bp, Homo sapien
acacatgcagtgtacagtggctcag

SEQ ID NO: 602770 - DNA, 25 bp, Homo sapien
cagactaagggcctgcaggcacatt

SEQ ID NO: 602771 - DNA, 25 bp, Homo sapien
ggcctgcaggcacattggaaagaca

SEQ ID NO: 602772 - DNA, 25 bp, Homo sapien
gcctggtattcaatttgtgagatgg

SEQ ID NO: 602773 - DNA, 25 bp, Homo sapien
tcaatttgtgagatggaaacctgtg

SEQ ID NO: 602774 - DNA, 25 bp, Homo sapien
gtaaggtacagttaccgattaatct

SEQ ID NO: 602775 - DNA, 25 bp, Homo sapien
ggtacagttaccgattaatctagag

SEQ ID NO: 602776 - DNA, 25 bp, Homo sapien
gtacagttaccgattaatctagaga

SEQ ID NO: 602777 - DNA, 25 bp, Homo sapien
acagttaccgattaatctagagata

SEQ ID NO: 602778 - DNA, 25 bp, Homo sapien
agttaccgattaatctagagataaa

SEQ ID NO: 602779 - DNA, 25 bp, Homo sapien
tatttcattaaacacctatgctgtc

SEQ ID NO: 602780 - DNA, 25 bp, Homo sapien
atttcattaaacacctatgctgtct

SEQ ID NO: 602781 - DNA, 25 bp, Homo sapien
tttcattaaacacctatgctgtctc

SEQ ID NO: 602782 - DNA, 25 bp, Homo sapien
ttcattaaacacctatgctgtctct

SEQ ID NO: 602783 - DNA, 25 bp, Homo sapien
tcattaaacacctatgctgtctcta

SEQ ID NO: 602784 - DNA, 25 bp, Homo sapien
cattaaacacctatgctgtctctat

SEQ ID NO: 602785 - DNA, 25 bp, Homo sapien
tctcctgcctcaggttcattagaaa

SEQ ID NO: 602786 - DNA, 25 bp, Homo sapien
ctcctgcctcaggttcattagaaaa

SEQ ID NO: 602787 - DNA, 25 bp, Homo sapien
tcctgcctcaggttcattagaaaag

SEQ ID NO: 602788 - DNA, 25 bp, Homo sapien
cctgcctcaggttcattagaaaaga

SEQ ID NO: 602789 - DNA, 25 bp, Homo sapien
tgcctcaggttcattagaaaagact

SEQ ID NO: 602790 - DNA, 25 bp, Homo sapien
caggttcattagaaaagactgagtt

SEQ ID NO: 602791 - DNA, 25 bp, Homo sapien
aggttcattagaaaagactgagttt

SEQ ID NO: 602792 - DNA, 25 bp, Homo sapien
ggttcattagaaaagactgagtttg

SEQ ID NO: 602793 - DNA, 25 bp, Homo sapien
ttcattagaaaagactgagtttggg

SEQ ID NO: 602794 - DNA, 25 bp, Homo sapien
aaagactgagtttggggccgggcag

SEQ ID NO: 602795 - DNA, 25 bp, Homo sapien
agccgagttcgtggtcactgcactc

SEQ ID NO: 602796 - DNA, 25 bp, Homo sapien
ctgtggcactttctgacatcatggg

SEQ ID NO: 602797 - DNA, 25 bp, Homo sapien
tgtggcactttctgacatcatgggg

SEQ ID NO: 602798 - DNA, 25 bp, Homo sapien
gtggcactttctgacatcatggggg

SEQ ID NO: 602799 - DNA, 25 bp, Homo sapien
tggcactttctgacatcatgggggc

SEQ ID NO: 602800 - DNA, 25 bp, Homo sapien
ggcactttctgacatcatgggggca

SEQ ID NO: 602801 - DNA, 25 bp, Homo sapien
gcactttctgacatcatgggggcag

SEQ ID NO: 602802 - DNA, 25 bp, Homo sapien
cactttctgacatcatgggggcagg

SEQ ID NO: 602803 - DNA, 25 bp, Homo sapien
actttctgacatcatgggggcaggg

SEQ ID NO: 602804 - DNA, 25 bp, Homo sapien
aatttcagagctgaacatgccattc

SEQ ID NO: 602805 - DNA, 25 bp, Homo sapien
accctgcttctcttacagttttgtg

SEQ ID NO: 602806 - DNA, 25 bp, Homo sapien
cctgcttctcttacagttttgtgta

SEQ ID NO: 602807 - DNA, 25 bp, Homo sapien
tgtgtaacttggtttttgatgccac

SEQ ID NO: 602808 - DNA, 25 bp, Homo sapien
acttggtttttgatgccaccatcac

SEQ ID NO: 602809 - DNA, 25 bp, Homo sapien
accatcaccagttgttcaatccagg

SEQ ID NO: 602810 - DNA, 25 bp, Homo sapien
ggaacttgaaactcatcttggcccc

SEQ ID NO: 602811 - DNA, 25 bp, Homo sapien
atgcacctccaatattcaagccatg

SEQ ID NO: 602812 - DNA, 25 bp, Homo sapien
ggaaatgtctcttcattcttacttc

SEQ ID NO: 602813 - DNA, 25 bp, Homo sapien
gtctcttcattcttacttctattat

SEQ ID NO: 602814 - DNA, 25 bp, Homo sapien
taaagaactcttattccttaagtgc

SEQ ID NO: 602815 - DNA, 25 bp, Homo sapien
ggtgctaggctatgatgaaaccatc

SEQ ID NO: 602816 - DNA, 25 bp, Homo sapien
ccatcaaggctgaattggtcctcat

SEQ ID NO: 602817 - DNA, 25 bp, Homo sapien
ggctgaattggtcctcattgatgaa

SEQ ID NO: 602818 - DNA, 25 bp, Homo sapien
gaattggtcctcattgatgaagatg

SEQ ID NO: 602819 - DNA, 25 bp, Homo sapien
aagacagtgacggacgtgtccacta

SEQ ID NO: 602820 - DNA, 25 bp, Homo sapien
acggacgtgtccactattgacggga

SEQ ID NO: 602821 - DNA, 25 bp, Homo sapien
tgtccactattgacgggaacgcggc

SEQ ID NO: 602822 - DNA, 25 bp, Homo sapien
ctattgacgggaacgcggctgagct

SEQ ID NO: 602823 - DNA, 25 bp, Homo sapien
aacgcggctgagcttgtgtccggga

SEQ ID NO: 602824 - DNA, 25 bp, Homo sapien
gaagagagcctagctacagagccag

SEQ ID NO: 602825 - DNA, 25 bp, Homo sapien
gagagcctagctacagagccagccc

SEQ ID NO: 602826 - DNA, 25 bp, Homo sapien
caggttcattagaaaagactgagtt

SEQ ID NO: 602827 - DNA, 25 bp, Homo sapien
aggttcattagaaaagactgagttt

SEQ ID NO: 602828 - DNA, 25 bp, Homo sapien
ggttcattagaaaagactgagtttg

SEQ ID NO: 602829 - DNA, 25 bp, Homo sapien
gttcattagaaaagactgagtttgg

SEQ ID NO: 602830 - DNA, 25 bp, Homo sapien
ttcattagaaaagactgagtttggg

SEQ ID NO: 602831 - DNA, 25 bp, Homo sapien
ttagaaaagactgagtttggggccg

SEQ ID NO: 602832 - DNA, 25 bp, Homo sapien
tagaaaagactgagtttggggccgg

SEQ ID NO: 602833 - DNA, 25 bp, Homo sapien
aaagactgagtttggggccgggcag

SEQ ID NO: 602834 - DNA, 25 bp, Homo sapien
aagactgagtttggggccgggcagg

SEQ ID NO: 602835 - DNA, 25 bp, Homo sapien
agactgagtttggggccgggcaggg

SEQ ID NO: 602836 - DNA, 25 bp, Homo sapien
ctccatcagtagcagaagaggatct

SEQ ID NO: 602837 - DNA, 25 bp, Homo sapien
aagaggatctacgaacactgttcgc

SEQ ID NO: 602838 - DNA, 25 bp, Homo sapien
acgaacactgttcgctaacactggg

SEQ ID NO: 602839 - DNA, 25 bp, Homo sapien
aatggctcttcttcagatggcaaca

SEQ ID NO: 602840 - DNA, 25 bp, Homo sapien
ctcttcttcagatggcaacagtgga

SEQ ID NO: 602841 - DNA, 25 bp, Homo sapien
gatggcaacagtggaagaagctatt

SEQ ID NO: 602842 - DNA, 25 bp, Homo sapien
agaagctattcaggccttgattgat

SEQ ID NO: 602843 - DNA, 25 bp, Homo sapien
attcaggccttgattgatcttcata

SEQ ID NO: 602844 - DNA, 25 bp, Homo sapien
ggccttgattgatcttcataattat

SEQ ID NO: 602845 - DNA, 25 bp, Homo sapien
cattgttcaatgtcatcacctattt

SEQ ID NO: 602846 - DNA, 25 bp, Homo sapien
tcatcacctatttgactgttcagaa

SEQ ID NO: 602847 - DNA, 25 bp, Homo sapien
atgcttaaattgtcaaactgtcatt

SEQ ID NO: 602848 - DNA, 25 bp, Homo sapien
taaattgtcaaactgtcattacttc

SEQ ID NO: 602849 - DNA, 25 bp, Homo sapien
attatagttgaaggcattctccaga

SEQ ID NO: 602850 - DNA, 25 bp, Homo sapien
agagggagccctccaaacttcagat

SEQ ID NO: 602851 - DNA, 25 bp, Homo sapien
agggagccctccaaacttcagatcc

SEQ ID NO: 602852 - DNA, 25 bp, Homo sapien
ttcagatcctgtgggtttagtatca

SEQ ID NO: 602853 - DNA, 25 bp, Homo sapien
gatcctgtgggtttagtatcattat

SEQ ID NO: 602854 - DNA, 25 bp, Homo sapien
gtatcattatcttcagctctttgat

SEQ ID NO: 602855 - DNA, 25 bp, Homo sapien
agctctttgataccctgtgttagag

SEQ ID NO: 602856 - DNA, 25 bp, Homo sapien
gataccctgtgttagagtaatagct

SEQ ID NO: 602857 - DNA, 25 bp, Homo sapien
aaggaagttcatgtcaataaattca

SEQ ID NO: 602858 - DNA, 25 bp, Homo sapien
gggctgttctgacccgctagggtgg

SEQ ID NO: 602859 - DNA, 25 bp, Homo sapien
tgttctgacccgctagggtggagga

SEQ ID NO: 602860 - DNA, 25 bp, Homo sapien
gttctgacccgctagggtggaggag

SEQ ID NO: 602861 - DNA, 25 bp, Homo sapien
tctgacccgctagggtggaggagag

SEQ ID NO: 602862 - DNA, 25 bp, Homo sapien
gtggggtttgttgatgaacctccac

SEQ ID NO: 602863 - DNA, 25 bp, Homo sapien
tggggtttgttgatgaacctccacc

SEQ ID NO: 602864 - DNA, 25 bp, Homo sapien
gtttgttgatgaacctccaccccca

SEQ ID NO: 602865 - DNA, 25 bp, Homo sapien
gagaccctgactctacgaaaattaa

SEQ ID NO: 602866 - DNA, 25 bp, Homo sapien
tgactctacgaaaattaaaagttag

SEQ ID NO: 602867 - DNA, 25 bp, Homo sapien
ggcgcgcacctgtggcttagctacc

SEQ ID NO: 602868 - DNA, 25 bp, Homo sapien
gcgcacctgtggcttagctaccctg

SEQ ID NO: 602869 - DNA, 25 bp, Homo sapien
tttattatcattcttcccactttca

SEQ ID NO: 602870 - DNA, 25 bp, Homo sapien
tttcaaaagagggaatggttggccg

SEQ ID NO: 602871 - DNA, 25 bp, Homo sapien
cgcggtcttgtatgtgcttggtagt

SEQ ID NO: 602872 - DNA, 25 bp, Homo sapien
gtatgtgcttggtagttgaatatta

SEQ ID NO: 602873 - DNA, 25 bp, Homo sapien
aaagcaagggtttttcaccatgatc

SEQ ID NO: 602874 - DNA, 25 bp, Homo sapien
gggtttttcaccatgatcttcctaa

SEQ ID NO: 602875 - DNA, 25 bp, Homo sapien
gtttttcaccatgatcttcctaaag

SEQ ID NO: 602876 - DNA, 25 bp, Homo sapien
gatcttcctaaagactcttacctaa

SEQ ID NO: 602877 - DNA, 25 bp, Homo sapien
gactcttacctaatttctactgcgt

SEQ ID NO: 602878 - DNA, 25 bp, Homo sapien
ttacctaatttctactgcgtccttt

SEQ ID NO: 602879 - DNA, 25 bp, Homo sapien
tactgcgtcctttccctgttggttt

SEQ ID NO: 602880 - DNA, 25 bp, Homo sapien
acagtgatgatgtcaaaaatattat

SEQ ID NO: 602881 - DNA, 25 bp, Homo sapien
cagtgatgatgtcaaaaatattata

SEQ ID NO: 602882 - DNA, 25 bp, Homo sapien
agtgatgatgtcaaaaatattatac

SEQ ID NO: 602883 - DNA, 25 bp, Homo sapien
gtgatgatgtcaaaaatattataca

SEQ ID NO: 602884 - DNA, 25 bp, Homo sapien
tatacataaaagagttggccaggca

SEQ ID NO: 602885 - DNA, 25 bp, Homo sapien
atacataaaagagttggccaggcat

SEQ ID NO: 602886 - DNA, 25 bp, Homo sapien
tacataaaagagttggccaggcatg

SEQ ID NO: 602887 - DNA, 25 bp, Homo sapien
acataaaagagttggccaggcatgg

SEQ ID NO: 602888 - DNA, 25 bp, Homo sapien
gctgagatgaagaattgcttaaacc

SEQ ID NO: 602889 - DNA, 25 bp, Homo sapien
ctgagatgaagaattgcttaaaccc

SEQ ID NO: 602890 - DNA, 25 bp, Homo sapien
cactgcactccagcactccgctctc

SEQ ID NO: 602891 - DNA, 25 bp, Homo sapien
cctataaagactccagactcggtag

SEQ ID NO: 602892 - DNA, 25 bp, Homo sapien
aagactccagactcggtagagggaa

SEQ ID NO: 602893 - DNA, 25 bp, Homo sapien
cagcttgactggacagaggtgactt

SEQ ID NO: 602894 - DNA, 25 bp, Homo sapien
ctttggaggagagacaacttgactt

SEQ ID NO: 602895 - DNA, 25 bp, Homo sapien
gagacaacttgactttggagagact

SEQ ID NO: 602896 - DNA, 25 bp, Homo sapien
gactttggagagactgcttgacttc

SEQ ID NO: 602897 - DNA, 25 bp, Homo sapien
acttcagggaagagctgacctgaga

SEQ ID NO: 602898 - DNA, 25 bp, Homo sapien
tgacctgagacagctgaactttggg

SEQ ID NO: 602899 - DNA, 25 bp, Homo sapien
ggaagattacctgcctgtcctgtcc

SEQ ID NO: 602900 - DNA, 25 bp, Homo sapien
tccactagagccatttccattgcta

SEQ ID NO: 602901 - DNA, 25 bp, Homo sapien
tagagccatttccattgctaaataa

SEQ ID NO: 602902 - DNA, 25 bp, Homo sapien
taggacacgctgagagactagttgt

SEQ ID NO: 602903 - DNA, 25 bp, Homo sapien
agttgtgatttgctattttgcctag

SEQ ID NO: 602904 - DNA, 25 bp, Homo sapien
tattttgcctagagctttgtccttc

SEQ ID NO: 602905 - DNA, 25 bp, Homo sapien
agctttgtccttctagatctgattg

SEQ ID NO: 602906 - DNA, 25 bp, Homo sapien
tctgattggctgtaagtatctctac

SEQ ID NO: 602907 - DNA, 25 bp, Homo sapien
gtatctctactgtgtacctgtggca

SEQ ID NO: 602908 - DNA, 25 bp, Homo sapien
ggcattccttcacagtgggttacaa

SEQ ID NO: 602909 - DNA, 25 bp, Homo sapien
gtgggttacaagcttcttttggatt

SEQ ID NO: 602910 - DNA, 25 bp, Homo sapien
tgatatgcttgccattttctcactg

SEQ ID NO: 602911 - DNA, 25 bp, Homo sapien
attttctcactggatgccctgggta

SEQ ID NO: 602912 - DNA, 25 bp, Homo sapien
gggctgccgaatgcttaggacacgc

SEQ ID NO: 602913 - DNA, 25 bp, Homo sapien
acccacaacggctctgtggacacag

SEQ ID NO: 602914 - DNA, 25 bp, Homo sapien
cacagagaatgattcctgcctgcag

SEQ ID NO: 602915 - DNA, 25 bp, Homo sapien
ttcgtcaccgtgaacgcccagtggg

SEQ ID NO: 602916 - DNA, 25 bp, Homo sapien
agcaagtgcctgacctacagcaagg

SEQ ID NO: 602917 - DNA, 25 bp, Homo sapien
tgacctacagcaaggcggtggccga

SEQ ID NO: 602918 - DNA, 25 bp, Homo sapien
acagcaaggcggtggccgacccgtt

SEQ ID NO: 602919 - DNA, 25 bp, Homo sapien
ttccgccaagtcctggccggcatgg

SEQ ID NO: 602920 - DNA, 25 bp, Homo sapien
tgcaccggctgctgaagagaacccc

SEQ ID NO: 602921 - DNA, 25 bp, Homo sapien
acccatgacagctctctggatgtgg

SEQ ID NO: 602922 - DNA, 25 bp, Homo sapien
acagctctctggatgtggccggcat

SEQ ID NO: 602923 - DNA, 25 bp, Homo sapien
atgtggccggcatggtgcaccagct

SEQ ID NO: 602924 - DNA, 25 bp, Homo sapien
tagatgcagacgtctgtcctacaca

SEQ ID NO: 602925 - DNA, 25 bp, Homo sapien
gacgtctgtcctacacaggtttaca

SEQ ID NO: 602926 - DNA, 25 bp, Homo sapien
ggagggtcttatataaccactgaga

SEQ ID NO: 602927 - DNA, 25 bp, Homo sapien
tgagaccgacagcaagaaccgcctt

SEQ ID NO: 602928 - DNA, 25 bp, Homo sapien
aggtaaacggcaagacccatgccct

SEQ ID NO: 602929 - DNA, 25 bp, Homo sapien
atgccctcagggatctaatggtaaa

SEQ ID NO: 602930 - DNA, 25 bp, Homo sapien
aaaactgccataaccaagggcacag

SEQ ID NO: 602931 - DNA, 25 bp, Homo sapien
agggcacagctaagcctggcacaga

SEQ ID NO: 602932 - DNA, 25 bp, Homo sapien
acagagagccaggaagacttcagta

SEQ ID NO: 602933 - DNA, 25 bp, Homo sapien
tttgaaataggcgatggcacccatg

SEQ ID NO: 602934 - DNA, 25 bp, Homo sapien
gatggcacccatgcatgtggcaggt

SEQ ID NO: 602935 - DNA, 25 bp, Homo sapien
gaatcatcttattaacttccacaag

SEQ ID NO: 602936 - DNA, 25 bp, Homo sapien
ttaacttccacaagcaaataaatgt

SEQ ID NO: 602937 - DNA, 25 bp, Homo sapien
atgtttagtctcttgttgacattgt

SEQ ID NO: 602938 - DNA, 25 bp, Homo sapien
gttgacattgtaataagcctccaga

SEQ ID NO: 602939 - DNA, 25 bp, Homo sapien
tgtaataagcctccagatcaatgtg

SEQ ID NO: 602940 - DNA, 25 bp, Homo sapien
gatcataatatgaatttcccactta

SEQ ID NO: 602941 - DNA, 25 bp, Homo sapien
tcccacttattaatagccttttaat

SEQ ID NO: 602942 - DNA, 25 bp, Homo sapien
aagtttcacttccagtatggtacaa

SEQ ID NO: 602943 - DNA, 25 bp, Homo sapien
ttccagtatggtacaaatattgttc

SEQ ID NO: 602944 - DNA, 25 bp, Homo sapien
ataatatcttagctattcttgacta

SEQ ID NO: 602945 - DNA, 25 bp, Homo sapien
tagctattcttgactaatgtgttat

SEQ ID NO: 602946 - DNA, 25 bp, Homo sapien
aattcagggcaagctaccaacccag

SEQ ID NO: 602947 - DNA, 25 bp, Homo sapien
gactgaaggaaagaggcagacacca

SEQ ID NO: 602948 - DNA, 25 bp, Homo sapien
tcctctgcaaagttctctggagaat

SEQ ID NO: 602949 - DNA, 25 bp, Homo sapien
gaatgtgtgatgttaacactcccag

SEQ ID NO: 602950 - DNA, 25 bp, Homo sapien
aacactcccagctaagggaaagcaa

SEQ ID NO: 602951 - DNA, 25 bp, Homo sapien
ggaatgcttccaatgtctccaagta

SEQ ID NO: 602952 - DNA, 25 bp, Homo sapien
ttccaatgtctccaagtattcctgt

SEQ ID NO: 602953 - DNA, 25 bp, Homo sapien
tgtctccaagtattcctgtggtcaa

SEQ ID NO: 602954 - DNA, 25 bp, Homo sapien
gtggtcaacagtttcgcagatccgt

SEQ ID NO: 602955 - DNA, 25 bp, Homo sapien
aacagtttcgcagatccgttaggcc

SEQ ID NO: 602956 - DNA, 25 bp, Homo sapien
gcagatccgttaggcccttaaagac

SEQ ID NO: 602957 - DNA, 25 bp, Homo sapien
gtggagtatgatcagcttgtcgaaa

SEQ ID NO: 602958 - DNA, 25 bp, Homo sapien
gaatcaatgacactctgtcttcgtg

SEQ ID NO: 602959 - DNA, 25 bp, Homo sapien
actctgtcttcgtggagagcagcct

SEQ ID NO: 602960 - DNA, 25 bp, Homo sapien
attgaagaacagaagtcattcgtga

SEQ ID NO: 602961 - DNA, 25 bp, Homo sapien
gtcattcgtgaaggacacagcacac

SEQ ID NO: 602962 - DNA, 25 bp, Homo sapien
acagcccagagagctcgcaggttaa

SEQ ID NO: 602963 - DNA, 25 bp, Homo sapien
gagctcgcaggttaaaactgcacat

SEQ ID NO: 602964 - DNA, 25 bp, Homo sapien
actgcacatggagcaatgtctgcca

SEQ ID NO: 602965 - DNA, 25 bp, Homo sapien
atgtctgccagccattcagggtact

SEQ ID NO: 602966 - DNA, 25 bp, Homo sapien
ataggtcagaatacgtttccagaaa

SEQ ID NO: 602967 - DNA, 25 bp, Homo sapien
ccagaaagtgacaccttctttttgg

SEQ ID NO: 602968 - DNA, 25 bp, Homo sapien
aggagctctccagtcgtggggtctt

SEQ ID NO: 602969 - DNA, 25 bp, Homo sapien
gggtctttggcttggttgtcccctg

SEQ ID NO: 602970 - DNA, 25 bp, Homo sapien
ttggcttggttgtcccctgctggtt

SEQ ID NO: 602971 - DNA, 25 bp, Homo sapien
cctgctggttctaatggccaagctc

SEQ ID NO: 602972 - DNA, 25 bp, Homo sapien
tgctggttctaatggccaagctcct

SEQ ID NO: 602973 - DNA, 25 bp, Homo sapien
ggttctaatggccaagctcctgtgg

SEQ ID NO: 602974 - DNA, 25 bp, Homo sapien
taatggccaagctcctgtggtgagt

SEQ ID NO: 602975 - DNA, 25 bp, Homo sapien
catcgtcctgtgttgccccaagcag

SEQ ID NO: 602976 - DNA, 25 bp, Homo sapien
tgtgtagagacaggatgctccagat

SEQ ID NO: 602977 - DNA, 25 bp, Homo sapien
aggatgctccagatggtgggacacc

SEQ ID NO: 602978 - DNA, 25 bp, Homo sapien
ccctggggccttgatggtgaaaatg

SEQ ID NO: 602979 - DNA, 25 bp, Homo sapien
tgcttctaccactgctcgtaaagac

SEQ ID NO: 602980 - DNA, 25 bp, Homo sapien
tgctcgtaaagacattccagtttta

SEQ ID NO: 602981 - DNA, 25 bp, Homo sapien
tcccgaatggtagagtgtgtccctg

SEQ ID NO: 602982 - DNA, 25 bp, Homo sapien
tgtgtccctgagatggaatcagctt

SEQ ID NO: 602983 - DNA, 25 bp, Homo sapien
ggaatcagcttgagtcttctgcaat

SEQ ID NO: 602984 - DNA, 25 bp, Homo sapien
gagtcttctgcaattggtcacaact

SEQ ID NO: 602985 - DNA, 25 bp, Homo sapien
ggtcacaactattcatgcttcctgt

SEQ ID NO: 602986 - DNA, 25 bp, Homo sapien
tattcatgcttcctgtgatttcatc

SEQ ID NO: 602987 - DNA, 25 bp, Homo sapien
ttcatccaactacttaccttgccta

SEQ ID NO: 602988 - DNA, 25 bp, Homo sapien
aactacttaccttgcctacgatatc

SEQ ID NO: 602989 - DNA, 25 bp, Homo sapien
gatatcccctttatctctaatcagt

SEQ ID NO: 602990 - DNA, 25 bp, Homo sapien
atgtgatcccaatgttggaagtggg

SEQ ID NO: 602991 - DNA, 25 bp, Homo sapien
gcctggtgggaagtaattgggtcgt

SEQ ID NO: 602992 - DNA, 25 bp, Homo sapien
cagatcccttatgaatggttcagca

SEQ ID NO: 602993 - DNA, 25 bp, Homo sapien
gcttagttcacacaagatctggtta

SEQ ID NO: 602994 - DNA, 25 bp, Homo sapien
atctggttatttaagagtctaagac

SEQ ID NO: 602995 - DNA, 25 bp, Homo sapien
tggttatttaagagtctaagacctc

SEQ ID NO: 602996 - DNA, 25 bp, Homo sapien
ttaagagtctaagacctccccttct

SEQ ID NO: 602997 - DNA, 25 bp, Homo sapien
tggctccccatcaccttatgtcatg

SEQ ID NO: 602998 - DNA, 25 bp, Homo sapien
gctccccatcaccttatgtcatgat

SEQ ID NO: 602999 - DNA, 25 bp, Homo sapien
tccccatcaccttatgtcatgatct

SEQ ID NO: 603000 - DNA, 25 bp, Homo sapien
ccatcaccttatgtcatgatcttaa

SEQ ID NO: 603001 - DNA, 25 bp, Homo sapien
ttcctatctcccttccatgtttttt

SEQ ID NO: 603002 - DNA, 25 bp, Homo sapien
ttccaccagaaagtaaactccacgt

SEQ ID NO: 603003 - DNA, 25 bp, Homo sapien
ggacactgattttaacccaataagt

SEQ ID NO: 603004 - DNA, 25 bp, Homo sapien
aataagtcccttttctgactgctga

SEQ ID NO: 603005 - DNA, 25 bp, Homo sapien
tgactgctgacctccaaaactgtaa

SEQ ID NO: 603006 - DNA, 25 bp, Homo sapien
gagataatttagttatggcagcaat

SEQ ID NO: 603007 - DNA, 25 bp, Homo sapien
tttagttatggcagcaataggaaac

SEQ ID NO: 603008 - DNA, 25 bp, Homo sapien
taggaaactagcacaccttcctagc

SEQ ID NO: 603009 - DNA, 25 bp, Homo sapien
ccttcctagccatcctatctaaaat

SEQ ID NO: 603010 - DNA, 25 bp, Homo sapien
atcctatctaaaatggcaacccatg

SEQ ID NO: 603011 - DNA, 25 bp, Homo sapien
aaaatggcaacccatgtccttcctg

SEQ ID NO: 603012 - DNA, 25 bp, Homo sapien
ctatactctcacaaccaactttttt

SEQ ID NO: 603013 - DNA, 25 bp, Homo sapien
aagttgaaacagctgctgcacaaac

SEQ ID NO: 603014 - DNA, 25 bp, Homo sapien
gctgctgcacaaacatcagaggaaa

SEQ ID NO: 603015 - DNA, 25 bp, Homo sapien
aagtttatctacatccattgtgtgg

SEQ ID NO: 603016 - DNA, 25 bp, Homo sapien
cattgtgtggatagaggactcctct

SEQ ID NO: 603017 - DNA, 25 bp, Homo sapien
tagaggactcctcttccctgaaact

SEQ ID NO: 603018 - DNA, 25 bp, Homo sapien
gaaaccagtttcctagcaatcattt

SEQ ID NO: 603019 - DNA, 25 bp, Homo sapien
gcaatcattttggatcactggactt

SEQ ID NO: 603020 - DNA, 25 bp, Homo sapien
ctggactttcagtggactacctaaa

SEQ ID NO: 603021 - DNA, 25 bp, Homo sapien
gaagatgacatctgcaatgcttttc

SEQ ID NO: 603022 - DNA, 25 bp, Homo sapien
aatgcttttcatctttaccaacggc

SEQ ID NO: 603023 - DNA, 25 bp, Homo sapien
gaaggccaaggcgggagtatcgttt

SEQ ID NO: 603024 - DNA, 25 bp, Homo sapien
gagtatcgtttgagctcaggtttga

SEQ ID NO: 603025 - DNA, 25 bp, Homo sapien
agtatcgtttgagctcaggtttgag

SEQ ID NO: 603026 - DNA, 25 bp, Homo sapien
tcgtttgagctcaggtttgagacca

SEQ ID NO: 603027 - DNA, 25 bp, Homo sapien
tatcaaaaatacataaaattggccg

SEQ ID NO: 603028 - DNA, 25 bp, Homo sapien
gatcgcttgaacctgacaagttgag

SEQ ID NO: 603029 - DNA, 25 bp, Homo sapien
atcgcttgaacctgacaagttgagg

SEQ ID NO: 603030 - DNA, 25 bp, Homo sapien
cgcttgaacctgacaagttgaggtt

SEQ ID NO: 603031 - DNA, 25 bp, Homo sapien
cttgaacctgacaagttgaggttgc

SEQ ID NO: 603032 - DNA, 25 bp, Homo sapien
tgaacctgacaagttgaggttgcag

SEQ ID NO: 603033 - DNA, 25 bp, Homo sapien
aacctgacaagttgaggttgcagtg

SEQ ID NO: 603034 - DNA, 25 bp, Homo sapien
gttgttcttagaaccctgacagggc

SEQ ID NO: 603035 - DNA, 25 bp, Homo sapien
tagaaccctgacagggcaacttcag

SEQ ID NO: 603036 - DNA, 25 bp, Homo sapien
gtaaaaatgattctgctaccatctt

SEQ ID NO: 603037 - DNA, 25 bp, Homo sapien
gattctgctaccatctttctcttat

SEQ ID NO: 603038 - DNA, 25 bp, Homo sapien
atttagttctcctcttctatcttac

SEQ ID NO: 603039 - DNA, 25 bp, Homo sapien
tatcttaccctcatgctattgcttt

SEQ ID NO: 603040 - DNA, 25 bp, Homo sapien
atgctattgctttccctcaggctgg

SEQ ID NO: 603041 - DNA, 25 bp, Homo sapien
caggctggttcatccttgaatgtat

SEQ ID NO: 603042 - DNA, 25 bp, Homo sapien
ttcagctttgtagttcatactctat

SEQ ID NO: 603043 - DNA, 25 bp, Homo sapien
gtagttcatactctatcctggataa

SEQ ID NO: 603044 - DNA, 25 bp, Homo sapien
aaagcagatcagttacttataaagt

SEQ ID NO: 603045 - DNA, 25 bp, Homo sapien
gacgcgattagtggttaagacttcc

SEQ ID NO: 603046 - DNA, 25 bp, Homo sapien
ggttaagacttccaagccagaagac

SEQ ID NO: 603047 - DNA, 25 bp, Homo sapien
agacttccaagccagaagacagagg

SEQ ID NO: 603048 - DNA, 25 bp, Homo sapien
agaagacagagggttcgaatcccag

SEQ ID NO: 603049 - DNA, 25 bp, Homo sapien
ggttcgaatcccagcactgccgtct

SEQ ID NO: 603050 - DNA, 25 bp, Homo sapien
agcactgccgtctactcactgtagt

SEQ ID NO: 603051 - DNA, 25 bp, Homo sapien
actgccgtctactcactgtagtagt

SEQ ID NO: 603052 - DNA, 25 bp, Homo sapien
tgccgtctactcactgtagtagtag

SEQ ID NO: 603053 - DNA, 25 bp, Homo sapien
gtagtagcagctacagaaaggtagt

SEQ ID NO: 603054 - DNA, 25 bp, Homo sapien
tagtagtgagacgtgaagccagctg

SEQ ID NO: 603055 - DNA, 25 bp, Homo sapien
ataaaagctggcgagcgcggcaccc

SEQ ID NO: 603056 - DNA, 25 bp, Homo sapien
aaagaatgagtctggcccctttttg

SEQ ID NO: 603057 - DNA, 25 bp, Homo sapien
aagaatgagtctggcccctttttgt

SEQ ID NO: 603058 - DNA, 25 bp, Homo sapien
tgagtctggcccctttttgtctttc

SEQ ID NO: 603059 - DNA, 25 bp, Homo sapien
gtctggcccctttttgtctttctct

SEQ ID NO: 603060 - DNA, 25 bp, Homo sapien
caagaagcccctcatcagatactag

SEQ ID NO: 603061 - DNA, 25 bp, Homo sapien
agaagcccctcatcagatactagtg

SEQ ID NO: 603062 - DNA, 25 bp, Homo sapien
aagcccctcatcagatactagtgcc

SEQ ID NO: 603063 - DNA, 25 bp, Homo sapien
cccctcatcagatactagtgccatg

SEQ ID NO: 603064 - DNA, 25 bp, Homo sapien
atcagatactagtgccatgaccttg

SEQ ID NO: 603065 - DNA, 25 bp, Homo sapien
gatactagtgccatgaccttggact

SEQ ID NO: 603066 - DNA, 25 bp, Homo sapien
actagtgccatgaccttggacttcc

SEQ ID NO: 603067 - DNA, 25 bp, Homo sapien
tgctttcatcttgtctaggcacaga

SEQ ID NO: 603068 - DNA, 25 bp, Homo sapien
tttcatcttgtctaggcacagagat

SEQ ID NO: 603069 - DNA, 25 bp, Homo sapien
tggtcatgggtttcagtactatctg

SEQ ID NO: 603070 - DNA, 25 bp, Homo sapien
gggataaaccaagataactgccatg

SEQ ID NO: 603071 - DNA, 25 bp, Homo sapien
aactgccatggttatgttagctaga

SEQ ID NO: 603072 - DNA, 25 bp, Homo sapien
ccatggttatgttagctagagtgtc

SEQ ID NO: 603073 - DNA, 25 bp, Homo sapien
tgttagctagagtgtccattggatc

SEQ ID NO: 603074 - DNA, 25 bp, Homo sapien
agtgtccattggatctcagcttctg

SEQ ID NO: 603075 - DNA, 25 bp, Homo sapien
tgtccattggatctcagcttctggt

SEQ ID NO: 603076 - DNA, 25 bp, Homo sapien
ttggatctcagcttctggtttattt

SEQ ID NO: 603077 - DNA, 25 bp, Homo sapien
atgacctgaggtatggagtgtatcc

SEQ ID NO: 603078 - DNA, 25 bp, Homo sapien
ttttgctgtgcaatagaaaatcagg

SEQ ID NO: 603079 - DNA, 25 bp, Homo sapien
aatcaggacaatgagctcttgacgc

SEQ ID NO: 603080 - DNA, 25 bp, Homo sapien
tcttgacgctagagattgtgcatcg

SEQ ID NO: 603081 - DNA, 25 bp, Homo sapien
ttgtgcatcgttacgtggagctgct

SEQ ID NO: 603082 - DNA, 25 bp, Homo sapien
catcgttacgtggagctgctggaca

SEQ ID NO: 603083 - DNA, 25 bp, Homo sapien
gtctgtgagctggatattatcttta

SEQ ID NO: 603084 - DNA, 25 bp, Homo sapien
cttatttcatcctggacgagtttat

SEQ ID NO: 603085 - DNA, 25 bp, Homo sapien
gaaaattgctgtcaaagccattgaa

SEQ ID NO: 603086 - DNA, 25 bp, Homo sapien
aaagccattgaagactctgatatgt

SEQ ID NO: 603087 - DNA, 25 bp, Homo sapien
tacaggaggtcagtacggtttccca

SEQ ID NO: 603088 - DNA, 25 bp, Homo sapien
gtcagtacggtttcccaaaccatgg

SEQ ID NO: 603089 - DNA, 25 bp, Homo sapien
tcactgtcagtgtagaggcataggt

SEQ ID NO: 603090 - DNA, 25 bp, Homo sapien
tgtcagtgtagaggcataggtccaa

SEQ ID NO: 603091 - DNA, 25 bp, Homo sapien
ataggtccaaaatatgtttccccag

SEQ ID NO: 603092 - DNA, 25 bp, Homo sapien
ggtccaaaatatgtttccccagtca

SEQ ID NO: 603093 - DNA, 25 bp, Homo sapien
tccaaaatatgtttccccagtcaaa

SEQ ID NO: 603094 - DNA, 25 bp, Homo sapien
tttccccagtcaaaaacatgtaagg

SEQ ID NO: 603095 - DNA, 25 bp, Homo sapien
aaacatgtaaggtttgcaccaggag

SEQ ID NO: 603096 - DNA, 25 bp, Homo sapien
tgtaaggtttgcaccaggagtggaa

SEQ ID NO: 603097 - DNA, 25 bp, Homo sapien
gcaaagacacttaagggctgggtac

SEQ ID NO: 603098 - DNA, 25 bp, Homo sapien
acacttaagggctgggtactcatgc

SEQ ID NO: 603099 - DNA, 25 bp, Homo sapien
ttaagggctgggtactcatgcctgt

SEQ ID NO: 603100 - DNA, 25 bp, Homo sapien
aagatctggttatttaagagtctaa

SEQ ID NO: 603101 - DNA, 25 bp, Homo sapien
atctggttatttaagagtctaagac

SEQ ID NO: 603102 - DNA, 25 bp, Homo sapien
ctggttatttaagagtctaagacct

SEQ ID NO: 603103 - DNA, 25 bp, Homo sapien
tggttatttaagagtctaagacctc

SEQ ID NO: 603104 - DNA, 25 bp, Homo sapien
tggctccccatcaccttatgtcatg

SEQ ID NO: 603105 - DNA, 25 bp, Homo sapien
ggctccccatcaccttatgtcatga

SEQ ID NO: 603106 - DNA, 25 bp, Homo sapien
gctccccatcaccttatgtcatgat

SEQ ID NO: 603107 - DNA, 25 bp, Homo sapien
tccccatcaccttatgtcatgatct

SEQ ID NO: 603108 - DNA, 25 bp, Homo sapien
ccccatcaccttatgtcatgatctt

SEQ ID NO: 603109 - DNA, 25 bp, Homo sapien
cccatcaccttatgtcatgatctta

SEQ ID NO: 603110 - DNA, 25 bp, Homo sapien
ccatcaccttatgtcatgatcttaa

SEQ ID NO: 603111 - DNA, 25 bp, Homo sapien
ttgtttataaaaggtatgctagttt

SEQ ID NO: 603112 - DNA, 25 bp, Homo sapien
ttttgctgtgcaatagaaaatcagg

SEQ ID NO: 603113 - DNA, 25 bp, Homo sapien
tagaaaatcaggacaatgagctctt

SEQ ID NO: 603114 - DNA, 25 bp, Homo sapien
gacaatgagctcttgacgctagaga

SEQ ID NO: 603115 - DNA, 25 bp, Homo sapien
atgagctcttgacgctagagattgt

SEQ ID NO: 603116 - DNA, 25 bp, Homo sapien
agctcttgacgctagagattgtgca

SEQ ID NO: 603117 - DNA, 25 bp, Homo sapien
tcttgacgctagagattgtgcatcg

SEQ ID NO: 603118 - DNA, 25 bp, Homo sapien
gacgctagagattgtgcatcgttac

SEQ ID NO: 603119 - DNA, 25 bp, Homo sapien
gctagagattgtgcatcgttacgtg

SEQ ID NO: 603120 - DNA, 25 bp, Homo sapien
agattgtgcatcgttacgtggagct

SEQ ID NO: 603121 - DNA, 25 bp, Homo sapien
ttgtgcatcgttacgtggagctgct

SEQ ID NO: 603122 - DNA, 25 bp, Homo sapien
cctggcatttctgtaaggcctaaat

SEQ ID NO: 603123 - DNA, 25 bp, Homo sapien
gtaaggcctaaataatgtctcatca

SEQ ID NO: 603124 - DNA, 25 bp, Homo sapien
cggtgatggtcctcttctctcaatt

SEQ ID NO: 603125 - DNA, 25 bp, Homo sapien
ttctctcaattcctgtagcacatac

SEQ ID NO: 603126 - DNA, 25 bp, Homo sapien
gtagcacataccatcattgacactt

SEQ ID NO: 603127 - DNA, 25 bp, Homo sapien
catcattgacacttagcatacgcta

SEQ ID NO: 603128 - DNA, 25 bp, Homo sapien
agcatacgctacttttcacacatta

SEQ ID NO: 603129 - DNA, 25 bp, Homo sapien
tcacacattactgtactccttttgt

SEQ ID NO: 603130 - DNA, 25 bp, Homo sapien
cttcctcagttcagtcgaaaaagct

SEQ ID NO: 603131 - DNA, 25 bp, Homo sapien
gtctttagcagctataaagggctca

SEQ ID NO: 603132 - DNA, 25 bp, Homo sapien
gggctcaaataactcagcctagtta

SEQ ID NO: 603133 - DNA, 25 bp, Homo sapien
gtacttagtgaattgtagcctaccc

SEQ ID NO: 603134 - DNA, 25 bp, Homo sapien
gtagcctacccagatgtgtaaacaa

SEQ ID NO: 603135 - DNA, 25 bp, Homo sapien
agactgtgaactactcttgtgacaa

SEQ ID NO: 603136 - DNA, 25 bp, Homo sapien
tggccaatcaaaggaggtcaactct

SEQ ID NO: 603137 - DNA, 25 bp, Homo sapien
gtcaactcttgacactgctttcaaa

SEQ ID NO: 603138 - DNA, 25 bp, Homo sapien
attgagctgtaaacaatctggctgt

SEQ ID NO: 603139 - DNA, 25 bp, Homo sapien
ttctgttttctgtacgccacttttc

SEQ ID NO: 603140 - DNA, 25 bp, Homo sapien
tgtacgccacttttctgtctctgtc

SEQ ID NO: 603141 - DNA, 25 bp, Homo sapien
tctctgaacctactctggctgagga

SEQ ID NO: 603142 - DNA, 25 bp, Homo sapien
aggaggctgcccaattctcaaaccg

SEQ ID NO: 603143 - DNA, 25 bp, Homo sapien
gcccaattctcaaaccgttcaatta

SEQ ID NO: 603144 - DNA, 25 bp, Homo sapien
aggcaggcggcggatcgcatgaggt

SEQ ID NO: 603145 - DNA, 25 bp, Homo sapien
ggcaggcggcggatcgcatgaggtc

SEQ ID NO: 603146 - DNA, 25 bp, Homo sapien
gcaggcggcggatcgcatgaggtca

SEQ ID NO: 603147 - DNA, 25 bp, Homo sapien
caggcggcggatcgcatgaggtcag

SEQ ID NO: 603148 - DNA, 25 bp, Homo sapien
aggcggcggatcgcatgaggtcagg

SEQ ID NO: 603149 - DNA, 25 bp, Homo sapien
gcgtggggtgtgcacctgtgatccc

SEQ ID NO: 603150 - DNA, 25 bp, Homo sapien
cgtggggtgtgcacctgtgatccca

SEQ ID NO: 603151 - DNA, 25 bp, Homo sapien
gagaattgtttggacccggaaggag

SEQ ID NO: 603152 - DNA, 25 bp, Homo sapien
ttggacccggaaggaggaggttgca

SEQ ID NO: 603153 - DNA, 25 bp, Homo sapien
tggacccggaaggaggaggttgcag

SEQ ID NO: 603154 - DNA, 25 bp, Homo sapien
actccaacctaagcgacagagtgag

SEQ ID NO: 603155 - DNA, 25 bp, Homo sapien
aagagttgagacacatgtgcccaca

SEQ ID NO: 603156 - DNA, 25 bp, Homo sapien
tgtgcccacatttatccaactggtt

SEQ ID NO: 603157 - DNA, 25 bp, Homo sapien
ccaactggttgatagttctggaact

SEQ ID NO: 603158 - DNA, 25 bp, Homo sapien
ttctggaactagaagctgctgcccc

SEQ ID NO: 603159 - DNA, 25 bp, Homo sapien
tgctgcccctgatgcctagaacaga

SEQ ID NO: 603160 - DNA, 25 bp, Homo sapien
gatgcctagaacagagctctcatta

SEQ ID NO: 603161 - DNA, 25 bp, Homo sapien
agagctctcattaagctgcagggca

SEQ ID NO: 603162 - DNA, 25 bp, Homo sapien
tagggagcttttggtatctgtgttc

SEQ ID NO: 603163 - DNA, 25 bp, Homo sapien
tgtgttccagacatttccctactca

SEQ ID NO: 603164 - DNA, 25 bp, Homo sapien
tcctgttttactctttcattaggca

SEQ ID NO: 603165 - DNA, 25 bp, Homo sapien
tctaatctagttccccttgtttact

SEQ ID NO: 603166 - DNA, 25 bp, Homo sapien
aagcatagctatgtcaatgtccagg

SEQ ID NO: 603167 - DNA, 25 bp, Homo sapien
tgtcaatgtccagggaagcattttt

SEQ ID NO: 603168 - DNA, 25 bp, Homo sapien
atttgttgtcatagatgcagccttt

SEQ ID NO: 603169 - DNA, 25 bp, Homo sapien
gatgcagcctttatctggaaatcag

SEQ ID NO: 603170 - DNA, 25 bp, Homo sapien
aatcagtgggcagctctggtcaagc

SEQ ID NO: 603171 - DNA, 25 bp, Homo sapien
gctctggtcaagcacagcatggcga

SEQ ID NO: 603172 - DNA, 25 bp, Homo sapien
cagcatggcgaccactgtgtagtat

SEQ ID NO: 603173 - DNA, 25 bp, Homo sapien
gcgaccactgtgtagtattttacca

SEQ ID NO: 603174 - DNA, 25 bp, Homo sapien
tagtattttaccacctaatccttag

SEQ ID NO: 603175 - DNA, 25 bp, Homo sapien
taatccttagtagccaacactgtta

SEQ ID NO: 603176 - DNA, 25 bp, Homo sapien
aacactgttaaatctgcataatggg

SEQ ID NO: 603177 - DNA, 25 bp, Homo sapien
tgggaaacatagcgaaaccccctct

SEQ ID NO: 603178 - DNA, 25 bp, Homo sapien
ggaaacatagcgaaaccccctctct

SEQ ID NO: 603179 - DNA, 25 bp, Homo sapien
gaaacatagcgaaaccccctctcta

SEQ ID NO: 603180 - DNA, 25 bp, Homo sapien
aaaaagagccaggtgtgggggcacg

SEQ ID NO: 603181 - DNA, 25 bp, Homo sapien
aagagccaggtgtgggggcacgtgc

SEQ ID NO: 603182 - DNA, 25 bp, Homo sapien
agagccaggtgtgggggcacgtgcc

SEQ ID NO: 603183 - DNA, 25 bp, Homo sapien
ctacttgggagctgaggaaggagga

SEQ ID NO: 603184 - DNA, 25 bp, Homo sapien
tgaggaaggaggattgtgtgagccc

SEQ ID NO: 603185 - DNA, 25 bp, Homo sapien
tgtgagcccaggaggtccaggatac

SEQ ID NO: 603186 - DNA, 25 bp, Homo sapien
gtgagcccaggaggtccaggataca

SEQ ID NO: 603187 - DNA, 25 bp, Homo sapien
aggtccaggatacagtgagccatga

SEQ ID NO: 603188 - DNA, 25 bp, Homo sapien
tttaaaatcaaatttgaggccaggt

SEQ ID NO: 603189 - DNA, 25 bp, Homo sapien
ttaaaatcaaatttgaggccaggtg

SEQ ID NO: 603190 - DNA, 25 bp, Homo sapien
taaaatcaaatttgaggccaggtgc

SEQ ID NO: 603191 - DNA, 25 bp, Homo sapien
gcagtggctcatgggcggaggaggg

SEQ ID NO: 603192 - DNA, 25 bp, Homo sapien
cagtggctcatgggcggaggagggc

SEQ ID NO: 603193 - DNA, 25 bp, Homo sapien
agtggctcatgggcggaggagggca

SEQ ID NO: 603194 - DNA, 25 bp, Homo sapien
atgggcggaggagggcagattactt

SEQ ID NO: 603195 - DNA, 25 bp, Homo sapien
ggtgaaaaagacaggctgtgtctcc

SEQ ID NO: 603196 - DNA, 25 bp, Homo sapien
gtgaaaaagacaggctgtgtctcca

SEQ ID NO: 603197 - DNA, 25 bp, Homo sapien
gaaaaagacaggctgtgtctccaaa

SEQ ID NO: 603198 - DNA, 25 bp, Homo sapien
aaaagacaggctgtgtctccaaaaa

SEQ ID NO: 603199 - DNA, 25 bp, Homo sapien
agccttcagtcggagtaaatgtctt

SEQ ID NO: 603200 - DNA, 25 bp, Homo sapien
gccttcagtcggagtaaatgtctta

SEQ ID NO: 603201 - DNA, 25 bp, Homo sapien
ccttcagtcggagtaaatgtcttat

SEQ ID NO: 603202 - DNA, 25 bp, Homo sapien
cttcagtcggagtaaatgtcttatt

SEQ ID NO: 603203 - DNA, 25 bp, Homo sapien
tcagtcggagtaaatgtcttattcg

SEQ ID NO: 603204 - DNA, 25 bp, Homo sapien
gtcggagtaaatgtcttattcgaca

SEQ ID NO: 603205 - DNA, 25 bp, Homo sapien
ggagtaaatgtcttattcgacatca

SEQ ID NO: 603206 - DNA, 25 bp, Homo sapien
ggtctgagtaaatgtcttattcggc

SEQ ID NO: 603207 - DNA, 25 bp, Homo sapien
gtctgagtaaatgtcttattcggca

SEQ ID NO: 603208 - DNA, 25 bp, Homo sapien
ctgagtaaatgtcttattcggcacc

SEQ ID NO: 603209 - DNA, 25 bp, Homo sapien
tgagtaaatgtcttattcggcacca

SEQ ID NO: 603210 - DNA, 25 bp, Homo sapien
agaagacaaggagttcttgcctagt

SEQ ID NO: 603211 - DNA, 25 bp, Homo sapien
caaggagttcttgcctagtgggtac

SEQ ID NO: 603212 - DNA, 25 bp, Homo sapien
agttcttgcctagtgggtacagagt

SEQ ID NO: 603213 - DNA, 25 bp, Homo sapien
ttgtggtgacagttacacaccattg

SEQ ID NO: 603214 - DNA, 25 bp, Homo sapien
gacagttacacaccattgtgaacat

SEQ ID NO: 603215 - DNA, 25 bp, Homo sapien
gtgaacataattagtaccactgaac

SEQ ID NO: 603216 - DNA, 25 bp, Homo sapien
aatggttagttgtatgttttatgta

SEQ ID NO: 603217 - DNA, 25 bp, Homo sapien
aggctggctgactttccctgcatgt

SEQ ID NO: 603218 - DNA, 25 bp, Homo sapien
tgactttccctgcatgtacgcacat

SEQ ID NO: 603219 - DNA, 25 bp, Homo sapien
gcatgtacgcacatcttcacatgtg

SEQ ID NO: 603220 - DNA, 25 bp, Homo sapien
cgcacatcttcacatgtgcacacat

SEQ ID NO: 603221 - DNA, 25 bp, Homo sapien
ctgtattgtaagaaggctggtgctc

SEQ ID NO: 603222 - DNA, 25 bp, Homo sapien
gtaagaaggctggtgctcctgaaat

SEQ ID NO: 603223 - DNA, 25 bp, Homo sapien
ggtgctcctgaaatctagcaggcag

SEQ ID NO: 603224 - DNA, 25 bp, Homo sapien
aaatctagcaggcaggtgcttacta

SEQ ID NO: 603225 - DNA, 25 bp, Homo sapien
gcaggcaggtgcttactagaagtca

SEQ ID NO: 603226 - DNA, 25 bp, Homo sapien
ggcaggtgcttactagaagtcacaa

SEQ ID NO: 603227 - DNA, 25 bp, Homo sapien
caggtgcttactagaagtcacaagt

SEQ ID NO: 603228 - DNA, 25 bp, Homo sapien
tctgtcttcaacatcatttgatact

SEQ ID NO: 603229 - DNA, 25 bp, Homo sapien
catttgatactatagacttattcat

SEQ ID NO: 603230 - DNA, 25 bp, Homo sapien
gacttattcataaggtcaattgcct

SEQ ID NO: 603231 - DNA, 25 bp, Homo sapien
ttattcataaggtcaattgcctagt

SEQ ID NO: 603232 - DNA, 25 bp, Homo sapien
tatccatcacctcagatgtttatca

SEQ ID NO: 603233 - DNA, 25 bp, Homo sapien
tttaccttgaaatactacagagcac

SEQ ID NO: 603234 - DNA, 25 bp, Homo sapien
tacagagcactagaacttattgagc

SEQ ID NO: 603235 - DNA, 25 bp, Homo sapien
gcactagaacttattgagctgcaat

SEQ ID NO: 603236 - DNA, 25 bp, Homo sapien
gctgcaattttgtatcaacctctcc

SEQ ID NO: 603237 - DNA, 25 bp, Homo sapien
caattttgtatcaacctctccctct

SEQ ID NO: 603238 - DNA, 25 bp, Homo sapien
taatacataataacacatttgtggg

SEQ ID NO: 603239 - DNA, 25 bp, Homo sapien
gtgggatacaaagtgatatttcagt

SEQ ID NO: 603240 - DNA, 25 bp, Homo sapien
atttcagtacatgtatacaacgtgt

SEQ ID NO: 603241 - DNA, 25 bp, Homo sapien
gtgtaatgatcaaagcacagtaatc

SEQ ID NO: 603242 - DNA, 25 bp, Homo sapien
cacagtaatcagcatatccatcacc

SEQ ID NO: 603243 - DNA, 25 bp, Homo sapien
agtggtgtgtgctaatgatcttcag

SEQ ID NO: 603244 - DNA, 25 bp, Homo sapien
gaacttatttgtattgctgaacact

SEQ ID NO: 603245 - DNA, 25 bp, Homo sapien
tgtacaaacctaacagccttgggcc

SEQ ID NO: 603246 - DNA, 25 bp, Homo sapien
aagttagctgcagtgccttcatcag

SEQ ID NO: 603247 - DNA, 25 bp, Homo sapien
gtgccttcatcaggtttgtaagact

SEQ ID NO: 603248 - DNA, 25 bp, Homo sapien
gagaaggttaacacagctctctgta

SEQ ID NO: 603249 - DNA, 25 bp, Homo sapien
aggaagttttgatccctgatgagga

SEQ ID NO: 603250 - DNA, 25 bp, Homo sapien
gaaattcacactgaagtctccaaat

SEQ ID NO: 603251 - DNA, 25 bp, Homo sapien
gaagtctccaaatacctgggaagag

SEQ ID NO: 603252 - DNA, 25 bp, Homo sapien
gtatggttccctgatgtgatgcctc

SEQ ID NO: 603253 - DNA, 25 bp, Homo sapien
gtgatgcctctctggtaatgggctg

SEQ ID NO: 603254 - DNA, 25 bp, Homo sapien
ggcagaacttcaattgtgtccctaa

SEQ ID NO: 603255 - DNA, 25 bp, Homo sapien
gaacttcaattgtgtccctaatggg

SEQ ID NO: 603256 - DNA, 25 bp, Homo sapien
atgggaaaccttgctgggatcatgt

SEQ ID NO: 603257 - DNA, 25 bp, Homo sapien
ccttgctgggatcatgtggtctaca

SEQ ID NO: 603258 - DNA, 25 bp, Homo sapien
tgtggtctacagcacaaggttgcta

SEQ ID NO: 603259 - DNA, 25 bp, Homo sapien
aaggttgctaaagcatcttctgcca

SEQ ID NO: 603260 - DNA, 25 bp, Homo sapien
agcatcttctgccagaattctgtga

SEQ ID NO: 603261 - DNA, 25 bp, Homo sapien
gaattctgtgagtatctggttaggt

SEQ ID NO: 603262 - DNA, 25 bp, Homo sapien
tatctggttaggtgggtctggaata

SEQ ID NO: 603263 - DNA, 25 bp, Homo sapien
aatatgctactctgctgtatgaatc

SEQ ID NO: 603264 - DNA, 25 bp, Homo sapien
atgctactctgctgtatgaatctcc

SEQ ID NO: 603265 - DNA, 25 bp, Homo sapien
gagtgtgccggcctcatctatctca

SEQ ID NO: 603266 - DNA, 25 bp, Homo sapien
tcatctatctcacatgtctccacat

SEQ ID NO: 603267 - DNA, 25 bp, Homo sapien
cacatgtctccacatctgcagcatg

SEQ ID NO: 603268 - DNA, 25 bp, Homo sapien
aggtgtttctattgtcagtccatgg

SEQ ID NO: 603269 - DNA, 25 bp, Homo sapien
gtttctattgtcagtccatggagag

SEQ ID NO: 603270 - DNA, 25 bp, Homo sapien
tccatggagagactggtgcagcccc

SEQ ID NO: 603271 - DNA, 25 bp, Homo sapien
gaggatgtgccttgagtcccaggaa

SEQ ID NO: 603272 - DNA, 25 bp, Homo sapien
tgtgccttgagtcccaggaaaggtc

SEQ ID NO: 603273 - DNA, 25 bp, Homo sapien
aggaaaggtcgaaagagctgagctc

SEQ ID NO: 603274 - DNA, 25 bp, Homo sapien
tggccatgcaaaggcgctgtagcac

SEQ ID NO: 603275 - DNA, 25 bp, Homo sapien
tgcaaaggcgctgtagcacagcttg

SEQ ID NO: 603276 - DNA, 25 bp, Homo sapien
atatttgtatagtttgagggatgct

SEQ ID NO: 603277 - DNA, 25 bp, Homo sapien
tatttgtatagtttgagggatgcta

SEQ ID NO: 603278 - DNA, 25 bp, Homo sapien
atttgtatagtttgagggatgctat

SEQ ID NO: 603279 - DNA, 25 bp, Homo sapien
tgtatagtttgagggatgctatgtt

SEQ ID NO: 603280 - DNA, 25 bp, Homo sapien
tatagtttgagggatgctatgttaa

SEQ ID NO: 603281 - DNA, 25 bp, Homo sapien
atagtttgagggatgctatgttaat

SEQ ID NO: 603282 - DNA, 25 bp, Homo sapien
tagtttgagggatgctatgttaatg

SEQ ID NO: 603283 - DNA, 25 bp, Homo sapien
agtttgagggatgctatgttaatgt

SEQ ID NO: 603284 - DNA, 25 bp, Homo sapien
gtttgagggatgctatgttaatgta

SEQ ID NO: 603285 - DNA, 25 bp, Homo sapien
gatacatattttgtaaagtgttact

SEQ ID NO: 603286 - DNA, 25 bp, Homo sapien
tgtaaagtgttactatattttaaag

SEQ ID NO: 603287 - DNA, 25 bp, Homo sapien
atgaccagcagagacaggctaaaga

SEQ ID NO: 603288 - DNA, 25 bp, Homo sapien
gacactgagctgaaaaccctggact

SEQ ID NO: 603289 - DNA, 25 bp, Homo sapien
gaaaaccctggactctattgctaaa

SEQ ID NO: 603290 - DNA, 25 bp, Homo sapien
tctattgctaaattgaggctcctga

SEQ ID NO: 603291 - DNA, 25 bp, Homo sapien
aattgaggctcctgaatccgttcgc

SEQ ID NO: 603292 - DNA, 25 bp, Homo sapien
gaatccgttcgctctgagcaactgt

SEQ ID NO: 603293 - DNA, 25 bp, Homo sapien
caagcactctgctgagcactcagat

SEQ ID NO: 603294 - DNA, 25 bp, Homo sapien
gggctgtgctatccgtcaacagaca

SEQ ID NO: 603295 - DNA, 25 bp, Homo sapien
gaactgctcagctgacaaactggta

SEQ ID NO: 603296 - DNA, 25 bp, Homo sapien
ggtagaggtccagaaacacagttct

SEQ ID NO: 603297 - DNA, 25 bp, Homo sapien
gctgcatagtgaaaaaaggccaatt

SEQ ID NO: 603298 - DNA, 25 bp, Homo sapien
ggagaagcccctcaagaacatcccg

SEQ ID NO: 603299 - DNA, 25 bp, Homo sapien
agaagcccctcaagaacatcccgtt

SEQ ID NO: 603300 - DNA, 25 bp, Homo sapien
ggccgaggatccttgcagggcttct

SEQ ID NO: 603301 - DNA, 25 bp, Homo sapien
ccgaggatccttgcagggcttctgg

SEQ ID NO: 603302 - DNA, 25 bp, Homo sapien
cctcagcttcacagtcaccgaagaa

SEQ ID NO: 603303 - DNA, 25 bp, Homo sapien
gcttcacagtcaccgaagaaatgaa

SEQ ID NO: 603304 - DNA, 25 bp, Homo sapien
gggcacaccgtccttttgtctctgc

SEQ ID NO: 603305 - DNA, 25 bp, Homo sapien
ttgtctctgcctttgaggttggcgg

SEQ ID NO: 603306 - DNA, 25 bp, Homo sapien
tctgcctttgaggttggcgggaact

SEQ ID NO: 603307 - DNA, 25 bp, Homo sapien
gcgggaactgaaactggtacggtct

SEQ ID NO: 603308 - DNA, 25 bp, Homo sapien
tgaaactggtacggtctttttgaat

SEQ ID NO: 603309 - DNA, 25 bp, Homo sapien
tccctgtaccgctactggaggcact

SEQ ID NO: 603310 - DNA, 25 bp, Homo sapien
ggaggcactccccaaacgtcaactg

SEQ ID NO: 603311 - DNA, 25 bp, Homo sapien
aagtctgtggcatagtgactgcctg

SEQ ID NO: 603312 - DNA, 25 bp, Homo sapien
atagtgactgcctgggcccttctcg

SEQ ID NO: 603313 - DNA, 25 bp, Homo sapien
ttctcgcgttcatccttggaagatc

SEQ ID NO: 603314 - DNA, 25 bp, Homo sapien
aagatctggtacctgagtgcagcga

SEQ ID NO: 603315 - DNA, 25 bp, Homo sapien
tcgggtccccatgctctctgggagg

SEQ ID NO: 603316 - DNA, 25 bp, Homo sapien
tgtgctgggtgtgttcgtgtaaatc

SEQ ID NO: 603317 - DNA, 25 bp, Homo sapien
gattctgtttgcagatggatctgtt

SEQ ID NO: 603318 - DNA, 25 bp, Homo sapien
gaaattctgttatgtcctgaacgtg

SEQ ID NO: 603319 - DNA, 25 bp, Homo sapien
gtcctgaacgtgaaattctgtcaac

SEQ ID NO: 603320 - DNA, 25 bp, Homo sapien
gggctgttctgacccgctagggtgg

SEQ ID NO: 603321 - DNA, 25 bp, Homo sapien
tgttctgacccgctagggtggagga

SEQ ID NO: 603322 - DNA, 25 bp, Homo sapien
gttctgacccgctagggtggaggag

SEQ ID NO: 603323 - DNA, 25 bp, Homo sapien
agtggggtttgttgatgaacctcca

SEQ ID NO: 603324 - DNA, 25 bp, Homo sapien
gtggggtttgttgatgaacctccac

SEQ ID NO: 603325 - DNA, 25 bp, Homo sapien
tggggtttgttgatgaacctccacc

SEQ ID NO: 603326 - DNA, 25 bp, Homo sapien
gtttgttgatgaacctccaccccca

SEQ ID NO: 603327 - DNA, 25 bp, Homo sapien
gagaccctgactctacgaaaattaa

SEQ ID NO: 603328 - DNA, 25 bp, Homo sapien
tgactctacgaaaattaaaagttag

SEQ ID NO: 603329 - DNA, 25 bp, Homo sapien
ggcgcgcacctgtggcttagctacc

SEQ ID NO: 603330 - DNA, 25 bp, Homo sapien
gcgcacctgtggcttagctaccctg

SEQ ID NO: 603331 - DNA, 25 bp, Homo sapien
tgcctctgtgtctcgtttaaaaata

SEQ ID NO: 603332 - DNA, 25 bp, Homo sapien
ttgtctacacataccgaatcttcag

SEQ ID NO: 603333 - DNA, 25 bp, Homo sapien
cttcagagagaaacacgggtattac

SEQ ID NO: 603334 - DNA, 25 bp, Homo sapien
cgggtattacaggatacagactgca

SEQ ID NO: 603335 - DNA, 25 bp, Homo sapien
acagactgcagaaggttctccaaaa

SEQ ID NO: 603336 - DNA, 25 bp, Homo sapien
gttctccaaaacaggtctttccaag

SEQ ID NO: 603337 - DNA, 25 bp, Homo sapien
aagcctaaaggaactgatctccaaa

SEQ ID NO: 603338 - DNA, 25 bp, Homo sapien
tggtggttcaccttttaaagccaat

SEQ ID NO: 603339 - DNA, 25 bp, Homo sapien
gaaccagccccagcttgagatggag

SEQ ID NO: 603340 - DNA, 25 bp, Homo sapien
catttgtgaacagtaacagcgatta

SEQ ID NO: 603341 - DNA, 25 bp, Homo sapien
agcgattatgtggatgtcttgcctt

SEQ ID NO: 603342 - DNA, 25 bp, Homo sapien
gcctgatactggcaataatatattt

SEQ ID NO: 603343 - DNA, 25 bp, Homo sapien
tgacaaatatgagtttctctttttc

SEQ ID NO: 603344 - DNA, 25 bp, Homo sapien
gcagacatctgggttgttgttgttt

SEQ ID NO: 603345 - DNA, 25 bp, Homo sapien
gacatctgggttgttgttgtttcat

SEQ ID NO: 603346 - DNA, 25 bp, Homo sapien
catctgggttgttgttgtttcatca

SEQ ID NO: 603347 - DNA, 25 bp, Homo sapien
tgggttgttgttgtttcatcaggga

SEQ ID NO: 603348 - DNA, 25 bp, Homo sapien
ggttgttgttgtttcatcagggaga

SEQ ID NO: 603349 - DNA, 25 bp, Homo sapien
ggtcagaaatgtcacgagctctcta

SEQ ID NO: 603350 - DNA, 25 bp, Homo sapien
tcagaaatgtcacgagctctctata

SEQ ID NO: 603351 - DNA, 25 bp, Homo sapien
gaaatgtcacgagctctctatagat

SEQ ID NO: 603352 - DNA, 25 bp, Homo sapien
tgtcacgagctctctatagatcctc

SEQ ID NO: 603353 - DNA, 25 bp, Homo sapien
gcatgacctcagaacctaaaaccaa

SEQ ID NO: 603354 - DNA, 25 bp, Homo sapien
gaacctaaaaccaaggtctcactga

SEQ ID NO: 603355 - DNA, 25 bp, Homo sapien
aaccaaggtctcactgacagtagtt

SEQ ID NO: 603356 - DNA, 25 bp, Homo sapien
gacagtagttcaagtgttcttcaaa

SEQ ID NO: 603357 - DNA, 25 bp, Homo sapien
gtagttcaagtgttcttcaaagata

SEQ ID NO: 603358 - DNA, 25 bp, Homo sapien
gagattttatgtattcttgtctttc

SEQ ID NO: 603359 - DNA, 25 bp, Homo sapien
gtctttcagagcaagcaaactgcct

SEQ ID NO: 603360 - DNA, 25 bp, Homo sapien
ttgtctaaatgaacacattggtgtg

SEQ ID NO: 603361 - DNA, 25 bp, Homo sapien
cacattggtgtgttgatcagatgag

SEQ ID NO: 603362 - DNA, 25 bp, Homo sapien
tgttgatcagatgagagctaggtta

SEQ ID NO: 603363 - DNA, 25 bp, Homo sapien
gagctaggttagaaatccaagaccc

SEQ ID NO: 603364 - DNA, 25 bp, Homo sapien
aatggtgaaaagctaggaatactgc

SEQ ID NO: 603365 - DNA, 25 bp, Homo sapien
acaactactacttaacattgttctg

SEQ ID NO: 603366 - DNA, 25 bp, Homo sapien
agacagtcacaaaaattactatagg

SEQ ID NO: 603367 - DNA, 25 bp, Homo sapien
ataggaatataattgcatacctgga

SEQ ID NO: 603368 - DNA, 25 bp, Homo sapien
atataattgcatacctggaaaacag

SEQ ID NO: 603369 - DNA, 25 bp, Homo sapien
gcatacctggaaaacagaagcagct

SEQ ID NO: 603370 - DNA, 25 bp, Homo sapien
aaagctaaagtgtactatttcagta

SEQ ID NO: 603371 - DNA, 25 bp, Homo sapien
gtactatttcagtaaggtgtccact

SEQ ID NO: 603372 - DNA, 25 bp, Homo sapien
atttcagtaaggtgtccactgataa

SEQ ID NO: 603373 - DNA, 25 bp, Homo sapien
taaggtgtccactgataaaaattat

SEQ ID NO: 603374 - DNA, 25 bp, Homo sapien
aggtgtccactgataaaaattatat

SEQ ID NO: 603375 - DNA, 25 bp, Homo sapien
accgcatcaaggagacagaaagaag

SEQ ID NO: 603376 - DNA, 25 bp, Homo sapien
caaaggaaggaccttatgaaacgca

SEQ ID NO: 603377 - DNA, 25 bp, Homo sapien
cttatgaaacgcacccccaaagcaa

SEQ ID NO: 603378 - DNA, 25 bp, Homo sapien
cgagggctgctttccccagaggaag

SEQ ID NO: 603379 - DNA, 25 bp, Homo sapien
cagaggaaggacattttcttcgcca

SEQ ID NO: 603380 - DNA, 25 bp, Homo sapien
gaggaaggacattttcttcgccagc

SEQ ID NO: 603381 - DNA, 25 bp, Homo sapien
aggaaggacattttcttcgccagcc

SEQ ID NO: 603382 - DNA, 25 bp, Homo sapien
ggaaggacattttcttcgccagcca

SEQ ID NO: 603383 - DNA, 25 bp, Homo sapien
cattttcttcgccagccacgaggaa

SEQ ID NO: 603384 - DNA, 25 bp, Homo sapien
ttttcttcgccagccacgaggaaat

SEQ ID NO: 603385 - DNA, 25 bp, Homo sapien
cttcgccagccacgaggaaatccgt

SEQ ID NO: 603386 - DNA, 25 bp, Homo sapien
gagtgcctatgagatgccaggccct

SEQ ID NO: 603387 - DNA, 25 bp, Homo sapien
tatgagatgccaggccctgtcctgg

SEQ ID NO: 603388 - DNA, 25 bp, Homo sapien
cctgtcctgggtattgtgggcactg

SEQ ID NO: 603389 - DNA, 25 bp, Homo sapien
gcactgtggagcgagatgtctttga

SEQ ID NO: 603390 - DNA, 25 bp, Homo sapien
ggagcgagatgtctttgaccctaaa

SEQ ID NO: 603391 - DNA, 25 bp, Homo sapien
gagatgtctttgaccctaaagagct

SEQ ID NO: 603392 - DNA, 25 bp, Homo sapien
gaccctaaagagcttttattccagt

SEQ ID NO: 603393 - DNA, 25 bp, Homo sapien
gagagactaggcgagacatgaaata

SEQ ID NO: 603394 - DNA, 25 bp, Homo sapien
gactaggcgagacatgaaatataca

SEQ ID NO: 603395 - DNA, 25 bp, Homo sapien
gaaatatacagggtcacaggagtct

SEQ ID NO: 603396 - DNA, 25 bp, Homo sapien
cagggtcacaggagtctcagtggac

SEQ ID NO: 603397 - DNA, 25 bp, Homo sapien
acatccatgttcttgggtcatcttt

SEQ ID NO: 603398 - DNA, 25 bp, Homo sapien
atgttcttgggtcatcttttttgcc

SEQ ID NO: 603399 - DNA, 25 bp, Homo sapien
atcttttttgccctttcatggagtc

SEQ ID NO: 603400 - DNA, 25 bp, Homo sapien
ttttgccctttcatggagtcataaa

SEQ ID NO: 603401 - DNA, 25 bp, Homo sapien
gagtcataaattttcccaactgaag

SEQ ID NO: 603402 - DNA, 25 bp, Homo sapien
aattttcccaactgaagtcttgtat

SEQ ID NO: 603403 - DNA, 25 bp, Homo sapien
ctgaagtcttgtatattctgttaga

SEQ ID NO: 603404 - DNA, 25 bp, Homo sapien
gattaattcctatttctagttgctg

SEQ ID NO: 603405 - DNA, 25 bp, Homo sapien
gttgctgtaaatgatatcttatgtt

SEQ ID NO: 603406 - DNA, 25 bp, Homo sapien
gttaaccctctcattagatctacta

SEQ ID NO: 603407 - DNA, 25 bp, Homo sapien
gatctactagtttacctgttgattc

SEQ ID NO: 603408 - DNA, 25 bp, Homo sapien
gcccggtcgtgctaatcactttgaa

SEQ ID NO: 603409 - DNA, 25 bp, Homo sapien
cggtcgtgctaatcactttgaaagg

SEQ ID NO: 603410 - DNA, 25 bp, Homo sapien
gaaaggcattatctcatcggttaaa

SEQ ID NO: 603411 - DNA, 25 bp, Homo sapien
ggcattatctcatcggttaaaacat

SEQ ID NO: 603412 - DNA, 25 bp, Homo sapien
aaaagtttacagcacactggcgcag

SEQ ID NO: 603413 - DNA, 25 bp, Homo sapien
agcacactggcgcagaagatggaaa

SEQ ID NO: 603414 - DNA, 25 bp, Homo sapien
gatggaaaaccgctgcttgcctttc

SEQ ID NO: 603415 - DNA, 25 bp, Homo sapien
cgctgcttgcctttctccgtttatt

SEQ ID NO: 603416 - DNA, 25 bp, Homo sapien
cattctgctctttggatcattttct

SEQ ID NO: 603417 - DNA, 25 bp, Homo sapien
ttggatcattttcttcggaaaaagt

SEQ ID NO: 603418 - DNA, 25 bp, Homo sapien
tccaaagtgtgtcttgtgtattaaa

SEQ ID NO: 603419 - DNA, 25 bp, Homo sapien
agccttcagtcggagtaaatgtctt

SEQ ID NO: 603420 - DNA, 25 bp, Homo sapien
attcgacatcagagcctccacactg

SEQ ID NO: 603421 - DNA, 25 bp, Homo sapien
cttcaatcagatctctcaacttgtt

SEQ ID NO: 603422 - DNA, 25 bp, Homo sapien
caatcagatctctcaacttgttgaa

SEQ ID NO: 603423 - DNA, 25 bp, Homo sapien
aatcagatctctcaacttgttgaac

SEQ ID NO: 603424 - DNA, 25 bp, Homo sapien
agatctctcaacttgttgaacatga

SEQ ID NO: 603425 - DNA, 25 bp, Homo sapien
tctcaacttgttgaacatgagcgaa

SEQ ID NO: 603426 - DNA, 25 bp, Homo sapien
gtggtaaggcattcggtctgagtaa

SEQ ID NO: 603427 - DNA, 25 bp, Homo sapien
tgagtaaatgtcttattcggcacca

SEQ ID NO: 603428 - DNA, 25 bp, Homo sapien
tattcggcaccagaggcttcacaca

SEQ ID NO: 603429 - DNA, 25 bp, Homo sapien
gcaccagaggcttcacacaagtgaa

SEQ ID NO: 603430 - DNA, 25 bp, Homo sapien
acagacctggaggttctgtacttgt

SEQ ID NO: 603431 - DNA, 25 bp, Homo sapien
ctgtacttgtgatttctggttgtgg

SEQ ID NO: 603432 - DNA, 25 bp, Homo sapien
tgatttctggttgtggatcctgaga

SEQ ID NO: 603433 - DNA, 25 bp, Homo sapien
gtggatcctgagaacaagaagtact

SEQ ID NO: 603434 - DNA, 25 bp, Homo sapien
gtactgggatcctaaagttctgaca

SEQ ID NO: 603435 - DNA, 25 bp, Homo sapien
gtgtgccaaattcaaggtggtccca

SEQ ID NO: 603436 - DNA, 25 bp, Homo sapien
aaggtggtcccagcctttctagtct

SEQ ID NO: 603437 - DNA, 25 bp, Homo sapien
tttctagtcttctctaacctttctt

SEQ ID NO: 603438 - DNA, 25 bp, Homo sapien
tctctaacctttcttctcagaagtc

SEQ ID NO: 603439 - DNA, 25 bp, Homo sapien
tttcttctcagaagtcgcacctgtt

SEQ ID NO: 603440 - DNA, 25 bp, Homo sapien
aagtcgcacctgttctgtctttcta

SEQ ID NO: 603441 - DNA, 25 bp, Homo sapien
agtaagtcagtgtacttgcaacaga

SEQ ID NO: 603442 - DNA, 25 bp, Homo sapien
gtcagtgtacttgcaacagaggctt

SEQ ID NO: 603443 - DNA, 25 bp, Homo sapien
tgtacttgcaacagaggcttgggat

SEQ ID NO: 603444 - DNA, 25 bp, Homo sapien
tttaggttcaatttgggcaaggttg

SEQ ID NO: 603445 - DNA, 25 bp, Homo sapien
gggcaaggttgtttgaatttcaata

SEQ ID NO: 603446 - DNA, 25 bp, Homo sapien
tttcaataatcaagggtttgggtca

SEQ ID NO: 603447 - DNA, 25 bp, Homo sapien
taatcaagggtttgggtcaaggaag

SEQ ID NO: 603448 - DNA, 25 bp, Homo sapien
gaaaaatcatgggacttgccattta

SEQ ID NO: 603449 - DNA, 25 bp, Homo sapien
gggacttgccatttaggaggataat

SEQ ID NO: 603450 - DNA, 25 bp, Homo sapien
taggaggataattttgtggtagtgt

SEQ ID NO: 603451 - DNA, 25 bp, Homo sapien
agctgggaaggcaggaaaccggcta

SEQ ID NO: 603452 - DNA, 25 bp, Homo sapien
accctccctgatccagaggcgggat

SEQ ID NO: 603453 - DNA, 25 bp, Homo sapien
ccctccctgatccagaggcgggatg

SEQ ID NO: 603454 - DNA, 25 bp, Homo sapien
cctccctgatccagaggcgggatgg

SEQ ID NO: 603455 - DNA, 25 bp, Homo sapien
ctccctgatccagaggcgggatggc

SEQ ID NO: 603456 - DNA, 25 bp, Homo sapien
tccctgatccagaggcgggatggcc

SEQ ID NO: 603457 - DNA, 25 bp, Homo sapien
ccctgatccagaggcgggatggccg

SEQ ID NO: 603458 - DNA, 25 bp, Homo sapien
ggctcggcggggctctgacggcgcg

SEQ ID NO: 603459 - DNA, 25 bp, Homo sapien
tgacggcgcggcctggcttgcaggc

SEQ ID NO: 603460 - DNA, 25 bp, Homo sapien
gcgcggcctggcttgcaggctagag

SEQ ID NO: 603461 - DNA, 25 bp, Homo sapien
cggcctggcttgcaggctagaggcg

SEQ ID NO: 603462 - DNA, 25 bp, Homo sapien
ggcctggcttgcaggctagaggcgg

SEQ ID NO: 603463 - DNA, 25 bp, Homo sapien
aaaagaaagggcgagatcaccaagg

SEQ ID NO: 603464 - DNA, 25 bp, Homo sapien
accaaggttcttccagggctgtatt

SEQ ID NO: 603465 - DNA, 25 bp, Homo sapien
tccagggctgtatttctgcagtttc

SEQ ID NO: 603466 - DNA, 25 bp, Homo sapien
gtatttctgcagtttcggttttcat

SEQ ID NO: 603467 - DNA, 25 bp, Homo sapien
gcagtttcggttttcatttgcttca

SEQ ID NO: 603468 - DNA, 25 bp, Homo sapien
ttcatttgcttcagcttactaagaa

SEQ ID NO: 603469 - DNA, 25 bp, Homo sapien
gaagcttcaaatctaactccatact

SEQ ID NO: 603470 - DNA, 25 bp, Homo sapien
aatctaactccatactgaacaaggg

SEQ ID NO: 603471 - DNA, 25 bp, Homo sapien
tttatgtcctcacctatgacctgga

SEQ ID NO: 603472 - DNA, 25 bp, Homo sapien
tatggtgttcaaggcaatagtacat

SEQ ID NO: 603473 - DNA, 25 bp, Homo sapien
ggttattgctattgtcatttgcata

SEQ ID NO: 603474 - DNA, 25 bp, Homo sapien
gttttccttttcactgacacccaga

SEQ ID NO: 603475 - DNA, 25 bp, Homo sapien
gacacccagattgtagtggaggagt

SEQ ID NO: 603476 - DNA, 25 bp, Homo sapien
gatataaataacatcctgaactcag

SEQ ID NO: 603477 - DNA, 25 bp, Homo sapien
cctgaactcaggtgaagtgcctaat

SEQ ID NO: 603478 - DNA, 25 bp, Homo sapien
ggtgaagtgcctaatttatttgaaa

SEQ ID NO: 603479 - DNA, 25 bp, Homo sapien
actggagcaggttttagcggccacc

SEQ ID NO: 603480 - DNA, 25 bp, Homo sapien
ggttttagcggccaccagaccaaga

SEQ ID NO: 603481 - DNA, 25 bp, Homo sapien
aacagagacgaggtaggatgtgcca

SEQ ID NO: 603482 - DNA, 25 bp, Homo sapien
gtggctttatcacaaaaacgtttct

SEQ ID NO: 603483 - DNA, 25 bp, Homo sapien
atttaaccattcattgattgcctga

SEQ ID NO: 603484 - DNA, 25 bp, Homo sapien
aaccattcattgattgcctgaaggg

SEQ ID NO: 603485 - DNA, 25 bp, Homo sapien
acaaggcatggccatcctctcctgg

SEQ ID NO: 603486 - DNA, 25 bp, Homo sapien
gagggctagctggtcaacagacagt

SEQ ID NO: 603487 - DNA, 25 bp, Homo sapien
agctggtcaacagacagtgtggtga

SEQ ID NO: 603488 - DNA, 25 bp, Homo sapien
tcaacagacagtgtggtgagagcag

SEQ ID NO: 603489 - DNA, 25 bp, Homo sapien
tgcagggtgatatcacagcacagag

SEQ ID NO: 603490 - DNA, 25 bp, Homo sapien
agcacagagaagcaacccatccagg

SEQ ID NO: 603491 - DNA, 25 bp, Homo sapien
agagaagcaacccatccaggcatgg

SEQ ID NO: 603492 - DNA, 25 bp, Homo sapien
gaacattactgatggaagtctaaac

SEQ ID NO: 603493 - DNA, 25 bp, Homo sapien
gatggaagtctaaactaggacctaa

SEQ ID NO: 603494 - DNA, 25 bp, Homo sapien
aactaggacctaaaagatcaatggg

SEQ ID NO: 603495 - DNA, 25 bp, Homo sapien
agatcaatgggaaccagctggccaa

SEQ ID NO: 603496 - DNA, 25 bp, Homo sapien
ctaccttccacaagcgtcaagaatt

SEQ ID NO: 603497 - DNA, 25 bp, Homo sapien
taccttccacaagcgtcaagaatta

SEQ ID NO: 603498 - DNA, 25 bp, Homo sapien
ccttccacaagcgtcaagaattaaa

SEQ ID NO: 603499 - DNA, 25 bp, Homo sapien
tccacaagcgtcaagaattaaatca

SEQ ID NO: 603500 - DNA, 25 bp, Homo sapien
aagcgtcaagaattaaatcaggcct

SEQ ID NO: 603501 - DNA, 25 bp, Homo sapien
gcgtcaagaattaaatcaggcctgg

SEQ ID NO: 603502 - DNA, 25 bp, Homo sapien
cgtcaagaattaaatcaggcctggc

SEQ ID NO: 603503 - DNA, 25 bp, Homo sapien
caagaattaaatcaggcctggcgcg

SEQ ID NO: 603504 - DNA, 25 bp, Homo sapien
aagaattaaatcaggcctggcgcgg

SEQ ID NO: 603505 - DNA, 25 bp, Homo sapien
agaattaaatcaggcctggcgcggt

SEQ ID NO: 603506 - DNA, 25 bp, Homo sapien
gaattaaatcaggcctggcgcggtg

SEQ ID NO: 603507 - DNA, 25 bp, Homo sapien
ggtgggagggctgcccagaacaggg

SEQ ID NO: 603508 - DNA, 25 bp, Homo sapien
cacatgtaccaaccttcctgttgct

SEQ ID NO: 603509 - DNA, 25 bp, Homo sapien
acatgtaccaaccttcctgttgctc

SEQ ID NO: 603510 - DNA, 25 bp, Homo sapien
atgtaccaaccttcctgttgctccc

SEQ ID NO: 603511 - DNA, 25 bp, Homo sapien
tgttgctccctccatccacagaata

SEQ ID NO: 603512 - DNA, 25 bp, Homo sapien
gctccctccatccacagaataatag

SEQ ID NO: 603513 - DNA, 25 bp, Homo sapien
ccatccacagaataatagctaccat

SEQ ID NO: 603514 - DNA, 25 bp, Homo sapien
atccacagaataatagctaccattt

SEQ ID NO: 603515 - DNA, 25 bp, Homo sapien
aaatgtttactctgggctgggagca

SEQ ID NO: 603516 - DNA, 25 bp, Homo sapien
tgagcaacactgtgagacccccccg

SEQ ID NO: 603517 - DNA, 25 bp, Homo sapien
ccccgccatctctacataaataata

SEQ ID NO: 603518 - DNA, 25 bp, Homo sapien
tggttgtggcccttatactgcagta

SEQ ID NO: 603519 - DNA, 25 bp, Homo sapien
gtggcccttatactgcagtattata

SEQ ID NO: 603520 - DNA, 25 bp, Homo sapien
gcagtattatatgctccatgagact

SEQ ID NO: 603521 - DNA, 25 bp, Homo sapien
tatatgctccatgagactgtggcac

SEQ ID NO: 603522 - DNA, 25 bp, Homo sapien
gtgagatagaacttgggagcccggg

SEQ ID NO: 603523 - DNA, 25 bp, Homo sapien
cttggtctccttcacatgtgtgggc

SEQ ID NO: 603524 - DNA, 25 bp, Homo sapien
ggtctccttcacatgtgtgggctat

SEQ ID NO: 603525 - DNA, 25 bp, Homo sapien
acatgtgtgggctatgcggtcacca

SEQ ID NO: 603526 - DNA, 25 bp, Homo sapien
atgtgtgggctatgcggtcaccaag

SEQ ID NO: 603527 - DNA, 25 bp, Homo sapien
gggctatgcggtcaccaaggcccac

SEQ ID NO: 603528 - DNA, 25 bp, Homo sapien
cattccgaggtggttgtggccctta

SEQ ID NO: 603529 - DNA, 25 bp, Homo sapien
agcccctctacctgtgggagcaatg

SEQ ID NO: 603530 - DNA, 25 bp, Homo sapien
gaaacaccagcttctatgtgactta

SEQ ID NO: 603531 - DNA, 25 bp, Homo sapien
atggatcttatcacgctttctttct

SEQ ID NO: 603532 - DNA, 25 bp, Homo sapien
aaagctaccaacatgcaacactgca

SEQ ID NO: 603533 - DNA, 25 bp, Homo sapien
tagccacaagtgactgggccattga

SEQ ID NO: 603534 - DNA, 25 bp, Homo sapien
actgggccattgaattggaccgcac

SEQ ID NO: 603535 - DNA, 25 bp, Homo sapien
ggaccgcactgattacaaaacactt

SEQ ID NO: 603536 - DNA, 25 bp, Homo sapien
agaatattccatcctagcactgctc

SEQ ID NO: 603537 - DNA, 25 bp, Homo sapien
actgctccaggtctttgcagggaaa

SEQ ID NO: 603538 - DNA, 25 bp, Homo sapien
tggatcgtgttctacttcatgtgga

SEQ ID NO: 603539 - DNA, 25 bp, Homo sapien
tgtgaactacttgaagtccctgccc

SEQ ID NO: 603540 - DNA, 25 bp, Homo sapien
gggccagcagcatcacctaggaaat

SEQ ID NO: 603541 - DNA, 25 bp, Homo sapien
catcacctaggaaattatgagaaat

SEQ ID NO: 603542 - DNA, 25 bp, Homo sapien
atgagaaatacagactctcagaccc

SEQ ID NO: 603543 - DNA, 25 bp, Homo sapien
gacccacaggatcagaagctgcatt

SEQ ID NO: 603544 - DNA, 25 bp, Homo sapien
aagactccaggtgactcatgcacaa

SEQ ID NO: 603545 - DNA, 25 bp, Homo sapien
gctggtccatgtaccgcactttgag

SEQ ID NO: 603546 - DNA, 25 bp, Homo sapien
tttgagtagcacttaacaggactat

SEQ ID NO: 603547 - DNA, 25 bp, Homo sapien
gagtagcacttaacaggactataaa

SEQ ID NO: 603548 - DNA, 25 bp, Homo sapien
tttggaaatcatcttcccccaccgt

SEQ ID NO: 603549 - DNA, 25 bp, Homo sapien
caccgtagtggcaacaaaacgttct

SEQ ID NO: 603550 - DNA, 25 bp, Homo sapien
cgtagtggcaacaaaacgttctttg

SEQ ID NO: 603551 - DNA, 25 bp, Homo sapien
ctgccaaaatagcatccccaacgtg

SEQ ID NO: 603552 - DNA, 25 bp, Homo sapien
tgccaaaatagcatccccaacgtgc

SEQ ID NO: 603553 - DNA, 25 bp, Homo sapien
gccaaaatagcatccccaacgtgca

SEQ ID NO: 603554 - DNA, 25 bp, Homo sapien
ccaaaatagcatccccaacgtgcag

SEQ ID NO: 603555 - DNA, 25 bp, Homo sapien
aaaatagcatccccaacgtgcagcc

SEQ ID NO: 603556 - DNA, 25 bp, Homo sapien
aatagcatccccaacgtgcagccct

SEQ ID NO: 603557 - DNA, 25 bp, Homo sapien
agccctccgcatctatcagcaggtt

SEQ ID NO: 603558 - DNA, 25 bp, Homo sapien
gccctccgcatctatcagcaggttg

SEQ ID NO: 603559 - DNA, 25 bp, Homo sapien
ccgcatctatcagcaggttgccccg

SEQ ID NO: 603560 - DNA, 25 bp, Homo sapien
ctaacaacaacaaagggcagtaaat

SEQ ID NO: 603561 - DNA, 25 bp, Homo sapien
ttaaagtactctttgtaaggtacag

SEQ ID NO: 603562 - DNA, 25 bp, Homo sapien
ggctctgaatgctcattgtgggctt

SEQ ID NO: 603563 - DNA, 25 bp, Homo sapien
ctgaatgctcattgtgggcttttaa

SEQ ID NO: 603564 - DNA, 25 bp, Homo sapien
gatggctcagtaacaacatttagtt

SEQ ID NO: 603565 - DNA, 25 bp, Homo sapien
gatctggcaatcatgggcattccca

SEQ ID NO: 603566 - DNA, 25 bp, Homo sapien
atgggcattcccacgtgaaaatgag

SEQ ID NO: 603567 - DNA, 25 bp, Homo sapien
aaatgaggatattagcgcagttgct

SEQ ID NO: 603568 - DNA, 25 bp, Homo sapien
agtgtgacccactgcccagctatgc

SEQ ID NO: 603569 - DNA, 25 bp, Homo sapien
tatgcataccccaagcattctggaa

SEQ ID NO: 603570 - DNA, 25 bp, Homo sapien
caagcattctggaagcatcggcttc

SEQ ID NO: 603571 - DNA, 25 bp, Homo sapien
gaagcatcggcttccgatcatttgt

SEQ ID NO: 603572 - DNA, 25 bp, Homo sapien
ggcttccgatcatttgtcatccaat

SEQ ID NO: 603573 - DNA, 25 bp, Homo sapien
ccatgccattgccaattctctaaat

SEQ ID NO: 603574 - DNA, 25 bp, Homo sapien
aattctctaaatgcattcacaaaca

SEQ ID NO: 603575 - DNA, 25 bp, Homo sapien
gacttcaaacatgtaaaaacacctt

SEQ ID NO: 603576 - DNA, 25 bp, Homo sapien
gtggtcttttatctaaagcattaac

SEQ ID NO: 603577 - DNA, 25 bp, Homo sapien
tatctaaagcattaaccaagtggag

SEQ ID NO: 603578 - DNA, 25 bp, Homo sapien
gaaggacttaaactcatacctaact

SEQ ID NO: 603579 - DNA, 25 bp, Homo sapien
taaactcatacctaacttcaccttt

SEQ ID NO: 603580 - DNA, 25 bp, Homo sapien
catacctaacttcaccttttgatct

SEQ ID NO: 603581 - DNA, 25 bp, Homo sapien
ctaacttcaccttttgatcttgatg

SEQ ID NO: 603582 - DNA, 25 bp, Homo sapien
atcttgatgcccctgggtgtgtagt

SEQ ID NO: 603583 - DNA, 25 bp, Homo sapien
cctgggtgtgtagtgccagtcctga

SEQ ID NO: 603584 - DNA, 25 bp, Homo sapien
tgcagatagctgtagttgatccatt

SEQ ID NO: 603585 - DNA, 25 bp, Homo sapien
cagatagctgtagttgatccatttt

SEQ ID NO: 603586 - DNA, 25 bp, Homo sapien
gatagctgtagttgatccattttta

SEQ ID NO: 603587 - DNA, 25 bp, Homo sapien
atagctgtagttgatccatttttat

SEQ ID NO: 603588 - DNA, 25 bp, Homo sapien
tttattgttgtacagtttaccattg

SEQ ID NO: 603589 - DNA, 25 bp, Homo sapien
attgttgtacagtttaccattgtat

SEQ ID NO: 603590 - DNA, 25 bp, Homo sapien
tgttgtacagtttaccattgtataa

SEQ ID NO: 603591 - DNA, 25 bp, Homo sapien
taccatgatttattcatgataactt

SEQ ID NO: 603592 - DNA, 25 bp, Homo sapien
acattctggttgtttgcaggtttta

SEQ ID NO: 603593 - DNA, 25 bp, Homo sapien
cattctggttgtttgcaggttttat

SEQ ID NO: 603594 - DNA, 25 bp, Homo sapien
tctggttgtttgcaggttttatttt

SEQ ID NO: 603595 - DNA, 25 bp, Homo sapien
tgccaagggagcttccctttttgtg

SEQ ID NO: 603596 - DNA, 25 bp, Homo sapien
tgtctgtgccatggacttcttgaag

SEQ ID NO: 603597 - DNA, 25 bp, Homo sapien
ctgtgccatggacttcttgaagtag

SEQ ID NO: 603598 - DNA, 25 bp, Homo sapien
ctgtggaccccttctcactgtgatg

SEQ ID NO: 603599 - DNA, 25 bp, Homo sapien
ccccttctcactgtgatgtttttta

SEQ ID NO: 603600 - DNA, 25 bp, Homo sapien
tctcactgtgatgttttttaaatgc

SEQ ID NO: 603601 - DNA, 25 bp, Homo sapien
aatagcagcagatctaaacaattga

SEQ ID NO: 603602 - DNA, 25 bp, Homo sapien
aatgtctaaatggtgagcgtaagtc

SEQ ID NO: 603603 - DNA, 25 bp, Homo sapien
gagcgtaagtcacatgctgagacgt

SEQ ID NO: 603604 - DNA, 25 bp, Homo sapien
aagtcacatgctgagacgtctgcaa

SEQ ID NO: 603605 - DNA, 25 bp, Homo sapien
gctgagacgtctgcaacaacaaact

SEQ ID NO: 603606 - DNA, 25 bp, Homo sapien
gaatctctccaagtcccaatttgta

SEQ ID NO: 603607 - DNA, 25 bp, Homo sapien
gtcccaatttgtacttgtcaaaaat

SEQ ID NO: 603608 - DNA, 25 bp, Homo sapien
atgaaaacggtacccaggcagctgc

SEQ ID NO: 603609 - DNA, 25 bp, Homo sapien
gctgttgtctcggaaaggtcactac

SEQ ID NO: 603610 - DNA, 25 bp, Homo sapien
aggtcactacgatcttgggtggagt

SEQ ID NO: 603611 - DNA, 25 bp, Homo sapien
gtggagtttaatgccaaccaccctt

SEQ ID NO: 603612 - DNA, 25 bp, Homo sapien
ttcattagacacaacaaaacccaaa

SEQ ID NO: 603613 - DNA, 25 bp, Homo sapien
aattccattttacaagacatgggca

SEQ ID NO: 603614 - DNA, 25 bp, Homo sapien
gacatgggcattacggatatctttg

SEQ ID NO: 603615 - DNA, 25 bp, Homo sapien
aaacgagggctgatcttactggaat

SEQ ID NO: 603616 - DNA, 25 bp, Homo sapien
ggctgatcttactggaatctctcca

SEQ ID NO: 603617 - DNA, 25 bp, Homo sapien
gagtcttccctttcaactgttgtta

SEQ ID NO: 603618 - DNA, 25 bp, Homo sapien
gttaaatctgagacatcctgactct

SEQ ID NO: 603619 - DNA, 25 bp, Homo sapien
gacatcctgactctcgagctgggaa

SEQ ID NO: 603620 - DNA, 25 bp, Homo sapien
ctgactctcgagctgggaagatgaa

SEQ ID NO: 603621 - DNA, 25 bp, Homo sapien
atatttggcctactttccaggcttg

SEQ ID NO: 603622 - DNA, 25 bp, Homo sapien
aggcttgggcaaaactcgctctgtt

SEQ ID NO: 603623 - DNA, 25 bp, Homo sapien
tgatcctcttgtgtcagcctgccag

SEQ ID NO: 603624 - DNA, 25 bp, Homo sapien
agcctgccaggtagctagatctgca

SEQ ID NO: 603625 - DNA, 25 bp, Homo sapien
tagctagatctgcaggcgtgaccca

SEQ ID NO: 603626 - DNA, 25 bp, Homo sapien
ggtttcttgagttaggtgcttattt

SEQ ID NO: 603627 - DNA, 25 bp, Homo sapien
atttgcaatatcttctggctgttaa

SEQ ID NO: 603628 - DNA, 25 bp, Homo sapien
gcgctgaaacaccactgatgaccct

SEQ ID NO: 603629 - DNA, 25 bp, Homo sapien
gaaacaccactgatgacccttaggg

SEQ ID NO: 603630 - DNA, 25 bp, Homo sapien
acaccactgatgacccttagggact

SEQ ID NO: 603631 - DNA, 25 bp, Homo sapien
gggaccctctgtcatttgagctctt

SEQ ID NO: 603632 - DNA, 25 bp, Homo sapien
accctctgtcatttgagctcttcga

SEQ ID NO: 603633 - DNA, 25 bp, Homo sapien
tctgtcatttgagctcttcgagtga

SEQ ID NO: 603634 - DNA, 25 bp, Homo sapien
gtcatttgagctcttcgagtgaaga

SEQ ID NO: 603635 - DNA, 25 bp, Homo sapien
agattatgagtatagaccccaagtc

SEQ ID NO: 603636 - DNA, 25 bp, Homo sapien
gagtatagaccccaagtcatgtttg

SEQ ID NO: 603637 - DNA, 25 bp, Homo sapien
gtatagaccccaagtcatgtttgtc

SEQ ID NO: 603638 - DNA, 25 bp, Homo sapien
tagaccccaagtcatgtttgtcttc

SEQ ID NO: 603639 - DNA, 25 bp, Homo sapien
tgtcagtgatgggtcctgataagta

SEQ ID NO: 603640 - DNA, 25 bp, Homo sapien
gtcagtgatgggtcctgataagtaa

SEQ ID NO: 603641 - DNA, 25 bp, Homo sapien
tcagtgatgggtcctgataagtaag

SEQ ID NO: 603642 - DNA, 25 bp, Homo sapien
ttctgagagactgttaatcacacac

SEQ ID NO: 603643 - DNA, 25 bp, Homo sapien
tctgagagactgttaatcacacaca

SEQ ID NO: 603644 - DNA, 25 bp, Homo sapien
ctgagagactgttaatcacacacaa

SEQ ID NO: 603645 - DNA, 25 bp, Homo sapien
tgagagactgttaatcacacacaac

SEQ ID NO: 603646 - DNA, 25 bp, Homo sapien
tagccccacatcctgttctcaaata

SEQ ID NO: 603647 - DNA, 25 bp, Homo sapien
actttgctcagcatgtagccccagc

SEQ ID NO: 603648 - DNA, 25 bp, Homo sapien
tttcttacaacgttatctttgtact

SEQ ID NO: 603649 - DNA, 25 bp, Homo sapien
tcttacaacgttatctttgtacttt

SEQ ID NO: 603650 - DNA, 25 bp, Homo sapien
gggtgtgagcagcttccagcaaaca

SEQ ID NO: 603651 - DNA, 25 bp, Homo sapien
gcattttatgcttttggtgcagtaa

SEQ ID NO: 603652 - DNA, 25 bp, Homo sapien
ataacagaaggctctctttttgtta

SEQ ID NO: 603653 - DNA, 25 bp, Homo sapien
tgagatattttgagcaccccagatt

SEQ ID NO: 603654 - DNA, 25 bp, Homo sapien
gagcaccccagatttatgcaaattg

SEQ ID NO: 603655 - DNA, 25 bp, Homo sapien
ttgtgaacctgggaaaagcaatgcc

SEQ ID NO: 603656 - DNA, 25 bp, Homo sapien
gggccctgagtaaattttgcggatg

SEQ ID NO: 603657 - DNA, 25 bp, Homo sapien
attttgcggatgtgctttggtgaca

SEQ ID NO: 603658 - DNA, 25 bp, Homo sapien
ctttggtgacaatgtggctgctgcc

SEQ ID NO: 603659 - DNA, 25 bp, Homo sapien
ggctgctgcctcttgctatttttct

SEQ ID NO: 603660 - DNA, 25 bp, Homo sapien
atacttgtaacaatggctaccattt

SEQ ID NO: 603661 - DNA, 25 bp, Homo sapien
aggatggttctgaggtatctgaagt

SEQ ID NO: 603662 - DNA, 25 bp, Homo sapien
gaggtatctgaagtatctccaaata

SEQ ID NO: 603663 - DNA, 25 bp, Homo sapien
tatctgaagatattccccatggaaa

SEQ ID NO: 603664 - DNA, 25 bp, Homo sapien
ttccccatggaaaagaaactaggct

SEQ ID NO: 603665 - DNA, 25 bp, Homo sapien
actaggcttatttggagtgacccca

SEQ ID NO: 603666 - DNA, 25 bp, Homo sapien
tatttggagtgaccccagaggacaa

SEQ ID NO: 603667 - DNA, 25 bp, Homo sapien
ccagaggacaagactacgactaaaa

SEQ ID NO: 603668 - DNA, 25 bp, Homo sapien
agactacgactaaaaatggacgctc

SEQ ID NO: 603669 - DNA, 25 bp, Homo sapien
atggacgctcgcaaatggaggaagt

SEQ ID NO: 603670 - DNA, 25 bp, Homo sapien
ggaggaagtagacctgacccctgac

SEQ ID NO: 603671 - DNA, 25 bp, Homo sapien
agacctgacccctgactaaggaaga

SEQ ID NO: 603672 - DNA, 25 bp, Homo sapien
tgccaaaatagcatccccaacgtgc

SEQ ID NO: 603673 - DNA, 25 bp, Homo sapien
agccctccgcatctatcagcaggtt

SEQ ID NO: 603674 - DNA, 25 bp, Homo sapien
gtaaggtacagttaccgattaatct

SEQ ID NO: 603675 - DNA, 25 bp, Homo sapien
ggtacagttaccgattaatctagag

SEQ ID NO: 603676 - DNA, 25 bp, Homo sapien
tacagttaccgattaatctagagat

SEQ ID NO: 603677 - DNA, 25 bp, Homo sapien
cagttaccgattaatctagagataa

SEQ ID NO: 603678 - DNA, 25 bp, Homo sapien
tatttcattaaacacctatgctgtc

SEQ ID NO: 603679 - DNA, 25 bp, Homo sapien
atttcattaaacacctatgctgtct

SEQ ID NO: 603680 - DNA, 25 bp, Homo sapien
ttcattaaacacctatgctgtctct

SEQ ID NO: 603681 - DNA, 25 bp, Homo sapien
tcattaaacacctatgctgtctcta

SEQ ID NO: 603682 - DNA, 25 bp, Homo sapien
cattaaacacctatgctgtctctat

SEQ ID NO: 603683 - DNA, 25 bp, Homo sapien
ctgccatcataaatgggtcctttca

SEQ ID NO: 603684 - DNA, 25 bp, Homo sapien
gccatcataaatgggtcctttcagg

SEQ ID NO: 603685 - DNA, 25 bp, Homo sapien
tttcaggttccttccttgtacctca

SEQ ID NO: 603686 - DNA, 25 bp, Homo sapien
aggttccttccttgtacctcagcac

SEQ ID NO: 603687 - DNA, 25 bp, Homo sapien
cttccttgtacctcagcactctggg

SEQ ID NO: 603688 - DNA, 25 bp, Homo sapien
gggtcattagaagccttagcaacac

SEQ ID NO: 603689 - DNA, 25 bp, Homo sapien
ttagcaacactgctcaccacagtat

SEQ ID NO: 603690 - DNA, 25 bp, Homo sapien
tgctcaccacagtatagctccagag

SEQ ID NO: 603691 - DNA, 25 bp, Homo sapien
gtatagctccagaggccctagcagt

SEQ ID NO: 603692 - DNA, 25 bp, Homo sapien
aaggattcacgaatcaggcagcccc

SEQ ID NO: 603693 - DNA, 25 bp, Homo sapien
ccagcacagacacatggtggaagat

SEQ ID NO: 603694 - DNA, 25 bp, Homo sapien
ggtaaatcggatgaagcagaactgg

SEQ ID NO: 603695 - DNA, 25 bp, Homo sapien
aagtcttagtaaagccatccccaga

SEQ ID NO: 603696 - DNA, 25 bp, Homo sapien
tcttagtaaagccatccccagatgg

SEQ ID NO: 603697 - DNA, 25 bp, Homo sapien
cccagatggcttcccttggattcca

SEQ ID NO: 603698 - DNA, 25 bp, Homo sapien
ggcttcccttggattccaacattta

SEQ ID NO: 603699 - DNA, 25 bp, Homo sapien
tcccttggattccaacatttacaga

SEQ ID NO: 603700 - DNA, 25 bp, Homo sapien
cagaacaagattttcagtgatctgt

SEQ ID NO: 603701 - DNA, 25 bp, Homo sapien
ggagtcctggtcgtggagctctccc

SEQ ID NO: 603702 - DNA, 25 bp, Homo sapien
gtcgtggagctctccctgcggagca

SEQ ID NO: 603703 - DNA, 25 bp, Homo sapien
gattttccagtctctatagcttctc

SEQ ID NO: 603704 - DNA, 25 bp, Homo sapien
ttttccagtctctatagcttctcag

SEQ ID NO: 603705 - DNA, 25 bp, Homo sapien
tgtcagtgatgggtcctgataagta

SEQ ID NO: 603706 - DNA, 25 bp, Homo sapien
tcagtgatgggtcctgataagtaag

SEQ ID NO: 603707 - DNA, 25 bp, Homo sapien
ttctgagagactgttaatcacacac

SEQ ID NO: 603708 - DNA, 25 bp, Homo sapien
tgagagactgttaatcacacacaac

SEQ ID NO: 603709 - DNA, 25 bp, Homo sapien
tagccccacatcctgttctcaaata

SEQ ID NO: 603710 - DNA, 25 bp, Homo sapien
cccacatcctgttctcaaatacttt

SEQ ID NO: 603711 - DNA, 25 bp, Homo sapien
atcctgttctcaaatactttgctca

SEQ ID NO: 603712 - DNA, 25 bp, Homo sapien
actttgctcagcatgtagccccagc

SEQ ID NO: 603713 - DNA, 25 bp, Homo sapien
tagaccctccagcatgaccctataa

SEQ ID NO: 603714 - DNA, 25 bp, Homo sapien
tttcttacaacgttatctttgtact

SEQ ID NO: 603715 - DNA, 25 bp, Homo sapien
tcttacaacgttatctttgtacttt

SEQ ID NO: 603716 - DNA, 25 bp, Homo sapien
agccgagttcgtggtcactgcactc

SEQ ID NO: 603717 - DNA, 25 bp, Homo sapien
aaagaatgagtctggcccctttttg

SEQ ID NO: 603718 - DNA, 25 bp, Homo sapien
tgagtctggcccctttttgtctttc

SEQ ID NO: 603719 - DNA, 25 bp, Homo sapien
gtctggcccctttttgtctttctct

SEQ ID NO: 603720 - DNA, 25 bp, Homo sapien
ttgcctttcaccatgttatgatgca

SEQ ID NO: 603721 - DNA, 25 bp, Homo sapien
aagaagcccctcatcagatactagt

SEQ ID NO: 603722 - DNA, 25 bp, Homo sapien
gaagcccctcatcagatactagtgc

SEQ ID NO: 603723 - DNA, 25 bp, Homo sapien
gcccctcatcagatactagtgccat

SEQ ID NO: 603724 - DNA, 25 bp, Homo sapien
atcagatactagtgccatgaccttg

SEQ ID NO: 603725 - DNA, 25 bp, Homo sapien
gatactagtgccatgaccttggact

SEQ ID NO: 603726 - DNA, 25 bp, Homo sapien
actagtgccatgaccttggacttcc

SEQ ID NO: 603727 - DNA, 25 bp, Homo sapien
gatacctgaacttcactaagggaga

SEQ ID NO: 603728 - DNA, 25 bp, Homo sapien
atctgtttatgttaaacttgcagga

SEQ ID NO: 603729 - DNA, 25 bp, Homo sapien
aggagtttggatattttcccagaga

SEQ ID NO: 603730 - DNA, 25 bp, Homo sapien
tttcccagagatgcagtccagattg

SEQ ID NO: 603731 - DNA, 25 bp, Homo sapien
agtccagattgaagaggtgttcata

SEQ ID NO: 603732 - DNA, 25 bp, Homo sapien
gaggtgttcatatctgaggaaattc

SEQ ID NO: 603733 - DNA, 25 bp, Homo sapien
gaggaaattcagatgtcaacgaaag

SEQ ID NO: 603734 - DNA, 25 bp, Homo sapien
gatgtcaacgaaagaatctgacttt

SEQ ID NO: 603735 - DNA, 25 bp, Homo sapien
ggagtaagttacacatttgacaatg

SEQ ID NO: 603736 - DNA, 25 bp, Homo sapien
attaaacggtgattcatggtgaaac

SEQ ID NO: 603737 - DNA, 25 bp, Homo sapien
atatatccttatgaagaagatcacg

SEQ ID NO: 603738 - DNA, 25 bp, Homo sapien
ctgtcatcatttgttcaccgtacaa

SEQ ID NO: 603739 - DNA, 25 bp, Homo sapien
gttcaccgtacaattcaaagggatg

SEQ ID NO: 603740 - DNA, 25 bp, Homo sapien
atctgatttaccgttacttcttctc

SEQ ID NO: 603741 - DNA, 25 bp, Homo sapien
tccaggtccttcagtatttgataca

SEQ ID NO: 603742 - DNA, 25 bp, Homo sapien
tgatttctagtctccagatctgtga

SEQ ID NO: 603743 - DNA, 25 bp, Homo sapien
gatctgtgaaacaatacttgtctgt

SEQ ID NO: 603744 - DNA, 25 bp, Homo sapien
tgttgtttaagtcactcagtttgtt

SEQ ID NO: 603745 - DNA, 25 bp, Homo sapien
tcagtttgttgtgacagccctagcc

SEQ ID NO: 603746 - DNA, 25 bp, Homo sapien
cagccctagccctgtagaattggga

SEQ ID NO: 603747 - DNA, 25 bp, Homo sapien
gatttaaaacactgagggcacttga

SEQ ID NO: 603748 - DNA, 25 bp, Homo sapien
gggcacttgaaactctgcttagcat

SEQ ID NO: 603749 - DNA, 25 bp, Homo sapien
tgctttcatcttgtctaggcacaga

SEQ ID NO: 603750 - DNA, 25 bp, Homo sapien
ctttcatcttgtctaggcacagaga

SEQ ID NO: 603751 - DNA, 25 bp, Homo sapien
tcatcttgtctaggcacagagatgt

SEQ ID NO: 603752 - DNA, 25 bp, Homo sapien
gggataaaccaagataactgccatg

SEQ ID NO: 603753 - DNA, 25 bp, Homo sapien
aactgccatggttatgttagctaga

SEQ ID NO: 603754 - DNA, 25 bp, Homo sapien
ccatggttatgttagctagagtgtc

SEQ ID NO: 603755 - DNA, 25 bp, Homo sapien
ggttatgttagctagagtgtccatt

SEQ ID NO: 603756 - DNA, 25 bp, Homo sapien
gttagctagagtgtccattggatct

SEQ ID NO: 603757 - DNA, 25 bp, Homo sapien
agtgtccattggatctcagcttctg

SEQ ID NO: 603758 - DNA, 25 bp, Homo sapien
tgtccattggatctcagcttctggt

SEQ ID NO: 603759 - DNA, 25 bp, Homo sapien
atgacctgaggtatggagtgtatcc

SEQ ID NO: 603760 - DNA, 25 bp, Homo sapien
atctcggcactttggaagtccgcgg

SEQ ID NO: 603761 - DNA, 25 bp, Homo sapien
tctcggcactttggaagtccgcggc

SEQ ID NO: 603762 - DNA, 25 bp, Homo sapien
ctcggcactttggaagtccgcggcg

SEQ ID NO: 603763 - DNA, 25 bp, Homo sapien
tcggcactttggaagtccgcggcgg

SEQ ID NO: 603764 - DNA, 25 bp, Homo sapien
cggcactttggaagtccgcggcggg

SEQ ID NO: 603765 - DNA, 25 bp, Homo sapien
ggcactttggaagtccgcggcgggt

SEQ ID NO: 603766 - DNA, 25 bp, Homo sapien
ttggaagtccgcggcgggtggttca

SEQ ID NO: 603767 - DNA, 25 bp, Homo sapien
tggaagtccgcggcgggtggttcac

SEQ ID NO: 603768 - DNA, 25 bp, Homo sapien
gtccgcggcgggtggttcacctgag

SEQ ID NO: 603769 - DNA, 25 bp, Homo sapien
gcaatgagccgagatgtgcactcca

SEQ ID NO: 603770 - DNA, 25 bp, Homo sapien
aatgagccgagatgtgcactccagc

SEQ ID NO: 603771 - DNA, 25 bp, Homo sapien
cctcagtttctttcaaatacagtta

SEQ ID NO: 603772 - DNA, 25 bp, Homo sapien
cagtttctttcaaatacagttatcc

SEQ ID NO: 603773 - DNA, 25 bp, Homo sapien
aggagcgtggttctaccaccccctg

SEQ ID NO: 603774 - DNA, 25 bp, Homo sapien
cccctgggcatacataaatcgacac

SEQ ID NO: 603775 - DNA, 25 bp, Homo sapien
cctgggcatacataaatcgacacat

SEQ ID NO: 603776 - DNA, 25 bp, Homo sapien
ataaatcgacacatgccaagtcctt

SEQ ID NO: 603777 - DNA, 25 bp, Homo sapien
aaatcgacacatgccaagtcctttt

SEQ ID NO: 603778 - DNA, 25 bp, Homo sapien
atcgacacatgccaagtcctttttt

SEQ ID NO: 603779 - DNA, 25 bp, Homo sapien
cgacacatgccaagtccttttttaa

SEQ ID NO: 603780 - DNA, 25 bp, Homo sapien
cagcaagagcaaaacaacctctgtc

SEQ ID NO: 603781 - DNA, 25 bp, Homo sapien
gagcaaaacaacctctgtcacacac

SEQ ID NO: 603782 - DNA, 25 bp, Homo sapien
gggctattcaaactgaagagcctga

SEQ ID NO: 603783 - DNA, 25 bp, Homo sapien
gaagagcctgagttactctcatggc

SEQ ID NO: 603784 - DNA, 25 bp, Homo sapien
gagttactctcatggctttagagaa

SEQ ID NO: 603785 - DNA, 25 bp, Homo sapien
taaatatgtgcagggagattcctcc

SEQ ID NO: 603786 - DNA, 25 bp, Homo sapien
agattcctccccacagagtttttat

SEQ ID NO: 603787 - DNA, 25 bp, Homo sapien
tccccacagagtttttattcagagg

SEQ ID NO: 603788 - DNA, 25 bp, Homo sapien
tattcagagggtctggagtgaacct

SEQ ID NO: 603789 - DNA, 25 bp, Homo sapien
gggtctggagtgaacctcaggaatt

SEQ ID NO: 603790 - DNA, 25 bp, Homo sapien
gaacctcaggaatttgctttttatg

SEQ ID NO: 603791 - DNA, 25 bp, Homo sapien
tcaggaatttgctttttatgtggat

SEQ ID NO: 603792 - DNA, 25 bp, Homo sapien
gtactgtgtgccattcatttttcta

SEQ ID NO: 603793 - DNA, 25 bp, Homo sapien
gaccttatgaaacgcacccccaaag

SEQ ID NO: 603794 - DNA, 25 bp, Homo sapien
cttatgaaacgcacccccaaagcaa

SEQ ID NO: 603795 - DNA, 25 bp, Homo sapien
cccagaggaaggacattttcttcgc

SEQ ID NO: 603796 - DNA, 25 bp, Homo sapien
ccagaggaaggacattttcttcgcc

SEQ ID NO: 603797 - DNA, 25 bp, Homo sapien
cagaggaaggacattttcttcgcca

SEQ ID NO: 603798 - DNA, 25 bp, Homo sapien
agaggaaggacattttcttcgccag

SEQ ID NO: 603799 - DNA, 25 bp, Homo sapien
gaggaaggacattttcttcgccagc

SEQ ID NO: 603800 - DNA, 25 bp, Homo sapien
aggaaggacattttcttcgccagcc

SEQ ID NO: 603801 - DNA, 25 bp, Homo sapien
ggaaggacattttcttcgccagcca

SEQ ID NO: 603802 - DNA, 25 bp, Homo sapien
cattttcttcgccagccacgaggaa

SEQ ID NO: 603803 - DNA, 25 bp, Homo sapien
ttaaaccagctgataattttagaaa

SEQ ID NO: 603804 - DNA, 25 bp, Homo sapien
ttttagaaagtgcttcatgcgcaga

SEQ ID NO: 603805 - DNA, 25 bp, Homo sapien
gaaagtgcttcatgcgcagagactt

SEQ ID NO: 603806 - DNA, 25 bp, Homo sapien
gcttcatgcgcagagacttttattc

SEQ ID NO: 603807 - DNA, 25 bp, Homo sapien
gcgcagagacttttattcaagtcat

SEQ ID NO: 603808 - DNA, 25 bp, Homo sapien
tcaagtcatctttgctttctgctag

SEQ ID NO: 603809 - DNA, 25 bp, Homo sapien
ttgctttctgctagtgctttttttt

SEQ ID NO: 603810 - DNA, 25 bp, Homo sapien
ttttcttgaaatgggacgggatctc

SEQ ID NO: 603811 - DNA, 25 bp, Homo sapien
aaatgggacgggatctcgctctgtc

SEQ ID NO: 603812 - DNA, 25 bp, Homo sapien
agtggcacgatagcagcgcactgca

SEQ ID NO: 603813 - DNA, 25 bp, Homo sapien
gatagcagcgcactgcaacctggac

SEQ ID NO: 603814 - DNA, 25 bp, Homo sapien
caaaggcacatggaatatattttaa

SEQ ID NO: 603815 - DNA, 25 bp, Homo sapien
tatatccacacatttgttgccagat

SEQ ID NO: 603816 - DNA, 25 bp, Homo sapien
atatccacacatttgttgccagatt

SEQ ID NO: 603817 - DNA, 25 bp, Homo sapien
ttcagaaaactgagctgcaatcgct

SEQ ID NO: 603818 - DNA, 25 bp, Homo sapien
aaactgagctgcaatcgctttccta

SEQ ID NO: 603819 - DNA, 25 bp, Homo sapien
ctgagctgcaatcgctttcctaaaa

SEQ ID NO: 603820 - DNA, 25 bp, Homo sapien
gagctgcaatcgctttcctaaaaca

SEQ ID NO: 603821 - DNA, 25 bp, Homo sapien
tgcaatcgctttcctaaaacagtag

SEQ ID NO: 603822 - DNA, 25 bp, Homo sapien
atcgctttcctaaaacagtagtgta

SEQ ID NO: 603823 - DNA, 25 bp, Homo sapien
gctttcctaaaacagtagtgtatta

SEQ ID NO: 603824 - DNA, 25 bp, Homo sapien
taaagtatactcttaggccaggcgt

SEQ ID NO: 603825 - DNA, 25 bp, Homo sapien
tgctggtgagtacccatgtccccag

SEQ ID NO: 603826 - DNA, 25 bp, Homo sapien
tgagtacccatgtccccaggtgaaa

SEQ ID NO: 603827 - DNA, 25 bp, Homo sapien
tacccatgtccccaggtgaaaaaga

SEQ ID NO: 603828 - DNA, 25 bp, Homo sapien
aaagcagctaactaactctgcccaa

SEQ ID NO: 603829 - DNA, 25 bp, Homo sapien
gctaactaactctgcccaatcctaa

SEQ ID NO: 603830 - DNA, 25 bp, Homo sapien
taactctgcccaatcctaaatctgc

SEQ ID NO: 603831 - DNA, 25 bp, Homo sapien
ctaaatctgcctcaaccctcaagaa

SEQ ID NO: 603832 - DNA, 25 bp, Homo sapien
aaactggaaatactctgaaatttgg

SEQ ID NO: 603833 - DNA, 25 bp, Homo sapien
tttggagtaaatatgacttgccttt

SEQ ID NO: 603834 - DNA, 25 bp, Homo sapien
cttgccttttgttggtttcatgcaa

SEQ ID NO: 603835 - DNA, 25 bp, Homo sapien
gccttttgttggtttcatgcaaaaa

SEQ ID NO: 603836 - DNA, 25 bp, Homo sapien
gagctgctttttaccgaaatcacgg

SEQ ID NO: 603837 - DNA, 25 bp, Homo sapien
aatcacggaaaatggcagctctctg

SEQ ID NO: 603838 - DNA, 25 bp, Homo sapien
ggcagctctctgatgctttaaggtt

SEQ ID NO: 603839 - DNA, 25 bp, Homo sapien
caagtatagatttcaggacctcaat

SEQ ID NO: 603840 - DNA, 25 bp, Homo sapien
ctcaataaggtacccatcccaattt

SEQ ID NO: 603841 - DNA, 25 bp, Homo sapien
gtacccatcccaatttttaatctct

SEQ ID NO: 603842 - DNA, 25 bp, Homo sapien
agagatttactcacatccaccataa

SEQ ID NO: 603843 - DNA, 25 bp, Homo sapien
accataatgcttctggcctcagttt

SEQ ID NO: 603844 - DNA, 25 bp, Homo sapien
gcctcagtttaagccatttcctcta

SEQ ID NO: 603845 - DNA, 25 bp, Homo sapien
tgcccaagtgatgagagcggtgaat

SEQ ID NO: 603846 - DNA, 25 bp, Homo sapien
tgggttatttctttgtttcccatga

SEQ ID NO: 603847 - DNA, 25 bp, Homo sapien
tctccacactgccatctgtgaaatc

SEQ ID NO: 603848 - DNA, 25 bp, Homo sapien
gtgaaatcatcacctctatcagaga

SEQ ID NO: 603849 - DNA, 25 bp, Homo sapien
gaaatcatcacctctatcagagaga

SEQ ID NO: 603850 - DNA, 25 bp, Homo sapien
tcatcacctctatcagagagatcag

SEQ ID NO: 603851 - DNA, 25 bp, Homo sapien
atcagagagatcagcaaacgtaact

SEQ ID NO: 603852 - DNA, 25 bp, Homo sapien
gagagatcagcaaacgtaactagtt

SEQ ID NO: 603853 - DNA, 25 bp, Homo sapien
gatcagcaaacgtaactagttcaaa

SEQ ID NO: 603854 - DNA, 25 bp, Homo sapien
gttcaaatagttcagctgacgcagg

SEQ ID NO: 603855 - DNA, 25 bp, Homo sapien
tcaaatagttcagctgacgcaggag

SEQ ID NO: 603856 - DNA, 25 bp, Homo sapien
gcagcagtgaacaatgattgcctca

SEQ ID NO: 603857 - DNA, 25 bp, Homo sapien
aacaatgattgcctcactgcactct

SEQ ID NO: 603858 - DNA, 25 bp, Homo sapien
ctatagctaataattctgtattgtt

SEQ ID NO: 603859 - DNA, 25 bp, Homo sapien
gtttacttgaagtttgctaagacaa

SEQ ID NO: 603860 - DNA, 25 bp, Homo sapien
taagacaaatttgcttaagtgcccc

SEQ ID NO: 603861 - DNA, 25 bp, Homo sapien
cccaccgaactactacataaattag

SEQ ID NO: 603862 - DNA, 25 bp, Homo sapien
gtataattatatccagtcatcacat

SEQ ID NO: 603863 - DNA, 25 bp, Homo sapien
ttatatccagtcatcacattgtaca

SEQ ID NO: 603864 - DNA, 25 bp, Homo sapien
gctgggaagaaaacgataaaactga

SEQ ID NO: 603865 - DNA, 25 bp, Homo sapien
ttctctctcaaatggtacaagtttt

SEQ ID NO: 603866 - DNA, 25 bp, Homo sapien
ctcaaatggtacaagttttcagttt

SEQ ID NO: 603867 - DNA, 25 bp, Homo sapien
gttttaagacaagttctgggaatct

SEQ ID NO: 603868 - DNA, 25 bp, Homo sapien
taagacaagttctgggaatctaatg

SEQ ID NO: 603869 - DNA, 25 bp, Homo sapien
tcactctgtatatgattgtgctttg

SEQ ID NO: 603870 - DNA, 25 bp, Homo sapien
gtgctttgttttcaggaagctcaat

SEQ ID NO: 603871 - DNA, 25 bp, Homo sapien
gaagctcaatatgcacacataaggc

SEQ ID NO: 603872 - DNA, 25 bp, Homo sapien
tcacattcattattccatgcatctt

SEQ ID NO: 603873 - DNA, 25 bp, Homo sapien
catgcatcttattaacaacctaggg

SEQ ID NO: 603874 - DNA, 25 bp, Homo sapien
acaacctagggagagaggatgtttt

SEQ ID NO: 603875 - DNA, 25 bp, Homo sapien
gtcacacattgttagtagtggaact

SEQ ID NO: 603876 - DNA, 25 bp, Homo sapien
gggcaaaccccacttggactctaga

SEQ ID NO: 603877 - DNA, 25 bp, Homo sapien
cccacttggactctagatcagcatg

SEQ ID NO: 603878 - DNA, 25 bp, Homo sapien
ggactctagatcagcatgtttcact

SEQ ID NO: 603879 - DNA, 25 bp, Homo sapien
tagatcagcatgtttcactctacaa

SEQ ID NO: 603880 - DNA, 25 bp, Homo sapien
agagcacaagaagtttcttcagcaa

SEQ ID NO: 603881 - DNA, 25 bp, Homo sapien
agaagtttcttcagcaatttagagc

SEQ ID NO: 603882 - DNA, 25 bp, Homo sapien
gtttcttcagcaatttagagctacc

SEQ ID NO: 603883 - DNA, 25 bp, Homo sapien
tagagctaccaattgtttcttgact

SEQ ID NO: 603884 - DNA, 25 bp, Homo sapien
gctaccaattgtttcttgactatat

SEQ ID NO: 603885 - DNA, 25 bp, Homo sapien
catttgacaaatttaagaacccagt

SEQ ID NO: 603886 - DNA, 25 bp, Homo sapien
aagaacccagtctttagtgatgcaa

SEQ ID NO: 603887 - DNA, 25 bp, Homo sapien
gaaccattaagaacaaggaattgct

SEQ ID NO: 603888 - DNA, 25 bp, Homo sapien
aaggaattgcttaaatcccttagct

SEQ ID NO: 603889 - DNA, 25 bp, Homo sapien
gcttaaatcccttagctggtgagga

SEQ ID NO: 603890 - DNA, 25 bp, Homo sapien
cccttagctggtgaggatatacatc

SEQ ID NO: 603891 - DNA, 25 bp, Homo sapien
cttcaatcagatctctcaacttgtt

SEQ ID NO: 603892 - DNA, 25 bp, Homo sapien
ttcaatcagatctctcaacttgttg

SEQ ID NO: 603893 - DNA, 25 bp, Homo sapien
tcaatcagatctctcaacttgttga

SEQ ID NO: 603894 - DNA, 25 bp, Homo sapien
caatcagatctctcaacttgttgaa

SEQ ID NO: 603895 - DNA, 25 bp, Homo sapien
aatcagatctctcaacttgttgaac

SEQ ID NO: 603896 - DNA, 25 bp, Homo sapien
atcagatctctcaacttgttgaaca

SEQ ID NO: 603897 - DNA, 25 bp, Homo sapien
tcagatctctcaacttgttgaacat

SEQ ID NO: 603898 - DNA, 25 bp, Homo sapien
agatctctcaacttgttgaacatga

SEQ ID NO: 603899 - DNA, 25 bp, Homo sapien
gatctctcaacttgttgaacatgag

SEQ ID NO: 603900 - DNA, 25 bp, Homo sapien
atctctcaacttgttgaacatgagc

SEQ ID NO: 603901 - DNA, 25 bp, Homo sapien
tctcaacttgttgaacatgagcgaa

SEQ ID NO: 603902 - DNA, 25 bp, Homo sapien
tcatcacagcccgactagcctggca

SEQ ID NO: 603903 - DNA, 25 bp, Homo sapien
gactagcctggcaccctgatctcag

SEQ ID NO: 603904 - DNA, 25 bp, Homo sapien
actagcctggcaccctgatctcaga

SEQ ID NO: 603905 - DNA, 25 bp, Homo sapien
taaggttatgcgagtggggccctca

SEQ ID NO: 603906 - DNA, 25 bp, Homo sapien
gggccctcaggataggattaatgcc

SEQ ID NO: 603907 - DNA, 25 bp, Homo sapien
gccctcaggataggattaatgccct

SEQ ID NO: 603908 - DNA, 25 bp, Homo sapien
cctcaggataggattaatgccctta

SEQ ID NO: 603909 - DNA, 25 bp, Homo sapien
aggaggagacgcaggctgtctctct

SEQ ID NO: 603910 - DNA, 25 bp, Homo sapien
tgtgctccacgccatgtgaggatac

SEQ ID NO: 603911 - DNA, 25 bp, Homo sapien
caagaagtcggcagtctgcaatcag

SEQ ID NO: 603912 - DNA, 25 bp, Homo sapien
tcagaaagaaagccctcatcacagc

SEQ ID NO: 603913 - DNA, 25 bp, Homo sapien
tacctgcccatatggctgtgaattc

SEQ ID NO: 603914 - DNA, 25 bp, Homo sapien
tacctcacccctcttgatggataat

SEQ ID NO: 603915 - DNA, 25 bp, Homo sapien
cacccctcttgatggataatcccaa

SEQ ID NO: 603916 - DNA, 25 bp, Homo sapien
gatggataatcccaagcaggagtga

SEQ ID NO: 603917 - DNA, 25 bp, Homo sapien
taatcccaagcaggagtgaatccca

SEQ ID NO: 603918 - DNA, 25 bp, Homo sapien
ggagtgaatcccaggtaatgggctt

SEQ ID NO: 603919 - DNA, 25 bp, Homo sapien
ggtaatgggcttgatcacactcctg

SEQ ID NO: 603920 - DNA, 25 bp, Homo sapien
taatgggcttgatcacactcctgta

SEQ ID NO: 603921 - DNA, 25 bp, Homo sapien
tgggcttgatcacactcctgtactg

SEQ ID NO: 603922 - DNA, 25 bp, Homo sapien
ttgatcacactcctgtactggcttc

SEQ ID NO: 603923 - DNA, 25 bp, Homo sapien
tttcttgggatcatgtccaaataaa

SEQ ID NO: 603924 - DNA, 25 bp, Homo sapien
agacagcactttatacttttaggga

SEQ ID NO: 603925 - DNA, 25 bp, Homo sapien
gcactttatacttttagggatgatt

SEQ ID NO: 603926 - DNA, 25 bp, Homo sapien
agggatgatttctataattcatgag

SEQ ID NO: 603927 - DNA, 25 bp, Homo sapien
aattcatgagtggagaggtttctct

SEQ ID NO: 603928 - DNA, 25 bp, Homo sapien
ggtgtaggggactggaaaccacatc

SEQ ID NO: 603929 - DNA, 25 bp, Homo sapien
ggaagtacagctttctctcctgagc

SEQ ID NO: 603930 - DNA, 25 bp, Homo sapien
tctcctgagcatgaaggtatcttgg

SEQ ID NO: 603931 - DNA, 25 bp, Homo sapien
gagcatgaaggtatcttggcatttc

SEQ ID NO: 603932 - DNA, 25 bp, Homo sapien
tgaaggtatcttggcatttcttcac

SEQ ID NO: 603933 - DNA, 25 bp, Homo sapien
gcatttcttcactgcaattgccatt

SEQ ID NO: 603934 - DNA, 25 bp, Homo sapien
ttcactgcaattgccatttgccttt

SEQ ID NO: 603935 - DNA, 25 bp, Homo sapien
tgagtacattgccagctggaaggaa

SEQ ID NO: 603936 - DNA, 25 bp, Homo sapien
cagctggaaggaaattgctacaagc

SEQ ID NO: 603937 - DNA, 25 bp, Homo sapien
tgctacaagcaactcttcggctaac

SEQ ID NO: 603938 - DNA, 25 bp, Homo sapien
gcaactcttcggctaacttcaaagg

SEQ ID NO: 603939 - DNA, 25 bp, Homo sapien
ggctaacttcaaaggattcaggttt

SEQ ID NO: 603940 - DNA, 25 bp, Homo sapien
ggattcaggtttaatcaagcacaga

SEQ ID NO: 603941 - DNA, 25 bp, Homo sapien
ataccagatgatacttactatgaaa

SEQ ID NO: 603942 - DNA, 25 bp, Homo sapien
gtttatcaagaaccaaatgtaacta

SEQ ID NO: 603943 - DNA, 25 bp, Homo sapien
atgtaactagattaacgcctgattc

SEQ ID NO: 603944 - DNA, 25 bp, Homo sapien
taacgcctgattctacttatggact

SEQ ID NO: 603945 - DNA, 25 bp, Homo sapien
gcctgattctacttatggactataa

SEQ ID NO: 603946 - DNA, 25 bp, Homo sapien
cagtcctcccttaatcaagtaatat

SEQ ID NO: 603947 - DNA, 25 bp, Homo sapien
ttatgaggtgcccacttagtgccag

SEQ ID NO: 603948 - DNA, 25 bp, Homo sapien
cacttagtgccagccattggctaag

SEQ ID NO: 603949 - DNA, 25 bp, Homo sapien
cattggctaagcaatcagtgagcaa

SEQ ID NO: 603950 - DNA, 25 bp, Homo sapien
cagtgagcaaaaccggcacagcgct

SEQ ID NO: 603951 - DNA, 25 bp, Homo sapien
ggcacagcgctgcttcttaagatag

SEQ ID NO: 603952 - DNA, 25 bp, Homo sapien
gcttcttaagataggctaccccaag

SEQ ID NO: 603953 - DNA, 25 bp, Homo sapien
ggctaccccaagcaaagaaggagta

SEQ ID NO: 603954 - DNA, 25 bp, Homo sapien
gaaggagtaatcacaaactgggaga

SEQ ID NO: 603955 - DNA, 25 bp, Homo sapien
ctgcttctgtggatagaaagtggtt

SEQ ID NO: 603956 - DNA, 25 bp, Homo sapien
aggcctctttgagaagtatttgtga

SEQ ID NO: 603957 - DNA, 25 bp, Homo sapien
cctcaagttcttgggcaccaagtac

SEQ ID NO: 603958 - DNA, 25 bp, Homo sapien
tcttgggcaccaagtacctggaggt

SEQ ID NO: 603959 - DNA, 25 bp, Homo sapien
tacctggaggtgacgctgagtggca

SEQ ID NO: 603960 - DNA, 25 bp, Homo sapien
agtggcatggactgggcctgcccct

SEQ ID NO: 603961 - DNA, 25 bp, Homo sapien
tgccccaacatgacggcgggcgacg

SEQ ID NO: 603962 - DNA, 25 bp, Homo sapien
acgggccgctggtcatcatgggtga

SEQ ID NO: 603963 - DNA, 25 bp, Homo sapien
ggtcatcatgggtgaggtgcgcgat

SEQ ID NO: 603964 - DNA, 25 bp, Homo sapien
gaggtgcgcgatggcgtggccgtgc

SEQ ID NO: 603965 - DNA, 25 bp, Homo sapien
ccgccagcgagaagcgcgtcaagaa

SEQ ID NO: 603966 - DNA, 25 bp, Homo sapien
tgctggagaagcaggcctgcgagct

SEQ ID NO: 603967 - DNA, 25 bp, Homo sapien
cccgtcctggtgaataaacgcactc

SEQ ID NO: 603968 - DNA, 25 bp, Homo sapien
tgtgcgtccaggacgtcgccccaaa

SEQ ID NO: 603969 - DNA, 25 bp, Homo sapien
acgtcgccccaaacctgcagaggtg

SEQ ID NO: 603970 - DNA, 25 bp, Homo sapien
tgcagaggtgcgagcggctccccga

SEQ ID NO: 603971 - DNA, 25 bp, Homo sapien
gacggccgcgggacctaccagtgca

SEQ ID NO: 603972 - DNA, 25 bp, Homo sapien
gcgggacctaccagtgcaaggcgaa

SEQ ID NO: 603973 - DNA, 25 bp, Homo sapien
ctaccagtgcaaggcgaacgtcttc

SEQ ID NO: 603974 - DNA, 25 bp, Homo sapien
agtgcaaggcgaacgtcttcctgtc

SEQ ID NO: 603975 - DNA, 25 bp, Homo sapien
aaggcgaacgtcttcctgtccctgc

SEQ ID NO: 603976 - DNA, 25 bp, Homo sapien
cgctcaccccgcagttaatggcaaa

SEQ ID NO: 603977 - DNA, 25 bp, Homo sapien
tcaccccgcagttaatggcaaacga

SEQ ID NO: 603978 - DNA, 25 bp, Homo sapien
ccccgcagttaatggcaaacgaata

SEQ ID NO: 603979 - DNA, 25 bp, Homo sapien
aggcatggtgccgtacccatagtct

SEQ ID NO: 603980 - DNA, 25 bp, Homo sapien
catggtgccgtacccatagtcttag

SEQ ID NO: 603981 - DNA, 25 bp, Homo sapien
ggtgccgtacccatagtcttagcta

SEQ ID NO: 603982 - DNA, 25 bp, Homo sapien
tgccgtacccatagtcttagctact

SEQ ID NO: 603983 - DNA, 25 bp, Homo sapien
tatctgagccctggcggttgaggct

SEQ ID NO: 603984 - DNA, 25 bp, Homo sapien
tgagccctggcggttgaggctataa

SEQ ID NO: 603985 - DNA, 25 bp, Homo sapien
gccctggcggttgaggctataatga

SEQ ID NO: 603986 - DNA, 25 bp, Homo sapien
cctggcggttgaggctataatgagc

SEQ ID NO: 603987 - DNA, 25 bp, Homo sapien
gaaccaagaaattactggacctgag

SEQ ID NO: 603988 - DNA, 25 bp, Homo sapien
ccaagaaattactggacctgaggcc

SEQ ID NO: 603989 - DNA, 25 bp, Homo sapien
ggacctgaggcctggcctttagctg

SEQ ID NO: 603990 - DNA, 25 bp, Homo sapien
gggcaggataactcactggaatgta

SEQ ID NO: 603991 - DNA, 25 bp, Homo sapien
ggataactcactggaatgtacagta

SEQ ID NO: 603992 - DNA, 25 bp, Homo sapien
aggaatggaatcttctccagtatga

SEQ ID NO: 603993 - DNA, 25 bp, Homo sapien
tcttctccagtatgaaattaccaga

SEQ ID NO: 603994 - DNA, 25 bp, Homo sapien
aaataatgtaatgatgctgaggata

SEQ ID NO: 603995 - DNA, 25 bp, Homo sapien
ctgaggatataagcttttagaaggt

SEQ ID NO: 603996 - DNA, 25 bp, Homo sapien
tgatggtatttctttctcgaatgaa

SEQ ID NO: 603997 - DNA, 25 bp, Homo sapien
ttctttctcgaatgaaaagctgctg

SEQ ID NO: 603998 - DNA, 25 bp, Homo sapien
gaaaagctgctggtttaccctcaac

SEQ ID NO: 603999 - DNA, 25 bp, Homo sapien
cattaccatgagtgaatttatatct

SEQ ID NO: 604000 - DNA, 25 bp, Homo sapien
tatctaattatttccacttgccctg

SEQ ID NO: 604001 - DNA, 25 bp, Homo sapien
cagttttaagtcaaaaggtattctg

SEQ ID NO: 604002 - DNA, 25 bp, Homo sapien
gaatataataaaagcctcacaaatt

SEQ ID NO: 604003 - DNA, 25 bp, Homo sapien
gtagttcatatttagtatatcagta

SEQ ID NO: 604004 - DNA, 25 bp, Homo sapien
gacatctttatagtcaactcttaat

SEQ ID NO: 604005 - DNA, 25 bp, Homo sapien
tatagtcaactcttaattaatgctt

SEQ ID NO: 604006 - DNA, 25 bp, Homo sapien
ttaatgcttattgtaccaaatcttt

SEQ ID NO: 604007 - DNA, 25 bp, Homo sapien
gaaatatgtactttcatgctaaaat

SEQ ID NO: 604008 - DNA, 25 bp, Homo sapien
gactgtgctataatttggcatgtca

SEQ ID NO: 604009 - DNA, 25 bp, Homo sapien
ttggcatgtcattatctagatttat

SEQ ID NO: 604010 - DNA, 25 bp, Homo sapien
gtatgtacgtatttcaggtccttga

SEQ ID NO: 604011 - DNA, 25 bp, Homo sapien
gtacgtatttcaggtccttgaaatt

SEQ ID NO: 604012 - DNA, 25 bp, Homo sapien
agtgctgggattaaaataaattgtt

SEQ ID NO: 604013 - DNA, 25 bp, Homo sapien
gtgctgggattaaaataaattgttt

SEQ ID NO: 604014 - DNA, 25 bp, Homo sapien
agccatgatcatactattgcacttc

SEQ ID NO: 604015 - DNA, 25 bp, Homo sapien
gccatgatcatactattgcacttca

SEQ ID NO: 604016 - DNA, 25 bp, Homo sapien
ccatgatcatactattgcacttcag

SEQ ID NO: 604017 - DNA, 25 bp, Homo sapien
catgatcatactattgcacttcagc

SEQ ID NO: 604018 - DNA, 25 bp, Homo sapien
atgatcatactattgcacttcagca

SEQ ID NO: 604019 - DNA, 25 bp, Homo sapien
tgatcatactattgcacttcagcat

SEQ ID NO: 604020 - DNA, 25 bp, Homo sapien
gatcatactattgcacttcagcatg

SEQ ID NO: 604021 - DNA, 25 bp, Homo sapien
atcatactattgcacttcagcatgg

SEQ ID NO: 604022 - DNA, 25 bp, Homo sapien
atactattgcacttcagcatgggcg

SEQ ID NO: 604023 - DNA, 25 bp, Homo sapien
ggtaccctcctcaacttatgacgca

SEQ ID NO: 604024 - DNA, 25 bp, Homo sapien
accctcctcaacttatgacgcagtt

SEQ ID NO: 604025 - DNA, 25 bp, Homo sapien
ctcctcaacttatgacgcagttgtg

SEQ ID NO: 604026 - DNA, 25 bp, Homo sapien
caacttatgacgcagttgtgatggg

SEQ ID NO: 604027 - DNA, 25 bp, Homo sapien
gttacttcggataaaccaactctat

SEQ ID NO: 604028 - DNA, 25 bp, Homo sapien
acttcggataaaccaactctatatt

SEQ ID NO: 604029 - DNA, 25 bp, Homo sapien
ggataaaccaactctatattgaaaa

SEQ ID NO: 604030 - DNA, 25 bp, Homo sapien
agtcaaaaatacacgttcgggccag

SEQ ID NO: 604031 - DNA, 25 bp, Homo sapien
caaaaatacacgttcgggccaggcg

SEQ ID NO: 604032 - DNA, 25 bp, Homo sapien
aaatacacgttcgggccaggcgcgg

SEQ ID NO: 604033 - DNA, 25 bp, Homo sapien
cgagcagatcaggagttgaggagtt

SEQ ID NO: 604034 - DNA, 25 bp, Homo sapien
agaacttccactcggtgcgggagat

SEQ ID NO: 604035 - DNA, 25 bp, Homo sapien
tgttcgagtcacagaggatcggctt

SEQ ID NO: 604036 - DNA, 25 bp, Homo sapien
ggatcggcttgaacaactctccagt

SEQ ID NO: 604037 - DNA, 25 bp, Homo sapien
aacaactctccagtgaacgggaata

SEQ ID NO: 604038 - DNA, 25 bp, Homo sapien
gaacgggaatagtagctgtcaaatg

SEQ ID NO: 604039 - DNA, 25 bp, Homo sapien
tgtaccgcacgtccggagctttcgt

SEQ ID NO: 604040 - DNA, 25 bp, Homo sapien
ggagctttcgtctacgactgtagca

SEQ ID NO: 604041 - DNA, 25 bp, Homo sapien
tgtagcaagttttgacacaccctca

SEQ ID NO: 604042 - DNA, 25 bp, Homo sapien
acacaccctcaaagccgaactaaat

SEQ ID NO: 604043 - DNA, 25 bp, Homo sapien
gaactaaatcgaaccccaaagcagg

SEQ ID NO: 604044 - DNA, 25 bp, Homo sapien
ggaacccatcaaggcaaaatcgaaa

SEQ ID NO: 604045 - DNA, 25 bp, Homo sapien
acacgagaccagtggacggtatatt

SEQ ID NO: 604046 - DNA, 25 bp, Homo sapien
accagtggacggtatattgccgggt

SEQ ID NO: 604047 - DNA, 25 bp, Homo sapien
tggacggtatattgccgggtcatcc

SEQ ID NO: 604048 - DNA, 25 bp, Homo sapien
gtatattgccgggtcatccgagaaa

SEQ ID NO: 604049 - DNA, 25 bp, Homo sapien
atattgccgggtcatccgagaaaag

SEQ ID NO: 604050 - DNA, 25 bp, Homo sapien
tgcggtggtaccagcgctgctgcca

SEQ ID NO: 604051 - DNA, 25 bp, Homo sapien
tatgcaaacaagatgcgccagccac

SEQ ID NO: 604052 - DNA, 25 bp, Homo sapien
tcgtgacacgcagtcccaagggtcg

SEQ ID NO: 604053 - DNA, 25 bp, Homo sapien
gtgacacgcagtcccaagggtcgct

SEQ ID NO: 604054 - DNA, 25 bp, Homo sapien
cacgcagtcccaagggtcgctcaaa

SEQ ID NO: 604055 - DNA, 25 bp, Homo sapien
gcaagcctaccagccttgtggccac

SEQ ID NO: 604056 - DNA, 25 bp, Homo sapien
gcaatggaaaagatcgcagggagtc

SEQ ID NO: 604057 - DNA, 25 bp, Homo sapien
aaagatcgcagggagtcccaagacc

SEQ ID NO: 604058 - DNA, 25 bp, Homo sapien
ggagtcccaagacccgggatgctcc

SEQ ID NO: 604059 - DNA, 25 bp, Homo sapien
gatgctccctcgagtcactcacagg

SEQ ID NO: 604060 - DNA, 25 bp, Homo sapien
tcgagtcactcacaggagctccaga

SEQ ID NO: 604061 - DNA, 25 bp, Homo sapien
agtcactcacaggagctccagagga

SEQ ID NO: 604062 - DNA, 25 bp, Homo sapien
ggcaatatttgaagcaacaatgact

SEQ ID NO: 604063 - DNA, 25 bp, Homo sapien
aagcaacaatgactgggaatttttc

SEQ ID NO: 604064 - DNA, 25 bp, Homo sapien
gggaaaatgcagatctagacacttt

SEQ ID NO: 604065 - DNA, 25 bp, Homo sapien
atgcagatctagacacttttcagaa

SEQ ID NO: 604066 - DNA, 25 bp, Homo sapien
gaaacactatgaaactccaaagtca

SEQ ID NO: 604067 - DNA, 25 bp, Homo sapien
ctggggccagcagcatcacctagga

SEQ ID NO: 604068 - DNA, 25 bp, Homo sapien
catcacctaggaaattatgagaaat

SEQ ID NO: 604069 - DNA, 25 bp, Homo sapien
ggaaattatgagaaatacagactct

SEQ ID NO: 604070 - DNA, 25 bp, Homo sapien
tttgagtagcacttaacaggactat

SEQ ID NO: 604071 - DNA, 25 bp, Homo sapien
ttgagtagcacttaacaggactata

SEQ ID NO: 604072 - DNA, 25 bp, Homo sapien
gagtagcacttaacaggactataaa

SEQ ID NO: 604073 - DNA, 25 bp, Homo sapien
agtagcacttaacaggactataaaa

SEQ ID NO: 604074 - DNA, 25 bp, Homo sapien
tttggaaatcatcttcccccaccgt

SEQ ID NO: 604075 - DNA, 25 bp, Homo sapien
ggaaatcatcttcccccaccgtagt

SEQ ID NO: 604076 - DNA, 25 bp, Homo sapien
caccgtagtggcaacaaaacgttct

SEQ ID NO: 604077 - DNA, 25 bp, Homo sapien
cgtagtggcaacaaaacgttctttg

SEQ ID NO: 604078 - DNA, 25 bp, Homo sapien
agacccagggttagccagacaggca

SEQ ID NO: 604079 - DNA, 25 bp, Homo sapien
gaagcagagatccagccttctggaa

SEQ ID NO: 604080 - DNA, 25 bp, Homo sapien
ctggaaaaaggcctagacggagcaa

SEQ ID NO: 604081 - DNA, 25 bp, Homo sapien
atgcagtcgaagatctagaaagcgt

SEQ ID NO: 604082 - DNA, 25 bp, Homo sapien
aagcgtgggtaaaggagccgtccat

SEQ ID NO: 604083 - DNA, 25 bp, Homo sapien
aaggagccgtccatgacgttaaaga

SEQ ID NO: 604084 - DNA, 25 bp, Homo sapien
acgttaaagacgtccttgactcagt

SEQ ID NO: 604085 - DNA, 25 bp, Homo sapien
gacgtccttgactcagtactatagc

SEQ ID NO: 604086 - DNA, 25 bp, Homo sapien
tgagaaatgatacccaggagcagca

SEQ ID NO: 604087 - DNA, 25 bp, Homo sapien
ggagcagcaggctttacgtcttcag

SEQ ID NO: 604088 - DNA, 25 bp, Homo sapien
gctttacgtcttcagcctaaaacct

SEQ ID NO: 604089 - DNA, 25 bp, Homo sapien
taggaacagacgtggggcactgtca

SEQ ID NO: 604090 - DNA, 25 bp, Homo sapien
aggaacagacgtggggcactgtcag

SEQ ID NO: 604091 - DNA, 25 bp, Homo sapien
gaacagacgtggggcactgtcagca

SEQ ID NO: 604092 - DNA, 25 bp, Homo sapien
aacagacgtggggcactgtcagcat

SEQ ID NO: 604093 - DNA, 25 bp, Homo sapien
acagacgtggggcactgtcagcatc

SEQ ID NO: 604094 - DNA, 25 bp, Homo sapien
cagacgtggggcactgtcagcatca

SEQ ID NO: 604095 - DNA, 25 bp, Homo sapien
cactgtcagcatcagcctcataaga

SEQ ID NO: 604096 - DNA, 25 bp, Homo sapien
actgtcagcatcagcctcataagaa

SEQ ID NO: 604097 - DNA, 25 bp, Homo sapien
ctgtcagcatcagcctcataagaaa

SEQ ID NO: 604098 - DNA, 25 bp, Homo sapien
tgtcagcatcagcctcataagaaaa

SEQ ID NO: 604099 - DNA, 25 bp, Homo sapien
attagctggatgtgatgcctcatgc

SEQ ID NO: 604100 - DNA, 25 bp, Homo sapien
tttcattattgtaggtaaacggtag

SEQ ID NO: 604101 - DNA, 25 bp, Homo sapien
tgtaggtaaacggtagtggaagcct

SEQ ID NO: 604102 - DNA, 25 bp, Homo sapien
gaaaacatcaagtgctgtaaatatg

SEQ ID NO: 604103 - DNA, 25 bp, Homo sapien
atgtaatctacacaccttcttggct

SEQ ID NO: 604104 - DNA, 25 bp, Homo sapien
taatctacacaccttcttggcttgt

SEQ ID NO: 604105 - DNA, 25 bp, Homo sapien
tacacaccttcttggcttgtctgca

SEQ ID NO: 604106 - DNA, 25 bp, Homo sapien
accttcttggcttgtctgcagtata

SEQ ID NO: 604107 - DNA, 25 bp, Homo sapien
atttaatttatctgtctctgtatat

SEQ ID NO: 604108 - DNA, 25 bp, Homo sapien
gtctctgtatatgaggcttccccct

SEQ ID NO: 604109 - DNA, 25 bp, Homo sapien
gggtcctgcattatggtactttcct

SEQ ID NO: 604110 - DNA, 25 bp, Homo sapien
ggtactttcctgaatttgaaagcaa

SEQ ID NO: 604111 - DNA, 25 bp, Homo sapien
aaaatagccaagtaaatagtcaagg

SEQ ID NO: 604112 - DNA, 25 bp, Homo sapien
aaatagccaagtaaatagtcaagga

SEQ ID NO: 604113 - DNA, 25 bp, Homo sapien
aatagccaagtaaatagtcaaggaa

SEQ ID NO: 604114 - DNA, 25 bp, Homo sapien
atagccaagtaaatagtcaaggaaa

SEQ ID NO: 604115 - DNA, 25 bp, Homo sapien
tagccaagtaaatagtcaaggaaat

SEQ ID NO: 604116 - DNA, 25 bp, Homo sapien
agccaagtaaatagtcaaggaaata

SEQ ID NO: 604117 - DNA, 25 bp, Homo sapien
caagacatagtgcaaaggatatata

SEQ ID NO: 604118 - DNA, 25 bp, Homo sapien
aagacatagtgcaaaggatatataa

SEQ ID NO: 604119 - DNA, 25 bp, Homo sapien
agacatagtgcaaaggatatataaa

SEQ ID NO: 604120 - DNA, 25 bp, Homo sapien
gacatagtgcaaaggatatataaag

SEQ ID NO: 604121 - DNA, 25 bp, Homo sapien
ggtgacagtgagactgtatcaaaaa

SEQ ID NO: 604122 - DNA, 25 bp, Homo sapien
ctgtctccattagaaatacgaaaat

SEQ ID NO: 604123 - DNA, 25 bp, Homo sapien
tgtctccattagaaatacgaaaatt

SEQ ID NO: 604124 - DNA, 25 bp, Homo sapien
gtctccattagaaatacgaaaatta

SEQ ID NO: 604125 - DNA, 25 bp, Homo sapien
ctccattagaaatacgaaaattagc

SEQ ID NO: 604126 - DNA, 25 bp, Homo sapien
ccattagaaatacgaaaattagctg

SEQ ID NO: 604127 - DNA, 25 bp, Homo sapien
tagctgggcgttctggtgtgcctgt

SEQ ID NO: 604128 - DNA, 25 bp, Homo sapien
agctgggcgttctggtgtgcctgta

SEQ ID NO: 604129 - DNA, 25 bp, Homo sapien
tgggcgttctggtgtgcctgtagtc

SEQ ID NO: 604130 - DNA, 25 bp, Homo sapien
gggcgttctggtgtgcctgtagtcc

SEQ ID NO: 604131 - DNA, 25 bp, Homo sapien
gagctgagatctaccactacacccc

SEQ ID NO: 604132 - DNA, 25 bp, Homo sapien
ttgtctctgccatctagaatggaag

SEQ ID NO: 604133 - DNA, 25 bp, Homo sapien
tctagaatggaagctccccgagagc

SEQ ID NO: 604134 - DNA, 25 bp, Homo sapien
gaaccttgtctgtgttgttcatggc

SEQ ID NO: 604135 - DNA, 25 bp, Homo sapien
aggtgctcaaatatttagttgattc

SEQ ID NO: 604136 - DNA, 25 bp, Homo sapien
cattggttgagtgttactacatgac

SEQ ID NO: 604137 - DNA, 25 bp, Homo sapien
gagtgttactacatgacaagtactt

SEQ ID NO: 604138 - DNA, 25 bp, Homo sapien
gtacttatttcacatattaactcat

SEQ ID NO: 604139 - DNA, 25 bp, Homo sapien
cagtgagctataggcctctgggcaa

SEQ ID NO: 604140 - DNA, 25 bp, Homo sapien
agctataggcctctgggcaaatcca

SEQ ID NO: 604141 - DNA, 25 bp, Homo sapien
tgggcaaatccagctccctgcttgt

SEQ ID NO: 604142 - DNA, 25 bp, Homo sapien
tccagctccctgcttgtttttataa

SEQ ID NO: 604143 - DNA, 25 bp, Homo sapien
atgtctaaacattaatttgtctagc

SEQ ID NO: 604144 - DNA, 25 bp, Homo sapien
aatttgtctagcattatcatcttaa

SEQ ID NO: 604145 - DNA, 25 bp, Homo sapien
gtctagcattatcatcttaatgaca

SEQ ID NO: 604146 - DNA, 25 bp, Homo sapien
actagaaaccagcaagtgaaagtgt

SEQ ID NO: 604147 - DNA, 25 bp, Homo sapien
tttatttcctattttctcaaaacag

SEQ ID NO: 604148 - DNA, 25 bp, Homo sapien
tttcctattttctcaaaacagttgt

SEQ ID NO: 604149 - DNA, 25 bp, Homo sapien
taactattaccttaaaaagcactgg

SEQ ID NO: 604150 - DNA, 25 bp, Homo sapien
gcactggtttagaaaaagccataac

SEQ ID NO: 604151 - DNA, 25 bp, Homo sapien
gaaaaagccataacttaaatagtgt

SEQ ID NO: 604152 - DNA, 25 bp, Homo sapien
aatttagcgaatatggtagaaggga

SEQ ID NO: 604153 - DNA, 25 bp, Homo sapien
ctccccttactgaataaattgaaat

SEQ ID NO: 604154 - DNA, 25 bp, Homo sapien
agagaaggtttgctgaccctctcct

SEQ ID NO: 604155 - DNA, 25 bp, Homo sapien
atctacggatgtcccttgtatacca

SEQ ID NO: 604156 - DNA, 25 bp, Homo sapien
ttgtataccactgtgcttgcactac

SEQ ID NO: 604157 - DNA, 25 bp, Homo sapien
ttgcactacatcaagacagcgattg

SEQ ID NO: 604158 - DNA, 25 bp, Homo sapien
acagcgattgtggacttgataccat

SEQ ID NO: 604159 - DNA, 25 bp, Homo sapien
caagatttcctcgtgaatgccagaa

SEQ ID NO: 604160 - DNA, 25 bp, Homo sapien
agaggtttgcgtgggtctagatcct

SEQ ID NO: 604161 - DNA, 25 bp, Homo sapien
tagatcctggctttgctagtcctag

SEQ ID NO: 604162 - DNA, 25 bp, Homo sapien
gacgttgggcaaatcacttttccta

SEQ ID NO: 604163 - DNA, 25 bp, Homo sapien
aatcacttttcctatctgtcttaat

SEQ ID NO: 604164 - DNA, 25 bp, Homo sapien
tctgtcttaatttctttgtcagtaa

SEQ ID NO: 604165 - DNA, 25 bp, Homo sapien
gaagagtagatgttttaaaagacct

SEQ ID NO: 604166 - DNA, 25 bp, Homo sapien
gacctgattttaaaagaatgaccaa

SEQ ID NO: 604167 - DNA, 25 bp, Homo sapien
gaatgaccaaaaatagccaagtaaa

SEQ ID NO: 604168 - DNA, 25 bp, Homo sapien
aaaatagccaagtaaatagtcaagg

SEQ ID NO: 604169 - DNA, 25 bp, Homo sapien
aatagccaagtaaatagtcaaggaa

SEQ ID NO: 604170 - DNA, 25 bp, Homo sapien
agccaagtaaatagtcaaggaaata

SEQ ID NO: 604171 - DNA, 25 bp, Homo sapien
caagacatagtgcaaaggatatata

SEQ ID NO: 604172 - DNA, 25 bp, Homo sapien
aagacatagtgcaaaggatatataa

SEQ ID NO: 604173 - DNA, 25 bp, Homo sapien
gacatagtgcaaaggatatataaag

SEQ ID NO: 604174 - DNA, 25 bp, Homo sapien
gaaagagagagataaacttctggta

SEQ ID NO: 604175 - DNA, 25 bp, Homo sapien
gataaacttctggtaaggcatttat

SEQ ID NO: 604176 - DNA, 25 bp, Homo sapien
gcaggacattgctgaggtggatcac

SEQ ID NO: 604177 - DNA, 25 bp, Homo sapien
ggatcacagtgaaggatgcttccgt

SEQ ID NO: 604178 - DNA, 25 bp, Homo sapien
tgaaggatgcttccgtcagggcacc

SEQ ID NO: 604179 - DNA, 25 bp, Homo sapien
ttccgtcagggcaccccggagatgt

SEQ ID NO: 604180 - DNA, 25 bp, Homo sapien
tgtagggatggacccctctacttcc

SEQ ID NO: 604181 - DNA, 25 bp, Homo sapien
acccctctacttccatcatatatat

SEQ ID NO: 604182 - DNA, 25 bp, Homo sapien
ttccatcatatatatgtggctttga

SEQ ID NO: 604183 - DNA, 25 bp, Homo sapien
gtggctttgagaggcaactttgccc

SEQ ID NO: 604184 - DNA, 25 bp, Homo sapien
ggattctgatgtcttattttgtcat

SEQ ID NO: 604185 - DNA, 25 bp, Homo sapien
tgtcctgtcatctcttaacagcagt

SEQ ID NO: 604186 - DNA, 25 bp, Homo sapien
gatcctcaagctggctctccagagg

SEQ ID NO: 604187 - DNA, 25 bp, Homo sapien
gatactaatatctttgctatggaca

SEQ ID NO: 604188 - DNA, 25 bp, Homo sapien
gctatggacattcaagataaccgct

SEQ ID NO: 604189 - DNA, 25 bp, Homo sapien
gataaccgctgtcttgtgctagtgg

SEQ ID NO: 604190 - DNA, 25 bp, Homo sapien
gtgctagtggttctagtccattttc

SEQ ID NO: 604191 - DNA, 25 bp, Homo sapien
gtccattttcaaactgcaaacacgg

SEQ ID NO: 604192 - DNA, 25 bp, Homo sapien
agcagccacaggaaggttgcctttg

SEQ ID NO: 604193 - DNA, 25 bp, Homo sapien
aacatcctgggacggaaggtctgat

SEQ ID NO: 604194 - DNA, 25 bp, Homo sapien
aaggtctgatggagactgccagtga

SEQ ID NO: 604195 - DNA, 25 bp, Homo sapien
aacaaggcctctgccatgctgtggg

SEQ ID NO: 604196 - DNA, 25 bp, Homo sapien
gtgggtctggatgaacatctggaca

SEQ ID NO: 604197 - DNA, 25 bp, Homo sapien
atctggacatggtctcacatgcagc

SEQ ID NO: 604198 - DNA, 25 bp, Homo sapien
ttttccttttacttctcagttgact

SEQ ID NO: 604199 - DNA, 25 bp, Homo sapien
tttccttttacttctcagttgactg

SEQ ID NO: 604200 - DNA, 25 bp, Homo sapien
actcttgggttaaggaagaatgtag

SEQ ID NO: 604201 - DNA, 25 bp, Homo sapien
gaagaatgtagtttcgttttatgtt

SEQ ID NO: 604202 - DNA, 25 bp, Homo sapien
gtttcgttttatgtttaatatcgct

SEQ ID NO: 604203 - DNA, 25 bp, Homo sapien
ttcgttttatgtttaatatcgctca

SEQ ID NO: 604204 - DNA, 25 bp, Homo sapien
tcgttttatgtttaatatcgctcaa

SEQ ID NO: 604205 - DNA, 25 bp, Homo sapien
gttttatgtttaatatcgctcaaag

SEQ ID NO: 604206 - DNA, 25 bp, Homo sapien
ttatgtttaatatcgctcaaagaaa

SEQ ID NO: 604207 - DNA, 25 bp, Homo sapien
gtttaatatcgctcaaagaaaaata

SEQ ID NO: 604208 - DNA, 25 bp, Homo sapien
gaaaaataaaagcatctccctctaa

SEQ ID NO: 604209 - DNA, 25 bp, Homo sapien
tgcaaccatcagtctgttctccatt

SEQ ID NO: 604210 - DNA, 25 bp, Homo sapien
tcacagcttgtgaccttctaagatt

SEQ ID NO: 604211 - DNA, 25 bp, Homo sapien
accttctaagattagctcaccatcc

SEQ ID NO: 604212 - DNA, 25 bp, Homo sapien
acccaactcagcagaatgccctaga

SEQ ID NO: 604213 - DNA, 25 bp, Homo sapien
agaatgccctagagatttatccaag

SEQ ID NO: 604214 - DNA, 25 bp, Homo sapien
tccaagttattgcaggtatttctag

SEQ ID NO: 604215 - DNA, 25 bp, Homo sapien
ttctagtttgttcctttctgttact

SEQ ID NO: 604216 - DNA, 25 bp, Homo sapien
tcctttctgttactgagttctacac

SEQ ID NO: 604217 - DNA, 25 bp, Homo sapien
ttactgagttctacactatgggtgt

SEQ ID NO: 604218 - DNA, 25 bp, Homo sapien
atcattcagcattcacctatcatac

SEQ ID NO: 604219 - DNA, 25 bp, Homo sapien
tcacctatcatacattttggttcct

SEQ ID NO: 604220 - DNA, 25 bp, Homo sapien
atgctacagttatggataagacccg

SEQ ID NO: 604221 - DNA, 25 bp, Homo sapien
cagttatggataagacccgagcttt

SEQ ID NO: 604222 - DNA, 25 bp, Homo sapien
ggataagacccgagctttgattgac

SEQ ID NO: 604223 - DNA, 25 bp, Homo sapien
aagacccgagctttgattgactccg

SEQ ID NO: 604224 - DNA, 25 bp, Homo sapien
acccgagctttgattgactccgtta

SEQ ID NO: 604225 - DNA, 25 bp, Homo sapien
gctttgattgactccgttattccga

SEQ ID NO: 604226 - DNA, 25 bp, Homo sapien
gattgactccgttattccgaaaggg

SEQ ID NO: 604227 - DNA, 25 bp, Homo sapien
gggcacaggcatgccaaatttgcat

SEQ ID NO: 604228 - DNA, 25 bp, Homo sapien
ggcatgccaaatttgcatcacatac

SEQ ID NO: 604229 - DNA, 25 bp, Homo sapien
caaatttgcatcacatacatttgtg

SEQ ID NO: 604230 - DNA, 25 bp, Homo sapien
atttgtgaagaagacagttacctgg

SEQ ID NO: 604231 - DNA, 25 bp, Homo sapien
tgctgatgggccacagtgacgtggt

SEQ ID NO: 604232 - DNA, 25 bp, Homo sapien
ctggcctcatttcaagcactgaagg

SEQ ID NO: 604233 - DNA, 25 bp, Homo sapien
catttcaagcactgaaggaggcccc

SEQ ID NO: 604234 - DNA, 25 bp, Homo sapien
gaaggaggccccactccctttgaga

SEQ ID NO: 604235 - DNA, 25 bp, Homo sapien
gaattgccttcatcggctactttgt

SEQ ID NO: 604236 - DNA, 25 bp, Homo sapien
tgccttcatcggctactttgtagaa

SEQ ID NO: 604237 - DNA, 25 bp, Homo sapien
tcggctactttgtagaaaagcctcc

SEQ ID NO: 604238 - DNA, 25 bp, Homo sapien
agcctccaaatgctgcagcgctgga

SEQ ID NO: 604239 - DNA, 25 bp, Homo sapien
tccaaatgctgcagcgctggaggcg

SEQ ID NO: 604240 - DNA, 25 bp, Homo sapien
ctgatccagtgtgccgtggttgagg

SEQ ID NO: 604241 - DNA, 25 bp, Homo sapien
tgaggggtacctgactccaaactac

SEQ ID NO: 604242 - DNA, 25 bp, Homo sapien
agtccccggtggtgctgatgctgct

SEQ ID NO: 604243 - DNA, 25 bp, Homo sapien
tgatgctgcttgcatggaccagttt

SEQ ID NO: 604244 - DNA, 25 bp, Homo sapien
catacttggagaaacacttggttag

SEQ ID NO: 604245 - DNA, 25 bp, Homo sapien
gaaacacttggttaggaaaactatg

SEQ ID NO: 604246 - DNA, 25 bp, Homo sapien
gttacagattgatcaaagggctctt

SEQ ID NO: 604247 - DNA, 25 bp, Homo sapien
ggctcttaagttccttttgtacaat

SEQ ID NO: 604248 - DNA, 25 bp, Homo sapien
cttttgtacaataaatcactgcgat

SEQ ID NO: 604249 - DNA, 25 bp, Homo sapien
atcactgcgatatcaaatgaggtaa

SEQ ID NO: 604250 - DNA, 25 bp, Homo sapien
atgaacatgctctttgaactcttaa

SEQ ID NO: 604251 - DNA, 25 bp, Homo sapien
tgctctttgaactcttaacttctag

SEQ ID NO: 604252 - DNA, 25 bp, Homo sapien
gaactcttaacttctagaccaatat

SEQ ID NO: 604253 - DNA, 25 bp, Homo sapien
cctcaagttcttgggcaccaagtac

SEQ ID NO: 604254 - DNA, 25 bp, Homo sapien
tcttgggcaccaagtacctggaggt

SEQ ID NO: 604255 - DNA, 25 bp, Homo sapien
tacctggaggtgacgctgagtggca

SEQ ID NO: 604256 - DNA, 25 bp, Homo sapien
agtggcatggactgggcctgcccct

SEQ ID NO: 604257 - DNA, 25 bp, Homo sapien
tgccccaacatgacggcgggcgacg

SEQ ID NO: 604258 - DNA, 25 bp, Homo sapien
acgggccgctggtcatcatgggtga

SEQ ID NO: 604259 - DNA, 25 bp, Homo sapien
tcatgggtgaggtgcgcgatggcgt

SEQ ID NO: 604260 - DNA, 25 bp, Homo sapien
ccgccagcgagaagcgcgtcaagaa

SEQ ID NO: 604261 - DNA, 25 bp, Homo sapien
agaagcaggcctgcgagctgctcaa

SEQ ID NO: 604262 - DNA, 25 bp, Homo sapien
gctgctcaaccgcttccaggactag

SEQ ID NO: 604263 - DNA, 25 bp, Homo sapien
cccgtcctggtgaataaacgcactc

SEQ ID NO: 604264 - DNA, 25 bp, Homo sapien
taggactataggcactggctttata

SEQ ID NO: 604265 - DNA, 25 bp, Homo sapien
aggactataggcactggctttataa

SEQ ID NO: 604266 - DNA, 25 bp, Homo sapien
gactataggcactggctttataatt

SEQ ID NO: 604267 - DNA, 25 bp, Homo sapien
taggcactggctttataatttttat

SEQ ID NO: 604268 - DNA, 25 bp, Homo sapien
gattctaggcatgagtcatcacacc

SEQ ID NO: 604269 - DNA, 25 bp, Homo sapien
ttctaggcatgagtcatcacaccta

SEQ ID NO: 604270 - DNA, 25 bp, Homo sapien
aggcatgagtcatcacacctagcta

SEQ ID NO: 604271 - DNA, 25 bp, Homo sapien
cacctagctagaaaatttttgagac

SEQ ID NO: 604272 - DNA, 25 bp, Homo sapien
tttgagacttgttttacgtccaggt

SEQ ID NO: 604273 - DNA, 25 bp, Homo sapien
gagacttgttttacgtccaggtgtg

SEQ ID NO: 604274 - DNA, 25 bp, Homo sapien
gacttgttttacgtccaggtgtggc

SEQ ID NO: 604275 - DNA, 25 bp, Homo sapien
aaaaatatctatctggatggccggg

SEQ ID NO: 604276 - DNA, 25 bp, Homo sapien
aaaatatctatctggatggccgggt

SEQ ID NO: 604277 - DNA, 25 bp, Homo sapien
aaatatctatctggatggccgggtg

SEQ ID NO: 604278 - DNA, 25 bp, Homo sapien
aatatctatctggatggccgggtgc

SEQ ID NO: 604279 - DNA, 25 bp, Homo sapien
atatctatctggatggccgggtgcg

SEQ ID NO: 604280 - DNA, 25 bp, Homo sapien
tatctatctggatggccgggtgcgg

SEQ ID NO: 604281 - DNA, 25 bp, Homo sapien
atctatctggatggccgggtgcggt

SEQ ID NO: 604282 - DNA, 25 bp, Homo sapien
aggcctggtgcgggcccctgtgatc

SEQ ID NO: 604283 - DNA, 25 bp, Homo sapien
ggcctggtgcgggcccctgtgatcc

SEQ ID NO: 604284 - DNA, 25 bp, Homo sapien
cctggtgcgggcccctgtgatccca

SEQ ID NO: 604285 - DNA, 25 bp, Homo sapien
ctggtgcgggcccctgtgatcccag

SEQ ID NO: 604286 - DNA, 25 bp, Homo sapien
accagtaagggaaaatcgctccaag

SEQ ID NO: 604287 - DNA, 25 bp, Homo sapien
atcgctccaagtgagcatgcacaca

SEQ ID NO: 604288 - DNA, 25 bp, Homo sapien
tgcacacaacctcagtaaacacact

SEQ ID NO: 604289 - DNA, 25 bp, Homo sapien
aacacactgtgcatgtggcttctcc

SEQ ID NO: 604290 - DNA, 25 bp, Homo sapien
ttctcccaagtactagcaggccact

SEQ ID NO: 604291 - DNA, 25 bp, Homo sapien
ggccactgcacatgtcacaactgag

SEQ ID NO: 604292 - DNA, 25 bp, Homo sapien
atgtcacaactgagcaacagcccac

SEQ ID NO: 604293 - DNA, 25 bp, Homo sapien
agcccaccccaatggagggatcaag

SEQ ID NO: 604294 - DNA, 25 bp, Homo sapien
cagtttataaaaatcctgagccaaa

SEQ ID NO: 604295 - DNA, 25 bp, Homo sapien
ttgatctctcaagttccctacttgg

SEQ ID NO: 604296 - DNA, 25 bp, Homo sapien
cttccaagtgtgatttgcttctttt

SEQ ID NO: 604297 - DNA, 25 bp, Homo sapien
atctcagatttggattcttactcta

SEQ ID NO: 604298 - DNA, 25 bp, Homo sapien
atttggattcttactctacctttgc

SEQ ID NO: 604299 - DNA, 25 bp, Homo sapien
ttactctacctttgccacaagtact

SEQ ID NO: 604300 - DNA, 25 bp, Homo sapien
acctttgccacaagtacttctttat

SEQ ID NO: 604301 - DNA, 25 bp, Homo sapien
aatccaaatgcctattctttaaaat

SEQ ID NO: 604302 - DNA, 25 bp, Homo sapien
aaacaagaattttagatcccaagag

SEQ ID NO: 604303 - DNA, 25 bp, Homo sapien
gatcaattttagcttctttcaacac

SEQ ID NO: 604304 - DNA, 25 bp, Homo sapien
ttctttcaacacagatttgtggatg

SEQ ID NO: 604305 - DNA, 25 bp, Homo sapien
gaataattgcttcttctagactgtg

SEQ ID NO: 604306 - DNA, 25 bp, Homo sapien
gcttcttctagactgtgttaaatgg

SEQ ID NO: 604307 - DNA, 25 bp, Homo sapien
gtaaatcttgatctctatttgaaca

SEQ ID NO: 604308 - DNA, 25 bp, Homo sapien
aaaaggctataagggctaggtgcag

SEQ ID NO: 604309 - DNA, 25 bp, Homo sapien
acaagacctcacttgtttctactaa

SEQ ID NO: 604310 - DNA, 25 bp, Homo sapien
caagacctcacttgtttctactaaa

SEQ ID NO: 604311 - DNA, 25 bp, Homo sapien
tagggtgcacctgtagtgtgagata

SEQ ID NO: 604312 - DNA, 25 bp, Homo sapien
gggtgcacctgtagtgtgagatact

SEQ ID NO: 604313 - DNA, 25 bp, Homo sapien
gtgcacctgtagtgtgagatactca

SEQ ID NO: 604314 - DNA, 25 bp, Homo sapien
gcacctgtagtgtgagatactcagg

SEQ ID NO: 604315 - DNA, 25 bp, Homo sapien
gtgagatactcaggggcgatcacct

SEQ ID NO: 604316 - DNA, 25 bp, Homo sapien
tgagcccaggagactcaggatgtag

SEQ ID NO: 604317 - DNA, 25 bp, Homo sapien
agcccaggagactcaggatgtagtg

SEQ ID NO: 604318 - DNA, 25 bp, Homo sapien
ggagactcaggatgtagtgagttat

SEQ ID NO: 604319 - DNA, 25 bp, Homo sapien
aataccttcatgaaaatgcgtccta

SEQ ID NO: 604320 - DNA, 25 bp, Homo sapien
atgaaaatgcgtcctatgtccgccc

SEQ ID NO: 604321 - DNA, 25 bp, Homo sapien
tatgtccgccctcttgaggaaggaa

SEQ ID NO: 604322 - DNA, 25 bp, Homo sapien
ctgaggatactgtgactgtcttgga

SEQ ID NO: 604323 - DNA, 25 bp, Homo sapien
gactgtcttggagacaactgtgaaa

SEQ ID NO: 604324 - DNA, 25 bp, Homo sapien
tttcagaacacttaacctcctacat

SEQ ID NO: 604325 - DNA, 25 bp, Homo sapien
cttaacctcctacatatgttttctt

SEQ ID NO: 604326 - DNA, 25 bp, Homo sapien
tatgttttcttaggaagattcttcc

SEQ ID NO: 604327 - DNA, 25 bp, Homo sapien
gaagattcttccctatcagttaaaa

SEQ ID NO: 604328 - DNA, 25 bp, Homo sapien
atctccattgaatcagaagttctca

SEQ ID NO: 604329 - DNA, 25 bp, Homo sapien
gaagttctcacaataccttcatgaa

SEQ ID NO: 604330 - DNA, 25 bp, Homo sapien
gagccgagattgcatcaccgcattc

SEQ ID NO: 604331 - DNA, 25 bp, Homo sapien
gccgagattgcatcaccgcattcca

SEQ ID NO: 604332 - DNA, 25 bp, Homo sapien
cgagattgcatcaccgcattccagc

SEQ ID NO: 604333 - DNA, 25 bp, Homo sapien
aagcaagacttcatcacacacacac

SEQ ID NO: 604334 - DNA, 25 bp, Homo sapien
agcaagacttcatcacacacacaca

SEQ ID NO: 604335 - DNA, 25 bp, Homo sapien
gcaagacttcatcacacacacacac

SEQ ID NO: 604336 - DNA, 25 bp, Homo sapien
acacacacacaaacgaaacaacaac

SEQ ID NO: 604337 - DNA, 25 bp, Homo sapien
cacacacacaaacgaaacaacaaca

SEQ ID NO: 604338 - DNA, 25 bp, Homo sapien
acacacacaaacgaaacaacaacaa

SEQ ID NO: 604339 - DNA, 25 bp, Homo sapien
cacacacaaacgaaacaacaacaac

SEQ ID NO: 604340 - DNA, 25 bp, Homo sapien
acacacaaacgaaacaacaacaaca

SEQ ID NO: 604341 - DNA, 25 bp, Homo sapien
ttctcctttccttcattatcatcaa

SEQ ID NO: 604342 - DNA, 25 bp, Homo sapien
ttatcatcaacaatatctcaggctg

SEQ ID NO: 604343 - DNA, 25 bp, Homo sapien
atcaacaatatctcaggctgctggt

SEQ ID NO: 604344 - DNA, 25 bp, Homo sapien
gctggtccctcctcaatcaatgagg

SEQ ID NO: 604345 - DNA, 25 bp, Homo sapien
atcaatgaggagacccttcctccta

SEQ ID NO: 604346 - DNA, 25 bp, Homo sapien
tgaggagacccttcctcctatccat

SEQ ID NO: 604347 - DNA, 25 bp, Homo sapien
tgccccagagatgccccagggtgga

SEQ ID NO: 604348 - DNA, 25 bp, Homo sapien
ggatgtggagactgagctgtggaga

SEQ ID NO: 604349 - DNA, 25 bp, Homo sapien
gctgtggagagtgtggttccctccc

SEQ ID NO: 604350 - DNA, 25 bp, Homo sapien
atggaatccccgatgcctggcaggg

SEQ ID NO: 604351 - DNA, 25 bp, Homo sapien
aatccccgatgcctggcagggccag

SEQ ID NO: 604352 - DNA, 25 bp, Homo sapien
ttgaatccccggaatagtgaaaaca

SEQ ID NO: 604353 - DNA, 25 bp, Homo sapien
acaatgaccattgcgtgctgagtac

SEQ ID NO: 604354 - DNA, 25 bp, Homo sapien
accattgcgtgctgagtacctgctc

SEQ ID NO: 604355 - DNA, 25 bp, Homo sapien
ggcatcttacaactctgttccaaag

SEQ ID NO: 604356 - DNA, 25 bp, Homo sapien
aactctgttccaaagtctgtgctgc

SEQ ID NO: 604357 - DNA, 25 bp, Homo sapien
tctgtgctgcttccataggactgtt

SEQ ID NO: 604358 - DNA, 25 bp, Homo sapien
tccataggactgttctcacttcttt

SEQ ID NO: 604359 - DNA, 25 bp, Homo sapien
cttctttccattttgcaagttctca

SEQ ID NO: 604360 - DNA, 25 bp, Homo sapien
gtctccctgcccgagtggatggtgc

SEQ ID NO: 604361 - DNA, 25 bp, Homo sapien
gtgccaccacctcttactgaaggag

SEQ ID NO: 604362 - DNA, 25 bp, Homo sapien
cttactgaaggagcggtttctgagg

SEQ ID NO: 604363 - DNA, 25 bp, Homo sapien
ggtacgcactcggtgaatgtcacgc

SEQ ID NO: 604364 - DNA, 25 bp, Homo sapien
actcggtgaatgtcacgcaaaaccc

SEQ ID NO: 604365 - DNA, 25 bp, Homo sapien
taactgctattgtaaccaattaata

SEQ ID NO: 604366 - DNA, 25 bp, Homo sapien
tattttaactatttgccagctctgc

SEQ ID NO: 604367 - DNA, 25 bp, Homo sapien
tatttgccagctctgcttctgtaaa

SEQ ID NO: 604368 - DNA, 25 bp, Homo sapien
ttgccagctctgcttctgtaaaact

SEQ ID NO: 604369 - DNA, 25 bp, Homo sapien
tgtaaaacttgtttcagctaaactc

SEQ ID NO: 604370 - DNA, 25 bp, Homo sapien
ttttgagcattacatgcctctcggt

SEQ ID NO: 604371 - DNA, 25 bp, Homo sapien
tgagcattacatgcctctcggttgc

SEQ ID NO: 604372 - DNA, 25 bp, Homo sapien
gttgccggctaataaagcactcctt

SEQ ID NO: 604373 - DNA, 25 bp, Homo sapien
cggctaataaagcactccttaattt

SEQ ID NO: 604374 - DNA, 25 bp, Homo sapien
gagaaggcagatgaactacaagtct

SEQ ID NO: 604375 - DNA, 25 bp, Homo sapien
gatgaactacaagtctgcctttctt

SEQ ID NO: 604376 - DNA, 25 bp, Homo sapien
tcttcctggtgcaggacttagccct

SEQ ID NO: 604377 - DNA, 25 bp, Homo sapien
ggacttagccctcctatgcaaataa

SEQ ID NO: 604378 - DNA, 25 bp, Homo sapien
cttagccctcctatgcaaataactc

SEQ ID NO: 604379 - DNA, 25 bp, Homo sapien
aataactcacataactcacaatctt

SEQ ID NO: 604380 - DNA, 25 bp, Homo sapien
acaatcttcctgcactcaacttatg

SEQ ID NO: 604381 - DNA, 25 bp, Homo sapien
ctgcactcaacttatgacctcagtt

SEQ ID NO: 604382 - DNA, 25 bp, Homo sapien
ttatcagcactgcatgtaaccctct

SEQ ID NO: 604383 - DNA, 25 bp, Homo sapien
tgccctttccattcttgcaacgtat

SEQ ID NO: 604384 - DNA, 25 bp, Homo sapien
cctttccattcttgcaacgtatttt

SEQ ID NO: 604385 - DNA, 25 bp, Homo sapien
agcagtgagctgcaccgggccggcg

SEQ ID NO: 604386 - DNA, 25 bp, Homo sapien
tgcactttcccgcagacaggtgagg

SEQ ID NO: 604387 - DNA, 25 bp, Homo sapien
gtccgtcatctccttttgtgaatct

SEQ ID NO: 604388 - DNA, 25 bp, Homo sapien
cgtcatctccttttgtgaatctgga

SEQ ID NO: 604389 - DNA, 25 bp, Homo sapien
catctccttttgtgaatctggagaa

SEQ ID NO: 604390 - DNA, 25 bp, Homo sapien
atctggagaagatttggaccacact

SEQ ID NO: 604391 - DNA, 25 bp, Homo sapien
atttggaccacactgtggtacagcc

SEQ ID NO: 604392 - DNA, 25 bp, Homo sapien
tacagcccagagtgcatttctacca

SEQ ID NO: 604393 - DNA, 25 bp, Homo sapien
aacaaccgttaacatttggtcacat

SEQ ID NO: 604394 - DNA, 25 bp, Homo sapien
aacatttggtcacatttgtggcctg

SEQ ID NO: 604395 - DNA, 25 bp, Homo sapien
ttggtcacatttgtggcctgttttc

SEQ ID NO: 604396 - DNA, 25 bp, Homo sapien
aatatgagcctggtcagatgtggtg

SEQ ID NO: 604397 - DNA, 25 bp, Homo sapien
atatgagcctggtcagatgtggtgg

SEQ ID NO: 604398 - DNA, 25 bp, Homo sapien
ggccaagcgggctattcccttgagc

SEQ ID NO: 604399 - DNA, 25 bp, Homo sapien
gccaagcgggctattcccttgagcc

SEQ ID NO: 604400 - DNA, 25 bp, Homo sapien
caagcgggctattcccttgagccca

SEQ ID NO: 604401 - DNA, 25 bp, Homo sapien
aagcgggctattcccttgagcccag

SEQ ID NO: 604402 - DNA, 25 bp, Homo sapien
ttgagcccaggatttagagagagaa

SEQ ID NO: 604403 - DNA, 25 bp, Homo sapien
gatttagagagagaagcctgggcaa

SEQ ID NO: 604404 - DNA, 25 bp, Homo sapien
atttagagagagaagcctgggcaac

SEQ ID NO: 604405 - DNA, 25 bp, Homo sapien
tttagagagagaagcctgggcaaca

SEQ ID NO: 604406 - DNA, 25 bp, Homo sapien
attgattgagcctgggatttcaagg

SEQ ID NO: 604407 - DNA, 25 bp, Homo sapien
gatttaaaaaacaacacaggctggg

SEQ ID NO: 604408 - DNA, 25 bp, Homo sapien
taaaaaacaacacaggctgggcgcg

SEQ ID NO: 604409 - DNA, 25 bp, Homo sapien
cttgaggtttgcgagttggaaacca

SEQ ID NO: 604410 - DNA, 25 bp, Homo sapien
ttgaggtttgcgagttggaaaccag

SEQ ID NO: 604411 - DNA, 25 bp, Homo sapien
tgaggtttgcgagttggaaaccagt

SEQ ID NO: 604412 - DNA, 25 bp, Homo sapien
gaggtttgcgagttggaaaccagtc

SEQ ID NO: 604413 - DNA, 25 bp, Homo sapien
aggtttgcgagttggaaaccagtct

SEQ ID NO: 604414 - DNA, 25 bp, Homo sapien
ggtttgcgagttggaaaccagtctg

SEQ ID NO: 604415 - DNA, 25 bp, Homo sapien
gtttgcgagttggaaaccagtctga

SEQ ID NO: 604416 - DNA, 25 bp, Homo sapien
tttgcgagttggaaaccagtctgac

SEQ ID NO: 604417 - DNA, 25 bp, Homo sapien
tgagagatggaggttgatgtgagct

SEQ ID NO: 604418 - DNA, 25 bp, Homo sapien
ttagctgtctgttcctgctcacact

SEQ ID NO: 604419 - DNA, 25 bp, Homo sapien
tgctcacactgccagaatcaactgc

SEQ ID NO: 604420 - DNA, 25 bp, Homo sapien
agaatcaactgctgccgacgtcctc

SEQ ID NO: 604421 - DNA, 25 bp, Homo sapien
taccacctgaacctgaccaatgaaa

SEQ ID NO: 604422 - DNA, 25 bp, Homo sapien
gacccgtggtcaactttaacatcag

SEQ ID NO: 604423 - DNA, 25 bp, Homo sapien
tgaacaagcttgcatccctcagatg

SEQ ID NO: 604424 - DNA, 25 bp, Homo sapien
ttttctatgcaggatagcccttctc

SEQ ID NO: 604425 - DNA, 25 bp, Homo sapien
ttctctttgttctggcagacgtgcc

SEQ ID NO: 604426 - DNA, 25 bp, Homo sapien
agacgtgcctttgttttatactgaa

SEQ ID NO: 604427 - DNA, 25 bp, Homo sapien
aaggctgagtctccccagttggcaa

SEQ ID NO: 604428 - DNA, 25 bp, Homo sapien
ctgctggttggaataaagactcttt

SEQ ID NO: 604429 - DNA, 25 bp, Homo sapien
ggaatttcagattgcgttgcatgga

SEQ ID NO: 604430 - DNA, 25 bp, Homo sapien
gattgcgttgcatggaacagagctc

SEQ ID NO: 604431 - DNA, 25 bp, Homo sapien
gaacagagctcccacaagctggccg

SEQ ID NO: 604432 - DNA, 25 bp, Homo sapien
agagctcccacaagctggccgaggg

SEQ ID NO: 604433 - DNA, 25 bp, Homo sapien
agctcccacaagctggccgagggat

SEQ ID NO: 604434 - DNA, 25 bp, Homo sapien
cacaagctggccgagggatgctggg

SEQ ID NO: 604435 - DNA, 25 bp, Homo sapien
gggagaacgcactcagggcaccagg

SEQ ID NO: 604436 - DNA, 25 bp, Homo sapien
gggctcctacgccactcagccagag

SEQ ID NO: 604437 - DNA, 25 bp, Homo sapien
ctcagccagagctgctcttctctta

SEQ ID NO: 604438 - DNA, 25 bp, Homo sapien
tataggttaaaagcttttgacagaa

SEQ ID NO: 604439 - DNA, 25 bp, Homo sapien
gacagaaactatcataaaggtttaa

SEQ ID NO: 604440 - DNA, 25 bp, Homo sapien
ttaagtgcaacttcgtgacctttta

SEQ ID NO: 604441 - DNA, 25 bp, Homo sapien
gcaacttcgtgaccttttaattgag

SEQ ID NO: 604442 - DNA, 25 bp, Homo sapien
gaggtattactgtgtaaccatcacc

SEQ ID NO: 604443 - DNA, 25 bp, Homo sapien
gtgtaaccatcaccagattaatata

SEQ ID NO: 604444 - DNA, 25 bp, Homo sapien
atggaacatcataagtaccctggga

SEQ ID NO: 604445 - DNA, 25 bp, Homo sapien
atcataagtaccctgggagactcct

SEQ ID NO: 604446 - DNA, 25 bp, Homo sapien
gggagactccttgtgctatttccca

SEQ ID NO: 604447 - DNA, 25 bp, Homo sapien
aaagaggtcagcactgttccggttc

SEQ ID NO: 604448 - DNA, 25 bp, Homo sapien
agcactgttccggttcttctattac

SEQ ID NO: 604449 - DNA, 25 bp, Homo sapien
gttccggttcttctattaccatata

SEQ ID NO: 604450 - DNA, 25 bp, Homo sapien
ccatatatttgttttgcctgctcat

SEQ ID NO: 604451 - DNA, 25 bp, Homo sapien
agatcattccctgcccaaattttaa

SEQ ID NO: 604452 - DNA, 25 bp, Homo sapien
tcattccctgcccaaattttaactt

SEQ ID NO: 604453 - DNA, 25 bp, Homo sapien
ttgctggcattctgttgtgaaaaag

SEQ ID NO: 604454 - DNA, 25 bp, Homo sapien
gaaaaagaatattctctgccccaat

SEQ ID NO: 604455 - DNA, 25 bp, Homo sapien
aaagaatattctctgccccaattat

SEQ ID NO: 604456 - DNA, 25 bp, Homo sapien
attaaaacatttcttgcctctcact

SEQ ID NO: 604457 - DNA, 25 bp, Homo sapien
ttgcctctcactctggactattgga

SEQ ID NO: 604458 - DNA, 25 bp, Homo sapien
gcctctcactctggactattggatt

SEQ ID NO: 604459 - DNA, 25 bp, Homo sapien
ctctcactctggactattggatttt

SEQ ID NO: 604460 - DNA, 25 bp, Homo sapien
ctcactctggactattggatttttt

SEQ ID NO: 604461 - DNA, 25 bp, Homo sapien
atgttttaagctttcattattatga

SEQ ID NO: 604462 - DNA, 25 bp, Homo sapien
catgatgtgtgtcttccaacagcag

SEQ ID NO: 604463 - DNA, 25 bp, Homo sapien
gatgtgtgtcttccaacagcagacg

SEQ ID NO: 604464 - DNA, 25 bp, Homo sapien
aatgtggatgcctcattcactgctg

SEQ ID NO: 604465 - DNA, 25 bp, Homo sapien
tcattcactgctgtgtgccggcatc

SEQ ID NO: 604466 - DNA, 25 bp, Homo sapien
tgtgtgccggcatccagagcaggac

SEQ ID NO: 604467 - DNA, 25 bp, Homo sapien
gagcaggcacctgactgatagttgt

SEQ ID NO: 604468 - DNA, 25 bp, Homo sapien
ggcacctgactgatagttgttgaat

SEQ ID NO: 604469 - DNA, 25 bp, Homo sapien
agcactgtgtagaaacactggctga

SEQ ID NO: 604470 - DNA, 25 bp, Homo sapien
aacactggctgaatagtacctagaa

SEQ ID NO: 604471 - DNA, 25 bp, Homo sapien
gtctcaaatacctacattagcaatg

SEQ ID NO: 604472 - DNA, 25 bp, Homo sapien
gaactaagcatctaattcaagaaac

SEQ ID NO: 604473 - DNA, 25 bp, Homo sapien
ggccatcctcataaacattcgtgat

SEQ ID NO: 604474 - DNA, 25 bp, Homo sapien
tcgtgatctagaaactggccgggct

SEQ ID NO: 604475 - DNA, 25 bp, Homo sapien
aggccagagccactttaactaacag

SEQ ID NO: 604476 - DNA, 25 bp, Homo sapien
aggcttttaggtgaactccttggca

SEQ ID NO: 604477 - DNA, 25 bp, Homo sapien
actccttggcagagaaaatctactg

SEQ ID NO: 604478 - DNA, 25 bp, Homo sapien
aaatctactgtggaagcgtaaagct

SEQ ID NO: 604479 - DNA, 25 bp, Homo sapien
ctgaagggaagtttctctgagctcc

SEQ ID NO: 604480 - DNA, 25 bp, Homo sapien
tctgctgccctgtgagtgagtatcg

SEQ ID NO: 604481 - DNA, 25 bp, Homo sapien
gtgagtatcggagacagcagccagt

SEQ ID NO: 604482 - DNA, 25 bp, Homo sapien
agacagcagccagtcccgctgattt

SEQ ID NO: 604483 - DNA, 25 bp, Homo sapien
cccaggcctactggcttcagagaaa

SEQ ID NO: 604484 - DNA, 25 bp, Homo sapien
tcccatacacagtcatgcgcacaga

SEQ ID NO: 604485 - DNA, 25 bp, Homo sapien
gcgcacagagagcaggtaccaatac

SEQ ID NO: 604486 - DNA, 25 bp, Homo sapien
gagtttcctcagcttaaacccttga

SEQ ID NO: 604487 - DNA, 25 bp, Homo sapien
aaacccttgacagcattaagtgagg

SEQ ID NO: 604488 - DNA, 25 bp, Homo sapien
gtgaggaaggagtttccttgacctg

SEQ ID NO: 604489 - DNA, 25 bp, Homo sapien
taaacatggaactgtgcccactgcc

SEQ ID NO: 604490 - DNA, 25 bp, Homo sapien
actgccttttcctttgctctgtgga

SEQ ID NO: 604491 - DNA, 25 bp, Homo sapien
gattggctgtggttctgccctggca

SEQ ID NO: 604492 - DNA, 25 bp, Homo sapien
tctgccctggcactcggatgtcaag

SEQ ID NO: 604493 - DNA, 25 bp, Homo sapien
actcggatgtcaagttgctctggct

SEQ ID NO: 604494 - DNA, 25 bp, Homo sapien
gtcaagttgctctggctgtttggga

SEQ ID NO: 604495 - DNA, 25 bp, Homo sapien
agagtgaaattgtgtctcaaataat

SEQ ID NO: 604496 - DNA, 25 bp, Homo sapien
gagtgaaattgtgtctcaaataata

SEQ ID NO: 604497 - DNA, 25 bp, Homo sapien
agtgaaattgtgtctcaaataataa

SEQ ID NO: 604498 - DNA, 25 bp, Homo sapien
ctgagatttatcattcctcctctct

SEQ ID NO: 604499 - DNA, 25 bp, Homo sapien
tgagatttatcattcctcctctctc

SEQ ID NO: 604500 - DNA, 25 bp, Homo sapien
gagatttatcattcctcctctctcc

SEQ ID NO: 604501 - DNA, 25 bp, Homo sapien
agatttatcattcctcctctctcct

SEQ ID NO: 604502 - DNA, 25 bp, Homo sapien
gatttatcattcctcctctctcctt

SEQ ID NO: 604503 - DNA, 25 bp, Homo sapien
atttatcattcctcctctctccttt

SEQ ID NO: 604504 - DNA, 25 bp, Homo sapien
tttatcattcctcctctctcctttt

SEQ ID NO: 604505 - DNA, 25 bp, Homo sapien
ttatcattcctcctctctccttttc

SEQ ID NO: 604506 - DNA, 25 bp, Homo sapien
gggcaccctcaaaatgtggctcaac

SEQ ID NO: 604507 - DNA, 25 bp, Homo sapien
atgtggctcaacaaaaattctataa

SEQ ID NO: 604508 - DNA, 25 bp, Homo sapien
aattctataaacgtccataagctaa

SEQ ID NO: 604509 - DNA, 25 bp, Homo sapien
cataagctaaaaagactgattccac

SEQ ID NO: 604510 - DNA, 25 bp, Homo sapien
aaaagactgattccacaagcttttt

SEQ ID NO: 604511 - DNA, 25 bp, Homo sapien
acaagctttttcatgtgaacttata

SEQ ID NO: 604512 - DNA, 25 bp, Homo sapien
aaatcacagatataacgagttaaga

SEQ ID NO: 604513 - DNA, 25 bp, Homo sapien
gtaaccagaacctgagtgataaact

SEQ ID NO: 604514 - DNA, 25 bp, Homo sapien
acctgagtgataaactttttagcaa

SEQ ID NO: 604515 - DNA, 25 bp, Homo sapien
gaaagtcttaatttgtgtcacgatt

SEQ ID NO: 604516 - DNA, 25 bp, Homo sapien
ggaaggaaagtcttagtttggaatg

SEQ ID NO: 604517 - DNA, 25 bp, Homo sapien
ttggctaccacatcaaaccctggag

SEQ ID NO: 604518 - DNA, 25 bp, Homo sapien
aaaccctggagcttgacatatataa

SEQ ID NO: 604519 - DNA, 25 bp, Homo sapien
gacatatataaacctgctcctttct

SEQ ID NO: 604520 - DNA, 25 bp, Homo sapien
atataaacctgctcctttcttaatt

SEQ ID NO: 604521 - DNA, 25 bp, Homo sapien
ttaatttcattagctcctccacgat

SEQ ID NO: 604522 - DNA, 25 bp, Homo sapien
gatcccatcatgacctaagttgcca

SEQ ID NO: 604523 - DNA, 25 bp, Homo sapien
aaatgtgttttactcagctttcttt

SEQ ID NO: 604524 - DNA, 25 bp, Homo sapien
actcagctttctttatgttttccaa

SEQ ID NO: 604525 - DNA, 25 bp, Homo sapien
aaagctgaattgtagaaccgcattt

SEQ ID NO: 604526 - DNA, 25 bp, Homo sapien
agaaccgcatttatactctgtcctt

SEQ ID NO: 604527 - DNA, 25 bp, Homo sapien
tctgtccttctctgtgtctcttttc

SEQ ID NO: 604528 - DNA, 25 bp, Homo sapien
aagactccttacaaatgccatctct

SEQ ID NO: 604529 - DNA, 25 bp, Homo sapien
atgccatctctttcatgaatccttc

SEQ ID NO: 604530 - DNA, 25 bp, Homo sapien
tctctttcatgaatccttccctgat

SEQ ID NO: 604531 - DNA, 25 bp, Homo sapien
caccacatcatgtatcgtgaatgtt

SEQ ID NO: 604532 - DNA, 25 bp, Homo sapien
gtgaatgttacctattatcgtagct

SEQ ID NO: 604533 - DNA, 25 bp, Homo sapien
tattatcgtagctatctccatccct

SEQ ID NO: 604534 - DNA, 25 bp, Homo sapien
tccatccctatctagagccatcttt

SEQ ID NO: 604535 - DNA, 25 bp, Homo sapien
gtgtgccttccttcagaccatgttt

SEQ ID NO: 604536 - DNA, 25 bp, Homo sapien
agaccatgtttgagtacctgccgtg

SEQ ID NO: 604537 - DNA, 25 bp, Homo sapien
tacctgccgtggtcaaggcacagta

SEQ ID NO: 604538 - DNA, 25 bp, Homo sapien
gaaccagaacgtactgtgagttgat

SEQ ID NO: 604539 - DNA, 25 bp, Homo sapien
agttgtccccatgcttaatgagtag

SEQ ID NO: 604540 - DNA, 25 bp, Homo sapien
atttttccccactgacttgtaatgc

SEQ ID NO: 604541 - DNA, 25 bp, Homo sapien
gtaatgccacgtttgtgtgtatcca

SEQ ID NO: 604542 - DNA, 25 bp, Homo sapien
tgtgtatccagtttctctgtgtgtg

SEQ ID NO: 604543 - DNA, 25 bp, Homo sapien
gtgtgtgtggtcctatttctgtgcc

SEQ ID NO: 604544 - DNA, 25 bp, Homo sapien
tgtgccttctattttggtgccttac

SEQ ID NO: 604545 - DNA, 25 bp, Homo sapien
ggtgccttaccttaattatcagtct

SEQ ID NO: 604546 - DNA, 25 bp, Homo sapien
gtgcactgattccacatagtattaa

SEQ ID NO: 604547 - DNA, 25 bp, Homo sapien
tcccatgtaattttgtcttcagaat

SEQ ID NO: 604548 - DNA, 25 bp, Homo sapien
ttgtcttgactattcttgtcccttt

SEQ ID NO: 604549 - DNA, 25 bp, Homo sapien
ccctttgtcccttcacatgaattta

SEQ ID NO: 604550 - DNA, 25 bp, Homo sapien
cttctacttcatcagatctcagctt

SEQ ID NO: 604551 - DNA, 25 bp, Homo sapien
tagaagctattttctgtgacaggat

SEQ ID NO: 604552 - DNA, 25 bp, Homo sapien
tgtgacaggattttcctgtccttcc

SEQ ID NO: 604553 - DNA, 25 bp, Homo sapien
ctccacctcctcaaattgggtaggt

SEQ ID NO: 604554 - DNA, 25 bp, Homo sapien
attgggtaggttcccctattctgtg

SEQ ID NO: 604555 - DNA, 25 bp, Homo sapien
tcccctattctgtgcttctagagca

SEQ ID NO: 604556 - DNA, 25 bp, Homo sapien
ttctagagcattttgtgtttgtccc

SEQ ID NO: 604557 - DNA, 25 bp, Homo sapien
tgtttgtccctgtcttagcaccaat

SEQ ID NO: 604558 - DNA, 25 bp, Homo sapien
tgtcttagcaccaatcccttctaat

SEQ ID NO: 604559 - DNA, 25 bp, Homo sapien
aatcccttctaattccttatctgtc

SEQ ID NO: 604560 - DNA, 25 bp, Homo sapien
atccctctgtatgctgtaaactcct

SEQ ID NO: 604561 - DNA, 25 bp, Homo sapien
accttcaggcagcatgcacaccttg

SEQ ID NO: 604562 - DNA, 25 bp, Homo sapien
aacccagtcaatcaccaagtcctat

SEQ ID NO: 604563 - DNA, 25 bp, Homo sapien
ccaagtcctatagatcctgagtcct

SEQ ID NO: 604564 - DNA, 25 bp, Homo sapien
gatcctgagtcctaaatgtttctag

SEQ ID NO: 604565 - DNA, 25 bp, Homo sapien
atgtttctagaatttatactgtttt

SEQ ID NO: 604566 - DNA, 25 bp, Homo sapien
tttatctttaatgttgtcaccttgg

SEQ ID NO: 604567 - DNA, 25 bp, Homo sapien
aatgttgtcaccttggtctgattca

SEQ ID NO: 604568 - DNA, 25 bp, Homo sapien
tgtcaccttggtctgattcatctca

SEQ ID NO: 604569 - DNA, 25 bp, Homo sapien
gtctgattcatctcactctgattac

SEQ ID NO: 604570 - DNA, 25 bp, Homo sapien
gattcatctcactctgattactaat

SEQ ID NO: 604571 - DNA, 25 bp, Homo sapien
ctctgattactaatatagctttcaa

SEQ ID NO: 604572 - DNA, 25 bp, Homo sapien
gatgaaagcagcatccttttcttgt

SEQ ID NO: 604573 - DNA, 25 bp, Homo sapien
aagctttcattctggcatcactgag

SEQ ID NO: 604574 - DNA, 25 bp, Homo sapien
cattctggcatcactgagtatcatg

SEQ ID NO: 604575 - DNA, 25 bp, Homo sapien
actgagtatcatgttagctgtgggc

SEQ ID NO: 604576 - DNA, 25 bp, Homo sapien
gtgggcttttcatatactgccttta

SEQ ID NO: 604577 - DNA, 25 bp, Homo sapien
atactgcctttatgatgttgaggta

SEQ ID NO: 604578 - DNA, 25 bp, Homo sapien
gatgttgaggtaatttccttctgtt

SEQ ID NO: 604579 - DNA, 25 bp, Homo sapien
tccttctgttcctttgttgagtgtt

SEQ ID NO: 604580 - DNA, 25 bp, Homo sapien
tctgttcctttgttgagtgttttta

SEQ ID NO: 604581 - DNA, 25 bp, Homo sapien
catgaagttgtgttgaatcttgtca

SEQ ID NO: 604582 - DNA, 25 bp, Homo sapien
tttcttatattgaaacatccttgca

SEQ ID NO: 604583 - DNA, 25 bp, Homo sapien
gttttgtatgcttataatattttcc

SEQ ID NO: 604584 - DNA, 25 bp, Homo sapien
aatgatgaactctgagtcttctgac

SEQ ID NO: 604585 - DNA, 25 bp, Homo sapien
aactctgagtcttctgacagaatgc

SEQ ID NO: 604586 - DNA, 25 bp, Homo sapien
aatgcagatcaatggattcctagcc

SEQ ID NO: 604587 - DNA, 25 bp, Homo sapien
gatcaatggattcctagccatcggg

SEQ ID NO: 604588 - DNA, 25 bp, Homo sapien
ggagagattctacatcttcttgcaa

SEQ ID NO: 604589 - DNA, 25 bp, Homo sapien
acatcttcttgcaactgttcatctg

SEQ ID NO: 604590 - DNA, 25 bp, Homo sapien
cttgcaactgttcatctggattacg

SEQ ID NO: 604591 - DNA, 25 bp, Homo sapien
gttcatctggattacggtggtggtt

SEQ ID NO: 604592 - DNA, 25 bp, Homo sapien
attacggtggtggttgcatgactgt

SEQ ID NO: 604593 - DNA, 25 bp, Homo sapien
gaaacttacatgtcacaggatggat

SEQ ID NO: 604594 - DNA, 25 bp, Homo sapien
gagaagctcactttcaaaatttgat

SEQ ID NO: 604595 - DNA, 25 bp, Homo sapien
atatggacattgcatttgacgagac

SEQ ID NO: 604596 - DNA, 25 bp, Homo sapien
gacattgcatttgacgagacagtag

SEQ ID NO: 604597 - DNA, 25 bp, Homo sapien
tttgacgagacagtagagatgggat

SEQ ID NO: 604598 - DNA, 25 bp, Homo sapien
gcgcccagccgtcacaggatttcat

SEQ ID NO: 604599 - DNA, 25 bp, Homo sapien
tcacaggatttcatacttattaaga

SEQ ID NO: 604600 - DNA, 25 bp, Homo sapien
ttattaagatccctctttcttcttt

SEQ ID NO: 604601 - DNA, 25 bp, Homo sapien
tcttctttaggattcccaagtaact

SEQ ID NO: 604602 - DNA, 25 bp, Homo sapien
ggattcccaagtaacttgtctctgc

SEQ ID NO: 604603 - DNA, 25 bp, Homo sapien
ccaagtaacttgtctctgctatttt

SEQ ID NO: 604604 - DNA, 25 bp, Homo sapien
gtaacttgtctctgctatttttaat

SEQ ID NO: 604605 - DNA, 25 bp, Homo sapien
aaagtaagtctctgaccaggggcgc

SEQ ID NO: 604606 - DNA, 25 bp, Homo sapien
gggcgctggctcacatcttaatccc

SEQ ID NO: 604607 - DNA, 25 bp, Homo sapien
ttcgaaaccagcctgtccaagttgg

SEQ ID NO: 604608 - DNA, 25 bp, Homo sapien
gaaaccagcctgtccaagttggcga

SEQ ID NO: 604609 - DNA, 25 bp, Homo sapien
aaaccagcctgtccaagttggcgaa

SEQ ID NO: 604610 - DNA, 25 bp, Homo sapien
aattagctgtcatgttacttggcgc

SEQ ID NO: 604611 - DNA, 25 bp, Homo sapien
ttagctgtcatgttacttggcgctt

SEQ ID NO: 604612 - DNA, 25 bp, Homo sapien
agctgtcatgttacttggcgcttgt

SEQ ID NO: 604613 - DNA, 25 bp, Homo sapien
ctgtcatgttacttggcgcttgtaa

SEQ ID NO: 604614 - DNA, 25 bp, Homo sapien
gtcatgttacttggcgcttgtaatc

SEQ ID NO: 604615 - DNA, 25 bp, Homo sapien
cgcttgtaatcccagatgcttggca

SEQ ID NO: 604616 - DNA, 25 bp, Homo sapien
tggaaacatataaatatcagactgt

SEQ ID NO: 604617 - DNA, 25 bp, Homo sapien
gtctttggtttccaacaccatgatg

SEQ ID NO: 604618 - DNA, 25 bp, Homo sapien
ggtttccaacaccatgatgaagctc

SEQ ID NO: 604619 - DNA, 25 bp, Homo sapien
aacaccatgatgaagctcttgcttt

SEQ ID NO: 604620 - DNA, 25 bp, Homo sapien
catgatgaagctcttgctttttaaa

SEQ ID NO: 604621 - DNA, 25 bp, Homo sapien
attctgcatgaattttagtaaactt

SEQ ID NO: 604622 - DNA, 25 bp, Homo sapien
gaatttaaagtggacagatgcctgt

SEQ ID NO: 604623 - DNA, 25 bp, Homo sapien
ttaaagtggacagatgcctgttggg

SEQ ID NO: 604624 - DNA, 25 bp, Homo sapien
gtaaaatcaactgcaactttttgat

SEQ ID NO: 604625 - DNA, 25 bp, Homo sapien
caactgcaactttttgatgttaatt

SEQ ID NO: 604626 - DNA, 25 bp, Homo sapien
ctataagcaagttaagtgacaagca

SEQ ID NO: 604627 - DNA, 25 bp, Homo sapien
atattagcgttttctggctgtaatg

SEQ ID NO: 604628 - DNA, 25 bp, Homo sapien
gagaactaatatcaaaaccctgaat

SEQ ID NO: 604629 - DNA, 25 bp, Homo sapien
cctttcaaagcttggttcattcgct

SEQ ID NO: 604630 - DNA, 25 bp, Homo sapien
ttcaaagcttggttcattcgctttt

SEQ ID NO: 604631 - DNA, 25 bp, Homo sapien
caaagcttggttcattcgcttttaa

SEQ ID NO: 604632 - DNA, 25 bp, Homo sapien
gcttggttcattcgcttttaaaata

SEQ ID NO: 604633 - DNA, 25 bp, Homo sapien
tggttcattcgcttttaaaataaag

SEQ ID NO: 604634 - DNA, 25 bp, Homo sapien
ccaatttccctcctactttatacag

SEQ ID NO: 604635 - DNA, 25 bp, Homo sapien
atgaatgttgttatagtaaaagcta

SEQ ID NO: 604636 - DNA, 25 bp, Homo sapien
aaaggaaagtacagtcattcaattt

SEQ ID NO: 604637 - DNA, 25 bp, Homo sapien
agtacagtcattcaatttctaattg

SEQ ID NO: 604638 - DNA, 25 bp, Homo sapien
aagtcatacctggatgtcagcgaag

SEQ ID NO: 604639 - DNA, 25 bp, Homo sapien
gcatcgctgtaaaaagcctaccaat

SEQ ID NO: 604640 - DNA, 25 bp, Homo sapien
aatgagagctcagttcaaggcgaac

SEQ ID NO: 604641 - DNA, 25 bp, Homo sapien
tcctgttctttataaggcacactca

SEQ ID NO: 604642 - DNA, 25 bp, Homo sapien
acactcataccaacacgatcctatt

SEQ ID NO: 604643 - DNA, 25 bp, Homo sapien
acgatcctattctgtggcaagcttg

SEQ ID NO: 604644 - DNA, 25 bp, Homo sapien
gtatgagctaaattccctgttaaaa

SEQ ID NO: 604645 - DNA, 25 bp, Homo sapien
ggtgacagatctcttcaaccaggtc

SEQ ID NO: 604646 - DNA, 25 bp, Homo sapien
aaccaggtcaaagctgatctttctg

SEQ ID NO: 604647 - DNA, 25 bp, Homo sapien
tggaatgtcaccaaccaagggccta

SEQ ID NO: 604648 - DNA, 25 bp, Homo sapien
aaaagccatccacaagtcatacctg

SEQ ID NO: 604649 - DNA, 25 bp, Homo sapien
gaaatccgaggaaaagactcaagaa

SEQ ID NO: 604650 - DNA, 25 bp, Homo sapien
tgaccccagccttcccgtgggaatg

SEQ ID NO: 604651 - DNA, 25 bp, Homo sapien
ccagccttcccgtgggaatgattca

SEQ ID NO: 604652 - DNA, 25 bp, Homo sapien
ccttcccgtgggaatgattcagaaa

SEQ ID NO: 604653 - DNA, 25 bp, Homo sapien
cccgtgggaatgattcagaaagatc

SEQ ID NO: 604654 - DNA, 25 bp, Homo sapien
gaaagatcaaactgacaagccaccg

SEQ ID NO: 604655 - DNA, 25 bp, Homo sapien
agatcaaactgacaagccaccgaca

SEQ ID NO: 604656 - DNA, 25 bp, Homo sapien
aaactgacaagccaccgacaggaaa

SEQ ID NO: 604657 - DNA, 25 bp, Homo sapien
gacaagccaccgacaggaaacttca

SEQ ID NO: 604658 - DNA, 25 bp, Homo sapien
gccaccgacaggaaacttcaatcat

SEQ ID NO: 604659 - DNA, 25 bp, Homo sapien
aggaaacttcaatcataaatctctt

SEQ ID NO: 604660 - DNA, 25 bp, Homo sapien
aagcattagttcataggacagttat

SEQ ID NO: 604661 - DNA, 25 bp, Homo sapien
tgtatattaaccaccttgcatgtat

SEQ ID NO: 604662 - DNA, 25 bp, Homo sapien
accaccttgcatgtattcaaatgtg

SEQ ID NO: 604663 - DNA, 25 bp, Homo sapien
atgtgttttgaaatctaacgtctac

SEQ ID NO: 604664 - DNA, 25 bp, Homo sapien
gaaatctaacgtctacattttgata

SEQ ID NO: 604665 - DNA, 25 bp, Homo sapien
gtttaactcttctacataagtgact

SEQ ID NO: 604666 - DNA, 25 bp, Homo sapien
ataagtgacttacaacaggcattaa

SEQ ID NO: 604667 - DNA, 25 bp, Homo sapien
caggcattaaatattgtttggcatt

SEQ ID NO: 604668 - DNA, 25 bp, Homo sapien
atatctgtaactgtatcttaatcta

SEQ ID NO: 604669 - DNA, 25 bp, Homo sapien
gtatcttaatctacaatgagcttaa

SEQ ID NO: 604670 - DNA, 25 bp, Homo sapien
gtgtagcataaaacagaaccttcaa

SEQ ID NO: 604671 - DNA, 25 bp, Homo sapien
aatatgagcctggtcagatgtggtg

SEQ ID NO: 604672 - DNA, 25 bp, Homo sapien
atatgagcctggtcagatgtggtgg

SEQ ID NO: 604673 - DNA, 25 bp, Homo sapien
ggaggccaagcgggctattcccttg

SEQ ID NO: 604674 - DNA, 25 bp, Homo sapien
gaggccaagcgggctattcccttga

SEQ ID NO: 604675 - DNA, 25 bp, Homo sapien
aggccaagcgggctattcccttgag

SEQ ID NO: 604676 - DNA, 25 bp, Homo sapien
ggccaagcgggctattcccttgagc

SEQ ID NO: 604677 - DNA, 25 bp, Homo sapien
gccaagcgggctattcccttgagcc

SEQ ID NO: 604678 - DNA, 25 bp, Homo sapien
caagcgggctattcccttgagccca

SEQ ID NO: 604679 - DNA, 25 bp, Homo sapien
aagcgggctattcccttgagcccag

SEQ ID NO: 604680 - DNA, 25 bp, Homo sapien
gatttagagagagaagcctgggcaa

SEQ ID NO: 604681 - DNA, 25 bp, Homo sapien
atttagagagagaagcctgggcaac

SEQ ID NO: 604682 - DNA, 25 bp, Homo sapien
tttctagtggtcttaattccctgac

SEQ ID NO: 604683 - DNA, 25 bp, Homo sapien
tagtggtcttaattccctgactcca

SEQ ID NO: 604684 - DNA, 25 bp, Homo sapien
gtggtcttaattccctgactccata

SEQ ID NO: 604685 - DNA, 25 bp, Homo sapien
gtcttaattccctgactccatagat

SEQ ID NO: 604686 - DNA, 25 bp, Homo sapien
ttaattccctgactccatagatctg

SEQ ID NO: 604687 - DNA, 25 bp, Homo sapien
attccctgactccatagatctggca

SEQ ID NO: 604688 - DNA, 25 bp, Homo sapien
ccctgactccatagatctggcatga

SEQ ID NO: 604689 - DNA, 25 bp, Homo sapien
gactccatagatctggcatgatgtt

SEQ ID NO: 604690 - DNA, 25 bp, Homo sapien
ctccatagatctggcatgatgtttg

SEQ ID NO: 604691 - DNA, 25 bp, Homo sapien
ggcatgatgtttgaaatctgacttt

SEQ ID NO: 604692 - DNA, 25 bp, Homo sapien
gatgtttgaaatctgactttctaaa

SEQ ID NO: 604693 - DNA, 25 bp, Homo sapien
atcaccaagaatagttaatgtttat

SEQ ID NO: 604694 - DNA, 25 bp, Homo sapien
tatgatagagaaaacaccaccgggc

SEQ ID NO: 604695 - DNA, 25 bp, Homo sapien
tgatagagaaaacaccaccgggcgc

SEQ ID NO: 604696 - DNA, 25 bp, Homo sapien
gatagagaaaacaccaccgggcgcg

SEQ ID NO: 604697 - DNA, 25 bp, Homo sapien
atagagaaaacaccaccgggcgcgg

SEQ ID NO: 604698 - DNA, 25 bp, Homo sapien
tagagaaaacaccaccgggcgcggt

SEQ ID NO: 604699 - DNA, 25 bp, Homo sapien
gttgtagtaagccaatggcaccact

SEQ ID NO: 604700 - DNA, 25 bp, Homo sapien
tgtagtaagccaatggcaccactct

SEQ ID NO: 604701 - DNA, 25 bp, Homo sapien
gtagtaagccaatggcaccactcta

SEQ ID NO: 604702 - DNA, 25 bp, Homo sapien
tagtaagccaatggcaccactctac

SEQ ID NO: 604703 - DNA, 25 bp, Homo sapien
gtaagccaatggcaccactctactc

SEQ ID NO: 604704 - DNA, 25 bp, Homo sapien
gcacatcttcaagttcttgccctgt

SEQ ID NO: 604705 - DNA, 25 bp, Homo sapien
tgtcctcactttagtatgccccaga

SEQ ID NO: 604706 - DNA, 25 bp, Homo sapien
ctcactttagtatgccccagaggaa

SEQ ID NO: 604707 - DNA, 25 bp, Homo sapien
gatatggacactctaagactcagaa

SEQ ID NO: 604708 - DNA, 25 bp, Homo sapien
gactcagaagaactttctcaggcat

SEQ ID NO: 604709 - DNA, 25 bp, Homo sapien
agaactttctcaggcattcattttc

SEQ ID NO: 604710 - DNA, 25 bp, Homo sapien
cattttcctatctattttgagccat

SEQ ID NO: 604711 - DNA, 25 bp, Homo sapien
agataccagagttacaatgcaatac

SEQ ID NO: 604712 - DNA, 25 bp, Homo sapien
gaagcacagatgcatgctacaacac

SEQ ID NO: 604713 - DNA, 25 bp, Homo sapien
gatgcatgctacaacacgaatgaac

SEQ ID NO: 604714 - DNA, 25 bp, Homo sapien
gaatgaactttgaaacgttgtgtta

SEQ ID NO: 604715 - DNA, 25 bp, Homo sapien
gaaccatttcttaaggccacaacat

SEQ ID NO: 604716 - DNA, 25 bp, Homo sapien
tcttaaggccacaacatgatttctg

SEQ ID NO: 604717 - DNA, 25 bp, Homo sapien
gatttctgtggtactgagtcatgtc

SEQ ID NO: 604718 - DNA, 25 bp, Homo sapien
gagtcatgtcttatgaaagcttctg

SEQ ID NO: 604719 - DNA, 25 bp, Homo sapien
gatgatcttggtctcagtactgtaa

SEQ ID NO: 604720 - DNA, 25 bp, Homo sapien
gtaaagtactaattgatgccaggat

SEQ ID NO: 604721 - DNA, 25 bp, Homo sapien
atgccaggattttgatagtaatgac

SEQ ID NO: 604722 - DNA, 25 bp, Homo sapien
gactaatcattgaggtcactttgga

SEQ ID NO: 604723 - DNA, 25 bp, Homo sapien
ggtcactttggaatataaactatca

SEQ ID NO: 604724 - DNA, 25 bp, Homo sapien
agacagaatccttaccatttataaa

SEQ ID NO: 604725 - DNA, 25 bp, Homo sapien
atgatttccacttaaactagtaata

SEQ ID NO: 604726 - DNA, 25 bp, Homo sapien
ggaatttcagattgcgttgcatgga

SEQ ID NO: 604727 - DNA, 25 bp, Homo sapien
gattgcgttgcatggaacagagctc

SEQ ID NO: 604728 - DNA, 25 bp, Homo sapien
gaacagagctcccacaagctggccg

SEQ ID NO: 604729 - DNA, 25 bp, Homo sapien
agagctcccacaagctggccgaggg

SEQ ID NO: 604730 - DNA, 25 bp, Homo sapien
agctcccacaagctggccgagggat

SEQ ID NO: 604731 - DNA, 25 bp, Homo sapien
cacaagctggccgagggatgctggg

SEQ ID NO: 604732 - DNA, 25 bp, Homo sapien
gggagaacgcactcagggcaccagg

SEQ ID NO: 604733 - DNA, 25 bp, Homo sapien
ctcagccagagctgctcttctctta

SEQ ID NO: 604734 - DNA, 25 bp, Homo sapien
tataggttaaaagcttttgacagaa

SEQ ID NO: 604735 - DNA, 25 bp, Homo sapien
gacagaaactatcataaaggtttaa

SEQ ID NO: 604736 - DNA, 25 bp, Homo sapien
gtttaaaaactgctgaccctggcca

SEQ ID NO: 604737 - DNA, 25 bp, Homo sapien
aatttctaagccttatccagtggcc

SEQ ID NO: 604738 - DNA, 25 bp, Homo sapien
tatccagtggcccacttagcgcagt

SEQ ID NO: 604739 - DNA, 25 bp, Homo sapien
tgcattgctggtgaatttttaaaag

SEQ ID NO: 604740 - DNA, 25 bp, Homo sapien
tttaaaagaacccaccagcatccac

SEQ ID NO: 604741 - DNA, 25 bp, Homo sapien
ataaagaatggactgtggctcacac

SEQ ID NO: 604742 - DNA, 25 bp, Homo sapien
tggctcacacagaatgccctctcaa

SEQ ID NO: 604743 - DNA, 25 bp, Homo sapien
tgccctctcaaaggtcccattgaaa

SEQ ID NO: 604744 - DNA, 25 bp, Homo sapien
ggtcccattgaaagaggtcctttag

SEQ ID NO: 604745 - DNA, 25 bp, Homo sapien
aggtcctttaggaagcacccataga

SEQ ID NO: 604746 - DNA, 25 bp, Homo sapien
attcttcatgtatttcgttacttac

SEQ ID NO: 604747 - DNA, 25 bp, Homo sapien
gttacttacagaatggcacacctaa

SEQ ID NO: 604748 - DNA, 25 bp, Homo sapien
gacacaaacatatacgcctagacgt

SEQ ID NO: 604749 - DNA, 25 bp, Homo sapien
acgcctagacgtgtatacatgtgta

SEQ ID NO: 604750 - DNA, 25 bp, Homo sapien
gtatacacgtatacagacacgtaca

SEQ ID NO: 604751 - DNA, 25 bp, Homo sapien
cagacacgtacacacaaacatcttt

SEQ ID NO: 604752 - DNA, 25 bp, Homo sapien
acatctttaaatgttgggcttctgt

SEQ ID NO: 604753 - DNA, 25 bp, Homo sapien
ttgggcttctgtgcctaagtgcata

SEQ ID NO: 604754 - DNA, 25 bp, Homo sapien
gtgcatatgtgcgactgacctgttg

SEQ ID NO: 604755 - DNA, 25 bp, Homo sapien
gtgcgactgacctgttgacctgtta

SEQ ID NO: 604756 - DNA, 25 bp, Homo sapien
gttgacctgttacgaactagctttt

SEQ ID NO: 604757 - DNA, 25 bp, Homo sapien
gaactagcttttgaaaatggcttct

SEQ ID NO: 604758 - DNA, 25 bp, Homo sapien
aatggcttctgacatcatttcagac

SEQ ID NO: 604759 - DNA, 25 bp, Homo sapien
ttctgtctttcctaagcagaaaaac

SEQ ID NO: 604760 - DNA, 25 bp, Homo sapien
ctgtctttcctaagcagaaaaacag

SEQ ID NO: 604761 - DNA, 25 bp, Homo sapien
taagcagaaaaacaggtagtacttc

SEQ ID NO: 604762 - DNA, 25 bp, Homo sapien
tagtacttcccctttaactagctat

SEQ ID NO: 604763 - DNA, 25 bp, Homo sapien
ttcccctttaactagctattttcag

SEQ ID NO: 604764 - DNA, 25 bp, Homo sapien
tcccctttaactagctattttcagt

SEQ ID NO: 604765 - DNA, 25 bp, Homo sapien
cctttaactagctattttcagttct

SEQ ID NO: 604766 - DNA, 25 bp, Homo sapien
tcagttcttgtaacagaggactgtt

SEQ ID NO: 604767 - DNA, 25 bp, Homo sapien
acagaggactgtttgtttgaatgtc

SEQ ID NO: 604768 - DNA, 25 bp, Homo sapien
ttgtttgaatgtccacccccaaaca

SEQ ID NO: 604769 - DNA, 25 bp, Homo sapien
acacaaccctgccaatccactttat

SEQ ID NO: 604770 - DNA, 25 bp, Homo sapien
gcttttctgtgaacgaatctctaaa

SEQ ID NO: 604771 - DNA, 25 bp, Homo sapien
gaatctctaaaactttttgccctca

SEQ ID NO: 604772 - DNA, 25 bp, Homo sapien
tctaaaactttttgccctcagtttg

SEQ ID NO: 604773 - DNA, 25 bp, Homo sapien
gggcccctctggtcgttgttgtgtc

SEQ ID NO: 604774 - DNA, 25 bp, Homo sapien
cgttgttgtgtcgtttgtgtactct

SEQ ID NO: 604775 - DNA, 25 bp, Homo sapien
gttgtgtcgtttgtgtactctttac

SEQ ID NO: 604776 - DNA, 25 bp, Homo sapien
gtgtcgtttgtgtactctttactgt

SEQ ID NO: 604777 - DNA, 25 bp, Homo sapien
tataggcagcctaagagttcccgga

SEQ ID NO: 604778 - DNA, 25 bp, Homo sapien
gcagcctaagagttcccggagtcgt

SEQ ID NO: 604779 - DNA, 25 bp, Homo sapien
agagttcccggagtcgttacagtcg

SEQ ID NO: 604780 - DNA, 25 bp, Homo sapien
gtgaaataaatacctcagactgatt

SEQ ID NO: 604781 - DNA, 25 bp, Homo sapien
ctggatctcccagttgatacaatga

SEQ ID NO: 604782 - DNA, 25 bp, Homo sapien
gaagtgtaagttagcacagtcctga

SEQ ID NO: 604783 - DNA, 25 bp, Homo sapien
agcacagtcctgaatgaccactcta

SEQ ID NO: 604784 - DNA, 25 bp, Homo sapien
tacacgctactctgagtggctcaaa

SEQ ID NO: 604785 - DNA, 25 bp, Homo sapien
aagactggagcgaacacatagcaca

SEQ ID NO: 604786 - DNA, 25 bp, Homo sapien
atagcacagctagatccgggattaa

SEQ ID NO: 604787 - DNA, 25 bp, Homo sapien
gatccgggattaattcgcttgagcc

SEQ ID NO: 604788 - DNA, 25 bp, Homo sapien
actcacctgtgagtccagttccaga

SEQ ID NO: 604789 - DNA, 25 bp, Homo sapien
agttccagaacccaagtagaggatg

SEQ ID NO: 604790 - DNA, 25 bp, Homo sapien
gggagcaaagctcctagctttttcc

SEQ ID NO: 604791 - DNA, 25 bp, Homo sapien
agctttttccctactgtctgcatct

SEQ ID NO: 604792 - DNA, 25 bp, Homo sapien
agctactgactgaattgcctggtca

SEQ ID NO: 604793 - DNA, 25 bp, Homo sapien
ttgcctggtcagttccgtgaaaaac

SEQ ID NO: 604794 - DNA, 25 bp, Homo sapien
gaaatagaaatgcacccggccagct

SEQ ID NO: 604795 - DNA, 25 bp, Homo sapien
ttccctggttggacggaccgtgaat

SEQ ID NO: 604796 - DNA, 25 bp, Homo sapien
ggacggaccgtgaatgctgccagtt

SEQ ID NO: 604797 - DNA, 25 bp, Homo sapien
tgaatgctgccagttctgtttcatt

SEQ ID NO: 604798 - DNA, 25 bp, Homo sapien
ataagaaactgtctgctctctaccc

SEQ ID NO: 604799 - DNA, 25 bp, Homo sapien
tctacccacagagtaattgtctagc

SEQ ID NO: 604800 - DNA, 25 bp, Homo sapien
gtaattgtctagctctatcatctaa

SEQ ID NO: 604801 - DNA, 25 bp, Homo sapien
atcatctaattatctcaacacgttt

SEQ ID NO: 604802 - DNA, 25 bp, Homo sapien
gtgagcgagatattaaggcccagat

SEQ ID NO: 604803 - DNA, 25 bp, Homo sapien
tacattcacaccatctaatagagat

SEQ ID NO: 604804 - DNA, 25 bp, Homo sapien
acattcacaccatctaatagagatg

SEQ ID NO: 604805 - DNA, 25 bp, Homo sapien
cattcacaccatctaatagagatgg

SEQ ID NO: 604806 - DNA, 25 bp, Homo sapien
attcacaccatctaatagagatggg

SEQ ID NO: 604807 - DNA, 25 bp, Homo sapien
gaaaagatcaaaatgcttttctttt

SEQ ID NO: 604808 - DNA, 25 bp, Homo sapien
tcttagttttctttctttatagaga

SEQ ID NO: 604809 - DNA, 25 bp, Homo sapien
tagttttctttctttatagagacag

SEQ ID NO: 604810 - DNA, 25 bp, Homo sapien
tttctttctttatagagacagagtt

SEQ ID NO: 604811 - DNA, 25 bp, Homo sapien
tctttctttatagagacagagtttc

SEQ ID NO: 604812 - DNA, 25 bp, Homo sapien
aaaattttttaattatctgggcatg

SEQ ID NO: 604813 - DNA, 25 bp, Homo sapien
agctatgattgtttcattgcactgt

SEQ ID NO: 604814 - DNA, 25 bp, Homo sapien
tatttttttgagaggcaggagaatg

SEQ ID NO: 604815 - DNA, 25 bp, Homo sapien
atttttttgagaggcaggagaatgg

SEQ ID NO: 604816 - DNA, 25 bp, Homo sapien
gcagtaagcccagatagcaccattg

SEQ ID NO: 604817 - DNA, 25 bp, Homo sapien
ccagatagcaccattgcaactccag

SEQ ID NO: 604818 - DNA, 25 bp, Homo sapien
cagatagcaccattgcaactccagc

SEQ ID NO: 604819 - DNA, 25 bp, Homo sapien
agatagcaccattgcaactccagcc

SEQ ID NO: 604820 - DNA, 25 bp, Homo sapien
gatagcaccattgcaactccagcct

SEQ ID NO: 604821 - DNA, 25 bp, Homo sapien
atagcaccattgcaactccagcctg

SEQ ID NO: 604822 - DNA, 25 bp, Homo sapien
ggtttctccatattaggctggtctt

SEQ ID NO: 604823 - DNA, 25 bp, Homo sapien
tctccatattaggctggtcttgaac

SEQ ID NO: 604824 - DNA, 25 bp, Homo sapien
tgagccaccgtacccggtcttgttt

SEQ ID NO: 604825 - DNA, 25 bp, Homo sapien
ggaatagtcagctgatgtgaatatg

SEQ ID NO: 604826 - DNA, 25 bp, Homo sapien
actgatccagaaatgtcacagagta

SEQ ID NO: 604827 - DNA, 25 bp, Homo sapien
cacagagtatagaattggtagacaa

SEQ ID NO: 604828 - DNA, 25 bp, Homo sapien
aaagttattatacccgcattccata

SEQ ID NO: 604829 - DNA, 25 bp, Homo sapien
atacccgcattccatatgttcaagc

SEQ ID NO: 604830 - DNA, 25 bp, Homo sapien
gcattccatatgttcaagcagctgg

SEQ ID NO: 604831 - DNA, 25 bp, Homo sapien
attgatcatattaagtagagacatt

SEQ ID NO: 604832 - DNA, 25 bp, Homo sapien
aaaaatatctacctgaaatcacatt

SEQ ID NO: 604833 - DNA, 25 bp, Homo sapien
gaggaaaactatcattactgagatg

SEQ ID NO: 604834 - DNA, 25 bp, Homo sapien
attaacagccaattagacatcacag

SEQ ID NO: 604835 - DNA, 25 bp, Homo sapien
acagccaattagacatcacagaaga

SEQ ID NO: 604836 - DNA, 25 bp, Homo sapien
agcaccgtcaggaaccccgcggagg

SEQ ID NO: 604837 - DNA, 25 bp, Homo sapien
tttccagggaggcccacatctgtca

SEQ ID NO: 604838 - DNA, 25 bp, Homo sapien
tgtcactccagaagcacccaagttt

SEQ ID NO: 604839 - DNA, 25 bp, Homo sapien
agaagcacccaagtttactctgcca

SEQ ID NO: 604840 - DNA, 25 bp, Homo sapien
cccaagtttactctgccacgtgagg

SEQ ID NO: 604841 - DNA, 25 bp, Homo sapien
cacgtgaggacgctcatccctcggt

SEQ ID NO: 604842 - DNA, 25 bp, Homo sapien
atccctcggtcacatgaacctagac

SEQ ID NO: 604843 - DNA, 25 bp, Homo sapien
cttcctttggaagctgcagtcgggt

SEQ ID NO: 604844 - DNA, 25 bp, Homo sapien
tttggaagctgcagtcgggtgtcct

SEQ ID NO: 604845 - DNA, 25 bp, Homo sapien
gcagtcgggtgtcctgaggcaaggt

SEQ ID NO: 604846 - DNA, 25 bp, Homo sapien
ctgaggcaaggtggccccacttcca

SEQ ID NO: 604847 - DNA, 25 bp, Homo sapien
acctctgtccgaaagtgatgctacc

SEQ ID NO: 604848 - DNA, 25 bp, Homo sapien
aaagtgatgctacccgtgcatcggc

SEQ ID NO: 604849 - DNA, 25 bp, Homo sapien
gtgcatcggccgctgaaccgtcagc

SEQ ID NO: 604850 - DNA, 25 bp, Homo sapien
cgctgaaccgtcagctggctgtggt

SEQ ID NO: 604851 - DNA, 25 bp, Homo sapien
gatggagtccgctgcgttgtcagct

SEQ ID NO: 604852 - DNA, 25 bp, Homo sapien
ttgtcagctgatgccgtcacctggc

SEQ ID NO: 604853 - DNA, 25 bp, Homo sapien
acctggcctgcaatggacccgagag

SEQ ID NO: 604854 - DNA, 25 bp, Homo sapien
tgcaatggacccgagagcttcacag

SEQ ID NO: 604855 - DNA, 25 bp, Homo sapien
agagcttcacagctgcctgctgtcc

SEQ ID NO: 604856 - DNA, 25 bp, Homo sapien
agctgagcacccgaataaaccgctg

SEQ ID NO: 604857 - DNA, 25 bp, Homo sapien
cgaataaaccgctgtggcttatcca

SEQ ID NO: 604858 - DNA, 25 bp, Homo sapien
gctaagttttgtattgccatattga

SEQ ID NO: 604859 - DNA, 25 bp, Homo sapien
ctaagttttgtattgccatattgaa

SEQ ID NO: 604860 - DNA, 25 bp, Homo sapien
taagttttgtattgccatattgaat

SEQ ID NO: 604861 - DNA, 25 bp, Homo sapien
aagttttgtattgccatattgaatt

SEQ ID NO: 604862 - DNA, 25 bp, Homo sapien
agttttgtattgccatattgaattt

SEQ ID NO: 604863 - DNA, 25 bp, Homo sapien
ttttgtattgccatattgaattttt

SEQ ID NO: 604864 - DNA, 25 bp, Homo sapien
tttgtattgccatattgaatttttg

SEQ ID NO: 604865 - DNA, 25 bp, Homo sapien
ttgtattgccatattgaatttttgt

SEQ ID NO: 604866 - DNA, 25 bp, Homo sapien
tgtattgccatattgaatttttgtt

SEQ ID NO: 604867 - DNA, 25 bp, Homo sapien
aagatatgtgtttatgtttccagtt

SEQ ID NO: 604868 - DNA, 25 bp, Homo sapien
ttacctttcactatttataataaag

SEQ ID NO: 604869 - DNA, 25 bp, Homo sapien
attgcttagggagttctggtgacct

SEQ ID NO: 604870 - DNA, 25 bp, Homo sapien
gttctggtgaccttaactctgaata

SEQ ID NO: 604871 - DNA, 25 bp, Homo sapien
gaccttaactctgaataccaagcaa

SEQ ID NO: 604872 - DNA, 25 bp, Homo sapien
cagccagaagtttaggcggtgtttc

SEQ ID NO: 604873 - DNA, 25 bp, Homo sapien
gtttcttatttactgtcagcaaact

SEQ ID NO: 604874 - DNA, 25 bp, Homo sapien
gaaatcaacagcattagtaggtcta

SEQ ID NO: 604875 - DNA, 25 bp, Homo sapien
tcaatgtttagctttccacttcctc

SEQ ID NO: 604876 - DNA, 25 bp, Homo sapien
gtcaccttactccacagcaagaatg

SEQ ID NO: 604877 - DNA, 25 bp, Homo sapien
atgactgtcagaacatgtgcagtaa

SEQ ID NO: 604878 - DNA, 25 bp, Homo sapien
gtaaaaggcactttcaagtcatgct

SEQ ID NO: 604879 - DNA, 25 bp, Homo sapien
caagtcatgctatgtgttgtacaaa

SEQ ID NO: 604880 - DNA, 25 bp, Homo sapien
gtcattgtaagttctaagggtattt

SEQ ID NO: 604881 - DNA, 25 bp, Homo sapien
acacttatcaggaggtgagcagctg

SEQ ID NO: 604882 - DNA, 25 bp, Homo sapien
ggtgagcagctgaaactttgtatct

SEQ ID NO: 604883 - DNA, 25 bp, Homo sapien
gagcagctgaaactttgtatctgtc

SEQ ID NO: 604884 - DNA, 25 bp, Homo sapien
gctgaaactttgtatctgtctgtct

SEQ ID NO: 604885 - DNA, 25 bp, Homo sapien
gaaactttgtatctgtctgtcttgg

SEQ ID NO: 604886 - DNA, 25 bp, Homo sapien
aactttgtatctgtctgtcttgggt

SEQ ID NO: 604887 - DNA, 25 bp, Homo sapien
tttgtatctgtctgtcttgggtttt

SEQ ID NO: 604888 - DNA, 25 bp, Homo sapien
gtctgtcttgggttttctgtgacaa

SEQ ID NO: 604889 - DNA, 25 bp, Homo sapien
tgtcttgggttttctgtgacaaaga

SEQ ID NO: 604890 - DNA, 25 bp, Homo sapien
cttgggttttctgtgacaaagatta

SEQ ID NO: 604891 - DNA, 25 bp, Homo sapien
ctcatacagtgaagcatttaaggac

SEQ ID NO: 604892 - DNA, 25 bp, Homo sapien
ttaaggacactagaatttaagccct

SEQ ID NO: 604893 - DNA, 25 bp, Homo sapien
atttaagccctatgtgatatttata

SEQ ID NO: 604894 - DNA, 25 bp, Homo sapien
ataaagcctccatcaatagagcgtt

SEQ ID NO: 604895 - DNA, 25 bp, Homo sapien
gcctccatcaatagagcgtttgaga

SEQ ID NO: 604896 - DNA, 25 bp, Homo sapien
gattatttcaagcagagatgaccaa

SEQ ID NO: 604897 - DNA, 25 bp, Homo sapien
aggtgctgcaaaacccttcacagaa

SEQ ID NO: 604898 - DNA, 25 bp, Homo sapien
tgctgcaaaacccttcacagaagaa

SEQ ID NO: 604899 - DNA, 25 bp, Homo sapien
taataaatgatgacctcactgtggc

SEQ ID NO: 604900 - DNA, 25 bp, Homo sapien
taaatgatgacctcactgtggcatt

SEQ ID NO: 604901 - DNA, 25 bp, Homo sapien
acaacttttgacaaattagagacag

SEQ ID NO: 604902 - DNA, 25 bp, Homo sapien
gtagtttccattctaaattgtgctt

SEQ ID NO: 604903 - DNA, 25 bp, Homo sapien
actgtcccagtgaagcttaggtcac

SEQ ID NO: 604904 - DNA, 25 bp, Homo sapien
tcacacaaggcatgactccaactgt

SEQ ID NO: 604905 - DNA, 25 bp, Homo sapien
tgtacctggctttgcgaacgtgcag

SEQ ID NO: 604906 - DNA, 25 bp, Homo sapien
gctttgcgaacgtgcagctgaggat

SEQ ID NO: 604907 - DNA, 25 bp, Homo sapien
ggctgtgcctgtgacatatatgcac

SEQ ID NO: 604908 - DNA, 25 bp, Homo sapien
atatgcactgcaaagtcttcctcat

SEQ ID NO: 604909 - DNA, 25 bp, Homo sapien
tgcaaagtcttcctcatacgtcaga

SEQ ID NO: 604910 - DNA, 25 bp, Homo sapien
catacgtcagacacgggatgttccc

SEQ ID NO: 604911 - DNA, 25 bp, Homo sapien
tgttccccacttggtcaaaaacagt

SEQ ID NO: 604912 - DNA, 25 bp, Homo sapien
gagagttgagcctaaatcacagaga

SEQ ID NO: 604913 - DNA, 25 bp, Homo sapien
ggtatcattagaacccagcacatgg

SEQ ID NO: 604914 - DNA, 25 bp, Homo sapien
agcacatggcccttagactgagatt

SEQ ID NO: 604915 - DNA, 25 bp, Homo sapien
catggcccttagactgagattcaga

SEQ ID NO: 604916 - DNA, 25 bp, Homo sapien
gcagcagaactgacattgggaccca

SEQ ID NO: 604917 - DNA, 25 bp, Homo sapien
aactgacattgggacccaggtccat

SEQ ID NO: 604918 - DNA, 25 bp, Homo sapien
gacccaggtccattggaggcatctt

SEQ ID NO: 604919 - DNA, 25 bp, Homo sapien
atcttttagttatgcgcttgagaaa

SEQ ID NO: 604920 - DNA, 25 bp, Homo sapien
atgcgcttgagaaatcgttgttgct

SEQ ID NO: 604921 - DNA, 25 bp, Homo sapien
aaatcgttgttgctgcacctagttc

SEQ ID NO: 604922 - DNA, 25 bp, Homo sapien
acttgctgaacaaatggctggatga

SEQ ID NO: 604923 - DNA, 25 bp, Homo sapien
caggaatggagcaagccagtacagt

SEQ ID NO: 604924 - DNA, 25 bp, Homo sapien
tgcctacctcacattatgaaaacac

SEQ ID NO: 604925 - DNA, 25 bp, Homo sapien
gaaaacactattcttgattttcttt

SEQ ID NO: 604926 - DNA, 25 bp, Homo sapien
tagtttttacgtttaggcctatgat

SEQ ID NO: 604927 - DNA, 25 bp, Homo sapien
acgtttaggcctatgatctatgtta

SEQ ID NO: 604928 - DNA, 25 bp, Homo sapien
aggcctatgatctatgttaatatta

SEQ ID NO: 604929 - DNA, 25 bp, Homo sapien
aacatacttgaaatcacattgtgta

SEQ ID NO: 604930 - DNA, 25 bp, Homo sapien
acctccaacactatttcatcaatct

SEQ ID NO: 604931 - DNA, 25 bp, Homo sapien
tcatcaatcttttcacatgtcattg

SEQ ID NO: 604932 - DNA, 25 bp, Homo sapien
atattaggagttgtgtgactttcta

SEQ ID NO: 604933 - DNA, 25 bp, Homo sapien
gactttctatgctatagatgtgctg

SEQ ID NO: 604934 - DNA, 25 bp, Homo sapien
ggacatttaggttattctccctctg

SEQ ID NO: 604935 - DNA, 25 bp, Homo sapien
gaagtgagtcaccacagcacgataa

SEQ ID NO: 604936 - DNA, 25 bp, Homo sapien
acagcacgataagcaattgcacgat

SEQ ID NO: 604937 - DNA, 25 bp, Homo sapien
ataagcaattgctccatttctccat

SEQ ID NO: 604938 - DNA, 25 bp, Homo sapien
atttctccatgtaacttgctcacat

SEQ ID NO: 604939 - DNA, 25 bp, Homo sapien
ttgctcacatgcctatcttggaagt

SEQ ID NO: 604940 - DNA, 25 bp, Homo sapien
acatgcctatcttggaagtgctgaa

SEQ ID NO: 604941 - DNA, 25 bp, Homo sapien
gaatattctctttgggtctgaccta

SEQ ID NO: 604942 - DNA, 25 bp, Homo sapien
gggtctgacctatgaatgtcaacaa

SEQ ID NO: 604943 - DNA, 25 bp, Homo sapien
tgtcaacaaatctctactttctcca

SEQ ID NO: 604944 - DNA, 25 bp, Homo sapien
tactttctccacatgtcacttgact

SEQ ID NO: 604945 - DNA, 25 bp, Homo sapien
gtcacttgactactgtttagccttt

SEQ ID NO: 604946 - DNA, 25 bp, Homo sapien
gagcatcaccaacgtcctgaggagc

SEQ ID NO: 604947 - DNA, 25 bp, Homo sapien
gcatcaccaacgtcctgaggagcct

SEQ ID NO: 604948 - DNA, 25 bp, Homo sapien
cggctgcctctttgctactgtgtag

SEQ ID NO: 604949 - DNA, 25 bp, Homo sapien
tgctactgtgtagcacctgctgcaa

SEQ ID NO: 604950 - DNA, 25 bp, Homo sapien
actgtgtagcacctgctgcaacgtt

SEQ ID NO: 604951 - DNA, 25 bp, Homo sapien
gtagcacctgctgcaacgttgcctg

SEQ ID NO: 604952 - DNA, 25 bp, Homo sapien
caacgttgcctgctgtccacgtggg

SEQ ID NO: 604953 - DNA, 25 bp, Homo sapien
atttcctattcaattttcatggagt

SEQ ID NO: 604954 - DNA, 25 bp, Homo sapien
cctattcaattttcatggagtttat

SEQ ID NO: 604955 - DNA, 25 bp, Homo sapien
ctgattggtaggtgatggtatgata

SEQ ID NO: 604956 - DNA, 25 bp, Homo sapien
atggtatgatatcaaactattttgc

SEQ ID NO: 604957 - DNA, 25 bp, Homo sapien
cagtggctctgcttgcttgtttcat

SEQ ID NO: 604958 - DNA, 25 bp, Homo sapien
gcttgcttgtttcatgtgctgccac

SEQ ID NO: 604959 - DNA, 25 bp, Homo sapien
gtttcatgtgctgccacttctcaag

SEQ ID NO: 604960 - DNA, 25 bp, Homo sapien
tgctctcacctgtttcttttaatga

SEQ ID NO: 604961 - DNA, 25 bp, Homo sapien
tttccttaccatgctattgtacttc

SEQ ID NO: 604962 - DNA, 25 bp, Homo sapien
aaacaactacttcttttgacagaat

SEQ ID NO: 604963 - DNA, 25 bp, Homo sapien
atgagctaacattgctctccgtgtc

SEQ ID NO: 604964 - DNA, 25 bp, Homo sapien
tccgtgtctctgcaagtctttgaaa

SEQ ID NO: 604965 - DNA, 25 bp, Homo sapien
agatgaatgggtactgcttggcccc

SEQ ID NO: 604966 - DNA, 25 bp, Homo sapien
cccctcagacactatactgatcttt

SEQ ID NO: 604967 - DNA, 25 bp, Homo sapien
tgatcttttcataacccttttcctt

SEQ ID NO: 604968 - DNA, 25 bp, Homo sapien
gagggaaatggaaatacttcaagaa

SEQ ID NO: 604969 - DNA, 25 bp, Homo sapien
cttcaagaagaagacaagtttttgt

SEQ ID NO: 604970 - DNA, 25 bp, Homo sapien
aaagttaactgatttcttcagaagt

SEQ ID NO: 604971 - DNA, 25 bp, Homo sapien
tcttcagaagtaaaggtattgcatc

SEQ ID NO: 604972 - DNA, 25 bp, Homo sapien
aagtaaaggtattgcatctttgaaa

SEQ ID NO: 604973 - DNA, 25 bp, Homo sapien
aggtattgcatctttgaaacaagaa

SEQ ID NO: 604974 - DNA, 25 bp, Homo sapien
aagcagtgcccagaaaacaagagct

SEQ ID NO: 604975 - DNA, 25 bp, Homo sapien
tgcccagaaaacaagagcttctaga

SEQ ID NO: 604976 - DNA, 25 bp, Homo sapien
cagaaaacaagagcttctagaaatt

SEQ ID NO: 604977 - DNA, 25 bp, Homo sapien
gaaacacttcatagaagagttggaa

SEQ ID NO: 604978 - DNA, 25 bp, Homo sapien
tattaaattcttagagggttggaag

SEQ ID NO: 604979 - DNA, 25 bp, Homo sapien
cacacgtcctgcaatattcactgag

SEQ ID NO: 604980 - DNA, 25 bp, Homo sapien
tattcactgaggaatgcacagcagc

SEQ ID NO: 604981 - DNA, 25 bp, Homo sapien
gcagcacatatgtgcctcatgtgtc

SEQ ID NO: 604982 - DNA, 25 bp, Homo sapien
tgtgtcctgctgtgatgcagcgagt

SEQ ID NO: 604983 - DNA, 25 bp, Homo sapien
gatgcagcgagtggcacacagcatt

SEQ ID NO: 604984 - DNA, 25 bp, Homo sapien
agcattattgtgtcaatcatgtgtc

SEQ ID NO: 604985 - DNA, 25 bp, Homo sapien
aatcatgtgtcttgatgtgatgcac

SEQ ID NO: 604986 - DNA, 25 bp, Homo sapien
ttgatgtgatgcactggttcagaca

SEQ ID NO: 604987 - DNA, 25 bp, Homo sapien
tggttcagacagtatcatggatgca

SEQ ID NO: 604988 - DNA, 25 bp, Homo sapien
atcatggatgcagtgtttctttaaa

SEQ ID NO: 604989 - DNA, 25 bp, Homo sapien
atacttcaaaaatgtctctgacaca

SEQ ID NO: 604990 - DNA, 25 bp, Homo sapien
aataatggagcacagctggccctgg

SEQ ID NO: 604991 - DNA, 25 bp, Homo sapien
caaaaacgaggattcttgtatggaa

SEQ ID NO: 604992 - DNA, 25 bp, Homo sapien
gtatggaaatcgttctgaatctttt

SEQ ID NO: 604993 - DNA, 25 bp, Homo sapien
gaatctttttcctgtaatggagtga

SEQ ID NO: 604994 - DNA, 25 bp, Homo sapien
taatggagtgactcttaacacaaga

SEQ ID NO: 604995 - DNA, 25 bp, Homo sapien
atgactattgcgaaaatctctctgg

SEQ ID NO: 604996 - DNA, 25 bp, Homo sapien
gaaaatctctctggcatatttaggt

SEQ ID NO: 604997 - DNA, 25 bp, Homo sapien
ttggagcatgtggttgtgcttgaac

SEQ ID NO: 604998 - DNA, 25 bp, Homo sapien
ggttgtgcttgaacaagtttctgtt

SEQ ID NO: 604999 - DNA, 25 bp, Homo sapien
acaaatgcctaacaattcagacaac

SEQ ID NO: 605000 - DNA, 25 bp, Homo sapien
actacagaaacaccttagttatctg

SEQ ID NO: 605001 - DNA, 25 bp, Homo sapien
ggaccaaaccagttctgaagcagtt

SEQ ID NO: 605002 - DNA, 25 bp, Homo sapien
cccctagagcttccattgcaagaga

SEQ ID NO: 605003 - DNA, 25 bp, Homo sapien
gaaacacatggctttcttggctaaa

SEQ ID NO: 605004 - DNA, 25 bp, Homo sapien
aattgggttttctgtcatgcaatca

SEQ ID NO: 605005 - DNA, 25 bp, Homo sapien
gtcatgcaatcaatagggtcctaac

SEQ ID NO: 605006 - DNA, 25 bp, Homo sapien
gggtcctaacaactgagggactcaa

SEQ ID NO: 605007 - DNA, 25 bp, Homo sapien
agggactcaacgtcagaagcggaac

SEQ ID NO: 605008 - DNA, 25 bp, Homo sapien
tgacatccgctgtgctgggtcccaa

SEQ ID NO: 605009 - DNA, 25 bp, Homo sapien
ctgggtcccaatgaagcagcagcca

SEQ ID NO: 605010 - DNA, 25 bp, Homo sapien
gccacatgtttgtgagtgcctacat

SEQ ID NO: 605011 - DNA, 25 bp, Homo sapien
gggtctgtcattttttagcagatta

SEQ ID NO: 605012 - DNA, 25 bp, Homo sapien
gaatcaagatctattttaccttctt

SEQ ID NO: 605013 - DNA, 25 bp, Homo sapien
taccttcttttaactatagtgctaa

SEQ ID NO: 605014 - DNA, 25 bp, Homo sapien
gtgctaattttatacactgagtaag

SEQ ID NO: 605015 - DNA, 25 bp, Homo sapien
agacagggtgatataatgcttattt

SEQ ID NO: 605016 - DNA, 25 bp, Homo sapien
aactttcgagatagcttctctttgt

SEQ ID NO: 605017 - DNA, 25 bp, Homo sapien
tattcaatggatggccttgctgacg

SEQ ID NO: 605018 - DNA, 25 bp, Homo sapien
cttgctgacgaaatgatactgcttt

SEQ ID NO: 605019 - DNA, 25 bp, Homo sapien
gctttttatcttctaattacttcgt

SEQ ID NO: 605020 - DNA, 25 bp, Homo sapien
acttcgtatctcattagtgcttcct

SEQ ID NO: 605021 - DNA, 25 bp, Homo sapien
tagtgcttcctctaatgggctaaag

SEQ ID NO: 605022 - DNA, 25 bp, Homo sapien
aactgttaaatgcacccaggttagt

SEQ ID NO: 605023 - DNA, 25 bp, Homo sapien
gattgcagagaagctagcaccttca

SEQ ID NO: 605024 - DNA, 25 bp, Homo sapien
gcagagaagctagcaccttcagaaa

SEQ ID NO: 605025 - DNA, 25 bp, Homo sapien
aagctagcaccttcagaaatcactg

SEQ ID NO: 605026 - DNA, 25 bp, Homo sapien
gaaatcactgaggaattgccaagta

SEQ ID NO: 605027 - DNA, 25 bp, Homo sapien
aggaattgccaagtagccagctcat

SEQ ID NO: 605028 - DNA, 25 bp, Homo sapien
aattgccaagtagccagctcatgcc

SEQ ID NO: 605029 - DNA, 25 bp, Homo sapien
aagtagccagctcatgcccgtgaag

SEQ ID NO: 605030 - DNA, 25 bp, Homo sapien
tagccagctcatgcccgtgaagaag

SEQ ID NO: 605031 - DNA, 25 bp, Homo sapien
gctcatgcccgtgaagaagcagctc

SEQ ID NO: 605032 - DNA, 25 bp, Homo sapien
atgcccgtgaagaagcagctccagg

SEQ ID NO: 605033 - DNA, 25 bp, Homo sapien
agcagctccagggagcatcatggga

SEQ ID NO: 605034 - DNA, 25 bp, Homo sapien
cagacaacagaatcagacccatggg

SEQ ID NO: 605035 - DNA, 25 bp, Homo sapien
agacccatggggcttcaagactctg

SEQ ID NO: 605036 - DNA, 25 bp, Homo sapien
gggttattgggcatagactgtataa

SEQ ID NO: 605037 - DNA, 25 bp, Homo sapien
gggcatagactgtataacaatgtat

SEQ ID NO: 605038 - DNA, 25 bp, Homo sapien
ataacaatgtatatgctatcttcaa

SEQ ID NO: 605039 - DNA, 25 bp, Homo sapien
aatgtatatgctatcttcaaaagga

SEQ ID NO: 605040 - DNA, 25 bp, Homo sapien
agctatgtgtgaaacatttggcaga

SEQ ID NO: 605041 - DNA, 25 bp, Homo sapien
atttggcagagagctagaaattata

SEQ ID NO: 605042 - DNA, 25 bp, Homo sapien
gaaattatagcaagtgacatagcag

SEQ ID NO: 605043 - DNA, 25 bp, Homo sapien
gcaagtgacatagcagattttttgg

SEQ ID NO: 605044 - DNA, 25 bp, Homo sapien
ggaaatctagattgagacagtgatg

SEQ ID NO: 605045 - DNA, 25 bp, Homo sapien
atgagggcaatgaatgtacaggaca

SEQ ID NO: 605046 - DNA, 25 bp, Homo sapien
gtacaggacatatttaggacttcaa

SEQ ID NO: 605047 - DNA, 25 bp, Homo sapien
tcaaaatgcatagcagtctgggact

SEQ ID NO: 605048 - DNA, 25 bp, Homo sapien
atagcagtctgggactatttgttat

SEQ ID NO: 605049 - DNA, 25 bp, Homo sapien
tatagaatcacatcccagaagcctc

SEQ ID NO: 605050 - DNA, 25 bp, Homo sapien
tcacatcccagaagcctctaagaag

SEQ ID NO: 605051 - DNA, 25 bp, Homo sapien
gaattttctgttataggccagcagg

SEQ ID NO: 605052 - DNA, 25 bp, Homo sapien
cagcaggtgaccattgagaggtagt

SEQ ID NO: 605053 - DNA, 25 bp, Homo sapien
cagaatgtggactaatttcggaaca

SEQ ID NO: 605054 - DNA, 25 bp, Homo sapien
gaatcttagccatctgtccaaattg

SEQ ID NO: 605055 - DNA, 25 bp, Homo sapien
gccatctgtccaaattgaattagca

SEQ ID NO: 605056 - DNA, 25 bp, Homo sapien
atattagcgttttctggctgtaatg

SEQ ID NO: 605057 - DNA, 25 bp, Homo sapien
gcgttttctggctgtaatgtatcaa

SEQ ID NO: 605058 - DNA, 25 bp, Homo sapien
gagaactaatatcaaaaccctgaat

SEQ ID NO: 605059 - DNA, 25 bp, Homo sapien
cctttcaaagcttggttcattcgct

SEQ ID NO: 605060 - DNA, 25 bp, Homo sapien
caaagcttggttcattcgcttttaa

SEQ ID NO: 605061 - DNA, 25 bp, Homo sapien
gcttggttcattcgcttttaaaata

SEQ ID NO: 605062 - DNA, 25 bp, Homo sapien
ccaatttccctcctactttatacag

SEQ ID NO: 605063 - DNA, 25 bp, Homo sapien
ttccctcctactttatacagttata

SEQ ID NO: 605064 - DNA, 25 bp, Homo sapien
aaagctaaagtatgtctgatttttt

SEQ ID NO: 605065 - DNA, 25 bp, Homo sapien
aaaggaaagtacagtcattcaattt

SEQ ID NO: 605066 - DNA, 25 bp, Homo sapien
agtacagtcattcaatttctaattg

SEQ ID NO: 605067 - DNA, 25 bp, Homo sapien
gtacatggccatgtgaagatcaaga

SEQ ID NO: 605068 - DNA, 25 bp, Homo sapien
tacatggccatgtgaagatcaagag

SEQ ID NO: 605069 - DNA, 25 bp, Homo sapien
catggccatgtgaagatcaagagga

SEQ ID NO: 605070 - DNA, 25 bp, Homo sapien
aagaggaaaacatctcaggacatgg

SEQ ID NO: 605071 - DNA, 25 bp, Homo sapien
atctcaggacatggacatagctggc

SEQ ID NO: 605072 - DNA, 25 bp, Homo sapien
tctcaggacatggacatagctggcc

SEQ ID NO: 605073 - DNA, 25 bp, Homo sapien
ctcaggacatggacatagctggcct

SEQ ID NO: 605074 - DNA, 25 bp, Homo sapien
aggacatggacatagctggcctgag

SEQ ID NO: 605075 - DNA, 25 bp, Homo sapien
ggacatggacatagctggcctgagc

SEQ ID NO: 605076 - DNA, 25 bp, Homo sapien
gacatggacatagctggcctgagcc

SEQ ID NO: 605077 - DNA, 25 bp, Homo sapien
gctggcctgagccaagccaaagcca

SEQ ID NO: 605078 - DNA, 25 bp, Homo sapien
tcaaaacttcaaaacgcgttaggct

SEQ ID NO: 605079 - DNA, 25 bp, Homo sapien
aacgcgttaggctattgccacagct

SEQ ID NO: 605080 - DNA, 25 bp, Homo sapien
ggctattgccacagctactttttaa

SEQ ID NO: 605081 - DNA, 25 bp, Homo sapien
ttatttcttttccagctactttcca

SEQ ID NO: 605082 - DNA, 25 bp, Homo sapien
tcttttccagctactttccatggta

SEQ ID NO: 605083 - DNA, 25 bp, Homo sapien
agctactttccatggtaatacaaaa

SEQ ID NO: 605084 - DNA, 25 bp, Homo sapien
ttccaattttctgggagaatgtcct

SEQ ID NO: 605085 - DNA, 25 bp, Homo sapien
gggagaatgtcctataatcaagatg

SEQ ID NO: 605086 - DNA, 25 bp, Homo sapien
ataatcaagatgtggcgctttgtga

SEQ ID NO: 605087 - DNA, 25 bp, Homo sapien
tcgtgaaatcacatggtctgtaata

SEQ ID NO: 605088 - DNA, 25 bp, Homo sapien
ttagctaaaggcttgcatggtttat

SEQ ID NO: 605089 - DNA, 25 bp, Homo sapien
gcacacctcattagccgtaattgtc

SEQ ID NO: 605090 - DNA, 25 bp, Homo sapien
tagccgtaattgtctgattaataca

SEQ ID NO: 605091 - DNA, 25 bp, Homo sapien
tacccctatggtagtgtttactatc

SEQ ID NO: 605092 - DNA, 25 bp, Homo sapien
gtttactatccttatttcactcaat

SEQ ID NO: 605093 - DNA, 25 bp, Homo sapien
gttactttaaccagaatgcctgcct

SEQ ID NO: 605094 - DNA, 25 bp, Homo sapien
taaccagaatgcctgccttgtttgg

SEQ ID NO: 605095 - DNA, 25 bp, Homo sapien
gcctgccttgtttggcattttggga

SEQ ID NO: 605096 - DNA, 25 bp, Homo sapien
ggaagcatatgactgtaaaccctct

SEQ ID NO: 605097 - DNA, 25 bp, Homo sapien
tgactgtaaaccctcttcaaacttt

SEQ ID NO: 605098 - DNA, 25 bp, Homo sapien
tcagacttacgtttgcttcttctaa

SEQ ID NO: 605099 - DNA, 25 bp, Homo sapien
gtttgcttcttctaagtccatcgac

SEQ ID NO: 605100 - DNA, 25 bp, Homo sapien
tggcagcttctaaatttaataacaa

SEQ ID NO: 605101 - DNA, 25 bp, Homo sapien
aaaatgctcacctacaaataagaag

SEQ ID NO: 605102 - DNA, 25 bp, Homo sapien
tatgatgtaacagacccaggaataa

SEQ ID NO: 605103 - DNA, 25 bp, Homo sapien
gatattcatgggaaggtcactgcct

SEQ ID NO: 605104 - DNA, 25 bp, Homo sapien
catgggaaggtcactgcctgaggct

SEQ ID NO: 605105 - DNA, 25 bp, Homo sapien
actgcctgaggctgcttgataaact

SEQ ID NO: 605106 - DNA, 25 bp, Homo sapien
cttgataaactccagccctttccta

SEQ ID NO: 605107 - DNA, 25 bp, Homo sapien
atccactgtttaatgtttaagcttt

SEQ ID NO: 605108 - DNA, 25 bp, Homo sapien
taagctttggatgctaagagtggtt

SEQ ID NO: 605109 - DNA, 25 bp, Homo sapien
gagtggttataataaactgtccaac

SEQ ID NO: 605110 - DNA, 25 bp, Homo sapien
agtttctcacttagacttcccaaga

SEQ ID NO: 605111 - DNA, 25 bp, Homo sapien
gtttgattagttctcttgacttctg

SEQ ID NO: 605112 - DNA, 25 bp, Homo sapien
gattagttctcttgacttctgttct

SEQ ID NO: 605113 - DNA, 25 bp, Homo sapien
gttctcttgacttctgttctttcaa

SEQ ID NO: 605114 - DNA, 25 bp, Homo sapien
aaacctggagtttcctgatacgcct

SEQ ID NO: 605115 - DNA, 25 bp, Homo sapien
tggagtttcctgatacgcctcttga

SEQ ID NO: 605116 - DNA, 25 bp, Homo sapien
agtttcctgatacgcctcttgaaga

SEQ ID NO: 605117 - DNA, 25 bp, Homo sapien
ttcctgatacgcctcttgaagaatg

SEQ ID NO: 605118 - DNA, 25 bp, Homo sapien
ggatatattgttaaaccttactggt

SEQ ID NO: 605119 - DNA, 25 bp, Homo sapien
aaaccttactggtattgttccacag

SEQ ID NO: 605120 - DNA, 25 bp, Homo sapien
tactggtattgttccacagcacata

SEQ ID NO: 605121 - DNA, 25 bp, Homo sapien
gtattgttccacagcacatagatgt

SEQ ID NO: 605122 - DNA, 25 bp, Homo sapien
tttatgaagatccttaccaagtttc

SEQ ID NO: 605123 - DNA, 25 bp, Homo sapien
accaagtttcactccaatacatgga

SEQ ID NO: 605124 - DNA, 25 bp, Homo sapien
catggaaaaacaccacattctgcaa

SEQ ID NO: 605125 - DNA, 25 bp, Homo sapien
tattccagcagattactgaaaactt

SEQ ID NO: 605126 - DNA, 25 bp, Homo sapien
gaaaacttagtctatgaaaagccag

SEQ ID NO: 605127 - DNA, 25 bp, Homo sapien
ggaccccctgaattttatgctgtgc

SEQ ID NO: 605128 - DNA, 25 bp, Homo sapien
atgctgtgccaggtatagaattgga

SEQ ID NO: 605129 - DNA, 25 bp, Homo sapien
aatacagcacacatacagcaaagtg

SEQ ID NO: 605130 - DNA, 25 bp, Homo sapien
gtacgtacaactctgaattcttatg

SEQ ID NO: 605131 - DNA, 25 bp, Homo sapien
gaagtaaacatacctgtaactacca

SEQ ID NO: 605132 - DNA, 25 bp, Homo sapien
tacctgtaactaccattcaagtttt

SEQ ID NO: 605133 - DNA, 25 bp, Homo sapien
agttttcaatggctgatagttttgt

SEQ ID NO: 605134 - DNA, 25 bp, Homo sapien
atttctagaaaacatccttgcatac

SEQ ID NO: 605135 - DNA, 25 bp, Homo sapien
gaaaacatccttgcatacaaagcag

SEQ ID NO: 605136 - DNA, 25 bp, Homo sapien
ccttgcatacaaagcaggatagcta

SEQ ID NO: 605137 - DNA, 25 bp, Homo sapien
aaacttcaagtgtctagcacatact

SEQ ID NO: 605138 - DNA, 25 bp, Homo sapien
tcaagtgtctagcacatactacatc

SEQ ID NO: 605139 - DNA, 25 bp, Homo sapien
gtgtctagcacatactacatctaag

SEQ ID NO: 605140 - DNA, 25 bp, Homo sapien
gcacatactacatctaagaggctaa

SEQ ID NO: 605141 - DNA, 25 bp, Homo sapien
ctaagaggctaaactctgataggaa

SEQ ID NO: 605142 - DNA, 25 bp, Homo sapien
agtagttgaaattctaggccggtgc

SEQ ID NO: 605143 - DNA, 25 bp, Homo sapien
agttgaaattctaggccggtgcggt

SEQ ID NO: 605144 - DNA, 25 bp, Homo sapien
ttttcctatcatccacttacacttt

SEQ ID NO: 605145 - DNA, 25 bp, Homo sapien
tatcatccacttacactttttctca

SEQ ID NO: 605146 - DNA, 25 bp, Homo sapien
tcatccacttacactttttctcagg

SEQ ID NO: 605147 - DNA, 25 bp, Homo sapien
tctgatttagtttttaacccctatg

SEQ ID NO: 605148 - DNA, 25 bp, Homo sapien
aatttgacttaaactaatgactgaa

SEQ ID NO: 605149 - DNA, 25 bp, Homo sapien
attgtaaattgctggtgttcttcta

SEQ ID NO: 605150 - DNA, 25 bp, Homo sapien
attgctggtgttcttctattatcta

SEQ ID NO: 605151 - DNA, 25 bp, Homo sapien
ggtgttcttctattatctaacccca

SEQ ID NO: 605152 - DNA, 25 bp, Homo sapien
gttcttctattatctaaccccaaat

SEQ ID NO: 605153 - DNA, 25 bp, Homo sapien
tatctaaccccaaatatttgtgtgg

SEQ ID NO: 605154 - DNA, 25 bp, Homo sapien
taatttaaccaacataacgtcaaat

SEQ ID NO: 605155 - DNA, 25 bp, Homo sapien
gttttgagacataatcttatcaccc

SEQ ID NO: 605156 - DNA, 25 bp, Homo sapien
ttttgagacataatcttatcaccca

SEQ ID NO: 605157 - DNA, 25 bp, Homo sapien
agtgaagtggcgcagtttaaactgc

SEQ ID NO: 605158 - DNA, 25 bp, Homo sapien
gtgaagtggcgcagtttaaactgcg

SEQ ID NO: 605159 - DNA, 25 bp, Homo sapien
gcagtttaaactgcgcaggctcatc

SEQ ID NO: 605160 - DNA, 25 bp, Homo sapien
gtttaaactgcgcaggctcatcatc

SEQ ID NO: 605161 - DNA, 25 bp, Homo sapien
tttaaactgcgcaggctcatcatcc

SEQ ID NO: 605162 - DNA, 25 bp, Homo sapien
ttaaactgcgcaggctcatcatcct

SEQ ID NO: 605163 - DNA, 25 bp, Homo sapien
aaactgcgcaggctcatcatcctcc

SEQ ID NO: 605164 - DNA, 25 bp, Homo sapien
actgcgcaggctcatcatcctcctt

SEQ ID NO: 605165 - DNA, 25 bp, Homo sapien
gcgcaggctcatcatcctccttcct

SEQ ID NO: 605166 - DNA, 25 bp, Homo sapien
ctgcaggtggacaaccttccaagga

SEQ ID NO: 605167 - DNA, 25 bp, Homo sapien
cggaggagggccattttcgactgca

SEQ ID NO: 605168 - DNA, 25 bp, Homo sapien
agggccattttcgactgcagctgaa

SEQ ID NO: 605169 - DNA, 25 bp, Homo sapien
ttttcgactgcagctgaacagccag

SEQ ID NO: 605170 - DNA, 25 bp, Homo sapien
cagctgaacagccagttgtttgtag

SEQ ID NO: 605171 - DNA, 25 bp, Homo sapien
gtcatccagacagaaaggcttccta

SEQ ID NO: 605172 - DNA, 25 bp, Homo sapien
tcctaggatgcattcgctccttaca

SEQ ID NO: 605173 - DNA, 25 bp, Homo sapien
attcgctccttacacttgaatggac

SEQ ID NO: 605174 - DNA, 25 bp, Homo sapien
ggaagagagggcaaaggtcacatct

SEQ ID NO: 605175 - DNA, 25 bp, Homo sapien
aaaggtcacatctggagtcaggcca

SEQ ID NO: 605176 - DNA, 25 bp, Homo sapien
cacatctggagtcaggccaggctgc

SEQ ID NO: 605177 - DNA, 25 bp, Homo sapien
cgcaaagattactgtctacatacta

SEQ ID NO: 605178 - DNA, 25 bp, Homo sapien
tgtctacatactaacacttcctctc

SEQ ID NO: 605179 - DNA, 25 bp, Homo sapien
ttcctctccccttggagaaaatatt

SEQ ID NO: 605180 - DNA, 25 bp, Homo sapien
gaaaatatttctcttagcttcgctt

SEQ ID NO: 605181 - DNA, 25 bp, Homo sapien
agcttcgcttttagtgcaagtggta

SEQ ID NO: 605182 - DNA, 25 bp, Homo sapien
aagattcacctctggagatcaccac

SEQ ID NO: 605183 - DNA, 25 bp, Homo sapien
tggagatcaccactcattctttggc

SEQ ID NO: 605184 - DNA, 25 bp, Homo sapien
tttctgcatgtgtaattcagccttt

SEQ ID NO: 605185 - DNA, 25 bp, Homo sapien
aaattattaggctggacaggcagag

SEQ ID NO: 605186 - DNA, 25 bp, Homo sapien
cagagttttcgtttgcctgttttgc

SEQ ID NO: 605187 - DNA, 25 bp, Homo sapien
ttcgtttgcctgttttgctcagtgt

SEQ ID NO: 605188 - DNA, 25 bp, Homo sapien
ctacagataataaaagcacatcgga

SEQ ID NO: 605189 - DNA, 25 bp, Homo sapien
aaagcacatcggaaagacatgtcca

SEQ ID NO: 605190 - DNA, 25 bp, Homo sapien
aagcacatcggaaagacatgtccat

SEQ ID NO: 605191 - DNA, 25 bp, Homo sapien
agcacatcggaaagacatgtccata

SEQ ID NO: 605192 - DNA, 25 bp, Homo sapien
gcacatcggaaagacatgtccataa

SEQ ID NO: 605193 - DNA, 25 bp, Homo sapien
cacatcggaaagacatgtccataaa

SEQ ID NO: 605194 - DNA, 25 bp, Homo sapien
catcggaaagacatgtccataaaat

SEQ ID NO: 605195 - DNA, 25 bp, Homo sapien
gacatgtccataaaataggtgacca

SEQ ID NO: 605196 - DNA, 25 bp, Homo sapien
catgtccataaaataggtgaccaaa

SEQ ID NO: 605197 - DNA, 25 bp, Homo sapien
ataggtgaccaaaacacattaagaa

SEQ ID NO: 605198 - DNA, 25 bp, Homo sapien
tgaccaaaacacattaagaaaagac

SEQ ID NO: 605199 - DNA, 25 bp, Homo sapien
cagagtcgctggctacctgagcctg

SEQ ID NO: 605200 - DNA, 25 bp, Homo sapien
agcatacctgcccttgtggtgcctg

SEQ ID NO: 605201 - DNA, 25 bp, Homo sapien
cccagctctagactgaggaggacag

SEQ ID NO: 605202 - DNA, 25 bp, Homo sapien
aggaggacagcactgtccacccagg

SEQ ID NO: 605203 - DNA, 25 bp, Homo sapien
gtccacccagggagagtccattaag

SEQ ID NO: 605204 - DNA, 25 bp, Homo sapien
ctgcactacttgtgccccagtagat

SEQ ID NO: 605205 - DNA, 25 bp, Homo sapien
tagatcctgggtctccccttaatgt

SEQ ID NO: 605206 - DNA, 25 bp, Homo sapien
atgtcacccttacttaacttgaaag

SEQ ID NO: 605207 - DNA, 25 bp, Homo sapien
tgtgtattaaaggaccctttcaaag

SEQ ID NO: 605208 - DNA, 25 bp, Homo sapien
cccttggtccataaccatttggtgg

SEQ ID NO: 605209 - DNA, 25 bp, Homo sapien
taaccatttggtgggcagagtcgct

SEQ ID NO: 605210 - DNA, 25 bp, Homo sapien
acatgcgtgaaatgggtcctgcgcc

SEQ ID NO: 605211 - DNA, 25 bp, Homo sapien
gaaatgggtcctgcgccgtaattac

SEQ ID NO: 605212 - DNA, 25 bp, Homo sapien
gcgccgtaattactcctgctggaga

SEQ ID NO: 605213 - DNA, 25 bp, Homo sapien
agaccgggattgcaaagatgactgt

SEQ ID NO: 605214 - DNA, 25 bp, Homo sapien
gatgactgtcatgttgtctcgtgca

SEQ ID NO: 605215 - DNA, 25 bp, Homo sapien
gtctcgtgcatcttacatcttttac

SEQ ID NO: 605216 - DNA, 25 bp, Homo sapien
gggttcacgtcccacagacccttat

SEQ ID NO: 605217 - DNA, 25 bp, Homo sapien
acagacccttatgtactgcagaggt

SEQ ID NO: 605218 - DNA, 25 bp, Homo sapien
tatgtactgcagaggtcaaactggg

SEQ ID NO: 605219 - DNA, 25 bp, Homo sapien
ggcgggtttctcacacgcgtcatca

SEQ ID NO: 605220 - DNA, 25 bp, Homo sapien
ggcctatctttatgaaccctccagg

SEQ ID NO: 605221 - DNA, 25 bp, Homo sapien
gtggtgattcgctataaccttcatg

SEQ ID NO: 605222 - DNA, 25 bp, Homo sapien
taaccttcatgcagagaggagacct

SEQ ID NO: 605223 - DNA, 25 bp, Homo sapien
ttactcctttttctaagcctagctg

SEQ ID NO: 605224 - DNA, 25 bp, Homo sapien
agcctagctgtgagagacactatct

SEQ ID NO: 605225 - DNA, 25 bp, Homo sapien
cactatctcttctattgactggtat

SEQ ID NO: 605226 - DNA, 25 bp, Homo sapien
catcatcaaacctgtgagctgggat

SEQ ID NO: 605227 - DNA, 25 bp, Homo sapien
aacttgttggcagaaagcacccagg

SEQ ID NO: 605228 - DNA, 25 bp, Homo sapien
atcacctggatgctgggccactgat

SEQ ID NO: 605229 - DNA, 25 bp, Homo sapien
gatgctgggccactgatatgtaaat

SEQ ID NO: 605230 - DNA, 25 bp, Homo sapien
atgtaaattttttccctgagggctg

SEQ ID NO: 605231 - DNA, 25 bp, Homo sapien
atcatctgggttttcaaccagtgac

SEQ ID NO: 605232 - DNA, 25 bp, Homo sapien
gtaagacggattctagcattgtcct

SEQ ID NO: 605233 - DNA, 25 bp, Homo sapien
gacggattctagcattgtcctattt

SEQ ID NO: 605234 - DNA, 25 bp, Homo sapien
ggattctagcattgtcctatttgtt

SEQ ID NO: 605235 - DNA, 25 bp, Homo sapien
ctatcaaaaatagcggcagggcact

SEQ ID NO: 605236 - DNA, 25 bp, Homo sapien
gtccttactcggttaatgaagccat

SEQ ID NO: 605237 - DNA, 25 bp, Homo sapien
tactcggttaatgaagccatcccct

SEQ ID NO: 605238 - DNA, 25 bp, Homo sapien
gttaatgaagccatccccttaccta

SEQ ID NO: 605239 - DNA, 25 bp, Homo sapien
catccccttacctacaaattgagag

SEQ ID NO: 605240 - DNA, 25 bp, Homo sapien
aggtttatgtgacatactcactccc

SEQ ID NO: 605241 - DNA, 25 bp, Homo sapien
acaggccaggaagcagaatgctgtt

SEQ ID NO: 605242 - DNA, 25 bp, Homo sapien
gaagcagaatgctgttgctatctac

SEQ ID NO: 605243 - DNA, 25 bp, Homo sapien
ttggctgggctgaactcgaattcct

SEQ ID NO: 605244 - DNA, 25 bp, Homo sapien
gctgggctgaactcgaattcctggc

SEQ ID NO: 605245 - DNA, 25 bp, Homo sapien
actgcctagcccagtgatccttgtt

SEQ ID NO: 605246 - DNA, 25 bp, Homo sapien
agcccagtgatccttgttctgaatt

SEQ ID NO: 605247 - DNA, 25 bp, Homo sapien
ccttgttctgaattactactgttat

SEQ ID NO: 605248 - DNA, 25 bp, Homo sapien
taagttttagtgtcattttgttgaa

SEQ ID NO: 605249 - DNA, 25 bp, Homo sapien
tgttgaaaatgctgcagttatgtca

SEQ ID NO: 605250 - DNA, 25 bp, Homo sapien
gtcaggctgttgtgtgttagagtac

SEQ ID NO: 605251 - DNA, 25 bp, Homo sapien
gttagagtacacgattggcaagttt

SEQ ID NO: 605252 - DNA, 25 bp, Homo sapien
ggcaagtttggtaatgtgtcttaat

SEQ ID NO: 605253 - DNA, 25 bp, Homo sapien
aaagctctgaattagtgctcagtgt

SEQ ID NO: 605254 - DNA, 25 bp, Homo sapien
tataaggctaaaaaccccagtcttg

SEQ ID NO: 605255 - DNA, 25 bp, Homo sapien
aaaccccagtcttgggatgcggaga

SEQ ID NO: 605256 - DNA, 25 bp, Homo sapien
tattctgttcacttcactgacagct

SEQ ID NO: 605257 - DNA, 25 bp, Homo sapien
actgacagctttgcactgtgcattc

SEQ ID NO: 605258 - DNA, 25 bp, Homo sapien
actgtgcattcccagctgggcatgt

SEQ ID NO: 605259 - DNA, 25 bp, Homo sapien
atgtcccagacatgatctcttgcat

SEQ ID NO: 605260 - DNA, 25 bp, Homo sapien
gatctcttgcatgggctgtactaac

SEQ ID NO: 605261 - DNA, 25 bp, Homo sapien
gctggcaaccagttacatgaaccgg

SEQ ID NO: 605262 - DNA, 25 bp, Homo sapien
aaccggtgtcaggagtgcacattaa

SEQ ID NO: 605263 - DNA, 25 bp, Homo sapien
cattaataggcatctgactagggca

SEQ ID NO: 605264 - DNA, 25 bp, Homo sapien
tgcgctacatccagcctaaagcctg

SEQ ID NO: 605265 - DNA, 25 bp, Homo sapien
cccagacatgctcttcatatcttat

SEQ ID NO: 605266 - DNA, 25 bp, Homo sapien
gacatgctcttcatatcttatcact

SEQ ID NO: 605267 - DNA, 25 bp, Homo sapien
atgctcttcatatcttatcactgtg

SEQ ID NO: 605268 - DNA, 25 bp, Homo sapien
gctcttcatatcttatcactgtgcc

SEQ ID NO: 605269 - DNA, 25 bp, Homo sapien
ttcatatcttatcactgtgcccctg

SEQ ID NO: 605270 - DNA, 25 bp, Homo sapien
atatcttatcactgtgcccctgttc

SEQ ID NO: 605271 - DNA, 25 bp, Homo sapien
tcactgtgcccctgttccagataaa

SEQ ID NO: 605272 - DNA, 25 bp, Homo sapien
tgtgcccctgttccagataaatcct

SEQ ID NO: 605273 - DNA, 25 bp, Homo sapien
aacccacacatttcagtgcaatgcc

SEQ ID NO: 605274 - DNA, 25 bp, Homo sapien
cccacacatttcagtgcaatgcctg

SEQ ID NO: 605275 - DNA, 25 bp, Homo sapien
gtgcaatgcctggaacaaaacaaca

SEQ ID NO: 605276 - DNA, 25 bp, Homo sapien
ttcctgtcaactttttaagttcaag

SEQ ID NO: 605277 - DNA, 25 bp, Homo sapien
acttccctaattgaatcagctgctg

SEQ ID NO: 605278 - DNA, 25 bp, Homo sapien
atcagctgctgcattctcttcccaa

SEQ ID NO: 605279 - DNA, 25 bp, Homo sapien
ttctcttcccaaccatcacgaaaat

SEQ ID NO: 605280 - DNA, 25 bp, Homo sapien
aaccatcacgaaaatgcttgctgga

SEQ ID NO: 605281 - DNA, 25 bp, Homo sapien
gcttgctggagaaaattgatgttat

SEQ ID NO: 605282 - DNA, 25 bp, Homo sapien
aaggtctgtatatcatgttttactc

SEQ ID NO: 605283 - DNA, 25 bp, Homo sapien
gttttactctttctggtagcattta

SEQ ID NO: 605284 - DNA, 25 bp, Homo sapien
ggtagcatttacatacttggaataa

SEQ ID NO: 605285 - DNA, 25 bp, Homo sapien
agttaacatgagaagaggcatcttt

SEQ ID NO: 605286 - DNA, 25 bp, Homo sapien
gttttcatggagactaagttgctta

SEQ ID NO: 605287 - DNA, 25 bp, Homo sapien
tggcttacttgcaaaatccacatgc

SEQ ID NO: 605288 - DNA, 25 bp, Homo sapien
aaaatccacatgcatcctcctggat

SEQ ID NO: 605289 - DNA, 25 bp, Homo sapien
tgctttttccccacgtttgtttctg

SEQ ID NO: 605290 - DNA, 25 bp, Homo sapien
ttttccccacgtttgtttctgtctg

SEQ ID NO: 605291 - DNA, 25 bp, Homo sapien
ttccccacgtttgtttctgtctgtc

SEQ ID NO: 605292 - DNA, 25 bp, Homo sapien
cccacgtttgtttctgtctgtctgg

SEQ ID NO: 605293 - DNA, 25 bp, Homo sapien
ttaagcctgccatctctttgaaagt

SEQ ID NO: 605294 - DNA, 25 bp, Homo sapien
taagcctgccatctctttgaaagtg

SEQ ID NO: 605295 - DNA, 25 bp, Homo sapien
aagcctgccatctctttgaaagtga

SEQ ID NO: 605296 - DNA, 25 bp, Homo sapien
gcctgccatctctttgaaagtgagc

SEQ ID NO: 605297 - DNA, 25 bp, Homo sapien
tgccatctctttgaaagtgagccgc

SEQ ID NO: 605298 - DNA, 25 bp, Homo sapien
gattcctgggctattccaagagtta

SEQ ID NO: 605299 - DNA, 25 bp, Homo sapien
aagagttactgaatccccaccctgg

SEQ ID NO: 605300 - DNA, 25 bp, Homo sapien
ttggcgtctgccagggaccatagac

SEQ ID NO: 605301 - DNA, 25 bp, Homo sapien
gggaccatagaccacagatactcat

SEQ ID NO: 605302 - DNA, 25 bp, Homo sapien
acagatactcatctacgcttgtgac

SEQ ID NO: 605303 - DNA, 25 bp, Homo sapien
ctcccgcccctgagtgtgtgctggg

SEQ ID NO: 605304 - DNA, 25 bp, Homo sapien
tgtggcaagtggagccccaaccgca

SEQ ID NO: 605305 - DNA, 25 bp, Homo sapien
agagcaccatctccagccgtgtgct

SEQ ID NO: 605306 - DNA, 25 bp, Homo sapien
ccagccgtgtgctctcgggtgcaga

SEQ ID NO: 605307 - DNA, 25 bp, Homo sapien
gtgctctcgggtgcagagctgacct

SEQ ID NO: 605308 - DNA, 25 bp, Homo sapien
gagctgacctcccaagtctcaggct

SEQ ID NO: 605309 - DNA, 25 bp, Homo sapien
ggttttatttagtccagatgctgaa

SEQ ID NO: 605310 - DNA, 25 bp, Homo sapien
aagcagctggtgtggaggtctttcc

SEQ ID NO: 605311 - DNA, 25 bp, Homo sapien
aggtctttcccagtgactcatcagt

SEQ ID NO: 605312 - DNA, 25 bp, Homo sapien
cattcaaaatcaaagcctgcacaag

SEQ ID NO: 605313 - DNA, 25 bp, Homo sapien
accaagcctttagactccagcagag

SEQ ID NO: 605314 - DNA, 25 bp, Homo sapien
gggaggaggctccaatacgactact

SEQ ID NO: 605315 - DNA, 25 bp, Homo sapien
tacgactactcccaattcacagggt

SEQ ID NO: 605316 - DNA, 25 bp, Homo sapien
acagggtttgtggttctggatgaaa

SEQ ID NO: 605317 - DNA, 25 bp, Homo sapien
gtggttctggatgaaatctttgcaa

SEQ ID NO: 605318 - DNA, 25 bp, Homo sapien
tctttgcaaagggtttccctggcac

SEQ ID NO: 605319 - DNA, 25 bp, Homo sapien
tttccctggcactcaaacagaataa

SEQ ID NO: 605320 - DNA, 25 bp, Homo sapien
tttcctaacctacagtttttctctg

SEQ ID NO: 605321 - DNA, 25 bp, Homo sapien
cagtttttctctgagtacatatggt

SEQ ID NO: 605322 - DNA, 25 bp, Homo sapien
gtacatatggtttcattgtttgatc

SEQ ID NO: 605323 - DNA, 25 bp, Homo sapien
atctatctgaatatgaacttctagg

SEQ ID NO: 605324 - DNA, 25 bp, Homo sapien
gaacttctaggatcatgtttattct

SEQ ID NO: 605325 - DNA, 25 bp, Homo sapien
aggatcatgtttattctagtagatg

SEQ ID NO: 605326 - DNA, 25 bp, Homo sapien
atgatgacttaaagcctgcagtata

SEQ ID NO: 605327 - DNA, 25 bp, Homo sapien
ctgcagtataggagggacaacgtca

SEQ ID NO: 605328 - DNA, 25 bp, Homo sapien
ggagggacaacgtcaactactgcat

SEQ ID NO: 605329 - DNA, 25 bp, Homo sapien
gacaacgtcaactactgcatgtgca

SEQ ID NO: 605330 - DNA, 25 bp, Homo sapien
ctgcatgtgcaataacaagcttgaa

SEQ ID NO: 605331 - DNA, 25 bp, Homo sapien
gtgggaactctctataccttctgcc

SEQ ID NO: 605332 - DNA, 25 bp, Homo sapien
accttctgcccaatattattgcgaa

SEQ ID NO: 605333 - DNA, 25 bp, Homo sapien
atattattgcgaacctaaaactgct

SEQ ID NO: 605334 - DNA, 25 bp, Homo sapien
tgggagttattgtttactgggtaca

SEQ ID NO: 605335 - DNA, 25 bp, Homo sapien
acagagtttcagttctggaaggtga

SEQ ID NO: 605336 - DNA, 25 bp, Homo sapien
acaacaatgtgaatacttagtgcca

SEQ ID NO: 605337 - DNA, 25 bp, Homo sapien
tgaatacttagtgccattgaaccgt

SEQ ID NO: 605338 - DNA, 25 bp, Homo sapien
agtgccattgaaccgtacacttaaa

SEQ ID NO: 605339 - DNA, 25 bp, Homo sapien
cacttaaaaatagttcagacggcta

SEQ ID NO: 605340 - DNA, 25 bp, Homo sapien
gttcagacggctaactttatgttgt

SEQ ID NO: 605341 - DNA, 25 bp, Homo sapien
gacggctaactttatgttgtgtatg

SEQ ID NO: 605342 - DNA, 25 bp, Homo sapien
agtctctgccttagatgctctggga

SEQ ID NO: 605343 - DNA, 25 bp, Homo sapien
tgggatcctgtaccctctttggtct

SEQ ID NO: 605344 - DNA, 25 bp, Homo sapien
tctttggtctcatgtcctacaatct

SEQ ID NO: 605345 - DNA, 25 bp, Homo sapien
ctacaatctgcattctggccataat

SEQ ID NO: 605346 - DNA, 25 bp, Homo sapien
tggccataatggtcttctctgctgt

SEQ ID NO: 605347 - DNA, 25 bp, Homo sapien
atggtcttctctgctgttccttgaa

SEQ ID NO: 605348 - DNA, 25 bp, Homo sapien
ctcaggactggctgcttcctttggt

SEQ ID NO: 605349 - DNA, 25 bp, Homo sapien
gcttcctttggtatgctattctgat

SEQ ID NO: 605350 - DNA, 25 bp, Homo sapien
aaattcgctgggaggccaataggct

SEQ ID NO: 605351 - DNA, 25 bp, Homo sapien
ataggctgaaatggctcctgcactt

SEQ ID NO: 605352 - DNA, 25 bp, Homo sapien
ttgggttcctaagtcagcaaactga

SEQ ID NO: 605353 - DNA, 25 bp, Homo sapien
agctgggactgtccacagagctcct

SEQ ID NO: 605354 - DNA, 25 bp, Homo sapien
tgtggcctttccagcatggtggtct

SEQ ID NO: 605355 - DNA, 25 bp, Homo sapien
ccagagctactgtcccaagagatag

SEQ ID NO: 605356 - DNA, 25 bp, Homo sapien
gaaggtggaaactgccagtctctta

SEQ ID NO: 605357 - DNA, 25 bp, Homo sapien
gccagtctcttaggctaggaccaga

SEQ ID NO: 605358 - DNA, 25 bp, Homo sapien
taggctaggaccagaaaccagcacc

SEQ ID NO: 605359 - DNA, 25 bp, Homo sapien
gcacccacagccttttggtagtgat

SEQ ID NO: 605360 - DNA, 25 bp, Homo sapien
atcattttaatcattcgtaagtggg

SEQ ID NO: 605361 - DNA, 25 bp, Homo sapien
aacattgtgtaaccatcggcactgt

SEQ ID NO: 605362 - DNA, 25 bp, Homo sapien
taaccatcggcactgtctatatcta

SEQ ID NO: 605363 - DNA, 25 bp, Homo sapien
ggcactgtctatatctaaaactttt

SEQ ID NO: 605364 - DNA, 25 bp, Homo sapien
ctctgttacagggtaccaatatgtg

SEQ ID NO: 605365 - DNA, 25 bp, Homo sapien
gggtaccaatatgtgaataactatc

SEQ ID NO: 605366 - DNA, 25 bp, Homo sapien
atgtgaataactatcattgtcttgt

SEQ ID NO: 605367 - DNA, 25 bp, Homo sapien
aactatcattgtcttgttagcagtg

SEQ ID NO: 605368 - DNA, 25 bp, Homo sapien
ctatcattgtcttgttagcagtggg

SEQ ID NO: 605369 - DNA, 25 bp, Homo sapien
gccctgactcacgtgaaggaattat

SEQ ID NO: 605370 - DNA, 25 bp, Homo sapien
ctcacgtgaaggaattatagcattt

SEQ ID NO: 605371 - DNA, 25 bp, Homo sapien
agcattttgaggtggcacatgttta

SEQ ID NO: 605372 - DNA, 25 bp, Homo sapien
gaggtggcacatgtttagttgatca

SEQ ID NO: 605373 - DNA, 25 bp, Homo sapien
ggcacatgtttagttgatcacataa

SEQ ID NO: 605374 - DNA, 25 bp, Homo sapien
tgaaaaacaggatcgtgaacttccg

SEQ ID NO: 605375 - DNA, 25 bp, Homo sapien
gcatccaggatgtgttaagatggca

SEQ ID NO: 605376 - DNA, 25 bp, Homo sapien
catccaggatgtgttaagatggcat

SEQ ID NO: 605377 - DNA, 25 bp, Homo sapien
atccaggatgtgttaagatggcatt

SEQ ID NO: 605378 - DNA, 25 bp, Homo sapien
tccaggatgtgttaagatggcattg

SEQ ID NO: 605379 - DNA, 25 bp, Homo sapien
ccaggatgtgttaagatggcattga

SEQ ID NO: 605380 - DNA, 25 bp, Homo sapien
caggatgtgttaagatggcattgag

SEQ ID NO: 605381 - DNA, 25 bp, Homo sapien
aagatggcattgaggccgagcgcgg

SEQ ID NO: 605382 - DNA, 25 bp, Homo sapien
agatggcattgaggccgagcgcggt

SEQ ID NO: 605383 - DNA, 25 bp, Homo sapien
gatggcattgaggccgagcgcggtg

SEQ ID NO: 605384 - DNA, 25 bp, Homo sapien
ggccagcctgggtcagccaatgatt

SEQ ID NO: 605385 - DNA, 25 bp, Homo sapien
cagcctgggtcagccaatgattggg

SEQ ID NO: 605386 - DNA, 25 bp, Homo sapien
tggggaggcagcttatctcctaaaa

SEQ ID NO: 605387 - DNA, 25 bp, Homo sapien
ctcctaaaaggagcatgggctttgt

SEQ ID NO: 605388 - DNA, 25 bp, Homo sapien
catgggctttgtgccttgagttcaa

SEQ ID NO: 605389 - DNA, 25 bp, Homo sapien
tgtgccttgagttcaaatccagctc

SEQ ID NO: 605390 - DNA, 25 bp, Homo sapien
aatactagcaattctcccacagttg

SEQ ID NO: 605391 - DNA, 25 bp, Homo sapien
gcaattctcccacagttgttttaaa

SEQ ID NO: 605392 - DNA, 25 bp, Homo sapien
aatctttagtgtctagcatatatgc

SEQ ID NO: 605393 - DNA, 25 bp, Homo sapien
gcatatatgctacgtgctcaatgaa

SEQ ID NO: 605394 - DNA, 25 bp, Homo sapien
acgtgctcaatgaagtgtgactttt

SEQ ID NO: 605395 - DNA, 25 bp, Homo sapien
ctagcagcgagaacacatggtgcaa

SEQ ID NO: 605396 - DNA, 25 bp, Homo sapien
ggaggtaggcaattgggctctcaaa

SEQ ID NO: 605397 - DNA, 25 bp, Homo sapien
ggctctcaaagaaacccttgggctt

SEQ ID NO: 605398 - DNA, 25 bp, Homo sapien
cttgggctttttctagcttaataat

SEQ ID NO: 605399 - DNA, 25 bp, Homo sapien
aaactggatttctagaagcatggct

SEQ ID NO: 605400 - DNA, 25 bp, Homo sapien
ggatttctagaagcatggctattaa

SEQ ID NO: 605401 - DNA, 25 bp, Homo sapien
ctccagaccccaattaggaaactga

SEQ ID NO: 605402 - DNA, 25 bp, Homo sapien
ggaaatcaaagtgggcctaatggaa

SEQ ID NO: 605403 - DNA, 25 bp, Homo sapien
aagaaaatgcaggtagctgcctaaa

SEQ ID NO: 605404 - DNA, 25 bp, Homo sapien
gtagctgcctaaaatccagtggact

SEQ ID NO: 605405 - DNA, 25 bp, Homo sapien
taaaatccagtggactccaggtcca

SEQ ID NO: 605406 - DNA, 25 bp, Homo sapien
taaccatttacttgtttagtatctg

SEQ ID NO: 605407 - DNA, 25 bp, Homo sapien
catttacttgtttagtatctgtgtc

SEQ ID NO: 605408 - DNA, 25 bp, Homo sapien
tttacttgtttagtatctgtgtctt

SEQ ID NO: 605409 - DNA, 25 bp, Homo sapien
tatctgtgtcttccattagcaagta

SEQ ID NO: 605410 - DNA, 25 bp, Homo sapien
atctgtgtcttccattagcaagtaa

SEQ ID NO: 605411 - DNA, 25 bp, Homo sapien
tctgtgtcttccattagcaagtaag

SEQ ID NO: 605412 - DNA, 25 bp, Homo sapien
ctgtgtcttccattagcaagtaagt

SEQ ID NO: 605413 - DNA, 25 bp, Homo sapien
gtgtcttccattagcaagtaagttc

SEQ ID NO: 605414 - DNA, 25 bp, Homo sapien
tgtcttccattagcaagtaagttct

SEQ ID NO: 605415 - DNA, 25 bp, Homo sapien
attagcaagtaagttctggccaggc

SEQ ID NO: 605416 - DNA, 25 bp, Homo sapien
tagcaagtaagttctggccaggcgt

SEQ ID NO: 605417 - DNA, 25 bp, Homo sapien
ccttggttaccctaagtgggcatat

SEQ ID NO: 605418 - DNA, 25 bp, Homo sapien
cttggttaccctaagtgggcatatc

SEQ ID NO: 605419 - DNA, 25 bp, Homo sapien
ttggttaccctaagtgggcatatcc

SEQ ID NO: 605420 - DNA, 25 bp, Homo sapien
tggttaccctaagtgggcatatccc

SEQ ID NO: 605421 - DNA, 25 bp, Homo sapien
ttaccctaagtgggcatatccccca

SEQ ID NO: 605422 - DNA, 25 bp, Homo sapien
gggcatatcccccatgccactcagc

SEQ ID NO: 605423 - DNA, 25 bp, Homo sapien
ggcatatcccccatgccactcagcc

SEQ ID NO: 605424 - DNA, 25 bp, Homo sapien
gcatatcccccatgccactcagccc

SEQ ID NO: 605425 - DNA, 25 bp, Homo sapien
catatcccccatgccactcagccct

SEQ ID NO: 605426 - DNA, 25 bp, Homo sapien
tatcccccatgccactcagccctgc

SEQ ID NO: 605427 - DNA, 25 bp, Homo sapien
atcccccatgccactcagccctgcc

SEQ ID NO: 605428 - DNA, 25 bp, Homo sapien
caaagactgttattcccggcgaagg

SEQ ID NO: 605429 - DNA, 25 bp, Homo sapien
gttattcccggcgaaggaagtgcca

SEQ ID NO: 605430 - DNA, 25 bp, Homo sapien
ggaagtgccaaactctaggcgaaat

SEQ ID NO: 605431 - DNA, 25 bp, Homo sapien
ggaaaccccatgaaattacactgac

SEQ ID NO: 605432 - DNA, 25 bp, Homo sapien
ttacactgacttgattcttgctttt

SEQ ID NO: 605433 - DNA, 25 bp, Homo sapien
aaaaccatccggtttctgatctgcc

SEQ ID NO: 605434 - DNA, 25 bp, Homo sapien
ctgatctgccagtgtgttggtctga

SEQ ID NO: 605435 - DNA, 25 bp, Homo sapien
gttggtctgagtccccgatgcagat

SEQ ID NO: 605436 - DNA, 25 bp, Homo sapien
gatgcagatcagtacctgggcccct

SEQ ID NO: 605437 - DNA, 25 bp, Homo sapien
ttctccattggagcactatgataat

SEQ ID NO: 605438 - DNA, 25 bp, Homo sapien
agaaatgcagctgctattcccgccg

SEQ ID NO: 605439 - DNA, 25 bp, Homo sapien
aggagaggcctgtgtacctgggctc

SEQ ID NO: 605440 - DNA, 25 bp, Homo sapien
gcctgtgtacctgggctcggtttta

SEQ ID NO: 605441 - DNA, 25 bp, Homo sapien
gtgtgcttgttggtgttaagtaaga

SEQ ID NO: 605442 - DNA, 25 bp, Homo sapien
gttaagtaagatagcacgatggaat

SEQ ID NO: 605443 - DNA, 25 bp, Homo sapien
agatagcacgatggaataatgaagt

SEQ ID NO: 605444 - DNA, 25 bp, Homo sapien
ggatgaagactttttacagataatc

SEQ ID NO: 605445 - DNA, 25 bp, Homo sapien
ttttacagataatcatgaagttctt

SEQ ID NO: 605446 - DNA, 25 bp, Homo sapien
tctttctcagtttaaacatttgtga

SEQ ID NO: 605447 - DNA, 25 bp, Homo sapien
ctcagtttaaacatttgtgattaac

SEQ ID NO: 605448 - DNA, 25 bp, Homo sapien
gagtaaaagtttagccaggcccagt

SEQ ID NO: 605449 - DNA, 25 bp, Homo sapien
agtaaaagtttagccaggcccagtg

SEQ ID NO: 605450 - DNA, 25 bp, Homo sapien
ctacagataataaaagcacatcgga

SEQ ID NO: 605451 - DNA, 25 bp, Homo sapien
aagcacatcggaaagacatgtccat

SEQ ID NO: 605452 - DNA, 25 bp, Homo sapien
agcacatcggaaagacatgtccata

SEQ ID NO: 605453 - DNA, 25 bp, Homo sapien
gcacatcggaaagacatgtccataa

SEQ ID NO: 605454 - DNA, 25 bp, Homo sapien
catcggaaagacatgtccataaaat

SEQ ID NO: 605455 - DNA, 25 bp, Homo sapien
gacatgtccataaaataggtgacca

SEQ ID NO: 605456 - DNA, 25 bp, Homo sapien
catgtccataaaataggtgaccaaa

SEQ ID NO: 605457 - DNA, 25 bp, Homo sapien
ataggtgaccaaaacacattaagaa

SEQ ID NO: 605458 - DNA, 25 bp, Homo sapien
tgaccaaaacacattaagaaaagac

SEQ ID NO: 605459 - DNA, 25 bp, Homo sapien
aaagacaaaagacagctgggtgcag

SEQ ID NO: 605460 - DNA, 25 bp, Homo sapien
atggtggtgcatgcccataaaccca

SEQ ID NO: 605461 - DNA, 25 bp, Homo sapien
ttctaatatgtacctgtcccgccta

SEQ ID NO: 605462 - DNA, 25 bp, Homo sapien
cgcctacgtcgcatcgagatcgcga

SEQ ID NO: 605463 - DNA, 25 bp, Homo sapien
gagatcgcgacctacctgaatctgt

SEQ ID NO: 605464 - DNA, 25 bp, Homo sapien
cctacctgaatctgtccgagaagca

SEQ ID NO: 605465 - DNA, 25 bp, Homo sapien
tcagaaccgccgagtgaagcacaag

SEQ ID NO: 605466 - DNA, 25 bp, Homo sapien
gagcgcaccgcaaggctgcaagtgc

SEQ ID NO: 605467 - DNA, 25 bp, Homo sapien
aaggctgcaagtgcgcatcgctctc

SEQ ID NO: 605468 - DNA, 25 bp, Homo sapien
tcagccaagtgctccgaggatgacg

SEQ ID NO: 605469 - DNA, 25 bp, Homo sapien
ggatgacgacgaattgcccatgtct

SEQ ID NO: 605470 - DNA, 25 bp, Homo sapien
tcagggaaggacgaccgggatctta

SEQ ID NO: 605471 - DNA, 25 bp, Homo sapien
ggatcttacggtcactccctaggcg

SEQ ID NO: 605472 - DNA, 25 bp, Homo sapien
catcctcctggatctcacagaagat

SEQ ID NO: 605473 - DNA, 25 bp, Homo sapien
ccacgtttgtttctgtctgtctggt

SEQ ID NO: 605474 - DNA, 25 bp, Homo sapien
ctgtctgtctggtacttttcctttt

SEQ ID NO: 605475 - DNA, 25 bp, Homo sapien
aagcctgccatctctttgaaagtga

SEQ ID NO: 605476 - DNA, 25 bp, Homo sapien
gtgagccgcacagtgataatccatt

SEQ ID NO: 605477 - DNA, 25 bp, Homo sapien
attttcttcattgtaaccccacagt

SEQ ID NO: 605478 - DNA, 25 bp, Homo sapien
ttttcttcattgtaaccccacagtg

SEQ ID NO: 605479 - DNA, 25 bp, Homo sapien
tttcttcattgtaaccccacagtgt

SEQ ID NO: 605480 - DNA, 25 bp, Homo sapien
tcttcattgtaaccccacagtgtat

SEQ ID NO: 605481 - DNA, 25 bp, Homo sapien
ccacagtgtatgtattccacattaa

SEQ ID NO: 605482 - DNA, 25 bp, Homo sapien
acagtgtatgtattccacattaaat

SEQ ID NO: 605483 - DNA, 25 bp, Homo sapien
gagggaaatggaaatacttcaagaa

SEQ ID NO: 605484 - DNA, 25 bp, Homo sapien
ttcaagaagaagacaagtttttgta

SEQ ID NO: 605485 - DNA, 25 bp, Homo sapien
tcttcagaagtaaaggtattgcatc

SEQ ID NO: 605486 - DNA, 25 bp, Homo sapien
ttcagaagtaaaggtattgcatctt

SEQ ID NO: 605487 - DNA, 25 bp, Homo sapien
aagtaaaggtattgcatctttgaaa

SEQ ID NO: 605488 - DNA, 25 bp, Homo sapien
tgcccagaaaacaagagcttctaga

SEQ ID NO: 605489 - DNA, 25 bp, Homo sapien
gcccagaaaacaagagcttctagaa

SEQ ID NO: 605490 - DNA, 25 bp, Homo sapien
cccagaaaacaagagcttctagaaa

SEQ ID NO: 605491 - DNA, 25 bp, Homo sapien
cagaaaacaagagcttctagaaatt

SEQ ID NO: 605492 - DNA, 25 bp, Homo sapien
tattaaattcttagagggttggaag

SEQ ID NO: 605493 - DNA, 25 bp, Homo sapien
taaattcttagagggttggaagata

SEQ ID NO: 605494 - DNA, 25 bp, Homo sapien
aaagttgagtactctggacaccaga

SEQ ID NO: 605495 - DNA, 25 bp, Homo sapien
gacgggtctgatgagttaccatgaa

SEQ ID NO: 605496 - DNA, 25 bp, Homo sapien
taccatgaaatgagcaccggactgt

SEQ ID NO: 605497 - DNA, 25 bp, Homo sapien
accggactgtgggtcaagaggccaa

SEQ ID NO: 605498 - DNA, 25 bp, Homo sapien
ggtcaagaggccaaccccagctttg

SEQ ID NO: 605499 - DNA, 25 bp, Homo sapien
caaccccagctttgctgctgacatt

SEQ ID NO: 605500 - DNA, 25 bp, Homo sapien
gctgacattctgtgttgtcttgaac

SEQ ID NO: 605501 - DNA, 25 bp, Homo sapien
aagtcacaccctctcttaaggtctc

SEQ ID NO: 605502 - DNA, 25 bp, Homo sapien
aaatatccacctgtcttgtatcatg

SEQ ID NO: 605503 - DNA, 25 bp, Homo sapien
acctgtcttgtatcatggactttaa

SEQ ID NO: 605504 - DNA, 25 bp, Homo sapien
aaaagagttctatggcacaaataaa

SEQ ID NO: 605505 - DNA, 25 bp, Homo sapien
cagagtggccctgaattgtggctta

SEQ ID NO: 605506 - DNA, 25 bp, Homo sapien
atcatcagccagatatgtagtccaa

SEQ ID NO: 605507 - DNA, 25 bp, Homo sapien
gatatgtagtccaagctgctgtcct

SEQ ID NO: 605508 - DNA, 25 bp, Homo sapien
ttcagaggtgattgccagtttccta

SEQ ID NO: 605509 - DNA, 25 bp, Homo sapien
tgattgccagtttcctatgtgagcc

SEQ ID NO: 605510 - DNA, 25 bp, Homo sapien
tatgtgagccctgcctagtgactca

SEQ ID NO: 605511 - DNA, 25 bp, Homo sapien
agtgactcaacaatattctctcaaa

SEQ ID NO: 605512 - DNA, 25 bp, Homo sapien
aaacctaagcttcagggaacttgtg

SEQ ID NO: 605513 - DNA, 25 bp, Homo sapien
gtgaacacagggaatatctctttta

SEQ ID NO: 605514 - DNA, 25 bp, Homo sapien
atctcttttatggaggtctggccac

SEQ ID NO: 605515 - DNA, 25 bp, Homo sapien
ttatggaggtctggccacaacaaac

SEQ ID NO: 605516 - DNA, 25 bp, Homo sapien
aaaatacttctgaggtgactgaacc

SEQ ID NO: 605517 - DNA, 25 bp, Homo sapien
gtgactgaaccaaaaacgggcccat

SEQ ID NO: 605518 - DNA, 25 bp, Homo sapien
aacgggcccatcaggtacaaaggat

SEQ ID NO: 605519 - DNA, 25 bp, Homo sapien
acaaaggataactatcatctccact

SEQ ID NO: 605520 - DNA, 25 bp, Homo sapien
tctccactccatcttttgacattgt

SEQ ID NO: 605521 - DNA, 25 bp, Homo sapien
aggaatctatgtcagagtgtcagct

SEQ ID NO: 605522 - DNA, 25 bp, Homo sapien
aaaggactcattttcctggtatcaa

SEQ ID NO: 605523 - DNA, 25 bp, Homo sapien
ttttcctggtatcaaaacttggcag

SEQ ID NO: 605524 - DNA, 25 bp, Homo sapien
aacttggcagctggtgattctccat

SEQ ID NO: 605525 - DNA, 25 bp, Homo sapien
gctggtgattctccatcatgataat

SEQ ID NO: 605526 - DNA, 25 bp, Homo sapien
caatctgcttgtctgtctataaata

SEQ ID NO: 605527 - DNA, 25 bp, Homo sapien
tgtaaagcagagcacagtcatgagc

SEQ ID NO: 605528 - DNA, 25 bp, Homo sapien
agtcatgagctttccttcccacaag

SEQ ID NO: 605529 - DNA, 25 bp, Homo sapien
gctttccttcccacaaggagcaata

SEQ ID NO: 605530 - DNA, 25 bp, Homo sapien
gcaatattttctaatgtgtacccat

SEQ ID NO: 605531 - DNA, 25 bp, Homo sapien
gtgtacccatcagtggaaccaggat

SEQ ID NO: 605532 - DNA, 25 bp, Homo sapien
accaggatggttaaaggcaacttat

SEQ ID NO: 605533 - DNA, 25 bp, Homo sapien
ggcaaaacaggactagttccagaaa

SEQ ID NO: 605534 - DNA, 25 bp, Homo sapien
agaaaattatgttgtcttcctctaa

SEQ ID NO: 605535 - DNA, 25 bp, Homo sapien
tatgttgtcttcctctaatactatt

SEQ ID NO: 605536 - DNA, 25 bp, Homo sapien
agtggatggcagtatcttcatggta

SEQ ID NO: 605537 - DNA, 25 bp, Homo sapien
catggtatccatggtaacgaataaa

SEQ ID NO: 605538 - DNA, 25 bp, Homo sapien
cataggagctggaactactgtgaac

SEQ ID NO: 605539 - DNA, 25 bp, Homo sapien
taggagctggaactactgtgaacta

SEQ ID NO: 605540 - DNA, 25 bp, Homo sapien
aggagctggaactactgtgaactag

SEQ ID NO: 605541 - DNA, 25 bp, Homo sapien
gagctggaactactgtgaactaggc

SEQ ID NO: 605542 - DNA, 25 bp, Homo sapien
gctggaactactgtgaactaggcat

SEQ ID NO: 605543 - DNA, 25 bp, Homo sapien
tggaactactgtgaactaggcatga

SEQ ID NO: 605544 - DNA, 25 bp, Homo sapien
ggaactactgtgaactaggcatgag

SEQ ID NO: 605545 - DNA, 25 bp, Homo sapien
gaactactgtgaactaggcatgaga

SEQ ID NO: 605546 - DNA, 25 bp, Homo sapien
actactgtgaactaggcatgagagg

SEQ ID NO: 605547 - DNA, 25 bp, Homo sapien
tactgtgaactaggcatgagaggga

SEQ ID NO: 605548 - DNA, 25 bp, Homo sapien
atgagagggatctaggttatgctcc

SEQ ID NO: 605549 - DNA, 25 bp, Homo sapien
tcagagccccgcgtcgaatagtggt

SEQ ID NO: 605550 - DNA, 25 bp, Homo sapien
cagagccccgcgtcgaatagtggtt

SEQ ID NO: 605551 - DNA, 25 bp, Homo sapien
gagccccgcgtcgaatagtggttga

SEQ ID NO: 605552 - DNA, 25 bp, Homo sapien
agccccgcgtcgaatagtggttgac

SEQ ID NO: 605553 - DNA, 25 bp, Homo sapien
gaatagtggttgactcgccgctcgc

SEQ ID NO: 605554 - DNA, 25 bp, Homo sapien
aatagtggttgactcgccgctcgca

SEQ ID NO: 605555 - DNA, 25 bp, Homo sapien
tagtggttgactcgccgctcgcaat

SEQ ID NO: 605556 - DNA, 25 bp, Homo sapien
ttgactcgccgctcgcaatggctca

SEQ ID NO: 605557 - DNA, 25 bp, Homo sapien
aggtcaggatttccaaagttccaga

SEQ ID NO: 605558 - DNA, 25 bp, Homo sapien
gtcaggatttccaaagttccagacc

SEQ ID NO: 605559 - DNA, 25 bp, Homo sapien
caggatttccaaagttccagaccag

SEQ ID NO: 605560 - DNA, 25 bp, Homo sapien
cacctcacacggcagggtattccaa

SEQ ID NO: 605561 - DNA, 25 bp, Homo sapien
acctcacacggcagggtattccaac

SEQ ID NO: 605562 - DNA, 25 bp, Homo sapien
tcacacggcagggtattccaacaga

SEQ ID NO: 605563 - DNA, 25 bp, Homo sapien
cacacggcagggtattccaacagac

SEQ ID NO: 605564 - DNA, 25 bp, Homo sapien
acacggcagggtattccaacagacc

SEQ ID NO: 605565 - DNA, 25 bp, Homo sapien
cacggcagggtattccaacagacct

SEQ ID NO: 605566 - DNA, 25 bp, Homo sapien
acggcagggtattccaacagaccta

SEQ ID NO: 605567 - DNA, 25 bp, Homo sapien
ccagaaaggacatctacaccgaaaa

SEQ ID NO: 605568 - DNA, 25 bp, Homo sapien
tctacaccgaaaacccatctgtaca

SEQ ID NO: 605569 - DNA, 25 bp, Homo sapien
ctacaccgaaaacccatctgtacat

SEQ ID NO: 605570 - DNA, 25 bp, Homo sapien
tacaccgaaaacccatctgtacatc

SEQ ID NO: 605571 - DNA, 25 bp, Homo sapien
aagagtcaactcatgcgaaaagctt

SEQ ID NO: 605572 - DNA, 25 bp, Homo sapien
aactcatgcgaaaagcttcaccgat

SEQ ID NO: 605573 - DNA, 25 bp, Homo sapien
gcgaaaagcttcaccgatgtcttat

SEQ ID NO: 605574 - DNA, 25 bp, Homo sapien
aagcttcaccgatgtcttattttag

SEQ ID NO: 605575 - DNA, 25 bp, Homo sapien
tcaccgatgtcttattttaggaaat

SEQ ID NO: 605576 - DNA, 25 bp, Homo sapien
tcagcaaccatcaacctcgaggcaa

SEQ ID NO: 605577 - DNA, 25 bp, Homo sapien
gcaaccatcaacctcgaggcaagac

SEQ ID NO: 605578 - DNA, 25 bp, Homo sapien
aagagtacgactcaccgaaggctca

SEQ ID NO: 605579 - DNA, 25 bp, Homo sapien
acgactcaccgaaggctcagattga

SEQ ID NO: 605580 - DNA, 25 bp, Homo sapien
gaaggctcagattgataatcagcat

SEQ ID NO: 605581 - DNA, 25 bp, Homo sapien
agattgataatcagcattttttagc

SEQ ID NO: 605582 - DNA, 25 bp, Homo sapien
ggatgcatggaaatagcagcttgaa

SEQ ID NO: 605583 - DNA, 25 bp, Homo sapien
agcagcttgaaactaggaggtaaca

SEQ ID NO: 605584 - DNA, 25 bp, Homo sapien
ggaggtaacaagaaagcttctagga

SEQ ID NO: 605585 - DNA, 25 bp, Homo sapien
agcttctaggaagtagatgttccat

SEQ ID NO: 605586 - DNA, 25 bp, Homo sapien
gaagtagatgttccatatcttcaaa

SEQ ID NO: 605587 - DNA, 25 bp, Homo sapien
gatgttccatatcttcaaaatgcct

SEQ ID NO: 605588 - DNA, 25 bp, Homo sapien
cctccaattttgtaagaatgctagc

SEQ ID NO: 605589 - DNA, 25 bp, Homo sapien
taagaatgctagctaggtattcctg

SEQ ID NO: 605590 - DNA, 25 bp, Homo sapien
gctaggtattcctgggattattata

SEQ ID NO: 605591 - DNA, 25 bp, Homo sapien
tattcctgggattattatactgaga

SEQ ID NO: 605592 - DNA, 25 bp, Homo sapien
tcctgggattattatactgagatat

SEQ ID NO: 605593 - DNA, 25 bp, Homo sapien
gctctggcttgttaactttgctgga

SEQ ID NO: 605594 - DNA, 25 bp, Homo sapien
actttgctggatttggcctgcagac

SEQ ID NO: 605595 - DNA, 25 bp, Homo sapien
aggccctgcactacagattgtggaa

SEQ ID NO: 605596 - DNA, 25 bp, Homo sapien
ggaatcatcatttcatttatctcag

SEQ ID NO: 605597 - DNA, 25 bp, Homo sapien
tcatttatctcagttgcagcatcga

SEQ ID NO: 605598 - DNA, 25 bp, Homo sapien
gcatcgaggtaatcagggtcctgat

SEQ ID NO: 605599 - DNA, 25 bp, Homo sapien
gattaacctgcttaagatcatacag

SEQ ID NO: 605600 - DNA, 25 bp, Homo sapien
acagcttaggatgtgcttgagttaa

SEQ ID NO: 605601 - DNA, 25 bp, Homo sapien
ttaagacccaagtcagagtggtgct

SEQ ID NO: 605602 - DNA, 25 bp, Homo sapien
agagtggtgctattataccttcaaa

SEQ ID NO: 605603 - DNA, 25 bp, Homo sapien
gagctggccggcagggttctatcta

SEQ ID NO: 605604 - DNA, 25 bp, Homo sapien
gctacttagttttgttgattccaag

SEQ ID NO: 605605 - DNA, 25 bp, Homo sapien
gttgattccaagaagtcactaattt

SEQ ID NO: 605606 - DNA, 25 bp, Homo sapien
tagattctgatttcgaggtagcttc

SEQ ID NO: 605607 - DNA, 25 bp, Homo sapien
cgaggtagcttcatttttctagtgt

SEQ ID NO: 605608 - DNA, 25 bp, Homo sapien
tttgttgagcacttactctctgctg

SEQ ID NO: 605609 - DNA, 25 bp, Homo sapien
tgagcacttactctctgctgtggct

SEQ ID NO: 605610 - DNA, 25 bp, Homo sapien
gtggctgggcatacattactttctt

SEQ ID NO: 605611 - DNA, 25 bp, Homo sapien
catacattactttctttccacagtc

SEQ ID NO: 605612 - DNA, 25 bp, Homo sapien
ttctttccacagtccgttggttgaa

SEQ ID NO: 605613 - DNA, 25 bp, Homo sapien
cagtccgttggttgaattgtcctga

SEQ ID NO: 605614 - DNA, 25 bp, Homo sapien
gatggcctgtgagccaaatctaccc

SEQ ID NO: 605615 - DNA, 25 bp, Homo sapien
aactgagcccgatgggttatgagaa

SEQ ID NO: 605616 - DNA, 25 bp, Homo sapien
aggagtgaatgtgccatcccagcta

SEQ ID NO: 605617 - DNA, 25 bp, Homo sapien
aatgtgccatcccagctagagctca

SEQ ID NO: 605618 - DNA, 25 bp, Homo sapien
aacttcccgtgacctggcaggagaa

SEQ ID NO: 605619 - DNA, 25 bp, Homo sapien
acctggcaggagaaatcgtcacgtg

SEQ ID NO: 605620 - DNA, 25 bp, Homo sapien
gtcacgtgaactcagacagtggttg

SEQ ID NO: 605621 - DNA, 25 bp, Homo sapien
ggttgggttgactgcgaatgacact

SEQ ID NO: 605622 - DNA, 25 bp, Homo sapien
acactgtgcagtgttgggcctgttt

SEQ ID NO: 605623 - DNA, 25 bp, Homo sapien
gttgggcctgtttctcagaaccaag

SEQ ID NO: 605624 - DNA, 25 bp, Homo sapien
aaaacttgtgtttggctccatcact

SEQ ID NO: 605625 - DNA, 25 bp, Homo sapien
ggctccatcactcatgctatacatg

SEQ ID NO: 605626 - DNA, 25 bp, Homo sapien
tcctccttgcatcctcagaaataat

SEQ ID NO: 605627 - DNA, 25 bp, Homo sapien
aattgctaggagttctcttttaact

SEQ ID NO: 605628 - DNA, 25 bp, Homo sapien
tcttttaacttagctcatcccttag

SEQ ID NO: 605629 - DNA, 25 bp, Homo sapien
agctcatcccttagataccttacat

SEQ ID NO: 605630 - DNA, 25 bp, Homo sapien
agcaaacccctcatttcttgtttct

SEQ ID NO: 605631 - DNA, 25 bp, Homo sapien
ctgaatgtgtgatctttgctctaat

SEQ ID NO: 605632 - DNA, 25 bp, Homo sapien
gagagtgcctgttatttcacctgac

SEQ ID NO: 605633 - DNA, 25 bp, Homo sapien
gttatttcacctgactctggttgtt

SEQ ID NO: 605634 - DNA, 25 bp, Homo sapien
tctggttgtttgtgagctgctaagt

SEQ ID NO: 605635 - DNA, 25 bp, Homo sapien
aaatctgggcctactaaaagctaca

SEQ ID NO: 605636 - DNA, 25 bp, Homo sapien
taaaagctacagtcaccctttccta

SEQ ID NO: 605637 - DNA, 25 bp, Homo sapien
gagcagtcagcaccgtcaggaaccc

SEQ ID NO: 605638 - DNA, 25 bp, Homo sapien
agcaccgtcaggaaccccgcggagg

SEQ ID NO: 605639 - DNA, 25 bp, Homo sapien
tgctttccagggaggcccacatctg

SEQ ID NO: 605640 - DNA, 25 bp, Homo sapien
tgtcactccagaagcacccaagttt

SEQ ID NO: 605641 - DNA, 25 bp, Homo sapien
agaagcacccaagtttactctgcca

SEQ ID NO: 605642 - DNA, 25 bp, Homo sapien
cccaagtttactctgccacgtgagg

SEQ ID NO: 605643 - DNA, 25 bp, Homo sapien
cacgtgaggacgctcatccctcggt

SEQ ID NO: 605644 - DNA, 25 bp, Homo sapien
atccctcggtcacatgaacctagac

SEQ ID NO: 605645 - DNA, 25 bp, Homo sapien
cttcctttggaagctgcagtcgggt

SEQ ID NO: 605646 - DNA, 25 bp, Homo sapien
tttggaagctgcagtcgggtgtcct

SEQ ID NO: 605647 - DNA, 25 bp, Homo sapien
gtgtcctgaggcaaggtggccccac

SEQ ID NO: 605648 - DNA, 25 bp, Homo sapien
gtcaagtaaattgcagctacttatc

SEQ ID NO: 605649 - DNA, 25 bp, Homo sapien
attgcagctacttatcaagcacttt

SEQ ID NO: 605650 - DNA, 25 bp, Homo sapien
gcagctacttatcaagcacttttga

SEQ ID NO: 605651 - DNA, 25 bp, Homo sapien
caagcacttttgaatgaatacatga

SEQ ID NO: 605652 - DNA, 25 bp, Homo sapien
gaatcatctctaaatatcacatcta

SEQ ID NO: 605653 - DNA, 25 bp, Homo sapien
atatcacatctatggttggcaggag

SEQ ID NO: 605654 - DNA, 25 bp, Homo sapien
acatctatggttggcaggagtggca

SEQ ID NO: 605655 - DNA, 25 bp, Homo sapien
ggcaggagtggcatgtataatacaa

SEQ ID NO: 605656 - DNA, 25 bp, Homo sapien
taatacaaaatgtctggtggcccta

SEQ ID NO: 605657 - DNA, 25 bp, Homo sapien
gtaaattcacaaatggctttttaga

SEQ ID NO: 605658 - DNA, 25 bp, Homo sapien
atggctttttagaactgatgacaaa

SEQ ID NO: 605659 - DNA, 25 bp, Homo sapien
gacaaccttagttcacttgggtatt

SEQ ID NO: 605660 - DNA, 25 bp, Homo sapien
ttgggtattcccataatccttgtct

SEQ ID NO: 605661 - DNA, 25 bp, Homo sapien
aatccttgtctttcagggttgacct

SEQ ID NO: 605662 - DNA, 25 bp, Homo sapien
tcagggttgacctgttacagctgct

SEQ ID NO: 605663 - DNA, 25 bp, Homo sapien
tgttacagctgcttaaacacatcac

SEQ ID NO: 605664 - DNA, 25 bp, Homo sapien
aacacatcactgtatgctaggtatt

SEQ ID NO: 605665 - DNA, 25 bp, Homo sapien
ctgtatgctaggtattgcctacctt

SEQ ID NO: 605666 - DNA, 25 bp, Homo sapien
tgcctaccttcacttacttttctaa

SEQ ID NO: 605667 - DNA, 25 bp, Homo sapien
ttacttttctaaccttgccgatgtg

SEQ ID NO: 605668 - DNA, 25 bp, Homo sapien
ataaactgggtatatctccgccaca

SEQ ID NO: 605669 - DNA, 25 bp, Homo sapien
gtatatctccgccacacttctacgt

SEQ ID NO: 605670 - DNA, 25 bp, Homo sapien
caagctaattcatagtgctagaaag

SEQ ID NO: 605671 - DNA, 25 bp, Homo sapien
tgctagaaagcagatcagttgttgg

SEQ ID NO: 605672 - DNA, 25 bp, Homo sapien
aaagcagatcagttgttggctgcgt

SEQ ID NO: 605673 - DNA, 25 bp, Homo sapien
gcagatcagttgttggctgcgtgta

SEQ ID NO: 605674 - DNA, 25 bp, Homo sapien
agatcagttgttggctgcgtgtagt

SEQ ID NO: 605675 - DNA, 25 bp, Homo sapien
ttgttggctgcgtgtagtgaggatt

SEQ ID NO: 605676 - DNA, 25 bp, Homo sapien
ggctgcgtgtagtgaggattgatta

SEQ ID NO: 605677 - DNA, 25 bp, Homo sapien
acttctgggaatgtggacatgttca

SEQ ID NO: 605678 - DNA, 25 bp, Homo sapien
ctgggaatgtggacatgttcatttt

SEQ ID NO: 605679 - DNA, 25 bp, Homo sapien
ggattcatgggtatatacatatgtt

SEQ ID NO: 605680 - DNA, 25 bp, Homo sapien
ttaagaatgtgcaattgggctgggc

SEQ ID NO: 605681 - DNA, 25 bp, Homo sapien
tgctgtttgtgtgaaacctccactg

SEQ ID NO: 605682 - DNA, 25 bp, Homo sapien
ttgtgtgaaacctccactgtgccaa

SEQ ID NO: 605683 - DNA, 25 bp, Homo sapien
tttaacatttattcacagatagcat

SEQ ID NO: 605684 - DNA, 25 bp, Homo sapien
atagcatgaaaagccacagtccatt

SEQ ID NO: 605685 - DNA, 25 bp, Homo sapien
tgaaaagccacagtccatttgccat

SEQ ID NO: 605686 - DNA, 25 bp, Homo sapien
aagccacagtccatttgccatttag

SEQ ID NO: 605687 - DNA, 25 bp, Homo sapien
cacagtccatttgccatttagctta

SEQ ID NO: 605688 - DNA, 25 bp, Homo sapien
gtccatttgccatttagcttatttg

SEQ ID NO: 605689 - DNA, 25 bp, Homo sapien
gccatttagcttatttgattgagag

SEQ ID NO: 605690 - DNA, 25 bp, Homo sapien
ctgaggcacaggaaggcacagtgac

SEQ ID NO: 605691 - DNA, 25 bp, Homo sapien
gaaggcacagtgactgagcaagagt

SEQ ID NO: 605692 - DNA, 25 bp, Homo sapien
gaaaatgcccccgtgatccaggata

SEQ ID NO: 605693 - DNA, 25 bp, Homo sapien
atccaggataaggagcattcagatc

SEQ ID NO: 605694 - DNA, 25 bp, Homo sapien
gagcattcagatcaaaattccagca

SEQ ID NO: 605695 - DNA, 25 bp, Homo sapien
gaaaacagagtctacatcatcagaa

SEQ ID NO: 605696 - DNA, 25 bp, Homo sapien
agcctccagggaagagctcgagtca

SEQ ID NO: 605697 - DNA, 25 bp, Homo sapien
aagagctcgagtcacacacacaggg

SEQ ID NO: 605698 - DNA, 25 bp, Homo sapien
gggacctggatcacagcacactgac

SEQ ID NO: 605699 - DNA, 25 bp, Homo sapien
ggatcacagcacactgacttctctg

SEQ ID NO: 605700 - DNA, 25 bp, Homo sapien
gcacactgacttctctgcaagaact

SEQ ID NO: 605701 - DNA, 25 bp, Homo sapien
tgacttctctgcaagaactcggaaa

SEQ ID NO: 605702 - DNA, 25 bp, Homo sapien
ttctctgcaagaactcggaaagtta

SEQ ID NO: 605703 - DNA, 25 bp, Homo sapien
accagtttaggcaacatagtggaac

SEQ ID NO: 605704 - DNA, 25 bp, Homo sapien
tgggcattttggcatatgcctatag

SEQ ID NO: 605705 - DNA, 25 bp, Homo sapien
gggcattttggcatatgcctatagt

SEQ ID NO: 605706 - DNA, 25 bp, Homo sapien
gcattttggcatatgcctatagtcc

SEQ ID NO: 605707 - DNA, 25 bp, Homo sapien
ggaggtcaagtttgcagtgaactac

SEQ ID NO: 605708 - DNA, 25 bp, Homo sapien
gaggtcaagtttgcagtgaactacg

SEQ ID NO: 605709 - DNA, 25 bp, Homo sapien
aggtcaagtttgcagtgaactacga

SEQ ID NO: 605710 - DNA, 25 bp, Homo sapien
ggtcaagtttgcagtgaactacgat

SEQ ID NO: 605711 - DNA, 25 bp, Homo sapien
gtcaagtttgcagtgaactacgatt

SEQ ID NO: 605712 - DNA, 25 bp, Homo sapien
tcaagtttgcagtgaactacgattg

SEQ ID NO: 605713 - DNA, 25 bp, Homo sapien
aagtttgcagtgaactacgattgca

SEQ ID NO: 605714 - DNA, 25 bp, Homo sapien
tcccgccaaggcgtttgtttgtgct

SEQ ID NO: 605715 - DNA, 25 bp, Homo sapien
ccaaggcgtttgtttgtgctgtgtg

SEQ ID NO: 605716 - DNA, 25 bp, Homo sapien
gtgtgccagctctgcgccaggacgc

SEQ ID NO: 605717 - DNA, 25 bp, Homo sapien
gaagggagctgcaagcgcttattaa

SEQ ID NO: 605718 - DNA, 25 bp, Homo sapien
agggagctgcaagcgcttattaatc

SEQ ID NO: 605719 - DNA, 25 bp, Homo sapien
gctgcaagcgcttattaatcgccaa

SEQ ID NO: 605720 - DNA, 25 bp, Homo sapien
agcgcttattaatcgccaacggtgt

SEQ ID NO: 605721 - DNA, 25 bp, Homo sapien
attaatcgccaacggtgtactcagc

SEQ ID NO: 605722 - DNA, 25 bp, Homo sapien
aatcgccaacggtgtactcagctct

SEQ ID NO: 605723 - DNA, 25 bp, Homo sapien
gccaacggtgtactcagctctgagg

SEQ ID NO: 605724 - DNA, 25 bp, Homo sapien
caacggtgtactcagctctgaggct

SEQ ID NO: 605725 - DNA, 25 bp, Homo sapien
ttatctattggtatgtatatgtatg

SEQ ID NO: 605726 - DNA, 25 bp, Homo sapien
gtcttaataaattagttcttgctat

SEQ ID NO: 605727 - DNA, 25 bp, Homo sapien
aaattagttcttgctatagtcgata

SEQ ID NO: 605728 - DNA, 25 bp, Homo sapien
tagttcttgctatagtcgatatggg

SEQ ID NO: 605729 - DNA, 25 bp, Homo sapien
gttcttgctatagtcgatatgggta

SEQ ID NO: 605730 - DNA, 25 bp, Homo sapien
cttgctatagtcgatatgggtaata

SEQ ID NO: 605731 - DNA, 25 bp, Homo sapien
atatattttgtttatgactgtgaaa

SEQ ID NO: 605732 - DNA, 25 bp, Homo sapien
ttaaatgagaatacgggctggaagc

SEQ ID NO: 605733 - DNA, 25 bp, Homo sapien
tacgggctggaagcctggaatccca

SEQ ID NO: 605734 - DNA, 25 bp, Homo sapien
tgagtttggagaatcgcagaggtca

SEQ ID NO: 605735 - DNA, 25 bp, Homo sapien
caacataggaagactgtgagaacag

SEQ ID NO: 605736 - DNA, 25 bp, Homo sapien
tgacctcgtgattcatctgcatcaa

SEQ ID NO: 605737 - DNA, 25 bp, Homo sapien
gacctcgtgattcatctgcatcaac

SEQ ID NO: 605738 - DNA, 25 bp, Homo sapien
acctcgtgattcatctgcatcaacc

SEQ ID NO: 605739 - DNA, 25 bp, Homo sapien
tcgtgattcatctgcatcaacctcc

SEQ ID NO: 605740 - DNA, 25 bp, Homo sapien
tgcatcaacctccttaagtgctcgg

SEQ ID NO: 605741 - DNA, 25 bp, Homo sapien
gcatcaacctccttaagtgctcgga

SEQ ID NO: 605742 - DNA, 25 bp, Homo sapien
atcaacctccttaagtgctcggatt

SEQ ID NO: 605743 - DNA, 25 bp, Homo sapien
tcaacctccttaagtgctcggatta

SEQ ID NO: 605744 - DNA, 25 bp, Homo sapien
catttttatatgtccacttaatagt

SEQ ID NO: 605745 - DNA, 25 bp, Homo sapien
atatgtccacttaatagttgactga

SEQ ID NO: 605746 - DNA, 25 bp, Homo sapien
gttgactgacagaaataaatggtat

SEQ ID NO: 605747 - DNA, 25 bp, Homo sapien
tctcccagcacgcagatggagatct

SEQ ID NO: 605748 - DNA, 25 bp, Homo sapien
cacctcacacggcagggtattccaa

SEQ ID NO: 605749 - DNA, 25 bp, Homo sapien
acctcacacggcagggtattccaac

SEQ ID NO: 605750 - DNA, 25 bp, Homo sapien
tcacacggcagggtattccaacaga

SEQ ID NO: 605751 - DNA, 25 bp, Homo sapien
cacacggcagggtattccaacagac

SEQ ID NO: 605752 - DNA, 25 bp, Homo sapien
cacggcagggtattccaacagacct

SEQ ID NO: 605753 - DNA, 25 bp, Homo sapien
acggcagggtattccaacagaccta

SEQ ID NO: 605754 - DNA, 25 bp, Homo sapien
agggtattccaacagacctacagct

SEQ ID NO: 605755 - DNA, 25 bp, Homo sapien
ccagaaaggacatctacaccgaaaa

SEQ ID NO: 605756 - DNA, 25 bp, Homo sapien
tctacaccgaaaacccatctgtaca

SEQ ID NO: 605757 - DNA, 25 bp, Homo sapien
ctacaccgaaaacccatctgtacat

SEQ ID NO: 605758 - DNA, 25 bp, Homo sapien
agcttctgagctacctttaaccctt

SEQ ID NO: 605759 - DNA, 25 bp, Homo sapien
tgctcggtgcacctatttcctaaga

SEQ ID NO: 605760 - DNA, 25 bp, Homo sapien
aagacctttatcacattctgtaccc

SEQ ID NO: 605761 - DNA, 25 bp, Homo sapien
tgtaccctttccaaattgccgatac

SEQ ID NO: 605762 - DNA, 25 bp, Homo sapien
ttgccgataccaatttcaaatcccc

SEQ ID NO: 605763 - DNA, 25 bp, Homo sapien
tccccagggcagacataatattctc

SEQ ID NO: 605764 - DNA, 25 bp, Homo sapien
tatctgaccactgctaacagctgtg

SEQ ID NO: 605765 - DNA, 25 bp, Homo sapien
acttgctgtttttagagcctctgct

SEQ ID NO: 605766 - DNA, 25 bp, Homo sapien
agagcctctgcttcagtgtacatat

SEQ ID NO: 605767 - DNA, 25 bp, Homo sapien
ttcagtgtacatatcccattttcat

SEQ ID NO: 605768 - DNA, 25 bp, Homo sapien
ttcatccctcgtttcttaaaagaat

SEQ ID NO: 605769 - DNA, 25 bp, Homo sapien
ttcctgttccagcaggctatgcagg

SEQ ID NO: 605770 - DNA, 25 bp, Homo sapien
gttccagcaggctatgcaggccaat

SEQ ID NO: 605771 - DNA, 25 bp, Homo sapien
agcaggctatgcaggccaatgcccg

SEQ ID NO: 605772 - DNA, 25 bp, Homo sapien
gctatgcaggccaatgcccggctca

SEQ ID NO: 605773 - DNA, 25 bp, Homo sapien
gacagagagggcacccccaggaaac

SEQ ID NO: 605774 - DNA, 25 bp, Homo sapien
gggtgagaatggagcactctcctca

SEQ ID NO: 605775 - DNA, 25 bp, Homo sapien
agaatggagcactctcctcagaggc

SEQ ID NO: 605776 - DNA, 25 bp, Homo sapien
aatggagcactctcctcagaggccc

SEQ ID NO: 605777 - DNA, 25 bp, Homo sapien
gcagccagcctgacaggcactacaa

SEQ ID NO: 605778 - DNA, 25 bp, Homo sapien
tggacccggagtgcagtccctgaga

SEQ ID NO: 605779 - DNA, 25 bp, Homo sapien
cccggagtgcagtccctgagataaa

SEQ ID NO: 605780 - DNA, 25 bp, Homo sapien
ctcccacttaaaagaacatacagta

SEQ ID NO: 605781 - DNA, 25 bp, Homo sapien
tcccacttaaaagaacatacagtat

SEQ ID NO: 605782 - DNA, 25 bp, Homo sapien
cccacttaaaagaacatacagtatt

SEQ ID NO: 605783 - DNA, 25 bp, Homo sapien
ccacttaaaagaacatacagtattt

SEQ ID NO: 605784 - DNA, 25 bp, Homo sapien
cacttaaaagaacatacagtatttg

SEQ ID NO: 605785 - DNA, 25 bp, Homo sapien
acttaaaagaacatacagtatttgg

SEQ ID NO: 605786 - DNA, 25 bp, Homo sapien
cttaaaagaacatacagtatttggt

SEQ ID NO: 605787 - DNA, 25 bp, Homo sapien
ttaaaagaacatacagtatttggtt

SEQ ID NO: 605788 - DNA, 25 bp, Homo sapien
acatgatctcgctgttttttatggt

SEQ ID NO: 605789 - DNA, 25 bp, Homo sapien
tgatctcgctgttttttatggttgc

SEQ ID NO: 605790 - DNA, 25 bp, Homo sapien
tactagattaattttgatggcaggc

SEQ ID NO: 605791 - DNA, 25 bp, Homo sapien
ttgatggcaggcttagcccctgggt

SEQ ID NO: 605792 - DNA, 25 bp, Homo sapien
cccctgggtctgtggacatttaaga

SEQ ID NO: 605793 - DNA, 25 bp, Homo sapien
tatgtttctaggtaacttcgttatc

SEQ ID NO: 605794 - DNA, 25 bp, Homo sapien
ggtaacttcgttatccttcattgta

SEQ ID NO: 605795 - DNA, 25 bp, Homo sapien
tatggtcagatatactattacagag

SEQ ID NO: 605796 - DNA, 25 bp, Homo sapien
attacagagtgtccaatgatccaaa

SEQ ID NO: 605797 - DNA, 25 bp, Homo sapien
gatccaaaagttattcatgttcaat

SEQ ID NO: 605798 - DNA, 25 bp, Homo sapien
gagtagaattcagtacacataacta

SEQ ID NO: 605799 - DNA, 25 bp, Homo sapien
ggaatttataccatttcagagcaat

SEQ ID NO: 605800 - DNA, 25 bp, Homo sapien
tttcagagcaataaagccacctagg

SEQ ID NO: 605801 - DNA, 25 bp, Homo sapien
atgtgatgtggcctttttgttttgt

SEQ ID NO: 605802 - DNA, 25 bp, Homo sapien
gttttgagacataatcttatcaccc

SEQ ID NO: 605803 - DNA, 25 bp, Homo sapien
ttttgagacataatcttatcaccca

SEQ ID NO: 605804 - DNA, 25 bp, Homo sapien
gacataatcttatcacccaggctgg

SEQ ID NO: 605805 - DNA, 25 bp, Homo sapien
agtgaagtggcgcagtttaaactgc

SEQ ID NO: 605806 - DNA, 25 bp, Homo sapien
gcagtttaaactgcgcaggctcatc

SEQ ID NO: 605807 - DNA, 25 bp, Homo sapien
gtttaaactgcgcaggctcatcatc

SEQ ID NO: 605808 - DNA, 25 bp, Homo sapien
tttaaactgcgcaggctcatcatcc

SEQ ID NO: 605809 - DNA, 25 bp, Homo sapien
ttaaactgcgcaggctcatcatcct

SEQ ID NO: 605810 - DNA, 25 bp, Homo sapien
actgcgcaggctcatcatcctcctt

SEQ ID NO: 605811 - DNA, 25 bp, Homo sapien
cctggctcattttttgattttcttt

SEQ ID NO: 605812 - DNA, 25 bp, Homo sapien
gcatgccagtctgaacaacagagca

SEQ ID NO: 605813 - DNA, 25 bp, Homo sapien
agagagaaacactgatttaccttca

SEQ ID NO: 605814 - DNA, 25 bp, Homo sapien
gaaacactgatttaccttcagaaag

SEQ ID NO: 605815 - DNA, 25 bp, Homo sapien
atacttgtatattgctatctactag

SEQ ID NO: 605816 - DNA, 25 bp, Homo sapien
tatctactagtatagcttcagttgg

SEQ ID NO: 605817 - DNA, 25 bp, Homo sapien
agcttcagttggtgtatgagtatag

SEQ ID NO: 605818 - DNA, 25 bp, Homo sapien
actattgggttgttctttatgtgat

SEQ ID NO: 605819 - DNA, 25 bp, Homo sapien
gggttgttctttatgtgattactcc

SEQ ID NO: 605820 - DNA, 25 bp, Homo sapien
gttctttatgtgattactccttccc

SEQ ID NO: 605821 - DNA, 25 bp, Homo sapien
ctttatgtgattactccttcccagt

SEQ ID NO: 605822 - DNA, 25 bp, Homo sapien
ttagtaaagtattccaatttgaggg

SEQ ID NO: 605823 - DNA, 25 bp, Homo sapien
accaaatattgtacatcctcactta

SEQ ID NO: 605824 - DNA, 25 bp, Homo sapien
tattgtacatcctcacttataagtg

SEQ ID NO: 605825 - DNA, 25 bp, Homo sapien
taagtgggagctgcgctatgaagat

SEQ ID NO: 605826 - DNA, 25 bp, Homo sapien
gcgctatgaagatacaaaggcacaa

SEQ ID NO: 605827 - DNA, 25 bp, Homo sapien
agatacaaaggcacaagaatgatac

SEQ ID NO: 605828 - DNA, 25 bp, Homo sapien
tgagggataaaaaaccatacattgg

SEQ ID NO: 605829 - DNA, 25 bp, Homo sapien
aaaaaaccatacattgggtacagtg

SEQ ID NO: 605830 - DNA, 25 bp, Homo sapien
cagaagtcactgctaaagaccttat

SEQ ID NO: 605831 - DNA, 25 bp, Homo sapien
aagtcactgctaaagaccttatcct

SEQ ID NO: 605832 - DNA, 25 bp, Homo sapien
ccttgtaaccaaaagccgcctgctc

SEQ ID NO: 605833 - DNA, 25 bp, Homo sapien
gaaaatagttccaatttatcatgcc

SEQ ID NO: 605834 - DNA, 25 bp, Homo sapien
atggctaaatcccaaacatccttgg

SEQ ID NO: 605835 - DNA, 25 bp, Homo sapien
atccttggcctgtgaagtcttcatt

SEQ ID NO: 605836 - DNA, 25 bp, Homo sapien
ttgtgtgacttatttggctcttaac

SEQ ID NO: 605837 - DNA, 25 bp, Homo sapien
aacagagtggcacatcctactgaca

SEQ ID NO: 605838 - DNA, 25 bp, Homo sapien
tactgacactgtcctatggagagtt

SEQ ID NO: 605839 - DNA, 25 bp, Homo sapien
agtgcaggaaacctgaacccagctc

SEQ ID NO: 605840 - DNA, 25 bp, Homo sapien
aggtccctctggaactttggctctt

SEQ ID NO: 605841 - DNA, 25 bp, Homo sapien
tcttctttgttttgtctcagtgagt

SEQ ID NO: 605842 - DNA, 25 bp, Homo sapien
tctcagtgagtgatttgggccctct

SEQ ID NO: 605843 - DNA, 25 bp, Homo sapien
gggccctctggctaaatagactagt

SEQ ID NO: 605844 - DNA, 25 bp, Homo sapien
gactagtcatgtccttacaggtctt

SEQ ID NO: 605845 - DNA, 25 bp, Homo sapien
ccactgtttaattctttcacttcag

SEQ ID NO: 605846 - DNA, 25 bp, Homo sapien
cactgtttaattctttcacttcaga

SEQ ID NO: 605847 - DNA, 25 bp, Homo sapien
ctttcacttcagaaattctactgat

SEQ ID NO: 605848 - DNA, 25 bp, Homo sapien
aattctactgattgattggtgattt

SEQ ID NO: 605849 - DNA, 25 bp, Homo sapien
gggagtggtgaagagaatccataac

SEQ ID NO: 605850 - DNA, 25 bp, Homo sapien
gaatccataactgatatttgtctaa

SEQ ID NO: 605851 - DNA, 25 bp, Homo sapien
tatttgtctaaaaaacttggtcctg

SEQ ID NO: 605852 - DNA, 25 bp, Homo sapien
ggtcctggtccaggcatagtagctt

SEQ ID NO: 605853 - DNA, 25 bp, Homo sapien
tcctggtccaggcatagtagcttat

SEQ ID NO: 605854 - DNA, 25 bp, Homo sapien
tatgcttgtaatctccgcaatttgg

SEQ ID NO: 605855 - DNA, 25 bp, Homo sapien
ggcagaagcagaaagatccttgagc

SEQ ID NO: 605856 - DNA, 25 bp, Homo sapien
gaggaacttcctccgctggataaag

SEQ ID NO: 605857 - DNA, 25 bp, Homo sapien
aagagcatctgtacaagccctgcag

SEQ ID NO: 605858 - DNA, 25 bp, Homo sapien
agcattctcctcgagggcaaggaat

SEQ ID NO: 605859 - DNA, 25 bp, Homo sapien
ttcaccattcagatccggaacaaga

SEQ ID NO: 605860 - DNA, 25 bp, Homo sapien
agaaaggacgtctgctctaaccatc

SEQ ID NO: 605861 - DNA, 25 bp, Homo sapien
tctaaccatcggatccggcatggtg

SEQ ID NO: 605862 - DNA, 25 bp, Homo sapien
gaagcgctgggcactgcagtacgca

SEQ ID NO: 605863 - DNA, 25 bp, Homo sapien
aaggcgtgtcgatcacaaaggaaga

SEQ ID NO: 605864 - DNA, 25 bp, Homo sapien
gcctgtttacagatgacgccgttgt

SEQ ID NO: 605865 - DNA, 25 bp, Homo sapien
gacgccgttgtctttgtaggaaatc

SEQ ID NO: 605866 - DNA, 25 bp, Homo sapien
taggaaatcccaaggtatccaccaa

SEQ ID NO: 605867 - DNA, 25 bp, Homo sapien
gcacaagccaactgtttgttggtat

SEQ ID NO: 605868 - DNA, 25 bp, Homo sapien
actgtttgttggtattatgtattaa

SEQ ID NO: 605869 - DNA, 25 bp, Homo sapien
ggtattatgtattaactttccattt

SEQ ID NO: 605870 - DNA, 25 bp, Homo sapien
aactttccattttgtaggctcttgt

SEQ ID NO: 605871 - DNA, 25 bp, Homo sapien
actttccattttgtaggctcttgtt

SEQ ID NO: 605872 - DNA, 25 bp, Homo sapien
gtttctcactaattttaatgtgcta

SEQ ID NO: 605873 - DNA, 25 bp, Homo sapien
caagtttttaaagagctgtttcagc

SEQ ID NO: 605874 - DNA, 25 bp, Homo sapien
taaagagctgtttcagcctgaaaaa

SEQ ID NO: 605875 - DNA, 25 bp, Homo sapien
gtttcagcctgaaaaacatagcaaa

SEQ ID NO: 605876 - DNA, 25 bp, Homo sapien
attagccagacatggggccgtgtgc

SEQ ID NO: 605877 - DNA, 25 bp, Homo sapien
ggagttcgaggatgtagtgaacttt

SEQ ID NO: 605878 - DNA, 25 bp, Homo sapien
gtagaaacaacccatgtgttcatcc

SEQ ID NO: 605879 - DNA, 25 bp, Homo sapien
cactgacgaatggatcaaaacatgt

SEQ ID NO: 605880 - DNA, 25 bp, Homo sapien
aaaacatgtggcgtgtccatccata

SEQ ID NO: 605881 - DNA, 25 bp, Homo sapien
tgtggcgtgtccatccatacaaggg

SEQ ID NO: 605882 - DNA, 25 bp, Homo sapien
gggatattacccagcagtcaaaagg

SEQ ID NO: 605883 - DNA, 25 bp, Homo sapien
ggagcaaagaactgatgtataccac

SEQ ID NO: 605884 - DNA, 25 bp, Homo sapien
gatgtataccacaccatggctgatt

SEQ ID NO: 605885 - DNA, 25 bp, Homo sapien
caccatggctgattctcaacagtat

SEQ ID NO: 605886 - DNA, 25 bp, Homo sapien
aaccagtcacaaaagcacatgtact

SEQ ID NO: 605887 - DNA, 25 bp, Homo sapien
agcacatgtactgtatgtctattta

SEQ ID NO: 605888 - DNA, 25 bp, Homo sapien
gtctatttatatgaactgcttggag

SEQ ID NO: 605889 - DNA, 25 bp, Homo sapien
tggactctagggaacagcactgtga

SEQ ID NO: 605890 - DNA, 25 bp, Homo sapien
taagccgtctttcccaggaatcctg

SEQ ID NO: 605891 - DNA, 25 bp, Homo sapien
aggaatcctgggtggagtccaacac

SEQ ID NO: 605892 - DNA, 25 bp, Homo sapien
aacacaatcacacggagaccaccat

SEQ ID NO: 605893 - DNA, 25 bp, Homo sapien
gagaccaccatctgagcctatgtca

SEQ ID NO: 605894 - DNA, 25 bp, Homo sapien
gagcctatgtcatttgtcctcattc

SEQ ID NO: 605895 - DNA, 25 bp, Homo sapien
atttgtcctcattctcattccagca

SEQ ID NO: 605896 - DNA, 25 bp, Homo sapien
tcattccagcatgagcgtttctgag

SEQ ID NO: 605897 - DNA, 25 bp, Homo sapien
gagcgtttctgagtctcttcaagac

SEQ ID NO: 605898 - DNA, 25 bp, Homo sapien
gacgaatctagttttcaccttcaca

SEQ ID NO: 605899 - DNA, 25 bp, Homo sapien
ttaataataaaaaccagctgcactg

SEQ ID NO: 605900 - DNA, 25 bp, Homo sapien
acactctggaattcctgactgccac

SEQ ID NO: 605901 - DNA, 25 bp, Homo sapien
ctgactgccacaggtgtacaggaaa

SEQ ID NO: 605902 - DNA, 25 bp, Homo sapien
gtcattgtaagttctaagggtattt

SEQ ID NO: 605903 - DNA, 25 bp, Homo sapien
acacttatcaggaggtgagcagctg

SEQ ID NO: 605904 - DNA, 25 bp, Homo sapien
ggtgagcagctgaaactttgtatct

SEQ ID NO: 605905 - DNA, 25 bp, Homo sapien
gctgaaactttgtatctgtctgtct

SEQ ID NO: 605906 - DNA, 25 bp, Homo sapien
gaaactttgtatctgtctgtcttgg

SEQ ID NO: 605907 - DNA, 25 bp, Homo sapien
aactttgtatctgtctgtcttgggt

SEQ ID NO: 605908 - DNA, 25 bp, Homo sapien
tttgtatctgtctgtcttgggtttt

SEQ ID NO: 605909 - DNA, 25 bp, Homo sapien
gtctgtcttgggttttctgtgacaa

SEQ ID NO: 605910 - DNA, 25 bp, Homo sapien
cttgggttttctgtgacaaagatta

SEQ ID NO: 605911 - DNA, 25 bp, Homo sapien
ggacatggaactttgagctctgaaa

SEQ ID NO: 605912 - DNA, 25 bp, Homo sapien
ggttaccaaaagcaatgaggttgtc

SEQ ID NO: 605913 - DNA, 25 bp, Homo sapien
aaagcaatgaggttgtcgagactgg

SEQ ID NO: 605914 - DNA, 25 bp, Homo sapien
gagactgggaaaactccatgcagat

SEQ ID NO: 605915 - DNA, 25 bp, Homo sapien
aaatgaggatggatgagccagatat

SEQ ID NO: 605916 - DNA, 25 bp, Homo sapien
gccagatatgggttagaggacatga

SEQ ID NO: 605917 - DNA, 25 bp, Homo sapien
ggagttgatagcgattacattgttg

SEQ ID NO: 605918 - DNA, 25 bp, Homo sapien
gcgattacattgttgtgatggttgt

SEQ ID NO: 605919 - DNA, 25 bp, Homo sapien
gatggttgtaacatcaggctacact

SEQ ID NO: 605920 - DNA, 25 bp, Homo sapien
gtaacatcaggctacacttgactag

SEQ ID NO: 605921 - DNA, 25 bp, Homo sapien
caggctacacttgactagggaatat

SEQ ID NO: 605922 - DNA, 25 bp, Homo sapien
aagtactaatctgacctgatatctg

SEQ ID NO: 605923 - DNA, 25 bp, Homo sapien
atctgacctgatatctgaagtaaca

SEQ ID NO: 605924 - DNA, 25 bp, Homo sapien
tgggctctttaaatggagcccttcc

SEQ ID NO: 605925 - DNA, 25 bp, Homo sapien
ccccatacctgcatctcattgaaga

SEQ ID NO: 605926 - DNA, 25 bp, Homo sapien
tgcatctcattgaagaggctgaact

SEQ ID NO: 605927 - DNA, 25 bp, Homo sapien
gttggagaattaagtctcgttccca

SEQ ID NO: 605928 - DNA, 25 bp, Homo sapien
gaattaagtctcgttcccagattta

SEQ ID NO: 605929 - DNA, 25 bp, Homo sapien
ttaagtctcgttcccagatttaatt

SEQ ID NO: 605930 - DNA, 25 bp, Homo sapien
atattgttgcataagaaatctactc

SEQ ID NO: 605931 - DNA, 25 bp, Homo sapien
gaaatctactctataaggcatctat

SEQ ID NO: 605932 - DNA, 25 bp, Homo sapien
actctataaggcatctattttcaaa

SEQ ID NO: 605933 - DNA, 25 bp, Homo sapien
ttgaaagagtcctccttggctgatg

SEQ ID NO: 605934 - DNA, 25 bp, Homo sapien
tgaaagagtcctccttggctgatgt

SEQ ID NO: 605935 - DNA, 25 bp, Homo sapien
gaaagagtcctccttggctgatgtg

SEQ ID NO: 605936 - DNA, 25 bp, Homo sapien
aaagagtcctccttggctgatgtgg

SEQ ID NO: 605937 - DNA, 25 bp, Homo sapien
aagagtcctccttggctgatgtggt

SEQ ID NO: 605938 - DNA, 25 bp, Homo sapien
agagtcctccttggctgatgtggtg

SEQ ID NO: 605939 - DNA, 25 bp, Homo sapien
gagtcctccttggctgatgtggtgg

SEQ ID NO: 605940 - DNA, 25 bp, Homo sapien
agtcctccttggctgatgtggtggc

SEQ ID NO: 605941 - DNA, 25 bp, Homo sapien
gtcctccttggctgatgtggtggct

SEQ ID NO: 605942 - DNA, 25 bp, Homo sapien
tcctccttggctgatgtggtggctc

SEQ ID NO: 605943 - DNA, 25 bp, Homo sapien
aatttgccaggcacagtggtgggtg

SEQ ID NO: 605944 - DNA, 25 bp, Homo sapien
tctgggcagactgtcatcacatgca

SEQ ID NO: 605945 - DNA, 25 bp, Homo sapien
gcagactgtcatcacatgcatgcat

SEQ ID NO: 605946 - DNA, 25 bp, Homo sapien
atcacatgcatgcataaaccggcat

SEQ ID NO: 605947 - DNA, 25 bp, Homo sapien
aaaccggcatgtgtgccaatgcaca

SEQ ID NO: 605948 - DNA, 25 bp, Homo sapien
aatgcacacgagtgtgccactcacc

SEQ ID NO: 605949 - DNA, 25 bp, Homo sapien
ttttgcctccctcgatactcaacaa

SEQ ID NO: 605950 - DNA, 25 bp, Homo sapien
gcctccctcgatactcaacaaagag

SEQ ID NO: 605951 - DNA, 25 bp, Homo sapien
caagcatccccaaccttgttgagga

SEQ ID NO: 605952 - DNA, 25 bp, Homo sapien
gagcacagcaggactgaaattttgg

SEQ ID NO: 605953 - DNA, 25 bp, Homo sapien
caggactgaaattttggacgggaga

SEQ ID NO: 605954 - DNA, 25 bp, Homo sapien
agagaggggctattccatcttgctt

SEQ ID NO: 605955 - DNA, 25 bp, Homo sapien
taaggctatagtgagacacgattgc

SEQ ID NO: 605956 - DNA, 25 bp, Homo sapien
aaggctatagtgagacacgattgca

SEQ ID NO: 605957 - DNA, 25 bp, Homo sapien
gctatagtgagacacgattgcacca

SEQ ID NO: 605958 - DNA, 25 bp, Homo sapien
ctatagtgagacacgattgcaccac

SEQ ID NO: 605959 - DNA, 25 bp, Homo sapien
atagtgagacacgattgcaccactt

SEQ ID NO: 605960 - DNA, 25 bp, Homo sapien
tagtgagacacgattgcaccacttc

SEQ ID NO: 605961 - DNA, 25 bp, Homo sapien
gtgagacacgattgcaccacttcat

SEQ ID NO: 605962 - DNA, 25 bp, Homo sapien
tgagacacgattgcaccacttcatc

SEQ ID NO: 605963 - DNA, 25 bp, Homo sapien
gagacacgattgcaccacttcatcc

SEQ ID NO: 605964 - DNA, 25 bp, Homo sapien
agacacgattgcaccacttcatccc

SEQ ID NO: 605965 - DNA, 25 bp, Homo sapien
gacacgattgcaccacttcatccca

SEQ ID NO: 605966 - DNA, 25 bp, Homo sapien
agcctcagccgggttaagacaagta

SEQ ID NO: 605967 - DNA, 25 bp, Homo sapien
gttaagacaagtagccccaagagga

SEQ ID NO: 605968 - DNA, 25 bp, Homo sapien
gagcctcagagagcctttcttcctg

SEQ ID NO: 605969 - DNA, 25 bp, Homo sapien
gaaatctaatactatctggctgcaa

SEQ ID NO: 605970 - DNA, 25 bp, Homo sapien
aaatatattatcaccggctctcagc

SEQ ID NO: 605971 - DNA, 25 bp, Homo sapien
attatcaccggctctcagcctaaga

SEQ ID NO: 605972 - DNA, 25 bp, Homo sapien
tcagcctaagagactaacatttgga

SEQ ID NO: 605973 - DNA, 25 bp, Homo sapien
gtaggaaatgtaatctgcatggcta

SEQ ID NO: 605974 - DNA, 25 bp, Homo sapien
atctgcatggctaattgattctcag

SEQ ID NO: 605975 - DNA, 25 bp, Homo sapien
gattctcagcgtatcagtttaaagg

SEQ ID NO: 605976 - DNA, 25 bp, Homo sapien
aagatcgatatctacatgatggata

SEQ ID NO: 605977 - DNA, 25 bp, Homo sapien
atgtctccaaaactttgcctgaatc

SEQ ID NO: 605978 - DNA, 25 bp, Homo sapien
tgcctgaatcttttgaatgaagaac

SEQ ID NO: 605979 - DNA, 25 bp, Homo sapien
gacacaaattctgcatcctatgaat

SEQ ID NO: 605980 - DNA, 25 bp, Homo sapien
gcatcctatgaatcatctaatgtgg

SEQ ID NO: 605981 - DNA, 25 bp, Homo sapien
atctaatgtggatgttacaacagaa

SEQ ID NO: 605982 - DNA, 25 bp, Homo sapien
gaaagctttaacagcacagaagata

SEQ ID NO: 605983 - DNA, 25 bp, Homo sapien
gaagataactctacctgcagtacag

SEQ ID NO: 605984 - DNA, 25 bp, Homo sapien
gataactctacctgcagtacagata

SEQ ID NO: 605985 - DNA, 25 bp, Homo sapien
gcagtacagataacttaccagctct

SEQ ID NO: 605986 - DNA, 25 bp, Homo sapien
gataacttaccagctctactaagac

SEQ ID NO: 605987 - DNA, 25 bp, Homo sapien
taccagctctactaagacaagacat

SEQ ID NO: 605988 - DNA, 25 bp, Homo sapien
aggcattcagccgaagcgcaattct

SEQ ID NO: 605989 - DNA, 25 bp, Homo sapien
cagccgaagcgcaattctgattcag

SEQ ID NO: 605990 - DNA, 25 bp, Homo sapien
ccgaagcgcaattctgattcagcat

SEQ ID NO: 605991 - DNA, 25 bp, Homo sapien
agcgcaattctgattcagcatcgac

SEQ ID NO: 605992 - DNA, 25 bp, Homo sapien
ttctgattcagcatcgacgaaccca

SEQ ID NO: 605993 - DNA, 25 bp, Homo sapien
tgattcagcatcgacgaacccatac

SEQ ID NO: 605994 - DNA, 25 bp, Homo sapien
attcagcatcgacgaacccatactg

SEQ ID NO: 605995 - DNA, 25 bp, Homo sapien
aaaccttatgcatgtgacgagtgtg

SEQ ID NO: 605996 - DNA, 25 bp, Homo sapien
gcatgtgacgagtgtgcaaaggcat

SEQ ID NO: 605997 - DNA, 25 bp, Homo sapien
gacgagtgtgcaaaggcattcagcc

SEQ ID NO: 605998 - DNA, 25 bp, Homo sapien
gtgtgcaaaggcattcagccgaagc

SEQ ID NO: 605999 - DNA, 25 bp, Homo sapien
cagtgtctgttgtttatgagttctc

SEQ ID NO: 606000 - DNA, 25 bp, Homo sapien
ctccatctgtgttcctgcaaaagac

SEQ ID NO: 606001 - DNA, 25 bp, Homo sapien
atctcgctgttttttatggttgcac

SEQ ID NO: 606002 - DNA, 25 bp, Homo sapien
ttctaacatttggtccttaaacctg

SEQ ID NO: 606003 - DNA, 25 bp, Homo sapien
tctaacatttggtccttaaacctgg

SEQ ID NO: 606004 - DNA, 25 bp, Homo sapien
tccttaaacctggttcctgacacag

SEQ ID NO: 606005 - DNA, 25 bp, Homo sapien
tgacacagagctcctaaatcccttg

SEQ ID NO: 606006 - DNA, 25 bp, Homo sapien
attttctgggtgatagaagcgtcct

SEQ ID NO: 606007 - DNA, 25 bp, Homo sapien
tttctgggtgatagaagcgtccttt

SEQ ID NO: 606008 - DNA, 25 bp, Homo sapien
tctgggtgatagaagcgtcctttgt

SEQ ID NO: 606009 - DNA, 25 bp, Homo sapien
tgggtgatagaagcgtcctttgttc

SEQ ID NO: 606010 - DNA, 25 bp, Homo sapien
ggaagataatatggaagctagggat

SEQ ID NO: 606011 - DNA, 25 bp, Homo sapien
gatataatagagtatgttgctggga

SEQ ID NO: 606012 - DNA, 25 bp, Homo sapien
gcatgcctgtattcttaactactcc

SEQ ID NO: 606013 - DNA, 25 bp, Homo sapien
atgcctgtattcttaactactccag

SEQ ID NO: 606014 - DNA, 25 bp, Homo sapien
tgcctgtattcttaactactccaga

SEQ ID NO: 606015 - DNA, 25 bp, Homo sapien
gcctgtattcttaactactccagag

SEQ ID NO: 606016 - DNA, 25 bp, Homo sapien
gtgaactacgattgagccacactgc

SEQ ID NO: 606017 - DNA, 25 bp, Homo sapien
tgaactacgattgagccacactgca

SEQ ID NO: 606018 - DNA, 25 bp, Homo sapien
gaactacgattgagccacactgcat

SEQ ID NO: 606019 - DNA, 25 bp, Homo sapien
aactacgattgagccacactgcatt

SEQ ID NO: 606020 - DNA, 25 bp, Homo sapien
ctacgattgagccacactgcattcc

SEQ ID NO: 606021 - DNA, 25 bp, Homo sapien
gagtaggagttttattgttctgtaa

SEQ ID NO: 606022 - DNA, 25 bp, Homo sapien
caaattgggaaaccttctttcatat

SEQ ID NO: 606023 - DNA, 25 bp, Homo sapien
tcatatttaatgagccagaacaagg

SEQ ID NO: 606024 - DNA, 25 bp, Homo sapien
gaacaaggaaacacagtattggaat

SEQ ID NO: 606025 - DNA, 25 bp, Homo sapien
cagtattggaataggtatttcctta

SEQ ID NO: 606026 - DNA, 25 bp, Homo sapien
aaatgtgagatgatttagcagtaaa

SEQ ID NO: 606027 - DNA, 25 bp, Homo sapien
ttagcagtaaaattttggagatcaa

SEQ ID NO: 606028 - DNA, 25 bp, Homo sapien
tttggagatcaaaacataggtgaga

SEQ ID NO: 606029 - DNA, 25 bp, Homo sapien
tctttttccattttagtctgttata

SEQ ID NO: 606030 - DNA, 25 bp, Homo sapien
aataaaagtcatacctggattggct

SEQ ID NO: 606031 - DNA, 25 bp, Homo sapien
aaaagtcatacctggattggcttag

SEQ ID NO: 606032 - DNA, 25 bp, Homo sapien
tgcaggtgacccagtttgctggctg

SEQ ID NO: 606033 - DNA, 25 bp, Homo sapien
tttgctggctgttgtgggtagctca

SEQ ID NO: 606034 - DNA, 25 bp, Homo sapien
tgggtagctcagaacaggaccctaa

SEQ ID NO: 606035 - DNA, 25 bp, Homo sapien
gctttaaaactcaacaccaaactgt

SEQ ID NO: 606036 - DNA, 25 bp, Homo sapien
caccaaactgtattcattcttgtgg

SEQ ID NO: 606037 - DNA, 25 bp, Homo sapien
tcattcttgtggtactgcctgtgtc

SEQ ID NO: 606038 - DNA, 25 bp, Homo sapien
tgcctgtgtcttaacatgcatccca

SEQ ID NO: 606039 - DNA, 25 bp, Homo sapien
ggcactggcaacctcttaggaaatt

SEQ ID NO: 606040 - DNA, 25 bp, Homo sapien
agtgtagcattctgtcactttcctc

SEQ ID NO: 606041 - DNA, 25 bp, Homo sapien
ttctgtcactttcctcagcgataaa

SEQ ID NO: 606042 - DNA, 25 bp, Homo sapien
ctcagcgataaaattctcattcttc

SEQ ID NO: 606043 - DNA, 25 bp, Homo sapien
agcttggaagggattgttcgaggat

SEQ ID NO: 606044 - DNA, 25 bp, Homo sapien
gggattgttcgaggatgtgggattt

SEQ ID NO: 606045 - DNA, 25 bp, Homo sapien
tcttagaagaccgaaggatgaatgt

SEQ ID NO: 606046 - DNA, 25 bp, Homo sapien
aagaccgaaggatgaatgtaaggaa

SEQ ID NO: 606047 - DNA, 25 bp, Homo sapien
gaaagttagtgggagattgacgaat

SEQ ID NO: 606048 - DNA, 25 bp, Homo sapien
tagtgggagattgacgaatttttac

SEQ ID NO: 606049 - DNA, 25 bp, Homo sapien
gtcaatttggaggttctaagggcat

SEQ ID NO: 606050 - DNA, 25 bp, Homo sapien
gttctaagggcatgatctgggtgaa

SEQ ID NO: 606051 - DNA, 25 bp, Homo sapien
ctaagggcatgatctgggtgaaatt

SEQ ID NO: 606052 - DNA, 25 bp, Homo sapien
ggagaatttgagatattctttcaga

SEQ ID NO: 606053 - DNA, 25 bp, Homo sapien
atttgagatattctttcagaggatt

SEQ ID NO: 606054 - DNA, 25 bp, Homo sapien
tgaattgctgtttggtttttacctt

SEQ ID NO: 606055 - DNA, 25 bp, Homo sapien
taccttaaggacactaaatattcag

SEQ ID NO: 606056 - DNA, 25 bp, Homo sapien
tttctgtttgtactgatactagacc

SEQ ID NO: 606057 - DNA, 25 bp, Homo sapien
gatactagaccatttagagcccaat

SEQ ID NO: 606058 - DNA, 25 bp, Homo sapien
agaccatttagagcccaatttgtgg

SEQ ID NO: 606059 - DNA, 25 bp, Homo sapien
tttgtggtctaccttcagcaagtgt

SEQ ID NO: 606060 - DNA, 25 bp, Homo sapien
gtattttgtatgctagtcatgttct

SEQ ID NO: 606061 - DNA, 25 bp, Homo sapien
tagtcatgttcttggttctgtcttc

SEQ ID NO: 606062 - DNA, 25 bp, Homo sapien
catgttcttggttctgtcttccttt

SEQ ID NO: 606063 - DNA, 25 bp, Homo sapien
ataatatctgcatcttgtaagcctt

SEQ ID NO: 606064 - DNA, 25 bp, Homo sapien
ctgcatcttgtaagcctttttgtaa

SEQ ID NO: 606065 - DNA, 25 bp, Homo sapien
tagcctgaggctgactagaggaact

SEQ ID NO: 606066 - DNA, 25 bp, Homo sapien
gactagaggaactgtctctgaacca

SEQ ID NO: 606067 - DNA, 25 bp, Homo sapien
tctgaaccatctcttggactccagc

SEQ ID NO: 606068 - DNA, 25 bp, Homo sapien
gtatgcacagacacccaggttatta

SEQ ID NO: 606069 - DNA, 25 bp, Homo sapien
acccaggttattaccgtctccagct

SEQ ID NO: 606070 - DNA, 25 bp, Homo sapien
tgaattcctcagtgcgccgactatg

SEQ ID NO: 606071 - DNA, 25 bp, Homo sapien
agtgcgccgactatgtcaccatcat

SEQ ID NO: 606072 - DNA, 25 bp, Homo sapien
tgcctcgcacctacaaagagcctta

SEQ ID NO: 606073 - DNA, 25 bp, Homo sapien
aagagccttacatgagtcctctcac

SEQ ID NO: 606074 - DNA, 25 bp, Homo sapien
ttaatctctccaatttactcctcat

SEQ ID NO: 606075 - DNA, 25 bp, Homo sapien
ttacatatccccacataagcaggaa

SEQ ID NO: 606076 - DNA, 25 bp, Homo sapien
ataagtggatgccttattgggcaaa

SEQ ID NO: 606077 - DNA, 25 bp, Homo sapien
cttattgggcaaagcagagggtaac

SEQ ID NO: 606078 - DNA, 25 bp, Homo sapien
gtaaccaattagaaggccctggctt

SEQ ID NO: 606079 - DNA, 25 bp, Homo sapien
tggcttctcttgattgatagctgag

SEQ ID NO: 606080 - DNA, 25 bp, Homo sapien
gaactcatcagagggatcagtgctt

SEQ ID NO: 606081 - DNA, 25 bp, Homo sapien
agggatcagtgctttctctgtgtat

SEQ ID NO: 606082 - DNA, 25 bp, Homo sapien
ttctctgtgtattgctggagtctga

SEQ ID NO: 606083 - DNA, 25 bp, Homo sapien
aagtgtgactctcatgtcactgatt

SEQ ID NO: 606084 - DNA, 25 bp, Homo sapien
tcatgtcactgattcatttctgaag

SEQ ID NO: 606085 - DNA, 25 bp, Homo sapien
tgtatttatcttgtgttatgctaga

SEQ ID NO: 606086 - DNA, 25 bp, Homo sapien
gttatgctagatattaaactccctg

SEQ ID NO: 606087 - DNA, 25 bp, Homo sapien
atgtttgtcattctgctaaaaagcc

SEQ ID NO: 606088 - DNA, 25 bp, Homo sapien
ttctgctaaaaagcctaaccccaag

SEQ ID NO: 606089 - DNA, 25 bp, Homo sapien
taaccccaaggcctgaaccttcaat

SEQ ID NO: 606090 - DNA, 25 bp, Homo sapien
aggcctgaaccttcaatcattaact

SEQ ID NO: 606091 - DNA, 25 bp, Homo sapien
accttcaatcattaacttcagtgta

SEQ ID NO: 606092 - DNA, 25 bp, Homo sapien
gttgtttagattgtcttcccagcct

SEQ ID NO: 606093 - DNA, 25 bp, Homo sapien
tttagattgtcttcccagcctatcc

SEQ ID NO: 606094 - DNA, 25 bp, Homo sapien
tatccctctagccatgagaccatgg

SEQ ID NO: 606095 - DNA, 25 bp, Homo sapien
tcccagggtcctgtctcagaagaga

SEQ ID NO: 606096 - DNA, 25 bp, Homo sapien
agatctacatccacagtcctcaaaa

SEQ ID NO: 606097 - DNA, 25 bp, Homo sapien
agtcctcaaaatgggatccataagg

SEQ ID NO: 606098 - DNA, 25 bp, Homo sapien
aaagcattcaattgttcctcatcct

SEQ ID NO: 606099 - DNA, 25 bp, Homo sapien
gttcctcatccttaaggcgacatgt

SEQ ID NO: 606100 - DNA, 25 bp, Homo sapien
ggcgacatgtgagaatacacactac

SEQ ID NO: 606101 - DNA, 25 bp, Homo sapien
gtgtaatgtaggacatcctcctgca

SEQ ID NO: 606102 - DNA, 25 bp, Homo sapien
ggacatcctcctgcaaatgaattca

SEQ ID NO: 606103 - DNA, 25 bp, Homo sapien
atgaattcatgtgcagtgcttcaga

SEQ ID NO: 606104 - DNA, 25 bp, Homo sapien
gtgcttcagaaaagtcacaccagga

SEQ ID NO: 606105 - DNA, 25 bp, Homo sapien
gtcacaccaggagagagatctgatc

SEQ ID NO: 606106 - DNA, 25 bp, Homo sapien
atatggtgttgcctttatgagttcc

SEQ ID NO: 606107 - DNA, 25 bp, Homo sapien
tatgagttccttatcctgaaagtgg

SEQ ID NO: 606108 - DNA, 25 bp, Homo sapien
ctcaaggagtgtgtctgtagttcat

SEQ ID NO: 606109 - DNA, 25 bp, Homo sapien
aagggatctcactcttctacctgtg

SEQ ID NO: 606110 - DNA, 25 bp, Homo sapien
ggattgtaacatccctggtcaagcc

SEQ ID NO: 606111 - DNA, 25 bp, Homo sapien
tggtcaagcccccagtgatgtgatt

SEQ ID NO: 606112 - DNA, 25 bp, Homo sapien
gtgattctcctgtttgatgcctgcc

SEQ ID NO: 606113 - DNA, 25 bp, Homo sapien
tctcctgtttgatgcctgccctcag

SEQ ID NO: 606114 - DNA, 25 bp, Homo sapien
tgtgacatagccctggcccaacaca

SEQ ID NO: 606115 - DNA, 25 bp, Homo sapien
tggcccaacacacagttcatgtaac

SEQ ID NO: 606116 - DNA, 25 bp, Homo sapien
caacacacagttcatgtaactcttg

SEQ ID NO: 606117 - DNA, 25 bp, Homo sapien
atgtaactcttgaatttgctcttta

SEQ ID NO: 606118 - DNA, 25 bp, Homo sapien
gaatttgctctttacatacaggtag

SEQ ID NO: 606119 - DNA, 25 bp, Homo sapien
gctctttacatacaggtaggattgt

SEQ ID NO: 606120 - DNA, 25 bp, Homo sapien
aaaaatggtcttgctgctgaaattg

SEQ ID NO: 606121 - DNA, 25 bp, Homo sapien
aaaatggtcttgctgctgaaattgt

SEQ ID NO: 606122 - DNA, 25 bp, Homo sapien
gctgctgaaattgtacttattttat

SEQ ID NO: 606123 - DNA, 25 bp, Homo sapien
ggctgggtgcagtcaagacaaaagt

SEQ ID NO: 606124 - DNA, 25 bp, Homo sapien
gtaaaatggtttacctgagcccagg

SEQ ID NO: 606125 - DNA, 25 bp, Homo sapien
taaaatggtttacctgagcccaggg

SEQ ID NO: 606126 - DNA, 25 bp, Homo sapien
tcctcttactttaattgaaatactc

SEQ ID NO: 606127 - DNA, 25 bp, Homo sapien
attgaaatactctgaattcccctca

SEQ ID NO: 606128 - DNA, 25 bp, Homo sapien
tggaaacagagagcattgagagcac

SEQ ID NO: 606129 - DNA, 25 bp, Homo sapien
gagagcactttctttaaaaggacca

SEQ ID NO: 606130 - DNA, 25 bp, Homo sapien
ataaattcctaatagattttgtcct

SEQ ID NO: 606131 - DNA, 25 bp, Homo sapien
cacccttttgtcttcatactgcata

SEQ ID NO: 606132 - DNA, 25 bp, Homo sapien
gcatatgaaaactgcccttgtatat

SEQ ID NO: 606133 - DNA, 25 bp, Homo sapien
aactgcccttgtatatgtggatatc

SEQ ID NO: 606134 - DNA, 25 bp, Homo sapien
tatatgtggatatctgaatgtgtca

SEQ ID NO: 606135 - DNA, 25 bp, Homo sapien
tgaatgtgtcagtgaaggcctatat

SEQ ID NO: 606136 - DNA, 25 bp, Homo sapien
tgaaggcctatatgaatgtgcacat

SEQ ID NO: 606137 - DNA, 25 bp, Homo sapien
atgtgggtatgttctcagccatgtg

SEQ ID NO: 606138 - DNA, 25 bp, Homo sapien
ggtatgttctcagccatgtgtataa

SEQ ID NO: 606139 - DNA, 25 bp, Homo sapien
cagccatgtgtataattccaaatgt

SEQ ID NO: 606140 - DNA, 25 bp, Homo sapien
atatgtgtttactgttgagtgtaca

SEQ ID NO: 606141 - DNA, 25 bp, Homo sapien
gatatatacagtggtatgcacatgt

SEQ ID NO: 606142 - DNA, 25 bp, Homo sapien
atagcacatgcaacctgcattaata

SEQ ID NO: 606143 - DNA, 25 bp, Homo sapien
gcaacctgcattaataatcacttct

SEQ ID NO: 606144 - DNA, 25 bp, Homo sapien
tttctacctggaaagggaattagtg

SEQ ID NO: 606145 - DNA, 25 bp, Homo sapien
ttagtggatgtaacagttcattccc

SEQ ID NO: 606146 - DNA, 25 bp, Homo sapien
tttccttgacgttttgattgttata

SEQ ID NO: 606147 - DNA, 25 bp, Homo sapien
gattgttataactcatttaagtggg

SEQ ID NO: 606148 - DNA, 25 bp, Homo sapien
agatttgatatctagccctgaagac

SEQ ID NO: 606149 - DNA, 25 bp, Homo sapien
atctagccctgaagactcatcattg

SEQ ID NO: 606150 - DNA, 25 bp, Homo sapien
gactcatcattgagcacagtgctag

SEQ ID NO: 606151 - DNA, 25 bp, Homo sapien
acagtgctagaaagaaatgcctacc

SEQ ID NO: 606152 - DNA, 25 bp, Homo sapien
aaatgcctaccaggctaggtgcagt

SEQ ID NO: 606153 - DNA, 25 bp, Homo sapien
ttctaacatttggtccttaaacctg

SEQ ID NO: 606154 - DNA, 25 bp, Homo sapien
tctaacatttggtccttaaacctgg

SEQ ID NO: 606155 - DNA, 25 bp, Homo sapien
aattttctgggtgatagaagcgtcc

SEQ ID NO: 606156 - DNA, 25 bp, Homo sapien
attttctgggtgatagaagcgtcct

SEQ ID NO: 606157 - DNA, 25 bp, Homo sapien
ttttctgggtgatagaagcgtcctt

SEQ ID NO: 606158 - DNA, 25 bp, Homo sapien
tttctgggtgatagaagcgtccttt

SEQ ID NO: 606159 - DNA, 25 bp, Homo sapien
ttctgggtgatagaagcgtcctttg

SEQ ID NO: 606160 - DNA, 25 bp, Homo sapien
tctgggtgatagaagcgtcctttgt

SEQ ID NO: 606161 - DNA, 25 bp, Homo sapien
ctgggtgatagaagcgtcctttgtt

SEQ ID NO: 606162 - DNA, 25 bp, Homo sapien
tgggtgatagaagcgtcctttgttc

SEQ ID NO: 606163 - DNA, 25 bp, Homo sapien
gggtgatagaagcgtcctttgttct

SEQ ID NO: 606164 - DNA, 25 bp, Homo sapien
ctattttctactgcaaaatcttgtt

SEQ ID NO: 606165 - DNA, 25 bp, Homo sapien
taatcattactcaatcataacttgt

SEQ ID NO: 606166 - DNA, 25 bp, Homo sapien
cattactcaatcataacttgtgttt

SEQ ID NO: 606167 - DNA, 25 bp, Homo sapien
taacttgtgtttaacctataatgcc

SEQ ID NO: 606168 - DNA, 25 bp, Homo sapien
acttgtgtttaacctataatgccta

SEQ ID NO: 606169 - DNA, 25 bp, Homo sapien
ttgtgtttaacctataatgcctaag

SEQ ID NO: 606170 - DNA, 25 bp, Homo sapien
gtgtttaacctataatgcctaaggc

SEQ ID NO: 606171 - DNA, 25 bp, Homo sapien
gtttaacctataatgcctaaggcta

SEQ ID NO: 606172 - DNA, 25 bp, Homo sapien
aatgcctaaggctattctgaatttt

SEQ ID NO: 606173 - DNA, 25 bp, Homo sapien
atgcctaaggctattctgaattttt

SEQ ID NO: 606174 - DNA, 25 bp, Homo sapien
gcctaaggctattctgaatttttgt

SEQ ID NO: 606175 - DNA, 25 bp, Homo sapien
agaggaaccgcctcactgttctacg

SEQ ID NO: 606176 - DNA, 25 bp, Homo sapien
ctgttctacgcccagaactaggcaa

SEQ ID NO: 606177 - DNA, 25 bp, Homo sapien
ttctacgcccagaactaggcaatga

SEQ ID NO: 606178 - DNA, 25 bp, Homo sapien
ggacctcttctcctgcatttgttac

SEQ ID NO: 606179 - DNA, 25 bp, Homo sapien
ctgcatttgttacccagataatttt

SEQ ID NO: 606180 - DNA, 25 bp, Homo sapien
ggtctgctcggaatgcaacaaaaca

SEQ ID NO: 606181 - DNA, 25 bp, Homo sapien
gtgttattgacaccaaaaccttatt

SEQ ID NO: 606182 - DNA, 25 bp, Homo sapien
gacaccaaaaccttatttgcaccaa

SEQ ID NO: 606183 - DNA, 25 bp, Homo sapien
caaaaccttatttgcaccaatccaa

SEQ ID NO: 606184 - DNA, 25 bp, Homo sapien
tgggacatatgtctgcaatgctgca

SEQ ID NO: 606185 - DNA, 25 bp, Homo sapien
atatgtctgcaatgctgcacacacc

SEQ ID NO: 606186 - DNA, 25 bp, Homo sapien
gaggaacttggagcaagagccatat

SEQ ID NO: 606187 - DNA, 25 bp, Homo sapien
agattgtagggattctggcagaagc

SEQ ID NO: 606188 - DNA, 25 bp, Homo sapien
ggcagaagcacaaggccaagccctg

SEQ ID NO: 606189 - DNA, 25 bp, Homo sapien
ttagtgcctcccattgtagaaccaa

SEQ ID NO: 606190 - DNA, 25 bp, Homo sapien
tgcctcccattgtagaaccaaactg

SEQ ID NO: 606191 - DNA, 25 bp, Homo sapien
gaagtggtggtcagtggattccttt

SEQ ID NO: 606192 - DNA, 25 bp, Homo sapien
gtcagtggattcctttgtctgtttc

SEQ ID NO: 606193 - DNA, 25 bp, Homo sapien
gtctgtttcttataggtcagcctcc

SEQ ID NO: 606194 - DNA, 25 bp, Homo sapien
agagagcatgttagagtgtggattt

SEQ ID NO: 606195 - DNA, 25 bp, Homo sapien
gtgcaaatgaaagttaccctgtagc

SEQ ID NO: 606196 - DNA, 25 bp, Homo sapien
cctgtagcccacttgactctgtaga

SEQ ID NO: 606197 - DNA, 25 bp, Homo sapien
gaaaagttgagtgctgaagactaca

SEQ ID NO: 606198 - DNA, 25 bp, Homo sapien
agtgctgaagactacaaagctgttt

SEQ ID NO: 606199 - DNA, 25 bp, Homo sapien
gctgtttgtaagttatcaagctagg

SEQ ID NO: 606200 - DNA, 25 bp, Homo sapien
ttgatcccaggtctgcctgataaat

SEQ ID NO: 606201 - DNA, 25 bp, Homo sapien
tctgcctgataaatcctggactctt

SEQ ID NO: 606202 - DNA, 25 bp, Homo sapien
ttaaccatgacataggagtgccctc

SEQ ID NO: 606203 - DNA, 25 bp, Homo sapien
atgacataggagtgccctcttgact

SEQ ID NO: 606204 - DNA, 25 bp, Homo sapien
cctcttgactcctatgatggcataa

SEQ ID NO: 606205 - DNA, 25 bp, Homo sapien
aagaattgtatcagaacgggtaatc

SEQ ID NO: 606206 - DNA, 25 bp, Homo sapien
ggtaatctggcattaaaacccctgt

SEQ ID NO: 606207 - DNA, 25 bp, Homo sapien
tctggcattaaaacccctgtgccac

SEQ ID NO: 606208 - DNA, 25 bp, Homo sapien
tgaggcaagtgaagcacttgaggtc

SEQ ID NO: 606209 - DNA, 25 bp, Homo sapien
ctgtaccacagcctgagcaacgaaa

SEQ ID NO: 606210 - DNA, 25 bp, Homo sapien
tgtaccacagcctgagcaacgaaag

SEQ ID NO: 606211 - DNA, 25 bp, Homo sapien
gtaccacagcctgagcaacgaaaga

SEQ ID NO: 606212 - DNA, 25 bp, Homo sapien
taccacagcctgagcaacgaaagaa

SEQ ID NO: 606213 - DNA, 25 bp, Homo sapien
cacagcctgagcaacgaaagaagac

SEQ ID NO: 606214 - DNA, 25 bp, Homo sapien
acagcctgagcaacgaaagaagact

SEQ ID NO: 606215 - DNA, 25 bp, Homo sapien
cagcctgagcaacgaaagaagactc

SEQ ID NO: 606216 - DNA, 25 bp, Homo sapien
cctgagcaacgaaagaagactctgt

SEQ ID NO: 606217 - DNA, 25 bp, Homo sapien
ctgagcaacgaaagaagactctgtc

SEQ ID NO: 606218 - DNA, 25 bp, Homo sapien
agcaacgaaagaagactctgtctaa

SEQ ID NO: 606219 - DNA, 25 bp, Homo sapien
aatggacagatgcagtccctcgggc

SEQ ID NO: 606220 - DNA, 25 bp, Homo sapien
agatgcagtccctcgggcaggtgtt

SEQ ID NO: 606221 - DNA, 25 bp, Homo sapien
agtccctcgggcaggtgttcatcgc

SEQ ID NO: 606222 - DNA, 25 bp, Homo sapien
gtgttcatcgccctcatcctaggta

SEQ ID NO: 606223 - DNA, 25 bp, Homo sapien
atcctaggtactagccctggatgtc

SEQ ID NO: 606224 - DNA, 25 bp, Homo sapien
ttcacacacagaagagcccttggtt

SEQ ID NO: 606225 - DNA, 25 bp, Homo sapien
gggcactatgctctcaaccagtttg

SEQ ID NO: 606226 - DNA, 25 bp, Homo sapien
agtttgtcagcccactcctcaggac

SEQ ID NO: 606227 - DNA, 25 bp, Homo sapien
ctcaggacacttcctcaggtgcaga

SEQ ID NO: 606228 - DNA, 25 bp, Homo sapien
caggtgcagacccttggacttgtaa

SEQ ID NO: 606229 - DNA, 25 bp, Homo sapien
cagacccttggacttgtaataataa

SEQ ID NO: 606230 - DNA, 25 bp, Homo sapien
gaccctatgccgacatttggcactc

SEQ ID NO: 606231 - DNA, 25 bp, Homo sapien
gacatttggcactcgatgagccatt

SEQ ID NO: 606232 - DNA, 25 bp, Homo sapien
cgatgagccatttctccacatttca

SEQ ID NO: 606233 - DNA, 25 bp, Homo sapien
tccacatttcaggagccttgtttta

SEQ ID NO: 606234 - DNA, 25 bp, Homo sapien
ccttgttttaagacagcctggctgt

SEQ ID NO: 606235 - DNA, 25 bp, Homo sapien
gacagcctggctgtctgagagccac

SEQ ID NO: 606236 - DNA, 25 bp, Homo sapien
agagccaccggagtcgagactggat

SEQ ID NO: 606237 - DNA, 25 bp, Homo sapien
caccggagtcgagactggatgcccg

SEQ ID NO: 606238 - DNA, 25 bp, Homo sapien
gccactgagagggatctttaagcag

SEQ ID NO: 606239 - DNA, 25 bp, Homo sapien
ggatctttaagcagagggccccaca

SEQ ID NO: 606240 - DNA, 25 bp, Homo sapien
gacccacgggtgtggctgccatgca

SEQ ID NO: 606241 - DNA, 25 bp, Homo sapien
tgagatcagaacctccaacatgccg

SEQ ID NO: 606242 - DNA, 25 bp, Homo sapien
tccaacatgccgagcagacgcaggc

SEQ ID NO: 606243 - DNA, 25 bp, Homo sapien
aacaggacaccagggcgctgtgcta

SEQ ID NO: 606244 - DNA, 25 bp, Homo sapien
gagggcactgtattgtccagacgct

SEQ ID NO: 606245 - DNA, 25 bp, Homo sapien
gtattgtccagacgcttggcaacga

SEQ ID NO: 606246 - DNA, 25 bp, Homo sapien
agacgcttggcaacgactctgcctg

SEQ ID NO: 606247 - DNA, 25 bp, Homo sapien
aacgactctgcctgcaagtggcaaa

SEQ ID NO: 606248 - DNA, 25 bp, Homo sapien
ggcaaataccaacataaccacatct

SEQ ID NO: 606249 - DNA, 25 bp, Homo sapien
atcttccttttagttgccacaaata

SEQ ID NO: 606250 - DNA, 25 bp, Homo sapien
ttagttgccacaaatattcagtttt

SEQ ID NO: 606251 - DNA, 25 bp, Homo sapien
atgtcccccatatgcatgtaatgaa

SEQ ID NO: 606252 - DNA, 25 bp, Homo sapien
aaatggttattcctaccagctccag

SEQ ID NO: 606253 - DNA, 25 bp, Homo sapien
gttattcctaccagctccagaaatg

SEQ ID NO: 606254 - DNA, 25 bp, Homo sapien
gttacacaatatacactagaagact

SEQ ID NO: 606255 - DNA, 25 bp, Homo sapien
tttgtccttaggtagtattgttcct

SEQ ID NO: 606256 - DNA, 25 bp, Homo sapien
gtagtattgttcctttcaaccaaag

SEQ ID NO: 606257 - DNA, 25 bp, Homo sapien
gttcctttcaaccaaagactccaga

SEQ ID NO: 606258 - DNA, 25 bp, Homo sapien
ggacgctgcttcacaccaaaggttt

SEQ ID NO: 606259 - DNA, 25 bp, Homo sapien
gctgcttcacaccaaaggtttaaaa

SEQ ID NO: 606260 - DNA, 25 bp, Homo sapien
tattttccaaatgcactaggaacat

SEQ ID NO: 606261 - DNA, 25 bp, Homo sapien
accagaaaggagtgaacagaatgct

SEQ ID NO: 606262 - DNA, 25 bp, Homo sapien
gtgaacagaatgctaatgaagatac

SEQ ID NO: 606263 - DNA, 25 bp, Homo sapien
caggattccatgatagcttccagaa

SEQ ID NO: 606264 - DNA, 25 bp, Homo sapien
gatagcttccagaactgccaaagaa

SEQ ID NO: 606265 - DNA, 25 bp, Homo sapien
gccaaagaacgcatttctgtgtttt

SEQ ID NO: 606266 - DNA, 25 bp, Homo sapien
tctgtggtatcttgtgactgccgcc

SEQ ID NO: 606267 - DNA, 25 bp, Homo sapien
gtgactgccgccctaggaaagtaaa

SEQ ID NO: 606268 - DNA, 25 bp, Homo sapien
gtaccctttgaaataccacctagag

SEQ ID NO: 606269 - DNA, 25 bp, Homo sapien
ggtaatagtacacccgatcatgtgc

SEQ ID NO: 606270 - DNA, 25 bp, Homo sapien
acccgatcatgtgctccagtttatg

SEQ ID NO: 606271 - DNA, 25 bp, Homo sapien
gaaatagttgcacgtcactcggaat

SEQ ID NO: 606272 - DNA, 25 bp, Homo sapien
gttgcacgtcactcggaattttgaa

SEQ ID NO: 606273 - DNA, 25 bp, Homo sapien
atttgcttgctatggacttgtcttg

SEQ ID NO: 606274 - DNA, 25 bp, Homo sapien
attatctttcactaccatcatatga

SEQ ID NO: 606275 - DNA, 25 bp, Homo sapien
atctttcactaccatcatatgactg

SEQ ID NO: 606276 - DNA, 25 bp, Homo sapien
tctttcactaccatcatatgactga

SEQ ID NO: 606277 - DNA, 25 bp, Homo sapien
tttcactaccatcatatgactgaat

SEQ ID NO: 606278 - DNA, 25 bp, Homo sapien
gatagtttttataagaatggtttgg

SEQ ID NO: 606279 - DNA, 25 bp, Homo sapien
ggtttggtttatatactcttttcat

SEQ ID NO: 606280 - DNA, 25 bp, Homo sapien
ttactgtttctcttctgttcaatat

SEQ ID NO: 606281 - DNA, 25 bp, Homo sapien
tactgtttctcttctgttcaatatt

SEQ ID NO: 606282 - DNA, 25 bp, Homo sapien
actgtttctcttctgttcaatattt

SEQ ID NO: 606283 - DNA, 25 bp, Homo sapien
gatatgacagttttattttgacttc

SEQ ID NO: 606284 - DNA, 25 bp, Homo sapien
atatgacagttttattttgacttct

SEQ ID NO: 606285 - DNA, 25 bp, Homo sapien
cttggcatccaggatgtgttaagat

SEQ ID NO: 606286 - DNA, 25 bp, Homo sapien
gcatccaggatgtgttaagatggca

SEQ ID NO: 606287 - DNA, 25 bp, Homo sapien
catccaggatgtgttaagatggcat

SEQ ID NO: 606288 - DNA, 25 bp, Homo sapien
atccaggatgtgttaagatggcatt

SEQ ID NO: 606289 - DNA, 25 bp, Homo sapien
tccaggatgtgttaagatggcattg

SEQ ID NO: 606290 - DNA, 25 bp, Homo sapien
ccaggatgtgttaagatggcattga

SEQ ID NO: 606291 - DNA, 25 bp, Homo sapien
caggatgtgttaagatggcattgag

SEQ ID NO: 606292 - DNA, 25 bp, Homo sapien
aagatggcattgaggccgagcgcgg

SEQ ID NO: 606293 - DNA, 25 bp, Homo sapien
agatggcattgaggccgagcgcggt

SEQ ID NO: 606294 - DNA, 25 bp, Homo sapien
gatggcattgaggccgagcgcggtg

SEQ ID NO: 606295 - DNA, 25 bp, Homo sapien
taccaaaaacaattggctgggcgtg

SEQ ID NO: 606296 - DNA, 25 bp, Homo sapien
gcacagataaatgccctcttttacc

SEQ ID NO: 606297 - DNA, 25 bp, Homo sapien
gccctcttttacctacgtgatttga

SEQ ID NO: 606298 - DNA, 25 bp, Homo sapien
tacgtgatttgacactcctctactg

SEQ ID NO: 606299 - DNA, 25 bp, Homo sapien
ggaccaagcacaccagtgatgtaat

SEQ ID NO: 606300 - DNA, 25 bp, Homo sapien
gatgtaattattctgcttggtcctt

SEQ ID NO: 606301 - DNA, 25 bp, Homo sapien
ttggtccttgcacacacaagtcact

SEQ ID NO: 606302 - DNA, 25 bp, Homo sapien
gtcactgtgatatatgtttgggccc

SEQ ID NO: 606303 - DNA, 25 bp, Homo sapien
tgtttgggcccatcacctagatgat

SEQ ID NO: 606304 - DNA, 25 bp, Homo sapien
gtgatacatcgcttgacgtagctct

SEQ ID NO: 606305 - DNA, 25 bp, Homo sapien
gacgtagctcttatgtgatgtgact

SEQ ID NO: 606306 - DNA, 25 bp, Homo sapien
ttctttcatgcttgggcccttccta

SEQ ID NO: 606307 - DNA, 25 bp, Homo sapien
cggcgctgcgtggtgtgccaggcac

SEQ ID NO: 606308 - DNA, 25 bp, Homo sapien
gagacgcccgagtcctacgtgtgcc

SEQ ID NO: 606309 - DNA, 25 bp, Homo sapien
ctacgtgtgccggacgctggactgc

SEQ ID NO: 606310 - DNA, 25 bp, Homo sapien
acgctggactgcgaggccgtgtact

SEQ ID NO: 606311 - DNA, 25 bp, Homo sapien
ccgtgtactgctggtcgtgctggga

SEQ ID NO: 606312 - DNA, 25 bp, Homo sapien
tgctgggacgacatgcggcagcggt

SEQ ID NO: 606313 - DNA, 25 bp, Homo sapien
gagctctcttcctccgcctttagtg

SEQ ID NO: 606314 - DNA, 25 bp, Homo sapien
tccgcctttagtgacagcaacgacg

SEQ ID NO: 606315 - DNA, 25 bp, Homo sapien
gtgacagcaacgacgacactgccta

SEQ ID NO: 606316 - DNA, 25 bp, Homo sapien
gcaacgacgacactgcctacgcggg

SEQ ID NO: 606317 - DNA, 25 bp, Homo sapien
ggtgaagaggcgtcctgctcgctct

SEQ ID NO: 606318 - DNA, 25 bp, Homo sapien
cttgaggtttgcgagttggaaacca

SEQ ID NO: 606319 - DNA, 25 bp, Homo sapien
ttgaggtttgcgagttggaaaccag

SEQ ID NO: 606320 - DNA, 25 bp, Homo sapien
tgaggtttgcgagttggaaaccagt

SEQ ID NO: 606321 - DNA, 25 bp, Homo sapien
gaggtttgcgagttggaaaccagtc

SEQ ID NO: 606322 - DNA, 25 bp, Homo sapien
aggtttgcgagttggaaaccagtct

SEQ ID NO: 606323 - DNA, 25 bp, Homo sapien
ggtttgcgagttggaaaccagtctg

SEQ ID NO: 606324 - DNA, 25 bp, Homo sapien
gtttgcgagttggaaaccagtctga

SEQ ID NO: 606325 - DNA, 25 bp, Homo sapien
tttgcgagttggaaaccagtctgac

SEQ ID NO: 606326 - DNA, 25 bp, Homo sapien
acccatcttcacttggtgctgccat

SEQ ID NO: 606327 - DNA, 25 bp, Homo sapien
ggtgctgccatcaactttgtaagat

SEQ ID NO: 606328 - DNA, 25 bp, Homo sapien
gaataatttgagtgtttccacagga

SEQ ID NO: 606329 - DNA, 25 bp, Homo sapien
ggtatgaatcatatcgtctaagtat

SEQ ID NO: 606330 - DNA, 25 bp, Homo sapien
atctttaaagggtgtctctgtgtac

SEQ ID NO: 606331 - DNA, 25 bp, Homo sapien
gggtgtctctgtgtactttgaatta

SEQ ID NO: 606332 - DNA, 25 bp, Homo sapien
attttgcagttatgtaggtatccta

SEQ ID NO: 606333 - DNA, 25 bp, Homo sapien
gtaggtatcctaatgagtgaatggt

SEQ ID NO: 606334 - DNA, 25 bp, Homo sapien
gaattcattgagctaaccttggttt

SEQ ID NO: 606335 - DNA, 25 bp, Homo sapien
ttagcattagcacccccattatatt

SEQ ID NO: 606336 - DNA, 25 bp, Homo sapien
attttcagggatagtaaatactcca

SEQ ID NO: 606337 - DNA, 25 bp, Homo sapien
agatcattccctgcccaaattttaa

SEQ ID NO: 606338 - DNA, 25 bp, Homo sapien
tcattccctgcccaaattttaactt

SEQ ID NO: 606339 - DNA, 25 bp, Homo sapien
gtgaaaaagaatattctctgcccca

SEQ ID NO: 606340 - DNA, 25 bp, Homo sapien
aaaagaatattctctgccccaatta

SEQ ID NO: 606341 - DNA, 25 bp, Homo sapien
aaagaatattctctgccccaattat

SEQ ID NO: 606342 - DNA, 25 bp, Homo sapien
ttgcctctcactctggactattgga

SEQ ID NO: 606343 - DNA, 25 bp, Homo sapien
gcctctcactctggactattggatt

SEQ ID NO: 606344 - DNA, 25 bp, Homo sapien
ctctcactctggactattggatttt

SEQ ID NO: 606345 - DNA, 25 bp, Homo sapien
ctcactctggactattggatttttt

SEQ ID NO: 606346 - DNA, 25 bp, Homo sapien
atgttttaagctttcattattatga

SEQ ID NO: 606347 - DNA, 25 bp, Homo sapien
gattgattttggtggataagaattt

SEQ ID NO: 606348 - DNA, 25 bp, Homo sapien
atggccacctggtagacatgggaga

SEQ ID NO: 606349 - DNA, 25 bp, Homo sapien
agggcaggagatgggtctctctcac

SEQ ID NO: 606350 - DNA, 25 bp, Homo sapien
aggaggagtgcagaccgtaaccctg

SEQ ID NO: 606351 - DNA, 25 bp, Homo sapien
gtaaccctgtctttctgacccagtg

SEQ ID NO: 606352 - DNA, 25 bp, Homo sapien
agtgccctaacctgtcagcatgaac

SEQ ID NO: 606353 - DNA, 25 bp, Homo sapien
gtcagcatgaaccacaccacaggtg

SEQ ID NO: 606354 - DNA, 25 bp, Homo sapien
acaggtgcccagacatcagagtttc

SEQ ID NO: 606355 - DNA, 25 bp, Homo sapien
cagacatcagagtttcacagacaga

SEQ ID NO: 606356 - DNA, 25 bp, Homo sapien
gacagaaatagtttccccagagttt

SEQ ID NO: 606357 - DNA, 25 bp, Homo sapien
ggcttttttaggctcaactatcatg

SEQ ID NO: 606358 - DNA, 25 bp, Homo sapien
ggctcaactatcatgcattattatt

SEQ ID NO: 606359 - DNA, 25 bp, Homo sapien
tttttcttttgtgctccttgagaag

SEQ ID NO: 606360 - DNA, 25 bp, Homo sapien
gtgctccttgagaagttatctttct

SEQ ID NO: 606361 - DNA, 25 bp, Homo sapien
ttctcccgcaatcattagcttcttt

SEQ ID NO: 606362 - DNA, 25 bp, Homo sapien
cgcaatcattagcttctttctgagc

SEQ ID NO: 606363 - DNA, 25 bp, Homo sapien
gggatccttgcaaaacaagctgctt

SEQ ID NO: 606364 - DNA, 25 bp, Homo sapien
aacaagctgctttcgctgatatttt

SEQ ID NO: 606365 - DNA, 25 bp, Homo sapien
gctttcgctgatattttatggactt

SEQ ID NO: 606366 - DNA, 25 bp, Homo sapien
tatggacttaggaatgatccttaca

SEQ ID NO: 606367 - DNA, 25 bp, Homo sapien
gaatgatccttacagaattcttttc

SEQ ID NO: 606368 - DNA, 25 bp, Homo sapien
gtgcaatttgtcttggaaggcaaca

SEQ ID NO: 606369 - DNA, 25 bp, Homo sapien
caataaatttggaagagggctggcc

SEQ ID NO: 606370 - DNA, 25 bp, Homo sapien
agttttcaatggctgatagttttgt

SEQ ID NO: 606371 - DNA, 25 bp, Homo sapien
gatagttttgttttctcacccttca

SEQ ID NO: 606372 - DNA, 25 bp, Homo sapien
atttctagaaaacatccttgcatac

SEQ ID NO: 606373 - DNA, 25 bp, Homo sapien
gaaaacatccttgcatacaaagcag

SEQ ID NO: 606374 - DNA, 25 bp, Homo sapien
ccttgcatacaaagcaggatagcta

SEQ ID NO: 606375 - DNA, 25 bp, Homo sapien
aaacttcaagtgtctagcacatact

SEQ ID NO: 606376 - DNA, 25 bp, Homo sapien
gtgtctagcacatactacatctaag

SEQ ID NO: 606377 - DNA, 25 bp, Homo sapien
gcacatactacatctaagaggctaa

SEQ ID NO: 606378 - DNA, 25 bp, Homo sapien
ctaagaggctaaactctgataggaa

SEQ ID NO: 606379 - DNA, 25 bp, Homo sapien
agtagttgaaattctaggccggtgc

SEQ ID NO: 606380 - DNA, 25 bp, Homo sapien
agttgaaattctaggccggtgcggt

SEQ ID NO: 606381 - DNA, 25 bp, Homo sapien
gacactttagttagagatccactgc

SEQ ID NO: 606382 - DNA, 25 bp, Homo sapien
tagagatccactgctgtgcgtgcac

SEQ ID NO: 606383 - DNA, 25 bp, Homo sapien
ctgtgcgtgcacacatactcacaca

SEQ ID NO: 606384 - DNA, 25 bp, Homo sapien
gcaatgacggactcgctggcggact

SEQ ID NO: 606385 - DNA, 25 bp, Homo sapien
accgagttctgcttgtgctccatga

SEQ ID NO: 606386 - DNA, 25 bp, Homo sapien
gtgctccatgagcttccggaaagat

SEQ ID NO: 606387 - DNA, 25 bp, Homo sapien
gatggctgcttggataacacctttc

SEQ ID NO: 606388 - DNA, 25 bp, Homo sapien
tgcacactctacgattgccttcata

SEQ ID NO: 606389 - DNA, 25 bp, Homo sapien
tagtccagcgtttgagtgagcactc

SEQ ID NO: 606390 - DNA, 25 bp, Homo sapien
gtgagcactccagtcagaacgaact

SEQ ID NO: 606391 - DNA, 25 bp, Homo sapien
gaacgaactctgcattgtgaacatc

SEQ ID NO: 606392 - DNA, 25 bp, Homo sapien
ccagctttggtgagatagatacgta

SEQ ID NO: 606393 - DNA, 25 bp, Homo sapien
gatacgtaatcttcgtaaagaccta

SEQ ID NO: 606394 - DNA, 25 bp, Homo sapien
gacctataaggaattcctctgtgga

SEQ ID NO: 606395 - DNA, 25 bp, Homo sapien
ggatgctgaaagaagcaactcttta

SEQ ID NO: 606396 - DNA, 25 bp, Homo sapien
aactctttaatcttgccagcccatg

SEQ ID NO: 606397 - DNA, 25 bp, Homo sapien
ttgccagcccatgcacagtgaagct

SEQ ID NO: 606398 - DNA, 25 bp, Homo sapien
gaagtgcttcaatttacagatgttt

SEQ ID NO: 606399 - DNA, 25 bp, Homo sapien
ttttccaacaaagacctaccgcagt

SEQ ID NO: 606400 - DNA, 25 bp, Homo sapien
taccgcagttacatcacaggctcca

SEQ ID NO: 606401 - DNA, 25 bp, Homo sapien
ggctgcttctgcaaggctgttagta

SEQ ID NO: 606402 - DNA, 25 bp, Homo sapien
taaggatactatgtattgctgtgct

SEQ ID NO: 606403 - DNA, 25 bp, Homo sapien
ttccagagggccctgaaacttttca

SEQ ID NO: 606404 - DNA, 25 bp, Homo sapien
agagggccctgaaacttttcaaatg

SEQ ID NO: 606405 - DNA, 25 bp, Homo sapien
aactaaatcaggctcatttgaagat

SEQ ID NO: 606406 - DNA, 25 bp, Homo sapien
aagttacactagatcttctttcagt

SEQ ID NO: 606407 - DNA, 25 bp, Homo sapien
ctagatcttctttcagttatatttt

SEQ ID NO: 606408 - DNA, 25 bp, Homo sapien
gtgtgttattgatatgaatgttcca

SEQ ID NO: 606409 - DNA, 25 bp, Homo sapien
gaaatctaagacgtcatcagttgta

SEQ ID NO: 606410 - DNA, 25 bp, Homo sapien
gacgtcatcagttgtaattctgctt

SEQ ID NO: 606411 - DNA, 25 bp, Homo sapien
aattctgcttatgttgtttgacaca

SEQ ID NO: 606412 - DNA, 25 bp, Homo sapien
tgtttgacacaaaataaccagtttc

SEQ ID NO: 606413 - DNA, 25 bp, Homo sapien
aataaccagtttcttgtcaatttct

SEQ ID NO: 606414 - DNA, 25 bp, Homo sapien
attatctttcactaccatcatatga

SEQ ID NO: 606415 - DNA, 25 bp, Homo sapien
atctttcactaccatcatatgactg

SEQ ID NO: 606416 - DNA, 25 bp, Homo sapien
tttcactaccatcatatgactgaat

SEQ ID NO: 606417 - DNA, 25 bp, Homo sapien
ggtttggtttatatactcttttcat

SEQ ID NO: 606418 - DNA, 25 bp, Homo sapien
ttctaagttttaatcagttatctac

SEQ ID NO: 606419 - DNA, 25 bp, Homo sapien
tcagttatctactttttagtttact

SEQ ID NO: 606420 - DNA, 25 bp, Homo sapien
ttactgtttctcttctgttcaatat

SEQ ID NO: 606421 - DNA, 25 bp, Homo sapien
actgtttctcttctgttcaatattt

SEQ ID NO: 606422 - DNA, 25 bp, Homo sapien
gatatgacagttttattttgacttc

SEQ ID NO: 606423 - DNA, 25 bp, Homo sapien
gacagttttattttgacttctgcat

SEQ ID NO: 606424 - DNA, 25 bp, Homo sapien
tattttgacttctgcattttgattg

SEQ ID NO: 606425 - DNA, 25 bp, Homo sapien
agaactgtcctgaagggcaaagtac

SEQ ID NO: 606426 - DNA, 25 bp, Homo sapien
gggcaaagtaccaagctacctaaag

SEQ ID NO: 606427 - DNA, 25 bp, Homo sapien
gtaccaagctacctaaagtttgtat

SEQ ID NO: 606428 - DNA, 25 bp, Homo sapien
tggtaaaatgggtcaagtttgtgtt

SEQ ID NO: 606429 - DNA, 25 bp, Homo sapien
tttgtgtttggaacccctagcctct

SEQ ID NO: 606430 - DNA, 25 bp, Homo sapien
gtgtggcagaaacagtcagttgcat

SEQ ID NO: 606431 - DNA, 25 bp, Homo sapien
agtcagttgcatctctcaccaacag

SEQ ID NO: 606432 - DNA, 25 bp, Homo sapien
ttgcatctctcaccaacaggtgggt

SEQ ID NO: 606433 - DNA, 25 bp, Homo sapien
ttcctggagaggaacggatcaagct

SEQ ID NO: 606434 - DNA, 25 bp, Homo sapien
ggaacggatcaagctaggaagcaca

SEQ ID NO: 606435 - DNA, 25 bp, Homo sapien
aggaagcacagaactgcaggccaga

SEQ ID NO: 606436 - DNA, 25 bp, Homo sapien
gagtttgagaacaactcctcagttg

SEQ ID NO: 606437 - DNA, 25 bp, Homo sapien
gtttgagaacaactcctcagttggt

SEQ ID NO: 606438 - DNA, 25 bp, Homo sapien
ttgagaacaactcctcagttggtca

SEQ ID NO: 606439 - DNA, 25 bp, Homo sapien
gagaacaactcctcagttggtcaac

SEQ ID NO: 606440 - DNA, 25 bp, Homo sapien
gaacaactcctcagttggtcaacat

SEQ ID NO: 606441 - DNA, 25 bp, Homo sapien
acaactcctcagttggtcaacatgt

SEQ ID NO: 606442 - DNA, 25 bp, Homo sapien
aactcctcagttggtcaacatgtca

SEQ ID NO: 606443 - DNA, 25 bp, Homo sapien
actcctcagttggtcaacatgtcaa

SEQ ID NO: 606444 - DNA, 25 bp, Homo sapien
aaacccctctctgctaagagtacaa

SEQ ID NO: 606445 - DNA, 25 bp, Homo sapien
acccctctctgctaagagtacaaag

SEQ ID NO: 606446 - DNA, 25 bp, Homo sapien
cctctctgctaagagtacaaagact

SEQ ID NO: 606447 - DNA, 25 bp, Homo sapien
ccatgcccgggctgaaatatttctc

SEQ ID NO: 606448 - DNA, 25 bp, Homo sapien
catgcccgggctgaaatatttctcg

SEQ ID NO: 606449 - DNA, 25 bp, Homo sapien
atgcccgggctgaaatatttctcgt

SEQ ID NO: 606450 - DNA, 25 bp, Homo sapien
gcccgggctgaaatatttctcgtaa

SEQ ID NO: 606451 - DNA, 25 bp, Homo sapien
ccgggctgaaatatttctcgtaata

SEQ ID NO: 606452 - DNA, 25 bp, Homo sapien
gctgaaatatttctcgtaatagcag

SEQ ID NO: 606453 - DNA, 25 bp, Homo sapien
gaaatatttctcgtaatagcagaat

SEQ ID NO: 606454 - DNA, 25 bp, Homo sapien
tagcagaatatttcatggccgaact

SEQ ID NO: 606455 - DNA, 25 bp, Homo sapien
gcagaatatttcatggccgaactct

SEQ ID NO: 606456 - DNA, 25 bp, Homo sapien
agaatatttcatggccgaactcttg

SEQ ID NO: 606457 - DNA, 25 bp, Homo sapien
tatttcatggccgaactcttgatag

SEQ ID NO: 606458 - DNA, 25 bp, Homo sapien
gtgtgatccaccatgcccgggctga

SEQ ID NO: 606459 - DNA, 25 bp, Homo sapien
catgcccgggctgaaatatttctcg

SEQ ID NO: 606460 - DNA, 25 bp, Homo sapien
gcccgggctgaaatatttctcgtaa

SEQ ID NO: 606461 - DNA, 25 bp, Homo sapien
gggctgaaatatttctcgtaatagc

SEQ ID NO: 606462 - DNA, 25 bp, Homo sapien
gaaatatttctcgtaatagcagaat

SEQ ID NO: 606463 - DNA, 25 bp, Homo sapien
tagcagaatatttcatggccgaact

SEQ ID NO: 606464 - DNA, 25 bp, Homo sapien
gcagaatatttcatggccgaactct

SEQ ID NO: 606465 - DNA, 25 bp, Homo sapien
agaatatttcatggccgaactcttg

SEQ ID NO: 606466 - DNA, 25 bp, Homo sapien
tatttcatggccgaactcttgatag

SEQ ID NO: 606467 - DNA, 25 bp, Homo sapien
ggtaccagaactcaggcacttggat

SEQ ID NO: 606468 - DNA, 25 bp, Homo sapien
aggcacttggattttatgaccttat

SEQ ID NO: 606469 - DNA, 25 bp, Homo sapien
aaataatgtatattggccaggtgcg

SEQ ID NO: 606470 - DNA, 25 bp, Homo sapien
ttgagacaaacctgggtaatatggt

SEQ ID NO: 606471 - DNA, 25 bp, Homo sapien
taaggctatagtgagacacgattgc

SEQ ID NO: 606472 - DNA, 25 bp, Homo sapien
aaggctatagtgagacacgattgca

SEQ ID NO: 606473 - DNA, 25 bp, Homo sapien
gctatagtgagacacgattgcacca

SEQ ID NO: 606474 - DNA, 25 bp, Homo sapien
ctatagtgagacacgattgcaccac

SEQ ID NO: 606475 - DNA, 25 bp, Homo sapien
atagtgagacacgattgcaccactt

SEQ ID NO: 606476 - DNA, 25 bp, Homo sapien
tagtgagacacgattgcaccacttc

SEQ ID NO: 606477 - DNA, 25 bp, Homo sapien
gtgagacacgattgcaccacttcat

SEQ ID NO: 606478 - DNA, 25 bp, Homo sapien
tgagacacgattgcaccacttcatc

SEQ ID NO: 606479 - DNA, 25 bp, Homo sapien
gagacacgattgcaccacttcatcc

SEQ ID NO: 606480 - DNA, 25 bp, Homo sapien
ccacactcatgaaccacatttgtct

SEQ ID NO: 606481 - DNA, 25 bp, Homo sapien
accacatttgtctatcagttttaag

SEQ ID NO: 606482 - DNA, 25 bp, Homo sapien
taagtgttatgatggttaccctgct

SEQ ID NO: 606483 - DNA, 25 bp, Homo sapien
gatggttaccctgcttgttattaaa

SEQ ID NO: 606484 - DNA, 25 bp, Homo sapien
aaagcctgccaataacagagctgaa

SEQ ID NO: 606485 - DNA, 25 bp, Homo sapien
ggcagagacacgtgctattccagaa

SEQ ID NO: 606486 - DNA, 25 bp, Homo sapien
tattccagaaagacccaactgctct

SEQ ID NO: 606487 - DNA, 25 bp, Homo sapien
tgtgtcagcctccattactctggtt

SEQ ID NO: 606488 - DNA, 25 bp, Homo sapien
tctggttcacaatgtttctctctca

SEQ ID NO: 606489 - DNA, 25 bp, Homo sapien
atcttctatttgtacctcgtggtcc

SEQ ID NO: 606490 - DNA, 25 bp, Homo sapien
gggacccatgggactatttaatcca

SEQ ID NO: 606491 - DNA, 25 bp, Homo sapien
aatctgatcttcaaggaaatactga

SEQ ID NO: 606492 - DNA, 25 bp, Homo sapien
aatactgaatccacatagcactccc

SEQ ID NO: 606493 - DNA, 25 bp, Homo sapien
gcattactcaccatctcacagagga

SEQ ID NO: 606494 - DNA, 25 bp, Homo sapien
ttaaaaatacttagccactcccacg

SEQ ID NO: 606495 - DNA, 25 bp, Homo sapien
actcccacgtgtcctgggaaactga

SEQ ID NO: 606496 - DNA, 25 bp, Homo sapien
gaaactgagaacacagtaactacca

SEQ ID NO: 606497 - DNA, 25 bp, Homo sapien
taactaccaaacaaattacatgatg

SEQ ID NO: 606498 - DNA, 25 bp, Homo sapien
atgatgtcacatgccagatacctaa

SEQ ID NO: 606499 - DNA, 25 bp, Homo sapien
gtcacatgccagatacctaaaggat

SEQ ID NO: 606500 - DNA, 25 bp, Homo sapien
taaaggataacatcaccccatcttc

SEQ ID NO: 606501 - DNA, 25 bp, Homo sapien
aggataacatcaccccatcttcaga

SEQ ID NO: 606502 - DNA, 25 bp, Homo sapien
ggagagccacatgcctgagtaagaa

SEQ ID NO: 606503 - DNA, 25 bp, Homo sapien
caagagggacttggagccaccagtg

SEQ ID NO: 606504 - DNA, 25 bp, Homo sapien
cccactggaagcaggtagctgaatg

SEQ ID NO: 606505 - DNA, 25 bp, Homo sapien
gtagctgaatggtggcctgaaccag

SEQ ID NO: 606506 - DNA, 25 bp, Homo sapien
gggttgccgtactcgcactccagag

SEQ ID NO: 606507 - DNA, 25 bp, Homo sapien
cagagccctgggatgtgccgcattc

SEQ ID NO: 606508 - DNA, 25 bp, Homo sapien
gatccagaagacctgggcacatctg

SEQ ID NO: 606509 - DNA, 25 bp, Homo sapien
ctgggcacatctgggactggaatac

SEQ ID NO: 606510 - DNA, 25 bp, Homo sapien
tacagaacgtgtttgatgcatcttt

SEQ ID NO: 606511 - DNA, 25 bp, Homo sapien
atgcatctttgaatggctggttttc

SEQ ID NO: 606512 - DNA, 25 bp, Homo sapien
ttcaattgtctgaagattctgttgg

SEQ ID NO: 606513 - DNA, 25 bp, Homo sapien
gctgttaggtaccaggaactgtgct

SEQ ID NO: 606514 - DNA, 25 bp, Homo sapien
aggaactgtgcttggcccttgacac

SEQ ID NO: 606515 - DNA, 25 bp, Homo sapien
gcttggcccttgacacatataattt

SEQ ID NO: 606516 - DNA, 25 bp, Homo sapien
tttcacggaatcctcacagcagatt

SEQ ID NO: 606517 - DNA, 25 bp, Homo sapien
tacagaccaccccttacaagagatg

SEQ ID NO: 606518 - DNA, 25 bp, Homo sapien
gtcgcccagctcattagtggttgaa

SEQ ID NO: 606519 - DNA, 25 bp, Homo sapien
actgagatatgaaagcagctctggc

SEQ ID NO: 606520 - DNA, 25 bp, Homo sapien
gctgactccaaaagccaaagctctt

SEQ ID NO: 606521 - DNA, 25 bp, Homo sapien
agccaaagctcttttgagggccaga

SEQ ID NO: 606522 - DNA, 25 bp, Homo sapien
gagagtcaggataccttttcctagg

SEQ ID NO: 606523 - DNA, 25 bp, Homo sapien
gagaggatagtaccttgtcacagaa

SEQ ID NO: 606524 - DNA, 25 bp, Homo sapien
agaatatccacagatcactgcccaa

SEQ ID NO: 606525 - DNA, 25 bp, Homo sapien
gatcactgcccaaagcggaagactg

SEQ ID NO: 606526 - DNA, 25 bp, Homo sapien
tgcccaaagcggaagactgattgaa

SEQ ID NO: 606527 - DNA, 25 bp, Homo sapien
gagatgctaatagagtttctgaaat

SEQ ID NO: 606528 - DNA, 25 bp, Homo sapien
ggaaaagtctcccaaaccttcagag

SEQ ID NO: 606529 - DNA, 25 bp, Homo sapien
aagtctcccaaaccttcagagagtg

SEQ ID NO: 606530 - DNA, 25 bp, Homo sapien
tcccaaaccttcagagagtggatgg

SEQ ID NO: 606531 - DNA, 25 bp, Homo sapien
ggagcgaagtaaggagaccccacct

SEQ ID NO: 606532 - DNA, 25 bp, Homo sapien
taaggagaccccacctgagcagata

SEQ ID NO: 606533 - DNA, 25 bp, Homo sapien
gaccccacctgagcagatacatggt

SEQ ID NO: 606534 - DNA, 25 bp, Homo sapien
gcagatacatggtattgcttacaat

SEQ ID NO: 606535 - DNA, 25 bp, Homo sapien
tttattcagataccctcacgccact

SEQ ID NO: 606536 - DNA, 25 bp, Homo sapien
cacgccactgcagaagcgagtagag

SEQ ID NO: 606537 - DNA, 25 bp, Homo sapien
gaaaaaagtgtctcccagcctgtgg

SEQ ID NO: 606538 - DNA, 25 bp, Homo sapien
ctcccagcctgtggaaagaggatgg

SEQ ID NO: 606539 - DNA, 25 bp, Homo sapien
tggctatttcatccactaaaggtgt

SEQ ID NO: 606540 - DNA, 25 bp, Homo sapien
tcatcccaggaggagtgaatgtctg

SEQ ID NO: 606541 - DNA, 25 bp, Homo sapien
gtgtgtgtacctgagataagatgat

SEQ ID NO: 606542 - DNA, 25 bp, Homo sapien
gatgatgtcttgtccaatgctggtt

SEQ ID NO: 606543 - DNA, 25 bp, Homo sapien
gtccaatgctggtttccaccttgtg

SEQ ID NO: 606544 - DNA, 25 bp, Homo sapien
ggagaggctcctgcgacctgtgacc

SEQ ID NO: 606545 - DNA, 25 bp, Homo sapien
tgtgaccctgaagcagaataagtgg

SEQ ID NO: 606546 - DNA, 25 bp, Homo sapien
agggatatacacttgctccctgacc

SEQ ID NO: 606547 - DNA, 25 bp, Homo sapien
ctgacctcatagaacgtccagctaa

SEQ ID NO: 606548 - DNA, 25 bp, Homo sapien
gaacgtccagctaacttgaagaacc

SEQ ID NO: 606549 - DNA, 25 bp, Homo sapien
tgtataggccaggacgtgaacgttt

SEQ ID NO: 606550 - DNA, 25 bp, Homo sapien
gaacgttttaatggtaatggtcaca

SEQ ID NO: 606551 - DNA, 25 bp, Homo sapien
ttctctctggtcatttagagcctta

SEQ ID NO: 606552 - DNA, 25 bp, Homo sapien
atatgtattttgttgagattcttca

SEQ ID NO: 606553 - DNA, 25 bp, Homo sapien
tcttcacttgtttaacacttaactg

SEQ ID NO: 606554 - DNA, 25 bp, Homo sapien
atgctgttggtaggcatcctgtgag

SEQ ID NO: 606555 - DNA, 25 bp, Homo sapien
catcctgtgagtgttgaggctcagc

SEQ ID NO: 606556 - DNA, 25 bp, Homo sapien
gaggctcagcagtttagggatatac

SEQ ID NO: 606557 - DNA, 25 bp, Homo sapien
taaaattggtggaaagcggtggctc

SEQ ID NO: 606558 - DNA, 25 bp, Homo sapien
aaaattggtggaaagcggtggctca

SEQ ID NO: 606559 - DNA, 25 bp, Homo sapien
aaattggtggaaagcggtggctcac

SEQ ID NO: 606560 - DNA, 25 bp, Homo sapien
gaaagcggtggctcacgtccgtaat

SEQ ID NO: 606561 - DNA, 25 bp, Homo sapien
ggtggatggactgagctcaagagtt

SEQ ID NO: 606562 - DNA, 25 bp, Homo sapien
tgtggtggcacgtgctcccagcctg

SEQ ID NO: 606563 - DNA, 25 bp, Homo sapien
tgggcaacacctcccagtacttggg

SEQ ID NO: 606564 - DNA, 25 bp, Homo sapien
gggcaacacctcccagtacttggga

SEQ ID NO: 606565 - DNA, 25 bp, Homo sapien
tatcgtgagccgtggaggtggttgc

SEQ ID NO: 606566 - DNA, 25 bp, Homo sapien
tcgtgagccgtggaggtggttgcag

SEQ ID NO: 606567 - DNA, 25 bp, Homo sapien
gagccgagactatgtcactgaactc

SEQ ID NO: 606568 - DNA, 25 bp, Homo sapien
gattgtaccatgcaagctggcaact

SEQ ID NO: 606569 - DNA, 25 bp, Homo sapien
atgcaagctggcaactagaacccaa

SEQ ID NO: 606570 - DNA, 25 bp, Homo sapien
tggcaactagaacccaaatccttgg

SEQ ID NO: 606571 - DNA, 25 bp, Homo sapien
agaacccaaatccttggactacttg

SEQ ID NO: 606572 - DNA, 25 bp, Homo sapien
taaaaatcatatctccacaacggtt

SEQ ID NO: 606573 - DNA, 25 bp, Homo sapien
tctccacaacggttctggaattctg

SEQ ID NO: 606574 - DNA, 25 bp, Homo sapien
gggattgccttctaatccagtttac

SEQ ID NO: 606575 - DNA, 25 bp, Homo sapien
ttctaatccagtttacaagtgacag

SEQ ID NO: 606576 - DNA, 25 bp, Homo sapien
acagaaaacctgttatgctgctttg

SEQ ID NO: 606577 - DNA, 25 bp, Homo sapien
tgctttgtagtcttaccttagattt

SEQ ID NO: 606578 - DNA, 25 bp, Homo sapien
gactatatttaccattttgttgaaa

SEQ ID NO: 606579 - DNA, 25 bp, Homo sapien
acggcggttgttagtgtgagtctgg

SEQ ID NO: 606580 - DNA, 25 bp, Homo sapien
cggcggttgttagtgtgagtctgga

SEQ ID NO: 606581 - DNA, 25 bp, Homo sapien
tgtgagtctggagggtgcccttcct

SEQ ID NO: 606582 - DNA, 25 bp, Homo sapien
gtgagtctggagggtgcccttcctc

SEQ ID NO: 606583 - DNA, 25 bp, Homo sapien
tgagtctggagggtgcccttcctcc

SEQ ID NO: 606584 - DNA, 25 bp, Homo sapien
gagtctggagggtgcccttcctcca

SEQ ID NO: 606585 - DNA, 25 bp, Homo sapien
agtctggagggtgcccttcctccac

SEQ ID NO: 606586 - DNA, 25 bp, Homo sapien
ctggagggtgcccttcctccaccag

SEQ ID NO: 606587 - DNA, 25 bp, Homo sapien
tggagggtgcccttcctccaccagc

SEQ ID NO: 606588 - DNA, 25 bp, Homo sapien
ggagggtgcccttcctccaccagcc

SEQ ID NO: 606589 - DNA, 25 bp, Homo sapien
ccccaggtcctctgcattaaaccag

SEQ ID NO: 606590 - DNA, 25 bp, Homo sapien
acaggcgtgggctcccgtgaccagc

SEQ ID NO: 606591 - DNA, 25 bp, Homo sapien
cgtgggctcccgtgaccagcctgga

SEQ ID NO: 606592 - DNA, 25 bp, Homo sapien
gtgaccagcctggaacgtgctgatg

SEQ ID NO: 606593 - DNA, 25 bp, Homo sapien
gaccagcctggaacgtgctgatgag

SEQ ID NO: 606594 - DNA, 25 bp, Homo sapien
agcctggaacgtgctgatgagcctc

SEQ ID NO: 606595 - DNA, 25 bp, Homo sapien
cctggaacgtgctgatgagcctctt

SEQ ID NO: 606596 - DNA, 25 bp, Homo sapien
tggaacgtgctgatgagcctctttt

SEQ ID NO: 606597 - DNA, 25 bp, Homo sapien
gaacgtgctgatgagcctctttttc

SEQ ID NO: 606598 - DNA, 25 bp, Homo sapien
aacgtgctgatgagcctctttttct

SEQ ID NO: 606599 - DNA, 25 bp, Homo sapien
acgtgctgatgagcctctttttctc

SEQ ID NO: 606600 - DNA, 25 bp, Homo sapien
cggtgggaacagatggtggatgctt

SEQ ID NO: 606601 - DNA, 25 bp, Homo sapien
ttaaaattggtggaaagcggtggct

SEQ ID NO: 606602 - DNA, 25 bp, Homo sapien
taaaattggtggaaagcggtggctc

SEQ ID NO: 606603 - DNA, 25 bp, Homo sapien
aaaattggtggaaagcggtggctca

SEQ ID NO: 606604 - DNA, 25 bp, Homo sapien
ttggtggaaagcggtggctcacgtc

SEQ ID NO: 606605 - DNA, 25 bp, Homo sapien
tgggcaacacctcccagtacttggg

SEQ ID NO: 606606 - DNA, 25 bp, Homo sapien
gggcaacacctcccagtacttggga

SEQ ID NO: 606607 - DNA, 25 bp, Homo sapien
atatcgtgagccgtggaggtggttg

SEQ ID NO: 606608 - DNA, 25 bp, Homo sapien
tatcgtgagccgtggaggtggttgc

SEQ ID NO: 606609 - DNA, 25 bp, Homo sapien
atcgtgagccgtggaggtggttgca

SEQ ID NO: 606610 - DNA, 25 bp, Homo sapien
tcgtgagccgtggaggtggttgcag

SEQ ID NO: 606611 - DNA, 25 bp, Homo sapien
gagccgagactatgtcactgaactc

SEQ ID NO: 606612 - DNA, 25 bp, Homo sapien
ttcagtttctggatagacggctttc

SEQ ID NO: 606613 - DNA, 25 bp, Homo sapien
tagacggctttcctatttccttgga

SEQ ID NO: 606614 - DNA, 25 bp, Homo sapien
tatttccttggacttagagatgaga

SEQ ID NO: 606615 - DNA, 25 bp, Homo sapien
gttgggtggaccagacgccatttaa

SEQ ID NO: 606616 - DNA, 25 bp, Homo sapien
gacgccatttaacccacgcagagta

SEQ ID NO: 606617 - DNA, 25 bp, Homo sapien
aacccacgcagagtattctggcata

SEQ ID NO: 606618 - DNA, 25 bp, Homo sapien
ggcataagaatgaacccgacaactc

SEQ ID NO: 606619 - DNA, 25 bp, Homo sapien
gaacccgacaactctcagggagaaa

SEQ ID NO: 606620 - DNA, 25 bp, Homo sapien
aaatgggcctggaatgatgttcctt

SEQ ID NO: 606621 - DNA, 25 bp, Homo sapien
gatgttccttgtaactttgaagcaa

SEQ ID NO: 606622 - DNA, 25 bp, Homo sapien
gaaactcagaaagtggtccttgtga

SEQ ID NO: 606623 - DNA, 25 bp, Homo sapien
tctccacaaacgtttttaaaatgtg

SEQ ID NO: 606624 - DNA, 25 bp, Homo sapien
tttttaaaatgtgccgggtgtactg

SEQ ID NO: 606625 - DNA, 25 bp, Homo sapien
ttttaaaatgtgccgggtgtactgg

SEQ ID NO: 606626 - DNA, 25 bp, Homo sapien
tttaaaatgtgccgggtgtactggt

SEQ ID NO: 606627 - DNA, 25 bp, Homo sapien
ttaaaatgtgccgggtgtactggtg

SEQ ID NO: 606628 - DNA, 25 bp, Homo sapien
taaaatgtgccgggtgtactggtgc

SEQ ID NO: 606629 - DNA, 25 bp, Homo sapien
aaaatgtgccgggtgtactggtgca

SEQ ID NO: 606630 - DNA, 25 bp, Homo sapien
aaatgtgccgggtgtactggtgcac

SEQ ID NO: 606631 - DNA, 25 bp, Homo sapien
aatgtgccgggtgtactggtgcaca

SEQ ID NO: 606632 - DNA, 25 bp, Homo sapien
atgtgccgggtgtactggtgcacac

SEQ ID NO: 606633 - DNA, 25 bp, Homo sapien
tgtgccgggtgtactggtgcacacc

SEQ ID NO: 606634 - DNA, 25 bp, Homo sapien
acagcttggagtttctgctggtctt

SEQ ID NO: 606635 - DNA, 25 bp, Homo sapien
tggtcttgggccagccggactcatt

SEQ ID NO: 606636 - DNA, 25 bp, Homo sapien
gactcattttcctaatcttagccac

SEQ ID NO: 606637 - DNA, 25 bp, Homo sapien
aatcttagccacttatccccagtga

SEQ ID NO: 606638 - DNA, 25 bp, Homo sapien
attccaaagaatccaacgcagcact

SEQ ID NO: 606639 - DNA, 25 bp, Homo sapien
tagcaagcaggttcaggacagccct

SEQ ID NO: 606640 - DNA, 25 bp, Homo sapien
aggacagccctggacgatttcccga

SEQ ID NO: 606641 - DNA, 25 bp, Homo sapien
tcagtttccctgaggtaccacctaa

SEQ ID NO: 606642 - DNA, 25 bp, Homo sapien
tcctcactccctgatcaatggaagt

SEQ ID NO: 606643 - DNA, 25 bp, Homo sapien
aagttcaggtcagtggagtctttcc

SEQ ID NO: 606644 - DNA, 25 bp, Homo sapien
ggagtctttccttgattgatcaccc

SEQ ID NO: 606645 - DNA, 25 bp, Homo sapien
ggaacaccaaagatctatatctgct

SEQ ID NO: 606646 - DNA, 25 bp, Homo sapien
agatctatatctgctatgatttttt

SEQ ID NO: 606647 - DNA, 25 bp, Homo sapien
atgtattttgtttatgtctgtaata

SEQ ID NO: 606648 - DNA, 25 bp, Homo sapien
caacaaagtctctctaccaacaaac

SEQ ID NO: 606649 - DNA, 25 bp, Homo sapien
ggaacccaagaggtaaaatctcaca

SEQ ID NO: 606650 - DNA, 25 bp, Homo sapien
ggtaaaatctcacacaattcttcgt

SEQ ID NO: 606651 - DNA, 25 bp, Homo sapien
aaatctcacacaattcttcgttcaa

SEQ ID NO: 606652 - DNA, 25 bp, Homo sapien
ctcacacaattcttcgttcaaaaaa

SEQ ID NO: 606653 - DNA, 25 bp, Homo sapien
aaaaaaggccatcacgtgtttatgg

SEQ ID NO: 606654 - DNA, 25 bp, Homo sapien
catcacgtgtttatggcaccattgg

SEQ ID NO: 606655 - DNA, 25 bp, Homo sapien
tgtttatggcaccattggaacacca

SEQ ID NO: 606656 - DNA, 25 bp, Homo sapien
gggattactcgacctcattacttag

SEQ ID NO: 606657 - DNA, 25 bp, Homo sapien
gacctcattacttagctaacgactg

SEQ ID NO: 606658 - DNA, 25 bp, Homo sapien
gctaacgactggataaaatttctta

SEQ ID NO: 606659 - DNA, 25 bp, Homo sapien
gtaacattgtattcgtgtttgcatt

SEQ ID NO: 606660 - DNA, 25 bp, Homo sapien
gtattcgtgtttgcattattaattt

SEQ ID NO: 606661 - DNA, 25 bp, Homo sapien
atcacattttcaacccatttataca

SEQ ID NO: 606662 - DNA, 25 bp, Homo sapien
taatgtttctttagagctgtataac

SEQ ID NO: 606663 - DNA, 25 bp, Homo sapien
ctagcaaggaagttattgttttgac

SEQ ID NO: 606664 - DNA, 25 bp, Homo sapien
attatgcttttctggtgcatgaaac

SEQ ID NO: 606665 - DNA, 25 bp, Homo sapien
ttgcaaagggcagtcacatccaact

SEQ ID NO: 606666 - DNA, 25 bp, Homo sapien
gggcagtcacatccaactttaataa

SEQ ID NO: 606667 - DNA, 25 bp, Homo sapien
gatcctagctgcaaactaagagacc

SEQ ID NO: 606668 - DNA, 25 bp, Homo sapien
tcctagctgcaaactaagagacctc

SEQ ID NO: 606669 - DNA, 25 bp, Homo sapien
ctagctgcaaactaagagacctcat

SEQ ID NO: 606670 - DNA, 25 bp, Homo sapien
agctgcaaactaagagacctcatta

SEQ ID NO: 606671 - DNA, 25 bp, Homo sapien
gctgcaaactaagagacctcattaa

SEQ ID NO: 606672 - DNA, 25 bp, Homo sapien
aagagacctcattaaaacctaacat

SEQ ID NO: 606673 - DNA, 25 bp, Homo sapien
gagacctcattaaaacctaacatgt

SEQ ID NO: 606674 - DNA, 25 bp, Homo sapien
gacctcattaaaacctaacatgtgg

SEQ ID NO: 606675 - DNA, 25 bp, Homo sapien
ctcattaaaacctaacatgtggctg

SEQ ID NO: 606676 - DNA, 25 bp, Homo sapien
cattaaaacctaacatgtggctggg

SEQ ID NO: 606677 - DNA, 25 bp, Homo sapien
aaacctaacatgtggctgggtgtgg

SEQ ID NO: 606678 - DNA, 25 bp, Homo sapien
gactttatagatcactgcagcatta

SEQ ID NO: 606679 - DNA, 25 bp, Homo sapien
agtttccagtttaccattccataag

SEQ ID NO: 606680 - DNA, 25 bp, Homo sapien
taagtacaattaatccttctagtgt

SEQ ID NO: 606681 - DNA, 25 bp, Homo sapien
aatactgttataattatctaggcaa

SEQ ID NO: 606682 - DNA, 25 bp, Homo sapien
actgatatttttgcacgattgtagt

SEQ ID NO: 606683 - DNA, 25 bp, Homo sapien
gattgtagtggtgtatagtcttgac

SEQ ID NO: 606684 - DNA, 25 bp, Homo sapien
tatagtcttgacttgcagagcattt

SEQ ID NO: 606685 - DNA, 25 bp, Homo sapien
gagcattttgcttgagtccttgaaa

SEQ ID NO: 606686 - DNA, 25 bp, Homo sapien
gcttgagtccttgaaatgtcgtgtt

SEQ ID NO: 606687 - DNA, 25 bp, Homo sapien
tgaaatgtcgtgttcattcattatt

SEQ ID NO: 606688 - DNA, 25 bp, Homo sapien
tatttgctgagtgcttacaatgtat

SEQ ID NO: 606689 - DNA, 25 bp, Homo sapien
gacgggccaataggtgcagcaagcc

SEQ ID NO: 606690 - DNA, 25 bp, Homo sapien
cgggccaataggtgcagcaagccat

SEQ ID NO: 606691 - DNA, 25 bp, Homo sapien
gccaataggtgcagcaagccatcgt

SEQ ID NO: 606692 - DNA, 25 bp, Homo sapien
aataggtgcagcaagccatcgtggc

SEQ ID NO: 606693 - DNA, 25 bp, Homo sapien
gcagcaagccatcgtggcacacatg

SEQ ID NO: 606694 - DNA, 25 bp, Homo sapien
agcaagccatcgtggcacacatgtg

SEQ ID NO: 606695 - DNA, 25 bp, Homo sapien
aagccatcgtggcacacatgtgcct

SEQ ID NO: 606696 - DNA, 25 bp, Homo sapien
agccatcgtggcacacatgtgccta

SEQ ID NO: 606697 - DNA, 25 bp, Homo sapien
atcgtggcacacatgtgcctaggaa

SEQ ID NO: 606698 - DNA, 25 bp, Homo sapien
gcacacatgtgcctaggaaacaaac

SEQ ID NO: 606699 - DNA, 25 bp, Homo sapien
cacatgtgcctaggaaacaaacctg

SEQ ID NO: 606700 - DNA, 25 bp, Homo sapien
gggacagattctctccatcaaatgg

SEQ ID NO: 606701 - DNA, 25 bp, Homo sapien
gagtataatggcactgacataccaa

SEQ ID NO: 606702 - DNA, 25 bp, Homo sapien
gacataccaagaacaaaggcacatg

SEQ ID NO: 606703 - DNA, 25 bp, Homo sapien
aggatccttctggatggtctgcaga

SEQ ID NO: 606704 - DNA, 25 bp, Homo sapien
gatggtctgcagactcagtgtacca

SEQ ID NO: 606705 - DNA, 25 bp, Homo sapien
ggattcctcagagctcgtcattaga

SEQ ID NO: 606706 - DNA, 25 bp, Homo sapien
gagctcgtcattagagaagaacatc

SEQ ID NO: 606707 - DNA, 25 bp, Homo sapien
gtatcccaaagcaaagactcatatt

SEQ ID NO: 606708 - DNA, 25 bp, Homo sapien
gactcatattatggatcagggtgat

SEQ ID NO: 606709 - DNA, 25 bp, Homo sapien
gcaaactgtgcatataaatctcgta

SEQ ID NO: 606710 - DNA, 25 bp, Homo sapien
aaatctcgtaattccagagggacag

SEQ ID NO: 606711 - DNA, 25 bp, Homo sapien
tgccttgcacatctctcctgagggc

SEQ ID NO: 606712 - DNA, 25 bp, Homo sapien
ctcctgagggctgtcatcccagaat

SEQ ID NO: 606713 - DNA, 25 bp, Homo sapien
gtcatcccagaatgagctgcatttg

SEQ ID NO: 606714 - DNA, 25 bp, Homo sapien
gaatgagctgcatttgtccagcctg

SEQ ID NO: 606715 - DNA, 25 bp, Homo sapien
tgagctgcatttgtccagcctggcc

SEQ ID NO: 606716 - DNA, 25 bp, Homo sapien
ttgcaaaacttttctgggggacctg

SEQ ID NO: 606717 - DNA, 25 bp, Homo sapien
gggggacctgttcacaatgccttct

SEQ ID NO: 606718 - DNA, 25 bp, Homo sapien
aatgccttctgtagcatactccaag

SEQ ID NO: 606719 - DNA, 25 bp, Homo sapien
gtagcatactccaagaatccggcgc

SEQ ID NO: 606720 - DNA, 25 bp, Homo sapien
acagcacccctttgcagtcaagctc

SEQ ID NO: 606721 - DNA, 25 bp, Homo sapien
tccccttccctttgaaatctcatgg

SEQ ID NO: 606722 - DNA, 25 bp, Homo sapien
cacacacgaagaacagtgtaaatta

SEQ ID NO: 606723 - DNA, 25 bp, Homo sapien
acacacgaagaacagtgtaaattaa

SEQ ID NO: 606724 - DNA, 25 bp, Homo sapien
cacacgaagaacagtgtaaattaaa

SEQ ID NO: 606725 - DNA, 25 bp, Homo sapien
accaaaccaaaggctgggtgtggcg

SEQ ID NO: 606726 - DNA, 25 bp, Homo sapien
ccaaaccaaaggctgggtgtggcgg

SEQ ID NO: 606727 - DNA, 25 bp, Homo sapien
aaaccaaaggctgggtgtggcggct

SEQ ID NO: 606728 - DNA, 25 bp, Homo sapien
ccaaaggctgggtgtggcggctatg

SEQ ID NO: 606729 - DNA, 25 bp, Homo sapien
aaaggctgggtgtggcggctatgcc

SEQ ID NO: 606730 - DNA, 25 bp, Homo sapien
tagccagacatagtggtgcacatct

SEQ ID NO: 606731 - DNA, 25 bp, Homo sapien
agccagacatagtggtgcacatctg

SEQ ID NO: 606732 - DNA, 25 bp, Homo sapien
gccagacatagtggtgcacatctgt

SEQ ID NO: 606733 - DNA, 25 bp, Homo sapien
gccccaaacacaacagaaactgctg

SEQ ID NO: 606734 - DNA, 25 bp, Homo sapien
aactgctgttttacttgggtctggg

SEQ ID NO: 606735 - DNA, 25 bp, Homo sapien
gctgttttacttgggtctgggacca

SEQ ID NO: 606736 - DNA, 25 bp, Homo sapien
tttacttgggtctgggaccaagcaa

SEQ ID NO: 606737 - DNA, 25 bp, Homo sapien
aagagcttctcccagaatccagact

SEQ ID NO: 606738 - DNA, 25 bp, Homo sapien
agaatccagactaagcccgctctct

SEQ ID NO: 606739 - DNA, 25 bp, Homo sapien
gggtgaaatccctcagaactactgt

SEQ ID NO: 606740 - DNA, 25 bp, Homo sapien
atccctcagaactactgtatgttgg

SEQ ID NO: 606741 - DNA, 25 bp, Homo sapien
ggaggcaagccctgactatgcaatt

SEQ ID NO: 606742 - DNA, 25 bp, Homo sapien
gactatgcaattaaggaaaacctgt

SEQ ID NO: 606743 - DNA, 25 bp, Homo sapien
atacaagcatcgtatgtttattgca

SEQ ID NO: 606744 - DNA, 25 bp, Homo sapien
aactgaggccagaagaggtgagctt

SEQ ID NO: 606745 - DNA, 25 bp, Homo sapien
tgaggccagaagaggtgagcttacc

SEQ ID NO: 606746 - DNA, 25 bp, Homo sapien
cccaaggcatctagtgaccagaggg

SEQ ID NO: 606747 - DNA, 25 bp, Homo sapien
cagccagggtgtgatcctgcctcat

SEQ ID NO: 606748 - DNA, 25 bp, Homo sapien
agggtgtgatcctgcctcatctgac

SEQ ID NO: 606749 - DNA, 25 bp, Homo sapien
atcctgcctcatctgacttcgtagt

SEQ ID NO: 606750 - DNA, 25 bp, Homo sapien
tctgacttcgtagttgggtacacat

SEQ ID NO: 606751 - DNA, 25 bp, Homo sapien
gacttcgtagttgggtacacattta

SEQ ID NO: 606752 - DNA, 25 bp, Homo sapien
ttgggtacacatttaacttccgcct

SEQ ID NO: 606753 - DNA, 25 bp, Homo sapien
taacttccgccttcctgtgtgtgtt

SEQ ID NO: 606754 - DNA, 25 bp, Homo sapien
gtgtgttttccaagagcatcattaa

SEQ ID NO: 606755 - DNA, 25 bp, Homo sapien
ctgcatagatctccccctgccccaa

SEQ ID NO: 606756 - DNA, 25 bp, Homo sapien
tgcatagatctccccctgccccaaa

SEQ ID NO: 606757 - DNA, 25 bp, Homo sapien
gcatagatctccccctgccccaaaa

SEQ ID NO: 606758 - DNA, 25 bp, Homo sapien
catagatctccccctgccccaaaaa

SEQ ID NO: 606759 - DNA, 25 bp, Homo sapien
aggtagcttgactctctgttcgagg

SEQ ID NO: 606760 - DNA, 25 bp, Homo sapien
ggtagcttgactctctgttcgaggc

SEQ ID NO: 606761 - DNA, 25 bp, Homo sapien
gtagcttgactctctgttcgaggct

SEQ ID NO: 606762 - DNA, 25 bp, Homo sapien
ctctgttcgaggctcagtccttttg

SEQ ID NO: 606763 - DNA, 25 bp, Homo sapien
tctgttcgaggctcagtccttttga

SEQ ID NO: 606764 - DNA, 25 bp, Homo sapien
ctgttcgaggctcagtccttttgat

SEQ ID NO: 606765 - DNA, 25 bp, Homo sapien
actaagccccgagggcctggatcgg

SEQ ID NO: 606766 - DNA, 25 bp, Homo sapien
gatcggagctgctagatcctctttg

SEQ ID NO: 606767 - DNA, 25 bp, Homo sapien
tagatcctctttgggcactggtgga

SEQ ID NO: 606768 - DNA, 25 bp, Homo sapien
actggtggatgtaggcacctcctgc

SEQ ID NO: 606769 - DNA, 25 bp, Homo sapien
tcctgccccagacgtaacaagtgac

SEQ ID NO: 606770 - DNA, 25 bp, Homo sapien
gacgtaacaagtgactactgatgta

SEQ ID NO: 606771 - DNA, 25 bp, Homo sapien
tactgatgtagaacggcttctccca

SEQ ID NO: 606772 - DNA, 25 bp, Homo sapien
cttctcccacacagttattatctga

SEQ ID NO: 606773 - DNA, 25 bp, Homo sapien
tattatctgacagcgctgaagctca

SEQ ID NO: 606774 - DNA, 25 bp, Homo sapien
gaagctcagaagtctaacgtagggc

SEQ ID NO: 606775 - DNA, 25 bp, Homo sapien
agaagtctaacgtagggccaggcgc

SEQ ID NO: 606776 - DNA, 25 bp, Homo sapien
ggaggtccctagctcaggacttatt

SEQ ID NO: 606777 - DNA, 25 bp, Homo sapien
acttattccatgcacactctgatag

SEQ ID NO: 606778 - DNA, 25 bp, Homo sapien
tgatagaatatttacgcccaacact

SEQ ID NO: 606779 - DNA, 25 bp, Homo sapien
aacactaactgtttggcttggcaaa

SEQ ID NO: 606780 - DNA, 25 bp, Homo sapien
taaagtcacagctggcctgtaggct

SEQ ID NO: 606781 - DNA, 25 bp, Homo sapien
atgtgcagctgagtcacaaccactt

SEQ ID NO: 606782 - DNA, 25 bp, Homo sapien
ggagcaagcgcctatgctcatgcct

SEQ ID NO: 606783 - DNA, 25 bp, Homo sapien
tcatgcctgcactcagacacatatc

SEQ ID NO: 606784 - DNA, 25 bp, Homo sapien
atatccacacagatacccacagatg

SEQ ID NO: 606785 - DNA, 25 bp, Homo sapien
gatgccgcgtgccactgagtcatag

SEQ ID NO: 606786 - DNA, 25 bp, Homo sapien
gagtcatagctacctcctcagagag

SEQ ID NO: 606787 - DNA, 25 bp, Homo sapien
tggtggccgccatttttggcctgga

SEQ ID NO: 606788 - DNA, 25 bp, Homo sapien
gccgccatttttggcctggagttcc

SEQ ID NO: 606789 - DNA, 25 bp, Homo sapien
gagttcctcatggtgtcccagttgt

SEQ ID NO: 606790 - DNA, 25 bp, Homo sapien
tcatggtgtcccagttgtgcgagga

SEQ ID NO: 606791 - DNA, 25 bp, Homo sapien
gtgtcccagttgtgcgaggacaaac

SEQ ID NO: 606792 - DNA, 25 bp, Homo sapien
cagtgcaagtgggtcatgggttcca

SEQ ID NO: 606793 - DNA, 25 bp, Homo sapien
agtgggtcatgggttccatcctcct

SEQ ID NO: 606794 - DNA, 25 bp, Homo sapien
tggtgtctttcgtcctctcctccgg

SEQ ID NO: 606795 - DNA, 25 bp, Homo sapien
gcgggctcctgggttttgtgatcct

SEQ ID NO: 606796 - DNA, 25 bp, Homo sapien
atcggcttcaccctaatgttttggt

SEQ ID NO: 606797 - DNA, 25 bp, Homo sapien
tgttttggtgcgaattcactgcctc

SEQ ID NO: 606798 - DNA, 25 bp, Homo sapien
agcgtttccagggctgggcgtggtg

SEQ ID NO: 606799 - DNA, 25 bp, Homo sapien
gcgtttccagggctgggcgtggtgg

SEQ ID NO: 606800 - DNA, 25 bp, Homo sapien
cagcactttgtgggggccgaggtgg

SEQ ID NO: 606801 - DNA, 25 bp, Homo sapien
cctggcccacatggcaaaaccccgc

SEQ ID NO: 606802 - DNA, 25 bp, Homo sapien
ctggcccacatggcaaaaccccgcc

SEQ ID NO: 606803 - DNA, 25 bp, Homo sapien
tggcccacatggcaaaaccccgcct

SEQ ID NO: 606804 - DNA, 25 bp, Homo sapien
ggcccacatggcaaaaccccgcctc

SEQ ID NO: 606805 - DNA, 25 bp, Homo sapien
gcccacatggcaaaaccccgcctct

SEQ ID NO: 606806 - DNA, 25 bp, Homo sapien
agaacccagcccagatcggaggaca

SEQ ID NO: 606807 - DNA, 25 bp, Homo sapien
agcccagatcggaggacaagttcct

SEQ ID NO: 606808 - DNA, 25 bp, Homo sapien
aatccaatttggagccccagcccaa

SEQ ID NO: 606809 - DNA, 25 bp, Homo sapien
cagcccagatctgaggccaagctat

SEQ ID NO: 606810 - DNA, 25 bp, Homo sapien
agatctgaggccaagctatgtgcta

SEQ ID NO: 606811 - DNA, 25 bp, Homo sapien
aagctatgtgctagagcccaggcca

SEQ ID NO: 606812 - DNA, 25 bp, Homo sapien
agcccaggccagctctgagaccaag

SEQ ID NO: 606813 - DNA, 25 bp, Homo sapien
aggccagctctgagaccaagcccag

SEQ ID NO: 606814 - DNA, 25 bp, Homo sapien
gcccagcattgagaataagctctgt

SEQ ID NO: 606815 - DNA, 25 bp, Homo sapien
tgtggtggaagtgtgggccgccatc

SEQ ID NO: 606816 - DNA, 25 bp, Homo sapien
agagaggcctgtggctagtttgccc

SEQ ID NO: 606817 - DNA, 25 bp, Homo sapien
gtcacaaaaagtccagaccccaggg

SEQ ID NO: 606818 - DNA, 25 bp, Homo sapien
cctccctaatgctcatgaatggacc

SEQ ID NO: 606819 - DNA, 25 bp, Homo sapien
taatgctcatgaatggacccctcat

SEQ ID NO: 606820 - DNA, 25 bp, Homo sapien
gctcatgaatggacccctcatgaat

SEQ ID NO: 606821 - DNA, 25 bp, Homo sapien
ttataagagaccccaaagagctgcc

SEQ ID NO: 606822 - DNA, 25 bp, Homo sapien
aaagagctgccttgcccttctgcaa

SEQ ID NO: 606823 - DNA, 25 bp, Homo sapien
ccttctgcaatgtgtgatcacagct

SEQ ID NO: 606824 - DNA, 25 bp, Homo sapien
gtgtgatcacagctagaaggcactg

SEQ ID NO: 606825 - DNA, 25 bp, Homo sapien
tcacagctagaaggcactgtcagag

SEQ ID NO: 606826 - DNA, 25 bp, Homo sapien
gagaagagaaactggtcctcaccag

SEQ ID NO: 606827 - DNA, 25 bp, Homo sapien
aagagaaactggtcctcaccagatg

SEQ ID NO: 606828 - DNA, 25 bp, Homo sapien
tagataatactcaacatgattcagt

SEQ ID NO: 606829 - DNA, 25 bp, Homo sapien
actcaacatgattcagtatgacaaa

SEQ ID NO: 606830 - DNA, 25 bp, Homo sapien
ttgagcacctactttatataaaaca

SEQ ID NO: 606831 - DNA, 25 bp, Homo sapien
gacaaattgcagtgtgatgtaatca

SEQ ID NO: 606832 - DNA, 25 bp, Homo sapien
acaaagaagccctataagaccattt

SEQ ID NO: 606833 - DNA, 25 bp, Homo sapien
gaagccctataagaccatttctcta

SEQ ID NO: 606834 - DNA, 25 bp, Homo sapien
gccctataagaccatttctctagaa

SEQ ID NO: 606835 - DNA, 25 bp, Homo sapien
gaccatttctctagaacagatgttc

SEQ ID NO: 606836 - DNA, 25 bp, Homo sapien
gaacagatgttcttaatatttttct

SEQ ID NO: 606837 - DNA, 25 bp, Homo sapien
aaatatgtggtagatagtatgcaag

SEQ ID NO: 606838 - DNA, 25 bp, Homo sapien
tagtatgcaagaaaagccgggtgcg

SEQ ID NO: 606839 - DNA, 25 bp, Homo sapien
cagtgcggtaaattagtatggtcaa

SEQ ID NO: 606840 - DNA, 25 bp, Homo sapien
gtatggtcaaccattagtccaccct

SEQ ID NO: 606841 - DNA, 25 bp, Homo sapien
atggtcaaccattagtccacccttt

SEQ ID NO: 606842 - DNA, 25 bp, Homo sapien
gtcaaccattagtccaccctttctg

SEQ ID NO: 606843 - DNA, 25 bp, Homo sapien
caaccattagtccaccctttctgaa

SEQ ID NO: 606844 - DNA, 25 bp, Homo sapien
aatcacttgaactccagaggagaag

SEQ ID NO: 606845 - DNA, 25 bp, Homo sapien
cacttgaactccagaggagaaggtt

SEQ ID NO: 606846 - DNA, 25 bp, Homo sapien
gttgcagtgactcgagatcccgcta

SEQ ID NO: 606847 - DNA, 25 bp, Homo sapien
tgcagtgactcgagatcccgctact

SEQ ID NO: 606848 - DNA, 25 bp, Homo sapien
agtgactcgagatcccgctactgca

SEQ ID NO: 606849 - DNA, 25 bp, Homo sapien
gtgactcgagatcccgctactgcac

SEQ ID NO: 606850 - DNA, 25 bp, Homo sapien
gtaaatgtccactctcatgctattt

SEQ ID NO: 606851 - DNA, 25 bp, Homo sapien
atgctattttatttctcaggccctt

SEQ ID NO: 606852 - DNA, 25 bp, Homo sapien
atttctcaggccctttgtcatggcc

SEQ ID NO: 606853 - DNA, 25 bp, Homo sapien
tgtcatggccttcttagtggtaaga

SEQ ID NO: 606854 - DNA, 25 bp, Homo sapien
gatgtaacttttgcttttgagaggt

SEQ ID NO: 606855 - DNA, 25 bp, Homo sapien
gaggcctgagtaaagattcaccagt

SEQ ID NO: 606856 - DNA, 25 bp, Homo sapien
tcaccagtttaggaagacattgcag

SEQ ID NO: 606857 - DNA, 25 bp, Homo sapien
attgcagtttgtttctatttgttca

SEQ ID NO: 606858 - DNA, 25 bp, Homo sapien
atttgttcaattcagtttactaggt

SEQ ID NO: 606859 - DNA, 25 bp, Homo sapien
ttcaagcaaggcctggcacataaat

SEQ ID NO: 606860 - DNA, 25 bp, Homo sapien
ggcacataaatcttcccttggctaa

SEQ ID NO: 606861 - DNA, 25 bp, Homo sapien
agaccgaagtggacagtggttaaga

SEQ ID NO: 606862 - DNA, 25 bp, Homo sapien
accgaagtggacagtggttaagatt

SEQ ID NO: 606863 - DNA, 25 bp, Homo sapien
ccgaagtggacagtggttaagattg

SEQ ID NO: 606864 - DNA, 25 bp, Homo sapien
cgaagtggacagtggttaagattgt

SEQ ID NO: 606865 - DNA, 25 bp, Homo sapien
aagtggacagtggttaagattgtgg

SEQ ID NO: 606866 - DNA, 25 bp, Homo sapien
agtggacagtggttaagattgtggg

SEQ ID NO: 606867 - DNA, 25 bp, Homo sapien
ggttaagattgtggggccgggcgag

SEQ ID NO: 606868 - DNA, 25 bp, Homo sapien
gtctctattgggagtacaaaaatta

SEQ ID NO: 606869 - DNA, 25 bp, Homo sapien
aattagccggccatagtggctcgtg

SEQ ID NO: 606870 - DNA, 25 bp, Homo sapien
attagccggccatagtggctcgtgc

SEQ ID NO: 606871 - DNA, 25 bp, Homo sapien
tagccggccatagtggctcgtgcct

SEQ ID NO: 606872 - DNA, 25 bp, Homo sapien
aagccatccagaggaatgcttcttc

SEQ ID NO: 606873 - DNA, 25 bp, Homo sapien
ggaatgcttcttcctctctacagga

SEQ ID NO: 606874 - DNA, 25 bp, Homo sapien
ctctctacaggacccacttcttggt

SEQ ID NO: 606875 - DNA, 25 bp, Homo sapien
gtaaccttttagtcaaaacagcatc

SEQ ID NO: 606876 - DNA, 25 bp, Homo sapien
gtcaaaacagcatcatacttggaaa

SEQ ID NO: 606877 - DNA, 25 bp, Homo sapien
acttggaaactgaaagcctactgtt

SEQ ID NO: 606878 - DNA, 25 bp, Homo sapien
gttattgttgcttaacagctgatac

SEQ ID NO: 606879 - DNA, 25 bp, Homo sapien
gatattctggtgacactactgtgct

SEQ ID NO: 606880 - DNA, 25 bp, Homo sapien
gacactactgtgctggcttacttaa

SEQ ID NO: 606881 - DNA, 25 bp, Homo sapien
actgtgctggcttacttaacctgaa

SEQ ID NO: 606882 - DNA, 25 bp, Homo sapien
ggcttacttaacctgaatacactat

SEQ ID NO: 606883 - DNA, 25 bp, Homo sapien
gtcacaaaaagtccagaccccaggg

SEQ ID NO: 606884 - DNA, 25 bp, Homo sapien
ctaatgctcatgaatggacccctca

SEQ ID NO: 606885 - DNA, 25 bp, Homo sapien
gctcatgaatggacccctcatgaat

SEQ ID NO: 606886 - DNA, 25 bp, Homo sapien
ggacccctcatgaatgaaaccagtg

SEQ ID NO: 606887 - DNA, 25 bp, Homo sapien
gaatgaaaccagtgcccttataaga

SEQ ID NO: 606888 - DNA, 25 bp, Homo sapien
ttataagagaccccaaagagctgcc

SEQ ID NO: 606889 - DNA, 25 bp, Homo sapien
aaagagctgccttgcccttctgcaa

SEQ ID NO: 606890 - DNA, 25 bp, Homo sapien
ccttctgcaatgtgtgatcacagct

SEQ ID NO: 606891 - DNA, 25 bp, Homo sapien
gtgtgatcacagctagaaggcactg

SEQ ID NO: 606892 - DNA, 25 bp, Homo sapien
tcacagctagaaggcactgtcagag

SEQ ID NO: 606893 - DNA, 25 bp, Homo sapien
gaagagaaactggtcctcaccagat

SEQ ID NO: 606894 - DNA, 25 bp, Homo sapien
gtggagacgatcagacatcctggcc

SEQ ID NO: 606895 - DNA, 25 bp, Homo sapien
tcctggcccacgaggctatgggaga

SEQ ID NO: 606896 - DNA, 25 bp, Homo sapien
ggctatgggagataccttcccggat

SEQ ID NO: 606897 - DNA, 25 bp, Homo sapien
taccttcccggatgcagatgctgat

SEQ ID NO: 606898 - DNA, 25 bp, Homo sapien
agatgctgatgaagacagtctggca

SEQ ID NO: 606899 - DNA, 25 bp, Homo sapien
agacagtctggcaggcgagctggat

SEQ ID NO: 606900 - DNA, 25 bp, Homo sapien
gggcgacccagctggcaaggaaccc

SEQ ID NO: 606901 - DNA, 25 bp, Homo sapien
agccgagatgtcctggctggccttt

SEQ ID NO: 606902 - DNA, 25 bp, Homo sapien
gagatgtcctggctggcctttccag

SEQ ID NO: 606903 - DNA, 25 bp, Homo sapien
agcaaaagtgaaatcagtagccttt

SEQ ID NO: 606904 - DNA, 25 bp, Homo sapien
cagtagcctttgctagtttgagggc

SEQ ID NO: 606905 - DNA, 25 bp, Homo sapien
aagtaaggatgtatgtcacctcagg

SEQ ID NO: 606906 - DNA, 25 bp, Homo sapien
gtgatgattatgttatctgtataaa

SEQ ID NO: 606907 - DNA, 25 bp, Homo sapien
tatgaaatctgggcatcctaaaaga

SEQ ID NO: 606908 - DNA, 25 bp, Homo sapien
ttcagggaacaagggaaataaccat

SEQ ID NO: 606909 - DNA, 25 bp, Homo sapien
aaataaccataaagtctgactgccc

SEQ ID NO: 606910 - DNA, 25 bp, Homo sapien
ataaagtctgactgcccatttgcct

SEQ ID NO: 606911 - DNA, 25 bp, Homo sapien
taaagtctgactgcccatttgcctt

SEQ ID NO: 606912 - DNA, 25 bp, Homo sapien
gtctgactgcccatttgccttgtga

SEQ ID NO: 606913 - DNA, 25 bp, Homo sapien
ccttgtgatattttgttgcccttga

SEQ ID NO: 606914 - DNA, 25 bp, Homo sapien
tgcccttgaagcatgtgatttctgt

SEQ ID NO: 606915 - DNA, 25 bp, Homo sapien
gcatgtgatttctgtgacccacacc

SEQ ID NO: 606916 - DNA, 25 bp, Homo sapien
attctgtgtgaaactctaaacttca

SEQ ID NO: 606917 - DNA, 25 bp, Homo sapien
gaaactctaaacttcactctaccaa

SEQ ID NO: 606918 - DNA, 25 bp, Homo sapien
actctaaacttcactctaccaataa

SEQ ID NO: 606919 - DNA, 25 bp, Homo sapien
ataaacttccccacattcacactag

SEQ ID NO: 606920 - DNA, 25 bp, Homo sapien
tgatgggaatgctgggtcttacata

SEQ ID NO: 606921 - DNA, 25 bp, Homo sapien
gggaatgctgggtcttacatatggt

SEQ ID NO: 606922 - DNA, 25 bp, Homo sapien
tgctgggtcttacatatggtggtct

SEQ ID NO: 606923 - DNA, 25 bp, Homo sapien
tgggtcttacatatggtggtcttca

SEQ ID NO: 606924 - DNA, 25 bp, Homo sapien
aattttaatgcttactgttttgtgt

SEQ ID NO: 606925 - DNA, 25 bp, Homo sapien
aatgcttactgttttgtgtagcttt

SEQ ID NO: 606926 - DNA, 25 bp, Homo sapien
gcagaaactgtctattaaaaagtca

SEQ ID NO: 606927 - DNA, 25 bp, Homo sapien
tttgacctttgtccccaaatgtctt

SEQ ID NO: 606928 - DNA, 25 bp, Homo sapien
aaatgtctttcatccagttactagg

SEQ ID NO: 606929 - DNA, 25 bp, Homo sapien
tccagttactaggacttgtagcctt

SEQ ID NO: 606930 - DNA, 25 bp, Homo sapien
aggacttgtagcctttttgcaaata

SEQ ID NO: 606931 - DNA, 25 bp, Homo sapien
gcctttttgcaaataggtatctgta

SEQ ID NO: 606932 - DNA, 25 bp, Homo sapien
ggtgatttgtgaagtgacccttagt

SEQ ID NO: 606933 - DNA, 25 bp, Homo sapien
gtgaagtgacccttagtggcatctg

SEQ ID NO: 606934 - DNA, 25 bp, Homo sapien
gtgacccttagtggcatctgtggtg

SEQ ID NO: 606935 - DNA, 25 bp, Homo sapien
atctgtggtggtcctactaatcaga

SEQ ID NO: 606936 - DNA, 25 bp, Homo sapien
tactaatcagatttgcagaagaaac

SEQ ID NO: 606937 - DNA, 25 bp, Homo sapien
ggaaactcctctcttatattaaaat

SEQ ID NO: 606938 - DNA, 25 bp, Homo sapien
agaaagtgtgtacagggccgggtgc

SEQ ID NO: 606939 - DNA, 25 bp, Homo sapien
gaaagtgtgtacagggccgggtgca

SEQ ID NO: 606940 - DNA, 25 bp, Homo sapien
gggagatcctacctctacaagaaaa

SEQ ID NO: 606941 - DNA, 25 bp, Homo sapien
ggagatcctacctctacaagaaaaa

SEQ ID NO: 606942 - DNA, 25 bp, Homo sapien
gagatcctacctctacaagaaaaaa

SEQ ID NO: 606943 - DNA, 25 bp, Homo sapien
aaaaaatgaactaggcaggtgaggt

SEQ ID NO: 606944 - DNA, 25 bp, Homo sapien
aaaaatgaactaggcaggtgaggtg

SEQ ID NO: 606945 - DNA, 25 bp, Homo sapien
gaactaggcaggtgaggtggtgttt

SEQ ID NO: 606946 - DNA, 25 bp, Homo sapien
actaggcaggtgaggtggtgtttgc

SEQ ID NO: 606947 - DNA, 25 bp, Homo sapien
gcttgagcccatgaagtcaggctgc

SEQ ID NO: 606948 - DNA, 25 bp, Homo sapien
gagcccatgaagtcaggctgcagtg

SEQ ID NO: 606949 - DNA, 25 bp, Homo sapien
ggccatgctggtggttgtagataca

SEQ ID NO: 606950 - DNA, 25 bp, Homo sapien
gttgtagatacaatggtgaccagat

SEQ ID NO: 606951 - DNA, 25 bp, Homo sapien
tggtgaccagatacagtccttcctt

SEQ ID NO: 606952 - DNA, 25 bp, Homo sapien
gggaacaaacctatacagtgtgaca

SEQ ID NO: 606953 - DNA, 25 bp, Homo sapien
tacagtgtgacaagagcttcaacag

SEQ ID NO: 606954 - DNA, 25 bp, Homo sapien
gggagaaacccaggaatctatggaa

SEQ ID NO: 606955 - DNA, 25 bp, Homo sapien
acccaggaatctatggaagcacata

SEQ ID NO: 606956 - DNA, 25 bp, Homo sapien
gactgatttaggctcaagggtgaaa

SEQ ID NO: 606957 - DNA, 25 bp, Homo sapien
aaagatcaacttgaggaaggcttcc

SEQ ID NO: 606958 - DNA, 25 bp, Homo sapien
ggaaggcttccacatttacatataa

SEQ ID NO: 606959 - DNA, 25 bp, Homo sapien
cacatttacatataactctactcat

SEQ ID NO: 606960 - DNA, 25 bp, Homo sapien
gctgcttacgggtgaacagacccca

SEQ ID NO: 606961 - DNA, 25 bp, Homo sapien
ttacgggtgaacagaccccaccagc

SEQ ID NO: 606962 - DNA, 25 bp, Homo sapien
gaagagcaggcctatgcttaagcat

SEQ ID NO: 606963 - DNA, 25 bp, Homo sapien
gagcaggcctatgcttaagcatgca

SEQ ID NO: 606964 - DNA, 25 bp, Homo sapien
atgcttaagcatgcaggagctctgg

SEQ ID NO: 606965 - DNA, 25 bp, Homo sapien
ggccggctgccctgagctgtggtgg

SEQ ID NO: 606966 - DNA, 25 bp, Homo sapien
gggttgagtcacagccatcccttca

SEQ ID NO: 606967 - DNA, 25 bp, Homo sapien
ttcaccctgctcatccaggtttgga

SEQ ID NO: 606968 - DNA, 25 bp, Homo sapien
gctcatccaggtttggagtgactta

SEQ ID NO: 606969 - DNA, 25 bp, Homo sapien
tccaggtttggagtgacttaataaa

SEQ ID NO: 606970 - DNA, 25 bp, Homo sapien
taaatgttttatctccttcttcagt

SEQ ID NO: 606971 - DNA, 25 bp, Homo sapien
aagttccacgtgtacctgcaggaat

SEQ ID NO: 606972 - DNA, 25 bp, Homo sapien
gtacctgcaggaatctgtgtggcat

SEQ ID NO: 606973 - DNA, 25 bp, Homo sapien
ctgtgtggcatttgtgcactggtgt

SEQ ID NO: 606974 - DNA, 25 bp, Homo sapien
aggaccacggagtgacaagccacca

SEQ ID NO: 606975 - DNA, 25 bp, Homo sapien
gacaagccaccaggttctaaaggga

SEQ ID NO: 606976 - DNA, 25 bp, Homo sapien
ggagacgaagatccccagaggacct

SEQ ID NO: 606977 - DNA, 25 bp, Homo sapien
ggacctggatagagatgtttccctg

SEQ ID NO: 606978 - DNA, 25 bp, Homo sapien
agatgtttccctgaccattgtctgc

SEQ ID NO: 606979 - DNA, 25 bp, Homo sapien
attgtctgctgtgtgctcccgatga

SEQ ID NO: 606980 - DNA, 25 bp, Homo sapien
ctcccgatgatgagactctagagtt

SEQ ID NO: 606981 - DNA, 25 bp, Homo sapien
atgcattcagtaaaactcgcgatga

SEQ ID NO: 606982 - DNA, 25 bp, Homo sapien
tagaaagtgtgtacagggccgggtg

SEQ ID NO: 606983 - DNA, 25 bp, Homo sapien
agaaagtgtgtacagggccgggtgc

SEQ ID NO: 606984 - DNA, 25 bp, Homo sapien
gaaagtgtgtacagggccgggtgca

SEQ ID NO: 606985 - DNA, 25 bp, Homo sapien
gggagatcctacctctacaagaaaa

SEQ ID NO: 606986 - DNA, 25 bp, Homo sapien
ggagatcctacctctacaagaaaaa

SEQ ID NO: 606987 - DNA, 25 bp, Homo sapien
aaaaaaatgaactaggcaggtgagg

SEQ ID NO: 606988 - DNA, 25 bp, Homo sapien
aaaaaatgaactaggcaggtgaggt

SEQ ID NO: 606989 - DNA, 25 bp, Homo sapien
aaaaatgaactaggcaggtgaggtg

SEQ ID NO: 606990 - DNA, 25 bp, Homo sapien
aaaatgaactaggcaggtgaggtgg

SEQ ID NO: 606991 - DNA, 25 bp, Homo sapien
gcttgagcccatgaagtcaggctgc

SEQ ID NO: 606992 - DNA, 25 bp, Homo sapien
gagcccatgaagtcaggctgcagtg

SEQ ID NO: 606993 - DNA, 25 bp, Homo sapien
agggtcagcatctccactagtggct

SEQ ID NO: 606994 - DNA, 25 bp, Homo sapien
ctgtgtgccccttatctcatggaaa

SEQ ID NO: 606995 - DNA, 25 bp, Homo sapien
catggaaagtgccaatttactgagc

SEQ ID NO: 606996 - DNA, 25 bp, Homo sapien
aacaggtaactgactgttcccacct

SEQ ID NO: 606997 - DNA, 25 bp, Homo sapien
cttttctcctgcagcatggagcaat

SEQ ID NO: 606998 - DNA, 25 bp, Homo sapien
catggagcaatcagtcatgtgacca

SEQ ID NO: 606999 - DNA, 25 bp, Homo sapien
gaagccttcaacatcatcttgggag

SEQ ID NO: 607000 - DNA, 25 bp, Homo sapien
acatcatcttgggagagaggcacag

SEQ ID NO: 607001 - DNA, 25 bp, Homo sapien
agaggcacagacctgtctcctgggt

SEQ ID NO: 607002 - DNA, 25 bp, Homo sapien
cctgggtgcatccttagccttggca

SEQ ID NO: 607003 - DNA, 25 bp, Homo sapien
gcaaaataaacttctccattgatcg

SEQ ID NO: 607004 - DNA, 25 bp, Homo sapien
atatcttttttatcctcaaacatga

SEQ ID NO: 607005 - DNA, 25 bp, Homo sapien
gatcaatttttgacagtgttccaaa

SEQ ID NO: 607006 - DNA, 25 bp, Homo sapien
gacagtgttccaaaaatatactatg

SEQ ID NO: 607007 - DNA, 25 bp, Homo sapien
tcctctatgtactacattgagcaaa

SEQ ID NO: 607008 - DNA, 25 bp, Homo sapien
ttgagcaaactccacagatttctgt

SEQ ID NO: 607009 - DNA, 25 bp, Homo sapien
gtaattcaatttcgttttccatgtg

SEQ ID NO: 607010 - DNA, 25 bp, Homo sapien
cgttttccatgtgtaggtccagatt

SEQ ID NO: 607011 - DNA, 25 bp, Homo sapien
gtgtaggtccagatttatttgaatg

SEQ ID NO: 607012 - DNA, 25 bp, Homo sapien
gaatgtccaaatacttagaattgta

SEQ ID NO: 607013 - DNA, 25 bp, Homo sapien
tgtaggctcttgttttgttattaaa

SEQ ID NO: 607014 - DNA, 25 bp, Homo sapien
aaagtctggttttattacattgtgt

SEQ ID NO: 607015 - DNA, 25 bp, Homo sapien
tcggcgtgcagctgcctggcgcaca

SEQ ID NO: 607016 - DNA, 25 bp, Homo sapien
ttcgacccctgcatgtaccgcgagt

SEQ ID NO: 607017 - DNA, 25 bp, Homo sapien
tgcatgtaccgcgagttgctgctag

SEQ ID NO: 607018 - DNA, 25 bp, Homo sapien
gtaccgcgagttgctgctagtgcac

SEQ ID NO: 607019 - DNA, 25 bp, Homo sapien
gcgagttgctgctagtgcaccgctt

SEQ ID NO: 607020 - DNA, 25 bp, Homo sapien
gttgctgctagtgcaccgcttcgcg

SEQ ID NO: 607021 - DNA, 25 bp, Homo sapien
gctgctcatgtggaaggcgctgcac

SEQ ID NO: 607022 - DNA, 25 bp, Homo sapien
tgtggaaggcgctgcacagccccgc

SEQ ID NO: 607023 - DNA, 25 bp, Homo sapien
atcgacgacgcctacatgggcatgt

SEQ ID NO: 607024 - DNA, 25 bp, Homo sapien
acgacgcctacatgggcatgtgtct

SEQ ID NO: 607025 - DNA, 25 bp, Homo sapien
gcatgtgtctggagcgcgccggcct

SEQ ID NO: 607026 - DNA, 25 bp, Homo sapien
ttaatttcctttcctaagcttatgt

SEQ ID NO: 607027 - DNA, 25 bp, Homo sapien
taagcttatgtaatagtttggccat

SEQ ID NO: 607028 - DNA, 25 bp, Homo sapien
tggccattaaatatcttgccctatt

SEQ ID NO: 607029 - DNA, 25 bp, Homo sapien
gccctattttccctattactgctag

SEQ ID NO: 607030 - DNA, 25 bp, Homo sapien
tattttccctattactgctagtatg

SEQ ID NO: 607031 - DNA, 25 bp, Homo sapien
ttactgctagtatgctacttcttac

SEQ ID NO: 607032 - DNA, 25 bp, Homo sapien
ggattaaagctttgtggttcatgca

SEQ ID NO: 607033 - DNA, 25 bp, Homo sapien
taaagctttgtggttcatgcaaaca

SEQ ID NO: 607034 - DNA, 25 bp, Homo sapien
aatgtgcagatgatagcacctccat

SEQ ID NO: 607035 - DNA, 25 bp, Homo sapien
gatgatagcacctccatattactaa

SEQ ID NO: 607036 - DNA, 25 bp, Homo sapien
gatagcacctccatattactaataa

SEQ ID NO: 607037 - DNA, 25 bp, Homo sapien
ggccaggccatgaccctgaaagcct

SEQ ID NO: 607038 - DNA, 25 bp, Homo sapien
gccaggccatgaccctgaaagccta

SEQ ID NO: 607039 - DNA, 25 bp, Homo sapien
aggccatgaccctgaaagcctagcc

SEQ ID NO: 607040 - DNA, 25 bp, Homo sapien
ctgctgctggcctctgggtcgtgcc

SEQ ID NO: 607041 - DNA, 25 bp, Homo sapien
gtcgtgccccgcagactgagctgcg

SEQ ID NO: 607042 - DNA, 25 bp, Homo sapien
gtgccccgcagactgagctgcgctt

SEQ ID NO: 607043 - DNA, 25 bp, Homo sapien
ccccgcagactgagctgcgcttggg

SEQ ID NO: 607044 - DNA, 25 bp, Homo sapien
tgggccgtcccgcaccgaacccagg

SEQ ID NO: 607045 - DNA, 25 bp, Homo sapien
gaacccaggcggtcggagcccggcg

SEQ ID NO: 607046 - DNA, 25 bp, Homo sapien
gcggggaggcgcgaggtccttctgg

SEQ ID NO: 607047 - DNA, 25 bp, Homo sapien
ttctgggggctcctccgacgcctga

SEQ ID NO: 607048 - DNA, 25 bp, Homo sapien
atgctgcagcgaggcagtccaatgt

SEQ ID NO: 607049 - DNA, 25 bp, Homo sapien
taaccgactatggagctaacctgaa

SEQ ID NO: 607050 - DNA, 25 bp, Homo sapien
aaaagtgcgcttgatctggcggctc

SEQ ID NO: 607051 - DNA, 25 bp, Homo sapien
atctggcggctccaaaaagcagcgt

SEQ ID NO: 607052 - DNA, 25 bp, Homo sapien
aaaagcagcgtggagcaggcactct

SEQ ID NO: 607053 - DNA, 25 bp, Homo sapien
agcaggcactcttgctccgtgaagg

SEQ ID NO: 607054 - DNA, 25 bp, Homo sapien
tgtccggaagtgtctcggtcgagca

SEQ ID NO: 607055 - DNA, 25 bp, Homo sapien
tcggtcgagcatgtcatcaagccat

SEQ ID NO: 607056 - DNA, 25 bp, Homo sapien
catccacaagctacatctgccagag

SEQ ID NO: 607057 - DNA, 25 bp, Homo sapien
atctgccagagccactcgaacgatt

SEQ ID NO: 607058 - DNA, 25 bp, Homo sapien
cgaacgattcctcctataccaatag

SEQ ID NO: 607059 - DNA, 25 bp, Homo sapien
aaaggaactgagtcaggcaagagct

SEQ ID NO: 607060 - DNA, 25 bp, Homo sapien
caggaggaagccacaagctcagagg

SEQ ID NO: 607061 - DNA, 25 bp, Homo sapien
aggaaagggtgagctggtctcccca

SEQ ID NO: 607062 - DNA, 25 bp, Homo sapien
ctccccagggagcagttgagtgcct

SEQ ID NO: 607063 - DNA, 25 bp, Homo sapien
cagggagcagttgagtgcctgaccc

SEQ ID NO: 607064 - DNA, 25 bp, Homo sapien
tgaccctactctctgtcctaaaaca

SEQ ID NO: 607065 - DNA, 25 bp, Homo sapien
ctctgtcctaaaacacacgcgtgta

SEQ ID NO: 607066 - DNA, 25 bp, Homo sapien
tgtgacttgtggtaccccaccgcca

SEQ ID NO: 607067 - DNA, 25 bp, Homo sapien
agtaaagccggccagtcacacatct

SEQ ID NO: 607068 - DNA, 25 bp, Homo sapien
ggccagtcacacatctgaaagagtc

SEQ ID NO: 607069 - DNA, 25 bp, Homo sapien
acatctgaaagagtccagactgacc

SEQ ID NO: 607070 - DNA, 25 bp, Homo sapien
gataaaatctggcaacttgagccag

SEQ ID NO: 607071 - DNA, 25 bp, Homo sapien
ataaaatctggcaacttgagccagg

SEQ ID NO: 607072 - DNA, 25 bp, Homo sapien
taaaatctggcaacttgagccaggt

SEQ ID NO: 607073 - DNA, 25 bp, Homo sapien
aaaatctggcaacttgagccaggtg

SEQ ID NO: 607074 - DNA, 25 bp, Homo sapien
aaatctggcaacttgagccaggtgc

SEQ ID NO: 607075 - DNA, 25 bp, Homo sapien
aatctggcaacttgagccaggtgcg

SEQ ID NO: 607076 - DNA, 25 bp, Homo sapien
atctggcaacttgagccaggtgcgg

SEQ ID NO: 607077 - DNA, 25 bp, Homo sapien
tctggcaacttgagccaggtgcggt

SEQ ID NO: 607078 - DNA, 25 bp, Homo sapien
ctggcaacttgagccaggtgcggtg

SEQ ID NO: 607079 - DNA, 25 bp, Homo sapien
tggcaacttgagccaggtgcggtgg

SEQ ID NO: 607080 - DNA, 25 bp, Homo sapien
tagcagggcgtcatggtgcatgcct

SEQ ID NO: 607081 - DNA, 25 bp, Homo sapien
gtaaatgcagtacaacagagtaaat

SEQ ID NO: 607082 - DNA, 25 bp, Homo sapien
tttactgagtatattctgtatgcca

SEQ ID NO: 607083 - DNA, 25 bp, Homo sapien
tctgtatgccagaaacacattaggt

SEQ ID NO: 607084 - DNA, 25 bp, Homo sapien
gaaacacattaggtatgctggatat

SEQ ID NO: 607085 - DNA, 25 bp, Homo sapien
tatgctggatatgtaatagtgaacc

SEQ ID NO: 607086 - DNA, 25 bp, Homo sapien
gaaccagacagacatgacctgtgtc

SEQ ID NO: 607087 - DNA, 25 bp, Homo sapien
cagacagacatgacctgtgtcttca

SEQ ID NO: 607088 - DNA, 25 bp, Homo sapien
tgtgtcttcaaggagcttataaata

SEQ ID NO: 607089 - DNA, 25 bp, Homo sapien
taagcgagcaaaaatatcagatact

SEQ ID NO: 607090 - DNA, 25 bp, Homo sapien
ccagtaagtggcaggtaggaaatca

SEQ ID NO: 607091 - DNA, 25 bp, Homo sapien
gtaggaaatcaccagggagtaatac

SEQ ID NO: 607092 - DNA, 25 bp, Homo sapien
gctgaggcagggggaccacttgagg

SEQ ID NO: 607093 - DNA, 25 bp, Homo sapien
accccgtctcactagaaatgcaaaa

SEQ ID NO: 607094 - DNA, 25 bp, Homo sapien
ccccgtctcactagaaatgcaaaaa

SEQ ID NO: 607095 - DNA, 25 bp, Homo sapien
cgtctcactagaaatgcaaaaaatt

SEQ ID NO: 607096 - DNA, 25 bp, Homo sapien
gtctcactagaaatgcaaaaaatta

SEQ ID NO: 607097 - DNA, 25 bp, Homo sapien
tctcactagaaatgcaaaaaattag

SEQ ID NO: 607098 - DNA, 25 bp, Homo sapien
tgggtgaaagggcaagactgtgtct

SEQ ID NO: 607099 - DNA, 25 bp, Homo sapien
gggtgaaagggcaagactgtgtctc

SEQ ID NO: 607100 - DNA, 25 bp, Homo sapien
ggtgaaagggcaagactgtgtctca

SEQ ID NO: 607101 - DNA, 25 bp, Homo sapien
gtgaaagggcaagactgtgtctcaa

SEQ ID NO: 607102 - DNA, 25 bp, Homo sapien
tgaaagggcaagactgtgtctcaaa

SEQ ID NO: 607103 - DNA, 25 bp, Homo sapien
tgaaatcaaggcatagtctttccag

SEQ ID NO: 607104 - DNA, 25 bp, Homo sapien
gtctaatttttactgtaatgcttgt

SEQ ID NO: 607105 - DNA, 25 bp, Homo sapien
gtaatgcttgtatgtcaacagttat

SEQ ID NO: 607106 - DNA, 25 bp, Homo sapien
aatgcttgtatgtcaacagttatga

SEQ ID NO: 607107 - DNA, 25 bp, Homo sapien
tgcttgtatgtcaacagttatgaag

SEQ ID NO: 607108 - DNA, 25 bp, Homo sapien
gtatgtcaacagttatgaaggccag

SEQ ID NO: 607109 - DNA, 25 bp, Homo sapien
atgtcaacagttatgaaggccaggc

SEQ ID NO: 607110 - DNA, 25 bp, Homo sapien
gtcaacagttatgaaggccaggcgc

SEQ ID NO: 607111 - DNA, 25 bp, Homo sapien
tcaacagttatgaaggccaggcgcg

SEQ ID NO: 607112 - DNA, 25 bp, Homo sapien
caacagttatgaaggccaggcgcgg

SEQ ID NO: 607113 - DNA, 25 bp, Homo sapien
aacagttatgaaggccaggcgcggc

SEQ ID NO: 607114 - DNA, 25 bp, Homo sapien
gatcacatggaaagagattcccaag

SEQ ID NO: 607115 - DNA, 25 bp, Homo sapien
gggatcatctgcaactacaccatct

SEQ ID NO: 607116 - DNA, 25 bp, Homo sapien
tcatctgcaactacaccatctttta

SEQ ID NO: 607117 - DNA, 25 bp, Homo sapien
tgcaactacaccatcttttaccaag

SEQ ID NO: 607118 - DNA, 25 bp, Homo sapien
aactacaccatcttttaccaagctg

SEQ ID NO: 607119 - DNA, 25 bp, Homo sapien
tacaccatcttttaccaagctgaag

SEQ ID NO: 607120 - DNA, 25 bp, Homo sapien
gacagtcaattccagcatcttgcag

SEQ ID NO: 607121 - DNA, 25 bp, Homo sapien
tcaattccagcatcttgcagtacgg

SEQ ID NO: 607122 - DNA, 25 bp, Homo sapien
ggagtccctgaaacgaaagacctct

SEQ ID NO: 607123 - DNA, 25 bp, Homo sapien
gaaagacctcttacattgttcaggt

SEQ ID NO: 607124 - DNA, 25 bp, Homo sapien
ttacattgttcaggtcatggccagc

SEQ ID NO: 607125 - DNA, 25 bp, Homo sapien
accttgatgagcgttgtgcgataat

SEQ ID NO: 607126 - DNA, 25 bp, Homo sapien
gagcgttgtgcgataataaatttcc

SEQ ID NO: 607127 - DNA, 25 bp, Homo sapien
gggctggaatgacattcactgtcat

SEQ ID NO: 607128 - DNA, 25 bp, Homo sapien
gacattcactgtcatgtacctcaga

SEQ ID NO: 607129 - DNA, 25 bp, Homo sapien
tgtcatgtacctcagaagtcaattt

SEQ ID NO: 607130 - DNA, 25 bp, Homo sapien
gtacctcagaagtcaatttgcaaga

SEQ ID NO: 607131 - DNA, 25 bp, Homo sapien
aatgtgtttgggttggcatccaccg

SEQ ID NO: 607132 - DNA, 25 bp, Homo sapien
gggttggcatccaccgttgtagaaa

SEQ ID NO: 607133 - DNA, 25 bp, Homo sapien
gcatccaccgttgtagaaagctaaa

SEQ ID NO: 607134 - DNA, 25 bp, Homo sapien
caaggaatgcccctaaaatgtttca

SEQ ID NO: 607135 - DNA, 25 bp, Homo sapien
gctgtcacctattacacttatgata

SEQ ID NO: 607136 - DNA, 25 bp, Homo sapien
cagtgcggtaaattagtatggtcaa

SEQ ID NO: 607137 - DNA, 25 bp, Homo sapien
gtatggtcaaccattagtccaccct

SEQ ID NO: 607138 - DNA, 25 bp, Homo sapien
atggtcaaccattagtccacccttt

SEQ ID NO: 607139 - DNA, 25 bp, Homo sapien
caaccattagtccaccctttctgaa

SEQ ID NO: 607140 - DNA, 25 bp, Homo sapien
tttctgaagctgctcttctttagaa

SEQ ID NO: 607141 - DNA, 25 bp, Homo sapien
tctgaagctgctcttctttagaaaa

SEQ ID NO: 607142 - DNA, 25 bp, Homo sapien
caggcatggtgctacacccctgtaa

SEQ ID NO: 607143 - DNA, 25 bp, Homo sapien
aatcacttgaactccagaggagaag

SEQ ID NO: 607144 - DNA, 25 bp, Homo sapien
gttgcagtgactcgagatcccgcta

SEQ ID NO: 607145 - DNA, 25 bp, Homo sapien
tgcagtgactcgagatcccgctact

SEQ ID NO: 607146 - DNA, 25 bp, Homo sapien
agtgactcgagatcccgctactgca

SEQ ID NO: 607147 - DNA, 25 bp, Homo sapien
gatgcatcacatctaaattatgaat

SEQ ID NO: 607148 - DNA, 25 bp, Homo sapien
atgcatcacatctaaattatgaatg

SEQ ID NO: 607149 - DNA, 25 bp, Homo sapien
tcacatctaaattatgaatgttgcc

SEQ ID NO: 607150 - DNA, 25 bp, Homo sapien
cacatctaaattatgaatgttgcca

SEQ ID NO: 607151 - DNA, 25 bp, Homo sapien
acatctaaattatgaatgttgccag

SEQ ID NO: 607152 - DNA, 25 bp, Homo sapien
catctaaattatgaatgttgccagg

SEQ ID NO: 607153 - DNA, 25 bp, Homo sapien
atctaaattatgaatgttgccaggt

SEQ ID NO: 607154 - DNA, 25 bp, Homo sapien
tctaaattatgaatgttgccaggtg

SEQ ID NO: 607155 - DNA, 25 bp, Homo sapien
ctaaattatgaatgttgccaggtgg

SEQ ID NO: 607156 - DNA, 25 bp, Homo sapien
taaattatgaatgttgccaggtggg

SEQ ID NO: 607157 - DNA, 25 bp, Homo sapien
aattatgaatgttgccaggtggggt

SEQ ID NO: 607158 - DNA, 25 bp, Homo sapien
ggataaaatctggcaacttgagcca

SEQ ID NO: 607159 - DNA, 25 bp, Homo sapien
gataaaatctggcaacttgagccag

SEQ ID NO: 607160 - DNA, 25 bp, Homo sapien
ataaaatctggcaacttgagccagg

SEQ ID NO: 607161 - DNA, 25 bp, Homo sapien
taaaatctggcaacttgagccaggt

SEQ ID NO: 607162 - DNA, 25 bp, Homo sapien
aaaatctggcaacttgagccaggtg

SEQ ID NO: 607163 - DNA, 25 bp, Homo sapien
aaatctggcaacttgagccaggtgc

SEQ ID NO: 607164 - DNA, 25 bp, Homo sapien
aatctggcaacttgagccaggtgcg

SEQ ID NO: 607165 - DNA, 25 bp, Homo sapien
atctggcaacttgagccaggtgcgg

SEQ ID NO: 607166 - DNA, 25 bp, Homo sapien
tctggcaacttgagccaggtgcggt

SEQ ID NO: 607167 - DNA, 25 bp, Homo sapien
ctggcaacttgagccaggtgcggtg

SEQ ID NO: 607168 - DNA, 25 bp, Homo sapien
ggaaatgcaaagtccgagacctctc

SEQ ID NO: 607169 - DNA, 25 bp, Homo sapien
atgcaaagtccgagacctctccgga

SEQ ID NO: 607170 - DNA, 25 bp, Homo sapien
aagtccgagacctctccggactctg

SEQ ID NO: 607171 - DNA, 25 bp, Homo sapien
atgtccactggaaatgcaaagtccg

SEQ ID NO: 607172 - DNA, 25 bp, Homo sapien
atgcaaagtccgagacttctccgga

SEQ ID NO: 607173 - DNA, 25 bp, Homo sapien
gtccgagacttctccggactctgca

SEQ ID NO: 607174 - DNA, 25 bp, Homo sapien
ggctccgtcggcaccggaaatgcaa

SEQ ID NO: 607175 - DNA, 25 bp, Homo sapien
cgtcggcaccggaaatgcaaagtct

SEQ ID NO: 607176 - DNA, 25 bp, Homo sapien
gaaatgcaaagtctgagcctctccg

SEQ ID NO: 607177 - DNA, 25 bp, Homo sapien
tgcaaagtctgagcctctccgggct

SEQ ID NO: 607178 - DNA, 25 bp, Homo sapien
ggccctgcaccatgtccactggaaa

SEQ ID NO: 607179 - DNA, 25 bp, Homo sapien
attaggccaggcgcggtggtgcaca

SEQ ID NO: 607180 - DNA, 25 bp, Homo sapien
ttaggccaggcgcggtggtgcacac

SEQ ID NO: 607181 - DNA, 25 bp, Homo sapien
taggccaggcgcggtggtgcacacc

SEQ ID NO: 607182 - DNA, 25 bp, Homo sapien
actcggaggctgaggcaccagaatc

SEQ ID NO: 607183 - DNA, 25 bp, Homo sapien
ctcggaggctgaggcaccagaatcg

SEQ ID NO: 607184 - DNA, 25 bp, Homo sapien
gaggcaccagaatcgcttgaacttg

SEQ ID NO: 607185 - DNA, 25 bp, Homo sapien
aggcaccagaatcgcttgaacttgg

SEQ ID NO: 607186 - DNA, 25 bp, Homo sapien
ggcaccagaatcgcttgaacttggg

SEQ ID NO: 607187 - DNA, 25 bp, Homo sapien
gcaccagaatcgcttgaacttggga

SEQ ID NO: 607188 - DNA, 25 bp, Homo sapien
caccagaatcgcttgaacttgggag

SEQ ID NO: 607189 - DNA, 25 bp, Homo sapien
accagaatcgcttgaacttgggagg

SEQ ID NO: 607190 - DNA, 25 bp, Homo sapien
catgtaacaggtttattgagatata

SEQ ID NO: 607191 - DNA, 25 bp, Homo sapien
tacaatacaatatactcatttagtg

SEQ ID NO: 607192 - DNA, 25 bp, Homo sapien
atactcatttagtgtatgatgcagt

SEQ ID NO: 607193 - DNA, 25 bp, Homo sapien
tagtgtatgatgcagtagttcttaa

SEQ ID NO: 607194 - DNA, 25 bp, Homo sapien
gatgcagtagttcttaatatattca

SEQ ID NO: 607195 - DNA, 25 bp, Homo sapien
gcagtagttcttaatatattcatag

SEQ ID NO: 607196 - DNA, 25 bp, Homo sapien
tgaacatttttatcaagccaaaaag

SEQ ID NO: 607197 - DNA, 25 bp, Homo sapien
aaaagaaattccatactcgcctgta

SEQ ID NO: 607198 - DNA, 25 bp, Homo sapien
aagaaattccatactcgcctgtagt

SEQ ID NO: 607199 - DNA, 25 bp, Homo sapien
agaaattccatactcgcctgtagtc

SEQ ID NO: 607200 - DNA, 25 bp, Homo sapien
gaaattccatactcgcctgtagtcc

SEQ ID NO: 607201 - DNA, 25 bp, Homo sapien
gtaaaatcaagaagcaagattccat

SEQ ID NO: 607202 - DNA, 25 bp, Homo sapien
aagattccataagctgagaactctg

SEQ ID NO: 607203 - DNA, 25 bp, Homo sapien
ctggacagctgatcaggtttaccta

SEQ ID NO: 607204 - DNA, 25 bp, Homo sapien
aggtttacctatggtgctttgcctt

SEQ ID NO: 607205 - DNA, 25 bp, Homo sapien
tttgcctttaactagagtgtgtgac

SEQ ID NO: 607206 - DNA, 25 bp, Homo sapien
cccttaacaccttttggagatggcg

SEQ ID NO: 607207 - DNA, 25 bp, Homo sapien
ccttaacaccttttggagatggcgt

SEQ ID NO: 607208 - DNA, 25 bp, Homo sapien
cttaacaccttttggagatggcgtt

SEQ ID NO: 607209 - DNA, 25 bp, Homo sapien
taacaccttttggagatggcgtttc

SEQ ID NO: 607210 - DNA, 25 bp, Homo sapien
ggagatggcgtttctgttttcagaa

SEQ ID NO: 607211 - DNA, 25 bp, Homo sapien
gatggcgtttctgttttcagaaatt

SEQ ID NO: 607212 - DNA, 25 bp, Homo sapien
gatcctagctgcaaactaagagacc

SEQ ID NO: 607213 - DNA, 25 bp, Homo sapien
tcctagctgcaaactaagagacctc

SEQ ID NO: 607214 - DNA, 25 bp, Homo sapien
ctagctgcaaactaagagacctcat

SEQ ID NO: 607215 - DNA, 25 bp, Homo sapien
tagctgcaaactaagagacctcatt

SEQ ID NO: 607216 - DNA, 25 bp, Homo sapien
agctgcaaactaagagacctcatta

SEQ ID NO: 607217 - DNA, 25 bp, Homo sapien
gctgcaaactaagagacctcattaa

SEQ ID NO: 607218 - DNA, 25 bp, Homo sapien
aagagacctcattaaaacctaacat

SEQ ID NO: 607219 - DNA, 25 bp, Homo sapien
gagacctcattaaaacctaacatgt

SEQ ID NO: 607220 - DNA, 25 bp, Homo sapien
gacctcattaaaacctaacatgtgg

SEQ ID NO: 607221 - DNA, 25 bp, Homo sapien
ctcattaaaacctaacatgtggctg

SEQ ID NO: 607222 - DNA, 25 bp, Homo sapien
cattaaaacctaacatgtggctggg

SEQ ID NO: 607223 - DNA, 25 bp, Homo sapien
cggagactggcctgttgagacagat

SEQ ID NO: 607224 - DNA, 25 bp, Homo sapien
gacagatgtgagatccagggaacat

SEQ ID NO: 607225 - DNA, 25 bp, Homo sapien
aagtgatggttccagaccgacacgc

SEQ ID NO: 607226 - DNA, 25 bp, Homo sapien
acgctccgtggagccacaggaggtt

SEQ ID NO: 607227 - DNA, 25 bp, Homo sapien
acaggaggttgcgtgggcaccacat

SEQ ID NO: 607228 - DNA, 25 bp, Homo sapien
ttgcgtgggcaccacattttggaca

SEQ ID NO: 607229 - DNA, 25 bp, Homo sapien
cacattttggacagtgggcactgag

SEQ ID NO: 607230 - DNA, 25 bp, Homo sapien
actgagaatccacaaccatcctgac

SEQ ID NO: 607231 - DNA, 25 bp, Homo sapien
atccacaaccatcctgaccagtgtg

SEQ ID NO: 607232 - DNA, 25 bp, Homo sapien
ggaattccggtctgtgaataaacct

SEQ ID NO: 607233 - DNA, 25 bp, Homo sapien
gaataaacctgcaatcgaatccgta

SEQ ID NO: 607234 - DNA, 25 bp, Homo sapien
aggccatgccatttgggtgaggatt

SEQ ID NO: 607235 - DNA, 25 bp, Homo sapien
gggtgaggatttgattccactgttt

SEQ ID NO: 607236 - DNA, 25 bp, Homo sapien
gaggatttgattccactgtttattt

SEQ ID NO: 607237 - DNA, 25 bp, Homo sapien
tattttctcattgtatcaagttgaa

SEQ ID NO: 607238 - DNA, 25 bp, Homo sapien
caagttgaatttctgcaggtgttgc

SEQ ID NO: 607239 - DNA, 25 bp, Homo sapien
tgcaggtgttgcaagtatgttcaac

SEQ ID NO: 607240 - DNA, 25 bp, Homo sapien
gcaagtatgttcaacgatttaaatt

SEQ ID NO: 607241 - DNA, 25 bp, Homo sapien
ctgttctagggcatcgtttcaatcg

SEQ ID NO: 607242 - DNA, 25 bp, Homo sapien
agggcatcgtttcaatcgcatcgta

SEQ ID NO: 607243 - DNA, 25 bp, Homo sapien
gtttcaatcgcatcgtatctctact

SEQ ID NO: 607244 - DNA, 25 bp, Homo sapien
atcgcatcgtatctctacttgggca

SEQ ID NO: 607245 - DNA, 25 bp, Homo sapien
gcatgtcttaattgaataactgtct

SEQ ID NO: 607246 - DNA, 25 bp, Homo sapien
aggtagcttgactctctgttcgagg

SEQ ID NO: 607247 - DNA, 25 bp, Homo sapien
ggtagcttgactctctgttcgaggc

SEQ ID NO: 607248 - DNA, 25 bp, Homo sapien
gtagcttgactctctgttcgaggct

SEQ ID NO: 607249 - DNA, 25 bp, Homo sapien
tagcttgactctctgttcgaggctc

SEQ ID NO: 607250 - DNA, 25 bp, Homo sapien
agcttgactctctgttcgaggctca

SEQ ID NO: 607251 - DNA, 25 bp, Homo sapien
ctctgttcgaggctcagtccttttg

SEQ ID NO: 607252 - DNA, 25 bp, Homo sapien
tctgttcgaggctcagtccttttga

SEQ ID NO: 607253 - DNA, 25 bp, Homo sapien
ctgttcgaggctcagtccttttgat

SEQ ID NO: 607254 - DNA, 25 bp, Homo sapien
ttcgaggctcagtccttttgatgtt

SEQ ID NO: 607255 - DNA, 25 bp, Homo sapien
tcgaggctcagtccttttgatgtta

SEQ ID NO: 607256 - DNA, 25 bp, Homo sapien
gtgtggtggtgcacatctataatcc

SEQ ID NO: 607257 - DNA, 25 bp, Homo sapien
tgtggtggtgcacatctataatccc

SEQ ID NO: 607258 - DNA, 25 bp, Homo sapien
tataatcccagttacccgggagcct

SEQ ID NO: 607259 - DNA, 25 bp, Homo sapien
ataatcccagttacccgggagcctg

SEQ ID NO: 607260 - DNA, 25 bp, Homo sapien
taatcccagttacccgggagcctga

SEQ ID NO: 607261 - DNA, 25 bp, Homo sapien
aatcccagttacccgggagcctgag

SEQ ID NO: 607262 - DNA, 25 bp, Homo sapien
atcccagttacccgggagcctgagg

SEQ ID NO: 607263 - DNA, 25 bp, Homo sapien
ccagttacccgggagcctgaggcag

SEQ ID NO: 607264 - DNA, 25 bp, Homo sapien
gctgggcagcaagagcaagactcta

SEQ ID NO: 607265 - DNA, 25 bp, Homo sapien
ctgggcagcaagagcaagactctat

SEQ ID NO: 607266 - DNA, 25 bp, Homo sapien
ggcagcaagagcaagactctatctc

SEQ ID NO: 607267 - DNA, 25 bp, Homo sapien
ggcctctagaagctgtgcctcttga

SEQ ID NO: 607268 - DNA, 25 bp, Homo sapien
agaagctgtgcctcttgatgaagaa

SEQ ID NO: 607269 - DNA, 25 bp, Homo sapien
aagaaggaatccctcgaggacagga

SEQ ID NO: 607270 - DNA, 25 bp, Homo sapien
gctgggatgacacttgtagctcttt

SEQ ID NO: 607271 - DNA, 25 bp, Homo sapien
gacacttgtagctctttgtgctaaa

SEQ ID NO: 607272 - DNA, 25 bp, Homo sapien
tgctaaaatgactcaggcagctcct

SEQ ID NO: 607273 - DNA, 25 bp, Homo sapien
tcaggcagctcctgcattcattttg

SEQ ID NO: 607274 - DNA, 25 bp, Homo sapien
cattttgggtgctgaagttttagaa

SEQ ID NO: 607275 - DNA, 25 bp, Homo sapien
tgggtctttcttagacttctcccag

SEQ ID NO: 607276 - DNA, 25 bp, Homo sapien
ctcccagcaaagcagagtccgtatc

SEQ ID NO: 607277 - DNA, 25 bp, Homo sapien
aagcagagtccgtatcctagtgtgt

SEQ ID NO: 607278 - DNA, 25 bp, Homo sapien
gacatggaagctctgcatatgtcag

SEQ ID NO: 607279 - DNA, 25 bp, Homo sapien
acatggaagctctgcatatgtcagc

SEQ ID NO: 607280 - DNA, 25 bp, Homo sapien
catggaagctctgcatatgtcagcc

SEQ ID NO: 607281 - DNA, 25 bp, Homo sapien
atggaagctctgcatatgtcagcca

SEQ ID NO: 607282 - DNA, 25 bp, Homo sapien
tggaagctctgcatatgtcagccaa

SEQ ID NO: 607283 - DNA, 25 bp, Homo sapien
ggaagctctgcatatgtcagccaat

SEQ ID NO: 607284 - DNA, 25 bp, Homo sapien
gaagctctgcatatgtcagccaatt

SEQ ID NO: 607285 - DNA, 25 bp, Homo sapien
aagctctgcatatgtcagccaattc

SEQ ID NO: 607286 - DNA, 25 bp, Homo sapien
agatctcattgcctttttatgccga

SEQ ID NO: 607287 - DNA, 25 bp, Homo sapien
ttgcctttttatgccgattaacatg

SEQ ID NO: 607288 - DNA, 25 bp, Homo sapien
tagcccctactgagcttatagttaa

SEQ ID NO: 607289 - DNA, 25 bp, Homo sapien
ctttcttcacctgaactgtgtctaa

SEQ ID NO: 607290 - DNA, 25 bp, Homo sapien
tccaccttctgtatttatacgcttg

SEQ ID NO: 607291 - DNA, 25 bp, Homo sapien
aaaacctaaatgttgggcttcacat

SEQ ID NO: 607292 - DNA, 25 bp, Homo sapien
ttccttgtaaatttcatcttggtga

SEQ ID NO: 607293 - DNA, 25 bp, Homo sapien
atcttggtgattgcagtctaccctc

SEQ ID NO: 607294 - DNA, 25 bp, Homo sapien
tggtgattgcagtctaccctctggc

SEQ ID NO: 607295 - DNA, 25 bp, Homo sapien
ttgtctgagccttgattcgatcatg

SEQ ID NO: 607296 - DNA, 25 bp, Homo sapien
ttcgatcatgaaaccagcttaccct

SEQ ID NO: 607297 - DNA, 25 bp, Homo sapien
gtttgagtgagaacttttgcttctg

SEQ ID NO: 607298 - DNA, 25 bp, Homo sapien
ggagtgaggttataaccacgcggaa

SEQ ID NO: 607299 - DNA, 25 bp, Homo sapien
ccacgcggaaggtcagggtcatcat

SEQ ID NO: 607300 - DNA, 25 bp, Homo sapien
aacttcccagcaatgagaagcggct

SEQ ID NO: 607301 - DNA, 25 bp, Homo sapien
agaagcggctctggtgccctggttc

SEQ ID NO: 607302 - DNA, 25 bp, Homo sapien
ggtgccctggttccaacaaggtcaa

SEQ ID NO: 607303 - DNA, 25 bp, Homo sapien
gttccaacaaggtcaagcgcactct

SEQ ID NO: 607304 - DNA, 25 bp, Homo sapien
aaggtcaagcgcactcttggctctc

SEQ ID NO: 607305 - DNA, 25 bp, Homo sapien
tcaagcgcactcttggctctcacga

SEQ ID NO: 607306 - DNA, 25 bp, Homo sapien
tctcacgacctgctgcttcctagtt

SEQ ID NO: 607307 - DNA, 25 bp, Homo sapien
tctctgtcactatccagccatgcag

SEQ ID NO: 607308 - DNA, 25 bp, Homo sapien
tggggggctgtctcgtgcatctccc

SEQ ID NO: 607309 - DNA, 25 bp, Homo sapien
agcctcccagtgaccattgtcacat

SEQ ID NO: 607310 - DNA, 25 bp, Homo sapien
gtgaccattgtcacatgagctggtg

SEQ ID NO: 607311 - DNA, 25 bp, Homo sapien
cattgtcacatgagctggtgggact

SEQ ID NO: 607312 - DNA, 25 bp, Homo sapien
tggtgggactgtgtcaccaggtact

SEQ ID NO: 607313 - DNA, 25 bp, Homo sapien
gactgtgtcaccaggtactgggtga

SEQ ID NO: 607314 - DNA, 25 bp, Homo sapien
accaggtactgggtgactgaaggat

SEQ ID NO: 607315 - DNA, 25 bp, Homo sapien
gactgaaggatgtggcatctaaata

SEQ ID NO: 607316 - DNA, 25 bp, Homo sapien
gatgtggcatctaaatattagcttc

SEQ ID NO: 607317 - DNA, 25 bp, Homo sapien
atattagcttctaggctggaacggt

SEQ ID NO: 607318 - DNA, 25 bp, Homo sapien
tagcttctaggctggaacggtggct

SEQ ID NO: 607319 - DNA, 25 bp, Homo sapien
tttgcttctttgtgatacatttgac

SEQ ID NO: 607320 - DNA, 25 bp, Homo sapien
aaatgccaaacctggattctcaaga

SEQ ID NO: 607321 - DNA, 25 bp, Homo sapien
gattctcaagatgaatgctctttca

SEQ ID NO: 607322 - DNA, 25 bp, Homo sapien
attcatctcagtaaaacaaagccta

SEQ ID NO: 607323 - DNA, 25 bp, Homo sapien
actcagatgtgggtgtatatttaac

SEQ ID NO: 607324 - DNA, 25 bp, Homo sapien
gtgtgattaggttcacttccatatt

SEQ ID NO: 607325 - DNA, 25 bp, Homo sapien
acttccatattttctgtgtaccacc

SEQ ID NO: 607326 - DNA, 25 bp, Homo sapien
tgtgtaccaccctgtattgttcata

SEQ ID NO: 607327 - DNA, 25 bp, Homo sapien
accaccctgtattgttcatagaact

SEQ ID NO: 607328 - DNA, 25 bp, Homo sapien
gtaactctctccattggataagtcc

SEQ ID NO: 607329 - DNA, 25 bp, Homo sapien
agtccatgatagtcctttgcttctt

SEQ ID NO: 607330 - DNA, 25 bp, Homo sapien
tatatacacatcttattgaaccatc

SEQ ID NO: 607331 - DNA, 25 bp, Homo sapien
tatacacatcttattgaaccatcca

SEQ ID NO: 607332 - DNA, 25 bp, Homo sapien
acacatcttattgaaccatccaaaa

SEQ ID NO: 607333 - DNA, 25 bp, Homo sapien
gaaccatccaaaaatcattgctttt

SEQ ID NO: 607334 - DNA, 25 bp, Homo sapien
taactgtttgcagcacaatataact

SEQ ID NO: 607335 - DNA, 25 bp, Homo sapien
aatataactttacattctttgccaa

SEQ ID NO: 607336 - DNA, 25 bp, Homo sapien
ataactttacattctttgccaatat

SEQ ID NO: 607337 - DNA, 25 bp, Homo sapien
aactttacattctttgccaatattc

SEQ ID NO: 607338 - DNA, 25 bp, Homo sapien
tccataggaaaaattttgacaatgt

SEQ ID NO: 607339 - DNA, 25 bp, Homo sapien
tggtttgttactttgacttataaat

SEQ ID NO: 607340 - DNA, 25 bp, Homo sapien
tttttggtttgatcgtatctaaatc

SEQ ID NO: 607341 - DNA, 25 bp, Homo sapien
cactcatgggtctatggagagaatt

SEQ ID NO: 607342 - DNA, 25 bp, Homo sapien
gggagcttggatggaataaatttgc

SEQ ID NO: 607343 - DNA, 25 bp, Homo sapien
gaaagttttactgaagtttagcatt

SEQ ID NO: 607344 - DNA, 25 bp, Homo sapien
ggaatcagtataacccaatagtatg

SEQ ID NO: 607345 - DNA, 25 bp, Homo sapien
agtataacccaatagtatgagcagt

SEQ ID NO: 607346 - DNA, 25 bp, Homo sapien
gtatgagcagttacttctccgcaac

SEQ ID NO: 607347 - DNA, 25 bp, Homo sapien
gttacttctccgcaacatcaaagtg

SEQ ID NO: 607348 - DNA, 25 bp, Homo sapien
tctccgcaacatcaaagtggctgca

SEQ ID NO: 607349 - DNA, 25 bp, Homo sapien
tcataacttagaaatttgggtggta

SEQ ID NO: 607350 - DNA, 25 bp, Homo sapien
ggtaattaaaccagcaactattctt

SEQ ID NO: 607351 - DNA, 25 bp, Homo sapien
gcaactattctttgtttaatgcatt

SEQ ID NO: 607352 - DNA, 25 bp, Homo sapien
agttcatgccagtgatccgagtact

SEQ ID NO: 607353 - DNA, 25 bp, Homo sapien
gccagtgatccgagtactttgggaa

SEQ ID NO: 607354 - DNA, 25 bp, Homo sapien
ccagtgatccgagtactttgggaag

SEQ ID NO: 607355 - DNA, 25 bp, Homo sapien
cagtgatccgagtactttgggaagc

SEQ ID NO: 607356 - DNA, 25 bp, Homo sapien
tttgaggccagactgcacaacacag

SEQ ID NO: 607357 - DNA, 25 bp, Homo sapien
tgaggccagactgcacaacacagtg

SEQ ID NO: 607358 - DNA, 25 bp, Homo sapien
tgagacctcgtttctacaaataatt

SEQ ID NO: 607359 - DNA, 25 bp, Homo sapien
ctgaggtagtaggattgtttgagac

SEQ ID NO: 607360 - DNA, 25 bp, Homo sapien
gaggctgaactgagccaggatcttg

SEQ ID NO: 607361 - DNA, 25 bp, Homo sapien
aggatcttgccaccacattccagct

SEQ ID NO: 607362 - DNA, 25 bp, Homo sapien
tcttgccaccacattccagcttggg

SEQ ID NO: 607363 - DNA, 25 bp, Homo sapien
aacagtcatctttgtactttagaaa

SEQ ID NO: 607364 - DNA, 25 bp, Homo sapien
acagtcatctttgtactttagaaaa

SEQ ID NO: 607365 - DNA, 25 bp, Homo sapien
cagtcatctttgtactttagaaaat

SEQ ID NO: 607366 - DNA, 25 bp, Homo sapien
agtcatctttgtactttagaaaatg

SEQ ID NO: 607367 - DNA, 25 bp, Homo sapien
gtcatctttgtactttagaaaatgg

SEQ ID NO: 607368 - DNA, 25 bp, Homo sapien
tcatctttgtactttagaaaatggc

SEQ ID NO: 607369 - DNA, 25 bp, Homo sapien
catctttgtactttagaaaatggca

SEQ ID NO: 607370 - DNA, 25 bp, Homo sapien
atctttgtactttagaaaatggcag

SEQ ID NO: 607371 - DNA, 25 bp, Homo sapien
tctttgtactttagaaaatggcagc

SEQ ID NO: 607372 - DNA, 25 bp, Homo sapien
ctttgtactttagaaaatggcagct

SEQ ID NO: 607373 - DNA, 25 bp, Homo sapien
tttgtactttagaaaatggcagctg

SEQ ID NO: 607374 - DNA, 25 bp, Homo sapien
actggaatacagttggaagcacagg

SEQ ID NO: 607375 - DNA, 25 bp, Homo sapien
gtaactggtacctgagctagctgca

SEQ ID NO: 607376 - DNA, 25 bp, Homo sapien
gtacctgagctagctgcacagccaa

SEQ ID NO: 607377 - DNA, 25 bp, Homo sapien
gcacagccaaggatagttcatgcct

SEQ ID NO: 607378 - DNA, 25 bp, Homo sapien
tagttcatgcctgtttcattgacac

SEQ ID NO: 607379 - DNA, 25 bp, Homo sapien
atcattcttccagctaagggtccaa

SEQ ID NO: 607380 - DNA, 25 bp, Homo sapien
aagggtccaatcagtgcctattctt

SEQ ID NO: 607381 - DNA, 25 bp, Homo sapien
tattcttccaccagctcaaagggcc

SEQ ID NO: 607382 - DNA, 25 bp, Homo sapien
tttggtcatgccaaagaggcagagt

SEQ ID NO: 607383 - DNA, 25 bp, Homo sapien
ggcagagttcaggattccctcagaa

SEQ ID NO: 607384 - DNA, 25 bp, Homo sapien
ggattccctcagaatgccctgcaca

SEQ ID NO: 607385 - DNA, 25 bp, Homo sapien
gaagatattctacattcagaggaag

SEQ ID NO: 607386 - DNA, 25 bp, Homo sapien
cattcagaggaagcaacactagact

SEQ ID NO: 607387 - DNA, 25 bp, Homo sapien
ggaagcaacactagactcaggcaaa

SEQ ID NO: 607388 - DNA, 25 bp, Homo sapien
caacactagactcaggcaaaacact

SEQ ID NO: 607389 - DNA, 25 bp, Homo sapien
gactcaggcaaaacactagctgaaa

SEQ ID NO: 607390 - DNA, 25 bp, Homo sapien
ggcaaaacactagctgaaatcagcg

SEQ ID NO: 607391 - DNA, 25 bp, Homo sapien
tgaaatcagcgatcgttatggagca

SEQ ID NO: 607392 - DNA, 25 bp, Homo sapien
gttatggagcacctaacttgagcag

SEQ ID NO: 607393 - DNA, 25 bp, Homo sapien
gaacttgatgaaccaatgttttctg

SEQ ID NO: 607394 - DNA, 25 bp, Homo sapien
ttgatgaaccaatgttttctgatat

SEQ ID NO: 607395 - DNA, 25 bp, Homo sapien
gttttctgatattgcattaaacatt

SEQ ID NO: 607396 - DNA, 25 bp, Homo sapien
gccaggagtggtttgcccggtactt

SEQ ID NO: 607397 - DNA, 25 bp, Homo sapien
tgcccggtacttcacattctgaaag

SEQ ID NO: 607398 - DNA, 25 bp, Homo sapien
gaattgtgttggcacagctctgtat

SEQ ID NO: 607399 - DNA, 25 bp, Homo sapien
ggcacagctctgtatagactgttac

SEQ ID NO: 607400 - DNA, 25 bp, Homo sapien
gactgttactaagagcatgacttta

SEQ ID NO: 607401 - DNA, 25 bp, Homo sapien
gagcatgactttatacagattgtta

SEQ ID NO: 607402 - DNA, 25 bp, Homo sapien
gattgttatgtaaataggctttcct

SEQ ID NO: 607403 - DNA, 25 bp, Homo sapien
ataggctttcctatgtcaaacactg

SEQ ID NO: 607404 - DNA, 25 bp, Homo sapien
atttgtctctccaacttgaaaatgc

SEQ ID NO: 607405 - DNA, 25 bp, Homo sapien
ttggaatcattctataaggtactat

SEQ ID NO: 607406 - DNA, 25 bp, Homo sapien
gagtctttaacctttgtaattactg

SEQ ID NO: 607407 - DNA, 25 bp, Homo sapien
agccaagatcacgaccaccacactc

SEQ ID NO: 607408 - DNA, 25 bp, Homo sapien
gccaagatcacgaccaccacactct

SEQ ID NO: 607409 - DNA, 25 bp, Homo sapien
ccaagatcacgaccaccacactcta

SEQ ID NO: 607410 - DNA, 25 bp, Homo sapien
caagatcacgaccaccacactctag

SEQ ID NO: 607411 - DNA, 25 bp, Homo sapien
aagatcacgaccaccacactctagc

SEQ ID NO: 607412 - DNA, 25 bp, Homo sapien
agatcacgaccaccacactctagcc

SEQ ID NO: 607413 - DNA, 25 bp, Homo sapien
gatcacgaccaccacactctagcct

SEQ ID NO: 607414 - DNA, 25 bp, Homo sapien
atcacgaccaccacactctagcctg

SEQ ID NO: 607415 - DNA, 25 bp, Homo sapien
tcacgaccaccacactctagcctgg

SEQ ID NO: 607416 - DNA, 25 bp, Homo sapien
cacgaccaccacactctagcctggg

SEQ ID NO: 607417 - DNA, 25 bp, Homo sapien
acgaccaccacactctagcctgggc

SEQ ID NO: 607418 - DNA, 25 bp, Homo sapien
ggactgctgtttggtaaaattcagg

SEQ ID NO: 607419 - DNA, 25 bp, Homo sapien
aaattcagggtgatatgttggtgct

SEQ ID NO: 607420 - DNA, 25 bp, Homo sapien
ggtgggagggagtccacagcggccc

SEQ ID NO: 607421 - DNA, 25 bp, Homo sapien
gggatgacaagctggtctcgctcag

SEQ ID NO: 607422 - DNA, 25 bp, Homo sapien
atgacaagctggtctcgctcagggc

SEQ ID NO: 607423 - DNA, 25 bp, Homo sapien
acaagctggtctcgctcagggccct

SEQ ID NO: 607424 - DNA, 25 bp, Homo sapien
tccatctctggattttcctggctca

SEQ ID NO: 607425 - DNA, 25 bp, Homo sapien
atctctggattttcctggctcactg

SEQ ID NO: 607426 - DNA, 25 bp, Homo sapien
tctggattttcctggctcactgaca

SEQ ID NO: 607427 - DNA, 25 bp, Homo sapien
ggattttcctggctcactgacaggg

SEQ ID NO: 607428 - DNA, 25 bp, Homo sapien
gaagcctcttccacctacaggtctg

SEQ ID NO: 607429 - DNA, 25 bp, Homo sapien
ggcggtgctggcagccaacgccatt

SEQ ID NO: 607430 - DNA, 25 bp, Homo sapien
ggtgctggcagccaacgccattgca

SEQ ID NO: 607431 - DNA, 25 bp, Homo sapien
gctggcagccaacgccattgcacag

SEQ ID NO: 607432 - DNA, 25 bp, Homo sapien
gagctgccagccctccttctatgat

SEQ ID NO: 607433 - DNA, 25 bp, Homo sapien
tgccagccctccttctatgatggca

SEQ ID NO: 607434 - DNA, 25 bp, Homo sapien
tcattgtcaagaagctgccatacct

SEQ ID NO: 607435 - DNA, 25 bp, Homo sapien
cattgtcaagaagctgccatacctg

SEQ ID NO: 607436 - DNA, 25 bp, Homo sapien
tgccatacctgccacggattctggg

SEQ ID NO: 607437 - DNA, 25 bp, Homo sapien
tgccacggattctgggccgcaacat

SEQ ID NO: 607438 - DNA, 25 bp, Homo sapien
tggagcacttcatgaaccacagcat

SEQ ID NO: 607439 - DNA, 25 bp, Homo sapien
agcacttcatgaaccacagcatcac

SEQ ID NO: 607440 - DNA, 25 bp, Homo sapien
gaatcatacaaaagtcttaaagttg

SEQ ID NO: 607441 - DNA, 25 bp, Homo sapien
atcaataagaaatgggatccttccc

SEQ ID NO: 607442 - DNA, 25 bp, Homo sapien
aaatgggatccttccctgttacaga

SEQ ID NO: 607443 - DNA, 25 bp, Homo sapien
acagagttgaactgcaagcttttct

SEQ ID NO: 607444 - DNA, 25 bp, Homo sapien
gagttgaactgcaagcttttctgtt

SEQ ID NO: 607445 - DNA, 25 bp, Homo sapien
ttgaactgcaagcttttctgttatt

SEQ ID NO: 607446 - DNA, 25 bp, Homo sapien
tccagaagccataacagaaagggaa

SEQ ID NO: 607447 - DNA, 25 bp, Homo sapien
gaatagttaacgtgggttcctcttg

SEQ ID NO: 607448 - DNA, 25 bp, Homo sapien
aaaagcagacaaattactctggaga

SEQ ID NO: 607449 - DNA, 25 bp, Homo sapien
tactctggagaagcaaatacttccg

SEQ ID NO: 607450 - DNA, 25 bp, Homo sapien
ggagaagcaaatacttccgataatt

SEQ ID NO: 607451 - DNA, 25 bp, Homo sapien
atgcaagtcttgaagctttccagcc

SEQ ID NO: 607452 - DNA, 25 bp, Homo sapien
tgaagctttccagccatggcattta

SEQ ID NO: 607453 - DNA, 25 bp, Homo sapien
gagacaatgcccaaactttcttatc

SEQ ID NO: 607454 - DNA, 25 bp, Homo sapien
tatctcagacaacagtcttcttcag

SEQ ID NO: 607455 - DNA, 25 bp, Homo sapien
tcttcttcagaagacctaccaggct

SEQ ID NO: 607456 - DNA, 25 bp, Homo sapien
gtagactatttgtaattccctggga

SEQ ID NO: 607457 - DNA, 25 bp, Homo sapien
attccctgggatctatctctcataa

SEQ ID NO: 607458 - DNA, 25 bp, Homo sapien
gggatctatctctcataattttaag

SEQ ID NO: 607459 - DNA, 25 bp, Homo sapien
tgtgactctttacacctctatgtct

SEQ ID NO: 607460 - DNA, 25 bp, Homo sapien
ttacacctctatgtctccattttct

SEQ ID NO: 607461 - DNA, 25 bp, Homo sapien
acccagggtttcagcatgctggagc

SEQ ID NO: 607462 - DNA, 25 bp, Homo sapien
gggaagatgggcatggccacccatc

SEQ ID NO: 607463 - DNA, 25 bp, Homo sapien
gaagatgggcatggccacccatcag

SEQ ID NO: 607464 - DNA, 25 bp, Homo sapien
gatgggcatggccacccatcagaag

SEQ ID NO: 607465 - DNA, 25 bp, Homo sapien
tgggcatggccacccatcagaagtt

SEQ ID NO: 607466 - DNA, 25 bp, Homo sapien
ggcatggccacccatcagaagttag

SEQ ID NO: 607467 - DNA, 25 bp, Homo sapien
catggccacccatcagaagttagtg

SEQ ID NO: 607468 - DNA, 25 bp, Homo sapien
tggccacccatcagaagttagtgct

SEQ ID NO: 607469 - DNA, 25 bp, Homo sapien
gccacccatcagaagttagtgctgg

SEQ ID NO: 607470 - DNA, 25 bp, Homo sapien
acccatcagaagttagtgctggaca

SEQ ID NO: 607471 - DNA, 25 bp, Homo sapien
atcagaagttagtgctggacagcct

SEQ ID NO: 607472 - DNA, 25 bp, Homo sapien
tcagaagttagtgctggacagcctg

SEQ ID NO: 607473 - DNA, 25 bp, Homo sapien
agaccgaagtggacagtggttaaga

SEQ ID NO: 607474 - DNA, 25 bp, Homo sapien
accgaagtggacagtggttaagatt

SEQ ID NO: 607475 - DNA, 25 bp, Homo sapien
ccgaagtggacagtggttaagattg

SEQ ID NO: 607476 - DNA, 25 bp, Homo sapien
cgaagtggacagtggttaagattgt

SEQ ID NO: 607477 - DNA, 25 bp, Homo sapien
aagtggacagtggttaagattgtgg

SEQ ID NO: 607478 - DNA, 25 bp, Homo sapien
ggttaagattgtggggccgggcgag

SEQ ID NO: 607479 - DNA, 25 bp, Homo sapien
gtctctattgggagtacaaaaatta

SEQ ID NO: 607480 - DNA, 25 bp, Homo sapien
aattagccggccatagtggctcgtg

SEQ ID NO: 607481 - DNA, 25 bp, Homo sapien
attagccggccatagtggctcgtgc

SEQ ID NO: 607482 - DNA, 25 bp, Homo sapien
ttagccggccatagtggctcgtgcc

SEQ ID NO: 607483 - DNA, 25 bp, Homo sapien
tagccggccatagtggctcgtgcct

SEQ ID NO: 607484 - DNA, 25 bp, Homo sapien
aagtggagaatgaggccaggcgtgg

SEQ ID NO: 607485 - DNA, 25 bp, Homo sapien
agtggagaatgaggccaggcgtggt

SEQ ID NO: 607486 - DNA, 25 bp, Homo sapien
gtggagaatgaggccaggcgtggtg

SEQ ID NO: 607487 - DNA, 25 bp, Homo sapien
tggagaatgaggccaggcgtggtgg

SEQ ID NO: 607488 - DNA, 25 bp, Homo sapien
ggagaatgaggccaggcgtggtggc

SEQ ID NO: 607489 - DNA, 25 bp, Homo sapien
gagaatgaggccaggcgtggtggct

SEQ ID NO: 607490 - DNA, 25 bp, Homo sapien
agaatgaggccaggcgtggtggctc

SEQ ID NO: 607491 - DNA, 25 bp, Homo sapien
gaatgaggccaggcgtggtggctca

SEQ ID NO: 607492 - DNA, 25 bp, Homo sapien
aggcacaagaaaagcttgaacccag

SEQ ID NO: 607493 - DNA, 25 bp, Homo sapien
ggcacaagaaaagcttgaacccagg

SEQ ID NO: 607494 - DNA, 25 bp, Homo sapien
gcacaagaaaagcttgaacccagga

SEQ ID NO: 607495 - DNA, 25 bp, Homo sapien
tgataacctggcactcatgggtcta

SEQ ID NO: 607496 - DNA, 25 bp, Homo sapien
cactcatgggtctatggagagaatt

SEQ ID NO: 607497 - DNA, 25 bp, Homo sapien
gggagcttggatggaataaatttgc

SEQ ID NO: 607498 - DNA, 25 bp, Homo sapien
aatttgcatctttattttcaggaaa

SEQ ID NO: 607499 - DNA, 25 bp, Homo sapien
gaaagttttactgaagtttagcatt

SEQ ID NO: 607500 - DNA, 25 bp, Homo sapien
ggaatcagtataacccaatagtatg

SEQ ID NO: 607501 - DNA, 25 bp, Homo sapien
gtatgagcagttacttctccgcaac

SEQ ID NO: 607502 - DNA, 25 bp, Homo sapien
cttctccgcaacatcaaagtggctg

SEQ ID NO: 607503 - DNA, 25 bp, Homo sapien
tcataacttagaaatttgggtggta

SEQ ID NO: 607504 - DNA, 25 bp, Homo sapien
ggtaattaaaccagcaactattctt

SEQ ID NO: 607505 - DNA, 25 bp, Homo sapien
gcaactattctttgtttaatgcatt

SEQ ID NO: 607506 - DNA, 25 bp, Homo sapien
gtgaggtaccttattgaagtgttct

SEQ ID NO: 607507 - DNA, 25 bp, Homo sapien
atctgaaggctgcttacgattggct

SEQ ID NO: 607508 - DNA, 25 bp, Homo sapien
gctgcttacgattggctagggttaa

SEQ ID NO: 607509 - DNA, 25 bp, Homo sapien
gctagggttaaatcttatttctgtc

SEQ ID NO: 607510 - DNA, 25 bp, Homo sapien
tgatccaagttaagtattacctatt

SEQ ID NO: 607511 - DNA, 25 bp, Homo sapien
gttacaatccaacttgagtttcact

SEQ ID NO: 607512 - DNA, 25 bp, Homo sapien
gagtttcacttatgtttgcagttta

SEQ ID NO: 607513 - DNA, 25 bp, Homo sapien
gcaatgataaggctatttctaaggc

SEQ ID NO: 607514 - DNA, 25 bp, Homo sapien
tttctaaggcctgggtggctttgtt

SEQ ID NO: 607515 - DNA, 25 bp, Homo sapien
gcagttaacataattgtcttttggg

SEQ ID NO: 607516 - DNA, 25 bp, Homo sapien
gtcttttgggtgaggtaccttattg

SEQ ID NO: 607517 - DNA, 25 bp, Homo sapien
caaaaagtagccaggcgtgatggcg

SEQ ID NO: 607518 - DNA, 25 bp, Homo sapien
tagctacttggtaggctgagacggg

SEQ ID NO: 607519 - DNA, 25 bp, Homo sapien
cttggtaggctgagacgggagaatt

SEQ ID NO: 607520 - DNA, 25 bp, Homo sapien
ttggtaggctgagacgggagaattg

SEQ ID NO: 607521 - DNA, 25 bp, Homo sapien
tggtaggctgagacgggagaattgc

SEQ ID NO: 607522 - DNA, 25 bp, Homo sapien
ggtaggctgagacgggagaattgct

SEQ ID NO: 607523 - DNA, 25 bp, Homo sapien
tccgggagatggtggttgcagtgaa

SEQ ID NO: 607524 - DNA, 25 bp, Homo sapien
cgggagatggtggttgcagtgaact

SEQ ID NO: 607525 - DNA, 25 bp, Homo sapien
gggagatggtggttgcagtgaactg

SEQ ID NO: 607526 - DNA, 25 bp, Homo sapien
ggagatggtggttgcagtgaactga

SEQ ID NO: 607527 - DNA, 25 bp, Homo sapien
gagatggtggttgcagtgaactgag

SEQ ID NO: 607528 - DNA, 25 bp, Homo sapien
tgctcacctattattcaagcttagg

SEQ ID NO: 607529 - DNA, 25 bp, Homo sapien
gctcacctattattcaagcttaggt

SEQ ID NO: 607530 - DNA, 25 bp, Homo sapien
acctattattcaagcttaggtgatt

SEQ ID NO: 607531 - DNA, 25 bp, Homo sapien
ctattattcaagcttaggtgattat

SEQ ID NO: 607532 - DNA, 25 bp, Homo sapien
tattcaagcttaggtgattatatga

SEQ ID NO: 607533 - DNA, 25 bp, Homo sapien
tcaagcttaggtgattatatgaaga

SEQ ID NO: 607534 - DNA, 25 bp, Homo sapien
gtcccaggaaagtggccatccctag

SEQ ID NO: 607535 - DNA, 25 bp, Homo sapien
caggaaagtggccatccctagccac

SEQ ID NO: 607536 - DNA, 25 bp, Homo sapien
aggaaagtggccatccctagccaca

SEQ ID NO: 607537 - DNA, 25 bp, Homo sapien
ggaaagtggccatccctagccacat

SEQ ID NO: 607538 - DNA, 25 bp, Homo sapien
gaaagtggccatccctagccacatc

SEQ ID NO: 607539 - DNA, 25 bp, Homo sapien
gatagcttaaacaatctgagtccgc

SEQ ID NO: 607540 - DNA, 25 bp, Homo sapien
gcttaaacaatctgagtccgcactc

SEQ ID NO: 607541 - DNA, 25 bp, Homo sapien
taaacaatctgagtccgcactcact

SEQ ID NO: 607542 - DNA, 25 bp, Homo sapien
aatctgagtccgcactcactctatt

SEQ ID NO: 607543 - DNA, 25 bp, Homo sapien
agtccgcactcactctattcctgtg

SEQ ID NO: 607544 - DNA, 25 bp, Homo sapien
ctattcctgtgagcctgcttaaagt

SEQ ID NO: 607545 - DNA, 25 bp, Homo sapien
tcctgtgagcctgcttaaagtgtct

SEQ ID NO: 607546 - DNA, 25 bp, Homo sapien
gtgagcctgcttaaagtgtctctca

SEQ ID NO: 607547 - DNA, 25 bp, Homo sapien
gcctgcttaaagtgtctctcatgta

SEQ ID NO: 607548 - DNA, 25 bp, Homo sapien
cttaaagtgtctctcatgtactcat

SEQ ID NO: 607549 - DNA, 25 bp, Homo sapien
gtcccccaacagctgttgaaggctg

SEQ ID NO: 607550 - DNA, 25 bp, Homo sapien
atgtaaatactctttggtaacctgc

SEQ ID NO: 607551 - DNA, 25 bp, Homo sapien
gtaaatactctttggtaacctgctt

SEQ ID NO: 607552 - DNA, 25 bp, Homo sapien
taaatactctttggtaacctgcttt

SEQ ID NO: 607553 - DNA, 25 bp, Homo sapien
aatactctttggtaacctgcttttg

SEQ ID NO: 607554 - DNA, 25 bp, Homo sapien
atactctttggtaacctgcttttgt

SEQ ID NO: 607555 - DNA, 25 bp, Homo sapien
tactctttggtaacctgcttttgtc

SEQ ID NO: 607556 - DNA, 25 bp, Homo sapien
tctttggtaacctgcttttgtccga

SEQ ID NO: 607557 - DNA, 25 bp, Homo sapien
ctttggtaacctgcttttgtccgag

SEQ ID NO: 607558 - DNA, 25 bp, Homo sapien
tttggtaacctgcttttgtccgaga

SEQ ID NO: 607559 - DNA, 25 bp, Homo sapien
ttggtaacctgcttttgtccgagaa

SEQ ID NO: 607560 - DNA, 25 bp, Homo sapien
tggtaacctgcttttgtccgagaac

SEQ ID NO: 607561 - DNA, 25 bp, Homo sapien
atatgcatgtttaatagagctgtta

SEQ ID NO: 607562 - DNA, 25 bp, Homo sapien
gagctgttaattgcactggacctgt

SEQ ID NO: 607563 - DNA, 25 bp, Homo sapien
tgcactggacctgtttatgctgagt

SEQ ID NO: 607564 - DNA, 25 bp, Homo sapien
acctgtttatgctgagtctaactct

SEQ ID NO: 607565 - DNA, 25 bp, Homo sapien
gggattgttaccttcaatgtctaaa

SEQ ID NO: 607566 - DNA, 25 bp, Homo sapien
gttaccttcaatgtctaaatcacta

SEQ ID NO: 607567 - DNA, 25 bp, Homo sapien
gtatttatgccacctaggttttaag

SEQ ID NO: 607568 - DNA, 25 bp, Homo sapien
cacctaggttttaagtgcagtgctt

SEQ ID NO: 607569 - DNA, 25 bp, Homo sapien
ttaacttaccattctgtcggtgctc

SEQ ID NO: 607570 - DNA, 25 bp, Homo sapien
attctgtcggtgctctatcagtagg

SEQ ID NO: 607571 - DNA, 25 bp, Homo sapien
gtgctctatcagtaggaacagccta

SEQ ID NO: 607572 - DNA, 25 bp, Homo sapien
ggctacggtagcactgtgacttgat

SEQ ID NO: 607573 - DNA, 25 bp, Homo sapien
tgtgacttgatgactccgtcctctc

SEQ ID NO: 607574 - DNA, 25 bp, Homo sapien
accacacagttggaaatccctggct

SEQ ID NO: 607575 - DNA, 25 bp, Homo sapien
aatccctggctatccagaaaggagg

SEQ ID NO: 607576 - DNA, 25 bp, Homo sapien
gcaacctctaggctggctatttgta

SEQ ID NO: 607577 - DNA, 25 bp, Homo sapien
ctaggctggctatttgtaggtgttt

SEQ ID NO: 607578 - DNA, 25 bp, Homo sapien
gaagtgacactaataactctgatca

SEQ ID NO: 607579 - DNA, 25 bp, Homo sapien
aactctgatcataactccaaaagca

SEQ ID NO: 607580 - DNA, 25 bp, Homo sapien
gggtctgatacttatgttctggtac

SEQ ID NO: 607581 - DNA, 25 bp, Homo sapien
atgttctggtactcgcaatgtgggc

SEQ ID NO: 607582 - DNA, 25 bp, Homo sapien
tactcgcaatgtgggcacctcctag

SEQ ID NO: 607583 - DNA, 25 bp, Homo sapien
ttgactcattttttaagcgtaaact

SEQ ID NO: 607584 - DNA, 25 bp, Homo sapien
aaagacagccttatattactccata

SEQ ID NO: 607585 - DNA, 25 bp, Homo sapien
gacagccttatattactccataagt

SEQ ID NO: 607586 - DNA, 25 bp, Homo sapien
cataagtgaaaaaccagcaccctcc

SEQ ID NO: 607587 - DNA, 25 bp, Homo sapien
gcaccctcctgctgcaaacagaagg

SEQ ID NO: 607588 - DNA, 25 bp, Homo sapien
aatctgacttagcttctattgcctg

SEQ ID NO: 607589 - DNA, 25 bp, Homo sapien
tgacttagcttctattgcctgccag

SEQ ID NO: 607590 - DNA, 25 bp, Homo sapien
ttagcttctattgcctgccagtgat

SEQ ID NO: 607591 - DNA, 25 bp, Homo sapien
tattgcctgccagtgattctgagct

SEQ ID NO: 607592 - DNA, 25 bp, Homo sapien
gattctgagcttaatgcctgcttgc

SEQ ID NO: 607593 - DNA, 25 bp, Homo sapien
gagcttaatgcctgcttgcttgtct

SEQ ID NO: 607594 - DNA, 25 bp, Homo sapien
aacagtcatctttgtactttagaaa

SEQ ID NO: 607595 - DNA, 25 bp, Homo sapien
acagtcatctttgtactttagaaaa

SEQ ID NO: 607596 - DNA, 25 bp, Homo sapien
cagtcatctttgtactttagaaaat

SEQ ID NO: 607597 - DNA, 25 bp, Homo sapien
gtcatctttgtactttagaaaatgg

SEQ ID NO: 607598 - DNA, 25 bp, Homo sapien
tcatctttgtactttagaaaatggc

SEQ ID NO: 607599 - DNA, 25 bp, Homo sapien
catctttgtactttagaaaatggca

SEQ ID NO: 607600 - DNA, 25 bp, Homo sapien
atctttgtactttagaaaatggcag

SEQ ID NO: 607601 - DNA, 25 bp, Homo sapien
tctttgtactttagaaaatggcagc

SEQ ID NO: 607602 - DNA, 25 bp, Homo sapien
ctttgtactttagaaaatggcagct

SEQ ID NO: 607603 - DNA, 25 bp, Homo sapien
tttgtactttagaaaatggcagctg

SEQ ID NO: 607604 - DNA, 25 bp, Homo sapien
ttgtactttagaaaatggcagctgg

SEQ ID NO: 607605 - DNA, 25 bp, Homo sapien
tcctgtaatataaaggtccattgct

SEQ ID NO: 607606 - DNA, 25 bp, Homo sapien
aaaggtccattgctagttgaaaagt

SEQ ID NO: 607607 - DNA, 25 bp, Homo sapien
attgctagttgaaaagtgacctctt

SEQ ID NO: 607608 - DNA, 25 bp, Homo sapien
atagtgaagcccgtatgtatggagt

SEQ ID NO: 607609 - DNA, 25 bp, Homo sapien
agcccgtatgtatggagttttaatc

SEQ ID NO: 607610 - DNA, 25 bp, Homo sapien
tctgctgctggaaagataatagaat

SEQ ID NO: 607611 - DNA, 25 bp, Homo sapien
gaatagctgattcttacaacaactg

SEQ ID NO: 607612 - DNA, 25 bp, Homo sapien
acaacaactgtatgatcagggatga

SEQ ID NO: 607613 - DNA, 25 bp, Homo sapien
tcagggatgagttagagtatttctt

SEQ ID NO: 607614 - DNA, 25 bp, Homo sapien
tttcttttgtctttgctcaaagcca

SEQ ID NO: 607615 - DNA, 25 bp, Homo sapien
gtctttgctcaaagccatacatata

SEQ ID NO: 607616 - DNA, 25 bp, Homo sapien
cagacatgatgcagcagccgcgagt

SEQ ID NO: 607617 - DNA, 25 bp, Homo sapien
acatgatgcagcagccgcgagtgga

SEQ ID NO: 607618 - DNA, 25 bp, Homo sapien
cagcagccgcgagtggagacagata

SEQ ID NO: 607619 - DNA, 25 bp, Homo sapien
cagccgcgagtggagacagatacca

SEQ ID NO: 607620 - DNA, 25 bp, Homo sapien
gtcctgggcgctgcaggaagcaaca

SEQ ID NO: 607621 - DNA, 25 bp, Homo sapien
ggaagcaacatgacttaggtaactg

SEQ ID NO: 607622 - DNA, 25 bp, Homo sapien
caacatgacttaggtaactgcccag

SEQ ID NO: 607623 - DNA, 25 bp, Homo sapien
acatgacttaggtaactgcccagag

SEQ ID NO: 607624 - DNA, 25 bp, Homo sapien
actgcccagaggtgcaccagacatg

SEQ ID NO: 607625 - DNA, 25 bp, Homo sapien
cccagaggtgcaccagacatgatgc

SEQ ID NO: 607626 - DNA, 25 bp, Homo sapien
cagaggtgcaccagacatgatgcag

SEQ ID NO: 607627 - DNA, 25 bp, Homo sapien
gacacgggttggattgttccctgga

SEQ ID NO: 607628 - DNA, 25 bp, Homo sapien
ggttggattgttccctggagcccct

SEQ ID NO: 607629 - DNA, 25 bp, Homo sapien
tggagcccctcattgatcctttgaa

SEQ ID NO: 607630 - DNA, 25 bp, Homo sapien
gatcctttgaacttacatttcctgg

SEQ ID NO: 607631 - DNA, 25 bp, Homo sapien
tggcaggcactgagctcaatattga

SEQ ID NO: 607632 - DNA, 25 bp, Homo sapien
atgaaacatgatcactcccctcatt

SEQ ID NO: 607633 - DNA, 25 bp, Homo sapien
tgatcactcccctcatttagtcaat

SEQ ID NO: 607634 - DNA, 25 bp, Homo sapien
tttagtcaatcaacagacactattg

SEQ ID NO: 607635 - DNA, 25 bp, Homo sapien
caacagacactattgagtacctact

SEQ ID NO: 607636 - DNA, 25 bp, Homo sapien
tatgtgcaagcattgtgttaggtac

SEQ ID NO: 607637 - DNA, 25 bp, Homo sapien
gtgttaggtacagtgaatacagtat

SEQ ID NO: 607638 - DNA, 25 bp, Homo sapien
ctgttctatgggaccattaccttca

SEQ ID NO: 607639 - DNA, 25 bp, Homo sapien
gttctatgggaccattaccttcatt

SEQ ID NO: 607640 - DNA, 25 bp, Homo sapien
tctatgggaccattaccttcattta

SEQ ID NO: 607641 - DNA, 25 bp, Homo sapien
atgggaccattaccttcatttatgt

SEQ ID NO: 607642 - DNA, 25 bp, Homo sapien
gggaccattaccttcatttatgtga

SEQ ID NO: 607643 - DNA, 25 bp, Homo sapien
gaccattaccttcatttatgtgatg

SEQ ID NO: 607644 - DNA, 25 bp, Homo sapien
attaccttcatttatgtgatgccca

SEQ ID NO: 607645 - DNA, 25 bp, Homo sapien
ttaccttcatttatgtgatgcccaa

SEQ ID NO: 607646 - DNA, 25 bp, Homo sapien
agctactcaactgaccagaacaagg

SEQ ID NO: 607647 - DNA, 25 bp, Homo sapien
tactcaactgaccagaacaaggtgg

SEQ ID NO: 607648 - DNA, 25 bp, Homo sapien
tcaactgaccagaacaaggtggtgt

SEQ ID NO: 607649 - DNA, 25 bp, Homo sapien
ctggccatcacattaatgaatgatg

SEQ ID NO: 607650 - DNA, 25 bp, Homo sapien
tgagattggagtacactgtcaccaa

SEQ ID NO: 607651 - DNA, 25 bp, Homo sapien
tggagtacactgtcaccaagggcag

SEQ ID NO: 607652 - DNA, 25 bp, Homo sapien
gagtacactgtcaccaagggcaggc

SEQ ID NO: 607653 - DNA, 25 bp, Homo sapien
tacactgtcaccaagggcaggcaca

SEQ ID NO: 607654 - DNA, 25 bp, Homo sapien
cactgtcaccaagggcaggcacaga

SEQ ID NO: 607655 - DNA, 25 bp, Homo sapien
gtcaccaagggcaggcacagatggc

SEQ ID NO: 607656 - DNA, 25 bp, Homo sapien
atggcttctggggttgtctggttcc

SEQ ID NO: 607657 - DNA, 25 bp, Homo sapien
ttgtctggttcccagtgagaggctc

SEQ ID NO: 607658 - DNA, 25 bp, Homo sapien
ctggttcccagtgagaggctcctga

SEQ ID NO: 607659 - DNA, 25 bp, Homo sapien
ggttcccagtgagaggctcctgaga

SEQ ID NO: 607660 - DNA, 25 bp, Homo sapien
gcaaagtggttatagcattttacgc

SEQ ID NO: 607661 - DNA, 25 bp, Homo sapien
gcattttacgcttccattggtcata

SEQ ID NO: 607662 - DNA, 25 bp, Homo sapien
tagatgacggttctagttgctccgc

SEQ ID NO: 607663 - DNA, 25 bp, Homo sapien
ttgctccgcacctttgtcaacattt

SEQ ID NO: 607664 - DNA, 25 bp, Homo sapien
gtcaacatttgggtctgtcagtctt

SEQ ID NO: 607665 - DNA, 25 bp, Homo sapien
ttttatacaccttgactttactgac

SEQ ID NO: 607666 - DNA, 25 bp, Homo sapien
ttgactttactgacaagcctttaaa

SEQ ID NO: 607667 - DNA, 25 bp, Homo sapien
gtttagcacattttcatgagcttat

SEQ ID NO: 607668 - DNA, 25 bp, Homo sapien
gagcttattggctattcctatatct

SEQ ID NO: 607669 - DNA, 25 bp, Homo sapien
ctattcctatatcttctgttgagaa

SEQ ID NO: 607670 - DNA, 25 bp, Homo sapien
caattaaagccatttgcccatgttc

SEQ ID NO: 607671 - DNA, 25 bp, Homo sapien
attaactaaatctggccaggcctgg

SEQ ID NO: 607672 - DNA, 25 bp, Homo sapien
ttaactaaatctggccaggcctggt

SEQ ID NO: 607673 - DNA, 25 bp, Homo sapien
taactaaatctggccaggcctggtg

SEQ ID NO: 607674 - DNA, 25 bp, Homo sapien
tggatcacctgcgatcaggagctca

SEQ ID NO: 607675 - DNA, 25 bp, Homo sapien
acaaaaagtcagccgggcatgtggc

SEQ ID NO: 607676 - DNA, 25 bp, Homo sapien
caaaaagtcagccgggcatgtggca

SEQ ID NO: 607677 - DNA, 25 bp, Homo sapien
aaaaagtcagccgggcatgtggcag

SEQ ID NO: 607678 - DNA, 25 bp, Homo sapien
aaaagtcagccgggcatgtggcagg

SEQ ID NO: 607679 - DNA, 25 bp, Homo sapien
aaagtcagccgggcatgtggcaggc

SEQ ID NO: 607680 - DNA, 25 bp, Homo sapien
aagtcagccgggcatgtggcaggcg

SEQ ID NO: 607681 - DNA, 25 bp, Homo sapien
agtcagccgggcatgtggcaggcgc

SEQ ID NO: 607682 - DNA, 25 bp, Homo sapien
aattccaaaagaccagttctcctca

SEQ ID NO: 607683 - DNA, 25 bp, Homo sapien
gaccagttctcctcaaaagttgtgt

SEQ ID NO: 607684 - DNA, 25 bp, Homo sapien
taaggaccttaaaattggctactag

SEQ ID NO: 607685 - DNA, 25 bp, Homo sapien
aattggctactagtctaacagtaat

SEQ ID NO: 607686 - DNA, 25 bp, Homo sapien
tttaaactccatgactaaccattga

SEQ ID NO: 607687 - DNA, 25 bp, Homo sapien
aaccattgagggtactttctggatg

SEQ ID NO: 607688 - DNA, 25 bp, Homo sapien
attatttgggaagtggctgtttcaa

SEQ ID NO: 607689 - DNA, 25 bp, Homo sapien
ggctgtttcaaagtgagtgggatct

SEQ ID NO: 607690 - DNA, 25 bp, Homo sapien
gatctaggtttaaatccagcttcac

SEQ ID NO: 607691 - DNA, 25 bp, Homo sapien
tcaccacctgtatcacttaagcaag

SEQ ID NO: 607692 - DNA, 25 bp, Homo sapien
aagcaagtgatgcagcctctcttag

SEQ ID NO: 607693 - DNA, 25 bp, Homo sapien
aatatgtcaccctgtgttccaatgg

SEQ ID NO: 607694 - DNA, 25 bp, Homo sapien
aatggcgtgctcacctattattcaa

SEQ ID NO: 607695 - DNA, 25 bp, Homo sapien
tgaccttcggacatctaccatcaaa

SEQ ID NO: 607696 - DNA, 25 bp, Homo sapien
agcaatggcctatccaaggacatgg

SEQ ID NO: 607697 - DNA, 25 bp, Homo sapien
acatggaagctctgcatatgtcagc

SEQ ID NO: 607698 - DNA, 25 bp, Homo sapien
catggaagctctgcatatgtcagcc

SEQ ID NO: 607699 - DNA, 25 bp, Homo sapien
atggaagctctgcatatgtcagcca

SEQ ID NO: 607700 - DNA, 25 bp, Homo sapien
tggaagctctgcatatgtcagccaa

SEQ ID NO: 607701 - DNA, 25 bp, Homo sapien
ggaagctctgcatatgtcagccaat

SEQ ID NO: 607702 - DNA, 25 bp, Homo sapien
gaagctctgcatatgtcagccaatt

SEQ ID NO: 607703 - DNA, 25 bp, Homo sapien
aagctctgcatatgtcagccaattc

SEQ ID NO: 607704 - DNA, 25 bp, Homo sapien
atgaccaccatccagatctagaacg

SEQ ID NO: 607705 - DNA, 25 bp, Homo sapien
gaacgagatcattattggcatccca

SEQ ID NO: 607706 - DNA, 25 bp, Homo sapien
tcattattggcatcccagataccct

SEQ ID NO: 607707 - DNA, 25 bp, Homo sapien
ttctatccgctcctggtgactatgc

SEQ ID NO: 607708 - DNA, 25 bp, Homo sapien
gtaacgtttatctaacactacaggt

SEQ ID NO: 607709 - DNA, 25 bp, Homo sapien
taacactacaggttagttttgctta

SEQ ID NO: 607710 - DNA, 25 bp, Homo sapien
tgaactttatatacatggaaccatt

SEQ ID NO: 607711 - DNA, 25 bp, Homo sapien
ggcttctctcactcaatactatgtt

SEQ ID NO: 607712 - DNA, 25 bp, Homo sapien
aaaacattgtggtagcagtagctta

SEQ ID NO: 607713 - DNA, 25 bp, Homo sapien
gtagcttatttgttttcattgccgt

SEQ ID NO: 607714 - DNA, 25 bp, Homo sapien
gttttcattgccgtacggtatgcca

SEQ ID NO: 607715 - DNA, 25 bp, Homo sapien
atggcatgaaagtgccgctcttccg

SEQ ID NO: 607716 - DNA, 25 bp, Homo sapien
ttccgctttcagactcagcgagagg

SEQ ID NO: 607717 - DNA, 25 bp, Homo sapien
tcagcgagaggcttgaggtgcattt

SEQ ID NO: 607718 - DNA, 25 bp, Homo sapien
gaagaggaatttgccgtttgttata

SEQ ID NO: 607719 - DNA, 25 bp, Homo sapien
gttataacgtcgctttgggtcctgc

SEQ ID NO: 607720 - DNA, 25 bp, Homo sapien
tgggtcctgcgcctttcgtggtaca

SEQ ID NO: 607721 - DNA, 25 bp, Homo sapien
ttcgtggtacactccaccggatctg

SEQ ID NO: 607722 - DNA, 25 bp, Homo sapien
accggatctgctgccgctgagcttg

SEQ ID NO: 607723 - DNA, 25 bp, Homo sapien
taaaagaaattcttgttactcctgt

SEQ ID NO: 607724 - DNA, 25 bp, Homo sapien
ctgtaccttgtcctccatttccttt

SEQ ID NO: 607725 - DNA, 25 bp, Homo sapien
ataccttgttgcaagatttctctct

SEQ ID NO: 607726 - DNA, 25 bp, Homo sapien
ggctccagtacctggtgggtatgct

SEQ ID NO: 607727 - DNA, 25 bp, Homo sapien
tacctggtgggtatgcttcggcaga

SEQ ID NO: 607728 - DNA, 25 bp, Homo sapien
gtatgcttcggcagagccctgccct

SEQ ID NO: 607729 - DNA, 25 bp, Homo sapien
acctgtgtgcagtcctgcagcacca

SEQ ID NO: 607730 - DNA, 25 bp, Homo sapien
tggagctgagcgagcagtcactaca

SEQ ID NO: 607731 - DNA, 25 bp, Homo sapien
ctgagcgagcagtcactacaggagc

SEQ ID NO: 607732 - DNA, 25 bp, Homo sapien
gagcttcaggctgtgaagagagcaa

SEQ ID NO: 607733 - DNA, 25 bp, Homo sapien
agagcaaagccggatctggtcatca

SEQ ID NO: 607734 - DNA, 25 bp, Homo sapien
agcaaagccggatctggtcatcaca

SEQ ID NO: 607735 - DNA, 25 bp, Homo sapien
aaagccggatctggtcatcacacac

SEQ ID NO: 607736 - DNA, 25 bp, Homo sapien
caaggaactcatctcgaccttctga

SEQ ID NO: 607737 - DNA, 25 bp, Homo sapien
acaggcgtgggctcccgtgaccagc

SEQ ID NO: 607738 - DNA, 25 bp, Homo sapien
gtgaccagcctggaacgtgctgatg

SEQ ID NO: 607739 - DNA, 25 bp, Homo sapien
agcctggaacgtgctgatgagcctc

SEQ ID NO: 607740 - DNA, 25 bp, Homo sapien
cctggaacgtgctgatgagcctctt

SEQ ID NO: 607741 - DNA, 25 bp, Homo sapien
tggaacgtgctgatgagcctctttt

SEQ ID NO: 607742 - DNA, 25 bp, Homo sapien
gaacgtgctgatgagcctctttttc

SEQ ID NO: 607743 - DNA, 25 bp, Homo sapien
acgtgctgatgagcctctttttctc

SEQ ID NO: 607744 - DNA, 25 bp, Homo sapien
cctgaaaccccggtgggaacagatg

SEQ ID NO: 607745 - DNA, 25 bp, Homo sapien
cggtgggaacagatggtggatgctt

SEQ ID NO: 607746 - DNA, 25 bp, Homo sapien
aagcatcgaagctgtccatgaggac

SEQ ID NO: 607747 - DNA, 25 bp, Homo sapien
aggacatccgcgtgctctctgagga

SEQ ID NO: 607748 - DNA, 25 bp, Homo sapien
gctgatactttacctagcatcctaa

SEQ ID NO: 607749 - DNA, 25 bp, Homo sapien
gggtcattcggatcgaatctcgcct

SEQ ID NO: 607750 - DNA, 25 bp, Homo sapien
aatctcgcctgctttcaatcagttg

SEQ ID NO: 607751 - DNA, 25 bp, Homo sapien
gagaatcagatccatgaagcttaca

SEQ ID NO: 607752 - DNA, 25 bp, Homo sapien
gaagcttacatcgtttctagaccat

SEQ ID NO: 607753 - DNA, 25 bp, Homo sapien
gtttctagaccattagctgctctga

SEQ ID NO: 607754 - DNA, 25 bp, Homo sapien
tagctgctctgaacacctttggtaa

SEQ ID NO: 607755 - DNA, 25 bp, Homo sapien
gttactatatgtggtggtcagcgac

SEQ ID NO: 607756 - DNA, 25 bp, Homo sapien
gtggtcagcgacaactttcagcagg

SEQ ID NO: 607757 - DNA, 25 bp, Homo sapien
tttcagcaggctgtctgctcaacag

SEQ ID NO: 607758 - DNA, 25 bp, Homo sapien
caaagtaagcgggaaccttgagcaa

SEQ ID NO: 607759 - DNA, 25 bp, Homo sapien
gaacgttgagatggcagaaactttc

SEQ ID NO: 607760 - DNA, 25 bp, Homo sapien
aagcatattgaaaggatcccactca

SEQ ID NO: 607761 - DNA, 25 bp, Homo sapien
ggatcccactcatatgaaactaaca

SEQ ID NO: 607762 - DNA, 25 bp, Homo sapien
gaaactaacaggctgttttctgttt

SEQ ID NO: 607763 - DNA, 25 bp, Homo sapien
tttaaactcaactgtgagtgcttct

SEQ ID NO: 607764 - DNA, 25 bp, Homo sapien
agtgcttctgttcagaacacgttat

SEQ ID NO: 607765 - DNA, 25 bp, Homo sapien
gaacacgttatttcatgactaggat

SEQ ID NO: 607766 - DNA, 25 bp, Homo sapien
gcaaatggtttatgacttgtctgct

SEQ ID NO: 607767 - DNA, 25 bp, Homo sapien
gacttgtctgctttctggtagttag

SEQ ID NO: 607768 - DNA, 25 bp, Homo sapien
gaatacaagggtcaatctatggcta

SEQ ID NO: 607769 - DNA, 25 bp, Homo sapien
atctatggctagtgtttattggtaa

SEQ ID NO: 607770 - DNA, 25 bp, Homo sapien
tgaagagagagcttgttagaaaaat

SEQ ID NO: 607771 - DNA, 25 bp, Homo sapien
ttagaaaaatactttctcatgatgc

SEQ ID NO: 607772 - DNA, 25 bp, Homo sapien
ctttctcatgatgcttgttatttta

SEQ ID NO: 607773 - DNA, 25 bp, Homo sapien
tttctcatgatgcttgttattttag

SEQ ID NO: 607774 - DNA, 25 bp, Homo sapien
ttctcatgatgcttgttattttagt

SEQ ID NO: 607775 - DNA, 25 bp, Homo sapien
tctcatgatgcttgttattttagta

SEQ ID NO: 607776 - DNA, 25 bp, Homo sapien
ctcatgatgcttgttattttagtag

SEQ ID NO: 607777 - DNA, 25 bp, Homo sapien
catgatgcttgttattttagtagaa

SEQ ID NO: 607778 - DNA, 25 bp, Homo sapien
gatgcttgttattttagtagaactt

SEQ ID NO: 607779 - DNA, 25 bp, Homo sapien
gcttgttattttagtagaacttcaa

SEQ ID NO: 607780 - DNA, 25 bp, Homo sapien
gtagaacttcaaataatgatattac

SEQ ID NO: 607781 - DNA, 25 bp, Homo sapien
ttgaaaatacaaaaggccgggcgtg

SEQ ID NO: 607782 - DNA, 25 bp, Homo sapien
tgaaaatacaaaaggccgggcgtgg

SEQ ID NO: 607783 - DNA, 25 bp, Homo sapien
caagatggtaaaaccctgtgtctac

SEQ ID NO: 607784 - DNA, 25 bp, Homo sapien
aagatggtaaaaccctgtgtctact

SEQ ID NO: 607785 - DNA, 25 bp, Homo sapien
agatggtaaaaccctgtgtctacta

SEQ ID NO: 607786 - DNA, 25 bp, Homo sapien
cagccaggcatggtgacgggcacct

SEQ ID NO: 607787 - DNA, 25 bp, Homo sapien
agccaggcatggtgacgggcacctg

SEQ ID NO: 607788 - DNA, 25 bp, Homo sapien
gccaggcatggtgacgggcacctgt

SEQ ID NO: 607789 - DNA, 25 bp, Homo sapien
ggaagtttcagtgagccgaggtggt

SEQ ID NO: 607790 - DNA, 25 bp, Homo sapien
aagtttcagtgagccgaggtggtgc

SEQ ID NO: 607791 - DNA, 25 bp, Homo sapien
agtttcagtgagccgaggtggtgcc

SEQ ID NO: 607792 - DNA, 25 bp, Homo sapien
tactgaaaaaatttcgccagcccaa

SEQ ID NO: 607793 - DNA, 25 bp, Homo sapien
tcgccagcccaactttgctagaaaa

SEQ ID NO: 607794 - DNA, 25 bp, Homo sapien
gggagttgtactgggcataatcatt

SEQ ID NO: 607795 - DNA, 25 bp, Homo sapien
gggcataatcattccagttaccgta

SEQ ID NO: 607796 - DNA, 25 bp, Homo sapien
tcattccagttaccgtatactactc

SEQ ID NO: 607797 - DNA, 25 bp, Homo sapien
gcctatgctacaatcggcagatgga

SEQ ID NO: 607798 - DNA, 25 bp, Homo sapien
taggagccatgatctctcagattgc

SEQ ID NO: 607799 - DNA, 25 bp, Homo sapien
gatctctcagattgcaggtctcatt

SEQ ID NO: 607800 - DNA, 25 bp, Homo sapien
gtactaacatcatactactcttttg

SEQ ID NO: 607801 - DNA, 25 bp, Homo sapien
actcttttgtaagccatctgagaaa

SEQ ID NO: 607802 - DNA, 25 bp, Homo sapien
gaaaaataagaacctgtacgtccat

SEQ ID NO: 607803 - DNA, 25 bp, Homo sapien
ctcgtactgagaggaggtgataccg

SEQ ID NO: 607804 - DNA, 25 bp, Homo sapien
tagggctgatggtgcgcactcctta

SEQ ID NO: 607805 - DNA, 25 bp, Homo sapien
gatggtgcgcactccttaaagagga

SEQ ID NO: 607806 - DNA, 25 bp, Homo sapien
ctccttaaagaggactatttagcct

SEQ ID NO: 607807 - DNA, 25 bp, Homo sapien
tcagccccacccgataattttattt

SEQ ID NO: 607808 - DNA, 25 bp, Homo sapien
taatataatgattcccttgcccagc

SEQ ID NO: 607809 - DNA, 25 bp, Homo sapien
tataatgattcccttgcccagcttg

SEQ ID NO: 607810 - DNA, 25 bp, Homo sapien
gggcatggcattaacactgtctgac

SEQ ID NO: 607811 - DNA, 25 bp, Homo sapien
attaacactgtctgacacagccagc

SEQ ID NO: 607812 - DNA, 25 bp, Homo sapien
ctgacgttttcctgcaaggtgggct

SEQ ID NO: 607813 - DNA, 25 bp, Homo sapien
taataaagggaaggctttcaggagc

SEQ ID NO: 607814 - DNA, 25 bp, Homo sapien
gagtgtgatcctcagaaggttactt

SEQ ID NO: 607815 - DNA, 25 bp, Homo sapien
gcatagtgttcctattgcttgctgc

SEQ ID NO: 607816 - DNA, 25 bp, Homo sapien
gtgtactttggagtaatctaccacc

SEQ ID NO: 607817 - DNA, 25 bp, Homo sapien
atagcccagctgaattatttagaga

SEQ ID NO: 607818 - DNA, 25 bp, Homo sapien
tatttagagatcctggtggtgctcc

SEQ ID NO: 607819 - DNA, 25 bp, Homo sapien
gtgctcctttcctacactctgaaga

SEQ ID NO: 607820 - DNA, 25 bp, Homo sapien
gaagaccactttccagattgggctg

SEQ ID NO: 607821 - DNA, 25 bp, Homo sapien
agattgggctgctgcggatcatttc

SEQ ID NO: 607822 - DNA, 25 bp, Homo sapien
catttcttttcttccataactctgc

SEQ ID NO: 607823 - DNA, 25 bp, Homo sapien
ttccataactctgccgtatgcatga

SEQ ID NO: 607824 - DNA, 25 bp, Homo sapien
gggtcaccagtattaacttccttct

SEQ ID NO: 607825 - DNA, 25 bp, Homo sapien
taggatctcagaatcattgtttact

SEQ ID NO: 607826 - DNA, 25 bp, Homo sapien
gaatcattgtttactatcccttatt

SEQ ID NO: 607827 - DNA, 25 bp, Homo sapien
aaatgtgtatgttctacctccaacg

SEQ ID NO: 607828 - DNA, 25 bp, Homo sapien
tgttctacctccaacggaaatgttt

SEQ ID NO: 607829 - DNA, 25 bp, Homo sapien
aggtcaagacttaattcaattcaga

SEQ ID NO: 607830 - DNA, 25 bp, Homo sapien
aagaccaaagttgcttgacttcaat

SEQ ID NO: 607831 - DNA, 25 bp, Homo sapien
gttgcttgacttcaattcctgtgca

SEQ ID NO: 607832 - DNA, 25 bp, Homo sapien
aattcctgtgcattagtgtgatgat

SEQ ID NO: 607833 - DNA, 25 bp, Homo sapien
gatttctgtcacatagcagcattcc

SEQ ID NO: 607834 - DNA, 25 bp, Homo sapien
gcagcattccgattctatgtaactg

SEQ ID NO: 607835 - DNA, 25 bp, Homo sapien
ggagatgataagtgctttcccctct

SEQ ID NO: 607836 - DNA, 25 bp, Homo sapien
atatgacttgtcaaagccgaaagac

SEQ ID NO: 607837 - DNA, 25 bp, Homo sapien
caaagccgaaagacacatagaatag

SEQ ID NO: 607838 - DNA, 25 bp, Homo sapien
gctttaccttcagtggcaagtattt

SEQ ID NO: 607839 - DNA, 25 bp, Homo sapien
accttcagtggcaagtatttgagtc

SEQ ID NO: 607840 - DNA, 25 bp, Homo sapien
cagtggcaagtatttgagtcaatat

SEQ ID NO: 607841 - DNA, 25 bp, Homo sapien
ttgagtcaatatcatcaagtgtgtt

SEQ ID NO: 607842 - DNA, 25 bp, Homo sapien
aaatgtttataaataggtcccagca

SEQ ID NO: 607843 - DNA, 25 bp, Homo sapien
gtttataaataggtcccagcatttt

SEQ ID NO: 607844 - DNA, 25 bp, Homo sapien
cccagcatttttgagagacccttct

SEQ ID NO: 607845 - DNA, 25 bp, Homo sapien
agcatttttgagagacccttctggg

SEQ ID NO: 607846 - DNA, 25 bp, Homo sapien
gtgaggtgcattgactcacgcctgt

SEQ ID NO: 607847 - DNA, 25 bp, Homo sapien
aacaatattgagtcatctaacatat

SEQ ID NO: 607848 - DNA, 25 bp, Homo sapien
gagtcatctaacatatgatcatgga

SEQ ID NO: 607849 - DNA, 25 bp, Homo sapien
gatcatggaaattgctccatttatt

SEQ ID NO: 607850 - DNA, 25 bp, Homo sapien
ttctttcacatcttgaagcagtgtt

SEQ ID NO: 607851 - DNA, 25 bp, Homo sapien
cacatcttgaagcagtgttttgcgt

SEQ ID NO: 607852 - DNA, 25 bp, Homo sapien
cttgaagcagtgttttgcgttttca

SEQ ID NO: 607853 - DNA, 25 bp, Homo sapien
gcagtgttttgcgttttcagtgtat

SEQ ID NO: 607854 - DNA, 25 bp, Homo sapien
gtgttttgcgttttcagtgtatagg

SEQ ID NO: 607855 - DNA, 25 bp, Homo sapien
gcgttttcagtgtataggtatttaa

SEQ ID NO: 607856 - DNA, 25 bp, Homo sapien
gatccctaaatattcaatgtttttg

SEQ ID NO: 607857 - DNA, 25 bp, Homo sapien
atgtttttgatgctattggaatttt

SEQ ID NO: 607858 - DNA, 25 bp, Homo sapien
acctgctgccttactctagaaagag

SEQ ID NO: 607859 - DNA, 25 bp, Homo sapien
aaagagtaggcaagttgcgccctct

SEQ ID NO: 607860 - DNA, 25 bp, Homo sapien
agttgcgccctctagtggcttagta

SEQ ID NO: 607861 - DNA, 25 bp, Homo sapien
gtggcttagtagttgcttgtcctat

SEQ ID NO: 607862 - DNA, 25 bp, Homo sapien
gttgcttgtcctattgactcagaac

SEQ ID NO: 607863 - DNA, 25 bp, Homo sapien
aatacagatagatggtccctgccct

SEQ ID NO: 607864 - DNA, 25 bp, Homo sapien
tgccctctgatggttccacttagga

SEQ ID NO: 607865 - DNA, 25 bp, Homo sapien
ccacttaggacttactgacttcact

SEQ ID NO: 607866 - DNA, 25 bp, Homo sapien
gacttactgacttcactgatggatg

SEQ ID NO: 607867 - DNA, 25 bp, Homo sapien
gaggaagcgatatgcattctgcaga

SEQ ID NO: 607868 - DNA, 25 bp, Homo sapien
gcagaatctgtacttggaggcccca

SEQ ID NO: 607869 - DNA, 25 bp, Homo sapien
aagggaccctagaaatcttcagcca

SEQ ID NO: 607870 - DNA, 25 bp, Homo sapien
gggaccctagaaatcttcagccatc

SEQ ID NO: 607871 - DNA, 25 bp, Homo sapien
ctagaaatcttcagccatccaaaag

SEQ ID NO: 607872 - DNA, 25 bp, Homo sapien
atcttcagccatccaaaagaaggca

SEQ ID NO: 607873 - DNA, 25 bp, Homo sapien
gatggtagaaatcacttcaagttgg

SEQ ID NO: 607874 - DNA, 25 bp, Homo sapien
aatcacttcaagttggtaatcacaa

SEQ ID NO: 607875 - DNA, 25 bp, Homo sapien
taaacacatccattaaaaggctatg

SEQ ID NO: 607876 - DNA, 25 bp, Homo sapien
tgcccaccatactatccttgaaaat

SEQ ID NO: 607877 - DNA, 25 bp, Homo sapien
ccatactatccttgaaaatctctaa

SEQ ID NO: 607878 - DNA, 25 bp, Homo sapien
aaatctctaatcttcaagccttcag

SEQ ID NO: 607879 - DNA, 25 bp, Homo sapien
tgatttgaaacaaaagggaccctag

SEQ ID NO: 607880 - DNA, 25 bp, Homo sapien
gatggttaaaaagcccacctggtgt

SEQ ID NO: 607881 - DNA, 25 bp, Homo sapien
ctctctttgttcctccaggagacgg

SEQ ID NO: 607882 - DNA, 25 bp, Homo sapien
tccaggagacggtctgtctgtgctg

SEQ ID NO: 607883 - DNA, 25 bp, Homo sapien
gtctgtgctggtagtgagctctaca

SEQ ID NO: 607884 - DNA, 25 bp, Homo sapien
tagcctggtattccacctatgactt

SEQ ID NO: 607885 - DNA, 25 bp, Homo sapien
gtattccacctatgacttctcaaca

SEQ ID NO: 607886 - DNA, 25 bp, Homo sapien
aacacactggactgagcatttgccc

SEQ ID NO: 607887 - DNA, 25 bp, Homo sapien
gagcatttgccctgagctaagcagc

SEQ ID NO: 607888 - DNA, 25 bp, Homo sapien
gagctaagcagcaaacaaggcagac

SEQ ID NO: 607889 - DNA, 25 bp, Homo sapien
tcagccagacctcttgactgcgagt

SEQ ID NO: 607890 - DNA, 25 bp, Homo sapien
cttgactgcgagtctcagatttttt

SEQ ID NO: 607891 - DNA, 25 bp, Homo sapien
ggaaactgatgatagatcgcattag

SEQ ID NO: 607892 - DNA, 25 bp, Homo sapien
gatagatcgcattagatgccaagaa

SEQ ID NO: 607893 - DNA, 25 bp, Homo sapien
gatgccaagaaattattgtctgttt

SEQ ID NO: 607894 - DNA, 25 bp, Homo sapien
attgtctgtttgattagatgtgcta

SEQ ID NO: 607895 - DNA, 25 bp, Homo sapien
gtgctaatggcactgtgattgtgta

SEQ ID NO: 607896 - DNA, 25 bp, Homo sapien
gattgtgtaaggaaatttccgtact

SEQ ID NO: 607897 - DNA, 25 bp, Homo sapien
tgcagcattcaggatgaaatgactt

SEQ ID NO: 607898 - DNA, 25 bp, Homo sapien
tgacttgatgtctgggattcacctt

SEQ ID NO: 607899 - DNA, 25 bp, Homo sapien
gatgtctgggattcaccttaaaata

SEQ ID NO: 607900 - DNA, 25 bp, Homo sapien
caatgatgtaacaatgtggcaaact

SEQ ID NO: 607901 - DNA, 25 bp, Homo sapien
gtggcaaactttgttaattgttgat

SEQ ID NO: 607902 - DNA, 25 bp, Homo sapien
acacatgtcacttgggaagcaacgt

SEQ ID NO: 607903 - DNA, 25 bp, Homo sapien
tgggaagcaacgtaagtatcacatt

SEQ ID NO: 607904 - DNA, 25 bp, Homo sapien
gtatcacattattttttgccaccct

SEQ ID NO: 607905 - DNA, 25 bp, Homo sapien
tttgccaccctttcatcataaatgg

SEQ ID NO: 607906 - DNA, 25 bp, Homo sapien
gccaccctttcatcataaatggaag

SEQ ID NO: 607907 - DNA, 25 bp, Homo sapien
gttataatgagataaaccaggtctg

SEQ ID NO: 607908 - DNA, 25 bp, Homo sapien
ttgttcttataaatctgcagttata

SEQ ID NO: 607909 - DNA, 25 bp, Homo sapien
atctgcagttatatggagtatttag

SEQ ID NO: 607910 - DNA, 25 bp, Homo sapien
ttcttcagttttaatacctcaaact

SEQ ID NO: 607911 - DNA, 25 bp, Homo sapien
cctcaaactgttttttgcacttcag

SEQ ID NO: 607912 - DNA, 25 bp, Homo sapien
gggtaaggtctgatgacatgtaaaa

SEQ ID NO: 607913 - DNA, 25 bp, Homo sapien
atggtacccagacacacccagttac

SEQ ID NO: 607914 - DNA, 25 bp, Homo sapien
gtggaagactacactgatctgacta

SEQ ID NO: 607915 - DNA, 25 bp, Homo sapien
gatctgactaccattcaggtcactg

SEQ ID NO: 607916 - DNA, 25 bp, Homo sapien
aggtcactgatgaccgcagcgtttg

SEQ ID NO: 607917 - DNA, 25 bp, Homo sapien
gggctggccattgccgccattgtaa

SEQ ID NO: 607918 - DNA, 25 bp, Homo sapien
gccattgccgccattgtaattggca

SEQ ID NO: 607919 - DNA, 25 bp, Homo sapien
ttgtaattggcattgtcgccctggc

SEQ ID NO: 607920 - DNA, 25 bp, Homo sapien
ctggctgcctgcgtcggctgttgct

SEQ ID NO: 607921 - DNA, 25 bp, Homo sapien
agccaagctgtcctgatgcagatga

SEQ ID NO: 607922 - DNA, 25 bp, Homo sapien
tgatgcagatgaaggcacccaatga

SEQ ID NO: 607923 - DNA, 25 bp, Homo sapien
gatgaaggcacccaatgagtgttaa

SEQ ID NO: 607924 - DNA, 25 bp, Homo sapien
ttctactttctgtggacacagagta

SEQ ID NO: 607925 - DNA, 25 bp, Homo sapien
gggacattaaatatgcccttcaaat

SEQ ID NO: 607926 - DNA, 25 bp, Homo sapien
gtaaacgagatttaacatgatgtct

SEQ ID NO: 607927 - DNA, 25 bp, Homo sapien
acatgatgtcttttatgctcctaaa

SEQ ID NO: 607928 - DNA, 25 bp, Homo sapien
ttatgctcctaaaacatcttttttc

SEQ ID NO: 607929 - DNA, 25 bp, Homo sapien
catcttttttcaaactccattcctt

SEQ ID NO: 607930 - DNA, 25 bp, Homo sapien
actccattccttagaacattcttct

SEQ ID NO: 607931 - DNA, 25 bp, Homo sapien
cattcttctactgagatgatccaag

SEQ ID NO: 607932 - DNA, 25 bp, Homo sapien
gatccaagaccaaaagtgttctttg

SEQ ID NO: 607933 - DNA, 25 bp, Homo sapien
gtgttctttggtacttgcttataaa

SEQ ID NO: 607934 - DNA, 25 bp, Homo sapien
aaagtgatagtacatgttagcatat

SEQ ID NO: 607935 - DNA, 25 bp, Homo sapien
tttagaattagtaagctatccaact

SEQ ID NO: 607936 - DNA, 25 bp, Homo sapien
gtaagctatccaactaaggtcaagt

SEQ ID NO: 607937 - DNA, 25 bp, Homo sapien
gctatccaactaaggtcaagttcaa

SEQ ID NO: 607938 - DNA, 25 bp, Homo sapien
tccaactaaggtcaagttcaagaat

SEQ ID NO: 607939 - DNA, 25 bp, Homo sapien
gttcaagaatattttaagagttact

SEQ ID NO: 607940 - DNA, 25 bp, Homo sapien
atagagatagctaggcatggtaact

SEQ ID NO: 607941 - DNA, 25 bp, Homo sapien
gatagctaggcatggtaacttgtgc

SEQ ID NO: 607942 - DNA, 25 bp, Homo sapien
ggattgtcttaagcccgggacttca

SEQ ID NO: 607943 - DNA, 25 bp, Homo sapien
ttaagcccgggacttcaatgctgca

SEQ ID NO: 607944 - DNA, 25 bp, Homo sapien
aagcccgggacttcaatgctgcagt

SEQ ID NO: 607945 - DNA, 25 bp, Homo sapien
ctgtgaaataaaggagaccccatct

SEQ ID NO: 607946 - DNA, 25 bp, Homo sapien
gagcagaaacctgagggataagaag

SEQ ID NO: 607947 - DNA, 25 bp, Homo sapien
gcatgacaggcagaaggcacagcaa

SEQ ID NO: 607948 - DNA, 25 bp, Homo sapien
gcacagcaaaagcaccgtcctggac

SEQ ID NO: 607949 - DNA, 25 bp, Homo sapien
agcaaaagcaccgtcctggaccaag

SEQ ID NO: 607950 - DNA, 25 bp, Homo sapien
aaaagcaccgtcctggaccaagctc

SEQ ID NO: 607951 - DNA, 25 bp, Homo sapien
accgtcctggaccaagctcagtgag

SEQ ID NO: 607952 - DNA, 25 bp, Homo sapien
gtcctggaccaagctcagtgaggag

SEQ ID NO: 607953 - DNA, 25 bp, Homo sapien
tggaccaagctcagtgaggaggcca

SEQ ID NO: 607954 - DNA, 25 bp, Homo sapien
ctgctggagcggagagccaaaggga

SEQ ID NO: 607955 - DNA, 25 bp, Homo sapien
aagggaagcctcgatggtgcctctg

SEQ ID NO: 607956 - DNA, 25 bp, Homo sapien
gggaagcctcgatggtgcctctgcc

SEQ ID NO: 607957 - DNA, 25 bp, Homo sapien
gggattgcagccaaaagacaattct

SEQ ID NO: 607958 - DNA, 25 bp, Homo sapien
agacaattctactctttgctccact

SEQ ID NO: 607959 - DNA, 25 bp, Homo sapien
ttgctccactgtagaaaaggttcct

SEQ ID NO: 607960 - DNA, 25 bp, Homo sapien
ggttccttgggcttaaagcaagatg

SEQ ID NO: 607961 - DNA, 25 bp, Homo sapien
gcctggaatcctgatattttggtta

SEQ ID NO: 607962 - DNA, 25 bp, Homo sapien
taggtcattaaaatcagtctttctg

SEQ ID NO: 607963 - DNA, 25 bp, Homo sapien
tcagtctttctgatatgtcagtaaa

SEQ ID NO: 607964 - DNA, 25 bp, Homo sapien
ttagatcaacatttgccatttccaa

SEQ ID NO: 607965 - DNA, 25 bp, Homo sapien
tgccatttccaagtaacataagaag

SEQ ID NO: 607966 - DNA, 25 bp, Homo sapien
atttgaggtgtcacaaaacatttga

SEQ ID NO: 607967 - DNA, 25 bp, Homo sapien
gaaatttcttgctttacaaacaagt

SEQ ID NO: 607968 - DNA, 25 bp, Homo sapien
aatatgtggttatgggactgcccgt

SEQ ID NO: 607969 - DNA, 25 bp, Homo sapien
gggactgcccgttgccggaagaaat

SEQ ID NO: 607970 - DNA, 25 bp, Homo sapien
gcagccccagcattatgcagagact

SEQ ID NO: 607971 - DNA, 25 bp, Homo sapien
gccggaagaaatgtcgcagccaaga

SEQ ID NO: 607972 - DNA, 25 bp, Homo sapien
ggaagatgtcccaacacctatgcat

SEQ ID NO: 607973 - DNA, 25 bp, Homo sapien
acacctatgcatgctgtttgagaaa

SEQ ID NO: 607974 - DNA, 25 bp, Homo sapien
gaaacgcagtagtgctggtccctag

SEQ ID NO: 607975 - DNA, 25 bp, Homo sapien
tggtccctagagtcgctggaagtag

SEQ ID NO: 607976 - DNA, 25 bp, Homo sapien
gagacttgtgctgctattagccgtt

SEQ ID NO: 607977 - DNA, 25 bp, Homo sapien
attagccgtttctcttctactctat

SEQ ID NO: 607978 - DNA, 25 bp, Homo sapien
tactctatcaagatcttccagtgag

SEQ ID NO: 607979 - DNA, 25 bp, Homo sapien
agcagcgcagcaacaggcacccggt

SEQ ID NO: 607980 - DNA, 25 bp, Homo sapien
gcagcaacaggcacccggttgccgg

SEQ ID NO: 607981 - DNA, 25 bp, Homo sapien
acgctcgttccctgtgcattttgtt

SEQ ID NO: 607982 - DNA, 25 bp, Homo sapien
aagtgtacaactcagtagctttagc

SEQ ID NO: 607983 - DNA, 25 bp, Homo sapien
aactcagtagctttagcgtgttcac

SEQ ID NO: 607984 - DNA, 25 bp, Homo sapien
gtagctttagcgtgttcacaataga

SEQ ID NO: 607985 - DNA, 25 bp, Homo sapien
tagcgtgttcacaatagagtggaac

SEQ ID NO: 607986 - DNA, 25 bp, Homo sapien
agagtggaaccattaccgctaatta

SEQ ID NO: 607987 - DNA, 25 bp, Homo sapien
gaaccattaccgctaattacagcac

SEQ ID NO: 607988 - DNA, 25 bp, Homo sapien
cgctaattacagcacatttccatca

SEQ ID NO: 607989 - DNA, 25 bp, Homo sapien
tctctgtggattttcctgccctgga

SEQ ID NO: 607990 - DNA, 25 bp, Homo sapien
gtcatgaaaatactcaagcagcctt

SEQ ID NO: 607991 - DNA, 25 bp, Homo sapien
aagcagccttatggagtgctccaca

SEQ ID NO: 607992 - DNA, 25 bp, Homo sapien
tggagtgctccacatgacaagggat

SEQ ID NO: 607993 - DNA, 25 bp, Homo sapien
aggcctcccaccaatagccatggga

SEQ ID NO: 607994 - DNA, 25 bp, Homo sapien
gccatgggagtgtgcaatcttgaaa

SEQ ID NO: 607995 - DNA, 25 bp, Homo sapien
ttgaaagctggtccttcaattccag

SEQ ID NO: 607996 - DNA, 25 bp, Homo sapien
ttcaattccagccaagcattcacat

SEQ ID NO: 607997 - DNA, 25 bp, Homo sapien
agccaagcattcacatgaccgcaat

SEQ ID NO: 607998 - DNA, 25 bp, Homo sapien
acatgaccgcaatcctagctgatct

SEQ ID NO: 607999 - DNA, 25 bp, Homo sapien
aatcctagctgatctcgcttgtgac

SEQ ID NO: 608000 - DNA, 25 bp, Homo sapien
tcgcttgtgacctctatgggagacc

SEQ ID NO: 608001 - DNA, 25 bp, Homo sapien
gaggccaaggcgggtcaatcacctg

SEQ ID NO: 608002 - DNA, 25 bp, Homo sapien
aggccaaggcgggtcaatcacctga

SEQ ID NO: 608003 - DNA, 25 bp, Homo sapien
ggccaaggcgggtcaatcacctgag

SEQ ID NO: 608004 - DNA, 25 bp, Homo sapien
gccaaggcgggtcaatcacctgagg

SEQ ID NO: 608005 - DNA, 25 bp, Homo sapien
aaaaatgcaaaaagttagccaggca

SEQ ID NO: 608006 - DNA, 25 bp, Homo sapien
aaaatgcaaaaagttagccaggcat

SEQ ID NO: 608007 - DNA, 25 bp, Homo sapien
aaatgcaaaaagttagccaggcatg

SEQ ID NO: 608008 - DNA, 25 bp, Homo sapien
aatgcaaaaagttagccaggcatgg

SEQ ID NO: 608009 - DNA, 25 bp, Homo sapien
atgcaaaaagttagccaggcatggt

SEQ ID NO: 608010 - DNA, 25 bp, Homo sapien
ggaaagcagcatccttgaaaatcat

SEQ ID NO: 608011 - DNA, 25 bp, Homo sapien
gcatccttgaaaatcatcgctctca

SEQ ID NO: 608012 - DNA, 25 bp, Homo sapien
tgaaaatcatcgctctcaggacggg

SEQ ID NO: 608013 - DNA, 25 bp, Homo sapien
ggtctgcctggaatagcactgaatg

SEQ ID NO: 608014 - DNA, 25 bp, Homo sapien
atgtgtttagtagtgcctttggctt

SEQ ID NO: 608015 - DNA, 25 bp, Homo sapien
tggagaaagctgcttgagcccttcc

SEQ ID NO: 608016 - DNA, 25 bp, Homo sapien
gcttgagcccttcccatgctcataa

SEQ ID NO: 608017 - DNA, 25 bp, Homo sapien
cagtgaggaagtgtctacagcaacc

SEQ ID NO: 608018 - DNA, 25 bp, Homo sapien
aatgtgatgtgcctctacagctgta

SEQ ID NO: 608019 - DNA, 25 bp, Homo sapien
gatgtgcctctacagctgtatgaag

SEQ ID NO: 608020 - DNA, 25 bp, Homo sapien
tacagctgtatgaagtagattctct

SEQ ID NO: 608021 - DNA, 25 bp, Homo sapien
aggctgtagtgacccttgatcagct

SEQ ID NO: 608022 - DNA, 25 bp, Homo sapien
gctgtagtgacccttgatcagctcc

SEQ ID NO: 608023 - DNA, 25 bp, Homo sapien
ctgtagtgacccttgatcagctcca

SEQ ID NO: 608024 - DNA, 25 bp, Homo sapien
tgtagtgacccttgatcagctccac

SEQ ID NO: 608025 - DNA, 25 bp, Homo sapien
gtagtgacccttgatcagctccact

SEQ ID NO: 608026 - DNA, 25 bp, Homo sapien
tagtgacccttgatcagctccactg

SEQ ID NO: 608027 - DNA, 25 bp, Homo sapien
agtgacccttgatcagctccactgc

SEQ ID NO: 608028 - DNA, 25 bp, Homo sapien
gtgacccttgatcagctccactgca

SEQ ID NO: 608029 - DNA, 25 bp, Homo sapien
tgacccttgatcagctccactgcat

SEQ ID NO: 608030 - DNA, 25 bp, Homo sapien
cttgatcagctccactgcataccag

SEQ ID NO: 608031 - DNA, 25 bp, Homo sapien
ttgatcagctccactgcataccagc

SEQ ID NO: 608032 - DNA, 25 bp, Homo sapien
tacttgacgaacatgatacctggct

SEQ ID NO: 608033 - DNA, 25 bp, Homo sapien
ttgacgaacatgatacctggctctc

SEQ ID NO: 608034 - DNA, 25 bp, Homo sapien
acgaacatgatacctggctctccta

SEQ ID NO: 608035 - DNA, 25 bp, Homo sapien
atgatacctggctctcctacaagtc

SEQ ID NO: 608036 - DNA, 25 bp, Homo sapien
agtcccactgaattggagtttcagg

SEQ ID NO: 608037 - DNA, 25 bp, Homo sapien
tggagtttcaggagaccgaagccca

SEQ ID NO: 608038 - DNA, 25 bp, Homo sapien
tttcaggagaccgaagcccaggcac

SEQ ID NO: 608039 - DNA, 25 bp, Homo sapien
gaccgaagcccaggcacatgtattt

SEQ ID NO: 608040 - DNA, 25 bp, Homo sapien
gtattttgcaaaactacactgaagt

SEQ ID NO: 608041 - DNA, 25 bp, Homo sapien
cactgaagtttctgataatgacgga

SEQ ID NO: 608042 - DNA, 25 bp, Homo sapien
atcaacaattaaacgcttacttctt

SEQ ID NO: 608043 - DNA, 25 bp, Homo sapien
agtgctagctcccttttgctcttgt

SEQ ID NO: 608044 - DNA, 25 bp, Homo sapien
ttttgctcttgtccattgttccctg

SEQ ID NO: 608045 - DNA, 25 bp, Homo sapien
attgttccctgtcgcccatttggaa

SEQ ID NO: 608046 - DNA, 25 bp, Homo sapien
tccctgtcgcccatttggaagagaa

SEQ ID NO: 608047 - DNA, 25 bp, Homo sapien
tcgcccatttggaagagaacgcagg

SEQ ID NO: 608048 - DNA, 25 bp, Homo sapien
gggtccataaagtaatagcagaagg

SEQ ID NO: 608049 - DNA, 25 bp, Homo sapien
gaagggatatactctgacatgatgg

SEQ ID NO: 608050 - DNA, 25 bp, Homo sapien
gaagagatgggtgcccttcttcaaa

SEQ ID NO: 608051 - DNA, 25 bp, Homo sapien
atgggtgcccttcttcaaaggcagg

SEQ ID NO: 608052 - DNA, 25 bp, Homo sapien
gcccttcttcaaaggcagggaagta

SEQ ID NO: 608053 - DNA, 25 bp, Homo sapien
tgagtgagggttaagccctttgccc

SEQ ID NO: 608054 - DNA, 25 bp, Homo sapien
ggctgtatccagtgctttgaaggaa

SEQ ID NO: 608055 - DNA, 25 bp, Homo sapien
ggctaactctatgtagaaaccctta

SEQ ID NO: 608056 - DNA, 25 bp, Homo sapien
cagtaggtgacagaccaactggtct

SEQ ID NO: 608057 - DNA, 25 bp, Homo sapien
ggtctctaggaccagttatgtctgt

SEQ ID NO: 608058 - DNA, 25 bp, Homo sapien
ttatgtctgttcctttcaaatccct

SEQ ID NO: 608059 - DNA, 25 bp, Homo sapien
tcaaatcccttgtatcttcaacacg

SEQ ID NO: 608060 - DNA, 25 bp, Homo sapien
aaactaccttttctattctgctaga

SEQ ID NO: 608061 - DNA, 25 bp, Homo sapien
agatgtccatgtaaaatgacgcccc

SEQ ID NO: 608062 - DNA, 25 bp, Homo sapien
attaatctgtttctggttctctgag

SEQ ID NO: 608063 - DNA, 25 bp, Homo sapien
gagcactctgttctatcagtgacaa

SEQ ID NO: 608064 - DNA, 25 bp, Homo sapien
aggttgtgacaggtatcatctttgc

SEQ ID NO: 608065 - DNA, 25 bp, Homo sapien
cagaaccagcgcatcattcacaggg

SEQ ID NO: 608066 - DNA, 25 bp, Homo sapien
gggatatgaagcctgacaatatttt

SEQ ID NO: 608067 - DNA, 25 bp, Homo sapien
tacttgacgaacatgatacctggct

SEQ ID NO: 608068 - DNA, 25 bp, Homo sapien
tgacgaacatgatacctggctctcc

SEQ ID NO: 608069 - DNA, 25 bp, Homo sapien
atgatacctggctctcctacaagtc

SEQ ID NO: 608070 - DNA, 25 bp, Homo sapien
agtcccactgaattggagtttcagg

SEQ ID NO: 608071 - DNA, 25 bp, Homo sapien
gagtttcaggagaccgaagcccagg

SEQ ID NO: 608072 - DNA, 25 bp, Homo sapien
gaccgaagcccaggcacatgtattt

SEQ ID NO: 608073 - DNA, 25 bp, Homo sapien
gtattttgcaaaactacactgaagt

SEQ ID NO: 608074 - DNA, 25 bp, Homo sapien
cactgaagtttctgataatgacgga

SEQ ID NO: 608075 - DNA, 25 bp, Homo sapien
atcaacaattaaacgcttacttctt

SEQ ID NO: 608076 - DNA, 25 bp, Homo sapien
gggccttactatgcaatgtgtggtc

SEQ ID NO: 608077 - DNA, 25 bp, Homo sapien
gtctgcagacaagcagcctcggtat

SEQ ID NO: 608078 - DNA, 25 bp, Homo sapien
ctcggtatcacccaggaagcatgtt

SEQ ID NO: 608079 - DNA, 25 bp, Homo sapien
agaagcacagaatccctggcttagc

SEQ ID NO: 608080 - DNA, 25 bp, Homo sapien
tagccccagatctatgactcagaat

SEQ ID NO: 608081 - DNA, 25 bp, Homo sapien
tgcatcttaacaaatccccatgtga

SEQ ID NO: 608082 - DNA, 25 bp, Homo sapien
ccccatgtgattggtatacgcctta

SEQ ID NO: 608083 - DNA, 25 bp, Homo sapien
aagtatcgctatcatggtttttccc

SEQ ID NO: 608084 - DNA, 25 bp, Homo sapien
aggactgcaaaacagatcgcctgga

SEQ ID NO: 608085 - DNA, 25 bp, Homo sapien
atcgcctggagagctttttagacta

SEQ ID NO: 608086 - DNA, 25 bp, Homo sapien
ttagactacacaaccctagctagat

SEQ ID NO: 608087 - DNA, 25 bp, Homo sapien
cccgccgcgcgagattaaaggacag

SEQ ID NO: 608088 - DNA, 25 bp, Homo sapien
attaaaggacagaccaagagggcgc

SEQ ID NO: 608089 - DNA, 25 bp, Homo sapien
gccaaggatttggttgggtcctatc

SEQ ID NO: 608090 - DNA, 25 bp, Homo sapien
tggttgggtcctatctctgagacat

SEQ ID NO: 608091 - DNA, 25 bp, Homo sapien
gggtcctatctctgagacattttga

SEQ ID NO: 608092 - DNA, 25 bp, Homo sapien
acattttgaagtctcacaccccttc

SEQ ID NO: 608093 - DNA, 25 bp, Homo sapien
ccttccatttgttgcctattccact

SEQ ID NO: 608094 - DNA, 25 bp, Homo sapien
gttgcctattccacttaactttgta

SEQ ID NO: 608095 - DNA, 25 bp, Homo sapien
atttgtttgaaatctactgttcgga

SEQ ID NO: 608096 - DNA, 25 bp, Homo sapien
atctactgttcggatgctggactag

SEQ ID NO: 608097 - DNA, 25 bp, Homo sapien
gatgctggactagaagagggacact

SEQ ID NO: 608098 - DNA, 25 bp, Homo sapien
aggccaaggccaggagatagcttga

SEQ ID NO: 608099 - DNA, 25 bp, Homo sapien
aggctgtagtgacccttgatcagct

SEQ ID NO: 608100 - DNA, 25 bp, Homo sapien
gctgtagtgacccttgatcagctcc

SEQ ID NO: 608101 - DNA, 25 bp, Homo sapien
ctgtagtgacccttgatcagctcca

SEQ ID NO: 608102 - DNA, 25 bp, Homo sapien
tgtagtgacccttgatcagctccac

SEQ ID NO: 608103 - DNA, 25 bp, Homo sapien
gtagtgacccttgatcagctccact

SEQ ID NO: 608104 - DNA, 25 bp, Homo sapien
tagtgacccttgatcagctccactg

SEQ ID NO: 608105 - DNA, 25 bp, Homo sapien
agtgacccttgatcagctccactgc

SEQ ID NO: 608106 - DNA, 25 bp, Homo sapien
tgacccttgatcagctccactgcat

SEQ ID NO: 608107 - DNA, 25 bp, Homo sapien
cttgatcagctccactgcataccag

SEQ ID NO: 608108 - DNA, 25 bp, Homo sapien
ttgatcagctccactgcataccagc

SEQ ID NO: 608109 - DNA, 25 bp, Homo sapien
gccagttatcattttccagtgtgct

SEQ ID NO: 608110 - DNA, 25 bp, Homo sapien
tttccagtgtgcttaccctgttatt

SEQ ID NO: 608111 - DNA, 25 bp, Homo sapien
ttccagtgtgcttaccctgttattt

SEQ ID NO: 608112 - DNA, 25 bp, Homo sapien
tccagtgtgcttaccctgttatttt

SEQ ID NO: 608113 - DNA, 25 bp, Homo sapien
ccagtgtgcttaccctgttattttt

SEQ ID NO: 608114 - DNA, 25 bp, Homo sapien
cagtgtgcttaccctgttattttta

SEQ ID NO: 608115 - DNA, 25 bp, Homo sapien
agtgtgcttaccctgttatttttat

SEQ ID NO: 608116 - DNA, 25 bp, Homo sapien
gtgtgcttaccctgttatttttatt

SEQ ID NO: 608117 - DNA, 25 bp, Homo sapien
gacctccatagctcaggtgatcccc

SEQ ID NO: 608118 - DNA, 25 bp, Homo sapien
acctccatagctcaggtgatcccca

SEQ ID NO: 608119 - DNA, 25 bp, Homo sapien
gtgatccccacacttcagccacctg

SEQ ID NO: 608120 - DNA, 25 bp, Homo sapien
tgtcctatgacgaattgtgcttcct

SEQ ID NO: 608121 - DNA, 25 bp, Homo sapien
gacgaattgtgcttcctggagcaga

SEQ ID NO: 608122 - DNA, 25 bp, Homo sapien
ttcctggagcagaggccacagagcc

SEQ ID NO: 608123 - DNA, 25 bp, Homo sapien
agagccccaccttggagttcttgct

SEQ ID NO: 608124 - DNA, 25 bp, Homo sapien
ggagttcttgctccggaacagtcag

SEQ ID NO: 608125 - DNA, 25 bp, Homo sapien
tgatggagctctgcaggctctacca

SEQ ID NO: 608126 - DNA, 25 bp, Homo sapien
aggctctaccacagggccgacgtgg

SEQ ID NO: 608127 - DNA, 25 bp, Homo sapien
aagcgggagcgtggagacccctcca

SEQ ID NO: 608128 - DNA, 25 bp, Homo sapien
ggcacttctagagctcttcttcttc

SEQ ID NO: 608129 - DNA, 25 bp, Homo sapien
agctcttcttcttccttcattggcc

SEQ ID NO: 608130 - DNA, 25 bp, Homo sapien
tcattggcctctccggatgttgaaa

SEQ ID NO: 608131 - DNA, 25 bp, Homo sapien
tggaaaccgctgatctgctctctgt

SEQ ID NO: 608132 - DNA, 25 bp, Homo sapien
tctctgtcactgtaatttcgccttc

SEQ ID NO: 608133 - DNA, 25 bp, Homo sapien
tttcgccttctctagaatgtcacat

SEQ ID NO: 608134 - DNA, 25 bp, Homo sapien
tagtatgtaaccttccacatttagc

SEQ ID NO: 608135 - DNA, 25 bp, Homo sapien
atttagcttctttcagtcagccata

SEQ ID NO: 608136 - DNA, 25 bp, Homo sapien
gtcagccatatgcttttcagactta

SEQ ID NO: 608137 - DNA, 25 bp, Homo sapien
gcttttcagacttactcatgttgtt

SEQ ID NO: 608138 - DNA, 25 bp, Homo sapien
caatagttcattcttttcttactga

SEQ ID NO: 608139 - DNA, 25 bp, Homo sapien
gcattccattgtgcttgatgtacat

SEQ ID NO: 608140 - DNA, 25 bp, Homo sapien
gatgtacataatttgcttatccatt

SEQ ID NO: 608141 - DNA, 25 bp, Homo sapien
ttctgtttctggaactcaaatccca

SEQ ID NO: 608142 - DNA, 25 bp, Homo sapien
ccacagatttgtgaggtcttcgatg

SEQ ID NO: 608143 - DNA, 25 bp, Homo sapien
tcttcgatgtagactctgagactgt

SEQ ID NO: 608144 - DNA, 25 bp, Homo sapien
gagactgtgattcatagttcccatg

SEQ ID NO: 608145 - DNA, 25 bp, Homo sapien
catagttcccatgacagcaaagtgg

SEQ ID NO: 608146 - DNA, 25 bp, Homo sapien
ccacctcgggccacgaagaggtagt

SEQ ID NO: 608147 - DNA, 25 bp, Homo sapien
gggtaaaaatcccatacttctgaca

SEQ ID NO: 608148 - DNA, 25 bp, Homo sapien
gtcagattaatattctacaccaggg

SEQ ID NO: 608149 - DNA, 25 bp, Homo sapien
tacaccagggttgtccagtcttttg

SEQ ID NO: 608150 - DNA, 25 bp, Homo sapien
gcttccctgggtcacgctggaataa

SEQ ID NO: 608151 - DNA, 25 bp, Homo sapien
gtcacgctggaataattgtcttggg

SEQ ID NO: 608152 - DNA, 25 bp, Homo sapien
ggcaacacataaaacacactaacaa

SEQ ID NO: 608153 - DNA, 25 bp, Homo sapien
gacaatcttcgccagattctggact

SEQ ID NO: 608154 - DNA, 25 bp, Homo sapien
cgccagattctggacttcagtctac

SEQ ID NO: 608155 - DNA, 25 bp, Homo sapien
gacttcagtctacattatttccagg

SEQ ID NO: 608156 - DNA, 25 bp, Homo sapien
tatttccagggatctattgattaaa

SEQ ID NO: 608157 - DNA, 25 bp, Homo sapien
ggaacaaacctgaaacatgcatcaa

SEQ ID NO: 608158 - DNA, 25 bp, Homo sapien
tgcatcaatctcaaagtgacctaga

SEQ ID NO: 608159 - DNA, 25 bp, Homo sapien
aagtgacctagagtcattgactttg

SEQ ID NO: 608160 - DNA, 25 bp, Homo sapien
ttggtgaatatccagacattttgag

SEQ ID NO: 608161 - DNA, 25 bp, Homo sapien
agacattttgagacctgttgcaccc

SEQ ID NO: 608162 - DNA, 25 bp, Homo sapien
agacctgttgcaccccaaatttaat

SEQ ID NO: 608163 - DNA, 25 bp, Homo sapien
gatcactgtagaagtatgactatca

SEQ ID NO: 608164 - DNA, 25 bp, Homo sapien
gaacgcccagagaacaagcactgtg

SEQ ID NO: 608165 - DNA, 25 bp, Homo sapien
agaacaagcactgtggaactgctat

SEQ ID NO: 608166 - DNA, 25 bp, Homo sapien
attttcctgttctacccttgatgga

SEQ ID NO: 608167 - DNA, 25 bp, Homo sapien
ttttcaaggtcatgctggccaatta

SEQ ID NO: 608168 - DNA, 25 bp, Homo sapien
gtcatgctggccaattaaggcatca

SEQ ID NO: 608169 - DNA, 25 bp, Homo sapien
taaggcatcatcagtcctacctgag

SEQ ID NO: 608170 - DNA, 25 bp, Homo sapien
gtcctacctgagcaacaagaatcta

SEQ ID NO: 608171 - DNA, 25 bp, Homo sapien
aactttattccaagtcagaaactgt

SEQ ID NO: 608172 - DNA, 25 bp, Homo sapien
cccctgctccatttcgtgacttttt

SEQ ID NO: 608173 - DNA, 25 bp, Homo sapien
ttagaagtgagtgtaatccagcaat

SEQ ID NO: 608174 - DNA, 25 bp, Homo sapien
gtgtaatccagcaatacagtttact

SEQ ID NO: 608175 - DNA, 25 bp, Homo sapien
cttcaacagacaatcaaaccttatt

SEQ ID NO: 608176 - DNA, 25 bp, Homo sapien
aacagacaatcaaaccttattcagc

SEQ ID NO: 608177 - DNA, 25 bp, Homo sapien
gcaaagccttcagtacacaattatt

SEQ ID NO: 608178 - DNA, 25 bp, Homo sapien
tgtgcaaaatcctttagcctgaacc

SEQ ID NO: 608179 - DNA, 25 bp, Homo sapien
gcaaaatcctttagcctgaaccgaa

SEQ ID NO: 608180 - DNA, 25 bp, Homo sapien
aatcctttagcctgaaccgaactct

SEQ ID NO: 608181 - DNA, 25 bp, Homo sapien
ttagcctgaaccgaactcttactgt

SEQ ID NO: 608182 - DNA, 25 bp, Homo sapien
gaaccgaactcttactgtccatcag

SEQ ID NO: 608183 - DNA, 25 bp, Homo sapien
aaatcctttagtcaatgctcacaag

SEQ ID NO: 608184 - DNA, 25 bp, Homo sapien
gtcaatgctcacaagttattcaaca

SEQ ID NO: 608185 - DNA, 25 bp, Homo sapien
gctcacaagttattcaacataagag

SEQ ID NO: 608186 - DNA, 25 bp, Homo sapien
gtgaaaatggcctattcctgcctta

SEQ ID NO: 608187 - DNA, 25 bp, Homo sapien
aaatggcctattcctgccttaactg

SEQ ID NO: 608188 - DNA, 25 bp, Homo sapien
aatggcctattcctgccttaactga

SEQ ID NO: 608189 - DNA, 25 bp, Homo sapien
atggcctattcctgccttaactgat

SEQ ID NO: 608190 - DNA, 25 bp, Homo sapien
tggcctattcctgccttaactgatg

SEQ ID NO: 608191 - DNA, 25 bp, Homo sapien
aactgatgacattatcttgtgaaat

SEQ ID NO: 608192 - DNA, 25 bp, Homo sapien
actgatgacattatcttgtgaaatt

SEQ ID NO: 608193 - DNA, 25 bp, Homo sapien
ctgatgacattatcttgtgaaattc

SEQ ID NO: 608194 - DNA, 25 bp, Homo sapien
tgacattatcttgtgaaattccttc

SEQ ID NO: 608195 - DNA, 25 bp, Homo sapien
caccttgtgaccccccattcctgcc

SEQ ID NO: 608196 - DNA, 25 bp, Homo sapien
ccattcctgcccccccagagaacaa

SEQ ID NO: 608197 - DNA, 25 bp, Homo sapien
cccgtcttgggcactcgcagggact

SEQ ID NO: 608198 - DNA, 25 bp, Homo sapien
actcgcagggactggcgggaggccg

SEQ ID NO: 608199 - DNA, 25 bp, Homo sapien
ggctggaatcgtgaccacggatgcc

SEQ ID NO: 608200 - DNA, 25 bp, Homo sapien
ggaatcgtgaccacggatgccgcaa

SEQ ID NO: 608201 - DNA, 25 bp, Homo sapien
atcgtgaccacggatgccgcaaggc

SEQ ID NO: 608202 - DNA, 25 bp, Homo sapien
cgtgaccacggatgccgcaaggcca

SEQ ID NO: 608203 - DNA, 25 bp, Homo sapien
acggatgccgcaaggccacagggcc

SEQ ID NO: 608204 - DNA, 25 bp, Homo sapien
aacgcgggaagaggccatcgcgtct

SEQ ID NO: 608205 - DNA, 25 bp, Homo sapien
agaggccatcgcgtctggacacctg

SEQ ID NO: 608206 - DNA, 25 bp, Homo sapien
atcgcgtctggacacctgggcttcg

SEQ ID NO: 608207 - DNA, 25 bp, Homo sapien
ggacacctgggcttcgtcccagagc

SEQ ID NO: 608208 - DNA, 25 bp, Homo sapien
atcttcatttcctatgctctcattc

SEQ ID NO: 608209 - DNA, 25 bp, Homo sapien
agcatcttccacattgattccacgg

SEQ ID NO: 608210 - DNA, 25 bp, Homo sapien
tgattccacggagggcaggtccaaa

SEQ ID NO: 608211 - DNA, 25 bp, Homo sapien
ctgcagctcccacataattgcagtt

SEQ ID NO: 608212 - DNA, 25 bp, Homo sapien
gtttctctgttctttgggtcaggag

SEQ ID NO: 608213 - DNA, 25 bp, Homo sapien
gggtcaggagcattcatgtacctca

SEQ ID NO: 608214 - DNA, 25 bp, Homo sapien
attcatgtacctcaaacccttttct

SEQ ID NO: 608215 - DNA, 25 bp, Homo sapien
ttctcttttagctatgaaccagggc

SEQ ID NO: 608216 - DNA, 25 bp, Homo sapien
ttccctattctataccactgtggtg

SEQ ID NO: 608217 - DNA, 25 bp, Homo sapien
gcccatgctcaacccattaatttat

SEQ ID NO: 608218 - DNA, 25 bp, Homo sapien
ggaataaggacgtcaaagttgctct

SEQ ID NO: 608219 - DNA, 25 bp, Homo sapien
tggacctcactcctgctttgaggag

SEQ ID NO: 608220 - DNA, 25 bp, Homo sapien
ggagtttctgggagcagccaaccct

SEQ ID NO: 608221 - DNA, 25 bp, Homo sapien
gagcagccaaccctagagatgatgt

SEQ ID NO: 608222 - DNA, 25 bp, Homo sapien
agatgatgtctgttctttgccacaa

SEQ ID NO: 608223 - DNA, 25 bp, Homo sapien
tatcaagcctcacagaagagtgtct

SEQ ID NO: 608224 - DNA, 25 bp, Homo sapien
gtctgttcacaggaatgacggaatt

SEQ ID NO: 608225 - DNA, 25 bp, Homo sapien
gacggaattctaacatggtggagca

SEQ ID NO: 608226 - DNA, 25 bp, Homo sapien
catggtggagcactattgctggatt

SEQ ID NO: 608227 - DNA, 25 bp, Homo sapien
aagtatattattctctgtcagagtc

SEQ ID NO: 608228 - DNA, 25 bp, Homo sapien
gtaacttgcaaacactcagttggat

SEQ ID NO: 608229 - DNA, 25 bp, Homo sapien
tggattttatactcacatgtggctc

SEQ ID NO: 608230 - DNA, 25 bp, Homo sapien
gaaagcagtctctcaaaagactttg

SEQ ID NO: 608231 - DNA, 25 bp, Homo sapien
ttatgcaaatcatactcctgcccaa

SEQ ID NO: 608232 - DNA, 25 bp, Homo sapien
aatcatactcctgcccaagaaaata

SEQ ID NO: 608233 - DNA, 25 bp, Homo sapien
agttccccttatctgagcagtatat

SEQ ID NO: 608234 - DNA, 25 bp, Homo sapien
gagcagtatatgttctaagacccct

SEQ ID NO: 608235 - DNA, 25 bp, Homo sapien
agacccctagtagattcgcaaacca

SEQ ID NO: 608236 - DNA, 25 bp, Homo sapien
gtagattcgcaaaccacagatagta

SEQ ID NO: 608237 - DNA, 25 bp, Homo sapien
gatagtaccaaactccattcatata

SEQ ID NO: 608238 - DNA, 25 bp, Homo sapien
atatatgatgttttttcttccctta

SEQ ID NO: 608239 - DNA, 25 bp, Homo sapien
cttaaccccactcatatgtatctgt

SEQ ID NO: 608240 - DNA, 25 bp, Homo sapien
ccccactcatatgtatctgtgataa

SEQ ID NO: 608241 - DNA, 25 bp, Homo sapien
aaattctgctgtgcggtgtttgcca

SEQ ID NO: 608242 - DNA, 25 bp, Homo sapien
gtgtttgccaaagtgcctagttcct

SEQ ID NO: 608243 - DNA, 25 bp, Homo sapien
aagtgcctagttcctggcaggtgaa

SEQ ID NO: 608244 - DNA, 25 bp, Homo sapien
agttcctggcaggtgaaggacaacc

SEQ ID NO: 608245 - DNA, 25 bp, Homo sapien
gacaaccgtgtgagacaattgccca

SEQ ID NO: 608246 - DNA, 25 bp, Homo sapien
aagagaatggactgcttggatgatg

SEQ ID NO: 608247 - DNA, 25 bp, Homo sapien
gaagctgacccaggttagggagcaa

SEQ ID NO: 608248 - DNA, 25 bp, Homo sapien
gggagcaatatccacaatggttgta

SEQ ID NO: 608249 - DNA, 25 bp, Homo sapien
atggttgtaatgtttgctggcagca

SEQ ID NO: 608250 - DNA, 25 bp, Homo sapien
gagggatatggtattccttggaatc

SEQ ID NO: 608251 - DNA, 25 bp, Homo sapien
atatgtctgtgcaatcaaggtggag

SEQ ID NO: 608252 - DNA, 25 bp, Homo sapien
agcaatctcactattcccctgtggt

SEQ ID NO: 608253 - DNA, 25 bp, Homo sapien
tattcccctgtggttgccaagacag

SEQ ID NO: 608254 - DNA, 25 bp, Homo sapien
ggttgccaagacagctgaataaatc

SEQ ID NO: 608255 - DNA, 25 bp, Homo sapien
taaatcatccatacatttcagtcct

SEQ ID NO: 608256 - DNA, 25 bp, Homo sapien
acatttcagtcctcttggagtctac

SEQ ID NO: 608257 - DNA, 25 bp, Homo sapien
gtcctcttggagtctacctttcagt

SEQ ID NO: 608258 - DNA, 25 bp, Homo sapien
tgctattttcctcctcttgttacaa

SEQ ID NO: 608259 - DNA, 25 bp, Homo sapien
ttcctcctcttgttacaagcttcag

SEQ ID NO: 608260 - DNA, 25 bp, Homo sapien
tggctctaaactgaactctgacttt

SEQ ID NO: 608261 - DNA, 25 bp, Homo sapien
gaactctgactttgaattcttttat

SEQ ID NO: 608262 - DNA, 25 bp, Homo sapien
gaaatgtaaaaggtcagctccaaga

SEQ ID NO: 608263 - DNA, 25 bp, Homo sapien
tggtatgcccatactacgtatgcag

SEQ ID NO: 608264 - DNA, 25 bp, Homo sapien
gcagaaatttctaagacttgttgat

SEQ ID NO: 608265 - DNA, 25 bp, Homo sapien
gcaagttgtagggagcatatactat

SEQ ID NO: 608266 - DNA, 25 bp, Homo sapien
atagtgattttcagcctcatcagac

SEQ ID NO: 608267 - DNA, 25 bp, Homo sapien
ctcatcagactgaatgccccatttt

SEQ ID NO: 608268 - DNA, 25 bp, Homo sapien
gactgaatgccccattttataacaa

SEQ ID NO: 608269 - DNA, 25 bp, Homo sapien
aatattttgtaatgtctccttcact

SEQ ID NO: 608270 - DNA, 25 bp, Homo sapien
tgtaatgtctccttcacttcaatga

SEQ ID NO: 608271 - DNA, 25 bp, Homo sapien
gataattgcatatgattccacacca

SEQ ID NO: 608272 - DNA, 25 bp, Homo sapien
gcatatgattccacaccatttcaac

SEQ ID NO: 608273 - DNA, 25 bp, Homo sapien
gattccacaccatttcaaccaaaat

SEQ ID NO: 608274 - DNA, 25 bp, Homo sapien
gaaattctgctgtgcggtgtttgcc

SEQ ID NO: 608275 - DNA, 25 bp, Homo sapien
aaattctgctgtgcggtgtttgcca

SEQ ID NO: 608276 - DNA, 25 bp, Homo sapien
tctgctgtgcggtgtttgccaaagt

SEQ ID NO: 608277 - DNA, 25 bp, Homo sapien
tgaaggacaaccgtgtgagacaatt

SEQ ID NO: 608278 - DNA, 25 bp, Homo sapien
gacaaccgtgtgagacaattgccca

SEQ ID NO: 608279 - DNA, 25 bp, Homo sapien
aaccgtgtgagacaattgcccacaa

SEQ ID NO: 608280 - DNA, 25 bp, Homo sapien
gtgtgagacaattgcccacaagaga

SEQ ID NO: 608281 - DNA, 25 bp, Homo sapien
gcccacaagagaatggactgcttgg

SEQ ID NO: 608282 - DNA, 25 bp, Homo sapien
aagagaatggactgcttggatgatg

SEQ ID NO: 608283 - DNA, 25 bp, Homo sapien
ggatatgtctgtgcaatcaaggtgg

SEQ ID NO: 608284 - DNA, 25 bp, Homo sapien
atatgtctgtgcaatcaaggtggag

SEQ ID NO: 608285 - DNA, 25 bp, Homo sapien
gcattcaataaatggcattctgttt

SEQ ID NO: 608286 - DNA, 25 bp, Homo sapien
cattctgttttattaaccatctggt

SEQ ID NO: 608287 - DNA, 25 bp, Homo sapien
taaccatctggttgcctattgttga

SEQ ID NO: 608288 - DNA, 25 bp, Homo sapien
tgcctattgttgaaggtcggctctt

SEQ ID NO: 608289 - DNA, 25 bp, Homo sapien
gaaggtcggctctttaatgtgcaaa

SEQ ID NO: 608290 - DNA, 25 bp, Homo sapien
acttctagataaaatcctttgatgg

SEQ ID NO: 608291 - DNA, 25 bp, Homo sapien
tgatggacatttaagctgtgccaac

SEQ ID NO: 608292 - DNA, 25 bp, Homo sapien
aagctgtgccaactatttactaata

SEQ ID NO: 608293 - DNA, 25 bp, Homo sapien
ccttatagtgttgttatgaaactca

SEQ ID NO: 608294 - DNA, 25 bp, Homo sapien
gggtctagcataaaatgtggagcat

SEQ ID NO: 608295 - DNA, 25 bp, Homo sapien
tgtggagcataataagcattcaata

SEQ ID NO: 608296 - DNA, 25 bp, Homo sapien
aaagcggagtaaatgatgattcagc

SEQ ID NO: 608297 - DNA, 25 bp, Homo sapien
caggccttctggaactgctatgtaa

SEQ ID NO: 608298 - DNA, 25 bp, Homo sapien
gaactgctatgtaaggatgagatgc

SEQ ID NO: 608299 - DNA, 25 bp, Homo sapien
gtttgaggtcaacaatcttattttg

SEQ ID NO: 608300 - DNA, 25 bp, Homo sapien
aagcttgttacttcatctttcctct

SEQ ID NO: 608301 - DNA, 25 bp, Homo sapien
ttgttacttcatctttcctctactc

SEQ ID NO: 608302 - DNA, 25 bp, Homo sapien
attctttccacctttcctgaaacag

SEQ ID NO: 608303 - DNA, 25 bp, Homo sapien
agtcagtaactgtcattgatcttga

SEQ ID NO: 608304 - DNA, 25 bp, Homo sapien
tgtcattgatcttgaccttgtcaaa

SEQ ID NO: 608305 - DNA, 25 bp, Homo sapien
cttgaccttgtcaaatcgtcttaag

SEQ ID NO: 608306 - DNA, 25 bp, Homo sapien
caaatcgtcttaaggtgaaatctag

SEQ ID NO: 608307 - DNA, 25 bp, Homo sapien
aatgacatttggtacgaatctatga

SEQ ID NO: 608308 - DNA, 25 bp, Homo sapien
atcggagataacctgtgagtccatc

SEQ ID NO: 608309 - DNA, 25 bp, Homo sapien
ataacctgtgagtccatcagtaggg

SEQ ID NO: 608310 - DNA, 25 bp, Homo sapien
aaatctgttcaagaggataagcaac

SEQ ID NO: 608311 - DNA, 25 bp, Homo sapien
gaggataagcaactctgtatgtgtt

SEQ ID NO: 608312 - DNA, 25 bp, Homo sapien
gggaatcgtagctgcgacacatggt

SEQ ID NO: 608313 - DNA, 25 bp, Homo sapien
tcgtagctgcgacacatggttgagt

SEQ ID NO: 608314 - DNA, 25 bp, Homo sapien
gctgcgacacatggttgagtgaata

SEQ ID NO: 608315 - DNA, 25 bp, Homo sapien
atagctgatgtttatgagagtttac

SEQ ID NO: 608316 - DNA, 25 bp, Homo sapien
gagagtttacatctcaaggatctat

SEQ ID NO: 608317 - DNA, 25 bp, Homo sapien
catctcaaggatctattacatttaa

SEQ ID NO: 608318 - DNA, 25 bp, Homo sapien
ctgaaaactcctgagcaaacaaagc

SEQ ID NO: 608319 - DNA, 25 bp, Homo sapien
agccacccaggccttagaaatagcc

SEQ ID NO: 608320 - DNA, 25 bp, Homo sapien
atagccttatcattgcttaaactgc

SEQ ID NO: 608321 - DNA, 25 bp, Homo sapien
aataggtaatacttaacttggatca

SEQ ID NO: 608322 - DNA, 25 bp, Homo sapien
gaaataagatttaaccctagccaat

SEQ ID NO: 608323 - DNA, 25 bp, Homo sapien
ttaaccctagccaatcgtaagcagc

SEQ ID NO: 608324 - DNA, 25 bp, Homo sapien
gccaatcgtaagcagccttcagata

SEQ ID NO: 608325 - DNA, 25 bp, Homo sapien
gaacacttcaataaggtacctcacc

SEQ ID NO: 608326 - DNA, 25 bp, Homo sapien
ggtacctcacccaaaagacaattat

SEQ ID NO: 608327 - DNA, 25 bp, Homo sapien
gacaattatgttaactgcaaaccta

SEQ ID NO: 608328 - DNA, 25 bp, Homo sapien
actgcaaacctatcaaatttcttta

SEQ ID NO: 608329 - DNA, 25 bp, Homo sapien
gtgtttgccaaagtgcctagttcct

SEQ ID NO: 608330 - DNA, 25 bp, Homo sapien
aagtgcctagttcctggcaggtgaa

SEQ ID NO: 608331 - DNA, 25 bp, Homo sapien
agttcctggcaggtgaaggacaacc

SEQ ID NO: 608332 - DNA, 25 bp, Homo sapien
gaagctgacccaggttagggagcaa

SEQ ID NO: 608333 - DNA, 25 bp, Homo sapien
cccaggttagggagcaatatccaca

SEQ ID NO: 608334 - DNA, 25 bp, Homo sapien
ggagcaatatccacaatggttgtaa

SEQ ID NO: 608335 - DNA, 25 bp, Homo sapien
atggttgtaatgtttgctggcagca

SEQ ID NO: 608336 - DNA, 25 bp, Homo sapien
gtaatgtttgctggcagcaaggcag

SEQ ID NO: 608337 - DNA, 25 bp, Homo sapien
aaggcagggcgggtcagagaggaaa

SEQ ID NO: 608338 - DNA, 25 bp, Homo sapien
gagggatatggtattccttggaatc

SEQ ID NO: 608339 - DNA, 25 bp, Homo sapien
gatatggtattccttggaatctggg

SEQ ID NO: 608340 - DNA, 25 bp, Homo sapien
gacaagcctcgtggttctgggcagt

SEQ ID NO: 608341 - DNA, 25 bp, Homo sapien
gcctcgtggttctgggcagtgccat

SEQ ID NO: 608342 - DNA, 25 bp, Homo sapien
cagtgccatggagctctgcgggaat

SEQ ID NO: 608343 - DNA, 25 bp, Homo sapien
agctctgcgggaatgactcggtgta

SEQ ID NO: 608344 - DNA, 25 bp, Homo sapien
gggaatgactcggtgtacgcctacg

SEQ ID NO: 608345 - DNA, 25 bp, Homo sapien
aatgactcggtgtacgcctacgcct

SEQ ID NO: 608346 - DNA, 25 bp, Homo sapien
ctcctccgtgttccggaaggcagga

SEQ ID NO: 608347 - DNA, 25 bp, Homo sapien
ggaagcgaagatccagtacgcgatc

SEQ ID NO: 608348 - DNA, 25 bp, Homo sapien
gatccagtacgcgatcatcgggact

SEQ ID NO: 608349 - DNA, 25 bp, Homo sapien
cagtacgcgatcatcgggactggga

SEQ ID NO: 608350 - DNA, 25 bp, Homo sapien
ggactgggagctgcgagctgctcac

SEQ ID NO: 608351 - DNA, 25 bp, Homo sapien
ggaaggcagctctgttctgaagcat

SEQ ID NO: 608352 - DNA, 25 bp, Homo sapien
ctgttctgaagcattcgaaaggtca

SEQ ID NO: 608353 - DNA, 25 bp, Homo sapien
cccagtggtgttcatccatccattt

SEQ ID NO: 608354 - DNA, 25 bp, Homo sapien
gcaacctcctgtgaactgagtgctg

SEQ ID NO: 608355 - DNA, 25 bp, Homo sapien
tcagacccaattcctgccctgaagg

SEQ ID NO: 608356 - DNA, 25 bp, Homo sapien
gggcaggcatgaataccccacatga

SEQ ID NO: 608357 - DNA, 25 bp, Homo sapien
gaataccccacatgagattgctcag

SEQ ID NO: 608358 - DNA, 25 bp, Homo sapien
acatgagattgctcagggcctgcat

SEQ ID NO: 608359 - DNA, 25 bp, Homo sapien
ggcctgcatggctgtgcccacgtcg

SEQ ID NO: 608360 - DNA, 25 bp, Homo sapien
gtcgctcgcgtcagtcactatgggc

SEQ ID NO: 608361 - DNA, 25 bp, Homo sapien
cactatgggcttcaccagcatcgtg

SEQ ID NO: 608362 - DNA, 25 bp, Homo sapien
aatttgccgggcgtgattggtgcct

SEQ ID NO: 608363 - DNA, 25 bp, Homo sapien
atttgccgggcgtgattggtgcctg

SEQ ID NO: 608364 - DNA, 25 bp, Homo sapien
tgattggtgcctgtaatctaagcta

SEQ ID NO: 608365 - DNA, 25 bp, Homo sapien
gattggtgcctgtaatctaagctac

SEQ ID NO: 608366 - DNA, 25 bp, Homo sapien
attggtgcctgtaatctaagctact

SEQ ID NO: 608367 - DNA, 25 bp, Homo sapien
tccagtgagcccagatcccgcaact

SEQ ID NO: 608368 - DNA, 25 bp, Homo sapien
ccagtgagcccagatcccgcaactg

SEQ ID NO: 608369 - DNA, 25 bp, Homo sapien
gcctgggcgatagagggagactcag

SEQ ID NO: 608370 - DNA, 25 bp, Homo sapien
cctgggcgatagagggagactcagt

SEQ ID NO: 608371 - DNA, 25 bp, Homo sapien
gcgatagagggagactcagtctcaa

SEQ ID NO: 608372 - DNA, 25 bp, Homo sapien
cgatagagggagactcagtctcaaa

SEQ ID NO: 608373 - DNA, 25 bp, Homo sapien
gggagggtcacaggacatgtcatca

SEQ ID NO: 608374 - DNA, 25 bp, Homo sapien
acaggacatgtcatcagcagtgaaa

SEQ ID NO: 608375 - DNA, 25 bp, Homo sapien
cagcagtgaaaaggttttgttccgt

SEQ ID NO: 608376 - DNA, 25 bp, Homo sapien
tttcctgccttcagaacttgcacgt

SEQ ID NO: 608377 - DNA, 25 bp, Homo sapien
cagaacttgcacgtgctggaatcca

SEQ ID NO: 608378 - DNA, 25 bp, Homo sapien
ggccgttcctggagatgtctgccct

SEQ ID NO: 608379 - DNA, 25 bp, Homo sapien
ttcctggagatgtctgcccttcggg

SEQ ID NO: 608380 - DNA, 25 bp, Homo sapien
gagcctttcccttgcagcctttgca

SEQ ID NO: 608381 - DNA, 25 bp, Homo sapien
ttcccttgcagcctttgcacttgct

SEQ ID NO: 608382 - DNA, 25 bp, Homo sapien
ctaaccatccctcgaagtccatggg

SEQ ID NO: 608383 - DNA, 25 bp, Homo sapien
tccctcgaagtccatgggcaccaga

SEQ ID NO: 608384 - DNA, 25 bp, Homo sapien
tttgattccttcaggcccttgtcag

SEQ ID NO: 608385 - DNA, 25 bp, Homo sapien
aggcccttgtcagctaccgaaggag

SEQ ID NO: 608386 - DNA, 25 bp, Homo sapien
ggaagacagtggcttcacctgtcct

SEQ ID NO: 608387 - DNA, 25 bp, Homo sapien
tcacctgtcctttagggaagctgga

SEQ ID NO: 608388 - DNA, 25 bp, Homo sapien
ccaaatatcttggttcagacagctc

SEQ ID NO: 608389 - DNA, 25 bp, Homo sapien
tgaaccccacgctcacagtggtcga

SEQ ID NO: 608390 - DNA, 25 bp, Homo sapien
ttgcctcccgattttcggagttggg

SEQ ID NO: 608391 - DNA, 25 bp, Homo sapien
gaagggccatgaccaccctcgtaga

SEQ ID NO: 608392 - DNA, 25 bp, Homo sapien
agactttttccatgggatacagttt

SEQ ID NO: 608393 - DNA, 25 bp, Homo sapien
gatacagtttaggacacgggtttct

SEQ ID NO: 608394 - DNA, 25 bp, Homo sapien
agggcctacatttctcaatccagag

SEQ ID NO: 608395 - DNA, 25 bp, Homo sapien
taatgaacctcatgctgttgaacag

SEQ ID NO: 608396 - DNA, 25 bp, Homo sapien
gctgttgaacaggtttttagagaat

SEQ ID NO: 608397 - DNA, 25 bp, Homo sapien
ggttcagatttatagacatccatag

SEQ ID NO: 608398 - DNA, 25 bp, Homo sapien
catccataggaaaaattctgctgta

SEQ ID NO: 608399 - DNA, 25 bp, Homo sapien
attataaccttattttgatatggaa

SEQ ID NO: 608400 - DNA, 25 bp, Homo sapien
agagactttgatcatgttcatgaac

SEQ ID NO: 608401 - DNA, 25 bp, Homo sapien
tcatgaacatgtacttgaacacaag

SEQ ID NO: 608402 - DNA, 25 bp, Homo sapien
gaaacactgtaatgatttacactga

SEQ ID NO: 608403 - DNA, 25 bp, Homo sapien
ttacactgaatcacaattgcactgt

SEQ ID NO: 608404 - DNA, 25 bp, Homo sapien
gaatcacaattgcactgttgatata

SEQ ID NO: 608405 - DNA, 25 bp, Homo sapien
tagagaaatcgttagaaatggtgac

SEQ ID NO: 608406 - DNA, 25 bp, Homo sapien
tagaatcttcacctttctttcaacc

SEQ ID NO: 608407 - DNA, 25 bp, Homo sapien
tttcaaccagtaccctcttcttgtt

SEQ ID NO: 608408 - DNA, 25 bp, Homo sapien
taccctcttcttgtttaggtcaaag

SEQ ID NO: 608409 - DNA, 25 bp, Homo sapien
gtctcaagatctaatgtacaccata

SEQ ID NO: 608410 - DNA, 25 bp, Homo sapien
tacaccataaggagtgcagtatcat

SEQ ID NO: 608411 - DNA, 25 bp, Homo sapien
gtatcatattgtgcactgggagtag

SEQ ID NO: 608412 - DNA, 25 bp, Homo sapien
ttaggaattctcagcacacacagaa

SEQ ID NO: 608413 - DNA, 25 bp, Homo sapien
aaggacggtaactgtgtgagatgct

SEQ ID NO: 608414 - DNA, 25 bp, Homo sapien
acttgactgtagtaatcacttcact

SEQ ID NO: 608415 - DNA, 25 bp, Homo sapien
gtgtatgtagatcagagcatcatgc

SEQ ID NO: 608416 - DNA, 25 bp, Homo sapien
gagcatcatgctgtacaccttatac

SEQ ID NO: 608417 - DNA, 25 bp, Homo sapien
agtcataaaatacatcgtggcttct

SEQ ID NO: 608418 - DNA, 25 bp, Homo sapien
gtcataaaatacatcgtggcttctg

SEQ ID NO: 608419 - DNA, 25 bp, Homo sapien
tcataaaatacatcgtggcttctgt

SEQ ID NO: 608420 - DNA, 25 bp, Homo sapien
cataaaatacatcgtggcttctgtc

SEQ ID NO: 608421 - DNA, 25 bp, Homo sapien
aatacatcgtggcttctgtcttgtt

SEQ ID NO: 608422 - DNA, 25 bp, Homo sapien
atacatcgtggcttctgtcttgttt

SEQ ID NO: 608423 - DNA, 25 bp, Homo sapien
ttgttttctttgatcgcttactttg

SEQ ID NO: 608424 - DNA, 25 bp, Homo sapien
tgttttctttgatcgcttactttgg

SEQ ID NO: 608425 - DNA, 25 bp, Homo sapien
aagaatgggtatgtgacctgcccct

SEQ ID NO: 608426 - DNA, 25 bp, Homo sapien
agttttgaggagctcccagtttcac

SEQ ID NO: 608427 - DNA, 25 bp, Homo sapien
ggagctcccagtttcacctgagatt

SEQ ID NO: 608428 - DNA, 25 bp, Homo sapien
tgagattccgcccagaaaatcccaa

SEQ ID NO: 608429 - DNA, 25 bp, Homo sapien
gaaaatcccaatacctacgttcgag

SEQ ID NO: 608430 - DNA, 25 bp, Homo sapien
atacctacgttcgaggatgccagag

SEQ ID NO: 608431 - DNA, 25 bp, Homo sapien
aagagcagcttctcttttctggtca

SEQ ID NO: 608432 - DNA, 25 bp, Homo sapien
gtcaaagtttagtaccagatcatct

SEQ ID NO: 608433 - DNA, 25 bp, Homo sapien
tgaaaaattcagtgacagccaggga

SEQ ID NO: 608434 - DNA, 25 bp, Homo sapien
gggaatttcttgtgtctgaaaaact

SEQ ID NO: 608435 - DNA, 25 bp, Homo sapien
gaaaaacttccagagcacaccaagg

SEQ ID NO: 608436 - DNA, 25 bp, Homo sapien
gggcatgtttctatcttattaatag

SEQ ID NO: 608437 - DNA, 25 bp, Homo sapien
tagtatatttttcctcatagagatg

SEQ ID NO: 608438 - DNA, 25 bp, Homo sapien
ttttcctcatagagatgtctactac

SEQ ID NO: 608439 - DNA, 25 bp, Homo sapien
gagatgtctactacacagttagaaa

SEQ ID NO: 608440 - DNA, 25 bp, Homo sapien
aaaggcctaagctgggcatcattgc

SEQ ID NO: 608441 - DNA, 25 bp, Homo sapien
aagctgggcatcattgcccttgcct

SEQ ID NO: 608442 - DNA, 25 bp, Homo sapien
gactgtagtgtgcaatgagcatgcc

SEQ ID NO: 608443 - DNA, 25 bp, Homo sapien
gtagtgtgcaatgagcatgcctgtg

SEQ ID NO: 608444 - DNA, 25 bp, Homo sapien
cactgcgctctagccgggcaataat

SEQ ID NO: 608445 - DNA, 25 bp, Homo sapien
ctctagccgggcaataataatatta

SEQ ID NO: 608446 - DNA, 25 bp, Homo sapien
attaatatatagatgccctgtctcc

SEQ ID NO: 608447 - DNA, 25 bp, Homo sapien
ggttagttgttacatgatagcagag

SEQ ID NO: 608448 - DNA, 25 bp, Homo sapien
gttgttacatgatagcagagatatt

SEQ ID NO: 608449 - DNA, 25 bp, Homo sapien
catgatagcagagatatttttactt

SEQ ID NO: 608450 - DNA, 25 bp, Homo sapien
gatatttttacttagattactttgg

SEQ ID NO: 608451 - DNA, 25 bp, Homo sapien
ttttacttagattactttgggaatg

SEQ ID NO: 608452 - DNA, 25 bp, Homo sapien
actttgggaatgagagattgttgtc

SEQ ID NO: 608453 - DNA, 25 bp, Homo sapien
gagattgttgtcttgaactctggca

SEQ ID NO: 608454 - DNA, 25 bp, Homo sapien
gattgttgtcttgaactctggcact

SEQ ID NO: 608455 - DNA, 25 bp, Homo sapien
attgttgtcttgaactctggcactg

SEQ ID NO: 608456 - DNA, 25 bp, Homo sapien
tgttgtcttgaactctggcactgta

SEQ ID NO: 608457 - DNA, 25 bp, Homo sapien
gttgtcttgaactctggcactgtac

SEQ ID NO: 608458 - DNA, 25 bp, Homo sapien
atctcctgaccttgaatcacaagag

SEQ ID NO: 608459 - DNA, 25 bp, Homo sapien
gaatcacaagagtcttaacagggaa

SEQ ID NO: 608460 - DNA, 25 bp, Homo sapien
agagtcttaacagggaatgtttcag

SEQ ID NO: 608461 - DNA, 25 bp, Homo sapien
aaataggataagacaatgccagagg

SEQ ID NO: 608462 - DNA, 25 bp, Homo sapien
aatgccagaggaaggatagaaacat

SEQ ID NO: 608463 - DNA, 25 bp, Homo sapien
gaaacatgggaagtttctatcattt

SEQ ID NO: 608464 - DNA, 25 bp, Homo sapien
gtttctatcatttcattttctgcgt

SEQ ID NO: 608465 - DNA, 25 bp, Homo sapien
atcatttcattttctgcgtttccag

SEQ ID NO: 608466 - DNA, 25 bp, Homo sapien
ttcattttctgcgtttccagcatgc

SEQ ID NO: 608467 - DNA, 25 bp, Homo sapien
gcgtttccagcatgcccttggaaaa

SEQ ID NO: 608468 - DNA, 25 bp, Homo sapien
tatggtgaaaaaggcgtttgcactc

SEQ ID NO: 608469 - DNA, 25 bp, Homo sapien
tggtcccatcattactcggagtgat

SEQ ID NO: 608470 - DNA, 25 bp, Homo sapien
gatgagactccaaccaacaattcgc

SEQ ID NO: 608471 - DNA, 25 bp, Homo sapien
aacaattcgcaacttggttctccaa

SEQ ID NO: 608472 - DNA, 25 bp, Homo sapien
gcaacttggttctccaagtatgcct

SEQ ID NO: 608473 - DNA, 25 bp, Homo sapien
atcaccagcgcactgatatcaggaa

SEQ ID NO: 608474 - DNA, 25 bp, Homo sapien
cactgatatcaggaatggtcattct

SEQ ID NO: 608475 - DNA, 25 bp, Homo sapien
tggtcattctgggagttacgagctt

SEQ ID NO: 608476 - DNA, 25 bp, Homo sapien
agttacgagcttttctcttcttctg

SEQ ID NO: 608477 - DNA, 25 bp, Homo sapien
ttctgcacaggaagggacccacaag

SEQ ID NO: 608478 - DNA, 25 bp, Homo sapien
agaaacccagtctttgactgactat

SEQ ID NO: 608479 - DNA, 25 bp, Homo sapien
gactgactataacagattcctgctc

SEQ ID NO: 608480 - DNA, 25 bp, Homo sapien
atggctcaaccatgtgaatttattt

SEQ ID NO: 608481 - DNA, 25 bp, Homo sapien
tgtgaatttattttggttgcctgtt

SEQ ID NO: 608482 - DNA, 25 bp, Homo sapien
gttgcctgttatctgggtacctgat

SEQ ID NO: 608483 - DNA, 25 bp, Homo sapien
gggtacctgatctatttatctctgg

SEQ ID NO: 608484 - DNA, 25 bp, Homo sapien
gatctatttatctctgggctatgct

SEQ ID NO: 608485 - DNA, 25 bp, Homo sapien
gggctatgctgtgacttctaattta

SEQ ID NO: 608486 - DNA, 25 bp, Homo sapien
gcttagctccagtctataatctgtt

SEQ ID NO: 608487 - DNA, 25 bp, Homo sapien
aagaatgccctaacactatggtgtt

SEQ ID NO: 608488 - DNA, 25 bp, Homo sapien
gaaactcaaaagatcggccaggcgc

SEQ ID NO: 608489 - DNA, 25 bp, Homo sapien
gtgtagtatgttctgagtatctcaa

SEQ ID NO: 608490 - DNA, 25 bp, Homo sapien
gagtatctcaagtatggtttcatct

SEQ ID NO: 608491 - DNA, 25 bp, Homo sapien
agcgtgggcgccttggccgtggtgg

SEQ ID NO: 608492 - DNA, 25 bp, Homo sapien
tggtggccgccatttttggcctgga

SEQ ID NO: 608493 - DNA, 25 bp, Homo sapien
gccgccatttttggcctggagttcc

SEQ ID NO: 608494 - DNA, 25 bp, Homo sapien
gagttcctcatggtgtcccagttgt

SEQ ID NO: 608495 - DNA, 25 bp, Homo sapien
tcatggtgtcccagttgtgcgagga

SEQ ID NO: 608496 - DNA, 25 bp, Homo sapien
gtgtcccagttgtgcgaggacaaac

SEQ ID NO: 608497 - DNA, 25 bp, Homo sapien
tcacagtgcaagtgggtcatgggtt

SEQ ID NO: 608498 - DNA, 25 bp, Homo sapien
tgcaagtgggtcatgggttccatcc

SEQ ID NO: 608499 - DNA, 25 bp, Homo sapien
agtgggtcatgggttccatcctcct

SEQ ID NO: 608500 - DNA, 25 bp, Homo sapien
gggtcatgggttccatcctcctcct

SEQ ID NO: 608501 - DNA, 25 bp, Homo sapien
tggtgtctttcgtcctctcctccgg

SEQ ID NO: 608502 - DNA, 25 bp, Homo sapien
gcctatctctaacacacagctcgag

SEQ ID NO: 608503 - DNA, 25 bp, Homo sapien
acacacagctcgagaacaattccac

SEQ ID NO: 608504 - DNA, 25 bp, Homo sapien
gaacaattccacacacaatctgaag

SEQ ID NO: 608505 - DNA, 25 bp, Homo sapien
atatgaaatggaacttttgggtgcc

SEQ ID NO: 608506 - DNA, 25 bp, Homo sapien
gaacttttgggtgccaaatgggact

SEQ ID NO: 608507 - DNA, 25 bp, Homo sapien
ggtgccaaatgggacttttagatta

SEQ ID NO: 608508 - DNA, 25 bp, Homo sapien
attatgcttaactttccctacaaag

SEQ ID NO: 608509 - DNA, 25 bp, Homo sapien
tggcatgattttctgcacctcctgt

SEQ ID NO: 608510 - DNA, 25 bp, Homo sapien
gattttctgcacctcctgtataaaa

SEQ ID NO: 608511 - DNA, 25 bp, Homo sapien
gaatccagaagctagactcgaccca

SEQ ID NO: 608512 - DNA, 25 bp, Homo sapien
acagcagcctatctctaacacacag

SEQ ID NO: 608513 - DNA, 25 bp, Homo sapien
aaggactttaccagcattcctgctg

SEQ ID NO: 608514 - DNA, 25 bp, Homo sapien
gcctgctggtgggtgattatctcta

SEQ ID NO: 608515 - DNA, 25 bp, Homo sapien
atatgtatcctatcacagtgcctgg

SEQ ID NO: 608516 - DNA, 25 bp, Homo sapien
ggaattgttctattggcattaccta

SEQ ID NO: 608517 - DNA, 25 bp, Homo sapien
gcattacctatcacttttatctacc

SEQ ID NO: 608518 - DNA, 25 bp, Homo sapien
ttttatctaccatagctttgtgcag

SEQ ID NO: 608519 - DNA, 25 bp, Homo sapien
ctttgtgcagtgttatcatgagctc

SEQ ID NO: 608520 - DNA, 25 bp, Homo sapien
gctcaagtttagatctgctaggtat

SEQ ID NO: 608521 - DNA, 25 bp, Homo sapien
ggtatagtaggagcctctccactga

SEQ ID NO: 608522 - DNA, 25 bp, Homo sapien
cctctccactgaattcctgaattaa

SEQ ID NO: 608523 - DNA, 25 bp, Homo sapien
atcaattcttgcatacacttcatag

SEQ ID NO: 608524 - DNA, 25 bp, Homo sapien
gggctctttctggttagttgttaca

SEQ ID NO: 608525 - DNA, 25 bp, Homo sapien
ttagttgttacatgatagcagagat

SEQ ID NO: 608526 - DNA, 25 bp, Homo sapien
catgatagcagagatatttttactt

SEQ ID NO: 608527 - DNA, 25 bp, Homo sapien
gatatttttacttagattactttgg

SEQ ID NO: 608528 - DNA, 25 bp, Homo sapien
ttttacttagattactttgggaatg

SEQ ID NO: 608529 - DNA, 25 bp, Homo sapien
actttgggaatgagagattgttgtc

SEQ ID NO: 608530 - DNA, 25 bp, Homo sapien
gagattgttgtcttgaactctggca

SEQ ID NO: 608531 - DNA, 25 bp, Homo sapien
gattgttgtcttgaactctggcact

SEQ ID NO: 608532 - DNA, 25 bp, Homo sapien
attgttgtcttgaactctggcactg

SEQ ID NO: 608533 - DNA, 25 bp, Homo sapien
gttgtcttgaactctggcactgtac

SEQ ID NO: 608534 - DNA, 25 bp, Homo sapien
gtagttgtgttagtttgcattaagc

SEQ ID NO: 608535 - DNA, 25 bp, Homo sapien
accttaggtcattgtgtacttagtc

SEQ ID NO: 608536 - DNA, 25 bp, Homo sapien
aggtcattgtgtacttagtctaagt

SEQ ID NO: 608537 - DNA, 25 bp, Homo sapien
gtgatgtaggactagagttccttgt

SEQ ID NO: 608538 - DNA, 25 bp, Homo sapien
agttccttgtgggattggaccagca

SEQ ID NO: 608539 - DNA, 25 bp, Homo sapien
gtgggattggaccagcattcctcaa

SEQ ID NO: 608540 - DNA, 25 bp, Homo sapien
ccagcattcctcaagacaaatggta

SEQ ID NO: 608541 - DNA, 25 bp, Homo sapien
aatggtaatttgctaggcgcatcct

SEQ ID NO: 608542 - DNA, 25 bp, Homo sapien
atttgctaggcgcatcctttggttt

SEQ ID NO: 608543 - DNA, 25 bp, Homo sapien
taggcgcatcctttggttttctccc

SEQ ID NO: 608544 - DNA, 25 bp, Homo sapien
agtctcgttctgtcggctgagatca

SEQ ID NO: 608545 - DNA, 25 bp, Homo sapien
ttctgtcggctgagatcacgccgtt

SEQ ID NO: 608546 - DNA, 25 bp, Homo sapien
gactactttcagacctatcacttga

SEQ ID NO: 608547 - DNA, 25 bp, Homo sapien
ttcagacctatcacttgagttgcag

SEQ ID NO: 608548 - DNA, 25 bp, Homo sapien
tatcacttgagttgcagtggcctcc

SEQ ID NO: 608549 - DNA, 25 bp, Homo sapien
ctccctcagaccagtatccaagaga

SEQ ID NO: 608550 - DNA, 25 bp, Homo sapien
aagagatcaacagagtggtccgcaa

SEQ ID NO: 608551 - DNA, 25 bp, Homo sapien
agagtggtccgcaatgcaggtccaa

SEQ ID NO: 608552 - DNA, 25 bp, Homo sapien
ggtccgcaatgcaggtccaatagct

SEQ ID NO: 608553 - DNA, 25 bp, Homo sapien
ggtccaatagctaattacctacaac

SEQ ID NO: 608554 - DNA, 25 bp, Homo sapien
aacaagtaatgcaggaagcccgaca

SEQ ID NO: 608555 - DNA, 25 bp, Homo sapien
gcaggaagcccgacaaaatcctcca

SEQ ID NO: 608556 - DNA, 25 bp, Homo sapien
ggtgtcccaggcaacttagagatta

SEQ ID NO: 608557 - DNA, 25 bp, Homo sapien
agatcagtggccagtgtactgccga

SEQ ID NO: 608558 - DNA, 25 bp, Homo sapien
gtgtactgccgagtgatacgtgaaa

SEQ ID NO: 608559 - DNA, 25 bp, Homo sapien
gtgatacgtgaaaagaacctatgtc

SEQ ID NO: 608560 - DNA, 25 bp, Homo sapien
tgaaaagaacctatgtcaggacatg

SEQ ID NO: 608561 - DNA, 25 bp, Homo sapien
gtggtatcagcgctgctgtgaaaca

SEQ ID NO: 608562 - DNA, 25 bp, Homo sapien
agggacttctatgcccaaaagctgc

SEQ ID NO: 608563 - DNA, 25 bp, Homo sapien
agctgcagcagaagagttgacctct

SEQ ID NO: 608564 - DNA, 25 bp, Homo sapien
aagagttgacctctagcaggctggc

SEQ ID NO: 608565 - DNA, 25 bp, Homo sapien
ctagcaggctggctggatcacagct

SEQ ID NO: 608566 - DNA, 25 bp, Homo sapien
aaacacacacactagcatgtttttc

SEQ ID NO: 608567 - DNA, 25 bp, Homo sapien
aacatccaatgtggtgcttgttttg

SEQ ID NO: 608568 - DNA, 25 bp, Homo sapien
aaaggtctattagcatgccaccatg

SEQ ID NO: 608569 - DNA, 25 bp, Homo sapien
gatgcatacagtgcccagctcagca

SEQ ID NO: 608570 - DNA, 25 bp, Homo sapien
cagcacctggtgcaaagtaagcaca

SEQ ID NO: 608571 - DNA, 25 bp, Homo sapien
agtaagcacaatctggcttccagcc

SEQ ID NO: 608572 - DNA, 25 bp, Homo sapien
atcactgctgttgctactatcacaa

SEQ ID NO: 608573 - DNA, 25 bp, Homo sapien
actatcacaaatattaggccccttc

SEQ ID NO: 608574 - DNA, 25 bp, Homo sapien
ggccccttctagaatgcaaagataa

SEQ ID NO: 608575 - DNA, 25 bp, Homo sapien
aaagataacccagggctgctcgttc

SEQ ID NO: 608576 - DNA, 25 bp, Homo sapien
agggctgctcgttctgtgtccagat

SEQ ID NO: 608577 - DNA, 25 bp, Homo sapien
gtgtccagatcacagagtttttctt

SEQ ID NO: 608578 - DNA, 25 bp, Homo sapien
ctttttatccttatcaactttattg

SEQ ID NO: 608579 - DNA, 25 bp, Homo sapien
aaatttaaagcaaaggccacgcacg

SEQ ID NO: 608580 - DNA, 25 bp, Homo sapien
aatttaaagcaaaggccacgcacgt

SEQ ID NO: 608581 - DNA, 25 bp, Homo sapien
atttaaagcaaaggccacgcacgtg

SEQ ID NO: 608582 - DNA, 25 bp, Homo sapien
taaagcaaaggccacgcacgtgtga

SEQ ID NO: 608583 - DNA, 25 bp, Homo sapien
aaagcaaaggccacgcacgtgtgac

SEQ ID NO: 608584 - DNA, 25 bp, Homo sapien
aagcaaaggccacgcacgtgtgact

SEQ ID NO: 608585 - DNA, 25 bp, Homo sapien
gcaaaggccacgcacgtgtgactca

SEQ ID NO: 608586 - DNA, 25 bp, Homo sapien
caaaggccacgcacgtgtgactcac

SEQ ID NO: 608587 - DNA, 25 bp, Homo sapien
aaaggccacgcacgtgtgactcacg

SEQ ID NO: 608588 - DNA, 25 bp, Homo sapien
aaggccacgcacgtgtgactcacgc

SEQ ID NO: 608589 - DNA, 25 bp, Homo sapien
ccacgcacgtgtgactcacgcctat

SEQ ID NO: 608590 - DNA, 25 bp, Homo sapien
gacacacatgtcctagatttgtttc

SEQ ID NO: 608591 - DNA, 25 bp, Homo sapien
gatttgtttcgtcaaagcgactttt

SEQ ID NO: 608592 - DNA, 25 bp, Homo sapien
ttggttgtcatgatcttacttccgg

SEQ ID NO: 608593 - DNA, 25 bp, Homo sapien
tcatgatcttacttccggtggaggt

SEQ ID NO: 608594 - DNA, 25 bp, Homo sapien
atcttacttccggtggaggttgcag

SEQ ID NO: 608595 - DNA, 25 bp, Homo sapien
ggctaggcaacagagtgcaactccg

SEQ ID NO: 608596 - DNA, 25 bp, Homo sapien
tttggcaaataaggaatcatgtcta

SEQ ID NO: 608597 - DNA, 25 bp, Homo sapien
aagacggaggtcatggcttgataga

SEQ ID NO: 608598 - DNA, 25 bp, Homo sapien
gagatggctgaacctatagtagaaa

SEQ ID NO: 608599 - DNA, 25 bp, Homo sapien
gaaaaacactaggttccgccaaatg

SEQ ID NO: 608600 - DNA, 25 bp, Homo sapien
gaaatgttgagtcacaatgacacac

SEQ ID NO: 608601 - DNA, 25 bp, Homo sapien
tccacaatgtattagcagccacaaa

SEQ ID NO: 608602 - DNA, 25 bp, Homo sapien
gtattagcagccacaaatttccact

SEQ ID NO: 608603 - DNA, 25 bp, Homo sapien
cagccacaaatttccactggtaacc

SEQ ID NO: 608604 - DNA, 25 bp, Homo sapien
ttccactggtaaccaaagagtacct

SEQ ID NO: 608605 - DNA, 25 bp, Homo sapien
gagtacctaagtagtttttcattat

SEQ ID NO: 608606 - DNA, 25 bp, Homo sapien
aacatggagctcagtattcaggaag

SEQ ID NO: 608607 - DNA, 25 bp, Homo sapien
aaataattatccctatcttcagaat

SEQ ID NO: 608608 - DNA, 25 bp, Homo sapien
atccctatcttcagaattaacttag

SEQ ID NO: 608609 - DNA, 25 bp, Homo sapien
gaattaacttagtctgtaatgtggc

SEQ ID NO: 608610 - DNA, 25 bp, Homo sapien
gctacatgacttacaccatacagaa

SEQ ID NO: 608611 - DNA, 25 bp, Homo sapien
tacaccatacagaacagtactggac

SEQ ID NO: 608612 - DNA, 25 bp, Homo sapien
ttagacaaagacatagccatagcct

SEQ ID NO: 608613 - DNA, 25 bp, Homo sapien
agacatagccatagccttcagagtg

SEQ ID NO: 608614 - DNA, 25 bp, Homo sapien
catagccttcagagtggcctacgga

SEQ ID NO: 608615 - DNA, 25 bp, Homo sapien
gaacccaaaccctttcactcagttg

SEQ ID NO: 608616 - DNA, 25 bp, Homo sapien
ttcactcagttggtcctgctcggaa

SEQ ID NO: 608617 - DNA, 25 bp, Homo sapien
gtcctgctcggaatcctgggattta

SEQ ID NO: 608618 - DNA, 25 bp, Homo sapien
cctgggatttaggaatcatctgggc

SEQ ID NO: 608619 - DNA, 25 bp, Homo sapien
gtccagctccacatgtcaattctgg

SEQ ID NO: 608620 - DNA, 25 bp, Homo sapien
cacatgtcaattctggagaggagtt

SEQ ID NO: 608621 - DNA, 25 bp, Homo sapien
ggagttataatatcctcacctttcc

SEQ ID NO: 608622 - DNA, 25 bp, Homo sapien
cttttgcttcccaaaggagcagaac

SEQ ID NO: 608623 - DNA, 25 bp, Homo sapien
ctcaaagaaaactaaaatgggctgg

SEQ ID NO: 608624 - DNA, 25 bp, Homo sapien
tcaaagaaaactaaaatgggctggg

SEQ ID NO: 608625 - DNA, 25 bp, Homo sapien
agaaaactaaaatgggctgggtgca

SEQ ID NO: 608626 - DNA, 25 bp, Homo sapien
gaaaactaaaatgggctgggtgcag

SEQ ID NO: 608627 - DNA, 25 bp, Homo sapien
aaaactaaaatgggctgggtgcagt

SEQ ID NO: 608628 - DNA, 25 bp, Homo sapien
aaactaaaatgggctgggtgcagtg

SEQ ID NO: 608629 - DNA, 25 bp, Homo sapien
agaactgcttgagcctgagaggcgg

SEQ ID NO: 608630 - DNA, 25 bp, Homo sapien
aactgcttgagcctgagaggcggag

SEQ ID NO: 608631 - DNA, 25 bp, Homo sapien
actgcttgagcctgagaggcggagg

SEQ ID NO: 608632 - DNA, 25 bp, Homo sapien
gtagtgagctgggattgctccattg

SEQ ID NO: 608633 - DNA, 25 bp, Homo sapien
tagtgagctgggattgctccattgc

SEQ ID NO: 608634 - DNA, 25 bp, Homo sapien
gaaaataaacacaggcacaaagcag

SEQ ID NO: 608635 - DNA, 25 bp, Homo sapien
acacaggcacaaagcagaagcattt

SEQ ID NO: 608636 - DNA, 25 bp, Homo sapien
tttcttccacttcaacagagctcct

SEQ ID NO: 608637 - DNA, 25 bp, Homo sapien
ttcaacagagctcctatgcctaaac

SEQ ID NO: 608638 - DNA, 25 bp, Homo sapien
gagctcctatgcctaaacagggcag

SEQ ID NO: 608639 - DNA, 25 bp, Homo sapien
gtggatgtcacagtgccggtaacag

SEQ ID NO: 608640 - DNA, 25 bp, Homo sapien
gagacagaatgatcagggtcagaga

SEQ ID NO: 608641 - DNA, 25 bp, Homo sapien
agtgccggtaacagtaaagccaagt

SEQ ID NO: 608642 - DNA, 25 bp, Homo sapien
aagccaagtgacatgagtctgtcta

SEQ ID NO: 608643 - DNA, 25 bp, Homo sapien
agtgacatgagtctgtctatgtaac

SEQ ID NO: 608644 - DNA, 25 bp, Homo sapien
gatcagggtcagagatgacatttag

SEQ ID NO: 608645 - DNA, 25 bp, Homo sapien
gtcatagccatatcctacatctata

SEQ ID NO: 608646 - DNA, 25 bp, Homo sapien
tagccatatcctacatctatatcct

SEQ ID NO: 608647 - DNA, 25 bp, Homo sapien
atcctgaagatgcactccaccaagg

SEQ ID NO: 608648 - DNA, 25 bp, Homo sapien
tgaagatgcactccaccaagggccg

SEQ ID NO: 608649 - DNA, 25 bp, Homo sapien
acctcactgcagtcactctgttcta

SEQ ID NO: 608650 - DNA, 25 bp, Homo sapien
actgcagtcactctgttctatggga

SEQ ID NO: 608651 - DNA, 25 bp, Homo sapien
tgcagtcactctgttctatgggacc

SEQ ID NO: 608652 - DNA, 25 bp, Homo sapien
ttatgtgatgcccaagtccagctac

SEQ ID NO: 608653 - DNA, 25 bp, Homo sapien
gtgatgcccaagtccagctactcaa

SEQ ID NO: 608654 - DNA, 25 bp, Homo sapien
ttctacaccgtggtgattcccatgt

SEQ ID NO: 608655 - DNA, 25 bp, Homo sapien
ctacaccgtggtgattcccatgttg

SEQ ID NO: 608656 - DNA, 25 bp, Homo sapien
tgagaacacttgccggcagcacttc

SEQ ID NO: 608657 - DNA, 25 bp, Homo sapien
gcagcacttccagctgcagcgttta

SEQ ID NO: 608658 - DNA, 25 bp, Homo sapien
gcagcgtttacccaaagatacctct

SEQ ID NO: 608659 - DNA, 25 bp, Homo sapien
ttacccaaagatacctctgccagga

SEQ ID NO: 608660 - DNA, 25 bp, Homo sapien
caaagatacctctgccaggaaagac

SEQ ID NO: 608661 - DNA, 25 bp, Homo sapien
tattattacttttgcatttctctag

SEQ ID NO: 608662 - DNA, 25 bp, Homo sapien
attacttttgcatttctctagcata

SEQ ID NO: 608663 - DNA, 25 bp, Homo sapien
tctctagcatattgacattggaaac

SEQ ID NO: 608664 - DNA, 25 bp, Homo sapien
tatatatagcattctggttttagtg

SEQ ID NO: 608665 - DNA, 25 bp, Homo sapien
atatagtaattcttgatcactgaaa

SEQ ID NO: 608666 - DNA, 25 bp, Homo sapien
gatcactgaaaatgtcagagcctag

SEQ ID NO: 608667 - DNA, 25 bp, Homo sapien
aggactttatgtggtgactacctgt

SEQ ID NO: 608668 - DNA, 25 bp, Homo sapien
gactttatgtggtgactacctgtcc

SEQ ID NO: 608669 - DNA, 25 bp, Homo sapien
ctttatgtggtgactacctgtcctc

SEQ ID NO: 608670 - DNA, 25 bp, Homo sapien
ttatgtggtgactacctgtcctcct

SEQ ID NO: 608671 - DNA, 25 bp, Homo sapien
aaataaagcaaaattccccagctca

SEQ ID NO: 608672 - DNA, 25 bp, Homo sapien
aattccccagctcataaaagacttc

SEQ ID NO: 608673 - DNA, 25 bp, Homo sapien
tccccagctcataaaagacttcact

SEQ ID NO: 608674 - DNA, 25 bp, Homo sapien
ataaaagacttcactcacaccacgt

SEQ ID NO: 608675 - DNA, 25 bp, Homo sapien
aaaagacttcactcacaccacgtgg

SEQ ID NO: 608676 - DNA, 25 bp, Homo sapien
ccaaccaataggagtaagatgggct

SEQ ID NO: 608677 - DNA, 25 bp, Homo sapien
ggtctctgaactaatatttagaggc

SEQ ID NO: 608678 - DNA, 25 bp, Homo sapien
gcagtggcctgcagaagcgggcggt

SEQ ID NO: 608679 - DNA, 25 bp, Homo sapien
gcagcgcacggtccctgcctgtgat

SEQ ID NO: 608680 - DNA, 25 bp, Homo sapien
tgatgcagcccatcggcccgtggag

SEQ ID NO: 608681 - DNA, 25 bp, Homo sapien
atcggcccgtggagacacaagcctg

SEQ ID NO: 608682 - DNA, 25 bp, Homo sapien
ggtcaccctgctccaagagctgcgg

SEQ ID NO: 608683 - DNA, 25 bp, Homo sapien
atttcagaggcgctcactcaagtgt

SEQ ID NO: 608684 - DNA, 25 bp, Homo sapien
tcagaggcgctcactcaagtgtgtg

SEQ ID NO: 608685 - DNA, 25 bp, Homo sapien
ctcactcaagtgtgtgggccacgga

SEQ ID NO: 608686 - DNA, 25 bp, Homo sapien
gggaccagtgcaacttgcaccgcaa

SEQ ID NO: 608687 - DNA, 25 bp, Homo sapien
aggagctggacttctgcgtcctgag

SEQ ID NO: 608688 - DNA, 25 bp, Homo sapien
cttctgcgtcctgaggccgtgctga

SEQ ID NO: 608689 - DNA, 25 bp, Homo sapien
gatttttgtggccatgtacaccgtc

SEQ ID NO: 608690 - DNA, 25 bp, Homo sapien
atgtacaccgtcttcgtgctgttcg

SEQ ID NO: 608691 - DNA, 25 bp, Homo sapien
tcgtgctgttcgctgtcttctggaa

SEQ ID NO: 608692 - DNA, 25 bp, Homo sapien
gtcttctggaacatctttgcctaca

SEQ ID NO: 608693 - DNA, 25 bp, Homo sapien
caccctgctggacttaaagctgccg

SEQ ID NO: 608694 - DNA, 25 bp, Homo sapien
tgctggacttaaagctgccgcctcc

SEQ ID NO: 608695 - DNA, 25 bp, Homo sapien
gggaaaagcagcacccacagggagc

SEQ ID NO: 608696 - DNA, 25 bp, Homo sapien
acagggagcgcctgcgaggtttctt

SEQ ID NO: 608697 - DNA, 25 bp, Homo sapien
gcgcctgcgaggtttcttctcatca

SEQ ID NO: 608698 - DNA, 25 bp, Homo sapien
acagaagactctgggccactgtaat

SEQ ID NO: 608699 - DNA, 25 bp, Homo sapien
ctgggccactgtaatgtttgtgttt

SEQ ID NO: 608700 - DNA, 25 bp, Homo sapien
aatcaacactataagttttcacctt

SEQ ID NO: 608701 - DNA, 25 bp, Homo sapien
aaagtagagctaaccacatccaaaa

SEQ ID NO: 608702 - DNA, 25 bp, Homo sapien
agagctaaccacatccaaaataaat

SEQ ID NO: 608703 - DNA, 25 bp, Homo sapien
aaacctttaattgactgatagagag

SEQ ID NO: 608704 - DNA, 25 bp, Homo sapien
gaaaaacacacatatttgaacaaat

SEQ ID NO: 608705 - DNA, 25 bp, Homo sapien
aaatagtataacttgattgcagata

SEQ ID NO: 608706 - DNA, 25 bp, Homo sapien
tatgtatcgctgtatctttggtggt

SEQ ID NO: 608707 - DNA, 25 bp, Homo sapien
atcgctgtatctttggtggtaagtt

SEQ ID NO: 608708 - DNA, 25 bp, Homo sapien
ctttggtggtaagttgaggcagtat

SEQ ID NO: 608709 - DNA, 25 bp, Homo sapien
gaggcagtatatgtctgatcactct

SEQ ID NO: 608710 - DNA, 25 bp, Homo sapien
ggcagtatatgtctgatcactctgg

SEQ ID NO: 608711 - DNA, 25 bp, Homo sapien
ggctgggtcaagaactgtgtgaaca

SEQ ID NO: 608712 - DNA, 25 bp, Homo sapien
atggagccctagaagcttcggagct

SEQ ID NO: 608713 - DNA, 25 bp, Homo sapien
agctgaggacttccagctgagcagc

SEQ ID NO: 608714 - DNA, 25 bp, Homo sapien
gctctcttcaatcagatcaaggacc

SEQ ID NO: 608715 - DNA, 25 bp, Homo sapien
atcaaggaccggaagaggccaccac

SEQ ID NO: 608716 - DNA, 25 bp, Homo sapien
gaagaggccaccacaaaaccagcaa

SEQ ID NO: 608717 - DNA, 25 bp, Homo sapien
tgactgcaaacctctgagcctggaa

SEQ ID NO: 608718 - DNA, 25 bp, Homo sapien
gagcctggaaccgattgacatgtaa

SEQ ID NO: 608719 - DNA, 25 bp, Homo sapien
gacatgtaaatgcacctgcaccgtt

SEQ ID NO: 608720 - DNA, 25 bp, Homo sapien
acctgcaccgtttctgagccgggag

SEQ ID NO: 608721 - DNA, 25 bp, Homo sapien
ctgagccgggagagtgtttacttaa

SEQ ID NO: 608722 - DNA, 25 bp, Homo sapien
ccttgctctggtcaggaaatgtcca

SEQ ID NO: 608723 - DNA, 25 bp, Homo sapien
cagtgtttcctgttatccacaggag

SEQ ID NO: 608724 - DNA, 25 bp, Homo sapien
agtgtttcctgttatccacaggaga

SEQ ID NO: 608725 - DNA, 25 bp, Homo sapien
gtgtttcctgttatccacaggagaa

SEQ ID NO: 608726 - DNA, 25 bp, Homo sapien
gtttcctgttatccacaggagaatg

SEQ ID NO: 608727 - DNA, 25 bp, Homo sapien
ttcctgttatccacaggagaatgta

SEQ ID NO: 608728 - DNA, 25 bp, Homo sapien
tgattatatgtgattgacaatgtgt

SEQ ID NO: 608729 - DNA, 25 bp, Homo sapien
atatgtgattgacaatgtgtatttt

SEQ ID NO: 608730 - DNA, 25 bp, Homo sapien
ttgagggagcaaagatttctgtaca

SEQ ID NO: 608731 - DNA, 25 bp, Homo sapien
gagggagcaaagatttctgtacata

SEQ ID NO: 608732 - DNA, 25 bp, Homo sapien
agggagcaaagatttctgtacatat

SEQ ID NO: 608733 - DNA, 25 bp, Homo sapien
gtttaatccacttcttttttatgag

SEQ ID NO: 608734 - DNA, 25 bp, Homo sapien
cttttttatgagtcagtgtttctga

SEQ ID NO: 608735 - DNA, 25 bp, Homo sapien
cattcccaaactttctaagtaagtg

SEQ ID NO: 608736 - DNA, 25 bp, Homo sapien
gtggatacactacacttcacaagtt

SEQ ID NO: 608737 - DNA, 25 bp, Homo sapien
acacttcacaagttttccagccttt

SEQ ID NO: 608738 - DNA, 25 bp, Homo sapien
aagttttccagcctttctcttcctg

SEQ ID NO: 608739 - DNA, 25 bp, Homo sapien
ggaggtattatccacactgtgatct

SEQ ID NO: 608740 - DNA, 25 bp, Homo sapien
tatccacactgtgatcttgaaataa

SEQ ID NO: 608741 - DNA, 25 bp, Homo sapien
gaatttcactaaggctgctttcgag

SEQ ID NO: 608742 - DNA, 25 bp, Homo sapien
ggctgctttcgagaacaaagtcttt

SEQ ID NO: 608743 - DNA, 25 bp, Homo sapien
atttttcttatgtaagaggcacatt

SEQ ID NO: 608744 - DNA, 25 bp, Homo sapien
agcgaacatgtataatagtaatatt

SEQ ID NO: 608745 - DNA, 25 bp, Homo sapien
gcgaacatgtataatagtaatattt

SEQ ID NO: 608746 - DNA, 25 bp, Homo sapien
gtataatagtaatattttggccggg

SEQ ID NO: 608747 - DNA, 25 bp, Homo sapien
tataatagtaatattttggccgggt

SEQ ID NO: 608748 - DNA, 25 bp, Homo sapien
ataatagtaatattttggccgggtg

SEQ ID NO: 608749 - DNA, 25 bp, Homo sapien
taatagtaatattttggccgggtgc

SEQ ID NO: 608750 - DNA, 25 bp, Homo sapien
atagtaatattttggccgggtgcag

SEQ ID NO: 608751 - DNA, 25 bp, Homo sapien
ggcgggtggattgagagtttgagac

SEQ ID NO: 608752 - DNA, 25 bp, Homo sapien
tagctgggcattgcggcgcatgtct

SEQ ID NO: 608753 - DNA, 25 bp, Homo sapien
tgggcattgcggcgcatgtctgtag

SEQ ID NO: 608754 - DNA, 25 bp, Homo sapien
gcattgcggcgcatgtctgtagtcc

SEQ ID NO: 608755 - DNA, 25 bp, Homo sapien
atttcatatgctgtacatcagtaac

SEQ ID NO: 608756 - DNA, 25 bp, Homo sapien
gttaatatccatgtactagtcacat

SEQ ID NO: 608757 - DNA, 25 bp, Homo sapien
agaaatgttttagggtcattgacca

SEQ ID NO: 608758 - DNA, 25 bp, Homo sapien
ggtcattgaccagtgtagtcagtac

SEQ ID NO: 608759 - DNA, 25 bp, Homo sapien
tagtcagtacagtggtcccatggta

SEQ ID NO: 608760 - DNA, 25 bp, Homo sapien
tacagtggtcccatggtatttgtgg

SEQ ID NO: 608761 - DNA, 25 bp, Homo sapien
gattggttccaggaatctcttggac

SEQ ID NO: 608762 - DNA, 25 bp, Homo sapien
aggaatctcttggacaccaactccg

SEQ ID NO: 608763 - DNA, 25 bp, Homo sapien
ttggacaccaactccgtggatgatc

SEQ ID NO: 608764 - DNA, 25 bp, Homo sapien
aactccgtggatgatcagacaatat

SEQ ID NO: 608765 - DNA, 25 bp, Homo sapien
ccagcattttgcgagaatcacttga

SEQ ID NO: 608766 - DNA, 25 bp, Homo sapien
gcttgagacatgttgcagaccccgc

SEQ ID NO: 608767 - DNA, 25 bp, Homo sapien
agacatgttgcagaccccgcacttg

SEQ ID NO: 608768 - DNA, 25 bp, Homo sapien
accccgcacttgctggatcagctga

SEQ ID NO: 608769 - DNA, 25 bp, Homo sapien
ttgctggatcagctgacgccacaca

SEQ ID NO: 608770 - DNA, 25 bp, Homo sapien
atcagctgacgccacacagatggat

SEQ ID NO: 608771 - DNA, 25 bp, Homo sapien
ctgacgccacacagatggataaact

SEQ ID NO: 608772 - DNA, 25 bp, Homo sapien
cacccgggaactgacgaagcgcaag

SEQ ID NO: 608773 - DNA, 25 bp, Homo sapien
ccctgtgagttcatccctgaccaac

SEQ ID NO: 608774 - DNA, 25 bp, Homo sapien
ttctgctccccgaattctcgaggag

SEQ ID NO: 608775 - DNA, 25 bp, Homo sapien
tccccgaattctcgaggagactgat

SEQ ID NO: 608776 - DNA, 25 bp, Homo sapien
gaattctcgaggagactgatttgag

SEQ ID NO: 608777 - DNA, 25 bp, Homo sapien
ggcatggccgtttcctatgatggct

SEQ ID NO: 608778 - DNA, 25 bp, Homo sapien
tatgatggctgctacgccttcactg

SEQ ID NO: 608779 - DNA, 25 bp, Homo sapien
ttcactgcgggagggcacgatcgct

SEQ ID NO: 608780 - DNA, 25 bp, Homo sapien
atcgctcggtggtgcagtggaaaat

SEQ ID NO: 608781 - DNA, 25 bp, Homo sapien
gaaaatcaccttaagccatcctggg

SEQ ID NO: 608782 - DNA, 25 bp, Homo sapien
aaaatcaccttaagccatcctggga

SEQ ID NO: 608783 - DNA, 25 bp, Homo sapien
aaatcaccttaagccatcctgggag

SEQ ID NO: 608784 - DNA, 25 bp, Homo sapien
aatcaccttaagccatcctgggagc

SEQ ID NO: 608785 - DNA, 25 bp, Homo sapien
ttaagccatcctgggagccaggcac

SEQ ID NO: 608786 - DNA, 25 bp, Homo sapien
gagccaggcaccaatattatcccca

SEQ ID NO: 608787 - DNA, 25 bp, Homo sapien
tattatccccatcagacacatcaag

SEQ ID NO: 608788 - DNA, 25 bp, Homo sapien
tgttgctagtttcacatcagtcccc

SEQ ID NO: 608789 - DNA, 25 bp, Homo sapien
tttcacatcagtcccctggtttaat

SEQ ID NO: 608790 - DNA, 25 bp, Homo sapien
tcagtcccctggtttaataagaaat

SEQ ID NO: 608791 - DNA, 25 bp, Homo sapien
tgaggatgtgaacctttgtgttcct

SEQ ID NO: 608792 - DNA, 25 bp, Homo sapien
gtgttcctcagctggaacgtttctc

SEQ ID NO: 608793 - DNA, 25 bp, Homo sapien
tggaacgtttctctctccgttgacg

SEQ ID NO: 608794 - DNA, 25 bp, Homo sapien
tccgttgacgctgtagctgggactg

SEQ ID NO: 608795 - DNA, 25 bp, Homo sapien
tgggactgggcttcttgactttgga

SEQ ID NO: 608796 - DNA, 25 bp, Homo sapien
gaagagggatggtatcctggcacct

SEQ ID NO: 608797 - DNA, 25 bp, Homo sapien
atggtatcctggcacctcctgtgtc

SEQ ID NO: 608798 - DNA, 25 bp, Homo sapien
tcctgtgtctgggactgaaaggcct

SEQ ID NO: 608799 - DNA, 25 bp, Homo sapien
cccctaagaagtcgtatctctaata

SEQ ID NO: 608800 - DNA, 25 bp, Homo sapien
gaagtcgtatctctaataaggccag

SEQ ID NO: 608801 - DNA, 25 bp, Homo sapien
aagtcgtatctctaataaggccaga

SEQ ID NO: 608802 - DNA, 25 bp, Homo sapien
agtcgtatctctaataaggccagac

SEQ ID NO: 608803 - DNA, 25 bp, Homo sapien
gtcgtatctctaataaggccagact

SEQ ID NO: 608804 - DNA, 25 bp, Homo sapien
tcgtatctctaataaggccagactc

SEQ ID NO: 608805 - DNA, 25 bp, Homo sapien
gtatctctaataaggccagactcag

SEQ ID NO: 608806 - DNA, 25 bp, Homo sapien
tatctctaataaggccagactcagt

SEQ ID NO: 608807 - DNA, 25 bp, Homo sapien
aataaggccagactcagtggctaac

SEQ ID NO: 608808 - DNA, 25 bp, Homo sapien
taaggccagactcagtggctaacac

SEQ ID NO: 608809 - DNA, 25 bp, Homo sapien
aggccagactcagtggctaacacct

SEQ ID NO: 608810 - DNA, 25 bp, Homo sapien
agttcgatgcatgctgactggatat

SEQ ID NO: 608811 - DNA, 25 bp, Homo sapien
gactggatatcagaggctactccct

SEQ ID NO: 608812 - DNA, 25 bp, Homo sapien
tttcaacccctcctttttctgcatg

SEQ ID NO: 608813 - DNA, 25 bp, Homo sapien
ttttctgcatggcagttgctgcctg

SEQ ID NO: 608814 - DNA, 25 bp, Homo sapien
gttggaaatgaaagtacctcggatt

SEQ ID NO: 608815 - DNA, 25 bp, Homo sapien
tgcgggccactactttatgtgcata

SEQ ID NO: 608816 - DNA, 25 bp, Homo sapien
gggccactactttatgtgcatagag

SEQ ID NO: 608817 - DNA, 25 bp, Homo sapien
tagagtgaacagatgggaaacccct

SEQ ID NO: 608818 - DNA, 25 bp, Homo sapien
aaccccagaaaatcctgtagcccag

SEQ ID NO: 608819 - DNA, 25 bp, Homo sapien
tgtagcccaggctcttgagcctctt

SEQ ID NO: 608820 - DNA, 25 bp, Homo sapien
aggctcttgagcctcttgctcgagc

SEQ ID NO: 608821 - DNA, 25 bp, Homo sapien
aaactccggacacactagcacttac

SEQ ID NO: 608822 - DNA, 25 bp, Homo sapien
aactccggacacactagcacttaca

SEQ ID NO: 608823 - DNA, 25 bp, Homo sapien
actccggacacactagcacttacag

SEQ ID NO: 608824 - DNA, 25 bp, Homo sapien
ctccggacacactagcacttacagg

SEQ ID NO: 608825 - DNA, 25 bp, Homo sapien
tccggacacactagcacttacagga

SEQ ID NO: 608826 - DNA, 25 bp, Homo sapien
ccggacacactagcacttacaggag

SEQ ID NO: 608827 - DNA, 25 bp, Homo sapien
cggacacactagcacttacaggagg

SEQ ID NO: 608828 - DNA, 25 bp, Homo sapien
ggacacactagcacttacaggaggc

SEQ ID NO: 608829 - DNA, 25 bp, Homo sapien
gacacactagcacttacaggaggcc

SEQ ID NO: 608830 - DNA, 25 bp, Homo sapien
cactagcacttacaggaggcccagg

SEQ ID NO: 608831 - DNA, 25 bp, Homo sapien
ggacggccaaggaattagacaccaa

SEQ ID NO: 608832 - DNA, 25 bp, Homo sapien
gaattagacaccaacacactgaaga

SEQ ID NO: 608833 - DNA, 25 bp, Homo sapien
acactgaagaatgctggtgacttac

SEQ ID NO: 608834 - DNA, 25 bp, Homo sapien
gaatgctggtgacttactgaacagg

SEQ ID NO: 608835 - DNA, 25 bp, Homo sapien
gtgacttactgaacaggagtgctcc

SEQ ID NO: 608836 - DNA, 25 bp, Homo sapien
acaggagtgctccacagaaattaga

SEQ ID NO: 608837 - DNA, 25 bp, Homo sapien
gctccacagaaattagaggttattt

SEQ ID NO: 608838 - DNA, 25 bp, Homo sapien
gaggttatttatccccagttggaga

SEQ ID NO: 608839 - DNA, 25 bp, Homo sapien
gttatttatccccagttggagaaag

SEQ ID NO: 608840 - DNA, 25 bp, Homo sapien
tcagaagctctgacccagttggaga

SEQ ID NO: 608841 - DNA, 25 bp, Homo sapien
agaagctctgacctgttcatccctg

SEQ ID NO: 608842 - DNA, 25 bp, Homo sapien
aaatggcctgttgagtgtaggtcat

SEQ ID NO: 608843 - DNA, 25 bp, Homo sapien
gagtgtaggtcatttgctgtcattg

SEQ ID NO: 608844 - DNA, 25 bp, Homo sapien
ggtcatttgctgtcattggtctgaa

SEQ ID NO: 608845 - DNA, 25 bp, Homo sapien
attggtctgaaagctgcagtcaccc

SEQ ID NO: 608846 - DNA, 25 bp, Homo sapien
caggacctgtgtctaccagttaaag

SEQ ID NO: 608847 - DNA, 25 bp, Homo sapien
gtgtctaccagttaaagttcaactt

SEQ ID NO: 608848 - DNA, 25 bp, Homo sapien
ctttaaaaggcagacgcgttgtgga

SEQ ID NO: 608849 - DNA, 25 bp, Homo sapien
acatcttctcactcttggggcatag

SEQ ID NO: 608850 - DNA, 25 bp, Homo sapien
gcgtggcaagggttaaataaatctc

SEQ ID NO: 608851 - DNA, 25 bp, Homo sapien
tctctagcagagtccaaatttttgt

SEQ ID NO: 608852 - DNA, 25 bp, Homo sapien
gagtccaaatttttgttgaactgaa

SEQ ID NO: 608853 - DNA, 25 bp, Homo sapien
tcctgatctgaaattacctgcactt

SEQ ID NO: 608854 - DNA, 25 bp, Homo sapien
acctgcactttatttggctccatct

SEQ ID NO: 608855 - DNA, 25 bp, Homo sapien
tatttggctccatctacttttctgc

SEQ ID NO: 608856 - DNA, 25 bp, Homo sapien
ccacttactccctgtataaccatag

SEQ ID NO: 608857 - DNA, 25 bp, Homo sapien
taaccataggctacgtaccctacct

SEQ ID NO: 608858 - DNA, 25 bp, Homo sapien
atggcaatcacaacaccttgctaca

SEQ ID NO: 608859 - DNA, 25 bp, Homo sapien
aacaccttgctacagatacgttagg

SEQ ID NO: 608860 - DNA, 25 bp, Homo sapien
aaatgggataacatgcagggtgcct

SEQ ID NO: 608861 - DNA, 25 bp, Homo sapien
atgcagggtgcctagccttcctggc

SEQ ID NO: 608862 - DNA, 25 bp, Homo sapien
caaaccctggagactactgtcttcc

SEQ ID NO: 608863 - DNA, 25 bp, Homo sapien
actgtcttccccttagtgatgctaa

SEQ ID NO: 608864 - DNA, 25 bp, Homo sapien
accacattaaatcccaggtacgaat

SEQ ID NO: 608865 - DNA, 25 bp, Homo sapien
ccaggtacgaatccaagttttgagt

SEQ ID NO: 608866 - DNA, 25 bp, Homo sapien
agttctagaaggatcatggcatgct

SEQ ID NO: 608867 - DNA, 25 bp, Homo sapien
tcatggcatgcttatcctttttgtt

SEQ ID NO: 608868 - DNA, 25 bp, Homo sapien
tttttgttttcaccaaccctgagag

SEQ ID NO: 608869 - DNA, 25 bp, Homo sapien
ttgttttcaccaaccctgagaggta

SEQ ID NO: 608870 - DNA, 25 bp, Homo sapien
tgagaggtagtctacattccaagat

SEQ ID NO: 608871 - DNA, 25 bp, Homo sapien
tagaagggctgcattctatgaggca

SEQ ID NO: 608872 - DNA, 25 bp, Homo sapien
attagacatggaattacagagcttt

SEQ ID NO: 608873 - DNA, 25 bp, Homo sapien
cagagcttttcattgcaatttccat

SEQ ID NO: 608874 - DNA, 25 bp, Homo sapien
tgcaatttccatgactgttatttat

SEQ ID NO: 608875 - DNA, 25 bp, Homo sapien
gttgtaattaatagagttgtcagct

SEQ ID NO: 608876 - DNA, 25 bp, Homo sapien
tagagttgtcagctaatacatcatt

SEQ ID NO: 608877 - DNA, 25 bp, Homo sapien
aactgcattttatgatagaaaactc

SEQ ID NO: 608878 - DNA, 25 bp, Homo sapien
gagttcagagaattgcatggctata

SEQ ID NO: 608879 - DNA, 25 bp, Homo sapien
gaattgcatggctatatttatctat

SEQ ID NO: 608880 - DNA, 25 bp, Homo sapien
gcatggctatatttatctattcata

SEQ ID NO: 608881 - DNA, 25 bp, Homo sapien
atctattcatatgacaacagtttct

SEQ ID NO: 608882 - DNA, 25 bp, Homo sapien
atgacaacagtttcttagcacttac

SEQ ID NO: 608883 - DNA, 25 bp, Homo sapien
aacagtttcttagcacttacatgtg

SEQ ID NO: 608884 - DNA, 25 bp, Homo sapien
taaaattaacactgaatcttgattc

SEQ ID NO: 608885 - DNA, 25 bp, Homo sapien
tcatgggtacatgaaccaatagaag

SEQ ID NO: 608886 - DNA, 25 bp, Homo sapien
taagtgagccagtattggcccctcg

SEQ ID NO: 608887 - DNA, 25 bp, Homo sapien
tgccgcccggaatcctccaaggagg

SEQ ID NO: 608888 - DNA, 25 bp, Homo sapien
aaggaggcttgcacttgtcggcttg

SEQ ID NO: 608889 - DNA, 25 bp, Homo sapien
ggcttgcacttgtcggcttgctctt

SEQ ID NO: 608890 - DNA, 25 bp, Homo sapien
cactgcgggagtcaaggcctaagca

SEQ ID NO: 608891 - DNA, 25 bp, Homo sapien
tcaaggcctaagcagggctccagct

SEQ ID NO: 608892 - DNA, 25 bp, Homo sapien
tcacagccccagtcacgttaggttt

SEQ ID NO: 608893 - DNA, 25 bp, Homo sapien
ggtttcccatttaaattctctctca

SEQ ID NO: 608894 - DNA, 25 bp, Homo sapien
ccatttaaattctctctcaacctct

SEQ ID NO: 608895 - DNA, 25 bp, Homo sapien
caaagtggtgtggacacggcgcctt

SEQ ID NO: 608896 - DNA, 25 bp, Homo sapien
ttgcccccagatctgcatcggaatg

SEQ ID NO: 608897 - DNA, 25 bp, Homo sapien
aacactctacatatgctccatcttg

SEQ ID NO: 608898 - DNA, 25 bp, Homo sapien
actctacatatgctccatcttgcag

SEQ ID NO: 608899 - DNA, 25 bp, Homo sapien
acatatgctccatcttgcagaggct

SEQ ID NO: 608900 - DNA, 25 bp, Homo sapien
atgctccatcttgcagaggcttcat

SEQ ID NO: 608901 - DNA, 25 bp, Homo sapien
tccatcttgcagaggcttcattctt

SEQ ID NO: 608902 - DNA, 25 bp, Homo sapien
tcttgcagaggcttcattcttggtt

SEQ ID NO: 608903 - DNA, 25 bp, Homo sapien
tgcagaggcttcattcttggttctc

SEQ ID NO: 608904 - DNA, 25 bp, Homo sapien
gaggcttcattcttggttctctagc

SEQ ID NO: 608905 - DNA, 25 bp, Homo sapien
gcttcattcttggttctctagctaa

SEQ ID NO: 608906 - DNA, 25 bp, Homo sapien
tcattcttggttctctagctaaaaa

SEQ ID NO: 608907 - DNA, 25 bp, Homo sapien
ttggttctctagctaaaaacagtag

SEQ ID NO: 608908 - DNA, 25 bp, Homo sapien
cgtagtggtacatgcatttagtcct

SEQ ID NO: 608909 - DNA, 25 bp, Homo sapien
gtagtggtacatgcatttagtccta

SEQ ID NO: 608910 - DNA, 25 bp, Homo sapien
tagtggtacatgcatttagtcctag

SEQ ID NO: 608911 - DNA, 25 bp, Homo sapien
agtggtacatgcatttagtcctagc

SEQ ID NO: 608912 - DNA, 25 bp, Homo sapien
gtggtacatgcatttagtcctagct

SEQ ID NO: 608913 - DNA, 25 bp, Homo sapien
tggtacatgcatttagtcctagcta

SEQ ID NO: 608914 - DNA, 25 bp, Homo sapien
ggtacatgcatttagtcctagctac

SEQ ID NO: 608915 - DNA, 25 bp, Homo sapien
gtacatgcatttagtcctagctact

SEQ ID NO: 608916 - DNA, 25 bp, Homo sapien
tgctctggacgtggcctttccagca

SEQ ID NO: 608917 - DNA, 25 bp, Homo sapien
cagcactcaccactctgaattaaac

SEQ ID NO: 608918 - DNA, 25 bp, Homo sapien
gcctcgggcagaggaccgtttcctt

SEQ ID NO: 608919 - DNA, 25 bp, Homo sapien
gaggaccgtttccttttacgctgtg

SEQ ID NO: 608920 - DNA, 25 bp, Homo sapien
ttacgctgtgccatgccagggagat

SEQ ID NO: 608921 - DNA, 25 bp, Homo sapien
agcagagtcctgagatgtcctttga

SEQ ID NO: 608922 - DNA, 25 bp, Homo sapien
gagatgtcctttgatgtacccacag

SEQ ID NO: 608923 - DNA, 25 bp, Homo sapien
gatgtacccacaggagagttcgctc

SEQ ID NO: 608924 - DNA, 25 bp, Homo sapien
agttcgctccttcccgaggcagtgt

SEQ ID NO: 608925 - DNA, 25 bp, Homo sapien
accaaaccacagaatgggacggcag

SEQ ID NO: 608926 - DNA, 25 bp, Homo sapien
ggcagagggccctaaaaagcccatt

SEQ ID NO: 608927 - DNA, 25 bp, Homo sapien
aacatatgttactacatcccagaaa

SEQ ID NO: 608928 - DNA, 25 bp, Homo sapien
attgcacagggctctgactttcagt

SEQ ID NO: 608929 - DNA, 25 bp, Homo sapien
gactttcagtactttctcacacatt

SEQ ID NO: 608930 - DNA, 25 bp, Homo sapien
ctcacacattttggccaagttttgg

SEQ ID NO: 608931 - DNA, 25 bp, Homo sapien
aagttttggagtctgataatttcac

SEQ ID NO: 608932 - DNA, 25 bp, Homo sapien
gccccaccccttatgtaatctaggg

SEQ ID NO: 608933 - DNA, 25 bp, Homo sapien
taatctagggacgtttttacatcct

SEQ ID NO: 608934 - DNA, 25 bp, Homo sapien
tttacatcctttctgtgactcactt

SEQ ID NO: 608935 - DNA, 25 bp, Homo sapien
actcacttctccaacctgtaaaatg

SEQ ID NO: 608936 - DNA, 25 bp, Homo sapien
caactcactctactaacttgttggg

SEQ ID NO: 608937 - DNA, 25 bp, Homo sapien
gtagaacatcctatgcaccttaaag

SEQ ID NO: 608938 - DNA, 25 bp, Homo sapien
gtgggcctttgaccaagctgtcaaa

SEQ ID NO: 608939 - DNA, 25 bp, Homo sapien
aagctgtcaaatttgttccccagcc

SEQ ID NO: 608940 - DNA, 25 bp, Homo sapien
cctagggtagtaactgtggctcaca

SEQ ID NO: 608941 - DNA, 25 bp, Homo sapien
ccctgacacttcacagttcttttta

SEQ ID NO: 608942 - DNA, 25 bp, Homo sapien
tcacagttctttttaccctttggca

SEQ ID NO: 608943 - DNA, 25 bp, Homo sapien
tttggcacctcatcaactttatacc

SEQ ID NO: 608944 - DNA, 25 bp, Homo sapien
aacaatccttgctattacatcctct

SEQ ID NO: 608945 - DNA, 25 bp, Homo sapien
ttacatcctctgctcaaataactgg

SEQ ID NO: 608946 - DNA, 25 bp, Homo sapien
actggcatggtttctgtctgttgac

SEQ ID NO: 608947 - DNA, 25 bp, Homo sapien
gtttctgtctgttgactgacacaca

SEQ ID NO: 608948 - DNA, 25 bp, Homo sapien
ctgggctatccagacatgactttag

SEQ ID NO: 608949 - DNA, 25 bp, Homo sapien
cacatgcctatggtaaaagtcaaac

SEQ ID NO: 608950 - DNA, 25 bp, Homo sapien
tattaaaaagtaagtctctcttcct

SEQ ID NO: 608951 - DNA, 25 bp, Homo sapien
tcagttccctggtcccattttcaaa

SEQ ID NO: 608952 - DNA, 25 bp, Homo sapien
gtaacaactgttaccagttactgat

SEQ ID NO: 608953 - DNA, 25 bp, Homo sapien
accagttactgatgtatcattccag

SEQ ID NO: 608954 - DNA, 25 bp, Homo sapien
gtatcattccagagatattccatgt

SEQ ID NO: 608955 - DNA, 25 bp, Homo sapien
acaagcatattgtgtgtgggtatgt

SEQ ID NO: 608956 - DNA, 25 bp, Homo sapien
tgggtatgtgtgtatcaggtttttt

SEQ ID NO: 608957 - DNA, 25 bp, Homo sapien
cacaaatggtggcatactatacatg

SEQ ID NO: 608958 - DNA, 25 bp, Homo sapien
ggtggcatactatacatgctgttct

SEQ ID NO: 608959 - DNA, 25 bp, Homo sapien
atattaaagctgatatcttaatccc

SEQ ID NO: 608960 - DNA, 25 bp, Homo sapien
agcctccatctctcttagggtcttg

SEQ ID NO: 608961 - DNA, 25 bp, Homo sapien
atctctcttagggtcttgcccatca

SEQ ID NO: 608962 - DNA, 25 bp, Homo sapien
tcttgcccatcactgctgctgtctt

SEQ ID NO: 608963 - DNA, 25 bp, Homo sapien
tggcttctcctgcaatctttcctgt

SEQ ID NO: 608964 - DNA, 25 bp, Homo sapien
tgttttcttctcctctctggagctg

SEQ ID NO: 608965 - DNA, 25 bp, Homo sapien
cacagaccagccaacagcatttcta

SEQ ID NO: 608966 - DNA, 25 bp, Homo sapien
cagccaacagcatttctacctttaa

SEQ ID NO: 608967 - DNA, 25 bp, Homo sapien
caacagcatttctacctttaaaact

SEQ ID NO: 608968 - DNA, 25 bp, Homo sapien
aaaactctgctattcaagccaggca

SEQ ID NO: 608969 - DNA, 25 bp, Homo sapien
ctctgctattcaagccaggcatggt

SEQ ID NO: 608970 - DNA, 25 bp, Homo sapien
cagtacgctatgactgtgcctgtga

SEQ ID NO: 608971 - DNA, 25 bp, Homo sapien
ttttgtgctttctatgcgctgggcg

SEQ ID NO: 608972 - DNA, 25 bp, Homo sapien
gcgctgggcgtattaagagctttac

SEQ ID NO: 608973 - DNA, 25 bp, Homo sapien
tgttgtccccattttgacagtgaag

SEQ ID NO: 608974 - DNA, 25 bp, Homo sapien
ttgtaccgtacagggttacacagct

SEQ ID NO: 608975 - DNA, 25 bp, Homo sapien
taattaacacccgagcaggctggct

SEQ ID NO: 608976 - DNA, 25 bp, Homo sapien
tggctccacgcttttaactctgttg

SEQ ID NO: 608977 - DNA, 25 bp, Homo sapien
ttttaactctgttgctctactacct

SEQ ID NO: 608978 - DNA, 25 bp, Homo sapien
tctactacctcctttatctgtggct

SEQ ID NO: 608979 - DNA, 25 bp, Homo sapien
atctgtggctctttttagtttacaa

SEQ ID NO: 608980 - DNA, 25 bp, Homo sapien
tttacttaaacttcggagacctgag

SEQ ID NO: 608981 - DNA, 25 bp, Homo sapien
cggagacctgagtgtgcttttgtgt

SEQ ID NO: 608982 - DNA, 25 bp, Homo sapien
cagggaaccctttcaccctcatggg

SEQ ID NO: 608983 - DNA, 25 bp, Homo sapien
tttcaccctcatggggctacagaga

SEQ ID NO: 608984 - DNA, 25 bp, Homo sapien
gggctacagagatagttcctcttgg

SEQ ID NO: 608985 - DNA, 25 bp, Homo sapien
ggctacagagatagttcctcttggg

SEQ ID NO: 608986 - DNA, 25 bp, Homo sapien
gctacagagatagttcctcttgggt

SEQ ID NO: 608987 - DNA, 25 bp, Homo sapien
ctacagagatagttcctcttgggtg

SEQ ID NO: 608988 - DNA, 25 bp, Homo sapien
tacagagatagttcctcttgggtgg

SEQ ID NO: 608989 - DNA, 25 bp, Homo sapien
acagagatagttcctcttgggtggg

SEQ ID NO: 608990 - DNA, 25 bp, Homo sapien
gaacaggttgccaggagaaagcagt

SEQ ID NO: 608991 - DNA, 25 bp, Homo sapien
aacaggttgccaggagaaagcagtg

SEQ ID NO: 608992 - DNA, 25 bp, Homo sapien
acgtggcaagatcccgtgtctacaa

SEQ ID NO: 608993 - DNA, 25 bp, Homo sapien
aagactcactggacttgcacaaggg

SEQ ID NO: 608994 - DNA, 25 bp, Homo sapien
caaaatccgagtctgctgagtcgct

SEQ ID NO: 608995 - DNA, 25 bp, Homo sapien
aatgagctcacccatatccatcaga

SEQ ID NO: 608996 - DNA, 25 bp, Homo sapien
atccatcagagtctaaaagcaggct

SEQ ID NO: 608997 - DNA, 25 bp, Homo sapien
aaagccactgttggacgccctttga

SEQ ID NO: 608998 - DNA, 25 bp, Homo sapien
gacgccctttgattgcttggcgata

SEQ ID NO: 608999 - DNA, 25 bp, Homo sapien
gattgcttggcgatatgtacctata

SEQ ID NO: 609000 - DNA, 25 bp, Homo sapien
gtgagaaaagtagcccggaacctgg

SEQ ID NO: 609001 - DNA, 25 bp, Homo sapien
aaggccacttcaggtgtccttgttg

SEQ ID NO: 609002 - DNA, 25 bp, Homo sapien
gtgctggatgtagtcaaccttgtgc

SEQ ID NO: 609003 - DNA, 25 bp, Homo sapien
aaccttgtgcaagactcactggact

SEQ ID NO: 609004 - DNA, 25 bp, Homo sapien
gttgaaaaatcattacctgtggaat

SEQ ID NO: 609005 - DNA, 25 bp, Homo sapien
aatattggaagcagcatagtgttga

SEQ ID NO: 609006 - DNA, 25 bp, Homo sapien
aacaagacagcttggtcagctacaa

SEQ ID NO: 609007 - DNA, 25 bp, Homo sapien
agcccgggtcagacaccaacacttg

SEQ ID NO: 609008 - DNA, 25 bp, Homo sapien
gggtcagacaccaacacttggccaa

SEQ ID NO: 609009 - DNA, 25 bp, Homo sapien
agaagctagggctcttcatcctgct

SEQ ID NO: 609010 - DNA, 25 bp, Homo sapien
gctgctgtttcagccgcagctgaat

SEQ ID NO: 609011 - DNA, 25 bp, Homo sapien
cagccgcagctgaatttgagaatgc

SEQ ID NO: 609012 - DNA, 25 bp, Homo sapien
ttgagaatgctgaatctgaggctga

SEQ ID NO: 609013 - DNA, 25 bp, Homo sapien
aatgctgaatctgaggctgatttca

SEQ ID NO: 609014 - DNA, 25 bp, Homo sapien
ctgaggctgatttcagtatacattt

SEQ ID NO: 609015 - DNA, 25 bp, Homo sapien
ggccttcacccttggctgccgaaga

SEQ ID NO: 609016 - DNA, 25 bp, Homo sapien
ccttggctgccgaagagggcaccaa

SEQ ID NO: 609017 - DNA, 25 bp, Homo sapien
gagggcaccaagaacttagtataga

SEQ ID NO: 609018 - DNA, 25 bp, Homo sapien
gaacttagtatagactcttctaaag

SEQ ID NO: 609019 - DNA, 25 bp, Homo sapien
ctgggagaatgctccaagaggagat

SEQ ID NO: 609020 - DNA, 25 bp, Homo sapien
agattcatgcctttagacagctgga

SEQ ID NO: 609021 - DNA, 25 bp, Homo sapien
gcctttagacagctggaagtacaaa

SEQ ID NO: 609022 - DNA, 25 bp, Homo sapien
aactgtgacatcaagaagggcagga

SEQ ID NO: 609023 - DNA, 25 bp, Homo sapien
aaggcatttctataacatctatctg

SEQ ID NO: 609024 - DNA, 25 bp, Homo sapien
aacatctatctgatcctaacagagt

SEQ ID NO: 609025 - DNA, 25 bp, Homo sapien
gatcttaacatctcacttctactcc

SEQ ID NO: 609026 - DNA, 25 bp, Homo sapien
agcctccagagccaaattgtttcct

SEQ ID NO: 609027 - DNA, 25 bp, Homo sapien
ccagagccaaattgtttccttcaga

SEQ ID NO: 609028 - DNA, 25 bp, Homo sapien
ttgtttccttcagaattccaccaca

SEQ ID NO: 609029 - DNA, 25 bp, Homo sapien
attccaccacattcataaagatttg

SEQ ID NO: 609030 - DNA, 25 bp, Homo sapien
agatttgacagcaattctatacagt

SEQ ID NO: 609031 - DNA, 25 bp, Homo sapien
gcaattctatacagtctctttgaga

SEQ ID NO: 609032 - DNA, 25 bp, Homo sapien
ggagctagtaaataccctgatactg

SEQ ID NO: 609033 - DNA, 25 bp, Homo sapien
gtaaataccctgatactgaaatgta

SEQ ID NO: 609034 - DNA, 25 bp, Homo sapien
gataaaattatagacccctgcatat

SEQ ID NO: 609035 - DNA, 25 bp, Homo sapien
atagacccctgcatattaaatttca

SEQ ID NO: 609036 - DNA, 25 bp, Homo sapien
aatacttgggtaatgaataacagca

SEQ ID NO: 609037 - DNA, 25 bp, Homo sapien
ttaaagtagcccaatctctgcctag

SEQ ID NO: 609038 - DNA, 25 bp, Homo sapien
ctctgcctagtttctgggtgtggcc

SEQ ID NO: 609039 - DNA, 25 bp, Homo sapien
cagcgcgcttcacagactttaatgt

SEQ ID NO: 609040 - DNA, 25 bp, Homo sapien
ctttaatgtggactcggttcaccga

SEQ ID NO: 609041 - DNA, 25 bp, Homo sapien
ttcaccgagggccttgttaaataca

SEQ ID NO: 609042 - DNA, 25 bp, Homo sapien
gttcagacagtgtagccaggaccga

SEQ ID NO: 609043 - DNA, 25 bp, Homo sapien
tagccaggaccgagtctgagattct

SEQ ID NO: 609044 - DNA, 25 bp, Homo sapien
caagctcctggaggctgatgtgctt

SEQ ID NO: 609045 - DNA, 25 bp, Homo sapien
tgatgtgcttttggtcagtgaacca

SEQ ID NO: 609046 - DNA, 25 bp, Homo sapien
tctaagtaaatctgccatgggttct

SEQ ID NO: 609047 - DNA, 25 bp, Homo sapien
catgggttctgggttctagatgtca

SEQ ID NO: 609048 - DNA, 25 bp, Homo sapien
tattacatataggccgggctcagtg

SEQ ID NO: 609049 - DNA, 25 bp, Homo sapien
gatttcgccaccagcctggccagtg

SEQ ID NO: 609050 - DNA, 25 bp, Homo sapien
tcgccaccagcctggccagtgtggt

SEQ ID NO: 609051 - DNA, 25 bp, Homo sapien
acaaacaaacgaaagtcaggcatgg

SEQ ID NO: 609052 - DNA, 25 bp, Homo sapien
caaacaaacgaaagtcaggcatggt

SEQ ID NO: 609053 - DNA, 25 bp, Homo sapien
aaacaaacgaaagtcaggcatggtg

SEQ ID NO: 609054 - DNA, 25 bp, Homo sapien
aacaaacgaaagtcaggcatggtgc

SEQ ID NO: 609055 - DNA, 25 bp, Homo sapien
acaaacgaaagtcaggcatggtgct

SEQ ID NO: 609056 - DNA, 25 bp, Homo sapien
caaacgaaagtcaggcatggtgctg

SEQ ID NO: 609057 - DNA, 25 bp, Homo sapien
aaacgaaagtcaggcatggtgctgg

SEQ ID NO: 609058 - DNA, 25 bp, Homo sapien
gaaagtcaggcatggtgctgggctg

SEQ ID NO: 609059 - DNA, 25 bp, Homo sapien
aaggaaaaagatgcagaatctgtat

SEQ ID NO: 609060 - DNA, 25 bp, Homo sapien
gaaaaagatgcagaatctgtatgga

SEQ ID NO: 609061 - DNA, 25 bp, Homo sapien
aaaagatgcagaatctgtatggagt

SEQ ID NO: 609062 - DNA, 25 bp, Homo sapien
aaagatgcagaatctgtatggagtt

SEQ ID NO: 609063 - DNA, 25 bp, Homo sapien
aagatgcagaatctgtatggagttt

SEQ ID NO: 609064 - DNA, 25 bp, Homo sapien
agatgcagaatctgtatggagtttc

SEQ ID NO: 609065 - DNA, 25 bp, Homo sapien
gatgcagaatctgtatggagtttca

SEQ ID NO: 609066 - DNA, 25 bp, Homo sapien
atgcagaatctgtatggagtttcac

SEQ ID NO: 609067 - DNA, 25 bp, Homo sapien
tgcagaatctgtatggagtttcact

SEQ ID NO: 609068 - DNA, 25 bp, Homo sapien
gcagaatctgtatggagtttcactg

SEQ ID NO: 609069 - DNA, 25 bp, Homo sapien
cagaatctgtatggagtttcactgt

SEQ ID NO: 609070 - DNA, 25 bp, Homo sapien
ggatgacctgtaccgtgttccagaa

SEQ ID NO: 609071 - DNA, 25 bp, Homo sapien
gacctgtaccgtgttccagaaagtg

SEQ ID NO: 609072 - DNA, 25 bp, Homo sapien
aaagtggcagcctctgatcgtacag

SEQ ID NO: 609073 - DNA, 25 bp, Homo sapien
ctctgatcgtacaggactttcggat

SEQ ID NO: 609074 - DNA, 25 bp, Homo sapien
acaggactttcggattatgggaggc

SEQ ID NO: 609075 - DNA, 25 bp, Homo sapien
ggaaacctggataagcagctgagct

SEQ ID NO: 609076 - DNA, 25 bp, Homo sapien
gctgagctttaagtgcaatgtttca

SEQ ID NO: 609077 - DNA, 25 bp, Homo sapien
aaatacattttcgagtctggcacta

SEQ ID NO: 609078 - DNA, 25 bp, Homo sapien
gtacaataaattcttcaactatgga

SEQ ID NO: 609079 - DNA, 25 bp, Homo sapien
gtttttagatcgttaattgttcact

SEQ ID NO: 609080 - DNA, 25 bp, Homo sapien
attgttcacttctttggtatatata

SEQ ID NO: 609081 - DNA, 25 bp, Homo sapien
gtttctatggagataacaggattta

SEQ ID NO: 609082 - DNA, 25 bp, Homo sapien
ttttacaatgatttgctttatccct

SEQ ID NO: 609083 - DNA, 25 bp, Homo sapien
ttgctttatccctcatgtttctata

SEQ ID NO: 609084 - DNA, 25 bp, Homo sapien
atccctcatgtttctataaacctaa

SEQ ID NO: 609085 - DNA, 25 bp, Homo sapien
gtttagaagactgaatctagctatg

SEQ ID NO: 609086 - DNA, 25 bp, Homo sapien
gaatctagctatgagaatgcctcta

SEQ ID NO: 609087 - DNA, 25 bp, Homo sapien
gagaatgcctctaggaatatatttt

SEQ ID NO: 609088 - DNA, 25 bp, Homo sapien
tacattttgaatgtcccatgtggaa

SEQ ID NO: 609089 - DNA, 25 bp, Homo sapien
gaaagtatgacagtaggcctaagac

SEQ ID NO: 609090 - DNA, 25 bp, Homo sapien
atgacagtaggcctaagacattcta

SEQ ID NO: 609091 - DNA, 25 bp, Homo sapien
aagacattctacattcctaaattat

SEQ ID NO: 609092 - DNA, 25 bp, Homo sapien
gtagctgtagccatacctaatagac

SEQ ID NO: 609093 - DNA, 25 bp, Homo sapien
agctgtagccatacctaatagacct

SEQ ID NO: 609094 - DNA, 25 bp, Homo sapien
tgtagccatacctaatagacctcct

SEQ ID NO: 609095 - DNA, 25 bp, Homo sapien
tagccatacctaatagacctcctga

SEQ ID NO: 609096 - DNA, 25 bp, Homo sapien
gccatacctaatagacctcctgatg

SEQ ID NO: 609097 - DNA, 25 bp, Homo sapien
atacctaatagacctcctgatgctg

SEQ ID NO: 609098 - DNA, 25 bp, Homo sapien
acctcctgatgctgtacttacagat

SEQ ID NO: 609099 - DNA, 25 bp, Homo sapien
tgtacttacagataccacctctctt

SEQ ID NO: 609100 - DNA, 25 bp, Homo sapien
tacttacagataccacctctcttaa

SEQ ID NO: 609101 - DNA, 25 bp, Homo sapien
ttacagataccacctctcttaatca

SEQ ID NO: 609102 - DNA, 25 bp, Homo sapien
acagataccacctctcttaatcagg

SEQ ID NO: 609103 - DNA, 25 bp, Homo sapien
tattctcgtaaaactgcgctttgcc

SEQ ID NO: 609104 - DNA, 25 bp, Homo sapien
gcgctttgccagtagcacagtgaat

SEQ ID NO: 609105 - DNA, 25 bp, Homo sapien
gtatgccaaatgcaagtccattcca

SEQ ID NO: 609106 - DNA, 25 bp, Homo sapien
gcaagtccattccaaaatccatttg

SEQ ID NO: 609107 - DNA, 25 bp, Homo sapien
ccatttggaaatcttgagctcagct

SEQ ID NO: 609108 - DNA, 25 bp, Homo sapien
aatcttgagctcagctgtggttctt

SEQ ID NO: 609109 - DNA, 25 bp, Homo sapien
ggttcttaaacttttgcagtccata

SEQ ID NO: 609110 - DNA, 25 bp, Homo sapien
ttttgcagtccatagggcctttttt

SEQ ID NO: 609111 - DNA, 25 bp, Homo sapien
aattcatgatgtttacagcacagat

SEQ ID NO: 609112 - DNA, 25 bp, Homo sapien
ttgtgccataatcctaatttagctg

SEQ ID NO: 609113 - DNA, 25 bp, Homo sapien
aaaaacttacttgcatatgttaaca

SEQ ID NO: 609114 - DNA, 25 bp, Homo sapien
ggcccacacgggtggattgtcagga

SEQ ID NO: 609115 - DNA, 25 bp, Homo sapien
cccacacgggtggattgtcaggagt

SEQ ID NO: 609116 - DNA, 25 bp, Homo sapien
ccacacgggtggattgtcaggagtt

SEQ ID NO: 609117 - DNA, 25 bp, Homo sapien
cacacgggtggattgtcaggagttc

SEQ ID NO: 609118 - DNA, 25 bp, Homo sapien
aaacacttaactctgagttgtacac

SEQ ID NO: 609119 - DNA, 25 bp, Homo sapien
aacacttaactctgagttgtacact

SEQ ID NO: 609120 - DNA, 25 bp, Homo sapien
acacttaactctgagttgtacacta

SEQ ID NO: 609121 - DNA, 25 bp, Homo sapien
acttaactctgagttgtacactata

SEQ ID NO: 609122 - DNA, 25 bp, Homo sapien
cttaactctgagttgtacactataa

SEQ ID NO: 609123 - DNA, 25 bp, Homo sapien
aactctgagttgtacactataaaag

SEQ ID NO: 609124 - DNA, 25 bp, Homo sapien
actctgagttgtacactataaaagg

SEQ ID NO: 609125 - DNA, 25 bp, Homo sapien
acttgctgatcttggagggactgac

SEQ ID NO: 609126 - DNA, 25 bp, Homo sapien
gagggactgaccctctcagggttaa

SEQ ID NO: 609127 - DNA, 25 bp, Homo sapien
tctcagggttaactcattcctaggg

SEQ ID NO: 609128 - DNA, 25 bp, Homo sapien
tttccctagagcatgcctttcatat

SEQ ID NO: 609129 - DNA, 25 bp, Homo sapien
aaatcaaccaatccaaacctctact

SEQ ID NO: 609130 - DNA, 25 bp, Homo sapien
tctttattgggctctcatactctga

SEQ ID NO: 609131 - DNA, 25 bp, Homo sapien
tattctcctaccctaattaccacag

SEQ ID NO: 609132 - DNA, 25 bp, Homo sapien
acagggccaggtactaaacaacttg

SEQ ID NO: 609133 - DNA, 25 bp, Homo sapien
caacttgagataatccctacacttt

SEQ ID NO: 609134 - DNA, 25 bp, Homo sapien
cctacactttgtagcctgctcaaaa

SEQ ID NO: 609135 - DNA, 25 bp, Homo sapien
aacctatttagcctgtgtaccctgc

SEQ ID NO: 609136 - DNA, 25 bp, Homo sapien
cctgatcactgcttaacggcatgta

SEQ ID NO: 609137 - DNA, 25 bp, Homo sapien
ggcatgtataatggatacttcctca

SEQ ID NO: 609138 - DNA, 25 bp, Homo sapien
atggatacttcctcatgcagaaccc

SEQ ID NO: 609139 - DNA, 25 bp, Homo sapien
ccccagaggagtgactgtacgccat

SEQ ID NO: 609140 - DNA, 25 bp, Homo sapien
aggagtgactgtacgccattctctt

SEQ ID NO: 609141 - DNA, 25 bp, Homo sapien
tgactgtacgccattctctttgcca

SEQ ID NO: 609142 - DNA, 25 bp, Homo sapien
ctctttgccaagtaatagaaaacca

SEQ ID NO: 609143 - DNA, 25 bp, Homo sapien
ttaagttcatactgagcactgcctc

SEQ ID NO: 609144 - DNA, 25 bp, Homo sapien
atactgagcactgcctccaagatta

SEQ ID NO: 609145 - DNA, 25 bp, Homo sapien
gagcactgcctccaagattaaaaca

SEQ ID NO: 609146 - DNA, 25 bp, Homo sapien
aacaaggatttctgtggtcccagac

SEQ ID NO: 609147 - DNA, 25 bp, Homo sapien
gacacagggtttcataatgttcccc

SEQ ID NO: 609148 - DNA, 25 bp, Homo sapien
agggtttcataatgttccccaggct

SEQ ID NO: 609149 - DNA, 25 bp, Homo sapien
agctgccgtgcctggactatcagca

SEQ ID NO: 609150 - DNA, 25 bp, Homo sapien
gccgtgcctggactatcagcagcaa

SEQ ID NO: 609151 - DNA, 25 bp, Homo sapien
gtgcctggactatcagcagcaaatg

SEQ ID NO: 609152 - DNA, 25 bp, Homo sapien
ggactatcagcagcaaatgttttgc

SEQ ID NO: 609153 - DNA, 25 bp, Homo sapien
aatgttttgctgttacggtgtactg

SEQ ID NO: 609154 - DNA, 25 bp, Homo sapien
gttttgctgttacggtgtactgttc

SEQ ID NO: 609155 - DNA, 25 bp, Homo sapien
gctgttacggtgtactgttcgtatt

SEQ ID NO: 609156 - DNA, 25 bp, Homo sapien
acggtgtactgttcgtatttagaca

SEQ ID NO: 609157 - DNA, 25 bp, Homo sapien
gtactgttcgtatttagacaagaag

SEQ ID NO: 609158 - DNA, 25 bp, Homo sapien
catttaccttgtgatatcttattac

SEQ ID NO: 609159 - DNA, 25 bp, Homo sapien
atttaccttgtgatatcttattacc

SEQ ID NO: 609160 - DNA, 25 bp, Homo sapien
ttaccttgtgatatcttattacctt

SEQ ID NO: 609161 - DNA, 25 bp, Homo sapien
taccttgtgatatcttattaccttg

SEQ ID NO: 609162 - DNA, 25 bp, Homo sapien
gtgatatcttattaccttgtgaagc

SEQ ID NO: 609163 - DNA, 25 bp, Homo sapien
ttaccttgtgaagcatgggatctct

SEQ ID NO: 609164 - DNA, 25 bp, Homo sapien
accttgtgaagcatgggatctctgt

SEQ ID NO: 609165 - DNA, 25 bp, Homo sapien
ccttgtgaagcatgggatctctgtg

SEQ ID NO: 609166 - DNA, 25 bp, Homo sapien
cttgtgaagcatgggatctctgtga

SEQ ID NO: 609167 - DNA, 25 bp, Homo sapien
agcatgggatctctgtgacccatac

SEQ ID NO: 609168 - DNA, 25 bp, Homo sapien
cagggggcatcacagaacctgccaa

SEQ ID NO: 609169 - DNA, 25 bp, Homo sapien
gtactagagaaacctcgtcccacca

SEQ ID NO: 609170 - DNA, 25 bp, Homo sapien
tactagagaaacctcgtcccaccag

SEQ ID NO: 609171 - DNA, 25 bp, Homo sapien
actagagaaacctcgtcccaccagg

SEQ ID NO: 609172 - DNA, 25 bp, Homo sapien
ctagagaaacctcgtcccaccaggc

SEQ ID NO: 609173 - DNA, 25 bp, Homo sapien
tagagaaacctcgtcccaccaggcc

SEQ ID NO: 609174 - DNA, 25 bp, Homo sapien
agagaaacctcgtcccaccaggcct

SEQ ID NO: 609175 - DNA, 25 bp, Homo sapien
gagaaacctcgtcccaccaggcctc

SEQ ID NO: 609176 - DNA, 25 bp, Homo sapien
gaaacctcgtcccaccaggcctcat

SEQ ID NO: 609177 - DNA, 25 bp, Homo sapien
aaacctcgtcccaccaggcctcatg

SEQ ID NO: 609178 - DNA, 25 bp, Homo sapien
ctcgtcccaccaggcctcatgtgat

SEQ ID NO: 609179 - DNA, 25 bp, Homo sapien
cgtcccaccaggcctcatgtgatcc

SEQ ID NO: 609180 - DNA, 25 bp, Homo sapien
ggtccccccgtgaagaaggacacat

SEQ ID NO: 609181 - DNA, 25 bp, Homo sapien
agaaggacacatcccagcgctctgg

SEQ ID NO: 609182 - DNA, 25 bp, Homo sapien
aaggacacatcccagcgctctggat

SEQ ID NO: 609183 - DNA, 25 bp, Homo sapien
ggacacatcccagcgctctggatgt

SEQ ID NO: 609184 - DNA, 25 bp, Homo sapien
tctggatgtgctgtgatcgagctaa

SEQ ID NO: 609185 - DNA, 25 bp, Homo sapien
ctggatgtgctgtgatcgagctaaa

SEQ ID NO: 609186 - DNA, 25 bp, Homo sapien
ggatgtgctgtgatcgagctaaatc

SEQ ID NO: 609187 - DNA, 25 bp, Homo sapien
atgtgctgtgatcgagctaaatcta

SEQ ID NO: 609188 - DNA, 25 bp, Homo sapien
gtgctgtgatcgagctaaatctaga

SEQ ID NO: 609189 - DNA, 25 bp, Homo sapien
gctgtgatcgagctaaatctagaga

SEQ ID NO: 609190 - DNA, 25 bp, Homo sapien
gtgatcgagctaaatctagagaaaa

SEQ ID NO: 609191 - DNA, 25 bp, Homo sapien
tttgcagggtcgtcatgaggataaa

SEQ ID NO: 609192 - DNA, 25 bp, Homo sapien
ttgcagggtcgtcatgaggataaag

SEQ ID NO: 609193 - DNA, 25 bp, Homo sapien
tgcagggtcgtcatgaggataaagg

SEQ ID NO: 609194 - DNA, 25 bp, Homo sapien
gcagggtcgtcatgaggataaaggg

SEQ ID NO: 609195 - DNA, 25 bp, Homo sapien
cagggtcgtcatgaggataaagggg

SEQ ID NO: 609196 - DNA, 25 bp, Homo sapien
aaggggatgggccaggtgtgacagc

SEQ ID NO: 609197 - DNA, 25 bp, Homo sapien
aggggatgggccaggtgtgacagct

SEQ ID NO: 609198 - DNA, 25 bp, Homo sapien
aggtgtgacagctcaggtttataat

SEQ ID NO: 609199 - DNA, 25 bp, Homo sapien
ggtgtgacagctcaggtttataatc

SEQ ID NO: 609200 - DNA, 25 bp, Homo sapien
gtgtgacagctcaggtttataatcc

SEQ ID NO: 609201 - DNA, 25 bp, Homo sapien
tgtgacagctcaggtttataatccc

SEQ ID NO: 609202 - DNA, 25 bp, Homo sapien
gacttagctcaaattacatgtgaat

SEQ ID NO: 609203 - DNA, 25 bp, Homo sapien
ggaacagttttgtggcatctggtca

SEQ ID NO: 609204 - DNA, 25 bp, Homo sapien
agttttgtggcatctggtcagtttt

SEQ ID NO: 609205 - DNA, 25 bp, Homo sapien
agagaccaggtcttccacaaacttg

SEQ ID NO: 609206 - DNA, 25 bp, Homo sapien
aggtcttccacaaacttgagtctgc

SEQ ID NO: 609207 - DNA, 25 bp, Homo sapien
aaacttgagtctgccttggagcacg

SEQ ID NO: 609208 - DNA, 25 bp, Homo sapien
aaacccagctgtacagcttctcaga

SEQ ID NO: 609209 - DNA, 25 bp, Homo sapien
cccttctacccaagaatggtatcct

SEQ ID NO: 609210 - DNA, 25 bp, Homo sapien
gaatggtatccttgctgggccaaat

SEQ ID NO: 609211 - DNA, 25 bp, Homo sapien
tgctgggccaaatccacttcctttg

SEQ ID NO: 609212 - DNA, 25 bp, Homo sapien
gggaggacagtttttctttgttctg

SEQ ID NO: 609213 - DNA, 25 bp, Homo sapien
gagggagagaatttgcccttctctt

SEQ ID NO: 609214 - DNA, 25 bp, Homo sapien
atttgcccttctctttttattctat

SEQ ID NO: 609215 - DNA, 25 bp, Homo sapien
gcccttctctttttattctattgga

SEQ ID NO: 609216 - DNA, 25 bp, Homo sapien
tattctattggaacccttaacagat

SEQ ID NO: 609217 - DNA, 25 bp, Homo sapien
acccttaacagattggatgatgcct

SEQ ID NO: 609218 - DNA, 25 bp, Homo sapien
ggatgatgcctgtccatattgatga

SEQ ID NO: 609219 - DNA, 25 bp, Homo sapien
attgatgagggtggttcttctgtac

SEQ ID NO: 609220 - DNA, 25 bp, Homo sapien
ggtggttcttctgtactcagtttac

SEQ ID NO: 609221 - DNA, 25 bp, Homo sapien
ctgtactcagtttactgcttcaaat

SEQ ID NO: 609222 - DNA, 25 bp, Homo sapien
tgcttcaaatgctagtctcttctga

SEQ ID NO: 609223 - DNA, 25 bp, Homo sapien
aaccatcacagaatgttatttggat

SEQ ID NO: 609224 - DNA, 25 bp, Homo sapien
agccaaatatccatactagttagaa

SEQ ID NO: 609225 - DNA, 25 bp, Homo sapien
aaatacctaggaaaacctcatgtgg

SEQ ID NO: 609226 - DNA, 25 bp, Homo sapien
aaaacctcatgtggataatatcaag

SEQ ID NO: 609227 - DNA, 25 bp, Homo sapien
tatcaagatatgtaacagagttcaa

SEQ ID NO: 609228 - DNA, 25 bp, Homo sapien
cagagttcaaaggttgtaactacct

SEQ ID NO: 609229 - DNA, 25 bp, Homo sapien
aactaccttctttgatgaattgttc

SEQ ID NO: 609230 - DNA, 25 bp, Homo sapien
gaattgttctagctagtgtggccaa

SEQ ID NO: 609231 - DNA, 25 bp, Homo sapien
gttctagctagtgtggccaaatctt

SEQ ID NO: 609232 - DNA, 25 bp, Homo sapien
ggccaaatcttccaaaagcaactat

SEQ ID NO: 609233 - DNA, 25 bp, Homo sapien
atgctgcctatcaattcaaaagttt

SEQ ID NO: 609234 - DNA, 25 bp, Homo sapien
gctgcctatcaattcaaaagtttta

SEQ ID NO: 609235 - DNA, 25 bp, Homo sapien
accaagcatagcactgtacagcatt

SEQ ID NO: 609236 - DNA, 25 bp, Homo sapien
agcactgtacagcattcttactcct

SEQ ID NO: 609237 - DNA, 25 bp, Homo sapien
tcttactcctaaacagcagtcagcc

SEQ ID NO: 609238 - DNA, 25 bp, Homo sapien
gcagtcagccacaaactgacccaga

SEQ ID NO: 609239 - DNA, 25 bp, Homo sapien
gacccagagtttaattagcagtgac

SEQ ID NO: 609240 - DNA, 25 bp, Homo sapien
gcagtgactaatttcatgtttccaa

SEQ ID NO: 609241 - DNA, 25 bp, Homo sapien
atgtttccaatgtacctgatttttc

SEQ ID NO: 609242 - DNA, 25 bp, Homo sapien
tacctgatttttcatgagccttaca

SEQ ID NO: 609243 - DNA, 25 bp, Homo sapien
atgagccttacagacacacagagac

SEQ ID NO: 609244 - DNA, 25 bp, Homo sapien
gagacacatacacattgatcttaaa

SEQ ID NO: 609245 - DNA, 25 bp, Homo sapien
aatttttctcagtcactgatatgca

SEQ ID NO: 609246 - DNA, 25 bp, Homo sapien
gagataaaacagagcaagcgctggg

SEQ ID NO: 609247 - DNA, 25 bp, Homo sapien
ggaatgaaagctgacgttcactgct

SEQ ID NO: 609248 - DNA, 25 bp, Homo sapien
tgacgttcactgctttttgttctcc

SEQ ID NO: 609249 - DNA, 25 bp, Homo sapien
tttgttctcccttgggtctctgtgg

SEQ ID NO: 609250 - DNA, 25 bp, Homo sapien
ttctcccttgggtctctgtggtcca

SEQ ID NO: 609251 - DNA, 25 bp, Homo sapien
aaaatgcaacatgaacctcgattgt

SEQ ID NO: 609252 - DNA, 25 bp, Homo sapien
atgaacctcgattgttctgtggacc

SEQ ID NO: 609253 - DNA, 25 bp, Homo sapien
ttgttctgtggaccattcctccctc

SEQ ID NO: 609254 - DNA, 25 bp, Homo sapien
accattcctccctctatgaaaattt

SEQ ID NO: 609255 - DNA, 25 bp, Homo sapien
ttcctccctctatgaaaatttacat

SEQ ID NO: 609256 - DNA, 25 bp, Homo sapien
cagccccaagttttatacttactgc

SEQ ID NO: 609257 - DNA, 25 bp, Homo sapien
gcccctccgaggaagaggcacagga

SEQ ID NO: 609258 - DNA, 25 bp, Homo sapien
ctccgaggaagaggcacaggacgcc

SEQ ID NO: 609259 - DNA, 25 bp, Homo sapien
ggcacaggacgcctgtggcggtggg

SEQ ID NO: 609260 - DNA, 25 bp, Homo sapien
ggagggcatgtggagtcagggctat

SEQ ID NO: 609261 - DNA, 25 bp, Homo sapien
gaactctggcctcaaacgaccttcc

SEQ ID NO: 609262 - DNA, 25 bp, Homo sapien
tacaggcgtgatgcccgggccttct

SEQ ID NO: 609263 - DNA, 25 bp, Homo sapien
gatgcccgggccttcttccatcttt

SEQ ID NO: 609264 - DNA, 25 bp, Homo sapien
atcttttggagcctaccccttgtgt

SEQ ID NO: 609265 - DNA, 25 bp, Homo sapien
tcttttggagcctaccccttgtgtt

SEQ ID NO: 609266 - DNA, 25 bp, Homo sapien
tggagcctaccccttgtgttacctc

SEQ ID NO: 609267 - DNA, 25 bp, Homo sapien
attacatgaaacacggcaagacacc

SEQ ID NO: 609268 - DNA, 25 bp, Homo sapien
tcccttatgctacaggaatttgttg

SEQ ID NO: 609269 - DNA, 25 bp, Homo sapien
tgagcttccagtgtgccaggcaagt

SEQ ID NO: 609270 - DNA, 25 bp, Homo sapien
aggcaagtggcaaacatttcttgaa

SEQ ID NO: 609271 - DNA, 25 bp, Homo sapien
tcagaagcaaacagtcatcatgagc

SEQ ID NO: 609272 - DNA, 25 bp, Homo sapien
agtcatcatgagcttgatagccagt

SEQ ID NO: 609273 - DNA, 25 bp, Homo sapien
gatagccagttacattttgagtgac

SEQ ID NO: 609274 - DNA, 25 bp, Homo sapien
gtgacatatgatatattacctggca

SEQ ID NO: 609275 - DNA, 25 bp, Homo sapien
gatatattacctggcatagtgctat

SEQ ID NO: 609276 - DNA, 25 bp, Homo sapien
ggcatagtgctattttgtgcatcaa

SEQ ID NO: 609277 - DNA, 25 bp, Homo sapien
tttgtgcatcaagattggtccagtt

SEQ ID NO: 609278 - DNA, 25 bp, Homo sapien
attggtccagttgaggccaggcgta

SEQ ID NO: 609279 - DNA, 25 bp, Homo sapien
agcgaacatgtataatagtaatatt

SEQ ID NO: 609280 - DNA, 25 bp, Homo sapien
gcgaacatgtataatagtaatattt

SEQ ID NO: 609281 - DNA, 25 bp, Homo sapien
acatgtataatagtaatattttggc

SEQ ID NO: 609282 - DNA, 25 bp, Homo sapien
catgtataatagtaatattttggcc

SEQ ID NO: 609283 - DNA, 25 bp, Homo sapien
atgtataatagtaatattttggccg

SEQ ID NO: 609284 - DNA, 25 bp, Homo sapien
tgtataatagtaatattttggccgg

SEQ ID NO: 609285 - DNA, 25 bp, Homo sapien
gtataatagtaatattttggccggg

SEQ ID NO: 609286 - DNA, 25 bp, Homo sapien
tagctgggcattgcggcgcatgtct

SEQ ID NO: 609287 - DNA, 25 bp, Homo sapien
tgggcattgcggcgcatgtctgtag

SEQ ID NO: 609288 - DNA, 25 bp, Homo sapien
cagtggtttgaataacagtatttgc

SEQ ID NO: 609289 - DNA, 25 bp, Homo sapien
ttgctagggtagttttaggaagact

SEQ ID NO: 609290 - DNA, 25 bp, Homo sapien
ggaagactgacagctctgaagaaat

SEQ ID NO: 609291 - DNA, 25 bp, Homo sapien
aggtaattttgcacctaattgccag

SEQ ID NO: 609292 - DNA, 25 bp, Homo sapien
ttttgcacctaattgccaggccaag

SEQ ID NO: 609293 - DNA, 25 bp, Homo sapien
ttgccaggccaagtcactgtttaga

SEQ ID NO: 609294 - DNA, 25 bp, Homo sapien
gtcactgtttagaggaagaaccagc

SEQ ID NO: 609295 - DNA, 25 bp, Homo sapien
agggggcataatcacctggttcacc

SEQ ID NO: 609296 - DNA, 25 bp, Homo sapien
ggttcacctcttccggtgtgaagat

SEQ ID NO: 609297 - DNA, 25 bp, Homo sapien
gaatgatgccagtaagtatagtaga

SEQ ID NO: 609298 - DNA, 25 bp, Homo sapien
gaaacactctattgcatttataaat

SEQ ID NO: 609299 - DNA, 25 bp, Homo sapien
catgattgtgtatcaaatgtgagtt

SEQ ID NO: 609300 - DNA, 25 bp, Homo sapien
gtcttaattttaggtagctgtagcc

SEQ ID NO: 609301 - DNA, 25 bp, Homo sapien
tagccatacctaatagacctcctga

SEQ ID NO: 609302 - DNA, 25 bp, Homo sapien
acctcctgatgctgtacttacagat

SEQ ID NO: 609303 - DNA, 25 bp, Homo sapien
cagataccacctctcttaatcaggt

SEQ ID NO: 609304 - DNA, 25 bp, Homo sapien
cctctcttaatcaggtaagattgta

SEQ ID NO: 609305 - DNA, 25 bp, Homo sapien
gaaaaatgataaatccacctggttg

SEQ ID NO: 609306 - DNA, 25 bp, Homo sapien
aatccacctggttgatgacactttt

SEQ ID NO: 609307 - DNA, 25 bp, Homo sapien
ccacctggttgatgacactttttaa

SEQ ID NO: 609308 - DNA, 25 bp, Homo sapien
cctggttgatgacactttttaattt

SEQ ID NO: 609309 - DNA, 25 bp, Homo sapien
ttaatttatagctctgataccttat

SEQ ID NO: 609310 - DNA, 25 bp, Homo sapien
agcctgggagcaattcaggcccatt

SEQ ID NO: 609311 - DNA, 25 bp, Homo sapien
gcaattcaggcccattctttctgat

SEQ ID NO: 609312 - DNA, 25 bp, Homo sapien
gcagtcagcgcggtggacgttctct

SEQ ID NO: 609313 - DNA, 25 bp, Homo sapien
ggtggacgttctctgacccagagca

SEQ ID NO: 609314 - DNA, 25 bp, Homo sapien
ggtgcctggtagtcacagcggcccc

SEQ ID NO: 609315 - DNA, 25 bp, Homo sapien
agcggcccctgcataattgcgtaat

SEQ ID NO: 609316 - DNA, 25 bp, Homo sapien
ataattgcgtaattcttgccgctcc

SEQ ID NO: 609317 - DNA, 25 bp, Homo sapien
atcgttccctggttctgtgagcctc

SEQ ID NO: 609318 - DNA, 25 bp, Homo sapien
tgccttttcctggttttgcgaagcg

SEQ ID NO: 609319 - DNA, 25 bp, Homo sapien
ttttcctggttttgcgaagcgccgt

SEQ ID NO: 609320 - DNA, 25 bp, Homo sapien
tggttttgcgaagcgccgtgttcat

SEQ ID NO: 609321 - DNA, 25 bp, Homo sapien
atttggtgctgtaccatgtgccagt

SEQ ID NO: 609322 - DNA, 25 bp, Homo sapien
ccatgtgccagtctctttaaaaata

SEQ ID NO: 609323 - DNA, 25 bp, Homo sapien
ctctcagggtagatgctagcattct

SEQ ID NO: 609324 - DNA, 25 bp, Homo sapien
tagcattctattttacatccccgag

SEQ ID NO: 609325 - DNA, 25 bp, Homo sapien
gatcacacagccagtatatccacaa

SEQ ID NO: 609326 - DNA, 25 bp, Homo sapien
agcaagtatttgaaccaggtttggc

SEQ ID NO: 609327 - DNA, 25 bp, Homo sapien
caggtttggctgagtctagagacga

SEQ ID NO: 609328 - DNA, 25 bp, Homo sapien
gacgatgttcttaatatgccacttt

SEQ ID NO: 609329 - DNA, 25 bp, Homo sapien
atgccactttgctagagtggccttt

SEQ ID NO: 609330 - DNA, 25 bp, Homo sapien
agtggcctttgaagtgctctttgaa

SEQ ID NO: 609331 - DNA, 25 bp, Homo sapien
attccgctcctagtattagcagcaa

SEQ ID NO: 609332 - DNA, 25 bp, Homo sapien
acctctcccttgtggaggatgagtt

SEQ ID NO: 609333 - DNA, 25 bp, Homo sapien
ggatgagttatatacccaccctggg

SEQ ID NO: 609334 - DNA, 25 bp, Homo sapien
gctgcccagtgtgccattgacggaa

SEQ ID NO: 609335 - DNA, 25 bp, Homo sapien
tgccattgacggaacgctgcaggtc

SEQ ID NO: 609336 - DNA, 25 bp, Homo sapien
cggacaggccgctcctgctaaagtg

SEQ ID NO: 609337 - DNA, 25 bp, Homo sapien
tattctcacagaagtaccatcccac

SEQ ID NO: 609338 - DNA, 25 bp, Homo sapien
gggactgtggttctacactgactca

SEQ ID NO: 609339 - DNA, 25 bp, Homo sapien
gggacattttcttatccttccagag

SEQ ID NO: 609340 - DNA, 25 bp, Homo sapien
atccttccagagactgacaagagag

SEQ ID NO: 609341 - DNA, 25 bp, Homo sapien
tgaaggtaccttgatctcacagctg

SEQ ID NO: 609342 - DNA, 25 bp, Homo sapien
ctcacagctgcatcctgatacatat

SEQ ID NO: 609343 - DNA, 25 bp, Homo sapien
aagggaagcatgtctagtgtctcca

SEQ ID NO: 609344 - DNA, 25 bp, Homo sapien
agcatgtctagtgtctccaaactga

SEQ ID NO: 609345 - DNA, 25 bp, Homo sapien
ccaaactgaggaaagttaccatgta

SEQ ID NO: 609346 - DNA, 25 bp, Homo sapien
gttaccatgtagagcttgactttag

SEQ ID NO: 609347 - DNA, 25 bp, Homo sapien
acaaaattatgaggcacccaatgat

SEQ ID NO: 609348 - DNA, 25 bp, Homo sapien
gaggcacccaatgataggaatctgt

SEQ ID NO: 609349 - DNA, 25 bp, Homo sapien
aagggtacatgttacacttcacaaa

SEQ ID NO: 609350 - DNA, 25 bp, Homo sapien
attcagcattgcatcttctgtgcct

SEQ ID NO: 609351 - DNA, 25 bp, Homo sapien
attgcatcttctgtgcctagcacaa

SEQ ID NO: 609352 - DNA, 25 bp, Homo sapien
agtgtagtgatgagattcctttagc

SEQ ID NO: 609353 - DNA, 25 bp, Homo sapien
gagattcctttagctatctatctat

SEQ ID NO: 609354 - DNA, 25 bp, Homo sapien
cctgtgtttgcagtgctacagggtg

SEQ ID NO: 609355 - DNA, 25 bp, Homo sapien
tcccacagctcctcaaggtcagagg

SEQ ID NO: 609356 - DNA, 25 bp, Homo sapien
cacagctcctcaaggtcagagggct

SEQ ID NO: 609357 - DNA, 25 bp, Homo sapien
tcctcaaggtcagagggctgggaac

SEQ ID NO: 609358 - DNA, 25 bp, Homo sapien
ggaacccctgggatgtggctgggat

SEQ ID NO: 609359 - DNA, 25 bp, Homo sapien
tggctgggatgaggaccctgcccct

SEQ ID NO: 609360 - DNA, 25 bp, Homo sapien
ctcctcaggcatttccaggcaaggg

SEQ ID NO: 609361 - DNA, 25 bp, Homo sapien
gggcacagagacacagccagcccag

SEQ ID NO: 609362 - DNA, 25 bp, Homo sapien
tgggaaactgaagcatgaacacaac

SEQ ID NO: 609363 - DNA, 25 bp, Homo sapien
tgaagcatgaacacaaccccagact

SEQ ID NO: 609364 - DNA, 25 bp, Homo sapien
aagcatgaacacaaccccagactgg

SEQ ID NO: 609365 - DNA, 25 bp, Homo sapien
atatctgaacgccactactggctgg

SEQ ID NO: 609366 - DNA, 25 bp, Homo sapien
actactggctggaaacttgaaggga

SEQ ID NO: 609367 - DNA, 25 bp, Homo sapien
gagggctaagcatcttgggctcaat

SEQ ID NO: 609368 - DNA, 25 bp, Homo sapien
gcatcttgggctcaataaaccactt

SEQ ID NO: 609369 - DNA, 25 bp, Homo sapien
actgggacctccgatgtgactagat

SEQ ID NO: 609370 - DNA, 25 bp, Homo sapien
gatgtgactagatatgcccagaact

SEQ ID NO: 609371 - DNA, 25 bp, Homo sapien
gatatgcccagaactgccaggctga

SEQ ID NO: 609372 - DNA, 25 bp, Homo sapien
gctgaccaacagctgtggaattcct

SEQ ID NO: 609373 - DNA, 25 bp, Homo sapien
ggaattcctgagtcacatcattttc

SEQ ID NO: 609374 - DNA, 25 bp, Homo sapien
tgagtcacatcattttctcctctaa

SEQ ID NO: 609375 - DNA, 25 bp, Homo sapien
tctccatttcctactctttccttgt

SEQ ID NO: 609376 - DNA, 25 bp, Homo sapien
ttcactagaggcaggccttggccat

SEQ ID NO: 609377 - DNA, 25 bp, Homo sapien
catcctccacagcagactattgagt

SEQ ID NO: 609378 - DNA, 25 bp, Homo sapien
atttacttcttactatgctgtttaa

SEQ ID NO: 609379 - DNA, 25 bp, Homo sapien
aaagcctctgatgaaatcctggtgg

SEQ ID NO: 609380 - DNA, 25 bp, Homo sapien
tctgttcttaccaatccaggaagtg

SEQ ID NO: 609381 - DNA, 25 bp, Homo sapien
agagagctgttgagccctgtttcca

SEQ ID NO: 609382 - DNA, 25 bp, Homo sapien
ctgtttccaaatccccaggtgaagc

SEQ ID NO: 609383 - DNA, 25 bp, Homo sapien
ggtgaagctgcgctgacatgccttc

SEQ ID NO: 609384 - DNA, 25 bp, Homo sapien
gctgacatgccttctgtccatacag

SEQ ID NO: 609385 - DNA, 25 bp, Homo sapien
atacagccctttccaagactcagct

SEQ ID NO: 609386 - DNA, 25 bp, Homo sapien
agactcagctatttgtgatcacccc

SEQ ID NO: 609387 - DNA, 25 bp, Homo sapien
gaaaacaagaattccagtacagctg

SEQ ID NO: 609388 - DNA, 25 bp, Homo sapien
agtacagctgtagcaagatgcgcag

SEQ ID NO: 609389 - DNA, 25 bp, Homo sapien
gatgcgcaggcatttggcagacatg

SEQ ID NO: 609390 - DNA, 25 bp, Homo sapien
ggcagacatgacgttggcagcagca

SEQ ID NO: 609391 - DNA, 25 bp, Homo sapien
ggcagcagcatccaagtgagttcct

SEQ ID NO: 609392 - DNA, 25 bp, Homo sapien
agtgagttcctgtgaatcacccgct

SEQ ID NO: 609393 - DNA, 25 bp, Homo sapien
gaatcacccgctttgagaattcaag

SEQ ID NO: 609394 - DNA, 25 bp, Homo sapien
caactagtgccattgcaggtggctt

SEQ ID NO: 609395 - DNA, 25 bp, Homo sapien
agatctctgaggctagttaacaatc

SEQ ID NO: 609396 - DNA, 25 bp, Homo sapien
ggctagttaacaatctctttgacat

SEQ ID NO: 609397 - DNA, 25 bp, Homo sapien
aaagcatccaattctctgcattgat

SEQ ID NO: 609398 - DNA, 25 bp, Homo sapien
ttttttcttagctgactgatgtatg

SEQ ID NO: 609399 - DNA, 25 bp, Homo sapien
cttagctgactgatgtatgttatta

SEQ ID NO: 609400 - DNA, 25 bp, Homo sapien
gtgattattaacttcttgagactat

SEQ ID NO: 609401 - DNA, 25 bp, Homo sapien
aacttcttgagactatattgttagt

SEQ ID NO: 609402 - DNA, 25 bp, Homo sapien
gaaaatgctgatttcatccattgcc

SEQ ID NO: 609403 - DNA, 25 bp, Homo sapien
gctgatttcatccattgcctattaa

SEQ ID NO: 609404 - DNA, 25 bp, Homo sapien
tccattgcctattaattgctcagcc

SEQ ID NO: 609405 - DNA, 25 bp, Homo sapien
cattgcctattaattgctcagccaa

SEQ ID NO: 609406 - DNA, 25 bp, Homo sapien
aaaatcaacatttcagctactaagt

SEQ ID NO: 609407 - DNA, 25 bp, Homo sapien
tcagctactaagtttacaatgtatg

SEQ ID NO: 609408 - DNA, 25 bp, Homo sapien
tcaggctcttaaccaaaattttaga

SEQ ID NO: 609409 - DNA, 25 bp, Homo sapien
tgaggagcatcaagaggccagagtt

SEQ ID NO: 609410 - DNA, 25 bp, Homo sapien
tttccaagttgggacccagaaggtg

SEQ ID NO: 609411 - DNA, 25 bp, Homo sapien
gggaccaatcccagggtaaggaatg

SEQ ID NO: 609412 - DNA, 25 bp, Homo sapien
gaatgaaagtaggagccccagaagc

SEQ ID NO: 609413 - DNA, 25 bp, Homo sapien
gaagctgaaaacatacttcaccgat

SEQ ID NO: 609414 - DNA, 25 bp, Homo sapien
acttcaccgatgtcagcattttacc

SEQ ID NO: 609415 - DNA, 25 bp, Homo sapien
atgtcagcattttacccagagccat

SEQ ID NO: 609416 - DNA, 25 bp, Homo sapien
attttacccagagccattccaaggt

SEQ ID NO: 609417 - DNA, 25 bp, Homo sapien
agagccattccaaggtgaccataac

SEQ ID NO: 609418 - DNA, 25 bp, Homo sapien
ttccaaggtgaccataactcactta

SEQ ID NO: 609419 - DNA, 25 bp, Homo sapien
aactcacttaaaagcctgaaagctg

SEQ ID NO: 609420 - DNA, 25 bp, Homo sapien
tgcccagccccgtagtggagaattt

SEQ ID NO: 609421 - DNA, 25 bp, Homo sapien
cccagccccgtagtggagaatttct

SEQ ID NO: 609422 - DNA, 25 bp, Homo sapien
agccccgtagtggagaatttctgtt

SEQ ID NO: 609423 - DNA, 25 bp, Homo sapien
gccccgtagtggagaatttctgttg

SEQ ID NO: 609424 - DNA, 25 bp, Homo sapien
ccgtagtggagaatttctgttgaat

SEQ ID NO: 609425 - DNA, 25 bp, Homo sapien
tctgttgaatgaaccaaaagcaact

SEQ ID NO: 609426 - DNA, 25 bp, Homo sapien
aacctctccatgcaccatgtgtttc

SEQ ID NO: 609427 - DNA, 25 bp, Homo sapien
ctctccatgcaccatgtgtttcaga

SEQ ID NO: 609428 - DNA, 25 bp, Homo sapien
tccatgcaccatgtgtttcagagga

SEQ ID NO: 609429 - DNA, 25 bp, Homo sapien
atgcaccatgtgtttcagaggagaa

SEQ ID NO: 609430 - DNA, 25 bp, Homo sapien
gaaagcacagtgaagaatgcagtgt

SEQ ID NO: 609431 - DNA, 25 bp, Homo sapien
aagatgctgctggacgaataaatga

SEQ ID NO: 609432 - DNA, 25 bp, Homo sapien
agatgctgctggacgaataaatgaa

SEQ ID NO: 609433 - DNA, 25 bp, Homo sapien
gatgctgctggacgaataaatgaaa

SEQ ID NO: 609434 - DNA, 25 bp, Homo sapien
atgctgctggacgaataaatgaaaa

SEQ ID NO: 609435 - DNA, 25 bp, Homo sapien
tgctgctggacgaataaatgaaaaa

SEQ ID NO: 609436 - DNA, 25 bp, Homo sapien
atgaaaaagcttctggccgggtgca

SEQ ID NO: 609437 - DNA, 25 bp, Homo sapien
gaaaaagcttctggccgggtgcagt

SEQ ID NO: 609438 - DNA, 25 bp, Homo sapien
cgtggtggccggcagctgtactccc

SEQ ID NO: 609439 - DNA, 25 bp, Homo sapien
tggtggccggcagctgtactcccag

SEQ ID NO: 609440 - DNA, 25 bp, Homo sapien
gtggccggcagctgtactcccagct

SEQ ID NO: 609441 - DNA, 25 bp, Homo sapien
gagaatggcgtgtggggtgaacccg

SEQ ID NO: 609442 - DNA, 25 bp, Homo sapien
accatgctagtgtagatgccagctc

SEQ ID NO: 609443 - DNA, 25 bp, Homo sapien
atgctagtgtagatgccagctcacg

SEQ ID NO: 609444 - DNA, 25 bp, Homo sapien
tagtgtagatgccagctcacgccag

SEQ ID NO: 609445 - DNA, 25 bp, Homo sapien
gtagatgccagctcacgccagcggg

SEQ ID NO: 609446 - DNA, 25 bp, Homo sapien
ctggtctggggctcctaggcctgat

SEQ ID NO: 609447 - DNA, 25 bp, Homo sapien
ttcagccccaggtttcctgtacttc

SEQ ID NO: 609448 - DNA, 25 bp, Homo sapien
agccccaggtttcctgtacttcagc

SEQ ID NO: 609449 - DNA, 25 bp, Homo sapien
gaagatggaacgtgaacttttttgt

SEQ ID NO: 609450 - DNA, 25 bp, Homo sapien
cacctgtgttcggtttccagttcta

SEQ ID NO: 609451 - DNA, 25 bp, Homo sapien
ctgtgtgttcttaagtaactcactt

SEQ ID NO: 609452 - DNA, 25 bp, Homo sapien
tcacttaaacctttctgagtctcat

SEQ ID NO: 609453 - DNA, 25 bp, Homo sapien
catgattgtgtatcaaatgtgagtt

SEQ ID NO: 609454 - DNA, 25 bp, Homo sapien
tgtcttaattttaggtagctgtagc

SEQ ID NO: 609455 - DNA, 25 bp, Homo sapien
tcttaattttaggtagctgtagcca

SEQ ID NO: 609456 - DNA, 25 bp, Homo sapien
cctctcttaatcaggtaagattgta

SEQ ID NO: 609457 - DNA, 25 bp, Homo sapien
gaaaaatgataaatccacctggttg

SEQ ID NO: 609458 - DNA, 25 bp, Homo sapien
gataaatccacctggttgatgacac

SEQ ID NO: 609459 - DNA, 25 bp, Homo sapien
taaatccacctggttgatgacactt

SEQ ID NO: 609460 - DNA, 25 bp, Homo sapien
aatccacctggttgatgacactttt

SEQ ID NO: 609461 - DNA, 25 bp, Homo sapien
tccacctggttgatgacacttttta

SEQ ID NO: 609462 - DNA, 25 bp, Homo sapien
cacctggttgatgacactttttaat

SEQ ID NO: 609463 - DNA, 25 bp, Homo sapien
ctggttgatgacactttttaattta

SEQ ID NO: 609464 - DNA, 25 bp, Homo sapien
gcaaaacatggctcacaaggcaaat

SEQ ID NO: 609465 - DNA, 25 bp, Homo sapien
gcctaccctgcctacttgataaata

SEQ ID NO: 609466 - DNA, 25 bp, Homo sapien
ggcatggccatacccacattttatg

SEQ ID NO: 609467 - DNA, 25 bp, Homo sapien
ttatgtattgtctgaggccactttc

SEQ ID NO: 609468 - DNA, 25 bp, Homo sapien
tctgaggccactttcatgagacaat

SEQ ID NO: 609469 - DNA, 25 bp, Homo sapien
tttcatgagacaatggcagagctgt

SEQ ID NO: 609470 - DNA, 25 bp, Homo sapien
agagctgtggtgatccgatggccca

SEQ ID NO: 609471 - DNA, 25 bp, Homo sapien
cgatggcccacaaccctaaaatatt

SEQ ID NO: 609472 - DNA, 25 bp, Homo sapien
aatatttactagttgcctctttaca

SEQ ID NO: 609473 - DNA, 25 bp, Homo sapien
aattatcccgatcttttgactagat

SEQ ID NO: 609474 - DNA, 25 bp, Homo sapien
attaacaaaacccaccacaggaatg

SEQ ID NO: 609475 - DNA, 25 bp, Homo sapien
gagactattaaagatgtgccagagt

SEQ ID NO: 609476 - DNA, 25 bp, Homo sapien
gaaaatcattaaagtaggacagcta

SEQ ID NO: 609477 - DNA, 25 bp, Homo sapien
ttgattattccttaacgcactccat

SEQ ID NO: 609478 - DNA, 25 bp, Homo sapien
attattccttaacgcactccattct

SEQ ID NO: 609479 - DNA, 25 bp, Homo sapien
tccattctccttttacattttatca

SEQ ID NO: 609480 - DNA, 25 bp, Homo sapien
gaattggcaaaggacttgatgaaac

SEQ ID NO: 609481 - DNA, 25 bp, Homo sapien
aaggacttgatgaaactgagtacta

SEQ ID NO: 609482 - DNA, 25 bp, Homo sapien
atgaaactgagtactaagatttggt

SEQ ID NO: 609483 - DNA, 25 bp, Homo sapien
gatttggtacagagtatgtcaggaa

SEQ ID NO: 609484 - DNA, 25 bp, Homo sapien
gaagacaactcagattgccatttta

SEQ ID NO: 609485 - DNA, 25 bp, Homo sapien
aactcagattgccattttaaataaa

SEQ ID NO: 609486 - DNA, 25 bp, Homo sapien
ggcagacagatcaaaccaaacagga

SEQ ID NO: 609487 - DNA, 25 bp, Homo sapien
ggaaatgcatgtttgatctgttgtc

SEQ ID NO: 609488 - DNA, 25 bp, Homo sapien
aatgcatgtttgatctgttgtcacg

SEQ ID NO: 609489 - DNA, 25 bp, Homo sapien
gcatgtttgatctgttgtcacgtgc

SEQ ID NO: 609490 - DNA, 25 bp, Homo sapien
atgtttgatctgttgtcacgtgcct

SEQ ID NO: 609491 - DNA, 25 bp, Homo sapien
tgatctgttgtcacgtgcctgtggg

SEQ ID NO: 609492 - DNA, 25 bp, Homo sapien
agctattcacatcaaggggactcaa

SEQ ID NO: 609493 - DNA, 25 bp, Homo sapien
gggactcaatatatcaacaattggt

SEQ ID NO: 609494 - DNA, 25 bp, Homo sapien
aatatgttggtgataattccgtgac

SEQ ID NO: 609495 - DNA, 25 bp, Homo sapien
gttggtgataattccgtgacagttg

SEQ ID NO: 609496 - DNA, 25 bp, Homo sapien
tgataattccgtgacagttggaaga

SEQ ID NO: 609497 - DNA, 25 bp, Homo sapien
tggcttcctagcagggcgctcccga

SEQ ID NO: 609498 - DNA, 25 bp, Homo sapien
gcgctcccgaatcccaagggctgga

SEQ ID NO: 609499 - DNA, 25 bp, Homo sapien
caggaagcgcctgccgggcccaatg

SEQ ID NO: 609500 - DNA, 25 bp, Homo sapien
ggaacgcaggcagcacggaggcggc

SEQ ID NO: 609501 - DNA, 25 bp, Homo sapien
tggcagtgccgctgatagagtcatg

SEQ ID NO: 609502 - DNA, 25 bp, Homo sapien
tgatagagtcatgcggtccatagcc

SEQ ID NO: 609503 - DNA, 25 bp, Homo sapien
tcatgcggtccatagcccctaaggg

SEQ ID NO: 609504 - DNA, 25 bp, Homo sapien
ggtccatagcccctaagggcaggcc

SEQ ID NO: 609505 - DNA, 25 bp, Homo sapien
agcagctggagggtcggcatggatc

SEQ ID NO: 609506 - DNA, 25 bp, Homo sapien
agggtcggcatggatccaagcatgc

SEQ ID NO: 609507 - DNA, 25 bp, Homo sapien
atggatccaagcatgccagatataa

SEQ ID NO: 609508 - DNA, 25 bp, Homo sapien
taaatatttaatccttccgctccac

SEQ ID NO: 609509 - DNA, 25 bp, Homo sapien
cttccgctccacatgacaatgtata

SEQ ID NO: 609510 - DNA, 25 bp, Homo sapien
aggatgggcaccttctacaaatctg

SEQ ID NO: 609511 - DNA, 25 bp, Homo sapien
tacaaatctgcttcgacgttttctc

SEQ ID NO: 609512 - DNA, 25 bp, Homo sapien
gacgttttctctaatgcgctattga

SEQ ID NO: 609513 - DNA, 25 bp, Homo sapien
tcaacactgtttgcagccctaagtg

SEQ ID NO: 609514 - DNA, 25 bp, Homo sapien
cagccctaagtgaggcattataatt

SEQ ID NO: 609515 - DNA, 25 bp, Homo sapien
aaagcaaagcgttccatcgaagaca

SEQ ID NO: 609516 - DNA, 25 bp, Homo sapien
actgttcctgattctactgggcatt

SEQ ID NO: 609517 - DNA, 25 bp, Homo sapien
tactgggcattctgcccaaccagag

SEQ ID NO: 609518 - DNA, 25 bp, Homo sapien
ggaaggcagaggatttcttcagaat

SEQ ID NO: 609519 - DNA, 25 bp, Homo sapien
agaggcctggctgttccggagacca

SEQ ID NO: 609520 - DNA, 25 bp, Homo sapien
tggctgttccggagaccaacgaagc

SEQ ID NO: 609521 - DNA, 25 bp, Homo sapien
ggagaccaacgaagcgctcccaact

SEQ ID NO: 609522 - DNA, 25 bp, Homo sapien
acccagggcctgtccacggagagtg

SEQ ID NO: 609523 - DNA, 25 bp, Homo sapien
aggacaggaggagccgcataaaact

SEQ ID NO: 609524 - DNA, 25 bp, Homo sapien
aggagccgcataaaactctgccctg

SEQ ID NO: 609525 - DNA, 25 bp, Homo sapien
gccctgcctggagtctatgtaggac

SEQ ID NO: 609526 - DNA, 25 bp, Homo sapien
gagtctatgtaggacagtgttgtct

SEQ ID NO: 609527 - DNA, 25 bp, Homo sapien
gacagtgttgtcttttacagacaag

SEQ ID NO: 609528 - DNA, 25 bp, Homo sapien
tacagacaagtctcgaagaatttga

SEQ ID NO: 609529 - DNA, 25 bp, Homo sapien
ggaaaatagcctactagctgtaatg

SEQ ID NO: 609530 - DNA, 25 bp, Homo sapien
cacccgggcggatccgagccgcagc

SEQ ID NO: 609531 - DNA, 25 bp, Homo sapien
gcggatccgagccgcagcagcctgg

SEQ ID NO: 609532 - DNA, 25 bp, Homo sapien
ccacctgctccttgttttgcagtga

SEQ ID NO: 609533 - DNA, 25 bp, Homo sapien
cacctgctccttgttttgcagtgag

SEQ ID NO: 609534 - DNA, 25 bp, Homo sapien
acctgctccttgttttgcagtgagg

SEQ ID NO: 609535 - DNA, 25 bp, Homo sapien
cctgctccttgttttgcagtgaggg

SEQ ID NO: 609536 - DNA, 25 bp, Homo sapien
tccttgttttgcagtgaggggtcca

SEQ ID NO: 609537 - DNA, 25 bp, Homo sapien
gggtccagcccctgagtgcccgcag

SEQ ID NO: 609538 - DNA, 25 bp, Homo sapien
acaccctggccccaagcgcaataaa

SEQ ID NO: 609539 - DNA, 25 bp, Homo sapien
tggccccaagcgcaataaacaccct

SEQ ID NO: 609540 - DNA, 25 bp, Homo sapien
gccccaagcgcaataaacaccctga

SEQ ID NO: 609541 - DNA, 25 bp, Homo sapien
caggcattctgatcatagcatatgt

SEQ ID NO: 609542 - DNA, 25 bp, Homo sapien
atatgtgtagttgctcctggcccgc

SEQ ID NO: 609543 - DNA, 25 bp, Homo sapien
gggaaatcaccgtctccaagcatgg

SEQ ID NO: 609544 - DNA, 25 bp, Homo sapien
ccaagcatggctcccatctggttac

SEQ ID NO: 609545 - DNA, 25 bp, Homo sapien
atggctcccatctggttaccctggg

SEQ ID NO: 609546 - DNA, 25 bp, Homo sapien
gccaaggtcagcagaggtgctttgc

SEQ ID NO: 609547 - DNA, 25 bp, Homo sapien
agcagaggtgctttgccaactgatt

SEQ ID NO: 609548 - DNA, 25 bp, Homo sapien
ggtgctttgccaactgattggcacc

SEQ ID NO: 609549 - DNA, 25 bp, Homo sapien
gattggcacccacactacttctgtc

SEQ ID NO: 609550 - DNA, 25 bp, Homo sapien
acactacttctgtccaggtgggctg

SEQ ID NO: 609551 - DNA, 25 bp, Homo sapien
gtgcccataggcacctcctgggaat

SEQ ID NO: 609552 - DNA, 25 bp, Homo sapien
tcatgatggctatgatgcccacact

SEQ ID NO: 609553 - DNA, 25 bp, Homo sapien
ggctatgatgcccacactgaaggtt

SEQ ID NO: 609554 - DNA, 25 bp, Homo sapien
tgatgcccacactgaaggttgttca

SEQ ID NO: 609555 - DNA, 25 bp, Homo sapien
gcccacactgaaggttgttcattta

SEQ ID NO: 609556 - DNA, 25 bp, Homo sapien
cactgaaggttgttcatttactgga

SEQ ID NO: 609557 - DNA, 25 bp, Homo sapien
gttcatttactggaatgagggcaag

SEQ ID NO: 609558 - DNA, 25 bp, Homo sapien
gtgttcctaacccacaaacaatagt

SEQ ID NO: 609559 - DNA, 25 bp, Homo sapien
aacccacaaacaatagtatgagcaa

SEQ ID NO: 609560 - DNA, 25 bp, Homo sapien
gtgggtaaatctcttttcatggctt

SEQ ID NO: 609561 - DNA, 25 bp, Homo sapien
aatctcttttcatggctttcagctc

SEQ ID NO: 609562 - DNA, 25 bp, Homo sapien
ttttcatggctttcagctctgaagg

SEQ ID NO: 609563 - DNA, 25 bp, Homo sapien
ttcaagggtatggtccaagaggcca

SEQ ID NO: 609564 - DNA, 25 bp, Homo sapien
acctggtgcctctggtaggctgaaa

SEQ ID NO: 609565 - DNA, 25 bp, Homo sapien
ctctggtaggctgaaaacatctttt

SEQ ID NO: 609566 - DNA, 25 bp, Homo sapien
aaatcctctaggtccaggatccgaa

SEQ ID NO: 609567 - DNA, 25 bp, Homo sapien
ggatccgaaatacctgcatgtcacc

SEQ ID NO: 609568 - DNA, 25 bp, Homo sapien
tgcatgtcaccaatctcattccata

SEQ ID NO: 609569 - DNA, 25 bp, Homo sapien
aatctcattccatacggtgccaggg

SEQ ID NO: 609570 - DNA, 25 bp, Homo sapien
ggtgccagggacacgctcctaaaat

SEQ ID NO: 609571 - DNA, 25 bp, Homo sapien
ggacacgctcctaaaattcagggta

SEQ ID NO: 609572 - DNA, 25 bp, Homo sapien
agatcccatggttggcccaactcca

SEQ ID NO: 609573 - DNA, 25 bp, Homo sapien
gatgaccaggatttcagaccttcag

SEQ ID NO: 609574 - DNA, 25 bp, Homo sapien
ctttccaggtggttttatgtatgct

SEQ ID NO: 609575 - DNA, 25 bp, Homo sapien
ggttttatgtatgcttatttgtgta

SEQ ID NO: 609576 - DNA, 25 bp, Homo sapien
gggatcatactgtaccttcagtttt

SEQ ID NO: 609577 - DNA, 25 bp, Homo sapien
tgtaccttcagttttgtagcctgct

SEQ ID NO: 609578 - DNA, 25 bp, Homo sapien
gtagcctgcttaaagaaataaccaa

SEQ ID NO: 609579 - DNA, 25 bp, Homo sapien
tcatttattcaactagtcttctaga

SEQ ID NO: 609580 - DNA, 25 bp, Homo sapien
tagtcttctagatgtgacatataga

SEQ ID NO: 609581 - DNA, 25 bp, Homo sapien
gtgacatatagaagctgttcttgat

SEQ ID NO: 609582 - DNA, 25 bp, Homo sapien
tttcaacatccatggtacacactgt

SEQ ID NO: 609583 - DNA, 25 bp, Homo sapien
atggtacacactgtaaataccttgg

SEQ ID NO: 609584 - DNA, 25 bp, Homo sapien
ccttggtgtatctttccaggtggtt

SEQ ID NO: 609585 - DNA, 25 bp, Homo sapien
gatgctaatataaatcctcagaaga

SEQ ID NO: 609586 - DNA, 25 bp, Homo sapien
taagtggaaaagacagcttgcaaaa

SEQ ID NO: 609587 - DNA, 25 bp, Homo sapien
ggagatgattaatgtggttgcactt

SEQ ID NO: 609588 - DNA, 25 bp, Homo sapien
aatgtggttgcactttttggcaaag

SEQ ID NO: 609589 - DNA, 25 bp, Homo sapien
actttttggcaaagattacgtgcat

SEQ ID NO: 609590 - DNA, 25 bp, Homo sapien
gattacgtgcatatgtaggtgaaca

SEQ ID NO: 609591 - DNA, 25 bp, Homo sapien
gtgaacatggtcatgtgcacctcat

SEQ ID NO: 609592 - DNA, 25 bp, Homo sapien
gtgcacctcatccacagaaacatgt

SEQ ID NO: 609593 - DNA, 25 bp, Homo sapien
gaaacatgtctggaaagtgtgcacc

SEQ ID NO: 609594 - DNA, 25 bp, Homo sapien
gaaagtgtgcaccattctatggaca

SEQ ID NO: 609595 - DNA, 25 bp, Homo sapien
tctatggacaacagaccttttgggt

SEQ ID NO: 609596 - DNA, 25 bp, Homo sapien
tgggaccccagatctggtctccaag

SEQ ID NO: 609597 - DNA, 25 bp, Homo sapien
ccagatctggtctccaagtactgtt

SEQ ID NO: 609598 - DNA, 25 bp, Homo sapien
atctggtctccaagtactgtttctc

SEQ ID NO: 609599 - DNA, 25 bp, Homo sapien
gtctccaagtactgtttctcttcta

SEQ ID NO: 609600 - DNA, 25 bp, Homo sapien
ctccaagtactgtttctcttctaag

SEQ ID NO: 609601 - DNA, 25 bp, Homo sapien
agacagactgtctcttagttttaat

SEQ ID NO: 609602 - DNA, 25 bp, Homo sapien
agaggggccatatttctactgaaag

SEQ ID NO: 609603 - DNA, 25 bp, Homo sapien
atgggaatattctgaaccggaatga

SEQ ID NO: 609604 - DNA, 25 bp, Homo sapien
atctttagattcagtctctttgccc

SEQ ID NO: 609605 - DNA, 25 bp, Homo sapien
ttagattcagtctctttgccctagt

SEQ ID NO: 609606 - DNA, 25 bp, Homo sapien
gtctctttgccctagtctttaaaag

SEQ ID NO: 609607 - DNA, 25 bp, Homo sapien
aaccagaaaagcctccctaaagatg

SEQ ID NO: 609608 - DNA, 25 bp, Homo sapien
aaagcctccctaaagatggaccaag

SEQ ID NO: 609609 - DNA, 25 bp, Homo sapien
gcctccctaaagatggaccaagaaa

SEQ ID NO: 609610 - DNA, 25 bp, Homo sapien
tccagcaagtccagccagagccttt

SEQ ID NO: 609611 - DNA, 25 bp, Homo sapien
aagtccagccagagccttttgcatt

SEQ ID NO: 609612 - DNA, 25 bp, Homo sapien
agccagagccttttgcattctaagc

SEQ ID NO: 609613 - DNA, 25 bp, Homo sapien
agagccttttgcattctaagcccag

SEQ ID NO: 609614 - DNA, 25 bp, Homo sapien
agccttttgcattctaagcccagtg

SEQ ID NO: 609615 - DNA, 25 bp, Homo sapien
ccttttgcattctaagcccagtgga

SEQ ID NO: 609616 - DNA, 25 bp, Homo sapien
tttgcattctaagcccagtggaaag

SEQ ID NO: 609617 - DNA, 25 bp, Homo sapien
gcattctaagcccagtggaaagtac

SEQ ID NO: 609618 - DNA, 25 bp, Homo sapien
ttaatgggcaagaatttccgctcct

SEQ ID NO: 609619 - DNA, 25 bp, Homo sapien
aatgggcaagaatttccgctcctac

SEQ ID NO: 609620 - DNA, 25 bp, Homo sapien
tgggcaagaatttccgctcctacct

SEQ ID NO: 609621 - DNA, 25 bp, Homo sapien
caagaatttccgctcctacctgctg

SEQ ID NO: 609622 - DNA, 25 bp, Homo sapien
acctgctggatctgcgaaacactag

SEQ ID NO: 609623 - DNA, 25 bp, Homo sapien
tgctggatctgcgaaacactagtac

SEQ ID NO: 609624 - DNA, 25 bp, Homo sapien
gcctttcaagggtgtacgcaaagca

SEQ ID NO: 609625 - DNA, 25 bp, Homo sapien
caagggtgtacgcaaagcactcatt

SEQ ID NO: 609626 - DNA, 25 bp, Homo sapien
gggtgtacgcaaagcactcattgat

SEQ ID NO: 609627 - DNA, 25 bp, Homo sapien
agcactcattgatacccttttggat

SEQ ID NO: 609628 - DNA, 25 bp, Homo sapien
cattgatacccttttggatggctat

SEQ ID NO: 609629 - DNA, 25 bp, Homo sapien
gtacttttcttgttctgagatacag

SEQ ID NO: 609630 - DNA, 25 bp, Homo sapien
acagggcatgaactggtagcagaaa

SEQ ID NO: 609631 - DNA, 25 bp, Homo sapien
aaatctagcaatacacagggcattc

SEQ ID NO: 609632 - DNA, 25 bp, Homo sapien
atacacagggcattccaaatgcttt

SEQ ID NO: 609633 - DNA, 25 bp, Homo sapien
caaatgctttcaggtaatatctgca

SEQ ID NO: 609634 - DNA, 25 bp, Homo sapien
ggtaatatctgcatcaccatgattc

SEQ ID NO: 609635 - DNA, 25 bp, Homo sapien
accatgattctgtagcttgccaagc

SEQ ID NO: 609636 - DNA, 25 bp, Homo sapien
gattctgtagcttgccaagcggcaa

SEQ ID NO: 609637 - DNA, 25 bp, Homo sapien
tgccaagcggcaatgtgaaacaaga

SEQ ID NO: 609638 - DNA, 25 bp, Homo sapien
acacaggttctgtagcagctactca

SEQ ID NO: 609639 - DNA, 25 bp, Homo sapien
cagctactcaactttcccattatag

SEQ ID NO: 609640 - DNA, 25 bp, Homo sapien
tggctggtgtctcccttctgccaag

SEQ ID NO: 609641 - DNA, 25 bp, Homo sapien
tggtgtctcccttctgccaagctat

SEQ ID NO: 609642 - DNA, 25 bp, Homo sapien
gtgtctcccttctgccaagctatgc

SEQ ID NO: 609643 - DNA, 25 bp, Homo sapien
ttctgccaagctatgcctcctgcag

SEQ ID NO: 609644 - DNA, 25 bp, Homo sapien
tctgccaagctatgcctcctgcaga

SEQ ID NO: 609645 - DNA, 25 bp, Homo sapien
gccaagctatgcctcctgcagaggt

SEQ ID NO: 609646 - DNA, 25 bp, Homo sapien
gaggtaggctccgtggtgtctccca

SEQ ID NO: 609647 - DNA, 25 bp, Homo sapien
actccgccccaactggagaacggtg

SEQ ID NO: 609648 - DNA, 25 bp, Homo sapien
tccgccccaactggagaacggtgta

SEQ ID NO: 609649 - DNA, 25 bp, Homo sapien
gccccaactggagaacggtgtaaag

SEQ ID NO: 609650 - DNA, 25 bp, Homo sapien
gagaacggtgtaaagaactgtcagc

SEQ ID NO: 609651 - DNA, 25 bp, Homo sapien
agaactgtgcgttctacgggcgcgc

SEQ ID NO: 609652 - DNA, 25 bp, Homo sapien
gggcgcgccgagaccgagcactact

SEQ ID NO: 609653 - DNA, 25 bp, Homo sapien
tactgctcctactgctaccgcgagg

SEQ ID NO: 609654 - DNA, 25 bp, Homo sapien
gaggttctaccttcgaggatttctt

SEQ ID NO: 609655 - DNA, 25 bp, Homo sapien
gatttcttttccattgtgtcggtgt

SEQ ID NO: 609656 - DNA, 25 bp, Homo sapien
gtgtcggtgtcttttttacatgccc

SEQ ID NO: 609657 - DNA, 25 bp, Homo sapien
tttacatgccctggtccaccggaag

SEQ ID NO: 609658 - DNA, 25 bp, Homo sapien
tcctctgtcagtgccgtgtacgtgt

SEQ ID NO: 609659 - DNA, 25 bp, Homo sapien
gtgccgtgtacgtgtttggtcaaac

SEQ ID NO: 609660 - DNA, 25 bp, Homo sapien
tttggtcaaacgttcctaatggtgc

SEQ ID NO: 609661 - DNA, 25 bp, Homo sapien
ctaatggtgcctgaacctacactga

SEQ ID NO: 609662 - DNA, 25 bp, Homo sapien
aatacccaagccctaaaattgatgg

SEQ ID NO: 609663 - DNA, 25 bp, Homo sapien
tggatgtgaccccaggtgttcccct

SEQ ID NO: 609664 - DNA, 25 bp, Homo sapien
tagatggtgggctggaacacccctc

SEQ ID NO: 609665 - DNA, 25 bp, Homo sapien
tgtattcccagaaagcctcgcgttg

SEQ ID NO: 609666 - DNA, 25 bp, Homo sapien
agaaagcctcgcgttgaggtgtgtt

SEQ ID NO: 609667 - DNA, 25 bp, Homo sapien
ttgaggtgtgttggccagctcccta

SEQ ID NO: 609668 - DNA, 25 bp, Homo sapien
cagctccctagtttgtgcttactat

SEQ ID NO: 609669 - DNA, 25 bp, Homo sapien
gtttgtgcttactatacctggccac

SEQ ID NO: 609670 - DNA, 25 bp, Homo sapien
taaggccgctggcttaaccctaggg

SEQ ID NO: 609671 - DNA, 25 bp, Homo sapien
gcaggcagtgttagatcagacccag

SEQ ID NO: 609672 - DNA, 25 bp, Homo sapien
ttagatcagacccagaccttctcat

SEQ ID NO: 609673 - DNA, 25 bp, Homo sapien
aagacagtgcttcaaaaacagctgc

SEQ ID NO: 609674 - DNA, 25 bp, Homo sapien
gaggccagtgttttcatacttactc

SEQ ID NO: 609675 - DNA, 25 bp, Homo sapien
ttcatacttactctttcaacgtgca

SEQ ID NO: 609676 - DNA, 25 bp, Homo sapien
tgcactgcccattgcctttatggag

SEQ ID NO: 609677 - DNA, 25 bp, Homo sapien
cattgcctttatggagccatggtca

SEQ ID NO: 609678 - DNA, 25 bp, Homo sapien
ttcatcaatttccagcctgaccatt

SEQ ID NO: 609679 - DNA, 25 bp, Homo sapien
aactgccagtaaaccaaggctgtga

SEQ ID NO: 609680 - DNA, 25 bp, Homo sapien
cagaagtctggaaactagtgttcat

SEQ ID NO: 609681 - DNA, 25 bp, Homo sapien
ctagtgttcatgagattttttccct

SEQ ID NO: 609682 - DNA, 25 bp, Homo sapien
tttccctcattcactattatctgtc

SEQ ID NO: 609683 - DNA, 25 bp, Homo sapien
cattcactattatctgtcccttata

SEQ ID NO: 609684 - DNA, 25 bp, Homo sapien
atgcacgggtctgcactggacattg

SEQ ID NO: 609685 - DNA, 25 bp, Homo sapien
ctggacattgcagtcctgggatgta

SEQ ID NO: 609686 - DNA, 25 bp, Homo sapien
gtaatttcccagaaggcctgtctca

SEQ ID NO: 609687 - DNA, 25 bp, Homo sapien
caggaagtttacagcccaatagaga

SEQ ID NO: 609688 - DNA, 25 bp, Homo sapien
cttcatataacgtaggtgtctccat

SEQ ID NO: 609689 - DNA, 25 bp, Homo sapien
gtgtctccattcatgaagcacgcat

SEQ ID NO: 609690 - DNA, 25 bp, Homo sapien
gggttcctgcatgcaaaatgtcaca

SEQ ID NO: 609691 - DNA, 25 bp, Homo sapien
attgggtctattactccttcaggag

SEQ ID NO: 609692 - DNA, 25 bp, Homo sapien
aaggctttgaggcttggtacaagtt

SEQ ID NO: 609693 - DNA, 25 bp, Homo sapien
gcacagtttgccatccatgacaatt

SEQ ID NO: 609694 - DNA, 25 bp, Homo sapien
tacatctgtcttttccctgcttcag

SEQ ID NO: 609695 - DNA, 25 bp, Homo sapien
taagctcagtgaaggcgggcattct

SEQ ID NO: 609696 - DNA, 25 bp, Homo sapien
gaaggcgggcattctgcctggctaa

SEQ ID NO: 609697 - DNA, 25 bp, Homo sapien
ggcattctgcctggctaacgcaggt

SEQ ID NO: 609698 - DNA, 25 bp, Homo sapien
taacgcaggtcgctccttgccgtgc

SEQ ID NO: 609699 - DNA, 25 bp, Homo sapien
ttgccgtgcctggaacattactgta

SEQ ID NO: 609700 - DNA, 25 bp, Homo sapien
ccgtgcctggaacattactgtaagt

SEQ ID NO: 609701 - DNA, 25 bp, Homo sapien
gtaagtgctcagcaaactactttaa

SEQ ID NO: 609702 - DNA, 25 bp, Homo sapien
aaatctgcaaggttgcttttgttta

SEQ ID NO: 609703 - DNA, 25 bp, Homo sapien
tgtttaaattggataaccttttgtg

SEQ ID NO: 609704 - DNA, 25 bp, Homo sapien
ccttttgtgttccaagtctttggag

SEQ ID NO: 609705 - DNA, 25 bp, Homo sapien
agatcacgccattttctgggcgaga

SEQ ID NO: 609706 - DNA, 25 bp, Homo sapien
tcatgtgatcctctaccagaagctg

SEQ ID NO: 609707 - DNA, 25 bp, Homo sapien
cagcagcaggccaaaggatagtgga

SEQ ID NO: 609708 - DNA, 25 bp, Homo sapien
gacaagaaggcctgggtgagccttc

SEQ ID NO: 609709 - DNA, 25 bp, Homo sapien
ccttctctgagaatcactgagctct

SEQ ID NO: 609710 - DNA, 25 bp, Homo sapien
gaatcactgagctctgaaccatgaa

SEQ ID NO: 609711 - DNA, 25 bp, Homo sapien
aaccatgaatgaactgcctacctct

SEQ ID NO: 609712 - DNA, 25 bp, Homo sapien
tgaatgaactgcctacctctgtact

SEQ ID NO: 609713 - DNA, 25 bp, Homo sapien
acctctgtacttcctgttgtatagg

SEQ ID NO: 609714 - DNA, 25 bp, Homo sapien
gaaatccctatctatttaaaccact

SEQ ID NO: 609715 - DNA, 25 bp, Homo sapien
aaaccactgtagtcaggtctatgta

SEQ ID NO: 609716 - DNA, 25 bp, Homo sapien
ggtctatgtatttgtgctgtggaac

SEQ ID NO: 609717 - DNA, 25 bp, Homo sapien
gggatgccggcatcagaagaatgtt

SEQ ID NO: 609718 - DNA, 25 bp, Homo sapien
cagaagaatgtttcgtgttcgaaat

SEQ ID NO: 609719 - DNA, 25 bp, Homo sapien
tttcgtgttcgaaattgtttgaggg

SEQ ID NO: 609720 - DNA, 25 bp, Homo sapien
tttttgcttacgtgggcatccttca

SEQ ID NO: 609721 - DNA, 25 bp, Homo sapien
tacgtgggcatccttcagcttttaa

SEQ ID NO: 609722 - DNA, 25 bp, Homo sapien
gtgggcatccttcagcttttaataa

SEQ ID NO: 609723 - DNA, 25 bp, Homo sapien
gggcatccttcagcttttaataatc

SEQ ID NO: 609724 - DNA, 25 bp, Homo sapien
tctgaaaaattctatttacccattg

SEQ ID NO: 609725 - DNA, 25 bp, Homo sapien
atgtgtataaattaatctcagtcaa

SEQ ID NO: 609726 - DNA, 25 bp, Homo sapien
ttaatctcagtcaattttatacaat

SEQ ID NO: 609727 - DNA, 25 bp, Homo sapien
atgtaccggaagaagaatgttcatt

SEQ ID NO: 609728 - DNA, 25 bp, Homo sapien
gagacctgagactaacaggctccta

SEQ ID NO: 609729 - DNA, 25 bp, Homo sapien
gagactaacaggctcctagatgatg

SEQ ID NO: 609730 - DNA, 25 bp, Homo sapien
ctagatgatgccaatgctccccgtc

SEQ ID NO: 609731 - DNA, 25 bp, Homo sapien
gaccgctgtttacctagcggcaaga

SEQ ID NO: 609732 - DNA, 25 bp, Homo sapien
gacgagatcattgccaagtgcctgc

SEQ ID NO: 609733 - DNA, 25 bp, Homo sapien
caagtgcctgcacggttctcataca

SEQ ID NO: 609734 - DNA, 25 bp, Homo sapien
tgcacggttctcatacaccataaac

SEQ ID NO: 609735 - DNA, 25 bp, Homo sapien
caccataaacgaaggccattctttc

SEQ ID NO: 609736 - DNA, 25 bp, Homo sapien
tttggtgactaatagtgtccactaa

SEQ ID NO: 609737 - DNA, 25 bp, Homo sapien
tgaactaagaaaaagcggacctatg

SEQ ID NO: 609738 - DNA, 25 bp, Homo sapien
aagcggacctatgattactgctgtt

SEQ ID NO: 609739 - DNA, 25 bp, Homo sapien
gataattgtccatgatcatctctat

SEQ ID NO: 609740 - DNA, 25 bp, Homo sapien
gtccatgatcatctctatatctaat

SEQ ID NO: 609741 - DNA, 25 bp, Homo sapien
ccacatcctactcttggacaacagg

SEQ ID NO: 609742 - DNA, 25 bp, Homo sapien
atcctactcttggacaacaggaaaa

SEQ ID NO: 609743 - DNA, 25 bp, Homo sapien
aatggagagctttttcagaatgttg

SEQ ID NO: 609744 - DNA, 25 bp, Homo sapien
gagctttttcagaatgttgaattta

SEQ ID NO: 609745 - DNA, 25 bp, Homo sapien
gaatttaggagttgtgtgtgctttt

SEQ ID NO: 609746 - DNA, 25 bp, Homo sapien
tgtgtgtgcttttgatctccatgtc

SEQ ID NO: 609747 - DNA, 25 bp, Homo sapien
gtgtgcttttgatctccatgtcaat

SEQ ID NO: 609748 - DNA, 25 bp, Homo sapien
gcttttgatctccatgtcaatccat

SEQ ID NO: 609749 - DNA, 25 bp, Homo sapien
tttgatctccatgtcaatccataaa

SEQ ID NO: 609750 - DNA, 25 bp, Homo sapien
tatttagcccgaagcagatccaaag

SEQ ID NO: 609751 - DNA, 25 bp, Homo sapien
gatccaaaggcacacatcttactga

SEQ ID NO: 609752 - DNA, 25 bp, Homo sapien
agatgaaaccatgcctcagagatac

SEQ ID NO: 609753 - DNA, 25 bp, Homo sapien
agatacatttatctctggctgccac

SEQ ID NO: 609754 - DNA, 25 bp, Homo sapien
tcagcatagctgatactcaagcaga

SEQ ID NO: 609755 - DNA, 25 bp, Homo sapien
aagcagatgactgacaaaggagccc

SEQ ID NO: 609756 - DNA, 25 bp, Homo sapien
gagcccaatctaaagggctgctgaa

SEQ ID NO: 609757 - DNA, 25 bp, Homo sapien
ttttggctaagatcacatgtatgtt

SEQ ID NO: 609758 - DNA, 25 bp, Homo sapien
gatcacatgtatgttatccccatat

SEQ ID NO: 609759 - DNA, 25 bp, Homo sapien
gttatccccatataaatggccaagt

SEQ ID NO: 609760 - DNA, 25 bp, Homo sapien
aagtacatctgttggtcaccgacaa

SEQ ID NO: 609761 - DNA, 25 bp, Homo sapien
tccaggaccccattcacgaagctag

SEQ ID NO: 609762 - DNA, 25 bp, Homo sapien
ccaggaccccattcacgaagctagg

SEQ ID NO: 609763 - DNA, 25 bp, Homo sapien
caggaccccattcacgaagctaggg

SEQ ID NO: 609764 - DNA, 25 bp, Homo sapien
aggaccccattcacgaagctagggt

SEQ ID NO: 609765 - DNA, 25 bp, Homo sapien
gaccccattcacgaagctagggtgc

SEQ ID NO: 609766 - DNA, 25 bp, Homo sapien
accccattcacgaagctagggtgcc

SEQ ID NO: 609767 - DNA, 25 bp, Homo sapien
ccattcacgaagctagggtgcccct

SEQ ID NO: 609768 - DNA, 25 bp, Homo sapien
cattcacgaagctagggtgcccctc

SEQ ID NO: 609769 - DNA, 25 bp, Homo sapien
attcacgaagctagggtgcccctct

SEQ ID NO: 609770 - DNA, 25 bp, Homo sapien
ttcacgaagctagggtgcccctctc

SEQ ID NO: 609771 - DNA, 25 bp, Homo sapien
tcacgaagctagggtgcccctctcc

SEQ ID NO: 609772 - DNA, 25 bp, Homo sapien
tttgccatcccggtcttgtttcagc

SEQ ID NO: 609773 - DNA, 25 bp, Homo sapien
atcccggtcttgtttcagcataaaa

SEQ ID NO: 609774 - DNA, 25 bp, Homo sapien
gcataaaagttcagacagctctgta

SEQ ID NO: 609775 - DNA, 25 bp, Homo sapien
ggtctggtacaggagttaaataaca

SEQ ID NO: 609776 - DNA, 25 bp, Homo sapien
gttaaataacaatgacacacacaca

SEQ ID NO: 609777 - DNA, 25 bp, Homo sapien
aaaccactgatctgtgattgctctc

SEQ ID NO: 609778 - DNA, 25 bp, Homo sapien
tgatctgtgattgctctccctttgt

SEQ ID NO: 609779 - DNA, 25 bp, Homo sapien
tgattgctctccctttgtgtctact

SEQ ID NO: 609780 - DNA, 25 bp, Homo sapien
ctttgtgtctactgccgtatacata

SEQ ID NO: 609781 - DNA, 25 bp, Homo sapien
gtgtctactgccgtatacatatata

SEQ ID NO: 609782 - DNA, 25 bp, Homo sapien
aactgtcatttacctgtatttgcaa

SEQ ID NO: 609783 - DNA, 25 bp, Homo sapien
ggagagacacaaatgaaccaatgag

SEQ ID NO: 609784 - DNA, 25 bp, Homo sapien
aaccaatgagggaggacaatgtatc

SEQ ID NO: 609785 - DNA, 25 bp, Homo sapien
aatgtatcattctgtgctggcttga

SEQ ID NO: 609786 - DNA, 25 bp, Homo sapien
ctgtgctggcttgatcagattaatg

SEQ ID NO: 609787 - DNA, 25 bp, Homo sapien
agattaatggacactgatggattca

SEQ ID NO: 609788 - DNA, 25 bp, Homo sapien
ttcagtggcctgtcaggaggaattt

SEQ ID NO: 609789 - DNA, 25 bp, Homo sapien
gaggaatttaggcttcatgaagaat

SEQ ID NO: 609790 - DNA, 25 bp, Homo sapien
ccagttagagagagggacagaatta

SEQ ID NO: 609791 - DNA, 25 bp, Homo sapien
gagaaagctttccatcctacttttt

SEQ ID NO: 609792 - DNA, 25 bp, Homo sapien
gctttccatcctacttttttcaatg

SEQ ID NO: 609793 - DNA, 25 bp, Homo sapien
tttttcaatgcttgtattccccatg

SEQ ID NO: 609794 - DNA, 25 bp, Homo sapien
aattaagaaatttggacaggtgctg

SEQ ID NO: 609795 - DNA, 25 bp, Homo sapien
attaagaaatttggacaggtgctgt

SEQ ID NO: 609796 - DNA, 25 bp, Homo sapien
ttaagaaatttggacaggtgctgtg

SEQ ID NO: 609797 - DNA, 25 bp, Homo sapien
taagaaatttggacaggtgctgtgg

SEQ ID NO: 609798 - DNA, 25 bp, Homo sapien
gaaatttggacaggtgctgtggctc

SEQ ID NO: 609799 - DNA, 25 bp, Homo sapien
ccggcctggccgatgcggtgaagcc

SEQ ID NO: 609800 - DNA, 25 bp, Homo sapien
cggcctggccgatgcggtgaagccc

SEQ ID NO: 609801 - DNA, 25 bp, Homo sapien
ggcctggccgatgcggtgaagccct

SEQ ID NO: 609802 - DNA, 25 bp, Homo sapien
ctggccgatgcggtgaagccctgtc

SEQ ID NO: 609803 - DNA, 25 bp, Homo sapien
gcaggggaactggttgaacccaaga

SEQ ID NO: 609804 - DNA, 25 bp, Homo sapien
caggggaactggttgaacccaagag

SEQ ID NO: 609805 - DNA, 25 bp, Homo sapien
ctagaagcaataggctaccccatat

SEQ ID NO: 609806 - DNA, 25 bp, Homo sapien
ctaccccatatagcctgagtgtgca

SEQ ID NO: 609807 - DNA, 25 bp, Homo sapien
accccatatagcctgagtgtgcagt

SEQ ID NO: 609808 - DNA, 25 bp, Homo sapien
tatagcctgagtgtgcagtagccta

SEQ ID NO: 609809 - DNA, 25 bp, Homo sapien
agcctgagtgtgcagtagcctatat

SEQ ID NO: 609810 - DNA, 25 bp, Homo sapien
gagtgtgcagtagcctatatcatct

SEQ ID NO: 609811 - DNA, 25 bp, Homo sapien
atctagatttgtgtaagtgcactcc

SEQ ID NO: 609812 - DNA, 25 bp, Homo sapien
tagatttgtgtaagtgcactccatg

SEQ ID NO: 609813 - DNA, 25 bp, Homo sapien
cacaaagtcgcctactgatgtattt

SEQ ID NO: 609814 - DNA, 25 bp, Homo sapien
aagtcgcctactgatgtatttctca

SEQ ID NO: 609815 - DNA, 25 bp, Homo sapien
gtcgcctactgatgtatttctcaga

SEQ ID NO: 609816 - DNA, 25 bp, Homo sapien
tccttcaaacttgatcagttcgctg

SEQ ID NO: 609817 - DNA, 25 bp, Homo sapien
gatcagttcgctgttctgtcttttg

SEQ ID NO: 609818 - DNA, 25 bp, Homo sapien
gttaattcacattcatctcctatat

SEQ ID NO: 609819 - DNA, 25 bp, Homo sapien
actttggctaagtcttgtgatttct

SEQ ID NO: 609820 - DNA, 25 bp, Homo sapien
aagtcttgtgatttcttgccttatt

SEQ ID NO: 609821 - DNA, 25 bp, Homo sapien
ttgccttattggagcttttcttcta

SEQ ID NO: 609822 - DNA, 25 bp, Homo sapien
ttggagcttttcttctaatctgaat

SEQ ID NO: 609823 - DNA, 25 bp, Homo sapien
acaagtcctaacctctccaggaagt

SEQ ID NO: 609824 - DNA, 25 bp, Homo sapien
ttgaaatgatgttacctgggtttga

SEQ ID NO: 609825 - DNA, 25 bp, Homo sapien
gggtttgagttcttggcattagcct

SEQ ID NO: 609826 - DNA, 25 bp, Homo sapien
tgagttcttggcattagcctgtatc

SEQ ID NO: 609827 - DNA, 25 bp, Homo sapien
gttgggatgttcagactggaaagca

SEQ ID NO: 609828 - DNA, 25 bp, Homo sapien
ttgggatgttcagactggaaagcag

SEQ ID NO: 609829 - DNA, 25 bp, Homo sapien
gactggaaagcaggaaactgactct

SEQ ID NO: 609830 - DNA, 25 bp, Homo sapien
ctggaaagcaggaaactgactctgg

SEQ ID NO: 609831 - DNA, 25 bp, Homo sapien
ggaaagcaggaaactgactctgggc

SEQ ID NO: 609832 - DNA, 25 bp, Homo sapien
gaaagcaggaaactgactctgggct

SEQ ID NO: 609833 - DNA, 25 bp, Homo sapien
aaagcaggaaactgactctgggctg

SEQ ID NO: 609834 - DNA, 25 bp, Homo sapien
aagcaggaaactgactctgggctgg

SEQ ID NO: 609835 - DNA, 25 bp, Homo sapien
caggaaactgactctgggctgggca

SEQ ID NO: 609836 - DNA, 25 bp, Homo sapien
aggaaactgactctgggctgggcat

SEQ ID NO: 609837 - DNA, 25 bp, Homo sapien
ggaaactgactctgggctgggcatg

SEQ ID NO: 609838 - DNA, 25 bp, Homo sapien
aattaagaaatttggacaggtgctg

SEQ ID NO: 609839 - DNA, 25 bp, Homo sapien
attaagaaatttggacaggtgctgt

SEQ ID NO: 609840 - DNA, 25 bp, Homo sapien
ttaagaaatttggacaggtgctgtg

SEQ ID NO: 609841 - DNA, 25 bp, Homo sapien
taagaaatttggacaggtgctgtgg

SEQ ID NO: 609842 - DNA, 25 bp, Homo sapien
ccggcctggccgatgcggtgaagcc

SEQ ID NO: 609843 - DNA, 25 bp, Homo sapien
cggcctggccgatgcggtgaagccc

SEQ ID NO: 609844 - DNA, 25 bp, Homo sapien
ggcctggccgatgcggtgaagccct

SEQ ID NO: 609845 - DNA, 25 bp, Homo sapien
ctggccgatgcggtgaagccctgtc

SEQ ID NO: 609846 - DNA, 25 bp, Homo sapien
gcaggggaactggttgaacccaaga

SEQ ID NO: 609847 - DNA, 25 bp, Homo sapien
caggggaactggttgaacccaagag

SEQ ID NO: 609848 - DNA, 25 bp, Homo sapien
agagccctttcacggtcagggcctg

SEQ ID NO: 609849 - DNA, 25 bp, Homo sapien
ctttcacggtcagggcctgagctct

SEQ ID NO: 609850 - DNA, 25 bp, Homo sapien
ggcctgagctctgtgggtgccatta

SEQ ID NO: 609851 - DNA, 25 bp, Homo sapien
cctgagctctgtgggtgccattagg

SEQ ID NO: 609852 - DNA, 25 bp, Homo sapien
gggtgccattaggaggagggtctgc

SEQ ID NO: 609853 - DNA, 25 bp, Homo sapien
tgtcctcacagcagcgtcgtcacag

SEQ ID NO: 609854 - DNA, 25 bp, Homo sapien
agcggcagcggctcctggtaccaag

SEQ ID NO: 609855 - DNA, 25 bp, Homo sapien
gcagcggctcctggtaccaagcata

SEQ ID NO: 609856 - DNA, 25 bp, Homo sapien
gctcctggtaccaagcataccttaa

SEQ ID NO: 609857 - DNA, 25 bp, Homo sapien
gtaccaagcataccttaaaaatgag

SEQ ID NO: 609858 - DNA, 25 bp, Homo sapien
taaaaatgagcccatggatgttgca

SEQ ID NO: 609859 - DNA, 25 bp, Homo sapien
cacagtcttccttcttttggcgtgt

SEQ ID NO: 609860 - DNA, 25 bp, Homo sapien
agtcttccttcttttggcgtgtggg

SEQ ID NO: 609861 - DNA, 25 bp, Homo sapien
ccttcttttggcgtgtgggctggta

SEQ ID NO: 609862 - DNA, 25 bp, Homo sapien
tcttttggcgtgtgggctggtacca

SEQ ID NO: 609863 - DNA, 25 bp, Homo sapien
gggcattgtcaatggtggtatcttt

SEQ ID NO: 609864 - DNA, 25 bp, Homo sapien
gtcaatggtggtatctttagcctga

SEQ ID NO: 609865 - DNA, 25 bp, Homo sapien
aatggtggtatctttagcctgagac

SEQ ID NO: 609866 - DNA, 25 bp, Homo sapien
ggtggtatctttagcctgagacaga

SEQ ID NO: 609867 - DNA, 25 bp, Homo sapien
ggtatctttagcctgagacagaaga

SEQ ID NO: 609868 - DNA, 25 bp, Homo sapien
tctggtttgttgtttcagaagacca

SEQ ID NO: 609869 - DNA, 25 bp, Homo sapien
gtttcagaagaccaataaagactgt

SEQ ID NO: 609870 - DNA, 25 bp, Homo sapien
taatctctgttagtaaagaggaagg

SEQ ID NO: 609871 - DNA, 25 bp, Homo sapien
aatctctgttagtaaagaggaagga

SEQ ID NO: 609872 - DNA, 25 bp, Homo sapien
aaagaggaaggagggtcaggtgcag

SEQ ID NO: 609873 - DNA, 25 bp, Homo sapien
ggaaggagggtcaggtgcagaggct

SEQ ID NO: 609874 - DNA, 25 bp, Homo sapien
gaaggagggtcaggtgcagaggctc

SEQ ID NO: 609875 - DNA, 25 bp, Homo sapien
aggagggtcaggtgcagaggctcac

SEQ ID NO: 609876 - DNA, 25 bp, Homo sapien
aagttggagtgagccgataatcgca

SEQ ID NO: 609877 - DNA, 25 bp, Homo sapien
agttggagtgagccgataatcgcac

SEQ ID NO: 609878 - DNA, 25 bp, Homo sapien
ttggagtgagccgataatcgcacca

SEQ ID NO: 609879 - DNA, 25 bp, Homo sapien
tggagtgagccgataatcgcaccat

SEQ ID NO: 609880 - DNA, 25 bp, Homo sapien
ggagtgagccgataatcgcaccatt

SEQ ID NO: 609881 - DNA, 25 bp, Homo sapien
aagatctgacctcactccagagttg

SEQ ID NO: 609882 - DNA, 25 bp, Homo sapien
tcactccagagttgaagggcacaga

SEQ ID NO: 609883 - DNA, 25 bp, Homo sapien
cacagagaaggcacagctagaggcg

SEQ ID NO: 609884 - DNA, 25 bp, Homo sapien
agctagaggcggcaggtacccctca

SEQ ID NO: 609885 - DNA, 25 bp, Homo sapien
tacccctcaaagctctcgggagagg

SEQ ID NO: 609886 - DNA, 25 bp, Homo sapien
ctcaaaagccctgagagggctgcat

SEQ ID NO: 609887 - DNA, 25 bp, Homo sapien
tgcatgcaaggagacaaagctggag

SEQ ID NO: 609888 - DNA, 25 bp, Homo sapien
aggtaggtggctttgctctaaacag

SEQ ID NO: 609889 - DNA, 25 bp, Homo sapien
gctctaaacagaatcgtctcagtaa

SEQ ID NO: 609890 - DNA, 25 bp, Homo sapien
tcgtctcagtaatgtgacactgcac

SEQ ID NO: 609891 - DNA, 25 bp, Homo sapien
gacactgcacatgtataggtaggct

SEQ ID NO: 609892 - DNA, 25 bp, Homo sapien
agagtccaggaaattaaattctctc

SEQ ID NO: 609893 - DNA, 25 bp, Homo sapien
gaagtactgcagaaactgctcaaga

SEQ ID NO: 609894 - DNA, 25 bp, Homo sapien
gctcaagatggaaggataccagaga

SEQ ID NO: 609895 - DNA, 25 bp, Homo sapien
cattgctcaatgtttaaaacttatt

SEQ ID NO: 609896 - DNA, 25 bp, Homo sapien
aacttagtccaaaatcaaacaacat

SEQ ID NO: 609897 - DNA, 25 bp, Homo sapien
tgaaaagtttatcctcaccctatct

SEQ ID NO: 609898 - DNA, 25 bp, Homo sapien
aagtttatcctcaccctatctactt

SEQ ID NO: 609899 - DNA, 25 bp, Homo sapien
tcaccctatctacttccagcaattt

SEQ ID NO: 609900 - DNA, 25 bp, Homo sapien
ttccagcaatttccttccaattcta

SEQ ID NO: 609901 - DNA, 25 bp, Homo sapien
gcaatttccttccaattctatctgt

SEQ ID NO: 609902 - DNA, 25 bp, Homo sapien
tttccttccaattctatctgtagta

SEQ ID NO: 609903 - DNA, 25 bp, Homo sapien
acccaaataagcctgtgtcttaaga

SEQ ID NO: 609904 - DNA, 25 bp, Homo sapien
taagcctgtgtcttaagatagacaa

SEQ ID NO: 609905 - DNA, 25 bp, Homo sapien
atttgtcgtattgtacatcctttgt

SEQ ID NO: 609906 - DNA, 25 bp, Homo sapien
gtattgtacatcctttgtatatgtg

SEQ ID NO: 609907 - DNA, 25 bp, Homo sapien
atatgtggaaggtattcattattct

SEQ ID NO: 609908 - DNA, 25 bp, Homo sapien
tgtaaccataaagcagaaaatctgt

SEQ ID NO: 609909 - DNA, 25 bp, Homo sapien
gaaagctctttcctcattatgtttg

SEQ ID NO: 609910 - DNA, 25 bp, Homo sapien
gctctttcctcattatgtttgtaaa

SEQ ID NO: 609911 - DNA, 25 bp, Homo sapien
ggaccctaaagtaagaataacaatg

SEQ ID NO: 609912 - DNA, 25 bp, Homo sapien
aaataagactcctaatctgaacgta

SEQ ID NO: 609913 - DNA, 25 bp, Homo sapien
gactcctaatctgaacgtaaattaa

SEQ ID NO: 609914 - DNA, 25 bp, Homo sapien
gtatcatgctactttgttgaacttg

SEQ ID NO: 609915 - DNA, 25 bp, Homo sapien
gttgaacttgttgattacctctgtc

SEQ ID NO: 609916 - DNA, 25 bp, Homo sapien
gatactttgtcctttccaatgtgaa

SEQ ID NO: 609917 - DNA, 25 bp, Homo sapien
ttgcctaattgctccagctagaatt

SEQ ID NO: 609918 - DNA, 25 bp, Homo sapien
gcaaaaacctgcattctgatctcgt

SEQ ID NO: 609919 - DNA, 25 bp, Homo sapien
tctgatctcgttcctgatcttggag

SEQ ID NO: 609920 - DNA, 25 bp, Homo sapien
ggaggagagctttcagtctgtcacc

SEQ ID NO: 609921 - DNA, 25 bp, Homo sapien
gagctttcagtctgtcaccattgag

SEQ ID NO: 609922 - DNA, 25 bp, Homo sapien
gatgtcagcggtacatgtttcatat

SEQ ID NO: 609923 - DNA, 25 bp, Homo sapien
ggcttttattatgttctggtagttt

SEQ ID NO: 609924 - DNA, 25 bp, Homo sapien
gtagtttcctactgttgctaatttt

SEQ ID NO: 609925 - DNA, 25 bp, Homo sapien
aggtcaacggattgagaccatctag

SEQ ID NO: 609926 - DNA, 25 bp, Homo sapien
ggtcaacggattgagaccatctagg

SEQ ID NO: 609927 - DNA, 25 bp, Homo sapien
gtcaacggattgagaccatctaggc

SEQ ID NO: 609928 - DNA, 25 bp, Homo sapien
tcaacggattgagaccatctaggcc

SEQ ID NO: 609929 - DNA, 25 bp, Homo sapien
caacggattgagaccatctaggcca

SEQ ID NO: 609930 - DNA, 25 bp, Homo sapien
aacggattgagaccatctaggccaa

SEQ ID NO: 609931 - DNA, 25 bp, Homo sapien
acggattgagaccatctaggccaac

SEQ ID NO: 609932 - DNA, 25 bp, Homo sapien
cggattgagaccatctaggccaacg

SEQ ID NO: 609933 - DNA, 25 bp, Homo sapien
ggattgagaccatctaggccaacgt

SEQ ID NO: 609934 - DNA, 25 bp, Homo sapien
gattgagaccatctaggccaacgtg

SEQ ID NO: 609935 - DNA, 25 bp, Homo sapien
attgagaccatctaggccaacgtgg

SEQ ID NO: 609936 - DNA, 25 bp, Homo sapien
cattatcaaagtgtccagtcatccc

SEQ ID NO: 609937 - DNA, 25 bp, Homo sapien
aaagtgtccagtcatcccagtggct

SEQ ID NO: 609938 - DNA, 25 bp, Homo sapien
cccagtggctggaaatcggatctag

SEQ ID NO: 609939 - DNA, 25 bp, Homo sapien
tcggatctagaactgaataccaact

SEQ ID NO: 609940 - DNA, 25 bp, Homo sapien
gaataccaactgagaccgcggaagt

SEQ ID NO: 609941 - DNA, 25 bp, Homo sapien
cgcggaagtctcagcggtcctgatg

SEQ ID NO: 609942 - DNA, 25 bp, Homo sapien
tggaatctgaaagtctgtccctccc

SEQ ID NO: 609943 - DNA, 25 bp, Homo sapien
aggcttctttaattacccaagagat

SEQ ID NO: 609944 - DNA, 25 bp, Homo sapien
attacccaagagatgcttcagagtc

SEQ ID NO: 609945 - DNA, 25 bp, Homo sapien
gatgcttcagagtcagctgactttc

SEQ ID NO: 609946 - DNA, 25 bp, Homo sapien
tgcagcatttcacatgtttacccaa

SEQ ID NO: 609947 - DNA, 25 bp, Homo sapien
tggagagtgtgcaggattgattaat

SEQ ID NO: 609948 - DNA, 25 bp, Homo sapien
ttgattaatgatgtctgccacggtc

SEQ ID NO: 609949 - DNA, 25 bp, Homo sapien
attaatgatgtctgccacggtcagg

SEQ ID NO: 609950 - DNA, 25 bp, Homo sapien
cacggtcaggccaactgctgtgttt

SEQ ID NO: 609951 - DNA, 25 bp, Homo sapien
gtcaggccaactgctgtgtttctgg

SEQ ID NO: 609952 - DNA, 25 bp, Homo sapien
ctgctgtgtttctggggcccacaag

SEQ ID NO: 609953 - DNA, 25 bp, Homo sapien
ggcccacaagctaaaaatggttgga

SEQ ID NO: 609954 - DNA, 25 bp, Homo sapien
tatttgtgacatatgagaatgctat

SEQ ID NO: 609955 - DNA, 25 bp, Homo sapien
gagaatgctatgaaagtcaactttg

SEQ ID NO: 609956 - DNA, 25 bp, Homo sapien
aagtcaactttgctatccataaata

SEQ ID NO: 609957 - DNA, 25 bp, Homo sapien
gtcaactttgctatccataaataaa

SEQ ID NO: 609958 - DNA, 25 bp, Homo sapien
aaaacttaggctatggggcccagcg

SEQ ID NO: 609959 - DNA, 25 bp, Homo sapien
gggcccagcgtggaggctcacacat

SEQ ID NO: 609960 - DNA, 25 bp, Homo sapien
ggcccagcgtggaggctcacacatg

SEQ ID NO: 609961 - DNA, 25 bp, Homo sapien
gcccagcgtggaggctcacacatgt

SEQ ID NO: 609962 - DNA, 25 bp, Homo sapien
ccagcgtggaggctcacacatgtaa

SEQ ID NO: 609963 - DNA, 25 bp, Homo sapien
tgggaagctaatgccggagaatcgc

SEQ ID NO: 609964 - DNA, 25 bp, Homo sapien
aagctaatgccggagaatcgcttaa

SEQ ID NO: 609965 - DNA, 25 bp, Homo sapien
agctaatgccggagaatcgcttaag

SEQ ID NO: 609966 - DNA, 25 bp, Homo sapien
aatgccggagaatcgcttaagccca

SEQ ID NO: 609967 - DNA, 25 bp, Homo sapien
cagcttgagcaacagtgagattcca

SEQ ID NO: 609968 - DNA, 25 bp, Homo sapien
agcttgagcaacagtgagattccat

SEQ ID NO: 609969 - DNA, 25 bp, Homo sapien
tgaaggcatgtggactgacttctga

SEQ ID NO: 609970 - DNA, 25 bp, Homo sapien
ttctgattgctgtgaggcactctcc

SEQ ID NO: 609971 - DNA, 25 bp, Homo sapien
tgtgaggcactctccttggcccttt

SEQ ID NO: 609972 - DNA, 25 bp, Homo sapien
tgcaaccggcatctgaccagtctaa

SEQ ID NO: 609973 - DNA, 25 bp, Homo sapien
gaccagtctaaacctggtgcagaat

SEQ ID NO: 609974 - DNA, 25 bp, Homo sapien
gcagaataacttcagtcccaaagga

SEQ ID NO: 609975 - DNA, 25 bp, Homo sapien
gatgaagctgtgttcggcctttgcc

SEQ ID NO: 609976 - DNA, 25 bp, Homo sapien
ctgtcccacgtctaacttacagata

SEQ ID NO: 609977 - DNA, 25 bp, Homo sapien
ggaaatggcagtaccctgtgcaaat

SEQ ID NO: 609978 - DNA, 25 bp, Homo sapien
gaggaagtgcagctactcaagcccc

SEQ ID NO: 609979 - DNA, 25 bp, Homo sapien
ttgacggtagttggcattcttttga

SEQ ID NO: 609980 - DNA, 25 bp, Homo sapien
ggaatgcttacctgcttataagtgt

SEQ ID NO: 609981 - DNA, 25 bp, Homo sapien
acctgcttataagtgtggtgtggca

SEQ ID NO: 609982 - DNA, 25 bp, Homo sapien
ggaaagacatccctaggacaagtaa

SEQ ID NO: 609983 - DNA, 25 bp, Homo sapien
taaacaccttgccaaatcccaaata

SEQ ID NO: 609984 - DNA, 25 bp, Homo sapien
gaagaaacactttgtcatcccagac

SEQ ID NO: 609985 - DNA, 25 bp, Homo sapien
aacactttgtcatcccagacaggga

SEQ ID NO: 609986 - DNA, 25 bp, Homo sapien
gtcatcccagacagggatttgtcat

SEQ ID NO: 609987 - DNA, 25 bp, Homo sapien
ttgtcataatgaagcctttcctgga

SEQ ID NO: 609988 - DNA, 25 bp, Homo sapien
aactagggcatgtagaggtatgtca

SEQ ID NO: 609989 - DNA, 25 bp, Homo sapien
aggtatgtcatggacctgagaatct

SEQ ID NO: 609990 - DNA, 25 bp, Homo sapien
tactaataggaatgcttacctgctt

SEQ ID NO: 609991 - DNA, 25 bp, Homo sapien
gctaatcccagtacagaaccactat

SEQ ID NO: 609992 - DNA, 25 bp, Homo sapien
gtacagaaccactatgggcaaattt

SEQ ID NO: 609993 - DNA, 25 bp, Homo sapien
tctgcacaccctctttgcaaaagga

SEQ ID NO: 609994 - DNA, 25 bp, Homo sapien
ggacacacctgagttgagtctgcct

SEQ ID NO: 609995 - DNA, 25 bp, Homo sapien
tgagttgagtctgcctctcattggc

SEQ ID NO: 609996 - DNA, 25 bp, Homo sapien
gcctctcattggcatgagctttgtg

SEQ ID NO: 609997 - DNA, 25 bp, Homo sapien
ggcgcacagacccttgctgtgagaa

SEQ ID NO: 609998 - DNA, 25 bp, Homo sapien
gctgtgagaacaggaaccccagtct

SEQ ID NO: 609999 - DNA, 25 bp, Homo sapien
gtcagatccgacagcaaacgaagca

SEQ ID NO: 610000 - DNA, 25 bp, Homo sapien
aacgaagcagatgcgtgaatcccct

SEQ ID NO: 610001 - DNA, 25 bp, Homo sapien
gtttgaagtgaacacttgccatttt

SEQ ID NO: 610002 - DNA, 25 bp, Homo sapien
tgaaagtgccatttctccctttatc

SEQ ID NO: 610003 - DNA, 25 bp, Homo sapien
gccatttctccctttatcattgtga

SEQ ID NO: 610004 - DNA, 25 bp, Homo sapien
tattcaaatgcatgagtctctgatt

SEQ ID NO: 610005 - DNA, 25 bp, Homo sapien
gagtctctgattttctaccatatac

SEQ ID NO: 610006 - DNA, 25 bp, Homo sapien
gggtagagactacagtttcctatag

SEQ ID NO: 610007 - DNA, 25 bp, Homo sapien
gaagaaacttcacatagtggccgaa

SEQ ID NO: 610008 - DNA, 25 bp, Homo sapien
gtggccgaaggatcttatttctcaa

SEQ ID NO: 610009 - DNA, 25 bp, Homo sapien
gaactggtttcctctttctggaaat

SEQ ID NO: 610010 - DNA, 25 bp, Homo sapien
aacttgatttcatggtatctctttc

SEQ ID NO: 610011 - DNA, 25 bp, Homo sapien
tggtatctctttcatcttcctcaat

SEQ ID NO: 610012 - DNA, 25 bp, Homo sapien
ttcctcaatgcctgtgctgtatgta

SEQ ID NO: 610013 - DNA, 25 bp, Homo sapien
atgaggacccttttgagaatctttc

SEQ ID NO: 610014 - DNA, 25 bp, Homo sapien
tgagaatctttcagtgatccccttc

SEQ ID NO: 610015 - DNA, 25 bp, Homo sapien
agtgatccccttctctaggaaggaa

SEQ ID NO: 610016 - DNA, 25 bp, Homo sapien
aggaagggtgaagtatgctttgtaa

SEQ ID NO: 610017 - DNA, 25 bp, Homo sapien
agagagattgtctatttgtctttta

SEQ ID NO: 610018 - DNA, 25 bp, Homo sapien
gtctatttgtcttttatctcctgat

SEQ ID NO: 610019 - DNA, 25 bp, Homo sapien
atctcctgatttcaaacacagtggt

SEQ ID NO: 610020 - DNA, 25 bp, Homo sapien
aacacagtggttccgctaagctgca

SEQ ID NO: 610021 - DNA, 25 bp, Homo sapien
ggttccgctaagctgcatctttttt

SEQ ID NO: 610022 - DNA, 25 bp, Homo sapien
gtcggaaaatgtaaccagtgcaatt

SEQ ID NO: 610023 - DNA, 25 bp, Homo sapien
gtgaccaataaaatacttgatgcca

SEQ ID NO: 610024 - DNA, 25 bp, Homo sapien
taaatagtgttctccttgtacccgg

SEQ ID NO: 610025 - DNA, 25 bp, Homo sapien
ttgtacccggaccaactggcattta

SEQ ID NO: 610026 - DNA, 25 bp, Homo sapien
tacccggaccaactggcatttattt

SEQ ID NO: 610027 - DNA, 25 bp, Homo sapien
tttatttacaaatgtcacccgccac

SEQ ID NO: 610028 - DNA, 25 bp, Homo sapien
actgggaaagtctcaaccacatctg

SEQ ID NO: 610029 - DNA, 25 bp, Homo sapien
aaccacatctggagaacgcccgaga

SEQ ID NO: 610030 - DNA, 25 bp, Homo sapien
acatctggagaacgcccgagagacc

SEQ ID NO: 610031 - DNA, 25 bp, Homo sapien
tacagggaaagccaacgggtctgca

SEQ ID NO: 610032 - DNA, 25 bp, Homo sapien
gggtctgcaggcctccgggagacga

SEQ ID NO: 610033 - DNA, 25 bp, Homo sapien
gccttgctcagctctaaacagccga

SEQ ID NO: 610034 - DNA, 25 bp, Homo sapien
tctaaacagccgaccaggaggccgg

SEQ ID NO: 610035 - DNA, 25 bp, Homo sapien
ctgctttgggcagtaaactacgtgg

SEQ ID NO: 610036 - DNA, 25 bp, Homo sapien
ggcagtaaactacgtggtcgctctt

SEQ ID NO: 610037 - DNA, 25 bp, Homo sapien
agtaaactacgtggtcgctcttgac

SEQ ID NO: 610038 - DNA, 25 bp, Homo sapien
aaactacgtggtcgctcttgaccta

SEQ ID NO: 610039 - DNA, 25 bp, Homo sapien
tggtcgctcttgacctacgggataa

SEQ ID NO: 610040 - DNA, 25 bp, Homo sapien
cgctcttgacctacgggataaccag

SEQ ID NO: 610041 - DNA, 25 bp, Homo sapien
gggataaccagttttccatgctcat

SEQ ID NO: 610042 - DNA, 25 bp, Homo sapien
gataaccagttttccatgctcatgc

SEQ ID NO: 610043 - DNA, 25 bp, Homo sapien
taaccagttttccatgctcatgccc

SEQ ID NO: 610044 - DNA, 25 bp, Homo sapien
agctagcccgcgctttcactaaagt

SEQ ID NO: 610045 - DNA, 25 bp, Homo sapien
tagcccgcgctttcactaaagttta

SEQ ID NO: 610046 - DNA, 25 bp, Homo sapien
gagaaatttcagttcttcactcagg

SEQ ID NO: 610047 - DNA, 25 bp, Homo sapien
gaaatttcagttcttcactcaggaa

SEQ ID NO: 610048 - DNA, 25 bp, Homo sapien
gttcttcactcaggaaatgtgctgt

SEQ ID NO: 610049 - DNA, 25 bp, Homo sapien
actcaggaaatgtgctgtattctct

SEQ ID NO: 610050 - DNA, 25 bp, Homo sapien
gctgtattctctaatgtactttcat

SEQ ID NO: 610051 - DNA, 25 bp, Homo sapien
tctaatgtactttcatgctgcagca

SEQ ID NO: 610052 - DNA, 25 bp, Homo sapien
actttcatgctgcagcatggagcct

SEQ ID NO: 610053 - DNA, 25 bp, Homo sapien
cagcatggagcctctttaaacagct

SEQ ID NO: 610054 - DNA, 25 bp, Homo sapien
atttcaatcatcttggtacaataga

SEQ ID NO: 610055 - DNA, 25 bp, Homo sapien
atagatgacttttacatcatgtata

SEQ ID NO: 610056 - DNA, 25 bp, Homo sapien
tcatgtatattagccttatgtgata

SEQ ID NO: 610057 - DNA, 25 bp, Homo sapien
tgataacattgagttctccctctct

SEQ ID NO: 610058 - DNA, 25 bp, Homo sapien
cctctctcccagatggtacgaagta

SEQ ID NO: 610059 - DNA, 25 bp, Homo sapien
tgcttctgagagcagccccacttca

SEQ ID NO: 610060 - DNA, 25 bp, Homo sapien
ctggcttcttcacacatttagatta

SEQ ID NO: 610061 - DNA, 25 bp, Homo sapien
acacatttagattacctgtccatat

SEQ ID NO: 610062 - DNA, 25 bp, Homo sapien
tacctgtccatatcttacgggcatt

SEQ ID NO: 610063 - DNA, 25 bp, Homo sapien
tacgggcatttgtggttttgaacct

SEQ ID NO: 610064 - DNA, 25 bp, Homo sapien
gatgttctctattctagttagcaca

SEQ ID NO: 610065 - DNA, 25 bp, Homo sapien
gcacaattatctaatcccttcggac

SEQ ID NO: 610066 - DNA, 25 bp, Homo sapien
atcccttcggacatagtgaaaagcc

SEQ ID NO: 610067 - DNA, 25 bp, Homo sapien
agcctagatttattccttttatcac

SEQ ID NO: 610068 - DNA, 25 bp, Homo sapien
gacgtaaactgtcttcttagtgcca

SEQ ID NO: 610069 - DNA, 25 bp, Homo sapien
aactgtcttcttagtgccaaatgca

SEQ ID NO: 610070 - DNA, 25 bp, Homo sapien
ttagtgccaaatgcaagcccttttt

SEQ ID NO: 610071 - DNA, 25 bp, Homo sapien
tgaaaaagctggacttcccagcatt

SEQ ID NO: 610072 - DNA, 25 bp, Homo sapien
gacttcccagcattacggaattccc

SEQ ID NO: 610073 - DNA, 25 bp, Homo sapien
agcattacggaattccctccaggaa

SEQ ID NO: 610074 - DNA, 25 bp, Homo sapien
gaattccctccaggaactacagctg

SEQ ID NO: 610075 - DNA, 25 bp, Homo sapien
aggaactacagctggacccggatcc

SEQ ID NO: 610076 - DNA, 25 bp, Homo sapien
ctggagacgctcacagtcttggata

SEQ ID NO: 610077 - DNA, 25 bp, Homo sapien
agtcttggatagctgtagtcagcat

SEQ ID NO: 610078 - DNA, 25 bp, Homo sapien
agtcagcatgggtttctggcttcac

SEQ ID NO: 610079 - DNA, 25 bp, Homo sapien
tggtctccacaacctcttacaaccc

SEQ ID NO: 610080 - DNA, 25 bp, Homo sapien
ttacaacccaggcattcctttctat

SEQ ID NO: 610081 - DNA, 25 bp, Homo sapien
caggcattcctttctatcgataatt

SEQ ID NO: 610082 - DNA, 25 bp, Homo sapien
gcattcctttctatcgataattact

SEQ ID NO: 610083 - DNA, 25 bp, Homo sapien
attgttatatctacctataatctag

SEQ ID NO: 610084 - DNA, 25 bp, Homo sapien
atatctacctataatctagaagccc

SEQ ID NO: 610085 - DNA, 25 bp, Homo sapien
tagaagcccccacatcaagttgttt

SEQ ID NO: 610086 - DNA, 25 bp, Homo sapien
gcccccacatcaagttgttttgcct

SEQ ID NO: 610087 - DNA, 25 bp, Homo sapien
tctggacaggaccaatgtatatctt

SEQ ID NO: 610088 - DNA, 25 bp, Homo sapien
gtgtcacaggccatgttcacttaca

SEQ ID NO: 610089 - DNA, 25 bp, Homo sapien
gtcacaggccatgttcacttacatt

SEQ ID NO: 610090 - DNA, 25 bp, Homo sapien
aattcatttgcagataggccaggtc

SEQ ID NO: 610091 - DNA, 25 bp, Homo sapien
tcatttgcagataggccaggtccat

SEQ ID NO: 610092 - DNA, 25 bp, Homo sapien
ttgcagataggccaggtccatgaag

SEQ ID NO: 610093 - DNA, 25 bp, Homo sapien
cagataggccaggtccatgaagaat

SEQ ID NO: 610094 - DNA, 25 bp, Homo sapien
taaataacatggctaatactacagt

SEQ ID NO: 610095 - DNA, 25 bp, Homo sapien
acatggctaatactacagttgaaag

SEQ ID NO: 610096 - DNA, 25 bp, Homo sapien
atactacagttgaaagtttgataca

SEQ ID NO: 610097 - DNA, 25 bp, Homo sapien
aaatttgctgagtcaaaaggcactg

SEQ ID NO: 610098 - DNA, 25 bp, Homo sapien
tgctgagtcaaaaggcactgggaag

SEQ ID NO: 610099 - DNA, 25 bp, Homo sapien
gaaggaaagacctggcctcattgaa

SEQ ID NO: 610100 - DNA, 25 bp, Homo sapien
ggaaagacctggcctcattgaattt

SEQ ID NO: 610101 - DNA, 25 bp, Homo sapien
ccaaaccctgtgtatagaaaaagat

SEQ ID NO: 610102 - DNA, 25 bp, Homo sapien
caaaccctgtgtatagaaaaagatt

SEQ ID NO: 610103 - DNA, 25 bp, Homo sapien
aaccctgtgtatagaaaaagattat

SEQ ID NO: 610104 - DNA, 25 bp, Homo sapien
accctgtgtatagaaaaagattata

SEQ ID NO: 610105 - DNA, 25 bp, Homo sapien
aaaagattataaagggctgggcacg

SEQ ID NO: 610106 - DNA, 25 bp, Homo sapien
aaagattataaagggctgggcacgg

SEQ ID NO: 610107 - DNA, 25 bp, Homo sapien
aagattataaagggctgggcacggt

SEQ ID NO: 610108 - DNA, 25 bp, Homo sapien
tcctggccaaccaacatagtaaaac

SEQ ID NO: 610109 - DNA, 25 bp, Homo sapien
ggcacacgcctatagctactcagga

SEQ ID NO: 610110 - DNA, 25 bp, Homo sapien
gcacacgcctatagctactcaggag

SEQ ID NO: 610111 - DNA, 25 bp, Homo sapien
cacacgcctatagctactcaggagg

SEQ ID NO: 610112 - DNA, 25 bp, Homo sapien
atttcagacttcgagcttctagaac

SEQ ID NO: 610113 - DNA, 25 bp, Homo sapien
ttcgagcttctagaactgtaagaca

SEQ ID NO: 610114 - DNA, 25 bp, Homo sapien
caggtccaggatacagcaagccact

SEQ ID NO: 610115 - DNA, 25 bp, Homo sapien
gcaagccactgttaggatgaagcta

SEQ ID NO: 610116 - DNA, 25 bp, Homo sapien
atgaagctacagatgggcagaccgc

SEQ ID NO: 610117 - DNA, 25 bp, Homo sapien
cagatgggcagaccgctcaagagct

SEQ ID NO: 610118 - DNA, 25 bp, Homo sapien
agaccgctcaagagctgggttccca

SEQ ID NO: 610119 - DNA, 25 bp, Homo sapien
agctgggttcccacaagacacttgt

SEQ ID NO: 610120 - DNA, 25 bp, Homo sapien
ggttcccacaagacacttgtttcta

SEQ ID NO: 610121 - DNA, 25 bp, Homo sapien
actgcttaactgtgtataatcttga

SEQ ID NO: 610122 - DNA, 25 bp, Homo sapien
attctcttctagagcctccaaagaa

SEQ ID NO: 610123 - DNA, 25 bp, Homo sapien
atattaaatgttgactctttgggag

SEQ ID NO: 610124 - DNA, 25 bp, Homo sapien
agttgttggcaagtttcaatggtga

SEQ ID NO: 610125 - DNA, 25 bp, Homo sapien
gtcaacttgaaatgtgttctgtaat

SEQ ID NO: 610126 - DNA, 25 bp, Homo sapien
gggacactacaaaaagctagctttc

SEQ ID NO: 610127 - DNA, 25 bp, Homo sapien
aaaagctagctttccaatgtgtgca

SEQ ID NO: 610128 - DNA, 25 bp, Homo sapien
agctttccaatgtgtgcatagtatt

SEQ ID NO: 610129 - DNA, 25 bp, Homo sapien
atacttattataagctgctccctgt

SEQ ID NO: 610130 - DNA, 25 bp, Homo sapien
ttataagctgctccctgtctatgta

SEQ ID NO: 610131 - DNA, 25 bp, Homo sapien
gctgctccctgtctatgtatttgga

SEQ ID NO: 610132 - DNA, 25 bp, Homo sapien
ttttcacaaagggaattgcctaaca

SEQ ID NO: 610133 - DNA, 25 bp, Homo sapien
gaattgcctaacatgtggactttta

SEQ ID NO: 610134 - DNA, 25 bp, Homo sapien
aattgtctttattactttgtacact

SEQ ID NO: 610135 - DNA, 25 bp, Homo sapien
attactttgtacactgctttcacca

SEQ ID NO: 610136 - DNA, 25 bp, Homo sapien
tttgtacactgctttcaccagtctg

SEQ ID NO: 610137 - DNA, 25 bp, Homo sapien
tacactgctttcaccagtctgctct

SEQ ID NO: 610138 - DNA, 25 bp, Homo sapien
agtctgctcttccatggctaacggg

SEQ ID NO: 610139 - DNA, 25 bp, Homo sapien
ggttttccacatccagtatgttcat

SEQ ID NO: 610140 - DNA, 25 bp, Homo sapien
ttccacatccagtatgttcataaga

SEQ ID NO: 610141 - DNA, 25 bp, Homo sapien
gttcataagatttctaccctgtgtg

SEQ ID NO: 610142 - DNA, 25 bp, Homo sapien
agatttctaccctgtgtgaacttcc

SEQ ID NO: 610143 - DNA, 25 bp, Homo sapien
tctaccctgtgtgaacttccagatg

SEQ ID NO: 610144 - DNA, 25 bp, Homo sapien
gtgtgaacttccagatgtcgaataa

SEQ ID NO: 610145 - DNA, 25 bp, Homo sapien
cgataatttcttatatatggatgaa

SEQ ID NO: 610146 - DNA, 25 bp, Homo sapien
aaattttatacattaaatctcctgc

SEQ ID NO: 610147 - DNA, 25 bp, Homo sapien
ttaaatctcctgcaatttgtcactc

SEQ ID NO: 610148 - DNA, 25 bp, Homo sapien
aaatctcctgcaatttgtcactctg

SEQ ID NO: 610149 - DNA, 25 bp, Homo sapien
aatctcctgcaatttgtcactctgg

SEQ ID NO: 610150 - DNA, 25 bp, Homo sapien
atctcctgcaatttgtcactctgga

SEQ ID NO: 610151 - DNA, 25 bp, Homo sapien
tctcctgcaatttgtcactctggat

SEQ ID NO: 610152 - DNA, 25 bp, Homo sapien
ctcctgcaatttgtcactctggatg

SEQ ID NO: 610153 - DNA, 25 bp, Homo sapien
tttggaactcctaaaccagtacttg

SEQ ID NO: 610154 - DNA, 25 bp, Homo sapien
ttggaactcctaaaccagtacttgt

SEQ ID NO: 610155 - DNA, 25 bp, Homo sapien
tggaactcctaaaccagtacttgtt

SEQ ID NO: 610156 - DNA, 25 bp, Homo sapien
cacttctaagtgaggctggattttc

SEQ ID NO: 610157 - DNA, 25 bp, Homo sapien
ctaagtgaggctggattttcagaat

SEQ ID NO: 610158 - DNA, 25 bp, Homo sapien
gcaactttcatatgatgtccggtct

SEQ ID NO: 610159 - DNA, 25 bp, Homo sapien
atatgatgtccggtctggcaacaca

SEQ ID NO: 610160 - DNA, 25 bp, Homo sapien
gtccggtctggcaacacatgtggca

SEQ ID NO: 610161 - DNA, 25 bp, Homo sapien
acatgtggcaaaaatgaaggctaca

SEQ ID NO: 610162 - DNA, 25 bp, Homo sapien
atttttccctagatagaagagcaca

SEQ ID NO: 610163 - DNA, 25 bp, Homo sapien
gaagagcacatccaatgtttccaac

SEQ ID NO: 610164 - DNA, 25 bp, Homo sapien
gagcacatccaatgtttccaacatg

SEQ ID NO: 610165 - DNA, 25 bp, Homo sapien
tgtttccaacatgatagttcagaag

SEQ ID NO: 610166 - DNA, 25 bp, Homo sapien
agttcagaagattcaacaactgtga

SEQ ID NO: 610167 - DNA, 25 bp, Homo sapien
aagggcggatgtgcaatcttcacct

SEQ ID NO: 610168 - DNA, 25 bp, Homo sapien
tgtgcaatcttcacctgtttattcg

SEQ ID NO: 610169 - DNA, 25 bp, Homo sapien
aatcttcacctgtttattcggtaga

SEQ ID NO: 610170 - DNA, 25 bp, Homo sapien
attcggtagagggtgccatcttcag

SEQ ID NO: 610171 - DNA, 25 bp, Homo sapien
catcttcaggtagcccttcacgttg

SEQ ID NO: 610172 - DNA, 25 bp, Homo sapien
gtagcccttcacgttgtacagaaaa

SEQ ID NO: 610173 - DNA, 25 bp, Homo sapien
gaaaacaatggagacttctcctcct

SEQ ID NO: 610174 - DNA, 25 bp, Homo sapien
gggcagtggtgtcacccttcctaag

SEQ ID NO: 610175 - DNA, 25 bp, Homo sapien
gtcacccttcctaagctacagagat

SEQ ID NO: 610176 - DNA, 25 bp, Homo sapien
gctacagagatgttgcttcaactta

SEQ ID NO: 610177 - DNA, 25 bp, Homo sapien
gttgcttcaacttacagctcagata

SEQ ID NO: 610178 - DNA, 25 bp, Homo sapien
ggaaatgcatgtttgatctgttgtc

SEQ ID NO: 610179 - DNA, 25 bp, Homo sapien
aaatgcatgtttgatctgttgtcac

SEQ ID NO: 610180 - DNA, 25 bp, Homo sapien
atgcatgtttgatctgttgtcacgt

SEQ ID NO: 610181 - DNA, 25 bp, Homo sapien
gcatgtttgatctgttgtcacgtgc

SEQ ID NO: 610182 - DNA, 25 bp, Homo sapien
agctattcacatcaaggggactcaa

SEQ ID NO: 610183 - DNA, 25 bp, Homo sapien
gggactcaatatatcaacaattggt

SEQ ID NO: 610184 - DNA, 25 bp, Homo sapien
aatatgttggtgataattccgtgac

SEQ ID NO: 610185 - DNA, 25 bp, Homo sapien
tatgttggtgataattccgtgacag

SEQ ID NO: 610186 - DNA, 25 bp, Homo sapien
gttggtgataattccgtgacagttg

SEQ ID NO: 610187 - DNA, 25 bp, Homo sapien
ggtgataattccgtgacagttggaa

SEQ ID NO: 610188 - DNA, 25 bp, Homo sapien
tgataattccgtgacagttggaaga

SEQ ID NO: 610189 - DNA, 25 bp, Homo sapien
accatcagggttgctgacaggagca

SEQ ID NO: 610190 - DNA, 25 bp, Homo sapien
acaggagcagtgttcaggagtctca

SEQ ID NO: 610191 - DNA, 25 bp, Homo sapien
ggagcagtgttcaggagtctcagac

SEQ ID NO: 610192 - DNA, 25 bp, Homo sapien
agtctcagacagtggattgtgctgc

SEQ ID NO: 610193 - DNA, 25 bp, Homo sapien
cctggtggctggagggtttgcaggc

SEQ ID NO: 610194 - DNA, 25 bp, Homo sapien
ccacaggacccacagaggcaaattg

SEQ ID NO: 610195 - DNA, 25 bp, Homo sapien
gaggcaaattgttcagttgactgta

SEQ ID NO: 610196 - DNA, 25 bp, Homo sapien
gttcagttgactgtacagtgtgaga

SEQ ID NO: 610197 - DNA, 25 bp, Homo sapien
ccttctctacctcatatgagaaatg

SEQ ID NO: 610198 - DNA, 25 bp, Homo sapien
taaatttgggaatctgggttatagt

SEQ ID NO: 610199 - DNA, 25 bp, Homo sapien
tctgggttatagtatgtgtgagtca

SEQ ID NO: 610200 - DNA, 25 bp, Homo sapien
taaaaggtgaccagctgctcaccat

SEQ ID NO: 610201 - DNA, 25 bp, Homo sapien
tgctcaccatcaggctgcaagtgtc

SEQ ID NO: 610202 - DNA, 25 bp, Homo sapien
gcaagtgtctacagtggaaccagat

SEQ ID NO: 610203 - DNA, 25 bp, Homo sapien
cctctttgaggaccagcactagaag

SEQ ID NO: 610204 - DNA, 25 bp, Homo sapien
gcactagaagcctcttggaacactt

SEQ ID NO: 610205 - DNA, 25 bp, Homo sapien
ggaacacttctgttacgggaggcag

SEQ ID NO: 610206 - DNA, 25 bp, Homo sapien
tactattgcccggtgccacaaaaag

SEQ ID NO: 610207 - DNA, 25 bp, Homo sapien
aaaaagtgcttccttcagtggcgct

SEQ ID NO: 610208 - DNA, 25 bp, Homo sapien
atgggaacccacgagggaactgaat

SEQ ID NO: 610209 - DNA, 25 bp, Homo sapien
ggaactgaatgcacacagccgccga

SEQ ID NO: 610210 - DNA, 25 bp, Homo sapien
aggcagctcgatgccaaagacacca

SEQ ID NO: 610211 - DNA, 25 bp, Homo sapien
tttttaaaaaatccaccagacacag

SEQ ID NO: 610212 - DNA, 25 bp, Homo sapien
ttttaaaaaatccaccagacacagt

SEQ ID NO: 610213 - DNA, 25 bp, Homo sapien
tttaaaaaatccaccagacacagtg

SEQ ID NO: 610214 - DNA, 25 bp, Homo sapien
aaaaaatccaccagacacagtggct

SEQ ID NO: 610215 - DNA, 25 bp, Homo sapien
aaaatccaccagacacagtggctcc

SEQ ID NO: 610216 - DNA, 25 bp, Homo sapien
aaatccaccagacacagtggctcct

SEQ ID NO: 610217 - DNA, 25 bp, Homo sapien
aatccaccagacacagtggctcctg

SEQ ID NO: 610218 - DNA, 25 bp, Homo sapien
ggcgacatagcgagagaccctgtct

SEQ ID NO: 610219 - DNA, 25 bp, Homo sapien
ctgggcgtggtagtggcatgcacct

SEQ ID NO: 610220 - DNA, 25 bp, Homo sapien
atgcacctgtagtcttggatacttg

SEQ ID NO: 610221 - DNA, 25 bp, Homo sapien
tgcacctgtagtcttggatacttgg

SEQ ID NO: 610222 - DNA, 25 bp, Homo sapien
gcttgagacatgttgcagaccccgc

SEQ ID NO: 610223 - DNA, 25 bp, Homo sapien
agacatgttgcagaccccgcacttg

SEQ ID NO: 610224 - DNA, 25 bp, Homo sapien
accccgcacttgctggatcagctga

SEQ ID NO: 610225 - DNA, 25 bp, Homo sapien
ttgctggatcagctgacgccacaca

SEQ ID NO: 610226 - DNA, 25 bp, Homo sapien
atcagctgacgccacacagatggat

SEQ ID NO: 610227 - DNA, 25 bp, Homo sapien
ctgacgccacacagatggataaact

SEQ ID NO: 610228 - DNA, 25 bp, Homo sapien
tggataaactgcctcgtctgatctt

SEQ ID NO: 610229 - DNA, 25 bp, Homo sapien
cacccgggaactgacgaagcgcaag

SEQ ID NO: 610230 - DNA, 25 bp, Homo sapien
gcttaaaaattctgctccccgaatt

SEQ ID NO: 610231 - DNA, 25 bp, Homo sapien
tctgctccccgaattctcgaggaga

SEQ ID NO: 610232 - DNA, 25 bp, Homo sapien
ccccgaattctcgaggagactgatt

SEQ ID NO: 610233 - DNA, 25 bp, Homo sapien
tttcaccctcatggggctacagaga

SEQ ID NO: 610234 - DNA, 25 bp, Homo sapien
gggctacagagatagttcctcttgg

SEQ ID NO: 610235 - DNA, 25 bp, Homo sapien
ggctacagagatagttcctcttggg

SEQ ID NO: 610236 - DNA, 25 bp, Homo sapien
gctacagagatagttcctcttgggt

SEQ ID NO: 610237 - DNA, 25 bp, Homo sapien
ctacagagatagttcctcttgggtg

SEQ ID NO: 610238 - DNA, 25 bp, Homo sapien
tacagagatagttcctcttgggtgg

SEQ ID NO: 610239 - DNA, 25 bp, Homo sapien
acagagatagttcctcttgggtggg

SEQ ID NO: 610240 - DNA, 25 bp, Homo sapien
gagatagttcctcttgggtggggaa

SEQ ID NO: 610241 - DNA, 25 bp, Homo sapien
gaacaggttgccaggagaaagcagt

SEQ ID NO: 610242 - DNA, 25 bp, Homo sapien
aacaggttgccaggagaaagcagtg

SEQ ID NO: 610243 - DNA, 25 bp, Homo sapien
acaggttgccaggagaaagcagtgg

SEQ ID NO: 610244 - DNA, 25 bp, Homo sapien
gccttggtcaacagggtgagatttt

SEQ ID NO: 610245 - DNA, 25 bp, Homo sapien
ccttggtcaacagggtgagattttg

SEQ ID NO: 610246 - DNA, 25 bp, Homo sapien
aaaagtaattataggtcatcatgga

SEQ ID NO: 610247 - DNA, 25 bp, Homo sapien
aaagtaattataggtcatcatggaa

SEQ ID NO: 610248 - DNA, 25 bp, Homo sapien
aagtaattataggtcatcatggaat

SEQ ID NO: 610249 - DNA, 25 bp, Homo sapien
gtaattataggtcatcatggaatat

SEQ ID NO: 610250 - DNA, 25 bp, Homo sapien
aattataggtcatcatggaatattt

SEQ ID NO: 610251 - DNA, 25 bp, Homo sapien
aaaatatataatcacctgtaatccc

SEQ ID NO: 610252 - DNA, 25 bp, Homo sapien
ataatcacctttagtattgtgatgt

SEQ ID NO: 610253 - DNA, 25 bp, Homo sapien
aatcacctttagtattgtgatgtat

SEQ ID NO: 610254 - DNA, 25 bp, Homo sapien
atcacctttagtattgtgatgtatt

SEQ ID NO: 610255 - DNA, 25 bp, Homo sapien
agtccctgcatttcctcacctataa

SEQ ID NO: 610256 - DNA, 25 bp, Homo sapien
gggaacactccttatggagctggtt

SEQ ID NO: 610257 - DNA, 25 bp, Homo sapien
gaacactccttatggagctggttca

SEQ ID NO: 610258 - DNA, 25 bp, Homo sapien
tggagctggttcaagtattgagcga

SEQ ID NO: 610259 - DNA, 25 bp, Homo sapien
gtattgagcgagagaccgggactac

SEQ ID NO: 610260 - DNA, 25 bp, Homo sapien
attgagcgagagaccgggactacaa

SEQ ID NO: 610261 - DNA, 25 bp, Homo sapien
gcgagagaccgggactacaagtgtt

SEQ ID NO: 610262 - DNA, 25 bp, Homo sapien
gagaccgggactacaagtgttttct

SEQ ID NO: 610263 - DNA, 25 bp, Homo sapien
gggactacaagtgttttctaacaca

SEQ ID NO: 610264 - DNA, 25 bp, Homo sapien
actacaagtgttttctaacacaggg

SEQ ID NO: 610265 - DNA, 25 bp, Homo sapien
aacacaggggcatgaattcagccgt

SEQ ID NO: 610266 - DNA, 25 bp, Homo sapien
gaggagtctggtgcgtcggccagca

SEQ ID NO: 610267 - DNA, 25 bp, Homo sapien
agcacgtcgccgtcggaaaagacca

SEQ ID NO: 610268 - DNA, 25 bp, Homo sapien
tcgccgtcggaaaagaccacgccgt

SEQ ID NO: 610269 - DNA, 25 bp, Homo sapien
cgacgcctggaagtacagcacggat

SEQ ID NO: 610270 - DNA, 25 bp, Homo sapien
gcacggatgtgaagctgagcctcaa

SEQ ID NO: 610271 - DNA, 25 bp, Homo sapien
atgtgaagctgagcctcaacatcct

SEQ ID NO: 610272 - DNA, 25 bp, Homo sapien
aagctgagcctcaacatcctgcgcg

SEQ ID NO: 610273 - DNA, 25 bp, Homo sapien
gggagcgcaagttcatcttcgccgg

SEQ ID NO: 610274 - DNA, 25 bp, Homo sapien
accggcaccagttccacgaggagat

SEQ ID NO: 610275 - DNA, 25 bp, Homo sapien
acgaggagatgatcggctactacct

SEQ ID NO: 610276 - DNA, 25 bp, Homo sapien
gctactacctgacgagcgcgcagga

SEQ ID NO: 610277 - DNA, 25 bp, Homo sapien
atccgtggaaccagaaaccacctgt

SEQ ID NO: 610278 - DNA, 25 bp, Homo sapien
acctgtaccccaaagacactgaaat

SEQ ID NO: 610279 - DNA, 25 bp, Homo sapien
aacagttgcggcgaacccatggaaa

SEQ ID NO: 610280 - DNA, 25 bp, Homo sapien
tgcggcgaacccatggaaaaacaga

SEQ ID NO: 610281 - DNA, 25 bp, Homo sapien
aaaacagaggaaactggccaggagg

SEQ ID NO: 610282 - DNA, 25 bp, Homo sapien
gcctgtgtgtgggaataaattccat

SEQ ID NO: 610283 - DNA, 25 bp, Homo sapien
tttaaggtagggatgtctaacaggc

SEQ ID NO: 610284 - DNA, 25 bp, Homo sapien
tttgagagtctcttccttgcagata

SEQ ID NO: 610285 - DNA, 25 bp, Homo sapien
gtctcttccttgcagataatggcag

SEQ ID NO: 610286 - DNA, 25 bp, Homo sapien
atggcagaagccgtggagtagatca

SEQ ID NO: 610287 - DNA, 25 bp, Homo sapien
gagtagatcagcacacccaaggaga

SEQ ID NO: 610288 - DNA, 25 bp, Homo sapien
taatttctcattttgtacggagaaa

SEQ ID NO: 610289 - DNA, 25 bp, Homo sapien
tctcattttgtacggagaaatattc

SEQ ID NO: 610290 - DNA, 25 bp, Homo sapien
atattcttttcaaaagcgtcttttg

SEQ ID NO: 610291 - DNA, 25 bp, Homo sapien
aagcgtcttttgactgaagtaactt

SEQ ID NO: 610292 - DNA, 25 bp, Homo sapien
gactgaagtaactttcctggtgctg

SEQ ID NO: 610293 - DNA, 25 bp, Homo sapien
ctgaagtaactttcctggtgctgtt

SEQ ID NO: 610294 - DNA, 25 bp, Homo sapien
ttcctggtgctgttgttaactcgtt

SEQ ID NO: 610295 - DNA, 25 bp, Homo sapien
tcctggtgctgttgttaactcgttc

SEQ ID NO: 610296 - DNA, 25 bp, Homo sapien
ctggtgctgttgttaactcgttcct

SEQ ID NO: 610297 - DNA, 25 bp, Homo sapien
ggtgctgttgttaactcgttccttt

SEQ ID NO: 610298 - DNA, 25 bp, Homo sapien
tgctgttgttaactcgttccttttt

SEQ ID NO: 610299 - DNA, 25 bp, Homo sapien
ggaagacagcctcctatggtggcat

SEQ ID NO: 610300 - DNA, 25 bp, Homo sapien
gaataagatgcttccagaactagta

SEQ ID NO: 610301 - DNA, 25 bp, Homo sapien
gggaaataactaacctcttcaggct

SEQ ID NO: 610302 - DNA, 25 bp, Homo sapien
aacctcttcaggctttatcaggcct

SEQ ID NO: 610303 - DNA, 25 bp, Homo sapien
gggaaccttgctcatgttagcaaga

SEQ ID NO: 610304 - DNA, 25 bp, Homo sapien
gaaaggtatcctagagaagccactc

SEQ ID NO: 610305 - DNA, 25 bp, Homo sapien
aaaaggctccctaatccagcctgtc

SEQ ID NO: 610306 - DNA, 25 bp, Homo sapien
agcctgtctccacatacatactgaa

SEQ ID NO: 610307 - DNA, 25 bp, Homo sapien
aaaattcttccctactctgaggcag

SEQ ID NO: 610308 - DNA, 25 bp, Homo sapien
gggtttctccagactggaatcctac

SEQ ID NO: 610309 - DNA, 25 bp, Homo sapien
gaatcctacctatctgtaccgacaa

SEQ ID NO: 610310 - DNA, 25 bp, Homo sapien
tagattgaggaagttccctttcctt

SEQ ID NO: 610311 - DNA, 25 bp, Homo sapien
tccctttcctttcaagtcagtcttt

SEQ ID NO: 610312 - DNA, 25 bp, Homo sapien
aaacatgtattgaagttttgtcaaa

SEQ ID NO: 610313 - DNA, 25 bp, Homo sapien
gtcaaatgtcttcatctattggaat

SEQ ID NO: 610314 - DNA, 25 bp, Homo sapien
tacatttcaatcttctgtctaccta

SEQ ID NO: 610315 - DNA, 25 bp, Homo sapien
cttctgtctacctaaaatccctaga

SEQ ID NO: 610316 - DNA, 25 bp, Homo sapien
aatccctagaataatctccatttgg

SEQ ID NO: 610317 - DNA, 25 bp, Homo sapien
gaataatctccatttggctatgatg

SEQ ID NO: 610318 - DNA, 25 bp, Homo sapien
tccatttggctatgatgtgttgtgc

SEQ ID NO: 610319 - DNA, 25 bp, Homo sapien
gttgtgcttttatatattactgaat

SEQ ID NO: 610320 - DNA, 25 bp, Homo sapien
ctgaattctatatgccaatattatt

SEQ ID NO: 610321 - DNA, 25 bp, Homo sapien
ggctgctcctgcttgccaatactga

SEQ ID NO: 610322 - DNA, 25 bp, Homo sapien
tcgatgccttcggagcctctgagct

SEQ ID NO: 610323 - DNA, 25 bp, Homo sapien
tctgagctctgcttgttctctggga

SEQ ID NO: 610324 - DNA, 25 bp, Homo sapien
tgggaccttccgttggccttgtgga

SEQ ID NO: 610325 - DNA, 25 bp, Homo sapien
ggccttgtggacttcctgccttgtt

SEQ ID NO: 610326 - DNA, 25 bp, Homo sapien
cttgttctttgattcagccctttca

SEQ ID NO: 610327 - DNA, 25 bp, Homo sapien
gattcagccctttcaaacatgctta

SEQ ID NO: 610328 - DNA, 25 bp, Homo sapien
aaacatgcttacctcgagtgaccca

SEQ ID NO: 610329 - DNA, 25 bp, Homo sapien
ctcgagtgacccagtgacatcagtg

SEQ ID NO: 610330 - DNA, 25 bp, Homo sapien
tgacatcagtggcttctcaagggaa

SEQ ID NO: 610331 - DNA, 25 bp, Homo sapien
ggaagagccttgctgtgcccctgta

SEQ ID NO: 610332 - DNA, 25 bp, Homo sapien
tatagaccttattcaagtcttgcta

SEQ ID NO: 610333 - DNA, 25 bp, Homo sapien
ttcaagtcttgctaattgtcaaaat

SEQ ID NO: 610334 - DNA, 25 bp, Homo sapien
attgttctttatatagttagccttt

SEQ ID NO: 610335 - DNA, 25 bp, Homo sapien
taattctgactcttcctgggttcag

SEQ ID NO: 610336 - DNA, 25 bp, Homo sapien
aaggcaagaggtgttgtacctgttg

SEQ ID NO: 610337 - DNA, 25 bp, Homo sapien
tgtacctgttggtgaggtggccttt

SEQ ID NO: 610338 - DNA, 25 bp, Homo sapien
tgttggtgaggtggcctttcttata

SEQ ID NO: 610339 - DNA, 25 bp, Homo sapien
ggcctttcttatacttagattctta

SEQ ID NO: 610340 - DNA, 25 bp, Homo sapien
tagattcttatacttggatgttgag

SEQ ID NO: 610341 - DNA, 25 bp, Homo sapien
gagtattaggtcaacatcactaatg

SEQ ID NO: 610342 - DNA, 25 bp, Homo sapien
aatgcaataccaccttacactcctg

SEQ ID NO: 610343 - DNA, 25 bp, Homo sapien
tttagaattagtaagctatccaact

SEQ ID NO: 610344 - DNA, 25 bp, Homo sapien
gtaagctatccaactaaggtcaagt

SEQ ID NO: 610345 - DNA, 25 bp, Homo sapien
tatccaactaaggtcaagttcaaga

SEQ ID NO: 610346 - DNA, 25 bp, Homo sapien
gttcaagaatattttaagagttact

SEQ ID NO: 610347 - DNA, 25 bp, Homo sapien
agatagctaggcatggtaacttgtg

SEQ ID NO: 610348 - DNA, 25 bp, Homo sapien
catggtaacttgtgcctgtaattcc

SEQ ID NO: 610349 - DNA, 25 bp, Homo sapien
tccagctgctctggaagccaaggtg

SEQ ID NO: 610350 - DNA, 25 bp, Homo sapien
ggattgtcttaagcccgggacttca

SEQ ID NO: 610351 - DNA, 25 bp, Homo sapien
ttaagcccgggacttcaatgctgca

SEQ ID NO: 610352 - DNA, 25 bp, Homo sapien
aagcccgggacttcaatgctgcagt

SEQ ID NO: 610353 - DNA, 25 bp, Homo sapien
ctgtgaaataaaggagaccccatct

SEQ ID NO: 610354 - DNA, 25 bp, Homo sapien
gagctctgggtgtttaaacgtctgg

SEQ ID NO: 610355 - DNA, 25 bp, Homo sapien
gctctgggtgtttaaacgtctggga

SEQ ID NO: 610356 - DNA, 25 bp, Homo sapien
cccactcttgccatgtgatgctttg

SEQ ID NO: 610357 - DNA, 25 bp, Homo sapien
actcttgccatgtgatgctttggcc

SEQ ID NO: 610358 - DNA, 25 bp, Homo sapien
tcttgccatgtgatgctttggcccc

SEQ ID NO: 610359 - DNA, 25 bp, Homo sapien
ccaccaccacaattggaagcttcct

SEQ ID NO: 610360 - DNA, 25 bp, Homo sapien
agaagcagacgccagcaccatactt

SEQ ID NO: 610361 - DNA, 25 bp, Homo sapien
tttacagcaatgcaataacaggcta

SEQ ID NO: 610362 - DNA, 25 bp, Homo sapien
taacaggctaatgcatggatcatca

SEQ ID NO: 610363 - DNA, 25 bp, Homo sapien
aggctaatgcatggatcatcaagaa

SEQ ID NO: 610364 - DNA, 25 bp, Homo sapien
gatcatcaagaagatggatttccac

SEQ ID NO: 610365 - DNA, 25 bp, Homo sapien
ggatgctcgccagggaaactggaaa

SEQ ID NO: 610366 - DNA, 25 bp, Homo sapien
cagggcaaagactgcagagctgcat

SEQ ID NO: 610367 - DNA, 25 bp, Homo sapien
tgcagagctgcatccatatcagtgc

SEQ ID NO: 610368 - DNA, 25 bp, Homo sapien
atatcagtgctgtgtcagcgttccc

SEQ ID NO: 610369 - DNA, 25 bp, Homo sapien
gcgttcccagaagacacttactttt

SEQ ID NO: 610370 - DNA, 25 bp, Homo sapien
atacagtgttgtcttagtctattta

SEQ ID NO: 610371 - DNA, 25 bp, Homo sapien
atgtgtactacatgtgactagggaa

SEQ ID NO: 610372 - DNA, 25 bp, Homo sapien
atgatctgtatgtaaatgctcagta

SEQ ID NO: 610373 - DNA, 25 bp, Homo sapien
atacgagttctatttggagttggga

SEQ ID NO: 610374 - DNA, 25 bp, Homo sapien
gaaaattcctagcaatggctccctc

SEQ ID NO: 610375 - DNA, 25 bp, Homo sapien
ctagcaatggctccctccaatggga

SEQ ID NO: 610376 - DNA, 25 bp, Homo sapien
attattttagttttaggatgacatg

SEQ ID NO: 610377 - DNA, 25 bp, Homo sapien
attttagttttaggatgacatgata

SEQ ID NO: 610378 - DNA, 25 bp, Homo sapien
taggatgacatgataaaacggattt

SEQ ID NO: 610379 - DNA, 25 bp, Homo sapien
gatgacatgataaaacggatttggg

SEQ ID NO: 610380 - DNA, 25 bp, Homo sapien
agcattttgggaggaagtggcggaa

SEQ ID NO: 610381 - DNA, 25 bp, Homo sapien
aagtggcggaaggatcactagagcc

SEQ ID NO: 610382 - DNA, 25 bp, Homo sapien
tgttagctctgtttggtggcatgca

SEQ ID NO: 610383 - DNA, 25 bp, Homo sapien
agctggggaggtctgcagtctagcc

SEQ ID NO: 610384 - DNA, 25 bp, Homo sapien
cagtctagcctgagctatggagcaa

SEQ ID NO: 610385 - DNA, 25 bp, Homo sapien
agtctagcctgagctatggagcaag

SEQ ID NO: 610386 - DNA, 25 bp, Homo sapien
tagcctgagctatggagcaagacct

SEQ ID NO: 610387 - DNA, 25 bp, Homo sapien
accaatctactctgcatccataaaa

SEQ ID NO: 610388 - DNA, 25 bp, Homo sapien
gttttatttgagttcatcttcagct

SEQ ID NO: 610389 - DNA, 25 bp, Homo sapien
gagttcatcttcagctttaaacaat

SEQ ID NO: 610390 - DNA, 25 bp, Homo sapien
gaaaacctgtctcagatttctggat

SEQ ID NO: 610391 - DNA, 25 bp, Homo sapien
gatttctggatgcagtcatgcccat

SEQ ID NO: 610392 - DNA, 25 bp, Homo sapien
agtcatgcccattcgttacaggata

SEQ ID NO: 610393 - DNA, 25 bp, Homo sapien
atgcccattcgttacaggatattgt

SEQ ID NO: 610394 - DNA, 25 bp, Homo sapien
gtaagtcttccttttatagtgttga

SEQ ID NO: 610395 - DNA, 25 bp, Homo sapien
gagatgaatagtgaccgttaccaat

SEQ ID NO: 610396 - DNA, 25 bp, Homo sapien
gtgaccgttaccaatgaggcattgc

SEQ ID NO: 610397 - DNA, 25 bp, Homo sapien
gaggcattgctcattgataagtgaa

SEQ ID NO: 610398 - DNA, 25 bp, Homo sapien
tccaggaccccattcacgaagctag

SEQ ID NO: 610399 - DNA, 25 bp, Homo sapien
caggaccccattcacgaagctaggg

SEQ ID NO: 610400 - DNA, 25 bp, Homo sapien
aggaccccattcacgaagctagggt

SEQ ID NO: 610401 - DNA, 25 bp, Homo sapien
gaccccattcacgaagctagggtgc

SEQ ID NO: 610402 - DNA, 25 bp, Homo sapien
ccattcacgaagctagggtgcccct

SEQ ID NO: 610403 - DNA, 25 bp, Homo sapien
attcacgaagctagggtgcccctct

SEQ ID NO: 610404 - DNA, 25 bp, Homo sapien
acgaagctagggtgcccctctccag

SEQ ID NO: 610405 - DNA, 25 bp, Homo sapien
acacagggagctagggtgcccctct

SEQ ID NO: 610406 - DNA, 25 bp, Homo sapien
agggagctagggtgcccctctccag

SEQ ID NO: 610407 - DNA, 25 bp, Homo sapien
aggaccccacacagggagctagggt

SEQ ID NO: 610408 - DNA, 25 bp, Homo sapien
acacagggagctagggtgccccctc

SEQ ID NO: 610409 - DNA, 25 bp, Homo sapien
aagagtaggggcttgggccaggcac

SEQ ID NO: 610410 - DNA, 25 bp, Homo sapien
agagtaggggcttgggccaggcacg

SEQ ID NO: 610411 - DNA, 25 bp, Homo sapien
gagtaggggcttgggccaggcacgg

SEQ ID NO: 610412 - DNA, 25 bp, Homo sapien
agtaggggcttgggccaggcacggt

SEQ ID NO: 610413 - DNA, 25 bp, Homo sapien
gtaggggcttgggccaggcacggtg

SEQ ID NO: 610414 - DNA, 25 bp, Homo sapien
taggggcttgggccaggcacggtgg

SEQ ID NO: 610415 - DNA, 25 bp, Homo sapien
aaaaatgcagaaattggctgggcgt

SEQ ID NO: 610416 - DNA, 25 bp, Homo sapien
gagccccgggggctgaggttgctgt

SEQ ID NO: 610417 - DNA, 25 bp, Homo sapien
agccccgggggctgaggttgctgtg

SEQ ID NO: 610418 - DNA, 25 bp, Homo sapien
gccccgggggctgaggttgctgtgg

SEQ ID NO: 610419 - DNA, 25 bp, Homo sapien
gggctgaggttgctgtgggccgaga

SEQ ID NO: 610420 - DNA, 25 bp, Homo sapien
tttctatgccgtttgctgcaaggat

SEQ ID NO: 610421 - DNA, 25 bp, Homo sapien
atgcgttgggcatggagtaacattc

SEQ ID NO: 610422 - DNA, 25 bp, Homo sapien
ttgggcatggagtaacattcccgag

SEQ ID NO: 610423 - DNA, 25 bp, Homo sapien
gagaccgtcctgcagtactgcacgt

SEQ ID NO: 610424 - DNA, 25 bp, Homo sapien
cgtgtctgtgctttggtttgtctgt

SEQ ID NO: 610425 - DNA, 25 bp, Homo sapien
ctgtgctttggtttgtctgtgtgtc

SEQ ID NO: 610426 - DNA, 25 bp, Homo sapien
tgtctgtgtgtctaccttgttttag

SEQ ID NO: 610427 - DNA, 25 bp, Homo sapien
gtgtgtctaccttgttttagagtaa

SEQ ID NO: 610428 - DNA, 25 bp, Homo sapien
gtaaaaaagtgaatctgaggccaga

SEQ ID NO: 610429 - DNA, 25 bp, Homo sapien
aggccagatcatcagtctgcacctg

SEQ ID NO: 610430 - DNA, 25 bp, Homo sapien
agatcatcagtctgcacctgcctct

SEQ ID NO: 610431 - DNA, 25 bp, Homo sapien
tctgcaggacaagcctgaggtggat

SEQ ID NO: 610432 - DNA, 25 bp, Homo sapien
tgaagggcagcttcctgaggaaagc

SEQ ID NO: 610433 - DNA, 25 bp, Homo sapien
gcggcctgcccttcggcattctggg

SEQ ID NO: 610434 - DNA, 25 bp, Homo sapien
gggccctaatttacaggatgcacct

SEQ ID NO: 610435 - DNA, 25 bp, Homo sapien
gatgcacctgaatttggaagtctta

SEQ ID NO: 610436 - DNA, 25 bp, Homo sapien
ttggaagtcttatattgtcatgttt

SEQ ID NO: 610437 - DNA, 25 bp, Homo sapien
tattgtcatgtttatctggtttgca

SEQ ID NO: 610438 - DNA, 25 bp, Homo sapien
atgtttatctggtttgcatgtccct

SEQ ID NO: 610439 - DNA, 25 bp, Homo sapien
ttatctggtttgcatgtccctgtcc

SEQ ID NO: 610440 - DNA, 25 bp, Homo sapien
atgtccctgtcctctctaaacagta

SEQ ID NO: 610441 - DNA, 25 bp, Homo sapien
tgtcctctctaaacagtagtgccaa

SEQ ID NO: 610442 - DNA, 25 bp, Homo sapien
aatagctgcatggtttattctaatt

SEQ ID NO: 610443 - DNA, 25 bp, Homo sapien
tcacatttcttattcctattatctg

SEQ ID NO: 610444 - DNA, 25 bp, Homo sapien
ttatctgaagaatccctcgtctgtg

SEQ ID NO: 610445 - DNA, 25 bp, Homo sapien
ctcgtctgtgcgtttcttgtgggaa

SEQ ID NO: 610446 - DNA, 25 bp, Homo sapien
tatcattttagtgctctgaggagtc

SEQ ID NO: 610447 - DNA, 25 bp, Homo sapien
ggagtcatatgaagatgtatccctc

SEQ ID NO: 610448 - DNA, 25 bp, Homo sapien
atgtatccctcatctgtgtttctga

SEQ ID NO: 610449 - DNA, 25 bp, Homo sapien
tcatctgtgtttctgaggacattaa

SEQ ID NO: 610450 - DNA, 25 bp, Homo sapien
tcaatttagtactagcaacagcttt

SEQ ID NO: 610451 - DNA, 25 bp, Homo sapien
tcatactccagaaagctgtagacac

SEQ ID NO: 610452 - DNA, 25 bp, Homo sapien
gaaagctgtagacactgctcatttt

SEQ ID NO: 610453 - DNA, 25 bp, Homo sapien
gctccggccttggtcaacagggtga

SEQ ID NO: 610454 - DNA, 25 bp, Homo sapien
cggccttggtcaacagggtgagatt

SEQ ID NO: 610455 - DNA, 25 bp, Homo sapien
aaagtaattataggtcatcatggaa

SEQ ID NO: 610456 - DNA, 25 bp, Homo sapien
aatcccaccatccaaagataatcac

SEQ ID NO: 610457 - DNA, 25 bp, Homo sapien
aaagataatcacctttagtattgtg

SEQ ID NO: 610458 - DNA, 25 bp, Homo sapien
tagtattgtgatgtattccctccat

SEQ ID NO: 610459 - DNA, 25 bp, Homo sapien
tccctccatctgtattccacaaaaa

SEQ ID NO: 610460 - DNA, 25 bp, Homo sapien
ttagatttgaattgtgtatagtttc

SEQ ID NO: 610461 - DNA, 25 bp, Homo sapien
ttgtgtatagtttcacatctccctt

SEQ ID NO: 610462 - DNA, 25 bp, Homo sapien
aattgtgctttatgagaaggaggga

SEQ ID NO: 610463 - DNA, 25 bp, Homo sapien
atgagaaggagggattgtttttaat

SEQ ID NO: 610464 - DNA, 25 bp, Homo sapien
aactgtctctttgttgtactcaagg

SEQ ID NO: 610465 - DNA, 25 bp, Homo sapien
gtctctttgttgtactcaagggttt

SEQ ID NO: 610466 - DNA, 25 bp, Homo sapien
tacaattcagggtaatccaccataa

SEQ ID NO: 610467 - DNA, 25 bp, Homo sapien
cagggtaatccaccataataagtga

SEQ ID NO: 610468 - DNA, 25 bp, Homo sapien
aataagtgatatggcttgggtttgt

SEQ ID NO: 610469 - DNA, 25 bp, Homo sapien
gggtggagcctagctggaagtgaca

SEQ ID NO: 610470 - DNA, 25 bp, Homo sapien
ccctctggcgctgttcttgtaatag

SEQ ID NO: 610471 - DNA, 25 bp, Homo sapien
ctctggcgctgttcttgtaatagtg

SEQ ID NO: 610472 - DNA, 25 bp, Homo sapien
ggcgctgttcttgtaatagtgagtt

SEQ ID NO: 610473 - DNA, 25 bp, Homo sapien
atagtgagttactgcaagatctgct

SEQ ID NO: 610474 - DNA, 25 bp, Homo sapien
agttactgcaagatctgcttgttta

SEQ ID NO: 610475 - DNA, 25 bp, Homo sapien
tgcctccatttaccttgtgatatct

SEQ ID NO: 610476 - DNA, 25 bp, Homo sapien
atttaccttgtgatatcttattacc

SEQ ID NO: 610477 - DNA, 25 bp, Homo sapien
taccttgtgatatcttattaccttg

SEQ ID NO: 610478 - DNA, 25 bp, Homo sapien
gtgatatcttattaccttgtgaagc

SEQ ID NO: 610479 - DNA, 25 bp, Homo sapien
ttaccttgtgaagcatgggatctct

SEQ ID NO: 610480 - DNA, 25 bp, Homo sapien
accttgtgaagcatgggatctctgt

SEQ ID NO: 610481 - DNA, 25 bp, Homo sapien
ccttgtgaagcatgggatctctgtg

SEQ ID NO: 610482 - DNA, 25 bp, Homo sapien
cttgtgaagcatgggatctctgtga

SEQ ID NO: 610483 - DNA, 25 bp, Homo sapien
agcatgggatctctgtgacccatac

SEQ ID NO: 610484 - DNA, 25 bp, Homo sapien
tgggatctctgtgacccatacccta

SEQ ID NO: 610485 - DNA, 25 bp, Homo sapien
cagggggcatcacagaacctgccaa

SEQ ID NO: 610486 - DNA, 25 bp, Homo sapien
gaacgtgtcagagggagctggtaca

SEQ ID NO: 610487 - DNA, 25 bp, Homo sapien
agctggtacagtagtgttggactgt

SEQ ID NO: 610488 - DNA, 25 bp, Homo sapien
acagtagtgttggactgttgccaca

SEQ ID NO: 610489 - DNA, 25 bp, Homo sapien
agtagtgttggactgttgccacagt

SEQ ID NO: 610490 - DNA, 25 bp, Homo sapien
agtgttggactgttgccacagtgca

SEQ ID NO: 610491 - DNA, 25 bp, Homo sapien
tgttggactgttgccacagtgcagt

SEQ ID NO: 610492 - DNA, 25 bp, Homo sapien
tggactgttgccacagtgcagtgac

SEQ ID NO: 610493 - DNA, 25 bp, Homo sapien
cacagtgcagtgaccttcataaagc

SEQ ID NO: 610494 - DNA, 25 bp, Homo sapien
cagtgcagtgaccttcataaagcat

SEQ ID NO: 610495 - DNA, 25 bp, Homo sapien
gtgcagtgaccttcataaagcatat

SEQ ID NO: 610496 - DNA, 25 bp, Homo sapien
gcagtgaccttcataaagcatataa

SEQ ID NO: 610497 - DNA, 25 bp, Homo sapien
ttttgtggaactatagggtaggtca

SEQ ID NO: 610498 - DNA, 25 bp, Homo sapien
ttgtggaactatagggtaggtcact

SEQ ID NO: 610499 - DNA, 25 bp, Homo sapien
ggaactatagggtaggtcactggta

SEQ ID NO: 610500 - DNA, 25 bp, Homo sapien
gaactatagggtaggtcactggtac

SEQ ID NO: 610501 - DNA, 25 bp, Homo sapien
aactatagggtaggtcactggtacg

SEQ ID NO: 610502 - DNA, 25 bp, Homo sapien
actatagggtaggtcactggtacga

SEQ ID NO: 610503 - DNA, 25 bp, Homo sapien
ctatagggtaggtcactggtacgag

SEQ ID NO: 610504 - DNA, 25 bp, Homo sapien
atagggtaggtcactggtacgagaa

SEQ ID NO: 610505 - DNA, 25 bp, Homo sapien
taggtcactggtacgagaaaggaga

SEQ ID NO: 610506 - DNA, 25 bp, Homo sapien
gtcactggtacgagaaaggagaaac

SEQ ID NO: 610507 - DNA, 25 bp, Homo sapien
gagaaacagcgtgggtgcggtgact

SEQ ID NO: 610508 - DNA, 25 bp, Homo sapien
gaggttacaagccagccacttggtg

SEQ ID NO: 610509 - DNA, 25 bp, Homo sapien
taattacgttggaccccttccatca

SEQ ID NO: 610510 - DNA, 25 bp, Homo sapien
gttggaccccttccatcatcaaagg

SEQ ID NO: 610511 - DNA, 25 bp, Homo sapien
catcaaagggatgccagtttttcct

SEQ ID NO: 610512 - DNA, 25 bp, Homo sapien
gacatgcattctggatatctggatt

SEQ ID NO: 610513 - DNA, 25 bp, Homo sapien
tgcttttgctaacacaatcatccgt

SEQ ID NO: 610514 - DNA, 25 bp, Homo sapien
catccgtgaacccagaaacctttat

SEQ ID NO: 610515 - DNA, 25 bp, Homo sapien
cctttattcatggtattccgtgtaa

SEQ ID NO: 610516 - DNA, 25 bp, Homo sapien
ttccgtgtaacattgcttctggcat

SEQ ID NO: 610517 - DNA, 25 bp, Homo sapien
attgcttctggcatacactatcagc

SEQ ID NO: 610518 - DNA, 25 bp, Homo sapien
tggcatacactatcagcctgagaaa

SEQ ID NO: 610519 - DNA, 25 bp, Homo sapien
atgagtgacatgtccatgaactgtc

SEQ ID NO: 610520 - DNA, 25 bp, Homo sapien
ggagtgatttccagaacgtattttt

SEQ ID NO: 610521 - DNA, 25 bp, Homo sapien
aaatcaaagtgcagaagggtgtata

SEQ ID NO: 610522 - DNA, 25 bp, Homo sapien
cagaagggtgtatatgctatgctac

SEQ ID NO: 610523 - DNA, 25 bp, Homo sapien
gaagggtgtatatgctatgctacat

SEQ ID NO: 610524 - DNA, 25 bp, Homo sapien
gtgtatatgctatgctacatgtgca

SEQ ID NO: 610525 - DNA, 25 bp, Homo sapien
tatgctatgctacatgtgcataaga

SEQ ID NO: 610526 - DNA, 25 bp, Homo sapien
gagaatagatatcacaaatttgctt

SEQ ID NO: 610527 - DNA, 25 bp, Homo sapien
gatatcacaaatttgcttacttttg

SEQ ID NO: 610528 - DNA, 25 bp, Homo sapien
aatggttatccattgggtagaaatg

SEQ ID NO: 610529 - DNA, 25 bp, Homo sapien
atgggaatgggtgaaaagctaaaat

SEQ ID NO: 610530 - DNA, 25 bp, Homo sapien
gctctttgccctcttggaaacgaag

SEQ ID NO: 610531 - DNA, 25 bp, Homo sapien
acgaagtttcgagttgctggatcag

SEQ ID NO: 610532 - DNA, 25 bp, Homo sapien
gatgaaggccaggtgtttccagcag

SEQ ID NO: 610533 - DNA, 25 bp, Homo sapien
ggagaccttgtgacccgcatggttg

SEQ ID NO: 610534 - DNA, 25 bp, Homo sapien
gcttttgctcagctggagtccagga

SEQ ID NO: 610535 - DNA, 25 bp, Homo sapien
gctggagtccaggaagctttggtta

SEQ ID NO: 610536 - DNA, 25 bp, Homo sapien
gaagctttggttagagaggccacaa

SEQ ID NO: 610537 - DNA, 25 bp, Homo sapien
gagaggccacaaccaggagtgtcct

SEQ ID NO: 610538 - DNA, 25 bp, Homo sapien
acaaccaggagtgtcctcagctgct

SEQ ID NO: 610539 - DNA, 25 bp, Homo sapien
ctcagctgctcagtctcctagagaa

SEQ ID NO: 610540 - DNA, 25 bp, Homo sapien
ggttcgaggctagtctaggcaatgt

SEQ ID NO: 610541 - DNA, 25 bp, Homo sapien
gctctcagggccttgggatagtgaa

SEQ ID NO: 610542 - DNA, 25 bp, Homo sapien
tctcagggccttgggatagtgaatt

SEQ ID NO: 610543 - DNA, 25 bp, Homo sapien
cagggccttgggatagtgaattcaa

SEQ ID NO: 610544 - DNA, 25 bp, Homo sapien
gtgaattcaagtctccgttatggcc

SEQ ID NO: 610545 - DNA, 25 bp, Homo sapien
gaattcaagtctccgttatggcctg

SEQ ID NO: 610546 - DNA, 25 bp, Homo sapien
attcaagtctccgttatggcctggc

SEQ ID NO: 610547 - DNA, 25 bp, Homo sapien
tcaagtctccgttatggcctggcag

SEQ ID NO: 610548 - DNA, 25 bp, Homo sapien
aagtctccgttatggcctggcagga

SEQ ID NO: 610549 - DNA, 25 bp, Homo sapien
agtctccgttatggcctggcaggat

SEQ ID NO: 610550 - DNA, 25 bp, Homo sapien
tccgttatggcctggcaggatggct

SEQ ID NO: 610551 - DNA, 25 bp, Homo sapien
tatggcctggcaggatggctcatgc

SEQ ID NO: 610552 - DNA, 25 bp, Homo sapien
gaagacctcttatcacatttttatg

SEQ ID NO: 610553 - DNA, 25 bp, Homo sapien
gaaacaggagcttttccaccttcca

SEQ ID NO: 610554 - DNA, 25 bp, Homo sapien
ttccaccttccaagggccataagga

SEQ ID NO: 610555 - DNA, 25 bp, Homo sapien
gtttccagggagatgaccctcagca

SEQ ID NO: 610556 - DNA, 25 bp, Homo sapien
cttttgcatttttgtcaggctatat

SEQ ID NO: 610557 - DNA, 25 bp, Homo sapien
gtcaggctatatgtggtacaacatc

SEQ ID NO: 610558 - DNA, 25 bp, Homo sapien
gtggtacaacatcattcagtatttt

SEQ ID NO: 610559 - DNA, 25 bp, Homo sapien
gcctgttttaggaattgacgtggac

SEQ ID NO: 610560 - DNA, 25 bp, Homo sapien
gacgtggacttgtcaaggtcaccgt

SEQ ID NO: 610561 - DNA, 25 bp, Homo sapien
aggtcaccgtaggagttcagacttt

SEQ ID NO: 610562 - DNA, 25 bp, Homo sapien
aggagttcagactttctttcataag

SEQ ID NO: 610563 - DNA, 25 bp, Homo sapien
aatagtttattcagccactgttccc

SEQ ID NO: 610564 - DNA, 25 bp, Homo sapien
ccacaatttttatcttgaccataat

SEQ ID NO: 610565 - DNA, 25 bp, Homo sapien
atttgtcattcttttataatccccg

SEQ ID NO: 610566 - DNA, 25 bp, Homo sapien
gtcattcttttataatccccgaagt

SEQ ID NO: 610567 - DNA, 25 bp, Homo sapien
aatccccgaagttaaatcttgctgt

SEQ ID NO: 610568 - DNA, 25 bp, Homo sapien
taaatcttgctgttatggtgctgtg

SEQ ID NO: 610569 - DNA, 25 bp, Homo sapien
gctgttatggtgctgtgttgcccaa

SEQ ID NO: 610570 - DNA, 25 bp, Homo sapien
gttatggtgctgtgttgcccaaaac

SEQ ID NO: 610571 - DNA, 25 bp, Homo sapien
atggtgctgtgttgcccaaaaccac

SEQ ID NO: 610572 - DNA, 25 bp, Homo sapien
tgctgtgttgcccaaaaccaccagt

SEQ ID NO: 610573 - DNA, 25 bp, Homo sapien
tgttgcccaaaaccaccagtactaa

SEQ ID NO: 610574 - DNA, 25 bp, Homo sapien
atgtattaattatatctcattcagt

SEQ ID NO: 610575 - DNA, 25 bp, Homo sapien
ttaattatatctcattcagtctgaa

SEQ ID NO: 610576 - DNA, 25 bp, Homo sapien
aattatatctcattcagtctgaaat

SEQ ID NO: 610577 - DNA, 25 bp, Homo sapien
attatatctcattcagtctgaaata

SEQ ID NO: 610578 - DNA, 25 bp, Homo sapien
aataaaaatgatgctcagtcgagtg

SEQ ID NO: 610579 - DNA, 25 bp, Homo sapien
taaaaatgatgctcagtcgagtgcg

SEQ ID NO: 610580 - DNA, 25 bp, Homo sapien
aaaaatgatgctcagtcgagtgcgg

SEQ ID NO: 610581 - DNA, 25 bp, Homo sapien
aaaatgatgctcagtcgagtgcggt

SEQ ID NO: 610582 - DNA, 25 bp, Homo sapien
aaatgatgctcagtcgagtgcggtg

SEQ ID NO: 610583 - DNA, 25 bp, Homo sapien
atgatgctcagtcgagtgcggtggc

SEQ ID NO: 610584 - DNA, 25 bp, Homo sapien
gatgctcagtcgagtgcggtggctc

SEQ ID NO: 610585 - DNA, 25 bp, Homo sapien
cctaaagagtaggggcttgggccag

SEQ ID NO: 610586 - DNA, 25 bp, Homo sapien
taaagagtaggggcttgggccaggc

SEQ ID NO: 610587 - DNA, 25 bp, Homo sapien
aaagagtaggggcttgggccaggca

SEQ ID NO: 610588 - DNA, 25 bp, Homo sapien
aagagtaggggcttgggccaggcac

SEQ ID NO: 610589 - DNA, 25 bp, Homo sapien
agagtaggggcttgggccaggcacg

SEQ ID NO: 610590 - DNA, 25 bp, Homo sapien
gagtaggggcttgggccaggcacgg

SEQ ID NO: 610591 - DNA, 25 bp, Homo sapien
gagccccgggggctgaggttgctgt

SEQ ID NO: 610592 - DNA, 25 bp, Homo sapien
agccccgggggctgaggttgctgtg

SEQ ID NO: 610593 - DNA, 25 bp, Homo sapien
aaggaggctctatatactgatgtta

SEQ ID NO: 610594 - DNA, 25 bp, Homo sapien
aagccctaagggactgaagagatgc

SEQ ID NO: 610595 - DNA, 25 bp, Homo sapien
tgaagagatgctgggcctgtccata

SEQ ID NO: 610596 - DNA, 25 bp, Homo sapien
tgggcctgtccataaagcctgttgc

SEQ ID NO: 610597 - DNA, 25 bp, Homo sapien
aagcctgttgccatgataaggccaa

SEQ ID NO: 610598 - DNA, 25 bp, Homo sapien
gggctagcttatctgcacagcaacc

SEQ ID NO: 610599 - DNA, 25 bp, Homo sapien
ttatctgcacagcaacccagccttt

SEQ ID NO: 610600 - DNA, 25 bp, Homo sapien
tgccttgcctcttcaagatgctatt

SEQ ID NO: 610601 - DNA, 25 bp, Homo sapien
gatgctattcactgaaacctaactt

SEQ ID NO: 610602 - DNA, 25 bp, Homo sapien
gggttacatatgattctcctatggt

SEQ ID NO: 610603 - DNA, 25 bp, Homo sapien
catatgattctcctatggtttcctc

SEQ ID NO: 610604 - DNA, 25 bp, Homo sapien
gggcgtgtttatcatcacgatgttc

SEQ ID NO: 610605 - DNA, 25 bp, Homo sapien
atcatcacgatgttcgggtagccca

SEQ ID NO: 610606 - DNA, 25 bp, Homo sapien
gatgttcgggtagcccagcatcatg

SEQ ID NO: 610607 - DNA, 25 bp, Homo sapien
ggaacacttcgccacaagcaagctg

SEQ ID NO: 610608 - DNA, 25 bp, Homo sapien
acttcgccacaagcaagctgtgtgt

SEQ ID NO: 610609 - DNA, 25 bp, Homo sapien
agctgtgtgtgctctgaagtggtca

SEQ ID NO: 610610 - DNA, 25 bp, Homo sapien
gtgtgctctgaagtggtcaccggat

SEQ ID NO: 610611 - DNA, 25 bp, Homo sapien
tggtcaccggatggcaggctgcttt

SEQ ID NO: 610612 - DNA, 25 bp, Homo sapien
ggctgcagtgatggactgctgacaa

SEQ ID NO: 610613 - DNA, 25 bp, Homo sapien
acaatatggccccacgatccaggtg

SEQ ID NO: 610614 - DNA, 25 bp, Homo sapien
tccaggtgccagtgcacagggccaa

SEQ ID NO: 610615 - DNA, 25 bp, Homo sapien
cttttcctatgctacaaccatctat

SEQ ID NO: 610616 - DNA, 25 bp, Homo sapien
cctatgctacaaccatctatattta

SEQ ID NO: 610617 - DNA, 25 bp, Homo sapien
aatatttatgaattgggcagtggca

SEQ ID NO: 610618 - DNA, 25 bp, Homo sapien
ggcagtggcaaacaaccaagtggtt

SEQ ID NO: 610619 - DNA, 25 bp, Homo sapien
caaccaagtggtttgggctttactg

SEQ ID NO: 610620 - DNA, 25 bp, Homo sapien
ttgggctttactggcaagggcttga

SEQ ID NO: 610621 - DNA, 25 bp, Homo sapien
tggcaagggcttgagggaaaacttt

SEQ ID NO: 610622 - DNA, 25 bp, Homo sapien
agttggcagtttctgactggtaaag

SEQ ID NO: 610623 - DNA, 25 bp, Homo sapien
ctgactggtaaagtctctggttaga

SEQ ID NO: 610624 - DNA, 25 bp, Homo sapien
ttggcggtttctgactgggtaaaga

SEQ ID NO: 610625 - DNA, 25 bp, Homo sapien
ctgactgggtaaagagaaatttcct

SEQ ID NO: 610626 - DNA, 25 bp, Homo sapien
aaactggaatttctccattccctgg

SEQ ID NO: 610627 - DNA, 25 bp, Homo sapien
gaaattgccctgtagattgtgccct

SEQ ID NO: 610628 - DNA, 25 bp, Homo sapien
tgccctgtagattgtgccctgagct

SEQ ID NO: 610629 - DNA, 25 bp, Homo sapien
gagaggcagcagacagtagcgtcaa

SEQ ID NO: 610630 - DNA, 25 bp, Homo sapien
agacagtagcgtcaaccccagtctc

SEQ ID NO: 610631 - DNA, 25 bp, Homo sapien
gtctcccaaatgctgagcaggacag

SEQ ID NO: 610632 - DNA, 25 bp, Homo sapien
aggagaggtacaagtgaattgcccc

SEQ ID NO: 610633 - DNA, 25 bp, Homo sapien
ccctgtctctgtgtcatagctgaga

SEQ ID NO: 610634 - DNA, 25 bp, Homo sapien
ttgttccctcttctggtttgaactg

SEQ ID NO: 610635 - DNA, 25 bp, Homo sapien
tctggtttgaactggccttttgaat

SEQ ID NO: 610636 - DNA, 25 bp, Homo sapien
gaactggccttttgaataggctcta

SEQ ID NO: 610637 - DNA, 25 bp, Homo sapien
ctaacaaatgctcaagtaacccaaa

SEQ ID NO: 610638 - DNA, 25 bp, Homo sapien
acaaatgctcaagtaacccaaaaga

SEQ ID NO: 610639 - DNA, 25 bp, Homo sapien
aacagataattaaatagtagcccta

SEQ ID NO: 610640 - DNA, 25 bp, Homo sapien
tagtagccctaaacccaaacatatc

SEQ ID NO: 610641 - DNA, 25 bp, Homo sapien
tagccctaaacccaaacatatcaat

SEQ ID NO: 610642 - DNA, 25 bp, Homo sapien
ttaaatgtaaatggtgtaagcacac

SEQ ID NO: 610643 - DNA, 25 bp, Homo sapien
ggtgtaagcacactagttaaaatag

SEQ ID NO: 610644 - DNA, 25 bp, Homo sapien
gtaaaaaggtatcactcgactatat

SEQ ID NO: 610645 - DNA, 25 bp, Homo sapien
aaggtatcactcgactatatgctgt

SEQ ID NO: 610646 - DNA, 25 bp, Homo sapien
gtatcactcgactatatgctgtcta

SEQ ID NO: 610647 - DNA, 25 bp, Homo sapien
atatgctgtctaccagaaacatact

SEQ ID NO: 610648 - DNA, 25 bp, Homo sapien
tactcaacattcaagtagtcttgaa

SEQ ID NO: 610649 - DNA, 25 bp, Homo sapien
aaagatgggtgggagtcaccttctt

SEQ ID NO: 610650 - DNA, 25 bp, Homo sapien
ttctttcccttcatcagttaccagt

SEQ ID NO: 610651 - DNA, 25 bp, Homo sapien
tttcccttcatcagttaccagtgtt

SEQ ID NO: 610652 - DNA, 25 bp, Homo sapien
cttcatcagttaccagtgttctctt

SEQ ID NO: 610653 - DNA, 25 bp, Homo sapien
catcagttaccagtgttctcttaac

SEQ ID NO: 610654 - DNA, 25 bp, Homo sapien
ccacctacaactcaggattcctatg

SEQ ID NO: 610655 - DNA, 25 bp, Homo sapien
aactcaggattcctatgtcctatgg

SEQ ID NO: 610656 - DNA, 25 bp, Homo sapien
gattcctatgtcctatgggttcagt

SEQ ID NO: 610657 - DNA, 25 bp, Homo sapien
tatgtcctatgggttcagttgtgtc

SEQ ID NO: 610658 - DNA, 25 bp, Homo sapien
gtcctatgggttcagttgtgtcccc

SEQ ID NO: 610659 - DNA, 25 bp, Homo sapien
ctccgagggtcgtatatgggcgctc

SEQ ID NO: 610660 - DNA, 25 bp, Homo sapien
agggtcgtatatgggcgctcctcga

SEQ ID NO: 610661 - DNA, 25 bp, Homo sapien
ttcggtgcgccccaggacgcaaagc

SEQ ID NO: 610662 - DNA, 25 bp, Homo sapien
aggacgcaaagctgggcgaccctcc

SEQ ID NO: 610663 - DNA, 25 bp, Homo sapien
gggctgctgcgagtttcctgcgatt

SEQ ID NO: 610664 - DNA, 25 bp, Homo sapien
gctgcgagtttcctgcgattgtgac

SEQ ID NO: 610665 - DNA, 25 bp, Homo sapien
ttcctgcgattgtgacttcgcgtta

SEQ ID NO: 610666 - DNA, 25 bp, Homo sapien
ttgtgacttcgcgttatgctctttc

SEQ ID NO: 610667 - DNA, 25 bp, Homo sapien
ttcgcgttatgctctttctctaaac

SEQ ID NO: 610668 - DNA, 25 bp, Homo sapien
gttatgctctttctctaaacaccgt

SEQ ID NO: 610669 - DNA, 25 bp, Homo sapien
tctctaaacaccgtctcttggcaag

SEQ ID NO: 610670 - DNA, 25 bp, Homo sapien
gggccgtagtcattggttctcgcca

SEQ ID NO: 610671 - DNA, 25 bp, Homo sapien
gccgtagtcattggttctcgccatt

SEQ ID NO: 610672 - DNA, 25 bp, Homo sapien
gtagtcattggttctcgccattgta

SEQ ID NO: 610673 - DNA, 25 bp, Homo sapien
agtcattggttctcgccattgtatt

SEQ ID NO: 610674 - DNA, 25 bp, Homo sapien
gtcattggttctcgccattgtattc

SEQ ID NO: 610675 - DNA, 25 bp, Homo sapien
ttgtgctctaggcttcagggcctct

SEQ ID NO: 610676 - DNA, 25 bp, Homo sapien
aggcttcagggcctctcctttttga

SEQ ID NO: 610677 - DNA, 25 bp, Homo sapien
ttcagggcctctcctttttgactct

SEQ ID NO: 610678 - DNA, 25 bp, Homo sapien
cagggcctctcctttttgactctgt

SEQ ID NO: 610679 - DNA, 25 bp, Homo sapien
tttgactctgtccaccaaaatctaa

SEQ ID NO: 610680 - DNA, 25 bp, Homo sapien
actgagtgtcgtctcttcttccctc

SEQ ID NO: 610681 - DNA, 25 bp, Homo sapien
tagattgaggaagttccctttcctt

SEQ ID NO: 610682 - DNA, 25 bp, Homo sapien
aaacatgtattgaagttttgtcaaa

SEQ ID NO: 610683 - DNA, 25 bp, Homo sapien
ttgtcaaatgtcttcatctattgga

SEQ ID NO: 610684 - DNA, 25 bp, Homo sapien
caaatgtcttcatctattggaataa

SEQ ID NO: 610685 - DNA, 25 bp, Homo sapien
gttaatattacatttcaatcttctg

SEQ ID NO: 610686 - DNA, 25 bp, Homo sapien
tacatttcaatcttctgtctaccta

SEQ ID NO: 610687 - DNA, 25 bp, Homo sapien
aatccctagaataatctccatttgg

SEQ ID NO: 610688 - DNA, 25 bp, Homo sapien
cctagaataatctccatttggctat

SEQ ID NO: 610689 - DNA, 25 bp, Homo sapien
gaataatctccatttggctatgatg

SEQ ID NO: 610690 - DNA, 25 bp, Homo sapien
gttgtgcttttatatattactgaat

SEQ ID NO: 610691 - DNA, 25 bp, Homo sapien
ctgaattctatatgccaatattatt

SEQ ID NO: 610692 - DNA, 25 bp, Homo sapien
agagttcccgattttgaaatgctgg

SEQ ID NO: 610693 - DNA, 25 bp, Homo sapien
ctgggctcactcagaagtggcagcc

SEQ ID NO: 610694 - DNA, 25 bp, Homo sapien
aagtggcagccccttgtgctttgga

SEQ ID NO: 610695 - DNA, 25 bp, Homo sapien
gaatgtgattctacaagttccagtg

SEQ ID NO: 610696 - DNA, 25 bp, Homo sapien
gtgattctacaagttccagtgggac

SEQ ID NO: 610697 - DNA, 25 bp, Homo sapien
gttccagtgggactgactgtacata

SEQ ID NO: 610698 - DNA, 25 bp, Homo sapien
gtgggactgactgtacatacctctc

SEQ ID NO: 610699 - DNA, 25 bp, Homo sapien
actgactgtacatacctctctagta

SEQ ID NO: 610700 - DNA, 25 bp, Homo sapien
gtacatacctctctagtatgttctg

SEQ ID NO: 610701 - DNA, 25 bp, Homo sapien
tagtatgttctgtgactctgctcat

SEQ ID NO: 610702 - DNA, 25 bp, Homo sapien
gtatgttctgtgactctgctcatta

SEQ ID NO: 610703 - DNA, 25 bp, Homo sapien
aatcctcatggaatataacgggact

SEQ ID NO: 610704 - DNA, 25 bp, Homo sapien
ataacgggacttgaccagcatttcc

SEQ ID NO: 610705 - DNA, 25 bp, Homo sapien
cttcagtaactcacttataaggaat

SEQ ID NO: 610706 - DNA, 25 bp, Homo sapien
attagagttgttcatttcttccatc

SEQ ID NO: 610707 - DNA, 25 bp, Homo sapien
gttgttcatttcttccatcatatac

SEQ ID NO: 610708 - DNA, 25 bp, Homo sapien
ttataagagtactgtgccggatcca

SEQ ID NO: 610709 - DNA, 25 bp, Homo sapien
gtactgtgccggatccagaaatgct

SEQ ID NO: 610710 - DNA, 25 bp, Homo sapien
gtgccggatccagaaatgctactaa

SEQ ID NO: 610711 - DNA, 25 bp, Homo sapien
atgctactaattatgttgaaactgt

SEQ ID NO: 610712 - DNA, 25 bp, Homo sapien
atgtttatgaattgctcaggtgagc

SEQ ID NO: 610713 - DNA, 25 bp, Homo sapien
ttgctcaggtgagcatggtgagcat

SEQ ID NO: 610714 - DNA, 25 bp, Homo sapien
gaagctcaaagccaaaatcaggcaa

SEQ ID NO: 610715 - DNA, 25 bp, Homo sapien
aagccaaaatcaggcaactgacgga

SEQ ID NO: 610716 - DNA, 25 bp, Homo sapien
gccaaaatcaggcaactgacggaag

SEQ ID NO: 610717 - DNA, 25 bp, Homo sapien
atcaggcaactgacggaagagaagg

SEQ ID NO: 610718 - DNA, 25 bp, Homo sapien
ggctttggaggagtacattactcaa

SEQ ID NO: 610719 - DNA, 25 bp, Homo sapien
ggaggagtacattactcaagagaga

SEQ ID NO: 610720 - DNA, 25 bp, Homo sapien
gagaaacagagcgaaagagacttta

SEQ ID NO: 610721 - DNA, 25 bp, Homo sapien
acagagcgaaagagactttagagga

SEQ ID NO: 610722 - DNA, 25 bp, Homo sapien
aacggaagagaatgcaagaactgga

SEQ ID NO: 610723 - DNA, 25 bp, Homo sapien
ccagcagaagaaggctttggcgaaa

SEQ ID NO: 610724 - DNA, 25 bp, Homo sapien
ggctttggcgaaaagcattacccag

SEQ ID NO: 610725 - DNA, 25 bp, Homo sapien
gattatatgtcatacctccattggg

SEQ ID NO: 610726 - DNA, 25 bp, Homo sapien
aagcataaccctgagattcttacta

SEQ ID NO: 610727 - DNA, 25 bp, Homo sapien
aaccctgagattcttactactgatg

SEQ ID NO: 610728 - DNA, 25 bp, Homo sapien
actactgatgagaacattatctgca

SEQ ID NO: 610729 - DNA, 25 bp, Homo sapien
gagaacattatctgcatatgccaaa

SEQ ID NO: 610730 - DNA, 25 bp, Homo sapien
ttaagcaaatgaaagctaccaattt

SEQ ID NO: 610731 - DNA, 25 bp, Homo sapien
tgaaagctaccaatttaaagttacg

SEQ ID NO: 610732 - DNA, 25 bp, Homo sapien
attgcttgtcaagctataaccacaa

SEQ ID NO: 610733 - DNA, 25 bp, Homo sapien
atacaatgaagaggcaatgtccatc

SEQ ID NO: 610734 - DNA, 25 bp, Homo sapien
gaagaggcaatgtccatctcaaaat

SEQ ID NO: 610735 - DNA, 25 bp, Homo sapien
ccatctcaaaatactgcttttacaa

SEQ ID NO: 610736 - DNA, 25 bp, Homo sapien
aaactccggacacactagcacttac

SEQ ID NO: 610737 - DNA, 25 bp, Homo sapien
aactccggacacactagcacttaca

SEQ ID NO: 610738 - DNA, 25 bp, Homo sapien
actccggacacactagcacttacag

SEQ ID NO: 610739 - DNA, 25 bp, Homo sapien
ctccggacacactagcacttacagg

SEQ ID NO: 610740 - DNA, 25 bp, Homo sapien
tccggacacactagcacttacagga

SEQ ID NO: 610741 - DNA, 25 bp, Homo sapien
ccggacacactagcacttacaggag

SEQ ID NO: 610742 - DNA, 25 bp, Homo sapien
cggacacactagcacttacaggagg

SEQ ID NO: 610743 - DNA, 25 bp, Homo sapien
ggacacactagcacttacaggaggc

SEQ ID NO: 610744 - DNA, 25 bp, Homo sapien
gacacactagcacttacaggaggcc

SEQ ID NO: 610745 - DNA, 25 bp, Homo sapien
cactagcacttacaggaggcccagg

SEQ ID NO: 610746 - DNA, 25 bp, Homo sapien
gtgaactatgatcaaaccactgtag

SEQ ID NO: 610747 - DNA, 25 bp, Homo sapien
ccagagggaatgtcgattacattac

SEQ ID NO: 610748 - DNA, 25 bp, Homo sapien
gtcgattacattactttgtgcccta

SEQ ID NO: 610749 - DNA, 25 bp, Homo sapien
gattacattactttgtgccctataa

SEQ ID NO: 610750 - DNA, 25 bp, Homo sapien
tacattactttgtgccctataaata

SEQ ID NO: 610751 - DNA, 25 bp, Homo sapien
ttactttgtgccctataaatatata

SEQ ID NO: 610752 - DNA, 25 bp, Homo sapien
taatacacaagtacaatgtagcaag

SEQ ID NO: 610753 - DNA, 25 bp, Homo sapien
caatgtagcaagatgtaatatcaat

SEQ ID NO: 610754 - DNA, 25 bp, Homo sapien
gaaattaacaatctgaaatgaactt

SEQ ID NO: 610755 - DNA, 25 bp, Homo sapien
atgattccatttacaatggtatcaa

SEQ ID NO: 610756 - DNA, 25 bp, Homo sapien
aacaaatgccagacttgtatatgga

SEQ ID NO: 610757 - DNA, 25 bp, Homo sapien
gccagacttgtatatggaaaagtac

SEQ ID NO: 610758 - DNA, 25 bp, Homo sapien
tttgagcaaggcatataccagtggt

SEQ ID NO: 610759 - DNA, 25 bp, Homo sapien
gggaagaatcttgtttattccatcc

SEQ ID NO: 610760 - DNA, 25 bp, Homo sapien
tcttgtttattccatccttgtttga

SEQ ID NO: 610761 - DNA, 25 bp, Homo sapien
atccttgtttgatgatcgaccacag

SEQ ID NO: 610762 - DNA, 25 bp, Homo sapien
gaatataacataacacttctgtgta

SEQ ID NO: 610763 - DNA, 25 bp, Homo sapien
gacaaggtagttttcactggatcct

SEQ ID NO: 610764 - DNA, 25 bp, Homo sapien
actggatccttactggtactctgaa

SEQ ID NO: 610765 - DNA, 25 bp, Homo sapien
gaattttcactatttgtccgcattt

SEQ ID NO: 610766 - DNA, 25 bp, Homo sapien
ttcactatttgtccgcatttcttct

SEQ ID NO: 610767 - DNA, 25 bp, Homo sapien
gcatttcttctccttcccggaaatt

SEQ ID NO: 610768 - DNA, 25 bp, Homo sapien
tttctgcgaaaaacaagtgctactt

SEQ ID NO: 610769 - DNA, 25 bp, Homo sapien
accaaccaaagaaattgttgccacg

SEQ ID NO: 610770 - DNA, 25 bp, Homo sapien
aaccaaagaaattgttgccacgaat

SEQ ID NO: 610771 - DNA, 25 bp, Homo sapien
accaaagaaattgttgccacgaata

SEQ ID NO: 610772 - DNA, 25 bp, Homo sapien
ccaaagaaattgttgccacgaataa

SEQ ID NO: 610773 - DNA, 25 bp, Homo sapien
caaagaaattgttgccacgaataaa

SEQ ID NO: 610774 - DNA, 25 bp, Homo sapien
agaaattgttgccacgaataaacaa

SEQ ID NO: 610775 - DNA, 25 bp, Homo sapien
caaatgaagctataattctagttgg

SEQ ID NO: 610776 - DNA, 25 bp, Homo sapien
atgaagctataattctagttggaga

SEQ ID NO: 610777 - DNA, 25 bp, Homo sapien
gaagctataattctagttggagatt

SEQ ID NO: 610778 - DNA, 25 bp, Homo sapien
aagctataattctagttggagattt

SEQ ID NO: 610779 - DNA, 25 bp, Homo sapien
gctataattctagttggagatttat

SEQ ID NO: 610780 - DNA, 25 bp, Homo sapien
aagtgacctcagcacagtttcttgg

SEQ ID NO: 610781 - DNA, 25 bp, Homo sapien
gcacagtttcttggccatcaaagga

SEQ ID NO: 610782 - DNA, 25 bp, Homo sapien
gtattatgtcataccccagtgggac

SEQ ID NO: 610783 - DNA, 25 bp, Homo sapien
accccagtgggacaagaggcttcct

SEQ ID NO: 610784 - DNA, 25 bp, Homo sapien
caagaggcttccttgttgtcctttt

SEQ ID NO: 610785 - DNA, 25 bp, Homo sapien
tcagccttggtgataatttacaaag

SEQ ID NO: 610786 - DNA, 25 bp, Homo sapien
agatgaacacttgagcaccctagat

SEQ ID NO: 610787 - DNA, 25 bp, Homo sapien
gcaccctagatgcttatagacccaa

SEQ ID NO: 610788 - DNA, 25 bp, Homo sapien
atagacccaagctagtacatgcaaa

SEQ ID NO: 610789 - DNA, 25 bp, Homo sapien
attatgtctacactgacaggtggat

SEQ ID NO: 610790 - DNA, 25 bp, Homo sapien
gtaaagtgtatcaaactagctgttt

SEQ ID NO: 610791 - DNA, 25 bp, Homo sapien
aactgaagctacaaaatggcctggt

SEQ ID NO: 610792 - DNA, 25 bp, Homo sapien
ctgaagctacaaaatggcctggttt

SEQ ID NO: 610793 - DNA, 25 bp, Homo sapien
aagctacaaaatggcctggtttctc

SEQ ID NO: 610794 - DNA, 25 bp, Homo sapien
ctacaaaatggcctggtttctcact

SEQ ID NO: 610795 - DNA, 25 bp, Homo sapien
acaaaatggcctggtttctcacttc

SEQ ID NO: 610796 - DNA, 25 bp, Homo sapien
aaaatggcctggtttctcacttcag

SEQ ID NO: 610797 - DNA, 25 bp, Homo sapien
aaatggcctggtttctcacttcagt

SEQ ID NO: 610798 - DNA, 25 bp, Homo sapien
atggcctggtttctcacttcagtta

SEQ ID NO: 610799 - DNA, 25 bp, Homo sapien
ggcctggtttctcacttcagttaaa

SEQ ID NO: 610800 - DNA, 25 bp, Homo sapien
gcctggtttctcacttcagttaaat

SEQ ID NO: 610801 - DNA, 25 bp, Homo sapien
cctggtttctcacttcagttaaatt

SEQ ID NO: 610802 - DNA, 25 bp, Homo sapien
tttgcagggtcgtcatgaggataaa

SEQ ID NO: 610803 - DNA, 25 bp, Homo sapien
ttgcagggtcgtcatgaggataaag

SEQ ID NO: 610804 - DNA, 25 bp, Homo sapien
gcagggtcgtcatgaggataaaggg

SEQ ID NO: 610805 - DNA, 25 bp, Homo sapien
aggtgtgacagctcaggtttataat

SEQ ID NO: 610806 - DNA, 25 bp, Homo sapien
ggtgtgacagctcaggtttataatc

SEQ ID NO: 610807 - DNA, 25 bp, Homo sapien
gtgtgacagctcaggtttataatcc

SEQ ID NO: 610808 - DNA, 25 bp, Homo sapien
tgtgacagctcaggtttataatccc

SEQ ID NO: 610809 - DNA, 25 bp, Homo sapien
tgacagctcaggtttataatcccag

SEQ ID NO: 610810 - DNA, 25 bp, Homo sapien
acagctcaggtttataatcccagca

SEQ ID NO: 610811 - DNA, 25 bp, Homo sapien
cttgaggccaagagtcccagactac

SEQ ID NO: 610812 - DNA, 25 bp, Homo sapien
ggccaagagtcccagactaccctgg

SEQ ID NO: 610813 - DNA, 25 bp, Homo sapien
gatattaatagtagcaacccagaat

SEQ ID NO: 610814 - DNA, 25 bp, Homo sapien
tagcaacccagaattgtcatgaagc

SEQ ID NO: 610815 - DNA, 25 bp, Homo sapien
gcaacccagaattgtcatgaagcct

SEQ ID NO: 610816 - DNA, 25 bp, Homo sapien
aacccagaattgtcatgaagcctaa

SEQ ID NO: 610817 - DNA, 25 bp, Homo sapien
cccagaattgtcatgaagcctaact

SEQ ID NO: 610818 - DNA, 25 bp, Homo sapien
cagaattgtcatgaagcctaactaa

SEQ ID NO: 610819 - DNA, 25 bp, Homo sapien
gaattgtcatgaagcctaactaagt

SEQ ID NO: 610820 - DNA, 25 bp, Homo sapien
tgtcatgaagcctaactaagttttt

SEQ ID NO: 610821 - DNA, 25 bp, Homo sapien
gaagcctaactaagtttttatatat

SEQ ID NO: 610822 - DNA, 25 bp, Homo sapien
agaagagggcttggaatgtaacaat

SEQ ID NO: 610823 - DNA, 25 bp, Homo sapien
ggaatgtaacaataactcaataaat

SEQ ID NO: 610824 - DNA, 25 bp, Homo sapien
aagtggaggctgtctgcatccacct

SEQ ID NO: 610825 - DNA, 25 bp, Homo sapien
gtggaggctgtctgcatccacctcc

SEQ ID NO: 610826 - DNA, 25 bp, Homo sapien
tttgtcaccgggacctcagcctgac

SEQ ID NO: 610827 - DNA, 25 bp, Homo sapien
accgccagctcagatgcggtgtgtg

SEQ ID NO: 610828 - DNA, 25 bp, Homo sapien
agctcagatgcggtgtgtggactcc

SEQ ID NO: 610829 - DNA, 25 bp, Homo sapien
tcagatgcggtgtgtggactccctt

SEQ ID NO: 610830 - DNA, 25 bp, Homo sapien
gatgcggtgtgtggactcccttctc

SEQ ID NO: 610831 - DNA, 25 bp, Homo sapien
ctgggatccccttgaccctggtcat

SEQ ID NO: 610832 - DNA, 25 bp, Homo sapien
ggatccccttgaccctggtcatcag

SEQ ID NO: 610833 - DNA, 25 bp, Homo sapien
ctgacaggccctgcgtgtgccatgt

SEQ ID NO: 610834 - DNA, 25 bp, Homo sapien
tggcctgggtttggagctcagcacc

SEQ ID NO: 610835 - DNA, 25 bp, Homo sapien
ggtggccggcatggccgtttcctat

SEQ ID NO: 610836 - DNA, 25 bp, Homo sapien
ggcatggccgtttcctatgatggct

SEQ ID NO: 610837 - DNA, 25 bp, Homo sapien
atggccgtttcctatgatggctgct

SEQ ID NO: 610838 - DNA, 25 bp, Homo sapien
gccgtttcctatgatggctgctacg

SEQ ID NO: 610839 - DNA, 25 bp, Homo sapien
gtttcctatgatggctgctacgcct

SEQ ID NO: 610840 - DNA, 25 bp, Homo sapien
tatgatggctgctacgccttcactg

SEQ ID NO: 610841 - DNA, 25 bp, Homo sapien
ggctgctacgccttcactgcgggag

SEQ ID NO: 610842 - DNA, 25 bp, Homo sapien
tacgccttcactgcgggagggcacg

SEQ ID NO: 610843 - DNA, 25 bp, Homo sapien
ttcactgcgggagggcacgatcgct

SEQ ID NO: 610844 - DNA, 25 bp, Homo sapien
agggcacgatcgctcggtggtgcag

SEQ ID NO: 610845 - DNA, 25 bp, Homo sapien
ggtggtgcagtggaaaatcacctta

SEQ ID NO: 610846 - DNA, 25 bp, Homo sapien
ttataaagggtgctgagaggattca

SEQ ID NO: 610847 - DNA, 25 bp, Homo sapien
gaggattcaaggtaacattcagtca

SEQ ID NO: 610848 - DNA, 25 bp, Homo sapien
aacattcagtcacaggctggccgga

SEQ ID NO: 610849 - DNA, 25 bp, Homo sapien
ggccggaccctgagtcttgttgaga

SEQ ID NO: 610850 - DNA, 25 bp, Homo sapien
gagtcttgttgagaaccggctgaaa

SEQ ID NO: 610851 - DNA, 25 bp, Homo sapien
gagaaccggctgaaatgacccgcac

SEQ ID NO: 610852 - DNA, 25 bp, Homo sapien
gaaatgacccgcaccatggcaggga

SEQ ID NO: 610853 - DNA, 25 bp, Homo sapien
ggaagggcccatcccagcatcaaca

SEQ ID NO: 610854 - DNA, 25 bp, Homo sapien
gcatcaacactgagcatgtatcaat

SEQ ID NO: 610855 - DNA, 25 bp, Homo sapien
atgtatcaatgtgggacaacgcagg

SEQ ID NO: 610856 - DNA, 25 bp, Homo sapien
gatgctacagatgctgctctgcctg

SEQ ID NO: 610857 - DNA, 25 bp, Homo sapien
ctttgagggcaccatggaatccgat

SEQ ID NO: 610858 - DNA, 25 bp, Homo sapien
tttgagggcaccatggaatccgatt

SEQ ID NO: 610859 - DNA, 25 bp, Homo sapien
ttgagggcaccatggaatccgattg

SEQ ID NO: 610860 - DNA, 25 bp, Homo sapien
gagggcaccatggaatccgattgct

SEQ ID NO: 610861 - DNA, 25 bp, Homo sapien
agggcaccatggaatccgattgctg

SEQ ID NO: 610862 - DNA, 25 bp, Homo sapien
gggcaccatggaatccgattgctgg

SEQ ID NO: 610863 - DNA, 25 bp, Homo sapien
ggcaccatggaatccgattgctgga

SEQ ID NO: 610864 - DNA, 25 bp, Homo sapien
gcaccatggaatccgattgctggaa

SEQ ID NO: 610865 - DNA, 25 bp, Homo sapien
accatggaatccgattgctggaaat

SEQ ID NO: 610866 - DNA, 25 bp, Homo sapien
catggaatccgattgctggaaataa

SEQ ID NO: 610867 - DNA, 25 bp, Homo sapien
atggaatccgattgctggaaataaa

SEQ ID NO: 610868 - DNA, 25 bp, Homo sapien
atttcaaaacaacattctcgccagg

SEQ ID NO: 610869 - DNA, 25 bp, Homo sapien
tttcaaaacaacattctcgccaggt

SEQ ID NO: 610870 - DNA, 25 bp, Homo sapien
ttcaaaacaacattctcgccaggtg

SEQ ID NO: 610871 - DNA, 25 bp, Homo sapien
tcaaaacaacattctcgccaggtgc

SEQ ID NO: 610872 - DNA, 25 bp, Homo sapien
caaaacaacattctcgccaggtgcg

SEQ ID NO: 610873 - DNA, 25 bp, Homo sapien
aaaacaacattctcgccaggtgcgg

SEQ ID NO: 610874 - DNA, 25 bp, Homo sapien
aaacaacattctcgccaggtgcggt

SEQ ID NO: 610875 - DNA, 25 bp, Homo sapien
cttgaacaggaagtcagaggttgcg

SEQ ID NO: 610876 - DNA, 25 bp, Homo sapien
ggcgccactgtactcacagaggttg

SEQ ID NO: 610877 - DNA, 25 bp, Homo sapien
gcgccactgtactcacagaggttgc

SEQ ID NO: 610878 - DNA, 25 bp, Homo sapien
cgccactgtactcacagaggttgca

SEQ ID NO: 610879 - DNA, 25 bp, Homo sapien
accatgctagtgtagatgccagctc

SEQ ID NO: 610880 - DNA, 25 bp, Homo sapien
tagtgtagatgccagctcacgccag

SEQ ID NO: 610881 - DNA, 25 bp, Homo sapien
gtagatgccagctcacgccagcggg

SEQ ID NO: 610882 - DNA, 25 bp, Homo sapien
ggaggagagttcagccccaggtttc

SEQ ID NO: 610883 - DNA, 25 bp, Homo sapien
agccccaggtttcctgtacttcagc

SEQ ID NO: 610884 - DNA, 25 bp, Homo sapien
gaagatggaacgtgaacttttttgt

SEQ ID NO: 610885 - DNA, 25 bp, Homo sapien
gaacttttttgttgtcccatgtgga

SEQ ID NO: 610886 - DNA, 25 bp, Homo sapien
cacctgtgttcggtttccagttcta

SEQ ID NO: 610887 - DNA, 25 bp, Homo sapien
ccagttctacctttgctgtctgtgt

SEQ ID NO: 610888 - DNA, 25 bp, Homo sapien
ctgtgtgttcttaagtaactcactt

SEQ ID NO: 610889 - DNA, 25 bp, Homo sapien
tcacttaaacctttctgagtctcat

SEQ ID NO: 610890 - DNA, 25 bp, Homo sapien
tggcaaactggagtagaggcattac

SEQ ID NO: 610891 - DNA, 25 bp, Homo sapien
gtagaggcattacagagacaacaat

SEQ ID NO: 610892 - DNA, 25 bp, Homo sapien
ggcatgaagttcagtgtgacttaac

SEQ ID NO: 610893 - DNA, 25 bp, Homo sapien
gtgacttaactacatgaggaccgtg

SEQ ID NO: 610894 - DNA, 25 bp, Homo sapien
acatgaggaccgtgagtgactaaga

SEQ ID NO: 610895 - DNA, 25 bp, Homo sapien
actattaggtgtttggacttcatct

SEQ ID NO: 610896 - DNA, 25 bp, Homo sapien
ggacttcatcttgtgggtttttagg

SEQ ID NO: 610897 - DNA, 25 bp, Homo sapien
catcttgtgggtttttaggagccaa

SEQ ID NO: 610898 - DNA, 25 bp, Homo sapien
ttttaggagccaagagacatcagtg

SEQ ID NO: 610899 - DNA, 25 bp, Homo sapien
gagacatcagtggagttttgctaaa

SEQ ID NO: 610900 - DNA, 25 bp, Homo sapien
acactacagcatttgtttttctaat

SEQ ID NO: 610901 - DNA, 25 bp, Homo sapien
gcctttttgagccaagtctctatct

SEQ ID NO: 610902 - DNA, 25 bp, Homo sapien
gccaagtctctatctgcacctttaa

SEQ ID NO: 610903 - DNA, 25 bp, Homo sapien
aacatggtgttattgcagacctggg

SEQ ID NO: 610904 - DNA, 25 bp, Homo sapien
gcagacctgggttaactcgggattg

SEQ ID NO: 610905 - DNA, 25 bp, Homo sapien
ctgctttgtatttatgactgtttta

SEQ ID NO: 610906 - DNA, 25 bp, Homo sapien
catttatttccatatagtgtgtaga

SEQ ID NO: 610907 - DNA, 25 bp, Homo sapien
aaaccacagctcttgacaactctta

SEQ ID NO: 610908 - DNA, 25 bp, Homo sapien
caactcttagagcactatttcacag

SEQ ID NO: 610909 - DNA, 25 bp, Homo sapien
agcactatttcacagctttcacata

SEQ ID NO: 610910 - DNA, 25 bp, Homo sapien
tcacatagcacagataactcgccat

SEQ ID NO: 610911 - DNA, 25 bp, Homo sapien
aactcgccatctgtgctaagcatta

SEQ ID NO: 610912 - DNA, 25 bp, Homo sapien
caggacagaccgcctggtttggaaa

SEQ ID NO: 610913 - DNA, 25 bp, Homo sapien
ggaaaccttggaagcatggtctgct

SEQ ID NO: 610914 - DNA, 25 bp, Homo sapien
gcatggtctgcttgtattacctggg

SEQ ID NO: 610915 - DNA, 25 bp, Homo sapien
gggtcatagatttagcactcataaa

SEQ ID NO: 610916 - DNA, 25 bp, Homo sapien
gcactcataaagtcatgtctgtctg

SEQ ID NO: 610917 - DNA, 25 bp, Homo sapien
aggagacaggagtaatcagcctact

SEQ ID NO: 610918 - DNA, 25 bp, Homo sapien
gacaaaatactgcattctattatgt

SEQ ID NO: 610919 - DNA, 25 bp, Homo sapien
aatgggcttttttatgtgaactaca

SEQ ID NO: 610920 - DNA, 25 bp, Homo sapien
tgaactacatccgtttacatcctca

SEQ ID NO: 610921 - DNA, 25 bp, Homo sapien
gtttacatcctcattatcccaaggt

SEQ ID NO: 610922 - DNA, 25 bp, Homo sapien
cattatcccaaggtttcggtattcg

SEQ ID NO: 610923 - DNA, 25 bp, Homo sapien
ttttttaatctcatttacgggccag

SEQ ID NO: 610924 - DNA, 25 bp, Homo sapien
ttttaatctcatttacgggccaggc

SEQ ID NO: 610925 - DNA, 25 bp, Homo sapien
tttaatctcatttacgggccaggca

SEQ ID NO: 610926 - DNA, 25 bp, Homo sapien
ttaatctcatttacgggccaggcat

SEQ ID NO: 610927 - DNA, 25 bp, Homo sapien
tctcatttacgggccaggcatgatg

SEQ ID NO: 610928 - DNA, 25 bp, Homo sapien
aatcctgctctactaaaaacacgaa

SEQ ID NO: 610929 - DNA, 25 bp, Homo sapien
aaaacacgaatattagtcgagtgtg

SEQ ID NO: 610930 - DNA, 25 bp, Homo sapien
aaacacgaatattagtcgagtgtgg

SEQ ID NO: 610931 - DNA, 25 bp, Homo sapien
aacacgaatattagtcgagtgtggg

SEQ ID NO: 610932 - DNA, 25 bp, Homo sapien
tgtgggggcatgaacctgtattccc

SEQ ID NO: 610933 - DNA, 25 bp, Homo sapien
gggggcatgaacctgtattcccagc

SEQ ID NO: 610934 - DNA, 25 bp, Homo sapien
gcttgttaaaggcatccgatgcaac

SEQ ID NO: 610935 - DNA, 25 bp, Homo sapien
tgtttagaagaactctccctctgtt

SEQ ID NO: 610936 - DNA, 25 bp, Homo sapien
gaactctccctctgttagtgttgaa

SEQ ID NO: 610937 - DNA, 25 bp, Homo sapien
tctccctctgttagtgttgaagaca

SEQ ID NO: 610938 - DNA, 25 bp, Homo sapien
aagcatatggcctgttctgggacat

SEQ ID NO: 610939 - DNA, 25 bp, Homo sapien
gttctgggacatgcgatctttgcaa

SEQ ID NO: 610940 - DNA, 25 bp, Homo sapien
gcgatctttgcaatccattttttaa

SEQ ID NO: 610941 - DNA, 25 bp, Homo sapien
ggtgtttaccattggcttttagcac

SEQ ID NO: 610942 - DNA, 25 bp, Homo sapien
ttaccattggcttttagcacggatg

SEQ ID NO: 610943 - DNA, 25 bp, Homo sapien
cacactgtccagcaaataccattta

SEQ ID NO: 610944 - DNA, 25 bp, Homo sapien
ataccatttatatgtggcattgaat

SEQ ID NO: 610945 - DNA, 25 bp, Homo sapien
atgaccgcgagtagcgcctgtactt

SEQ ID NO: 610946 - DNA, 25 bp, Homo sapien
ttcgggaacgggacctggacttgct

SEQ ID NO: 610947 - DNA, 25 bp, Homo sapien
gactcctggacgaaaaccggctcga

SEQ ID NO: 610948 - DNA, 25 bp, Homo sapien
gaaaaccggctcgagacgcgggaat

SEQ ID NO: 610949 - DNA, 25 bp, Homo sapien
gaatgggaccgagagcttctggaaa

SEQ ID NO: 610950 - DNA, 25 bp, Homo sapien
tagaccgcgacgacagccggctgga

SEQ ID NO: 610951 - DNA, 25 bp, Homo sapien
gaggtcgagggcgaatccttctcct

SEQ ID NO: 610952 - DNA, 25 bp, Homo sapien
cggccacatgtcgttcgcgtagttg

SEQ ID NO: 610953 - DNA, 25 bp, Homo sapien
tcgcgtagttggacatcttcacctg

SEQ ID NO: 610954 - DNA, 25 bp, Homo sapien
tttagcctgcgctttctccggaaag

SEQ ID NO: 610955 - DNA, 25 bp, Homo sapien
tttctccggaaaggatcccgcaagc

SEQ ID NO: 610956 - DNA, 25 bp, Homo sapien
tggaacatttcagatatatactatg

SEQ ID NO: 610957 - DNA, 25 bp, Homo sapien
attaattcccatgtacccattacct

SEQ ID NO: 610958 - DNA, 25 bp, Homo sapien
taattcccatgtacccattacctgg

SEQ ID NO: 610959 - DNA, 25 bp, Homo sapien
atgtacccattacctggcttcaaaa

SEQ ID NO: 610960 - DNA, 25 bp, Homo sapien
gtacccattacctggcttcaaaaat

SEQ ID NO: 610961 - DNA, 25 bp, Homo sapien
cctggcttcaaaaattatcattttg

SEQ ID NO: 610962 - DNA, 25 bp, Homo sapien
accttctccaccagattcttatgaa

SEQ ID NO: 610963 - DNA, 25 bp, Homo sapien
tctccaccagattcttatgaaaata

SEQ ID NO: 610964 - DNA, 25 bp, Homo sapien
cttatgaaaataaattcctggcatc

SEQ ID NO: 610965 - DNA, 25 bp, Homo sapien
aattcctggcatcatattattttaa

SEQ ID NO: 610966 - DNA, 25 bp, Homo sapien
tcctggcatcatattattttaatca

SEQ ID NO: 610967 - DNA, 25 bp, Homo sapien
ccaaatatactgacccagctgccca

SEQ ID NO: 610968 - DNA, 25 bp, Homo sapien
cagctgcccaccattgaaagactat

SEQ ID NO: 610969 - DNA, 25 bp, Homo sapien
tgcccaccattgaaagactatccat

SEQ ID NO: 610970 - DNA, 25 bp, Homo sapien
agactatccatgacacgatatttct

SEQ ID NO: 610971 - DNA, 25 bp, Homo sapien
acgatatttctatctctttcctggg

SEQ ID NO: 610972 - DNA, 25 bp, Homo sapien
actcatggtcggctcttgcaaggta

SEQ ID NO: 610973 - DNA, 25 bp, Homo sapien
ggtcggctcttgcaaggtaacatct

SEQ ID NO: 610974 - DNA, 25 bp, Homo sapien
ggctcttgcaaggtaacatctgtaa

SEQ ID NO: 610975 - DNA, 25 bp, Homo sapien
caaggtaacatctgtaatgatgctg

SEQ ID NO: 610976 - DNA, 25 bp, Homo sapien
gatgctgttacaaaggctcatgtgg

SEQ ID NO: 610977 - DNA, 25 bp, Homo sapien
ggctcatgtggaaaaggacttcatt

SEQ ID NO: 610978 - DNA, 25 bp, Homo sapien
aaaagtctttgggtacatatatgtg

SEQ ID NO: 610979 - DNA, 25 bp, Homo sapien
aaagtctttgggtacatatatgtga

SEQ ID NO: 610980 - DNA, 25 bp, Homo sapien
agtctttgggtacatatatgtgagt

SEQ ID NO: 610981 - DNA, 25 bp, Homo sapien
gaactgaaaacattagttgtcccca

SEQ ID NO: 610982 - DNA, 25 bp, Homo sapien
actgaaaacattagttgtccccaag

SEQ ID NO: 610983 - DNA, 25 bp, Homo sapien
ctgaaaacattagttgtccccaaga

SEQ ID NO: 610984 - DNA, 25 bp, Homo sapien
tgaaaacattagttgtccccaagaa

SEQ ID NO: 610985 - DNA, 25 bp, Homo sapien
gaaaacattagttgtccccaagaag

SEQ ID NO: 610986 - DNA, 25 bp, Homo sapien
tgtccccaagaagggaactaaattg

SEQ ID NO: 610987 - DNA, 25 bp, Homo sapien
ggaactaaattgttagaggacagga

SEQ ID NO: 610988 - DNA, 25 bp, Homo sapien
gaaaagagatacgtgtgtgtacata

SEQ ID NO: 610989 - DNA, 25 bp, Homo sapien
aatgatggatccacagaaaaaccct

SEQ ID NO: 610990 - DNA, 25 bp, Homo sapien
tacttcgtaacccctaacctgcatg

SEQ ID NO: 610991 - DNA, 25 bp, Homo sapien
taacctgcatggaattctgatcaag

SEQ ID NO: 610992 - DNA, 25 bp, Homo sapien
acctgcatggaattctgatcaagaa

SEQ ID NO: 610993 - DNA, 25 bp, Homo sapien
tgcatggaattctgatcaagaagca

SEQ ID NO: 610994 - DNA, 25 bp, Homo sapien
tcaagaagcaactagttccccagaa

SEQ ID NO: 610995 - DNA, 25 bp, Homo sapien
aagaagcaactagttccccagaagc

SEQ ID NO: 610996 - DNA, 25 bp, Homo sapien
gaagcaactagttccccagaagcag

SEQ ID NO: 610997 - DNA, 25 bp, Homo sapien
aagcaactagttccccagaagcaga

SEQ ID NO: 610998 - DNA, 25 bp, Homo sapien
ccccagaagcagaaagagtagaaaa

SEQ ID NO: 610999 - DNA, 25 bp, Homo sapien
gcagaaagagtagaaaagctccaaa

SEQ ID NO: 611000 - DNA, 25 bp, Homo sapien
tatagctataaatttctccatgttg

SEQ ID NO: 611001 - DNA, 25 bp, Homo sapien
agccgctacacctttcttaaatgac

SEQ ID NO: 611002 - DNA, 25 bp, Homo sapien
gctacacctttcttaaatgactcta

SEQ ID NO: 611003 - DNA, 25 bp, Homo sapien
tgactctaagactgtttacttacag

SEQ ID NO: 611004 - DNA, 25 bp, Homo sapien
tgtttacttacagtcctcagttttt

SEQ ID NO: 611005 - DNA, 25 bp, Homo sapien
ttacttacagtcctcagtttttagt

SEQ ID NO: 611006 - DNA, 25 bp, Homo sapien
tacagtcctcagtttttagtaactt

SEQ ID NO: 611007 - DNA, 25 bp, Homo sapien
gaattactcatttatacacatgcac

SEQ ID NO: 611008 - DNA, 25 bp, Homo sapien
atacacatgcactgttcattcattt

SEQ ID NO: 611009 - DNA, 25 bp, Homo sapien
tgcactgttcattcatttatacaac

SEQ ID NO: 611010 - DNA, 25 bp, Homo sapien
ttcattcatttatacaaccacacat

SEQ ID NO: 611011 - DNA, 25 bp, Homo sapien
aaaaaagcaacctcaggcctgcctc

SEQ ID NO: 611012 - DNA, 25 bp, Homo sapien
cccaccatctcttgcaagttttaat

SEQ ID NO: 611013 - DNA, 25 bp, Homo sapien
ccatctcttgcaagttttaatccag

SEQ ID NO: 611014 - DNA, 25 bp, Homo sapien
agttttaatccagacaagcatatgt

SEQ ID NO: 611015 - DNA, 25 bp, Homo sapien
atccagacaagcatatgtagaggta

SEQ ID NO: 611016 - DNA, 25 bp, Homo sapien
gaagatggaacctaagaattttact

SEQ ID NO: 611017 - DNA, 25 bp, Homo sapien
ccctatctcctatactcagagcaag

SEQ ID NO: 611018 - DNA, 25 bp, Homo sapien
tatctcctatactcagagcaagcat

SEQ ID NO: 611019 - DNA, 25 bp, Homo sapien
tctcctatactcagagcaagcataa

SEQ ID NO: 611020 - DNA, 25 bp, Homo sapien
atattcccatcgaggcatcacataa

SEQ ID NO: 611021 - DNA, 25 bp, Homo sapien
aagggatgcatgagtgctacccata

SEQ ID NO: 611022 - DNA, 25 bp, Homo sapien
gttaaccctcagtggaatcatacat

SEQ ID NO: 611023 - DNA, 25 bp, Homo sapien
atacattcatgttcagtggcatcca

SEQ ID NO: 611024 - DNA, 25 bp, Homo sapien
agtggcatccatccccaggatataa

SEQ ID NO: 611025 - DNA, 25 bp, Homo sapien
gtttgcctagaacttactatctggg

SEQ ID NO: 611026 - DNA, 25 bp, Homo sapien
aggccttttccagcaacatctttct

SEQ ID NO: 611027 - DNA, 25 bp, Homo sapien
acatctttctgggaggagttcgttt

SEQ ID NO: 611028 - DNA, 25 bp, Homo sapien
gaagaacgtggattggatggactct

SEQ ID NO: 611029 - DNA, 25 bp, Homo sapien
aagagcagcgcctttggcagaagat

SEQ ID NO: 611030 - DNA, 25 bp, Homo sapien
gaagatggccaacaaccctggaact

SEQ ID NO: 611031 - DNA, 25 bp, Homo sapien
ctggaactccctttgagggtgtact

SEQ ID NO: 611032 - DNA, 25 bp, Homo sapien
gagggtgtactcatgcttcgttcca

SEQ ID NO: 611033 - DNA, 25 bp, Homo sapien
gtgtgggagttagaaaataaggact

SEQ ID NO: 611034 - DNA, 25 bp, Homo sapien
agaaaataaggactaggcgcctggg

SEQ ID NO: 611035 - DNA, 25 bp, Homo sapien
gaaaataaggactaggcgcctgggc

SEQ ID NO: 611036 - DNA, 25 bp, Homo sapien
aaaataaggactaggcgcctgggcg

SEQ ID NO: 611037 - DNA, 25 bp, Homo sapien
aaataaggactaggcgcctgggcgc

SEQ ID NO: 611038 - DNA, 25 bp, Homo sapien
aataaggactaggcgcctgggcgcg

SEQ ID NO: 611039 - DNA, 25 bp, Homo sapien
ataaggactaggcgcctgggcgcgg

SEQ ID NO: 611040 - DNA, 25 bp, Homo sapien
taaggactaggcgcctgggcgcggt

SEQ ID NO: 611041 - DNA, 25 bp, Homo sapien
aaggactaggcgcctgggcgcggtg

SEQ ID NO: 611042 - DNA, 25 bp, Homo sapien
aggactaggcgcctgggcgcggtgg

SEQ ID NO: 611043 - DNA, 25 bp, Homo sapien
atctatagaggatttgcatcaacat

SEQ ID NO: 611044 - DNA, 25 bp, Homo sapien
gcatcaacatatattctttctattt

SEQ ID NO: 611045 - DNA, 25 bp, Homo sapien
ttttcttttgaaatgcagcatattc

SEQ ID NO: 611046 - DNA, 25 bp, Homo sapien
gcagcatattccaaaaggcttacaa

SEQ ID NO: 611047 - DNA, 25 bp, Homo sapien
caagatagtataaagctgctgggat

SEQ ID NO: 611048 - DNA, 25 bp, Homo sapien
tccctctcttacctgtgataactaa

SEQ ID NO: 611049 - DNA, 25 bp, Homo sapien
tacaaccttggtactaacctggtct

SEQ ID NO: 611050 - DNA, 25 bp, Homo sapien
taacctggtctcaaatctctgtcta

SEQ ID NO: 611051 - DNA, 25 bp, Homo sapien
ggtctcaaatctctgtctataaaca

SEQ ID NO: 611052 - DNA, 25 bp, Homo sapien
gagatttcatggactgctgatcaca

SEQ ID NO: 611053 - DNA, 25 bp, Homo sapien
tggactgctgatcacatttctagag

SEQ ID NO: 611054 - DNA, 25 bp, Homo sapien
tgaagttgacacagacctccatact

SEQ ID NO: 611055 - DNA, 25 bp, Homo sapien
gttgacacagacctccatactttat

SEQ ID NO: 611056 - DNA, 25 bp, Homo sapien
taagttgttggactctagtaccaag

SEQ ID NO: 611057 - DNA, 25 bp, Homo sapien
ataattactgtctgattttcttaca

SEQ ID NO: 611058 - DNA, 25 bp, Homo sapien
gttttccaaggttcttagaagacat

SEQ ID NO: 611059 - DNA, 25 bp, Homo sapien
tggattctcattcatacccttgtat

SEQ ID NO: 611060 - DNA, 25 bp, Homo sapien
catacccttgtataattggaatttt

SEQ ID NO: 611061 - DNA, 25 bp, Homo sapien
aatttttgattcttagctgctacca

SEQ ID NO: 611062 - DNA, 25 bp, Homo sapien
gctgctaccagctagttctctgaag

SEQ ID NO: 611063 - DNA, 25 bp, Homo sapien
aaaatacatgcccatgaccaaatat

SEQ ID NO: 611064 - DNA, 25 bp, Homo sapien
aggcatctgaggcattacaaagtga

SEQ ID NO: 611065 - DNA, 25 bp, Homo sapien
cagctgcctgagagttctcggtgga

SEQ ID NO: 611066 - DNA, 25 bp, Homo sapien
ttctcggtggagaggcccggaatat

SEQ ID NO: 611067 - DNA, 25 bp, Homo sapien
agaggcccggaatatcccacaagaa

SEQ ID NO: 611068 - DNA, 25 bp, Homo sapien
aacaagtctccgttagttccaagtg

SEQ ID NO: 611069 - DNA, 25 bp, Homo sapien
gttccaagtggaatgacagcccttt

SEQ ID NO: 611070 - DNA, 25 bp, Homo sapien
gaatgacagccctttctgagtttcc

SEQ ID NO: 611071 - DNA, 25 bp, Homo sapien
ctgagtttccctgagttgagagcta

SEQ ID NO: 611072 - DNA, 25 bp, Homo sapien
gagctaatacatgtgttgtgggaac

SEQ ID NO: 611073 - DNA, 25 bp, Homo sapien
tgtgggaacaacagcccaagccaaa

SEQ ID NO: 611074 - DNA, 25 bp, Homo sapien
aagccaaaggccacgcggaggccag

SEQ ID NO: 611075 - DNA, 25 bp, Homo sapien
agatccacggatctcatgagctcag

SEQ ID NO: 611076 - DNA, 25 bp, Homo sapien
cccctccagctgaagtatcttcaag

SEQ ID NO: 611077 - DNA, 25 bp, Homo sapien
tatttaaagggccagcaccaattgc

SEQ ID NO: 611078 - DNA, 25 bp, Homo sapien
aaaattagacagtgactgcatgctc

SEQ ID NO: 611079 - DNA, 25 bp, Homo sapien
gactgcatgctcagggaaaggtaca

SEQ ID NO: 611080 - DNA, 25 bp, Homo sapien
ctcagggaaaggtacagctcaaaaa

SEQ ID NO: 611081 - DNA, 25 bp, Homo sapien
ggtacagctcaaaaaagatctggaa

SEQ ID NO: 611082 - DNA, 25 bp, Homo sapien
gatctggaaagaccttaaatttcca

SEQ ID NO: 611083 - DNA, 25 bp, Homo sapien
aaatttccatcttgggttgatcctc

SEQ ID NO: 611084 - DNA, 25 bp, Homo sapien
catcttgggttgatcctctgcacag

SEQ ID NO: 611085 - DNA, 25 bp, Homo sapien
gatcctctgcacagaaacagcctgc

SEQ ID NO: 611086 - DNA, 25 bp, Homo sapien
aacagcctgcaacaatcaaaacaag

SEQ ID NO: 611087 - DNA, 25 bp, Homo sapien
ctgggtacctggctgcccaaaattt

SEQ ID NO: 611088 - DNA, 25 bp, Homo sapien
catttcctggactgcctgcagctaa

SEQ ID NO: 611089 - DNA, 25 bp, Homo sapien
tggactgcctgcagctaactgtggc

SEQ ID NO: 611090 - DNA, 25 bp, Homo sapien
tgcctgcagctaactgtggctacat

SEQ ID NO: 611091 - DNA, 25 bp, Homo sapien
actgtggctacatcacttagttctc

SEQ ID NO: 611092 - DNA, 25 bp, Homo sapien
atcacttagttctcatcagtgagat

SEQ ID NO: 611093 - DNA, 25 bp, Homo sapien
tgtaaatacaagtgttgggcagctg

SEQ ID NO: 611094 - DNA, 25 bp, Homo sapien
gtgttgggcagctgccgcaaataat

SEQ ID NO: 611095 - DNA, 25 bp, Homo sapien
gggcagctgccgcaaataatctcct

SEQ ID NO: 611096 - DNA, 25 bp, Homo sapien
agctgccgcaaataatctccttaag

SEQ ID NO: 611097 - DNA, 25 bp, Homo sapien
tgccgcaaataatctccttaagaga

SEQ ID NO: 611098 - DNA, 25 bp, Homo sapien
gcttttctgctaattgttgaaggcc

SEQ ID NO: 611099 - DNA, 25 bp, Homo sapien
gctaattgttgaaggcccagctgcc

SEQ ID NO: 611100 - DNA, 25 bp, Homo sapien
ggatctacaccccatttgcaatgaa

SEQ ID NO: 611101 - DNA, 25 bp, Homo sapien
ttgcaatgaagccacacatctcgtg

SEQ ID NO: 611102 - DNA, 25 bp, Homo sapien
atgaagccacacatctcgtgagcca

SEQ ID NO: 611103 - DNA, 25 bp, Homo sapien
gggccctaacgcaggatagctctga

SEQ ID NO: 611104 - DNA, 25 bp, Homo sapien
gggacccttgacagtggaggacatt

SEQ ID NO: 611105 - DNA, 25 bp, Homo sapien
ggacattggcccgagaactcttcat

SEQ ID NO: 611106 - DNA, 25 bp, Homo sapien
agaactcttcatcgacctgatcaaa

SEQ ID NO: 611107 - DNA, 25 bp, Homo sapien
agtctgagactcttctcccagttta

SEQ ID NO: 611108 - DNA, 25 bp, Homo sapien
ctcccagtttattatctccctatta

SEQ ID NO: 611109 - DNA, 25 bp, Homo sapien
cactgcgcccggacaaattaacagg

SEQ ID NO: 611110 - DNA, 25 bp, Homo sapien
actgcgcccggacaaattaacaggt

SEQ ID NO: 611111 - DNA, 25 bp, Homo sapien
ctgcgcccggacaaattaacaggtt

SEQ ID NO: 611112 - DNA, 25 bp, Homo sapien
tgcgcccggacaaattaacaggttt

SEQ ID NO: 611113 - DNA, 25 bp, Homo sapien
taacaggtttttattagcaattact

SEQ ID NO: 611114 - DNA, 25 bp, Homo sapien
caggtttttattagcaattacttat

SEQ ID NO: 611115 - DNA, 25 bp, Homo sapien
gtttttattagcaattacttatcct

SEQ ID NO: 611116 - DNA, 25 bp, Homo sapien
ttttattagcaattacttatcctta

SEQ ID NO: 611117 - DNA, 25 bp, Homo sapien
tttattagcaattacttatccttaa

SEQ ID NO: 611118 - DNA, 25 bp, Homo sapien
ttattagcaattacttatccttaaa

SEQ ID NO: 611119 - DNA, 25 bp, Homo sapien
caattacttatccttaaatgaataa

SEQ ID NO: 611120 - DNA, 25 bp, Homo sapien
cctggcgtggtcatccagggtgtac

SEQ ID NO: 611121 - DNA, 25 bp, Homo sapien
cgtggtcatccagggtgtacgcaga

SEQ ID NO: 611122 - DNA, 25 bp, Homo sapien
tcatccagggtgtacgcagacccaa

SEQ ID NO: 611123 - DNA, 25 bp, Homo sapien
ggtgtacgcagacccaagcgccacg

SEQ ID NO: 611124 - DNA, 25 bp, Homo sapien
ttctgcacgctctagagccagctgg

SEQ ID NO: 611125 - DNA, 25 bp, Homo sapien
acgctctagagccagctgggcacaa

SEQ ID NO: 611126 - DNA, 25 bp, Homo sapien
ttggcccggccaccgagtggaacca

SEQ ID NO: 611127 - DNA, 25 bp, Homo sapien
ttctggctggccaacccttctatgg

SEQ ID NO: 611128 - DNA, 25 bp, Homo sapien
ggccaacccttctatgggctgtgga

SEQ ID NO: 611129 - DNA, 25 bp, Homo sapien
caacccttctatgggctgtggacaa

SEQ ID NO: 611130 - DNA, 25 bp, Homo sapien
cttctatgggctgtggacaaggctg

SEQ ID NO: 611131 - DNA, 25 bp, Homo sapien
gaatatttatgaccttagaaaacag

SEQ ID NO: 611132 - DNA, 25 bp, Homo sapien
aaacagtcagttttactttataatg

SEQ ID NO: 611133 - DNA, 25 bp, Homo sapien
tgaagaattgataccttattttctg

SEQ ID NO: 611134 - DNA, 25 bp, Homo sapien
tgtcacttattattgccatcacccc

SEQ ID NO: 611135 - DNA, 25 bp, Homo sapien
gaatttctctatttcggaataggca

SEQ ID NO: 611136 - DNA, 25 bp, Homo sapien
atgtttctttggtatagagcttgct

SEQ ID NO: 611137 - DNA, 25 bp, Homo sapien
atagagcttgcttgtctgtatgcct

SEQ ID NO: 611138 - DNA, 25 bp, Homo sapien
cttgcttgtctgtatgcctgattaa

SEQ ID NO: 611139 - DNA, 25 bp, Homo sapien
gcttgtctgtatgcctgattaaaga

SEQ ID NO: 611140 - DNA, 25 bp, Homo sapien
gtatgcctgattaaagactgtaaga

SEQ ID NO: 611141 - DNA, 25 bp, Homo sapien
gaagatattattggctttatgttta

SEQ ID NO: 611142 - DNA, 25 bp, Homo sapien
actggcgcacgatgtagggcacctt

SEQ ID NO: 611143 - DNA, 25 bp, Homo sapien
ctggcgcacgatgtagggcaccttg

SEQ ID NO: 611144 - DNA, 25 bp, Homo sapien
gcgcacgatgtagggcaccttggac

SEQ ID NO: 611145 - DNA, 25 bp, Homo sapien
tgttctcagtgtcctaacagccctg

SEQ ID NO: 611146 - DNA, 25 bp, Homo sapien
agtgtcctaacagccctgcttgggc

SEQ ID NO: 611147 - DNA, 25 bp, Homo sapien
taacagccctgcttgggccataaca

SEQ ID NO: 611148 - DNA, 25 bp, Homo sapien
tgcttgggccataacacaggagacc

SEQ ID NO: 611149 - DNA, 25 bp, Homo sapien
ttgggccataacacaggagacctgc

SEQ ID NO: 611150 - DNA, 25 bp, Homo sapien
ataacacaggagacctgctccctat

SEQ ID NO: 611151 - DNA, 25 bp, Homo sapien
ggctgcacacagagccttctgcatg

SEQ ID NO: 611152 - DNA, 25 bp, Homo sapien
gcacacagagccttctgcatgcctg

SEQ ID NO: 611153 - DNA, 25 bp, Homo sapien
aatgataaagaacccactcccaaat

SEQ ID NO: 611154 - DNA, 25 bp, Homo sapien
gataaagaacccactcccaaataag

SEQ ID NO: 611155 - DNA, 25 bp, Homo sapien
gaacccactcccaaataagagtctg

SEQ ID NO: 611156 - DNA, 25 bp, Homo sapien
ataagagtctgccacattgctttaa

SEQ ID NO: 611157 - DNA, 25 bp, Homo sapien
gagtctgccacattgctttaaggag

SEQ ID NO: 611158 - DNA, 25 bp, Homo sapien
gccacattgctttaaggagcgcaga

SEQ ID NO: 611159 - DNA, 25 bp, Homo sapien
taaggagcgcagaattgtcatgaaa

SEQ ID NO: 611160 - DNA, 25 bp, Homo sapien
aatttcatcgaaagggctaatcaca

SEQ ID NO: 611161 - DNA, 25 bp, Homo sapien
ggctaatcacaataagttgacctcg

SEQ ID NO: 611162 - DNA, 25 bp, Homo sapien
ataagttgacctcgaagaaaatcac

SEQ ID NO: 611163 - DNA, 25 bp, Homo sapien
gtcagtgattgaagggacacactac

SEQ ID NO: 611164 - DNA, 25 bp, Homo sapien
aagcaagcaaattaaaagcactgag

SEQ ID NO: 611165 - DNA, 25 bp, Homo sapien
acacattatgtatacagcagaagta

SEQ ID NO: 611166 - DNA, 25 bp, Homo sapien
gtatacagcagaagtaaatctttaa

SEQ ID NO: 611167 - DNA, 25 bp, Homo sapien
gaaataaactaatattgcttccata

SEQ ID NO: 611168 - DNA, 25 bp, Homo sapien
aactaatattgcttccataattcag

SEQ ID NO: 611169 - DNA, 25 bp, Homo sapien
ctaatattgcttccataattcagag

SEQ ID NO: 611170 - DNA, 25 bp, Homo sapien
taatattgcttccataattcagaga

SEQ ID NO: 611171 - DNA, 25 bp, Homo sapien
atattgcttccataattcagagaat

SEQ ID NO: 611172 - DNA, 25 bp, Homo sapien
attgcttccataattcagagaatgt

SEQ ID NO: 611173 - DNA, 25 bp, Homo sapien
tgcttccataattcagagaatgtgg

SEQ ID NO: 611174 - DNA, 25 bp, Homo sapien
gataaaagtaaagaattaggccaga

SEQ ID NO: 611175 - DNA, 25 bp, Homo sapien
gaagtcatccaccaagcgtttaaga

SEQ ID NO: 611176 - DNA, 25 bp, Homo sapien
aggttctaaactctgtcttccgaca

SEQ ID NO: 611177 - DNA, 25 bp, Homo sapien
gacatctggatgaagtagccgctac

SEQ ID NO: 611178 - DNA, 25 bp, Homo sapien
gagatggccagattgctgtctgata

SEQ ID NO: 611179 - DNA, 25 bp, Homo sapien
tgctgcgctggctcaaggtgaactt

SEQ ID NO: 611180 - DNA, 25 bp, Homo sapien
agtgaagccttcattgcctggatcc

SEQ ID NO: 611181 - DNA, 25 bp, Homo sapien
tggatccacatcaaggccctgagag

SEQ ID NO: 611182 - DNA, 25 bp, Homo sapien
agagtgtttgtggagtccgtgctca

SEQ ID NO: 611183 - DNA, 25 bp, Homo sapien
tccgtgctcaggtatggactaccag

SEQ ID NO: 611184 - DNA, 25 bp, Homo sapien
tgaacttccaggcagtgctcctgca

SEQ ID NO: 611185 - DNA, 25 bp, Homo sapien
agtgctcctgcagccgcataagaag

SEQ ID NO: 611186 - DNA, 25 bp, Homo sapien
agcagtctggccatagctttgctgc

SEQ ID NO: 611187 - DNA, 25 bp, Homo sapien
agtctggccatagctttgctgcact

SEQ ID NO: 611188 - DNA, 25 bp, Homo sapien
tctggccatagctttgctgcactgc

SEQ ID NO: 611189 - DNA, 25 bp, Homo sapien
ggccatagctttgctgcactgcgca

SEQ ID NO: 611190 - DNA, 25 bp, Homo sapien
atagctttgctgcactgcgcacttc

SEQ ID NO: 611191 - DNA, 25 bp, Homo sapien
agctttgctgcactgcgcacttctc

SEQ ID NO: 611192 - DNA, 25 bp, Homo sapien
aaatctgcacatgggacccctgaat

SEQ ID NO: 611193 - DNA, 25 bp, Homo sapien
atctgcacatgggacccctgaatgt

SEQ ID NO: 611194 - DNA, 25 bp, Homo sapien
ctgcacatgggacccctgaatgtaa

SEQ ID NO: 611195 - DNA, 25 bp, Homo sapien
cacatgggacccctgaatgtaaaat

SEQ ID NO: 611196 - DNA, 25 bp, Homo sapien
catgggacccctgaatgtaaaatta

SEQ ID NO: 611197 - DNA, 25 bp, Homo sapien
tatgtattattctgtggccttggac

SEQ ID NO: 611198 - DNA, 25 bp, Homo sapien
ggccttggacaagtatggaaccatt

SEQ ID NO: 611199 - DNA, 25 bp, Homo sapien
cagctacacctgcaaagtctcaata

SEQ ID NO: 611200 - DNA, 25 bp, Homo sapien
gtctcaataatacactccagggata

SEQ ID NO: 611201 - DNA, 25 bp, Homo sapien
tacactccagggatagaccttgcag

SEQ ID NO: 611202 - DNA, 25 bp, Homo sapien
gaccttgcagagtgttgtgagattt

SEQ ID NO: 611203 - DNA, 25 bp, Homo sapien
gcaccaagcatgcttaggtcatggt

SEQ ID NO: 611204 - DNA, 25 bp, Homo sapien
ggtcatggtagatgccttgttacta

SEQ ID NO: 611205 - DNA, 25 bp, Homo sapien
gttactagtagctttattcttgctg

SEQ ID NO: 611206 - DNA, 25 bp, Homo sapien
attcttgctgttattaatgccatta

SEQ ID NO: 611207 - DNA, 25 bp, Homo sapien
tgtggttggtattatctgtgctttc

SEQ ID NO: 611208 - DNA, 25 bp, Homo sapien
gttcaatgccgttaactccgggcct

SEQ ID NO: 611209 - DNA, 25 bp, Homo sapien
caatgccgttaactccgggcctggg

SEQ ID NO: 611210 - DNA, 25 bp, Homo sapien
tccgggcctgggtaaaagactcaag

SEQ ID NO: 611211 - DNA, 25 bp, Homo sapien
ggcctgggtaaaagactcaagtcct

SEQ ID NO: 611212 - DNA, 25 bp, Homo sapien
taaaagactcaagtcctgaccccat

SEQ ID NO: 611213 - DNA, 25 bp, Homo sapien
atcatactccaaccaatacataccc

SEQ ID NO: 611214 - DNA, 25 bp, Homo sapien
gcctgcgctgtctgcgcctgggtct

SEQ ID NO: 611215 - DNA, 25 bp, Homo sapien
gcctgggtctcttcaaccgcagtga

SEQ ID NO: 611216 - DNA, 25 bp, Homo sapien
tgggtctcttcaaccgcagtgagcg

SEQ ID NO: 611217 - DNA, 25 bp, Homo sapien
tcttcaaccgcagtgagcggtcgca

SEQ ID NO: 611218 - DNA, 25 bp, Homo sapien
cgcagtgagcggtcgcacggctcca

SEQ ID NO: 611219 - DNA, 25 bp, Homo sapien
ggttctgtgttcactgatacatccc

SEQ ID NO: 611220 - DNA, 25 bp, Homo sapien
tgttcactgatacatccccttcctt

SEQ ID NO: 611221 - DNA, 25 bp, Homo sapien
ccttcaccgggctcatgaaaagaaa

SEQ ID NO: 611222 - DNA, 25 bp, Homo sapien
ctgttgatgtgattctctaggttac

SEQ ID NO: 611223 - DNA, 25 bp, Homo sapien
gattctctaggttactacctttctt

SEQ ID NO: 611224 - DNA, 25 bp, Homo sapien
tttcttcctgctgcaaatgctgcat

SEQ ID NO: 611225 - DNA, 25 bp, Homo sapien
gcaaatgctgcatgacactaagctt

SEQ ID NO: 611226 - DNA, 25 bp, Homo sapien
gacactaagcttacaggatctagaa

SEQ ID NO: 611227 - DNA, 25 bp, Homo sapien
agactgaagaaacactaggctgatc

SEQ ID NO: 611228 - DNA, 25 bp, Homo sapien
ctaggctgatcttaagtttccgaaa

SEQ ID NO: 611229 - DNA, 25 bp, Homo sapien
taagtttccgaaatacactctgtaa

SEQ ID NO: 611230 - DNA, 25 bp, Homo sapien
catttcttttcacgccaagtccatt

SEQ ID NO: 611231 - DNA, 25 bp, Homo sapien
aagtccattcccctgttaacagttg

SEQ ID NO: 611232 - DNA, 25 bp, Homo sapien
tgttaacagttgcttcccagtttcc

SEQ ID NO: 611233 - DNA, 25 bp, Homo sapien
agttgcttcccagtttcctgcacag

SEQ ID NO: 611234 - DNA, 25 bp, Homo sapien
tgcacagctgcatggtctgggacac

SEQ ID NO: 611235 - DNA, 25 bp, Homo sapien
gcatggtctgggacacttaaagaaa

SEQ ID NO: 611236 - DNA, 25 bp, Homo sapien
cacaggaaatcagtgttcttggtat

SEQ ID NO: 611237 - DNA, 25 bp, Homo sapien
aatgcatcttgccaagacttgaaga

SEQ ID NO: 611238 - DNA, 25 bp, Homo sapien
accagaggccttgaatactcagaaa

SEQ ID NO: 611239 - DNA, 25 bp, Homo sapien
gaggatatctatgaaccttgacatt

SEQ ID NO: 611240 - DNA, 25 bp, Homo sapien
ttgacatttcttttcacgccaagtc

SEQ ID NO: 611241 - DNA, 25 bp, Homo sapien
accatgggcggcaacgctgaaggac

SEQ ID NO: 611242 - DNA, 25 bp, Homo sapien
gcaacgctgaaggacagccctgcaa

SEQ ID NO: 611243 - DNA, 25 bp, Homo sapien
ctgcaagtttccattccgcttccag

SEQ ID NO: 611244 - DNA, 25 bp, Homo sapien
gcttccagggcacatcctatgacag

SEQ ID NO: 611245 - DNA, 25 bp, Homo sapien
agggcacatcctatgacagctgcac

SEQ ID NO: 611246 - DNA, 25 bp, Homo sapien
atcctatgacagctgcaccactgag

SEQ ID NO: 611247 - DNA, 25 bp, Homo sapien
atgacagctgcaccactgagggccg

SEQ ID NO: 611248 - DNA, 25 bp, Homo sapien
actgagggccgcacggatggctacc

SEQ ID NO: 611249 - DNA, 25 bp, Homo sapien
tggtgcggcaccactgaggactacg

SEQ ID NO: 611250 - DNA, 25 bp, Homo sapien
actgaggactacgaccgcgacaaga

SEQ ID NO: 611251 - DNA, 25 bp, Homo sapien
acgaccgcgacaagaagtatggctt

SEQ ID NO: 611252 - DNA, 25 bp, Homo sapien
acggtcagtcatgtacgttcacaca

SEQ ID NO: 611253 - DNA, 25 bp, Homo sapien
gtcagtcatgtacgttcacacactt

SEQ ID NO: 611254 - DNA, 25 bp, Homo sapien
agtcatgtacgttcacacacttggt

SEQ ID NO: 611255 - DNA, 25 bp, Homo sapien
tcatgtacgttcacacacttggtct

SEQ ID NO: 611256 - DNA, 25 bp, Homo sapien
atgtacgttcacacacttggtcttc

SEQ ID NO: 611257 - DNA, 25 bp, Homo sapien
tacgttcacacacttggtcttcttt

SEQ ID NO: 611258 - DNA, 25 bp, Homo sapien
cgttcacacacttggtcttctttct

SEQ ID NO: 611259 - DNA, 25 bp, Homo sapien
caccaccaccctctaaggtaaatgt

SEQ ID NO: 611260 - DNA, 25 bp, Homo sapien
accaccctctaaggtaaatgtcatt

SEQ ID NO: 611261 - DNA, 25 bp, Homo sapien
ccctctaaggtaaatgtcattatct

SEQ ID NO: 611262 - DNA, 25 bp, Homo sapien
aaatgtcattatctcattttttcag

SEQ ID NO: 611263 - DNA, 25 bp, Homo sapien
gaaggggcaaggcccttcttggtca

SEQ ID NO: 611264 - DNA, 25 bp, Homo sapien
aaggggcaaggcccttcttggtcag

SEQ ID NO: 611265 - DNA, 25 bp, Homo sapien
aggggcaaggcccttcttggtcagc

SEQ ID NO: 611266 - DNA, 25 bp, Homo sapien
ggggcaaggcccttcttggtcagca

SEQ ID NO: 611267 - DNA, 25 bp, Homo sapien
gggcaaggcccttcttggtcagcag

SEQ ID NO: 611268 - DNA, 25 bp, Homo sapien
ggcaaggcccttcttggtcagcagg

SEQ ID NO: 611269 - DNA, 25 bp, Homo sapien
gcaaggcccttcttggtcagcaggg

SEQ ID NO: 611270 - DNA, 25 bp, Homo sapien
caaggcccttcttggtcagcaggga

SEQ ID NO: 611271 - DNA, 25 bp, Homo sapien
aaggcccttcttggtcagcagggat

SEQ ID NO: 611272 - DNA, 25 bp, Homo sapien
aggcccttcttggtcagcagggata

SEQ ID NO: 611273 - DNA, 25 bp, Homo sapien
ggcccttcttggtcagcagggataa

SEQ ID NO: 611274 - DNA, 25 bp, Homo sapien
acagcttggagcttagaagcaagtg

SEQ ID NO: 611275 - DNA, 25 bp, Homo sapien
gttcatctctttcactggctcataa

SEQ ID NO: 611276 - DNA, 25 bp, Homo sapien
tggctcataattttgcaacggcggt

SEQ ID NO: 611277 - DNA, 25 bp, Homo sapien
tttgcaacggcggtttcatctctac

SEQ ID NO: 611278 - DNA, 25 bp, Homo sapien
gcggtttcatctctaccctgacaat

SEQ ID NO: 611279 - DNA, 25 bp, Homo sapien
gacttaattgaagacctcagacgga

SEQ ID NO: 611280 - DNA, 25 bp, Homo sapien
tgaagacctcagacggacagcataa

SEQ ID NO: 611281 - DNA, 25 bp, Homo sapien
agacggacagcataacacggaacct

SEQ ID NO: 611282 - DNA, 25 bp, Homo sapien
taacacggaacctgagaccttgatt

SEQ ID NO: 611283 - DNA, 25 bp, Homo sapien
ggacaggcttaaagtgtattctgga

SEQ ID NO: 611284 - DNA, 25 bp, Homo sapien
taaagtgtattctggagttggtgcc

SEQ ID NO: 611285 - DNA, 25 bp, Homo sapien
aattgttagaaagcagataccatca

SEQ ID NO: 611286 - DNA, 25 bp, Homo sapien
gataccatcaaattggttctgggaa

SEQ ID NO: 611287 - DNA, 25 bp, Homo sapien
ccatcaaattggttctgggaagtgt

SEQ ID NO: 611288 - DNA, 25 bp, Homo sapien
ttctgggaagtgtgaaatcaaagtt

SEQ ID NO: 611289 - DNA, 25 bp, Homo sapien
gtgaaatcaaagttgcacaacccaa

SEQ ID NO: 611290 - DNA, 25 bp, Homo sapien
aaagttgcacaacccaaagaggtat

SEQ ID NO: 611291 - DNA, 25 bp, Homo sapien
gttgcacaacccaaagaggtatata

SEQ ID NO: 611292 - DNA, 25 bp, Homo sapien
aaagaggtatataggcagcaacagc

SEQ ID NO: 611293 - DNA, 25 bp, Homo sapien
ggtggcaatcaccaaaacaattacc

SEQ ID NO: 611294 - DNA, 25 bp, Homo sapien
aaacaattaccagccatactaaagg

SEQ ID NO: 611295 - DNA, 25 bp, Homo sapien
ttaccagccatactaaaggagaaca

SEQ ID NO: 611296 - DNA, 25 bp, Homo sapien
ctaaggccatactgggagctgctcc

SEQ ID NO: 611297 - DNA, 25 bp, Homo sapien
gatcacccggagtctggaaagcgct

SEQ ID NO: 611298 - DNA, 25 bp, Homo sapien
gtctggaaagcgctcctggtgtccc

SEQ ID NO: 611299 - DNA, 25 bp, Homo sapien
agaccatgtcccatcgttgttgaaa

SEQ ID NO: 611300 - DNA, 25 bp, Homo sapien
tgtcccatcgttgttgaaaaaatat

SEQ ID NO: 611301 - DNA, 25 bp, Homo sapien
taccatggccggctatcagatcctg

SEQ ID NO: 611302 - DNA, 25 bp, Homo sapien
gctatcagatcctgggctgcaggaa

SEQ ID NO: 611303 - DNA, 25 bp, Homo sapien
tcacagtgaagctcctgccttcagc

SEQ ID NO: 611304 - DNA, 25 bp, Homo sapien
tgccttcagcagatcctactacttg

SEQ ID NO: 611305 - DNA, 25 bp, Homo sapien
agatcctactacttgccgccattct

SEQ ID NO: 611306 - DNA, 25 bp, Homo sapien
cattctcccccatcacatgaaaaaa

SEQ ID NO: 611307 - DNA, 25 bp, Homo sapien
aagctcaagcttgtgtggtacaaga

SEQ ID NO: 611308 - DNA, 25 bp, Homo sapien
gtatgcaattgacactgattcctac

SEQ ID NO: 611309 - DNA, 25 bp, Homo sapien
tgacactgattcctaccaacgatat

SEQ ID NO: 611310 - DNA, 25 bp, Homo sapien
gatatccaaatcttagcatgagcag

SEQ ID NO: 611311 - DNA, 25 bp, Homo sapien
aactaaagcagcgtttttcctgcaa

SEQ ID NO: 611312 - DNA, 25 bp, Homo sapien
gtttttcctgcaagtgggcgcactg

SEQ ID NO: 611313 - DNA, 25 bp, Homo sapien
actgcgtatcccctgcgggaaagac

SEQ ID NO: 611314 - DNA, 25 bp, Homo sapien
ggaaagaccacgctggctgctgacc

SEQ ID NO: 611315 - DNA, 25 bp, Homo sapien
tggctgctgaccaaactccactggc

SEQ ID NO: 611316 - DNA, 25 bp, Homo sapien
atcttcctccatcctgagggcatct

SEQ ID NO: 611317 - DNA, 25 bp, Homo sapien
gcccgaggctgagaactgagttcca

SEQ ID NO: 611318 - DNA, 25 bp, Homo sapien
aactggctaccagcttcagaaatgt

SEQ ID NO: 611319 - DNA, 25 bp, Homo sapien
ctggctaccagcttcagaaatgtgt

SEQ ID NO: 611320 - DNA, 25 bp, Homo sapien
cagcttcagaaatgtgttacttatg

SEQ ID NO: 611321 - DNA, 25 bp, Homo sapien
cagaaatgtgttacttatgttcaag

SEQ ID NO: 611322 - DNA, 25 bp, Homo sapien
tggatttggcatatagtcatctata

SEQ ID NO: 611323 - DNA, 25 bp, Homo sapien
cctgcagatgccaaaatacatggat

SEQ ID NO: 611324 - DNA, 25 bp, Homo sapien
aaatacatggatgcccaagtcctca

SEQ ID NO: 611325 - DNA, 25 bp, Homo sapien
atggatgcccaagtcctcagctaaa

SEQ ID NO: 611326 - DNA, 25 bp, Homo sapien
gatgcccaagtcctcagctaaaaat

SEQ ID NO: 611327 - DNA, 25 bp, Homo sapien
tgcccaagtcctcagctaaaaatag

SEQ ID NO: 611328 - DNA, 25 bp, Homo sapien
agtcctcagctaaaaatagcgtagt

SEQ ID NO: 611329 - DNA, 25 bp, Homo sapien
gacggataaaatcattattacctaa

SEQ ID NO: 611330 - DNA, 25 bp, Homo sapien
tattacctaaactatcttgtggagt

SEQ ID NO: 611331 - DNA, 25 bp, Homo sapien
tacctaaactatcttgtggagttaa

SEQ ID NO: 611332 - DNA, 25 bp, Homo sapien
ggagttaaaaacagaatgcacattc

SEQ ID NO: 611333 - DNA, 25 bp, Homo sapien
cagaatgcacattcgaaggaaacga

SEQ ID NO: 611334 - DNA, 25 bp, Homo sapien
ttgtgggaggaaagcgagcacaact

SEQ ID NO: 611335 - DNA, 25 bp, Homo sapien
tatttttaaaggtctccacagagtt

SEQ ID NO: 611336 - DNA, 25 bp, Homo sapien
gtctccacagagtttatgccatatt

SEQ ID NO: 611337 - DNA, 25 bp, Homo sapien
atgaagttggctgtgcaggctttgc

SEQ ID NO: 611338 - DNA, 25 bp, Homo sapien
aagttggctgtgcaggctttgcatc

SEQ ID NO: 611339 - DNA, 25 bp, Homo sapien
gcaggctttgcatctgtggctcaag

SEQ ID NO: 611340 - DNA, 25 bp, Homo sapien
attgtttcaacttccctatatgtag

SEQ ID NO: 611341 - DNA, 25 bp, Homo sapien
tatgtagggcatttcacaacaaaat

SEQ ID NO: 611342 - DNA, 25 bp, Homo sapien
aatctgacttagtttgctctccaaa

SEQ ID NO: 611343 - DNA, 25 bp, Homo sapien
gtttgctctccaaaatgtactttta

SEQ ID NO: 611344 - DNA, 25 bp, Homo sapien
gctgatctggatagtgaggcttaaa

SEQ ID NO: 611345 - DNA, 25 bp, Homo sapien
ggcttaaagtgtcccattgccatta

SEQ ID NO: 611346 - DNA, 25 bp, Homo sapien
gtgtcccattgccattagactcatg

SEQ ID NO: 611347 - DNA, 25 bp, Homo sapien
ttgccattagactcatgggtccctt

SEQ ID NO: 611348 - DNA, 25 bp, Homo sapien
atgggtcccttgtgcaaaataactt

SEQ ID NO: 611349 - DNA, 25 bp, Homo sapien
aaaaggagggattatatttgcacat

SEQ ID NO: 611350 - DNA, 25 bp, Homo sapien
tttgcacatgcacatgcgtatgcct

SEQ ID NO: 611351 - DNA, 25 bp, Homo sapien
tactactgggtacctttgctgacag

SEQ ID NO: 611352 - DNA, 25 bp, Homo sapien
acctttgctgacagtcatttttggg

SEQ ID NO: 611353 - DNA, 25 bp, Homo sapien
gctgacagtcatttttgggtcttac

SEQ ID NO: 611354 - DNA, 25 bp, Homo sapien
acagtcatttttgggtcttacctga

SEQ ID NO: 611355 - DNA, 25 bp, Homo sapien
gtcatttttgggtcttacctgattg

SEQ ID NO: 611356 - DNA, 25 bp, Homo sapien
atttttgggtcttacctgattgcac

SEQ ID NO: 611357 - DNA, 25 bp, Homo sapien
ttgggtcttacctgattgcacatgg

SEQ ID NO: 611358 - DNA, 25 bp, Homo sapien
ggtcttacctgattgcacatgggtt

SEQ ID NO: 611359 - DNA, 25 bp, Homo sapien
tacctgattgcacatgggttcttca

SEQ ID NO: 611360 - DNA, 25 bp, Homo sapien
ctgattgcacatgggttcttcagcg

SEQ ID NO: 611361 - DNA, 25 bp, Homo sapien
gcaatgtgtgttgaaacaattttca

SEQ ID NO: 611362 - DNA, 25 bp, Homo sapien
tttcactcttagctcactgattgga

SEQ ID NO: 611363 - DNA, 25 bp, Homo sapien
actcttagctcactgattggaaaac

SEQ ID NO: 611364 - DNA, 25 bp, Homo sapien
tttgctctgtttgatatcctcacta

SEQ ID NO: 611365 - DNA, 25 bp, Homo sapien
gctctgtttgatatcctcactatta

SEQ ID NO: 611366 - DNA, 25 bp, Homo sapien
gatatcctcactattatggaataca

SEQ ID NO: 611367 - DNA, 25 bp, Homo sapien
ttatggaatacattgtgcagctaaa

SEQ ID NO: 611368 - DNA, 25 bp, Homo sapien
gcgcctagtggacattcatgaatgt

SEQ ID NO: 611369 - DNA, 25 bp, Homo sapien
gtggacattcatgaatgtgtactac

SEQ ID NO: 611370 - DNA, 25 bp, Homo sapien
ccgaaagaacacttgttggatttct

SEQ ID NO: 611371 - DNA, 25 bp, Homo sapien
tgttttctatagtagatctttgaaa

SEQ ID NO: 611372 - DNA, 25 bp, Homo sapien
ggtataatactgcatttctcagtgt

SEQ ID NO: 611373 - DNA, 25 bp, Homo sapien
tgttgatttcttccgcctggttcca

SEQ ID NO: 611374 - DNA, 25 bp, Homo sapien
atttcttccgcctggttccatttat

SEQ ID NO: 611375 - DNA, 25 bp, Homo sapien
ttccgcctggttccatttatggtgt

SEQ ID NO: 611376 - DNA, 25 bp, Homo sapien
cgcctggttccatttatggtgttct

SEQ ID NO: 611377 - DNA, 25 bp, Homo sapien
atggtgttcttaattgtacccttca

SEQ ID NO: 611378 - DNA, 25 bp, Homo sapien
gtgttcttaattgtacccttcatgg

SEQ ID NO: 611379 - DNA, 25 bp, Homo sapien
cttaattgtacccttcatggaattc

SEQ ID NO: 611380 - DNA, 25 bp, Homo sapien
ggaattcttattaccagtgtttctg

SEQ ID NO: 611381 - DNA, 25 bp, Homo sapien
cttattaccagtgtttctgaaactc

SEQ ID NO: 611382 - DNA, 25 bp, Homo sapien
ccatcccaatttctcctgtaattaa

SEQ ID NO: 611383 - DNA, 25 bp, Homo sapien
tgcattagtgtgctatatttgtaat

SEQ ID NO: 611384 - DNA, 25 bp, Homo sapien
caggtcactctcagggattcaggga

SEQ ID NO: 611385 - DNA, 25 bp, Homo sapien
gtcactctcagggattcagggaaaa

SEQ ID NO: 611386 - DNA, 25 bp, Homo sapien
ttcagggaaaataagcattgtgtct

SEQ ID NO: 611387 - DNA, 25 bp, Homo sapien
agaaaggccaagttctgggcatgtg

SEQ ID NO: 611388 - DNA, 25 bp, Homo sapien
gctgcaggcatgtcttacgggacag

SEQ ID NO: 611389 - DNA, 25 bp, Homo sapien
tgtcttacgggacagagacagcccc

SEQ ID NO: 611390 - DNA, 25 bp, Homo sapien
gaggactggcctcccgataactctg

SEQ ID NO: 611391 - DNA, 25 bp, Homo sapien
tggcctcccgataactctgttctgc

SEQ ID NO: 611392 - DNA, 25 bp, Homo sapien
tgttctgcctggagtgtccttgtgc

SEQ ID NO: 611393 - DNA, 25 bp, Homo sapien
gtgtccttgtgctggacttcctcca

SEQ ID NO: 611394 - DNA, 25 bp, Homo sapien
gggtcagctaccttggattcctcct

SEQ ID NO: 611395 - DNA, 25 bp, Homo sapien
atgaatgcctggcaccctatatctg

SEQ ID NO: 611396 - DNA, 25 bp, Homo sapien
cctggcaccctatatctgtgtgtgt

SEQ ID NO: 611397 - DNA, 25 bp, Homo sapien
agggtcatagagctcctcaaagcag

SEQ ID NO: 611398 - DNA, 25 bp, Homo sapien
gtctttgtgcctcctaccctagagc

SEQ ID NO: 611399 - DNA, 25 bp, Homo sapien
cctagagcccagcatagcacttgtc

SEQ ID NO: 611400 - DNA, 25 bp, Homo sapien
tagcacttgtcccatagtgagccct

SEQ ID NO: 611401 - DNA, 25 bp, Homo sapien
tgtcccatagtgagccctcaacaaa

SEQ ID NO: 611402 - DNA, 25 bp, Homo sapien
gatggcaatcaatgctccatcctgc

SEQ ID NO: 611403 - DNA, 25 bp, Homo sapien
ctggacacaacacccaacagttgct

SEQ ID NO: 611404 - DNA, 25 bp, Homo sapien
acccaacagttgctcaagggccagt

SEQ ID NO: 611405 - DNA, 25 bp, Homo sapien
gggccagtgtggcattcttacttaa

SEQ ID NO: 611406 - DNA, 25 bp, Homo sapien
atcgtggatatcacctccaagtgtt

SEQ ID NO: 611407 - DNA, 25 bp, Homo sapien
ccaagtgttaggtaaggagcatcat

SEQ ID NO: 611408 - DNA, 25 bp, Homo sapien
ttgaggtatttcacatcaccagatt

SEQ ID NO: 611409 - DNA, 25 bp, Homo sapien
tgtgacggaaacaaatgtctctctg

SEQ ID NO: 611410 - DNA, 25 bp, Homo sapien
gtctctctgaattccatatgcttta

SEQ ID NO: 611411 - DNA, 25 bp, Homo sapien
tttcctctctgcagttacacctgaa

SEQ ID NO: 611412 - DNA, 25 bp, Homo sapien
gttacacctgaagtgaccctgtttc

SEQ ID NO: 611413 - DNA, 25 bp, Homo sapien
agggaagccagctgcgcatatctcc

SEQ ID NO: 611414 - DNA, 25 bp, Homo sapien
tcctggatcccagagggcgattgtg

SEQ ID NO: 611415 - DNA, 25 bp, Homo sapien
ggcgattgtgccactaagcaagaat

SEQ ID NO: 611416 - DNA, 25 bp, Homo sapien
gcaagaatactggagcaatggcaca

SEQ ID NO: 611417 - DNA, 25 bp, Homo sapien
ccgttggtgcagaccaagcatccag

SEQ ID NO: 611418 - DNA, 25 bp, Homo sapien
cgttggtgcagaccaagcatccagt

SEQ ID NO: 611419 - DNA, 25 bp, Homo sapien
gttggtgcagaccaagcatccagtg

SEQ ID NO: 611420 - DNA, 25 bp, Homo sapien
ttggtgcagaccaagcatccagtgg

SEQ ID NO: 611421 - DNA, 25 bp, Homo sapien
tggtgcagaccaagcatccagtggg

SEQ ID NO: 611422 - DNA, 25 bp, Homo sapien
ggtgcagaccaagcatccagtggga

SEQ ID NO: 611423 - DNA, 25 bp, Homo sapien
gtgcagaccaagcatccagtgggaa

SEQ ID NO: 611424 - DNA, 25 bp, Homo sapien
tgcagaccaagcatccagtgggaac

SEQ ID NO: 611425 - DNA, 25 bp, Homo sapien
gcagaccaagcatccagtgggaaca

SEQ ID NO: 611426 - DNA, 25 bp, Homo sapien
agaccaagcatccagtgggaacaca

SEQ ID NO: 611427 - DNA, 25 bp, Homo sapien
gaccaagcatccagtgggaacacac

SEQ ID NO: 611428 - DNA, 25 bp, Homo sapien
tactggagcaatggcacagtgactg

SEQ ID NO: 611429 - DNA, 25 bp, Homo sapien
catcgtggatatcacctccaagtgt

SEQ ID NO: 611430 - DNA, 25 bp, Homo sapien
cgtggatatcacctccaagtgttag

SEQ ID NO: 611431 - DNA, 25 bp, Homo sapien
gttacacctgaagtgaccctgtttc

SEQ ID NO: 611432 - DNA, 25 bp, Homo sapien
acaggaatagaactgcagtatgcaa

SEQ ID NO: 611433 - DNA, 25 bp, Homo sapien
gaatagaactgcagtatgcaaggca

SEQ ID NO: 611434 - DNA, 25 bp, Homo sapien
atgcaaggcagttgcagggaagcca

SEQ ID NO: 611435 - DNA, 25 bp, Homo sapien
tcctggatcccagagggcgattgtg

SEQ ID NO: 611436 - DNA, 25 bp, Homo sapien
ctggatcccagagggcgattgtgcc

SEQ ID NO: 611437 - DNA, 25 bp, Homo sapien
gccactaagcaagaatactggagca

SEQ ID NO: 611438 - DNA, 25 bp, Homo sapien
gcaagaatactggagcaatggcaca

SEQ ID NO: 611439 - DNA, 25 bp, Homo sapien
tgcatctggctaagcacaaagtaaa

SEQ ID NO: 611440 - DNA, 25 bp, Homo sapien
agtaaatggctaatgtccaatgcag

SEQ ID NO: 611441 - DNA, 25 bp, Homo sapien
tgcagggaataacccttcccaaatt

SEQ ID NO: 611442 - DNA, 25 bp, Homo sapien
aaatacagctgtttccacatctaac

SEQ ID NO: 611443 - DNA, 25 bp, Homo sapien
atctaactatcaccaaagctttctg

SEQ ID NO: 611444 - DNA, 25 bp, Homo sapien
acacagggaagggttaacgccacat

SEQ ID NO: 611445 - DNA, 25 bp, Homo sapien
gggttaacgccacatgtaatcccta

SEQ ID NO: 611446 - DNA, 25 bp, Homo sapien
tccctaccgggaaacgcaagataca

SEQ ID NO: 611447 - DNA, 25 bp, Homo sapien
aaatgtctgacttattaatggtgaa

SEQ ID NO: 611448 - DNA, 25 bp, Homo sapien
ggtgaatggcttaaactcttactta

SEQ ID NO: 611449 - DNA, 25 bp, Homo sapien
gtttagctctggtagtaaaagcata

SEQ ID NO: 611450 - DNA, 25 bp, Homo sapien
agctgaaagcccacaaacattccat

SEQ ID NO: 611451 - DNA, 25 bp, Homo sapien
tgaaagcccacaaacattccatcgt

SEQ ID NO: 611452 - DNA, 25 bp, Homo sapien
aagcccacaaacattccatcgtgat

SEQ ID NO: 611453 - DNA, 25 bp, Homo sapien
gcccacaaacattccatcgtgatcg

SEQ ID NO: 611454 - DNA, 25 bp, Homo sapien
tactacagctatgaatactacctgg

SEQ ID NO: 611455 - DNA, 25 bp, Homo sapien
tggactatctggacctcattcccgt

SEQ ID NO: 611456 - DNA, 25 bp, Homo sapien
actatctggacctcattcccgtgga

SEQ ID NO: 611457 - DNA, 25 bp, Homo sapien
atctggacctcattcccgtggacga

SEQ ID NO: 611458 - DNA, 25 bp, Homo sapien
gacctcattcccgtggacgagaaga

SEQ ID NO: 611459 - DNA, 25 bp, Homo sapien
tcattcccgtggacgagaagaagct

SEQ ID NO: 611460 - DNA, 25 bp, Homo sapien
attcccgtggacgagaagaagctga

SEQ ID NO: 611461 - DNA, 25 bp, Homo sapien
gatgatacatcccaacttcagggtg

SEQ ID NO: 611462 - DNA, 25 bp, Homo sapien
gatacatcccaacttcagggtgatg

SEQ ID NO: 611463 - DNA, 25 bp, Homo sapien
gaaggaggccaaggaatttgtatat

SEQ ID NO: 611464 - DNA, 25 bp, Homo sapien
atttgtatatggtgtcagagtaaac

SEQ ID NO: 611465 - DNA, 25 bp, Homo sapien
gcaagaattgcagttcaggacatac

SEQ ID NO: 611466 - DNA, 25 bp, Homo sapien
gttcaggacatacacacagactgag

SEQ ID NO: 611467 - DNA, 25 bp, Homo sapien
tacacacagactgagtggtctttag

SEQ ID NO: 611468 - DNA, 25 bp, Homo sapien
agactgagtggtctttagtatgtca

SEQ ID NO: 611469 - DNA, 25 bp, Homo sapien
gagaaggtcgagagttttattagaa

SEQ ID NO: 611470 - DNA, 25 bp, Homo sapien
gagaaatgttgctactgttttgaaa

SEQ ID NO: 611471 - DNA, 25 bp, Homo sapien
agaaggttcattggcactatagtaa

SEQ ID NO: 611472 - DNA, 25 bp, Homo sapien
aaggaggagaggatatgagatcaga

SEQ ID NO: 611473 - DNA, 25 bp, Homo sapien
aggaggagaggatatgagatcagaa

SEQ ID NO: 611474 - DNA, 25 bp, Homo sapien
ggaggagaggatatgagatcagaaa

SEQ ID NO: 611475 - DNA, 25 bp, Homo sapien
gaggagaggatatgagatcagaaag

SEQ ID NO: 611476 - DNA, 25 bp, Homo sapien
aggagaggatatgagatcagaaaga

SEQ ID NO: 611477 - DNA, 25 bp, Homo sapien
cagagcacgaggagcggtgctcaga

SEQ ID NO: 611478 - DNA, 25 bp, Homo sapien
agagcacgaggagcggtgctcagag

SEQ ID NO: 611479 - DNA, 25 bp, Homo sapien
gagcacgaggagcggtgctcagagc

SEQ ID NO: 611480 - DNA, 25 bp, Homo sapien
tgaccatcacgttttctatcacaac

SEQ ID NO: 611481 - DNA, 25 bp, Homo sapien
gttttctatcacaacatgacctgac

SEQ ID NO: 611482 - DNA, 25 bp, Homo sapien
atgacctgacagttgtatcccgata

SEQ ID NO: 611483 - DNA, 25 bp, Homo sapien
ttgtatcccgataatttgccagtta

SEQ ID NO: 611484 - DNA, 25 bp, Homo sapien
gactgtgcttatcttcactgtatta

SEQ ID NO: 611485 - DNA, 25 bp, Homo sapien
gaagtacaccaaatacggcattttc

SEQ ID NO: 611486 - DNA, 25 bp, Homo sapien
gagatgttttataccacagcacaag

SEQ ID NO: 611487 - DNA, 25 bp, Homo sapien
agcacaagtggccatcagtatattt

SEQ ID NO: 611488 - DNA, 25 bp, Homo sapien
atatatcacagaaccctgaggcttt

SEQ ID NO: 611489 - DNA, 25 bp, Homo sapien
gaggctttaaaacactatggactta

SEQ ID NO: 611490 - DNA, 25 bp, Homo sapien
atggacttaccactttcttgacaaa

SEQ ID NO: 611491 - DNA, 25 bp, Homo sapien
tcctattcttcacacaaagactgcc

SEQ ID NO: 611492 - DNA, 25 bp, Homo sapien
aaagactgccagtgattgcacaagg

SEQ ID NO: 611493 - DNA, 25 bp, Homo sapien
tgattgcacaaggaccagcatcttt

SEQ ID NO: 611494 - DNA, 25 bp, Homo sapien
catctgcttctgtgaagatctggaa

SEQ ID NO: 611495 - DNA, 25 bp, Homo sapien
aatgatggatccacagaaaaaccct

SEQ ID NO: 611496 - DNA, 25 bp, Homo sapien
tacttcgtaacccctaacctgcatg

SEQ ID NO: 611497 - DNA, 25 bp, Homo sapien
taacctgcatggaattctgatcaag

SEQ ID NO: 611498 - DNA, 25 bp, Homo sapien
tgcatggaattctgatcaagaagca

SEQ ID NO: 611499 - DNA, 25 bp, Homo sapien
tcaagaagcaactagttccccagaa

SEQ ID NO: 611500 - DNA, 25 bp, Homo sapien
aagcaactagttccccagaagcaga

SEQ ID NO: 611501 - DNA, 25 bp, Homo sapien
ccccagaagcagaaagagtagaaaa

SEQ ID NO: 611502 - DNA, 25 bp, Homo sapien
cattgaatgtgctgaccaaaggctt

SEQ ID NO: 611503 - DNA, 25 bp, Homo sapien
gaatgtgctgaccaaaggcttgcaa

SEQ ID NO: 611504 - DNA, 25 bp, Homo sapien
gaccaaaggcttgcaatatcccact

SEQ ID NO: 611505 - DNA, 25 bp, Homo sapien
aaaggcttgcaatatcccactccca

SEQ ID NO: 611506 - DNA, 25 bp, Homo sapien
atatcccactcccagattgcacatt

SEQ ID NO: 611507 - DNA, 25 bp, Homo sapien
aggatttaattagaaagcccagaga

SEQ ID NO: 611508 - DNA, 25 bp, Homo sapien
gccagaaaaccaagatcaaaaagct

SEQ ID NO: 611509 - DNA, 25 bp, Homo sapien
agcttagaaaatcatccgaagtcca

SEQ ID NO: 611510 - DNA, 25 bp, Homo sapien
aagtccatgaccatgttggcatata

SEQ ID NO: 611511 - DNA, 25 bp, Homo sapien
gtccatgaccatgttggcatataac

SEQ ID NO: 611512 - DNA, 25 bp, Homo sapien
tatttataggatacaggctgggcgc

SEQ ID NO: 611513 - DNA, 25 bp, Homo sapien
gcgcccgaccagtgggtgctattat

SEQ ID NO: 611514 - DNA, 25 bp, Homo sapien
ggtgctattatttatctccactttg

SEQ ID NO: 611515 - DNA, 25 bp, Homo sapien
ttacaaagagttgagaatccagcct

SEQ ID NO: 611516 - DNA, 25 bp, Homo sapien
gcctggctacaggatgctaagcaga

SEQ ID NO: 611517 - DNA, 25 bp, Homo sapien
ctaagcagagcagggcgttatggcc

SEQ ID NO: 611518 - DNA, 25 bp, Homo sapien
tccaggtgggttctttcctaagcca

SEQ ID NO: 611519 - DNA, 25 bp, Homo sapien
ccaaaagcagcatatcctctaagat

SEQ ID NO: 611520 - DNA, 25 bp, Homo sapien
agataaacacccacaaatgcccagg

SEQ ID NO: 611521 - DNA, 25 bp, Homo sapien
aatgcccagggaaaatgttccaggt

SEQ ID NO: 611522 - DNA, 25 bp, Homo sapien
atgttccaggtggtcgagaactcaa

SEQ ID NO: 611523 - DNA, 25 bp, Homo sapien
ggtcgagaactcaattcctaatgaa

SEQ ID NO: 611524 - DNA, 25 bp, Homo sapien
gggcctgggaatgcttgccaaaaga

SEQ ID NO: 611525 - DNA, 25 bp, Homo sapien
gaatgcttgccaaaagacacaggat

SEQ ID NO: 611526 - DNA, 25 bp, Homo sapien
gattagtggctgtctaggactcctg

SEQ ID NO: 611527 - DNA, 25 bp, Homo sapien
tggctgtctaggactcctggcccag

SEQ ID NO: 611528 - DNA, 25 bp, Homo sapien
gggaaccctgcttctctgcaacttg

SEQ ID NO: 611529 - DNA, 25 bp, Homo sapien
ctctgcaacttgcttatgcatcttg

SEQ ID NO: 611530 - DNA, 25 bp, Homo sapien
atgcatcttgttgtaagctggctat

SEQ ID NO: 611531 - DNA, 25 bp, Homo sapien
gctggctatgcatgctatcaactca

SEQ ID NO: 611532 - DNA, 25 bp, Homo sapien
tatcaactcattaaggctatttagt

SEQ ID NO: 611533 - DNA, 25 bp, Homo sapien
aattttgtttgccttagagttgtat

SEQ ID NO: 611534 - DNA, 25 bp, Homo sapien
ttaatagggagcacttgaagacaaa

SEQ ID NO: 611535 - DNA, 25 bp, Homo sapien
acctcaaaagcaggggcagtttatt

SEQ ID NO: 611536 - DNA, 25 bp, Homo sapien
gagccttaaaagtcagactttgcta

SEQ ID NO: 611537 - DNA, 25 bp, Homo sapien
tcactgtcctgaatataacattaag

SEQ ID NO: 611538 - DNA, 25 bp, Homo sapien
aataggatttggttaggtctagata

SEQ ID NO: 611539 - DNA, 25 bp, Homo sapien
ggttaggtctagataacatttaata

SEQ ID NO: 611540 - DNA, 25 bp, Homo sapien
acatttaataatttcaactgtgtta

SEQ ID NO: 611541 - DNA, 25 bp, Homo sapien
aaagtaatttttgatgtgaccatgg

SEQ ID NO: 611542 - DNA, 25 bp, Homo sapien
atttttgatgtgaccatggacttgt

SEQ ID NO: 611543 - DNA, 25 bp, Homo sapien
tttgatgtgaccatggacttgtcat

SEQ ID NO: 611544 - DNA, 25 bp, Homo sapien
gatgtgaccatggacttgtcatgaa

SEQ ID NO: 611545 - DNA, 25 bp, Homo sapien
aatataaaggtgaaagggattccat

SEQ ID NO: 611546 - DNA, 25 bp, Homo sapien
aagttaattatttgatgggcctgcc

SEQ ID NO: 611547 - DNA, 25 bp, Homo sapien
gttaattatttgatgggcctgccat

SEQ ID NO: 611548 - DNA, 25 bp, Homo sapien
ttaattatttgatgggcctgccatg

SEQ ID NO: 611549 - DNA, 25 bp, Homo sapien
gcctgccatgtgaaaaccagaaaat

SEQ ID NO: 611550 - DNA, 25 bp, Homo sapien
accagaaaataacctcgtactcaca

SEQ ID NO: 611551 - DNA, 25 bp, Homo sapien
aaaataacctcgtactcacaagcca

SEQ ID NO: 611552 - DNA, 25 bp, Homo sapien
aataacctcgtactcacaagccagt

SEQ ID NO: 611553 - DNA, 25 bp, Homo sapien
taacctcgtactcacaagccagtgg

SEQ ID NO: 611554 - DNA, 25 bp, Homo sapien
acctcgtactcacaagccagtggaa

SEQ ID NO: 611555 - DNA, 25 bp, Homo sapien
tcgtactcacaagccagtggaaggg

SEQ ID NO: 611556 - DNA, 25 bp, Homo sapien
tcacaagccagtggaagggattcct

SEQ ID NO: 611557 - DNA, 25 bp, Homo sapien
cattgaatgtgctgaccaaaggctt

SEQ ID NO: 611558 - DNA, 25 bp, Homo sapien
ttgaatgtgctgaccaaaggcttgc

SEQ ID NO: 611559 - DNA, 25 bp, Homo sapien
gaatgtgctgaccaaaggcttgcaa

SEQ ID NO: 611560 - DNA, 25 bp, Homo sapien
tgtgctgaccaaaggcttgcaatat

SEQ ID NO: 611561 - DNA, 25 bp, Homo sapien
gctgaccaaaggcttgcaatatccc

SEQ ID NO: 611562 - DNA, 25 bp, Homo sapien
gaccaaaggcttgcaatatcccact

SEQ ID NO: 611563 - DNA, 25 bp, Homo sapien
accaaaggcttgcaatatcccactc

SEQ ID NO: 611564 - DNA, 25 bp, Homo sapien
aaggcttgcaatatcccactcccag

SEQ ID NO: 611565 - DNA, 25 bp, Homo sapien
aggatttaattagaaagcccagaga

SEQ ID NO: 611566 - DNA, 25 bp, Homo sapien
gccagaaaaccaagatcaaaaagct

SEQ ID NO: 611567 - DNA, 25 bp, Homo sapien
agcttagaaaatcatccgaagtcca

SEQ ID NO: 611568 - DNA, 25 bp, Homo sapien
gcacccagctgcagatattttattg

SEQ ID NO: 611569 - DNA, 25 bp, Homo sapien
tattgaatcttatttttggcaggtt

SEQ ID NO: 611570 - DNA, 25 bp, Homo sapien
gaatcttatttttggcaggttgata

SEQ ID NO: 611571 - DNA, 25 bp, Homo sapien
caggttgataacagggattttttgc

SEQ ID NO: 611572 - DNA, 25 bp, Homo sapien
gaataagataggtttggccctgatg

SEQ ID NO: 611573 - DNA, 25 bp, Homo sapien
ggtttggccctgatgagagttacac

SEQ ID NO: 611574 - DNA, 25 bp, Homo sapien
ggccctgatgagagttacacaaaaa

SEQ ID NO: 611575 - DNA, 25 bp, Homo sapien
atctttactgtgtatgtctcatgag

SEQ ID NO: 611576 - DNA, 25 bp, Homo sapien
atgtctcatgagactttcagtcatt

SEQ ID NO: 611577 - DNA, 25 bp, Homo sapien
gagactttcagtcattgcagaacat

SEQ ID NO: 611578 - DNA, 25 bp, Homo sapien
tttcagtcattgcagaacatactta

SEQ ID NO: 611579 - DNA, 25 bp, Homo sapien
gaagcatctttaggaactactttaa

SEQ ID NO: 611580 - DNA, 25 bp, Homo sapien
gcatctttaggaactactttaattt

SEQ ID NO: 611581 - DNA, 25 bp, Homo sapien
tatgaacctactactaatttactta

SEQ ID NO: 611582 - DNA, 25 bp, Homo sapien
tttacttagttttcttccagtcact

SEQ ID NO: 611583 - DNA, 25 bp, Homo sapien
cttccagtcacttaggatagcaaat

SEQ ID NO: 611584 - DNA, 25 bp, Homo sapien
aatcagatcatgttgcctaatggat

SEQ ID NO: 611585 - DNA, 25 bp, Homo sapien
agatcatgttgcctaatggatttag

SEQ ID NO: 611586 - DNA, 25 bp, Homo sapien
tcatgttgcctaatggatttagaaa

SEQ ID NO: 611587 - DNA, 25 bp, Homo sapien
gaagcaatctatttacatctcaatg

SEQ ID NO: 611588 - DNA, 25 bp, Homo sapien
gcaatctatttacatctcaatgaaa

SEQ ID NO: 611589 - DNA, 25 bp, Homo sapien
aagcagaaaacccaaagaagcatct

SEQ ID NO: 611590 - DNA, 25 bp, Homo sapien
gctagtgcttgaagcttacctaaaa

SEQ ID NO: 611591 - DNA, 25 bp, Homo sapien
gtgcttgaagcttacctaaaatata

SEQ ID NO: 611592 - DNA, 25 bp, Homo sapien
aaattcactctcaaccaagatgcca

SEQ ID NO: 611593 - DNA, 25 bp, Homo sapien
cactctcaaccaagatgccatcttt

SEQ ID NO: 611594 - DNA, 25 bp, Homo sapien
gagagattgttcttatagatgggta

SEQ ID NO: 611595 - DNA, 25 bp, Homo sapien
gatgggtatgattcttagacattca

SEQ ID NO: 611596 - DNA, 25 bp, Homo sapien
ggaaaaataacaacatctaacatca

SEQ ID NO: 611597 - DNA, 25 bp, Homo sapien
tttgaagtctaaggatacagctttc

SEQ ID NO: 611598 - DNA, 25 bp, Homo sapien
gaggaaatggattcactttattgca

SEQ ID NO: 611599 - DNA, 25 bp, Homo sapien
atggattcactttattgcaagagga

SEQ ID NO: 611600 - DNA, 25 bp, Homo sapien
gcaagaggaagcaactctaacttta

SEQ ID NO: 611601 - DNA, 25 bp, Homo sapien
gtttaatatacagaactggctgccc

SEQ ID NO: 611602 - DNA, 25 bp, Homo sapien
ggctgccctcaatgcatgagacttc

SEQ ID NO: 611603 - DNA, 25 bp, Homo sapien
aatgcatgagacttcctggtatttt

SEQ ID NO: 611604 - DNA, 25 bp, Homo sapien
gtaatcctcactttgcacagtgtca

SEQ ID NO: 611605 - DNA, 25 bp, Homo sapien
actttgcacagtgtcatgtctgcat

SEQ ID NO: 611606 - DNA, 25 bp, Homo sapien
catgtctgcatattgaaaccctata

SEQ ID NO: 611607 - DNA, 25 bp, Homo sapien
attgaaaccctatactcacttcgtg

SEQ ID NO: 611608 - DNA, 25 bp, Homo sapien
tcacttcgtgcaatcctttggtaag

SEQ ID NO: 611609 - DNA, 25 bp, Homo sapien
acacaggtctgatatgtacaagttt

SEQ ID NO: 611610 - DNA, 25 bp, Homo sapien
cagtgaacatggtactatgcatcat

SEQ ID NO: 611611 - DNA, 25 bp, Homo sapien
gactatctgaagttgctttcaaata

SEQ ID NO: 611612 - DNA, 25 bp, Homo sapien
gactgtttgactagtcctacctggg

SEQ ID NO: 611613 - DNA, 25 bp, Homo sapien
tgtttgactagtcctacctgggttc

SEQ ID NO: 611614 - DNA, 25 bp, Homo sapien
tgactagtcctacctgggttccgga

SEQ ID NO: 611615 - DNA, 25 bp, Homo sapien
tcctacctgggttccggaaatacat

SEQ ID NO: 611616 - DNA, 25 bp, Homo sapien
tgggttccggaaatacatgcatcat

SEQ ID NO: 611617 - DNA, 25 bp, Homo sapien
gttccggaaatacatgcatcatctg

SEQ ID NO: 611618 - DNA, 25 bp, Homo sapien
catgcatcatctgtacttgaagagg

SEQ ID NO: 611619 - DNA, 25 bp, Homo sapien
gggaggtcatttatctgagtctctc

SEQ ID NO: 611620 - DNA, 25 bp, Homo sapien
ggtcatttatctgagtctctccaga

SEQ ID NO: 611621 - DNA, 25 bp, Homo sapien
tctctccagaagtttttaaggctac

SEQ ID NO: 611622 - DNA, 25 bp, Homo sapien
taaggctacattttggaatcattaa

SEQ ID NO: 611623 - DNA, 25 bp, Homo sapien
tttttaaagtgcagtacaggaaagg

SEQ ID NO: 611624 - DNA, 25 bp, Homo sapien
gggtctgtgtccaagaggtccagaa

SEQ ID NO: 611625 - DNA, 25 bp, Homo sapien
tccaagaggtccagaagggtcgtgt

SEQ ID NO: 611626 - DNA, 25 bp, Homo sapien
cagaagggtcgtgtggactagccac

SEQ ID NO: 611627 - DNA, 25 bp, Homo sapien
ggtcgtgtggactagccacagaatt

SEQ ID NO: 611628 - DNA, 25 bp, Homo sapien
ccacagaattcagcaatggtctcat

SEQ ID NO: 611629 - DNA, 25 bp, Homo sapien
gaattcagcaatggtctcatacgtt

SEQ ID NO: 611630 - DNA, 25 bp, Homo sapien
gcaatggtctcatacgttgtcaggg

SEQ ID NO: 611631 - DNA, 25 bp, Homo sapien
gggccagtctcttatctaatgtagg

SEQ ID NO: 611632 - DNA, 25 bp, Homo sapien
cagtctcttatctaatgtaggttca

SEQ ID NO: 611633 - DNA, 25 bp, Homo sapien
ctaatgtaggttcattcatttatct

SEQ ID NO: 611634 - DNA, 25 bp, Homo sapien
tcttttgggtatattcctagaaatg

SEQ ID NO: 611635 - DNA, 25 bp, Homo sapien
gctaggtcatgtggcaactttagat

SEQ ID NO: 611636 - DNA, 25 bp, Homo sapien
gatttaacattttgaggaactccca

SEQ ID NO: 611637 - DNA, 25 bp, Homo sapien
gaggaactcccaaattgttttcaca

SEQ ID NO: 611638 - DNA, 25 bp, Homo sapien
tctgtacctttgtacattcccacca

SEQ ID NO: 611639 - DNA, 25 bp, Homo sapien
attcccaccactgatgaatgagtgt

SEQ ID NO: 611640 - DNA, 25 bp, Homo sapien
gaatgagtgttccattttctccata

SEQ ID NO: 611641 - DNA, 25 bp, Homo sapien
gagtgttccattttctccatattct

SEQ ID NO: 611642 - DNA, 25 bp, Homo sapien
gtctgtcttcttttattgtagctac

SEQ ID NO: 611643 - DNA, 25 bp, Homo sapien
attgtagctactatagtgggtataa

SEQ ID NO: 611644 - DNA, 25 bp, Homo sapien
tccctaacgtctaatgatgttgaat

SEQ ID NO: 611645 - DNA, 25 bp, Homo sapien
aattatgacacaaacatctcctttt

SEQ ID NO: 611646 - DNA, 25 bp, Homo sapien
attttatttttctacgccatctggc

SEQ ID NO: 611647 - DNA, 25 bp, Homo sapien
acgccatctggctagtagatcctaa

SEQ ID NO: 611648 - DNA, 25 bp, Homo sapien
agatcctaattgcttagctatctgt

SEQ ID NO: 611649 - DNA, 25 bp, Homo sapien
agctatctgtttgatggtatcctca

SEQ ID NO: 611650 - DNA, 25 bp, Homo sapien
gatggtatcctcagtgtaatttatg

SEQ ID NO: 611651 - DNA, 25 bp, Homo sapien
gtgattgtaacatagcttagtctac

SEQ ID NO: 611652 - DNA, 25 bp, Homo sapien
gatgtggatttaaattctgcagcta

SEQ ID NO: 611653 - DNA, 25 bp, Homo sapien
gctttaaacttatcgggcacttctc

SEQ ID NO: 611654 - DNA, 25 bp, Homo sapien
gggcacttctcacaggaccttaata

SEQ ID NO: 611655 - DNA, 25 bp, Homo sapien
caggaccttaatagcatttatgtaa

SEQ ID NO: 611656 - DNA, 25 bp, Homo sapien
tgcgattgcccctggatatattgct

SEQ ID NO: 611657 - DNA, 25 bp, Homo sapien
gcccctggatatattgctacggaca

SEQ ID NO: 611658 - DNA, 25 bp, Homo sapien
ttgctacggacatgaacgaggcgtt

SEQ ID NO: 611659 - DNA, 25 bp, Homo sapien
aacgaggcgttgatcaaggacgaga

SEQ ID NO: 611660 - DNA, 25 bp, Homo sapien
gagagcggagagtatcctcagtcgt

SEQ ID NO: 611661 - DNA, 25 bp, Homo sapien
gagagtatcctcagtcgtattccgg

SEQ ID NO: 611662 - DNA, 25 bp, Homo sapien
tcctcagtcgtattccggcagggag

SEQ ID NO: 611663 - DNA, 25 bp, Homo sapien
ttcaagggtgcggtagttttcttgg

SEQ ID NO: 611664 - DNA, 25 bp, Homo sapien
aggtagattgattgactgatcgcta

SEQ ID NO: 611665 - DNA, 25 bp, Homo sapien
gactgatcgctagagttgcacgaca

SEQ ID NO: 611666 - DNA, 25 bp, Homo sapien
cacgacagaggaggcaatgtttaat

SEQ ID NO: 611667 - DNA, 25 bp, Homo sapien
tgataatggtcctgggcaatggagt

SEQ ID NO: 611668 - DNA, 25 bp, Homo sapien
ggagtgatatctgcaaggtggtaac

SEQ ID NO: 611669 - DNA, 25 bp, Homo sapien
caaggtggtaacaccagatggacat

SEQ ID NO: 611670 - DNA, 25 bp, Homo sapien
gatggacatgggaagaaccgagcta

SEQ ID NO: 611671 - DNA, 25 bp, Homo sapien
gctgaagaatatccagtctgccctc

SEQ ID NO: 611672 - DNA, 25 bp, Homo sapien
tgagccccttcagagcaggaaacaa

SEQ ID NO: 611673 - DNA, 25 bp, Homo sapien
aaacaacctcagactcatcacaaag

SEQ ID NO: 611674 - DNA, 25 bp, Homo sapien
gtatatttttctcaccacattcttc

SEQ ID NO: 611675 - DNA, 25 bp, Homo sapien
gaggttgtagacaaatgtttccatg

SEQ ID NO: 611676 - DNA, 25 bp, Homo sapien
tttccatgacctctcagctttccaa

SEQ ID NO: 611677 - DNA, 25 bp, Homo sapien
tcagctttccaacaggaatcttgta

SEQ ID NO: 611678 - DNA, 25 bp, Homo sapien
ctttgctgaaacctgaaagtgagca

SEQ ID NO: 611679 - DNA, 25 bp, Homo sapien
gctgaaacctgaaagtgagcaaact

SEQ ID NO: 611680 - DNA, 25 bp, Homo sapien
gaaacctgaaagtgagcaaactgat

SEQ ID NO: 611681 - DNA, 25 bp, Homo sapien
acctgaaagtgagcaaactgataga

SEQ ID NO: 611682 - DNA, 25 bp, Homo sapien
gtgagcaaactgatagaaatgcata

SEQ ID NO: 611683 - DNA, 25 bp, Homo sapien
tagaaatgcatataacaggccgggc

SEQ ID NO: 611684 - DNA, 25 bp, Homo sapien
gaaatgcatataacaggccgggcgt

SEQ ID NO: 611685 - DNA, 25 bp, Homo sapien
aaatgcatataacaggccgggcgta

SEQ ID NO: 611686 - DNA, 25 bp, Homo sapien
aatgcatataacaggccgggcgtag

SEQ ID NO: 611687 - DNA, 25 bp, Homo sapien
atgcatataacaggccgggcgtagt

SEQ ID NO: 611688 - DNA, 25 bp, Homo sapien
atataacaggccgggcgtagtggct

SEQ ID NO: 611689 - DNA, 25 bp, Homo sapien
tgggttatgcccaacatctgctttc

SEQ ID NO: 611690 - DNA, 25 bp, Homo sapien
agaggatgaggtgagcagctcccaa

SEQ ID NO: 611691 - DNA, 25 bp, Homo sapien
agcagctcccaatgagaaccctgaa

SEQ ID NO: 611692 - DNA, 25 bp, Homo sapien
gaaccctgaacactgagtctgtaat

SEQ ID NO: 611693 - DNA, 25 bp, Homo sapien
agtctgtaatgagcttcccttgtat

SEQ ID NO: 611694 - DNA, 25 bp, Homo sapien
gagcttcccttgtatacaacattgc

SEQ ID NO: 611695 - DNA, 25 bp, Homo sapien
caacattgcacatgggttgtcacaa

SEQ ID NO: 611696 - DNA, 25 bp, Homo sapien
gtcacaactgattgctggaggaatt

SEQ ID NO: 611697 - DNA, 25 bp, Homo sapien
aattgtgtcctatgtgactctgctg

SEQ ID NO: 611698 - DNA, 25 bp, Homo sapien
actgtgggaggcttacacctggttt

SEQ ID NO: 611699 - DNA, 25 bp, Homo sapien
tggactttgtccatgcgcttttttc

SEQ ID NO: 611700 - DNA, 25 bp, Homo sapien
tgtactcccatcctttgttgctttg

SEQ ID NO: 611701 - DNA, 25 bp, Homo sapien
tcccatcctttgttgctttgcagca

SEQ ID NO: 611702 - DNA, 25 bp, Homo sapien
tttgttgctttgcagcaggagctga

SEQ ID NO: 611703 - DNA, 25 bp, Homo sapien
gaatatgtggtgatgactggtttgt

SEQ ID NO: 611704 - DNA, 25 bp, Homo sapien
accttggttttctctggctctaaag

SEQ ID NO: 611705 - DNA, 25 bp, Homo sapien
tggctctaaagccagcactcttgtt

SEQ ID NO: 611706 - DNA, 25 bp, Homo sapien
tctaaagccagcactcttgttctct

SEQ ID NO: 611707 - DNA, 25 bp, Homo sapien
aaagccagcactcttgttctctgga

SEQ ID NO: 611708 - DNA, 25 bp, Homo sapien
agcactcttgttctctggacagggt

SEQ ID NO: 611709 - DNA, 25 bp, Homo sapien
tcttgttctctggacagggtctttt

SEQ ID NO: 611710 - DNA, 25 bp, Homo sapien
gttctctggacagggtcttttaatc

SEQ ID NO: 611711 - DNA, 25 bp, Homo sapien
gaaaataaggactaggcgcctgggc

SEQ ID NO: 611712 - DNA, 25 bp, Homo sapien
aaaataaggactaggcgcctgggcg

SEQ ID NO: 611713 - DNA, 25 bp, Homo sapien
aaataaggactaggcgcctgggcgc

SEQ ID NO: 611714 - DNA, 25 bp, Homo sapien
aataaggactaggcgcctgggcgcg

SEQ ID NO: 611715 - DNA, 25 bp, Homo sapien
ataaggactaggcgcctgggcgcgg

SEQ ID NO: 611716 - DNA, 25 bp, Homo sapien
taaggactaggcgcctgggcgcggt

SEQ ID NO: 611717 - DNA, 25 bp, Homo sapien
aaggactaggcgcctgggcgcggtg

SEQ ID NO: 611718 - DNA, 25 bp, Homo sapien
aggactaggcgcctgggcgcggtgg

SEQ ID NO: 611719 - DNA, 25 bp, Homo sapien
ggactaggcgcctgggcgcggtggc

SEQ ID NO: 611720 - DNA, 25 bp, Homo sapien
gactaggcgcctgggcgcggtggct

SEQ ID NO: 611721 - DNA, 25 bp, Homo sapien
ggaggccgcggtgggcagaacacga

SEQ ID NO: 611722 - DNA, 25 bp, Homo sapien
aatggactcatttaccttccaggag

SEQ ID NO: 611723 - DNA, 25 bp, Homo sapien
ttaccttccaggagcacctctgtgg

SEQ ID NO: 611724 - DNA, 25 bp, Homo sapien
caccatgtgaaagaggtaagcccta

SEQ ID NO: 611725 - DNA, 25 bp, Homo sapien
taagccctaaggtggaggcagaagc

SEQ ID NO: 611726 - DNA, 25 bp, Homo sapien
ccaagggaatacaggaggctaattt

SEQ ID NO: 611727 - DNA, 25 bp, Homo sapien
gaggctaattttgacaggaactgta

SEQ ID NO: 611728 - DNA, 25 bp, Homo sapien
gaactgtatgggaaaaggtggcctt

SEQ ID NO: 611729 - DNA, 25 bp, Homo sapien
aaaggtggcctttgtgttgagccta

SEQ ID NO: 611730 - DNA, 25 bp, Homo sapien
gtgttgagcctagtagaatgacttc

SEQ ID NO: 611731 - DNA, 25 bp, Homo sapien
gaatgacttcaataggcagttttta

SEQ ID NO: 611732 - DNA, 25 bp, Homo sapien
gatcttattatgagtcaggcactgt

SEQ ID NO: 611733 - DNA, 25 bp, Homo sapien
tgtactcccatcctttgttgctttg

SEQ ID NO: 611734 - DNA, 25 bp, Homo sapien
tactcccatcctttgttgctttgca

SEQ ID NO: 611735 - DNA, 25 bp, Homo sapien
cccatcctttgttgctttgcagcag

SEQ ID NO: 611736 - DNA, 25 bp, Homo sapien
gaatatgtggtgatgactggtttgt

SEQ ID NO: 611737 - DNA, 25 bp, Homo sapien
ttttctctggctctaaagccagcac

SEQ ID NO: 611738 - DNA, 25 bp, Homo sapien
tggctctaaagccagcactcttgtt

SEQ ID NO: 611739 - DNA, 25 bp, Homo sapien
tctaaagccagcactcttgttctct

SEQ ID NO: 611740 - DNA, 25 bp, Homo sapien
aaagccagcactcttgttctctgga

SEQ ID NO: 611741 - DNA, 25 bp, Homo sapien
agcactcttgttctctggacagggt

SEQ ID NO: 611742 - DNA, 25 bp, Homo sapien
tcttgttctctggacagggtctttt

SEQ ID NO: 611743 - DNA, 25 bp, Homo sapien
gttctctggacagggtcttttaatc

SEQ ID NO: 611744 - DNA, 25 bp, Homo sapien
ttcactgtctgactttagtctccca

SEQ ID NO: 611745 - DNA, 25 bp, Homo sapien
actgtctgactttagtctcccacta

SEQ ID NO: 611746 - DNA, 25 bp, Homo sapien
gtctgactttagtctcccactaaaa

SEQ ID NO: 611747 - DNA, 25 bp, Homo sapien
tgactttagtctcccactaaaactg

SEQ ID NO: 611748 - DNA, 25 bp, Homo sapien
tagtctcccactaaaactgcatttc

SEQ ID NO: 611749 - DNA, 25 bp, Homo sapien
agtctcccactaaaactgcatttcc

SEQ ID NO: 611750 - DNA, 25 bp, Homo sapien
ctcccactaaaactgcatttccttt

SEQ ID NO: 611751 - DNA, 25 bp, Homo sapien
taaaactgcatttcctttctacaat

SEQ ID NO: 611752 - DNA, 25 bp, Homo sapien
ttctacaatttcaatttctcccttt

SEQ ID NO: 611753 - DNA, 25 bp, Homo sapien
ctgcacctacgggtcctaataaatc

SEQ ID NO: 611754 - DNA, 25 bp, Homo sapien
tacgggtcctaataaatcttcactg

SEQ ID NO: 611755 - DNA, 25 bp, Homo sapien
ttgggcccaagagttgttatagcga

SEQ ID NO: 611756 - DNA, 25 bp, Homo sapien
gttatagcgagctttgcttgttcca

SEQ ID NO: 611757 - DNA, 25 bp, Homo sapien
atagcgagctttgcttgttccactg

SEQ ID NO: 611758 - DNA, 25 bp, Homo sapien
cgagctttgcttgttccactgtact

SEQ ID NO: 611759 - DNA, 25 bp, Homo sapien
aaaagtactacaaatgaaccatctt

SEQ ID NO: 611760 - DNA, 25 bp, Homo sapien
ggaatcatgagtcttgtcctcctta

SEQ ID NO: 611761 - DNA, 25 bp, Homo sapien
tgagtcttgtcctccttattataca

SEQ ID NO: 611762 - DNA, 25 bp, Homo sapien
gtcctccttattatacaacgtaata

SEQ ID NO: 611763 - DNA, 25 bp, Homo sapien
ttatacaacgtaatacttcagaggg

SEQ ID NO: 611764 - DNA, 25 bp, Homo sapien
gggaaggactcaagctaacacatga

SEQ ID NO: 611765 - DNA, 25 bp, Homo sapien
ggactcaagctaacacatgaagaaa

SEQ ID NO: 611766 - DNA, 25 bp, Homo sapien
ccgaccctgtccttatcttataata

SEQ ID NO: 611767 - DNA, 25 bp, Homo sapien
tcttctagaaccagacgatgctcta

SEQ ID NO: 611768 - DNA, 25 bp, Homo sapien
gacgatgctctagttctcctagatt

SEQ ID NO: 611769 - DNA, 25 bp, Homo sapien
gttctcctagattctgaacctcatg

SEQ ID NO: 611770 - DNA, 25 bp, Homo sapien
agattctgaacctcatgacctgtac

SEQ ID NO: 611771 - DNA, 25 bp, Homo sapien
tcatgacctgtaccactcactagtt

SEQ ID NO: 611772 - DNA, 25 bp, Homo sapien
tgtaccactcactagttccagacta

SEQ ID NO: 611773 - DNA, 25 bp, Homo sapien
cactagttccagactacacaacttc

SEQ ID NO: 611774 - DNA, 25 bp, Homo sapien
acacaacttctagaaggtgccacct

SEQ ID NO: 611775 - DNA, 25 bp, Homo sapien
agggtcctgattcaagatctggtga

SEQ ID NO: 611776 - DNA, 25 bp, Homo sapien
gatctggtgatctgctgtttctctg

SEQ ID NO: 611777 - DNA, 25 bp, Homo sapien
gctgtcaaccaagaattatacatcc

SEQ ID NO: 611778 - DNA, 25 bp, Homo sapien
gtcaaccaagaattatacatccagc

SEQ ID NO: 611779 - DNA, 25 bp, Homo sapien
aaccaagaattatacatccagcaaa

SEQ ID NO: 611780 - DNA, 25 bp, Homo sapien
aaatacttagaaatttcgtcaggct

SEQ ID NO: 611781 - DNA, 25 bp, Homo sapien
atacttagaaatttcgtcaggctga

SEQ ID NO: 611782 - DNA, 25 bp, Homo sapien
tacttagaaatttcgtcaggctgaa

SEQ ID NO: 611783 - DNA, 25 bp, Homo sapien
cttagaaatttcgtcaggctgaaaa

SEQ ID NO: 611784 - DNA, 25 bp, Homo sapien
gaaatttcgtcaggctgaaaatcca

SEQ ID NO: 611785 - DNA, 25 bp, Homo sapien
aatttcgtcaggctgaaaatccaag

SEQ ID NO: 611786 - DNA, 25 bp, Homo sapien
atttcgtcaggctgaaaatccaagc

SEQ ID NO: 611787 - DNA, 25 bp, Homo sapien
ttcgtcaggctgaaaatccaagcaa

SEQ ID NO: 611788 - DNA, 25 bp, Homo sapien
gaaaagccttagtttgaagaacatt

SEQ ID NO: 611789 - DNA, 25 bp, Homo sapien
gaactcttacatcaagaggtctcca

SEQ ID NO: 611790 - DNA, 25 bp, Homo sapien
ttacatcaagaggtctccagtacct

SEQ ID NO: 611791 - DNA, 25 bp, Homo sapien
tccagtacctcaaaaaccagtgttc

SEQ ID NO: 611792 - DNA, 25 bp, Homo sapien
tacctcaaaaaccagtgttcaaaag

SEQ ID NO: 611793 - DNA, 25 bp, Homo sapien
gaataaaagccttcctttgcgcagc

SEQ ID NO: 611794 - DNA, 25 bp, Homo sapien
aaagccttcctttgcgcagcgtgtt

SEQ ID NO: 611795 - DNA, 25 bp, Homo sapien
ttcctttgcgcagcgtgttacatgt

SEQ ID NO: 611796 - DNA, 25 bp, Homo sapien
tttgcgcagcgtgttacatgtggaa

SEQ ID NO: 611797 - DNA, 25 bp, Homo sapien
ttacatgtggaaatgtggaacgcac

SEQ ID NO: 611798 - DNA, 25 bp, Homo sapien
aatgtggaacgcacacgatcattct

SEQ ID NO: 611799 - DNA, 25 bp, Homo sapien
tggccgtaaacgtcaaggcaggata

SEQ ID NO: 611800 - DNA, 25 bp, Homo sapien
ataatcagagtcagtccaacaaaag

SEQ ID NO: 611801 - DNA, 25 bp, Homo sapien
ctatttcaagtaacaggcaggtcct

SEQ ID NO: 611802 - DNA, 25 bp, Homo sapien
ggcaggtccttcatttttaccaaag

SEQ ID NO: 611803 - DNA, 25 bp, Homo sapien
agaagtccacgaatggttcctgatg

SEQ ID NO: 611804 - DNA, 25 bp, Homo sapien
atggttcctgatggaatcaacccaa

SEQ ID NO: 611805 - DNA, 25 bp, Homo sapien
aaaatgttcatcacacatggtgtct

SEQ ID NO: 611806 - DNA, 25 bp, Homo sapien
tgtctatgaaccagagaagccttct

SEQ ID NO: 611807 - DNA, 25 bp, Homo sapien
gagaagccttctcggaacttgcagc

SEQ ID NO: 611808 - DNA, 25 bp, Homo sapien
gaacttgcagcgaaagtcatctatc

SEQ ID NO: 611809 - DNA, 25 bp, Homo sapien
gtcatctatcttttcctatagggat

SEQ ID NO: 611810 - DNA, 25 bp, Homo sapien
gcggcttttgaaaacctggacctct

SEQ ID NO: 611811 - DNA, 25 bp, Homo sapien
aaaacctggacctctatgtcaacat

SEQ ID NO: 611812 - DNA, 25 bp, Homo sapien
acatgacagggtgaaactattcccc

SEQ ID NO: 611813 - DNA, 25 bp, Homo sapien
gactgttcaacttgtagatacatca

SEQ ID NO: 611814 - DNA, 25 bp, Homo sapien
ttatacctgaccaaaacatgttctg

SEQ ID NO: 611815 - DNA, 25 bp, Homo sapien
aacatgttctgatatgtgtaggaca

SEQ ID NO: 611816 - DNA, 25 bp, Homo sapien
gacagagacctggatgtgctttgat

SEQ ID NO: 611817 - DNA, 25 bp, Homo sapien
gacctggatgtgctttgatcgttaa

SEQ ID NO: 611818 - DNA, 25 bp, Homo sapien
gatcgttaatgaggtggtcacatga

SEQ ID NO: 611819 - DNA, 25 bp, Homo sapien
aagtctggaggctagacttcctgaa

SEQ ID NO: 611820 - DNA, 25 bp, Homo sapien
tagacttcctgaaagcaagtcaaga

SEQ ID NO: 611821 - DNA, 25 bp, Homo sapien
aaacttcctaactttgttgcaatag

SEQ ID NO: 611822 - DNA, 25 bp, Homo sapien
gttgcaataggcttgactaccattt

SEQ ID NO: 611823 - DNA, 25 bp, Homo sapien
ataggcttgactaccatttcatttg

SEQ ID NO: 611824 - DNA, 25 bp, Homo sapien
ggcacagtagccatctttttcatta

SEQ ID NO: 611825 - DNA, 25 bp, Homo sapien
agtagccatctttttcattatgttg

SEQ ID NO: 611826 - DNA, 25 bp, Homo sapien
atgttgcaacactgatcacgtgcct

SEQ ID NO: 611827 - DNA, 25 bp, Homo sapien
acactgatcacgtgcctcgataaaa

SEQ ID NO: 611828 - DNA, 25 bp, Homo sapien
acgtgcctcgataaaatggctgatt

SEQ ID NO: 611829 - DNA, 25 bp, Homo sapien
tcaacaagatgatggcaacacgaag

SEQ ID NO: 611830 - DNA, 25 bp, Homo sapien
gactttggattgtctatttaaaatc

SEQ ID NO: 611831 - DNA, 25 bp, Homo sapien
aaactctatcttaagtgcactttca

SEQ ID NO: 611832 - DNA, 25 bp, Homo sapien
gaggcagtcggtgttcacccctatc

SEQ ID NO: 611833 - DNA, 25 bp, Homo sapien
aactacagtgtgctgtgcctggaat

SEQ ID NO: 611834 - DNA, 25 bp, Homo sapien
actacagtgtgctgtgcctggaatg

SEQ ID NO: 611835 - DNA, 25 bp, Homo sapien
ctacagtgtgctgtgcctggaatgc

SEQ ID NO: 611836 - DNA, 25 bp, Homo sapien
tacagtgtgctgtgcctggaatgca

SEQ ID NO: 611837 - DNA, 25 bp, Homo sapien
acagtgtgctgtgcctggaatgcaa

SEQ ID NO: 611838 - DNA, 25 bp, Homo sapien
agtgtgctgtgcctggaatgcaaaa

SEQ ID NO: 611839 - DNA, 25 bp, Homo sapien
gtgtgctgtgcctggaatgcaaaaa

SEQ ID NO: 611840 - DNA, 25 bp, Homo sapien
tgtgctgtgcctggaatgcaaaaat

SEQ ID NO: 611841 - DNA, 25 bp, Homo sapien
tgctgtgcctggaatgcaaaaatgc

SEQ ID NO: 611842 - DNA, 25 bp, Homo sapien
ctgtgcctggaatgcaaaaatgcag

SEQ ID NO: 611843 - DNA, 25 bp, Homo sapien
ccccggcgttaaataatctatagat

SEQ ID NO: 611844 - DNA, 25 bp, Homo sapien
tatagattcttatgcaggtctgcct

SEQ ID NO: 611845 - DNA, 25 bp, Homo sapien
gcaggtctgcctaatggaaagatca

SEQ ID NO: 611846 - DNA, 25 bp, Homo sapien
gcctcctccttggaaaataggcctt

SEQ ID NO: 611847 - DNA, 25 bp, Homo sapien
tggaaaataggcctttcttttcatt

SEQ ID NO: 611848 - DNA, 25 bp, Homo sapien
gagagaatgtctctcctgttctcct

SEQ ID NO: 611849 - DNA, 25 bp, Homo sapien
tgttctcctctcttgacttaatctc

SEQ ID NO: 611850 - DNA, 25 bp, Homo sapien
tctcttgacttaatctcctatgcag

SEQ ID NO: 611851 - DNA, 25 bp, Homo sapien
gaagcagataactggagctggatca

SEQ ID NO: 611852 - DNA, 25 bp, Homo sapien
agctggatcagcagtgtaattaaat

SEQ ID NO: 611853 - DNA, 25 bp, Homo sapien
attaaatgatactttgtactggtaa

SEQ ID NO: 611854 - DNA, 25 bp, Homo sapien
gtgtgattccacttttaggagatac

SEQ ID NO: 611855 - DNA, 25 bp, Homo sapien
tttaggagatacttagagcagtcag

SEQ ID NO: 611856 - DNA, 25 bp, Homo sapien
ggagatacttagagcagtcagaatc

SEQ ID NO: 611857 - DNA, 25 bp, Homo sapien
cacaaagacagagtggtggttggca

SEQ ID NO: 611858 - DNA, 25 bp, Homo sapien
gattgtttcataggtatagagtttt

SEQ ID NO: 611859 - DNA, 25 bp, Homo sapien
tcataggtatagagttttggtttta

SEQ ID NO: 611860 - DNA, 25 bp, Homo sapien
ggtggcaatggctgcacaacattac

SEQ ID NO: 611861 - DNA, 25 bp, Homo sapien
ggcaatggctgcacaacattacaaa

SEQ ID NO: 611862 - DNA, 25 bp, Homo sapien
caatggctgcacaacattacaaatg

SEQ ID NO: 611863 - DNA, 25 bp, Homo sapien
tttaataacatgaactgtacacttg

SEQ ID NO: 611864 - DNA, 25 bp, Homo sapien
aacatgaactgtacacttgaaaatg

SEQ ID NO: 611865 - DNA, 25 bp, Homo sapien
ttttttgcctgtgtaccggcagact

SEQ ID NO: 611866 - DNA, 25 bp, Homo sapien
gtaccggcagactcactggaggtta

SEQ ID NO: 611867 - DNA, 25 bp, Homo sapien
caaaaccattcgctggactattccc

SEQ ID NO: 611868 - DNA, 25 bp, Homo sapien
gaattcccctagtggcaaagatttc

SEQ ID NO: 611869 - DNA, 25 bp, Homo sapien
tcttggaatatatggagttcctcca

SEQ ID NO: 611870 - DNA, 25 bp, Homo sapien
tcccttactaccgtttttcatagct

SEQ ID NO: 611871 - DNA, 25 bp, Homo sapien
cgtttttcatagctgacattaccat

SEQ ID NO: 611872 - DNA, 25 bp, Homo sapien
acattaccatagctaaactcctctg

SEQ ID NO: 611873 - DNA, 25 bp, Homo sapien
taaactcctctgaagtggacagctg

SEQ ID NO: 611874 - DNA, 25 bp, Homo sapien
gtggacagctggtcgctattgtgat

SEQ ID NO: 611875 - DNA, 25 bp, Homo sapien
ggtcgctattgtgatattctgtgaa

SEQ ID NO: 611876 - DNA, 25 bp, Homo sapien
aggcggctcccaggaaggatattgt

SEQ ID NO: 611877 - DNA, 25 bp, Homo sapien
tcccaggaaggatattgtaggtgtt

SEQ ID NO: 611878 - DNA, 25 bp, Homo sapien
ggccagggcatctcttgccaggtgc

SEQ ID NO: 611879 - DNA, 25 bp, Homo sapien
atctcttgccaggtgcctgcaaaga

SEQ ID NO: 611880 - DNA, 25 bp, Homo sapien
ggtgcctgcaaagaggccttttgct

SEQ ID NO: 611881 - DNA, 25 bp, Homo sapien
aggccttttgctcttggtcgaagtc

SEQ ID NO: 611882 - DNA, 25 bp, Homo sapien
ggtcgaagtcagctttctgcgtgaa

SEQ ID NO: 611883 - DNA, 25 bp, Homo sapien
gggctttcgctctggaaccacaaag

SEQ ID NO: 611884 - DNA, 25 bp, Homo sapien
ggaaccacaaagtctgccatgccct

SEQ ID NO: 611885 - DNA, 25 bp, Homo sapien
ctggtgcttgcagccgatgctgtag

SEQ ID NO: 611886 - DNA, 25 bp, Homo sapien
gactctcgtacggacgggctcggca

SEQ ID NO: 611887 - DNA, 25 bp, Homo sapien
tcgaggctgacggaatcctggacat

SEQ ID NO: 611888 - DNA, 25 bp, Homo sapien
gaatcctggacatgggctggcatca

SEQ ID NO: 611889 - DNA, 25 bp, Homo sapien
atgggctggcatcacgggccatctt

SEQ ID NO: 611890 - DNA, 25 bp, Homo sapien
acgggccatcttctacttgagatat

SEQ ID NO: 611891 - DNA, 25 bp, Homo sapien
gcaactgtattgaaatctcctaaat

SEQ ID NO: 611892 - DNA, 25 bp, Homo sapien
ctaaatgcagcagatttggagcctg

SEQ ID NO: 611893 - DNA, 25 bp, Homo sapien
tggagcctgcaaacacttcttttag

SEQ ID NO: 611894 - DNA, 25 bp, Homo sapien
aacacttcttttagggaggaggcag

SEQ ID NO: 611895 - DNA, 25 bp, Homo sapien
gaggaggcagtattgctcttaacct

SEQ ID NO: 611896 - DNA, 25 bp, Homo sapien
atcctcaatggtctttgagacgttt

SEQ ID NO: 611897 - DNA, 25 bp, Homo sapien
cgtttggaaacgtgtgcacaagtga

SEQ ID NO: 611898 - DNA, 25 bp, Homo sapien
tggatgacctgcctagcagtttccc

SEQ ID NO: 611899 - DNA, 25 bp, Homo sapien
tgcctagcagtttccccatgagata

SEQ ID NO: 611900 - DNA, 25 bp, Homo sapien
agcagtttccccatgagatagagga

SEQ ID NO: 611901 - DNA, 25 bp, Homo sapien
atgtctacgtatttcattccctgtt

SEQ ID NO: 611902 - DNA, 25 bp, Homo sapien
ctacgtatttcattccctgttcctg

SEQ ID NO: 611903 - DNA, 25 bp, Homo sapien
gaaacaatttcaatcactgacaaat

SEQ ID NO: 611904 - DNA, 25 bp, Homo sapien
ttactgagtgcccatatgtgaaaga

SEQ ID NO: 611905 - DNA, 25 bp, Homo sapien
gtgaaagaaatccactctacattcc

SEQ ID NO: 611906 - DNA, 25 bp, Homo sapien
aatccactctacattccacagatgc

SEQ ID NO: 611907 - DNA, 25 bp, Homo sapien
tacattccacagatgcatttcctct

SEQ ID NO: 611908 - DNA, 25 bp, Homo sapien
atgtagaatatatctgtcttccctt

SEQ ID NO: 611909 - DNA, 25 bp, Homo sapien
gaacactgaggtggatgccctcgac

SEQ ID NO: 611910 - DNA, 25 bp, Homo sapien
ggatgccctcgacccgagcatcatg

SEQ ID NO: 611911 - DNA, 25 bp, Homo sapien
tcgacccgagcatcatggacttcgc

SEQ ID NO: 611912 - DNA, 25 bp, Homo sapien
gcatcatggacttcgctctgcaggg

SEQ ID NO: 611913 - DNA, 25 bp, Homo sapien
atgagggattcagcttggacacact

SEQ ID NO: 611914 - DNA, 25 bp, Homo sapien
agggattcagcttggacacactggg

SEQ ID NO: 611915 - DNA, 25 bp, Homo sapien
tggacacactgggcgcctttgcaga

SEQ ID NO: 611916 - DNA, 25 bp, Homo sapien
agactccccgcttggctgtgacctg

SEQ ID NO: 611917 - DNA, 25 bp, Homo sapien
ccgccatgggaagggctcctgtaga

SEQ ID NO: 611918 - DNA, 25 bp, Homo sapien
catcaacatcagcaccgacatgaac

SEQ ID NO: 611919 - DNA, 25 bp, Homo sapien
tcagcaccgacatgaacactgaggt

SEQ ID NO: 611920 - DNA, 25 bp, Homo sapien
tcagtagtctccctgagaagcacca

SEQ ID NO: 611921 - DNA, 25 bp, Homo sapien
gagaagcaccacatggctatgcaaa

SEQ ID NO: 611922 - DNA, 25 bp, Homo sapien
acgggtctgagtctaaggaacaaat

SEQ ID NO: 611923 - DNA, 25 bp, Homo sapien
acaaatgacatgtggcttgaggcca

SEQ ID NO: 611924 - DNA, 25 bp, Homo sapien
ttgaggccacactccagacacggaa

SEQ ID NO: 611925 - DNA, 25 bp, Homo sapien
ctccagacacggaattgggtttgct

SEQ ID NO: 611926 - DNA, 25 bp, Homo sapien
gtctcagctagaccactgacttgct

SEQ ID NO: 611927 - DNA, 25 bp, Homo sapien
ttcaccatctcagtcctacatggag

SEQ ID NO: 611928 - DNA, 25 bp, Homo sapien
atctcagtcctacatggagcttaat

SEQ ID NO: 611929 - DNA, 25 bp, Homo sapien
aaaacctgctttgtcctgatgacta

SEQ ID NO: 611930 - DNA, 25 bp, Homo sapien
gctttgtcctgatgactaaatggag

SEQ ID NO: 611931 - DNA, 25 bp, Homo sapien
aattcctatcgcatagtgacatcct

SEQ ID NO: 611932 - DNA, 25 bp, Homo sapien
gtgacatcctagctatcttaacatc

SEQ ID NO: 611933 - DNA, 25 bp, Homo sapien
acaatgcattactcatgtgtttatg

SEQ ID NO: 611934 - DNA, 25 bp, Homo sapien
attactcatgtgtttatgttgatgc

SEQ ID NO: 611935 - DNA, 25 bp, Homo sapien
gttgatgctggtgttaacctattgt

SEQ ID NO: 611936 - DNA, 25 bp, Homo sapien
gtgttaacctattgtgctgccagta

SEQ ID NO: 611937 - DNA, 25 bp, Homo sapien
acctattgtgctgccagtagtataa

SEQ ID NO: 611938 - DNA, 25 bp, Homo sapien
gtatagcatgtcctgtttagatttc

SEQ ID NO: 611939 - DNA, 25 bp, Homo sapien
gcatgtcctgtttagatttcttcca

SEQ ID NO: 611940 - DNA, 25 bp, Homo sapien
tgtttagatttcttccaagcatact

SEQ ID NO: 611941 - DNA, 25 bp, Homo sapien
aacttccattcctgctctggaggaa

SEQ ID NO: 611942 - DNA, 25 bp, Homo sapien
tgcttgcaaatggaacgggcttgac

SEQ ID NO: 611943 - DNA, 25 bp, Homo sapien
atggaacgggcttgaccttctttat

SEQ ID NO: 611944 - DNA, 25 bp, Homo sapien
aacgggcttgaccttctttatcact

SEQ ID NO: 611945 - DNA, 25 bp, Homo sapien
ctttatcactccagaaatgctttat

SEQ ID NO: 611946 - DNA, 25 bp, Homo sapien
aatcttttttctattggagcatcac

SEQ ID NO: 611947 - DNA, 25 bp, Homo sapien
ctattggagcatcactttaaaacct

SEQ ID NO: 611948 - DNA, 25 bp, Homo sapien
acctcaaagttgagaaggcttttct

SEQ ID NO: 611949 - DNA, 25 bp, Homo sapien
gcatgatgctgaagccagaagcctt

SEQ ID NO: 611950 - DNA, 25 bp, Homo sapien
atctctgtggccagtctctacaaaa

SEQ ID NO: 611951 - DNA, 25 bp, Homo sapien
atgtgaaaaattgcccaactttcct

SEQ ID NO: 611952 - DNA, 25 bp, Homo sapien
tgcccaactttcctcacaaatgagt

SEQ ID NO: 611953 - DNA, 25 bp, Homo sapien
ctattcttaggctttatctacaaag

SEQ ID NO: 611954 - DNA, 25 bp, Homo sapien
atttatcaaccagaatatgcagtag

SEQ ID NO: 611955 - DNA, 25 bp, Homo sapien
tggtagctgattaagtatagttccc

SEQ ID NO: 611956 - DNA, 25 bp, Homo sapien
ttctttctaaccctgccacatagtt

SEQ ID NO: 611957 - DNA, 25 bp, Homo sapien
tctaaccctgccacatagttatatg

SEQ ID NO: 611958 - DNA, 25 bp, Homo sapien
ccctgccacatagttatatgttcta

SEQ ID NO: 611959 - DNA, 25 bp, Homo sapien
atatgttctaaatcttccttgctgg

SEQ ID NO: 611960 - DNA, 25 bp, Homo sapien
atgttctaaatcttccttgctggta

SEQ ID NO: 611961 - DNA, 25 bp, Homo sapien
gttctaaatcttccttgctggtaca

SEQ ID NO: 611962 - DNA, 25 bp, Homo sapien
aaatcttccttgctggtacatctat

SEQ ID NO: 611963 - DNA, 25 bp, Homo sapien
ttccttgctggtacatctatattga

SEQ ID NO: 611964 - DNA, 25 bp, Homo sapien
atcctcttgacttcacaggtggcgt

SEQ ID NO: 611965 - DNA, 25 bp, Homo sapien
gacttcacaggtggcgttaacccga

SEQ ID NO: 611966 - DNA, 25 bp, Homo sapien
cgttaacccgatcgcttgtgtgaaa

SEQ ID NO: 611967 - DNA, 25 bp, Homo sapien
aacccgatcgcttgtgtgaaaataa

SEQ ID NO: 611968 - DNA, 25 bp, Homo sapien
tcgcttgtgtgaaaataacgcatcg

SEQ ID NO: 611969 - DNA, 25 bp, Homo sapien
taacgcatcgggaggcactaggctg

SEQ ID NO: 611970 - DNA, 25 bp, Homo sapien
ggcactaggctgagggcttcagtac

SEQ ID NO: 611971 - DNA, 25 bp, Homo sapien
gagggcttcagtacctcagaagcaa

SEQ ID NO: 611972 - DNA, 25 bp, Homo sapien
tgtttcacttcaatccatccttttt

SEQ ID NO: 611973 - DNA, 25 bp, Homo sapien
cttccttccaagaacactgatgaag

SEQ ID NO: 611974 - DNA, 25 bp, Homo sapien
ggttttccttgtgctccttggtaga

SEQ ID NO: 611975 - DNA, 25 bp, Homo sapien
gggctcttccaagtcagaagaatgg

SEQ ID NO: 611976 - DNA, 25 bp, Homo sapien
aaggtggacaagcaacccagcatcc

SEQ ID NO: 611977 - DNA, 25 bp, Homo sapien
aatgcctgcccgtgttgagtgagac

SEQ ID NO: 611978 - DNA, 25 bp, Homo sapien
gtgttgagtgagacttctccatcct

SEQ ID NO: 611979 - DNA, 25 bp, Homo sapien
tggctgcgtgacctcagtgacctgc

SEQ ID NO: 611980 - DNA, 25 bp, Homo sapien
cagtgacctgcaccccattttggga

SEQ ID NO: 611981 - DNA, 25 bp, Homo sapien
cccattttgggacaccttggtgcat

SEQ ID NO: 611982 - DNA, 25 bp, Homo sapien
gggacaccttggtgcattaaggaaa

SEQ ID NO: 611983 - DNA, 25 bp, Homo sapien
gggtgaaagcccttgaattcatcct

SEQ ID NO: 611984 - DNA, 25 bp, Homo sapien
aaagcccttgaattcatcctcatgg

SEQ ID NO: 611985 - DNA, 25 bp, Homo sapien
tcatcctcatgggaaatggctgagt

SEQ ID NO: 611986 - DNA, 25 bp, Homo sapien
accaaacatgcccctggagtcacgg

SEQ ID NO: 611987 - DNA, 25 bp, Homo sapien
tctgcatccagaagtgcctgccgtg

SEQ ID NO: 611988 - DNA, 25 bp, Homo sapien
gaagtgcctgccgtgccacagggaa

SEQ ID NO: 611989 - DNA, 25 bp, Homo sapien
aacctcacaggctcaggcgagctca

SEQ ID NO: 611990 - DNA, 25 bp, Homo sapien
ctcacaggctcaggcgagctcagtg

SEQ ID NO: 611991 - DNA, 25 bp, Homo sapien
ctcagtggagccagggagcagaact

SEQ ID NO: 611992 - DNA, 25 bp, Homo sapien
tgaccagccgctacgacaggagagc

SEQ ID NO: 611993 - DNA, 25 bp, Homo sapien
agccgctacgacaggagagctcctc

SEQ ID NO: 611994 - DNA, 25 bp, Homo sapien
tctcctctgggaactgaccctcaat

SEQ ID NO: 611995 - DNA, 25 bp, Homo sapien
cctctgggaactgaccctcaatggg

SEQ ID NO: 611996 - DNA, 25 bp, Homo sapien
atgggggtcccctcgtcaggagcaa

SEQ ID NO: 611997 - DNA, 25 bp, Homo sapien
tcgttgcaggtagcctcattaattc

SEQ ID NO: 611998 - DNA, 25 bp, Homo sapien
aggtagcctcattaattctcaacag

SEQ ID NO: 611999 - DNA, 25 bp, Homo sapien
ttaattctcaacagtgtctaagaga

SEQ ID NO: 612000 - DNA, 25 bp, Homo sapien
gtgtgtgtgcattaatcccccagac

SEQ ID NO: 612001 - DNA, 25 bp, Homo sapien
actccctgagggattcatttgtact

SEQ ID NO: 612002 - DNA, 25 bp, Homo sapien
gattcatttgtacttgaaatccagg

SEQ ID NO: 612003 - DNA, 25 bp, Homo sapien
gaaatccaggatagaatcttgccta

SEQ ID NO: 612004 - DNA, 25 bp, Homo sapien
atagaatcttgcctatccttctcta

SEQ ID NO: 612005 - DNA, 25 bp, Homo sapien
aatcttgcctatccttctctaatgt

SEQ ID NO: 612006 - DNA, 25 bp, Homo sapien
tatccttctctaatgtcagctttct

SEQ ID NO: 612007 - DNA, 25 bp, Homo sapien
tctctaatgtcagctttcttttgct

SEQ ID NO: 612008 - DNA, 25 bp, Homo sapien
ttaaggcaactgagcaagatatatt

SEQ ID NO: 612009 - DNA, 25 bp, Homo sapien
tatcagtgctgagccactggtttgt

SEQ ID NO: 612010 - DNA, 25 bp, Homo sapien
actggtttgtgggtatgtcatttcc

SEQ ID NO: 612011 - DNA, 25 bp, Homo sapien
gggtatgtcatttccacagacatca

SEQ ID NO: 612012 - DNA, 25 bp, Homo sapien
tttccacagacatcaaaatgctatt

SEQ ID NO: 612013 - DNA, 25 bp, Homo sapien
atttagtttgttttggtccatcatt

SEQ ID NO: 612014 - DNA, 25 bp, Homo sapien
ttgttttggtccatcattcaatgat

SEQ ID NO: 612015 - DNA, 25 bp, Homo sapien
gatacctccccttagaattgaatga

SEQ ID NO: 612016 - DNA, 25 bp, Homo sapien
aattatttcacatctgtggcaaggt

SEQ ID NO: 612017 - DNA, 25 bp, Homo sapien
gtagagtgctttgtttatccagttt

SEQ ID NO: 612018 - DNA, 25 bp, Homo sapien
gtggaagtttatatggacatctaaa

SEQ ID NO: 612019 - DNA, 25 bp, Homo sapien
caaaatagaattctaggtcattgta

SEQ ID NO: 612020 - DNA, 25 bp, Homo sapien
ggtcattgtaagtcatttatttagc

SEQ ID NO: 612021 - DNA, 25 bp, Homo sapien
gcaaaaatctttacttgttaataga

SEQ ID NO: 612022 - DNA, 25 bp, Homo sapien
ttacttgttaatagagaggagtctc

SEQ ID NO: 612023 - DNA, 25 bp, Homo sapien
gaggagtctcaacttgttaagacca

SEQ ID NO: 612024 - DNA, 25 bp, Homo sapien
tctcaacttgttaagaccaatacag

SEQ ID NO: 612025 - DNA, 25 bp, Homo sapien
gaccaatacagatagcatgaagcca

SEQ ID NO: 612026 - DNA, 25 bp, Homo sapien
tagcatgaagccaactgaaactgtc

SEQ ID NO: 612027 - DNA, 25 bp, Homo sapien
gccaactgaaactgtcttttctctc

SEQ ID NO: 612028 - DNA, 25 bp, Homo sapien
ctctctcccctgtatttaaatgaca

SEQ ID NO: 612029 - DNA, 25 bp, Homo sapien
agtgtattcttaatgttatactcaa

SEQ ID NO: 612030 - DNA, 25 bp, Homo sapien
gcttcctaagggatgagacaggaga

SEQ ID NO: 612031 - DNA, 25 bp, Homo sapien
gatgagacaggagacttcaccgcct

SEQ ID NO: 612032 - DNA, 25 bp, Homo sapien
agacaggagacttcaccgcctcttt

SEQ ID NO: 612033 - DNA, 25 bp, Homo sapien
ctttcctcctgtctggttctttgat

SEQ ID NO: 612034 - DNA, 25 bp, Homo sapien
tgtctggttctttgatcctctccgg

SEQ ID NO: 612035 - DNA, 25 bp, Homo sapien
ggttctttgatcctctccggcagct

SEQ ID NO: 612036 - DNA, 25 bp, Homo sapien
tccggcagcttcatctacatagggt

SEQ ID NO: 612037 - DNA, 25 bp, Homo sapien
gcttcatctacatagggttgcccag

SEQ ID NO: 612038 - DNA, 25 bp, Homo sapien
ctacatagggttgcccagggcgctg

SEQ ID NO: 612039 - DNA, 25 bp, Homo sapien
aggcagtcttgctgtccccaggagg

SEQ ID NO: 612040 - DNA, 25 bp, Homo sapien
ctctggacaccacttgttgattatt

SEQ ID NO: 612041 - DNA, 25 bp, Homo sapien
taactggaacagcatagtaaattct

SEQ ID NO: 612042 - DNA, 25 bp, Homo sapien
gaacagcatagtaaattctagttaa

SEQ ID NO: 612043 - DNA, 25 bp, Homo sapien
gttttagttaacatacatgctcaag

SEQ ID NO: 612044 - DNA, 25 bp, Homo sapien
tttagttaacatacatgctcaagtt

SEQ ID NO: 612045 - DNA, 25 bp, Homo sapien
aacatacatgctcaagttaagggtg

SEQ ID NO: 612046 - DNA, 25 bp, Homo sapien
catacatgctcaagttaagggtgtg

SEQ ID NO: 612047 - DNA, 25 bp, Homo sapien
tacatgctcaagttaagggtgtggt

SEQ ID NO: 612048 - DNA, 25 bp, Homo sapien
catgctcaagttaagggtgtggtat

SEQ ID NO: 612049 - DNA, 25 bp, Homo sapien
tgctcaagttaagggtgtggtatac

SEQ ID NO: 612050 - DNA, 25 bp, Homo sapien
aagggtgtggtatactaacaactgc

SEQ ID NO: 612051 - DNA, 25 bp, Homo sapien
agggtgtggtatactaacaactgca

SEQ ID NO: 612052 - DNA, 25 bp, Homo sapien
aggagatcatcccattacagctaag

SEQ ID NO: 612053 - DNA, 25 bp, Homo sapien
agatcatcccattacagctaaggcc

SEQ ID NO: 612054 - DNA, 25 bp, Homo sapien
atcccattacagctaaggccattgc

SEQ ID NO: 612055 - DNA, 25 bp, Homo sapien
ccattacagctaaggccattgccaa

SEQ ID NO: 612056 - DNA, 25 bp, Homo sapien
agaggaagtcgctgcccggcttaag

SEQ ID NO: 612057 - DNA, 25 bp, Homo sapien
ccggcttaagatccctatcagcaag

SEQ ID NO: 612058 - DNA, 25 bp, Homo sapien
agtgctgccaaagccattgtggtgc

SEQ ID NO: 612059 - DNA, 25 bp, Homo sapien
caaagccattgtggtgcatggtgca

SEQ ID NO: 612060 - DNA, 25 bp, Homo sapien
agcaagtgtcgcagtgcaggaatta

SEQ ID NO: 612061 - DNA, 25 bp, Homo sapien
gcagtgcaggaattaaggtgatcat

SEQ ID NO: 612062 - DNA, 25 bp, Homo sapien
atcatggtaacaggagatcatccca

SEQ ID NO: 612063 - DNA, 25 bp, Homo sapien
agcaggaggagaagatgcagggcca

SEQ ID NO: 612064 - DNA, 25 bp, Homo sapien
aggaggagatgatgcgagagaagga

SEQ ID NO: 612065 - DNA, 25 bp, Homo sapien
ggaggagaggatatgagatcagaaa

SEQ ID NO: 612066 - DNA, 25 bp, Homo sapien
aggagaggatatgagatcagaaaga

SEQ ID NO: 612067 - DNA, 25 bp, Homo sapien
gatcagaaagagaagatgcaggaga

SEQ ID NO: 612068 - DNA, 25 bp, Homo sapien
aggagaggctgccagagcacgagga

SEQ ID NO: 612069 - DNA, 25 bp, Homo sapien
ggagaggctgccagagcacgaggag

SEQ ID NO: 612070 - DNA, 25 bp, Homo sapien
cacgaggagcggtgctcagagccct

SEQ ID NO: 612071 - DNA, 25 bp, Homo sapien
acgaggagcggtgctcagagccctg

SEQ ID NO: 612072 - DNA, 25 bp, Homo sapien
cgaggagcggtgctcagagccctgc

SEQ ID NO: 612073 - DNA, 25 bp, Homo sapien
ggagcggtgctcagagccctgcctc

SEQ ID NO: 612074 - DNA, 25 bp, Homo sapien
agcacttctgaagcctattagattg

SEQ ID NO: 612075 - DNA, 25 bp, Homo sapien
gaagcctattagattgcagattttt

SEQ ID NO: 612076 - DNA, 25 bp, Homo sapien
tttttccccacagcatcttgacaga

SEQ ID NO: 612077 - DNA, 25 bp, Homo sapien
cccacagcatcttgacagaccagtg

SEQ ID NO: 612078 - DNA, 25 bp, Homo sapien
gacagaccagtgttccacagatcat

SEQ ID NO: 612079 - DNA, 25 bp, Homo sapien
cagtgttccacagatcatcctcaag

SEQ ID NO: 612080 - DNA, 25 bp, Homo sapien
gatcatcctcaagggaacacaggta

SEQ ID NO: 612081 - DNA, 25 bp, Homo sapien
gtatgatcatgtgaatctcatccca

SEQ ID NO: 612082 - DNA, 25 bp, Homo sapien
tgtgaatctcatcccataatagtgt

SEQ ID NO: 612083 - DNA, 25 bp, Homo sapien
cataatagtgtacaagacatcttgc

SEQ ID NO: 612084 - DNA, 25 bp, Homo sapien
agacatcttgcattgtgcttggcac

SEQ ID NO: 612085 - DNA, 25 bp, Homo sapien
agcaatagttatgagtcattggagg

SEQ ID NO: 612086 - DNA, 25 bp, Homo sapien
aggagacatcccagaggcgccagct

SEQ ID NO: 612087 - DNA, 25 bp, Homo sapien
ggagacatcccagaggcgccagctc

SEQ ID NO: 612088 - DNA, 25 bp, Homo sapien
gagacatcccagaggcgccagctcc

SEQ ID NO: 612089 - DNA, 25 bp, Homo sapien
agacatcccagaggcgccagctccc

SEQ ID NO: 612090 - DNA, 25 bp, Homo sapien
tcccagaggcgccagctcccctctg

SEQ ID NO: 612091 - DNA, 25 bp, Homo sapien
tggaaggggatgtgcaactcagagg

SEQ ID NO: 612092 - DNA, 25 bp, Homo sapien
ggaaggggatgtgcaactcagaggg

SEQ ID NO: 612093 - DNA, 25 bp, Homo sapien
gggatgtgcaactcagaggggacct

SEQ ID NO: 612094 - DNA, 25 bp, Homo sapien
ggagaccccagagggaccatggcag

SEQ ID NO: 612095 - DNA, 25 bp, Homo sapien
gagaccccagagggaccatggcaga

SEQ ID NO: 612096 - DNA, 25 bp, Homo sapien
ccaccattccgatggctctgtcagc

SEQ ID NO: 612097 - DNA, 25 bp, Homo sapien
gcctctctgggcacttgcagccgcc

SEQ ID NO: 612098 - DNA, 25 bp, Homo sapien
cccagtcaccactgagcagcatggg

SEQ ID NO: 612099 - DNA, 25 bp, Homo sapien
ggcacgctatgcctgtcgaattcac

SEQ ID NO: 612100 - DNA, 25 bp, Homo sapien
acgctatgcctgtcgaattcaccat

SEQ ID NO: 612101 - DNA, 25 bp, Homo sapien
cgctatgcctgtcgaattcaccatc

SEQ ID NO: 612102 - DNA, 25 bp, Homo sapien
tatgcctgtcgaattcaccatccca

SEQ ID NO: 612103 - DNA, 25 bp, Homo sapien
atgcctgtcgaattcaccatcccag

SEQ ID NO: 612104 - DNA, 25 bp, Homo sapien
ttgtgtcccacttctacccttctgg

SEQ ID NO: 612105 - DNA, 25 bp, Homo sapien
tgtgtcccacttctacccttctggg

SEQ ID NO: 612106 - DNA, 25 bp, Homo sapien
cttctacccttctgggggcctggag

SEQ ID NO: 612107 - DNA, 25 bp, Homo sapien
gtgagaagttgtgcggccaccactt

SEQ ID NO: 612108 - DNA, 25 bp, Homo sapien
aagttgtgcggccaccacttcgtac

SEQ ID NO: 612109 - DNA, 25 bp, Homo sapien
ttgtgcggccaccacttcgtacgcg

SEQ ID NO: 612110 - DNA, 25 bp, Homo sapien
gctggtccaccgaagccaggaggcc

SEQ ID NO: 612111 - DNA, 25 bp, Homo sapien
tgcacgctactgctgcctcagtggc

SEQ ID NO: 612112 - DNA, 25 bp, Homo sapien
gctactgctgcctcagtggctgtac

SEQ ID NO: 612113 - DNA, 25 bp, Homo sapien
cagtggctgtacccaacaagacctg

SEQ ID NO: 612114 - DNA, 25 bp, Homo sapien
tgggccctgccctggtgttcgcgtt

SEQ ID NO: 612115 - DNA, 25 bp, Homo sapien
ctgccctggtgttcgcgttgggccc

SEQ ID NO: 612116 - DNA, 25 bp, Homo sapien
gcccaccccagagatgcgtgagaag

SEQ ID NO: 612117 - DNA, 25 bp, Homo sapien
atgcgtgagaagttgtgcggccacc

SEQ ID NO: 612118 - DNA, 25 bp, Homo sapien
tgggtcaccaggtcctctcaagagt

SEQ ID NO: 612119 - DNA, 25 bp, Homo sapien
accaggtcctctcaagagtcctcag

SEQ ID NO: 612120 - DNA, 25 bp, Homo sapien
actgccatcgatttcactctatgga

SEQ ID NO: 612121 - DNA, 25 bp, Homo sapien
gatttcactctatggaggcaatcca

SEQ ID NO: 612122 - DNA, 25 bp, Homo sapien
aggcaatccattaagggctccagca

SEQ ID NO: 612123 - DNA, 25 bp, Homo sapien
gcaatccattaagggctccagcaac

SEQ ID NO: 612124 - DNA, 25 bp, Homo sapien
cagagtctgtgttccgagcagcact

SEQ ID NO: 612125 - DNA, 25 bp, Homo sapien
gcactcagtaagaaggtggctgact

SEQ ID NO: 612126 - DNA, 25 bp, Homo sapien
gaaggtggctgacttgattcatttt

SEQ ID NO: 612127 - DNA, 25 bp, Homo sapien
gtgcaggctgccactactgaggagc

SEQ ID NO: 612128 - DNA, 25 bp, Homo sapien
gcaggctgccactactgaggagcag

SEQ ID NO: 612129 - DNA, 25 bp, Homo sapien
tctgatgggaaggacttgactccag

SEQ ID NO: 612130 - DNA, 25 bp, Homo sapien
tgggaaggacttgactccaggtgca

SEQ ID NO: 612131 - DNA, 25 bp, Homo sapien
aaggacttgactccaggtgcagaga

SEQ ID NO: 612132 - DNA, 25 bp, Homo sapien
acttgactccaggtgcagagatgca

SEQ ID NO: 612133 - DNA, 25 bp, Homo sapien
tgcagagatgcacaggctcaagaga

SEQ ID NO: 612134 - DNA, 25 bp, Homo sapien
gatgcacaggctcaagagagtaaac

SEQ ID NO: 612135 - DNA, 25 bp, Homo sapien
gagagtaaaccaggactgctgcccg

SEQ ID NO: 612136 - DNA, 25 bp, Homo sapien
gtaaaccaggactgctgcccgcaca

SEQ ID NO: 612137 - DNA, 25 bp, Homo sapien
acatttacaatggactgctggtgca

SEQ ID NO: 612138 - DNA, 25 bp, Homo sapien
atttacaatggactgctggtgcaga

SEQ ID NO: 612139 - DNA, 25 bp, Homo sapien
aatggactgctggtgcagaagaata

SEQ ID NO: 612140 - DNA, 25 bp, Homo sapien
acatgtatgaggcaatgaggtgtat

SEQ ID NO: 612141 - DNA, 25 bp, Homo sapien
gtctgagccgattcacaaagttgtc

SEQ ID NO: 612142 - DNA, 25 bp, Homo sapien
aaagttgtccctgcaagaagccatg

SEQ ID NO: 612143 - DNA, 25 bp, Homo sapien
tccctgcaagaagccatgcctatat

SEQ ID NO: 612144 - DNA, 25 bp, Homo sapien
tgcctatatggctgtgtttacttct

SEQ ID NO: 612145 - DNA, 25 bp, Homo sapien
atggctgtgtttacttctttacctg

SEQ ID NO: 612146 - DNA, 25 bp, Homo sapien
tacttctttacctgtattacatcca

SEQ ID NO: 612147 - DNA, 25 bp, Homo sapien
attacatccaattccaggagctcct

SEQ ID NO: 612148 - DNA, 25 bp, Homo sapien
attccaggagctccttttatattta

SEQ ID NO: 612149 - DNA, 25 bp, Homo sapien
gcagtatcactgagaattccatcat

SEQ ID NO: 612150 - DNA, 25 bp, Homo sapien
aattccatcatttattcatcaacta

SEQ ID NO: 612151 - DNA, 25 bp, Homo sapien
ggctactcagggaaacgtgctctaa

SEQ ID NO: 612152 - DNA, 25 bp, Homo sapien
ggaataacaagtacgaaagccctga

SEQ ID NO: 612153 - DNA, 25 bp, Homo sapien
gaaagccctgatatgcgagctaagg

SEQ ID NO: 612154 - DNA, 25 bp, Homo sapien
agctaaggtgctcagggacaacaaa

SEQ ID NO: 612155 - DNA, 25 bp, Homo sapien
gttacaaagcagttcatgtgggact

SEQ ID NO: 612156 - DNA, 25 bp, Homo sapien
agcagttcatgtgggactttgtaga

SEQ ID NO: 612157 - DNA, 25 bp, Homo sapien
gacgagtataaggactgtggctttt

SEQ ID NO: 612158 - DNA, 25 bp, Homo sapien
ggactgtggctttttcagtgaatga

SEQ ID NO: 612159 - DNA, 25 bp, Homo sapien
taactggcaggttctgagcaaggag

SEQ ID NO: 612160 - DNA, 25 bp, Homo sapien
gagcaaggagggatatgacctgatt

SEQ ID NO: 612161 - DNA, 25 bp, Homo sapien
gataatgtaatcgtgtttaaactca

SEQ ID NO: 612162 - DNA, 25 bp, Homo sapien
tatgctgatagcaatctgtcttaaa

SEQ ID NO: 612163 - DNA, 25 bp, Homo sapien
gatagcaatctgtcttaaataagca

SEQ ID NO: 612164 - DNA, 25 bp, Homo sapien
gcagcagttgatacaattcagtact

SEQ ID NO: 612165 - DNA, 25 bp, Homo sapien
taatcttatagttacgaaacggtct

SEQ ID NO: 612166 - DNA, 25 bp, Homo sapien
gcaatctgaagactttatgccttta

SEQ ID NO: 612167 - DNA, 25 bp, Homo sapien
tgaagactttatgcctttaacgaaa

SEQ ID NO: 612168 - DNA, 25 bp, Homo sapien
tatgcctttaacgaaatatctgatt

SEQ ID NO: 612169 - DNA, 25 bp, Homo sapien
atatctgattataaatccacatggg

SEQ ID NO: 612170 - DNA, 25 bp, Homo sapien
ggacagatgaaacaagaacaaccat

SEQ ID NO: 612171 - DNA, 25 bp, Homo sapien
gaacaaccatgaattgcttgatagt

SEQ ID NO: 612172 - DNA, 25 bp, Homo sapien
atgaattgcttgatagtttatgctg

SEQ ID NO: 612173 - DNA, 25 bp, Homo sapien
ccaccattgtggaagcttactgaaa

SEQ ID NO: 612174 - DNA, 25 bp, Homo sapien
cattgtggaagcttactgaaacctt

SEQ ID NO: 612175 - DNA, 25 bp, Homo sapien
tgaaaccttccaccagaggcagatg

SEQ ID NO: 612176 - DNA, 25 bp, Homo sapien
gatgccggcacacacttcttgtaca

SEQ ID NO: 612177 - DNA, 25 bp, Homo sapien
tgccggcacacacttcttgtacagt

SEQ ID NO: 612178 - DNA, 25 bp, Homo sapien
tcttgtacagtctgcccaacgatga

SEQ ID NO: 612179 - DNA, 25 bp, Homo sapien
gtacagtctgcccaacgatgaacca

SEQ ID NO: 612180 - DNA, 25 bp, Homo sapien
tacagtctgcccaacgatgaaccaa

SEQ ID NO: 612181 - DNA, 25 bp, Homo sapien
agtctgcccaacgatgaaccaaaca

SEQ ID NO: 612182 - DNA, 25 bp, Homo sapien
tctgcccaacgatgaaccaaacaag

SEQ ID NO: 612183 - DNA, 25 bp, Homo sapien
cccaacgatgaaccaaacaagcctt

SEQ ID NO: 612184 - DNA, 25 bp, Homo sapien
ttgcggctcccctattgtcaatatc

SEQ ID NO: 612185 - DNA, 25 bp, Homo sapien
tgtcaatatcttcctgcggtgccca

SEQ ID NO: 612186 - DNA, 25 bp, Homo sapien
ccaccgcacatctttgttcaaaaac

SEQ ID NO: 612187 - DNA, 25 bp, Homo sapien
tttgttcaaaaacgccgcatcttcg

SEQ ID NO: 612188 - DNA, 25 bp, Homo sapien
atacctttgatagcactgcagggct

SEQ ID NO: 612189 - DNA, 25 bp, Homo sapien
actgcagggcttcagatcggcattc

SEQ ID NO: 612190 - DNA, 25 bp, Homo sapien
atcggcattctggacgggttgtttt

SEQ ID NO: 612191 - DNA, 25 bp, Homo sapien
tatctggttgcatggaatcgcgctg

SEQ ID NO: 612192 - DNA, 25 bp, Homo sapien
gttctctatccttcctatgttatga

SEQ ID NO: 612193 - DNA, 25 bp, Homo sapien
gaaatagtttctcgccgtctagata

SEQ ID NO: 612194 - DNA, 25 bp, Homo sapien
acaaagtcttccattgcggccttga

SEQ ID NO: 612195 - DNA, 25 bp, Homo sapien
tgcagaccaaagccaccaactcagg

SEQ ID NO: 612196 - DNA, 25 bp, Homo sapien
gcagaccaaagccaccaactcaggg

SEQ ID NO: 612197 - DNA, 25 bp, Homo sapien
cagaccaaagccaccaactcagggg

SEQ ID NO: 612198 - DNA, 25 bp, Homo sapien
agaccaaagccaccaactcaggggt

SEQ ID NO: 612199 - DNA, 25 bp, Homo sapien
agcctggaccagggatctcggggct

SEQ ID NO: 612200 - DNA, 25 bp, Homo sapien
ctggaccagggatctcggggctgac

SEQ ID NO: 612201 - DNA, 25 bp, Homo sapien
tggaccagggatctcggggctgacc

SEQ ID NO: 612202 - DNA, 25 bp, Homo sapien
ggaccagggatctcggggctgaccc

SEQ ID NO: 612203 - DNA, 25 bp, Homo sapien
gaccagggatctcggggctgacccc

SEQ ID NO: 612204 - DNA, 25 bp, Homo sapien
agtgctgaactaacccccttcatct

SEQ ID NO: 612205 - DNA, 25 bp, Homo sapien
ttcccctccagggtcattttgaaca

SEQ ID NO: 612206 - DNA, 25 bp, Homo sapien
tcccctccagggtcattttgaacac

SEQ ID NO: 612207 - DNA, 25 bp, Homo sapien
ccctccagggtcattttgaacactc

SEQ ID NO: 612208 - DNA, 25 bp, Homo sapien
ctccagggtcattttgaacactctt

SEQ ID NO: 612209 - DNA, 25 bp, Homo sapien
tccagggtcattttgaacactcttc

SEQ ID NO: 612210 - DNA, 25 bp, Homo sapien
ccagggtcattttgaacactcttcc

SEQ ID NO: 612211 - DNA, 25 bp, Homo sapien
cagggtcattttgaacactcttcct

SEQ ID NO: 612212 - DNA, 25 bp, Homo sapien
tcttccttcctgacaactaaacttt

SEQ ID NO: 612213 - DNA, 25 bp, Homo sapien
ttcctgacaactaaacttttcactg

SEQ ID NO: 612214 - DNA, 25 bp, Homo sapien
cctgacaactaaacttttcactgtt

SEQ ID NO: 612215 - DNA, 25 bp, Homo sapien
gatacaggatccatggctgggtcac

SEQ ID NO: 612216 - DNA, 25 bp, Homo sapien
catggctgggtcacttctgggtgca

SEQ ID NO: 612217 - DNA, 25 bp, Homo sapien
ggtcacttctgggtgcaagaggctt

SEQ ID NO: 612218 - DNA, 25 bp, Homo sapien
acttctgggtgcaagaggctttcta

SEQ ID NO: 612219 - DNA, 25 bp, Homo sapien
ggtgcaagaggctttctagacctta

SEQ ID NO: 612220 - DNA, 25 bp, Homo sapien
agaggctttctagaccttagacact

SEQ ID NO: 612221 - DNA, 25 bp, Homo sapien
ggctttctagaccttagacactcaa

SEQ ID NO: 612222 - DNA, 25 bp, Homo sapien
agacactcaagattacggtcccggg

SEQ ID NO: 612223 - DNA, 25 bp, Homo sapien
tcaagattacggtcccgggccagta

SEQ ID NO: 612224 - DNA, 25 bp, Homo sapien
agtaacagcacctgggagcttggta

SEQ ID NO: 612225 - DNA, 25 bp, Homo sapien
atgcagaatcttagcctaggcaaca

SEQ ID NO: 612226 - DNA, 25 bp, Homo sapien
gtccccatcacctgtcagctaagga

SEQ ID NO: 612227 - DNA, 25 bp, Homo sapien
agctaaggaattctgcatgtcatca

SEQ ID NO: 612228 - DNA, 25 bp, Homo sapien
gaattctgcatgtcatcagtgcaat

SEQ ID NO: 612229 - DNA, 25 bp, Homo sapien
gcaataaaatgtgatcgccagagtg

SEQ ID NO: 612230 - DNA, 25 bp, Homo sapien
gatcgccagagtgaaaaccttgtaa

SEQ ID NO: 612231 - DNA, 25 bp, Homo sapien
tgtggcttctctcaacaccagtatg

SEQ ID NO: 612232 - DNA, 25 bp, Homo sapien
caacaccagtatgtccaaggaggat

SEQ ID NO: 612233 - DNA, 25 bp, Homo sapien
caaggaggatgcatttttattgctt

SEQ ID NO: 612234 - DNA, 25 bp, Homo sapien
gacctaaaataagggctggaagcca

SEQ ID NO: 612235 - DNA, 25 bp, Homo sapien
accaggtaccagtgaggtgtctgct

SEQ ID NO: 612236 - DNA, 25 bp, Homo sapien
accagtgaggtgtctgctctttgtc

SEQ ID NO: 612237 - DNA, 25 bp, Homo sapien
aacagggagtattttggcatgatct

SEQ ID NO: 612238 - DNA, 25 bp, Homo sapien
catgatctctttttgcttatttgcc

SEQ ID NO: 612239 - DNA, 25 bp, Homo sapien
ttgcttatttgccttccattttcca

SEQ ID NO: 612240 - DNA, 25 bp, Homo sapien
tttgccttccattttccataaagca

SEQ ID NO: 612241 - DNA, 25 bp, Homo sapien
acttttgccaagcaccatacttaag

SEQ ID NO: 612242 - DNA, 25 bp, Homo sapien
tacttaagactcaacttttttgcaa

SEQ ID NO: 612243 - DNA, 25 bp, Homo sapien
gacaaagcactgtctttaagaacac

SEQ ID NO: 612244 - DNA, 25 bp, Homo sapien
cacactagatcccttcttctgaaaa

SEQ ID NO: 612245 - DNA, 25 bp, Homo sapien
gatcccttcttctgaaaatcactgt

SEQ ID NO: 612246 - DNA, 25 bp, Homo sapien
ttagcattcactgcatgcctggaat

SEQ ID NO: 612247 - DNA, 25 bp, Homo sapien
tgtttctccccaaaagagcacaaat

SEQ ID NO: 612248 - DNA, 25 bp, Homo sapien
aaacctctatttactagctttcaag

SEQ ID NO: 612249 - DNA, 25 bp, Homo sapien
atttactagctttcaagaagagcaa

SEQ ID NO: 612250 - DNA, 25 bp, Homo sapien
gagcaaaaaatcatcccactgcctg

SEQ ID NO: 612251 - DNA, 25 bp, Homo sapien
aaaaaatcatcccactgcctgctaa

SEQ ID NO: 612252 - DNA, 25 bp, Homo sapien
aaatcatcccactgcctgctaactg

SEQ ID NO: 612253 - DNA, 25 bp, Homo sapien
tgctaactgcccatctattgcggtt

SEQ ID NO: 612254 - DNA, 25 bp, Homo sapien
taactgcccatctattgcggttatg

SEQ ID NO: 612255 - DNA, 25 bp, Homo sapien
ctgcccatctattgcggttatggat

SEQ ID NO: 612256 - DNA, 25 bp, Homo sapien
ctattgcggttatggatgtttctga

SEQ ID NO: 612257 - DNA, 25 bp, Homo sapien
tgcggttatggatgtttctgagaat

SEQ ID NO: 612258 - DNA, 25 bp, Homo sapien
tttatgctatattgggcaaactaga

SEQ ID NO: 612259 - DNA, 25 bp, Homo sapien
aaattcatcaaccacaattccctgg

SEQ ID NO: 612260 - DNA, 25 bp, Homo sapien
ggccagaagaaccacatagacttat

SEQ ID NO: 612261 - DNA, 25 bp, Homo sapien
gacttatctattaccaggatcggag

SEQ ID NO: 612262 - DNA, 25 bp, Homo sapien
ggatcggagagagcgggcccctttc

SEQ ID NO: 612263 - DNA, 25 bp, Homo sapien
ctcttaatttattctgacaatgagg

SEQ ID NO: 612264 - DNA, 25 bp, Homo sapien
gctgcatgatagtgatgtagagtct

SEQ ID NO: 612265 - DNA, 25 bp, Homo sapien
agtctaatggtgtatctctggatac

SEQ ID NO: 612266 - DNA, 25 bp, Homo sapien
tctggatacacaaagagccatctca

SEQ ID NO: 612267 - DNA, 25 bp, Homo sapien
aagagccatctcaggtaacaacttt

SEQ ID NO: 612268 - DNA, 25 bp, Homo sapien
ggtaacaactttaatccttgaaatg

SEQ ID NO: 612269 - DNA, 25 bp, Homo sapien
ttatcttcctgttaattattccatt

SEQ ID NO: 612270 - DNA, 25 bp, Homo sapien
agctttggtgaggtatctgttagag

SEQ ID NO: 612271 - DNA, 25 bp, Homo sapien
gaggtatctgttagaggttttgccc

SEQ ID NO: 612272 - DNA, 25 bp, Homo sapien
tatattttgtataacagacctttat

SEQ ID NO: 612273 - DNA, 25 bp, Homo sapien
gacctttatcagataggtcttttgc

SEQ ID NO: 612274 - DNA, 25 bp, Homo sapien
cccaggctgtggcttattttctcaa

SEQ ID NO: 612275 - DNA, 25 bp, Homo sapien
tgtggcttattttctcaatccttga

SEQ ID NO: 612276 - DNA, 25 bp, Homo sapien
gaaatggtagcataatatacacagt

SEQ ID NO: 612277 - DNA, 25 bp, Homo sapien
atatacacagttgtccattttttaa

SEQ ID NO: 612278 - DNA, 25 bp, Homo sapien
aaagactaaaccatctcacagattg

SEQ ID NO: 612279 - DNA, 25 bp, Homo sapien
taaaccatctcacagattgttctgt

SEQ ID NO: 612280 - DNA, 25 bp, Homo sapien
ccatctcacagattgttctgtatca

SEQ ID NO: 612281 - DNA, 25 bp, Homo sapien
aaaattggccatgtgtggtgtctca

SEQ ID NO: 612282 - DNA, 25 bp, Homo sapien
aaattggccatgtgtggtgtctcac

SEQ ID NO: 612283 - DNA, 25 bp, Homo sapien
attggccatgtgtggtgtctcacgc

SEQ ID NO: 612284 - DNA, 25 bp, Homo sapien
ggagtccaagatggacagatcactg

SEQ ID NO: 612285 - DNA, 25 bp, Homo sapien
gagtccaagatggacagatcactgg

SEQ ID NO: 612286 - DNA, 25 bp, Homo sapien
agtccaagatggacagatcactgga

SEQ ID NO: 612287 - DNA, 25 bp, Homo sapien
caagatggacagatcactggagcct

SEQ ID NO: 612288 - DNA, 25 bp, Homo sapien
aagatggacagatcactggagccta

SEQ ID NO: 612289 - DNA, 25 bp, Homo sapien
gatggacagatcactggagcctagg

SEQ ID NO: 612290 - DNA, 25 bp, Homo sapien
tggacagatcactggagcctaggag

SEQ ID NO: 612291 - DNA, 25 bp, Homo sapien
tgaaaccccatctatctttataaaa

SEQ ID NO: 612292 - DNA, 25 bp, Homo sapien
aagctgggagcactttgaacttgaa

SEQ ID NO: 612293 - DNA, 25 bp, Homo sapien
gaacttgaaaatcatttctcttaga

SEQ ID NO: 612294 - DNA, 25 bp, Homo sapien
atttctcttagaactacacttgggc

SEQ ID NO: 612295 - DNA, 25 bp, Homo sapien
cttagaactacacttgggcactgcc

SEQ ID NO: 612296 - DNA, 25 bp, Homo sapien
gtcagctccatgacaacatgaccag

SEQ ID NO: 612297 - DNA, 25 bp, Homo sapien
tgacaacatgaccagctcagcaaag

SEQ ID NO: 612298 - DNA, 25 bp, Homo sapien
tcagcaaaggctgagactgcccatg

SEQ ID NO: 612299 - DNA, 25 bp, Homo sapien
aaggctgagactgcccatgacctga

SEQ ID NO: 612300 - DNA, 25 bp, Homo sapien
atgacctgaaggctccaggtggctt

SEQ ID NO: 612301 - DNA, 25 bp, Homo sapien
gctccaggtggctttaaagcgctat

SEQ ID NO: 612302 - DNA, 25 bp, Homo sapien
ggctttaaagcgctatgtttaccaa

SEQ ID NO: 612303 - DNA, 25 bp, Homo sapien
gagaaattcatctacttttagtgat

SEQ ID NO: 612304 - DNA, 25 bp, Homo sapien
tcatctacttttagtgatggcaagt

SEQ ID NO: 612305 - DNA, 25 bp, Homo sapien
gacagaactcagtatggtttttctt

SEQ ID NO: 612306 - DNA, 25 bp, Homo sapien
actcagtatggtttttcttctaagc

SEQ ID NO: 612307 - DNA, 25 bp, Homo sapien
ttcttctaagcctaaaataagctgg

SEQ ID NO: 612308 - DNA, 25 bp, Homo sapien
gcctaaaataagctgggtcctacta

SEQ ID NO: 612309 - DNA, 25 bp, Homo sapien
ataagctgggtcctactacttttca

SEQ ID NO: 612310 - DNA, 25 bp, Homo sapien
agctgggtcctactacttttcatta

SEQ ID NO: 612311 - DNA, 25 bp, Homo sapien
ctgggtcctactacttttcattatg

SEQ ID NO: 612312 - DNA, 25 bp, Homo sapien
gggtcctactacttttcattatgtg

SEQ ID NO: 612313 - DNA, 25 bp, Homo sapien
ggtcctactacttttcattatgtgt

SEQ ID NO: 612314 - DNA, 25 bp, Homo sapien
gtgtgaaccggcaggtgggcagcca

SEQ ID NO: 612315 - DNA, 25 bp, Homo sapien
tgtgaaccggcaggtgggcagccag

SEQ ID NO: 612316 - DNA, 25 bp, Homo sapien
ccagccagccctgtgcccatggaag

SEQ ID NO: 612317 - DNA, 25 bp, Homo sapien
agcatgtctcattcacatccttccc

SEQ ID NO: 612318 - DNA, 25 bp, Homo sapien
gcatgtctcattcacatccttccct

SEQ ID NO: 612319 - DNA, 25 bp, Homo sapien
catgtctcattcacatccttccctc

SEQ ID NO: 612320 - DNA, 25 bp, Homo sapien
tctgccctgagaccggtgggtgcca

SEQ ID NO: 612321 - DNA, 25 bp, Homo sapien
tgccctgagaccggtgggtgccact

SEQ ID NO: 612322 - DNA, 25 bp, Homo sapien
gccctgagaccggtgggtgccactc

SEQ ID NO: 612323 - DNA, 25 bp, Homo sapien
gagaccggtgggtgccactccctct

SEQ ID NO: 612324 - DNA, 25 bp, Homo sapien
agaccggtgggtgccactccctctc

SEQ ID NO: 612325 - DNA, 25 bp, Homo sapien
tattattttctatggcagtggcccc

SEQ ID NO: 612326 - DNA, 25 bp, Homo sapien
gttctcaggccatgaaactcgggaa

SEQ ID NO: 612327 - DNA, 25 bp, Homo sapien
actcgggaacggattgtggctgtca

SEQ ID NO: 612328 - DNA, 25 bp, Homo sapien
gattgtggctgtcacgcagaatcaa

SEQ ID NO: 612329 - DNA, 25 bp, Homo sapien
tggattggccgtgttgcttcaggac

SEQ ID NO: 612330 - DNA, 25 bp, Homo sapien
ggactcaatcttctcaaagcttctg

SEQ ID NO: 612331 - DNA, 25 bp, Homo sapien
aaagcttctgactccagacagacag

SEQ ID NO: 612332 - DNA, 25 bp, Homo sapien
tgtaagatcctgaattccactgcct

SEQ ID NO: 612333 - DNA, 25 bp, Homo sapien
cactgcctgccaagcaactgaaagt

SEQ ID NO: 612334 - DNA, 25 bp, Homo sapien
ttatcatcagctgcttctccctgat

SEQ ID NO: 612335 - DNA, 25 bp, Homo sapien
ctccctgatctattttcccattaaa

SEQ ID NO: 612336 - DNA, 25 bp, Homo sapien
gcgcagtgtggatgccctgcagacc

SEQ ID NO: 612337 - DNA, 25 bp, Homo sapien
agtgtggatgccctgcagaccgcct

SEQ ID NO: 612338 - DNA, 25 bp, Homo sapien
gtggatgccctgcagaccgccttcg

SEQ ID NO: 612339 - DNA, 25 bp, Homo sapien
agacgctggagctgatagaccacat

SEQ ID NO: 612340 - DNA, 25 bp, Homo sapien
gctggagctgatagaccacatgcag

SEQ ID NO: 612341 - DNA, 25 bp, Homo sapien
gagctgatagaccacatgcagtgtg

SEQ ID NO: 612342 - DNA, 25 bp, Homo sapien
cctgggaaggtgcacgagctgtggg

SEQ ID NO: 612343 - DNA, 25 bp, Homo sapien
ctggagacgctggtgctgtcccgca

SEQ ID NO: 612344 - DNA, 25 bp, Homo sapien
agctgcagggcacggtagaggctct

SEQ ID NO: 612345 - DNA, 25 bp, Homo sapien
cacggtagaggctctggagtccagc

SEQ ID NO: 612346 - DNA, 25 bp, Homo sapien
cccgccggcgcccaggagaaggtgg

SEQ ID NO: 612347 - DNA, 25 bp, Homo sapien
gtagaatatttcaattgccaacagg

SEQ ID NO: 612348 - DNA, 25 bp, Homo sapien
gtaaatctacattgggtcaaacaga

SEQ ID NO: 612349 - DNA, 25 bp, Homo sapien
aacagattttccagctcatagtcgg

SEQ ID NO: 612350 - DNA, 25 bp, Homo sapien
tccagctcatagtcggaagccggca

SEQ ID NO: 612351 - DNA, 25 bp, Homo sapien
tcggaagccggcaccctcaaatgag

SEQ ID NO: 612352 - DNA, 25 bp, Homo sapien
aaatgagcccgaatatctatgtaaa

SEQ ID NO: 612353 - DNA, 25 bp, Homo sapien
tatgtaaatggatgggactccccta

SEQ ID NO: 612354 - DNA, 25 bp, Homo sapien
ggactcccctattcagagtgtagct

SEQ ID NO: 612355 - DNA, 25 bp, Homo sapien
gtagctgggaagatgaagccctcat

SEQ ID NO: 612356 - DNA, 25 bp, Homo sapien
aaattccagaattgcattgacagct

SEQ ID NO: 612357 - DNA, 25 bp, Homo sapien
tgcattgacagcttccacagtagga

SEQ ID NO: 612358 - DNA, 25 bp, Homo sapien
ctaaaaacacgaatattagtcgagt

SEQ ID NO: 612359 - DNA, 25 bp, Homo sapien
taaaaacacgaatattagtcgagtg

SEQ ID NO: 612360 - DNA, 25 bp, Homo sapien
aaaaacacgaatattagtcgagtgt

SEQ ID NO: 612361 - DNA, 25 bp, Homo sapien
aaaacacgaatattagtcgagtgtg

SEQ ID NO: 612362 - DNA, 25 bp, Homo sapien
aaacacgaatattagtcgagtgtgg

SEQ ID NO: 612363 - DNA, 25 bp, Homo sapien
aacacgaatattagtcgagtgtggg

SEQ ID NO: 612364 - DNA, 25 bp, Homo sapien
gaatattagtcgagtgtgggggcat

SEQ ID NO: 612365 - DNA, 25 bp, Homo sapien
aatattagtcgagtgtgggggcatg

SEQ ID NO: 612366 - DNA, 25 bp, Homo sapien
tgtgggggcatgaacctgtattccc

SEQ ID NO: 612367 - DNA, 25 bp, Homo sapien
tgggggcatgaacctgtattcccag

SEQ ID NO: 612368 - DNA, 25 bp, Homo sapien
gggggcatgaacctgtattcccagc

SEQ ID NO: 612369 - DNA, 25 bp, Homo sapien
acaggccctcattggatcaaggaaa

SEQ ID NO: 612370 - DNA, 25 bp, Homo sapien
aggaaaacagctctcaatgaaaaaa

SEQ ID NO: 612371 - DNA, 25 bp, Homo sapien
gaaaagatccctgttggtgggttga

SEQ ID NO: 612372 - DNA, 25 bp, Homo sapien
ggttgaagttctccatcattctgca

SEQ ID NO: 612373 - DNA, 25 bp, Homo sapien
attctgcagtacctccaagcctttg

SEQ ID NO: 612374 - DNA, 25 bp, Homo sapien
acctccaagcctttggctggctctg

SEQ ID NO: 612375 - DNA, 25 bp, Homo sapien
gactgtggtcacttacttagggcag

SEQ ID NO: 612376 - DNA, 25 bp, Homo sapien
ggtcacttacttagggcagaatttg

SEQ ID NO: 612377 - DNA, 25 bp, Homo sapien
tttggtgagcattggacagaatcta

SEQ ID NO: 612378 - DNA, 25 bp, Homo sapien
atctatggcttagtgcatgggcaaa

SEQ ID NO: 612379 - DNA, 25 bp, Homo sapien
gaatgagttcacagaatggaagcaa

SEQ ID NO: 612380 - DNA, 25 bp, Homo sapien
cttatgtactaggagaaattcttct

SEQ ID NO: 612381 - DNA, 25 bp, Homo sapien
taagagtcatcaccaggactttctt

SEQ ID NO: 612382 - DNA, 25 bp, Homo sapien
aagagtcatcaccaggactttctta

SEQ ID NO: 612383 - DNA, 25 bp, Homo sapien
agagtcatcaccaggactttcttat

SEQ ID NO: 612384 - DNA, 25 bp, Homo sapien
gagtcatcaccaggactttcttata

SEQ ID NO: 612385 - DNA, 25 bp, Homo sapien
gtcatcaccaggactttcttataag

SEQ ID NO: 612386 - DNA, 25 bp, Homo sapien
catcaccaggactttcttataagct

SEQ ID NO: 612387 - DNA, 25 bp, Homo sapien
atcaccaggactttcttataagcta

SEQ ID NO: 612388 - DNA, 25 bp, Homo sapien
tcaccaggactttcttataagctaa

SEQ ID NO: 612389 - DNA, 25 bp, Homo sapien
accaggactttcttataagctaatt

SEQ ID NO: 612390 - DNA, 25 bp, Homo sapien
ggactttcttataagctaattaaca

SEQ ID NO: 612391 - DNA, 25 bp, Homo sapien
gaaatgatcttagtacatcttttga

SEQ ID NO: 612392 - DNA, 25 bp, Homo sapien
gagaacgattactacccaagcagct

SEQ ID NO: 612393 - DNA, 25 bp, Homo sapien
ttactacccaagcagctctgaaaga

SEQ ID NO: 612394 - DNA, 25 bp, Homo sapien
tgattaccaagagaagacaccacag

SEQ ID NO: 612395 - DNA, 25 bp, Homo sapien
gaagacaccacagaaaagtattcag

SEQ ID NO: 612396 - DNA, 25 bp, Homo sapien
gtattcagaaatatccagcaaactc

SEQ ID NO: 612397 - DNA, 25 bp, Homo sapien
ataccttcggaagaattgcactcta

SEQ ID NO: 612398 - DNA, 25 bp, Homo sapien
attgcactctaagcagtcatgggac

SEQ ID NO: 612399 - DNA, 25 bp, Homo sapien
agcagtcatgggactttggacttga

SEQ ID NO: 612400 - DNA, 25 bp, Homo sapien
gactttggacttgatgagattctga

SEQ ID NO: 612401 - DNA, 25 bp, Homo sapien
aaagcaagcgaatatctactaagaa

SEQ ID NO: 612402 - DNA, 25 bp, Homo sapien
gtttttgatacttgatgtgtgacag

SEQ ID NO: 612403 - DNA, 25 bp, Homo sapien
ttttgatacttgatgtgtgacaggg

SEQ ID NO: 612404 - DNA, 25 bp, Homo sapien
gatattggtttaaaggatgtataca

SEQ ID NO: 612405 - DNA, 25 bp, Homo sapien
attgtaagcattcaataagaactag

SEQ ID NO: 612406 - DNA, 25 bp, Homo sapien
tacgtaacttgcgaatctgtttacc

SEQ ID NO: 612407 - DNA, 25 bp, Homo sapien
gtaacttgcgaatctgtttaccctc

SEQ ID NO: 612408 - DNA, 25 bp, Homo sapien
aacttgcgaatctgtttaccctcac

SEQ ID NO: 612409 - DNA, 25 bp, Homo sapien
ttgcgaatctgtttaccctcacttg

SEQ ID NO: 612410 - DNA, 25 bp, Homo sapien
aatctgtttaccctcacttgcaaat

SEQ ID NO: 612411 - DNA, 25 bp, Homo sapien
tctgtttaccctcacttgcaaataa

SEQ ID NO: 612412 - DNA, 25 bp, Homo sapien
gtttaccctcacttgcaaataaaat

SEQ ID NO: 612413 - DNA, 25 bp, Homo sapien
tccacctcctgggatgcaagcaacg

SEQ ID NO: 612414 - DNA, 25 bp, Homo sapien
ccacctcctgggatgcaagcaacgc

SEQ ID NO: 612415 - DNA, 25 bp, Homo sapien
cctcctgggatgcaagcaacgctcc

SEQ ID NO: 612416 - DNA, 25 bp, Homo sapien
actcctgagcttgggcggtccacct

SEQ ID NO: 612417 - DNA, 25 bp, Homo sapien
ctcctgagcttgggcggtccacctg

SEQ ID NO: 612418 - DNA, 25 bp, Homo sapien
tcctgagcttgggcggtccacctgc

SEQ ID NO: 612419 - DNA, 25 bp, Homo sapien
cctgagcttgggcggtccacctgcc

SEQ ID NO: 612420 - DNA, 25 bp, Homo sapien
tgagcttgggcggtccacctgcctt

SEQ ID NO: 612421 - DNA, 25 bp, Homo sapien
gagcttgggcggtccacctgccttg

SEQ ID NO: 612422 - DNA, 25 bp, Homo sapien
cctggcctcctgtgtttaacatata

SEQ ID NO: 612423 - DNA, 25 bp, Homo sapien
ctggcctcctgtgtttaacatatat

SEQ ID NO: 612424 - DNA, 25 bp, Homo sapien
tgctattttgttcaccgccttcgat

SEQ ID NO: 612425 - DNA, 25 bp, Homo sapien
tcaccgccttcgatgatttgtggaa

SEQ ID NO: 612426 - DNA, 25 bp, Homo sapien
gaaggctgacggtgctcaaaactgt

SEQ ID NO: 612427 - DNA, 25 bp, Homo sapien
aagcctgatcaaattgtcactactt

SEQ ID NO: 612428 - DNA, 25 bp, Homo sapien
tttgatacccaatttctgaaacttt

SEQ ID NO: 612429 - DNA, 25 bp, Homo sapien
actttactcttctactctattgacg

SEQ ID NO: 612430 - DNA, 25 bp, Homo sapien
ttgacgtgatcaacattcatggtat

SEQ ID NO: 612431 - DNA, 25 bp, Homo sapien
ggtatagacccacaatcatctctac

SEQ ID NO: 612432 - DNA, 25 bp, Homo sapien
atctctaccgaatgtttttacttct

SEQ ID NO: 612433 - DNA, 25 bp, Homo sapien
ttctattctctaacaagctgtcgct

SEQ ID NO: 612434 - DNA, 25 bp, Homo sapien
caagctgtcgctatgtttttatata

SEQ ID NO: 612435 - DNA, 25 bp, Homo sapien
atctgcaaacctgttagggtcactg

SEQ ID NO: 612436 - DNA, 25 bp, Homo sapien
tctgcaaacctgttagggtcactgt

SEQ ID NO: 612437 - DNA, 25 bp, Homo sapien
tggacctgggctatgtgagtctcct

SEQ ID NO: 612438 - DNA, 25 bp, Homo sapien
gacctgggctatgtgagtctcctct

SEQ ID NO: 612439 - DNA, 25 bp, Homo sapien
acctgggctatgtgagtctcctctg

SEQ ID NO: 612440 - DNA, 25 bp, Homo sapien
cctgggctatgtgagtctcctctgc

SEQ ID NO: 612441 - DNA, 25 bp, Homo sapien
ctgggctatgtgagtctcctctgct

SEQ ID NO: 612442 - DNA, 25 bp, Homo sapien
tgggctatgtgagtctcctctgctc

SEQ ID NO: 612443 - DNA, 25 bp, Homo sapien
acctcttagtcccatgattccttct

SEQ ID NO: 612444 - DNA, 25 bp, Homo sapien
ttccttcctgctattgactactgtg

SEQ ID NO: 612445 - DNA, 25 bp, Homo sapien
gctattgactactgtgcagactcag

SEQ ID NO: 612446 - DNA, 25 bp, Homo sapien
ctgtgcagactcagctggattttag

SEQ ID NO: 612447 - DNA, 25 bp, Homo sapien
cagactcagctggattttagataat

SEQ ID NO: 612448 - DNA, 25 bp, Homo sapien
tataatatcacaatggtttccatgg

SEQ ID NO: 612449 - DNA, 25 bp, Homo sapien
atggagatggatcatgatgtcacaa

SEQ ID NO: 612450 - DNA, 25 bp, Homo sapien
ggatcatgatgtcacaaaagtagat

SEQ ID NO: 612451 - DNA, 25 bp, Homo sapien
gatatatattctttggatactgaaa

SEQ ID NO: 612452 - DNA, 25 bp, Homo sapien
gaattttcaaactggtatatagagg

SEQ ID NO: 612453 - DNA, 25 bp, Homo sapien
gaaatggctattcaaaggctattca

SEQ ID NO: 612454 - DNA, 25 bp, Homo sapien
ttgggcagacgggatcagcaacctt

SEQ ID NO: 612455 - DNA, 25 bp, Homo sapien
gggatcagcaaccttttattaccaa

SEQ ID NO: 612456 - DNA, 25 bp, Homo sapien
ttattaccaaagttaatggccatga

SEQ ID NO: 612457 - DNA, 25 bp, Homo sapien
cgctctttttctgaaggcacatatt

SEQ ID NO: 612458 - DNA, 25 bp, Homo sapien
gcacatattttctgtgccgactcca

SEQ ID NO: 612459 - DNA, 25 bp, Homo sapien
gtaaatatgttaggccttcttggca

SEQ ID NO: 612460 - DNA, 25 bp, Homo sapien
aggccttcttggcaatagggtctca

SEQ ID NO: 612461 - DNA, 25 bp, Homo sapien
atagggtctcagtcacacctgttta

SEQ ID NO: 612462 - DNA, 25 bp, Homo sapien
tcagtcacacctgtttagctttttc

SEQ ID NO: 612463 - DNA, 25 bp, Homo sapien
gtttagctttttcctgtgttgcaaa

SEQ ID NO: 612464 - DNA, 25 bp, Homo sapien
ttttcctgtgttgcaaaagcagaca

SEQ ID NO: 612465 - DNA, 25 bp, Homo sapien
catttcctggactgcctgcagctaa

SEQ ID NO: 612466 - DNA, 25 bp, Homo sapien
tggactgcctgcagctaactgtggc

SEQ ID NO: 612467 - DNA, 25 bp, Homo sapien
actgtggctacatcacttagttctc

SEQ ID NO: 612468 - DNA, 25 bp, Homo sapien
atcacttagttctcatcagtgagat

SEQ ID NO: 612469 - DNA, 25 bp, Homo sapien
cttagttctcatcagtgagatgtaa

SEQ ID NO: 612470 - DNA, 25 bp, Homo sapien
tgtaaatacaagtgttgggcagctg

SEQ ID NO: 612471 - DNA, 25 bp, Homo sapien
gtgttgggcagctgccgcaaataat

SEQ ID NO: 612472 - DNA, 25 bp, Homo sapien
gggcagctgccgcaaataatctcct

SEQ ID NO: 612473 - DNA, 25 bp, Homo sapien
agctgccgcaaataatctccttaag

SEQ ID NO: 612474 - DNA, 25 bp, Homo sapien
gctgccgcaaataatctccttaaga

SEQ ID NO: 612475 - DNA, 25 bp, Homo sapien
tgccgcaaataatctccttaagaga

SEQ ID NO: 612476 - DNA, 25 bp, Homo sapien
gcgtggccagcaacgcgggcggcaa

SEQ ID NO: 612477 - DNA, 25 bp, Homo sapien
cgtggccagcaacgcgggcggcaac

SEQ ID NO: 612478 - DNA, 25 bp, Homo sapien
gtggccagcaacgcgggcggcaacg

SEQ ID NO: 612479 - DNA, 25 bp, Homo sapien
tggccagcaacgcgggcggcaacga

SEQ ID NO: 612480 - DNA, 25 bp, Homo sapien
ggccagcaacgcgggcggcaacgac

SEQ ID NO: 612481 - DNA, 25 bp, Homo sapien
gccagcaacgcgggcggcaacgaca

SEQ ID NO: 612482 - DNA, 25 bp, Homo sapien
ccagcaacgcgggcggcaacgacac

SEQ ID NO: 612483 - DNA, 25 bp, Homo sapien
agcaacgcgggcggcaacgacacct

SEQ ID NO: 612484 - DNA, 25 bp, Homo sapien
gcaacgcgggcggcaacgacaccta

SEQ ID NO: 612485 - DNA, 25 bp, Homo sapien
caacgcgggcggcaacgacacctac

SEQ ID NO: 612486 - DNA, 25 bp, Homo sapien
aacgcgggcggcaacgacacctact

SEQ ID NO: 612487 - DNA, 25 bp, Homo sapien
ataatcaagtgaatggaatgaccca

SEQ ID NO: 612488 - DNA, 25 bp, Homo sapien
ggaatgacccattctgtggatacta

SEQ ID NO: 612489 - DNA, 25 bp, Homo sapien
tgacccattctgtggatactactca

SEQ ID NO: 612490 - DNA, 25 bp, Homo sapien
acccattctgtggatactactcagc

SEQ ID NO: 612491 - DNA, 25 bp, Homo sapien
ccattctgtggatactactcagcct

SEQ ID NO: 612492 - DNA, 25 bp, Homo sapien
atcatagtggcagagatggaggtta

SEQ ID NO: 612493 - DNA, 25 bp, Homo sapien
atggaggttacatatgagctcaaca

SEQ ID NO: 612494 - DNA, 25 bp, Homo sapien
gaggttacatatgagctcaacaaca

SEQ ID NO: 612495 - DNA, 25 bp, Homo sapien
ttacatatgagctcaacaacatgga

SEQ ID NO: 612496 - DNA, 25 bp, Homo sapien
aggctgtcctggctacggccacttc

SEQ ID NO: 612497 - DNA, 25 bp, Homo sapien
ctgtcctggctacggccacttctga

SEQ ID NO: 612498 - DNA, 25 bp, Homo sapien
tagatggtatatagagccctcttag

SEQ ID NO: 612499 - DNA, 25 bp, Homo sapien
tatagagccctcttagatttatagc

SEQ ID NO: 612500 - DNA, 25 bp, Homo sapien
gccctcttagatttatagctgctaa

SEQ ID NO: 612501 - DNA, 25 bp, Homo sapien
aaacgctgaaagtgaaaagcatgtt

SEQ ID NO: 612502 - DNA, 25 bp, Homo sapien
aagaattcatcttctcacagcactg

SEQ ID NO: 612503 - DNA, 25 bp, Homo sapien
aattcatcttctcacagcactgcct

SEQ ID NO: 612504 - DNA, 25 bp, Homo sapien
gtgtttcaaatgtttcttttggata

SEQ ID NO: 612505 - DNA, 25 bp, Homo sapien
gtttcttttggatatgttgtgcaca

SEQ ID NO: 612506 - DNA, 25 bp, Homo sapien
ggatatgttgtgcacacctgacctg

SEQ ID NO: 612507 - DNA, 25 bp, Homo sapien
atgttgtgcacacctgacctgctgc

SEQ ID NO: 612508 - DNA, 25 bp, Homo sapien
gctgccaaggcagaagcctgctatg

SEQ ID NO: 612509 - DNA, 25 bp, Homo sapien
ggtatcttgttataaagaggcacat

SEQ ID NO: 612510 - DNA, 25 bp, Homo sapien
aggcacatatcaagaaaccatctct

SEQ ID NO: 612511 - DNA, 25 bp, Homo sapien
aaccatctctactctatgcattgtg

SEQ ID NO: 612512 - DNA, 25 bp, Homo sapien
atctctactctatgcattgtggaac

SEQ ID NO: 612513 - DNA, 25 bp, Homo sapien
tactctatgcattgtggaacacctt

SEQ ID NO: 612514 - DNA, 25 bp, Homo sapien
ggaacacctttaaatccatcctgat

SEQ ID NO: 612515 - DNA, 25 bp, Homo sapien
atccatcctgattcaagttgcctta

SEQ ID NO: 612516 - DNA, 25 bp, Homo sapien
agttgccttattcaaagtgtttgct

SEQ ID NO: 612517 - DNA, 25 bp, Homo sapien
agtgtttgctgatattttgtccttc

SEQ ID NO: 612518 - DNA, 25 bp, Homo sapien
tgatattttgtccttcactagccca

SEQ ID NO: 612519 - DNA, 25 bp, Homo sapien
ccttcactagcccactcataatgaa

SEQ ID NO: 612520 - DNA, 25 bp, Homo sapien
cactcaagataacctggtggctctg

SEQ ID NO: 612521 - DNA, 25 bp, Homo sapien
aagataacctggtggctctgtgcca

SEQ ID NO: 612522 - DNA, 25 bp, Homo sapien
ataacctggtggctctgtgccattc

SEQ ID NO: 612523 - DNA, 25 bp, Homo sapien
tgtgccattccctacagtattctca

SEQ ID NO: 612524 - DNA, 25 bp, Homo sapien
ctacagtattctcatcttcgtctat

SEQ ID NO: 612525 - DNA, 25 bp, Homo sapien
aaatcagaaaactcctcatccgtca

SEQ ID NO: 612526 - DNA, 25 bp, Homo sapien
tcatccgtcagcacccggatggctg

SEQ ID NO: 612527 - DNA, 25 bp, Homo sapien
gggagacgtactactaaactcagca

SEQ ID NO: 612528 - DNA, 25 bp, Homo sapien
gacgtactactaaactcagcagatg

SEQ ID NO: 612529 - DNA, 25 bp, Homo sapien
actaaactcagcagatgaagagctt

SEQ ID NO: 612530 - DNA, 25 bp, Homo sapien
atgaagagcttcatgtgacacaggg

SEQ ID NO: 612531 - DNA, 25 bp, Homo sapien
gggactgactcaaagtcatctggca

SEQ ID NO: 612532 - DNA, 25 bp, Homo sapien
agtcatctggcaacttagagacgag

SEQ ID NO: 612533 - DNA, 25 bp, Homo sapien
gcaacttagagacgaggccagagct

SEQ ID NO: 612534 - DNA, 25 bp, Homo sapien
aggccagagctcctcaaatctccta

SEQ ID NO: 612535 - DNA, 25 bp, Homo sapien
agagctcctcaaatctcctagctct

SEQ ID NO: 612536 - DNA, 25 bp, Homo sapien
ctagctctgaatccatgttcttttt

SEQ ID NO: 612537 - DNA, 25 bp, Homo sapien
atgttctttttattgagcgggtcat

SEQ ID NO: 612538 - DNA, 25 bp, Homo sapien
attgagcgggtcatgacgtaacccc

SEQ ID NO: 612539 - DNA, 25 bp, Homo sapien
ccccagatgagtgcagcttttaatc

SEQ ID NO: 612540 - DNA, 25 bp, Homo sapien
cagcttttaatctcccacatcaagg

SEQ ID NO: 612541 - DNA, 25 bp, Homo sapien
cccacatcaaggagcctgctggctg

SEQ ID NO: 612542 - DNA, 25 bp, Homo sapien
gtgaccaggtgcaatggctcaggcc

SEQ ID NO: 612543 - DNA, 25 bp, Homo sapien
tgaccaggtgcaatggctcaggcct

SEQ ID NO: 612544 - DNA, 25 bp, Homo sapien
gaccaggtgcaatggctcaggcctg

SEQ ID NO: 612545 - DNA, 25 bp, Homo sapien
accaggtgcaatggctcaggcctgt

SEQ ID NO: 612546 - DNA, 25 bp, Homo sapien
ccaggtgcaatggctcaggcctgta

SEQ ID NO: 612547 - DNA, 25 bp, Homo sapien
ataaaaacaaaattggctgggcgcg

SEQ ID NO: 612548 - DNA, 25 bp, Homo sapien
taaaaacaaaattggctgggcgcgg

SEQ ID NO: 612549 - DNA, 25 bp, Homo sapien
aaaacaaaattggctgggcgcggtg

SEQ ID NO: 612550 - DNA, 25 bp, Homo sapien
aaacaaaattggctgggcgcggtgg

SEQ ID NO: 612551 - DNA, 25 bp, Homo sapien
ccaacctgaccaatgtggagaaacc

SEQ ID NO: 612552 - DNA, 25 bp, Homo sapien
caacctgaccaatgtggagaaaccc

SEQ ID NO: 612553 - DNA, 25 bp, Homo sapien
atggaggaggctgtaagaattcaga

SEQ ID NO: 612554 - DNA, 25 bp, Homo sapien
tggaggaggctgtaagaattcagag

SEQ ID NO: 612555 - DNA, 25 bp, Homo sapien
ggaggaggctgtaagaattcagagg

SEQ ID NO: 612556 - DNA, 25 bp, Homo sapien
gaggaggctgtaagaattcagagga

SEQ ID NO: 612557 - DNA, 25 bp, Homo sapien
aggaggctgtaagaattcagaggag

SEQ ID NO: 612558 - DNA, 25 bp, Homo sapien
ggaggctgtaagaattcagaggagg

SEQ ID NO: 612559 - DNA, 25 bp, Homo sapien
gaggctgtaagaattcagaggaggg

SEQ ID NO: 612560 - DNA, 25 bp, Homo sapien
tgtaagaattcagaggaggggccag

SEQ ID NO: 612561 - DNA, 25 bp, Homo sapien
gtaagaattcagaggaggggccagg

SEQ ID NO: 612562 - DNA, 25 bp, Homo sapien
aggcagtagagtatgctgggcaacc

SEQ ID NO: 612563 - DNA, 25 bp, Homo sapien
ggcagtagagtatgctgggcaaccc

SEQ ID NO: 612564 - DNA, 25 bp, Homo sapien
tggctttgtatcctgcctcttttag

SEQ ID NO: 612565 - DNA, 25 bp, Homo sapien
ggctttgtatcctgcctcttttagc

SEQ ID NO: 612566 - DNA, 25 bp, Homo sapien
gctttgtatcctgcctcttttagct

SEQ ID NO: 612567 - DNA, 25 bp, Homo sapien
ctttgtatcctgcctcttttagctt

SEQ ID NO: 612568 - DNA, 25 bp, Homo sapien
gcctcttttagcttcaaagacaagt

SEQ ID NO: 612569 - DNA, 25 bp, Homo sapien
cctcttttagcttcaaagacaagtt

SEQ ID NO: 612570 - DNA, 25 bp, Homo sapien
ttttagcttcaaagacaagttatga

SEQ ID NO: 612571 - DNA, 25 bp, Homo sapien
gacaagttatgagaacttaaccact

SEQ ID NO: 612572 - DNA, 25 bp, Homo sapien
agttatgagaacttaaccactctgg

SEQ ID NO: 612573 - DNA, 25 bp, Homo sapien
gacatgctagtggtaatactgctct

SEQ ID NO: 612574 - DNA, 25 bp, Homo sapien
tactgctctttaatgcaccgagatg

SEQ ID NO: 612575 - DNA, 25 bp, Homo sapien
aatgcaccgagatgtttgtacacgt

SEQ ID NO: 612576 - DNA, 25 bp, Homo sapien
tgtttgtacacgtgcacatcaaggc

SEQ ID NO: 612577 - DNA, 25 bp, Homo sapien
acatcaaggcacagcaccttttctt

SEQ ID NO: 612578 - DNA, 25 bp, Homo sapien
gcacagcaccttttcttaaccttgt

SEQ ID NO: 612579 - DNA, 25 bp, Homo sapien
accttgtttacgacacagagacttt

SEQ ID NO: 612580 - DNA, 25 bp, Homo sapien
tttgtttacatgttttcccgctgac

SEQ ID NO: 612581 - DNA, 25 bp, Homo sapien
actattaccctattgtcctgccaca

SEQ ID NO: 612582 - DNA, 25 bp, Homo sapien
gaactcagagaccagtaagcaccgg

SEQ ID NO: 612583 - DNA, 25 bp, Homo sapien
agaccagtaagcaccggtcccctgg

SEQ ID NO: 612584 - DNA, 25 bp, Homo sapien
actgtggctggagcctatcacctct

SEQ ID NO: 612585 - DNA, 25 bp, Homo sapien
tgtggctggagcctatcacctctgg

SEQ ID NO: 612586 - DNA, 25 bp, Homo sapien
tggctggagcctatcacctctggat

SEQ ID NO: 612587 - DNA, 25 bp, Homo sapien
gctggagcctatcacctctggatga

SEQ ID NO: 612588 - DNA, 25 bp, Homo sapien
tggagcctatcacctctggatgaaa

SEQ ID NO: 612589 - DNA, 25 bp, Homo sapien
ggagcctatcacctctggatgaaat

SEQ ID NO: 612590 - DNA, 25 bp, Homo sapien
gagcctatcacctctggatgaaatg

SEQ ID NO: 612591 - DNA, 25 bp, Homo sapien
gcctatcacctctggatgaaatggg

SEQ ID NO: 612592 - DNA, 25 bp, Homo sapien
tgtggatgggtgatgttggacaact

SEQ ID NO: 612593 - DNA, 25 bp, Homo sapien
actggaaggaggactcaggtagccc

SEQ ID NO: 612594 - DNA, 25 bp, Homo sapien
tggaaggaggactcaggtagcccca

SEQ ID NO: 612595 - DNA, 25 bp, Homo sapien
agcaatagttatgagtcattggagg

SEQ ID NO: 612596 - DNA, 25 bp, Homo sapien
tatgagtcattggaggagacatccc

SEQ ID NO: 612597 - DNA, 25 bp, Homo sapien
aggagacatcccagaggcgccagct

SEQ ID NO: 612598 - DNA, 25 bp, Homo sapien
gagacatcccagaggcgccagctcc

SEQ ID NO: 612599 - DNA, 25 bp, Homo sapien
aaattaagacctggtgctctgggtg

SEQ ID NO: 612600 - DNA, 25 bp, Homo sapien
aattaagacctggtgctctgggtgg

SEQ ID NO: 612601 - DNA, 25 bp, Homo sapien
attaagacctggtgctctgggtggg

SEQ ID NO: 612602 - DNA, 25 bp, Homo sapien
ggaaggggatgtgcaactcagaggg

SEQ ID NO: 612603 - DNA, 25 bp, Homo sapien
gagaccccagagggaccatggcaga

SEQ ID NO: 612604 - DNA, 25 bp, Homo sapien
gaccccagagggaccatggcagagc

SEQ ID NO: 612605 - DNA, 25 bp, Homo sapien
ggaccatggcagagccggagccctc

SEQ ID NO: 612606 - DNA, 25 bp, Homo sapien
aaactgaggcacttatacaacagaa

SEQ ID NO: 612607 - DNA, 25 bp, Homo sapien
acttgtgttctcacacttctagagg

SEQ ID NO: 612608 - DNA, 25 bp, Homo sapien
gacaggcttagttcattctgagagc

SEQ ID NO: 612609 - DNA, 25 bp, Homo sapien
gcctctctcctggtttgtaaatgca

SEQ ID NO: 612610 - DNA, 25 bp, Homo sapien
tgtaaatgcatgtcttcttcctgtg

SEQ ID NO: 612611 - DNA, 25 bp, Homo sapien
tgtgtctcttcacatagttttccct

SEQ ID NO: 612612 - DNA, 25 bp, Homo sapien
agttttccctctatgtgtatctgcc

SEQ ID NO: 612613 - DNA, 25 bp, Homo sapien
tctgcctctgtgtccaaagttcctt

SEQ ID NO: 612614 - DNA, 25 bp, Homo sapien
gtgtccaaagttccttttcataagg

SEQ ID NO: 612615 - DNA, 25 bp, Homo sapien
ggattagggctcacaattattactt

SEQ ID NO: 612616 - DNA, 25 bp, Homo sapien
tgattatctctttaaagaccttgtg

SEQ ID NO: 612617 - DNA, 25 bp, Homo sapien
atgttgggattattgctgctcctga

SEQ ID NO: 612618 - DNA, 25 bp, Homo sapien
gctgctcctgatactatggtgtgtt

SEQ ID NO: 612619 - DNA, 25 bp, Homo sapien
ggtgtggctcatttgccttacaaaa

SEQ ID NO: 612620 - DNA, 25 bp, Homo sapien
aagcatgggtagtcgggcaccgaca

SEQ ID NO: 612621 - DNA, 25 bp, Homo sapien
gtcgggcaccgacagttaattcact

SEQ ID NO: 612622 - DNA, 25 bp, Homo sapien
gacagttaattcactctccggattc

SEQ ID NO: 612623 - DNA, 25 bp, Homo sapien
ctctccggattcgtgggttaacata

SEQ ID NO: 612624 - DNA, 25 bp, Homo sapien
gattagtatttgtgttgacccttta

SEQ ID NO: 612625 - DNA, 25 bp, Homo sapien
gttgaccctttacggtacaatccag

SEQ ID NO: 612626 - DNA, 25 bp, Homo sapien
ggtacaatccagcttaggctctatc

SEQ ID NO: 612627 - DNA, 25 bp, Homo sapien
gcttaggctctatcattcctatttc

SEQ ID NO: 612628 - DNA, 25 bp, Homo sapien
ttctaacaagtaccagcacactgag

SEQ ID NO: 612629 - DNA, 25 bp, Homo sapien
acaactatcgtggaaaatctgggag

SEQ ID NO: 612630 - DNA, 25 bp, Homo sapien
gaaaagtagctgaaaacctggtagg

SEQ ID NO: 612631 - DNA, 25 bp, Homo sapien
aagaacaatcagaggcggccttcca

SEQ ID NO: 612632 - DNA, 25 bp, Homo sapien
ggccttccacttctgagaacagttc

SEQ ID NO: 612633 - DNA, 25 bp, Homo sapien
gaacagttcctgtgagtcacctgat

SEQ ID NO: 612634 - DNA, 25 bp, Homo sapien
tgagtcacctgatgttgttctagat

SEQ ID NO: 612635 - DNA, 25 bp, Homo sapien
aagacagtgttggtcaacccagctg

SEQ ID NO: 612636 - DNA, 25 bp, Homo sapien
tgttggtcaacccagctgcaggcac

SEQ ID NO: 612637 - DNA, 25 bp, Homo sapien
ctgcaggcacttgatttcctctaaa

SEQ ID NO: 612638 - DNA, 25 bp, Homo sapien
gatttcctctaaaagctctggataa

SEQ ID NO: 612639 - DNA, 25 bp, Homo sapien
gcagaccaaagccaccaactcaggg

SEQ ID NO: 612640 - DNA, 25 bp, Homo sapien
gcagcctgtcacctggagcctggac

SEQ ID NO: 612641 - DNA, 25 bp, Homo sapien
tggaccagggatctcggggctgacc

SEQ ID NO: 612642 - DNA, 25 bp, Homo sapien
caactccatcatctgcaaacctgtt

SEQ ID NO: 612643 - DNA, 25 bp, Homo sapien
catctgcaaacctgttagggtcact

SEQ ID NO: 612644 - DNA, 25 bp, Homo sapien
aaggagcagctctctcacttggcca

SEQ ID NO: 612645 - DNA, 25 bp, Homo sapien
tgcaggtccacctggtcatctgctc

SEQ ID NO: 612646 - DNA, 25 bp, Homo sapien
gcttggccaacaaggctgagttcct

SEQ ID NO: 612647 - DNA, 25 bp, Homo sapien
aacaaggctgagttcctggacctgg

SEQ ID NO: 612648 - DNA, 25 bp, Homo sapien
tggacctgggctatgtgagtctcct

SEQ ID NO: 612649 - DNA, 25 bp, Homo sapien
tgggctatgtgagtctcctctgctc

SEQ ID NO: 612650 - DNA, 25 bp, Homo sapien
ccggcttgaaggtctagaagatgga

SEQ ID NO: 612651 - DNA, 25 bp, Homo sapien
gaagatggatagacaccagagactt

SEQ ID NO: 612652 - DNA, 25 bp, Homo sapien
ggatagacaccagagacttgtagtc

SEQ ID NO: 612653 - DNA, 25 bp, Homo sapien
agacttgtagtctatgtctccttct

SEQ ID NO: 612654 - DNA, 25 bp, Homo sapien
catcttttacttgggactccatcag

SEQ ID NO: 612655 - DNA, 25 bp, Homo sapien
tacttgggactccatcagtgactca

SEQ ID NO: 612656 - DNA, 25 bp, Homo sapien
tgggactccatcagtgactcatcat

SEQ ID NO: 612657 - DNA, 25 bp, Homo sapien
actccatcagtgactcatcattgct

SEQ ID NO: 612658 - DNA, 25 bp, Homo sapien
agtgactcatcattgcttttggtgt

SEQ ID NO: 612659 - DNA, 25 bp, Homo sapien
attgcttttggtgtgacttaccagc

SEQ ID NO: 612660 - DNA, 25 bp, Homo sapien
tttggtgtgacttaccagcggccgc

SEQ ID NO: 612661 - DNA, 25 bp, Homo sapien
agcatgcagtttgtggcaattctat

SEQ ID NO: 612662 - DNA, 25 bp, Homo sapien
caatgtttagttattctcaatgcag

SEQ ID NO: 612663 - DNA, 25 bp, Homo sapien
gcagattcttggcattccattccgt

SEQ ID NO: 612664 - DNA, 25 bp, Homo sapien
gcattccattccgtttctgctgatt

SEQ ID NO: 612665 - DNA, 25 bp, Homo sapien
ttatctgttggaatgaacgcggcgt

SEQ ID NO: 612666 - DNA, 25 bp, Homo sapien
atgaacgcggcgtgttgctgcaact

SEQ ID NO: 612667 - DNA, 25 bp, Homo sapien
ttgctgcaactgtgcgctggtgaga

SEQ ID NO: 612668 - DNA, 25 bp, Homo sapien
gagcctgctggtagtgcaagacgct

SEQ ID NO: 612669 - DNA, 25 bp, Homo sapien
ttaaagaccgcgctggtaccattgc

SEQ ID NO: 612670 - DNA, 25 bp, Homo sapien
tgcttttttcaagtgcttgtctctt

SEQ ID NO: 612671 - DNA, 25 bp, Homo sapien
caagtgcttgtctctttggtaaagg

SEQ ID NO: 612672 - DNA, 25 bp, Homo sapien
aaacgagccacaatataaacagtct

SEQ ID NO: 612673 - DNA, 25 bp, Homo sapien
taaacagtctcacatcttggtacct

SEQ ID NO: 612674 - DNA, 25 bp, Homo sapien
aacagtctcacatcttggtacctca

SEQ ID NO: 612675 - DNA, 25 bp, Homo sapien
agtctcacatcttggtacctcacca

SEQ ID NO: 612676 - DNA, 25 bp, Homo sapien
atcttggtacctcaccaaatgtccc

SEQ ID NO: 612677 - DNA, 25 bp, Homo sapien
tcgaaacaaaaacctagactacact

SEQ ID NO: 612678 - DNA, 25 bp, Homo sapien
gactacactaagctttaactgttgg

SEQ ID NO: 612679 - DNA, 25 bp, Homo sapien
ttaactgttgggttctttcttggca

SEQ ID NO: 612680 - DNA, 25 bp, Homo sapien
actgttgggttctttcttggcagaa

SEQ ID NO: 612681 - DNA, 25 bp, Homo sapien
gttgggttctttcttggcagaattt

SEQ ID NO: 612682 - DNA, 25 bp, Homo sapien
ctttcttggcagaatttttccctag

SEQ ID NO: 612683 - DNA, 25 bp, Homo sapien
gggtgggaacaagcttttatcataa

SEQ ID NO: 612684 - DNA, 25 bp, Homo sapien
gtgggaacaagcttttatcataaaa

SEQ ID NO: 612685 - DNA, 25 bp, Homo sapien
tatcataaaaccttctgtgctactg

SEQ ID NO: 612686 - DNA, 25 bp, Homo sapien
ataaaaccttctgtgctactgatat

SEQ ID NO: 612687 - DNA, 25 bp, Homo sapien
aaaaccttctgtgctactgatattt

SEQ ID NO: 612688 - DNA, 25 bp, Homo sapien
aaccttctgtgctactgatattttt

SEQ ID NO: 612689 - DNA, 25 bp, Homo sapien
aaaagtaacacaacctcactacagt

SEQ ID NO: 612690 - DNA, 25 bp, Homo sapien
agtaacacaacctcactacagtaca

SEQ ID NO: 612691 - DNA, 25 bp, Homo sapien
cacaacctcactacagtacacttaa

SEQ ID NO: 612692 - DNA, 25 bp, Homo sapien
acctcactacagtacacttaaaaag

SEQ ID NO: 612693 - DNA, 25 bp, Homo sapien
taaaaagaggactcaaggccgggtg

SEQ ID NO: 612694 - DNA, 25 bp, Homo sapien
taagtatgttctgcaatgactgaaa

SEQ ID NO: 612695 - DNA, 25 bp, Homo sapien
gttctgcaatgactgaaagtctcat

SEQ ID NO: 612696 - DNA, 25 bp, Homo sapien
aagtctcatgagacatacacagtaa

SEQ ID NO: 612697 - DNA, 25 bp, Homo sapien
acttttttgtgtaactctcatcagg

SEQ ID NO: 612698 - DNA, 25 bp, Homo sapien
ttttgtgtaactctcatcagggcca

SEQ ID NO: 612699 - DNA, 25 bp, Homo sapien
tgtgtaactctcatcagggccaaac

SEQ ID NO: 612700 - DNA, 25 bp, Homo sapien
taactctcatcagggccaaacctat

SEQ ID NO: 612701 - DNA, 25 bp, Homo sapien
gggccaaacctatcttattcagcaa

SEQ ID NO: 612702 - DNA, 25 bp, Homo sapien
aaaaatccctgttatcaacctgcca

SEQ ID NO: 612703 - DNA, 25 bp, Homo sapien
atccctgttatcaacctgccaaaaa

SEQ ID NO: 612704 - DNA, 25 bp, Homo sapien
aataaaatatctgcagctgggtgca

SEQ ID NO: 612705 - DNA, 25 bp, Homo sapien
tccccgcagatgagctttaacacag

SEQ ID NO: 612706 - DNA, 25 bp, Homo sapien
gatgagctttaacacagatgaatct

SEQ ID NO: 612707 - DNA, 25 bp, Homo sapien
gaatctcttctgcattcagaagtgc

SEQ ID NO: 612708 - DNA, 25 bp, Homo sapien
agaagtgctgcctcaaactcgagct

SEQ ID NO: 612709 - DNA, 25 bp, Homo sapien
gtgctgcctcaaactcgagctattt

SEQ ID NO: 612710 - DNA, 25 bp, Homo sapien
tgcctcaaactcgagctatttcctg

SEQ ID NO: 612711 - DNA, 25 bp, Homo sapien
aaactcgagctatttcctgtgatga

SEQ ID NO: 612712 - DNA, 25 bp, Homo sapien
tatttcctgtgatgagctccaagcc

SEQ ID NO: 612713 - DNA, 25 bp, Homo sapien
tgtgatgagctccaagcccctagag

SEQ ID NO: 612714 - DNA, 25 bp, Homo sapien
agctccaagcccctagagaggaagg

SEQ ID NO: 612715 - DNA, 25 bp, Homo sapien
gcctgacgaggcactggatgggcct

SEQ ID NO: 612716 - DNA, 25 bp, Homo sapien
ggacagtcattctcagactttgagt

SEQ ID NO: 612717 - DNA, 25 bp, Homo sapien
cagactttgagtttcaagacccctt

SEQ ID NO: 612718 - DNA, 25 bp, Homo sapien
ttgagtttcaagacccctttacact

SEQ ID NO: 612719 - DNA, 25 bp, Homo sapien
ctcttaaaaaccatcaaggacctca

SEQ ID NO: 612720 - DNA, 25 bp, Homo sapien
aaggacctcaaagagcttctgttta

SEQ ID NO: 612721 - DNA, 25 bp, Homo sapien
gggttatatctgtccatatttactg

SEQ ID NO: 612722 - DNA, 25 bp, Homo sapien
agagacatttgtttgcggacctatc

SEQ ID NO: 612723 - DNA, 25 bp, Homo sapien
gtttgcggacctatctacaagtcta

SEQ ID NO: 612724 - DNA, 25 bp, Homo sapien
ggacctatctacaagtctagactca

SEQ ID NO: 612725 - DNA, 25 bp, Homo sapien
agtctagactcagacagagacctga

SEQ ID NO: 612726 - DNA, 25 bp, Homo sapien
gagacctgagtcatgtcattacact

SEQ ID NO: 612727 - DNA, 25 bp, Homo sapien
cacctcctgggatgcaagcaacgct

SEQ ID NO: 612728 - DNA, 25 bp, Homo sapien
cctcctgggatgcaagcaacgctcc

SEQ ID NO: 612729 - DNA, 25 bp, Homo sapien
acctcagcctcttgaataacttgga

SEQ ID NO: 612730 - DNA, 25 bp, Homo sapien
gaataacttggactacaggcatgtt

SEQ ID NO: 612731 - DNA, 25 bp, Homo sapien
ataacttggactacaggcatgttcc

SEQ ID NO: 612732 - DNA, 25 bp, Homo sapien
aacttggactacaggcatgttccat

SEQ ID NO: 612733 - DNA, 25 bp, Homo sapien
ttggactacaggcatgttccatcac

SEQ ID NO: 612734 - DNA, 25 bp, Homo sapien
tgagcttgggcggtccacctgcctt

SEQ ID NO: 612735 - DNA, 25 bp, Homo sapien
gagcttgggcggtccacctgccttg

SEQ ID NO: 612736 - DNA, 25 bp, Homo sapien
cctggcctcctgtgtttaacatata

SEQ ID NO: 612737 - DNA, 25 bp, Homo sapien
ctggcctcctgtgtttaacatatat

SEQ ID NO: 612738 - DNA, 25 bp, Homo sapien
gtgtaaactggtctatccggagagt

SEQ ID NO: 612739 - DNA, 25 bp, Homo sapien
tctatccggagagtggtatagcctc

SEQ ID NO: 612740 - DNA, 25 bp, Homo sapien
gtatagcctctcatacagtgttcaa

SEQ ID NO: 612741 - DNA, 25 bp, Homo sapien
agatttaactcactgcaggtccaca

SEQ ID NO: 612742 - DNA, 25 bp, Homo sapien
gcaggtccacagcaaccgataagat

SEQ ID NO: 612743 - DNA, 25 bp, Homo sapien
taaactcgttggttatggtctccca

SEQ ID NO: 612744 - DNA, 25 bp, Homo sapien
gttggttatggtctcccactttgca

SEQ ID NO: 612745 - DNA, 25 bp, Homo sapien
tgagataacttggtttaggacccca

SEQ ID NO: 612746 - DNA, 25 bp, Homo sapien
ctggagctgggctgaacattagttc

SEQ ID NO: 612747 - DNA, 25 bp, Homo sapien
cattagttcattgtttcttcgatta

SEQ ID NO: 612748 - DNA, 25 bp, Homo sapien
tgtttcttcgattaatctatgctgc

SEQ ID NO: 612749 - DNA, 25 bp, Homo sapien
tattccctaaccaatgtagcattta

SEQ ID NO: 612750 - DNA, 25 bp, Homo sapien
acattgcattggtattacttttatg

SEQ ID NO: 612751 - DNA, 25 bp, Homo sapien
aaagtctttgggtacatatatgtga

SEQ ID NO: 612752 - DNA, 25 bp, Homo sapien
agtctttgggtacatatatgtgagt

SEQ ID NO: 612753 - DNA, 25 bp, Homo sapien
gaactgaaaacattagttgtcccca

SEQ ID NO: 612754 - DNA, 25 bp, Homo sapien
actgaaaacattagttgtccccaag

SEQ ID NO: 612755 - DNA, 25 bp, Homo sapien
tgaaaacattagttgtccccaagaa

SEQ ID NO: 612756 - DNA, 25 bp, Homo sapien
gaaaacattagttgtccccaagaag

SEQ ID NO: 612757 - DNA, 25 bp, Homo sapien
tgtccccaagaagggaactaaattg

SEQ ID NO: 612758 - DNA, 25 bp, Homo sapien
ggaactaaattgttagaggacagga

SEQ ID NO: 612759 - DNA, 25 bp, Homo sapien
gaaaagagatacgtgtgtgtacata

SEQ ID NO: 612760 - DNA, 25 bp, Homo sapien
gggatcctttctctagctggtggac

SEQ ID NO: 612761 - DNA, 25 bp, Homo sapien
tctagctggtggacgttcttatgcc

SEQ ID NO: 612762 - DNA, 25 bp, Homo sapien
ttcttatgccaccacttccatgatt

SEQ ID NO: 612763 - DNA, 25 bp, Homo sapien
ccacttccatgattttcaggctttc

SEQ ID NO: 612764 - DNA, 25 bp, Homo sapien
tttcttcacagttcacacttgcttc

SEQ ID NO: 612765 - DNA, 25 bp, Homo sapien
gttcacacttgcttccaggatagga

SEQ ID NO: 612766 - DNA, 25 bp, Homo sapien
ataggaggaatgtaaccagccagcc

SEQ ID NO: 612767 - DNA, 25 bp, Homo sapien
aatgtaaccagccagcctcgacaag

SEQ ID NO: 612768 - DNA, 25 bp, Homo sapien
agccagcctcgacaagtagcttgtg

SEQ ID NO: 612769 - DNA, 25 bp, Homo sapien
gcctcgacaagtagcttgtgtctgt

SEQ ID NO: 612770 - DNA, 25 bp, Homo sapien
ttgtgtctgttgcttgcatgcacag

SEQ ID NO: 612771 - DNA, 25 bp, Homo sapien
tggctttgtatcctgcctcttttag

SEQ ID NO: 612772 - DNA, 25 bp, Homo sapien
tgagaacttaaccactctggacctc

SEQ ID NO: 612773 - DNA, 25 bp, Homo sapien
gtaatgttatccaaggtacttagca

SEQ ID NO: 612774 - DNA, 25 bp, Homo sapien
atgttatccaaggtacttagcaaag

SEQ ID NO: 612775 - DNA, 25 bp, Homo sapien
gttatccaaggtacttagcaaagta

SEQ ID NO: 612776 - DNA, 25 bp, Homo sapien
gtacctaatagagtagttctgtgtc

SEQ ID NO: 612777 - DNA, 25 bp, Homo sapien
cctaatagagtagttctgtgtctgg

SEQ ID NO: 612778 - DNA, 25 bp, Homo sapien
gagtagttctgtgtctggcatatag

SEQ ID NO: 612779 - DNA, 25 bp, Homo sapien
gtaaggattcaatttatcttggaga

SEQ ID NO: 612780 - DNA, 25 bp, Homo sapien
aggattcaatttatcttggagatta

SEQ ID NO: 612781 - DNA, 25 bp, Homo sapien
ttagagaattttggacatttaacca

SEQ ID NO: 612782 - DNA, 25 bp, Homo sapien
gtaatgttatccaaggtacttagca

SEQ ID NO: 612783 - DNA, 25 bp, Homo sapien
aatgttatccaaggtacttagcaaa

SEQ ID NO: 612784 - DNA, 25 bp, Homo sapien
tgttatccaaggtacttagcaaagt

SEQ ID NO: 612785 - DNA, 25 bp, Homo sapien
gttatccaaggtacttagcaaagta

SEQ ID NO: 612786 - DNA, 25 bp, Homo sapien
gtacctaatagagtagttctgtgtc

SEQ ID NO: 612787 - DNA, 25 bp, Homo sapien
acctaatagagtagttctgtgtctg

SEQ ID NO: 612788 - DNA, 25 bp, Homo sapien
cctaatagagtagttctgtgtctgg

SEQ ID NO: 612789 - DNA, 25 bp, Homo sapien
gtaaggattcaatttatcttggaga

SEQ ID NO: 612790 - DNA, 25 bp, Homo sapien
aaggattcaatttatcttggagatt

SEQ ID NO: 612791 - DNA, 25 bp, Homo sapien
ggattcaatttatcttggagattat

SEQ ID NO: 612792 - DNA, 25 bp, Homo sapien
ttagagaattttggacatttaacca

SEQ ID NO: 612793 - DNA, 25 bp, Homo sapien
tcttcaccgtcctttcccagagaaa

SEQ ID NO: 612794 - DNA, 25 bp, Homo sapien
tttcccagagaaagcgacagcacag

SEQ ID NO: 612795 - DNA, 25 bp, Homo sapien
gcacagcctatgacaaccgaagcta

SEQ ID NO: 612796 - DNA, 25 bp, Homo sapien
gaggaaaccagagccattcgactat

SEQ ID NO: 612797 - DNA, 25 bp, Homo sapien
accagagccattcgactattgctag

SEQ ID NO: 612798 - DNA, 25 bp, Homo sapien
gccattcgactattgctagaggaga

SEQ ID NO: 612799 - DNA, 25 bp, Homo sapien
atagctgcaggaaaacatgcgcaaa

SEQ ID NO: 612800 - DNA, 25 bp, Homo sapien
aatagcacaaacattgcgtcgtcaa

SEQ ID NO: 612801 - DNA, 25 bp, Homo sapien
aaacattgcgtcgtcaaggctgcaa

SEQ ID NO: 612802 - DNA, 25 bp, Homo sapien
tcaaggctgcaatgtctaatacaaa

SEQ ID NO: 612803 - DNA, 25 bp, Homo sapien
aatagaaggttctcatagcaacaaa

SEQ ID NO: 612804 - DNA, 25 bp, Homo sapien
gagcatggtgccatgaagcccttca

SEQ ID NO: 612805 - DNA, 25 bp, Homo sapien
aaatgccccattcatgcagccgcag

SEQ ID NO: 612806 - DNA, 25 bp, Homo sapien
atgcagccgcagaagcaggccaact

SEQ ID NO: 612807 - DNA, 25 bp, Homo sapien
gcagaagcaggccaactgttgattc

SEQ ID NO: 612808 - DNA, 25 bp, Homo sapien
aactgttgattctgaaggcctttgt

SEQ ID NO: 612809 - DNA, 25 bp, Homo sapien
gattctgaaggcctttgtcaactac

SEQ ID NO: 612810 - DNA, 25 bp, Homo sapien
ggacaaactcccctgaccattgtgt

SEQ ID NO: 612811 - DNA, 25 bp, Homo sapien
tcccctgaccattgtgttcaaacac

SEQ ID NO: 612812 - DNA, 25 bp, Homo sapien
aaagggtagccctgtacattgctgc

SEQ ID NO: 612813 - DNA, 25 bp, Homo sapien
attgctgctttttgtgggtacattg

SEQ ID NO: 612814 - DNA, 25 bp, Homo sapien
ttttgtgggtacattgaactcactg

SEQ ID NO: 612815 - DNA, 25 bp, Homo sapien
aaggcagttgtgtatgggagagcat

SEQ ID NO: 612816 - DNA, 25 bp, Homo sapien
atgggagagcatgcgaggagggcga

SEQ ID NO: 612817 - DNA, 25 bp, Homo sapien
ggagatggagcaggaacatttggtt

SEQ ID NO: 612818 - DNA, 25 bp, Homo sapien
tggttggggctctgaggcactcttc

SEQ ID NO: 612819 - DNA, 25 bp, Homo sapien
ggctgtgcaggaaggatttagctaa

SEQ ID NO: 612820 - DNA, 25 bp, Homo sapien
gcaggaaggatttagctaaagccat

SEQ ID NO: 612821 - DNA, 25 bp, Homo sapien
aaggatttagctaaagccataaagc

SEQ ID NO: 612822 - DNA, 25 bp, Homo sapien
agccataaagctggaagagggtttg

SEQ ID NO: 612823 - DNA, 25 bp, Homo sapien
gggaacggctttgaagttacatttg

SEQ ID NO: 612824 - DNA, 25 bp, Homo sapien
gaagttacatttgttttgcaagttc

SEQ ID NO: 612825 - DNA, 25 bp, Homo sapien
catttgttttgcaagttctttgttt

SEQ ID NO: 612826 - DNA, 25 bp, Homo sapien
ttaaaactgcttacaccagaagcct

SEQ ID NO: 612827 - DNA, 25 bp, Homo sapien
aaaactgcttacaccagaagccttt

SEQ ID NO: 612828 - DNA, 25 bp, Homo sapien
aaactgcttacaccagaagcctttt

SEQ ID NO: 612829 - DNA, 25 bp, Homo sapien
aactgcttacaccagaagcctttta

SEQ ID NO: 612830 - DNA, 25 bp, Homo sapien
actgcttacaccagaagccttttag

SEQ ID NO: 612831 - DNA, 25 bp, Homo sapien
ctgcttacaccagaagccttttaga

SEQ ID NO: 612832 - DNA, 25 bp, Homo sapien
gaagccttttagagaagcatgagac

SEQ ID NO: 612833 - DNA, 25 bp, Homo sapien
gccttttagagaagcatgagactgt

SEQ ID NO: 612834 - DNA, 25 bp, Homo sapien
tagagaagcatgagactgtttgact

SEQ ID NO: 612835 - DNA, 25 bp, Homo sapien
gagaagcatgagactgtttgactag

SEQ ID NO: 612836 - DNA, 25 bp, Homo sapien
agaagcatgagactgtttgactagt

SEQ ID NO: 612837 - DNA, 25 bp, Homo sapien
gtttcaggacaatagctgtggttct

SEQ ID NO: 612838 - DNA, 25 bp, Homo sapien
aatagctgtggttctgtttcaaaca

SEQ ID NO: 612839 - DNA, 25 bp, Homo sapien
atgcatggagaagacagaacacctt

SEQ ID NO: 612840 - DNA, 25 bp, Homo sapien
gacagaacaccttctcaaatgggaa

SEQ ID NO: 612841 - DNA, 25 bp, Homo sapien
gagagagacagcaaacatagcaaaa

SEQ ID NO: 612842 - DNA, 25 bp, Homo sapien
acgagagaatacttcatgtggacac

SEQ ID NO: 612843 - DNA, 25 bp, Homo sapien
atacttcatgtggacactgggtgca

SEQ ID NO: 612844 - DNA, 25 bp, Homo sapien
gggtgcaaatcatgtccatcgatct

SEQ ID NO: 612845 - DNA, 25 bp, Homo sapien
aaatcatgtccatcgatctggaatt

SEQ ID NO: 612846 - DNA, 25 bp, Homo sapien
gatctggaatttataccccagcctt

SEQ ID NO: 612847 - DNA, 25 bp, Homo sapien
taacaaaattggtcgtgtgaattat

SEQ ID NO: 612848 - DNA, 25 bp, Homo sapien
atatatgtgattaacatccgcatgt

SEQ ID NO: 612849 - DNA, 25 bp, Homo sapien
taacatccgcatgtatgtatttaag

SEQ ID NO: 612850 - DNA, 25 bp, Homo sapien
gtatttaagccagttctttacatat

SEQ ID NO: 612851 - DNA, 25 bp, Homo sapien
gccagttctttacatattgaatcat

SEQ ID NO: 612852 - DNA, 25 bp, Homo sapien
tttccttctgatcctcatacagata

SEQ ID NO: 612853 - DNA, 25 bp, Homo sapien
tgtcattctgtgacttccttttttt

SEQ ID NO: 612854 - DNA, 25 bp, Homo sapien
gacattgactcaacatttttcatgt

SEQ ID NO: 612855 - DNA, 25 bp, Homo sapien
ttttcatgttgcttcacaatctcgt

SEQ ID NO: 612856 - DNA, 25 bp, Homo sapien
atgttgcttcacaatctcgtaatta

SEQ ID NO: 612857 - DNA, 25 bp, Homo sapien
gcttcacaatctcgtaattaacatt

SEQ ID NO: 612858 - DNA, 25 bp, Homo sapien
ttgctttttaaataccttgaggtgg

SEQ ID NO: 612859 - DNA, 25 bp, Homo sapien
gacattatcacaaatccccaaagca

SEQ ID NO: 612860 - DNA, 25 bp, Homo sapien
aatccccaaagcatacatacaaggc

SEQ ID NO: 612861 - DNA, 25 bp, Homo sapien
aagcatacatacaaggcaggaattt

SEQ ID NO: 612862 - DNA, 25 bp, Homo sapien
gaaattgtctaattccacctagctg

SEQ ID NO: 612863 - DNA, 25 bp, Homo sapien
gtctaattccacctagctgctatgt

SEQ ID NO: 612864 - DNA, 25 bp, Homo sapien
acctagctgctatgtgataaatgta

SEQ ID NO: 612865 - DNA, 25 bp, Homo sapien
gaattcctggaaatcaatctatatc

SEQ ID NO: 612866 - DNA, 25 bp, Homo sapien
aaatcaatctatatcttccacacat

SEQ ID NO: 612867 - DNA, 25 bp, Homo sapien
tcttccacacataggtataaccagg

SEQ ID NO: 612868 - DNA, 25 bp, Homo sapien
atctacttccaaagtaattcatggt

SEQ ID NO: 612869 - DNA, 25 bp, Homo sapien
ttcatggtatttccaccggaacaaa

SEQ ID NO: 612870 - DNA, 25 bp, Homo sapien
actgtggctggagcctatcacctct

SEQ ID NO: 612871 - DNA, 25 bp, Homo sapien
gtggctggagcctatcacctctgga

SEQ ID NO: 612872 - DNA, 25 bp, Homo sapien
gctggagcctatcacctctggatga

SEQ ID NO: 612873 - DNA, 25 bp, Homo sapien
tggagcctatcacctctggatgaaa

SEQ ID NO: 612874 - DNA, 25 bp, Homo sapien
gagcctatcacctctggatgaaatg

SEQ ID NO: 612875 - DNA, 25 bp, Homo sapien
gcctatcacctctggatgaaatggg

SEQ ID NO: 612876 - DNA, 25 bp, Homo sapien
tgtggatgggtgatgttggacaact

SEQ ID NO: 612877 - DNA, 25 bp, Homo sapien
actggaaggaggactcaggtagccc

SEQ ID NO: 612878 - DNA, 25 bp, Homo sapien
tggaaggaggactcaggtagcccca

SEQ ID NO: 612879 - DNA, 25 bp, Homo sapien
aggaggactcaggtagccccagcca

SEQ ID NO: 612880 - DNA, 25 bp, Homo sapien
aaatatgctgtctggctgacattaa

SEQ ID NO: 612881 - DNA, 25 bp, Homo sapien
aaggcagttgagacttcatgcactt

SEQ ID NO: 612882 - DNA, 25 bp, Homo sapien
gagacttcatgcacttttgggcaga

SEQ ID NO: 612883 - DNA, 25 bp, Homo sapien
cttcatgcacttttgggcagaacaa

SEQ ID NO: 612884 - DNA, 25 bp, Homo sapien
gagctggatgcaagaccagtgcttt

SEQ ID NO: 612885 - DNA, 25 bp, Homo sapien
cagtgctttaaaggacctcacagta

SEQ ID NO: 612886 - DNA, 25 bp, Homo sapien
ttaaaggacctcacagtaatgttga

SEQ ID NO: 612887 - DNA, 25 bp, Homo sapien
cacagtaatgttgagaagaagccag

SEQ ID NO: 612888 - DNA, 25 bp, Homo sapien
ccaggaatggtagtatggaatacat

SEQ ID NO: 612889 - DNA, 25 bp, Homo sapien
tggaatacatgattagagtctacta

SEQ ID NO: 612890 - DNA, 25 bp, Homo sapien
tactaagactacagatagttcactg

SEQ ID NO: 612891 - DNA, 25 bp, Homo sapien
ctacagatagttcactgaaaacccg

SEQ ID NO: 612892 - DNA, 25 bp, Homo sapien
atccaagcaaagtctatgttgcctt

SEQ ID NO: 612893 - DNA, 25 bp, Homo sapien
aaagtctatgttgccttcaccagtg

SEQ ID NO: 612894 - DNA, 25 bp, Homo sapien
tatgttgccttcaccagtgttcaga

SEQ ID NO: 612895 - DNA, 25 bp, Homo sapien
gttgccttcaccagtgttcagatac

SEQ ID NO: 612896 - DNA, 25 bp, Homo sapien
ttcaccagtgttcagatacacctgg

SEQ ID NO: 612897 - DNA, 25 bp, Homo sapien
ggagaccatttttacccaacagcat

SEQ ID NO: 612898 - DNA, 25 bp, Homo sapien
atttttacccaacagcatcagctca

SEQ ID NO: 612899 - DNA, 25 bp, Homo sapien
aacagcatcagctcagattcttgtg

SEQ ID NO: 612900 - DNA, 25 bp, Homo sapien
cagctcagattcttgtgattataac

SEQ ID NO: 612901 - DNA, 25 bp, Homo sapien
gtgattataacacagcatgattgct

SEQ ID NO: 612902 - DNA, 25 bp, Homo sapien
agcatgattgctgcttcatgccttc

SEQ ID NO: 612903 - DNA, 25 bp, Homo sapien
tcgaccctctgtcctggcgataggt

SEQ ID NO: 612904 - DNA, 25 bp, Homo sapien
gtcctggcgataggttccagttccc

SEQ ID NO: 612905 - DNA, 25 bp, Homo sapien
atggcagcacctttccaggctctga

SEQ ID NO: 612906 - DNA, 25 bp, Homo sapien
ttccaggctctgaaatgtacattct

SEQ ID NO: 612907 - DNA, 25 bp, Homo sapien
attctaacgtacaagcttaccgcac

SEQ ID NO: 612908 - DNA, 25 bp, Homo sapien
acaagcttaccgcacctggtttcgt

SEQ ID NO: 612909 - DNA, 25 bp, Homo sapien
gtttcgtcctgttctatgactctga

SEQ ID NO: 612910 - DNA, 25 bp, Homo sapien
atgactctgaaccacattctcggct

SEQ ID NO: 612911 - DNA, 25 bp, Homo sapien
gctctttaatattgccatctgtccc

SEQ ID NO: 612912 - DNA, 25 bp, Homo sapien
atctgtccctctgtaatcaaaccaa

SEQ ID NO: 612913 - DNA, 25 bp, Homo sapien
gggacatgagaatcatttcagcttg

SEQ ID NO: 612914 - DNA, 25 bp, Homo sapien
gtttctttgagtttcatttagacca

SEQ ID NO: 612915 - DNA, 25 bp, Homo sapien
atttagaccatacaagctgaccatg

SEQ ID NO: 612916 - DNA, 25 bp, Homo sapien
gctgaccatgacatatgacttctat

SEQ ID NO: 612917 - DNA, 25 bp, Homo sapien
gacatatgacttctatgtgttcagt

SEQ ID NO: 612918 - DNA, 25 bp, Homo sapien
gtgttcagtcacttaagatcatcaa

SEQ ID NO: 612919 - DNA, 25 bp, Homo sapien
agatcatcaaatgcctagactttgt

SEQ ID NO: 612920 - DNA, 25 bp, Homo sapien
aaatgcctagactttgtatttgaaa

SEQ ID NO: 612921 - DNA, 25 bp, Homo sapien
aatctttggcatcccttctaacttg

SEQ ID NO: 612922 - DNA, 25 bp, Homo sapien
ttggcatcccttctaacttgtgttt

SEQ ID NO: 612923 - DNA, 25 bp, Homo sapien
gcatcccttctaacttgtgttttgc

SEQ ID NO: 612924 - DNA, 25 bp, Homo sapien
tgcagttaaattactttggagatga

SEQ ID NO: 612925 - DNA, 25 bp, Homo sapien
acttccacatggcatctcatttaac

SEQ ID NO: 612926 - DNA, 25 bp, Homo sapien
cacatggcatctcatttaaccttca

SEQ ID NO: 612927 - DNA, 25 bp, Homo sapien
ttcaccacaacccaactaggaaggc

SEQ ID NO: 612928 - DNA, 25 bp, Homo sapien
aggaaggcaccatcattatcccatt

SEQ ID NO: 612929 - DNA, 25 bp, Homo sapien
aggcccaggaaggtgaatttaccag

SEQ ID NO: 612930 - DNA, 25 bp, Homo sapien
aatttaccagccagctcacaaatgg

SEQ ID NO: 612931 - DNA, 25 bp, Homo sapien
gctcacaaatggactagtagatggc

SEQ ID NO: 612932 - DNA, 25 bp, Homo sapien
atggcagtttgtggattggagccca

SEQ ID NO: 612933 - DNA, 25 bp, Homo sapien
ccacaccctctcaaatgagggctat

SEQ ID NO: 612934 - DNA, 25 bp, Homo sapien
acagcatgcagtaggtgcccaatca

SEQ ID NO: 612935 - DNA, 25 bp, Homo sapien
agtaggtgcccaatcataacagcag

SEQ ID NO: 612936 - DNA, 25 bp, Homo sapien
ttggaggagaagacccttattggca

SEQ ID NO: 612937 - DNA, 25 bp, Homo sapien
tggaggagaagacccttattggcat

SEQ ID NO: 612938 - DNA, 25 bp, Homo sapien
gaggagaagacccttattggcatga

SEQ ID NO: 612939 - DNA, 25 bp, Homo sapien
aggagaagacccttattggcatgac

SEQ ID NO: 612940 - DNA, 25 bp, Homo sapien
ttattttaacttgcattcataaaaa

SEQ ID NO: 612941 - DNA, 25 bp, Homo sapien
actttgagagtttacatcagaaaga

SEQ ID NO: 612942 - DNA, 25 bp, Homo sapien
ctttgagagtttacatcagaaagaa

SEQ ID NO: 612943 - DNA, 25 bp, Homo sapien
tttgagagtttacatcagaaagaaa

SEQ ID NO: 612944 - DNA, 25 bp, Homo sapien
atgacatgatccaaacttgataaag

SEQ ID NO: 612945 - DNA, 25 bp, Homo sapien
tgacatgatccaaacttgataaagg

SEQ ID NO: 612946 - DNA, 25 bp, Homo sapien
gacatgatccaaacttgataaagga

SEQ ID NO: 612947 - DNA, 25 bp, Homo sapien
gtgttcacttatgttagctcattta

SEQ ID NO: 612948 - DNA, 25 bp, Homo sapien
atgttagctcatttagtccttataa

SEQ ID NO: 612949 - DNA, 25 bp, Homo sapien
atttagtccttataacaagcctgtg

SEQ ID NO: 612950 - DNA, 25 bp, Homo sapien
tacagtagggtttagtgacttacca

SEQ ID NO: 612951 - DNA, 25 bp, Homo sapien
tgacttaccaaagggtcgaaggcct

SEQ ID NO: 612952 - DNA, 25 bp, Homo sapien
gtagagcaaagattccaggcagtca

SEQ ID NO: 612953 - DNA, 25 bp, Homo sapien
caggcagtcagattcttgagtccat

SEQ ID NO: 612954 - DNA, 25 bp, Homo sapien
ttgagtccattgtcttaaccattat

SEQ ID NO: 612955 - DNA, 25 bp, Homo sapien
taaccattatgccttattagtgcct

SEQ ID NO: 612956 - DNA, 25 bp, Homo sapien
ccttattagtgccttgttgccttaa

SEQ ID NO: 612957 - DNA, 25 bp, Homo sapien
ttgccttaataaacacttgctgact

SEQ ID NO: 612958 - DNA, 25 bp, Homo sapien
aaaaaagcaacctcaggcctgcctc

SEQ ID NO: 612959 - DNA, 25 bp, Homo sapien
cccaccatctcttgcaagttttaat

SEQ ID NO: 612960 - DNA, 25 bp, Homo sapien
caccatctcttgcaagttttaatcc

SEQ ID NO: 612961 - DNA, 25 bp, Homo sapien
ccatctcttgcaagttttaatccag

SEQ ID NO: 612962 - DNA, 25 bp, Homo sapien
agttttaatccagacaagcatatgt

SEQ ID NO: 612963 - DNA, 25 bp, Homo sapien
aatccagacaagcatatgtagaggt

SEQ ID NO: 612964 - DNA, 25 bp, Homo sapien
tccagacaagcatatgtagaggtag

SEQ ID NO: 612965 - DNA, 25 bp, Homo sapien
gaagatggaacctaagaattttact

SEQ ID NO: 612966 - DNA, 25 bp, Homo sapien
ccctatctcctatactcagagcaag

SEQ ID NO: 612967 - DNA, 25 bp, Homo sapien
tatctcctatactcagagcaagcat

SEQ ID NO: 612968 - DNA, 25 bp, Homo sapien
tctcctatactcagagcaagcataa

SEQ ID NO: 612969 - DNA, 25 bp, Homo sapien
atctcaggcaggaagcctgacggca

SEQ ID NO: 612970 - DNA, 25 bp, Homo sapien
tgacggcagagagatcttatccttg

SEQ ID NO: 612971 - DNA, 25 bp, Homo sapien
ggcaaggctagggagtctccacatg

SEQ ID NO: 612972 - DNA, 25 bp, Homo sapien
ggctagggagtctccacatgggctt

SEQ ID NO: 612973 - DNA, 25 bp, Homo sapien
tccacatgggcttcaaagactgaaa

SEQ ID NO: 612974 - DNA, 25 bp, Homo sapien
aagactgaaattcacacaaatgtgt

SEQ ID NO: 612975 - DNA, 25 bp, Homo sapien
aggtacagtatgtgtattttcagag

SEQ ID NO: 612976 - DNA, 25 bp, Homo sapien
gaccttcggtttcatcagattttag

SEQ ID NO: 612977 - DNA, 25 bp, Homo sapien
ttttagggaagtgcgtgatccaaaa

SEQ ID NO: 612978 - DNA, 25 bp, Homo sapien
tgatccaaaaacacttaagaccttt

SEQ ID NO: 612979 - DNA, 25 bp, Homo sapien
ctaggtggcttaaacagctgatatg

SEQ ID NO: 612980 - DNA, 25 bp, Homo sapien
gatcaagttccaccattatgcaaaa

SEQ ID NO: 612981 - DNA, 25 bp, Homo sapien
gcaaaagggactcctgtaagccagg

SEQ ID NO: 612982 - DNA, 25 bp, Homo sapien
ggactcctgtaagccaggtgaagaa

SEQ ID NO: 612983 - DNA, 25 bp, Homo sapien
gggcaaggcccttcttggtcagcag

SEQ ID NO: 612984 - DNA, 25 bp, Homo sapien
gcaaggcccttcttggtcagcaggg

SEQ ID NO: 612985 - DNA, 25 bp, Homo sapien
caaggcccttcttggtcagcaggga

SEQ ID NO: 612986 - DNA, 25 bp, Homo sapien
aaggcccttcttggtcagcagggat

SEQ ID NO: 612987 - DNA, 25 bp, Homo sapien
aggcccttcttggtcagcagggata

SEQ ID NO: 612988 - DNA, 25 bp, Homo sapien
ggcccttcttggtcagcagggataa

SEQ ID NO: 612989 - DNA, 25 bp, Homo sapien
gctctgaggcactcttctgcttggg

SEQ ID NO: 612990 - DNA, 25 bp, Homo sapien
ggaacggctttgaagttacatttgt

SEQ ID NO: 612991 - DNA, 25 bp, Homo sapien
ctgctattccatgagagggtgaaga

SEQ ID NO: 612992 - DNA, 25 bp, Homo sapien
gtgaagacatcacatttctatatgg

SEQ ID NO: 612993 - DNA, 25 bp, Homo sapien
gatccaaaatttgtattgctgtaga

SEQ ID NO: 612994 - DNA, 25 bp, Homo sapien
aattggtgaattatagatgcttgat

SEQ ID NO: 612995 - DNA, 25 bp, Homo sapien
tgatgaaatcacaagtcctaccact

SEQ ID NO: 612996 - DNA, 25 bp, Homo sapien
tgccttccaaatccctgcagaaaac

SEQ ID NO: 612997 - DNA, 25 bp, Homo sapien
gcagatggttagtattattcaatgg

SEQ ID NO: 612998 - DNA, 25 bp, Homo sapien
attgctatttgccttagatttctct

SEQ ID NO: 612999 - DNA, 25 bp, Homo sapien
tttgccttagatttctctttttgta

SEQ ID NO: 613000 - DNA, 25 bp, Homo sapien
gttattttgggtacagaactcacaa

SEQ ID NO: 613001 - DNA, 25 bp, Homo sapien
gagcacgtgcaattgtttaaccatt

SEQ ID NO: 613002 - DNA, 25 bp, Homo sapien
atgaattgttgagaatcaccaaata

SEQ ID NO: 613003 - DNA, 25 bp, Homo sapien
gttgagaatcaccaaatatttgagt

SEQ ID NO: 613004 - DNA, 25 bp, Homo sapien
aagcaagcaaattaaaagcactgag

SEQ ID NO: 613005 - DNA, 25 bp, Homo sapien
acacattatgtatacagcagaagta

SEQ ID NO: 613006 - DNA, 25 bp, Homo sapien
gtatacagcagaagtaaatctttaa

SEQ ID NO: 613007 - DNA, 25 bp, Homo sapien
gaaataaactaatattgcttccata

SEQ ID NO: 613008 - DNA, 25 bp, Homo sapien
aactaatattgcttccataattcag

SEQ ID NO: 613009 - DNA, 25 bp, Homo sapien
taatattgcttccataattcagaga

SEQ ID NO: 613010 - DNA, 25 bp, Homo sapien
tattgcttccataattcagagaatg

SEQ ID NO: 613011 - DNA, 25 bp, Homo sapien
tgcttccataattcagagaatgtgg

SEQ ID NO: 613012 - DNA, 25 bp, Homo sapien
gataaaagtaaagaattaggccaga

SEQ ID NO: 613013 - DNA, 25 bp, Homo sapien
cggactccgtgctgttcgagtactt

SEQ ID NO: 613014 - DNA, 25 bp, Homo sapien
actccgtgctgttcgagtacttcgt

SEQ ID NO: 613015 - DNA, 25 bp, Homo sapien
gtgctgttcgagtacttcgtgtgcc

SEQ ID NO: 613016 - DNA, 25 bp, Homo sapien
tgttcgagtacttcgtgtgccgcaa

SEQ ID NO: 613017 - DNA, 25 bp, Homo sapien
ttcgagtacttcgtgtgccgcaaac

SEQ ID NO: 613018 - DNA, 25 bp, Homo sapien
agtacttcgtgtgccgcaaacccaa

SEQ ID NO: 613019 - DNA, 25 bp, Homo sapien
gtgtgccgcaaacccaagatccggg

SEQ ID NO: 613020 - DNA, 25 bp, Homo sapien
gtgccgcaaacccaagatccgggag

SEQ ID NO: 613021 - DNA, 25 bp, Homo sapien
gccgcaaacccaagatccgggagcg

SEQ ID NO: 613022 - DNA, 25 bp, Homo sapien
gcgtcacggccaccgcgggcgaaga

SEQ ID NO: 613023 - DNA, 25 bp, Homo sapien
gctggagatccaggacgcgcggccg

SEQ ID NO: 613024 - DNA, 25 bp, Homo sapien
taatattggcaaaagggacctggaa

SEQ ID NO: 613025 - DNA, 25 bp, Homo sapien
aagggacctggaacattaattggag

SEQ ID NO: 613026 - DNA, 25 bp, Homo sapien
ttaattggagggagccccgcctcgt

SEQ ID NO: 613027 - DNA, 25 bp, Homo sapien
gggcatctctttttaactcccacct

SEQ ID NO: 613028 - DNA, 25 bp, Homo sapien
ttaactcccaccttctcgtgctata

SEQ ID NO: 613029 - DNA, 25 bp, Homo sapien
ttctcgtgctatactctgtggctgt

SEQ ID NO: 613030 - DNA, 25 bp, Homo sapien
aagtgcttagggacagcatgatctt

SEQ ID NO: 613031 - DNA, 25 bp, Homo sapien
gcatgatcttactgttattcaaagg

SEQ ID NO: 613032 - DNA, 25 bp, Homo sapien
tagactaggaagatgtgtgaccaag

SEQ ID NO: 613033 - DNA, 25 bp, Homo sapien
gctccttccctgtattttgtgacca

SEQ ID NO: 613034 - DNA, 25 bp, Homo sapien
ccctgtattttgtgaccagaatgaa

SEQ ID NO: 613035 - DNA, 25 bp, Homo sapien
taatgttaggtagtttagggtctct

SEQ ID NO: 613036 - DNA, 25 bp, Homo sapien
tagggtctctaggtgttatctcctt

SEQ ID NO: 613037 - DNA, 25 bp, Homo sapien
ggtctctaggtgttatctcctttga

SEQ ID NO: 613038 - DNA, 25 bp, Homo sapien
aggtgttatctcctttgattcgccc

SEQ ID NO: 613039 - DNA, 25 bp, Homo sapien
tttgattcgccctttctgtagagat

SEQ ID NO: 613040 - DNA, 25 bp, Homo sapien
gattcgccctttctgtagagattat

SEQ ID NO: 613041 - DNA, 25 bp, Homo sapien
gccctttctgtagagattatccaag

SEQ ID NO: 613042 - DNA, 25 bp, Homo sapien
gagattatccaagcataactactga

SEQ ID NO: 613043 - DNA, 25 bp, Homo sapien
ataactactgaatagcctgcaaatg

SEQ ID NO: 613044 - DNA, 25 bp, Homo sapien
ctgaatagcctgcaaatgaggtttt

SEQ ID NO: 613045 - DNA, 25 bp, Homo sapien
gaggttttaaggtcagcacaactat

SEQ ID NO: 613046 - DNA, 25 bp, Homo sapien
acacaagggcacacaccaggagaat

SEQ ID NO: 613047 - DNA, 25 bp, Homo sapien
ggcacacaccaggagaatgtcatgt

SEQ ID NO: 613048 - DNA, 25 bp, Homo sapien
atgtcatgtgacaatggaagcagag

SEQ ID NO: 613049 - DNA, 25 bp, Homo sapien
aagcagagattggagagctgtgtct

SEQ ID NO: 613050 - DNA, 25 bp, Homo sapien
gagagctgtgtctataagccaagta

SEQ ID NO: 613051 - DNA, 25 bp, Homo sapien
gtgtctataagccaagtaacatcaa

SEQ ID NO: 613052 - DNA, 25 bp, Homo sapien
gagaaaggcgtggaacggactccca

SEQ ID NO: 613053 - DNA, 25 bp, Homo sapien
ggactcccaccttgagccttcagag

SEQ ID NO: 613054 - DNA, 25 bp, Homo sapien
gccttcagagacagcgtggacctac

SEQ ID NO: 613055 - DNA, 25 bp, Homo sapien
agcgtggacctactgacaccttgac

SEQ ID NO: 613056 - DNA, 25 bp, Homo sapien
gacttctagccagaactttgagaga

SEQ ID NO: 613057 - DNA, 25 bp, Homo sapien
gaaaacccgatcacacaaatgctgt

SEQ ID NO: 613058 - DNA, 25 bp, Homo sapien
aaatgctgtgactagagacttgaca

SEQ ID NO: 613059 - DNA, 25 bp, Homo sapien
gagacttgacaggtgccaaatcaga

SEQ ID NO: 613060 - DNA, 25 bp, Homo sapien
tgacaggtgccaaatcagagtgcta

SEQ ID NO: 613061 - DNA, 25 bp, Homo sapien
atcagagtgctacaggtccaatgcc

SEQ ID NO: 613062 - DNA, 25 bp, Homo sapien
agtgctacaggtccaatgcctctca

SEQ ID NO: 613063 - DNA, 25 bp, Homo sapien
tctcaccgataccatgcggctgctg

SEQ ID NO: 613064 - DNA, 25 bp, Homo sapien
gataccatgcggctgctgtgtgaac

SEQ ID NO: 613065 - DNA, 25 bp, Homo sapien
gctgctgtgtgaacttccctcacca

SEQ ID NO: 613066 - DNA, 25 bp, Homo sapien
gtgtgaacttccctcaccacgtaac

SEQ ID NO: 613067 - DNA, 25 bp, Homo sapien
taaccctcaccttagggaagagaag

SEQ ID NO: 613068 - DNA, 25 bp, Homo sapien
tactgtaacttactgcaccatacta

SEQ ID NO: 613069 - DNA, 25 bp, Homo sapien
tactgcaccatactaatacatgaat

SEQ ID NO: 613070 - DNA, 25 bp, Homo sapien
taagtgcagcttttaacccttctca

SEQ ID NO: 613071 - DNA, 25 bp, Homo sapien
ttaacccttctcatctcacagggaa

SEQ ID NO: 613072 - DNA, 25 bp, Homo sapien
atttggtaattttggcacttgctaa

SEQ ID NO: 613073 - DNA, 25 bp, Homo sapien
aaatagattttctgagttgcaatat

SEQ ID NO: 613074 - DNA, 25 bp, Homo sapien
gttgcaatatagtcaatttcgctta

SEQ ID NO: 613075 - DNA, 25 bp, Homo sapien
gtcaatttcgcttattctacatata

SEQ ID NO: 613076 - DNA, 25 bp, Homo sapien
tctacatatagtcatgggataatac

SEQ ID NO: 613077 - DNA, 25 bp, Homo sapien
ggataatactgatccatttctcagc

SEQ ID NO: 613078 - DNA, 25 bp, Homo sapien
atttctcagctttacatatgtctaa

SEQ ID NO: 613079 - DNA, 25 bp, Homo sapien
ttcactgtctgactttagtctccca

SEQ ID NO: 613080 - DNA, 25 bp, Homo sapien
tcactgtctgactttagtctcccac

SEQ ID NO: 613081 - DNA, 25 bp, Homo sapien
actgtctgactttagtctcccacta

SEQ ID NO: 613082 - DNA, 25 bp, Homo sapien
ctgtctgactttagtctcccactaa

SEQ ID NO: 613083 - DNA, 25 bp, Homo sapien
tgtctgactttagtctcccactaaa

SEQ ID NO: 613084 - DNA, 25 bp, Homo sapien
gtctgactttagtctcccactaaaa

SEQ ID NO: 613085 - DNA, 25 bp, Homo sapien
tctgactttagtctcccactaaaac

SEQ ID NO: 613086 - DNA, 25 bp, Homo sapien
tgactttagtctcccactaaaactg

SEQ ID NO: 613087 - DNA, 25 bp, Homo sapien
tagtctcccactaaaactgcatttc

SEQ ID NO: 613088 - DNA, 25 bp, Homo sapien
agtctcccactaaaactgcatttcc

SEQ ID NO: 613089 - DNA, 25 bp, Homo sapien
ctgcacctacgggtcctaataaatc

SEQ ID NO: 613090 - DNA, 25 bp, Homo sapien
ggatgtttcacacctataaaagcct

SEQ ID NO: 613091 - DNA, 25 bp, Homo sapien
aagttggatacactcttgttgtaga

SEQ ID NO: 613092 - DNA, 25 bp, Homo sapien
tggatacactcttgttgtagaatct

SEQ ID NO: 613093 - DNA, 25 bp, Homo sapien
tgaagttcattgaggtctatagtga

SEQ ID NO: 613094 - DNA, 25 bp, Homo sapien
gaaactataaagaagctatctctga

SEQ ID NO: 613095 - DNA, 25 bp, Homo sapien
ctctgaaaatactttatgatgtgtg

SEQ ID NO: 613096 - DNA, 25 bp, Homo sapien
agctgtcagtaaaaatgctgtgcaa

SEQ ID NO: 613097 - DNA, 25 bp, Homo sapien
gctgtgcaatatgtggattcatgtc

SEQ ID NO: 613098 - DNA, 25 bp, Homo sapien
catgtcacaaatttaaacctctgca

SEQ ID NO: 613099 - DNA, 25 bp, Homo sapien
tattcagcaagtttggaataccttt

SEQ ID NO: 613100 - DNA, 25 bp, Homo sapien
ggaatacctttttgtagaatataca

SEQ ID NO: 613101 - DNA, 25 bp, Homo sapien
agattcttgaagactaactttctca

SEQ ID NO: 613102 - DNA, 25 bp, Homo sapien
aactttctcaatcatattctcggga

SEQ ID NO: 613103 - DNA, 25 bp, Homo sapien
ttctcgggaaagtaactatgtgttc

SEQ ID NO: 613104 - DNA, 25 bp, Homo sapien
ctctgtctactgagaatcgacttca

SEQ ID NO: 613105 - DNA, 25 bp, Homo sapien
gacttcaaatgcatgctactaaaat

SEQ ID NO: 613106 - DNA, 25 bp, Homo sapien
atggagctaatatgcgtcatttcct

SEQ ID NO: 613107 - DNA, 25 bp, Homo sapien
atatgcgtcatttcctcagctataa

SEQ ID NO: 613108 - DNA, 25 bp, Homo sapien
gtcatttcctcagctataatttggg

SEQ ID NO: 613109 - DNA, 25 bp, Homo sapien
acttgttaaatcactagactgctat

SEQ ID NO: 613110 - DNA, 25 bp, Homo sapien
agactgctataaggtttgcccataa

SEQ ID NO: 613111 - DNA, 25 bp, Homo sapien
aggtttgcccataaacattgtaaat

SEQ ID NO: 613112 - DNA, 25 bp, Homo sapien
gaccttgcaaaagacaatgtgccaa

SEQ ID NO: 613113 - DNA, 25 bp, Homo sapien
aataatcaagacctcattacttttg

SEQ ID NO: 613114 - DNA, 25 bp, Homo sapien
acttttgaagaagcaaattagccaa

SEQ ID NO: 613115 - DNA, 25 bp, Homo sapien
ccaaatttggttctgatccaatcaa

SEQ ID NO: 613116 - DNA, 25 bp, Homo sapien
ggttctgatccaatcaaatctgata

SEQ ID NO: 613117 - DNA, 25 bp, Homo sapien
aaatctgataatggttgtactgaag

SEQ ID NO: 613118 - DNA, 25 bp, Homo sapien
gttgtactgaagatgacacctcctc

SEQ ID NO: 613119 - DNA, 25 bp, Homo sapien
tactgaagatgacacctcctctcat

SEQ ID NO: 613120 - DNA, 25 bp, Homo sapien
atgacacctcctctcattctgatga

SEQ ID NO: 613121 - DNA, 25 bp, Homo sapien
ctcctctcattctgatgacactatg

SEQ ID NO: 613122 - DNA, 25 bp, Homo sapien
agtttctaatgagctcgttgaaagt

SEQ ID NO: 613123 - DNA, 25 bp, Homo sapien
acgagagggctttgagtgtttctga

SEQ ID NO: 613124 - DNA, 25 bp, Homo sapien
gatggcaggcacaacatctgaaacc

SEQ ID NO: 613125 - DNA, 25 bp, Homo sapien
gaaacccacaaacgcatggccagag

SEQ ID NO: 613126 - DNA, 25 bp, Homo sapien
acgcatggccagagggatttctatt

SEQ ID NO: 613127 - DNA, 25 bp, Homo sapien
ggatttctatttttgccggtggatc

SEQ ID NO: 613128 - DNA, 25 bp, Homo sapien
tttgccggtggatcaggcaggtcca

SEQ ID NO: 613129 - DNA, 25 bp, Homo sapien
ggcaggtccacacttgctaagtata

SEQ ID NO: 613130 - DNA, 25 bp, Homo sapien
tatgtgggtcacaggacagccaact

SEQ ID NO: 613131 - DNA, 25 bp, Homo sapien
gacagccaactgcaaattactctcc

SEQ ID NO: 613132 - DNA, 25 bp, Homo sapien
aatctgtcatatgccctagttctat

SEQ ID NO: 613133 - DNA, 25 bp, Homo sapien
gccctagttctatgtcttatgttat

SEQ ID NO: 613134 - DNA, 25 bp, Homo sapien
ttacatgaaattgggctgggcacga

SEQ ID NO: 613135 - DNA, 25 bp, Homo sapien
acatgaaattgggctgggcacgatg

SEQ ID NO: 613136 - DNA, 25 bp, Homo sapien
cactcctgttatcccagtgctttag

SEQ ID NO: 613137 - DNA, 25 bp, Homo sapien
ctagctactcaggtggcggaggtga

SEQ ID NO: 613138 - DNA, 25 bp, Homo sapien
ggattgcccgaacccaggagtcaaa

SEQ ID NO: 613139 - DNA, 25 bp, Homo sapien
attgcccgaacccaggagtcaaaag

SEQ ID NO: 613140 - DNA, 25 bp, Homo sapien
ttgcccgaacccaggagtcaaaagc

SEQ ID NO: 613141 - DNA, 25 bp, Homo sapien
tgcccgaacccaggagtcaaaagct

SEQ ID NO: 613142 - DNA, 25 bp, Homo sapien
gcccgaacccaggagtcaaaagctg

SEQ ID NO: 613143 - DNA, 25 bp, Homo sapien
cccgaacccaggagtcaaaagctgc

SEQ ID NO: 613144 - DNA, 25 bp, Homo sapien
gagctactgtgatcatgcctctcta

SEQ ID NO: 613145 - DNA, 25 bp, Homo sapien
tcttccaagatattgtattcccaag

SEQ ID NO: 613146 - DNA, 25 bp, Homo sapien
ttacctgtcttttaatccagtccat

SEQ ID NO: 613147 - DNA, 25 bp, Homo sapien
ttttaatccagtccattttctgaca

SEQ ID NO: 613148 - DNA, 25 bp, Homo sapien
tattaaacagaacgccagttgcatt

SEQ ID NO: 613149 - DNA, 25 bp, Homo sapien
aacgccagttgcatttactttggtg

SEQ ID NO: 613150 - DNA, 25 bp, Homo sapien
gcatttactttggtgatttgcaaac

SEQ ID NO: 613151 - DNA, 25 bp, Homo sapien
tgatttgcaaacttggaatgaagcc

SEQ ID NO: 613152 - DNA, 25 bp, Homo sapien
gaagccaccagtcattttttaagaa

SEQ ID NO: 613153 - DNA, 25 bp, Homo sapien
aatctaaccattttattctctgctt

SEQ ID NO: 613154 - DNA, 25 bp, Homo sapien
aaccattttattctctgcttcatag

SEQ ID NO: 613155 - DNA, 25 bp, Homo sapien
tattctctgcttcatagcattctaa

SEQ ID NO: 613156 - DNA, 25 bp, Homo sapien
agcattaaaagttgaaaggttcacg

SEQ ID NO: 613157 - DNA, 25 bp, Homo sapien
gcattaaaagttgaaaggttcacgc

SEQ ID NO: 613158 - DNA, 25 bp, Homo sapien
ttaaaagttgaaaggttcacgcctg

SEQ ID NO: 613159 - DNA, 25 bp, Homo sapien
taaaagttgaaaggttcacgcctgt

SEQ ID NO: 613160 - DNA, 25 bp, Homo sapien
tgaagcaggaggatcgcctgagtcc

SEQ ID NO: 613161 - DNA, 25 bp, Homo sapien
tcgcctgagtccaggaatttgagac

SEQ ID NO: 613162 - DNA, 25 bp, Homo sapien
tagccagacatcgtagcacgcactt

SEQ ID NO: 613163 - DNA, 25 bp, Homo sapien
agccagacatcgtagcacgcactta

SEQ ID NO: 613164 - DNA, 25 bp, Homo sapien
gccagacatcgtagcacgcacttat

SEQ ID NO: 613165 - DNA, 25 bp, Homo sapien
ccagacatcgtagcacgcacttata

SEQ ID NO: 613166 - DNA, 25 bp, Homo sapien
cagacatcgtagcacgcacttataa

SEQ ID NO: 613167 - DNA, 25 bp, Homo sapien
gtaagtgttaactattatactggaa

SEQ ID NO: 613168 - DNA, 25 bp, Homo sapien
agtgttaactattatactggaaaga

SEQ ID NO: 613169 - DNA, 25 bp, Homo sapien
ctggaaagaaggctcagttccttga

SEQ ID NO: 613170 - DNA, 25 bp, Homo sapien
ggaaagaaggctcagttccttgatt

SEQ ID NO: 613171 - DNA, 25 bp, Homo sapien
aagaaggctcagttccttgatttag

SEQ ID NO: 613172 - DNA, 25 bp, Homo sapien
gaaggctcagttccttgatttaggt

SEQ ID NO: 613173 - DNA, 25 bp, Homo sapien
aggctcagttccttgatttaggtgt

SEQ ID NO: 613174 - DNA, 25 bp, Homo sapien
ggctcagttccttgatttaggtgtg

SEQ ID NO: 613175 - DNA, 25 bp, Homo sapien
ctcagttccttgatttaggtgtggg

SEQ ID NO: 613176 - DNA, 25 bp, Homo sapien
cagttccttgatttaggtgtgggag

SEQ ID NO: 613177 - DNA, 25 bp, Homo sapien
ttccttgatttaggtgtgggagaaa

SEQ ID NO: 613178 - DNA, 25 bp, Homo sapien
ggaacttccaaatcatctaaaccag

SEQ ID NO: 613179 - DNA, 25 bp, Homo sapien
tctaaaccagctttgtatgacacta

SEQ ID NO: 613180 - DNA, 25 bp, Homo sapien
acactaagaataccctcattccttc

SEQ ID NO: 613181 - DNA, 25 bp, Homo sapien
tcattccttcagtgtctagctctgt

SEQ ID NO: 613182 - DNA, 25 bp, Homo sapien
gtgtttatttgcagaggaccctcat

SEQ ID NO: 613183 - DNA, 25 bp, Homo sapien
gcagaggaccctcatgcatggatcc

SEQ ID NO: 613184 - DNA, 25 bp, Homo sapien
aatgaggcaaactgtgaagcagact

SEQ ID NO: 613185 - DNA, 25 bp, Homo sapien
gaagcagactagactgtgccgctta

SEQ ID NO: 613186 - DNA, 25 bp, Homo sapien
gtgccgcttaccgtaaagtctttga

SEQ ID NO: 613187 - DNA, 25 bp, Homo sapien
aactgctaggcatgatatttactta

SEQ ID NO: 613188 - DNA, 25 bp, Homo sapien
ttggttgaggttttatgctttcagt

SEQ ID NO: 613189 - DNA, 25 bp, Homo sapien
attttactgttttgccaatcggttg

SEQ ID NO: 613190 - DNA, 25 bp, Homo sapien
tttgccaatcggttgatgatcatat

SEQ ID NO: 613191 - DNA, 25 bp, Homo sapien
ggacaccacataacgaaccacatgc

SEQ ID NO: 613192 - DNA, 25 bp, Homo sapien
tttaaatcagttacttgagtccaag

SEQ ID NO: 613193 - DNA, 25 bp, Homo sapien
acttgagtccaagtatgtatggtga

SEQ ID NO: 613194 - DNA, 25 bp, Homo sapien
taggtaatttcctatttgggacata

SEQ ID NO: 613195 - DNA, 25 bp, Homo sapien
tatttgggacatagtaggtatacac

SEQ ID NO: 613196 - DNA, 25 bp, Homo sapien
gtaggtatacacttttccattctta

SEQ ID NO: 613197 - DNA, 25 bp, Homo sapien
tatacacttttccattcttaccaca

SEQ ID NO: 613198 - DNA, 25 bp, Homo sapien
acacatctatggtactttgtaatcc

SEQ ID NO: 613199 - DNA, 25 bp, Homo sapien
gtaatccagtatttaaaggcctaca

SEQ ID NO: 613200 - DNA, 25 bp, Homo sapien
gatcacttgagctctagaggccaag

SEQ ID NO: 613201 - DNA, 25 bp, Homo sapien
atcacttgagctctagaggccaagg

SEQ ID NO: 613202 - DNA, 25 bp, Homo sapien
tcacttgagctctagaggccaaggc

SEQ ID NO: 613203 - DNA, 25 bp, Homo sapien
cacttgagctctagaggccaaggct

SEQ ID NO: 613204 - DNA, 25 bp, Homo sapien
acttgagctctagaggccaaggctg

SEQ ID NO: 613205 - DNA, 25 bp, Homo sapien
cttgagctctagaggccaaggctgc

SEQ ID NO: 613206 - DNA, 25 bp, Homo sapien
ttgagctctagaggccaaggctgca

SEQ ID NO: 613207 - DNA, 25 bp, Homo sapien
atcatgcctctgcaccctagtctgg

SEQ ID NO: 613208 - DNA, 25 bp, Homo sapien
tcatgcctctgcaccctagtctggg

SEQ ID NO: 613209 - DNA, 25 bp, Homo sapien
catgcctctgcaccctagtctgggt

SEQ ID NO: 613210 - DNA, 25 bp, Homo sapien
atgcctctgcaccctagtctgggtg

SEQ ID NO: 613211 - DNA, 25 bp, Homo sapien
aggagccgctgaccccggaaatgga

SEQ ID NO: 613212 - DNA, 25 bp, Homo sapien
ccgctgaccccggaaatggagagat

SEQ ID NO: 613213 - DNA, 25 bp, Homo sapien
cgctgaccccggaaatggagagatg

SEQ ID NO: 613214 - DNA, 25 bp, Homo sapien
gctgaccccggaaatggagagatgg

SEQ ID NO: 613215 - DNA, 25 bp, Homo sapien
ctgaccccggaaatggagagatgga

SEQ ID NO: 613216 - DNA, 25 bp, Homo sapien
tgaccccggaaatggagagatggag

SEQ ID NO: 613217 - DNA, 25 bp, Homo sapien
gaccccggaaatggagagatggagc

SEQ ID NO: 613218 - DNA, 25 bp, Homo sapien
caggctccctccggcctcggggacg

SEQ ID NO: 613219 - DNA, 25 bp, Homo sapien
gcggcagcagcaaccggcacgcggc

SEQ ID NO: 613220 - DNA, 25 bp, Homo sapien
cggcagcagcaaccggcacgcggcg

SEQ ID NO: 613221 - DNA, 25 bp, Homo sapien
gcagcaaccggcacgcggcgcccgc

SEQ ID NO: 613222 - DNA, 25 bp, Homo sapien
aaagagttggctttgatccccgcct

SEQ ID NO: 613223 - DNA, 25 bp, Homo sapien
gtggctcactcagaattcttcattg

SEQ ID NO: 613224 - DNA, 25 bp, Homo sapien
cattgatgggctagggaccctactc

SEQ ID NO: 613225 - DNA, 25 bp, Homo sapien
ggtcatgcccagaagtgattatagg

SEQ ID NO: 613226 - DNA, 25 bp, Homo sapien
gattataggtcaccagtctcggtct

SEQ ID NO: 613227 - DNA, 25 bp, Homo sapien
gtctcggtctccagtggtggactca

SEQ ID NO: 613228 - DNA, 25 bp, Homo sapien
agtggtggactcagaactggctgcc

SEQ ID NO: 613229 - DNA, 25 bp, Homo sapien
gaactggctgccctagagaagacct

SEQ ID NO: 613230 - DNA, 25 bp, Homo sapien
gagaagacctacaatacataccggt

SEQ ID NO: 613231 - DNA, 25 bp, Homo sapien
tcacccgggtccagttcaagctggc

SEQ ID NO: 613232 - DNA, 25 bp, Homo sapien
aagaaccatctccaatgtgccgcat

SEQ ID NO: 613233 - DNA, 25 bp, Homo sapien
cctgtactccagtgaccttggagca

SEQ ID NO: 613234 - DNA, 25 bp, Homo sapien
tgtactccagtgaccttggagcagc

SEQ ID NO: 613235 - DNA, 25 bp, Homo sapien
tactccagtgaccttggagcagcaa

SEQ ID NO: 613236 - DNA, 25 bp, Homo sapien
tccagtgaccttggagcagcaactg

SEQ ID NO: 613237 - DNA, 25 bp, Homo sapien
gtgaccttggagcagcaactggttt

SEQ ID NO: 613238 - DNA, 25 bp, Homo sapien
gaccttggagcagcaactggtttct

SEQ ID NO: 613239 - DNA, 25 bp, Homo sapien
accttggagcagcaactggtttctc

SEQ ID NO: 613240 - DNA, 25 bp, Homo sapien
ttggagcagcaactggtttctcctt

SEQ ID NO: 613241 - DNA, 25 bp, Homo sapien
gagcagcaactggtttctccttctg

SEQ ID NO: 613242 - DNA, 25 bp, Homo sapien
gcagcaactggtttctccttctggg

SEQ ID NO: 613243 - DNA, 25 bp, Homo sapien
tggtttctccttctggggatcccca

SEQ ID NO: 613244 - DNA, 25 bp, Homo sapien
gagcaagattctatctccaagatag

SEQ ID NO: 613245 - DNA, 25 bp, Homo sapien
agcaagattctatctccaagatagt

SEQ ID NO: 613246 - DNA, 25 bp, Homo sapien
aagattctatctccaagatagtttt

SEQ ID NO: 613247 - DNA, 25 bp, Homo sapien
gattctatctccaagatagtttttt

SEQ ID NO: 613248 - DNA, 25 bp, Homo sapien
aaagaggaataggatttttgtctat

SEQ ID NO: 613249 - DNA, 25 bp, Homo sapien
gaggaataggatttttgtctatttt

SEQ ID NO: 613250 - DNA, 25 bp, Homo sapien
cagtctgatctcaaacttccagtct

SEQ ID NO: 613251 - DNA, 25 bp, Homo sapien
gtctgatctcaaacttccagtctca

SEQ ID NO: 613252 - DNA, 25 bp, Homo sapien
tctgatctcaaacttccagtctcaa

SEQ ID NO: 613253 - DNA, 25 bp, Homo sapien
aacttccagtctcaagtgatcttcc

SEQ ID NO: 613254 - DNA, 25 bp, Homo sapien
tataggcctgcaccaccatgaccaa

SEQ ID NO: 613255 - DNA, 25 bp, Homo sapien
tatatagcattcttgaaagtgacaa

SEQ ID NO: 613256 - DNA, 25 bp, Homo sapien
ttgaaagtgacaaaattagcggttt

SEQ ID NO: 613257 - DNA, 25 bp, Homo sapien
actgggtgtggctgtaataaggcaa

SEQ ID NO: 613258 - DNA, 25 bp, Homo sapien
gggtgtggctgtaataaggcaacat

SEQ ID NO: 613259 - DNA, 25 bp, Homo sapien
taaggcaacatgagggacccttttg

SEQ ID NO: 613260 - DNA, 25 bp, Homo sapien
caacatgagggacccttttgatgat

SEQ ID NO: 613261 - DNA, 25 bp, Homo sapien
atatcctgggtataatattatcctg

SEQ ID NO: 613262 - DNA, 25 bp, Homo sapien
aatattatcctgtagtttggcaaga

SEQ ID NO: 613263 - DNA, 25 bp, Homo sapien
atcctgtagtttggcaagatattat

SEQ ID NO: 613264 - DNA, 25 bp, Homo sapien
gcaagatattatcattgtatagtat

SEQ ID NO: 613265 - DNA, 25 bp, Homo sapien
atttcttacaatggatgtgaatcta

SEQ ID NO: 613266 - DNA, 25 bp, Homo sapien
taaagggatgcttaagctgctgatt

SEQ ID NO: 613267 - DNA, 25 bp, Homo sapien
agggatgcttaagctgctgattgtg

SEQ ID NO: 613268 - DNA, 25 bp, Homo sapien
gattgtgaagtgaaacaactcaaga

SEQ ID NO: 613269 - DNA, 25 bp, Homo sapien
gaaacaactcaagagtatcctggat

SEQ ID NO: 613270 - DNA, 25 bp, Homo sapien
aacaactcaagagtatcctggatgt

SEQ ID NO: 613271 - DNA, 25 bp, Homo sapien
agtatcctggatgttcggataaatt

SEQ ID NO: 613272 - DNA, 25 bp, Homo sapien
cctggatgttcggataaatttacta

SEQ ID NO: 613273 - DNA, 25 bp, Homo sapien
ggatgttcggataaatttactagtt

SEQ ID NO: 613274 - DNA, 25 bp, Homo sapien
tcggataaatttactagtttttcat

SEQ ID NO: 613275 - DNA, 25 bp, Homo sapien
acattcgttttatccttataaagat

SEQ ID NO: 613276 - DNA, 25 bp, Homo sapien
cgttttatccttataaagatggaga

SEQ ID NO: 613277 - DNA, 25 bp, Homo sapien
atgtcataaaagttctgtgctatct

SEQ ID NO: 613278 - DNA, 25 bp, Homo sapien
aaaagttctgtgctatcttaagaaa

SEQ ID NO: 613279 - DNA, 25 bp, Homo sapien
gctggaagagatggtaattccatgt

SEQ ID NO: 613280 - DNA, 25 bp, Homo sapien
ttccatgtttttcaatttaaagcct

SEQ ID NO: 613281 - DNA, 25 bp, Homo sapien
tacatttttcccaagaatcagttat

SEQ ID NO: 613282 - DNA, 25 bp, Homo sapien
gaatcagttattcttcttatgttaa

SEQ ID NO: 613283 - DNA, 25 bp, Homo sapien
atatcagggttgtgttttgcattta

SEQ ID NO: 613284 - DNA, 25 bp, Homo sapien
gatgaataaccaacttcaatagtat

SEQ ID NO: 613285 - DNA, 25 bp, Homo sapien
ggaataagatacacacctcaacatg

SEQ ID NO: 613286 - DNA, 25 bp, Homo sapien
gatacacacctcaacatgtacatta

SEQ ID NO: 613287 - DNA, 25 bp, Homo sapien
acacctcaacatgtacattaaggat

SEQ ID NO: 613288 - DNA, 25 bp, Homo sapien
ttaacattttaaagcctatttgcct

SEQ ID NO: 613289 - DNA, 25 bp, Homo sapien
taaagcctatttgcctttgccgtta

SEQ ID NO: 613290 - DNA, 25 bp, Homo sapien
ctatttgcctttgccgttacccagt

SEQ ID NO: 613291 - DNA, 25 bp, Homo sapien
gcctttgccgttacccagtaacata

SEQ ID NO: 613292 - DNA, 25 bp, Homo sapien
gttacccagtaacataatatttcac

SEQ ID NO: 613293 - DNA, 25 bp, Homo sapien
atatttcactaaacccattaagatg

SEQ ID NO: 613294 - DNA, 25 bp, Homo sapien
ctaaacccattaagatgcttgaact

SEQ ID NO: 613295 - DNA, 25 bp, Homo sapien
atcattcacacattccaaaatatct

SEQ ID NO: 613296 - DNA, 25 bp, Homo sapien
acacattccaaaatatctccataat

SEQ ID NO: 613297 - DNA, 25 bp, Homo sapien
aatgcttattatgtatattctatat

SEQ ID NO: 613298 - DNA, 25 bp, Homo sapien
attaaaacaatttcttctctaatgt

SEQ ID NO: 613299 - DNA, 25 bp, Homo sapien
acagtctggactttacgtgatctat

SEQ ID NO: 613300 - DNA, 25 bp, Homo sapien
ggactttacgtgatctatgggacat

SEQ ID NO: 613301 - DNA, 25 bp, Homo sapien
gtgatctatgggacatctagaggat

SEQ ID NO: 613302 - DNA, 25 bp, Homo sapien
agagaggctgccttttctgtgtacc

SEQ ID NO: 613303 - DNA, 25 bp, Homo sapien
tgccttttctgtgtacctcttttaa

SEQ ID NO: 613304 - DNA, 25 bp, Homo sapien
tttctgtgtacctcttttaataagt

SEQ ID NO: 613305 - DNA, 25 bp, Homo sapien
taagtaaggacagcttcttagaacc

SEQ ID NO: 613306 - DNA, 25 bp, Homo sapien
tttctgaaccaatcactgacatgag

SEQ ID NO: 613307 - DNA, 25 bp, Homo sapien
gagaaatgaaacagctacttaagat

SEQ ID NO: 613308 - DNA, 25 bp, Homo sapien
atgaagatttgctctctgagtcatg

SEQ ID NO: 613309 - DNA, 25 bp, Homo sapien
gaaatgactggtggccaataaacca

SEQ ID NO: 613310 - DNA, 25 bp, Homo sapien
ttccattgcactacttttgttcctt

SEQ ID NO: 613311 - DNA, 25 bp, Homo sapien
gtgggtccctttctggactctctaa

SEQ ID NO: 613312 - DNA, 25 bp, Homo sapien
tggactctctaatctgtgctactga

SEQ ID NO: 613313 - DNA, 25 bp, Homo sapien
tctgtgctactgactgatgtgttca

SEQ ID NO: 613314 - DNA, 25 bp, Homo sapien
gatgtgttcattctttctccagtac

SEQ ID NO: 613315 - DNA, 25 bp, Homo sapien
cactgtcttgattattgcagcttta

SEQ ID NO: 613316 - DNA, 25 bp, Homo sapien
agtcagttagcattgttagcattgc

SEQ ID NO: 613317 - DNA, 25 bp, Homo sapien
gatgaatactgtcccaatgctccta

SEQ ID NO: 613318 - DNA, 25 bp, Homo sapien
atgctcctaaaactcctctgtctct

SEQ ID NO: 613319 - DNA, 25 bp, Homo sapien
gtctctctctgcctgtataaacgaa

SEQ ID NO: 613320 - DNA, 25 bp, Homo sapien
gaaatcttaacttttctacttcaga

SEQ ID NO: 613321 - DNA, 25 bp, Homo sapien
gttatatctcaggtcttatcaacct

SEQ ID NO: 613322 - DNA, 25 bp, Homo sapien
tatatctcaggtcttatcaacctca

SEQ ID NO: 613323 - DNA, 25 bp, Homo sapien
atctcaggtcttatcaacctcagct

SEQ ID NO: 613324 - DNA, 25 bp, Homo sapien
ctcaggtcttatcaacctcagctta

SEQ ID NO: 613325 - DNA, 25 bp, Homo sapien
tcaggtcttatcaacctcagcttaa

SEQ ID NO: 613326 - DNA, 25 bp, Homo sapien
caggtcttatcaacctcagcttaaa

SEQ ID NO: 613327 - DNA, 25 bp, Homo sapien
ggtcttatcaacctcagcttaaaaa

SEQ ID NO: 613328 - DNA, 25 bp, Homo sapien
gtcttatcaacctcagcttaaaaag

SEQ ID NO: 613329 - DNA, 25 bp, Homo sapien
ttatcaacctcagcttaaaaagttg

SEQ ID NO: 613330 - DNA, 25 bp, Homo sapien
taaaaagttgaagtatcggctgggc

SEQ ID NO: 613331 - DNA, 25 bp, Homo sapien
aaaagttgaagtatcggctgggcgt

SEQ ID NO: 613332 - DNA, 25 bp, Homo sapien
gctgttagattctgttctcctttga

SEQ ID NO: 613333 - DNA, 25 bp, Homo sapien
gggaaggatgtgtttctattttatg

SEQ ID NO: 613334 - DNA, 25 bp, Homo sapien
ggcagagtgctggagtgatttcccc

SEQ ID NO: 613335 - DNA, 25 bp, Homo sapien
gcaacgatggcagatttagctccag

SEQ ID NO: 613336 - DNA, 25 bp, Homo sapien
ggcagatttagctccagggcttaga

SEQ ID NO: 613337 - DNA, 25 bp, Homo sapien
ggcttagattttaggatcctccctc

SEQ ID NO: 613338 - DNA, 25 bp, Homo sapien
attttaggatcctccctctcaaata

SEQ ID NO: 613339 - DNA, 25 bp, Homo sapien
tccctctcaaataccatgatgtatc

SEQ ID NO: 613340 - DNA, 25 bp, Homo sapien
atgatgtatcatgggctttctctcc

SEQ ID NO: 613341 - DNA, 25 bp, Homo sapien
atgggctttctctccacagaaaatt

SEQ ID NO: 613342 - DNA, 25 bp, Homo sapien
acaatgaaacttacccattctccca

SEQ ID NO: 613343 - DNA, 25 bp, Homo sapien
agggctctctcaaggccatcatttc

SEQ ID NO: 613344 - DNA, 25 bp, Homo sapien
tcaaggccatcatttccgcggagtc

SEQ ID NO: 613345 - DNA, 25 bp, Homo sapien
atttccgcggagtcccatttcctga

SEQ ID NO: 613346 - DNA, 25 bp, Homo sapien
agtcccatttcctgactcaaatgac

SEQ ID NO: 613347 - DNA, 25 bp, Homo sapien
gactcaaatgacaagctctcaactt

SEQ ID NO: 613348 - DNA, 25 bp, Homo sapien
caaatgacaagctctcaactttcta

SEQ ID NO: 613349 - DNA, 25 bp, Homo sapien
ctcaactttctactcaagatcattg

SEQ ID NO: 613350 - DNA, 25 bp, Homo sapien
aagatcattgaaacatctgtgttga

SEQ ID NO: 613351 - DNA, 25 bp, Homo sapien
acatctgtgttgattatttgtaacc

SEQ ID NO: 613352 - DNA, 25 bp, Homo sapien
gattatttgtaaccgggatatgctt

SEQ ID NO: 613353 - DNA, 25 bp, Homo sapien
tgtaaccgggatatgctttatttat

SEQ ID NO: 613354 - DNA, 25 bp, Homo sapien
gggttcatgggtggatacttatctc

SEQ ID NO: 613355 - DNA, 25 bp, Homo sapien
gttcatgggtggatacttatctcca

SEQ ID NO: 613356 - DNA, 25 bp, Homo sapien
taataaatacaacagtgcttttaat

SEQ ID NO: 613357 - DNA, 25 bp, Homo sapien
atgttacagataaatcttacatgta

SEQ ID NO: 613358 - DNA, 25 bp, Homo sapien
ttaaatcacaaaacaatagaggctg

SEQ ID NO: 613359 - DNA, 25 bp, Homo sapien
cacaaaacaatagaggctgagagga

SEQ ID NO: 613360 - DNA, 25 bp, Homo sapien
gctgagaggaaattttgggcatgat

SEQ ID NO: 613361 - DNA, 25 bp, Homo sapien
ttttgggcatgatatgtttatggca

SEQ ID NO: 613362 - DNA, 25 bp, Homo sapien
gtttatggcattgtgatgggttcat

SEQ ID NO: 613363 - DNA, 25 bp, Homo sapien
ttatggcattgtgatgggttcatgg

SEQ ID NO: 613364 - DNA, 25 bp, Homo sapien
atgggttcatgggtggatacttatc

SEQ ID NO: 613365 - DNA, 25 bp, Homo sapien
cccgctgatggccaaggcaattcga

SEQ ID NO: 613366 - DNA, 25 bp, Homo sapien
ccgctgatggccaaggcaattcgag

SEQ ID NO: 613367 - DNA, 25 bp, Homo sapien
cgctgatggccaaggcaattcgaga

SEQ ID NO: 613368 - DNA, 25 bp, Homo sapien
gctgatggccaaggcaattcgagac

SEQ ID NO: 613369 - DNA, 25 bp, Homo sapien
ctgatggccaaggcaattcgagact

SEQ ID NO: 613370 - DNA, 25 bp, Homo sapien
tgatggccaaggcaattcgagacta

SEQ ID NO: 613371 - DNA, 25 bp, Homo sapien
gatggccaaggcaattcgagactac

SEQ ID NO: 613372 - DNA, 25 bp, Homo sapien
atggccaaggcaattcgagactaca

SEQ ID NO: 613373 - DNA, 25 bp, Homo sapien
tggccaaggcaattcgagactacaa

SEQ ID NO: 613374 - DNA, 25 bp, Homo sapien
ggccaaggcaattcgagactacaag

SEQ ID NO: 613375 - DNA, 25 bp, Homo sapien
gcccggctgattctacatattccaa

SEQ ID NO: 613376 - DNA, 25 bp, Homo sapien
ggctgattctacatattccaaaaaa

SEQ ID NO: 613377 - DNA, 25 bp, Homo sapien
agtttatttagtgctattatctggg

SEQ ID NO: 613378 - DNA, 25 bp, Homo sapien
tgggggaccagttatatcagcagaa

SEQ ID NO: 613379 - DNA, 25 bp, Homo sapien
tatcagcagaaaagggcgactaagc

SEQ ID NO: 613380 - DNA, 25 bp, Homo sapien
gaaaagggcgactaagctgtcatta

SEQ ID NO: 613381 - DNA, 25 bp, Homo sapien
ggcgactaagctgtcattatgactc

SEQ ID NO: 613382 - DNA, 25 bp, Homo sapien
agctgtcattatgactcaaatggtt

SEQ ID NO: 613383 - DNA, 25 bp, Homo sapien
tcctcctcctgaaaagacaacaaag

SEQ ID NO: 613384 - DNA, 25 bp, Homo sapien
aatcatattctaaagcggtttattc

SEQ ID NO: 613385 - DNA, 25 bp, Homo sapien
tttattctaaaaaccatgagtgagg

SEQ ID NO: 613386 - DNA, 25 bp, Homo sapien
ctgacgtctgtagcaagagaagtaa

SEQ ID NO: 613387 - DNA, 25 bp, Homo sapien
aagggtgtttgtttgcagggcacca

SEQ ID NO: 613388 - DNA, 25 bp, Homo sapien
gcagggcaccaagcaagtagaataa

SEQ ID NO: 613389 - DNA, 25 bp, Homo sapien
agctattgcttaaaacctgacctcc

SEQ ID NO: 613390 - DNA, 25 bp, Homo sapien
tgacctccccaatggcttacaagca

SEQ ID NO: 613391 - DNA, 25 bp, Homo sapien
ggcaaaatcatacatcaatacgtgg

SEQ ID NO: 613392 - DNA, 25 bp, Homo sapien
ggtttggtcccaaaaggcaggatat

SEQ ID NO: 613393 - DNA, 25 bp, Homo sapien
gggttgcaggattcagagattcttt

SEQ ID NO: 613394 - DNA, 25 bp, Homo sapien
gattctttgatttgcgattgtttaa

SEQ ID NO: 613395 - DNA, 25 bp, Homo sapien
ggaagcaaggctttgtctagaaact

SEQ ID NO: 613396 - DNA, 25 bp, Homo sapien
ggctttgtctagaaacttgggatca

SEQ ID NO: 613397 - DNA, 25 bp, Homo sapien
ggtggcgggagcctgtagtctcagt

SEQ ID NO: 613398 - DNA, 25 bp, Homo sapien
gtggcgggagcctgtagtctcagtt

SEQ ID NO: 613399 - DNA, 25 bp, Homo sapien
tggcgggagcctgtagtctcagtta

SEQ ID NO: 613400 - DNA, 25 bp, Homo sapien
ggcgggagcctgtagtctcagttac

SEQ ID NO: 613401 - DNA, 25 bp, Homo sapien
gcgggagcctgtagtctcagttact

SEQ ID NO: 613402 - DNA, 25 bp, Homo sapien
cgggagcctgtagtctcagttactc

SEQ ID NO: 613403 - DNA, 25 bp, Homo sapien
gggagcctgtagtctcagttactca

SEQ ID NO: 613404 - DNA, 25 bp, Homo sapien
ggagcctgtagtctcagttactcag

SEQ ID NO: 613405 - DNA, 25 bp, Homo sapien
atgaataccttctgctgtgtctagc

SEQ ID NO: 613406 - DNA, 25 bp, Homo sapien
tgaataccttctgctgtgtctagct

SEQ ID NO: 613407 - DNA, 25 bp, Homo sapien
accttctgctgtgtctagctatatc

SEQ ID NO: 613408 - DNA, 25 bp, Homo sapien
ttctgctgtgtctagctatatcgca

SEQ ID NO: 613409 - DNA, 25 bp, Homo sapien
ctgctgtgtctagctatatcgcatc

SEQ ID NO: 613410 - DNA, 25 bp, Homo sapien
gctgtgtctagctatatcgcatctt

SEQ ID NO: 613411 - DNA, 25 bp, Homo sapien
gtgtctagctatatcgcatcttaac

SEQ ID NO: 613412 - DNA, 25 bp, Homo sapien
gtctagctatatcgcatcttaacac

SEQ ID NO: 613413 - DNA, 25 bp, Homo sapien
tagctatatcgcatcttaacactat

SEQ ID NO: 613414 - DNA, 25 bp, Homo sapien
gctatatcgcatcttaacactattt

SEQ ID NO: 613415 - DNA, 25 bp, Homo sapien
atcgcatcttaacactattttatta

SEQ ID NO: 613416 - DNA, 25 bp, Homo sapien
aaaaaaggacaaaattagctggatg

SEQ ID NO: 613417 - DNA, 25 bp, Homo sapien
gagcctagattacgccattgtactt

SEQ ID NO: 613418 - DNA, 25 bp, Homo sapien
agcctagattacgccattgtacttc

SEQ ID NO: 613419 - DNA, 25 bp, Homo sapien
gcctagattacgccattgtacttca

SEQ ID NO: 613420 - DNA, 25 bp, Homo sapien
cctagattacgccattgtacttcag

SEQ ID NO: 613421 - DNA, 25 bp, Homo sapien
ctagattacgccattgtacttcagt

SEQ ID NO: 613422 - DNA, 25 bp, Homo sapien
tagattacgccattgtacttcagtc

SEQ ID NO: 613423 - DNA, 25 bp, Homo sapien
agattacgccattgtacttcagtct

SEQ ID NO: 613424 - DNA, 25 bp, Homo sapien
gattacgccattgtacttcagtctg

SEQ ID NO: 613425 - DNA, 25 bp, Homo sapien
attacgccattgtacttcagtctgg

SEQ ID NO: 613426 - DNA, 25 bp, Homo sapien
gtacttcagtctgggcaacgagcga

SEQ ID NO: 613427 - DNA, 25 bp, Homo sapien
agaggctgaggagtccccacactct

SEQ ID NO: 613428 - DNA, 25 bp, Homo sapien
gagtccccacactctgtgtgtgagt

SEQ ID NO: 613429 - DNA, 25 bp, Homo sapien
attcactgctgaagcccctgaaatg

SEQ ID NO: 613430 - DNA, 25 bp, Homo sapien
gcaaaagtttcagtcctgagtgatg

SEQ ID NO: 613431 - DNA, 25 bp, Homo sapien
gaatgtcttgaacaagcagggcccc

SEQ ID NO: 613432 - DNA, 25 bp, Homo sapien
ttccctaagaagcatcctgtccttg

SEQ ID NO: 613433 - DNA, 25 bp, Homo sapien
atcctctctttcagtccgagtccag

SEQ ID NO: 613434 - DNA, 25 bp, Homo sapien
ctttcagtccgagtccagctgtgtg

SEQ ID NO: 613435 - DNA, 25 bp, Homo sapien
catgggtaacctgcttttcctgtct

SEQ ID NO: 613436 - DNA, 25 bp, Homo sapien
tttcctgtctgatgctcaggtttcc

SEQ ID NO: 613437 - DNA, 25 bp, Homo sapien
tgtctgatgctcaggtttcccacct

SEQ ID NO: 613438 - DNA, 25 bp, Homo sapien
ggtattatgttcagtgatcttggca

SEQ ID NO: 613439 - DNA, 25 bp, Homo sapien
gttcagtgatcttggcaaatcctct

SEQ ID NO: 613440 - DNA, 25 bp, Homo sapien
cagtgatcttggcaaatcctcttat

SEQ ID NO: 613441 - DNA, 25 bp, Homo sapien
gtgatcttggcaaatcctcttattc

SEQ ID NO: 613442 - DNA, 25 bp, Homo sapien
ttcttgttttttcatgcacacattt

SEQ ID NO: 613443 - DNA, 25 bp, Homo sapien
ttgttttttcatgcacacatttgta

SEQ ID NO: 613444 - DNA, 25 bp, Homo sapien
tttctagtccttacacctttggctt

SEQ ID NO: 613445 - DNA, 25 bp, Homo sapien
tctagtccttacacctttggctttc

SEQ ID NO: 613446 - DNA, 25 bp, Homo sapien
aagtggttatagaggcatctttgtt

SEQ ID NO: 613447 - DNA, 25 bp, Homo sapien
ggttatagaggcatctttgttttgt

SEQ ID NO: 613448 - DNA, 25 bp, Homo sapien
gttttgtttatcatctcagagtaaa

SEQ ID NO: 613449 - DNA, 25 bp, Homo sapien
ggtattatgttcagtgatcttggca

SEQ ID NO: 613450 - DNA, 25 bp, Homo sapien
gttcagtgatcttggcaaatcctct

SEQ ID NO: 613451 - DNA, 25 bp, Homo sapien
gtgatcttggcaaatcctcttattc

SEQ ID NO: 613452 - DNA, 25 bp, Homo sapien
tcttgttttttcatgcacacatttg

SEQ ID NO: 613453 - DNA, 25 bp, Homo sapien
tttctagtccttacacctttggctt

SEQ ID NO: 613454 - DNA, 25 bp, Homo sapien
tctagtccttacacctttggctttc

SEQ ID NO: 613455 - DNA, 25 bp, Homo sapien
ttggctttccttactgcattgttaa

SEQ ID NO: 613456 - DNA, 25 bp, Homo sapien
aagtggttatagaggcatctttgtt

SEQ ID NO: 613457 - DNA, 25 bp, Homo sapien
ggttatagaggcatctttgttttgt

SEQ ID NO: 613458 - DNA, 25 bp, Homo sapien
gttttgtttatcatctcagagtaaa

SEQ ID NO: 613459 - DNA, 25 bp, Homo sapien
gtaaaggactgcaatgtttcactat

SEQ ID NO: 613460 - DNA, 25 bp, Homo sapien
caccaccaaaggagtttccaagttg

SEQ ID NO: 613461 - DNA, 25 bp, Homo sapien
tccaagttgggcaccactgagtgaa

SEQ ID NO: 613462 - DNA, 25 bp, Homo sapien
accactgagtgaagtgccacagacc

SEQ ID NO: 613463 - DNA, 25 bp, Homo sapien
cattcaaaggtttactgctttcttc

SEQ ID NO: 613464 - DNA, 25 bp, Homo sapien
cctggatgtctctgaggaaatgtac

SEQ ID NO: 613465 - DNA, 25 bp, Homo sapien
gtacaatcgtgtcatctggtggcta

SEQ ID NO: 613466 - DNA, 25 bp, Homo sapien
gtgtcatctggtggctaaaaggtct

SEQ ID NO: 613467 - DNA, 25 bp, Homo sapien
taaaaggtctgtgcttttccctcct

SEQ ID NO: 613468 - DNA, 25 bp, Homo sapien
ggagtggcatctatgtatctacaga

SEQ ID NO: 613469 - DNA, 25 bp, Homo sapien
tacagagctgggtcgtttaggagat

SEQ ID NO: 613470 - DNA, 25 bp, Homo sapien
gagataaatgctgggattttgacct

SEQ ID NO: 613471 - DNA, 25 bp, Homo sapien
actcccactggtcgatcaatcagct

SEQ ID NO: 613472 - DNA, 25 bp, Homo sapien
tggtcgatcaatcagctcatgcatc

SEQ ID NO: 613473 - DNA, 25 bp, Homo sapien
gatcaatcagctcatgcatcgtcgt

SEQ ID NO: 613474 - DNA, 25 bp, Homo sapien
agctcatgcatcgtcgtccatggat

SEQ ID NO: 613475 - DNA, 25 bp, Homo sapien
atcgtcgtccatggatccatcatta

SEQ ID NO: 613476 - DNA, 25 bp, Homo sapien
tggatccatcattaatcaatcaatc

SEQ ID NO: 613477 - DNA, 25 bp, Homo sapien
tataattatttgttcagtcgggtta

SEQ ID NO: 613478 - DNA, 25 bp, Homo sapien
actggctaaggctgggttcctggtc

SEQ ID NO: 613479 - DNA, 25 bp, Homo sapien
ttcctggtctggtccggtggcaaaa

SEQ ID NO: 613480 - DNA, 25 bp, Homo sapien
ggtctggtccggtggcaaaaaatcg

SEQ ID NO: 613481 - DNA, 25 bp, Homo sapien
gggaaaatgacggcaactctcgtgg

SEQ ID NO: 613482 - DNA, 25 bp, Homo sapien
ttgaaactgcaaaacctctacctgt

SEQ ID NO: 613483 - DNA, 25 bp, Homo sapien
tgaaactgcaaaacctctacctgtt

SEQ ID NO: 613484 - DNA, 25 bp, Homo sapien
gaaactgcaaaacctctacctgttt

SEQ ID NO: 613485 - DNA, 25 bp, Homo sapien
aaatgagatcttttgaccaggcaca

SEQ ID NO: 613486 - DNA, 25 bp, Homo sapien
aatgagatcttttgaccaggcacag

SEQ ID NO: 613487 - DNA, 25 bp, Homo sapien
atgagatcttttgaccaggcacagt

SEQ ID NO: 613488 - DNA, 25 bp, Homo sapien
tgagatcttttgaccaggcacagtg

SEQ ID NO: 613489 - DNA, 25 bp, Homo sapien
gagatcttttgaccaggcacagtgg

SEQ ID NO: 613490 - DNA, 25 bp, Homo sapien
atcgcttaaacttgggaggttgcag

SEQ ID NO: 613491 - DNA, 25 bp, Homo sapien
tcgcttaaacttgggaggttgcagt

SEQ ID NO: 613492 - DNA, 25 bp, Homo sapien
cgcttaaacttgggaggttgcagtg

SEQ ID NO: 613493 - DNA, 25 bp, Homo sapien
atcgagctcatccagtgcaatgctt

SEQ ID NO: 613494 - DNA, 25 bp, Homo sapien
agtgcaatgcttctcagcttgtgcc

SEQ ID NO: 613495 - DNA, 25 bp, Homo sapien
gtgcccactttggattcacttggaa

SEQ ID NO: 613496 - DNA, 25 bp, Homo sapien
tgggccccattccagaccagttaaa

SEQ ID NO: 613497 - DNA, 25 bp, Homo sapien
gttaaatcatactatctgggagaga

SEQ ID NO: 613498 - DNA, 25 bp, Homo sapien
gtggtatgttttaacacctccttag

SEQ ID NO: 613499 - DNA, 25 bp, Homo sapien
acctccttagggattctgctgatca

SEQ ID NO: 613500 - DNA, 25 bp, Homo sapien
tagggattctgctgatcaaccaagg

SEQ ID NO: 613501 - DNA, 25 bp, Homo sapien
gaatcaaactagactcattttacat

SEQ ID NO: 613502 - DNA, 25 bp, Homo sapien
aaatgttgcccaagtcacgtagcta

SEQ ID NO: 613503 - DNA, 25 bp, Homo sapien
gcccaagtcacgtagctagtgtcaa

SEQ ID NO: 613504 - DNA, 25 bp, Homo sapien
cctcctcagattttagggctgaggg

SEQ ID NO: 613505 - DNA, 25 bp, Homo sapien
gcttgcccttcacggcacggttgga

SEQ ID NO: 613506 - DNA, 25 bp, Homo sapien
cccaggaaatgtccctagggttcat

SEQ ID NO: 613507 - DNA, 25 bp, Homo sapien
gtccctagggttcatttgagggctt

SEQ ID NO: 613508 - DNA, 25 bp, Homo sapien
gggttcatttgagggcttttagtat

SEQ ID NO: 613509 - DNA, 25 bp, Homo sapien
gggcttttagtattaatttctcatt

SEQ ID NO: 613510 - DNA, 25 bp, Homo sapien
ttaatttctcattcactgtctaaag

SEQ ID NO: 613511 - DNA, 25 bp, Homo sapien
tctcattcactgtctaaagaagtta

SEQ ID NO: 613512 - DNA, 25 bp, Homo sapien
gaagatgaagtttattgcagttttg

SEQ ID NO: 613513 - DNA, 25 bp, Homo sapien
gcattggtttaaaggtacattacag

SEQ ID NO: 613514 - DNA, 25 bp, Homo sapien
tacagtatatagatggtttcgaaaa

SEQ ID NO: 613515 - DNA, 25 bp, Homo sapien
gggaggacgagtcgggtgaatcacc

SEQ ID NO: 613516 - DNA, 25 bp, Homo sapien
ggaggacgagtcgggtgaatcacct

SEQ ID NO: 613517 - DNA, 25 bp, Homo sapien
gaggacgagtcgggtgaatcacctg

SEQ ID NO: 613518 - DNA, 25 bp, Homo sapien
aggacgagtcgggtgaatcacctga

SEQ ID NO: 613519 - DNA, 25 bp, Homo sapien
ggacgagtcgggtgaatcacctgag

SEQ ID NO: 613520 - DNA, 25 bp, Homo sapien
ttagccgaacgtggtggcaggtgcc

SEQ ID NO: 613521 - DNA, 25 bp, Homo sapien
tagccgaacgtggtggcaggtgcct

SEQ ID NO: 613522 - DNA, 25 bp, Homo sapien
agccgaacgtggtggcaggtgccta

SEQ ID NO: 613523 - DNA, 25 bp, Homo sapien
acagtgttgagaggtgggctcttac

SEQ ID NO: 613524 - DNA, 25 bp, Homo sapien
ggctcttacgaggtgataaggtcat

SEQ ID NO: 613525 - DNA, 25 bp, Homo sapien
tctgcccccaatggattaatgccaa

SEQ ID NO: 613526 - DNA, 25 bp, Homo sapien
ccccaatggattaatgccaacagag

SEQ ID NO: 613527 - DNA, 25 bp, Homo sapien
atgccaacagaggtgggtttgttat

SEQ ID NO: 613528 - DNA, 25 bp, Homo sapien
gtttgttattgtgggaatgtgtcct

SEQ ID NO: 613529 - DNA, 25 bp, Homo sapien
attgtgggaatgtgtccttgtgaag

SEQ ID NO: 613530 - DNA, 25 bp, Homo sapien
cttgtgaaggaggagctcggtcccc

SEQ ID NO: 613531 - DNA, 25 bp, Homo sapien
tgaaggaggagctcggtcccccttt

SEQ ID NO: 613532 - DNA, 25 bp, Homo sapien
gaaggcccttgaaagatgctggcac

SEQ ID NO: 613533 - DNA, 25 bp, Homo sapien
aggcccttgaaagatgctggcacct

SEQ ID NO: 613534 - DNA, 25 bp, Homo sapien
taggcaggagaaggatgtcatcaaa

SEQ ID NO: 613535 - DNA, 25 bp, Homo sapien
gacaggatgtcatttttgagctaat

SEQ ID NO: 613536 - DNA, 25 bp, Homo sapien
agagatgcatcacatccagaccctg

SEQ ID NO: 613537 - DNA, 25 bp, Homo sapien
gttcatcatgtctgagatcttcagg

SEQ ID NO: 613538 - DNA, 25 bp, Homo sapien
agctggaccacagcaccgtggataa

SEQ ID NO: 613539 - DNA, 25 bp, Homo sapien
attttcccctgtttagatgagttgc

SEQ ID NO: 613540 - DNA, 25 bp, Homo sapien
gatgagttgcttgaaatccacaggc

SEQ ID NO: 613541 - DNA, 25 bp, Homo sapien
atccacaggcatttcttctacagta

SEQ ID NO: 613542 - DNA, 25 bp, Homo sapien
gcaggaatcctgtgctggcagcgac

SEQ ID NO: 613543 - DNA, 25 bp, Homo sapien
gtgctggcagcgacaggaattttgt

SEQ ID NO: 613544 - DNA, 25 bp, Homo sapien
gaattttgtgatcgaccgaattgga

SEQ ID NO: 613545 - DNA, 25 bp, Homo sapien
gacaacgaggataatgaagtccctg

SEQ ID NO: 613546 - DNA, 25 bp, Homo sapien
tgaagtccctgaggttaccagaagt

SEQ ID NO: 613547 - DNA, 25 bp, Homo sapien
tgaggttaccagaagtcgcagtcca

SEQ ID NO: 613548 - DNA, 25 bp, Homo sapien
gttaccagaagtcgcagtccaggcc

SEQ ID NO: 613549 - DNA, 25 bp, Homo sapien
aagtggatgggacacccaccatgtc

SEQ ID NO: 613550 - DNA, 25 bp, Homo sapien
aggacgctgattccacctcctaaaa

SEQ ID NO: 613551 - DNA, 25 bp, Homo sapien
taaaacctgcctacttcaggacttt

SEQ ID NO: 613552 - DNA, 25 bp, Homo sapien
gcctacttcaggactttaagactca

SEQ ID NO: 613553 - DNA, 25 bp, Homo sapien
ttaagactcacagtcttcagcctgt

SEQ ID NO: 613554 - DNA, 25 bp, Homo sapien
atgtcttcatgttgagttttatagc

SEQ ID NO: 613555 - DNA, 25 bp, Homo sapien
gttttatagcatgactgttgacctt

SEQ ID NO: 613556 - DNA, 25 bp, Homo sapien
atgatctgtttcaactctgtggcca

SEQ ID NO: 613557 - DNA, 25 bp, Homo sapien
ggccaagacgccttatgatgcttcc

SEQ ID NO: 613558 - DNA, 25 bp, Homo sapien
agacgccttatgatgcttccaggag

SEQ ID NO: 613559 - DNA, 25 bp, Homo sapien
cttatgatgcttccaggaggcaaga

SEQ ID NO: 613560 - DNA, 25 bp, Homo sapien
gagaagtctgcaggagccgctgacc

SEQ ID NO: 613561 - DNA, 25 bp, Homo sapien
ccgctgaccccggaaatggagagat

SEQ ID NO: 613562 - DNA, 25 bp, Homo sapien
ctgaccccggaaatggagagatgga

SEQ ID NO: 613563 - DNA, 25 bp, Homo sapien
ggcggcagcagcaaccggcacgcgg

SEQ ID NO: 613564 - DNA, 25 bp, Homo sapien
caaaacccgaaaacaggctgccaag

SEQ ID NO: 613565 - DNA, 25 bp, Homo sapien
gccaaggcaattcgagactacaagg

SEQ ID NO: 613566 - DNA, 25 bp, Homo sapien
ctacaagggaagattctcccgacga

SEQ ID NO: 613567 - DNA, 25 bp, Homo sapien
tatgttttgtcccttctataaacta

SEQ ID NO: 613568 - DNA, 25 bp, Homo sapien
aatatactcccattgctaattaagc

SEQ ID NO: 613569 - DNA, 25 bp, Homo sapien
tgctaattaagctattccctcatcc

SEQ ID NO: 613570 - DNA, 25 bp, Homo sapien
atccctccagtttagacagtcttct

SEQ ID NO: 613571 - DNA, 25 bp, Homo sapien
agacagtcttctcactttatttaat

SEQ ID NO: 613572 - DNA, 25 bp, Homo sapien
tttatttaatcccaatccatctcca

SEQ ID NO: 613573 - DNA, 25 bp, Homo sapien
atggccgcttcaacaccagtatatc

SEQ ID NO: 613574 - DNA, 25 bp, Homo sapien
tgatctcctttcatattgcaggcag

SEQ ID NO: 613575 - DNA, 25 bp, Homo sapien
ttcagtcatggctgtgtggttgaat

SEQ ID NO: 613576 - DNA, 25 bp, Homo sapien
atgtgctggttctgttagcactgca

SEQ ID NO: 613577 - DNA, 25 bp, Homo sapien
tagcactgcagcatctttttaggtt

SEQ ID NO: 613578 - DNA, 25 bp, Homo sapien
acacgaaaatgtagtcatctatcaa

SEQ ID NO: 613579 - DNA, 25 bp, Homo sapien
gtagtcatctatcaagacagcctgt

SEQ ID NO: 613580 - DNA, 25 bp, Homo sapien
gtcatctatcaagacagcctgtgtc

SEQ ID NO: 613581 - DNA, 25 bp, Homo sapien
tcaagacagcctgtgtctcactctg

SEQ ID NO: 613582 - DNA, 25 bp, Homo sapien
aagtactgagctatctttaataata

SEQ ID NO: 613583 - DNA, 25 bp, Homo sapien
taaaaagcacacatagtcttgacaa

SEQ ID NO: 613584 - DNA, 25 bp, Homo sapien
gcacacatagtcttgacaaatgtat

SEQ ID NO: 613585 - DNA, 25 bp, Homo sapien
aaattctctgttggaatttgcctac

SEQ ID NO: 613586 - DNA, 25 bp, Homo sapien
tggaatttgcctacttacctataaa

SEQ ID NO: 613587 - DNA, 25 bp, Homo sapien
gcctacttacctataaacagctcac

SEQ ID NO: 613588 - DNA, 25 bp, Homo sapien
tacctataaacagctcactacactt

SEQ ID NO: 613589 - DNA, 25 bp, Homo sapien
gcatattactaaagacttagactcc

SEQ ID NO: 613590 - DNA, 25 bp, Homo sapien
gacttagactcctaagactttccgt

SEQ ID NO: 613591 - DNA, 25 bp, Homo sapien
ttagactcctaagactttccgtaag

SEQ ID NO: 613592 - DNA, 25 bp, Homo sapien
tagactcctaagactttccgtaagg

SEQ ID NO: 613593 - DNA, 25 bp, Homo sapien
ttccgtaagggaaactagatgtgct

SEQ ID NO: 613594 - DNA, 25 bp, Homo sapien
ctagatgtgctttgtagtgcagtcc

SEQ ID NO: 613595 - DNA, 25 bp, Homo sapien
gatgtgctttgtagtgcagtcctaa

SEQ ID NO: 613596 - DNA, 25 bp, Homo sapien
gtgctttgtagtgcagtcctaattt

SEQ ID NO: 613597 - DNA, 25 bp, Homo sapien
gctttgtagtgcagtcctaattttt

SEQ ID NO: 613598 - DNA, 25 bp, Homo sapien
ttgtagtgcagtcctaatttttaaa

SEQ ID NO: 613599 - DNA, 25 bp, Homo sapien
aactttggatggctcaggcggaagg

SEQ ID NO: 613600 - DNA, 25 bp, Homo sapien
acctcaccccagcacttcctatggg

SEQ ID NO: 613601 - DNA, 25 bp, Homo sapien
acttcctatgggactcacgcctttg

SEQ ID NO: 613602 - DNA, 25 bp, Homo sapien
cttcctatgggactcacgcctttgt

SEQ ID NO: 613603 - DNA, 25 bp, Homo sapien
ctatgggactcacgcctttgtctcg

SEQ ID NO: 613604 - DNA, 25 bp, Homo sapien
tgggactcacgcctttgtctcgggc

SEQ ID NO: 613605 - DNA, 25 bp, Homo sapien
gggactcacgcctttgtctcgggct

SEQ ID NO: 613606 - DNA, 25 bp, Homo sapien
ggactcacgcctttgtctcgggctt

SEQ ID NO: 613607 - DNA, 25 bp, Homo sapien
gactcacgcctttgtctcgggcttt

SEQ ID NO: 613608 - DNA, 25 bp, Homo sapien
actcacgcctttgtctcgggctttt

SEQ ID NO: 613609 - DNA, 25 bp, Homo sapien
tcacgcctttgtctcgggcttttgg

SEQ ID NO: 613610 - DNA, 25 bp, Homo sapien
cacgcctttgtctcgggcttttggt

SEQ ID NO: 613611 - DNA, 25 bp, Homo sapien
agaagggtcggctctctgcattggg

SEQ ID NO: 613612 - DNA, 25 bp, Homo sapien
gatgaaatcgacttgcctttgtgaa

SEQ ID NO: 613613 - DNA, 25 bp, Homo sapien
tgcctttgtgaaattgaccagcccc

SEQ ID NO: 613614 - DNA, 25 bp, Homo sapien
tgaccagccccctctataaaactta

SEQ ID NO: 613615 - DNA, 25 bp, Homo sapien
tataaaacttacagtcccccattgg

SEQ ID NO: 613616 - DNA, 25 bp, Homo sapien
cttctctgcctaattgcaaactgaa

SEQ ID NO: 613617 - DNA, 25 bp, Homo sapien
taattgcaaactgaactaccctctc

SEQ ID NO: 613618 - DNA, 25 bp, Homo sapien
taccctctcccttgactgttaagag

SEQ ID NO: 613619 - DNA, 25 bp, Homo sapien
ccttgactgttaagagggccggagt

SEQ ID NO: 613620 - DNA, 25 bp, Homo sapien
agggccggagttaccgcctcgattg

SEQ ID NO: 613621 - DNA, 25 bp, Homo sapien
ccaataaagcctcttctttcagggc

SEQ ID NO: 613622 - DNA, 25 bp, Homo sapien
ggttatattcaaacactatgccttt

SEQ ID NO: 613623 - DNA, 25 bp, Homo sapien
tattcaaacactatgcctttttatg

SEQ ID NO: 613624 - DNA, 25 bp, Homo sapien
atgcctttttatgtgagggacctct

SEQ ID NO: 613625 - DNA, 25 bp, Homo sapien
gtgagggacctcttgagcatcagat

SEQ ID NO: 613626 - DNA, 25 bp, Homo sapien
agcatcagatgattttggtatccac

SEQ ID NO: 613627 - DNA, 25 bp, Homo sapien
caagggatgactgtagtgcatttta

SEQ ID NO: 613628 - DNA, 25 bp, Homo sapien
tgactgtagtgcattttatctattt

SEQ ID NO: 613629 - DNA, 25 bp, Homo sapien
atccaatgccaagcattttccctat

SEQ ID NO: 613630 - DNA, 25 bp, Homo sapien
atgccaagcattttccctatgcttt

SEQ ID NO: 613631 - DNA, 25 bp, Homo sapien
cattttccctatgctttattctaag

SEQ ID NO: 613632 - DNA, 25 bp, Homo sapien
ctatgctttattctaagagggtacc

SEQ ID NO: 613633 - DNA, 25 bp, Homo sapien
acagtgttgagaggtgggctcttac

SEQ ID NO: 613634 - DNA, 25 bp, Homo sapien
ggctcttacgaggtgataaggtcat

SEQ ID NO: 613635 - DNA, 25 bp, Homo sapien
ccccaatggattaatgccaacagag

SEQ ID NO: 613636 - DNA, 25 bp, Homo sapien
atgccaacagaggtgggtttgttat

SEQ ID NO: 613637 - DNA, 25 bp, Homo sapien
gtttgttattgtgggaatgtgtcct

SEQ ID NO: 613638 - DNA, 25 bp, Homo sapien
attgtgggaatgtgtccttgtgaag

SEQ ID NO: 613639 - DNA, 25 bp, Homo sapien
cttgtgaaggaggagctcggtcccc

SEQ ID NO: 613640 - DNA, 25 bp, Homo sapien
ctctagccttctgccatggaataat

SEQ ID NO: 613641 - DNA, 25 bp, Homo sapien
gaaggcccttgaaagatgctggcac

SEQ ID NO: 613642 - DNA, 25 bp, Homo sapien
aggcccttgaaagatgctggcacct

SEQ ID NO: 613643 - DNA, 25 bp, Homo sapien
tctcagcttccagaattttgagaaa

SEQ ID NO: 613644 - DNA, 25 bp, Homo sapien
atagaggaaagtcacgtccctgcct

SEQ ID NO: 613645 - DNA, 25 bp, Homo sapien
tgccttcaagggtctcgcagacagg

SEQ ID NO: 613646 - DNA, 25 bp, Homo sapien
gccttcaagggtctcgcagacaggt

SEQ ID NO: 613647 - DNA, 25 bp, Homo sapien
ccttcaagggtctcgcagacaggtg

SEQ ID NO: 613648 - DNA, 25 bp, Homo sapien
atggtgaactgtgggtacctagaac

SEQ ID NO: 613649 - DNA, 25 bp, Homo sapien
cagcagaagttcactcaagctacag

SEQ ID NO: 613650 - DNA, 25 bp, Homo sapien
gcagaagttcactcaagctacagaa

SEQ ID NO: 613651 - DNA, 25 bp, Homo sapien
agaagttcactcaagctacagaaat

SEQ ID NO: 613652 - DNA, 25 bp, Homo sapien
agtattgctggaggccgggagttcg

SEQ ID NO: 613653 - DNA, 25 bp, Homo sapien
tggccaatgtagtaacacccccgtc

SEQ ID NO: 613654 - DNA, 25 bp, Homo sapien
caatgtagtaacacccccgtctcta

SEQ ID NO: 613655 - DNA, 25 bp, Homo sapien
gggtggccgcggtggaaatgtagga

SEQ ID NO: 613656 - DNA, 25 bp, Homo sapien
aagcgcaaagctgatgggtacaacc

SEQ ID NO: 613657 - DNA, 25 bp, Homo sapien
gcgcaaagctgatgggtacaaccag

SEQ ID NO: 613658 - DNA, 25 bp, Homo sapien
cagccagattccaagcggcgccaga

SEQ ID NO: 613659 - DNA, 25 bp, Homo sapien
aagcggcgccagaccaataatcaga

SEQ ID NO: 613660 - DNA, 25 bp, Homo sapien
cggcgccagaccaataatcagaact

SEQ ID NO: 613661 - DNA, 25 bp, Homo sapien
attgctcagcaaccgctccaaggtg

SEQ ID NO: 613662 - DNA, 25 bp, Homo sapien
tcagcaaccgctccaaggtggtgat

SEQ ID NO: 613663 - DNA, 25 bp, Homo sapien
gcaaccgctccaaggtggtgatcat

SEQ ID NO: 613664 - DNA, 25 bp, Homo sapien
accgctccaaggtggtgatcattct

SEQ ID NO: 613665 - DNA, 25 bp, Homo sapien
cgctccaaggtggtgatcattctgg

SEQ ID NO: 613666 - DNA, 25 bp, Homo sapien
atgcaagaaatgtgattaccccaag

SEQ ID NO: 613667 - DNA, 25 bp, Homo sapien
attaccccaagattactgcactgtg

SEQ ID NO: 613668 - DNA, 25 bp, Homo sapien
agcccaagccaagtggaaaggctct

SEQ ID NO: 613669 - DNA, 25 bp, Homo sapien
gctctggacggtgagttgccatgca

SEQ ID NO: 613670 - DNA, 25 bp, Homo sapien
gaggcaggccaaggaaaaccatagc

SEQ ID NO: 613671 - DNA, 25 bp, Homo sapien
gaaaaccatagcacctgacagtgaa

SEQ ID NO: 613672 - DNA, 25 bp, Homo sapien
tgcctcagctgacaccatagggata

SEQ ID NO: 613673 - DNA, 25 bp, Homo sapien
ggataaaagacaaaccacccagtca

SEQ ID NO: 613674 - DNA, 25 bp, Homo sapien
cagtcaagctattcctgagttcctt

SEQ ID NO: 613675 - DNA, 25 bp, Homo sapien
tgagttccttacctccaaaaccatg

SEQ ID NO: 613676 - DNA, 25 bp, Homo sapien
acagggttgaagtgtgatcacatgc

SEQ ID NO: 613677 - DNA, 25 bp, Homo sapien
gggccatgagccaggttcacacatt

SEQ ID NO: 613678 - DNA, 25 bp, Homo sapien
ttcacacattcttacgaccatcctt

SEQ ID NO: 613679 - DNA, 25 bp, Homo sapien
ttacgaccatccttcctagagtggg

SEQ ID NO: 613680 - DNA, 25 bp, Homo sapien
gccaatcctgtgggtctttttcctt

SEQ ID NO: 613681 - DNA, 25 bp, Homo sapien
gggccagtgccctaatggaagccta

SEQ ID NO: 613682 - DNA, 25 bp, Homo sapien
gccctaatggaagcctaagaagcat

SEQ ID NO: 613683 - DNA, 25 bp, Homo sapien
ctaagaagcataatgagggtgacat

SEQ ID NO: 613684 - DNA, 25 bp, Homo sapien
agggtgacattagccctcctagaca

SEQ ID NO: 613685 - DNA, 25 bp, Homo sapien
tgacattagccctcctagacagaaa

SEQ ID NO: 613686 - DNA, 25 bp, Homo sapien
tcctagacagaaagcgtattataaa

SEQ ID NO: 613687 - DNA, 25 bp, Homo sapien
gaaagcgtattataaagctacaata

SEQ ID NO: 613688 - DNA, 25 bp, Homo sapien
tttcctcactgttccaaatcccaca

SEQ ID NO: 613689 - DNA, 25 bp, Homo sapien
ttcctcactgttccaaatcccacag

SEQ ID NO: 613690 - DNA, 25 bp, Homo sapien
tcctcactgttccaaatcccacagc

SEQ ID NO: 613691 - DNA, 25 bp, Homo sapien
ttcttcctttttgagcaggatggga

SEQ ID NO: 613692 - DNA, 25 bp, Homo sapien
tcttcctttttgagcaggatgggat

SEQ ID NO: 613693 - DNA, 25 bp, Homo sapien
cttcctttttgagcaggatgggatt

SEQ ID NO: 613694 - DNA, 25 bp, Homo sapien
ttcctttttgagcaggatgggatta

SEQ ID NO: 613695 - DNA, 25 bp, Homo sapien
tcctttttgagcaggatgggattac

SEQ ID NO: 613696 - DNA, 25 bp, Homo sapien
cctttttgagcaggatgggattaca

SEQ ID NO: 613697 - DNA, 25 bp, Homo sapien
ctttttgagcaggatgggattacag

SEQ ID NO: 613698 - DNA, 25 bp, Homo sapien
ttttcctcctctgaagaaatttagg

SEQ ID NO: 613699 - DNA, 25 bp, Homo sapien
tcctcctctgaagaaatttaggatt

SEQ ID NO: 613700 - DNA, 25 bp, Homo sapien
ttaggatttttctcttaaagcaaat

SEQ ID NO: 613701 - DNA, 25 bp, Homo sapien
ggatttttctcttaaagcaaatact

SEQ ID NO: 613702 - DNA, 25 bp, Homo sapien
attaactttattgttgcttttatca

SEQ ID NO: 613703 - DNA, 25 bp, Homo sapien
gcttttatcaaagagtatgtaatct

SEQ ID NO: 613704 - DNA, 25 bp, Homo sapien
atgtaatctatactaacttgttggg

SEQ ID NO: 613705 - DNA, 25 bp, Homo sapien
ctaacttgttgggaaattctgccaa

SEQ ID NO: 613706 - DNA, 25 bp, Homo sapien
acttgttgggaaattctgccaatga

SEQ ID NO: 613707 - DNA, 25 bp, Homo sapien
attctgccaatgaacaactttttta

SEQ ID NO: 613708 - DNA, 25 bp, Homo sapien
ttctgccaatgaacaacttttttat

SEQ ID NO: 613709 - DNA, 25 bp, Homo sapien
atccatgttttcgtggattagtatt

SEQ ID NO: 613710 - DNA, 25 bp, Homo sapien
ttcgtggattagtatttttgcagct

SEQ ID NO: 613711 - DNA, 25 bp, Homo sapien
acgataggattgttagatgcaaata

SEQ ID NO: 613712 - DNA, 25 bp, Homo sapien
gtaactctccctaaaatgtttgtga

SEQ ID NO: 613713 - DNA, 25 bp, Homo sapien
cctaaaatgtttgtgagagcttgta

SEQ ID NO: 613714 - DNA, 25 bp, Homo sapien
tgtgagagcttgtaaaatgttgttc

SEQ ID NO: 613715 - DNA, 25 bp, Homo sapien
atcctttccagagacatacaaattg

SEQ ID NO: 613716 - DNA, 25 bp, Homo sapien
gagacatacaaattgccagttgatg

SEQ ID NO: 613717 - DNA, 25 bp, Homo sapien
gataacacagttgagtacattaaaa

SEQ ID NO: 613718 - DNA, 25 bp, Homo sapien
gttgagtacattaaaagggaccttg

SEQ ID NO: 613719 - DNA, 25 bp, Homo sapien
gggaccttgaacacaaaatccatgt

SEQ ID NO: 613720 - DNA, 25 bp, Homo sapien
tactctgtttgcattctaagtcttc

SEQ ID NO: 613721 - DNA, 25 bp, Homo sapien
gcattctaagtcttcaaagtcttgt

SEQ ID NO: 613722 - DNA, 25 bp, Homo sapien
gtcttcaaagtcttgtgtttgtttt

SEQ ID NO: 613723 - DNA, 25 bp, Homo sapien
ttgttttatagagtgcagtgcagct

SEQ ID NO: 613724 - DNA, 25 bp, Homo sapien
agagtgcagtgcagcttggacaaaa

SEQ ID NO: 613725 - DNA, 25 bp, Homo sapien
gcagtgcagcttggacaaaacacat

SEQ ID NO: 613726 - DNA, 25 bp, Homo sapien
ccagtagtcagtgtctatagtgttg

SEQ ID NO: 613727 - DNA, 25 bp, Homo sapien
agtcagtgtctatagtgttggacag

SEQ ID NO: 613728 - DNA, 25 bp, Homo sapien
gtgcatgtatggtgtatacaaacat

SEQ ID NO: 613729 - DNA, 25 bp, Homo sapien
atacaatattgctgatgaactgaaa

SEQ ID NO: 613730 - DNA, 25 bp, Homo sapien
acaagtaaaatgcacatgctaaggt

SEQ ID NO: 613731 - DNA, 25 bp, Homo sapien
tatccactgcttgccgacttcagta

SEQ ID NO: 613732 - DNA, 25 bp, Homo sapien
gacttcagtagcaagagcctccaga

SEQ ID NO: 613733 - DNA, 25 bp, Homo sapien
gagcctccagaatgctcatggataa

SEQ ID NO: 613734 - DNA, 25 bp, Homo sapien
acatcatctttgtggccacacattg

SEQ ID NO: 613735 - DNA, 25 bp, Homo sapien
ggccacacattgttttatgagctga

SEQ ID NO: 613736 - DNA, 25 bp, Homo sapien
tatgagctgagtcatcagactggct

SEQ ID NO: 613737 - DNA, 25 bp, Homo sapien
atcagactggctggctccttaaatg

SEQ ID NO: 613738 - DNA, 25 bp, Homo sapien
ctgtgtgattctctaggcagcagaa

SEQ ID NO: 613739 - DNA, 25 bp, Homo sapien
gaagtgtatctcatcgagctttgta

SEQ ID NO: 613740 - DNA, 25 bp, Homo sapien
tcgagctttgtagagggccagtatc

SEQ ID NO: 613741 - DNA, 25 bp, Homo sapien
taccattatggagtttgcttgtgat

SEQ ID NO: 613742 - DNA, 25 bp, Homo sapien
ggaaaccctggagatttggaagatg

SEQ ID NO: 613743 - DNA, 25 bp, Homo sapien
gaaaccctggagatttggaagatga

SEQ ID NO: 613744 - DNA, 25 bp, Homo sapien
aaaccctggagatttggaagatgat

SEQ ID NO: 613745 - DNA, 25 bp, Homo sapien
aaccctggagatttggaagatgatg

SEQ ID NO: 613746 - DNA, 25 bp, Homo sapien
accctggagatttggaagatgatgg

SEQ ID NO: 613747 - DNA, 25 bp, Homo sapien
ggctggagcggtggccgggagactg

SEQ ID NO: 613748 - DNA, 25 bp, Homo sapien
agcggtggccgggagactgcacatt

SEQ ID NO: 613749 - DNA, 25 bp, Homo sapien
gcggtggccgggagactgcacattg

SEQ ID NO: 613750 - DNA, 25 bp, Homo sapien
cggtggccgggagactgcacattgg

SEQ ID NO: 613751 - DNA, 25 bp, Homo sapien
gaactgtgcacccaaagactgaact

SEQ ID NO: 613752 - DNA, 25 bp, Homo sapien
agactgaactggtgtgtgtgcaaaa

SEQ ID NO: 613753 - DNA, 25 bp, Homo sapien
tcagtttccccactagaggtggcgc

SEQ ID NO: 613754 - DNA, 25 bp, Homo sapien
tagaggtggcgctgagacccttttc

SEQ ID NO: 613755 - DNA, 25 bp, Homo sapien
tgagacccttttcgtcgctgttttt

SEQ ID NO: 613756 - DNA, 25 bp, Homo sapien
cgctgtttttggcttgtggaatgaa

SEQ ID NO: 613757 - DNA, 25 bp, Homo sapien
tggaatgaatttgtctgcccttttt

SEQ ID NO: 613758 - DNA, 25 bp, Homo sapien
tgcccttttttgtcactcactgttg

SEQ ID NO: 613759 - DNA, 25 bp, Homo sapien
actgttgtgacagatcctccgattt

SEQ ID NO: 613760 - DNA, 25 bp, Homo sapien
gatcctccgatttcttacataagtt

SEQ ID NO: 613761 - DNA, 25 bp, Homo sapien
ataagttatgcagccacactgtgac

SEQ ID NO: 613762 - DNA, 25 bp, Homo sapien
gccaagttttaaagtgccagccagg

SEQ ID NO: 613763 - DNA, 25 bp, Homo sapien
ggcacacaaaggctgtaaaaatgta

SEQ ID NO: 613764 - DNA, 25 bp, Homo sapien
atcaacgtcatggatcaagttcctc

SEQ ID NO: 613765 - DNA, 25 bp, Homo sapien
ggatcaagttcctcctgatgaccaa

SEQ ID NO: 613766 - DNA, 25 bp, Homo sapien
aagttcctcctgatgaccaagccac

SEQ ID NO: 613767 - DNA, 25 bp, Homo sapien
gatggttatgttcagttgactctgc

SEQ ID NO: 613768 - DNA, 25 bp, Homo sapien
tatgttcagttgactctgctgaggc

SEQ ID NO: 613769 - DNA, 25 bp, Homo sapien
gttcagttgactctgctgaggcagt

SEQ ID NO: 613770 - DNA, 25 bp, Homo sapien
agttgactctgctgaggcagtcagg

SEQ ID NO: 613771 - DNA, 25 bp, Homo sapien
agtgtgatctcctcctgggaattgc

SEQ ID NO: 613772 - DNA, 25 bp, Homo sapien
gagatgcaggtgactcccatggacc

SEQ ID NO: 613773 - DNA, 25 bp, Homo sapien
aggtgactcccatggaccagaaaaa

SEQ ID NO: 613774 - DNA, 25 bp, Homo sapien
ggccctctccatcaacgtcatggat

SEQ ID NO: 613775 - DNA, 25 bp, Homo sapien
atcaacgtcatggatcaagttcctc

SEQ ID NO: 613776 - DNA, 25 bp, Homo sapien
ggatcaagttcctcctgatgaccaa

SEQ ID NO: 613777 - DNA, 25 bp, Homo sapien
atcaagttcctcctgatgaccaagc

SEQ ID NO: 613778 - DNA, 25 bp, Homo sapien
aagttcctcctgatgaccaagccac

SEQ ID NO: 613779 - DNA, 25 bp, Homo sapien
gatggttatgttcagttgactctgc

SEQ ID NO: 613780 - DNA, 25 bp, Homo sapien
ggttatgttcagttgactctgctga

SEQ ID NO: 613781 - DNA, 25 bp, Homo sapien
tatgttcagttgactctgctgaggc

SEQ ID NO: 613782 - DNA, 25 bp, Homo sapien
gttcagttgactctgctgaggcagt

SEQ ID NO: 613783 - DNA, 25 bp, Homo sapien
agttgactctgctgaggcagtcagg

SEQ ID NO: 613784 - DNA, 25 bp, Homo sapien
ggccctctccatcaacgtcatggat

SEQ ID NO: 613785 - DNA, 25 bp, Homo sapien
cctctccatcaacgtcatggatcaa

SEQ ID NO: 613786 - DNA, 25 bp, Homo sapien
atcctgttcttaatctccctcctga

SEQ ID NO: 613787 - DNA, 25 bp, Homo sapien
tgttcttaatctccctcctgacact

SEQ ID NO: 613788 - DNA, 25 bp, Homo sapien
tgcctgcgtgcagtcctgagtgtta

SEQ ID NO: 613789 - DNA, 25 bp, Homo sapien
tgcgtgcagtcctgagtgttaggca

SEQ ID NO: 613790 - DNA, 25 bp, Homo sapien
cagtcctgagtgttaggcaggcaca

SEQ ID NO: 613791 - DNA, 25 bp, Homo sapien
ggaatgttctgatctgaaccctaca

SEQ ID NO: 613792 - DNA, 25 bp, Homo sapien
tgttctgatctgaaccctacacaga

SEQ ID NO: 613793 - DNA, 25 bp, Homo sapien
ctgatctgaaccctacacagaatga

SEQ ID NO: 613794 - DNA, 25 bp, Homo sapien
ggtggaaattctaatatatgcacta

SEQ ID NO: 613795 - DNA, 25 bp, Homo sapien
aaacacatggcttctgtataacttg

SEQ ID NO: 613796 - DNA, 25 bp, Homo sapien
ggcttctgtataacttgatatgctt

SEQ ID NO: 613797 - DNA, 25 bp, Homo sapien
aaagcaattaactccagagacagca

SEQ ID NO: 613798 - DNA, 25 bp, Homo sapien
gcaattaactccagagacagcaaaa

SEQ ID NO: 613799 - DNA, 25 bp, Homo sapien
tccagagacagcaaaaaggtgtata

SEQ ID NO: 613800 - DNA, 25 bp, Homo sapien
agggaagtgtaatcatattatacta

SEQ ID NO: 613801 - DNA, 25 bp, Homo sapien
tattatactacaaagctcaagtcgt

SEQ ID NO: 613802 - DNA, 25 bp, Homo sapien
atactacaaagctcaagtcgtaaat

SEQ ID NO: 613803 - DNA, 25 bp, Homo sapien
acaaagctcaagtcgtaaatatatt

SEQ ID NO: 613804 - DNA, 25 bp, Homo sapien
cattggcataatgtaaacagcatat

SEQ ID NO: 613805 - DNA, 25 bp, Homo sapien
ggcataatgtaaacagcatattgaa

SEQ ID NO: 613806 - DNA, 25 bp, Homo sapien
agaaagctacatgatcattttcatt

SEQ ID NO: 613807 - DNA, 25 bp, Homo sapien
ggaagtcaagatatccaaaacagaa

SEQ ID NO: 613808 - DNA, 25 bp, Homo sapien
cagtatcgtataaatccatgttaat

SEQ ID NO: 613809 - DNA, 25 bp, Homo sapien
tgttaatttcctggtagtgatgaca

SEQ ID NO: 613810 - DNA, 25 bp, Homo sapien
ttcctggtagtgatgacagcactgt

SEQ ID NO: 613811 - DNA, 25 bp, Homo sapien
atgacagcactgtgattatatagga

SEQ ID NO: 613812 - DNA, 25 bp, Homo sapien
agtgtgtccttggtgtttgggaatt

SEQ ID NO: 613813 - DNA, 25 bp, Homo sapien
gtgtccttggtgtttgggaattaca

SEQ ID NO: 613814 - DNA, 25 bp, Homo sapien
gtgtttgggaattacatggtgaaat

SEQ ID NO: 613815 - DNA, 25 bp, Homo sapien
ggataatggggcaacttactttcaa

SEQ ID NO: 613816 - DNA, 25 bp, Homo sapien
gaatgaataggagttttttgtagta

SEQ ID NO: 613817 - DNA, 25 bp, Homo sapien
gtagtattcttacgacttttccata

SEQ ID NO: 613818 - DNA, 25 bp, Homo sapien
ttcttacgacttttccataagtttg

SEQ ID NO: 613819 - DNA, 25 bp, Homo sapien
aggccactggcctatgtcttcctgg

SEQ ID NO: 613820 - DNA, 25 bp, Homo sapien
tggcctatgtcttcctgggtccagc

SEQ ID NO: 613821 - DNA, 25 bp, Homo sapien
ccaaggacaggctgttgagagctgt

SEQ ID NO: 613822 - DNA, 25 bp, Homo sapien
atcccgggtggatggagcttcagta

SEQ ID NO: 613823 - DNA, 25 bp, Homo sapien
aaggaggagaaagagccagccgctc

SEQ ID NO: 613824 - DNA, 25 bp, Homo sapien
aggagaaagagccagccgctccatt

SEQ ID NO: 613825 - DNA, 25 bp, Homo sapien
aagagccagccgctccattggagag

SEQ ID NO: 613826 - DNA, 25 bp, Homo sapien
agccagccgctccattggagagcag

SEQ ID NO: 613827 - DNA, 25 bp, Homo sapien
caacctcactggcttaatcaagctc

SEQ ID NO: 613828 - DNA, 25 bp, Homo sapien
tcactggcttaatcaagctccgctt

SEQ ID NO: 613829 - DNA, 25 bp, Homo sapien
tcaagctccgcttccacctgaggag

SEQ ID NO: 613830 - DNA, 25 bp, Homo sapien
gtaagtgttaactattatactggaa

SEQ ID NO: 613831 - DNA, 25 bp, Homo sapien
ctggaaagaaggctcagttccttga

SEQ ID NO: 613832 - DNA, 25 bp, Homo sapien
ggaaagaaggctcagttccttgatt

SEQ ID NO: 613833 - DNA, 25 bp, Homo sapien
aagaaggctcagttccttgatttag

SEQ ID NO: 613834 - DNA, 25 bp, Homo sapien
gaaggctcagttccttgatttaggt

SEQ ID NO: 613835 - DNA, 25 bp, Homo sapien
aggctcagttccttgatttaggtgt

SEQ ID NO: 613836 - DNA, 25 bp, Homo sapien
gctcagttccttgatttaggtgtgg

SEQ ID NO: 613837 - DNA, 25 bp, Homo sapien
cagttccttgatttaggtgtgggag

SEQ ID NO: 613838 - DNA, 25 bp, Homo sapien
ttccttgatttaggtgtgggagaaa

SEQ ID NO: 613839 - DNA, 25 bp, Homo sapien
tggtgaaactcatgtctacgaaaaa

SEQ ID NO: 613840 - DNA, 25 bp, Homo sapien
caaaagttagcctggtgttggtggc

SEQ ID NO: 613841 - DNA, 25 bp, Homo sapien
tggcagctatggcttccgactcagt

SEQ ID NO: 613842 - DNA, 25 bp, Homo sapien
atggcttccgactcagttgtgtggc

SEQ ID NO: 613843 - DNA, 25 bp, Homo sapien
tccgactcagttgtgtggccagtgg

SEQ ID NO: 613844 - DNA, 25 bp, Homo sapien
gccagtgggcctcgtctcttcatct

SEQ ID NO: 613845 - DNA, 25 bp, Homo sapien
ttcatctcccaggtgactccaggag

SEQ ID NO: 613846 - DNA, 25 bp, Homo sapien
tcccaggtgactccaggaggctcag

SEQ ID NO: 613847 - DNA, 25 bp, Homo sapien
ggctgcaagtgggagacgtgattct

SEQ ID NO: 613848 - DNA, 25 bp, Homo sapien
gattctggaagtgaacgggtatcct

SEQ ID NO: 613849 - DNA, 25 bp, Homo sapien
aatgacctggagaggcttcagcagc

SEQ ID NO: 613850 - DNA, 25 bp, Homo sapien
gcctgaagctggcagccaggtctct

SEQ ID NO: 613851 - DNA, 25 bp, Homo sapien
gggctctggcctcggatctactgta

SEQ ID NO: 613852 - DNA, 25 bp, Homo sapien
gaaccgaatgttctgattaagagat

SEQ ID NO: 613853 - DNA, 25 bp, Homo sapien
gggaatcagcagatctctacattac

SEQ ID NO: 613854 - DNA, 25 bp, Homo sapien
agcagatctctacattacctaattc

SEQ ID NO: 613855 - DNA, 25 bp, Homo sapien
cattacctaattcttttctcttaca

SEQ ID NO: 613856 - DNA, 25 bp, Homo sapien
tcttttctcttacatttgaatgcaa

SEQ ID NO: 613857 - DNA, 25 bp, Homo sapien
caaatgtatattcacgtgcggttat

SEQ ID NO: 613858 - DNA, 25 bp, Homo sapien
tcacgtgcggttatgactcaagtca

SEQ ID NO: 613859 - DNA, 25 bp, Homo sapien
taatgacgttgtaggtgaatcacat

SEQ ID NO: 613860 - DNA, 25 bp, Homo sapien
gtgaatcacattcagatttcctttt

SEQ ID NO: 613861 - DNA, 25 bp, Homo sapien
agatttccttttgcaggttttccag

SEQ ID NO: 613862 - DNA, 25 bp, Homo sapien
aaacaatgcttctagtaggtaactt

SEQ ID NO: 613863 - DNA, 25 bp, Homo sapien
ttcattatctgcacaatggctcgcc

SEQ ID NO: 613864 - DNA, 25 bp, Homo sapien
atggctcgccacagacgagatggca

SEQ ID NO: 613865 - DNA, 25 bp, Homo sapien
gatggcaagatccaggttacttttg

SEQ ID NO: 613866 - DNA, 25 bp, Homo sapien
caggttacttttggagatctctttg

SEQ ID NO: 613867 - DNA, 25 bp, Homo sapien
gatctctttgacagatacgttcgta

SEQ ID NO: 613868 - DNA, 25 bp, Homo sapien
gcattctcatgcgtgccaggaaaca

SEQ ID NO: 613869 - DNA, 25 bp, Homo sapien
ggcaaggccgagatgaccatgttgt

SEQ ID NO: 613870 - DNA, 25 bp, Homo sapien
gaccatgttgtgattacgctactca

SEQ ID NO: 613871 - DNA, 25 bp, Homo sapien
tatggccgccccaaagaaggaacca

SEQ ID NO: 613872 - DNA, 25 bp, Homo sapien
aaactgctgaaagggccaagcgtgc

SEQ ID NO: 613873 - DNA, 25 bp, Homo sapien
tgctgaggagcacatctacagggaa

SEQ ID NO: 613874 - DNA, 25 bp, Homo sapien
ttgctgagcgcaactttccgcataa

SEQ ID NO: 613875 - DNA, 25 bp, Homo sapien
aactttccgcataagacggtggccg

SEQ ID NO: 613876 - DNA, 25 bp, Homo sapien
gcataagacggtggccgctcagaga

SEQ ID NO: 613877 - DNA, 25 bp, Homo sapien
aaggccaaggcgctcaagcgcagtt

SEQ ID NO: 613878 - DNA, 25 bp, Homo sapien
gctcaagcgcagtttcaagtctcag

SEQ ID NO: 613879 - DNA, 25 bp, Homo sapien
aagcgcagtttcaagtctcaggccg

SEQ ID NO: 613880 - DNA, 25 bp, Homo sapien
gtttcaagtctcaggccgtgggcga

SEQ ID NO: 613881 - DNA, 25 bp, Homo sapien
agtctcaggccgtgggcgactctgt

SEQ ID NO: 613882 - DNA, 25 bp, Homo sapien
tcatctggtcgcagctggagcatgc

SEQ ID NO: 613883 - DNA, 25 bp, Homo sapien
cagctggagcatgccgacgtcagga

SEQ ID NO: 613884 - DNA, 25 bp, Homo sapien
gagcatgccgacgtcaggaagaacc

SEQ ID NO: 613885 - DNA, 25 bp, Homo sapien
gtatgagtctctttcaaactgaagg

SEQ ID NO: 613886 - DNA, 25 bp, Homo sapien
gtctctttcaaactgaaggttctgg

SEQ ID NO: 613887 - DNA, 25 bp, Homo sapien
aactgaaggttctggtatcttaaga

SEQ ID NO: 613888 - DNA, 25 bp, Homo sapien
ggtatcttaagaaagtatgcgtatt

SEQ ID NO: 613889 - DNA, 25 bp, Homo sapien
atgcgtattttgtttccataccgta

SEQ ID NO: 613890 - DNA, 25 bp, Homo sapien
ttccataccgtatttataaagctat

SEQ ID NO: 613891 - DNA, 25 bp, Homo sapien
gctataagttaatgaccaatatttc

SEQ ID NO: 613892 - DNA, 25 bp, Homo sapien
ctaagtaggatttcatgtaagatgc

SEQ ID NO: 613893 - DNA, 25 bp, Homo sapien
gtaagatgcacacttctattacaag

SEQ ID NO: 613894 - DNA, 25 bp, Homo sapien
attacaagtgaaacctacgccaaat

SEQ ID NO: 613895 - DNA, 25 bp, Homo sapien
tgaaacctacgccaaatgttaaaga

SEQ ID NO: 613896 - DNA, 25 bp, Homo sapien
tcactaggaaccaatctctgcacat

SEQ ID NO: 613897 - DNA, 25 bp, Homo sapien
taggaaccaatctctgcacataatc

SEQ ID NO: 613898 - DNA, 25 bp, Homo sapien
caatctctgcacataatcccacatg

SEQ ID NO: 613899 - DNA, 25 bp, Homo sapien
aatcccacatgtattgtaaagtaag

SEQ ID NO: 613900 - DNA, 25 bp, Homo sapien
gaaggctatgtaaggacaatgacaa

SEQ ID NO: 613901 - DNA, 25 bp, Homo sapien
aactgataagggatgcaaaaccaag

SEQ ID NO: 613902 - DNA, 25 bp, Homo sapien
tgcaaaaccaagagaatcattcatg

SEQ ID NO: 613903 - DNA, 25 bp, Homo sapien
gaagaatgactataccatgcctggt

SEQ ID NO: 613904 - DNA, 25 bp, Homo sapien
aatgactataccatgcctggttctg

SEQ ID NO: 613905 - DNA, 25 bp, Homo sapien
gcctggttctgatgctcgtttaaaa

SEQ ID NO: 613906 - DNA, 25 bp, Homo sapien
ggttctgatgctcgtttaaaatatt

SEQ ID NO: 613907 - DNA, 25 bp, Homo sapien
cacaacctggcctgcttgggttttt

SEQ ID NO: 613908 - DNA, 25 bp, Homo sapien
ttgggtttttctatcttggctctgc

SEQ ID NO: 613909 - DNA, 25 bp, Homo sapien
tcttggctctgccacctagctgtgg

SEQ ID NO: 613910 - DNA, 25 bp, Homo sapien
aattgggatgattggatctgtctca

SEQ ID NO: 613911 - DNA, 25 bp, Homo sapien
gattggatctgtctcatagggttgt

SEQ ID NO: 613912 - DNA, 25 bp, Homo sapien
gatctgtctcatagggttgtgaaaa

SEQ ID NO: 613913 - DNA, 25 bp, Homo sapien
gctcttagaagagtacctcatatgt

SEQ ID NO: 613914 - DNA, 25 bp, Homo sapien
gtacctcatatgtaataagcacgca

SEQ ID NO: 613915 - DNA, 25 bp, Homo sapien
agcacgcaactgttaattattgtta

SEQ ID NO: 613916 - DNA, 25 bp, Homo sapien
gtataaatcagatacactgtggtca

SEQ ID NO: 613917 - DNA, 25 bp, Homo sapien
cactgtggtcaaagatttgtgtgta

SEQ ID NO: 613918 - DNA, 25 bp, Homo sapien
gccagacccaataagctaccatagt

SEQ ID NO: 613919 - DNA, 25 bp, Homo sapien
gctaccatagtaggattcccattcc

SEQ ID NO: 613920 - DNA, 25 bp, Homo sapien
ttcccattcctaggccattctggaa

SEQ ID NO: 613921 - DNA, 25 bp, Homo sapien
aaggccaaaccatagggactgagca

SEQ ID NO: 613922 - DNA, 25 bp, Homo sapien
ggaaaccctggagatttggaagatg

SEQ ID NO: 613923 - DNA, 25 bp, Homo sapien
aaccctggagatttggaagatgatg

SEQ ID NO: 613924 - DNA, 25 bp, Homo sapien
agcggtggccgggagactgcacatt

SEQ ID NO: 613925 - DNA, 25 bp, Homo sapien
actgcacattggtttggaaccatgg

SEQ ID NO: 613926 - DNA, 25 bp, Homo sapien
gaaccatggaggaactgtgcaccca

SEQ ID NO: 613927 - DNA, 25 bp, Homo sapien
gaactgtgcacccaaagactgaact

SEQ ID NO: 613928 - DNA, 25 bp, Homo sapien
agactgaactggtgtgtgtgcaaaa

SEQ ID NO: 613929 - DNA, 25 bp, Homo sapien
ataactgaaaacatacattaagaac

SEQ ID NO: 613930 - DNA, 25 bp, Homo sapien
taactgaaaacatacattaagaact

SEQ ID NO: 613931 - DNA, 25 bp, Homo sapien
aactgaaaacatacattaagaactc

SEQ ID NO: 613932 - DNA, 25 bp, Homo sapien
actgaaaacatacattaagaactct

SEQ ID NO: 613933 - DNA, 25 bp, Homo sapien
ctgaaaacatacattaagaactctt

SEQ ID NO: 613934 - DNA, 25 bp, Homo sapien
tgaaaacatacattaagaactcttt

SEQ ID NO: 613935 - DNA, 25 bp, Homo sapien
gaaaacatacattaagaactctttt

SEQ ID NO: 613936 - DNA, 25 bp, Homo sapien
gaactctttttctctggccgagtgt

SEQ ID NO: 613937 - DNA, 25 bp, Homo sapien
aactctttttctctggccgagtgtg

SEQ ID NO: 613938 - DNA, 25 bp, Homo sapien
actctttttctctggccgagtgtgg

SEQ ID NO: 613939 - DNA, 25 bp, Homo sapien
ctctttttctctggccgagtgtggt

SEQ ID NO: 613940 - DNA, 25 bp, Homo sapien
gtttatgttttaaagacacacagag

SEQ ID NO: 613941 - DNA, 25 bp, Homo sapien
aactattgtaatctctttctttcct

SEQ ID NO: 613942 - DNA, 25 bp, Homo sapien
tctttctttcctgagccttaggcat

SEQ ID NO: 613943 - DNA, 25 bp, Homo sapien
tttcctgagccttaggcatcttcat

SEQ ID NO: 613944 - DNA, 25 bp, Homo sapien
gagccttaggcatcttcattataaa

SEQ ID NO: 613945 - DNA, 25 bp, Homo sapien
ttaggcatcttcattataaaccaaa

SEQ ID NO: 613946 - DNA, 25 bp, Homo sapien
atataacttgagattttcccagggt

SEQ ID NO: 613947 - DNA, 25 bp, Homo sapien
cccagggtttatatactcgttagag

SEQ ID NO: 613948 - DNA, 25 bp, Homo sapien
aaaatggcaatttgggatgtctctt

SEQ ID NO: 613949 - DNA, 25 bp, Homo sapien
tgggatgtctctttggagtcaaaaa

SEQ ID NO: 613950 - DNA, 25 bp, Homo sapien
gtctctttggagtcaaaaaccttat

SEQ ID NO: 613951 - DNA, 25 bp, Homo sapien
gttaataatctacagccttccttcc

SEQ ID NO: 613952 - DNA, 25 bp, Homo sapien
aaaaaacaggccagacacagccaag

SEQ ID NO: 613953 - DNA, 25 bp, Homo sapien
acacagccaagtttacaaaatcttc

SEQ ID NO: 613954 - DNA, 25 bp, Homo sapien
gccaagtttacaaaatcttcaaaga

SEQ ID NO: 613955 - DNA, 25 bp, Homo sapien
agaacagataagcactactttgtat

SEQ ID NO: 613956 - DNA, 25 bp, Homo sapien
gataagcactactttgtataaactt

SEQ ID NO: 613957 - DNA, 25 bp, Homo sapien
gaaaaaggacaacttcccacatcat

SEQ ID NO: 613958 - DNA, 25 bp, Homo sapien
ggacaacttcccacatcattttgta

SEQ ID NO: 613959 - DNA, 25 bp, Homo sapien
aacttcccacatcattttgtatgca

SEQ ID NO: 613960 - DNA, 25 bp, Homo sapien
cattttgtatgcataaccttgataa

SEQ ID NO: 613961 - DNA, 25 bp, Homo sapien
gcataaccttgataataaaactgaa

SEQ ID NO: 613962 - DNA, 25 bp, Homo sapien
aacacatcattctgccattcaactt

SEQ ID NO: 613963 - DNA, 25 bp, Homo sapien
gccattcaacttttgcacattctga

SEQ ID NO: 613964 - DNA, 25 bp, Homo sapien
gcacattctgattttgtcccttcaa

SEQ ID NO: 613965 - DNA, 25 bp, Homo sapien
tgtcccttcaactttcatacctttt

SEQ ID NO: 613966 - DNA, 25 bp, Homo sapien
caagaacaagttatgaatgcggatt

SEQ ID NO: 613967 - DNA, 25 bp, Homo sapien
atgcggattggctggctgttttatt

SEQ ID NO: 613968 - DNA, 25 bp, Homo sapien
attggctggctgttttattacttta

SEQ ID NO: 613969 - DNA, 25 bp, Homo sapien
agctgaatgtgtgagagggttccca

SEQ ID NO: 613970 - DNA, 25 bp, Homo sapien
gagggttcccataaatggagttcac

SEQ ID NO: 613971 - DNA, 25 bp, Homo sapien
taaaacactcagagaagtgcctggg

SEQ ID NO: 613972 - DNA, 25 bp, Homo sapien
gggcataataagcactgtataggag

SEQ ID NO: 613973 - DNA, 25 bp, Homo sapien
aacaaaaacgtcatcagtcctgatt

SEQ ID NO: 613974 - DNA, 25 bp, Homo sapien
tcatcagtcctgatttattatcaaa

SEQ ID NO: 613975 - DNA, 25 bp, Homo sapien
attttctcctataagctctgctcag

SEQ ID NO: 613976 - DNA, 25 bp, Homo sapien
agaagtcattctgtagtccaagtta

SEQ ID NO: 613977 - DNA, 25 bp, Homo sapien
ttctgtagtccaagttagggctaat

SEQ ID NO: 613978 - DNA, 25 bp, Homo sapien
agggctaatgaggagccatactctt

SEQ ID NO: 613979 - DNA, 25 bp, Homo sapien
ggagccatactcttacatcaaaata

SEQ ID NO: 613980 - DNA, 25 bp, Homo sapien
gactctggtattttgctgtagtttc

SEQ ID NO: 613981 - DNA, 25 bp, Homo sapien
tgtagtttccactcaccttcctttg

SEQ ID NO: 613982 - DNA, 25 bp, Homo sapien
actcaccttcctttggacacattat

SEQ ID NO: 613983 - DNA, 25 bp, Homo sapien
cttcctttggacacattattttcat

SEQ ID NO: 613984 - DNA, 25 bp, Homo sapien
gaaaagccgaaagccgtgattccga

SEQ ID NO: 613985 - DNA, 25 bp, Homo sapien
agccgaaagccgtgattccgatcta

SEQ ID NO: 613986 - DNA, 25 bp, Homo sapien
gaaagccgtgattccgatctacgaa

SEQ ID NO: 613987 - DNA, 25 bp, Homo sapien
gtgattccgatctacgaaggcgatt

SEQ ID NO: 613988 - DNA, 25 bp, Homo sapien
ttccgatctacgaaggcgattacca

SEQ ID NO: 613989 - DNA, 25 bp, Homo sapien
tacgaaggcgattaccaccctgagc

SEQ ID NO: 613990 - DNA, 25 bp, Homo sapien
gagcccctgaccgtagaggtgcaga

SEQ ID NO: 613991 - DNA, 25 bp, Homo sapien
cctgaccgtagaggtgcagatccag

SEQ ID NO: 613992 - DNA, 25 bp, Homo sapien
gaaccagtgccgctcggcggaggag

SEQ ID NO: 613993 - DNA, 25 bp, Homo sapien
atgttcgccgtgtagggcgtgggca

SEQ ID NO: 613994 - DNA, 25 bp, Homo sapien
gtgggcagtaaaggctgttcccagc

SEQ ID NO: 613995 - DNA, 25 bp, Homo sapien
agggaatatgcctcctatggaacat

SEQ ID NO: 613996 - DNA, 25 bp, Homo sapien
tatgcctcctatggaacatgatggg

SEQ ID NO: 613997 - DNA, 25 bp, Homo sapien
aaacataagaatttcatctgctgaa

SEQ ID NO: 613998 - DNA, 25 bp, Homo sapien
gaaacatccaaatctgctaatcaag

SEQ ID NO: 613999 - DNA, 25 bp, Homo sapien
gctaatcaagatacctgtagtcctt

SEQ ID NO: 614000 - DNA, 25 bp, Homo sapien
gatacctgtagtccttttgcaggga

SEQ ID NO: 614001 - DNA, 25 bp, Homo sapien
tagtccttttgcagggatgctcttt

SEQ ID NO: 614002 - DNA, 25 bp, Homo sapien
gatgctctttggaggtgaagatcga

SEQ ID NO: 614003 - DNA, 25 bp, Homo sapien
gaagatcgagaacttattcagagaa

SEQ ID NO: 614004 - DNA, 25 bp, Homo sapien
agaactgttggaacaaatggctgag

SEQ ID NO: 614005 - DNA, 25 bp, Homo sapien
aaatggctgagcaacagaggaacaa

SEQ ID NO: 614006 - DNA, 25 bp, Homo sapien
ctgtttagatataatggtagccact

SEQ ID NO: 614007 - DNA, 25 bp, Homo sapien
ggtagccactagaagatttacatca

SEQ ID NO: 614008 - DNA, 25 bp, Homo sapien
agaagccctttccatcagtgaccag

SEQ ID NO: 614009 - DNA, 25 bp, Homo sapien
ctttccatcagtgaccaggtttggt

SEQ ID NO: 614010 - DNA, 25 bp, Homo sapien
gaccaggtttggtatctgctaggag

SEQ ID NO: 614011 - DNA, 25 bp, Homo sapien
gtatctgctaggagggaaaagcctg

SEQ ID NO: 614012 - DNA, 25 bp, Homo sapien
gaaaagcctggtaactgatcaccag

SEQ ID NO: 614013 - DNA, 25 bp, Homo sapien
actgatcaccagtgtttctgttctt

SEQ ID NO: 614014 - DNA, 25 bp, Homo sapien
agtttgtaatttaccaaggcatgat

SEQ ID NO: 614015 - DNA, 25 bp, Homo sapien
caaggcatgattaattttgctgatg

SEQ ID NO: 614016 - DNA, 25 bp, Homo sapien
aagatggctgactaaaagtgcccaa

SEQ ID NO: 614017 - DNA, 25 bp, Homo sapien
taattgactgaatggaacccctctt

SEQ ID NO: 614018 - DNA, 25 bp, Homo sapien
aatggaacccctcttgaccaaagtg

SEQ ID NO: 614019 - DNA, 25 bp, Homo sapien
tcttgaccaaagtgaccccagaaaa

SEQ ID NO: 614020 - DNA, 25 bp, Homo sapien
gtcagacacgcttcattatatctcc

SEQ ID NO: 614021 - DNA, 25 bp, Homo sapien
tatatctccgtctcttttatggttt

SEQ ID NO: 614022 - DNA, 25 bp, Homo sapien
tcttttatggtttagacacagcaac

SEQ ID NO: 614023 - DNA, 25 bp, Homo sapien
aggctgacagaatagaccctttgtg

SEQ ID NO: 614024 - DNA, 25 bp, Homo sapien
agaatagaccctttgtggcaataac

SEQ ID NO: 614025 - DNA, 25 bp, Homo sapien
agatctaaggtcatgccaggcaagt

SEQ ID NO: 614026 - DNA, 25 bp, Homo sapien
tcatgccaggcaagtgttatgtcat

SEQ ID NO: 614027 - DNA, 25 bp, Homo sapien
ttatgtcatgcactcctacacttaa

SEQ ID NO: 614028 - DNA, 25 bp, Homo sapien
agctgctttccctgaatgcaatgca

SEQ ID NO: 614029 - DNA, 25 bp, Homo sapien
aatgcaatgcatgagcaggccaggc

SEQ ID NO: 614030 - DNA, 25 bp, Homo sapien
ccagctaacccacagaattatgaga

SEQ ID NO: 614031 - DNA, 25 bp, Homo sapien
taagccactaagtctgttatgcagc

SEQ ID NO: 614032 - DNA, 25 bp, Homo sapien
ggccctgaaagcagcagatctcacc

SEQ ID NO: 614033 - DNA, 25 bp, Homo sapien
agatctcacctgcattggaggatga

SEQ ID NO: 614034 - DNA, 25 bp, Homo sapien
ggatgagacgccacatgaagaagaa

SEQ ID NO: 614035 - DNA, 25 bp, Homo sapien
aagacgccacagacagcagcgcagt

SEQ ID NO: 614036 - DNA, 25 bp, Homo sapien
gcagtaccaccttccagagatgtga

SEQ ID NO: 614037 - DNA, 25 bp, Homo sapien
atgtgagtgtgaccgtctttgacct

SEQ ID NO: 614038 - DNA, 25 bp, Homo sapien
tttgaccttctagcccagctgcttt

SEQ ID NO: 614039 - DNA, 25 bp, Homo sapien
ttggccaggccccagaacctttgtc

SEQ ID NO: 614040 - DNA, 25 bp, Homo sapien
agaacctttgtctctgccctgtact

SEQ ID NO: 614041 - DNA, 25 bp, Homo sapien
cctgtactccagtgaccttggagca

SEQ ID NO: 614042 - DNA, 25 bp, Homo sapien
gtgaccttggagcagcaactggttt

SEQ ID NO: 614043 - DNA, 25 bp, Homo sapien
accttggagcagcaactggtttctc

SEQ ID NO: 614044 - DNA, 25 bp, Homo sapien
gagcagcaactggtttctccttctg

SEQ ID NO: 614045 - DNA, 25 bp, Homo sapien
gcagcaactggtttctccttctggg

SEQ ID NO: 614046 - DNA, 25 bp, Homo sapien
tgcccagcatatgctcaactctgat

SEQ ID NO: 614047 - DNA, 25 bp, Homo sapien
aggtccccaaagtctctgaccaggc

SEQ ID NO: 614048 - DNA, 25 bp, Homo sapien
tctgaccaggctttggtttctgccc

SEQ ID NO: 614049 - DNA, 25 bp, Homo sapien
caggctttggtttctgcccactcag

SEQ ID NO: 614050 - DNA, 25 bp, Homo sapien
gatatagaacattccagggccaggt

SEQ ID NO: 614051 - DNA, 25 bp, Homo sapien
tagaacattccagggccaggttcag

SEQ ID NO: 614052 - DNA, 25 bp, Homo sapien
ttcagtggatcatgcttgtaatcgc

SEQ ID NO: 614053 - DNA, 25 bp, Homo sapien
aaaaatagctggccattgtgacata

SEQ ID NO: 614054 - DNA, 25 bp, Homo sapien
ttgtgacatatacctgtaaccgtag

SEQ ID NO: 614055 - DNA, 25 bp, Homo sapien
gtgacatatacctgtaaccgtagct

SEQ ID NO: 614056 - DNA, 25 bp, Homo sapien
gacatatacctgtaaccgtagctac

SEQ ID NO: 614057 - DNA, 25 bp, Homo sapien
atatacctgtaaccgtagctactct

SEQ ID NO: 614058 - DNA, 25 bp, Homo sapien
ctgtaaccgtagctactctggtggc

SEQ ID NO: 614059 - DNA, 25 bp, Homo sapien
tggctgaggcttgagtatcgcctgg

SEQ ID NO: 614060 - DNA, 25 bp, Homo sapien
aggcttgagtatcgcctgggaggca

SEQ ID NO: 614061 - DNA, 25 bp, Homo sapien
ggagagacatctatagcaggaaatc

SEQ ID NO: 614062 - DNA, 25 bp, Homo sapien
gtcatcatggacttcttcaataggc

SEQ ID NO: 614063 - DNA, 25 bp, Homo sapien
tggacttcttcaataggccaatggg

SEQ ID NO: 614064 - DNA, 25 bp, Homo sapien
ggtgagcatattgtggaatgcagca

SEQ ID NO: 614065 - DNA, 25 bp, Homo sapien
gaatgcagcagaggataagcctaga

SEQ ID NO: 614066 - DNA, 25 bp, Homo sapien
gagaggaagaacctaatcatgaagg

SEQ ID NO: 614067 - DNA, 25 bp, Homo sapien
tgaaggttctcaagtgtcatgctga

SEQ ID NO: 614068 - DNA, 25 bp, Homo sapien
ggttctcaagtgtcatgctgaggat

SEQ ID NO: 614069 - DNA, 25 bp, Homo sapien
gaggatttcagtgattattcagtag

SEQ ID NO: 614070 - DNA, 25 bp, Homo sapien
tattcagtagacttgaaagccacag

SEQ ID NO: 614071 - DNA, 25 bp, Homo sapien
gagtggtaaaatgtcactaaggaat

SEQ ID NO: 614072 - DNA, 25 bp, Homo sapien
cacttctggaagctgggttcatttt

SEQ ID NO: 614073 - DNA, 25 bp, Homo sapien
ctggaagctgggttcattttcaaat

SEQ ID NO: 614074 - DNA, 25 bp, Homo sapien
gctgggttcattttcaaattagttt

SEQ ID NO: 614075 - DNA, 25 bp, Homo sapien
atatctcaaggttattgtatgtgac

SEQ ID NO: 614076 - DNA, 25 bp, Homo sapien
gttattgtatgtgactattttagca

SEQ ID NO: 614077 - DNA, 25 bp, Homo sapien
tgggaaattgaactaaccaactgaa

SEQ ID NO: 614078 - DNA, 25 bp, Homo sapien
ttcaaggttctcaatgggagtttct

SEQ ID NO: 614079 - DNA, 25 bp, Homo sapien
ggatgtatagaagttcccctaatta

SEQ ID NO: 614080 - DNA, 25 bp, Homo sapien
gaacacaatcttggtattcagctgt

SEQ ID NO: 614081 - DNA, 25 bp, Homo sapien
ccttcttaccattcaccacaaagta

SEQ ID NO: 614082 - DNA, 25 bp, Homo sapien
accattcaccacaaagtaattctca

SEQ ID NO: 614083 - DNA, 25 bp, Homo sapien
aaaacatcatgccagcatcagtgag

SEQ ID NO: 614084 - DNA, 25 bp, Homo sapien
catcatgccagcatcagtgagctga

SEQ ID NO: 614085 - DNA, 25 bp, Homo sapien
aagaacttcatggagtctgtaccag

SEQ ID NO: 614086 - DNA, 25 bp, Homo sapien
tggagtctgtaccagaaccacggcc

SEQ ID NO: 614087 - DNA, 25 bp, Homo sapien
gtaccagaaccacggcctagtgaat

SEQ ID NO: 614088 - DNA, 25 bp, Homo sapien
aaccacggcctagtgaatgggataa

SEQ ID NO: 614089 - DNA, 25 bp, Homo sapien
ggataaacgcttatccactcactca

SEQ ID NO: 614090 - DNA, 25 bp, Homo sapien
acccttccgaactcttaacatcaat

SEQ ID NO: 614091 - DNA, 25 bp, Homo sapien
tccgaactcttaacatcaatgggca

SEQ ID NO: 614092 - DNA, 25 bp, Homo sapien
atcaatgggcaaatccccacaggag

SEQ ID NO: 614093 - DNA, 25 bp, Homo sapien
tgggcaaatccccacaggagaagga

SEQ ID NO: 614094 - DNA, 25 bp, Homo sapien
ggccaggccccagaacctttgtctc

SEQ ID NO: 614095 - DNA, 25 bp, Homo sapien
gccaggccccagaacctttgtctct

SEQ ID NO: 614096 - DNA, 25 bp, Homo sapien
ccaggccccagaacctttgtctctg

SEQ ID NO: 614097 - DNA, 25 bp, Homo sapien
caggccccagaacctttgtctctgc

SEQ ID NO: 614098 - DNA, 25 bp, Homo sapien
aggccccagaacctttgtctctgcc

SEQ ID NO: 614099 - DNA, 25 bp, Homo sapien
ggccccagaacctttgtctctgccc

SEQ ID NO: 614100 - DNA, 25 bp, Homo sapien
ccagaacctttgtctctgccctgta

SEQ ID NO: 614101 - DNA, 25 bp, Homo sapien
cagaacctttgtctctgccctgtac

SEQ ID NO: 614102 - DNA, 25 bp, Homo sapien
aggtccccaaagtctctgaccaggc

SEQ ID NO: 614103 - DNA, 25 bp, Homo sapien
ggtccccaaagtctctgaccaggct

SEQ ID NO: 614104 - DNA, 25 bp, Homo sapien
tctgaccaggctttggtttctgccc

SEQ ID NO: 614105 - DNA, 25 bp, Homo sapien
gttacatgtgtaacttgcctgaatg

SEQ ID NO: 614106 - DNA, 25 bp, Homo sapien
acatgtgtaacttgcctgaatgaga

SEQ ID NO: 614107 - DNA, 25 bp, Homo sapien
gtaacttgcctgaatgagaaatgaa

SEQ ID NO: 614108 - DNA, 25 bp, Homo sapien
acagaaccaaaaggatcttctggag

SEQ ID NO: 614109 - DNA, 25 bp, Homo sapien
atcttctggaggatggttatgtgga

SEQ ID NO: 614110 - DNA, 25 bp, Homo sapien
tggagcagaaagtgagtctacattc

SEQ ID NO: 614111 - DNA, 25 bp, Homo sapien
gtgagtctacattcttatctgagga

SEQ ID NO: 614112 - DNA, 25 bp, Homo sapien
ttatctgaggatgctctctcctcga

SEQ ID NO: 614113 - DNA, 25 bp, Homo sapien
tgaggatgctctctcctcgagccta

SEQ ID NO: 614114 - DNA, 25 bp, Homo sapien
tctcctcgagcctatctgcaaaaat

SEQ ID NO: 614115 - DNA, 25 bp, Homo sapien
cctcgagcctatctgcaaaaataag

SEQ ID NO: 614116 - DNA, 25 bp, Homo sapien
ggacaagagctaggcatgtacttct

SEQ ID NO: 614117 - DNA, 25 bp, Homo sapien
taggcatgtacttctgaccaggtgg

SEQ ID NO: 614118 - DNA, 25 bp, Homo sapien
gaccaggtgggtaagcaactctaag

SEQ ID NO: 614119 - DNA, 25 bp, Homo sapien
ggtaagcaactctaagtctgtattt

SEQ ID NO: 614120 - DNA, 25 bp, Homo sapien
gtctgtatttgtattggtcattctc

SEQ ID NO: 614121 - DNA, 25 bp, Homo sapien
ggtcattctcagtggaaatccctta

SEQ ID NO: 614122 - DNA, 25 bp, Homo sapien
ggaaatcccttaggccctctagtgg

SEQ ID NO: 614123 - DNA, 25 bp, Homo sapien
tttcccctacctgcatattggtttt

SEQ ID NO: 614124 - DNA, 25 bp, Homo sapien
ctgcatattggttttcatgttttat

SEQ ID NO: 614125 - DNA, 25 bp, Homo sapien
ttatattcactgttactatcttctg

SEQ ID NO: 614126 - DNA, 25 bp, Homo sapien
gttactatcttctgtgtttaattaa

SEQ ID NO: 614127 - DNA, 25 bp, Homo sapien
ggtacctcctgctgaggaaaagtta

SEQ ID NO: 614128 - DNA, 25 bp, Homo sapien
ctcctgctgaggaaaagttaggttc

SEQ ID NO: 614129 - DNA, 25 bp, Homo sapien
gaaaagttaggttccaggctgcaag

SEQ ID NO: 614130 - DNA, 25 bp, Homo sapien
aagttaggttccaggctgcaagtta

SEQ ID NO: 614131 - DNA, 25 bp, Homo sapien
ttaggttccaggctgcaagttacca

SEQ ID NO: 614132 - DNA, 25 bp, Homo sapien
aggttccaggctgcaagttaccaca

SEQ ID NO: 614133 - DNA, 25 bp, Homo sapien
gttccaggctgcaagttaccacaat

SEQ ID NO: 614134 - DNA, 25 bp, Homo sapien
ttccaggctgcaagttaccacaatc

SEQ ID NO: 614135 - DNA, 25 bp, Homo sapien
caggctgcaagttaccacaatccaa

SEQ ID NO: 614136 - DNA, 25 bp, Homo sapien
ggctgcaagttaccacaatccaagt

SEQ ID NO: 614137 - DNA, 25 bp, Homo sapien
ctgcaagttaccacaatccaagtga

SEQ ID NO: 614138 - DNA, 25 bp, Homo sapien
gctctgattcctaagaattcttctg

SEQ ID NO: 614139 - DNA, 25 bp, Homo sapien
ttcctattggaggtgttaaatctac

SEQ ID NO: 614140 - DNA, 25 bp, Homo sapien
ggtgttaaatctacaagcaagacat

SEQ ID NO: 614141 - DNA, 25 bp, Homo sapien
gcaagacatatgttataagtcgaac

SEQ ID NO: 614142 - DNA, 25 bp, Homo sapien
taagtcgaactgaaccagcgatggc

SEQ ID NO: 614143 - DNA, 25 bp, Homo sapien
cagcgatggcaactacaaaagcagt

SEQ ID NO: 614144 - DNA, 25 bp, Homo sapien
acaatctcacactttttctacacat

SEQ ID NO: 614145 - DNA, 25 bp, Homo sapien
ctcacactttttctacacattgctt

SEQ ID NO: 614146 - DNA, 25 bp, Homo sapien
ctacacattgcttttacctttataa

SEQ ID NO: 614147 - DNA, 25 bp, Homo sapien
ttttacctttataatgtagcagtga

SEQ ID NO: 614148 - DNA, 25 bp, Homo sapien
gaacttaatatccaactgatcatag

SEQ ID NO: 614149 - DNA, 25 bp, Homo sapien
gggcactctgaatcatcagtccgtc

SEQ ID NO: 614150 - DNA, 25 bp, Homo sapien
ctgaatcatcagtccgtctttagaa

SEQ ID NO: 614151 - DNA, 25 bp, Homo sapien
atcatcagtccgtctttagaactcc

SEQ ID NO: 614152 - DNA, 25 bp, Homo sapien
gtctttagaactccccacatggtca

SEQ ID NO: 614153 - DNA, 25 bp, Homo sapien
gaactccccacatggtcagctgagg

SEQ ID NO: 614154 - DNA, 25 bp, Homo sapien
gaggcattccattgagaatgcatca

SEQ ID NO: 614155 - DNA, 25 bp, Homo sapien
gaatgcatcatgtcttgacttctct

SEQ ID NO: 614156 - DNA, 25 bp, Homo sapien
atgtcttgacttctctctctggcca

SEQ ID NO: 614157 - DNA, 25 bp, Homo sapien
aatcctgccgtcattgcatttctta

SEQ ID NO: 614158 - DNA, 25 bp, Homo sapien
gtcattgcatttcttaataaacctc

SEQ ID NO: 614159 - DNA, 25 bp, Homo sapien
tgaaaaatgtcctctcacatgcagc

SEQ ID NO: 614160 - DNA, 25 bp, Homo sapien
ggcccttgtctcttatttctgtcat

SEQ ID NO: 614161 - DNA, 25 bp, Homo sapien
atttctgtcatactaaacattgtac

SEQ ID NO: 614162 - DNA, 25 bp, Homo sapien
actaaacattgtacttctttttctg

SEQ ID NO: 614163 - DNA, 25 bp, Homo sapien
gtacttctttttctgcattagaatt

SEQ ID NO: 614164 - DNA, 25 bp, Homo sapien
attaaatggacttttatcagctttg

SEQ ID NO: 614165 - DNA, 25 bp, Homo sapien
aaatggacttttatcagctttgata

SEQ ID NO: 614166 - DNA, 25 bp, Homo sapien
agctttgataaactgtattcccagc

SEQ ID NO: 614167 - DNA, 25 bp, Homo sapien
gataaactgtattcccagcattgag

SEQ ID NO: 614168 - DNA, 25 bp, Homo sapien
gagaacattgcttagtggatagtag

SEQ ID NO: 614169 - DNA, 25 bp, Homo sapien
cattgcttagtggatagtaggtatt

SEQ ID NO: 614170 - DNA, 25 bp, Homo sapien
gcttagtggatagtaggtattcaca

SEQ ID NO: 614171 - DNA, 25 bp, Homo sapien
gatcagaggtcatactgtgaagcac

SEQ ID NO: 614172 - DNA, 25 bp, Homo sapien
agaggtcatactgtgaagcaccttt

SEQ ID NO: 614173 - DNA, 25 bp, Homo sapien
aggtcatactgtgaagcacctttgg

SEQ ID NO: 614174 - DNA, 25 bp, Homo sapien
gcacctttggataaacggcagggac

SEQ ID NO: 614175 - DNA, 25 bp, Homo sapien
atccattgaaaggtctcatgcaggg

SEQ ID NO: 614176 - DNA, 25 bp, Homo sapien
ccattgaaaggtctcatgcagggaa

SEQ ID NO: 614177 - DNA, 25 bp, Homo sapien
gatatctctcaatagaatgttgcag

SEQ ID NO: 614178 - DNA, 25 bp, Homo sapien
aatgttgcagttttagtattctcct

SEQ ID NO: 614179 - DNA, 25 bp, Homo sapien
gttgcagttttagtattctcctatt

SEQ ID NO: 614180 - DNA, 25 bp, Homo sapien
tgcagttttagtattctcctattaa

SEQ ID NO: 614181 - DNA, 25 bp, Homo sapien
ttagtattctcctattaaacatttg

SEQ ID NO: 614182 - DNA, 25 bp, Homo sapien
tattcttaagaaatgcttgctaaag

SEQ ID NO: 614183 - DNA, 25 bp, Homo sapien
taagaaatgcttgctaaagtgtcat

SEQ ID NO: 614184 - DNA, 25 bp, Homo sapien
gaaagaaggtacagtcaatgtggca

SEQ ID NO: 614185 - DNA, 25 bp, Homo sapien
aagaaggtacagtcaatgtggcaaa

SEQ ID NO: 614186 - DNA, 25 bp, Homo sapien
gaaggtacagtcaatgtggcaaaca

SEQ ID NO: 614187 - DNA, 25 bp, Homo sapien
aaggtacagtcaatgtggcaaacat

SEQ ID NO: 614188 - DNA, 25 bp, Homo sapien
aggtacagtcaatgtggcaaacatt

SEQ ID NO: 614189 - DNA, 25 bp, Homo sapien
gtggcaaacattaacagccggaaaa

SEQ ID NO: 614190 - DNA, 25 bp, Homo sapien
gcaaacattaacagccggaaaatct

SEQ ID NO: 614191 - DNA, 25 bp, Homo sapien
attaacagccggaaaatctacatga

SEQ ID NO: 614192 - DNA, 25 bp, Homo sapien
taacagccggaaaatctacatgaag

SEQ ID NO: 614193 - DNA, 25 bp, Homo sapien
taaaactacaaacatcagccgaggt

SEQ ID NO: 614194 - DNA, 25 bp, Homo sapien
aaactacaaacatcagccgaggttg

SEQ ID NO: 614195 - DNA, 25 bp, Homo sapien
actacaaacatcagccgaggttggt

SEQ ID NO: 614196 - DNA, 25 bp, Homo sapien
ctacaaacatcagccgaggttggtg

SEQ ID NO: 614197 - DNA, 25 bp, Homo sapien
caaacatcagccgaggttggtggta

SEQ ID NO: 614198 - DNA, 25 bp, Homo sapien
aaacatcagccgaggttggtggtat

SEQ ID NO: 614199 - DNA, 25 bp, Homo sapien
aacatcagccgaggttggtggtatg

SEQ ID NO: 614200 - DNA, 25 bp, Homo sapien
acatcagccgaggttggtggtatgc

SEQ ID NO: 614201 - DNA, 25 bp, Homo sapien
catcagccgaggttggtggtatgca

SEQ ID NO: 614202 - DNA, 25 bp, Homo sapien
atcagccgaggttggtggtatgcac

SEQ ID NO: 614203 - DNA, 25 bp, Homo sapien
tcagccgaggttggtggtatgcacc

SEQ ID NO: 614204 - DNA, 25 bp, Homo sapien
agcgccccctgcaggcagtgaagag

SEQ ID NO: 614205 - DNA, 25 bp, Homo sapien
ggagccagagaagcctttaagcaag

SEQ ID NO: 614206 - DNA, 25 bp, Homo sapien
gaagtcaatagatgctgtgagattt

SEQ ID NO: 614207 - DNA, 25 bp, Homo sapien
tttggtcacatatgagtaatctcaa

SEQ ID NO: 614208 - DNA, 25 bp, Homo sapien
agtctgatctggctttttccttgta

SEQ ID NO: 614209 - DNA, 25 bp, Homo sapien
tgatctggctttttccttgtactat

SEQ ID NO: 614210 - DNA, 25 bp, Homo sapien
ggctttttccttgtactatgattta

SEQ ID NO: 614211 - DNA, 25 bp, Homo sapien
atgatttagggcattctgtcctctg

SEQ ID NO: 614212 - DNA, 25 bp, Homo sapien
tctgcccctgactgctaagtgttga

SEQ ID NO: 614213 - DNA, 25 bp, Homo sapien
gcccctgactgctaagtgttgagaa

SEQ ID NO: 614214 - DNA, 25 bp, Homo sapien
gcaaatttaaccatacatagagtgt

SEQ ID NO: 614215 - DNA, 25 bp, Homo sapien
atccaccactgctgagaaccaatcg

SEQ ID NO: 614216 - DNA, 25 bp, Homo sapien
tgctgagaaccaatcggccaggccc

SEQ ID NO: 614217 - DNA, 25 bp, Homo sapien
tctgctctgacttcatgcaaaccta

SEQ ID NO: 614218 - DNA, 25 bp, Homo sapien
tgacttcatgcaaacctaacctaac

SEQ ID NO: 614219 - DNA, 25 bp, Homo sapien
gcaaacctaacctaaccttcactgg

SEQ ID NO: 614220 - DNA, 25 bp, Homo sapien
ttcactggctccaaaatctccattt

SEQ ID NO: 614221 - DNA, 25 bp, Homo sapien
ggctccaaaatctccatttctggat

SEQ ID NO: 614222 - DNA, 25 bp, Homo sapien
tctggatcccagtggtctgacccca

SEQ ID NO: 614223 - DNA, 25 bp, Homo sapien
tctcctcctagccaaggtcaggcaa

SEQ ID NO: 614224 - DNA, 25 bp, Homo sapien
gaaaatggtacttcctgcaaagctc

SEQ ID NO: 614225 - DNA, 25 bp, Homo sapien
ggtacttcctgcaaagctctctttg

SEQ ID NO: 614226 - DNA, 25 bp, Homo sapien
aaatgcttgctacctattaactagt

SEQ ID NO: 614227 - DNA, 25 bp, Homo sapien
gcttgctacctattaactagtattt

SEQ ID NO: 614228 - DNA, 25 bp, Homo sapien
actagtatttgtttctaaggctaat

SEQ ID NO: 614229 - DNA, 25 bp, Homo sapien
ctaaggctaatttaagtcctagaat

SEQ ID NO: 614230 - DNA, 25 bp, Homo sapien
tttaagtcctagaattgattgcaag

SEQ ID NO: 614231 - DNA, 25 bp, Homo sapien
gattgcaaggattagatcaggagta

SEQ ID NO: 614232 - DNA, 25 bp, Homo sapien
agatcaggagtatagtggacatgtt

SEQ ID NO: 614233 - DNA, 25 bp, Homo sapien
aatatagagatgctttttaggacca

SEQ ID NO: 614234 - DNA, 25 bp, Homo sapien
tagagatgctttttaggaccattgt

SEQ ID NO: 614235 - DNA, 25 bp, Homo sapien
tttttaccaagttcacacagaaatg

SEQ ID NO: 614236 - DNA, 25 bp, Homo sapien
agaaatgtaggtgcattggctgggc

SEQ ID NO: 614237 - DNA, 25 bp, Homo sapien
aatgaaccgcatttagtggacccgg

SEQ ID NO: 614238 - DNA, 25 bp, Homo sapien
cgcatttagtggacccggaggcagc

SEQ ID NO: 614239 - DNA, 25 bp, Homo sapien
gaggcagcccaaatagtcccagaaa

SEQ ID NO: 614240 - DNA, 25 bp, Homo sapien
tagtcccagaaaggctgggttgctt

SEQ ID NO: 614241 - DNA, 25 bp, Homo sapien
tgggttgcttaatgggtggcttcac

SEQ ID NO: 614242 - DNA, 25 bp, Homo sapien
atagagcgtagggacaaccgcctca

SEQ ID NO: 614243 - DNA, 25 bp, Homo sapien
aaccgcctcacctctgaagatactg

SEQ ID NO: 614244 - DNA, 25 bp, Homo sapien
ctctgaagatactgccgtggcgggc

SEQ ID NO: 614245 - DNA, 25 bp, Homo sapien
ctcccttggccatcgggctgtgagt

SEQ ID NO: 614246 - DNA, 25 bp, Homo sapien
gggacacctgcattatggctcacgt

SEQ ID NO: 614247 - DNA, 25 bp, Homo sapien
gaggcagccccatgtcggacaataa

SEQ ID NO: 614248 - DNA, 25 bp, Homo sapien
ccccttgatctggacagagatgtgg

SEQ ID NO: 614249 - DNA, 25 bp, Homo sapien
gggtacctgttcaccattcattaga

SEQ ID NO: 614250 - DNA, 25 bp, Homo sapien
attcattagatgctcgggaagcctt

SEQ ID NO: 614251 - DNA, 25 bp, Homo sapien
aattctacaaagatctttccctcat

SEQ ID NO: 614252 - DNA, 25 bp, Homo sapien
aagatctttccctcatagaagtatg

SEQ ID NO: 614253 - DNA, 25 bp, Homo sapien
gtgaagaccatgagtcattttacca

SEQ ID NO: 614254 - DNA, 25 bp, Homo sapien
tttaccaatatggaaacagaggccc

SEQ ID NO: 614255 - DNA, 25 bp, Homo sapien
gagagccctgggaatataaacatat

SEQ ID NO: 614256 - DNA, 25 bp, Homo sapien
aaacatattcccaagaccacggagt

SEQ ID NO: 614257 - DNA, 25 bp, Homo sapien
aagaccacggagtcccagatgggct

SEQ ID NO: 614258 - DNA, 25 bp, Homo sapien
agatgggctcccactgtgacttggc

SEQ ID NO: 614259 - DNA, 25 bp, Homo sapien
tggctgcaggattcaacctcccgga

SEQ ID NO: 614260 - DNA, 25 bp, Homo sapien
tgcaggattcaacctcccggaggag

SEQ ID NO: 614261 - DNA, 25 bp, Homo sapien
caggattcaacctcccggaggagga

SEQ ID NO: 614262 - DNA, 25 bp, Homo sapien
gggcactgggcagcgccttacaggg

SEQ ID NO: 614263 - DNA, 25 bp, Homo sapien
gctgcactccttggagctcgtctta

SEQ ID NO: 614264 - DNA, 25 bp, Homo sapien
actccttggagctcgtcttatctcg

SEQ ID NO: 614265 - DNA, 25 bp, Homo sapien
ttggagctcgtcttatctcgggccg

SEQ ID NO: 614266 - DNA, 25 bp, Homo sapien
ggagctcgtcttatctcgggccgtg

SEQ ID NO: 614267 - DNA, 25 bp, Homo sapien
gctcgtcttatctcgggccgtgcgg

SEQ ID NO: 614268 - DNA, 25 bp, Homo sapien
atctcgggccgtgcgggagttgctg

SEQ ID NO: 614269 - DNA, 25 bp, Homo sapien
gctgtccaaggctgggcactcagtc

SEQ ID NO: 614270 - DNA, 25 bp, Homo sapien
cccactcactgtccgaatctggttg

SEQ ID NO: 614271 - DNA, 25 bp, Homo sapien
tccgtcgggacgtttcagggtgtca

SEQ ID NO: 614272 - DNA, 25 bp, Homo sapien
gtttcagggtgtcagcgtcttagct

SEQ ID NO: 614273 - DNA, 25 bp, Homo sapien
tcagcgtcttagctgctctcactga

SEQ ID NO: 614274 - DNA, 25 bp, Homo sapien
tctcactgaccttcatcataagagg

SEQ ID NO: 614275 - DNA, 25 bp, Homo sapien
gacaggcaattgcacagcctctgtg

SEQ ID NO: 614276 - DNA, 25 bp, Homo sapien
agcctctgtgttgctgcttttggaa

SEQ ID NO: 614277 - DNA, 25 bp, Homo sapien
gtgttgctgcttttggaattcacgc

SEQ ID NO: 614278 - DNA, 25 bp, Homo sapien
ggaattcacgcagcttgttttagag

SEQ ID NO: 614279 - DNA, 25 bp, Homo sapien
ggagccttagctaatcagctgtatt

SEQ ID NO: 614280 - DNA, 25 bp, Homo sapien
agctgtatttaaggtttctgaatca

SEQ ID NO: 614281 - DNA, 25 bp, Homo sapien
atgatttacaaaggcaggacaacag

SEQ ID NO: 614282 - DNA, 25 bp, Homo sapien
tttacaaaggcaggacaacagagtt

SEQ ID NO: 614283 - DNA, 25 bp, Homo sapien
caacagagttgtaacgggtttgaag

SEQ ID NO: 614284 - DNA, 25 bp, Homo sapien
cgaaagaggaagtctgaaatgttac

SEQ ID NO: 614285 - DNA, 25 bp, Homo sapien
tgaggaacatggtgacgagtagcaa

SEQ ID NO: 614286 - DNA, 25 bp, Homo sapien
aacatggtgacgagtagcaagagac

SEQ ID NO: 614287 - DNA, 25 bp, Homo sapien
gggactgtctcagccatgcaaacct

SEQ ID NO: 614288 - DNA, 25 bp, Homo sapien
gtctcagccatgcaaacctcatgga

SEQ ID NO: 614289 - DNA, 25 bp, Homo sapien
gcaaacctcatggagcattttggaa

SEQ ID NO: 614290 - DNA, 25 bp, Homo sapien
acctcatggagcattttggaaagtt

SEQ ID NO: 614291 - DNA, 25 bp, Homo sapien
tttgtcatgtttactttcaaacatg

SEQ ID NO: 614292 - DNA, 25 bp, Homo sapien
agcattaaaagttgaaaggttcacg

SEQ ID NO: 614293 - DNA, 25 bp, Homo sapien
gcattaaaagttgaaaggttcacgc

SEQ ID NO: 614294 - DNA, 25 bp, Homo sapien
ttaaaagttgaaaggttcacgcctg

SEQ ID NO: 614295 - DNA, 25 bp, Homo sapien
taaaagttgaaaggttcacgcctgt

SEQ ID NO: 614296 - DNA, 25 bp, Homo sapien
tagccagacatcgtagcacgcactt

SEQ ID NO: 614297 - DNA, 25 bp, Homo sapien
agccagacatcgtagcacgcactta

SEQ ID NO: 614298 - DNA, 25 bp, Homo sapien
gccagacatcgtagcacgcacttat

SEQ ID NO: 614299 - DNA, 25 bp, Homo sapien
ccagacatcgtagcacgcacttata

SEQ ID NO: 614300 - DNA, 25 bp, Homo sapien
cagacatcgtagcacgcacttataa

SEQ ID NO: 614301 - DNA, 25 bp, Homo sapien
cactcaaaaagaattcctggctggg

SEQ ID NO: 614302 - DNA, 25 bp, Homo sapien
agaattcctggctgggtgcggttgg

SEQ ID NO: 614303 - DNA, 25 bp, Homo sapien
ttcctggctgggtgcggttggctca

SEQ ID NO: 614304 - DNA, 25 bp, Homo sapien
aggcatggcaacgtgtacctgtaat

SEQ ID NO: 614305 - DNA, 25 bp, Homo sapien
ggcatggcaacgtgtacctgtaatc

SEQ ID NO: 614306 - DNA, 25 bp, Homo sapien
gcatggcaacgtgtacctgtaatcc

SEQ ID NO: 614307 - DNA, 25 bp, Homo sapien
aaattgcttgaaccgctcagacaga

SEQ ID NO: 614308 - DNA, 25 bp, Homo sapien
tgcttgaaccgctcagacagagcaa

SEQ ID NO: 614309 - DNA, 25 bp, Homo sapien
gcttgaaccgctcagacagagcaag

SEQ ID NO: 614310 - DNA, 25 bp, Homo sapien
ttgaaccgctcagacagagcaagac

SEQ ID NO: 614311 - DNA, 25 bp, Homo sapien
tgaaccgctcagacagagcaagact

SEQ ID NO: 614312 - DNA, 25 bp, Homo sapien
tgcagaatggaaatttgactcaaat

SEQ ID NO: 614313 - DNA, 25 bp, Homo sapien
tgactcaaatatgggttgacttcat

SEQ ID NO: 614314 - DNA, 25 bp, Homo sapien
gacttcattatcaacagggaactgt

SEQ ID NO: 614315 - DNA, 25 bp, Homo sapien
ctgtgatatttgcttaagttctata

SEQ ID NO: 614316 - DNA, 25 bp, Homo sapien
aggaattttgtttgatgcaactatg

SEQ ID NO: 614317 - DNA, 25 bp, Homo sapien
gcaactatgtaaagatatcctggtg

SEQ ID NO: 614318 - DNA, 25 bp, Homo sapien
tatcctggtggaactattgtgagag

SEQ ID NO: 614319 - DNA, 25 bp, Homo sapien
gagttagtcatggacatgcaaaact

SEQ ID NO: 614320 - DNA, 25 bp, Homo sapien
aaactctgtgtcaaatctatataat

SEQ ID NO: 614321 - DNA, 25 bp, Homo sapien
ctttgatgccaatagtgccttctga

SEQ ID NO: 614322 - DNA, 25 bp, Homo sapien
ctgaaagtatggtatcatggatgac

SEQ ID NO: 614323 - DNA, 25 bp, Homo sapien
gccagagacagccatacttacagga

SEQ ID NO: 614324 - DNA, 25 bp, Homo sapien
tacttacaggactggaggctgccac

SEQ ID NO: 614325 - DNA, 25 bp, Homo sapien
tggaggctgccaccactgacatgtt

SEQ ID NO: 614326 - DNA, 25 bp, Homo sapien
tgacatgttccaccagattcttgtt

SEQ ID NO: 614327 - DNA, 25 bp, Homo sapien
tccaccagattcttgttgggctcaa

SEQ ID NO: 614328 - DNA, 25 bp, Homo sapien
gttgggctcaagaagcattcaagct

SEQ ID NO: 614329 - DNA, 25 bp, Homo sapien
cccttcgtatttatgaaatccggag

SEQ ID NO: 614330 - DNA, 25 bp, Homo sapien
aaatccggaggtactggagcagcgc

SEQ ID NO: 614331 - DNA, 25 bp, Homo sapien
ggagcagcgctgtatgtccagcatc

SEQ ID NO: 614332 - DNA, 25 bp, Homo sapien
gaaaggcctgctcatataatttcct

SEQ ID NO: 614333 - DNA, 25 bp, Homo sapien
tataatttcctacggcctcaggcca

SEQ ID NO: 614334 - DNA, 25 bp, Homo sapien
atgtctatattgcagcagaattgtg

SEQ ID NO: 614335 - DNA, 25 bp, Homo sapien
gcagcagaattgtgggtaaactaaa

SEQ ID NO: 614336 - DNA, 25 bp, Homo sapien
ccttctggcacagggacaggctagg

SEQ ID NO: 614337 - DNA, 25 bp, Homo sapien
tcatggagagtggtgctaagagcat

SEQ ID NO: 614338 - DNA, 25 bp, Homo sapien
gaaggcactcttatggtggaggcca

SEQ ID NO: 614339 - DNA, 25 bp, Homo sapien
gcactcttatggtggaggccatgcc

SEQ ID NO: 614340 - DNA, 25 bp, Homo sapien
ggaggccatgccctgtatctttcag

SEQ ID NO: 614341 - DNA, 25 bp, Homo sapien
atgccctgtatctttcaggacctgt

SEQ ID NO: 614342 - DNA, 25 bp, Homo sapien
tcaggacctgttttagttgctctaa

SEQ ID NO: 614343 - DNA, 25 bp, Homo sapien
ctgttttagttgctctaatgaggca

SEQ ID NO: 614344 - DNA, 25 bp, Homo sapien
aaaaagaatgttgcttagccctcct

SEQ ID NO: 614345 - DNA, 25 bp, Homo sapien
agcccgaggtgggtcccacccgcat

SEQ ID NO: 614346 - DNA, 25 bp, Homo sapien
gaggtgggtcccacccgcatctcct

SEQ ID NO: 614347 - DNA, 25 bp, Homo sapien
ccagccctggagaagtagctctggc

SEQ ID NO: 614348 - DNA, 25 bp, Homo sapien
aagtagctctggcttgtcttctttt

SEQ ID NO: 614349 - DNA, 25 bp, Homo sapien
agtagctctggcttgtcttcttttt

SEQ ID NO: 614350 - DNA, 25 bp, Homo sapien
gtagctctggcttgtcttctttttc

SEQ ID NO: 614351 - DNA, 25 bp, Homo sapien
tagctctggcttgtcttctttttca

SEQ ID NO: 614352 - DNA, 25 bp, Homo sapien
agctctggcttgtcttctttttcat

SEQ ID NO: 614353 - DNA, 25 bp, Homo sapien
gctctggcttgtcttctttttcatt

SEQ ID NO: 614354 - DNA, 25 bp, Homo sapien
ataatttatgtatcgactaagaaat

SEQ ID NO: 614355 - DNA, 25 bp, Homo sapien
gaaataataaggtacattcagatgt

SEQ ID NO: 614356 - DNA, 25 bp, Homo sapien
cgcgttcggcgaaaacacacatttt

SEQ ID NO: 614357 - DNA, 25 bp, Homo sapien
attttctaagaaactgattgctggg

SEQ ID NO: 614358 - DNA, 25 bp, Homo sapien
agaaactgattgctgggaaggctac

SEQ ID NO: 614359 - DNA, 25 bp, Homo sapien
gaaggctacagtgggtaagagctct

SEQ ID NO: 614360 - DNA, 25 bp, Homo sapien
ggtaagagctcttgctctctgtggg

SEQ ID NO: 614361 - DNA, 25 bp, Homo sapien
cttgctctctgtgggcctgcctggt

SEQ ID NO: 614362 - DNA, 25 bp, Homo sapien
ggttcggaatcagggcagtgctctc

SEQ ID NO: 614363 - DNA, 25 bp, Homo sapien
agtgctctctgcctaagtgaacttg

SEQ ID NO: 614364 - DNA, 25 bp, Homo sapien
gcctaagtgaacttgggcaattttc

SEQ ID NO: 614365 - DNA, 25 bp, Homo sapien
gggcaattttctacaaacctcagtt

SEQ ID NO: 614366 - DNA, 25 bp, Homo sapien
tcagtttctgcacccgtaaagtagc

SEQ ID NO: 614367 - DNA, 25 bp, Homo sapien
caattccattcaataccaattgatg

SEQ ID NO: 614368 - DNA, 25 bp, Homo sapien
aattccattcaataccaattgatga

SEQ ID NO: 614369 - DNA, 25 bp, Homo sapien
attccattcaataccaattgatgat

SEQ ID NO: 614370 - DNA, 25 bp, Homo sapien
ttccattcaataccaattgatgatg

SEQ ID NO: 614371 - DNA, 25 bp, Homo sapien
tccattcaataccaattgatgatgg

SEQ ID NO: 614372 - DNA, 25 bp, Homo sapien
cattcaataccaattgatgatggtt

SEQ ID NO: 614373 - DNA, 25 bp, Homo sapien
attcaataccaattgatgatggtta

SEQ ID NO: 614374 - DNA, 25 bp, Homo sapien
ttcaataccaattgatgatggttat

SEQ ID NO: 614375 - DNA, 25 bp, Homo sapien
tgatgatggttatttttgattccat

SEQ ID NO: 614376 - DNA, 25 bp, Homo sapien
gatgatggttatttttgattccatt

SEQ ID NO: 614377 - DNA, 25 bp, Homo sapien
tgattctattcgattgcattcgata

SEQ ID NO: 614378 - DNA, 25 bp, Homo sapien
gtactcgagaagtatgtcacaggtt

SEQ ID NO: 614379 - DNA, 25 bp, Homo sapien
gtcacaggtttattgctggtatcaa

SEQ ID NO: 614380 - DNA, 25 bp, Homo sapien
attgctggtatcaataaagtctcta

SEQ ID NO: 614381 - DNA, 25 bp, Homo sapien
gtctctatagtgtgtggcaatccat

SEQ ID NO: 614382 - DNA, 25 bp, Homo sapien
gtgtgtggcaatccatgttttaaaa

SEQ ID NO: 614383 - DNA, 25 bp, Homo sapien
aggagttagctttgtgatcatagat

SEQ ID NO: 614384 - DNA, 25 bp, Homo sapien
gttagctttgtgatcatagattatc

SEQ ID NO: 614385 - DNA, 25 bp, Homo sapien
gattatcaaatctaatatgccacca

SEQ ID NO: 614386 - DNA, 25 bp, Homo sapien
atatgccaccaattataagatttat

SEQ ID NO: 614387 - DNA, 25 bp, Homo sapien
gatttattccagtttttgagatgta

SEQ ID NO: 614388 - DNA, 25 bp, Homo sapien
gtgaaataaagtgcacctaagaatt

SEQ ID NO: 614389 - DNA, 25 bp, Homo sapien
gttggtcatgcaattcaaatattaa

SEQ ID NO: 614390 - DNA, 25 bp, Homo sapien
gaatcttgtaatgcatctggtttaa

SEQ ID NO: 614391 - DNA, 25 bp, Homo sapien
cttgtaatgcatctggtttaatacc

SEQ ID NO: 614392 - DNA, 25 bp, Homo sapien
aatgcatctggtttaatacctgtca

SEQ ID NO: 614393 - DNA, 25 bp, Homo sapien
gcatctggtttaatacctgtcattt

SEQ ID NO: 614394 - DNA, 25 bp, Homo sapien
ggtttaatacctgtcattttgtaga

SEQ ID NO: 614395 - DNA, 25 bp, Homo sapien
tgtcattttgtagaacggttaaatg

SEQ ID NO: 614396 - DNA, 25 bp, Homo sapien
ttcccaaggtcatacacctaatcag

SEQ ID NO: 614397 - DNA, 25 bp, Homo sapien
caaggtcatacacctaatcagtggt

SEQ ID NO: 614398 - DNA, 25 bp, Homo sapien
ggtcatacacctaatcagtggtata

SEQ ID NO: 614399 - DNA, 25 bp, Homo sapien
catacacctaatcagtggtatattc

SEQ ID NO: 614400 - DNA, 25 bp, Homo sapien
gggaataacttactctttaagtcag

SEQ ID NO: 614401 - DNA, 25 bp, Homo sapien
taaatttgtaccagctttttcctct

SEQ ID NO: 614402 - DNA, 25 bp, Homo sapien
ttgtaccagctttttcctctacttg

SEQ ID NO: 614403 - DNA, 25 bp, Homo sapien
gttaagacctgtctccaatagacat

SEQ ID NO: 614404 - DNA, 25 bp, Homo sapien
gtctccaatagacattccaattgag

SEQ ID NO: 614405 - DNA, 25 bp, Homo sapien
gcaaattacattggtgtctgcccac

SEQ ID NO: 614406 - DNA, 25 bp, Homo sapien
gtctgcccaccactgaaggcaaaaa

SEQ ID NO: 614407 - DNA, 25 bp, Homo sapien
ggaggcaggtaacttctcggaccac

SEQ ID NO: 614408 - DNA, 25 bp, Homo sapien
ttctcggaccaccagattatcttga

SEQ ID NO: 614409 - DNA, 25 bp, Homo sapien
gattatcttgatcttcagccagctt

SEQ ID NO: 614410 - DNA, 25 bp, Homo sapien
cagccagctttattgttgttctaca

SEQ ID NO: 614411 - DNA, 25 bp, Homo sapien
acacccaggaacaagtttaccagct

SEQ ID NO: 614412 - DNA, 25 bp, Homo sapien
agtttaccagctatctaggcatcct

SEQ ID NO: 614413 - DNA, 25 bp, Homo sapien
tctaggcatccttcaatctgatcag

SEQ ID NO: 614414 - DNA, 25 bp, Homo sapien
gcatccttcaatctgatcaggttga

SEQ ID NO: 614415 - DNA, 25 bp, Homo sapien
tatattaacatcacaagtccttgtc

SEQ ID NO: 614416 - DNA, 25 bp, Homo sapien
tgtcaacttgaaccccttgtcaact

SEQ ID NO: 614417 - DNA, 25 bp, Homo sapien
cctgaaatcatatttaatctccaaa

SEQ ID NO: 614418 - DNA, 25 bp, Homo sapien
tacacctaacgtaatacagctatcc

SEQ ID NO: 614419 - DNA, 25 bp, Homo sapien
tacagctatccttcatacaaccaga

SEQ ID NO: 614420 - DNA, 25 bp, Homo sapien
atacaaccagaagcacactaatcct

SEQ ID NO: 614421 - DNA, 25 bp, Homo sapien
agcacactaatccttaacctaaatg

SEQ ID NO: 614422 - DNA, 25 bp, Homo sapien
tactaaaacccagtaatccctagag

SEQ ID NO: 614423 - DNA, 25 bp, Homo sapien
agaaagggcgtctcctgcagtattc

SEQ ID NO: 614424 - DNA, 25 bp, Homo sapien
gtctcctgcagtattccactgaaac

SEQ ID NO: 614425 - DNA, 25 bp, Homo sapien
gtattccactgaaactcgctggttt

SEQ ID NO: 614426 - DNA, 25 bp, Homo sapien
gaaactcgctggttttgctcgaatt

SEQ ID NO: 614427 - DNA, 25 bp, Homo sapien
gttttgctcgaattagacacttgaa

SEQ ID NO: 614428 - DNA, 25 bp, Homo sapien
agtggtttagtagtccaaatgctgt

SEQ ID NO: 614429 - DNA, 25 bp, Homo sapien
aaatgctgtgtattatgacagtgtc

SEQ ID NO: 614430 - DNA, 25 bp, Homo sapien
agtgtcttcctctgacgtatttata

SEQ ID NO: 614431 - DNA, 25 bp, Homo sapien
gttaagattatgtgggcaacagaca

SEQ ID NO: 614432 - DNA, 25 bp, Homo sapien
cagacaatataataaccctaacctt

SEQ ID NO: 614433 - DNA, 25 bp, Homo sapien
ctgatatcagaaaagtcccatggta

SEQ ID NO: 614434 - DNA, 25 bp, Homo sapien
gtcccatggtaaatgcaaatttcac

SEQ ID NO: 614435 - DNA, 25 bp, Homo sapien
tcacaaaattctaatgtttccttgg

SEQ ID NO: 614436 - DNA, 25 bp, Homo sapien
gtttccttggaatcttgaattttat

SEQ ID NO: 614437 - DNA, 25 bp, Homo sapien
ttggcaacaaatacagttttccttg

SEQ ID NO: 614438 - DNA, 25 bp, Homo sapien
ttccttgaaatgacagcctcacttt

SEQ ID NO: 614439 - DNA, 25 bp, Homo sapien
tttttgagtgagaagatacctgcca

SEQ ID NO: 614440 - DNA, 25 bp, Homo sapien
gaagatacctgccaaatattcaagt

SEQ ID NO: 614441 - DNA, 25 bp, Homo sapien
tcaagtctgaatggcgattgcttac

SEQ ID NO: 614442 - DNA, 25 bp, Homo sapien
gattgcttaccagtcattctttcat

SEQ ID NO: 614443 - DNA, 25 bp, Homo sapien
ttcatgttaaaatggtcttcctcca

SEQ ID NO: 614444 - DNA, 25 bp, Homo sapien
gaggccctctatgttgtattagcat

SEQ ID NO: 614445 - DNA, 25 bp, Homo sapien
tagcatgcactagaaggctctccaa

SEQ ID NO: 614446 - DNA, 25 bp, Homo sapien
gaaggctctccaacctgattgtaga

SEQ ID NO: 614447 - DNA, 25 bp, Homo sapien
tccaacctgattgtagagtccttca

SEQ ID NO: 614448 - DNA, 25 bp, Homo sapien
cagattctgctgaagtagatggtca

SEQ ID NO: 614449 - DNA, 25 bp, Homo sapien
gtcagagagtgcttgttataacatt

SEQ ID NO: 614450 - DNA, 25 bp, Homo sapien
taggaagggcaatgtgtttggcaca

SEQ ID NO: 614451 - DNA, 25 bp, Homo sapien
gtgtttggcacattctgagagtact

SEQ ID NO: 614452 - DNA, 25 bp, Homo sapien
gattctactagggatttcaaagcac

SEQ ID NO: 614453 - DNA, 25 bp, Homo sapien
ttgggtaaaggctctcatgtgtttt

SEQ ID NO: 614454 - DNA, 25 bp, Homo sapien
gttgacattgtgactgttatttcta

SEQ ID NO: 614455 - DNA, 25 bp, Homo sapien
accgaagcagcgtgtcctccgtggg

SEQ ID NO: 614456 - DNA, 25 bp, Homo sapien
ccgaagcagcgtgtcctccgtggga

SEQ ID NO: 614457 - DNA, 25 bp, Homo sapien
cgaagcagcgtgtcctccgtgggag

SEQ ID NO: 614458 - DNA, 25 bp, Homo sapien
gaagcagcgtgtcctccgtgggagc

SEQ ID NO: 614459 - DNA, 25 bp, Homo sapien
aagcagcgtgtcctccgtgggagcc

SEQ ID NO: 614460 - DNA, 25 bp, Homo sapien
agcagcgtgtcctccgtgggagccc

SEQ ID NO: 614461 - DNA, 25 bp, Homo sapien
gcagcgtgtcctccgtgggagcccg

SEQ ID NO: 614462 - DNA, 25 bp, Homo sapien
cagcgtgtcctccgtgggagcccga

SEQ ID NO: 614463 - DNA, 25 bp, Homo sapien
agcgtgtcctccgtgggagcccgag

SEQ ID NO: 614464 - DNA, 25 bp, Homo sapien
agatagtctaccgatcccatagtct

SEQ ID NO: 614465 - DNA, 25 bp, Homo sapien
gatcccatagtctgcggaccaatgc

SEQ ID NO: 614466 - DNA, 25 bp, Homo sapien
tagtctgcggaccaatgcctgccca

SEQ ID NO: 614467 - DNA, 25 bp, Homo sapien
ctggccattctccaggcagcaggaa

SEQ ID NO: 614468 - DNA, 25 bp, Homo sapien
ggctagccaagccatgttcctgagg

SEQ ID NO: 614469 - DNA, 25 bp, Homo sapien
agcggcctccagagatggataatga

SEQ ID NO: 614470 - DNA, 25 bp, Homo sapien
tggataatgagctcacctaccttgg

SEQ ID NO: 614471 - DNA, 25 bp, Homo sapien
agctcacctaccttggattcctgag

SEQ ID NO: 614472 - DNA, 25 bp, Homo sapien
tgagaggagttaatccctgcacccc

SEQ ID NO: 614473 - DNA, 25 bp, Homo sapien
gagatggatgtatgacttgacctgt

SEQ ID NO: 614474 - DNA, 25 bp, Homo sapien
aacaataaatgtgacttgtccacac

SEQ ID NO: 614475 - DNA, 25 bp, Homo sapien
accatctcttctgctgtgactgggt

SEQ ID NO: 614476 - DNA, 25 bp, Homo sapien
ctgtgactgggttgcctgaatttgt

SEQ ID NO: 614477 - DNA, 25 bp, Homo sapien
gaatttgtgggagacccgtgatccc

SEQ ID NO: 614478 - DNA, 25 bp, Homo sapien
ccgtgatcccatcccagagtgtgcg

SEQ ID NO: 614479 - DNA, 25 bp, Homo sapien
gggaatgcgctctggaaacaccctt

SEQ ID NO: 614480 - DNA, 25 bp, Homo sapien
aggagaccatccttggagtgaacgt

SEQ ID NO: 614481 - DNA, 25 bp, Homo sapien
tccttggagtgaacgtcccctgaca

SEQ ID NO: 614482 - DNA, 25 bp, Homo sapien
cctgacaccccaaggttcaaactgt

SEQ ID NO: 614483 - DNA, 25 bp, Homo sapien
aggttcaaactgtctcaagctgaga

SEQ ID NO: 614484 - DNA, 25 bp, Homo sapien
tagtagcagaattaacacagggttt

SEQ ID NO: 614485 - DNA, 25 bp, Homo sapien
cacagggttttaacttgcaatacgg

SEQ ID NO: 614486 - DNA, 25 bp, Homo sapien
gactgtattatttcttttgaacaca

SEQ ID NO: 614487 - DNA, 25 bp, Homo sapien
ttgcctatgtttactttcttgcata

SEQ ID NO: 614488 - DNA, 25 bp, Homo sapien
ctgcctatttaggtttactagtatt

SEQ ID NO: 614489 - DNA, 25 bp, Homo sapien
tacttggtatatattaatcgtgaaa

SEQ ID NO: 614490 - DNA, 25 bp, Homo sapien
gaagggcaatttaaggccgcatttt

SEQ ID NO: 614491 - DNA, 25 bp, Homo sapien
aaggccgcattttaagtcactatat

SEQ ID NO: 614492 - DNA, 25 bp, Homo sapien
tatgtaaatttaaacacccacgtgt

SEQ ID NO: 614493 - DNA, 25 bp, Homo sapien
taaacacccacgtgttaccgcagga

SEQ ID NO: 614494 - DNA, 25 bp, Homo sapien
gttaccgcaggatctctttatcaaa

SEQ ID NO: 614495 - DNA, 25 bp, Homo sapien
gcaggatctctttatcaaaatttca

SEQ ID NO: 614496 - DNA, 25 bp, Homo sapien
caaaatttcagttgaaagcacccgt

SEQ ID NO: 614497 - DNA, 25 bp, Homo sapien
caaaataaatgggttctctttcctg

SEQ ID NO: 614498 - DNA, 25 bp, Homo sapien
gttctctttcctgctgatatgaaat

SEQ ID NO: 614499 - DNA, 25 bp, Homo sapien
tgaaatgacatttaacccaccccga

SEQ ID NO: 614500 - DNA, 25 bp, Homo sapien
aacccaccccgagagattctagaga

SEQ ID NO: 614501 - DNA, 25 bp, Homo sapien
aaatgttactgatcccagggtccta

SEQ ID NO: 614502 - DNA, 25 bp, Homo sapien
tcccagggtcctagaaaatcttcaa

SEQ ID NO: 614503 - DNA, 25 bp, Homo sapien
tagaatcttagagggaccttacgcc

SEQ ID NO: 614504 - DNA, 25 bp, Homo sapien
gaccttacgccaactgagaaccatt

SEQ ID NO: 614505 - DNA, 25 bp, Homo sapien
atagccaattacctttatgttagcc

SEQ ID NO: 614506 - DNA, 25 bp, Homo sapien
tttatgttagcccttgatatcacat

SEQ ID NO: 614507 - DNA, 25 bp, Homo sapien
gatatcacataaccccataaatcct

SEQ ID NO: 614508 - DNA, 25 bp, Homo sapien
gggtttgtgcttggtcttactgaga

SEQ ID NO: 614509 - DNA, 25 bp, Homo sapien
ttggtcttactgagagctttcccta

SEQ ID NO: 614510 - DNA, 25 bp, Homo sapien
tgagagctttccctacttgaccaga

SEQ ID NO: 614511 - DNA, 25 bp, Homo sapien
gaccagaccccagcattgttctaga

SEQ ID NO: 614512 - DNA, 25 bp, Homo sapien
agatttgtctcttgtgggctacagg

SEQ ID NO: 614513 - DNA, 25 bp, Homo sapien
gcaaacattttgtagtttcctcttt

SEQ ID NO: 614514 - DNA, 25 bp, Homo sapien
ggcttgatgagccacacatgtttct

SEQ ID NO: 614515 - DNA, 25 bp, Homo sapien
gggacaacgaattgtttcatttgca

SEQ ID NO: 614516 - DNA, 25 bp, Homo sapien
catttgcatgtggtttttctcatga

SEQ ID NO: 614517 - DNA, 25 bp, Homo sapien
atcattaacatgagacagccccaaa

SEQ ID NO: 614518 - DNA, 25 bp, Homo sapien
gacagccccaaaccaaggaaaccag

SEQ ID NO: 614519 - DNA, 25 bp, Homo sapien
gtcaacaaaatttatgtaaggccag

SEQ ID NO: 614520 - DNA, 25 bp, Homo sapien
acaaaatttatgtaaggccagtaca

SEQ ID NO: 614521 - DNA, 25 bp, Homo sapien
attagtggggagataaaccttgtca

SEQ ID NO: 614522 - DNA, 25 bp, Homo sapien
aaaccttgtcatggatcagaagagt

SEQ ID NO: 614523 - DNA, 25 bp, Homo sapien
accttgtcatggatcagaagagttg

SEQ ID NO: 614524 - DNA, 25 bp, Homo sapien
tgtcatggatcagaagagttgttat

SEQ ID NO: 614525 - DNA, 25 bp, Homo sapien
tggatcagaagagttgttatgttta

SEQ ID NO: 614526 - DNA, 25 bp, Homo sapien
ttacaagctgattctaccatttata

SEQ ID NO: 614527 - DNA, 25 bp, Homo sapien
agctgattctaccatttatatggta

SEQ ID NO: 614528 - DNA, 25 bp, Homo sapien
ttatatggtaatgtcaatgatcaag

SEQ ID NO: 614529 - DNA, 25 bp, Homo sapien
ggtaatgtcaatgatcaagaataat

SEQ ID NO: 614530 - DNA, 25 bp, Homo sapien
gtgaacagccaactgacatgtagta

SEQ ID NO: 614531 - DNA, 25 bp, Homo sapien
agacaggatattagcatatggcaca

SEQ ID NO: 614532 - DNA, 25 bp, Homo sapien
gtaacacatacttagcatgcaccta

SEQ ID NO: 614533 - DNA, 25 bp, Homo sapien
tagcatgcacctatcaaatatgtat

SEQ ID NO: 614534 - DNA, 25 bp, Homo sapien
aaatatgtatcaggcacagtgccac

SEQ ID NO: 614535 - DNA, 25 bp, Homo sapien
agtgccacggccttaggatggagaa

SEQ ID NO: 614536 - DNA, 25 bp, Homo sapien
gttcttgctctcagagagcttagat

SEQ ID NO: 614537 - DNA, 25 bp, Homo sapien
gaagttgatagatgctgttttccaa

SEQ ID NO: 614538 - DNA, 25 bp, Homo sapien
gatgctgttttccaagtttctccac

SEQ ID NO: 614539 - DNA, 25 bp, Homo sapien
aagtttctccacttgtatttctgaa

SEQ ID NO: 614540 - DNA, 25 bp, Homo sapien
tgtatttctgaaactgtgaacagcc

SEQ ID NO: 614541 - DNA, 25 bp, Homo sapien
ggcctcccggagcacttaattacag

SEQ ID NO: 614542 - DNA, 25 bp, Homo sapien
cccggagcacttaattacaggaatg

SEQ ID NO: 614543 - DNA, 25 bp, Homo sapien
ggagcacttaattacaggaatgact

SEQ ID NO: 614544 - DNA, 25 bp, Homo sapien
caggaatgactgcatgtgctgttgt

SEQ ID NO: 614545 - DNA, 25 bp, Homo sapien
gctgttgtgcctatactttctggag

SEQ ID NO: 614546 - DNA, 25 bp, Homo sapien
gttgtgcctatactttctggagata

SEQ ID NO: 614547 - DNA, 25 bp, Homo sapien
gtgcctatactttctggagatacgt

SEQ ID NO: 614548 - DNA, 25 bp, Homo sapien
actttctggagatacgttgttagga

SEQ ID NO: 614549 - DNA, 25 bp, Homo sapien
tctggagatacgttgttaggaattt

SEQ ID NO: 614550 - DNA, 25 bp, Homo sapien
ggaatttatgtagttggccgggcac

SEQ ID NO: 614551 - DNA, 25 bp, Homo sapien
aatttatgtagttggccgggcacgg

SEQ ID NO: 614552 - DNA, 25 bp, Homo sapien
ccacattcttcttccactattagtt

SEQ ID NO: 614553 - DNA, 25 bp, Homo sapien
cattcttcttccactattagtttta

SEQ ID NO: 614554 - DNA, 25 bp, Homo sapien
atatgtgcttttcatgtctgcattc

SEQ ID NO: 614555 - DNA, 25 bp, Homo sapien
gtgcttttcatgtctgcattctgat

SEQ ID NO: 614556 - DNA, 25 bp, Homo sapien
tcatgtctgcattctgataaggaaa

SEQ ID NO: 614557 - DNA, 25 bp, Homo sapien
aagaatggccactaattgaattact

SEQ ID NO: 614558 - DNA, 25 bp, Homo sapien
aaaatgcagctgttctttgcaccca

SEQ ID NO: 614559 - DNA, 25 bp, Homo sapien
gcagctgttctttgcacccaaatga

SEQ ID NO: 614560 - DNA, 25 bp, Homo sapien
gctgttctttgcacccaaatgagtg

SEQ ID NO: 614561 - DNA, 25 bp, Homo sapien
tttgcacccaaatgagtgttaccat

SEQ ID NO: 614562 - DNA, 25 bp, Homo sapien
gagtgttaccattcaatttttcaaa

SEQ ID NO: 614563 - DNA, 25 bp, Homo sapien
ttactggcgtgaggcatcgtgccca

SEQ ID NO: 614564 - DNA, 25 bp, Homo sapien
tactggcgtgaggcatcgtgcccag

SEQ ID NO: 614565 - DNA, 25 bp, Homo sapien
ctggcgtgaggcatcgtgcccagca

SEQ ID NO: 614566 - DNA, 25 bp, Homo sapien
gtgcccagcaagctactgtcttttc

SEQ ID NO: 614567 - DNA, 25 bp, Homo sapien
tgcccagcaagctactgtcttttct

SEQ ID NO: 614568 - DNA, 25 bp, Homo sapien
gcccagcaagctactgtcttttctt

SEQ ID NO: 614569 - DNA, 25 bp, Homo sapien
ccagcaagctactgtcttttctttg

SEQ ID NO: 614570 - DNA, 25 bp, Homo sapien
cagcaagctactgtcttttctttga

SEQ ID NO: 614571 - DNA, 25 bp, Homo sapien
gcaagctactgtcttttctttgacc

SEQ ID NO: 614572 - DNA, 25 bp, Homo sapien
tgtcttttctttgaccctttccagt

SEQ ID NO: 614573 - DNA, 25 bp, Homo sapien
ttgaccctttccagtttttgaagat

SEQ ID NO: 614574 - DNA, 25 bp, Homo sapien
agtcctatgatttcatagatgtagc

SEQ ID NO: 614575 - DNA, 25 bp, Homo sapien
agatgtagcttaggataaggccaag

SEQ ID NO: 614576 - DNA, 25 bp, Homo sapien
taaggccaaggtagatgttgcctat

SEQ ID NO: 614577 - DNA, 25 bp, Homo sapien
ggccaaggtagatgttgcctatata

SEQ ID NO: 614578 - DNA, 25 bp, Homo sapien
ccaaggtagatgttgcctatataag

SEQ ID NO: 614579 - DNA, 25 bp, Homo sapien
aaggtagatgttgcctatataaggt

SEQ ID NO: 614580 - DNA, 25 bp, Homo sapien
agatgttgcctatataaggtttttt

SEQ ID NO: 614581 - DNA, 25 bp, Homo sapien
ttttttctcaagtataactagtcct

SEQ ID NO: 614582 - DNA, 25 bp, Homo sapien
tttctcaagtataactagtcctatg

SEQ ID NO: 614583 - DNA, 25 bp, Homo sapien
aagtataactagtcctatgatttca

SEQ ID NO: 614584 - DNA, 25 bp, Homo sapien
gtataactagtcctatgatttcata

SEQ ID NO: 614585 - DNA, 25 bp, Homo sapien
gaggtcaggaactcgagacgagacc

SEQ ID NO: 614586 - DNA, 25 bp, Homo sapien
ggaactcgagacgagaccaggctgg

SEQ ID NO: 614587 - DNA, 25 bp, Homo sapien
gaactcgagacgagaccaggctggg

SEQ ID NO: 614588 - DNA, 25 bp, Homo sapien
actccactccagtccaggtgaaaga

SEQ ID NO: 614589 - DNA, 25 bp, Homo sapien
ctccactccagtccaggtgaaagag

SEQ ID NO: 614590 - DNA, 25 bp, Homo sapien
tccactccagtccaggtgaaagagc

SEQ ID NO: 614591 - DNA, 25 bp, Homo sapien
ccactccagtccaggtgaaagagcc

SEQ ID NO: 614592 - DNA, 25 bp, Homo sapien
tccagtccaggtgaaagagccagat

SEQ ID NO: 614593 - DNA, 25 bp, Homo sapien
ccagtccaggtgaaagagccagatc

SEQ ID NO: 614594 - DNA, 25 bp, Homo sapien
cagtccaggtgaaagagccagatcc

SEQ ID NO: 614595 - DNA, 25 bp, Homo sapien
agtccaggtgaaagagccagatcct

SEQ ID NO: 614596 - DNA, 25 bp, Homo sapien
tgagcgatcccaccgaagcagcgtg

SEQ ID NO: 614597 - DNA, 25 bp, Homo sapien
ccgaagcagcgtgtcctccgtggga

SEQ ID NO: 614598 - DNA, 25 bp, Homo sapien
agcccgaggtgggtcccacccgcat

SEQ ID NO: 614599 - DNA, 25 bp, Homo sapien
ccagccctggagaagtagctctggc

SEQ ID NO: 614600 - DNA, 25 bp, Homo sapien
aagtagctctggcttgtcttctttt

SEQ ID NO: 614601 - DNA, 25 bp, Homo sapien
gtagctctggcttgtcttctttttc

SEQ ID NO: 614602 - DNA, 25 bp, Homo sapien
tagctctggcttgtcttctttttca

SEQ ID NO: 614603 - DNA, 25 bp, Homo sapien
agctctggcttgtcttctttttcat

SEQ ID NO: 614604 - DNA, 25 bp, Homo sapien
gctctggcttgtcttctttttcatt

SEQ ID NO: 614605 - DNA, 25 bp, Homo sapien
ataatttatgtatcgactaagaaat

SEQ ID NO: 614606 - DNA, 25 bp, Homo sapien
gaaataataaggtacattcagatgt

SEQ ID NO: 614607 - DNA, 25 bp, Homo sapien
ggcccacaccattttcttactctat

SEQ ID NO: 614608 - DNA, 25 bp, Homo sapien
ttcttactctatgcattggagcgaa

SEQ ID NO: 614609 - DNA, 25 bp, Homo sapien
aattgactacgatgggtgattccta

SEQ ID NO: 614610 - DNA, 25 bp, Homo sapien
gatgggtgattcctaaagttatatt

SEQ ID NO: 614611 - DNA, 25 bp, Homo sapien
tgcattagtaaaactccctgtttga

SEQ ID NO: 614612 - DNA, 25 bp, Homo sapien
aactccctgtttgaatgtttctagt

SEQ ID NO: 614613 - DNA, 25 bp, Homo sapien
atgtttctagtattcacagcccggg

SEQ ID NO: 614614 - DNA, 25 bp, Homo sapien
ctagtattcacagcccgggtcactg

SEQ ID NO: 614615 - DNA, 25 bp, Homo sapien
cgggtcactgtctttctataacgat

SEQ ID NO: 614616 - DNA, 25 bp, Homo sapien
ttacagccttgctctttctactata

SEQ ID NO: 614617 - DNA, 25 bp, Homo sapien
ttctactatataaacttccctaatc

SEQ ID NO: 614618 - DNA, 25 bp, Homo sapien
gtaagtaaaagcacattcagcacct

SEQ ID NO: 614619 - DNA, 25 bp, Homo sapien
aagtaaaagcacattcagcacctga

SEQ ID NO: 614620 - DNA, 25 bp, Homo sapien
gtaaaagcacattcagcacctgaac

SEQ ID NO: 614621 - DNA, 25 bp, Homo sapien
aaagcacattcagcacctgaaccgt

SEQ ID NO: 614622 - DNA, 25 bp, Homo sapien
agcacattcagcacctgaaccgtgg

SEQ ID NO: 614623 - DNA, 25 bp, Homo sapien
acattcagcacctgaaccgtggttt

SEQ ID NO: 614624 - DNA, 25 bp, Homo sapien
attcagcacctgaaccgtggtttat

SEQ ID NO: 614625 - DNA, 25 bp, Homo sapien
tcagcacctgaaccgtggtttataa

SEQ ID NO: 614626 - DNA, 25 bp, Homo sapien
gcacctgaaccgtggtttataatac

SEQ ID NO: 614627 - DNA, 25 bp, Homo sapien
gaaccgtggtttataataccattct

SEQ ID NO: 614628 - DNA, 25 bp, Homo sapien
tataataccattctttaaaacaagg

SEQ ID NO: 614629 - DNA, 25 bp, Homo sapien
tttttagcacatccccaaccctgaa

SEQ ID NO: 614630 - DNA, 25 bp, Homo sapien
ccaaccctgaaaacttcgcattaag

SEQ ID NO: 614631 - DNA, 25 bp, Homo sapien
cttcgcattaagagccaagcacaat

SEQ ID NO: 614632 - DNA, 25 bp, Homo sapien
agcacaatgttggtagctccaagat

SEQ ID NO: 614633 - DNA, 25 bp, Homo sapien
ctgactgtgttctcagaatgaggga

SEQ ID NO: 614634 - DNA, 25 bp, Homo sapien
gaatgagggattacccatcactggg

SEQ ID NO: 614635 - DNA, 25 bp, Homo sapien
atcactgggtattccttcccaagta

SEQ ID NO: 614636 - DNA, 25 bp, Homo sapien
gattttcactggtaatacacattgc

SEQ ID NO: 614637 - DNA, 25 bp, Homo sapien
aaatgcatatctggttagttgtctg

SEQ ID NO: 614638 - DNA, 25 bp, Homo sapien
tggttagttgtctgctgcccagatc

SEQ ID NO: 614639 - DNA, 25 bp, Homo sapien
tgctgcccagatcttatcaatacca

SEQ ID NO: 614640 - DNA, 25 bp, Homo sapien
atgacttggatatgctgacgactgt

SEQ ID NO: 614641 - DNA, 25 bp, Homo sapien
atgaataccttctgctgtgtctagc

SEQ ID NO: 614642 - DNA, 25 bp, Homo sapien
tgaataccttctgctgtgtctagct

SEQ ID NO: 614643 - DNA, 25 bp, Homo sapien
accttctgctgtgtctagctatatc

SEQ ID NO: 614644 - DNA, 25 bp, Homo sapien
ttctgctgtgtctagctatatcgca

SEQ ID NO: 614645 - DNA, 25 bp, Homo sapien
gctgtgtctagctatatcgcatctt

SEQ ID NO: 614646 - DNA, 25 bp, Homo sapien
gtctagctatatcgcatcttaacac

SEQ ID NO: 614647 - DNA, 25 bp, Homo sapien
gctatatcgcatcttaacactattt

SEQ ID NO: 614648 - DNA, 25 bp, Homo sapien
atcgcatcttaacactattttatta

SEQ ID NO: 614649 - DNA, 25 bp, Homo sapien
aaatcaacctgccacattttgggag

SEQ ID NO: 614650 - DNA, 25 bp, Homo sapien
ttttgggagcttttctacatgtctg

SEQ ID NO: 614651 - DNA, 25 bp, Homo sapien
taaaatgtaagttcttggctgggtg

SEQ ID NO: 614652 - DNA, 25 bp, Homo sapien
aaaatgtaagttcttggctgggtgt

SEQ ID NO: 614653 - DNA, 25 bp, Homo sapien
ttagccgtttgtggtggcacacaca

SEQ ID NO: 614654 - DNA, 25 bp, Homo sapien
tagccgtttgtggtggcacacacat

SEQ ID NO: 614655 - DNA, 25 bp, Homo sapien
agccgtttgtggtggcacacacatg

SEQ ID NO: 614656 - DNA, 25 bp, Homo sapien
tttgtggtggcacacacatgtggtc

SEQ ID NO: 614657 - DNA, 25 bp, Homo sapien
gaggtggaaccgtcacctgagccgg

SEQ ID NO: 614658 - DNA, 25 bp, Homo sapien
aggtggaaccgtcacctgagccggg

SEQ ID NO: 614659 - DNA, 25 bp, Homo sapien
tggaaccgtcacctgagccggggag

SEQ ID NO: 614660 - DNA, 25 bp, Homo sapien
aaccgtcacctgagccggggaggca

SEQ ID NO: 614661 - DNA, 25 bp, Homo sapien
gatctcaccactgcagacctcatct

SEQ ID NO: 614662 - DNA, 25 bp, Homo sapien
cagtgtttgaaatagatagcgggta

SEQ ID NO: 614663 - DNA, 25 bp, Homo sapien
gtttgaaatagatagcgggtacctt

SEQ ID NO: 614664 - DNA, 25 bp, Homo sapien
gggcactgtcctccactgctagaca

SEQ ID NO: 614665 - DNA, 25 bp, Homo sapien
gtctcctttaccctaaaggcagctg

SEQ ID NO: 614666 - DNA, 25 bp, Homo sapien
ctttaccctaaaggcagctgggcag

SEQ ID NO: 614667 - DNA, 25 bp, Homo sapien
accctaaaggcagctgggcagggac

SEQ ID NO: 614668 - DNA, 25 bp, Homo sapien
ccaggctctgcttcttggtgacagt

SEQ ID NO: 614669 - DNA, 25 bp, Homo sapien
caggctctgcttcttggtgacagtt

SEQ ID NO: 614670 - DNA, 25 bp, Homo sapien
gccagagccctgtatgctttgattt

SEQ ID NO: 614671 - DNA, 25 bp, Homo sapien
ccagagccctgtatgctttgatttt

SEQ ID NO: 614672 - DNA, 25 bp, Homo sapien
agagccctgtatgctttgatttttt

SEQ ID NO: 614673 - DNA, 25 bp, Homo sapien
ggactaatacacttatcaatctata

SEQ ID NO: 614674 - DNA, 25 bp, Homo sapien
gaagtctcacattctagattcattt

SEQ ID NO: 614675 - DNA, 25 bp, Homo sapien
ataccttttcacaattgtgtttaca

SEQ ID NO: 614676 - DNA, 25 bp, Homo sapien
acaaggttactatgctaaccacaca

SEQ ID NO: 614677 - DNA, 25 bp, Homo sapien
atgctaaccacacaatgccacacat

SEQ ID NO: 614678 - DNA, 25 bp, Homo sapien
cccctctttgaaaattgactgactg

SEQ ID NO: 614679 - DNA, 25 bp, Homo sapien
aattgactgactgctatttctatac

SEQ ID NO: 614680 - DNA, 25 bp, Homo sapien
gactgctatttctatactagttaca

SEQ ID NO: 614681 - DNA, 25 bp, Homo sapien
actagttacagctgtattgttgctc

SEQ ID NO: 614682 - DNA, 25 bp, Homo sapien
agctgtattgttgctctagtcggcc

SEQ ID NO: 614683 - DNA, 25 bp, Homo sapien
tgttgctctagtcggcccttccaaa

SEQ ID NO: 614684 - DNA, 25 bp, Homo sapien
tcctgctgctcctgaggaggtgccc

SEQ ID NO: 614685 - DNA, 25 bp, Homo sapien
aggtgcccagtcaccgcagagaggc

SEQ ID NO: 614686 - DNA, 25 bp, Homo sapien
gtcaccgcagagaggcaccccgagt

SEQ ID NO: 614687 - DNA, 25 bp, Homo sapien
cggccacaccgcgagtggatgctgt

SEQ ID NO: 614688 - DNA, 25 bp, Homo sapien
gccccgactttgatcccagggcggg

SEQ ID NO: 614689 - DNA, 25 bp, Homo sapien
ggaacggagagcactgtgactccag

SEQ ID NO: 614690 - DNA, 25 bp, Homo sapien
tggctcggagcaccatgtccgtcaa

SEQ ID NO: 614691 - DNA, 25 bp, Homo sapien
ggagcaccatgtccgtcaatagaag

SEQ ID NO: 614692 - DNA, 25 bp, Homo sapien
gcaccatgtccgtcaatagaagagg

SEQ ID NO: 614693 - DNA, 25 bp, Homo sapien
aagaggaaggctttgtgcagcagta

SEQ ID NO: 614694 - DNA, 25 bp, Homo sapien
gcctgccgggcaattgatttaaatc

SEQ ID NO: 614695 - DNA, 25 bp, Homo sapien
ccctaatagccgctgttggtagaga

SEQ ID NO: 614696 - DNA, 25 bp, Homo sapien
ctaatagccgctgttggtagagata

SEQ ID NO: 614697 - DNA, 25 bp, Homo sapien
atagccgctgttggtagagatagtc

SEQ ID NO: 614698 - DNA, 25 bp, Homo sapien
gccgctgttggtagagatagtctct

SEQ ID NO: 614699 - DNA, 25 bp, Homo sapien
gagatagtctctcaagagccaggca

SEQ ID NO: 614700 - DNA, 25 bp, Homo sapien
gatagtctctcaagagccaggcatg

SEQ ID NO: 614701 - DNA, 25 bp, Homo sapien
catggtggttcacaaagtgctggta

SEQ ID NO: 614702 - DNA, 25 bp, Homo sapien
ggtggttcacaaagtgctggtaatc

SEQ ID NO: 614703 - DNA, 25 bp, Homo sapien
ggttcacaaagtgctggtaatccca

SEQ ID NO: 614704 - DNA, 25 bp, Homo sapien
aatatagcaagaccaggacaggcgc

SEQ ID NO: 614705 - DNA, 25 bp, Homo sapien
atagcaagaccaggacaggcgcggt

SEQ ID NO: 614706 - DNA, 25 bp, Homo sapien
tcctctttggtctgtagccgcttgg

SEQ ID NO: 614707 - DNA, 25 bp, Homo sapien
tctttggtctgtagccgcttggcat

SEQ ID NO: 614708 - DNA, 25 bp, Homo sapien
gtctgtagccgcttggcatctgctt

SEQ ID NO: 614709 - DNA, 25 bp, Homo sapien
ttggcatctgcttctacccggttct

SEQ ID NO: 614710 - DNA, 25 bp, Homo sapien
tacccggttcttgccatacttgtac

SEQ ID NO: 614711 - DNA, 25 bp, Homo sapien
ggttcttgccatacttgtactgggc

SEQ ID NO: 614712 - DNA, 25 bp, Homo sapien
gccatacttgtactgggcagcatct

SEQ ID NO: 614713 - DNA, 25 bp, Homo sapien
cttgtactgggcagcatcttgagaa

SEQ ID NO: 614714 - DNA, 25 bp, Homo sapien
ctagcctgggaaatatgggacgatc

SEQ ID NO: 614715 - DNA, 25 bp, Homo sapien
gaaatatgggacgatcccttctcca

SEQ ID NO: 614716 - DNA, 25 bp, Homo sapien
atgggacgatcccttctccacaaaa

SEQ ID NO: 614717 - DNA, 25 bp, Homo sapien
tgcgggaaattctttcgttacaact

SEQ ID NO: 614718 - DNA, 25 bp, Homo sapien
tttcgttacaactccaacctcatta

SEQ ID NO: 614719 - DNA, 25 bp, Homo sapien
tcgttacaactccaacctcattaaa

SEQ ID NO: 614720 - DNA, 25 bp, Homo sapien
agcatatacttgttgagcaccagaa

SEQ ID NO: 614721 - DNA, 25 bp, Homo sapien
catatacttgttgagcaccagaaaa

SEQ ID NO: 614722 - DNA, 25 bp, Homo sapien
gagtgcagcgaatgccagaaggcct

SEQ ID NO: 614723 - DNA, 25 bp, Homo sapien
gcagcgaatgccagaaggcctttat

SEQ ID NO: 614724 - DNA, 25 bp, Homo sapien
atgccagaaggcctttattagaaag

SEQ ID NO: 614725 - DNA, 25 bp, Homo sapien
gaaagtctcacctggttcatcacca

SEQ ID NO: 614726 - DNA, 25 bp, Homo sapien
gtctcacctggttcatcaccagaaa

SEQ ID NO: 614727 - DNA, 25 bp, Homo sapien
agaggcttgtgtgctccatgaatgt

SEQ ID NO: 614728 - DNA, 25 bp, Homo sapien
ttaactggaagtggattcttaagtc

SEQ ID NO: 614729 - DNA, 25 bp, Homo sapien
taactggaagtggattcttaagtcc

SEQ ID NO: 614730 - DNA, 25 bp, Homo sapien
aactggaagtggattcttaagtcct

SEQ ID NO: 614731 - DNA, 25 bp, Homo sapien
actggaagtggattcttaagtcctt

SEQ ID NO: 614732 - DNA, 25 bp, Homo sapien
ctggaagtggattcttaagtccttt

SEQ ID NO: 614733 - DNA, 25 bp, Homo sapien
tggaagtggattcttaagtccttta

SEQ ID NO: 614734 - DNA, 25 bp, Homo sapien
gaagtggattcttaagtcctttaag

SEQ ID NO: 614735 - DNA, 25 bp, Homo sapien
aagtcctttaagatggaaatttatg

SEQ ID NO: 614736 - DNA, 25 bp, Homo sapien
agtcctttaagatggaaatttatgt

SEQ ID NO: 614737 - DNA, 25 bp, Homo sapien
gtcctttaagatggaaatttatgtt

SEQ ID NO: 614738 - DNA, 25 bp, Homo sapien
aagatggaaatttatgttctttcta

SEQ ID NO: 614739 - DNA, 25 bp, Homo sapien
gtggattttccagaatatcctccat

SEQ ID NO: 614740 - DNA, 25 bp, Homo sapien
tttccagaatatcctccatcttcaa

SEQ ID NO: 614741 - DNA, 25 bp, Homo sapien
ccagaatatcctccatcttcaaatt

SEQ ID NO: 614742 - DNA, 25 bp, Homo sapien
gaatatcctccatcttcaaattata

SEQ ID NO: 614743 - DNA, 25 bp, Homo sapien
catcttcaaattatatccgcggtta

SEQ ID NO: 614744 - DNA, 25 bp, Homo sapien
atatccgcggttataaccatccttg

SEQ ID NO: 614745 - DNA, 25 bp, Homo sapien
taaccatccttgtggctttgtatgt

SEQ ID NO: 614746 - DNA, 25 bp, Homo sapien
atccttgtggctttgtatgttcacc

SEQ ID NO: 614747 - DNA, 25 bp, Homo sapien
gtggctttgtatgttcaccaatgga

SEQ ID NO: 614748 - DNA, 25 bp, Homo sapien
gctttgtatgttcaccaatggaaga

SEQ ID NO: 614749 - DNA, 25 bp, Homo sapien
tatgttcaccaatggaagaaaaccc

SEQ ID NO: 614750 - DNA, 25 bp, Homo sapien
ctggatgacagagaaggtcatggga

SEQ ID NO: 614751 - DNA, 25 bp, Homo sapien
tggatgacagagaaggtcatgggaa

SEQ ID NO: 614752 - DNA, 25 bp, Homo sapien
ggatgacagagaaggtcatgggaac

SEQ ID NO: 614753 - DNA, 25 bp, Homo sapien
gatgacagagaaggtcatgggaaca

SEQ ID NO: 614754 - DNA, 25 bp, Homo sapien
atgacagagaaggtcatgggaacat

SEQ ID NO: 614755 - DNA, 25 bp, Homo sapien
tgacagagaaggtcatgggaacata

SEQ ID NO: 614756 - DNA, 25 bp, Homo sapien
gacagagaaggtcatgggaacatac

SEQ ID NO: 614757 - DNA, 25 bp, Homo sapien
acagagaaggtcatgggaacataca

SEQ ID NO: 614758 - DNA, 25 bp, Homo sapien
cagagaaggtcatgggaacatacag

SEQ ID NO: 614759 - DNA, 25 bp, Homo sapien
agagaaggtcatgggaacatacaga

SEQ ID NO: 614760 - DNA, 25 bp, Homo sapien
gagaaggtcatgggaacatacagag

SEQ ID NO: 614761 - DNA, 25 bp, Homo sapien
aagccaagccatttaatgacctcag

SEQ ID NO: 614762 - DNA, 25 bp, Homo sapien
atgacctcagtttgcgtatgtgtgg

SEQ ID NO: 614763 - DNA, 25 bp, Homo sapien
atgtgtggttgctctgggaagccca

SEQ ID NO: 614764 - DNA, 25 bp, Homo sapien
gggaagcccaaagcacagacctata

SEQ ID NO: 614765 - DNA, 25 bp, Homo sapien
atatccctttgcagcttgtcttttt

SEQ ID NO: 614766 - DNA, 25 bp, Homo sapien
ttgtctttttgcatagctcagcctg

SEQ ID NO: 614767 - DNA, 25 bp, Homo sapien
tagctcagcctgatgtgaaacaata

SEQ ID NO: 614768 - DNA, 25 bp, Homo sapien
ggcctgcccatgttgttgagaggtc

SEQ ID NO: 614769 - DNA, 25 bp, Homo sapien
aggtcttggtgagggctcaactcaa

SEQ ID NO: 614770 - DNA, 25 bp, Homo sapien
gaggattcttctgtcttggagttca

SEQ ID NO: 614771 - DNA, 25 bp, Homo sapien
ctgtcttggagttcagaggcccaaa

SEQ ID NO: 614772 - DNA, 25 bp, Homo sapien
taatatttgctcaaagttttaccct

SEQ ID NO: 614773 - DNA, 25 bp, Homo sapien
taccctgttagttgtttttccatca

SEQ ID NO: 614774 - DNA, 25 bp, Homo sapien
aaggaactgagtactggagagctat

SEQ ID NO: 614775 - DNA, 25 bp, Homo sapien
gaaaatgagctcctgcattctgcta

SEQ ID NO: 614776 - DNA, 25 bp, Homo sapien
tcctgcattctgctatacaccttat

SEQ ID NO: 614777 - DNA, 25 bp, Homo sapien
tatacaccttatccctggctgagtt

SEQ ID NO: 614778 - DNA, 25 bp, Homo sapien
tatccctggctgagtttgcaaaaag

SEQ ID NO: 614779 - DNA, 25 bp, Homo sapien
aaaggcaagcttccctttattcaga

SEQ ID NO: 614780 - DNA, 25 bp, Homo sapien
ttcagaaggtaccatacagtacatt

SEQ ID NO: 614781 - DNA, 25 bp, Homo sapien
gatgatcatgaggtggtatttgtaa

SEQ ID NO: 614782 - DNA, 25 bp, Homo sapien
ggtatttgtaacagctaagaagcat

SEQ ID NO: 614783 - DNA, 25 bp, Homo sapien
agctctgctggctagtctggcggcg

SEQ ID NO: 614784 - DNA, 25 bp, Homo sapien
gctgggcatgcgacgtggcacttct

SEQ ID NO: 614785 - DNA, 25 bp, Homo sapien
tgggcatgcgacgtggcacttctgc

SEQ ID NO: 614786 - DNA, 25 bp, Homo sapien
ggtcagctggcggagtggcgacggg

SEQ ID NO: 614787 - DNA, 25 bp, Homo sapien
gaacccacggcactggctcgacgtg

SEQ ID NO: 614788 - DNA, 25 bp, Homo sapien
actggctcgacgtgagcgtgccctg

SEQ ID NO: 614789 - DNA, 25 bp, Homo sapien
ttctggagagctggcagcgcgcgct

SEQ ID NO: 614790 - DNA, 25 bp, Homo sapien
tggcagcgcgcgctcatttcccagg

SEQ ID NO: 614791 - DNA, 25 bp, Homo sapien
gtgacgcgcgccgaggtggaagcaa

SEQ ID NO: 614792 - DNA, 25 bp, Homo sapien
tggaagcaagactgggcgcctgggc

SEQ ID NO: 614793 - DNA, 25 bp, Homo sapien
gcctgggcgggcgagggcactgctg

SEQ ID NO: 614794 - DNA, 25 bp, Homo sapien
tgtcccctctgtcagtgctgcctga

SEQ ID NO: 614795 - DNA, 25 bp, Homo sapien
cagtgctgcctgacagaggtctata

SEQ ID NO: 614796 - DNA, 25 bp, Homo sapien
ctgacagaggtctatacaagcacaa

SEQ ID NO: 614797 - DNA, 25 bp, Homo sapien
tactttgaccttgggatacttgaca

SEQ ID NO: 614798 - DNA, 25 bp, Homo sapien
gatacttgacagtgtggttggcaaa

SEQ ID NO: 614799 - DNA, 25 bp, Homo sapien
gttggcaaagtaaccagaagatcta

SEQ ID NO: 614800 - DNA, 25 bp, Homo sapien
agaagatctaggtcttagtcctctg

SEQ ID NO: 614801 - DNA, 25 bp, Homo sapien
tagtcctctgttactaaccagctgt

SEQ ID NO: 614802 - DNA, 25 bp, Homo sapien
ctgttactaaccagctgtatgacct

SEQ ID NO: 614803 - DNA, 25 bp, Homo sapien
gggcaagtcacaggccctctctgaa

SEQ ID NO: 614804 - DNA, 25 bp, Homo sapien
tcacaggccctctctgaactcagtt

SEQ ID NO: 614805 - DNA, 25 bp, Homo sapien
gatgcagagcagttcctttggagca

SEQ ID NO: 614806 - DNA, 25 bp, Homo sapien
cagttcctttggagcatctggacca

SEQ ID NO: 614807 - DNA, 25 bp, Homo sapien
tctggaccaccagctgttgccatga

SEQ ID NO: 614808 - DNA, 25 bp, Homo sapien
agctgttgccatgactaccatctgg

SEQ ID NO: 614809 - DNA, 25 bp, Homo sapien
atgactaccatctggctggtacctg

SEQ ID NO: 614810 - DNA, 25 bp, Homo sapien
tggtacctgctgagcctaaacctgg

SEQ ID NO: 614811 - DNA, 25 bp, Homo sapien
aggctccagctgtgaacgtcccggc

SEQ ID NO: 614812 - DNA, 25 bp, Homo sapien
gggcttggatcaccagtccgaaagc

SEQ ID NO: 614813 - DNA, 25 bp, Homo sapien
gtccgaaagccagtgccttggagaa

SEQ ID NO: 614814 - DNA, 25 bp, Homo sapien
gaaagtttccccataatgctcttgc

SEQ ID NO: 614815 - DNA, 25 bp, Homo sapien
gcaagtgaatatgagctgtggtttt

SEQ ID NO: 614816 - DNA, 25 bp, Homo sapien
agtttatttagtgctattatctggg

SEQ ID NO: 614817 - DNA, 25 bp, Homo sapien
ttagtgctattatctgggggaccag

SEQ ID NO: 614818 - DNA, 25 bp, Homo sapien
tgggggaccagttatatcagcagaa

SEQ ID NO: 614819 - DNA, 25 bp, Homo sapien
tatcagcagaaaagggcgactaagc

SEQ ID NO: 614820 - DNA, 25 bp, Homo sapien
gaaaagggcgactaagctgtcatta

SEQ ID NO: 614821 - DNA, 25 bp, Homo sapien
gggcgactaagctgtcattatgact

SEQ ID NO: 614822 - DNA, 25 bp, Homo sapien
gcgactaagctgtcattatgactca

SEQ ID NO: 614823 - DNA, 25 bp, Homo sapien
agctgtcattatgactcaaatggtt

SEQ ID NO: 614824 - DNA, 25 bp, Homo sapien
tcctcctcctgaaaagacaacaaag

SEQ ID NO: 614825 - DNA, 25 bp, Homo sapien
aaaatcatattctaaagcggtttat

SEQ ID NO: 614826 - DNA, 25 bp, Homo sapien
tcatattctaaagcggtttattcta

SEQ ID NO: 614827 - DNA, 25 bp, Homo sapien
tggtcagtacaaccctgcagggcaa

SEQ ID NO: 614828 - DNA, 25 bp, Homo sapien
cagtacaaccctgcagggcaaggag

SEQ ID NO: 614829 - DNA, 25 bp, Homo sapien
gagctgcagaaacaactatccaaac

SEQ ID NO: 614830 - DNA, 25 bp, Homo sapien
cttgatctcccatgttccacttcgg

SEQ ID NO: 614831 - DNA, 25 bp, Homo sapien
catgttccacttcggctgaaccaaa

SEQ ID NO: 614832 - DNA, 25 bp, Homo sapien
cacttcggctgaaccaaaccaaaag

SEQ ID NO: 614833 - DNA, 25 bp, Homo sapien
aagccatgtgtgaaaactgtgctac

SEQ ID NO: 614834 - DNA, 25 bp, Homo sapien
aatggagagtgatacgactcaggga

SEQ ID NO: 614835 - DNA, 25 bp, Homo sapien
gaagatatccagcactaaagtatta

SEQ ID NO: 614836 - DNA, 25 bp, Homo sapien
tccagcactaaagtattaatgcctt

SEQ ID NO: 614837 - DNA, 25 bp, Homo sapien
gaagtagatgatgtctatatgcata

SEQ ID NO: 614838 - DNA, 25 bp, Homo sapien
tcctcaaatcaatgtcagggagtca

SEQ ID NO: 614839 - DNA, 25 bp, Homo sapien
agggagtcaaaagggctgtagcaca

SEQ ID NO: 614840 - DNA, 25 bp, Homo sapien
tgtagcacaggatggagtttgattt

SEQ ID NO: 614841 - DNA, 25 bp, Homo sapien
gatggagtttgatttatccctcctc

SEQ ID NO: 614842 - DNA, 25 bp, Homo sapien
agcctctaagcccaacagcacagta

SEQ ID NO: 614843 - DNA, 25 bp, Homo sapien
aagcccaacagcacagtacccaagg

SEQ ID NO: 614844 - DNA, 25 bp, Homo sapien
cacagtacccaagggagaagccaaa

SEQ ID NO: 614845 - DNA, 25 bp, Homo sapien
gaagccaaacctaagcggcggaaga

SEQ ID NO: 614846 - DNA, 25 bp, Homo sapien
agtgaggaggcccttccaacgttga

SEQ ID NO: 614847 - DNA, 25 bp, Homo sapien
ttccaacgttgatgccccttctctt

SEQ ID NO: 614848 - DNA, 25 bp, Homo sapien
ccttctctttcctcaaatcaatgtc

SEQ ID NO: 614849 - DNA, 25 bp, Homo sapien
ccaagtgatgtctttcagggaagca

SEQ ID NO: 614850 - DNA, 25 bp, Homo sapien
gatagcgggtaccttccctggatgg

SEQ ID NO: 614851 - DNA, 25 bp, Homo sapien
gtaccttccctggatggagtcaggg

SEQ ID NO: 614852 - DNA, 25 bp, Homo sapien
tgctagacacccccagaatgcctgg

SEQ ID NO: 614853 - DNA, 25 bp, Homo sapien
ccccagaatgcctggcgctctgcag

SEQ ID NO: 614854 - DNA, 25 bp, Homo sapien
cgctctgcagagcacagtctgagct

SEQ ID NO: 614855 - DNA, 25 bp, Homo sapien
agcacagtctgagctgctctaagaa

SEQ ID NO: 614856 - DNA, 25 bp, Homo sapien
gtctcctttaccctaaaggcagctg

SEQ ID NO: 614857 - DNA, 25 bp, Homo sapien
aggctctgcttcttggtgacagttg

SEQ ID NO: 614858 - DNA, 25 bp, Homo sapien
tcttggtgacagttggccagagccc

SEQ ID NO: 614859 - DNA, 25 bp, Homo sapien
ggccagagccctgtatgctttgatt

SEQ ID NO: 614860 - DNA, 25 bp, Homo sapien
tggtattcaccaagccagttccaca

SEQ ID NO: 614861 - DNA, 25 bp, Homo sapien
ggtattcaccaagccagttccacat

SEQ ID NO: 614862 - DNA, 25 bp, Homo sapien
tattcaccaagccagttccacattt

SEQ ID NO: 614863 - DNA, 25 bp, Homo sapien
attcaccaagccagttccacatttc

SEQ ID NO: 614864 - DNA, 25 bp, Homo sapien
tcaccaagccagttccacatttctt

SEQ ID NO: 614865 - DNA, 25 bp, Homo sapien
caccaagccagttccacatttctta

SEQ ID NO: 614866 - DNA, 25 bp, Homo sapien
accaagccagttccacatttcttat

SEQ ID NO: 614867 - DNA, 25 bp, Homo sapien
atttcttattcagatgaccttgcaa

SEQ ID NO: 614868 - DNA, 25 bp, Homo sapien
tttcttattcagatgaccttgcaaa

SEQ ID NO: 614869 - DNA, 25 bp, Homo sapien
ttcttattcagatgaccttgcaaaa

SEQ ID NO: 614870 - DNA, 25 bp, Homo sapien
tcttattcagatgaccttgcaaaag

SEQ ID NO: 614871 - DNA, 25 bp, Homo sapien
tgccttcaagggtctcgcagacagg

SEQ ID NO: 614872 - DNA, 25 bp, Homo sapien
gccttcaagggtctcgcagacaggt

SEQ ID NO: 614873 - DNA, 25 bp, Homo sapien
ccttcaagggtctcgcagacaggtg

SEQ ID NO: 614874 - DNA, 25 bp, Homo sapien
cagcagaagttcactcaagctacag

SEQ ID NO: 614875 - DNA, 25 bp, Homo sapien
agcagaagttcactcaagctacaga

SEQ ID NO: 614876 - DNA, 25 bp, Homo sapien
gcagaagttcactcaagctacagaa

SEQ ID NO: 614877 - DNA, 25 bp, Homo sapien
cagaagttcactcaagctacagaaa

SEQ ID NO: 614878 - DNA, 25 bp, Homo sapien
agaagttcactcaagctacagaaat

SEQ ID NO: 614879 - DNA, 25 bp, Homo sapien
agtattgctggaggccgggagttcg

SEQ ID NO: 614880 - DNA, 25 bp, Homo sapien
tggccaatgtagtaacacccccgtc

SEQ ID NO: 614881 - DNA, 25 bp, Homo sapien
caatgtagtaacacccccgtctcta

SEQ ID NO: 614882 - DNA, 25 bp, Homo sapien
tattcttaagaaatgcttgctaaag

SEQ ID NO: 614883 - DNA, 25 bp, Homo sapien
taagaaatgcttgctaaagtgtcat

SEQ ID NO: 614884 - DNA, 25 bp, Homo sapien
gcttgctaaagtgtcatgatgtctg

SEQ ID NO: 614885 - DNA, 25 bp, Homo sapien
gcaacttaccttcaaatggttctaa

SEQ ID NO: 614886 - DNA, 25 bp, Homo sapien
aagaaggtacagtcaatgtggcaaa

SEQ ID NO: 614887 - DNA, 25 bp, Homo sapien
aaggtacagtcaatgtggcaaacat

SEQ ID NO: 614888 - DNA, 25 bp, Homo sapien
gtggcaaacattaacagccggaaaa

SEQ ID NO: 614889 - DNA, 25 bp, Homo sapien
gcaaacattaacagccggaaaatct

SEQ ID NO: 614890 - DNA, 25 bp, Homo sapien
attaacagccggaaaatctacatga

SEQ ID NO: 614891 - DNA, 25 bp, Homo sapien
taacagccggaaaatctacatgaag

SEQ ID NO: 614892 - DNA, 25 bp, Homo sapien
ttcctgtactgctcttttaactctt

SEQ ID NO: 614893 - DNA, 25 bp, Homo sapien
gacatgagataattagcctgagcta

SEQ ID NO: 614894 - DNA, 25 bp, Homo sapien
tagcctgagctaacgcagcaaatca

SEQ ID NO: 614895 - DNA, 25 bp, Homo sapien
gagcccaaatgtgttgaccttccag

SEQ ID NO: 614896 - DNA, 25 bp, Homo sapien
accttccagtgcagatacaacagaa

SEQ ID NO: 614897 - DNA, 25 bp, Homo sapien
aggagataggtctggattcaatccc

SEQ ID NO: 614898 - DNA, 25 bp, Homo sapien
tggattcaatcccagctccataatt

SEQ ID NO: 614899 - DNA, 25 bp, Homo sapien
gctccataattctaggcaaattctt

SEQ ID NO: 614900 - DNA, 25 bp, Homo sapien
aattctttcaactctgagccttggc

SEQ ID NO: 614901 - DNA, 25 bp, Homo sapien
cttggcttcccttctataatatagg

SEQ ID NO: 614902 - DNA, 25 bp, Homo sapien
aatataggctaagagcacccacctc

SEQ ID NO: 614903 - DNA, 25 bp, Homo sapien
ggagagctggctgaaatttcacaaa

SEQ ID NO: 614904 - DNA, 25 bp, Homo sapien
acaaagccaggaaaactaatcggtg

SEQ ID NO: 614905 - DNA, 25 bp, Homo sapien
gaagcagaaagtaacgtttcatgtg

SEQ ID NO: 614906 - DNA, 25 bp, Homo sapien
aagcagaaagtaacgtttcatgtga

SEQ ID NO: 614907 - DNA, 25 bp, Homo sapien
agcagaaagtaacgtttcatgtgat

SEQ ID NO: 614908 - DNA, 25 bp, Homo sapien
gcagaaagtaacgtttcatgtgatc

SEQ ID NO: 614909 - DNA, 25 bp, Homo sapien
cagaaagtaacgtttcatgtgatcc

SEQ ID NO: 614910 - DNA, 25 bp, Homo sapien
agaaagtaacgtttcatgtgatcct

SEQ ID NO: 614911 - DNA, 25 bp, Homo sapien
gaaagtaacgtttcatgtgatcctg

SEQ ID NO: 614912 - DNA, 25 bp, Homo sapien
aaagtaacgtttcatgtgatcctgt

SEQ ID NO: 614913 - DNA, 25 bp, Homo sapien
aagtaacgtttcatgtgatcctgtc

SEQ ID NO: 614914 - DNA, 25 bp, Homo sapien
tggtggtggaggccagtagtcccaa

SEQ ID NO: 614915 - DNA, 25 bp, Homo sapien
ggtggtggaggccagtagtcccaac

SEQ ID NO: 614916 - DNA, 25 bp, Homo sapien
gtggtggaggccagtagtcccaact

SEQ ID NO: 614917 - DNA, 25 bp, Homo sapien
tggtggaggccagtagtcccaacta

SEQ ID NO: 614918 - DNA, 25 bp, Homo sapien
ggtggaggccagtagtcccaactac

SEQ ID NO: 614919 - DNA, 25 bp, Homo sapien
gtggaggccagtagtcccaactact

SEQ ID NO: 614920 - DNA, 25 bp, Homo sapien
tggaggccagtagtcccaactactt

SEQ ID NO: 614921 - DNA, 25 bp, Homo sapien
ggaggccagtagtcccaactacttg

SEQ ID NO: 614922 - DNA, 25 bp, Homo sapien
gaggccagtagtcccaactacttgg

SEQ ID NO: 614923 - DNA, 25 bp, Homo sapien
agggctgaggtcaagctgtgaaact

SEQ ID NO: 614924 - DNA, 25 bp, Homo sapien
ggtcaagctgtgaaactgcattctt

SEQ ID NO: 614925 - DNA, 25 bp, Homo sapien
actgcattcttcatagtgggtctat

SEQ ID NO: 614926 - DNA, 25 bp, Homo sapien
tagaagcccggaaggaaacaggtct

SEQ ID NO: 614927 - DNA, 25 bp, Homo sapien
aggtctggccctggatccaggaaaa

SEQ ID NO: 614928 - DNA, 25 bp, Homo sapien
ggagatgtagcttagtacttagaat

SEQ ID NO: 614929 - DNA, 25 bp, Homo sapien
gaattatcccagaagtgaacaacat

SEQ ID NO: 614930 - DNA, 25 bp, Homo sapien
aacatcagtaaggtctgggcttccc

SEQ ID NO: 614931 - DNA, 25 bp, Homo sapien
taacctcttatgagggtttcaacct

SEQ ID NO: 614932 - DNA, 25 bp, Homo sapien
agggtttcaacctcacatccatata

SEQ ID NO: 614933 - DNA, 25 bp, Homo sapien
ttcaacctcacatccatatatcttt

SEQ ID NO: 614934 - DNA, 25 bp, Homo sapien
gaaaacaggacttcgtggcgtgccc

SEQ ID NO: 614935 - DNA, 25 bp, Homo sapien
gacttcgtggcgtgccctggcagac

SEQ ID NO: 614936 - DNA, 25 bp, Homo sapien
ggcgtgccctggcagacaagccaaa

SEQ ID NO: 614937 - DNA, 25 bp, Homo sapien
gacaagccaaagcaactgtgggcat

SEQ ID NO: 614938 - DNA, 25 bp, Homo sapien
aagcaactgtgggcatcaggctgtg

SEQ ID NO: 614939 - DNA, 25 bp, Homo sapien
gggcggcatccctaggacccagaat

SEQ ID NO: 614940 - DNA, 25 bp, Homo sapien
gacccagaataatgcctgcgcacag

SEQ ID NO: 614941 - DNA, 25 bp, Homo sapien
taatgcctgcgcacagtaggcacgg

SEQ ID NO: 614942 - DNA, 25 bp, Homo sapien
gcgcacagtaggcacggaagtattt

SEQ ID NO: 614943 - DNA, 25 bp, Homo sapien
gagatcatcatgaaataagcgctat

SEQ ID NO: 614944 - DNA, 25 bp, Homo sapien
gaaataagcgctattggccgggcac

SEQ ID NO: 614945 - DNA, 25 bp, Homo sapien
aactgaaaacatacattaagaactc

SEQ ID NO: 614946 - DNA, 25 bp, Homo sapien
actgaaaacatacattaagaactct

SEQ ID NO: 614947 - DNA, 25 bp, Homo sapien
ctgaaaacatacattaagaactctt

SEQ ID NO: 614948 - DNA, 25 bp, Homo sapien
tgaaaacatacattaagaactcttt

SEQ ID NO: 614949 - DNA, 25 bp, Homo sapien
gaaaacatacattaagaactctttt

SEQ ID NO: 614950 - DNA, 25 bp, Homo sapien
gaactctttttctctggccgagtgt

SEQ ID NO: 614951 - DNA, 25 bp, Homo sapien
aactctttttctctggccgagtgtg

SEQ ID NO: 614952 - DNA, 25 bp, Homo sapien
actctttttctctggccgagtgtgg

SEQ ID NO: 614953 - DNA, 25 bp, Homo sapien
ctctttttctctggccgagtgtggt

SEQ ID NO: 614954 - DNA, 25 bp, Homo sapien
tctttttctctggccgagtgtggtg

SEQ ID NO: 614955 - DNA, 25 bp, Homo sapien
ctttttctctggccgagtgtggtgg

SEQ ID NO: 614956 - DNA, 25 bp, Homo sapien
tgtcatttcgatcacatcatctcac

SEQ ID NO: 614957 - DNA, 25 bp, Homo sapien
atcatctcactgattctctcagcct

SEQ ID NO: 614958 - DNA, 25 bp, Homo sapien
tttccctatctgtaaccatgagtgt

SEQ ID NO: 614959 - DNA, 25 bp, Homo sapien
tccattttgcaaaagctctctccta

SEQ ID NO: 614960 - DNA, 25 bp, Homo sapien
aagctctctcctaggacacagctag

SEQ ID NO: 614961 - DNA, 25 bp, Homo sapien
acagctaggcactttccgggcaagg

SEQ ID NO: 614962 - DNA, 25 bp, Homo sapien
caacggccacaagctttcttttgaa

SEQ ID NO: 614963 - DNA, 25 bp, Homo sapien
cttttgaaacacgagactcctggtt

SEQ ID NO: 614964 - DNA, 25 bp, Homo sapien
gagactcctggtttgacaagccatg

SEQ ID NO: 614965 - DNA, 25 bp, Homo sapien
acaagccatgactatgtgatcctga

SEQ ID NO: 614966 - DNA, 25 bp, Homo sapien
gtgatcctgaggttgcatgcccatc

SEQ ID NO: 614967 - DNA, 25 bp, Homo sapien
aacagagactttggtggttacacat

SEQ ID NO: 614968 - DNA, 25 bp, Homo sapien
gaatacagacttcacataattaatt

SEQ ID NO: 614969 - DNA, 25 bp, Homo sapien
aaggtagagctgtaaactgcctatc

SEQ ID NO: 614970 - DNA, 25 bp, Homo sapien
gagctgtaaactgcctatctgatca

SEQ ID NO: 614971 - DNA, 25 bp, Homo sapien
gtaaactgcctatctgatcactgaa

SEQ ID NO: 614972 - DNA, 25 bp, Homo sapien
atctgatcactgaaggcattcccca

SEQ ID NO: 614973 - DNA, 25 bp, Homo sapien
gaaggcattccccaaaacacacatg

SEQ ID NO: 614974 - DNA, 25 bp, Homo sapien
cacacatgcagaagtgcttagcaaa

SEQ ID NO: 614975 - DNA, 25 bp, Homo sapien
gagacttgttggttccagagttatt

SEQ ID NO: 614976 - DNA, 25 bp, Homo sapien
tgttggttccagagttattagttaa

SEQ ID NO: 614977 - DNA, 25 bp, Homo sapien
aaatctatttattagctggtcaata

SEQ ID NO: 614978 - DNA, 25 bp, Homo sapien
ttgaagcccatcatcgagtctgtac

SEQ ID NO: 614979 - DNA, 25 bp, Homo sapien
tctgtacctacaacgagaccaaaca

SEQ ID NO: 614980 - DNA, 25 bp, Homo sapien
aagctgcccaactgtgccccgggag

SEQ ID NO: 614981 - DNA, 25 bp, Homo sapien
atccgctgtgactgcggagcctgct

SEQ ID NO: 614982 - DNA, 25 bp, Homo sapien
ccaccacggagtgtgagaccatctg

SEQ ID NO: 614983 - DNA, 25 bp, Homo sapien
tgagaccatctgaggccgctagctg

SEQ ID NO: 614984 - DNA, 25 bp, Homo sapien
tctctgcagacccacctgtgtgagc

SEQ ID NO: 614985 - DNA, 25 bp, Homo sapien
ctgtgtgagcagcacatgcagttat

SEQ ID NO: 614986 - DNA, 25 bp, Homo sapien
gcacatgcagttatacttcctggat

SEQ ID NO: 614987 - DNA, 25 bp, Homo sapien
ttcctggatgcaagactgtttaatt

SEQ ID NO: 614988 - DNA, 25 bp, Homo sapien
gactgtttaatttcgaccacaccca

SEQ ID NO: 614989 - DNA, 25 bp, Homo sapien
tgaaggtccagtactcagtgcacga

SEQ ID NO: 614990 - DNA, 25 bp, Homo sapien
tactcagtgcacgagaaccagctgc

SEQ ID NO: 614991 - DNA, 25 bp, Homo sapien
accagctgcagatggccacttcttt

SEQ ID NO: 614992 - DNA, 25 bp, Homo sapien
agtcctcatcgattggcaacttcaa

SEQ ID NO: 614993 - DNA, 25 bp, Homo sapien
gagggaattaactggcttcatcacc

SEQ ID NO: 614994 - DNA, 25 bp, Homo sapien
ttcatcaccagctatctcgaagaag

SEQ ID NO: 614995 - DNA, 25 bp, Homo sapien
tcgaagaagcctacatcccagttgt

SEQ ID NO: 614996 - DNA, 25 bp, Homo sapien
atcccagttgtcaatgatgtgcttc

SEQ ID NO: 614997 - DNA, 25 bp, Homo sapien
tcccggactttctggccatgaatta

SEQ ID NO: 614998 - DNA, 25 bp, Homo sapien
tgaattacaatctggctgagctgga

SEQ ID NO: 614999 - DNA, 25 bp, Homo sapien
gaatgccctgatgctggacttgaag

SEQ ID NO: 615000 - DNA, 25 bp, Homo sapien
gaaagataattttccagcctataat

SEQ ID NO: 615001 - DNA, 25 bp, Homo sapien
tttccagcctataattaaatttctc

SEQ ID NO: 615002 - DNA, 25 bp, Homo sapien
aacatgtcaaaatcagtaactactt

SEQ ID NO: 615003 - DNA, 25 bp, Homo sapien
tcagtaactactttaatggaatggt

SEQ ID NO: 615004 - DNA, 25 bp, Homo sapien
tctgcaaatatgtctattgactttt

SEQ ID NO: 615005 - DNA, 25 bp, Homo sapien
ctattgacttttcaaatttggtgac

SEQ ID NO: 615006 - DNA, 25 bp, Homo sapien
atttggtgacttctttcgaattaat

SEQ ID NO: 615007 - DNA, 25 bp, Homo sapien
gtgacttctttcgaattaattccct

SEQ ID NO: 615008 - DNA, 25 bp, Homo sapien
ttcgaattaattcccttacgtctgt

SEQ ID NO: 615009 - DNA, 25 bp, Homo sapien
ttaattcccttacgtctgttcctca

SEQ ID NO: 615010 - DNA, 25 bp, Homo sapien
tacgtctgttcctcatccacataaa

SEQ ID NO: 615011 - DNA, 25 bp, Homo sapien
cagcttcagacctctttcttaagat

SEQ ID NO: 615012 - DNA, 25 bp, Homo sapien
cagctaattttagcctctaattcaa

SEQ ID NO: 615013 - DNA, 25 bp, Homo sapien
ttttatttgtcttctcctatatact

SEQ ID NO: 615014 - DNA, 25 bp, Homo sapien
gtcttctcctatatactttaatgta

SEQ ID NO: 615015 - DNA, 25 bp, Homo sapien
aggtggtgtctgtagctgttactgc

SEQ ID NO: 615016 - DNA, 25 bp, Homo sapien
gctgttactgccatcttgctaatga

SEQ ID NO: 615017 - DNA, 25 bp, Homo sapien
ggtcagaagcagagcaacaatctgg

SEQ ID NO: 615018 - DNA, 25 bp, Homo sapien
gaagaagcctgggttcctgacgacc

SEQ ID NO: 615019 - DNA, 25 bp, Homo sapien
gcctgggttcctgacgacctttagg

SEQ ID NO: 615020 - DNA, 25 bp, Homo sapien
tttaggtccaaaccactattccagc

SEQ ID NO: 615021 - DNA, 25 bp, Homo sapien
aaaccactattccagcttcagacct

SEQ ID NO: 615022 - DNA, 25 bp, Homo sapien
agaaggttggaaccgggaccatgag

SEQ ID NO: 615023 - DNA, 25 bp, Homo sapien
gggaagcgatcacatctggtgacca

SEQ ID NO: 615024 - DNA, 25 bp, Homo sapien
atctggtgaccaggctgcttcattc

SEQ ID NO: 615025 - DNA, 25 bp, Homo sapien
tggtgaccaggctgcttcattcaac

SEQ ID NO: 615026 - DNA, 25 bp, Homo sapien
tgaccaggctgcttcattcaacact

SEQ ID NO: 615027 - DNA, 25 bp, Homo sapien
aggctgcttcattcaacactgtgta

SEQ ID NO: 615028 - DNA, 25 bp, Homo sapien
ggctgcttcattcaacactgtgtaa

SEQ ID NO: 615029 - DNA, 25 bp, Homo sapien
gctgcttcattcaacactgtgtaaa

SEQ ID NO: 615030 - DNA, 25 bp, Homo sapien
cactgtgtaaacaccaaagccttaa

SEQ ID NO: 615031 - DNA, 25 bp, Homo sapien
actccaaccacattccaagctgaga

SEQ ID NO: 615032 - DNA, 25 bp, Homo sapien
tccaaccacattccaagctgagata

SEQ ID NO: 615033 - DNA, 25 bp, Homo sapien
gaaccatctgaggatgcacacagga

SEQ ID NO: 615034 - DNA, 25 bp, Homo sapien
agaaatcccacgaatgtcagtcata

SEQ ID NO: 615035 - DNA, 25 bp, Homo sapien
gtcagtcatactcaaaagccttcag

SEQ ID NO: 615036 - DNA, 25 bp, Homo sapien
aagccttcagttgccaagtcattct

SEQ ID NO: 615037 - DNA, 25 bp, Homo sapien
agttgccaagtcattctttctaaaa

SEQ ID NO: 615038 - DNA, 25 bp, Homo sapien
aaaccagtgagagcacacactaaag

SEQ ID NO: 615039 - DNA, 25 bp, Homo sapien
gatattgtctttgtcaatacctcat

SEQ ID NO: 615040 - DNA, 25 bp, Homo sapien
gtctttgtcaatacctcatttgtaa

SEQ ID NO: 615041 - DNA, 25 bp, Homo sapien
ttgtaaaacagacccattagtcgtg

SEQ ID NO: 615042 - DNA, 25 bp, Homo sapien
gacccattagtcgtgaatttccagc

SEQ ID NO: 615043 - DNA, 25 bp, Homo sapien
gtgaatttccagctctttcaaaaat

SEQ ID NO: 615044 - DNA, 25 bp, Homo sapien
caaaacaaaagaaggccaggagcag

SEQ ID NO: 615045 - DNA, 25 bp, Homo sapien
taaaactacaaacatcagccgaggt

SEQ ID NO: 615046 - DNA, 25 bp, Homo sapien
aaactacaaacatcagccgaggttg

SEQ ID NO: 615047 - DNA, 25 bp, Homo sapien
actacaaacatcagccgaggttggt

SEQ ID NO: 615048 - DNA, 25 bp, Homo sapien
ctacaaacatcagccgaggttggtg

SEQ ID NO: 615049 - DNA, 25 bp, Homo sapien
caaacatcagccgaggttggtggta

SEQ ID NO: 615050 - DNA, 25 bp, Homo sapien
aaacatcagccgaggttggtggtat

SEQ ID NO: 615051 - DNA, 25 bp, Homo sapien
acatcagccgaggttggtggtatgc

SEQ ID NO: 615052 - DNA, 25 bp, Homo sapien
catcagccgaggttggtggtatgca

SEQ ID NO: 615053 - DNA, 25 bp, Homo sapien
atcagccgaggttggtggtatgcac

SEQ ID NO: 615054 - DNA, 25 bp, Homo sapien
tcagccgaggttggtggtatgcacc

SEQ ID NO: 615055 - DNA, 25 bp, Homo sapien
tcaacccagtttccctctctggaaa

SEQ ID NO: 615056 - DNA, 25 bp, Homo sapien
ccctctctggaaataaccacaatga

SEQ ID NO: 615057 - DNA, 25 bp, Homo sapien
ctggaaataaccacaatgactaatt

SEQ ID NO: 615058 - DNA, 25 bp, Homo sapien
tcttttgtattcttccagagttatt

SEQ ID NO: 615059 - DNA, 25 bp, Homo sapien
acatgtatggttgcatatatttctg

SEQ ID NO: 615060 - DNA, 25 bp, Homo sapien
cattaggtgtagctgcagtgacact

SEQ ID NO: 615061 - DNA, 25 bp, Homo sapien
aggtgtagctgcagtgacactgatt

SEQ ID NO: 615062 - DNA, 25 bp, Homo sapien
gtgacactgattagcattcatcata

SEQ ID NO: 615063 - DNA, 25 bp, Homo sapien
atatgtactatgctcatatgattca

SEQ ID NO: 615064 - DNA, 25 bp, Homo sapien
caaagttcaaaatggcctcaagagt

SEQ ID NO: 615065 - DNA, 25 bp, Homo sapien
atggcctcaagagtataaactgtga

SEQ ID NO: 615066 - DNA, 25 bp, Homo sapien
caaaatcaggaatctgctccctgca

SEQ ID NO: 615067 - DNA, 25 bp, Homo sapien
aaatcaggaatctgctccctgcacc

SEQ ID NO: 615068 - DNA, 25 bp, Homo sapien
gctccctgcaccctctattaagagg

SEQ ID NO: 615069 - DNA, 25 bp, Homo sapien
tgcaccctctattaagaggctggga

SEQ ID NO: 615070 - DNA, 25 bp, Homo sapien
taagaggctgggaagaagctcttga

SEQ ID NO: 615071 - DNA, 25 bp, Homo sapien
aggagatccttcttcaatgttaaag

SEQ ID NO: 615072 - DNA, 25 bp, Homo sapien
tgggtgaggaggagtcctttaacct

SEQ ID NO: 615073 - DNA, 25 bp, Homo sapien
tgaggaggagtcctttaacctgaag

SEQ ID NO: 615074 - DNA, 25 bp, Homo sapien
ctcgtctcttgttgttcatctttaa

SEQ ID NO: 615075 - DNA, 25 bp, Homo sapien
tcgtctcttgttgttcatctttaaa

SEQ ID NO: 615076 - DNA, 25 bp, Homo sapien
gtctcttgttgttcatctttaaaag

SEQ ID NO: 615077 - DNA, 25 bp, Homo sapien
ggtccaaagtgggagttgaaatgat

SEQ ID NO: 615078 - DNA, 25 bp, Homo sapien
gtccaaagtgggagttgaaatgatg

SEQ ID NO: 615079 - DNA, 25 bp, Homo sapien
tccaaagtgggagttgaaatgatga

SEQ ID NO: 615080 - DNA, 25 bp, Homo sapien
gaaatgatgaaggatcgtaaacaca

SEQ ID NO: 615081 - DNA, 25 bp, Homo sapien
aaatgatgaaggatcgtaaacacat

SEQ ID NO: 615082 - DNA, 25 bp, Homo sapien
atgatgaaggatcgtaaacacattg

SEQ ID NO: 615083 - DNA, 25 bp, Homo sapien
tgatgaaggatcgtaaacacattga

SEQ ID NO: 615084 - DNA, 25 bp, Homo sapien
gatgaaggatcgtaaacacattgat

SEQ ID NO: 615085 - DNA, 25 bp, Homo sapien
atgaaggatcgtaaacacattgatg

SEQ ID NO: 615086 - DNA, 25 bp, Homo sapien
tgaaggatcgtaaacacattgatgt

SEQ ID NO: 615087 - DNA, 25 bp, Homo sapien
gaaggatcgtaaacacattgatgtc

SEQ ID NO: 615088 - DNA, 25 bp, Homo sapien
cctggaaagggtcagctctccctga

SEQ ID NO: 615089 - DNA, 25 bp, Homo sapien
gaaagggtcagctctccctgacaga

SEQ ID NO: 615090 - DNA, 25 bp, Homo sapien
agggtcagctctccctgacagagac

SEQ ID NO: 615091 - DNA, 25 bp, Homo sapien
gaaggactgggcactgtttagactc

SEQ ID NO: 615092 - DNA, 25 bp, Homo sapien
aggactgggcactgtttagactctg

SEQ ID NO: 615093 - DNA, 25 bp, Homo sapien
tgcccaccgggctccacttggagat

SEQ ID NO: 615094 - DNA, 25 bp, Homo sapien
gggctccacttggagatcagcagga

SEQ ID NO: 615095 - DNA, 25 bp, Homo sapien
ggccagtgtgggacccctgctgcca

SEQ ID NO: 615096 - DNA, 25 bp, Homo sapien
gtgtcctttctggaaattaagaagg

SEQ ID NO: 615097 - DNA, 25 bp, Homo sapien
attaagaaggtgtgctccagagcca

SEQ ID NO: 615098 - DNA, 25 bp, Homo sapien
aagaaggtgtgctccagagccaaga

SEQ ID NO: 615099 - DNA, 25 bp, Homo sapien
aaatcctgtgtgactttgctaagct

SEQ ID NO: 615100 - DNA, 25 bp, Homo sapien
tcctgtgtgactttgctaagctctt

SEQ ID NO: 615101 - DNA, 25 bp, Homo sapien
tgtgtgactttgctaagctctttaa

SEQ ID NO: 615102 - DNA, 25 bp, Homo sapien
aagctctttaacttctctatgcgtc

SEQ ID NO: 615103 - DNA, 25 bp, Homo sapien
ctttaacttctctatgcgtcacatt

SEQ ID NO: 615104 - DNA, 25 bp, Homo sapien
ttaacttctctatgcgtcacattcc

SEQ ID NO: 615105 - DNA, 25 bp, Homo sapien
ggagcagtccatggtgcagccctca

SEQ ID NO: 615106 - DNA, 25 bp, Homo sapien
agcagtccatggtgcagccctcatg

SEQ ID NO: 615107 - DNA, 25 bp, Homo sapien
tgctgggaagattacataaatgcct

SEQ ID NO: 615108 - DNA, 25 bp, Homo sapien
aagattacataaatgcctggcacat

SEQ ID NO: 615109 - DNA, 25 bp, Homo sapien
cctggcacataccaaggactcaaaa

SEQ ID NO: 615110 - DNA, 25 bp, Homo sapien
gccaaatgtcaaagaatgtaccaat

SEQ ID NO: 615111 - DNA, 25 bp, Homo sapien
tgtaccaataagtgttctaaagcct

SEQ ID NO: 615112 - DNA, 25 bp, Homo sapien
caaaaattacacatgctgctggacc

SEQ ID NO: 615113 - DNA, 25 bp, Homo sapien
aacatctgctggataaacgtcgaaa

SEQ ID NO: 615114 - DNA, 25 bp, Homo sapien
gataaacgtcgaaaccagtggagat

SEQ ID NO: 615115 - DNA, 25 bp, Homo sapien
tactaaaaccgtagcttcccaccag

SEQ ID NO: 615116 - DNA, 25 bp, Homo sapien
gctgggaaatgtttaagaggtctca

SEQ ID NO: 615117 - DNA, 25 bp, Homo sapien
gtctcatagtagtaccctgtggcta

SEQ ID NO: 615118 - DNA, 25 bp, Homo sapien
gtggctacttttaggaacaccagtc

SEQ ID NO: 615119 - DNA, 25 bp, Homo sapien
acaccagtctatttttactgagagc

SEQ ID NO: 615120 - DNA, 25 bp, Homo sapien
tatttttactgagagctggacaaca

SEQ ID NO: 615121 - DNA, 25 bp, Homo sapien
ctgatgaattttgttctgtgagacc

SEQ ID NO: 615122 - DNA, 25 bp, Homo sapien
gatgaattttgttctgtgagaccta

SEQ ID NO: 615123 - DNA, 25 bp, Homo sapien
tgaattttgttctgtgagacctacc

SEQ ID NO: 615124 - DNA, 25 bp, Homo sapien
gaattttgttctgtgagacctacca

SEQ ID NO: 615125 - DNA, 25 bp, Homo sapien
aattttgttctgtgagacctaccag

SEQ ID NO: 615126 - DNA, 25 bp, Homo sapien
attttgttctgtgagacctaccaga

SEQ ID NO: 615127 - DNA, 25 bp, Homo sapien
ttttgttctgtgagacctaccagat

SEQ ID NO: 615128 - DNA, 25 bp, Homo sapien
ttgttctgtgagacctaccagatat

SEQ ID NO: 615129 - DNA, 25 bp, Homo sapien
gttctgtgagacctaccagatattt

SEQ ID NO: 615130 - DNA, 25 bp, Homo sapien
ctgtgagacctaccagatatttttt

SEQ ID NO: 615131 - DNA, 25 bp, Homo sapien
gatatttttttctatctgggttgga

SEQ ID NO: 615132 - DNA, 25 bp, Homo sapien
ggcgacgcctgctaggcgcatgacc

SEQ ID NO: 615133 - DNA, 25 bp, Homo sapien
tgctaggcgcatgaccctcagagtc

SEQ ID NO: 615134 - DNA, 25 bp, Homo sapien
aggcgcatgaccctcagagtcaggc

SEQ ID NO: 615135 - DNA, 25 bp, Homo sapien
agagtcaggcctgtactcacctcag

SEQ ID NO: 615136 - DNA, 25 bp, Homo sapien
tgtactcacctcagcatctatcaag

SEQ ID NO: 615137 - DNA, 25 bp, Homo sapien
ctcagcatctatcaagggccttcaa

SEQ ID NO: 615138 - DNA, 25 bp, Homo sapien
tatcaagggccttcaaggatcgggt

SEQ ID NO: 615139 - DNA, 25 bp, Homo sapien
taatcatcgtcaaatatatcgttac

SEQ ID NO: 615140 - DNA, 25 bp, Homo sapien
taaaaagatacgtacaatttgggag

SEQ ID NO: 615141 - DNA, 25 bp, Homo sapien
tatacaaaattatccaagcgtgctg

SEQ ID NO: 615142 - DNA, 25 bp, Homo sapien
tatccaagcgtgctgggaaggtctt

SEQ ID NO: 615143 - DNA, 25 bp, Homo sapien
ctccctgtgaagtctgtgttcccaa

SEQ ID NO: 615144 - DNA, 25 bp, Homo sapien
cctgtgaagtctgtgttcccaacta

SEQ ID NO: 615145 - DNA, 25 bp, Homo sapien
gtgttcccaactaccactgtgctgg

SEQ ID NO: 615146 - DNA, 25 bp, Homo sapien
gaactggttcttggtaagagagctg

SEQ ID NO: 615147 - DNA, 25 bp, Homo sapien
aagcatcagcagagggcaaataaag

SEQ ID NO: 615148 - DNA, 25 bp, Homo sapien
gagaatcccatagaacaggttggaa

SEQ ID NO: 615149 - DNA, 25 bp, Homo sapien
gtatgaaaacaaaggactgtcctct

SEQ ID NO: 615150 - DNA, 25 bp, Homo sapien
aggactgtcctctttaagacaaggc

SEQ ID NO: 615151 - DNA, 25 bp, Homo sapien
aagacaaggcacctggtcatctttt

SEQ ID NO: 615152 - DNA, 25 bp, Homo sapien
tggtcatcttttccctcttacagct

SEQ ID NO: 615153 - DNA, 25 bp, Homo sapien
cttttccctcttacagctacaaagg

SEQ ID NO: 615154 - DNA, 25 bp, Homo sapien
attccatttgatgacaattccattc

SEQ ID NO: 615155 - DNA, 25 bp, Homo sapien
aattccattcaataccaattgatga

SEQ ID NO: 615156 - DNA, 25 bp, Homo sapien
cattcaataccaattgatgatggtt

SEQ ID NO: 615157 - DNA, 25 bp, Homo sapien
gatgatggttatttttgattccatt

SEQ ID NO: 615158 - DNA, 25 bp, Homo sapien
tgattctattcgattgcattcgata

SEQ ID NO: 615159 - DNA, 25 bp, Homo sapien
cgattgcattcgataattccatttg

SEQ ID NO: 615160 - DNA, 25 bp, Homo sapien
gattgcattcgataattccatttga

SEQ ID NO: 615161 - DNA, 25 bp, Homo sapien
tgcattcgataattccatttgattg

SEQ ID NO: 615162 - DNA, 25 bp, Homo sapien
cattcgataattccatttgattgca

SEQ ID NO: 615163 - DNA, 25 bp, Homo sapien
ttcgataattccatttgattgcatt

SEQ ID NO: 615164 - DNA, 25 bp, Homo sapien
ataattccatttgattgcattcgat

SEQ ID NO: 615165 - DNA, 25 bp, Homo sapien
gatagcgggtaccttccctggatgg

SEQ ID NO: 615166 - DNA, 25 bp, Homo sapien
tgctagacacccccagaatgcctgg

SEQ ID NO: 615167 - DNA, 25 bp, Homo sapien
gctagacacccccagaatgcctggc

SEQ ID NO: 615168 - DNA, 25 bp, Homo sapien
ctagacacccccagaatgcctggcg

SEQ ID NO: 615169 - DNA, 25 bp, Homo sapien
tagacacccccagaatgcctggcgc

SEQ ID NO: 615170 - DNA, 25 bp, Homo sapien
agacacccccagaatgcctggcgct

SEQ ID NO: 615171 - DNA, 25 bp, Homo sapien
gacacccccagaatgcctggcgctc

SEQ ID NO: 615172 - DNA, 25 bp, Homo sapien
acacccccagaatgcctggcgctct

SEQ ID NO: 615173 - DNA, 25 bp, Homo sapien
cacccccagaatgcctggcgctctg

SEQ ID NO: 615174 - DNA, 25 bp, Homo sapien
ccccagaatgcctggcgctctgcag

SEQ ID NO: 615175 - DNA, 25 bp, Homo sapien
cgctctgcagagcacagtctgagct

SEQ ID NO: 615176 - DNA, 25 bp, Homo sapien
aaatttcccagaatgtctgcagcca

SEQ ID NO: 615177 - DNA, 25 bp, Homo sapien
gtctgcagccatgagaacgtcaaat

SEQ ID NO: 615178 - DNA, 25 bp, Homo sapien
gaacgtcaaatacagcatctaggca

SEQ ID NO: 615179 - DNA, 25 bp, Homo sapien
aaatacagcatctaggcaacccctt

SEQ ID NO: 615180 - DNA, 25 bp, Homo sapien
taggcaacccctttgatcatgttgt

SEQ ID NO: 615181 - DNA, 25 bp, Homo sapien
gatcatgttgtacgtaaacagtatt

SEQ ID NO: 615182 - DNA, 25 bp, Homo sapien
attataaattactaccgtgactggg

SEQ ID NO: 615183 - DNA, 25 bp, Homo sapien
tactaccgtgactgggatgcaagag

SEQ ID NO: 615184 - DNA, 25 bp, Homo sapien
gactgggatgcaagagaattaggac

SEQ ID NO: 615185 - DNA, 25 bp, Homo sapien
ggactataattttcctatttgatgt

SEQ ID NO: 615186 - DNA, 25 bp, Homo sapien
tcctacactgtctcaagagtattaa

SEQ ID NO: 615187 - DNA, 25 bp, Homo sapien
aaagattcttatcatgattttcatt

SEQ ID NO: 615188 - DNA, 25 bp, Homo sapien
ttcattttactagtccaaagatcac

SEQ ID NO: 615189 - DNA, 25 bp, Homo sapien
ttttactagtccaaagatcactgag

SEQ ID NO: 615190 - DNA, 25 bp, Homo sapien
tactagtccaaagatcactgagtta

SEQ ID NO: 615191 - DNA, 25 bp, Homo sapien
gatcactgagttaaactgcctattt

SEQ ID NO: 615192 - DNA, 25 bp, Homo sapien
actgagttaaactgcctattttagt

SEQ ID NO: 615193 - DNA, 25 bp, Homo sapien
gagttaaactgcctattttagtaga

SEQ ID NO: 615194 - DNA, 25 bp, Homo sapien
aaactgcctattttagtagatgaac

SEQ ID NO: 615195 - DNA, 25 bp, Homo sapien
actgcctattttagtagatgaacaa

SEQ ID NO: 615196 - DNA, 25 bp, Homo sapien
gtagatgaacaaaagtgccttgaat

SEQ ID NO: 615197 - DNA, 25 bp, Homo sapien
aagtgccttgaataaagacgtaatt

SEQ ID NO: 615198 - DNA, 25 bp, Homo sapien
gatattcttgtacctctgtccctta

SEQ ID NO: 615199 - DNA, 25 bp, Homo sapien
gtacctctgtcccttactcttttgg

SEQ ID NO: 615200 - DNA, 25 bp, Homo sapien
tcataaagacaggattgtgcaatct

SEQ ID NO: 615201 - DNA, 25 bp, Homo sapien
tgtgcaatctaagttgatcagtctc

SEQ ID NO: 615202 - DNA, 25 bp, Homo sapien
gtgagttcatatgccagagttttta

SEQ ID NO: 615203 - DNA, 25 bp, Homo sapien
gagtttttattcgtcttgtgattgc

SEQ ID NO: 615204 - DNA, 25 bp, Homo sapien
gtcttgtgattgctgacatacctgt

SEQ ID NO: 615205 - DNA, 25 bp, Homo sapien
gacatacctgtgcactcatgtgtat

SEQ ID NO: 615206 - DNA, 25 bp, Homo sapien
atgtgtatacccctgcatgtggaaa

SEQ ID NO: 615207 - DNA, 25 bp, Homo sapien
gaagatgttttcactttgtgtctag

SEQ ID NO: 615208 - DNA, 25 bp, Homo sapien
gtgtctaggtttatgtacgtgaaca

SEQ ID NO: 615209 - DNA, 25 bp, Homo sapien
gagatggtccataaactctttggca

SEQ ID NO: 615210 - DNA, 25 bp, Homo sapien
gatggtccataaactctttggcaga

SEQ ID NO: 615211 - DNA, 25 bp, Homo sapien
tggtccataaactctttggcagatc

SEQ ID NO: 615212 - DNA, 25 bp, Homo sapien
gtccataaactctttggcagatcta

SEQ ID NO: 615213 - DNA, 25 bp, Homo sapien
taaactctttggcagatctaacatt

SEQ ID NO: 615214 - DNA, 25 bp, Homo sapien
actctttggcagatctaacattctc

SEQ ID NO: 615215 - DNA, 25 bp, Homo sapien
tctttggcagatctaacattctcta

SEQ ID NO: 615216 - DNA, 25 bp, Homo sapien
ttggcagatctaacattctctaaag

SEQ ID NO: 615217 - DNA, 25 bp, Homo sapien
gcagatctaacattctctaaagaga

SEQ ID NO: 615218 - DNA, 25 bp, Homo sapien
cattctctaaagagaattggccagg

SEQ ID NO: 615219 - DNA, 25 bp, Homo sapien
aggagttgatgaccggcctgggtaa

SEQ ID NO: 615220 - DNA, 25 bp, Homo sapien
tcgatctgattaaggagttcatgtt

SEQ ID NO: 615221 - DNA, 25 bp, Homo sapien
atggagactgtaagactgatcgcac

SEQ ID NO: 615222 - DNA, 25 bp, Homo sapien
gactgtaagactgatcgcactgctc

SEQ ID NO: 615223 - DNA, 25 bp, Homo sapien
aagactgatcgcactgctcacggaa

SEQ ID NO: 615224 - DNA, 25 bp, Homo sapien
gctcacggaacccaaagtgtgctgg

SEQ ID NO: 615225 - DNA, 25 bp, Homo sapien
agtgtgctggtcatgggacagcttc

SEQ ID NO: 615226 - DNA, 25 bp, Homo sapien
cagtggctcagaagacaccccaaac

SEQ ID NO: 615227 - DNA, 25 bp, Homo sapien
ccaaacccttcaggaaatgtccaag

SEQ ID NO: 615228 - DNA, 25 bp, Homo sapien
atgcttcagagtgctccggcctgta

SEQ ID NO: 615229 - DNA, 25 bp, Homo sapien
gagtgctccggcctgtactgaccag

SEQ ID NO: 615230 - DNA, 25 bp, Homo sapien
gtactgaccagcctgcgccttgcag

SEQ ID NO: 615231 - DNA, 25 bp, Homo sapien
gaaatgtcaacagcaattctggata

SEQ ID NO: 615232 - DNA, 25 bp, Homo sapien
gcaattctggatatggttgaggtat

SEQ ID NO: 615233 - DNA, 25 bp, Homo sapien
gttgaggtatttaccaaccagatac

SEQ ID NO: 615234 - DNA, 25 bp, Homo sapien
ggtatttaccaaccagatacagagt

SEQ ID NO: 615235 - DNA, 25 bp, Homo sapien
gatacagagttttccagagcacatg

SEQ ID NO: 615236 - DNA, 25 bp, Homo sapien
agagttttccagagcacatggcaaa

SEQ ID NO: 615237 - DNA, 25 bp, Homo sapien
catggcaaatgtggaactgaagaaa

SEQ ID NO: 615238 - DNA, 25 bp, Homo sapien
aaaatctgaaggcttttactcaatt

SEQ ID NO: 615239 - DNA, 25 bp, Homo sapien
ctctggccattcaggtgaacaaaat

SEQ ID NO: 615240 - DNA, 25 bp, Homo sapien
ggtgaacaaaatctgctgggcgaca

SEQ ID NO: 615241 - DNA, 25 bp, Homo sapien
tgaacaaaatctgctgggcgacagg

SEQ ID NO: 615242 - DNA, 25 bp, Homo sapien
gcgggcggatcattttataactgtc

SEQ ID NO: 615243 - DNA, 25 bp, Homo sapien
cgggcggatcattttataactgtct

SEQ ID NO: 615244 - DNA, 25 bp, Homo sapien
gggcggatcattttataactgtcta

SEQ ID NO: 615245 - DNA, 25 bp, Homo sapien
ggcggatcattttataactgtctat

SEQ ID NO: 615246 - DNA, 25 bp, Homo sapien
gcggatcattttataactgtctatt

SEQ ID NO: 615247 - DNA, 25 bp, Homo sapien
ggatcattttataactgtctattaa

SEQ ID NO: 615248 - DNA, 25 bp, Homo sapien
ttttcctgtctacatggaattgccg

SEQ ID NO: 615249 - DNA, 25 bp, Homo sapien
tttcctgtctacatggaattgccga

SEQ ID NO: 615250 - DNA, 25 bp, Homo sapien
ttcctgtctacatggaattgccgac

SEQ ID NO: 615251 - DNA, 25 bp, Homo sapien
tcctgtctacatggaattgccgact

SEQ ID NO: 615252 - DNA, 25 bp, Homo sapien
cctgtctacatggaattgccgactg

SEQ ID NO: 615253 - DNA, 25 bp, Homo sapien
gaggcatgggtgtccagtccaatgt

SEQ ID NO: 615254 - DNA, 25 bp, Homo sapien
acatgggactgggaagtcagcagac

SEQ ID NO: 615255 - DNA, 25 bp, Homo sapien
ctgggatagagagggccctgaacac

SEQ ID NO: 615256 - DNA, 25 bp, Homo sapien
gggcttgcttggtccttatcctgta

SEQ ID NO: 615257 - DNA, 25 bp, Homo sapien
gcttggtccttatcctgtaggaggt

SEQ ID NO: 615258 - DNA, 25 bp, Homo sapien
taggaggtgggaccacctttccctg

SEQ ID NO: 615259 - DNA, 25 bp, Homo sapien
tgaactttctctacaacccttggga

SEQ ID NO: 615260 - DNA, 25 bp, Homo sapien
ttctctacaacccttgggagcgtgg

SEQ ID NO: 615261 - DNA, 25 bp, Homo sapien
ccagggtcagtttactaagttagag

SEQ ID NO: 615262 - DNA, 25 bp, Homo sapien
gtgtcagctgtaactcctaggatat

SEQ ID NO: 615263 - DNA, 25 bp, Homo sapien
ggatattttatgtggaacctaacat

SEQ ID NO: 615264 - DNA, 25 bp, Homo sapien
tccacgccgaaaaatgaagtgcaca

SEQ ID NO: 615265 - DNA, 25 bp, Homo sapien
agtgcacaagagcacgcaggcgctt

SEQ ID NO: 615266 - DNA, 25 bp, Homo sapien
acaagagcacgcaggcgcttcacaa

SEQ ID NO: 615267 - DNA, 25 bp, Homo sapien
acaccaacctgacccgggaagtcag

SEQ ID NO: 615268 - DNA, 25 bp, Homo sapien
tgacccgggaagtcaggccattttc

SEQ ID NO: 615269 - DNA, 25 bp, Homo sapien
aagtcaggccattttccgcctggca

SEQ ID NO: 615270 - DNA, 25 bp, Homo sapien
gtgtccactttgatttccagacctc

SEQ ID NO: 615271 - DNA, 25 bp, Homo sapien
tccactttgatttccagacctcatc

SEQ ID NO: 615272 - DNA, 25 bp, Homo sapien
gcaggagcactgtcccgcagcgcgt

SEQ ID NO: 615273 - DNA, 25 bp, Homo sapien
agcgcgtcacctttttccgacagat

SEQ ID NO: 615274 - DNA, 25 bp, Homo sapien
cgtcacctttttccgacagatgtcg

SEQ ID NO: 615275 - DNA, 25 bp, Homo sapien
gttgcctcaccactgctactgatat

SEQ ID NO: 615276 - DNA, 25 bp, Homo sapien
tgctactgatatcacccacaccatg

SEQ ID NO: 615277 - DNA, 25 bp, Homo sapien
tcctggtgtctgagcaagccatttg

SEQ ID NO: 615278 - DNA, 25 bp, Homo sapien
gagcaagccatttggaggcccaata

SEQ ID NO: 615279 - DNA, 25 bp, Homo sapien
aataattggcctgccagggcccact

SEQ ID NO: 615280 - DNA, 25 bp, Homo sapien
gggcccactgacaccagtgccagta

SEQ ID NO: 615281 - DNA, 25 bp, Homo sapien
agtgccagtatacaccaccctgaaa

SEQ ID NO: 615282 - DNA, 25 bp, Homo sapien
agacagacatgttcagcccattgct

SEQ ID NO: 615283 - DNA, 25 bp, Homo sapien
gccaccactgggacctaaagattgg

SEQ ID NO: 615284 - DNA, 25 bp, Homo sapien
taaagattggcctacctgacatacc

SEQ ID NO: 615285 - DNA, 25 bp, Homo sapien
agaacttgcctccactaataactgc

SEQ ID NO: 615286 - DNA, 25 bp, Homo sapien
cacgctactgaaggtcttaccagca

SEQ ID NO: 615287 - DNA, 25 bp, Homo sapien
cttaccagcaggtggcatcagctat

SEQ ID NO: 615288 - DNA, 25 bp, Homo sapien
atcagctatgtggtgtacgaagcca

SEQ ID NO: 615289 - DNA, 25 bp, Homo sapien
gtacgaagccatgaagaaaaccctg

SEQ ID NO: 615290 - DNA, 25 bp, Homo sapien
aaaaccctgggcatataggctgtga

SEQ ID NO: 615291 - DNA, 25 bp, Homo sapien
gtgagctggacgacacagcctaggc

SEQ ID NO: 615292 - DNA, 25 bp, Homo sapien
cacagcctaggcagaaatgggacag

SEQ ID NO: 615293 - DNA, 25 bp, Homo sapien
aggaggacctgatgacccctggccc

SEQ ID NO: 615294 - DNA, 25 bp, Homo sapien
ccaaagagccctcgaggcctcaagg

SEQ ID NO: 615295 - DNA, 25 bp, Homo sapien
aagaaacgtggactccagtctggcc

SEQ ID NO: 615296 - DNA, 25 bp, Homo sapien
ggctccagggcgaaatggtgaacat

SEQ ID NO: 615297 - DNA, 25 bp, Homo sapien
tccattatatttctgagtacacttg

SEQ ID NO: 615298 - DNA, 25 bp, Homo sapien
gagtacacttgttgttcagcctcac

SEQ ID NO: 615299 - DNA, 25 bp, Homo sapien
tacacttgttgttcagcctcaccta

SEQ ID NO: 615300 - DNA, 25 bp, Homo sapien
cctaccccaatgaatatatgatatc

SEQ ID NO: 615301 - DNA, 25 bp, Homo sapien
acatctggattctgtattaaactat

SEQ ID NO: 615302 - DNA, 25 bp, Homo sapien
aaagagtatctctatgatttcaaaa

SEQ ID NO: 615303 - DNA, 25 bp, Homo sapien
atacaattggctatatgctatctgt

SEQ ID NO: 615304 - DNA, 25 bp, Homo sapien
ttggctatatgctatctgtaattat

SEQ ID NO: 615305 - DNA, 25 bp, Homo sapien
tctgtaattataccataagcctggg

SEQ ID NO: 615306 - DNA, 25 bp, Homo sapien
aattataccataagcctgggaattt

SEQ ID NO: 615307 - DNA, 25 bp, Homo sapien
aatcctgacagatttaattaggttt

SEQ ID NO: 615308 - DNA, 25 bp, Homo sapien
attcttgagcccctgcaaagcaaac

SEQ ID NO: 615309 - DNA, 25 bp, Homo sapien
ctggcctactgcctgagtataagcc

SEQ ID NO: 615310 - DNA, 25 bp, Homo sapien
ggcctactgcctgagtataagccaa

SEQ ID NO: 615311 - DNA, 25 bp, Homo sapien
tactgcctgagtataagccaagcac

SEQ ID NO: 615312 - DNA, 25 bp, Homo sapien
gcctgagtataagccaagcacactt

SEQ ID NO: 615313 - DNA, 25 bp, Homo sapien
gagtataagccaagcacacttccca

SEQ ID NO: 615314 - DNA, 25 bp, Homo sapien
tataagccaagcacacttcccatgg

SEQ ID NO: 615315 - DNA, 25 bp, Homo sapien
aagcacacttcccatggctcttcta

SEQ ID NO: 615316 - DNA, 25 bp, Homo sapien
gcacacttcccatggctcttctaag

SEQ ID NO: 615317 - DNA, 25 bp, Homo sapien
ctaagaatcagggtatgctttaata

SEQ ID NO: 615318 - DNA, 25 bp, Homo sapien
gaatcagggtatgctttaataaagg

SEQ ID NO: 615319 - DNA, 25 bp, Homo sapien
ctgttagaaagatggtaattcatag

SEQ ID NO: 615320 - DNA, 25 bp, Homo sapien
tgttagaaagatggtaattcatagg

SEQ ID NO: 615321 - DNA, 25 bp, Homo sapien
gttagaaagatggtaattcataggc

SEQ ID NO: 615322 - DNA, 25 bp, Homo sapien
ttagaaagatggtaattcataggcc

SEQ ID NO: 615323 - DNA, 25 bp, Homo sapien
tagaaagatggtaattcataggccg

SEQ ID NO: 615324 - DNA, 25 bp, Homo sapien
agaaagatggtaattcataggccgg

SEQ ID NO: 615325 - DNA, 25 bp, Homo sapien
gaaagatggtaattcataggccggg

SEQ ID NO: 615326 - DNA, 25 bp, Homo sapien
aaagatggtaattcataggccgggt

SEQ ID NO: 615327 - DNA, 25 bp, Homo sapien
aagatggtaattcataggccgggtg

SEQ ID NO: 615328 - DNA, 25 bp, Homo sapien
gcgtggccaccatggtaaaaccccg

SEQ ID NO: 615329 - DNA, 25 bp, Homo sapien
aaaatatgaaaattggccaggcgca

SEQ ID NO: 615330 - DNA, 25 bp, Homo sapien
aaatatgaaaattggccaggcgcag

SEQ ID NO: 615331 - DNA, 25 bp, Homo sapien
aatatgaaaattggccaggcgcagt

SEQ ID NO: 615332 - DNA, 25 bp, Homo sapien
atatgaaaattggccaggcgcagtg

SEQ ID NO: 615333 - DNA, 25 bp, Homo sapien
aggcgcagtgactcacgcatataat

SEQ ID NO: 615334 - DNA, 25 bp, Homo sapien
gcacagtggtacacacctgtgattc

SEQ ID NO: 615335 - DNA, 25 bp, Homo sapien
cacagtggtacacacctgtgattcc

SEQ ID NO: 615336 - DNA, 25 bp, Homo sapien
acagtggtacacacctgtgattcca

SEQ ID NO: 615337 - DNA, 25 bp, Homo sapien
cagtggtacacacctgtgattccag

SEQ ID NO: 615338 - DNA, 25 bp, Homo sapien
agtggtacacacctgtgattccagc

SEQ ID NO: 615339 - DNA, 25 bp, Homo sapien
gaaaagacaagccatggactaggag

SEQ ID NO: 615340 - DNA, 25 bp, Homo sapien
aaaagacaagccatggactaggagt

SEQ ID NO: 615341 - DNA, 25 bp, Homo sapien
aaagacaagccatggactaggagta

SEQ ID NO: 615342 - DNA, 25 bp, Homo sapien
aagacaagccatggactaggagtaa

SEQ ID NO: 615343 - DNA, 25 bp, Homo sapien
agacaagccatggactaggagtaaa

SEQ ID NO: 615344 - DNA, 25 bp, Homo sapien
gacaagccatggactaggagtaaaa

SEQ ID NO: 615345 - DNA, 25 bp, Homo sapien
acaagccatggactaggagtaaaat

SEQ ID NO: 615346 - DNA, 25 bp, Homo sapien
caagccatggactaggagtaaaatg

SEQ ID NO: 615347 - DNA, 25 bp, Homo sapien
aagccatggactaggagtaaaatgt

SEQ ID NO: 615348 - DNA, 25 bp, Homo sapien
gccatggactaggagtaaaatgtaa

SEQ ID NO: 615349 - DNA, 25 bp, Homo sapien
ccatggactaggagtaaaatgtaaa

SEQ ID NO: 615350 - DNA, 25 bp, Homo sapien
acccattaaacaatagctccttggc

SEQ ID NO: 615351 - DNA, 25 bp, Homo sapien
cccattaaacaatagctccttggcc

SEQ ID NO: 615352 - DNA, 25 bp, Homo sapien
ccattaaacaatagctccttggccg

SEQ ID NO: 615353 - DNA, 25 bp, Homo sapien
cattaaacaatagctccttggccgg

SEQ ID NO: 615354 - DNA, 25 bp, Homo sapien
attaaacaatagctccttggccggg

SEQ ID NO: 615355 - DNA, 25 bp, Homo sapien
ttaaacaatagctccttggccgggc

SEQ ID NO: 615356 - DNA, 25 bp, Homo sapien
taaacaatagctccttggccgggcg

SEQ ID NO: 615357 - DNA, 25 bp, Homo sapien
aaacaatagctccttggccgggcgc

SEQ ID NO: 615358 - DNA, 25 bp, Homo sapien
aacaatagctccttggccgggcgcg

SEQ ID NO: 615359 - DNA, 25 bp, Homo sapien
acaatagctccttggccgggcgcgg

SEQ ID NO: 615360 - DNA, 25 bp, Homo sapien
attagccagctgcagtggcgggcgc

SEQ ID NO: 615361 - DNA, 25 bp, Homo sapien
aacaatggaataggatgacactata

SEQ ID NO: 615362 - DNA, 25 bp, Homo sapien
tggaataggatgacactatatgtgg

SEQ ID NO: 615363 - DNA, 25 bp, Homo sapien
gggaggctggcactttgcattcatt

SEQ ID NO: 615364 - DNA, 25 bp, Homo sapien
ggaggctggcactttgcattcatta

SEQ ID NO: 615365 - DNA, 25 bp, Homo sapien
gaggctggcactttgcattcattat

SEQ ID NO: 615366 - DNA, 25 bp, Homo sapien
ttgcattcattattttagacatgga

SEQ ID NO: 615367 - DNA, 25 bp, Homo sapien
gaagcaaatgtattatttatctaac

SEQ ID NO: 615368 - DNA, 25 bp, Homo sapien
gtattatttatctaacttttggaat

SEQ ID NO: 615369 - DNA, 25 bp, Homo sapien
tatctaacttttggaatattatgtg

SEQ ID NO: 615370 - DNA, 25 bp, Homo sapien
cttttgtcattgtaactgagattga

SEQ ID NO: 615371 - DNA, 25 bp, Homo sapien
gtcattgtaactgagattgaatata

SEQ ID NO: 615372 - DNA, 25 bp, Homo sapien
gagaatacgacagagcctgatggct

SEQ ID NO: 615373 - DNA, 25 bp, Homo sapien
gatggctcagcaagtattttgataa

SEQ ID NO: 615374 - DNA, 25 bp, Homo sapien
aagtgtgcagcctggatgtctgtaa

SEQ ID NO: 615375 - DNA, 25 bp, Homo sapien
agcctggatgtctgtaattacgaaa

SEQ ID NO: 615376 - DNA, 25 bp, Homo sapien
attgttcacacagatgtggcgtgaa

SEQ ID NO: 615377 - DNA, 25 bp, Homo sapien
atgatgtgatttaaacctctctgac

SEQ ID NO: 615378 - DNA, 25 bp, Homo sapien
cctctctgacttctgtattggtgat

SEQ ID NO: 615379 - DNA, 25 bp, Homo sapien
tggtgatggctgattcctttatcgc

SEQ ID NO: 615380 - DNA, 25 bp, Homo sapien
tgattcctttatcgcactcgtagag

SEQ ID NO: 615381 - DNA, 25 bp, Homo sapien
atcgcactcgtagagtcactaggta

SEQ ID NO: 615382 - DNA, 25 bp, Homo sapien
actaggtacggacccaagcttcaga

SEQ ID NO: 615383 - DNA, 25 bp, Homo sapien
gaaaggaactggtcataaacgaaat

SEQ ID NO: 615384 - DNA, 25 bp, Homo sapien
cgaaatgaatcaatgcaggttacta

SEQ ID NO: 615385 - DNA, 25 bp, Homo sapien
aatgcaggttactaagcagtgtcaa

SEQ ID NO: 615386 - DNA, 25 bp, Homo sapien
ctaagcagtgtcaagtagcatgttt

SEQ ID NO: 615387 - DNA, 25 bp, Homo sapien
gttttatgacaacaactacaactcc

SEQ ID NO: 615388 - DNA, 25 bp, Homo sapien
cgccactaggagaaaagacgctggg

SEQ ID NO: 615389 - DNA, 25 bp, Homo sapien
ggcagaccacatgtcagcagtgggt

SEQ ID NO: 615390 - DNA, 25 bp, Homo sapien
acatgtcagcagtgggtgtcgctta

SEQ ID NO: 615391 - DNA, 25 bp, Homo sapien
gtcagcagtgggtgtcgcttagtaa

SEQ ID NO: 615392 - DNA, 25 bp, Homo sapien
cagtgggtgtcgcttagtaatatat

SEQ ID NO: 615393 - DNA, 25 bp, Homo sapien
cgcttagtaatatattgtgggtcat

SEQ ID NO: 615394 - DNA, 25 bp, Homo sapien
aacaatgacctattacccttctggc

SEQ ID NO: 615395 - DNA, 25 bp, Homo sapien
ctattacccttctggcactatagta

SEQ ID NO: 615396 - DNA, 25 bp, Homo sapien
ggcactatagtaagccccaacgagt

SEQ ID NO: 615397 - DNA, 25 bp, Homo sapien
caacgagtaagtggtagtcattcaa

SEQ ID NO: 615398 - DNA, 25 bp, Homo sapien
gtcattcaatgaagtacccactatg

SEQ ID NO: 615399 - DNA, 25 bp, Homo sapien
tatgtgccagacatagtgtcagctc

SEQ ID NO: 615400 - DNA, 25 bp, Homo sapien
cagacatagtgtcagctccagtggg

SEQ ID NO: 615401 - DNA, 25 bp, Homo sapien
aggtgtgtggattcatcctccttgc

SEQ ID NO: 615402 - DNA, 25 bp, Homo sapien
atcctccttgcacttgcagaacttg

SEQ ID NO: 615403 - DNA, 25 bp, Homo sapien
tagtacaagattactttcagctagg

SEQ ID NO: 615404 - DNA, 25 bp, Homo sapien
gggaatgcagctttctggtaatgat

SEQ ID NO: 615405 - DNA, 25 bp, Homo sapien
acatacatctttgtccttgttgagc

SEQ ID NO: 615406 - DNA, 25 bp, Homo sapien
acatctttgtccttgttgagcttac

SEQ ID NO: 615407 - DNA, 25 bp, Homo sapien
gtccttgttgagcttacattctaac

SEQ ID NO: 615408 - DNA, 25 bp, Homo sapien
gagcttacattctaacagacaggag

SEQ ID NO: 615409 - DNA, 25 bp, Homo sapien
gacaggagatagaccataaacagta

SEQ ID NO: 615410 - DNA, 25 bp, Homo sapien
tatgttggaaactaggtgctataga

SEQ ID NO: 615411 - DNA, 25 bp, Homo sapien
gggacaaatggagcttacaacttta

SEQ ID NO: 615412 - DNA, 25 bp, Homo sapien
gtagtcagggtaaactctattggga

SEQ ID NO: 615413 - DNA, 25 bp, Homo sapien
aactctattgggaaggtaacatttg

SEQ ID NO: 615414 - DNA, 25 bp, Homo sapien
aagacattgttgtagtccatgtaga

SEQ ID NO: 615415 - DNA, 25 bp, Homo sapien
agtccatgtagatggatgtagtcta

SEQ ID NO: 615416 - DNA, 25 bp, Homo sapien
tgaagcgggagccagcgcatgacat

SEQ ID NO: 615417 - DNA, 25 bp, Homo sapien
gaagcgggagccagcgcatgacatg

SEQ ID NO: 615418 - DNA, 25 bp, Homo sapien
aagcgggagccagcgcatgacatgg

SEQ ID NO: 615419 - DNA, 25 bp, Homo sapien
ggagccagcgcatgacatggcaaga

SEQ ID NO: 615420 - DNA, 25 bp, Homo sapien
gccagcgcatgacatggcaagagca

SEQ ID NO: 615421 - DNA, 25 bp, Homo sapien
ccagcgcatgacatggcaagagcag

SEQ ID NO: 615422 - DNA, 25 bp, Homo sapien
caaaaaattagtcatgcacctataa

SEQ ID NO: 615423 - DNA, 25 bp, Homo sapien
aaatacccgcctcctgtgtactcca

SEQ ID NO: 615424 - DNA, 25 bp, Homo sapien
acccgcctcctgtgtactccacagg

SEQ ID NO: 615425 - DNA, 25 bp, Homo sapien
actccacagggcacagggagctttc

SEQ ID NO: 615426 - DNA, 25 bp, Homo sapien
ctccacagggcacagggagctttca

SEQ ID NO: 615427 - DNA, 25 bp, Homo sapien
tgatagaaataataagaggccaggc

SEQ ID NO: 615428 - DNA, 25 bp, Homo sapien
gaaataataagaggccaggcaccgt

SEQ ID NO: 615429 - DNA, 25 bp, Homo sapien
gaggcagagttcaggtggatcattt

SEQ ID NO: 615430 - DNA, 25 bp, Homo sapien
aggcagagttcaggtggatcatttg

SEQ ID NO: 615431 - DNA, 25 bp, Homo sapien
ggcagagttcaggtggatcatttgg

SEQ ID NO: 615432 - DNA, 25 bp, Homo sapien
cagagttcaggtggatcatttgggc

SEQ ID NO: 615433 - DNA, 25 bp, Homo sapien
agagttcaggtggatcatttgggcc

SEQ ID NO: 615434 - DNA, 25 bp, Homo sapien
gagttcaggtggatcatttgggccc

SEQ ID NO: 615435 - DNA, 25 bp, Homo sapien
agttcaggtggatcatttgggccca

SEQ ID NO: 615436 - DNA, 25 bp, Homo sapien
ttcaggtggatcatttgggcccagg

SEQ ID NO: 615437 - DNA, 25 bp, Homo sapien
tcaggtggatcatttgggcccagga

SEQ ID NO: 615438 - DNA, 25 bp, Homo sapien
gaaatgagcttgtcacaaaagaaca

SEQ ID NO: 615439 - DNA, 25 bp, Homo sapien
atgattccagttatatgaggtgccc

SEQ ID NO: 615440 - DNA, 25 bp, Homo sapien
gattccagttatatgaggtgcccat

SEQ ID NO: 615441 - DNA, 25 bp, Homo sapien
gaggtgcccatagttgtcaaattca

SEQ ID NO: 615442 - DNA, 25 bp, Homo sapien
gtgcccatagttgtcaaattcacaa

SEQ ID NO: 615443 - DNA, 25 bp, Homo sapien
caaaaagtggcatggtcgttaccaa

SEQ ID NO: 615444 - DNA, 25 bp, Homo sapien
agtggcatggtcgttaccaagggct

SEQ ID NO: 615445 - DNA, 25 bp, Homo sapien
tggtgagttagtgtttaattggtac

SEQ ID NO: 615446 - DNA, 25 bp, Homo sapien
agttctggagatgaatgttgggaat

SEQ ID NO: 615447 - DNA, 25 bp, Homo sapien
ttgggaatggctgtgcaacactgtg

SEQ ID NO: 615448 - DNA, 25 bp, Homo sapien
aatggctgtgcaacactgtgaatgt

SEQ ID NO: 615449 - DNA, 25 bp, Homo sapien
ctgagcctagaaggtcgaagctgca

SEQ ID NO: 615450 - DNA, 25 bp, Homo sapien
gaaaagacaagccatggactaggag

SEQ ID NO: 615451 - DNA, 25 bp, Homo sapien
aaaagacaagccatggactaggagt

SEQ ID NO: 615452 - DNA, 25 bp, Homo sapien
aaagacaagccatggactaggagta

SEQ ID NO: 615453 - DNA, 25 bp, Homo sapien
aagacaagccatggactaggagtaa

SEQ ID NO: 615454 - DNA, 25 bp, Homo sapien
agacaagccatggactaggagtaaa

SEQ ID NO: 615455 - DNA, 25 bp, Homo sapien
gacaagccatggactaggagtaaaa

SEQ ID NO: 615456 - DNA, 25 bp, Homo sapien
acaagccatggactaggagtaaaat

SEQ ID NO: 615457 - DNA, 25 bp, Homo sapien
caagccatggactaggagtaaaatg

SEQ ID NO: 615458 - DNA, 25 bp, Homo sapien
aagccatggactaggagtaaaatgt

SEQ ID NO: 615459 - DNA, 25 bp, Homo sapien
gccatggactaggagtaaaatgtaa

SEQ ID NO: 615460 - DNA, 25 bp, Homo sapien
gggagccatgatcgtgacactgcat

SEQ ID NO: 615461 - DNA, 25 bp, Homo sapien
ggagccatgatcgtgacactgcatt

SEQ ID NO: 615462 - DNA, 25 bp, Homo sapien
catgttaaagttactgaaatctggc

SEQ ID NO: 615463 - DNA, 25 bp, Homo sapien
tgttaaagttactgaaatctggctg

SEQ ID NO: 615464 - DNA, 25 bp, Homo sapien
gttaaagttactgaaatctggctgg

SEQ ID NO: 615465 - DNA, 25 bp, Homo sapien
ttaaagttactgaaatctggctggg

SEQ ID NO: 615466 - DNA, 25 bp, Homo sapien
taaagttactgaaatctggctgggt

SEQ ID NO: 615467 - DNA, 25 bp, Homo sapien
aaagttactgaaatctggctgggtg

SEQ ID NO: 615468 - DNA, 25 bp, Homo sapien
aagttactgaaatctggctgggtgg

SEQ ID NO: 615469 - DNA, 25 bp, Homo sapien
ttactgaaatctggctgggtggagt

SEQ ID NO: 615470 - DNA, 25 bp, Homo sapien
ttgaagccgggaggtcgaaggtgca

SEQ ID NO: 615471 - DNA, 25 bp, Homo sapien
ccactgacatgtgggagccgtgcat

SEQ ID NO: 615472 - DNA, 25 bp, Homo sapien
gtgcatggcagtggccagcgtcctt

SEQ ID NO: 615473 - DNA, 25 bp, Homo sapien
atggcagtggccagcgtccttgtcc

SEQ ID NO: 615474 - DNA, 25 bp, Homo sapien
cagtggccagcgtccttgtcctgcg

SEQ ID NO: 615475 - DNA, 25 bp, Homo sapien
ctgtggacatcactcgccttcagaa

SEQ ID NO: 615476 - DNA, 25 bp, Homo sapien
gacatcactcgccttcagaacactg

SEQ ID NO: 615477 - DNA, 25 bp, Homo sapien
ttcagaacactgagccctcctacct

SEQ ID NO: 615478 - DNA, 25 bp, Homo sapien
tcctacctcctgatatccagggctg

SEQ ID NO: 615479 - DNA, 25 bp, Homo sapien
tcctgatatccagggctgccgatgg

SEQ ID NO: 615480 - DNA, 25 bp, Homo sapien
ggataaagcctcaagtcctgcaact

SEQ ID NO: 615481 - DNA, 25 bp, Homo sapien
ataaagcctcaagtcctgcaactat

SEQ ID NO: 615482 - DNA, 25 bp, Homo sapien
gtggcagtataatgagtgattttaa

SEQ ID NO: 615483 - DNA, 25 bp, Homo sapien
tggcagtataatgagtgattttaaa

SEQ ID NO: 615484 - DNA, 25 bp, Homo sapien
ggcagtataatgagtgattttaaaa

SEQ ID NO: 615485 - DNA, 25 bp, Homo sapien
tgattttaaaatctggactggaggc

SEQ ID NO: 615486 - DNA, 25 bp, Homo sapien
ttttaaaatctggactggaggccga

SEQ ID NO: 615487 - DNA, 25 bp, Homo sapien
tttaaaatctggactggaggccgag

SEQ ID NO: 615488 - DNA, 25 bp, Homo sapien
taaaatctggactggaggccgaggc

SEQ ID NO: 615489 - DNA, 25 bp, Homo sapien
aaaatctggactggaggccgaggca

SEQ ID NO: 615490 - DNA, 25 bp, Homo sapien
gcacatcactggaagtcaggagttt

SEQ ID NO: 615491 - DNA, 25 bp, Homo sapien
agcttggccaatatatagaaaaacc

SEQ ID NO: 615492 - DNA, 25 bp, Homo sapien
gcttggccaatatatagaaaaaccc

SEQ ID NO: 615493 - DNA, 25 bp, Homo sapien
agcagcaaattgcaagagcatctgt

SEQ ID NO: 615494 - DNA, 25 bp, Homo sapien
aaattgcaagagcatctgtgactgc

SEQ ID NO: 615495 - DNA, 25 bp, Homo sapien
agagcatctgtgactgctgggctaa

SEQ ID NO: 615496 - DNA, 25 bp, Homo sapien
catctgtgactgctgggctaaggca

SEQ ID NO: 615497 - DNA, 25 bp, Homo sapien
gggtgctggtggaaatcactagaca

SEQ ID NO: 615498 - DNA, 25 bp, Homo sapien
gctggtggaaatcactagacagtta

SEQ ID NO: 615499 - DNA, 25 bp, Homo sapien
tgtgggtgcctgcaacactttctgg

SEQ ID NO: 615500 - DNA, 25 bp, Homo sapien
cctgcaacactttctgggcgttata

SEQ ID NO: 615501 - DNA, 25 bp, Homo sapien
gcaacactttctgggcgttataagg

SEQ ID NO: 615502 - DNA, 25 bp, Homo sapien
cactttctgggcgttataaggaaga

SEQ ID NO: 615503 - DNA, 25 bp, Homo sapien
tgggcgttataaggaagatggcctc

SEQ ID NO: 615504 - DNA, 25 bp, Homo sapien
cttgaattgtaatccgaattgtaac

SEQ ID NO: 615505 - DNA, 25 bp, Homo sapien
ttgaattgtaatccgaattgtaacc

SEQ ID NO: 615506 - DNA, 25 bp, Homo sapien
tgtaatccgaattgtaacccccacg

SEQ ID NO: 615507 - DNA, 25 bp, Homo sapien
taatccgaattgtaacccccacgtg

SEQ ID NO: 615508 - DNA, 25 bp, Homo sapien
tccgaattgtaacccccacgtgttg

SEQ ID NO: 615509 - DNA, 25 bp, Homo sapien
ctgaaggttttgcaaggagcttttc

SEQ ID NO: 615510 - DNA, 25 bp, Homo sapien
tgaaggttttgcaaggagcttttcc

SEQ ID NO: 615511 - DNA, 25 bp, Homo sapien
cttttgctcaggactctccttcctg

SEQ ID NO: 615512 - DNA, 25 bp, Homo sapien
ttttgctcaggactctccttcctgc

SEQ ID NO: 615513 - DNA, 25 bp, Homo sapien
tttgctcaggactctccttcctgca

SEQ ID NO: 615514 - DNA, 25 bp, Homo sapien
gaggcctccccagaactatgagtca

SEQ ID NO: 615515 - DNA, 25 bp, Homo sapien
taagatctgcaggtttttttccaac

SEQ ID NO: 615516 - DNA, 25 bp, Homo sapien
gtttatagcttttcaccccacggat

SEQ ID NO: 615517 - DNA, 25 bp, Homo sapien
cacggatccccgaggccatgacagg

SEQ ID NO: 615518 - DNA, 25 bp, Homo sapien
tccccgaggccatgacaggcagtga

SEQ ID NO: 615519 - DNA, 25 bp, Homo sapien
gccatgacaggcagtgacctccttg

SEQ ID NO: 615520 - DNA, 25 bp, Homo sapien
ccccatcttgggagggcttgtccag

SEQ ID NO: 615521 - DNA, 25 bp, Homo sapien
tgggagggcttgtccagtttcagtt

SEQ ID NO: 615522 - DNA, 25 bp, Homo sapien
ttactaggctttgttttacagtcac

SEQ ID NO: 615523 - DNA, 25 bp, Homo sapien
ggctttgttttacagtcactagtta

SEQ ID NO: 615524 - DNA, 25 bp, Homo sapien
aacttcttgtctcaagggacttcat

SEQ ID NO: 615525 - DNA, 25 bp, Homo sapien
ttgtctcaagggacttcattttaat

SEQ ID NO: 615526 - DNA, 25 bp, Homo sapien
gagctacgataacaccactgcacta

SEQ ID NO: 615527 - DNA, 25 bp, Homo sapien
agctacgataacaccactgcactac

SEQ ID NO: 615528 - DNA, 25 bp, Homo sapien
ctacgataacaccactgcactacag

SEQ ID NO: 615529 - DNA, 25 bp, Homo sapien
tggatgacagagcaacactttgtgt

SEQ ID NO: 615530 - DNA, 25 bp, Homo sapien
ggatgacagagcaacactttgtgtc

SEQ ID NO: 615531 - DNA, 25 bp, Homo sapien
gatgacagagcaacactttgtgtca

SEQ ID NO: 615532 - DNA, 25 bp, Homo sapien
atgacagagcaacactttgtgtcaa

SEQ ID NO: 615533 - DNA, 25 bp, Homo sapien
tgacagagcaacactttgtgtcaaa

SEQ ID NO: 615534 - DNA, 25 bp, Homo sapien
agcaacactttgtgtcaaaaaaaag

SEQ ID NO: 615535 - DNA, 25 bp, Homo sapien
gcaacactttgtgtcaaaaaaaaga

SEQ ID NO: 615536 - DNA, 25 bp, Homo sapien
caacactttgtgtcaaaaaaaagag

SEQ ID NO: 615537 - DNA, 25 bp, Homo sapien
acactcattccaaaaagtcaggaaa

SEQ ID NO: 615538 - DNA, 25 bp, Homo sapien
gatcaaattctatacacagttatta

SEQ ID NO: 615539 - DNA, 25 bp, Homo sapien
ggagcagattaacatccttacagac

SEQ ID NO: 615540 - DNA, 25 bp, Homo sapien
gcagattaacatccttacagacaat

SEQ ID NO: 615541 - DNA, 25 bp, Homo sapien
tacagacaatgaaaacacaccaggg

SEQ ID NO: 615542 - DNA, 25 bp, Homo sapien
aaacacaccagggagacaccataaa

SEQ ID NO: 615543 - DNA, 25 bp, Homo sapien
acaccagggagacaccataaaacag

SEQ ID NO: 615544 - DNA, 25 bp, Homo sapien
gggagacaccataaaacagaccaag

SEQ ID NO: 615545 - DNA, 25 bp, Homo sapien
gacaccataaaacagaccaagacta

SEQ ID NO: 615546 - DNA, 25 bp, Homo sapien
cataaaacagaccaagactaactta

SEQ ID NO: 615547 - DNA, 25 bp, Homo sapien
aaaacaaatacatcagcctgggcat

SEQ ID NO: 615548 - DNA, 25 bp, Homo sapien
ataattatgcaaggctatatggtta

SEQ ID NO: 615549 - DNA, 25 bp, Homo sapien
tatgcaaggctatatggttattagg

SEQ ID NO: 615550 - DNA, 25 bp, Homo sapien
atggttattaggacagtgattaaaa

SEQ ID NO: 615551 - DNA, 25 bp, Homo sapien
ttaggacagtgattaaaaacagctt

SEQ ID NO: 615552 - DNA, 25 bp, Homo sapien
ggacagtgattaaaaacagcttaat

SEQ ID NO: 615553 - DNA, 25 bp, Homo sapien
tgataatgtactttaaattctctgt

SEQ ID NO: 615554 - DNA, 25 bp, Homo sapien
atagatattaaacgattgggtatta

SEQ ID NO: 615555 - DNA, 25 bp, Homo sapien
attgggtattagaatctgtacatta

SEQ ID NO: 615556 - DNA, 25 bp, Homo sapien
gggtattagaatctgtacattatta

SEQ ID NO: 615557 - DNA, 25 bp, Homo sapien
gtattagaatctgtacattattaaa

SEQ ID NO: 615558 - DNA, 25 bp, Homo sapien
cattattaaatgacactacatgtgc

SEQ ID NO: 615559 - DNA, 25 bp, Homo sapien
attatctgaagaactcccctggaag

SEQ ID NO: 615560 - DNA, 25 bp, Homo sapien
ctggaagctcttctcacaactggaa

SEQ ID NO: 615561 - DNA, 25 bp, Homo sapien
gaagctcttctcacaactggaaaaa

SEQ ID NO: 615562 - DNA, 25 bp, Homo sapien
ctggaaaaacacagcagccagttag

SEQ ID NO: 615563 - DNA, 25 bp, Homo sapien
gcagccagttagcagagccacgtcc

SEQ ID NO: 615564 - DNA, 25 bp, Homo sapien
agagccacgtcccaggccaaaataa

SEQ ID NO: 615565 - DNA, 25 bp, Homo sapien
aggccaaaataactgcctgacagtc

SEQ ID NO: 615566 - DNA, 25 bp, Homo sapien
gggcacagcattctggcccaacctt

SEQ ID NO: 615567 - DNA, 25 bp, Homo sapien
ttctggcccaaccttgcaggaatgt

SEQ ID NO: 615568 - DNA, 25 bp, Homo sapien
ccttgcaggaatgtggttctgacaa

SEQ ID NO: 615569 - DNA, 25 bp, Homo sapien
atgtggttctgacaaaccagctgga

SEQ ID NO: 615570 - DNA, 25 bp, Homo sapien
aattctttcaggcaacagtgataag

SEQ ID NO: 615571 - DNA, 25 bp, Homo sapien
gtgttcccagtgtctggagcacaca

SEQ ID NO: 615572 - DNA, 25 bp, Homo sapien
gagcacacactctaaacacatcggg

SEQ ID NO: 615573 - DNA, 25 bp, Homo sapien
catgaattcgccctgtttgagactc

SEQ ID NO: 615574 - DNA, 25 bp, Homo sapien
attcgccctgtttgagactcagttt

SEQ ID NO: 615575 - DNA, 25 bp, Homo sapien
gagactcagtttctgaggccaagag

SEQ ID NO: 615576 - DNA, 25 bp, Homo sapien
ggccaagagttcgttctcggtggat

SEQ ID NO: 615577 - DNA, 25 bp, Homo sapien
ctcggtggatcgctacacgttgaaa

SEQ ID NO: 615578 - DNA, 25 bp, Homo sapien
ttgtgtaaggtcaacattcaggcta

SEQ ID NO: 615579 - DNA, 25 bp, Homo sapien
ttcaggctatagtacgatggcatgg

SEQ ID NO: 615580 - DNA, 25 bp, Homo sapien
gcatggtggagagaaaacacttttc

SEQ ID NO: 615581 - DNA, 25 bp, Homo sapien
catgtttctcatttttgcaaagcac

SEQ ID NO: 615582 - DNA, 25 bp, Homo sapien
ttatcattctaagtatgggcagtta

SEQ ID NO: 615583 - DNA, 25 bp, Homo sapien
gggcagttagtgaaacttgtctttc

SEQ ID NO: 615584 - DNA, 25 bp, Homo sapien
tcatcattaaaatctgttcttcaca

SEQ ID NO: 615585 - DNA, 25 bp, Homo sapien
acttcttaatgtagcacagcccagc

SEQ ID NO: 615586 - DNA, 25 bp, Homo sapien
tagccactaccaggacactacaaaa

SEQ ID NO: 615587 - DNA, 25 bp, Homo sapien
tgctcaggctttgccaaagtctcag

SEQ ID NO: 615588 - DNA, 25 bp, Homo sapien
gctttgccaaagtctcaggcttata

SEQ ID NO: 615589 - DNA, 25 bp, Homo sapien
tagagaattttcttgcacccaaaag

SEQ ID NO: 615590 - DNA, 25 bp, Homo sapien
caagcatcactgtctaactcaagcc

SEQ ID NO: 615591 - DNA, 25 bp, Homo sapien
aactcaagccctgttttgtttatgt

SEQ ID NO: 615592 - DNA, 25 bp, Homo sapien
aggattaaatggtgccacaggggcc

SEQ ID NO: 615593 - DNA, 25 bp, Homo sapien
ggattaaatggtgccacaggggcca

SEQ ID NO: 615594 - DNA, 25 bp, Homo sapien
gattaaatggtgccacaggggccag

SEQ ID NO: 615595 - DNA, 25 bp, Homo sapien
attaaatggtgccacaggggccagg

SEQ ID NO: 615596 - DNA, 25 bp, Homo sapien
ttaaatggtgccacaggggccaggc

SEQ ID NO: 615597 - DNA, 25 bp, Homo sapien
taaatggtgccacaggggccaggcg

SEQ ID NO: 615598 - DNA, 25 bp, Homo sapien
aaatggtgccacaggggccaggcgc

SEQ ID NO: 615599 - DNA, 25 bp, Homo sapien
aatggtgccacaggggccaggcgca

SEQ ID NO: 615600 - DNA, 25 bp, Homo sapien
atggtgccacaggggccaggcgcag

SEQ ID NO: 615601 - DNA, 25 bp, Homo sapien
ttgaattgtaatccgaattgtaacc

SEQ ID NO: 615602 - DNA, 25 bp, Homo sapien
tgtaatccgaattgtaacccccacg

SEQ ID NO: 615603 - DNA, 25 bp, Homo sapien
taatccgaattgtaacccccacgtg

SEQ ID NO: 615604 - DNA, 25 bp, Homo sapien
tccgaattgtaacccccacgtgttg

SEQ ID NO: 615605 - DNA, 25 bp, Homo sapien
tctcacgagatctgaaggttttgca

SEQ ID NO: 615606 - DNA, 25 bp, Homo sapien
tgaaggttttgcaaggagcttttcc

SEQ ID NO: 615607 - DNA, 25 bp, Homo sapien
cttttgctcaggactctccttcctg

SEQ ID NO: 615608 - DNA, 25 bp, Homo sapien
tttgctcaggactctccttcctgca

SEQ ID NO: 615609 - DNA, 25 bp, Homo sapien
ctccttcctgcagccaagtgaagga

SEQ ID NO: 615610 - DNA, 25 bp, Homo sapien
caagtgaaggacaagtttgcttccc

SEQ ID NO: 615611 - DNA, 25 bp, Homo sapien
gaggcctccccagaactatgagtca

SEQ ID NO: 615612 - DNA, 25 bp, Homo sapien
aaaactggtaacaggctgggtgcaa

SEQ ID NO: 615613 - DNA, 25 bp, Homo sapien
aaactggtaacaggctgggtgcaat

SEQ ID NO: 615614 - DNA, 25 bp, Homo sapien
aactggtaacaggctgggtgcaatg

SEQ ID NO: 615615 - DNA, 25 bp, Homo sapien
actggtaacaggctgggtgcaatgg

SEQ ID NO: 615616 - DNA, 25 bp, Homo sapien
ctggtaacaggctgggtgcaatggc

SEQ ID NO: 615617 - DNA, 25 bp, Homo sapien
tggtaacaggctgggtgcaatggct

SEQ ID NO: 615618 - DNA, 25 bp, Homo sapien
caggcatggcggctggcacctataa

SEQ ID NO: 615619 - DNA, 25 bp, Homo sapien
aggcatggcggctggcacctataat

SEQ ID NO: 615620 - DNA, 25 bp, Homo sapien
ggcatggcggctggcacctataatc

SEQ ID NO: 615621 - DNA, 25 bp, Homo sapien
gcatggcggctggcacctataatcc

SEQ ID NO: 615622 - DNA, 25 bp, Homo sapien
catggcggctggcacctataatccc

SEQ ID NO: 615623 - DNA, 25 bp, Homo sapien
tgagagagtacatcttccacttatt

SEQ ID NO: 615624 - DNA, 25 bp, Homo sapien
gaagacattgttatcatacaagatg

SEQ ID NO: 615625 - DNA, 25 bp, Homo sapien
catacaagatgatagctccatgcat

SEQ ID NO: 615626 - DNA, 25 bp, Homo sapien
tccatgcatgttattgaacctgaaa

SEQ ID NO: 615627 - DNA, 25 bp, Homo sapien
attgaacctgaaaaccttccaatag

SEQ ID NO: 615628 - DNA, 25 bp, Homo sapien
tactgacaatcctggccgtgcgtag

SEQ ID NO: 615629 - DNA, 25 bp, Homo sapien
aatcctggccgtgcgtaggcctaag

SEQ ID NO: 615630 - DNA, 25 bp, Homo sapien
cgtgcgtaggcctaagctaatgtgt

SEQ ID NO: 615631 - DNA, 25 bp, Homo sapien
aggcctaagctaatgtgtgagttta

SEQ ID NO: 615632 - DNA, 25 bp, Homo sapien
gtgtgagtttatgtcttacctttta

SEQ ID NO: 615633 - DNA, 25 bp, Homo sapien
tgagtttatgtcttaccttttaaca

SEQ ID NO: 615634 - DNA, 25 bp, Homo sapien
agccatgcgcgataataaaattgtg

SEQ ID NO: 615635 - DNA, 25 bp, Homo sapien
gccatgcgcgataataaaattgtgt

SEQ ID NO: 615636 - DNA, 25 bp, Homo sapien
ccatgcgcgataataaaattgtgtt

SEQ ID NO: 615637 - DNA, 25 bp, Homo sapien
cctctgcccccaagttgaaacaagt

SEQ ID NO: 615638 - DNA, 25 bp, Homo sapien
ccccaagttgaaacaagtctcatgc

SEQ ID NO: 615639 - DNA, 25 bp, Homo sapien
ccaagttgaaacaagtctcatgcct

SEQ ID NO: 615640 - DNA, 25 bp, Homo sapien
caagttgaaacaagtctcatgcctc

SEQ ID NO: 615641 - DNA, 25 bp, Homo sapien
aagttgaaacaagtctcatgcctca

SEQ ID NO: 615642 - DNA, 25 bp, Homo sapien
agttgaaacaagtctcatgcctcag

SEQ ID NO: 615643 - DNA, 25 bp, Homo sapien
gttgaaacaagtctcatgcctcagt

SEQ ID NO: 615644 - DNA, 25 bp, Homo sapien
ttgaaacaagtctcatgcctcagtc

SEQ ID NO: 615645 - DNA, 25 bp, Homo sapien
tttgggcaaccaaggccggaggatc

SEQ ID NO: 615646 - DNA, 25 bp, Homo sapien
gaagtttaataccagcctggttaag

SEQ ID NO: 615647 - DNA, 25 bp, Homo sapien
agtttaataccagcctggttaagat

SEQ ID NO: 615648 - DNA, 25 bp, Homo sapien
tttaataccagcctggttaagatag

SEQ ID NO: 615649 - DNA, 25 bp, Homo sapien
aataccagcctggttaagatagtga

SEQ ID NO: 615650 - DNA, 25 bp, Homo sapien
gcctggttaagatagtgagatgctt

SEQ ID NO: 615651 - DNA, 25 bp, Homo sapien
cctggttaagatagtgagatgctta

SEQ ID NO: 615652 - DNA, 25 bp, Homo sapien
ggttaagatagtgagatgcttactc

SEQ ID NO: 615653 - DNA, 25 bp, Homo sapien
tgagatgcttactctacaaaaataa

SEQ ID NO: 615654 - DNA, 25 bp, Homo sapien
aaaaaataagttagctggatgcagt

SEQ ID NO: 615655 - DNA, 25 bp, Homo sapien
ctggatgcagtggtgagtttctaag

SEQ ID NO: 615656 - DNA, 25 bp, Homo sapien
ctttttcaggagtattttctttgat

SEQ ID NO: 615657 - DNA, 25 bp, Homo sapien
aaagatttgtgtgtgccttgttaat

SEQ ID NO: 615658 - DNA, 25 bp, Homo sapien
gtgtgtgccttgttaataggcctca

SEQ ID NO: 615659 - DNA, 25 bp, Homo sapien
ttgttaataggcctcaacgggctaa

SEQ ID NO: 615660 - DNA, 25 bp, Homo sapien
taataggcctcaacgggctaaatac

SEQ ID NO: 615661 - DNA, 25 bp, Homo sapien
ggctaaatacaacaggacaaccaat

SEQ ID NO: 615662 - DNA, 25 bp, Homo sapien
ggacaaccaatgattaacttttaag

SEQ ID NO: 615663 - DNA, 25 bp, Homo sapien
aaaatgtgttgcagataatagaatc

SEQ ID NO: 615664 - DNA, 25 bp, Homo sapien
atagaatctatgcaaaatgtgtttg

SEQ ID NO: 615665 - DNA, 25 bp, Homo sapien
atttggataattccaccatggatat

SEQ ID NO: 615666 - DNA, 25 bp, Homo sapien
atatattatcattactcttacatgt

SEQ ID NO: 615667 - DNA, 25 bp, Homo sapien
ttgtaagttacaacattccactgga

SEQ ID NO: 615668 - DNA, 25 bp, Homo sapien
tgtaagttacaacattccactggat

SEQ ID NO: 615669 - DNA, 25 bp, Homo sapien
attccactggatccttatattgcct

SEQ ID NO: 615670 - DNA, 25 bp, Homo sapien
tccttatattgcctgtagtggaaga

SEQ ID NO: 615671 - DNA, 25 bp, Homo sapien
atattgcctgtagtggaagagggtc

SEQ ID NO: 615672 - DNA, 25 bp, Homo sapien
gaagagggtcttgtgtgtctgcccc

SEQ ID NO: 615673 - DNA, 25 bp, Homo sapien
aagagggtcttgtgtgtctgcccct

SEQ ID NO: 615674 - DNA, 25 bp, Homo sapien
gtgtctgccccttctagttttcact

SEQ ID NO: 615675 - DNA, 25 bp, Homo sapien
taggataatttagtctttggcatgt

SEQ ID NO: 615676 - DNA, 25 bp, Homo sapien
gataatttagtctttggcatgtggc

SEQ ID NO: 615677 - DNA, 25 bp, Homo sapien
tttagtctttggcatgtggcattat

SEQ ID NO: 615678 - DNA, 25 bp, Homo sapien
tcctttgttgcttcatttttctcta

SEQ ID NO: 615679 - DNA, 25 bp, Homo sapien
gcttcatttttctctacagcattcc

SEQ ID NO: 615680 - DNA, 25 bp, Homo sapien
attccccaaattaccaccgtggatg

SEQ ID NO: 615681 - DNA, 25 bp, Homo sapien
ttaccaccgtggatgctgcaatttt

SEQ ID NO: 615682 - DNA, 25 bp, Homo sapien
gcaattttgcatgtgggtcttattc

SEQ ID NO: 615683 - DNA, 25 bp, Homo sapien
tccagtcaaacgcaagctccaggca

SEQ ID NO: 615684 - DNA, 25 bp, Homo sapien
tgagtgcattggacacggcgagtat

SEQ ID NO: 615685 - DNA, 25 bp, Homo sapien
gtattattctgtttttggactccgt

SEQ ID NO: 615686 - DNA, 25 bp, Homo sapien
tggactccgtttcggttctatgcgg

SEQ ID NO: 615687 - DNA, 25 bp, Homo sapien
ctatgcggacgcgtatgtgtacact

SEQ ID NO: 615688 - DNA, 25 bp, Homo sapien
gtatgtgtacactgggagctgatgt

SEQ ID NO: 615689 - DNA, 25 bp, Homo sapien
tttaacccacttcaaggctatttgt

SEQ ID NO: 615690 - DNA, 25 bp, Homo sapien
tgttttcctttaattgttcaatcgg

SEQ ID NO: 615691 - DNA, 25 bp, Homo sapien
gtaacttttagcaaccacattccct

SEQ ID NO: 615692 - DNA, 25 bp, Homo sapien
caaccacattccctacagcaaaagg

SEQ ID NO: 615693 - DNA, 25 bp, Homo sapien
aaagggttattagggaggcactcag

SEQ ID NO: 615694 - DNA, 25 bp, Homo sapien
aggcactcagttcctcaatagttcc

SEQ ID NO: 615695 - DNA, 25 bp, Homo sapien
caggaaacatagaccacagcccttt

SEQ ID NO: 615696 - DNA, 25 bp, Homo sapien
agccctttgggaaagacactgcttc

SEQ ID NO: 615697 - DNA, 25 bp, Homo sapien
gacactgcttcttaaattgctaacc

SEQ ID NO: 615698 - DNA, 25 bp, Homo sapien
tccctagtgaccagaactggccaag

SEQ ID NO: 615699 - DNA, 25 bp, Homo sapien
tgaaagggctgatcccacagggaaa

SEQ ID NO: 615700 - DNA, 25 bp, Homo sapien
taatcaagatctactcatggggctg

SEQ ID NO: 615701 - DNA, 25 bp, Homo sapien
aatcaagatctactcatggggctgg

SEQ ID NO: 615702 - DNA, 25 bp, Homo sapien
atcaagatctactcatggggctggg

SEQ ID NO: 615703 - DNA, 25 bp, Homo sapien
tcaagatctactcatggggctgggc

SEQ ID NO: 615704 - DNA, 25 bp, Homo sapien
caagatctactcatggggctgggcc

SEQ ID NO: 615705 - DNA, 25 bp, Homo sapien
aagatctactcatggggctgggcct

SEQ ID NO: 615706 - DNA, 25 bp, Homo sapien
agatctactcatggggctgggcctg

SEQ ID NO: 615707 - DNA, 25 bp, Homo sapien
gatctactcatggggctgggcctgg

SEQ ID NO: 615708 - DNA, 25 bp, Homo sapien
atctactcatggggctgggcctggt

SEQ ID NO: 615709 - DNA, 25 bp, Homo sapien
ctactcatggggctgggcctggtgg

SEQ ID NO: 615710 - DNA, 25 bp, Homo sapien
tgggcctggtggttcacacgtgtaa

SEQ ID NO: 615711 - DNA, 25 bp, Homo sapien
aatgagcttgggtcatatgcccatc

SEQ ID NO: 615712 - DNA, 25 bp, Homo sapien
tgagcttgggtcatatgcccatcac

SEQ ID NO: 615713 - DNA, 25 bp, Homo sapien
gagcttgggtcatatgcccatcact

SEQ ID NO: 615714 - DNA, 25 bp, Homo sapien
cttgggtcatatgcccatcactgag

SEQ ID NO: 615715 - DNA, 25 bp, Homo sapien
gggtcatatgcccatcactgagtca

SEQ ID NO: 615716 - DNA, 25 bp, Homo sapien
gtcatatgcccatcactgagtcaat

SEQ ID NO: 615717 - DNA, 25 bp, Homo sapien
catatgcccatcactgagtcaatca

SEQ ID NO: 615718 - DNA, 25 bp, Homo sapien
atatgcccatcactgagtcaatcag

SEQ ID NO: 615719 - DNA, 25 bp, Homo sapien
atgcccatcactgagtcaatcagtt

SEQ ID NO: 615720 - DNA, 25 bp, Homo sapien
gcccatcactgagtcaatcagttta

SEQ ID NO: 615721 - DNA, 25 bp, Homo sapien
gtttagtcaagagaaatggactttg

SEQ ID NO: 615722 - DNA, 25 bp, Homo sapien
aggattaaatggtgccacaggggcc

SEQ ID NO: 615723 - DNA, 25 bp, Homo sapien
ggattaaatggtgccacaggggcca

SEQ ID NO: 615724 - DNA, 25 bp, Homo sapien
ttaaatggtgccacaggggccaggc

SEQ ID NO: 615725 - DNA, 25 bp, Homo sapien
taaatggtgccacaggggccaggcg

SEQ ID NO: 615726 - DNA, 25 bp, Homo sapien
aaatggtgccacaggggccaggcgc

SEQ ID NO: 615727 - DNA, 25 bp, Homo sapien
aatggtgccacaggggccaggcgca

SEQ ID NO: 615728 - DNA, 25 bp, Homo sapien
atggtgccacaggggccaggcgcag

SEQ ID NO: 615729 - DNA, 25 bp, Homo sapien
tggtgccacaggggccaggcgcagt

SEQ ID NO: 615730 - DNA, 25 bp, Homo sapien
ggtgccacaggggccaggcgcagtg

SEQ ID NO: 615731 - DNA, 25 bp, Homo sapien
ccagcctcagcaacagagcaaaact

SEQ ID NO: 615732 - DNA, 25 bp, Homo sapien
cagcctcagcaacagagcaaaactc

SEQ ID NO: 615733 - DNA, 25 bp, Homo sapien
atcaacgggttaggcactgggtcat

SEQ ID NO: 615734 - DNA, 25 bp, Homo sapien
ggcactgggtcatattttcttgagc

SEQ ID NO: 615735 - DNA, 25 bp, Homo sapien
tttcttgagctgacttactgctcac

SEQ ID NO: 615736 - DNA, 25 bp, Homo sapien
tactgctcactgcattctgatggag

SEQ ID NO: 615737 - DNA, 25 bp, Homo sapien
gatgcttggaactctggctgcagac

SEQ ID NO: 615738 - DNA, 25 bp, Homo sapien
ggctgcagactgatgttgggtcata

SEQ ID NO: 615739 - DNA, 25 bp, Homo sapien
gttgggtcatagtaaccactattcc

SEQ ID NO: 615740 - DNA, 25 bp, Homo sapien
aaccactattcctttgtctctgggc

SEQ ID NO: 615741 - DNA, 25 bp, Homo sapien
gggccagtgttttgcacccttctgc

SEQ ID NO: 615742 - DNA, 25 bp, Homo sapien
cacccttctgctcttagaggcaaga

SEQ ID NO: 615743 - DNA, 25 bp, Homo sapien
tttccaggcttaattcagaccattt

SEQ ID NO: 615744 - DNA, 25 bp, Homo sapien
tatgggattagggagtactgcgtac

SEQ ID NO: 615745 - DNA, 25 bp, Homo sapien
gtactgcgtacatccaaggtttgtg

SEQ ID NO: 615746 - DNA, 25 bp, Homo sapien
aggtttgtggtgtttgctgagataa

SEQ ID NO: 615747 - DNA, 25 bp, Homo sapien
taacacattatcaaaagcctctcta

SEQ ID NO: 615748 - DNA, 25 bp, Homo sapien
gttctttcttggcagtctttacaac

SEQ ID NO: 615749 - DNA, 25 bp, Homo sapien
ttggcagtctttacaactgacaaca

SEQ ID NO: 615750 - DNA, 25 bp, Homo sapien
tgacaacagcagagccctctcatgt

SEQ ID NO: 615751 - DNA, 25 bp, Homo sapien
tcatgtttctatgaccttcctcagc

SEQ ID NO: 615752 - DNA, 25 bp, Homo sapien
tcctcagcacagtcggaatgcacat

SEQ ID NO: 615753 - DNA, 25 bp, Homo sapien
cggaatgcacatgtacggtatcaga

SEQ ID NO: 615754 - DNA, 25 bp, Homo sapien
tacggtatcagagagcagcccgcct

SEQ ID NO: 615755 - DNA, 25 bp, Homo sapien
aacacaacaagacctcgtatctatg

SEQ ID NO: 615756 - DNA, 25 bp, Homo sapien
cacaacaagacctcgtatctatgaa

SEQ ID NO: 615757 - DNA, 25 bp, Homo sapien
caacaagacctcgtatctatgaaaa

SEQ ID NO: 615758 - DNA, 25 bp, Homo sapien
caagacctcgtatctatgaaaaaat

SEQ ID NO: 615759 - DNA, 25 bp, Homo sapien
agacctcgtatctatgaaaaaataa

SEQ ID NO: 615760 - DNA, 25 bp, Homo sapien
taaaattagctgcacacctatttgg

SEQ ID NO: 615761 - DNA, 25 bp, Homo sapien
aaattagctgcacacctatttggtg

SEQ ID NO: 615762 - DNA, 25 bp, Homo sapien
attagctgcacacctatttggtggc

SEQ ID NO: 615763 - DNA, 25 bp, Homo sapien
tagctgcacacctatttggtggcac

SEQ ID NO: 615764 - DNA, 25 bp, Homo sapien
gctgcacacctatttggtggcacac

SEQ ID NO: 615765 - DNA, 25 bp, Homo sapien
tgcacacctatttggtggcacacac

SEQ ID NO: 615766 - DNA, 25 bp, Homo sapien
tttagatcagaattgtcacaggaaa

SEQ ID NO: 615767 - DNA, 25 bp, Homo sapien
ataaaacactttgccatcctgacag

SEQ ID NO: 615768 - DNA, 25 bp, Homo sapien
acactttgccatcctgacagtagat

SEQ ID NO: 615769 - DNA, 25 bp, Homo sapien
tgccatcctgacagtagatcagaag

SEQ ID NO: 615770 - DNA, 25 bp, Homo sapien
atagatttagtcttggtacatccag

SEQ ID NO: 615771 - DNA, 25 bp, Homo sapien
gtacatccagatttccggagtccaa

SEQ ID NO: 615772 - DNA, 25 bp, Homo sapien
gatttccggagtccaaaagtggtct

SEQ ID NO: 615773 - DNA, 25 bp, Homo sapien
gtccaaaagtggtctgtctctctgt

SEQ ID NO: 615774 - DNA, 25 bp, Homo sapien
aaaagtggtctgtctctctgtgggc

SEQ ID NO: 615775 - DNA, 25 bp, Homo sapien
ctctgtgggcaacccttgagaacca

SEQ ID NO: 615776 - DNA, 25 bp, Homo sapien
ataccccaatgggactgggcacagt

SEQ ID NO: 615777 - DNA, 25 bp, Homo sapien
gaccatcttggccggcgtggtggag

SEQ ID NO: 615778 - DNA, 25 bp, Homo sapien
accatcttggccggcgtggtggagc

SEQ ID NO: 615779 - DNA, 25 bp, Homo sapien
ccatcttggccggcgtggtggagcc

SEQ ID NO: 615780 - DNA, 25 bp, Homo sapien
atcttggccggcgtggtggagccct

SEQ ID NO: 615781 - DNA, 25 bp, Homo sapien
tcttggccggcgtggtggagccctg

SEQ ID NO: 615782 - DNA, 25 bp, Homo sapien
ttggccggcgtggtggagccctgtc

SEQ ID NO: 615783 - DNA, 25 bp, Homo sapien
gcgtggtggagccctgtctctgctg

SEQ ID NO: 615784 - DNA, 25 bp, Homo sapien
ctgctgaaaatgcaaggattggctg

SEQ ID NO: 615785 - DNA, 25 bp, Homo sapien
tgctgaaaatgcaaggattggctgg

SEQ ID NO: 615786 - DNA, 25 bp, Homo sapien
gctgaaaatgcaaggattggctggg

SEQ ID NO: 615787 - DNA, 25 bp, Homo sapien
ctgaaaatgcaaggattggctgggc

SEQ ID NO: 615788 - DNA, 25 bp, Homo sapien
tacacaagaaaaagtatagtaggct

SEQ ID NO: 615789 - DNA, 25 bp, Homo sapien
acacaagaaaaagtatagtaggctg

SEQ ID NO: 615790 - DNA, 25 bp, Homo sapien
cacaagaaaaagtatagtaggctgg

SEQ ID NO: 615791 - DNA, 25 bp, Homo sapien
tgagctatgattactacacccttgc

SEQ ID NO: 615792 - DNA, 25 bp, Homo sapien
gagctatgattactacacccttgca

SEQ ID NO: 615793 - DNA, 25 bp, Homo sapien
agctatgattactacacccttgcac

SEQ ID NO: 615794 - DNA, 25 bp, Homo sapien
gctatgattactacacccttgcact

SEQ ID NO: 615795 - DNA, 25 bp, Homo sapien
ctatgattactacacccttgcactc

SEQ ID NO: 615796 - DNA, 25 bp, Homo sapien
tatgattactacacccttgcactcc

SEQ ID NO: 615797 - DNA, 25 bp, Homo sapien
atgattactacacccttgcactcca

SEQ ID NO: 615798 - DNA, 25 bp, Homo sapien
actgcactcagcctaaaactgtatg

SEQ ID NO: 615799 - DNA, 25 bp, Homo sapien
taaaactgtatgttctctctagaaa

SEQ ID NO: 615800 - DNA, 25 bp, Homo sapien
actcttattgtactcagaatttcag

SEQ ID NO: 615801 - DNA, 25 bp, Homo sapien
aattcagagaattctcagaacccag

SEQ ID NO: 615802 - DNA, 25 bp, Homo sapien
ggaataaccctgagtatttgaaaat

SEQ ID NO: 615803 - DNA, 25 bp, Homo sapien
aatacatgttgttatgtcttccatt

SEQ ID NO: 615804 - DNA, 25 bp, Homo sapien
atgtcttccatttttgcccattgat

SEQ ID NO: 615805 - DNA, 25 bp, Homo sapien
ttgcccattgatgtgcatgaaacaa

SEQ ID NO: 615806 - DNA, 25 bp, Homo sapien
atgaaacaagcacagttccctttcc

SEQ ID NO: 615807 - DNA, 25 bp, Homo sapien
gttccctttccacatgaaagccttt

SEQ ID NO: 615808 - DNA, 25 bp, Homo sapien
gatgtaccatatcacatactgtgca

SEQ ID NO: 615809 - DNA, 25 bp, Homo sapien
ttttttaaaagtagctgcgtgtagt

SEQ ID NO: 615810 - DNA, 25 bp, Homo sapien
aaagtagctgcgtgtagtggtctca

SEQ ID NO: 615811 - DNA, 25 bp, Homo sapien
aagtagctgcgtgtagtggtctcaa

SEQ ID NO: 615812 - DNA, 25 bp, Homo sapien
agtagctgcgtgtagtggtctcaac

SEQ ID NO: 615813 - DNA, 25 bp, Homo sapien
gtagctgcgtgtagtggtctcaact

SEQ ID NO: 615814 - DNA, 25 bp, Homo sapien
tagctgcgtgtagtggtctcaacta

SEQ ID NO: 615815 - DNA, 25 bp, Homo sapien
agctgcgtgtagtggtctcaactac

SEQ ID NO: 615816 - DNA, 25 bp, Homo sapien
gctgcgtgtagtggtctcaactact

SEQ ID NO: 615817 - DNA, 25 bp, Homo sapien
ctgcgtgtagtggtctcaactactc

SEQ ID NO: 615818 - DNA, 25 bp, Homo sapien
gcgtgtagtggtctcaactactcaa

SEQ ID NO: 615819 - DNA, 25 bp, Homo sapien
gtagtggtctcaactactcaagagg

SEQ ID NO: 615820 - DNA, 25 bp, Homo sapien
ctttaaaaactgatggcaaaggtct

SEQ ID NO: 615821 - DNA, 25 bp, Homo sapien
tttaaaaactgatggcaaaggtctg

SEQ ID NO: 615822 - DNA, 25 bp, Homo sapien
ttaaaaactgatggcaaaggtctgg

SEQ ID NO: 615823 - DNA, 25 bp, Homo sapien
taaaaactgatggcaaaggtctggc

SEQ ID NO: 615824 - DNA, 25 bp, Homo sapien
aaaaactgatggcaaaggtctggcg

SEQ ID NO: 615825 - DNA, 25 bp, Homo sapien
aaaactgatggcaaaggtctggcgc

SEQ ID NO: 615826 - DNA, 25 bp, Homo sapien
aaactgatggcaaaggtctggcgca

SEQ ID NO: 615827 - DNA, 25 bp, Homo sapien
aactgatggcaaaggtctggcgcag

SEQ ID NO: 615828 - DNA, 25 bp, Homo sapien
actgatggcaaaggtctggcgcagt

SEQ ID NO: 615829 - DNA, 25 bp, Homo sapien
ctgatggcaaaggtctggcgcagtg

SEQ ID NO: 615830 - DNA, 25 bp, Homo sapien
aaatctcaagaaaggatcgaccggg

SEQ ID NO: 615831 - DNA, 25 bp, Homo sapien
aatctcaagaaaggatcgaccgggc

SEQ ID NO: 615832 - DNA, 25 bp, Homo sapien
atctcaagaaaggatcgaccgggca

SEQ ID NO: 615833 - DNA, 25 bp, Homo sapien
tctcaagaaaggatcgaccgggcat

SEQ ID NO: 615834 - DNA, 25 bp, Homo sapien
ctcaagaaaggatcgaccgggcata

SEQ ID NO: 615835 - DNA, 25 bp, Homo sapien
tcaagaaaggatcgaccgggcatag

SEQ ID NO: 615836 - DNA, 25 bp, Homo sapien
caagaaaggatcgaccgggcatagt

SEQ ID NO: 615837 - DNA, 25 bp, Homo sapien
aagaaaggatcgaccgggcatagtg

SEQ ID NO: 615838 - DNA, 25 bp, Homo sapien
aaaggatcgaccgggcatagtggct

SEQ ID NO: 615839 - DNA, 25 bp, Homo sapien
aggcagaggtgagagaatcgtgctt

SEQ ID NO: 615840 - DNA, 25 bp, Homo sapien
agaatcgtgcttgaacaggggagat

SEQ ID NO: 615841 - DNA, 25 bp, Homo sapien
ggaggacccgcctcaaagagccggc

SEQ ID NO: 615842 - DNA, 25 bp, Homo sapien
gatcatcgcctcctagaatacccag

SEQ ID NO: 615843 - DNA, 25 bp, Homo sapien
tcctagaatacccagctcaacgtct

SEQ ID NO: 615844 - DNA, 25 bp, Homo sapien
agaatacccagctcaacgtctacct

SEQ ID NO: 615845 - DNA, 25 bp, Homo sapien
agctcaacgtctacctggagtcggc

SEQ ID NO: 615846 - DNA, 25 bp, Homo sapien
aggacgcgctcatctcaaacccaga

SEQ ID NO: 615847 - DNA, 25 bp, Homo sapien
gctcatctcaaacccagagctcagg

SEQ ID NO: 615848 - DNA, 25 bp, Homo sapien
ccagagctcaggcttttagggcaga

SEQ ID NO: 615849 - DNA, 25 bp, Homo sapien
ctcaggcttttagggcagagagcga

SEQ ID NO: 615850 - DNA, 25 bp, Homo sapien
tgaggtccaaggaataggattgcct

SEQ ID NO: 615851 - DNA, 25 bp, Homo sapien
catcttgtagtcattcagcaaacat

SEQ ID NO: 615852 - DNA, 25 bp, Homo sapien
caaggtgaattgtttgcataaataa

SEQ ID NO: 615853 - DNA, 25 bp, Homo sapien
gaattgtttgcataaataagctcac

SEQ ID NO: 615854 - DNA, 25 bp, Homo sapien
attgtttgcataaataagctcacag

SEQ ID NO: 615855 - DNA, 25 bp, Homo sapien
tgtttgcataaataagctcacagag

SEQ ID NO: 615856 - DNA, 25 bp, Homo sapien
gtttgcataaataagctcacagagg

SEQ ID NO: 615857 - DNA, 25 bp, Homo sapien
tttgcataaataagctcacagaggc

SEQ ID NO: 615858 - DNA, 25 bp, Homo sapien
ttgcataaataagctcacagaggct

SEQ ID NO: 615859 - DNA, 25 bp, Homo sapien
tgcataaataagctcacagaggctg

SEQ ID NO: 615860 - DNA, 25 bp, Homo sapien
gcataaataagctcacagaggctgg

SEQ ID NO: 615861 - DNA, 25 bp, Homo sapien
aaataagctcacagaggctgggcgt

SEQ ID NO: 615862 - DNA, 25 bp, Homo sapien
aataagctcacagaggctgggcgtg

SEQ ID NO: 615863 - DNA, 25 bp, Homo sapien
ttccagcatgagattagccttcaat

SEQ ID NO: 615864 - DNA, 25 bp, Homo sapien
tagccttcaatattgatttctggaa

SEQ ID NO: 615865 - DNA, 25 bp, Homo sapien
cattgattaacctaaaacttttgag

SEQ ID NO: 615866 - DNA, 25 bp, Homo sapien
gattatataactgtaactgtctaga

SEQ ID NO: 615867 - DNA, 25 bp, Homo sapien
gaaatttaagccttttcctcagaat

SEQ ID NO: 615868 - DNA, 25 bp, Homo sapien
tttaagccttttcctcagaattatt

SEQ ID NO: 615869 - DNA, 25 bp, Homo sapien
cttactgatagattactggacttga

SEQ ID NO: 615870 - DNA, 25 bp, Homo sapien
ggacttgagtcataatttattggtt

SEQ ID NO: 615871 - DNA, 25 bp, Homo sapien
attggttatcttattctgccctatc

SEQ ID NO: 615872 - DNA, 25 bp, Homo sapien
gttatcttattctgccctatctact

SEQ ID NO: 615873 - DNA, 25 bp, Homo sapien
gccctatctactctcagcactaatt

SEQ ID NO: 615874 - DNA, 25 bp, Homo sapien
taaagtacataatttcacagtggct

SEQ ID NO: 615875 - DNA, 25 bp, Homo sapien
aaagtacataatttcacagtggctc

SEQ ID NO: 615876 - DNA, 25 bp, Homo sapien
agtacataatttcacagtggctcat

SEQ ID NO: 615877 - DNA, 25 bp, Homo sapien
gtacataatttcacagtggctcatg

SEQ ID NO: 615878 - DNA, 25 bp, Homo sapien
gacctgcctgggtaatatgatggaa

SEQ ID NO: 615879 - DNA, 25 bp, Homo sapien
acctgcctgggtaatatgatggaac

SEQ ID NO: 615880 - DNA, 25 bp, Homo sapien
cctgcctgggtaatatgatggaacc

SEQ ID NO: 615881 - DNA, 25 bp, Homo sapien
ctgcctgggtaatatgatggaaccc

SEQ ID NO: 615882 - DNA, 25 bp, Homo sapien
tgggagaatttgctggagcctggaa

SEQ ID NO: 615883 - DNA, 25 bp, Homo sapien
gagaatttgctggagcctggaaggc

SEQ ID NO: 615884 - DNA, 25 bp, Homo sapien
gaatttgctggagcctggaaggcgg

SEQ ID NO: 615885 - DNA, 25 bp, Homo sapien
gtatttatataactatgaagcttac

SEQ ID NO: 615886 - DNA, 25 bp, Homo sapien
gaagcttacatcagaattcatctca

SEQ ID NO: 615887 - DNA, 25 bp, Homo sapien
atcagaattcatctcactggctaga

SEQ ID NO: 615888 - DNA, 25 bp, Homo sapien
aattcatctcactggctagattggt

SEQ ID NO: 615889 - DNA, 25 bp, Homo sapien
ctcactggctagattggttcatttg

SEQ ID NO: 615890 - DNA, 25 bp, Homo sapien
tggctagattggttcatttgctaaa

SEQ ID NO: 615891 - DNA, 25 bp, Homo sapien
tatccccaggagacattcactttaa

SEQ ID NO: 615892 - DNA, 25 bp, Homo sapien
ggagacattcactttaatgccttct

SEQ ID NO: 615893 - DNA, 25 bp, Homo sapien
actttaatgccttcttgtgtatcag

SEQ ID NO: 615894 - DNA, 25 bp, Homo sapien
tgccttcttgtgtatcagaaatcaa

SEQ ID NO: 615895 - DNA, 25 bp, Homo sapien
atataaagggtaggacagtgggcaa

SEQ ID NO: 615896 - DNA, 25 bp, Homo sapien
taataaagaaacaggccgggcgcgg

SEQ ID NO: 615897 - DNA, 25 bp, Homo sapien
ataaagaaacaggccgggcgcggtg

SEQ ID NO: 615898 - DNA, 25 bp, Homo sapien
taaagaaacaggccgggcgcggtgg

SEQ ID NO: 615899 - DNA, 25 bp, Homo sapien
tcctggctaacactgtggaacccct

SEQ ID NO: 615900 - DNA, 25 bp, Homo sapien
cctggctaacactgtggaaccccta

SEQ ID NO: 615901 - DNA, 25 bp, Homo sapien
ctggctaacactgtggaacccctaa

SEQ ID NO: 615902 - DNA, 25 bp, Homo sapien
tggctaacactgtggaacccctaaa

SEQ ID NO: 615903 - DNA, 25 bp, Homo sapien
gctaacactgtggaacccctaaaag

SEQ ID NO: 615904 - DNA, 25 bp, Homo sapien
gcttagtgcccactgacctcatctg

SEQ ID NO: 615905 - DNA, 25 bp, Homo sapien
cttagtgcccactgacctcatctgt

SEQ ID NO: 615906 - DNA, 25 bp, Homo sapien
tagtgcccactgacctcatctgtcc

SEQ ID NO: 615907 - DNA, 25 bp, Homo sapien
cttccccctagctggcatgaaggaa

SEQ ID NO: 615908 - DNA, 25 bp, Homo sapien
aaaaaatcgattcacattagggctg

SEQ ID NO: 615909 - DNA, 25 bp, Homo sapien
aaaaatcgattcacattagggctgt

SEQ ID NO: 615910 - DNA, 25 bp, Homo sapien
cacaatctaacagcaggggccccac

SEQ ID NO: 615911 - DNA, 25 bp, Homo sapien
gggccccacaagtaagagaagataa

SEQ ID NO: 615912 - DNA, 25 bp, Homo sapien
ggccccacaagtaagagaagataag

SEQ ID NO: 615913 - DNA, 25 bp, Homo sapien
caagtaagagaagataaggtccccg

SEQ ID NO: 615914 - DNA, 25 bp, Homo sapien
taagagaagataaggtccccggtag

SEQ ID NO: 615915 - DNA, 25 bp, Homo sapien
gcaccaggaggtatctaaatccacc

SEQ ID NO: 615916 - DNA, 25 bp, Homo sapien
accaggaggtatctaaatccaccag

SEQ ID NO: 615917 - DNA, 25 bp, Homo sapien
ggaggtatctaaatccaccaggagc

SEQ ID NO: 615918 - DNA, 25 bp, Homo sapien
ggtatctaaatccaccaggagccat

SEQ ID NO: 615919 - DNA, 25 bp, Homo sapien
gtatctaaatccaccaggagccata

SEQ ID NO: 615920 - DNA, 25 bp, Homo sapien
atctaaatccaccaggagccatagg

SEQ ID NO: 615921 - DNA, 25 bp, Homo sapien
taaatccaccaggagccataggcat

SEQ ID NO: 615922 - DNA, 25 bp, Homo sapien
aatccaccaggagccataggcatca

SEQ ID NO: 615923 - DNA, 25 bp, Homo sapien
tccatttaccagtcttccctggcaa

SEQ ID NO: 615924 - DNA, 25 bp, Homo sapien
catttaccagtcttccctggcaaga

SEQ ID NO: 615925 - DNA, 25 bp, Homo sapien
ctgccttggccaaaagaggtatggg

SEQ ID NO: 615926 - DNA, 25 bp, Homo sapien
tgtggagaacacttatacactcttg

SEQ ID NO: 615927 - DNA, 25 bp, Homo sapien
ggagaacacttatacactcttggtg

SEQ ID NO: 615928 - DNA, 25 bp, Homo sapien
tgggaaaatgaatttgttcagccac

SEQ ID NO: 615929 - DNA, 25 bp, Homo sapien
atttgttcagccacagtggaatgct

SEQ ID NO: 615930 - DNA, 25 bp, Homo sapien
ttgttcagccacagtggaatgctgt

SEQ ID NO: 615931 - DNA, 25 bp, Homo sapien
gtggaatgctgtttggcaatttctc

SEQ ID NO: 615932 - DNA, 25 bp, Homo sapien
ccaacaatcccattactaggtatag

SEQ ID NO: 615933 - DNA, 25 bp, Homo sapien
acaatcccattactaggtatagacc

SEQ ID NO: 615934 - DNA, 25 bp, Homo sapien
atataatcaacataggtacccatca

SEQ ID NO: 615935 - DNA, 25 bp, Homo sapien
taatcaacataggtacccatcaaga

SEQ ID NO: 615936 - DNA, 25 bp, Homo sapien
ggtacccatcaagaatggattggac

SEQ ID NO: 615937 - DNA, 25 bp, Homo sapien
tgaagcgggagccagcgcatgacat

SEQ ID NO: 615938 - DNA, 25 bp, Homo sapien
gaagcgggagccagcgcatgacatg

SEQ ID NO: 615939 - DNA, 25 bp, Homo sapien
ggagccagcgcatgacatggcaaga

SEQ ID NO: 615940 - DNA, 25 bp, Homo sapien
gccagcgcatgacatggcaagagca

SEQ ID NO: 615941 - DNA, 25 bp, Homo sapien
ccagcgcatgacatggcaagagcag

SEQ ID NO: 615942 - DNA, 25 bp, Homo sapien
caaaaaattagtcatgcacctataa

SEQ ID NO: 615943 - DNA, 25 bp, Homo sapien
aaattagtcatgcacctataatccc

SEQ ID NO: 615944 - DNA, 25 bp, Homo sapien
aaatacccgcctcctgtgtactcca

SEQ ID NO: 615945 - DNA, 25 bp, Homo sapien
acccgcctcctgtgtactccacagg

SEQ ID NO: 615946 - DNA, 25 bp, Homo sapien
actccacagggcacagggagctttc

SEQ ID NO: 615947 - DNA, 25 bp, Homo sapien
ctccacagggcacagggagctttca

SEQ ID NO: 615948 - DNA, 25 bp, Homo sapien
catcagtttctttcctaggccctta

SEQ ID NO: 615949 - DNA, 25 bp, Homo sapien
taggcccttaaaatatcaatagagc

SEQ ID NO: 615950 - DNA, 25 bp, Homo sapien
gagccttttgccaatccattatact

SEQ ID NO: 615951 - DNA, 25 bp, Homo sapien
taaaacacaattaattcctcgggat

SEQ ID NO: 615952 - DNA, 25 bp, Homo sapien
ggtgttttaaatgtccacaggcatg

SEQ ID NO: 615953 - DNA, 25 bp, Homo sapien
atggaaactagagctgccctgtgct

SEQ ID NO: 615954 - DNA, 25 bp, Homo sapien
tgtgctctgcaagggtttttatcga

SEQ ID NO: 615955 - DNA, 25 bp, Homo sapien
gaatttatagtaagctcagcaacaa

SEQ ID NO: 615956 - DNA, 25 bp, Homo sapien
agcaacaaagccctgttgtggagtg

SEQ ID NO: 615957 - DNA, 25 bp, Homo sapien
gttacctgatgggacatagaactaa

SEQ ID NO: 615958 - DNA, 25 bp, Homo sapien
aactaagtgaccgtgagatctgaaa

SEQ ID NO: 615959 - DNA, 25 bp, Homo sapien
gaaccctggagagattcaaatgatt

SEQ ID NO: 615960 - DNA, 25 bp, Homo sapien
accctggagagattcaaatgattgc

SEQ ID NO: 615961 - DNA, 25 bp, Homo sapien
aatccagcccgggtgtcctagtgag

SEQ ID NO: 615962 - DNA, 25 bp, Homo sapien
atccagcccgggtgtcctagtgagg

SEQ ID NO: 615963 - DNA, 25 bp, Homo sapien
cgggtgtcctagtgaggctgtctca

SEQ ID NO: 615964 - DNA, 25 bp, Homo sapien
ggtgtcctagtgaggctgtctcaaa

SEQ ID NO: 615965 - DNA, 25 bp, Homo sapien
aaagagaacttattccaccacatag

SEQ ID NO: 615966 - DNA, 25 bp, Homo sapien
gagaacttattccaccacatagaac

SEQ ID NO: 615967 - DNA, 25 bp, Homo sapien
gaacttattccaccacatagaacca

SEQ ID NO: 615968 - DNA, 25 bp, Homo sapien
tattccaccacatagaaccataaag

SEQ ID NO: 615969 - DNA, 25 bp, Homo sapien
ccacatagaaccataaagttccagt

SEQ ID NO: 615970 - DNA, 25 bp, Homo sapien
catcgctgtgtggattatgaataca

SEQ ID NO: 615971 - DNA, 25 bp, Homo sapien
gaatacagagagctgccatcttcct

SEQ ID NO: 615972 - DNA, 25 bp, Homo sapien
ctgccatcttcctgatcacaataga

SEQ ID NO: 615973 - DNA, 25 bp, Homo sapien
aatagaccacgattgcaaagcctcc

SEQ ID NO: 615974 - DNA, 25 bp, Homo sapien
attgcaaagcctcctctcccagaga

SEQ ID NO: 615975 - DNA, 25 bp, Homo sapien
gtgtgcaagtcagaccctgcacagg

SEQ ID NO: 615976 - DNA, 25 bp, Homo sapien
gggtgtctcacctggcctaaacgta

SEQ ID NO: 615977 - DNA, 25 bp, Homo sapien
aacgtaaaggcttgtgccggagaca

SEQ ID NO: 615978 - DNA, 25 bp, Homo sapien
gcttgtgccggagacagtgattgaa

SEQ ID NO: 615979 - DNA, 25 bp, Homo sapien
catttgaaaagccagctctccctgg

SEQ ID NO: 615980 - DNA, 25 bp, Homo sapien
atttagatgtctttccctagtccat

SEQ ID NO: 615981 - DNA, 25 bp, Homo sapien
ttcccagtatttttctggtaagaag

SEQ ID NO: 615982 - DNA, 25 bp, Homo sapien
gtatttttctggtaagaagtctcag

SEQ ID NO: 615983 - DNA, 25 bp, Homo sapien
ttctggtaagaagtctcagttatat

SEQ ID NO: 615984 - DNA, 25 bp, Homo sapien
gaagtctcagttatatgatttattg

SEQ ID NO: 615985 - DNA, 25 bp, Homo sapien
gatttattgatagtgcatatattat

SEQ ID NO: 615986 - DNA, 25 bp, Homo sapien
gaaggtgtgttaagatttcctgaaa

SEQ ID NO: 615987 - DNA, 25 bp, Homo sapien
tatttagacatattcttggtcttat

SEQ ID NO: 615988 - DNA, 25 bp, Homo sapien
tcttggtcttatttcatcagagatt

SEQ ID NO: 615989 - DNA, 25 bp, Homo sapien
tggtcttatttcatcagagattgaa

SEQ ID NO: 615990 - DNA, 25 bp, Homo sapien
taaattattttcttgcctgttcaaa

SEQ ID NO: 615991 - DNA, 25 bp, Homo sapien
aaatgattgtaggaacactctgtga

SEQ ID NO: 615992 - DNA, 25 bp, Homo sapien
agaaatgataaatattcagctgggc

SEQ ID NO: 615993 - DNA, 25 bp, Homo sapien
gaaatgataaatattcagctgggcg

SEQ ID NO: 615994 - DNA, 25 bp, Homo sapien
aaatgataaatattcagctgggcgt

SEQ ID NO: 615995 - DNA, 25 bp, Homo sapien
aatgataaatattcagctgggcgtg

SEQ ID NO: 615996 - DNA, 25 bp, Homo sapien
atgataaatattcagctgggcgtgg

SEQ ID NO: 615997 - DNA, 25 bp, Homo sapien
tgataaatattcagctgggcgtggt

SEQ ID NO: 615998 - DNA, 25 bp, Homo sapien
gataaatattcagctgggcgtggtt

SEQ ID NO: 615999 - DNA, 25 bp, Homo sapien
gggcgtggttgctcgcgcctatatt

SEQ ID NO: 616000 - DNA, 25 bp, Homo sapien
ggcgtggttgctcgcgcctatattc

SEQ ID NO: 616001 - DNA, 25 bp, Homo sapien
gcgtggttgctcgcgcctatattcc

SEQ ID NO: 616002 - DNA, 25 bp, Homo sapien
gtggttgctcgcgcctatattccca

SEQ ID NO: 616003 - DNA, 25 bp, Homo sapien
tgggcccgcagggaagccagttcta

SEQ ID NO: 616004 - DNA, 25 bp, Homo sapien
gcagggaagccagttctaccagcag

SEQ ID NO: 616005 - DNA, 25 bp, Homo sapien
agggaagccagttctaccagcagtc

SEQ ID NO: 616006 - DNA, 25 bp, Homo sapien
aagccagttctaccagcagtctgca

SEQ ID NO: 616007 - DNA, 25 bp, Homo sapien
agttctaccagcagtctgcaggtaa

SEQ ID NO: 616008 - DNA, 25 bp, Homo sapien
ctaccagcagtctgcaggtaacagg

SEQ ID NO: 616009 - DNA, 25 bp, Homo sapien
caaggaccccgtgtccagaagaacg

SEQ ID NO: 616010 - DNA, 25 bp, Homo sapien
cccgtgtccagaagaacggcagctt

SEQ ID NO: 616011 - DNA, 25 bp, Homo sapien
ttgtaaccccatccctgtaatgaga

SEQ ID NO: 616012 - DNA, 25 bp, Homo sapien
gtaaccccatccctgtaatgagaat

SEQ ID NO: 616013 - DNA, 25 bp, Homo sapien
accccatccctgtaatgagaatgaa

SEQ ID NO: 616014 - DNA, 25 bp, Homo sapien
gaaaggtaaattgtgactgcgtcat

SEQ ID NO: 616015 - DNA, 25 bp, Homo sapien
ttgtgactgcgtcatgcacagctga

SEQ ID NO: 616016 - DNA, 25 bp, Homo sapien
gcacagctgactgtgtatgccacag

SEQ ID NO: 616017 - DNA, 25 bp, Homo sapien
gtgtatgccacagtgagttaaaact

SEQ ID NO: 616018 - DNA, 25 bp, Homo sapien
ttaaaactgaatccactaaacaagg

SEQ ID NO: 616019 - DNA, 25 bp, Homo sapien
aaattctgagcaagagtgtctcaac

SEQ ID NO: 616020 - DNA, 25 bp, Homo sapien
aagagtgtctcaacgggatccaggt

SEQ ID NO: 616021 - DNA, 25 bp, Homo sapien
cgggatccaggttttctcatgttta

SEQ ID NO: 616022 - DNA, 25 bp, Homo sapien
aagttgtttttcagtgctgcatcta

SEQ ID NO: 616023 - DNA, 25 bp, Homo sapien
gctgcatctagcacctgaagattct

SEQ ID NO: 616024 - DNA, 25 bp, Homo sapien
gcacctgaagattctgggaacaatt

SEQ ID NO: 616025 - DNA, 25 bp, Homo sapien
ggagttcaaggctgatcctgccacc

SEQ ID NO: 616026 - DNA, 25 bp, Homo sapien
gagttcaaggctgatcctgccaccg

SEQ ID NO: 616027 - DNA, 25 bp, Homo sapien
agttcaaggctgatcctgccaccgc

SEQ ID NO: 616028 - DNA, 25 bp, Homo sapien
gttcaaggctgatcctgccaccgca

SEQ ID NO: 616029 - DNA, 25 bp, Homo sapien
ttcaaggctgatcctgccaccgcac

SEQ ID NO: 616030 - DNA, 25 bp, Homo sapien
aatataatgagacacagactctaca

SEQ ID NO: 616031 - DNA, 25 bp, Homo sapien
atataatgagacacagactctacaa

SEQ ID NO: 616032 - DNA, 25 bp, Homo sapien
tataatgagacacagactctacaaa

SEQ ID NO: 616033 - DNA, 25 bp, Homo sapien
ataatgagacacagactctacaaaa

SEQ ID NO: 616034 - DNA, 25 bp, Homo sapien
taatgagacacagactctacaaaaa

SEQ ID NO: 616035 - DNA, 25 bp, Homo sapien
gagacacagactctacaaaaaatac

SEQ ID NO: 616036 - DNA, 25 bp, Homo sapien
gcgtttggacccctgtcttggaccg

SEQ ID NO: 616037 - DNA, 25 bp, Homo sapien
gtttggacccctgtcttggaccgct

SEQ ID NO: 616038 - DNA, 25 bp, Homo sapien
ttggacccctgtcttggaccgctgt

SEQ ID NO: 616039 - DNA, 25 bp, Homo sapien
ggacccctgtcttggaccgctgtcg

SEQ ID NO: 616040 - DNA, 25 bp, Homo sapien
ccctgtcttggaccgctgtcggata

SEQ ID NO: 616041 - DNA, 25 bp, Homo sapien
tgtcttggaccgctgtcggatagta

SEQ ID NO: 616042 - DNA, 25 bp, Homo sapien
gtcttggaccgctgtcggatagtaa

SEQ ID NO: 616043 - DNA, 25 bp, Homo sapien
tcttggaccgctgtcggatagtaaa

SEQ ID NO: 616044 - DNA, 25 bp, Homo sapien
ggcatcggacccgtcggagagtaaa

SEQ ID NO: 616045 - DNA, 25 bp, Homo sapien
gcatcggacccgtcggagagtaaat

SEQ ID NO: 616046 - DNA, 25 bp, Homo sapien
catcggacccgtcggagagtaaatc

SEQ ID NO: 616047 - DNA, 25 bp, Homo sapien
tttgtaagttacaacattccactgg

SEQ ID NO: 616048 - DNA, 25 bp, Homo sapien
ttgtaagttacaacattccactgga

SEQ ID NO: 616049 - DNA, 25 bp, Homo sapien
tgtaagttacaacattccactggat

SEQ ID NO: 616050 - DNA, 25 bp, Homo sapien
ttgcctgtagtggaagagggtcttg

SEQ ID NO: 616051 - DNA, 25 bp, Homo sapien
tgcctgtagtggaagagggtcttgt

SEQ ID NO: 616052 - DNA, 25 bp, Homo sapien
gaagagggtcttgtgtgtctgcccc

SEQ ID NO: 616053 - DNA, 25 bp, Homo sapien
aagagggtcttgtgtgtctgcccct

SEQ ID NO: 616054 - DNA, 25 bp, Homo sapien
taggataatttagtctttggcatgt

SEQ ID NO: 616055 - DNA, 25 bp, Homo sapien
aggataatttagtctttggcatgtg

SEQ ID NO: 616056 - DNA, 25 bp, Homo sapien
ggataatttagtctttggcatgtgg

SEQ ID NO: 616057 - DNA, 25 bp, Homo sapien
gataatttagtctttggcatgtggc

SEQ ID NO: 616058 - DNA, 25 bp, Homo sapien
aatcatctaactgattcataatcac

SEQ ID NO: 616059 - DNA, 25 bp, Homo sapien
gattcataatcacttctaaaccatt

SEQ ID NO: 616060 - DNA, 25 bp, Homo sapien
cataatcacttctaaaccattgttt

SEQ ID NO: 616061 - DNA, 25 bp, Homo sapien
tctaaaccattgtttatatctcctt

SEQ ID NO: 616062 - DNA, 25 bp, Homo sapien
atatctccttttagaagatcttgtc

SEQ ID NO: 616063 - DNA, 25 bp, Homo sapien
ctccttttagaagatcttgtctgtt

SEQ ID NO: 616064 - DNA, 25 bp, Homo sapien
cttgtctgtttttgcccgaagtgga

SEQ ID NO: 616065 - DNA, 25 bp, Homo sapien
ttgtctgtttttgcccgaagtggac

SEQ ID NO: 616066 - DNA, 25 bp, Homo sapien
tgtttttgcccgaagtggacagatc

SEQ ID NO: 616067 - DNA, 25 bp, Homo sapien
tttgcccgaagtggacagatcacaa

SEQ ID NO: 616068 - DNA, 25 bp, Homo sapien
tcaggagtttaagaacgtcctgggc

SEQ ID NO: 616069 - DNA, 25 bp, Homo sapien
gttctatatgtctaactcatcaagt

SEQ ID NO: 616070 - DNA, 25 bp, Homo sapien
gtctaactcatcaagttaatttctg

SEQ ID NO: 616071 - DNA, 25 bp, Homo sapien
taatttctgagagctgcatttctta

SEQ ID NO: 616072 - DNA, 25 bp, Homo sapien
atttctgagagctgcatttcttaaa

SEQ ID NO: 616073 - DNA, 25 bp, Homo sapien
tctgagagctgcatttcttaaaaga

SEQ ID NO: 616074 - DNA, 25 bp, Homo sapien
atgttaaaggtcagggagatcgaga

SEQ ID NO: 616075 - DNA, 25 bp, Homo sapien
atatatccattatactttgcctcag

SEQ ID NO: 616076 - DNA, 25 bp, Homo sapien
tatccattatactttgcctcagttc

SEQ ID NO: 616077 - DNA, 25 bp, Homo sapien
tccattatactttgcctcagttcta

SEQ ID NO: 616078 - DNA, 25 bp, Homo sapien
ttgcctcagttctatatgtctaact

SEQ ID NO: 616079 - DNA, 25 bp, Homo sapien
gcctcagttctatatgtctaactca

SEQ ID NO: 616080 - DNA, 25 bp, Homo sapien
gaatatctagaatgcgttggaggaa

SEQ ID NO: 616081 - DNA, 25 bp, Homo sapien
attttccgtggatctttcatgtctc

SEQ ID NO: 616082 - DNA, 25 bp, Homo sapien
cgtggatctttcatgtctctgtaca

SEQ ID NO: 616083 - DNA, 25 bp, Homo sapien
tcatgtctctgtacatcctgagaag

SEQ ID NO: 616084 - DNA, 25 bp, Homo sapien
gagaggcattgtcattgttctgaac

SEQ ID NO: 616085 - DNA, 25 bp, Homo sapien
gttctgaactctcttttcaaggatc

SEQ ID NO: 616086 - DNA, 25 bp, Homo sapien
aaggccaggtttgtctaccttctag

SEQ ID NO: 616087 - DNA, 25 bp, Homo sapien
ccaggtttgtctaccttctagtaca

SEQ ID NO: 616088 - DNA, 25 bp, Homo sapien
atattaaaaatatctctgggcaaag

SEQ ID NO: 616089 - DNA, 25 bp, Homo sapien
aaagcaagcttactgccaactataa

SEQ ID NO: 616090 - DNA, 25 bp, Homo sapien
tatatggattccctaaacacccacc

SEQ ID NO: 616091 - DNA, 25 bp, Homo sapien
ggcacttttattcccaaagtatttg

SEQ ID NO: 616092 - DNA, 25 bp, Homo sapien
tatatgggtacccaacccttaggct

SEQ ID NO: 616093 - DNA, 25 bp, Homo sapien
ttaggctacatctgcttccttaaca

SEQ ID NO: 616094 - DNA, 25 bp, Homo sapien
ggctacatctgcttccttaacatag

SEQ ID NO: 616095 - DNA, 25 bp, Homo sapien
gcttccttaacatagaaaatcactg

SEQ ID NO: 616096 - DNA, 25 bp, Homo sapien
gaaaatcactgactttctcacatat

SEQ ID NO: 616097 - DNA, 25 bp, Homo sapien
ctgactttctcacatattaataatt

SEQ ID NO: 616098 - DNA, 25 bp, Homo sapien
ggataatgatgtatttcccctgcat

SEQ ID NO: 616099 - DNA, 25 bp, Homo sapien
tatttcccctgcatatcacattatt

SEQ ID NO: 616100 - DNA, 25 bp, Homo sapien
ttcagcagctgtcaatgtctaataa

SEQ ID NO: 616101 - DNA, 25 bp, Homo sapien
ggttaaatacataaaagtcgtgcat

SEQ ID NO: 616102 - DNA, 25 bp, Homo sapien
cccagaagcaatgtgcccaaggaga

SEQ ID NO: 616103 - DNA, 25 bp, Homo sapien
ggaagagctcggtgagcatgatcat

SEQ ID NO: 616104 - DNA, 25 bp, Homo sapien
atgatcatggctcaggttctccatc

SEQ ID NO: 616105 - DNA, 25 bp, Homo sapien
tcaggttctccatccacatgcctaa

SEQ ID NO: 616106 - DNA, 25 bp, Homo sapien
gaattaactgtgtgatcatgggcaa

SEQ ID NO: 616107 - DNA, 25 bp, Homo sapien
ggcaagttgccaagttaaccctcat

SEQ ID NO: 616108 - DNA, 25 bp, Homo sapien
agttaaccctcatatctaaattcag

SEQ ID NO: 616109 - DNA, 25 bp, Homo sapien
aattcaggtatccttgaacaaacat

SEQ ID NO: 616110 - DNA, 25 bp, Homo sapien
gacagatactgatgatccgccatgt

SEQ ID NO: 616111 - DNA, 25 bp, Homo sapien
gatccgccatgtttactataaccat

SEQ ID NO: 616112 - DNA, 25 bp, Homo sapien
tgaattaaaaatggcctctcaacct

SEQ ID NO: 616113 - DNA, 25 bp, Homo sapien
ggtatctaaatccaccaggagccat

SEQ ID NO: 616114 - DNA, 25 bp, Homo sapien
ggagccataggcatcacgttgacgt

SEQ ID NO: 616115 - DNA, 25 bp, Homo sapien
acgttgacgtccatttaccagtctt

SEQ ID NO: 616116 - DNA, 25 bp, Homo sapien
cttccctggcaagattcttctgaat

SEQ ID NO: 616117 - DNA, 25 bp, Homo sapien
gattcttctgaattgtgctgccttg

SEQ ID NO: 616118 - DNA, 25 bp, Homo sapien
attcttctgaattgtgctgccttgg

SEQ ID NO: 616119 - DNA, 25 bp, Homo sapien
ttcttctgaattgtgctgccttggc

SEQ ID NO: 616120 - DNA, 25 bp, Homo sapien
tcttctgaattgtgctgccttggcc

SEQ ID NO: 616121 - DNA, 25 bp, Homo sapien
tctgaattgtgctgccttggccaaa

SEQ ID NO: 616122 - DNA, 25 bp, Homo sapien
ggaaaccaattcaggtggatcgtta

SEQ ID NO: 616123 - DNA, 25 bp, Homo sapien
aattcaggtggatcgttagaggtca

SEQ ID NO: 616124 - DNA, 25 bp, Homo sapien
ggccgagattggcagatcacttgag

SEQ ID NO: 616125 - DNA, 25 bp, Homo sapien
cagactggccaacatcacgaaaccc

SEQ ID NO: 616126 - DNA, 25 bp, Homo sapien
actggccaacatcacgaaaccccat

SEQ ID NO: 616127 - DNA, 25 bp, Homo sapien
catgcctgtaattttaggtacttgg

SEQ ID NO: 616128 - DNA, 25 bp, Homo sapien
atgcctgtaattttaggtacttggg

SEQ ID NO: 616129 - DNA, 25 bp, Homo sapien
gcctgtaattttaggtacttgggag

SEQ ID NO: 616130 - DNA, 25 bp, Homo sapien
tgtaattttaggtacttgggaggct

SEQ ID NO: 616131 - DNA, 25 bp, Homo sapien
gtaattttaggtacttgggaggctg

SEQ ID NO: 616132 - DNA, 25 bp, Homo sapien
taattttaggtacttgggaggctga

SEQ ID NO: 616133 - DNA, 25 bp, Homo sapien
tggcagagtaacaggcacatagaat

SEQ ID NO: 616134 - DNA, 25 bp, Homo sapien
gaatgaatgttgttacccctttggt

SEQ ID NO: 616135 - DNA, 25 bp, Homo sapien
cctttggtccttagtcttatcatga

SEQ ID NO: 616136 - DNA, 25 bp, Homo sapien
gtcttatcatgaactagctatgtcc

SEQ ID NO: 616137 - DNA, 25 bp, Homo sapien
gaactagctatgtccttagccaaat

SEQ ID NO: 616138 - DNA, 25 bp, Homo sapien
gtccttagccaaattacttaccact

SEQ ID NO: 616139 - DNA, 25 bp, Homo sapien
taccactttttgatctttgttacct

SEQ ID NO: 616140 - DNA, 25 bp, Homo sapien
gttacctatttatctacactgaaag

SEQ ID NO: 616141 - DNA, 25 bp, Homo sapien
gatttgtatatttctacttcagcta

SEQ ID NO: 616142 - DNA, 25 bp, Homo sapien
ggattacctttttcaaattggaatg

SEQ ID NO: 616143 - DNA, 25 bp, Homo sapien
caaattggaatgcttggtcagctaa

SEQ ID NO: 616144 - DNA, 25 bp, Homo sapien
atcattcttggctgtgtgcggtggc

SEQ ID NO: 616145 - DNA, 25 bp, Homo sapien
tcattcttggctgtgtgcggtggct

SEQ ID NO: 616146 - DNA, 25 bp, Homo sapien
attcttggctgtgtgcggtggctca

SEQ ID NO: 616147 - DNA, 25 bp, Homo sapien
tcaggaggctgtggcgagaggaaca

SEQ ID NO: 616148 - DNA, 25 bp, Homo sapien
caggaggctgtggcgagaggaacac

SEQ ID NO: 616149 - DNA, 25 bp, Homo sapien
ggaggctgtggcgagaggaacactt

SEQ ID NO: 616150 - DNA, 25 bp, Homo sapien
aggaacacttgagcctggaaaaggt

SEQ ID NO: 616151 - DNA, 25 bp, Homo sapien
ggaacacttgagcctggaaaaggtt

SEQ ID NO: 616152 - DNA, 25 bp, Homo sapien
gaacacttgagcctggaaaaggttg

SEQ ID NO: 616153 - DNA, 25 bp, Homo sapien
aacacttgagcctggaaaaggttgc

SEQ ID NO: 616154 - DNA, 25 bp, Homo sapien
tgagctggaatcgtgccactccact

SEQ ID NO: 616155 - DNA, 25 bp, Homo sapien
tttaagtcacttatccgcatatatt

SEQ ID NO: 616156 - DNA, 25 bp, Homo sapien
atccgcatatattttgtccattcca

SEQ ID NO: 616157 - DNA, 25 bp, Homo sapien
gtctgttagacattgggccatcgta

SEQ ID NO: 616158 - DNA, 25 bp, Homo sapien
cattgggccatcgtagttgagtcta

SEQ ID NO: 616159 - DNA, 25 bp, Homo sapien
tggtgtggatggacctcctcagcac

SEQ ID NO: 616160 - DNA, 25 bp, Homo sapien
tcagcacagcgagacggactctctg

SEQ ID NO: 616161 - DNA, 25 bp, Homo sapien
tctctgccctgtgtgactgagggag

SEQ ID NO: 616162 - DNA, 25 bp, Homo sapien
ctgctctccttccaagttttgcaat

SEQ ID NO: 616163 - DNA, 25 bp, Homo sapien
agttttgcaatcctgcactttctgc

SEQ ID NO: 616164 - DNA, 25 bp, Homo sapien
tgctgcccagacactgaaagctgtt

SEQ ID NO: 616165 - DNA, 25 bp, Homo sapien
tgaaagctgttgctgcttctatttt

SEQ ID NO: 616166 - DNA, 25 bp, Homo sapien
cttcctgcctctgacttttaaaggt

SEQ ID NO: 616167 - DNA, 25 bp, Homo sapien
tgggctcctctcaggtctggacatc

SEQ ID NO: 616168 - DNA, 25 bp, Homo sapien
gggctcctctcaggtctggacatca

SEQ ID NO: 616169 - DNA, 25 bp, Homo sapien
ggctcctctcaggtctggacatcat

SEQ ID NO: 616170 - DNA, 25 bp, Homo sapien
agctagaggcatggagcccccaatc

SEQ ID NO: 616171 - DNA, 25 bp, Homo sapien
gctagaggcatggagcccccaatca

SEQ ID NO: 616172 - DNA, 25 bp, Homo sapien
ctagaggcatggagcccccaatcac

SEQ ID NO: 616173 - DNA, 25 bp, Homo sapien
tagaggcatggagcccccaatcaca

SEQ ID NO: 616174 - DNA, 25 bp, Homo sapien
gaggcatggagcccccaatcacagg

SEQ ID NO: 616175 - DNA, 25 bp, Homo sapien
aggcatggagcccccaatcacaggg

SEQ ID NO: 616176 - DNA, 25 bp, Homo sapien
atggagcccccaatcacaggggaag

SEQ ID NO: 616177 - DNA, 25 bp, Homo sapien
tcccaacagtcgacttctgaatctg

SEQ ID NO: 616178 - DNA, 25 bp, Homo sapien
ttaaaatgccaacagcttccactct

SEQ ID NO: 616179 - DNA, 25 bp, Homo sapien
tccactctcccagctgatttaaaaa

SEQ ID NO: 616180 - DNA, 25 bp, Homo sapien
ataatcaatgtgcttgaatcctgca

SEQ ID NO: 616181 - DNA, 25 bp, Homo sapien
atgtgcttgaatcctgcacacactc

SEQ ID NO: 616182 - DNA, 25 bp, Homo sapien
gcacacactcctatccagtgaggga

SEQ ID NO: 616183 - DNA, 25 bp, Homo sapien
tcctatccagtgagggacgctcaat

SEQ ID NO: 616184 - DNA, 25 bp, Homo sapien
gcaaaacagccattgtcctgagaat

SEQ ID NO: 616185 - DNA, 25 bp, Homo sapien
tcctgagaatgttttatgacgtaac

SEQ ID NO: 616186 - DNA, 25 bp, Homo sapien
tgacgtaacgatatggtgtctttta

SEQ ID NO: 616187 - DNA, 25 bp, Homo sapien
ggtgtcttttacatacttttttctg

SEQ ID NO: 616188 - DNA, 25 bp, Homo sapien
ataacctaattaaacgatgggagag

SEQ ID NO: 616189 - DNA, 25 bp, Homo sapien
cctaattaaacgatgggagagtaca

SEQ ID NO: 616190 - DNA, 25 bp, Homo sapien
ttaaacgatgggagagtacaggcat

SEQ ID NO: 616191 - DNA, 25 bp, Homo sapien
ggagagtacaggcatggtacctcac

SEQ ID NO: 616192 - DNA, 25 bp, Homo sapien
gagagtacaggcatggtacctcaca

SEQ ID NO: 616193 - DNA, 25 bp, Homo sapien
agagtacaggcatggtacctcacac

SEQ ID NO: 616194 - DNA, 25 bp, Homo sapien
gagtacaggcatggtacctcacacc

SEQ ID NO: 616195 - DNA, 25 bp, Homo sapien
ggcaaatcgcttggggcctggaatt

SEQ ID NO: 616196 - DNA, 25 bp, Homo sapien
attcaagaccagtctattacgaccc

SEQ ID NO: 616197 - DNA, 25 bp, Homo sapien
tcccagctactcgagctatgattgc

SEQ ID NO: 616198 - DNA, 25 bp, Homo sapien
cccagctactcgagctatgattgca

SEQ ID NO: 616199 - DNA, 25 bp, Homo sapien
ataaatgctgttagaaagatggtaa

SEQ ID NO: 616200 - DNA, 25 bp, Homo sapien
aatgctgttagaaagatggtaattc

SEQ ID NO: 616201 - DNA, 25 bp, Homo sapien
atgctgttagaaagatggtaattca

SEQ ID NO: 616202 - DNA, 25 bp, Homo sapien
ttagaaagatggtaattcataggcc

SEQ ID NO: 616203 - DNA, 25 bp, Homo sapien
tagaaagatggtaattcataggccg

SEQ ID NO: 616204 - DNA, 25 bp, Homo sapien
agaaagatggtaattcataggccgg

SEQ ID NO: 616205 - DNA, 25 bp, Homo sapien
gaaagatggtaattcataggccggg

SEQ ID NO: 616206 - DNA, 25 bp, Homo sapien
aaagatggtaattcataggccgggt

SEQ ID NO: 616207 - DNA, 25 bp, Homo sapien
aagatggtaattcataggccgggtg

SEQ ID NO: 616208 - DNA, 25 bp, Homo sapien
agatggtaattcataggccgggtgc

SEQ ID NO: 616209 - DNA, 25 bp, Homo sapien
gatggtaattcataggccgggtgca

SEQ ID NO: 616210 - DNA, 25 bp, Homo sapien
tccagtaaagttcaaaagaggtaag

SEQ ID NO: 616211 - DNA, 25 bp, Homo sapien
aagaggtaagaatgcctgctatcac

SEQ ID NO: 616212 - DNA, 25 bp, Homo sapien
ggtaagaatgcctgctatcacatct

SEQ ID NO: 616213 - DNA, 25 bp, Homo sapien
aagaatgcctgctatcacatctatt

SEQ ID NO: 616214 - DNA, 25 bp, Homo sapien
gaatgcctgctatcacatctattat

SEQ ID NO: 616215 - DNA, 25 bp, Homo sapien
gcctgctatcacatctattatccaa

SEQ ID NO: 616216 - DNA, 25 bp, Homo sapien
gctatcacatctattatccaacatt

SEQ ID NO: 616217 - DNA, 25 bp, Homo sapien
tcacatctattatccaacattatat

SEQ ID NO: 616218 - DNA, 25 bp, Homo sapien
gataggcataaggatcaaaaaggca

SEQ ID NO: 616219 - DNA, 25 bp, Homo sapien
gtattttcaaaagttatgagtctat

SEQ ID NO: 616220 - DNA, 25 bp, Homo sapien
aaagcactcaaaaagtccaatgact

SEQ ID NO: 616221 - DNA, 25 bp, Homo sapien
agcagagtgcctgctgtggcagaaa

SEQ ID NO: 616222 - DNA, 25 bp, Homo sapien
gaaagcaaccctgggtgacgtctct

SEQ ID NO: 616223 - DNA, 25 bp, Homo sapien
ctgggtgacgtctctgtttcaggaa

SEQ ID NO: 616224 - DNA, 25 bp, Homo sapien
gtttcaggaatgttcttccctatgt

SEQ ID NO: 616225 - DNA, 25 bp, Homo sapien
ttccctatgtgggttaagcgtcagg

SEQ ID NO: 616226 - DNA, 25 bp, Homo sapien
ggagaagctgcccatgcactcttca

SEQ ID NO: 616227 - DNA, 25 bp, Homo sapien
atgcactcttcatcttgtgccacat

SEQ ID NO: 616228 - DNA, 25 bp, Homo sapien
tcttgtgccacatgggccacgaaga

SEQ ID NO: 616229 - DNA, 25 bp, Homo sapien
caaactcagaggatggaccgtgaaa

SEQ ID NO: 616230 - DNA, 25 bp, Homo sapien
gagaaaaagctccaacaaacccagg

SEQ ID NO: 616231 - DNA, 25 bp, Homo sapien
gaaacttattatcctcagggctcag

SEQ ID NO: 616232 - DNA, 25 bp, Homo sapien
gatatccataagcaaaatctgttta

SEQ ID NO: 616233 - DNA, 25 bp, Homo sapien
gcaaaatctgtttataccctcacta

SEQ ID NO: 616234 - DNA, 25 bp, Homo sapien
aaatctgtttataccctcactaatt

SEQ ID NO: 616235 - DNA, 25 bp, Homo sapien
tctgtttataccctcactaattttt

SEQ ID NO: 616236 - DNA, 25 bp, Homo sapien
agtattttctctttatgtgtgccta

SEQ ID NO: 616237 - DNA, 25 bp, Homo sapien
attttctctttatgtgtgcctaagt

SEQ ID NO: 616238 - DNA, 25 bp, Homo sapien
tctctttatgtgtgcctaagtgata

SEQ ID NO: 616239 - DNA, 25 bp, Homo sapien
ctaagtgatataccaatttccccat

SEQ ID NO: 616240 - DNA, 25 bp, Homo sapien
agtgatataccaatttccccatata

SEQ ID NO: 616241 - DNA, 25 bp, Homo sapien
gatataccaatttccccatatatta

SEQ ID NO: 616242 - DNA, 25 bp, Homo sapien
atgattattattgaaaccctgtctc

SEQ ID NO: 616243 - DNA, 25 bp, Homo sapien
atttgagctctggaatgaaaatctc

SEQ ID NO: 616244 - DNA, 25 bp, Homo sapien
aatctccagggaggaaggtatggct

SEQ ID NO: 616245 - DNA, 25 bp, Homo sapien
aaggtatggctgtgcatgtttctca

SEQ ID NO: 616246 - DNA, 25 bp, Homo sapien
ggtatggctgtgcatgtttctcaac

SEQ ID NO: 616247 - DNA, 25 bp, Homo sapien
gtgcatgtttctcaactatattttg

SEQ ID NO: 616248 - DNA, 25 bp, Homo sapien
gttttttctgaatttcaccttctct

SEQ ID NO: 616249 - DNA, 25 bp, Homo sapien
ctcactgtgaatcctgtagtaacca

SEQ ID NO: 616250 - DNA, 25 bp, Homo sapien
gaagagctaaaaagacctctttctt

SEQ ID NO: 616251 - DNA, 25 bp, Homo sapien
tattttccttttgcaaaggcttata

SEQ ID NO: 616252 - DNA, 25 bp, Homo sapien
tttgcaaaggcttataagggcttat

SEQ ID NO: 616253 - DNA, 25 bp, Homo sapien
ttataagggcttatgttttcaaaag

SEQ ID NO: 616254 - DNA, 25 bp, Homo sapien
ggagcaattctctgcacgcattaag

SEQ ID NO: 616255 - DNA, 25 bp, Homo sapien
attaaggcgtgtgattggtccctgt

SEQ ID NO: 616256 - DNA, 25 bp, Homo sapien
tgattggtccctgtgagccgcggct

SEQ ID NO: 616257 - DNA, 25 bp, Homo sapien
tgcgggcttctcaaggtggtcacac

SEQ ID NO: 616258 - DNA, 25 bp, Homo sapien
tcaaggtggtcacactcccggtttc

SEQ ID NO: 616259 - DNA, 25 bp, Homo sapien
ctcccggtttcctaagctgctctta

SEQ ID NO: 616260 - DNA, 25 bp, Homo sapien
gctccaggaacctgcgactgctgaa

SEQ ID NO: 616261 - DNA, 25 bp, Homo sapien
tgttttgaagctcattcccatgtgc

SEQ ID NO: 616262 - DNA, 25 bp, Homo sapien
atgtgctacctgcaggcttgctcta

SEQ ID NO: 616263 - DNA, 25 bp, Homo sapien
gcaggcttgctctaatgagatgtat

SEQ ID NO: 616264 - DNA, 25 bp, Homo sapien
gaatgccttcaatcatttcagccat

SEQ ID NO: 616265 - DNA, 25 bp, Homo sapien
gcattaaaaccttcttgaggtggcc

SEQ ID NO: 616266 - DNA, 25 bp, Homo sapien
cattaaaaccttcttgaggtggccg

SEQ ID NO: 616267 - DNA, 25 bp, Homo sapien
aaccttcttgaggtggccgggcgca

SEQ ID NO: 616268 - DNA, 25 bp, Homo sapien
ccttcttgaggtggccgggcgcagt

SEQ ID NO: 616269 - DNA, 25 bp, Homo sapien
cttcttgaggtggccgggcgcagtg

SEQ ID NO: 616270 - DNA, 25 bp, Homo sapien
ttcttgaggtggccgggcgcagtgg

SEQ ID NO: 616271 - DNA, 25 bp, Homo sapien
cgagaccagccagtccaacatgatg

SEQ ID NO: 616272 - DNA, 25 bp, Homo sapien
gagaccagccagtccaacatgatga

SEQ ID NO: 616273 - DNA, 25 bp, Homo sapien
agaccagccagtccaacatgatgaa

SEQ ID NO: 616274 - DNA, 25 bp, Homo sapien
gaccagccagtccaacatgatgaaa

SEQ ID NO: 616275 - DNA, 25 bp, Homo sapien
gcgggtgcctataatcccgctactc

SEQ ID NO: 616276 - DNA, 25 bp, Homo sapien
accaaagtgtctttgccgatataat

SEQ ID NO: 616277 - DNA, 25 bp, Homo sapien
caaagtgtctttgccgatataatta

SEQ ID NO: 616278 - DNA, 25 bp, Homo sapien
gtgtctttgccgatataattaagga

SEQ ID NO: 616279 - DNA, 25 bp, Homo sapien
gtctttgccgatataattaaggatc

SEQ ID NO: 616280 - DNA, 25 bp, Homo sapien
ggatcttgagatgaaatcaacctgg

SEQ ID NO: 616281 - DNA, 25 bp, Homo sapien
gatgaaatcaacctggattatccag

SEQ ID NO: 616282 - DNA, 25 bp, Homo sapien
ccaggtggccccaaaatccaatgac

SEQ ID NO: 616283 - DNA, 25 bp, Homo sapien
caggtggccccaaaatccaatgaca

SEQ ID NO: 616284 - DNA, 25 bp, Homo sapien
aggtggccccaaaatccaatgacaa

SEQ ID NO: 616285 - DNA, 25 bp, Homo sapien
tgacaagtgtcattataagagaaag

SEQ ID NO: 616286 - DNA, 25 bp, Homo sapien
tataagagaaaggaggtcgggcaca

SEQ ID NO: 616287 - DNA, 25 bp, Homo sapien
tgggggctggtgaccacagcacccc

SEQ ID NO: 616288 - DNA, 25 bp, Homo sapien
cttcctgcctctgacttttaaaggt

SEQ ID NO: 616289 - DNA, 25 bp, Homo sapien
gcctctgacttttaaaggtgggtag

SEQ ID NO: 616290 - DNA, 25 bp, Homo sapien
tgggctcctctcaggtctggacatc

SEQ ID NO: 616291 - DNA, 25 bp, Homo sapien
gggctcctctcaggtctggacatca

SEQ ID NO: 616292 - DNA, 25 bp, Homo sapien
ggctcctctcaggtctggacatcat

SEQ ID NO: 616293 - DNA, 25 bp, Homo sapien
tcctctcaggtctggacatcatcat

SEQ ID NO: 616294 - DNA, 25 bp, Homo sapien
agctagaggcatggagcccccaatc

SEQ ID NO: 616295 - DNA, 25 bp, Homo sapien
gctagaggcatggagcccccaatca

SEQ ID NO: 616296 - DNA, 25 bp, Homo sapien
tagaggcatggagcccccaatcaca

SEQ ID NO: 616297 - DNA, 25 bp, Homo sapien
aggcatggagcccccaatcacaggg

SEQ ID NO: 616298 - DNA, 25 bp, Homo sapien
agaagcactcttccagaagggtgaa

SEQ ID NO: 616299 - DNA, 25 bp, Homo sapien
gaaatgccgatagtccaaatcaaag

SEQ ID NO: 616300 - DNA, 25 bp, Homo sapien
gaagatgctcagttcagccttctct

SEQ ID NO: 616301 - DNA, 25 bp, Homo sapien
agttcagccttctctcatagcctac

SEQ ID NO: 616302 - DNA, 25 bp, Homo sapien
ctcatagcctacttcttgccttcta

SEQ ID NO: 616303 - DNA, 25 bp, Homo sapien
ttctagcctagagccacctgattgt

SEQ ID NO: 616304 - DNA, 25 bp, Homo sapien
tagagccacctgattgtcccttgaa

SEQ ID NO: 616305 - DNA, 25 bp, Homo sapien
gattgtcccttgaagctctgaaatt

SEQ ID NO: 616306 - DNA, 25 bp, Homo sapien
ataaattgtgtgaaggaaggccctt

SEQ ID NO: 616307 - DNA, 25 bp, Homo sapien
gaaggccctttacagtaaactgaat

SEQ ID NO: 616308 - DNA, 25 bp, Homo sapien
aatccctggagcctgtgattatttc

SEQ ID NO: 616309 - DNA, 25 bp, Homo sapien
tggccccagtatgcatcaggttatg

SEQ ID NO: 616310 - DNA, 25 bp, Homo sapien
atgcatcaggttatggatactgtca

SEQ ID NO: 616311 - DNA, 25 bp, Homo sapien
gatactgtcagaatgccaggtctac

SEQ ID NO: 616312 - DNA, 25 bp, Homo sapien
gccaggtctactaccagaaggaaat

SEQ ID NO: 616313 - DNA, 25 bp, Homo sapien
gagccaatacaataaccaaagggtg

SEQ ID NO: 616314 - DNA, 25 bp, Homo sapien
atactgttctatactcagtcctgtc

SEQ ID NO: 616315 - DNA, 25 bp, Homo sapien
tatactcagtcctgtccaatcagtt

SEQ ID NO: 616316 - DNA, 25 bp, Homo sapien
agtcctgtccaatcagttttttaag

SEQ ID NO: 616317 - DNA, 25 bp, Homo sapien
gaatagtaattaattgtgcaggtca

SEQ ID NO: 616318 - DNA, 25 bp, Homo sapien
tgtgcaggtcaaaaagtttcagagg

SEQ ID NO: 616319 - DNA, 25 bp, Homo sapien
gtaatgtgcccaaccaaaaataagt

SEQ ID NO: 616320 - DNA, 25 bp, Homo sapien
aaaatcagttattctctcgtgtgaa

SEQ ID NO: 616321 - DNA, 25 bp, Homo sapien
gttattctctcgtgtgaaatgcttt

SEQ ID NO: 616322 - DNA, 25 bp, Homo sapien
tctctcgtgtgaaatgctttaagca

SEQ ID NO: 616323 - DNA, 25 bp, Homo sapien
aggaagttaaggtcaacgtgatgaa

SEQ ID NO: 616324 - DNA, 25 bp, Homo sapien
ggtcaacgtgatgaaattgttttac

SEQ ID NO: 616325 - DNA, 25 bp, Homo sapien
tcaggttgctgaatcatgcggaggc

SEQ ID NO: 616326 - DNA, 25 bp, Homo sapien
gaatcatgcggaggcaatcttcata

SEQ ID NO: 616327 - DNA, 25 bp, Homo sapien
catgcggaggcaatcttcataaaat

SEQ ID NO: 616328 - DNA, 25 bp, Homo sapien
ggcaatcttcataaaatgcctgaag

SEQ ID NO: 616329 - DNA, 25 bp, Homo sapien
aatgcctgaaggtgattgctaaaaa

SEQ ID NO: 616330 - DNA, 25 bp, Homo sapien
aaaaaagccgaagcggtgatggtat

SEQ ID NO: 616331 - DNA, 25 bp, Homo sapien
tactcctgagatcaagtactccacc

SEQ ID NO: 616332 - DNA, 25 bp, Homo sapien
ggacgaactgcaaggtagccaagaa

SEQ ID NO: 616333 - DNA, 25 bp, Homo sapien
tagccaagaagtgcgagtacaccaa

SEQ ID NO: 616334 - DNA, 25 bp, Homo sapien
gtgcgagtacaccaaggaaaggcaa

SEQ ID NO: 616335 - DNA, 25 bp, Homo sapien
ggcaataaccgaagccattctgaaa

SEQ ID NO: 616336 - DNA, 25 bp, Homo sapien
aacatgtagatgtgtcagaatctgc

SEQ ID NO: 616337 - DNA, 25 bp, Homo sapien
gtcagaatctgcagtgctcttggaa

SEQ ID NO: 616338 - DNA, 25 bp, Homo sapien
atagcatgtcgtttcatccttgagc

SEQ ID NO: 616339 - DNA, 25 bp, Homo sapien
gtttcatccttgagcttattctttg

SEQ ID NO: 616340 - DNA, 25 bp, Homo sapien
tgagcttattctttgttacttttta

SEQ ID NO: 616341 - DNA, 25 bp, Homo sapien
aaataacacaataaagccagctcta

SEQ ID NO: 616342 - DNA, 25 bp, Homo sapien
agatacttgtacgtgttaaaagaca

SEQ ID NO: 616343 - DNA, 25 bp, Homo sapien
gatacttgtacgtgttaaaagacac

SEQ ID NO: 616344 - DNA, 25 bp, Homo sapien
atacttgtacgtgttaaaagacaca

SEQ ID NO: 616345 - DNA, 25 bp, Homo sapien
tacttgtacgtgttaaaagacacac

SEQ ID NO: 616346 - DNA, 25 bp, Homo sapien
gttaaaagacacacataggccgggc

SEQ ID NO: 616347 - DNA, 25 bp, Homo sapien
ttaaaagacacacataggccgggca

SEQ ID NO: 616348 - DNA, 25 bp, Homo sapien
taaaagacacacataggccgggcac

SEQ ID NO: 616349 - DNA, 25 bp, Homo sapien
aaaagacacacataggccgggcacg

SEQ ID NO: 616350 - DNA, 25 bp, Homo sapien
aaagacacacataggccgggcacgg

SEQ ID NO: 616351 - DNA, 25 bp, Homo sapien
ctggggttgggtcacgtgcctgtaa

SEQ ID NO: 616352 - DNA, 25 bp, Homo sapien
ggggttgggtcacgtgcctgtaatc

SEQ ID NO: 616353 - DNA, 25 bp, Homo sapien
cttctttaagaaatgcaaggtaggc

SEQ ID NO: 616354 - DNA, 25 bp, Homo sapien
ttctttaagaaatgcaaggtaggct

SEQ ID NO: 616355 - DNA, 25 bp, Homo sapien
tctttaagaaatgcaaggtaggctg

SEQ ID NO: 616356 - DNA, 25 bp, Homo sapien
ctttaagaaatgcaaggtaggctgg

SEQ ID NO: 616357 - DNA, 25 bp, Homo sapien
ttaagaaatgcaaggtaggctgggc

SEQ ID NO: 616358 - DNA, 25 bp, Homo sapien
taagaaatgcaaggtaggctgggca

SEQ ID NO: 616359 - DNA, 25 bp, Homo sapien
aagaaatgcaaggtaggctgggcat

SEQ ID NO: 616360 - DNA, 25 bp, Homo sapien
actagcttaagcaacatagtgaaac

SEQ ID NO: 616361 - DNA, 25 bp, Homo sapien
aactctgtctctgcagaaaatttaa

SEQ ID NO: 616362 - DNA, 25 bp, Homo sapien
actctgtctctgcagaaaatttaaa

SEQ ID NO: 616363 - DNA, 25 bp, Homo sapien
ctctgtctctgcagaaaatttaaaa

SEQ ID NO: 616364 - DNA, 25 bp, Homo sapien
agccaggaatgcctgtagtcatgcc

SEQ ID NO: 616365 - DNA, 25 bp, Homo sapien
gccaggaatgcctgtagtcatgcct

SEQ ID NO: 616366 - DNA, 25 bp, Homo sapien
ccaggaatgcctgtagtcatgcctg

SEQ ID NO: 616367 - DNA, 25 bp, Homo sapien
caggaatgcctgtagtcatgcctgt

SEQ ID NO: 616368 - DNA, 25 bp, Homo sapien
aggaatgcctgtagtcatgcctgta

SEQ ID NO: 616369 - DNA, 25 bp, Homo sapien
ggaatgcctgtagtcatgcctgtag

SEQ ID NO: 616370 - DNA, 25 bp, Homo sapien
gaatgcctgtagtcatgcctgtagt

SEQ ID NO: 616371 - DNA, 25 bp, Homo sapien
aatgcctgtagtcatgcctgtagtc

SEQ ID NO: 616372 - DNA, 25 bp, Homo sapien
tccaaaacacatgaaacatatcata

SEQ ID NO: 616373 - DNA, 25 bp, Homo sapien
gaaacatatcatataaatctaacaa

SEQ ID NO: 616374 - DNA, 25 bp, Homo sapien
aaacatatcatataaatctaacaaa

SEQ ID NO: 616375 - DNA, 25 bp, Homo sapien
agggcacctcgctatgtagtggtga

SEQ ID NO: 616376 - DNA, 25 bp, Homo sapien
gaaaagtctggcgtcactgttgctg

SEQ ID NO: 616377 - DNA, 25 bp, Homo sapien
tctggcgtcactgttgctgtggtaa

SEQ ID NO: 616378 - DNA, 25 bp, Homo sapien
ggaaatgtacctaatgaattcaatg

SEQ ID NO: 616379 - DNA, 25 bp, Homo sapien
tgtcctcaggaaagtagctaaccct

SEQ ID NO: 616380 - DNA, 25 bp, Homo sapien
ggaaagtagctaaccctgctgagcc

SEQ ID NO: 616381 - DNA, 25 bp, Homo sapien
tgctgagccttgtccacacttggac

SEQ ID NO: 616382 - DNA, 25 bp, Homo sapien
gtccacacttggacctgacttaggt

SEQ ID NO: 616383 - DNA, 25 bp, Homo sapien
ggacctgacttaggtgatgagatct

SEQ ID NO: 616384 - DNA, 25 bp, Homo sapien
gatgagatctagaccttaagccaga

SEQ ID NO: 616385 - DNA, 25 bp, Homo sapien
tgaggtaattggatgaagcttctgg

SEQ ID NO: 616386 - DNA, 25 bp, Homo sapien
tctacatttttcttcttaccatata

SEQ ID NO: 616387 - DNA, 25 bp, Homo sapien
gcaacaaatatttagtggacattaa

SEQ ID NO: 616388 - DNA, 25 bp, Homo sapien
tggacattaatatatgccaggtagc

SEQ ID NO: 616389 - DNA, 25 bp, Homo sapien
tgccaggtagcatttcaattaagaa

SEQ ID NO: 616390 - DNA, 25 bp, Homo sapien
gcgtaagaggtaaatctagaaccag

SEQ ID NO: 616391 - DNA, 25 bp, Homo sapien
ctagaaccagaatatttcttacaga

SEQ ID NO: 616392 - DNA, 25 bp, Homo sapien
ggatgacagctgattttatgtgtat

SEQ ID NO: 616393 - DNA, 25 bp, Homo sapien
taaagtgatttatctctctgtgcta

SEQ ID NO: 616394 - DNA, 25 bp, Homo sapien
tctctgtgctataaattacacccag

SEQ ID NO: 616395 - DNA, 25 bp, Homo sapien
ttacacccagaggtagtggtagtca

SEQ ID NO: 616396 - DNA, 25 bp, Homo sapien
cagaggtagtggtagtcaagtataa

SEQ ID NO: 616397 - DNA, 25 bp, Homo sapien
cttagtgcccactgacctcatctgt

SEQ ID NO: 616398 - DNA, 25 bp, Homo sapien
gacctcatctgtccctgttatttca

SEQ ID NO: 616399 - DNA, 25 bp, Homo sapien
tctgtccctgttatttcatccttgt

SEQ ID NO: 616400 - DNA, 25 bp, Homo sapien
cttccccctagctggcatgaaggaa

SEQ ID NO: 616401 - DNA, 25 bp, Homo sapien
aaaaaatcgattcacattagggctg

SEQ ID NO: 616402 - DNA, 25 bp, Homo sapien
aaaaatcgattcacattagggctgt

SEQ ID NO: 616403 - DNA, 25 bp, Homo sapien
tgttcttcctttagagcacaatcta

SEQ ID NO: 616404 - DNA, 25 bp, Homo sapien
tttagagcacaatctaacagcaggg

SEQ ID NO: 616405 - DNA, 25 bp, Homo sapien
gggccccacaagtaagagaagataa

SEQ ID NO: 616406 - DNA, 25 bp, Homo sapien
taagagaagataaggtccccggtag

SEQ ID NO: 616407 - DNA, 25 bp, Homo sapien
aagaagccccttaggccggacgcag

SEQ ID NO: 616408 - DNA, 25 bp, Homo sapien
tcctttaaattctggaaacaagaca

SEQ ID NO: 616409 - DNA, 25 bp, Homo sapien
gatgcccactttcaccactgttaat

SEQ ID NO: 616410 - DNA, 25 bp, Homo sapien
gcccactttcaccactgttaatata

SEQ ID NO: 616411 - DNA, 25 bp, Homo sapien
ttcaccactgttaatatagtactgg

SEQ ID NO: 616412 - DNA, 25 bp, Homo sapien
aatatagtactggaaatccttgcca

SEQ ID NO: 616413 - DNA, 25 bp, Homo sapien
tatagtactggaaatccttgccaga

SEQ ID NO: 616414 - DNA, 25 bp, Homo sapien
atccttgccagagcaattagacaac

SEQ ID NO: 616415 - DNA, 25 bp, Homo sapien
gccagagcaattagacaacagaaat

SEQ ID NO: 616416 - DNA, 25 bp, Homo sapien
aaatcaacatacaatcagtcacatt

SEQ ID NO: 616417 - DNA, 25 bp, Homo sapien
acatacaatcagtcacatttctata

SEQ ID NO: 616418 - DNA, 25 bp, Homo sapien
cacatttctatatactgacagcaaa

SEQ ID NO: 616419 - DNA, 25 bp, Homo sapien
gcctggctagcatggatatatgggt

SEQ ID NO: 616420 - DNA, 25 bp, Homo sapien
cctggctagcatggatatatgggtg

SEQ ID NO: 616421 - DNA, 25 bp, Homo sapien
ctggctagcatggatatatgggtgt

SEQ ID NO: 616422 - DNA, 25 bp, Homo sapien
ggctagcatggatatatgggtgtat

SEQ ID NO: 616423 - DNA, 25 bp, Homo sapien
gctagcatggatatatgggtgtata

SEQ ID NO: 616424 - DNA, 25 bp, Homo sapien
atatatgggtgtatatcaccgtgcc

SEQ ID NO: 616425 - DNA, 25 bp, Homo sapien
tatatgggtgtatatcaccgtgcct

SEQ ID NO: 616426 - DNA, 25 bp, Homo sapien
atatgggtgtatatcaccgtgcctg

SEQ ID NO: 616427 - DNA, 25 bp, Homo sapien
tatgggtgtatatcaccgtgcctgg

SEQ ID NO: 616428 - DNA, 25 bp, Homo sapien
atgggtgtatatcaccgtgcctggc

SEQ ID NO: 616429 - DNA, 25 bp, Homo sapien
tgggtgtatatcaccgtgcctggct

SEQ ID NO: 616430 - DNA, 25 bp, Homo sapien
taacaagtaccacactgcaaatatg

SEQ ID NO: 616431 - DNA, 25 bp, Homo sapien
gaatatgatcacttttgtcttaaat

SEQ ID NO: 616432 - DNA, 25 bp, Homo sapien
ttaaatttactcttcacattctctt

SEQ ID NO: 616433 - DNA, 25 bp, Homo sapien
agacaaaggtcattattttcttcta

SEQ ID NO: 616434 - DNA, 25 bp, Homo sapien
tatgtttaaggaatgtgacagcacc

SEQ ID NO: 616435 - DNA, 25 bp, Homo sapien
gcaccttgaacttaccctaaaatca

SEQ ID NO: 616436 - DNA, 25 bp, Homo sapien
gaacttaccctaaaatcactgtaca

SEQ ID NO: 616437 - DNA, 25 bp, Homo sapien
atcactgtacattagagaaatccta

SEQ ID NO: 616438 - DNA, 25 bp, Homo sapien
catgttttcatcaatgtgggaatat

SEQ ID NO: 616439 - DNA, 25 bp, Homo sapien
gcatgtttagtgacattctttgtgg

SEQ ID NO: 616440 - DNA, 25 bp, Homo sapien
gtgacattctttgtggtggcaaaaa

SEQ ID NO: 616441 - DNA, 25 bp, Homo sapien
catccaattcgggttgtcaatgcat

SEQ ID NO: 616442 - DNA, 25 bp, Homo sapien
gtcaatgcattgcagaccctgtgcg

SEQ ID NO: 616443 - DNA, 25 bp, Homo sapien
gtgcgcactcattcgaggagtccat

SEQ ID NO: 616444 - DNA, 25 bp, Homo sapien
gaataagtctacctctgggtttgac

SEQ ID NO: 616445 - DNA, 25 bp, Homo sapien
ctacctctgggtttgacattatcaa

SEQ ID NO: 616446 - DNA, 25 bp, Homo sapien
cattatcaacatgctgatgggcttt

SEQ ID NO: 616447 - DNA, 25 bp, Homo sapien
aggcataagctgcagatgtgcctgt

SEQ ID NO: 616448 - DNA, 25 bp, Homo sapien
atgtgcctgtggatggcagcttctg

SEQ ID NO: 616449 - DNA, 25 bp, Homo sapien
agcttctgacagctgttcctggaca

SEQ ID NO: 616450 - DNA, 25 bp, Homo sapien
gttcctggacactatcagcagacaa

SEQ ID NO: 616451 - DNA, 25 bp, Homo sapien
gatgattgaatttggccttgcattt

SEQ ID NO: 616452 - DNA, 25 bp, Homo sapien
acgcgcatgtaatcctagctacacg

SEQ ID NO: 616453 - DNA, 25 bp, Homo sapien
catgtaatcctagctacacggaggc

SEQ ID NO: 616454 - DNA, 25 bp, Homo sapien
tttaaaaactgatggcaaaggtctg

SEQ ID NO: 616455 - DNA, 25 bp, Homo sapien
aaaaactgatggcaaaggtctggcg

SEQ ID NO: 616456 - DNA, 25 bp, Homo sapien
aaaactgatggcaaaggtctggcgc

SEQ ID NO: 616457 - DNA, 25 bp, Homo sapien
aaactgatggcaaaggtctggcgca

SEQ ID NO: 616458 - DNA, 25 bp, Homo sapien
aactgatggcaaaggtctggcgcag

SEQ ID NO: 616459 - DNA, 25 bp, Homo sapien
actgatggcaaaggtctggcgcagt

SEQ ID NO: 616460 - DNA, 25 bp, Homo sapien
ctgatggcaaaggtctggcgcagtg

SEQ ID NO: 616461 - DNA, 25 bp, Homo sapien
ggagccccaggtgaacagatcacga

SEQ ID NO: 616462 - DNA, 25 bp, Homo sapien
gattgagaccaaactggttaacatg

SEQ ID NO: 616463 - DNA, 25 bp, Homo sapien
ttggcgctgtctgaaaagaaaatgg

SEQ ID NO: 616464 - DNA, 25 bp, Homo sapien
tggcgctgtctgaaaagaaaatgga

SEQ ID NO: 616465 - DNA, 25 bp, Homo sapien
ggcgctgtctgaaaagaaaatggag

SEQ ID NO: 616466 - DNA, 25 bp, Homo sapien
gcgctgtctgaaaagaaaatggagg

SEQ ID NO: 616467 - DNA, 25 bp, Homo sapien
tgtctgaaaagaaaatggaggcctt

SEQ ID NO: 616468 - DNA, 25 bp, Homo sapien
gtctgaaaagaaaatggaggccttg

SEQ ID NO: 616469 - DNA, 25 bp, Homo sapien
ctgaaaagaaaatggaggccttggg

SEQ ID NO: 616470 - DNA, 25 bp, Homo sapien
tgaaaagaaaatggaggccttgggc

SEQ ID NO: 616471 - DNA, 25 bp, Homo sapien
tggaggccttgggccgggtttggtg

SEQ ID NO: 616472 - DNA, 25 bp, Homo sapien
gccttgggccgggtttggtggctca

SEQ ID NO: 616473 - DNA, 25 bp, Homo sapien
ttgggccgggtttggtggctcattc

SEQ ID NO: 616474 - DNA, 25 bp, Homo sapien
acacaagaaaaagtatagtaggctg

SEQ ID NO: 616475 - DNA, 25 bp, Homo sapien
cacaagaaaaagtatagtaggctgg

SEQ ID NO: 616476 - DNA, 25 bp, Homo sapien
taggctgggtgcagcagttcacacc

SEQ ID NO: 616477 - DNA, 25 bp, Homo sapien
cataatgaggccctgtttctactaa

SEQ ID NO: 616478 - DNA, 25 bp, Homo sapien
tgagctatgattactacacccttgc

SEQ ID NO: 616479 - DNA, 25 bp, Homo sapien
gagctatgattactacacccttgca

SEQ ID NO: 616480 - DNA, 25 bp, Homo sapien
agctatgattactacacccttgcac

SEQ ID NO: 616481 - DNA, 25 bp, Homo sapien
gctatgattactacacccttgcact

SEQ ID NO: 616482 - DNA, 25 bp, Homo sapien
ctatgattactacacccttgcactc

SEQ ID NO: 616483 - DNA, 25 bp, Homo sapien
tatgattactacacccttgcactcc

SEQ ID NO: 616484 - DNA, 25 bp, Homo sapien
atgattactacacccttgcactcca

SEQ ID NO: 616485 - DNA, 25 bp, Homo sapien
aatactgggctttcaccttaaacat

SEQ ID NO: 616486 - DNA, 25 bp, Homo sapien
gggctttcaccttaaacattcagac

SEQ ID NO: 616487 - DNA, 25 bp, Homo sapien
gacaaattctgcagtataccccata

SEQ ID NO: 616488 - DNA, 25 bp, Homo sapien
gcagtataccccataacattttgaa

SEQ ID NO: 616489 - DNA, 25 bp, Homo sapien
taaaaataattctgtcctttctcct

SEQ ID NO: 616490 - DNA, 25 bp, Homo sapien
tttctcctccaaatctgtataactg

SEQ ID NO: 616491 - DNA, 25 bp, Homo sapien
aactgtctattgtatgaaggtatca

SEQ ID NO: 616492 - DNA, 25 bp, Homo sapien
gttggacacttaagtcacttccagt

SEQ ID NO: 616493 - DNA, 25 bp, Homo sapien
taaacactattgcaatgagcatcct

SEQ ID NO: 616494 - DNA, 25 bp, Homo sapien
agcatccttatgcatatgtattttc

SEQ ID NO: 616495 - DNA, 25 bp, Homo sapien
gtattttctcttgtttgattatgtc

SEQ ID NO: 616496 - DNA, 25 bp, Homo sapien
tggctggagccagagtccaaacgcg

SEQ ID NO: 616497 - DNA, 25 bp, Homo sapien
gagccagagtccaaacgcgcacaca

SEQ ID NO: 616498 - DNA, 25 bp, Homo sapien
aaacgcgcacacactactttccagt

SEQ ID NO: 616499 - DNA, 25 bp, Homo sapien
tactttccagtcatatccctcttgg

SEQ ID NO: 616500 - DNA, 25 bp, Homo sapien
gggctgttcctaccagtgatcaaat

SEQ ID NO: 616501 - DNA, 25 bp, Homo sapien
gtgatcaaattcagcggaccaggaa

SEQ ID NO: 616502 - DNA, 25 bp, Homo sapien
aattcagcggaccaggaagaaggaa

SEQ ID NO: 616503 - DNA, 25 bp, Homo sapien
ctgaagcaggaagactgtttctctt

SEQ ID NO: 616504 - DNA, 25 bp, Homo sapien
gccactgcctacaaaacagtcatag

SEQ ID NO: 616505 - DNA, 25 bp, Homo sapien
gcctacaaaacagtcatagcctttg

SEQ ID NO: 616506 - DNA, 25 bp, Homo sapien
atgtccacgggcacaatggatcaga

SEQ ID NO: 616507 - DNA, 25 bp, Homo sapien
caaactttctccacgttctttctag

SEQ ID NO: 616508 - DNA, 25 bp, Homo sapien
tccacgttctttctagtcatacact

SEQ ID NO: 616509 - DNA, 25 bp, Homo sapien
tagtcatacactctaacaatcccgc

SEQ ID NO: 616510 - DNA, 25 bp, Homo sapien
taacaatcccgcttcctttttacat

SEQ ID NO: 616511 - DNA, 25 bp, Homo sapien
attcacactgactatgctccaagag

SEQ ID NO: 616512 - DNA, 25 bp, Homo sapien
gaagcaatatatgttctggttgaga

SEQ ID NO: 616513 - DNA, 25 bp, Homo sapien
gttctggttgagataaggcatgtac

SEQ ID NO: 616514 - DNA, 25 bp, Homo sapien
agaaagaagccaatccaaggatgta

SEQ ID NO: 616515 - DNA, 25 bp, Homo sapien
ggcacaggcaacatagcttggtcaa

SEQ ID NO: 616516 - DNA, 25 bp, Homo sapien
gcttggtcaagcaggtggagcaata

SEQ ID NO: 616517 - DNA, 25 bp, Homo sapien
gcaataggcacaatctcttgggaga

SEQ ID NO: 616518 - DNA, 25 bp, Homo sapien
taagtttatcatatgaggccgggca

SEQ ID NO: 616519 - DNA, 25 bp, Homo sapien
aagtttatcatatgaggccgggcac

SEQ ID NO: 616520 - DNA, 25 bp, Homo sapien
agtttatcatatgaggccgggcacg

SEQ ID NO: 616521 - DNA, 25 bp, Homo sapien
gtttatcatatgaggccgggcacgg

SEQ ID NO: 616522 - DNA, 25 bp, Homo sapien
cacggtggctcatatatgggattac

SEQ ID NO: 616523 - DNA, 25 bp, Homo sapien
acggtggctcatatatgggattaca

SEQ ID NO: 616524 - DNA, 25 bp, Homo sapien
cggtggctcatatatgggattacat

SEQ ID NO: 616525 - DNA, 25 bp, Homo sapien
gtggctcatatatgggattacatgc

SEQ ID NO: 616526 - DNA, 25 bp, Homo sapien
tggctcatatatgggattacatgcc

SEQ ID NO: 616527 - DNA, 25 bp, Homo sapien
ggctcatatatgggattacatgcct

SEQ ID NO: 616528 - DNA, 25 bp, Homo sapien
catatatgggattacatgcctgtaa

SEQ ID NO: 616529 - DNA, 25 bp, Homo sapien
tattcaattctcttttctaattctt

SEQ ID NO: 616530 - DNA, 25 bp, Homo sapien
ttctaattcttatcgttgtactcac

SEQ ID NO: 616531 - DNA, 25 bp, Homo sapien
atcgttgtactcacatctttctggg

SEQ ID NO: 616532 - DNA, 25 bp, Homo sapien
gggacactgacatgtcttttcctac

SEQ ID NO: 616533 - DNA, 25 bp, Homo sapien
gtcttttcctacattagattcagta

SEQ ID NO: 616534 - DNA, 25 bp, Homo sapien
atacactgtattttcattataatct

SEQ ID NO: 616535 - DNA, 25 bp, Homo sapien
aaagagtaagtgtttccatattgta

SEQ ID NO: 616536 - DNA, 25 bp, Homo sapien
gtgtttccatattgtaatgcatatc

SEQ ID NO: 616537 - DNA, 25 bp, Homo sapien
acttttatcatgacttaattccttg

SEQ ID NO: 616538 - DNA, 25 bp, Homo sapien
gatttcatctggatttcatgcctag

SEQ ID NO: 616539 - DNA, 25 bp, Homo sapien
ttcatgcctagttacatgacccagt

SEQ ID NO: 616540 - DNA, 25 bp, Homo sapien
ctagggactttgctatctgactcct

SEQ ID NO: 616541 - DNA, 25 bp, Homo sapien
ggactttgctatctgactcctcttc

SEQ ID NO: 616542 - DNA, 25 bp, Homo sapien
cttctccagtactgcccacattttt

SEQ ID NO: 616543 - DNA, 25 bp, Homo sapien
ctgcccacatttttgtaagatctaa

SEQ ID NO: 616544 - DNA, 25 bp, Homo sapien
tgtaagatctaattcctactaaaaa

SEQ ID NO: 616545 - DNA, 25 bp, Homo sapien
attcctctttccataattcttatca

SEQ ID NO: 616546 - DNA, 25 bp, Homo sapien
aattcttatcatgattctgcttctt

SEQ ID NO: 616547 - DNA, 25 bp, Homo sapien
cttatcatgattctgcttctttcac

SEQ ID NO: 616548 - DNA, 25 bp, Homo sapien
ttcactgaatcctggatgatacaga

SEQ ID NO: 616549 - DNA, 25 bp, Homo sapien
ataagtatcaatcagtcaacagtag

SEQ ID NO: 616550 - DNA, 25 bp, Homo sapien
atcagtcaacagtagttacctctga

SEQ ID NO: 616551 - DNA, 25 bp, Homo sapien
ttttctgaacagactccttgaagtt

SEQ ID NO: 616552 - DNA, 25 bp, Homo sapien
gaagttcagtaaatacatctccctc

SEQ ID NO: 616553 - DNA, 25 bp, Homo sapien
aatacatctccctcacttttatcac

SEQ ID NO: 616554 - DNA, 25 bp, Homo sapien
ttatcactcaccttggatatacgag

SEQ ID NO: 616555 - DNA, 25 bp, Homo sapien
atacgagttgatacgcaaagcccct

SEQ ID NO: 616556 - DNA, 25 bp, Homo sapien
tacgcaaagcccctctcacttttta

SEQ ID NO: 616557 - DNA, 25 bp, Homo sapien
ttaaaaactacctgttgtcccactg

SEQ ID NO: 616558 - DNA, 25 bp, Homo sapien
gttgtcccactgagaaggcctggtt

SEQ ID NO: 616559 - DNA, 25 bp, Homo sapien
ggcctggttgttgaattgctgaata

SEQ ID NO: 616560 - DNA, 25 bp, Homo sapien
tgctgccatcttgtcggtgtcataa

SEQ ID NO: 616561 - DNA, 25 bp, Homo sapien
gccatcttgtcggtgtcataagggt

SEQ ID NO: 616562 - DNA, 25 bp, Homo sapien
ggtaaggatgcctacttattttcct

SEQ ID NO: 616563 - DNA, 25 bp, Homo sapien
aggatgcctacttattttcctcatt

SEQ ID NO: 616564 - DNA, 25 bp, Homo sapien
ggaaatagttacactttgattaaat

SEQ ID NO: 616565 - DNA, 25 bp, Homo sapien
tcttatactgtaaaccaatcgattc

SEQ ID NO: 616566 - DNA, 25 bp, Homo sapien
gtaaaccaatcgattcagccctaac

SEQ ID NO: 616567 - DNA, 25 bp, Homo sapien
gattcagccctaactaactagatct

SEQ ID NO: 616568 - DNA, 25 bp, Homo sapien
ctaactagatctaaagactgcttta

SEQ ID NO: 616569 - DNA, 25 bp, Homo sapien
tcatttatttctgctttcactggta

SEQ ID NO: 616570 - DNA, 25 bp, Homo sapien
ttctgctttcactggtaaattttat

SEQ ID NO: 616571 - DNA, 25 bp, Homo sapien
ttgtacatacaatgtgtcaggcact

SEQ ID NO: 616572 - DNA, 25 bp, Homo sapien
cactgctctaggtgctaaatatata

SEQ ID NO: 616573 - DNA, 25 bp, Homo sapien
gaatgatctcagatggaaggttaga

SEQ ID NO: 616574 - DNA, 25 bp, Homo sapien
aactgcaagaaaccaacgaaaatag

SEQ ID NO: 616575 - DNA, 25 bp, Homo sapien
aaagtctaaaagcagccacaaggga

SEQ ID NO: 616576 - DNA, 25 bp, Homo sapien
agtctaaaagcagccacaagggaaa

SEQ ID NO: 616577 - DNA, 25 bp, Homo sapien
gattagactaacagctgacttcaca

SEQ ID NO: 616578 - DNA, 25 bp, Homo sapien
gactaacagctgacttcacaacaga

SEQ ID NO: 616579 - DNA, 25 bp, Homo sapien
tagaatctactaactgcaaacctag

SEQ ID NO: 616580 - DNA, 25 bp, Homo sapien
tagcaaaaatactttccaggaatga

SEQ ID NO: 616581 - DNA, 25 bp, Homo sapien
gagggaattaattaacagtgtacca

SEQ ID NO: 616582 - DNA, 25 bp, Homo sapien
taattaacagtgtaccagctgaagg

SEQ ID NO: 616583 - DNA, 25 bp, Homo sapien
taacagtgtaccagctgaaggaaat

SEQ ID NO: 616584 - DNA, 25 bp, Homo sapien
gtcaccaaaaatacctaactatggt

SEQ ID NO: 616585 - DNA, 25 bp, Homo sapien
atacctaactatggttggaagctta

SEQ ID NO: 616586 - DNA, 25 bp, Homo sapien
ttggaagcttagtgctttcagcccc

SEQ ID NO: 616587 - DNA, 25 bp, Homo sapien
agctggagctcgatcatgcctgcgt

SEQ ID NO: 616588 - DNA, 25 bp, Homo sapien
tggagctcgatcatgcctgcgtgac

SEQ ID NO: 616589 - DNA, 25 bp, Homo sapien
gctcgatcatgcctgcgtgacaaag

SEQ ID NO: 616590 - DNA, 25 bp, Homo sapien
cctgcgtgacaaagcctccagaaaa

SEQ ID NO: 616591 - DNA, 25 bp, Homo sapien
caaagcctccagaaaaatccttgaa

SEQ ID NO: 616592 - DNA, 25 bp, Homo sapien
aaagacaggacatggagagctgctg

SEQ ID NO: 616593 - DNA, 25 bp, Homo sapien
agagctgctgggttggcgaacacat

SEQ ID NO: 616594 - DNA, 25 bp, Homo sapien
tgccgggaggatggtgcaccccaac

SEQ ID NO: 616595 - DNA, 25 bp, Homo sapien
cactgcagtccagcaacctcgatga

SEQ ID NO: 616596 - DNA, 25 bp, Homo sapien
actgcagtccagcaacctcgatgac

SEQ ID NO: 616597 - DNA, 25 bp, Homo sapien
ctgcagtccagcaacctcgatgaca

SEQ ID NO: 616598 - DNA, 25 bp, Homo sapien
tgcagtccagcaacctcgatgacag

SEQ ID NO: 616599 - DNA, 25 bp, Homo sapien
gcagtccagcaacctcgatgacaga

SEQ ID NO: 616600 - DNA, 25 bp, Homo sapien
tggtcatggtggcccaccccagtaa

SEQ ID NO: 616601 - DNA, 25 bp, Homo sapien
ggtcatggtggcccaccccagtaat

SEQ ID NO: 616602 - DNA, 25 bp, Homo sapien
aaaaaaagattggccaagagtggtg

SEQ ID NO: 616603 - DNA, 25 bp, Homo sapien
aaaaaagattggccaagagtggtgg

SEQ ID NO: 616604 - DNA, 25 bp, Homo sapien
caaatggagctctacttatgggcat

SEQ ID NO: 616605 - DNA, 25 bp, Homo sapien
gagctctacttatgggcattctggg

SEQ ID NO: 616606 - DNA, 25 bp, Homo sapien
gggcctaaaatgcttacacgccatt

SEQ ID NO: 616607 - DNA, 25 bp, Homo sapien
tgcttacacgccattatgatccaag

SEQ ID NO: 616608 - DNA, 25 bp, Homo sapien
acacgccattatgatccaagcaaaa

SEQ ID NO: 616609 - DNA, 25 bp, Homo sapien
gcagttgtcaacattagaacatcat

SEQ ID NO: 616610 - DNA, 25 bp, Homo sapien
tgcctgcttcttttaatgaattatt

SEQ ID NO: 616611 - DNA, 25 bp, Homo sapien
gagaatccaggatttagtaaacatg

SEQ ID NO: 616612 - DNA, 25 bp, Homo sapien
tttagtaaacatgtgatttcagtac

SEQ ID NO: 616613 - DNA, 25 bp, Homo sapien
gatttcagtacagggcttttcttgg

SEQ ID NO: 616614 - DNA, 25 bp, Homo sapien
cagtacagggcttttcttggacttt

SEQ ID NO: 616615 - DNA, 25 bp, Homo sapien
gaagttatctacagaggacatcctc

SEQ ID NO: 616616 - DNA, 25 bp, Homo sapien
gaggacatcctcactctgaagataa

SEQ ID NO: 616617 - DNA, 25 bp, Homo sapien
tctgaagataacacacatggctagt

SEQ ID NO: 616618 - DNA, 25 bp, Homo sapien
cacatggctagtgggctgcaggact

SEQ ID NO: 616619 - DNA, 25 bp, Homo sapien
ctccattccattgttcaggctgcaa

SEQ ID NO: 616620 - DNA, 25 bp, Homo sapien
cattgttcaggctgcaacccacagg

SEQ ID NO: 616621 - DNA, 25 bp, Homo sapien
aacccacagggaagttagggctgct

SEQ ID NO: 616622 - DNA, 25 bp, Homo sapien
ggctgctgtcaccaggatgagtttt

SEQ ID NO: 616623 - DNA, 25 bp, Homo sapien
tctttaaagggttgccctggtccat

SEQ ID NO: 616624 - DNA, 25 bp, Homo sapien
ttaccttgaagtccttggcttggca

SEQ ID NO: 616625 - DNA, 25 bp, Homo sapien
ttggcacaccgcactaaacaggttt

SEQ ID NO: 616626 - DNA, 25 bp, Homo sapien
catgcctagcccagaaattttctct

SEQ ID NO: 616627 - DNA, 25 bp, Homo sapien
tttctctttgaatactatacattga

SEQ ID NO: 616628 - DNA, 25 bp, Homo sapien
ctatacattgatgagttctgtcttt

SEQ ID NO: 616629 - DNA, 25 bp, Homo sapien
ttgatgagttctgtctttatgctta

SEQ ID NO: 616630 - DNA, 25 bp, Homo sapien
tctttatgcttatgatccacgcagg

SEQ ID NO: 616631 - DNA, 25 bp, Homo sapien
atgcttatgatccacgcaggtaggt

SEQ ID NO: 616632 - DNA, 25 bp, Homo sapien
tatgatccacgcaggtaggtcgtct

SEQ ID NO: 616633 - DNA, 25 bp, Homo sapien
atccacgcaggtaggtcgtctcaga

SEQ ID NO: 616634 - DNA, 25 bp, Homo sapien
cgcaggtaggtcgtctcagatttaa

SEQ ID NO: 616635 - DNA, 25 bp, Homo sapien
ttctgtcttgatggagtctgtgtaa

SEQ ID NO: 616636 - DNA, 25 bp, Homo sapien
accaaagcagtaattcttactatag

SEQ ID NO: 616637 - DNA, 25 bp, Homo sapien
cctttcctctagattgttcatacag

SEQ ID NO: 616638 - DNA, 25 bp, Homo sapien
agattgttcatacagccactcactc

SEQ ID NO: 616639 - DNA, 25 bp, Homo sapien
tcatacagccactcactctaagaaa

SEQ ID NO: 616640 - DNA, 25 bp, Homo sapien
tacagccactcactctaagaaacct

SEQ ID NO: 616641 - DNA, 25 bp, Homo sapien
ctcactctaagaaacctgcttgctt

SEQ ID NO: 616642 - DNA, 25 bp, Homo sapien
aagaaacctgcttgcttttctcttc

SEQ ID NO: 616643 - DNA, 25 bp, Homo sapien
aacctgcttgcttttctcttcagga

SEQ ID NO: 616644 - DNA, 25 bp, Homo sapien
gcttgcttttctcttcaggagcctg

SEQ ID NO: 616645 - DNA, 25 bp, Homo sapien
gagcccggcaccaggtaattcaaga

SEQ ID NO: 616646 - DNA, 25 bp, Homo sapien
ccggcaccaggtaattcaagataag

SEQ ID NO: 616647 - DNA, 25 bp, Homo sapien
tcaagataagtcttttccatgtgtt

SEQ ID NO: 616648 - DNA, 25 bp, Homo sapien
gattcttctgaattgtgctgccttg

SEQ ID NO: 616649 - DNA, 25 bp, Homo sapien
attcttctgaattgtgctgccttgg

SEQ ID NO: 616650 - DNA, 25 bp, Homo sapien
ttcttctgaattgtgctgccttggc

SEQ ID NO: 616651 - DNA, 25 bp, Homo sapien
tcttctgaattgtgctgccttggcc

SEQ ID NO: 616652 - DNA, 25 bp, Homo sapien
ggaaaccaattcaggtggatcgtta

SEQ ID NO: 616653 - DNA, 25 bp, Homo sapien
gaaaccaattcaggtggatcgttag

SEQ ID NO: 616654 - DNA, 25 bp, Homo sapien
aaaccaattcaggtggatcgttaga

SEQ ID NO: 616655 - DNA, 25 bp, Homo sapien
aaccaattcaggtggatcgttagag

SEQ ID NO: 616656 - DNA, 25 bp, Homo sapien
accaattcaggtggatcgttagagg

SEQ ID NO: 616657 - DNA, 25 bp, Homo sapien
caattcaggtggatcgttagaggtc

SEQ ID NO: 616658 - DNA, 25 bp, Homo sapien
aattcaggtggatcgttagaggtca

SEQ ID NO: 616659 - DNA, 25 bp, Homo sapien
gacacatgccagagagaagccctac

SEQ ID NO: 616660 - DNA, 25 bp, Homo sapien
acacatgccagagagaagccctacc

SEQ ID NO: 616661 - DNA, 25 bp, Homo sapien
cacatgccagagagaagccctacca

SEQ ID NO: 616662 - DNA, 25 bp, Homo sapien
acatgccagagagaagccctaccag

SEQ ID NO: 616663 - DNA, 25 bp, Homo sapien
atgccagagagaagccctaccagtg

SEQ ID NO: 616664 - DNA, 25 bp, Homo sapien
tgccagagagaagccctaccagtgt

SEQ ID NO: 616665 - DNA, 25 bp, Homo sapien
agagagaagccctaccagtgtaaag

SEQ ID NO: 616666 - DNA, 25 bp, Homo sapien
agtgtaaagaatgtaggccaggcgc

SEQ ID NO: 616667 - DNA, 25 bp, Homo sapien
gtgtaaagaatgtaggccaggcgca

SEQ ID NO: 616668 - DNA, 25 bp, Homo sapien
tgtaaagaatgtaggccaggcgcag

SEQ ID NO: 616669 - DNA, 25 bp, Homo sapien
ccaggcgcagtggcatcccagcact

SEQ ID NO: 616670 - DNA, 25 bp, Homo sapien
aaatttactcaaggggctcaacagc

SEQ ID NO: 616671 - DNA, 25 bp, Homo sapien
agcagattcaagatgtcaggagaaa

SEQ ID NO: 616672 - DNA, 25 bp, Homo sapien
ataaataggacttatccaattggaa

SEQ ID NO: 616673 - DNA, 25 bp, Homo sapien
aggacttatccaattggaagaacag

SEQ ID NO: 616674 - DNA, 25 bp, Homo sapien
gaaagatgaacagggcctcagagac

SEQ ID NO: 616675 - DNA, 25 bp, Homo sapien
ctcagagacctataggacaccatta

SEQ ID NO: 616676 - DNA, 25 bp, Homo sapien
gacctataggacaccattaagcaca

SEQ ID NO: 616677 - DNA, 25 bp, Homo sapien
attaagcacagcaacatatgtttca

SEQ ID NO: 616678 - DNA, 25 bp, Homo sapien
gcaacatatgtttcatgggagtctc

SEQ ID NO: 616679 - DNA, 25 bp, Homo sapien
gtttcatgggagtctcataagcaat

SEQ ID NO: 616680 - DNA, 25 bp, Homo sapien
gggagtctcataagcaattgaaaga

SEQ ID NO: 616681 - DNA, 25 bp, Homo sapien
accaaagtgtctttgccgatataat

SEQ ID NO: 616682 - DNA, 25 bp, Homo sapien
ccaaagtgtctttgccgatataatt

SEQ ID NO: 616683 - DNA, 25 bp, Homo sapien
caaagtgtctttgccgatataatta

SEQ ID NO: 616684 - DNA, 25 bp, Homo sapien
agtgtctttgccgatataattaagg

SEQ ID NO: 616685 - DNA, 25 bp, Homo sapien
gtgtctttgccgatataattaagga

SEQ ID NO: 616686 - DNA, 25 bp, Homo sapien
tgtctttgccgatataattaaggat

SEQ ID NO: 616687 - DNA, 25 bp, Homo sapien
gtctttgccgatataattaaggatc

SEQ ID NO: 616688 - DNA, 25 bp, Homo sapien
ccaggtggccccaaaatccaatgac

SEQ ID NO: 616689 - DNA, 25 bp, Homo sapien
caggtggccccaaaatccaatgaca

SEQ ID NO: 616690 - DNA, 25 bp, Homo sapien
aggtggccccaaaatccaatgacaa

SEQ ID NO: 616691 - DNA, 25 bp, Homo sapien
tataagagaaaggaggtcgggcaca

SEQ ID NO: 616692 - DNA, 25 bp, Homo sapien
agtcccaccgtgtgattccattatt

SEQ ID NO: 616693 - DNA, 25 bp, Homo sapien
gattccattattatcgcattcttga

SEQ ID NO: 616694 - DNA, 25 bp, Homo sapien
catgcgggatccttgtgacggaagc

SEQ ID NO: 616695 - DNA, 25 bp, Homo sapien
ccttgtgacggaagcgttttgtgtc

SEQ ID NO: 616696 - DNA, 25 bp, Homo sapien
aagcgttttgtgtcgtgtgggtgtc

SEQ ID NO: 616697 - DNA, 25 bp, Homo sapien
gtgtctgtcggtttcctggctgtga

SEQ ID NO: 616698 - DNA, 25 bp, Homo sapien
cggtttcctggctgtgatgctgtgc

SEQ ID NO: 616699 - DNA, 25 bp, Homo sapien
gctgtgatgctgtgccattgtcttg

SEQ ID NO: 616700 - DNA, 25 bp, Homo sapien
gtgccattgtcttgtgggatgctgc

SEQ ID NO: 616701 - DNA, 25 bp, Homo sapien
attgtcttgtgggatgctgccatcg

SEQ ID NO: 616702 - DNA, 25 bp, Homo sapien
atgctgccatcggtggaaactgggt

SEQ ID NO: 616703 - DNA, 25 bp, Homo sapien
actgcagtccagcaacctcgatgac

SEQ ID NO: 616704 - DNA, 25 bp, Homo sapien
ctgcagtccagcaacctcgatgaca

SEQ ID NO: 616705 - DNA, 25 bp, Homo sapien
tgcagtccagcaacctcgatgacag

SEQ ID NO: 616706 - DNA, 25 bp, Homo sapien
gcagtccagcaacctcgatgacaga

SEQ ID NO: 616707 - DNA, 25 bp, Homo sapien
aaaaaaaatacggctggtcatggtg

SEQ ID NO: 616708 - DNA, 25 bp, Homo sapien
tggtcatggtggcccaccccagtaa

SEQ ID NO: 616709 - DNA, 25 bp, Homo sapien
ggtcatggtggcccaccccagtaat

SEQ ID NO: 616710 - DNA, 25 bp, Homo sapien
aaaaaaagattggccaagagtggtg

SEQ ID NO: 616711 - DNA, 25 bp, Homo sapien
aaaaaagattggccaagagtggtgg

SEQ ID NO: 616712 - DNA, 25 bp, Homo sapien
aaaaagattggccaagagtggtggc

SEQ ID NO: 616713 - DNA, 25 bp, Homo sapien
aaagattggccaagagtggtggcag

SEQ ID NO: 616714 - DNA, 25 bp, Homo sapien
atctctttaaaagaggcatccaggc

SEQ ID NO: 616715 - DNA, 25 bp, Homo sapien
tctctttaaaagaggcatccaggcc

SEQ ID NO: 616716 - DNA, 25 bp, Homo sapien
ctctttaaaagaggcatccaggccg

SEQ ID NO: 616717 - DNA, 25 bp, Homo sapien
ctttaaaagaggcatccaggccgga

SEQ ID NO: 616718 - DNA, 25 bp, Homo sapien
tttaaaagaggcatccaggccggac

SEQ ID NO: 616719 - DNA, 25 bp, Homo sapien
ttaaaagaggcatccaggccggacg

SEQ ID NO: 616720 - DNA, 25 bp, Homo sapien
taaaagaggcatccaggccggacgc

SEQ ID NO: 616721 - DNA, 25 bp, Homo sapien
aaaagaggcatccaggccggacgcg

SEQ ID NO: 616722 - DNA, 25 bp, Homo sapien
aaagaggcatccaggccggacgcgg

SEQ ID NO: 616723 - DNA, 25 bp, Homo sapien
aagaggcatccaggccggacgcggt

SEQ ID NO: 616724 - DNA, 25 bp, Homo sapien
agaggcatccaggccggacgcggtg

SEQ ID NO: 616725 - DNA, 25 bp, Homo sapien
gaagaataatgatctggccacccaa

SEQ ID NO: 616726 - DNA, 25 bp, Homo sapien
atctggccacccaagtgactgtttt

SEQ ID NO: 616727 - DNA, 25 bp, Homo sapien
aactcacaagattctctgtcaggaa

SEQ ID NO: 616728 - DNA, 25 bp, Homo sapien
ttctctgtcaggaatttcatcatgt

SEQ ID NO: 616729 - DNA, 25 bp, Homo sapien
gttgtcctggtcacatccctgctga

SEQ ID NO: 616730 - DNA, 25 bp, Homo sapien
atccctgctgagttccagtgacatg

SEQ ID NO: 616731 - DNA, 25 bp, Homo sapien
aattgcagaactaccactgtaggga

SEQ ID NO: 616732 - DNA, 25 bp, Homo sapien
ggaaattcatttagacttactttgc

SEQ ID NO: 616733 - DNA, 25 bp, Homo sapien
gacttactttgcaaattagggcctt

SEQ ID NO: 616734 - DNA, 25 bp, Homo sapien
attagggccttggacatcctggaag

SEQ ID NO: 616735 - DNA, 25 bp, Homo sapien
ggcagggtatcaatctaagtaaaat

SEQ ID NO: 616736 - DNA, 25 bp, Homo sapien
ggagggcagcatgtatcccacttgg

SEQ ID NO: 616737 - DNA, 25 bp, Homo sapien
atgtatcccacttggctgcagggtt

SEQ ID NO: 616738 - DNA, 25 bp, Homo sapien
ccacttggctgcagggttctgaggc

SEQ ID NO: 616739 - DNA, 25 bp, Homo sapien
ctagaagacagaaccctgggcacca

SEQ ID NO: 616740 - DNA, 25 bp, Homo sapien
atcgctcaggccctcactgaacggg

SEQ ID NO: 616741 - DNA, 25 bp, Homo sapien
gatttttaaggaactcctcgggcag

SEQ ID NO: 616742 - DNA, 25 bp, Homo sapien
aactcctcgggcagaggacactgat

SEQ ID NO: 616743 - DNA, 25 bp, Homo sapien
gaagattctgcagagcatcctgaaa

SEQ ID NO: 616744 - DNA, 25 bp, Homo sapien
tgaaaacacacaggctcttgatgat

SEQ ID NO: 616745 - DNA, 25 bp, Homo sapien
caggctcttgatgatgtgttagaca

SEQ ID NO: 616746 - DNA, 25 bp, Homo sapien
tgtgttagacacctcctgaataccc

SEQ ID NO: 616747 - DNA, 25 bp, Homo sapien
taattaaaatctactcaccatcaaa

SEQ ID NO: 616748 - DNA, 25 bp, Homo sapien
aattaaaatctactcaccatcaaac

SEQ ID NO: 616749 - DNA, 25 bp, Homo sapien
attaaaatctactcaccatcaaact

SEQ ID NO: 616750 - DNA, 25 bp, Homo sapien
ttaaaatctactcaccatcaaactt

SEQ ID NO: 616751 - DNA, 25 bp, Homo sapien
taaaatctactcaccatcaaacttt

SEQ ID NO: 616752 - DNA, 25 bp, Homo sapien
aaatctactcaccatcaaacttttt

SEQ ID NO: 616753 - DNA, 25 bp, Homo sapien
aagaacataagccaatgtcaggagt

SEQ ID NO: 616754 - DNA, 25 bp, Homo sapien
agaacataagccaatgtcaggagtt

SEQ ID NO: 616755 - DNA, 25 bp, Homo sapien
gaacataagccaatgtcaggagttg

SEQ ID NO: 616756 - DNA, 25 bp, Homo sapien
aacataagccaatgtcaggagttgg

SEQ ID NO: 616757 - DNA, 25 bp, Homo sapien
ataagccaatgtcaggagttggaga

SEQ ID NO: 616758 - DNA, 25 bp, Homo sapien
aacaaaatatgaacaggcctggcca

SEQ ID NO: 616759 - DNA, 25 bp, Homo sapien
aaaatatgaacaggcctggccaaca

SEQ ID NO: 616760 - DNA, 25 bp, Homo sapien
agccaggaatgcctgtagtcatgcc

SEQ ID NO: 616761 - DNA, 25 bp, Homo sapien
gccaggaatgcctgtagtcatgcct

SEQ ID NO: 616762 - DNA, 25 bp, Homo sapien
ccaggaatgcctgtagtcatgcctg

SEQ ID NO: 616763 - DNA, 25 bp, Homo sapien
aggaatgcctgtagtcatgcctgta

SEQ ID NO: 616764 - DNA, 25 bp, Homo sapien
ggaatgcctgtagtcatgcctgtag

SEQ ID NO: 616765 - DNA, 25 bp, Homo sapien
gaatgcctgtagtcatgcctgtagt

SEQ ID NO: 616766 - DNA, 25 bp, Homo sapien
aatgcctgtagtcatgcctgtagtc

SEQ ID NO: 616767 - DNA, 25 bp, Homo sapien
taaataccatttacaataactccaa

SEQ ID NO: 616768 - DNA, 25 bp, Homo sapien
aataactccaaaacacatgaaacat

SEQ ID NO: 616769 - DNA, 25 bp, Homo sapien
gttgcaccttttctacaaaaggagg

SEQ ID NO: 616770 - DNA, 25 bp, Homo sapien
aaggagggctaagcagccacctgtg

SEQ ID NO: 616771 - DNA, 25 bp, Homo sapien
ggcctttctgcctcgggaaagaaca

SEQ ID NO: 616772 - DNA, 25 bp, Homo sapien
acagggagtttagctcaggactaga

SEQ ID NO: 616773 - DNA, 25 bp, Homo sapien
ggactagagcccgtgtttccatgct

SEQ ID NO: 616774 - DNA, 25 bp, Homo sapien
gtttccatgctcatcagaagggtct

SEQ ID NO: 616775 - DNA, 25 bp, Homo sapien
accaggatgaagtctttcttagccc

SEQ ID NO: 616776 - DNA, 25 bp, Homo sapien
tagccctctcagtggctttgggaaa

SEQ ID NO: 616777 - DNA, 25 bp, Homo sapien
gtcaaactctgggtttggagaccag

SEQ ID NO: 616778 - DNA, 25 bp, Homo sapien
gaccagaaacccactattgtagaca

SEQ ID NO: 616779 - DNA, 25 bp, Homo sapien
gaaaccagtgaacttcatgggaaga

SEQ ID NO: 616780 - DNA, 25 bp, Homo sapien
gggcatggccaaaatccattctgca

SEQ ID NO: 616781 - DNA, 25 bp, Homo sapien
attctgcactctgatgactcattca

SEQ ID NO: 616782 - DNA, 25 bp, Homo sapien
gatgactcattcaaatgctcagcag

SEQ ID NO: 616783 - DNA, 25 bp, Homo sapien
gaggacggaagagctcatggtcccc

SEQ ID NO: 616784 - DNA, 25 bp, Homo sapien
gagtctaagcactttgcttttcact

SEQ ID NO: 616785 - DNA, 25 bp, Homo sapien
acttttctcattctattgtgcttca

SEQ ID NO: 616786 - DNA, 25 bp, Homo sapien
attctattgtgcttcaggctaatga

SEQ ID NO: 616787 - DNA, 25 bp, Homo sapien
aatgagttacaatctgtgcagcctt

SEQ ID NO: 616788 - DNA, 25 bp, Homo sapien
ctgtgcagcctttagagcagtgcct

SEQ ID NO: 616789 - DNA, 25 bp, Homo sapien
gtgcctggtccagagacaaaactat

SEQ ID NO: 616790 - DNA, 25 bp, Homo sapien
gaacactcaattaagggcatggcca

SEQ ID NO: 616791 - DNA, 25 bp, Homo sapien
gaagtttaataccagcctggttaag

SEQ ID NO: 616792 - DNA, 25 bp, Homo sapien
agtttaataccagcctggttaagat

SEQ ID NO: 616793 - DNA, 25 bp, Homo sapien
tttaataccagcctggttaagatag

SEQ ID NO: 616794 - DNA, 25 bp, Homo sapien
ttaataccagcctggttaagatagt

SEQ ID NO: 616795 - DNA, 25 bp, Homo sapien
aataccagcctggttaagatagtga

SEQ ID NO: 616796 - DNA, 25 bp, Homo sapien
agcctggttaagatagtgagatgct

SEQ ID NO: 616797 - DNA, 25 bp, Homo sapien
gcctggttaagatagtgagatgctt

SEQ ID NO: 616798 - DNA, 25 bp, Homo sapien
cctggttaagatagtgagatgctta

SEQ ID NO: 616799 - DNA, 25 bp, Homo sapien
ctggttaagatagtgagatgcttac

SEQ ID NO: 616800 - DNA, 25 bp, Homo sapien
ggttaagatagtgagatgcttactc

SEQ ID NO: 616801 - DNA, 25 bp, Homo sapien
tgagatgcttactctacaaaaataa

SEQ ID NO: 616802 - DNA, 25 bp, Homo sapien
tgggcagccagagtgaaaactccat

SEQ ID NO: 616803 - DNA, 25 bp, Homo sapien
ggcagccagagtgaaaactccatct

SEQ ID NO: 616804 - DNA, 25 bp, Homo sapien
aaggtaaaccatatatgcataatga

SEQ ID NO: 616805 - DNA, 25 bp, Homo sapien
gaaatatctccagtaaaagtggcta

SEQ ID NO: 616806 - DNA, 25 bp, Homo sapien
atctccagtaaaagtggctatttcc

SEQ ID NO: 616807 - DNA, 25 bp, Homo sapien
tccagtaaaagtggctatttccaaa

SEQ ID NO: 616808 - DNA, 25 bp, Homo sapien
gtggctatttccaaaattaatggca

SEQ ID NO: 616809 - DNA, 25 bp, Homo sapien
atggcagatgccaaactacagatcc

SEQ ID NO: 616810 - DNA, 25 bp, Homo sapien
ggcagatgccaaactacagatccag

SEQ ID NO: 616811 - DNA, 25 bp, Homo sapien
cagatgccaaactacagatccagga

SEQ ID NO: 616812 - DNA, 25 bp, Homo sapien
gatgccaaactacagatccaggaag

SEQ ID NO: 616813 - DNA, 25 bp, Homo sapien
attcacccagtgaaactattccaga

SEQ ID NO: 616814 - DNA, 25 bp, Homo sapien
aactattccagaacagaccctgctt

SEQ ID NO: 616815 - DNA, 25 bp, Homo sapien
cctgcttcctgatgaatttgtctcc

SEQ ID NO: 616816 - DNA, 25 bp, Homo sapien
ctgatgaatttgtctcctgtttggg

SEQ ID NO: 616817 - DNA, 25 bp, Homo sapien
gatcgtgaatgaggagttgccatct

SEQ ID NO: 616818 - DNA, 25 bp, Homo sapien
tgaggagttgccatctattaatact

SEQ ID NO: 616819 - DNA, 25 bp, Homo sapien
aagccacttcaataggatttcactc

SEQ ID NO: 616820 - DNA, 25 bp, Homo sapien
aggatttcactcttggaaaagtaga

SEQ ID NO: 616821 - DNA, 25 bp, Homo sapien
atcaatatgagaaagctgccttgca

SEQ ID NO: 616822 - DNA, 25 bp, Homo sapien
gctgccttgcaatctgaacttgggt

SEQ ID NO: 616823 - DNA, 25 bp, Homo sapien
gaacttgggttttccctgcaataga

SEQ ID NO: 616824 - DNA, 25 bp, Homo sapien
cactgtaacgtatggaacccgccaa

SEQ ID NO: 616825 - DNA, 25 bp, Homo sapien
aacccgccaatttcattcacaattt

SEQ ID NO: 616826 - DNA, 25 bp, Homo sapien
attcacaatttacgccagcttctaa

SEQ ID NO: 616827 - DNA, 25 bp, Homo sapien
gtgggatctaacgtattgagggaca

SEQ ID NO: 616828 - DNA, 25 bp, Homo sapien
ttgagggacatctggcttggcaaat

SEQ ID NO: 616829 - DNA, 25 bp, Homo sapien
tgtcctcctcacactctcaaatata

SEQ ID NO: 616830 - DNA, 25 bp, Homo sapien
aaatatacctgcaccccggacaagt

SEQ ID NO: 616831 - DNA, 25 bp, Homo sapien
accccggacaagtgcatctcaaaga

SEQ ID NO: 616832 - DNA, 25 bp, Homo sapien
agatgtcactgtaagtccatgccaa

SEQ ID NO: 616833 - DNA, 25 bp, Homo sapien
aagtccatgccaagccaaagccgtg

SEQ ID NO: 616834 - DNA, 25 bp, Homo sapien
acggcaagttgctacgacctggatt

SEQ ID NO: 616835 - DNA, 25 bp, Homo sapien
atccagccagcttgcaacactgaca

SEQ ID NO: 616836 - DNA, 25 bp, Homo sapien
gcaacactgacagtcacacagagat

SEQ ID NO: 616837 - DNA, 25 bp, Homo sapien
cagagatatgcataccattgcgcat

SEQ ID NO: 616838 - DNA, 25 bp, Homo sapien
cataccattgcgcataaatacacat

SEQ ID NO: 616839 - DNA, 25 bp, Homo sapien
ggcccagacaggtcaccatgccaaa

SEQ ID NO: 616840 - DNA, 25 bp, Homo sapien
aggtcaccatgccaaaaacactcca

SEQ ID NO: 616841 - DNA, 25 bp, Homo sapien
cacggacacctgacaatgagtgagt

SEQ ID NO: 616842 - DNA, 25 bp, Homo sapien
gtgagttcacattgtggaagcccag

SEQ ID NO: 616843 - DNA, 25 bp, Homo sapien
ggcctctcaagaaaccaaggttcct

SEQ ID NO: 616844 - DNA, 25 bp, Homo sapien
aaggttcctgaccagactgcttaga

SEQ ID NO: 616845 - DNA, 25 bp, Homo sapien
ctgaccagactgcttagaggagaaa

SEQ ID NO: 616846 - DNA, 25 bp, Homo sapien
cgtgccaccgtactccagtctgggc

SEQ ID NO: 616847 - DNA, 25 bp, Homo sapien
ctgaggcgggcggattgcctgagct

SEQ ID NO: 616848 - DNA, 25 bp, Homo sapien
tgaggcgggcggattgcctgagctc

SEQ ID NO: 616849 - DNA, 25 bp, Homo sapien
gaggcgggcggattgcctgagctca

SEQ ID NO: 616850 - DNA, 25 bp, Homo sapien
aggcgggcggattgcctgagctcag

SEQ ID NO: 616851 - DNA, 25 bp, Homo sapien
ggcgggcggattgcctgagctcagg

SEQ ID NO: 616852 - DNA, 25 bp, Homo sapien
gcgggcggattgcctgagctcagga

SEQ ID NO: 616853 - DNA, 25 bp, Homo sapien
cgggcggattgcctgagctcaggag

SEQ ID NO: 616854 - DNA, 25 bp, Homo sapien
gggcggattgcctgagctcaggagt

SEQ ID NO: 616855 - DNA, 25 bp, Homo sapien
tagaagggacaccacagaactcaat

SEQ ID NO: 616856 - DNA, 25 bp, Homo sapien
tggcccacacatcaaagtcctcgag

SEQ ID NO: 616857 - DNA, 25 bp, Homo sapien
tatgcttcatgttctcttttaccag

SEQ ID NO: 616858 - DNA, 25 bp, Homo sapien
catgttctcttttaccagacaatga

SEQ ID NO: 616859 - DNA, 25 bp, Homo sapien
ctcatactgattcctcatttttcct

SEQ ID NO: 616860 - DNA, 25 bp, Homo sapien
cctcatttttccttgacttccagga

SEQ ID NO: 616861 - DNA, 25 bp, Homo sapien
gacttccaggaatgtctgtgataaa

SEQ ID NO: 616862 - DNA, 25 bp, Homo sapien
gggacaattgcgagaattatcctca

SEQ ID NO: 616863 - DNA, 25 bp, Homo sapien
gaattatcctcagccataagtccct

SEQ ID NO: 616864 - DNA, 25 bp, Homo sapien
ataagtccctcacatggttatcacc

SEQ ID NO: 616865 - DNA, 25 bp, Homo sapien
ggttatcacctgtccattatgtatc

SEQ ID NO: 616866 - DNA, 25 bp, Homo sapien
cttagaagttacctattattgctgg

SEQ ID NO: 616867 - DNA, 25 bp, Homo sapien
ttagaagttacctattattgctggg

SEQ ID NO: 616868 - DNA, 25 bp, Homo sapien
tagaagttacctattattgctgggt

SEQ ID NO: 616869 - DNA, 25 bp, Homo sapien
agaagttacctattattgctgggtg

SEQ ID NO: 616870 - DNA, 25 bp, Homo sapien
gaagttacctattattgctgggtgt

SEQ ID NO: 616871 - DNA, 25 bp, Homo sapien
aagttacctattattgctgggtgtg

SEQ ID NO: 616872 - DNA, 25 bp, Homo sapien
agttacctattattgctgggtgtgg

SEQ ID NO: 616873 - DNA, 25 bp, Homo sapien
gttacctattattgctgggtgtggt

SEQ ID NO: 616874 - DNA, 25 bp, Homo sapien
ttacctattattgctgggtgtggtg

SEQ ID NO: 616875 - DNA, 25 bp, Homo sapien
aggcgtgatggtgggtgtttgtaat

SEQ ID NO: 616876 - DNA, 25 bp, Homo sapien
ggcgtgatggtgggtgtttgtaatc

SEQ ID NO: 616877 - DNA, 25 bp, Homo sapien
gcagaaattcccggtagtaggggat

SEQ ID NO: 616878 - DNA, 25 bp, Homo sapien
atgtcaaaggtcattgggtacgcat

SEQ ID NO: 616879 - DNA, 25 bp, Homo sapien
tgtcaaaggtcattgggtacgcatg

SEQ ID NO: 616880 - DNA, 25 bp, Homo sapien
gtcaaaggtcattgggtacgcatgc

SEQ ID NO: 616881 - DNA, 25 bp, Homo sapien
tcaaaggtcattgggtacgcatgct

SEQ ID NO: 616882 - DNA, 25 bp, Homo sapien
aaaggtcattgggtacgcatgcttt

SEQ ID NO: 616883 - DNA, 25 bp, Homo sapien
aaggtcattgggtacgcatgcttta

SEQ ID NO: 616884 - DNA, 25 bp, Homo sapien
aggtcattgggtacgcatgctttat

SEQ ID NO: 616885 - DNA, 25 bp, Homo sapien
ggtcattgggtacgcatgctttata

SEQ ID NO: 616886 - DNA, 25 bp, Homo sapien
ttataataaatttccccttgatcct

SEQ ID NO: 616887 - DNA, 25 bp, Homo sapien
tataataaatttccccttgatcctt

SEQ ID NO: 616888 - DNA, 25 bp, Homo sapien
ttaaaagtactgataactgcggtca

SEQ ID NO: 616889 - DNA, 25 bp, Homo sapien
taaaagtactgataactgcggtcag

SEQ ID NO: 616890 - DNA, 25 bp, Homo sapien
aaaagtactgataactgcggtcagg

SEQ ID NO: 616891 - DNA, 25 bp, Homo sapien
aaagtactgataactgcggtcaggt

SEQ ID NO: 616892 - DNA, 25 bp, Homo sapien
aagtactgataactgcggtcaggtg

SEQ ID NO: 616893 - DNA, 25 bp, Homo sapien
agtactgataactgcggtcaggtgc

SEQ ID NO: 616894 - DNA, 25 bp, Homo sapien
gtactgataactgcggtcaggtgca

SEQ ID NO: 616895 - DNA, 25 bp, Homo sapien
ctgataactgcggtcaggtgcagtg

SEQ ID NO: 616896 - DNA, 25 bp, Homo sapien
tgataactgcggtcaggtgcagtgg

SEQ ID NO: 616897 - DNA, 25 bp, Homo sapien
tggctcacacctgctgggagcctca

SEQ ID NO: 616898 - DNA, 25 bp, Homo sapien
tgctgggagcctcagcacgttggga

SEQ ID NO: 616899 - DNA, 25 bp, Homo sapien
agatgttttagaagtccgtcccaag

SEQ ID NO: 616900 - DNA, 25 bp, Homo sapien
gtccgtcccaagtggatagtcttac

SEQ ID NO: 616901 - DNA, 25 bp, Homo sapien
agaattatgtgttcaacctgccctc

SEQ ID NO: 616902 - DNA, 25 bp, Homo sapien
cacccctaaagcttggtgctttgca

SEQ ID NO: 616903 - DNA, 25 bp, Homo sapien
ggtgctttgcatttatagtgtgtat

SEQ ID NO: 616904 - DNA, 25 bp, Homo sapien
gaatggaactacagtcaatgtgcat

SEQ ID NO: 616905 - DNA, 25 bp, Homo sapien
cagacggaagtggattacagttcaa

SEQ ID NO: 616906 - DNA, 25 bp, Homo sapien
cagttcaaaaggagctgtccagcaa

SEQ ID NO: 616907 - DNA, 25 bp, Homo sapien
ggagctgtccagcaatcaacagttt

SEQ ID NO: 616908 - DNA, 25 bp, Homo sapien
ggaagtgttcagacaccgtaaaatc

SEQ ID NO: 616909 - DNA, 25 bp, Homo sapien
acaccgtaaaatcatgtctcaaaga

SEQ ID NO: 616910 - DNA, 25 bp, Homo sapien
cagtgtatatgtgctagtgtgtgtg

SEQ ID NO: 616911 - DNA, 25 bp, Homo sapien
gtgtgtgcacgtactattcaatatc

SEQ ID NO: 616912 - DNA, 25 bp, Homo sapien
tattcaatatcttgtagcattactc

SEQ ID NO: 616913 - DNA, 25 bp, Homo sapien
gtagcattactctacttaagagcta

SEQ ID NO: 616914 - DNA, 25 bp, Homo sapien
aagagctattgttttcatacctatt

SEQ ID NO: 616915 - DNA, 25 bp, Homo sapien
tcatacctattttcatcaggctggt

SEQ ID NO: 616916 - DNA, 25 bp, Homo sapien
ttcatcaggctggtacttcacagat

SEQ ID NO: 616917 - DNA, 25 bp, Homo sapien
gctggtacttcacagataagctgca

SEQ ID NO: 616918 - DNA, 25 bp, Homo sapien
gataagctgcaataagggtgttttt

SEQ ID NO: 616919 - DNA, 25 bp, Homo sapien
aaattctatgattacttttcagcat

SEQ ID NO: 616920 - DNA, 25 bp, Homo sapien
gtttggctttgttgaaatgtctgag

SEQ ID NO: 616921 - DNA, 25 bp, Homo sapien
aggacaatttccagaagtgttaatt

SEQ ID NO: 616922 - DNA, 25 bp, Homo sapien
accagttacggttattttgctgtgg

SEQ ID NO: 616923 - DNA, 25 bp, Homo sapien
tctttatgccaccactgcagtgtca

SEQ ID NO: 616924 - DNA, 25 bp, Homo sapien
atgccaccactgcagtgtcattctg

SEQ ID NO: 616925 - DNA, 25 bp, Homo sapien
accactgcagtgtcattctgatttg

SEQ ID NO: 616926 - DNA, 25 bp, Homo sapien
gcagtgtcattctgatttgtagata

SEQ ID NO: 616927 - DNA, 25 bp, Homo sapien
gtcattctgatttgtagatacattc

SEQ ID NO: 616928 - DNA, 25 bp, Homo sapien
gtgggatggagattcaactgtaatt

SEQ ID NO: 616929 - DNA, 25 bp, Homo sapien
ttagctcttcttttgttagttatag

SEQ ID NO: 616930 - DNA, 25 bp, Homo sapien
gctcttcttttgttagttatagaac

SEQ ID NO: 616931 - DNA, 25 bp, Homo sapien
agtgaacaaagtacttaatcttcct

SEQ ID NO: 616932 - DNA, 25 bp, Homo sapien
atatttagtaactttccagctatct

SEQ ID NO: 616933 - DNA, 25 bp, Homo sapien
gtaactttccagctatctttctatt

SEQ ID NO: 616934 - DNA, 25 bp, Homo sapien
actttccagctatctttctattatg

SEQ ID NO: 616935 - DNA, 25 bp, Homo sapien
gctatctttctattatggatttcta

SEQ ID NO: 616936 - DNA, 25 bp, Homo sapien
atggtccagcatacagtctatcttg

SEQ ID NO: 616937 - DNA, 25 bp, Homo sapien
tccagcatacagtctatcttggtga

SEQ ID NO: 616938 - DNA, 25 bp, Homo sapien
gtgaatattccatatgcacttgaac

SEQ ID NO: 616939 - DNA, 25 bp, Homo sapien
ttccatatgcacttgaacagaatat

SEQ ID NO: 616940 - DNA, 25 bp, Homo sapien
atatgtattcagctgttgctgggta

SEQ ID NO: 616941 - DNA, 25 bp, Homo sapien
agctgttgctgggtataatgatatt

SEQ ID NO: 616942 - DNA, 25 bp, Homo sapien
taaaaatatccattaggtcaaggta

SEQ ID NO: 616943 - DNA, 25 bp, Homo sapien
aataaggccatagcacagtcagtga

SEQ ID NO: 616944 - DNA, 25 bp, Homo sapien
ctgttctttgagttgtgatagtctc

SEQ ID NO: 616945 - DNA, 25 bp, Homo sapien
gagttgtgatagtctcagtactatg

SEQ ID NO: 616946 - DNA, 25 bp, Homo sapien
gtctcagtactatgtagtgattcag

SEQ ID NO: 616947 - DNA, 25 bp, Homo sapien
aaaagtgatattggccactcttcct

SEQ ID NO: 616948 - DNA, 25 bp, Homo sapien
atattggccactcttccttacttaa

SEQ ID NO: 616949 - DNA, 25 bp, Homo sapien
tggccactcttccttacttaagaag

SEQ ID NO: 616950 - DNA, 25 bp, Homo sapien
gaatcatcaaagtgttcttctaagc

SEQ ID NO: 616951 - DNA, 25 bp, Homo sapien
aagtgttcttctaagctggacacag

SEQ ID NO: 616952 - DNA, 25 bp, Homo sapien
gctggacacagtagcatgggcttgt

SEQ ID NO: 616953 - DNA, 25 bp, Homo sapien
gacacagtagcatgggcttgtagtc

SEQ ID NO: 616954 - DNA, 25 bp, Homo sapien
cacaccaccccagggaaaaatctct

SEQ ID NO: 616955 - DNA, 25 bp, Homo sapien
tctctttaaaagaggcatccaggcc

SEQ ID NO: 616956 - DNA, 25 bp, Homo sapien
ctctttaaaagaggcatccaggccg

SEQ ID NO: 616957 - DNA, 25 bp, Homo sapien
ctttaaaagaggcatccaggccgga

SEQ ID NO: 616958 - DNA, 25 bp, Homo sapien
tttaaaagaggcatccaggccggac

SEQ ID NO: 616959 - DNA, 25 bp, Homo sapien
ttaaaagaggcatccaggccggacg

SEQ ID NO: 616960 - DNA, 25 bp, Homo sapien
taaaagaggcatccaggccggacgc

SEQ ID NO: 616961 - DNA, 25 bp, Homo sapien
aaaagaggcatccaggccggacgcg

SEQ ID NO: 616962 - DNA, 25 bp, Homo sapien
aaagaggcatccaggccggacgcgg

SEQ ID NO: 616963 - DNA, 25 bp, Homo sapien
aagaggcatccaggccggacgcggt

SEQ ID NO: 616964 - DNA, 25 bp, Homo sapien
agaggcatccaggccggacgcggtg

SEQ ID NO: 616965 - DNA, 25 bp, Homo sapien
gaaaaactagatgaactaagattac

SEQ ID NO: 616966 - DNA, 25 bp, Homo sapien
aaaaactagatgaactaagattaca

SEQ ID NO: 616967 - DNA, 25 bp, Homo sapien
aaaactagatgaactaagattacag

SEQ ID NO: 616968 - DNA, 25 bp, Homo sapien
aaactagatgaactaagattacaga

SEQ ID NO: 616969 - DNA, 25 bp, Homo sapien
aactagatgaactaagattacagaa

SEQ ID NO: 616970 - DNA, 25 bp, Homo sapien
actagatgaactaagattacagaaa

SEQ ID NO: 616971 - DNA, 25 bp, Homo sapien
ctagatgaactaagattacagaaaa

SEQ ID NO: 616972 - DNA, 25 bp, Homo sapien
tagatgaactaagattacagaaaaa

SEQ ID NO: 616973 - DNA, 25 bp, Homo sapien
agatgaactaagattacagaaaaat

SEQ ID NO: 616974 - DNA, 25 bp, Homo sapien
gatgaactaagattacagaaaaatc

SEQ ID NO: 616975 - DNA, 25 bp, Homo sapien
aagattacagaaaaatctttgggag

SEQ ID NO: 616976 - DNA, 25 bp, Homo sapien
caaggtgaattgtttgcataaataa

SEQ ID NO: 616977 - DNA, 25 bp, Homo sapien
gaattgtttgcataaataagctcac

SEQ ID NO: 616978 - DNA, 25 bp, Homo sapien
aattgtttgcataaataagctcaca

SEQ ID NO: 616979 - DNA, 25 bp, Homo sapien
attgtttgcataaataagctcacag

SEQ ID NO: 616980 - DNA, 25 bp, Homo sapien
ttgtttgcataaataagctcacaga

SEQ ID NO: 616981 - DNA, 25 bp, Homo sapien
tgtttgcataaataagctcacagag

SEQ ID NO: 616982 - DNA, 25 bp, Homo sapien
gtttgcataaataagctcacagagg

SEQ ID NO: 616983 - DNA, 25 bp, Homo sapien
tttgcataaataagctcacagaggc

SEQ ID NO: 616984 - DNA, 25 bp, Homo sapien
ttgcataaataagctcacagaggct

SEQ ID NO: 616985 - DNA, 25 bp, Homo sapien
tgcataaataagctcacagaggctg

SEQ ID NO: 616986 - DNA, 25 bp, Homo sapien
gcataaataagctcacagaggctgg

SEQ ID NO: 616987 - DNA, 25 bp, Homo sapien
gtggcaaagctctgtgtatattaaa

SEQ ID NO: 616988 - DNA, 25 bp, Homo sapien
ggcaaagctctgtgtatattaaaaa

SEQ ID NO: 616989 - DNA, 25 bp, Homo sapien
aaagctctgtgtatattaaaaatgt

SEQ ID NO: 616990 - DNA, 25 bp, Homo sapien
ttaaaaatgtattgagtccgggcac

SEQ ID NO: 616991 - DNA, 25 bp, Homo sapien
aaaaatgtattgagtccgggcacgg

SEQ ID NO: 616992 - DNA, 25 bp, Homo sapien
aaaatgtattgagtccgggcacggt

SEQ ID NO: 616993 - DNA, 25 bp, Homo sapien
aaatgtattgagtccgggcacggtg

SEQ ID NO: 616994 - DNA, 25 bp, Homo sapien
atggcggcaggagactgtagtccca

SEQ ID NO: 616995 - DNA, 25 bp, Homo sapien
cagctatttgggagattgaacccgg

SEQ ID NO: 616996 - DNA, 25 bp, Homo sapien
gctatttgggagattgaacccggaa

SEQ ID NO: 616997 - DNA, 25 bp, Homo sapien
tatttgggagattgaacccggaaag

SEQ ID NO: 616998 - DNA, 25 bp, Homo sapien
tagggactttgctatctgactcctc

SEQ ID NO: 616999 - DNA, 25 bp, Homo sapien
tatctgactcctcttccagactttt

SEQ ID NO: 617000 - DNA, 25 bp, Homo sapien
tccagacttttgcttctccagtact

SEQ ID NO: 617001 - DNA, 25 bp, Homo sapien
tccagtactgcccacatttttgtaa

SEQ ID NO: 617002 - DNA, 25 bp, Homo sapien
ctgcccacatttttgtaagatctaa

SEQ ID NO: 617003 - DNA, 25 bp, Homo sapien
tgtaagatctaattcctactaaaaa

SEQ ID NO: 617004 - DNA, 25 bp, Homo sapien
attcctctttccataattcttatca

SEQ ID NO: 617005 - DNA, 25 bp, Homo sapien
cttatcatgattctgcttctttcac

SEQ ID NO: 617006 - DNA, 25 bp, Homo sapien
ttcactgaatcctggatgatacaga

SEQ ID NO: 617007 - DNA, 25 bp, Homo sapien
ataagtatcaatcagtcaacagtag

SEQ ID NO: 617008 - DNA, 25 bp, Homo sapien
atcagtcaacagtagttacctctga

SEQ ID NO: 617009 - DNA, 25 bp, Homo sapien
acagataagaatacagctggccagg

SEQ ID NO: 617010 - DNA, 25 bp, Homo sapien
cagataagaatacagctggccaggc

SEQ ID NO: 617011 - DNA, 25 bp, Homo sapien
agataagaatacagctggccaggcg

SEQ ID NO: 617012 - DNA, 25 bp, Homo sapien
taagaatacagctggccaggcgcgg

SEQ ID NO: 617013 - DNA, 25 bp, Homo sapien
aggcccaggtgggtgtatcatttaa

SEQ ID NO: 617014 - DNA, 25 bp, Homo sapien
ggcccaggtgggtgtatcatttaag

SEQ ID NO: 617015 - DNA, 25 bp, Homo sapien
gcccaggtgggtgtatcatttaagg

SEQ ID NO: 617016 - DNA, 25 bp, Homo sapien
cccaggtgggtgtatcatttaaggt

SEQ ID NO: 617017 - DNA, 25 bp, Homo sapien
ccaggtgggtgtatcatttaaggtc

SEQ ID NO: 617018 - DNA, 25 bp, Homo sapien
caggtgggtgtatcatttaaggtca

SEQ ID NO: 617019 - DNA, 25 bp, Homo sapien
tgtatcatttaaggtcagaagttca

SEQ ID NO: 617020 - DNA, 25 bp, Homo sapien
gaaacacagaatgcttctatgataa

SEQ ID NO: 617021 - DNA, 25 bp, Homo sapien
aaacacagaatgcttctatgataag

SEQ ID NO: 617022 - DNA, 25 bp, Homo sapien
aacacagaatgcttctatgataaga

SEQ ID NO: 617023 - DNA, 25 bp, Homo sapien
acacagaatgcttctatgataagag

SEQ ID NO: 617024 - DNA, 25 bp, Homo sapien
cacagaatgcttctatgataagaga

SEQ ID NO: 617025 - DNA, 25 bp, Homo sapien
gaatgcttctatgataagagaaaac

SEQ ID NO: 617026 - DNA, 25 bp, Homo sapien
tgcttctatgataagagaaaactcc

SEQ ID NO: 617027 - DNA, 25 bp, Homo sapien
gcttctatgataagagaaaactcca

SEQ ID NO: 617028 - DNA, 25 bp, Homo sapien
cttctatgataagagaaaactccag

SEQ ID NO: 617029 - DNA, 25 bp, Homo sapien
tctatgataagagaaaactccagcc

SEQ ID NO: 617030 - DNA, 25 bp, Homo sapien
taagagaaaactccagccaggctca

SEQ ID NO: 617031 - DNA, 25 bp, Homo sapien
aacatggcatacatccagagctctt

SEQ ID NO: 617032 - DNA, 25 bp, Homo sapien
cagagctcttgtggcacttgtatca

SEQ ID NO: 617033 - DNA, 25 bp, Homo sapien
gcacttgtatcaagcggtacagcta

SEQ ID NO: 617034 - DNA, 25 bp, Homo sapien
ggtacagctatgcacactctctaag

SEQ ID NO: 617035 - DNA, 25 bp, Homo sapien
cacactctctaaggcgggcagctgt

SEQ ID NO: 617036 - DNA, 25 bp, Homo sapien
cgggcagctgtaagggctgtcctct

SEQ ID NO: 617037 - DNA, 25 bp, Homo sapien
tgcttctggcatgccacattggcta

SEQ ID NO: 617038 - DNA, 25 bp, Homo sapien
tgccacattggctaaatatatcgac

SEQ ID NO: 617039 - DNA, 25 bp, Homo sapien
taaatatatcgaccatcacctctgc

SEQ ID NO: 617040 - DNA, 25 bp, Homo sapien
gcagtaattattgacgtattcctga

SEQ ID NO: 617041 - DNA, 25 bp, Homo sapien
tgacgtattcctgatggttttctct

SEQ ID NO: 617042 - DNA, 25 bp, Homo sapien
aggtgcctgctactatgtcctgcta

SEQ ID NO: 617043 - DNA, 25 bp, Homo sapien
cctgctactatgtcctgctaatttt

SEQ ID NO: 617044 - DNA, 25 bp, Homo sapien
tacccggcctatatccaccaaaaat

SEQ ID NO: 617045 - DNA, 25 bp, Homo sapien
agtcacttaatctctttaggcctca

SEQ ID NO: 617046 - DNA, 25 bp, Homo sapien
tcacttaatctctttaggcctcatc

SEQ ID NO: 617047 - DNA, 25 bp, Homo sapien
acttaatctctttaggcctcatctg

SEQ ID NO: 617048 - DNA, 25 bp, Homo sapien
ttaatctctttaggcctcatctgaa

SEQ ID NO: 617049 - DNA, 25 bp, Homo sapien
atctctttaggcctcatctgaaaag

SEQ ID NO: 617050 - DNA, 25 bp, Homo sapien
tctttaggcctcatctgaaaaggag

SEQ ID NO: 617051 - DNA, 25 bp, Homo sapien
ttaggcctcatctgaaaaggagaga

SEQ ID NO: 617052 - DNA, 25 bp, Homo sapien
gcctcatctgaaaaggagagaaggt

SEQ ID NO: 617053 - DNA, 25 bp, Homo sapien
cagatcactcgaagccagaagctca

SEQ ID NO: 617054 - DNA, 25 bp, Homo sapien
agatcactcgaagccagaagctcaa

SEQ ID NO: 617055 - DNA, 25 bp, Homo sapien
gatgcttacataattgtgaatatac

SEQ ID NO: 617056 - DNA, 25 bp, Homo sapien
aaatggtaaatcttatataaactgt

SEQ ID NO: 617057 - DNA, 25 bp, Homo sapien
atggacaaccaagagaaataacaga

SEQ ID NO: 617058 - DNA, 25 bp, Homo sapien
aaaagacacctaagtcattcagatt

SEQ ID NO: 617059 - DNA, 25 bp, Homo sapien
tcagattttggagttccaggccaga

SEQ ID NO: 617060 - DNA, 25 bp, Homo sapien
cagattttggagttccaggccagat

SEQ ID NO: 617061 - DNA, 25 bp, Homo sapien
gattttggagttccaggccagatgt

SEQ ID NO: 617062 - DNA, 25 bp, Homo sapien
ttttggagttccaggccagatgtgg

SEQ ID NO: 617063 - DNA, 25 bp, Homo sapien
tttggagttccaggccagatgtggt

SEQ ID NO: 617064 - DNA, 25 bp, Homo sapien
tgcacccagccgttaaatttttaat

SEQ ID NO: 617065 - DNA, 25 bp, Homo sapien
gtatgaaacttaaagtgacctaaat

SEQ ID NO: 617066 - DNA, 25 bp, Homo sapien
ctaaatgtccaataaagcatgatat

SEQ ID NO: 617067 - DNA, 25 bp, Homo sapien
aatgtccaataaagcatgatatagc

SEQ ID NO: 617068 - DNA, 25 bp, Homo sapien
gtccaataaagcatgatatagctat

SEQ ID NO: 617069 - DNA, 25 bp, Homo sapien
ataaagcatgatatagctatacaaa

SEQ ID NO: 617070 - DNA, 25 bp, Homo sapien
acaaaacaataccagaaggacatta

SEQ ID NO: 617071 - DNA, 25 bp, Homo sapien
caataccagaaggacattaagtgat

SEQ ID NO: 617072 - DNA, 25 bp, Homo sapien
accagaaggacattaagtgatgttg

SEQ ID NO: 617073 - DNA, 25 bp, Homo sapien
gaataatgtccccaagttattatta

SEQ ID NO: 617074 - DNA, 25 bp, Homo sapien
taatgtccccaagttattattaagt

SEQ ID NO: 617075 - DNA, 25 bp, Homo sapien
gctgttcacaagagtatggaggcct

SEQ ID NO: 617076 - DNA, 25 bp, Homo sapien
tatggaggccttccttattcagtgt

SEQ ID NO: 617077 - DNA, 25 bp, Homo sapien
aggccttccttattcagtgtgactg

SEQ ID NO: 617078 - DNA, 25 bp, Homo sapien
agtgtgactggtgcctggtgttcct

SEQ ID NO: 617079 - DNA, 25 bp, Homo sapien
gcctggtgttcctagtgtggagata

SEQ ID NO: 617080 - DNA, 25 bp, Homo sapien
gttcctagtgtggagatactatgat

SEQ ID NO: 617081 - DNA, 25 bp, Homo sapien
tactatgatttgttatctacagtga

SEQ ID NO: 617082 - DNA, 25 bp, Homo sapien
gtgattaaatctagattgtttccag

SEQ ID NO: 617083 - DNA, 25 bp, Homo sapien
ttgtttccagtttttcactattgaa

SEQ ID NO: 617084 - DNA, 25 bp, Homo sapien
actattgaaagttgtgacctgaagc

SEQ ID NO: 617085 - DNA, 25 bp, Homo sapien
gtgacctgaagctggttgtggcaat

SEQ ID NO: 617086 - DNA, 25 bp, Homo sapien
caatgatcaattttatcttactact

SEQ ID NO: 617087 - DNA, 25 bp, Homo sapien
tcttactactttataacttttgctg

SEQ ID NO: 617088 - DNA, 25 bp, Homo sapien
tgctgacttttattctttgcattgt

SEQ ID NO: 617089 - DNA, 25 bp, Homo sapien
tgcattgtatgtaatgtccatcagt

SEQ ID NO: 617090 - DNA, 25 bp, Homo sapien
gtaatgtccatcagtataaattgag

SEQ ID NO: 617091 - DNA, 25 bp, Homo sapien
gagactgtgaatttctaggacccac

SEQ ID NO: 617092 - DNA, 25 bp, Homo sapien
gtgaatttctaggacccacaaaagt

SEQ ID NO: 617093 - DNA, 25 bp, Homo sapien
tctaggacccacaaaagtggtattt

SEQ ID NO: 617094 - DNA, 25 bp, Homo sapien
ggaagctgggcattaaattacctca

SEQ ID NO: 617095 - DNA, 25 bp, Homo sapien
gggcattaaattacctcatccagca

SEQ ID NO: 617096 - DNA, 25 bp, Homo sapien
cattaaattacctcatccagcagaa

SEQ ID NO: 617097 - DNA, 25 bp, Homo sapien
ggataattctattgcctcttgtgaa

SEQ ID NO: 617098 - DNA, 25 bp, Homo sapien
tattgcctcttgtgaatactaaaca

SEQ ID NO: 617099 - DNA, 25 bp, Homo sapien
ttttttcacagcattctattcatct

SEQ ID NO: 617100 - DNA, 25 bp, Homo sapien
tctattcatctaaaagcaccggtaa

SEQ ID NO: 617101 - DNA, 25 bp, Homo sapien
gcaccggtaattaacgatgctaata

SEQ ID NO: 617102 - DNA, 25 bp, Homo sapien
gtataatccctttgtaaacatctct

SEQ ID NO: 617103 - DNA, 25 bp, Homo sapien
gtaaacatctcttcacaaggtcata

SEQ ID NO: 617104 - DNA, 25 bp, Homo sapien
gactgaatgaaggacgccaggcttt

SEQ ID NO: 617105 - DNA, 25 bp, Homo sapien
tttgtcattgaatgcactcactgca

SEQ ID NO: 617106 - DNA, 25 bp, Homo sapien
gaagtagtacatttgccttctacca

SEQ ID NO: 617107 - DNA, 25 bp, Homo sapien
cttctaccatctcattaacattgct

SEQ ID NO: 617108 - DNA, 25 bp, Homo sapien
aagagctgaggtcctatggagccaa

SEQ ID NO: 617109 - DNA, 25 bp, Homo sapien
ggcagtcagttggtattgcatttac

SEQ ID NO: 617110 - DNA, 25 bp, Homo sapien
accttttatgcccacagactgctga

SEQ ID NO: 617111 - DNA, 25 bp, Homo sapien
acagactgctgaggcccggattaag

SEQ ID NO: 617112 - DNA, 25 bp, Homo sapien
gaggcccggattaagctagcacaag

SEQ ID NO: 617113 - DNA, 25 bp, Homo sapien
agaggacaactaaccctgtgctttg

SEQ ID NO: 617114 - DNA, 25 bp, Homo sapien
ctaaccctgtgctttgaaaatccaa

SEQ ID NO: 617115 - DNA, 25 bp, Homo sapien
aaatccaattcacatttcttgagta

SEQ ID NO: 617116 - DNA, 25 bp, Homo sapien
agtatgactatgtcctaggcagtgg

SEQ ID NO: 617117 - DNA, 25 bp, Homo sapien
taacaccatctattggagacaccaa

SEQ ID NO: 617118 - DNA, 25 bp, Homo sapien
aaaccagaattgtagttcaacgcaa

SEQ ID NO: 617119 - DNA, 25 bp, Homo sapien
ggcctaagcatctgggtgtgtggga

SEQ ID NO: 617120 - DNA, 25 bp, Homo sapien
aagctgttacatgattctaatttgc

SEQ ID NO: 617121 - DNA, 25 bp, Homo sapien
acatgattctaatttgctgccttgg

SEQ ID NO: 617122 - DNA, 25 bp, Homo sapien
actatgccccataggccaaatccaa

SEQ ID NO: 617123 - DNA, 25 bp, Homo sapien
gccaaatccaaccaatctcctgttt

SEQ ID NO: 617124 - DNA, 25 bp, Homo sapien
aatctcctgtttttgtactgccttg

SEQ ID NO: 617125 - DNA, 25 bp, Homo sapien
ctgtttttgtactgccttggagcta

SEQ ID NO: 617126 - DNA, 25 bp, Homo sapien
ctgccttggagctaagaagggcttt

SEQ ID NO: 617127 - DNA, 25 bp, Homo sapien
aatttcactgtctgtaaatcaagtt

SEQ ID NO: 617128 - DNA, 25 bp, Homo sapien
gtaaatcaagtttcgttgcaaccaa

SEQ ID NO: 617129 - DNA, 25 bp, Homo sapien
gtttcgttgcaaccaaagcctttgg

SEQ ID NO: 617130 - DNA, 25 bp, Homo sapien
atctcgtctgccctcattctctgtt

SEQ ID NO: 617131 - DNA, 25 bp, Homo sapien
aacaccaaaggattaagtcatgaca

SEQ ID NO: 617132 - DNA, 25 bp, Homo sapien
taagtcatgacaggcttgaattcgg

SEQ ID NO: 617133 - DNA, 25 bp, Homo sapien
gttagttaaccttcagggtctcagt

SEQ ID NO: 617134 - DNA, 25 bp, Homo sapien
ttaaccttcagggtctcagtctctc

SEQ ID NO: 617135 - DNA, 25 bp, Homo sapien
ggataagaatagcacccactaccta

SEQ ID NO: 617136 - DNA, 25 bp, Homo sapien
agcacccactacctatggttattac

SEQ ID NO: 617137 - DNA, 25 bp, Homo sapien
aaagcattcaaaatagaggccctgt

SEQ ID NO: 617138 - DNA, 25 bp, Homo sapien
atagaggccctgtgtaactggcact

SEQ ID NO: 617139 - DNA, 25 bp, Homo sapien
gtgtaactggcactctgtgagcatt

SEQ ID NO: 617140 - DNA, 25 bp, Homo sapien
gcactctgtgagcattctgtttgaa

SEQ ID NO: 617141 - DNA, 25 bp, Homo sapien
tcactaataggaactccttggagaa

SEQ ID NO: 617142 - DNA, 25 bp, Homo sapien
gcaggaaaagatgagcctagagcat

SEQ ID NO: 617143 - DNA, 25 bp, Homo sapien
atgagcctagagcatcttgctgtgc

SEQ ID NO: 617144 - DNA, 25 bp, Homo sapien
ctagagcatcttgctgtgccggaaa

SEQ ID NO: 617145 - DNA, 25 bp, Homo sapien
gagcatcttgctgtgccggaaagta

SEQ ID NO: 617146 - DNA, 25 bp, Homo sapien
gcatcttgctgtgccggaaagtaag

SEQ ID NO: 617147 - DNA, 25 bp, Homo sapien
ttgctgtgccggaaagtaaggaagt

SEQ ID NO: 617148 - DNA, 25 bp, Homo sapien
aatgatagggacacatcaaaggaca

SEQ ID NO: 617149 - DNA, 25 bp, Homo sapien
ctatacactgtttagcaatctttgc

SEQ ID NO: 617150 - DNA, 25 bp, Homo sapien
tttgctaatttgttattcatggata

SEQ ID NO: 617151 - DNA, 25 bp, Homo sapien
ttggggaggttgtgcattccagaaa

SEQ ID NO: 617152 - DNA, 25 bp, Homo sapien
tcagctcctagtatgtgagaatcac

SEQ ID NO: 617153 - DNA, 25 bp, Homo sapien
aatcacttggagagaagcttgccat

SEQ ID NO: 617154 - DNA, 25 bp, Homo sapien
agagaagcttgccattgtccttact

SEQ ID NO: 617155 - DNA, 25 bp, Homo sapien
tactctccagctccaaagtcaggga

SEQ ID NO: 617156 - DNA, 25 bp, Homo sapien
aaaggagccctaccagtaccactgt

SEQ ID NO: 617157 - DNA, 25 bp, Homo sapien
actgtcatccccaggtgactgtagg

SEQ ID NO: 617158 - DNA, 25 bp, Homo sapien
gactgtaggcatacccaaagctgta

SEQ ID NO: 617159 - DNA, 25 bp, Homo sapien
cccaaagctgtaccatcctgaagag

SEQ ID NO: 617160 - DNA, 25 bp, Homo sapien
tgtaccatcctgaagagcaacatca

SEQ ID NO: 617161 - DNA, 25 bp, Homo sapien
attcaaccagtcactagaccagcag

SEQ ID NO: 617162 - DNA, 25 bp, Homo sapien
gggtattcattatccagtgttccta

SEQ ID NO: 617163 - DNA, 25 bp, Homo sapien
tacccggcctatatccaccaaaaat

SEQ ID NO: 617164 - DNA, 25 bp, Homo sapien
agtcacttaatctctttaggcctca

SEQ ID NO: 617165 - DNA, 25 bp, Homo sapien
gtcacttaatctctttaggcctcat

SEQ ID NO: 617166 - DNA, 25 bp, Homo sapien
tcacttaatctctttaggcctcatc

SEQ ID NO: 617167 - DNA, 25 bp, Homo sapien
acttaatctctttaggcctcatctg

SEQ ID NO: 617168 - DNA, 25 bp, Homo sapien
cttaatctctttaggcctcatctga

SEQ ID NO: 617169 - DNA, 25 bp, Homo sapien
ttaatctctttaggcctcatctgaa

SEQ ID NO: 617170 - DNA, 25 bp, Homo sapien
atctctttaggcctcatctgaaaag

SEQ ID NO: 617171 - DNA, 25 bp, Homo sapien
tctttaggcctcatctgaaaaggag

SEQ ID NO: 617172 - DNA, 25 bp, Homo sapien
ttaggcctcatctgaaaaggagaga

SEQ ID NO: 617173 - DNA, 25 bp, Homo sapien
gcctcatctgaaaaggagagaaggt

SEQ ID NO: 617174 - DNA, 25 bp, Homo sapien
aaggggattcatggccaggcagggt

SEQ ID NO: 617175 - DNA, 25 bp, Homo sapien
gcagggtggcatgttcttgtctgta

SEQ ID NO: 617176 - DNA, 25 bp, Homo sapien
cagggtggcatgttcttgtctgtaa

SEQ ID NO: 617177 - DNA, 25 bp, Homo sapien
agggtggcatgttcttgtctgtaat

SEQ ID NO: 617178 - DNA, 25 bp, Homo sapien
gtggcatgttcttgtctgtaatctc

SEQ ID NO: 617179 - DNA, 25 bp, Homo sapien
tggcatgttcttgtctgtaatctca

SEQ ID NO: 617180 - DNA, 25 bp, Homo sapien
gcatgttcttgtctgtaatctcagt

SEQ ID NO: 617181 - DNA, 25 bp, Homo sapien
atgttcttgtctgtaatctcagtac

SEQ ID NO: 617182 - DNA, 25 bp, Homo sapien
cagtgagctataatacaaggcttca

SEQ ID NO: 617183 - DNA, 25 bp, Homo sapien
gctataatacaaggcttcattgcac

SEQ ID NO: 617184 - DNA, 25 bp, Homo sapien
ataatacaaggcttcattgcactcc

SEQ ID NO: 617185 - DNA, 25 bp, Homo sapien
aactcctgtaatccccacgcttggg

SEQ ID NO: 617186 - DNA, 25 bp, Homo sapien
taatccccacgcttgggaggccggg

SEQ ID NO: 617187 - DNA, 25 bp, Homo sapien
gggagaccaccatatctgcaaaaaa

SEQ ID NO: 617188 - DNA, 25 bp, Homo sapien
aaataacaaatcagccgagtgcggt

SEQ ID NO: 617189 - DNA, 25 bp, Homo sapien
aataacaaatcagccgagtgcggtg

SEQ ID NO: 617190 - DNA, 25 bp, Homo sapien
gggcagagggattgcttggacccgg

SEQ ID NO: 617191 - DNA, 25 bp, Homo sapien
gccattgcactctagactgcaggac

SEQ ID NO: 617192 - DNA, 25 bp, Homo sapien
attgcactctagactgcaggacgga

SEQ ID NO: 617193 - DNA, 25 bp, Homo sapien
tgcactctagactgcaggacggaga

SEQ ID NO: 617194 - DNA, 25 bp, Homo sapien
cactctagactgcaggacggagaga

SEQ ID NO: 617195 - DNA, 25 bp, Homo sapien
ctagactgcaggacggagagagacc

SEQ ID NO: 617196 - DNA, 25 bp, Homo sapien
ttgcaaggttgtgatgaatcccatc

SEQ ID NO: 617197 - DNA, 25 bp, Homo sapien
tgaatcccatcaagtccctgcatat

SEQ ID NO: 617198 - DNA, 25 bp, Homo sapien
agtccctgcatatgaaaacctttgt

SEQ ID NO: 617199 - DNA, 25 bp, Homo sapien
gttactatacctgttgtctttatgg

SEQ ID NO: 617200 - DNA, 25 bp, Homo sapien
acctgttgtctttatggaccttaca

SEQ ID NO: 617201 - DNA, 25 bp, Homo sapien
ggaccttacaatgtcaggatagaag

SEQ ID NO: 617202 - DNA, 25 bp, Homo sapien
gaaagactacccagtccagtcattt

SEQ ID NO: 617203 - DNA, 25 bp, Homo sapien
tacccagtccagtcattttcaagat

SEQ ID NO: 617204 - DNA, 25 bp, Homo sapien
atgtatttatctgttgatctgtcac

SEQ ID NO: 617205 - DNA, 25 bp, Homo sapien
gatctgtcacattctttccacaaat

SEQ ID NO: 617206 - DNA, 25 bp, Homo sapien
ggcaaacttatattcctttaggtat

SEQ ID NO: 617207 - DNA, 25 bp, Homo sapien
gacttccaggaacagaccgtaggca

SEQ ID NO: 617208 - DNA, 25 bp, Homo sapien
acttccaggaacagaccgtaggcag

SEQ ID NO: 617209 - DNA, 25 bp, Homo sapien
cttccaggaacagaccgtaggcagt

SEQ ID NO: 617210 - DNA, 25 bp, Homo sapien
ttccaggaacagaccgtaggcagtg

SEQ ID NO: 617211 - DNA, 25 bp, Homo sapien
tccaggaacagaccgtaggcagtgg

SEQ ID NO: 617212 - DNA, 25 bp, Homo sapien
caggaacagaccgtaggcagtggca

SEQ ID NO: 617213 - DNA, 25 bp, Homo sapien
aggaacagaccgtaggcagtggcag

SEQ ID NO: 617214 - DNA, 25 bp, Homo sapien
ggaacagaccgtaggcagtggcaga

SEQ ID NO: 617215 - DNA, 25 bp, Homo sapien
gaacagaccgtaggcagtggcagag

SEQ ID NO: 617216 - DNA, 25 bp, Homo sapien
aacagaccgtaggcagtggcagagg

SEQ ID NO: 617217 - DNA, 25 bp, Homo sapien
ggcagtggcagagggaagattcttg

SEQ ID NO: 617218 - DNA, 25 bp, Homo sapien
acactcattccaaaaagtcaggaaa

SEQ ID NO: 617219 - DNA, 25 bp, Homo sapien
gatcaaattctatacacagttatta

SEQ ID NO: 617220 - DNA, 25 bp, Homo sapien
aaatgcgaagaaggagcagattaac

SEQ ID NO: 617221 - DNA, 25 bp, Homo sapien
ggagcagattaacatccttacagac

SEQ ID NO: 617222 - DNA, 25 bp, Homo sapien
gcagattaacatccttacagacaat

SEQ ID NO: 617223 - DNA, 25 bp, Homo sapien
aaacacaccagggagacaccataaa

SEQ ID NO: 617224 - DNA, 25 bp, Homo sapien
acaccagggagacaccataaaacag

SEQ ID NO: 617225 - DNA, 25 bp, Homo sapien
gggagacaccataaaacagaccaag

SEQ ID NO: 617226 - DNA, 25 bp, Homo sapien
gagacaccataaaacagaccaagac

SEQ ID NO: 617227 - DNA, 25 bp, Homo sapien
gacaccataaaacagaccaagacta

SEQ ID NO: 617228 - DNA, 25 bp, Homo sapien
cataaaacagaccaagactaactta

SEQ ID NO: 617229 - DNA, 25 bp, Homo sapien
aaaaaactgagcatgcaccagcaga

SEQ ID NO: 617230 - DNA, 25 bp, Homo sapien
aaactgagcatgcaccagcagacag

SEQ ID NO: 617231 - DNA, 25 bp, Homo sapien
gaatcagaagcagtgtacacattcc

SEQ ID NO: 617232 - DNA, 25 bp, Homo sapien
gaagcagtgtacacattccttgaaa

SEQ ID NO: 617233 - DNA, 25 bp, Homo sapien
gcagtgtacacattccttgaaagca

SEQ ID NO: 617234 - DNA, 25 bp, Homo sapien
gtacacattccttgaaagcaaaaga

SEQ ID NO: 617235 - DNA, 25 bp, Homo sapien
taggataactgacatatgaaaccat

SEQ ID NO: 617236 - DNA, 25 bp, Homo sapien
aatagctcatgttttatttccgaaa

SEQ ID NO: 617237 - DNA, 25 bp, Homo sapien
gctcatgttttatttccgaaacctt

SEQ ID NO: 617238 - DNA, 25 bp, Homo sapien
tttttccaccgcacaccagaactgt

SEQ ID NO: 617239 - DNA, 25 bp, Homo sapien
ttccaccgcacaccagaactgtgga

SEQ ID NO: 617240 - DNA, 25 bp, Homo sapien
tcactaataggaactccttggagaa

SEQ ID NO: 617241 - DNA, 25 bp, Homo sapien
gctgattccagaacaggagcaggaa

SEQ ID NO: 617242 - DNA, 25 bp, Homo sapien
gatgagcctagagcatcttgctgtg

SEQ ID NO: 617243 - DNA, 25 bp, Homo sapien
ctagagcatcttgctgtgccggaaa

SEQ ID NO: 617244 - DNA, 25 bp, Homo sapien
agcatcttgctgtgccggaaagtaa

SEQ ID NO: 617245 - DNA, 25 bp, Homo sapien
ttgctgtgccggaaagtaaggaagt

SEQ ID NO: 617246 - DNA, 25 bp, Homo sapien
aatgatagggacacatcaaaggaca

SEQ ID NO: 617247 - DNA, 25 bp, Homo sapien
ccgtgcctggcctagaacaaaggaa

SEQ ID NO: 617248 - DNA, 25 bp, Homo sapien
ctatacactgtttagcaatctttgc

SEQ ID NO: 617249 - DNA, 25 bp, Homo sapien
tttgctaatttgttattcatggata

SEQ ID NO: 617250 - DNA, 25 bp, Homo sapien
ggaggttgtgcattccagaaaggaa

SEQ ID NO: 617251 - DNA, 25 bp, Homo sapien
gaaagcagggactcggccgggcccg

SEQ ID NO: 617252 - DNA, 25 bp, Homo sapien
agcagggactcggccgggcccggtg

SEQ ID NO: 617253 - DNA, 25 bp, Homo sapien
gcagggactcggccgggcccggtgg

SEQ ID NO: 617254 - DNA, 25 bp, Homo sapien
ggactcggccgggcccggtggctca

SEQ ID NO: 617255 - DNA, 25 bp, Homo sapien
ggcgcctgttaatcccagcgacttg

SEQ ID NO: 617256 - DNA, 25 bp, Homo sapien
gcgcctgttaatcccagcgacttgg

SEQ ID NO: 617257 - DNA, 25 bp, Homo sapien
cctgttaatcccagcgacttgggaa

SEQ ID NO: 617258 - DNA, 25 bp, Homo sapien
ctgttaatcccagcgacttgggaag

SEQ ID NO: 617259 - DNA, 25 bp, Homo sapien
tgttaatcccagcgacttgggaagc

SEQ ID NO: 617260 - DNA, 25 bp, Homo sapien
gttaatcccagcgacttgggaagcc

SEQ ID NO: 617261 - DNA, 25 bp, Homo sapien
ttaatcccagcgacttgggaagccg

SEQ ID NO: 617262 - DNA, 25 bp, Homo sapien
cagaccagaactccctttctttgcg

SEQ ID NO: 617263 - DNA, 25 bp, Homo sapien
accagaactccctttctttgcggag

SEQ ID NO: 617264 - DNA, 25 bp, Homo sapien
agaactccctttctttgcggagcac

SEQ ID NO: 617265 - DNA, 25 bp, Homo sapien
gaactccctttctttgcggagcacc

SEQ ID NO: 617266 - DNA, 25 bp, Homo sapien
tttctttgcggagcaccatagctta

SEQ ID NO: 617267 - DNA, 25 bp, Homo sapien
ttctttgcggagcaccatagcttat

SEQ ID NO: 617268 - DNA, 25 bp, Homo sapien
tctttgcggagcaccatagcttatg

SEQ ID NO: 617269 - DNA, 25 bp, Homo sapien
tttgcggagcaccatagcttatgcc

SEQ ID NO: 617270 - DNA, 25 bp, Homo sapien
ttgcggagcaccatagcttatgcct

SEQ ID NO: 617271 - DNA, 25 bp, Homo sapien
tgcggagcaccatagcttatgcctg

SEQ ID NO: 617272 - DNA, 25 bp, Homo sapien
cggagcaccatagcttatgcctgta

SEQ ID NO: 617273 - DNA, 25 bp, Homo sapien
acttagtgactttggctcacagttt

SEQ ID NO: 617274 - DNA, 25 bp, Homo sapien
ggctcacagtttcatcatccataaa

SEQ ID NO: 617275 - DNA, 25 bp, Homo sapien
gacacaagactattaaggagggcta

SEQ ID NO: 617276 - DNA, 25 bp, Homo sapien
ggagggctagaagttatccaacagt

SEQ ID NO: 617277 - DNA, 25 bp, Homo sapien
aatcatatttgccatttcctgtcac

SEQ ID NO: 617278 - DNA, 25 bp, Homo sapien
catttcctgtcactggaatgggtaa

SEQ ID NO: 617279 - DNA, 25 bp, Homo sapien
gaatgggtaaccttgcttggcttga

SEQ ID NO: 617280 - DNA, 25 bp, Homo sapien
gcttggcttgaatctccagttctgg

SEQ ID NO: 617281 - DNA, 25 bp, Homo sapien
acagtgctgtgcttgagagcagttt

SEQ ID NO: 617282 - DNA, 25 bp, Homo sapien
ttgagagcagtttagtagaccagac

SEQ ID NO: 617283 - DNA, 25 bp, Homo sapien
gaccagactgaaataaacgctcttt

SEQ ID NO: 617284 - DNA, 25 bp, Homo sapien
gaaaaactagatgaactaagattac

SEQ ID NO: 617285 - DNA, 25 bp, Homo sapien
aaaactagatgaactaagattacag

SEQ ID NO: 617286 - DNA, 25 bp, Homo sapien
aaactagatgaactaagattacaga

SEQ ID NO: 617287 - DNA, 25 bp, Homo sapien
aactagatgaactaagattacagaa

SEQ ID NO: 617288 - DNA, 25 bp, Homo sapien
actagatgaactaagattacagaaa

SEQ ID NO: 617289 - DNA, 25 bp, Homo sapien
ctagatgaactaagattacagaaaa

SEQ ID NO: 617290 - DNA, 25 bp, Homo sapien
tagatgaactaagattacagaaaaa

SEQ ID NO: 617291 - DNA, 25 bp, Homo sapien
agatgaactaagattacagaaaaat

SEQ ID NO: 617292 - DNA, 25 bp, Homo sapien
ttacagaaaaatctttgggaggccg

SEQ ID NO: 617293 - DNA, 25 bp, Homo sapien
tacagaaaaatctttgggaggccga

SEQ ID NO: 617294 - DNA, 25 bp, Homo sapien
ctgtagtcccagcaggagaatggtg

SEQ ID NO: 617295 - DNA, 25 bp, Homo sapien
tctgttatgggctgggctcatgttc

SEQ ID NO: 617296 - DNA, 25 bp, Homo sapien
tatgggctgggctcatgttcagcgt

SEQ ID NO: 617297 - DNA, 25 bp, Homo sapien
tcatgttcagcgtgcgagggttaca

SEQ ID NO: 617298 - DNA, 25 bp, Homo sapien
gttcagcgtgcgagggttacaaaat

SEQ ID NO: 617299 - DNA, 25 bp, Homo sapien
cagcgtgcgagggttacaaaataga

SEQ ID NO: 617300 - DNA, 25 bp, Homo sapien
aaaacaaacattcctgtgctcttag

SEQ ID NO: 617301 - DNA, 25 bp, Homo sapien
aaacattcctgtgctcttagaggtt

SEQ ID NO: 617302 - DNA, 25 bp, Homo sapien
attcctgtgctcttagaggttacct

SEQ ID NO: 617303 - DNA, 25 bp, Homo sapien
gtgctcttagaggttacctcctggg

SEQ ID NO: 617304 - DNA, 25 bp, Homo sapien
gcaggaggacagatgatgagcaaaa

SEQ ID NO: 617305 - DNA, 25 bp, Homo sapien
gatacagtgtgttgtagctaggcat

SEQ ID NO: 617306 - DNA, 25 bp, Homo sapien
aagaaatattcaatcaggccccaga

SEQ ID NO: 617307 - DNA, 25 bp, Homo sapien
tcaatcaggccccagataccatttt

SEQ ID NO: 617308 - DNA, 25 bp, Homo sapien
attttacctgctgaaggtgcctagg

SEQ ID NO: 617309 - DNA, 25 bp, Homo sapien
gggtatacacctgctggattgtaat

SEQ ID NO: 617310 - DNA, 25 bp, Homo sapien
ggtgttttcaaaaactctccaatct

SEQ ID NO: 617311 - DNA, 25 bp, Homo sapien
tatctgattgctttccaccattacc

SEQ ID NO: 617312 - DNA, 25 bp, Homo sapien
gctttccaccattacctctgagaat

SEQ ID NO: 617313 - DNA, 25 bp, Homo sapien
gaataactttcccaaactctcactt

SEQ ID NO: 617314 - DNA, 25 bp, Homo sapien
aaagtgctttgcgattctaattctc

SEQ ID NO: 617315 - DNA, 25 bp, Homo sapien
aattctcttaaggtgcagggtgtgt

SEQ ID NO: 617316 - DNA, 25 bp, Homo sapien
gtgtattatctagacatactccatg

SEQ ID NO: 617317 - DNA, 25 bp, Homo sapien
ggggaaattggccaggtgcggtggg

SEQ ID NO: 617318 - DNA, 25 bp, Homo sapien
gggaaattggccaggtgcggtgggt

SEQ ID NO: 617319 - DNA, 25 bp, Homo sapien
ggaaattggccaggtgcggtgggtc

SEQ ID NO: 617320 - DNA, 25 bp, Homo sapien
gaaattggccaggtgcggtgggtca

SEQ ID NO: 617321 - DNA, 25 bp, Homo sapien
aaattggccaggtgcggtgggtcac

SEQ ID NO: 617322 - DNA, 25 bp, Homo sapien
aattggccaggtgcggtgggtcaca

SEQ ID NO: 617323 - DNA, 25 bp, Homo sapien
attggccaggtgcggtgggtcacac

SEQ ID NO: 617324 - DNA, 25 bp, Homo sapien
ttggccaggtgcggtgggtcacacc

SEQ ID NO: 617325 - DNA, 25 bp, Homo sapien
tggccaggtgcggtgggtcacacct

SEQ ID NO: 617326 - DNA, 25 bp, Homo sapien
gaaaaaggaaacaaccatgctgtag

SEQ ID NO: 617327 - DNA, 25 bp, Homo sapien
aaggaaacaaccatgctgtagtgat

SEQ ID NO: 617328 - DNA, 25 bp, Homo sapien
aggaaacaaccatgctgtagtgatg

SEQ ID NO: 617329 - DNA, 25 bp, Homo sapien
aaacaaccatgctgtagtgatggct

SEQ ID NO: 617330 - DNA, 25 bp, Homo sapien
caaccatgctgtagtgatggctgca

SEQ ID NO: 617331 - DNA, 25 bp, Homo sapien
gtgatggctgcaagaaattaaaata

SEQ ID NO: 617332 - DNA, 25 bp, Homo sapien
gcaagaaattaaaatagtgagccta

SEQ ID NO: 617333 - DNA, 25 bp, Homo sapien
agtgagcctatatagttagattgac

SEQ ID NO: 617334 - DNA, 25 bp, Homo sapien
gagcctatatagttagattgacagt

SEQ ID NO: 617335 - DNA, 25 bp, Homo sapien
gcctatatagttagattgacagttt

SEQ ID NO: 617336 - DNA, 25 bp, Homo sapien
tagttagattgacagttttgttttt

SEQ ID NO: 617337 - DNA, 25 bp, Homo sapien
atgtcattttccctttagagtctcc

SEQ ID NO: 617338 - DNA, 25 bp, Homo sapien
tccttctcatttgcatttaaacttg

SEQ ID NO: 617339 - DNA, 25 bp, Homo sapien
aaaaccctcactgaattctctgttg

SEQ ID NO: 617340 - DNA, 25 bp, Homo sapien
tgaattctctgttgctctccaactg

SEQ ID NO: 617341 - DNA, 25 bp, Homo sapien
ttgctctccaactgcaacttttctc

SEQ ID NO: 617342 - DNA, 25 bp, Homo sapien
aacttttctctttcattgccacact

SEQ ID NO: 617343 - DNA, 25 bp, Homo sapien
cattgccacacttcttacatattga

SEQ ID NO: 617344 - DNA, 25 bp, Homo sapien
cagaagcttactttctccattcttt

SEQ ID NO: 617345 - DNA, 25 bp, Homo sapien
ctccattctttgtatgttacctcta

SEQ ID NO: 617346 - DNA, 25 bp, Homo sapien
gttacctctatgtatctgaagttta

SEQ ID NO: 617347 - DNA, 25 bp, Homo sapien
aatgtttcgcgatcttttgtgacag

SEQ ID NO: 617348 - DNA, 25 bp, Homo sapien
tgctagcaatgtttattgtatttcc

SEQ ID NO: 617349 - DNA, 25 bp, Homo sapien
ttgtatttccttaagccacccaata

SEQ ID NO: 617350 - DNA, 25 bp, Homo sapien
gggaaaacacctattattcaaatgc

SEQ ID NO: 617351 - DNA, 25 bp, Homo sapien
ttcaaatgcacaagtgaggcagagt

SEQ ID NO: 617352 - DNA, 25 bp, Homo sapien
gcagagtataaatgtgacttggctc

SEQ ID NO: 617353 - DNA, 25 bp, Homo sapien
atgtgacttggctcattatcaccaa

SEQ ID NO: 617354 - DNA, 25 bp, Homo sapien
cattatcaccaagtttacttgcagg

SEQ ID NO: 617355 - DNA, 25 bp, Homo sapien
ccaagtttacttgcaggatcaaatt

SEQ ID NO: 617356 - DNA, 25 bp, Homo sapien
caggatcaaatttagaaccatggtt

SEQ ID NO: 617357 - DNA, 25 bp, Homo sapien
ttacacagtagtcatcagtctgcat

SEQ ID NO: 617358 - DNA, 25 bp, Homo sapien
gtcatcagtctgcatagttaaaaaa

SEQ ID NO: 617359 - DNA, 25 bp, Homo sapien
atatctaacagatgatgttcctgcc

SEQ ID NO: 617360 - DNA, 25 bp, Homo sapien
tgttcctgccatctagtcgcaaaat

SEQ ID NO: 617361 - DNA, 25 bp, Homo sapien
gtcgcaaaattgtcttaagggatta

SEQ ID NO: 617362 - DNA, 25 bp, Homo sapien
taagaaagtttgctacagtatttac

SEQ ID NO: 617363 - DNA, 25 bp, Homo sapien
acagtatttactgttttcaagccaa

SEQ ID NO: 617364 - DNA, 25 bp, Homo sapien
aacatgtttatttgggaccagaaca

SEQ ID NO: 617365 - DNA, 25 bp, Homo sapien
aacatggtccagtttgagttcttaa

SEQ ID NO: 617366 - DNA, 25 bp, Homo sapien
gtttgagttcttaagatctgctata

SEQ ID NO: 617367 - DNA, 25 bp, Homo sapien
agatctgctataactaactaactca

SEQ ID NO: 617368 - DNA, 25 bp, Homo sapien
actaactaactcagctgctagtatt

SEQ ID NO: 617369 - DNA, 25 bp, Homo sapien
agctgctagtatttcaagatgacat

SEQ ID NO: 617370 - DNA, 25 bp, Homo sapien
tcacagctttgtgtataattgcaaa

SEQ ID NO: 617371 - DNA, 25 bp, Homo sapien
atcaacatgaatgcccaaaatagtg

SEQ ID NO: 617372 - DNA, 25 bp, Homo sapien
taaacagattattacccatattatg

SEQ ID NO: 617373 - DNA, 25 bp, Homo sapien
cagattattacccatattatgaaga

SEQ ID NO: 617374 - DNA, 25 bp, Homo sapien
taaatgtaatgtgccaggcgcaatg

SEQ ID NO: 617375 - DNA, 25 bp, Homo sapien
tgtaatgtgccaggcgcaatgggat

SEQ ID NO: 617376 - DNA, 25 bp, Homo sapien
gtgccaggcgcaatgggatatgcct

SEQ ID NO: 617377 - DNA, 25 bp, Homo sapien
gcgcaatgggatatgcctgcaggcc

SEQ ID NO: 617378 - DNA, 25 bp, Homo sapien
aatgggatatgcctgcaggcccagc

SEQ ID NO: 617379 - DNA, 25 bp, Homo sapien
taaaagttatagacattcccaaaga

SEQ ID NO: 617380 - DNA, 25 bp, Homo sapien
agacattcccaaagatatacctgca

SEQ ID NO: 617381 - DNA, 25 bp, Homo sapien
gcctggctagcatggatatatgggt

SEQ ID NO: 617382 - DNA, 25 bp, Homo sapien
ctggctagcatggatatatgggtgt

SEQ ID NO: 617383 - DNA, 25 bp, Homo sapien
ggctagcatggatatatgggtgtat

SEQ ID NO: 617384 - DNA, 25 bp, Homo sapien
gctagcatggatatatgggtgtata

SEQ ID NO: 617385 - DNA, 25 bp, Homo sapien
atatatgggtgtatatcaccgtgcc

SEQ ID NO: 617386 - DNA, 25 bp, Homo sapien
tatatgggtgtatatcaccgtgcct

SEQ ID NO: 617387 - DNA, 25 bp, Homo sapien
atatgggtgtatatcaccgtgcctg

SEQ ID NO: 617388 - DNA, 25 bp, Homo sapien
tatgggtgtatatcaccgtgcctgg

SEQ ID NO: 617389 - DNA, 25 bp, Homo sapien
atgggtgtatatcaccgtgcctggc

SEQ ID NO: 617390 - DNA, 25 bp, Homo sapien
tgggtgtatatcaccgtgcctggct

SEQ ID NO: 617391 - DNA, 25 bp, Homo sapien
tgcccaggcctgtcttttgtaaaga

SEQ ID NO: 617392 - DNA, 25 bp, Homo sapien
acattaatagtctcactcattttag

SEQ ID NO: 617393 - DNA, 25 bp, Homo sapien
ctttacacttcataggatttccttt

SEQ ID NO: 617394 - DNA, 25 bp, Homo sapien
ttttcaccaaggtcttcccatgttt

SEQ ID NO: 617395 - DNA, 25 bp, Homo sapien
tttccaagttaattctctgatgttt

SEQ ID NO: 617396 - DNA, 25 bp, Homo sapien
gactcaatgatttcatccggagaca

SEQ ID NO: 617397 - DNA, 25 bp, Homo sapien
aagtgcataggcttcttacgccggg

SEQ ID NO: 617398 - DNA, 25 bp, Homo sapien
ttacgccgggtcaggcaaaggcaca

SEQ ID NO: 617399 - DNA, 25 bp, Homo sapien
ggcacagcttttgggtctaaggagc

SEQ ID NO: 617400 - DNA, 25 bp, Homo sapien
tgggtctaaggagctatgccattga

SEQ ID NO: 617401 - DNA, 25 bp, Homo sapien
aaaatgttgtagtgtttctgccaag

SEQ ID NO: 617402 - DNA, 25 bp, Homo sapien
gtttctgccaagttcatcattttca

SEQ ID NO: 617403 - DNA, 25 bp, Homo sapien
agccatgcgcgataataaaattgtg

SEQ ID NO: 617404 - DNA, 25 bp, Homo sapien
ccatgcgcgataataaaattgtgtt

SEQ ID NO: 617405 - DNA, 25 bp, Homo sapien
cagagtttcactccgtcactcaggt

SEQ ID NO: 617406 - DNA, 25 bp, Homo sapien
gtttcactccgtcactcaggttgga

SEQ ID NO: 617407 - DNA, 25 bp, Homo sapien
cctctgcccccaagttgaaacaagt

SEQ ID NO: 617408 - DNA, 25 bp, Homo sapien
ccaagttgaaacaagtctcatgcct

SEQ ID NO: 617409 - DNA, 25 bp, Homo sapien
aagttgaaacaagtctcatgcctca

SEQ ID NO: 617410 - DNA, 25 bp, Homo sapien
agttgaaacaagtctcatgcctcag

SEQ ID NO: 617411 - DNA, 25 bp, Homo sapien
gttgaaacaagtctcatgcctcagt

SEQ ID NO: 617412 - DNA, 25 bp, Homo sapien
ttgaaacaagtctcatgcctcagtc

SEQ ID NO: 617413 - DNA, 25 bp, Homo sapien
tgaaacaagtctcatgcctcagtct

SEQ ID NO: 617414 - DNA, 25 bp, Homo sapien
tatgtggtaacccaaaacagtaaca

SEQ ID NO: 617415 - DNA, 25 bp, Homo sapien
cttggtgacctaaataactgtatat

SEQ ID NO: 617416 - DNA, 25 bp, Homo sapien
aataatgtcatctgatatggaaaca

SEQ ID NO: 617417 - DNA, 25 bp, Homo sapien
tatggaaacatgtaaccgaaaactt

SEQ ID NO: 617418 - DNA, 25 bp, Homo sapien
gatagtacccatgaataatgtttaa

SEQ ID NO: 617419 - DNA, 25 bp, Homo sapien
atgctgtggttttttgtggattttt

SEQ ID NO: 617420 - DNA, 25 bp, Homo sapien
ggaatatttttctcactgctgcact

SEQ ID NO: 617421 - DNA, 25 bp, Homo sapien
tgcactctcttgtcatctagctctg

SEQ ID NO: 617422 - DNA, 25 bp, Homo sapien
tcttgtcatctagctctgccaaatt

SEQ ID NO: 617423 - DNA, 25 bp, Homo sapien
gtcatctagctctgccaaatttttg

SEQ ID NO: 617424 - DNA, 25 bp, Homo sapien
agctctgccaaatttttggctatta

SEQ ID NO: 617425 - DNA, 25 bp, Homo sapien
tcctcaaggagggttcatgacatat

SEQ ID NO: 617426 - DNA, 25 bp, Homo sapien
catgacatattcatttccttcatat

SEQ ID NO: 617427 - DNA, 25 bp, Homo sapien
taatgtgaaacataccaggacagaa

SEQ ID NO: 617428 - DNA, 25 bp, Homo sapien
gtaatgagtgctgcttccttcattt

SEQ ID NO: 617429 - DNA, 25 bp, Homo sapien
ttccttcattttgcctcctctggat

SEQ ID NO: 617430 - DNA, 25 bp, Homo sapien
attttgcctcctctggattccacaa

SEQ ID NO: 617431 - DNA, 25 bp, Homo sapien
ggattccacaatgttgattgtagtt

SEQ ID NO: 617432 - DNA, 25 bp, Homo sapien
gattgtagttggaatctatctctaa

SEQ ID NO: 617433 - DNA, 25 bp, Homo sapien
ggaatctatctctaatgacacttga

SEQ ID NO: 617434 - DNA, 25 bp, Homo sapien
agagttctttaagctcagtggtttt

SEQ ID NO: 617435 - DNA, 25 bp, Homo sapien
agctcagtggttttgaaggcaagaa

SEQ ID NO: 617436 - DNA, 25 bp, Homo sapien
gaaaaaggaaacaaccatgctgtag

SEQ ID NO: 617437 - DNA, 25 bp, Homo sapien
aaggaaacaaccatgctgtagtgat

SEQ ID NO: 617438 - DNA, 25 bp, Homo sapien
aaacaaccatgctgtagtgatggct

SEQ ID NO: 617439 - DNA, 25 bp, Homo sapien
caaccatgctgtagtgatggctgca

SEQ ID NO: 617440 - DNA, 25 bp, Homo sapien
catgctgtagtgatggctgcaagaa

SEQ ID NO: 617441 - DNA, 25 bp, Homo sapien
gtgatggctgcaagaaattaaaata

SEQ ID NO: 617442 - DNA, 25 bp, Homo sapien
gcaagaaattaaaatagtgagccta

SEQ ID NO: 617443 - DNA, 25 bp, Homo sapien
agtgagcctatatagttagattgac

SEQ ID NO: 617444 - DNA, 25 bp, Homo sapien
gagcctatatagttagattgacagt

SEQ ID NO: 617445 - DNA, 25 bp, Homo sapien
tatagttagattgacagttttgttt

SEQ ID NO: 617446 - DNA, 25 bp, Homo sapien
aaaaaatccaatcctggctgggcgc

SEQ ID NO: 617447 - DNA, 25 bp, Homo sapien
aatcttaattttcttaccatataat

SEQ ID NO: 617448 - DNA, 25 bp, Homo sapien
atataattgatttctaaagcagcag

SEQ ID NO: 617449 - DNA, 25 bp, Homo sapien
gcagcagcaatagtgttcttttaga

SEQ ID NO: 617450 - DNA, 25 bp, Homo sapien
aaaccctgagttacaaataccacag

SEQ ID NO: 617451 - DNA, 25 bp, Homo sapien
agttacaaataccacagtctccggg

SEQ ID NO: 617452 - DNA, 25 bp, Homo sapien
gggagacattcattttcagatgaag

SEQ ID NO: 617453 - DNA, 25 bp, Homo sapien
tgaagacagggcttgagtcactttc

SEQ ID NO: 617454 - DNA, 25 bp, Homo sapien
acagggcttgagtcactttcgaatt

SEQ ID NO: 617455 - DNA, 25 bp, Homo sapien
gggcttgagtcactttcgaattaga

SEQ ID NO: 617456 - DNA, 25 bp, Homo sapien
tcgaattagagtgttctgctgttct

SEQ ID NO: 617457 - DNA, 25 bp, Homo sapien
gtgttctgctgttctagaaggcaat

SEQ ID NO: 617458 - DNA, 25 bp, Homo sapien
tttatctacctttttaagatactcg

SEQ ID NO: 617459 - DNA, 25 bp, Homo sapien
ttatctacctttttaagatactcgg

SEQ ID NO: 617460 - DNA, 25 bp, Homo sapien
tatctacctttttaagatactcggc

SEQ ID NO: 617461 - DNA, 25 bp, Homo sapien
tctacctttttaagatactcggccg

SEQ ID NO: 617462 - DNA, 25 bp, Homo sapien
cctttttaagatactcggccggatg

SEQ ID NO: 617463 - DNA, 25 bp, Homo sapien
ctttttaagatactcggccggatgc

SEQ ID NO: 617464 - DNA, 25 bp, Homo sapien
tttttaagatactcggccggatgca

SEQ ID NO: 617465 - DNA, 25 bp, Homo sapien
ttttaagatactcggccggatgcag

SEQ ID NO: 617466 - DNA, 25 bp, Homo sapien
tttaagatactcggccggatgcagt

SEQ ID NO: 617467 - DNA, 25 bp, Homo sapien
ttaagatactcggccggatgcagtg

SEQ ID NO: 617468 - DNA, 25 bp, Homo sapien
taagatactcggccggatgcagtgg

SEQ ID NO: 617469 - DNA, 25 bp, Homo sapien
ataaagtggctgtacttcccagatt

SEQ ID NO: 617470 - DNA, 25 bp, Homo sapien
tacttcccagatttcattgtgcggc

SEQ ID NO: 617471 - DNA, 25 bp, Homo sapien
agatttcattgtgcggcccaaccct

SEQ ID NO: 617472 - DNA, 25 bp, Homo sapien
aaccctgtgtttctcgtctatgact

SEQ ID NO: 617473 - DNA, 25 bp, Homo sapien
cgtctatgacttcatgctgcttctg

SEQ ID NO: 617474 - DNA, 25 bp, Homo sapien
tgtgcctccttacaacggcagattt

SEQ ID NO: 617475 - DNA, 25 bp, Homo sapien
agaacaaggctgcagtgcgaatcat

SEQ ID NO: 617476 - DNA, 25 bp, Homo sapien
atcatggcaggtgacaatgtcgaga

SEQ ID NO: 617477 - DNA, 25 bp, Homo sapien
gacaatgtcgagatctgcatgaatc

SEQ ID NO: 617478 - DNA, 25 bp, Homo sapien
atgaatcttgatgcggcctccttca

SEQ ID NO: 617479 - DNA, 25 bp, Homo sapien
ttcagccaacataaccctggtgcca

SEQ ID NO: 617480 - DNA, 25 bp, Homo sapien
ggccgcttccactggtttggagaca

SEQ ID NO: 617481 - DNA, 25 bp, Homo sapien
cactggtttggagacacaggcattt

SEQ ID NO: 617482 - DNA, 25 bp, Homo sapien
gagcgatgacatcaactccatcatg

SEQ ID NO: 617483 - DNA, 25 bp, Homo sapien
tggaaaaggctctcaactactccca

SEQ ID NO: 617484 - DNA, 25 bp, Homo sapien
actactcccaaaagtgtgccttcct

SEQ ID NO: 617485 - DNA, 25 bp, Homo sapien
atggcctccctgaagaaccattcag

SEQ ID NO: 617486 - DNA, 25 bp, Homo sapien
tactgggaagttcagccctcccgaa

SEQ ID NO: 617487 - DNA, 25 bp, Homo sapien
gacacttcagctaagaagtcagccc

SEQ ID NO: 617488 - DNA, 25 bp, Homo sapien
gaagtcagcccaagaagctttgccc

SEQ ID NO: 617489 - DNA, 25 bp, Homo sapien
gggccagaatggtttgactcccctc

SEQ ID NO: 617490 - DNA, 25 bp, Homo sapien
tcccctcctaataacacgcagaaga

SEQ ID NO: 617491 - DNA, 25 bp, Homo sapien
acagggctgtgtctctccttaggct

SEQ ID NO: 617492 - DNA, 25 bp, Homo sapien
tgaggacagggctgtgtctcccctc

SEQ ID NO: 617493 - DNA, 25 bp, Homo sapien
gggctccttgaggatgggacacttt

SEQ ID NO: 617494 - DNA, 25 bp, Homo sapien
gctccttgaggatgggacactttaa

SEQ ID NO: 617495 - DNA, 25 bp, Homo sapien
cttgaggatgggacactttaaagaa

SEQ ID NO: 617496 - DNA, 25 bp, Homo sapien
gaagagaaattgacaggttgaccct

SEQ ID NO: 617497 - DNA, 25 bp, Homo sapien
gggatctttgggtcaataaaacatt

SEQ ID NO: 617498 - DNA, 25 bp, Homo sapien
taaaacattctatagaccctcagtg

SEQ ID NO: 617499 - DNA, 25 bp, Homo sapien
attctatagaccctcagtggtcaga

SEQ ID NO: 617500 - DNA, 25 bp, Homo sapien
atagaccctcagtggtcagactagg

SEQ ID NO: 617501 - DNA, 25 bp, Homo sapien
accctcagtggtcagactaggaaaa

SEQ ID NO: 617502 - DNA, 25 bp, Homo sapien
ttttctttaaagcatctctgatgta

SEQ ID NO: 617503 - DNA, 25 bp, Homo sapien
gcatctctgatgtagaaaagttaaa

SEQ ID NO: 617504 - DNA, 25 bp, Homo sapien
atcactgaattaggatgtctagggt

SEQ ID NO: 617505 - DNA, 25 bp, Homo sapien
tctagggtagggtagatccagactt

SEQ ID NO: 617506 - DNA, 25 bp, Homo sapien
atccagacttgggactagttaactc

SEQ ID NO: 617507 - DNA, 25 bp, Homo sapien
gggactagttaactctatttgcctt

SEQ ID NO: 617508 - DNA, 25 bp, Homo sapien
gttaactctatttgcctttatttca

SEQ ID NO: 617509 - DNA, 25 bp, Homo sapien
actctatttgcctttatttcagaat

SEQ ID NO: 617510 - DNA, 25 bp, Homo sapien
tttcagaatacaaagtggcctgcat

SEQ ID NO: 617511 - DNA, 25 bp, Homo sapien
agtggcctgcataattatgtcattt

SEQ ID NO: 617512 - DNA, 25 bp, Homo sapien
ataattatgtcatttgtctttcaga

SEQ ID NO: 617513 - DNA, 25 bp, Homo sapien
gtacatgcatcagcaaaacccaaaa

SEQ ID NO: 617514 - DNA, 25 bp, Homo sapien
tacatgcatcagcaaaacccaaaac

SEQ ID NO: 617515 - DNA, 25 bp, Homo sapien
atcagcaaaacccaaaaccctatca

SEQ ID NO: 617516 - DNA, 25 bp, Homo sapien
tcagcaaaacccaaaaccctatcaa

SEQ ID NO: 617517 - DNA, 25 bp, Homo sapien
tcaagatagagaatgtgcccgggcg

SEQ ID NO: 617518 - DNA, 25 bp, Homo sapien
caagatagagaatgtgcccgggcgt

SEQ ID NO: 617519 - DNA, 25 bp, Homo sapien
aagatagagaatgtgcccgggcgtg

SEQ ID NO: 617520 - DNA, 25 bp, Homo sapien
agatagagaatgtgcccgggcgtgg

SEQ ID NO: 617521 - DNA, 25 bp, Homo sapien
gatagagaatgtgcccgggcgtggt

SEQ ID NO: 617522 - DNA, 25 bp, Homo sapien
tagagaatgtgcccgggcgtggtgg

SEQ ID NO: 617523 - DNA, 25 bp, Homo sapien
gagaatgtgcccgggcgtggtggct

SEQ ID NO: 617524 - DNA, 25 bp, Homo sapien
tataactagatcagagggaatccag

SEQ ID NO: 617525 - DNA, 25 bp, Homo sapien
aactagatcagagggaatccagaga

SEQ ID NO: 617526 - DNA, 25 bp, Homo sapien
gatcagagggaatccagagaatgga

SEQ ID NO: 617527 - DNA, 25 bp, Homo sapien
cagagaatggagtttttagacacga

SEQ ID NO: 617528 - DNA, 25 bp, Homo sapien
gagaatggagtttttagacacgaat

SEQ ID NO: 617529 - DNA, 25 bp, Homo sapien
gaatggagtttttagacacgaattt

SEQ ID NO: 617530 - DNA, 25 bp, Homo sapien
gattgagaattttggaggataaacc

SEQ ID NO: 617531 - DNA, 25 bp, Homo sapien
ggaggataaaccaaacattctaata

SEQ ID NO: 617532 - DNA, 25 bp, Homo sapien
gaggataaaccaaacattctaataa

SEQ ID NO: 617533 - DNA, 25 bp, Homo sapien
gaaattaagaactcggtgggtggat

SEQ ID NO: 617534 - DNA, 25 bp, Homo sapien
aagagagactaagtgaacagcaaca

SEQ ID NO: 617535 - DNA, 25 bp, Homo sapien
gtactcacctatttggtttacccag

SEQ ID NO: 617536 - DNA, 25 bp, Homo sapien
tcacctatttggtttacccagttgg

SEQ ID NO: 617537 - DNA, 25 bp, Homo sapien
cagtaattgagagtgcaggcttgaa

SEQ ID NO: 617538 - DNA, 25 bp, Homo sapien
aattgagagtgcaggcttgaaggca

SEQ ID NO: 617539 - DNA, 25 bp, Homo sapien
gtactgaacactatatatactaggt

SEQ ID NO: 617540 - DNA, 25 bp, Homo sapien
tacatacatacatacgtacctaaga

SEQ ID NO: 617541 - DNA, 25 bp, Homo sapien
tacatacgtacctaagataaaattt

SEQ ID NO: 617542 - DNA, 25 bp, Homo sapien
ttatgcagaataagagactaacaat

SEQ ID NO: 617543 - DNA, 25 bp, Homo sapien
gaatgattataacaatatgctgtaa

SEQ ID NO: 617544 - DNA, 25 bp, Homo sapien
gctgtaatagaagtcatgcaaatgt

SEQ ID NO: 617545 - DNA, 25 bp, Homo sapien
gtcatgcaaatgtgcatctctctct

SEQ ID NO: 617546 - DNA, 25 bp, Homo sapien
agagaccagagaaggcctaggctat

SEQ ID NO: 617547 - DNA, 25 bp, Homo sapien
agagaaggcctaggctatccacaca

SEQ ID NO: 617548 - DNA, 25 bp, Homo sapien
taggctatccacacatctctggcta

SEQ ID NO: 617549 - DNA, 25 bp, Homo sapien
atctctggctaacccaggctgtaaa

SEQ ID NO: 617550 - DNA, 25 bp, Homo sapien
ggctaacccaggctgtaaacctgtg

SEQ ID NO: 617551 - DNA, 25 bp, Homo sapien
cacaagaggtggattgattgctaat

SEQ ID NO: 617552 - DNA, 25 bp, Homo sapien
ggatcttactggttgataggaacat

SEQ ID NO: 617553 - DNA, 25 bp, Homo sapien
ataggaacattctcaaattggattg

SEQ ID NO: 617554 - DNA, 25 bp, Homo sapien
caaattggattgtggtgatgcttgc

SEQ ID NO: 617555 - DNA, 25 bp, Homo sapien
tgcttgcacaactctaagtttatcc

SEQ ID NO: 617556 - DNA, 25 bp, Homo sapien
acaactctaagtttatcccaaattg

SEQ ID NO: 617557 - DNA, 25 bp, Homo sapien
tttgatgctatgtgacttgccttta

SEQ ID NO: 617558 - DNA, 25 bp, Homo sapien
tgatgctatgtgacttgcctttaat

SEQ ID NO: 617559 - DNA, 25 bp, Homo sapien
gatgctatgtgacttgcctttaata

SEQ ID NO: 617560 - DNA, 25 bp, Homo sapien
atgctatgtgacttgcctttaatat

SEQ ID NO: 617561 - DNA, 25 bp, Homo sapien
gctatgtgacttgcctttaatatta

SEQ ID NO: 617562 - DNA, 25 bp, Homo sapien
gtgacttgcctttaatattacataa

SEQ ID NO: 617563 - DNA, 25 bp, Homo sapien
attacataatggaatggctgttcac

SEQ ID NO: 617564 - DNA, 25 bp, Homo sapien
tacataatggaatggctgttcactt

SEQ ID NO: 617565 - DNA, 25 bp, Homo sapien
taatggaatggctgttcacttgatt

SEQ ID NO: 617566 - DNA, 25 bp, Homo sapien
atggaatggctgttcacttgattag

SEQ ID NO: 617567 - DNA, 25 bp, Homo sapien
ggaatggctgttcacttgattagtt

SEQ ID NO: 617568 - DNA, 25 bp, Homo sapien
ctgtgtctctccttaggctggggtc

SEQ ID NO: 617569 - DNA, 25 bp, Homo sapien
gggctccttgaggatgggacacttt

SEQ ID NO: 617570 - DNA, 25 bp, Homo sapien
gctccttgaggatgggacactttaa

SEQ ID NO: 617571 - DNA, 25 bp, Homo sapien
cttgaggatgggacactttaaagaa

SEQ ID NO: 617572 - DNA, 25 bp, Homo sapien
taaaacattctatagaccctcagtg

SEQ ID NO: 617573 - DNA, 25 bp, Homo sapien
attctatagaccctcagtggtcaga

SEQ ID NO: 617574 - DNA, 25 bp, Homo sapien
tctatagaccctcagtggtcagact

SEQ ID NO: 617575 - DNA, 25 bp, Homo sapien
atagaccctcagtggtcagactagg

SEQ ID NO: 617576 - DNA, 25 bp, Homo sapien
agaccctcagtggtcagactaggaa

SEQ ID NO: 617577 - DNA, 25 bp, Homo sapien
accctcagtggtcagactaggaaaa

SEQ ID NO: 617578 - DNA, 25 bp, Homo sapien
cctcagtggtcagactaggaaaaaa

SEQ ID NO: 617579 - DNA, 25 bp, Homo sapien
gaacatgaccaagtacgtatccaag

SEQ ID NO: 617580 - DNA, 25 bp, Homo sapien
gaccaagtacgtatccaagctggaa

SEQ ID NO: 617581 - DNA, 25 bp, Homo sapien
gtatccaagctggaagagcccgctg

SEQ ID NO: 617582 - DNA, 25 bp, Homo sapien
ccaagctggaagagcccgctgggaa

SEQ ID NO: 617583 - DNA, 25 bp, Homo sapien
ggtggctaagccaaagggacctcca

SEQ ID NO: 617584 - DNA, 25 bp, Homo sapien
ggctaagccaaagggacctccagtg

SEQ ID NO: 617585 - DNA, 25 bp, Homo sapien
gggacctccagtgcaaaagaagaaa

SEQ ID NO: 617586 - DNA, 25 bp, Homo sapien
agtcaaggaagaactttagcttctc

SEQ ID NO: 617587 - DNA, 25 bp, Homo sapien
ggcatcattttctgaatggattgat

SEQ ID NO: 617588 - DNA, 25 bp, Homo sapien
taaaagcatatatcattgtggtagg

SEQ ID NO: 617589 - DNA, 25 bp, Homo sapien
gtggataataaagcctctgagtgtc

SEQ ID NO: 617590 - DNA, 25 bp, Homo sapien
gtatgtactctaaaactgaaggttc

SEQ ID NO: 617591 - DNA, 25 bp, Homo sapien
gttcttagacgtgaccttattgtac

SEQ ID NO: 617592 - DNA, 25 bp, Homo sapien
gtgaccttattgtacatgtctcaga

SEQ ID NO: 617593 - DNA, 25 bp, Homo sapien
tctagctgttgtccatatgtgatag

SEQ ID NO: 617594 - DNA, 25 bp, Homo sapien
gtccatatgtgatagctgagaacct

SEQ ID NO: 617595 - DNA, 25 bp, Homo sapien
gagaacctatcactgcagaaagcta

SEQ ID NO: 617596 - DNA, 25 bp, Homo sapien
attaccattaaaattgaatcctcca

SEQ ID NO: 617597 - DNA, 25 bp, Homo sapien
atgattacctgggtccccgaagcat

SEQ ID NO: 617598 - DNA, 25 bp, Homo sapien
ggtccccgaagcattgttttattca

SEQ ID NO: 617599 - DNA, 25 bp, Homo sapien
tagtttgtaaccttgtttggctgaa

SEQ ID NO: 617600 - DNA, 25 bp, Homo sapien
tgtaaccttgtttggctgaaatcag

SEQ ID NO: 617601 - DNA, 25 bp, Homo sapien
gagagaaatcgagaggtgccctaca

SEQ ID NO: 617602 - DNA, 25 bp, Homo sapien
agcagccaggcctatcaggatccgt

SEQ ID NO: 617603 - DNA, 25 bp, Homo sapien
tatcaggatccgtcacacacggcag

SEQ ID NO: 617604 - DNA, 25 bp, Homo sapien
gacaccggcctgatgcagagcgtga

SEQ ID NO: 617605 - DNA, 25 bp, Homo sapien
tcctgctgggacctgtgttgtaagc

SEQ ID NO: 617606 - DNA, 25 bp, Homo sapien
gtaagctcctatttgcttatcttgt

SEQ ID NO: 617607 - DNA, 25 bp, Homo sapien
gcttatcttgtttatttcaagcaga

SEQ ID NO: 617608 - DNA, 25 bp, Homo sapien
ataaattccataaccctctgtattg

SEQ ID NO: 617609 - DNA, 25 bp, Homo sapien
ataaccctctgtattgactgcaatg

SEQ ID NO: 617610 - DNA, 25 bp, Homo sapien
taagctgctgaggagactggttctg

SEQ ID NO: 617611 - DNA, 25 bp, Homo sapien
ctggttctgttggtcagtcaggtgt

SEQ ID NO: 617612 - DNA, 25 bp, Homo sapien
gtgcccggcccttttcctgatagtt

SEQ ID NO: 617613 - DNA, 25 bp, Homo sapien
tgcccggcccttttcctgatagttc

SEQ ID NO: 617614 - DNA, 25 bp, Homo sapien
gcccggcccttttcctgatagttct

SEQ ID NO: 617615 - DNA, 25 bp, Homo sapien
ttttcctgatagttctttaacaacg

SEQ ID NO: 617616 - DNA, 25 bp, Homo sapien
tttcctgatagttctttaacaacgt

SEQ ID NO: 617617 - DNA, 25 bp, Homo sapien
ttcctgatagttctttaacaacgtt

SEQ ID NO: 617618 - DNA, 25 bp, Homo sapien
tcctgatagttctttaacaacgtta

SEQ ID NO: 617619 - DNA, 25 bp, Homo sapien
acaacgttaacttatgtaatcagag

SEQ ID NO: 617620 - DNA, 25 bp, Homo sapien
caacgttaacttatgtaatcagaga

SEQ ID NO: 617621 - DNA, 25 bp, Homo sapien
cgttaacttatgtaatcagagatca

SEQ ID NO: 617622 - DNA, 25 bp, Homo sapien
taacttatgtaatcagagatcaagc

SEQ ID NO: 617623 - DNA, 25 bp, Homo sapien
gaatttcccaggctatgaaggactg

SEQ ID NO: 617624 - DNA, 25 bp, Homo sapien
tatgaaggactggtcggccaacccg

SEQ ID NO: 617625 - DNA, 25 bp, Homo sapien
tcggccaacccgctgtttgaaagaa

SEQ ID NO: 617626 - DNA, 25 bp, Homo sapien
ggatggaagaattgccaacctcaac

SEQ ID NO: 617627 - DNA, 25 bp, Homo sapien
gaattgccaacctcaacaagcgcta

SEQ ID NO: 617628 - DNA, 25 bp, Homo sapien
caagcgctacgcagcagtcagggat

SEQ ID NO: 617629 - DNA, 25 bp, Homo sapien
atgctggagtgaagatccaagccat

SEQ ID NO: 617630 - DNA, 25 bp, Homo sapien
agatccaagccatggttgcagtaag

SEQ ID NO: 617631 - DNA, 25 bp, Homo sapien
atggttgcagtaaggaaacacccag

SEQ ID NO: 617632 - DNA, 25 bp, Homo sapien
gaggttttttgagaacccacttgct

SEQ ID NO: 617633 - DNA, 25 bp, Homo sapien
aaacccagggctggagatttcataa

SEQ ID NO: 617634 - DNA, 25 bp, Homo sapien
tggagggcaacggtacgatctcgac

SEQ ID NO: 617635 - DNA, 25 bp, Homo sapien
ggagggcaacggtacgatctcgaca

SEQ ID NO: 617636 - DNA, 25 bp, Homo sapien
gagggcaacggtacgatctcgacac

SEQ ID NO: 617637 - DNA, 25 bp, Homo sapien
agggcaacggtacgatctcgacaca

SEQ ID NO: 617638 - DNA, 25 bp, Homo sapien
gggcaacggtacgatctcgacacac

SEQ ID NO: 617639 - DNA, 25 bp, Homo sapien
ggcaacggtacgatctcgacacact

SEQ ID NO: 617640 - DNA, 25 bp, Homo sapien
gcaacggtacgatctcgacacactg

SEQ ID NO: 617641 - DNA, 25 bp, Homo sapien
caacggtacgatctcgacacactgc

SEQ ID NO: 617642 - DNA, 25 bp, Homo sapien
aacggtacgatctcgacacactgca

SEQ ID NO: 617643 - DNA, 25 bp, Homo sapien
acggtacgatctcgacacactgcaa

SEQ ID NO: 617644 - DNA, 25 bp, Homo sapien
gaggcaggagatggtttgaacaggg

SEQ ID NO: 617645 - DNA, 25 bp, Homo sapien
gattaagtaatttgtcacacagcta

SEQ ID NO: 617646 - DNA, 25 bp, Homo sapien
atggcagagcagaaattcacattca

SEQ ID NO: 617647 - DNA, 25 bp, Homo sapien
attcacattcaagcagtctggtttc

SEQ ID NO: 617648 - DNA, 25 bp, Homo sapien
caagcagtctggtttcagaatctgt

SEQ ID NO: 617649 - DNA, 25 bp, Homo sapien
tcagaatctgtgcttgttacaaaag

SEQ ID NO: 617650 - DNA, 25 bp, Homo sapien
gaacagtgctgtgacagagagtact

SEQ ID NO: 617651 - DNA, 25 bp, Homo sapien
aattttctgtgttgagggatactac

SEQ ID NO: 617652 - DNA, 25 bp, Homo sapien
gagggatactactttaaaggcaaca

SEQ ID NO: 617653 - DNA, 25 bp, Homo sapien
ttaaaggcaacatctgagcagagca

SEQ ID NO: 617654 - DNA, 25 bp, Homo sapien
tctgagcagagcactgagggatgca

SEQ ID NO: 617655 - DNA, 25 bp, Homo sapien
agggatgcaaagaagccagttaggt

SEQ ID NO: 617656 - DNA, 25 bp, Homo sapien
tgcccggcccggagaacatgatctt

SEQ ID NO: 617657 - DNA, 25 bp, Homo sapien
ggcccggagaacatgatcttaacca

SEQ ID NO: 617658 - DNA, 25 bp, Homo sapien
gaacatgatcttaaccatactgtct

SEQ ID NO: 617659 - DNA, 25 bp, Homo sapien
accatactgtcttccaagtgaaaga

SEQ ID NO: 617660 - DNA, 25 bp, Homo sapien
gtcttccaagtgaaagattctacct

SEQ ID NO: 617661 - DNA, 25 bp, Homo sapien
tctacctttctaagacatctggagt

SEQ ID NO: 617662 - DNA, 25 bp, Homo sapien
ttctaagacatctggagtcagacag

SEQ ID NO: 617663 - DNA, 25 bp, Homo sapien
ctgagttcaagtcgtgccttcctcc

SEQ ID NO: 617664 - DNA, 25 bp, Homo sapien
tccccactttactgaaccttcagtg

SEQ ID NO: 617665 - DNA, 25 bp, Homo sapien
cagtgagtctttctacctcagaagg

SEQ ID NO: 617666 - DNA, 25 bp, Homo sapien
gagtctttctacctcagaaggctgt

SEQ ID NO: 617667 - DNA, 25 bp, Homo sapien
tagtgtacaacagatggacatccat

SEQ ID NO: 617668 - DNA, 25 bp, Homo sapien
cagatggacatccatttctcaattc

SEQ ID NO: 617669 - DNA, 25 bp, Homo sapien
attaccttcatgtttcacataagaa

SEQ ID NO: 617670 - DNA, 25 bp, Homo sapien
ataactcatctaaggctacacacgt

SEQ ID NO: 617671 - DNA, 25 bp, Homo sapien
gctacacacgtaataagtgccagga

SEQ ID NO: 617672 - DNA, 25 bp, Homo sapien
gtagtcaacttcagaatcctcaact

SEQ ID NO: 617673 - DNA, 25 bp, Homo sapien
acttcagaatcctcaactgtcatcc

SEQ ID NO: 617674 - DNA, 25 bp, Homo sapien
actaccctcctgatacactggtgat

SEQ ID NO: 617675 - DNA, 25 bp, Homo sapien
gatacactggtgatctagactaatg

SEQ ID NO: 617676 - DNA, 25 bp, Homo sapien
gatctagactaatgaaaggacctta

SEQ ID NO: 617677 - DNA, 25 bp, Homo sapien
aaggaccttataccacttactcaag

SEQ ID NO: 617678 - DNA, 25 bp, Homo sapien
accacacccggcagcaaatatttat

SEQ ID NO: 617679 - DNA, 25 bp, Homo sapien
tgtgtgccccaagctgttctaggtg

SEQ ID NO: 617680 - DNA, 25 bp, Homo sapien
tgttctaggtgctataaatgggcca

SEQ ID NO: 617681 - DNA, 25 bp, Homo sapien
ctaggtgctataaatgggccagaca

SEQ ID NO: 617682 - DNA, 25 bp, Homo sapien
ataaatgggccagacaagctgtcag

SEQ ID NO: 617683 - DNA, 25 bp, Homo sapien
aatgggccagacaagctgtcaggga

SEQ ID NO: 617684 - DNA, 25 bp, Homo sapien
gacaagctgtcagggaggttgccct

SEQ ID NO: 617685 - DNA, 25 bp, Homo sapien
gttgccctggctgggaagacagaca

SEQ ID NO: 617686 - DNA, 25 bp, Homo sapien
gacatcagacaacataattccagag

SEQ ID NO: 617687 - DNA, 25 bp, Homo sapien
agacaacataattccagagctggat

SEQ ID NO: 617688 - DNA, 25 bp, Homo sapien
cagagctggataaatactagggaga

SEQ ID NO: 617689 - DNA, 25 bp, Homo sapien
gataaagtcttctcttcctttctgt

SEQ ID NO: 617690 - DNA, 25 bp, Homo sapien
tctgtcagagttttacctttggcct

SEQ ID NO: 617691 - DNA, 25 bp, Homo sapien
acctttggcctattctggactgcaa

SEQ ID NO: 617692 - DNA, 25 bp, Homo sapien
ttgccaagcacttcccttaaataac

SEQ ID NO: 617693 - DNA, 25 bp, Homo sapien
aataacttctcttttttgcaggact

SEQ ID NO: 617694 - DNA, 25 bp, Homo sapien
ttttttgcaggactatcctctcagc

SEQ ID NO: 617695 - DNA, 25 bp, Homo sapien
tactctttctttactactttgccta

SEQ ID NO: 617696 - DNA, 25 bp, Homo sapien
ctactttgcctatttaatgctggaa

SEQ ID NO: 617697 - DNA, 25 bp, Homo sapien
agtgctttcatgctgtagatctcct

SEQ ID NO: 617698 - DNA, 25 bp, Homo sapien
atgctgtagatctcctgctagacta

SEQ ID NO: 617699 - DNA, 25 bp, Homo sapien
gactacaggctgtacttgggagtga

SEQ ID NO: 617700 - DNA, 25 bp, Homo sapien
agtgttatgaaaggcacgtagtata

SEQ ID NO: 617701 - DNA, 25 bp, Homo sapien
gtagtatatagagcccaaagccctg

SEQ ID NO: 617702 - DNA, 25 bp, Homo sapien
caaagccctgggattgcaccctgac

SEQ ID NO: 617703 - DNA, 25 bp, Homo sapien
tgggattgcaccctgacactggcat

SEQ ID NO: 617704 - DNA, 25 bp, Homo sapien
ttagcagcagtggaaccgcgagcaa

SEQ ID NO: 617705 - DNA, 25 bp, Homo sapien
agtggaaccgcgagcaagtcccttc

SEQ ID NO: 617706 - DNA, 25 bp, Homo sapien
agcaagtcccttccttttagagcgt

SEQ ID NO: 617707 - DNA, 25 bp, Homo sapien
tccttttagagcgtgtttcctgtta

SEQ ID NO: 617708 - DNA, 25 bp, Homo sapien
atcataaacaccgatcctttgtcct

SEQ ID NO: 617709 - DNA, 25 bp, Homo sapien
caagctgactttagagttgtcaaca

SEQ ID NO: 617710 - DNA, 25 bp, Homo sapien
gcaaaaattcactgaaccctccttt

SEQ ID NO: 617711 - DNA, 25 bp, Homo sapien
ctggtgttccaaggcagaaggcatt

SEQ ID NO: 617712 - DNA, 25 bp, Homo sapien
gcattcatgtcttcagggatgaccg

SEQ ID NO: 617713 - DNA, 25 bp, Homo sapien
atgtcttcagggatgaccgcccttg

SEQ ID NO: 617714 - DNA, 25 bp, Homo sapien
gggatgaccgcccttgcttcaactc

SEQ ID NO: 617715 - DNA, 25 bp, Homo sapien
gggggcatagtctttttgcaatcac

SEQ ID NO: 617716 - DNA, 25 bp, Homo sapien
ttgcaatcacaattctaggagccag

SEQ ID NO: 617717 - DNA, 25 bp, Homo sapien
aattctaggagccagttgaccccag

SEQ ID NO: 617718 - DNA, 25 bp, Homo sapien
tctaggagccagttgaccccagcag

SEQ ID NO: 617719 - DNA, 25 bp, Homo sapien
agcccctcgctagttgctctggaga

SEQ ID NO: 617720 - DNA, 25 bp, Homo sapien
atcagtgccccttcctaaacatcag

SEQ ID NO: 617721 - DNA, 25 bp, Homo sapien
agttcccagaagcaccgggacacac

SEQ ID NO: 617722 - DNA, 25 bp, Homo sapien
gaacatgaccaagtacgtatccaag

SEQ ID NO: 617723 - DNA, 25 bp, Homo sapien
gaccaagtacgtatccaagctggaa

SEQ ID NO: 617724 - DNA, 25 bp, Homo sapien
ccaagctggaagagcccgctgggaa

SEQ ID NO: 617725 - DNA, 25 bp, Homo sapien
ggtggctaagccaaagggacctcca

SEQ ID NO: 617726 - DNA, 25 bp, Homo sapien
gggacctccagtgcaaaagaagaaa

SEQ ID NO: 617727 - DNA, 25 bp, Homo sapien
agtcaaggaagaactttagcttctc

SEQ ID NO: 617728 - DNA, 25 bp, Homo sapien
ctttagcttctccaataccaggaaa

SEQ ID NO: 617729 - DNA, 25 bp, Homo sapien
atgcttattttccagatcctggcat

SEQ ID NO: 617730 - DNA, 25 bp, Homo sapien
ggcatcattttctgaatggattgat

SEQ ID NO: 617731 - DNA, 25 bp, Homo sapien
taaaagcatatatcattgtggtagg

SEQ ID NO: 617732 - DNA, 25 bp, Homo sapien
gtggataataaagcctctgagtgtc

SEQ ID NO: 617733 - DNA, 25 bp, Homo sapien
aacttatttacatttgcccctgcca

SEQ ID NO: 617734 - DNA, 25 bp, Homo sapien
atccctaaggctcagcattgtttct

SEQ ID NO: 617735 - DNA, 25 bp, Homo sapien
gcattgtttctgatacagagccagt

SEQ ID NO: 617736 - DNA, 25 bp, Homo sapien
gttttgtccatactaggtgttcaac

SEQ ID NO: 617737 - DNA, 25 bp, Homo sapien
ctaggtgttcaacatgtacttattg

SEQ ID NO: 617738 - DNA, 25 bp, Homo sapien
atgtttccatcaaaagttatctctc

SEQ ID NO: 617739 - DNA, 25 bp, Homo sapien
aagttatctctctctaggctggaaa

SEQ ID NO: 617740 - DNA, 25 bp, Homo sapien
gttcttttcatattgtgcttttttg

SEQ ID NO: 617741 - DNA, 25 bp, Homo sapien
ggtttgtttccctatttgaagcatc

SEQ ID NO: 617742 - DNA, 25 bp, Homo sapien
tatttgaagcatcctccagtagaat

SEQ ID NO: 617743 - DNA, 25 bp, Homo sapien
catcctccagtagaatgcaagatct

SEQ ID NO: 617744 - DNA, 25 bp, Homo sapien
ggtcatatcttttcaccactagcaa

SEQ ID NO: 617745 - DNA, 25 bp, Homo sapien
gcaatagctgagatgcttggacata

SEQ ID NO: 617746 - DNA, 25 bp, Homo sapien
gcttggacataatccaccctccaaa

SEQ ID NO: 617747 - DNA, 25 bp, Homo sapien
cctcaccccttttaaggagcttgat

SEQ ID NO: 617748 - DNA, 25 bp, Homo sapien
gacgatcatgcaattctcttcaaag

SEQ ID NO: 617749 - DNA, 25 bp, Homo sapien
gagtgtcagtccattaaatccccat

SEQ ID NO: 617750 - DNA, 25 bp, Homo sapien
ccccatacagcccattactaaaata

SEQ ID NO: 617751 - DNA, 25 bp, Homo sapien
atattttgctttgccacttgtgcaa

SEQ ID NO: 617752 - DNA, 25 bp, Homo sapien
ccacttgtgcaacagatctggctgt

SEQ ID NO: 617753 - DNA, 25 bp, Homo sapien
agatctggctgtatctgccttgaaa

SEQ ID NO: 617754 - DNA, 25 bp, Homo sapien
gagcttcatttgaatatctcttctg

SEQ ID NO: 617755 - DNA, 25 bp, Homo sapien
ccctgtcacctaggccaatcatagc

SEQ ID NO: 617756 - DNA, 25 bp, Homo sapien
gccaatcatagcctctgcagcctca

SEQ ID NO: 617757 - DNA, 25 bp, Homo sapien
ccacctgtaagcacaggccaccatg

SEQ ID NO: 617758 - DNA, 25 bp, Homo sapien
aagtgctggaacttcaagtgagagc

SEQ ID NO: 617759 - DNA, 25 bp, Homo sapien
tggaacttcaagtgagagccgccgc

SEQ ID NO: 617760 - DNA, 25 bp, Homo sapien
gaacttcaagtgagagccgccgcgc

SEQ ID NO: 617761 - DNA, 25 bp, Homo sapien
acttcaagtgagagccgccgcgcct

SEQ ID NO: 617762 - DNA, 25 bp, Homo sapien
tggtgttggagcatggtatttagca

SEQ ID NO: 617763 - DNA, 25 bp, Homo sapien
ggagcatggtatttagcagactcat

SEQ ID NO: 617764 - DNA, 25 bp, Homo sapien
gcatggtatttagcagactcatcct

SEQ ID NO: 617765 - DNA, 25 bp, Homo sapien
ggtatttagcagactcatcctattt

SEQ ID NO: 617766 - DNA, 25 bp, Homo sapien
ttgtagaggcaatgtactgtagaaa

SEQ ID NO: 617767 - DNA, 25 bp, Homo sapien
tgtactgtagaaaaaagacccaggt

SEQ ID NO: 617768 - DNA, 25 bp, Homo sapien
gacccaggtttaaaatctcagcttt

SEQ ID NO: 617769 - DNA, 25 bp, Homo sapien
agctttattagctatacgaccttag

SEQ ID NO: 617770 - DNA, 25 bp, Homo sapien
ttagctatacgaccttagaaaagtt

SEQ ID NO: 617771 - DNA, 25 bp, Homo sapien
taacctttctcaattgcaaactgga

SEQ ID NO: 617772 - DNA, 25 bp, Homo sapien
taatgtgtagagcacctggcatcat

SEQ ID NO: 617773 - DNA, 25 bp, Homo sapien
tggcatcatgcctgacatctggtga

SEQ ID NO: 617774 - DNA, 25 bp, Homo sapien
atgcctgacatctggtgatgatcaa

SEQ ID NO: 617775 - DNA, 25 bp, Homo sapien
gatgatcaattgtgttggttttact

SEQ ID NO: 617776 - DNA, 25 bp, Homo sapien
gataattcatctggataattctgat

SEQ ID NO: 617777 - DNA, 25 bp, Homo sapien
gttaaatctaagttgcttgtagcta

SEQ ID NO: 617778 - DNA, 25 bp, Homo sapien
gcttgtagctaagcaggattttata

SEQ ID NO: 617779 - DNA, 25 bp, Homo sapien
gaaagtaatgtgtttaaatgcttag

SEQ ID NO: 617780 - DNA, 25 bp, Homo sapien
tgggaccagcagtagtgaaactagt

SEQ ID NO: 617781 - DNA, 25 bp, Homo sapien
gaaaagtttccctcagcccatatgg

SEQ ID NO: 617782 - DNA, 25 bp, Homo sapien
aagtttccctcagcccatatgggca

SEQ ID NO: 617783 - DNA, 25 bp, Homo sapien
atatgggcaatttcccttggttcct

SEQ ID NO: 617784 - DNA, 25 bp, Homo sapien
gcaatttcccttggttcctgtggag

SEQ ID NO: 617785 - DNA, 25 bp, Homo sapien
ggttcctgtggagcatttggctaca

SEQ ID NO: 617786 - DNA, 25 bp, Homo sapien
gagcatttggctacagacacagaag

SEQ ID NO: 617787 - DNA, 25 bp, Homo sapien
atttggctacagacacagaagcaaa

SEQ ID NO: 617788 - DNA, 25 bp, Homo sapien
tcacattcatggctgtttaaccaat

SEQ ID NO: 617789 - DNA, 25 bp, Homo sapien
atggctgtttaaccaatctgaaagt

SEQ ID NO: 617790 - DNA, 25 bp, Homo sapien
taaccaatctgaaagttacggtttg

SEQ ID NO: 617791 - DNA, 25 bp, Homo sapien
aagtcatacaacacattttctttgt

SEQ ID NO: 617792 - DNA, 25 bp, Homo sapien
gagaactagataacatggtaacaga

SEQ ID NO: 617793 - DNA, 25 bp, Homo sapien
gagaattgattttcatatgaatctt

SEQ ID NO: 617794 - DNA, 25 bp, Homo sapien
ccacagtaaaatagttgacatcata

SEQ ID NO: 617795 - DNA, 25 bp, Homo sapien
ttgtttaattcttggtttgcctaat

SEQ ID NO: 617796 - DNA, 25 bp, Homo sapien
taattcttggtttgcctaattcgtt

SEQ ID NO: 617797 - DNA, 25 bp, Homo sapien
tttcatacaaataaaggatacctgg

SEQ ID NO: 617798 - DNA, 25 bp, Homo sapien
taaaggatacctggatttatttagg

SEQ ID NO: 617799 - DNA, 25 bp, Homo sapien
ttgtagaggcaatgtactgtagaaa

SEQ ID NO: 617800 - DNA, 25 bp, Homo sapien
aagacccaggtttaaaatctcagct

SEQ ID NO: 617801 - DNA, 25 bp, Homo sapien
gacccaggtttaaaatctcagcttt

SEQ ID NO: 617802 - DNA, 25 bp, Homo sapien
aaatctcagctttattagctatacg

SEQ ID NO: 617803 - DNA, 25 bp, Homo sapien
agctttattagctatacgaccttag

SEQ ID NO: 617804 - DNA, 25 bp, Homo sapien
gctttattagctatacgaccttaga

SEQ ID NO: 617805 - DNA, 25 bp, Homo sapien
tattagctatacgaccttagaaaag

SEQ ID NO: 617806 - DNA, 25 bp, Homo sapien
tagctatacgaccttagaaaagtta

SEQ ID NO: 617807 - DNA, 25 bp, Homo sapien
ggtgatgatcaattgtgttggtttt

SEQ ID NO: 617808 - DNA, 25 bp, Homo sapien
gatgatcaattgtgttggttttact

SEQ ID NO: 617809 - DNA, 25 bp, Homo sapien
actattaatgataattcatctggat

SEQ ID NO: 617810 - DNA, 25 bp, Homo sapien
ttccccatctctataattctgtcac

SEQ ID NO: 617811 - DNA, 25 bp, Homo sapien
gtgaccatttgatacctactgtttt

SEQ ID NO: 617812 - DNA, 25 bp, Homo sapien
tactgttttcactcaccataatgcc

SEQ ID NO: 617813 - DNA, 25 bp, Homo sapien
gagatccatccaagctgtggcaggt

SEQ ID NO: 617814 - DNA, 25 bp, Homo sapien
gtggcaggtgtcagtccttggtcct

SEQ ID NO: 617815 - DNA, 25 bp, Homo sapien
ccttggtcctgttttattgctgagt

SEQ ID NO: 617816 - DNA, 25 bp, Homo sapien
tgctgagttgcattccatggtacgg

SEQ ID NO: 617817 - DNA, 25 bp, Homo sapien
cggatgaacccgagcttaacctgtc

SEQ ID NO: 617818 - DNA, 25 bp, Homo sapien
ttaacctgtcccctattgacaagac

SEQ ID NO: 617819 - DNA, 25 bp, Homo sapien
tattgacaagaccttttccctagcc

SEQ ID NO: 617820 - DNA, 25 bp, Homo sapien
tttccctagcctttggcaacctaca

SEQ ID NO: 617821 - DNA, 25 bp, Homo sapien
agagccatatcaagctccttttccc

SEQ ID NO: 617822 - DNA, 25 bp, Homo sapien
tgcatctccctaagggcatagccta

SEQ ID NO: 617823 - DNA, 25 bp, Homo sapien
gcatagcctagtggtggtttctccc

SEQ ID NO: 617824 - DNA, 25 bp, Homo sapien
tgagtaggcccagctagcctctgtc

SEQ ID NO: 617825 - DNA, 25 bp, Homo sapien
tcccctgttatttgggccctaacag

SEQ ID NO: 617826 - DNA, 25 bp, Homo sapien
ggccctaacagaagctacccaaatt

SEQ ID NO: 617827 - DNA, 25 bp, Homo sapien
tacccaaatttgaaccatctctgcc

SEQ ID NO: 617828 - DNA, 25 bp, Homo sapien
tgccccatgctcaagacctgagggt

SEQ ID NO: 617829 - DNA, 25 bp, Homo sapien
gggtctcacatcctcaaaatgggtc

SEQ ID NO: 617830 - DNA, 25 bp, Homo sapien
aaaatgggtccccagattccagatc

SEQ ID NO: 617831 - DNA, 25 bp, Homo sapien
cccagattccagatccaaggatttg

SEQ ID NO: 617832 - DNA, 25 bp, Homo sapien
aatcgcttgaacctattccaataaa

SEQ ID NO: 617833 - DNA, 25 bp, Homo sapien
atcgcttgaacctattccaataaaa

SEQ ID NO: 617834 - DNA, 25 bp, Homo sapien
gcttgaacctattccaataaaactg

SEQ ID NO: 617835 - DNA, 25 bp, Homo sapien
taaaactgctccttattggtaattg

SEQ ID NO: 617836 - DNA, 25 bp, Homo sapien
aaaactgctccttattggtaattgt

SEQ ID NO: 617837 - DNA, 25 bp, Homo sapien
aaactgctccttattggtaattgtg

SEQ ID NO: 617838 - DNA, 25 bp, Homo sapien
aactgctccttattggtaattgtga

SEQ ID NO: 617839 - DNA, 25 bp, Homo sapien
actgctccttattggtaattgtgat

SEQ ID NO: 617840 - DNA, 25 bp, Homo sapien
ctgctccttattggtaattgtgata

SEQ ID NO: 617841 - DNA, 25 bp, Homo sapien
gctccttattggtaattgtgataat

SEQ ID NO: 617842 - DNA, 25 bp, Homo sapien
gtgataataaaattgtaccatactt

SEQ ID NO: 617843 - DNA, 25 bp, Homo sapien
aagcatgaactactgattttgtttt

SEQ ID NO: 617844 - DNA, 25 bp, Homo sapien
agcatgaactactgattttgttttc

SEQ ID NO: 617845 - DNA, 25 bp, Homo sapien
ttttcaaaagtactgtaaacggcag

SEQ ID NO: 617846 - DNA, 25 bp, Homo sapien
tttcaaaagtactgtaaacggcagg

SEQ ID NO: 617847 - DNA, 25 bp, Homo sapien
ttcaaaagtactgtaaacggcagga

SEQ ID NO: 617848 - DNA, 25 bp, Homo sapien
tcaaaagtactgtaaacggcaggaa

SEQ ID NO: 617849 - DNA, 25 bp, Homo sapien
aagtactgtaaacggcaggaaagat

SEQ ID NO: 617850 - DNA, 25 bp, Homo sapien
agtactgtaaacggcaggaaagatc

SEQ ID NO: 617851 - DNA, 25 bp, Homo sapien
gtactgtaaacggcaggaaagatcc

SEQ ID NO: 617852 - DNA, 25 bp, Homo sapien
tactgtaaacggcaggaaagatcca

SEQ ID NO: 617853 - DNA, 25 bp, Homo sapien
actgtaaacggcaggaaagatccaa

SEQ ID NO: 617854 - DNA, 25 bp, Homo sapien
gtcaaatctaacctgcttaaataag

SEQ ID NO: 617855 - DNA, 25 bp, Homo sapien
gagtttggtgagaaagtgaaaccac

SEQ ID NO: 617856 - DNA, 25 bp, Homo sapien
gtgaaaccacctgatcttgaatcaa

SEQ ID NO: 617857 - DNA, 25 bp, Homo sapien
accacctgatcttgaatcaatgttg

SEQ ID NO: 617858 - DNA, 25 bp, Homo sapien
gatcttgaatcaatgttgaggtgaa

SEQ ID NO: 617859 - DNA, 25 bp, Homo sapien
gcttcttttcctaagagtctgaaac

SEQ ID NO: 617860 - DNA, 25 bp, Homo sapien
ctaagagtctgaaaccattccattt

SEQ ID NO: 617861 - DNA, 25 bp, Homo sapien
gagtctgaaaccattccatttcatt

SEQ ID NO: 617862 - DNA, 25 bp, Homo sapien
gtgtctgtttctaagaaattctgtt

SEQ ID NO: 617863 - DNA, 25 bp, Homo sapien
aattctgttttcttagttctctggt

SEQ ID NO: 617864 - DNA, 25 bp, Homo sapien
tctgttttcttagttctctggttaa

SEQ ID NO: 617865 - DNA, 25 bp, Homo sapien
agaggttgggccactcacagctgca

SEQ ID NO: 617866 - DNA, 25 bp, Homo sapien
cactcacagctgcatgatgaggtag

SEQ ID NO: 617867 - DNA, 25 bp, Homo sapien
cacagctgcatgatgaggtagaggt

SEQ ID NO: 617868 - DNA, 25 bp, Homo sapien
catgatgaggtagaggtggccccca

SEQ ID NO: 617869 - DNA, 25 bp, Homo sapien
agaggtggcccccactctcatagat

SEQ ID NO: 617870 - DNA, 25 bp, Homo sapien
tctcatagatgtcatccagggctac

SEQ ID NO: 617871 - DNA, 25 bp, Homo sapien
aatgttggggtgcttgatcctgaaa

SEQ ID NO: 617872 - DNA, 25 bp, Homo sapien
aaggagaaatgaggtggtttagcca

SEQ ID NO: 617873 - DNA, 25 bp, Homo sapien
tcacttggccccagcagttcaaagc

SEQ ID NO: 617874 - DNA, 25 bp, Homo sapien
gttcaaagctgcagtctgttatgat

SEQ ID NO: 617875 - DNA, 25 bp, Homo sapien
tgcagtctgttatgattgcacctgt

SEQ ID NO: 617876 - DNA, 25 bp, Homo sapien
acgttaaatgaaaacattagccagc

SEQ ID NO: 617877 - DNA, 25 bp, Homo sapien
cgttaaatgaaaacattagccagct

SEQ ID NO: 617878 - DNA, 25 bp, Homo sapien
gttaaatgaaaacattagccagctg

SEQ ID NO: 617879 - DNA, 25 bp, Homo sapien
ttaaatgaaaacattagccagctgt

SEQ ID NO: 617880 - DNA, 25 bp, Homo sapien
taaatgaaaacattagccagctgta

SEQ ID NO: 617881 - DNA, 25 bp, Homo sapien
aaatgaaaacattagccagctgtag

SEQ ID NO: 617882 - DNA, 25 bp, Homo sapien
aatgaaaacattagccagctgtagt

SEQ ID NO: 617883 - DNA, 25 bp, Homo sapien
atgaaaacattagccagctgtagtg

SEQ ID NO: 617884 - DNA, 25 bp, Homo sapien
ggtgactgagagagatcctggctcc

SEQ ID NO: 617885 - DNA, 25 bp, Homo sapien
gtgactgagagagatcctggctcca

SEQ ID NO: 617886 - DNA, 25 bp, Homo sapien
tgactgagagagatcctggctccaa

SEQ ID NO: 617887 - DNA, 25 bp, Homo sapien
gagaaactgcgaatctaaaaggaat

SEQ ID NO: 617888 - DNA, 25 bp, Homo sapien
gaaactgcgaatctaaaaggaatat

SEQ ID NO: 617889 - DNA, 25 bp, Homo sapien
actgcgaatctaaaaggaatatgac

SEQ ID NO: 617890 - DNA, 25 bp, Homo sapien
atctaaaaggaatatgacaaagcct

SEQ ID NO: 617891 - DNA, 25 bp, Homo sapien
acactgcagagactccttacggaaa

SEQ ID NO: 617892 - DNA, 25 bp, Homo sapien
cactgcagagactccttacggaaat

SEQ ID NO: 617893 - DNA, 25 bp, Homo sapien
actgcagagactccttacggaaata

SEQ ID NO: 617894 - DNA, 25 bp, Homo sapien
ctgcagagactccttacggaaataa

SEQ ID NO: 617895 - DNA, 25 bp, Homo sapien
tgcagagactccttacggaaataaa

SEQ ID NO: 617896 - DNA, 25 bp, Homo sapien
gcagagactccttacggaaataaaa

SEQ ID NO: 617897 - DNA, 25 bp, Homo sapien
gaaagacctgccggccgcggtggct

SEQ ID NO: 617898 - DNA, 25 bp, Homo sapien
aagtgtcaaaagcaccttctgcaca

SEQ ID NO: 617899 - DNA, 25 bp, Homo sapien
agtctgcacacactggccggtggtc

SEQ ID NO: 617900 - DNA, 25 bp, Homo sapien
cggtggtcctgttcccgcaaggttg

SEQ ID NO: 617901 - DNA, 25 bp, Homo sapien
cagagacatgggtcctccgggtgat

SEQ ID NO: 617902 - DNA, 25 bp, Homo sapien
tgagctgcacgtgctaatgattaac

SEQ ID NO: 617903 - DNA, 25 bp, Homo sapien
gtgctaatgattaacgccccgtccg

SEQ ID NO: 617904 - DNA, 25 bp, Homo sapien
ccgtgctggccggtttctcaaatgc

SEQ ID NO: 617905 - DNA, 25 bp, Homo sapien
tttctcaaatgcctcctgacgattg

SEQ ID NO: 617906 - DNA, 25 bp, Homo sapien
tgacgattgcgcacagccggacatc

SEQ ID NO: 617907 - DNA, 25 bp, Homo sapien
gcacagccggacatcatttgtactg

SEQ ID NO: 617908 - DNA, 25 bp, Homo sapien
ggaaatcactgaggctttctgaggt

SEQ ID NO: 617909 - DNA, 25 bp, Homo sapien
atcctgggatgggtttacagcacct

SEQ ID NO: 617910 - DNA, 25 bp, Homo sapien
aggtgttcctctccagcagttaatg

SEQ ID NO: 617911 - DNA, 25 bp, Homo sapien
aagcatctgtgtgccgaagaacctg

SEQ ID NO: 617912 - DNA, 25 bp, Homo sapien
aggtactagtccaggagtaggctgt

SEQ ID NO: 617913 - DNA, 25 bp, Homo sapien
gagccgggagccaacagctctgaag

SEQ ID NO: 617914 - DNA, 25 bp, Homo sapien
acagctctgaagctctgagctctga

SEQ ID NO: 617915 - DNA, 25 bp, Homo sapien
tgaggctttgaagctaccgcacact

SEQ ID NO: 617916 - DNA, 25 bp, Homo sapien
gcacactctgtcatctgttgattgt

SEQ ID NO: 617917 - DNA, 25 bp, Homo sapien
gtcatctgttgattgttcctgggca

SEQ ID NO: 617918 - DNA, 25 bp, Homo sapien
agagtgggcccttgcatctgtttat

SEQ ID NO: 617919 - DNA, 25 bp, Homo sapien
gtggtgtctgtgcagactcacagtt

SEQ ID NO: 617920 - DNA, 25 bp, Homo sapien
acaggagccgatgccaaatggtcta

SEQ ID NO: 617921 - DNA, 25 bp, Homo sapien
caaatggtctagaggcagaagggct

SEQ ID NO: 617922 - DNA, 25 bp, Homo sapien
gggacagtaaactctcaccgcagct

SEQ ID NO: 617923 - DNA, 25 bp, Homo sapien
atgcccctcacatggacttggaatc

SEQ ID NO: 617924 - DNA, 25 bp, Homo sapien
acttggaatcagtgtctctcttgct

SEQ ID NO: 617925 - DNA, 25 bp, Homo sapien
tctcttgctgatgagcacctccagg

SEQ ID NO: 617926 - DNA, 25 bp, Homo sapien
gagcctcagtttcgcctttatgtgc

SEQ ID NO: 617927 - DNA, 25 bp, Homo sapien
cagtttcgcctttatgtgcttatat

SEQ ID NO: 617928 - DNA, 25 bp, Homo sapien
tcactgtattcttcagccataggag

SEQ ID NO: 617929 - DNA, 25 bp, Homo sapien
cttcagccataggagtgcggtcttc

SEQ ID NO: 617930 - DNA, 25 bp, Homo sapien
ggtcttccttctggacatttctaat

SEQ ID NO: 617931 - DNA, 25 bp, Homo sapien
tgtttcaaaatctctgtttaagtag

SEQ ID NO: 617932 - DNA, 25 bp, Homo sapien
aaatctctgtttaagtagtgaatac

SEQ ID NO: 617933 - DNA, 25 bp, Homo sapien
gtagtgaatacatttcagactatca

SEQ ID NO: 617934 - DNA, 25 bp, Homo sapien
tttcagactatcacaaagcatatat

SEQ ID NO: 617935 - DNA, 25 bp, Homo sapien
gactatcacaaagcatatatgtaat

SEQ ID NO: 617936 - DNA, 25 bp, Homo sapien
agccaattaaattctagtcctaact

SEQ ID NO: 617937 - DNA, 25 bp, Homo sapien
aattctagtcctaacttgtatttat

SEQ ID NO: 617938 - DNA, 25 bp, Homo sapien
tttgaagagtgttttaatgacttgc

SEQ ID NO: 617939 - DNA, 25 bp, Homo sapien
aatgacttgctagcacattttacag

SEQ ID NO: 617940 - DNA, 25 bp, Homo sapien
gacttgctagcacattttacagcta

SEQ ID NO: 617941 - DNA, 25 bp, Homo sapien
ttgctagcacattttacagctattg

SEQ ID NO: 617942 - DNA, 25 bp, Homo sapien
aagcttaaaaagctgtccaggatcg

SEQ ID NO: 617943 - DNA, 25 bp, Homo sapien
gcttaaaaagctgtccaggatcggt

SEQ ID NO: 617944 - DNA, 25 bp, Homo sapien
taaaaagctgtccaggatcggtggt

SEQ ID NO: 617945 - DNA, 25 bp, Homo sapien
aaaaagctgtccaggatcggtggtt

SEQ ID NO: 617946 - DNA, 25 bp, Homo sapien
aaaagctgtccaggatcggtggttt

SEQ ID NO: 617947 - DNA, 25 bp, Homo sapien
aaagctgtccaggatcggtggttta

SEQ ID NO: 617948 - DNA, 25 bp, Homo sapien
aagctgtccaggatcggtggtttac

SEQ ID NO: 617949 - DNA, 25 bp, Homo sapien
agctgtccaggatcggtggtttaca

SEQ ID NO: 617950 - DNA, 25 bp, Homo sapien
gctgtccaggatcggtggtttacac

SEQ ID NO: 617951 - DNA, 25 bp, Homo sapien
tgtccaggatcggtggtttacacct

SEQ ID NO: 617952 - DNA, 25 bp, Homo sapien
gtccaggatcggtggtttacacctg

SEQ ID NO: 617953 - DNA, 25 bp, Homo sapien
agtcctgtgcctctgagtggccatt

SEQ ID NO: 617954 - DNA, 25 bp, Homo sapien
tgagtggccattgacccttggagag

SEQ ID NO: 617955 - DNA, 25 bp, Homo sapien
tgacccttggagagcctgatgaaag

SEQ ID NO: 617956 - DNA, 25 bp, Homo sapien
cccttggagagcctgatgaaagcta

SEQ ID NO: 617957 - DNA, 25 bp, Homo sapien
atgaaagctatggaccctcttccaa

SEQ ID NO: 617958 - DNA, 25 bp, Homo sapien
gaaagctatggaccctcttccaaaa

SEQ ID NO: 617959 - DNA, 25 bp, Homo sapien
aaaaaatgcacatccacagctgggc

SEQ ID NO: 617960 - DNA, 25 bp, Homo sapien
atgcacatccacagctgggcacggt

SEQ ID NO: 617961 - DNA, 25 bp, Homo sapien
tggtggccagactggagactcctcc

SEQ ID NO: 617962 - DNA, 25 bp, Homo sapien
ggagactcctcccacggcagaaagg

SEQ ID NO: 617963 - DNA, 25 bp, Homo sapien
agactcctcccacggcagaaaggca

SEQ ID NO: 617964 - DNA, 25 bp, Homo sapien
accaggcaaggaacttccgcctcta

SEQ ID NO: 617965 - DNA, 25 bp, Homo sapien
ttccgcctctacacacaggaggtgt

SEQ ID NO: 617966 - DNA, 25 bp, Homo sapien
tggaaatgggtcacaatgtgtcctt

SEQ ID NO: 617967 - DNA, 25 bp, Homo sapien
agacgacgtctgtacagccccagga

SEQ ID NO: 617968 - DNA, 25 bp, Homo sapien
ctccctcttcagatgtttgaacttg

SEQ ID NO: 617969 - DNA, 25 bp, Homo sapien
ggtatagtagcttgtttcacctaga

SEQ ID NO: 617970 - DNA, 25 bp, Homo sapien
tcacctagaaatattaacccagcct

SEQ ID NO: 617971 - DNA, 25 bp, Homo sapien
taacccagcctccttataataaaat

SEQ ID NO: 617972 - DNA, 25 bp, Homo sapien
caaagttatatctgttcccccttgt

SEQ ID NO: 617973 - DNA, 25 bp, Homo sapien
tcccagtggagggtcaataaatcac

SEQ ID NO: 617974 - DNA, 25 bp, Homo sapien
taaatcacatgatggctttggcaac

SEQ ID NO: 617975 - DNA, 25 bp, Homo sapien
taaaatcaaaagaccctcatgccag

SEQ ID NO: 617976 - DNA, 25 bp, Homo sapien
aaaatcaaaagaccctcatgccagc

SEQ ID NO: 617977 - DNA, 25 bp, Homo sapien
aaatcaaaagaccctcatgccagcc

SEQ ID NO: 617978 - DNA, 25 bp, Homo sapien
aatcaaaagaccctcatgccagcca

SEQ ID NO: 617979 - DNA, 25 bp, Homo sapien
atcaaaagaccctcatgccagccag

SEQ ID NO: 617980 - DNA, 25 bp, Homo sapien
tcaaaagaccctcatgccagccagg

SEQ ID NO: 617981 - DNA, 25 bp, Homo sapien
aaaagaccctcatgccagccaggcg

SEQ ID NO: 617982 - DNA, 25 bp, Homo sapien
aaagaccctcatgccagccaggcgc

SEQ ID NO: 617983 - DNA, 25 bp, Homo sapien
aagaccctcatgccagccaggcgca

SEQ ID NO: 617984 - DNA, 25 bp, Homo sapien
agaccctcatgccagccaggcgcag

SEQ ID NO: 617985 - DNA, 25 bp, Homo sapien
gaccctcatgccagccaggcgcagt

SEQ ID NO: 617986 - DNA, 25 bp, Homo sapien
ctaggaaatttttatgacagaactt

SEQ ID NO: 617987 - DNA, 25 bp, Homo sapien
cagaacttccattcatcaacagttt

SEQ ID NO: 617988 - DNA, 25 bp, Homo sapien
tcatcaacagtttacttaccctgaa

SEQ ID NO: 617989 - DNA, 25 bp, Homo sapien
ttacttaccctgaaatagtttgtat

SEQ ID NO: 617990 - DNA, 25 bp, Homo sapien
cattttaatccattgctgttgatac

SEQ ID NO: 617991 - DNA, 25 bp, Homo sapien
aatccattgctgttgatacttttat

SEQ ID NO: 617992 - DNA, 25 bp, Homo sapien
gatacttttattgatagggccatag

SEQ ID NO: 617993 - DNA, 25 bp, Homo sapien
agggccatagttcaactgtgctctg

SEQ ID NO: 617994 - DNA, 25 bp, Homo sapien
gggctttcctacttcaatcagattt

SEQ ID NO: 617995 - DNA, 25 bp, Homo sapien
tcagatttcaacttttgattgtttc

SEQ ID NO: 617996 - DNA, 25 bp, Homo sapien
ttgattgtttctgtactgggcttcc

SEQ ID NO: 617997 - DNA, 25 bp, Homo sapien
gtattatgagaaccagaagtaacaa

SEQ ID NO: 617998 - DNA, 25 bp, Homo sapien
gcaaattcaaaatcaagccacttct

SEQ ID NO: 617999 - DNA, 25 bp, Homo sapien
attcaaaatcaagccacttctccat

SEQ ID NO: 618000 - DNA, 25 bp, Homo sapien
cttccccttgtcaaacacaaaacat

SEQ ID NO: 618001 - DNA, 25 bp, Homo sapien
aaacgatattatgtctgattttaga

SEQ ID NO: 618002 - DNA, 25 bp, Homo sapien
gtctgggatgtagaataacaataat

SEQ ID NO: 618003 - DNA, 25 bp, Homo sapien
taacaataatctgcttctaaatgag

SEQ ID NO: 618004 - DNA, 25 bp, Homo sapien
gagaaaatcataggcatctgacaaa

SEQ ID NO: 618005 - DNA, 25 bp, Homo sapien
ggcatctgacaaatgctggtttcaa

SEQ ID NO: 618006 - DNA, 25 bp, Homo sapien
caaatgctggtttcaaagttatctt

SEQ ID NO: 618007 - DNA, 25 bp, Homo sapien
gttatctttccaaaatagaagcgag

SEQ ID NO: 618008 - DNA, 25 bp, Homo sapien
tctggcaaagagggttgggacagct

SEQ ID NO: 618009 - DNA, 25 bp, Homo sapien
ggcagaggttgggccactcacagct

SEQ ID NO: 618010 - DNA, 25 bp, Homo sapien
cactcacagctgcatgatgaggtag

SEQ ID NO: 618011 - DNA, 25 bp, Homo sapien
actcacagctgcatgatgaggtaga

SEQ ID NO: 618012 - DNA, 25 bp, Homo sapien
cacagctgcatgatgaggtagaggt

SEQ ID NO: 618013 - DNA, 25 bp, Homo sapien
catgatgaggtagaggtggccccca

SEQ ID NO: 618014 - DNA, 25 bp, Homo sapien
agaggtggcccccactctcatagat

SEQ ID NO: 618015 - DNA, 25 bp, Homo sapien
tctcatagatgtcatccagggctac

SEQ ID NO: 618016 - DNA, 25 bp, Homo sapien
aatgttggggtgcttgatcctgaaa

SEQ ID NO: 618017 - DNA, 25 bp, Homo sapien
aaggagaaatgaggtggtttagcca

SEQ ID NO: 618018 - DNA, 25 bp, Homo sapien
gagaaatgaggtggtttagccaggc

SEQ ID NO: 618019 - DNA, 25 bp, Homo sapien
atctatccagtgtctttaagatagc

SEQ ID NO: 618020 - DNA, 25 bp, Homo sapien
tctatccagtgtctttaagatagca

SEQ ID NO: 618021 - DNA, 25 bp, Homo sapien
ctatccagtgtctttaagatagcaa

SEQ ID NO: 618022 - DNA, 25 bp, Homo sapien
tatccagtgtctttaagatagcaaa

SEQ ID NO: 618023 - DNA, 25 bp, Homo sapien
atccagtgtctttaagatagcaaaa

SEQ ID NO: 618024 - DNA, 25 bp, Homo sapien
tccagtgtctttaagatagcaaaac

SEQ ID NO: 618025 - DNA, 25 bp, Homo sapien
ccagtgtctttaagatagcaaaact

SEQ ID NO: 618026 - DNA, 25 bp, Homo sapien
cagtgtctttaagatagcaaaacta

SEQ ID NO: 618027 - DNA, 25 bp, Homo sapien
agtgtctttaagatagcaaaactaa

SEQ ID NO: 618028 - DNA, 25 bp, Homo sapien
ggatgatcccttcaatggagttcaa

SEQ ID NO: 618029 - DNA, 25 bp, Homo sapien
gttcaagggcaatctttctctagta

SEQ ID NO: 618030 - DNA, 25 bp, Homo sapien
aatctttctctagtactttggcata

SEQ ID NO: 618031 - DNA, 25 bp, Homo sapien
aagccttgcaatactgtgtcatgtc

SEQ ID NO: 618032 - DNA, 25 bp, Homo sapien
gcaggagacatgtgagcttctatta

SEQ ID NO: 618033 - DNA, 25 bp, Homo sapien
ggaggataggccttccagtagctat

SEQ ID NO: 618034 - DNA, 25 bp, Homo sapien
aatctgtattttccactaagggtag

SEQ ID NO: 618035 - DNA, 25 bp, Homo sapien
ctaagggtaggtctgattgccatca

SEQ ID NO: 618036 - DNA, 25 bp, Homo sapien
gattgccatcagtcagtagtacctt

SEQ ID NO: 618037 - DNA, 25 bp, Homo sapien
caattgattctattagctttgctta

SEQ ID NO: 618038 - DNA, 25 bp, Homo sapien
taccattgtgtttgtaataccttac

SEQ ID NO: 618039 - DNA, 25 bp, Homo sapien
aggtggcgtgtcctgaccattcagt

SEQ ID NO: 618040 - DNA, 25 bp, Homo sapien
ggctgagccctgtgaaaacaggcat

SEQ ID NO: 618041 - DNA, 25 bp, Homo sapien
acaggcattctgtaggtcttcggat

SEQ ID NO: 618042 - DNA, 25 bp, Homo sapien
aggtcttcggatgaggaacttgcag

SEQ ID NO: 618043 - DNA, 25 bp, Homo sapien
gaacttgcagaagcagccgggtgct

SEQ ID NO: 618044 - DNA, 25 bp, Homo sapien
ggtgctgccatcctaagctggtttt

SEQ ID NO: 618045 - DNA, 25 bp, Homo sapien
gaaaagctgtggtttgcctgtcaga

SEQ ID NO: 618046 - DNA, 25 bp, Homo sapien
ggtttgcctgtcagagtgagcgccc

SEQ ID NO: 618047 - DNA, 25 bp, Homo sapien
ggtaaccacagtttctccatagagc

SEQ ID NO: 618048 - DNA, 25 bp, Homo sapien
gagtgggctgggacgactcctacct

SEQ ID NO: 618049 - DNA, 25 bp, Homo sapien
gactcctaccttagcagctgctggg

SEQ ID NO: 618050 - DNA, 25 bp, Homo sapien
gggagcaccgagagagaagatcact

SEQ ID NO: 618051 - DNA, 25 bp, Homo sapien
aacaccgagtgtggcgtggagcaca

SEQ ID NO: 618052 - DNA, 25 bp, Homo sapien
tggagcacagacagagaagatcact

SEQ ID NO: 618053 - DNA, 25 bp, Homo sapien
cactgagagagagaagatcactgga

SEQ ID NO: 618054 - DNA, 25 bp, Homo sapien
gaagatcactggatcaaaccccgag

SEQ ID NO: 618055 - DNA, 25 bp, Homo sapien
gatcactggatcaaaccccgagtgt

SEQ ID NO: 618056 - DNA, 25 bp, Homo sapien
tcactggatcaaaccccgagtgtgg

SEQ ID NO: 618057 - DNA, 25 bp, Homo sapien
atcaaaccccgagtgtggcgtgggt

SEQ ID NO: 618058 - DNA, 25 bp, Homo sapien
ggtgaggtgcaggagcctaaccaac

SEQ ID NO: 618059 - DNA, 25 bp, Homo sapien
gtgcaggagcctaaccaacggtaag

SEQ ID NO: 618060 - DNA, 25 bp, Homo sapien
tgcaggagcctaaccaacggtaagg

SEQ ID NO: 618061 - DNA, 25 bp, Homo sapien
acgggtccacagcaccacagttgtt

SEQ ID NO: 618062 - DNA, 25 bp, Homo sapien
gcaccacagttgtttctagagtcca

SEQ ID NO: 618063 - DNA, 25 bp, Homo sapien
ctagagtccaatttacggacggcgt

SEQ ID NO: 618064 - DNA, 25 bp, Homo sapien
cggacggcgtaaaatttcatgatgc

SEQ ID NO: 618065 - DNA, 25 bp, Homo sapien
tccaccagtcccattattggacgtg

SEQ ID NO: 618066 - DNA, 25 bp, Homo sapien
tcccattattggacgtgtaaatcac

SEQ ID NO: 618067 - DNA, 25 bp, Homo sapien
gttacccgcagttcactttctgcag

SEQ ID NO: 618068 - DNA, 25 bp, Homo sapien
gtttgttacctgcagacagctacag

SEQ ID NO: 618069 - DNA, 25 bp, Homo sapien
acctgcagacagctacagtatgaaa

SEQ ID NO: 618070 - DNA, 25 bp, Homo sapien
aatattaagctattctgagggagag

SEQ ID NO: 618071 - DNA, 25 bp, Homo sapien
agccacatcacttctgttacagtat

SEQ ID NO: 618072 - DNA, 25 bp, Homo sapien
atagtgacagtcaaacacaggagca

SEQ ID NO: 618073 - DNA, 25 bp, Homo sapien
ggagcaaatctgattctagggcaca

SEQ ID NO: 618074 - DNA, 25 bp, Homo sapien
tctagggcacagagtaattattcac

SEQ ID NO: 618075 - DNA, 25 bp, Homo sapien
gagtaattattcactggcctatttt

SEQ ID NO: 618076 - DNA, 25 bp, Homo sapien
atttaataatatcactccttctcaa

SEQ ID NO: 618077 - DNA, 25 bp, Homo sapien
ccattgtgaaaaccgaaagtgctca

SEQ ID NO: 618078 - DNA, 25 bp, Homo sapien
gaaaaccgaaagtgctcatatttat

SEQ ID NO: 618079 - DNA, 25 bp, Homo sapien
gctcatatttatttgttagtgcatt

SEQ ID NO: 618080 - DNA, 25 bp, Homo sapien
ttatttgttagtgcattaacggaag

SEQ ID NO: 618081 - DNA, 25 bp, Homo sapien
ttaacggaagataatgccccagtgg

SEQ ID NO: 618082 - DNA, 25 bp, Homo sapien
agatttaatagggatctgctctgct

SEQ ID NO: 618083 - DNA, 25 bp, Homo sapien
tcagccggcattctttacgaggcgc

SEQ ID NO: 618084 - DNA, 25 bp, Homo sapien
gcatttcaccaaccctgggagctaa

SEQ ID NO: 618085 - DNA, 25 bp, Homo sapien
caaccctgggagctaatgcgttttc

SEQ ID NO: 618086 - DNA, 25 bp, Homo sapien
aatgcgttttccctggcttcatatc

SEQ ID NO: 618087 - DNA, 25 bp, Homo sapien
atatccacccgaatgattgctgcgt

SEQ ID NO: 618088 - DNA, 25 bp, Homo sapien
gattgctgcgtaatcctcaaacggc

SEQ ID NO: 618089 - DNA, 25 bp, Homo sapien
gtaatcctcaaacggcctggactgt

SEQ ID NO: 618090 - DNA, 25 bp, Homo sapien
cggcctggactgttatttacttaat

SEQ ID NO: 618091 - DNA, 25 bp, Homo sapien
tctcttacttttcaaaccctagctt

SEQ ID NO: 618092 - DNA, 25 bp, Homo sapien
aaccctagcttcatcttaagctgta

SEQ ID NO: 618093 - DNA, 25 bp, Homo sapien
gaaagcatgtgtctgatgtgttatt

SEQ ID NO: 618094 - DNA, 25 bp, Homo sapien
aaacacctgggcccatttagatcaa

SEQ ID NO: 618095 - DNA, 25 bp, Homo sapien
gaagatcttcaggaccaaacctcag

SEQ ID NO: 618096 - DNA, 25 bp, Homo sapien
ttcaggaccaaacctcagttagaga

SEQ ID NO: 618097 - DNA, 25 bp, Homo sapien
gagaagaattgaatcacgtacgtct

SEQ ID NO: 618098 - DNA, 25 bp, Homo sapien
ttgaatcacgtacgtctttagacga

SEQ ID NO: 618099 - DNA, 25 bp, Homo sapien
acgtctttagacgaatgcacactga

SEQ ID NO: 618100 - DNA, 25 bp, Homo sapien
agacgaatgcacactgacacggaga

SEQ ID NO: 618101 - DNA, 25 bp, Homo sapien
cgaatgcacactgacacggagacac

SEQ ID NO: 618102 - DNA, 25 bp, Homo sapien
gaaggtgtgtaagctctggaaaaac

SEQ ID NO: 618103 - DNA, 25 bp, Homo sapien
agctctggaaaaactgtaatctgga

SEQ ID NO: 618104 - DNA, 25 bp, Homo sapien
gttacagaaataaaatccctcttct

SEQ ID NO: 618105 - DNA, 25 bp, Homo sapien
caagaaggagcacacagatcctgat

SEQ ID NO: 618106 - DNA, 25 bp, Homo sapien
ggagcacacagatcctgatgcagtc

SEQ ID NO: 618107 - DNA, 25 bp, Homo sapien
gatgcagtctggaagaataaagcga

SEQ ID NO: 618108 - DNA, 25 bp, Homo sapien
aagaataaagcgagcccaccggaat

SEQ ID NO: 618109 - DNA, 25 bp, Homo sapien
taaagcgagcccaccggaatgaaca

SEQ ID NO: 618110 - DNA, 25 bp, Homo sapien
agcccaccggaatgaacacctgcat

SEQ ID NO: 618111 - DNA, 25 bp, Homo sapien
aacacctgcattcttgcctgagtga

SEQ ID NO: 618112 - DNA, 25 bp, Homo sapien
gcattcttgcctgagtgacaaccta

SEQ ID NO: 618113 - DNA, 25 bp, Homo sapien
ttcttgcctgagtgacaacctacca

SEQ ID NO: 618114 - DNA, 25 bp, Homo sapien
tgcctgagtgacaacctaccataag

SEQ ID NO: 618115 - DNA, 25 bp, Homo sapien
gtgacaacctaccataaggacaagt

SEQ ID NO: 618116 - DNA, 25 bp, Homo sapien
cactttgcaaaaacggagaatggaa

SEQ ID NO: 618117 - DNA, 25 bp, Homo sapien
gagaatggaagcgtacagaactgta

SEQ ID NO: 618118 - DNA, 25 bp, Homo sapien
tagaacctgacttccttcacactaa

SEQ ID NO: 618119 - DNA, 25 bp, Homo sapien
cttcacactaactattcctgcattt

SEQ ID NO: 618120 - DNA, 25 bp, Homo sapien
cactaactattcctgcatttagcag

SEQ ID NO: 618121 - DNA, 25 bp, Homo sapien
aagcccgatagcatgattgagtgga

SEQ ID NO: 618122 - DNA, 25 bp, Homo sapien
acatgaagggacaagggtttggcta

SEQ ID NO: 618123 - DNA, 25 bp, Homo sapien
caagggtttggctagttatgtttat

SEQ ID NO: 618124 - DNA, 25 bp, Homo sapien
ggaattgagtcaagataccagaaac

SEQ ID NO: 618125 - DNA, 25 bp, Homo sapien
gataccagaaactctacttatagta

SEQ ID NO: 618126 - DNA, 25 bp, Homo sapien
cttatagtaagatcccactttgcaa

SEQ ID NO: 618127 - DNA, 25 bp, Homo sapien
cctgttttgtgtgtactaaaagtct

SEQ ID NO: 618128 - DNA, 25 bp, Homo sapien
ctaaaagtctttacccatccttgat

SEQ ID NO: 618129 - DNA, 25 bp, Homo sapien
gtctttacccatccttgatcatgaa

SEQ ID NO: 618130 - DNA, 25 bp, Homo sapien
tacccatccttgatcatgaagattt

SEQ ID NO: 618131 - DNA, 25 bp, Homo sapien
ttcttctagatgttccattgtttta

SEQ ID NO: 618132 - DNA, 25 bp, Homo sapien
tatgtttaaatctatgacctacgtt

SEQ ID NO: 618133 - DNA, 25 bp, Homo sapien
atgacctacgttatatgccttttaa

SEQ ID NO: 618134 - DNA, 25 bp, Homo sapien
tttattccatacagaaatacagctg

SEQ ID NO: 618135 - DNA, 25 bp, Homo sapien
gctgttttgttgaaaaggctccctt

SEQ ID NO: 618136 - DNA, 25 bp, Homo sapien
ctgtgagcttgccttttcataggtg

SEQ ID NO: 618137 - DNA, 25 bp, Homo sapien
gagcttgccttttcataggtgtatt

SEQ ID NO: 618138 - DNA, 25 bp, Homo sapien
gaaataacatttagatgttcatctc

SEQ ID NO: 618139 - DNA, 25 bp, Homo sapien
tagatgttcatctcatattgaaaag

SEQ ID NO: 618140 - DNA, 25 bp, Homo sapien
gatgttcatctcatattgaaaagca

SEQ ID NO: 618141 - DNA, 25 bp, Homo sapien
atgttcatctcatattgaaaagcag

SEQ ID NO: 618142 - DNA, 25 bp, Homo sapien
gttcatctcatattgaaaagcagtt

SEQ ID NO: 618143 - DNA, 25 bp, Homo sapien
tcatctcatattgaaaagcagttac

SEQ ID NO: 618144 - DNA, 25 bp, Homo sapien
tctcatattgaaaagcagttactgg

SEQ ID NO: 618145 - DNA, 25 bp, Homo sapien
ctcatattgaaaagcagttactggc

SEQ ID NO: 618146 - DNA, 25 bp, Homo sapien
catattgaaaagcagttactggctg

SEQ ID NO: 618147 - DNA, 25 bp, Homo sapien
atattgaaaagcagttactggctgg

SEQ ID NO: 618148 - DNA, 25 bp, Homo sapien
agatcactcgaggttaggatttcca

SEQ ID NO: 618149 - DNA, 25 bp, Homo sapien
aactacaaaaatactaggactgttg

SEQ ID NO: 618150 - DNA, 25 bp, Homo sapien
caaaaatactaggactgttgaatta

SEQ ID NO: 618151 - DNA, 25 bp, Homo sapien
actaggactgttgaattaggaaatc

SEQ ID NO: 618152 - DNA, 25 bp, Homo sapien
aggactgttgaattaggaaatcata

SEQ ID NO: 618153 - DNA, 25 bp, Homo sapien
ggaaatcatatctattatctgctaa

SEQ ID NO: 618154 - DNA, 25 bp, Homo sapien
gaaatcatatctattatctgctaat

SEQ ID NO: 618155 - DNA, 25 bp, Homo sapien
atatctattatctgctaattgctgg

SEQ ID NO: 618156 - DNA, 25 bp, Homo sapien
atctattatctgctaattgctggag

SEQ ID NO: 618157 - DNA, 25 bp, Homo sapien
ctattatctgctaattgctggagac

SEQ ID NO: 618158 - DNA, 25 bp, Homo sapien
tattatctgctaattgctggagact

SEQ ID NO: 618159 - DNA, 25 bp, Homo sapien
attatctgctaattgctggagactt

SEQ ID NO: 618160 - DNA, 25 bp, Homo sapien
acttaaatcttaagaaatgaactgg

SEQ ID NO: 618161 - DNA, 25 bp, Homo sapien
cttaaatcttaagaaatgaactggt

SEQ ID NO: 618162 - DNA, 25 bp, Homo sapien
ttaaatcttaagaaatgaactggtg

SEQ ID NO: 618163 - DNA, 25 bp, Homo sapien
taaatcttaagaaatgaactggtgg

SEQ ID NO: 618164 - DNA, 25 bp, Homo sapien
aaatcttaagaaatgaactggtggc

SEQ ID NO: 618165 - DNA, 25 bp, Homo sapien
aatcttaagaaatgaactggtggcc

SEQ ID NO: 618166 - DNA, 25 bp, Homo sapien
atcttaagaaatgaactggtggcca

SEQ ID NO: 618167 - DNA, 25 bp, Homo sapien
tcttaagaaatgaactggtggccag

SEQ ID NO: 618168 - DNA, 25 bp, Homo sapien
cttaagaaatgaactggtggccagg

SEQ ID NO: 618169 - DNA, 25 bp, Homo sapien
gtgaaaagtctgtgcatcagtgcat

SEQ ID NO: 618170 - DNA, 25 bp, Homo sapien
gtgcatcagtgcatgtcccaggcat

SEQ ID NO: 618171 - DNA, 25 bp, Homo sapien
gtgcatgtcccaggcatcacacatt

SEQ ID NO: 618172 - DNA, 25 bp, Homo sapien
atcacacattgcctggccgtggcag

SEQ ID NO: 618173 - DNA, 25 bp, Homo sapien
cttcctggtgggatggacccctgcc

SEQ ID NO: 618174 - DNA, 25 bp, Homo sapien
gggatggacccctgccatctcgatt

SEQ ID NO: 618175 - DNA, 25 bp, Homo sapien
tgccatctcgattcctcaatcagct

SEQ ID NO: 618176 - DNA, 25 bp, Homo sapien
tcaatcagctcccttctaccttggg

SEQ ID NO: 618177 - DNA, 25 bp, Homo sapien
ttctaccttgggtcagaccaacttt

SEQ ID NO: 618178 - DNA, 25 bp, Homo sapien
agatctatcctgagaaaccacagta

SEQ ID NO: 618179 - DNA, 25 bp, Homo sapien
accacagtaaatggattcagacctg

SEQ ID NO: 618180 - DNA, 25 bp, Homo sapien
gcttagttacaaggttctcaaacat

SEQ ID NO: 618181 - DNA, 25 bp, Homo sapien
aagatacccagactttattcccaga

SEQ ID NO: 618182 - DNA, 25 bp, Homo sapien
gagattctgattcatcaagtttgag

SEQ ID NO: 618183 - DNA, 25 bp, Homo sapien
agtttgaggagggacctgagaatct

SEQ ID NO: 618184 - DNA, 25 bp, Homo sapien
tctgcattttttcaagctcatggtt

SEQ ID NO: 618185 - DNA, 25 bp, Homo sapien
gataatttgggttgcgacattgtca

SEQ ID NO: 618186 - DNA, 25 bp, Homo sapien
gcgacattgtcattaaggcttcact

SEQ ID NO: 618187 - DNA, 25 bp, Homo sapien
ttaaggcttcactgtgtccagctaa

SEQ ID NO: 618188 - DNA, 25 bp, Homo sapien
gtgtccagctaacttcaattcttga

SEQ ID NO: 618189 - DNA, 25 bp, Homo sapien
taacaagtcagtagaggaacccgaa

SEQ ID NO: 618190 - DNA, 25 bp, Homo sapien
ggaacccgaaatgttagcctgcaat

SEQ ID NO: 618191 - DNA, 25 bp, Homo sapien
gtcacttggcaaaaagggccgaggt

SEQ ID NO: 618192 - DNA, 25 bp, Homo sapien
acttggcaaaaagggccgaggtctg

SEQ ID NO: 618193 - DNA, 25 bp, Homo sapien
ccgaggtctggtgatgtggttccca

SEQ ID NO: 618194 - DNA, 25 bp, Homo sapien
gtctggtgatgtggttcccaggatc

SEQ ID NO: 618195 - DNA, 25 bp, Homo sapien
tctggtgatgtggttcccaggatct

SEQ ID NO: 618196 - DNA, 25 bp, Homo sapien
cccctcctgcagttggactgaattc

SEQ ID NO: 618197 - DNA, 25 bp, Homo sapien
ccctcctgcagttggactgaattct

SEQ ID NO: 618198 - DNA, 25 bp, Homo sapien
gttttcaagtgggtgacggcgctct

SEQ ID NO: 618199 - DNA, 25 bp, Homo sapien
ttcaagtgggtgacggcgctctccg

SEQ ID NO: 618200 - DNA, 25 bp, Homo sapien
gcctgtggagagtgctcggcctaac

SEQ ID NO: 618201 - DNA, 25 bp, Homo sapien
gtggagagtgctcggcctaacctta

SEQ ID NO: 618202 - DNA, 25 bp, Homo sapien
tctctcttctactgtggctcttcta

SEQ ID NO: 618203 - DNA, 25 bp, Homo sapien
ctctcttctactgtggctcttctat

SEQ ID NO: 618204 - DNA, 25 bp, Homo sapien
tctcttctactgtggctcttctatc

SEQ ID NO: 618205 - DNA, 25 bp, Homo sapien
cttctactgtggctcttctatcctg

SEQ ID NO: 618206 - DNA, 25 bp, Homo sapien
ttctactgtggctcttctatcctgg

SEQ ID NO: 618207 - DNA, 25 bp, Homo sapien
tctactgtggctcttctatcctggt

SEQ ID NO: 618208 - DNA, 25 bp, Homo sapien
cgccccaagttactcatttccttag

SEQ ID NO: 618209 - DNA, 25 bp, Homo sapien
gccccaagttactcatttccttagt

SEQ ID NO: 618210 - DNA, 25 bp, Homo sapien
cccaagttactcatttccttagttg

SEQ ID NO: 618211 - DNA, 25 bp, Homo sapien
atgtaagattgcataaatgctcaat

SEQ ID NO: 618212 - DNA, 25 bp, Homo sapien
tgtaagattgcataaatgctcaata

SEQ ID NO: 618213 - DNA, 25 bp, Homo sapien
atctctctcttctccaagcataaag

SEQ ID NO: 618214 - DNA, 25 bp, Homo sapien
cagcagacacactgaattttatatt

SEQ ID NO: 618215 - DNA, 25 bp, Homo sapien
ttatattcaggtttgtccttgccca

SEQ ID NO: 618216 - DNA, 25 bp, Homo sapien
tattcaggtttgtccttgcccagcc

SEQ ID NO: 618217 - DNA, 25 bp, Homo sapien
gaaaaaggcggatctgttggcagca

SEQ ID NO: 618218 - DNA, 25 bp, Homo sapien
aggcggatctgttggcagcagccct

SEQ ID NO: 618219 - DNA, 25 bp, Homo sapien
cagcagcccttatagaaagagaaat

SEQ ID NO: 618220 - DNA, 25 bp, Homo sapien
gaaagagaaattagccatgtgagag

SEQ ID NO: 618221 - DNA, 25 bp, Homo sapien
gacgtggaagaggtcaagttagaca

SEQ ID NO: 618222 - DNA, 25 bp, Homo sapien
gacaaggatttaagagctgaccaag

SEQ ID NO: 618223 - DNA, 25 bp, Homo sapien
gctgaccaaggctagagagggatca

SEQ ID NO: 618224 - DNA, 25 bp, Homo sapien
gatgcacgccataaaaatgaacttt

SEQ ID NO: 618225 - DNA, 25 bp, Homo sapien
attgtatccctttctcgaaagtgtt

SEQ ID NO: 618226 - DNA, 25 bp, Homo sapien
aagtgtttagaacaggcaaacctat

SEQ ID NO: 618227 - DNA, 25 bp, Homo sapien
acaggcaaacctatggagacggaaa

SEQ ID NO: 618228 - DNA, 25 bp, Homo sapien
aatggactggaggttgcctaggact

SEQ ID NO: 618229 - DNA, 25 bp, Homo sapien
taatggctaatggattctttcaagg

SEQ ID NO: 618230 - DNA, 25 bp, Homo sapien
ggattctttcaagggcacggaaaat

SEQ ID NO: 618231 - DNA, 25 bp, Homo sapien
ggtgatggttacataaccctgtgaa

SEQ ID NO: 618232 - DNA, 25 bp, Homo sapien
ggttacataaccctgtgaatctaca

SEQ ID NO: 618233 - DNA, 25 bp, Homo sapien
accctgtgaatctacaaagtcactg

SEQ ID NO: 618234 - DNA, 25 bp, Homo sapien
ctgaattgtacacttgatgttgggt

SEQ ID NO: 618235 - DNA, 25 bp, Homo sapien
tggagggcaacggtacgatctcgac

SEQ ID NO: 618236 - DNA, 25 bp, Homo sapien
ggagggcaacggtacgatctcgaca

SEQ ID NO: 618237 - DNA, 25 bp, Homo sapien
gagggcaacggtacgatctcgacac

SEQ ID NO: 618238 - DNA, 25 bp, Homo sapien
agggcaacggtacgatctcgacaca

SEQ ID NO: 618239 - DNA, 25 bp, Homo sapien
gggcaacggtacgatctcgacacac

SEQ ID NO: 618240 - DNA, 25 bp, Homo sapien
ggcaacggtacgatctcgacacact

SEQ ID NO: 618241 - DNA, 25 bp, Homo sapien
gcaacggtacgatctcgacacactg

SEQ ID NO: 618242 - DNA, 25 bp, Homo sapien
caacggtacgatctcgacacactgc

SEQ ID NO: 618243 - DNA, 25 bp, Homo sapien
aacggtacgatctcgacacactgca

SEQ ID NO: 618244 - DNA, 25 bp, Homo sapien
gaacaggggaagcgaaggttacagt

SEQ ID NO: 618245 - DNA, 25 bp, Homo sapien
aacaggggaagcgaaggttacagtg

SEQ ID NO: 618246 - DNA, 25 bp, Homo sapien
tctctcttctactgtggctcttcta

SEQ ID NO: 618247 - DNA, 25 bp, Homo sapien
ctctcttctactgtggctcttctat

SEQ ID NO: 618248 - DNA, 25 bp, Homo sapien
tctcttctactgtggctcttctatc

SEQ ID NO: 618249 - DNA, 25 bp, Homo sapien
cttctactgtggctcttctatcctg

SEQ ID NO: 618250 - DNA, 25 bp, Homo sapien
ttctactgtggctcttctatcctgg

SEQ ID NO: 618251 - DNA, 25 bp, Homo sapien
tctactgtggctcttctatcctggt

SEQ ID NO: 618252 - DNA, 25 bp, Homo sapien
gccccaagttactcatttccttagt

SEQ ID NO: 618253 - DNA, 25 bp, Homo sapien
cccaagttactcatttccttagttg

SEQ ID NO: 618254 - DNA, 25 bp, Homo sapien
caagttactcatttccttagttgtt

SEQ ID NO: 618255 - DNA, 25 bp, Homo sapien
tgtaagattgcataaatgctcaata

SEQ ID NO: 618256 - DNA, 25 bp, Homo sapien
cagctgcatttttcattgtccgaat

SEQ ID NO: 618257 - DNA, 25 bp, Homo sapien
cagcctgtggtaacctctattctag

SEQ ID NO: 618258 - DNA, 25 bp, Homo sapien
gcctgtggtaacctctattctagtt

SEQ ID NO: 618259 - DNA, 25 bp, Homo sapien
tgtggtaacctctattctagtttct

SEQ ID NO: 618260 - DNA, 25 bp, Homo sapien
acctctattctagtttctgtgtcta

SEQ ID NO: 618261 - DNA, 25 bp, Homo sapien
cctcatataggaggattatacaata

SEQ ID NO: 618262 - DNA, 25 bp, Homo sapien
acttcattcctctttatggctgata

SEQ ID NO: 618263 - DNA, 25 bp, Homo sapien
taccatgttttgcttttcattcatc

SEQ ID NO: 618264 - DNA, 25 bp, Homo sapien
tgatgaacacttgagttcttcccct

SEQ ID NO: 618265 - DNA, 25 bp, Homo sapien
gaacacttgagttcttcccctcttt

SEQ ID NO: 618266 - DNA, 25 bp, Homo sapien
tcttcccctctttcagttattgtga

SEQ ID NO: 618267 - DNA, 25 bp, Homo sapien
cccctctttcagttattgtgagtaa

SEQ ID NO: 618268 - DNA, 25 bp, Homo sapien
gaggaacacaatctcaatcgttgct

SEQ ID NO: 618269 - DNA, 25 bp, Homo sapien
ggaacacaatctcaatcgttgctga

SEQ ID NO: 618270 - DNA, 25 bp, Homo sapien
gaacacaatctcaatcgttgctgaa

SEQ ID NO: 618271 - DNA, 25 bp, Homo sapien
acacaatctcaatcgttgctgaatc

SEQ ID NO: 618272 - DNA, 25 bp, Homo sapien
acaatctcaatcgttgctgaatcct

SEQ ID NO: 618273 - DNA, 25 bp, Homo sapien
caatctcaatcgttgctgaatcctt

SEQ ID NO: 618274 - DNA, 25 bp, Homo sapien
aatctcaatcgttgctgaatccttt

SEQ ID NO: 618275 - DNA, 25 bp, Homo sapien
atctcaatcgttgctgaatcctttc

SEQ ID NO: 618276 - DNA, 25 bp, Homo sapien
tctcaatcgttgctgaatcctttca

SEQ ID NO: 618277 - DNA, 25 bp, Homo sapien
ctcaatcgttgctgaatcctttcat

SEQ ID NO: 618278 - DNA, 25 bp, Homo sapien
caatcgttgctgaatcctttcatat

SEQ ID NO: 618279 - DNA, 25 bp, Homo sapien
gaggttcagaaggtttatcaccctg

SEQ ID NO: 618280 - DNA, 25 bp, Homo sapien
aggtttatcaccctgaagtcatgtg

SEQ ID NO: 618281 - DNA, 25 bp, Homo sapien
gtacacatttctctgcagggcgagt

SEQ ID NO: 618282 - DNA, 25 bp, Homo sapien
atatccccaggtgttctgttaccac

SEQ ID NO: 618283 - DNA, 25 bp, Homo sapien
tctgttaccacctgcaaaaggtaga

SEQ ID NO: 618284 - DNA, 25 bp, Homo sapien
gcaaaaggtagacacgcccgcccga

SEQ ID NO: 618285 - DNA, 25 bp, Homo sapien
ttgctgtgctctgttatagtcctcc

SEQ ID NO: 618286 - DNA, 25 bp, Homo sapien
tgttatagtcctccttgtcgctgca

SEQ ID NO: 618287 - DNA, 25 bp, Homo sapien
actctgggcccctagaactggtgtc

SEQ ID NO: 618288 - DNA, 25 bp, Homo sapien
tggtgtcccagaaagccaccctgct

SEQ ID NO: 618289 - DNA, 25 bp, Homo sapien
gaagacgagcaggtgcacagacccc

SEQ ID NO: 618290 - DNA, 25 bp, Homo sapien
acccaggccttgctgattgtagtgt

SEQ ID NO: 618291 - DNA, 25 bp, Homo sapien
gctgattgtagtgtgatgggtcccc

SEQ ID NO: 618292 - DNA, 25 bp, Homo sapien
taagggtgtatgttcactgtctgaa

SEQ ID NO: 618293 - DNA, 25 bp, Homo sapien
gtatgttcactgtctgaaccctcaa

SEQ ID NO: 618294 - DNA, 25 bp, Homo sapien
gtctgaaccctcaaggccaggcagt

SEQ ID NO: 618295 - DNA, 25 bp, Homo sapien
aaggccaggcagttagtcaaggcca

SEQ ID NO: 618296 - DNA, 25 bp, Homo sapien
aagatatctgaaaacctactaagga

SEQ ID NO: 618297 - DNA, 25 bp, Homo sapien
aaaacagtcccatggcacatacaca

SEQ ID NO: 618298 - DNA, 25 bp, Homo sapien
gtcccatggcacatacacagtaggt

SEQ ID NO: 618299 - DNA, 25 bp, Homo sapien
agatgtgaggcaaagcaggtctcta

SEQ ID NO: 618300 - DNA, 25 bp, Homo sapien
gcaaagcaggtctctagagctgtcc

SEQ ID NO: 618301 - DNA, 25 bp, Homo sapien
tggctcccggcggtaacggcgtcct

SEQ ID NO: 618302 - DNA, 25 bp, Homo sapien
gcggtaacggcgtccttctccgcag

SEQ ID NO: 618303 - DNA, 25 bp, Homo sapien
ggtaacggcgtccttctccgcagca

SEQ ID NO: 618304 - DNA, 25 bp, Homo sapien
ttctccgcagcacgcaggtcttcat

SEQ ID NO: 618305 - DNA, 25 bp, Homo sapien
ggtgagaaggtgtggctgccccgcc

SEQ ID NO: 618306 - DNA, 25 bp, Homo sapien
tactccgcacgtggagctgcctaaa

SEQ ID NO: 618307 - DNA, 25 bp, Homo sapien
actccgcacgtggagctgcctaaat

SEQ ID NO: 618308 - DNA, 25 bp, Homo sapien
gcacgtggagctgcctaaatcctga

SEQ ID NO: 618309 - DNA, 25 bp, Homo sapien
acgtggagctgcctaaatcctgatt

SEQ ID NO: 618310 - DNA, 25 bp, Homo sapien
cgtggagctgcctaaatcctgattt

SEQ ID NO: 618311 - DNA, 25 bp, Homo sapien
gtggagctgcctaaatcctgatttt

SEQ ID NO: 618312 - DNA, 25 bp, Homo sapien
tagtaaatcctgcttgttaacaaga

SEQ ID NO: 618313 - DNA, 25 bp, Homo sapien
acttgaactaattatcttgctcttg

SEQ ID NO: 618314 - DNA, 25 bp, Homo sapien
tatcttgctcttgttttagattcca

SEQ ID NO: 618315 - DNA, 25 bp, Homo sapien
gctttccttgatgaggtactggtct

SEQ ID NO: 618316 - DNA, 25 bp, Homo sapien
tccttgatgaggtactggtctgtct

SEQ ID NO: 618317 - DNA, 25 bp, Homo sapien
gatgaggtactggtctgtctttaat

SEQ ID NO: 618318 - DNA, 25 bp, Homo sapien
ggtactggtctgtctttaatattta

SEQ ID NO: 618319 - DNA, 25 bp, Homo sapien
taaagctttcacttatctccatgac

SEQ ID NO: 618320 - DNA, 25 bp, Homo sapien
gctttcacttatctccatgacattt

SEQ ID NO: 618321 - DNA, 25 bp, Homo sapien
ttcacttatctccatgacatttgga

SEQ ID NO: 618322 - DNA, 25 bp, Homo sapien
gaattatttaggacaactccgataa

SEQ ID NO: 618323 - DNA, 25 bp, Homo sapien
gaaaaacgtgtctgccctgaaaaca

SEQ ID NO: 618324 - DNA, 25 bp, Homo sapien
aggaacaaaggcgtggctgcaccct

SEQ ID NO: 618325 - DNA, 25 bp, Homo sapien
gtgtacctgtgatgcacccgtggtg

SEQ ID NO: 618326 - DNA, 25 bp, Homo sapien
gtggtgcctcgagggacccttctta

SEQ ID NO: 618327 - DNA, 25 bp, Homo sapien
agggacccttcttatgtctgctctt

SEQ ID NO: 618328 - DNA, 25 bp, Homo sapien
acaccctttcgtgcttcagggaaat

SEQ ID NO: 618329 - DNA, 25 bp, Homo sapien
ttcagggaaatctacgtccttctca

SEQ ID NO: 618330 - DNA, 25 bp, Homo sapien
ggaaatctacgtccttctcatctaa

SEQ ID NO: 618331 - DNA, 25 bp, Homo sapien
acgtccttctcatctaaccttgaga

SEQ ID NO: 618332 - DNA, 25 bp, Homo sapien
gagaatgcatcaaggtcaactgtaa

SEQ ID NO: 618333 - DNA, 25 bp, Homo sapien
caaggtcaactgtaacagaccccgt

SEQ ID NO: 618334 - DNA, 25 bp, Homo sapien
tggaaggactctgcactggcgtgaa

SEQ ID NO: 618335 - DNA, 25 bp, Homo sapien
gcactggcgtgaacgggctccatgt

SEQ ID NO: 618336 - DNA, 25 bp, Homo sapien
ggctccatgtacacctggataggct

SEQ ID NO: 618337 - DNA, 25 bp, Homo sapien
tggataggctgatacccacctgaac

SEQ ID NO: 618338 - DNA, 25 bp, Homo sapien
tgaacaggctccatgcagacccgaa

SEQ ID NO: 618339 - DNA, 25 bp, Homo sapien
atgcagacccgaagtcttcacacac

SEQ ID NO: 618340 - DNA, 25 bp, Homo sapien
agtcttcacacacgcccgactggat

SEQ ID NO: 618341 - DNA, 25 bp, Homo sapien
tggattccacacacacctggacagt

SEQ ID NO: 618342 - DNA, 25 bp, Homo sapien
ggtggatgtgccaccatttactgag

SEQ ID NO: 618343 - DNA, 25 bp, Homo sapien
atttactgagctttccctagggagg

SEQ ID NO: 618344 - DNA, 25 bp, Homo sapien
taacttgttcctctccttttacgag

SEQ ID NO: 618345 - DNA, 25 bp, Homo sapien
tatcagcctttacccctgaaaatcc

SEQ ID NO: 618346 - DNA, 25 bp, Homo sapien
aaatccagactgcttatgacaaaag

SEQ ID NO: 618347 - DNA, 25 bp, Homo sapien
gaaaagcatgtttacctacaactta

SEQ ID NO: 618348 - DNA, 25 bp, Homo sapien
caacttagaattgtctttgcccaga

SEQ ID NO: 618349 - DNA, 25 bp, Homo sapien
agaattgtctttgcccagactttga

SEQ ID NO: 618350 - DNA, 25 bp, Homo sapien
gactttgatccttcatggaggccag

SEQ ID NO: 618351 - DNA, 25 bp, Homo sapien
gccagagggccgtggtctagaacaa

SEQ ID NO: 618352 - DNA, 25 bp, Homo sapien
ggcagcaactcataaagatatcctt

SEQ ID NO: 618353 - DNA, 25 bp, Homo sapien
ttgtataattccctttctggcaaag

SEQ ID NO: 618354 - DNA, 25 bp, Homo sapien
ttttttcttaagctatcacgatgta

SEQ ID NO: 618355 - DNA, 25 bp, Homo sapien
attttggacaacagatcctcttggc

SEQ ID NO: 618356 - DNA, 25 bp, Homo sapien
aggcactgccgggcgctgtggctca

SEQ ID NO: 618357 - DNA, 25 bp, Homo sapien
ggcactgccgggcgctgtggctcac

SEQ ID NO: 618358 - DNA, 25 bp, Homo sapien
gcactgccgggcgctgtggctcacg

SEQ ID NO: 618359 - DNA, 25 bp, Homo sapien
cactgccgggcgctgtggctcacgc

SEQ ID NO: 618360 - DNA, 25 bp, Homo sapien
tcaccccatttcactccagcccggg

SEQ ID NO: 618361 - DNA, 25 bp, Homo sapien
caccccatttcactccagcccgggc

SEQ ID NO: 618362 - DNA, 25 bp, Homo sapien
accccatttcactccagcccgggcg

SEQ ID NO: 618363 - DNA, 25 bp, Homo sapien
ccccatttcactccagcccgggcga

SEQ ID NO: 618364 - DNA, 25 bp, Homo sapien
cccatttcactccagcccgggcgac

SEQ ID NO: 618365 - DNA, 25 bp, Homo sapien
gggcgacaagagtgaaactcgacct

SEQ ID NO: 618366 - DNA, 25 bp, Homo sapien
ggcgacaagagtgaaactcgacctc

SEQ ID NO: 618367 - DNA, 25 bp, Homo sapien
taaaatcaaaagaccctcatgccag

SEQ ID NO: 618368 - DNA, 25 bp, Homo sapien
aaaatcaaaagaccctcatgccagc

SEQ ID NO: 618369 - DNA, 25 bp, Homo sapien
aaatcaaaagaccctcatgccagcc

SEQ ID NO: 618370 - DNA, 25 bp, Homo sapien
aatcaaaagaccctcatgccagcca

SEQ ID NO: 618371 - DNA, 25 bp, Homo sapien
atcaaaagaccctcatgccagccag

SEQ ID NO: 618372 - DNA, 25 bp, Homo sapien
tcaaaagaccctcatgccagccagg

SEQ ID NO: 618373 - DNA, 25 bp, Homo sapien
aaaagaccctcatgccagccaggcg

SEQ ID NO: 618374 - DNA, 25 bp, Homo sapien
aaagaccctcatgccagccaggcgc

SEQ ID NO: 618375 - DNA, 25 bp, Homo sapien
agaccctcatgccagccaggcgcag

SEQ ID NO: 618376 - DNA, 25 bp, Homo sapien
gaccctcatgccagccaggcgcagt

SEQ ID NO: 618377 - DNA, 25 bp, Homo sapien
accctcatgccagccaggcgcagtg

SEQ ID NO: 618378 - DNA, 25 bp, Homo sapien
ggaaaagttcattattagaatcctt

SEQ ID NO: 618379 - DNA, 25 bp, Homo sapien
gttcattattagaatccttctctcg

SEQ ID NO: 618380 - DNA, 25 bp, Homo sapien
tcattattagaatccttctctcggc

SEQ ID NO: 618381 - DNA, 25 bp, Homo sapien
cattattagaatccttctctcggct

SEQ ID NO: 618382 - DNA, 25 bp, Homo sapien
attattagaatccttctctcggctg

SEQ ID NO: 618383 - DNA, 25 bp, Homo sapien
ttattagaatccttctctcggctgg

SEQ ID NO: 618384 - DNA, 25 bp, Homo sapien
tattagaatccttctctcggctggg

SEQ ID NO: 618385 - DNA, 25 bp, Homo sapien
attagaatccttctctcggctgggc

SEQ ID NO: 618386 - DNA, 25 bp, Homo sapien
ttagaatccttctctcggctgggcg

SEQ ID NO: 618387 - DNA, 25 bp, Homo sapien
tagaatccttctctcggctgggcgc

SEQ ID NO: 618388 - DNA, 25 bp, Homo sapien
agaatccttctctcggctgggcgcg

SEQ ID NO: 618389 - DNA, 25 bp, Homo sapien
cccctttcagctgttgcttttagga

SEQ ID NO: 618390 - DNA, 25 bp, Homo sapien
gcttttaggatttgtgagacaggct

SEQ ID NO: 618391 - DNA, 25 bp, Homo sapien
agacaggctggagcttggttcagtt

SEQ ID NO: 618392 - DNA, 25 bp, Homo sapien
gcttggttcagttttgggttcatca

SEQ ID NO: 618393 - DNA, 25 bp, Homo sapien
tgggttcatcattccccgggctgtg

SEQ ID NO: 618394 - DNA, 25 bp, Homo sapien
ctgtggcagtgccttccagaacctt

SEQ ID NO: 618395 - DNA, 25 bp, Homo sapien
agtggcaccattccagacctgtgtg

SEQ ID NO: 618396 - DNA, 25 bp, Homo sapien
agacctgtgtgagcccgggacctgc

SEQ ID NO: 618397 - DNA, 25 bp, Homo sapien
ctgccggctcttctttgtgtggatg

SEQ ID NO: 618398 - DNA, 25 bp, Homo sapien
tgtggatgacgtcctgtccgctaaa

SEQ ID NO: 618399 - DNA, 25 bp, Homo sapien
tcatcgcagggctcctgctctatgc

SEQ ID NO: 618400 - DNA, 25 bp, Homo sapien
cgcacgtgtgctacgagcaggcgca

SEQ ID NO: 618401 - DNA, 25 bp, Homo sapien
cacgtgtgctacgagcaggcgcagc

SEQ ID NO: 618402 - DNA, 25 bp, Homo sapien
cagcgcctggttaaggactgggacc

SEQ ID NO: 618403 - DNA, 25 bp, Homo sapien
ctggttaaggactgggacccgcgca

SEQ ID NO: 618404 - DNA, 25 bp, Homo sapien
tggttaaggactgggacccgcgcac

SEQ ID NO: 618405 - DNA, 25 bp, Homo sapien
ttaaggactgggacccgcgcacgcc

SEQ ID NO: 618406 - DNA, 25 bp, Homo sapien
cagcgcggacccctagtgaccccag

SEQ ID NO: 618407 - DNA, 25 bp, Homo sapien
gctgggacctcggagagcagacaca

SEQ ID NO: 618408 - DNA, 25 bp, Homo sapien
gggacctcggagagcagacacagcc

SEQ ID NO: 618409 - DNA, 25 bp, Homo sapien
tccaagcaccctctaggagaattat

SEQ ID NO: 618410 - DNA, 25 bp, Homo sapien
agcaccctctaggagaattataatt

SEQ ID NO: 618411 - DNA, 25 bp, Homo sapien
gggaatactggaatcatgctcagga

SEQ ID NO: 618412 - DNA, 25 bp, Homo sapien
agggatgcaaacttgccccgtgaat

SEQ ID NO: 618413 - DNA, 25 bp, Homo sapien
atttagagacgaccgacaactgccc

SEQ ID NO: 618414 - DNA, 25 bp, Homo sapien
acaactgccctgtactttcagatta

SEQ ID NO: 618415 - DNA, 25 bp, Homo sapien
tttcagattacagccacgtgtggaa

SEQ ID NO: 618416 - DNA, 25 bp, Homo sapien
aaacatcagatgcaatcccagctgc

SEQ ID NO: 618417 - DNA, 25 bp, Homo sapien
aatcccagctgctttcagtacagtc

SEQ ID NO: 618418 - DNA, 25 bp, Homo sapien
agtaaagaattgcttcctcccacaa

SEQ ID NO: 618419 - DNA, 25 bp, Homo sapien
tatcgcccaaacctcaatctatatg

SEQ ID NO: 618420 - DNA, 25 bp, Homo sapien
atgggacatctcaaatgcaatacga

SEQ ID NO: 618421 - DNA, 25 bp, Homo sapien
gagcaaaactgacctaatcccacac

SEQ ID NO: 618422 - DNA, 25 bp, Homo sapien
gtgtgaatacataagaccatgccat

SEQ ID NO: 618423 - DNA, 25 bp, Homo sapien
acataagaccatgccatcattttta

SEQ ID NO: 618424 - DNA, 25 bp, Homo sapien
atcaaagctgttaccttttctgaaa

SEQ ID NO: 618425 - DNA, 25 bp, Homo sapien
aaagaattgttctatttccttgagc

SEQ ID NO: 618426 - DNA, 25 bp, Homo sapien
atttccttgagctcattgtgatgaa

SEQ ID NO: 618427 - DNA, 25 bp, Homo sapien
attgtgatgaatcttgagtctcccc

SEQ ID NO: 618428 - DNA, 25 bp, Homo sapien
gagtctcccctcaagaattaagctg

SEQ ID NO: 618429 - DNA, 25 bp, Homo sapien
aattaagctgtgttctggaagatga

SEQ ID NO: 618430 - DNA, 25 bp, Homo sapien
cctccccaaagttataccaagacat

SEQ ID NO: 618431 - DNA, 25 bp, Homo sapien
ttggaatatgcttttctattatatc

SEQ ID NO: 618432 - DNA, 25 bp, Homo sapien
gagagacatttcatacttggtattt

SEQ ID NO: 618433 - DNA, 25 bp, Homo sapien
ttgatatctgattctgttgtaggaa

SEQ ID NO: 618434 - DNA, 25 bp, Homo sapien
aaaatgggacacaggcaagtaaatt

SEQ ID NO: 618435 - DNA, 25 bp, Homo sapien
aattgatttatgatgctttcaacca

SEQ ID NO: 618436 - DNA, 25 bp, Homo sapien
gatgctttcaaccaagcttcacaaa

SEQ ID NO: 618437 - DNA, 25 bp, Homo sapien
accaagcttcacaaaattagtacta

SEQ ID NO: 618438 - DNA, 25 bp, Homo sapien
ttatcatattctaataacctgtcat

SEQ ID NO: 618439 - DNA, 25 bp, Homo sapien
taacctgtcataaacctagcatatt

SEQ ID NO: 618440 - DNA, 25 bp, Homo sapien
gcatattttaggtctccttagtgga

SEQ ID NO: 618441 - DNA, 25 bp, Homo sapien
aaattagttattgagttcttggctg

SEQ ID NO: 618442 - DNA, 25 bp, Homo sapien
gagttcttggctgtactagagaatt

SEQ ID NO: 618443 - DNA, 25 bp, Homo sapien
attgtgtggctcttaattgatgttt

SEQ ID NO: 618444 - DNA, 25 bp, Homo sapien
aagcatgaactactgattttgtttt

SEQ ID NO: 618445 - DNA, 25 bp, Homo sapien
agcatgaactactgattttgttttc

SEQ ID NO: 618446 - DNA, 25 bp, Homo sapien
gttttcatgaaaattcacatttgaa

SEQ ID NO: 618447 - DNA, 25 bp, Homo sapien
ttttcaaaagtactgtaaacggcag

SEQ ID NO: 618448 - DNA, 25 bp, Homo sapien
tttcaaaagtactgtaaacggcagg

SEQ ID NO: 618449 - DNA, 25 bp, Homo sapien
ttcaaaagtactgtaaacggcagga

SEQ ID NO: 618450 - DNA, 25 bp, Homo sapien
tcaaaagtactgtaaacggcaggaa

SEQ ID NO: 618451 - DNA, 25 bp, Homo sapien
aagtactgtaaacggcaggaaagat

SEQ ID NO: 618452 - DNA, 25 bp, Homo sapien
tactgtaaacggcaggaaagatcca

SEQ ID NO: 618453 - DNA, 25 bp, Homo sapien
actgtaaacggcaggaaagatccaa

SEQ ID NO: 618454 - DNA, 25 bp, Homo sapien
aaacggcaggaaagatccaaaattg

SEQ ID NO: 618455 - DNA, 25 bp, Homo sapien
ggatgcacagtgtcagtttgacccc

SEQ ID NO: 618456 - DNA, 25 bp, Homo sapien
ccgtttctggccagggcaccgtggt

SEQ ID NO: 618457 - DNA, 25 bp, Homo sapien
agccccactgacttcagctgctggg

SEQ ID NO: 618458 - DNA, 25 bp, Homo sapien
agagccgtgagaagagtcgatcccc

SEQ ID NO: 618459 - DNA, 25 bp, Homo sapien
gggcttcatgtgtctttttgctgca

SEQ ID NO: 618460 - DNA, 25 bp, Homo sapien
ggcttcatgtgtctttttgctgcat

SEQ ID NO: 618461 - DNA, 25 bp, Homo sapien
tgctgcattttactcacacacgacc

SEQ ID NO: 618462 - DNA, 25 bp, Homo sapien
acgaccctcctagtccatgtaagag

SEQ ID NO: 618463 - DNA, 25 bp, Homo sapien
gaccctcctagtccatgtaagagaa

SEQ ID NO: 618464 - DNA, 25 bp, Homo sapien
cctcctagtccatgtaagagaagat

SEQ ID NO: 618465 - DNA, 25 bp, Homo sapien
aatataagcttcacagaccagcgtt

SEQ ID NO: 618466 - DNA, 25 bp, Homo sapien
gctgtgtggtgcaggccaaacgctc

SEQ ID NO: 618467 - DNA, 25 bp, Homo sapien
agcactggccttggaggtgaccaca

SEQ ID NO: 618468 - DNA, 25 bp, Homo sapien
agagaaatgacctgatggccagaaa

SEQ ID NO: 618469 - DNA, 25 bp, Homo sapien
tgatggccagaaaacccaccgtgat

SEQ ID NO: 618470 - DNA, 25 bp, Homo sapien
aacccaccgtgatatttaccaactg

SEQ ID NO: 618471 - DNA, 25 bp, Homo sapien
atatttaccaactgcactcaattta

SEQ ID NO: 618472 - DNA, 25 bp, Homo sapien
aaagcaaatccctaaaccatcacgt

SEQ ID NO: 618473 - DNA, 25 bp, Homo sapien
aaccatcacgtgtgcctaataaatg

SEQ ID NO: 618474 - DNA, 25 bp, Homo sapien
taaatggctaagaccagtttctaaa

SEQ ID NO: 618475 - DNA, 25 bp, Homo sapien
gcctttacaaaatgaaacccagcca

SEQ ID NO: 618476 - DNA, 25 bp, Homo sapien
gaaacccagccattgtttaggaaca

SEQ ID NO: 618477 - DNA, 25 bp, Homo sapien
gacagggaaaatgtccacattgctc

SEQ ID NO: 618478 - DNA, 25 bp, Homo sapien
aaatgtccacattgctctacggata

SEQ ID NO: 618479 - DNA, 25 bp, Homo sapien
gtccacattgctctacggatacaaa

SEQ ID NO: 618480 - DNA, 25 bp, Homo sapien
gctctacggatacaaagtttcagtt

SEQ ID NO: 618481 - DNA, 25 bp, Homo sapien
ttctattgcacagcacagtgtctat

SEQ ID NO: 618482 - DNA, 25 bp, Homo sapien
acagcacagtgtctatagttaatag

SEQ ID NO: 618483 - DNA, 25 bp, Homo sapien
tttaatgttctcaccgcaacgaaat

SEQ ID NO: 618484 - DNA, 25 bp, Homo sapien
gttctcaccgcaacgaaataattgt

SEQ ID NO: 618485 - DNA, 25 bp, Homo sapien
gctaattagcctgatttgctcattc

SEQ ID NO: 618486 - DNA, 25 bp, Homo sapien
ttagcctgatttgctcattccacag

SEQ ID NO: 618487 - DNA, 25 bp, Homo sapien
ctgatttgctcattccacagtgtat

SEQ ID NO: 618488 - DNA, 25 bp, Homo sapien
tggaagggtccaattgactagaaat

SEQ ID NO: 618489 - DNA, 25 bp, Homo sapien
atagtttagagattcatatggagac

SEQ ID NO: 618490 - DNA, 25 bp, Homo sapien
tatggagacatcatgaagcctgcct

SEQ ID NO: 618491 - DNA, 25 bp, Homo sapien
tgccccttatacttgggctctctgt

SEQ ID NO: 618492 - DNA, 25 bp, Homo sapien
aggagagtgaagtctacagcctaga

SEQ ID NO: 618493 - DNA, 25 bp, Homo sapien
aagtctacagcctagagggtgccct

SEQ ID NO: 618494 - DNA, 25 bp, Homo sapien
ccctgtgtgtggtgtcagatgtaac

SEQ ID NO: 618495 - DNA, 25 bp, Homo sapien
gtggtgtcagatgtaacctttcaca

SEQ ID NO: 618496 - DNA, 25 bp, Homo sapien
gatgtaacctttcacatgggatgtg

SEQ ID NO: 618497 - DNA, 25 bp, Homo sapien
gtgtgtgctgtgagcattgtgctat

SEQ ID NO: 618498 - DNA, 25 bp, Homo sapien
gaatggttagtattttgtgtttaca

SEQ ID NO: 618499 - DNA, 25 bp, Homo sapien
ggcgcttgccagcattagctgcaga

SEQ ID NO: 618500 - DNA, 25 bp, Homo sapien
ttgccagcattagctgcagagtcga

SEQ ID NO: 618501 - DNA, 25 bp, Homo sapien
cagcattagctgcagagtcgacaga

SEQ ID NO: 618502 - DNA, 25 bp, Homo sapien
ttagctgcagagtcgacagagacga

SEQ ID NO: 618503 - DNA, 25 bp, Homo sapien
cagagacgaggagataatgtgtgaa

SEQ ID NO: 618504 - DNA, 25 bp, Homo sapien
gagattgttcagtgtgcagggcaga

SEQ ID NO: 618505 - DNA, 25 bp, Homo sapien
atctgtgctgaggttttgcagggat

SEQ ID NO: 618506 - DNA, 25 bp, Homo sapien
gttttgcagggatcagctggctgtc

SEQ ID NO: 618507 - DNA, 25 bp, Homo sapien
gtgccatgacaggtggctgccacgc

SEQ ID NO: 618508 - DNA, 25 bp, Homo sapien
aggtggctgccacgcacagcaatgc

SEQ ID NO: 618509 - DNA, 25 bp, Homo sapien
ggctgccacgcacagcaatgctgtg

SEQ ID NO: 618510 - DNA, 25 bp, Homo sapien
acaaatcaagcttggattccaggga

SEQ ID NO: 618511 - DNA, 25 bp, Homo sapien
aattttaccattcactcttaaggct

SEQ ID NO: 618512 - DNA, 25 bp, Homo sapien
tcaagagaaaaccatgcagcattat

SEQ ID NO: 618513 - DNA, 25 bp, Homo sapien
agcattatgttcactgccaagtaat

SEQ ID NO: 618514 - DNA, 25 bp, Homo sapien
atggaagaattctgtaaaaccactt

SEQ ID NO: 618515 - DNA, 25 bp, Homo sapien
aaaaccacttctggagttcaacatt

SEQ ID NO: 618516 - DNA, 25 bp, Homo sapien
ggagttcaacatttaaccgagcaca

SEQ ID NO: 618517 - DNA, 25 bp, Homo sapien
accgagcacattttacttacctgtt

SEQ ID NO: 618518 - DNA, 25 bp, Homo sapien
acctgttaccagtgtgtcgcttgga

SEQ ID NO: 618519 - DNA, 25 bp, Homo sapien
gtgtgtcgcttggaatgtcttctat

SEQ ID NO: 618520 - DNA, 25 bp, Homo sapien
tgtcttctattaggcatttctcctc

SEQ ID NO: 618521 - DNA, 25 bp, Homo sapien
ttctcaggaattttgcaaagtggtt

SEQ ID NO: 618522 - DNA, 25 bp, Homo sapien
caaagtggttattaaacccagccat

SEQ ID NO: 618523 - DNA, 25 bp, Homo sapien
gtggttattaaacccagccattatt

SEQ ID NO: 618524 - DNA, 25 bp, Homo sapien
aaaattaaatcatagcctgggtgca

SEQ ID NO: 618525 - DNA, 25 bp, Homo sapien
gtaatatcaacactttgggacgccg

SEQ ID NO: 618526 - DNA, 25 bp, Homo sapien
ttgggacgccgaggcaggagttgag

SEQ ID NO: 618527 - DNA, 25 bp, Homo sapien
aggccaggtgtttaagatcgagtga

SEQ ID NO: 618528 - DNA, 25 bp, Homo sapien
ccaggtgtttaagatcgagtgagac

SEQ ID NO: 618529 - DNA, 25 bp, Homo sapien
gtgtttaagatcgagtgagacctca

SEQ ID NO: 618530 - DNA, 25 bp, Homo sapien
gtttaagatcgagtgagacctcatc

SEQ ID NO: 618531 - DNA, 25 bp, Homo sapien
cttggaagactgaggtgaaagaatt

SEQ ID NO: 618532 - DNA, 25 bp, Homo sapien
agggaagttggaatcctggcgctca

SEQ ID NO: 618533 - DNA, 25 bp, Homo sapien
tggcgctcagcttagtcctgctgac

SEQ ID NO: 618534 - DNA, 25 bp, Homo sapien
gctgacctttcacagttcaggcgag

SEQ ID NO: 618535 - DNA, 25 bp, Homo sapien
acagttcaggcgagccaggcttgta

SEQ ID NO: 618536 - DNA, 25 bp, Homo sapien
aagattgagcactgcactctgagca

SEQ ID NO: 618537 - DNA, 25 bp, Homo sapien
tcctgcccagatcaagtggccagaa

SEQ ID NO: 618538 - DNA, 25 bp, Homo sapien
tggtcccatctccttcgaggtggca

SEQ ID NO: 618539 - DNA, 25 bp, Homo sapien
gaggtggcatccttcaacgggcaca

SEQ ID NO: 618540 - DNA, 25 bp, Homo sapien
acacctgaagtggatggctgccagt

SEQ ID NO: 618541 - DNA, 25 bp, Homo sapien
agttatcacaggtcagcagagcttc

SEQ ID NO: 618542 - DNA, 25 bp, Homo sapien
gcagagcttcatgccattttgcttc

SEQ ID NO: 618543 - DNA, 25 bp, Homo sapien
ggtcaaagactccaggctaagccat

SEQ ID NO: 618544 - DNA, 25 bp, Homo sapien
ccaggctaagccattttcatcaaag

SEQ ID NO: 618545 - DNA, 25 bp, Homo sapien
gtatttcacgtggtcatcttaggag

SEQ ID NO: 618546 - DNA, 25 bp, Homo sapien
ctagttgaaagtcacttctcctgct

SEQ ID NO: 618547 - DNA, 25 bp, Homo sapien
tctcctgctggttgtccaggaaatc

SEQ ID NO: 618548 - DNA, 25 bp, Homo sapien
aatctgggagagatgttgcttactc

SEQ ID NO: 618549 - DNA, 25 bp, Homo sapien
gttgcttactcttgatcatccatga

SEQ ID NO: 618550 - DNA, 25 bp, Homo sapien
gtggtcctagcgcatgatttcaaag

SEQ ID NO: 618551 - DNA, 25 bp, Homo sapien
ggtctggagacctgaaagcatttgt

SEQ ID NO: 618552 - DNA, 25 bp, Homo sapien
aagcatttgttcatgtccagagctt

SEQ ID NO: 618553 - DNA, 25 bp, Homo sapien
ccaagatactgttcctagggcaatg

SEQ ID NO: 618554 - DNA, 25 bp, Homo sapien
gaaggtcagggcacagaacgaattt

SEQ ID NO: 618555 - DNA, 25 bp, Homo sapien
gcacagaacgaatttggatcctgga

SEQ ID NO: 618556 - DNA, 25 bp, Homo sapien
gatcctggagctcccgagactgcag

SEQ ID NO: 618557 - DNA, 25 bp, Homo sapien
gagactcagaaacaggacggcagca

SEQ ID NO: 618558 - DNA, 25 bp, Homo sapien
tccctcgagttctttcacaaggagc

SEQ ID NO: 618559 - DNA, 25 bp, Homo sapien
gttctttcacaaggagcctgtgttt

SEQ ID NO: 618560 - DNA, 25 bp, Homo sapien
catcaccatggctgttccagattaa

SEQ ID NO: 618561 - DNA, 25 bp, Homo sapien
gaagacagcttatctaagcgcacac

SEQ ID NO: 618562 - DNA, 25 bp, Homo sapien
aagcgcacacaatgaatgcacagag

SEQ ID NO: 618563 - DNA, 25 bp, Homo sapien
gcacagaggattcaaggtccccaat

SEQ ID NO: 618564 - DNA, 25 bp, Homo sapien
atccccagatcccagtcatattaag

SEQ ID NO: 618565 - DNA, 25 bp, Homo sapien
caaagtggttattaaacccagccat

SEQ ID NO: 618566 - DNA, 25 bp, Homo sapien
agtggttattaaacccagccattat

SEQ ID NO: 618567 - DNA, 25 bp, Homo sapien
gtggttattaaacccagccattatt

SEQ ID NO: 618568 - DNA, 25 bp, Homo sapien
aaaaattaaatcatagcctgggtgc

SEQ ID NO: 618569 - DNA, 25 bp, Homo sapien
aaaattaaatcatagcctgggtgca

SEQ ID NO: 618570 - DNA, 25 bp, Homo sapien
aggccaggtgtttaagatcgagtga

SEQ ID NO: 618571 - DNA, 25 bp, Homo sapien
gccaggtgtttaagatcgagtgaga

SEQ ID NO: 618572 - DNA, 25 bp, Homo sapien
ccaggtgtttaagatcgagtgagac

SEQ ID NO: 618573 - DNA, 25 bp, Homo sapien
gtgtttaagatcgagtgagacctca

SEQ ID NO: 618574 - DNA, 25 bp, Homo sapien
gtttaagatcgagtgagacctcatc

SEQ ID NO: 618575 - DNA, 25 bp, Homo sapien
cttggaagactgaggtgaaagaatt

SEQ ID NO: 618576 - DNA, 25 bp, Homo sapien
cgctgctgagtgtgacgtggaatct

SEQ ID NO: 618577 - DNA, 25 bp, Homo sapien
gagtgtgacgtggaatcttcttatt

SEQ ID NO: 618578 - DNA, 25 bp, Homo sapien
acaagtcaggtggaacatctcgaat

SEQ ID NO: 618579 - DNA, 25 bp, Homo sapien
catctcgaatatgtttctgggccat

SEQ ID NO: 618580 - DNA, 25 bp, Homo sapien
atgtttctgggccatttgattttcc

SEQ ID NO: 618581 - DNA, 25 bp, Homo sapien
ttgattttcctgcaagtcacctgtt

SEQ ID NO: 618582 - DNA, 25 bp, Homo sapien
aagtcacctgttccagttctttgcc

SEQ ID NO: 618583 - DNA, 25 bp, Homo sapien
ccatttcctgttgggttggtcaata

SEQ ID NO: 618584 - DNA, 25 bp, Homo sapien
acacgttggatacgtggctggcctt

SEQ ID NO: 618585 - DNA, 25 bp, Homo sapien
tttggcttgcctttgacttcgtttg

SEQ ID NO: 618586 - DNA, 25 bp, Homo sapien
ttgttctatcgaagcatgtgcagaa

SEQ ID NO: 618587 - DNA, 25 bp, Homo sapien
gaaaccctcacacgtgggaataggg

SEQ ID NO: 618588 - DNA, 25 bp, Homo sapien
gggaatagggacaagaacactcatt

SEQ ID NO: 618589 - DNA, 25 bp, Homo sapien
gaacactcattgctgcactgtttat

SEQ ID NO: 618590 - DNA, 25 bp, Homo sapien
ggagtgaccgaaatgtccatcttaa

SEQ ID NO: 618591 - DNA, 25 bp, Homo sapien
aaataccttgtgttacagctgcaca

SEQ ID NO: 618592 - DNA, 25 bp, Homo sapien
gaaaccgactccatacgtgagcatg

SEQ ID NO: 618593 - DNA, 25 bp, Homo sapien
atacgtgagcatggaggagcagccc

SEQ ID NO: 618594 - DNA, 25 bp, Homo sapien
agcagccccagcatggcagtgagca

SEQ ID NO: 618595 - DNA, 25 bp, Homo sapien
ggcagtgagcagcacaaaccagtca

SEQ ID NO: 618596 - DNA, 25 bp, Homo sapien
tgaaagcatcattgtgacaccattt

SEQ ID NO: 618597 - DNA, 25 bp, Homo sapien
gaaaacgtacacacatgcagaataa

SEQ ID NO: 618598 - DNA, 25 bp, Homo sapien
ttgccagagctgcatacctgaaggt

SEQ ID NO: 618599 - DNA, 25 bp, Homo sapien
gagctgcatacctgaaggtcacagt

SEQ ID NO: 618600 - DNA, 25 bp, Homo sapien
gaaggtcacagtgtcttccgggaca

SEQ ID NO: 618601 - DNA, 25 bp, Homo sapien
gtcacagtgtcttccgggacagctg

SEQ ID NO: 618602 - DNA, 25 bp, Homo sapien
ggagatcaattatcctgagaactca

SEQ ID NO: 618603 - DNA, 25 bp, Homo sapien
gagaactcaactcagccagtgacat

SEQ ID NO: 618604 - DNA, 25 bp, Homo sapien
aagggatgggacgtagttgacactt

SEQ ID NO: 618605 - DNA, 25 bp, Homo sapien
gtagttgacacttgtgggacccttt

SEQ ID NO: 618606 - DNA, 25 bp, Homo sapien
ttgtgggaccctttctattctaaag

SEQ ID NO: 618607 - DNA, 25 bp, Homo sapien
gggaccctttctattctaaagccag

SEQ ID NO: 618608 - DNA, 25 bp, Homo sapien
ttctattctaaagccagagtgcttg

SEQ ID NO: 618609 - DNA, 25 bp, Homo sapien
aagggcagtgtctgtataaaggaca

SEQ ID NO: 618610 - DNA, 25 bp, Homo sapien
agagtgttttacattactggaaaga

SEQ ID NO: 618611 - DNA, 25 bp, Homo sapien
ggtttaagcacaattttctataagt

SEQ ID NO: 618612 - DNA, 25 bp, Homo sapien
ggttctttacagtattgactcacag

SEQ ID NO: 618613 - DNA, 25 bp, Homo sapien
gactcacagctacttaaatgaccta

SEQ ID NO: 618614 - DNA, 25 bp, Homo sapien
cctaaacatgtggtggagacgggac

SEQ ID NO: 618615 - DNA, 25 bp, Homo sapien
gagacgggacacttgctgtttctgc

SEQ ID NO: 618616 - DNA, 25 bp, Homo sapien
gctgtttctgctacagacactgact

SEQ ID NO: 618617 - DNA, 25 bp, Homo sapien
ctacagacactgacttttggaatgt

SEQ ID NO: 618618 - DNA, 25 bp, Homo sapien
gtgggtaaaaggctgtttgtatctc

SEQ ID NO: 618619 - DNA, 25 bp, Homo sapien
tatctctctgaattggccttacgtt

SEQ ID NO: 618620 - DNA, 25 bp, Homo sapien
agctactgcacacgtgcacccagaa

SEQ ID NO: 618621 - DNA, 25 bp, Homo sapien
cagaagaccgcccagaacatgcttg

SEQ ID NO: 618622 - DNA, 25 bp, Homo sapien
agaccgcccagaacatgcttgctag

SEQ ID NO: 618623 - DNA, 25 bp, Homo sapien
tgcttgctagtaacacctcttccca

SEQ ID NO: 618624 - DNA, 25 bp, Homo sapien
tcccataaagggagtttctccagca

SEQ ID NO: 618625 - DNA, 25 bp, Homo sapien
aaagggagtttctccagcagtgatc

SEQ ID NO: 618626 - DNA, 25 bp, Homo sapien
cagtgatcaatgctgtctcatcctt

SEQ ID NO: 618627 - DNA, 25 bp, Homo sapien
ttaggagcagcccaccctgaatcct

SEQ ID NO: 618628 - DNA, 25 bp, Homo sapien
aatcctctcagggtgtacagtttat

SEQ ID NO: 618629 - DNA, 25 bp, Homo sapien
gggtgtacagtttattttgcactta

SEQ ID NO: 618630 - DNA, 25 bp, Homo sapien
cagtttattttgcacttaactttca

SEQ ID NO: 618631 - DNA, 25 bp, Homo sapien
ttatgtaactactcccagcatgaat

SEQ ID NO: 618632 - DNA, 25 bp, Homo sapien
tgaatgattttagcctctcaaggtg

SEQ ID NO: 618633 - DNA, 25 bp, Homo sapien
tagcctctcaaggtgatatcactaa

SEQ ID NO: 618634 - DNA, 25 bp, Homo sapien
cagttggctctcaagagacaatatg

SEQ ID NO: 618635 - DNA, 25 bp, Homo sapien
caatcccagtgcactactgaatata

SEQ ID NO: 618636 - DNA, 25 bp, Homo sapien
aaaggagccccattctacaagatac

SEQ ID NO: 618637 - DNA, 25 bp, Homo sapien
gagaaaccagattcattctacatgg

SEQ ID NO: 618638 - DNA, 25 bp, Homo sapien
acatggttacaacaggcatctttga

SEQ ID NO: 618639 - DNA, 25 bp, Homo sapien
aagtgatgcttgttctgatacctga

SEQ ID NO: 618640 - DNA, 25 bp, Homo sapien
gttctgatacctgaaatatgagtgg

SEQ ID NO: 618641 - DNA, 25 bp, Homo sapien
gagtggatgttaaccaggcaaggaa

SEQ ID NO: 618642 - DNA, 25 bp, Homo sapien
aggaaacttcccatcacaataacaa

SEQ ID NO: 618643 - DNA, 25 bp, Homo sapien
caaaggttcaatattctatttcaaa

SEQ ID NO: 618644 - DNA, 25 bp, Homo sapien
gttgaggtaacacagcagttggaat

SEQ ID NO: 618645 - DNA, 25 bp, Homo sapien
ggttgagtatttacacaatgcaaga

SEQ ID NO: 618646 - DNA, 25 bp, Homo sapien
aaatggaattatgtaggttgcgttg

SEQ ID NO: 618647 - DNA, 25 bp, Homo sapien
gttgcgttgaccttgtagaacctga

SEQ ID NO: 618648 - DNA, 25 bp, Homo sapien
tgtagaacctgagttatgacaagct

SEQ ID NO: 618649 - DNA, 25 bp, Homo sapien
gacaagcttcctgaagtattttgga

SEQ ID NO: 618650 - DNA, 25 bp, Homo sapien
aagatagtacttccggaaaggacat

SEQ ID NO: 618651 - DNA, 25 bp, Homo sapien
aacagtggacaatcaatcttgggac

SEQ ID NO: 618652 - DNA, 25 bp, Homo sapien
aatcaatcttgggactatgaatttt

SEQ ID NO: 618653 - DNA, 25 bp, Homo sapien
tattcttcacaatttatggtcctga

SEQ ID NO: 618654 - DNA, 25 bp, Homo sapien
ttcttcacaatttatggtcctgaga

SEQ ID NO: 618655 - DNA, 25 bp, Homo sapien
ttcacaatttatggtcctgagacta

SEQ ID NO: 618656 - DNA, 25 bp, Homo sapien
cacaatttatggtcctgagactacg

SEQ ID NO: 618657 - DNA, 25 bp, Homo sapien
caatttatggtcctgagactacgga

SEQ ID NO: 618658 - DNA, 25 bp, Homo sapien
atttatggtcctgagactacggagg

SEQ ID NO: 618659 - DNA, 25 bp, Homo sapien
tatggtcctgagactacggagggat

SEQ ID NO: 618660 - DNA, 25 bp, Homo sapien
tggtcctgagactacggagggatct

SEQ ID NO: 618661 - DNA, 25 bp, Homo sapien
gtcctgagactacggagggatctac

SEQ ID NO: 618662 - DNA, 25 bp, Homo sapien
cctgagactacggagggatctacca

SEQ ID NO: 618663 - DNA, 25 bp, Homo sapien
tgagactacggagggatctaccaga

SEQ ID NO: 618664 - DNA, 25 bp, Homo sapien
tctctctctgaaattatcttgctta

SEQ ID NO: 618665 - DNA, 25 bp, Homo sapien
tgtgtgtgtatcacccatctttcca

SEQ ID NO: 618666 - DNA, 25 bp, Homo sapien
gtatcacccatctttccactggaat

SEQ ID NO: 618667 - DNA, 25 bp, Homo sapien
gagccttgtgatgtcaggctgttaa

SEQ ID NO: 618668 - DNA, 25 bp, Homo sapien
gttaagatttcaggccctggtgaaa

SEQ ID NO: 618669 - DNA, 25 bp, Homo sapien
aaaacatgttcaggatgccctctct

SEQ ID NO: 618670 - DNA, 25 bp, Homo sapien
tcccctttgcccagcaagagtggac

SEQ ID NO: 618671 - DNA, 25 bp, Homo sapien
gactgattaaagttggacctgaggt

SEQ ID NO: 618672 - DNA, 25 bp, Homo sapien
gacctgaggtttccatgaatatgca

SEQ ID NO: 618673 - DNA, 25 bp, Homo sapien
aatatgcaaccgagtcattctgacg

SEQ ID NO: 618674 - DNA, 25 bp, Homo sapien
attctgacgacagtgagtcctggcc

SEQ ID NO: 618675 - DNA, 25 bp, Homo sapien
gtgccatccgcgtgacgctaggtca

SEQ ID NO: 618676 - DNA, 25 bp, Homo sapien
tgacgctaggtcagcgctgccggtt

SEQ ID NO: 618677 - DNA, 25 bp, Homo sapien
agcgctgccggttctttaccaaatg

SEQ ID NO: 618678 - DNA, 25 bp, Homo sapien
gttctttaccaaatgtgcttgcttc

SEQ ID NO: 618679 - DNA, 25 bp, Homo sapien
tgcttctcctaagttatttataaag

SEQ ID NO: 618680 - DNA, 25 bp, Homo sapien
gaaatcactaatggactctactggt

SEQ ID NO: 618681 - DNA, 25 bp, Homo sapien
tctactggtttgagtgcttctgagc

SEQ ID NO: 618682 - DNA, 25 bp, Homo sapien
gtgcttctgagctggatgaccgacc

SEQ ID NO: 618683 - DNA, 25 bp, Homo sapien
tgagctggatgaccgaccgcctgta

SEQ ID NO: 618684 - DNA, 25 bp, Homo sapien
accgaccgcctgtatgtttgtgtaa

SEQ ID NO: 618685 - DNA, 25 bp, Homo sapien
ccgcctgtatgtttgtgtaattaat

SEQ ID NO: 618686 - DNA, 25 bp, Homo sapien
gggtagtagagtcattttaataatc

SEQ ID NO: 618687 - DNA, 25 bp, Homo sapien
ttaataatcataattcttccaatcc

SEQ ID NO: 618688 - DNA, 25 bp, Homo sapien
catgagcatgggatgtttttctcat

SEQ ID NO: 618689 - DNA, 25 bp, Homo sapien
gtagttttccttgtagggatctgtc

SEQ ID NO: 618690 - DNA, 25 bp, Homo sapien
tccttgtagggatctgtcatctctt

SEQ ID NO: 618691 - DNA, 25 bp, Homo sapien
gggatctgtcatctctttgactaat

SEQ ID NO: 618692 - DNA, 25 bp, Homo sapien
tttgactaattgtatttctaagcat

SEQ ID NO: 618693 - DNA, 25 bp, Homo sapien
gacattttaattcggttctcagctt

SEQ ID NO: 618694 - DNA, 25 bp, Homo sapien
aattcggttctcagcttgatcacca

SEQ ID NO: 618695 - DNA, 25 bp, Homo sapien
ttctcagcttgatcaccattagtgt

SEQ ID NO: 618696 - DNA, 25 bp, Homo sapien
aatgctactaatttctgtaagttga

SEQ ID NO: 618697 - DNA, 25 bp, Homo sapien
aaaactcctatcatctgcaaacctt

SEQ ID NO: 618698 - DNA, 25 bp, Homo sapien
tctgcaaacctttgggtaaatccat

SEQ ID NO: 618699 - DNA, 25 bp, Homo sapien
aatccattaatacatggctcagatg

SEQ ID NO: 618700 - DNA, 25 bp, Homo sapien
ggctcagatgagcaaaccagtgcag

SEQ ID NO: 618701 - DNA, 25 bp, Homo sapien
accagtgcagtggttgctgaaaact

SEQ ID NO: 618702 - DNA, 25 bp, Homo sapien
ggttgctgaaaactgtaggccagat

SEQ ID NO: 618703 - DNA, 25 bp, Homo sapien
ctggtggtcttggagccactggaat

SEQ ID NO: 618704 - DNA, 25 bp, Homo sapien
ttaaaaatacagatccccagccggt

SEQ ID NO: 618705 - DNA, 25 bp, Homo sapien
agccggtgccttgggtcacgcctgt

SEQ ID NO: 618706 - DNA, 25 bp, Homo sapien
acacagggagaatcccgtctctaca

SEQ ID NO: 618707 - DNA, 25 bp, Homo sapien
tctacaaaaaatatcgggctacagg

SEQ ID NO: 618708 - DNA, 25 bp, Homo sapien
gctactttctgcagaggttaggtac

SEQ ID NO: 618709 - DNA, 25 bp, Homo sapien
ggtactatagacattaggatcagga

SEQ ID NO: 618710 - DNA, 25 bp, Homo sapien
taaatttttctctaggagacacgga

SEQ ID NO: 618711 - DNA, 25 bp, Homo sapien
cacggaaaggaatttgttcagctct

SEQ ID NO: 618712 - DNA, 25 bp, Homo sapien
ggaatttgttcagctcttgagagat

SEQ ID NO: 618713 - DNA, 25 bp, Homo sapien
acaggaggcttttaagaagcatcca

SEQ ID NO: 618714 - DNA, 25 bp, Homo sapien
aagaagcatccaacagcaactgtct

SEQ ID NO: 618715 - DNA, 25 bp, Homo sapien
gcaactgtctcctttctagttattt

SEQ ID NO: 618716 - DNA, 25 bp, Homo sapien
ttctattacttcagccttacctcct

SEQ ID NO: 618717 - DNA, 25 bp, Homo sapien
caacttcagcacctcattataatat

SEQ ID NO: 618718 - DNA, 25 bp, Homo sapien
cctcattataatatccttcccaatc

SEQ ID NO: 618719 - DNA, 25 bp, Homo sapien
ggacaggacagccacctgtggacac

SEQ ID NO: 618720 - DNA, 25 bp, Homo sapien
gtggacactgtactaggaaggggtt

SEQ ID NO: 618721 - DNA, 25 bp, Homo sapien
acactgtactaggaaggggttggca

SEQ ID NO: 618722 - DNA, 25 bp, Homo sapien
ggttggcagggtcacaagagggcgc

SEQ ID NO: 618723 - DNA, 25 bp, Homo sapien
gttggcagggtcacaagagggcgcc

SEQ ID NO: 618724 - DNA, 25 bp, Homo sapien
ttggcagggtcacaagagggcgccc

SEQ ID NO: 618725 - DNA, 25 bp, Homo sapien
tggcagggtcacaagagggcgccca

SEQ ID NO: 618726 - DNA, 25 bp, Homo sapien
ggcagggtcacaagagggcgcccag

SEQ ID NO: 618727 - DNA, 25 bp, Homo sapien
gcagggtcacaagagggcgcccagg

SEQ ID NO: 618728 - DNA, 25 bp, Homo sapien
cagggtcacaagagggcgcccaggt

SEQ ID NO: 618729 - DNA, 25 bp, Homo sapien
agggtcacaagagggcgcccaggtt

SEQ ID NO: 618730 - DNA, 25 bp, Homo sapien
gcaagtaccttgttcacaaagtggg

SEQ ID NO: 618731 - DNA, 25 bp, Homo sapien
gggaaacacgtttaaaccatcagat

SEQ ID NO: 618732 - DNA, 25 bp, Homo sapien
gattttgtgagaactccctgactat

SEQ ID NO: 618733 - DNA, 25 bp, Homo sapien
ataggataaatcatccctttgatcc

SEQ ID NO: 618734 - DNA, 25 bp, Homo sapien
caggtccctcccttgatttgggtgg

SEQ ID NO: 618735 - DNA, 25 bp, Homo sapien
tgggaacatagagccaaatcatatt

SEQ ID NO: 618736 - DNA, 25 bp, Homo sapien
aaatcatattggtatatttatccca

SEQ ID NO: 618737 - DNA, 25 bp, Homo sapien
ccagtgtcatctctaatctaactta

SEQ ID NO: 618738 - DNA, 25 bp, Homo sapien
cttagttctgaataccattgctttt

SEQ ID NO: 618739 - DNA, 25 bp, Homo sapien
taccattgcttttttaccgtgtgat

SEQ ID NO: 618740 - DNA, 25 bp, Homo sapien
gcttttttaccgtgtgatctgaata

SEQ ID NO: 618741 - DNA, 25 bp, Homo sapien
gggaggttaaggccgtagtgtgcct

SEQ ID NO: 618742 - DNA, 25 bp, Homo sapien
ggaggttaaggccgtagtgtgcctt

SEQ ID NO: 618743 - DNA, 25 bp, Homo sapien
gaggttaaggccgtagtgtgccttg

SEQ ID NO: 618744 - DNA, 25 bp, Homo sapien
aggttaaggccgtagtgtgccttga

SEQ ID NO: 618745 - DNA, 25 bp, Homo sapien
ggttaaggccgtagtgtgccttgac

SEQ ID NO: 618746 - DNA, 25 bp, Homo sapien
gttaaggccgtagtgtgccttgact

SEQ ID NO: 618747 - DNA, 25 bp, Homo sapien
ttaaggccgtagtgtgccttgactg

SEQ ID NO: 618748 - DNA, 25 bp, Homo sapien
taaggccgtagtgtgccttgactgt

SEQ ID NO: 618749 - DNA, 25 bp, Homo sapien
aaggccgtagtgtgccttgactgtg

SEQ ID NO: 618750 - DNA, 25 bp, Homo sapien
aggccgtagtgtgccttgactgtgc

SEQ ID NO: 618751 - DNA, 25 bp, Homo sapien
gccgtagtgtgccttgactgtgcca

SEQ ID NO: 618752 - DNA, 25 bp, Homo sapien
caaagtcattgtggaagctgaagac

SEQ ID NO: 618753 - DNA, 25 bp, Homo sapien
aggaaatcacttatctgtaacaaaa

SEQ ID NO: 618754 - DNA, 25 bp, Homo sapien
tgaccccacgtagaagacaacgact

SEQ ID NO: 618755 - DNA, 25 bp, Homo sapien
gacaacgactcagtaatgaatctac

SEQ ID NO: 618756 - DNA, 25 bp, Homo sapien
taatgaatctactacccctggagga

SEQ ID NO: 618757 - DNA, 25 bp, Homo sapien
tacccctggaggaataagtgaatat

SEQ ID NO: 618758 - DNA, 25 bp, Homo sapien
aacagctgagtggttgttctcagtc

SEQ ID NO: 618759 - DNA, 25 bp, Homo sapien
gtggttgttctcagtcttattatta

SEQ ID NO: 618760 - DNA, 25 bp, Homo sapien
aaatgataaaccttgcctctgatga

SEQ ID NO: 618761 - DNA, 25 bp, Homo sapien
ctctgatgagggtcagaccttctaa

SEQ ID NO: 618762 - DNA, 25 bp, Homo sapien
agggtcagaccttctaataaaagag

SEQ ID NO: 618763 - DNA, 25 bp, Homo sapien
cataatcaagacaacaagcaataaa

SEQ ID NO: 618764 - DNA, 25 bp, Homo sapien
caagcaataaatggaaacctaccct

SEQ ID NO: 618765 - DNA, 25 bp, Homo sapien
tacccttaagtagctaaactgttgc

SEQ ID NO: 618766 - DNA, 25 bp, Homo sapien
ccttaagtagctaaactgttgcatt

SEQ ID NO: 618767 - DNA, 25 bp, Homo sapien
taaactgttgcatttagcagataga

SEQ ID NO: 618768 - DNA, 25 bp, Homo sapien
gttgcatttagcagatagaaagtgc

SEQ ID NO: 618769 - DNA, 25 bp, Homo sapien
aagtgctaaagcagatactttgatt

SEQ ID NO: 618770 - DNA, 25 bp, Homo sapien
gcagatactttgattatgttcaagg

SEQ ID NO: 618771 - DNA, 25 bp, Homo sapien
ctttgattatgttcaaggacttaat

SEQ ID NO: 618772 - DNA, 25 bp, Homo sapien
atgagaacaagcatacattccaaaa

SEQ ID NO: 618773 - DNA, 25 bp, Homo sapien
gagaacaagcatacattccaaaaaa

SEQ ID NO: 618774 - DNA, 25 bp, Homo sapien
aatttggtgaccaaatgtgaaaaag

SEQ ID NO: 618775 - DNA, 25 bp, Homo sapien
tacataaaaaatatataccggccag

SEQ ID NO: 618776 - DNA, 25 bp, Homo sapien
acataaaaaatatataccggccagg

SEQ ID NO: 618777 - DNA, 25 bp, Homo sapien
cataaaaaatatataccggccaggc

SEQ ID NO: 618778 - DNA, 25 bp, Homo sapien
taaaaaatatataccggccaggcac

SEQ ID NO: 618779 - DNA, 25 bp, Homo sapien
aaaaaatatataccggccaggcacg

SEQ ID NO: 618780 - DNA, 25 bp, Homo sapien
aaaaatatataccggccaggcacgg

SEQ ID NO: 618781 - DNA, 25 bp, Homo sapien
aaatatataccggccaggcacggtg

SEQ ID NO: 618782 - DNA, 25 bp, Homo sapien
aatatataccggccaggcacggtgg

SEQ ID NO: 618783 - DNA, 25 bp, Homo sapien
attagctaggtgtggtggcaggtgc

SEQ ID NO: 618784 - DNA, 25 bp, Homo sapien
ttagctaggtgtggtggcaggtgcc

SEQ ID NO: 618785 - DNA, 25 bp, Homo sapien
ccagggattcctgctcacagagaaa

SEQ ID NO: 618786 - DNA, 25 bp, Homo sapien
ttcctgctcacagagaaaaggtcat

SEQ ID NO: 618787 - DNA, 25 bp, Homo sapien
aaaaggtcataggaggacacagtga

SEQ ID NO: 618788 - DNA, 25 bp, Homo sapien
ggcacccagaccttagatttgcagc

SEQ ID NO: 618789 - DNA, 25 bp, Homo sapien
gaccttagatttgcagcctctaaaa

SEQ ID NO: 618790 - DNA, 25 bp, Homo sapien
gtcatggcagcctgagctaatactc

SEQ ID NO: 618791 - DNA, 25 bp, Homo sapien
gcagcctgagctaatactctggttt

SEQ ID NO: 618792 - DNA, 25 bp, Homo sapien
actctggtttgtaaatctacgtcac

SEQ ID NO: 618793 - DNA, 25 bp, Homo sapien
tttgtaaatctacgtcacccagacc

SEQ ID NO: 618794 - DNA, 25 bp, Homo sapien
cccctggaagagctactgtagctag

SEQ ID NO: 618795 - DNA, 25 bp, Homo sapien
gctactgtagctagagtccccactt

SEQ ID NO: 618796 - DNA, 25 bp, Homo sapien
caccacacccggcagcaaatattta

SEQ ID NO: 618797 - DNA, 25 bp, Homo sapien
ccacacccggcagcaaatatttatt

SEQ ID NO: 618798 - DNA, 25 bp, Homo sapien
tgttctaggtgctataaatgggcca

SEQ ID NO: 618799 - DNA, 25 bp, Homo sapien
ctaggtgctataaatgggccagaca

SEQ ID NO: 618800 - DNA, 25 bp, Homo sapien
ataaatgggccagacaagctgtcag

SEQ ID NO: 618801 - DNA, 25 bp, Homo sapien
aatgggccagacaagctgtcaggga

SEQ ID NO: 618802 - DNA, 25 bp, Homo sapien
agacaagctgtcagggaggttgccc

SEQ ID NO: 618803 - DNA, 25 bp, Homo sapien
agctgtcagggaggttgccctggct

SEQ ID NO: 618804 - DNA, 25 bp, Homo sapien
gacatcagacaacataattccagag

SEQ ID NO: 618805 - DNA, 25 bp, Homo sapien
agacaacataattccagagctggat

SEQ ID NO: 618806 - DNA, 25 bp, Homo sapien
cagagctggataaatactagggaga

SEQ ID NO: 618807 - DNA, 25 bp, Homo sapien
taagagtcaagggagtagccggggt

SEQ ID NO: 618808 - DNA, 25 bp, Homo sapien
agagtcaagggagtagccggggtag

SEQ ID NO: 618809 - DNA, 25 bp, Homo sapien
gagtcaagggagtagccggggtagt

SEQ ID NO: 618810 - DNA, 25 bp, Homo sapien
ggagtagccggggtagtggcttaca

SEQ ID NO: 618811 - DNA, 25 bp, Homo sapien
gagtagccggggtagtggcttacac

SEQ ID NO: 618812 - DNA, 25 bp, Homo sapien
gtagccggggtagtggcttacacct

SEQ ID NO: 618813 - DNA, 25 bp, Homo sapien
tagccggggtagtggcttacacctg

SEQ ID NO: 618814 - DNA, 25 bp, Homo sapien
agccggggtagtggcttacacctgt

SEQ ID NO: 618815 - DNA, 25 bp, Homo sapien
ctgggcaacaggctgagactctctc

SEQ ID NO: 618816 - DNA, 25 bp, Homo sapien
tgggcaacaggctgagactctctct

SEQ ID NO: 618817 - DNA, 25 bp, Homo sapien
gggcaacaggctgagactctctctc

SEQ ID NO: 618818 - DNA, 25 bp, Homo sapien
ttaatctcccttgtgagcaaagatt

SEQ ID NO: 618819 - DNA, 25 bp, Homo sapien
ctcccttgtgagcaaagattgattt

SEQ ID NO: 618820 - DNA, 25 bp, Homo sapien
agattgatttttaaccctcttcata

SEQ ID NO: 618821 - DNA, 25 bp, Homo sapien
tttaaccctcttcatataatttcag

SEQ ID NO: 618822 - DNA, 25 bp, Homo sapien
tttcagctactattataagaccttg

SEQ ID NO: 618823 - DNA, 25 bp, Homo sapien
agaaagctgttattagcctgatgaa

SEQ ID NO: 618824 - DNA, 25 bp, Homo sapien
gctgttattagcctgatgaatgtga

SEQ ID NO: 618825 - DNA, 25 bp, Homo sapien
gtgaattgattcctgtggccttgtc

SEQ ID NO: 618826 - DNA, 25 bp, Homo sapien
ataagatgtgttgcttttctctcat

SEQ ID NO: 618827 - DNA, 25 bp, Homo sapien
gatgtgttgcttttctctcattata

SEQ ID NO: 618828 - DNA, 25 bp, Homo sapien
gcatacatcgttcttgtagaaaaca

SEQ ID NO: 618829 - DNA, 25 bp, Homo sapien
atgtatcctttctctcaagctcaga

SEQ ID NO: 618830 - DNA, 25 bp, Homo sapien
gtatcctttctctcaagctcagaaa

SEQ ID NO: 618831 - DNA, 25 bp, Homo sapien
gtagccacctgctaatatccagcaa

SEQ ID NO: 618832 - DNA, 25 bp, Homo sapien
tatccagcaagctatcaagtctgca

SEQ ID NO: 618833 - DNA, 25 bp, Homo sapien
agcaagctatcaagtctgcattttg

SEQ ID NO: 618834 - DNA, 25 bp, Homo sapien
tctctatgcgtcagtggattttaat

SEQ ID NO: 618835 - DNA, 25 bp, Homo sapien
gcgtcagtggattttaatttcttta

SEQ ID NO: 618836 - DNA, 25 bp, Homo sapien
ccagcaaacgtttctagagctattt

SEQ ID NO: 618837 - DNA, 25 bp, Homo sapien
agagctatttaatataccttctgct

SEQ ID NO: 618838 - DNA, 25 bp, Homo sapien
aatataccaaatgcttttcagagaa

SEQ ID NO: 618839 - DNA, 25 bp, Homo sapien
atactgtgcttaacatattttacta

SEQ ID NO: 618840 - DNA, 25 bp, Homo sapien
agtctggggctaacaaacctctctg

SEQ ID NO: 618841 - DNA, 25 bp, Homo sapien
tctctgtgacctcactgtttggcca

SEQ ID NO: 618842 - DNA, 25 bp, Homo sapien
tgacctcactgtttggccactgtga

SEQ ID NO: 618843 - DNA, 25 bp, Homo sapien
actgtttggccactgtgacctgttc

SEQ ID NO: 618844 - DNA, 25 bp, Homo sapien
cactgtgacctgttccctttaatct

SEQ ID NO: 618845 - DNA, 25 bp, Homo sapien
ttgcccaggacccatctcttagaca

SEQ ID NO: 618846 - DNA, 25 bp, Homo sapien
atctcttagacagctcctgggttct

SEQ ID NO: 618847 - DNA, 25 bp, Homo sapien
tagacagctcctgggttctagctca

SEQ ID NO: 618848 - DNA, 25 bp, Homo sapien
gggttctagctcagttctagccatc

SEQ ID NO: 618849 - DNA, 25 bp, Homo sapien
tagctcagttctagccatcacatgg

SEQ ID NO: 618850 - DNA, 25 bp, Homo sapien
tcagttctagccatcacatggctca

SEQ ID NO: 618851 - DNA, 25 bp, Homo sapien
tagatactgcataggacttcattag

SEQ ID NO: 618852 - DNA, 25 bp, Homo sapien
ctgcataggacttcattagcttaaa

SEQ ID NO: 618853 - DNA, 25 bp, Homo sapien
gtggttgtaggctaggacttcatta

SEQ ID NO: 618854 - DNA, 25 bp, Homo sapien
ggctaggacttcattagcttaaaac

SEQ ID NO: 618855 - DNA, 25 bp, Homo sapien
aactgtacttggcagattgtccctg

SEQ ID NO: 618856 - DNA, 25 bp, Homo sapien
gtacttggcagattgtccctggaat

SEQ ID NO: 618857 - DNA, 25 bp, Homo sapien
cttggcagattgtccctggaatcat

SEQ ID NO: 618858 - DNA, 25 bp, Homo sapien
gattgtccctggaatcattcttgca

SEQ ID NO: 618859 - DNA, 25 bp, Homo sapien
aatcattcttgcagctctgttcctt

SEQ ID NO: 618860 - DNA, 25 bp, Homo sapien
attcttgcagctctgttccttcttt

SEQ ID NO: 618861 - DNA, 25 bp, Homo sapien
tcttgctcccttcaggccgactgaa

SEQ ID NO: 618862 - DNA, 25 bp, Homo sapien
aggtgatatgatctttcagcggtca

SEQ ID NO: 618863 - DNA, 25 bp, Homo sapien
gatctttcagcggtcacagagcaag

SEQ ID NO: 618864 - DNA, 25 bp, Homo sapien
ggaggtactgggattcctttatcca

SEQ ID NO: 618865 - DNA, 25 bp, Homo sapien
tactgggattcctttatccagatgt

SEQ ID NO: 618866 - DNA, 25 bp, Homo sapien
tgcccaggtgtagagtggctgccat

SEQ ID NO: 618867 - DNA, 25 bp, Homo sapien
agagtggctgccatccctacctgag

SEQ ID NO: 618868 - DNA, 25 bp, Homo sapien
acacagcccgggaacaggatctcgt

SEQ ID NO: 618869 - DNA, 25 bp, Homo sapien
ggaacaggatctcgttctccacctg

SEQ ID NO: 618870 - DNA, 25 bp, Homo sapien
acggacctcgtgtgctcatactgca

SEQ ID NO: 618871 - DNA, 25 bp, Homo sapien
gtgtgctcatactgcagcctcacct

SEQ ID NO: 618872 - DNA, 25 bp, Homo sapien
acctgctcgcacaggcagatggaca

SEQ ID NO: 618873 - DNA, 25 bp, Homo sapien
ccactgtgcctaaccaacaatataa

SEQ ID NO: 618874 - DNA, 25 bp, Homo sapien
tgtgcctaaccaacaatataatttt

SEQ ID NO: 618875 - DNA, 25 bp, Homo sapien
aaatcagcctatgtaacatgctgaa

SEQ ID NO: 618876 - DNA, 25 bp, Homo sapien
gcctatgtaacatgctgaacataaa

SEQ ID NO: 618877 - DNA, 25 bp, Homo sapien
catagacttttatagaactgggagg

SEQ ID NO: 618878 - DNA, 25 bp, Homo sapien
gggagggtccctggagataatctaa

SEQ ID NO: 618879 - DNA, 25 bp, Homo sapien
gagggtccctggagataatctaacc

SEQ ID NO: 618880 - DNA, 25 bp, Homo sapien
gggtccctggagataatctaaccta

SEQ ID NO: 618881 - DNA, 25 bp, Homo sapien
gtccctggagataatctaacctagt

SEQ ID NO: 618882 - DNA, 25 bp, Homo sapien
ctggagataatctaacctagtggtt

SEQ ID NO: 618883 - DNA, 25 bp, Homo sapien
gataatctaacctagtggttgtggg

SEQ ID NO: 618884 - DNA, 25 bp, Homo sapien
ctgagaagctccacatactcttttt

SEQ ID NO: 618885 - DNA, 25 bp, Homo sapien
gaagctccacatactctttttcttt

SEQ ID NO: 618886 - DNA, 25 bp, Homo sapien
tggattcagcagtccctttttcaaa

SEQ ID NO: 618887 - DNA, 25 bp, Homo sapien
tttcaaaggatttgttgttggctgt

SEQ ID NO: 618888 - DNA, 25 bp, Homo sapien
tgtcttccagatgttcctcttgact

SEQ ID NO: 618889 - DNA, 25 bp, Homo sapien
agatgttcctcttgactccattgtg

SEQ ID NO: 618890 - DNA, 25 bp, Homo sapien
gactccattgtgtgtagccttttag

SEQ ID NO: 618891 - DNA, 25 bp, Homo sapien
acacgtgcttgttatctggtcttga

SEQ ID NO: 618892 - DNA, 25 bp, Homo sapien
atctggtcttgacattcacttataa

SEQ ID NO: 618893 - DNA, 25 bp, Homo sapien
aggcacggtgctgcatgcctttgct

SEQ ID NO: 618894 - DNA, 25 bp, Homo sapien
gaggatcgcagaaacctaggagttg

SEQ ID NO: 618895 - DNA, 25 bp, Homo sapien
gttgatccttgagttatttaatggt

SEQ ID NO: 618896 - DNA, 25 bp, Homo sapien
tccttgagttatttaatggtatcca

SEQ ID NO: 618897 - DNA, 25 bp, Homo sapien
aatggtatccaaatgatatctgaaa

SEQ ID NO: 618898 - DNA, 25 bp, Homo sapien
aatagttggcaaagtcatttcattt

SEQ ID NO: 618899 - DNA, 25 bp, Homo sapien
ccactgccatgggttaccatctgaa

SEQ ID NO: 618900 - DNA, 25 bp, Homo sapien
actgccatgggttaccatctgaacc

SEQ ID NO: 618901 - DNA, 25 bp, Homo sapien
ggttaccatctgaaccctgattcat

SEQ ID NO: 618902 - DNA, 25 bp, Homo sapien
tcaaagatactcacaatggccaact

SEQ ID NO: 618903 - DNA, 25 bp, Homo sapien
gatactcacaatggccaactgtgtg

SEQ ID NO: 618904 - DNA, 25 bp, Homo sapien
caatggccaactgtgtgtgaatact

SEQ ID NO: 618905 - DNA, 25 bp, Homo sapien
gccaactgtgtgtgaatactggaaa

SEQ ID NO: 618906 - DNA, 25 bp, Homo sapien
aaatcttaagaaatgaactggtggc

SEQ ID NO: 618907 - DNA, 25 bp, Homo sapien
aatcttaagaaatgaactggtggcc

SEQ ID NO: 618908 - DNA, 25 bp, Homo sapien
atcttaagaaatgaactggtggcca

SEQ ID NO: 618909 - DNA, 25 bp, Homo sapien
tcttaagaaatgaactggtggccag

SEQ ID NO: 618910 - DNA, 25 bp, Homo sapien
cttaagaaatgaactggtggccagg

SEQ ID NO: 618911 - DNA, 25 bp, Homo sapien
ttaagaaatgaactggtggccaggt

SEQ ID NO: 618912 - DNA, 25 bp, Homo sapien
aagaaatgaactggtggccaggtgc

SEQ ID NO: 618913 - DNA, 25 bp, Homo sapien
agaaatgaactggtggccaggtgca

SEQ ID NO: 618914 - DNA, 25 bp, Homo sapien
gaaatgaactggtggccaggtgcag

SEQ ID NO: 618915 - DNA, 25 bp, Homo sapien
aaatgaactggtggccaggtgcagt

SEQ ID NO: 618916 - DNA, 25 bp, Homo sapien
aatgaactggtggccaggtgcagtg

SEQ ID NO: 618917 - DNA, 25 bp, Homo sapien
gaaataacatttagatgttcatctc

SEQ ID NO: 618918 - DNA, 25 bp, Homo sapien
tagatgttcatctcatattgaaaag

SEQ ID NO: 618919 - DNA, 25 bp, Homo sapien
gatgttcatctcatattgaaaagca

SEQ ID NO: 618920 - DNA, 25 bp, Homo sapien
gttcatctcatattgaaaagcagtt

SEQ ID NO: 618921 - DNA, 25 bp, Homo sapien
tctcatattgaaaagcagttactgg

SEQ ID NO: 618922 - DNA, 25 bp, Homo sapien
catattgaaaagcagttactggctg

SEQ ID NO: 618923 - DNA, 25 bp, Homo sapien
atattgaaaagcagttactggctgg

SEQ ID NO: 618924 - DNA, 25 bp, Homo sapien
aaagcagttactggctgggcacact

SEQ ID NO: 618925 - DNA, 25 bp, Homo sapien
agatcactcgaggttaggatttcca

SEQ ID NO: 618926 - DNA, 25 bp, Homo sapien
tcactcgaggttaggatttccagac

SEQ ID NO: 618927 - DNA, 25 bp, Homo sapien
actcgaggttaggatttccagacca

SEQ ID NO: 618928 - DNA, 25 bp, Homo sapien
aggtcagacaaccagcttctcaaga

SEQ ID NO: 618929 - DNA, 25 bp, Homo sapien
caagaccctttggtgttgcagctga

SEQ ID NO: 618930 - DNA, 25 bp, Homo sapien
gtgttgcagctgatacagaacattc

SEQ ID NO: 618931 - DNA, 25 bp, Homo sapien
ggattctgggcggttttctcatgag

SEQ ID NO: 618932 - DNA, 25 bp, Homo sapien
ggcggttttctcatgagtccaacga

SEQ ID NO: 618933 - DNA, 25 bp, Homo sapien
gatgagatacatctgtcctcagtta

SEQ ID NO: 618934 - DNA, 25 bp, Homo sapien
gtcctcagttataagtaccacaccc

SEQ ID NO: 618935 - DNA, 25 bp, Homo sapien
gtgattcaggtggagattccgcatt

SEQ ID NO: 618936 - DNA, 25 bp, Homo sapien
tgaggaagtgtgaagaccctgctgt

SEQ ID NO: 618937 - DNA, 25 bp, Homo sapien
cctgctgtgtcatctgttagtgagc

SEQ ID NO: 618938 - DNA, 25 bp, Homo sapien
tagtgagcagacttcctccttagtt

SEQ ID NO: 618939 - DNA, 25 bp, Homo sapien
aaatgaaaacattagccagctgtag

SEQ ID NO: 618940 - DNA, 25 bp, Homo sapien
aatgaaaacattagccagctgtagt

SEQ ID NO: 618941 - DNA, 25 bp, Homo sapien
atgaaaacattagccagctgtagtg

SEQ ID NO: 618942 - DNA, 25 bp, Homo sapien
agggtgcagttagctatgatggtac

SEQ ID NO: 618943 - DNA, 25 bp, Homo sapien
ttagctatgatggtaccactgccct

SEQ ID NO: 618944 - DNA, 25 bp, Homo sapien
ggtgactgagagagatcctggctcc

SEQ ID NO: 618945 - DNA, 25 bp, Homo sapien
gtgactgagagagatcctggctcca

SEQ ID NO: 618946 - DNA, 25 bp, Homo sapien
tgactgagagagatcctggctccaa

SEQ ID NO: 618947 - DNA, 25 bp, Homo sapien
gactgagagagatcctggctccaaa

SEQ ID NO: 618948 - DNA, 25 bp, Homo sapien
actgagagagatcctggctccaaac

SEQ ID NO: 618949 - DNA, 25 bp, Homo sapien
ctgagagagatcctggctccaaaca

SEQ ID NO: 618950 - DNA, 25 bp, Homo sapien
tcagcagggtcggcctgaggaacct

SEQ ID NO: 618951 - DNA, 25 bp, Homo sapien
gggtctgcacgctaagaaggctctc

SEQ ID NO: 618952 - DNA, 25 bp, Homo sapien
taagaaggctctcccggatgtctgc

SEQ ID NO: 618953 - DNA, 25 bp, Homo sapien
gctctcccggatgtctgcgctgggt

SEQ ID NO: 618954 - DNA, 25 bp, Homo sapien
gggtcccgcggcagcatgtctatgt

SEQ ID NO: 618955 - DNA, 25 bp, Homo sapien
atgtctatgtctctggaaggagtgt

SEQ ID NO: 618956 - DNA, 25 bp, Homo sapien
agtgtgggcatcaagggcccagaca

SEQ ID NO: 618957 - DNA, 25 bp, Homo sapien
tcaagggcccagacagagatactat

SEQ ID NO: 618958 - DNA, 25 bp, Homo sapien
tgttgtcagggcctgctttagtgca

SEQ ID NO: 618959 - DNA, 25 bp, Homo sapien
tcagggcctgctttagtgcatgcat

SEQ ID NO: 618960 - DNA, 25 bp, Homo sapien
ggcctgctttagtgcatgcatcatt

SEQ ID NO: 618961 - DNA, 25 bp, Homo sapien
gaacatacactctggtaattttaat

SEQ ID NO: 618962 - DNA, 25 bp, Homo sapien
ttcagcctgaaatgtcctatatcca

SEQ ID NO: 618963 - DNA, 25 bp, Homo sapien
cctatatccacactgtttcctaatt

SEQ ID NO: 618964 - DNA, 25 bp, Homo sapien
aaatcctatttaatctgcaccatgt

SEQ ID NO: 618965 - DNA, 25 bp, Homo sapien
tttaatctgcaccatgttcactcct

SEQ ID NO: 618966 - DNA, 25 bp, Homo sapien
tcctctgtctgttctccgctggcta

SEQ ID NO: 618967 - DNA, 25 bp, Homo sapien
ccagctgcgggaatgtctgattttt

SEQ ID NO: 618968 - DNA, 25 bp, Homo sapien
gaatgtctgatttttcacttgctga

SEQ ID NO: 618969 - DNA, 25 bp, Homo sapien
atttagaggctcgtatgacacattc

SEQ ID NO: 618970 - DNA, 25 bp, Homo sapien
ggctcgtatgacacattcaaccttt

SEQ ID NO: 618971 - DNA, 25 bp, Homo sapien
agtgttgtgatgcacccaattttta

SEQ ID NO: 618972 - DNA, 25 bp, Homo sapien
gagatgggacaggacagccacctgt

SEQ ID NO: 618973 - DNA, 25 bp, Homo sapien
agatgggacaggacagccacctgtg

SEQ ID NO: 618974 - DNA, 25 bp, Homo sapien
atgggacaggacagccacctgtgga

SEQ ID NO: 618975 - DNA, 25 bp, Homo sapien
ggacaggacagccacctgtggacac

SEQ ID NO: 618976 - DNA, 25 bp, Homo sapien
acaggacagccacctgtggacactg

SEQ ID NO: 618977 - DNA, 25 bp, Homo sapien
ccacctgtggacactgtactaggaa

SEQ ID NO: 618978 - DNA, 25 bp, Homo sapien
acactgtactaggaaggggttggca

SEQ ID NO: 618979 - DNA, 25 bp, Homo sapien
ggttggcagggtcacaagagggcgc

SEQ ID NO: 618980 - DNA, 25 bp, Homo sapien
tggcagggtcacaagagggcgccca

SEQ ID NO: 618981 - DNA, 25 bp, Homo sapien
agggtcacaagagggcgcccaggtt

SEQ ID NO: 618982 - DNA, 25 bp, Homo sapien
agggcgcccaggttctaggagtcca

SEQ ID NO: 618983 - DNA, 25 bp, Homo sapien
acagttctctaaatcttgatggagt

SEQ ID NO: 618984 - DNA, 25 bp, Homo sapien
gatggagtaatctacatccccaaga

SEQ ID NO: 618985 - DNA, 25 bp, Homo sapien
taatgaaggttagggcactcaaaac

SEQ ID NO: 618986 - DNA, 25 bp, Homo sapien
tgagtatgagtctctgtctttctct

SEQ ID NO: 618987 - DNA, 25 bp, Homo sapien
tcctttccttttatgatactgaata

SEQ ID NO: 618988 - DNA, 25 bp, Homo sapien
gaacatatgcaagtacttccctcta

SEQ ID NO: 618989 - DNA, 25 bp, Homo sapien
tacttccctctaccttcattattag

SEQ ID NO: 618990 - DNA, 25 bp, Homo sapien
ttattagattcttgcccagctaggc

SEQ ID NO: 618991 - DNA, 25 bp, Homo sapien
gcccagctaggcaggtccaagattt

SEQ ID NO: 618992 - DNA, 25 bp, Homo sapien
agattttgtttctggctatgctaat

SEQ ID NO: 618993 - DNA, 25 bp, Homo sapien
ctggctatgctaattttggacaata

SEQ ID NO: 618994 - DNA, 25 bp, Homo sapien
gaatttacacacatcacttctcatt

SEQ ID NO: 618995 - DNA, 25 bp, Homo sapien
aatggcaaaacttaggcccgcagcc

SEQ ID NO: 618996 - DNA, 25 bp, Homo sapien
gcccgcagccattctgggaacaaag

SEQ ID NO: 618997 - DNA, 25 bp, Homo sapien
aaagtgggtgggacatgccgttcct

SEQ ID NO: 618998 - DNA, 25 bp, Homo sapien
gacatgccgttcctgatgggtagca

SEQ ID NO: 618999 - DNA, 25 bp, Homo sapien
atgggtagcagcaccaggaccagct

SEQ ID NO: 619000 - DNA, 25 bp, Homo sapien
ggaccagctccactgcatggaataa

SEQ ID NO: 619001 - DNA, 25 bp, Homo sapien
gaacccacagctttggtgaataggc

SEQ ID NO: 619002 - DNA, 25 bp, Homo sapien
ttggtgaataggcagccacctctgc

SEQ ID NO: 619003 - DNA, 25 bp, Homo sapien
cacctctgccacatatcataacttg

SEQ ID NO: 619004 - DNA, 25 bp, Homo sapien
gaagcattaaccttggagtgccctg

SEQ ID NO: 619005 - DNA, 25 bp, Homo sapien
acacgacggccgtttgggaggctca

SEQ ID NO: 619006 - DNA, 25 bp, Homo sapien
tttgggaggctcacagctttcggca

SEQ ID NO: 619007 - DNA, 25 bp, Homo sapien
agctttcggcactgtggccctgatg

SEQ ID NO: 619008 - DNA, 25 bp, Homo sapien
tgtggccctgatgtttttgcttcac

SEQ ID NO: 619009 - DNA, 25 bp, Homo sapien
cactgcaatttgtttctgatctcca

SEQ ID NO: 619010 - DNA, 25 bp, Homo sapien
tgatctccagtcaagtccttacaac

SEQ ID NO: 619011 - DNA, 25 bp, Homo sapien
aagtccttacaacgctgggatcctc

SEQ ID NO: 619012 - DNA, 25 bp, Homo sapien
gctgggatcctctagagagtttata

SEQ ID NO: 619013 - DNA, 25 bp, Homo sapien
gagtttatactttgacctcgtgaca

SEQ ID NO: 619014 - DNA, 25 bp, Homo sapien
ttgacctcgtgacaattaacaccag

SEQ ID NO: 619015 - DNA, 25 bp, Homo sapien
gacaattaacaccagaggccaagaa

SEQ ID NO: 619016 - DNA, 25 bp, Homo sapien
gtggcttctgactctggtcctagca

SEQ ID NO: 619017 - DNA, 25 bp, Homo sapien
tagcaatgcttttactccaggtcag

SEQ ID NO: 619018 - DNA, 25 bp, Homo sapien
gtgaaagttgttcctttgaagcagt

SEQ ID NO: 619019 - DNA, 25 bp, Homo sapien
gaagcagtctaaggctgatgctccc

SEQ ID NO: 619020 - DNA, 25 bp, Homo sapien
ctgatgctccctgaatggcatgaga

SEQ ID NO: 619021 - DNA, 25 bp, Homo sapien
tggcatgagagctcattggcatggc

SEQ ID NO: 619022 - DNA, 25 bp, Homo sapien
atggcctctgggtgctaccggaaac

SEQ ID NO: 619023 - DNA, 25 bp, Homo sapien
gtgctaccggaaaccagggctttca

SEQ ID NO: 619024 - DNA, 25 bp, Homo sapien
cagggctttcaggatggcccgttat

SEQ ID NO: 619025 - DNA, 25 bp, Homo sapien
tatccatccgtgtcctggtgggtac

SEQ ID NO: 619026 - DNA, 25 bp, Homo sapien
tggtgggtacatcctacatcagcct

SEQ ID NO: 619027 - DNA, 25 bp, Homo sapien
gagccgagaacatagagtgcatctc

SEQ ID NO: 619028 - DNA, 25 bp, Homo sapien
gagtgcatctctgatgtttactaca

SEQ ID NO: 619029 - DNA, 25 bp, Homo sapien
atgtttactacatctcccatgccag

SEQ ID NO: 619030 - DNA, 25 bp, Homo sapien
aggctcttattccacaccagaggga

SEQ ID NO: 619031 - DNA, 25 bp, Homo sapien
agagggactgtccattagtgcctat

SEQ ID NO: 619032 - DNA, 25 bp, Homo sapien
agtgcctatcactagagctgaatgg

SEQ ID NO: 619033 - DNA, 25 bp, Homo sapien
tagagctgaatggacccattccaat

SEQ ID NO: 619034 - DNA, 25 bp, Homo sapien
cccattccaattcaatacctttcta

SEQ ID NO: 619035 - DNA, 25 bp, Homo sapien
tgtcatatgtttgcaaattccaggg

SEQ ID NO: 619036 - DNA, 25 bp, Homo sapien
gactattgattcatagctcctaaga

SEQ ID NO: 619037 - DNA, 25 bp, Homo sapien
agacctgaaaactcttctcaagaaa

SEQ ID NO: 619038 - DNA, 25 bp, Homo sapien
gcgccgcttgccttggaaaggtttc

SEQ ID NO: 619039 - DNA, 25 bp, Homo sapien
gccgcttgccttggaaaggtttctt

SEQ ID NO: 619040 - DNA, 25 bp, Homo sapien
aaaacgggcaagagaagtgcatggt

SEQ ID NO: 619041 - DNA, 25 bp, Homo sapien
agaagtgcatggtgggcaggagcaa

SEQ ID NO: 619042 - DNA, 25 bp, Homo sapien
caggagcaagccctagatagcccca

SEQ ID NO: 619043 - DNA, 25 bp, Homo sapien
tagatagccccagagggatgcacag

SEQ ID NO: 619044 - DNA, 25 bp, Homo sapien
ggatgcacagggatgggaacactct

SEQ ID NO: 619045 - DNA, 25 bp, Homo sapien
atgcacagggatgggaacactctgc

SEQ ID NO: 619046 - DNA, 25 bp, Homo sapien
gcacagggatgggaacactctgcca

SEQ ID NO: 619047 - DNA, 25 bp, Homo sapien
acagggatgggaacactctgccatc

SEQ ID NO: 619048 - DNA, 25 bp, Homo sapien
gggatgggaacactctgccatcccc

SEQ ID NO: 619049 - DNA, 25 bp, Homo sapien
aagcaaggagagtgcatgactcact

SEQ ID NO: 619050 - DNA, 25 bp, Homo sapien
gcatgactcactggaaccgctaaac

SEQ ID NO: 619051 - DNA, 25 bp, Homo sapien
ggaaccgctaaaccaggaatcagta

SEQ ID NO: 619052 - DNA, 25 bp, Homo sapien
taatttgacggcagtgtccttggct

SEQ ID NO: 619053 - DNA, 25 bp, Homo sapien
gaatgtttcaccattaaccaagatg

SEQ ID NO: 619054 - DNA, 25 bp, Homo sapien
agatgttggctgtaggtgtctctta

SEQ ID NO: 619055 - DNA, 25 bp, Homo sapien
agttgagttagttcccatcttttca

SEQ ID NO: 619056 - DNA, 25 bp, Homo sapien
tcccatcttttcagagtttgataaa

SEQ ID NO: 619057 - DNA, 25 bp, Homo sapien
gtattttattaggtaggctgttgtt

SEQ ID NO: 619058 - DNA, 25 bp, Homo sapien
ggctgttgttggctggttttcactc

SEQ ID NO: 619059 - DNA, 25 bp, Homo sapien
ttggctggttttcactcctttgtaa

SEQ ID NO: 619060 - DNA, 25 bp, Homo sapien
gtaatttccttgatggcacttctgt

SEQ ID NO: 619061 - DNA, 25 bp, Homo sapien
ccttgatggcacttctgtcctatgt

SEQ ID NO: 619062 - DNA, 25 bp, Homo sapien
aaaattgtgtccttgatcatcgttc

SEQ ID NO: 619063 - DNA, 25 bp, Homo sapien
tgatcatcgttcttaattctccatt

SEQ ID NO: 619064 - DNA, 25 bp, Homo sapien
aattctccattagtgagttctgaac

SEQ ID NO: 619065 - DNA, 25 bp, Homo sapien
gaacttgggtttgaagcatttgcta

SEQ ID NO: 619066 - DNA, 25 bp, Homo sapien
agctttgttatctcaagtggtggca

SEQ ID NO: 619067 - DNA, 25 bp, Homo sapien
aagtggtggcacagagttcttaagc

SEQ ID NO: 619068 - DNA, 25 bp, Homo sapien
agctattgattgttcactgacttta

SEQ ID NO: 619069 - DNA, 25 bp, Homo sapien
tgttgtttgtgtgttcgatcatgaa

SEQ ID NO: 619070 - DNA, 25 bp, Homo sapien
gtgtttatttgttttcctactggat

SEQ ID NO: 619071 - DNA, 25 bp, Homo sapien
aagctgtttctgtatgtaacaactg

SEQ ID NO: 619072 - DNA, 25 bp, Homo sapien
tgtatgtaacaactgcaacctaact

SEQ ID NO: 619073 - DNA, 25 bp, Homo sapien
tcttgtgataagtagctgagtctca

SEQ ID NO: 619074 - DNA, 25 bp, Homo sapien
gccaatgaaaggttgccgactgatc

SEQ ID NO: 619075 - DNA, 25 bp, Homo sapien
gactgatcagaccacgtccatataa

SEQ ID NO: 619076 - DNA, 25 bp, Homo sapien
gaccacgtccatataaggcaaacgc

SEQ ID NO: 619077 - DNA, 25 bp, Homo sapien
ttctgtctgtaaatatgcctgccca

SEQ ID NO: 619078 - DNA, 25 bp, Homo sapien
atgcctgcccacattgctgggtaga

SEQ ID NO: 619079 - DNA, 25 bp, Homo sapien
gaggaggttctaagtgcttcccaat

SEQ ID NO: 619080 - DNA, 25 bp, Homo sapien
ggttctaagtgcttcccaattcata

SEQ ID NO: 619081 - DNA, 25 bp, Homo sapien
agtgcttcccaattcataaattgtt

SEQ ID NO: 619082 - DNA, 25 bp, Homo sapien
aacaacatgttgcataccaccctag

SEQ ID NO: 619083 - DNA, 25 bp, Homo sapien
ttgcataccaccctagatctctatg

SEQ ID NO: 619084 - DNA, 25 bp, Homo sapien
gatctctatgccagtgtcattcatt

SEQ ID NO: 619085 - DNA, 25 bp, Homo sapien
aaatttgccaaacgtggagacctgg

SEQ ID NO: 619086 - DNA, 25 bp, Homo sapien
gagacctggcacaaagatgtagaca

SEQ ID NO: 619087 - DNA, 25 bp, Homo sapien
gatgtagacatcctagttgtttggg

SEQ ID NO: 619088 - DNA, 25 bp, Homo sapien
gtgagtatagcaatctggagcatga

SEQ ID NO: 619089 - DNA, 25 bp, Homo sapien
gacagagagcctaaagatcatgact

SEQ ID NO: 619090 - DNA, 25 bp, Homo sapien
tgactaaggccaagtctttgcgcat

SEQ ID NO: 619091 - DNA, 25 bp, Homo sapien
gcgcattgctgaatatgccttccag

SEQ ID NO: 619092 - DNA, 25 bp, Homo sapien
aaggtcaacatcacgaaactgggag

SEQ ID NO: 619093 - DNA, 25 bp, Homo sapien
aagggctcagagaaccagatattca

SEQ ID NO: 619094 - DNA, 25 bp, Homo sapien
attcaactttcagaagcatcccctg

SEQ ID NO: 619095 - DNA, 25 bp, Homo sapien
aagcatcccctgaagggcaggttgt

SEQ ID NO: 619096 - DNA, 25 bp, Homo sapien
aagggcaggttgtctgctcccctga

SEQ ID NO: 619097 - DNA, 25 bp, Homo sapien
tgctcccctgattcattgaggatca

SEQ ID NO: 619098 - DNA, 25 bp, Homo sapien
ccaggtaggcagtaggctctcacta

SEQ ID NO: 619099 - DNA, 25 bp, Homo sapien
gctctcactacgtactgctgaatga

SEQ ID NO: 619100 - DNA, 25 bp, Homo sapien
taaagttttacctagtgccccacat

SEQ ID NO: 619101 - DNA, 25 bp, Homo sapien
tcctgttttctgaatccaatttaac

SEQ ID NO: 619102 - DNA, 25 bp, Homo sapien
ccaatttaacttattcttccctctg

SEQ ID NO: 619103 - DNA, 25 bp, Homo sapien
cttccctctgttattaaaccattgt

SEQ ID NO: 619104 - DNA, 25 bp, Homo sapien
cgcacgtgtgctacgagcaggcgca

SEQ ID NO: 619105 - DNA, 25 bp, Homo sapien
cacgtgtgctacgagcaggcgcagc

SEQ ID NO: 619106 - DNA, 25 bp, Homo sapien
cagcgcctggttaaggactgggacc

SEQ ID NO: 619107 - DNA, 25 bp, Homo sapien
ctggttaaggactgggacccgcgca

SEQ ID NO: 619108 - DNA, 25 bp, Homo sapien
ttaaggactgggacccgcgcacgcc

SEQ ID NO: 619109 - DNA, 25 bp, Homo sapien
aagagcagcgcggacccctagtgac

SEQ ID NO: 619110 - DNA, 25 bp, Homo sapien
ctgattggatgctggctgggacctc

SEQ ID NO: 619111 - DNA, 25 bp, Homo sapien
gctgggacctcggagagcagacaca

SEQ ID NO: 619112 - DNA, 25 bp, Homo sapien
gggacctcggagagcagacacagcc

SEQ ID NO: 619113 - DNA, 25 bp, Homo sapien
tccaagcaccctctaggagaattat

SEQ ID NO: 619114 - DNA, 25 bp, Homo sapien
agcaccctctaggagaattataatt

SEQ ID NO: 619115 - DNA, 25 bp, Homo sapien
agtactctagatcattccttcttcc

SEQ ID NO: 619116 - DNA, 25 bp, Homo sapien
tagatcattccttcttcctagtaac

SEQ ID NO: 619117 - DNA, 25 bp, Homo sapien
tgcaactttgttgcttctgtgtttg

SEQ ID NO: 619118 - DNA, 25 bp, Homo sapien
gcttctgtgtttgactcacagccac

SEQ ID NO: 619119 - DNA, 25 bp, Homo sapien
actttcccccatgcggaagtgagtg

SEQ ID NO: 619120 - DNA, 25 bp, Homo sapien
tattcagctatatggagtagtagac

SEQ ID NO: 619121 - DNA, 25 bp, Homo sapien
gagaaactggtatttgctttaacta

SEQ ID NO: 619122 - DNA, 25 bp, Homo sapien
gtatttgctttaactacctgctgct

SEQ ID NO: 619123 - DNA, 25 bp, Homo sapien
tgctttaactacctgctgcttgtaa

SEQ ID NO: 619124 - DNA, 25 bp, Homo sapien
taactacctgctgcttgtaagcgct

SEQ ID NO: 619125 - DNA, 25 bp, Homo sapien
ttgtaagcgcttcctctgtaactca

SEQ ID NO: 619126 - DNA, 25 bp, Homo sapien
caagaacgggaagcggcagcgtcct

SEQ ID NO: 619127 - DNA, 25 bp, Homo sapien
gaagcggcagcgtcctggcgtccta

SEQ ID NO: 619128 - DNA, 25 bp, Homo sapien
agcgtcctggcgtcctaggtgagac

SEQ ID NO: 619129 - DNA, 25 bp, Homo sapien
cctggcgtcctaggtgagacttcaa

SEQ ID NO: 619130 - DNA, 25 bp, Homo sapien
aggtgagacttcaagacggctccct

SEQ ID NO: 619131 - DNA, 25 bp, Homo sapien
tgagacttcaagacggctccctgct

SEQ ID NO: 619132 - DNA, 25 bp, Homo sapien
agcagacgccggctctgggagggcc

SEQ ID NO: 619133 - DNA, 25 bp, Homo sapien
tgtggagggaaggtgaccccgcagt

SEQ ID NO: 619134 - DNA, 25 bp, Homo sapien
agcggaagcaggacggcgcggtgcc

SEQ ID NO: 619135 - DNA, 25 bp, Homo sapien
gcggcactgagaggcggccataaaa

SEQ ID NO: 619136 - DNA, 25 bp, Homo sapien
tgagaggcggccataaaaaccggag

SEQ ID NO: 619137 - DNA, 25 bp, Homo sapien
tgcccttggacatctgattccaggt

SEQ ID NO: 619138 - DNA, 25 bp, Homo sapien
tctgattccaggtttttcagccttt

SEQ ID NO: 619139 - DNA, 25 bp, Homo sapien
ttcagcctttggactctaggacttg

SEQ ID NO: 619140 - DNA, 25 bp, Homo sapien
tttgggctttcagccttcggcctca

SEQ ID NO: 619141 - DNA, 25 bp, Homo sapien
tgcactgtagcttccctggtttggg

SEQ ID NO: 619142 - DNA, 25 bp, Homo sapien
gacttggcctgagccatgcttctgg

SEQ ID NO: 619143 - DNA, 25 bp, Homo sapien
tattggcttctgtcattctgcagtt

SEQ ID NO: 619144 - DNA, 25 bp, Homo sapien
attctgcagtttgtagccagcctac

SEQ ID NO: 619145 - DNA, 25 bp, Homo sapien
agcctactgtgggacttcgcctttg

SEQ ID NO: 619146 - DNA, 25 bp, Homo sapien
ttcgcctttgtgattgttcagccaa

SEQ ID NO: 619147 - DNA, 25 bp, Homo sapien
gccaattcttcctaataaattcccg

SEQ ID NO: 619148 - DNA, 25 bp, Homo sapien
tggaagggagagctgggcatggcag

SEQ ID NO: 619149 - DNA, 25 bp, Homo sapien
agagctgggcatggcagttcatgcc

SEQ ID NO: 619150 - DNA, 25 bp, Homo sapien
gtttttaattagcagggcatgatgg

SEQ ID NO: 619151 - DNA, 25 bp, Homo sapien
ttaattagcagggcatgatggtgtg

SEQ ID NO: 619152 - DNA, 25 bp, Homo sapien
attagcagggcatgatggtgtgttt

SEQ ID NO: 619153 - DNA, 25 bp, Homo sapien
ttagcagggcatgatggtgtgtttc

SEQ ID NO: 619154 - DNA, 25 bp, Homo sapien
tagcagggcatgatggtgtgtttct

SEQ ID NO: 619155 - DNA, 25 bp, Homo sapien
agcagggcatgatggtgtgtttctg

SEQ ID NO: 619156 - DNA, 25 bp, Homo sapien
cagggcatgatggtgtgtttctgta

SEQ ID NO: 619157 - DNA, 25 bp, Homo sapien
gcatgatggtgtgtttctgtagtcc

SEQ ID NO: 619158 - DNA, 25 bp, Homo sapien
catgatggtgtgtttctgtagtccc

SEQ ID NO: 619159 - DNA, 25 bp, Homo sapien
ggcatgcagagggtagcatgttcat

SEQ ID NO: 619160 - DNA, 25 bp, Homo sapien
agcatgttcatgtggaggcatcctt

SEQ ID NO: 619161 - DNA, 25 bp, Homo sapien
caccgccaaagacagcgcgaagctg

SEQ ID NO: 619162 - DNA, 25 bp, Homo sapien
gcgaagctgcaaccacctagctgct

SEQ ID NO: 619163 - DNA, 25 bp, Homo sapien
ggagaaagagctgcacattgtaaat

SEQ ID NO: 619164 - DNA, 25 bp, Homo sapien
gccaatgagtctgcctgggatgtgt

SEQ ID NO: 619165 - DNA, 25 bp, Homo sapien
agtctgcctgggatgtgtgtgaatc

SEQ ID NO: 619166 - DNA, 25 bp, Homo sapien
gtgtgtgaatcccaaaagacgcaat

SEQ ID NO: 619167 - DNA, 25 bp, Homo sapien
aagacgcaatcccaaatgccatagt

SEQ ID NO: 619168 - DNA, 25 bp, Homo sapien
aaatgccatagtcccaagtgttgag

SEQ ID NO: 619169 - DNA, 25 bp, Homo sapien
gtcccaagtgttgagaatccaaaat

SEQ ID NO: 619170 - DNA, 25 bp, Homo sapien
aggtgtgtcgggtcctggcctggga

SEQ ID NO: 619171 - DNA, 25 bp, Homo sapien
tggtggctctaaggcacctgcttgt

SEQ ID NO: 619172 - DNA, 25 bp, Homo sapien
gggaatcctgaagtcacagaactca

SEQ ID NO: 619173 - DNA, 25 bp, Homo sapien
gaagtcacagaactcacctggagga

SEQ ID NO: 619174 - DNA, 25 bp, Homo sapien
gaactcacctggaggaccccttact

SEQ ID NO: 619175 - DNA, 25 bp, Homo sapien
tacttcccttcaaagtgctttccct

SEQ ID NO: 619176 - DNA, 25 bp, Homo sapien
accacatttcagtgggatttcaggc

SEQ ID NO: 619177 - DNA, 25 bp, Homo sapien
tgagtggtgtgacacccttgatcat

SEQ ID NO: 619178 - DNA, 25 bp, Homo sapien
agcagctggcacctgtacaggtcac

SEQ ID NO: 619179 - DNA, 25 bp, Homo sapien
gcacctgtacaggtcaccttagaaa

SEQ ID NO: 619180 - DNA, 25 bp, Homo sapien
ggtcaccttagaaagtgctttccca

SEQ ID NO: 619181 - DNA, 25 bp, Homo sapien
tgatttcaccactgactggctgttg

SEQ ID NO: 619182 - DNA, 25 bp, Homo sapien
gactggctgttgttaaagcaaacta

SEQ ID NO: 619183 - DNA, 25 bp, Homo sapien
agcaaactaagtatggcctgagaag

SEQ ID NO: 619184 - DNA, 25 bp, Homo sapien
atggcctgagaaggaccgcatactt

SEQ ID NO: 619185 - DNA, 25 bp, Homo sapien
aggaccgcatacttctgtatctgag

SEQ ID NO: 619186 - DNA, 25 bp, Homo sapien
acctagcttaacaggcagactaata

SEQ ID NO: 619187 - DNA, 25 bp, Homo sapien
gactaataggccaagctctaaccaa

SEQ ID NO: 619188 - DNA, 25 bp, Homo sapien
gctctaaccaatccagccatctgtt

SEQ ID NO: 619189 - DNA, 25 bp, Homo sapien
ttcctcacttccaatttctgtacgt

SEQ ID NO: 619190 - DNA, 25 bp, Homo sapien
taccatgtggctgcgctggagtctc

SEQ ID NO: 619191 - DNA, 25 bp, Homo sapien
ctctgtgaatctgctgtgatagtgg

SEQ ID NO: 619192 - DNA, 25 bp, Homo sapien
gtaagacctagacctggatcttcta

SEQ ID NO: 619193 - DNA, 25 bp, Homo sapien
tagacctggatcttctaactccaag

SEQ ID NO: 619194 - DNA, 25 bp, Homo sapien
ttctaactccaagccgagtgtactc

SEQ ID NO: 619195 - DNA, 25 bp, Homo sapien
aagccgagtgtactctccagttcac

SEQ ID NO: 619196 - DNA, 25 bp, Homo sapien
tccagttcaccttctgtgctctatg

SEQ ID NO: 619197 - DNA, 25 bp, Homo sapien
tctgtgctctatggctgctgtaatg

SEQ ID NO: 619198 - DNA, 25 bp, Homo sapien
atgttttgacttactgcttttagca

SEQ ID NO: 619199 - DNA, 25 bp, Homo sapien
gcttttagcagaaagtattcccttt

SEQ ID NO: 619200 - DNA, 25 bp, Homo sapien
gtattcccttttcttatagtagtga

SEQ ID NO: 619201 - DNA, 25 bp, Homo sapien
tgtgaagttctcaccgacaatgccc

SEQ ID NO: 619202 - DNA, 25 bp, Homo sapien
gacaatgcccctggataattttctg

SEQ ID NO: 619203 - DNA, 25 bp, Homo sapien
caaaaacaaagaaacctggctcatt

SEQ ID NO: 619204 - DNA, 25 bp, Homo sapien
acctggctcatttcttgtttcggca

SEQ ID NO: 619205 - DNA, 25 bp, Homo sapien
cctggctcatttcttgtttcggcaa

SEQ ID NO: 619206 - DNA, 25 bp, Homo sapien
tggctcatttcttgtttcggcaagt

SEQ ID NO: 619207 - DNA, 25 bp, Homo sapien
gctcatttcttgtttcggcaagtct

SEQ ID NO: 619208 - DNA, 25 bp, Homo sapien
catttcttgtttcggcaagtctgct

SEQ ID NO: 619209 - DNA, 25 bp, Homo sapien
ttcttgtttcggcaagtctgctaaa

SEQ ID NO: 619210 - DNA, 25 bp, Homo sapien
tcttgtttcggcaagtctgctaaaa

SEQ ID NO: 619211 - DNA, 25 bp, Homo sapien
gtttcggcaagtctgctaaaagatt

SEQ ID NO: 619212 - DNA, 25 bp, Homo sapien
aagtctgctaaaagattcactcagc

SEQ ID NO: 619213 - DNA, 25 bp, Homo sapien
gtctgctaaaagattcactcagcac

SEQ ID NO: 619214 - DNA, 25 bp, Homo sapien
agctccatgcatcttgtacttggcc

SEQ ID NO: 619215 - DNA, 25 bp, Homo sapien
ggcttttctagtgtgggagatctga

SEQ ID NO: 619216 - DNA, 25 bp, Homo sapien
aaaggatgagatcctgctccacaag

SEQ ID NO: 619217 - DNA, 25 bp, Homo sapien
tggttttctaagaagcccacctctg

SEQ ID NO: 619218 - DNA, 25 bp, Homo sapien
tctgcgtgccaagagtgatgcattc

SEQ ID NO: 619219 - DNA, 25 bp, Homo sapien
tccacttggagttcaagcgcaggcc

SEQ ID NO: 619220 - DNA, 25 bp, Homo sapien
caagcgcaggcctgatgtttgtggt

SEQ ID NO: 619221 - DNA, 25 bp, Homo sapien
tgtggtgcactttgaatcttctcta

SEQ ID NO: 619222 - DNA, 25 bp, Homo sapien
ctttgaatcttctctagcttctttc

SEQ ID NO: 619223 - DNA, 25 bp, Homo sapien
tttctgcccatagcatgtctctcag

SEQ ID NO: 619224 - DNA, 25 bp, Homo sapien
ctctcagccccatcaatatactttt

SEQ ID NO: 619225 - DNA, 25 bp, Homo sapien
aagcttaaaaagctgtccaggatcg

SEQ ID NO: 619226 - DNA, 25 bp, Homo sapien
gcttaaaaagctgtccaggatcggt

SEQ ID NO: 619227 - DNA, 25 bp, Homo sapien
taaaaagctgtccaggatcggtggt

SEQ ID NO: 619228 - DNA, 25 bp, Homo sapien
aaaagctgtccaggatcggtggttt

SEQ ID NO: 619229 - DNA, 25 bp, Homo sapien
aaagctgtccaggatcggtggttta

SEQ ID NO: 619230 - DNA, 25 bp, Homo sapien
aagctgtccaggatcggtggtttac

SEQ ID NO: 619231 - DNA, 25 bp, Homo sapien
agctgtccaggatcggtggtttaca

SEQ ID NO: 619232 - DNA, 25 bp, Homo sapien
gctgtccaggatcggtggtttacac

SEQ ID NO: 619233 - DNA, 25 bp, Homo sapien
tgtccaggatcggtggtttacacct

SEQ ID NO: 619234 - DNA, 25 bp, Homo sapien
gtccaggatcggtggtttacacctg

SEQ ID NO: 619235 - DNA, 25 bp, Homo sapien
gcccagccaatttagtgaaacccca

SEQ ID NO: 619236 - DNA, 25 bp, Homo sapien
aaatccactccaaggacagacacag

SEQ ID NO: 619237 - DNA, 25 bp, Homo sapien
caacatgttgagacctccatctgtg

SEQ ID NO: 619238 - DNA, 25 bp, Homo sapien
acatgttgagacctccatctgtgcc

SEQ ID NO: 619239 - DNA, 25 bp, Homo sapien
atgttgagacctccatctgtgcccc

SEQ ID NO: 619240 - DNA, 25 bp, Homo sapien
tcacttgagcctaagcagtcgcggc

SEQ ID NO: 619241 - DNA, 25 bp, Homo sapien
acttgagcctaagcagtcgcggctg

SEQ ID NO: 619242 - DNA, 25 bp, Homo sapien
gagcctaagcagtcgcggctgcagt

SEQ ID NO: 619243 - DNA, 25 bp, Homo sapien
aagcagtcgcggctgcagtgaacaa

SEQ ID NO: 619244 - DNA, 25 bp, Homo sapien
cagtcgcggctgcagtgaacaagat

SEQ ID NO: 619245 - DNA, 25 bp, Homo sapien
agtcgcggctgcagtgaacaagatc

SEQ ID NO: 619246 - DNA, 25 bp, Homo sapien
tcacttgcccctacaaaatccactc

SEQ ID NO: 619247 - DNA, 25 bp, Homo sapien
ttgaccctaagatgcaaggcgtcta

SEQ ID NO: 619248 - DNA, 25 bp, Homo sapien
gatgcaaggcgtctaatcccttgaa

SEQ ID NO: 619249 - DNA, 25 bp, Homo sapien
tgaacccgcttgaacccgcttgaac

SEQ ID NO: 619250 - DNA, 25 bp, Homo sapien
aacccgcttgaacatatctgctgga

SEQ ID NO: 619251 - DNA, 25 bp, Homo sapien
atctgctggactgatgtcttctgca

SEQ ID NO: 619252 - DNA, 25 bp, Homo sapien
gactgatgtcttctgcaggttgcag

SEQ ID NO: 619253 - DNA, 25 bp, Homo sapien
tctgcaggttgcagatcctgaccat

SEQ ID NO: 619254 - DNA, 25 bp, Homo sapien
cttcacatggcaccagtagcgttgt

SEQ ID NO: 619255 - DNA, 25 bp, Homo sapien
ggcaccagtagcgttgtgtgtgatt

SEQ ID NO: 619256 - DNA, 25 bp, Homo sapien
gttcagagttttgcagttcacaaaa

SEQ ID NO: 619257 - DNA, 25 bp, Homo sapien
atagcgaggataatactaaccatgt

SEQ ID NO: 619258 - DNA, 25 bp, Homo sapien
gcgccgcttgccttggaaaggtttc

SEQ ID NO: 619259 - DNA, 25 bp, Homo sapien
gccgcttgccttggaaaggtttctt

SEQ ID NO: 619260 - DNA, 25 bp, Homo sapien
tcttcttcaggaaaacgggcaagag

SEQ ID NO: 619261 - DNA, 25 bp, Homo sapien
aaaacgggcaagagaagtgcatggt

SEQ ID NO: 619262 - DNA, 25 bp, Homo sapien
agaagtgcatggtgggcaggagcaa

SEQ ID NO: 619263 - DNA, 25 bp, Homo sapien
caggagcaagccctagatagcccca

SEQ ID NO: 619264 - DNA, 25 bp, Homo sapien
tagatagccccagagggatgcacag

SEQ ID NO: 619265 - DNA, 25 bp, Homo sapien
ggatgcacagggatgggaacactct

SEQ ID NO: 619266 - DNA, 25 bp, Homo sapien
cacagggatgggaacactctgccat

SEQ ID NO: 619267 - DNA, 25 bp, Homo sapien
agggatgggaacactctgccatccc

SEQ ID NO: 619268 - DNA, 25 bp, Homo sapien
tgaatctcaccccaatgttgttttg

SEQ ID NO: 619269 - DNA, 25 bp, Homo sapien
ccgtgggagagacgattccagtttc

SEQ ID NO: 619270 - DNA, 25 bp, Homo sapien
cgtgggagagacgattccagtttct

SEQ ID NO: 619271 - DNA, 25 bp, Homo sapien
gtgggagagacgattccagtttctg

SEQ ID NO: 619272 - DNA, 25 bp, Homo sapien
tgggagagacgattccagtttctga

SEQ ID NO: 619273 - DNA, 25 bp, Homo sapien
gggagagacgattccagtttctgaa

SEQ ID NO: 619274 - DNA, 25 bp, Homo sapien
ggagagacgattccagtttctgaaa

SEQ ID NO: 619275 - DNA, 25 bp, Homo sapien
gagagacgattccagtttctgaaaa

SEQ ID NO: 619276 - DNA, 25 bp, Homo sapien
agagacgattccagtttctgaaaac

SEQ ID NO: 619277 - DNA, 25 bp, Homo sapien
gagacgattccagtttctgaaaacg

SEQ ID NO: 619278 - DNA, 25 bp, Homo sapien
agacgattccagtttctgaaaacga

SEQ ID NO: 619279 - DNA, 25 bp, Homo sapien
ccagggagtggtatgagggagatgc

SEQ ID NO: 619280 - DNA, 25 bp, Homo sapien
agtgttatgcaaccattaaaaatta

SEQ ID NO: 619281 - DNA, 25 bp, Homo sapien
gtgttatgcaaccattaaaaattag

SEQ ID NO: 619282 - DNA, 25 bp, Homo sapien
tgttatgcaaccattaaaaattagg

SEQ ID NO: 619283 - DNA, 25 bp, Homo sapien
taaaaattaggtttggccaggcgcg

SEQ ID NO: 619284 - DNA, 25 bp, Homo sapien
aaattaggtttggccaggcgcggtg

SEQ ID NO: 619285 - DNA, 25 bp, Homo sapien
aattaggtttggccaggcgcggtgg

SEQ ID NO: 619286 - DNA, 25 bp, Homo sapien
ggccaacatagtgaagccttgtctt

SEQ ID NO: 619287 - DNA, 25 bp, Homo sapien
gccaacatagtgaagccttgtcttt

SEQ ID NO: 619288 - DNA, 25 bp, Homo sapien
acatagtgaagccttgtctttacta

SEQ ID NO: 619289 - DNA, 25 bp, Homo sapien
catagtgaagccttgtctttactaa

SEQ ID NO: 619290 - DNA, 25 bp, Homo sapien
tagtgaagccttgtctttactaaaa

SEQ ID NO: 619291 - DNA, 25 bp, Homo sapien
ttttgccatgttgcgcaactaatga

SEQ ID NO: 619292 - DNA, 25 bp, Homo sapien
gttgcgcaactaatgaagtccatct

SEQ ID NO: 619293 - DNA, 25 bp, Homo sapien
ctaatgaagtccatctaattttgcc

SEQ ID NO: 619294 - DNA, 25 bp, Homo sapien
tctaattttgccactggatgcatta

SEQ ID NO: 619295 - DNA, 25 bp, Homo sapien
gccactggatgcattatgacactct

SEQ ID NO: 619296 - DNA, 25 bp, Homo sapien
cactggatgcattatgacactctcc

SEQ ID NO: 619297 - DNA, 25 bp, Homo sapien
atgaatcaagctcattatgaaacca

SEQ ID NO: 619298 - DNA, 25 bp, Homo sapien
gtaaaattttctcctatgaaactca

SEQ ID NO: 619299 - DNA, 25 bp, Homo sapien
aattttctcctatgaaactcatcat

SEQ ID NO: 619300 - DNA, 25 bp, Homo sapien
gaaactcatcatataacacagacat

SEQ ID NO: 619301 - DNA, 25 bp, Homo sapien
atatgtgcgattaaattgtttggga

SEQ ID NO: 619302 - DNA, 25 bp, Homo sapien
aagaaagtaactcagggccagacac

SEQ ID NO: 619303 - DNA, 25 bp, Homo sapien
gaaagtaactcagggccagacacag

SEQ ID NO: 619304 - DNA, 25 bp, Homo sapien
aggttaaggccgtagtgtgccttga

SEQ ID NO: 619305 - DNA, 25 bp, Homo sapien
ggttaaggccgtagtgtgccttgac

SEQ ID NO: 619306 - DNA, 25 bp, Homo sapien
gttaaggccgtagtgtgccttgact

SEQ ID NO: 619307 - DNA, 25 bp, Homo sapien
ttaaggccgtagtgtgccttgactg

SEQ ID NO: 619308 - DNA, 25 bp, Homo sapien
taaggccgtagtgtgccttgactgt

SEQ ID NO: 619309 - DNA, 25 bp, Homo sapien
aaggccgtagtgtgccttgactgtg

SEQ ID NO: 619310 - DNA, 25 bp, Homo sapien
aggccgtagtgtgccttgactgtgc

SEQ ID NO: 619311 - DNA, 25 bp, Homo sapien
gccgtagtgtgccttgactgtgcca

SEQ ID NO: 619312 - DNA, 25 bp, Homo sapien
tagtgtgccttgactgtgccactgc

SEQ ID NO: 619313 - DNA, 25 bp, Homo sapien
catttgaatattcagcactggaatc

SEQ ID NO: 619314 - DNA, 25 bp, Homo sapien
gaatattcagcactggaatctttaa

SEQ ID NO: 619315 - DNA, 25 bp, Homo sapien
tcagcactggaatctttaatgggta

SEQ ID NO: 619316 - DNA, 25 bp, Homo sapien
cactggaatctttaatgggtagaga

SEQ ID NO: 619317 - DNA, 25 bp, Homo sapien
aaaacagtctaatatttgattcata

SEQ ID NO: 619318 - DNA, 25 bp, Homo sapien
ctaatatttgattcatattcccaaa

SEQ ID NO: 619319 - DNA, 25 bp, Homo sapien
atacgtaaagtaatgaaagtgtcct

SEQ ID NO: 619320 - DNA, 25 bp, Homo sapien
tataagcaatatagcaagtctcaag

SEQ ID NO: 619321 - DNA, 25 bp, Homo sapien
aagcaatatagcaagtctcaagagt

SEQ ID NO: 619322 - DNA, 25 bp, Homo sapien
aaccagattcaactttattaacttg

SEQ ID NO: 619323 - DNA, 25 bp, Homo sapien
caactttattaacttgtgtcacaag

SEQ ID NO: 619324 - DNA, 25 bp, Homo sapien
caattccaggcattggctcctggat

SEQ ID NO: 619325 - DNA, 25 bp, Homo sapien
ggctcctggatgtcatttctggact

SEQ ID NO: 619326 - DNA, 25 bp, Homo sapien
cagccttcctcacaagctgactgaa

SEQ ID NO: 619327 - DNA, 25 bp, Homo sapien
ccttgagtgaacattagtggtatcc

SEQ ID NO: 619328 - DNA, 25 bp, Homo sapien
tagtggtatccaggcagtacttgct

SEQ ID NO: 619329 - DNA, 25 bp, Homo sapien
gtatccaggcagtacttgctacagg

SEQ ID NO: 619330 - DNA, 25 bp, Homo sapien
ggcagtacttgctacaggcccgagt

SEQ ID NO: 619331 - DNA, 25 bp, Homo sapien
ggcccgagtggcatagagagattct

SEQ ID NO: 619332 - DNA, 25 bp, Homo sapien
gggtgccagcttagctgcagtagta

SEQ ID NO: 619333 - DNA, 25 bp, Homo sapien
gctgcagtagtatagagtacccaat

SEQ ID NO: 619334 - DNA, 25 bp, Homo sapien
tagagtacccaataaattcctaagt

SEQ ID NO: 619335 - DNA, 25 bp, Homo sapien
tccagcctgtggtaacctctattct

SEQ ID NO: 619336 - DNA, 25 bp, Homo sapien
cagcctgtggtaacctctattctag

SEQ ID NO: 619337 - DNA, 25 bp, Homo sapien
gcctgtggtaacctctattctagtt

SEQ ID NO: 619338 - DNA, 25 bp, Homo sapien
tgtggtaacctctattctagtttct

SEQ ID NO: 619339 - DNA, 25 bp, Homo sapien
cctcatataggaggattatacaata

SEQ ID NO: 619340 - DNA, 25 bp, Homo sapien
atctgttgatgaacacttgagttct

SEQ ID NO: 619341 - DNA, 25 bp, Homo sapien
gatgaacacttgagttcttcccctc

SEQ ID NO: 619342 - DNA, 25 bp, Homo sapien
gaacacttgagttcttcccctcttt

SEQ ID NO: 619343 - DNA, 25 bp, Homo sapien
tcttcccctctttcagttattgtga

SEQ ID NO: 619344 - DNA, 25 bp, Homo sapien
ttcccctctttcagttattgtgagt

SEQ ID NO: 619345 - DNA, 25 bp, Homo sapien
ccctctttcagttattgtgagtaat

SEQ ID NO: 619346 - DNA, 25 bp, Homo sapien
tctggtggtgactcctataaactgc

SEQ ID NO: 619347 - DNA, 25 bp, Homo sapien
aactgcaaacacgtaatccccgaga

SEQ ID NO: 619348 - DNA, 25 bp, Homo sapien
aatccccgagactcccaaatagtat

SEQ ID NO: 619349 - DNA, 25 bp, Homo sapien
aaacacctaatatataatccctaag

SEQ ID NO: 619350 - DNA, 25 bp, Homo sapien
aatccctaagacttctgagagttgt

SEQ ID NO: 619351 - DNA, 25 bp, Homo sapien
ttgtgactgacagaggcaactcttt

SEQ ID NO: 619352 - DNA, 25 bp, Homo sapien
gaggcaactctttgaagatagcaaa

SEQ ID NO: 619353 - DNA, 25 bp, Homo sapien
agagtcttagttatgcattttttgg

SEQ ID NO: 619354 - DNA, 25 bp, Homo sapien
gaagcttttcttgatgtggttctat

SEQ ID NO: 619355 - DNA, 25 bp, Homo sapien
gattttacaaatcgattttctctta

SEQ ID NO: 619356 - DNA, 25 bp, Homo sapien
ttcttatacttttcagctaccttca

SEQ ID NO: 619357 - DNA, 25 bp, Homo sapien
ggctggcacattcctgagccaaaat

SEQ ID NO: 619358 - DNA, 25 bp, Homo sapien
aatgcacacataagctgctttccct

SEQ ID NO: 619359 - DNA, 25 bp, Homo sapien
gtagcaaagctcttcactcctgagt

SEQ ID NO: 619360 - DNA, 25 bp, Homo sapien
gggcattctcaattggattacgctg

SEQ ID NO: 619361 - DNA, 25 bp, Homo sapien
aaggcctgcggtatgttatttcaac

SEQ ID NO: 619362 - DNA, 25 bp, Homo sapien
atttggcttcagaaatgcctgtctc

SEQ ID NO: 619363 - DNA, 25 bp, Homo sapien
agaaatgcctgtctcgacctttttg

SEQ ID NO: 619364 - DNA, 25 bp, Homo sapien
acctttttgccctcagagtctactt

SEQ ID NO: 619365 - DNA, 25 bp, Homo sapien
ttgctttctagagggtcaccagcct

SEQ ID NO: 619366 - DNA, 25 bp, Homo sapien
ccatgcatgttctttaccctgcaaa

SEQ ID NO: 619367 - DNA, 25 bp, Homo sapien
ttaccctgcaaatattggcccatgt

SEQ ID NO: 619368 - DNA, 25 bp, Homo sapien
gggactcattaaactatggtacaag

SEQ ID NO: 619369 - DNA, 25 bp, Homo sapien
atggtacaagcttagatatgactct

SEQ ID NO: 619370 - DNA, 25 bp, Homo sapien
caagcttagatatgactctgtagtc

SEQ ID NO: 619371 - DNA, 25 bp, Homo sapien
aattgttcacaatatttcagccaat

SEQ ID NO: 619372 - DNA, 25 bp, Homo sapien
atttcagccaataaacaatagtata

SEQ ID NO: 619373 - DNA, 25 bp, Homo sapien
aatagtggttatctttgtgtgcggt

SEQ ID NO: 619374 - DNA, 25 bp, Homo sapien
ggttatctttgtgtgcggtgaatat

SEQ ID NO: 619375 - DNA, 25 bp, Homo sapien
tgtgcggtgaatatgtatgatactt

SEQ ID NO: 619376 - DNA, 25 bp, Homo sapien
ttttctttttcatgctcacctatca

SEQ ID NO: 619377 - DNA, 25 bp, Homo sapien
tttcatgctcacctatcaattctaa

SEQ ID NO: 619378 - DNA, 25 bp, Homo sapien
gctcacctatcaattctaatcttag

SEQ ID NO: 619379 - DNA, 25 bp, Homo sapien
aaacctctgcatagttctgccaatg

SEQ ID NO: 619380 - DNA, 25 bp, Homo sapien
atagttctgccaatgcaccgccatg

SEQ ID NO: 619381 - DNA, 25 bp, Homo sapien
aatgcaccgccatgctggcctgtag

SEQ ID NO: 619382 - DNA, 25 bp, Homo sapien
tggcctgtagcatcccttattattc

SEQ ID NO: 619383 - DNA, 25 bp, Homo sapien
cttattattccatagctgtgtcttt

SEQ ID NO: 619384 - DNA, 25 bp, Homo sapien
agacaaaccaaacctcgtgtgattt

SEQ ID NO: 619385 - DNA, 25 bp, Homo sapien
aaacctcgtgtgatttgatatgatt

SEQ ID NO: 619386 - DNA, 25 bp, Homo sapien
gaaatcccaatactcatttgtccag

SEQ ID NO: 619387 - DNA, 25 bp, Homo sapien
aatactcatttgtccagtgatccaa

SEQ ID NO: 619388 - DNA, 25 bp, Homo sapien
gtgatccaaaccaaaaagtgcattc

SEQ ID NO: 619389 - DNA, 25 bp, Homo sapien
gaaagggaaaaccagtgctactacg

SEQ ID NO: 619390 - DNA, 25 bp, Homo sapien
ggaagatttgtctctactgcggtcg

SEQ ID NO: 619391 - DNA, 25 bp, Homo sapien
tctctactgcggtcgttagggatgg

SEQ ID NO: 619392 - DNA, 25 bp, Homo sapien
gatgggctagggaaccccgaacttg

SEQ ID NO: 619393 - DNA, 25 bp, Homo sapien
tcctctccagctcatggctgtaaaa

SEQ ID NO: 619394 - DNA, 25 bp, Homo sapien
atggctgtaaaaaccctgagcatct

SEQ ID NO: 619395 - DNA, 25 bp, Homo sapien
gagcatctatgagatatgacgcaga

SEQ ID NO: 619396 - DNA, 25 bp, Homo sapien
tttaaaggcgatctcttgaaagcaa

SEQ ID NO: 619397 - DNA, 25 bp, Homo sapien
aaaaacattaacatccctcgcagtg

SEQ ID NO: 619398 - DNA, 25 bp, Homo sapien
tcgcagtgctgcatcacagaaactt

SEQ ID NO: 619399 - DNA, 25 bp, Homo sapien
aaaataatacgaggcctccttcata

SEQ ID NO: 619400 - DNA, 25 bp, Homo sapien
cctccttcatacctcttaaaacaag

SEQ ID NO: 619401 - DNA, 25 bp, Homo sapien
gaaagcctttcatcttcattcatct

SEQ ID NO: 619402 - DNA, 25 bp, Homo sapien
agtagacatttgttctcaccctgga

SEQ ID NO: 619403 - DNA, 25 bp, Homo sapien
gagaaactgcgaatctaaaaggaat

SEQ ID NO: 619404 - DNA, 25 bp, Homo sapien
actgcgaatctaaaaggaatatgac

SEQ ID NO: 619405 - DNA, 25 bp, Homo sapien
acaaagccttcagcgtggtctcaaa

SEQ ID NO: 619406 - DNA, 25 bp, Homo sapien
ttcatacaagaactcacactgcaga

SEQ ID NO: 619407 - DNA, 25 bp, Homo sapien
acactgcagagactccttacggaaa

SEQ ID NO: 619408 - DNA, 25 bp, Homo sapien
cactgcagagactccttacggaaat

SEQ ID NO: 619409 - DNA, 25 bp, Homo sapien
ctgcagagactccttacggaaataa

SEQ ID NO: 619410 - DNA, 25 bp, Homo sapien
gcagagactccttacggaaataaaa

SEQ ID NO: 619411 - DNA, 25 bp, Homo sapien
aatgtaggaaagacctgccggccgc

SEQ ID NO: 619412 - DNA, 25 bp, Homo sapien
ggccatccggctgattgacattgag

SEQ ID NO: 619413 - DNA, 25 bp, Homo sapien
acattgagagggacaacgaggacca

SEQ ID NO: 619414 - DNA, 25 bp, Homo sapien
ttcaagcgggaggtgatggcctaca

SEQ ID NO: 619415 - DNA, 25 bp, Homo sapien
tggcctacaggcagacacggcatga

SEQ ID NO: 619416 - DNA, 25 bp, Homo sapien
gcttttcatgggtgcctgcatgagc

SEQ ID NO: 619417 - DNA, 25 bp, Homo sapien
gccatcatcaccaggccagtttgat

SEQ ID NO: 619418 - DNA, 25 bp, Homo sapien
ggccagtttgattgtcctaaatata

SEQ ID NO: 619419 - DNA, 25 bp, Homo sapien
tgaagattccgtccccatcatcgag

SEQ ID NO: 619420 - DNA, 25 bp, Homo sapien
catcatcgagtggaagcggcttcct

SEQ ID NO: 619421 - DNA, 25 bp, Homo sapien
agctgaatcgctttccctttataaa

SEQ ID NO: 619422 - DNA, 25 bp, Homo sapien
tttccctttataaagcacagctgaa

SEQ ID NO: 619423 - DNA, 25 bp, Homo sapien
gagagctctctagtgtcccttttat

SEQ ID NO: 619424 - DNA, 25 bp, Homo sapien
gctctctagtgtcccttttataggg

SEQ ID NO: 619425 - DNA, 25 bp, Homo sapien
gggcactaatcccactcaggaggac

SEQ ID NO: 619426 - DNA, 25 bp, Homo sapien
actaatcccactcaggaggactcca

SEQ ID NO: 619427 - DNA, 25 bp, Homo sapien
aggaggactccaccctctggatcta

SEQ ID NO: 619428 - DNA, 25 bp, Homo sapien
gggacacaaatattagctctcctgt

SEQ ID NO: 619429 - DNA, 25 bp, Homo sapien
aaatattagctctcctgtgatcttt

SEQ ID NO: 619430 - DNA, 25 bp, Homo sapien
tattagctctcctgtgatctttcaa

SEQ ID NO: 619431 - DNA, 25 bp, Homo sapien
ttagctctcctgtgatctttcaaga

SEQ ID NO: 619432 - DNA, 25 bp, Homo sapien
gctctcctgtgatctttcaagaaga

SEQ ID NO: 619433 - DNA, 25 bp, Homo sapien
aagctttgtacatttcacagttaga

SEQ ID NO: 619434 - DNA, 25 bp, Homo sapien
atgcccagcacctgaaaccatgcgt

SEQ ID NO: 619435 - DNA, 25 bp, Homo sapien
acctgaaaccatgcgttcctgagag

SEQ ID NO: 619436 - DNA, 25 bp, Homo sapien
gttcctgagagatggttgtggtttc

SEQ ID NO: 619437 - DNA, 25 bp, Homo sapien
gagggctgggactctctaggtcacc

SEQ ID NO: 619438 - DNA, 25 bp, Homo sapien
gtgaagacagccctagccaggcctc

SEQ ID NO: 619439 - DNA, 25 bp, Homo sapien
aggcctcctgtcaagtcgcactgct

SEQ ID NO: 619440 - DNA, 25 bp, Homo sapien
tatgcagccctgagtccaagctcag

SEQ ID NO: 619441 - DNA, 25 bp, Homo sapien
agccctgagtccaagctcagtggcg

SEQ ID NO: 619442 - DNA, 25 bp, Homo sapien
gctcagtggcggtgacccccaaaga

SEQ ID NO: 619443 - DNA, 25 bp, Homo sapien
gaaccagctggttccaaaagatgga

SEQ ID NO: 619444 - DNA, 25 bp, Homo sapien
gtgttttggaagctgtcatgatgat

SEQ ID NO: 619445 - DNA, 25 bp, Homo sapien
tgcccagatctgcactattcggagg

SEQ ID NO: 619446 - DNA, 25 bp, Homo sapien
gatctgcactattcggaggcagaaa

SEQ ID NO: 619447 - DNA, 25 bp, Homo sapien
aaagggctgccagtttctagggcct

SEQ ID NO: 619448 - DNA, 25 bp, Homo sapien
tttctagggcctaatgagtaaggaa

SEQ ID NO: 619449 - DNA, 25 bp, Homo sapien
agaaggtcacatgcttagcctggca

SEQ ID NO: 619450 - DNA, 25 bp, Homo sapien
acatgcttagcctggcatacccagt

SEQ ID NO: 619451 - DNA, 25 bp, Homo sapien
ggcatacccagtccctggctaaaga

SEQ ID NO: 619452 - DNA, 25 bp, Homo sapien
gtccctggctaaagaactgagtata

SEQ ID NO: 619453 - DNA, 25 bp, Homo sapien
actgagtatacaaaactagcctaga

SEQ ID NO: 619454 - DNA, 25 bp, Homo sapien
gaataatcaggacccacctgctggt

SEQ ID NO: 619455 - DNA, 25 bp, Homo sapien
caacagtgtctgctatgtcatcatt

SEQ ID NO: 619456 - DNA, 25 bp, Homo sapien
ttcagccaagtgattctgggcatgg

SEQ ID NO: 619457 - DNA, 25 bp, Homo sapien
ctgggcatgggaatgccctcagcat

SEQ ID NO: 619458 - DNA, 25 bp, Homo sapien
aatgccctcagcatggcatcttagg

SEQ ID NO: 619459 - DNA, 25 bp, Homo sapien
cctggctctctggatagacacggat

SEQ ID NO: 619460 - DNA, 25 bp, Homo sapien
tagacacggatgactggcggcactg

SEQ ID NO: 619461 - DNA, 25 bp, Homo sapien
ctggtgagaaagagacggccctgac

SEQ ID NO: 619462 - DNA, 25 bp, Homo sapien
caacctgagaccctgctccagaggg

SEQ ID NO: 619463 - DNA, 25 bp, Homo sapien
aacccaagtaggtgactggagttct

SEQ ID NO: 619464 - DNA, 25 bp, Homo sapien
actggagttctgtgtttaaccaaat

SEQ ID NO: 619465 - DNA, 25 bp, Homo sapien
taataatcctgtccagcaacgcaag

SEQ ID NO: 619466 - DNA, 25 bp, Homo sapien
tgtccagcaacgcaagctctaaaag

SEQ ID NO: 619467 - DNA, 25 bp, Homo sapien
tacaggctcggacctcattgtacag

SEQ ID NO: 619468 - DNA, 25 bp, Homo sapien
ctcggacctcattgtacagcttgga

SEQ ID NO: 619469 - DNA, 25 bp, Homo sapien
gcacagcaggagagtcaaattagtt

SEQ ID NO: 619470 - DNA, 25 bp, Homo sapien
gtatgtctgtactaactgaaggatc

SEQ ID NO: 619471 - DNA, 25 bp, Homo sapien
gaaggatcaaacctcccatgtcaaa

SEQ ID NO: 619472 - DNA, 25 bp, Homo sapien
tcccatgtcaaaaccaaccaacgtt

SEQ ID NO: 619473 - DNA, 25 bp, Homo sapien
ccaaccaacgttggcatgggcatgg

SEQ ID NO: 619474 - DNA, 25 bp, Homo sapien
gttgtcacattactaagccagcctg

SEQ ID NO: 619475 - DNA, 25 bp, Homo sapien
agcctgcttccaactactgtcatgg

SEQ ID NO: 619476 - DNA, 25 bp, Homo sapien
actactgtcatggaggattccacta

SEQ ID NO: 619477 - DNA, 25 bp, Homo sapien
ggaggattccactactaggttaatt

SEQ ID NO: 619478 - DNA, 25 bp, Homo sapien
gggtgtaatcgctccagcgggaaaa

SEQ ID NO: 619479 - DNA, 25 bp, Homo sapien
tcgctccagcgggaaaacgaggcct

SEQ ID NO: 619480 - DNA, 25 bp, Homo sapien
gagcgcttccagtccctcggtagag

SEQ ID NO: 619481 - DNA, 25 bp, Homo sapien
ggtagagccacgtgctcaggatttt

SEQ ID NO: 619482 - DNA, 25 bp, Homo sapien
gattttcgggcgtgtgcttcgtgca

SEQ ID NO: 619483 - DNA, 25 bp, Homo sapien
tgtgcttcgtgcacgctcatccaga

SEQ ID NO: 619484 - DNA, 25 bp, Homo sapien
cagacgctgcagaaacctggttcct

SEQ ID NO: 619485 - DNA, 25 bp, Homo sapien
gtctgttctgggaggctagaatcca

SEQ ID NO: 619486 - DNA, 25 bp, Homo sapien
tgggagaccgagctgctccaaagcc

SEQ ID NO: 619487 - DNA, 25 bp, Homo sapien
tggcttttctgagggtcattaaacg

SEQ ID NO: 619488 - DNA, 25 bp, Homo sapien
tgagggtcattaaacgcagtttctc

SEQ ID NO: 619489 - DNA, 25 bp, Homo sapien
cactgagagagagaagatcactgga

SEQ ID NO: 619490 - DNA, 25 bp, Homo sapien
gaagatcactggatcaaaccccgag

SEQ ID NO: 619491 - DNA, 25 bp, Homo sapien
aagatcactggatcaaaccccgagt

SEQ ID NO: 619492 - DNA, 25 bp, Homo sapien
gatcactggatcaaaccccgagtgt

SEQ ID NO: 619493 - DNA, 25 bp, Homo sapien
tcactggatcaaaccccgagtgtgg

SEQ ID NO: 619494 - DNA, 25 bp, Homo sapien
cactggatcaaaccccgagtgtggc

SEQ ID NO: 619495 - DNA, 25 bp, Homo sapien
atcaaaccccgagtgtggcgtgggt

SEQ ID NO: 619496 - DNA, 25 bp, Homo sapien
ggtgaggtgcaggagcctaaccaac

SEQ ID NO: 619497 - DNA, 25 bp, Homo sapien
gtgaggtgcaggagcctaaccaacg

SEQ ID NO: 619498 - DNA, 25 bp, Homo sapien
gtgcaggagcctaaccaacggtaag

SEQ ID NO: 619499 - DNA, 25 bp, Homo sapien
tgcaggagcctaaccaacggtaagg

SEQ ID NO: 619500 - DNA, 25 bp, Homo sapien
tgcagcactgaggtgtcatcttcac

SEQ ID NO: 619501 - DNA, 25 bp, Homo sapien
ggtgtcatcttcacttctaacaatg

SEQ ID NO: 619502 - DNA, 25 bp, Homo sapien
aacaatggcaaacccaagctggcat

SEQ ID NO: 619503 - DNA, 25 bp, Homo sapien
aagctggcatctctgtacccactct

SEQ ID NO: 619504 - DNA, 25 bp, Homo sapien
gaatgtcttcagtgctgacataata

SEQ ID NO: 619505 - DNA, 25 bp, Homo sapien
aaaagctgtcaatcacctaaacgcc

SEQ ID NO: 619506 - DNA, 25 bp, Homo sapien
caatcacctaaacgcccagctgtag

SEQ ID NO: 619507 - DNA, 25 bp, Homo sapien
gggactgcagaaatgcatcgtatga

SEQ ID NO: 619508 - DNA, 25 bp, Homo sapien
gtatgaaactcatccactgcatgaa

SEQ ID NO: 619509 - DNA, 25 bp, Homo sapien
actgcatgaactactcttgccatca

SEQ ID NO: 619510 - DNA, 25 bp, Homo sapien
actcttgccatcagcagcattcaaa

SEQ ID NO: 619511 - DNA, 25 bp, Homo sapien
cagtaattgagagtgcaggcttgaa

SEQ ID NO: 619512 - DNA, 25 bp, Homo sapien
aattgagagtgcaggcttgaaggca

SEQ ID NO: 619513 - DNA, 25 bp, Homo sapien
gtactgaacactatatatactaggt

SEQ ID NO: 619514 - DNA, 25 bp, Homo sapien
tgaacactatatatactaggttttt

SEQ ID NO: 619515 - DNA, 25 bp, Homo sapien
tacatacgtacctaagataaaattt

SEQ ID NO: 619516 - DNA, 25 bp, Homo sapien
ttatgcagaataagagactaacaat

SEQ ID NO: 619517 - DNA, 25 bp, Homo sapien
gaatgattataacaatatgctgtaa

SEQ ID NO: 619518 - DNA, 25 bp, Homo sapien
gctgtaatagaagtcatgcaaatgt

SEQ ID NO: 619519 - DNA, 25 bp, Homo sapien
gaagtcatgcaaatgtgcatctctc

SEQ ID NO: 619520 - DNA, 25 bp, Homo sapien
agtcatgcaaatgtgcatctctctc

SEQ ID NO: 619521 - DNA, 25 bp, Homo sapien
gtcatgcaaatgtgcatctctctct

SEQ ID NO: 619522 - DNA, 25 bp, Homo sapien
aacgtgtgtatgtatgcttgcagca

SEQ ID NO: 619523 - DNA, 25 bp, Homo sapien
gcttgcagcatttttgtagtaatac

SEQ ID NO: 619524 - DNA, 25 bp, Homo sapien
attttcttatcttcctgtaattagg

SEQ ID NO: 619525 - DNA, 25 bp, Homo sapien
cttatcttcctgtaattaggtattg

SEQ ID NO: 619526 - DNA, 25 bp, Homo sapien
gaatacctctcaaaatagattgtaa

SEQ ID NO: 619527 - DNA, 25 bp, Homo sapien
atttttctcacccattttgctgaag

SEQ ID NO: 619528 - DNA, 25 bp, Homo sapien
ttctcacccattttgctgaaggcta

SEQ ID NO: 619529 - DNA, 25 bp, Homo sapien
cacccattttgctgaaggctaccaa

SEQ ID NO: 619530 - DNA, 25 bp, Homo sapien
tttgctgaaggctaccaagttacat

SEQ ID NO: 619531 - DNA, 25 bp, Homo sapien
gaaggctaccaagttacataatgaa

SEQ ID NO: 619532 - DNA, 25 bp, Homo sapien
tatgacttggtgcctttttagtaaa

SEQ ID NO: 619533 - DNA, 25 bp, Homo sapien
aagaaccgatgtttcattctctccc

SEQ ID NO: 619534 - DNA, 25 bp, Homo sapien
gggtgggctacatcttcttacccaa

SEQ ID NO: 619535 - DNA, 25 bp, Homo sapien
tcttcttacccaaacaaccaggagc

SEQ ID NO: 619536 - DNA, 25 bp, Homo sapien
aaccaggagcatttgttggcaagtt

SEQ ID NO: 619537 - DNA, 25 bp, Homo sapien
gcaagtttattgtgcccagtgccga

SEQ ID NO: 619538 - DNA, 25 bp, Homo sapien
gtgcccagtgccgatgtctggacaa

SEQ ID NO: 619539 - DNA, 25 bp, Homo sapien
gatgtctggacaattaattccctag

SEQ ID NO: 619540 - DNA, 25 bp, Homo sapien
aattccctaggtcagtggctttcac

SEQ ID NO: 619541 - DNA, 25 bp, Homo sapien
acagtttgtgatggtgactccagga

SEQ ID NO: 619542 - DNA, 25 bp, Homo sapien
ggaaggaaactcaccatgaccctgt

SEQ ID NO: 619543 - DNA, 25 bp, Homo sapien
aaactcaccatgaccctgtatatac

SEQ ID NO: 619544 - DNA, 25 bp, Homo sapien
taaatggtatgtctctgtagggcac

SEQ ID NO: 619545 - DNA, 25 bp, Homo sapien
atggtatgtctctgtagggcactta

SEQ ID NO: 619546 - DNA, 25 bp, Homo sapien
tatgtctctgtagggcacttaccat

SEQ ID NO: 619547 - DNA, 25 bp, Homo sapien
cttgcaggacgggaagttgtcctga

SEQ ID NO: 619548 - DNA, 25 bp, Homo sapien
tgtgaacggctaggacattactata

SEQ ID NO: 619549 - DNA, 25 bp, Homo sapien
ggctaggacattactataaaccact

SEQ ID NO: 619550 - DNA, 25 bp, Homo sapien
tactataaaccactatagactttat

SEQ ID NO: 619551 - DNA, 25 bp, Homo sapien
aacactgtatacttaggctatgcca

SEQ ID NO: 619552 - DNA, 25 bp, Homo sapien
cactgtatacttaggctatgccaaa

SEQ ID NO: 619553 - DNA, 25 bp, Homo sapien
tacttaggctatgccaaatttatca

SEQ ID NO: 619554 - DNA, 25 bp, Homo sapien
tatattaaccttggcttataacttt

SEQ ID NO: 619555 - DNA, 25 bp, Homo sapien
aactgccagacattctggttttttg

SEQ ID NO: 619556 - DNA, 25 bp, Homo sapien
tgagacagggtctgggtctttcacc

SEQ ID NO: 619557 - DNA, 25 bp, Homo sapien
gcctctgctccccagtagctgcaac

SEQ ID NO: 619558 - DNA, 25 bp, Homo sapien
ctctgctccccagtagctgcaacca

SEQ ID NO: 619559 - DNA, 25 bp, Homo sapien
tgctccccagtagctgcaaccacag

SEQ ID NO: 619560 - DNA, 25 bp, Homo sapien
gagacagtgtctcaccatgaggcag

SEQ ID NO: 619561 - DNA, 25 bp, Homo sapien
agacagtgtctcaccatgaggcagg

SEQ ID NO: 619562 - DNA, 25 bp, Homo sapien
gacagtgtctcaccatgaggcagga

SEQ ID NO: 619563 - DNA, 25 bp, Homo sapien
cagtgtctcaccatgaggcaggaga

SEQ ID NO: 619564 - DNA, 25 bp, Homo sapien
agtgtctcaccatgaggcaggagaa

SEQ ID NO: 619565 - DNA, 25 bp, Homo sapien
aatcacttgaacttgtggggtggag

SEQ ID NO: 619566 - DNA, 25 bp, Homo sapien
ataatggactatactgctctgcagt

SEQ ID NO: 619567 - DNA, 25 bp, Homo sapien
actgctctgcagtataaaggaacaa

SEQ ID NO: 619568 - DNA, 25 bp, Homo sapien
aaaggaacaaactgacacatgcaac

SEQ ID NO: 619569 - DNA, 25 bp, Homo sapien
tgcaacaacatggattagtgtcaaa

SEQ ID NO: 619570 - DNA, 25 bp, Homo sapien
gattagtgtcaaaaacttggtgagt

SEQ ID NO: 619571 - DNA, 25 bp, Homo sapien
gaagatagacgcgagtacctactgt

SEQ ID NO: 619572 - DNA, 25 bp, Homo sapien
gtacctactgtatgatcctgtagac

SEQ ID NO: 619573 - DNA, 25 bp, Homo sapien
tcctgtagacatgaaattctagata

SEQ ID NO: 619574 - DNA, 25 bp, Homo sapien
agttatagaaagaacagtggttgcc

SEQ ID NO: 619575 - DNA, 25 bp, Homo sapien
gggtgattgactgcaaaagggctca

SEQ ID NO: 619576 - DNA, 25 bp, Homo sapien
gcaaaagggctcaagggagtgttta

SEQ ID NO: 619577 - DNA, 25 bp, Homo sapien
gagtatttattaactgccaagacta

SEQ ID NO: 619578 - DNA, 25 bp, Homo sapien
gtatttattaactgccaagactatg

SEQ ID NO: 619579 - DNA, 25 bp, Homo sapien
ttattaactgccaagactatgctca

SEQ ID NO: 619580 - DNA, 25 bp, Homo sapien
ttaactgccaagactatgctcagtg

SEQ ID NO: 619581 - DNA, 25 bp, Homo sapien
ctgccaagactatgctcagtgcttt

SEQ ID NO: 619582 - DNA, 25 bp, Homo sapien
tgccaagactatgctcagtgctttt

SEQ ID NO: 619583 - DNA, 25 bp, Homo sapien
gccaagactatgctcagtgcttttc

SEQ ID NO: 619584 - DNA, 25 bp, Homo sapien
caagactatgctcagtgcttttcat

SEQ ID NO: 619585 - DNA, 25 bp, Homo sapien
agactatgctcagtgcttttcatgc

SEQ ID NO: 619586 - DNA, 25 bp, Homo sapien
tcatgcattatctcattgtttgaaa

SEQ ID NO: 619587 - DNA, 25 bp, Homo sapien
gcattatctcattgtttgaaatttc

SEQ ID NO: 619588 - DNA, 25 bp, Homo sapien
gatggataagtttatggcactgaca

SEQ ID NO: 619589 - DNA, 25 bp, Homo sapien
atggcactgacaatgatagtttgat

SEQ ID NO: 619590 - DNA, 25 bp, Homo sapien
ggtttcatggtacgtacttatctcc

SEQ ID NO: 619591 - DNA, 25 bp, Homo sapien
tggtacgtacttatctccaaatgca

SEQ ID NO: 619592 - DNA, 25 bp, Homo sapien
atctccaaatgcatcaagttgcaaa

SEQ ID NO: 619593 - DNA, 25 bp, Homo sapien
caaaataaatatctgcagtgctctg

SEQ ID NO: 619594 - DNA, 25 bp, Homo sapien
aatatctgcagtgctctgtatttga

SEQ ID NO: 619595 - DNA, 25 bp, Homo sapien
gtgctctgtatttgagttgtactca

SEQ ID NO: 619596 - DNA, 25 bp, Homo sapien
gaaatgaaatcatatcccattggga

SEQ ID NO: 619597 - DNA, 25 bp, Homo sapien
ccattgggatagagtgagggaacat

SEQ ID NO: 619598 - DNA, 25 bp, Homo sapien
gacaagcgtggatggagctagttat

SEQ ID NO: 619599 - DNA, 25 bp, Homo sapien
gatagttggattctcgtatctgttt

SEQ ID NO: 619600 - DNA, 25 bp, Homo sapien
gtatctgtttttgtattcagtctgt

SEQ ID NO: 619601 - DNA, 25 bp, Homo sapien
gaaggaaatccagctacatacagat

SEQ ID NO: 619602 - DNA, 25 bp, Homo sapien
gctacatacagatttggagttggaa

SEQ ID NO: 619603 - DNA, 25 bp, Homo sapien
cctttttagatcatggtggatactc

SEQ ID NO: 619604 - DNA, 25 bp, Homo sapien
catggtggatactcttctttgttat

SEQ ID NO: 619605 - DNA, 25 bp, Homo sapien
ggatactcttctttgttatgtcatc

SEQ ID NO: 619606 - DNA, 25 bp, Homo sapien
gcagtttctgaaaaattagttgtaa

SEQ ID NO: 619607 - DNA, 25 bp, Homo sapien
tagttgaatccatatcagtgaactc

SEQ ID NO: 619608 - DNA, 25 bp, Homo sapien
cagtgaactcatacttttctatatt

SEQ ID NO: 619609 - DNA, 25 bp, Homo sapien
cttttctatattaaacttcattgct

SEQ ID NO: 619610 - DNA, 25 bp, Homo sapien
ggacctgaagttgaactgccttggc

SEQ ID NO: 619611 - DNA, 25 bp, Homo sapien
gaactgccttggctcttgttcccat

SEQ ID NO: 619612 - DNA, 25 bp, Homo sapien
ggcaaggacatctcaccaggtatca

SEQ ID NO: 619613 - DNA, 25 bp, Homo sapien
ccaggtatcagtgggtggtctacac

SEQ ID NO: 619614 - DNA, 25 bp, Homo sapien
gtgggtggtctacactatttgagta

SEQ ID NO: 619615 - DNA, 25 bp, Homo sapien
aaagtcctatccttatagtgttgct

SEQ ID NO: 619616 - DNA, 25 bp, Homo sapien
tagtgttgctttcctgcctggtgac

SEQ ID NO: 619617 - DNA, 25 bp, Homo sapien
ctggtgacttgactgagtttaggct

SEQ ID NO: 619618 - DNA, 25 bp, Homo sapien
gagtttaggcttagcgacctgctta

SEQ ID NO: 619619 - DNA, 25 bp, Homo sapien
gagtacgtacttgcataagcggtta

SEQ ID NO: 619620 - DNA, 25 bp, Homo sapien
gaacagtaccaaacgcttaataaca

SEQ ID NO: 619621 - DNA, 25 bp, Homo sapien
tctgcctccgaaattgttgggattg

SEQ ID NO: 619622 - DNA, 25 bp, Homo sapien
aggcatgagccttcatgtctgaccc

SEQ ID NO: 619623 - DNA, 25 bp, Homo sapien
ccttcatgtctgacccagtctatta

SEQ ID NO: 619624 - DNA, 25 bp, Homo sapien
gacccagtctattaagttttatcat

SEQ ID NO: 619625 - DNA, 25 bp, Homo sapien
catgaatctatgttgtcatatccga

SEQ ID NO: 619626 - DNA, 25 bp, Homo sapien
gttgtcatatccgatgtgtcttgat

SEQ ID NO: 619627 - DNA, 25 bp, Homo sapien
tatttatccaaaatccgatcctgca

SEQ ID NO: 619628 - DNA, 25 bp, Homo sapien
aatccgatcctgcaactgtcaaaga

SEQ ID NO: 619629 - DNA, 25 bp, Homo sapien
gatgattatgtagatttcccctgct

SEQ ID NO: 619630 - DNA, 25 bp, Homo sapien
agatttcccctgcttatctgctaat

SEQ ID NO: 619631 - DNA, 25 bp, Homo sapien
cctgcttatctgctaatgcgatgaa

SEQ ID NO: 619632 - DNA, 25 bp, Homo sapien
tcctacaggcagttattaggtattg

SEQ ID NO: 619633 - DNA, 25 bp, Homo sapien
taggtattgagtgctcacacacccc

SEQ ID NO: 619634 - DNA, 25 bp, Homo sapien
gcatagtcaccacatgccattagct

SEQ ID NO: 619635 - DNA, 25 bp, Homo sapien
attagctccagataaacttccagaa

SEQ ID NO: 619636 - DNA, 25 bp, Homo sapien
ttctcaccaagccagcaggacagag

SEQ ID NO: 619637 - DNA, 25 bp, Homo sapien
aagcctgggctttaagatcaaacaa

SEQ ID NO: 619638 - DNA, 25 bp, Homo sapien
gatcaaacaaacacagcttcaaatt

SEQ ID NO: 619639 - DNA, 25 bp, Homo sapien
agcttcaaattaggactctgtcact

SEQ ID NO: 619640 - DNA, 25 bp, Homo sapien
tctgtcacttcctgtgtactgggca

SEQ ID NO: 619641 - DNA, 25 bp, Homo sapien
gctgagtatgtggtttctcatctgt

SEQ ID NO: 619642 - DNA, 25 bp, Homo sapien
gagaaagatgattatctcccaatct

SEQ ID NO: 619643 - DNA, 25 bp, Homo sapien
aaaacaatttggtatgctgggggat

SEQ ID NO: 619644 - DNA, 25 bp, Homo sapien
atttggtatgctgggggatgtctta

SEQ ID NO: 619645 - DNA, 25 bp, Homo sapien
atgctgggggatgtcttagaagtat

SEQ ID NO: 619646 - DNA, 25 bp, Homo sapien
gggatgtcttagaagtatgtagagt

SEQ ID NO: 619647 - DNA, 25 bp, Homo sapien
cttagaagtatgtagagtagaccag

SEQ ID NO: 619648 - DNA, 25 bp, Homo sapien
tagaagtatgtagagtagaccaggt

SEQ ID NO: 619649 - DNA, 25 bp, Homo sapien
gaagtatgtagagtagaccaggtac

SEQ ID NO: 619650 - DNA, 25 bp, Homo sapien
aagtatgtagagtagaccaggtaca

SEQ ID NO: 619651 - DNA, 25 bp, Homo sapien
gtatgtagagtagaccaggtacagt

SEQ ID NO: 619652 - DNA, 25 bp, Homo sapien
tatgtagagtagaccaggtacagtg

SEQ ID NO: 619653 - DNA, 25 bp, Homo sapien
gtagagtagaccaggtacagtggct

SEQ ID NO: 619654 - DNA, 25 bp, Homo sapien
gatgttgatagacctgctctgatgg

SEQ ID NO: 619655 - DNA, 25 bp, Homo sapien
gttgatagacctgctctgatgggct

SEQ ID NO: 619656 - DNA, 25 bp, Homo sapien
gatagacctgctctgatgggctgac

SEQ ID NO: 619657 - DNA, 25 bp, Homo sapien
agacctgctctgatgggctgaccac

SEQ ID NO: 619658 - DNA, 25 bp, Homo sapien
tttgtcccccgttactgatctcaca

SEQ ID NO: 619659 - DNA, 25 bp, Homo sapien
gcaggcaagtcagtccgtcatctca

SEQ ID NO: 619660 - DNA, 25 bp, Homo sapien
caagtcagtccgtcatctcatctgg

SEQ ID NO: 619661 - DNA, 25 bp, Homo sapien
gtccatttaagtcagctggccaact

SEQ ID NO: 619662 - DNA, 25 bp, Homo sapien
tttaagtcagctggccaactctgtt

SEQ ID NO: 619663 - DNA, 25 bp, Homo sapien
tggccaactctgttaaatggatatg

SEQ ID NO: 619664 - DNA, 25 bp, Homo sapien
tatgaagtgggtacgaagctggttt

SEQ ID NO: 619665 - DNA, 25 bp, Homo sapien
gattatcccagcatcattttcgata

SEQ ID NO: 619666 - DNA, 25 bp, Homo sapien
atcccagcatcattttcgataagta

SEQ ID NO: 619667 - DNA, 25 bp, Homo sapien
ccagcatcattttcgataagtaaat

SEQ ID NO: 619668 - DNA, 25 bp, Homo sapien
aacaatctaaatgtctaacagtagg

SEQ ID NO: 619669 - DNA, 25 bp, Homo sapien
gtctaacagtaggaaaatgtttcag

SEQ ID NO: 619670 - DNA, 25 bp, Homo sapien
agtaaatttgtatatctactcagtg

SEQ ID NO: 619671 - DNA, 25 bp, Homo sapien
ttgtatatctactcagtggactatt

SEQ ID NO: 619672 - DNA, 25 bp, Homo sapien
atctactcagtggactattatgcag

SEQ ID NO: 619673 - DNA, 25 bp, Homo sapien
ctcagtggactattatgcagtcttt

SEQ ID NO: 619674 - DNA, 25 bp, Homo sapien
atgcagtctttaaagtgatataaca

SEQ ID NO: 619675 - DNA, 25 bp, Homo sapien
aaaaagtagcatgtaggcctggcat

SEQ ID NO: 619676 - DNA, 25 bp, Homo sapien
ggaactgaaaataactcaccatatg

SEQ ID NO: 619677 - DNA, 25 bp, Homo sapien
aactcaccatatgtattgagcagga

SEQ ID NO: 619678 - DNA, 25 bp, Homo sapien
gaggatttagaggtacacaaggagt

SEQ ID NO: 619679 - DNA, 25 bp, Homo sapien
gtacacaaggagtttgggtttcatc

SEQ ID NO: 619680 - DNA, 25 bp, Homo sapien
agtttgggtttcatcctgaggacaa

SEQ ID NO: 619681 - DNA, 25 bp, Homo sapien
ggagacactggagggttttcataag

SEQ ID NO: 619682 - DNA, 25 bp, Homo sapien
gaagggtaacatacaatattaacat

SEQ ID NO: 619683 - DNA, 25 bp, Homo sapien
aatgcaagggtgtggcaaatgttat

SEQ ID NO: 619684 - DNA, 25 bp, Homo sapien
aaatgttatggagtagagcagagct

SEQ ID NO: 619685 - DNA, 25 bp, Homo sapien
gtgatcagtcagagcactgtaacaa

SEQ ID NO: 619686 - DNA, 25 bp, Homo sapien
gcactgtaacaattagataggctag

SEQ ID NO: 619687 - DNA, 25 bp, Homo sapien
gcactgccaaagcttgtccgtggga

SEQ ID NO: 619688 - DNA, 25 bp, Homo sapien
aaagcttgtccgtgggagtgccaca

SEQ ID NO: 619689 - DNA, 25 bp, Homo sapien
gtccgtgggagtgccacactcataa

SEQ ID NO: 619690 - DNA, 25 bp, Homo sapien
gtgccacactcataactgccaggtt

SEQ ID NO: 619691 - DNA, 25 bp, Homo sapien
ataactgccaggttccgacttctgt

SEQ ID NO: 619692 - DNA, 25 bp, Homo sapien
aggttccgacttctgtccaccctag

SEQ ID NO: 619693 - DNA, 25 bp, Homo sapien
taggtccactttccctccagacaat

SEQ ID NO: 619694 - DNA, 25 bp, Homo sapien
ttccctccagacaatggtcagctag

SEQ ID NO: 619695 - DNA, 25 bp, Homo sapien
ggtcagctagactggagaaccatct

SEQ ID NO: 619696 - DNA, 25 bp, Homo sapien
tagactggagaaccatctgcctgcc

SEQ ID NO: 619697 - DNA, 25 bp, Homo sapien
gcccccttagggaggagctgagctt

SEQ ID NO: 619698 - DNA, 25 bp, Homo sapien
gcacccagcctagttgagtatactc

SEQ ID NO: 619699 - DNA, 25 bp, Homo sapien
gtgttttgccacttttattcctgcc

SEQ ID NO: 619700 - DNA, 25 bp, Homo sapien
tttattcctgcctctaagcagacct

SEQ ID NO: 619701 - DNA, 25 bp, Homo sapien
aagtttggaagttcaactgccatca

SEQ ID NO: 619702 - DNA, 25 bp, Homo sapien
caactgccatcatgtgcctatgaag

SEQ ID NO: 619703 - DNA, 25 bp, Homo sapien
aatgctaaggctggcaaagcaggaa

SEQ ID NO: 619704 - DNA, 25 bp, Homo sapien
gaagattgagagaacctaggtccca

SEQ ID NO: 619705 - DNA, 25 bp, Homo sapien
gaacctaggtcccatatgacattag

SEQ ID NO: 619706 - DNA, 25 bp, Homo sapien
atgacattaggccacagttccagct

SEQ ID NO: 619707 - DNA, 25 bp, Homo sapien
agttccagctttggacacccttaag

SEQ ID NO: 619708 - DNA, 25 bp, Homo sapien
ggacacccttaagtgttttgttgca

SEQ ID NO: 619709 - DNA, 25 bp, Homo sapien
aaatatggctcattctcaaccattt

SEQ ID NO: 619710 - DNA, 25 bp, Homo sapien
tatggctcattctcaaccattttgt

SEQ ID NO: 619711 - DNA, 25 bp, Homo sapien
tagaaaaacattaacacaagaggga

SEQ ID NO: 619712 - DNA, 25 bp, Homo sapien
gggaaaatctgtaggaattcgttga

SEQ ID NO: 619713 - DNA, 25 bp, Homo sapien
aatctgtaggaattcgttgaaagaa

SEQ ID NO: 619714 - DNA, 25 bp, Homo sapien
agaaaaggtacaaagcaagctgtca

SEQ ID NO: 619715 - DNA, 25 bp, Homo sapien
tacaaagcaagctgtcaagtgcccc

SEQ ID NO: 619716 - DNA, 25 bp, Homo sapien
tcaagtgcccccatgctgggtggag

SEQ ID NO: 619717 - DNA, 25 bp, Homo sapien
gggccatttgaagtaaagcttatag

SEQ ID NO: 619718 - DNA, 25 bp, Homo sapien
gaagtaaagcttatagctgggaaga

SEQ ID NO: 619719 - DNA, 25 bp, Homo sapien
aaagaattgtccatggcgtgaaccc

SEQ ID NO: 619720 - DNA, 25 bp, Homo sapien
aaagcagagtgattgaactccaatt

SEQ ID NO: 619721 - DNA, 25 bp, Homo sapien
cagagtgattgaactccaatttcaa

SEQ ID NO: 619722 - DNA, 25 bp, Homo sapien
agcagcaagcaggataccataaaag

SEQ ID NO: 619723 - DNA, 25 bp, Homo sapien
taccataaaagcatcagagtatctg

SEQ ID NO: 619724 - DNA, 25 bp, Homo sapien
aagtcagaattgttatacctggaac

SEQ ID NO: 619725 - DNA, 25 bp, Homo sapien
gttatacctggaacaatggatgctg

SEQ ID NO: 619726 - DNA, 25 bp, Homo sapien
atacctggaacaatggatgctgaga

SEQ ID NO: 619727 - DNA, 25 bp, Homo sapien
aacaatggatgctgagagcctatca

SEQ ID NO: 619728 - DNA, 25 bp, Homo sapien
gagcctatcagaattcttctagctg

SEQ ID NO: 619729 - DNA, 25 bp, Homo sapien
ttaaaaggaaaacccatcatgggca

SEQ ID NO: 619730 - DNA, 25 bp, Homo sapien
cccatcatgggcaggaaagagaaaa

SEQ ID NO: 619731 - DNA, 25 bp, Homo sapien
agacttaagatttttgtactaactg

SEQ ID NO: 619732 - DNA, 25 bp, Homo sapien
gacttaagatttttgtactaactgt

SEQ ID NO: 619733 - DNA, 25 bp, Homo sapien
cttaagatttttgtactaactgtat

SEQ ID NO: 619734 - DNA, 25 bp, Homo sapien
gatttttgtactaactgtatctttg

SEQ ID NO: 619735 - DNA, 25 bp, Homo sapien
tatctttgttttcctagggtgatac

SEQ ID NO: 619736 - DNA, 25 bp, Homo sapien
atctttgttttcctagggtgataca

SEQ ID NO: 619737 - DNA, 25 bp, Homo sapien
tctttgttttcctagggtgatacaa

SEQ ID NO: 619738 - DNA, 25 bp, Homo sapien
ctttgttttcctagggtgatacaat

SEQ ID NO: 619739 - DNA, 25 bp, Homo sapien
tttgttttcctagggtgatacaatt

SEQ ID NO: 619740 - DNA, 25 bp, Homo sapien
tgttttcctagggtgatacaattct

SEQ ID NO: 619741 - DNA, 25 bp, Homo sapien
gttttcctagggtgatacaattctg

SEQ ID NO: 619742 - DNA, 25 bp, Homo sapien
ttgtctacagatgagtgtgaaatag

SEQ ID NO: 619743 - DNA, 25 bp, Homo sapien
tgtgaaatagaagcctgcagaagct

SEQ ID NO: 619744 - DNA, 25 bp, Homo sapien
caccctcccactcagggtgggatta

SEQ ID NO: 619745 - DNA, 25 bp, Homo sapien
aggcaagtgaggctctcagctgggc

SEQ ID NO: 619746 - DNA, 25 bp, Homo sapien
ctcagctgggcgcaaagtctaaggt

SEQ ID NO: 619747 - DNA, 25 bp, Homo sapien
gcgcaaagtctaaggtgggagcaca

SEQ ID NO: 619748 - DNA, 25 bp, Homo sapien
gtgggagcacatctgtcatcaaaca

SEQ ID NO: 619749 - DNA, 25 bp, Homo sapien
gggagcacatctgtcatcaaacaat

SEQ ID NO: 619750 - DNA, 25 bp, Homo sapien
gcacatctgtcatcaaacaataatg

SEQ ID NO: 619751 - DNA, 25 bp, Homo sapien
tccatgatgaacgaaacctcaaaat

SEQ ID NO: 619752 - DNA, 25 bp, Homo sapien
aaagacatgatttgacatggcaaaa

SEQ ID NO: 619753 - DNA, 25 bp, Homo sapien
ccctctcggagcaggcgtcgatgag

SEQ ID NO: 619754 - DNA, 25 bp, Homo sapien
atgaggctaatggtgtcgtggccat

SEQ ID NO: 619755 - DNA, 25 bp, Homo sapien
tggccattgtggaaagagaacttgc

SEQ ID NO: 619756 - DNA, 25 bp, Homo sapien
aatttgttgtcattgcggcagtact

SEQ ID NO: 619757 - DNA, 25 bp, Homo sapien
gcagtactcgatgatgcggctggat

SEQ ID NO: 619758 - DNA, 25 bp, Homo sapien
ggatgcagatcttctcgtcctgttc

SEQ ID NO: 619759 - DNA, 25 bp, Homo sapien
tcggcgctggtgtccacaaagacgt

SEQ ID NO: 619760 - DNA, 25 bp, Homo sapien
cacaaagacgtggtcttgcatggcc

SEQ ID NO: 619761 - DNA, 25 bp, Homo sapien
ggaggacctgctttgaacttggcga

SEQ ID NO: 619762 - DNA, 25 bp, Homo sapien
tgctttgaacttggcgatggcgctg

SEQ ID NO: 619763 - DNA, 25 bp, Homo sapien
cgctgaagagtgaggcggccctctc

SEQ ID NO: 619764 - DNA, 25 bp, Homo sapien
tgatgtttaacacctttttatgggc

SEQ ID NO: 619765 - DNA, 25 bp, Homo sapien
gatgtttaacacctttttatgggct

SEQ ID NO: 619766 - DNA, 25 bp, Homo sapien
taaaatcactatattttctttggtg

SEQ ID NO: 619767 - DNA, 25 bp, Homo sapien
gaacttattgagtatttacatattc

SEQ ID NO: 619768 - DNA, 25 bp, Homo sapien
cttattgagtatttacatattctgg

SEQ ID NO: 619769 - DNA, 25 bp, Homo sapien
gttcttttctagatatgttattagc

SEQ ID NO: 619770 - DNA, 25 bp, Homo sapien
agatatgttattagcaaattattct

SEQ ID NO: 619771 - DNA, 25 bp, Homo sapien
tattctgctagctttcttattaatt

SEQ ID NO: 619772 - DNA, 25 bp, Homo sapien
ttctgctagctttcttattaatttt

SEQ ID NO: 619773 - DNA, 25 bp, Homo sapien
ttcttaatgatgtctcttggagatt

SEQ ID NO: 619774 - DNA, 25 bp, Homo sapien
agattgtattaattagtctgttctc

SEQ ID NO: 619775 - DNA, 25 bp, Homo sapien
gtgatacaattctggagactggaga

SEQ ID NO: 619776 - DNA, 25 bp, Homo sapien
gagactggagaagtaattccaccaa

SEQ ID NO: 619777 - DNA, 25 bp, Homo sapien
ggagaagtaattccaccaatgaaag

SEQ ID NO: 619778 - DNA, 25 bp, Homo sapien
gaaagaatttcctgatcaacatcat

SEQ ID NO: 619779 - DNA, 25 bp, Homo sapien
aatttcctgatcaacatcattaaag

SEQ ID NO: 619780 - DNA, 25 bp, Homo sapien
ggcttatgagcctaagtttgttcct

SEQ ID NO: 619781 - DNA, 25 bp, Homo sapien
atgagcctaagtttgttcctatatt

SEQ ID NO: 619782 - DNA, 25 bp, Homo sapien
gcctaagtttgttcctatattacca

SEQ ID NO: 619783 - DNA, 25 bp, Homo sapien
aagtttgttcctatattaccatatt

SEQ ID NO: 619784 - DNA, 25 bp, Homo sapien
gttcctatattaccatatttactga

SEQ ID NO: 619785 - DNA, 25 bp, Homo sapien
accatatttactgaattttctggaa

SEQ ID NO: 619786 - DNA, 25 bp, Homo sapien
cacctaaatattttctggcttccct

SEQ ID NO: 619787 - DNA, 25 bp, Homo sapien
tttatccactaaaaagacaccagaa

SEQ ID NO: 619788 - DNA, 25 bp, Homo sapien
agacaccagaattactccccaaaat

SEQ ID NO: 619789 - DNA, 25 bp, Homo sapien
ttactccccaaaatactactttcat

SEQ ID NO: 619790 - DNA, 25 bp, Homo sapien
aactgtagttctagaattctgagac

SEQ ID NO: 619791 - DNA, 25 bp, Homo sapien
gaattctgagactccaaccatggca

SEQ ID NO: 619792 - DNA, 25 bp, Homo sapien
gagactccaaccatggcatacacag

SEQ ID NO: 619793 - DNA, 25 bp, Homo sapien
gttcccactctacttatcttcaata

SEQ ID NO: 619794 - DNA, 25 bp, Homo sapien
tcaatacaaaccctttaactagctg

SEQ ID NO: 619795 - DNA, 25 bp, Homo sapien
ctgagctggtagcataggcccaaga

SEQ ID NO: 619796 - DNA, 25 bp, Homo sapien
agcataggcccaagaaattttaaag

SEQ ID NO: 619797 - DNA, 25 bp, Homo sapien
ttgatccaggatatttacttctagg

SEQ ID NO: 619798 - DNA, 25 bp, Homo sapien
gatatttacttctaggatttatcct

SEQ ID NO: 619799 - DNA, 25 bp, Homo sapien
tatcctaaagatataattccacaaa

SEQ ID NO: 619800 - DNA, 25 bp, Homo sapien
gttgaaaatacacaaatgcccatct

SEQ ID NO: 619801 - DNA, 25 bp, Homo sapien
aatgcccatctgtagaaaactggat

SEQ ID NO: 619802 - DNA, 25 bp, Homo sapien
taaactatggtaccacatgagagaa

SEQ ID NO: 619803 - DNA, 25 bp, Homo sapien
gagagaatgttatgcagccatgaag

SEQ ID NO: 619804 - DNA, 25 bp, Homo sapien
gaaggaagatctctgtaaacctaca

SEQ ID NO: 619805 - DNA, 25 bp, Homo sapien
aacctacagggagtgatttccagca

SEQ ID NO: 619806 - DNA, 25 bp, Homo sapien
tacagggagtgatttccagcatata

SEQ ID NO: 619807 - DNA, 25 bp, Homo sapien
tttccagcatatattgttaaacaac

SEQ ID NO: 619808 - DNA, 25 bp, Homo sapien
tagaagctaccggtttaaatcacct

SEQ ID NO: 619809 - DNA, 25 bp, Homo sapien
tggtatctttagagaatgaagcccc

SEQ ID NO: 619810 - DNA, 25 bp, Homo sapien
ttttttccctacagtgtagcaataa

SEQ ID NO: 619811 - DNA, 25 bp, Homo sapien
aatcacatgtcagttcagacagcag

SEQ ID NO: 619812 - DNA, 25 bp, Homo sapien
gtcagttcagacagcagcaggaata

SEQ ID NO: 619813 - DNA, 25 bp, Homo sapien
agcaggaatagctgactggtaagtt

SEQ ID NO: 619814 - DNA, 25 bp, Homo sapien
ctggtaagttattattcttccatgc

SEQ ID NO: 619815 - DNA, 25 bp, Homo sapien
tcttccatgcttgctacttccaaaa

SEQ ID NO: 619816 - DNA, 25 bp, Homo sapien
gcttgctacttccaaaatacgtttg

SEQ ID NO: 619817 - DNA, 25 bp, Homo sapien
tccaaaatacgtttgtgaacttctt

SEQ ID NO: 619818 - DNA, 25 bp, Homo sapien
gtgaacttctttcaaggcttaaatg

SEQ ID NO: 619819 - DNA, 25 bp, Homo sapien
tggcaagactaatagaacctgtatc

SEQ ID NO: 619820 - DNA, 25 bp, Homo sapien
gactaatagaacctgtatcataggg

SEQ ID NO: 619821 - DNA, 25 bp, Homo sapien
aacatgtctgttaaatgaccagggc

SEQ ID NO: 619822 - DNA, 25 bp, Homo sapien
atgtctgttaaatgaccagggcctg

SEQ ID NO: 619823 - DNA, 25 bp, Homo sapien
tctgttaaatgaccagggcctggac

SEQ ID NO: 619824 - DNA, 25 bp, Homo sapien
agggcctggaccacggtaagtgctc

SEQ ID NO: 619825 - DNA, 25 bp, Homo sapien
gcctggaccacggtaagtgctcaat

SEQ ID NO: 619826 - DNA, 25 bp, Homo sapien
ctggaccacggtaagtgctcaataa

SEQ ID NO: 619827 - DNA, 25 bp, Homo sapien
caataaaaatgttagctcggctggc

SEQ ID NO: 619828 - DNA, 25 bp, Homo sapien
aaaaatgttagctcggctggctgtg

SEQ ID NO: 619829 - DNA, 25 bp, Homo sapien
atgttagctcggctggctgtggtgg

SEQ ID NO: 619830 - DNA, 25 bp, Homo sapien
aacatgtataattcccagtttacag

SEQ ID NO: 619831 - DNA, 25 bp, Homo sapien
ggaaaactagaagctaagtaaccag

SEQ ID NO: 619832 - DNA, 25 bp, Homo sapien
aatagtcagagatcaataccaagcc

SEQ ID NO: 619833 - DNA, 25 bp, Homo sapien
tcagagatcaataccaagccaaaag

SEQ ID NO: 619834 - DNA, 25 bp, Homo sapien
gaaactgatgcataatcctgccttc

SEQ ID NO: 619835 - DNA, 25 bp, Homo sapien
actgatgcataatcctgccttcttc

SEQ ID NO: 619836 - DNA, 25 bp, Homo sapien
tgcccttgaagccagagccagtgtg

SEQ ID NO: 619837 - DNA, 25 bp, Homo sapien
ccttgaagccagagccagtgtgatg

SEQ ID NO: 619838 - DNA, 25 bp, Homo sapien
agaaagaggccttctttgccttcac

SEQ ID NO: 619839 - DNA, 25 bp, Homo sapien
cttctttgccttcaccctgaactgg

SEQ ID NO: 619840 - DNA, 25 bp, Homo sapien
ttcaccctgaactgggacaatgcag

SEQ ID NO: 619841 - DNA, 25 bp, Homo sapien
gaattgtccactccatgcgaggcag

SEQ ID NO: 619842 - DNA, 25 bp, Homo sapien
cctgccagactgctaccgttctggg

SEQ ID NO: 619843 - DNA, 25 bp, Homo sapien
gaaagtggacgtgccagagctcatg

SEQ ID NO: 619844 - DNA, 25 bp, Homo sapien
agagctcatggcacatcctccagaa

SEQ ID NO: 619845 - DNA, 25 bp, Homo sapien
catggcacatcctccagaaaagcct

SEQ ID NO: 619846 - DNA, 25 bp, Homo sapien
aagcctctgagagaccctgagtgct

SEQ ID NO: 619847 - DNA, 25 bp, Homo sapien
gagagaccctgagtgcttagctaga

SEQ ID NO: 619848 - DNA, 25 bp, Homo sapien
aagcagacagttgcagtgccatgac

SEQ ID NO: 619849 - DNA, 25 bp, Homo sapien
cagttgcagtgccatgacatgtggt

SEQ ID NO: 619850 - DNA, 25 bp, Homo sapien
gggacaggcaggtgttaccaagttc

SEQ ID NO: 619851 - DNA, 25 bp, Homo sapien
acaggcaggtgttaccaagttcggg

SEQ ID NO: 619852 - DNA, 25 bp, Homo sapien
gtgcgatctcggcttaccggaatct

SEQ ID NO: 619853 - DNA, 25 bp, Homo sapien
tgcgatctcggcttaccggaatctc

SEQ ID NO: 619854 - DNA, 25 bp, Homo sapien
gcgatctcggcttaccggaatctct

SEQ ID NO: 619855 - DNA, 25 bp, Homo sapien
cgatctcggcttaccggaatctctg

SEQ ID NO: 619856 - DNA, 25 bp, Homo sapien
gatctcggcttaccggaatctctgc

SEQ ID NO: 619857 - DNA, 25 bp, Homo sapien
atctcggcttaccggaatctctgcc

SEQ ID NO: 619858 - DNA, 25 bp, Homo sapien
ctcggcttaccggaatctctgcctc

SEQ ID NO: 619859 - DNA, 25 bp, Homo sapien
tcggcttaccggaatctctgcctcc

SEQ ID NO: 619860 - DNA, 25 bp, Homo sapien
cggcttaccggaatctctgcctccc

SEQ ID NO: 619861 - DNA, 25 bp, Homo sapien
tgcccggctaatttaacgcccagct

SEQ ID NO: 619862 - DNA, 25 bp, Homo sapien
gcccggctaatttaacgcccagcta

SEQ ID NO: 619863 - DNA, 25 bp, Homo sapien
cgggactgcttcctctaaagtcaat

SEQ ID NO: 619864 - DNA, 25 bp, Homo sapien
aataatgatttcctgattgacaaat

SEQ ID NO: 619865 - DNA, 25 bp, Homo sapien
gattgacaaattcagggcctttgac

SEQ ID NO: 619866 - DNA, 25 bp, Homo sapien
tcagggcctttgaccataacttttt

SEQ ID NO: 619867 - DNA, 25 bp, Homo sapien
caagagcttcataactgcatttagt

SEQ ID NO: 619868 - DNA, 25 bp, Homo sapien
gtgttattgactacttcctcacacc

SEQ ID NO: 619869 - DNA, 25 bp, Homo sapien
ctctctgacaacttgtttatttgct

SEQ ID NO: 619870 - DNA, 25 bp, Homo sapien
gctgatttatacctcctttactttc

SEQ ID NO: 619871 - DNA, 25 bp, Homo sapien
ctcctttactttctgtgagaatttg

SEQ ID NO: 619872 - DNA, 25 bp, Homo sapien
gaatttgcacatggcttggttcctg

SEQ ID NO: 619873 - DNA, 25 bp, Homo sapien
ccccttaatcctctgtattgatttt

SEQ ID NO: 619874 - DNA, 25 bp, Homo sapien
agcctggacagatgtgcctctagtc

SEQ ID NO: 619875 - DNA, 25 bp, Homo sapien
gacagatgtgcctctagtctgcctt

SEQ ID NO: 619876 - DNA, 25 bp, Homo sapien
tagtctgccttgtgccctaggtttc

SEQ ID NO: 619877 - DNA, 25 bp, Homo sapien
ttgtgccctaggtttcgggtgagca

SEQ ID NO: 619878 - DNA, 25 bp, Homo sapien
ctaggtttcgggtgagcagttcctc

SEQ ID NO: 619879 - DNA, 25 bp, Homo sapien
tttcgggtgagcagttcctcaggct

SEQ ID NO: 619880 - DNA, 25 bp, Homo sapien
tgctcacactgctgacaggtaggag

SEQ ID NO: 619881 - DNA, 25 bp, Homo sapien
cacactgctgacaggtaggaggcca

SEQ ID NO: 619882 - DNA, 25 bp, Homo sapien
aggcttccacttctgaggaaccaga

SEQ ID NO: 619883 - DNA, 25 bp, Homo sapien
atggatgaacttaagtgcctcaggg

SEQ ID NO: 619884 - DNA, 25 bp, Homo sapien
tggcctccctctgatatagccaagg

SEQ ID NO: 619885 - DNA, 25 bp, Homo sapien
tgtattgcctgattcacaaattggt

SEQ ID NO: 619886 - DNA, 25 bp, Homo sapien
attgcctgattcacaaattggtgca

SEQ ID NO: 619887 - DNA, 25 bp, Homo sapien
gtgtgtttaacacctaaagtctatc

SEQ ID NO: 619888 - DNA, 25 bp, Homo sapien
tgtttaacacctaaagtctatctcc

SEQ ID NO: 619889 - DNA, 25 bp, Homo sapien
taaattccttctttttctgcaaaag

SEQ ID NO: 619890 - DNA, 25 bp, Homo sapien
ttccttctttttctgcaaaagactg

SEQ ID NO: 619891 - DNA, 25 bp, Homo sapien
gcaaaagactggaatctgctactta

SEQ ID NO: 619892 - DNA, 25 bp, Homo sapien
agactggaatctgctacttaacaag

SEQ ID NO: 619893 - DNA, 25 bp, Homo sapien
actggaatctgctacttaacaagag

SEQ ID NO: 619894 - DNA, 25 bp, Homo sapien
gataaatgtaatgtataccggaaag

SEQ ID NO: 619895 - DNA, 25 bp, Homo sapien
atattatttcttgtacattgtacta

SEQ ID NO: 619896 - DNA, 25 bp, Homo sapien
gaaaactaggctacgctggtatctt

SEQ ID NO: 619897 - DNA, 25 bp, Homo sapien
gctggtatcttaaattgactttcct

SEQ ID NO: 619898 - DNA, 25 bp, Homo sapien
attgactttcctgaggtcacgggca

SEQ ID NO: 619899 - DNA, 25 bp, Homo sapien
gaggtcacgggcactcagtgccaag

SEQ ID NO: 619900 - DNA, 25 bp, Homo sapien
gcactcagtgccaagaggagttggt

SEQ ID NO: 619901 - DNA, 25 bp, Homo sapien
ggagttggtacctacgcatttgaaa

SEQ ID NO: 619902 - DNA, 25 bp, Homo sapien
ggtacctacgcatttgaaatttctg

SEQ ID NO: 619903 - DNA, 25 bp, Homo sapien
atttctggtcttactctgtacttag

SEQ ID NO: 619904 - DNA, 25 bp, Homo sapien
ctgtacttagtcactcttttctttc

SEQ ID NO: 619905 - DNA, 25 bp, Homo sapien
ttttctttcatttggccctatggtg

SEQ ID NO: 619906 - DNA, 25 bp, Homo sapien
tcatttggccctatggtgggcaaac

SEQ ID NO: 619907 - DNA, 25 bp, Homo sapien
ctggtctgggccggagcctgccggg

SEQ ID NO: 619908 - DNA, 25 bp, Homo sapien
ggatgacgggccaggccagattcca

SEQ ID NO: 619909 - DNA, 25 bp, Homo sapien
gatgacgggccaggccagattccac

SEQ ID NO: 619910 - DNA, 25 bp, Homo sapien
gggccaggccagattccaccgcgga

SEQ ID NO: 619911 - DNA, 25 bp, Homo sapien
ggccaggccagattccaccgcggag

SEQ ID NO: 619912 - DNA, 25 bp, Homo sapien
cgcggagccgaggcatgccgagcta

SEQ ID NO: 619913 - DNA, 25 bp, Homo sapien
gcagctcacccggaaggccgcgcgg

SEQ ID NO: 619914 - DNA, 25 bp, Homo sapien
gggtccgggcgtggatcccggcacg

SEQ ID NO: 619915 - DNA, 25 bp, Homo sapien
atcccggcacgcgagcccgggcgtt

SEQ ID NO: 619916 - DNA, 25 bp, Homo sapien
gcgttcgcaggggaggattttcctt

SEQ ID NO: 619917 - DNA, 25 bp, Homo sapien
tcgcaggggaggattttccttgctg

SEQ ID NO: 619918 - DNA, 25 bp, Homo sapien
gaccaaaactgcaatgttggagaca

SEQ ID NO: 619919 - DNA, 25 bp, Homo sapien
ggagacaaagtagaccacatgggaa

SEQ ID NO: 619920 - DNA, 25 bp, Homo sapien
tagaccacatgggaatagtgacaga

SEQ ID NO: 619921 - DNA, 25 bp, Homo sapien
tagtgacagagtagacattgtagaa

SEQ ID NO: 619922 - DNA, 25 bp, Homo sapien
atatgtcaataaaagctatccaaaa

SEQ ID NO: 619923 - DNA, 25 bp, Homo sapien
atgaacagcacatcagtgatctgtg

SEQ ID NO: 619924 - DNA, 25 bp, Homo sapien
atcagtgatctgtgtgataacttca

SEQ ID NO: 619925 - DNA, 25 bp, Homo sapien
taacttcacacagcctaagatatat

SEQ ID NO: 619926 - DNA, 25 bp, Homo sapien
gatatatgtgcaattggattccctg

SEQ ID NO: 619927 - DNA, 25 bp, Homo sapien
atgtgcaattggattccctgaaggg

SEQ ID NO: 619928 - DNA, 25 bp, Homo sapien
aactcacatatctaagtaggtcaat

SEQ ID NO: 619929 - DNA, 25 bp, Homo sapien
tacagacagcgcttgccgcagagaa

SEQ ID NO: 619930 - DNA, 25 bp, Homo sapien
gcgcttgccgcagagaagctgctct

SEQ ID NO: 619931 - DNA, 25 bp, Homo sapien
gaggcagctgtcttaaataaagaag

SEQ ID NO: 619932 - DNA, 25 bp, Homo sapien
gagagcctgcagttatgtacatttt

SEQ ID NO: 619933 - DNA, 25 bp, Homo sapien
gcctgcagttatgtacattttgtcc

SEQ ID NO: 619934 - DNA, 25 bp, Homo sapien
tacattttgtcctttccgtaagaga

SEQ ID NO: 619935 - DNA, 25 bp, Homo sapien
aatgaggactttggaaattcagatc

SEQ ID NO: 619936 - DNA, 25 bp, Homo sapien
ggaaattcagatccctctttgatat

SEQ ID NO: 619937 - DNA, 25 bp, Homo sapien
aattcagatccctctttgatatcag

SEQ ID NO: 619938 - DNA, 25 bp, Homo sapien
gatatcagagatttaaacaacacat

SEQ ID NO: 619939 - DNA, 25 bp, Homo sapien
gttttaaccagttgtagtcaaaatg

SEQ ID NO: 619940 - DNA, 25 bp, Homo sapien
tatatgacctaccttcctctgggaa

SEQ ID NO: 619941 - DNA, 25 bp, Homo sapien
cctctgggaacgcacgactggtaag

SEQ ID NO: 619942 - DNA, 25 bp, Homo sapien
tcaagtgagcatgcgcgcaacttca

SEQ ID NO: 619943 - DNA, 25 bp, Homo sapien
atgcgcgcaacttcagtaatcacac

SEQ ID NO: 619944 - DNA, 25 bp, Homo sapien
gtaatcacactgtgcatgcgacccc

SEQ ID NO: 619945 - DNA, 25 bp, Homo sapien
tggcaggtcaccacatacgcggaca

SEQ ID NO: 619946 - DNA, 25 bp, Homo sapien
gatgagacgtaaatcccagaactat

SEQ ID NO: 619947 - DNA, 25 bp, Homo sapien
ccaagttaagggtcaggcagggcac

SEQ ID NO: 619948 - DNA, 25 bp, Homo sapien
caggcagggcacttagatctctcaa

SEQ ID NO: 619949 - DNA, 25 bp, Homo sapien
cacttagatctctcaagttgcctgc

SEQ ID NO: 619950 - DNA, 25 bp, Homo sapien
gcctgcctgacccaagtgtagtgta

SEQ ID NO: 619951 - DNA, 25 bp, Homo sapien
gagactcgcaatccagtgatcacag

SEQ ID NO: 619952 - DNA, 25 bp, Homo sapien
agtgatcacagcagctatgcacaat

SEQ ID NO: 619953 - DNA, 25 bp, Homo sapien
agctatgcacaatccttcaacttct

SEQ ID NO: 619954 - DNA, 25 bp, Homo sapien
ttcaacttctccacttattacaacc

SEQ ID NO: 619955 - DNA, 25 bp, Homo sapien
cacagtctccttggaccatgagttt

SEQ ID NO: 619956 - DNA, 25 bp, Homo sapien
gaccatgagtttaatccttcccttt

SEQ ID NO: 619957 - DNA, 25 bp, Homo sapien
gagtttaatccttccctttcatatt

SEQ ID NO: 619958 - DNA, 25 bp, Homo sapien
actccttggaacttttcactcttca

SEQ ID NO: 619959 - DNA, 25 bp, Homo sapien
tcttcaccacgcttggatggcaaag

SEQ ID NO: 619960 - DNA, 25 bp, Homo sapien
ggatggcaaagtcccacctgggtaa

SEQ ID NO: 619961 - DNA, 25 bp, Homo sapien
cgtgcctgctcctgatagggaaaaa

SEQ ID NO: 619962 - DNA, 25 bp, Homo sapien
gagatcgagaccacggtgaaaccct

SEQ ID NO: 619963 - DNA, 25 bp, Homo sapien
agatcgagaccacggtgaaaccctg

SEQ ID NO: 619964 - DNA, 25 bp, Homo sapien
gatcgagaccacggtgaaaccctgt

SEQ ID NO: 619965 - DNA, 25 bp, Homo sapien
atcgagaccacggtgaaaccctgtc

SEQ ID NO: 619966 - DNA, 25 bp, Homo sapien
aaattatcttggcacagtggcgggc

SEQ ID NO: 619967 - DNA, 25 bp, Homo sapien
aattatcttggcacagtggcgggca

SEQ ID NO: 619968 - DNA, 25 bp, Homo sapien
attatcttggcacagtggcgggcac

SEQ ID NO: 619969 - DNA, 25 bp, Homo sapien
ttatcttggcacagtggcgggcacc

SEQ ID NO: 619970 - DNA, 25 bp, Homo sapien
tatcttggcacagtggcgggcacct

SEQ ID NO: 619971 - DNA, 25 bp, Homo sapien
atcttggcacagtggcgggcacctg

SEQ ID NO: 619972 - DNA, 25 bp, Homo sapien
tcttggcacagtggcgggcacctgt

SEQ ID NO: 619973 - DNA, 25 bp, Homo sapien
ccgtctcaggtcacggttttggatt

SEQ ID NO: 619974 - DNA, 25 bp, Homo sapien
aacaccagcccaccggattattaat

SEQ ID NO: 619975 - DNA, 25 bp, Homo sapien
ccagcccaccggattattaataaag

SEQ ID NO: 619976 - DNA, 25 bp, Homo sapien
taaagataatcacacacaccccttc

SEQ ID NO: 619977 - DNA, 25 bp, Homo sapien
gcagccggcctgacactttataaag

SEQ ID NO: 619978 - DNA, 25 bp, Homo sapien
ggcctgacactttataaagcacgtt

SEQ ID NO: 619979 - DNA, 25 bp, Homo sapien
ataaagcacgttaggatataatcca

SEQ ID NO: 619980 - DNA, 25 bp, Homo sapien
ggatataatccaattgaaactgcaa

SEQ ID NO: 619981 - DNA, 25 bp, Homo sapien
gaaactgcaatatcgagaacatctc

SEQ ID NO: 619982 - DNA, 25 bp, Homo sapien
tatcgagaacatctcatcttatcac

SEQ ID NO: 619983 - DNA, 25 bp, Homo sapien
tgaaattatatcacattcctctttt

SEQ ID NO: 619984 - DNA, 25 bp, Homo sapien
aggattcagcagaaggactctccat

SEQ ID NO: 619985 - DNA, 25 bp, Homo sapien
gcagaaggactctccatgtttaccg

SEQ ID NO: 619986 - DNA, 25 bp, Homo sapien
gaaggactctccatgtttaccggag

SEQ ID NO: 619987 - DNA, 25 bp, Homo sapien
gaggaaatctttgcatttcagcgca

SEQ ID NO: 619988 - DNA, 25 bp, Homo sapien
aaatctttgcatttcagcgcacaat

SEQ ID NO: 619989 - DNA, 25 bp, Homo sapien
ctttgcatttcagcgcacaatttcc

SEQ ID NO: 619990 - DNA, 25 bp, Homo sapien
acggaaatgcagactgaacagtact

SEQ ID NO: 619991 - DNA, 25 bp, Homo sapien
gaacagtactggaatgaaggagaca

SEQ ID NO: 619992 - DNA, 25 bp, Homo sapien
agaaccaagaagtaactgccacttt

SEQ ID NO: 619993 - DNA, 25 bp, Homo sapien
gaagtaactgccacttttgcataaa

SEQ ID NO: 619994 - DNA, 25 bp, Homo sapien
aactgccacttttgcataaataaaa

SEQ ID NO: 619995 - DNA, 25 bp, Homo sapien
ctgccttctgaacatttaacaattt

SEQ ID NO: 619996 - DNA, 25 bp, Homo sapien
gaacatttaacaatttggccaaagg

SEQ ID NO: 619997 - DNA, 25 bp, Homo sapien
gagaacgcatagacatacacgcatg

SEQ ID NO: 619998 - DNA, 25 bp, Homo sapien
tacacgcatggatgcatgtcttaag

SEQ ID NO: 619999 - DNA, 25 bp, Homo sapien
aatgatctttatgcgcatctgactt

SEQ ID NO: 620000 - DNA, 25 bp, Homo sapien
tgcgcatctgacttaattcatttaa

SEQ ID NO: 620001 - DNA, 25 bp, Homo sapien
attggatttggtcttaagtgaattt

SEQ ID NO: 620002 - DNA, 25 bp, Homo sapien
aattctcagataacaaccatcacag

SEQ ID NO: 620003 - DNA, 25 bp, Homo sapien
aagcattagcctttgagcatctcag

SEQ ID NO: 620004 - DNA, 25 bp, Homo sapien
ctgcctttggccagatgggctagtg

SEQ ID NO: 620005 - DNA, 25 bp, Homo sapien
gccagatgggctagtgcacttttgt

SEQ ID NO: 620006 - DNA, 25 bp, Homo sapien
taatgcttggcagaattaggtgcat

SEQ ID NO: 620007 - DNA, 25 bp, Homo sapien
tgcattagagaagcagcactggtaa

SEQ ID NO: 620008 - DNA, 25 bp, Homo sapien
gagaagcagcactggtaagtatgaa

SEQ ID NO: 620009 - DNA, 25 bp, Homo sapien
ggaggagactgtatggcagctctgc

SEQ ID NO: 620010 - DNA, 25 bp, Homo sapien
agctctgctttccagagattgtatt

SEQ ID NO: 620011 - DNA, 25 bp, Homo sapien
gtattcagcaagtaatgtacaaaat

SEQ ID NO: 620012 - DNA, 25 bp, Homo sapien
aaaatcagctgatctcacgacattt

SEQ ID NO: 620013 - DNA, 25 bp, Homo sapien
caagcagtgcttccattagtcggaa

SEQ ID NO: 620014 - DNA, 25 bp, Homo sapien
ccattagtcggaaactgaattgctt

SEQ ID NO: 620015 - DNA, 25 bp, Homo sapien
cattattggaacatagaatctacct

SEQ ID NO: 620016 - DNA, 25 bp, Homo sapien
acatatactcataggtgggcagatc

SEQ ID NO: 620017 - DNA, 25 bp, Homo sapien
aaatgctaatatctacctctctctt

SEQ ID NO: 620018 - DNA, 25 bp, Homo sapien
gtatcaagtttctatggtgctctca

SEQ ID NO: 620019 - DNA, 25 bp, Homo sapien
tctatggtgctctcactgctctgaa

SEQ ID NO: 620020 - DNA, 25 bp, Homo sapien
actgctctgaaagtgcacttgacca

SEQ ID NO: 620021 - DNA, 25 bp, Homo sapien
gacctggagaggtagcatgtctgac

SEQ ID NO: 620022 - DNA, 25 bp, Homo sapien
gcatgtctgacgttgacatttacca

SEQ ID NO: 620023 - DNA, 25 bp, Homo sapien
gacatttaccagagtggaccctcag

SEQ ID NO: 620024 - DNA, 25 bp, Homo sapien
gaccctcagaggttagatgacaggt

SEQ ID NO: 620025 - DNA, 25 bp, Homo sapien
gaaagtctcatcaacctggttttgc

SEQ ID NO: 620026 - DNA, 25 bp, Homo sapien
catttccacatacctgtgtatctcc

SEQ ID NO: 620027 - DNA, 25 bp, Homo sapien
gtgtatctccagacttgggcatgag

SEQ ID NO: 620028 - DNA, 25 bp, Homo sapien
ctgagtggccttgaatggaaaggcc

SEQ ID NO: 620029 - DNA, 25 bp, Homo sapien
aaaggcctgagtgaaggggatcatt

SEQ ID NO: 620030 - DNA, 25 bp, Homo sapien
agtgaaggggatcattgtcctggtg

SEQ ID NO: 620031 - DNA, 25 bp, Homo sapien
gtgaaggggatcattgtcctggtgg

SEQ ID NO: 620032 - DNA, 25 bp, Homo sapien
gggctcagagaacaagaatcagctt

SEQ ID NO: 620033 - DNA, 25 bp, Homo sapien
ggctcagagaacaagaatcagcttc

SEQ ID NO: 620034 - DNA, 25 bp, Homo sapien
gctcagagaacaagaatcagcttct

SEQ ID NO: 620035 - DNA, 25 bp, Homo sapien
ctcagagaacaagaatcagcttctc

SEQ ID NO: 620036 - DNA, 25 bp, Homo sapien
gagaacaagaatcagcttctcagcc

SEQ ID NO: 620037 - DNA, 25 bp, Homo sapien
agaacaagaatcagcttctcagcct

SEQ ID NO: 620038 - DNA, 25 bp, Homo sapien
gaacaagaatcagcttctcagcctg

SEQ ID NO: 620039 - DNA, 25 bp, Homo sapien
ggaactgcccattcaaatgactggt

SEQ ID NO: 620040 - DNA, 25 bp, Homo sapien
caaatgactggtgcccaggaagctc

SEQ ID NO: 620041 - DNA, 25 bp, Homo sapien
gaagctctgggcatacaggattgaa

SEQ ID NO: 620042 - DNA, 25 bp, Homo sapien
gattgaacctgtggcaggaccctga

SEQ ID NO: 620043 - DNA, 25 bp, Homo sapien
cccagccagcggattattggcaggt

SEQ ID NO: 620044 - DNA, 25 bp, Homo sapien
gtgggaacatggactccactttgtc

SEQ ID NO: 620045 - DNA, 25 bp, Homo sapien
actttgtcagagcttcccattgttt

SEQ ID NO: 620046 - DNA, 25 bp, Homo sapien
gaatctggaattcgagaactttaaa

SEQ ID NO: 620047 - DNA, 25 bp, Homo sapien
gttttggtcaaagagaacctgtctc

SEQ ID NO: 620048 - DNA, 25 bp, Homo sapien
agaacctgtctcagactgaacacag

SEQ ID NO: 620049 - DNA, 25 bp, Homo sapien
aacacagtccacaaggctgccaatt

SEQ ID NO: 620050 - DNA, 25 bp, Homo sapien
ttccagcatagacatcctacctgtt

SEQ ID NO: 620051 - DNA, 25 bp, Homo sapien
ccagcatagacatcctacctgttaa

SEQ ID NO: 620052 - DNA, 25 bp, Homo sapien
gcatagacatcctacctgttaattg

SEQ ID NO: 620053 - DNA, 25 bp, Homo sapien
agacatcctacctgttaattggaag

SEQ ID NO: 620054 - DNA, 25 bp, Homo sapien
catcctacctgttaattggaagggt

SEQ ID NO: 620055 - DNA, 25 bp, Homo sapien
gaagggttattttctacctccacag

SEQ ID NO: 620056 - DNA, 25 bp, Homo sapien
tacctccacagggtgtccaaagaat

SEQ ID NO: 620057 - DNA, 25 bp, Homo sapien
ctccacagggtgtccaaagaataga

SEQ ID NO: 620058 - DNA, 25 bp, Homo sapien
cacagggtgtccaaagaatagaaat

SEQ ID NO: 620059 - DNA, 25 bp, Homo sapien
gagaggacatctctataaaccttac

SEQ ID NO: 620060 - DNA, 25 bp, Homo sapien
ggacatctctataaaccttacagaa

SEQ ID NO: 620061 - DNA, 25 bp, Homo sapien
caagcggccacagttgtcttggact

SEQ ID NO: 620062 - DNA, 25 bp, Homo sapien
attctggcaatctctctactggcag

SEQ ID NO: 620063 - DNA, 25 bp, Homo sapien
gggtgctgccaatccaatgtgcatg

SEQ ID NO: 620064 - DNA, 25 bp, Homo sapien
atagctgtagccctaccacagggtg

SEQ ID NO: 620065 - DNA, 25 bp, Homo sapien
acagggtgtctgtctgtagctccat

SEQ ID NO: 620066 - DNA, 25 bp, Homo sapien
gtagctccatggcagggtatatgtc

SEQ ID NO: 620067 - DNA, 25 bp, Homo sapien
gggtatatgtctgtagcctggtcat

SEQ ID NO: 620068 - DNA, 25 bp, Homo sapien
gcctggtcatggagtgcttatagct

SEQ ID NO: 620069 - DNA, 25 bp, Homo sapien
gtgcttatagctgtagctccacaat

SEQ ID NO: 620070 - DNA, 25 bp, Homo sapien
gctccacaatgaggtatctggtttg

SEQ ID NO: 620071 - DNA, 25 bp, Homo sapien
gtgagtatcctaggtactgcccaca

SEQ ID NO: 620072 - DNA, 25 bp, Homo sapien
ttaggaggaccactaacctcaagag

SEQ ID NO: 620073 - DNA, 25 bp, Homo sapien
taggaggaccactaacctcaagagg

SEQ ID NO: 620074 - DNA, 25 bp, Homo sapien
aggaggaccactaacctcaagaggc

SEQ ID NO: 620075 - DNA, 25 bp, Homo sapien
ggaccactaacctcaagaggctggg

SEQ ID NO: 620076 - DNA, 25 bp, Homo sapien
gaccactaacctcaagaggctgggt

SEQ ID NO: 620077 - DNA, 25 bp, Homo sapien
accactaacctcaagaggctgggtg

SEQ ID NO: 620078 - DNA, 25 bp, Homo sapien
ccactaacctcaagaggctgggtgc

SEQ ID NO: 620079 - DNA, 25 bp, Homo sapien
cactaacctcaagaggctgggtgcg

SEQ ID NO: 620080 - DNA, 25 bp, Homo sapien
aacttcgtaagatattacctgtgaa

SEQ ID NO: 620081 - DNA, 25 bp, Homo sapien
aatgtattttagatggccttttaga

SEQ ID NO: 620082 - DNA, 25 bp, Homo sapien
gccttttagaaatctagtccgtgga

SEQ ID NO: 620083 - DNA, 25 bp, Homo sapien
gtccgtggacacaatctagcatcat

SEQ ID NO: 620084 - DNA, 25 bp, Homo sapien
ctagcatcatgcagttgccttcaaa

SEQ ID NO: 620085 - DNA, 25 bp, Homo sapien
gttctgttgaaaataacccatttgt

SEQ ID NO: 620086 - DNA, 25 bp, Homo sapien
taacccatttgtcattttagttttg

SEQ ID NO: 620087 - DNA, 25 bp, Homo sapien
gatatgacttagttatacatgcctt

SEQ ID NO: 620088 - DNA, 25 bp, Homo sapien
acatgccttttgaagcagtacccac

SEQ ID NO: 620089 - DNA, 25 bp, Homo sapien
gtacccacccacatagtaattgcga

SEQ ID NO: 620090 - DNA, 25 bp, Homo sapien
gtaattgcgactatcttgtgttttg

SEQ ID NO: 620091 - DNA, 25 bp, Homo sapien
cagctactcagcagggcctgaggtg

SEQ ID NO: 620092 - DNA, 25 bp, Homo sapien
agggcctgaggtggaagaagcgcgt

SEQ ID NO: 620093 - DNA, 25 bp, Homo sapien
tggaagaagcgcgtgaacccatgag

SEQ ID NO: 620094 - DNA, 25 bp, Homo sapien
gaagaagcgcgtgaacccatgaggc

SEQ ID NO: 620095 - DNA, 25 bp, Homo sapien
gaagcgcgtgaacccatgaggctaa

SEQ ID NO: 620096 - DNA, 25 bp, Homo sapien
gcgcgtgaacccatgaggctaagtc

SEQ ID NO: 620097 - DNA, 25 bp, Homo sapien
gaacccatgaggctaagtctgtagt

SEQ ID NO: 620098 - DNA, 25 bp, Homo sapien
acccatgaggctaagtctgtagtga

SEQ ID NO: 620099 - DNA, 25 bp, Homo sapien
ccatgaggctaagtctgtagtgagc

SEQ ID NO: 620100 - DNA, 25 bp, Homo sapien
gctaagtctgtagtgagccgtgatc

SEQ ID NO: 620101 - DNA, 25 bp, Homo sapien
ctaagtctgtagtgagccgtgatca

SEQ ID NO: 620102 - DNA, 25 bp, Homo sapien
ttctattaaccacattttcccctct

SEQ ID NO: 620103 - DNA, 25 bp, Homo sapien
tttcatggccagtagaagtcacaca

SEQ ID NO: 620104 - DNA, 25 bp, Homo sapien
gaagtcacacatacccaaggcgagg

SEQ ID NO: 620105 - DNA, 25 bp, Homo sapien
gaggctgccctcctctagtgaactg

SEQ ID NO: 620106 - DNA, 25 bp, Homo sapien
gcaatcatttgaacatcctgcctca

SEQ ID NO: 620107 - DNA, 25 bp, Homo sapien
tcctgcctcaattgaatcatcctga

SEQ ID NO: 620108 - DNA, 25 bp, Homo sapien
atcatcctgacagctatccctatgg

SEQ ID NO: 620109 - DNA, 25 bp, Homo sapien
tatggctggccagtcaactcccaag

SEQ ID NO: 620110 - DNA, 25 bp, Homo sapien
aactcccaagcacttcctggaaatg

SEQ ID NO: 620111 - DNA, 25 bp, Homo sapien
atgcagatgctgtatccagggcaga

SEQ ID NO: 620112 - DNA, 25 bp, Homo sapien
aaagtacttcccctgtcatctcact

SEQ ID NO: 620113 - DNA, 25 bp, Homo sapien
tagctaatgtcttagctcttttctg

SEQ ID NO: 620114 - DNA, 25 bp, Homo sapien
atgtgacttgagaaagctctcccct

SEQ ID NO: 620115 - DNA, 25 bp, Homo sapien
cattttctcctgtaacctctttgga

SEQ ID NO: 620116 - DNA, 25 bp, Homo sapien
gaggaagtcaccagggtaaccactt

SEQ ID NO: 620117 - DNA, 25 bp, Homo sapien
gggtaaccactttcttttatgctag

SEQ ID NO: 620118 - DNA, 25 bp, Homo sapien
tttatgctagttttcttgagtgcaa

SEQ ID NO: 620119 - DNA, 25 bp, Homo sapien
acttccccacagacatatgacagaa

SEQ ID NO: 620120 - DNA, 25 bp, Homo sapien
gttactgagtacctgagctatgctt

SEQ ID NO: 620121 - DNA, 25 bp, Homo sapien
agctatgctttgtgtacctgatatc

SEQ ID NO: 620122 - DNA, 25 bp, Homo sapien
gtacctgatatcattgagttcccac

SEQ ID NO: 620123 - DNA, 25 bp, Homo sapien
ttcccacatcaaccttctgagatag

SEQ ID NO: 620124 - DNA, 25 bp, Homo sapien
aaaaatgcatacttgggctgggcgc

SEQ ID NO: 620125 - DNA, 25 bp, Homo sapien
aaaatgcatacttgggctgggcgca

SEQ ID NO: 620126 - DNA, 25 bp, Homo sapien
aaatgcatacttgggctgggcgcag

SEQ ID NO: 620127 - DNA, 25 bp, Homo sapien
aatgcatacttgggctgggcgcagt

SEQ ID NO: 620128 - DNA, 25 bp, Homo sapien
ccgagtgtggtgacgggcgcctgtg

SEQ ID NO: 620129 - DNA, 25 bp, Homo sapien
aaaatggtgtgaaccttgggggcag

SEQ ID NO: 620130 - DNA, 25 bp, Homo sapien
aaatggtgtgaaccttgggggcaga

SEQ ID NO: 620131 - DNA, 25 bp, Homo sapien
aatggtgtgaaccttgggggcagag

SEQ ID NO: 620132 - DNA, 25 bp, Homo sapien
tggtgtgaaccttgggggcagagct

SEQ ID NO: 620133 - DNA, 25 bp, Homo sapien
ggtgtgaaccttgggggcagagctt

SEQ ID NO: 620134 - DNA, 25 bp, Homo sapien
gtgtgaaccttgggggcagagcttg

SEQ ID NO: 620135 - DNA, 25 bp, Homo sapien
tttaactttctaggcctccaaagcg

SEQ ID NO: 620136 - DNA, 25 bp, Homo sapien
taggcctccaaagcgccaggcaagt

SEQ ID NO: 620137 - DNA, 25 bp, Homo sapien
cttctcgtctccttattgtttcatg

SEQ ID NO: 620138 - DNA, 25 bp, Homo sapien
attttgttctcgatctcatttccac

SEQ ID NO: 620139 - DNA, 25 bp, Homo sapien
gttctcgatctcatttccacaaagg

SEQ ID NO: 620140 - DNA, 25 bp, Homo sapien
tccacaaaggatatgaagcgtctga

SEQ ID NO: 620141 - DNA, 25 bp, Homo sapien
gaagcgtctgattttctcaagatgt

SEQ ID NO: 620142 - DNA, 25 bp, Homo sapien
gtgtgtgaattctttgtgtatctta

SEQ ID NO: 620143 - DNA, 25 bp, Homo sapien
atgtcctttcaccagaatgtttaag

SEQ ID NO: 620144 - DNA, 25 bp, Homo sapien
cagaatgtttaaggagggcccggat

SEQ ID NO: 620145 - DNA, 25 bp, Homo sapien
gggcccggatactcaagaatcagtt

SEQ ID NO: 620146 - DNA, 25 bp, Homo sapien
actttccctttataagtagccattg

SEQ ID NO: 620147 - DNA, 25 bp, Homo sapien
gtagccattgtactagtttcttatg

SEQ ID NO: 620148 - DNA, 25 bp, Homo sapien
gtttcttatgtatctctcagtgttt

SEQ ID NO: 620149 - DNA, 25 bp, Homo sapien
gtatctctcagtgtttctttatgta

SEQ ID NO: 620150 - DNA, 25 bp, Homo sapien
ataatcttatttcttccattactca

SEQ ID NO: 620151 - DNA, 25 bp, Homo sapien
attactcaggaagatggcatattat

SEQ ID NO: 620152 - DNA, 25 bp, Homo sapien
tataatctttagagatgtccacatc

SEQ ID NO: 620153 - DNA, 25 bp, Homo sapien
gatgtccacatcataacagaacttc

SEQ ID NO: 620154 - DNA, 25 bp, Homo sapien
ataacagaacttcttcattcttttt

SEQ ID NO: 620155 - DNA, 25 bp, Homo sapien
gaattttatttgttcatactccata

SEQ ID NO: 620156 - DNA, 25 bp, Homo sapien
gttcatactccatagtttaacaaac

SEQ ID NO: 620157 - DNA, 25 bp, Homo sapien
atgcaaatggatgaacgagtataac

SEQ ID NO: 620158 - DNA, 25 bp, Homo sapien
ttcaataaactgatctgctctcccc

SEQ ID NO: 620159 - DNA, 25 bp, Homo sapien
tttgcttcctacaattgtttatttg

SEQ ID NO: 620160 - DNA, 25 bp, Homo sapien
tgtttatttgtgctcttcactgccc

SEQ ID NO: 620161 - DNA, 25 bp, Homo sapien
ttcactgcccgatttcagagcatgt

SEQ ID NO: 620162 - DNA, 25 bp, Homo sapien
gcccgatttcagagcatgtactaac

SEQ ID NO: 620163 - DNA, 25 bp, Homo sapien
ttcattttttcactcctttctggag

SEQ ID NO: 620164 - DNA, 25 bp, Homo sapien
tttcactcctttctggagctgagaa

SEQ ID NO: 620165 - DNA, 25 bp, Homo sapien
ttttctcctccagtaattcacagtg

SEQ ID NO: 620166 - DNA, 25 bp, Homo sapien
cctccagtaattcacagtgtcctca

SEQ ID NO: 620167 - DNA, 25 bp, Homo sapien
tgtcctcaggtatcagaatgcaaat

SEQ ID NO: 620168 - DNA, 25 bp, Homo sapien
agacttcaacactccatggcatcct

SEQ ID NO: 620169 - DNA, 25 bp, Homo sapien
actccatggcatcctaacgaagtca

SEQ ID NO: 620170 - DNA, 25 bp, Homo sapien
ggcatcctaacgaagtcattgactt

SEQ ID NO: 620171 - DNA, 25 bp, Homo sapien
tgttgttactttcagcatatcccct

SEQ ID NO: 620172 - DNA, 25 bp, Homo sapien
atatcccctgtctggcacaaaggga

SEQ ID NO: 620173 - DNA, 25 bp, Homo sapien
cacaaagggagcacagttgacctgt

SEQ ID NO: 620174 - DNA, 25 bp, Homo sapien
gaggttagggactcagacctacctt

SEQ ID NO: 620175 - DNA, 25 bp, Homo sapien
gactcagacctaccttgcagtagaa

SEQ ID NO: 620176 - DNA, 25 bp, Homo sapien
aaaacttaagtaccgatagcctctg

SEQ ID NO: 620177 - DNA, 25 bp, Homo sapien
gttgaccaggaaccttactgataat

SEQ ID NO: 620178 - DNA, 25 bp, Homo sapien
gtgttatacgctgtatttttacaat

SEQ ID NO: 620179 - DNA, 25 bp, Homo sapien
tagactaagaaatccagtgcttggc

SEQ ID NO: 620180 - DNA, 25 bp, Homo sapien
agtgcttggccacaattattagttc

SEQ ID NO: 620181 - DNA, 25 bp, Homo sapien
gatggacatatgatctggattaggg

SEQ ID NO: 620182 - DNA, 25 bp, Homo sapien
ggaggaaatgacctctctttcttac

SEQ ID NO: 620183 - DNA, 25 bp, Homo sapien
aatgacctctctttcttactaaagg

SEQ ID NO: 620184 - DNA, 25 bp, Homo sapien
tggaaagagacaggcctaaggcact

SEQ ID NO: 620185 - DNA, 25 bp, Homo sapien
gcctaaggcactgccagtcattttt

SEQ ID NO: 620186 - DNA, 25 bp, Homo sapien
ccccttgggttgttctgcctagaat

SEQ ID NO: 620187 - DNA, 25 bp, Homo sapien
ggttgttctgcctagaattcatcaa

SEQ ID NO: 620188 - DNA, 25 bp, Homo sapien
atttgagctctggatggtgctaccc

SEQ ID NO: 620189 - DNA, 25 bp, Homo sapien
agctctggatggtgctacccaggaa

SEQ ID NO: 620190 - DNA, 25 bp, Homo sapien
gaaagggactctccagcttttggga

SEQ ID NO: 620191 - DNA, 25 bp, Homo sapien
ggactctccagcttttgggagcaga

SEQ ID NO: 620192 - DNA, 25 bp, Homo sapien
ggcaagaaaatggatcctcccttgg

SEQ ID NO: 620193 - DNA, 25 bp, Homo sapien
ggatcctcccttggagcctctggaa

SEQ ID NO: 620194 - DNA, 25 bp, Homo sapien
ggaagagatggtatcctgatgatac

SEQ ID NO: 620195 - DNA, 25 bp, Homo sapien
gatgataccttaattttagcccact

SEQ ID NO: 620196 - DNA, 25 bp, Homo sapien
accttaattttagcccactgacatc

SEQ ID NO: 620197 - DNA, 25 bp, Homo sapien
taattttagcccactgacatccatt

SEQ ID NO: 620198 - DNA, 25 bp, Homo sapien
ttttagcccactgacatccatttag

SEQ ID NO: 620199 - DNA, 25 bp, Homo sapien
tagcccactgacatccatttaggac

SEQ ID NO: 620200 - DNA, 25 bp, Homo sapien
cactgacatccatttaggacttctg

SEQ ID NO: 620201 - DNA, 25 bp, Homo sapien
aagtctgaagtcatttccacttgaa

SEQ ID NO: 620202 - DNA, 25 bp, Homo sapien
acaattgcgatggtttagactttat

SEQ ID NO: 620203 - DNA, 25 bp, Homo sapien
tgcttgaaagtctcagacccactgt

SEQ ID NO: 620204 - DNA, 25 bp, Homo sapien
ttttaaacacgctactgtcggctca

SEQ ID NO: 620205 - DNA, 25 bp, Homo sapien
tgtcggctcatccagtattcatgga

SEQ ID NO: 620206 - DNA, 25 bp, Homo sapien
gtattcatggacaggactcagggaa

SEQ ID NO: 620207 - DNA, 25 bp, Homo sapien
ggactcagggaagtacgactagact

SEQ ID NO: 620208 - DNA, 25 bp, Homo sapien
gactggaaatgaacgcgggctcccc

SEQ ID NO: 620209 - DNA, 25 bp, Homo sapien
tccccggtagcctgaaaacacaggt

SEQ ID NO: 620210 - DNA, 25 bp, Homo sapien
ggtgcagacatctttcctatgaaac

SEQ ID NO: 620211 - DNA, 25 bp, Homo sapien
atgaaacccttgtgatgcttccttt

SEQ ID NO: 620212 - DNA, 25 bp, Homo sapien
gatgtttaacacctttttatgggct

SEQ ID NO: 620213 - DNA, 25 bp, Homo sapien
taaaatcactatattttctttggtg

SEQ ID NO: 620214 - DNA, 25 bp, Homo sapien
tggtgaagatttcaaaccttttgcc

SEQ ID NO: 620215 - DNA, 25 bp, Homo sapien
gaacttattgagtatttacatattc

SEQ ID NO: 620216 - DNA, 25 bp, Homo sapien
attgagtatttacatattctggata

SEQ ID NO: 620217 - DNA, 25 bp, Homo sapien
attctggatacaagttcttttctag

SEQ ID NO: 620218 - DNA, 25 bp, Homo sapien
gttcttttctagatatgttattagc

SEQ ID NO: 620219 - DNA, 25 bp, Homo sapien
tattctgctagctttcttattaatt

SEQ ID NO: 620220 - DNA, 25 bp, Homo sapien
ttctgctagctttcttattaatttt

SEQ ID NO: 620221 - DNA, 25 bp, Homo sapien
ttcttaatgatgtctcttggagatt

SEQ ID NO: 620222 - DNA, 25 bp, Homo sapien
agattgtattaattagtctgttctc

SEQ ID NO: 620223 - DNA, 25 bp, Homo sapien
aggcataatctaaaccggtaagcct

SEQ ID NO: 620224 - DNA, 25 bp, Homo sapien
ggcataatctaaaccggtaagccta

SEQ ID NO: 620225 - DNA, 25 bp, Homo sapien
gcataatctaaaccggtaagcctaa

SEQ ID NO: 620226 - DNA, 25 bp, Homo sapien
atacttaggttctgtaaattttcat

SEQ ID NO: 620227 - DNA, 25 bp, Homo sapien
tacttaggttctgtaaattttcatt

SEQ ID NO: 620228 - DNA, 25 bp, Homo sapien
cttaggttctgtaaattttcatttg

SEQ ID NO: 620229 - DNA, 25 bp, Homo sapien
ttaggttctgtaaattttcatttgt

SEQ ID NO: 620230 - DNA, 25 bp, Homo sapien
taggttctgtaaattttcatttgtg

SEQ ID NO: 620231 - DNA, 25 bp, Homo sapien
catttgtgatagctttattttaatt

SEQ ID NO: 620232 - DNA, 25 bp, Homo sapien
ttgtgatagctttattttaatttct

SEQ ID NO: 620233 - DNA, 25 bp, Homo sapien
ttgttttataaccaggattcagcag

SEQ ID NO: 620234 - DNA, 25 bp, Homo sapien
aaagagtaaattgtcggcagggcgc

SEQ ID NO: 620235 - DNA, 25 bp, Homo sapien
aagagtaaattgtcggcagggcgca

SEQ ID NO: 620236 - DNA, 25 bp, Homo sapien
agagtaaattgtcggcagggcgcag

SEQ ID NO: 620237 - DNA, 25 bp, Homo sapien
gtaaattgtcggcagggcgcagtgg

SEQ ID NO: 620238 - DNA, 25 bp, Homo sapien
aattacccgagcatggtgacaggct

SEQ ID NO: 620239 - DNA, 25 bp, Homo sapien
attacccgagcatggtgacaggctt

SEQ ID NO: 620240 - DNA, 25 bp, Homo sapien
ttacccgagcatggtgacaggcttc

SEQ ID NO: 620241 - DNA, 25 bp, Homo sapien
tacccgagcatggtgacaggcttct

SEQ ID NO: 620242 - DNA, 25 bp, Homo sapien
acccgagcatggtgacaggcttctg

SEQ ID NO: 620243 - DNA, 25 bp, Homo sapien
cccgagcatggtgacaggcttctgt

SEQ ID NO: 620244 - DNA, 25 bp, Homo sapien
ccgagcatggtgacaggcttctgta

SEQ ID NO: 620245 - DNA, 25 bp, Homo sapien
tgttctgaaactttccgtgacctaa

SEQ ID NO: 620246 - DNA, 25 bp, Homo sapien
gttctgaaactttccgtgacctaat

SEQ ID NO: 620247 - DNA, 25 bp, Homo sapien
ttctgaaactttccgtgacctaata

SEQ ID NO: 620248 - DNA, 25 bp, Homo sapien
gaaactttccgtgacctaataccat

SEQ ID NO: 620249 - DNA, 25 bp, Homo sapien
aaactttccgtgacctaataccatg

SEQ ID NO: 620250 - DNA, 25 bp, Homo sapien
aactttccgtgacctaataccatgc

SEQ ID NO: 620251 - DNA, 25 bp, Homo sapien
actttccgtgacctaataccatgca

SEQ ID NO: 620252 - DNA, 25 bp, Homo sapien
ctttccgtgacctaataccatgcat

SEQ ID NO: 620253 - DNA, 25 bp, Homo sapien
tttccgtgacctaataccatgcatc

SEQ ID NO: 620254 - DNA, 25 bp, Homo sapien
ttccgtgacctaataccatgcatcc

SEQ ID NO: 620255 - DNA, 25 bp, Homo sapien
gtgggttttgaatcgggatgttaga

SEQ ID NO: 620256 - DNA, 25 bp, Homo sapien
gagatggcactagtatttccaaggt

SEQ ID NO: 620257 - DNA, 25 bp, Homo sapien
ttccttggtgttcagggtgtgcaca

SEQ ID NO: 620258 - DNA, 25 bp, Homo sapien
ggagcttatctgttatgtgttcatc

SEQ ID NO: 620259 - DNA, 25 bp, Homo sapien
tgttcatcagttagcaatgggacct

SEQ ID NO: 620260 - DNA, 25 bp, Homo sapien
ctgaagttcaacaacccagggtata

SEQ ID NO: 620261 - DNA, 25 bp, Homo sapien
aggagaattactcctctctctgggt

SEQ ID NO: 620262 - DNA, 25 bp, Homo sapien
tctctctgggtcttgaatgctctat

SEQ ID NO: 620263 - DNA, 25 bp, Homo sapien
gaatttgtatttagcctcaaggcag

SEQ ID NO: 620264 - DNA, 25 bp, Homo sapien
agcctcaaggcagcatttcatttgt

SEQ ID NO: 620265 - DNA, 25 bp, Homo sapien
tgtaaagcacttgggtaaccctttg

SEQ ID NO: 620266 - DNA, 25 bp, Homo sapien
taaccctttgttcttgcaataacaa

SEQ ID NO: 620267 - DNA, 25 bp, Homo sapien
gagaagatccggaactaaaaatatg

SEQ ID NO: 620268 - DNA, 25 bp, Homo sapien
atccggaactaaaaatatggaccag

SEQ ID NO: 620269 - DNA, 25 bp, Homo sapien
ggtggtgattccaccaaacttggaa

SEQ ID NO: 620270 - DNA, 25 bp, Homo sapien
gattccaccaaacttggaaacactt

SEQ ID NO: 620271 - DNA, 25 bp, Homo sapien
ttggaaacacttaacaagaccccat

SEQ ID NO: 620272 - DNA, 25 bp, Homo sapien
acacttaacaagaccccataacatg

SEQ ID NO: 620273 - DNA, 25 bp, Homo sapien
aacaagaccccataacatgcaagat

SEQ ID NO: 620274 - DNA, 25 bp, Homo sapien
gaccccataacatgcaagatatgca

SEQ ID NO: 620275 - DNA, 25 bp, Homo sapien
gggtacattttctataccagtgcct

SEQ ID NO: 620276 - DNA, 25 bp, Homo sapien
acattttctataccagtgccttaag

SEQ ID NO: 620277 - DNA, 25 bp, Homo sapien
ttctataccagtgccttaagtaaaa

SEQ ID NO: 620278 - DNA, 25 bp, Homo sapien
aacgtaaacgtcagtagtcctatat

SEQ ID NO: 620279 - DNA, 25 bp, Homo sapien
acgtcagtagtcctatatgtttgtt

SEQ ID NO: 620280 - DNA, 25 bp, Homo sapien
tagtcctatatgtttgtttcattca

SEQ ID NO: 620281 - DNA, 25 bp, Homo sapien
atgtttatgggtggtttgtgtgttt

SEQ ID NO: 620282 - DNA, 25 bp, Homo sapien
tggtttgtgtgtttgtctttctagc

SEQ ID NO: 620283 - DNA, 25 bp, Homo sapien
tgtctttctagccaggctggaagtt

SEQ ID NO: 620284 - DNA, 25 bp, Homo sapien
tagccaggctggaagtttccacatt

SEQ ID NO: 620285 - DNA, 25 bp, Homo sapien
ggcattgatctaaaaacatatcctt

SEQ ID NO: 620286 - DNA, 25 bp, Homo sapien
ttaaataaccaaattgccacaagtt

SEQ ID NO: 620287 - DNA, 25 bp, Homo sapien
aattgccacaagttacatgatcaag

SEQ ID NO: 620288 - DNA, 25 bp, Homo sapien
gccacaagttacatgatcaagacaa

SEQ ID NO: 620289 - DNA, 25 bp, Homo sapien
tttttcccctggcaaatcattcctt

SEQ ID NO: 620290 - DNA, 25 bp, Homo sapien
ttcccctggcaaatcattccttcaa

SEQ ID NO: 620291 - DNA, 25 bp, Homo sapien
ccctggcaaatcattccttcaacaa

SEQ ID NO: 620292 - DNA, 25 bp, Homo sapien
tggcaaatcattccttcaacaacct

SEQ ID NO: 620293 - DNA, 25 bp, Homo sapien
gcaaatcattccttcaacaacctca

SEQ ID NO: 620294 - DNA, 25 bp, Homo sapien
aaatcattccttcaacaacctcatc

SEQ ID NO: 620295 - DNA, 25 bp, Homo sapien
cagctactttggagtcttaggtagg

SEQ ID NO: 620296 - DNA, 25 bp, Homo sapien
ctttggagtcttaggtaggaggatc

SEQ ID NO: 620297 - DNA, 25 bp, Homo sapien
ttggagtcttaggtaggaggatcac

SEQ ID NO: 620298 - DNA, 25 bp, Homo sapien
gtgagtcatgatcccgccattatac

SEQ ID NO: 620299 - DNA, 25 bp, Homo sapien
tcatgatcccgccattatactccat

SEQ ID NO: 620300 - DNA, 25 bp, Homo sapien
gagagatgctcttgagtcccataac

SEQ ID NO: 620301 - DNA, 25 bp, Homo sapien
gtcccataacatacaacctaccagt

SEQ ID NO: 620302 - DNA, 25 bp, Homo sapien
agttttctgcaacccgaaagcccag

SEQ ID NO: 620303 - DNA, 25 bp, Homo sapien
ccagggctggcactataatcttaac

SEQ ID NO: 620304 - DNA, 25 bp, Homo sapien
aactagtcactacataaggcttttg

SEQ ID NO: 620305 - DNA, 25 bp, Homo sapien
atagttcttcattccacagatgcgg

SEQ ID NO: 620306 - DNA, 25 bp, Homo sapien
aactgtgttatccttgagaatttga

SEQ ID NO: 620307 - DNA, 25 bp, Homo sapien
gactgtgcaatgtggatgtcctctg

SEQ ID NO: 620308 - DNA, 25 bp, Homo sapien
tggtgtcccactctgatggtagact

SEQ ID NO: 620309 - DNA, 25 bp, Homo sapien
ggtagactgacatccagcaccatac

SEQ ID NO: 620310 - DNA, 25 bp, Homo sapien
tgagtttacccagcccaggcaaaaa

SEQ ID NO: 620311 - DNA, 25 bp, Homo sapien
tagcccaggttggagtggaatgaca

SEQ ID NO: 620312 - DNA, 25 bp, Homo sapien
agcccaggttggagtggaatgacac

SEQ ID NO: 620313 - DNA, 25 bp, Homo sapien
gcccaggttggagtggaatgacacg

SEQ ID NO: 620314 - DNA, 25 bp, Homo sapien
cccaggttggagtggaatgacacga

SEQ ID NO: 620315 - DNA, 25 bp, Homo sapien
ccaggttggagtggaatgacacgat

SEQ ID NO: 620316 - DNA, 25 bp, Homo sapien
gttggagtggaatgacacgatctcg

SEQ ID NO: 620317 - DNA, 25 bp, Homo sapien
ttggagtggaatgacacgatctcgg

SEQ ID NO: 620318 - DNA, 25 bp, Homo sapien
aggcacccaccatcacgccaagcta

SEQ ID NO: 620319 - DNA, 25 bp, Homo sapien
ggcacccaccatcacgccaagctaa

SEQ ID NO: 620320 - DNA, 25 bp, Homo sapien
gcacccaccatcacgccaagctaat

SEQ ID NO: 620321 - DNA, 25 bp, Homo sapien
cacccaccatcacgccaagctaatt

SEQ ID NO: 620322 - DNA, 25 bp, Homo sapien
aatcagacgtaaccctgaggtgctg

SEQ ID NO: 620323 - DNA, 25 bp, Homo sapien
cctggccctgactttagtttgtaga

SEQ ID NO: 620324 - DNA, 25 bp, Homo sapien
ctgactttagtttgtagatgctggt

SEQ ID NO: 620325 - DNA, 25 bp, Homo sapien
agatgctggtacttttgggcatgta

SEQ ID NO: 620326 - DNA, 25 bp, Homo sapien
tagaatgcatagatattgaccagat

SEQ ID NO: 620327 - DNA, 25 bp, Homo sapien
gaccagatgtcatgcatattccatt

SEQ ID NO: 620328 - DNA, 25 bp, Homo sapien
tttaggaacttattttatctctggg

SEQ ID NO: 620329 - DNA, 25 bp, Homo sapien
aacttattttatctctgggtgtgta

SEQ ID NO: 620330 - DNA, 25 bp, Homo sapien
ttatctctgggtgtgtagaattaaa

SEQ ID NO: 620331 - DNA, 25 bp, Homo sapien
aatttataaacctgacctctctgtt

SEQ ID NO: 620332 - DNA, 25 bp, Homo sapien
aaacctgacctctctgtttattttg

SEQ ID NO: 620333 - DNA, 25 bp, Homo sapien
aacattagctgttctgtctttcaat

SEQ ID NO: 620334 - DNA, 25 bp, Homo sapien
ggagactgcctccatgtgagttaat

SEQ ID NO: 620335 - DNA, 25 bp, Homo sapien
ctgcctccatgtgagttaattactt

SEQ ID NO: 620336 - DNA, 25 bp, Homo sapien
ttaattactttgctctggaactagc

SEQ ID NO: 620337 - DNA, 25 bp, Homo sapien
gctctggaactagcattattgtcat

SEQ ID NO: 620338 - DNA, 25 bp, Homo sapien
tattgtcattatcatcgccattctg

SEQ ID NO: 620339 - DNA, 25 bp, Homo sapien
tgtcattatcatcgccattctgtca

SEQ ID NO: 620340 - DNA, 25 bp, Homo sapien
ctgtcatcatcatctgattaatatt

SEQ ID NO: 620341 - DNA, 25 bp, Homo sapien
taatattgtggattttccccctctg

SEQ ID NO: 620342 - DNA, 25 bp, Homo sapien
tctgcttgcatcttcttttgactca

SEQ ID NO: 620343 - DNA, 25 bp, Homo sapien
ttttgactcactctggaagaaatgt

SEQ ID NO: 620344 - DNA, 25 bp, Homo sapien
acgcatgccaaacgcctgcagattc

SEQ ID NO: 620345 - DNA, 25 bp, Homo sapien
tgcagattctgccagagtcaacctt

SEQ ID NO: 620346 - DNA, 25 bp, Homo sapien
ttcttctcctgtcttagtggccaga

SEQ ID NO: 620347 - DNA, 25 bp, Homo sapien
aaggataaacaaggcctgcgtccag

SEQ ID NO: 620348 - DNA, 25 bp, Homo sapien
aaggcctgcgtccagacagagttgt

SEQ ID NO: 620349 - DNA, 25 bp, Homo sapien
gtttctctgaaacattgctggcttc

SEQ ID NO: 620350 - DNA, 25 bp, Homo sapien
ctggcttcttctgagtttgattcag

SEQ ID NO: 620351 - DNA, 25 bp, Homo sapien
gagtttgattcagctgttctctgat

SEQ ID NO: 620352 - DNA, 25 bp, Homo sapien
aaaacttgccttcagagatatctct

SEQ ID NO: 620353 - DNA, 25 bp, Homo sapien
aatcttcagctttagttggtcaaca

SEQ ID NO: 620354 - DNA, 25 bp, Homo sapien
aattgaactcctactgtgggcctgg

SEQ ID NO: 620355 - DNA, 25 bp, Homo sapien
catggtggcgggtctctgtagaccc

SEQ ID NO: 620356 - DNA, 25 bp, Homo sapien
ctgtagacccagctaagattgaggc

SEQ ID NO: 620357 - DNA, 25 bp, Homo sapien
tgccgctgcactctaatctgacagc

SEQ ID NO: 620358 - DNA, 25 bp, Homo sapien
tgcactctaatctgacagcagagca

SEQ ID NO: 620359 - DNA, 25 bp, Homo sapien
agcagagcaagacccgcttaaagcg

SEQ ID NO: 620360 - DNA, 25 bp, Homo sapien
aaacatgcaactttcttgccattag

SEQ ID NO: 620361 - DNA, 25 bp, Homo sapien
ctttcttgccattaggtgagtgtgt

SEQ ID NO: 620362 - DNA, 25 bp, Homo sapien
tgtttctgcctcttgtatcagcaac

SEQ ID NO: 620363 - DNA, 25 bp, Homo sapien
ttgtatcagcaacagaagcctcaga

SEQ ID NO: 620364 - DNA, 25 bp, Homo sapien
gaagcctcagattatccagctgtat

SEQ ID NO: 620365 - DNA, 25 bp, Homo sapien
atccagctgtatcagaactttccat

SEQ ID NO: 620366 - DNA, 25 bp, Homo sapien
ggctcagcaatgctggcatgagact

SEQ ID NO: 620367 - DNA, 25 bp, Homo sapien
gcaatgctggcatgagactcaaatg

SEQ ID NO: 620368 - DNA, 25 bp, Homo sapien
aaatgcaaagatcctgcttcccgtt

SEQ ID NO: 620369 - DNA, 25 bp, Homo sapien
aagagcctccaaggcgccattggct

SEQ ID NO: 620370 - DNA, 25 bp, Homo sapien
tccaaggcgccattggcttcctggg

SEQ ID NO: 620371 - DNA, 25 bp, Homo sapien
ttcctgggactctgagtctgccggc

SEQ ID NO: 620372 - DNA, 25 bp, Homo sapien
gagtctgccggcctcttttcctgac

SEQ ID NO: 620373 - DNA, 25 bp, Homo sapien
tgactccagtttcttctggcctgag

SEQ ID NO: 620374 - DNA, 25 bp, Homo sapien
ctgcatttgcatctcggattgtgtt

SEQ ID NO: 620375 - DNA, 25 bp, Homo sapien
tgcatctcggattgtgtttttaaac

SEQ ID NO: 620376 - DNA, 25 bp, Homo sapien
tctcggattgtgtttttaaacccat

SEQ ID NO: 620377 - DNA, 25 bp, Homo sapien
gtttcctgtttcattgatgaatcag

SEQ ID NO: 620378 - DNA, 25 bp, Homo sapien
cattgatgaatcaggagtcttctat

SEQ ID NO: 620379 - DNA, 25 bp, Homo sapien
gtactacttttacacatgttcacag

SEQ ID NO: 620380 - DNA, 25 bp, Homo sapien
acaagcataggtcttatcatccact

SEQ ID NO: 620381 - DNA, 25 bp, Homo sapien
taggtcttatcatccacttattcca

SEQ ID NO: 620382 - DNA, 25 bp, Homo sapien
atccacttattccaaggctaagaat

SEQ ID NO: 620383 - DNA, 25 bp, Homo sapien
aagttaagtgactagtctgaggaca

SEQ ID NO: 620384 - DNA, 25 bp, Homo sapien
gagacatggatgtggctatgcccag

SEQ ID NO: 620385 - DNA, 25 bp, Homo sapien
tatgcccaggtatatgtggctgaaa

SEQ ID NO: 620386 - DNA, 25 bp, Homo sapien
tggctgaaagctggtgctctgtctc

SEQ ID NO: 620387 - DNA, 25 bp, Homo sapien
gtctctatgcaagacaggcagagga

SEQ ID NO: 620388 - DNA, 25 bp, Homo sapien
atgtaactgtacttaatgacactga

SEQ ID NO: 620389 - DNA, 25 bp, Homo sapien
aagtggcaagagctacaggaatgct

SEQ ID NO: 620390 - DNA, 25 bp, Homo sapien
caggaatgctaggtaggcaggcaat

SEQ ID NO: 620391 - DNA, 25 bp, Homo sapien
gggaaacacatctcaatcaaacgta

SEQ ID NO: 620392 - DNA, 25 bp, Homo sapien
tcaatcaaacgtatccaatggcccc

SEQ ID NO: 620393 - DNA, 25 bp, Homo sapien
caatggcccctcagatgtgccttgt

SEQ ID NO: 620394 - DNA, 25 bp, Homo sapien
gggccatgggactcactctttgtga

SEQ ID NO: 620395 - DNA, 25 bp, Homo sapien
gggactcactctttgtgaagctcat

SEQ ID NO: 620396 - DNA, 25 bp, Homo sapien
gtgaagctcatgaaaacaatatcta

SEQ ID NO: 620397 - DNA, 25 bp, Homo sapien
aatatctagcagttccaaagaaggg

SEQ ID NO: 620398 - DNA, 25 bp, Homo sapien
gaatgcaaagctaatgtcactcttt

SEQ ID NO: 620399 - DNA, 25 bp, Homo sapien
ttaccatcttacctctgccttttgt

SEQ ID NO: 620400 - DNA, 25 bp, Homo sapien
tgccttttgtttccttacttccagg

SEQ ID NO: 620401 - DNA, 25 bp, Homo sapien
ttgtttccttacttccaggtattcg

SEQ ID NO: 620402 - DNA, 25 bp, Homo sapien
ttacttccaggtattcgccttccat

SEQ ID NO: 620403 - DNA, 25 bp, Homo sapien
cagggccacaaatggtactgagggc

SEQ ID NO: 620404 - DNA, 25 bp, Homo sapien
aaatggtactgagggcagagtgtcc

SEQ ID NO: 620405 - DNA, 25 bp, Homo sapien
gcagagtgtcccagtccagtgaagg

SEQ ID NO: 620406 - DNA, 25 bp, Homo sapien
agtgtcccagtccagtgaaggccta

SEQ ID NO: 620407 - DNA, 25 bp, Homo sapien
gtcccagtccagtgaaggcctagag

SEQ ID NO: 620408 - DNA, 25 bp, Homo sapien
gcatggcgagtggaggattaatata

SEQ ID NO: 620409 - DNA, 25 bp, Homo sapien
acccagagataacacttaccaattc

SEQ ID NO: 620410 - DNA, 25 bp, Homo sapien
tacagtgttataaggatcaaggttt

SEQ ID NO: 620411 - DNA, 25 bp, Homo sapien
gttataaggatcaaggttttcatga

SEQ ID NO: 620412 - DNA, 25 bp, Homo sapien
agttaaggcaactaaagcatttaga

SEQ ID NO: 620413 - DNA, 25 bp, Homo sapien
agaacattgccagctcaaagtaggt

SEQ ID NO: 620414 - DNA, 25 bp, Homo sapien
attgccagctcaaagtaggtgctca

SEQ ID NO: 620415 - DNA, 25 bp, Homo sapien
ccctcatctgtaaatctgtatgaat

SEQ ID NO: 620416 - DNA, 25 bp, Homo sapien
tctgtatgaatgatacctgccttgc

SEQ ID NO: 620417 - DNA, 25 bp, Homo sapien
gtatgaatgatacctgccttgcagg

SEQ ID NO: 620418 - DNA, 25 bp, Homo sapien
ctgccttgcagggttattgtgagga

SEQ ID NO: 620419 - DNA, 25 bp, Homo sapien
ggttattgtgaggatttgacatatt

SEQ ID NO: 620420 - DNA, 25 bp, Homo sapien
ttgctattataactactattgctgt

SEQ ID NO: 620421 - DNA, 25 bp, Homo sapien
agatgaaacactttatattggaaga

SEQ ID NO: 620422 - DNA, 25 bp, Homo sapien
gataccatcttggacttccataact

SEQ ID NO: 620423 - DNA, 25 bp, Homo sapien
atcttggacttccataactagagag

SEQ ID NO: 620424 - DNA, 25 bp, Homo sapien
ggacagtctgcctttcttgatagga

SEQ ID NO: 620425 - DNA, 25 bp, Homo sapien
gtctgcctttcttgataggagctaa

SEQ ID NO: 620426 - DNA, 25 bp, Homo sapien
ataggagctaatggagctggtgact

SEQ ID NO: 620427 - DNA, 25 bp, Homo sapien
tgctcatttactaagctgaaaatcc

SEQ ID NO: 620428 - DNA, 25 bp, Homo sapien
tactaagctgaaaatcctagagtcc

SEQ ID NO: 620429 - DNA, 25 bp, Homo sapien
tcctagagtccttaaggatcatgct

SEQ ID NO: 620430 - DNA, 25 bp, Homo sapien
tccttaaggatcatgctggctgggc

SEQ ID NO: 620431 - DNA, 25 bp, Homo sapien
cttaaggatcatgctggctgggcat

SEQ ID NO: 620432 - DNA, 25 bp, Homo sapien
atgcagcccgcagattggaccagct

SEQ ID NO: 620433 - DNA, 25 bp, Homo sapien
ggaccagcttggtatagtcaataca

SEQ ID NO: 620434 - DNA, 25 bp, Homo sapien
gtgacacaatcgctccttgtcattc

SEQ ID NO: 620435 - DNA, 25 bp, Homo sapien
gtcattctcaactgttctgtattgg

SEQ ID NO: 620436 - DNA, 25 bp, Homo sapien
gtgctgggcttttatccgactggaa

SEQ ID NO: 620437 - DNA, 25 bp, Homo sapien
agcacagtaggtttgccgacactaa

SEQ ID NO: 620438 - DNA, 25 bp, Homo sapien
acactaacatcaccacaggcagtga

SEQ ID NO: 620439 - DNA, 25 bp, Homo sapien
ggcagtgagcaatgccctgtgctat

SEQ ID NO: 620440 - DNA, 25 bp, Homo sapien
gtgctatgacctcgtgatgaccaaa

SEQ ID NO: 620441 - DNA, 25 bp, Homo sapien
gttatgcggcacatgactatttcta

SEQ ID NO: 620442 - DNA, 25 bp, Homo sapien
actatttctaagctcactagggccc

SEQ ID NO: 620443 - DNA, 25 bp, Homo sapien
ttaggaggaccactaacctcaagag

SEQ ID NO: 620444 - DNA, 25 bp, Homo sapien
taggaggaccactaacctcaagagg

SEQ ID NO: 620445 - DNA, 25 bp, Homo sapien
aggaggaccactaacctcaagaggc

SEQ ID NO: 620446 - DNA, 25 bp, Homo sapien
ggaggaccactaacctcaagaggct

SEQ ID NO: 620447 - DNA, 25 bp, Homo sapien
gaggaccactaacctcaagaggctg

SEQ ID NO: 620448 - DNA, 25 bp, Homo sapien
ggaccactaacctcaagaggctggg

SEQ ID NO: 620449 - DNA, 25 bp, Homo sapien
gaccactaacctcaagaggctgggt

SEQ ID NO: 620450 - DNA, 25 bp, Homo sapien
accactaacctcaagaggctgggtg

SEQ ID NO: 620451 - DNA, 25 bp, Homo sapien
ccactaacctcaagaggctgggtgc

SEQ ID NO: 620452 - DNA, 25 bp, Homo sapien
cactaacctcaagaggctgggtgcg

SEQ ID NO: 620453 - DNA, 25 bp, Homo sapien
gccagacgtggtggttggcacctat

SEQ ID NO: 620454 - DNA, 25 bp, Homo sapien
cagatgcagatgaaggaaacacaac

SEQ ID NO: 620455 - DNA, 25 bp, Homo sapien
ggaaacacaacctaaagagctagaa

SEQ ID NO: 620456 - DNA, 25 bp, Homo sapien
tggtcatccaaactccaatgacatt

SEQ ID NO: 620457 - DNA, 25 bp, Homo sapien
caatgacattatctcccaggtggaa

SEQ ID NO: 620458 - DNA, 25 bp, Homo sapien
attatctcccaggtggaagagtgta

SEQ ID NO: 620459 - DNA, 25 bp, Homo sapien
attgaaagatgtacagcggtcatat

SEQ ID NO: 620460 - DNA, 25 bp, Homo sapien
gatgtacagcggtcatatgaaggaa

SEQ ID NO: 620461 - DNA, 25 bp, Homo sapien
gaggaatctgaagacattagagaac

SEQ ID NO: 620462 - DNA, 25 bp, Homo sapien
gaaaaggagcccatatcaatcacac

SEQ ID NO: 620463 - DNA, 25 bp, Homo sapien
aaggagcccatatcaatcacacctc

SEQ ID NO: 620464 - DNA, 25 bp, Homo sapien
tacaatactccctgcctggagctct

SEQ ID NO: 620465 - DNA, 25 bp, Homo sapien
tctgacttccagaacctacgataat

SEQ ID NO: 620466 - DNA, 25 bp, Homo sapien
gaacctacgataatagactccatga

SEQ ID NO: 620467 - DNA, 25 bp, Homo sapien
gaaatctgtaatcagtggccacagg

SEQ ID NO: 620468 - DNA, 25 bp, Homo sapien
aggaaactcatgcaacagcccttcc

SEQ ID NO: 620469 - DNA, 25 bp, Homo sapien
aactcatgcaacagcccttccaagg

SEQ ID NO: 620470 - DNA, 25 bp, Homo sapien
ccagcaaagcctccgtggtgtctgc

SEQ ID NO: 620471 - DNA, 25 bp, Homo sapien
tgtgcctcctgggacacaagacagg

SEQ ID NO: 620472 - DNA, 25 bp, Homo sapien
agagggccgccatcagtcctcaaag

SEQ ID NO: 620473 - DNA, 25 bp, Homo sapien
gccgccatcagtcctcaaagacatg

SEQ ID NO: 620474 - DNA, 25 bp, Homo sapien
aagacatgctcagatgcagtggctc

SEQ ID NO: 620475 - DNA, 25 bp, Homo sapien
ctggcaccagctggtcccaaggtgg

SEQ ID NO: 620476 - DNA, 25 bp, Homo sapien
gaatgtaggccatgtagcccagaga

SEQ ID NO: 620477 - DNA, 25 bp, Homo sapien
agaagaatttcaggatccagagtca

SEQ ID NO: 620478 - DNA, 25 bp, Homo sapien
agagtcagacaaacaaacccttcct

SEQ ID NO: 620479 - DNA, 25 bp, Homo sapien
aacccttccattccgaggctgattg

SEQ ID NO: 620480 - DNA, 25 bp, Homo sapien
ccattccgaggctgattgactttaa

SEQ ID NO: 620481 - DNA, 25 bp, Homo sapien
aatcatgtctattctctgagtgtca

SEQ ID NO: 620482 - DNA, 25 bp, Homo sapien
gagtgtcacgttcctcacctgtgaa

SEQ ID NO: 620483 - DNA, 25 bp, Homo sapien
gtgaaataaccaccatcattgggct

SEQ ID NO: 620484 - DNA, 25 bp, Homo sapien
ccatcattgggctttcagggaggag

SEQ ID NO: 620485 - DNA, 25 bp, Homo sapien
atcattcatgtcgagcacctagtaa

SEQ ID NO: 620486 - DNA, 25 bp, Homo sapien
gtcgagcacctagtaaaaagcctat

SEQ ID NO: 620487 - DNA, 25 bp, Homo sapien
cttagacaatgatttgctggcagaa

SEQ ID NO: 620488 - DNA, 25 bp, Homo sapien
gatttgctggcagaatctgtttgat

SEQ ID NO: 620489 - DNA, 25 bp, Homo sapien
gaatctgtttgatgtaactgtttta

SEQ ID NO: 620490 - DNA, 25 bp, Homo sapien
aactctgaaatctattgcaggctta

SEQ ID NO: 620491 - DNA, 25 bp, Homo sapien
cttccagtggaaggttgggcagtaa

SEQ ID NO: 620492 - DNA, 25 bp, Homo sapien
gtaaattgcagttactgtcaatcag

SEQ ID NO: 620493 - DNA, 25 bp, Homo sapien
gtcaatcagttttagctcttagcag

SEQ ID NO: 620494 - DNA, 25 bp, Homo sapien
gctcttagcagagtagtaaccatat

SEQ ID NO: 620495 - DNA, 25 bp, Homo sapien
agtagtaaccatatcacccatcctt

SEQ ID NO: 620496 - DNA, 25 bp, Homo sapien
tccagcccatacacattgtgggagt

SEQ ID NO: 620497 - DNA, 25 bp, Homo sapien
tggtagttcgtaccttcactttttg

SEQ ID NO: 620498 - DNA, 25 bp, Homo sapien
atatgagcattgttgttgggactac

SEQ ID NO: 620499 - DNA, 25 bp, Homo sapien
gttgttgggactacagtgctatttt

SEQ ID NO: 620500 - DNA, 25 bp, Homo sapien
gatttgcatgtgagtatacacctac

SEQ ID NO: 620501 - DNA, 25 bp, Homo sapien
gagtatacacctacaggtctctgtt

SEQ ID NO: 620502 - DNA, 25 bp, Homo sapien
ggtctctgttatagccgtgacatgt

SEQ ID NO: 620503 - DNA, 25 bp, Homo sapien
gccgtgacatgtcttctgttactat

SEQ ID NO: 620504 - DNA, 25 bp, Homo sapien
taacaaatccttatggtttcttggg

SEQ ID NO: 620505 - DNA, 25 bp, Homo sapien
aatccttatggtttcttgggtcact

SEQ ID NO: 620506 - DNA, 25 bp, Homo sapien
catctttcagtacatatgtaagact

SEQ ID NO: 620507 - DNA, 25 bp, Homo sapien
atgtaagacttaaggcattattgaa

SEQ ID NO: 620508 - DNA, 25 bp, Homo sapien
gaaaataagcctgtgctacatggta

SEQ ID NO: 620509 - DNA, 25 bp, Homo sapien
cataactttcataactttgaacatt

SEQ ID NO: 620510 - DNA, 25 bp, Homo sapien
taactttgaacattttggctcatag

SEQ ID NO: 620511 - DNA, 25 bp, Homo sapien
attttggctcataggcgaaagggaa

SEQ ID NO: 620512 - DNA, 25 bp, Homo sapien
ttttggctcataggcgaaagggaat

SEQ ID NO: 620513 - DNA, 25 bp, Homo sapien
tggctcataggcgaaagggaattgc

SEQ ID NO: 620514 - DNA, 25 bp, Homo sapien
taggcgaaagggaattgccttattt

SEQ ID NO: 620515 - DNA, 25 bp, Homo sapien
attgccttatttcgaatgagacttt

SEQ ID NO: 620516 - DNA, 25 bp, Homo sapien
gccttatttcgaatgagactttgga

SEQ ID NO: 620517 - DNA, 25 bp, Homo sapien
cttatttcgaatgagactttggact

SEQ ID NO: 620518 - DNA, 25 bp, Homo sapien
aggtaattgactcacggggccaagt

SEQ ID NO: 620519 - DNA, 25 bp, Homo sapien
acggggccaagtcttgctgttcttg

SEQ ID NO: 620520 - DNA, 25 bp, Homo sapien
ttaaaaaatgctaggaaggcccagg

SEQ ID NO: 620521 - DNA, 25 bp, Homo sapien
taaaaaatgctaggaaggcccaggc

SEQ ID NO: 620522 - DNA, 25 bp, Homo sapien
aaaaaatgctaggaaggcccaggca

SEQ ID NO: 620523 - DNA, 25 bp, Homo sapien
aaaaatgctaggaaggcccaggcac

SEQ ID NO: 620524 - DNA, 25 bp, Homo sapien
aaaatgctaggaaggcccaggcacg

SEQ ID NO: 620525 - DNA, 25 bp, Homo sapien
aaatgctaggaaggcccaggcacgg

SEQ ID NO: 620526 - DNA, 25 bp, Homo sapien
aatgctaggaaggcccaggcacggt

SEQ ID NO: 620527 - DNA, 25 bp, Homo sapien
atgctaggaaggcccaggcacggtg

SEQ ID NO: 620528 - DNA, 25 bp, Homo sapien
tgctaggaaggcccaggcacggtgg

SEQ ID NO: 620529 - DNA, 25 bp, Homo sapien
gctaggaaggcccaggcacggtggc

SEQ ID NO: 620530 - DNA, 25 bp, Homo sapien
ctaggaaggcccaggcacggtggct

SEQ ID NO: 620531 - DNA, 25 bp, Homo sapien
aacatttattgagccagatatgcct

SEQ ID NO: 620532 - DNA, 25 bp, Homo sapien
tgagccagatatgcctaattgaaat

SEQ ID NO: 620533 - DNA, 25 bp, Homo sapien
gaataggcaggaaccaatttgcatt

SEQ ID NO: 620534 - DNA, 25 bp, Homo sapien
ggaaccaatttgcatttaagtagta

SEQ ID NO: 620535 - DNA, 25 bp, Homo sapien
aagtagtatgggaagcctcgagtat

SEQ ID NO: 620536 - DNA, 25 bp, Homo sapien
agcctcgagtatgttttcttgtcca

SEQ ID NO: 620537 - DNA, 25 bp, Homo sapien
ttcttgtccagagtgaagcaaccaa

SEQ ID NO: 620538 - DNA, 25 bp, Homo sapien
gatgctggagatatcttagactcaa

SEQ ID NO: 620539 - DNA, 25 bp, Homo sapien
gagcaggatttcaaggacggaatta

SEQ ID NO: 620540 - DNA, 25 bp, Homo sapien
ggacggaattagtattgcacagaga

SEQ ID NO: 620541 - DNA, 25 bp, Homo sapien
tgcacagagattagggacacttctt

SEQ ID NO: 620542 - DNA, 25 bp, Homo sapien
gttattggcaaaatttattctcatt

SEQ ID NO: 620543 - DNA, 25 bp, Homo sapien
atttattctcattatacctgcttca

SEQ ID NO: 620544 - DNA, 25 bp, Homo sapien
tcattatacctgcttcatatgggta

SEQ ID NO: 620545 - DNA, 25 bp, Homo sapien
acctgcttcatatgggtatattact

SEQ ID NO: 620546 - DNA, 25 bp, Homo sapien
tcattttacaatgcacttcaccaat

SEQ ID NO: 620547 - DNA, 25 bp, Homo sapien
tacaatgcacttcaccaatgaaaca

SEQ ID NO: 620548 - DNA, 25 bp, Homo sapien
gaaacagctaatttccattttgaaa

SEQ ID NO: 620549 - DNA, 25 bp, Homo sapien
cagagaagttaaatgcggtgtagca

SEQ ID NO: 620550 - DNA, 25 bp, Homo sapien
tcaacagattattcctcctctcctt

SEQ ID NO: 620551 - DNA, 25 bp, Homo sapien
agattattcctcctctccttagaat

SEQ ID NO: 620552 - DNA, 25 bp, Homo sapien
attcctcctctccttagaataacca

SEQ ID NO: 620553 - DNA, 25 bp, Homo sapien
acagtaaaattaaagcgccgctcag

SEQ ID NO: 620554 - DNA, 25 bp, Homo sapien
attaaagcgccgctcagctgagtgc

SEQ ID NO: 620555 - DNA, 25 bp, Homo sapien
gctcagctgagtgccgtgatcaaga

SEQ ID NO: 620556 - DNA, 25 bp, Homo sapien
gatcaagatcacacatattgggagg

SEQ ID NO: 620557 - DNA, 25 bp, Homo sapien
gggctggagtccaggtctcctacca

SEQ ID NO: 620558 - DNA, 25 bp, Homo sapien
gatcaagggagggtacaatgttagc

SEQ ID NO: 620559 - DNA, 25 bp, Homo sapien
tacaatgttagcttggttaagacac

SEQ ID NO: 620560 - DNA, 25 bp, Homo sapien
gttaagacacaagaaagcccagagt

SEQ ID NO: 620561 - DNA, 25 bp, Homo sapien
gaaagcccagagtgacagaagcatc

SEQ ID NO: 620562 - DNA, 25 bp, Homo sapien
gacagaagcatcatgcacaagagga

SEQ ID NO: 620563 - DNA, 25 bp, Homo sapien
aaaggcaggcgttttgagttatcaa

SEQ ID NO: 620564 - DNA, 25 bp, Homo sapien
cttagtgcattagtgtcacagataa

SEQ ID NO: 620565 - DNA, 25 bp, Homo sapien
gattattcatgacgtttttctccaa

SEQ ID NO: 620566 - DNA, 25 bp, Homo sapien
ttcatgacgtttttctccaattctt

SEQ ID NO: 620567 - DNA, 25 bp, Homo sapien
aaatgaagtatgacacttgctgttt

SEQ ID NO: 620568 - DNA, 25 bp, Homo sapien
cttgctgtttttcttctactgatta

SEQ ID NO: 620569 - DNA, 25 bp, Homo sapien
gttagaatgttcatactcttctcat

SEQ ID NO: 620570 - DNA, 25 bp, Homo sapien
tcttctcattacttatttgctttca

SEQ ID NO: 620571 - DNA, 25 bp, Homo sapien
acttatttgctttcatgggccattt

SEQ ID NO: 620572 - DNA, 25 bp, Homo sapien
catgggccattttaacagttttatt

SEQ ID NO: 620573 - DNA, 25 bp, Homo sapien
ttgttaacagaatggcagactaaac

SEQ ID NO: 620574 - DNA, 25 bp, Homo sapien
gactaaacacacattccctttgtgt

SEQ ID NO: 620575 - DNA, 25 bp, Homo sapien
aaatgcgcggccgggggcggtggct

SEQ ID NO: 620576 - DNA, 25 bp, Homo sapien
aatgcgcggccgggggcggtggctc

SEQ ID NO: 620577 - DNA, 25 bp, Homo sapien
atgcgcggccgggggcggtggctca

SEQ ID NO: 620578 - DNA, 25 bp, Homo sapien
tgcgcggccgggggcggtggctcat

SEQ ID NO: 620579 - DNA, 25 bp, Homo sapien
gcgcggccgggggcggtggctcatg

SEQ ID NO: 620580 - DNA, 25 bp, Homo sapien
cgcggccgggggcggtggctcatgc

SEQ ID NO: 620581 - DNA, 25 bp, Homo sapien
gcggccgggggcggtggctcatgcc

SEQ ID NO: 620582 - DNA, 25 bp, Homo sapien
ttagcctggcgtggtagtgggcgcc

SEQ ID NO: 620583 - DNA, 25 bp, Homo sapien
tagcctggcgtggtagtgggcgcct

SEQ ID NO: 620584 - DNA, 25 bp, Homo sapien
agcctggcgtggtagtgggcgcctg

SEQ ID NO: 620585 - DNA, 25 bp, Homo sapien
ggcgggagcatggcatgaacccggg

SEQ ID NO: 620586 - DNA, 25 bp, Homo sapien
cctctgcatgcttgttcatggtgat

SEQ ID NO: 620587 - DNA, 25 bp, Homo sapien
gcttgttcatggtgatttggttgtt

SEQ ID NO: 620588 - DNA, 25 bp, Homo sapien
tatttcaatgatggtttcagtgatg

SEQ ID NO: 620589 - DNA, 25 bp, Homo sapien
gcataagagtatttcacaggattca

SEQ ID NO: 620590 - DNA, 25 bp, Homo sapien
ggattcagcaaagagcccataattt

SEQ ID NO: 620591 - DNA, 25 bp, Homo sapien
tttcagggacaaaaccaagtataat

SEQ ID NO: 620592 - DNA, 25 bp, Homo sapien
taatatttcacaggattcaacaaag

SEQ ID NO: 620593 - DNA, 25 bp, Homo sapien
aagagccccataatttctgggtatg

SEQ ID NO: 620594 - DNA, 25 bp, Homo sapien
ttctgggtatgtctctacctggtca

SEQ ID NO: 620595 - DNA, 25 bp, Homo sapien
gtctctacctggtcagacatgagaa

SEQ ID NO: 620596 - DNA, 25 bp, Homo sapien
tccaaaagatccctttagtgccctt

SEQ ID NO: 620597 - DNA, 25 bp, Homo sapien
gaggctgctgtgttaatgctggact

SEQ ID NO: 620598 - DNA, 25 bp, Homo sapien
gttaatgctggactgtattgccact

SEQ ID NO: 620599 - DNA, 25 bp, Homo sapien
gtattgccactaaacaagcagtttg

SEQ ID NO: 620600 - DNA, 25 bp, Homo sapien
agtttgaaggctgtgatcgcttgta

SEQ ID NO: 620601 - DNA, 25 bp, Homo sapien
ggctgtgatcgcttgtattcacttt

SEQ ID NO: 620602 - DNA, 25 bp, Homo sapien
tattcactttgtaactcgggtactg

SEQ ID NO: 620603 - DNA, 25 bp, Homo sapien
tcgggtactgtttgtggagcacttc

SEQ ID NO: 620604 - DNA, 25 bp, Homo sapien
ttgtggagcacttctgtgatcttag

SEQ ID NO: 620605 - DNA, 25 bp, Homo sapien
gcacttctgtgatcttaggttatta

SEQ ID NO: 620606 - DNA, 25 bp, Homo sapien
agactatatataaccccttcaaaag

SEQ ID NO: 620607 - DNA, 25 bp, Homo sapien
aaccccttcaaaagtaccatatctg

SEQ ID NO: 620608 - DNA, 25 bp, Homo sapien
ctggttcaatcttgggagattgtgt

SEQ ID NO: 620609 - DNA, 25 bp, Homo sapien
ggagattgtgtgtttccaggaattt

SEQ ID NO: 620610 - DNA, 25 bp, Homo sapien
aggaatttagccgtttcctccagat

SEQ ID NO: 620611 - DNA, 25 bp, Homo sapien
gaatttagccgtttcctccagattt

SEQ ID NO: 620612 - DNA, 25 bp, Homo sapien
ttagccgtttcctccagattttctt

SEQ ID NO: 620613 - DNA, 25 bp, Homo sapien
gtttcctccagattttcttctttat

SEQ ID NO: 620614 - DNA, 25 bp, Homo sapien
gattttcttctttatgtgcatcgac

SEQ ID NO: 620615 - DNA, 25 bp, Homo sapien
ttcttctttatgtgcatcgacttga

SEQ ID NO: 620616 - DNA, 25 bp, Homo sapien
ctttatgtgcatcgacttgagtgta

SEQ ID NO: 620617 - DNA, 25 bp, Homo sapien
atgtgcatcgacttgagtgtaaaca

SEQ ID NO: 620618 - DNA, 25 bp, Homo sapien
gcatcgacttgagtgtaaacataac

SEQ ID NO: 620619 - DNA, 25 bp, Homo sapien
agcctcatagttcccaggagtgtgc

SEQ ID NO: 620620 - DNA, 25 bp, Homo sapien
ggctaaacacccgtctgtgttccag

SEQ ID NO: 620621 - DNA, 25 bp, Homo sapien
gtctgtgttccagccagctgaagca

SEQ ID NO: 620622 - DNA, 25 bp, Homo sapien
gctgaagcacctgtctggtgcgagt

SEQ ID NO: 620623 - DNA, 25 bp, Homo sapien
tggtgcgagttctagacaggacagt

SEQ ID NO: 620624 - DNA, 25 bp, Homo sapien
agtggtgggatctcactcagttgct

SEQ ID NO: 620625 - DNA, 25 bp, Homo sapien
ggagtaatttgttggccatctgcct

SEQ ID NO: 620626 - DNA, 25 bp, Homo sapien
gccatctgcctgttaagggcactgg

SEQ ID NO: 620627 - DNA, 25 bp, Homo sapien
tgatccaaaggtctgctcacgtagc

SEQ ID NO: 620628 - DNA, 25 bp, Homo sapien
ggtctgctcacgtagcaaacatttg

SEQ ID NO: 620629 - DNA, 25 bp, Homo sapien
gggtcagatagtgtggccctcatga

SEQ ID NO: 620630 - DNA, 25 bp, Homo sapien
ggtgttggaggcaacttctgttcca

SEQ ID NO: 620631 - DNA, 25 bp, Homo sapien
ttctgttccaagaactcccagcagc

SEQ ID NO: 620632 - DNA, 25 bp, Homo sapien
actcccagcagctttgaaagcagac

SEQ ID NO: 620633 - DNA, 25 bp, Homo sapien
gatgagttgagaccctgaatccctg

SEQ ID NO: 620634 - DNA, 25 bp, Homo sapien
aatccctgggctgttgttcctgtca

SEQ ID NO: 620635 - DNA, 25 bp, Homo sapien
tcctgtcacccctaattaatatgtg

SEQ ID NO: 620636 - DNA, 25 bp, Homo sapien
gagagacaacagctgggttttccat

SEQ ID NO: 620637 - DNA, 25 bp, Homo sapien
ggttttccatccctaacacatttat

SEQ ID NO: 620638 - DNA, 25 bp, Homo sapien
gcaatttctgcatgtctcatatatt

SEQ ID NO: 620639 - DNA, 25 bp, Homo sapien
gaaattactgtctggaaaactgcaa

SEQ ID NO: 620640 - DNA, 25 bp, Homo sapien
aaaactgcaatttcatcttgagagt

SEQ ID NO: 620641 - DNA, 25 bp, Homo sapien
accacatctggcttcctactgacat

SEQ ID NO: 620642 - DNA, 25 bp, Homo sapien
acatctggcttcctactgacatctt

SEQ ID NO: 620643 - DNA, 25 bp, Homo sapien
atctggcttcctactgacatcttaa

SEQ ID NO: 620644 - DNA, 25 bp, Homo sapien
ctggcttcctactgacatcttaact

SEQ ID NO: 620645 - DNA, 25 bp, Homo sapien
gacatcttaactttagtgcagtgag

SEQ ID NO: 620646 - DNA, 25 bp, Homo sapien
cttaactttagtgcagtgagactca

SEQ ID NO: 620647 - DNA, 25 bp, Homo sapien
actttagtgcagtgagactcatatt

SEQ ID NO: 620648 - DNA, 25 bp, Homo sapien
ttagtgcagtgagactcatatttga

SEQ ID NO: 620649 - DNA, 25 bp, Homo sapien
gaatttctgaccttatattatagaa

SEQ ID NO: 620650 - DNA, 25 bp, Homo sapien
atttctgaccttatattatagaacc

SEQ ID NO: 620651 - DNA, 25 bp, Homo sapien
tagaaccataagacattatagaatt

SEQ ID NO: 620652 - DNA, 25 bp, Homo sapien
acatagggaaggatgctgagtggcc

SEQ ID NO: 620653 - DNA, 25 bp, Homo sapien
ctgagtggccttgaatggaaaggcc

SEQ ID NO: 620654 - DNA, 25 bp, Homo sapien
cttgaatggaaaggcctgagtgaag

SEQ ID NO: 620655 - DNA, 25 bp, Homo sapien
gggatcattgtcctggtggacttcc

SEQ ID NO: 620656 - DNA, 25 bp, Homo sapien
tggtggacttccttcacctgcaggc

SEQ ID NO: 620657 - DNA, 25 bp, Homo sapien
gggctcagagaacaagaatcagctt

SEQ ID NO: 620658 - DNA, 25 bp, Homo sapien
ggctcagagaacaagaatcagcttc

SEQ ID NO: 620659 - DNA, 25 bp, Homo sapien
gctcagagaacaagaatcagcttct

SEQ ID NO: 620660 - DNA, 25 bp, Homo sapien
agaacaagaatcagcttctcagcct

SEQ ID NO: 620661 - DNA, 25 bp, Homo sapien
gaacaagaatcagcttctcagcctg

SEQ ID NO: 620662 - DNA, 25 bp, Homo sapien
agaatcagcttctcagcctgagtaa

SEQ ID NO: 620663 - DNA, 25 bp, Homo sapien
gtttcccaaggaaattctgcatcat

SEQ ID NO: 620664 - DNA, 25 bp, Homo sapien
tctgcatcatgaacgaaaagccaag

SEQ ID NO: 620665 - DNA, 25 bp, Homo sapien
atcatgaacgaaaagccaagcaatt

SEQ ID NO: 620666 - DNA, 25 bp, Homo sapien
aaagccaagcaattatgccaagaaa

SEQ ID NO: 620667 - DNA, 25 bp, Homo sapien
aaccttcactgttacataaggtaca

SEQ ID NO: 620668 - DNA, 25 bp, Homo sapien
aaagcatcaagaattctgcctttta

SEQ ID NO: 620669 - DNA, 25 bp, Homo sapien
aagttttctcttcatgggataattt

SEQ ID NO: 620670 - DNA, 25 bp, Homo sapien
tctcttcatgggataatttagtact

SEQ ID NO: 620671 - DNA, 25 bp, Homo sapien
catgggataatttagtactgctttt

SEQ ID NO: 620672 - DNA, 25 bp, Homo sapien
aatttagtactgcttttatctatca

SEQ ID NO: 620673 - DNA, 25 bp, Homo sapien
gcttttatctatcatctgtcaattt

SEQ ID NO: 620674 - DNA, 25 bp, Homo sapien
gtgaattttcttctctgcaatcgac

SEQ ID NO: 620675 - DNA, 25 bp, Homo sapien
tctgcaatcgacaattccccaaatc

SEQ ID NO: 620676 - DNA, 25 bp, Homo sapien
tccccaaatcacatcaggtcattaa

SEQ ID NO: 620677 - DNA, 25 bp, Homo sapien
attcatccaatttactgagtgcctc

SEQ ID NO: 620678 - DNA, 25 bp, Homo sapien
accctggccctcaaggaatttctat

SEQ ID NO: 620679 - DNA, 25 bp, Homo sapien
ggccctcaaggaatttctattcttc

SEQ ID NO: 620680 - DNA, 25 bp, Homo sapien
ttctgggagcaggatatttacatgg

SEQ ID NO: 620681 - DNA, 25 bp, Homo sapien
ttacatgggtgactgcagcttgatc

SEQ ID NO: 620682 - DNA, 25 bp, Homo sapien
cagcttgatctgtgtggtactagtg

SEQ ID NO: 620683 - DNA, 25 bp, Homo sapien
gatctgtgtggtactagtgggaaac

SEQ ID NO: 620684 - DNA, 25 bp, Homo sapien
aggatgttgggcacaaaagagtcac

SEQ ID NO: 620685 - DNA, 25 bp, Homo sapien
taataattcaccactgaatgcacaa

SEQ ID NO: 620686 - DNA, 25 bp, Homo sapien
ttcaccactgaatgcacaattaaaa

SEQ ID NO: 620687 - DNA, 25 bp, Homo sapien
acaatgacctaaaatgttgtggaag

SEQ ID NO: 620688 - DNA, 25 bp, Homo sapien
aggtatgaagtttctgtaggcattc

SEQ ID NO: 620689 - DNA, 25 bp, Homo sapien
gaagtttctgtaggcattcaagata

SEQ ID NO: 620690 - DNA, 25 bp, Homo sapien
ctgtaggcattcaagataagttgtt

SEQ ID NO: 620691 - DNA, 25 bp, Homo sapien
ataagttgttatcagcctaaaatag

SEQ ID NO: 620692 - DNA, 25 bp, Homo sapien
gtaaaaacctttagcagatacagaa

SEQ ID NO: 620693 - DNA, 25 bp, Homo sapien
aacagaatcaaagcatatcaccaca

SEQ ID NO: 620694 - DNA, 25 bp, Homo sapien
aatcaaagcatatcaccacaaaggg

SEQ ID NO: 620695 - DNA, 25 bp, Homo sapien
accacaaagggttatcaattcacaa

SEQ ID NO: 620696 - DNA, 25 bp, Homo sapien
atgtggatgggaacacccaggccct

SEQ ID NO: 620697 - DNA, 25 bp, Homo sapien
ggagacaaagctgatgcatccctgt

SEQ ID NO: 620698 - DNA, 25 bp, Homo sapien
atgcatccctgttggatccccgcgt

SEQ ID NO: 620699 - DNA, 25 bp, Homo sapien
ggcatccgctcggtgtgtgtcagcc

SEQ ID NO: 620700 - DNA, 25 bp, Homo sapien
gtgtgtcagccccaatggacagcat

SEQ ID NO: 620701 - DNA, 25 bp, Homo sapien
agccccaatggacagcatctagcat

SEQ ID NO: 620702 - DNA, 25 bp, Homo sapien
caatggacagcatctagcatcaggg

SEQ ID NO: 620703 - DNA, 25 bp, Homo sapien
gaccgtatgggcacacttagggtgc

SEQ ID NO: 620704 - DNA, 25 bp, Homo sapien
acacttagggtgcacgaacttcagt

SEQ ID NO: 620705 - DNA, 25 bp, Homo sapien
ggtgcacgaacttcagtccctgagt

SEQ ID NO: 620706 - DNA, 25 bp, Homo sapien
acgaacttcagtccctgagtgagat

SEQ ID NO: 620707 - DNA, 25 bp, Homo sapien
cctgagccaccacgcagaagaggca

SEQ ID NO: 620708 - DNA, 25 bp, Homo sapien
tgagccaccacgcagaagaggcact

SEQ ID NO: 620709 - DNA, 25 bp, Homo sapien
agccaccacgcagaagaggcacttt

SEQ ID NO: 620710 - DNA, 25 bp, Homo sapien
gccaccacgcagaagaggcactttc

SEQ ID NO: 620711 - DNA, 25 bp, Homo sapien
aacaagctattgtttggctatacat

SEQ ID NO: 620712 - DNA, 25 bp, Homo sapien
aagctattgtttggctatacattgt

SEQ ID NO: 620713 - DNA, 25 bp, Homo sapien
tttgtatcacatattccaggaacta

SEQ ID NO: 620714 - DNA, 25 bp, Homo sapien
gtatcacatattccaggaactacag

SEQ ID NO: 620715 - DNA, 25 bp, Homo sapien
atcacatattccaggaactacagga

SEQ ID NO: 620716 - DNA, 25 bp, Homo sapien
aaaataatgggtgaggcagctagtt

SEQ ID NO: 620717 - DNA, 25 bp, Homo sapien
aataatgggtgaggcagctagttag

SEQ ID NO: 620718 - DNA, 25 bp, Homo sapien
aagctagctgattttacacgtttga

SEQ ID NO: 620719 - DNA, 25 bp, Homo sapien
agctgattttacacgtttgatttta

SEQ ID NO: 620720 - DNA, 25 bp, Homo sapien
ttacacgtttgattttatgattaca

SEQ ID NO: 620721 - DNA, 25 bp, Homo sapien
aaaaccgcaatgttacaggtctctc

SEQ ID NO: 620722 - DNA, 25 bp, Homo sapien
tcacacctttcactgtacttctgta

SEQ ID NO: 620723 - DNA, 25 bp, Homo sapien
acctttcactgtacttctgtaataa

SEQ ID NO: 620724 - DNA, 25 bp, Homo sapien
ttgattttgagttacgatgattgcg

SEQ ID NO: 620725 - DNA, 25 bp, Homo sapien
gatgattgcgtattccaggtacaac

SEQ ID NO: 620726 - DNA, 25 bp, Homo sapien
gcgtattccaggtacaacttaaatt

SEQ ID NO: 620727 - DNA, 25 bp, Homo sapien
ggtacaacttaaattgctgtaactg

SEQ ID NO: 620728 - DNA, 25 bp, Homo sapien
atgtaaacttaccttatagtatatg

SEQ ID NO: 620729 - DNA, 25 bp, Homo sapien
cacttcgggagtctgacacggggag

SEQ ID NO: 620730 - DNA, 25 bp, Homo sapien
acttcgggagtctgacacggggaga

SEQ ID NO: 620731 - DNA, 25 bp, Homo sapien
cttcgggagtctgacacggggagat

SEQ ID NO: 620732 - DNA, 25 bp, Homo sapien
ttcgggagtctgacacggggagatc

SEQ ID NO: 620733 - DNA, 25 bp, Homo sapien
tcgggagtctgacacggggagatca

SEQ ID NO: 620734 - DNA, 25 bp, Homo sapien
cgggagtctgacacggggagatcac

SEQ ID NO: 620735 - DNA, 25 bp, Homo sapien
gggagtctgacacggggagatcact

SEQ ID NO: 620736 - DNA, 25 bp, Homo sapien
ggagtctgacacggggagatcactt

SEQ ID NO: 620737 - DNA, 25 bp, Homo sapien
gagtctgacacggggagatcacttg

SEQ ID NO: 620738 - DNA, 25 bp, Homo sapien
agtctgacacggggagatcacttga

SEQ ID NO: 620739 - DNA, 25 bp, Homo sapien
gtgtgtttctgtcttagtgtttaag

SEQ ID NO: 620740 - DNA, 25 bp, Homo sapien
tgtttctgtcttagtgtttaaggga

SEQ ID NO: 620741 - DNA, 25 bp, Homo sapien
ttttatgcagctgtacaatgtattt

SEQ ID NO: 620742 - DNA, 25 bp, Homo sapien
gtatttgtgttgtgttaattacaaa

SEQ ID NO: 620743 - DNA, 25 bp, Homo sapien
aagtctgtaaaactcatgaacagtg

SEQ ID NO: 620744 - DNA, 25 bp, Homo sapien
aaactcatgaacagtggcatgcacc

SEQ ID NO: 620745 - DNA, 25 bp, Homo sapien
tatgattacacctgtggatagcccc

SEQ ID NO: 620746 - DNA, 25 bp, Homo sapien
atgattacacctgtggatagcccca

SEQ ID NO: 620747 - DNA, 25 bp, Homo sapien
gattacacctgtggatagccccact

SEQ ID NO: 620748 - DNA, 25 bp, Homo sapien
ttacacctgtggatagccccactgg

SEQ ID NO: 620749 - DNA, 25 bp, Homo sapien
acacctgtggatagccccactgggc

SEQ ID NO: 620750 - DNA, 25 bp, Homo sapien
gcaaatgatgtccactctcatcact

SEQ ID NO: 620751 - DNA, 25 bp, Homo sapien
tccactctcatcacttctattgaat

SEQ ID NO: 620752 - DNA, 25 bp, Homo sapien
actctcatcacttctattgaatata

SEQ ID NO: 620753 - DNA, 25 bp, Homo sapien
gaaagttctattcagagcaatcagg

SEQ ID NO: 620754 - DNA, 25 bp, Homo sapien
agttctattcagagcaatcaggaaa

SEQ ID NO: 620755 - DNA, 25 bp, Homo sapien
aaagcagtcatatagagaaggaagt

SEQ ID NO: 620756 - DNA, 25 bp, Homo sapien
gtagtaaaatgatctctgttctcag

SEQ ID NO: 620757 - DNA, 25 bp, Homo sapien
aaatgatctctgttctcagatgaca

SEQ ID NO: 620758 - DNA, 25 bp, Homo sapien
agaaactaatgatcacacacacaca

SEQ ID NO: 620759 - DNA, 25 bp, Homo sapien
acacaaccaaactatatgttgctta

SEQ ID NO: 620760 - DNA, 25 bp, Homo sapien
gagtgaaaaaggatataccctgaaa

SEQ ID NO: 620761 - DNA, 25 bp, Homo sapien
gaaagctacgtagtaatagttcaca

SEQ ID NO: 620762 - DNA, 25 bp, Homo sapien
catattaaatattctcattgacaga

SEQ ID NO: 620763 - DNA, 25 bp, Homo sapien
gcatgtgtgtgcttagtgatgtcct

SEQ ID NO: 620764 - DNA, 25 bp, Homo sapien
gtgtgcttagtgatgtccttccaaa

SEQ ID NO: 620765 - DNA, 25 bp, Homo sapien
gtgcttagtgatgtccttccaaatt

SEQ ID NO: 620766 - DNA, 25 bp, Homo sapien
agtgatgtccttccaaattaatttt

SEQ ID NO: 620767 - DNA, 25 bp, Homo sapien
aattttatcagttgtttatcttgga

SEQ ID NO: 620768 - DNA, 25 bp, Homo sapien
atcagttgtttatcttggatcataa

SEQ ID NO: 620769 - DNA, 25 bp, Homo sapien
agataaatattcatgggccagcttt

SEQ ID NO: 620770 - DNA, 25 bp, Homo sapien
ttcatgggccagctttcctttgaat

SEQ ID NO: 620771 - DNA, 25 bp, Homo sapien
ttcatgaaaaagtagttggctctct

SEQ ID NO: 620772 - DNA, 25 bp, Homo sapien
taaatgtgaattgccgcttactggt

SEQ ID NO: 620773 - DNA, 25 bp, Homo sapien
gaattgccgcttactggtgttataa

SEQ ID NO: 620774 - DNA, 25 bp, Homo sapien
actggtgttataacttctctgggta

SEQ ID NO: 620775 - DNA, 25 bp, Homo sapien
agaataattatatcttccccgccca

SEQ ID NO: 620776 - DNA, 25 bp, Homo sapien
acctcacaggcttgtttcagaaatc

SEQ ID NO: 620777 - DNA, 25 bp, Homo sapien
gctgaacatacgtaaggtggcatta

SEQ ID NO: 620778 - DNA, 25 bp, Homo sapien
tttgatttactaagccaatggacta

SEQ ID NO: 620779 - DNA, 25 bp, Homo sapien
gattaatttacttctatgttagggc

SEQ ID NO: 620780 - DNA, 25 bp, Homo sapien
tacttctatgttagggctatttccc

SEQ ID NO: 620781 - DNA, 25 bp, Homo sapien
gggctatttccctataatattgagc

SEQ ID NO: 620782 - DNA, 25 bp, Homo sapien
tttccctataatattgagccatttc

SEQ ID NO: 620783 - DNA, 25 bp, Homo sapien
gggtaattggcttctcagtcctgaa

SEQ ID NO: 620784 - DNA, 25 bp, Homo sapien
aattggcttctcagtcctgaaggac

SEQ ID NO: 620785 - DNA, 25 bp, Homo sapien
gaaggactatttgacaagccatatg

SEQ ID NO: 620786 - DNA, 25 bp, Homo sapien
attcaccagtttccaaaacccattg

SEQ ID NO: 620787 - DNA, 25 bp, Homo sapien
gtttccaaaacccattgatcaaagg

SEQ ID NO: 620788 - DNA, 25 bp, Homo sapien
gatcaaaggtcatgccccaagtgtt

SEQ ID NO: 620789 - DNA, 25 bp, Homo sapien
gtgccttccagcttatgcatatgtg

SEQ ID NO: 620790 - DNA, 25 bp, Homo sapien
atgcatatgtgagccctggtgggtt

SEQ ID NO: 620791 - DNA, 25 bp, Homo sapien
tggtgggtttccaggcacctggcac

SEQ ID NO: 620792 - DNA, 25 bp, Homo sapien
ggcatagtaagggtcagaggcatct

SEQ ID NO: 620793 - DNA, 25 bp, Homo sapien
ggaactgatgatccgcagcatcttg

SEQ ID NO: 620794 - DNA, 25 bp, Homo sapien
ccagcacttcgggagtctgacacgg

SEQ ID NO: 620795 - DNA, 25 bp, Homo sapien
cagcacttcgggagtctgacacggg

SEQ ID NO: 620796 - DNA, 25 bp, Homo sapien
cacttcgggagtctgacacggggag

SEQ ID NO: 620797 - DNA, 25 bp, Homo sapien
acttcgggagtctgacacggggaga

SEQ ID NO: 620798 - DNA, 25 bp, Homo sapien
ttcgggagtctgacacggggagatc

SEQ ID NO: 620799 - DNA, 25 bp, Homo sapien
gggagtctgacacggggagatcact

SEQ ID NO: 620800 - DNA, 25 bp, Homo sapien
ggagtctgacacggggagatcactt

SEQ ID NO: 620801 - DNA, 25 bp, Homo sapien
gagtctgacacggggagatcacttg

SEQ ID NO: 620802 - DNA, 25 bp, Homo sapien
agtctgacacggggagatcacttga

SEQ ID NO: 620803 - DNA, 25 bp, Homo sapien
gtagcagagcgtggtggtgcattcc

SEQ ID NO: 620804 - DNA, 25 bp, Homo sapien
aattgcttgaaccaaagaagtcaag

SEQ ID NO: 620805 - DNA, 25 bp, Homo sapien
ccctctctggaaatattttctcact

SEQ ID NO: 620806 - DNA, 25 bp, Homo sapien
ttttctcacttcctgtagtccataa

SEQ ID NO: 620807 - DNA, 25 bp, Homo sapien
cctgtagtccataagtgaggcctta

SEQ ID NO: 620808 - DNA, 25 bp, Homo sapien
cgcattaagaattttgcctccatta

SEQ ID NO: 620809 - DNA, 25 bp, Homo sapien
aattttgcctccattagatccatgc

SEQ ID NO: 620810 - DNA, 25 bp, Homo sapien
gcctccattagatccatgctactaa

SEQ ID NO: 620811 - DNA, 25 bp, Homo sapien
tgagtcaaatatacagcctgtaggt

SEQ ID NO: 620812 - DNA, 25 bp, Homo sapien
acagcctgtaggttgaagtataatc

SEQ ID NO: 620813 - DNA, 25 bp, Homo sapien
aatcattacatctcgcttaaggcaa

SEQ ID NO: 620814 - DNA, 25 bp, Homo sapien
aaaatcacttgcttatttccagaag

SEQ ID NO: 620815 - DNA, 25 bp, Homo sapien
gccaatagcttaaatcaaattcctt

SEQ ID NO: 620816 - DNA, 25 bp, Homo sapien
ctggttcaatcttgggagattgtgt

SEQ ID NO: 620817 - DNA, 25 bp, Homo sapien
ggagattgtgtgtttccaggaattt

SEQ ID NO: 620818 - DNA, 25 bp, Homo sapien
aggaatttagccgtttcctccagat

SEQ ID NO: 620819 - DNA, 25 bp, Homo sapien
ttagccgtttcctccagattttctt

SEQ ID NO: 620820 - DNA, 25 bp, Homo sapien
gtttcctccagattttcttctttat

SEQ ID NO: 620821 - DNA, 25 bp, Homo sapien
gattttcttctttatgtgcatcgac

SEQ ID NO: 620822 - DNA, 25 bp, Homo sapien
ttcttctttatgtgcatcgacttga

SEQ ID NO: 620823 - DNA, 25 bp, Homo sapien
ctttatgtgcatcgacttgagtgta

SEQ ID NO: 620824 - DNA, 25 bp, Homo sapien
gtgcatcgacttgagtgtaaacata

SEQ ID NO: 620825 - DNA, 25 bp, Homo sapien
ttggtagtctggaactgaacctgca

SEQ ID NO: 620826 - DNA, 25 bp, Homo sapien
tgaacctgcaatatcaccaaagtat

SEQ ID NO: 620827 - DNA, 25 bp, Homo sapien
tgtttcctttgctgttaaataccag

SEQ ID NO: 620828 - DNA, 25 bp, Homo sapien
gtttcctttgctgttaaataccaga

SEQ ID NO: 620829 - DNA, 25 bp, Homo sapien
tttcctttgctgttaaataccagag

SEQ ID NO: 620830 - DNA, 25 bp, Homo sapien
ttcctttgctgttaaataccagaga

SEQ ID NO: 620831 - DNA, 25 bp, Homo sapien
tcctttgctgttaaataccagagag

SEQ ID NO: 620832 - DNA, 25 bp, Homo sapien
cctttgctgttaaataccagagagg

SEQ ID NO: 620833 - DNA, 25 bp, Homo sapien
ctttgctgttaaataccagagaggg

SEQ ID NO: 620834 - DNA, 25 bp, Homo sapien
taaataccagagaggggccgggcac

SEQ ID NO: 620835 - DNA, 25 bp, Homo sapien
ctaacagtgaaacccatcgctacta

SEQ ID NO: 620836 - DNA, 25 bp, Homo sapien
gcctgaacccacgaggtggaggact

SEQ ID NO: 620837 - DNA, 25 bp, Homo sapien
aacccacgaggtggaggactgcagt

SEQ ID NO: 620838 - DNA, 25 bp, Homo sapien
tccactcttgtgttcctaaccctga

SEQ ID NO: 620839 - DNA, 25 bp, Homo sapien
taaccctgatcctgaccctaggtca

SEQ ID NO: 620840 - DNA, 25 bp, Homo sapien
tgaccctaggtcaaccagattctct

SEQ ID NO: 620841 - DNA, 25 bp, Homo sapien
ggtcaaccagattctctttctcagg

SEQ ID NO: 620842 - DNA, 25 bp, Homo sapien
aggaatgttaaatctgtatagcgag

SEQ ID NO: 620843 - DNA, 25 bp, Homo sapien
gtatagcgagacttagcagggtaaa

SEQ ID NO: 620844 - DNA, 25 bp, Homo sapien
tggtgacaggagctgtatagtccaa

SEQ ID NO: 620845 - DNA, 25 bp, Homo sapien
gtatagtccaacagtactacccttg

SEQ ID NO: 620846 - DNA, 25 bp, Homo sapien
gtactacccttgaaaaactgtctgt

SEQ ID NO: 620847 - DNA, 25 bp, Homo sapien
aactgtctgtgaattactacttctg

SEQ ID NO: 620848 - DNA, 25 bp, Homo sapien
gggaacaacaaaatccagttctgat

SEQ ID NO: 620849 - DNA, 25 bp, Homo sapien
ttcctggtactggagcttgagctct

SEQ ID NO: 620850 - DNA, 25 bp, Homo sapien
tggtactggagcttgagctcttgcc

SEQ ID NO: 620851 - DNA, 25 bp, Homo sapien
tggagcttgagctcttgcctggaac

SEQ ID NO: 620852 - DNA, 25 bp, Homo sapien
gagcttgagctcttgcctggaacgc

SEQ ID NO: 620853 - DNA, 25 bp, Homo sapien
tgagctcttgcctggaacgctgcag

SEQ ID NO: 620854 - DNA, 25 bp, Homo sapien
accctgcttgatcccacctgggagg

SEQ ID NO: 620855 - DNA, 25 bp, Homo sapien
atcccacctgggaggccaggacact

SEQ ID NO: 620856 - DNA, 25 bp, Homo sapien
gcgtgcacccagacgctggtgccat

SEQ ID NO: 620857 - DNA, 25 bp, Homo sapien
acacctcagtgacaaacacaccttt

SEQ ID NO: 620858 - DNA, 25 bp, Homo sapien
gtgacaaacacacctttttatacca

SEQ ID NO: 620859 - DNA, 25 bp, Homo sapien
aaacacacctttttataccaatcag

SEQ ID NO: 620860 - DNA, 25 bp, Homo sapien
gtaatattgccgttctgctgatttt

SEQ ID NO: 620861 - DNA, 25 bp, Homo sapien
tgttctgaaactttccgtgacctaa

SEQ ID NO: 620862 - DNA, 25 bp, Homo sapien
gttctgaaactttccgtgacctaat

SEQ ID NO: 620863 - DNA, 25 bp, Homo sapien
ttctgaaactttccgtgacctaata

SEQ ID NO: 620864 - DNA, 25 bp, Homo sapien
gaaactttccgtgacctaataccat

SEQ ID NO: 620865 - DNA, 25 bp, Homo sapien
aaactttccgtgacctaataccatg

SEQ ID NO: 620866 - DNA, 25 bp, Homo sapien
aactttccgtgacctaataccatgc

SEQ ID NO: 620867 - DNA, 25 bp, Homo sapien
ctttccgtgacctaataccatgcat

SEQ ID NO: 620868 - DNA, 25 bp, Homo sapien
tttccgtgacctaataccatgcatc

SEQ ID NO: 620869 - DNA, 25 bp, Homo sapien
ttccgtgacctaataccatgcatcc

SEQ ID NO: 620870 - DNA, 25 bp, Homo sapien
gtgggttttgaatcgggatgttaga

SEQ ID NO: 620871 - DNA, 25 bp, Homo sapien
gagctgttgggagcagattcaagcc

SEQ ID NO: 620872 - DNA, 25 bp, Homo sapien
ttgggagcagattcaagccgtgtca

SEQ ID NO: 620873 - DNA, 25 bp, Homo sapien
tcaagccgtgtcactctgaagaagt

SEQ ID NO: 620874 - DNA, 25 bp, Homo sapien
gaagaagtgcaggtgtgaacgtcat

SEQ ID NO: 620875 - DNA, 25 bp, Homo sapien
aggtgtgaacgtcatgacctgctcc

SEQ ID NO: 620876 - DNA, 25 bp, Homo sapien
gtgaacgtcatgacctgctccagca

SEQ ID NO: 620877 - DNA, 25 bp, Homo sapien
gaggccaagagcattgccgggacca

SEQ ID NO: 620878 - DNA, 25 bp, Homo sapien
attgccgggaccaagtcccaccagg

SEQ ID NO: 620879 - DNA, 25 bp, Homo sapien
ggccatcgtgccagtcagagggcat

SEQ ID NO: 620880 - DNA, 25 bp, Homo sapien
gtgccagtcagagggcatcatctca

SEQ ID NO: 620881 - DNA, 25 bp, Homo sapien
gctgccactgcagacaagtagaaca

SEQ ID NO: 620882 - DNA, 25 bp, Homo sapien
agatgcccacatcctgtgggagtga

SEQ ID NO: 620883 - DNA, 25 bp, Homo sapien
atgtgctatagcatcctcagctgga

SEQ ID NO: 620884 - DNA, 25 bp, Homo sapien
tcctcagctggatgctaggagacta

SEQ ID NO: 620885 - DNA, 25 bp, Homo sapien
gatgctagtggaatcccactgccag

SEQ ID NO: 620886 - DNA, 25 bp, Homo sapien
agaccctggttccttgtgtcttcca

SEQ ID NO: 620887 - DNA, 25 bp, Homo sapien
gcctgctctgtggtttactttgcaa

SEQ ID NO: 620888 - DNA, 25 bp, Homo sapien
aacccacacttaccttcagaaaatg

SEQ ID NO: 620889 - DNA, 25 bp, Homo sapien
aaatgagaatactctctcctcctga

SEQ ID NO: 620890 - DNA, 25 bp, Homo sapien
tcaagaccttgtgaaggcgctcgaa

SEQ ID NO: 620891 - DNA, 25 bp, Homo sapien
ggcgctcgaagaataggttcatcca

SEQ ID NO: 620892 - DNA, 25 bp, Homo sapien
ggttcatccactggtaacactcaag

SEQ ID NO: 620893 - DNA, 25 bp, Homo sapien
ttttttctcagctggccataaccta

SEQ ID NO: 620894 - DNA, 25 bp, Homo sapien
agctggccataacctatgctgttta

SEQ ID NO: 620895 - DNA, 25 bp, Homo sapien
tggccataacctatgctgtttaaaa

SEQ ID NO: 620896 - DNA, 25 bp, Homo sapien
aatgtgattgtgtgggattcctttt

SEQ ID NO: 620897 - DNA, 25 bp, Homo sapien
tgattgtgtgggattcctttttatt

SEQ ID NO: 620898 - DNA, 25 bp, Homo sapien
catgagtctaagaaggcttgtcagt

SEQ ID NO: 620899 - DNA, 25 bp, Homo sapien
agaaggcttgtcagtgatacccact

SEQ ID NO: 620900 - DNA, 25 bp, Homo sapien
aaggcttgtcagtgatacccactcc

SEQ ID NO: 620901 - DNA, 25 bp, Homo sapien
ttgtcagtgatacccactccccgtt

SEQ ID NO: 620902 - DNA, 25 bp, Homo sapien
gttaccaccacccaaaaatcatatg

SEQ ID NO: 620903 - DNA, 25 bp, Homo sapien
atctgtatgtatttgggccagggac

SEQ ID NO: 620904 - DNA, 25 bp, Homo sapien
tcttctgaccatttacactgagctt

SEQ ID NO: 620905 - DNA, 25 bp, Homo sapien
ctgaccatttacactgagcttcttt

SEQ ID NO: 620906 - DNA, 25 bp, Homo sapien
gagcttctttcattatctcatatgc

SEQ ID NO: 620907 - DNA, 25 bp, Homo sapien
attatctcatatgcaaccttgtgga

SEQ ID NO: 620908 - DNA, 25 bp, Homo sapien
tcatatgcaaccttgtggattgaag

SEQ ID NO: 620909 - DNA, 25 bp, Homo sapien
gagagtccttaggattacccaggaa

SEQ ID NO: 620910 - DNA, 25 bp, Homo sapien
gattacccaggaacatccctgtctg

SEQ ID NO: 620911 - DNA, 25 bp, Homo sapien
gaaaccacatgtgtctacttcattt

SEQ ID NO: 620912 - DNA, 25 bp, Homo sapien
gtctacttcatttctgtcacgggta

SEQ ID NO: 620913 - DNA, 25 bp, Homo sapien
acttcatttctgtcacgggtaggac

SEQ ID NO: 620914 - DNA, 25 bp, Homo sapien
cgggtaggacagtgtcatatacttt

SEQ ID NO: 620915 - DNA, 25 bp, Homo sapien
gtgcccagccattactacaataatt

SEQ ID NO: 620916 - DNA, 25 bp, Homo sapien
aaactaatatgagaagcgggaaaat

SEQ ID NO: 620917 - DNA, 25 bp, Homo sapien
gaaaatggctgtggttgaatgacat

SEQ ID NO: 620918 - DNA, 25 bp, Homo sapien
gttgaatgacatgattgaccaggat

SEQ ID NO: 620919 - DNA, 25 bp, Homo sapien
gacatgattgaccaggattagacaa

SEQ ID NO: 620920 - DNA, 25 bp, Homo sapien
accaggattagacaattgttggatc

SEQ ID NO: 620921 - DNA, 25 bp, Homo sapien
acaattgttggatcagagtactggg

SEQ ID NO: 620922 - DNA, 25 bp, Homo sapien
gagtactgggtacatgaaggtcatt

SEQ ID NO: 620923 - DNA, 25 bp, Homo sapien
ttattatattctgcttacttttttg

SEQ ID NO: 620924 - DNA, 25 bp, Homo sapien
gcttacttttttgtatgctcaattt

SEQ ID NO: 620925 - DNA, 25 bp, Homo sapien
cttttttgtatgctcaatttttcat

SEQ ID NO: 620926 - DNA, 25 bp, Homo sapien
ttgcacttttttgttctcatcagta

SEQ ID NO: 620927 - DNA, 25 bp, Homo sapien
ttttgttctcatcagtatccataat

SEQ ID NO: 620928 - DNA, 25 bp, Homo sapien
gtatccataatgaagcactaagcat

SEQ ID NO: 620929 - DNA, 25 bp, Homo sapien
aagcatgtaacattttgcagattga

SEQ ID NO: 620930 - DNA, 25 bp, Homo sapien
gcagattgagatttcccagtcacca

SEQ ID NO: 620931 - DNA, 25 bp, Homo sapien
ttgagatttcccagtcaccatgcac

SEQ ID NO: 620932 - DNA, 25 bp, Homo sapien
aaacaagcagtaacagagtgtggaa

SEQ ID NO: 620933 - DNA, 25 bp, Homo sapien
ggaagtacaacctctcctctgttta

SEQ ID NO: 620934 - DNA, 25 bp, Homo sapien
aacctctcctctgtttaacactgaa

SEQ ID NO: 620935 - DNA, 25 bp, Homo sapien
gtttaacactgaacaaaatctttgg

SEQ ID NO: 620936 - DNA, 25 bp, Homo sapien
atctttgggagagtataatgttata

SEQ ID NO: 620937 - DNA, 25 bp, Homo sapien
acattaattccacttcacatattga

SEQ ID NO: 620938 - DNA, 25 bp, Homo sapien
ttcacatattgaaagtctaacatac

SEQ ID NO: 620939 - DNA, 25 bp, Homo sapien
aagagattaaatatctcctttcttt

SEQ ID NO: 620940 - DNA, 25 bp, Homo sapien
gccaaatgttaatgaattgtcttat

SEQ ID NO: 620941 - DNA, 25 bp, Homo sapien
aagatatgatactttctcccaagct

SEQ ID NO: 620942 - DNA, 25 bp, Homo sapien
atactttctcccaagctatactgtt

SEQ ID NO: 620943 - DNA, 25 bp, Homo sapien
agctatactgtttcccataaagtat

SEQ ID NO: 620944 - DNA, 25 bp, Homo sapien
ctgtttcccataaagtatttgagat

SEQ ID NO: 620945 - DNA, 25 bp, Homo sapien
aagtgacacttgtatgttaatccta

SEQ ID NO: 620946 - DNA, 25 bp, Homo sapien
atgttaatcctataaattggtttct

SEQ ID NO: 620947 - DNA, 25 bp, Homo sapien
attggtttcttgtaccatgtaggat

SEQ ID NO: 620948 - DNA, 25 bp, Homo sapien
gcagagtgattgaactccaatttca

SEQ ID NO: 620949 - DNA, 25 bp, Homo sapien
agcagcaagcaggataccataaaag

SEQ ID NO: 620950 - DNA, 25 bp, Homo sapien
taccataaaagcatcagagtatctg

SEQ ID NO: 620951 - DNA, 25 bp, Homo sapien
aagtcagaattgttatacctggaac

SEQ ID NO: 620952 - DNA, 25 bp, Homo sapien
atacctggaacaatggatgctgaga

SEQ ID NO: 620953 - DNA, 25 bp, Homo sapien
aacaatggatgctgagagcctatca

SEQ ID NO: 620954 - DNA, 25 bp, Homo sapien
gagcctatcagaattcttctagctg

SEQ ID NO: 620955 - DNA, 25 bp, Homo sapien
agaattcttctagctgagtgcagtg

SEQ ID NO: 620956 - DNA, 25 bp, Homo sapien
acccagcctgtgctgagcattttaa

SEQ ID NO: 620957 - DNA, 25 bp, Homo sapien
ttaaaaggaaaacccatcatgggca

SEQ ID NO: 620958 - DNA, 25 bp, Homo sapien
cccatcatgggcaggaaagagaaaa

SEQ ID NO: 620959 - DNA, 25 bp, Homo sapien
tatgctttaacgtgcaggcgtgaaa

SEQ ID NO: 620960 - DNA, 25 bp, Homo sapien
ggcgtgaaacaccatggcagaacca

SEQ ID NO: 620961 - DNA, 25 bp, Homo sapien
atggcagaaccaccactagatctca

SEQ ID NO: 620962 - DNA, 25 bp, Homo sapien
aaccaccactagatctcagaggctg

SEQ ID NO: 620963 - DNA, 25 bp, Homo sapien
ctcagaggctgtagtgggaaagatt

SEQ ID NO: 620964 - DNA, 25 bp, Homo sapien
gcatgttcagcataaaataagccca

SEQ ID NO: 620965 - DNA, 25 bp, Homo sapien
aagcccattttatttcactaagaag

SEQ ID NO: 620966 - DNA, 25 bp, Homo sapien
actaagaagctctcatttctgcata

SEQ ID NO: 620967 - DNA, 25 bp, Homo sapien
tagagccaaagaaagccctgttact

SEQ ID NO: 620968 - DNA, 25 bp, Homo sapien
agccctgttactgtatttcctttgt

SEQ ID NO: 620969 - DNA, 25 bp, Homo sapien
ttcctttgtgtttattcatgcatat

SEQ ID NO: 620970 - DNA, 25 bp, Homo sapien
gaatcaaaaaccagcttgcattgtt

SEQ ID NO: 620971 - DNA, 25 bp, Homo sapien
acaagttaatcatccataagaataa

SEQ ID NO: 620972 - DNA, 25 bp, Homo sapien
taactctaatatactgagactcatc

SEQ ID NO: 620973 - DNA, 25 bp, Homo sapien
tactgagactcatcaaatatgtttc

SEQ ID NO: 620974 - DNA, 25 bp, Homo sapien
atgtttcatctgtgagtttataaat

SEQ ID NO: 620975 - DNA, 25 bp, Homo sapien
tctgtgagtttataaatgatgctaa

SEQ ID NO: 620976 - DNA, 25 bp, Homo sapien
gatgtaattgatcgtttttggagga

SEQ ID NO: 620977 - DNA, 25 bp, Homo sapien
tcgtttttggaggattgtagtgcac

SEQ ID NO: 620978 - DNA, 25 bp, Homo sapien
ggaggattgtagtgcaccaatttat

SEQ ID NO: 620979 - DNA, 25 bp, Homo sapien
tgtagtgcaccaatttattattttg

SEQ ID NO: 620980 - DNA, 25 bp, Homo sapien
attattttgcaaactggcaggtaat

SEQ ID NO: 620981 - DNA, 25 bp, Homo sapien
gaaagatgctgccaggtgtagtggc

SEQ ID NO: 620982 - DNA, 25 bp, Homo sapien
gagttcagcttggaattaccagctt

SEQ ID NO: 620983 - DNA, 25 bp, Homo sapien
agttcagcttggaattaccagcttg

SEQ ID NO: 620984 - DNA, 25 bp, Homo sapien
gttcagcttggaattaccagcttgg

SEQ ID NO: 620985 - DNA, 25 bp, Homo sapien
ttcagcttggaattaccagcttggc

SEQ ID NO: 620986 - DNA, 25 bp, Homo sapien
tcagcttggaattaccagcttggcc

SEQ ID NO: 620987 - DNA, 25 bp, Homo sapien
cagcttggaattaccagcttggccg

SEQ ID NO: 620988 - DNA, 25 bp, Homo sapien
agcttggaattaccagcttggccga

SEQ ID NO: 620989 - DNA, 25 bp, Homo sapien
gcttggaattaccagcttggccgac

SEQ ID NO: 620990 - DNA, 25 bp, Homo sapien
agttctctctctgagaagcatagta

SEQ ID NO: 620991 - DNA, 25 bp, Homo sapien
aagcatagtagatttcacagaacag

SEQ ID NO: 620992 - DNA, 25 bp, Homo sapien
gtagatttcacagaacagtttttga

SEQ ID NO: 620993 - DNA, 25 bp, Homo sapien
tatttccacaaagatgttattgcag

SEQ ID NO: 620994 - DNA, 25 bp, Homo sapien
attgcagagatgaggtgagtatact

SEQ ID NO: 620995 - DNA, 25 bp, Homo sapien
gagtatacttttgctttgtgtcata

SEQ ID NO: 620996 - DNA, 25 bp, Homo sapien
ttgtgtcatatatgcagttgcgata

SEQ ID NO: 620997 - DNA, 25 bp, Homo sapien
tatgcagttgcgatatatctcaaac

SEQ ID NO: 620998 - DNA, 25 bp, Homo sapien
ttttctggagtatagacatgtcaaa

SEQ ID NO: 620999 - DNA, 25 bp, Homo sapien
acagtatttgtatctaatacctttg

SEQ ID NO: 621000 - DNA, 25 bp, Homo sapien
atacctttgaaagatctttgatgta

SEQ ID NO: 621001 - DNA, 25 bp, Homo sapien
tcttatcactctctattcttctgtg

SEQ ID NO: 621002 - DNA, 25 bp, Homo sapien
tcactctctattcttctgtgttttc

SEQ ID NO: 621003 - DNA, 25 bp, Homo sapien
acggatgcttcctatatttattgaa

SEQ ID NO: 621004 - DNA, 25 bp, Homo sapien
aatatctagtgcagatttgctggta

SEQ ID NO: 621005 - DNA, 25 bp, Homo sapien
gcagatttgctggtagtatctttaa

SEQ ID NO: 621006 - DNA, 25 bp, Homo sapien
tcaagctttttgaaagacaacccta

SEQ ID NO: 621007 - DNA, 25 bp, Homo sapien
ctttctgtgtggttattctgtatct

SEQ ID NO: 621008 - DNA, 25 bp, Homo sapien
gtggttattctgtatctttgttata

SEQ ID NO: 621009 - DNA, 25 bp, Homo sapien
agaatttatatcctgactatcttaa

SEQ ID NO: 621010 - DNA, 25 bp, Homo sapien
tcctgactatcttaatggcaacatt

SEQ ID NO: 621011 - DNA, 25 bp, Homo sapien
ggcaacatttggctcttttaagaca

SEQ ID NO: 621012 - DNA, 25 bp, Homo sapien
gtgatcaagttaagggtttctaaat

SEQ ID NO: 621013 - DNA, 25 bp, Homo sapien
gggtttctaaatacaatcacataag

SEQ ID NO: 621014 - DNA, 25 bp, Homo sapien
tacaatcacataagagggaggcaga

SEQ ID NO: 621015 - DNA, 25 bp, Homo sapien
gaaaagaaaagaccacgtgaccata

SEQ ID NO: 621016 - DNA, 25 bp, Homo sapien
gaccacgtgaccatagaggcagaga

SEQ ID NO: 621017 - DNA, 25 bp, Homo sapien
gacaaggaccagattctcccttaga

SEQ ID NO: 621018 - DNA, 25 bp, Homo sapien
accagattctcccttagagcctctg

SEQ ID NO: 621019 - DNA, 25 bp, Homo sapien
cagtgatactggctttagacgtcta

SEQ ID NO: 621020 - DNA, 25 bp, Homo sapien
ggctttagacgtctagcctccagat

SEQ ID NO: 621021 - DNA, 25 bp, Homo sapien
tagacgtctagcctccagatccgtg

SEQ ID NO: 621022 - DNA, 25 bp, Homo sapien
ctccagatccgtgagagaatacatt

SEQ ID NO: 621023 - DNA, 25 bp, Homo sapien
ataatattatgcgtcctggctagtc

SEQ ID NO: 621024 - DNA, 25 bp, Homo sapien
atattatgcgtcctggctagtctca

SEQ ID NO: 621025 - DNA, 25 bp, Homo sapien
ctggctagtctcactacagcttaat

SEQ ID NO: 621026 - DNA, 25 bp, Homo sapien
cactacagcttaatgaggttatttc

SEQ ID NO: 621027 - DNA, 25 bp, Homo sapien
ggttatttctaagaaatcctttcat

SEQ ID NO: 621028 - DNA, 25 bp, Homo sapien
aaaagccctccatgcctactttgtg

SEQ ID NO: 621029 - DNA, 25 bp, Homo sapien
cctccatgcctactttgtgagtcat

SEQ ID NO: 621030 - DNA, 25 bp, Homo sapien
tttctgtgtgtctctattatcagca

SEQ ID NO: 621031 - DNA, 25 bp, Homo sapien
gtgtgtctctattatcagcattaaa

SEQ ID NO: 621032 - DNA, 25 bp, Homo sapien
aaaaaattattctcccagctctcag

SEQ ID NO: 621033 - DNA, 25 bp, Homo sapien
agctctcagcccaagttgatttcta

SEQ ID NO: 621034 - DNA, 25 bp, Homo sapien
tccagtactggcctttgatttatga

SEQ ID NO: 621035 - DNA, 25 bp, Homo sapien
ttgatttatgagatgtcccctgtct

SEQ ID NO: 621036 - DNA, 25 bp, Homo sapien
gacctcccaggatggcatttggtga

SEQ ID NO: 621037 - DNA, 25 bp, Homo sapien
tcttgatgttctcttgctttggcat

SEQ ID NO: 621038 - DNA, 25 bp, Homo sapien
gagtgtcatttccagatcttttcca

SEQ ID NO: 621039 - DNA, 25 bp, Homo sapien
gatcttttccagacctgtgcaattc

SEQ ID NO: 621040 - DNA, 25 bp, Homo sapien
tgtgcaattctttccattcttcata

SEQ ID NO: 621041 - DNA, 25 bp, Homo sapien
attcttcataacagcccatgaccca

SEQ ID NO: 621042 - DNA, 25 bp, Homo sapien
tcctctgtttcagccacaaagctag

SEQ ID NO: 621043 - DNA, 25 bp, Homo sapien
aaagctagccatgcctgtgtgcgca

SEQ ID NO: 621044 - DNA, 25 bp, Homo sapien
tgtgtgcgcactgctgtttctcatt

SEQ ID NO: 621045 - DNA, 25 bp, Homo sapien
tgtgtgtccagagaggtggctgcag

SEQ ID NO: 621046 - DNA, 25 bp, Homo sapien
ggattggcaaggcagtatttcagcc

SEQ ID NO: 621047 - DNA, 25 bp, Homo sapien
ggcaaggcagtatttcagccacatt

SEQ ID NO: 621048 - DNA, 25 bp, Homo sapien
ggcagtatttcagccacattgggtg

SEQ ID NO: 621049 - DNA, 25 bp, Homo sapien
tttcagccacattgggtgggatcca

SEQ ID NO: 621050 - DNA, 25 bp, Homo sapien
cacattgggtgggatccagagacct

SEQ ID NO: 621051 - DNA, 25 bp, Homo sapien
cctgaggacacagagtgacatgttc

SEQ ID NO: 621052 - DNA, 25 bp, Homo sapien
aggacacagagtgacatgttctggg

SEQ ID NO: 621053 - DNA, 25 bp, Homo sapien
tgttctggggtcctaactggcacaa

SEQ ID NO: 621054 - DNA, 25 bp, Homo sapien
ggggtcctaactggcacaaagacta

SEQ ID NO: 621055 - DNA, 25 bp, Homo sapien
acaaagactagaggagcccggccgg

SEQ ID NO: 621056 - DNA, 25 bp, Homo sapien
attattagaacttaacgtggccatg

SEQ ID NO: 621057 - DNA, 25 bp, Homo sapien
ttattagaacttaacgtggccatgc

SEQ ID NO: 621058 - DNA, 25 bp, Homo sapien
tattagaacttaacgtggccatgca

SEQ ID NO: 621059 - DNA, 25 bp, Homo sapien
attagaacttaacgtggccatgcat

SEQ ID NO: 621060 - DNA, 25 bp, Homo sapien
ttagaacttaacgtggccatgcatg

SEQ ID NO: 621061 - DNA, 25 bp, Homo sapien
tagaacttaacgtggccatgcatga

SEQ ID NO: 621062 - DNA, 25 bp, Homo sapien
agaacttaacgtggccatgcatgat

SEQ ID NO: 621063 - DNA, 25 bp, Homo sapien
acttaacgtggccatgcatgatggc

SEQ ID NO: 621064 - DNA, 25 bp, Homo sapien
ttaacgtggccatgcatgatggctt

SEQ ID NO: 621065 - DNA, 25 bp, Homo sapien
aacgtggccatgcatgatggcttac

SEQ ID NO: 621066 - DNA, 25 bp, Homo sapien
acgtggccatgcatgatggcttaca

SEQ ID NO: 621067 - DNA, 25 bp, Homo sapien
gtcctttgaattgtgttgagatttg

SEQ ID NO: 621068 - DNA, 25 bp, Homo sapien
atggcccagcatgtgtttaacctta

SEQ ID NO: 621069 - DNA, 25 bp, Homo sapien
aaccttagtgaagatttgtgggcac

SEQ ID NO: 621070 - DNA, 25 bp, Homo sapien
gaatgcatgttctgcagatgccgca

SEQ ID NO: 621071 - DNA, 25 bp, Homo sapien
agatgccgcatgcagtcatctacat

SEQ ID NO: 621072 - DNA, 25 bp, Homo sapien
gcagtcatctacataaagccattag

SEQ ID NO: 621073 - DNA, 25 bp, Homo sapien
atacgttgttcatatcttctctgct

SEQ ID NO: 621074 - DNA, 25 bp, Homo sapien
tcatatcttctctgctcttaatgaa

SEQ ID NO: 621075 - DNA, 25 bp, Homo sapien
gacaattgttgagttatctctactt

SEQ ID NO: 621076 - DNA, 25 bp, Homo sapien
tctctacttagatatagttctgtga

SEQ ID NO: 621077 - DNA, 25 bp, Homo sapien
agttctgtgaactttgctttatata

SEQ ID NO: 621078 - DNA, 25 bp, Homo sapien
cctgtcctactgcaggacactgagg

SEQ ID NO: 621079 - DNA, 25 bp, Homo sapien
gacactgagggcttggctgcctgcc

SEQ ID NO: 621080 - DNA, 25 bp, Homo sapien
tgagggcttggctgcctgccaccgc

SEQ ID NO: 621081 - DNA, 25 bp, Homo sapien
tctctccctgttctctgggcctgag

SEQ ID NO: 621082 - DNA, 25 bp, Homo sapien
caagtgccgacttgtttctcccaga

SEQ ID NO: 621083 - DNA, 25 bp, Homo sapien
gttcctcgtccgtttactgccgcag

SEQ ID NO: 621084 - DNA, 25 bp, Homo sapien
agcccctcctggttcttctggtgct

SEQ ID NO: 621085 - DNA, 25 bp, Homo sapien
ccctcctggttcttctggtgctggg

SEQ ID NO: 621086 - DNA, 25 bp, Homo sapien
ctcctgcaggctcattgccactttt

SEQ ID NO: 621087 - DNA, 25 bp, Homo sapien
attgccacttttgtagagaatgttc

SEQ ID NO: 621088 - DNA, 25 bp, Homo sapien
gccacttttgtagagaatgttctct

SEQ ID NO: 621089 - DNA, 25 bp, Homo sapien
ttgaaacaggagcatactctgtcac

SEQ ID NO: 621090 - DNA, 25 bp, Homo sapien
tgaaacaggagcatactctgtcacc

SEQ ID NO: 621091 - DNA, 25 bp, Homo sapien
gaaacaggagcatactctgtcaccc

SEQ ID NO: 621092 - DNA, 25 bp, Homo sapien
aaacaggagcatactctgtcaccca

SEQ ID NO: 621093 - DNA, 25 bp, Homo sapien
aacaggagcatactctgtcacccag

SEQ ID NO: 621094 - DNA, 25 bp, Homo sapien
caggctaaaatgcagtggcaccatc

SEQ ID NO: 621095 - DNA, 25 bp, Homo sapien
tctcaggttcaagtggtcctcctac

SEQ ID NO: 621096 - DNA, 25 bp, Homo sapien
ctcaggttcaagtggtcctcctacc

SEQ ID NO: 621097 - DNA, 25 bp, Homo sapien
tcaggttcaagtggtcctcctacct

SEQ ID NO: 621098 - DNA, 25 bp, Homo sapien
accatgcttggataatttttaattt

SEQ ID NO: 621099 - DNA, 25 bp, Homo sapien
ccatgcttggataatttttaatttt

SEQ ID NO: 621100 - DNA, 25 bp, Homo sapien
agcgtgcaagtgacaaagtgctcaa

SEQ ID NO: 621101 - DNA, 25 bp, Homo sapien
agtgctcaacttagactctgggcaa

SEQ ID NO: 621102 - DNA, 25 bp, Homo sapien
ggcaaaattctcacaaagggctttc

SEQ ID NO: 621103 - DNA, 25 bp, Homo sapien
aagggctttctaatcctcacttaat

SEQ ID NO: 621104 - DNA, 25 bp, Homo sapien
aagttgtggcttgcttcaccaggtc

SEQ ID NO: 621105 - DNA, 25 bp, Homo sapien
tcaccaggtctgctcaggtcagcgg

SEQ ID NO: 621106 - DNA, 25 bp, Homo sapien
cctacggccaggatgggtggtaatt

SEQ ID NO: 621107 - DNA, 25 bp, Homo sapien
ggaatacttggccagtctgcagacc

SEQ ID NO: 621108 - DNA, 25 bp, Homo sapien
tgcagacctcagaccacaaaaaacc

SEQ ID NO: 621109 - DNA, 25 bp, Homo sapien
atcctcaagcagtctcttctttatg

SEQ ID NO: 621110 - DNA, 25 bp, Homo sapien
agtctcttctttatgcctcgcaagg

SEQ ID NO: 621111 - DNA, 25 bp, Homo sapien
ctgacctggctaccgagcttggcag

SEQ ID NO: 621112 - DNA, 25 bp, Homo sapien
tggctaccgagcttggcagctaata

SEQ ID NO: 621113 - DNA, 25 bp, Homo sapien
ttggcagctaataggcgggcccctc

SEQ ID NO: 621114 - DNA, 25 bp, Homo sapien
ataggcgggcccctcagcattcacg

SEQ ID NO: 621115 - DNA, 25 bp, Homo sapien
gctgctttatcaaactaggattgtt

SEQ ID NO: 621116 - DNA, 25 bp, Homo sapien
tcaaactaggattgttcccccaggt

SEQ ID NO: 621117 - DNA, 25 bp, Homo sapien
aagttatttattactgcggatgggc

SEQ ID NO: 621118 - DNA, 25 bp, Homo sapien
attactgcggatgggctaggagtta

SEQ ID NO: 621119 - DNA, 25 bp, Homo sapien
agtgactcaaatcacaacacctcct

SEQ ID NO: 621120 - DNA, 25 bp, Homo sapien
gactcaaatcacaacacctcctgga

SEQ ID NO: 621121 - DNA, 25 bp, Homo sapien
acctcctggacgaagctggaaggga

SEQ ID NO: 621122 - DNA, 25 bp, Homo sapien
tgttggctagactgatctcgaaccc

SEQ ID NO: 621123 - DNA, 25 bp, Homo sapien
cctgagccaccacgcagaagaggca

SEQ ID NO: 621124 - DNA, 25 bp, Homo sapien
gagccaccacgcagaagaggcactt

SEQ ID NO: 621125 - DNA, 25 bp, Homo sapien
gccaccacgcagaagaggcactttc

SEQ ID NO: 621126 - DNA, 25 bp, Homo sapien
acgcagaagaggcactttccaagtt

SEQ ID NO: 621127 - DNA, 25 bp, Homo sapien
gaggcactttccaagttgtttacca

SEQ ID NO: 621128 - DNA, 25 bp, Homo sapien
aacaagctattgtttggctatacat

SEQ ID NO: 621129 - DNA, 25 bp, Homo sapien
aagctattgtttggctatacattgt

SEQ ID NO: 621130 - DNA, 25 bp, Homo sapien
tttgtatcacatattccaggaacta

SEQ ID NO: 621131 - DNA, 25 bp, Homo sapien
atcacatattccaggaactacagga

SEQ ID NO: 621132 - DNA, 25 bp, Homo sapien
aaataatgggtgaggcagctagtta

SEQ ID NO: 621133 - DNA, 25 bp, Homo sapien
gcagaaacagaacatagccaccctt

SEQ ID NO: 621134 - DNA, 25 bp, Homo sapien
gccaccctttttcattaatgacctt

SEQ ID NO: 621135 - DNA, 25 bp, Homo sapien
taatgaccttttcttcacgtggtgg

SEQ ID NO: 621136 - DNA, 25 bp, Homo sapien
ttcacgtggtggtcaactcagcagg

SEQ ID NO: 621137 - DNA, 25 bp, Homo sapien
gacagctgtattttcagcctgtgtg

SEQ ID NO: 621138 - DNA, 25 bp, Homo sapien
tcagcctgtgtgtctcagtcaccat

SEQ ID NO: 621139 - DNA, 25 bp, Homo sapien
ctgtgtgtctcagtcaccatcctgt

SEQ ID NO: 621140 - DNA, 25 bp, Homo sapien
tgtgtctcagtcaccatcctgttgg

SEQ ID NO: 621141 - DNA, 25 bp, Homo sapien
cagttgagggccatcattttctaaa

SEQ ID NO: 621142 - DNA, 25 bp, Homo sapien
gttgagggccatcattttctaaaca

SEQ ID NO: 621143 - DNA, 25 bp, Homo sapien
ttcccataatttttaccgtgaatgt

SEQ ID NO: 621144 - DNA, 25 bp, Homo sapien
agcatgaatcgactcggcaaccata

SEQ ID NO: 621145 - DNA, 25 bp, Homo sapien
gactcggcaaccataatgaactgtt

SEQ ID NO: 621146 - DNA, 25 bp, Homo sapien
aatgaactgttcacatgctgaggca

SEQ ID NO: 621147 - DNA, 25 bp, Homo sapien
atgctgaggcagaaaccactcgtcc

SEQ ID NO: 621148 - DNA, 25 bp, Homo sapien
cagtctgttcttgacacaatgtact

SEQ ID NO: 621149 - DNA, 25 bp, Homo sapien
attatcaaaagcagcctcaacttgg

SEQ ID NO: 621150 - DNA, 25 bp, Homo sapien
cctcaacttggctttctcatagaaa

SEQ ID NO: 621151 - DNA, 25 bp, Homo sapien
aaaaggcagtttctgtgactgcaaa

SEQ ID NO: 621152 - DNA, 25 bp, Homo sapien
tcaggaagacctaagcttgggacat

SEQ ID NO: 621153 - DNA, 25 bp, Homo sapien
gtgtggcagacaccattagctgaat

SEQ ID NO: 621154 - DNA, 25 bp, Homo sapien
gctgaatcatcagcagttattccat

SEQ ID NO: 621155 - DNA, 25 bp, Homo sapien
aaaggggtgtgagccaggcctcttc

SEQ ID NO: 621156 - DNA, 25 bp, Homo sapien
acaccagacttcatgaaccatgcct

SEQ ID NO: 621157 - DNA, 25 bp, Homo sapien
cagacttcatgaaccatgcctggta

SEQ ID NO: 621158 - DNA, 25 bp, Homo sapien
gacttcatgaaccatgcctggtatt

SEQ ID NO: 621159 - DNA, 25 bp, Homo sapien
ttcatgaaccatgcctggtattgtc

SEQ ID NO: 621160 - DNA, 25 bp, Homo sapien
gcctggtattgtcatgtttttgtga

SEQ ID NO: 621161 - DNA, 25 bp, Homo sapien
tattgtcatgtttttgtgagcagcc

SEQ ID NO: 621162 - DNA, 25 bp, Homo sapien
ttgtcatgtttttgtgagcagccgt

SEQ ID NO: 621163 - DNA, 25 bp, Homo sapien
gtcatgtttttgtgagcagccgtga

SEQ ID NO: 621164 - DNA, 25 bp, Homo sapien
catgtttttgtgagcagccgtgaat

SEQ ID NO: 621165 - DNA, 25 bp, Homo sapien
tttttgtgagcagccgtgaataggg

SEQ ID NO: 621166 - DNA, 25 bp, Homo sapien
aggaatctcccagtcacggaccaaa

SEQ ID NO: 621167 - DNA, 25 bp, Homo sapien
gtcacggaccaaatacttgcaagtt

SEQ ID NO: 621168 - DNA, 25 bp, Homo sapien
atacttgcaagttagaggctggcag

SEQ ID NO: 621169 - DNA, 25 bp, Homo sapien
ggaagttgcactagatgattacgaa

SEQ ID NO: 621170 - DNA, 25 bp, Homo sapien
gattacgaagatcacatcccactct

SEQ ID NO: 621171 - DNA, 25 bp, Homo sapien
agatcacatcccactctctgaacta

SEQ ID NO: 621172 - DNA, 25 bp, Homo sapien
tgaactacaatcactgtgctccctg

SEQ ID NO: 621173 - DNA, 25 bp, Homo sapien
gggagatccttcatgttgagggttt

SEQ ID NO: 621174 - DNA, 25 bp, Homo sapien
catgttgagggttttgctgggttct

SEQ ID NO: 621175 - DNA, 25 bp, Homo sapien
gttttgctgggttctcaggctagtg

SEQ ID NO: 621176 - DNA, 25 bp, Homo sapien
tctctctcttgcctgtggctttgga

SEQ ID NO: 621177 - DNA, 25 bp, Homo sapien
atcagttaatcatcgttacatgttg

SEQ ID NO: 621178 - DNA, 25 bp, Homo sapien
taaaagttggatactgacagtctct

SEQ ID NO: 621179 - DNA, 25 bp, Homo sapien
ggatactgacagtctctaatagttt

SEQ ID NO: 621180 - DNA, 25 bp, Homo sapien
aatagtttatcatccaattgcaagt

SEQ ID NO: 621181 - DNA, 25 bp, Homo sapien
attgcaagtaacctacaattttagg

SEQ ID NO: 621182 - DNA, 25 bp, Homo sapien
aaggatggtcacagtgatttctcaa

SEQ ID NO: 621183 - DNA, 25 bp, Homo sapien
gatttctcaaactacagctcacacc

SEQ ID NO: 621184 - DNA, 25 bp, Homo sapien
acagctcacaccaagtattttttct

SEQ ID NO: 621185 - DNA, 25 bp, Homo sapien
taaggacaatatggctataaactga

SEQ ID NO: 621186 - DNA, 25 bp, Homo sapien
aaactgaggatgttttcctctataa

SEQ ID NO: 621187 - DNA, 25 bp, Homo sapien
tcctctataagaactgaatatgact

SEQ ID NO: 621188 - DNA, 25 bp, Homo sapien
gaaatacctttctgcctctaagaga

SEQ ID NO: 621189 - DNA, 25 bp, Homo sapien
aagagagcactgatattctgcatgt

SEQ ID NO: 621190 - DNA, 25 bp, Homo sapien
atattctgcatgtagtctgccaggg

SEQ ID NO: 621191 - DNA, 25 bp, Homo sapien
gagcacagagaaaccaatcgcccac

SEQ ID NO: 621192 - DNA, 25 bp, Homo sapien
aatcgcccacttccagtgagttctc

SEQ ID NO: 621193 - DNA, 25 bp, Homo sapien
gagttctcatcttgtgattcggcac

SEQ ID NO: 621194 - DNA, 25 bp, Homo sapien
gtgattcggcacctctgcctgtcag

SEQ ID NO: 621195 - DNA, 25 bp, Homo sapien
tttaccagataccagggcccatgga

SEQ ID NO: 621196 - DNA, 25 bp, Homo sapien
atggacctttcctctttggcgagtt

SEQ ID NO: 621197 - DNA, 25 bp, Homo sapien
tggcgagtttcaaaattgccactgt

SEQ ID NO: 621198 - DNA, 25 bp, Homo sapien
gggacacaatcacaacttgtcacaa

SEQ ID NO: 621199 - DNA, 25 bp, Homo sapien
cacagcaatttttgaagcatctgct

SEQ ID NO: 621200 - DNA, 25 bp, Homo sapien
agcatctgctttgccattatctcat

SEQ ID NO: 621201 - DNA, 25 bp, Homo sapien
aacatgtataattcccagtttacag

SEQ ID NO: 621202 - DNA, 25 bp, Homo sapien
ggaaaactagaagctaagtaaccag

SEQ ID NO: 621203 - DNA, 25 bp, Homo sapien
gtcagagatcaataccaagccaaaa

SEQ ID NO: 621204 - DNA, 25 bp, Homo sapien
gaaactgatgcataatcctgccttc

SEQ ID NO: 621205 - DNA, 25 bp, Homo sapien
actgatgcataatcctgccttcttc

SEQ ID NO: 621206 - DNA, 25 bp, Homo sapien
tgcccttgaagccagagccagtgtg

SEQ ID NO: 621207 - DNA, 25 bp, Homo sapien
ccttgaagccagagccagtgtgatg

SEQ ID NO: 621208 - DNA, 25 bp, Homo sapien
agaaagaggccttctttgccttcac

SEQ ID NO: 621209 - DNA, 25 bp, Homo sapien
ttcaccctgaactgggacaatgcag

SEQ ID NO: 621210 - DNA, 25 bp, Homo sapien
ctgttattatcatcctgtgggaggg

SEQ ID NO: 621211 - DNA, 25 bp, Homo sapien
cctgtgggagggttatattttctag

SEQ ID NO: 621212 - DNA, 25 bp, Homo sapien
acagctattattcgaggcttgctct

SEQ ID NO: 621213 - DNA, 25 bp, Homo sapien
attcgaggcttgctctgtagaaaac

SEQ ID NO: 621214 - DNA, 25 bp, Homo sapien
gctctgtagaaaactacttcatttt

SEQ ID NO: 621215 - DNA, 25 bp, Homo sapien
gagggatttgtttactgatctcaga

SEQ ID NO: 621216 - DNA, 25 bp, Homo sapien
cagaaaatctctcataaggttttaa

SEQ ID NO: 621217 - DNA, 25 bp, Homo sapien
aactttctatgattctatttcagag

SEQ ID NO: 621218 - DNA, 25 bp, Homo sapien
gagaaactgttgtcacttttgaaac

SEQ ID NO: 621219 - DNA, 25 bp, Homo sapien
gtcacttttgaaactaggcctatga

SEQ ID NO: 621220 - DNA, 25 bp, Homo sapien
ctaggcctatgaatttaatgtggaa

SEQ ID NO: 621221 - DNA, 25 bp, Homo sapien
tctgcctctttaccaaaccacatgg

SEQ ID NO: 621222 - DNA, 25 bp, Homo sapien
tttaccaaaccacatggctgcgcag

SEQ ID NO: 621223 - DNA, 25 bp, Homo sapien
ctcgtgccagcagcatggttcctgg

SEQ ID NO: 621224 - DNA, 25 bp, Homo sapien
agcatggttcctggcctgcagtgtc

SEQ ID NO: 621225 - DNA, 25 bp, Homo sapien
tgtctgagggtagcctgggtgatct

SEQ ID NO: 621226 - DNA, 25 bp, Homo sapien
gatcttggcaatgaatcacagcatt

SEQ ID NO: 621227 - DNA, 25 bp, Homo sapien
gggcatgtctttcctagacaggcag

SEQ ID NO: 621228 - DNA, 25 bp, Homo sapien
gtctttcctagacaggcagaggtga

SEQ ID NO: 621229 - DNA, 25 bp, Homo sapien
cagaggtgagtgtccaactcctgcc

SEQ ID NO: 621230 - DNA, 25 bp, Homo sapien
ggaaatggccattcggtccattatg

SEQ ID NO: 621231 - DNA, 25 bp, Homo sapien
ggtccattatgacccaggcccatgc

SEQ ID NO: 621232 - DNA, 25 bp, Homo sapien
gaaagtgaagcggtagctcgcgcac

SEQ ID NO: 621233 - DNA, 25 bp, Homo sapien
aagtgaagcggtagctcgcgcacac

SEQ ID NO: 621234 - DNA, 25 bp, Homo sapien
gtgaagcggtagctcgcgcacactc

SEQ ID NO: 621235 - DNA, 25 bp, Homo sapien
gaagcggtagctcgcgcacactcgc

SEQ ID NO: 621236 - DNA, 25 bp, Homo sapien
taggcggcacccaccgccgggagga

SEQ ID NO: 621237 - DNA, 25 bp, Homo sapien
cgcggaaggtgagagcgggcctacc

SEQ ID NO: 621238 - DNA, 25 bp, Homo sapien
tgagagcgggcctaccgcccagtac

SEQ ID NO: 621239 - DNA, 25 bp, Homo sapien
gggtctgggcccatttatttcgcgt

SEQ ID NO: 621240 - DNA, 25 bp, Homo sapien
gtctgggcccatttatttcgcgttg

SEQ ID NO: 621241 - DNA, 25 bp, Homo sapien
tgggcccatttatttcgcgttgcgg

SEQ ID NO: 621242 - DNA, 25 bp, Homo sapien
gggcccatttatttcgcgttgcggg

SEQ ID NO: 621243 - DNA, 25 bp, Homo sapien
ctgtagtttctgtatgtggagtttc

SEQ ID NO: 621244 - DNA, 25 bp, Homo sapien
gggtaaatcctttgagttcaatatg

SEQ ID NO: 621245 - DNA, 25 bp, Homo sapien
ctatgtgctatgtcatctcaaatat

SEQ ID NO: 621246 - DNA, 25 bp, Homo sapien
tctctgggtcattgtatgttttgta

SEQ ID NO: 621247 - DNA, 25 bp, Homo sapien
tttcctatttggtatttgtctccca

SEQ ID NO: 621248 - DNA, 25 bp, Homo sapien
gcaaaacttgtcatctatcgcctta

SEQ ID NO: 621249 - DNA, 25 bp, Homo sapien
tatcgccttattttaattctcacta

SEQ ID NO: 621250 - DNA, 25 bp, Homo sapien
aattctcactatgtaaacttgtaag

SEQ ID NO: 621251 - DNA, 25 bp, Homo sapien
gtaagaactaactcacaacttggtg

SEQ ID NO: 621252 - DNA, 25 bp, Homo sapien
ctcacaacttggtgtctcataactc

SEQ ID NO: 621253 - DNA, 25 bp, Homo sapien
tggtgtctcataactcacttctgaa

SEQ ID NO: 621254 - DNA, 25 bp, Homo sapien
taaaccaagagaccggctgggtgtg

SEQ ID NO: 621255 - DNA, 25 bp, Homo sapien
aaaccaagagaccggctgggtgtgg

SEQ ID NO: 621256 - DNA, 25 bp, Homo sapien
aaccaagagaccggctgggtgtggt

SEQ ID NO: 621257 - DNA, 25 bp, Homo sapien
accaagagaccggctgggtgtggtg

SEQ ID NO: 621258 - DNA, 25 bp, Homo sapien
ccaagagaccggctgggtgtggtgg

SEQ ID NO: 621259 - DNA, 25 bp, Homo sapien
caagagaccggctgggtgtggtggc

SEQ ID NO: 621260 - DNA, 25 bp, Homo sapien
aagagaccggctgggtgtggtggct

SEQ ID NO: 621261 - DNA, 25 bp, Homo sapien
agagaccggctgggtgtggtggctc

SEQ ID NO: 621262 - DNA, 25 bp, Homo sapien
gagaccggctgggtgtggtggctca

SEQ ID NO: 621263 - DNA, 25 bp, Homo sapien
cgagatcaagccactgtactccatc

SEQ ID NO: 621264 - DNA, 25 bp, Homo sapien
gagatcaagccactgtactccatcc

SEQ ID NO: 621265 - DNA, 25 bp, Homo sapien
gcatatttttccaattctctaattt

SEQ ID NO: 621266 - DNA, 25 bp, Homo sapien
tccaattctctaattttagggaagt

SEQ ID NO: 621267 - DNA, 25 bp, Homo sapien
gaagttgtttacagcgtggcacaca

SEQ ID NO: 621268 - DNA, 25 bp, Homo sapien
ttgtttacagcgtggcacacactat

SEQ ID NO: 621269 - DNA, 25 bp, Homo sapien
cgtggcacacactatctctaatgga

SEQ ID NO: 621270 - DNA, 25 bp, Homo sapien
ggcacacactatctctaatggaata

SEQ ID NO: 621271 - DNA, 25 bp, Homo sapien
gtaaagtgaaaccatacctaagtca

SEQ ID NO: 621272 - DNA, 25 bp, Homo sapien
gaaaccatacctaagtcacttgaaa

SEQ ID NO: 621273 - DNA, 25 bp, Homo sapien
ggaattgtactttgttggagtaatc

SEQ ID NO: 621274 - DNA, 25 bp, Homo sapien
actttgttggagtaatctaattgcc

SEQ ID NO: 621275 - DNA, 25 bp, Homo sapien
atctaattgccaaaagttgacactt

SEQ ID NO: 621276 - DNA, 25 bp, Homo sapien
taggtggctgtcaaccgtcacggaa

SEQ ID NO: 621277 - DNA, 25 bp, Homo sapien
cgtcacggaatgttgatgcctgtca

SEQ ID NO: 621278 - DNA, 25 bp, Homo sapien
gatgcctgtcatgagatttcccaca

SEQ ID NO: 621279 - DNA, 25 bp, Homo sapien
tgagatttcccacactggacttgca

SEQ ID NO: 621280 - DNA, 25 bp, Homo sapien
ggacttgcaggtacttgcaggtact

SEQ ID NO: 621281 - DNA, 25 bp, Homo sapien
gcaggtactaggtacttgcaggtac

SEQ ID NO: 621282 - DNA, 25 bp, Homo sapien
caggtaccaggttctctgcaggagt

SEQ ID NO: 621283 - DNA, 25 bp, Homo sapien
gttctctgcaggagtctatgctgga

SEQ ID NO: 621284 - DNA, 25 bp, Homo sapien
acaggactggcacagggcatcttcc

SEQ ID NO: 621285 - DNA, 25 bp, Homo sapien
ggcatcttcccagagtaccaatttt

SEQ ID NO: 621286 - DNA, 25 bp, Homo sapien
caaagtacggactcccgactaccag

SEQ ID NO: 621287 - DNA, 25 bp, Homo sapien
tctcagcagagccaatgctccagag

SEQ ID NO: 621288 - DNA, 25 bp, Homo sapien
agcagagccaatgctccagagctgg

SEQ ID NO: 621289 - DNA, 25 bp, Homo sapien
gcagagccaatgctccagagctgga

SEQ ID NO: 621290 - DNA, 25 bp, Homo sapien
agagccaatgctccagagctggaca

SEQ ID NO: 621291 - DNA, 25 bp, Homo sapien
gagccaatgctccagagctggacaa

SEQ ID NO: 621292 - DNA, 25 bp, Homo sapien
ctggacaatggccaaatagacatta

SEQ ID NO: 621293 - DNA, 25 bp, Homo sapien
gacaatggccaaatagacattaact

SEQ ID NO: 621294 - DNA, 25 bp, Homo sapien
aatggccaaatagacattaactttg

SEQ ID NO: 621295 - DNA, 25 bp, Homo sapien
cattaactttgaaactggaggccaa

SEQ ID NO: 621296 - DNA, 25 bp, Homo sapien
ttaactttgaaactggaggccaagg

SEQ ID NO: 621297 - DNA, 25 bp, Homo sapien
aactttgaaactggaggccaaggcg

SEQ ID NO: 621298 - DNA, 25 bp, Homo sapien
cctcatctccttttgctgtagaatt

SEQ ID NO: 621299 - DNA, 25 bp, Homo sapien
gttatcagactgagactgttatgaa

SEQ ID NO: 621300 - DNA, 25 bp, Homo sapien
gagatttgctgtattctgaagtaat

SEQ ID NO: 621301 - DNA, 25 bp, Homo sapien
atctgttaggattctaggcatattt

SEQ ID NO: 621302 - DNA, 25 bp, Homo sapien
ataaaattgactgtgcatggtgctg

SEQ ID NO: 621303 - DNA, 25 bp, Homo sapien
gatgacctccctttctgagcttcct

SEQ ID NO: 621304 - DNA, 25 bp, Homo sapien
tgagcttcctttcatctctagactt

SEQ ID NO: 621305 - DNA, 25 bp, Homo sapien
tcctttcatctctagacttgtctac

SEQ ID NO: 621306 - DNA, 25 bp, Homo sapien
tctagacttgtctacttgtctgaat

SEQ ID NO: 621307 - DNA, 25 bp, Homo sapien
tttaagtttccttctgtcccagaat

SEQ ID NO: 621308 - DNA, 25 bp, Homo sapien
ttccttctgtcccagaatacatgca

SEQ ID NO: 621309 - DNA, 25 bp, Homo sapien
aaaaggaaagatgctgccaggtgta

SEQ ID NO: 621310 - DNA, 25 bp, Homo sapien
gaaagatgctgccaggtgtagtggc

SEQ ID NO: 621311 - DNA, 25 bp, Homo sapien
gagttcagcttggaattaccagctt

SEQ ID NO: 621312 - DNA, 25 bp, Homo sapien
agttcagcttggaattaccagcttg

SEQ ID NO: 621313 - DNA, 25 bp, Homo sapien
gttcagcttggaattaccagcttgg

SEQ ID NO: 621314 - DNA, 25 bp, Homo sapien
ttcagcttggaattaccagcttggc

SEQ ID NO: 621315 - DNA, 25 bp, Homo sapien
tcagcttggaattaccagcttggcc

SEQ ID NO: 621316 - DNA, 25 bp, Homo sapien
agcttggaattaccagcttggccga

SEQ ID NO: 621317 - DNA, 25 bp, Homo sapien
gcttggaattaccagcttggccgac

SEQ ID NO: 621318 - DNA, 25 bp, Homo sapien
gaattaccagcttggccgacatggt

SEQ ID NO: 621319 - DNA, 25 bp, Homo sapien
ctgggtatgatgatgcacgcctgta

SEQ ID NO: 621320 - DNA, 25 bp, Homo sapien
gacagctgtattttcagcctgtgtg

SEQ ID NO: 621321 - DNA, 25 bp, Homo sapien
acagctgtattttcagcctgtgtgt

SEQ ID NO: 621322 - DNA, 25 bp, Homo sapien
tcagcctgtgtgtctcagtcaccat

SEQ ID NO: 621323 - DNA, 25 bp, Homo sapien
cagcctgtgtgtctcagtcaccatc

SEQ ID NO: 621324 - DNA, 25 bp, Homo sapien
agcctgtgtgtctcagtcaccatcc

SEQ ID NO: 621325 - DNA, 25 bp, Homo sapien
gcctgtgtgtctcagtcaccatcct

SEQ ID NO: 621326 - DNA, 25 bp, Homo sapien
cctgtgtgtctcagtcaccatcctg

SEQ ID NO: 621327 - DNA, 25 bp, Homo sapien
ctgtgtgtctcagtcaccatcctgt

SEQ ID NO: 621328 - DNA, 25 bp, Homo sapien
cagttgagggccatcattttctaaa

SEQ ID NO: 621329 - DNA, 25 bp, Homo sapien
agttgagggccatcattttctaaac

SEQ ID NO: 621330 - DNA, 25 bp, Homo sapien
gttgagggccatcattttctaaaca

SEQ ID NO: 621331 - DNA, 25 bp, Homo sapien
aagtgcaaactgcaggtccctgtaa

SEQ ID NO: 621332 - DNA, 25 bp, Homo sapien
aactgcaggtccctgtaatgatttc

SEQ ID NO: 621333 - DNA, 25 bp, Homo sapien
gatttcaaagactccgttccaacaa

SEQ ID NO: 621334 - DNA, 25 bp, Homo sapien
gactccgttccaacaatgcattaat

SEQ ID NO: 621335 - DNA, 25 bp, Homo sapien
aaggcagctgacatcaaactgaata

SEQ ID NO: 621336 - DNA, 25 bp, Homo sapien
tttcctcctcaaaaacgagtgtgca

SEQ ID NO: 621337 - DNA, 25 bp, Homo sapien
gtgcattatttgtggtgaccattct

SEQ ID NO: 621338 - DNA, 25 bp, Homo sapien
cattcttggtattgttctattacgt

SEQ ID NO: 621339 - DNA, 25 bp, Homo sapien
gttctattacgtaaaacacagcata

SEQ ID NO: 621340 - DNA, 25 bp, Homo sapien
acacagcatagcatcattcttttag

SEQ ID NO: 621341 - DNA, 25 bp, Homo sapien
cattcttttagatgccattcattta

SEQ ID NO: 621342 - DNA, 25 bp, Homo sapien
atttacattttgggccgggcgcagt

SEQ ID NO: 621343 - DNA, 25 bp, Homo sapien
tttacattttgggccgggcgcagtg

SEQ ID NO: 621344 - DNA, 25 bp, Homo sapien
ttacattttgggccgggcgcagtgg

SEQ ID NO: 621345 - DNA, 25 bp, Homo sapien
ttgaagtgaactgagatctcgccac

SEQ ID NO: 621346 - DNA, 25 bp, Homo sapien
tgaagtgaactgagatctcgccact

SEQ ID NO: 621347 - DNA, 25 bp, Homo sapien
gaagtgaactgagatctcgccactg

SEQ ID NO: 621348 - DNA, 25 bp, Homo sapien
aagtgaactgagatctcgccactgc

SEQ ID NO: 621349 - DNA, 25 bp, Homo sapien
ctgggtaacagagctactctgtctc

SEQ ID NO: 621350 - DNA, 25 bp, Homo sapien
tgggtaacagagctactctgtctca

SEQ ID NO: 621351 - DNA, 25 bp, Homo sapien
gggtaacagagctactctgtctcaa

SEQ ID NO: 621352 - DNA, 25 bp, Homo sapien
ggtaacagagctactctgtctcaac

SEQ ID NO: 621353 - DNA, 25 bp, Homo sapien
tggaatgaaagtgcccccgagggtt

SEQ ID NO: 621354 - DNA, 25 bp, Homo sapien
cccgagggttgagggaattcttgca

SEQ ID NO: 621355 - DNA, 25 bp, Homo sapien
gaattcttgcagagtgacacgctta

SEQ ID NO: 621356 - DNA, 25 bp, Homo sapien
gacacgcttaaagtatcctggctcc

SEQ ID NO: 621357 - DNA, 25 bp, Homo sapien
ttaaagtatcctggctcccgtcctg

SEQ ID NO: 621358 - DNA, 25 bp, Homo sapien
tggctcccgtcctggtacacgggct

SEQ ID NO: 621359 - DNA, 25 bp, Homo sapien
ctctgtgcagactgcgttcccgagc

SEQ ID NO: 621360 - DNA, 25 bp, Homo sapien
gcgcccaggccgtgagcaagagtct

SEQ ID NO: 621361 - DNA, 25 bp, Homo sapien
tgagcaagagtctccgccgcctggc

SEQ ID NO: 621362 - DNA, 25 bp, Homo sapien
ctgaagcccagcaactcgctgtggc

SEQ ID NO: 621363 - DNA, 25 bp, Homo sapien
agcaactcgctgtggccttgggaag

SEQ ID NO: 621364 - DNA, 25 bp, Homo sapien
gccgccgcacctggctgatatttgg

SEQ ID NO: 621365 - DNA, 25 bp, Homo sapien
cgccgcacctggctgatatttggta

SEQ ID NO: 621366 - DNA, 25 bp, Homo sapien
gccgcacctggctgatatttggtag

SEQ ID NO: 621367 - DNA, 25 bp, Homo sapien
ccgcacctggctgatatttggtaga

SEQ ID NO: 621368 - DNA, 25 bp, Homo sapien
cgcacctggctgatatttggtagag

SEQ ID NO: 621369 - DNA, 25 bp, Homo sapien
gcacctggctgatatttggtagaga

SEQ ID NO: 621370 - DNA, 25 bp, Homo sapien
cacctggctgatatttggtagagat

SEQ ID NO: 621371 - DNA, 25 bp, Homo sapien
acctggctgatatttggtagagatg

SEQ ID NO: 621372 - DNA, 25 bp, Homo sapien
ccaccttggccttctaaaatactga

SEQ ID NO: 621373 - DNA, 25 bp, Homo sapien
caccttggccttctaaaatactgag

SEQ ID NO: 621374 - DNA, 25 bp, Homo sapien
accttggccttctaaaatactgaga

SEQ ID NO: 621375 - DNA, 25 bp, Homo sapien
aaggcagattggttagggtatttag

SEQ ID NO: 621376 - DNA, 25 bp, Homo sapien
gggtatttaggaaggcagattgcaa

SEQ ID NO: 621377 - DNA, 25 bp, Homo sapien
aaggcagattgcaattccaagttga

SEQ ID NO: 621378 - DNA, 25 bp, Homo sapien
aattccaagttgagagtcccgagca

SEQ ID NO: 621379 - DNA, 25 bp, Homo sapien
tgagagtcccgagcaatgacacggt

SEQ ID NO: 621380 - DNA, 25 bp, Homo sapien
aatgacacggtggtactttctgttg

SEQ ID NO: 621381 - DNA, 25 bp, Homo sapien
ggtggtactttctgttggtttcatt

SEQ ID NO: 621382 - DNA, 25 bp, Homo sapien
ttccttatatatcccaaactacatt

SEQ ID NO: 621383 - DNA, 25 bp, Homo sapien
aaaagaagccctaggataagcctgc

SEQ ID NO: 621384 - DNA, 25 bp, Homo sapien
gataagcctgctttttctagaccaa

SEQ ID NO: 621385 - DNA, 25 bp, Homo sapien
gcctgctttttctagaccaagacta

SEQ ID NO: 621386 - DNA, 25 bp, Homo sapien
gatataggtgccagacattgctact

SEQ ID NO: 621387 - DNA, 25 bp, Homo sapien
cattgctacttgaataggactgaac

SEQ ID NO: 621388 - DNA, 25 bp, Homo sapien
aggactgaactgctaaacttagatc

SEQ ID NO: 621389 - DNA, 25 bp, Homo sapien
aacttagatcagtggtggacaggcc

SEQ ID NO: 621390 - DNA, 25 bp, Homo sapien
ggtggacaggccatagccaaattta

SEQ ID NO: 621391 - DNA, 25 bp, Homo sapien
tgttgagcttatactgttcaaggtt

SEQ ID NO: 621392 - DNA, 25 bp, Homo sapien
gttcaaggttaactttcatggtgtt

SEQ ID NO: 621393 - DNA, 25 bp, Homo sapien
aagcttagaatgctctcaatcccac

SEQ ID NO: 621394 - DNA, 25 bp, Homo sapien
aatcccacatggtaacaactagctg

SEQ ID NO: 621395 - DNA, 25 bp, Homo sapien
gtaacaactagctgaacatgatgat

SEQ ID NO: 621396 - DNA, 25 bp, Homo sapien
acatgatgatgcctgactctggaaa

SEQ ID NO: 621397 - DNA, 25 bp, Homo sapien
acagctggccaatctctcgatcaat

SEQ ID NO: 621398 - DNA, 25 bp, Homo sapien
caatctctcgatcaatcctatcaga

SEQ ID NO: 621399 - DNA, 25 bp, Homo sapien
gatcaatcctatcagaacttgagtt

SEQ ID NO: 621400 - DNA, 25 bp, Homo sapien
tttctctccctgttcagtgatataa

SEQ ID NO: 621401 - DNA, 25 bp, Homo sapien
agtgatataacctcagctgggcatg

SEQ ID NO: 621402 - DNA, 25 bp, Homo sapien
ataacctcagctgggcatgcttatt

SEQ ID NO: 621403 - DNA, 25 bp, Homo sapien
gctgggcatgcttatttaatagttt

SEQ ID NO: 621404 - DNA, 25 bp, Homo sapien
atggaaatattagggttcatcaacc

SEQ ID NO: 621405 - DNA, 25 bp, Homo sapien
agggttcatcaacccatgaaatggg

SEQ ID NO: 621406 - DNA, 25 bp, Homo sapien
gggctagcctgcagcatcaagtatt

SEQ ID NO: 621407 - DNA, 25 bp, Homo sapien
gcctgcagcatcaagtatttaaatt

SEQ ID NO: 621408 - DNA, 25 bp, Homo sapien
tggcttgtaattacaatcctctgat

SEQ ID NO: 621409 - DNA, 25 bp, Homo sapien
aatcctctgataattcaacttccta

SEQ ID NO: 621410 - DNA, 25 bp, Homo sapien
gataattcaacttcctattagaaca

SEQ ID NO: 621411 - DNA, 25 bp, Homo sapien
acaaaactcaacactgttcagagga

SEQ ID NO: 621412 - DNA, 25 bp, Homo sapien
ctgagccaccatccatgaagtcaaa

SEQ ID NO: 621413 - DNA, 25 bp, Homo sapien
gccaccatccatgaagtcaaatata

SEQ ID NO: 621414 - DNA, 25 bp, Homo sapien
gggcatgttgatgcacacctgttgg

SEQ ID NO: 621415 - DNA, 25 bp, Homo sapien
gcatgttgatgcacacctgttggga

SEQ ID NO: 621416 - DNA, 25 bp, Homo sapien
ttgatgcacacctgttgggaggcta

SEQ ID NO: 621417 - DNA, 25 bp, Homo sapien
atgcacacctgttgggaggctaagg

SEQ ID NO: 621418 - DNA, 25 bp, Homo sapien
gccatgatagtgttactgcgctcca

SEQ ID NO: 621419 - DNA, 25 bp, Homo sapien
aacatcgtgtgtctgtaatgagagc

SEQ ID NO: 621420 - DNA, 25 bp, Homo sapien
gcagggaccactaaactaactctct

SEQ ID NO: 621421 - DNA, 25 bp, Homo sapien
ctaactctctacaattattctggac

SEQ ID NO: 621422 - DNA, 25 bp, Homo sapien
tattctggacattgttcctggttac

SEQ ID NO: 621423 - DNA, 25 bp, Homo sapien
attgttcctggttacttcacttcca

SEQ ID NO: 621424 - DNA, 25 bp, Homo sapien
ttccctcatccttccaaaagcttat

SEQ ID NO: 621425 - DNA, 25 bp, Homo sapien
gcttatattttgttacagcccctct

SEQ ID NO: 621426 - DNA, 25 bp, Homo sapien
cagcccctctgctaaatcaaataga

SEQ ID NO: 621427 - DNA, 25 bp, Homo sapien
gtattcaatatatccccttgactaa

SEQ ID NO: 621428 - DNA, 25 bp, Homo sapien
gactaagatatggtctctacctgca

SEQ ID NO: 621429 - DNA, 25 bp, Homo sapien
tctctacctgcaaccatgtgacata

SEQ ID NO: 621430 - DNA, 25 bp, Homo sapien
gtaaggcctgaagaccatgagtatg

SEQ ID NO: 621431 - DNA, 25 bp, Homo sapien
ccatgagtatgtattttgagtatct

SEQ ID NO: 621432 - DNA, 25 bp, Homo sapien
tttgagtatcttctgccagtatagt

SEQ ID NO: 621433 - DNA, 25 bp, Homo sapien
tcttctgccagtatagtgcttcttg

SEQ ID NO: 621434 - DNA, 25 bp, Homo sapien
gtgcttcttggcatctaagaggcac

SEQ ID NO: 621435 - DNA, 25 bp, Homo sapien
tcttggcatctaagaggcactccta

SEQ ID NO: 621436 - DNA, 25 bp, Homo sapien
gaggcactcctaaatatctactgaa

SEQ ID NO: 621437 - DNA, 25 bp, Homo sapien
cttaatttttttctgggccaccatg

SEQ ID NO: 621438 - DNA, 25 bp, Homo sapien
aagaatttgtgtatgttatgcgtat

SEQ ID NO: 621439 - DNA, 25 bp, Homo sapien
gtgtgtgcctttatgaacaactcag

SEQ ID NO: 621440 - DNA, 25 bp, Homo sapien
actcagttgctcataaactcagaaa

SEQ ID NO: 621441 - DNA, 25 bp, Homo sapien
ttgcctgagcccagcagggccaagg

SEQ ID NO: 621442 - DNA, 25 bp, Homo sapien
tgcctgagcccagcagggccaaggc

SEQ ID NO: 621443 - DNA, 25 bp, Homo sapien
gggccaaggcattgcagaaaccctc

SEQ ID NO: 621444 - DNA, 25 bp, Homo sapien
ggccaaggcattgcagaaaccctct

SEQ ID NO: 621445 - DNA, 25 bp, Homo sapien
gccaaggcattgcagaaaccctctc

SEQ ID NO: 621446 - DNA, 25 bp, Homo sapien
gcagaaaccctctcctggccaggca

SEQ ID NO: 621447 - DNA, 25 bp, Homo sapien
cagaaaccctctcctggccaggcat

SEQ ID NO: 621448 - DNA, 25 bp, Homo sapien
agaaaccctctcctggccaggcatg

SEQ ID NO: 621449 - DNA, 25 bp, Homo sapien
gaaaccctctcctggccaggcatgg

SEQ ID NO: 621450 - DNA, 25 bp, Homo sapien
aaaccctctcctggccaggcatggt

SEQ ID NO: 621451 - DNA, 25 bp, Homo sapien
aaccctctcctggccaggcatggtg

SEQ ID NO: 621452 - DNA, 25 bp, Homo sapien
atgcctacagcctctattttcagtc

SEQ ID NO: 621453 - DNA, 25 bp, Homo sapien
cagcctctattttcagtcttacttc

SEQ ID NO: 621454 - DNA, 25 bp, Homo sapien
ttacttccaaacagactttccacct

SEQ ID NO: 621455 - DNA, 25 bp, Homo sapien
gactttccacctaggagtttctggc

SEQ ID NO: 621456 - DNA, 25 bp, Homo sapien
caagagcaaggcaataggtcggcag

SEQ ID NO: 621457 - DNA, 25 bp, Homo sapien
ggcaggcgaagattgttttgctcat

SEQ ID NO: 621458 - DNA, 25 bp, Homo sapien
gttttgctcatgtactgttaatcca

SEQ ID NO: 621459 - DNA, 25 bp, Homo sapien
tctggctatgctgaaagtgacttag

SEQ ID NO: 621460 - DNA, 25 bp, Homo sapien
agtgacttagggaccagaactggat

SEQ ID NO: 621461 - DNA, 25 bp, Homo sapien
actggattacagtcttctacttagc

SEQ ID NO: 621462 - DNA, 25 bp, Homo sapien
agtcttctacttagcagtgtgcctg

SEQ ID NO: 621463 - DNA, 25 bp, Homo sapien
ggcccagaagatccccaggtaaata

SEQ ID NO: 621464 - DNA, 25 bp, Homo sapien
aggtaaatatcaccagttcctgccc

SEQ ID NO: 621465 - DNA, 25 bp, Homo sapien
gcccttccgaagctcacagctgaga

SEQ ID NO: 621466 - DNA, 25 bp, Homo sapien
tcacagctgagaaaagggagacact

SEQ ID NO: 621467 - DNA, 25 bp, Homo sapien
atccccggatgctgtgcagaggagt

SEQ ID NO: 621468 - DNA, 25 bp, Homo sapien
tgtgcagaggagtcacgtcgtgttc

SEQ ID NO: 621469 - DNA, 25 bp, Homo sapien
acgtcgtgttcagactcagtccaaa

SEQ ID NO: 621470 - DNA, 25 bp, Homo sapien
ctcagtccaaagtcagcacagaaaa

SEQ ID NO: 621471 - DNA, 25 bp, Homo sapien
tgacaaacagcccagaaaactcctc

SEQ ID NO: 621472 - DNA, 25 bp, Homo sapien
ctccctcaaaaatcccataaatcga

SEQ ID NO: 621473 - DNA, 25 bp, Homo sapien
gattctaaatagcttcctttgtttt

SEQ ID NO: 621474 - DNA, 25 bp, Homo sapien
actcgcatgcgaatccaaggtctga

SEQ ID NO: 621475 - DNA, 25 bp, Homo sapien
gcatgcgaatccaaggtctgacaga

SEQ ID NO: 621476 - DNA, 25 bp, Homo sapien
aaggtctgacagatgccaactccag

SEQ ID NO: 621477 - DNA, 25 bp, Homo sapien
aatgtatatgaccaactgtaaccaa

SEQ ID NO: 621478 - DNA, 25 bp, Homo sapien
ctgtaaccaaaaaccgaatgtctat

SEQ ID NO: 621479 - DNA, 25 bp, Homo sapien
aaaccgaatgtctatacaaaagaga

SEQ ID NO: 621480 - DNA, 25 bp, Homo sapien
ctgtttatacaaaacttgctatttt

SEQ ID NO: 621481 - DNA, 25 bp, Homo sapien
tgctattttgtatattgttctctgc

SEQ ID NO: 621482 - DNA, 25 bp, Homo sapien
ctctgcttcatctcagtgattttag

SEQ ID NO: 621483 - DNA, 25 bp, Homo sapien
gcttcatctcagtgattttagagtt

SEQ ID NO: 621484 - DNA, 25 bp, Homo sapien
aagttaataattaaactctctcatc

SEQ ID NO: 621485 - DNA, 25 bp, Homo sapien
gcttaaacttttgcctgggaataca

SEQ ID NO: 621486 - DNA, 25 bp, Homo sapien
ttgcctgggaatacactagagagaa

SEQ ID NO: 621487 - DNA, 25 bp, Homo sapien
taaggaagctcgatttaatttggtt

SEQ ID NO: 621488 - DNA, 25 bp, Homo sapien
agatatgccattagtcatctagagc

SEQ ID NO: 621489 - DNA, 25 bp, Homo sapien
gtcatctagagcaacaagactgcct

SEQ ID NO: 621490 - DNA, 25 bp, Homo sapien
caagactgcctcttagaatgccagg

SEQ ID NO: 621491 - DNA, 25 bp, Homo sapien
aatgccaggcgcctgtccttaaatt

SEQ ID NO: 621492 - DNA, 25 bp, Homo sapien
ggcgcctgtccttaaattatgttca

SEQ ID NO: 621493 - DNA, 25 bp, Homo sapien
attatgttcactaaccacctgaggg

SEQ ID NO: 621494 - DNA, 25 bp, Homo sapien
cacctgagggtgtagctaaaatgat

SEQ ID NO: 621495 - DNA, 25 bp, Homo sapien
atgattttggaagtagcctttgtta

SEQ ID NO: 621496 - DNA, 25 bp, Homo sapien
acaaaattagcatgacacagtggca

SEQ ID NO: 621497 - DNA, 25 bp, Homo sapien
acacagtggcatgcatctgcagtcc

SEQ ID NO: 621498 - DNA, 25 bp, Homo sapien
acagtggcatgcatctgcagtccta

SEQ ID NO: 621499 - DNA, 25 bp, Homo sapien
cagtggcatgcatctgcagtcctag

SEQ ID NO: 621500 - DNA, 25 bp, Homo sapien
gagcaagaccacataaaaacactat

SEQ ID NO: 621501 - DNA, 25 bp, Homo sapien
gcaagaccacataaaaacactattg

SEQ ID NO: 621502 - DNA, 25 bp, Homo sapien
aacactattggttaggagccaggtc

SEQ ID NO: 621503 - DNA, 25 bp, Homo sapien
cactattggttaggagccaggtcca

SEQ ID NO: 621504 - DNA, 25 bp, Homo sapien
ctattggttaggagccaggtccagt

SEQ ID NO: 621505 - DNA, 25 bp, Homo sapien
tattggttaggagccaggtccagtg

SEQ ID NO: 621506 - DNA, 25 bp, Homo sapien
tggttaggagccaggtccagtggct

SEQ ID NO: 621507 - DNA, 25 bp, Homo sapien
aggacatgtagtacccacatctcta

SEQ ID NO: 621508 - DNA, 25 bp, Homo sapien
tacccacatctctaggcctgcaggt

SEQ ID NO: 621509 - DNA, 25 bp, Homo sapien
gcaggtgcctttccgacaggaacaa

SEQ ID NO: 621510 - DNA, 25 bp, Homo sapien
acgtggtaacattccagtgtggcct

SEQ ID NO: 621511 - DNA, 25 bp, Homo sapien
taacattccagtgtggcctggccag

SEQ ID NO: 621512 - DNA, 25 bp, Homo sapien
gccagcaggcacagccaggtaatgt

SEQ ID NO: 621513 - DNA, 25 bp, Homo sapien
aatgtatggcgcagcaggcaccaat

SEQ ID NO: 621514 - DNA, 25 bp, Homo sapien
ggagggccacgtgctcctgtgtcta

SEQ ID NO: 621515 - DNA, 25 bp, Homo sapien
tgtctaccccaacacaaaggtgctt

SEQ ID NO: 621516 - DNA, 25 bp, Homo sapien
ctggctgagtttaagtttctgcaaa

SEQ ID NO: 621517 - DNA, 25 bp, Homo sapien
gcaaactggcaaaatgagggcttga

SEQ ID NO: 621518 - DNA, 25 bp, Homo sapien
gagcatttattacgtctaaagctca

SEQ ID NO: 621519 - DNA, 25 bp, Homo sapien
acgtctaaagctcatgcaaccctat

SEQ ID NO: 621520 - DNA, 25 bp, Homo sapien
taaagctcatgcaaccctataggaa

SEQ ID NO: 621521 - DNA, 25 bp, Homo sapien
tgcaaccctataggaaagcatgttt

SEQ ID NO: 621522 - DNA, 25 bp, Homo sapien
tgtcttctaagaacttactcactca

SEQ ID NO: 621523 - DNA, 25 bp, Homo sapien
tactcactcaaagaaagggctactc

SEQ ID NO: 621524 - DNA, 25 bp, Homo sapien
agggctactccattttctaaatcct

SEQ ID NO: 621525 - DNA, 25 bp, Homo sapien
tctaaatcctacatgtcttgaaatt

SEQ ID NO: 621526 - DNA, 25 bp, Homo sapien
atacatattttcacgatcaaggatt

SEQ ID NO: 621527 - DNA, 25 bp, Homo sapien
aggatttatatgttattgagctgat

SEQ ID NO: 621528 - DNA, 25 bp, Homo sapien
gagctgattaaatcttgtcatttta

SEQ ID NO: 621529 - DNA, 25 bp, Homo sapien
actcagcagggcctgaggtggaaga

SEQ ID NO: 621530 - DNA, 25 bp, Homo sapien
tggaagaagcgcgtgaacccatgag

SEQ ID NO: 621531 - DNA, 25 bp, Homo sapien
gaagaagcgcgtgaacccatgaggc

SEQ ID NO: 621532 - DNA, 25 bp, Homo sapien
gaacccatgaggctaagtctgtagt

SEQ ID NO: 621533 - DNA, 25 bp, Homo sapien
aacccatgaggctaagtctgtagtg

SEQ ID NO: 621534 - DNA, 25 bp, Homo sapien
acccatgaggctaagtctgtagtga

SEQ ID NO: 621535 - DNA, 25 bp, Homo sapien
cccatgaggctaagtctgtagtgag

SEQ ID NO: 621536 - DNA, 25 bp, Homo sapien
ccatgaggctaagtctgtagtgagc

SEQ ID NO: 621537 - DNA, 25 bp, Homo sapien
tgaggctaagtctgtagtgagccgt

SEQ ID NO: 621538 - DNA, 25 bp, Homo sapien
gctaagtctgtagtgagccgtgatc

SEQ ID NO: 621539 - DNA, 25 bp, Homo sapien
ctaagtctgtagtgagccgtgatca

SEQ ID NO: 621540 - DNA, 25 bp, Homo sapien
gcattagagacatttcctgtccttc

SEQ ID NO: 621541 - DNA, 25 bp, Homo sapien
tccttctttccatatctgacatgat

SEQ ID NO: 621542 - DNA, 25 bp, Homo sapien
atctgacatgatactttgcacaaaa

SEQ ID NO: 621543 - DNA, 25 bp, Homo sapien
gtaaaatcttatacaactctatgtt

SEQ ID NO: 621544 - DNA, 25 bp, Homo sapien
attattaataatcttcttcccagtg

SEQ ID NO: 621545 - DNA, 25 bp, Homo sapien
taatcttcttcccagtgtatactcg

SEQ ID NO: 621546 - DNA, 25 bp, Homo sapien
gtgtatactcgcctcaagtgggaaa

SEQ ID NO: 621547 - DNA, 25 bp, Homo sapien
gcctcaagtgggaaattctccatct

SEQ ID NO: 621548 - DNA, 25 bp, Homo sapien
aatatccacagtttacttcttttgc

SEQ ID NO: 621549 - DNA, 25 bp, Homo sapien
acagtttacttcttttgcttgccag

SEQ ID NO: 621550 - DNA, 25 bp, Homo sapien
tttacttcttttgcttgccagaaag

SEQ ID NO: 621551 - DNA, 25 bp, Homo sapien
ttccaactcttagaaaattttccag

SEQ ID NO: 621552 - DNA, 25 bp, Homo sapien
aattttccagtactggccgggcgtg

SEQ ID NO: 621553 - DNA, 25 bp, Homo sapien
attttccagtactggccgggcgtgg

SEQ ID NO: 621554 - DNA, 25 bp, Homo sapien
ttttccagtactggccgggcgtggt

SEQ ID NO: 621555 - DNA, 25 bp, Homo sapien
tttccagtactggccgggcgtggtg

SEQ ID NO: 621556 - DNA, 25 bp, Homo sapien
ttccagtactggccgggcgtggtgg

SEQ ID NO: 621557 - DNA, 25 bp, Homo sapien
gggtgggtcacgaggtcgggagatt

SEQ ID NO: 621558 - DNA, 25 bp, Homo sapien
ggtgggtcacgaggtcgggagattg

SEQ ID NO: 621559 - DNA, 25 bp, Homo sapien
gtgggtcacgaggtcgggagattga

SEQ ID NO: 621560 - DNA, 25 bp, Homo sapien
ggtgtggtggcgggcccttgtggtc

SEQ ID NO: 621561 - DNA, 25 bp, Homo sapien
ggcgggcccttgtggtcccagctgc

SEQ ID NO: 621562 - DNA, 25 bp, Homo sapien
gtaaatcacaacatatagggtcaaa

SEQ ID NO: 621563 - DNA, 25 bp, Homo sapien
ttgtagggcatgacttcctagacct

SEQ ID NO: 621564 - DNA, 25 bp, Homo sapien
agggcatgacttcctagacctctta

SEQ ID NO: 621565 - DNA, 25 bp, Homo sapien
tgacttcctagacctcttaggtagg

SEQ ID NO: 621566 - DNA, 25 bp, Homo sapien
gacctcttaggtaggaatctgggta

SEQ ID NO: 621567 - DNA, 25 bp, Homo sapien
ctgggtaagacagaatatcagactt

SEQ ID NO: 621568 - DNA, 25 bp, Homo sapien
gacagaatatcagacttagtcctca

SEQ ID NO: 621569 - DNA, 25 bp, Homo sapien
agacttagtcctcaattcctaatgc

SEQ ID NO: 621570 - DNA, 25 bp, Homo sapien
aagttctgagatccaaaatgctcca

SEQ ID NO: 621571 - DNA, 25 bp, Homo sapien
aaacattttttagcaccgacataat

SEQ ID NO: 621572 - DNA, 25 bp, Homo sapien
gcaccgacataatgccacaagtgga

SEQ ID NO: 621573 - DNA, 25 bp, Homo sapien
tctctgttatacaagggctggtaac

SEQ ID NO: 621574 - DNA, 25 bp, Homo sapien
caagggctggtaacaaatacactcc

SEQ ID NO: 621575 - DNA, 25 bp, Homo sapien
aaatacactccagtgtctttatggt

SEQ ID NO: 621576 - DNA, 25 bp, Homo sapien
tttgttttcctgatgctctgctgtc

SEQ ID NO: 621577 - DNA, 25 bp, Homo sapien
tctgctgtcttcttgaagaatagac

SEQ ID NO: 621578 - DNA, 25 bp, Homo sapien
agaatagacgatgcctgcttcacca

SEQ ID NO: 621579 - DNA, 25 bp, Homo sapien
gatgcctgcttcaccaatagctgag

SEQ ID NO: 621580 - DNA, 25 bp, Homo sapien
cactctctgggaagacctggttgtt

SEQ ID NO: 621581 - DNA, 25 bp, Homo sapien
tgctccttcaggtgactccttagag

SEQ ID NO: 621582 - DNA, 25 bp, Homo sapien
gtgtggtacacacagcctaaggaca

SEQ ID NO: 621583 - DNA, 25 bp, Homo sapien
catgctgttcatcccggcctgggct

SEQ ID NO: 621584 - DNA, 25 bp, Homo sapien
gttttcttcaagtaggacgagttat

SEQ ID NO: 621585 - DNA, 25 bp, Homo sapien
gggtagctcaaaagttaatcaacat

SEQ ID NO: 621586 - DNA, 25 bp, Homo sapien
gaacatcatgacaattgtgaaccat

SEQ ID NO: 621587 - DNA, 25 bp, Homo sapien
atagtgacacttgttctggtgaacc

SEQ ID NO: 621588 - DNA, 25 bp, Homo sapien
gtgaaccatggtctaactacaatta

SEQ ID NO: 621589 - DNA, 25 bp, Homo sapien
gaagggcatcacaatcatatcaagt

SEQ ID NO: 621590 - DNA, 25 bp, Homo sapien
attaaagaactcagcatctctgcag

SEQ ID NO: 621591 - DNA, 25 bp, Homo sapien
atctctgcaggcttactaacctgat

SEQ ID NO: 621592 - DNA, 25 bp, Homo sapien
taacctgatgttgtcttcctagagt

SEQ ID NO: 621593 - DNA, 25 bp, Homo sapien
tttgggtatacgtaaatgaactgcc

SEQ ID NO: 621594 - DNA, 25 bp, Homo sapien
gaactgccctcattacctaagaaag

SEQ ID NO: 621595 - DNA, 25 bp, Homo sapien
ttggaggagtactactttgaacagc

SEQ ID NO: 621596 - DNA, 25 bp, Homo sapien
gaggagtactactttgaacagcata

SEQ ID NO: 621597 - DNA, 25 bp, Homo sapien
ggagtactactttgaacagcataga

SEQ ID NO: 621598 - DNA, 25 bp, Homo sapien
gtactactttgaacagcatagagcc

SEQ ID NO: 621599 - DNA, 25 bp, Homo sapien
tactttgaacagcatagagccaatc

SEQ ID NO: 621600 - DNA, 25 bp, Homo sapien
gaacagcatagagccaatcacattt

SEQ ID NO: 621601 - DNA, 25 bp, Homo sapien
acagcatagagccaatcacattttg

SEQ ID NO: 621602 - DNA, 25 bp, Homo sapien
gcatagagccaatcacattttgcac

SEQ ID NO: 621603 - DNA, 25 bp, Homo sapien
tagagccaatcacattttgcacaag

SEQ ID NO: 621604 - DNA, 25 bp, Homo sapien
gagccaatcacattttgcacaaggg

SEQ ID NO: 621605 - DNA, 25 bp, Homo sapien
aagggcagtcaccatgaaaggaaaa

SEQ ID NO: 621606 - DNA, 25 bp, Homo sapien
ttgttttcaaatattcaaacgttat

SEQ ID NO: 621607 - DNA, 25 bp, Homo sapien
ttagtggcacaataataatcataaa

SEQ ID NO: 621608 - DNA, 25 bp, Homo sapien
atgaatgaaacaaaaccttaggaat

SEQ ID NO: 621609 - DNA, 25 bp, Homo sapien
ggaatttagagtaagatccaaatac

SEQ ID NO: 621610 - DNA, 25 bp, Homo sapien
gagtaagatccaaatacgaataaga

SEQ ID NO: 621611 - DNA, 25 bp, Homo sapien
taatcaatgggcatgaaatgagtaa

SEQ ID NO: 621612 - DNA, 25 bp, Homo sapien
gggcatgaaatgagtaatgttctta

SEQ ID NO: 621613 - DNA, 25 bp, Homo sapien
gtaatgttcttagaacaatgagcaa

SEQ ID NO: 621614 - DNA, 25 bp, Homo sapien
aatgagcaatgttcttagaacaatg

SEQ ID NO: 621615 - DNA, 25 bp, Homo sapien
tagaacaatgagcaaaccttttgga

SEQ ID NO: 621616 - DNA, 25 bp, Homo sapien
cttttggaataaaggctgcttccct

SEQ ID NO: 621617 - DNA, 25 bp, Homo sapien
cttgagatcagacatccagaagcca

SEQ ID NO: 621618 - DNA, 25 bp, Homo sapien
catcagcatccatccttggaaggaa

SEQ ID NO: 621619 - DNA, 25 bp, Homo sapien
ccatccttggaaggaaacacagcct

SEQ ID NO: 621620 - DNA, 25 bp, Homo sapien
gggctgggaccagaaagtctccttg

SEQ ID NO: 621621 - DNA, 25 bp, Homo sapien
gctgggaccagaaagtctccttggg

SEQ ID NO: 621622 - DNA, 25 bp, Homo sapien
tggcagctacgctcaccagacacat

SEQ ID NO: 621623 - DNA, 25 bp, Homo sapien
acgctcaccagacacatgtcctgtg

SEQ ID NO: 621624 - DNA, 25 bp, Homo sapien
taaatccagattcaaagagaacctg

SEQ ID NO: 621625 - DNA, 25 bp, Homo sapien
gggcaccagggatgttcagactaat

SEQ ID NO: 621626 - DNA, 25 bp, Homo sapien
ccagggatgttcagactaatgcttt

SEQ ID NO: 621627 - DNA, 25 bp, Homo sapien
tcagactaatgctttgtggccacct

SEQ ID NO: 621628 - DNA, 25 bp, Homo sapien
agataagatgctacacttctgctag

SEQ ID NO: 621629 - DNA, 25 bp, Homo sapien
gatgctacacttctgctagctgtga

SEQ ID NO: 621630 - DNA, 25 bp, Homo sapien
acacttctgctagctgtgagagttt

SEQ ID NO: 621631 - DNA, 25 bp, Homo sapien
gctagctgtgagagtttgtcaattt

SEQ ID NO: 621632 - DNA, 25 bp, Homo sapien
atttttgctctctagtactttcaca

SEQ ID NO: 621633 - DNA, 25 bp, Homo sapien
tgctctctagtactttcacatttga

SEQ ID NO: 621634 - DNA, 25 bp, Homo sapien
gtactttcacatttgagaacacata

SEQ ID NO: 621635 - DNA, 25 bp, Homo sapien
ttgagaacacataagtgtgcttatt

SEQ ID NO: 621636 - DNA, 25 bp, Homo sapien
gttttcttgcttatcaatatgtctg

SEQ ID NO: 621637 - DNA, 25 bp, Homo sapien
gcttatcaatatgtctgtcttagaa

SEQ ID NO: 621638 - DNA, 25 bp, Homo sapien
ttagaatttcttatccccaacctgc

SEQ ID NO: 621639 - DNA, 25 bp, Homo sapien
taaaataggcacatatctgaagata

SEQ ID NO: 621640 - DNA, 25 bp, Homo sapien
ctgaagataaaagccgaattgaccc

SEQ ID NO: 621641 - DNA, 25 bp, Homo sapien
aatcattaatggctttgaatggcta

SEQ ID NO: 621642 - DNA, 25 bp, Homo sapien
aatggctttgaatggctatgaaaaa

SEQ ID NO: 621643 - DNA, 25 bp, Homo sapien
aaaaataatatctctgccctcttca

SEQ ID NO: 621644 - DNA, 25 bp, Homo sapien
aataatatctctgccctcttcacta

SEQ ID NO: 621645 - DNA, 25 bp, Homo sapien
cctcttcactactcccatgtaaaat

SEQ ID NO: 621646 - DNA, 25 bp, Homo sapien
gtagattttaccaacgtttcaagag

SEQ ID NO: 621647 - DNA, 25 bp, Homo sapien
tttaccaacgtttcaagagagacat

SEQ ID NO: 621648 - DNA, 25 bp, Homo sapien
gtttcaagagagacatgattcccaa

SEQ ID NO: 621649 - DNA, 25 bp, Homo sapien
gacatgattcccaaatattatgtaa

SEQ ID NO: 621650 - DNA, 25 bp, Homo sapien
catctgatccttccatttggctggg

SEQ ID NO: 621651 - DNA, 25 bp, Homo sapien
gatccttccatttggctgggcaatg

SEQ ID NO: 621652 - DNA, 25 bp, Homo sapien
ttccatttggctgggcaatgttgtc

SEQ ID NO: 621653 - DNA, 25 bp, Homo sapien
ttggctgggcaatgttgtcagacat

SEQ ID NO: 621654 - DNA, 25 bp, Homo sapien
gggcaatgttgtcagacatgtcatc

SEQ ID NO: 621655 - DNA, 25 bp, Homo sapien
gtcatcattcaagaagtgacttccc

SEQ ID NO: 621656 - DNA, 25 bp, Homo sapien
atgtctgaggcatttcaagggtagt

SEQ ID NO: 621657 - DNA, 25 bp, Homo sapien
gaggcatttcaagggtagtaccaca

SEQ ID NO: 621658 - DNA, 25 bp, Homo sapien
caagggtagtaccacaggatatggt

SEQ ID NO: 621659 - DNA, 25 bp, Homo sapien
atatgttatggaatgattacctcaa

SEQ ID NO: 621660 - DNA, 25 bp, Homo sapien
atggaatgattacctcaatcaagct

SEQ ID NO: 621661 - DNA, 25 bp, Homo sapien
cttttttggatcctaaattcaccag

SEQ ID NO: 621662 - DNA, 25 bp, Homo sapien
ggaaattttaaccacatgcattcag

SEQ ID NO: 621663 - DNA, 25 bp, Homo sapien
agtgtcagctggcagtgtacccagt

SEQ ID NO: 621664 - DNA, 25 bp, Homo sapien
agtgtacccagtgtaccactgtgtc

SEQ ID NO: 621665 - DNA, 25 bp, Homo sapien
gtgtcgcccaccctgtggtcattag

SEQ ID NO: 621666 - DNA, 25 bp, Homo sapien
gtggtcattagcaattggaattcct

SEQ ID NO: 621667 - DNA, 25 bp, Homo sapien
attgtaccaccttttctctactctt

SEQ ID NO: 621668 - DNA, 25 bp, Homo sapien
ctcttcccagactcaacacatttga

SEQ ID NO: 621669 - DNA, 25 bp, Homo sapien
acacatttgattgtatatgcgcatg

SEQ ID NO: 621670 - DNA, 25 bp, Homo sapien
gggacagagtcaacaagccagaact

SEQ ID NO: 621671 - DNA, 25 bp, Homo sapien
gaactagatgcttctacctggacag

SEQ ID NO: 621672 - DNA, 25 bp, Homo sapien
ttgctggaggtgtcgcccagccacc

SEQ ID NO: 621673 - DNA, 25 bp, Homo sapien
actgcaggacacctaggcctcctga

SEQ ID NO: 621674 - DNA, 25 bp, Homo sapien
ggcctcctgagaactttgtattctg

SEQ ID NO: 621675 - DNA, 25 bp, Homo sapien
gaagtttgcattctcaaggaacctc

SEQ ID NO: 621676 - DNA, 25 bp, Homo sapien
ctctacctgtgccagattgagggca

SEQ ID NO: 621677 - DNA, 25 bp, Homo sapien
agattgagggcactccctgccctac

SEQ ID NO: 621678 - DNA, 25 bp, Homo sapien
tgccctaccctaacagaacaggatt

SEQ ID NO: 621679 - DNA, 25 bp, Homo sapien
acaggattccagttgctgttttaat

SEQ ID NO: 621680 - DNA, 25 bp, Homo sapien
tgttatttgtaactggtgggagaaa

SEQ ID NO: 621681 - DNA, 25 bp, Homo sapien
atgtggttataattcacactgtaga

SEQ ID NO: 621682 - DNA, 25 bp, Homo sapien
cactgtagagcttattaaaagtcac

SEQ ID NO: 621683 - DNA, 25 bp, Homo sapien
tattcctttaactgcgcatcgaagg

SEQ ID NO: 621684 - DNA, 25 bp, Homo sapien
ctttaactgcgcatcgaaggaaaaa

SEQ ID NO: 621685 - DNA, 25 bp, Homo sapien
gacctacaatttccaaattaactct

SEQ ID NO: 621686 - DNA, 25 bp, Homo sapien
gtatgtgattacttacatggataat

SEQ ID NO: 621687 - DNA, 25 bp, Homo sapien
cttacatggataatcataactttca

SEQ ID NO: 621688 - DNA, 25 bp, Homo sapien
atatctatgacacaccaagtcttac

SEQ ID NO: 621689 - DNA, 25 bp, Homo sapien
ctatgacacaccaagtcttactaaa

SEQ ID NO: 621690 - DNA, 25 bp, Homo sapien
gttaatagggaaatgacccatgaat

SEQ ID NO: 621691 - DNA, 25 bp, Homo sapien
gaattcttacaaccactttctgttt

SEQ ID NO: 621692 - DNA, 25 bp, Homo sapien
ttacaaccactttctgtttaatttg

SEQ ID NO: 621693 - DNA, 25 bp, Homo sapien
ttacaatttcaatgttcagatgctg

SEQ ID NO: 621694 - DNA, 25 bp, Homo sapien
cccttctggattgggcaccatggct

SEQ ID NO: 621695 - DNA, 25 bp, Homo sapien
cttctggattgggcaccatggctta

SEQ ID NO: 621696 - DNA, 25 bp, Homo sapien
ggattgggcaccatggcttatgtct

SEQ ID NO: 621697 - DNA, 25 bp, Homo sapien
gattgggcaccatggcttatgtctg

SEQ ID NO: 621698 - DNA, 25 bp, Homo sapien
attgggcaccatggcttatgtctgt

SEQ ID NO: 621699 - DNA, 25 bp, Homo sapien
ttgggcaccatggcttatgtctgta

SEQ ID NO: 621700 - DNA, 25 bp, Homo sapien
gagtcagctgtgttaacgacactgc

SEQ ID NO: 621701 - DNA, 25 bp, Homo sapien
agtcagctgtgttaacgacactgca

SEQ ID NO: 621702 - DNA, 25 bp, Homo sapien
tcagctgtgttaacgacactgcact

SEQ ID NO: 621703 - DNA, 25 bp, Homo sapien
cagctgtgttaacgacactgcactt

SEQ ID NO: 621704 - DNA, 25 bp, Homo sapien
agctgtgttaacgacactgcacttc

SEQ ID NO: 621705 - DNA, 25 bp, Homo sapien
ttattgtgctgattacttgggtgac

SEQ ID NO: 621706 - DNA, 25 bp, Homo sapien
cttgggtgacaaaagtatctatctg

SEQ ID NO: 621707 - DNA, 25 bp, Homo sapien
caaaagtatctatctgtacaccaaa

SEQ ID NO: 621708 - DNA, 25 bp, Homo sapien
gacatgcaatttacccatgtaaaaa

SEQ ID NO: 621709 - DNA, 25 bp, Homo sapien
gaaacaacatttgagtcactcagtg

SEQ ID NO: 621710 - DNA, 25 bp, Homo sapien
caacatttgagtcactcagtgtggc

SEQ ID NO: 621711 - DNA, 25 bp, Homo sapien
agtgtggcaaatgtaccctactcat

SEQ ID NO: 621712 - DNA, 25 bp, Homo sapien
ggcaaatgtaccctactcatgtaag

SEQ ID NO: 621713 - DNA, 25 bp, Homo sapien
gggacctcagtataacatctttgca

SEQ ID NO: 621714 - DNA, 25 bp, Homo sapien
gacctcagtataacatctttgcaac

SEQ ID NO: 621715 - DNA, 25 bp, Homo sapien
tcagtataacatctttgcaactttt

SEQ ID NO: 621716 - DNA, 25 bp, Homo sapien
aactacattgtacctggccttaggc

SEQ ID NO: 621717 - DNA, 25 bp, Homo sapien
gtacctggccttaggcttggaattg

SEQ ID NO: 621718 - DNA, 25 bp, Homo sapien
aaatgaaaccagcttttgccctcag

SEQ ID NO: 621719 - DNA, 25 bp, Homo sapien
agcttttgccctcaggttgatccca

SEQ ID NO: 621720 - DNA, 25 bp, Homo sapien
aggttgatcccatctcctggagttg

SEQ ID NO: 621721 - DNA, 25 bp, Homo sapien
atctcctggagttggcagacaaatg

SEQ ID NO: 621722 - DNA, 25 bp, Homo sapien
aaactgtatggttcacattgtgcta

SEQ ID NO: 621723 - DNA, 25 bp, Homo sapien
aagcttagctaacttttgtttgata

SEQ ID NO: 621724 - DNA, 25 bp, Homo sapien
aataccgtatgcattatgtcccagg

SEQ ID NO: 621725 - DNA, 25 bp, Homo sapien
gtatgcattatgtcccagggtgtga

SEQ ID NO: 621726 - DNA, 25 bp, Homo sapien
gtgtgaggaggcttgaaattctcaa

SEQ ID NO: 621727 - DNA, 25 bp, Homo sapien
ataggacctcctactattctcttaa

SEQ ID NO: 621728 - DNA, 25 bp, Homo sapien
tactattctcttaaggtcctaggaa

SEQ ID NO: 621729 - DNA, 25 bp, Homo sapien
aagactgggtactgaggctgtgtcc

SEQ ID NO: 621730 - DNA, 25 bp, Homo sapien
agatgtctgcttccgaagcagccgc

SEQ ID NO: 621731 - DNA, 25 bp, Homo sapien
gaagcagccgcgtcatgacgggttt

SEQ ID NO: 621732 - DNA, 25 bp, Homo sapien
gtcatgacgggtttctgctgaggaa

SEQ ID NO: 621733 - DNA, 25 bp, Homo sapien
ccatatgccctctcgggttgtcagg

SEQ ID NO: 621734 - DNA, 25 bp, Homo sapien
gggtccttcatgtgcagatggaaca

SEQ ID NO: 621735 - DNA, 25 bp, Homo sapien
agatggaacagcatcgcctcacagc

SEQ ID NO: 621736 - DNA, 25 bp, Homo sapien
gacgaacagatgtggtctactgcca

SEQ ID NO: 621737 - DNA, 25 bp, Homo sapien
tggtctactgccacgaacaatgcgg

SEQ ID NO: 621738 - DNA, 25 bp, Homo sapien
aatttctgatgctccagccacgaaa

SEQ ID NO: 621739 - DNA, 25 bp, Homo sapien
agccacgaaatctatggtactctgt

SEQ ID NO: 621740 - DNA, 25 bp, Homo sapien
ggtactctgtatggcagctctagta

SEQ ID NO: 621741 - DNA, 25 bp, Homo sapien
atattttgccatgatttggtttctc

SEQ ID NO: 621742 - DNA, 25 bp, Homo sapien
caatggtgactcgtttcactcaacc

SEQ ID NO: 621743 - DNA, 25 bp, Homo sapien
tcctagaacctactctgatgatcag

SEQ ID NO: 621744 - DNA, 25 bp, Homo sapien
gtatctattatgaacccacaatgtg

SEQ ID NO: 621745 - DNA, 25 bp, Homo sapien
gttttgctttgccatgtgtggcttt

SEQ ID NO: 621746 - DNA, 25 bp, Homo sapien
taaagcaaagcagtgctcctgtctt

SEQ ID NO: 621747 - DNA, 25 bp, Homo sapien
gctcctgtctttatggttcttttca

SEQ ID NO: 621748 - DNA, 25 bp, Homo sapien
atggttcttttcactccacataaaa

SEQ ID NO: 621749 - DNA, 25 bp, Homo sapien
atactctcctcttatgcatcaatgg

SEQ ID NO: 621750 - DNA, 25 bp, Homo sapien
ctcctcttatgcatcaatggcagaa

SEQ ID NO: 621751 - DNA, 25 bp, Homo sapien
ggcagaaagcactctgttgttcaac

SEQ ID NO: 621752 - DNA, 25 bp, Homo sapien
caatctttatatggactgaatgcat

SEQ ID NO: 621753 - DNA, 25 bp, Homo sapien
ggactgaatgcatcattttgagcaa

SEQ ID NO: 621754 - DNA, 25 bp, Homo sapien
gggcatctcccattggattccagcc

SEQ ID NO: 621755 - DNA, 25 bp, Homo sapien
cattggattccagcctctcataaaa

SEQ ID NO: 621756 - DNA, 25 bp, Homo sapien
gattccagcctctcataaaacacag

SEQ ID NO: 621757 - DNA, 25 bp, Homo sapien
aaatgctgtggactccagactgtca

SEQ ID NO: 621758 - DNA, 25 bp, Homo sapien
actccagactgtcacctacttgaaa

SEQ ID NO: 621759 - DNA, 25 bp, Homo sapien
ccagactgtcacctacttgaaaggg

SEQ ID NO: 621760 - DNA, 25 bp, Homo sapien
aggccagatgtagtggcccaggcct

SEQ ID NO: 621761 - DNA, 25 bp, Homo sapien
gccagatgtagtggcccaggcctgt

SEQ ID NO: 621762 - DNA, 25 bp, Homo sapien
gtggcccaggcctgtgattgcagca

SEQ ID NO: 621763 - DNA, 25 bp, Homo sapien
tggcccaggcctgtgattgcagcac

SEQ ID NO: 621764 - DNA, 25 bp, Homo sapien
agatcgcttgacatcaggagctgga

SEQ ID NO: 621765 - DNA, 25 bp, Homo sapien
gatcgcttgacatcaggagctggag

SEQ ID NO: 621766 - DNA, 25 bp, Homo sapien
atcgcttgacatcaggagctggaga

SEQ ID NO: 621767 - DNA, 25 bp, Homo sapien
tcgcttgacatcaggagctggagac

SEQ ID NO: 621768 - DNA, 25 bp, Homo sapien
cgcttgacatcaggagctggagacc

SEQ ID NO: 621769 - DNA, 25 bp, Homo sapien
tggccagcatgaggaaacgccgtct

SEQ ID NO: 621770 - DNA, 25 bp, Homo sapien
ccagcatgaggaaacgccgtctcta

SEQ ID NO: 621771 - DNA, 25 bp, Homo sapien
atcggggattattgtgctgattact

SEQ ID NO: 621772 - DNA, 25 bp, Homo sapien
cttgggtgacaaaagtatctatctg

SEQ ID NO: 621773 - DNA, 25 bp, Homo sapien
caaaagtatctatctgtacaccaaa

SEQ ID NO: 621774 - DNA, 25 bp, Homo sapien
gacatgcaatttacccatgtaaaaa

SEQ ID NO: 621775 - DNA, 25 bp, Homo sapien
gaaacaacatttgagtcactcagtg

SEQ ID NO: 621776 - DNA, 25 bp, Homo sapien
caacatttgagtcactcagtgtggc

SEQ ID NO: 621777 - DNA, 25 bp, Homo sapien
agtgtggcaaatgtaccctactcat

SEQ ID NO: 621778 - DNA, 25 bp, Homo sapien
actcatgtaagggttaataataggg

SEQ ID NO: 621779 - DNA, 25 bp, Homo sapien
gggacctcagtataacatctttgca

SEQ ID NO: 621780 - DNA, 25 bp, Homo sapien
gacctcagtataacatctttgcaac

SEQ ID NO: 621781 - DNA, 25 bp, Homo sapien
tcagtataacatctttgcaactttt

SEQ ID NO: 621782 - DNA, 25 bp, Homo sapien
taaaaatacatagtaggacaggcgc

SEQ ID NO: 621783 - DNA, 25 bp, Homo sapien
aaaaatacatagtaggacaggcgcg

SEQ ID NO: 621784 - DNA, 25 bp, Homo sapien
aaaatacatagtaggacaggcgcgg

SEQ ID NO: 621785 - DNA, 25 bp, Homo sapien
aaatacatagtaggacaggcgcggt

SEQ ID NO: 621786 - DNA, 25 bp, Homo sapien
aatacatagtaggacaggcgcggtg

SEQ ID NO: 621787 - DNA, 25 bp, Homo sapien
atacatagtaggacaggcgcggtgg

SEQ ID NO: 621788 - DNA, 25 bp, Homo sapien
tacatagtaggacaggcgcggtggc

SEQ ID NO: 621789 - DNA, 25 bp, Homo sapien
acatagtaggacaggcgcggtggct

SEQ ID NO: 621790 - DNA, 25 bp, Homo sapien
catagtaggacaggcgcggtggctc

SEQ ID NO: 621791 - DNA, 25 bp, Homo sapien
gcttcagtgagccatttttgtgcca

SEQ ID NO: 621792 - DNA, 25 bp, Homo sapien
cttcagtgagccatttttgtgccac

SEQ ID NO: 621793 - DNA, 25 bp, Homo sapien
ctgaggcaagaattactcaaacagg

SEQ ID NO: 621794 - DNA, 25 bp, Homo sapien
tgaggcaagaattactcaaacaggg

SEQ ID NO: 621795 - DNA, 25 bp, Homo sapien
gaggcaagaattactcaaacaggga

SEQ ID NO: 621796 - DNA, 25 bp, Homo sapien
aggcaagaattactcaaacagggag

SEQ ID NO: 621797 - DNA, 25 bp, Homo sapien
ggcaagaattactcaaacagggaga

SEQ ID NO: 621798 - DNA, 25 bp, Homo sapien
gcaagaattactcaaacagggagac

SEQ ID NO: 621799 - DNA, 25 bp, Homo sapien
caagaattactcaaacagggagaca

SEQ ID NO: 621800 - DNA, 25 bp, Homo sapien
aagaattactcaaacagggagacag

SEQ ID NO: 621801 - DNA, 25 bp, Homo sapien
gaattactcaaacagggagacagac

SEQ ID NO: 621802 - DNA, 25 bp, Homo sapien
attactcaaacagggagacagacag

SEQ ID NO: 621803 - DNA, 25 bp, Homo sapien
tactcaaacagggagacagacagag

SEQ ID NO: 621804 - DNA, 25 bp, Homo sapien
gtgcccggccaagaaaagcaacttc

SEQ ID NO: 621805 - DNA, 25 bp, Homo sapien
gcaacttcgaaaagtgactaaccag

SEQ ID NO: 621806 - DNA, 25 bp, Homo sapien
aagtgactaaccagctttcttcagc

SEQ ID NO: 621807 - DNA, 25 bp, Homo sapien
agtgactaaccagctttcttcagcc

SEQ ID NO: 621808 - DNA, 25 bp, Homo sapien
gtgactaaccagctttcttcagccc

SEQ ID NO: 621809 - DNA, 25 bp, Homo sapien
tccctgtctgtaaagccaacctctt

SEQ ID NO: 621810 - DNA, 25 bp, Homo sapien
cttctgctcaactcattggaatatg

SEQ ID NO: 621811 - DNA, 25 bp, Homo sapien
tctgctcaactcattggaatatgta

SEQ ID NO: 621812 - DNA, 25 bp, Homo sapien
gctcaactcattggaatatgtattc

SEQ ID NO: 621813 - DNA, 25 bp, Homo sapien
tattttatggaatggagtgttgcct

SEQ ID NO: 621814 - DNA, 25 bp, Homo sapien
tatggaatggagtgttgcctgattc

SEQ ID NO: 621815 - DNA, 25 bp, Homo sapien
aatgcaaccattaatagcgtggtta

SEQ ID NO: 621816 - DNA, 25 bp, Homo sapien
ttctgggaaaaatcctaaactagat

SEQ ID NO: 621817 - DNA, 25 bp, Homo sapien
tagactgataggaaacctagttttt

SEQ ID NO: 621818 - DNA, 25 bp, Homo sapien
tatatatcccgataaatctcaagga

SEQ ID NO: 621819 - DNA, 25 bp, Homo sapien
cgataaatctcaaggaacaattcca

SEQ ID NO: 621820 - DNA, 25 bp, Homo sapien
aagtgagagctaaacttgtatcatg

SEQ ID NO: 621821 - DNA, 25 bp, Homo sapien
cttgtatcatgggaattcattgtaa

SEQ ID NO: 621822 - DNA, 25 bp, Homo sapien
catgggaattcattgtaagtattaa

SEQ ID NO: 621823 - DNA, 25 bp, Homo sapien
gtattaaagacatacgcgaactttg

SEQ ID NO: 621824 - DNA, 25 bp, Homo sapien
gacatacgcgaactttgaaacttta

SEQ ID NO: 621825 - DNA, 25 bp, Homo sapien
actttaacagttttgagatagagaa

SEQ ID NO: 621826 - DNA, 25 bp, Homo sapien
gaaataaagatatgaaattcagcca

SEQ ID NO: 621827 - DNA, 25 bp, Homo sapien
aaataaagatatgaaattcagccag

SEQ ID NO: 621828 - DNA, 25 bp, Homo sapien
aataaagatatgaaattcagccagg

SEQ ID NO: 621829 - DNA, 25 bp, Homo sapien
ataaagatatgaaattcagccaggg

SEQ ID NO: 621830 - DNA, 25 bp, Homo sapien
gatatgaaattcagccaggggtggt

SEQ ID NO: 621831 - DNA, 25 bp, Homo sapien
atatgaaattcagccaggggtggtg

SEQ ID NO: 621832 - DNA, 25 bp, Homo sapien
tatgaaattcagccaggggtggtgg

SEQ ID NO: 621833 - DNA, 25 bp, Homo sapien
aattcagccaggggtggtggctcgt

SEQ ID NO: 621834 - DNA, 25 bp, Homo sapien
ttcagccaggggtggtggctcgtgc

SEQ ID NO: 621835 - DNA, 25 bp, Homo sapien
ttgaatccggggggcaagggttgca

SEQ ID NO: 621836 - DNA, 25 bp, Homo sapien
atccggggggcaagggttgcagtga

SEQ ID NO: 621837 - DNA, 25 bp, Homo sapien
cactctcatgattcttcttttgcaa

SEQ ID NO: 621838 - DNA, 25 bp, Homo sapien
agcacaggcttgttaacttgaccaa

SEQ ID NO: 621839 - DNA, 25 bp, Homo sapien
gttaacttgaccaagcatgcatggt

SEQ ID NO: 621840 - DNA, 25 bp, Homo sapien
caagcatgcatggtctaatggaaga

SEQ ID NO: 621841 - DNA, 25 bp, Homo sapien
aatggaagaactgggcttcaaacca

SEQ ID NO: 621842 - DNA, 25 bp, Homo sapien
ggcttcaaaccaaaggcatctggct

SEQ ID NO: 621843 - DNA, 25 bp, Homo sapien
ggctccagacctcatgtcttgcaag

SEQ ID NO: 621844 - DNA, 25 bp, Homo sapien
tcatgtcttgcaaggagtgaatatg

SEQ ID NO: 621845 - DNA, 25 bp, Homo sapien
gagagagtgtaagtttcaggaagac

SEQ ID NO: 621846 - DNA, 25 bp, Homo sapien
gtgtctgcttttgtttctcattatc

SEQ ID NO: 621847 - DNA, 25 bp, Homo sapien
ttctcattatctcccagcactgttc

SEQ ID NO: 621848 - DNA, 25 bp, Homo sapien
ggaaatctgataatatgctagtata

SEQ ID NO: 621849 - DNA, 25 bp, Homo sapien
gaacttgagaatattatgcttcatg

SEQ ID NO: 621850 - DNA, 25 bp, Homo sapien
atgcttcatgaaataagcgaggcac

SEQ ID NO: 621851 - DNA, 25 bp, Homo sapien
aacaactaatgcgtggttctactta

SEQ ID NO: 621852 - DNA, 25 bp, Homo sapien
gcgtggttctacttacatgaggtat

SEQ ID NO: 621853 - DNA, 25 bp, Homo sapien
aaagtagtcatgtaactgagcagct

SEQ ID NO: 621854 - DNA, 25 bp, Homo sapien
atgtaactgagcagcttggcttcaa

SEQ ID NO: 621855 - DNA, 25 bp, Homo sapien
tgagcagcttggcttcaaaccgtgt

SEQ ID NO: 621856 - DNA, 25 bp, Homo sapien
cagcttggcttcaaaccgtgtttta

SEQ ID NO: 621857 - DNA, 25 bp, Homo sapien
caaaactgcctatgtgtttcctttc

SEQ ID NO: 621858 - DNA, 25 bp, Homo sapien
actgcctatgtgtttcctttcattt

SEQ ID NO: 621859 - DNA, 25 bp, Homo sapien
gccaggaattcgtgactagcctgac

SEQ ID NO: 621860 - DNA, 25 bp, Homo sapien
ccaggaattcgtgactagcctgacc

SEQ ID NO: 621861 - DNA, 25 bp, Homo sapien
atttcaaagttatacttgtgttgtt

SEQ ID NO: 621862 - DNA, 25 bp, Homo sapien
tttcaaagttatacttgtgttgttt

SEQ ID NO: 621863 - DNA, 25 bp, Homo sapien
ttcaaagttatacttgtgttgtttc

SEQ ID NO: 621864 - DNA, 25 bp, Homo sapien
tcaaagttatacttgtgttgtttct

SEQ ID NO: 621865 - DNA, 25 bp, Homo sapien
tgtttcttagaatttggccgggcat

SEQ ID NO: 621866 - DNA, 25 bp, Homo sapien
gtttcttagaatttggccgggcatg

SEQ ID NO: 621867 - DNA, 25 bp, Homo sapien
tttcttagaatttggccgggcatgg

SEQ ID NO: 621868 - DNA, 25 bp, Homo sapien
atatttaaaacaatctcaaggccag

SEQ ID NO: 621869 - DNA, 25 bp, Homo sapien
tatttaaaacaatctcaaggccagg

SEQ ID NO: 621870 - DNA, 25 bp, Homo sapien
atttaaaacaatctcaaggccaggc

SEQ ID NO: 621871 - DNA, 25 bp, Homo sapien
tttaaaacaatctcaaggccaggca

SEQ ID NO: 621872 - DNA, 25 bp, Homo sapien
ttaaaacaatctcaaggccaggcat

SEQ ID NO: 621873 - DNA, 25 bp, Homo sapien
taaaacaatctcaaggccaggcatg

SEQ ID NO: 621874 - DNA, 25 bp, Homo sapien
ctgaggcatgcagatttcctgaggt

SEQ ID NO: 621875 - DNA, 25 bp, Homo sapien
tgaggcatgcagatttcctgaggtc

SEQ ID NO: 621876 - DNA, 25 bp, Homo sapien
gaggcatgcagatttcctgaggtca

SEQ ID NO: 621877 - DNA, 25 bp, Homo sapien
aggcatgcagatttcctgaggtcag

SEQ ID NO: 621878 - DNA, 25 bp, Homo sapien
gcatgcagatttcctgaggtcagga

SEQ ID NO: 621879 - DNA, 25 bp, Homo sapien
aatattgctattgaaagacattgat

SEQ ID NO: 621880 - DNA, 25 bp, Homo sapien
attgaaagacattgatagactgggt

SEQ ID NO: 621881 - DNA, 25 bp, Homo sapien
tgaaagacattgatagactgggtac

SEQ ID NO: 621882 - DNA, 25 bp, Homo sapien
aagacattgatagactgggtactgt

SEQ ID NO: 621883 - DNA, 25 bp, Homo sapien
agacattgatagactgggtactgtg

SEQ ID NO: 621884 - DNA, 25 bp, Homo sapien
acattgatagactgggtactgtggc

SEQ ID NO: 621885 - DNA, 25 bp, Homo sapien
cattgatagactgggtactgtggct

SEQ ID NO: 621886 - DNA, 25 bp, Homo sapien
gcaacatgatgcaacccctcctcta

SEQ ID NO: 621887 - DNA, 25 bp, Homo sapien
aacatgatgcaacccctcctctaca

SEQ ID NO: 621888 - DNA, 25 bp, Homo sapien
tgggaggtttgctttatcctgggag

SEQ ID NO: 621889 - DNA, 25 bp, Homo sapien
gggaggtttgctttatcctgggagg

SEQ ID NO: 621890 - DNA, 25 bp, Homo sapien
atcgaggaagatatactgccaagtc

SEQ ID NO: 621891 - DNA, 25 bp, Homo sapien
aaatccacctgttcagtgatttcag

SEQ ID NO: 621892 - DNA, 25 bp, Homo sapien
atcaccagtgagtatcagtttctgc

SEQ ID NO: 621893 - DNA, 25 bp, Homo sapien
gagaatctaatgcaggctttgcttc

SEQ ID NO: 621894 - DNA, 25 bp, Homo sapien
ggctttgcttctcatcggaatcccc

SEQ ID NO: 621895 - DNA, 25 bp, Homo sapien
cccagctggtgtcttggttgactga

SEQ ID NO: 621896 - DNA, 25 bp, Homo sapien
tggtgtcttggttgactgagagtct

SEQ ID NO: 621897 - DNA, 25 bp, Homo sapien
aatggatttattctctgctaggttt

SEQ ID NO: 621898 - DNA, 25 bp, Homo sapien
ttctctgctaggtttttaacagtca

SEQ ID NO: 621899 - DNA, 25 bp, Homo sapien
aacagtcaagaagggctgtggtcct

SEQ ID NO: 621900 - DNA, 25 bp, Homo sapien
actggtcaaaccttagtgtgcatca

SEQ ID NO: 621901 - DNA, 25 bp, Homo sapien
ggaagtgtcttatataagccttggt

SEQ ID NO: 621902 - DNA, 25 bp, Homo sapien
ggtgttgattttcatcagctcctca

SEQ ID NO: 621903 - DNA, 25 bp, Homo sapien
cagctcctcatggactgggactgtg

SEQ ID NO: 621904 - DNA, 25 bp, Homo sapien
actgtgcttgagtccccagtcccta

SEQ ID NO: 621905 - DNA, 25 bp, Homo sapien
agtccctagagcagtggcctccaaa

SEQ ID NO: 621906 - DNA, 25 bp, Homo sapien
gtggcctccaaagtaaggtacatca

SEQ ID NO: 621907 - DNA, 25 bp, Homo sapien
acatcagatcatccatgtgcctggg

SEQ ID NO: 621908 - DNA, 25 bp, Homo sapien
aaatatgagctcttctacttacgtt

SEQ ID NO: 621909 - DNA, 25 bp, Homo sapien
gagctcttctacttacgtttacttt

SEQ ID NO: 621910 - DNA, 25 bp, Homo sapien
tacctgctttgcatttctactccat

SEQ ID NO: 621911 - DNA, 25 bp, Homo sapien
ctactccatcaatttctattttatc

SEQ ID NO: 621912 - DNA, 25 bp, Homo sapien
aattgaagtcaggagaagccttgat

SEQ ID NO: 621913 - DNA, 25 bp, Homo sapien
gaagccttgattcttataaactgca

SEQ ID NO: 621914 - DNA, 25 bp, Homo sapien
gccttgattcttataaactgcaaaa

SEQ ID NO: 621915 - DNA, 25 bp, Homo sapien
tgattcttataaactgcaaaacatt

SEQ ID NO: 621916 - DNA, 25 bp, Homo sapien
cattagtttgaagtctagtttgtag

SEQ ID NO: 621917 - DNA, 25 bp, Homo sapien
gtaggtatcatttgttttctatgag

SEQ ID NO: 621918 - DNA, 25 bp, Homo sapien
atcatttgttttctatgaggaattc

SEQ ID NO: 621919 - DNA, 25 bp, Homo sapien
gttatattttctttcattcaaagac

SEQ ID NO: 621920 - DNA, 25 bp, Homo sapien
ctttcattcaaagacaggacttaca

SEQ ID NO: 621921 - DNA, 25 bp, Homo sapien
gacaggacttacatgagccttcctt

SEQ ID NO: 621922 - DNA, 25 bp, Homo sapien
aggacttacatgagccttcctttct

SEQ ID NO: 621923 - DNA, 25 bp, Homo sapien
ggcagattatctgaggccaggaatt

SEQ ID NO: 621924 - DNA, 25 bp, Homo sapien
gccaggaattcgtgactagcctgac

SEQ ID NO: 621925 - DNA, 25 bp, Homo sapien
ccaggaattcgtgactagcctgacc

SEQ ID NO: 621926 - DNA, 25 bp, Homo sapien
atttcaaagttatacttgtgttgtt

SEQ ID NO: 621927 - DNA, 25 bp, Homo sapien
tttcaaagttatacttgtgttgttt

SEQ ID NO: 621928 - DNA, 25 bp, Homo sapien
ttcaaagttatacttgtgttgtttc

SEQ ID NO: 621929 - DNA, 25 bp, Homo sapien
tcaaagttatacttgtgttgtttct

SEQ ID NO: 621930 - DNA, 25 bp, Homo sapien
aagttatacttgtgttgtttcttag

SEQ ID NO: 621931 - DNA, 25 bp, Homo sapien
tgtttcttagaatttggccgggcat

SEQ ID NO: 621932 - DNA, 25 bp, Homo sapien
gtttcttagaatttggccgggcatg

SEQ ID NO: 621933 - DNA, 25 bp, Homo sapien
tttcttagaatttggccgggcatgg

SEQ ID NO: 621934 - DNA, 25 bp, Homo sapien
taatcaaagcctgaggaactcttcc

SEQ ID NO: 621935 - DNA, 25 bp, Homo sapien
gaactcttccagaattaaggagact

SEQ ID NO: 621936 - DNA, 25 bp, Homo sapien
actatagagatgtgttcaacggaac

SEQ ID NO: 621937 - DNA, 25 bp, Homo sapien
acggaacacataattctgaattcgt

SEQ ID NO: 621938 - DNA, 25 bp, Homo sapien
gaattcgtatgattttgctactgag

SEQ ID NO: 621939 - DNA, 25 bp, Homo sapien
ttgctactgagacattgctgaaatt

SEQ ID NO: 621940 - DNA, 25 bp, Homo sapien
gggtctcaagattatagggttaatt

SEQ ID NO: 621941 - DNA, 25 bp, Homo sapien
ggaaatgcacactacagtattcagt

SEQ ID NO: 621942 - DNA, 25 bp, Homo sapien
cagtattcagtgtcgttgggcatta

SEQ ID NO: 621943 - DNA, 25 bp, Homo sapien
ttgggcattatgttgacaaactcat

SEQ ID NO: 621944 - DNA, 25 bp, Homo sapien
gacaaactcatgtaaaatggttcag

SEQ ID NO: 621945 - DNA, 25 bp, Homo sapien
aataattttcttgtatctgtggcat

SEQ ID NO: 621946 - DNA, 25 bp, Homo sapien
gtatctgtggcattaagttaggaaa

SEQ ID NO: 621947 - DNA, 25 bp, Homo sapien
taccaaataattaccctttctactg

SEQ ID NO: 621948 - DNA, 25 bp, Homo sapien
taccctttctactgaagacaactgt

SEQ ID NO: 621949 - DNA, 25 bp, Homo sapien
gacaactgttgctgtaatccatcat

SEQ ID NO: 621950 - DNA, 25 bp, Homo sapien
taatccatcatactttttgtttgct

SEQ ID NO: 621951 - DNA, 25 bp, Homo sapien
ttgtatttttctacttgagactgtt

SEQ ID NO: 621952 - DNA, 25 bp, Homo sapien
actgttgcatattaattgttcgctg

SEQ ID NO: 621953 - DNA, 25 bp, Homo sapien
ttaattgttcgctgctgtctcataa

SEQ ID NO: 621954 - DNA, 25 bp, Homo sapien
gctgctgtctcataaaatcttcttc

SEQ ID NO: 621955 - DNA, 25 bp, Homo sapien
ttctgaatttcatcctcctatagtt

SEQ ID NO: 621956 - DNA, 25 bp, Homo sapien
agcctgtccttctgagctgccggtg

SEQ ID NO: 621957 - DNA, 25 bp, Homo sapien
ccggtgctcaagtccttgctataaa

SEQ ID NO: 621958 - DNA, 25 bp, Homo sapien
ataaagcaggatgcggacgcctgtg

SEQ ID NO: 621959 - DNA, 25 bp, Homo sapien
ctggaggtgagttccctgcccatag

SEQ ID NO: 621960 - DNA, 25 bp, Homo sapien
ctgcccataggcattgcccaggata

SEQ ID NO: 621961 - DNA, 25 bp, Homo sapien
ataggcattgcccaggatagcagcc

SEQ ID NO: 621962 - DNA, 25 bp, Homo sapien
ctccttccagcgtaaaccagtagtg

SEQ ID NO: 621963 - DNA, 25 bp, Homo sapien
gagggccaccttgctttatagcata

SEQ ID NO: 621964 - DNA, 25 bp, Homo sapien
ttatagcatattactcaggcctgat

SEQ ID NO: 621965 - DNA, 25 bp, Homo sapien
actcaggcctgattcattcattcgt

SEQ ID NO: 621966 - DNA, 25 bp, Homo sapien
ttaggaaacagagatcaacctgggc

SEQ ID NO: 621967 - DNA, 25 bp, Homo sapien
tagagactccatttccttgcttaaa

SEQ ID NO: 621968 - DNA, 25 bp, Homo sapien
acaagtcagagattattttcccaat

SEQ ID NO: 621969 - DNA, 25 bp, Homo sapien
attttcccaattgtactcatgagta

SEQ ID NO: 621970 - DNA, 25 bp, Homo sapien
agtacttgggactcgcacacagatt

SEQ ID NO: 621971 - DNA, 25 bp, Homo sapien
gattcccacagaacttggatagcct

SEQ ID NO: 621972 - DNA, 25 bp, Homo sapien
tagcctcaccctcaagtagaagcag

SEQ ID NO: 621973 - DNA, 25 bp, Homo sapien
gttttctgccaagtagcggacgcat

SEQ ID NO: 621974 - DNA, 25 bp, Homo sapien
gcggacgcattttacttagttgcta

SEQ ID NO: 621975 - DNA, 25 bp, Homo sapien
aagtggtgggagatgttcctgtcct

SEQ ID NO: 621976 - DNA, 25 bp, Homo sapien
atgttcctgtcctgagcctttcttt

SEQ ID NO: 621977 - DNA, 25 bp, Homo sapien
tcctaatcatagctcagctctgagt

SEQ ID NO: 621978 - DNA, 25 bp, Homo sapien
gtaaaaagaaatattaggctgggcg

SEQ ID NO: 621979 - DNA, 25 bp, Homo sapien
taaaaagaaatattaggctgggcgc

SEQ ID NO: 621980 - DNA, 25 bp, Homo sapien
aaaaagaaatattaggctgggcgcg

SEQ ID NO: 621981 - DNA, 25 bp, Homo sapien
aaaagaaatattaggctgggcgcgg

SEQ ID NO: 621982 - DNA, 25 bp, Homo sapien
aaagaaatattaggctgggcgcggt

SEQ ID NO: 621983 - DNA, 25 bp, Homo sapien
aagaaatattaggctgggcgcggtg

SEQ ID NO: 621984 - DNA, 25 bp, Homo sapien
agaaatattaggctgggcgcggtgg

SEQ ID NO: 621985 - DNA, 25 bp, Homo sapien
ggcgggtggatcactagttcaggag

SEQ ID NO: 621986 - DNA, 25 bp, Homo sapien
cgggtggatcactagttcaggagat

SEQ ID NO: 621987 - DNA, 25 bp, Homo sapien
gaagtttgtcttcctacaaccacgt

SEQ ID NO: 621988 - DNA, 25 bp, Homo sapien
acaaccacgtgatcctctctctggg

SEQ ID NO: 621989 - DNA, 25 bp, Homo sapien
ccccactcaaccagggacaagaggt

SEQ ID NO: 621990 - DNA, 25 bp, Homo sapien
agttgacctgattatgtgtccatca

SEQ ID NO: 621991 - DNA, 25 bp, Homo sapien
ttatgtgtccatcaaggaagtgccc

SEQ ID NO: 621992 - DNA, 25 bp, Homo sapien
ggaagtgcccctggaaggcaaataa

SEQ ID NO: 621993 - DNA, 25 bp, Homo sapien
gcaccatttacattacagtctccta

SEQ ID NO: 621994 - DNA, 25 bp, Homo sapien
cagtctcctaagtgcaggcaatgat

SEQ ID NO: 621995 - DNA, 25 bp, Homo sapien
gtgcaggcaatgataccccaaggtg

SEQ ID NO: 621996 - DNA, 25 bp, Homo sapien
gctctgcagaccctccagcaaagag

SEQ ID NO: 621997 - DNA, 25 bp, Homo sapien
gggcttaggagctcatgcctgcaat

SEQ ID NO: 621998 - DNA, 25 bp, Homo sapien
cagcctaatcgcctcattagcatat

SEQ ID NO: 621999 - DNA, 25 bp, Homo sapien
atcgcctcattagcatatcaacaat

SEQ ID NO: 622000 - DNA, 25 bp, Homo sapien
acaatagtccaattgctcgccagta

SEQ ID NO: 622001 - DNA, 25 bp, Homo sapien
aattgctcgccagtaccacaatctg

SEQ ID NO: 622002 - DNA, 25 bp, Homo sapien
gatattatccgtcaatttccaaagc

SEQ ID NO: 622003 - DNA, 25 bp, Homo sapien
aaagcattttcatggatcggcgtga

SEQ ID NO: 622004 - DNA, 25 bp, Homo sapien
gatcggcgtgaacggatatgcccct

SEQ ID NO: 622005 - DNA, 25 bp, Homo sapien
cgtgaacggatatgcccctctcggt

SEQ ID NO: 622006 - DNA, 25 bp, Homo sapien
ggtctcgcacccaagtggagctact

SEQ ID NO: 622007 - DNA, 25 bp, Homo sapien
acccaagtggagctactctctggct

SEQ ID NO: 622008 - DNA, 25 bp, Homo sapien
tctggctctttaccaacagcctaat

SEQ ID NO: 622009 - DNA, 25 bp, Homo sapien
agggataatcaatgcacgaatgtat

SEQ ID NO: 622010 - DNA, 25 bp, Homo sapien
caatgcacgaatgtataatggtcaa

SEQ ID NO: 622011 - DNA, 25 bp, Homo sapien
ataatggtcaagatgttgcaagaga

SEQ ID NO: 622012 - DNA, 25 bp, Homo sapien
ttagtttgccaatttcagagacact

SEQ ID NO: 622013 - DNA, 25 bp, Homo sapien
tttcagagacactataggacataag

SEQ ID NO: 622014 - DNA, 25 bp, Homo sapien
aaaacagaggcatgggtgatttttt

SEQ ID NO: 622015 - DNA, 25 bp, Homo sapien
gatattattacaacgggctcttaaa

SEQ ID NO: 622016 - DNA, 25 bp, Homo sapien
caaagtgtacatattagcttggcat

SEQ ID NO: 622017 - DNA, 25 bp, Homo sapien
acatattagcttggcattcagtaaa

SEQ ID NO: 622018 - DNA, 25 bp, Homo sapien
cagtaaatattgttgctaccctaca

SEQ ID NO: 622019 - DNA, 25 bp, Homo sapien
aatattgttgctaccctacaagaaa

SEQ ID NO: 622020 - DNA, 25 bp, Homo sapien
tgcagaacttcctgtgacagcccac

SEQ ID NO: 622021 - DNA, 25 bp, Homo sapien
gtgacagcccacctcaaagcaaagg

SEQ ID NO: 622022 - DNA, 25 bp, Homo sapien
acctcaaagcaaagggctccaatgt

SEQ ID NO: 622023 - DNA, 25 bp, Homo sapien
aagcaaagggctccaatgtttgagt

SEQ ID NO: 622024 - DNA, 25 bp, Homo sapien
gggctccaatgtttgagtgaggcta

SEQ ID NO: 622025 - DNA, 25 bp, Homo sapien
aatgtttgagtgaggctagcacgtg

SEQ ID NO: 622026 - DNA, 25 bp, Homo sapien
cacgtggggcagattttaggcagct

SEQ ID NO: 622027 - DNA, 25 bp, Homo sapien
ttttcccccagttatggacttgctc

SEQ ID NO: 622028 - DNA, 25 bp, Homo sapien
tctctctttcaacggctcactatct

SEQ ID NO: 622029 - DNA, 25 bp, Homo sapien
tctttcaacggctcactatcttgcc

SEQ ID NO: 622030 - DNA, 25 bp, Homo sapien
tacaggtgcttaccaccccaccagg

SEQ ID NO: 622031 - DNA, 25 bp, Homo sapien
tactcgggaagcttagatggaagga

SEQ ID NO: 622032 - DNA, 25 bp, Homo sapien
actcgggaagcttagatggaaggat

SEQ ID NO: 622033 - DNA, 25 bp, Homo sapien
tcgggaagcttagatggaaggatca

SEQ ID NO: 622034 - DNA, 25 bp, Homo sapien
cgggaagcttagatggaaggatcaa

SEQ ID NO: 622035 - DNA, 25 bp, Homo sapien
gggaagcttagatggaaggatcaac

SEQ ID NO: 622036 - DNA, 25 bp, Homo sapien
ggaagcttagatggaaggatcaact

SEQ ID NO: 622037 - DNA, 25 bp, Homo sapien
gaagcttagatggaaggatcaactg

SEQ ID NO: 622038 - DNA, 25 bp, Homo sapien
aagcttagatggaaggatcaactga

SEQ ID NO: 622039 - DNA, 25 bp, Homo sapien
agcttagatggaaggatcaactgag

SEQ ID NO: 622040 - DNA, 25 bp, Homo sapien
cttagatggaaggatcaactgagcc

SEQ ID NO: 622041 - DNA, 25 bp, Homo sapien
ttagatggaaggatcaactgagccc

SEQ ID NO: 622042 - DNA, 25 bp, Homo sapien
cacctgaggtctcctaggagtttga

SEQ ID NO: 622043 - DNA, 25 bp, Homo sapien
acctgaggtctcctaggagtttgag

SEQ ID NO: 622044 - DNA, 25 bp, Homo sapien
gcctgcgccaatgtggtgaaaccgt

SEQ ID NO: 622045 - DNA, 25 bp, Homo sapien
cctgcgccaatgtggtgaaaccgtg

SEQ ID NO: 622046 - DNA, 25 bp, Homo sapien
ctgcgccaatgtggtgaaaccgtgt

SEQ ID NO: 622047 - DNA, 25 bp, Homo sapien
tgcgccaatgtggtgaaaccgtgtc

SEQ ID NO: 622048 - DNA, 25 bp, Homo sapien
gcgccaatgtggtgaaaccgtgtct

SEQ ID NO: 622049 - DNA, 25 bp, Homo sapien
cgccaatgtggtgaaaccgtgtctc

SEQ ID NO: 622050 - DNA, 25 bp, Homo sapien
attagcctggcttggtggcgcacgc

SEQ ID NO: 622051 - DNA, 25 bp, Homo sapien
ttagcctggcttggtggcgcacgcc

SEQ ID NO: 622052 - DNA, 25 bp, Homo sapien
ttgaggcaggggaattactggaacc

SEQ ID NO: 622053 - DNA, 25 bp, Homo sapien
ccttgtatggaactaaagacttagg

SEQ ID NO: 622054 - DNA, 25 bp, Homo sapien
ggaactaaagacttaggctttcagc

SEQ ID NO: 622055 - DNA, 25 bp, Homo sapien
aactaaagacttaggctttcagctg

SEQ ID NO: 622056 - DNA, 25 bp, Homo sapien
taaagacttaggctttcagctgggc

SEQ ID NO: 622057 - DNA, 25 bp, Homo sapien
aaagacttaggctttcagctgggca

SEQ ID NO: 622058 - DNA, 25 bp, Homo sapien
aagacttaggctttcagctgggcac

SEQ ID NO: 622059 - DNA, 25 bp, Homo sapien
agacttaggctttcagctgggcacg

SEQ ID NO: 622060 - DNA, 25 bp, Homo sapien
ggaggccaacaggagcatagatgac

SEQ ID NO: 622061 - DNA, 25 bp, Homo sapien
aggccaacaggagcatagatgactt

SEQ ID NO: 622062 - DNA, 25 bp, Homo sapien
gccaacaggagcatagatgacttga

SEQ ID NO: 622063 - DNA, 25 bp, Homo sapien
acaggagcatagatgacttgaggcc

SEQ ID NO: 622064 - DNA, 25 bp, Homo sapien
aagagctgcagtgtagataatcaaa

SEQ ID NO: 622065 - DNA, 25 bp, Homo sapien
ttgtctaggacaagagaatctatct

SEQ ID NO: 622066 - DNA, 25 bp, Homo sapien
gaatctatctctgagggctctgtgt

SEQ ID NO: 622067 - DNA, 25 bp, Homo sapien
tgttggctagtgaggcagatctgcc

SEQ ID NO: 622068 - DNA, 25 bp, Homo sapien
gatctgccttctaattaggctccaa

SEQ ID NO: 622069 - DNA, 25 bp, Homo sapien
taggctccaatcaggatagtattgc

SEQ ID NO: 622070 - DNA, 25 bp, Homo sapien
tagtattgcaattagctcgggatat

SEQ ID NO: 622071 - DNA, 25 bp, Homo sapien
ctcgggatattatagcagttagctt

SEQ ID NO: 622072 - DNA, 25 bp, Homo sapien
atagcagttagcttctattcttgga

SEQ ID NO: 622073 - DNA, 25 bp, Homo sapien
tcttggaacaaattcctgggagatt

SEQ ID NO: 622074 - DNA, 25 bp, Homo sapien
attcctgggagatttaagttgggtg

SEQ ID NO: 622075 - DNA, 25 bp, Homo sapien
tggagtttgaaaagggactattaat

SEQ ID NO: 622076 - DNA, 25 bp, Homo sapien
ggagtttgaaaagggactattaatg

SEQ ID NO: 622077 - DNA, 25 bp, Homo sapien
tgaaaagggactattaatgaaatct

SEQ ID NO: 622078 - DNA, 25 bp, Homo sapien
gaaaagggactattaatgaaatctt

SEQ ID NO: 622079 - DNA, 25 bp, Homo sapien
aagggactattaatgaaatctttct

SEQ ID NO: 622080 - DNA, 25 bp, Homo sapien
agggactattaatgaaatctttctt

SEQ ID NO: 622081 - DNA, 25 bp, Homo sapien
gggactattaatgaaatctttcttt

SEQ ID NO: 622082 - DNA, 25 bp, Homo sapien
ggactattaatgaaatctttctttt

SEQ ID NO: 622083 - DNA, 25 bp, Homo sapien
gactattaatgaaatctttcttttc

SEQ ID NO: 622084 - DNA, 25 bp, Homo sapien
tccccgccactgattcagtgagctg

SEQ ID NO: 622085 - DNA, 25 bp, Homo sapien
ccccgccactgattcagtgagctgg

SEQ ID NO: 622086 - DNA, 25 bp, Homo sapien
tcattctggtaaactaactaaaaca

SEQ ID NO: 622087 - DNA, 25 bp, Homo sapien
agttattggcaattgtcaccctcac

SEQ ID NO: 622088 - DNA, 25 bp, Homo sapien
ttggcaattgtcaccctcactttca

SEQ ID NO: 622089 - DNA, 25 bp, Homo sapien
cctcactttcactgctggtattgat

SEQ ID NO: 622090 - DNA, 25 bp, Homo sapien
ttcactgctggtattgattctctca

SEQ ID NO: 622091 - DNA, 25 bp, Homo sapien
gcaaagtgaccgttgagcctaaaca

SEQ ID NO: 622092 - DNA, 25 bp, Homo sapien
ttgagcctaaacatctcctgcagag

SEQ ID NO: 622093 - DNA, 25 bp, Homo sapien
ctaaacatctcctgcagagtggctt

SEQ ID NO: 622094 - DNA, 25 bp, Homo sapien
cagagtggcttccatgtggtttcat

SEQ ID NO: 622095 - DNA, 25 bp, Homo sapien
gcttccatgtggtttcattccagca

SEQ ID NO: 622096 - DNA, 25 bp, Homo sapien
atgtggtttcattccagcatggcac

SEQ ID NO: 622097 - DNA, 25 bp, Homo sapien
gtaaaatgaagtcagtggtccctaa

SEQ ID NO: 622098 - DNA, 25 bp, Homo sapien
gtcagtggtccctaaaatgaaattg

SEQ ID NO: 622099 - DNA, 25 bp, Homo sapien
ttagctagcatttgattatacatcg

SEQ ID NO: 622100 - DNA, 25 bp, Homo sapien
gattatacatcgatagtttccccat

SEQ ID NO: 622101 - DNA, 25 bp, Homo sapien
agtttccccatgtgattttaacgca

SEQ ID NO: 622102 - DNA, 25 bp, Homo sapien
ccattaggtaggtgatcttatctta

SEQ ID NO: 622103 - DNA, 25 bp, Homo sapien
atgagtttatctttttcaacatgga

SEQ ID NO: 622104 - DNA, 25 bp, Homo sapien
aaatttgttttgctgaccgaaggct

SEQ ID NO: 622105 - DNA, 25 bp, Homo sapien
gaccgaaggctgtgtaacttagaac

SEQ ID NO: 622106 - DNA, 25 bp, Homo sapien
gtaattgaataacccatctctatgg

SEQ ID NO: 622107 - DNA, 25 bp, Homo sapien
tgaaacacctttagtttgttcaaag

SEQ ID NO: 622108 - DNA, 25 bp, Homo sapien
tattaaattaagaaatacggctggg

SEQ ID NO: 622109 - DNA, 25 bp, Homo sapien
gattgcgccactggaatccgggcct

SEQ ID NO: 622110 - DNA, 25 bp, Homo sapien
attgcgccactggaatccgggcctg

SEQ ID NO: 622111 - DNA, 25 bp, Homo sapien
ttgcgccactggaatccgggcctgg

SEQ ID NO: 622112 - DNA, 25 bp, Homo sapien
tgcgccactggaatccgggcctggg

SEQ ID NO: 622113 - DNA, 25 bp, Homo sapien
gcgccactggaatccgggcctgggg

SEQ ID NO: 622114 - DNA, 25 bp, Homo sapien
cgccactggaatccgggcctggggc

SEQ ID NO: 622115 - DNA, 25 bp, Homo sapien
gccactggaatccgggcctggggct

SEQ ID NO: 622116 - DNA, 25 bp, Homo sapien
ccactggaatccgggcctggggcta

SEQ ID NO: 622117 - DNA, 25 bp, Homo sapien
cactggaatccgggcctggggctaa

SEQ ID NO: 622118 - DNA, 25 bp, Homo sapien
tttaaagaaaagttgggctgagcgt

SEQ ID NO: 622119 - DNA, 25 bp, Homo sapien
ttaaagaaaagttgggctgagcgtg

SEQ ID NO: 622120 - DNA, 25 bp, Homo sapien
taaagaaaagttgggctgagcgtgg

SEQ ID NO: 622121 - DNA, 25 bp, Homo sapien
aaagaaaagttgggctgagcgtggt

SEQ ID NO: 622122 - DNA, 25 bp, Homo sapien
ttgggctgagcgtggtgggtcactc

SEQ ID NO: 622123 - DNA, 25 bp, Homo sapien
tgggctgagcgtggtgggtcactcc

SEQ ID NO: 622124 - DNA, 25 bp, Homo sapien
ggctgagcgtggtgggtcactcctg

SEQ ID NO: 622125 - DNA, 25 bp, Homo sapien
atcacttaaccgcaggaggtccagg

SEQ ID NO: 622126 - DNA, 25 bp, Homo sapien
tcacttaaccgcaggaggtccaggc

SEQ ID NO: 622127 - DNA, 25 bp, Homo sapien
cacttaaccgcaggaggtccaggct

SEQ ID NO: 622128 - DNA, 25 bp, Homo sapien
cttaaccgcaggaggtccaggctgc

SEQ ID NO: 622129 - DNA, 25 bp, Homo sapien
ggatcacaggtataattcaagcttt

SEQ ID NO: 622130 - DNA, 25 bp, Homo sapien
aattcaagcttttcatgtagtcatg

SEQ ID NO: 622131 - DNA, 25 bp, Homo sapien
agcttttcatgtagtcatgtagatc

SEQ ID NO: 622132 - DNA, 25 bp, Homo sapien
catgtagatcactagactccttggt

SEQ ID NO: 622133 - DNA, 25 bp, Homo sapien
gatcactagactccttggtgtactg

SEQ ID NO: 622134 - DNA, 25 bp, Homo sapien
agactccttggtgtactgacgtagc

SEQ ID NO: 622135 - DNA, 25 bp, Homo sapien
gtactgacgtagcaatttaaaagca

SEQ ID NO: 622136 - DNA, 25 bp, Homo sapien
tcatgtgtagtacatctagaagtag

SEQ ID NO: 622137 - DNA, 25 bp, Homo sapien
tattctgaagagttgtaacctttta

SEQ ID NO: 622138 - DNA, 25 bp, Homo sapien
aatactaacagtgacatggttttgt

SEQ ID NO: 622139 - DNA, 25 bp, Homo sapien
ggtttagcaatatttagcccattat

SEQ ID NO: 622140 - DNA, 25 bp, Homo sapien
cttgtgtatccttctagaaattttt

SEQ ID NO: 622141 - DNA, 25 bp, Homo sapien
ttgtgtatccttctagaaatttttt

SEQ ID NO: 622142 - DNA, 25 bp, Homo sapien
gaaattttttatggctaggtatggt

SEQ ID NO: 622143 - DNA, 25 bp, Homo sapien
aaattttttatggctaggtatggtg

SEQ ID NO: 622144 - DNA, 25 bp, Homo sapien
aattttttatggctaggtatggtgg

SEQ ID NO: 622145 - DNA, 25 bp, Homo sapien
attttttatggctaggtatggtggc

SEQ ID NO: 622146 - DNA, 25 bp, Homo sapien
ttttttatggctaggtatggtggct

SEQ ID NO: 622147 - DNA, 25 bp, Homo sapien
tttttatggctaggtatggtggctc

SEQ ID NO: 622148 - DNA, 25 bp, Homo sapien
ttttatggctaggtatggtggctca

SEQ ID NO: 622149 - DNA, 25 bp, Homo sapien
tgagaccccgactgcccgacggctc

SEQ ID NO: 622150 - DNA, 25 bp, Homo sapien
ccgacggctctacactgccagcggg

SEQ ID NO: 622151 - DNA, 25 bp, Homo sapien
tgccagcgggcctcctgagggctac

SEQ ID NO: 622152 - DNA, 25 bp, Homo sapien
cagcgggcctcctgagggctacgtc

SEQ ID NO: 622153 - DNA, 25 bp, Homo sapien
tcctgagggctacgtcccctgttgg

SEQ ID NO: 622154 - DNA, 25 bp, Homo sapien
ggctacgtcccctgttggccggagc

SEQ ID NO: 622155 - DNA, 25 bp, Homo sapien
ctgttggccggagcccagcagctgt

SEQ ID NO: 622156 - DNA, 25 bp, Homo sapien
agcagctgtgggagccccgagaacg

SEQ ID NO: 622157 - DNA, 25 bp, Homo sapien
gtgggagccccgagaacgcctccag

SEQ ID NO: 622158 - DNA, 25 bp, Homo sapien
gagaacgcctccagcggggatgaca

SEQ ID NO: 622159 - DNA, 25 bp, Homo sapien
gatgacacagaagatcaggatcctc

SEQ ID NO: 622160 - DNA, 25 bp, Homo sapien
gatatatcattatgtttcaggccat

SEQ ID NO: 622161 - DNA, 25 bp, Homo sapien
ttcaggccatactaatcaagaggtg

SEQ ID NO: 622162 - DNA, 25 bp, Homo sapien
ggtaatttttattatccgccataga

SEQ ID NO: 622163 - DNA, 25 bp, Homo sapien
attatccgccatagaaattgctgac

SEQ ID NO: 622164 - DNA, 25 bp, Homo sapien
agaaattgctgacactctagcctcc

SEQ ID NO: 622165 - DNA, 25 bp, Homo sapien
ggagatctcaaatattcccagaaaa

SEQ ID NO: 622166 - DNA, 25 bp, Homo sapien
aacacttgactgtcatgaccatcca

SEQ ID NO: 622167 - DNA, 25 bp, Homo sapien
tatttttctctgctctacctctgga

SEQ ID NO: 622168 - DNA, 25 bp, Homo sapien
acctctggataccttcttgatgttg

SEQ ID NO: 622169 - DNA, 25 bp, Homo sapien
ttcttgatgttgactgctgcctcaa

SEQ ID NO: 622170 - DNA, 25 bp, Homo sapien
tgactgctgcctcaaaattctgaag

SEQ ID NO: 622171 - DNA, 25 bp, Homo sapien
catagaggtcttcttgaatcctgga

SEQ ID NO: 622172 - DNA, 25 bp, Homo sapien
tgaatcctggattggtgctgttttt

SEQ ID NO: 622173 - DNA, 25 bp, Homo sapien
tgctgtttttgcactatgccatggt

SEQ ID NO: 622174 - DNA, 25 bp, Homo sapien
gcactatgccatggtagccttgtag

SEQ ID NO: 622175 - DNA, 25 bp, Homo sapien
gccatggtagccttgtagtattaga

SEQ ID NO: 622176 - DNA, 25 bp, Homo sapien
gtagtattagaagtttgcctttgaa

SEQ ID NO: 622177 - DNA, 25 bp, Homo sapien
gtttgcctttgaatgatttggtatt

SEQ ID NO: 622178 - DNA, 25 bp, Homo sapien
gtatttttcatactaacatgttctt

SEQ ID NO: 622179 - DNA, 25 bp, Homo sapien
aataagttcatgttttacctagcta

SEQ ID NO: 622180 - DNA, 25 bp, Homo sapien
gttcatgttttacctagctaacaaa

SEQ ID NO: 622181 - DNA, 25 bp, Homo sapien
caaattagtatatccagatgttgaa

SEQ ID NO: 622182 - DNA, 25 bp, Homo sapien
ggcaggaaacagaacaagagtcttc

SEQ ID NO: 622183 - DNA, 25 bp, Homo sapien
agtcttccagactgatgagtttgtc

SEQ ID NO: 622184 - DNA, 25 bp, Homo sapien
ttgtcagagagatcccagtcatgct

SEQ ID NO: 622185 - DNA, 25 bp, Homo sapien
gtcatgctggatttaccaatcctag

SEQ ID NO: 622186 - DNA, 25 bp, Homo sapien
ccaatcctaggaaagcactgagaat

SEQ ID NO: 622187 - DNA, 25 bp, Homo sapien
gaattctaggaacccaatgatgtct

SEQ ID NO: 622188 - DNA, 25 bp, Homo sapien
aatgatgtctttacatgtgtattca

SEQ ID NO: 622189 - DNA, 25 bp, Homo sapien
gtgtattcaaatgttttagcccttc

SEQ ID NO: 622190 - DNA, 25 bp, Homo sapien
ttagcccttcaacataaagctctat

SEQ ID NO: 622191 - DNA, 25 bp, Homo sapien
taaaacacaaattccttccctctct

SEQ ID NO: 622192 - DNA, 25 bp, Homo sapien
attccttccctctctaaggtagtag

SEQ ID NO: 622193 - DNA, 25 bp, Homo sapien
gcaatcacaatatgtattcattttg

SEQ ID NO: 622194 - DNA, 25 bp, Homo sapien
aggagtttcatcattgcttagcaat

SEQ ID NO: 622195 - DNA, 25 bp, Homo sapien
agtttattggtgctatatggaagtt

SEQ ID NO: 622196 - DNA, 25 bp, Homo sapien
gaagttgagtgcgtgatcacaccac

SEQ ID NO: 622197 - DNA, 25 bp, Homo sapien
gagtgcgtgatcacaccacagttta

SEQ ID NO: 622198 - DNA, 25 bp, Homo sapien
gcgtgatcacaccacagtttatcca

SEQ ID NO: 622199 - DNA, 25 bp, Homo sapien
ttctactgttgatggacatatgagt

SEQ ID NO: 622200 - DNA, 25 bp, Homo sapien
acatatgagtaatttccggtttgga

SEQ ID NO: 622201 - DNA, 25 bp, Homo sapien
ggaactactacaaacagtgctgtta

SEQ ID NO: 622202 - DNA, 25 bp, Homo sapien
ggtgaacaaatatattcactcctgt

SEQ ID NO: 622203 - DNA, 25 bp, Homo sapien
tattcactcctgtttgaaataaact

SEQ ID NO: 622204 - DNA, 25 bp, Homo sapien
ggcgtggcattcatctctcatttaa

SEQ ID NO: 622205 - DNA, 25 bp, Homo sapien
ggcattcatctctcatttaaaaggc

SEQ ID NO: 622206 - DNA, 25 bp, Homo sapien
aaggccttcctcgtgataatacaga

SEQ ID NO: 622207 - DNA, 25 bp, Homo sapien
gaaaataattcacctctggtgtctt

SEQ ID NO: 622208 - DNA, 25 bp, Homo sapien
tcacctctggtgtcttaagttacag

SEQ ID NO: 622209 - DNA, 25 bp, Homo sapien
ttaagttacagtccctctaaggaca

SEQ ID NO: 622210 - DNA, 25 bp, Homo sapien
tccctctaaggacaagtattttctg

SEQ ID NO: 622211 - DNA, 25 bp, Homo sapien
aacagttgggtcactgaattcgcct

SEQ ID NO: 622212 - DNA, 25 bp, Homo sapien
actgaattcgcctagttggcatgac

SEQ ID NO: 622213 - DNA, 25 bp, Homo sapien
gcctagttggcatgactttctctat

SEQ ID NO: 622214 - DNA, 25 bp, Homo sapien
tgactttctctatgaatggtggcac

SEQ ID NO: 622215 - DNA, 25 bp, Homo sapien
aagaaagagtttaggtccaggcacg

SEQ ID NO: 622216 - DNA, 25 bp, Homo sapien
gaaagagtttaggtccaggcacggt

SEQ ID NO: 622217 - DNA, 25 bp, Homo sapien
aaagagtttaggtccaggcacggtg

SEQ ID NO: 622218 - DNA, 25 bp, Homo sapien
aagagtttaggtccaggcacggtgg

SEQ ID NO: 622219 - DNA, 25 bp, Homo sapien
gccagggtggtggaaccccatccct

SEQ ID NO: 622220 - DNA, 25 bp, Homo sapien
ctaaagatgctgatattggccaggc

SEQ ID NO: 622221 - DNA, 25 bp, Homo sapien
taaagatgctgatattggccaggcg

SEQ ID NO: 622222 - DNA, 25 bp, Homo sapien
aaagatgctgatattggccaggcgt

SEQ ID NO: 622223 - DNA, 25 bp, Homo sapien
aagatgctgatattggccaggcgta

SEQ ID NO: 622224 - DNA, 25 bp, Homo sapien
agatgctgatattggccaggcgtag

SEQ ID NO: 622225 - DNA, 25 bp, Homo sapien
gatgctgatattggccaggcgtagt

SEQ ID NO: 622226 - DNA, 25 bp, Homo sapien
ctcttctagagagatgtcagggcag

SEQ ID NO: 622227 - DNA, 25 bp, Homo sapien
tctagagagatgtcagggcagggct

SEQ ID NO: 622228 - DNA, 25 bp, Homo sapien
gattgcttgagcgtagccattcgag

SEQ ID NO: 622229 - DNA, 25 bp, Homo sapien
attgcttgagcgtagccattcgaga

SEQ ID NO: 622230 - DNA, 25 bp, Homo sapien
tgcttgagcgtagccattcgagagc

SEQ ID NO: 622231 - DNA, 25 bp, Homo sapien
cttgagcgtagccattcgagagcag

SEQ ID NO: 622232 - DNA, 25 bp, Homo sapien
ttgagcgtagccattcgagagcagc

SEQ ID NO: 622233 - DNA, 25 bp, Homo sapien
gagcgtagccattcgagagcagcct

SEQ ID NO: 622234 - DNA, 25 bp, Homo sapien
agcgtagccattcgagagcagcctg

SEQ ID NO: 622235 - DNA, 25 bp, Homo sapien
gcctgggcaacgtagagatccccat

SEQ ID NO: 622236 - DNA, 25 bp, Homo sapien
gggcaacgtagagatccccatctct

SEQ ID NO: 622237 - DNA, 25 bp, Homo sapien
aattgaagtcaggagaagccttgat

SEQ ID NO: 622238 - DNA, 25 bp, Homo sapien
gaagccttgattcttataaactgca

SEQ ID NO: 622239 - DNA, 25 bp, Homo sapien
tgattcttataaactgcaaaacatt

SEQ ID NO: 622240 - DNA, 25 bp, Homo sapien
cattagtttgaagtctagtttgtag

SEQ ID NO: 622241 - DNA, 25 bp, Homo sapien
gtaggtatcatttgttttctatgag

SEQ ID NO: 622242 - DNA, 25 bp, Homo sapien
atcatttgttttctatgaggaattc

SEQ ID NO: 622243 - DNA, 25 bp, Homo sapien
attttctttcattcaaagacaggac

SEQ ID NO: 622244 - DNA, 25 bp, Homo sapien
aagacaggacttacatgagccttcc

SEQ ID NO: 622245 - DNA, 25 bp, Homo sapien
aggacttacatgagccttcctttct

SEQ ID NO: 622246 - DNA, 25 bp, Homo sapien
tacatgagccttcctttctgctgtt

SEQ ID NO: 622247 - DNA, 25 bp, Homo sapien
aaaatgtcttatggctgggtgcagt

SEQ ID NO: 622248 - DNA, 25 bp, Homo sapien
ttgtcctgagtcctcccctgtaata

SEQ ID NO: 622249 - DNA, 25 bp, Homo sapien
agtcctcccctgtaatacttagcag

SEQ ID NO: 622250 - DNA, 25 bp, Homo sapien
agttctcccctaagacattctattt

SEQ ID NO: 622251 - DNA, 25 bp, Homo sapien
tgagttattctctaggatgttccac

SEQ ID NO: 622252 - DNA, 25 bp, Homo sapien
taggatgttccacttccagctattg

SEQ ID NO: 622253 - DNA, 25 bp, Homo sapien
gttccacttccagctattgtgaaga

SEQ ID NO: 622254 - DNA, 25 bp, Homo sapien
tatggctaataacatcttaagattc

SEQ ID NO: 622255 - DNA, 25 bp, Homo sapien
taagattctcagaagtattcctatt

SEQ ID NO: 622256 - DNA, 25 bp, Homo sapien
gttcttatcagaatctctagttatt

SEQ ID NO: 622257 - DNA, 25 bp, Homo sapien
aattcaaccagtctgggccaccata

SEQ ID NO: 622258 - DNA, 25 bp, Homo sapien
caccatacagccttgtctggaagcc

SEQ ID NO: 622259 - DNA, 25 bp, Homo sapien
aatattgctattgaaagacattgat

SEQ ID NO: 622260 - DNA, 25 bp, Homo sapien
tgaaagacattgatagactgggtac

SEQ ID NO: 622261 - DNA, 25 bp, Homo sapien
aagacattgatagactgggtactgt

SEQ ID NO: 622262 - DNA, 25 bp, Homo sapien
agacattgatagactgggtactgtg

SEQ ID NO: 622263 - DNA, 25 bp, Homo sapien
cattgatagactgggtactgtggct

SEQ ID NO: 622264 - DNA, 25 bp, Homo sapien
atagactgggtactgtggctcatgc

SEQ ID NO: 622265 - DNA, 25 bp, Homo sapien
caaggcgggtagatagcttgagtcc

SEQ ID NO: 622266 - DNA, 25 bp, Homo sapien
gcccaggcaacatgatgcaacccct

SEQ ID NO: 622267 - DNA, 25 bp, Homo sapien
aacatgatgcaacccctcctctaca

SEQ ID NO: 622268 - DNA, 25 bp, Homo sapien
tgggaggtttgctttatcctgggag

SEQ ID NO: 622269 - DNA, 25 bp, Homo sapien
aggtttgctttatcctgggaggctg

SEQ ID NO: 622270 - DNA, 25 bp, Homo sapien
tctcatgtgagataccagaatggaa

SEQ ID NO: 622271 - DNA, 25 bp, Homo sapien
gaatggaaacatacagctccttaat

SEQ ID NO: 622272 - DNA, 25 bp, Homo sapien
atacagctccttaatgtaacacata

SEQ ID NO: 622273 - DNA, 25 bp, Homo sapien
tgaagctactttttccataaaaggt

SEQ ID NO: 622274 - DNA, 25 bp, Homo sapien
aaaaggttattctgtaagcaatcat

SEQ ID NO: 622275 - DNA, 25 bp, Homo sapien
ttctgtaagcaatcatatggaactt

SEQ ID NO: 622276 - DNA, 25 bp, Homo sapien
tgtgtttacaacagtctacctccta

SEQ ID NO: 622277 - DNA, 25 bp, Homo sapien
ttacaacagtctacctcctattcgt

SEQ ID NO: 622278 - DNA, 25 bp, Homo sapien
tcctattcgtctgatcttgcttatg

SEQ ID NO: 622279 - DNA, 25 bp, Homo sapien
tgatcttgcttatgaccgactgaaa

SEQ ID NO: 622280 - DNA, 25 bp, Homo sapien
ttatgaccgactgaaaagcaacaga

SEQ ID NO: 622281 - DNA, 25 bp, Homo sapien
cgtgggcacgcggtgccgtctcccc

SEQ ID NO: 622282 - DNA, 25 bp, Homo sapien
gcctggcgcgctcatgcttcaggaa

SEQ ID NO: 622283 - DNA, 25 bp, Homo sapien
cctggcgcgctcatgcttcaggaat

SEQ ID NO: 622284 - DNA, 25 bp, Homo sapien
ctggcgcgctcatgcttcaggaatg

SEQ ID NO: 622285 - DNA, 25 bp, Homo sapien
tggcgcgctcatgcttcaggaatgc

SEQ ID NO: 622286 - DNA, 25 bp, Homo sapien
gcgcgctcatgcttcaggaatgcgg

SEQ ID NO: 622287 - DNA, 25 bp, Homo sapien
tcatgcttcaggaatgcgggcgccc

SEQ ID NO: 622288 - DNA, 25 bp, Homo sapien
gaatgcgggcgcccgggtcgcgcgt

SEQ ID NO: 622289 - DNA, 25 bp, Homo sapien
gtcgcgcgtccctgggaatttccgc

SEQ ID NO: 622290 - DNA, 25 bp, Homo sapien
gtccctgggaatttccgcgcccgct

SEQ ID NO: 622291 - DNA, 25 bp, Homo sapien
agggcagcagcagccagtacaggac

SEQ ID NO: 622292 - DNA, 25 bp, Homo sapien
tgcttccccgctcttctgtgaagta

SEQ ID NO: 622293 - DNA, 25 bp, Homo sapien
ctgtgaagtacccagggaccctgat

SEQ ID NO: 622294 - DNA, 25 bp, Homo sapien
ggtgccaatgccaatttaggtcaga

SEQ ID NO: 622295 - DNA, 25 bp, Homo sapien
gccaatttaggtcagaacttcagag

SEQ ID NO: 622296 - DNA, 25 bp, Homo sapien
gaaagtggatgcaccaggttggttt

SEQ ID NO: 622297 - DNA, 25 bp, Homo sapien
aactcagtggtgtcagtcatgcctc

SEQ ID NO: 622298 - DNA, 25 bp, Homo sapien
tgtcagtcatgcctcaagaccttca

SEQ ID NO: 622299 - DNA, 25 bp, Homo sapien
ccttcagtgggaatgggtcatcagc

SEQ ID NO: 622300 - DNA, 25 bp, Homo sapien
tgggaatgggtcatcagccagctgc

SEQ ID NO: 622301 - DNA, 25 bp, Homo sapien
atcagccagctgcaaacaatgcagt

SEQ ID NO: 622302 - DNA, 25 bp, Homo sapien
attcatgaccatctggaacctcaga

SEQ ID NO: 622303 - DNA, 25 bp, Homo sapien
gcgcaaactggagtccactgagagc

SEQ ID NO: 622304 - DNA, 25 bp, Homo sapien
aaactggagtccactgagagccgca

SEQ ID NO: 622305 - DNA, 25 bp, Homo sapien
aactggagtccactgagagccgcag

SEQ ID NO: 622306 - DNA, 25 bp, Homo sapien
actggagtccactgagagccgcagc

SEQ ID NO: 622307 - DNA, 25 bp, Homo sapien
tggagtccactgagagccgcagcag

SEQ ID NO: 622308 - DNA, 25 bp, Homo sapien
gagtccactgagagccgcagcagct

SEQ ID NO: 622309 - DNA, 25 bp, Homo sapien
agtccactgagagccgcagcagctt

SEQ ID NO: 622310 - DNA, 25 bp, Homo sapien
tgagagccgcagcagcttctcacag

SEQ ID NO: 622311 - DNA, 25 bp, Homo sapien
gagagccgcagcagcttctcacagc

SEQ ID NO: 622312 - DNA, 25 bp, Homo sapien
agcttctcacagcacgcacgcacta

SEQ ID NO: 622313 - DNA, 25 bp, Homo sapien
atggagatgacctgctccatcacca

SEQ ID NO: 622314 - DNA, 25 bp, Homo sapien
acccgggaggctgacacaccaggat

SEQ ID NO: 622315 - DNA, 25 bp, Homo sapien
ccgggaggctgacacaccaggatct

SEQ ID NO: 622316 - DNA, 25 bp, Homo sapien
cgggaggctgacacaccaggatctc

SEQ ID NO: 622317 - DNA, 25 bp, Homo sapien
ggaggctgacacaccaggatctcct

SEQ ID NO: 622318 - DNA, 25 bp, Homo sapien
gaggctgacacaccaggatctcctg

SEQ ID NO: 622319 - DNA, 25 bp, Homo sapien
aggctgacacaccaggatctcctga

SEQ ID NO: 622320 - DNA, 25 bp, Homo sapien
ggctgacacaccaggatctcctgaa

SEQ ID NO: 622321 - DNA, 25 bp, Homo sapien
gatctcctgaacccgaacccgggag

SEQ ID NO: 622322 - DNA, 25 bp, Homo sapien
gaaatacttaacgtatgcatgagtg

SEQ ID NO: 622323 - DNA, 25 bp, Homo sapien
atacttaacgtatgcatgagtgaca

SEQ ID NO: 622324 - DNA, 25 bp, Homo sapien
cttaacgtatgcatgagtgacagcg

SEQ ID NO: 622325 - DNA, 25 bp, Homo sapien
aagtggagtccctccaaatctgtga

SEQ ID NO: 622326 - DNA, 25 bp, Homo sapien
aatctgtgacaaaaccagttgccaa

SEQ ID NO: 622327 - DNA, 25 bp, Homo sapien
gctgagccaaaagctaagaagtctg

SEQ ID NO: 622328 - DNA, 25 bp, Homo sapien
gaagtctgaacttgctataccaaag

SEQ ID NO: 622329 - DNA, 25 bp, Homo sapien
ataccaaagaatccagcaagcaacg

SEQ ID NO: 622330 - DNA, 25 bp, Homo sapien
acgattcatgccctgctttggaaaa

SEQ ID NO: 622331 - DNA, 25 bp, Homo sapien
agaagccaattcaggccctaattca

SEQ ID NO: 622332 - DNA, 25 bp, Homo sapien
caggccctaattcaatcatgattgt

SEQ ID NO: 622333 - DNA, 25 bp, Homo sapien
tgattgtccttgtcatgctgttgaa

SEQ ID NO: 622334 - DNA, 25 bp, Homo sapien
tgctgttgaatatcgggttggccat

SEQ ID NO: 622335 - DNA, 25 bp, Homo sapien
gaaagttgaatatcgggttggccat

SEQ ID NO: 622336 - DNA, 25 bp, Homo sapien
gaaagccaattctgattgtttgaat

SEQ ID NO: 622337 - DNA, 25 bp, Homo sapien
aatgagagcacgtctgcatgggagt

SEQ ID NO: 622338 - DNA, 25 bp, Homo sapien
accccttccttgtgtgcatcgtggg

SEQ ID NO: 622339 - DNA, 25 bp, Homo sapien
ttgtttgtgaggtcccttaaccact

SEQ ID NO: 622340 - DNA, 25 bp, Homo sapien
ttttctctttgctccagcccagggt

SEQ ID NO: 622341 - DNA, 25 bp, Homo sapien
tccagcccagggtctaggagtgtga

SEQ ID NO: 622342 - DNA, 25 bp, Homo sapien
gagtgtgacctcgaaagcactgccc

SEQ ID NO: 622343 - DNA, 25 bp, Homo sapien
tcagtctgcatcaggcagtctggtt

SEQ ID NO: 622344 - DNA, 25 bp, Homo sapien
gcagtctggtttggttattgccatg

SEQ ID NO: 622345 - DNA, 25 bp, Homo sapien
tattgccatgtgtgcttgtcagaca

SEQ ID NO: 622346 - DNA, 25 bp, Homo sapien
acagtatagctgtgcagtggcccca

SEQ ID NO: 622347 - DNA, 25 bp, Homo sapien
agtagagagttctcacagactcctg

SEQ ID NO: 622348 - DNA, 25 bp, Homo sapien
gttctcacagactcctgaaggaata

SEQ ID NO: 622349 - DNA, 25 bp, Homo sapien
tataacgatgttttaattaccaact

SEQ ID NO: 622350 - DNA, 25 bp, Homo sapien
gaaaatatctactgaatcgcgacta

SEQ ID NO: 622351 - DNA, 25 bp, Homo sapien
tgaatcgcgactagcagatacccag

SEQ ID NO: 622352 - DNA, 25 bp, Homo sapien
agcagatacccaggtctgttcagca

SEQ ID NO: 622353 - DNA, 25 bp, Homo sapien
aggtctgttcagcacctgtactctc

SEQ ID NO: 622354 - DNA, 25 bp, Homo sapien
actctcccctaggtctgctgaggaa

SEQ ID NO: 622355 - DNA, 25 bp, Homo sapien
gtctgctgaggaacagatcaattct

SEQ ID NO: 622356 - DNA, 25 bp, Homo sapien
gatcaattctgttggagttgacctt

SEQ ID NO: 622357 - DNA, 25 bp, Homo sapien
ctgttggagttgaccttgaaattta

SEQ ID NO: 622358 - DNA, 25 bp, Homo sapien
cacctaggctatatgagcaatacag

SEQ ID NO: 622359 - DNA, 25 bp, Homo sapien
taggctatatgagcaatacagccta

SEQ ID NO: 622360 - DNA, 25 bp, Homo sapien
gctcttaggcttcaaacttgtacga

SEQ ID NO: 622361 - DNA, 25 bp, Homo sapien
tcttaggcttcaaacttgtacgaca

SEQ ID NO: 622362 - DNA, 25 bp, Homo sapien
ttaggcttcaaacttgtacgacatg

SEQ ID NO: 622363 - DNA, 25 bp, Homo sapien
taggcttcaaacttgtacgacatgt

SEQ ID NO: 622364 - DNA, 25 bp, Homo sapien
ggcttcaaacttgtacgacatgtca

SEQ ID NO: 622365 - DNA, 25 bp, Homo sapien
gcttcaaacttgtacgacatgtcac

SEQ ID NO: 622366 - DNA, 25 bp, Homo sapien
ttcaaacttgtacgacatgtcactg

SEQ ID NO: 622367 - DNA, 25 bp, Homo sapien
caaacttgtacgacatgtcactgta

SEQ ID NO: 622368 - DNA, 25 bp, Homo sapien
acttgtacgacatgtcactgtactg

SEQ ID NO: 622369 - DNA, 25 bp, Homo sapien
tgctgtggacagttgcacaggctgt

SEQ ID NO: 622370 - DNA, 25 bp, Homo sapien
gacagttgcacaggctgtggcctgt

SEQ ID NO: 622371 - DNA, 25 bp, Homo sapien
tgcacaggctgtggcctgtaccaga

SEQ ID NO: 622372 - DNA, 25 bp, Homo sapien
cagaagaaggagtcactgttcattc

SEQ ID NO: 622373 - DNA, 25 bp, Homo sapien
aagaaggagtcactgttcattctga

SEQ ID NO: 622374 - DNA, 25 bp, Homo sapien
tctgagcaaaaagcccttttgtata

SEQ ID NO: 622375 - DNA, 25 bp, Homo sapien
ccttttgtatatttagttagagcta

SEQ ID NO: 622376 - DNA, 25 bp, Homo sapien
gtgtgtgtgctttttagagatttac

SEQ ID NO: 622377 - DNA, 25 bp, Homo sapien
gagatttacattttactagtgtgag

SEQ ID NO: 622378 - DNA, 25 bp, Homo sapien
tgagcagagctcatggaaaaactgt

SEQ ID NO: 622379 - DNA, 25 bp, Homo sapien
gctcatggaaaaactgttcctgttt

SEQ ID NO: 622380 - DNA, 25 bp, Homo sapien
tgtccctgcataacatttcctctga

SEQ ID NO: 622381 - DNA, 25 bp, Homo sapien
tacctcctaaaagccctatctccaa

SEQ ID NO: 622382 - DNA, 25 bp, Homo sapien
ccctatctccaaataggtatcatat

SEQ ID NO: 622383 - DNA, 25 bp, Homo sapien
tggaggctggggtttcaacacacaa

SEQ ID NO: 622384 - DNA, 25 bp, Homo sapien
tcaacacacaaaatttgggaggact

SEQ ID NO: 622385 - DNA, 25 bp, Homo sapien
atttgggaggacttaattcagttca

SEQ ID NO: 622386 - DNA, 25 bp, Homo sapien
ggaggacttaattcagttcagagca

SEQ ID NO: 622387 - DNA, 25 bp, Homo sapien
gagcagagtttttagcttaacaata

SEQ ID NO: 622388 - DNA, 25 bp, Homo sapien
tagcttaacaatattttaggacaaa

SEQ ID NO: 622389 - DNA, 25 bp, Homo sapien
ttttcccccataacacagccagtga

SEQ ID NO: 622390 - DNA, 25 bp, Homo sapien
gatgagggcaacgagacaagttaat

SEQ ID NO: 622391 - DNA, 25 bp, Homo sapien
attctcaggtgtctacttcttctat

SEQ ID NO: 622392 - DNA, 25 bp, Homo sapien
tacttcttctatcccgattgacttt

SEQ ID NO: 622393 - DNA, 25 bp, Homo sapien
gattgactttagctcctcaagggca

SEQ ID NO: 622394 - DNA, 25 bp, Homo sapien
tcctcaagggcagaaactatatcat

SEQ ID NO: 622395 - DNA, 25 bp, Homo sapien
gtatttgttctaactccagcacagg

SEQ ID NO: 622396 - DNA, 25 bp, Homo sapien
ccagcacagggccttgtacatagaa

SEQ ID NO: 622397 - DNA, 25 bp, Homo sapien
acggacgagtttctaacatgcttaa

SEQ ID NO: 622398 - DNA, 25 bp, Homo sapien
tttctaacatgcttaaccttttctc

SEQ ID NO: 622399 - DNA, 25 bp, Homo sapien
tttctcagagaataagctagttacc

SEQ ID NO: 622400 - DNA, 25 bp, Homo sapien
aagctagttacctgagtgaggactt

SEQ ID NO: 622401 - DNA, 25 bp, Homo sapien
gagtgaggacttactacttatttaa

SEQ ID NO: 622402 - DNA, 25 bp, Homo sapien
aagaaagagtttaggtccaggcacg

SEQ ID NO: 622403 - DNA, 25 bp, Homo sapien
gaaagagtttaggtccaggcacggt

SEQ ID NO: 622404 - DNA, 25 bp, Homo sapien
aaagagtttaggtccaggcacggtg

SEQ ID NO: 622405 - DNA, 25 bp, Homo sapien
aagagtttaggtccaggcacggtgg

SEQ ID NO: 622406 - DNA, 25 bp, Homo sapien
gggccaaggagggtggttcaactga

SEQ ID NO: 622407 - DNA, 25 bp, Homo sapien
gccagggtggtggaaccccatccct

SEQ ID NO: 622408 - DNA, 25 bp, Homo sapien
ctaaagatgctgatattggccaggc

SEQ ID NO: 622409 - DNA, 25 bp, Homo sapien
aaagatgctgatattggccaggcgt

SEQ ID NO: 622410 - DNA, 25 bp, Homo sapien
aagatgctgatattggccaggcgta

SEQ ID NO: 622411 - DNA, 25 bp, Homo sapien
agatgctgatattggccaggcgtag

SEQ ID NO: 622412 - DNA, 25 bp, Homo sapien
gatgctgatattggccaggcgtagt

SEQ ID NO: 622413 - DNA, 25 bp, Homo sapien
tgatagaaaaaacatgggctaggcc

SEQ ID NO: 622414 - DNA, 25 bp, Homo sapien
gatagaaaaaacatgggctaggccg

SEQ ID NO: 622415 - DNA, 25 bp, Homo sapien
atagaaaaaacatgggctaggccgg

SEQ ID NO: 622416 - DNA, 25 bp, Homo sapien
tagaaaaaacatgggctaggccggg

SEQ ID NO: 622417 - DNA, 25 bp, Homo sapien
aaaaacatgggctaggccgggtgcg

SEQ ID NO: 622418 - DNA, 25 bp, Homo sapien
aaaacatgggctaggccgggtgcgg

SEQ ID NO: 622419 - DNA, 25 bp, Homo sapien
aaacatgggctaggccgggtgcggt

SEQ ID NO: 622420 - DNA, 25 bp, Homo sapien
aacatgggctaggccgggtgcggtg

SEQ ID NO: 622421 - DNA, 25 bp, Homo sapien
gctgaggtgggcgattcatgaggtc

SEQ ID NO: 622422 - DNA, 25 bp, Homo sapien
ctgaggtgggcgattcatgaggtca

SEQ ID NO: 622423 - DNA, 25 bp, Homo sapien
gaggtggaggttgcaccactgtact

SEQ ID NO: 622424 - DNA, 25 bp, Homo sapien
ctgatcagggcaaagctcgtttagt

SEQ ID NO: 622425 - DNA, 25 bp, Homo sapien
agctcgtttagtgctcatgaggccc

SEQ ID NO: 622426 - DNA, 25 bp, Homo sapien
gctcatgaggccctgcgaggcaaca

SEQ ID NO: 622427 - DNA, 25 bp, Homo sapien
gcaacacctgccgtgctatggttag

SEQ ID NO: 622428 - DNA, 25 bp, Homo sapien
gaaggacgctgaagctctgaaaggt

SEQ ID NO: 622429 - DNA, 25 bp, Homo sapien
gccccattcctaacagctggacaat

SEQ ID NO: 622430 - DNA, 25 bp, Homo sapien
ggacaatgcgggaagcctagctgcc

SEQ ID NO: 622431 - DNA, 25 bp, Homo sapien
ggaagcctagctgcccagtgggttc

SEQ ID NO: 622432 - DNA, 25 bp, Homo sapien
tgggttcccaaaggctccagggtgc

SEQ ID NO: 622433 - DNA, 25 bp, Homo sapien
aaggctccagggtgcttttgacgtt

SEQ ID NO: 622434 - DNA, 25 bp, Homo sapien
cttttgacgttgagctgggcctgcc

SEQ ID NO: 622435 - DNA, 25 bp, Homo sapien
cttgtgtatccttctagaaattttt

SEQ ID NO: 622436 - DNA, 25 bp, Homo sapien
ttgtgtatccttctagaaatttttt

SEQ ID NO: 622437 - DNA, 25 bp, Homo sapien
tgtgtatccttctagaaatttttta

SEQ ID NO: 622438 - DNA, 25 bp, Homo sapien
gaaattttttatggctaggtatggt

SEQ ID NO: 622439 - DNA, 25 bp, Homo sapien
aaattttttatggctaggtatggtg

SEQ ID NO: 622440 - DNA, 25 bp, Homo sapien
aattttttatggctaggtatggtgg

SEQ ID NO: 622441 - DNA, 25 bp, Homo sapien
attttttatggctaggtatggtggc

SEQ ID NO: 622442 - DNA, 25 bp, Homo sapien
ttttttatggctaggtatggtggct

SEQ ID NO: 622443 - DNA, 25 bp, Homo sapien
tttttatggctaggtatggtggctc

SEQ ID NO: 622444 - DNA, 25 bp, Homo sapien
ttttatggctaggtatggtggctca

SEQ ID NO: 622445 - DNA, 25 bp, Homo sapien
tggtcccggcacattgggaggcgga

SEQ ID NO: 622446 - DNA, 25 bp, Homo sapien
tgcatataactcttcaatgatcaga

SEQ ID NO: 622447 - DNA, 25 bp, Homo sapien
atgcttttgtggaggcaactgctat

SEQ ID NO: 622448 - DNA, 25 bp, Homo sapien
gaggcaactgctatgcttgaaagaa

SEQ ID NO: 622449 - DNA, 25 bp, Homo sapien
aagaacatagatggcctttgaagta

SEQ ID NO: 622450 - DNA, 25 bp, Homo sapien
tttcattcaaagtcaagttccgtca

SEQ ID NO: 622451 - DNA, 25 bp, Homo sapien
gtcaagttccgtcacatagtagcta

SEQ ID NO: 622452 - DNA, 25 bp, Homo sapien
gtcacatagtagctacggaatcata

SEQ ID NO: 622453 - DNA, 25 bp, Homo sapien
caaattatctaacatctgcaacctt

SEQ ID NO: 622454 - DNA, 25 bp, Homo sapien
aatccttgacctgcagtcattataa

SEQ ID NO: 622455 - DNA, 25 bp, Homo sapien
gtcattataatgaaatctggagcca

SEQ ID NO: 622456 - DNA, 25 bp, Homo sapien
tgatggatatatgaacctttggatt

SEQ ID NO: 622457 - DNA, 25 bp, Homo sapien
tattaaattaagaaatacggctggg

SEQ ID NO: 622458 - DNA, 25 bp, Homo sapien
taaattaagaaatacggctgggcgc

SEQ ID NO: 622459 - DNA, 25 bp, Homo sapien
gattgcgccactggaatccgggcct

SEQ ID NO: 622460 - DNA, 25 bp, Homo sapien
attgcgccactggaatccgggcctg

SEQ ID NO: 622461 - DNA, 25 bp, Homo sapien
ttgcgccactggaatccgggcctgg

SEQ ID NO: 622462 - DNA, 25 bp, Homo sapien
tgcgccactggaatccgggcctggg

SEQ ID NO: 622463 - DNA, 25 bp, Homo sapien
gcgccactggaatccgggcctgggg

SEQ ID NO: 622464 - DNA, 25 bp, Homo sapien
cgccactggaatccgggcctggggc

SEQ ID NO: 622465 - DNA, 25 bp, Homo sapien
gccactggaatccgggcctggggct

SEQ ID NO: 622466 - DNA, 25 bp, Homo sapien
ccactggaatccgggcctggggcta

SEQ ID NO: 622467 - DNA, 25 bp, Homo sapien
cactggaatccgggcctggggctaa

SEQ ID NO: 622468 - DNA, 25 bp, Homo sapien
gaccctgaaatatggcgtctggcct

SEQ ID NO: 622469 - DNA, 25 bp, Homo sapien
tgaaatatggcgtctggcctgcttg

SEQ ID NO: 622470 - DNA, 25 bp, Homo sapien
aatatggcgtctggcctgcttgaaa

SEQ ID NO: 622471 - DNA, 25 bp, Homo sapien
tggcgtctggcctgcttgaaagttt

SEQ ID NO: 622472 - DNA, 25 bp, Homo sapien
cgtctggcctgcttgaaagtttggg

SEQ ID NO: 622473 - DNA, 25 bp, Homo sapien
gggcagaagctgtattaaacttgtt

SEQ ID NO: 622474 - DNA, 25 bp, Homo sapien
gaagctgtattaaacttgttccgta

SEQ ID NO: 622475 - DNA, 25 bp, Homo sapien
taaacttgttccgtacacgtcctgg

SEQ ID NO: 622476 - DNA, 25 bp, Homo sapien
acttgttccgtacacgtcctggaga

SEQ ID NO: 622477 - DNA, 25 bp, Homo sapien
agatgtttttagaacggcctcgtgt

SEQ ID NO: 622478 - DNA, 25 bp, Homo sapien
aacggcctcgtgttcggtttgatgg

SEQ ID NO: 622479 - DNA, 25 bp, Homo sapien
cataacacagtttctccttgatgtc

SEQ ID NO: 622480 - DNA, 25 bp, Homo sapien
ttgatgtcccggacaatctcacgct

SEQ ID NO: 622481 - DNA, 25 bp, Homo sapien
acgctcagctgtcaaccagatacaa

SEQ ID NO: 622482 - DNA, 25 bp, Homo sapien
acattagggtctgcacaggtggcaa

SEQ ID NO: 622483 - DNA, 25 bp, Homo sapien
ggtggcaaagattcacctgccctac

SEQ ID NO: 622484 - DNA, 25 bp, Homo sapien
tctccctcaagacatgtgccatcaa

SEQ ID NO: 622485 - DNA, 25 bp, Homo sapien
gtcagttcaatattctgcaatccaa

SEQ ID NO: 622486 - DNA, 25 bp, Homo sapien
gataatgacgtagtagggccaccag

SEQ ID NO: 622487 - DNA, 25 bp, Homo sapien
acctctgttcctaggacagtgtctc

SEQ ID NO: 622488 - DNA, 25 bp, Homo sapien
cagtgtctcatgcatagtaggccct

SEQ ID NO: 622489 - DNA, 25 bp, Homo sapien
agtaggccctcagcatgcattgtct

SEQ ID NO: 622490 - DNA, 25 bp, Homo sapien
tccaaccctgtctgagaagtcaatg

SEQ ID NO: 622491 - DNA, 25 bp, Homo sapien
gataacttggaaaccacttctgaaa

SEQ ID NO: 622492 - DNA, 25 bp, Homo sapien
acttctgaaagtttgccagtcattg

SEQ ID NO: 622493 - DNA, 25 bp, Homo sapien
ccagtcattgacagagtccttttta

SEQ ID NO: 622494 - DNA, 25 bp, Homo sapien
gtcctttttacatcttctactttca

SEQ ID NO: 622495 - DNA, 25 bp, Homo sapien
tactttcaaagcttttctacacagg

SEQ ID NO: 622496 - DNA, 25 bp, Homo sapien
ttctacacaggtcaccccttttgaa

SEQ ID NO: 622497 - DNA, 25 bp, Homo sapien
ggataattatcaccagcttaccaag

SEQ ID NO: 622498 - DNA, 25 bp, Homo sapien
accagcttaccaagaatgatgctaa

SEQ ID NO: 622499 - DNA, 25 bp, Homo sapien
atgagtccccaaagatcacacagct

SEQ ID NO: 622500 - DNA, 25 bp, Homo sapien
atagacacagcaatcctggctctgc

SEQ ID NO: 622501 - DNA, 25 bp, Homo sapien
ttctttaaagaaaagttgggctgag

SEQ ID NO: 622502 - DNA, 25 bp, Homo sapien
tctttaaagaaaagttgggctgagc

SEQ ID NO: 622503 - DNA, 25 bp, Homo sapien
ctttaaagaaaagttgggctgagcg

SEQ ID NO: 622504 - DNA, 25 bp, Homo sapien
tttaaagaaaagttgggctgagcgt

SEQ ID NO: 622505 - DNA, 25 bp, Homo sapien
ttaaagaaaagttgggctgagcgtg

SEQ ID NO: 622506 - DNA, 25 bp, Homo sapien
taaagaaaagttgggctgagcgtgg

SEQ ID NO: 622507 - DNA, 25 bp, Homo sapien
aaagaaaagttgggctgagcgtggt

SEQ ID NO: 622508 - DNA, 25 bp, Homo sapien
ggatcacttaaccgcaggaggtcca

SEQ ID NO: 622509 - DNA, 25 bp, Homo sapien
atcacttaaccgcaggaggtccagg

SEQ ID NO: 622510 - DNA, 25 bp, Homo sapien
tcacttaaccgcaggaggtccaggc

SEQ ID NO: 622511 - DNA, 25 bp, Homo sapien
cacttaaccgcaggaggtccaggct

SEQ ID NO: 622512 - DNA, 25 bp, Homo sapien
ttataagagtttctggccaggcgtg

SEQ ID NO: 622513 - DNA, 25 bp, Homo sapien
tataagagtttctggccaggcgtgg

SEQ ID NO: 622514 - DNA, 25 bp, Homo sapien
ataagagtttctggccaggcgtggt

SEQ ID NO: 622515 - DNA, 25 bp, Homo sapien
taagagtttctggccaggcgtggtg

SEQ ID NO: 622516 - DNA, 25 bp, Homo sapien
aagagtttctggccaggcgtggtgg

SEQ ID NO: 622517 - DNA, 25 bp, Homo sapien
agagtttctggccaggcgtggtggc

SEQ ID NO: 622518 - DNA, 25 bp, Homo sapien
taaaaattacaaagattagccaggt

SEQ ID NO: 622519 - DNA, 25 bp, Homo sapien
tcaggagaatctcttgggctcggga

SEQ ID NO: 622520 - DNA, 25 bp, Homo sapien
gaatctcttgggctcgggaggcgga

SEQ ID NO: 622521 - DNA, 25 bp, Homo sapien
aatctcttgggctcgggaggcggag

SEQ ID NO: 622522 - DNA, 25 bp, Homo sapien
atctcttgggctcgggaggcggagg

SEQ ID NO: 622523 - DNA, 25 bp, Homo sapien
tgggaaagttggtgtccacggctct

SEQ ID NO: 622524 - DNA, 25 bp, Homo sapien
aaagttggtgtccacggctctccat

SEQ ID NO: 622525 - DNA, 25 bp, Homo sapien
tgggacattgtctttctgcctaggc

SEQ ID NO: 622526 - DNA, 25 bp, Homo sapien
gtctttctgcctaggcctggccaag

SEQ ID NO: 622527 - DNA, 25 bp, Homo sapien
tctgctggctcttgcttaagtggaa

SEQ ID NO: 622528 - DNA, 25 bp, Homo sapien
gctcttgcttaagtggaagccagca

SEQ ID NO: 622529 - DNA, 25 bp, Homo sapien
tctgggcagcaggtctttgggcact

SEQ ID NO: 622530 - DNA, 25 bp, Homo sapien
aggtctttgggcactcaggtcaaga

SEQ ID NO: 622531 - DNA, 25 bp, Homo sapien
ccaggcccagggttatgtttacagc

SEQ ID NO: 622532 - DNA, 25 bp, Homo sapien
gcccagggttatgtttacagctttg

SEQ ID NO: 622533 - DNA, 25 bp, Homo sapien
aacagcaactcccaaggctattttg

SEQ ID NO: 622534 - DNA, 25 bp, Homo sapien
taaaaacaacattttgccgggtgcg

SEQ ID NO: 622535 - DNA, 25 bp, Homo sapien
acaacattttgccgggtgcggtagc

SEQ ID NO: 622536 - DNA, 25 bp, Homo sapien
caacattttgccgggtgcggtagct

SEQ ID NO: 622537 - DNA, 25 bp, Homo sapien
aacattttgccgggtgcggtagctc

SEQ ID NO: 622538 - DNA, 25 bp, Homo sapien
acattttgccgggtgcggtagctca

SEQ ID NO: 622539 - DNA, 25 bp, Homo sapien
cattttgccgggtgcggtagctcat

SEQ ID NO: 622540 - DNA, 25 bp, Homo sapien
attttgccgggtgcggtagctcatg

SEQ ID NO: 622541 - DNA, 25 bp, Homo sapien
tttgccgggtgcggtagctcatgcc

SEQ ID NO: 622542 - DNA, 25 bp, Homo sapien
cctggcactttggaaggcctaggcg

SEQ ID NO: 622543 - DNA, 25 bp, Homo sapien
ctggcactttggaaggcctaggcgg

SEQ ID NO: 622544 - DNA, 25 bp, Homo sapien
tggcactttggaaggcctaggcggg

SEQ ID NO: 622545 - DNA, 25 bp, Homo sapien
attctagatgtaatccattggtggt

SEQ ID NO: 622546 - DNA, 25 bp, Homo sapien
atccattggtggttatatatattgc

SEQ ID NO: 622547 - DNA, 25 bp, Homo sapien
ggtggttatatatattgccaatatc

SEQ ID NO: 622548 - DNA, 25 bp, Homo sapien
cccactaatgtacatggtattcctt

SEQ ID NO: 622549 - DNA, 25 bp, Homo sapien
ttttctaagtgatgtctttcaatag

SEQ ID NO: 622550 - DNA, 25 bp, Homo sapien
ggttcttaattgtaatgtagtccac

SEQ ID NO: 622551 - DNA, 25 bp, Homo sapien
tgtaatgtagtccactttatcaatc

SEQ ID NO: 622552 - DNA, 25 bp, Homo sapien
tttatcaatctgtgttaggctgttc

SEQ ID NO: 622553 - DNA, 25 bp, Homo sapien
tataaagaaataactggccaggcac

SEQ ID NO: 622554 - DNA, 25 bp, Homo sapien
acagcagctcatgtttgtgacccta

SEQ ID NO: 622555 - DNA, 25 bp, Homo sapien
gcagctcatgtttgtgaccctagca

SEQ ID NO: 622556 - DNA, 25 bp, Homo sapien
agtacggctctaggccgcctgggca

SEQ ID NO: 622557 - DNA, 25 bp, Homo sapien
gaaataagccgcatgattgacaaga

SEQ ID NO: 622558 - DNA, 25 bp, Homo sapien
gattgacaagagctctacctgcttt

SEQ ID NO: 622559 - DNA, 25 bp, Homo sapien
tacctgcttttgtggtgatgtgcaa

SEQ ID NO: 622560 - DNA, 25 bp, Homo sapien
gatgtgcaatttcaccatgaatttc

SEQ ID NO: 622561 - DNA, 25 bp, Homo sapien
accctctgaggtggttagccccatt

SEQ ID NO: 622562 - DNA, 25 bp, Homo sapien
gtggttagccccattttattgttga

SEQ ID NO: 622563 - DNA, 25 bp, Homo sapien
ggttaagtcactcacctataatcat

SEQ ID NO: 622564 - DNA, 25 bp, Homo sapien
aatcatacaggttgttcccaggccc

SEQ ID NO: 622565 - DNA, 25 bp, Homo sapien
tgactctggatcacctgctgtagta

SEQ ID NO: 622566 - DNA, 25 bp, Homo sapien
atcacctgctgtagtacggctctag

SEQ ID NO: 622567 - DNA, 25 bp, Homo sapien
gttaccgagctattcagaaaagaaa

SEQ ID NO: 622568 - DNA, 25 bp, Homo sapien
ttaccgagctattcagaaaagaaag

SEQ ID NO: 622569 - DNA, 25 bp, Homo sapien
taccgagctattcagaaaagaaagt

SEQ ID NO: 622570 - DNA, 25 bp, Homo sapien
accgagctattcagaaaagaaagtg

SEQ ID NO: 622571 - DNA, 25 bp, Homo sapien
ccgagctattcagaaaagaaagtgc

SEQ ID NO: 622572 - DNA, 25 bp, Homo sapien
cgagctattcagaaaagaaagtgca

SEQ ID NO: 622573 - DNA, 25 bp, Homo sapien
gagctattcagaaaagaaagtgcag

SEQ ID NO: 622574 - DNA, 25 bp, Homo sapien
agctattcagaaaagaaagtgcagg

SEQ ID NO: 622575 - DNA, 25 bp, Homo sapien
tattcagaaaagaaagtgcagggct

SEQ ID NO: 622576 - DNA, 25 bp, Homo sapien
attcagaaaagaaagtgcagggctg

SEQ ID NO: 622577 - DNA, 25 bp, Homo sapien
aaagaaagtgcagggctgggcgcgg

SEQ ID NO: 622578 - DNA, 25 bp, Homo sapien
aatcacgcttctgtgtgtaatgcct

SEQ ID NO: 622579 - DNA, 25 bp, Homo sapien
tgtgtgtaatgcctgatccatcggg

SEQ ID NO: 622580 - DNA, 25 bp, Homo sapien
tgggcaagtcgcagaacacctgcaa

SEQ ID NO: 622581 - DNA, 25 bp, Homo sapien
aacacctgcaaatccacatctgtaa

SEQ ID NO: 622582 - DNA, 25 bp, Homo sapien
actgtgctgtgctgatgtcctgagc

SEQ ID NO: 622583 - DNA, 25 bp, Homo sapien
tgtgctgatgtcctgagccaccctg

SEQ ID NO: 622584 - DNA, 25 bp, Homo sapien
accctgcctggttgagtgtgttgac

SEQ ID NO: 622585 - DNA, 25 bp, Homo sapien
tgcagttcctcccaggttgtcatgt

SEQ ID NO: 622586 - DNA, 25 bp, Homo sapien
cctcccaggttgtcatgttgtgtga

SEQ ID NO: 622587 - DNA, 25 bp, Homo sapien
tcatgttgtgtgactgcagaggaca

SEQ ID NO: 622588 - DNA, 25 bp, Homo sapien
tgcagaggacaaagcttcactcccc

SEQ ID NO: 622589 - DNA, 25 bp, Homo sapien
aatgtccagtaacatgaagatgctg

SEQ ID NO: 622590 - DNA, 25 bp, Homo sapien
gaagatgctgaactttcctagtcat

SEQ ID NO: 622591 - DNA, 25 bp, Homo sapien
gctgaactttcctagtcatttaggg

SEQ ID NO: 622592 - DNA, 25 bp, Homo sapien
gggaaatcaccacaaatatatctgg

SEQ ID NO: 622593 - DNA, 25 bp, Homo sapien
atatatctggctgatcaggttgaaa

SEQ ID NO: 622594 - DNA, 25 bp, Homo sapien
ctggctgatcaggttgaaagttaaa

SEQ ID NO: 622595 - DNA, 25 bp, Homo sapien
tcccttatagaggactctcagtaag

SEQ ID NO: 622596 - DNA, 25 bp, Homo sapien
gaggactctcagtaagtcacttaca

SEQ ID NO: 622597 - DNA, 25 bp, Homo sapien
gtcacttacacaagaatcctaattt

SEQ ID NO: 622598 - DNA, 25 bp, Homo sapien
gctgcttccaggagacctgacttag

SEQ ID NO: 622599 - DNA, 25 bp, Homo sapien
gcttccaggagacctgacttagaaa

SEQ ID NO: 622600 - DNA, 25 bp, Homo sapien
aggttgcctcccatcgtttgcagga

SEQ ID NO: 622601 - DNA, 25 bp, Homo sapien
atcgtttgcaggagcggaagacccg

SEQ ID NO: 622602 - DNA, 25 bp, Homo sapien
gatggagcaggtttcacagtgccct

SEQ ID NO: 622603 - DNA, 25 bp, Homo sapien
gtttcatctgcacgtctctttcaat

SEQ ID NO: 622604 - DNA, 25 bp, Homo sapien
gtctctttcaatgcgggcgtgcgaa

SEQ ID NO: 622605 - DNA, 25 bp, Homo sapien
atgcgggcgtgcgaacttccaggta

SEQ ID NO: 622606 - DNA, 25 bp, Homo sapien
acttccaggtagagccgagttcaag

SEQ ID NO: 622607 - DNA, 25 bp, Homo sapien
gaagtactgcatgcgacgagcaagt

SEQ ID NO: 622608 - DNA, 25 bp, Homo sapien
accctcattatgtcagttactacta

SEQ ID NO: 622609 - DNA, 25 bp, Homo sapien
gaaattagaacttcactgccctttt

SEQ ID NO: 622610 - DNA, 25 bp, Homo sapien
ttttctttttcccatcgaggtgcag

SEQ ID NO: 622611 - DNA, 25 bp, Homo sapien
aaatatcactggacagcattttcaa

SEQ ID NO: 622612 - DNA, 25 bp, Homo sapien
attcagtgagtcttatgtatccctt

SEQ ID NO: 622613 - DNA, 25 bp, Homo sapien
gtatcccttcatggtaaagtcatca

SEQ ID NO: 622614 - DNA, 25 bp, Homo sapien
aagtcatcagattgacctttggcat

SEQ ID NO: 622615 - DNA, 25 bp, Homo sapien
attgacctttggcatgggcagcatg

SEQ ID NO: 622616 - DNA, 25 bp, Homo sapien
ggcagcatggaacagacaattcctg

SEQ ID NO: 622617 - DNA, 25 bp, Homo sapien
ataatctccttgaggcactgtcttc

SEQ ID NO: 622618 - DNA, 25 bp, Homo sapien
actgtcttcaccactttacttcttg

SEQ ID NO: 622619 - DNA, 25 bp, Homo sapien
tacttcttgttgctaatatttctga

SEQ ID NO: 622620 - DNA, 25 bp, Homo sapien
ttttaggaagccacactagcctgtg

SEQ ID NO: 622621 - DNA, 25 bp, Homo sapien
caggcagttcagagcttggttgata

SEQ ID NO: 622622 - DNA, 25 bp, Homo sapien
gggcttttaggatgtgattaggtca

SEQ ID NO: 622623 - DNA, 25 bp, Homo sapien
aaaagagacttcagagagctccttt

SEQ ID NO: 622624 - DNA, 25 bp, Homo sapien
aagagacttcagagagctcctttcc

SEQ ID NO: 622625 - DNA, 25 bp, Homo sapien
agagacttcagagagctcctttccc

SEQ ID NO: 622626 - DNA, 25 bp, Homo sapien
gacttcagagagctcctttcccctt

SEQ ID NO: 622627 - DNA, 25 bp, Homo sapien
aagatggccatctgtgaactaataa

SEQ ID NO: 622628 - DNA, 25 bp, Homo sapien
gatggccatctgtgaactaataagg

SEQ ID NO: 622629 - DNA, 25 bp, Homo sapien
ggccatctgtgaactaataaggcag

SEQ ID NO: 622630 - DNA, 25 bp, Homo sapien
ctgtgaactaataaggcagccctca

SEQ ID NO: 622631 - DNA, 25 bp, Homo sapien
gacatcaaatctgatgacactttga

SEQ ID NO: 622632 - DNA, 25 bp, Homo sapien
tcaaatctgatgacactttgatctt

SEQ ID NO: 622633 - DNA, 25 bp, Homo sapien
aaacaataagaaaatcacagccggg

SEQ ID NO: 622634 - DNA, 25 bp, Homo sapien
aacaataagaaaatcacagccgggt

SEQ ID NO: 622635 - DNA, 25 bp, Homo sapien
acaataagaaaatcacagccgggtg

SEQ ID NO: 622636 - DNA, 25 bp, Homo sapien
caataagaaaatcacagccgggtgt

SEQ ID NO: 622637 - DNA, 25 bp, Homo sapien
aataagaaaatcacagccgggtgtg

SEQ ID NO: 622638 - DNA, 25 bp, Homo sapien
ataagaaaatcacagccgggtgtgg

SEQ ID NO: 622639 - DNA, 25 bp, Homo sapien
taagaaaatcacagccgggtgtggt

SEQ ID NO: 622640 - DNA, 25 bp, Homo sapien
aagaaaatcacagccgggtgtggtg

SEQ ID NO: 622641 - DNA, 25 bp, Homo sapien
agaaaatcacagccgggtgtggtgg

SEQ ID NO: 622642 - DNA, 25 bp, Homo sapien
aggcgggaggatggcgtgagcccgg

SEQ ID NO: 622643 - DNA, 25 bp, Homo sapien
gcgggaggatggcgtgagcccggga

SEQ ID NO: 622644 - DNA, 25 bp, Homo sapien
aaacaaattggggctgggtacagtg

SEQ ID NO: 622645 - DNA, 25 bp, Homo sapien
aacaaattggggctgggtacagtgg

SEQ ID NO: 622646 - DNA, 25 bp, Homo sapien
caaaaaatgcaaaaattagacaggt

SEQ ID NO: 622647 - DNA, 25 bp, Homo sapien
aaaaaatgcaaaaattagacaggtg

SEQ ID NO: 622648 - DNA, 25 bp, Homo sapien
aaattagacaggtgtggtggcgtgc

SEQ ID NO: 622649 - DNA, 25 bp, Homo sapien
aattagacaggtgtggtggcgtgca

SEQ ID NO: 622650 - DNA, 25 bp, Homo sapien
attagacaggtgtggtggcgtgcac

SEQ ID NO: 622651 - DNA, 25 bp, Homo sapien
ttagacaggtgtggtggcgtgcacc

SEQ ID NO: 622652 - DNA, 25 bp, Homo sapien
tttacaattttgtctccttcaataa

SEQ ID NO: 622653 - DNA, 25 bp, Homo sapien
acaattttgtctccttcaataacaa

SEQ ID NO: 622654 - DNA, 25 bp, Homo sapien
taagatttgatgaacttctgtaaac

SEQ ID NO: 622655 - DNA, 25 bp, Homo sapien
agatttgatgaacttctgtaaacat

SEQ ID NO: 622656 - DNA, 25 bp, Homo sapien
aaacattttgctcaatatcattgta

SEQ ID NO: 622657 - DNA, 25 bp, Homo sapien
cattttgctcaatatcattgtattt

SEQ ID NO: 622658 - DNA, 25 bp, Homo sapien
attttgtgctttgtaaattagctgt

SEQ ID NO: 622659 - DNA, 25 bp, Homo sapien
tgctttgtaaattagctgtactgag

SEQ ID NO: 622660 - DNA, 25 bp, Homo sapien
aaattagctgtactgagttaccaag

SEQ ID NO: 622661 - DNA, 25 bp, Homo sapien
ttagctgtactgagttaccaagtaa

SEQ ID NO: 622662 - DNA, 25 bp, Homo sapien
gctgtactgagttaccaagtaataa

SEQ ID NO: 622663 - DNA, 25 bp, Homo sapien
agaataacaccacctccactcataa

SEQ ID NO: 622664 - DNA, 25 bp, Homo sapien
acctccactcataagtctttgcagt

SEQ ID NO: 622665 - DNA, 25 bp, Homo sapien
aagtctttgcagtatcctctgagcg

SEQ ID NO: 622666 - DNA, 25 bp, Homo sapien
tttgcagtatcctctgagcgtcaag

SEQ ID NO: 622667 - DNA, 25 bp, Homo sapien
tatcctctgagcgtcaagacacgtg

SEQ ID NO: 622668 - DNA, 25 bp, Homo sapien
gagcgtcaagacacgtgttgctttc

SEQ ID NO: 622669 - DNA, 25 bp, Homo sapien
gacacgtgttgctttcactaaagga

SEQ ID NO: 622670 - DNA, 25 bp, Homo sapien
gactggaataacgagtgatcatcaa

SEQ ID NO: 622671 - DNA, 25 bp, Homo sapien
ggaggttttaattgcacagttgtga

SEQ ID NO: 622672 - DNA, 25 bp, Homo sapien
attgcacagttgtgaggtttgggtt

SEQ ID NO: 622673 - DNA, 25 bp, Homo sapien
gtttgggttgtcaggctgagaaaat

SEQ ID NO: 622674 - DNA, 25 bp, Homo sapien
acatgcctgtagtgctcgggtggct

SEQ ID NO: 622675 - DNA, 25 bp, Homo sapien
tagtgctcgggtggctgagatggga

SEQ ID NO: 622676 - DNA, 25 bp, Homo sapien
gaagatggcagctgcaataagctga

SEQ ID NO: 622677 - DNA, 25 bp, Homo sapien
cgccactgtacgcaagcctaaacaa

SEQ ID NO: 622678 - DNA, 25 bp, Homo sapien
gtacgcaagcctaaacaacctgagt

SEQ ID NO: 622679 - DNA, 25 bp, Homo sapien
cgcaagcctaaacaacctgagtgag

SEQ ID NO: 622680 - DNA, 25 bp, Homo sapien
aaacaaataccctccctgagcttca

SEQ ID NO: 622681 - DNA, 25 bp, Homo sapien
aacaaataccctccctgagcttcag

SEQ ID NO: 622682 - DNA, 25 bp, Homo sapien
tgagcttcagttcccctaatggtaa

SEQ ID NO: 622683 - DNA, 25 bp, Homo sapien
gcttcagttcccctaatggtaaaat

SEQ ID NO: 622684 - DNA, 25 bp, Homo sapien
cagttcccctaatggtaaaatagag

SEQ ID NO: 622685 - DNA, 25 bp, Homo sapien
tagggacttagtttttattgacatt

SEQ ID NO: 622686 - DNA, 25 bp, Homo sapien
gggacttagtttttattgacattgt

SEQ ID NO: 622687 - DNA, 25 bp, Homo sapien
cttagtttttattgacattgtgctt

SEQ ID NO: 622688 - DNA, 25 bp, Homo sapien
ttgacattgtgcttttattccctag

SEQ ID NO: 622689 - DNA, 25 bp, Homo sapien
tgacattgtgcttttattccctaga

SEQ ID NO: 622690 - DNA, 25 bp, Homo sapien
gacattgtgcttttattccctagag

SEQ ID NO: 622691 - DNA, 25 bp, Homo sapien
acattgtgcttttattccctagaga

SEQ ID NO: 622692 - DNA, 25 bp, Homo sapien
attgtgcttttattccctagagacc

SEQ ID NO: 622693 - DNA, 25 bp, Homo sapien
ttgtgcttttattccctagagaccc

SEQ ID NO: 622694 - DNA, 25 bp, Homo sapien
tgtgcttttattccctagagaccct

SEQ ID NO: 622695 - DNA, 25 bp, Homo sapien
tttattccctagagaccctgaaata

SEQ ID NO: 622696 - DNA, 25 bp, Homo sapien
tacttgccttttcaaatagcttgtg

SEQ ID NO: 622697 - DNA, 25 bp, Homo sapien
acttgccttttcaaatagcttgtgc

SEQ ID NO: 622698 - DNA, 25 bp, Homo sapien
ttgccttttcaaatagcttgtgctt

SEQ ID NO: 622699 - DNA, 25 bp, Homo sapien
tgccttttcaaatagcttgtgcttt

SEQ ID NO: 622700 - DNA, 25 bp, Homo sapien
gacttttattcagtgagtaaaactt

SEQ ID NO: 622701 - DNA, 25 bp, Homo sapien
tctttgttgctggactaacaggtag

SEQ ID NO: 622702 - DNA, 25 bp, Homo sapien
ctttgttgctggactaacaggtagt

SEQ ID NO: 622703 - DNA, 25 bp, Homo sapien
ttgttgctggactaacaggtagtca

SEQ ID NO: 622704 - DNA, 25 bp, Homo sapien
gttgctggactaacaggtagtcagt

SEQ ID NO: 622705 - DNA, 25 bp, Homo sapien
gctggactaacaggtagtcagtaat

SEQ ID NO: 622706 - DNA, 25 bp, Homo sapien
ctaacaggtagtcagtaatatttgt

SEQ ID NO: 622707 - DNA, 25 bp, Homo sapien
tttaattgtgatcatttcactcatg

SEQ ID NO: 622708 - DNA, 25 bp, Homo sapien
ttaattgtgatcatttcactcatgt

SEQ ID NO: 622709 - DNA, 25 bp, Homo sapien
taattgtgatcatttcactcatgta

SEQ ID NO: 622710 - DNA, 25 bp, Homo sapien
aattgtgatcatttcactcatgtat

SEQ ID NO: 622711 - DNA, 25 bp, Homo sapien
tttcactcatgtattacatatttca

SEQ ID NO: 622712 - DNA, 25 bp, Homo sapien
tcactcatgtattacatatttcaaa

SEQ ID NO: 622713 - DNA, 25 bp, Homo sapien
tatttcaaaattatcgggccaggcg

SEQ ID NO: 622714 - DNA, 25 bp, Homo sapien
atttcaaaattatcgggccaggcgc

SEQ ID NO: 622715 - DNA, 25 bp, Homo sapien
tttcaaaattatcgggccaggcgcg

SEQ ID NO: 622716 - DNA, 25 bp, Homo sapien
ttcaaaattatcgggccaggcgcgg

SEQ ID NO: 622717 - DNA, 25 bp, Homo sapien
agcttgtagccagccaagatcgtgc

SEQ ID NO: 622718 - DNA, 25 bp, Homo sapien
aatagcaaaagcagacacctttgcc

SEQ ID NO: 622719 - DNA, 25 bp, Homo sapien
ttgccttgttcctgagcttagagca

SEQ ID NO: 622720 - DNA, 25 bp, Homo sapien
tcctgagcttagagcagaagctttt

SEQ ID NO: 622721 - DNA, 25 bp, Homo sapien
agaagctttttgtctttcaccctgg

SEQ ID NO: 622722 - DNA, 25 bp, Homo sapien
ttgtctttcaccctggagtacattg

SEQ ID NO: 622723 - DNA, 25 bp, Homo sapien
tcaccctggagtacattgtttgatg

SEQ ID NO: 622724 - DNA, 25 bp, Homo sapien
tacttttttgagtgttttcaccctg

SEQ ID NO: 622725 - DNA, 25 bp, Homo sapien
taaaatacttttctctgcatccatg

SEQ ID NO: 622726 - DNA, 25 bp, Homo sapien
acttttctctgcatccatgaggtga

SEQ ID NO: 622727 - DNA, 25 bp, Homo sapien
tccatgaggtgatcaatgtttcttt

SEQ ID NO: 622728 - DNA, 25 bp, Homo sapien
aattcatgttttaagatatccttgc

SEQ ID NO: 622729 - DNA, 25 bp, Homo sapien
cacctaggctatatgagcaatacag

SEQ ID NO: 622730 - DNA, 25 bp, Homo sapien
taggctatatgagcaatacagccta

SEQ ID NO: 622731 - DNA, 25 bp, Homo sapien
gctcttaggcttcaaacttgtacga

SEQ ID NO: 622732 - DNA, 25 bp, Homo sapien
cttaggcttcaaacttgtacgacat

SEQ ID NO: 622733 - DNA, 25 bp, Homo sapien
taggcttcaaacttgtacgacatgt

SEQ ID NO: 622734 - DNA, 25 bp, Homo sapien
ggcttcaaacttgtacgacatgtca

SEQ ID NO: 622735 - DNA, 25 bp, Homo sapien
ttcaaacttgtacgacatgtcactg

SEQ ID NO: 622736 - DNA, 25 bp, Homo sapien
caaacttgtacgacatgtcactgta

SEQ ID NO: 622737 - DNA, 25 bp, Homo sapien
acttgtacgacatgtcactgtactg

SEQ ID NO: 622738 - DNA, 25 bp, Homo sapien
acgacatgtcactgtactgaatact

SEQ ID NO: 622739 - DNA, 25 bp, Homo sapien
atatgtggttcattgttggccgaaa

SEQ ID NO: 622740 - DNA, 25 bp, Homo sapien
tctgcctcttacaagctatatgcct

SEQ ID NO: 622741 - DNA, 25 bp, Homo sapien
gcctcttacaagctatatgcctttg

SEQ ID NO: 622742 - DNA, 25 bp, Homo sapien
tacaagctatatgcctttggtcagg

SEQ ID NO: 622743 - DNA, 25 bp, Homo sapien
agctatatgcctttggtcaggtcac

SEQ ID NO: 622744 - DNA, 25 bp, Homo sapien
tatatgcctttggtcaggtcacttt

SEQ ID NO: 622745 - DNA, 25 bp, Homo sapien
gcctttggtcaggtcactttacctc

SEQ ID NO: 622746 - DNA, 25 bp, Homo sapien
tttggtcaggtcactttacctccct

SEQ ID NO: 622747 - DNA, 25 bp, Homo sapien
ggtcaggtcactttacctccctggt

SEQ ID NO: 622748 - DNA, 25 bp, Homo sapien
cactttacctccctggtcttcagtt

SEQ ID NO: 622749 - DNA, 25 bp, Homo sapien
taaaaatactaactcccagcctggg

SEQ ID NO: 622750 - DNA, 25 bp, Homo sapien
taaatggggattcgcctgtagtctc

SEQ ID NO: 622751 - DNA, 25 bp, Homo sapien
tctgcctcttacaagctatatgcct

SEQ ID NO: 622752 - DNA, 25 bp, Homo sapien
gcctcttacaagctatatgcctttg

SEQ ID NO: 622753 - DNA, 25 bp, Homo sapien
tacaagctatatgcctttggtcagg

SEQ ID NO: 622754 - DNA, 25 bp, Homo sapien
aagctatatgcctttggtcaggtca

SEQ ID NO: 622755 - DNA, 25 bp, Homo sapien
gctatatgcctttggtcaggtcact

SEQ ID NO: 622756 - DNA, 25 bp, Homo sapien
tatatgcctttggtcaggtcacttt

SEQ ID NO: 622757 - DNA, 25 bp, Homo sapien
gcctttggtcaggtcactttacctc

SEQ ID NO: 622758 - DNA, 25 bp, Homo sapien
tttggtcaggtcactttacctccct

SEQ ID NO: 622759 - DNA, 25 bp, Homo sapien
ggtcaggtcactttacctccctggt

SEQ ID NO: 622760 - DNA, 25 bp, Homo sapien
cactttacctccctggtcttcagtt

SEQ ID NO: 622761 - DNA, 25 bp, Homo sapien
taaatggggattcgcctgtagtctc

SEQ ID NO: 622762 - DNA, 25 bp, Homo sapien
ataaacactattgcagaacttcctg

SEQ ID NO: 622763 - DNA, 25 bp, Homo sapien
tgcagaacttcctgtgacagcccac

SEQ ID NO: 622764 - DNA, 25 bp, Homo sapien
gtgacagcccacctcaaagcaaagg

SEQ ID NO: 622765 - DNA, 25 bp, Homo sapien
acctcaaagcaaagggctccaatgt

SEQ ID NO: 622766 - DNA, 25 bp, Homo sapien
aagcaaagggctccaatgtttgagt

SEQ ID NO: 622767 - DNA, 25 bp, Homo sapien
gggctccaatgtttgagtgaggcta

SEQ ID NO: 622768 - DNA, 25 bp, Homo sapien
aatgtttgagtgaggctagcacgtg

SEQ ID NO: 622769 - DNA, 25 bp, Homo sapien
gattttaggcagctctccttttccc

SEQ ID NO: 622770 - DNA, 25 bp, Homo sapien
ttttcccccagttatggacttgctc

SEQ ID NO: 622771 - DNA, 25 bp, Homo sapien
tctctctttcaacggctcactatct

SEQ ID NO: 622772 - DNA, 25 bp, Homo sapien
tctttcaacggctcactatcttgcc

SEQ ID NO: 622773 - DNA, 25 bp, Homo sapien
gccaacatttggtatgatcagacta

SEQ ID NO: 622774 - DNA, 25 bp, Homo sapien
gatcagactattttattatagccat

SEQ ID NO: 622775 - DNA, 25 bp, Homo sapien
gactagtgatgttggacttcttttc

SEQ ID NO: 622776 - DNA, 25 bp, Homo sapien
gttggacttcttttcatagtgctta

SEQ ID NO: 622777 - DNA, 25 bp, Homo sapien
cttttcatagtgcttattgggcatt

SEQ ID NO: 622778 - DNA, 25 bp, Homo sapien
catagtgcttattgggcatttgtat

SEQ ID NO: 622779 - DNA, 25 bp, Homo sapien
tgtctattaaattttcttgcccttt

SEQ ID NO: 622780 - DNA, 25 bp, Homo sapien
actgaattgcaggaggtgactttga

SEQ ID NO: 622781 - DNA, 25 bp, Homo sapien
attgcaggaggtgactttgaaaagt

SEQ ID NO: 622782 - DNA, 25 bp, Homo sapien
aagtttttcattttggatcaaatct

SEQ ID NO: 622783 - DNA, 25 bp, Homo sapien
aatatattttcccagatcgtggccc

SEQ ID NO: 622784 - DNA, 25 bp, Homo sapien
aaaattcaactaccttatcttactg

SEQ ID NO: 622785 - DNA, 25 bp, Homo sapien
gctatgaatgtacaaatctaatcct

SEQ ID NO: 622786 - DNA, 25 bp, Homo sapien
aaatctaatcctaggccagtgaaaa

SEQ ID NO: 622787 - DNA, 25 bp, Homo sapien
atcctaggccagtgaaaaattacat

SEQ ID NO: 622788 - DNA, 25 bp, Homo sapien
aaattacatctttttagctcattat

SEQ ID NO: 622789 - DNA, 25 bp, Homo sapien
gctcattataactagattacctcat

SEQ ID NO: 622790 - DNA, 25 bp, Homo sapien
gaatcccaacttttaagaatgcttt

SEQ ID NO: 622791 - DNA, 25 bp, Homo sapien
gaatgctttccttatatgcatgtac

SEQ ID NO: 622792 - DNA, 25 bp, Homo sapien
atatgcatgtacttcctaccgttaa

SEQ ID NO: 622793 - DNA, 25 bp, Homo sapien
gtacttcctaccgttaatgccttag

SEQ ID NO: 622794 - DNA, 25 bp, Homo sapien
tcctaccgttaatgccttagggaga

SEQ ID NO: 622795 - DNA, 25 bp, Homo sapien
tctgaagtcactgcatttattccct

SEQ ID NO: 622796 - DNA, 25 bp, Homo sapien
tgatcctcatttgcaggtccagtac

SEQ ID NO: 622797 - DNA, 25 bp, Homo sapien
gcaggtccagtaccttgtacaagtt

SEQ ID NO: 622798 - DNA, 25 bp, Homo sapien
taccttgtacaagtttctttttgtg

SEQ ID NO: 622799 - DNA, 25 bp, Homo sapien
ttttgtgccatattagactgtaagc

SEQ ID NO: 622800 - DNA, 25 bp, Homo sapien
gcagggcccaagtcttatgaatttg

SEQ ID NO: 622801 - DNA, 25 bp, Homo sapien
gggcccaagtcttatgaatttgtgt

SEQ ID NO: 622802 - DNA, 25 bp, Homo sapien
gaatttgtgtctgcatagtgtctag

SEQ ID NO: 622803 - DNA, 25 bp, Homo sapien
gtctgcatagtgtctagtacttgtc

SEQ ID NO: 622804 - DNA, 25 bp, Homo sapien
gtctagtacttgtctgaggcccaca

SEQ ID NO: 622805 - DNA, 25 bp, Homo sapien
gtacttgtctgaggcccacaataaa

SEQ ID NO: 622806 - DNA, 25 bp, Homo sapien
tgtacttcagtttgtttccccactc

SEQ ID NO: 622807 - DNA, 25 bp, Homo sapien
tacttcagtttgtttccccactcat

SEQ ID NO: 622808 - DNA, 25 bp, Homo sapien
tccccactcatctagtaataaaagt

SEQ ID NO: 622809 - DNA, 25 bp, Homo sapien
aatagtctgaacttgtgtttccagt

SEQ ID NO: 622810 - DNA, 25 bp, Homo sapien
gtctgaacttgtgtttccagtatgg

SEQ ID NO: 622811 - DNA, 25 bp, Homo sapien
aacttgtgtttccagtatggtagcc

SEQ ID NO: 622812 - DNA, 25 bp, Homo sapien
atggtagccacttaccatatgtggc

SEQ ID NO: 622813 - DNA, 25 bp, Homo sapien
atatgtggctaaattgcgatgtgct

SEQ ID NO: 622814 - DNA, 25 bp, Homo sapien
ggctaaattgcgatgtgctataact

SEQ ID NO: 622815 - DNA, 25 bp, Homo sapien
aattgcgatgtgctataactataag

SEQ ID NO: 622816 - DNA, 25 bp, Homo sapien
gcgatgtgctataactataaggtaa

SEQ ID NO: 622817 - DNA, 25 bp, Homo sapien
tgggttatctgcctctaagtgtgcc

SEQ ID NO: 622818 - DNA, 25 bp, Homo sapien
cttctcccactatttttcacatggt

SEQ ID NO: 622819 - DNA, 25 bp, Homo sapien
cacatggtgacttaggaacagtttc

SEQ ID NO: 622820 - DNA, 25 bp, Homo sapien
gaacagtttcagtctgaccttgtca

SEQ ID NO: 622821 - DNA, 25 bp, Homo sapien
cattcaggccttgagtggtgtccta

SEQ ID NO: 622822 - DNA, 25 bp, Homo sapien
gacaaaatccacatcttagcctggc

SEQ ID NO: 622823 - DNA, 25 bp, Homo sapien
gtctctaggtatttatcctccagga

SEQ ID NO: 622824 - DNA, 25 bp, Homo sapien
aaatagctactccactagcctggct

SEQ ID NO: 622825 - DNA, 25 bp, Homo sapien
ggctcagcaccagggctaggcagaa

SEQ ID NO: 622826 - DNA, 25 bp, Homo sapien
gattgtagcacagtttaccaagttt

SEQ ID NO: 622827 - DNA, 25 bp, Homo sapien
accaagtttctgttattgagctaaa

SEQ ID NO: 622828 - DNA, 25 bp, Homo sapien
agtcaaactctagaccatgcttgcc

SEQ ID NO: 622829 - DNA, 25 bp, Homo sapien
atgcttgcctcttcaggcacttggc

SEQ ID NO: 622830 - DNA, 25 bp, Homo sapien
aggcacttggctctctcagcacaaa

SEQ ID NO: 622831 - DNA, 25 bp, Homo sapien
ggctctctcagcacaaatataacag

SEQ ID NO: 622832 - DNA, 25 bp, Homo sapien
tataacaggtctttgcactccaggc

SEQ ID NO: 622833 - DNA, 25 bp, Homo sapien
ccaagagtgaactctggaggcctga

SEQ ID NO: 622834 - DNA, 25 bp, Homo sapien
aatcaggcctgaagtgccctccttt

SEQ ID NO: 622835 - DNA, 25 bp, Homo sapien
ccaaagcctgcttcagatggctggg

SEQ ID NO: 622836 - DNA, 25 bp, Homo sapien
ctgccggtctgccaagaagagcttg

SEQ ID NO: 622837 - DNA, 25 bp, Homo sapien
attaaggccctcaggtttcgcactt

SEQ ID NO: 622838 - DNA, 25 bp, Homo sapien
gtttcgcacttatttccccagaact

SEQ ID NO: 622839 - DNA, 25 bp, Homo sapien
agagcacattcactttattcccagt

SEQ ID NO: 622840 - DNA, 25 bp, Homo sapien
tcccagtcagaagtggtctcatttg

SEQ ID NO: 622841 - DNA, 25 bp, Homo sapien
ggtctcatttgatggtaatacaccc

SEQ ID NO: 622842 - DNA, 25 bp, Homo sapien
ggtaatacacccattcaattttcag

SEQ ID NO: 622843 - DNA, 25 bp, Homo sapien
cagttgcatgttgaattaccttaca

SEQ ID NO: 622844 - DNA, 25 bp, Homo sapien
ttgtatgttaacttcccatggcctg

SEQ ID NO: 622845 - DNA, 25 bp, Homo sapien
gtgagggcgctttagttaaaccata

SEQ ID NO: 622846 - DNA, 25 bp, Homo sapien
atggctacttactcatggactctcg

SEQ ID NO: 622847 - DNA, 25 bp, Homo sapien
catggactctcgcttgacaagattg

SEQ ID NO: 622848 - DNA, 25 bp, Homo sapien
gacaagattgtaaacttcactggaa

SEQ ID NO: 622849 - DNA, 25 bp, Homo sapien
actggaaagtcctgaggttctactt

SEQ ID NO: 622850 - DNA, 25 bp, Homo sapien
ttcctcttcctctggtagcagataa

SEQ ID NO: 622851 - DNA, 25 bp, Homo sapien
ctcttcctctggtagcagataagta

SEQ ID NO: 622852 - DNA, 25 bp, Homo sapien
gaagaggtggcaattttatttcttt

SEQ ID NO: 622853 - DNA, 25 bp, Homo sapien
aagagattaacaaagttgctggttt

SEQ ID NO: 622854 - DNA, 25 bp, Homo sapien
acaaagttgctggttttggtgggat

SEQ ID NO: 622855 - DNA, 25 bp, Homo sapien
tttggtgggattgctcctgattggt

SEQ ID NO: 622856 - DNA, 25 bp, Homo sapien
tgggattgctcctgattggtggtaa

SEQ ID NO: 622857 - DNA, 25 bp, Homo sapien
attgctcctgattggtggtaaaaga

SEQ ID NO: 622858 - DNA, 25 bp, Homo sapien
ctcctgattggtggtaaaagaaagc

SEQ ID NO: 622859 - DNA, 25 bp, Homo sapien
gaaagcagcacataaatgcttatga

SEQ ID NO: 622860 - DNA, 25 bp, Homo sapien
tgcttatgataagcaggctgggtgc

SEQ ID NO: 622861 - DNA, 25 bp, Homo sapien
aaaaatttgtgggtgccaagactca

SEQ ID NO: 622862 - DNA, 25 bp, Homo sapien
aaaatttgtgggtgccaagactcaa

SEQ ID NO: 622863 - DNA, 25 bp, Homo sapien
aaatttgtgggtgccaagactcaag

SEQ ID NO: 622864 - DNA, 25 bp, Homo sapien
aatttgtgggtgccaagactcaaga

SEQ ID NO: 622865 - DNA, 25 bp, Homo sapien
agaccatgggagctggtcgggcaca

SEQ ID NO: 622866 - DNA, 25 bp, Homo sapien
accatgggagctggtcgggcacagt

SEQ ID NO: 622867 - DNA, 25 bp, Homo sapien
gaggcatcggctgcagtgagtgaag

SEQ ID NO: 622868 - DNA, 25 bp, Homo sapien
tgagtgaagatcgagacactgccct

SEQ ID NO: 622869 - DNA, 25 bp, Homo sapien
gagtgaagatcgagacactgccctc

SEQ ID NO: 622870 - DNA, 25 bp, Homo sapien
agtgaagatcgagacactgccctcc

SEQ ID NO: 622871 - DNA, 25 bp, Homo sapien
gtgaagatcgagacactgccctcca

SEQ ID NO: 622872 - DNA, 25 bp, Homo sapien
caacgagtggcagcataggtgagca

SEQ ID NO: 622873 - DNA, 25 bp, Homo sapien
gcagcataggtgagcagagcagaaa

SEQ ID NO: 622874 - DNA, 25 bp, Homo sapien
gcataggtgagcagagcagaaagca

SEQ ID NO: 622875 - DNA, 25 bp, Homo sapien
gagcagaaagcaggtgtggacaggt

SEQ ID NO: 622876 - DNA, 25 bp, Homo sapien
tgtctaggcagggactagctgtcca

SEQ ID NO: 622877 - DNA, 25 bp, Homo sapien
cagggactagctgtccagggcacat

SEQ ID NO: 622878 - DNA, 25 bp, Homo sapien
ggactagctgtccagggcacatctg

SEQ ID NO: 622879 - DNA, 25 bp, Homo sapien
gactagctgtccagggcacatctgt

SEQ ID NO: 622880 - DNA, 25 bp, Homo sapien
atctgtggtttgtggaaacacaata

SEQ ID NO: 622881 - DNA, 25 bp, Homo sapien
caataataagagctgatttcaccat

SEQ ID NO: 622882 - DNA, 25 bp, Homo sapien
aataagagctgatttcaccatctct

SEQ ID NO: 622883 - DNA, 25 bp, Homo sapien
gggtttcattctctcttactatata

SEQ ID NO: 622884 - DNA, 25 bp, Homo sapien
atatatagggtgtcagagcagggca

SEQ ID NO: 622885 - DNA, 25 bp, Homo sapien
agagcagggcactgtttctcacact

SEQ ID NO: 622886 - DNA, 25 bp, Homo sapien
cactgtttctcacactaactttcgt

SEQ ID NO: 622887 - DNA, 25 bp, Homo sapien
tcacactaactttcgttttctttct

SEQ ID NO: 622888 - DNA, 25 bp, Homo sapien
ctggcgctttgtagtactccttgtg

SEQ ID NO: 622889 - DNA, 25 bp, Homo sapien
gctttgtagtactccttgtgttgaa

SEQ ID NO: 622890 - DNA, 25 bp, Homo sapien
aagtattcatttggctgttaatcta

SEQ ID NO: 622891 - DNA, 25 bp, Homo sapien
ttggctgttaatctatccttgtacc

SEQ ID NO: 622892 - DNA, 25 bp, Homo sapien
atccttgtacctgtataacaccgta

SEQ ID NO: 622893 - DNA, 25 bp, Homo sapien
aacaccgtacaagttactgtatctt

SEQ ID NO: 622894 - DNA, 25 bp, Homo sapien
gggcttttaggatgtgattaggtca

SEQ ID NO: 622895 - DNA, 25 bp, Homo sapien
taggtcatgagtgtggaaccttcat

SEQ ID NO: 622896 - DNA, 25 bp, Homo sapien
aagagacttcagagagctcctttcc

SEQ ID NO: 622897 - DNA, 25 bp, Homo sapien
agagacttcagagagctcctttccc

SEQ ID NO: 622898 - DNA, 25 bp, Homo sapien
gacttcagagagctcctttcccctt

SEQ ID NO: 622899 - DNA, 25 bp, Homo sapien
aagatggccatctgtgaactaataa

SEQ ID NO: 622900 - DNA, 25 bp, Homo sapien
gatggccatctgtgaactaataagg

SEQ ID NO: 622901 - DNA, 25 bp, Homo sapien
ctgtgaactaataaggcagccctca

SEQ ID NO: 622902 - DNA, 25 bp, Homo sapien
ataaggcagccctcattagacatca

SEQ ID NO: 622903 - DNA, 25 bp, Homo sapien
gacatcaaatctgatgacactttga

SEQ ID NO: 622904 - DNA, 25 bp, Homo sapien
tcaaatctgatgacactttgatctt

SEQ ID NO: 622905 - DNA, 25 bp, Homo sapien
ttgttggaaagcctagccctctcag

SEQ ID NO: 622906 - DNA, 25 bp, Homo sapien
agccctctcagattcagggttcaga

SEQ ID NO: 622907 - DNA, 25 bp, Homo sapien
aaattgtctgactagcccttagcct

SEQ ID NO: 622908 - DNA, 25 bp, Homo sapien
agcccttagcctcagaatggtcaac

SEQ ID NO: 622909 - DNA, 25 bp, Homo sapien
agtggtgatctcatatagtcagctt

SEQ ID NO: 622910 - DNA, 25 bp, Homo sapien
tagtcagctttttcatgaacattaa

SEQ ID NO: 622911 - DNA, 25 bp, Homo sapien
aattcatggtgaatgcactcacagc

SEQ ID NO: 622912 - DNA, 25 bp, Homo sapien
gcactcacagcaaccaaaatccaaa

SEQ ID NO: 622913 - DNA, 25 bp, Homo sapien
aaaccttaaacattagcttggctca

SEQ ID NO: 622914 - DNA, 25 bp, Homo sapien
gcttggctcattgagttcttggtac

SEQ ID NO: 622915 - DNA, 25 bp, Homo sapien
agttcttggtacaacctgcttttca

SEQ ID NO: 622916 - DNA, 25 bp, Homo sapien
agtgctgacccggtggcaccagaag

SEQ ID NO: 622917 - DNA, 25 bp, Homo sapien
ggtggcaccagaagccaggcctgcc

SEQ ID NO: 622918 - DNA, 25 bp, Homo sapien
ctgcctgagcccaatgccaagagac

SEQ ID NO: 622919 - DNA, 25 bp, Homo sapien
tgagcccaatgccaagagaccctga

SEQ ID NO: 622920 - DNA, 25 bp, Homo sapien
aatgccaagagaccctgatcgccag

SEQ ID NO: 622921 - DNA, 25 bp, Homo sapien
aagagaccctgatcgccaggcttca

SEQ ID NO: 622922 - DNA, 25 bp, Homo sapien
agaccgccctgtagaatctgccagg

SEQ ID NO: 622923 - DNA, 25 bp, Homo sapien
tgccagggattctcaggacatgact

SEQ ID NO: 622924 - DNA, 25 bp, Homo sapien
gcaaacattttcttgttaagtactg

SEQ ID NO: 622925 - DNA, 25 bp, Homo sapien
ttaaactttattcatgctcacacat

SEQ ID NO: 622926 - DNA, 25 bp, Homo sapien
actttattcatgctcacacatctga

SEQ ID NO: 622927 - DNA, 25 bp, Homo sapien
ttcactcaacccgttttgtttctca

SEQ ID NO: 622928 - DNA, 25 bp, Homo sapien
cccgttttgtttctcatggtggatg

SEQ ID NO: 622929 - DNA, 25 bp, Homo sapien
ggtggatgaacgactctaaaaccat

SEQ ID NO: 622930 - DNA, 25 bp, Homo sapien
gactctaaaaccatcttgcttcgtt

SEQ ID NO: 622931 - DNA, 25 bp, Homo sapien
atcttgcttcgttatgtgttccctg

SEQ ID NO: 622932 - DNA, 25 bp, Homo sapien
atgtgttccctggtttaacatcctc

SEQ ID NO: 622933 - DNA, 25 bp, Homo sapien
ttaacatcctcctcactcaaaacaa

SEQ ID NO: 622934 - DNA, 25 bp, Homo sapien
tcaaaacaacagcagctccccagag

SEQ ID NO: 622935 - DNA, 25 bp, Homo sapien
taatccccgctctgccagcatggtg

SEQ ID NO: 622936 - DNA, 25 bp, Homo sapien
cttgggttttcaacaaatgtcctga

SEQ ID NO: 622937 - DNA, 25 bp, Homo sapien
ttcaacaaatgtcctgacccagcag

SEQ ID NO: 622938 - DNA, 25 bp, Homo sapien
gcatgatagaaaaaacatgggctag

SEQ ID NO: 622939 - DNA, 25 bp, Homo sapien
catgatagaaaaaacatgggctagg

SEQ ID NO: 622940 - DNA, 25 bp, Homo sapien
atgatagaaaaaacatgggctaggc

SEQ ID NO: 622941 - DNA, 25 bp, Homo sapien
tgatagaaaaaacatgggctaggcc

SEQ ID NO: 622942 - DNA, 25 bp, Homo sapien
gatagaaaaaacatgggctaggccg

SEQ ID NO: 622943 - DNA, 25 bp, Homo sapien
atagaaaaaacatgggctaggccgg

SEQ ID NO: 622944 - DNA, 25 bp, Homo sapien
tagaaaaaacatgggctaggccggg

SEQ ID NO: 622945 - DNA, 25 bp, Homo sapien
gaaaaaacatgggctaggccgggtg

SEQ ID NO: 622946 - DNA, 25 bp, Homo sapien
aaaaacatgggctaggccgggtgcg

SEQ ID NO: 622947 - DNA, 25 bp, Homo sapien
aaaacatgggctaggccgggtgcgg

SEQ ID NO: 622948 - DNA, 25 bp, Homo sapien
ccaacatggtgaagtagatagagta

SEQ ID NO: 622949 - DNA, 25 bp, Homo sapien
caacatggtgaagtagatagagtag

SEQ ID NO: 622950 - DNA, 25 bp, Homo sapien
aacatggtgaagtagatagagtaga

SEQ ID NO: 622951 - DNA, 25 bp, Homo sapien
acatggtgaagtagatagagtagag

SEQ ID NO: 622952 - DNA, 25 bp, Homo sapien
catggtgaagtagatagagtagaga

SEQ ID NO: 622953 - DNA, 25 bp, Homo sapien
ggtgaagtagatagagtagagacat

SEQ ID NO: 622954 - DNA, 25 bp, Homo sapien
tagagacatggtagtctctactaaa

SEQ ID NO: 622955 - DNA, 25 bp, Homo sapien
agagacatggtagtctctactaaaa

SEQ ID NO: 622956 - DNA, 25 bp, Homo sapien
cctgagaaacgagcaaaactcggtc

SEQ ID NO: 622957 - DNA, 25 bp, Homo sapien
ctgagaaacgagcaaaactcggtct

SEQ ID NO: 622958 - DNA, 25 bp, Homo sapien
tgagaaacgagcaaaactcggtctc

SEQ ID NO: 622959 - DNA, 25 bp, Homo sapien
tccgagaggcctcctatttggcaga

SEQ ID NO: 622960 - DNA, 25 bp, Homo sapien
gaggcctcctatttggcagagattt

SEQ ID NO: 622961 - DNA, 25 bp, Homo sapien
tatttggcagagatttccccaccta

SEQ ID NO: 622962 - DNA, 25 bp, Homo sapien
cagagatttccccacctattaagac

SEQ ID NO: 622963 - DNA, 25 bp, Homo sapien
tattaagacccaaggccctgcctgg

SEQ ID NO: 622964 - DNA, 25 bp, Homo sapien
caaggccctgcctggagcgggacgt

SEQ ID NO: 622965 - DNA, 25 bp, Homo sapien
aaaagaacatttcacttccggcctg

SEQ ID NO: 622966 - DNA, 25 bp, Homo sapien
gaacatttcacttccggcctgcaaa

SEQ ID NO: 622967 - DNA, 25 bp, Homo sapien
ttcacttccggcctgcaaacctgaa

SEQ ID NO: 622968 - DNA, 25 bp, Homo sapien
tgggcgcgggtgaagtttttctcca

SEQ ID NO: 622969 - DNA, 25 bp, Homo sapien
aagtttttctccagcgcctagggca

SEQ ID NO: 622970 - DNA, 25 bp, Homo sapien
ccaacatggtgaagtagatagagta

SEQ ID NO: 622971 - DNA, 25 bp, Homo sapien
caacatggtgaagtagatagagtag

SEQ ID NO: 622972 - DNA, 25 bp, Homo sapien
aacatggtgaagtagatagagtaga

SEQ ID NO: 622973 - DNA, 25 bp, Homo sapien
acatggtgaagtagatagagtagag

SEQ ID NO: 622974 - DNA, 25 bp, Homo sapien
catggtgaagtagatagagtagaga

SEQ ID NO: 622975 - DNA, 25 bp, Homo sapien
ggtgaagtagatagagtagagacat

SEQ ID NO: 622976 - DNA, 25 bp, Homo sapien
tagagtagagacatggtagtctcta

SEQ ID NO: 622977 - DNA, 25 bp, Homo sapien
agagtagagacatggtagtctctac

SEQ ID NO: 622978 - DNA, 25 bp, Homo sapien
gtagagacatggtagtctctactaa

SEQ ID NO: 622979 - DNA, 25 bp, Homo sapien
tagagacatggtagtctctactaaa

SEQ ID NO: 622980 - DNA, 25 bp, Homo sapien
cctgagaaacgagcaaaactcggtc

SEQ ID NO: 622981 - DNA, 25 bp, Homo sapien
ctgtttaatgtttctaaatgtgtgt

SEQ ID NO: 622982 - DNA, 25 bp, Homo sapien
gataaggtttatctacttcagtcaa

SEQ ID NO: 622983 - DNA, 25 bp, Homo sapien
ggtttatctacttcagtcaaagcgg

SEQ ID NO: 622984 - DNA, 25 bp, Homo sapien
tatctacttcagtcaaagcggtaaa

SEQ ID NO: 622985 - DNA, 25 bp, Homo sapien
aagcggtaaaatgataatgccagta

SEQ ID NO: 622986 - DNA, 25 bp, Homo sapien
gataatgccagtagactataagata

SEQ ID NO: 622987 - DNA, 25 bp, Homo sapien
gtaatgtagtacctaaagcagccac

SEQ ID NO: 622988 - DNA, 25 bp, Homo sapien
gtagtacctaaagcagccacttaaa

SEQ ID NO: 622989 - DNA, 25 bp, Homo sapien
gtacctaaagcagccacttaaaagc

SEQ ID NO: 622990 - DNA, 25 bp, Homo sapien
gccacttaaaagctatacaaaggag

SEQ ID NO: 622991 - DNA, 25 bp, Homo sapien
ggagatatactcaacagtactgtag

SEQ ID NO: 622992 - DNA, 25 bp, Homo sapien
ttttaattgtgatcatttcactcat

SEQ ID NO: 622993 - DNA, 25 bp, Homo sapien
tttaattgtgatcatttcactcatg

SEQ ID NO: 622994 - DNA, 25 bp, Homo sapien
ttaattgtgatcatttcactcatgt

SEQ ID NO: 622995 - DNA, 25 bp, Homo sapien
taattgtgatcatttcactcatgta

SEQ ID NO: 622996 - DNA, 25 bp, Homo sapien
aattgtgatcatttcactcatgtat

SEQ ID NO: 622997 - DNA, 25 bp, Homo sapien
tttcactcatgtattacatatttca

SEQ ID NO: 622998 - DNA, 25 bp, Homo sapien
ttcactcatgtattacatatttcaa

SEQ ID NO: 622999 - DNA, 25 bp, Homo sapien
tcactcatgtattacatatttcaaa

SEQ ID NO: 623000 - DNA, 25 bp, Homo sapien
tatttcaaaattatcgggccaggcg

SEQ ID NO: 623001 - DNA, 25 bp, Homo sapien
atttcaaaattatcgggccaggcgc

SEQ ID NO: 623002 - DNA, 25 bp, Homo sapien
tttcaaaattatcgggccaggcgcg

SEQ ID NO: 623003 - DNA, 25 bp, Homo sapien
gctccatgctgaagagctgcagctt

SEQ ID NO: 623004 - DNA, 25 bp, Homo sapien
agcttctgcaggacatttgtaccat

SEQ ID NO: 623005 - DNA, 25 bp, Homo sapien
tttgtaccatcgaggtcaaaggcaa

SEQ ID NO: 623006 - DNA, 25 bp, Homo sapien
gtgacatgagtttcagtccatcttc

SEQ ID NO: 623007 - DNA, 25 bp, Homo sapien
tcagtccatcttcatgaggttccag

SEQ ID NO: 623008 - DNA, 25 bp, Homo sapien
atgaggttccagttaaggcctgtga

SEQ ID NO: 623009 - DNA, 25 bp, Homo sapien
ttaaggcctgtgaattcgcaattgt

SEQ ID NO: 623010 - DNA, 25 bp, Homo sapien
aattcgcaattgttcttcccgactg

SEQ ID NO: 623011 - DNA, 25 bp, Homo sapien
tgaacctcacatactcacatcagat

SEQ ID NO: 623012 - DNA, 25 bp, Homo sapien
acaaccaccttgtagaagctgctta

SEQ ID NO: 623013 - DNA, 25 bp, Homo sapien
gcttaaccagctcttactattgcaa

SEQ ID NO: 623014 - DNA, 25 bp, Homo sapien
agcttaacctggatgccagcgtgca

SEQ ID NO: 623015 - DNA, 25 bp, Homo sapien
taacctggatgccagcgtgcagcac

SEQ ID NO: 623016 - DNA, 25 bp, Homo sapien
ctggatgccagcgtgcagcacttgg

SEQ ID NO: 623017 - DNA, 25 bp, Homo sapien
tgccagcgtgcagcacttggaggat

SEQ ID NO: 623018 - DNA, 25 bp, Homo sapien
tccagccctcggtccattaataaga

SEQ ID NO: 623019 - DNA, 25 bp, Homo sapien
cagccctcggtccattaataagaag

SEQ ID NO: 623020 - DNA, 25 bp, Homo sapien
gccctcggtccattaataagaaggc

SEQ ID NO: 623021 - DNA, 25 bp, Homo sapien
tggacaactccctgcaacccaagag

SEQ ID NO: 623022 - DNA, 25 bp, Homo sapien
gcaacccaagagtctggcagcctcc

SEQ ID NO: 623023 - DNA, 25 bp, Homo sapien
accgggactgtctgttctcagggac

SEQ ID NO: 623024 - DNA, 25 bp, Homo sapien
tgtctgttctcagggaccatctcgg

SEQ ID NO: 623025 - DNA, 25 bp, Homo sapien
caaaaactcagaaataggcagcagc

SEQ ID NO: 623026 - DNA, 25 bp, Homo sapien
aaaaactcagaaataggcagcagca

SEQ ID NO: 623027 - DNA, 25 bp, Homo sapien
aaaactcagaaataggcagcagcag

SEQ ID NO: 623028 - DNA, 25 bp, Homo sapien
aaactcagaaataggcagcagcagc

SEQ ID NO: 623029 - DNA, 25 bp, Homo sapien
actcagaaataggcagcagcagcta

SEQ ID NO: 623030 - DNA, 25 bp, Homo sapien
gcagctaaagataagcagaacaacc

SEQ ID NO: 623031 - DNA, 25 bp, Homo sapien
agctaaagataagcagaacaaccat

SEQ ID NO: 623032 - DNA, 25 bp, Homo sapien
tgttcatgttcatattcatgtaaga

SEQ ID NO: 623033 - DNA, 25 bp, Homo sapien
gttcatgttcatattcatgtaagaa

SEQ ID NO: 623034 - DNA, 25 bp, Homo sapien
tcatgttcatattcatgtaagaatg

SEQ ID NO: 623035 - DNA, 25 bp, Homo sapien
gttcatattcatgtaagaatgtatt

SEQ ID NO: 623036 - DNA, 25 bp, Homo sapien
atatctagacatttggtggactctt

SEQ ID NO: 623037 - DNA, 25 bp, Homo sapien
ttggtggactcttttagtagctgtt

SEQ ID NO: 623038 - DNA, 25 bp, Homo sapien
actcttttagtagctgttggtagga

SEQ ID NO: 623039 - DNA, 25 bp, Homo sapien
taggagagggctgcctctttgcaga

SEQ ID NO: 623040 - DNA, 25 bp, Homo sapien
gggctgcctctttgcagaagtattt

SEQ ID NO: 623041 - DNA, 25 bp, Homo sapien
atgtatttctaaactttaggctcta

SEQ ID NO: 623042 - DNA, 25 bp, Homo sapien
ggctctaaaggactgtaaattgcta

SEQ ID NO: 623043 - DNA, 25 bp, Homo sapien
gtttctactctacataattatgcat

SEQ ID NO: 623044 - DNA, 25 bp, Homo sapien
atgcatttttctttacatcctcctc

SEQ ID NO: 623045 - DNA, 25 bp, Homo sapien
ttacatcctcctccagttgaaaagc

SEQ ID NO: 623046 - DNA, 25 bp, Homo sapien
cctcctccagttgaaaagctctttg

SEQ ID NO: 623047 - DNA, 25 bp, Homo sapien
tgccttcctgcctagtctcacatgt

SEQ ID NO: 623048 - DNA, 25 bp, Homo sapien
gtcagagtcattaagcgggatccca

SEQ ID NO: 623049 - DNA, 25 bp, Homo sapien
cagagtcattaagcgggatcccagc

SEQ ID NO: 623050 - DNA, 25 bp, Homo sapien
gtcattaagcgggatcccagcatct

SEQ ID NO: 623051 - DNA, 25 bp, Homo sapien
attaagcgggatcccagcatctcag

SEQ ID NO: 623052 - DNA, 25 bp, Homo sapien
agcgggatcccagcatctcagagtc

SEQ ID NO: 623053 - DNA, 25 bp, Homo sapien
agagtccagtcaagttccctcctgc

SEQ ID NO: 623054 - DNA, 25 bp, Homo sapien
agtccagtcaagttccctcctgcag

SEQ ID NO: 623055 - DNA, 25 bp, Homo sapien
aggcagctcgagcatgccctgagct

SEQ ID NO: 623056 - DNA, 25 bp, Homo sapien
agcatgccctgagctctctgaaagt

SEQ ID NO: 623057 - DNA, 25 bp, Homo sapien
tgccctgagctctctgaaagttgtc

SEQ ID NO: 623058 - DNA, 25 bp, Homo sapien
gagcagggagcttttgaaaacatga

SEQ ID NO: 623059 - DNA, 25 bp, Homo sapien
gcagggagcttttgaaaacatgagg

SEQ ID NO: 623060 - DNA, 25 bp, Homo sapien
tttgaaaacatgagggagtacccca

SEQ ID NO: 623061 - DNA, 25 bp, Homo sapien
gaaaacatgagggagtaccccaagc

SEQ ID NO: 623062 - DNA, 25 bp, Homo sapien
aaacatgagggagtaccccaagcaa

SEQ ID NO: 623063 - DNA, 25 bp, Homo sapien
aacatgagggagtaccccaagcaag

SEQ ID NO: 623064 - DNA, 25 bp, Homo sapien
catgagggagtaccccaagcaagga

SEQ ID NO: 623065 - DNA, 25 bp, Homo sapien
agggagtaccccaagcaaggagaag

SEQ ID NO: 623066 - DNA, 25 bp, Homo sapien
ggagtaccccaagcaaggagaagag

SEQ ID NO: 623067 - DNA, 25 bp, Homo sapien
gagtgatacaaggtgagtctgacag

SEQ ID NO: 623068 - DNA, 25 bp, Homo sapien
tgatacaaggtgagtctgacaggtc

SEQ ID NO: 623069 - DNA, 25 bp, Homo sapien
ggcctggatttctagcacgaatcta

SEQ ID NO: 623070 - DNA, 25 bp, Homo sapien
tctaacagtaatttgtgggcccctt

SEQ ID NO: 623071 - DNA, 25 bp, Homo sapien
ttgtgggccccttggttcttggaag

SEQ ID NO: 623072 - DNA, 25 bp, Homo sapien
tggttcttggaagtcccctatgtta

SEQ ID NO: 623073 - DNA, 25 bp, Homo sapien
tggaagtcccctatgttactttaat

SEQ ID NO: 623074 - DNA, 25 bp, Homo sapien
tgaaagaagttgtgtgtgctctgtt

SEQ ID NO: 623075 - DNA, 25 bp, Homo sapien
ccttccacctccgagagagaattat

SEQ ID NO: 623076 - DNA, 25 bp, Homo sapien
gagaattattttttgccctataact

SEQ ID NO: 623077 - DNA, 25 bp, Homo sapien
ttttttgccctataactattgagtt

SEQ ID NO: 623078 - DNA, 25 bp, Homo sapien
gacatcttgagaataataggctttt

SEQ ID NO: 623079 - DNA, 25 bp, Homo sapien
tttaaactccagcagctaatctgat

SEQ ID NO: 623080 - DNA, 25 bp, Homo sapien
cagggacctggtattgttcacatca

SEQ ID NO: 623081 - DNA, 25 bp, Homo sapien
ggtattgttcacatcaaggcacaga

SEQ ID NO: 623082 - DNA, 25 bp, Homo sapien
gttaagtctaacgttatgagaaagt

SEQ ID NO: 623083 - DNA, 25 bp, Homo sapien
ttcctgttttaagcttcttcaatgc

SEQ ID NO: 623084 - DNA, 25 bp, Homo sapien
ttaagcttcttcaatgctattcaga

SEQ ID NO: 623085 - DNA, 25 bp, Homo sapien
aatgctattcagaactactcaaagg

SEQ ID NO: 623086 - DNA, 25 bp, Homo sapien
aaacaccagacttttagacacccag

SEQ ID NO: 623087 - DNA, 25 bp, Homo sapien
agacttttagacacccagggcagta

SEQ ID NO: 623088 - DNA, 25 bp, Homo sapien
agggcagtacaatccagcaaccgtt

SEQ ID NO: 623089 - DNA, 25 bp, Homo sapien
agtacaatccagcaaccgtttaaag

SEQ ID NO: 623090 - DNA, 25 bp, Homo sapien
cagaaagcatggtgtactactaagc

SEQ ID NO: 623091 - DNA, 25 bp, Homo sapien
atttagaaatcttggtgtgctcagc

SEQ ID NO: 623092 - DNA, 25 bp, Homo sapien
ttagaaatcttggtgtgctcagcta

SEQ ID NO: 623093 - DNA, 25 bp, Homo sapien
agaaatcttggtgtgctcagctagg

SEQ ID NO: 623094 - DNA, 25 bp, Homo sapien
gaaatcttggtgtgctcagctaggt

SEQ ID NO: 623095 - DNA, 25 bp, Homo sapien
aatcttggtgtgctcagctaggtgc

SEQ ID NO: 623096 - DNA, 25 bp, Homo sapien
atcttggtgtgctcagctaggtgca

SEQ ID NO: 623097 - DNA, 25 bp, Homo sapien
cttggtgtgctcagctaggtgcagc

SEQ ID NO: 623098 - DNA, 25 bp, Homo sapien
tgctcagctaggtgcagcgggctca

SEQ ID NO: 623099 - DNA, 25 bp, Homo sapien
gctcagctaggtgcagcgggctcac

SEQ ID NO: 623100 - DNA, 25 bp, Homo sapien
tcagctaggtgcagcgggctcacgc

SEQ ID NO: 623101 - DNA, 25 bp, Homo sapien
gctacttgagaagctaagagtggga

SEQ ID NO: 623102 - DNA, 25 bp, Homo sapien
gtacacaggtacgtaccagcacaca

SEQ ID NO: 623103 - DNA, 25 bp, Homo sapien
ggtacgtaccagcacacactgccga

SEQ ID NO: 623104 - DNA, 25 bp, Homo sapien
actgctgacagcacagtctgagcca

SEQ ID NO: 623105 - DNA, 25 bp, Homo sapien
cagtctgagccaagtgctgctgtgg

SEQ ID NO: 623106 - DNA, 25 bp, Homo sapien
ccaagtgctgctgtgggatccctgg

SEQ ID NO: 623107 - DNA, 25 bp, Homo sapien
agtagaatgaacagcgcgtcgaaca

SEQ ID NO: 623108 - DNA, 25 bp, Homo sapien
cagcgcgtcgaacaaacaggaaagt

SEQ ID NO: 623109 - DNA, 25 bp, Homo sapien
gtaggaggaagtgctcatcgcccct

SEQ ID NO: 623110 - DNA, 25 bp, Homo sapien
gccacagtgcaggaatcagccattg

SEQ ID NO: 623111 - DNA, 25 bp, Homo sapien
aggaatcagccattgccctggcaat

SEQ ID NO: 623112 - DNA, 25 bp, Homo sapien
tcaaatagaatcagagcagctgcca

SEQ ID NO: 623113 - DNA, 25 bp, Homo sapien
gagaatacctgctcagtggactgag

SEQ ID NO: 623114 - DNA, 25 bp, Homo sapien
gaagatcaaccctcaatgtaggcag

SEQ ID NO: 623115 - DNA, 25 bp, Homo sapien
atgtaggcaggcactatccaatcac

SEQ ID NO: 623116 - DNA, 25 bp, Homo sapien
tatccaatcacctgagggcccagat

SEQ ID NO: 623117 - DNA, 25 bp, Homo sapien
aattctctcttccagagctgtgaca

SEQ ID NO: 623118 - DNA, 25 bp, Homo sapien
atgcccttgtaccacacaactctag

SEQ ID NO: 623119 - DNA, 25 bp, Homo sapien
acaactctaggtcctttggcctttg

SEQ ID NO: 623120 - DNA, 25 bp, Homo sapien
gactctgacacttgcaccagtggcc

SEQ ID NO: 623121 - DNA, 25 bp, Homo sapien
gggctctcaagcctttagccttgaa

SEQ ID NO: 623122 - DNA, 25 bp, Homo sapien
gcctttagccttgaacttagttaca

SEQ ID NO: 623123 - DNA, 25 bp, Homo sapien
ttagttacaccatgtgcctccttgt

SEQ ID NO: 623124 - DNA, 25 bp, Homo sapien
atctttcatgtgactctcacaaccg

SEQ ID NO: 623125 - DNA, 25 bp, Homo sapien
tcatgtgactctcacaaccggagac

SEQ ID NO: 623126 - DNA, 25 bp, Homo sapien
tctcacaaccggagacccggacatt

SEQ ID NO: 623127 - DNA, 25 bp, Homo sapien
attggagaaaccctcagtaagagag

SEQ ID NO: 623128 - DNA, 25 bp, Homo sapien
gaaaccctcagtaagagagatccaa

SEQ ID NO: 623129 - DNA, 25 bp, Homo sapien
gagagatccaactgggttcagaccc

SEQ ID NO: 623130 - DNA, 25 bp, Homo sapien
gatccaactgggttcagaccccgag

SEQ ID NO: 623131 - DNA, 25 bp, Homo sapien
ttcagaccccgaggctgtgttgacg

SEQ ID NO: 623132 - DNA, 25 bp, Homo sapien
ttgacgggacatgaggcaggatata

SEQ ID NO: 623133 - DNA, 25 bp, Homo sapien
ggcaggatatagaccaggagccacc

SEQ ID NO: 623134 - DNA, 25 bp, Homo sapien
actgtattccatccagtctggacaa

SEQ ID NO: 623135 - DNA, 25 bp, Homo sapien
gaactttcactggttccagctagcc

SEQ ID NO: 623136 - DNA, 25 bp, Homo sapien
tccagctagccttggctgttagcaa

SEQ ID NO: 623137 - DNA, 25 bp, Homo sapien
agccttggctgttagcaattatttt

SEQ ID NO: 623138 - DNA, 25 bp, Homo sapien
gggcaggaaactaagctggcattat

SEQ ID NO: 623139 - DNA, 25 bp, Homo sapien
taagctggcattatggtcacaggaa

SEQ ID NO: 623140 - DNA, 25 bp, Homo sapien
cagactgatttggagcctttcaaac

SEQ ID NO: 623141 - DNA, 25 bp, Homo sapien
gatttggagcctttcaaactgcaga

SEQ ID NO: 623142 - DNA, 25 bp, Homo sapien
aaactgcagacctttgttactgacc

SEQ ID NO: 623143 - DNA, 25 bp, Homo sapien
gacctttgttactgaccgatgctta

SEQ ID NO: 623144 - DNA, 25 bp, Homo sapien
gatgcttaatttggtttctgggttt

SEQ ID NO: 623145 - DNA, 25 bp, Homo sapien
agagctcagctagggcaggctgcca

SEQ ID NO: 623146 - DNA, 25 bp, Homo sapien
atgaaaatggttaactggtcgggca

SEQ ID NO: 623147 - DNA, 25 bp, Homo sapien
tgaaaatggttaactggtcgggcac

SEQ ID NO: 623148 - DNA, 25 bp, Homo sapien
gaaaatggttaactggtcgggcaca

SEQ ID NO: 623149 - DNA, 25 bp, Homo sapien
aaaatggttaactggtcgggcacag

SEQ ID NO: 623150 - DNA, 25 bp, Homo sapien
aaatggttaactggtcgggcacagt

SEQ ID NO: 623151 - DNA, 25 bp, Homo sapien
tgaagccctgtatctactagaggta

SEQ ID NO: 623152 - DNA, 25 bp, Homo sapien
gaagccctgtatctactagaggtac

SEQ ID NO: 623153 - DNA, 25 bp, Homo sapien
aagccctgtatctactagaggtaca

SEQ ID NO: 623154 - DNA, 25 bp, Homo sapien
agccctgtatctactagaggtacaa

SEQ ID NO: 623155 - DNA, 25 bp, Homo sapien
gccctgtatctactagaggtacaaa

SEQ ID NO: 623156 - DNA, 25 bp, Homo sapien
ccctgtatctactagaggtacaaaa

SEQ ID NO: 623157 - DNA, 25 bp, Homo sapien
gtcgagagagctgttgttgcacccc

SEQ ID NO: 623158 - DNA, 25 bp, Homo sapien
tcgagagagctgttgttgcacccct

SEQ ID NO: 623159 - DNA, 25 bp, Homo sapien
cgagagagctgttgttgcacccctg

SEQ ID NO: 623160 - DNA, 25 bp, Homo sapien
gagagagctgttgttgcacccctgt

SEQ ID NO: 623161 - DNA, 25 bp, Homo sapien
agagagctgttgttgcacccctgtg

SEQ ID NO: 623162 - DNA, 25 bp, Homo sapien
gagagctgttgttgcacccctgtgc

SEQ ID NO: 623163 - DNA, 25 bp, Homo sapien
agagctgttgttgcacccctgtgct

SEQ ID NO: 623164 - DNA, 25 bp, Homo sapien
gagctgttgttgcacccctgtgctc

SEQ ID NO: 623165 - DNA, 25 bp, Homo sapien
gctgttgttgcacccctgtgctcca

SEQ ID NO: 623166 - DNA, 25 bp, Homo sapien
acccatagatgggcctgatcttgaa

SEQ ID NO: 623167 - DNA, 25 bp, Homo sapien
agatgggcctgatcttgaaagagat

SEQ ID NO: 623168 - DNA, 25 bp, Homo sapien
aatgacaatggctagatttttcaac

SEQ ID NO: 623169 - DNA, 25 bp, Homo sapien
gacaatggctagatttttcaacagc

SEQ ID NO: 623170 - DNA, 25 bp, Homo sapien
gtcagatgaacaatgtgtatgcctt

SEQ ID NO: 623171 - DNA, 25 bp, Homo sapien
gatgaacaatgtgtatgccttcaga

SEQ ID NO: 623172 - DNA, 25 bp, Homo sapien
tgaacaatgtgtatgccttcagact

SEQ ID NO: 623173 - DNA, 25 bp, Homo sapien
aaatgtgtccccctgccaattctat

SEQ ID NO: 623174 - DNA, 25 bp, Homo sapien
cctgccaattctatactccgaagtt

SEQ ID NO: 623175 - DNA, 25 bp, Homo sapien
ctgccaattctatactccgaagttt

SEQ ID NO: 623176 - DNA, 25 bp, Homo sapien
gccaattctatactccgaagtttaa

SEQ ID NO: 623177 - DNA, 25 bp, Homo sapien
caattctatactccgaagtttaagt

SEQ ID NO: 623178 - DNA, 25 bp, Homo sapien
tactccgaagtttaagtatagaata

SEQ ID NO: 623179 - DNA, 25 bp, Homo sapien
tgcagacgtggtatagagaatccta

SEQ ID NO: 623180 - DNA, 25 bp, Homo sapien
gagaatcctagcatctccatggaga

SEQ ID NO: 623181 - DNA, 25 bp, Homo sapien
ctccatggagaactgctaaggcaat

SEQ ID NO: 623182 - DNA, 25 bp, Homo sapien
gcaatgagttgtttagtgacacata

SEQ ID NO: 623183 - DNA, 25 bp, Homo sapien
taaaagccaagcattaccacgcgtg

SEQ ID NO: 623184 - DNA, 25 bp, Homo sapien
gcattaccacgcgtgctgaggaaag

SEQ ID NO: 623185 - DNA, 25 bp, Homo sapien
gggcagttacaaaggagatcacttt

SEQ ID NO: 623186 - DNA, 25 bp, Homo sapien
gagatcactttgtagttattggcta

SEQ ID NO: 623187 - DNA, 25 bp, Homo sapien
gttattggctaattacatgtatgtt

SEQ ID NO: 623188 - DNA, 25 bp, Homo sapien
gtatgttttatacatgcctttatac

SEQ ID NO: 623189 - DNA, 25 bp, Homo sapien
acatgcctttatacgtagattctat

SEQ ID NO: 623190 - DNA, 25 bp, Homo sapien
tgtatctaaagagctggaaaccggc

SEQ ID NO: 623191 - DNA, 25 bp, Homo sapien
gtatctaaagagctggaaaccggcc

SEQ ID NO: 623192 - DNA, 25 bp, Homo sapien
tatctaaagagctggaaaccggccg

SEQ ID NO: 623193 - DNA, 25 bp, Homo sapien
atctaaagagctggaaaccggccgg

SEQ ID NO: 623194 - DNA, 25 bp, Homo sapien
tctaaagagctggaaaccggccggg

SEQ ID NO: 623195 - DNA, 25 bp, Homo sapien
taaagagctggaaaccggccgggcg

SEQ ID NO: 623196 - DNA, 25 bp, Homo sapien
aagagctggaaaccggccgggcgcg

SEQ ID NO: 623197 - DNA, 25 bp, Homo sapien
agagctggaaaccggccgggcgcgg

SEQ ID NO: 623198 - DNA, 25 bp, Homo sapien
gagctggaaaccggccgggcgcggt

SEQ ID NO: 623199 - DNA, 25 bp, Homo sapien
agctggaaaccggccgggcgcggtg

SEQ ID NO: 623200 - DNA, 25 bp, Homo sapien
gctggaaaccggccgggcgcggtgg

SEQ ID NO: 623201 - DNA, 25 bp, Homo sapien
atgggatcagaagcctccatcttgg

SEQ ID NO: 623202 - DNA, 25 bp, Homo sapien
catcttggcccctgagtttgctgga

SEQ ID NO: 623203 - DNA, 25 bp, Homo sapien
gatattgtgggatgaaaagtcttct

SEQ ID NO: 623204 - DNA, 25 bp, Homo sapien
aaaagtcttcttgttggtctatgag

SEQ ID NO: 623205 - DNA, 25 bp, Homo sapien
gttggtctatgagtttggtacacaa

SEQ ID NO: 623206 - DNA, 25 bp, Homo sapien
tttggtacacaaacataatggagat

SEQ ID NO: 623207 - DNA, 25 bp, Homo sapien
atggagatgaaacctcggcaacata

SEQ ID NO: 623208 - DNA, 25 bp, Homo sapien
accttgtgtggttggcatgggcctc

SEQ ID NO: 623209 - DNA, 25 bp, Homo sapien
gagaaggtcagtgaactgtgccact

SEQ ID NO: 623210 - DNA, 25 bp, Homo sapien
aggtcagtgaactgtgccactgcac

SEQ ID NO: 623211 - DNA, 25 bp, Homo sapien
ctgcactagtctgcgtgacggaggg

SEQ ID NO: 623212 - DNA, 25 bp, Homo sapien
agtgggccatatgggtgccatcaga

SEQ ID NO: 623213 - DNA, 25 bp, Homo sapien
catcagatgggctcttgtttctctg

SEQ ID NO: 623214 - DNA, 25 bp, Homo sapien
tttctctgtgacctgttctgttaga

SEQ ID NO: 623215 - DNA, 25 bp, Homo sapien
ttctgttagacctctttcctgcttt

SEQ ID NO: 623216 - DNA, 25 bp, Homo sapien
ggttgtttatctgtcctctagtgaa

SEQ ID NO: 623217 - DNA, 25 bp, Homo sapien
tgtcctctagtgaaccagctggttt

SEQ ID NO: 623218 - DNA, 25 bp, Homo sapien
aggtggtgcttttctgagagtgtct

SEQ ID NO: 623219 - DNA, 25 bp, Homo sapien
gagagtgtcttgctgttaacagtta

SEQ ID NO: 623220 - DNA, 25 bp, Homo sapien
gttactatggatgtcatatgccagc

SEQ ID NO: 623221 - DNA, 25 bp, Homo sapien
gtcatatgccagctggttctgttaa

SEQ ID NO: 623222 - DNA, 25 bp, Homo sapien
aagtctgtgaatccaaagccttgaa

SEQ ID NO: 623223 - DNA, 25 bp, Homo sapien
ttaacaatattcttcccaactgggt

SEQ ID NO: 623224 - DNA, 25 bp, Homo sapien
taacaatattcttcccaactgggtg

SEQ ID NO: 623225 - DNA, 25 bp, Homo sapien
aacaatattcttcccaactgggtgc

SEQ ID NO: 623226 - DNA, 25 bp, Homo sapien
aaagcaaacaattagccaattgcaa

SEQ ID NO: 623227 - DNA, 25 bp, Homo sapien
aattagccaattgcaattagccaca

SEQ ID NO: 623228 - DNA, 25 bp, Homo sapien
agccaattgcaattagccacacctg

SEQ ID NO: 623229 - DNA, 25 bp, Homo sapien
gccaattgcaattagccacacctgt

SEQ ID NO: 623230 - DNA, 25 bp, Homo sapien
ccaattgcaattagccacacctgtg

SEQ ID NO: 623231 - DNA, 25 bp, Homo sapien
caattgcaattagccacacctgtgg

SEQ ID NO: 623232 - DNA, 25 bp, Homo sapien
attgcaattagccacacctgtggtc

SEQ ID NO: 623233 - DNA, 25 bp, Homo sapien
ttgcaattagccacacctgtggtcc

SEQ ID NO: 623234 - DNA, 25 bp, Homo sapien
ctctactgtacattccagaaaggat

SEQ ID NO: 623235 - DNA, 25 bp, Homo sapien
tactttttgacttgcacatttcttg

SEQ ID NO: 623236 - DNA, 25 bp, Homo sapien
acatttcttgcaagtatctcagaga

SEQ ID NO: 623237 - DNA, 25 bp, Homo sapien
gcaagtatctcagagacttccaggg

SEQ ID NO: 623238 - DNA, 25 bp, Homo sapien
gggaccccaaatcatactttgcaaa

SEQ ID NO: 623239 - DNA, 25 bp, Homo sapien
aactgcactaatgtgttcactcaaa

SEQ ID NO: 623240 - DNA, 25 bp, Homo sapien
aaactactttgaatgaatgtgtcca

SEQ ID NO: 623241 - DNA, 25 bp, Homo sapien
gaatgaatgtgtccattagcaaatc

SEQ ID NO: 623242 - DNA, 25 bp, Homo sapien
gcaaatcagttgcatcagtttaaga

SEQ ID NO: 623243 - DNA, 25 bp, Homo sapien
attacagtgtagtgtgcccagaaat

SEQ ID NO: 623244 - DNA, 25 bp, Homo sapien
tagtgtgcccagaaatattatagaa

SEQ ID NO: 623245 - DNA, 25 bp, Homo sapien
ggtcgagagagctgttgttgcaccc

SEQ ID NO: 623246 - DNA, 25 bp, Homo sapien
gtcgagagagctgttgttgcacccc

SEQ ID NO: 623247 - DNA, 25 bp, Homo sapien
tcgagagagctgttgttgcacccct

SEQ ID NO: 623248 - DNA, 25 bp, Homo sapien
cgagagagctgttgttgcacccctg

SEQ ID NO: 623249 - DNA, 25 bp, Homo sapien
gagagagctgttgttgcacccctgt

SEQ ID NO: 623250 - DNA, 25 bp, Homo sapien
agagagctgttgttgcacccctgtg

SEQ ID NO: 623251 - DNA, 25 bp, Homo sapien
gagagctgttgttgcacccctgtgc

SEQ ID NO: 623252 - DNA, 25 bp, Homo sapien
agagctgttgttgcacccctgtgct

SEQ ID NO: 623253 - DNA, 25 bp, Homo sapien
gagctgttgttgcacccctgtgctc

SEQ ID NO: 623254 - DNA, 25 bp, Homo sapien
gctgttgttgcacccctgtgctcca

SEQ ID NO: 623255 - DNA, 25 bp, Homo sapien
acccatagatgggcctgatcttgaa

SEQ ID NO: 623256 - DNA, 25 bp, Homo sapien
ggctgggttactttgtttcctgcaa

SEQ ID NO: 623257 - DNA, 25 bp, Homo sapien
gggttactttgtttcctgcaaatct

SEQ ID NO: 623258 - DNA, 25 bp, Homo sapien
caggagtgcaccttgtcagtcaggg

SEQ ID NO: 623259 - DNA, 25 bp, Homo sapien
ggttgcttggaaactcagtcctgga

SEQ ID NO: 623260 - DNA, 25 bp, Homo sapien
acatggtgctggctgtcaccgcaag

SEQ ID NO: 623261 - DNA, 25 bp, Homo sapien
gcaagccacagaagcaccttttctc

SEQ ID NO: 623262 - DNA, 25 bp, Homo sapien
agcagcctgcacattctggaggttc

SEQ ID NO: 623263 - DNA, 25 bp, Homo sapien
gcacattctggaggttcatatcttt

SEQ ID NO: 623264 - DNA, 25 bp, Homo sapien
ctggaggttcatatctttgggactg

SEQ ID NO: 623265 - DNA, 25 bp, Homo sapien
catatctttgggactgaaaattggg

SEQ ID NO: 623266 - DNA, 25 bp, Homo sapien
ttaaatttccgctcctgctcaggaa

SEQ ID NO: 623267 - DNA, 25 bp, Homo sapien
gaatttcccttgcaaccatctttaa

SEQ ID NO: 623268 - DNA, 25 bp, Homo sapien
actcttctggccatcaccttatttc

SEQ ID NO: 623269 - DNA, 25 bp, Homo sapien
atcaccttatttctcctgagtcggt

SEQ ID NO: 623270 - DNA, 25 bp, Homo sapien
gagtcggtttaatttttcactctgt

SEQ ID NO: 623271 - DNA, 25 bp, Homo sapien
tcactctgttcactattacctgatc

SEQ ID NO: 623272 - DNA, 25 bp, Homo sapien
tacctgatctaagccattcactcat

SEQ ID NO: 623273 - DNA, 25 bp, Homo sapien
attcactcattctctcattcgctgt

SEQ ID NO: 623274 - DNA, 25 bp, Homo sapien
cccagaatgtaaggcctataaggat

SEQ ID NO: 623275 - DNA, 25 bp, Homo sapien
aggactttgcttgtattgttcccca

SEQ ID NO: 623276 - DNA, 25 bp, Homo sapien
ttgttccccatggaattcctggtat

SEQ ID NO: 623277 - DNA, 25 bp, Homo sapien
agaagaatgcttggctcagagcagg

SEQ ID NO: 623278 - DNA, 25 bp, Homo sapien
caggtgtgatggcaatatagtgaaa

SEQ ID NO: 623279 - DNA, 25 bp, Homo sapien
ccgggcatactggtgtgccccttta

SEQ ID NO: 623280 - DNA, 25 bp, Homo sapien
cgggcatactggtgtgcccctttag

SEQ ID NO: 623281 - DNA, 25 bp, Homo sapien
gggcatactggtgtgcccctttagt

SEQ ID NO: 623282 - DNA, 25 bp, Homo sapien
ggcatactggtgtgcccctttagtc

SEQ ID NO: 623283 - DNA, 25 bp, Homo sapien
gcatactggtgtgcccctttagtca

SEQ ID NO: 623284 - DNA, 25 bp, Homo sapien
catactggtgtgcccctttagtcac

SEQ ID NO: 623285 - DNA, 25 bp, Homo sapien
atactggtgtgcccctttagtcaca

SEQ ID NO: 623286 - DNA, 25 bp, Homo sapien
actggtgtgcccctttagtcacagc

SEQ ID NO: 623287 - DNA, 25 bp, Homo sapien
ctggtgtgcccctttagtcacagct

SEQ ID NO: 623288 - DNA, 25 bp, Homo sapien
tgtgcccctttagtcacagctgctt

SEQ ID NO: 623289 - DNA, 25 bp, Homo sapien
aggttctccacaggcaacccattta

SEQ ID NO: 623290 - DNA, 25 bp, Homo sapien
gcaacccatttatcagaaccacgtg

SEQ ID NO: 623291 - DNA, 25 bp, Homo sapien
gaaccacgtggacatctttcaacta

SEQ ID NO: 623292 - DNA, 25 bp, Homo sapien
acatctttcaactatcctggacaac

SEQ ID NO: 623293 - DNA, 25 bp, Homo sapien
aacaaccatgttatttcttagccat

SEQ ID NO: 623294 - DNA, 25 bp, Homo sapien
atttcttagccattggacttccacc

SEQ ID NO: 623295 - DNA, 25 bp, Homo sapien
ggacttccaccttatctttattgag

SEQ ID NO: 623296 - DNA, 25 bp, Homo sapien
accttatctttattgagttctgcta

SEQ ID NO: 623297 - DNA, 25 bp, Homo sapien
caagaatatcttgtggaggcctgat

SEQ ID NO: 623298 - DNA, 25 bp, Homo sapien
tgtggaggcctgatgatctcaacag

SEQ ID NO: 623299 - DNA, 25 bp, Homo sapien
tgatgatctcaacaggaatttctgg

SEQ ID NO: 623300 - DNA, 25 bp, Homo sapien
agatttctaggctggctgtcactcc

SEQ ID NO: 623301 - DNA, 25 bp, Homo sapien
tttccctgttgctggttctaggccg

SEQ ID NO: 623302 - DNA, 25 bp, Homo sapien
gttgctggttctaggccggccgtaa

SEQ ID NO: 623303 - DNA, 25 bp, Homo sapien
cccggctccctttttgctgtgaagt

SEQ ID NO: 623304 - DNA, 25 bp, Homo sapien
tgaagtgggagttctcaccctgctg

SEQ ID NO: 623305 - DNA, 25 bp, Homo sapien
catgcctggtctggcaccatgagtt

SEQ ID NO: 623306 - DNA, 25 bp, Homo sapien
accatgagttcttatcctgccagga

SEQ ID NO: 623307 - DNA, 25 bp, Homo sapien
tatcctgccaggagtgctggccctg

SEQ ID NO: 623308 - DNA, 25 bp, Homo sapien
ggtgacctcttggagctgcggcttc

SEQ ID NO: 623309 - DNA, 25 bp, Homo sapien
ccaggtgtcctaccccggctgtgtg

SEQ ID NO: 623310 - DNA, 25 bp, Homo sapien
gctggtggcatctcacgtcgctggc

SEQ ID NO: 623311 - DNA, 25 bp, Homo sapien
agtagtcctataaaagctagtagta

SEQ ID NO: 623312 - DNA, 25 bp, Homo sapien
gtagtcctataaaagctagtagtaa

SEQ ID NO: 623313 - DNA, 25 bp, Homo sapien
tagtcctataaaagctagtagtaac

SEQ ID NO: 623314 - DNA, 25 bp, Homo sapien
agtcctataaaagctagtagtaaca

SEQ ID NO: 623315 - DNA, 25 bp, Homo sapien
gtcctataaaagctagtagtaacat

SEQ ID NO: 623316 - DNA, 25 bp, Homo sapien
ttaaaagaaaatgcccattgactaa

SEQ ID NO: 623317 - DNA, 25 bp, Homo sapien
aaagaaaatgcccattgactaatga

SEQ ID NO: 623318 - DNA, 25 bp, Homo sapien
aagaaaatgcccattgactaatgaa

SEQ ID NO: 623319 - DNA, 25 bp, Homo sapien
cccattgactaatgaatgaataaac

SEQ ID NO: 623320 - DNA, 25 bp, Homo sapien
gaataaacaacatgtagtgtatttc

SEQ ID NO: 623321 - DNA, 25 bp, Homo sapien
aataaacaacatgtagtgtatttct

SEQ ID NO: 623322 - DNA, 25 bp, Homo sapien
gggagacacacatgatgctcacgtg

SEQ ID NO: 623323 - DNA, 25 bp, Homo sapien
acacacatgatgctcacgtgtctgt

SEQ ID NO: 623324 - DNA, 25 bp, Homo sapien
gcagtgaggcaacaacccaattcct

SEQ ID NO: 623325 - DNA, 25 bp, Homo sapien
gaggcaacaacccaattccttcaac

SEQ ID NO: 623326 - DNA, 25 bp, Homo sapien
gccctgcttggatcctctggagaca

SEQ ID NO: 623327 - DNA, 25 bp, Homo sapien
ttggatcctctggagacaccactgt

SEQ ID NO: 623328 - DNA, 25 bp, Homo sapien
tggagacaccactgtgccaggactc

SEQ ID NO: 623329 - DNA, 25 bp, Homo sapien
accactgtgccaggactcctgatga

SEQ ID NO: 623330 - DNA, 25 bp, Homo sapien
gtgccaggactcctgatgagccaca

SEQ ID NO: 623331 - DNA, 25 bp, Homo sapien
aatgtgccatgaggtctgttcctac

SEQ ID NO: 623332 - DNA, 25 bp, Homo sapien
gtgccatgaggtctgttcctacatg

SEQ ID NO: 623333 - DNA, 25 bp, Homo sapien
tatatgagtgaagacaatttctgaa

SEQ ID NO: 623334 - DNA, 25 bp, Homo sapien
caaagtattatttctatgactcaga

SEQ ID NO: 623335 - DNA, 25 bp, Homo sapien
atgactcagatatttttcaataccg

SEQ ID NO: 623336 - DNA, 25 bp, Homo sapien
gactcagatatttttcaataccgtt

SEQ ID NO: 623337 - DNA, 25 bp, Homo sapien
tcagatatttttcaataccgtttta

SEQ ID NO: 623338 - DNA, 25 bp, Homo sapien
attatgtttagtctttttgtctatg

SEQ ID NO: 623339 - DNA, 25 bp, Homo sapien
tttgtctatgtatttctgtttctgt

SEQ ID NO: 623340 - DNA, 25 bp, Homo sapien
tgtctggtggtatgggtatgtaatt

SEQ ID NO: 623341 - DNA, 25 bp, Homo sapien
ctggtggtatgggtatgtaattgaa

SEQ ID NO: 623342 - DNA, 25 bp, Homo sapien
ttgtttaatttctatttcatgctat

SEQ ID NO: 623343 - DNA, 25 bp, Homo sapien
gtgtttatacatatatcggcataga

SEQ ID NO: 623344 - DNA, 25 bp, Homo sapien
taatcttggcccactacaatcttca

SEQ ID NO: 623345 - DNA, 25 bp, Homo sapien
aatcttggcccactacaatcttcac

SEQ ID NO: 623346 - DNA, 25 bp, Homo sapien
tggtgcctggcccatgctgtagctc

SEQ ID NO: 623347 - DNA, 25 bp, Homo sapien
tgcctggcccatgctgtagctctta

SEQ ID NO: 623348 - DNA, 25 bp, Homo sapien
ctggcccatgctgtagctcttacag

SEQ ID NO: 623349 - DNA, 25 bp, Homo sapien
tggcccatgctgtagctcttacagc

SEQ ID NO: 623350 - DNA, 25 bp, Homo sapien
gcccatgctgtagctcttacagcaa

SEQ ID NO: 623351 - DNA, 25 bp, Homo sapien
atgctgtagctcttacagcaaacaa

SEQ ID NO: 623352 - DNA, 25 bp, Homo sapien
ctttttatttctgctttcgctagat

SEQ ID NO: 623353 - DNA, 25 bp, Homo sapien
ttttatttctgctttcgctagatgg

SEQ ID NO: 623354 - DNA, 25 bp, Homo sapien
ttatttctgctttcgctagatggag

SEQ ID NO: 623355 - DNA, 25 bp, Homo sapien
aaactccagggctcattagtccttt

SEQ ID NO: 623356 - DNA, 25 bp, Homo sapien
taaacgccggtgtgaaatgatgggt

SEQ ID NO: 623357 - DNA, 25 bp, Homo sapien
aaatgatgggtatccgtgtgcctgg

SEQ ID NO: 623358 - DNA, 25 bp, Homo sapien
gtatccgtgtgcctggtccaagttt

SEQ ID NO: 623359 - DNA, 25 bp, Homo sapien
tggtccaagtttcctggtggttgac

SEQ ID NO: 623360 - DNA, 25 bp, Homo sapien
tcctggtggttgacttgggcgaata

SEQ ID NO: 623361 - DNA, 25 bp, Homo sapien
taagacatgttctgcagagttctcc

SEQ ID NO: 623362 - DNA, 25 bp, Homo sapien
gtaatattccgtttgttttgctcct

SEQ ID NO: 623363 - DNA, 25 bp, Homo sapien
tttgctcctttgcaattaactacaa

SEQ ID NO: 623364 - DNA, 25 bp, Homo sapien
taactacaaacttctaagtcctaga

SEQ ID NO: 623365 - DNA, 25 bp, Homo sapien
gagcaacgatcattttcctagtcaa

SEQ ID NO: 623366 - DNA, 25 bp, Homo sapien
gggtagagcgcagattctctctcca

SEQ ID NO: 623367 - DNA, 25 bp, Homo sapien
tccacagcagctcttaccaaatgta

SEQ ID NO: 623368 - DNA, 25 bp, Homo sapien
ccaaatgtagagatgccctgcaggc

SEQ ID NO: 623369 - DNA, 25 bp, Homo sapien
tgcaggccactttccaacactgtca

SEQ ID NO: 623370 - DNA, 25 bp, Homo sapien
aacactgtcacacagggccatgagc

SEQ ID NO: 623371 - DNA, 25 bp, Homo sapien
catgagccaggcagattaagtgagc

SEQ ID NO: 623372 - DNA, 25 bp, Homo sapien
gtgagcagagccctattttccaaag

SEQ ID NO: 623373 - DNA, 25 bp, Homo sapien
tttccaaaggagagcaacattgttc

SEQ ID NO: 623374 - DNA, 25 bp, Homo sapien
aacattgttccatttgattcctaag

SEQ ID NO: 623375 - DNA, 25 bp, Homo sapien
aagggacaagatctttcacgaacca

SEQ ID NO: 623376 - DNA, 25 bp, Homo sapien
gatctttcacgaaccaacactgtaa

SEQ ID NO: 623377 - DNA, 25 bp, Homo sapien
ttgcctctcccagggaaagactttt

SEQ ID NO: 623378 - DNA, 25 bp, Homo sapien
gcctctcccagggaaagacttttag

SEQ ID NO: 623379 - DNA, 25 bp, Homo sapien
agaatgatttattccgcgttcctct

SEQ ID NO: 623380 - DNA, 25 bp, Homo sapien
tttattccgcgttcctctgcttcac

SEQ ID NO: 623381 - DNA, 25 bp, Homo sapien
gcttcacccgcctgcggcttagggt

SEQ ID NO: 623382 - DNA, 25 bp, Homo sapien
gctaggctgctcatgtgaagcgctt

SEQ ID NO: 623383 - DNA, 25 bp, Homo sapien
aggctgctcatgtgaagcgcttacg

SEQ ID NO: 623384 - DNA, 25 bp, Homo sapien
tgtgaagcgcttacgggtgagccct

SEQ ID NO: 623385 - DNA, 25 bp, Homo sapien
gggctgggaattgctatttgcgcca

SEQ ID NO: 623386 - DNA, 25 bp, Homo sapien
tgggaattgctatttgcgccactgc

SEQ ID NO: 623387 - DNA, 25 bp, Homo sapien
gaattgctatttgcgccactgcggc

SEQ ID NO: 623388 - DNA, 25 bp, Homo sapien
gtactatatatagtagtcctataaa

SEQ ID NO: 623389 - DNA, 25 bp, Homo sapien
agtagtcctataaaagctagtagta

SEQ ID NO: 623390 - DNA, 25 bp, Homo sapien
gtagtcctataaaagctagtagtaa

SEQ ID NO: 623391 - DNA, 25 bp, Homo sapien
tagtcctataaaagctagtagtaac

SEQ ID NO: 623392 - DNA, 25 bp, Homo sapien
gtcctataaaagctagtagtaacat

SEQ ID NO: 623393 - DNA, 25 bp, Homo sapien
aagctagtagtaacatgtatatttt

SEQ ID NO: 623394 - DNA, 25 bp, Homo sapien
catgtatatttttggtgtttaattc

SEQ ID NO: 623395 - DNA, 25 bp, Homo sapien
aaagaaaatgcccattgactaatga

SEQ ID NO: 623396 - DNA, 25 bp, Homo sapien
aagaaaatgcccattgactaatgaa

SEQ ID NO: 623397 - DNA, 25 bp, Homo sapien
cccattgactaatgaatgaataaac

SEQ ID NO: 623398 - DNA, 25 bp, Homo sapien
gaataaacaacatgtagtgtatttc

SEQ ID NO: 623399 - DNA, 25 bp, Homo sapien
cttaaagcagaaaattgccagccaa

SEQ ID NO: 623400 - DNA, 25 bp, Homo sapien
aagaaagaatactgtgtccatcaaa

SEQ ID NO: 623401 - DNA, 25 bp, Homo sapien
gggtgaaatagtctttcctagacaa

SEQ ID NO: 623402 - DNA, 25 bp, Homo sapien
tagtctttcctagacaaaaattgag

SEQ ID NO: 623403 - DNA, 25 bp, Homo sapien
catcttgagagagttttacattttg

SEQ ID NO: 623404 - DNA, 25 bp, Homo sapien
gaaaagacagtattcactaccagga

SEQ ID NO: 623405 - DNA, 25 bp, Homo sapien
aacatgcaggagtatgaaagtcact

SEQ ID NO: 623406 - DNA, 25 bp, Homo sapien
tgaaagtcactggtagagagcagat

SEQ ID NO: 623407 - DNA, 25 bp, Homo sapien
gggaatcaaatcttagcactacagt

SEQ ID NO: 623408 - DNA, 25 bp, Homo sapien
atcttagcactacagtaaaccgcca

SEQ ID NO: 623409 - DNA, 25 bp, Homo sapien
gcactacagtaaaccgccaaacctt

SEQ ID NO: 623410 - DNA, 25 bp, Homo sapien
tatatgagtgaagacaatttctgaa

SEQ ID NO: 623411 - DNA, 25 bp, Homo sapien
caaagtattatttctatgactcaga

SEQ ID NO: 623412 - DNA, 25 bp, Homo sapien
atgactcagatatttttcaataccg

SEQ ID NO: 623413 - DNA, 25 bp, Homo sapien
gactcagatatttttcaataccgtt

SEQ ID NO: 623414 - DNA, 25 bp, Homo sapien
tcagatatttttcaataccgtttta

SEQ ID NO: 623415 - DNA, 25 bp, Homo sapien
tgtctggtggtatgggtatgtaatt

SEQ ID NO: 623416 - DNA, 25 bp, Homo sapien
ctggtggtatgggtatgtaattgaa

SEQ ID NO: 623417 - DNA, 25 bp, Homo sapien
tacatagtatttatatagtttcata

SEQ ID NO: 623418 - DNA, 25 bp, Homo sapien
tgtgtttatacatatatcggcatag

SEQ ID NO: 623419 - DNA, 25 bp, Homo sapien
gtgtttatacatatatcggcataga

SEQ ID NO: 623420 - DNA, 25 bp, Homo sapien
gtttatacatatatcggcatagata

SEQ ID NO: 623421 - DNA, 25 bp, Homo sapien
agaggcggatggtcacactcagatc

SEQ ID NO: 623422 - DNA, 25 bp, Homo sapien
gagcccaggatcaagggacccactg

SEQ ID NO: 623423 - DNA, 25 bp, Homo sapien
ttggcttgagccgtcagaggccctg

SEQ ID NO: 623424 - DNA, 25 bp, Homo sapien
gtcagaggccctgtgctgagtgtct

SEQ ID NO: 623425 - DNA, 25 bp, Homo sapien
gagacactcacagctttgtcatcag

SEQ ID NO: 623426 - DNA, 25 bp, Homo sapien
agctttgtcatcagggcacaggctt

SEQ ID NO: 623427 - DNA, 25 bp, Homo sapien
aggcttcctcggagccaggatgatc

SEQ ID NO: 623428 - DNA, 25 bp, Homo sapien
gagccaggatgatctgtgccacgct

SEQ ID NO: 623429 - DNA, 25 bp, Homo sapien
aggatgatctgtgccacgcttgcac

SEQ ID NO: 623430 - DNA, 25 bp, Homo sapien
tctctcctgctattgaattagtacc

SEQ ID NO: 623431 - DNA, 25 bp, Homo sapien
ctattgaattagtacctagctgcac

SEQ ID NO: 623432 - DNA, 25 bp, Homo sapien
ttaaaatacatacattgtgccgggt

SEQ ID NO: 623433 - DNA, 25 bp, Homo sapien
taaaatacatacattgtgccgggta

SEQ ID NO: 623434 - DNA, 25 bp, Homo sapien
aaaatacatacattgtgccgggtac

SEQ ID NO: 623435 - DNA, 25 bp, Homo sapien
aaatacatacattgtgccgggtacg

SEQ ID NO: 623436 - DNA, 25 bp, Homo sapien
aatacatacattgtgccgggtacgg

SEQ ID NO: 623437 - DNA, 25 bp, Homo sapien
atacatacattgtgccgggtacggt

SEQ ID NO: 623438 - DNA, 25 bp, Homo sapien
tacatacattgtgccgggtacggtg

SEQ ID NO: 623439 - DNA, 25 bp, Homo sapien
acatacattgtgccgggtacggtgg

SEQ ID NO: 623440 - DNA, 25 bp, Homo sapien
catacattgtgccgggtacggtggc

SEQ ID NO: 623441 - DNA, 25 bp, Homo sapien
aaacaacattctacaactcccgaag

SEQ ID NO: 623442 - DNA, 25 bp, Homo sapien
cattctacaactcccgaaggacaga

SEQ ID NO: 623443 - DNA, 25 bp, Homo sapien
gtgaatcccttcagaatacagcatt

SEQ ID NO: 623444 - DNA, 25 bp, Homo sapien
gaacctgattatttctgctccagat

SEQ ID NO: 623445 - DNA, 25 bp, Homo sapien
ttctgctccagatctgtccagtgag

SEQ ID NO: 623446 - DNA, 25 bp, Homo sapien
gtgagatttatcaagcagcggatgc

SEQ ID NO: 623447 - DNA, 25 bp, Homo sapien
caagcagcggatgcatttttagaaa

SEQ ID NO: 623448 - DNA, 25 bp, Homo sapien
aatattctcaagttttacactgtca

SEQ ID NO: 623449 - DNA, 25 bp, Homo sapien
gttttacactgtcaacctaacaaag

SEQ ID NO: 623450 - DNA, 25 bp, Homo sapien
gagacaagctcttggcaacaagtaa

SEQ ID NO: 623451 - DNA, 25 bp, Homo sapien
atttgtgaatttactgtcgatacta

SEQ ID NO: 623452 - DNA, 25 bp, Homo sapien
taattccaccaccaggcaaccactg

SEQ ID NO: 623453 - DNA, 25 bp, Homo sapien
caaccactgatctgtgtttggttct

SEQ ID NO: 623454 - DNA, 25 bp, Homo sapien
cactgatctgtgtttggttcttaaa

SEQ ID NO: 623455 - DNA, 25 bp, Homo sapien
ctgatctgtgtttggttcttaaatt

SEQ ID NO: 623456 - DNA, 25 bp, Homo sapien
tctgtgtttggttcttaaattttgg

SEQ ID NO: 623457 - DNA, 25 bp, Homo sapien
ggacttttcccaaatgtcacataaa

SEQ ID NO: 623458 - DNA, 25 bp, Homo sapien
tgtcacataaatagaatcgcattgg

SEQ ID NO: 623459 - DNA, 25 bp, Homo sapien
atcgcattggatatagacttttgaa

SEQ ID NO: 623460 - DNA, 25 bp, Homo sapien
ggatatagacttttgaatctgtttt

SEQ ID NO: 623461 - DNA, 25 bp, Homo sapien
tgttcttgtgatggcgaaaaagtct

SEQ ID NO: 623462 - DNA, 25 bp, Homo sapien
ttgtgatggcgaaaaagtctcagga

SEQ ID NO: 623463 - DNA, 25 bp, Homo sapien
aagtaacgatagtaaagaagctcac

SEQ ID NO: 623464 - DNA, 25 bp, Homo sapien
gtaacgatagtaaagaagctcactg

SEQ ID NO: 623465 - DNA, 25 bp, Homo sapien
acgatagtaaagaagctcactggcc

SEQ ID NO: 623466 - DNA, 25 bp, Homo sapien
cgatagtaaagaagctcactggcca

SEQ ID NO: 623467 - DNA, 25 bp, Homo sapien
gatagtaaagaagctcactggccag

SEQ ID NO: 623468 - DNA, 25 bp, Homo sapien
atagtaaagaagctcactggccagg

SEQ ID NO: 623469 - DNA, 25 bp, Homo sapien
tagtaaagaagctcactggccaggc

SEQ ID NO: 623470 - DNA, 25 bp, Homo sapien
agtaaagaagctcactggccaggca

SEQ ID NO: 623471 - DNA, 25 bp, Homo sapien
gtaaagaagctcactggccaggcac

SEQ ID NO: 623472 - DNA, 25 bp, Homo sapien
taaagaagctcactggccaggcacg

SEQ ID NO: 623473 - DNA, 25 bp, Homo sapien
aaagaagctcactggccaggcacgg

SEQ ID NO: 623474 - DNA, 25 bp, Homo sapien
taacatttggctctgaggtatattc

SEQ ID NO: 623475 - DNA, 25 bp, Homo sapien
ggctctgaggtatattctattaata

SEQ ID NO: 623476 - DNA, 25 bp, Homo sapien
gtcgtagaagtttaaatacatgctt

SEQ ID NO: 623477 - DNA, 25 bp, Homo sapien
catgcttatttctcacagtaagaaa

SEQ ID NO: 623478 - DNA, 25 bp, Homo sapien
tgctgagaccagcattaaaactcag

SEQ ID NO: 623479 - DNA, 25 bp, Homo sapien
aaactcagctcatctggctgtagaa

SEQ ID NO: 623480 - DNA, 25 bp, Homo sapien
agctcatctggctgtagaacctgta

SEQ ID NO: 623481 - DNA, 25 bp, Homo sapien
atctggctgtagaacctgtactctt

SEQ ID NO: 623482 - DNA, 25 bp, Homo sapien
taagtactattttatgttgcatcac

SEQ ID NO: 623483 - DNA, 25 bp, Homo sapien
tgttgcatcacataatggtacatga

SEQ ID NO: 623484 - DNA, 25 bp, Homo sapien
tgaaaattttattgtctaccctttg

SEQ ID NO: 623485 - DNA, 25 bp, Homo sapien
caggtgtgatggcaatatagtgaaa

SEQ ID NO: 623486 - DNA, 25 bp, Homo sapien
ccgggcatactggtgtgccccttta

SEQ ID NO: 623487 - DNA, 25 bp, Homo sapien
cgggcatactggtgtgcccctttag

SEQ ID NO: 623488 - DNA, 25 bp, Homo sapien
gggcatactggtgtgcccctttagt

SEQ ID NO: 623489 - DNA, 25 bp, Homo sapien
ggcatactggtgtgcccctttagtc

SEQ ID NO: 623490 - DNA, 25 bp, Homo sapien
gcatactggtgtgcccctttagtca

SEQ ID NO: 623491 - DNA, 25 bp, Homo sapien
catactggtgtgcccctttagtcac

SEQ ID NO: 623492 - DNA, 25 bp, Homo sapien
actggtgtgcccctttagtcacagc

SEQ ID NO: 623493 - DNA, 25 bp, Homo sapien
ctggtgtgcccctttagtcacagct

SEQ ID NO: 623494 - DNA, 25 bp, Homo sapien
tgtgcccctttagtcacagctgctt

SEQ ID NO: 623495 - DNA, 25 bp, Homo sapien
ccctttagtcacagctgcttgcaag

SEQ ID NO: 623496 - DNA, 25 bp, Homo sapien
tgtgtagcgcctcatgaccgagaaa

SEQ ID NO: 623497 - DNA, 25 bp, Homo sapien
caaacactagtggaacttggagcat

SEQ ID NO: 623498 - DNA, 25 bp, Homo sapien
aacttggagcattgtggtgaaaatc

SEQ ID NO: 623499 - DNA, 25 bp, Homo sapien
gttcctacttaaacatttagcctca

SEQ ID NO: 623500 - DNA, 25 bp, Homo sapien
tttagcctcagaagtagatttttta

SEQ ID NO: 623501 - DNA, 25 bp, Homo sapien
acgaagccgcagttaatgtgctgat

SEQ ID NO: 623502 - DNA, 25 bp, Homo sapien
gaacttgagcttcacattctgtctt

SEQ ID NO: 623503 - DNA, 25 bp, Homo sapien
ttctgtctttggctgtgaacaaata

SEQ ID NO: 623504 - DNA, 25 bp, Homo sapien
ataagtgctcccgttgtatgggctc

SEQ ID NO: 623505 - DNA, 25 bp, Homo sapien
cgttgtatgggctcagcatgttctt

SEQ ID NO: 623506 - DNA, 25 bp, Homo sapien
gctcagcatgttcttgggagactgc

SEQ ID NO: 623507 - DNA, 25 bp, Homo sapien
tgaagaagcttaaaacaggaagaaa

SEQ ID NO: 623508 - DNA, 25 bp, Homo sapien
ggaagaaaacctgccttttcaatca

SEQ ID NO: 623509 - DNA, 25 bp, Homo sapien
gaagaaaacctgccttttcaatcaa

SEQ ID NO: 623510 - DNA, 25 bp, Homo sapien
aagaaaacctgccttttcaatcaag

SEQ ID NO: 623511 - DNA, 25 bp, Homo sapien
agaaaacctgccttttcaatcaagt

SEQ ID NO: 623512 - DNA, 25 bp, Homo sapien
gaaaacctgccttttcaatcaagtt

SEQ ID NO: 623513 - DNA, 25 bp, Homo sapien
tgccttttcaatcaagtttatttat

SEQ ID NO: 623514 - DNA, 25 bp, Homo sapien
caatcaagtttatttatagctactc

SEQ ID NO: 623515 - DNA, 25 bp, Homo sapien
aatcaagtttatttatagctactcc

SEQ ID NO: 623516 - DNA, 25 bp, Homo sapien
atcaagtttatttatagctactccc

SEQ ID NO: 623517 - DNA, 25 bp, Homo sapien
tcaagtttatttatagctactcccc

SEQ ID NO: 623518 - DNA, 25 bp, Homo sapien
tttaaagaacactgcccctattgta

SEQ ID NO: 623519 - DNA, 25 bp, Homo sapien
tgcccctattgtaagaggaagcatg

SEQ ID NO: 623520 - DNA, 25 bp, Homo sapien
gaggaagcatgtaactgaattgtaa

SEQ ID NO: 623521 - DNA, 25 bp, Homo sapien
gattgtttaatccaccagagactac

SEQ ID NO: 623522 - DNA, 25 bp, Homo sapien
tccaccagagactacattttattca

SEQ ID NO: 623523 - DNA, 25 bp, Homo sapien
atatgactactgtcattgattgata

SEQ ID NO: 623524 - DNA, 25 bp, Homo sapien
gataattaatcttctgatctatgaa

SEQ ID NO: 623525 - DNA, 25 bp, Homo sapien
gatctatgaatcaaagtcaaccctg

SEQ ID NO: 623526 - DNA, 25 bp, Homo sapien
gtcaaccctgaatcatttgggtttt

SEQ ID NO: 623527 - DNA, 25 bp, Homo sapien
agaatattttgctccatcctggttt

SEQ ID NO: 623528 - DNA, 25 bp, Homo sapien
aatattttgctccatcctggtttat

SEQ ID NO: 623529 - DNA, 25 bp, Homo sapien
cattttttaaatgcttaccagtcat

SEQ ID NO: 623530 - DNA, 25 bp, Homo sapien
ttttaaatgcttaccagtcatttgt

SEQ ID NO: 623531 - DNA, 25 bp, Homo sapien
cagcttttgtgaatggacctattca

SEQ ID NO: 623532 - DNA, 25 bp, Homo sapien
gcttttgtgaatggacctattcatc

SEQ ID NO: 623533 - DNA, 25 bp, Homo sapien
ttttgtgaatggacctattcatctt

SEQ ID NO: 623534 - DNA, 25 bp, Homo sapien
ttgtgaatggacctattcatctttt

SEQ ID NO: 623535 - DNA, 25 bp, Homo sapien
gtgaatggacctattcatcttttga

SEQ ID NO: 623536 - DNA, 25 bp, Homo sapien
tgaatggacctattcatcttttgac

SEQ ID NO: 623537 - DNA, 25 bp, Homo sapien
gaatggacctattcatcttttgact

SEQ ID NO: 623538 - DNA, 25 bp, Homo sapien
aatggacctattcatcttttgactt

SEQ ID NO: 623539 - DNA, 25 bp, Homo sapien
atggacctattcatcttttgacttt

SEQ ID NO: 623540 - DNA, 25 bp, Homo sapien
cgtgggcacgcggtgccgtctcccc

SEQ ID NO: 623541 - DNA, 25 bp, Homo sapien
gcctggcgcgctcatgcttcaggaa

SEQ ID NO: 623542 - DNA, 25 bp, Homo sapien
cctggcgcgctcatgcttcaggaat

SEQ ID NO: 623543 - DNA, 25 bp, Homo sapien
ctggcgcgctcatgcttcaggaatg

SEQ ID NO: 623544 - DNA, 25 bp, Homo sapien
tggcgcgctcatgcttcaggaatgc

SEQ ID NO: 623545 - DNA, 25 bp, Homo sapien
gcgcgctcatgcttcaggaatgcgg

SEQ ID NO: 623546 - DNA, 25 bp, Homo sapien
ttcaggaatgcgggcgcccgggtcg

SEQ ID NO: 623547 - DNA, 25 bp, Homo sapien
gaatgcgggcgcccgggtcgcgcgt

SEQ ID NO: 623548 - DNA, 25 bp, Homo sapien
gtcgcgcgtccctgggaatttccgc

SEQ ID NO: 623549 - DNA, 25 bp, Homo sapien
gcgtccctgggaatttccgcgcccg

SEQ ID NO: 623550 - DNA, 25 bp, Homo sapien
gtccctgggaatttccgcgcccgct

SEQ ID NO: 623551 - DNA, 25 bp, Homo sapien
accacacccggctatctctcttcct

SEQ ID NO: 623552 - DNA, 25 bp, Homo sapien
tcttccttttaacatgggccccacg

SEQ ID NO: 623553 - DNA, 25 bp, Homo sapien
tccttttaacatgggccccacgcct

SEQ ID NO: 623554 - DNA, 25 bp, Homo sapien
taacatgggccccacgcctggcctc

SEQ ID NO: 623555 - DNA, 25 bp, Homo sapien
cctggcctctgttcctgcaaactga

SEQ ID NO: 623556 - DNA, 25 bp, Homo sapien
ctggcctctgttcctgcaaactgac

SEQ ID NO: 623557 - DNA, 25 bp, Homo sapien
tggcctctgttcctgcaaactgact

SEQ ID NO: 623558 - DNA, 25 bp, Homo sapien
ggcctctgttcctgcaaactgactc

SEQ ID NO: 623559 - DNA, 25 bp, Homo sapien
tctgttcctgcaaactgactcccta

SEQ ID NO: 623560 - DNA, 25 bp, Homo sapien
tctttttctctccacagtccaggga

SEQ ID NO: 623561 - DNA, 25 bp, Homo sapien
ggaaggactgaaaagtcttgtggac

SEQ ID NO: 623562 - DNA, 25 bp, Homo sapien
gcatgccttgtgcattgttgtaaca

SEQ ID NO: 623563 - DNA, 25 bp, Homo sapien
gtaacaattgaatggcacgaggaac

SEQ ID NO: 623564 - DNA, 25 bp, Homo sapien
ggaacataaagctcatagccccagt

SEQ ID NO: 623565 - DNA, 25 bp, Homo sapien
agccccagtgtccaacacatagtca

SEQ ID NO: 623566 - DNA, 25 bp, Homo sapien
attattacataatccggaaggcagc

SEQ ID NO: 623567 - DNA, 25 bp, Homo sapien
aatccggaaggcagctgttttcact

SEQ ID NO: 623568 - DNA, 25 bp, Homo sapien
aggcagctgttttcactggaaatta

SEQ ID NO: 623569 - DNA, 25 bp, Homo sapien
tattgtgtgtgaacattctctttga

SEQ ID NO: 623570 - DNA, 25 bp, Homo sapien
gtgaacattctctttgatattactt

SEQ ID NO: 623571 - DNA, 25 bp, Homo sapien
aatctgttactcagaactctcgatg

SEQ ID NO: 623572 - DNA, 25 bp, Homo sapien
actctcgatgagttgttaagtagaa

SEQ ID NO: 623573 - DNA, 25 bp, Homo sapien
aactcatgacatgtgttacttaatc

SEQ ID NO: 623574 - DNA, 25 bp, Homo sapien
tgtgttacttaatcctcatctacca

SEQ ID NO: 623575 - DNA, 25 bp, Homo sapien
ttaatcctcatctaccaggtaggtg

SEQ ID NO: 623576 - DNA, 25 bp, Homo sapien
atctaccaggtaggtgctattatta

SEQ ID NO: 623577 - DNA, 25 bp, Homo sapien
ggtgctattattatttctatatatg

SEQ ID NO: 623578 - DNA, 25 bp, Homo sapien
atgagatgagtggactgatacataa

SEQ ID NO: 623579 - DNA, 25 bp, Homo sapien
gttaagtaatttatccaaagctaca

SEQ ID NO: 623580 - DNA, 25 bp, Homo sapien
ttaaacctaggactatcttaatcca

SEQ ID NO: 623581 - DNA, 25 bp, Homo sapien
cttaatccaaaagttcatgctctta

SEQ ID NO: 623582 - DNA, 25 bp, Homo sapien
gaacttaggtagcactaatgatcaa

SEQ ID NO: 623583 - DNA, 25 bp, Homo sapien
taggtagcactaatgatcaatatca

SEQ ID NO: 623584 - DNA, 25 bp, Homo sapien
gggacctcttgttttctgctgggag

SEQ ID NO: 623585 - DNA, 25 bp, Homo sapien
tcttgttttctgctgggagcttcca

SEQ ID NO: 623586 - DNA, 25 bp, Homo sapien
ggagcttccagtgacatcttttcat

SEQ ID NO: 623587 - DNA, 25 bp, Homo sapien
cttttcatctgagttgagccgagac

SEQ ID NO: 623588 - DNA, 25 bp, Homo sapien
agacaaggccagtattttcagaaag

SEQ ID NO: 623589 - DNA, 25 bp, Homo sapien
ttttcagaaaggcaacctactagga

SEQ ID NO: 623590 - DNA, 25 bp, Homo sapien
gtgagctatagaccttgtttaccat

SEQ ID NO: 623591 - DNA, 25 bp, Homo sapien
tagaccttgtttaccatcctttact

SEQ ID NO: 623592 - DNA, 25 bp, Homo sapien
tgtttaccatcctttactcagctag

SEQ ID NO: 623593 - DNA, 25 bp, Homo sapien
actcagctagctggtgtcaacaggt

SEQ ID NO: 623594 - DNA, 25 bp, Homo sapien
tccttcctcaacctagtctgtagaa

SEQ ID NO: 623595 - DNA, 25 bp, Homo sapien
gatcaccccagaagagagtacagga

SEQ ID NO: 623596 - DNA, 25 bp, Homo sapien
agccaggatttggacgcaggtctct

SEQ ID NO: 623597 - DNA, 25 bp, Homo sapien
ctctctgactcaaatccttttctct

SEQ ID NO: 623598 - DNA, 25 bp, Homo sapien
ttttctctttcccttacttcatcct

SEQ ID NO: 623599 - DNA, 25 bp, Homo sapien
cccctcatctcctgaaaattagaag

SEQ ID NO: 623600 - DNA, 25 bp, Homo sapien
attagaagccggatcctggaataca

SEQ ID NO: 623601 - DNA, 25 bp, Homo sapien
ccacccattttaaggatacatcaag

SEQ ID NO: 623602 - DNA, 25 bp, Homo sapien
ttgtaatcttactagtttgaacttt

SEQ ID NO: 623603 - DNA, 25 bp, Homo sapien
gggactggcttcaaagaaatgtttt

SEQ ID NO: 623604 - DNA, 25 bp, Homo sapien
agtggtgttacgtttaatgccttgt

SEQ ID NO: 623605 - DNA, 25 bp, Homo sapien
gttacgtttaatgccttgtgtttat

SEQ ID NO: 623606 - DNA, 25 bp, Homo sapien
aatctcaaactccagtgctccttct

SEQ ID NO: 623607 - DNA, 25 bp, Homo sapien
gctccttcttttaagaactccaggc

SEQ ID NO: 623608 - DNA, 25 bp, Homo sapien
actccaggcgtgtcttaccagtaat

SEQ ID NO: 623609 - DNA, 25 bp, Homo sapien
ggcgtgtcttaccagtaatgtcccc

SEQ ID NO: 623610 - DNA, 25 bp, Homo sapien
aatgtccccctggagatgatactga

SEQ ID NO: 623611 - DNA, 25 bp, Homo sapien
acattcctcaaacagaaatcaccat

SEQ ID NO: 623612 - DNA, 25 bp, Homo sapien
aaatcctgttcctctctagcctgtg

SEQ ID NO: 623613 - DNA, 25 bp, Homo sapien
tagcctgtgctctccatatgctcat

SEQ ID NO: 623614 - DNA, 25 bp, Homo sapien
tatgctcatccattactgaagctag

SEQ ID NO: 623615 - DNA, 25 bp, Homo sapien
gattcatatttagtacctgttggct

SEQ ID NO: 623616 - DNA, 25 bp, Homo sapien
tacctgttggctttgcttcttaaga

SEQ ID NO: 623617 - DNA, 25 bp, Homo sapien
tgggcgtggtgataggcgcttgtaa

SEQ ID NO: 623618 - DNA, 25 bp, Homo sapien
gggcgtggtgataggcgcttgtaat

SEQ ID NO: 623619 - DNA, 25 bp, Homo sapien
attgcagcaagctgtgtggagtgca

SEQ ID NO: 623620 - DNA, 25 bp, Homo sapien
ttgcagcaagctgtgtggagtgcag

SEQ ID NO: 623621 - DNA, 25 bp, Homo sapien
gcagcaagctgtgtggagtgcagtg

SEQ ID NO: 623622 - DNA, 25 bp, Homo sapien
agcaagctgtgtggagtgcagtgag

SEQ ID NO: 623623 - DNA, 25 bp, Homo sapien
gcaagctgtgtggagtgcagtgaga

SEQ ID NO: 623624 - DNA, 25 bp, Homo sapien
ctaggcaagagtgagactgtgtgta

SEQ ID NO: 623625 - DNA, 25 bp, Homo sapien
aagagtgagactgtgtgtaaaaaca

SEQ ID NO: 623626 - DNA, 25 bp, Homo sapien
aaaaattgctggacgcggtggccca

SEQ ID NO: 623627 - DNA, 25 bp, Homo sapien
aaaattgctggacgcggtggcccac

SEQ ID NO: 623628 - DNA, 25 bp, Homo sapien
tggcaatacctggtttgtcatagtt

SEQ ID NO: 623629 - DNA, 25 bp, Homo sapien
ggcaatacctggtttgtcatagttt

SEQ ID NO: 623630 - DNA, 25 bp, Homo sapien
gcaatacctggtttgtcatagtttc

SEQ ID NO: 623631 - DNA, 25 bp, Homo sapien
caatacctggtttgtcatagtttca

SEQ ID NO: 623632 - DNA, 25 bp, Homo sapien
agtttcacattaccttaaacagatg

SEQ ID NO: 623633 - DNA, 25 bp, Homo sapien
gtttcacattaccttaaacagatgc

SEQ ID NO: 623634 - DNA, 25 bp, Homo sapien
tttcacattaccttaaacagatgcc

SEQ ID NO: 623635 - DNA, 25 bp, Homo sapien
ttcacattaccttaaacagatgccc

SEQ ID NO: 623636 - DNA, 25 bp, Homo sapien
tcacattaccttaaacagatgccca

SEQ ID NO: 623637 - DNA, 25 bp, Homo sapien
cacattaccttaaacagatgcccag

SEQ ID NO: 623638 - DNA, 25 bp, Homo sapien
acattaccttaaacagatgcccaga

SEQ ID NO: 623639 - DNA, 25 bp, Homo sapien
atgtgttacttttgtcttgttttct

SEQ ID NO: 623640 - DNA, 25 bp, Homo sapien
gttacttttgtcttgttttctagct

SEQ ID NO: 623641 - DNA, 25 bp, Homo sapien
tctagctttaattgaaagggtctcc

SEQ ID NO: 623642 - DNA, 25 bp, Homo sapien
aattgaaagggtctccagtcttagc

SEQ ID NO: 623643 - DNA, 25 bp, Homo sapien
tgaaagggtctccagtcttagcacc

SEQ ID NO: 623644 - DNA, 25 bp, Homo sapien
aagggtctccagtcttagcaccatt

SEQ ID NO: 623645 - DNA, 25 bp, Homo sapien
gtctccagtcttagcaccattaatt

SEQ ID NO: 623646 - DNA, 25 bp, Homo sapien
ctccagtcttagcaccattaattat

SEQ ID NO: 623647 - DNA, 25 bp, Homo sapien
aaaaacatactcttcattgcattaa

SEQ ID NO: 623648 - DNA, 25 bp, Homo sapien
atactcttcattgcattaaaagtgg

SEQ ID NO: 623649 - DNA, 25 bp, Homo sapien
ttgcattaaaagtggataattccag

SEQ ID NO: 623650 - DNA, 25 bp, Homo sapien
aaggccatgaaaataaggttctcat

SEQ ID NO: 623651 - DNA, 25 bp, Homo sapien
ttctcatgcttgtatgcctgataac

SEQ ID NO: 623652 - DNA, 25 bp, Homo sapien
tcatgcttgtatgcctgataacaaa

SEQ ID NO: 623653 - DNA, 25 bp, Homo sapien
agactacaaaaaacacaaccctgca

SEQ ID NO: 623654 - DNA, 25 bp, Homo sapien
caaccctgcacaaaggccattaaac

SEQ ID NO: 623655 - DNA, 25 bp, Homo sapien
ccagcaaactgcctgtgcaaacttg

SEQ ID NO: 623656 - DNA, 25 bp, Homo sapien
aactgcctgtgcaaacttgaactgg

SEQ ID NO: 623657 - DNA, 25 bp, Homo sapien
actggcattacccttgttaatgatc

SEQ ID NO: 623658 - DNA, 25 bp, Homo sapien
tacccttgttaatgatctttgtagc

SEQ ID NO: 623659 - DNA, 25 bp, Homo sapien
aagcacatggtttactatggcatgt

SEQ ID NO: 623660 - DNA, 25 bp, Homo sapien
catggtttactatggcatgtgtatt

SEQ ID NO: 623661 - DNA, 25 bp, Homo sapien
aggtaggccgttgttaatcctagca

SEQ ID NO: 623662 - DNA, 25 bp, Homo sapien
ggtaggccgttgttaatcctagcac

SEQ ID NO: 623663 - DNA, 25 bp, Homo sapien
gtaggccgttgttaatcctagcact

SEQ ID NO: 623664 - DNA, 25 bp, Homo sapien
taggccgttgttaatcctagcactt

SEQ ID NO: 623665 - DNA, 25 bp, Homo sapien
aaaattatttggttacggtggcatg

SEQ ID NO: 623666 - DNA, 25 bp, Homo sapien
aaattatttggttacggtggcatgc

SEQ ID NO: 623667 - DNA, 25 bp, Homo sapien
aattatttggttacggtggcatgca

SEQ ID NO: 623668 - DNA, 25 bp, Homo sapien
attatttggttacggtggcatgcac

SEQ ID NO: 623669 - DNA, 25 bp, Homo sapien
ttatttggttacggtggcatgcacc

SEQ ID NO: 623670 - DNA, 25 bp, Homo sapien
atttggttacggtggcatgcacctg

SEQ ID NO: 623671 - DNA, 25 bp, Homo sapien
ctcgagaggcaaaggtgggaagatc

SEQ ID NO: 623672 - DNA, 25 bp, Homo sapien
atatcatgagatctattgttaacat

SEQ ID NO: 623673 - DNA, 25 bp, Homo sapien
tattcattgttcagccatcctttct

SEQ ID NO: 623674 - DNA, 25 bp, Homo sapien
attcattgttcagccatcctttcta

SEQ ID NO: 623675 - DNA, 25 bp, Homo sapien
aataatgggaagatgtaggtgcaaa

SEQ ID NO: 623676 - DNA, 25 bp, Homo sapien
taggtgcaaagattgtgggtgaaca

SEQ ID NO: 623677 - DNA, 25 bp, Homo sapien
ttgtgggtgaacatggtgtatgtat

SEQ ID NO: 623678 - DNA, 25 bp, Homo sapien
atatgattataagccatgtagtaaa

SEQ ID NO: 623679 - DNA, 25 bp, Homo sapien
agccatgtagtaaagaagagcttat

SEQ ID NO: 623680 - DNA, 25 bp, Homo sapien
aaaacagttacatctcttctcttct

SEQ ID NO: 623681 - DNA, 25 bp, Homo sapien
ttactccccagttgtaaatattatt

SEQ ID NO: 623682 - DNA, 25 bp, Homo sapien
catctttaagttgtttcttctgtta

SEQ ID NO: 623683 - DNA, 25 bp, Homo sapien
ttaaaatacatacattgtgccgggt

SEQ ID NO: 623684 - DNA, 25 bp, Homo sapien
taaaatacatacattgtgccgggta

SEQ ID NO: 623685 - DNA, 25 bp, Homo sapien
aaaatacatacattgtgccgggtac

SEQ ID NO: 623686 - DNA, 25 bp, Homo sapien
aaatacatacattgtgccgggtacg

SEQ ID NO: 623687 - DNA, 25 bp, Homo sapien
aatacatacattgtgccgggtacgg

SEQ ID NO: 623688 - DNA, 25 bp, Homo sapien
atacatacattgtgccgggtacggt

SEQ ID NO: 623689 - DNA, 25 bp, Homo sapien
tacatacattgtgccgggtacggtg

SEQ ID NO: 623690 - DNA, 25 bp, Homo sapien
acatacattgtgccgggtacggtgg

SEQ ID NO: 623691 - DNA, 25 bp, Homo sapien
catacattgtgccgggtacggtggc

SEQ ID NO: 623692 - DNA, 25 bp, Homo sapien
atacattgtgccgggtacggtggct

SEQ ID NO: 623693 - DNA, 25 bp, Homo sapien
tacattgtgccgggtacggtggctc

SEQ ID NO: 623694 - DNA, 25 bp, Homo sapien
gttctctgtggctgtaaggccaagt

SEQ ID NO: 623695 - DNA, 25 bp, Homo sapien
aaggccaagtgatagcctaggttgg

SEQ ID NO: 623696 - DNA, 25 bp, Homo sapien
tgatagcctaggttggtcacttaga

SEQ ID NO: 623697 - DNA, 25 bp, Homo sapien
tggtcacttagagccacagccagct

SEQ ID NO: 623698 - DNA, 25 bp, Homo sapien
gctcctctaggcctagggatgctga

SEQ ID NO: 623699 - DNA, 25 bp, Homo sapien
ggaatgcctggctcctgagagtcat

SEQ ID NO: 623700 - DNA, 25 bp, Homo sapien
atggcttcctgaaatgacctcagag

SEQ ID NO: 623701 - DNA, 25 bp, Homo sapien
gaaatgacctcagaggacgctgccc

SEQ ID NO: 623702 - DNA, 25 bp, Homo sapien
gaggcctttgtagggtactctcaca

SEQ ID NO: 623703 - DNA, 25 bp, Homo sapien
tgtagggtactctcacaaggcatcc

SEQ ID NO: 623704 - DNA, 25 bp, Homo sapien
ctcacaaggcatccctcagtcaggg

SEQ ID NO: 623705 - DNA, 25 bp, Homo sapien
gtggttcaggtgcactactgcctaa

SEQ ID NO: 623706 - DNA, 25 bp, Homo sapien
gtgcactactgcctaatagtactga

SEQ ID NO: 623707 - DNA, 25 bp, Homo sapien
ctgcctaatagtactgagggtggaa

SEQ ID NO: 623708 - DNA, 25 bp, Homo sapien
ataattgatctcagcctcacctctt

SEQ ID NO: 623709 - DNA, 25 bp, Homo sapien
gcctcacctcttcaattccaagagt

SEQ ID NO: 623710 - DNA, 25 bp, Homo sapien
aattccaagagtagtcacttcagac

SEQ ID NO: 623711 - DNA, 25 bp, Homo sapien
gtagtcacttcagacttgaaatttg

SEQ ID NO: 623712 - DNA, 25 bp, Homo sapien
tattaccctaataagccatggcatt

SEQ ID NO: 623713 - DNA, 25 bp, Homo sapien
agccatggcatttaggttcaaacaa

SEQ ID NO: 623714 - DNA, 25 bp, Homo sapien
agagagcttttagaatttaatacaa

SEQ ID NO: 623715 - DNA, 25 bp, Homo sapien
aaggcttaatattatccttcagaaa

SEQ ID NO: 623716 - DNA, 25 bp, Homo sapien
tggcaatacctggtttgtcatagtt

SEQ ID NO: 623717 - DNA, 25 bp, Homo sapien
ggcaatacctggtttgtcatagttt

SEQ ID NO: 623718 - DNA, 25 bp, Homo sapien
gcaatacctggtttgtcatagtttc

SEQ ID NO: 623719 - DNA, 25 bp, Homo sapien
caatacctggtttgtcatagtttca

SEQ ID NO: 623720 - DNA, 25 bp, Homo sapien
ggtttgtcatagtttcacattacct

SEQ ID NO: 623721 - DNA, 25 bp, Homo sapien
ttgtcatagtttcacattaccttaa

SEQ ID NO: 623722 - DNA, 25 bp, Homo sapien
gtttcacattaccttaaacagatgc

SEQ ID NO: 623723 - DNA, 25 bp, Homo sapien
ttcacattaccttaaacagatgccc

SEQ ID NO: 623724 - DNA, 25 bp, Homo sapien
cacattaccttaaacagatgcccag

SEQ ID NO: 623725 - DNA, 25 bp, Homo sapien
acattaccttaaacagatgcccaga

SEQ ID NO: 623726 - DNA, 25 bp, Homo sapien
accttaaacagatgcccagactggg

SEQ ID NO: 623727 - DNA, 25 bp, Homo sapien
aaaatataaaatgagcgctgtggct

SEQ ID NO: 623728 - DNA, 25 bp, Homo sapien
aaatataaaatgagcgctgtggctc

SEQ ID NO: 623729 - DNA, 25 bp, Homo sapien
aatataaaatgagcgctgtggctca

SEQ ID NO: 623730 - DNA, 25 bp, Homo sapien
tataaaatgagcgctgtggctcatg

SEQ ID NO: 623731 - DNA, 25 bp, Homo sapien
aatcagccgggcttgatggtacata

SEQ ID NO: 623732 - DNA, 25 bp, Homo sapien
atcagccgggcttgatggtacatac

SEQ ID NO: 623733 - DNA, 25 bp, Homo sapien
tcagccgggcttgatggtacatacc

SEQ ID NO: 623734 - DNA, 25 bp, Homo sapien
cagccgggcttgatggtacatacct

SEQ ID NO: 623735 - DNA, 25 bp, Homo sapien
agccgggcttgatggtacatacctg

SEQ ID NO: 623736 - DNA, 25 bp, Homo sapien
gccgggcttgatggtacatacctgt

SEQ ID NO: 623737 - DNA, 25 bp, Homo sapien
ccgggcttgatggtacatacctgta

SEQ ID NO: 623738 - DNA, 25 bp, Homo sapien
gagagatataaaaccaatgcacctg

SEQ ID NO: 623739 - DNA, 25 bp, Homo sapien
agagatataaaaccaatgcacctgg

SEQ ID NO: 623740 - DNA, 25 bp, Homo sapien
gagatataaaaccaatgcacctggg

SEQ ID NO: 623741 - DNA, 25 bp, Homo sapien
agatataaaaccaatgcacctgggt

SEQ ID NO: 623742 - DNA, 25 bp, Homo sapien
gatataaaaccaatgcacctgggtg

SEQ ID NO: 623743 - DNA, 25 bp, Homo sapien
atataaaaccaatgcacctgggtgc

SEQ ID NO: 623744 - DNA, 25 bp, Homo sapien
tataaaaccaatgcacctgggtgcg

SEQ ID NO: 623745 - DNA, 25 bp, Homo sapien
ataaaaccaatgcacctgggtgcgg

SEQ ID NO: 623746 - DNA, 25 bp, Homo sapien
taaaaccaatgcacctgggtgcggt

SEQ ID NO: 623747 - DNA, 25 bp, Homo sapien
aaaaccaatgcacctgggtgcggtg

SEQ ID NO: 623748 - DNA, 25 bp, Homo sapien
aaaccaatgcacctgggtgcggtgg

SEQ ID NO: 623749 - DNA, 25 bp, Homo sapien
gaactaaaggtgcacaccagcacac

SEQ ID NO: 623750 - DNA, 25 bp, Homo sapien
cacaccaggccaatgctgaacattt

SEQ ID NO: 623751 - DNA, 25 bp, Homo sapien
cattttttaaatgcttaccagtcat

SEQ ID NO: 623752 - DNA, 25 bp, Homo sapien
ttttaaatgcttaccagtcatttgt

SEQ ID NO: 623753 - DNA, 25 bp, Homo sapien
accagtcatttgtatttcagctttt

SEQ ID NO: 623754 - DNA, 25 bp, Homo sapien
cagcttttgtgaatggacctattca

SEQ ID NO: 623755 - DNA, 25 bp, Homo sapien
gcttttgtgaatggacctattcatc

SEQ ID NO: 623756 - DNA, 25 bp, Homo sapien
gtgaatggacctattcatcttttga

SEQ ID NO: 623757 - DNA, 25 bp, Homo sapien
gaatggacctattcatcttttgact

SEQ ID NO: 623758 - DNA, 25 bp, Homo sapien
atggacctattcatcttttgacttt

SEQ ID NO: 623759 - DNA, 25 bp, Homo sapien
gactttttattcacttcattgtttt

SEQ ID NO: 623760 - DNA, 25 bp, Homo sapien
tgcaaataccatgtttcttcagatc

SEQ ID NO: 623761 - DNA, 25 bp, Homo sapien
gatctatctaacactcacgtttttt

SEQ ID NO: 623762 - DNA, 25 bp, Homo sapien
gaaattgggataatggcctcagtca

SEQ ID NO: 623763 - DNA, 25 bp, Homo sapien
gcctcagtcattacgtttggtggtt

SEQ ID NO: 623764 - DNA, 25 bp, Homo sapien
tattttggcagtgttcgttcttctt

SEQ ID NO: 623765 - DNA, 25 bp, Homo sapien
tgccatcttagatttggcgagatat

SEQ ID NO: 623766 - DNA, 25 bp, Homo sapien
gatatggtggaacccaactcataga

SEQ ID NO: 623767 - DNA, 25 bp, Homo sapien
catagagtgggtatgaggctcagct

SEQ ID NO: 623768 - DNA, 25 bp, Homo sapien
agctacttagtgcttaacaatgcct

SEQ ID NO: 623769 - DNA, 25 bp, Homo sapien
atgcctagcatatgatcagggttcc

SEQ ID NO: 623770 - DNA, 25 bp, Homo sapien
atgatcagggttccagaagctgtca

SEQ ID NO: 623771 - DNA, 25 bp, Homo sapien
aaaaaagtggcaaggcacgatggct

SEQ ID NO: 623772 - DNA, 25 bp, Homo sapien
aaaaagtggcaaggcacgatggctc

SEQ ID NO: 623773 - DNA, 25 bp, Homo sapien
aaaagtggcaaggcacgatggctca

SEQ ID NO: 623774 - DNA, 25 bp, Homo sapien
aaagtggcaaggcacgatggctcac

SEQ ID NO: 623775 - DNA, 25 bp, Homo sapien
aagtggcaaggcacgatggctcaca

SEQ ID NO: 623776 - DNA, 25 bp, Homo sapien
agtggcaaggcacgatggctcacac

SEQ ID NO: 623777 - DNA, 25 bp, Homo sapien
gtggcaaggcacgatggctcacacc

SEQ ID NO: 623778 - DNA, 25 bp, Homo sapien
tggcaaggcacgatggctcacacct

SEQ ID NO: 623779 - DNA, 25 bp, Homo sapien
ttggggtcaggagtttgaaactagc

SEQ ID NO: 623780 - DNA, 25 bp, Homo sapien
tggggtcaggagtttgaaactagcc

SEQ ID NO: 623781 - DNA, 25 bp, Homo sapien
ggcaacagagtgaaagcgagacccc

SEQ ID NO: 623782 - DNA, 25 bp, Homo sapien
caaaaactcagaaataggcagcagc

SEQ ID NO: 623783 - DNA, 25 bp, Homo sapien
aaaaactcagaaataggcagcagca

SEQ ID NO: 623784 - DNA, 25 bp, Homo sapien
aaaactcagaaataggcagcagcag

SEQ ID NO: 623785 - DNA, 25 bp, Homo sapien
aaactcagaaataggcagcagcagc

SEQ ID NO: 623786 - DNA, 25 bp, Homo sapien
actcagaaataggcagcagcagcta

SEQ ID NO: 623787 - DNA, 25 bp, Homo sapien
gcagcagcagctaaagataagcaga

SEQ ID NO: 623788 - DNA, 25 bp, Homo sapien
gcagctaaagataagcagaacaacc

SEQ ID NO: 623789 - DNA, 25 bp, Homo sapien
gcagaacaaccatgttcatgttcat

SEQ ID NO: 623790 - DNA, 25 bp, Homo sapien
gttcatgttcatattcatgtaagaa

SEQ ID NO: 623791 - DNA, 25 bp, Homo sapien
gttcatattcatgtaagaatgtatt

SEQ ID NO: 623792 - DNA, 25 bp, Homo sapien
agaatgtattttgttaaatgactcc

SEQ ID NO: 623793 - DNA, 25 bp, Homo sapien
gcttcagtattttgatagtgcctaa

SEQ ID NO: 623794 - DNA, 25 bp, Homo sapien
gtgcctaaaggccatagagtatagt

SEQ ID NO: 623795 - DNA, 25 bp, Homo sapien
gtatagtggataatcactgggacta

SEQ ID NO: 623796 - DNA, 25 bp, Homo sapien
actgggactagagccagacagcctg

SEQ ID NO: 623797 - DNA, 25 bp, Homo sapien
gatgctggatctgctgcttcctgcc

SEQ ID NO: 623798 - DNA, 25 bp, Homo sapien
caagtcttaacttacctgtgcttca

SEQ ID NO: 623799 - DNA, 25 bp, Homo sapien
ggcagccttgatttcataggtttgt

SEQ ID NO: 623800 - DNA, 25 bp, Homo sapien
gatttcataggtttgtccccagtgt

SEQ ID NO: 623801 - DNA, 25 bp, Homo sapien
taggtttgtccccagtgttagctta

SEQ ID NO: 623802 - DNA, 25 bp, Homo sapien
agtgttagcttaatatctggcatgt

SEQ ID NO: 623803 - DNA, 25 bp, Homo sapien
aataaacatgcatcatgtctgtgcc

SEQ ID NO: 623804 - DNA, 25 bp, Homo sapien
ttcaggctaaggtttcctgggtgca

SEQ ID NO: 623805 - DNA, 25 bp, Homo sapien
aggtttcctgggtgcaacgtggaca

SEQ ID NO: 623806 - DNA, 25 bp, Homo sapien
tcctgggtgcaacgtggacacgaat

SEQ ID NO: 623807 - DNA, 25 bp, Homo sapien
gacacgaatacagaactcctatgga

SEQ ID NO: 623808 - DNA, 25 bp, Homo sapien
gaactcctatggaactgcacacccg

SEQ ID NO: 623809 - DNA, 25 bp, Homo sapien
acacccgcttctgaagttgagccta

SEQ ID NO: 623810 - DNA, 25 bp, Homo sapien
gttgagcctaaaaacagacgtgtgt

SEQ ID NO: 623811 - DNA, 25 bp, Homo sapien
cctaaaaacagacgtgtgtgtgcct

SEQ ID NO: 623812 - DNA, 25 bp, Homo sapien
gtgtgcctgcaagtctagataccgt

SEQ ID NO: 623813 - DNA, 25 bp, Homo sapien
caagtctagataccgtctcgtgcgt

SEQ ID NO: 623814 - DNA, 25 bp, Homo sapien
accgtctcgtgcgtgcatcaaaata

SEQ ID NO: 623815 - DNA, 25 bp, Homo sapien
aggctgaacacacctgggccccagg

SEQ ID NO: 623816 - DNA, 25 bp, Homo sapien
ccatggcaacctcagcaaagcaatt

SEQ ID NO: 623817 - DNA, 25 bp, Homo sapien
aaagcaattgcactcctcccaagac

SEQ ID NO: 623818 - DNA, 25 bp, Homo sapien
ctcccaagacccagtcaggaacaaa

SEQ ID NO: 623819 - DNA, 25 bp, Homo sapien
aggaacaaaactgccgctgaagaga

SEQ ID NO: 623820 - DNA, 25 bp, Homo sapien
aaaactgccgctgaagagactggag

SEQ ID NO: 623821 - DNA, 25 bp, Homo sapien
ctggaggaatcataagatagtcttc

SEQ ID NO: 623822 - DNA, 25 bp, Homo sapien
gatagtcttcgaatcacagaacaga

SEQ ID NO: 623823 - DNA, 25 bp, Homo sapien
agaacagaatctccctgtctcagga

SEQ ID NO: 623824 - DNA, 25 bp, Homo sapien
gatctgagaatcgtaaaacacacaa

SEQ ID NO: 623825 - DNA, 25 bp, Homo sapien
tacaagtacttaggctcattccgtt

SEQ ID NO: 623826 - DNA, 25 bp, Homo sapien
accacacccggctatctctcttcct

SEQ ID NO: 623827 - DNA, 25 bp, Homo sapien
tcttccttttaacatgggccccacg

SEQ ID NO: 623828 - DNA, 25 bp, Homo sapien
tccttttaacatgggccccacgcct

SEQ ID NO: 623829 - DNA, 25 bp, Homo sapien
ttttaacatgggccccacgcctggc

SEQ ID NO: 623830 - DNA, 25 bp, Homo sapien
aacatgggccccacgcctggcctct

SEQ ID NO: 623831 - DNA, 25 bp, Homo sapien
cctggcctctgttcctgcaaactga

SEQ ID NO: 623832 - DNA, 25 bp, Homo sapien
ctggcctctgttcctgcaaactgac

SEQ ID NO: 623833 - DNA, 25 bp, Homo sapien
tggcctctgttcctgcaaactgact

SEQ ID NO: 623834 - DNA, 25 bp, Homo sapien
ggcctctgttcctgcaaactgactc

SEQ ID NO: 623835 - DNA, 25 bp, Homo sapien
gcctctgttcctgcaaactgactcc

SEQ ID NO: 623836 - DNA, 25 bp, Homo sapien
tcctgcaaactgactccctacccca

SEQ ID NO: 623837 - DNA, 25 bp, Homo sapien
tgagcatctaccatgtaccaggccc

SEQ ID NO: 623838 - DNA, 25 bp, Homo sapien
gtaccaggccccagactgagactta

SEQ ID NO: 623839 - DNA, 25 bp, Homo sapien
gccccagactgagacttaggcttca

SEQ ID NO: 623840 - DNA, 25 bp, Homo sapien
taggcttcagtctaagtcacaatcg

SEQ ID NO: 623841 - DNA, 25 bp, Homo sapien
tcacaatcgtgaataaggcagacat

SEQ ID NO: 623842 - DNA, 25 bp, Homo sapien
aataaggcagacatggtctctgctc

SEQ ID NO: 623843 - DNA, 25 bp, Homo sapien
tggtctctgctctcatgaggcttcc

SEQ ID NO: 623844 - DNA, 25 bp, Homo sapien
ctctcatgaggcttccgcggtgtgg

SEQ ID NO: 623845 - DNA, 25 bp, Homo sapien
aaagtagcccatgctaggcctcggg

SEQ ID NO: 623846 - DNA, 25 bp, Homo sapien
gggccggacatagtgacctatgcct

SEQ ID NO: 623847 - DNA, 25 bp, Homo sapien
atagtgacctatgcctgcggtccag

SEQ ID NO: 623848 - DNA, 25 bp, Homo sapien
gaaaggtagtttactcctgagtcct

SEQ ID NO: 623849 - DNA, 25 bp, Homo sapien
tcctgagtccttacctcattacaat

SEQ ID NO: 623850 - DNA, 25 bp, Homo sapien
gagtccttacctcattacaattttt

SEQ ID NO: 623851 - DNA, 25 bp, Homo sapien
caattttttcttatcaactgaccca

SEQ ID NO: 623852 - DNA, 25 bp, Homo sapien
tatcaactgacccaaatttagactt

SEQ ID NO: 623853 - DNA, 25 bp, Homo sapien
agaaatgacatgtatccgacagcat

SEQ ID NO: 623854 - DNA, 25 bp, Homo sapien
gtatccgacagcatattagcctaaa

SEQ ID NO: 623855 - DNA, 25 bp, Homo sapien
taaaggtcaaacctcacataaaaga

SEQ ID NO: 623856 - DNA, 25 bp, Homo sapien
gaagtttacaacattccccagaatt

SEQ ID NO: 623857 - DNA, 25 bp, Homo sapien
tacaacattccccagaattgctctt

SEQ ID NO: 623858 - DNA, 25 bp, Homo sapien
gaattgctcttctcatttaatttaa

SEQ ID NO: 623859 - DNA, 25 bp, Homo sapien
ttattctttgttttattacacccag

SEQ ID NO: 623860 - DNA, 25 bp, Homo sapien
tattctttgttttattacacccaga

SEQ ID NO: 623861 - DNA, 25 bp, Homo sapien
ttctttgttttattacacccagatt

SEQ ID NO: 623862 - DNA, 25 bp, Homo sapien
ttgttttattacacccagattttat

SEQ ID NO: 623863 - DNA, 25 bp, Homo sapien
ttattacacccagattttatgcatg

SEQ ID NO: 623864 - DNA, 25 bp, Homo sapien
attacacccagattttatgcatgat

SEQ ID NO: 623865 - DNA, 25 bp, Homo sapien
atttatatacagttgatacagcttt

SEQ ID NO: 623866 - DNA, 25 bp, Homo sapien
tatacagttgatacagctttatgat

SEQ ID NO: 623867 - DNA, 25 bp, Homo sapien
tacagttgatacagctttatgattt

SEQ ID NO: 623868 - DNA, 25 bp, Homo sapien
cagctttatgatttttgacgaatgt

SEQ ID NO: 623869 - DNA, 25 bp, Homo sapien
gctttatgatttttgacgaatgttt

SEQ ID NO: 623870 - DNA, 25 bp, Homo sapien
ggaggttgaggtggccggatcacaa

SEQ ID NO: 623871 - DNA, 25 bp, Homo sapien
atggcgtgagcccaggacggggagc

SEQ ID NO: 623872 - DNA, 25 bp, Homo sapien
tggcgtgagcccaggacggggagct

SEQ ID NO: 623873 - DNA, 25 bp, Homo sapien
ggcgtgagcccaggacggggagctt

SEQ ID NO: 623874 - DNA, 25 bp, Homo sapien
gcgtgagcccaggacggggagcttg

SEQ ID NO: 623875 - DNA, 25 bp, Homo sapien
cgtgagcccaggacggggagcttgc

SEQ ID NO: 623876 - DNA, 25 bp, Homo sapien
gtgagcccaggacggggagcttgca

SEQ ID NO: 623877 - DNA, 25 bp, Homo sapien
tgagcccaggacggggagcttgcag

SEQ ID NO: 623878 - DNA, 25 bp, Homo sapien
gagcccaggacggggagcttgcagt

SEQ ID NO: 623879 - DNA, 25 bp, Homo sapien
agcccaggacggggagcttgcagtg

SEQ ID NO: 623880 - DNA, 25 bp, Homo sapien
gcccaggacggggagcttgcagtga

SEQ ID NO: 623881 - DNA, 25 bp, Homo sapien
agagttgaaataaaggaagccaggc

SEQ ID NO: 623882 - DNA, 25 bp, Homo sapien
gagttgaaataaaggaagccaggca

SEQ ID NO: 623883 - DNA, 25 bp, Homo sapien
agttgaaataaaggaagccaggcac

SEQ ID NO: 623884 - DNA, 25 bp, Homo sapien
ttgaaataaaggaagccaggcacgg

SEQ ID NO: 623885 - DNA, 25 bp, Homo sapien
tgaaataaaggaagccaggcacggt

SEQ ID NO: 623886 - DNA, 25 bp, Homo sapien
gaaataaaggaagccaggcacggtg

SEQ ID NO: 623887 - DNA, 25 bp, Homo sapien
aaataaaggaagccaggcacggtgg

SEQ ID NO: 623888 - DNA, 25 bp, Homo sapien
tggtgggcacctgcggtctcagcta

SEQ ID NO: 623889 - DNA, 25 bp, Homo sapien
ggtgggcacctgcggtctcagctac

SEQ ID NO: 623890 - DNA, 25 bp, Homo sapien
gtgggcacctgcggtctcagctact

SEQ ID NO: 623891 - DNA, 25 bp, Homo sapien
tgggcacctgcggtctcagctactc

SEQ ID NO: 623892 - DNA, 25 bp, Homo sapien
aaaatataaaatgagcgctgtggct

SEQ ID NO: 623893 - DNA, 25 bp, Homo sapien
aatcagccgggcttgatggtacata

SEQ ID NO: 623894 - DNA, 25 bp, Homo sapien
atcagccgggcttgatggtacatac

SEQ ID NO: 623895 - DNA, 25 bp, Homo sapien
tcagccgggcttgatggtacatacc

SEQ ID NO: 623896 - DNA, 25 bp, Homo sapien
cagccgggcttgatggtacatacct

SEQ ID NO: 623897 - DNA, 25 bp, Homo sapien
agccgggcttgatggtacatacctg

SEQ ID NO: 623898 - DNA, 25 bp, Homo sapien
gccgggcttgatggtacatacctgt

SEQ ID NO: 623899 - DNA, 25 bp, Homo sapien
ccgggcttgatggtacatacctgta

SEQ ID NO: 623900 - DNA, 25 bp, Homo sapien
tacttgccttttcaaatagcttgtg

SEQ ID NO: 623901 - DNA, 25 bp, Homo sapien
cttgccttttcaaatagcttgtgct

SEQ ID NO: 623902 - DNA, 25 bp, Homo sapien
tgccttttcaaatagcttgtgcttt

SEQ ID NO: 623903 - DNA, 25 bp, Homo sapien
gacttttattcagtgagtaaaactt

SEQ ID NO: 623904 - DNA, 25 bp, Homo sapien
taaaagttcaacagtttcccctgag

SEQ ID NO: 623905 - DNA, 25 bp, Homo sapien
caacagtttcccctgaggaagataa

SEQ ID NO: 623906 - DNA, 25 bp, Homo sapien
aatatctttggttctttgttgctgg

SEQ ID NO: 623907 - DNA, 25 bp, Homo sapien
tctttgttgctggactaacaggtag

SEQ ID NO: 623908 - DNA, 25 bp, Homo sapien
gttgctggactaacaggtagtcagt

SEQ ID NO: 623909 - DNA, 25 bp, Homo sapien
gctggactaacaggtagtcagtaat

SEQ ID NO: 623910 - DNA, 25 bp, Homo sapien
ctaacaggtagtcagtaatatttgt

SEQ ID NO: 623911 - DNA, 25 bp, Homo sapien
gtcccacttggttgatagggcatct

SEQ ID NO: 623912 - DNA, 25 bp, Homo sapien
atagggcatctctagcctgacagat

SEQ ID NO: 623913 - DNA, 25 bp, Homo sapien
atctctagcctgacagatttatctg

SEQ ID NO: 623914 - DNA, 25 bp, Homo sapien
gagaacaggattatgcatttgaaac

SEQ ID NO: 623915 - DNA, 25 bp, Homo sapien
gaaaccagtttaattcttagcaaga

SEQ ID NO: 623916 - DNA, 25 bp, Homo sapien
aattcttagcaagacaatgcgcatg

SEQ ID NO: 623917 - DNA, 25 bp, Homo sapien
acaatgcgcatgtcttatgtagatt

SEQ ID NO: 623918 - DNA, 25 bp, Homo sapien
atgcatttgctaaagcctttctgga

SEQ ID NO: 623919 - DNA, 25 bp, Homo sapien
tgctaaagcctttctggacgtttac

SEQ ID NO: 623920 - DNA, 25 bp, Homo sapien
gtttacccagctctcaatgattgat

SEQ ID NO: 623921 - DNA, 25 bp, Homo sapien
acaggcagtggataaacatttttga

SEQ ID NO: 623922 - DNA, 25 bp, Homo sapien
agctcacagtgcgagtagcctgcaa

SEQ ID NO: 623923 - DNA, 25 bp, Homo sapien
agcctgcaagtgctaagggcataat

SEQ ID NO: 623924 - DNA, 25 bp, Homo sapien
gggcataatgcctccaaggtcaact

SEQ ID NO: 623925 - DNA, 25 bp, Homo sapien
caaggtcaactttaatcaacgaggt

SEQ ID NO: 623926 - DNA, 25 bp, Homo sapien
aatcaacgaggttcaagagtcagaa

SEQ ID NO: 623927 - DNA, 25 bp, Homo sapien
gagtgaattccttctgagatacatt

SEQ ID NO: 623928 - DNA, 25 bp, Homo sapien
agatacattctttctggtttctcag

SEQ ID NO: 623929 - DNA, 25 bp, Homo sapien
attctttctggtttctcagaggctc

SEQ ID NO: 623930 - DNA, 25 bp, Homo sapien
tccccagaggaagtaggccccagtt

SEQ ID NO: 623931 - DNA, 25 bp, Homo sapien
taggccccagttgcttaggaaaaat

SEQ ID NO: 623932 - DNA, 25 bp, Homo sapien
actccattccgtgaagttcctggga

SEQ ID NO: 623933 - DNA, 25 bp, Homo sapien
tagtctcctgacatttgatttcgga

SEQ ID NO: 623934 - DNA, 25 bp, Homo sapien
tgacatttgatttcggaggagctgg

SEQ ID NO: 623935 - DNA, 25 bp, Homo sapien
ggagagtgaaggaagccaaagttca

SEQ ID NO: 623936 - DNA, 25 bp, Homo sapien
gaagccaaagttcaacagatgagag

SEQ ID NO: 623937 - DNA, 25 bp, Homo sapien
tttttccttagcgtggtttcactgg

SEQ ID NO: 623938 - DNA, 25 bp, Homo sapien
tccttagcgtggtttcactggaata

SEQ ID NO: 623939 - DNA, 25 bp, Homo sapien
cactggaataatgaactcagagcct

SEQ ID NO: 623940 - DNA, 25 bp, Homo sapien
gaaaacctcaatgtcaaatggccag

SEQ ID NO: 623941 - DNA, 25 bp, Homo sapien
tcaatgtcaaatggccaggctggtt

SEQ ID NO: 623942 - DNA, 25 bp, Homo sapien
acgaggagagtgacaaagttaagca

SEQ ID NO: 623943 - DNA, 25 bp, Homo sapien
taagggattggtttatacaagtaag

SEQ ID NO: 623944 - DNA, 25 bp, Homo sapien
gggtggcaacgtgtgtcagcacact

SEQ ID NO: 623945 - DNA, 25 bp, Homo sapien
ggtggcaacgtgtgtcagcacactg

SEQ ID NO: 623946 - DNA, 25 bp, Homo sapien
gtggcaacgtgtgtcagcacactgg

SEQ ID NO: 623947 - DNA, 25 bp, Homo sapien
tggcaacgtgtgtcagcacactggc

SEQ ID NO: 623948 - DNA, 25 bp, Homo sapien
ggcaacgtgtgtcagcacactggct

SEQ ID NO: 623949 - DNA, 25 bp, Homo sapien
gcaacgtgtgtcagcacactggctc

SEQ ID NO: 623950 - DNA, 25 bp, Homo sapien
caacgtgtgtcagcacactggctct

SEQ ID NO: 623951 - DNA, 25 bp, Homo sapien
aacgtgtgtcagcacactggctctg

SEQ ID NO: 623952 - DNA, 25 bp, Homo sapien
acgtgtgtcagcacactggctctga

SEQ ID NO: 623953 - DNA, 25 bp, Homo sapien
cgtgtgtcagcacactggctctgag

SEQ ID NO: 623954 - DNA, 25 bp, Homo sapien
gtgtgtcagcacactggctctgaga

SEQ ID NO: 623955 - DNA, 25 bp, Homo sapien
gaagcatggtaccagaatctgcctg

SEQ ID NO: 623956 - DNA, 25 bp, Homo sapien
gtaccagaatctgcctgacttctaa

SEQ ID NO: 623957 - DNA, 25 bp, Homo sapien
agaatctgcctgacttctaatgagg

SEQ ID NO: 623958 - DNA, 25 bp, Homo sapien
tgcctgacttctaatgagggcttca

SEQ ID NO: 623959 - DNA, 25 bp, Homo sapien
tgacttctaatgagggcttcaggaa

SEQ ID NO: 623960 - DNA, 25 bp, Homo sapien
gaagggtgagcaggcatctcaacat

SEQ ID NO: 623961 - DNA, 25 bp, Homo sapien
agcaggcatctcaacatggtggagt

SEQ ID NO: 623962 - DNA, 25 bp, Homo sapien
aagagagctattacacttctttaat

SEQ ID NO: 623963 - DNA, 25 bp, Homo sapien
aaagaatttacttggctttgcctag

SEQ ID NO: 623964 - DNA, 25 bp, Homo sapien
ttacttggctttgcctagttcctta

SEQ ID NO: 623965 - DNA, 25 bp, Homo sapien
ggctttgcctagttccttatagaaa

SEQ ID NO: 623966 - DNA, 25 bp, Homo sapien
ggaagatggtacatctgccttggaa

SEQ ID NO: 623967 - DNA, 25 bp, Homo sapien
agatggtacatctgccttggaaaac

SEQ ID NO: 623968 - DNA, 25 bp, Homo sapien
tggtacatctgccttggaaaactat

SEQ ID NO: 623969 - DNA, 25 bp, Homo sapien
gtacatctgccttggaaaactatat

SEQ ID NO: 623970 - DNA, 25 bp, Homo sapien
acatctgccttggaaaactatatgg

SEQ ID NO: 623971 - DNA, 25 bp, Homo sapien
atctgccttggaaaactatatggtg

SEQ ID NO: 623972 - DNA, 25 bp, Homo sapien
gaaaactatatggtggttctcccca

SEQ ID NO: 623973 - DNA, 25 bp, Homo sapien
actatatggtggttctccccaaaat

SEQ ID NO: 623974 - DNA, 25 bp, Homo sapien
tatatggtggttctccccaaaatta

SEQ ID NO: 623975 - DNA, 25 bp, Homo sapien
ttctgggtacacacccaaaagaact

SEQ ID NO: 623976 - DNA, 25 bp, Homo sapien
aagaactgaaaacatggctaacatg

SEQ ID NO: 623977 - DNA, 25 bp, Homo sapien
atggcaaaagtgtacgtacctggaa

SEQ ID NO: 623978 - DNA, 25 bp, Homo sapien
ttgaatgttgttttcaccaaggcat

SEQ ID NO: 623979 - DNA, 25 bp, Homo sapien
gttgttttcaccaaggcattttgat

SEQ ID NO: 623980 - DNA, 25 bp, Homo sapien
ttttcaccaaggcattttgatctga

SEQ ID NO: 623981 - DNA, 25 bp, Homo sapien
ggcattttgatctgaatgactttaa

SEQ ID NO: 623982 - DNA, 25 bp, Homo sapien
gaatgtttctaagccatataaatat

SEQ ID NO: 623983 - DNA, 25 bp, Homo sapien
aattccccattttgaaatctttcag

SEQ ID NO: 623984 - DNA, 25 bp, Homo sapien
aatctttcagatcaccttttcacag

SEQ ID NO: 623985 - DNA, 25 bp, Homo sapien
tcagatcaccttttcacagtgtcag

SEQ ID NO: 623986 - DNA, 25 bp, Homo sapien
gatcaccttttcacagtgtcagagt

SEQ ID NO: 623987 - DNA, 25 bp, Homo sapien
tttcacagtgtcagagtaatatatt

SEQ ID NO: 623988 - DNA, 25 bp, Homo sapien
gaacccaggtgcactaaggtaactt

SEQ ID NO: 623989 - DNA, 25 bp, Homo sapien
aaggtaacttcgctactctgctaga

SEQ ID NO: 623990 - DNA, 25 bp, Homo sapien
acttcgctactctgctagagtctca

SEQ ID NO: 623991 - DNA, 25 bp, Homo sapien
ctgttaagccttgggctgtgagatg

SEQ ID NO: 623992 - DNA, 25 bp, Homo sapien
agatgggccagtgtagcccggctac

SEQ ID NO: 623993 - DNA, 25 bp, Homo sapien
ctactgccgtgttccctgggtcagg

SEQ ID NO: 623994 - DNA, 25 bp, Homo sapien
tcagggacagctgcctcactgggag

SEQ ID NO: 623995 - DNA, 25 bp, Homo sapien
tgcctcactgggagcgccttagaaa

SEQ ID NO: 623996 - DNA, 25 bp, Homo sapien
tgggagcgccttagaaatgtagaat

SEQ ID NO: 623997 - DNA, 25 bp, Homo sapien
aatgtagaatcttggccaggaatct

SEQ ID NO: 623998 - DNA, 25 bp, Homo sapien
gccaggaatctggagcctgtaatcc

SEQ ID NO: 623999 - DNA, 25 bp, Homo sapien
aggtaggccgttgttaatcctagca

SEQ ID NO: 624000 - DNA, 25 bp, Homo sapien
ggtaggccgttgttaatcctagcac

SEQ ID NO: 624001 - DNA, 25 bp, Homo sapien
gtaggccgttgttaatcctagcact

SEQ ID NO: 624002 - DNA, 25 bp, Homo sapien
taggccgttgttaatcctagcactt

SEQ ID NO: 624003 - DNA, 25 bp, Homo sapien
aaaattatttggttacggtggcatg

SEQ ID NO: 624004 - DNA, 25 bp, Homo sapien
aaattatttggttacggtggcatgc

SEQ ID NO: 624005 - DNA, 25 bp, Homo sapien
aattatttggttacggtggcatgca

SEQ ID NO: 624006 - DNA, 25 bp, Homo sapien
attatttggttacggtggcatgcac

SEQ ID NO: 624007 - DNA, 25 bp, Homo sapien
ttatttggttacggtggcatgcacc

SEQ ID NO: 624008 - DNA, 25 bp, Homo sapien
agcagggcatagtggcgggcgccta

SEQ ID NO: 624009 - DNA, 25 bp, Homo sapien
gcagggcatagtggcgggcgcctat

SEQ ID NO: 624010 - DNA, 25 bp, Homo sapien
gggcgcctatactcccagttgctcg

SEQ ID NO: 624011 - DNA, 25 bp, Homo sapien
ggcgcctatactcccagttgctcgg

SEQ ID NO: 624012 - DNA, 25 bp, Homo sapien
gcgcctatactcccagttgctcggg

SEQ ID NO: 624013 - DNA, 25 bp, Homo sapien
cgcctatactcccagttgctcggga

SEQ ID NO: 624014 - DNA, 25 bp, Homo sapien
gcctatactcccagttgctcgggag

SEQ ID NO: 624015 - DNA, 25 bp, Homo sapien
ctatactcccagttgctcgggaggc

SEQ ID NO: 624016 - DNA, 25 bp, Homo sapien
tatactcccagttgctcgggaggct

SEQ ID NO: 624017 - DNA, 25 bp, Homo sapien
atactcccagttgctcgggaggctg

SEQ ID NO: 624018 - DNA, 25 bp, Homo sapien
tactcccagttgctcgggaggctga

SEQ ID NO: 624019 - DNA, 25 bp, Homo sapien
cagacccggtctccaggaacaaaag

SEQ ID NO: 624020 - DNA, 25 bp, Homo sapien
ccttgggagaagcaacaggcattga

SEQ ID NO: 624021 - DNA, 25 bp, Homo sapien
aggcattgaacactcaagccaccaa

SEQ ID NO: 624022 - DNA, 25 bp, Homo sapien
cactcaagccaccaaatccaaggta

SEQ ID NO: 624023 - DNA, 25 bp, Homo sapien
atccaaggtatggttggctacccca

SEQ ID NO: 624024 - DNA, 25 bp, Homo sapien
aggtatggttggctaccccagccaa

SEQ ID NO: 624025 - DNA, 25 bp, Homo sapien
ccagccaaagagcaatcccaaagca

SEQ ID NO: 624026 - DNA, 25 bp, Homo sapien
aatcccaaagcaggaattcaacagt

SEQ ID NO: 624027 - DNA, 25 bp, Homo sapien
aagacttagtggattttccttatcg

SEQ ID NO: 624028 - DNA, 25 bp, Homo sapien
gattttccttatcgatccttctcat

SEQ ID NO: 624029 - DNA, 25 bp, Homo sapien
ttatcgatccttctcattgttttta

SEQ ID NO: 624030 - DNA, 25 bp, Homo sapien
accagtctgttctggcatgcttcca

SEQ ID NO: 624031 - DNA, 25 bp, Homo sapien
ccagtctgttctggcatgcttccaa

SEQ ID NO: 624032 - DNA, 25 bp, Homo sapien
cagtctgttctggcatgcttccaaa

SEQ ID NO: 624033 - DNA, 25 bp, Homo sapien
gtctgttctggcatgcttccaaaga

SEQ ID NO: 624034 - DNA, 25 bp, Homo sapien
ggcatgcttccaaagatctcagggc

SEQ ID NO: 624035 - DNA, 25 bp, Homo sapien
gcatgcttccaaagatctcagggct

SEQ ID NO: 624036 - DNA, 25 bp, Homo sapien
catgcttccaaagatctcagggctg

SEQ ID NO: 624037 - DNA, 25 bp, Homo sapien
tccaaagatctcagggctgggtgca

SEQ ID NO: 624038 - DNA, 25 bp, Homo sapien
agtccaggacttcgaggccagcttg

SEQ ID NO: 624039 - DNA, 25 bp, Homo sapien
tgggaggtggatggcttgaatcttg

SEQ ID NO: 624040 - DNA, 25 bp, Homo sapien
gatggcttgaatcttggaggtggag

SEQ ID NO: 624041 - DNA, 25 bp, Homo sapien
ttgtacttttagtaactaccattct

SEQ ID NO: 624042 - DNA, 25 bp, Homo sapien
ttagtaactaccattctttgattag

SEQ ID NO: 624043 - DNA, 25 bp, Homo sapien
gaatgcatatcttactttggttgta

SEQ ID NO: 624044 - DNA, 25 bp, Homo sapien
tgcatatcttactttggttgtaaat

SEQ ID NO: 624045 - DNA, 25 bp, Homo sapien
ggttgtaaattatcaagggctttct

SEQ ID NO: 624046 - DNA, 25 bp, Homo sapien
gtaaattatcaagggctttctaata

SEQ ID NO: 624047 - DNA, 25 bp, Homo sapien
tcacatactgtgtttccagttgtct

SEQ ID NO: 624048 - DNA, 25 bp, Homo sapien
catactgtgtttccagttgtcttga

SEQ ID NO: 624049 - DNA, 25 bp, Homo sapien
ctgtgtttccagttgtcttgatatt

SEQ ID NO: 624050 - DNA, 25 bp, Homo sapien
gtgtttccagttgtcttgatattga

SEQ ID NO: 624051 - DNA, 25 bp, Homo sapien
tgtaataaacttcatgctcacctat

SEQ ID NO: 624052 - DNA, 25 bp, Homo sapien
gggtgatggcgtgagactccatgtc

SEQ ID NO: 624053 - DNA, 25 bp, Homo sapien
ggtgatggcgtgagactccatgtca

SEQ ID NO: 624054 - DNA, 25 bp, Homo sapien
gtgatggcgtgagactccatgtcaa

SEQ ID NO: 624055 - DNA, 25 bp, Homo sapien
tgatggcgtgagactccatgtcaaa

SEQ ID NO: 624056 - DNA, 25 bp, Homo sapien
gatggcgtgagactccatgtcaaaa

SEQ ID NO: 624057 - DNA, 25 bp, Homo sapien
atggcgtgagactccatgtcaaaaa

SEQ ID NO: 624058 - DNA, 25 bp, Homo sapien
tggcgtgagactccatgtcaaaaaa

SEQ ID NO: 624059 - DNA, 25 bp, Homo sapien
gggaggataggacgggccaggcacg

SEQ ID NO: 624060 - DNA, 25 bp, Homo sapien
ggaggataggacgggccaggcacgg

SEQ ID NO: 624061 - DNA, 25 bp, Homo sapien
gaggataggacgggccaggcacggg

SEQ ID NO: 624062 - DNA, 25 bp, Homo sapien
gataggacgggccaggcacgggggc

SEQ ID NO: 624063 - DNA, 25 bp, Homo sapien
tctgtaggagatcttccaaattact

SEQ ID NO: 624064 - DNA, 25 bp, Homo sapien
attacaaaaattacaccactcaatg

SEQ ID NO: 624065 - DNA, 25 bp, Homo sapien
aaattacaccactcaatgtagtcta

SEQ ID NO: 624066 - DNA, 25 bp, Homo sapien
attacaccactcaatgtagtctaaa

SEQ ID NO: 624067 - DNA, 25 bp, Homo sapien
acaccactcaatgtagtctaaatta

SEQ ID NO: 624068 - DNA, 25 bp, Homo sapien
tattgagagtaaattgtagccattc

SEQ ID NO: 624069 - DNA, 25 bp, Homo sapien
tgagagtaaattgtagccattcttt

SEQ ID NO: 624070 - DNA, 25 bp, Homo sapien
tagccattcttttacatgttttctg

SEQ ID NO: 624071 - DNA, 25 bp, Homo sapien
gccattcttttacatgttttctgaa

SEQ ID NO: 624072 - DNA, 25 bp, Homo sapien
tcttttacatgttttctgaacttag

SEQ ID NO: 624073 - DNA, 25 bp, Homo sapien
ttacatgttttctgaacttagttgc

SEQ ID NO: 624074 - DNA, 25 bp, Homo sapien
agatggtgatgctcattctcactgc

SEQ ID NO: 624075 - DNA, 25 bp, Homo sapien
gatgctcattctcactgctcattat

SEQ ID NO: 624076 - DNA, 25 bp, Homo sapien
atgccagtataatgcatttgcatgc

SEQ ID NO: 624077 - DNA, 25 bp, Homo sapien
atttgcatgcaaaaagactctacca

SEQ ID NO: 624078 - DNA, 25 bp, Homo sapien
caaaaagactctaccaccagtgcca

SEQ ID NO: 624079 - DNA, 25 bp, Homo sapien
agttaccctgtagcctctaaaatgg

SEQ ID NO: 624080 - DNA, 25 bp, Homo sapien
ggaagaaccctcagttctggaaaat

SEQ ID NO: 624081 - DNA, 25 bp, Homo sapien
ataagtatagtcaatcgagcagcca

SEQ ID NO: 624082 - DNA, 25 bp, Homo sapien
gtatagtcaatcgagcagccaatct

SEQ ID NO: 624083 - DNA, 25 bp, Homo sapien
agtcaatcgagcagccaatctcacc

SEQ ID NO: 624084 - DNA, 25 bp, Homo sapien
agccaatctcaccgctctgtctatg

SEQ ID NO: 624085 - DNA, 25 bp, Homo sapien
aaacaagtcagaggaccagcatcta

SEQ ID NO: 624086 - DNA, 25 bp, Homo sapien
aggaccagcatctaactacttggac

SEQ ID NO: 624087 - DNA, 25 bp, Homo sapien
accagcatctaactacttggaccag

SEQ ID NO: 624088 - DNA, 25 bp, Homo sapien
ctacttggaccagatggaagaatat

SEQ ID NO: 624089 - DNA, 25 bp, Homo sapien
ctgcttctgtattcaggaggttgtg

SEQ ID NO: 624090 - DNA, 25 bp, Homo sapien
ttctgtattcaggaggttgtgagtg

SEQ ID NO: 624091 - DNA, 25 bp, Homo sapien
ggatggctcgcaacgtctcttcatt

SEQ ID NO: 624092 - DNA, 25 bp, Homo sapien
gttatgtgaagatacttacccctga

SEQ ID NO: 624093 - DNA, 25 bp, Homo sapien
gtgaagatacttacccctgaaggag

SEQ ID NO: 624094 - DNA, 25 bp, Homo sapien
gatacttacccctgaaggagaaatt

SEQ ID NO: 624095 - DNA, 25 bp, Homo sapien
gaaggagaaattttcaaggagcctt

SEQ ID NO: 624096 - DNA, 25 bp, Homo sapien
aagcaggtgcgtttctgcaggatga

SEQ ID NO: 624097 - DNA, 25 bp, Homo sapien
caggtgcgtttctgcaggatgagct

SEQ ID NO: 624098 - DNA, 25 bp, Homo sapien
gcttaattaaagaacacgctcacgg

SEQ ID NO: 624099 - DNA, 25 bp, Homo sapien
ttaaagaacacgctcacggcatcca

SEQ ID NO: 624100 - DNA, 25 bp, Homo sapien
agaacacgctcacggcatccaaaag

SEQ ID NO: 624101 - DNA, 25 bp, Homo sapien
acgctcacggcatccaaaagatctt

SEQ ID NO: 624102 - DNA, 25 bp, Homo sapien
gctcacggcatccaaaagatcttga

SEQ ID NO: 624103 - DNA, 25 bp, Homo sapien
aaaagatcttgaattgccaccgtgt

SEQ ID NO: 624104 - DNA, 25 bp, Homo sapien
ttttaactcttttcatggtgggtca

SEQ ID NO: 624105 - DNA, 25 bp, Homo sapien
ttaactcttttcatggtgggtcatt

SEQ ID NO: 624106 - DNA, 25 bp, Homo sapien
atggtgggtcattgtcctccctgca

SEQ ID NO: 624107 - DNA, 25 bp, Homo sapien
tacaaaaatgaagttgcaggccagg

SEQ ID NO: 624108 - DNA, 25 bp, Homo sapien
acaaaaatgaagttgcaggccaggc

SEQ ID NO: 624109 - DNA, 25 bp, Homo sapien
caaaaatgaagttgcaggccaggcg

SEQ ID NO: 624110 - DNA, 25 bp, Homo sapien
aaaatgaagttgcaggccaggcgtg

SEQ ID NO: 624111 - DNA, 25 bp, Homo sapien
aaatgaagttgcaggccaggcgtgg

SEQ ID NO: 624112 - DNA, 25 bp, Homo sapien
aatgaagttgcaggccaggcgtggt

SEQ ID NO: 624113 - DNA, 25 bp, Homo sapien
atgaagttgcaggccaggcgtggtg

SEQ ID NO: 624114 - DNA, 25 bp, Homo sapien
tgaagttgcaggccaggcgtggtgg

SEQ ID NO: 624115 - DNA, 25 bp, Homo sapien
taatctaaccagagcaccttcatgg

SEQ ID NO: 624116 - DNA, 25 bp, Homo sapien
gcaccttcatggtggaagacaccca

SEQ ID NO: 624117 - DNA, 25 bp, Homo sapien
tggaagacacccaccaggtcataca

SEQ ID NO: 624118 - DNA, 25 bp, Homo sapien
gacacccaccaggtcatacaatgtg

SEQ ID NO: 624119 - DNA, 25 bp, Homo sapien
aatgtgaacttttgtatctctgcag

SEQ ID NO: 624120 - DNA, 25 bp, Homo sapien
gtatctctgcagtggtttcaaggac

SEQ ID NO: 624121 - DNA, 25 bp, Homo sapien
tctctgcagtggtttcaaggacaaa

SEQ ID NO: 624122 - DNA, 25 bp, Homo sapien
gtccaatgtattgggccatttttcc

SEQ ID NO: 624123 - DNA, 25 bp, Homo sapien
ttatttttcctttgacttatttgtg

SEQ ID NO: 624124 - DNA, 25 bp, Homo sapien
tgacttatttgtgttgttcttattt

SEQ ID NO: 624125 - DNA, 25 bp, Homo sapien
tagtctgtaagttagcctttttggg

SEQ ID NO: 624126 - DNA, 25 bp, Homo sapien
accacactgggccaatgcttaatat

SEQ ID NO: 624127 - DNA, 25 bp, Homo sapien
cacactgggccaatgcttaatattt

SEQ ID NO: 624128 - DNA, 25 bp, Homo sapien
gaaacaaagccttttgacttgttag

SEQ ID NO: 624129 - DNA, 25 bp, Homo sapien
gaaactttatagttgtgacattgaa

SEQ ID NO: 624130 - DNA, 25 bp, Homo sapien
gttgtgacattgaaagactgttggg

SEQ ID NO: 624131 - DNA, 25 bp, Homo sapien
tactttccatcttaatgtaacctta

SEQ ID NO: 624132 - DNA, 25 bp, Homo sapien
tccatcttaatgtaaccttatgcta

SEQ ID NO: 624133 - DNA, 25 bp, Homo sapien
aatgtaaccttatgctattctgtat

SEQ ID NO: 624134 - DNA, 25 bp, Homo sapien
gtaaccttatgctattctgtatttt

SEQ ID NO: 624135 - DNA, 25 bp, Homo sapien
aaccttatgctattctgtattttta

SEQ ID NO: 624136 - DNA, 25 bp, Homo sapien
ttttactgtatattgcttttacaat

SEQ ID NO: 624137 - DNA, 25 bp, Homo sapien
gaggccatgatggacacccgcgtgc

SEQ ID NO: 624138 - DNA, 25 bp, Homo sapien
aggccatgatggacacccgcgtgca

SEQ ID NO: 624139 - DNA, 25 bp, Homo sapien
ggccatgatggacacccgcgtgcaa

SEQ ID NO: 624140 - DNA, 25 bp, Homo sapien
ccatgatggacacccgcgtgcaaga

SEQ ID NO: 624141 - DNA, 25 bp, Homo sapien
atggacacccgcgtgcaagatgctg

SEQ ID NO: 624142 - DNA, 25 bp, Homo sapien
tggacacccgcgtgcaagatgctgt

SEQ ID NO: 624143 - DNA, 25 bp, Homo sapien
ggacacccgcgtgcaagatgctgtc

SEQ ID NO: 624144 - DNA, 25 bp, Homo sapien
gtccagcagcaccagcagaagatgt

SEQ ID NO: 624145 - DNA, 25 bp, Homo sapien
tccagcagcaccagcagaagatgtg

SEQ ID NO: 624146 - DNA, 25 bp, Homo sapien
cagcagcaccagcagaagatgtgct

SEQ ID NO: 624147 - DNA, 25 bp, Homo sapien
cagcaccagcagaagatgtgctggc

SEQ ID NO: 624148 - DNA, 25 bp, Homo sapien
atcacctgtggctcatgtgcattgg

SEQ ID NO: 624149 - DNA, 25 bp, Homo sapien
ctgtggctcatgtgcattggcccca

SEQ ID NO: 624150 - DNA, 25 bp, Homo sapien
tgtggctcatgtgcattggccccat

SEQ ID NO: 624151 - DNA, 25 bp, Homo sapien
ctgcccagccgacgccaggcagagc

SEQ ID NO: 624152 - DNA, 25 bp, Homo sapien
gtagatgtcgctcgtcttctctcta

SEQ ID NO: 624153 - DNA, 25 bp, Homo sapien
ctcgtcttctctctacttaaattgt

SEQ ID NO: 624154 - DNA, 25 bp, Homo sapien
tcgtcttctctctacttaaattgtc

SEQ ID NO: 624155 - DNA, 25 bp, Homo sapien
gtcttctctctacttaaattgtcat

SEQ ID NO: 624156 - DNA, 25 bp, Homo sapien
ttctctctacttaaattgtcatcca

SEQ ID NO: 624157 - DNA, 25 bp, Homo sapien
tctacttaaattgtcatccaccagg

SEQ ID NO: 624158 - DNA, 25 bp, Homo sapien
tacttaaattgtcatccaccaggtc

SEQ ID NO: 624159 - DNA, 25 bp, Homo sapien
actgggaaatgagctctgagcccct

SEQ ID NO: 624160 - DNA, 25 bp, Homo sapien
ctgagcccctggataggaatgtttc

SEQ ID NO: 624161 - DNA, 25 bp, Homo sapien
ggaatgtttctgtttgcctgaggcc

SEQ ID NO: 624162 - DNA, 25 bp, Homo sapien
aatgtttctgtttgcctgaggcctt

SEQ ID NO: 624163 - DNA, 25 bp, Homo sapien
ctgaggcctttgaccatgccagata

SEQ ID NO: 624164 - DNA, 25 bp, Homo sapien
gcctttgaccatgccagatagttta

SEQ ID NO: 624165 - DNA, 25 bp, Homo sapien
tttgaccatgccagatagtttatgc

SEQ ID NO: 624166 - DNA, 25 bp, Homo sapien
agtgaatacctgttttcctgtgtct

SEQ ID NO: 624167 - DNA, 25 bp, Homo sapien
ttttcctgtgtctaagaccctgggc

SEQ ID NO: 624168 - DNA, 25 bp, Homo sapien
accctgggctgcactgtattaattt

SEQ ID NO: 624169 - DNA, 25 bp, Homo sapien
gggctgcactgtattaatttgacct

SEQ ID NO: 624170 - DNA, 25 bp, Homo sapien
gctgttttcttagggtgcatccttt

SEQ ID NO: 624171 - DNA, 25 bp, Homo sapien
ctgttttcttagggtgcatcctttg

SEQ ID NO: 624172 - DNA, 25 bp, Homo sapien
tgttttcttagggtgcatcctttgt

SEQ ID NO: 624173 - DNA, 25 bp, Homo sapien
ttttcttagggtgcatcctttgttt

SEQ ID NO: 624174 - DNA, 25 bp, Homo sapien
tttcttagggtgcatcctttgtttt

SEQ ID NO: 624175 - DNA, 25 bp, Homo sapien
ttcttagggtgcatcctttgttttt

SEQ ID NO: 624176 - DNA, 25 bp, Homo sapien
cttagggtgcatcctttgtttttct

SEQ ID NO: 624177 - DNA, 25 bp, Homo sapien
ttagggtgcatcctttgtttttctg

SEQ ID NO: 624178 - DNA, 25 bp, Homo sapien
tagggtgcatcctttgtttttctgg

SEQ ID NO: 624179 - DNA, 25 bp, Homo sapien
gatggagctgctgtgcctaataaca

SEQ ID NO: 624180 - DNA, 25 bp, Homo sapien
gggcatcactcaacattcagcctgt

SEQ ID NO: 624181 - DNA, 25 bp, Homo sapien
atcactcaacattcagcctgtacac

SEQ ID NO: 624182 - DNA, 25 bp, Homo sapien
acattcagcctgtacacactcaaag

SEQ ID NO: 624183 - DNA, 25 bp, Homo sapien
ttcagcctgtacacactcaaaggtg

SEQ ID NO: 624184 - DNA, 25 bp, Homo sapien
gcctgtacacactcaaaggtgtaga

SEQ ID NO: 624185 - DNA, 25 bp, Homo sapien
acacactcaaaggtgtagaagtgac

SEQ ID NO: 624186 - DNA, 25 bp, Homo sapien
gtgacaaagatgactggccagccag

SEQ ID NO: 624187 - DNA, 25 bp, Homo sapien
gttactgggtcgtgatgacgcagac

SEQ ID NO: 624188 - DNA, 25 bp, Homo sapien
gtgatgacgcagacctgccgggaca

SEQ ID NO: 624189 - DNA, 25 bp, Homo sapien
gggcacttgcaggaatggcacttga

SEQ ID NO: 624190 - DNA, 25 bp, Homo sapien
cagttgtgttatttccccaattctt

SEQ ID NO: 624191 - DNA, 25 bp, Homo sapien
atttccccaattctttgtcttcgtg

SEQ ID NO: 624192 - DNA, 25 bp, Homo sapien
aattctttgtcttcgtgcacttaga

SEQ ID NO: 624193 - DNA, 25 bp, Homo sapien
cgtgcacttagaaaataggattacc

SEQ ID NO: 624194 - DNA, 25 bp, Homo sapien
taggattacctcctattttcctcca

SEQ ID NO: 624195 - DNA, 25 bp, Homo sapien
ttcctctggagttaggacaagaatg

SEQ ID NO: 624196 - DNA, 25 bp, Homo sapien
gacaagaatgggaactacccgaaga

SEQ ID NO: 624197 - DNA, 25 bp, Homo sapien
gaggatctagcttttttagtcttcc

SEQ ID NO: 624198 - DNA, 25 bp, Homo sapien
ttttagtcttccacaattagctttg

SEQ ID NO: 624199 - DNA, 25 bp, Homo sapien
gggcaaatattaccagctctgctgt

SEQ ID NO: 624200 - DNA, 25 bp, Homo sapien
atattaccagctctgctgttttcag

SEQ ID NO: 624201 - DNA, 25 bp, Homo sapien
tgtagatactcacttgtctcagcag

SEQ ID NO: 624202 - DNA, 25 bp, Homo sapien
gtagatactcacttgtctcagcagc

SEQ ID NO: 624203 - DNA, 25 bp, Homo sapien
tagatactcacttgtctcagcagca

SEQ ID NO: 624204 - DNA, 25 bp, Homo sapien
agatactcacttgtctcagcagcat

SEQ ID NO: 624205 - DNA, 25 bp, Homo sapien
gatactcacttgtctcagcagcatc

SEQ ID NO: 624206 - DNA, 25 bp, Homo sapien
atactcacttgtctcagcagcatct

SEQ ID NO: 624207 - DNA, 25 bp, Homo sapien
tactcacttgtctcagcagcatctg

SEQ ID NO: 624208 - DNA, 25 bp, Homo sapien
actcacttgtctcagcagcatctgt

SEQ ID NO: 624209 - DNA, 25 bp, Homo sapien
tcacttgtctcagcagcatctgttg

SEQ ID NO: 624210 - DNA, 25 bp, Homo sapien
aaaggctttttaggccgagcacagt

SEQ ID NO: 624211 - DNA, 25 bp, Homo sapien
aaggctttttaggccgagcacagtg

SEQ ID NO: 624212 - DNA, 25 bp, Homo sapien
aaagcccagctcagcgggtacgcag

SEQ ID NO: 624213 - DNA, 25 bp, Homo sapien
ccagctcagcgggtacgcagtggag

SEQ ID NO: 624214 - DNA, 25 bp, Homo sapien
cgcagtggaggcgacaaggaaccaa

SEQ ID NO: 624215 - DNA, 25 bp, Homo sapien
ggaggcgacaaggaaccaatcacaa

SEQ ID NO: 624216 - DNA, 25 bp, Homo sapien
gacaaggaaccaatcacaactacag

SEQ ID NO: 624217 - DNA, 25 bp, Homo sapien
aaggaaccaatcacaactacagagg

SEQ ID NO: 624218 - DNA, 25 bp, Homo sapien
caatcacaactacagaggtttctct

SEQ ID NO: 624219 - DNA, 25 bp, Homo sapien
tacagaggtttctctgatcctcctc

SEQ ID NO: 624220 - DNA, 25 bp, Homo sapien
gaggtttctctgatcctcctccact

SEQ ID NO: 624221 - DNA, 25 bp, Homo sapien
actcccgctgcttcaacttgactaa

SEQ ID NO: 624222 - DNA, 25 bp, Homo sapien
gctgcttcaacttgactaagcttaa

SEQ ID NO: 624223 - DNA, 25 bp, Homo sapien
acaccgtcatcgttgagagcgcgta

SEQ ID NO: 624224 - DNA, 25 bp, Homo sapien
agcgcgtatttggttctatcgtgtc

SEQ ID NO: 624225 - DNA, 25 bp, Homo sapien
gattgacgagccatttgaccgtgct

SEQ ID NO: 624226 - DNA, 25 bp, Homo sapien
tgaccgtgctagcatgccagctgaa

SEQ ID NO: 624227 - DNA, 25 bp, Homo sapien
gccagctgaacatcgtttcttcatt

SEQ ID NO: 624228 - DNA, 25 bp, Homo sapien
ggtacaaatgtacgcctaatcaata

SEQ ID NO: 624229 - DNA, 25 bp, Homo sapien
aatcaatacagacagcacagccgct

SEQ ID NO: 624230 - DNA, 25 bp, Homo sapien
tgggctagtccgtgcagttcagaat

SEQ ID NO: 624231 - DNA, 25 bp, Homo sapien
agttcagaatgctaaggacggcgaa

SEQ ID NO: 624232 - DNA, 25 bp, Homo sapien
gacggcgaacgtgagcagataactt

SEQ ID NO: 624233 - DNA, 25 bp, Homo sapien
agataacttactgggcattaatgcg

SEQ ID NO: 624234 - DNA, 25 bp, Homo sapien
ctccaagtttctgggcgccactgca

SEQ ID NO: 624235 - DNA, 25 bp, Homo sapien
gcattccctgatacccacagtggaa

SEQ ID NO: 624236 - DNA, 25 bp, Homo sapien
agtggaagctgtttgcagtcggcct

SEQ ID NO: 624237 - DNA, 25 bp, Homo sapien
tgcagtcggccttgtccagctgcag

SEQ ID NO: 624238 - DNA, 25 bp, Homo sapien
cagctggcatgcttgactgtgtgca

SEQ ID NO: 624239 - DNA, 25 bp, Homo sapien
tgcagtggccagatcccatgcttgc

SEQ ID NO: 624240 - DNA, 25 bp, Homo sapien
tcacccttggcaagtgtgggatcca

SEQ ID NO: 624241 - DNA, 25 bp, Homo sapien
gggatccaaaccactagcatgagcc

SEQ ID NO: 624242 - DNA, 25 bp, Homo sapien
ctagcatgagccgagtggacagaac

SEQ ID NO: 624243 - DNA, 25 bp, Homo sapien
agtggacagaacgaacccagtgggc

SEQ ID NO: 624244 - DNA, 25 bp, Homo sapien
gtgggcccgagcaaaacacaggtaa

SEQ ID NO: 624245 - DNA, 25 bp, Homo sapien
tgcattccctgatacccacagtgga

SEQ ID NO: 624246 - DNA, 25 bp, Homo sapien
cattccctgatacccacagtggaag

SEQ ID NO: 624247 - DNA, 25 bp, Homo sapien
tccctgatacccacagtggaagctg

SEQ ID NO: 624248 - DNA, 25 bp, Homo sapien
agtggaagctgtttgcagtcggcct

SEQ ID NO: 624249 - DNA, 25 bp, Homo sapien
cagctgcagcctcacagggagctgg

SEQ ID NO: 624250 - DNA, 25 bp, Homo sapien
ttcactgctctgtacccagctcacc

SEQ ID NO: 624251 - DNA, 25 bp, Homo sapien
accactagcatgagccgagtggaca

SEQ ID NO: 624252 - DNA, 25 bp, Homo sapien
ctagcatgagccgagtggacagaac

SEQ ID NO: 624253 - DNA, 25 bp, Homo sapien
tgagccgagtggacagaacgaaccc

SEQ ID NO: 624254 - DNA, 25 bp, Homo sapien
gccgagtggacagaacgaacccagt

SEQ ID NO: 624255 - DNA, 25 bp, Homo sapien
agtggacagaacgaacccagtgggc

SEQ ID NO: 624256 - DNA, 25 bp, Homo sapien
ccttgactgattcagccctttgtgg

SEQ ID NO: 624257 - DNA, 25 bp, Homo sapien
tcagccctttgtggtttgccgtcct

SEQ ID NO: 624258 - DNA, 25 bp, Homo sapien
agccctttgtggtttgccgtcctgt

SEQ ID NO: 624259 - DNA, 25 bp, Homo sapien
gccctttgtggtttgccgtcctgtt

SEQ ID NO: 624260 - DNA, 25 bp, Homo sapien
tgtggtttgccgtcctgtttctcta

SEQ ID NO: 624261 - DNA, 25 bp, Homo sapien
gtggtttgccgtcctgtttctctac

SEQ ID NO: 624262 - DNA, 25 bp, Homo sapien
tctacagcttggacctcttcagtct

SEQ ID NO: 624263 - DNA, 25 bp, Homo sapien
tacagcttggacctcttcagtcttt

SEQ ID NO: 624264 - DNA, 25 bp, Homo sapien
acagcttggacctcttcagtctttc

SEQ ID NO: 624265 - DNA, 25 bp, Homo sapien
agcttggacctcttcagtctttcca

SEQ ID NO: 624266 - DNA, 25 bp, Homo sapien
gcttggacctcttcagtctttccat

SEQ ID NO: 624267 - DNA, 25 bp, Homo sapien
tatgggttattaagaaaagtgtact

SEQ ID NO: 624268 - DNA, 25 bp, Homo sapien
taagaaaagtgtactttggccaggc

SEQ ID NO: 624269 - DNA, 25 bp, Homo sapien
aagaaaagtgtactttggccaggcg

SEQ ID NO: 624270 - DNA, 25 bp, Homo sapien
agaaaagtgtactttggccaggcgc

SEQ ID NO: 624271 - DNA, 25 bp, Homo sapien
gaaaagtgtactttggccaggcgca

SEQ ID NO: 624272 - DNA, 25 bp, Homo sapien
aaaagtgtactttggccaggcgcag

SEQ ID NO: 624273 - DNA, 25 bp, Homo sapien
aggcagcagaaacgcttggacccga

SEQ ID NO: 624274 - DNA, 25 bp, Homo sapien
cagcagaaacgcttggacccgagag

SEQ ID NO: 624275 - DNA, 25 bp, Homo sapien
agcagaaacgcttggacccgagagg

SEQ ID NO: 624276 - DNA, 25 bp, Homo sapien
gcagaaacgcttggacccgagaggc

SEQ ID NO: 624277 - DNA, 25 bp, Homo sapien
cagaaacgcttggacccgagaggcg

SEQ ID NO: 624278 - DNA, 25 bp, Homo sapien
ttcattcttttcgtattgcttagaa

SEQ ID NO: 624279 - DNA, 25 bp, Homo sapien
cattcttttcgtattgcttagaata

SEQ ID NO: 624280 - DNA, 25 bp, Homo sapien
agaatatgacatgctgaaccaggca

SEQ ID NO: 624281 - DNA, 25 bp, Homo sapien
atatgacatgctgaaccaggcatgg

SEQ ID NO: 624282 - DNA, 25 bp, Homo sapien
tcatgcttgtaaacctgatgctttg

SEQ ID NO: 624283 - DNA, 25 bp, Homo sapien
atgcttgtaaacctgatgctttggg

SEQ ID NO: 624284 - DNA, 25 bp, Homo sapien
gcttgtaaacctgatgctttgggag

SEQ ID NO: 624285 - DNA, 25 bp, Homo sapien
taaacctgatgctttgggaggacaa

SEQ ID NO: 624286 - DNA, 25 bp, Homo sapien
aaacctgatgctttgggaggacaag

SEQ ID NO: 624287 - DNA, 25 bp, Homo sapien
aggacaaggtggttcattggaggcc

SEQ ID NO: 624288 - DNA, 25 bp, Homo sapien
gtggttcattggaggccaggagtta

SEQ ID NO: 624289 - DNA, 25 bp, Homo sapien
gagccttttagaacaggtatccagg

SEQ ID NO: 624290 - DNA, 25 bp, Homo sapien
ggtatccagggattttacctctcca

SEQ ID NO: 624291 - DNA, 25 bp, Homo sapien
tccagggattttacctctccagtgc

SEQ ID NO: 624292 - DNA, 25 bp, Homo sapien
tctccagtgctaggcagggtctatg

SEQ ID NO: 624293 - DNA, 25 bp, Homo sapien
gggtctatgcccataacatcagcag

SEQ ID NO: 624294 - DNA, 25 bp, Homo sapien
ttattttccattcccaaccccattg

SEQ ID NO: 624295 - DNA, 25 bp, Homo sapien
ttcccaaccccattgaacagagcag

SEQ ID NO: 624296 - DNA, 25 bp, Homo sapien
gaacagagcaggatctggtcaaaac

SEQ ID NO: 624297 - DNA, 25 bp, Homo sapien
ggatctggtcaaaacagggtgcagt

SEQ ID NO: 624298 - DNA, 25 bp, Homo sapien
gtgcagtggagaagcctgctgaaac

SEQ ID NO: 624299 - DNA, 25 bp, Homo sapien
gagaagcctgctgaaaccagcagat

SEQ ID NO: 624300 - DNA, 25 bp, Homo sapien
gtgcccactagaccctagattctta

SEQ ID NO: 624301 - DNA, 25 bp, Homo sapien
gaccctagattcttaactgtaactg

SEQ ID NO: 624302 - DNA, 25 bp, Homo sapien
ttaactgtaactgtggtttctgtgg

SEQ ID NO: 624303 - DNA, 25 bp, Homo sapien
gtgacagaggcattcaagccagact

SEQ ID NO: 624304 - DNA, 25 bp, Homo sapien
cagaggcattcaagccagactccat

SEQ ID NO: 624305 - DNA, 25 bp, Homo sapien
aggcattcttagtcataggaggttg

SEQ ID NO: 624306 - DNA, 25 bp, Homo sapien
tcttagtcataggaggttggcagga

SEQ ID NO: 624307 - DNA, 25 bp, Homo sapien
ttggcaggacgggtatcacaaaata

SEQ ID NO: 624308 - DNA, 25 bp, Homo sapien
cacaaaatacaggtcaggatgcggt

SEQ ID NO: 624309 - DNA, 25 bp, Homo sapien
tgcggtaaagaagacggccaaatcc

SEQ ID NO: 624310 - DNA, 25 bp, Homo sapien
accaagacagtgacaaaagtgactt

SEQ ID NO: 624311 - DNA, 25 bp, Homo sapien
aaaccctaagccaggatgacagtca

SEQ ID NO: 624312 - DNA, 25 bp, Homo sapien
cctaagccaggatgacagtcaagcc

SEQ ID NO: 624313 - DNA, 25 bp, Homo sapien
aagccaggatgacagtcaagccgac

SEQ ID NO: 624314 - DNA, 25 bp, Homo sapien
aggatgacagtcaagccgacgccac

SEQ ID NO: 624315 - DNA, 25 bp, Homo sapien
ggatgacagtcaagccgacgccacc

SEQ ID NO: 624316 - DNA, 25 bp, Homo sapien
cacctctaaggccaccttacctggg

SEQ ID NO: 624317 - DNA, 25 bp, Homo sapien
tacctggggaaaggtcttcatcatc

SEQ ID NO: 624318 - DNA, 25 bp, Homo sapien
tggctcacgggtctctgtcatgacc

SEQ ID NO: 624319 - DNA, 25 bp, Homo sapien
ctcacgggtctctgtcatgaccggg

SEQ ID NO: 624320 - DNA, 25 bp, Homo sapien
acctccggccacaagttctctaata

SEQ ID NO: 624321 - DNA, 25 bp, Homo sapien
tccggccacaagttctctaatacag

SEQ ID NO: 624322 - DNA, 25 bp, Homo sapien
ctcgtctctgtgttttgtagatgac

SEQ ID NO: 624323 - DNA, 25 bp, Homo sapien
cgtctctgtgttttgtagatgaccg

SEQ ID NO: 624324 - DNA, 25 bp, Homo sapien
tctctgtgttttgtagatgaccgca

SEQ ID NO: 624325 - DNA, 25 bp, Homo sapien
ctctgtgttttgtagatgaccgcac

SEQ ID NO: 624326 - DNA, 25 bp, Homo sapien
ctgtgttttgtagatgaccgcacct

SEQ ID NO: 624327 - DNA, 25 bp, Homo sapien
tgtgttttgtagatgaccgcacctc

SEQ ID NO: 624328 - DNA, 25 bp, Homo sapien
gtgttttgtagatgaccgcacctcg

SEQ ID NO: 624329 - DNA, 25 bp, Homo sapien
tgttttgtagatgaccgcacctcga

SEQ ID NO: 624330 - DNA, 25 bp, Homo sapien
agagtgagaagcctgactgaccccg

SEQ ID NO: 624331 - DNA, 25 bp, Homo sapien
acttcacgccgtctaagtggagaag

SEQ ID NO: 624332 - DNA, 25 bp, Homo sapien
cagttcacgctgttttgtaaccact

SEQ ID NO: 624333 - DNA, 25 bp, Homo sapien
tacactttaaataagaatccagatg

SEQ ID NO: 624334 - DNA, 25 bp, Homo sapien
acactttaaataagaatccagatgg

SEQ ID NO: 624335 - DNA, 25 bp, Homo sapien
actttaaataagaatccagatgggc

SEQ ID NO: 624336 - DNA, 25 bp, Homo sapien
ctttaaataagaatccagatgggct

SEQ ID NO: 624337 - DNA, 25 bp, Homo sapien
tttaaataagaatccagatgggctg

SEQ ID NO: 624338 - DNA, 25 bp, Homo sapien
ttaaataagaatccagatgggctgg

SEQ ID NO: 624339 - DNA, 25 bp, Homo sapien
aaataagaatccagatgggctgggc

SEQ ID NO: 624340 - DNA, 25 bp, Homo sapien
aataagaatccagatgggctgggcg

SEQ ID NO: 624341 - DNA, 25 bp, Homo sapien
ataagaatccagatgggctgggcgc

SEQ ID NO: 624342 - DNA, 25 bp, Homo sapien
aagaatccagatgggctgggcgcgg

SEQ ID NO: 624343 - DNA, 25 bp, Homo sapien
tgcaatccggcctgggctaaagagc

SEQ ID NO: 624344 - DNA, 25 bp, Homo sapien
ggagcttctagcaccccagagtgtg

SEQ ID NO: 624345 - DNA, 25 bp, Homo sapien
cagagtgtggctcctcagtgagttc

SEQ ID NO: 624346 - DNA, 25 bp, Homo sapien
tgtggctcctcagtgagttctgcca

SEQ ID NO: 624347 - DNA, 25 bp, Homo sapien
gggaagttgtggcaccctcctgcaa

SEQ ID NO: 624348 - DNA, 25 bp, Homo sapien
gcaccctcctgcaaatttgttctta

SEQ ID NO: 624349 - DNA, 25 bp, Homo sapien
cctcctgcaaatttgttcttacctt

SEQ ID NO: 624350 - DNA, 25 bp, Homo sapien
tgcaaatttgttcttacctttgatg

SEQ ID NO: 624351 - DNA, 25 bp, Homo sapien
cttacctttgatgttctgcctcagc

SEQ ID NO: 624352 - DNA, 25 bp, Homo sapien
cctcagccctagagacactctatat

SEQ ID NO: 624353 - DNA, 25 bp, Homo sapien
gacactctatatctgttattgctgt

SEQ ID NO: 624354 - DNA, 25 bp, Homo sapien
ttcactttttgttataacacttagt

SEQ ID NO: 624355 - DNA, 25 bp, Homo sapien
aagcatctccccacagggctgtagg

SEQ ID NO: 624356 - DNA, 25 bp, Homo sapien
atgaaaagcttttggcacagtgcct

SEQ ID NO: 624357 - DNA, 25 bp, Homo sapien
tcaaagaatagtcccgtgcacgcgt

SEQ ID NO: 624358 - DNA, 25 bp, Homo sapien
tcccgtgcacgcgttgaatcaatga

SEQ ID NO: 624359 - DNA, 25 bp, Homo sapien
aaataacttgaggttgcctgtttat

SEQ ID NO: 624360 - DNA, 25 bp, Homo sapien
agtgcctaccatggaatcagggaag

SEQ ID NO: 624361 - DNA, 25 bp, Homo sapien
accatggaatcagggaaggttttct

SEQ ID NO: 624362 - DNA, 25 bp, Homo sapien
gttttctgcaacctttactttgaca

SEQ ID NO: 624363 - DNA, 25 bp, Homo sapien
tgcaacctttactttgacagggaag

SEQ ID NO: 624364 - DNA, 25 bp, Homo sapien
tcggtagcgacgacgagggtattcc

SEQ ID NO: 624365 - DNA, 25 bp, Homo sapien
acgacgagggtattccaggctgtca

SEQ ID NO: 624366 - DNA, 25 bp, Homo sapien
gggcatcactcaacattcagcctgt

SEQ ID NO: 624367 - DNA, 25 bp, Homo sapien
gcatcactcaacattcagcctgtac

SEQ ID NO: 624368 - DNA, 25 bp, Homo sapien
atcactcaacattcagcctgtacac

SEQ ID NO: 624369 - DNA, 25 bp, Homo sapien
tcaacattcagcctgtacacactca

SEQ ID NO: 624370 - DNA, 25 bp, Homo sapien
acattcagcctgtacacactcaaag

SEQ ID NO: 624371 - DNA, 25 bp, Homo sapien
ttcagcctgtacacactcaaaggtg

SEQ ID NO: 624372 - DNA, 25 bp, Homo sapien
gcctgtacacactcaaaggtgtaga

SEQ ID NO: 624373 - DNA, 25 bp, Homo sapien
acacactcaaaggtgtagaagtgac

SEQ ID NO: 624374 - DNA, 25 bp, Homo sapien
aagtgacaaagatgactggccagcc

SEQ ID NO: 624375 - DNA, 25 bp, Homo sapien
gtgacaaagatgactggccagccag

SEQ ID NO: 624376 - DNA, 25 bp, Homo sapien
tgacaaagatgactggccagccaga

SEQ ID NO: 624377 - DNA, 25 bp, Homo sapien
gctggttctgatatcagggtcggtt

SEQ ID NO: 624378 - DNA, 25 bp, Homo sapien
atatcagggtcggtttcaggaggct

SEQ ID NO: 624379 - DNA, 25 bp, Homo sapien
gggtcctattatgctgccttcctgt

SEQ ID NO: 624380 - DNA, 25 bp, Homo sapien
ttcctgtgggcctggtactctcggg

SEQ ID NO: 624381 - DNA, 25 bp, Homo sapien
tactctcgggttgatgcctgaggca

SEQ ID NO: 624382 - DNA, 25 bp, Homo sapien
tgcctgaggcattgcgaattttacc

SEQ ID NO: 624383 - DNA, 25 bp, Homo sapien
taccatgttgcgtgctgggtgtttt

SEQ ID NO: 624384 - DNA, 25 bp, Homo sapien
taaatcatcttaatctttgttctgg

SEQ ID NO: 624385 - DNA, 25 bp, Homo sapien
agttttagctgctcacttttctgga

SEQ ID NO: 624386 - DNA, 25 bp, Homo sapien
tggaggcctcggctgtcgtctttac

SEQ ID NO: 624387 - DNA, 25 bp, Homo sapien
ggctgtcgtctttacgagtttctgc

SEQ ID NO: 624388 - DNA, 25 bp, Homo sapien
ggttaactcagcaagcttgggttgc

SEQ ID NO: 624389 - DNA, 25 bp, Homo sapien
ttaactcagcaagcttgggttgctt

SEQ ID NO: 624390 - DNA, 25 bp, Homo sapien
aactcagcaagcttgggttgcttaa

SEQ ID NO: 624391 - DNA, 25 bp, Homo sapien
cagcaagcttgggttgcttaaacct

SEQ ID NO: 624392 - DNA, 25 bp, Homo sapien
gcaagcttgggttgcttaaaccttg

SEQ ID NO: 624393 - DNA, 25 bp, Homo sapien
aagcttgggttgcttaaaccttgca

SEQ ID NO: 624394 - DNA, 25 bp, Homo sapien
gcttgggttgcttaaaccttgcaca

SEQ ID NO: 624395 - DNA, 25 bp, Homo sapien
cttgggttgcttaaaccttgcacat

SEQ ID NO: 624396 - DNA, 25 bp, Homo sapien
tgggttgcttaaaccttgcacattc

SEQ ID NO: 624397 - DNA, 25 bp, Homo sapien
ggttgcttaaaccttgcacattcca

SEQ ID NO: 624398 - DNA, 25 bp, Homo sapien
gttgcttaaaccttgcacattccaa

SEQ ID NO: 624399 - DNA, 25 bp, Homo sapien
gttttaagcgtgtttctttaccatg

SEQ ID NO: 624400 - DNA, 25 bp, Homo sapien
agcgtgtttctttaccatgttaggc

SEQ ID NO: 624401 - DNA, 25 bp, Homo sapien
gtgtttctttaccatgttaggccag

SEQ ID NO: 624402 - DNA, 25 bp, Homo sapien
gtttctttaccatgttaggccagta

SEQ ID NO: 624403 - DNA, 25 bp, Homo sapien
ttctttaccatgttaggccagtagg

SEQ ID NO: 624404 - DNA, 25 bp, Homo sapien
accatgttaggccagtaggtacaga

SEQ ID NO: 624405 - DNA, 25 bp, Homo sapien
ttaggccagtaggtacagagaaaat

SEQ ID NO: 624406 - DNA, 25 bp, Homo sapien
ataatattagctctttatgtcagca

SEQ ID NO: 624407 - DNA, 25 bp, Homo sapien
attagctctttatgtcagcataggt

SEQ ID NO: 624408 - DNA, 25 bp, Homo sapien
gctctttatgtcagcataggtaaca

SEQ ID NO: 624409 - DNA, 25 bp, Homo sapien
gtcagcataggtaacaaagccttaa

SEQ ID NO: 624410 - DNA, 25 bp, Homo sapien
tatgggttattaagaaaagtgtact

SEQ ID NO: 624411 - DNA, 25 bp, Homo sapien
tattaagaaaagtgtactttggcca

SEQ ID NO: 624412 - DNA, 25 bp, Homo sapien
attaagaaaagtgtactttggccag

SEQ ID NO: 624413 - DNA, 25 bp, Homo sapien
ttaagaaaagtgtactttggccagg

SEQ ID NO: 624414 - DNA, 25 bp, Homo sapien
taagaaaagtgtactttggccaggc

SEQ ID NO: 624415 - DNA, 25 bp, Homo sapien
aagaaaagtgtactttggccaggcg

SEQ ID NO: 624416 - DNA, 25 bp, Homo sapien
agaaaagtgtactttggccaggcgc

SEQ ID NO: 624417 - DNA, 25 bp, Homo sapien
gaaaagtgtactttggccaggcgca

SEQ ID NO: 624418 - DNA, 25 bp, Homo sapien
aaaagtgtactttggccaggcgcag

SEQ ID NO: 624419 - DNA, 25 bp, Homo sapien
acacttatttcatcactgagtttta

SEQ ID NO: 624420 - DNA, 25 bp, Homo sapien
tttcatcactgagttttaattttaa

SEQ ID NO: 624421 - DNA, 25 bp, Homo sapien
gtgcaatcacagtttactgcacccc

SEQ ID NO: 624422 - DNA, 25 bp, Homo sapien
aatcacagtttactgcacccctgac

SEQ ID NO: 624423 - DNA, 25 bp, Homo sapien
agcgtcctgagtagccagaactata

SEQ ID NO: 624424 - DNA, 25 bp, Homo sapien
gcgtcctgagtagccagaactatag

SEQ ID NO: 624425 - DNA, 25 bp, Homo sapien
agtagccagaactataggcacacca

SEQ ID NO: 624426 - DNA, 25 bp, Homo sapien
tacacctagctttttcttttgccag

SEQ ID NO: 624427 - DNA, 25 bp, Homo sapien
acacctagctttttcttttgccagg

SEQ ID NO: 624428 - DNA, 25 bp, Homo sapien
cacctagctttttcttttgccaggt

SEQ ID NO: 624429 - DNA, 25 bp, Homo sapien
aaattgcccaatctttttcatagtg

SEQ ID NO: 624430 - DNA, 25 bp, Homo sapien
tgcgcctggcctagggtgcagccac

SEQ ID NO: 624431 - DNA, 25 bp, Homo sapien
gatgagcagtgtccagtgcagtacc

SEQ ID NO: 624432 - DNA, 25 bp, Homo sapien
tgtccagtgcagtacctggaccgga

SEQ ID NO: 624433 - DNA, 25 bp, Homo sapien
cagtgcagtacctggaccggagccc

SEQ ID NO: 624434 - DNA, 25 bp, Homo sapien
gagacaatcaactgtgtcctgccca

SEQ ID NO: 624435 - DNA, 25 bp, Homo sapien
caaggtgcattgtcttccagtatct

SEQ ID NO: 624436 - DNA, 25 bp, Homo sapien
aggtgcattgtcttccagtatctac

SEQ ID NO: 624437 - DNA, 25 bp, Homo sapien
gtgcattgtcttccagtatctacag

SEQ ID NO: 624438 - DNA, 25 bp, Homo sapien
gcattgtcttccagtatctacagct

SEQ ID NO: 624439 - DNA, 25 bp, Homo sapien
gtcttccagtatctacagcttcaga

SEQ ID NO: 624440 - DNA, 25 bp, Homo sapien
cagaacttgagctaagtaaatgctt

SEQ ID NO: 624441 - DNA, 25 bp, Homo sapien
catgaaagacatgtcgccttctgta

SEQ ID NO: 624442 - DNA, 25 bp, Homo sapien
tgaaagacatgtcgccttctgtaac

SEQ ID NO: 624443 - DNA, 25 bp, Homo sapien
aagacatgtcgccttctgtaaccag

SEQ ID NO: 624444 - DNA, 25 bp, Homo sapien
ccagaattggtttcggaattgtcca

SEQ ID NO: 624445 - DNA, 25 bp, Homo sapien
gaattggtttcggaattgtccagtt

SEQ ID NO: 624446 - DNA, 25 bp, Homo sapien
tggtttcggaattgtccagttgtcc

SEQ ID NO: 624447 - DNA, 25 bp, Homo sapien
tttcggaattgtccagttgtcccca

SEQ ID NO: 624448 - DNA, 25 bp, Homo sapien
ttcggaattgtccagttgtccccag

SEQ ID NO: 624449 - DNA, 25 bp, Homo sapien
cagttgtccccagcctctagacctg

SEQ ID NO: 624450 - DNA, 25 bp, Homo sapien
gacctgcctcctagaaaagtgaagc

SEQ ID NO: 624451 - DNA, 25 bp, Homo sapien
cctacctcccaggtaagtgagcggg

SEQ ID NO: 624452 - DNA, 25 bp, Homo sapien
aagattgagggtgtctccactccag

SEQ ID NO: 624453 - DNA, 25 bp, Homo sapien
tccagaggaggccaagttctacctt

SEQ ID NO: 624454 - DNA, 25 bp, Homo sapien
ttctaccttggtaagcgtgttgctt

SEQ ID NO: 624455 - DNA, 25 bp, Homo sapien
gttgcttacgtctacagagcttcta

SEQ ID NO: 624456 - DNA, 25 bp, Homo sapien
ttagaggttccaagatcagagtcat

SEQ ID NO: 624457 - DNA, 25 bp, Homo sapien
gggtaagatcaccagaactcacggt

SEQ ID NO: 624458 - DNA, 25 bp, Homo sapien
agaactcacggttcttctggtaccg

SEQ ID NO: 624459 - DNA, 25 bp, Homo sapien
ggtaccgtcagagcaaacttcaagt

SEQ ID NO: 624460 - DNA, 25 bp, Homo sapien
aacttgccagctaagaccttcggtg

SEQ ID NO: 624461 - DNA, 25 bp, Homo sapien
aagaccttcggtgcctctgtcagaa

SEQ ID NO: 624462 - DNA, 25 bp, Homo sapien
tcagaatcttcttgtacccatccaa

SEQ ID NO: 624463 - DNA, 25 bp, Homo sapien
gttgaagaccacacaatgtttgcct

SEQ ID NO: 624464 - DNA, 25 bp, Homo sapien
gaagaccacacaatgtttgcctaag

SEQ ID NO: 624465 - DNA, 25 bp, Homo sapien
ccacacaatgtttgcctaaggattt

SEQ ID NO: 624466 - DNA, 25 bp, Homo sapien
gtttgcctaaggattttgctagatc

SEQ ID NO: 624467 - DNA, 25 bp, Homo sapien
ggattttgctagatctttgacagtc

SEQ ID NO: 624468 - DNA, 25 bp, Homo sapien
ttgctagatctttgacagtctccgt

SEQ ID NO: 624469 - DNA, 25 bp, Homo sapien
gctagatctttgacagtctccgttt

SEQ ID NO: 624470 - DNA, 25 bp, Homo sapien
agatctttgacagtctccgttttcc

SEQ ID NO: 624471 - DNA, 25 bp, Homo sapien
tctttgacagtctccgttttccccg

SEQ ID NO: 624472 - DNA, 25 bp, Homo sapien
aattttctcactatcttataatcca

SEQ ID NO: 624473 - DNA, 25 bp, Homo sapien
tcactatcttataatccaaatcctc

SEQ ID NO: 624474 - DNA, 25 bp, Homo sapien
tgtagctctgagtcttcttagaagg

SEQ ID NO: 624475 - DNA, 25 bp, Homo sapien
gtagctctgagtcttcttagaagga

SEQ ID NO: 624476 - DNA, 25 bp, Homo sapien
tagctctgagtcttcttagaaggag

SEQ ID NO: 624477 - DNA, 25 bp, Homo sapien
agctctgagtcttcttagaaggagc

SEQ ID NO: 624478 - DNA, 25 bp, Homo sapien
gctctgagtcttcttagaaggagca

SEQ ID NO: 624479 - DNA, 25 bp, Homo sapien
ctgagtcttcttagaaggagcactt

SEQ ID NO: 624480 - DNA, 25 bp, Homo sapien
tgagtcttcttagaaggagcacttt

SEQ ID NO: 624481 - DNA, 25 bp, Homo sapien
gagtcttcttagaaggagcacttta

SEQ ID NO: 624482 - DNA, 25 bp, Homo sapien
agtcttcttagaaggagcactttaa

SEQ ID NO: 624483 - DNA, 25 bp, Homo sapien
gtcttcttagaaggagcactttaaa

SEQ ID NO: 624484 - DNA, 25 bp, Homo sapien
aaatcagagttctgggccaggcatg

SEQ ID NO: 624485 - DNA, 25 bp, Homo sapien
tggaaatgaatcacaagacccattc

SEQ ID NO: 624486 - DNA, 25 bp, Homo sapien
ggaaatgaatcacaagacccattct

SEQ ID NO: 624487 - DNA, 25 bp, Homo sapien
gaaatgaatcacaagacccattctt

SEQ ID NO: 624488 - DNA, 25 bp, Homo sapien
aaatgaatcacaagacccattcttg

SEQ ID NO: 624489 - DNA, 25 bp, Homo sapien
aatgaatcacaagacccattcttgt

SEQ ID NO: 624490 - DNA, 25 bp, Homo sapien
atgaatcacaagacccattcttgtt

SEQ ID NO: 624491 - DNA, 25 bp, Homo sapien
tgaatcacaagacccattcttgttc

SEQ ID NO: 624492 - DNA, 25 bp, Homo sapien
aatcacaagacccattcttgttctt

SEQ ID NO: 624493 - DNA, 25 bp, Homo sapien
atcacaagacccattcttgttcttc

SEQ ID NO: 624494 - DNA, 25 bp, Homo sapien
tcacaagacccattcttgttcttct

SEQ ID NO: 624495 - DNA, 25 bp, Homo sapien
cacaagacccattcttgttcttctc

SEQ ID NO: 624496 - DNA, 25 bp, Homo sapien
gcgagttccacgagcgcaaggagaa

SEQ ID NO: 624497 - DNA, 25 bp, Homo sapien
aaggagaacttcgtcgtcagggccg

SEQ ID NO: 624498 - DNA, 25 bp, Homo sapien
gtcgtcagggccgatgactaagctt

SEQ ID NO: 624499 - DNA, 25 bp, Homo sapien
atgactaagcttacacgttacggag

SEQ ID NO: 624500 - DNA, 25 bp, Homo sapien
cacgttacggagcacactacgatgt

SEQ ID NO: 624501 - DNA, 25 bp, Homo sapien
ctacgatgtgtgtatatgtcggcat

SEQ ID NO: 624502 - DNA, 25 bp, Homo sapien
gtgatgttgcgcacagtcgtatagc

SEQ ID NO: 624503 - DNA, 25 bp, Homo sapien
tcgtatagcgtatgcaggcgtgcgt

SEQ ID NO: 624504 - DNA, 25 bp, Homo sapien
gtgtttggcggctatcagccccgat

SEQ ID NO: 624505 - DNA, 25 bp, Homo sapien
ataagcgctgatcgtgaacaagaat

SEQ ID NO: 624506 - DNA, 25 bp, Homo sapien
taaagcttctcgtgataaatattcc

SEQ ID NO: 624507 - DNA, 25 bp, Homo sapien
tatggctgtgagaggaataaaacat

SEQ ID NO: 624508 - DNA, 25 bp, Homo sapien
tgaattaaaggaagtcacagatcag

SEQ ID NO: 624509 - DNA, 25 bp, Homo sapien
accaaccacacaaagtttctaagag

SEQ ID NO: 624510 - DNA, 25 bp, Homo sapien
accacacaaagtttctaagagcaaa

SEQ ID NO: 624511 - DNA, 25 bp, Homo sapien
aagagcaaactgttcaggtcggcaa

SEQ ID NO: 624512 - DNA, 25 bp, Homo sapien
caaactgttcaggtcggcaagtcac

SEQ ID NO: 624513 - DNA, 25 bp, Homo sapien
aactgttcaggtcggcaagtcactc

SEQ ID NO: 624514 - DNA, 25 bp, Homo sapien
tgttcaggtcggcaagtcactctta

SEQ ID NO: 624515 - DNA, 25 bp, Homo sapien
ttcaggtcggcaagtcactcttatc

SEQ ID NO: 624516 - DNA, 25 bp, Homo sapien
aggtcggcaagtcactcttatccac

SEQ ID NO: 624517 - DNA, 25 bp, Homo sapien
cggcaagtcactcttatccactgtt

SEQ ID NO: 624518 - DNA, 25 bp, Homo sapien
aagaggccatttataattctgtttt

SEQ ID NO: 624519 - DNA, 25 bp, Homo sapien
agaggccatttataattctgttttt

SEQ ID NO: 624520 - DNA, 25 bp, Homo sapien
gaggccatttataattctgttttta

SEQ ID NO: 624521 - DNA, 25 bp, Homo sapien
aattgaaaagagtcgggccaggtgc

SEQ ID NO: 624522 - DNA, 25 bp, Homo sapien
attgaaaagagtcgggccaggtgca

SEQ ID NO: 624523 - DNA, 25 bp, Homo sapien
ttgaaaagagtcgggccaggtgcag

SEQ ID NO: 624524 - DNA, 25 bp, Homo sapien
tgaaaagagtcgggccaggtgcagt

SEQ ID NO: 624525 - DNA, 25 bp, Homo sapien
gaaaagagtcgggccaggtgcagtg

SEQ ID NO: 624526 - DNA, 25 bp, Homo sapien
agcattttcggaggccgggtgggtg

SEQ ID NO: 624527 - DNA, 25 bp, Homo sapien
gcattttcggaggccgggtgggtgg

SEQ ID NO: 624528 - DNA, 25 bp, Homo sapien
tgagccaagatggtgccatgcactc

SEQ ID NO: 624529 - DNA, 25 bp, Homo sapien
ccacaactcggaatatactgaaaac

SEQ ID NO: 624530 - DNA, 25 bp, Homo sapien
gaaaaccaccacattgtatacttta

SEQ ID NO: 624531 - DNA, 25 bp, Homo sapien
aaggaaactgtcactcgatggactc

SEQ ID NO: 624532 - DNA, 25 bp, Homo sapien
aaactgtcactcgatggactccagg

SEQ ID NO: 624533 - DNA, 25 bp, Homo sapien
gtcactcgatggactccaggtgaaa

SEQ ID NO: 624534 - DNA, 25 bp, Homo sapien
gatggactccaggtgaaatataact

SEQ ID NO: 624535 - DNA, 25 bp, Homo sapien
aatataactgatccagctgcctggg

SEQ ID NO: 624536 - DNA, 25 bp, Homo sapien
ctgcctgggagggaaaagatatctt

SEQ ID NO: 624537 - DNA, 25 bp, Homo sapien
aatgacaggaatggcagcattatgg

SEQ ID NO: 624538 - DNA, 25 bp, Homo sapien
taaagaatctgggtttctttcaggg

SEQ ID NO: 624539 - DNA, 25 bp, Homo sapien
tgttctaaaacggattgtggtgaca

SEQ ID NO: 624540 - DNA, 25 bp, Homo sapien
gtcagtgcctagaactgaaaaacta

SEQ ID NO: 624541 - DNA, 25 bp, Homo sapien
aaactactcaataaatggatttgtt

SEQ ID NO: 624542 - DNA, 25 bp, Homo sapien
aggatgatgtcttcttactttgccc

SEQ ID NO: 624543 - DNA, 25 bp, Homo sapien
gatgatgtcttcttactttgcccaa

SEQ ID NO: 624544 - DNA, 25 bp, Homo sapien
tgatgtcttcttactttgcccaagc

SEQ ID NO: 624545 - DNA, 25 bp, Homo sapien
tgtcttcttactttgcccaagcctg

SEQ ID NO: 624546 - DNA, 25 bp, Homo sapien
tgcccaagcctggaaagtaggccaa

SEQ ID NO: 624547 - DNA, 25 bp, Homo sapien
caagcctggaaagtaggccaaatat

SEQ ID NO: 624548 - DNA, 25 bp, Homo sapien
ggccaaatatataatagagtttctt

SEQ ID NO: 624549 - DNA, 25 bp, Homo sapien
tttcatcttcccagctcgagagtca

SEQ ID NO: 624550 - DNA, 25 bp, Homo sapien
tcatcttcccagctcgagagtcagg

SEQ ID NO: 624551 - DNA, 25 bp, Homo sapien
tgacctcttggcgagaatgcaaaga

SEQ ID NO: 624552 - DNA, 25 bp, Homo sapien
gacctcttggcgagaatgcaaagaa

SEQ ID NO: 624553 - DNA, 25 bp, Homo sapien
acctcttggcgagaatgcaaagaag

SEQ ID NO: 624554 - DNA, 25 bp, Homo sapien
cctcttggcgagaatgcaaagaagg

SEQ ID NO: 624555 - DNA, 25 bp, Homo sapien
cttggcgagaatgcaaagaagggaa

SEQ ID NO: 624556 - DNA, 25 bp, Homo sapien
cgagaatgcaaagaagggaacgctt

SEQ ID NO: 624557 - DNA, 25 bp, Homo sapien
gagaatgcaaagaagggaacgcttg

SEQ ID NO: 624558 - DNA, 25 bp, Homo sapien
gaatgcaaagaagggaacgcttgct

SEQ ID NO: 624559 - DNA, 25 bp, Homo sapien
atgcaaagaagggaacgcttgctta

SEQ ID NO: 624560 - DNA, 25 bp, Homo sapien
tgcaaagaagggaacgcttgcttat

SEQ ID NO: 624561 - DNA, 25 bp, Homo sapien
gcaaagaagggaacgcttgcttata

SEQ ID NO: 624562 - DNA, 25 bp, Homo sapien
ttctcagcatttcctatgttccagt

SEQ ID NO: 624563 - DNA, 25 bp, Homo sapien
tctcagcatttcctatgttccagtt

SEQ ID NO: 624564 - DNA, 25 bp, Homo sapien
atttcctatgttccagttttatagc

SEQ ID NO: 624565 - DNA, 25 bp, Homo sapien
tttcctatgttccagttttatagca

SEQ ID NO: 624566 - DNA, 25 bp, Homo sapien
ttcctatgttccagttttatagcac

SEQ ID NO: 624567 - DNA, 25 bp, Homo sapien
tcctatgttccagttttatagcaca

SEQ ID NO: 624568 - DNA, 25 bp, Homo sapien
tccagttttatagcacatagtgaag

SEQ ID NO: 624569 - DNA, 25 bp, Homo sapien
tagcacatagtgaagaatattgact

SEQ ID NO: 624570 - DNA, 25 bp, Homo sapien
tagttagggtaaagcaagtgtaaag

SEQ ID NO: 624571 - DNA, 25 bp, Homo sapien
ggaagtggatggtaaggcattttga

SEQ ID NO: 624572 - DNA, 25 bp, Homo sapien
atatatttccaagccaataatttct

SEQ ID NO: 624573 - DNA, 25 bp, Homo sapien
taatttgtctaatctttgcccctga

SEQ ID NO: 624574 - DNA, 25 bp, Homo sapien
ttgcccctgattcctggtagatgac

SEQ ID NO: 624575 - DNA, 25 bp, Homo sapien
gaccactaaactaagtctttggaat

SEQ ID NO: 624576 - DNA, 25 bp, Homo sapien
agtagtgtctttgttattcatggtg

SEQ ID NO: 624577 - DNA, 25 bp, Homo sapien
tattcatggtgggaccgtcaagcat

SEQ ID NO: 624578 - DNA, 25 bp, Homo sapien
ggatgagagctgatcaccccagaaa

SEQ ID NO: 624579 - DNA, 25 bp, Homo sapien
gagcgaagtgatatctccctgatca

SEQ ID NO: 624580 - DNA, 25 bp, Homo sapien
gatatctccctgatcaccttcagga

SEQ ID NO: 624581 - DNA, 25 bp, Homo sapien
caccttcaggaagatgagacaagct

SEQ ID NO: 624582 - DNA, 25 bp, Homo sapien
gattaaattaaagcctgtgaccaat

SEQ ID NO: 624583 - DNA, 25 bp, Homo sapien
gcctgtgaccaatgatacaatcaat

SEQ ID NO: 624584 - DNA, 25 bp, Homo sapien
tggtaatgtctttgattaccaccac

SEQ ID NO: 624585 - DNA, 25 bp, Homo sapien
ttgattaccaccaccatctgacctg

SEQ ID NO: 624586 - DNA, 25 bp, Homo sapien
accaccatctgacctggtcttatga

SEQ ID NO: 624587 - DNA, 25 bp, Homo sapien
atctgacctggtcttatgacctgtt

SEQ ID NO: 624588 - DNA, 25 bp, Homo sapien
acctggtcttatgacctgttagctt

SEQ ID NO: 624589 - DNA, 25 bp, Homo sapien
atggcaggggcctcatctgtcctgt

SEQ ID NO: 624590 - DNA, 25 bp, Homo sapien
tgtggcctgggtcctagcaccatgt

SEQ ID NO: 624591 - DNA, 25 bp, Homo sapien
gggtcctagcaccatgtctggtaca

SEQ ID NO: 624592 - DNA, 25 bp, Homo sapien
ccatgtctggtacagtgtagatgct

SEQ ID NO: 624593 - DNA, 25 bp, Homo sapien
gatgctcaagggaagtttactttgt

SEQ ID NO: 624594 - DNA, 25 bp, Homo sapien
tgtaaacctccagccattttgcaga

SEQ ID NO: 624595 - DNA, 25 bp, Homo sapien
cttcttcagtggcttggcacagtca

SEQ ID NO: 624596 - DNA, 25 bp, Homo sapien
cttcagtggcttggcacagtcaggg

SEQ ID NO: 624597 - DNA, 25 bp, Homo sapien
ggaaaaactgagacgaccaaagatc

SEQ ID NO: 624598 - DNA, 25 bp, Homo sapien
acatagaagttctgtccgtcatcgc

SEQ ID NO: 624599 - DNA, 25 bp, Homo sapien
tagaagttctgtccgtcatcgcgca

SEQ ID NO: 624600 - DNA, 25 bp, Homo sapien
agttctgtccgtcatcgcgcagcaa

SEQ ID NO: 624601 - DNA, 25 bp, Homo sapien
tcgcgcagcaactcattaccattag

SEQ ID NO: 624602 - DNA, 25 bp, Homo sapien
gcagcaactcattaccattaggaac

SEQ ID NO: 624603 - DNA, 25 bp, Homo sapien
ttaccattaggaacgccaaagcggc

SEQ ID NO: 624604 - DNA, 25 bp, Homo sapien
acgccaaagcggcaaagctctctag

SEQ ID NO: 624605 - DNA, 25 bp, Homo sapien
cagatggtttggactgcaagatgat

SEQ ID NO: 624606 - DNA, 25 bp, Homo sapien
gaagagaagccggtcctctgcaggc

SEQ ID NO: 624607 - DNA, 25 bp, Homo sapien
agaagccggtcctctgcaggctcaa

SEQ ID NO: 624608 - DNA, 25 bp, Homo sapien
tcaagcctatctgggcctctgggga

SEQ ID NO: 624609 - DNA, 25 bp, Homo sapien
tgaccttgtcctacttcactgcctt

SEQ ID NO: 624610 - DNA, 25 bp, Homo sapien
tacttcactgcctttgtctgtgtta

SEQ ID NO: 624611 - DNA, 25 bp, Homo sapien
ttcactgcctttgtctgtgttacta

SEQ ID NO: 624612 - DNA, 25 bp, Homo sapien
cactgcctttgtctgtgttactagt

SEQ ID NO: 624613 - DNA, 25 bp, Homo sapien
tttgtctgtgttactagtggcccca

SEQ ID NO: 624614 - DNA, 25 bp, Homo sapien
gcccttcatccaagctcctatgtga

SEQ ID NO: 624615 - DNA, 25 bp, Homo sapien
ggcagaagtggctcatttatgaccc

SEQ ID NO: 624616 - DNA, 25 bp, Homo sapien
ggctcatttatgacccattcactag

SEQ ID NO: 624617 - DNA, 25 bp, Homo sapien
gggtactgggtcactgcttaagacc

SEQ ID NO: 624618 - DNA, 25 bp, Homo sapien
ggtactgggtcactgcttaagacct

SEQ ID NO: 624619 - DNA, 25 bp, Homo sapien
gtactgggtcactgcttaagacctg

SEQ ID NO: 624620 - DNA, 25 bp, Homo sapien
actgggtcactgcttaagacctgga

SEQ ID NO: 624621 - DNA, 25 bp, Homo sapien
ctgggtcactgcttaagacctggac

SEQ ID NO: 624622 - DNA, 25 bp, Homo sapien
gaggcggcattttcagcgcataaca

SEQ ID NO: 624623 - DNA, 25 bp, Homo sapien
aggcggcattttcagcgcataacag

SEQ ID NO: 624624 - DNA, 25 bp, Homo sapien
ggcggcattttcagcgcataacagt

SEQ ID NO: 624625 - DNA, 25 bp, Homo sapien
gcggcattttcagcgcataacagtg

SEQ ID NO: 624626 - DNA, 25 bp, Homo sapien
gcattttcagcgcataacagtgcac

SEQ ID NO: 624627 - DNA, 25 bp, Homo sapien
cattttcagcgcataacagtgcact

SEQ ID NO: 624628 - DNA, 25 bp, Homo sapien
tcatttctctgcttcaaagatcagt

SEQ ID NO: 624629 - DNA, 25 bp, Homo sapien
gtgaaattgctacctgagttcatcc

SEQ ID NO: 624630 - DNA, 25 bp, Homo sapien
tgctacctgagttcatccatttcac

SEQ ID NO: 624631 - DNA, 25 bp, Homo sapien
atccatttcacagttgatctgcatg

SEQ ID NO: 624632 - DNA, 25 bp, Homo sapien
acagttgatctgcatgggaaattat

SEQ ID NO: 624633 - DNA, 25 bp, Homo sapien
ggaaattatatgtgcttctctgatt

SEQ ID NO: 624634 - DNA, 25 bp, Homo sapien
tctttggatgtgtcgcttttattct

SEQ ID NO: 624635 - DNA, 25 bp, Homo sapien
gtgtcgcttttattctaactgctgg

SEQ ID NO: 624636 - DNA, 25 bp, Homo sapien
gcttttattctaactgctggaacta

SEQ ID NO: 624637 - DNA, 25 bp, Homo sapien
gctggaactatttgttgtacctctt

SEQ ID NO: 624638 - DNA, 25 bp, Homo sapien
gcaaaaattctacttaatatgggat

SEQ ID NO: 624639 - DNA, 25 bp, Homo sapien
agtactggaatacccactaggcagg

SEQ ID NO: 624640 - DNA, 25 bp, Homo sapien
taggcaggctctctaccacgcagaa

SEQ ID NO: 624641 - DNA, 25 bp, Homo sapien
ggctctctaccacgcagaaaagttg

SEQ ID NO: 624642 - DNA, 25 bp, Homo sapien
gttgcatacgaagtctggaaccctt

SEQ ID NO: 624643 - DNA, 25 bp, Homo sapien
tctggaacccttaactcctaaccat

SEQ ID NO: 624644 - DNA, 25 bp, Homo sapien
ttaactcctaaccatctaacctgct

SEQ ID NO: 624645 - DNA, 25 bp, Homo sapien
catctaacctgctcgggccatgagt

SEQ ID NO: 624646 - DNA, 25 bp, Homo sapien
gtacctgctcgcgttcaagaactga

SEQ ID NO: 624647 - DNA, 25 bp, Homo sapien
cgcgttcaagaactgagcctctcag

SEQ ID NO: 624648 - DNA, 25 bp, Homo sapien
tgagcctctcagtgggacataaaga

SEQ ID NO: 624649 - DNA, 25 bp, Homo sapien
gccaggagtcagagacgaccagcct

SEQ ID NO: 624650 - DNA, 25 bp, Homo sapien
atgcccctttggactcgatcttgga

SEQ ID NO: 624651 - DNA, 25 bp, Homo sapien
gactcgatcttggagggtgcagccc

SEQ ID NO: 624652 - DNA, 25 bp, Homo sapien
atcttggagggtgcagcccgcctgc

SEQ ID NO: 624653 - DNA, 25 bp, Homo sapien
agcctgcagtcctgcgttgcacttg

SEQ ID NO: 624654 - DNA, 25 bp, Homo sapien
agtcctgcgttgcacttgtcattgt

SEQ ID NO: 624655 - DNA, 25 bp, Homo sapien
gcgttgcacttgtcattgtgtttct

SEQ ID NO: 624656 - DNA, 25 bp, Homo sapien
acttgtcattgtgtttctcccagga

SEQ ID NO: 624657 - DNA, 25 bp, Homo sapien
ttgtcattgtgtttctcccaggacc

SEQ ID NO: 624658 - DNA, 25 bp, Homo sapien
aagaaaagctctcacgttgctccac

SEQ ID NO: 624659 - DNA, 25 bp, Homo sapien
gttgctccaccaataaacgtttcga

SEQ ID NO: 624660 - DNA, 25 bp, Homo sapien
tccaccaataaacgtttcgatcttt

SEQ ID NO: 624661 - DNA, 25 bp, Homo sapien
caggatttctggttctacttcaaca

SEQ ID NO: 624662 - DNA, 25 bp, Homo sapien
ggttctacttcaacaaacagtgcat

SEQ ID NO: 624663 - DNA, 25 bp, Homo sapien
gcataattttggacacagcatcaga

SEQ ID NO: 624664 - DNA, 25 bp, Homo sapien
tcagatttcctgacttcttacaaag

SEQ ID NO: 624665 - DNA, 25 bp, Homo sapien
gacttcttacaaaggacagctaatt

SEQ ID NO: 624666 - DNA, 25 bp, Homo sapien
aaacgtgtcaatctgtagtaattag

SEQ ID NO: 624667 - DNA, 25 bp, Homo sapien
gagaatccaagtcttaaaactctat

SEQ ID NO: 624668 - DNA, 25 bp, Homo sapien
aactctatgtgggatacatttctga

SEQ ID NO: 624669 - DNA, 25 bp, Homo sapien
tctgatgaagcttctatttgactaa

SEQ ID NO: 624670 - DNA, 25 bp, Homo sapien
tattatttcgatttggatcctggta

SEQ ID NO: 624671 - DNA, 25 bp, Homo sapien
gatcctggtaagtggtgatactgct

SEQ ID NO: 624672 - DNA, 25 bp, Homo sapien
ggctgaggtgggtggcttacagggt

SEQ ID NO: 624673 - DNA, 25 bp, Homo sapien
gctgaggtgggtggcttacagggtc

SEQ ID NO: 624674 - DNA, 25 bp, Homo sapien
tgaggtgggtggcttacagggtcag

SEQ ID NO: 624675 - DNA, 25 bp, Homo sapien
gaggtgggtggcttacagggtcagg

SEQ ID NO: 624676 - DNA, 25 bp, Homo sapien
tgggtggcttacagggtcaggagtt

SEQ ID NO: 624677 - DNA, 25 bp, Homo sapien
ggtggcttacagggtcaggagttcg

SEQ ID NO: 624678 - DNA, 25 bp, Homo sapien
gtggcttacagggtcaggagttcga

SEQ ID NO: 624679 - DNA, 25 bp, Homo sapien
aaattacccaagcatagtggtgggt

SEQ ID NO: 624680 - DNA, 25 bp, Homo sapien
tacccaagcatagtggtgggtgcct

SEQ ID NO: 624681 - DNA, 25 bp, Homo sapien
ggcaggagaattcgttgggcctggg

SEQ ID NO: 624682 - DNA, 25 bp, Homo sapien
ggagaattcgttgggcctgggaggc

SEQ ID NO: 624683 - DNA, 25 bp, Homo sapien
tttacactttaaataagaatccaga

SEQ ID NO: 624684 - DNA, 25 bp, Homo sapien
tacactttaaataagaatccagatg

SEQ ID NO: 624685 - DNA, 25 bp, Homo sapien
acactttaaataagaatccagatgg

SEQ ID NO: 624686 - DNA, 25 bp, Homo sapien
actttaaataagaatccagatgggc

SEQ ID NO: 624687 - DNA, 25 bp, Homo sapien
ctttaaataagaatccagatgggct

SEQ ID NO: 624688 - DNA, 25 bp, Homo sapien
tttaaataagaatccagatgggctg

SEQ ID NO: 624689 - DNA, 25 bp, Homo sapien
ttaaataagaatccagatgggctgg

SEQ ID NO: 624690 - DNA, 25 bp, Homo sapien
taaataagaatccagatgggctggg

SEQ ID NO: 624691 - DNA, 25 bp, Homo sapien
aaataagaatccagatgggctgggc

SEQ ID NO: 624692 - DNA, 25 bp, Homo sapien
aataagaatccagatgggctgggcg

SEQ ID NO: 624693 - DNA, 25 bp, Homo sapien
ataagaatccagatgggctgggcgc

SEQ ID NO: 624694 - DNA, 25 bp, Homo sapien
cggtcggtctaagtagtgaaaacat

SEQ ID NO: 624695 - DNA, 25 bp, Homo sapien
gtgaaaacatttgacgtacatgaag

SEQ ID NO: 624696 - DNA, 25 bp, Homo sapien
aacatttgacgtacatgaagactcg

SEQ ID NO: 624697 - DNA, 25 bp, Homo sapien
gacgtacatgaagactcgtataaat

SEQ ID NO: 624698 - DNA, 25 bp, Homo sapien
gaagactcgtataaataagtcaact

SEQ ID NO: 624699 - DNA, 25 bp, Homo sapien
ataagtcaacttttctgtgggactc

SEQ ID NO: 624700 - DNA, 25 bp, Homo sapien
aagtcaacttttctgtgggactcgc

SEQ ID NO: 624701 - DNA, 25 bp, Homo sapien
gtcaacttttctgtgggactcgcgt

SEQ ID NO: 624702 - DNA, 25 bp, Homo sapien
caacttttctgtgggactcgcgttt

SEQ ID NO: 624703 - DNA, 25 bp, Homo sapien
acttttctgtgggactcgcgtttat

SEQ ID NO: 624704 - DNA, 25 bp, Homo sapien
ttttctgtgggactcgcgtttatac

SEQ ID NO: 624705 - DNA, 25 bp, Homo sapien
agagaggtgcagtaatttggccaaa

SEQ ID NO: 624706 - DNA, 25 bp, Homo sapien
atttggccaaagtcacgcggctaat

SEQ ID NO: 624707 - DNA, 25 bp, Homo sapien
aagtcacgcggctaataactaccca

SEQ ID NO: 624708 - DNA, 25 bp, Homo sapien
gcggctaataactacccaggactgg

SEQ ID NO: 624709 - DNA, 25 bp, Homo sapien
aactacccaggactggagctcagcg

SEQ ID NO: 624710 - DNA, 25 bp, Homo sapien
gagctcagcgtggatgccatcgctt

SEQ ID NO: 624711 - DNA, 25 bp, Homo sapien
acagctgtctggcaagaacctcctg

SEQ ID NO: 624712 - DNA, 25 bp, Homo sapien
tgacagcctggaataccctcgtcgt

SEQ ID NO: 624713 - DNA, 25 bp, Homo sapien
ggaataccctcgtcgtcgctaccga

SEQ ID NO: 624714 - DNA, 25 bp, Homo sapien
caagcccttccctgtcaaagtaaag

SEQ ID NO: 624715 - DNA, 25 bp, Homo sapien
cagaaaaccttccctgattccatgg

SEQ ID NO: 624716 - DNA, 25 bp, Homo sapien
ggcagagatcagttccttgagtata

SEQ ID NO: 624717 - DNA, 25 bp, Homo sapien
gatcagttccttgagtataaagtgt

SEQ ID NO: 624718 - DNA, 25 bp, Homo sapien
taaatgaacccattatctactccta

SEQ ID NO: 624719 - DNA, 25 bp, Homo sapien
tcctaagtaattaagtgatgtgcac

SEQ ID NO: 624720 - DNA, 25 bp, Homo sapien
gatgtgcacagatacacctagctat

SEQ ID NO: 624721 - DNA, 25 bp, Homo sapien
gatacacctagctataggtaaacag

SEQ ID NO: 624722 - DNA, 25 bp, Homo sapien
agtgaggtttttcttgactataagt

SEQ ID NO: 624723 - DNA, 25 bp, Homo sapien
tcttgactataagttttcccttttg

SEQ ID NO: 624724 - DNA, 25 bp, Homo sapien
ttcccttttggaaaaattcgctgtg

SEQ ID NO: 624725 - DNA, 25 bp, Homo sapien
aaattcgctgtggatttgagtatat

SEQ ID NO: 624726 - DNA, 25 bp, Homo sapien
gagtatattttctcttagacattaa

SEQ ID NO: 624727 - DNA, 25 bp, Homo sapien
atgtctgtgttggtacttggaaaac

SEQ ID NO: 624728 - DNA, 25 bp, Homo sapien
agtgccatggaaatatattgtcttg

SEQ ID NO: 624729 - DNA, 25 bp, Homo sapien
attgtcttggttatcttcattattc

SEQ ID NO: 624730 - DNA, 25 bp, Homo sapien
tatgggagaatatgggagctgatca

SEQ ID NO: 624731 - DNA, 25 bp, Homo sapien
ggagctgatcataatcccagaagac

SEQ ID NO: 624732 - DNA, 25 bp, Homo sapien
taatcccagaagacatagtcctgag

SEQ ID NO: 624733 - DNA, 25 bp, Homo sapien
tagtcctgagtgctatcatcctgaa

SEQ ID NO: 624734 - DNA, 25 bp, Homo sapien
gtcctgagtgctatcatcctgaatg

SEQ ID NO: 624735 - DNA, 25 bp, Homo sapien
tgagtgctatcatcctgaatgttgg

SEQ ID NO: 624736 - DNA, 25 bp, Homo sapien
tatcatcctgaatgttggaatcctg

SEQ ID NO: 624737 - DNA, 25 bp, Homo sapien
aaaaacatgacaacagcctgggcaa

SEQ ID NO: 624738 - DNA, 25 bp, Homo sapien
gttaacttatcagagaccacacaga

SEQ ID NO: 624739 - DNA, 25 bp, Homo sapien
gaggagggtttgtacccagacattt

SEQ ID NO: 624740 - DNA, 25 bp, Homo sapien
gtttgtacccagacatttgaaccac

SEQ ID NO: 624741 - DNA, 25 bp, Homo sapien
tttgaaccacagaaactatgctcta

SEQ ID NO: 624742 - DNA, 25 bp, Homo sapien
gaaactatgctctaagcccgcatgt

SEQ ID NO: 624743 - DNA, 25 bp, Homo sapien
ccctcttggaccctgatagctgaag

SEQ ID NO: 624744 - DNA, 25 bp, Homo sapien
agctgaaggtaaactccatgcccca

SEQ ID NO: 624745 - DNA, 25 bp, Homo sapien
ggtcttcacctgacaccgcagtggg

SEQ ID NO: 624746 - DNA, 25 bp, Homo sapien
gaaactgtgattcccaggctgagca

SEQ ID NO: 624747 - DNA, 25 bp, Homo sapien
attcccaggctgagcacagaggctt

SEQ ID NO: 624748 - DNA, 25 bp, Homo sapien
tgagcacagaggcttactcctgtaa

SEQ ID NO: 624749 - DNA, 25 bp, Homo sapien
gatctgataacatttgacacaacta

SEQ ID NO: 624750 - DNA, 25 bp, Homo sapien
ggagaaaccatgacacctgagacca

SEQ ID NO: 624751 - DNA, 25 bp, Homo sapien
tgagaccaatactcctgagactact

SEQ ID NO: 624752 - DNA, 25 bp, Homo sapien
tgagactactatgccaccatctgag

SEQ ID NO: 624753 - DNA, 25 bp, Homo sapien
tgaggccactactcccgagactact

SEQ ID NO: 624754 - DNA, 25 bp, Homo sapien
cgagactactatgccaccatctgag

SEQ ID NO: 624755 - DNA, 25 bp, Homo sapien
tgagactgctacttccgagactatg

SEQ ID NO: 624756 - DNA, 25 bp, Homo sapien
ttacttctggtatggaacaactaga

SEQ ID NO: 624757 - DNA, 25 bp, Homo sapien
atatccaaagagctgattctaccaa

SEQ ID NO: 624758 - DNA, 25 bp, Homo sapien
attctaccaatccaatttcaccagg

SEQ ID NO: 624759 - DNA, 25 bp, Homo sapien
attccatcagggattggatgaccat

SEQ ID NO: 624760 - DNA, 25 bp, Homo sapien
ttgaaccccgaaggcagtgtttgtg

SEQ ID NO: 624761 - DNA, 25 bp, Homo sapien
aaccccgaaggcagtgtttgtggtg

SEQ ID NO: 624762 - DNA, 25 bp, Homo sapien
accccgaaggcagtgtttgtggtga

SEQ ID NO: 624763 - DNA, 25 bp, Homo sapien
agtgtttgtggtgagcagaaattgc

SEQ ID NO: 624764 - DNA, 25 bp, Homo sapien
gtttgtggtgagcagaaattgcttc

SEQ ID NO: 624765 - DNA, 25 bp, Homo sapien
tttgtggtgagcagaaattgcttca

SEQ ID NO: 624766 - DNA, 25 bp, Homo sapien
ttgtggtgagcagaaattgcttcat

SEQ ID NO: 624767 - DNA, 25 bp, Homo sapien
tgtggtgagcagaaattgcttcatt

SEQ ID NO: 624768 - DNA, 25 bp, Homo sapien
gtggtgagcagaaattgcttcattg

SEQ ID NO: 624769 - DNA, 25 bp, Homo sapien
tggtgagcagaaattgcttcattgc

SEQ ID NO: 624770 - DNA, 25 bp, Homo sapien
ggtgagcagaaattgcttcattgca

SEQ ID NO: 624771 - DNA, 25 bp, Homo sapien
acggccagctgctagcacatttttt

SEQ ID NO: 624772 - DNA, 25 bp, Homo sapien
cagctgctagcacattttttacctc

SEQ ID NO: 624773 - DNA, 25 bp, Homo sapien
tttttacctccctcatgcaagggtg

SEQ ID NO: 624774 - DNA, 25 bp, Homo sapien
atgcaagggtgcgtgtacacataca

SEQ ID NO: 624775 - DNA, 25 bp, Homo sapien
gtagtgagagcttcgggacagacct

SEQ ID NO: 624776 - DNA, 25 bp, Homo sapien
tcgggacagaccttggctcagggac

SEQ ID NO: 624777 - DNA, 25 bp, Homo sapien
tggctcagggactgccctcatttga

SEQ ID NO: 624778 - DNA, 25 bp, Homo sapien
gccctcatttgatgtcctttttcag

SEQ ID NO: 624779 - DNA, 25 bp, Homo sapien
ctgtgccttttttgcatttggcttt

SEQ ID NO: 624780 - DNA, 25 bp, Homo sapien
tgcatttggctttattttgattttt

SEQ ID NO: 624781 - DNA, 25 bp, Homo sapien
tccctttatcatggacttttatttt

SEQ ID NO: 624782 - DNA, 25 bp, Homo sapien
gaagaacaatctaaccatgctggca

SEQ ID NO: 624783 - DNA, 25 bp, Homo sapien
ccatcctacctgcaatgccaaggta

SEQ ID NO: 624784 - DNA, 25 bp, Homo sapien
gccaaggtaagtctgcgaaagtcac

SEQ ID NO: 624785 - DNA, 25 bp, Homo sapien
aaagtcacttatattcagagcatgt

SEQ ID NO: 624786 - DNA, 25 bp, Homo sapien
agcatgtggattgggactctgaaga

SEQ ID NO: 624787 - DNA, 25 bp, Homo sapien
gattgggactctgaagaacaacttt

SEQ ID NO: 624788 - DNA, 25 bp, Homo sapien
tttatggtggacaccttcgtctcca

SEQ ID NO: 624789 - DNA, 25 bp, Homo sapien
gtctccatctggtgagtccagcaca

SEQ ID NO: 624790 - DNA, 25 bp, Homo sapien
agcctgagggttccatgggctcaac

SEQ ID NO: 624791 - DNA, 25 bp, Homo sapien
agacttgcctgtgagtgccccttga

SEQ ID NO: 624792 - DNA, 25 bp, Homo sapien
ccccttgatggatgtatttgtctgt

SEQ ID NO: 624793 - DNA, 25 bp, Homo sapien
ttttggccaggctcaatgcagggta

SEQ ID NO: 624794 - DNA, 25 bp, Homo sapien
gccaggctcaatgcagggtaatgat

SEQ ID NO: 624795 - DNA, 25 bp, Homo sapien
tgagtcttgtccctgtcctcaagct

SEQ ID NO: 624796 - DNA, 25 bp, Homo sapien
ctgtcctcaagcttatagggagtaa

SEQ ID NO: 624797 - DNA, 25 bp, Homo sapien
tgaaattaacggagaatacaactgc

SEQ ID NO: 624798 - DNA, 25 bp, Homo sapien
atacaactgcttccatttattgagc

SEQ ID NO: 624799 - DNA, 25 bp, Homo sapien
tgatgccagatgtacaatagttctc

SEQ ID NO: 624800 - DNA, 25 bp, Homo sapien
gttctcaaggtagggtttgtctcca

SEQ ID NO: 624801 - DNA, 25 bp, Homo sapien
caaggtagggtttgtctccatttca

SEQ ID NO: 624802 - DNA, 25 bp, Homo sapien
cagaagttagctattgccgtgtaat

SEQ ID NO: 624803 - DNA, 25 bp, Homo sapien
gctattgccgtgtaataaaccatcc

SEQ ID NO: 624804 - DNA, 25 bp, Homo sapien
gcagtgagccgaatttttgcaatca

SEQ ID NO: 624805 - DNA, 25 bp, Homo sapien
atttttgcaatcagatcttggcgat

SEQ ID NO: 624806 - DNA, 25 bp, Homo sapien
tttttgcaatcagatcttggcgatg

SEQ ID NO: 624807 - DNA, 25 bp, Homo sapien
ttttgcaatcagatcttggcgatga

SEQ ID NO: 624808 - DNA, 25 bp, Homo sapien
tttgcaatcagatcttggcgatgac

SEQ ID NO: 624809 - DNA, 25 bp, Homo sapien
ttgcaatcagatcttggcgatgacc

SEQ ID NO: 624810 - DNA, 25 bp, Homo sapien
tgcaatcagatcttggcgatgacct

SEQ ID NO: 624811 - DNA, 25 bp, Homo sapien
gcaatcagatcttggcgatgacctt

SEQ ID NO: 624812 - DNA, 25 bp, Homo sapien
cactaggcataaatgttaaacacaa

SEQ ID NO: 624813 - DNA, 25 bp, Homo sapien
actaggcataaatgttaaacacaaa

SEQ ID NO: 624814 - DNA, 25 bp, Homo sapien
taggcataaatgttaaacacaaaac

SEQ ID NO: 624815 - DNA, 25 bp, Homo sapien
ttaaaatgtattctctggctgggtg

SEQ ID NO: 624816 - DNA, 25 bp, Homo sapien
taaaatgtattctctggctgggtgc

SEQ ID NO: 624817 - DNA, 25 bp, Homo sapien
aaaatgtattctctggctgggtgca

SEQ ID NO: 624818 - DNA, 25 bp, Homo sapien
aaatgtattctctggctgggtgcag

SEQ ID NO: 624819 - DNA, 25 bp, Homo sapien
aatgtattctctggctgggtgcagt

SEQ ID NO: 624820 - DNA, 25 bp, Homo sapien
tgggaggaattactttgggaggctg

SEQ ID NO: 624821 - DNA, 25 bp, Homo sapien
aggcaggaaagttgcctgaaccagg

SEQ ID NO: 624822 - DNA, 25 bp, Homo sapien
ggcaggaaagttgcctgaaccaggg

SEQ ID NO: 624823 - DNA, 25 bp, Homo sapien
caggaaagttgcctgaaccagggag

SEQ ID NO: 624824 - DNA, 25 bp, Homo sapien
aggaaagttgcctgaaccagggagg

SEQ ID NO: 624825 - DNA, 25 bp, Homo sapien
gaaagttgcctgaaccagggaggcg

SEQ ID NO: 624826 - DNA, 25 bp, Homo sapien
gtacctggtatagagtggaccatca

SEQ ID NO: 624827 - DNA, 25 bp, Homo sapien
gaccatcaggaaatgttagttgtga

SEQ ID NO: 624828 - DNA, 25 bp, Homo sapien
gagagcctaacttttcagggagggc

SEQ ID NO: 624829 - DNA, 25 bp, Homo sapien
tcagggagggcttcacatacgaagt

SEQ ID NO: 624830 - DNA, 25 bp, Homo sapien
gggcttcacatacgaagtgcacttt

SEQ ID NO: 624831 - DNA, 25 bp, Homo sapien
aagtgcactttgagctgaatttcca

SEQ ID NO: 624832 - DNA, 25 bp, Homo sapien
gagctgaatttccaaaggcaagtag

SEQ ID NO: 624833 - DNA, 25 bp, Homo sapien
gcaagtagtaatgccttagggcagt

SEQ ID NO: 624834 - DNA, 25 bp, Homo sapien
cttagggcagtgtcttagttaccat

SEQ ID NO: 624835 - DNA, 25 bp, Homo sapien
agtgtcttagttaccattgctgttt

SEQ ID NO: 624836 - DNA, 25 bp, Homo sapien
cttagttaccattgctgttttatta

SEQ ID NO: 624837 - DNA, 25 bp, Homo sapien
agagactaccaaagatctggcaaaa

SEQ ID NO: 624838 - DNA, 25 bp, Homo sapien
gatctggcaaaagctcttgccatcc

SEQ ID NO: 624839 - DNA, 25 bp, Homo sapien
aaaagctcttgccatccagtgtgtg

SEQ ID NO: 624840 - DNA, 25 bp, Homo sapien
agctcttgccatccagtgtgtggtc

SEQ ID NO: 624841 - DNA, 25 bp, Homo sapien
gccatccagtgtgtggtctttaact

SEQ ID NO: 624842 - DNA, 25 bp, Homo sapien
gtgtgtggtctttaactgttcagat

SEQ ID NO: 624843 - DNA, 25 bp, Homo sapien
actgttcagatggtttggactacaa

SEQ ID NO: 624844 - DNA, 25 bp, Homo sapien
aagaatttgaacacgtcctttgatt

SEQ ID NO: 624845 - DNA, 25 bp, Homo sapien
gaacacgtcctttgattcaagtcaa

SEQ ID NO: 624846 - DNA, 25 bp, Homo sapien
tgattcaagtcaaatgttctctccc

SEQ ID NO: 624847 - DNA, 25 bp, Homo sapien
ataatgaatatctacttagccacct

SEQ ID NO: 624848 - DNA, 25 bp, Homo sapien
ctttcttctcaacagcttatccaaa

SEQ ID NO: 624849 - DNA, 25 bp, Homo sapien
ccttgactgattcagccctttgtgg

SEQ ID NO: 624850 - DNA, 25 bp, Homo sapien
agccctttgtggtttgccgtcctgt

SEQ ID NO: 624851 - DNA, 25 bp, Homo sapien
tgtggtttgccgtcctgtttctcta

SEQ ID NO: 624852 - DNA, 25 bp, Homo sapien
tctacagcttggacctcttcagtct

SEQ ID NO: 624853 - DNA, 25 bp, Homo sapien
tacagcttggacctcttcagtcttt

SEQ ID NO: 624854 - DNA, 25 bp, Homo sapien
gcttggacctcttcagtctttccat

SEQ ID NO: 624855 - DNA, 25 bp, Homo sapien
gtctttccatcataggtttaactct

SEQ ID NO: 624856 - DNA, 25 bp, Homo sapien
gtttaactctctgttgaatgcttct

SEQ ID NO: 624857 - DNA, 25 bp, Homo sapien
gaatgcttctttgtagctatgcaaa

SEQ ID NO: 624858 - DNA, 25 bp, Homo sapien
ggtattactaccatgcagccagtga

SEQ ID NO: 624859 - DNA, 25 bp, Homo sapien
aaagaccaggcaaatccttagcaga

SEQ ID NO: 624860 - DNA, 25 bp, Homo sapien
caggcaaatccttagcagaaatgag

SEQ ID NO: 624861 - DNA, 25 bp, Homo sapien
aaatgaggacgtggctcagtctgcc

SEQ ID NO: 624862 - DNA, 25 bp, Homo sapien
gaggacgtggctcagtctgccaaca

SEQ ID NO: 624863 - DNA, 25 bp, Homo sapien
gtggctcagtctgccaacacagcta

SEQ ID NO: 624864 - DNA, 25 bp, Homo sapien
tgccaacacagctacccggagcaat

SEQ ID NO: 624865 - DNA, 25 bp, Homo sapien
agctacccggagcaatccctggtga

SEQ ID NO: 624866 - DNA, 25 bp, Homo sapien
acccggagcaatccctggtgaagga

SEQ ID NO: 624867 - DNA, 25 bp, Homo sapien
ccctggtgaaggaaggcagctctag

SEQ ID NO: 624868 - DNA, 25 bp, Homo sapien
gcagctctagagaatgccagccaca

SEQ ID NO: 624869 - DNA, 25 bp, Homo sapien
agctctagagaatgccagccacagg

SEQ ID NO: 624870 - DNA, 25 bp, Homo sapien
agatctggcaaaagctcttgccatc

SEQ ID NO: 624871 - DNA, 25 bp, Homo sapien
gcaaaagctcttgccatccagtgtg

SEQ ID NO: 624872 - DNA, 25 bp, Homo sapien
aaaagctcttgccatccagtgtgtg

SEQ ID NO: 624873 - DNA, 25 bp, Homo sapien
aagctcttgccatccagtgtgtggt

SEQ ID NO: 624874 - DNA, 25 bp, Homo sapien
gctcttgccatccagtgtgtggtct

SEQ ID NO: 624875 - DNA, 25 bp, Homo sapien
ttgccatccagtgtgtggtctttaa

SEQ ID NO: 624876 - DNA, 25 bp, Homo sapien
gccatccagtgtgtggtctttaact

SEQ ID NO: 624877 - DNA, 25 bp, Homo sapien
tccagtgtgtggtctttaactgttc

SEQ ID NO: 624878 - DNA, 25 bp, Homo sapien
gtgtgtggtctttaactgttcagat

SEQ ID NO: 624879 - DNA, 25 bp, Homo sapien
gtggtctttaactgttcagatggtt

SEQ ID NO: 624880 - DNA, 25 bp, Homo sapien
tttaactgttcagatggtttggact

SEQ ID NO: 624881 - DNA, 25 bp, Homo sapien
gaagaggagtttcattcgcgtccca

SEQ ID NO: 624882 - DNA, 25 bp, Homo sapien
agtttcattcgcgtcccatctttca

SEQ ID NO: 624883 - DNA, 25 bp, Homo sapien
tctttcagaagccttgtccaggtct

SEQ ID NO: 624884 - DNA, 25 bp, Homo sapien
tccaggtctccctgttagcacctga

SEQ ID NO: 624885 - DNA, 25 bp, Homo sapien
ttagcacctgactcagcggcagctt

SEQ ID NO: 624886 - DNA, 25 bp, Homo sapien
ttctgccgctgggttttcatttcac

SEQ ID NO: 624887 - DNA, 25 bp, Homo sapien
ttcatttcactgtggatatccctga

SEQ ID NO: 624888 - DNA, 25 bp, Homo sapien
tgtggatatccctgaggccatgagg

SEQ ID NO: 624889 - DNA, 25 bp, Homo sapien
gcagctccaactccagagaagggta

SEQ ID NO: 624890 - DNA, 25 bp, Homo sapien
aactccagagaagggtacagctgac

SEQ ID NO: 624891 - DNA, 25 bp, Homo sapien
tagcccccttggaacctaacagata

SEQ ID NO: 624892 - DNA, 25 bp, Homo sapien
atcggatgcatgttagagacaatgt

SEQ ID NO: 624893 - DNA, 25 bp, Homo sapien
gatgcatgttagagacaatgtgaaa

SEQ ID NO: 624894 - DNA, 25 bp, Homo sapien
aaatagcaatggatcagtatggaaa

SEQ ID NO: 624895 - DNA, 25 bp, Homo sapien
tagcaatggatcagtatggaaaatt

SEQ ID NO: 624896 - DNA, 25 bp, Homo sapien
aaaagtggatcttgtattgatgcac

SEQ ID NO: 624897 - DNA, 25 bp, Homo sapien
gtggatcttgtattgatgcactgga

SEQ ID NO: 624898 - DNA, 25 bp, Homo sapien
gatcttgtattgatgcactggaggg

SEQ ID NO: 624899 - DNA, 25 bp, Homo sapien
cttgtattgatgcactggagggata

SEQ ID NO: 624900 - DNA, 25 bp, Homo sapien
tattgatgcactggagggataggat

SEQ ID NO: 624901 - DNA, 25 bp, Homo sapien
gataggatgggcattgctcaaaaag

SEQ ID NO: 624902 - DNA, 25 bp, Homo sapien
taggatgggcattgctcaaaaagag

SEQ ID NO: 624903 - DNA, 25 bp, Homo sapien
aaaaacatgacgatgggccctgaat

SEQ ID NO: 624904 - DNA, 25 bp, Homo sapien
gacgatgggccctgaatgccaagat

SEQ ID NO: 624905 - DNA, 25 bp, Homo sapien
gaatgccaagattcattggagcttt

SEQ ID NO: 624906 - DNA, 25 bp, Homo sapien
cattggagctttggagctttatctt

SEQ ID NO: 624907 - DNA, 25 bp, Homo sapien
ggagctttatcttgtaggaccttat

SEQ ID NO: 624908 - DNA, 25 bp, Homo sapien
atcttgtaggaccttatcctgactc

SEQ ID NO: 624909 - DNA, 25 bp, Homo sapien
cttatcctgactcccttagaatgta

SEQ ID NO: 624910 - DNA, 25 bp, Homo sapien
gagaacagggactttgtctgccttg

SEQ ID NO: 624911 - DNA, 25 bp, Homo sapien
actttgtctgccttgttttctactt

SEQ ID NO: 624912 - DNA, 25 bp, Homo sapien
cttttatcaccagcacccagaatga

SEQ ID NO: 624913 - DNA, 25 bp, Homo sapien
accagcacccagaatgatgcctaaa

SEQ ID NO: 624914 - DNA, 25 bp, Homo sapien
ggaaccctcctcttggcaagggctt

SEQ ID NO: 624915 - DNA, 25 bp, Homo sapien
tcctcttggcaagggctttccgaag

SEQ ID NO: 624916 - DNA, 25 bp, Homo sapien
gcaagggctttccgaagttaacctg

SEQ ID NO: 624917 - DNA, 25 bp, Homo sapien
ggccatgacagcaaagggttggata

SEQ ID NO: 624918 - DNA, 25 bp, Homo sapien
acagcaaagggttggatagcctcat

SEQ ID NO: 624919 - DNA, 25 bp, Homo sapien
gggttggatagcctcattatccctc

SEQ ID NO: 624920 - DNA, 25 bp, Homo sapien
ttggatagcctcattatccctcctc

SEQ ID NO: 624921 - DNA, 25 bp, Homo sapien
cagaactctggaacagccagcgtta

SEQ ID NO: 624922 - DNA, 25 bp, Homo sapien
gaactctggaacagccagcgttaac

SEQ ID NO: 624923 - DNA, 25 bp, Homo sapien
acacaggccttcagtctgatgagaa

SEQ ID NO: 624924 - DNA, 25 bp, Homo sapien
acaggccttcagtctgatgagaaac

SEQ ID NO: 624925 - DNA, 25 bp, Homo sapien
ggaatagtttatgttcccaccagcc

SEQ ID NO: 624926 - DNA, 25 bp, Homo sapien
aggatttggtagtcacagggcgtca

SEQ ID NO: 624927 - DNA, 25 bp, Homo sapien
acagggcgtcaaatagagtcttcag

SEQ ID NO: 624928 - DNA, 25 bp, Homo sapien
gagtcttcagaagggtgttgcctca

SEQ ID NO: 624929 - DNA, 25 bp, Homo sapien
tcagaagggtgttgcctcagcacta

SEQ ID NO: 624930 - DNA, 25 bp, Homo sapien
gtgttgcctcagcactagggcataa

SEQ ID NO: 624931 - DNA, 25 bp, Homo sapien
gcctcagcactagggcataatttgg

SEQ ID NO: 624932 - DNA, 25 bp, Homo sapien
agcttaaaagctactcctgaacagt

SEQ ID NO: 624933 - DNA, 25 bp, Homo sapien
tactcctgaacagtacccttaactt

SEQ ID NO: 624934 - DNA, 25 bp, Homo sapien
tttcaaataagtgcatccctaacaa

SEQ ID NO: 624935 - DNA, 25 bp, Homo sapien
agtgcatccctaacaaaactcaata

SEQ ID NO: 624936 - DNA, 25 bp, Homo sapien
gataaatcggtgtgtattttatttt

SEQ ID NO: 624937 - DNA, 25 bp, Homo sapien
ttttgcagaaatggatttatatcat

SEQ ID NO: 624938 - DNA, 25 bp, Homo sapien
cagaaatggatttatatcatacaca

SEQ ID NO: 624939 - DNA, 25 bp, Homo sapien
gaaatggatttatatcatacacaaa

SEQ ID NO: 624940 - DNA, 25 bp, Homo sapien
aatggatttatatcatacacaaagc

SEQ ID NO: 624941 - DNA, 25 bp, Homo sapien
atggatttatatcatacacaaagca

SEQ ID NO: 624942 - DNA, 25 bp, Homo sapien
tggatttatatcatacacaaagcac

SEQ ID NO: 624943 - DNA, 25 bp, Homo sapien
ggatttatatcatacacaaagcaca

SEQ ID NO: 624944 - DNA, 25 bp, Homo sapien
gatttatatcatacacaaagcacac

SEQ ID NO: 624945 - DNA, 25 bp, Homo sapien
ttatatcatacacaaagcacacaaa

SEQ ID NO: 624946 - DNA, 25 bp, Homo sapien
tatcatacacaaagcacacaaatat

SEQ ID NO: 624947 - DNA, 25 bp, Homo sapien
agagaactggtgtggtgtagtccca

SEQ ID NO: 624948 - DNA, 25 bp, Homo sapien
gtggtgtagtcccagattcttctgc

SEQ ID NO: 624949 - DNA, 25 bp, Homo sapien
ttctgcccaacactctagacacatt

SEQ ID NO: 624950 - DNA, 25 bp, Homo sapien
aacactctagacacattacctggga

SEQ ID NO: 624951 - DNA, 25 bp, Homo sapien
gacacattacctgggaaagctctcc

SEQ ID NO: 624952 - DNA, 25 bp, Homo sapien
attacctgggaaagctctcctccct

SEQ ID NO: 624953 - DNA, 25 bp, Homo sapien
tccccatgggagaagagtccttcac

SEQ ID NO: 624954 - DNA, 25 bp, Homo sapien
tgggagaagagtccttcacgcctca

SEQ ID NO: 624955 - DNA, 25 bp, Homo sapien
aagagtccttcacgcctcattaggg

SEQ ID NO: 624956 - DNA, 25 bp, Homo sapien
gggcatcaaagactcaagttaagat

SEQ ID NO: 624957 - DNA, 25 bp, Homo sapien
taattggtagacattagatgcacaa

SEQ ID NO: 624958 - DNA, 25 bp, Homo sapien
acaaaaactaggccaggcaagatgg

SEQ ID NO: 624959 - DNA, 25 bp, Homo sapien
caaaaactaggccaggcaagatggc

SEQ ID NO: 624960 - DNA, 25 bp, Homo sapien
aaaaactaggccaggcaagatggct

SEQ ID NO: 624961 - DNA, 25 bp, Homo sapien
aaaactaggccaggcaagatggctc

SEQ ID NO: 624962 - DNA, 25 bp, Homo sapien
aaactaggccaggcaagatggctca

SEQ ID NO: 624963 - DNA, 25 bp, Homo sapien
aactaggccaggcaagatggctcac

SEQ ID NO: 624964 - DNA, 25 bp, Homo sapien
actaggccaggcaagatggctcaca

SEQ ID NO: 624965 - DNA, 25 bp, Homo sapien
ctaggccaggcaagatggctcacac

SEQ ID NO: 624966 - DNA, 25 bp, Homo sapien
taggccaggcaagatggctcacacc

SEQ ID NO: 624967 - DNA, 25 bp, Homo sapien
cagatacattctatagtatgtaaat

SEQ ID NO: 624968 - DNA, 25 bp, Homo sapien
aaagttggattgtagagatggctgc

SEQ ID NO: 624969 - DNA, 25 bp, Homo sapien
aagttggattgtagagatggctgca

SEQ ID NO: 624970 - DNA, 25 bp, Homo sapien
agttggattgtagagatggctgcac

SEQ ID NO: 624971 - DNA, 25 bp, Homo sapien
gttggattgtagagatggctgcaca

SEQ ID NO: 624972 - DNA, 25 bp, Homo sapien
gttaaaacagatacattctatagta

SEQ ID NO: 624973 - DNA, 25 bp, Homo sapien
taaaacagatacattctatagtatg

SEQ ID NO: 624974 - DNA, 25 bp, Homo sapien
aaaacagatacattctatagtatgt

SEQ ID NO: 624975 - DNA, 25 bp, Homo sapien
aaacagatacattctatagtatgta

SEQ ID NO: 624976 - DNA, 25 bp, Homo sapien
aacagatacattctatagtatgtaa

SEQ ID NO: 624977 - DNA, 25 bp, Homo sapien
acagatacattctatagtatgtaaa

SEQ ID NO: 624978 - DNA, 25 bp, Homo sapien
agatcctcagcatccaacaagccat

SEQ ID NO: 624979 - DNA, 25 bp, Homo sapien
agcatccaacaagccatcattcgga

SEQ ID NO: 624980 - DNA, 25 bp, Homo sapien
gccatcattcggaagctaaagacat

SEQ ID NO: 624981 - DNA, 25 bp, Homo sapien
agacattcatctttgaagggactga

SEQ ID NO: 624982 - DNA, 25 bp, Homo sapien
gcagggctgaactgcccgacaatct

SEQ ID NO: 624983 - DNA, 25 bp, Homo sapien
tgcccgacaatctcaaggccttgtt

SEQ ID NO: 624984 - DNA, 25 bp, Homo sapien
aatctcaaggccttgttccggacag

SEQ ID NO: 624985 - DNA, 25 bp, Homo sapien
tgttccggacagtggccatgatggt

SEQ ID NO: 624986 - DNA, 25 bp, Homo sapien
tgatggtcccagattacgccctcat

SEQ ID NO: 624987 - DNA, 25 bp, Homo sapien
ccagattacgccctcattggagaaa

SEQ ID NO: 624988 - DNA, 25 bp, Homo sapien
ttacgccctcattggagaaatctcc

SEQ ID NO: 624989 - DNA, 25 bp, Homo sapien
ttcaaaaagctaacaacatcctaat

SEQ ID NO: 624990 - DNA, 25 bp, Homo sapien
aacatcctaatagaactgttcagat

SEQ ID NO: 624991 - DNA, 25 bp, Homo sapien
atagaactgttcagatgacaagagt

SEQ ID NO: 624992 - DNA, 25 bp, Homo sapien
gacaagagtgtcttcttgcttttca

SEQ ID NO: 624993 - DNA, 25 bp, Homo sapien
cagatttggccactgatcgaagttt

SEQ ID NO: 624994 - DNA, 25 bp, Homo sapien
ggccactgatcgaagttttacccat

SEQ ID NO: 624995 - DNA, 25 bp, Homo sapien
tgatcgaagttttacccataaggga

SEQ ID NO: 624996 - DNA, 25 bp, Homo sapien
gggaaataacatagtatcaagcaat

SEQ ID NO: 624997 - DNA, 25 bp, Homo sapien
ttatcagtttgacatggatgggttt

SEQ ID NO: 624998 - DNA, 25 bp, Homo sapien
gactgaaagtatgtttattatgcta

SEQ ID NO: 624999 - DNA, 25 bp, Homo sapien
tataacagcgaaaaaggttctcctt

SEQ ID NO: 625000 - DNA, 25 bp, Homo sapien
tgtcctccatcaacacctggctgag

SEQ ID NO: 625001 - DNA, 25 bp, Homo sapien
atcaacacctggctgagcaggaaca

SEQ ID NO: 625002 - DNA, 25 bp, Homo sapien
ctggctgagcaggaacaactatgac

SEQ ID NO: 625003 - DNA, 25 bp, Homo sapien
ggaacaactatgacctaggaccagg

SEQ ID NO: 625004 - DNA, 25 bp, Homo sapien
taggaccagggccttcaggaatctt

SEQ ID NO: 625005 - DNA, 25 bp, Homo sapien
gaccagggccttcaggaatcttcac

SEQ ID NO: 625006 - DNA, 25 bp, Homo sapien
ttcaggaatcttcacccctaacttg

SEQ ID NO: 625007 - DNA, 25 bp, Homo sapien
gaatcttcacccctaacttgaactt

SEQ ID NO: 625008 - DNA, 25 bp, Homo sapien
tcacccctaacttgaacttcataac

SEQ ID NO: 625009 - DNA, 25 bp, Homo sapien
acttgaacttcataacactggagag

SEQ ID NO: 625010 - DNA, 25 bp, Homo sapien
acttcataacactggagagagagac

SEQ ID NO: 625011 - DNA, 25 bp, Homo sapien
agaaatcctctgaaactgagtgcag

SEQ ID NO: 625012 - DNA, 25 bp, Homo sapien
aatcctctgaaactgagtgcagaag

SEQ ID NO: 625013 - DNA, 25 bp, Homo sapien
gtgtgtgcattgacagtatgggcta

SEQ ID NO: 625014 - DNA, 25 bp, Homo sapien
gtgtgcattgacagtatgggctaga

SEQ ID NO: 625015 - DNA, 25 bp, Homo sapien
atgggctagagggtgtttctttcct

SEQ ID NO: 625016 - DNA, 25 bp, Homo sapien
gctagagggtgtttctttcctacca

SEQ ID NO: 625017 - DNA, 25 bp, Homo sapien
tgttctcctcccaggatgacattat

SEQ ID NO: 625018 - DNA, 25 bp, Homo sapien
tctcctcccaggatgacattattga

SEQ ID NO: 625019 - DNA, 25 bp, Homo sapien
tccgtagacgaggtcaggctgcttc

SEQ ID NO: 625020 - DNA, 25 bp, Homo sapien
caggctgcttctaaatcttgagcca

SEQ ID NO: 625021 - DNA, 25 bp, Homo sapien
gctgcttctaaatcttgagccaaga

SEQ ID NO: 625022 - DNA, 25 bp, Homo sapien
gggttttgccaggttttgccatgtt

SEQ ID NO: 625023 - DNA, 25 bp, Homo sapien
tcaagtgatctgcacacgtctgact

SEQ ID NO: 625024 - DNA, 25 bp, Homo sapien
aagtgatctgcacacgtctgactcc

SEQ ID NO: 625025 - DNA, 25 bp, Homo sapien
tctgcacacgtctgactcccaaagt

SEQ ID NO: 625026 - DNA, 25 bp, Homo sapien
ctggcctcatttattagttctaacg

SEQ ID NO: 625027 - DNA, 25 bp, Homo sapien
ggcctcatttattagttctaacgtg

SEQ ID NO: 625028 - DNA, 25 bp, Homo sapien
attagttctaacgtgtgtgtgtgca

SEQ ID NO: 625029 - DNA, 25 bp, Homo sapien
tgtgtgcacacacgccctttaggca

SEQ ID NO: 625030 - DNA, 25 bp, Homo sapien
acacgccctttaggcatttctactt

SEQ ID NO: 625031 - DNA, 25 bp, Homo sapien
cgccctttaggcatttctacttata

SEQ ID NO: 625032 - DNA, 25 bp, Homo sapien
ctttaggcatttctacttataagat

SEQ ID NO: 625033 - DNA, 25 bp, Homo sapien
caatgcacagacacacaaccgattt

SEQ ID NO: 625034 - DNA, 25 bp, Homo sapien
caaccgattttgtagggtcctagca

SEQ ID NO: 625035 - DNA, 25 bp, Homo sapien
gtagggtcctagcagaattttctct

SEQ ID NO: 625036 - DNA, 25 bp, Homo sapien
ggtcctagcagaattttctctgtag

SEQ ID NO: 625037 - DNA, 25 bp, Homo sapien
tctctgtaggaaaagcactcaatct

SEQ ID NO: 625038 - DNA, 25 bp, Homo sapien
gtaggaaaagcactcaatctcaaaa

SEQ ID NO: 625039 - DNA, 25 bp, Homo sapien
aaaaaagttctgttttagacatgct

SEQ ID NO: 625040 - DNA, 25 bp, Homo sapien
gttttagacatgctacattggagat

SEQ ID NO: 625041 - DNA, 25 bp, Homo sapien
tggagatgtctattcacttcctaat

SEQ ID NO: 625042 - DNA, 25 bp, Homo sapien
aagtagtggttagcagttggatgta

SEQ ID NO: 625043 - DNA, 25 bp, Homo sapien
ggatgtaagagtcagaagttttagc

SEQ ID NO: 625044 - DNA, 25 bp, Homo sapien
cccagtagttgaaaatcaattcata

SEQ ID NO: 625045 - DNA, 25 bp, Homo sapien
ccagtagttgaaaatcaattcataa

SEQ ID NO: 625046 - DNA, 25 bp, Homo sapien
cagtagttgaaaatcaattcataac

SEQ ID NO: 625047 - DNA, 25 bp, Homo sapien
agtagttgaaaatcaattcataact

SEQ ID NO: 625048 - DNA, 25 bp, Homo sapien
gtagttgaaaatcaattcataactt

SEQ ID NO: 625049 - DNA, 25 bp, Homo sapien
tagttgaaaatcaattcataactta

SEQ ID NO: 625050 - DNA, 25 bp, Homo sapien
agttgaaaatcaattcataacttag

SEQ ID NO: 625051 - DNA, 25 bp, Homo sapien
gttgaaaatcaattcataacttaga

SEQ ID NO: 625052 - DNA, 25 bp, Homo sapien
ttgaaaatcaattcataacttagaa

SEQ ID NO: 625053 - DNA, 25 bp, Homo sapien
tgaaaatcaattcataacttagaaa

SEQ ID NO: 625054 - DNA, 25 bp, Homo sapien
aaggcactgccagttgtttgcgctg

SEQ ID NO: 625055 - DNA, 25 bp, Homo sapien
cgctgggctgaaagtggtgcttcta

SEQ ID NO: 625056 - DNA, 25 bp, Homo sapien
ctgaaagtggtgcttctacttgtga

SEQ ID NO: 625057 - DNA, 25 bp, Homo sapien
agtctccgactagatatctgctgtc

SEQ ID NO: 625058 - DNA, 25 bp, Homo sapien
tgctgtcccctcttacacagggtaa

SEQ ID NO: 625059 - DNA, 25 bp, Homo sapien
gtaaagactactgggcccaattcct

SEQ ID NO: 625060 - DNA, 25 bp, Homo sapien
aggccctgcgtatgacttcatttca

SEQ ID NO: 625061 - DNA, 25 bp, Homo sapien
acctgtgtttgccatctgctctttg

SEQ ID NO: 625062 - DNA, 25 bp, Homo sapien
ttgccatctgctctttgtgtctttg

SEQ ID NO: 625063 - DNA, 25 bp, Homo sapien
tttctgttttcctcagtaaatacac

SEQ ID NO: 625064 - DNA, 25 bp, Homo sapien
gtaaatacacctggcttttgtaatt

SEQ ID NO: 625065 - DNA, 25 bp, Homo sapien
catctgcctcaagcctgttcaattt

SEQ ID NO: 625066 - DNA, 25 bp, Homo sapien
gcctcaagcctgttcaatttactca

SEQ ID NO: 625067 - DNA, 25 bp, Homo sapien
acaactttgtttataatgccttctt

SEQ ID NO: 625068 - DNA, 25 bp, Homo sapien
taatgccttcttagagctcggactt

SEQ ID NO: 625069 - DNA, 25 bp, Homo sapien
gagctcggactttccatagaagaca

SEQ ID NO: 625070 - DNA, 25 bp, Homo sapien
ctcctcctgaaataggtcctttaga

SEQ ID NO: 625071 - DNA, 25 bp, Homo sapien
taggtcctttagaaatgcttttagt

SEQ ID NO: 625072 - DNA, 25 bp, Homo sapien
aatgcttttagtagccaggcatagt

SEQ ID NO: 625073 - DNA, 25 bp, Homo sapien
gcatgcctgtattccaggtgctcag

SEQ ID NO: 625074 - DNA, 25 bp, Homo sapien
tgtggtgcactgtgatcatgcctat

SEQ ID NO: 625075 - DNA, 25 bp, Homo sapien
cactgtgatcatgcctatgagtagc

SEQ ID NO: 625076 - DNA, 25 bp, Homo sapien
ggtcaggggttccagaccagtctga

SEQ ID NO: 625077 - DNA, 25 bp, Homo sapien
gtcaggggttccagaccagtctgac

SEQ ID NO: 625078 - DNA, 25 bp, Homo sapien
tcaggggttccagaccagtctgacc

SEQ ID NO: 625079 - DNA, 25 bp, Homo sapien
caggggttccagaccagtctgacca

SEQ ID NO: 625080 - DNA, 25 bp, Homo sapien
acaaagtccaatgtggtggcacgtg

SEQ ID NO: 625081 - DNA, 25 bp, Homo sapien
caaagtccaatgtggtggcacgtgc

SEQ ID NO: 625082 - DNA, 25 bp, Homo sapien
aaagtccaatgtggtggcacgtgcc

SEQ ID NO: 625083 - DNA, 25 bp, Homo sapien
gaacccatgaggtggaagtttcagt

SEQ ID NO: 625084 - DNA, 25 bp, Homo sapien
aacccatgaggtggaagtttcagtg

SEQ ID NO: 625085 - DNA, 25 bp, Homo sapien
acccatgaggtggaagtttcagtga

SEQ ID NO: 625086 - DNA, 25 bp, Homo sapien
cccatgaggtggaagtttcagtgag

SEQ ID NO: 625087 - DNA, 25 bp, Homo sapien
atagcccatctcatgggctcttgtc

SEQ ID NO: 625088 - DNA, 25 bp, Homo sapien
atctcatgggctcttgtcctttgct

SEQ ID NO: 625089 - DNA, 25 bp, Homo sapien
tcatgggctcttgtcctttgctgta

SEQ ID NO: 625090 - DNA, 25 bp, Homo sapien
catgggctcttgtcctttgctgtaa

SEQ ID NO: 625091 - DNA, 25 bp, Homo sapien
atgggctcttgtcctttgctgtaag

SEQ ID NO: 625092 - DNA, 25 bp, Homo sapien
gggctcttgtcctttgctgtaagaa

SEQ ID NO: 625093 - DNA, 25 bp, Homo sapien
ggctcttgtcctttgctgtaagaat

SEQ ID NO: 625094 - DNA, 25 bp, Homo sapien
gctcttgtcctttgctgtaagaatt

SEQ ID NO: 625095 - DNA, 25 bp, Homo sapien
cttgtcctttgctgtaagaatttta

SEQ ID NO: 625096 - DNA, 25 bp, Homo sapien
tgtaagaattttatcgagggccggg

SEQ ID NO: 625097 - DNA, 25 bp, Homo sapien
agaattttatcgagggccgggcatg

SEQ ID NO: 625098 - DNA, 25 bp, Homo sapien
acacttatttcatcactgagtttta

SEQ ID NO: 625099 - DNA, 25 bp, Homo sapien
tttcatcactgagttttaattttaa

SEQ ID NO: 625100 - DNA, 25 bp, Homo sapien
gtgcaatcacagtttactgcacccc

SEQ ID NO: 625101 - DNA, 25 bp, Homo sapien
aatcacagtttactgcacccctgac

SEQ ID NO: 625102 - DNA, 25 bp, Homo sapien
agcgtcctgagtagccagaactata

SEQ ID NO: 625103 - DNA, 25 bp, Homo sapien
agtagccagaactataggcacacca

SEQ ID NO: 625104 - DNA, 25 bp, Homo sapien
tataggcacaccactacacctagct

SEQ ID NO: 625105 - DNA, 25 bp, Homo sapien
tacacctagctttttcttttgccag

SEQ ID NO: 625106 - DNA, 25 bp, Homo sapien
cacctagctttttcttttgccaggt

SEQ ID NO: 625107 - DNA, 25 bp, Homo sapien
aaattgcccaatctttttcatagtg

SEQ ID NO: 625108 - DNA, 25 bp, Homo sapien
ctttttcatagtgtcttgtccactt

SEQ ID NO: 625109 - DNA, 25 bp, Homo sapien
aagcccttcctgactgggctcaagg

SEQ ID NO: 625110 - DNA, 25 bp, Homo sapien
ttcaataactagttctccgaaacag

SEQ ID NO: 625111 - DNA, 25 bp, Homo sapien
tagttctccgaaacagcactggatg

SEQ ID NO: 625112 - DNA, 25 bp, Homo sapien
acacaactcgttccaggacttagtg

SEQ ID NO: 625113 - DNA, 25 bp, Homo sapien
aactcgttccaggacttagtgacca

SEQ ID NO: 625114 - DNA, 25 bp, Homo sapien
ttctgtccctgttcaatagagttca

SEQ ID NO: 625115 - DNA, 25 bp, Homo sapien
ctgtccctgttcaatagagttcaaa

SEQ ID NO: 625116 - DNA, 25 bp, Homo sapien
ttaaattttgctccacaatgtgcca

SEQ ID NO: 625117 - DNA, 25 bp, Homo sapien
caatgtgccatattatctgtatcca

SEQ ID NO: 625118 - DNA, 25 bp, Homo sapien
atattatctgtatccaacctgtcat

SEQ ID NO: 625119 - DNA, 25 bp, Homo sapien
tgtatccaacctgtcattgggcatt

SEQ ID NO: 625120 - DNA, 25 bp, Homo sapien
aaaacccacactggtagtatgtgga

SEQ ID NO: 625121 - DNA, 25 bp, Homo sapien
ggtagaccaaattgtcacgtaagaa

SEQ ID NO: 625122 - DNA, 25 bp, Homo sapien
gagttgctgagctagggtagtcaca

SEQ ID NO: 625123 - DNA, 25 bp, Homo sapien
gagctagggtagtcacagggctaaa

SEQ ID NO: 625124 - DNA, 25 bp, Homo sapien
gggctaaagaagcagcacacctgaa

SEQ ID NO: 625125 - DNA, 25 bp, Homo sapien
gctgtttgcgcagtaaagatctaac

SEQ ID NO: 625126 - DNA, 25 bp, Homo sapien
gatctaacttagtggcagcttgtac

SEQ ID NO: 625127 - DNA, 25 bp, Homo sapien
gattatctcagttttgtgtgtagta

SEQ ID NO: 625128 - DNA, 25 bp, Homo sapien
tgtgtgtagtacctgggacttttcc

SEQ ID NO: 625129 - DNA, 25 bp, Homo sapien
aagtgttttaggcaagctcagtcgt

SEQ ID NO: 625130 - DNA, 25 bp, Homo sapien
ggcaagctcagtcgtacataaacat

SEQ ID NO: 625131 - DNA, 25 bp, Homo sapien
gaagacaagcacttcaaagaggcag

SEQ ID NO: 625132 - DNA, 25 bp, Homo sapien
aagacaagcacttcaaagaggcagc

SEQ ID NO: 625133 - DNA, 25 bp, Homo sapien
agacaagcacttcaaagaggcagcg

SEQ ID NO: 625134 - DNA, 25 bp, Homo sapien
gacaagcacttcaaagaggcagcgt

SEQ ID NO: 625135 - DNA, 25 bp, Homo sapien
acaagcacttcaaagaggcagcgtc

SEQ ID NO: 625136 - DNA, 25 bp, Homo sapien
caagcacttcaaagaggcagcgtca

SEQ ID NO: 625137 - DNA, 25 bp, Homo sapien
aagcacttcaaagaggcagcgtcag

SEQ ID NO: 625138 - DNA, 25 bp, Homo sapien
agcacttcaaagaggcagcgtcagc

SEQ ID NO: 625139 - DNA, 25 bp, Homo sapien
aaagaggcagcgtcagccaggggca

SEQ ID NO: 625140 - DNA, 25 bp, Homo sapien
agaggcagcgtcagccaggggcagt

SEQ ID NO: 625141 - DNA, 25 bp, Homo sapien
gaggcagcgtcagccaggggcagtg

SEQ ID NO: 625142 - DNA, 25 bp, Homo sapien
ttttgcagaaatggatttatatcat

SEQ ID NO: 625143 - DNA, 25 bp, Homo sapien
cagaaatggatttatatcatacaca

SEQ ID NO: 625144 - DNA, 25 bp, Homo sapien
agaaatggatttatatcatacacaa

SEQ ID NO: 625145 - DNA, 25 bp, Homo sapien
gaaatggatttatatcatacacaaa

SEQ ID NO: 625146 - DNA, 25 bp, Homo sapien
aaatggatttatatcatacacaaag

SEQ ID NO: 625147 - DNA, 25 bp, Homo sapien
aatggatttatatcatacacaaagc

SEQ ID NO: 625148 - DNA, 25 bp, Homo sapien
atggatttatatcatacacaaagca

SEQ ID NO: 625149 - DNA, 25 bp, Homo sapien
tggatttatatcatacacaaagcac

SEQ ID NO: 625150 - DNA, 25 bp, Homo sapien
tggtgcttgtaatccagtgacatca

SEQ ID NO: 625151 - DNA, 25 bp, Homo sapien
ggtgcttgtaatccagtgacatcag

SEQ ID NO: 625152 - DNA, 25 bp, Homo sapien
gtgcttgtaatccagtgacatcagg

SEQ ID NO: 625153 - DNA, 25 bp, Homo sapien
gcttgtaatccagtgacatcaggat

SEQ ID NO: 625154 - DNA, 25 bp, Homo sapien
atccagtgacatcaggattgaaaaa

SEQ ID NO: 625155 - DNA, 25 bp, Homo sapien
tttgagactaccctgcaacatgcta

SEQ ID NO: 625156 - DNA, 25 bp, Homo sapien
ttgagactaccctgcaacatgctat

SEQ ID NO: 625157 - DNA, 25 bp, Homo sapien
tgagactaccctgcaacatgctatc

SEQ ID NO: 625158 - DNA, 25 bp, Homo sapien
gagactaccctgcaacatgctatct

SEQ ID NO: 625159 - DNA, 25 bp, Homo sapien
caacatgctatctctactaaatgta

SEQ ID NO: 625160 - DNA, 25 bp, Homo sapien
atgctatctctactaaatgtacaaa

SEQ ID NO: 625161 - DNA, 25 bp, Homo sapien
actgcgttccgaagctgaaattgag

SEQ ID NO: 625162 - DNA, 25 bp, Homo sapien
attgagagagaatgtgtggcatcac

SEQ ID NO: 625163 - DNA, 25 bp, Homo sapien
gaatgtgtggcatcactatcgtcat

SEQ ID NO: 625164 - DNA, 25 bp, Homo sapien
atgtgtggcatcactatcgtcatca

SEQ ID NO: 625165 - DNA, 25 bp, Homo sapien
atcatcaacagacaactacaacttt

SEQ ID NO: 625166 - DNA, 25 bp, Homo sapien
gaaaccagaaatgaactctattcaa

SEQ ID NO: 625167 - DNA, 25 bp, Homo sapien
acaattcagtggtatcagtttaatt

SEQ ID NO: 625168 - DNA, 25 bp, Homo sapien
cagtggtatcagtttaattgtaaca

SEQ ID NO: 625169 - DNA, 25 bp, Homo sapien
atttaattcaagtccaatccatgta

SEQ ID NO: 625170 - DNA, 25 bp, Homo sapien
caagtccaatccatgtaatcagtat

SEQ ID NO: 625171 - DNA, 25 bp, Homo sapien
aatcttcaaatcaataaatctcagt

SEQ ID NO: 625172 - DNA, 25 bp, Homo sapien
gaagacgaggtctacaatgccattc

SEQ ID NO: 625173 - DNA, 25 bp, Homo sapien
gaggtctacaatgccattcccatca

SEQ ID NO: 625174 - DNA, 25 bp, Homo sapien
atgccattcccatcatcatgggcag

SEQ ID NO: 625175 - DNA, 25 bp, Homo sapien
tcccatcatcatgggcagctctgtg

SEQ ID NO: 625176 - DNA, 25 bp, Homo sapien
gctctgctactgctggcgctcatca

SEQ ID NO: 625177 - DNA, 25 bp, Homo sapien
ccacactgtacaagcttggcttctt

SEQ ID NO: 625178 - DNA, 25 bp, Homo sapien
ttggcttcttcaaacgccactacaa

SEQ ID NO: 625179 - DNA, 25 bp, Homo sapien
caaacgccactacaaggaaatgctg

SEQ ID NO: 625180 - DNA, 25 bp, Homo sapien
ggaaatgctggaggacaagcctgaa

SEQ ID NO: 625181 - DNA, 25 bp, Homo sapien
gctggaggacaagcctgaagacact

SEQ ID NO: 625182 - DNA, 25 bp, Homo sapien
tgaagacactgccacattcagtggg

SEQ ID NO: 625183 - DNA, 25 bp, Homo sapien
gaagagaagccggtcctctgcaggc

SEQ ID NO: 625184 - DNA, 25 bp, Homo sapien
agaagccggtcctctgcaggctcaa

SEQ ID NO: 625185 - DNA, 25 bp, Homo sapien
tcaagcctatctgggcctctgggga

SEQ ID NO: 625186 - DNA, 25 bp, Homo sapien
tgaccttgtcctacttcactgcctt

SEQ ID NO: 625187 - DNA, 25 bp, Homo sapien
ttgtcctacttcactgcctttgtct

SEQ ID NO: 625188 - DNA, 25 bp, Homo sapien
tacttcactgcctttgtctgtgtta

SEQ ID NO: 625189 - DNA, 25 bp, Homo sapien
ttcactgcctttgtctgtgttacta

SEQ ID NO: 625190 - DNA, 25 bp, Homo sapien
cactgcctttgtctgtgttactagt

SEQ ID NO: 625191 - DNA, 25 bp, Homo sapien
gtgcccttcatccaagctcctatgt

SEQ ID NO: 625192 - DNA, 25 bp, Homo sapien
gcccttcatccaagctcctatgtga

SEQ ID NO: 625193 - DNA, 25 bp, Homo sapien
ggcagaagtggctcatttatgaccc

SEQ ID NO: 625194 - DNA, 25 bp, Homo sapien
ccgtaggtttgtaactgtttcatag

SEQ ID NO: 625195 - DNA, 25 bp, Homo sapien
cgtaggtttgtaactgtttcataga

SEQ ID NO: 625196 - DNA, 25 bp, Homo sapien
gtaggtttgtaactgtttcatagaa

SEQ ID NO: 625197 - DNA, 25 bp, Homo sapien
taggtttgtaactgtttcatagaag

SEQ ID NO: 625198 - DNA, 25 bp, Homo sapien
aggtttgtaactgtttcatagaaga

SEQ ID NO: 625199 - DNA, 25 bp, Homo sapien
ggtttgtaactgtttcatagaagag

SEQ ID NO: 625200 - DNA, 25 bp, Homo sapien
gtttgtaactgtttcatagaagagc

SEQ ID NO: 625201 - DNA, 25 bp, Homo sapien
tttgtaactgtttcatagaagagcc

SEQ ID NO: 625202 - DNA, 25 bp, Homo sapien
ttgtaactgtttcatagaagagccc

SEQ ID NO: 625203 - DNA, 25 bp, Homo sapien
tttacatgaagcatccagaaaagat

SEQ ID NO: 625204 - DNA, 25 bp, Homo sapien
cagaaaagataaacgtatagggaca

SEQ ID NO: 625205 - DNA, 25 bp, Homo sapien
tagactaatgtttgcaaagggctgg

SEQ ID NO: 625206 - DNA, 25 bp, Homo sapien
agactaatgtttgcaaagggctggg

SEQ ID NO: 625207 - DNA, 25 bp, Homo sapien
ctaatgtttgcaaagggctggggct

SEQ ID NO: 625208 - DNA, 25 bp, Homo sapien
ggctgaaagctggtagtgactgcta

SEQ ID NO: 625209 - DNA, 25 bp, Homo sapien
actgctaatgggagtgagggatctt

SEQ ID NO: 625210 - DNA, 25 bp, Homo sapien
agtgagggatcttgcagtgatggaa

SEQ ID NO: 625211 - DNA, 25 bp, Homo sapien
gatggctgcacaactcagtaaatgg

SEQ ID NO: 625212 - DNA, 25 bp, Homo sapien
ggctgcacaactcagtaaatggact

SEQ ID NO: 625213 - DNA, 25 bp, Homo sapien
gcacaactcagtaaatggactaaaa

SEQ ID NO: 625214 - DNA, 25 bp, Homo sapien
aacctagtaatagtccatttgccta

SEQ ID NO: 625215 - DNA, 25 bp, Homo sapien
aatagtccatttgcctagaggaaat

SEQ ID NO: 625216 - DNA, 25 bp, Homo sapien
gaaataatgtgctccctgaaagatg

SEQ ID NO: 625217 - DNA, 25 bp, Homo sapien
atgtgctccctgaaagatgactatt

SEQ ID NO: 625218 - DNA, 25 bp, Homo sapien
gctccctgaaagatgactattctag

SEQ ID NO: 625219 - DNA, 25 bp, Homo sapien
aatagtattgtttgtctcatatgca

SEQ ID NO: 625220 - DNA, 25 bp, Homo sapien
tgtttgtctcatatgcattatttgc

SEQ ID NO: 625221 - DNA, 25 bp, Homo sapien
ttgtcctcagagatttccaatggtg

SEQ ID NO: 625222 - DNA, 25 bp, Homo sapien
gatttccaatggtgaatttactggt

SEQ ID NO: 625223 - DNA, 25 bp, Homo sapien
gaatttactggtatactaagtgatt

SEQ ID NO: 625224 - DNA, 25 bp, Homo sapien
tatgataagaaagtctgtcacagtg

SEQ ID NO: 625225 - DNA, 25 bp, Homo sapien
cggtcaaatgaatggagaaatcaaa

SEQ ID NO: 625226 - DNA, 25 bp, Homo sapien
tgaatggagaaatcaaaggcgggac

SEQ ID NO: 625227 - DNA, 25 bp, Homo sapien
gaatggagaaatcaaaggcgggaca

SEQ ID NO: 625228 - DNA, 25 bp, Homo sapien
aatggagaaatcaaaggcgggacag

SEQ ID NO: 625229 - DNA, 25 bp, Homo sapien
atggagaaatcaaaggcgggacagg

SEQ ID NO: 625230 - DNA, 25 bp, Homo sapien
tggagaaatcaaaggcgggacaggc

SEQ ID NO: 625231 - DNA, 25 bp, Homo sapien
ggagaaatcaaaggcgggacaggcc

SEQ ID NO: 625232 - DNA, 25 bp, Homo sapien
aatcaaaggcgggacaggccgggcg

SEQ ID NO: 625233 - DNA, 25 bp, Homo sapien
atcaaaggcgggacaggccgggcgt

SEQ ID NO: 625234 - DNA, 25 bp, Homo sapien
tcaaaggcgggacaggccgggcgtg

SEQ ID NO: 625235 - DNA, 25 bp, Homo sapien
caaaggcgggacaggccgggcgtgg

SEQ ID NO: 625236 - DNA, 25 bp, Homo sapien
catgagtattactatcaaggtcaca

SEQ ID NO: 625237 - DNA, 25 bp, Homo sapien
actatcaaggtcacatttttcatct

SEQ ID NO: 625238 - DNA, 25 bp, Homo sapien
tttcatctagtatgttttaccctgg

SEQ ID NO: 625239 - DNA, 25 bp, Homo sapien
gttttaccctggtacttgttggcag

SEQ ID NO: 625240 - DNA, 25 bp, Homo sapien
gtacttgttggcagggtcaggacta

SEQ ID NO: 625241 - DNA, 25 bp, Homo sapien
gtcaggactaaggtgagatgcgcaa

SEQ ID NO: 625242 - DNA, 25 bp, Homo sapien
gtgagatgcgcaaggcatttgcctc

SEQ ID NO: 625243 - DNA, 25 bp, Homo sapien
gcgcaaggcatttgcctcacacaaa

SEQ ID NO: 625244 - DNA, 25 bp, Homo sapien
catttgcctcacacaaaatgcacaa

SEQ ID NO: 625245 - DNA, 25 bp, Homo sapien
gaatcactaaaagtactttgccata

SEQ ID NO: 625246 - DNA, 25 bp, Homo sapien
aattttgatctcttgttcattgtag

SEQ ID NO: 625247 - DNA, 25 bp, Homo sapien
cgagacatcgatgtcggccttgggc

SEQ ID NO: 625248 - DNA, 25 bp, Homo sapien
gggcaggctcacatccacatctgga

SEQ ID NO: 625249 - DNA, 25 bp, Homo sapien
ggaccttctcctttgaagccaggca

SEQ ID NO: 625250 - DNA, 25 bp, Homo sapien
gcattttcaccttgggcatcttcag

SEQ ID NO: 625251 - DNA, 25 bp, Homo sapien
tgggccatgaacatccacatcaggg

SEQ ID NO: 625252 - DNA, 25 bp, Homo sapien
ggtgttgatgtccacttttgggccc

SEQ ID NO: 625253 - DNA, 25 bp, Homo sapien
ttttgggcccttgatgtcagcttct

SEQ ID NO: 625254 - DNA, 25 bp, Homo sapien
ttgaggtcaccttccactttaggaa

SEQ ID NO: 625255 - DNA, 25 bp, Homo sapien
ggaagggtaacatccacatcaccct

SEQ ID NO: 625256 - DNA, 25 bp, Homo sapien
acatcacccttcactttgggtcctt

SEQ ID NO: 625257 - DNA, 25 bp, Homo sapien
ggtcctttcaggtttaagtcaatat

SEQ ID NO: 625258 - DNA, 25 bp, Homo sapien
atcattgtgggtgctctatgctcat

SEQ ID NO: 625259 - DNA, 25 bp, Homo sapien
tgctctatgctcatccactcaaggg

SEQ ID NO: 625260 - DNA, 25 bp, Homo sapien
ctgcagctgaaactggatctcctga

SEQ ID NO: 625261 - DNA, 25 bp, Homo sapien
actggatctcctgaaggtgatttca

SEQ ID NO: 625262 - DNA, 25 bp, Homo sapien
ggtgatttcaagtcctcctttgaga

SEQ ID NO: 625263 - DNA, 25 bp, Homo sapien
ttgagattggcttccctgtggatat

SEQ ID NO: 625264 - DNA, 25 bp, Homo sapien
tccctgtggatatgcaccaagcgat

SEQ ID NO: 625265 - DNA, 25 bp, Homo sapien
accaagcgatccacatttgctcagg

SEQ ID NO: 625266 - DNA, 25 bp, Homo sapien
ttgctcaggcatttgtattcatgta

SEQ ID NO: 625267 - DNA, 25 bp, Homo sapien
gtggcaggcagtaccctgtattagg

SEQ ID NO: 625268 - DNA, 25 bp, Homo sapien
aggtagcgtcaggtgctgtaacaaa

SEQ ID NO: 625269 - DNA, 25 bp, Homo sapien
gccaagccatttagatacctgatac

SEQ ID NO: 625270 - DNA, 25 bp, Homo sapien
atcaggtatctaactttgacattcc

SEQ ID NO: 625271 - DNA, 25 bp, Homo sapien
ttgacattcctagagctgaccaatt

SEQ ID NO: 625272 - DNA, 25 bp, Homo sapien
gaccaattttggcattaactgagta

SEQ ID NO: 625273 - DNA, 25 bp, Homo sapien
attaactgagtaaaatgcgcctgtg

SEQ ID NO: 625274 - DNA, 25 bp, Homo sapien
aatgcgcctgtgaattacctgttag

SEQ ID NO: 625275 - DNA, 25 bp, Homo sapien
ggaggacagcaaacctggcatcaat

SEQ ID NO: 625276 - DNA, 25 bp, Homo sapien
gatgatcgagagtcacactggtgat

SEQ ID NO: 625277 - DNA, 25 bp, Homo sapien
atttgcactctgaaatgacttcaac

SEQ ID NO: 625278 - DNA, 25 bp, Homo sapien
attatgttcttcttatgtgcagttg

SEQ ID NO: 625279 - DNA, 25 bp, Homo sapien
atgtgcagttgaatccactctgtga

SEQ ID NO: 625280 - DNA, 25 bp, Homo sapien
gagatccccattggcatctaccgga

SEQ ID NO: 625281 - DNA, 25 bp, Homo sapien
cccattggcatctaccggacagaga

SEQ ID NO: 625282 - DNA, 25 bp, Homo sapien
cattggcatctaccggacagagagc

SEQ ID NO: 625283 - DNA, 25 bp, Homo sapien
gcatctaccggacagagagccacgt

SEQ ID NO: 625284 - DNA, 25 bp, Homo sapien
taccggacagagagccacgtcttct

SEQ ID NO: 625285 - DNA, 25 bp, Homo sapien
ggacagagagccacgtcttctccac

SEQ ID NO: 625286 - DNA, 25 bp, Homo sapien
agtcccagatctcggtgaacgtgga

SEQ ID NO: 625287 - DNA, 25 bp, Homo sapien
cagatctcggtgaacgtggaggact

SEQ ID NO: 625288 - DNA, 25 bp, Homo sapien
gactgtgaggacacacgggaagtga

SEQ ID NO: 625289 - DNA, 25 bp, Homo sapien
gagcacccactgctacggcgcaaga

SEQ ID NO: 625290 - DNA, 25 bp, Homo sapien
tgctacggcgcaagagcctgcagtg

SEQ ID NO: 625291 - DNA, 25 bp, Homo sapien
gggtactgggtcactgcttaagacc

SEQ ID NO: 625292 - DNA, 25 bp, Homo sapien
gtactgggtcactgcttaagacctg

SEQ ID NO: 625293 - DNA, 25 bp, Homo sapien
ctgggtcactgcttaagacctggac

SEQ ID NO: 625294 - DNA, 25 bp, Homo sapien
tcactgcttaagacctggaccggga

SEQ ID NO: 625295 - DNA, 25 bp, Homo sapien
tgcttaagacctggaccgggagaag

SEQ ID NO: 625296 - DNA, 25 bp, Homo sapien
aaggaggcggcattttcagcgcata

SEQ ID NO: 625297 - DNA, 25 bp, Homo sapien
gaggcggcattttcagcgcataaca

SEQ ID NO: 625298 - DNA, 25 bp, Homo sapien
ggcggcattttcagcgcataacagt

SEQ ID NO: 625299 - DNA, 25 bp, Homo sapien
gcattttcagcgcataacagtgcac

SEQ ID NO: 625300 - DNA, 25 bp, Homo sapien
cattttcagcgcataacagtgcact

SEQ ID NO: 625301 - DNA, 25 bp, Homo sapien
gcgcataacagtgcactgcaggttg

SEQ ID NO: 625302 - DNA, 25 bp, Homo sapien
acaatagcgaacctccatctcaaat

SEQ ID NO: 625303 - DNA, 25 bp, Homo sapien
aaaatgcctacacgctctttaaaat

SEQ ID NO: 625304 - DNA, 25 bp, Homo sapien
tgcctacacgctctttaaaatgcaa

SEQ ID NO: 625305 - DNA, 25 bp, Homo sapien
aatgcaaggctttctcttaaattag

SEQ ID NO: 625306 - DNA, 25 bp, Homo sapien
ctttctcttaaattagcctaactga

SEQ ID NO: 625307 - DNA, 25 bp, Homo sapien
ttagcctaactgaactgcgttgagc

SEQ ID NO: 625308 - DNA, 25 bp, Homo sapien
taactgaactgcgttgagctgcttc

SEQ ID NO: 625309 - DNA, 25 bp, Homo sapien
gaactgcgttgagctgcttcaactt

SEQ ID NO: 625310 - DNA, 25 bp, Homo sapien
gcgttgagctgcttcaactttggaa

SEQ ID NO: 625311 - DNA, 25 bp, Homo sapien
gaatatatgtttgccaatctccttg

SEQ ID NO: 625312 - DNA, 25 bp, Homo sapien
tatgtttgccaatctccttgttttc

SEQ ID NO: 625313 - DNA, 25 bp, Homo sapien
tatctgtaaaaacaccttgcgatgt

SEQ ID NO: 625314 - DNA, 25 bp, Homo sapien
ccttgcgatgtgtggattcagttca

SEQ ID NO: 625315 - DNA, 25 bp, Homo sapien
gattcagttcacagagctaaacctt

SEQ ID NO: 625316 - DNA, 25 bp, Homo sapien
cagttcacagagctaaacctttttt

SEQ ID NO: 625317 - DNA, 25 bp, Homo sapien
gttcagccagttggaaacacatttt

SEQ ID NO: 625318 - DNA, 25 bp, Homo sapien
aaacacatttttgtagaatctatga

SEQ ID NO: 625319 - DNA, 25 bp, Homo sapien
gattatttcagaatccattgaactc

SEQ ID NO: 625320 - DNA, 25 bp, Homo sapien
gtgatgcatggattcatttctcaga

SEQ ID NO: 625321 - DNA, 25 bp, Homo sapien
attcagcctgttggaaacatccttt

SEQ ID NO: 625322 - DNA, 25 bp, Homo sapien
ttcaaagcccattgatgccagtagt

SEQ ID NO: 625323 - DNA, 25 bp, Homo sapien
gcccattgatgccagtagtgaaaaa

SEQ ID NO: 625324 - DNA, 25 bp, Homo sapien
cccagtagttgaaaatcaattcata

SEQ ID NO: 625325 - DNA, 25 bp, Homo sapien
ccagtagttgaaaatcaattcataa

SEQ ID NO: 625326 - DNA, 25 bp, Homo sapien
cagtagttgaaaatcaattcataac

SEQ ID NO: 625327 - DNA, 25 bp, Homo sapien
agtagttgaaaatcaattcataact

SEQ ID NO: 625328 - DNA, 25 bp, Homo sapien
gtagttgaaaatcaattcataactt

SEQ ID NO: 625329 - DNA, 25 bp, Homo sapien
tagttgaaaatcaattcataactta

SEQ ID NO: 625330 - DNA, 25 bp, Homo sapien
agttgaaaatcaattcataacttag

SEQ ID NO: 625331 - DNA, 25 bp, Homo sapien
gttgaaaatcaattcataacttaga

SEQ ID NO: 625332 - DNA, 25 bp, Homo sapien
ttgaaaatcaattcataacttagaa

SEQ ID NO: 625333 - DNA, 25 bp, Homo sapien
tgaaaatcaattcataacttagaaa

SEQ ID NO: 625334 - DNA, 25 bp, Homo sapien
gaaaatcaattcataacttagaaac

SEQ ID NO: 625335 - DNA, 25 bp, Homo sapien
tattaaccagttagtctcttcatta

SEQ ID NO: 625336 - DNA, 25 bp, Homo sapien
taaccagttagtctcttcattaaag

SEQ ID NO: 625337 - DNA, 25 bp, Homo sapien
ataatatcattctaaagttctcaaa

SEQ ID NO: 625338 - DNA, 25 bp, Homo sapien
tattcaagagtgcttctgagggcct

SEQ ID NO: 625339 - DNA, 25 bp, Homo sapien
ttcaagagtgcttctgagggccttc

SEQ ID NO: 625340 - DNA, 25 bp, Homo sapien
agagtgcttctgagggccttctcca

SEQ ID NO: 625341 - DNA, 25 bp, Homo sapien
gagtgcttctgagggccttctccat

SEQ ID NO: 625342 - DNA, 25 bp, Homo sapien
acctccttaaagatacaatattcca

SEQ ID NO: 625343 - DNA, 25 bp, Homo sapien
agatacaatattccaggattttgca

SEQ ID NO: 625344 - DNA, 25 bp, Homo sapien
tgactttaagttgtcatagtcagac

SEQ ID NO: 625345 - DNA, 25 bp, Homo sapien
tgtcatagtcagacacaattgacaa

SEQ ID NO: 625346 - DNA, 25 bp, Homo sapien
gaaaagataaatagtctgggtgcgg

SEQ ID NO: 625347 - DNA, 25 bp, Homo sapien
aaaagataaatagtctgggtgcggt

SEQ ID NO: 625348 - DNA, 25 bp, Homo sapien
aaagataaatagtctgggtgcggtg

SEQ ID NO: 625349 - DNA, 25 bp, Homo sapien
aagataaatagtctgggtgcggtgg

SEQ ID NO: 625350 - DNA, 25 bp, Homo sapien
agataaatagtctgggtgcggtggc

SEQ ID NO: 625351 - DNA, 25 bp, Homo sapien
gataaatagtctgggtgcggtggct

SEQ ID NO: 625352 - DNA, 25 bp, Homo sapien
ataaatagtctgggtgcggtggctg

SEQ ID NO: 625353 - DNA, 25 bp, Homo sapien
aaatagtctgggtgcggtggctgat

SEQ ID NO: 625354 - DNA, 25 bp, Homo sapien
aatagtctgggtgcggtggctgatg

SEQ ID NO: 625355 - DNA, 25 bp, Homo sapien
atagtctgggtgcggtggctgatgc

SEQ ID NO: 625356 - DNA, 25 bp, Homo sapien
agctacttgggagcttgggaggctg

SEQ ID NO: 625357 - DNA, 25 bp, Homo sapien
gcaagtagcgaatttactgttaggt

SEQ ID NO: 625358 - DNA, 25 bp, Homo sapien
gggaggtaagctgtccaccatctta

SEQ ID NO: 625359 - DNA, 25 bp, Homo sapien
aagctgtccaccatcttagggaggg

SEQ ID NO: 625360 - DNA, 25 bp, Homo sapien
tagcacgctcccaggcttgagggca

SEQ ID NO: 625361 - DNA, 25 bp, Homo sapien
gagggcaggaattcacgtcttcaga

SEQ ID NO: 625362 - DNA, 25 bp, Homo sapien
aattcacgtcttcagaaccgacatg

SEQ ID NO: 625363 - DNA, 25 bp, Homo sapien
aaccgacatgaaatggtgtggccct

SEQ ID NO: 625364 - DNA, 25 bp, Homo sapien
tgtggccctgtgactacacactttg

SEQ ID NO: 625365 - DNA, 25 bp, Homo sapien
ttgatggtgggtgcataggctctct

SEQ ID NO: 625366 - DNA, 25 bp, Homo sapien
ggtgcataggctctcttcaagcaaa

SEQ ID NO: 625367 - DNA, 25 bp, Homo sapien
ggctctcttcaagcaaattctttaa

SEQ ID NO: 625368 - DNA, 25 bp, Homo sapien
agaaaagccttctgtgcccaggcta

SEQ ID NO: 625369 - DNA, 25 bp, Homo sapien
aggctaaagctgttacatttccaca

SEQ ID NO: 625370 - DNA, 25 bp, Homo sapien
gctgttacatttccacagtgtggat

SEQ ID NO: 625371 - DNA, 25 bp, Homo sapien
gtggatgcagtcagaatccctgcac

SEQ ID NO: 625372 - DNA, 25 bp, Homo sapien
aatccctgcacattctggtcataag

SEQ ID NO: 625373 - DNA, 25 bp, Homo sapien
gtcataaggattagagtcaccagat

SEQ ID NO: 625374 - DNA, 25 bp, Homo sapien
agtcaccagatgaggctctaaacag

SEQ ID NO: 625375 - DNA, 25 bp, Homo sapien
gaggctctaaacagatcgcatccct

SEQ ID NO: 625376 - DNA, 25 bp, Homo sapien
taaacagatcgcatcccttggaatt

SEQ ID NO: 625377 - DNA, 25 bp, Homo sapien
gcatcccttggaattagaaagcagt

SEQ ID NO: 625378 - DNA, 25 bp, Homo sapien
cctgtgatcggcacttcggaaggcc

SEQ ID NO: 625379 - DNA, 25 bp, Homo sapien
gaatctgagacgattgcattgtcta

SEQ ID NO: 625380 - DNA, 25 bp, Homo sapien
gcattgtctaaacagtggaattgca

SEQ ID NO: 625381 - DNA, 25 bp, Homo sapien
gtttactttccatagatctggtctg

SEQ ID NO: 625382 - DNA, 25 bp, Homo sapien
gatctggtctgatggaatgttccta

SEQ ID NO: 625383 - DNA, 25 bp, Homo sapien
gaatgttcctactgtgcaactgcat

SEQ ID NO: 625384 - DNA, 25 bp, Homo sapien
gtgcaactgcataacaatatgtggt

SEQ ID NO: 625385 - DNA, 25 bp, Homo sapien
caatatgtggttaaaacttcctagg

SEQ ID NO: 625386 - DNA, 25 bp, Homo sapien
ttgaatgtagattggtatcacctcc

SEQ ID NO: 625387 - DNA, 25 bp, Homo sapien
ttggtatcacctccaactcctagtg

SEQ ID NO: 625388 - DNA, 25 bp, Homo sapien
caactcctagtgcttagtggtcaaa

SEQ ID NO: 625389 - DNA, 25 bp, Homo sapien
gttgaaaacctttccaatactatga

SEQ ID NO: 625390 - DNA, 25 bp, Homo sapien
atgcaacagatgagtgaccaccgct

SEQ ID NO: 625391 - DNA, 25 bp, Homo sapien
aacagatgagtgaccaccgctacga

SEQ ID NO: 625392 - DNA, 25 bp, Homo sapien
gatgagtgaccaccgctacgacaaa

SEQ ID NO: 625393 - DNA, 25 bp, Homo sapien
agtgaccaccgctacgacaaactca

SEQ ID NO: 625394 - DNA, 25 bp, Homo sapien
aactcactgtgcctgatgacatagc

SEQ ID NO: 625395 - DNA, 25 bp, Homo sapien
actgtgcctgatgacatagcagcaa

SEQ ID NO: 625396 - DNA, 25 bp, Homo sapien
gcctgatgacatagcagcaaactgt

SEQ ID NO: 625397 - DNA, 25 bp, Homo sapien
gacatagcagcaaactgtatatatc

SEQ ID NO: 625398 - DNA, 25 bp, Homo sapien
gtatatatctaaatatccccaacaa

SEQ ID NO: 625399 - DNA, 25 bp, Homo sapien
tatccccaacaaagggcacgtcttg

SEQ ID NO: 625400 - DNA, 25 bp, Homo sapien
aaagggcacgtcttgctgcaccgaa

SEQ ID NO: 625401 - DNA, 25 bp, Homo sapien
atttttctttggactagttcagtca

SEQ ID NO: 625402 - DNA, 25 bp, Homo sapien
ggaaaacggagactgtcaaagatct

SEQ ID NO: 625403 - DNA, 25 bp, Homo sapien
aaacggagactgtcaaagatctagc

SEQ ID NO: 625404 - DNA, 25 bp, Homo sapien
aaagatctagcaaaatccttaggca

SEQ ID NO: 625405 - DNA, 25 bp, Homo sapien
gatctagcaaaatccttaggcaaac

SEQ ID NO: 625406 - DNA, 25 bp, Homo sapien
aaatccttaggcaaacattgtgtgg

SEQ ID NO: 625407 - DNA, 25 bp, Homo sapien
ccttaggcaaacattgtgtggtctt

SEQ ID NO: 625408 - DNA, 25 bp, Homo sapien
aggcaaacattgtgtggtcttcaac

SEQ ID NO: 625409 - DNA, 25 bp, Homo sapien
tgtggtcttcaactgttttgaggat

SEQ ID NO: 625410 - DNA, 25 bp, Homo sapien
ggtcttcaactgttttgaggatttg

SEQ ID NO: 625411 - DNA, 25 bp, Homo sapien
tcaactgttttgaggatttggatta

SEQ ID NO: 625412 - DNA, 25 bp, Homo sapien
ccctcagctgcatctgaggtttctt

SEQ ID NO: 625413 - DNA, 25 bp, Homo sapien
cctcagctgcatctgaggtttcttc

SEQ ID NO: 625414 - DNA, 25 bp, Homo sapien
ctcagctgcatctgaggtttcttct

SEQ ID NO: 625415 - DNA, 25 bp, Homo sapien
tcagctgcatctgaggtttcttctc

SEQ ID NO: 625416 - DNA, 25 bp, Homo sapien
cagctgcatctgaggtttcttctca

SEQ ID NO: 625417 - DNA, 25 bp, Homo sapien
agctgcatctgaggtttcttctcac

SEQ ID NO: 625418 - DNA, 25 bp, Homo sapien
gctgcatctgaggtttcttctcacc

SEQ ID NO: 625419 - DNA, 25 bp, Homo sapien
aaaatgaaacacaggccgggcatgg

SEQ ID NO: 625420 - DNA, 25 bp, Homo sapien
aaatgaaacacaggccgggcatggt

SEQ ID NO: 625421 - DNA, 25 bp, Homo sapien
aatgaaacacaggccgggcatggtg

SEQ ID NO: 625422 - DNA, 25 bp, Homo sapien
atgaaacacaggccgggcatggtgg

SEQ ID NO: 625423 - DNA, 25 bp, Homo sapien
gtcacgcatgcgaaagctttgggag

SEQ ID NO: 625424 - DNA, 25 bp, Homo sapien
aggctgcctcaggagacccgggaca

SEQ ID NO: 625425 - DNA, 25 bp, Homo sapien
ggacagctacggagaggattatttc

SEQ ID NO: 625426 - DNA, 25 bp, Homo sapien
ggattatttccgcatctatactgac

SEQ ID NO: 625427 - DNA, 25 bp, Homo sapien
aacataatgcaggtggcagagccca

SEQ ID NO: 625428 - DNA, 25 bp, Homo sapien
cagagcccagagtcagagatgtcat

SEQ ID NO: 625429 - DNA, 25 bp, Homo sapien
ggagcatgctattgtttcccggagc

SEQ ID NO: 625430 - DNA, 25 bp, Homo sapien
tacaaccctggcctggatgccaaac

SEQ ID NO: 625431 - DNA, 25 bp, Homo sapien
agttgcccacccctgtgacagattt

SEQ ID NO: 625432 - DNA, 25 bp, Homo sapien
gacagatttcatcctaagccggtac

SEQ ID NO: 625433 - DNA, 25 bp, Homo sapien
ggtaccttccaaggccagcggacag

SEQ ID NO: 625434 - DNA, 25 bp, Homo sapien
aaacatcctccaagatgaggccaca

SEQ ID NO: 625435 - DNA, 25 bp, Homo sapien
gggtgagccttcttaggagaaacac

SEQ ID NO: 625436 - DNA, 25 bp, Homo sapien
ggagaaacacctgccctaggagtcc

SEQ ID NO: 625437 - DNA, 25 bp, Homo sapien
tgccctaggagtcctgctctgagac

SEQ ID NO: 625438 - DNA, 25 bp, Homo sapien
tctgagactctctttgtacagaaat

SEQ ID NO: 625439 - DNA, 25 bp, Homo sapien
gaaattctctgcttacaaggtgcct

SEQ ID NO: 625440 - DNA, 25 bp, Homo sapien
gcaagaaaatgctggtcaagtgcaa

SEQ ID NO: 625441 - DNA, 25 bp, Homo sapien
tcaagtgcaaagtacctccggcggg

SEQ ID NO: 625442 - DNA, 25 bp, Homo sapien
cacccacaagtacgtctcacaaatt

SEQ ID NO: 625443 - DNA, 25 bp, Homo sapien
tttgcaggaacacaatgttggcttc

SEQ ID NO: 625444 - DNA, 25 bp, Homo sapien
acacaatgttggcttcaagttgaag

SEQ ID NO: 625445 - DNA, 25 bp, Homo sapien
gggatcttgacgaagcagtcgttca

SEQ ID NO: 625446 - DNA, 25 bp, Homo sapien
cgaagcagtcgttcagcgagaggtt

SEQ ID NO: 625447 - DNA, 25 bp, Homo sapien
gaggttgtggcggatgctgttctgc

SEQ ID NO: 625448 - DNA, 25 bp, Homo sapien
aagcggtcactaatgaaggcgcaga

SEQ ID NO: 625449 - DNA, 25 bp, Homo sapien
agatgccgctgagcgtgaggcgctt

SEQ ID NO: 625450 - DNA, 25 bp, Homo sapien
tgtgcgggctttgcaggatggccat

SEQ ID NO: 625451 - DNA, 25 bp, Homo sapien
ccatggtgatgagcgcgatgtacga

SEQ ID NO: 625452 - DNA, 25 bp, Homo sapien
gaaagctgccattgtcgaacatgtc

SEQ ID NO: 625453 - DNA, 25 bp, Homo sapien
agctgccattgtcgaacatgtcctg

SEQ ID NO: 625454 - DNA, 25 bp, Homo sapien
attgtcgaacatgtcctgggaggcg

SEQ ID NO: 625455 - DNA, 25 bp, Homo sapien
tccaggctccagtagttgcccttgc

SEQ ID NO: 625456 - DNA, 25 bp, Homo sapien
cgcccagccaatattttcaaggctg

SEQ ID NO: 625457 - DNA, 25 bp, Homo sapien
tattttcaaggctgtgcaaccatca

SEQ ID NO: 625458 - DNA, 25 bp, Homo sapien
aaccccatacttactagcattcgct

SEQ ID NO: 625459 - DNA, 25 bp, Homo sapien
tacttactagcattcgcttcgcatt

SEQ ID NO: 625460 - DNA, 25 bp, Homo sapien
tagcattcgcttcgcatttccctct

SEQ ID NO: 625461 - DNA, 25 bp, Homo sapien
cagccctaagcaactgctaatcttt

SEQ ID NO: 625462 - DNA, 25 bp, Homo sapien
aagcaactgctaatctttctttccc

SEQ ID NO: 625463 - DNA, 25 bp, Homo sapien
tgctaatctttctttccctatcaat

SEQ ID NO: 625464 - DNA, 25 bp, Homo sapien
atctttctttccctatcaatttgtc

SEQ ID NO: 625465 - DNA, 25 bp, Homo sapien
tctttccctatcaatttgtccattc

SEQ ID NO: 625466 - DNA, 25 bp, Homo sapien
ccctatcaatttgtccattctggat

SEQ ID NO: 625467 - DNA, 25 bp, Homo sapien
aaaaatatagaaactagctgggcat

SEQ ID NO: 625468 - DNA, 25 bp, Homo sapien
aaatatagaaactagctgggcatgg

SEQ ID NO: 625469 - DNA, 25 bp, Homo sapien
aatatagaaactagctgggcatggt

SEQ ID NO: 625470 - DNA, 25 bp, Homo sapien
atatagaaactagctgggcatggtg

SEQ ID NO: 625471 - DNA, 25 bp, Homo sapien
gtgcaacagagaaagactccgtttc

SEQ ID NO: 625472 - DNA, 25 bp, Homo sapien
tgcaacagagaaagactccgtttca

SEQ ID NO: 625473 - DNA, 25 bp, Homo sapien
gcaacagagaaagactccgtttcaa

SEQ ID NO: 625474 - DNA, 25 bp, Homo sapien
caacagagaaagactccgtttcaaa

SEQ ID NO: 625475 - DNA, 25 bp, Homo sapien
acagagaaagactccgtttcaaaag

SEQ ID NO: 625476 - DNA, 25 bp, Homo sapien
cagagaaagactccgtttcaaaaga

SEQ ID NO: 625477 - DNA, 25 bp, Homo sapien
gagaaagactccgtttcaaaagaga

SEQ ID NO: 625478 - DNA, 25 bp, Homo sapien
aggcatgatggcaggcacctctaat

SEQ ID NO: 625479 - DNA, 25 bp, Homo sapien
ggcatgatggcaggcacctctaatc

SEQ ID NO: 625480 - DNA, 25 bp, Homo sapien
gcatgatggcaggcacctctaatcc

SEQ ID NO: 625481 - DNA, 25 bp, Homo sapien
catgatggcaggcacctctaatccc

SEQ ID NO: 625482 - DNA, 25 bp, Homo sapien
tgagctgacagcgtgccactctact

SEQ ID NO: 625483 - DNA, 25 bp, Homo sapien
gagctgacagcgtgccactctactc

SEQ ID NO: 625484 - DNA, 25 bp, Homo sapien
agctgacagcgtgccactctactcc

SEQ ID NO: 625485 - DNA, 25 bp, Homo sapien
gctgacagcgtgccactctactcca

SEQ ID NO: 625486 - DNA, 25 bp, Homo sapien
ctgacagcgtgccactctactccag

SEQ ID NO: 625487 - DNA, 25 bp, Homo sapien
tctactccagccttggtgatagagt

SEQ ID NO: 625488 - DNA, 25 bp, Homo sapien
gccttggtgatagagtgagactcca

SEQ ID NO: 625489 - DNA, 25 bp, Homo sapien
gcacctggacaagaacacaagggtg

SEQ ID NO: 625490 - DNA, 25 bp, Homo sapien
acaagggtggcttagtgggtgacca

SEQ ID NO: 625491 - DNA, 25 bp, Homo sapien
tacctgtggagccacagctgcctca

SEQ ID NO: 625492 - DNA, 25 bp, Homo sapien
ttcccaagacccaggatcatgtacc

SEQ ID NO: 625493 - DNA, 25 bp, Homo sapien
aagacccaggatcatgtacccgagc

SEQ ID NO: 625494 - DNA, 25 bp, Homo sapien
caggatcatgtacccgagcctactc

SEQ ID NO: 625495 - DNA, 25 bp, Homo sapien
ggacatagaactcggcactggctcg

SEQ ID NO: 625496 - DNA, 25 bp, Homo sapien
actggctcggccagcactggtctca

SEQ ID NO: 625497 - DNA, 25 bp, Homo sapien
agcactggtctcatttcgggcgatg

SEQ ID NO: 625498 - DNA, 25 bp, Homo sapien
atttcgggcgatgcccaacagcagg

SEQ ID NO: 625499 - DNA, 25 bp, Homo sapien
gggaggtcccacctatcaatgccac

SEQ ID NO: 625500 - DNA, 25 bp, Homo sapien
accatctattgaaaaccgtctacag

SEQ ID NO: 625501 - DNA, 25 bp, Homo sapien
aaccgtctacagataagtgctttgt

SEQ ID NO: 625502 - DNA, 25 bp, Homo sapien
agaaatattaacttcatctcagtaa

SEQ ID NO: 625503 - DNA, 25 bp, Homo sapien
atctcagtaaaatggaaggcttgcc

SEQ ID NO: 625504 - DNA, 25 bp, Homo sapien
atgtttctcctgtggctttgactac

SEQ ID NO: 625505 - DNA, 25 bp, Homo sapien
tgtggctttgactactcctggcaca

SEQ ID NO: 625506 - DNA, 25 bp, Homo sapien
tactcctggcacattgtacctgcaa

SEQ ID NO: 625507 - DNA, 25 bp, Homo sapien
gcacattgtacctgcaacttccctg

SEQ ID NO: 625508 - DNA, 25 bp, Homo sapien
accctgaggcacaaagactccagtt

SEQ ID NO: 625509 - DNA, 25 bp, Homo sapien
caagttgctttaatatctgttaaca

SEQ ID NO: 625510 - DNA, 25 bp, Homo sapien
gcaagttatagttatgggctggtaa

SEQ ID NO: 625511 - DNA, 25 bp, Homo sapien
tggctttccgctcggtcagctgagc

SEQ ID NO: 625512 - DNA, 25 bp, Homo sapien
tcagctgagccgcacaagcagcagt

SEQ ID NO: 625513 - DNA, 25 bp, Homo sapien
agccgcacaagcagcagtggcgctg

SEQ ID NO: 625514 - DNA, 25 bp, Homo sapien
ttttgcagttcccaccattgagggc

SEQ ID NO: 625515 - DNA, 25 bp, Homo sapien
cagttcccaccattgagggctgtaa

SEQ ID NO: 625516 - DNA, 25 bp, Homo sapien
agggctgtaacatttctctatttct

SEQ ID NO: 625517 - DNA, 25 bp, Homo sapien
tctggcttagaatgtgtgtaggatg

SEQ ID NO: 625518 - DNA, 25 bp, Homo sapien
tattcagcattcattccgctcacgc

SEQ ID NO: 625519 - DNA, 25 bp, Homo sapien
acaccaggctctgcgtgcggtgctg

SEQ ID NO: 625520 - DNA, 25 bp, Homo sapien
aggactccgcttctcagctgtaggg

SEQ ID NO: 625521 - DNA, 25 bp, Homo sapien
ttctcagctgtagggctcagggtgc

SEQ ID NO: 625522 - DNA, 25 bp, Homo sapien
ttcacacatttgtcaagcacagttg

SEQ ID NO: 625523 - DNA, 25 bp, Homo sapien
taaagtccaaaacattcatttcacc

SEQ ID NO: 625524 - DNA, 25 bp, Homo sapien
atttcacctgcttgctaatgtgtat

SEQ ID NO: 625525 - DNA, 25 bp, Homo sapien
aatgtgtattagtcctgttaatggc

SEQ ID NO: 625526 - DNA, 25 bp, Homo sapien
agtcctgttaatggcattttccaac

SEQ ID NO: 625527 - DNA, 25 bp, Homo sapien
gaaaagctatcacccatttaagagt

SEQ ID NO: 625528 - DNA, 25 bp, Homo sapien
ggatcaaaccccagtaattttagca

SEQ ID NO: 625529 - DNA, 25 bp, Homo sapien
gaaatctctgcatgcacttttacat

SEQ ID NO: 625530 - DNA, 25 bp, Homo sapien
atatgtcacctctagtgtacacctc

SEQ ID NO: 625531 - DNA, 25 bp, Homo sapien
acctctagtgtacacctctgtatga

SEQ ID NO: 625532 - DNA, 25 bp, Homo sapien
gtatgatgacttatctttgctgttt

SEQ ID NO: 625533 - DNA, 25 bp, Homo sapien
gggctgcgtgtctgcagctcctcag

SEQ ID NO: 625534 - DNA, 25 bp, Homo sapien
tgcgtgtctgcagctcctcagggcg

SEQ ID NO: 625535 - DNA, 25 bp, Homo sapien
cccctggcagctgtactgtgggtgc

SEQ ID NO: 625536 - DNA, 25 bp, Homo sapien
ccacgtctagcatcatgcctggtat

SEQ ID NO: 625537 - DNA, 25 bp, Homo sapien
acgtctagcatcatgcctggtattg

SEQ ID NO: 625538 - DNA, 25 bp, Homo sapien
gtctagcatcatgcctggtattggg

SEQ ID NO: 625539 - DNA, 25 bp, Homo sapien
gggagggtgctacgtaaatctatac

SEQ ID NO: 625540 - DNA, 25 bp, Homo sapien
gggtgctacgtaaatctatactcaa

SEQ ID NO: 625541 - DNA, 25 bp, Homo sapien
gtaaatctatactcaagggctcctc

SEQ ID NO: 625542 - DNA, 25 bp, Homo sapien
aaatctatactcaagggctcctcag

SEQ ID NO: 625543 - DNA, 25 bp, Homo sapien
aatctatactcaagggctcctcaga

SEQ ID NO: 625544 - DNA, 25 bp, Homo sapien
ggagtagctatgaacacaattcgga

SEQ ID NO: 625545 - DNA, 25 bp, Homo sapien
aacacaattcggagtcttacctatt

SEQ ID NO: 625546 - DNA, 25 bp, Homo sapien
tcggagtcttacctattaagagaac

SEQ ID NO: 625547 - DNA, 25 bp, Homo sapien
gaacatgtatcagagttagattcct

SEQ ID NO: 625548 - DNA, 25 bp, Homo sapien
agagttagattcctctttccattct

SEQ ID NO: 625549 - DNA, 25 bp, Homo sapien
ctctttccattctgttctatcattg

SEQ ID NO: 625550 - DNA, 25 bp, Homo sapien
cattctgttctatcattgccatcag

SEQ ID NO: 625551 - DNA, 25 bp, Homo sapien
ttgccatcagatgtgcctcttcatt

SEQ ID NO: 625552 - DNA, 25 bp, Homo sapien
cattttcactttgaaacactgttaa

SEQ ID NO: 625553 - DNA, 25 bp, Homo sapien
gactgaaataaaaggcaatcttgct

SEQ ID NO: 625554 - DNA, 25 bp, Homo sapien
gaatatatcatatctccatcacctg

SEQ ID NO: 625555 - DNA, 25 bp, Homo sapien
aggagcagtggtcccccagtgacca

SEQ ID NO: 625556 - DNA, 25 bp, Homo sapien
cccagtgaccatctatcaataccat

SEQ ID NO: 625557 - DNA, 25 bp, Homo sapien
agtgaccatctatcaataccatttc

SEQ ID NO: 625558 - DNA, 25 bp, Homo sapien
agtacagacaggacttacccaagtt

SEQ ID NO: 625559 - DNA, 25 bp, Homo sapien
caggacttacccaagttatttgtag

SEQ ID NO: 625560 - DNA, 25 bp, Homo sapien
tatttgtagtttgtactggtaggaa

SEQ ID NO: 625561 - DNA, 25 bp, Homo sapien
attgcagtggcaataccctgaagtg

SEQ ID NO: 625562 - DNA, 25 bp, Homo sapien
gtggcaataccctgaagtggacaat

SEQ ID NO: 625563 - DNA, 25 bp, Homo sapien
taccctgaagtggacaatggaagat

SEQ ID NO: 625564 - DNA, 25 bp, Homo sapien
ggaagatccaagttatttgtcacat

SEQ ID NO: 625565 - DNA, 25 bp, Homo sapien
gatccaagttatttgtcacatttta

SEQ ID NO: 625566 - DNA, 25 bp, Homo sapien
aaatgtgcccacagatacagccttg

SEQ ID NO: 625567 - DNA, 25 bp, Homo sapien
gtgcccacagatacagccttgcaaa

SEQ ID NO: 625568 - DNA, 25 bp, Homo sapien
gttttaatgaagctacatctccatc

SEQ ID NO: 625569 - DNA, 25 bp, Homo sapien
catctccatcttgtgacttgtaaaa

SEQ ID NO: 625570 - DNA, 25 bp, Homo sapien
aaaggcattgctgtaaacgacttac

SEQ ID NO: 625571 - DNA, 25 bp, Homo sapien
acgacttacggatttcttgtgcttt

SEQ ID NO: 625572 - DNA, 25 bp, Homo sapien
tcttcagtatgaatgttaccgcttg

SEQ ID NO: 625573 - DNA, 25 bp, Homo sapien
ttaccgcttgacatttgcctttcag

SEQ ID NO: 625574 - DNA, 25 bp, Homo sapien
catttgcctttcaggtcgaatgaaa

SEQ ID NO: 625575 - DNA, 25 bp, Homo sapien
ggctggcactaatacacctattgat

SEQ ID NO: 625576 - DNA, 25 bp, Homo sapien
acctattgattgcaagttcctctcc

SEQ ID NO: 625577 - DNA, 25 bp, Homo sapien
tggaaccaagtttgccctcaagctc

SEQ ID NO: 625578 - DNA, 25 bp, Homo sapien
tcaagctctggctgcaacatctggg

SEQ ID NO: 625579 - DNA, 25 bp, Homo sapien
aagctctggctgcaacatctgggca

SEQ ID NO: 625580 - DNA, 25 bp, Homo sapien
ccccaccgtgtaaaagtgcagctta

SEQ ID NO: 625581 - DNA, 25 bp, Homo sapien
aaaagtgcagcttacctggacccag

SEQ ID NO: 625582 - DNA, 25 bp, Homo sapien
agtgcagcttacctggacccagggc

SEQ ID NO: 625583 - DNA, 25 bp, Homo sapien
agaatggaacatggaccctcttccc

SEQ ID NO: 625584 - DNA, 25 bp, Homo sapien
gtgaagtgtaaaatcccctccctag

SEQ ID NO: 625585 - DNA, 25 bp, Homo sapien
tgaagtgtaaaatcccctccctagc

SEQ ID NO: 625586 - DNA, 25 bp, Homo sapien
catctccatgacactcacagaacat

SEQ ID NO: 625587 - DNA, 25 bp, Homo sapien
aacataggtcctaggccttggcgag

SEQ ID NO: 625588 - DNA, 25 bp, Homo sapien
accagccacaacaacacgctacccc

SEQ ID NO: 625589 - DNA, 25 bp, Homo sapien
cccactccaccactcgggtataggg

SEQ ID NO: 625590 - DNA, 25 bp, Homo sapien
cactccaccactcgggtataggggg

SEQ ID NO: 625591 - DNA, 25 bp, Homo sapien
tggcccggccactccgaaggcaggg

SEQ ID NO: 625592 - DNA, 25 bp, Homo sapien
ccggccactccgaaggcagggagga

SEQ ID NO: 625593 - DNA, 25 bp, Homo sapien
agggaggaggacttggcaactggct

SEQ ID NO: 625594 - DNA, 25 bp, Homo sapien
ggaggaggacttggcaactggcttt

SEQ ID NO: 625595 - DNA, 25 bp, Homo sapien
cgatgcgtgtctttcccacgcagag

SEQ ID NO: 625596 - DNA, 25 bp, Homo sapien
gatgcgtgtctttcccacgcagaga

SEQ ID NO: 625597 - DNA, 25 bp, Homo sapien
atgcgtgtctttcccacgcagagaa

SEQ ID NO: 625598 - DNA, 25 bp, Homo sapien
gcgtgtctttcccacgcagagaagc

SEQ ID NO: 625599 - DNA, 25 bp, Homo sapien
cctgtaacccaagtgccttgaacat

SEQ ID NO: 625600 - DNA, 25 bp, Homo sapien
acccaagtgccttgaacattgcctc

SEQ ID NO: 625601 - DNA, 25 bp, Homo sapien
ccaagtgccttgaacattgcctcat

SEQ ID NO: 625602 - DNA, 25 bp, Homo sapien
caagtgccttgaacattgcctcatt

SEQ ID NO: 625603 - DNA, 25 bp, Homo sapien
aagtgccttgaacattgcctcatta

SEQ ID NO: 625604 - DNA, 25 bp, Homo sapien
agtgccttgaacattgcctcattaa

SEQ ID NO: 625605 - DNA, 25 bp, Homo sapien
gtgccttgaacattgcctcattaat

SEQ ID NO: 625606 - DNA, 25 bp, Homo sapien
tgccttgaacattgcctcattaatt

SEQ ID NO: 625607 - DNA, 25 bp, Homo sapien
gccttgaacattgcctcattaattg

SEQ ID NO: 625608 - DNA, 25 bp, Homo sapien
agcatgggtgtggtcctgtatgtca

SEQ ID NO: 625609 - DNA, 25 bp, Homo sapien
gtcctgtatgtcatgctctgtgcca

SEQ ID NO: 625610 - DNA, 25 bp, Homo sapien
tctgtgccagcctaccttttgacga

SEQ ID NO: 625611 - DNA, 25 bp, Homo sapien
gcctaccttttgacgacacagacat

SEQ ID NO: 625612 - DNA, 25 bp, Homo sapien
tgacgacacagacatccccaagatg

SEQ ID NO: 625613 - DNA, 25 bp, Homo sapien
actcatctgagcatctcggccgatt

SEQ ID NO: 625614 - DNA, 25 bp, Homo sapien
gcatctcggccgattgccaggacct

SEQ ID NO: 625615 - DNA, 25 bp, Homo sapien
gaggctcctggaacccgatatgatc

SEQ ID NO: 625616 - DNA, 25 bp, Homo sapien
tggaacccgatatgatcctccggcc

SEQ ID NO: 625617 - DNA, 25 bp, Homo sapien
gatcctccggccttcaattgaagaa

SEQ ID NO: 625618 - DNA, 25 bp, Homo sapien
gcaatggcaagtgctctccaataaa

SEQ ID NO: 625619 - DNA, 25 bp, Homo sapien
gaagacaagcacttcaaagaggcag

SEQ ID NO: 625620 - DNA, 25 bp, Homo sapien
aagacaagcacttcaaagaggcagc

SEQ ID NO: 625621 - DNA, 25 bp, Homo sapien
agacaagcacttcaaagaggcagcg

SEQ ID NO: 625622 - DNA, 25 bp, Homo sapien
gacaagcacttcaaagaggcagcgt

SEQ ID NO: 625623 - DNA, 25 bp, Homo sapien
acaagcacttcaaagaggcagcgtc

SEQ ID NO: 625624 - DNA, 25 bp, Homo sapien
caagcacttcaaagaggcagcgtca

SEQ ID NO: 625625 - DNA, 25 bp, Homo sapien
aagcacttcaaagaggcagcgtcag

SEQ ID NO: 625626 - DNA, 25 bp, Homo sapien
agcacttcaaagaggcagcgtcagc

SEQ ID NO: 625627 - DNA, 25 bp, Homo sapien
acttcaaagaggcagcgtcagccag

SEQ ID NO: 625628 - DNA, 25 bp, Homo sapien
ttcaaagaggcagcgtcagccaggg

SEQ ID NO: 625629 - DNA, 25 bp, Homo sapien
agaggcagcgtcagccaggggcagt

SEQ ID NO: 625630 - DNA, 25 bp, Homo sapien
agagaaatttggactagctgtaaaa

SEQ ID NO: 625631 - DNA, 25 bp, Homo sapien
atccttgcagagtactgtgttgttg

SEQ ID NO: 625632 - DNA, 25 bp, Homo sapien
tactgtgttgttggtgctgtccatg

SEQ ID NO: 625633 - DNA, 25 bp, Homo sapien
tgtgttgttggtgctgtccatgctg

SEQ ID NO: 625634 - DNA, 25 bp, Homo sapien
gtccatgctgtagctcaaaataaag

SEQ ID NO: 625635 - DNA, 25 bp, Homo sapien
gaaatcaatatcactaaagcacaac

SEQ ID NO: 625636 - DNA, 25 bp, Homo sapien
aaagcacaactttcagagattgaac

SEQ ID NO: 625637 - DNA, 25 bp, Homo sapien
cacaaggaacttgttaatttggaga

SEQ ID NO: 625638 - DNA, 25 bp, Homo sapien
agggatcttttcattcagatatctc

SEQ ID NO: 625639 - DNA, 25 bp, Homo sapien
ttcattcagatatctcttttagtag

SEQ ID NO: 625640 - DNA, 25 bp, Homo sapien
ggaacaaggagagagcatcaataat

SEQ ID NO: 625641 - DNA, 25 bp, Homo sapien
cctgcaggacatgctctgcctggga

SEQ ID NO: 625642 - DNA, 25 bp, Homo sapien
gggtggctgtatccctgtcccacat

SEQ ID NO: 625643 - DNA, 25 bp, Homo sapien
gtatccctgtcccacatcagaaact

SEQ ID NO: 625644 - DNA, 25 bp, Homo sapien
tccctgtcccacatcagaaactgat

SEQ ID NO: 625645 - DNA, 25 bp, Homo sapien
ctgtcccacatcagaaactgatcct

SEQ ID NO: 625646 - DNA, 25 bp, Homo sapien
cagaaactgatcctcaggacttgaa

SEQ ID NO: 625647 - DNA, 25 bp, Homo sapien
agacctggagacaaagggcataatt

SEQ ID NO: 625648 - DNA, 25 bp, Homo sapien
cctggagacaaagggcataattgtt

SEQ ID NO: 625649 - DNA, 25 bp, Homo sapien
gggaaatggatgacagctgaagcta

SEQ ID NO: 625650 - DNA, 25 bp, Homo sapien
tgaagctattcatatggagccatat

SEQ ID NO: 625651 - DNA, 25 bp, Homo sapien
gctattcatatggagccatatactc

SEQ ID NO: 625652 - DNA, 25 bp, Homo sapien
tcaagctctggctgcaacatctggg

SEQ ID NO: 625653 - DNA, 25 bp, Homo sapien
aagctctggctgcaacatctgggca

SEQ ID NO: 625654 - DNA, 25 bp, Homo sapien
ccccaccgtgtaaaagtgcagctta

SEQ ID NO: 625655 - DNA, 25 bp, Homo sapien
caccgtgtaaaagtgcagcttacct

SEQ ID NO: 625656 - DNA, 25 bp, Homo sapien
gtaaaagtgcagcttacctggaccc

SEQ ID NO: 625657 - DNA, 25 bp, Homo sapien
aaaagtgcagcttacctggacccag

SEQ ID NO: 625658 - DNA, 25 bp, Homo sapien
aagtgcagcttacctggacccaggg

SEQ ID NO: 625659 - DNA, 25 bp, Homo sapien
agtgcagcttacctggacccagggc

SEQ ID NO: 625660 - DNA, 25 bp, Homo sapien
agaatggaacatggaccctcttccc

SEQ ID NO: 625661 - DNA, 25 bp, Homo sapien
gtgaagtgtaaaatcccctccctag

SEQ ID NO: 625662 - DNA, 25 bp, Homo sapien
tgaagtgtaaaatcccctccctagc

SEQ ID NO: 625663 - DNA, 25 bp, Homo sapien
aatgccagccacaggcacgcgcacg

SEQ ID NO: 625664 - DNA, 25 bp, Homo sapien
ccagccacaggcacgcgcacggctt

SEQ ID NO: 625665 - DNA, 25 bp, Homo sapien
ccacaggcacgcgcacggcttgcaa

SEQ ID NO: 625666 - DNA, 25 bp, Homo sapien
gcattcaacagcgaagcggcacagc

SEQ ID NO: 625667 - DNA, 25 bp, Homo sapien
cattcaacagcgaagcggcacagct

SEQ ID NO: 625668 - DNA, 25 bp, Homo sapien
attcaacagcgaagcggcacagctg

SEQ ID NO: 625669 - DNA, 25 bp, Homo sapien
ttcaacagcgaagcggcacagctgg

SEQ ID NO: 625670 - DNA, 25 bp, Homo sapien
tcaacagcgaagcggcacagctggt

SEQ ID NO: 625671 - DNA, 25 bp, Homo sapien
caacagcgaagcggcacagctggtt

SEQ ID NO: 625672 - DNA, 25 bp, Homo sapien
agctggtttccagaaccgtctcccg

SEQ ID NO: 625673 - DNA, 25 bp, Homo sapien
gctggtttccagaaccgtctcccgg

SEQ ID NO: 625674 - DNA, 25 bp, Homo sapien
ctgtggctcatgtgcattggcccca

SEQ ID NO: 625675 - DNA, 25 bp, Homo sapien
tgtggctcatgtgcattggccccat

SEQ ID NO: 625676 - DNA, 25 bp, Homo sapien
ctgcccagccgacgccaggcagagc

SEQ ID NO: 625677 - DNA, 25 bp, Homo sapien
ctcgtcttctctctacttaaattgt

SEQ ID NO: 625678 - DNA, 25 bp, Homo sapien
tcgtcttctctctacttaaattgtc

SEQ ID NO: 625679 - DNA, 25 bp, Homo sapien
cgtcttctctctacttaaattgtca

SEQ ID NO: 625680 - DNA, 25 bp, Homo sapien
gtcttctctctacttaaattgtcat

SEQ ID NO: 625681 - DNA, 25 bp, Homo sapien
ttctctctacttaaattgtcatcca

SEQ ID NO: 625682 - DNA, 25 bp, Homo sapien
tctacttaaattgtcatccaccagg

SEQ ID NO: 625683 - DNA, 25 bp, Homo sapien
ctacttaaattgtcatccaccaggt

SEQ ID NO: 625684 - DNA, 25 bp, Homo sapien
tacttaaattgtcatccaccaggtc

SEQ ID NO: 625685 - DNA, 25 bp, Homo sapien
cctgctccacaggtagactgttgtg

SEQ ID NO: 625686 - DNA, 25 bp, Homo sapien
tccacaggtagactgttgtgggctc

SEQ ID NO: 625687 - DNA, 25 bp, Homo sapien
tgggcctcttctgaggcaggagctt

SEQ ID NO: 625688 - DNA, 25 bp, Homo sapien
ggagctttcttgagggatgccacaa

SEQ ID NO: 625689 - DNA, 25 bp, Homo sapien
tgagggatgccacaaacagccttcc

SEQ ID NO: 625690 - DNA, 25 bp, Homo sapien
gcagttccctccctgatgagctgga

SEQ ID NO: 625691 - DNA, 25 bp, Homo sapien
tcctgacagtacagggagggcacca

SEQ ID NO: 625692 - DNA, 25 bp, Homo sapien
ggagggcaccagctagatcctccct

SEQ ID NO: 625693 - DNA, 25 bp, Homo sapien
tagatcctcccttgtggtgtgagat

SEQ ID NO: 625694 - DNA, 25 bp, Homo sapien
tcctcccttgtggtgtgagatgttc

SEQ ID NO: 625695 - DNA, 25 bp, Homo sapien
agatgttcctggaactcagccaggc

SEQ ID NO: 625696 - DNA, 25 bp, Homo sapien
ggctcctttaggcagcgtcaaaata

SEQ ID NO: 625697 - DNA, 25 bp, Homo sapien
gctcctttaggcagcgtcaaaatag

SEQ ID NO: 625698 - DNA, 25 bp, Homo sapien
ctcctttaggcagcgtcaaaatagg

SEQ ID NO: 625699 - DNA, 25 bp, Homo sapien
cctttaggcagcgtcaaaataggca

SEQ ID NO: 625700 - DNA, 25 bp, Homo sapien
tttaggcagcgtcaaaataggcaga

SEQ ID NO: 625701 - DNA, 25 bp, Homo sapien
tgaagctggttctccagagggctct

SEQ ID NO: 625702 - DNA, 25 bp, Homo sapien
ctgtggcctgccctttggcattcag

SEQ ID NO: 625703 - DNA, 25 bp, Homo sapien
tgtggcctgccctttggcattcagt

SEQ ID NO: 625704 - DNA, 25 bp, Homo sapien
tccgctcttaacagcagtgccaacc

SEQ ID NO: 625705 - DNA, 25 bp, Homo sapien
gctcttaacagcagtgccaacccca

SEQ ID NO: 625706 - DNA, 25 bp, Homo sapien
atcatttacttcttcgtgggctcct

SEQ ID NO: 625707 - DNA, 25 bp, Homo sapien
aactgggtgtggttgcgggcgccta

SEQ ID NO: 625708 - DNA, 25 bp, Homo sapien
gagcccagatctgaccactgctctc

SEQ ID NO: 625709 - DNA, 25 bp, Homo sapien
gcccagatctgaccactgctctcca

SEQ ID NO: 625710 - DNA, 25 bp, Homo sapien
tagccagctatggtggtaggcgcat

SEQ ID NO: 625711 - DNA, 25 bp, Homo sapien
agccagctatggtggtaggcgcatg

SEQ ID NO: 625712 - DNA, 25 bp, Homo sapien
gccagctatggtggtaggcgcatgt

SEQ ID NO: 625713 - DNA, 25 bp, Homo sapien
ccagctatggtggtaggcgcatgta

SEQ ID NO: 625714 - DNA, 25 bp, Homo sapien
cagctatggtggtaggcgcatgtaa

SEQ ID NO: 625715 - DNA, 25 bp, Homo sapien
agctatggtggtaggcgcatgtaat

SEQ ID NO: 625716 - DNA, 25 bp, Homo sapien
gctatggtggtaggcgcatgtaatc

SEQ ID NO: 625717 - DNA, 25 bp, Homo sapien
ctatggtggtaggcgcatgtaatcc

SEQ ID NO: 625718 - DNA, 25 bp, Homo sapien
atcacaccactgcacgttgagagat

SEQ ID NO: 625719 - DNA, 25 bp, Homo sapien
acaccactgcacgttgagagatcat

SEQ ID NO: 625720 - DNA, 25 bp, Homo sapien
tgcacgttgagagatcatgctactg

SEQ ID NO: 625721 - DNA, 25 bp, Homo sapien
tgtgaagttctactgctctagttat

SEQ ID NO: 625722 - DNA, 25 bp, Homo sapien
gaagttctactgctctagttatgca

SEQ ID NO: 625723 - DNA, 25 bp, Homo sapien
gttctactgctctagttatgcaggg

SEQ ID NO: 625724 - DNA, 25 bp, Homo sapien
actgctctagttatgcagggtggca

SEQ ID NO: 625725 - DNA, 25 bp, Homo sapien
ctctagttatgcagggtggcaggat

SEQ ID NO: 625726 - DNA, 25 bp, Homo sapien
gcaggatggcattggtaaattgact

SEQ ID NO: 625727 - DNA, 25 bp, Homo sapien
gatggcattggtaaattgacttgaa

SEQ ID NO: 625728 - DNA, 25 bp, Homo sapien
catgattttgattacaagtcttatg

SEQ ID NO: 625729 - DNA, 25 bp, Homo sapien
ggcagcttggtatcgccgttgaacc

SEQ ID NO: 625730 - DNA, 25 bp, Homo sapien
gatcaacagccgctctcggaagaag

SEQ ID NO: 625731 - DNA, 25 bp, Homo sapien
ggaagaagcgcaagccctattcgaa

SEQ ID NO: 625732 - DNA, 25 bp, Homo sapien
aagccctattcgaagttgcaactgg

SEQ ID NO: 625733 - DNA, 25 bp, Homo sapien
gggcgagtttctggtcaacgagttc

SEQ ID NO: 625734 - DNA, 25 bp, Homo sapien
tcaacgagttcatcacacgccagcg

SEQ ID NO: 625735 - DNA, 25 bp, Homo sapien
gccagcgccggagggaactctcaga

SEQ ID NO: 625736 - DNA, 25 bp, Homo sapien
ggaactctcagaccgcttgaatctt

SEQ ID NO: 625737 - DNA, 25 bp, Homo sapien
cttgaatcttagtgaccagcaggtc

SEQ ID NO: 625738 - DNA, 25 bp, Homo sapien
gaaaagacttctgttgagggagcaa

SEQ ID NO: 625739 - DNA, 25 bp, Homo sapien
gagggagcaagctctctccttcttt

SEQ ID NO: 625740 - DNA, 25 bp, Homo sapien
tgctggcactgctacaagcactggg

SEQ ID NO: 625741 - DNA, 25 bp, Homo sapien
gcactgggccgtgtatcaataaggc

SEQ ID NO: 625742 - DNA, 25 bp, Homo sapien
tcaataaggcccatggagctgcgtc

SEQ ID NO: 625743 - DNA, 25 bp, Homo sapien
ccggccaggattggactcggaacca

SEQ ID NO: 625744 - DNA, 25 bp, Homo sapien
attggactcggaaccaggcggagct

SEQ ID NO: 625745 - DNA, 25 bp, Homo sapien
agctgaggctggaaaggcccgacac

SEQ ID NO: 625746 - DNA, 25 bp, Homo sapien
gaaaggcccgacacgcaggtgctgt

SEQ ID NO: 625747 - DNA, 25 bp, Homo sapien
aggtgctgtcatccgcacattatca

SEQ ID NO: 625748 - DNA, 25 bp, Homo sapien
acattatcaggcatggccaggcacc

SEQ ID NO: 625749 - DNA, 25 bp, Homo sapien
aggcaccagggtcctgcacgtgctc

SEQ ID NO: 625750 - DNA, 25 bp, Homo sapien
tgcacgtgctctgcgctactttgac

SEQ ID NO: 625751 - DNA, 25 bp, Homo sapien
ggagtattggtgtggcatttcagca

SEQ ID NO: 625752 - DNA, 25 bp, Homo sapien
gtattggtgtggcatttcagcaaat

SEQ ID NO: 625753 - DNA, 25 bp, Homo sapien
atttgttttaaccatcagccaagga

SEQ ID NO: 625754 - DNA, 25 bp, Homo sapien
aatctgtctcttcaatatagttaca

SEQ ID NO: 625755 - DNA, 25 bp, Homo sapien
gtctcttcaatatagttacacaggt

SEQ ID NO: 625756 - DNA, 25 bp, Homo sapien
ggtgactaagtgtcacccgcttcca

SEQ ID NO: 625757 - DNA, 25 bp, Homo sapien
gcttccaccttctctaatcaaggaa

SEQ ID NO: 625758 - DNA, 25 bp, Homo sapien
gaaatggtgacgatcaggttactat

SEQ ID NO: 625759 - DNA, 25 bp, Homo sapien
gatcaggttactatagattccttat

SEQ ID NO: 625760 - DNA, 25 bp, Homo sapien
agattccttataaggtgccttcata

SEQ ID NO: 625761 - DNA, 25 bp, Homo sapien
ggtgccttcataatggataactgta

SEQ ID NO: 625762 - DNA, 25 bp, Homo sapien
ggcagctactgatctgttcttcatc

SEQ ID NO: 625763 - DNA, 25 bp, Homo sapien
actgatctgttcttcatctccagaa

SEQ ID NO: 625764 - DNA, 25 bp, Homo sapien
tcaaacagtatataacctttcgggt

SEQ ID NO: 625765 - DNA, 25 bp, Homo sapien
ttcgggttgacttttttcattcagc

SEQ ID NO: 625766 - DNA, 25 bp, Homo sapien
cccctgaggtccatgcagattgttg

SEQ ID NO: 625767 - DNA, 25 bp, Homo sapien
catgcagattgttgctgtatcagta

SEQ ID NO: 625768 - DNA, 25 bp, Homo sapien
tcagtagttcatagatagtttcatt

SEQ ID NO: 625769 - DNA, 25 bp, Homo sapien
gatagtttcattgctgagtcgtgtt

SEQ ID NO: 625770 - DNA, 25 bp, Homo sapien
gagtcgtgttttatgacatggacgt

SEQ ID NO: 625771 - DNA, 25 bp, Homo sapien
gacatggacgtaccacagtgtgttt

SEQ ID NO: 625772 - DNA, 25 bp, Homo sapien
acgtaccacagtgtgtttaaccact

SEQ ID NO: 625773 - DNA, 25 bp, Homo sapien
gcagtgttctgaatagcagtccagc

SEQ ID NO: 625774 - DNA, 25 bp, Homo sapien
gtgttctgaatagcagtccagctat

SEQ ID NO: 625775 - DNA, 25 bp, Homo sapien
ctgaatagcagtccagctatgaggg

SEQ ID NO: 625776 - DNA, 25 bp, Homo sapien
ctggagaggccattaagacctggct

SEQ ID NO: 625777 - DNA, 25 bp, Homo sapien
aggccattaagacctggctgtcgcc

SEQ ID NO: 625778 - DNA, 25 bp, Homo sapien
ttaagacctggctgtcgcctccaca

SEQ ID NO: 625779 - DNA, 25 bp, Homo sapien
tgtcgcctccacagctgctcggagg

SEQ ID NO: 625780 - DNA, 25 bp, Homo sapien
tccacagctgctcggaggcagagaa

SEQ ID NO: 625781 - DNA, 25 bp, Homo sapien
gcagagaaaggtggctttgtaagaa

SEQ ID NO: 625782 - DNA, 25 bp, Homo sapien
aagagatcattctttttccaccatg

SEQ ID NO: 625783 - DNA, 25 bp, Homo sapien
agatcattctttttccaccatgtga

SEQ ID NO: 625784 - DNA, 25 bp, Homo sapien
tatctccatcacctggtatgtcaca

SEQ ID NO: 625785 - DNA, 25 bp, Homo sapien
tctccatcacctggtatgtcacatt

SEQ ID NO: 625786 - DNA, 25 bp, Homo sapien
ccatcacctggtatgtcacatttac

SEQ ID NO: 625787 - DNA, 25 bp, Homo sapien
tcacctggtatgtcacatttacagt

SEQ ID NO: 625788 - DNA, 25 bp, Homo sapien
ggtatgtcacatttacagttcttgt

SEQ ID NO: 625789 - DNA, 25 bp, Homo sapien
gtcacatttacagttcttgtactct

SEQ ID NO: 625790 - DNA, 25 bp, Homo sapien
gttcttgtactctatatgccttttt

SEQ ID NO: 625791 - DNA, 25 bp, Homo sapien
tcttgtactctatatgcctttttat

SEQ ID NO: 625792 - DNA, 25 bp, Homo sapien
ctttttatgtctttatacttactat

SEQ ID NO: 625793 - DNA, 25 bp, Homo sapien
gtctttatacttactatttttgcat

SEQ ID NO: 625794 - DNA, 25 bp, Homo sapien
acttactatttttgcattctaagaa

SEQ ID NO: 625795 - DNA, 25 bp, Homo sapien
ctctggtctgacatcccattggcat

SEQ ID NO: 625796 - DNA, 25 bp, Homo sapien
acatcccattggcatcacacacgat

SEQ ID NO: 625797 - DNA, 25 bp, Homo sapien
tgcctcccggaggtgctcttgtgca

SEQ ID NO: 625798 - DNA, 25 bp, Homo sapien
tcttgtgcacacagcaggtcaaagt

SEQ ID NO: 625799 - DNA, 25 bp, Homo sapien
acacagcaggtcaaagtgccagaga

SEQ ID NO: 625800 - DNA, 25 bp, Homo sapien
gtgccagagaattagatcctgtcct

SEQ ID NO: 625801 - DNA, 25 bp, Homo sapien
ttagatcctgtcctcttgggaacag

SEQ ID NO: 625802 - DNA, 25 bp, Homo sapien
ttgggaacagccctcagccagcagt

SEQ ID NO: 625803 - DNA, 25 bp, Homo sapien
agccagcagtgagcccttaggagga

SEQ ID NO: 625804 - DNA, 25 bp, Homo sapien
taggaggatgctccaagctctatcc

SEQ ID NO: 625805 - DNA, 25 bp, Homo sapien
aacttgatgaagctccctgggctgg

SEQ ID NO: 625806 - DNA, 25 bp, Homo sapien
aaaggcagcgagattaagtaacctg

SEQ ID NO: 625807 - DNA, 25 bp, Homo sapien
agtaacctgctcaaggccacataat

SEQ ID NO: 625808 - DNA, 25 bp, Homo sapien
caaggccacataattaggaaatgaa

SEQ ID NO: 625809 - DNA, 25 bp, Homo sapien
gggtcttgagatgaacccagacaat

SEQ ID NO: 625810 - DNA, 25 bp, Homo sapien
ggctttggagctcatcatccgtttt

SEQ ID NO: 625811 - DNA, 25 bp, Homo sapien
ctttggagctcatcatccgtttttt

SEQ ID NO: 625812 - DNA, 25 bp, Homo sapien
ggagctcatcatccgtttttttaaa

SEQ ID NO: 625813 - DNA, 25 bp, Homo sapien
aaaaccctgttgtatacactataat

SEQ ID NO: 625814 - DNA, 25 bp, Homo sapien
gttgtatacactataatatgcattt

SEQ ID NO: 625815 - DNA, 25 bp, Homo sapien
ctccaaaataagctccatacccatt

SEQ ID NO: 625816 - DNA, 25 bp, Homo sapien
ccaaaataagctccatacccattgt

SEQ ID NO: 625817 - DNA, 25 bp, Homo sapien
gcccgctcctgcttggtgagagagt

SEQ ID NO: 625818 - DNA, 25 bp, Homo sapien
cgctcctgcttggtgagagagtcag

SEQ ID NO: 625819 - DNA, 25 bp, Homo sapien
gctcctgcttggtgagagagtcagc

SEQ ID NO: 625820 - DNA, 25 bp, Homo sapien
ctcctgcttggtgagagagtcagca

SEQ ID NO: 625821 - DNA, 25 bp, Homo sapien
tcctgcttggtgagagagtcagcac

SEQ ID NO: 625822 - DNA, 25 bp, Homo sapien
ctgcttggtgagagagtcagcacgc

SEQ ID NO: 625823 - DNA, 25 bp, Homo sapien
tgcttggtgagagagtcagcacgca

SEQ ID NO: 625824 - DNA, 25 bp, Homo sapien
cttggtgagagagtcagcacgcagt

SEQ ID NO: 625825 - DNA, 25 bp, Homo sapien
gtgagagagtcagcacgcagtggcc

SEQ ID NO: 625826 - DNA, 25 bp, Homo sapien
gagtcagcacgcagtggcctgcagt

SEQ ID NO: 625827 - DNA, 25 bp, Homo sapien
cgcagtggcctgcagtctcactctg

SEQ ID NO: 625828 - DNA, 25 bp, Homo sapien
caaacaaggattacagtgaatgtga

SEQ ID NO: 625829 - DNA, 25 bp, Homo sapien
gaataggcatttctatgacatttta

SEQ ID NO: 625830 - DNA, 25 bp, Homo sapien
tattttatcatatgcagtcacttct

SEQ ID NO: 625831 - DNA, 25 bp, Homo sapien
atatgcagtcacttctttgtaaatg

SEQ ID NO: 625832 - DNA, 25 bp, Homo sapien
aaaagagtgattttcctcacctgag

SEQ ID NO: 625833 - DNA, 25 bp, Homo sapien
gagtgattttcctcacctgagtaca

SEQ ID NO: 625834 - DNA, 25 bp, Homo sapien
ctcacctgagtacatgaaaagaaaa

SEQ ID NO: 625835 - DNA, 25 bp, Homo sapien
aatcaaatcatctgtactagcactg

SEQ ID NO: 625836 - DNA, 25 bp, Homo sapien
tcatctgtactagcactgttaatct

SEQ ID NO: 625837 - DNA, 25 bp, Homo sapien
aaagtggttgcatagagaagagtaa

SEQ ID NO: 625838 - DNA, 25 bp, Homo sapien
gagtaagaatgtagaccagcttatt

SEQ ID NO: 625839 - DNA, 25 bp, Homo sapien
tcctgcttggtgagagagtcagcac

SEQ ID NO: 625840 - DNA, 25 bp, Homo sapien
cctgcttggtgagagagtcagcacg

SEQ ID NO: 625841 - DNA, 25 bp, Homo sapien
ctgcttggtgagagagtcagcacgc

SEQ ID NO: 625842 - DNA, 25 bp, Homo sapien
tgcttggtgagagagtcagcacgca

SEQ ID NO: 625843 - DNA, 25 bp, Homo sapien
gcttggtgagagagtcagcacgcag

SEQ ID NO: 625844 - DNA, 25 bp, Homo sapien
cttggtgagagagtcagcacgcagt

SEQ ID NO: 625845 - DNA, 25 bp, Homo sapien
ttggtgagagagtcagcacgcagtg

SEQ ID NO: 625846 - DNA, 25 bp, Homo sapien
tggtgagagagtcagcacgcagtgg

SEQ ID NO: 625847 - DNA, 25 bp, Homo sapien
ggtgagagagtcagcacgcagtggc

SEQ ID NO: 625848 - DNA, 25 bp, Homo sapien
gtgagagagtcagcacgcagtggcc

SEQ ID NO: 625849 - DNA, 25 bp, Homo sapien
gaagcaaataaacagatctcaaata

SEQ ID NO: 625850 - DNA, 25 bp, Homo sapien
ttagaggtgggatatcagggtaacc

SEQ ID NO: 625851 - DNA, 25 bp, Homo sapien
gggatatcagggtaaccaggcaaaa

SEQ ID NO: 625852 - DNA, 25 bp, Homo sapien
gggtaaccaggcaaaataactgata

SEQ ID NO: 625853 - DNA, 25 bp, Homo sapien
gctcaaaaacttatcctgctctggt

SEQ ID NO: 625854 - DNA, 25 bp, Homo sapien
tcaaaaacttatcctgctctggtgg

SEQ ID NO: 625855 - DNA, 25 bp, Homo sapien
ttgtgactcatgctgtgtaacaaag

SEQ ID NO: 625856 - DNA, 25 bp, Homo sapien
gactcatgctgtgtaacaaagacct

SEQ ID NO: 625857 - DNA, 25 bp, Homo sapien
atgctgtgtaacaaagacctgtgta

SEQ ID NO: 625858 - DNA, 25 bp, Homo sapien
caaagacctgtgtagacattgagtt

SEQ ID NO: 625859 - DNA, 25 bp, Homo sapien
gacctgtgtagacattgagttgtat

SEQ ID NO: 625860 - DNA, 25 bp, Homo sapien
tggactgcctgtgctctgggctcca

SEQ ID NO: 625861 - DNA, 25 bp, Homo sapien
agatcaacactgagtatccctgaca

SEQ ID NO: 625862 - DNA, 25 bp, Homo sapien
gtatccctgacaggattcagccaag

SEQ ID NO: 625863 - DNA, 25 bp, Homo sapien
cagcctctttgggtaagagcccctt

SEQ ID NO: 625864 - DNA, 25 bp, Homo sapien
tcctcagtccttccagtagttttta

SEQ ID NO: 625865 - DNA, 25 bp, Homo sapien
ttaaccaatttcctgtgttccatcc

SEQ ID NO: 625866 - DNA, 25 bp, Homo sapien
gttccatcctactctgcttgagata

SEQ ID NO: 625867 - DNA, 25 bp, Homo sapien
tctacttttgtgtttgagcactgaa

SEQ ID NO: 625868 - DNA, 25 bp, Homo sapien
gagcactgaatgatacatagttcct

SEQ ID NO: 625869 - DNA, 25 bp, Homo sapien
atagttccttccatatcagtccata

SEQ ID NO: 625870 - DNA, 25 bp, Homo sapien
atcagtccatagtgagcttcctcat

SEQ ID NO: 625871 - DNA, 25 bp, Homo sapien
gtggcaataaatattagaagcctgc

SEQ ID NO: 625872 - DNA, 25 bp, Homo sapien
gaagcctgcagaatccagctacgaa

SEQ ID NO: 625873 - DNA, 25 bp, Homo sapien
aagcctgcagaatccagctacgaat

SEQ ID NO: 625874 - DNA, 25 bp, Homo sapien
gcctgcagaatccagctacgaatat

SEQ ID NO: 625875 - DNA, 25 bp, Homo sapien
gcagaatccagctacgaatatagag

SEQ ID NO: 625876 - DNA, 25 bp, Homo sapien
ccagctacgaatatagagggttttg

SEQ ID NO: 625877 - DNA, 25 bp, Homo sapien
tatagagggttttgctcttgggcct

SEQ ID NO: 625878 - DNA, 25 bp, Homo sapien
atagagggttttgctcttgggcctt

SEQ ID NO: 625879 - DNA, 25 bp, Homo sapien
agagggttttgctcttgggccttcg

SEQ ID NO: 625880 - DNA, 25 bp, Homo sapien
agggttttgctcttgggccttcgtg

SEQ ID NO: 625881 - DNA, 25 bp, Homo sapien
ggttttgctcttgggccttcgtggc

SEQ ID NO: 625882 - DNA, 25 bp, Homo sapien
gaaatgtcaacttctggccacaacg

SEQ ID NO: 625883 - DNA, 25 bp, Homo sapien
ggccacaacggcaaccagtaaaatg

SEQ ID NO: 625884 - DNA, 25 bp, Homo sapien
gactatttttactgtcttatctatt

SEQ ID NO: 625885 - DNA, 25 bp, Homo sapien
atagtatttgcaggtggaacgccta

SEQ ID NO: 625886 - DNA, 25 bp, Homo sapien
ggaacgcctagcagggcttgagtct

SEQ ID NO: 625887 - DNA, 25 bp, Homo sapien
aactctgctgcttttactctaattg

SEQ ID NO: 625888 - DNA, 25 bp, Homo sapien
tttactctaattgaccgagacaagt

SEQ ID NO: 625889 - DNA, 25 bp, Homo sapien
atagagcttcaattttctcatatct

SEQ ID NO: 625890 - DNA, 25 bp, Homo sapien
gtaacataacaattcacagcctttt

SEQ ID NO: 625891 - DNA, 25 bp, Homo sapien
acagccttttactttgtagttatcg

SEQ ID NO: 625892 - DNA, 25 bp, Homo sapien
gttatcgtgaagatctaatcgcagt

SEQ ID NO: 625893 - DNA, 25 bp, Homo sapien
gttcccatgaggctcctacatttga

SEQ ID NO: 625894 - DNA, 25 bp, Homo sapien
gaggctcctacatttgagtggagga

SEQ ID NO: 625895 - DNA, 25 bp, Homo sapien
gaggaagatgtacttgtctacgttg

SEQ ID NO: 625896 - DNA, 25 bp, Homo sapien
gtacttgtctacgttgggtgatgat

SEQ ID NO: 625897 - DNA, 25 bp, Homo sapien
ggtgatgattagtgccatgaagaac

SEQ ID NO: 625898 - DNA, 25 bp, Homo sapien
tgtggacagggctatcttagctatc

SEQ ID NO: 625899 - DNA, 25 bp, Homo sapien
gggctatcttagctatcactctaat

SEQ ID NO: 625900 - DNA, 25 bp, Homo sapien
gaaaaaacacatgcagagaccctga

SEQ ID NO: 625901 - DNA, 25 bp, Homo sapien
ggagaagcagggtcactttgtcaaa

SEQ ID NO: 625902 - DNA, 25 bp, Homo sapien
ggtcactttgtcaaagggacagcaa

SEQ ID NO: 625903 - DNA, 25 bp, Homo sapien
gcaaggaagccaatgaccgggtgaa

SEQ ID NO: 625904 - DNA, 25 bp, Homo sapien
taactgtttgaccagaggccagctg

SEQ ID NO: 625905 - DNA, 25 bp, Homo sapien
accagaggccagctgtcccaggatg

SEQ ID NO: 625906 - DNA, 25 bp, Homo sapien
ccagaggccagctgtcccaggatgc

SEQ ID NO: 625907 - DNA, 25 bp, Homo sapien
cagaggccagctgtcccaggatgcg

SEQ ID NO: 625908 - DNA, 25 bp, Homo sapien
agaggccagctgtcccaggatgcgg

SEQ ID NO: 625909 - DNA, 25 bp, Homo sapien
gaggccagctgtcccaggatgcggt

SEQ ID NO: 625910 - DNA, 25 bp, Homo sapien
gccagctgtcccaggatgcggttaa

SEQ ID NO: 625911 - DNA, 25 bp, Homo sapien
ccagctgtcccaggatgcggttaag

SEQ ID NO: 625912 - DNA, 25 bp, Homo sapien
cagctgtcccaggatgcggttaaga

SEQ ID NO: 625913 - DNA, 25 bp, Homo sapien
agaactggcaagaaaaacatctcca

SEQ ID NO: 625914 - DNA, 25 bp, Homo sapien
aaaacatctccaggaagcggtcaga

SEQ ID NO: 625915 - DNA, 25 bp, Homo sapien
tgcctggaacacactggcccagcaa

SEQ ID NO: 625916 - DNA, 25 bp, Homo sapien
gcaaccacatctacagcagccaagg

SEQ ID NO: 625917 - DNA, 25 bp, Homo sapien
atgcaggacaactacgccctgacat

SEQ ID NO: 625918 - DNA, 25 bp, Homo sapien
tacgccctgacattcggcaacagca

SEQ ID NO: 625919 - DNA, 25 bp, Homo sapien
acattcggcaacagcacccggaggg

SEQ ID NO: 625920 - DNA, 25 bp, Homo sapien
ctactggaaggaatgggcaaagcga

SEQ ID NO: 625921 - DNA, 25 bp, Homo sapien
gggcaaagcgaaaccacacactatg

SEQ ID NO: 625922 - DNA, 25 bp, Homo sapien
tgaaaatgctttaatggtggtgtct

SEQ ID NO: 625923 - DNA, 25 bp, Homo sapien
tacagcatggatgtggacagggaaa

SEQ ID NO: 625924 - DNA, 25 bp, Homo sapien
aacagcaagtgcacacagtgggaca

SEQ ID NO: 625925 - DNA, 25 bp, Homo sapien
gcacacagtgggacaggccacagga

SEQ ID NO: 625926 - DNA, 25 bp, Homo sapien
ggcatcagtttgagacaccctgatg

SEQ ID NO: 625927 - DNA, 25 bp, Homo sapien
tgatgcaaaagaacggaccctcaag

SEQ ID NO: 625928 - DNA, 25 bp, Homo sapien
ggaccctcaaggaagttggctgtac

SEQ ID NO: 625929 - DNA, 25 bp, Homo sapien
gctgtacatgtattttccttcctag

SEQ ID NO: 625930 - DNA, 25 bp, Homo sapien
atgtattttccttcctagcacagga

SEQ ID NO: 625931 - DNA, 25 bp, Homo sapien
aagattatccaatcagcaccactcc

SEQ ID NO: 625932 - DNA, 25 bp, Homo sapien
ccactcctagcacctgattatatat

SEQ ID NO: 625933 - DNA, 25 bp, Homo sapien
aagtagcttttctctcggacaccaa

SEQ ID NO: 625934 - DNA, 25 bp, Homo sapien
aagtccccatctcatgcgtggttga

SEQ ID NO: 625935 - DNA, 25 bp, Homo sapien
aggatgatgcttcttcctccaggat

SEQ ID NO: 625936 - DNA, 25 bp, Homo sapien
cttcctccaggattggtatcctatg

SEQ ID NO: 625937 - DNA, 25 bp, Homo sapien
aacaggcttcagaaagagtatttta

SEQ ID NO: 625938 - DNA, 25 bp, Homo sapien
gatgaaaggcatattttctttgttt

SEQ ID NO: 625939 - DNA, 25 bp, Homo sapien
tttctccaagtttcataaccgttca

SEQ ID NO: 625940 - DNA, 25 bp, Homo sapien
gtttcataaccgttcagttgcagaa

SEQ ID NO: 625941 - DNA, 25 bp, Homo sapien
gttgcagaaccaagaatctaaaacc

SEQ ID NO: 625942 - DNA, 25 bp, Homo sapien
accagctctgggaaacaaatgtcca

SEQ ID NO: 625943 - DNA, 25 bp, Homo sapien
aaacaaatgtccagatgccagcctc

SEQ ID NO: 625944 - DNA, 25 bp, Homo sapien
atgtccagatgccagcctcatagtt

SEQ ID NO: 625945 - DNA, 25 bp, Homo sapien
ccagcctcatagttgaacttggatt

SEQ ID NO: 625946 - DNA, 25 bp, Homo sapien
ttgaaaataccttcagcacttagaa

SEQ ID NO: 625947 - DNA, 25 bp, Homo sapien
gaagagacattcaaatacatttcat

SEQ ID NO: 625948 - DNA, 25 bp, Homo sapien
atatatcctacagaatacagtcaaa

SEQ ID NO: 625949 - DNA, 25 bp, Homo sapien
agacacatcatgttggatttagcag

SEQ ID NO: 625950 - DNA, 25 bp, Homo sapien
gttggatttagcagacaatgatttg

SEQ ID NO: 625951 - DNA, 25 bp, Homo sapien
tgaaactaaccatgattgatatgtc

SEQ ID NO: 625952 - DNA, 25 bp, Homo sapien
ttacaatgtggtcccaatccagcta

SEQ ID NO: 625953 - DNA, 25 bp, Homo sapien
aatccagctaaacccctggttggat

SEQ ID NO: 625954 - DNA, 25 bp, Homo sapien
acccctggttggattgaggtaatca

SEQ ID NO: 625955 - DNA, 25 bp, Homo sapien
gaggtaatcaatctctcaccctatc

SEQ ID NO: 625956 - DNA, 25 bp, Homo sapien
atctctcaccctatctacagaagaa

SEQ ID NO: 625957 - DNA, 25 bp, Homo sapien
actcatggtggagtaagatgccatc

SEQ ID NO: 625958 - DNA, 25 bp, Homo sapien
atctggagcctctatgattcattta

SEQ ID NO: 625959 - DNA, 25 bp, Homo sapien
atgttttcactacttagaccgaccg

SEQ ID NO: 625960 - DNA, 25 bp, Homo sapien
tgttttcactacttagaccgaccgg

SEQ ID NO: 625961 - DNA, 25 bp, Homo sapien
gtataaacgcgagtcccacagaaaa

SEQ ID NO: 625962 - DNA, 25 bp, Homo sapien
ataaacgcgagtcccacagaaaagt

SEQ ID NO: 625963 - DNA, 25 bp, Homo sapien
gttgacttatttatacgagtcttca

SEQ ID NO: 625964 - DNA, 25 bp, Homo sapien
atttatacgagtcttcatgtacgtc

SEQ ID NO: 625965 - DNA, 25 bp, Homo sapien
tatacgagtcttcatgtacgtcaaa

SEQ ID NO: 625966 - DNA, 25 bp, Homo sapien
tacgagtcttcatgtacgtcaaatg

SEQ ID NO: 625967 - DNA, 25 bp, Homo sapien
cgagtcttcatgtacgtcaaatgtt

SEQ ID NO: 625968 - DNA, 25 bp, Homo sapien
gtcttcatgtacgtcaaatgttttc

SEQ ID NO: 625969 - DNA, 25 bp, Homo sapien
tcatgtacgtcaaatgttttcacta

SEQ ID NO: 625970 - DNA, 25 bp, Homo sapien
cgagacatcgatgtcggccttgggc

SEQ ID NO: 625971 - DNA, 25 bp, Homo sapien
gatgtcggccttgggcaggctcaca

SEQ ID NO: 625972 - DNA, 25 bp, Homo sapien
gggcaggctcacatccacatctgga

SEQ ID NO: 625973 - DNA, 25 bp, Homo sapien
ttaggaagggtaacatccacatcac

SEQ ID NO: 625974 - DNA, 25 bp, Homo sapien
gaagggtaacatccacatcaccctt

SEQ ID NO: 625975 - DNA, 25 bp, Homo sapien
acatcacccttcactttgggtcctt

SEQ ID NO: 625976 - DNA, 25 bp, Homo sapien
cacccttcactttgggtcctttcag

SEQ ID NO: 625977 - DNA, 25 bp, Homo sapien
ggtcctttcaggtttaagtcaatat

SEQ ID NO: 625978 - DNA, 25 bp, Homo sapien
tcaggtttaagtcaatatcaggcat

SEQ ID NO: 625979 - DNA, 25 bp, Homo sapien
tttaagtcaatatcaggcatggaga

SEQ ID NO: 625980 - DNA, 25 bp, Homo sapien
agatcttgggggctttgatgctcat

SEQ ID NO: 625981 - DNA, 25 bp, Homo sapien
taaagtatgttgctgtgtagtgttt

SEQ ID NO: 625982 - DNA, 25 bp, Homo sapien
gtgtagtgttttacttttcccaatg

SEQ ID NO: 625983 - DNA, 25 bp, Homo sapien
atgggtatatttcttctgtggtcta

SEQ ID NO: 625984 - DNA, 25 bp, Homo sapien
atttcttctgtggtctagtaaatga

SEQ ID NO: 625985 - DNA, 25 bp, Homo sapien
ttttatgtttactccatgaatgtta

SEQ ID NO: 625986 - DNA, 25 bp, Homo sapien
actgagtctagagggcccaccaggc

SEQ ID NO: 625987 - DNA, 25 bp, Homo sapien
ccaccaggcagtattccagactagg

SEQ ID NO: 625988 - DNA, 25 bp, Homo sapien
ggctctcaaaatttggcccaccagt

SEQ ID NO: 625989 - DNA, 25 bp, Homo sapien
caaaatttggcccaccagtcagcag

SEQ ID NO: 625990 - DNA, 25 bp, Homo sapien
ttggaccccattttgcacctattga

SEQ ID NO: 625991 - DNA, 25 bp, Homo sapien
ccccattttgcacctattgaatcag

SEQ ID NO: 625992 - DNA, 25 bp, Homo sapien
ggagaccgaggcaagtggatctctt

SEQ ID NO: 625993 - DNA, 25 bp, Homo sapien
gagaccgaggcaagtggatctcttg

SEQ ID NO: 625994 - DNA, 25 bp, Homo sapien
agaccgaggcaagtggatctcttga

SEQ ID NO: 625995 - DNA, 25 bp, Homo sapien
gaccgaggcaagtggatctcttgag

SEQ ID NO: 625996 - DNA, 25 bp, Homo sapien
accgaggcaagtggatctcttgagc

SEQ ID NO: 625997 - DNA, 25 bp, Homo sapien
cgaggcaagtggatctcttgagctc

SEQ ID NO: 625998 - DNA, 25 bp, Homo sapien
agaccagcccgggtagcacggtgaa

SEQ ID NO: 625999 - DNA, 25 bp, Homo sapien
gaccagcccgggtagcacggtgaaa

SEQ ID NO: 626000 - DNA, 25 bp, Homo sapien
attgcctgagcctgacaggcagagg

SEQ ID NO: 626001 - DNA, 25 bp, Homo sapien
ttgcctgagcctgacaggcagaggt

SEQ ID NO: 626002 - DNA, 25 bp, Homo sapien
tgcctgagcctgacaggcagaggtt

SEQ ID NO: 626003 - DNA, 25 bp, Homo sapien
taaaagtaatacttttggctgggca

SEQ ID NO: 626004 - DNA, 25 bp, Homo sapien
aaagtaatacttttggctgggcacg

SEQ ID NO: 626005 - DNA, 25 bp, Homo sapien
aagtaatacttttggctgggcacgg

SEQ ID NO: 626006 - DNA, 25 bp, Homo sapien
agtaatacttttggctgggcacggt

SEQ ID NO: 626007 - DNA, 25 bp, Homo sapien
gtaatacttttggctgggcacggtg

SEQ ID NO: 626008 - DNA, 25 bp, Homo sapien
taatacttttggctgggcacggtgg

SEQ ID NO: 626009 - DNA, 25 bp, Homo sapien
gtgagcccagatcgccatggcactc

SEQ ID NO: 626010 - DNA, 25 bp, Homo sapien
tgagcccagatcgccatggcactcc

SEQ ID NO: 626011 - DNA, 25 bp, Homo sapien
gcccagatcgccatggcactccagc

SEQ ID NO: 626012 - DNA, 25 bp, Homo sapien
cccagatcgccatggcactccagcc

SEQ ID NO: 626013 - DNA, 25 bp, Homo sapien
agatcgccatggcactccagcctgg

SEQ ID NO: 626014 - DNA, 25 bp, Homo sapien
gtatattacatagcgggagtccttg

SEQ ID NO: 626015 - DNA, 25 bp, Homo sapien
agtccttgtgcctacacatctctga

SEQ ID NO: 626016 - DNA, 25 bp, Homo sapien
gagcctgcagagaatgactctcttc

SEQ ID NO: 626017 - DNA, 25 bp, Homo sapien
tctctttcctatgtcaggccggtat

SEQ ID NO: 626018 - DNA, 25 bp, Homo sapien
gtcaggccggtatctaagccagtaa

SEQ ID NO: 626019 - DNA, 25 bp, Homo sapien
agccagtaatgtgtgttctgggcca

SEQ ID NO: 626020 - DNA, 25 bp, Homo sapien
tgttctgggccagtggtccctaaac

SEQ ID NO: 626021 - DNA, 25 bp, Homo sapien
aactggaaacttaacatgggtagca

SEQ ID NO: 626022 - DNA, 25 bp, Homo sapien
gaagctttgcttccttgataatcat

SEQ ID NO: 626023 - DNA, 25 bp, Homo sapien
ggttttgactgagcaacctttgcaa

SEQ ID NO: 626024 - DNA, 25 bp, Homo sapien
agcaacctttgcaattttatatctt

SEQ ID NO: 626025 - DNA, 25 bp, Homo sapien
caaagtctgaagttccagggcaatt

SEQ ID NO: 626026 - DNA, 25 bp, Homo sapien
gtctgaagttccagggcaatttatc

SEQ ID NO: 626027 - DNA, 25 bp, Homo sapien
tctgaagttccagggcaatttatct

SEQ ID NO: 626028 - DNA, 25 bp, Homo sapien
ctgaagttccagggcaatttatctg

SEQ ID NO: 626029 - DNA, 25 bp, Homo sapien
tgaagttccagggcaatttatctgg

SEQ ID NO: 626030 - DNA, 25 bp, Homo sapien
aagttccagggcaatttatctggaa

SEQ ID NO: 626031 - DNA, 25 bp, Homo sapien
agttccagggcaatttatctggaaa

SEQ ID NO: 626032 - DNA, 25 bp, Homo sapien
gttccagggcaatttatctggaaaa

SEQ ID NO: 626033 - DNA, 25 bp, Homo sapien
ttccagggcaatttatctggaaaag

SEQ ID NO: 626034 - DNA, 25 bp, Homo sapien
tccagggcaatttatctggaaaagc

SEQ ID NO: 626035 - DNA, 25 bp, Homo sapien
ccagggcaatttatctggaaaagct

SEQ ID NO: 626036 - DNA, 25 bp, Homo sapien
gttgtttaagagctgtataatggtg

SEQ ID NO: 626037 - DNA, 25 bp, Homo sapien
agctgtataatggtgatattattcc

SEQ ID NO: 626038 - DNA, 25 bp, Homo sapien
gctgtataatggtgatattattcct

SEQ ID NO: 626039 - DNA, 25 bp, Homo sapien
ctgtataatggtgatattattcctt

SEQ ID NO: 626040 - DNA, 25 bp, Homo sapien
aatggtgatattattccttctgtac

SEQ ID NO: 626041 - DNA, 25 bp, Homo sapien
tggtgatattattccttctgtactt

SEQ ID NO: 626042 - DNA, 25 bp, Homo sapien
tgatattattccttctgtacttatt

SEQ ID NO: 626043 - DNA, 25 bp, Homo sapien
gatattattccttctgtacttattt

SEQ ID NO: 626044 - DNA, 25 bp, Homo sapien
atattattccttctgtacttatttt

SEQ ID NO: 626045 - DNA, 25 bp, Homo sapien
ggtgcacatcaccacaggtgcacat

SEQ ID NO: 626046 - DNA, 25 bp, Homo sapien
tgcacatcaccacaggtgcacatca

SEQ ID NO: 626047 - DNA, 25 bp, Homo sapien
agagggcatgtaatgccggaagatc

SEQ ID NO: 626048 - DNA, 25 bp, Homo sapien
agggcatgtaatgccggaagatcgc

SEQ ID NO: 626049 - DNA, 25 bp, Homo sapien
ggcatgtaatgccggaagatcgcac

SEQ ID NO: 626050 - DNA, 25 bp, Homo sapien
catgtaatgccggaagatcgcacag

SEQ ID NO: 626051 - DNA, 25 bp, Homo sapien
atgtaatgccggaagatcgcacagc

SEQ ID NO: 626052 - DNA, 25 bp, Homo sapien
tgtaatgccggaagatcgcacagct

SEQ ID NO: 626053 - DNA, 25 bp, Homo sapien
gtaatgccggaagatcgcacagctg

SEQ ID NO: 626054 - DNA, 25 bp, Homo sapien
taatgccggaagatcgcacagctgg

SEQ ID NO: 626055 - DNA, 25 bp, Homo sapien
aatgccggaagatcgcacagctggc

SEQ ID NO: 626056 - DNA, 25 bp, Homo sapien
atgccggaagatcgcacagctggcc

SEQ ID NO: 626057 - DNA, 25 bp, Homo sapien
tgccggaagatcgcacagctggccg

SEQ ID NO: 626058 - DNA, 25 bp, Homo sapien
tattggactcagaagttgacatcag

SEQ ID NO: 626059 - DNA, 25 bp, Homo sapien
actatataaaggaccacacagctag

SEQ ID NO: 626060 - DNA, 25 bp, Homo sapien
accacacagctagagttaattttag

SEQ ID NO: 626061 - DNA, 25 bp, Homo sapien
ttttagttactgtaaaccaggcaca

SEQ ID NO: 626062 - DNA, 25 bp, Homo sapien
aaccaggcacagtttcaaacctaag

SEQ ID NO: 626063 - DNA, 25 bp, Homo sapien
tcaaacctaagatttcaaccaaagt

SEQ ID NO: 626064 - DNA, 25 bp, Homo sapien
tcaaccaaagtgaaaggccctatca

SEQ ID NO: 626065 - DNA, 25 bp, Homo sapien
gaaaggccctatcacaatgtacaca

SEQ ID NO: 626066 - DNA, 25 bp, Homo sapien
acaatgtacacagatcacttagctt

SEQ ID NO: 626067 - DNA, 25 bp, Homo sapien
aagatgcaatttatcctgacacgaa

SEQ ID NO: 626068 - DNA, 25 bp, Homo sapien
ttatcctgacacgaaagttaacatg

SEQ ID NO: 626069 - DNA, 25 bp, Homo sapien
gaatgtgtcacagcaacctagtggg

SEQ ID NO: 626070 - DNA, 25 bp, Homo sapien
gtcacagcaacctagtgggcaccta

SEQ ID NO: 626071 - DNA, 25 bp, Homo sapien
aacctagtgggcacctatgtaccta

SEQ ID NO: 626072 - DNA, 25 bp, Homo sapien
tagtgggcacctatgtacctactat

SEQ ID NO: 626073 - DNA, 25 bp, Homo sapien
gcacctatgtacctactatctgttg

SEQ ID NO: 626074 - DNA, 25 bp, Homo sapien
ctatgtacctactatctgttgatga

SEQ ID NO: 626075 - DNA, 25 bp, Homo sapien
gtacctactatctgttgatgaatat

SEQ ID NO: 626076 - DNA, 25 bp, Homo sapien
ttgatgaatatcctagtttcttcta

SEQ ID NO: 626077 - DNA, 25 bp, Homo sapien
aagcattgatgaaggacagcatttc

SEQ ID NO: 626078 - DNA, 25 bp, Homo sapien
aggacagcatttctacattctttat

SEQ ID NO: 626079 - DNA, 25 bp, Homo sapien
cagcatttctacattctttattttt

SEQ ID NO: 626080 - DNA, 25 bp, Homo sapien
aacattttgtggtgggaatttgtga

SEQ ID NO: 626081 - DNA, 25 bp, Homo sapien
tacgaagtcaagagcatggtacggt

SEQ ID NO: 626082 - DNA, 25 bp, Homo sapien
gcatggtacggtgaggacccagcac

SEQ ID NO: 626083 - DNA, 25 bp, Homo sapien
tctgggtgtaaatctgagacatcac

SEQ ID NO: 626084 - DNA, 25 bp, Homo sapien
gtaaatctgagacatcacagcatgc

SEQ ID NO: 626085 - DNA, 25 bp, Homo sapien
atcacagcatgcaggctgcagacgt

SEQ ID NO: 626086 - DNA, 25 bp, Homo sapien
tgcaggctgcagacgtaggcatctc

SEQ ID NO: 626087 - DNA, 25 bp, Homo sapien
ggctgcagacgtaggcatctctaca

SEQ ID NO: 626088 - DNA, 25 bp, Homo sapien
gcagacgtaggcatctctacaaaag

SEQ ID NO: 626089 - DNA, 25 bp, Homo sapien
ctctacaaaagaaggatgcgtttac

SEQ ID NO: 626090 - DNA, 25 bp, Homo sapien
ggatgcgtttacaggagaatcgctt

SEQ ID NO: 626091 - DNA, 25 bp, Homo sapien
ataaggtcattaggatagaccctaa

SEQ ID NO: 626092 - DNA, 25 bp, Homo sapien
aggatagaccctaattcaatatgac

SEQ ID NO: 626093 - DNA, 25 bp, Homo sapien
aagaagaggcgagtagggcacaaca

SEQ ID NO: 626094 - DNA, 25 bp, Homo sapien
ggcgagtagggcacaacaggcacaa

SEQ ID NO: 626095 - DNA, 25 bp, Homo sapien
gtagggcacaacaggcacaaaggga

SEQ ID NO: 626096 - DNA, 25 bp, Homo sapien
acaacaggcacaaagggagaccata

SEQ ID NO: 626097 - DNA, 25 bp, Homo sapien
aagggagaccataaggagacacaga

SEQ ID NO: 626098 - DNA, 25 bp, Homo sapien
cataaggagacacagaggaaggaca

SEQ ID NO: 626099 - DNA, 25 bp, Homo sapien
aggaaggacaactctttacaagcta

SEQ ID NO: 626100 - DNA, 25 bp, Homo sapien
gaaggacaactctttacaagctaag

SEQ ID NO: 626101 - DNA, 25 bp, Homo sapien
tacaagctaagaagagagggcctca

SEQ ID NO: 626102 - DNA, 25 bp, Homo sapien
gtatgtaaatgcaccctgtaaatgt

SEQ ID NO: 626103 - DNA, 25 bp, Homo sapien
gcaccctgtaaatgttactttccat

SEQ ID NO: 626104 - DNA, 25 bp, Homo sapien
atttcagaaaagctaccaagtcttg

SEQ ID NO: 626105 - DNA, 25 bp, Homo sapien
ccaagtcttgagtgctttgtagcct

SEQ ID NO: 626106 - DNA, 25 bp, Homo sapien
gtagcctatgttgcatgtagcggac

SEQ ID NO: 626107 - DNA, 25 bp, Homo sapien
tgtagcggactttaactgctccaag

SEQ ID NO: 626108 - DNA, 25 bp, Homo sapien
ggactttaactgctccaaggagttg

SEQ ID NO: 626109 - DNA, 25 bp, Homo sapien
tttcattccataacagtcttttcac

SEQ ID NO: 626110 - DNA, 25 bp, Homo sapien
taacagtcttttcacattggatttt

SEQ ID NO: 626111 - DNA, 25 bp, Homo sapien
tggattttaaacaaagtggctctgg

SEQ ID NO: 626112 - DNA, 25 bp, Homo sapien
gtggctctgggttataagatgtcat

SEQ ID NO: 626113 - DNA, 25 bp, Homo sapien
agcagtgccgacacccctgagaaca

SEQ ID NO: 626114 - DNA, 25 bp, Homo sapien
cacagccagcaactgggcttggaag

SEQ ID NO: 626115 - DNA, 25 bp, Homo sapien
caactgggcttggaagcttccctga

SEQ ID NO: 626116 - DNA, 25 bp, Homo sapien
ttccctgaggtcgacgctgcctgga

SEQ ID NO: 626117 - DNA, 25 bp, Homo sapien
gacgctgcctggaaatggactttgc

SEQ ID NO: 626118 - DNA, 25 bp, Homo sapien
actttgctgcctgcattcaggccag

SEQ ID NO: 626119 - DNA, 25 bp, Homo sapien
ccccattacaagttggcctcatatt

SEQ ID NO: 626120 - DNA, 25 bp, Homo sapien
gttggcctcatattaacatgtctga

SEQ ID NO: 626121 - DNA, 25 bp, Homo sapien
gtctgaggactaaggctggtattct

SEQ ID NO: 626122 - DNA, 25 bp, Homo sapien
tattctagaacacgcctttcactga

SEQ ID NO: 626123 - DNA, 25 bp, Homo sapien
agaacacgcctttcactgattgtgt

SEQ ID NO: 626124 - DNA, 25 bp, Homo sapien
ggccgatgcccaacagtgacatcga

SEQ ID NO: 626125 - DNA, 25 bp, Homo sapien
atgcccaacagtgacatcgacttga

SEQ ID NO: 626126 - DNA, 25 bp, Homo sapien
aacagtgacatcgacttgagcaacc

SEQ ID NO: 626127 - DNA, 25 bp, Homo sapien
gtgacatcgacttgagcaacctgga

SEQ ID NO: 626128 - DNA, 25 bp, Homo sapien
atcgacttgagcaacctggagcggc

SEQ ID NO: 626129 - DNA, 25 bp, Homo sapien
ggagaagtaccggagcttcgaccgc

SEQ ID NO: 626130 - DNA, 25 bp, Homo sapien
agaagtaccggagcttcgaccgcta

SEQ ID NO: 626131 - DNA, 25 bp, Homo sapien
cactggtggcggacctaccgagagt

SEQ ID NO: 626132 - DNA, 25 bp, Homo sapien
ggtggcggacctaccgagagtattt

SEQ ID NO: 626133 - DNA, 25 bp, Homo sapien
gcggacctaccgagagtatttcggg

SEQ ID NO: 626134 - DNA, 25 bp, Homo sapien
cttgaccacctgactttccggattg

SEQ ID NO: 626135 - DNA, 25 bp, Homo sapien
cttgttattctttaaagctctaaat

SEQ ID NO: 626136 - DNA, 25 bp, Homo sapien
aaaaatttcatttggccaggcactg

SEQ ID NO: 626137 - DNA, 25 bp, Homo sapien
ccagcttgggcccagggagtcaaag

SEQ ID NO: 626138 - DNA, 25 bp, Homo sapien
gagctatgaatgtgtcactggatcc

SEQ ID NO: 626139 - DNA, 25 bp, Homo sapien
atgaatgtgtcactggatccacctt

SEQ ID NO: 626140 - DNA, 25 bp, Homo sapien
aatgtgtcactggatccaccttagg

SEQ ID NO: 626141 - DNA, 25 bp, Homo sapien
gtgtcactggatccaccttaggcag

SEQ ID NO: 626142 - DNA, 25 bp, Homo sapien
tcactggatccaccttaggcagtag

SEQ ID NO: 626143 - DNA, 25 bp, Homo sapien
ctggatccaccttaggcagtagagc

SEQ ID NO: 626144 - DNA, 25 bp, Homo sapien
atccaccttaggcagtagagcaaga

SEQ ID NO: 626145 - DNA, 25 bp, Homo sapien
gtagagcaagaacctggtctatctc

SEQ ID NO: 626146 - DNA, 25 bp, Homo sapien
gttaaactgccatgggaactgattt

SEQ ID NO: 626147 - DNA, 25 bp, Homo sapien
gccatgggaactgatttacccagtt

SEQ ID NO: 626148 - DNA, 25 bp, Homo sapien
gatttacccagttttagttcatagc

SEQ ID NO: 626149 - DNA, 25 bp, Homo sapien
acccagttttagttcatagccttca

SEQ ID NO: 626150 - DNA, 25 bp, Homo sapien
agttcatagccttcattgtattatc

SEQ ID NO: 626151 - DNA, 25 bp, Homo sapien
cattgtattatctatcagggcaaaa

SEQ ID NO: 626152 - DNA, 25 bp, Homo sapien
aagttagccgtgtgaacatgttcgt

SEQ ID NO: 626153 - DNA, 25 bp, Homo sapien
attgctatctcatgcctagaattct

SEQ ID NO: 626154 - DNA, 25 bp, Homo sapien
aactattgggtctttgtttgtatat

SEQ ID NO: 626155 - DNA, 25 bp, Homo sapien
atgggtctaaatgttatgtgttgtt

SEQ ID NO: 626156 - DNA, 25 bp, Homo sapien
tttttacagggtacagattggctca

SEQ ID NO: 626157 - DNA, 25 bp, Homo sapien
gaggatatatacacaaaatgaccca

SEQ ID NO: 626158 - DNA, 25 bp, Homo sapien
gtcttttcatcacaggatggcatta

SEQ ID NO: 626159 - DNA, 25 bp, Homo sapien
caggatggcattagctctgtgtctg

SEQ ID NO: 626160 - DNA, 25 bp, Homo sapien
tgtggctggctctcgctctatattt

SEQ ID NO: 626161 - DNA, 25 bp, Homo sapien
tctcgctctatatttctttctgcca

SEQ ID NO: 626162 - DNA, 25 bp, Homo sapien
tttctgccacctgaataagcaccga

SEQ ID NO: 626163 - DNA, 25 bp, Homo sapien
gaagctatgagtggagctgccgcct

SEQ ID NO: 626164 - DNA, 25 bp, Homo sapien
tcacccatggagtcctctctatagg

SEQ ID NO: 626165 - DNA, 25 bp, Homo sapien
tctataggcctctccgcttatattg

SEQ ID NO: 626166 - DNA, 25 bp, Homo sapien
ctctccgcttatattggcttcattg

SEQ ID NO: 626167 - DNA, 25 bp, Homo sapien
tattggcttcattgatggcccatgg

SEQ ID NO: 626168 - DNA, 25 bp, Homo sapien
aggaggtcctcctcaatctcccaag

SEQ ID NO: 626169 - DNA, 25 bp, Homo sapien
tacccaccccacaggaacgatggga

SEQ ID NO: 626170 - DNA, 25 bp, Homo sapien
gaacgatgggaaaacctgcctccct

SEQ ID NO: 626171 - DNA, 25 bp, Homo sapien
ggaaaacctgcctccctctaggagg

SEQ ID NO: 626172 - DNA, 25 bp, Homo sapien
tgctgcgcgggtaaggaacctcgct

SEQ ID NO: 626173 - DNA, 25 bp, Homo sapien
taaggaacctcgctatgccttgctc

SEQ ID NO: 626174 - DNA, 25 bp, Homo sapien
atgccttgctcccatcaacactttt

SEQ ID NO: 626175 - DNA, 25 bp, Homo sapien
caacacttttattctagatttgaag

SEQ ID NO: 626176 - DNA, 25 bp, Homo sapien
tctctgcacaaaagaagtcaacgca

SEQ ID NO: 626177 - DNA, 25 bp, Homo sapien
gaagtcaacgcaggaataaattcca

SEQ ID NO: 626178 - DNA, 25 bp, Homo sapien
aaattccaagatactgaactacctc

SEQ ID NO: 626179 - DNA, 25 bp, Homo sapien
gacagcaatcatcacaactgtaatg

SEQ ID NO: 626180 - DNA, 25 bp, Homo sapien
ttgttgacatttgtctccctggagt

SEQ ID NO: 626181 - DNA, 25 bp, Homo sapien
tccctggagttgcaaaccctcagag

SEQ ID NO: 626182 - DNA, 25 bp, Homo sapien
aaccctcagagaacagggccggtgt

SEQ ID NO: 626183 - DNA, 25 bp, Homo sapien
agggccggtgtccatcttgttcaca

SEQ ID NO: 626184 - DNA, 25 bp, Homo sapien
tgagaagagcccctggcacactgtg

SEQ ID NO: 626185 - DNA, 25 bp, Homo sapien
cccaggaagtctctgctggctagga

SEQ ID NO: 626186 - DNA, 25 bp, Homo sapien
ggctaggaccaaccaaaacctgagt

SEQ ID NO: 626187 - DNA, 25 bp, Homo sapien
aaaacctgagtcttaactgcctgct

SEQ ID NO: 626188 - DNA, 25 bp, Homo sapien
agtcttaactgcctgctctataaaa

SEQ ID NO: 626189 - DNA, 25 bp, Homo sapien
taaaacacctcgttgagctgttgca

SEQ ID NO: 626190 - DNA, 25 bp, Homo sapien
aagagctgcctaagaggcaatgagt

SEQ ID NO: 626191 - DNA, 25 bp, Homo sapien
cttgtgatctgggaactcccaagaa

SEQ ID NO: 626192 - DNA, 25 bp, Homo sapien
tgggaactcccaagaacagcaggcc

SEQ ID NO: 626193 - DNA, 25 bp, Homo sapien
aggcccacctaccttcaaagctgaa

SEQ ID NO: 626194 - DNA, 25 bp, Homo sapien
ttcaaagctgaagccgccaggaccg

SEQ ID NO: 626195 - DNA, 25 bp, Homo sapien
gaagccgccaggaccgccaaagaat

SEQ ID NO: 626196 - DNA, 25 bp, Homo sapien
aggaccgccaaagaatgccttgaag

SEQ ID NO: 626197 - DNA, 25 bp, Homo sapien
atctgtagagcagggcaagtaacat

SEQ ID NO: 626198 - DNA, 25 bp, Homo sapien
gttcgaagagaactgatgacactga

SEQ ID NO: 626199 - DNA, 25 bp, Homo sapien
gatgacactgagaacagatctccaa

SEQ ID NO: 626200 - DNA, 25 bp, Homo sapien
atctccaaagctttcctggagagtc

SEQ ID NO: 626201 - DNA, 25 bp, Homo sapien
ctcgtctctgtgttttgtagatgac

SEQ ID NO: 626202 - DNA, 25 bp, Homo sapien
tcgtctctgtgttttgtagatgacc

SEQ ID NO: 626203 - DNA, 25 bp, Homo sapien
cgtctctgtgttttgtagatgaccg

SEQ ID NO: 626204 - DNA, 25 bp, Homo sapien
gtctctgtgttttgtagatgaccgc

SEQ ID NO: 626205 - DNA, 25 bp, Homo sapien
tctctgtgttttgtagatgaccgca

SEQ ID NO: 626206 - DNA, 25 bp, Homo sapien
ctctgtgttttgtagatgaccgcac

SEQ ID NO: 626207 - DNA, 25 bp, Homo sapien
tctgtgttttgtagatgaccgcacc

SEQ ID NO: 626208 - DNA, 25 bp, Homo sapien
ctgtgttttgtagatgaccgcacct

SEQ ID NO: 626209 - DNA, 25 bp, Homo sapien
tgtgttttgtagatgaccgcacctc

SEQ ID NO: 626210 - DNA, 25 bp, Homo sapien
gtgttttgtagatgaccgcacctcg

SEQ ID NO: 626211 - DNA, 25 bp, Homo sapien
tgttttgtagatgaccgcacctcga

SEQ ID NO: 626212 - DNA, 25 bp, Homo sapien
agacccaggacctgcctgactggga

SEQ ID NO: 626213 - DNA, 25 bp, Homo sapien
agagatgcctccaggcttgggtaga

SEQ ID NO: 626214 - DNA, 25 bp, Homo sapien
atgcctccaggcttgggtagatgaa

SEQ ID NO: 626215 - DNA, 25 bp, Homo sapien
tccaggcttgggtagatgaagccag

SEQ ID NO: 626216 - DNA, 25 bp, Homo sapien
gggcttcctgccttcctggaaggct

SEQ ID NO: 626217 - DNA, 25 bp, Homo sapien
cttcctggaaggcttttccctgtct

SEQ ID NO: 626218 - DNA, 25 bp, Homo sapien
gagtttatgaaagaccagcaggcaa

SEQ ID NO: 626219 - DNA, 25 bp, Homo sapien
gaaagaccagcaggcaatgcggcaa

SEQ ID NO: 626220 - DNA, 25 bp, Homo sapien
gaccagcaggcaatgcggcaataaa

SEQ ID NO: 626221 - DNA, 25 bp, Homo sapien
atgcggcaataaaaaagaccttggg

SEQ ID NO: 626222 - DNA, 25 bp, Homo sapien
gcgggtctggcgctgacatccaacc

SEQ ID NO: 626223 - DNA, 25 bp, Homo sapien
ggccaggtgcaatgagccacatcca

SEQ ID NO: 626224 - DNA, 25 bp, Homo sapien
atgagccacatccataatcccagtg

SEQ ID NO: 626225 - DNA, 25 bp, Homo sapien
gaaaggctaagtcagaaggataaca

SEQ ID NO: 626226 - DNA, 25 bp, Homo sapien
gaaggataacattaggccgggaatt

SEQ ID NO: 626227 - DNA, 25 bp, Homo sapien
gccgggaatttaagacctgcctgag

SEQ ID NO: 626228 - DNA, 25 bp, Homo sapien
acctgcctgagcaacgaagcaagag

SEQ ID NO: 626229 - DNA, 25 bp, Homo sapien
gaagcaagagcgcatctctacaaga

SEQ ID NO: 626230 - DNA, 25 bp, Homo sapien
acaaatagctaggtatggtgatgca

SEQ ID NO: 626231 - DNA, 25 bp, Homo sapien
tctaggatacactgagctaatgatc

SEQ ID NO: 626232 - DNA, 25 bp, Homo sapien
gagctaatgatcctgtaactgcact

SEQ ID NO: 626233 - DNA, 25 bp, Homo sapien
tgatcctgtaactgcactacagtct

SEQ ID NO: 626234 - DNA, 25 bp, Homo sapien
tcctggtaaggaacatatgtctatt

SEQ ID NO: 626235 - DNA, 25 bp, Homo sapien
gtaaggaacatatgtctatttgctt

SEQ ID NO: 626236 - DNA, 25 bp, Homo sapien
gtctatttgcttttcactctcaaga

SEQ ID NO: 626237 - DNA, 25 bp, Homo sapien
tatttgcttttcactctcaagacag

SEQ ID NO: 626238 - DNA, 25 bp, Homo sapien
tgcttttcactctcaagacagtctc

SEQ ID NO: 626239 - DNA, 25 bp, Homo sapien
ttcactctcaagacagtctctttta

SEQ ID NO: 626240 - DNA, 25 bp, Homo sapien
tcttttcaaaacatatcatcttctt

SEQ ID NO: 626241 - DNA, 25 bp, Homo sapien
tcttcatacaatttctcagtgcagc

SEQ ID NO: 626242 - DNA, 25 bp, Homo sapien
tcatacaatttctcagtgcagcaaa

SEQ ID NO: 626243 - DNA, 25 bp, Homo sapien
ttctcagtgcagcaaatttttcctg

SEQ ID NO: 626244 - DNA, 25 bp, Homo sapien
gtgcagcaaatttttcctggtaagg

SEQ ID NO: 626245 - DNA, 25 bp, Homo sapien
tacacctgtacctgacctggaaact

SEQ ID NO: 626246 - DNA, 25 bp, Homo sapien
acacctgtacctgacctggaaactg

SEQ ID NO: 626247 - DNA, 25 bp, Homo sapien
cacctgtacctgacctggaaactga

SEQ ID NO: 626248 - DNA, 25 bp, Homo sapien
acctgtacctgacctggaaactgat

SEQ ID NO: 626249 - DNA, 25 bp, Homo sapien
cctgtacctgacctggaaactgatc

SEQ ID NO: 626250 - DNA, 25 bp, Homo sapien
ctgtacctgacctggaaactgatct

SEQ ID NO: 626251 - DNA, 25 bp, Homo sapien
atgcagagatggtcccgatgacaag

SEQ ID NO: 626252 - DNA, 25 bp, Homo sapien
gggatcctacacctgtacctgacct

SEQ ID NO: 626253 - DNA, 25 bp, Homo sapien
ggatcctacacctgtacctgacctg

SEQ ID NO: 626254 - DNA, 25 bp, Homo sapien
atcctacacctgtacctgacctgga

SEQ ID NO: 626255 - DNA, 25 bp, Homo sapien
cctacacctgtacctgacctggaaa

SEQ ID NO: 626256 - DNA, 25 bp, Homo sapien
gtcaaatactttttcttgactgata

SEQ ID NO: 626257 - DNA, 25 bp, Homo sapien
atactttttcttgactgatattatc

SEQ ID NO: 626258 - DNA, 25 bp, Homo sapien
ctttttcttgactgatattatcatg

SEQ ID NO: 626259 - DNA, 25 bp, Homo sapien
gactgatattatcatgtgatttttc

SEQ ID NO: 626260 - DNA, 25 bp, Homo sapien
atgttagattacattgatctttgaa

SEQ ID NO: 626261 - DNA, 25 bp, Homo sapien
gatctttgaatattgtaccagcctt

SEQ ID NO: 626262 - DNA, 25 bp, Homo sapien
tctttgaatattgtaccagccttgc

SEQ ID NO: 626263 - DNA, 25 bp, Homo sapien
ggttacagtgtataatcaaatatag

SEQ ID NO: 626264 - DNA, 25 bp, Homo sapien
aggattttgtttctatgtataatag

SEQ ID NO: 626265 - DNA, 25 bp, Homo sapien
atgtataatagggatatttttctgt

SEQ ID NO: 626266 - DNA, 25 bp, Homo sapien
ttctgtagattttgtttcgttttgg

SEQ ID NO: 626267 - DNA, 25 bp, Homo sapien
gggatcaagtccaatcaagaaaaag

SEQ ID NO: 626268 - DNA, 25 bp, Homo sapien
aagcccaccacgttttctcaaagag

SEQ ID NO: 626269 - DNA, 25 bp, Homo sapien
gcccaccacgttttctcaaagagaa

SEQ ID NO: 626270 - DNA, 25 bp, Homo sapien
caaaacgtaagcagtcccagtcctg

SEQ ID NO: 626271 - DNA, 25 bp, Homo sapien
aacgtaagcagtcccagtcctgctc

SEQ ID NO: 626272 - DNA, 25 bp, Homo sapien
agatctactcgtcagctcctccgat

SEQ ID NO: 626273 - DNA, 25 bp, Homo sapien
gaaaggcatcccgaacgcatcaggt

SEQ ID NO: 626274 - DNA, 25 bp, Homo sapien
atcccgaacgcatcaggtgcagaga

SEQ ID NO: 626275 - DNA, 25 bp, Homo sapien
aacgcatcaggtgcagagaccggca

SEQ ID NO: 626276 - DNA, 25 bp, Homo sapien
tgcagagaccggcacccaccgagag

SEQ ID NO: 626277 - DNA, 25 bp, Homo sapien
gagcgcacggcgagctccggtgtca

SEQ ID NO: 626278 - DNA, 25 bp, Homo sapien
tgtgcctctttgctgcactgaacac

SEQ ID NO: 626279 - DNA, 25 bp, Homo sapien
tgcctctttgctgcactgaacactt

SEQ ID NO: 626280 - DNA, 25 bp, Homo sapien
gcctctttgctgcactgaacacttg

SEQ ID NO: 626281 - DNA, 25 bp, Homo sapien
ctctttgctgcactgaacacttgtc

SEQ ID NO: 626282 - DNA, 25 bp, Homo sapien
tctttgctgcactgaacacttgtct

SEQ ID NO: 626283 - DNA, 25 bp, Homo sapien
tttgctgcactgaacacttgtctca

SEQ ID NO: 626284 - DNA, 25 bp, Homo sapien
ttgctgcactgaacacttgtctcag

SEQ ID NO: 626285 - DNA, 25 bp, Homo sapien
gctgcactgaacacttgtctcagtc

SEQ ID NO: 626286 - DNA, 25 bp, Homo sapien
ctgcactgaacacttgtctcagtca

SEQ ID NO: 626287 - DNA, 25 bp, Homo sapien
aaagtcagagagacccaatgatgag

SEQ ID NO: 626288 - DNA, 25 bp, Homo sapien
taaaagaaaataccagactgggcgt

SEQ ID NO: 626289 - DNA, 25 bp, Homo sapien
cactgtttcttatagcggtggttta

SEQ ID NO: 626290 - DNA, 25 bp, Homo sapien
tttcttatagcggtggtttaaacag

SEQ ID NO: 626291 - DNA, 25 bp, Homo sapien
tcttatagcggtggtttaaacagag

SEQ ID NO: 626292 - DNA, 25 bp, Homo sapien
atagcggtggtttaaacagaggtgc

SEQ ID NO: 626293 - DNA, 25 bp, Homo sapien
gcggtggtttaaacagaggtgcaaa

SEQ ID NO: 626294 - DNA, 25 bp, Homo sapien
aggtgcaaacagcaagcggatcttg

SEQ ID NO: 626295 - DNA, 25 bp, Homo sapien
aaacagcaagcggatcttgtcgcct

SEQ ID NO: 626296 - DNA, 25 bp, Homo sapien
aacagcaagcggatcttgtcgcctt

SEQ ID NO: 626297 - DNA, 25 bp, Homo sapien
acagcaagcggatcttgtcgccttt

SEQ ID NO: 626298 - DNA, 25 bp, Homo sapien
agcaagcggatcttgtcgcctttgg

SEQ ID NO: 626299 - DNA, 25 bp, Homo sapien
gcaagcggatcttgtcgcctttggg

SEQ ID NO: 626300 - DNA, 25 bp, Homo sapien
acttgagggcactgggcccagatgc

SEQ ID NO: 626301 - DNA, 25 bp, Homo sapien
agatgccacatcaagctgcaccaag

SEQ ID NO: 626302 - DNA, 25 bp, Homo sapien
tctggagccactgagcagcatcaca

SEQ ID NO: 626303 - DNA, 25 bp, Homo sapien
agcatcacactccaagactcttgtt

SEQ ID NO: 626304 - DNA, 25 bp, Homo sapien
tcctgccccgtcctactgagagggt

SEQ ID NO: 626305 - DNA, 25 bp, Homo sapien
agtggtgaggcactctacagagtca

SEQ ID NO: 626306 - DNA, 25 bp, Homo sapien
gtgaggcactctacagagtcactgt

SEQ ID NO: 626307 - DNA, 25 bp, Homo sapien
ggcactctacagagtcactgttcct

SEQ ID NO: 626308 - DNA, 25 bp, Homo sapien
agagtcactgttcctcttggagatt

SEQ ID NO: 626309 - DNA, 25 bp, Homo sapien
ttttgcagctgaggttccttcattt

SEQ ID NO: 626310 - DNA, 25 bp, Homo sapien
gcagctgaggttccttcatttattc

SEQ ID NO: 626311 - DNA, 25 bp, Homo sapien
aatcctctgtaccctaccaattcat

SEQ ID NO: 626312 - DNA, 25 bp, Homo sapien
gcaaccactgatcttgttaccctct

SEQ ID NO: 626313 - DNA, 25 bp, Homo sapien
gatcttgttaccctcttcatagttt

SEQ ID NO: 626314 - DNA, 25 bp, Homo sapien
gttaccctcttcatagtttcacctt

SEQ ID NO: 626315 - DNA, 25 bp, Homo sapien
catgccttttcacggctttgcagct

SEQ ID NO: 626316 - DNA, 25 bp, Homo sapien
ttttcacggctttgcagctcaattc

SEQ ID NO: 626317 - DNA, 25 bp, Homo sapien
ttgcagctcaattctctttggtgct

SEQ ID NO: 626318 - DNA, 25 bp, Homo sapien
tgctaagtaatatgccattgtctgg

SEQ ID NO: 626319 - DNA, 25 bp, Homo sapien
ctggatgtaccccagtttatcccct

SEQ ID NO: 626320 - DNA, 25 bp, Homo sapien
tttatcccctcacctactgaaggat

SEQ ID NO: 626321 - DNA, 25 bp, Homo sapien
ctgaaggatatcttgattgtttcca

SEQ ID NO: 626322 - DNA, 25 bp, Homo sapien
ctctctgaaaagagtgtcctcacag

SEQ ID NO: 626323 - DNA, 25 bp, Homo sapien
gagtgtcctcacaggataccttgag

SEQ ID NO: 626324 - DNA, 25 bp, Homo sapien
gataccttgagcaattgtcctcggt

SEQ ID NO: 626325 - DNA, 25 bp, Homo sapien
tgtcctcggtcacaataaaaatgat

SEQ ID NO: 626326 - DNA, 25 bp, Homo sapien
gatctaacacacttgatttgcagaa

SEQ ID NO: 626327 - DNA, 25 bp, Homo sapien
gctgaaaagtggcataaactggcca

SEQ ID NO: 626328 - DNA, 25 bp, Homo sapien
accccaaaacccatgacacaattat

SEQ ID NO: 626329 - DNA, 25 bp, Homo sapien
gacacaattatcacccaaatgaagg

SEQ ID NO: 626330 - DNA, 25 bp, Homo sapien
aaggtgctgctgttcataatgatgt

SEQ ID NO: 626331 - DNA, 25 bp, Homo sapien
gatgtaggtgtaggagacaatcgta

SEQ ID NO: 626332 - DNA, 25 bp, Homo sapien
gacaatcgtagggatcaaagaacca

SEQ ID NO: 626333 - DNA, 25 bp, Homo sapien
gtgcgccttggtggagcgctctcca

SEQ ID NO: 626334 - DNA, 25 bp, Homo sapien
aagaccctgcaggtttgacagcacc

SEQ ID NO: 626335 - DNA, 25 bp, Homo sapien
gcaccaggtcatgatgtgccctgga

SEQ ID NO: 626336 - DNA, 25 bp, Homo sapien
tgccctggagacagaactgccgctg

SEQ ID NO: 626337 - DNA, 25 bp, Homo sapien
gggtgtgagtgataccatggtacat

SEQ ID NO: 626338 - DNA, 25 bp, Homo sapien
gataccatggtacatagacgcttac

SEQ ID NO: 626339 - DNA, 25 bp, Homo sapien
atagacgcttactatgcccatgtgt

SEQ ID NO: 626340 - DNA, 25 bp, Homo sapien
tatgcccatgtgtcggtaccctgca

SEQ ID NO: 626341 - DNA, 25 bp, Homo sapien
gtaccctgcacacacatttgaagtt

SEQ ID NO: 626342 - DNA, 25 bp, Homo sapien
ttgaagttgggagctcgtttccgca

SEQ ID NO: 626343 - DNA, 25 bp, Homo sapien
agctcgtttccgcagggttcctgtg

SEQ ID NO: 626344 - DNA, 25 bp, Homo sapien
gaaacatctgcatttgaaagactac

SEQ ID NO: 626345 - DNA, 25 bp, Homo sapien
gactacttgtcatttgttgtgtggt

SEQ ID NO: 626346 - DNA, 25 bp, Homo sapien
tgttgtgtggtaatgctaatctttc

SEQ ID NO: 626347 - DNA, 25 bp, Homo sapien
agttatcatactttcctattcccat

SEQ ID NO: 626348 - DNA, 25 bp, Homo sapien
tattcccatgtccttcgagccgtca

SEQ ID NO: 626349 - DNA, 25 bp, Homo sapien
ggaaagtcgtcgcaaggccttcact

SEQ ID NO: 626350 - DNA, 25 bp, Homo sapien
acccgtctgtggtcggactctacta

SEQ ID NO: 626351 - DNA, 25 bp, Homo sapien
gactctactacggtgctgctatgtt

SEQ ID NO: 626352 - DNA, 25 bp, Homo sapien
tacggtgctgctatgttcatgtaca

SEQ ID NO: 626353 - DNA, 25 bp, Homo sapien
agaccagcttctaaacatacgccag

SEQ ID NO: 626354 - DNA, 25 bp, Homo sapien
taaacatacgccagaccaggacaag

SEQ ID NO: 626355 - DNA, 25 bp, Homo sapien
gcagcccccttcctgagagacatgg

SEQ ID NO: 626356 - DNA, 25 bp, Homo sapien
tctgcctagaatgttgtctcagcac

SEQ ID NO: 626357 - DNA, 25 bp, Homo sapien
agaatgttgtctcagcacttctctt

SEQ ID NO: 626358 - DNA, 25 bp, Homo sapien
tctgccttgctgaactttccctaga

SEQ ID NO: 626359 - DNA, 25 bp, Homo sapien
gctgaactttccctagagccaagga

SEQ ID NO: 626360 - DNA, 25 bp, Homo sapien
actttccctagagccaaggaggcct

SEQ ID NO: 626361 - DNA, 25 bp, Homo sapien
caaggaggcctccatacaacctttc

SEQ ID NO: 626362 - DNA, 25 bp, Homo sapien
tcatttggagtcagacttgcactgc

SEQ ID NO: 626363 - DNA, 25 bp, Homo sapien
ggagtcagacttgcactgcagtcta

SEQ ID NO: 626364 - DNA, 25 bp, Homo sapien
tgcactgcagtctaatggtcatccc

SEQ ID NO: 626365 - DNA, 25 bp, Homo sapien
gtctaatggtcatcccacttttttc

SEQ ID NO: 626366 - DNA, 25 bp, Homo sapien
cactccaagactcttgtttcccggc

SEQ ID NO: 626367 - DNA, 25 bp, Homo sapien
ggtctgcacctcagggggcttcagt

SEQ ID NO: 626368 - DNA, 25 bp, Homo sapien
tcctgccccgtcctactgagagggt

SEQ ID NO: 626369 - DNA, 25 bp, Homo sapien
agtggtgaggcactctacagagtca

SEQ ID NO: 626370 - DNA, 25 bp, Homo sapien
tggtgaggcactctacagagtcact

SEQ ID NO: 626371 - DNA, 25 bp, Homo sapien
gtgaggcactctacagagtcactgt

SEQ ID NO: 626372 - DNA, 25 bp, Homo sapien
gaggcactctacagagtcactgttc

SEQ ID NO: 626373 - DNA, 25 bp, Homo sapien
ggcactctacagagtcactgttcct

SEQ ID NO: 626374 - DNA, 25 bp, Homo sapien
ttttgcagctgaggttccttcattt

SEQ ID NO: 626375 - DNA, 25 bp, Homo sapien
ttgcagctgaggttccttcatttat

SEQ ID NO: 626376 - DNA, 25 bp, Homo sapien
gcagctgaggttccttcatttattc

SEQ ID NO: 626377 - DNA, 25 bp, Homo sapien
tcagcgccccgggtagctaagatta

SEQ ID NO: 626378 - DNA, 25 bp, Homo sapien
agcgccccgggtagctaagattaca

SEQ ID NO: 626379 - DNA, 25 bp, Homo sapien
gacgcaaaatgttgctgggtagccc

SEQ ID NO: 626380 - DNA, 25 bp, Homo sapien
gcaaaatgttgctgggtagcccatg

SEQ ID NO: 626381 - DNA, 25 bp, Homo sapien
aatgttgctgggtagcccatgttgc

SEQ ID NO: 626382 - DNA, 25 bp, Homo sapien
tgttgctgggtagcccatgttgccc

SEQ ID NO: 626383 - DNA, 25 bp, Homo sapien
tgctgggtagcccatgttgcccacg

SEQ ID NO: 626384 - DNA, 25 bp, Homo sapien
taggctcaaggggtccagctacctt

SEQ ID NO: 626385 - DNA, 25 bp, Homo sapien
catgcccggcccaggtgattttatt

SEQ ID NO: 626386 - DNA, 25 bp, Homo sapien
tgcccggcccaggtgattttattta

SEQ ID NO: 626387 - DNA, 25 bp, Homo sapien
gcccggcccaggtgattttatttat

SEQ ID NO: 626388 - DNA, 25 bp, Homo sapien
aacactgggagtcccatttcagcat

SEQ ID NO: 626389 - DNA, 25 bp, Homo sapien
ctgggagtcccatttcagcatgaga

SEQ ID NO: 626390 - DNA, 25 bp, Homo sapien
acagacatccaaaccatattaagag

SEQ ID NO: 626391 - DNA, 25 bp, Homo sapien
tccaaaccatattaagagtcatagt

SEQ ID NO: 626392 - DNA, 25 bp, Homo sapien
taagagtcatagtacaagaaacaga

SEQ ID NO: 626393 - DNA, 25 bp, Homo sapien
aacagaaggccaagtattgcacaat

SEQ ID NO: 626394 - DNA, 25 bp, Homo sapien
agaaggccaagtattgcacaatatt

SEQ ID NO: 626395 - DNA, 25 bp, Homo sapien
tgaacaatcttaagtaacctctaaa

SEQ ID NO: 626396 - DNA, 25 bp, Homo sapien
atgaaagaacaagatagtaccaaaa

SEQ ID NO: 626397 - DNA, 25 bp, Homo sapien
gaacaagatagtaccaaaaaataca

SEQ ID NO: 626398 - DNA, 25 bp, Homo sapien
aagcatagagcaatgtactcaatga

SEQ ID NO: 626399 - DNA, 25 bp, Homo sapien
aaagctgaaagatgccttcttgaaa

SEQ ID NO: 626400 - DNA, 25 bp, Homo sapien
aaagatgccttcttgaaacactggc

SEQ ID NO: 626401 - DNA, 25 bp, Homo sapien
gaaacactggcattagcaccacatg

SEQ ID NO: 626402 - DNA, 25 bp, Homo sapien
ttagcaccacatgaagaatatattc

SEQ ID NO: 626403 - DNA, 25 bp, Homo sapien
aagaatatattcagcgccatttgaa

SEQ ID NO: 626404 - DNA, 25 bp, Homo sapien
gcgccatttgaatatagtcagggat

SEQ ID NO: 626405 - DNA, 25 bp, Homo sapien
gtcagggataagatttcctcatcta

SEQ ID NO: 626406 - DNA, 25 bp, Homo sapien
gatttcctcatctagttttatagag

SEQ ID NO: 626407 - DNA, 25 bp, Homo sapien
tatagagccaatattcccaaccagt

SEQ ID NO: 626408 - DNA, 25 bp, Homo sapien
agagccaatattcccaaccagtaag

SEQ ID NO: 626409 - DNA, 25 bp, Homo sapien
ttcccaaccagtaagatttcaagtg

SEQ ID NO: 626410 - DNA, 25 bp, Homo sapien
tagaaagccaaaccacaggtaaggt

SEQ ID NO: 626411 - DNA, 25 bp, Homo sapien
gggactactgtattatttctcttct

SEQ ID NO: 626412 - DNA, 25 bp, Homo sapien
tcttcttctgtgtctttacctccat

SEQ ID NO: 626413 - DNA, 25 bp, Homo sapien
gtgtctttacctccatgggttatga

SEQ ID NO: 626414 - DNA, 25 bp, Homo sapien
gaatttcactgaagcatacgcatgc

SEQ ID NO: 626415 - DNA, 25 bp, Homo sapien
gcatacgcatgctgtgaagatactt

SEQ ID NO: 626416 - DNA, 25 bp, Homo sapien
acttttgcaggtatagttgctccag

SEQ ID NO: 626417 - DNA, 25 bp, Homo sapien
gctgagactgggtattatgtgtata

SEQ ID NO: 626418 - DNA, 25 bp, Homo sapien
atgtgtatagaacactctcatatat

SEQ ID NO: 626419 - DNA, 25 bp, Homo sapien
taaaggcacacatttcagcaaagtg

SEQ ID NO: 626420 - DNA, 25 bp, Homo sapien
atttcagcaaagtgagaggactcca

SEQ ID NO: 626421 - DNA, 25 bp, Homo sapien
tgtgatcttcttcccctcctaaagc

SEQ ID NO: 626422 - DNA, 25 bp, Homo sapien
agctctcttgctctagtatctatgt

SEQ ID NO: 626423 - DNA, 25 bp, Homo sapien
gctctagtatctatgtcaacaaact

SEQ ID NO: 626424 - DNA, 25 bp, Homo sapien
acaaactacttattctatgtgttgg

SEQ ID NO: 626425 - DNA, 25 bp, Homo sapien
tgcatttaacatccttgtccccagc

SEQ ID NO: 626426 - DNA, 25 bp, Homo sapien
ttgtccccagcttgaccatcctttg

SEQ ID NO: 626427 - DNA, 25 bp, Homo sapien
catcctttgctcttacatctttatt

SEQ ID NO: 626428 - DNA, 25 bp, Homo sapien
acttgtagctcccacatgttggcgg

SEQ ID NO: 626429 - DNA, 25 bp, Homo sapien
catgttggcggttgtaatctttttt

SEQ ID NO: 626430 - DNA, 25 bp, Homo sapien
attcatgtacttgcagccatcttca

SEQ ID NO: 626431 - DNA, 25 bp, Homo sapien
gcagccatcttcaatcagctccatg

SEQ ID NO: 626432 - DNA, 25 bp, Homo sapien
cagagaaagaaacacagccaatatt

SEQ ID NO: 626433 - DNA, 25 bp, Homo sapien
gaaagaaacacagccaatattaaaa

SEQ ID NO: 626434 - DNA, 25 bp, Homo sapien
gtgtctccagagataacactcctta

SEQ ID NO: 626435 - DNA, 25 bp, Homo sapien
gtctccagagataacactccttagt

SEQ ID NO: 626436 - DNA, 25 bp, Homo sapien
ctccagagataacactccttagtat

SEQ ID NO: 626437 - DNA, 25 bp, Homo sapien
ccagagataacactccttagtataa

SEQ ID NO: 626438 - DNA, 25 bp, Homo sapien
gagataacactccttagtataacaa

SEQ ID NO: 626439 - DNA, 25 bp, Homo sapien
gataacactccttagtataacaata

SEQ ID NO: 626440 - DNA, 25 bp, Homo sapien
taacactccttagtataacaataaa

SEQ ID NO: 626441 - DNA, 25 bp, Homo sapien
ttattttcacactcacttttaataa

SEQ ID NO: 626442 - DNA, 25 bp, Homo sapien
tttcacactcacttttaataaaaat

SEQ ID NO: 626443 - DNA, 25 bp, Homo sapien
ttggaactaggtaatggacagaggt

SEQ ID NO: 626444 - DNA, 25 bp, Homo sapien
tgcctgtaccaccactgtaccttag

SEQ ID NO: 626445 - DNA, 25 bp, Homo sapien
ctgtaccaccactgtaccttagaag

SEQ ID NO: 626446 - DNA, 25 bp, Homo sapien
tgtaccaccactgtaccttagaagc

SEQ ID NO: 626447 - DNA, 25 bp, Homo sapien
gtaccaccactgtaccttagaagca

SEQ ID NO: 626448 - DNA, 25 bp, Homo sapien
taccaccactgtaccttagaagcag

SEQ ID NO: 626449 - DNA, 25 bp, Homo sapien
accaccactgtaccttagaagcagt

SEQ ID NO: 626450 - DNA, 25 bp, Homo sapien
actgtaccttagaagcagtgatctt

SEQ ID NO: 626451 - DNA, 25 bp, Homo sapien
gtaccttagaagcagtgatcttgca

SEQ ID NO: 626452 - DNA, 25 bp, Homo sapien
accttagaagcagtgatcttgcatt

SEQ ID NO: 626453 - DNA, 25 bp, Homo sapien
cagaggcttataggcaaaagaggct

SEQ ID NO: 626454 - DNA, 25 bp, Homo sapien
aagggttaagttttatgtgactgca

SEQ ID NO: 626455 - DNA, 25 bp, Homo sapien
atgtgactgcaagggtctttcggtc

SEQ ID NO: 626456 - DNA, 25 bp, Homo sapien
tgcaagggtctttcggtctgaggta

SEQ ID NO: 626457 - DNA, 25 bp, Homo sapien
cggtctgaggtaagaattttttcat

SEQ ID NO: 626458 - DNA, 25 bp, Homo sapien
tattttaattgtggtaagaacccat

SEQ ID NO: 626459 - DNA, 25 bp, Homo sapien
aaggagcagttcatctacaatgctt

SEQ ID NO: 626460 - DNA, 25 bp, Homo sapien
cagttcatctacaatgctttcctct

SEQ ID NO: 626461 - DNA, 25 bp, Homo sapien
acaatgctttcctctactggttaga

SEQ ID NO: 626462 - DNA, 25 bp, Homo sapien
tgctttcctctactggttagagcaa

SEQ ID NO: 626463 - DNA, 25 bp, Homo sapien
tcctctactggttagagcaacatca

SEQ ID NO: 626464 - DNA, 25 bp, Homo sapien
gcaacatcagcaagattttaggcag

SEQ ID NO: 626465 - DNA, 25 bp, Homo sapien
gagccccaaagttgtgcttaacagt

SEQ ID NO: 626466 - DNA, 25 bp, Homo sapien
gttctcaatagaagtctacctgggc

SEQ ID NO: 626467 - DNA, 25 bp, Homo sapien
ctacctgggctgtgggccagaacaa

SEQ ID NO: 626468 - DNA, 25 bp, Homo sapien
tattgtggcaaatacattttctaac

SEQ ID NO: 626469 - DNA, 25 bp, Homo sapien
gcacctactgtgttcatatccttat

SEQ ID NO: 626470 - DNA, 25 bp, Homo sapien
atccttattgaactattccacctct

SEQ ID NO: 626471 - DNA, 25 bp, Homo sapien
ctattccacctctagaaatgtatcc

SEQ ID NO: 626472 - DNA, 25 bp, Homo sapien
gtatcctacagatgtacctgctcat

SEQ ID NO: 626473 - DNA, 25 bp, Homo sapien
gtacctgctcatatgcacttgtgta

SEQ ID NO: 626474 - DNA, 25 bp, Homo sapien
gggtatgacttggtccattttgtgc

SEQ ID NO: 626475 - DNA, 25 bp, Homo sapien
cattttgtgctgcaatgactgaata

SEQ ID NO: 626476 - DNA, 25 bp, Homo sapien
ggttagttttctgtggatcgaatca

SEQ ID NO: 626477 - DNA, 25 bp, Homo sapien
atcgaatcacatcaaccacttttac

SEQ ID NO: 626478 - DNA, 25 bp, Homo sapien
acttttactgtgatattcttccctt

SEQ ID NO: 626479 - DNA, 25 bp, Homo sapien
attcttcccttgtatagactctctt

SEQ ID NO: 626480 - DNA, 25 bp, Homo sapien
agactctcttgtgttgatccttata

SEQ ID NO: 626481 - DNA, 25 bp, Homo sapien
tggttctattcatcttctcaggttc

SEQ ID NO: 626482 - DNA, 25 bp, Homo sapien
tctcaggttcagttcaagtctttac

SEQ ID NO: 626483 - DNA, 25 bp, Homo sapien
ggtagtgtcttaatatcttatctct

SEQ ID NO: 626484 - DNA, 25 bp, Homo sapien
gcagtaccacatcatgatgtccaag

SEQ ID NO: 626485 - DNA, 25 bp, Homo sapien
gatgtccaagaaactctgcattcag

SEQ ID NO: 626486 - DNA, 25 bp, Homo sapien
gaaacctgcattccatgattcatgt

SEQ ID NO: 626487 - DNA, 25 bp, Homo sapien
tacagctaagaaaagaccataaaag

SEQ ID NO: 626488 - DNA, 25 bp, Homo sapien
agtgtggatgcatgtaaggtgtaca

SEQ ID NO: 626489 - DNA, 25 bp, Homo sapien
tgtggatgcatgtaaggtgtacaaa

SEQ ID NO: 626490 - DNA, 25 bp, Homo sapien
gcatgtaaggtgtacaaaggaggtt

SEQ ID NO: 626491 - DNA, 25 bp, Homo sapien
gtgtttgacaactactgacagcaag

SEQ ID NO: 626492 - DNA, 25 bp, Homo sapien
gtttgacaactactgacagcaagat

SEQ ID NO: 626493 - DNA, 25 bp, Homo sapien
gacaactactgacagcaagatattt

SEQ ID NO: 626494 - DNA, 25 bp, Homo sapien
actactgacagcaagatatttcagt

SEQ ID NO: 626495 - DNA, 25 bp, Homo sapien
gtctttcataaatttccaaatgtaa

SEQ ID NO: 626496 - DNA, 25 bp, Homo sapien
atgtaaaaaccgtggcaaatcattt

SEQ ID NO: 626497 - DNA, 25 bp, Homo sapien
tgtaaaaaccgtggcaaatcatttt

SEQ ID NO: 626498 - DNA, 25 bp, Homo sapien
tgctgaccaccagcatgatggtgtt

SEQ ID NO: 626499 - DNA, 25 bp, Homo sapien
atgagcagtgaacttgtgcaagcta

SEQ ID NO: 626500 - DNA, 25 bp, Homo sapien
gaacttgtgcaagctaactttagca

SEQ ID NO: 626501 - DNA, 25 bp, Homo sapien
gctaactttagcaccgccagaattt

SEQ ID NO: 626502 - DNA, 25 bp, Homo sapien
gcaccgccagaatttcacacgtgaa

SEQ ID NO: 626503 - DNA, 25 bp, Homo sapien
aagtgatcgatgagattcccacaga

SEQ ID NO: 626504 - DNA, 25 bp, Homo sapien
atctgcagggcaaaactggtttcca

SEQ ID NO: 626505 - DNA, 25 bp, Homo sapien
agcagagcggtcaggcaacccgtca

SEQ ID NO: 626506 - DNA, 25 bp, Homo sapien
gtgcacagacgcacctgttcatgat

SEQ ID NO: 626507 - DNA, 25 bp, Homo sapien
agacgcacctgttcatgatgatgga

SEQ ID NO: 626508 - DNA, 25 bp, Homo sapien
aaactaagggcattggaattggcaa

SEQ ID NO: 626509 - DNA, 25 bp, Homo sapien
tgcattcagagagctattcaacaga

SEQ ID NO: 626510 - DNA, 25 bp, Homo sapien
agaacttaagctcaatcccggaatt

SEQ ID NO: 626511 - DNA, 25 bp, Homo sapien
gaatcctggctatgcaggacactct

SEQ ID NO: 626512 - DNA, 25 bp, Homo sapien
aggacactctgaattgccggacaat

SEQ ID NO: 626513 - DNA, 25 bp, Homo sapien
tgccggacaatcttaaggttctttt

SEQ ID NO: 626514 - DNA, 25 bp, Homo sapien
gatggttccaaactatgcgcttata

SEQ ID NO: 626515 - DNA, 25 bp, Homo sapien
gcgcttatagcagaaatctccctct

SEQ ID NO: 626516 - DNA, 25 bp, Homo sapien
atctccctctactcttacggatttt

SEQ ID NO: 626517 - DNA, 25 bp, Homo sapien
gatttttgaatgcaagacctctgtc

SEQ ID NO: 626518 - DNA, 25 bp, Homo sapien
agacctctgtctgtgaaaatagtaa

SEQ ID NO: 626519 - DNA, 25 bp, Homo sapien
gacctataggctttgctcagagcag

SEQ ID NO: 626520 - DNA, 25 bp, Homo sapien
aaacctggagttctagatatcatca

SEQ ID NO: 626521 - DNA, 25 bp, Homo sapien
gacatcatcacaataagtactccca

SEQ ID NO: 626522 - DNA, 25 bp, Homo sapien
taagtactcccattgtattcagccc

SEQ ID NO: 626523 - DNA, 25 bp, Homo sapien
gtattcagccctaaccgtatggtag

SEQ ID NO: 626524 - DNA, 25 bp, Homo sapien
ggtagcaactttatggtattccctt

SEQ ID NO: 626525 - DNA, 25 bp, Homo sapien
gatgataggtttgttgactcactca

SEQ ID NO: 626526 - DNA, 25 bp, Homo sapien
ttgactcactcaaggcggtgggact

SEQ ID NO: 626527 - DNA, 25 bp, Homo sapien
tcaaggcggtgggactctccagcag

SEQ ID NO: 626528 - DNA, 25 bp, Homo sapien
aggtatcaggcacagcatctgcttc

SEQ ID NO: 626529 - DNA, 25 bp, Homo sapien
ttcaaagaacacatcgacgacaggg

SEQ ID NO: 626530 - DNA, 25 bp, Homo sapien
ccttgcactcactcaggacaggaga

SEQ ID NO: 626531 - DNA, 25 bp, Homo sapien
tggccatggcaatgactccggagaa

SEQ ID NO: 626532 - DNA, 25 bp, Homo sapien
ggttaacagcaacaactcattcatg

SEQ ID NO: 626533 - DNA, 25 bp, Homo sapien
aactcattcatggaggtgtcagaac

SEQ ID NO: 626534 - DNA, 25 bp, Homo sapien
tcagaacatgacagctttagcagtg

SEQ ID NO: 626535 - DNA, 25 bp, Homo sapien
gtggctgacagcatttagcctacaa

SEQ ID NO: 626536 - DNA, 25 bp, Homo sapien
aggacagtctcctcaagctgattgt

SEQ ID NO: 626537 - DNA, 25 bp, Homo sapien
tgttaactattccacctatccatga

SEQ ID NO: 626538 - DNA, 25 bp, Homo sapien
attccacctatccatgatcctgtga

SEQ ID NO: 626539 - DNA, 25 bp, Homo sapien
tgtgacaagctccacacactttcta

SEQ ID NO: 626540 - DNA, 25 bp, Homo sapien
ctttctatcagacatggctacagtg

SEQ ID NO: 626541 - DNA, 25 bp, Homo sapien
ggatccttaggctagcaaaagcaat

SEQ ID NO: 626542 - DNA, 25 bp, Homo sapien
aaacctggtctctattgaaaataca

SEQ ID NO: 626543 - DNA, 25 bp, Homo sapien
aacctggtctctattgaaaatacaa

SEQ ID NO: 626544 - DNA, 25 bp, Homo sapien
acctggtctctattgaaaatacaaa

SEQ ID NO: 626545 - DNA, 25 bp, Homo sapien
cctggtctctattgaaaatacaaaa

SEQ ID NO: 626546 - DNA, 25 bp, Homo sapien
cagacgtggtggcacgcgcctgtgg

SEQ ID NO: 626547 - DNA, 25 bp, Homo sapien
agacgtggtggcacgcgcctgtggt

SEQ ID NO: 626548 - DNA, 25 bp, Homo sapien
acggtgaaacctggtctctattgaa

SEQ ID NO: 626549 - DNA, 25 bp, Homo sapien
cggtgaaacctggtctctattgaaa

SEQ ID NO: 626550 - DNA, 25 bp, Homo sapien
ggtgaaacctggtctctattgaaaa

SEQ ID NO: 626551 - DNA, 25 bp, Homo sapien
gtgaaacctggtctctattgaaaat

SEQ ID NO: 626552 - DNA, 25 bp, Homo sapien
gaaacctggtctctattgaaaatac

SEQ ID NO: 626553 - DNA, 25 bp, Homo sapien
ctctccggtatgcattctgtgatga

SEQ ID NO: 626554 - DNA, 25 bp, Homo sapien
gatgacttgcaagatttgaactctg

SEQ ID NO: 626555 - DNA, 25 bp, Homo sapien
tttgaactctgcctgaagaccttgc

SEQ ID NO: 626556 - DNA, 25 bp, Homo sapien
attacatttgtaacgcttttctcca

SEQ ID NO: 626557 - DNA, 25 bp, Homo sapien
tttctccagtgtggattgccatatg

SEQ ID NO: 626558 - DNA, 25 bp, Homo sapien
gtagttagacttgatcttaccctaa

SEQ ID NO: 626559 - DNA, 25 bp, Homo sapien
tgatcttaccctaaaggctttccca

SEQ ID NO: 626560 - DNA, 25 bp, Homo sapien
tcccacactctgtacacctgtaagg

SEQ ID NO: 626561 - DNA, 25 bp, Homo sapien
aattcttcggtgatttgccaggtga

SEQ ID NO: 626562 - DNA, 25 bp, Homo sapien
gtctctcagggatggcactctatgg

SEQ ID NO: 626563 - DNA, 25 bp, Homo sapien
ttgaatgtcctctaaaggcttttcc

SEQ ID NO: 626564 - DNA, 25 bp, Homo sapien
ttggaactaggtaatggacagaggt

SEQ ID NO: 626565 - DNA, 25 bp, Homo sapien
gaaggtttggaccatcttagagact

SEQ ID NO: 626566 - DNA, 25 bp, Homo sapien
ggttgtgaccaaaatcctgacagaa

SEQ ID NO: 626567 - DNA, 25 bp, Homo sapien
tgcctgtaccaccactgtaccttag

SEQ ID NO: 626568 - DNA, 25 bp, Homo sapien
ctgtaccaccactgtaccttagaag

SEQ ID NO: 626569 - DNA, 25 bp, Homo sapien
gtaccaccactgtaccttagaagca

SEQ ID NO: 626570 - DNA, 25 bp, Homo sapien
accaccactgtaccttagaagcagt

SEQ ID NO: 626571 - DNA, 25 bp, Homo sapien
gtaccttagaagcagtgatcttgca

SEQ ID NO: 626572 - DNA, 25 bp, Homo sapien
accttagaagcagtgatcttgcatt

SEQ ID NO: 626573 - DNA, 25 bp, Homo sapien
gcattttatttcagaggcttatagg

SEQ ID NO: 626574 - DNA, 25 bp, Homo sapien
cagaggcttataggcaaaagaggct

SEQ ID NO: 626575 - DNA, 25 bp, Homo sapien
tacacctgtacctgacctggaaact

SEQ ID NO: 626576 - DNA, 25 bp, Homo sapien
acacctgtacctgacctggaaactg

SEQ ID NO: 626577 - DNA, 25 bp, Homo sapien
acctgtacctgacctggaaactgat

SEQ ID NO: 626578 - DNA, 25 bp, Homo sapien
cctgtacctgacctggaaactgatc

SEQ ID NO: 626579 - DNA, 25 bp, Homo sapien
ctgtacctgacctggaaactgatct

SEQ ID NO: 626580 - DNA, 25 bp, Homo sapien
gatgaatgcagagatggtcccgatg

SEQ ID NO: 626581 - DNA, 25 bp, Homo sapien
atgcagagatggtcccgatgacaag

SEQ ID NO: 626582 - DNA, 25 bp, Homo sapien
gattgggcctatgctggagcccagt

SEQ ID NO: 626583 - DNA, 25 bp, Homo sapien
gggatcctacacctgtacctgacct

SEQ ID NO: 626584 - DNA, 25 bp, Homo sapien
atcctacacctgtacctgacctgga

SEQ ID NO: 626585 - DNA, 25 bp, Homo sapien
cctacacctgtacctgacctggaaa

SEQ ID NO: 626586 - DNA, 25 bp, Homo sapien
agatcccggtggacccggacacagc

SEQ ID NO: 626587 - DNA, 25 bp, Homo sapien
ttccaggggctgtcttgccatgtcc

SEQ ID NO: 626588 - DNA, 25 bp, Homo sapien
atgtcccttcccagatctgcctgga

SEQ ID NO: 626589 - DNA, 25 bp, Homo sapien
atctgcctggattcatgccaggcca

SEQ ID NO: 626590 - DNA, 25 bp, Homo sapien
aggccaccctccacaatttgctgag

SEQ ID NO: 626591 - DNA, 25 bp, Homo sapien
agggcacccagagtgctaactagcc

SEQ ID NO: 626592 - DNA, 25 bp, Homo sapien
tgtgtgggggatactactctctgcc

SEQ ID NO: 626593 - DNA, 25 bp, Homo sapien
agagggacccagtcttctcctcagc

SEQ ID NO: 626594 - DNA, 25 bp, Homo sapien
agtcttctcctcagcagctgcttga

SEQ ID NO: 626595 - DNA, 25 bp, Homo sapien
cagctgcttgaggacagtattagcg

SEQ ID NO: 626596 - DNA, 25 bp, Homo sapien
aggacagtattagcggtcccctcaa

SEQ ID NO: 626597 - DNA, 25 bp, Homo sapien
aaggccaattgctggtgatatttta

SEQ ID NO: 626598 - DNA, 25 bp, Homo sapien
aacatgtgtcacagaacaaggaaga

SEQ ID NO: 626599 - DNA, 25 bp, Homo sapien
acaaggaagaggatgacgtgcaaat

SEQ ID NO: 626600 - DNA, 25 bp, Homo sapien
atgacgtgcaaatagtaagcatctt

SEQ ID NO: 626601 - DNA, 25 bp, Homo sapien
gtaagcatcttaatattccccaaac

SEQ ID NO: 626602 - DNA, 25 bp, Homo sapien
ccaggtgtggttctgaccaaatcta

SEQ ID NO: 626603 - DNA, 25 bp, Homo sapien
tgaccaaatctacttcattgccatc

SEQ ID NO: 626604 - DNA, 25 bp, Homo sapien
aaatctacttcattgccatctctat

SEQ ID NO: 626605 - DNA, 25 bp, Homo sapien
ttgccatctctatctcaactagaat

SEQ ID NO: 626606 - DNA, 25 bp, Homo sapien
gacttaaaagacctattttgcggag

SEQ ID NO: 626607 - DNA, 25 bp, Homo sapien
ttttgcggagaatatcacacatagg

SEQ ID NO: 626608 - DNA, 25 bp, Homo sapien
aacaagtccaggactacactcctct

SEQ ID NO: 626609 - DNA, 25 bp, Homo sapien
tgcctctccacgttgatctgcagct

SEQ ID NO: 626610 - DNA, 25 bp, Homo sapien
tgatctgcagcttctagagaagact

SEQ ID NO: 626611 - DNA, 25 bp, Homo sapien
ctgagcaaagagatgctggtgtctt

SEQ ID NO: 626612 - DNA, 25 bp, Homo sapien
tgctggtgtctttgacttcagggaa

SEQ ID NO: 626613 - DNA, 25 bp, Homo sapien
acttcagggaagagcaatgtcaagg

SEQ ID NO: 626614 - DNA, 25 bp, Homo sapien
aatgtcaaggagagaggccagcaga

SEQ ID NO: 626615 - DNA, 25 bp, Homo sapien
ttaaatctctattcacctgtcactg

SEQ ID NO: 626616 - DNA, 25 bp, Homo sapien
ccagcctgccattgtggtgggtgaa

SEQ ID NO: 626617 - DNA, 25 bp, Homo sapien
gtgggtgaagacaacatttagggat

SEQ ID NO: 626618 - DNA, 25 bp, Homo sapien
acatttagggattctagtgctagta

SEQ ID NO: 626619 - DNA, 25 bp, Homo sapien
atatacgtgtagctcatgtatttca

SEQ ID NO: 626620 - DNA, 25 bp, Homo sapien
ggtgatgtttttgtgcccagcaaca

SEQ ID NO: 626621 - DNA, 25 bp, Homo sapien
ttttgtgcccagcaacatgctgtag

SEQ ID NO: 626622 - DNA, 25 bp, Homo sapien
acatgctgtaggaatttaactcttg

SEQ ID NO: 626623 - DNA, 25 bp, Homo sapien
tcttgtttacatccattagcctcat

SEQ ID NO: 626624 - DNA, 25 bp, Homo sapien
attagcctcatggttttgcttcaag

SEQ ID NO: 626625 - DNA, 25 bp, Homo sapien
catggttttgcttcaagtctcagct

SEQ ID NO: 626626 - DNA, 25 bp, Homo sapien
caagtctcagcttccaagaacctat

SEQ ID NO: 626627 - DNA, 25 bp, Homo sapien
gaacctatcgatgacttactgtgca

SEQ ID NO: 626628 - DNA, 25 bp, Homo sapien
tcgatgacttactgtgcatggtctg

SEQ ID NO: 626629 - DNA, 25 bp, Homo sapien
gtgcatggtctgagactaagtaaag

SEQ ID NO: 626630 - DNA, 25 bp, Homo sapien
tctccagtgtagacttttatatgtt

SEQ ID NO: 626631 - DNA, 25 bp, Homo sapien
tttgtaagagttgagctctgactga

SEQ ID NO: 626632 - DNA, 25 bp, Homo sapien
agttgagctctgactgaaggcttca

SEQ ID NO: 626633 - DNA, 25 bp, Homo sapien
tgagctctgactgaaggcttcacca

SEQ ID NO: 626634 - DNA, 25 bp, Homo sapien
gactgaaggcttcaccacattcttt

SEQ ID NO: 626635 - DNA, 25 bp, Homo sapien
aaggcttcaccacattctttacact

SEQ ID NO: 626636 - DNA, 25 bp, Homo sapien
gcttcaccacattctttacacttgt

SEQ ID NO: 626637 - DNA, 25 bp, Homo sapien
aggctttcctacagtctttacaggt

SEQ ID NO: 626638 - DNA, 25 bp, Homo sapien
gctttcctacagtctttacaggtgt

SEQ ID NO: 626639 - DNA, 25 bp, Homo sapien
tacagtctttacaggtgtagggttt

SEQ ID NO: 626640 - DNA, 25 bp, Homo sapien
gtttctctccagtgtagacttttat

SEQ ID NO: 626641 - DNA, 25 bp, Homo sapien
tggcatgaaacttgagctttaaaac

SEQ ID NO: 626642 - DNA, 25 bp, Homo sapien
gcatgaaacttgagctttaaaacac

SEQ ID NO: 626643 - DNA, 25 bp, Homo sapien
gaaacttgagctttaaaacacacca

SEQ ID NO: 626644 - DNA, 25 bp, Homo sapien
aaacttgagctttaaaacacaccag

SEQ ID NO: 626645 - DNA, 25 bp, Homo sapien
acttgagctttaaaacacaccaggg

SEQ ID NO: 626646 - DNA, 25 bp, Homo sapien
cttgagctttaaaacacaccagggg

SEQ ID NO: 626647 - DNA, 25 bp, Homo sapien
ttgagctttaaaacacaccaggggc

SEQ ID NO: 626648 - DNA, 25 bp, Homo sapien
tgagctttaaaacacaccaggggcc

SEQ ID NO: 626649 - DNA, 25 bp, Homo sapien
gagctttaaaacacaccaggggcca

SEQ ID NO: 626650 - DNA, 25 bp, Homo sapien
agctttaaaacacaccaggggccag

SEQ ID NO: 626651 - DNA, 25 bp, Homo sapien
gctttaaaacacaccaggggccagg

SEQ ID NO: 626652 - DNA, 25 bp, Homo sapien
gcacctcttatgcttgctttgaaaa

SEQ ID NO: 626653 - DNA, 25 bp, Homo sapien
gcttgctttgaaaatatacttatga

SEQ ID NO: 626654 - DNA, 25 bp, Homo sapien
atacttatgaggttagtgcccatct

SEQ ID NO: 626655 - DNA, 25 bp, Homo sapien
tatgaggttagtgcccatcttcctg

SEQ ID NO: 626656 - DNA, 25 bp, Homo sapien
cccatcttcctgtcttatgattcga

SEQ ID NO: 626657 - DNA, 25 bp, Homo sapien
tatgattcgaatcctttccttcttt

SEQ ID NO: 626658 - DNA, 25 bp, Homo sapien
tccttctttcttccctaattcctgt

SEQ ID NO: 626659 - DNA, 25 bp, Homo sapien
tgttctttttctctcatgacccctg

SEQ ID NO: 626660 - DNA, 25 bp, Homo sapien
ctggctacccattagcctttggaaa

SEQ ID NO: 626661 - DNA, 25 bp, Homo sapien
aagagaaggatcttggatctcacac

SEQ ID NO: 626662 - DNA, 25 bp, Homo sapien
atttcaggcgaatccacagagtaaa

SEQ ID NO: 626663 - DNA, 25 bp, Homo sapien
aaagtgtttgttagttgtcggctgg

SEQ ID NO: 626664 - DNA, 25 bp, Homo sapien
aagtgtttgttagttgtcggctggg

SEQ ID NO: 626665 - DNA, 25 bp, Homo sapien
agtgtttgttagttgtcggctgggc

SEQ ID NO: 626666 - DNA, 25 bp, Homo sapien
gtgtttgttagttgtcggctgggcg

SEQ ID NO: 626667 - DNA, 25 bp, Homo sapien
tgtttgttagttgtcggctgggcgt

SEQ ID NO: 626668 - DNA, 25 bp, Homo sapien
gtttgttagttgtcggctgggcgtg

SEQ ID NO: 626669 - DNA, 25 bp, Homo sapien
tttgttagttgtcggctgggcgtgg

SEQ ID NO: 626670 - DNA, 25 bp, Homo sapien
ttgttagttgtcggctgggcgtggt

SEQ ID NO: 626671 - DNA, 25 bp, Homo sapien
cgggagaatggcgaatggcgtgaac

SEQ ID NO: 626672 - DNA, 25 bp, Homo sapien
gggagaatggcgaatggcgtgaacc

SEQ ID NO: 626673 - DNA, 25 bp, Homo sapien
ggagaatggcgaatggcgtgaaccc

SEQ ID NO: 626674 - DNA, 25 bp, Homo sapien
tatgttgaccctagcctgcacggat

SEQ ID NO: 626675 - DNA, 25 bp, Homo sapien
tagcctgcacggatacctgggtcta

SEQ ID NO: 626676 - DNA, 25 bp, Homo sapien
cctgcacggatacctgggtctatga

SEQ ID NO: 626677 - DNA, 25 bp, Homo sapien
tgcacggatacctgggtctatgagt

SEQ ID NO: 626678 - DNA, 25 bp, Homo sapien
gatacctgggtctatgagtgcacgg

SEQ ID NO: 626679 - DNA, 25 bp, Homo sapien
ctgggtctatgagtgcacggtgttt

SEQ ID NO: 626680 - DNA, 25 bp, Homo sapien
gagtgcacggtgtttttgagcacca

SEQ ID NO: 626681 - DNA, 25 bp, Homo sapien
gtgcacggtgtttttgagcaccacc

SEQ ID NO: 626682 - DNA, 25 bp, Homo sapien
ccatttttcttgtgtttcccttcat

SEQ ID NO: 626683 - DNA, 25 bp, Homo sapien
ttttcttgtgtttcccttcatttgt

SEQ ID NO: 626684 - DNA, 25 bp, Homo sapien
gtgtgtgcactgatgataacaggat

SEQ ID NO: 626685 - DNA, 25 bp, Homo sapien
tttctgcaagtctgggtgagacgca

SEQ ID NO: 626686 - DNA, 25 bp, Homo sapien
aggtgcagcgcatggctcctataag

SEQ ID NO: 626687 - DNA, 25 bp, Homo sapien
ggctcctataagcacctgcaccagg

SEQ ID NO: 626688 - DNA, 25 bp, Homo sapien
aggcacctgcctcattgaggtgtaa

SEQ ID NO: 626689 - DNA, 25 bp, Homo sapien
agatgctcagtctagtttatcccca

SEQ ID NO: 626690 - DNA, 25 bp, Homo sapien
tcagtctagtttatccccatgggat

SEQ ID NO: 626691 - DNA, 25 bp, Homo sapien
atccccatgggatccagattctctt

SEQ ID NO: 626692 - DNA, 25 bp, Homo sapien
gcccatgttcactctagcttttctg

SEQ ID NO: 626693 - DNA, 25 bp, Homo sapien
gaaatttcaagaccaataccagaca

SEQ ID NO: 626694 - DNA, 25 bp, Homo sapien
gttagactccttcatagaccttttc

SEQ ID NO: 626695 - DNA, 25 bp, Homo sapien
agaccttttcccatgctcacaattt

SEQ ID NO: 626696 - DNA, 25 bp, Homo sapien
ctgagttacttgcagatcttggtgg

SEQ ID NO: 626697 - DNA, 25 bp, Homo sapien
atcttggtggtcagctgggtctatt

SEQ ID NO: 626698 - DNA, 25 bp, Homo sapien
gggccagtctgatcacgatcataga

SEQ ID NO: 626699 - DNA, 25 bp, Homo sapien
atatctattcaccaatttctactgg

SEQ ID NO: 626700 - DNA, 25 bp, Homo sapien
ctactggatatgcattttctttttg

SEQ ID NO: 626701 - DNA, 25 bp, Homo sapien
ctgaagatatctgaaatgacccagt

SEQ ID NO: 626702 - DNA, 25 bp, Homo sapien
gtggactcctccacctcagaatcat

SEQ ID NO: 626703 - DNA, 25 bp, Homo sapien
agtttccttttcatgataccttcag

SEQ ID NO: 626704 - DNA, 25 bp, Homo sapien
gataccttcagatttatcttgacta

SEQ ID NO: 626705 - DNA, 25 bp, Homo sapien
aattcattgttacgtcacttttcta

SEQ ID NO: 626706 - DNA, 25 bp, Homo sapien
acgtcacttttctatagttttgaga

SEQ ID NO: 626707 - DNA, 25 bp, Homo sapien
ggagcctgaccatgtgactgaagtg

SEQ ID NO: 626708 - DNA, 25 bp, Homo sapien
gcctgaccatgtgactgaagtgcct

SEQ ID NO: 626709 - DNA, 25 bp, Homo sapien
gaccatgtgactgaagtgcctccat

SEQ ID NO: 626710 - DNA, 25 bp, Homo sapien
tgactgaagtgcctccatcacatga

SEQ ID NO: 626711 - DNA, 25 bp, Homo sapien
gaagtgcctccatcacatgataaag

SEQ ID NO: 626712 - DNA, 25 bp, Homo sapien
atgagaaggtgctccttttggatga

SEQ ID NO: 626713 - DNA, 25 bp, Homo sapien
aaggtgctccttttggatgagcaaa

SEQ ID NO: 626714 - DNA, 25 bp, Homo sapien
aaagcagcggcatggtttgaaaggc

SEQ ID NO: 626715 - DNA, 25 bp, Homo sapien
catggtttgaaaggcctgactccaa

SEQ ID NO: 626716 - DNA, 25 bp, Homo sapien
ggtttgaaaggcctgactccaattt

SEQ ID NO: 626717 - DNA, 25 bp, Homo sapien
ttgaaaggcctgactccaattttga

SEQ ID NO: 626718 - DNA, 25 bp, Homo sapien
aaagtatttagctcctgtgcaggta

SEQ ID NO: 626719 - DNA, 25 bp, Homo sapien
ttagctcctgtgcaggtaaaccagc

SEQ ID NO: 626720 - DNA, 25 bp, Homo sapien
gtgcaggtaaaccagctgtgttctt

SEQ ID NO: 626721 - DNA, 25 bp, Homo sapien
agctgtgttcttccacctttcttgt

SEQ ID NO: 626722 - DNA, 25 bp, Homo sapien
cttccacctttcttgttgttgatct

SEQ ID NO: 626723 - DNA, 25 bp, Homo sapien
gtaagtatgactcaggaatgaagtt

SEQ ID NO: 626724 - DNA, 25 bp, Homo sapien
gtgcatgtgtgctcctcttagtcag

SEQ ID NO: 626725 - DNA, 25 bp, Homo sapien
tcttagtcagcctcttggtgttgcg

SEQ ID NO: 626726 - DNA, 25 bp, Homo sapien
tggtgttgcgctcagccaatggaat

SEQ ID NO: 626727 - DNA, 25 bp, Homo sapien
tgcgctcagccaatggaattgcaaa

SEQ ID NO: 626728 - DNA, 25 bp, Homo sapien
gaattgcaaagtatttagctcctgt

SEQ ID NO: 626729 - DNA, 25 bp, Homo sapien
gggcatgaggcccacactgatgaac

SEQ ID NO: 626730 - DNA, 25 bp, Homo sapien
tctccagggctgaggtatctgcaca

SEQ ID NO: 626731 - DNA, 25 bp, Homo sapien
aggtatctgcacaagccagcttcag

SEQ ID NO: 626732 - DNA, 25 bp, Homo sapien
agcttcagcatgactgggatatcac

SEQ ID NO: 626733 - DNA, 25 bp, Homo sapien
cggaaataatagtccacctcattgg

SEQ ID NO: 626734 - DNA, 25 bp, Homo sapien
gaaaggtggcctgaatgcagccgaa

SEQ ID NO: 626735 - DNA, 25 bp, Homo sapien
atgcagccgaagaatgaggtcccca

SEQ ID NO: 626736 - DNA, 25 bp, Homo sapien
tgaggtccccatggctaggatgata

SEQ ID NO: 626737 - DNA, 25 bp, Homo sapien
aggatgatacatgctctgtggctca

SEQ ID NO: 626738 - DNA, 25 bp, Homo sapien
ctgtggctcatgattatggtgtagc

SEQ ID NO: 626739 - DNA, 25 bp, Homo sapien
gatggagaagacgatgccactgtag

SEQ ID NO: 626740 - DNA, 25 bp, Homo sapien
ccccatttcttctgtgatcttgttg

SEQ ID NO: 626741 - DNA, 25 bp, Homo sapien
tgtgatcttgttgccctactcaagc

SEQ ID NO: 626742 - DNA, 25 bp, Homo sapien
tactcaagctctcatgctcagacat

SEQ ID NO: 626743 - DNA, 25 bp, Homo sapien
gctggtcattttcacagtgggacag

SEQ ID NO: 626744 - DNA, 25 bp, Homo sapien
tttcacagtgggacaggcagtcatt

SEQ ID NO: 626745 - DNA, 25 bp, Homo sapien
gcagtcattactctaccactaatat

SEQ ID NO: 626746 - DNA, 25 bp, Homo sapien
accactaatatgcatcttgatctct

SEQ ID NO: 626747 - DNA, 25 bp, Homo sapien
cttgatctcttatggccacattggg

SEQ ID NO: 626748 - DNA, 25 bp, Homo sapien
accactatcatgaaagagggactgt

SEQ ID NO: 626749 - DNA, 25 bp, Homo sapien
ggactgtgtaacttactagtcactg

SEQ ID NO: 626750 - DNA, 25 bp, Homo sapien
aacttactagtcactgtgtcctgga

SEQ ID NO: 626751 - DNA, 25 bp, Homo sapien
tccagtggttctttgcagaggttgc

SEQ ID NO: 626752 - DNA, 25 bp, Homo sapien
ttgcagaggttgcttttatccatat

SEQ ID NO: 626753 - DNA, 25 bp, Homo sapien
tgaagccaacaataatttgcccaag

SEQ ID NO: 626754 - DNA, 25 bp, Homo sapien
tttgcccaagactacacagtaaagg

SEQ ID NO: 626755 - DNA, 25 bp, Homo sapien
agtaggtattcaacccaggtctgcc

SEQ ID NO: 626756 - DNA, 25 bp, Homo sapien
gagaccatgctctggctagaagaga

SEQ ID NO: 626757 - DNA, 25 bp, Homo sapien
gaggatgatgcaggataccatagaa

SEQ ID NO: 626758 - DNA, 25 bp, Homo sapien
aacggagatgtttactggtcatgcc

SEQ ID NO: 626759 - DNA, 25 bp, Homo sapien
tttactggtcatgccgttggaggat

SEQ ID NO: 626760 - DNA, 25 bp, Homo sapien
catgccgttggaggatcagggaccc

SEQ ID NO: 626761 - DNA, 25 bp, Homo sapien
tggaggatcagggacccactctttt

SEQ ID NO: 626762 - DNA, 25 bp, Homo sapien
accatacgctggcatcgaaaacact

SEQ ID NO: 626763 - DNA, 25 bp, Homo sapien
ttggcgggaatcacctgaaacagct

SEQ ID NO: 626764 - DNA, 25 bp, Homo sapien
gaatcacctgaaacagcttccagag

SEQ ID NO: 626765 - DNA, 25 bp, Homo sapien
acctgaaacagcttccagagtgtat

SEQ ID NO: 626766 - DNA, 25 bp, Homo sapien
gtatggaggacgttcttacactccc

SEQ ID NO: 626767 - DNA, 25 bp, Homo sapien
tggaggacgttcttacactcccact

SEQ ID NO: 626768 - DNA, 25 bp, Homo sapien
tccatccaagccaaggtctccttag

SEQ ID NO: 626769 - DNA, 25 bp, Homo sapien
aagccaaggtctccttaggccttca

SEQ ID NO: 626770 - DNA, 25 bp, Homo sapien
ttaggccttcagacgaccttttgta

SEQ ID NO: 626771 - DNA, 25 bp, Homo sapien
ggccttcagacgaccttttgtatga

SEQ ID NO: 626772 - DNA, 25 bp, Homo sapien
cttcagacgaccttttgtatgatct

SEQ ID NO: 626773 - DNA, 25 bp, Homo sapien
atcatggacaccacgatgatgtggg

SEQ ID NO: 626774 - DNA, 25 bp, Homo sapien
tggtgcaggtggaagctgccttcct

SEQ ID NO: 626775 - DNA, 25 bp, Homo sapien
tttcccgagtgggacctcagcatca

SEQ ID NO: 626776 - DNA, 25 bp, Homo sapien
ctcagcatcaccaggatgacagtat

SEQ ID NO: 626777 - DNA, 25 bp, Homo sapien
agatgataactagcagcccactgtt

SEQ ID NO: 626778 - DNA, 25 bp, Homo sapien
agcagcccactgttgaagatcatga

SEQ ID NO: 626779 - DNA, 25 bp, Homo sapien
gaggtatcagtgcaggcaagtctca

SEQ ID NO: 626780 - DNA, 25 bp, Homo sapien
tcagtgcaggcaagtctcagtactt

SEQ ID NO: 626781 - DNA, 25 bp, Homo sapien
gggaacatcacagtagaagttatct

SEQ ID NO: 626782 - DNA, 25 bp, Homo sapien
tgaagggccaggtatagatatagat

SEQ ID NO: 626783 - DNA, 25 bp, Homo sapien
gaatgaagatcatggacaccacgat

SEQ ID NO: 626784 - DNA, 25 bp, Homo sapien
aaggctacactttgtcacttcagag

SEQ ID NO: 626785 - DNA, 25 bp, Homo sapien
cactttgtcacttcagagtgccaga

SEQ ID NO: 626786 - DNA, 25 bp, Homo sapien
gagtgccagagatacccatcagtaa

SEQ ID NO: 626787 - DNA, 25 bp, Homo sapien
catatatgcttagtaccatgcaggt

SEQ ID NO: 626788 - DNA, 25 bp, Homo sapien
agtaccatgcaggtaaatcccaggt

SEQ ID NO: 626789 - DNA, 25 bp, Homo sapien
aatcccaggtgattgtcatcgagct

SEQ ID NO: 626790 - DNA, 25 bp, Homo sapien
gattgtcatcgagctgaacttttac

SEQ ID NO: 626791 - DNA, 25 bp, Homo sapien
gagctgaacttttactcagatgttt

SEQ ID NO: 626792 - DNA, 25 bp, Homo sapien
aagtgatgcacttgtaaggttataa

SEQ ID NO: 626793 - DNA, 25 bp, Homo sapien
agaagttgctgttttgcaataaatc

SEQ ID NO: 626794 - DNA, 25 bp, Homo sapien
ttaatatttcaagtgactgcttgcc

SEQ ID NO: 626795 - DNA, 25 bp, Homo sapien
gaaacaaagccaaattgctgccgag

SEQ ID NO: 626796 - DNA, 25 bp, Homo sapien
aagccaaattgctgccgaggcccag

SEQ ID NO: 626797 - DNA, 25 bp, Homo sapien
gaggctggaagctttctgagacgtt

SEQ ID NO: 626798 - DNA, 25 bp, Homo sapien
ggctggaagctttctgagacgtttc

SEQ ID NO: 626799 - DNA, 25 bp, Homo sapien
gggaaaagatcctgaaattatgtaa

SEQ ID NO: 626800 - DNA, 25 bp, Homo sapien
ggaacaccaaataggacccagcaag

SEQ ID NO: 626801 - DNA, 25 bp, Homo sapien
gaaggaaactacttccaatatggca

SEQ ID NO: 626802 - DNA, 25 bp, Homo sapien
ggcaaagttgatcctcaaattcaga

SEQ ID NO: 626803 - DNA, 25 bp, Homo sapien
aattcagaactattctttcccagcc

SEQ ID NO: 626804 - DNA, 25 bp, Homo sapien
gaactattctttcccagccctgcag

SEQ ID NO: 626805 - DNA, 25 bp, Homo sapien
caagttcaacatcttaagcatggga

SEQ ID NO: 626806 - DNA, 25 bp, Homo sapien
aagcacatggctccactgttggctg

SEQ ID NO: 626807 - DNA, 25 bp, Homo sapien
ctctgcaggcaagtttcaacaatgg

SEQ ID NO: 626808 - DNA, 25 bp, Homo sapien
gtcaatgacattgggaccacagaag

SEQ ID NO: 626809 - DNA, 25 bp, Homo sapien
ccacagaagggcaagtcggtcatga

SEQ ID NO: 626810 - DNA, 25 bp, Homo sapien
gaaaagaatctgcacagtggcatgc

SEQ ID NO: 626811 - DNA, 25 bp, Homo sapien
agtggcatgcaggatgcctccaatc

SEQ ID NO: 626812 - DNA, 25 bp, Homo sapien
aggatgcctccaatccaggctatca

SEQ ID NO: 626813 - DNA, 25 bp, Homo sapien
atccaggctatcaccaccagaaggt

SEQ ID NO: 626814 - DNA, 25 bp, Homo sapien
ggcagatcccttgttgcataatggt

SEQ ID NO: 626815 - DNA, 25 bp, Homo sapien
ttcagggagctcaggatgactatgt

SEQ ID NO: 626816 - DNA, 25 bp, Homo sapien
atgagcaagcacatggctccactgt

SEQ ID NO: 626817 - DNA, 25 bp, Homo sapien
gttatagactccaaggagcctacat

SEQ ID NO: 626818 - DNA, 25 bp, Homo sapien
gagcctacattatttggaactgact

SEQ ID NO: 626819 - DNA, 25 bp, Homo sapien
gactcattggactaaattttggcag

SEQ ID NO: 626820 - DNA, 25 bp, Homo sapien
aaattttggcagctcatattgaact

SEQ ID NO: 626821 - DNA, 25 bp, Homo sapien
tcagtttttgctgtttgcctgaact

SEQ ID NO: 626822 - DNA, 25 bp, Homo sapien
tgctgtttgcctgaacttgtctaaa

SEQ ID NO: 626823 - DNA, 25 bp, Homo sapien
gaacttgtctaaacacattccacag

SEQ ID NO: 626824 - DNA, 25 bp, Homo sapien
cattccacagaataaggcttaagtc

SEQ ID NO: 626825 - DNA, 25 bp, Homo sapien
cattagtttccatttccttaattag

SEQ ID NO: 626826 - DNA, 25 bp, Homo sapien
gaagtgactatttctgggaagctgg

SEQ ID NO: 626827 - DNA, 25 bp, Homo sapien
gaagctgggagtatgtgacatttgt

SEQ ID NO: 626828 - DNA, 25 bp, Homo sapien
atgaacctccaattattgccctacc

SEQ ID NO: 626829 - DNA, 25 bp, Homo sapien
ttgccctaccatgctccaatattga

SEQ ID NO: 626830 - DNA, 25 bp, Homo sapien
aatattgacctcaacatcatgttat

SEQ ID NO: 626831 - DNA, 25 bp, Homo sapien
atgtgcactgtgatggtggtcatca

SEQ ID NO: 626832 - DNA, 25 bp, Homo sapien
tcctgcatatatgtcctggttgcca

SEQ ID NO: 626833 - DNA, 25 bp, Homo sapien
catcctgaggatatcttctgctgca

SEQ ID NO: 626834 - DNA, 25 bp, Homo sapien
aaaaagtctctctacatgtgcctcc

SEQ ID NO: 626835 - DNA, 25 bp, Homo sapien
ctgacagcagtcaccattttctatg

SEQ ID NO: 626836 - DNA, 25 bp, Homo sapien
gggttctctcttacatgtatctatg

SEQ ID NO: 626837 - DNA, 25 bp, Homo sapien
gtatctatgccatcgtattaatgag

SEQ ID NO: 626838 - DNA, 25 bp, Homo sapien
aaaagtggcctctgtgttttatggc

SEQ ID NO: 626839 - DNA, 25 bp, Homo sapien
ttctgccagaattcagcccttaatc

SEQ ID NO: 626840 - DNA, 25 bp, Homo sapien
tgccagaattcagcccttaatcgac

SEQ ID NO: 626841 - DNA, 25 bp, Homo sapien
ggagagaaagcctacgaatgttatg

SEQ ID NO: 626842 - DNA, 25 bp, Homo sapien
agagaaagcctacgaatgttatgaa

SEQ ID NO: 626843 - DNA, 25 bp, Homo sapien
tgggaagtgcttctctcagatgtcc

SEQ ID NO: 626844 - DNA, 25 bp, Homo sapien
gaagtgcttctctcagatgtcctat

SEQ ID NO: 626845 - DNA, 25 bp, Homo sapien
agtgcttctctcagatgtcctatct

SEQ ID NO: 626846 - DNA, 25 bp, Homo sapien
tgcttctctcagatgtcctatctca

SEQ ID NO: 626847 - DNA, 25 bp, Homo sapien
ttctctcagatgtcctatctcacta

SEQ ID NO: 626848 - DNA, 25 bp, Homo sapien
tctcagatgtcctatctcactatac

SEQ ID NO: 626849 - DNA, 25 bp, Homo sapien
tcagatgtcctatctcactatacat

SEQ ID NO: 626850 - DNA, 25 bp, Homo sapien
tggagaatgccaaccacaatttcta

SEQ ID NO: 626851 - DNA, 25 bp, Homo sapien
atgccaaccacaatttctactccta

SEQ ID NO: 626852 - DNA, 25 bp, Homo sapien
atcctgaaatacaaagtgaatgccc

SEQ ID NO: 626853 - DNA, 25 bp, Homo sapien
gaagtgcagggagccctggacacca

SEQ ID NO: 626854 - DNA, 25 bp, Homo sapien
ctggacaccactgagtctgcatgaa

SEQ ID NO: 626855 - DNA, 25 bp, Homo sapien
gagtctgcatgaaatcccttctagg

SEQ ID NO: 626856 - DNA, 25 bp, Homo sapien
gcatgaaatcccttctaggcctctg

SEQ ID NO: 626857 - DNA, 25 bp, Homo sapien
ctctgccacaggagctgtgatcttt

SEQ ID NO: 626858 - DNA, 25 bp, Homo sapien
gatctttgtgttctgaaggcttcac

SEQ ID NO: 626859 - DNA, 25 bp, Homo sapien
tgaaggcttcactcaggtgtggctg

SEQ ID NO: 626860 - DNA, 25 bp, Homo sapien
gggcagaggcagtggctctttagaa

SEQ ID NO: 626861 - DNA, 25 bp, Homo sapien
gcctgtgaagggaactcctcgtgcc

SEQ ID NO: 626862 - DNA, 25 bp, Homo sapien
gaagggaactcctcgtgcctgggca

SEQ ID NO: 626863 - DNA, 25 bp, Homo sapien
aactcctcgtgcctgggcaggctta

SEQ ID NO: 626864 - DNA, 25 bp, Homo sapien
tcacgctctgagtgggcttccctgg

SEQ ID NO: 626865 - DNA, 25 bp, Homo sapien
ctttgccctggtgcactgggcggta

SEQ ID NO: 626866 - DNA, 25 bp, Homo sapien
actgggcggtaccacttcaccacgt

SEQ ID NO: 626867 - DNA, 25 bp, Homo sapien
ttcaccacgtctttcagtggtcctt

SEQ ID NO: 626868 - DNA, 25 bp, Homo sapien
tttcagtggtccttccgtgtgttcc

SEQ ID NO: 626869 - DNA, 25 bp, Homo sapien
gatttcaaatgttgctgtgctcaca

SEQ ID NO: 626870 - DNA, 25 bp, Homo sapien
tgtgctcacagaaacctgatggttt

SEQ ID NO: 626871 - DNA, 25 bp, Homo sapien
aacctgatggtttacacaccaagca

SEQ ID NO: 626872 - DNA, 25 bp, Homo sapien
agcatggtcagcttagcctgtgagg

SEQ ID NO: 626873 - DNA, 25 bp, Homo sapien
gcatggtcagcttagcctgtgaggc

SEQ ID NO: 626874 - DNA, 25 bp, Homo sapien
catggtcagcttagcctgtgaggct

SEQ ID NO: 626875 - DNA, 25 bp, Homo sapien
atggtcagcttagcctgtgaggctg

SEQ ID NO: 626876 - DNA, 25 bp, Homo sapien
tcaggtacttgatggtccttgccag

SEQ ID NO: 626877 - DNA, 25 bp, Homo sapien
gctgatgacatctccatctctttga

SEQ ID NO: 626878 - DNA, 25 bp, Homo sapien
ctgatgacatctccatctctttgaa

SEQ ID NO: 626879 - DNA, 25 bp, Homo sapien
tgatgacatctccatctctttgaag

SEQ ID NO: 626880 - DNA, 25 bp, Homo sapien
gatgacatctccatctctttgaagt

SEQ ID NO: 626881 - DNA, 25 bp, Homo sapien
atgacatctccatctctttgaagtc

SEQ ID NO: 626882 - DNA, 25 bp, Homo sapien
tgacatctccatctctttgaagtca

SEQ ID NO: 626883 - DNA, 25 bp, Homo sapien
aagacaaaaatctgggccaggcttg

SEQ ID NO: 626884 - DNA, 25 bp, Homo sapien
agacaaaaatctgggccaggcttga

SEQ ID NO: 626885 - DNA, 25 bp, Homo sapien
gacaaaaatctgggccaggcttgat

SEQ ID NO: 626886 - DNA, 25 bp, Homo sapien
aaaaatctgggccaggcttgatggc

SEQ ID NO: 626887 - DNA, 25 bp, Homo sapien
aaaatctgggccaggcttgatggct

SEQ ID NO: 626888 - DNA, 25 bp, Homo sapien
aaatctgggccaggcttgatggctc

SEQ ID NO: 626889 - DNA, 25 bp, Homo sapien
aatctgggccaggcttgatggctca

SEQ ID NO: 626890 - DNA, 25 bp, Homo sapien
ggcagagggcagaggatttcttgag

SEQ ID NO: 626891 - DNA, 25 bp, Homo sapien
gcagagggcagaggatttcttgagc

SEQ ID NO: 626892 - DNA, 25 bp, Homo sapien
gagcccaggatctggagactagcct

SEQ ID NO: 626893 - DNA, 25 bp, Homo sapien
ccaggatctggagactagcctgggc

SEQ ID NO: 626894 - DNA, 25 bp, Homo sapien
ctcgttatgccaggagagaatgaca

SEQ ID NO: 626895 - DNA, 25 bp, Homo sapien
tgatcaacagcctccttttgcccaa

SEQ ID NO: 626896 - DNA, 25 bp, Homo sapien
ttgcccaaatattgatactcccatg

SEQ ID NO: 626897 - DNA, 25 bp, Homo sapien
aaatatgtagtcattcctttccttt

SEQ ID NO: 626898 - DNA, 25 bp, Homo sapien
tcctttctgtgctttctaatcaaac

SEQ ID NO: 626899 - DNA, 25 bp, Homo sapien
ggcagtagaatctctgaggtcagtg

SEQ ID NO: 626900 - DNA, 25 bp, Homo sapien
tctgaggtcagtggtgatctggttc

SEQ ID NO: 626901 - DNA, 25 bp, Homo sapien
caagaagagactatgggtgcacatt

SEQ ID NO: 626902 - DNA, 25 bp, Homo sapien
gacctgcttgttatgaaccttcaca

SEQ ID NO: 626903 - DNA, 25 bp, Homo sapien
ttatgaaccttcacagaagacccag

SEQ ID NO: 626904 - DNA, 25 bp, Homo sapien
cacgaggtgggcatctttaatcatc

SEQ ID NO: 626905 - DNA, 25 bp, Homo sapien
ttgccaactatacactatctaagtc

SEQ ID NO: 626906 - DNA, 25 bp, Homo sapien
aactatacactatctaagtctaata

SEQ ID NO: 626907 - DNA, 25 bp, Homo sapien
gagatgattggacatagtaattatt

SEQ ID NO: 626908 - DNA, 25 bp, Homo sapien
gattcttctcatttagagacatttg

SEQ ID NO: 626909 - DNA, 25 bp, Homo sapien
gagacatttgggattcgcatacaat

SEQ ID NO: 626910 - DNA, 25 bp, Homo sapien
tttgggattcgcatacaattggtac

SEQ ID NO: 626911 - DNA, 25 bp, Homo sapien
ggattcgcatacaattggtacaaga

SEQ ID NO: 626912 - DNA, 25 bp, Homo sapien
ctgagagaaattttaaccaattgat

SEQ ID NO: 626913 - DNA, 25 bp, Homo sapien
accaattgattttatgttgcaattt

SEQ ID NO: 626914 - DNA, 25 bp, Homo sapien
ataaggaacttgtattactaataag

SEQ ID NO: 626915 - DNA, 25 bp, Homo sapien
aatttttttagctgtgtattctgac

SEQ ID NO: 626916 - DNA, 25 bp, Homo sapien
cttgccatactgtggtcccaatgaa

SEQ ID NO: 626917 - DNA, 25 bp, Homo sapien
tctgtgacattccagcactgttgcc

SEQ ID NO: 626918 - DNA, 25 bp, Homo sapien
gacacatccttagcccagagggtga

SEQ ID NO: 626919 - DNA, 25 bp, Homo sapien
agggtgagcttcaccagcgttggcc

SEQ ID NO: 626920 - DNA, 25 bp, Homo sapien
agcgttggcctcatatctcttgtct

SEQ ID NO: 626921 - DNA, 25 bp, Homo sapien
atatctcttgtctgctttctgctaa

SEQ ID NO: 626922 - DNA, 25 bp, Homo sapien
gtctgctttctgctaattcttttat

SEQ ID NO: 626923 - DNA, 25 bp, Homo sapien
gctaattcttttatcctacactaga

SEQ ID NO: 626924 - DNA, 25 bp, Homo sapien
acccaaggatctgtgtggccctggc

SEQ ID NO: 626925 - DNA, 25 bp, Homo sapien
cacatggctgttagggtgcattcat

SEQ ID NO: 626926 - DNA, 25 bp, Homo sapien
gggtgcattcattccagtatcttga

SEQ ID NO: 626927 - DNA, 25 bp, Homo sapien
acctgctctttaaaatagagacaat

SEQ ID NO: 626928 - DNA, 25 bp, Homo sapien
atagagacaatcactgttttcttta

SEQ ID NO: 626929 - DNA, 25 bp, Homo sapien
ctttatttctgggtctttaatatct

SEQ ID NO: 626930 - DNA, 25 bp, Homo sapien
tttaagcacaaaaatgggtcagatt

SEQ ID NO: 626931 - DNA, 25 bp, Homo sapien
atgggtcagatttggaattgtattc

SEQ ID NO: 626932 - DNA, 25 bp, Homo sapien
tggaattgtattcaacactgaggca

SEQ ID NO: 626933 - DNA, 25 bp, Homo sapien
ggcaacaatgtagaagatggctttt

SEQ ID NO: 626934 - DNA, 25 bp, Homo sapien
atacctaatattctgatttaattca

SEQ ID NO: 626935 - DNA, 25 bp, Homo sapien
atttaattcactgtccgaatgaaaa

SEQ ID NO: 626936 - DNA, 25 bp, Homo sapien
cactgtccgaatgaaaaataccctt

SEQ ID NO: 626937 - DNA, 25 bp, Homo sapien
tgtccgaatgaaaaatacccttaga

SEQ ID NO: 626938 - DNA, 25 bp, Homo sapien
atatctccaggtttatcttttctca

SEQ ID NO: 626939 - DNA, 25 bp, Homo sapien
tctccaggtttatcttttctcaaag

SEQ ID NO: 626940 - DNA, 25 bp, Homo sapien
ccaggtttatcttttctcaaagatg

SEQ ID NO: 626941 - DNA, 25 bp, Homo sapien
tatcttttctcaaagatgttggttt

SEQ ID NO: 626942 - DNA, 25 bp, Homo sapien
agcgaggctcagtttatccatttct

SEQ ID NO: 626943 - DNA, 25 bp, Homo sapien
aaacttctagtcttcatcagccatg

SEQ ID NO: 626944 - DNA, 25 bp, Homo sapien
gtcttcatcagccatgccaatggca

SEQ ID NO: 626945 - DNA, 25 bp, Homo sapien
ttcatcagccatgccaatggcaggc

SEQ ID NO: 626946 - DNA, 25 bp, Homo sapien
caatggcaggcaaacttttcccgct

SEQ ID NO: 626947 - DNA, 25 bp, Homo sapien
aatggcaggcaaacttttcccgctg

SEQ ID NO: 626948 - DNA, 25 bp, Homo sapien
tggcaggcaaacttttcccgctggg

SEQ ID NO: 626949 - DNA, 25 bp, Homo sapien
agggcaaaggcagcccacgatcact

SEQ ID NO: 626950 - DNA, 25 bp, Homo sapien
aaaggcagcccacgatcactttcga

SEQ ID NO: 626951 - DNA, 25 bp, Homo sapien
ggcagcccacgatcactttcgaata

SEQ ID NO: 626952 - DNA, 25 bp, Homo sapien
agcccacgatcactttcgaatacag

SEQ ID NO: 626953 - DNA, 25 bp, Homo sapien
ccacgatcactttcgaatacaggag

SEQ ID NO: 626954 - DNA, 25 bp, Homo sapien
gataggagtggacccttcaaacacg

SEQ ID NO: 626955 - DNA, 25 bp, Homo sapien
taggagtggacccttcaaacacggg

SEQ ID NO: 626956 - DNA, 25 bp, Homo sapien
gggaagcgctttcattgattcctct

SEQ ID NO: 626957 - DNA, 25 bp, Homo sapien
ggaagcgctttcattgattcctctc

SEQ ID NO: 626958 - DNA, 25 bp, Homo sapien
gcactatcaatgaccagggcaaagg

SEQ ID NO: 626959 - DNA, 25 bp, Homo sapien
actatcaatgaccagggcaaaggca

SEQ ID NO: 626960 - DNA, 25 bp, Homo sapien
gcgggtggatcgctcaagctcagga

SEQ ID NO: 626961 - DNA, 25 bp, Homo sapien
aaattaaccgggtctggtgacacat

SEQ ID NO: 626962 - DNA, 25 bp, Homo sapien
aattaaccgggtctggtgacacatg

SEQ ID NO: 626963 - DNA, 25 bp, Homo sapien
attaaccgggtctggtgacacatgc

SEQ ID NO: 626964 - DNA, 25 bp, Homo sapien
ttaaccgggtctggtgacacatgcc

SEQ ID NO: 626965 - DNA, 25 bp, Homo sapien
taaccgggtctggtgacacatgcct

SEQ ID NO: 626966 - DNA, 25 bp, Homo sapien
tgaggtaggggaactgcttgaactc

SEQ ID NO: 626967 - DNA, 25 bp, Homo sapien
aggtaggggaactgcttgaactcag

SEQ ID NO: 626968 - DNA, 25 bp, Homo sapien
ggtaggggaactgcttgaactcagg

SEQ ID NO: 626969 - DNA, 25 bp, Homo sapien
gtaggggaactgcttgaactcagga

SEQ ID NO: 626970 - DNA, 25 bp, Homo sapien
ctgcactccagcctatgggatagag

SEQ ID NO: 626971 - DNA, 25 bp, Homo sapien
aacaccaaaacagtgcttggagcca

SEQ ID NO: 626972 - DNA, 25 bp, Homo sapien
agccaaacctcaataaagacagtgt

SEQ ID NO: 626973 - DNA, 25 bp, Homo sapien
aagacagtgtttgctcttccaacag

SEQ ID NO: 626974 - DNA, 25 bp, Homo sapien
aacagtgtaacaccatcacaggcac

SEQ ID NO: 626975 - DNA, 25 bp, Homo sapien
ggcaccacatgagcctggatagctg

SEQ ID NO: 626976 - DNA, 25 bp, Homo sapien
tgagcctggatagctgacaaccgct

SEQ ID NO: 626977 - DNA, 25 bp, Homo sapien
cctggatagctgacaaccgctggat

SEQ ID NO: 626978 - DNA, 25 bp, Homo sapien
acaggagtcattccactctcagagg

SEQ ID NO: 626979 - DNA, 25 bp, Homo sapien
gagtcattccactctcagaggtgca

SEQ ID NO: 626980 - DNA, 25 bp, Homo sapien
tgcccaaaggtactcagctacaaca

SEQ ID NO: 626981 - DNA, 25 bp, Homo sapien
aaggtactcagctacaacaccaaaa

SEQ ID NO: 626982 - DNA, 25 bp, Homo sapien
gcacaagaaagatggtgctgctcaa

SEQ ID NO: 626983 - DNA, 25 bp, Homo sapien
tgctgctcaaaaacactgtgctctc

SEQ ID NO: 626984 - DNA, 25 bp, Homo sapien
actgtgctctcatagacccaagtgt

SEQ ID NO: 626985 - DNA, 25 bp, Homo sapien
tgctctcatagacccaagtgtctgt

SEQ ID NO: 626986 - DNA, 25 bp, Homo sapien
tagacccaagtgtctgtgcaggcta

SEQ ID NO: 626987 - DNA, 25 bp, Homo sapien
aagtgtctgtgcaggctagcgtcaa

SEQ ID NO: 626988 - DNA, 25 bp, Homo sapien
gtctgtgcaggctagcgtcaacata

SEQ ID NO: 626989 - DNA, 25 bp, Homo sapien
atcctgttatcatcatcacacacac

SEQ ID NO: 626990 - DNA, 25 bp, Homo sapien
tgttatcatcatcacacacactctt

SEQ ID NO: 626991 - DNA, 25 bp, Homo sapien
acacacactcttttgcttatacgga

SEQ ID NO: 626992 - DNA, 25 bp, Homo sapien
aggaacatgcaataccagtgaaagg

SEQ ID NO: 626993 - DNA, 25 bp, Homo sapien
accattatttttgtgatctcttccc

SEQ ID NO: 626994 - DNA, 25 bp, Homo sapien
ttatttttgtgatctcttccctctc

SEQ ID NO: 626995 - DNA, 25 bp, Homo sapien
agcacctacatcaatgaattactgg

SEQ ID NO: 626996 - DNA, 25 bp, Homo sapien
aatgaattactggttctggtcttga

SEQ ID NO: 626997 - DNA, 25 bp, Homo sapien
aattactggttctggtcttgagtgc

SEQ ID NO: 626998 - DNA, 25 bp, Homo sapien
tactggttctggtcttgagtgcatt

SEQ ID NO: 626999 - DNA, 25 bp, Homo sapien
tttaacatcctgacgcctgccttaa

SEQ ID NO: 627000 - DNA, 25 bp, Homo sapien
ctgccttaaccatccttgcttctta

SEQ ID NO: 627001 - DNA, 25 bp, Homo sapien
ttaaccatccttgcttcttacatct

SEQ ID NO: 627002 - DNA, 25 bp, Homo sapien
catccttgcttcttacatctttatc

SEQ ID NO: 627003 - DNA, 25 bp, Homo sapien
gcttcttacatctttatcattgcca

SEQ ID NO: 627004 - DNA, 25 bp, Homo sapien
gctcattgacaaggcacctagtcat

SEQ ID NO: 627005 - DNA, 25 bp, Homo sapien
caaggcacctagtcatccaaaagct

SEQ ID NO: 627006 - DNA, 25 bp, Homo sapien
ggcacctagtcatccaaaagctctg

SEQ ID NO: 627007 - DNA, 25 bp, Homo sapien
atccattctgcagtccatgtatcca

SEQ ID NO: 627008 - DNA, 25 bp, Homo sapien
tctgcagtccatgtatccaggagta

SEQ ID NO: 627009 - DNA, 25 bp, Homo sapien
gtatccaggagtaattcagactttc

SEQ ID NO: 627010 - DNA, 25 bp, Homo sapien
cagactttcaagtgttattacctaa

SEQ ID NO: 627011 - DNA, 25 bp, Homo sapien
gaaacacatttcataaggcaacact

SEQ ID NO: 627012 - DNA, 25 bp, Homo sapien
aggcaacactgccataaatagtgat

SEQ ID NO: 627013 - DNA, 25 bp, Homo sapien
cattctagatcccatgatcccatta

SEQ ID NO: 627014 - DNA, 25 bp, Homo sapien
agatcccatgatcccattaagaaca

SEQ ID NO: 627015 - DNA, 25 bp, Homo sapien
aactgggaactaccgtgcctcccat

SEQ ID NO: 627016 - DNA, 25 bp, Homo sapien
tgggaactaccgtgcctcccatcag

SEQ ID NO: 627017 - DNA, 25 bp, Homo sapien
gaactaccgtgcctcccatcagttt

SEQ ID NO: 627018 - DNA, 25 bp, Homo sapien
actaccgtgcctcccatcagtttca

SEQ ID NO: 627019 - DNA, 25 bp, Homo sapien
gcccctgcagtgaggctgacttgaa

SEQ ID NO: 627020 - DNA, 25 bp, Homo sapien
cccctgcagtgaggctgacttgaag

SEQ ID NO: 627021 - DNA, 25 bp, Homo sapien
ctgcagtgaggctgacttgaagaga

SEQ ID NO: 627022 - DNA, 25 bp, Homo sapien
tgcagtgaggctgacttgaagagat

SEQ ID NO: 627023 - DNA, 25 bp, Homo sapien
gactctttcaaaagatttatggtga

SEQ ID NO: 627024 - DNA, 25 bp, Homo sapien
ctctttcaaaagatttatggtgaga

SEQ ID NO: 627025 - DNA, 25 bp, Homo sapien
ttatggtgagaatgggagtaagtcc

SEQ ID NO: 627026 - DNA, 25 bp, Homo sapien
caccaggaacagcagtgtctcattc

SEQ ID NO: 627027 - DNA, 25 bp, Homo sapien
atcagagcaagcaagacttaggaga

SEQ ID NO: 627028 - DNA, 25 bp, Homo sapien
ctaagagctaaggacgagtgaatca

SEQ ID NO: 627029 - DNA, 25 bp, Homo sapien
gtgaatcagagaacacaccgtccca

SEQ ID NO: 627030 - DNA, 25 bp, Homo sapien
agaacacaccgtcccacagaagtag

SEQ ID NO: 627031 - DNA, 25 bp, Homo sapien
accgtcccacagaagtagcagcaag

SEQ ID NO: 627032 - DNA, 25 bp, Homo sapien
gtagcagcaagaggtcagctccaca

SEQ ID NO: 627033 - DNA, 25 bp, Homo sapien
aagaggtcagctccacacgcagctt

SEQ ID NO: 627034 - DNA, 25 bp, Homo sapien
acgcagcttctgagacatggtcacc

SEQ ID NO: 627035 - DNA, 25 bp, Homo sapien
gatgatcatgatggtaacactctca

SEQ ID NO: 627036 - DNA, 25 bp, Homo sapien
tgatggtaacactctcattcaaagt

SEQ ID NO: 627037 - DNA, 25 bp, Homo sapien
cttctcccctgtgtgaattcgctgg

SEQ ID NO: 627038 - DNA, 25 bp, Homo sapien
aattcgctggtgttgggtgaggtgt

SEQ ID NO: 627039 - DNA, 25 bp, Homo sapien
gaggtgtgtgctctgccggaaggcc

SEQ ID NO: 627040 - DNA, 25 bp, Homo sapien
tcctgtgtgtgtccgctcatgctgg

SEQ ID NO: 627041 - DNA, 25 bp, Homo sapien
gtgtgtgtccgctcatgctggctga

SEQ ID NO: 627042 - DNA, 25 bp, Homo sapien
ttttcccacactcgttgcatccata

SEQ ID NO: 627043 - DNA, 25 bp, Homo sapien
actcgttgcatccatagggcttctc

SEQ ID NO: 627044 - DNA, 25 bp, Homo sapien
tctcctgtgtgaacctcccgaattc

SEQ ID NO: 627045 - DNA, 25 bp, Homo sapien
agctgtgactgaatgggttgccgca

SEQ ID NO: 627046 - DNA, 25 bp, Homo sapien
actgaatgggttgccgcagtcattg

SEQ ID NO: 627047 - DNA, 25 bp, Homo sapien
tgggttgccgcagtcattgcattca

SEQ ID NO: 627048 - DNA, 25 bp, Homo sapien
agacccctgcattggctgggcacag

SEQ ID NO: 627049 - DNA, 25 bp, Homo sapien
gacccctgcattggctgggcacagt

SEQ ID NO: 627050 - DNA, 25 bp, Homo sapien
acccctgcattggctgggcacagtg

SEQ ID NO: 627051 - DNA, 25 bp, Homo sapien
cccctgcattggctgggcacagtgg

SEQ ID NO: 627052 - DNA, 25 bp, Homo sapien
accccatctctgctaaaaaatatat

SEQ ID NO: 627053 - DNA, 25 bp, Homo sapien
ccccatctctgctaaaaaatatata

SEQ ID NO: 627054 - DNA, 25 bp, Homo sapien
cccatctctgctaaaaaatatatat

SEQ ID NO: 627055 - DNA, 25 bp, Homo sapien
ccatctctgctaaaaaatatatata

SEQ ID NO: 627056 - DNA, 25 bp, Homo sapien
agtttctccgtctgggccccataag

SEQ ID NO: 627057 - DNA, 25 bp, Homo sapien
gccccataagactgacaacgctgtt

SEQ ID NO: 627058 - DNA, 25 bp, Homo sapien
aacgctgttgtagcttggtgatctc

SEQ ID NO: 627059 - DNA, 25 bp, Homo sapien
gtgatctcggcctgcagctgagtga

SEQ ID NO: 627060 - DNA, 25 bp, Homo sapien
agctgagtgatctccttctgctgcc

SEQ ID NO: 627061 - DNA, 25 bp, Homo sapien
aacacctcggatagctctgccatct

SEQ ID NO: 627062 - DNA, 25 bp, Homo sapien
gctccacacactccagaatgagcat

SEQ ID NO: 627063 - DNA, 25 bp, Homo sapien
agaatgagcatctgttcctcatcct

SEQ ID NO: 627064 - DNA, 25 bp, Homo sapien
gttcacgaggcctgcttccataatc

SEQ ID NO: 627065 - DNA, 25 bp, Homo sapien
gcttccataatcctgcatgtgggag

SEQ ID NO: 627066 - DNA, 25 bp, Homo sapien
cagctcgcaggctctctgggtggac

SEQ ID NO: 627067 - DNA, 25 bp, Homo sapien
cagagggtcacgcacctgggagcct

SEQ ID NO: 627068 - DNA, 25 bp, Homo sapien
agagggtcacgcacctgggagcctg

SEQ ID NO: 627069 - DNA, 25 bp, Homo sapien
ggtcacgcacctgggagcctgttgc

SEQ ID NO: 627070 - DNA, 25 bp, Homo sapien
gtcacgcacctgggagcctgttgct

SEQ ID NO: 627071 - DNA, 25 bp, Homo sapien
acctgggagcctgttgctggcacgg

SEQ ID NO: 627072 - DNA, 25 bp, Homo sapien
ctgggagcctgttgctggcacggtc

SEQ ID NO: 627073 - DNA, 25 bp, Homo sapien
gggagcctgttgctggcacggtccg

SEQ ID NO: 627074 - DNA, 25 bp, Homo sapien
gagcctgttgctggcacggtccggg

SEQ ID NO: 627075 - DNA, 25 bp, Homo sapien
ctgttgctggcacggtccgggcgga

SEQ ID NO: 627076 - DNA, 25 bp, Homo sapien
ttgctggcacggtccgggcggaggt

SEQ ID NO: 627077 - DNA, 25 bp, Homo sapien
cggtccgggcggaggttctgcggcg

SEQ ID NO: 627078 - DNA, 25 bp, Homo sapien
tcaggagcccctccgactgcgggta

SEQ ID NO: 627079 - DNA, 25 bp, Homo sapien
aggagcccctccgactgcgggtagc

SEQ ID NO: 627080 - DNA, 25 bp, Homo sapien
agcccctccgactgcgggtagccgg

SEQ ID NO: 627081 - DNA, 25 bp, Homo sapien
ggatctttcacactgtgttgagcat

SEQ ID NO: 627082 - DNA, 25 bp, Homo sapien
catggtcagcttagcctgtgaggct

SEQ ID NO: 627083 - DNA, 25 bp, Homo sapien
tgggttgggctctcaggtacttgat

SEQ ID NO: 627084 - DNA, 25 bp, Homo sapien
ggtacttgatggtccttgccagcat

SEQ ID NO: 627085 - DNA, 25 bp, Homo sapien
atctctttgaagtcattgtccagct

SEQ ID NO: 627086 - DNA, 25 bp, Homo sapien
ggcatccagcagtgcatcactgaag

SEQ ID NO: 627087 - DNA, 25 bp, Homo sapien
atcactgaagttggactcgttgccc

SEQ ID NO: 627088 - DNA, 25 bp, Homo sapien
tgaagttggactcgttgcccagctc

SEQ ID NO: 627089 - DNA, 25 bp, Homo sapien
gccttacctatctacaatgtgtgga

SEQ ID NO: 627090 - DNA, 25 bp, Homo sapien
ccttacctatctacaatgtgtggat

SEQ ID NO: 627091 - DNA, 25 bp, Homo sapien
cttacctatctacaatgtgtggatg

SEQ ID NO: 627092 - DNA, 25 bp, Homo sapien
ttacctatctacaatgtgtggatga

SEQ ID NO: 627093 - DNA, 25 bp, Homo sapien
tacctatctacaatgtgtggatgat

SEQ ID NO: 627094 - DNA, 25 bp, Homo sapien
acctatctacaatgtgtggatgatt

SEQ ID NO: 627095 - DNA, 25 bp, Homo sapien
cctatctacaatgtgtggatgattt

SEQ ID NO: 627096 - DNA, 25 bp, Homo sapien
ctatctacaatgtgtggatgatttc

SEQ ID NO: 627097 - DNA, 25 bp, Homo sapien
ttgaatctggaaggcccaggttgta

SEQ ID NO: 627098 - DNA, 25 bp, Homo sapien
tgaatctggaaggcccaggttgtag

SEQ ID NO: 627099 - DNA, 25 bp, Homo sapien
gaatctggaaggcccaggttgtagt

SEQ ID NO: 627100 - DNA, 25 bp, Homo sapien
aatctggaaggcccaggttgtagtg

SEQ ID NO: 627101 - DNA, 25 bp, Homo sapien
ccgctgtactgcagtctgggcgcca

SEQ ID NO: 627102 - DNA, 25 bp, Homo sapien
cgctgtactgcagtctgggcgccag

SEQ ID NO: 627103 - DNA, 25 bp, Homo sapien
gctgtactgcagtctgggcgccaga

SEQ ID NO: 627104 - DNA, 25 bp, Homo sapien
ctgtactgcagtctgggcgccagag

SEQ ID NO: 627105 - DNA, 25 bp, Homo sapien
tgtactgcagtctgggcgccagagc

SEQ ID NO: 627106 - DNA, 25 bp, Homo sapien
gtactgcagtctgggcgccagagca

SEQ ID NO: 627107 - DNA, 25 bp, Homo sapien
tactgcagtctgggcgccagagcaa

SEQ ID NO: 627108 - DNA, 25 bp, Homo sapien
cctgcaccatacactaaagatcggt

SEQ ID NO: 627109 - DNA, 25 bp, Homo sapien
accatacactaaagatcggtggaga

SEQ ID NO: 627110 - DNA, 25 bp, Homo sapien
tacactaaagatcggtggagaacct

SEQ ID NO: 627111 - DNA, 25 bp, Homo sapien
agagtgagtctcagcacatgttgca

SEQ ID NO: 627112 - DNA, 25 bp, Homo sapien
gagtgagtctcagcacatgttgcag

SEQ ID NO: 627113 - DNA, 25 bp, Homo sapien
gtgagtctcagcacatgttgcagcc

SEQ ID NO: 627114 - DNA, 25 bp, Homo sapien
tgagtctcagcacatgttgcagcca

SEQ ID NO: 627115 - DNA, 25 bp, Homo sapien
gagtctcagcacatgttgcagccag

SEQ ID NO: 627116 - DNA, 25 bp, Homo sapien
agtctcagcacatgttgcagccagg

SEQ ID NO: 627117 - DNA, 25 bp, Homo sapien
cgtgtgatatgaggcccattcctgc

SEQ ID NO: 627118 - DNA, 25 bp, Homo sapien
gtgatatgaggcccattcctgcctc

SEQ ID NO: 627119 - DNA, 25 bp, Homo sapien
ttgacccttccagcaccgtttgaat

SEQ ID NO: 627120 - DNA, 25 bp, Homo sapien
acccttccagcaccgtttgaattca

SEQ ID NO: 627121 - DNA, 25 bp, Homo sapien
acagcacagggacgcatccgggcac

SEQ ID NO: 627122 - DNA, 25 bp, Homo sapien
cacagggacgcatccgggcacaggt

SEQ ID NO: 627123 - DNA, 25 bp, Homo sapien
acgcatccgggcacaggtgcatgta

SEQ ID NO: 627124 - DNA, 25 bp, Homo sapien
cgggcacaggtgcatgtaagtttct

SEQ ID NO: 627125 - DNA, 25 bp, Homo sapien
gcatgtaagtttcttgccttgtgca

SEQ ID NO: 627126 - DNA, 25 bp, Homo sapien
taagtttcttgccttgtgcagtaag

SEQ ID NO: 627127 - DNA, 25 bp, Homo sapien
tcttgccttgtgcagtaagtttggc

SEQ ID NO: 627128 - DNA, 25 bp, Homo sapien
gtgcagtaagtttggcaggcccctt

SEQ ID NO: 627129 - DNA, 25 bp, Homo sapien
cagtaagtttggcaggccccttgac

SEQ ID NO: 627130 - DNA, 25 bp, Homo sapien
ttccacttccagaggccccgggata

SEQ ID NO: 627131 - DNA, 25 bp, Homo sapien
atagagagaaatgtcaggcagggct

SEQ ID NO: 627132 - DNA, 25 bp, Homo sapien
cctgtgggatcctcaggcaggaggg

SEQ ID NO: 627133 - DNA, 25 bp, Homo sapien
gagggctatatcatgatggcctgga

SEQ ID NO: 627134 - DNA, 25 bp, Homo sapien
ggctatatcatgatggcctggagct

SEQ ID NO: 627135 - DNA, 25 bp, Homo sapien
gggctggaggtgagtcttcccggat

SEQ ID NO: 627136 - DNA, 25 bp, Homo sapien
ttcccggatgctgggaatcaccagg

SEQ ID NO: 627137 - DNA, 25 bp, Homo sapien
cccggatgctgggaatcaccaggcg

SEQ ID NO: 627138 - DNA, 25 bp, Homo sapien
tgggaatcaccaggcgggcaggagg

SEQ ID NO: 627139 - DNA, 25 bp, Homo sapien
gggcaggagggctgttccaggctga

SEQ ID NO: 627140 - DNA, 25 bp, Homo sapien
aggagggctgttccaggctgaggga

SEQ ID NO: 627141 - DNA, 25 bp, Homo sapien
ttctgtgacctctacgctctgatga

SEQ ID NO: 627142 - DNA, 25 bp, Homo sapien
tacgctctgatgaagatctcctgca

SEQ ID NO: 627143 - DNA, 25 bp, Homo sapien
tgatgaagatctcctgcaccagcac

SEQ ID NO: 627144 - DNA, 25 bp, Homo sapien
tacctcaacacccttatgattcaca

SEQ ID NO: 627145 - DNA, 25 bp, Homo sapien
gattcacacagaaggtgctgttgta

SEQ ID NO: 627146 - DNA, 25 bp, Homo sapien
tggagctctggccttcattactgcc

SEQ ID NO: 627147 - DNA, 25 bp, Homo sapien
attactgcctcctatgcctgcatca

SEQ ID NO: 627148 - DNA, 25 bp, Homo sapien
tggtggccatattctatggcaccct

SEQ ID NO: 627149 - DNA, 25 bp, Homo sapien
atattctatggcaccctcagttggg

SEQ ID NO: 627150 - DNA, 25 bp, Homo sapien
atggcaccctcagttgggtctactt

SEQ ID NO: 627151 - DNA, 25 bp, Homo sapien
cctttccagctattcagtgaccaag

SEQ ID NO: 627152 - DNA, 25 bp, Homo sapien
ccagacaccgtcttagcggggagtg

SEQ ID NO: 627153 - DNA, 25 bp, Homo sapien
gggagtggtcactcacttctctaga

SEQ ID NO: 627154 - DNA, 25 bp, Homo sapien
ggagtggtcactcacttctctagac

SEQ ID NO: 627155 - DNA, 25 bp, Homo sapien
acttctctagactcacttctctaga

SEQ ID NO: 627156 - DNA, 25 bp, Homo sapien
acttctctagactctcagcgctcta

SEQ ID NO: 627157 - DNA, 25 bp, Homo sapien
tctctagactctcagcgctctatct

SEQ ID NO: 627158 - DNA, 25 bp, Homo sapien
tcagcgctctatctgtactcttcat

SEQ ID NO: 627159 - DNA, 25 bp, Homo sapien
agcgctctatctgtactcttcattt

SEQ ID NO: 627160 - DNA, 25 bp, Homo sapien
gctctatctgtactcttcatttctt

SEQ ID NO: 627161 - DNA, 25 bp, Homo sapien
ctctatctgtactcttcatttcttc

SEQ ID NO: 627162 - DNA, 25 bp, Homo sapien
tcttcttttgtgagatgaagtcttg

SEQ ID NO: 627163 - DNA, 25 bp, Homo sapien
gggagaaaattgactgtgatcttat

SEQ ID NO: 627164 - DNA, 25 bp, Homo sapien
gttccagaaacttttatactgtaga

SEQ ID NO: 627165 - DNA, 25 bp, Homo sapien
attgtcagtcattaagattttctat

SEQ ID NO: 627166 - DNA, 25 bp, Homo sapien
ttctgacatcagtttcatgcatttt

SEQ ID NO: 627167 - DNA, 25 bp, Homo sapien
catttttaatgcctttagtccagtg

SEQ ID NO: 627168 - DNA, 25 bp, Homo sapien
ttaatgcctttagtccagtggatat

SEQ ID NO: 627169 - DNA, 25 bp, Homo sapien
ggatatagcagtacaggaatctcca

SEQ ID NO: 627170 - DNA, 25 bp, Homo sapien
gtacaggaatctccaaggcaaatgt

SEQ ID NO: 627171 - DNA, 25 bp, Homo sapien
ggtattctgtgaaattaccttctga

SEQ ID NO: 627172 - DNA, 25 bp, Homo sapien
gaaattaccttctgattgtagtcac

SEQ ID NO: 627173 - DNA, 25 bp, Homo sapien
gtagtcacatgtaacacatcaactt

SEQ ID NO: 627174 - DNA, 25 bp, Homo sapien
tgagattcaagcaaacaaatatgga

SEQ ID NO: 627175 - DNA, 25 bp, Homo sapien
atggaagctaccaaaggctcatgaa

SEQ ID NO: 627176 - DNA, 25 bp, Homo sapien
ggatccttgcagagagatgttctaa

SEQ ID NO: 627177 - DNA, 25 bp, Homo sapien
gagagatgttctaaatgttgcctag

SEQ ID NO: 627178 - DNA, 25 bp, Homo sapien
atgttgcctagaaaggcagtttgga

SEQ ID NO: 627179 - DNA, 25 bp, Homo sapien
tctccagtcagaggtctggatgcta

SEQ ID NO: 627180 - DNA, 25 bp, Homo sapien
gtcagaggtctggatgctaagttta

SEQ ID NO: 627181 - DNA, 25 bp, Homo sapien
gctaagtttagctctgccacatatt

SEQ ID NO: 627182 - DNA, 25 bp, Homo sapien
agctctgccacatattagccaggta

SEQ ID NO: 627183 - DNA, 25 bp, Homo sapien
tattagccaggtaattttgaagtaa

SEQ ID NO: 627184 - DNA, 25 bp, Homo sapien
gtaaagcatttaaagccagacctgg

SEQ ID NO: 627185 - DNA, 25 bp, Homo sapien
gataataatagccaggttcggtggc

SEQ ID NO: 627186 - DNA, 25 bp, Homo sapien
ataataatagccaggttcggtggct

SEQ ID NO: 627187 - DNA, 25 bp, Homo sapien
taataatagccaggttcggtggctc

SEQ ID NO: 627188 - DNA, 25 bp, Homo sapien
aataatagccaggttcggtggctca

SEQ ID NO: 627189 - DNA, 25 bp, Homo sapien
ataatagccaggttcggtggctcat

SEQ ID NO: 627190 - DNA, 25 bp, Homo sapien
ggattgctggagcccggaaagtcga

SEQ ID NO: 627191 - DNA, 25 bp, Homo sapien
gattgctggagcccggaaagtcgag

SEQ ID NO: 627192 - DNA, 25 bp, Homo sapien
attgctggagcccggaaagtcgagg

SEQ ID NO: 627193 - DNA, 25 bp, Homo sapien
tgctggagcccggaaagtcgaggct

SEQ ID NO: 627194 - DNA, 25 bp, Homo sapien
gctggagcccggaaagtcgaggctg

SEQ ID NO: 627195 - DNA, 25 bp, Homo sapien
ctggagcccggaaagtcgaggctgc

SEQ ID NO: 627196 - DNA, 25 bp, Homo sapien
ggtgacagaccatgtgctctagtca

SEQ ID NO: 627197 - DNA, 25 bp, Homo sapien
tgacagaccatgtgctctagtcacc

SEQ ID NO: 627198 - DNA, 25 bp, Homo sapien
acagaccatgtgctctagtcaccgt

SEQ ID NO: 627199 - DNA, 25 bp, Homo sapien
agaccatgtgctctagtcaccgtgc

SEQ ID NO: 627200 - DNA, 25 bp, Homo sapien
accatgtgctctagtcaccgtgctg

SEQ ID NO: 627201 - DNA, 25 bp, Homo sapien
catgtgctctagtcaccgtgctggc

SEQ ID NO: 627202 - DNA, 25 bp, Homo sapien
gtccccaaggaagggagagttgtct

SEQ ID NO: 627203 - DNA, 25 bp, Homo sapien
aagggagagttgtctcggaatgctc

SEQ ID NO: 627204 - DNA, 25 bp, Homo sapien
gtctcggaatgctcagggggactca

SEQ ID NO: 627205 - DNA, 25 bp, Homo sapien
gggactcattaaagcaacactttca

SEQ ID NO: 627206 - DNA, 25 bp, Homo sapien
ggactcattaaagcaacactttcat

SEQ ID NO: 627207 - DNA, 25 bp, Homo sapien
gtctcttcgagaacatgggagaacg

SEQ ID NO: 627208 - DNA, 25 bp, Homo sapien
tctcttcgagaacatgggagaacgc

SEQ ID NO: 627209 - DNA, 25 bp, Homo sapien
ctcttcgagaacatgggagaacgca

SEQ ID NO: 627210 - DNA, 25 bp, Homo sapien
tcttcgagaacatgggagaacgcac

SEQ ID NO: 627211 - DNA, 25 bp, Homo sapien
cttcgagaacatgggagaacgcaca

SEQ ID NO: 627212 - DNA, 25 bp, Homo sapien
tcgagaacatgggagaacgcacagt

SEQ ID NO: 627213 - DNA, 25 bp, Homo sapien
cgagaacatgggagaacgcacagtg

SEQ ID NO: 627214 - DNA, 25 bp, Homo sapien
agaacatgggagaacgcacagtgga

SEQ ID NO: 627215 - DNA, 25 bp, Homo sapien
gaacatgggagaacgcacagtggag

SEQ ID NO: 627216 - DNA, 25 bp, Homo sapien
aacatgggagaacgcacagtggaga

SEQ ID NO: 627217 - DNA, 25 bp, Homo sapien
acatgggagaacgcacagtggagag

SEQ ID NO: 627218 - DNA, 25 bp, Homo sapien
gcctgtgaaggcatagatttcaaat

SEQ ID NO: 627219 - DNA, 25 bp, Homo sapien
aggtgtctgcacacacaagctctag

SEQ ID NO: 627220 - DNA, 25 bp, Homo sapien
tgcacacacaagctctagtaccggg

SEQ ID NO: 627221 - DNA, 25 bp, Homo sapien
taaatacccaagtggtctgcacagt

SEQ ID NO: 627222 - DNA, 25 bp, Homo sapien
aagtggtctgcacagtagccaccat

SEQ ID NO: 627223 - DNA, 25 bp, Homo sapien
agtagccaccatgatccctgagatc

SEQ ID NO: 627224 - DNA, 25 bp, Homo sapien
accatgatccctgagatccatgaga

SEQ ID NO: 627225 - DNA, 25 bp, Homo sapien
tcataaaaacccctctgttcataat

SEQ ID NO: 627226 - DNA, 25 bp, Homo sapien
tctgttcataatcactgggtagttc

SEQ ID NO: 627227 - DNA, 25 bp, Homo sapien
ggatggcaaacagaactcgaatgta

SEQ ID NO: 627228 - DNA, 25 bp, Homo sapien
gaggatcaacaagaaaggaaccata

SEQ ID NO: 627229 - DNA, 25 bp, Homo sapien
taatgtatgaaccttgtatgaatct

SEQ ID NO: 627230 - DNA, 25 bp, Homo sapien
aatgtatgaaccttgtatgaatctt

SEQ ID NO: 627231 - DNA, 25 bp, Homo sapien
atgtatgaaccttgtatgaatcttc

SEQ ID NO: 627232 - DNA, 25 bp, Homo sapien
tgtatgaaccttgtatgaatcttca

SEQ ID NO: 627233 - DNA, 25 bp, Homo sapien
gtatgaaccttgtatgaatcttcat

SEQ ID NO: 627234 - DNA, 25 bp, Homo sapien
tatgaaccttgtatgaatcttcatt

SEQ ID NO: 627235 - DNA, 25 bp, Homo sapien
atgaaccttgtatgaatcttcattc

SEQ ID NO: 627236 - DNA, 25 bp, Homo sapien
tgaaccttgtatgaatcttcattca

SEQ ID NO: 627237 - DNA, 25 bp, Homo sapien
accttgtatgaatcttcattcaaac

SEQ ID NO: 627238 - DNA, 25 bp, Homo sapien
ccttgtatgaatcttcattcaaaca

SEQ ID NO: 627239 - DNA, 25 bp, Homo sapien
tgtatgaatcttcattcaaacaatt

SEQ ID NO: 627240 - DNA, 25 bp, Homo sapien
gagacgtacacaggtaattgtccaa

SEQ ID NO: 627241 - DNA, 25 bp, Homo sapien
taattgtccaaattgtggctgtggg

SEQ ID NO: 627242 - DNA, 25 bp, Homo sapien
aaaagcgcagcactttatccttcaa

SEQ ID NO: 627243 - DNA, 25 bp, Homo sapien
gcagcactttatccttcaatacatt

SEQ ID NO: 627244 - DNA, 25 bp, Homo sapien
aatttgttcactatcgagttagaga

SEQ ID NO: 627245 - DNA, 25 bp, Homo sapien
tcgagttagagaagccatgagggtt

SEQ ID NO: 627246 - DNA, 25 bp, Homo sapien
gagggttgctgaaatggctagacat

SEQ ID NO: 627247 - DNA, 25 bp, Homo sapien
agacatgactatgttttgccagttt

SEQ ID NO: 627248 - DNA, 25 bp, Homo sapien
tgcatagtactgaagctctgtcaca

SEQ ID NO: 627249 - DNA, 25 bp, Homo sapien
gctctgtcacaggaggacttagtgc

SEQ ID NO: 627250 - DNA, 25 bp, Homo sapien
gacttagtgcatgcaattggcgaaa

SEQ ID NO: 627251 - DNA, 25 bp, Homo sapien
atttactccaagcaccaatattcgg

SEQ ID NO: 627252 - DNA, 25 bp, Homo sapien
caatattcggtgtcccaatctgggt

SEQ ID NO: 627253 - DNA, 25 bp, Homo sapien
gtgtcccaatctgggtctgctcaga

SEQ ID NO: 627254 - DNA, 25 bp, Homo sapien
gggtctgctcagactgagacctact

SEQ ID NO: 627255 - DNA, 25 bp, Homo sapien
gtgcttttattgacctcttcaactc

SEQ ID NO: 627256 - DNA, 25 bp, Homo sapien
ggcctgggattttagcagagcagtc

SEQ ID NO: 627257 - DNA, 25 bp, Homo sapien
cagagcagtcacagagggttacaca

SEQ ID NO: 627258 - DNA, 25 bp, Homo sapien
cagagggttacacagctgctgacct

SEQ ID NO: 627259 - DNA, 25 bp, Homo sapien
tttctccagaccttgacttgcaggc

SEQ ID NO: 627260 - DNA, 25 bp, Homo sapien
aagtctcttatcagaaccctagaaa

SEQ ID NO: 627261 - DNA, 25 bp, Homo sapien
aacaggactcctgacatttactcca

SEQ ID NO: 627262 - DNA, 25 bp, Homo sapien
agctctctgcttgccctgagtagag

SEQ ID NO: 627263 - DNA, 25 bp, Homo sapien
ttgccctgagtagaggtgatcttca

SEQ ID NO: 627264 - DNA, 25 bp, Homo sapien
gaggtgatcttcagaacagtggaga

SEQ ID NO: 627265 - DNA, 25 bp, Homo sapien
ccataagatacgaggatacagacaa

SEQ ID NO: 627266 - DNA, 25 bp, Homo sapien
cgtgagagccaatagatcgcctact

SEQ ID NO: 627267 - DNA, 25 bp, Homo sapien
gagccaatagatcgcctactgcaaa

SEQ ID NO: 627268 - DNA, 25 bp, Homo sapien
caatagatcgcctactgcaaaaatg

SEQ ID NO: 627269 - DNA, 25 bp, Homo sapien
tacattgaaggagacgtcagagcaa

SEQ ID NO: 627270 - DNA, 25 bp, Homo sapien
atgaagggctgaaatagacggcgat

SEQ ID NO: 627271 - DNA, 25 bp, Homo sapien
atagacggcgatggctgtgccgtaa

SEQ ID NO: 627272 - DNA, 25 bp, Homo sapien
ggctgtgccgtaaaacaacaccacc

SEQ ID NO: 627273 - DNA, 25 bp, Homo sapien
tccaggtttatcttttctcaaagat

SEQ ID NO: 627274 - DNA, 25 bp, Homo sapien
ggtttatcttttctcaaagatgttg

SEQ ID NO: 627275 - DNA, 25 bp, Homo sapien
tatcttttctcaaagatgttggttt

SEQ ID NO: 627276 - DNA, 25 bp, Homo sapien
gtcttcatcagccatgccaatggca

SEQ ID NO: 627277 - DNA, 25 bp, Homo sapien
ttcatcagccatgccaatggcaggc

SEQ ID NO: 627278 - DNA, 25 bp, Homo sapien
agccatgccaatggcaggcaaactt

SEQ ID NO: 627279 - DNA, 25 bp, Homo sapien
gccaatggcaggcaaacttttcccg

SEQ ID NO: 627280 - DNA, 25 bp, Homo sapien
caatggcaggcaaacttttcccgct

SEQ ID NO: 627281 - DNA, 25 bp, Homo sapien
aatggcaggcaaacttttcccgctg

SEQ ID NO: 627282 - DNA, 25 bp, Homo sapien
atggcaggcaaacttttcccgctgg

SEQ ID NO: 627283 - DNA, 25 bp, Homo sapien
tggcaggcaaacttttcccgctggg

SEQ ID NO: 627284 - DNA, 25 bp, Homo sapien
cagtttagatagtggtgtctttgct

SEQ ID NO: 627285 - DNA, 25 bp, Homo sapien
gtctttgctgggtgactgtcctcaa

SEQ ID NO: 627286 - DNA, 25 bp, Homo sapien
gtgactgtcctcaagatctggttgg

SEQ ID NO: 627287 - DNA, 25 bp, Homo sapien
gatctggttggaatatcattcttaa

SEQ ID NO: 627288 - DNA, 25 bp, Homo sapien
gtatttgcatacaggatataattcc

SEQ ID NO: 627289 - DNA, 25 bp, Homo sapien
ggatataattccttgttgatacata

SEQ ID NO: 627290 - DNA, 25 bp, Homo sapien
gttgatacataccaaaaaggcttga

SEQ ID NO: 627291 - DNA, 25 bp, Homo sapien
gcttgatgtttgtaggccaccttct

SEQ ID NO: 627292 - DNA, 25 bp, Homo sapien
gccaccttctctttgaacattcatt

SEQ ID NO: 627293 - DNA, 25 bp, Homo sapien
gaacattcattcactacattttgta

SEQ ID NO: 627294 - DNA, 25 bp, Homo sapien
tcgtgattattgtaatgtttcctag

SEQ ID NO: 627295 - DNA, 25 bp, Homo sapien
ttttcattaaagatactccttactt

SEQ ID NO: 627296 - DNA, 25 bp, Homo sapien
taaagatactccttactttcaaatt

SEQ ID NO: 627297 - DNA, 25 bp, Homo sapien
gatataaaatggtcttgtttctatg

SEQ ID NO: 627298 - DNA, 25 bp, Homo sapien
aaaatggtcttgtttctatgaaaat

SEQ ID NO: 627299 - DNA, 25 bp, Homo sapien
aaccatgttttatttgacatttgga

SEQ ID NO: 627300 - DNA, 25 bp, Homo sapien
gacatttggaatgattttgcaatcc

SEQ ID NO: 627301 - DNA, 25 bp, Homo sapien
gcaatccatgtgtttatttagcatc

SEQ ID NO: 627302 - DNA, 25 bp, Homo sapien
gcatcaattatcataacttcctaag

SEQ ID NO: 627303 - DNA, 25 bp, Homo sapien
aattcaacaattcttttatgccaaa

SEQ ID NO: 627304 - DNA, 25 bp, Homo sapien
gggaaaagggcaaatatctcttcat

SEQ ID NO: 627305 - DNA, 25 bp, Homo sapien
ggcaaatatctcttcatttctttct

SEQ ID NO: 627306 - DNA, 25 bp, Homo sapien
tagacagaaaatgtctctctgtacc

SEQ ID NO: 627307 - DNA, 25 bp, Homo sapien
gtctctctgtacctatgatttgtgt

SEQ ID NO: 627308 - DNA, 25 bp, Homo sapien
aaaccattatcatggcagtctactg

SEQ ID NO: 627309 - DNA, 25 bp, Homo sapien
tggcagtctactgattgcagggaat

SEQ ID NO: 627310 - DNA, 25 bp, Homo sapien
ctgattgcagggaatgtcacttcac

SEQ ID NO: 627311 - DNA, 25 bp, Homo sapien
gcagggaatgtcacttcacatttcc

SEQ ID NO: 627312 - DNA, 25 bp, Homo sapien
tcacatttccacatcaacaactttt

SEQ ID NO: 627313 - DNA, 25 bp, Homo sapien
acagaatgctgacttttgttccctt

SEQ ID NO: 627314 - DNA, 25 bp, Homo sapien
ttgttcccttgcctgagacttatat

SEQ ID NO: 627315 - DNA, 25 bp, Homo sapien
ttgcctgagacttatatgacagcta

SEQ ID NO: 627316 - DNA, 25 bp, Homo sapien
atgacagctatttcagctacttttt

SEQ ID NO: 627317 - DNA, 25 bp, Homo sapien
ccagtttatgccacttttcagctta

SEQ ID NO: 627318 - DNA, 25 bp, Homo sapien
ttcagcttactttctgcaaatcaag

SEQ ID NO: 627319 - DNA, 25 bp, Homo sapien
gatcatttttattgtgaccgaggac

SEQ ID NO: 627320 - DNA, 25 bp, Homo sapien
ttgtgaccgaggacaattgctcaag

SEQ ID NO: 627321 - DNA, 25 bp, Homo sapien
ggacaattgctcaaggtatcctgtg

SEQ ID NO: 627322 - DNA, 25 bp, Homo sapien
tatcctgtgaggacactcttttcag

SEQ ID NO: 627323 - DNA, 25 bp, Homo sapien
tcattggttctttgatccctacgat

SEQ ID NO: 627324 - DNA, 25 bp, Homo sapien
ttgatccctacgattgtctcctaca

SEQ ID NO: 627325 - DNA, 25 bp, Homo sapien
acatcattatgaacagcagcacctt

SEQ ID NO: 627326 - DNA, 25 bp, Homo sapien
tgaacagcagcaccttcatttgggt

SEQ ID NO: 627327 - DNA, 25 bp, Homo sapien
ccttcatttgggtgataattgtgtc

SEQ ID NO: 627328 - DNA, 25 bp, Homo sapien
gaggccgtgtcctcttttccttaga

SEQ ID NO: 627329 - DNA, 25 bp, Homo sapien
tttccttagagaggctgacggtgac

SEQ ID NO: 627330 - DNA, 25 bp, Homo sapien
ctgacggtgacagcttgggccattt

SEQ ID NO: 627331 - DNA, 25 bp, Homo sapien
agcttgggccattttatgtctcctg

SEQ ID NO: 627332 - DNA, 25 bp, Homo sapien
tccctgtcgttatttgaatttgtga

SEQ ID NO: 627333 - DNA, 25 bp, Homo sapien
gaatttgtgacccttgctgctgaga

SEQ ID NO: 627334 - DNA, 25 bp, Homo sapien
tgctgctgagatcctccccaagaga

SEQ ID NO: 627335 - DNA, 25 bp, Homo sapien
gaactttctcggtggagagcccaga

SEQ ID NO: 627336 - DNA, 25 bp, Homo sapien
gagagcccagacaacacccttggta

SEQ ID NO: 627337 - DNA, 25 bp, Homo sapien
aacacccttggtagctgggaagcca

SEQ ID NO: 627338 - DNA, 25 bp, Homo sapien
tgggaagccacatgctggatgagct

SEQ ID NO: 627339 - DNA, 25 bp, Homo sapien
gaaaagttcctgactcctcctcctg

SEQ ID NO: 627340 - DNA, 25 bp, Homo sapien
taaaatctagaaacggtggtgccca

SEQ ID NO: 627341 - DNA, 25 bp, Homo sapien
gtggtgcccatgacttggagaagac

SEQ ID NO: 627342 - DNA, 25 bp, Homo sapien
tggagaagactcagcaccacccagc

SEQ ID NO: 627343 - DNA, 25 bp, Homo sapien
tggtccacttccttggcgtgtgaac

SEQ ID NO: 627344 - DNA, 25 bp, Homo sapien
ggcgtgtgaacatgcttgaattcta

SEQ ID NO: 627345 - DNA, 25 bp, Homo sapien
gaattctaaggttttatcctcaagt

SEQ ID NO: 627346 - DNA, 25 bp, Homo sapien
gatttgtggttgcagccaagaacac

SEQ ID NO: 627347 - DNA, 25 bp, Homo sapien
aagaacacactcacgtggacacaca

SEQ ID NO: 627348 - DNA, 25 bp, Homo sapien
gatgatcaccagtctttttgtttgt

SEQ ID NO: 627349 - DNA, 25 bp, Homo sapien
gacatgcaacctgccagtgttttac

SEQ ID NO: 627350 - DNA, 25 bp, Homo sapien
gtcttcctatcgctgtgtacaatgg

SEQ ID NO: 627351 - DNA, 25 bp, Homo sapien
ctatcgctgtgtacaatggctttca

SEQ ID NO: 627352 - DNA, 25 bp, Homo sapien
gctgtgtacaatggctttcagtaga

SEQ ID NO: 627353 - DNA, 25 bp, Homo sapien
ggctttcagtagaactttttacatc

SEQ ID NO: 627354 - DNA, 25 bp, Homo sapien
gaactttttacatcttcaaactcat

SEQ ID NO: 627355 - DNA, 25 bp, Homo sapien
tcttcaaactcatcagataactgtg

SEQ ID NO: 627356 - DNA, 25 bp, Homo sapien
aatatctttttctgaggacattcct

SEQ ID NO: 627357 - DNA, 25 bp, Homo sapien
ttttctgaggacattcctcccaaat

SEQ ID NO: 627358 - DNA, 25 bp, Homo sapien
ctgataggtccttttctgttttgag

SEQ ID NO: 627359 - DNA, 25 bp, Homo sapien
gcttcagtgtagtggcacgacgaaa

SEQ ID NO: 627360 - DNA, 25 bp, Homo sapien
gtggcacgacgaaaaccagagacct

SEQ ID NO: 627361 - DNA, 25 bp, Homo sapien
gaaaccagttttgccctgcagatac

SEQ ID NO: 627362 - DNA, 25 bp, Homo sapien
gtgggaatctcatcgatcacttcac

SEQ ID NO: 627363 - DNA, 25 bp, Homo sapien
acgtgtgaaattctggcggtgctaa

SEQ ID NO: 627364 - DNA, 25 bp, Homo sapien
aagttagcttgcacaagttcactgc

SEQ ID NO: 627365 - DNA, 25 bp, Homo sapien
gttcactgctcatgaacaccatcat

SEQ ID NO: 627366 - DNA, 25 bp, Homo sapien
ttgccaattccaatgcccttagttt

SEQ ID NO: 627367 - DNA, 25 bp, Homo sapien
agtttgcatctcttacatcttcatc

SEQ ID NO: 627368 - DNA, 25 bp, Homo sapien
atcttcatcctttccactattctga

SEQ ID NO: 627369 - DNA, 25 bp, Homo sapien
ccatcatcatgaacaggtgcgtctg

SEQ ID NO: 627370 - DNA, 25 bp, Homo sapien
gtctgtgcacggatggccacggtct

SEQ ID NO: 627371 - DNA, 25 bp, Homo sapien
tgaccgctctgctggaaaccagttt

SEQ ID NO: 627372 - DNA, 25 bp, Homo sapien
gccttacctatctacaatgtgtgga

SEQ ID NO: 627373 - DNA, 25 bp, Homo sapien
ccttacctatctacaatgtgtggat

SEQ ID NO: 627374 - DNA, 25 bp, Homo sapien
cttacctatctacaatgtgtggatg

SEQ ID NO: 627375 - DNA, 25 bp, Homo sapien
ttacctatctacaatgtgtggatga

SEQ ID NO: 627376 - DNA, 25 bp, Homo sapien
tacctatctacaatgtgtggatgat

SEQ ID NO: 627377 - DNA, 25 bp, Homo sapien
acctatctacaatgtgtggatgatt

SEQ ID NO: 627378 - DNA, 25 bp, Homo sapien
ctatctacaatgtgtggatgatttc

SEQ ID NO: 627379 - DNA, 25 bp, Homo sapien
gtgtggatgatttcttacactaaag

SEQ ID NO: 627380 - DNA, 25 bp, Homo sapien
atttcttacactaaagatgctgggc

SEQ ID NO: 627381 - DNA, 25 bp, Homo sapien
cttacactaaagatgctgggctggg

SEQ ID NO: 627382 - DNA, 25 bp, Homo sapien
ttacactaaagatgctgggctgggt

SEQ ID NO: 627383 - DNA, 25 bp, Homo sapien
accaccgctataagaaacagtgatt

SEQ ID NO: 627384 - DNA, 25 bp, Homo sapien
aaaggcgacaagatccgcttgctgt

SEQ ID NO: 627385 - DNA, 25 bp, Homo sapien
aggcgacaagatccgcttgctgttt

SEQ ID NO: 627386 - DNA, 25 bp, Homo sapien
gacaagatccgcttgctgtttgcac

SEQ ID NO: 627387 - DNA, 25 bp, Homo sapien
aagatccgcttgctgtttgcacctc

SEQ ID NO: 627388 - DNA, 25 bp, Homo sapien
cttgctgtttgcacctctgtttaaa

SEQ ID NO: 627389 - DNA, 25 bp, Homo sapien
gctgtttgcacctctgtttaaacca

SEQ ID NO: 627390 - DNA, 25 bp, Homo sapien
gtttgcacctctgtttaaaccaccg

SEQ ID NO: 627391 - DNA, 25 bp, Homo sapien
cctctgtttaaaccaccgctataag

SEQ ID NO: 627392 - DNA, 25 bp, Homo sapien
tctgtttaaaccaccgctataagaa

SEQ ID NO: 627393 - DNA, 25 bp, Homo sapien
ttaaaccaccgctataagaaacagt

SEQ ID NO: 627394 - DNA, 25 bp, Homo sapien
tgactttcactcctcaagatccatt

SEQ ID NO: 627395 - DNA, 25 bp, Homo sapien
agatccattctctatgatgcccttc

SEQ ID NO: 627396 - DNA, 25 bp, Homo sapien
tatgatgcccttcccacttgaaaga

SEQ ID NO: 627397 - DNA, 25 bp, Homo sapien
tgcccttcccacttgaaagagcttt

SEQ ID NO: 627398 - DNA, 25 bp, Homo sapien
agagctttctttagccaaggtcttt

SEQ ID NO: 627399 - DNA, 25 bp, Homo sapien
agccaaggtctttctttgatactct

SEQ ID NO: 627400 - DNA, 25 bp, Homo sapien
aggtctttctttgatactctgtccc

SEQ ID NO: 627401 - DNA, 25 bp, Homo sapien
tactctgtccccctaaaaatcagtg

SEQ ID NO: 627402 - DNA, 25 bp, Homo sapien
tttgatttcgcaaattttctgtcac

SEQ ID NO: 627403 - DNA, 25 bp, Homo sapien
tttctgtcacttggaatgattctta

SEQ ID NO: 627404 - DNA, 25 bp, Homo sapien
ttcatagctcagtatagaactacat

SEQ ID NO: 627405 - DNA, 25 bp, Homo sapien
ggagactgtccttttgtaggctaaa

SEQ ID NO: 627406 - DNA, 25 bp, Homo sapien
ggctaaatgctgtcagccacttctt

SEQ ID NO: 627407 - DNA, 25 bp, Homo sapien
tgacattccttcactgctaaagctg

SEQ ID NO: 627408 - DNA, 25 bp, Homo sapien
atgttctgacacctccatgaatgag

SEQ ID NO: 627409 - DNA, 25 bp, Homo sapien
gaatgagttgttgctgttaaccttc

SEQ ID NO: 627410 - DNA, 25 bp, Homo sapien
tgttaaccttctccggagtcattgc

SEQ ID NO: 627411 - DNA, 25 bp, Homo sapien
atggccaccttcttgactgtgatca

SEQ ID NO: 627412 - DNA, 25 bp, Homo sapien
gactgtgatcatttcctacatcttc

SEQ ID NO: 627413 - DNA, 25 bp, Homo sapien
gctttacactgtagccatgtctgat

SEQ ID NO: 627414 - DNA, 25 bp, Homo sapien
ttgcttttgctagcctaaggatcca

SEQ ID NO: 627415 - DNA, 25 bp, Homo sapien
ggagcttgtcacaggatcatggata

SEQ ID NO: 627416 - DNA, 25 bp, Homo sapien
attttttgtgtccattgtgtgctca

SEQ ID NO: 627417 - DNA, 25 bp, Homo sapien
gtgtccattgtgtgctcaaagcttt

SEQ ID NO: 627418 - DNA, 25 bp, Homo sapien
gcttttatagctgagaccatgattg

SEQ ID NO: 627419 - DNA, 25 bp, Homo sapien
tgagaccatgattggtgcctcttct

SEQ ID NO: 627420 - DNA, 25 bp, Homo sapien
attggtgcctcttctccgtagggat

SEQ ID NO: 627421 - DNA, 25 bp, Homo sapien
ctcttctccgtagggatttccagca

SEQ ID NO: 627422 - DNA, 25 bp, Homo sapien
tccagcacacttgagcaaggaaagg

SEQ ID NO: 627423 - DNA, 25 bp, Homo sapien
ggaactacatggatctcagtctgtt

SEQ ID NO: 627424 - DNA, 25 bp, Homo sapien
ggatctcagtctgttaagataacaa

SEQ ID NO: 627425 - DNA, 25 bp, Homo sapien
agtagagaaagtgtacctgtgacta

SEQ ID NO: 627426 - DNA, 25 bp, Homo sapien
tgtacctgtgactaacttttagtaa

SEQ ID NO: 627427 - DNA, 25 bp, Homo sapien
ggagcggttgcttccttcgtgccca

SEQ ID NO: 627428 - DNA, 25 bp, Homo sapien
caggccagggcctctgaagccgagc

SEQ ID NO: 627429 - DNA, 25 bp, Homo sapien
cagggcctctgaagccgagcctcgg

SEQ ID NO: 627430 - DNA, 25 bp, Homo sapien
gtttttgtgatgatgcttggccttc

SEQ ID NO: 627431 - DNA, 25 bp, Homo sapien
atgatgcttggccttccgtgctggt

SEQ ID NO: 627432 - DNA, 25 bp, Homo sapien
atgcttggccttccgtgctggtcca

SEQ ID NO: 627433 - DNA, 25 bp, Homo sapien
catccgccatctgggacttctggga

SEQ ID NO: 627434 - DNA, 25 bp, Homo sapien
ggacttctgggaggcgacaacgcct

SEQ ID NO: 627435 - DNA, 25 bp, Homo sapien
tgggaggcgacaacgccttcctgcg

SEQ ID NO: 627436 - DNA, 25 bp, Homo sapien
gcagctgcagtagggtctccttcgc

SEQ ID NO: 627437 - DNA, 25 bp, Homo sapien
agtagggtctccttcgccctcgagg

SEQ ID NO: 627438 - DNA, 25 bp, Homo sapien
ggagaatactgaccaccagcataac

SEQ ID NO: 627439 - DNA, 25 bp, Homo sapien
agcataaccatgtccacgagcaggg

SEQ ID NO: 627440 - DNA, 25 bp, Homo sapien
gggaactcacacaagctagttttag

SEQ ID NO: 627441 - DNA, 25 bp, Homo sapien
ttagcactgcaaggatttcacatgt

SEQ ID NO: 627442 - DNA, 25 bp, Homo sapien
aaatggtcgatgacattcccacaga

SEQ ID NO: 627443 - DNA, 25 bp, Homo sapien
gggcacaactagttaccagcagagc

SEQ ID NO: 627444 - DNA, 25 bp, Homo sapien
agcagagcagtcagacagcctgtca

SEQ ID NO: 627445 - DNA, 25 bp, Homo sapien
agacagcctgtcacccaggagatgg

SEQ ID NO: 627446 - DNA, 25 bp, Homo sapien
tgtcacccaggagatggcggccatc

SEQ ID NO: 627447 - DNA, 25 bp, Homo sapien
atggcggccatctgcacacagacgt

SEQ ID NO: 627448 - DNA, 25 bp, Homo sapien
ggatgaagccatacgagatgcaaat

SEQ ID NO: 627449 - DNA, 25 bp, Homo sapien
gtcgacagattttgcctatcattag

SEQ ID NO: 627450 - DNA, 25 bp, Homo sapien
attttgcctatcattaggatctggg

SEQ ID NO: 627451 - DNA, 25 bp, Homo sapien
gggatactgatgttccatcatcaag

SEQ ID NO: 627452 - DNA, 25 bp, Homo sapien
gttccatcatcaagggccaagtcgt

SEQ ID NO: 627453 - DNA, 25 bp, Homo sapien
tctccctggaaggagctaatccttt

SEQ ID NO: 627454 - DNA, 25 bp, Homo sapien
tcctttcccctcagtcttaaaatga

SEQ ID NO: 627455 - DNA, 25 bp, Homo sapien
gtcttaaaatgagggcacgttccca

SEQ ID NO: 627456 - DNA, 25 bp, Homo sapien
aaatgagggcacgttcccaggacgc

SEQ ID NO: 627457 - DNA, 25 bp, Homo sapien
tgctcaccgatgagcggcacgctct

SEQ ID NO: 627458 - DNA, 25 bp, Homo sapien
gctctcggccggtggcatgctctcg

SEQ ID NO: 627459 - DNA, 25 bp, Homo sapien
caagcagtcgacagattttgcctat

SEQ ID NO: 627460 - DNA, 25 bp, Homo sapien
gctgaatacctgaattgaacctgag

SEQ ID NO: 627461 - DNA, 25 bp, Homo sapien
acaatgggataatgtcacagtaaat

SEQ ID NO: 627462 - DNA, 25 bp, Homo sapien
gatgtactatgttggagttacagaa

SEQ ID NO: 627463 - DNA, 25 bp, Homo sapien
gattaaagcatgaagaagaccacct

SEQ ID NO: 627464 - DNA, 25 bp, Homo sapien
gaagaccacctacatatgacaagat

SEQ ID NO: 627465 - DNA, 25 bp, Homo sapien
tgacaagattaatagccggatgcac

SEQ ID NO: 627466 - DNA, 25 bp, Homo sapien
attaatagccggatgcacagtccat

SEQ ID NO: 627467 - DNA, 25 bp, Homo sapien
gatgcacagtccattggtcataatg

SEQ ID NO: 627468 - DNA, 25 bp, Homo sapien
gtccattggtcataatggctggata

SEQ ID NO: 627469 - DNA, 25 bp, Homo sapien
tttcctttttaagattgcgaagaga

SEQ ID NO: 627470 - DNA, 25 bp, Homo sapien
gaatagtcacaatgctgaatacctg

SEQ ID NO: 627471 - DNA, 25 bp, Homo sapien
ccagctttggccatcgtggtagtaa

SEQ ID NO: 627472 - DNA, 25 bp, Homo sapien
gtaaacctgatcacagtcacactgg

SEQ ID NO: 627473 - DNA, 25 bp, Homo sapien
gtcacactggtgattgtcaagaccc

SEQ ID NO: 627474 - DNA, 25 bp, Homo sapien
gtgattgtcaagacccagcgagctg

SEQ ID NO: 627475 - DNA, 25 bp, Homo sapien
agacccagcgagctgccattggcaa

SEQ ID NO: 627476 - DNA, 25 bp, Homo sapien
gccattggcaattccatgttccagg

SEQ ID NO: 627477 - DNA, 25 bp, Homo sapien
aatcagcaagaacatcgccatcctc

SEQ ID NO: 627478 - DNA, 25 bp, Homo sapien
atttggagtagccactgtcatcgat

SEQ ID NO: 627479 - DNA, 25 bp, Homo sapien
tgtcatcgatgacagatccctggcc

SEQ ID NO: 627480 - DNA, 25 bp, Homo sapien
tgctcaatgcattccaggtaagtcc

SEQ ID NO: 627481 - DNA, 25 bp, Homo sapien
cagatgcttctgaccaagtgcaaag

SEQ ID NO: 627482 - DNA, 25 bp, Homo sapien
cactagcagcgtccgtgatgctgtt

SEQ ID NO: 627483 - DNA, 25 bp, Homo sapien
gcgtccgtgatgctgttcttgtgaa

SEQ ID NO: 627484 - DNA, 25 bp, Homo sapien
gtgaatgtcgaacacaaactgtggg

SEQ ID NO: 627485 - DNA, 25 bp, Homo sapien
acaaactgtgggttcttgatcacgt

SEQ ID NO: 627486 - DNA, 25 bp, Homo sapien
actgtgggttcttgatcacgttcac

SEQ ID NO: 627487 - DNA, 25 bp, Homo sapien
ttcttgatcacgttcaccccagaag

SEQ ID NO: 627488 - DNA, 25 bp, Homo sapien
ctgtagtcgggatgtccttggcgta

SEQ ID NO: 627489 - DNA, 25 bp, Homo sapien
tcacgttcaccccagaagcgcaggg

SEQ ID NO: 627490 - DNA, 25 bp, Homo sapien
agcagtttgttggaggtgagtcctt

SEQ ID NO: 627491 - DNA, 25 bp, Homo sapien
aggtgagtccttgcccagcttgtgc

SEQ ID NO: 627492 - DNA, 25 bp, Homo sapien
aggagtccatgaagtctggccacca

SEQ ID NO: 627493 - DNA, 25 bp, Homo sapien
acacagacccgctcaggacggcttt

SEQ ID NO: 627494 - DNA, 25 bp, Homo sapien
caggacggcttttctgtatggcaga

SEQ ID NO: 627495 - DNA, 25 bp, Homo sapien
gtatggcagatctttctcagaagtg

SEQ ID NO: 627496 - DNA, 25 bp, Homo sapien
gcagatctttctcagaagtgctggg

SEQ ID NO: 627497 - DNA, 25 bp, Homo sapien
tttttcccctgaattctcgctcctt

SEQ ID NO: 627498 - DNA, 25 bp, Homo sapien
tgaattctcgctcctttcccttata

SEQ ID NO: 627499 - DNA, 25 bp, Homo sapien
tacattaagggatttaggcaggtgc

SEQ ID NO: 627500 - DNA, 25 bp, Homo sapien
gaggatcgcgtgagcccgaagaatt

SEQ ID NO: 627501 - DNA, 25 bp, Homo sapien
gcgtgagcccgaagaatttgagact

SEQ ID NO: 627502 - DNA, 25 bp, Homo sapien
ctagcgagaccgcatctctgtgaaa

SEQ ID NO: 627503 - DNA, 25 bp, Homo sapien
gcgagaccgcatctctgtgaaataa

SEQ ID NO: 627504 - DNA, 25 bp, Homo sapien
tatcgacctctgagagcatccgggt

SEQ ID NO: 627505 - DNA, 25 bp, Homo sapien
gagcatccgggtaactgagggttta

SEQ ID NO: 627506 - DNA, 25 bp, Homo sapien
gaatagggacaggagacctcacctt

SEQ ID NO: 627507 - DNA, 25 bp, Homo sapien
ggacaggagacctcacctttctttt

SEQ ID NO: 627508 - DNA, 25 bp, Homo sapien
acctttcttttccatgtagccatag

SEQ ID NO: 627509 - DNA, 25 bp, Homo sapien
gtagccataggagatagtcccacga

SEQ ID NO: 627510 - DNA, 25 bp, Homo sapien
ggagatagtcccacgatctgatgat

SEQ ID NO: 627511 - DNA, 25 bp, Homo sapien
gatctgatgatctgtagcaatgggt

SEQ ID NO: 627512 - DNA, 25 bp, Homo sapien
taggaacagaagctagtttcgtcat

SEQ ID NO: 627513 - DNA, 25 bp, Homo sapien
gctagtttcgtcatgggaagtcccc

SEQ ID NO: 627514 - DNA, 25 bp, Homo sapien
tcgtcatgggaagtcccctgttttc

SEQ ID NO: 627515 - DNA, 25 bp, Homo sapien
gggacccatgaggaactttttcttg

SEQ ID NO: 627516 - DNA, 25 bp, Homo sapien
ctttttcttgtatttgtttgccatt

SEQ ID NO: 627517 - DNA, 25 bp, Homo sapien
gccatttttaacactttgcaagatg

SEQ ID NO: 627518 - DNA, 25 bp, Homo sapien
tgagcacaaactgttgacgccatct

SEQ ID NO: 627519 - DNA, 25 bp, Homo sapien
acgccatctctcaagtcaactgcaa

SEQ ID NO: 627520 - DNA, 25 bp, Homo sapien
tgcaactagctccactttcaaatct

SEQ ID NO: 627521 - DNA, 25 bp, Homo sapien
aaatctttaggctctgcacaaggca

SEQ ID NO: 627522 - DNA, 25 bp, Homo sapien
tctgcacaaggcacaccttcagaaa

SEQ ID NO: 627523 - DNA, 25 bp, Homo sapien
aagctttccaaatgctccagagctc

SEQ ID NO: 627524 - DNA, 25 bp, Homo sapien
agctcagtgccctgcatgtggtggc

SEQ ID NO: 627525 - DNA, 25 bp, Homo sapien
atgtggtggcttcagagcccactac

SEQ ID NO: 627526 - DNA, 25 bp, Homo sapien
caacatagtgataaccctccatcac

SEQ ID NO: 627527 - DNA, 25 bp, Homo sapien
aacatagtgataaccctccatcact

SEQ ID NO: 627528 - DNA, 25 bp, Homo sapien
acatagtgataaccctccatcacta

SEQ ID NO: 627529 - DNA, 25 bp, Homo sapien
atagtgataaccctccatcactaca

SEQ ID NO: 627530 - DNA, 25 bp, Homo sapien
tagtgataaccctccatcactacaa

SEQ ID NO: 627531 - DNA, 25 bp, Homo sapien
agtgataaccctccatcactacaaa

SEQ ID NO: 627532 - DNA, 25 bp, Homo sapien
gtgataaccctccatcactacaaaa

SEQ ID NO: 627533 - DNA, 25 bp, Homo sapien
tgataaccctccatcactacaaaaa

SEQ ID NO: 627534 - DNA, 25 bp, Homo sapien
agttcaaggttgcatgaaggagttc

SEQ ID NO: 627535 - DNA, 25 bp, Homo sapien
gttcaaggttgcatgaaggagttca

SEQ ID NO: 627536 - DNA, 25 bp, Homo sapien
tcaaggttgcatgaaggagttcaag

SEQ ID NO: 627537 - DNA, 25 bp, Homo sapien
tcggcctcccaacaagaaagctttc

SEQ ID NO: 627538 - DNA, 25 bp, Homo sapien
gcctcccaacaagaaagctttcagt

SEQ ID NO: 627539 - DNA, 25 bp, Homo sapien
agctttcagtccagtatttccagtc

SEQ ID NO: 627540 - DNA, 25 bp, Homo sapien
agtccagtatttccagtccttagtc

SEQ ID NO: 627541 - DNA, 25 bp, Homo sapien
atttccagtccttagtcatctgtgg

SEQ ID NO: 627542 - DNA, 25 bp, Homo sapien
ttagtcatctgtggattccctccat

SEQ ID NO: 627543 - DNA, 25 bp, Homo sapien
attccctccatgtttttgaccattt

SEQ ID NO: 627544 - DNA, 25 bp, Homo sapien
catgtttttgaccatttccattttt

SEQ ID NO: 627545 - DNA, 25 bp, Homo sapien
aaatagtatggatttctggtctccc

SEQ ID NO: 627546 - DNA, 25 bp, Homo sapien
gtgataacatctaacataactgtag

SEQ ID NO: 627547 - DNA, 25 bp, Homo sapien
aacataactgtagcacattgtcaaa

SEQ ID NO: 627548 - DNA, 25 bp, Homo sapien
caaacaaaaaagtggacataggcat

SEQ ID NO: 627549 - DNA, 25 bp, Homo sapien
aaacaaaaaagtggacataggcatt

SEQ ID NO: 627550 - DNA, 25 bp, Homo sapien
aacaaaaaagtggacataggcattc

SEQ ID NO: 627551 - DNA, 25 bp, Homo sapien
acaaaaaagtggacataggcattct

SEQ ID NO: 627552 - DNA, 25 bp, Homo sapien
caaaaaagtggacataggcattcta

SEQ ID NO: 627553 - DNA, 25 bp, Homo sapien
aaaaaagtggacataggcattctag

SEQ ID NO: 627554 - DNA, 25 bp, Homo sapien
aaaaagtggacataggcattctagt

SEQ ID NO: 627555 - DNA, 25 bp, Homo sapien
aagtggacataggcattctagtcag

SEQ ID NO: 627556 - DNA, 25 bp, Homo sapien
ttgagtctttacaatgtttaatata

SEQ ID NO: 627557 - DNA, 25 bp, Homo sapien
ttttcattaaagatactccttactt

SEQ ID NO: 627558 - DNA, 25 bp, Homo sapien
taaagatactccttactttcaaatt

SEQ ID NO: 627559 - DNA, 25 bp, Homo sapien
gatataaaatggtcttgtttctatg

SEQ ID NO: 627560 - DNA, 25 bp, Homo sapien
aaccatgttttatttgacatttgga

SEQ ID NO: 627561 - DNA, 25 bp, Homo sapien
gacatttggaatgattttgcaatcc

SEQ ID NO: 627562 - DNA, 25 bp, Homo sapien
gcatcaattatcataacttcctaag

SEQ ID NO: 627563 - DNA, 25 bp, Homo sapien
tcaattatcataacttcctaagaaa

SEQ ID NO: 627564 - DNA, 25 bp, Homo sapien
aattcaacaattcttttatgccaaa

SEQ ID NO: 627565 - DNA, 25 bp, Homo sapien
gggaaaagggcaaatatctcttcat

SEQ ID NO: 627566 - DNA, 25 bp, Homo sapien
gaaaagggcaaatatctcttcattt

SEQ ID NO: 627567 - DNA, 25 bp, Homo sapien
attatggctttcttggacctcttca

SEQ ID NO: 627568 - DNA, 25 bp, Homo sapien
agaagcctgagaaccggaactacat

SEQ ID NO: 627569 - DNA, 25 bp, Homo sapien
gaaccggaactacatagaggccaga

SEQ ID NO: 627570 - DNA, 25 bp, Homo sapien
atcagtgtctacatgctaaaggcaa

SEQ ID NO: 627571 - DNA, 25 bp, Homo sapien
gctaaaggcaattttcaggaacaag

SEQ ID NO: 627572 - DNA, 25 bp, Homo sapien
attttcaggaacaagtaccaggagc

SEQ ID NO: 627573 - DNA, 25 bp, Homo sapien
gaaggtggttttatgaacccagagg

SEQ ID NO: 627574 - DNA, 25 bp, Homo sapien
tggttatgagttgtggtgccacttt

SEQ ID NO: 627575 - DNA, 25 bp, Homo sapien
gtgccactttattcaaccttatctg

SEQ ID NO: 627576 - DNA, 25 bp, Homo sapien
caaccttatctgcttggaagttttt

SEQ ID NO: 627577 - DNA, 25 bp, Homo sapien
caagaagggctgtattatggctttc

SEQ ID NO: 627578 - DNA, 25 bp, Homo sapien
ttgtgattagaaatgtgggcttggc

SEQ ID NO: 627579 - DNA, 25 bp, Homo sapien
tgtgattagaaatgtgggcttggcc

SEQ ID NO: 627580 - DNA, 25 bp, Homo sapien
gtgattagaaatgtgggcttggcca

SEQ ID NO: 627581 - DNA, 25 bp, Homo sapien
tgattagaaatgtgggcttggccag

SEQ ID NO: 627582 - DNA, 25 bp, Homo sapien
gattagaaatgtgggcttggccagg

SEQ ID NO: 627583 - DNA, 25 bp, Homo sapien
attagaaatgtgggcttggccaggc

SEQ ID NO: 627584 - DNA, 25 bp, Homo sapien
ttagaaatgtgggcttggccaggcg

SEQ ID NO: 627585 - DNA, 25 bp, Homo sapien
agaaatgtgggcttggccaggcgta

SEQ ID NO: 627586 - DNA, 25 bp, Homo sapien
gaaatgtgggcttggccaggcgtag

SEQ ID NO: 627587 - DNA, 25 bp, Homo sapien
aaatgtgggcttggccaggcgtagt

SEQ ID NO: 627588 - DNA, 25 bp, Homo sapien
aatgtgggcttggccaggcgtagtg

SEQ ID NO: 627589 - DNA, 25 bp, Homo sapien
attgctggtctgtttgcagatgcat

SEQ ID NO: 627590 - DNA, 25 bp, Homo sapien
gcagatgcattatcagtgcatgcaa

SEQ ID NO: 627591 - DNA, 25 bp, Homo sapien
aaataagattatgcctcgtttagga

SEQ ID NO: 627592 - DNA, 25 bp, Homo sapien
cctcgtttaggattctctttcttgt

SEQ ID NO: 627593 - DNA, 25 bp, Homo sapien
tgtaaagtccaatcactgctgcatt

SEQ ID NO: 627594 - DNA, 25 bp, Homo sapien
tcacatatagtgacacacattggat

SEQ ID NO: 627595 - DNA, 25 bp, Homo sapien
aacttcagccacatgattctttcac

SEQ ID NO: 627596 - DNA, 25 bp, Homo sapien
cagccacatgattctttcactcaaa

SEQ ID NO: 627597 - DNA, 25 bp, Homo sapien
aaaacataatgtggctctcctttat

SEQ ID NO: 627598 - DNA, 25 bp, Homo sapien
tgtggctctcctttatatctttttt

SEQ ID NO: 627599 - DNA, 25 bp, Homo sapien
ttgcatagctttccattgtgtgtat

SEQ ID NO: 627600 - DNA, 25 bp, Homo sapien
tggagccagcctgggtattgggatt

SEQ ID NO: 627601 - DNA, 25 bp, Homo sapien
ccaggtgattctaaggcagttgaga

SEQ ID NO: 627602 - DNA, 25 bp, Homo sapien
ggcaggatgatatcaaatctttctc

SEQ ID NO: 627603 - DNA, 25 bp, Homo sapien
atatcaaatctttctcaggtggaaa

SEQ ID NO: 627604 - DNA, 25 bp, Homo sapien
tggagagctctttgggcactgcaga

SEQ ID NO: 627605 - DNA, 25 bp, Homo sapien
agctctttgggcactgcagagtgga

SEQ ID NO: 627606 - DNA, 25 bp, Homo sapien
gctgggaagggactgcattcctgca

SEQ ID NO: 627607 - DNA, 25 bp, Homo sapien
gcattcctgcaagggacctcttgga

SEQ ID NO: 627608 - DNA, 25 bp, Homo sapien
caagggacctcttggaagcccctct

SEQ ID NO: 627609 - DNA, 25 bp, Homo sapien
cagctatgcctgttctaccataaga

SEQ ID NO: 627610 - DNA, 25 bp, Homo sapien
tgttctaccataagacatgttcccc

SEQ ID NO: 627611 - DNA, 25 bp, Homo sapien
tcaccttccaattgccttactgtgt

SEQ ID NO: 627612 - DNA, 25 bp, Homo sapien
tactgtgtccccaatgaggtggact

SEQ ID NO: 627613 - DNA, 25 bp, Homo sapien
gaggtggactattatttccgtgata

SEQ ID NO: 627614 - DNA, 25 bp, Homo sapien
atcccagtcatgctgaagctggctt

SEQ ID NO: 627615 - DNA, 25 bp, Homo sapien
aagctggcttgtgcagatacctcag

SEQ ID NO: 627616 - DNA, 25 bp, Homo sapien
gggttcatcagtgtgggcctcatgc

SEQ ID NO: 627617 - DNA, 25 bp, Homo sapien
gcatcgtcttctccatcttgtagat

SEQ ID NO: 627618 - DNA, 25 bp, Homo sapien
gctacaccataatcatgagccacag

SEQ ID NO: 627619 - DNA, 25 bp, Homo sapien
tgagccacagagcatgtatcatcct

SEQ ID NO: 627620 - DNA, 25 bp, Homo sapien
gagcatgtatcatcctagccatggg

SEQ ID NO: 627621 - DNA, 25 bp, Homo sapien
tcattcttcggctgcattcaggcca

SEQ ID NO: 627622 - DNA, 25 bp, Homo sapien
gaccccaatatcatagataacttct

SEQ ID NO: 627623 - DNA, 25 bp, Homo sapien
catgatcttcaacagtgggctgcta

SEQ ID NO: 627624 - DNA, 25 bp, Homo sapien
agtgggctgctagttatcatctggt

SEQ ID NO: 627625 - DNA, 25 bp, Homo sapien
tgctagttatcatctggttcctcct

SEQ ID NO: 627626 - DNA, 25 bp, Homo sapien
tccttctgatctcttatactgtcat

SEQ ID NO: 627627 - DNA, 25 bp, Homo sapien
atctcttatactgtcatcctggtga

SEQ ID NO: 627628 - DNA, 25 bp, Homo sapien
gtgatgctgaggtcccactcgggaa

SEQ ID NO: 627629 - DNA, 25 bp, Homo sapien
ctgaggtcccactcgggaaaggcaa

SEQ ID NO: 627630 - DNA, 25 bp, Homo sapien
gtggtgtccatgatcttcattccct

SEQ ID NO: 627631 - DNA, 25 bp, Homo sapien
tcttcattccctgtatctatatcta

SEQ ID NO: 627632 - DNA, 25 bp, Homo sapien
tccctgtatctatatctatacctgg

SEQ ID NO: 627633 - DNA, 25 bp, Homo sapien
aaaagattacaaccgccaacatgtg

SEQ ID NO: 627634 - DNA, 25 bp, Homo sapien
gattacaaccgccaacatgtgggag

SEQ ID NO: 627635 - DNA, 25 bp, Homo sapien
tacaaccgccaacatgtgggagcta

SEQ ID NO: 627636 - DNA, 25 bp, Homo sapien
aaccgccaacatgtgggagctacaa

SEQ ID NO: 627637 - DNA, 25 bp, Homo sapien
ccgccaacatgtgggagctacaagt

SEQ ID NO: 627638 - DNA, 25 bp, Homo sapien
ggatgttaaatgcaccaacacatag

SEQ ID NO: 627639 - DNA, 25 bp, Homo sapien
gtttgttgacatagatactagagca

SEQ ID NO: 627640 - DNA, 25 bp, Homo sapien
acatagatactagagcaagagagct

SEQ ID NO: 627641 - DNA, 25 bp, Homo sapien
gaagaagatcacagaaataatggtt

SEQ ID NO: 627642 - DNA, 25 bp, Homo sapien
tggagctgattgaagatggctgcaa

SEQ ID NO: 627643 - DNA, 25 bp, Homo sapien
tgaagatggctgcaagtacatgaat

SEQ ID NO: 627644 - DNA, 25 bp, Homo sapien
tcacagaatgcagctgagtaaggct

SEQ ID NO: 627645 - DNA, 25 bp, Homo sapien
gagtaaggctgtgccagttctctgc

SEQ ID NO: 627646 - DNA, 25 bp, Homo sapien
ttctctgccttagccttaagaggcc

SEQ ID NO: 627647 - DNA, 25 bp, Homo sapien
gcttccacctgtgctgtcttgggag

SEQ ID NO: 627648 - DNA, 25 bp, Homo sapien
tgtcttgggagctgtgaatcactac

SEQ ID NO: 627649 - DNA, 25 bp, Homo sapien
ggcagctctgatagggagacctcat

SEQ ID NO: 627650 - DNA, 25 bp, Homo sapien
gacctcatggacaggccacgtggag

SEQ ID NO: 627651 - DNA, 25 bp, Homo sapien
atacacggagaaagagcccagccct

SEQ ID NO: 627652 - DNA, 25 bp, Homo sapien
agctgagcccagtcttccggctgtc

SEQ ID NO: 627653 - DNA, 25 bp, Homo sapien
agatgccagacttgcgagctgagct

SEQ ID NO: 627654 - DNA, 25 bp, Homo sapien
gagctgagctgtcttgggcattcca

SEQ ID NO: 627655 - DNA, 25 bp, Homo sapien
gcatgccactgtgcagattcttttc

SEQ ID NO: 627656 - DNA, 25 bp, Homo sapien
agattcttttcatgaccgacttgcc

SEQ ID NO: 627657 - DNA, 25 bp, Homo sapien
ggtcccaatgtcattgaccacttta

SEQ ID NO: 627658 - DNA, 25 bp, Homo sapien
gaccactttatgtgtgatctcttcc

SEQ ID NO: 627659 - DNA, 25 bp, Homo sapien
gatctcttcccattgttgaaacttg

SEQ ID NO: 627660 - DNA, 25 bp, Homo sapien
tgaaacttgcctgcagagacaccta

SEQ ID NO: 627661 - DNA, 25 bp, Homo sapien
gagacacctacagacttgggatgct

SEQ ID NO: 627662 - DNA, 25 bp, Homo sapien
gccaacagtggagccatgtgcttgc

SEQ ID NO: 627663 - DNA, 25 bp, Homo sapien
cgtcatctcctacatagtcatcctg

SEQ ID NO: 627664 - DNA, 25 bp, Homo sapien
ccttctggtggtgatagcctggatt

SEQ ID NO: 627665 - DNA, 25 bp, Homo sapien
agcctggattggaggcatcctgcat

SEQ ID NO: 627666 - DNA, 25 bp, Homo sapien
caacatagtgataaccctccatcac

SEQ ID NO: 627667 - DNA, 25 bp, Homo sapien
aacatagtgataaccctccatcact

SEQ ID NO: 627668 - DNA, 25 bp, Homo sapien
atagtgataaccctccatcactaca

SEQ ID NO: 627669 - DNA, 25 bp, Homo sapien
agtgataaccctccatcactacaaa

SEQ ID NO: 627670 - DNA, 25 bp, Homo sapien
gtgataaccctccatcactacaaaa

SEQ ID NO: 627671 - DNA, 25 bp, Homo sapien
tgataaccctccatcactacaaaaa

SEQ ID NO: 627672 - DNA, 25 bp, Homo sapien
agttcaaggttgcatgaaggagttc

SEQ ID NO: 627673 - DNA, 25 bp, Homo sapien
gttcaaggttgcatgaaggagttca

SEQ ID NO: 627674 - DNA, 25 bp, Homo sapien
tcaaggttgcatgaaggagttcaag

SEQ ID NO: 627675 - DNA, 25 bp, Homo sapien
gagttcaaggttgccatgatcacac

SEQ ID NO: 627676 - DNA, 25 bp, Homo sapien
ctgggctacaaagcaagatcctctc

SEQ ID NO: 627677 - DNA, 25 bp, Homo sapien
gattttgcaatcacagcatgtcaca

SEQ ID NO: 627678 - DNA, 25 bp, Homo sapien
gcatgtcacagtcacaaggaactat

SEQ ID NO: 627679 - DNA, 25 bp, Homo sapien
ggaactatataggttatttctcacg

SEQ ID NO: 627680 - DNA, 25 bp, Homo sapien
ggttatttctcacgattggcatttt

SEQ ID NO: 627681 - DNA, 25 bp, Homo sapien
taaggctcctaaatcgtgctgtttc

SEQ ID NO: 627682 - DNA, 25 bp, Homo sapien
taaatcgtgctgtttcaggactttt

SEQ ID NO: 627683 - DNA, 25 bp, Homo sapien
aatattttgaaggtcggcgaaagat

SEQ ID NO: 627684 - DNA, 25 bp, Homo sapien
aagagtgtaaactgcgtcctcccag

SEQ ID NO: 627685 - DNA, 25 bp, Homo sapien
ggcacaacaaaaagtctgcggcata

SEQ ID NO: 627686 - DNA, 25 bp, Homo sapien
tctgcggcataactgacacctgtaa

SEQ ID NO: 627687 - DNA, 25 bp, Homo sapien
gctaagaaattcagttccaggatat

SEQ ID NO: 627688 - DNA, 25 bp, Homo sapien
tatactcagtactgtcttcactctg

SEQ ID NO: 627689 - DNA, 25 bp, Homo sapien
tgcagcttgcttttggtacaggaat

SEQ ID NO: 627690 - DNA, 25 bp, Homo sapien
tttttaaaacgattccactatggag

SEQ ID NO: 627691 - DNA, 25 bp, Homo sapien
agaggagtgcgtgcacccgagccac

SEQ ID NO: 627692 - DNA, 25 bp, Homo sapien
gcagactccaggatactggctccta

SEQ ID NO: 627693 - DNA, 25 bp, Homo sapien
ggatactggctcctaaaaccacaca

SEQ ID NO: 627694 - DNA, 25 bp, Homo sapien
acacaaccacagtcctattgctgca

SEQ ID NO: 627695 - DNA, 25 bp, Homo sapien
acagtcctattgctgcacctaagaa

SEQ ID NO: 627696 - DNA, 25 bp, Homo sapien
aaatgaatcttccacaagtccccac

SEQ ID NO: 627697 - DNA, 25 bp, Homo sapien
aagtccccactcatttcttgaattg

SEQ ID NO: 627698 - DNA, 25 bp, Homo sapien
catttcttgaattgtcctgtggaag

SEQ ID NO: 627699 - DNA, 25 bp, Homo sapien
tagtagagtccgaccacagacgggt

SEQ ID NO: 627700 - DNA, 25 bp, Homo sapien
tagtgaaggccttgcgacgactttc

SEQ ID NO: 627701 - DNA, 25 bp, Homo sapien
tgacggctcgaaggacatgggaata

SEQ ID NO: 627702 - DNA, 25 bp, Homo sapien
ggaaagattagcattaccacacaac

SEQ ID NO: 627703 - DNA, 25 bp, Homo sapien
agtctttcaaatgcagatgtttctg

SEQ ID NO: 627704 - DNA, 25 bp, Homo sapien
aatgcagatgtttctgtgcaggata

SEQ ID NO: 627705 - DNA, 25 bp, Homo sapien
cttgtcctggtctggcgtatgttta

SEQ ID NO: 627706 - DNA, 25 bp, Homo sapien
ctggcgtatgtttagaagctggtct

SEQ ID NO: 627707 - DNA, 25 bp, Homo sapien
agaagctggtctcatgtacatgaac

SEQ ID NO: 627708 - DNA, 25 bp, Homo sapien
acatgaacatagcagcaccgtagta

SEQ ID NO: 627709 - DNA, 25 bp, Homo sapien
agcaccgtagtagagtccgaccaca

SEQ ID NO: 627710 - DNA, 25 bp, Homo sapien
aagcgaggatgttttccaccgcgat

SEQ ID NO: 627711 - DNA, 25 bp, Homo sapien
atggcttctccttgacttcagggta

SEQ ID NO: 627712 - DNA, 25 bp, Homo sapien
taggagtcttgaatcttgccaccat

SEQ ID NO: 627713 - DNA, 25 bp, Homo sapien
ttgccaccatctgccaatggatgtg

SEQ ID NO: 627714 - DNA, 25 bp, Homo sapien
gcatgtgcttttaatgatgtcctga

SEQ ID NO: 627715 - DNA, 25 bp, Homo sapien
ggagctgtttgtctggtatcccagt

SEQ ID NO: 627716 - DNA, 25 bp, Homo sapien
tatcccagtgcagcggctgctgaaa

SEQ ID NO: 627717 - DNA, 25 bp, Homo sapien
ggcaagaccttcaattagcttaagt

SEQ ID NO: 627718 - DNA, 25 bp, Homo sapien
ggaccgagagtgcattccccagagt

SEQ ID NO: 627719 - DNA, 25 bp, Homo sapien
gcattccccagagtcgctgttggaa

SEQ ID NO: 627720 - DNA, 25 bp, Homo sapien
tcgctgttggaaccggctttctttt

SEQ ID NO: 627721 - DNA, 25 bp, Homo sapien
aacagaattgggtaagaagcccttg

SEQ ID NO: 627722 - DNA, 25 bp, Homo sapien
gaagcccttggaattgaagactaaa

SEQ ID NO: 627723 - DNA, 25 bp, Homo sapien
gagagagccaagtctcaggtttaac

SEQ ID NO: 627724 - DNA, 25 bp, Homo sapien
gtctcaggtttaactgaagaccaac

SEQ ID NO: 627725 - DNA, 25 bp, Homo sapien
gaagattatcaatatccgaaaccaa

SEQ ID NO: 627726 - DNA, 25 bp, Homo sapien
aagacgatgatagctaatccggatt

SEQ ID NO: 627727 - DNA, 25 bp, Homo sapien
atccggattgggaaaaattccagag

SEQ ID NO: 627728 - DNA, 25 bp, Homo sapien
ataatttggactacagtgattctga

SEQ ID NO: 627729 - DNA, 25 bp, Homo sapien
gagtgaatatacttttagtgcaaat

SEQ ID NO: 627730 - DNA, 25 bp, Homo sapien
atgaaaaatcctaaagtgcctcttt

SEQ ID NO: 627731 - DNA, 25 bp, Homo sapien
aaagtgcctctttacctcaacacat

SEQ ID NO: 627732 - DNA, 25 bp, Homo sapien
ggagctaaatactttgcaattccat

SEQ ID NO: 627733 - DNA, 25 bp, Homo sapien
ctttgcaattccattggctgagcgc

SEQ ID NO: 627734 - DNA, 25 bp, Homo sapien
cttcatcaacttcattcctgagtca

SEQ ID NO: 627735 - DNA, 25 bp, Homo sapien
tggctgagcgcaacaccaagaggct

SEQ ID NO: 627736 - DNA, 25 bp, Homo sapien
gcgcaacaccaagaggctgactaag

SEQ ID NO: 627737 - DNA, 25 bp, Homo sapien
gaggctgactaagaggagcacacat

SEQ ID NO: 627738 - DNA, 25 bp, Homo sapien
tgactaagaggagcacacatgcaca

SEQ ID NO: 627739 - DNA, 25 bp, Homo sapien
acttcattcctgagtcatacttact

SEQ ID NO: 627740 - DNA, 25 bp, Homo sapien
gaacacagctggtttacctgcacag

SEQ ID NO: 627741 - DNA, 25 bp, Homo sapien
acagctggtttacctgcacaggagc

SEQ ID NO: 627742 - DNA, 25 bp, Homo sapien
acctgcacaggagctaaatactttg

SEQ ID NO: 627743 - DNA, 25 bp, Homo sapien
ttatctcaacttcattgttgtccag

SEQ ID NO: 627744 - DNA, 25 bp, Homo sapien
cttcattgttgtccagaagctgctt

SEQ ID NO: 627745 - DNA, 25 bp, Homo sapien
ttattatttgtgaccgtgaaaggat

SEQ ID NO: 627746 - DNA, 25 bp, Homo sapien
ggatggaaacaaattcctgttttga

SEQ ID NO: 627747 - DNA, 25 bp, Homo sapien
gttttgagtcaaagctacctgcgtc

SEQ ID NO: 627748 - DNA, 25 bp, Homo sapien
gacacggccgtaatgtggagtcagt

SEQ ID NO: 627749 - DNA, 25 bp, Homo sapien
tggagtcagtaagccaaggttgtga

SEQ ID NO: 627750 - DNA, 25 bp, Homo sapien
ttactttttattccaggcagcgctg

SEQ ID NO: 627751 - DNA, 25 bp, Homo sapien
tttattccaggcagcgctgtactgg

SEQ ID NO: 627752 - DNA, 25 bp, Homo sapien
gggcctcaaatgctgaataatgctc

SEQ ID NO: 627753 - DNA, 25 bp, Homo sapien
aataatgctcctgttggacttcagt

SEQ ID NO: 627754 - DNA, 25 bp, Homo sapien
gagataatgcatacacagtgttagc

SEQ ID NO: 627755 - DNA, 25 bp, Homo sapien
ggaagcatggccactgttaaataaa

SEQ ID NO: 627756 - DNA, 25 bp, Homo sapien
agtcaactcaatgtacttgttcatg

SEQ ID NO: 627757 - DNA, 25 bp, Homo sapien
attattatgaatgtcctgaggtcct

SEQ ID NO: 627758 - DNA, 25 bp, Homo sapien
gaatgtcctgaggtccttcgtagac

SEQ ID NO: 627759 - DNA, 25 bp, Homo sapien
gtccttcgtagactcttcttccagt

SEQ ID NO: 627760 - DNA, 25 bp, Homo sapien
ctgatgccccaaccctcaatgtggg

SEQ ID NO: 627761 - DNA, 25 bp, Homo sapien
gggcacatttctgtcacctgaagaa

SEQ ID NO: 627762 - DNA, 25 bp, Homo sapien
taaaccctaactcacacctattatg

SEQ ID NO: 627763 - DNA, 25 bp, Homo sapien
acacctattatgtgtctctgaccaa

SEQ ID NO: 627764 - DNA, 25 bp, Homo sapien
gtgtctctgaccaactatagggaat

SEQ ID NO: 627765 - DNA, 25 bp, Homo sapien
actttcttacattcattttcatccc

SEQ ID NO: 627766 - DNA, 25 bp, Homo sapien
cttacattcattttcatcccaaaca

SEQ ID NO: 627767 - DNA, 25 bp, Homo sapien
aatccattgattgttccttgcattg

SEQ ID NO: 627768 - DNA, 25 bp, Homo sapien
attgattgttccttgcattgcatat

SEQ ID NO: 627769 - DNA, 25 bp, Homo sapien
ccttgcattgcatatcttattaaaa

SEQ ID NO: 627770 - DNA, 25 bp, Homo sapien
aaagatatttcctacatgcaactaa

SEQ ID NO: 627771 - DNA, 25 bp, Homo sapien
aactaataagacatgctgactgttg

SEQ ID NO: 627772 - DNA, 25 bp, Homo sapien
ctgactgttgtcagctctaaattta

SEQ ID NO: 627773 - DNA, 25 bp, Homo sapien
tgaaatttgctttttgctccacacc

SEQ ID NO: 627774 - DNA, 25 bp, Homo sapien
ccacacctcacctgtttttgataaa

SEQ ID NO: 627775 - DNA, 25 bp, Homo sapien
aaatctgtgctaataagtacatagg

SEQ ID NO: 627776 - DNA, 25 bp, Homo sapien
ttaagagaactcaggttggggccaa

SEQ ID NO: 627777 - DNA, 25 bp, Homo sapien
ttgaatctggaaggcccaggttgta

SEQ ID NO: 627778 - DNA, 25 bp, Homo sapien
aaggcccaggttgtagtgagcctag

SEQ ID NO: 627779 - DNA, 25 bp, Homo sapien
ctagatcatgccgctgtactgcagt

SEQ ID NO: 627780 - DNA, 25 bp, Homo sapien
atgccgctgtactgcagtctgggcg

SEQ ID NO: 627781 - DNA, 25 bp, Homo sapien
ccgctgtactgcagtctgggcgcca

SEQ ID NO: 627782 - DNA, 25 bp, Homo sapien
cgctgtactgcagtctgggcgccag

SEQ ID NO: 627783 - DNA, 25 bp, Homo sapien
gctgtactgcagtctgggcgccaga

SEQ ID NO: 627784 - DNA, 25 bp, Homo sapien
tgtactgcagtctgggcgccagagc

SEQ ID NO: 627785 - DNA, 25 bp, Homo sapien
gtactgcagtctgggcgccagagca

SEQ ID NO: 627786 - DNA, 25 bp, Homo sapien
tactgcagtctgggcgccagagcaa

SEQ ID NO: 627787 - DNA, 25 bp, Homo sapien
tatgttgacgctagcctgcacagac

SEQ ID NO: 627788 - DNA, 25 bp, Homo sapien
atgttgacgctagcctgcacagaca

SEQ ID NO: 627789 - DNA, 25 bp, Homo sapien
gttgacgctagcctgcacagacact

SEQ ID NO: 627790 - DNA, 25 bp, Homo sapien
tgcacagacacttgggtctatgaga

SEQ ID NO: 627791 - DNA, 25 bp, Homo sapien
gacacttgggtctatgagagcacag

SEQ ID NO: 627792 - DNA, 25 bp, Homo sapien
ttgggtctatgagagcacagtgttt

SEQ ID NO: 627793 - DNA, 25 bp, Homo sapien
acagtgtttttgagcagcaccatct

SEQ ID NO: 627794 - DNA, 25 bp, Homo sapien
ttgagcagcaccatctttcttgtgc

SEQ ID NO: 627795 - DNA, 25 bp, Homo sapien
caccatctttcttgtgcttcctttc

SEQ ID NO: 627796 - DNA, 25 bp, Homo sapien
tcctttcactggtattgcatgttcc

SEQ ID NO: 627797 - DNA, 25 bp, Homo sapien
tccgtataagcaaaagagtgtgtgt

SEQ ID NO: 627798 - DNA, 25 bp, Homo sapien
gagagagagatgtcaactaaatata

SEQ ID NO: 627799 - DNA, 25 bp, Homo sapien
taatgtatgaaccttgtatgaatct

SEQ ID NO: 627800 - DNA, 25 bp, Homo sapien
aatgtatgaaccttgtatgaatctt

SEQ ID NO: 627801 - DNA, 25 bp, Homo sapien
atgtatgaaccttgtatgaatcttc

SEQ ID NO: 627802 - DNA, 25 bp, Homo sapien
tgtatgaaccttgtatgaatcttca

SEQ ID NO: 627803 - DNA, 25 bp, Homo sapien
gtatgaaccttgtatgaatcttcat

SEQ ID NO: 627804 - DNA, 25 bp, Homo sapien
atgaaccttgtatgaatcttcattc

SEQ ID NO: 627805 - DNA, 25 bp, Homo sapien
tgaaccttgtatgaatcttcattca

SEQ ID NO: 627806 - DNA, 25 bp, Homo sapien
accttgtatgaatcttcattcaaac

SEQ ID NO: 627807 - DNA, 25 bp, Homo sapien
ccttgtatgaatcttcattcaaaca

SEQ ID NO: 627808 - DNA, 25 bp, Homo sapien
tgtatgaatcttcattcaaacaatt

SEQ ID NO: 627809 - DNA, 25 bp, Homo sapien
actcacacaaccatggccatgtagc

SEQ ID NO: 627810 - DNA, 25 bp, Homo sapien
ctcagcatcatgtcctctatttaga

SEQ ID NO: 627811 - DNA, 25 bp, Homo sapien
agcatcatgtcctctatttagaaat

SEQ ID NO: 627812 - DNA, 25 bp, Homo sapien
tgatgctcagcttccgcgggcacca

SEQ ID NO: 627813 - DNA, 25 bp, Homo sapien
gcgggcaccaacttgctgcggaatc

SEQ ID NO: 627814 - DNA, 25 bp, Homo sapien
tgctgcggaatcctgctttgcagat

SEQ ID NO: 627815 - DNA, 25 bp, Homo sapien
ggaatcctgctttgcagatcatcgt

SEQ ID NO: 627816 - DNA, 25 bp, Homo sapien
tgctttgcagatcatcgttcctcga

SEQ ID NO: 627817 - DNA, 25 bp, Homo sapien
ttgcagatcatcgttcctcgagcat

SEQ ID NO: 627818 - DNA, 25 bp, Homo sapien
gatcatcgttcctcgagcattcgga

SEQ ID NO: 627819 - DNA, 25 bp, Homo sapien
tcctcgagcattcggacgcctcggg

SEQ ID NO: 627820 - DNA, 25 bp, Homo sapien
gagagagtccagatttgcagaaaga

SEQ ID NO: 627821 - DNA, 25 bp, Homo sapien
agctgttagttttgtgatctctgcc

SEQ ID NO: 627822 - DNA, 25 bp, Homo sapien
ttagttttgtgatctctgcctggag

SEQ ID NO: 627823 - DNA, 25 bp, Homo sapien
ttttgtgatctctgcctggaggttt

SEQ ID NO: 627824 - DNA, 25 bp, Homo sapien
gccattgcaatgagtccagattagg

SEQ ID NO: 627825 - DNA, 25 bp, Homo sapien
atgagtccagattagggcttgttcc

SEQ ID NO: 627826 - DNA, 25 bp, Homo sapien
cagattagggcttgttcctgcaggg

SEQ ID NO: 627827 - DNA, 25 bp, Homo sapien
ggcacttgtggcagagggttccaaa

SEQ ID NO: 627828 - DNA, 25 bp, Homo sapien
ttgtggcagagggttccaaagtcat

SEQ ID NO: 627829 - DNA, 25 bp, Homo sapien
tcatgggcatagagaagacaggttg

SEQ ID NO: 627830 - DNA, 25 bp, Homo sapien
tcctgttgggccctgaggaggactg

SEQ ID NO: 627831 - DNA, 25 bp, Homo sapien
ccctgccctggtaactggaagaaat

SEQ ID NO: 627832 - DNA, 25 bp, Homo sapien
catcaaaacatttgctcagtgcctg

SEQ ID NO: 627833 - DNA, 25 bp, Homo sapien
ttgctcagtgcctgacagagaccca

SEQ ID NO: 627834 - DNA, 25 bp, Homo sapien
agagacccagcaacatctgttcttg

SEQ ID NO: 627835 - DNA, 25 bp, Homo sapien
acatctgttcttgtgcattttaatg

SEQ ID NO: 627836 - DNA, 25 bp, Homo sapien
ttttaatgatcatgcctccagcttc

SEQ ID NO: 627837 - DNA, 25 bp, Homo sapien
ccagcttcctgatattttcctggaa

SEQ ID NO: 627838 - DNA, 25 bp, Homo sapien
atcctaaggcagaagtattttacta

SEQ ID NO: 627839 - DNA, 25 bp, Homo sapien
agtacaatgacaacctcatctccag

SEQ ID NO: 627840 - DNA, 25 bp, Homo sapien
tcatctccagaagggatttcttgac

SEQ ID NO: 627841 - DNA, 25 bp, Homo sapien
actcaactttggacttggtttcagc

SEQ ID NO: 627842 - DNA, 25 bp, Homo sapien
tttggtgttgtagctgagtaccttt

SEQ ID NO: 627843 - DNA, 25 bp, Homo sapien
ttgtagctgagtacctttgggcagt

SEQ ID NO: 627844 - DNA, 25 bp, Homo sapien
atccagcggttgtcagctatccagg

SEQ ID NO: 627845 - DNA, 25 bp, Homo sapien
agcggttgtcagctatccaggctca

SEQ ID NO: 627846 - DNA, 25 bp, Homo sapien
ggttgtcagctatccaggctcatgt

SEQ ID NO: 627847 - DNA, 25 bp, Homo sapien
gtcagctatccaggctcatgtggtg

SEQ ID NO: 627848 - DNA, 25 bp, Homo sapien
atccaggctcatgtggtgcctgtga

SEQ ID NO: 627849 - DNA, 25 bp, Homo sapien
gtgcctgtgatggtgttacactgtt

SEQ ID NO: 627850 - DNA, 25 bp, Homo sapien
gttggaagagcaaacactgtcttta

SEQ ID NO: 627851 - DNA, 25 bp, Homo sapien
gaggtttggctccaagcactgtttt

SEQ ID NO: 627852 - DNA, 25 bp, Homo sapien
tttggctccaagcactgttttggtg

SEQ ID NO: 627853 - DNA, 25 bp, Homo sapien
acagatgtgacccttttctgctatg

SEQ ID NO: 627854 - DNA, 25 bp, Homo sapien
gtgacccttttctgctatggtatga

SEQ ID NO: 627855 - DNA, 25 bp, Homo sapien
ttctgctatggtatgaatcatctgt

SEQ ID NO: 627856 - DNA, 25 bp, Homo sapien
tcatctgtttatgaagtggctgaac

SEQ ID NO: 627857 - DNA, 25 bp, Homo sapien
gcagaaacagcccttcatttggaaa

SEQ ID NO: 627858 - DNA, 25 bp, Homo sapien
caaatctgaaagtcatagtgctgaa

SEQ ID NO: 627859 - DNA, 25 bp, Homo sapien
agtgctgaattaagtcttcacaaac

SEQ ID NO: 627860 - DNA, 25 bp, Homo sapien
aaagatccagacattaggactgtat

SEQ ID NO: 627861 - DNA, 25 bp, Homo sapien
ggactgtataccttttcaatctgtt

SEQ ID NO: 627862 - DNA, 25 bp, Homo sapien
tttttgtttttctgatgccctacga

SEQ ID NO: 627863 - DNA, 25 bp, Homo sapien
gatgccctacgatcctaaagaacag

SEQ ID NO: 627864 - DNA, 25 bp, Homo sapien
ctgttaaaaagtcagctattagtct

SEQ ID NO: 627865 - DNA, 25 bp, Homo sapien
tatattttctcctaacctatcttcc

SEQ ID NO: 627866 - DNA, 25 bp, Homo sapien
cctaacctatcttccagttcagtaa

SEQ ID NO: 627867 - DNA, 25 bp, Homo sapien
taattctctctgtctaatctgctga

SEQ ID NO: 627868 - DNA, 25 bp, Homo sapien
aatctgctgaaacttacccactgag

SEQ ID NO: 627869 - DNA, 25 bp, Homo sapien
tgctgaaacttacccactgagtttt

SEQ ID NO: 627870 - DNA, 25 bp, Homo sapien
gtgcttttctgttctaaaattccca

SEQ ID NO: 627871 - DNA, 25 bp, Homo sapien
aaaattcccatatgatactttctga

SEQ ID NO: 627872 - DNA, 25 bp, Homo sapien
gaaagatttcaatttcctgctgaat

SEQ ID NO: 627873 - DNA, 25 bp, Homo sapien
tgccttctattttctttaacacatt

SEQ ID NO: 627874 - DNA, 25 bp, Homo sapien
ggcatagtgtgcttacaaattttaa

SEQ ID NO: 627875 - DNA, 25 bp, Homo sapien
ggagcggttgcttccttcgtgccca

SEQ ID NO: 627876 - DNA, 25 bp, Homo sapien
ggttgcttccttcgtgcccaggcca

SEQ ID NO: 627877 - DNA, 25 bp, Homo sapien
caggccagggcctctgaagccgagc

SEQ ID NO: 627878 - DNA, 25 bp, Homo sapien
cagggcctctgaagccgagcctcgg

SEQ ID NO: 627879 - DNA, 25 bp, Homo sapien
atgatgcttggccttccgtgctggt

SEQ ID NO: 627880 - DNA, 25 bp, Homo sapien
atgcttggccttccgtgctggtcca

SEQ ID NO: 627881 - DNA, 25 bp, Homo sapien
ggacttctgggaggcgacaacgcct

SEQ ID NO: 627882 - DNA, 25 bp, Homo sapien
ttctgggaggcgacaacgccttcct

SEQ ID NO: 627883 - DNA, 25 bp, Homo sapien
tgggaggcgacaacgccttcctgcg

SEQ ID NO: 627884 - DNA, 25 bp, Homo sapien
agtagggtctccttcgccctcgagg

SEQ ID NO: 627885 - DNA, 25 bp, Homo sapien
ttcgccctcgaggtcacccagtctg

SEQ ID NO: 627886 - DNA, 25 bp, Homo sapien
attcactcgtccttagctcttagga

SEQ ID NO: 627887 - DNA, 25 bp, Homo sapien
tagctcttaggatcctcttctatag

SEQ ID NO: 627888 - DNA, 25 bp, Homo sapien
taagtcttgcttgctctgatgtcac

SEQ ID NO: 627889 - DNA, 25 bp, Homo sapien
tgaatgagacactgctgttcctggt

SEQ ID NO: 627890 - DNA, 25 bp, Homo sapien
gttcctggtggccactttgaatgag

SEQ ID NO: 627891 - DNA, 25 bp, Homo sapien
agtgttaccatcatgatcatcctca

SEQ ID NO: 627892 - DNA, 25 bp, Homo sapien
ctgctaattctcaccactatcctga

SEQ ID NO: 627893 - DNA, 25 bp, Homo sapien
ggtgaccatgtctcagaagctgcgt

SEQ ID NO: 627894 - DNA, 25 bp, Homo sapien
gtgtggagctgacctcttgctgcta

SEQ ID NO: 627895 - DNA, 25 bp, Homo sapien
ctgctacttctgtgggacggtgtgt

SEQ ID NO: 627896 - DNA, 25 bp, Homo sapien
cggtgtgttctctgattcactcgtc

SEQ ID NO: 627897 - DNA, 25 bp, Homo sapien
ggtggtgctcaaaaacaccgtgcac

SEQ ID NO: 627898 - DNA, 25 bp, Homo sapien
gtgctcaaaaacaccgtgcactcat

SEQ ID NO: 627899 - DNA, 25 bp, Homo sapien
aacaccgtgcactcatagacccagg

SEQ ID NO: 627900 - DNA, 25 bp, Homo sapien
atagacccaggtatccgtgcaggct

SEQ ID NO: 627901 - DNA, 25 bp, Homo sapien
agacccaggtatccgtgcaggctag

SEQ ID NO: 627902 - DNA, 25 bp, Homo sapien
aggtatccgtgcaggctagggtcaa

SEQ ID NO: 627903 - DNA, 25 bp, Homo sapien
atccgtgcaggctagggtcaacata

SEQ ID NO: 627904 - DNA, 25 bp, Homo sapien
atcctgttatcatcagtgcacacac

SEQ ID NO: 627905 - DNA, 25 bp, Homo sapien
atcatcagtgcacacactctttttc

SEQ ID NO: 627906 - DNA, 25 bp, Homo sapien
agtgcacacactctttttctcatac

SEQ ID NO: 627907 - DNA, 25 bp, Homo sapien
gcacacactctttttctcatacgga

SEQ ID NO: 627908 - DNA, 25 bp, Homo sapien
tccaagcctgcctgggcgggtgtcc

SEQ ID NO: 627909 - DNA, 25 bp, Homo sapien
ccaagcctgcctgggcgggtgtcct

SEQ ID NO: 627910 - DNA, 25 bp, Homo sapien
caagcctgcctgggcgggtgtcctg

SEQ ID NO: 627911 - DNA, 25 bp, Homo sapien
aagcctgcctgggcgggtgtcctgt

SEQ ID NO: 627912 - DNA, 25 bp, Homo sapien
agcctgcctgggcgggtgtcctgtg

SEQ ID NO: 627913 - DNA, 25 bp, Homo sapien
gcctgcctgggcgggtgtcctgtga

SEQ ID NO: 627914 - DNA, 25 bp, Homo sapien
cctgcctgggcgggtgtcctgtgac

SEQ ID NO: 627915 - DNA, 25 bp, Homo sapien
ctgcctgggcgggtgtcctgtgact

SEQ ID NO: 627916 - DNA, 25 bp, Homo sapien
gagcagttttctgaagccagccagc

SEQ ID NO: 627917 - DNA, 25 bp, Homo sapien
ttttctgaagccagccagcagatgg

SEQ ID NO: 627918 - DNA, 25 bp, Homo sapien
cagagctatccgaggtgttggtgct

SEQ ID NO: 627919 - DNA, 25 bp, Homo sapien
aggagatcactcagctgcaggccga

SEQ ID NO: 627920 - DNA, 25 bp, Homo sapien
tgcaggccgagatcaccaagctaca

SEQ ID NO: 627921 - DNA, 25 bp, Homo sapien
gatcaccaagctacaacagcgttgt

SEQ ID NO: 627922 - DNA, 25 bp, Homo sapien
acaacagcgttgtcagtcttatggg

SEQ ID NO: 627923 - DNA, 25 bp, Homo sapien
tggcctcagagaagggagtccaccc

SEQ ID NO: 627924 - DNA, 25 bp, Homo sapien
agaagggagtccacccagagagcct

SEQ ID NO: 627925 - DNA, 25 bp, Homo sapien
agctggctcccacatgcaggattat

SEQ ID NO: 627926 - DNA, 25 bp, Homo sapien
atggaagcaggcctcgtgaacgcca

SEQ ID NO: 627927 - DNA, 25 bp, Homo sapien
gaaacacgactttgatcttccagag

SEQ ID NO: 627928 - DNA, 25 bp, Homo sapien
atcttccagagttggtgactgccat

SEQ ID NO: 627929 - DNA, 25 bp, Homo sapien
ggtgactgccatgttgaacttccat

SEQ ID NO: 627930 - DNA, 25 bp, Homo sapien
gaaagcagagttgcccaagccaact

SEQ ID NO: 627931 - DNA, 25 bp, Homo sapien
tccctttccatgaggacctacaatg

SEQ ID NO: 627932 - DNA, 25 bp, Homo sapien
ggacctacaatgtcagcgccatgag

SEQ ID NO: 627933 - DNA, 25 bp, Homo sapien
atgagcttcacacccgaggagctgg

SEQ ID NO: 627934 - DNA, 25 bp, Homo sapien
aagcacgtgccggaattccagatca

SEQ ID NO: 627935 - DNA, 25 bp, Homo sapien
atacaacgtggatgccgttcgccag

SEQ ID NO: 627936 - DNA, 25 bp, Homo sapien
ttcgccaggccatagcggatggttg

SEQ ID NO: 627937 - DNA, 25 bp, Homo sapien
ttggccgatgaactttgatgacagc

SEQ ID NO: 627938 - DNA, 25 bp, Homo sapien
taaggatcaacacaagagagtctat

SEQ ID NO: 627939 - DNA, 25 bp, Homo sapien
aaaagtggttgatgtgattcgatcc

SEQ ID NO: 627940 - DNA, 25 bp, Homo sapien
gattcgatccacagaaaactaacct

SEQ ID NO: 627941 - DNA, 25 bp, Homo sapien
actaacctaaatacaagccctacat

SEQ ID NO: 627942 - DNA, 25 bp, Homo sapien
atacaagccctacatgaatcatgga

SEQ ID NO: 627943 - DNA, 25 bp, Homo sapien
atgcaggtttccagctatgaaggcc

SEQ ID NO: 627944 - DNA, 25 bp, Homo sapien
ctatgaaggcccctgtggtcatctg

SEQ ID NO: 627945 - DNA, 25 bp, Homo sapien
gaatgcagagtttcttggacatcat

SEQ ID NO: 627946 - DNA, 25 bp, Homo sapien
acatcatgatgtggtactgcagtgg

SEQ ID NO: 627947 - DNA, 25 bp, Homo sapien
gatattaagacactacctatggtaa

SEQ ID NO: 627948 - DNA, 25 bp, Homo sapien
gtaaagacttgaactgaacctgaga

SEQ ID NO: 627949 - DNA, 25 bp, Homo sapien
gaattcaaacggtgctggaagggtc

SEQ ID NO: 627950 - DNA, 25 bp, Homo sapien
attcaaacggtgctggaagggtcaa

SEQ ID NO: 627951 - DNA, 25 bp, Homo sapien
ttcaaacggtgctggaagggtcaag

SEQ ID NO: 627952 - DNA, 25 bp, Homo sapien
gtcaaggggcctgccaaacttactg

SEQ ID NO: 627953 - DNA, 25 bp, Homo sapien
aacttactgcacaaggcaagaaact

SEQ ID NO: 627954 - DNA, 25 bp, Homo sapien
ggcaagaaacttacatgcacctgtg

SEQ ID NO: 627955 - DNA, 25 bp, Homo sapien
aagaaacttacatgcacctgtgccc

SEQ ID NO: 627956 - DNA, 25 bp, Homo sapien
agaaacttacatgcacctgtgcccg

SEQ ID NO: 627957 - DNA, 25 bp, Homo sapien
aaacttacatgcacctgtgcccgga

SEQ ID NO: 627958 - DNA, 25 bp, Homo sapien
acttacatgcacctgtgcccggatg

SEQ ID NO: 627959 - DNA, 25 bp, Homo sapien
tacatgcacctgtgcccggatgcgt

SEQ ID NO: 627960 - DNA, 25 bp, Homo sapien
gctgggcaacgagtccaacttcagt

SEQ ID NO: 627961 - DNA, 25 bp, Homo sapien
ctgggcaacgagtccaacttcagtg

SEQ ID NO: 627962 - DNA, 25 bp, Homo sapien
gggcaacgagtccaacttcagtgat

SEQ ID NO: 627963 - DNA, 25 bp, Homo sapien
ggcaacgagtccaacttcagtgatg

SEQ ID NO: 627964 - DNA, 25 bp, Homo sapien
caacgagtccaacttcagtgatgca

SEQ ID NO: 627965 - DNA, 25 bp, Homo sapien
aacgagtccaacttcagtgatgcac

SEQ ID NO: 627966 - DNA, 25 bp, Homo sapien
acgagtccaacttcagtgatgcact

SEQ ID NO: 627967 - DNA, 25 bp, Homo sapien
gagtccaacttcagtgatgcactgc

SEQ ID NO: 627968 - DNA, 25 bp, Homo sapien
gtccaacttcagtgatgcactgctg

SEQ ID NO: 627969 - DNA, 25 bp, Homo sapien
caacttcagtgatgcactgctggat

SEQ ID NO: 627970 - DNA, 25 bp, Homo sapien
cttcagtgatgcactgctggatgcc

SEQ ID NO: 627971 - DNA, 25 bp, Homo sapien
tttcccaaccatttccatcaggtga

SEQ ID NO: 627972 - DNA, 25 bp, Homo sapien
atttccatcaggtgagtttgctgtc

SEQ ID NO: 627973 - DNA, 25 bp, Homo sapien
agtttgctgtctgtgagtcgtgcaa

SEQ ID NO: 627974 - DNA, 25 bp, Homo sapien
tctgtgagtcgtgcaagcttggtcg

SEQ ID NO: 627975 - DNA, 25 bp, Homo sapien
ttggagaatgagaagcccgatggaa

SEQ ID NO: 627976 - DNA, 25 bp, Homo sapien
cccgatggaaattgcaggctgaact

SEQ ID NO: 627977 - DNA, 25 bp, Homo sapien
attgcaggctgaactttctctgctg

SEQ ID NO: 627978 - DNA, 25 bp, Homo sapien
attttctatttgctatgttcttcat

SEQ ID NO: 627979 - DNA, 25 bp, Homo sapien
gttcttcattttggttcaactgcca

SEQ ID NO: 627980 - DNA, 25 bp, Homo sapien
caactgccatcagggtgccaggcag

SEQ ID NO: 627981 - DNA, 25 bp, Homo sapien
ggtgccaggcaggacttgatttttc

SEQ ID NO: 627982 - DNA, 25 bp, Homo sapien
aaatgctcacctggcaaatcaccga

SEQ ID NO: 627983 - DNA, 25 bp, Homo sapien
gctcacctggcaaatcaccgaagaa

SEQ ID NO: 627984 - DNA, 25 bp, Homo sapien
tcacctggcaaatcaccgaagaatt

SEQ ID NO: 627985 - DNA, 25 bp, Homo sapien
acctggcaaatcaccgaagaattca

SEQ ID NO: 627986 - DNA, 25 bp, Homo sapien
aagcctttagggtaagatcaagtct

SEQ ID NO: 627987 - DNA, 25 bp, Homo sapien
gtaagatcaagtctaactacccata

SEQ ID NO: 627988 - DNA, 25 bp, Homo sapien
aagatcaagtctaactacccatatg

SEQ ID NO: 627989 - DNA, 25 bp, Homo sapien
aaggtcttcaggcagagttcaaatc

SEQ ID NO: 627990 - DNA, 25 bp, Homo sapien
gagttcaaatcttgcaagtcatcac

SEQ ID NO: 627991 - DNA, 25 bp, Homo sapien
aaatcttgcaagtcatcacagaatg

SEQ ID NO: 627992 - DNA, 25 bp, Homo sapien
aagtcatcacagaatgcataccgga

SEQ ID NO: 627993 - DNA, 25 bp, Homo sapien
gatagagaccattcggctaacacag

SEQ ID NO: 627994 - DNA, 25 bp, Homo sapien
caaacaaaaaagtggacataggcat

SEQ ID NO: 627995 - DNA, 25 bp, Homo sapien
aaacaaaaaagtggacataggcatt

SEQ ID NO: 627996 - DNA, 25 bp, Homo sapien
aacaaaaaagtggacataggcattc

SEQ ID NO: 627997 - DNA, 25 bp, Homo sapien
acaaaaaagtggacataggcattct

SEQ ID NO: 627998 - DNA, 25 bp, Homo sapien
caaaaaagtggacataggcattcta

SEQ ID NO: 627999 - DNA, 25 bp, Homo sapien
aaaaaagtggacataggcattctag

SEQ ID NO: 628000 - DNA, 25 bp, Homo sapien
aaaaagtggacataggcattctagt

SEQ ID NO: 628001 - DNA, 25 bp, Homo sapien
aaaagtggacataggcattctagtc

SEQ ID NO: 628002 - DNA, 25 bp, Homo sapien
aaagtggacataggcattctagtca

SEQ ID NO: 628003 - DNA, 25 bp, Homo sapien
aagtggacataggcattctagtcag

SEQ ID NO: 628004 - DNA, 25 bp, Homo sapien
agagggtcacgcacctgggagcctg

SEQ ID NO: 628005 - DNA, 25 bp, Homo sapien
ggtcacgcacctgggagcctgttgc

SEQ ID NO: 628006 - DNA, 25 bp, Homo sapien
acctgggagcctgttgctggcacgg

SEQ ID NO: 628007 - DNA, 25 bp, Homo sapien
tgggagcctgttgctggcacggtcc

SEQ ID NO: 628008 - DNA, 25 bp, Homo sapien
gagcctgttgctggcacggtccggg

SEQ ID NO: 628009 - DNA, 25 bp, Homo sapien
ctgttgctggcacggtccgggcgga

SEQ ID NO: 628010 - DNA, 25 bp, Homo sapien
ttgctggcacggtccgggcggaggt

SEQ ID NO: 628011 - DNA, 25 bp, Homo sapien
cggtccgggcggaggttctgcggcg

SEQ ID NO: 628012 - DNA, 25 bp, Homo sapien
agcctgtcggttgcagggctgaaaa

SEQ ID NO: 628013 - DNA, 25 bp, Homo sapien
ggaccatcaagtacctgacagccca

SEQ ID NO: 628014 - DNA, 25 bp, Homo sapien
cacagtgtgcaagatccagggccag

SEQ ID NO: 628015 - DNA, 25 bp, Homo sapien
tgaaaacgtgttaccattccttcaa

SEQ ID NO: 628016 - DNA, 25 bp, Homo sapien
ttcaatcaacctatggtgataaaca

SEQ ID NO: 628017 - DNA, 25 bp, Homo sapien
gaaggttttacttctctgaagagaa

SEQ ID NO: 628018 - DNA, 25 bp, Homo sapien
tctctgaagagaagggacaatagca

SEQ ID NO: 628019 - DNA, 25 bp, Homo sapien
gggacaatagcaaaatgattctcaa

SEQ ID NO: 628020 - DNA, 25 bp, Homo sapien
gcaaaatgattctcaatttaaaagg

SEQ ID NO: 628021 - DNA, 25 bp, Homo sapien
agttacaaaaagcaggatatccaca

SEQ ID NO: 628022 - DNA, 25 bp, Homo sapien
agcaggatatccacacaaacataag

SEQ ID NO: 628023 - DNA, 25 bp, Homo sapien
tatccacacaaacataagacaccat

SEQ ID NO: 628024 - DNA, 25 bp, Homo sapien
acattcctgttaaaaatattcaaag

SEQ ID NO: 628025 - DNA, 25 bp, Homo sapien
ggcaaaaataaagtgcaaaaccatt

SEQ ID NO: 628026 - DNA, 25 bp, Homo sapien
ttctcttctaagtgggttatctgat

SEQ ID NO: 628027 - DNA, 25 bp, Homo sapien
cttctaagtgggttatctgatgttt

SEQ ID NO: 628028 - DNA, 25 bp, Homo sapien
ctaagtgggttatctgatgtttttt

SEQ ID NO: 628029 - DNA, 25 bp, Homo sapien
aaaggatttgccactctcaatacat

SEQ ID NO: 628030 - DNA, 25 bp, Homo sapien
ggatttgccactctcaatacattgg

SEQ ID NO: 628031 - DNA, 25 bp, Homo sapien
atttgccactctcaatacattggaa

SEQ ID NO: 628032 - DNA, 25 bp, Homo sapien
gcatgcaaggtatcgcttctgatta

SEQ ID NO: 628033 - DNA, 25 bp, Homo sapien
catgcaaggtatcgcttctgattaa

SEQ ID NO: 628034 - DNA, 25 bp, Homo sapien
tctgattaaataccttgccatatac

SEQ ID NO: 628035 - DNA, 25 bp, Homo sapien
aataccttgccatatacatcacatt

SEQ ID NO: 628036 - DNA, 25 bp, Homo sapien
catcacatttacattgtttctcttc

SEQ ID NO: 628037 - DNA, 25 bp, Homo sapien
ctcctgtattcgaaagtgatcgtgg

SEQ ID NO: 628038 - DNA, 25 bp, Homo sapien
ttcgaaagtgatcgtgggctgcctt

SEQ ID NO: 628039 - DNA, 25 bp, Homo sapien
tcgaaagtgatcgtgggctgccttt

SEQ ID NO: 628040 - DNA, 25 bp, Homo sapien
gctgcctttgccctggtcattgata

SEQ ID NO: 628041 - DNA, 25 bp, Homo sapien
tgcctttgccctggtcattgatagt

SEQ ID NO: 628042 - DNA, 25 bp, Homo sapien
cctttgccctggtcattgatagtgc

SEQ ID NO: 628043 - DNA, 25 bp, Homo sapien
tgcagggagaggaatcaatgaaagc

SEQ ID NO: 628044 - DNA, 25 bp, Homo sapien
gaatcaatgaaagcgcttccccgtg

SEQ ID NO: 628045 - DNA, 25 bp, Homo sapien
tcaatgaaagcgcttccccgtgttt

SEQ ID NO: 628046 - DNA, 25 bp, Homo sapien
aatgaaagcgcttccccgtgtttga

SEQ ID NO: 628047 - DNA, 25 bp, Homo sapien
cgtgtttgaagggtccactcctatc

SEQ ID NO: 628048 - DNA, 25 bp, Homo sapien
tgtgcctctttgctgcactgaacac

SEQ ID NO: 628049 - DNA, 25 bp, Homo sapien
tgcctctttgctgcactgaacactt

SEQ ID NO: 628050 - DNA, 25 bp, Homo sapien
gcctctttgctgcactgaacacttg

SEQ ID NO: 628051 - DNA, 25 bp, Homo sapien
ctctttgctgcactgaacacttgtc

SEQ ID NO: 628052 - DNA, 25 bp, Homo sapien
tctttgctgcactgaacacttgtct

SEQ ID NO: 628053 - DNA, 25 bp, Homo sapien
ctttgctgcactgaacacttgtctc

SEQ ID NO: 628054 - DNA, 25 bp, Homo sapien
tttgctgcactgaacacttgtctca

SEQ ID NO: 628055 - DNA, 25 bp, Homo sapien
ttgctgcactgaacacttgtctcag

SEQ ID NO: 628056 - DNA, 25 bp, Homo sapien
tgctgcactgaacacttgtctcagt

SEQ ID NO: 628057 - DNA, 25 bp, Homo sapien
gctgcactgaacacttgtctcagtc

SEQ ID NO: 628058 - DNA, 25 bp, Homo sapien
ctgcactgaacacttgtctcagtca

SEQ ID NO: 628059 - DNA, 25 bp, Homo sapien
tcagaatcacatgaggacgtcctgt

SEQ ID NO: 628060 - DNA, 25 bp, Homo sapien
tttctcttactcagaggactgtgct

SEQ ID NO: 628061 - DNA, 25 bp, Homo sapien
aggactgtgctcagtgatgctgaac

SEQ ID NO: 628062 - DNA, 25 bp, Homo sapien
gatgctgaacacttgtggaggtgct

SEQ ID NO: 628063 - DNA, 25 bp, Homo sapien
gtctttgccttgaaaacggcaccat

SEQ ID NO: 628064 - DNA, 25 bp, Homo sapien
ggccatgcatggatactgtttgtac

SEQ ID NO: 628065 - DNA, 25 bp, Homo sapien
ctgtggaaggagttgtttctctttc

SEQ ID NO: 628066 - DNA, 25 bp, Homo sapien
ctttctttacaaggctctctgttgg

SEQ ID NO: 628067 - DNA, 25 bp, Homo sapien
tctctgttggctttgtaggtgctgt

SEQ ID NO: 628068 - DNA, 25 bp, Homo sapien
gtaggtgctgtttgccttgaaggca

SEQ ID NO: 628069 - DNA, 25 bp, Homo sapien
ttgaaggcaatgattcctggatctc

SEQ ID NO: 628070 - DNA, 25 bp, Homo sapien
tatgttgacgctagcctgcacagac

SEQ ID NO: 628071 - DNA, 25 bp, Homo sapien
atgttgacgctagcctgcacagaca

SEQ ID NO: 628072 - DNA, 25 bp, Homo sapien
gttgacgctagcctgcacagacact

SEQ ID NO: 628073 - DNA, 25 bp, Homo sapien
tgcacagacacttgggtctatgaga

SEQ ID NO: 628074 - DNA, 25 bp, Homo sapien
cagacacttgggtctatgagagcac

SEQ ID NO: 628075 - DNA, 25 bp, Homo sapien
gacacttgggtctatgagagcacag

SEQ ID NO: 628076 - DNA, 25 bp, Homo sapien
acttgggtctatgagagcacagtgt

SEQ ID NO: 628077 - DNA, 25 bp, Homo sapien
ttgggtctatgagagcacagtgttt

SEQ ID NO: 628078 - DNA, 25 bp, Homo sapien
acagtgtttttgagcagcaccatct

SEQ ID NO: 628079 - DNA, 25 bp, Homo sapien
caccatctttcttgtgcttcctttc

SEQ ID NO: 628080 - DNA, 25 bp, Homo sapien
tccgtataagcaaaagagtgtgtgt

SEQ ID NO: 628081 - DNA, 25 bp, Homo sapien
gcatttctaagcaagtgtgagttca

SEQ ID NO: 628082 - DNA, 25 bp, Homo sapien
gtactactaagctttgacacgaact

SEQ ID NO: 628083 - DNA, 25 bp, Homo sapien
actaagctttgacacgaactatggg

SEQ ID NO: 628084 - DNA, 25 bp, Homo sapien
ttaatatacaaccatacctcaaaat

SEQ ID NO: 628085 - DNA, 25 bp, Homo sapien
ctcaaaatattgcaggatcagttcc

SEQ ID NO: 628086 - DNA, 25 bp, Homo sapien
cactgccatgaagtcaatattgcaa

SEQ ID NO: 628087 - DNA, 25 bp, Homo sapien
gtgcccaaaaatcatggtctagttt

SEQ ID NO: 628088 - DNA, 25 bp, Homo sapien
tgctttcaccctcacaactggaggg

SEQ ID NO: 628089 - DNA, 25 bp, Homo sapien
acaactggagggttcatggagctct

SEQ ID NO: 628090 - DNA, 25 bp, Homo sapien
actggagggttcatggagctctcca

SEQ ID NO: 628091 - DNA, 25 bp, Homo sapien
ctccaggggatgacggttgtgccat

SEQ ID NO: 628092 - DNA, 25 bp, Homo sapien
taaccacctatttctgacctctgga

SEQ ID NO: 628093 - DNA, 25 bp, Homo sapien
gggctgagcccggaattttatgacc

SEQ ID NO: 628094 - DNA, 25 bp, Homo sapien
ggaattttatgaccagcgcccgctg

SEQ ID NO: 628095 - DNA, 25 bp, Homo sapien
tcgtcaccctctaatttctcgcaaa

SEQ ID NO: 628096 - DNA, 25 bp, Homo sapien
tctaatttctcgcaaaactcccggg

SEQ ID NO: 628097 - DNA, 25 bp, Homo sapien
gggacccttcttaatgtcagtagcc

SEQ ID NO: 628098 - DNA, 25 bp, Homo sapien
ttaatgtcagtagccacagtcgccg

SEQ ID NO: 628099 - DNA, 25 bp, Homo sapien
agcaggctcgggttcccgcaggata

SEQ ID NO: 628100 - DNA, 25 bp, Homo sapien
tcgggttcccgcaggatacactgcc

SEQ ID NO: 628101 - DNA, 25 bp, Homo sapien
gctcccctacgccttttggaatcag

SEQ ID NO: 628102 - DNA, 25 bp, Homo sapien
gccttttggaatcagcgacagacgc

SEQ ID NO: 628103 - DNA, 25 bp, Homo sapien
tccaactgccagctgatcaggtcag

SEQ ID NO: 628104 - DNA, 25 bp, Homo sapien
tccaagcctgcctgggcgggtgtcc

SEQ ID NO: 628105 - DNA, 25 bp, Homo sapien
gtgtcctgtgactggacagtggctc

SEQ ID NO: 628106 - DNA, 25 bp, Homo sapien
tgtgactggacagtggctccccagc

SEQ ID NO: 628107 - DNA, 25 bp, Homo sapien
ttcatctgtgacttagtctgtcata

SEQ ID NO: 628108 - DNA, 25 bp, Homo sapien
agtctgtcatagtggtgagctgatc

SEQ ID NO: 628109 - DNA, 25 bp, Homo sapien
gtctgtcatagtggtgagctgatcc

SEQ ID NO: 628110 - DNA, 25 bp, Homo sapien
tctgtcatagtggtgagctgatcca

SEQ ID NO: 628111 - DNA, 25 bp, Homo sapien
gtcatagtggtgagctgatccaggt

SEQ ID NO: 628112 - DNA, 25 bp, Homo sapien
agctgatccaggtgtgaccgttgct

SEQ ID NO: 628113 - DNA, 25 bp, Homo sapien
gatccaggtgtgaccgttgctgaaa

SEQ ID NO: 628114 - DNA, 25 bp, Homo sapien
tgggcagggtggctctaacctataa

SEQ ID NO: 628115 - DNA, 25 bp, Homo sapien
gggcagggtggctctaacctataat

SEQ ID NO: 628116 - DNA, 25 bp, Homo sapien
ggcagggtggctctaacctataatc

SEQ ID NO: 628117 - DNA, 25 bp, Homo sapien
gcagggtggctctaacctataatcc

SEQ ID NO: 628118 - DNA, 25 bp, Homo sapien
tagccgggcttggtgtggacacctg

SEQ ID NO: 628119 - DNA, 25 bp, Homo sapien
agccgggcttggtgtggacacctgt

SEQ ID NO: 628120 - DNA, 25 bp, Homo sapien
cgggcttggtgtggacacctgtaat

SEQ ID NO: 628121 - DNA, 25 bp, Homo sapien
agtgggctgagatagtgccactgaa

SEQ ID NO: 628122 - DNA, 25 bp, Homo sapien
tgggctgagatagtgccactgaact

SEQ ID NO: 628123 - DNA, 25 bp, Homo sapien
gggctgagatagtgccactgaactc

SEQ ID NO: 628124 - DNA, 25 bp, Homo sapien
ggctgagatagtgccactgaactcc

SEQ ID NO: 628125 - DNA, 25 bp, Homo sapien
aagaaaccagcaacagccaagatgt

SEQ ID NO: 628126 - DNA, 25 bp, Homo sapien
taagaagcaaggatggttaaggcag

SEQ ID NO: 628127 - DNA, 25 bp, Homo sapien
gttaaggcaggcgtcaggatgttaa

SEQ ID NO: 628128 - DNA, 25 bp, Homo sapien
ggcaggcgtcaggatgttaaatgca

SEQ ID NO: 628129 - DNA, 25 bp, Homo sapien
aatgcactcaagaccagaaccagta

SEQ ID NO: 628130 - DNA, 25 bp, Homo sapien
gcactcaagaccagaaccagtaatt

SEQ ID NO: 628131 - DNA, 25 bp, Homo sapien
gaccagaaccagtaattcattgatg

SEQ ID NO: 628132 - DNA, 25 bp, Homo sapien
catggagctgacagatgatggctgc

SEQ ID NO: 628133 - DNA, 25 bp, Homo sapien
acagatgatggctgcaggtacatga

SEQ ID NO: 628134 - DNA, 25 bp, Homo sapien
atgaatgctgcagacccaaagaaac

SEQ ID NO: 628135 - DNA, 25 bp, Homo sapien
gacccaaagaaaccagcaacagcca

SEQ ID NO: 628136 - DNA, 25 bp, Homo sapien
agacaagagatatgaggccaacgct

SEQ ID NO: 628137 - DNA, 25 bp, Homo sapien
gaggccaacgctggtgaagctcacc

SEQ ID NO: 628138 - DNA, 25 bp, Homo sapien
caccctctgggctaaggatgtgtca

SEQ ID NO: 628139 - DNA, 25 bp, Homo sapien
atgtgtcagcacaggccaagggcaa

SEQ ID NO: 628140 - DNA, 25 bp, Homo sapien
agggcaacagtgctggaatgtcaca

SEQ ID NO: 628141 - DNA, 25 bp, Homo sapien
gaagtgatccacttcattgggacca

SEQ ID NO: 628142 - DNA, 25 bp, Homo sapien
tgggaccacagtatggcaaggtgaa

SEQ ID NO: 628143 - DNA, 25 bp, Homo sapien
gatactggaatgaatgcaccctaac

SEQ ID NO: 628144 - DNA, 25 bp, Homo sapien
agggccacacagatccttgggttca

SEQ ID NO: 628145 - DNA, 25 bp, Homo sapien
agatccttgggttcatgatggctgt

SEQ ID NO: 628146 - DNA, 25 bp, Homo sapien
tgggttcatgatggctgtgtatcgc

SEQ ID NO: 628147 - DNA, 25 bp, Homo sapien
catcatttcctctgtgatctcaatc

SEQ ID NO: 628148 - DNA, 25 bp, Homo sapien
tcctgcagctctcttgctctgacgt

SEQ ID NO: 628149 - DNA, 25 bp, Homo sapien
ctctgacgtctccttcaatgtaatg

SEQ ID NO: 628150 - DNA, 25 bp, Homo sapien
agtaggcgatctattggctctcacg

SEQ ID NO: 628151 - DNA, 25 bp, Homo sapien
cttgtctgtatcctcgtatcttatg

SEQ ID NO: 628152 - DNA, 25 bp, Homo sapien
tcgtatcttatggacttatcttctc

SEQ ID NO: 628153 - DNA, 25 bp, Homo sapien
gacttatcttctccactgttctgaa

SEQ ID NO: 628154 - DNA, 25 bp, Homo sapien
tccactgttctgaagatcacctcta

SEQ ID NO: 628155 - DNA, 25 bp, Homo sapien
gatcacctctactcagggcaagcag

SEQ ID NO: 628156 - DNA, 25 bp, Homo sapien
gcaagcagagagctgtttccacctg

SEQ ID NO: 628157 - DNA, 25 bp, Homo sapien
ggtgttgttttacggcacagccatc

SEQ ID NO: 628158 - DNA, 25 bp, Homo sapien
ctgtcccactgtgaaaatgaccagc

SEQ ID NO: 628159 - DNA, 25 bp, Homo sapien
tcattgagggagatgtctgagcatg

SEQ ID NO: 628160 - DNA, 25 bp, Homo sapien
gcatgagagcttgagtagggcaaca

SEQ ID NO: 628161 - DNA, 25 bp, Homo sapien
gatggtgttgtcagcacaaaaggac

SEQ ID NO: 628162 - DNA, 25 bp, Homo sapien
gagaggatccaggacacagtgacta

SEQ ID NO: 628163 - DNA, 25 bp, Homo sapien
gacacagtgactagtaagttacaca

SEQ ID NO: 628164 - DNA, 25 bp, Homo sapien
aagttacacagtccctctttcatga

SEQ ID NO: 628165 - DNA, 25 bp, Homo sapien
acagtccctctttcatgatagtggt

SEQ ID NO: 628166 - DNA, 25 bp, Homo sapien
ccctctttcatgatagtggtgtagc

SEQ ID NO: 628167 - DNA, 25 bp, Homo sapien
ccttgaggatggtgaccccaatgtg

SEQ ID NO: 628168 - DNA, 25 bp, Homo sapien
ccccaatgtggccataagagatcaa

SEQ ID NO: 628169 - DNA, 25 bp, Homo sapien
gtatacaggttgtcagccaggctct

SEQ ID NO: 628170 - DNA, 25 bp, Homo sapien
agggccagccacttgacgggcaatt

SEQ ID NO: 628171 - DNA, 25 bp, Homo sapien
ttgacgggcaatttggaggcacagc

SEQ ID NO: 628172 - DNA, 25 bp, Homo sapien
ggaggcacagccctaacaatagtag

SEQ ID NO: 628173 - DNA, 25 bp, Homo sapien
atagtagccccgctgtagatcttcc

SEQ ID NO: 628174 - DNA, 25 bp, Homo sapien
aggagagtccaaagtcagccacaca

SEQ ID NO: 628175 - DNA, 25 bp, Homo sapien
atgcagttccgagcggccaggtctc

SEQ ID NO: 628176 - DNA, 25 bp, Homo sapien
cggtggatgaagttccgagagctca

SEQ ID NO: 628177 - DNA, 25 bp, Homo sapien
gagagctcaggtactccatgctgca

SEQ ID NO: 628178 - DNA, 25 bp, Homo sapien
atgctgcaggcaatgtccaccatga

SEQ ID NO: 628179 - DNA, 25 bp, Homo sapien
tgtccaccatgaaccggatcagggt

SEQ ID NO: 628180 - DNA, 25 bp, Homo sapien
ttaagtgctataggacttccagcta

SEQ ID NO: 628181 - DNA, 25 bp, Homo sapien
ggacttccagctacaaatcctgaaa

SEQ ID NO: 628182 - DNA, 25 bp, Homo sapien
aatcctgaaaacacggagtggctgt

SEQ ID NO: 628183 - DNA, 25 bp, Homo sapien
gctgtgataatacgactagccaaca

SEQ ID NO: 628184 - DNA, 25 bp, Homo sapien
aacatcacacagtaattttgcacat

SEQ ID NO: 628185 - DNA, 25 bp, Homo sapien
agttgagcctataatcgtgatacag

SEQ ID NO: 628186 - DNA, 25 bp, Homo sapien
ggcactaaaatctcaggtgacattt

SEQ ID NO: 628187 - DNA, 25 bp, Homo sapien
aaaccatctttactagcgagcttcc

SEQ ID NO: 628188 - DNA, 25 bp, Homo sapien
gcgagcttcccacaatggttctaga

SEQ ID NO: 628189 - DNA, 25 bp, Homo sapien
atggttctagaaccttccttcattc

SEQ ID NO: 628190 - DNA, 25 bp, Homo sapien
aacccaaccaggattccaacagact

SEQ ID NO: 628191 - DNA, 25 bp, Homo sapien
acacagacttcttgcctttactttt

SEQ ID NO: 628192 - DNA, 25 bp, Homo sapien
ttgcctttacttttatctgactgct

SEQ ID NO: 628193 - DNA, 25 bp, Homo sapien
tgggctggaatataatcgctactta

SEQ ID NO: 628194 - DNA, 25 bp, Homo sapien
tcgctacttaactggacttgacttt

SEQ ID NO: 628195 - DNA, 25 bp, Homo sapien
cttgactttcaaggcctgattggcg

SEQ ID NO: 628196 - DNA, 25 bp, Homo sapien
caaggcctgattggcgtttccagta

SEQ ID NO: 628197 - DNA, 25 bp, Homo sapien
gcgtttccagtatagcagttgcctg

SEQ ID NO: 628198 - DNA, 25 bp, Homo sapien
agcagttgcctgagtcatctagttt

SEQ ID NO: 628199 - DNA, 25 bp, Homo sapien
aatcaaaggactggcttggaggcta

SEQ ID NO: 628200 - DNA, 25 bp, Homo sapien
tggcttggaggctagtgtcctgtct

SEQ ID NO: 628201 - DNA, 25 bp, Homo sapien
aatgggcttaatgtaacttcagtta

SEQ ID NO: 628202 - DNA, 25 bp, Homo sapien
gaaaagttctaaaagcatgcacaat

SEQ ID NO: 628203 - DNA, 25 bp, Homo sapien
caatgtgactcataacttggaggag

SEQ ID NO: 628204 - DNA, 25 bp, Homo sapien
gagaaactctccaagtggcactact

SEQ ID NO: 628205 - DNA, 25 bp, Homo sapien
caagtggcactactaccaaatcagt

SEQ ID NO: 628206 - DNA, 25 bp, Homo sapien
aatcagtttccattgctgctttact

SEQ ID NO: 628207 - DNA, 25 bp, Homo sapien
cattgctgctttacttgatgtgaat

SEQ ID NO: 628208 - DNA, 25 bp, Homo sapien
acaaagaacttgcttcaaagaagga

SEQ ID NO: 628209 - DNA, 25 bp, Homo sapien
aggtcattacttagccttaccccag

SEQ ID NO: 628210 - DNA, 25 bp, Homo sapien
tacttagccttaccccagataagaa

SEQ ID NO: 628211 - DNA, 25 bp, Homo sapien
tatccaaaaataaagcacctgcctt

SEQ ID NO: 628212 - DNA, 25 bp, Homo sapien
gcacctgccttttatagattgtgta

SEQ ID NO: 628213 - DNA, 25 bp, Homo sapien
acttgaaaatctagcaatgtgcatt

SEQ ID NO: 628214 - DNA, 25 bp, Homo sapien
atctagcaatgtgcatttacatcat

SEQ ID NO: 628215 - DNA, 25 bp, Homo sapien
atttacatcatagaactacatctct

SEQ ID NO: 628216 - DNA, 25 bp, Homo sapien
gaactacatctctatggaaaagcat

SEQ ID NO: 628217 - DNA, 25 bp, Homo sapien
gaaaagcattccagtttcaagtttt

SEQ ID NO: 628218 - DNA, 25 bp, Homo sapien
aaacaggaaaccagatgaatcccaa

SEQ ID NO: 628219 - DNA, 25 bp, Homo sapien
cagagaggggacatgcttttctcaa

SEQ ID NO: 628220 - DNA, 25 bp, Homo sapien
aactgaggcccacagcaacaataat

SEQ ID NO: 628221 - DNA, 25 bp, Homo sapien
agtggataattgagacctccattat

SEQ ID NO: 628222 - DNA, 25 bp, Homo sapien
gagacctccattattagtagttaat

SEQ ID NO: 628223 - DNA, 25 bp, Homo sapien
atcaaagatctctcctaattagctt

SEQ ID NO: 628224 - DNA, 25 bp, Homo sapien
ctctgcagctgaagcaataactgaa

SEQ ID NO: 628225 - DNA, 25 bp, Homo sapien
acagctgagggccatctgctgacag

SEQ ID NO: 628226 - DNA, 25 bp, Homo sapien
gctgacagtactccctgcagctggg

SEQ ID NO: 628227 - DNA, 25 bp, Homo sapien
agctgggcagcacatcctttctcaa

SEQ ID NO: 628228 - DNA, 25 bp, Homo sapien
gatcaaggcagttgcatctccgtgt

SEQ ID NO: 628229 - DNA, 25 bp, Homo sapien
tttttctttgcattcctagggcctc

SEQ ID NO: 628230 - DNA, 25 bp, Homo sapien
attcctagggcctcccatagtatat

SEQ ID NO: 628231 - DNA, 25 bp, Homo sapien
gggcctcccatagtatatggcacat

SEQ ID NO: 628232 - DNA, 25 bp, Homo sapien
acatagtaggcaaaactggaggtct

SEQ ID NO: 628233 - DNA, 25 bp, Homo sapien
actggaggtctgtagggcaaattca

SEQ ID NO: 628234 - DNA, 25 bp, Homo sapien
agatgagtattgttttttcacccac

SEQ ID NO: 628235 - DNA, 25 bp, Homo sapien
gatacatgtaagagagaaccccata

SEQ ID NO: 628236 - DNA, 25 bp, Homo sapien
catagaaaatggtgactgctgtcag

SEQ ID NO: 628237 - DNA, 25 bp, Homo sapien
gggaggcacatgtagagagactttt

SEQ ID NO: 628238 - DNA, 25 bp, Homo sapien
ttccctgcagcagaagatatcctca

SEQ ID NO: 628239 - DNA, 25 bp, Homo sapien
gatatcctcaggatggcaaccagga

SEQ ID NO: 628240 - DNA, 25 bp, Homo sapien
ggcaaccaggacatatatgcaggaa

SEQ ID NO: 628241 - DNA, 25 bp, Homo sapien
tgatgaccaccatcacagtgcacat

SEQ ID NO: 628242 - DNA, 25 bp, Homo sapien
cacagtgcacatcaaatttaatccc

SEQ ID NO: 628243 - DNA, 25 bp, Homo sapien
tcaatattggagcatggtagggcaa

SEQ ID NO: 628244 - DNA, 25 bp, Homo sapien
ggtagggcaataattggaggttcat

SEQ ID NO: 628245 - DNA, 25 bp, Homo sapien
gagactcattaatacgatggcatag

SEQ ID NO: 628246 - DNA, 25 bp, Homo sapien
gccgcagaacctccgcccggaccgt

SEQ ID NO: 628247 - DNA, 25 bp, Homo sapien
ggaccgtgccagcaacaggctccca

SEQ ID NO: 628248 - DNA, 25 bp, Homo sapien
gcaacaggctcccaggtgcgtgacc

SEQ ID NO: 628249 - DNA, 25 bp, Homo sapien
tcccaggtgcgtgaccctctgcacg

SEQ ID NO: 628250 - DNA, 25 bp, Homo sapien
tctgttcgcaggattgttttaaagt

SEQ ID NO: 628251 - DNA, 25 bp, Homo sapien
ctgttcgcaggattgttttaaagta

SEQ ID NO: 628252 - DNA, 25 bp, Homo sapien
tgttcgcaggattgttttaaagtat

SEQ ID NO: 628253 - DNA, 25 bp, Homo sapien
gttcgcaggattgttttaaagtata

SEQ ID NO: 628254 - DNA, 25 bp, Homo sapien
ttcgcaggattgttttaaagtatac

SEQ ID NO: 628255 - DNA, 25 bp, Homo sapien
tcgcaggattgttttaaagtatact

SEQ ID NO: 628256 - DNA, 25 bp, Homo sapien
gcaggattgttttaaagtatactga

SEQ ID NO: 628257 - DNA, 25 bp, Homo sapien
tgtgcagaccacttgggtatttagt

SEQ ID NO: 628258 - DNA, 25 bp, Homo sapien
tttccattttgtggccccaatgaaa

SEQ ID NO: 628259 - DNA, 25 bp, Homo sapien
taatcatctcttctgtgagactccc

SEQ ID NO: 628260 - DNA, 25 bp, Homo sapien
ccccggtactagagcttgtgtgtgc

SEQ ID NO: 628261 - DNA, 25 bp, Homo sapien
tgcagacaccttcttatttgaaatc

SEQ ID NO: 628262 - DNA, 25 bp, Homo sapien
tgccttcacaggcaccattttgatt

SEQ ID NO: 628263 - DNA, 25 bp, Homo sapien
tatggttcctttcttgttgatcctc

SEQ ID NO: 628264 - DNA, 25 bp, Homo sapien
gttgatcctcttgtcttacattcga

SEQ ID NO: 628265 - DNA, 25 bp, Homo sapien
ttacattcgagttctgtttgccatc

SEQ ID NO: 628266 - DNA, 25 bp, Homo sapien
gtaatattctcatggatctcaggga

SEQ ID NO: 628267 - DNA, 25 bp, Homo sapien
gatctcagggatcatggtggctact

SEQ ID NO: 628268 - DNA, 25 bp, Homo sapien
tcccggtcacctagcgttgttttgg

SEQ ID NO: 628269 - DNA, 25 bp, Homo sapien
accgctactcctcagcgaggaatta

SEQ ID NO: 628270 - DNA, 25 bp, Homo sapien
ttattagccaagttttctcacccag

SEQ ID NO: 628271 - DNA, 25 bp, Homo sapien
cagattccgtatttgtgaacaagct

SEQ ID NO: 628272 - DNA, 25 bp, Homo sapien
aagcttttcttgacactacccgtat

SEQ ID NO: 628273 - DNA, 25 bp, Homo sapien
cgtatttccagcatcgtcgttttat

SEQ ID NO: 628274 - DNA, 25 bp, Homo sapien
aaacatccataaaagctgcccctta

SEQ ID NO: 628275 - DNA, 25 bp, Homo sapien
aaaagctgccccttagatgcattca

SEQ ID NO: 628276 - DNA, 25 bp, Homo sapien
acctgcttgcttgtcatttgtcctt

SEQ ID NO: 628277 - DNA, 25 bp, Homo sapien
atttgtccttctgacatctgctgtt

SEQ ID NO: 628278 - DNA, 25 bp, Homo sapien
atctgctgttgttcacccctttaat

SEQ ID NO: 628279 - DNA, 25 bp, Homo sapien
catccttttgatgcagtgctgagta

SEQ ID NO: 628280 - DNA, 25 bp, Homo sapien
gtgctgagtaatgaggtatttccct

SEQ ID NO: 628281 - DNA, 25 bp, Homo sapien
gtatttccctgtctaaagattttag

SEQ ID NO: 628282 - DNA, 25 bp, Homo sapien
gaaaaatacattgcactctgaaaca

SEQ ID NO: 628283 - DNA, 25 bp, Homo sapien
gtgtggtcattagattaactcaggc

SEQ ID NO: 628284 - DNA, 25 bp, Homo sapien
cattagattaactcaggctttggac

SEQ ID NO: 628285 - DNA, 25 bp, Homo sapien
atttcctcttacaccagtctctgaa

SEQ ID NO: 628286 - DNA, 25 bp, Homo sapien
gcttaaaggattcgttatttccagt

SEQ ID NO: 628287 - DNA, 25 bp, Homo sapien
tatttccagttgcaaatgccatcag

SEQ ID NO: 628288 - DNA, 25 bp, Homo sapien
gtaccaccaagaatgtagtttacca

SEQ ID NO: 628289 - DNA, 25 bp, Homo sapien
gtgaataaactgtcttaagctttcc

SEQ ID NO: 628290 - DNA, 25 bp, Homo sapien
aagcttctcccacttcttgaaaggc

SEQ ID NO: 628291 - DNA, 25 bp, Homo sapien
ctcccacttcttgaaaggctttatt

SEQ ID NO: 628292 - DNA, 25 bp, Homo sapien
ttttatatagcctctggaagccaga

SEQ ID NO: 628293 - DNA, 25 bp, Homo sapien
agaaagcgagcctcacagggcggct

SEQ ID NO: 628294 - DNA, 25 bp, Homo sapien
tcacagggcggctctggagagatct

SEQ ID NO: 628295 - DNA, 25 bp, Homo sapien
gaaggctgcgttcataagttcagaa

SEQ ID NO: 628296 - DNA, 25 bp, Homo sapien
aagtttatgctttaggccgctagac

SEQ ID NO: 628297 - DNA, 25 bp, Homo sapien
gccgctagaccgtaagctctttgag

SEQ ID NO: 628298 - DNA, 25 bp, Homo sapien
gaccgtaagctctttgagttcagtt

SEQ ID NO: 628299 - DNA, 25 bp, Homo sapien
tcttcattgtatttcaagaactgtg

SEQ ID NO: 628300 - DNA, 25 bp, Homo sapien
aaaatccttccccagagcaagcttc

SEQ ID NO: 628301 - DNA, 25 bp, Homo sapien
gtttctgaagtattctttcaagctt

SEQ ID NO: 628302 - DNA, 25 bp, Homo sapien
tgaagtattctttcaagcttttctc

SEQ ID NO: 628303 - DNA, 25 bp, Homo sapien
aaatttagagatgatatccctatta

SEQ ID NO: 628304 - DNA, 25 bp, Homo sapien
gagatgatatccctattaaaaacat

SEQ ID NO: 628305 - DNA, 25 bp, Homo sapien
aaaaacatttctcctctatgattgt

SEQ ID NO: 628306 - DNA, 25 bp, Homo sapien
acatttctcctctatgattgtatac

SEQ ID NO: 628307 - DNA, 25 bp, Homo sapien
ttctcctctatgattgtatacacag

SEQ ID NO: 628308 - DNA, 25 bp, Homo sapien
atgattgtatacacaggccagctgc

SEQ ID NO: 628309 - DNA, 25 bp, Homo sapien
cacaggccagctgcttgaaataaaa

SEQ ID NO: 628310 - DNA, 25 bp, Homo sapien
aggccagctgcttgaaataaaaata

SEQ ID NO: 628311 - DNA, 25 bp, Homo sapien
gtaaacttcagttgaaagattcatt

SEQ ID NO: 628312 - DNA, 25 bp, Homo sapien
cctggtgattcccagcatccgggaa

SEQ ID NO: 628313 - DNA, 25 bp, Homo sapien
tggtgattcccagcatccgggaaga

SEQ ID NO: 628314 - DNA, 25 bp, Homo sapien
gtgattcccagcatccgggaagact

SEQ ID NO: 628315 - DNA, 25 bp, Homo sapien
gattcccagcatccgggaagactca

SEQ ID NO: 628316 - DNA, 25 bp, Homo sapien
agcatccgggaagactcacctccag

SEQ ID NO: 628317 - DNA, 25 bp, Homo sapien
cagctccaggccatcatgatatagc

SEQ ID NO: 628318 - DNA, 25 bp, Homo sapien
gctccaggccatcatgatatagccc

SEQ ID NO: 628319 - DNA, 25 bp, Homo sapien
tccaggccatcatgatatagccctc

SEQ ID NO: 628320 - DNA, 25 bp, Homo sapien
ggccatcatgatatagccctcccct

SEQ ID NO: 628321 - DNA, 25 bp, Homo sapien
agccctgcctgacatttctctctat

SEQ ID NO: 628322 - DNA, 25 bp, Homo sapien
tgcctgacatttctctctatccttc

SEQ ID NO: 628323 - DNA, 25 bp, Homo sapien
tagaatatggccaccacagtgaggt

SEQ ID NO: 628324 - DNA, 25 bp, Homo sapien
ggaccaccaggatgatgcaggcata

SEQ ID NO: 628325 - DNA, 25 bp, Homo sapien
tgcaggcataggaggcagtaatgaa

SEQ ID NO: 628326 - DNA, 25 bp, Homo sapien
aaggccagagctccactgattacaa

SEQ ID NO: 628327 - DNA, 25 bp, Homo sapien
gattacaacagcaccttctgtgtga

SEQ ID NO: 628328 - DNA, 25 bp, Homo sapien
cagcaccttctgtgtgaatcataag

SEQ ID NO: 628329 - DNA, 25 bp, Homo sapien
gtgcaggagatcttcatcagagcgt

SEQ ID NO: 628330 - DNA, 25 bp, Homo sapien
ttcatcagagcgtagaggtcacaga

SEQ ID NO: 628331 - DNA, 25 bp, Homo sapien
cttggtcactgaatagctggaaagg

SEQ ID NO: 628332 - DNA, 25 bp, Homo sapien
aagtagacccaactgagggtgccat

SEQ ID NO: 628333 - DNA, 25 bp, Homo sapien
cccaactgagggtgccatagaatat

SEQ ID NO: 628334 - DNA, 25 bp, Homo sapien
tggtaactagttgtgccctgcagat

SEQ ID NO: 628335 - DNA, 25 bp, Homo sapien
gggaatgtcatcgaccatttcacat

SEQ ID NO: 628336 - DNA, 25 bp, Homo sapien
acatgtgaaatccttgcagtgctaa

SEQ ID NO: 628337 - DNA, 25 bp, Homo sapien
agttccctgctcgtggacatggtta

SEQ ID NO: 628338 - DNA, 25 bp, Homo sapien
tggtcagtattctcctgctgcccat

SEQ ID NO: 628339 - DNA, 25 bp, Homo sapien
tgctgcccatcccaatgcttttgat

SEQ ID NO: 628340 - DNA, 25 bp, Homo sapien
gatttgcatctcgtatggcttcatc

SEQ ID NO: 628341 - DNA, 25 bp, Homo sapien
ggcttcatcctttctacaattctga

SEQ ID NO: 628342 - DNA, 25 bp, Homo sapien
tcatcatgagcaggcacgtctgtgt

SEQ ID NO: 628343 - DNA, 25 bp, Homo sapien
acgtctgtgtgcagatggccgccat

SEQ ID NO: 628344 - DNA, 25 bp, Homo sapien
gtctgactgctctgctggtaactag

SEQ ID NO: 628345 - DNA, 25 bp, Homo sapien
caaaaagcaacttgtcagccaataa

SEQ ID NO: 628346 - DNA, 25 bp, Homo sapien
aaatgcagtaaccagtacttagact

SEQ ID NO: 628347 - DNA, 25 bp, Homo sapien
tacttagactgtactaggatagaaa

SEQ ID NO: 628348 - DNA, 25 bp, Homo sapien
gaaagaaccacctcagtagtgtctg

SEQ ID NO: 628349 - DNA, 25 bp, Homo sapien
tgtctgaggctaacacatttccatc

SEQ ID NO: 628350 - DNA, 25 bp, Homo sapien
ttttgcaaacctggttcccttcgct

SEQ ID NO: 628351 - DNA, 25 bp, Homo sapien
ttcgcttctgccacatcacgcagag

SEQ ID NO: 628352 - DNA, 25 bp, Homo sapien
tcacgcagagctagtgatcgagttt

SEQ ID NO: 628353 - DNA, 25 bp, Homo sapien
gatcgagtttgcacaattacaccaa

SEQ ID NO: 628354 - DNA, 25 bp, Homo sapien
atacattgtatttgtgggccatcac

SEQ ID NO: 628355 - DNA, 25 bp, Homo sapien
ttgtgggccatcacatcactttatg

SEQ ID NO: 628356 - DNA, 25 bp, Homo sapien
agactaaccttctgtaactccaaca

SEQ ID NO: 628357 - DNA, 25 bp, Homo sapien
atttactgtgacattatcccattgt

SEQ ID NO: 628358 - DNA, 25 bp, Homo sapien
atcccattgtctaagatttcttgta

SEQ ID NO: 628359 - DNA, 25 bp, Homo sapien
ttattttctcaggttcaattcaggt

SEQ ID NO: 628360 - DNA, 25 bp, Homo sapien
aggttcaattcaggtattcagcatt

SEQ ID NO: 628361 - DNA, 25 bp, Homo sapien
ttactttatccagccattatgacca

SEQ ID NO: 628362 - DNA, 25 bp, Homo sapien
gcattgtgactattcttgtatctta

SEQ ID NO: 628363 - DNA, 25 bp, Homo sapien
acatttgttctcttcgcaatcttaa

SEQ ID NO: 628364 - DNA, 25 bp, Homo sapien
tatgaccaatggactgtgcatccgg

SEQ ID NO: 628365 - DNA, 25 bp, Homo sapien
gtgcatccggctattaatcttgtca

SEQ ID NO: 628366 - DNA, 25 bp, Homo sapien
tatgtaggtggtcttcttcatgctt

SEQ ID NO: 628367 - DNA, 25 bp, Homo sapien
acatgcagctttacgagtatgcaaa

SEQ ID NO: 628368 - DNA, 25 bp, Homo sapien
tgcaaaagatctcttccagcagcgc

SEQ ID NO: 628369 - DNA, 25 bp, Homo sapien
tagagcaccagagggaccgccagaa

SEQ ID NO: 628370 - DNA, 25 bp, Homo sapien
cagcgagagcacagggaccaccagt

SEQ ID NO: 628371 - DNA, 25 bp, Homo sapien
gcacagggaccaccagtggcccaaa

SEQ ID NO: 628372 - DNA, 25 bp, Homo sapien
gaagggactgtcaccgaggactaca

SEQ ID NO: 628373 - DNA, 25 bp, Homo sapien
gaggactacaacagccaggtggtga

SEQ ID NO: 628374 - DNA, 25 bp, Homo sapien
gggtgagcaggcacattgactttct

SEQ ID NO: 628375 - DNA, 25 bp, Homo sapien
agcaggcacattgactttctgttga

SEQ ID NO: 628376 - DNA, 25 bp, Homo sapien
gactttctgttgaggtaccttggag

SEQ ID NO: 628377 - DNA, 25 bp, Homo sapien
ttgaggtaccttggagaagctgagc

SEQ ID NO: 628378 - DNA, 25 bp, Homo sapien
aagaaaccagcaacagccaagatgt

SEQ ID NO: 628379 - DNA, 25 bp, Homo sapien
taagaagcaaggatggttaaggcag

SEQ ID NO: 628380 - DNA, 25 bp, Homo sapien
gttaaggcaggcgtcaggatgttaa

SEQ ID NO: 628381 - DNA, 25 bp, Homo sapien
ggcaggcgtcaggatgttaaatgca

SEQ ID NO: 628382 - DNA, 25 bp, Homo sapien
aatgcactcaagaccagaaccagta

SEQ ID NO: 628383 - DNA, 25 bp, Homo sapien
gcactcaagaccagaaccagtaatt

SEQ ID NO: 628384 - DNA, 25 bp, Homo sapien
gaccagaaccagtaattcattgatg

SEQ ID NO: 628385 - DNA, 25 bp, Homo sapien
tccatggagctgacagatgatggct

SEQ ID NO: 628386 - DNA, 25 bp, Homo sapien
atggagctgacagatgatggctgca

SEQ ID NO: 628387 - DNA, 25 bp, Homo sapien
gctgcagacccaaagaaaccagcaa

SEQ ID NO: 628388 - DNA, 25 bp, Homo sapien
gacccaaagaaaccagcaacagcca

SEQ ID NO: 628389 - DNA, 25 bp, Homo sapien
ggccgccaacatccgcgaaaggaag

SEQ ID NO: 628390 - DNA, 25 bp, Homo sapien
ggaagcggatgttcaacctcaacga

SEQ ID NO: 628391 - DNA, 25 bp, Homo sapien
gttcaacctcaacgaggcctttgac

SEQ ID NO: 628392 - DNA, 25 bp, Homo sapien
cctttgaccagctgcggaggaaggt

SEQ ID NO: 628393 - DNA, 25 bp, Homo sapien
gtgcccacgtttgcttacgagaaaa

SEQ ID NO: 628394 - DNA, 25 bp, Homo sapien
agaaaaggctgtcccggatcgagac

SEQ ID NO: 628395 - DNA, 25 bp, Homo sapien
tggccatcgtctatatctccttcat

SEQ ID NO: 628396 - DNA, 25 bp, Homo sapien
tcgtctatatctccttcatgaccga

SEQ ID NO: 628397 - DNA, 25 bp, Homo sapien
cttcatgaccgagctcttggagagc

SEQ ID NO: 628398 - DNA, 25 bp, Homo sapien
agcctggtgtggagagtctgccctt

SEQ ID NO: 628399 - DNA, 25 bp, Homo sapien
tgcccttcctcgtctggtagtgctg

SEQ ID NO: 628400 - DNA, 25 bp, Homo sapien
ggagtagcattgacccactagacat

SEQ ID NO: 628401 - DNA, 25 bp, Homo sapien
gcattgacccactagacatagagga

SEQ ID NO: 628402 - DNA, 25 bp, Homo sapien
gacatagaggatgtgtaccaacaca

SEQ ID NO: 628403 - DNA, 25 bp, Homo sapien
ccaaagttcagttctaaaagtcaca

SEQ ID NO: 628404 - DNA, 25 bp, Homo sapien
ctaaaagtcacatttggcatgttta

SEQ ID NO: 628405 - DNA, 25 bp, Homo sapien
ccaacagacagaagctggaacatgt

SEQ ID NO: 628406 - DNA, 25 bp, Homo sapien
ggaagcaaagcgagtttatttataa

SEQ ID NO: 628407 - DNA, 25 bp, Homo sapien
tgaatattaccaaaaagatcccaaa

SEQ ID NO: 628408 - DNA, 25 bp, Homo sapien
gcataaacaatcaactcttgaccag

SEQ ID NO: 628409 - DNA, 25 bp, Homo sapien
ttgaccagatatactctacaggact

SEQ ID NO: 628410 - DNA, 25 bp, Homo sapien
tacaggactcagaaagggcaatctc

SEQ ID NO: 628411 - DNA, 25 bp, Homo sapien
aaaagaaatgattcggctggaccca

SEQ ID NO: 628412 - DNA, 25 bp, Homo sapien
aaagaaatgattcggctggacccag

SEQ ID NO: 628413 - DNA, 25 bp, Homo sapien
aagaaatgattcggctggacccagt

SEQ ID NO: 628414 - DNA, 25 bp, Homo sapien
agaaatgattcggctggacccagtg

SEQ ID NO: 628415 - DNA, 25 bp, Homo sapien
gaaatgattcggctggacccagtgg

SEQ ID NO: 628416 - DNA, 25 bp, Homo sapien
aaatgattcggctggacccagtggc

SEQ ID NO: 628417 - DNA, 25 bp, Homo sapien
aatgattcggctggacccagtggct

SEQ ID NO: 628418 - DNA, 25 bp, Homo sapien
tgattcggctggacccagtggctca

SEQ ID NO: 628419 - DNA, 25 bp, Homo sapien
gaggcactagaatggcttgatccca

SEQ ID NO: 628420 - DNA, 25 bp, Homo sapien
aggcactagaatggcttgatcccag

SEQ ID NO: 628421 - DNA, 25 bp, Homo sapien
gcactagaatggcttgatcccagga

SEQ ID NO: 628422 - DNA, 25 bp, Homo sapien
cagctgcatagggaacaccaccatg

SEQ ID NO: 628423 - DNA, 25 bp, Homo sapien
caccaccatgcttttgtttacagta

SEQ ID NO: 628424 - DNA, 25 bp, Homo sapien
tgaaaaacaagagcgccctcggtag

SEQ ID NO: 628425 - DNA, 25 bp, Homo sapien
gtaggccccagccaggcactggttt

SEQ ID NO: 628426 - DNA, 25 bp, Homo sapien
actggtttcaccagggtgcggccct

SEQ ID NO: 628427 - DNA, 25 bp, Homo sapien
tgcggccctgatgggacacctggca

SEQ ID NO: 628428 - DNA, 25 bp, Homo sapien
cagtggctagcatggacgtagtaga

SEQ ID NO: 628429 - DNA, 25 bp, Homo sapien
aaattcaaggccacgagagagggtg

SEQ ID NO: 628430 - DNA, 25 bp, Homo sapien
aaaacagctgactttaacgccatcc

SEQ ID NO: 628431 - DNA, 25 bp, Homo sapien
acgccatccagagtctgtatatttt

SEQ ID NO: 628432 - DNA, 25 bp, Homo sapien
tgggtgcccacagctgcatagggaa

SEQ ID NO: 628433 - DNA, 25 bp, Homo sapien
tatctccaaatccaaaataaagagt

SEQ ID NO: 628434 - DNA, 25 bp, Homo sapien
atctccaaatccaaaataaagagta

SEQ ID NO: 628435 - DNA, 25 bp, Homo sapien
tctccaaatccaaaataaagagtaa

SEQ ID NO: 628436 - DNA, 25 bp, Homo sapien
aaagagtaaagtggggctgggcaca

SEQ ID NO: 628437 - DNA, 25 bp, Homo sapien
aagagtaaagtggggctgggcacag

SEQ ID NO: 628438 - DNA, 25 bp, Homo sapien
ggaggtcaaggagggcagatcattt

SEQ ID NO: 628439 - DNA, 25 bp, Homo sapien
gaggtcaaggagggcagatcatttg

SEQ ID NO: 628440 - DNA, 25 bp, Homo sapien
aggtcaaggagggcagatcatttga

SEQ ID NO: 628441 - DNA, 25 bp, Homo sapien
ggtcaaggagggcagatcatttgag

SEQ ID NO: 628442 - DNA, 25 bp, Homo sapien
gtcaaggagggcagatcatttgagg

SEQ ID NO: 628443 - DNA, 25 bp, Homo sapien
tcaaggagggcagatcatttgaggt

SEQ ID NO: 628444 - DNA, 25 bp, Homo sapien
cagccattgaagaccatttgttata

SEQ ID NO: 628445 - DNA, 25 bp, Homo sapien
gaagaccatttgttatacgtactac

SEQ ID NO: 628446 - DNA, 25 bp, Homo sapien
tacgtactacttttcattgatcagc

SEQ ID NO: 628447 - DNA, 25 bp, Homo sapien
ttttcattgatcagctacatttttg

SEQ ID NO: 628448 - DNA, 25 bp, Homo sapien
tttttgatggttacttttcctacat

SEQ ID NO: 628449 - DNA, 25 bp, Homo sapien
ggttacttttcctacatttttgatg

SEQ ID NO: 628450 - DNA, 25 bp, Homo sapien
gatggatgtttttgctatatcattt

SEQ ID NO: 628451 - DNA, 25 bp, Homo sapien
ggcttccattctttatcacttattg

SEQ ID NO: 628452 - DNA, 25 bp, Homo sapien
tggtgatatttgcatatgtggcgat

SEQ ID NO: 628453 - DNA, 25 bp, Homo sapien
atgtggcgatgaatatttggtgtag

SEQ ID NO: 628454 - DNA, 25 bp, Homo sapien
tatttggtgtagaacattcatcttt

SEQ ID NO: 628455 - DNA, 25 bp, Homo sapien
gacaaacactatacacatatccaga

SEQ ID NO: 628456 - DNA, 25 bp, Homo sapien
acacatatccagaaggtctcaatta

SEQ ID NO: 628457 - DNA, 25 bp, Homo sapien
gaaatgctatcctttgttttacaat

SEQ ID NO: 628458 - DNA, 25 bp, Homo sapien
gttttacaatgtatgcgaccagaat

SEQ ID NO: 628459 - DNA, 25 bp, Homo sapien
agatctaacattaagaggtctgcta

SEQ ID NO: 628460 - DNA, 25 bp, Homo sapien
gaggtctgctatgctgagtgaaatc

SEQ ID NO: 628461 - DNA, 25 bp, Homo sapien
gaaatcttgctgtgggaaaacttaa

SEQ ID NO: 628462 - DNA, 25 bp, Homo sapien
gttacaaagtagcttaacactcaat

SEQ ID NO: 628463 - DNA, 25 bp, Homo sapien
cactcaatttctaacataccttctc

SEQ ID NO: 628464 - DNA, 25 bp, Homo sapien
ttctaacataccttctctcgagtag

SEQ ID NO: 628465 - DNA, 25 bp, Homo sapien
ttctctcgagtagataccaccaaat

SEQ ID NO: 628466 - DNA, 25 bp, Homo sapien
gtcttgagtgtctaatgccttaact

SEQ ID NO: 628467 - DNA, 25 bp, Homo sapien
agaatatttctactggtggaccact

SEQ ID NO: 628468 - DNA, 25 bp, Homo sapien
tggtggaccacttcagacagaggag

SEQ ID NO: 628469 - DNA, 25 bp, Homo sapien
gactctatctcttttatttgcctaa

SEQ ID NO: 628470 - DNA, 25 bp, Homo sapien
atctcctttgttctgctggactgta

SEQ ID NO: 628471 - DNA, 25 bp, Homo sapien
tgctggactgtaatggaagaacttc

SEQ ID NO: 628472 - DNA, 25 bp, Homo sapien
gaagaacttcatctgggttttggta

SEQ ID NO: 628473 - DNA, 25 bp, Homo sapien
ttcatctgggttttggtattttcct

SEQ ID NO: 628474 - DNA, 25 bp, Homo sapien
cttcccttataacatgtgctcagct

SEQ ID NO: 628475 - DNA, 25 bp, Homo sapien
atgtgctcagctaactatactatta

SEQ ID NO: 628476 - DNA, 25 bp, Homo sapien
ttacgttttgtaaggcaactaactg

SEQ ID NO: 628477 - DNA, 25 bp, Homo sapien
gagtgattaccctcataatccgtga

SEQ ID NO: 628478 - DNA, 25 bp, Homo sapien
taatccgtgactaagaacatccaaa

SEQ ID NO: 628479 - DNA, 25 bp, Homo sapien
aaatcagcatggcttcttcctgtct

SEQ ID NO: 628480 - DNA, 25 bp, Homo sapien
gtctgaaattattactacttagggt

SEQ ID NO: 628481 - DNA, 25 bp, Homo sapien
tagggtttttcacgtgttatttcat

SEQ ID NO: 628482 - DNA, 25 bp, Homo sapien
tctgttttaaacttgcaagacgtat

SEQ ID NO: 628483 - DNA, 25 bp, Homo sapien
gcaagacgtattgtctcttcagaaa

SEQ ID NO: 628484 - DNA, 25 bp, Homo sapien
ttctctctagattacttcaccaaag

SEQ ID NO: 628485 - DNA, 25 bp, Homo sapien
ttcaccaaagtacagttcctacagg

SEQ ID NO: 628486 - DNA, 25 bp, Homo sapien
atgatctgacctaacctactattgg

SEQ ID NO: 628487 - DNA, 25 bp, Homo sapien
tgacctaacctactattggctgaag

SEQ ID NO: 628488 - DNA, 25 bp, Homo sapien
agggctcccactgcaatcctgagag

SEQ ID NO: 628489 - DNA, 25 bp, Homo sapien
tcccactgcaatcctgagaggcagg

SEQ ID NO: 628490 - DNA, 25 bp, Homo sapien
gaggcagggtttgtcctgagcactt

SEQ ID NO: 628491 - DNA, 25 bp, Homo sapien
gtcctgagcacttggttcacacaga

SEQ ID NO: 628492 - DNA, 25 bp, Homo sapien
tggttcacacagacccggcagatgt

SEQ ID NO: 628493 - DNA, 25 bp, Homo sapien
acccggcagatgtgatgtcatttca

SEQ ID NO: 628494 - DNA, 25 bp, Homo sapien
atcctctcatctgaggtgcagtggt

SEQ ID NO: 628495 - DNA, 25 bp, Homo sapien
gcagtggtgtccctgaattggctca

SEQ ID NO: 628496 - DNA, 25 bp, Homo sapien
cctgaattggctcaggtggtttcct

SEQ ID NO: 628497 - DNA, 25 bp, Homo sapien
caggtggtttcctacaaccatttgt

SEQ ID NO: 628498 - DNA, 25 bp, Homo sapien
gtgaaccagttttaaatagagccat

SEQ ID NO: 628499 - DNA, 25 bp, Homo sapien
gaagtttatagtttttgctctactg

SEQ ID NO: 628500 - DNA, 25 bp, Homo sapien
ttgctctactgtttaggtctgtggt

SEQ ID NO: 628501 - DNA, 25 bp, Homo sapien
ctactgtttaggtctgtggttcatt

SEQ ID NO: 628502 - DNA, 25 bp, Homo sapien
aatttcattatttcgcatgaggata

SEQ ID NO: 628503 - DNA, 25 bp, Homo sapien
gcatgaggatattcagttgtcctga

SEQ ID NO: 628504 - DNA, 25 bp, Homo sapien
agttgtcctgataccatttgtttaa

SEQ ID NO: 628505 - DNA, 25 bp, Homo sapien
tatttctggattcttgattctattc

SEQ ID NO: 628506 - DNA, 25 bp, Homo sapien
tgattctattccattcatcgctacg

SEQ ID NO: 628507 - DNA, 25 bp, Homo sapien
tcatcgctacgcctatttttatgcc

SEQ ID NO: 628508 - DNA, 25 bp, Homo sapien
atgccagtaccatactgtctttatt

SEQ ID NO: 628509 - DNA, 25 bp, Homo sapien
tgtctttattactgtggctttgtaa

SEQ ID NO: 628510 - DNA, 25 bp, Homo sapien
attttttgggttgctggagttcatc

SEQ ID NO: 628511 - DNA, 25 bp, Homo sapien
tttgggttgctggagttcatctata

SEQ ID NO: 628512 - DNA, 25 bp, Homo sapien
ggagttcatctataagtcatttttg

SEQ ID NO: 628513 - DNA, 25 bp, Homo sapien
taagactatcaaacacagtgttgcc

SEQ ID NO: 628514 - DNA, 25 bp, Homo sapien
cagtgttgcctacaatagcaaaaat

SEQ ID NO: 628515 - DNA, 25 bp, Homo sapien
gtagtctatctatatgatgcctatt

SEQ ID NO: 628516 - DNA, 25 bp, Homo sapien
tatgatgcctatttttaggctttaa

SEQ ID NO: 628517 - DNA, 25 bp, Homo sapien
gtcttcaaaatctttaatgactgat

SEQ ID NO: 628518 - DNA, 25 bp, Homo sapien
aatgcttaatccttagcaggctctt

SEQ ID NO: 628519 - DNA, 25 bp, Homo sapien
cttagcaggctcttattctttaatt

SEQ ID NO: 628520 - DNA, 25 bp, Homo sapien
ttctttaattaaacgtgcctttgag

SEQ ID NO: 628521 - DNA, 25 bp, Homo sapien
gctaagaagtggaccgtagccctgt

SEQ ID NO: 628522 - DNA, 25 bp, Homo sapien
aagaagtggaccgtagccctgtctg

SEQ ID NO: 628523 - DNA, 25 bp, Homo sapien
aagtggaccgtagccctgtctgttc

SEQ ID NO: 628524 - DNA, 25 bp, Homo sapien
gaccgtagccctgtctgttcaaagg

SEQ ID NO: 628525 - DNA, 25 bp, Homo sapien
gggttgagccaacaaaaggtctgcc

SEQ ID NO: 628526 - DNA, 25 bp, Homo sapien
ttgagccaacaaaaggtctgccgaa

SEQ ID NO: 628527 - DNA, 25 bp, Homo sapien
gagccaacaaaaggtctgccgaaac

SEQ ID NO: 628528 - DNA, 25 bp, Homo sapien
tatttcggcgaagacatgagacagt

SEQ ID NO: 628529 - DNA, 25 bp, Homo sapien
gaagacatgagacagtcccgccctg

SEQ ID NO: 628530 - DNA, 25 bp, Homo sapien
gacagtcccgccctgtcaaggaaat

SEQ ID NO: 628531 - DNA, 25 bp, Homo sapien
cagtcccgccctgtcaaggaaattt

SEQ ID NO: 628532 - DNA, 25 bp, Homo sapien
tagcaaaagatataccatgcaaatc

SEQ ID NO: 628533 - DNA, 25 bp, Homo sapien
atcaaaataatgcttaggtggctat

SEQ ID NO: 628534 - DNA, 25 bp, Homo sapien
atgcttaggtggctataatatcaag

SEQ ID NO: 628535 - DNA, 25 bp, Homo sapien
atcaagacaccatagatttcagagc

SEQ ID NO: 628536 - DNA, 25 bp, Homo sapien
aggatggtcttgaatacatggtgcc

SEQ ID NO: 628537 - DNA, 25 bp, Homo sapien
atacatggtgccaggtcaactgaat

SEQ ID NO: 628538 - DNA, 25 bp, Homo sapien
acaaatcatgatttcccctcacgac

SEQ ID NO: 628539 - DNA, 25 bp, Homo sapien
tgatttcccctcacgacacaaaaat

SEQ ID NO: 628540 - DNA, 25 bp, Homo sapien
gacacaaaaatcaattccaggttta

SEQ ID NO: 628541 - DNA, 25 bp, Homo sapien
ggtttatatacctacatgtgacaga

SEQ ID NO: 628542 - DNA, 25 bp, Homo sapien
atacagaatatcttcataccttggg

SEQ ID NO: 628543 - DNA, 25 bp, Homo sapien
tcttgccatctccacaactcatgat

SEQ ID NO: 628544 - DNA, 25 bp, Homo sapien
atctgttcccacactgggactatga

SEQ ID NO: 628545 - DNA, 25 bp, Homo sapien
gactatgagcaggtttgcggcatgt

SEQ ID NO: 628546 - DNA, 25 bp, Homo sapien
gggtgaggcaaaactccctcatcag

SEQ ID NO: 628547 - DNA, 25 bp, Homo sapien
cctcatcagacttgccatcaggata

SEQ ID NO: 628548 - DNA, 25 bp, Homo sapien
taatacctagttgacttggcccaaa

SEQ ID NO: 628549 - DNA, 25 bp, Homo sapien
gttgacttggcccaaactcattcac

SEQ ID NO: 628550 - DNA, 25 bp, Homo sapien
cccaactgacccctatacaatagaa

SEQ ID NO: 628551 - DNA, 25 bp, Homo sapien
agcattgctggtttggtgaggttaa

SEQ ID NO: 628552 - DNA, 25 bp, Homo sapien
gaggtgctggtcattgtaaaactac

SEQ ID NO: 628553 - DNA, 25 bp, Homo sapien
gaaatttggagtactcttgccatct

SEQ ID NO: 628554 - DNA, 25 bp, Homo sapien
gaaagcacagttcctattatttgtt

SEQ ID NO: 628555 - DNA, 25 bp, Homo sapien
cacagttcctattatttgttctgaa

SEQ ID NO: 628556 - DNA, 25 bp, Homo sapien
tgttctgaatttagtgagcttgatc

SEQ ID NO: 628557 - DNA, 25 bp, Homo sapien
tttcctgtaggaaaagtcactggag

SEQ ID NO: 628558 - DNA, 25 bp, Homo sapien
aagtcactggagtgtactcatataa

SEQ ID NO: 628559 - DNA, 25 bp, Homo sapien
aaatcatgttgcatgttgacatcaa

SEQ ID NO: 628560 - DNA, 25 bp, Homo sapien
atgttgacatcaaattttagcccaa

SEQ ID NO: 628561 - DNA, 25 bp, Homo sapien
aaattttagcccaatcatattacta

SEQ ID NO: 628562 - DNA, 25 bp, Homo sapien
atattactaatactcggccaaactg

SEQ ID NO: 628563 - DNA, 25 bp, Homo sapien
tcggccaaactgacgattgccaaag

SEQ ID NO: 628564 - DNA, 25 bp, Homo sapien
tgacgattgccaaagcaattcacat

SEQ ID NO: 628565 - DNA, 25 bp, Homo sapien
attgttcgtcttaatggctgcacag

SEQ ID NO: 628566 - DNA, 25 bp, Homo sapien
atggctgcacagtattccactgtat

SEQ ID NO: 628567 - DNA, 25 bp, Homo sapien
tttggttgccggtactgttatcagc

SEQ ID NO: 628568 - DNA, 25 bp, Homo sapien
tatcagccagggaatttgcgaggac

SEQ ID NO: 628569 - DNA, 25 bp, Homo sapien
gaatttgcgaggacccagcgggatt

SEQ ID NO: 628570 - DNA, 25 bp, Homo sapien
aggacccagcgggatttatggagct

SEQ ID NO: 628571 - DNA, 25 bp, Homo sapien
cagatctgtccagaattctgttgtc

SEQ ID NO: 628572 - DNA, 25 bp, Homo sapien
aattctgttgtctcgggtatcatct

SEQ ID NO: 628573 - DNA, 25 bp, Homo sapien
gtgcagacaggaccagccccagtgt

SEQ ID NO: 628574 - DNA, 25 bp, Homo sapien
gccccagtgtccgagcgagaatcag

SEQ ID NO: 628575 - DNA, 25 bp, Homo sapien
gagaatcagcgagcagcacgcgcag

SEQ ID NO: 628576 - DNA, 25 bp, Homo sapien
cagttaagcggaaatccattcaggt

SEQ ID NO: 628577 - DNA, 25 bp, Homo sapien
tacccaaggtcacttatcagccaat

SEQ ID NO: 628578 - DNA, 25 bp, Homo sapien
tactcaatcatttttgttcgcaagt

SEQ ID NO: 628579 - DNA, 25 bp, Homo sapien
tttgttcgcaagtattagttattat

SEQ ID NO: 628580 - DNA, 25 bp, Homo sapien
ttcacattagcaaaactagccttaa

SEQ ID NO: 628581 - DNA, 25 bp, Homo sapien
gcaaaactagccttaaaactgtttg

SEQ ID NO: 628582 - DNA, 25 bp, Homo sapien
aaggtaactcagaagccagaagata

SEQ ID NO: 628583 - DNA, 25 bp, Homo sapien
atattctgattggacctattgctgc

SEQ ID NO: 628584 - DNA, 25 bp, Homo sapien
tctgattggacctattgctgcaatg

SEQ ID NO: 628585 - DNA, 25 bp, Homo sapien
gcaatgaatggcaagctggtacagt

SEQ ID NO: 628586 - DNA, 25 bp, Homo sapien
gcaagctggtacagttaagcggaaa

SEQ ID NO: 628587 - DNA, 25 bp, Homo sapien
ctttgaaaaacaagggagctatata

SEQ ID NO: 628588 - DNA, 25 bp, Homo sapien
tttgaaaaacaagggagctatatat

SEQ ID NO: 628589 - DNA, 25 bp, Homo sapien
gaaaaacaagggagctatatataag

SEQ ID NO: 628590 - DNA, 25 bp, Homo sapien
aaaaacaagggagctatatataaga

SEQ ID NO: 628591 - DNA, 25 bp, Homo sapien
aaaacaagggagctatatataagaa

SEQ ID NO: 628592 - DNA, 25 bp, Homo sapien
aaacaagggagctatatataagaat

SEQ ID NO: 628593 - DNA, 25 bp, Homo sapien
aacaagggagctatatataagaata

SEQ ID NO: 628594 - DNA, 25 bp, Homo sapien
gaatatataagagctggctcacacc

SEQ ID NO: 628595 - DNA, 25 bp, Homo sapien
aatatataagagctggctcacacct

SEQ ID NO: 628596 - DNA, 25 bp, Homo sapien
atatataagagctggctcacacctg

SEQ ID NO: 628597 - DNA, 25 bp, Homo sapien
gactgttccataaagttgatggctt

SEQ ID NO: 628598 - DNA, 25 bp, Homo sapien
ctactttgcccttttaacagcttca

SEQ ID NO: 628599 - DNA, 25 bp, Homo sapien
aaatgcttgggcactactcttcgaa

SEQ ID NO: 628600 - DNA, 25 bp, Homo sapien
gggcactactcttcgaatgactgaa

SEQ ID NO: 628601 - DNA, 25 bp, Homo sapien
actatttgcttccagcgtttggtac

SEQ ID NO: 628602 - DNA, 25 bp, Homo sapien
cagcgtttggtactcttactttgga

SEQ ID NO: 628603 - DNA, 25 bp, Homo sapien
ggagaacaagtcattacagtaaacc

SEQ ID NO: 628604 - DNA, 25 bp, Homo sapien
agtaaaccatgtacacctattcggt

SEQ ID NO: 628605 - DNA, 25 bp, Homo sapien
tattcggttttctaaagctcgcgtt

SEQ ID NO: 628606 - DNA, 25 bp, Homo sapien
agctcgcgtttttcacattatcagg

SEQ ID NO: 628607 - DNA, 25 bp, Homo sapien
gtaagtaccgaatgcactgccttta

SEQ ID NO: 628608 - DNA, 25 bp, Homo sapien
aaaccctcaagattttcagactcat

SEQ ID NO: 628609 - DNA, 25 bp, Homo sapien
gactcatttagtctaacacaagaga

SEQ ID NO: 628610 - DNA, 25 bp, Homo sapien
tcacaacccctctattttcagtaaa

SEQ ID NO: 628611 - DNA, 25 bp, Homo sapien
ggcaaaggcacattgggcatcctca

SEQ ID NO: 628612 - DNA, 25 bp, Homo sapien
ggcatcctcaggtggatcgaaactt

SEQ ID NO: 628613 - DNA, 25 bp, Homo sapien
aggtggatcgaaacttgctgttatc

SEQ ID NO: 628614 - DNA, 25 bp, Homo sapien
gatcgaaacttgctgttatcaaaca

SEQ ID NO: 628615 - DNA, 25 bp, Homo sapien
agataccaactatagagcttgtaag

SEQ ID NO: 628616 - DNA, 25 bp, Homo sapien
gaactggtaacaggcaactgagaaa

SEQ ID NO: 628617 - DNA, 25 bp, Homo sapien
gcaaggtacatgttgaggcatctca

SEQ ID NO: 628618 - DNA, 25 bp, Homo sapien
tgttgaggcatctcagttgtcccct

SEQ ID NO: 628619 - DNA, 25 bp, Homo sapien
acgccccgccagtgtatattttcta

SEQ ID NO: 628620 - DNA, 25 bp, Homo sapien
gccccgccagtgtatattttctaaa

SEQ ID NO: 628621 - DNA, 25 bp, Homo sapien
gccagtgtatattttctaaaaacaa

SEQ ID NO: 628622 - DNA, 25 bp, Homo sapien
tctctttcataaccacaattataaa

SEQ ID NO: 628623 - DNA, 25 bp, Homo sapien
aatattttctaacctacagacctca

SEQ ID NO: 628624 - DNA, 25 bp, Homo sapien
ttttctaacctacagacctcatttg

SEQ ID NO: 628625 - DNA, 25 bp, Homo sapien
ctaacctacagacctcatttgaatt

SEQ ID NO: 628626 - DNA, 25 bp, Homo sapien
aacctacagacctcatttgaatttg

SEQ ID NO: 628627 - DNA, 25 bp, Homo sapien
tacagacctcatttgaatttgctca

SEQ ID NO: 628628 - DNA, 25 bp, Homo sapien
cagacctcatttgaatttgctcaaa

SEQ ID NO: 628629 - DNA, 25 bp, Homo sapien
tttgctcaaatgttccaataatgtc

SEQ ID NO: 628630 - DNA, 25 bp, Homo sapien
taggtttttccaagttttctcagag

SEQ ID NO: 628631 - DNA, 25 bp, Homo sapien
tttttccaagttttctcagagccca

SEQ ID NO: 628632 - DNA, 25 bp, Homo sapien
tcagagcccaaagtctaggtcttga

SEQ ID NO: 628633 - DNA, 25 bp, Homo sapien
cagagcccaaagtctaggtcttgaa

SEQ ID NO: 628634 - DNA, 25 bp, Homo sapien
agagcccaaagtctaggtcttgaac

SEQ ID NO: 628635 - DNA, 25 bp, Homo sapien
gagcccaaagtctaggtcttgaact

SEQ ID NO: 628636 - DNA, 25 bp, Homo sapien
agcccaaagtctaggtcttgaactc

SEQ ID NO: 628637 - DNA, 25 bp, Homo sapien
gcccaaagtctaggtcttgaactca

SEQ ID NO: 628638 - DNA, 25 bp, Homo sapien
cccaaagtctaggtcttgaactcat

SEQ ID NO: 628639 - DNA, 25 bp, Homo sapien
aatgaataaggtgggatgcggtggc

SEQ ID NO: 628640 - DNA, 25 bp, Homo sapien
tgaataaggtgggatgcggtggctc

SEQ ID NO: 628641 - DNA, 25 bp, Homo sapien
atcatcacatcttcaatatcccttt

SEQ ID NO: 628642 - DNA, 25 bp, Homo sapien
aatatccctttaccatagccacagg

SEQ ID NO: 628643 - DNA, 25 bp, Homo sapien
ctccagagactcagccataaacatc

SEQ ID NO: 628644 - DNA, 25 bp, Homo sapien
gactcagccataaacatctttggac

SEQ ID NO: 628645 - DNA, 25 bp, Homo sapien
aacatcattattcaacctaccacat

SEQ ID NO: 628646 - DNA, 25 bp, Homo sapien
ttcaacctaccacatagaccttttt

SEQ ID NO: 628647 - DNA, 25 bp, Homo sapien
taccacatagacctttttctttaat

SEQ ID NO: 628648 - DNA, 25 bp, Homo sapien
acatgaggtactttaatacaggcat

SEQ ID NO: 628649 - DNA, 25 bp, Homo sapien
atgcttaataatcccattagggtaa

SEQ ID NO: 628650 - DNA, 25 bp, Homo sapien
gggtagccatcatctcaagaatttg

SEQ ID NO: 628651 - DNA, 25 bp, Homo sapien
caagaatttgtccttactttagtgt

SEQ ID NO: 628652 - DNA, 25 bp, Homo sapien
ggtcacatttatcttgaaagccgag

SEQ ID NO: 628653 - DNA, 25 bp, Homo sapien
ccgaggtagggtaccatgtgtgctc

SEQ ID NO: 628654 - DNA, 25 bp, Homo sapien
gcaacatggttgaccttcatagtga

SEQ ID NO: 628655 - DNA, 25 bp, Homo sapien
ttcatgctcaaatgtccaagccctg

SEQ ID NO: 628656 - DNA, 25 bp, Homo sapien
agccctgcatttctgataccatgga

SEQ ID NO: 628657 - DNA, 25 bp, Homo sapien
ataccatggaatcacaagcacgctg

SEQ ID NO: 628658 - DNA, 25 bp, Homo sapien
gcacgctgtgtgatactgtgcagca

SEQ ID NO: 628659 - DNA, 25 bp, Homo sapien
tgtgcagcatttgatcctgcctgac

SEQ ID NO: 628660 - DNA, 25 bp, Homo sapien
tgtgtctcagcctatcaacgaagat

SEQ ID NO: 628661 - DNA, 25 bp, Homo sapien
gatatttatagctgccttatgccaa

SEQ ID NO: 628662 - DNA, 25 bp, Homo sapien
ctgccttatgccaacgtacttttta

SEQ ID NO: 628663 - DNA, 25 bp, Homo sapien
gacaagcctttgtgcgtcgagatga

SEQ ID NO: 628664 - DNA, 25 bp, Homo sapien
gtttacctgggtccctaagcagtct

SEQ ID NO: 628665 - DNA, 25 bp, Homo sapien
taagcagtcttagtgacccctcttt

SEQ ID NO: 628666 - DNA, 25 bp, Homo sapien
agtgacccctcttttatcacaaagc

SEQ ID NO: 628667 - DNA, 25 bp, Homo sapien
ctgccacgaactctgtttacaaaga

SEQ ID NO: 628668 - DNA, 25 bp, Homo sapien
tttacaaagacctctcttgcacttg

SEQ ID NO: 628669 - DNA, 25 bp, Homo sapien
gacctctcttgcacttgaatttgac

SEQ ID NO: 628670 - DNA, 25 bp, Homo sapien
gaagctgttgcttagactgtctcct

SEQ ID NO: 628671 - DNA, 25 bp, Homo sapien
aatgtcactctcaattacccactta

SEQ ID NO: 628672 - DNA, 25 bp, Homo sapien
tcaattacccacttaaatctgcagg

SEQ ID NO: 628673 - DNA, 25 bp, Homo sapien
gcagggaatggcttccaagaatcca

SEQ ID NO: 628674 - DNA, 25 bp, Homo sapien
tacagacttaaagacacaacggttg

SEQ ID NO: 628675 - DNA, 25 bp, Homo sapien
acagacttaaagacacaacggttgg

SEQ ID NO: 628676 - DNA, 25 bp, Homo sapien
cagacttaaagacacaacggttggc

SEQ ID NO: 628677 - DNA, 25 bp, Homo sapien
gacttaaagacacaacggttggcca

SEQ ID NO: 628678 - DNA, 25 bp, Homo sapien
acttaaagacacaacggttggccag

SEQ ID NO: 628679 - DNA, 25 bp, Homo sapien
ttaaagacacaacggttggccaggc

SEQ ID NO: 628680 - DNA, 25 bp, Homo sapien
aaagacacaacggttggccaggcac

SEQ ID NO: 628681 - DNA, 25 bp, Homo sapien
aagacacaacggttggccaggcaca

SEQ ID NO: 628682 - DNA, 25 bp, Homo sapien
ccagcctcggcaacggagacattgt

SEQ ID NO: 628683 - DNA, 25 bp, Homo sapien
cagcctcggcaacggagacattgtc

SEQ ID NO: 628684 - DNA, 25 bp, Homo sapien
agcctcggcaacggagacattgtct

SEQ ID NO: 628685 - DNA, 25 bp, Homo sapien
atccccatttgccatagttagagtg

SEQ ID NO: 628686 - DNA, 25 bp, Homo sapien
ccatagttagagtgggcacattcca

SEQ ID NO: 628687 - DNA, 25 bp, Homo sapien
tagagtgggcacattccacaagcca

SEQ ID NO: 628688 - DNA, 25 bp, Homo sapien
ggcacattccacaagccaggtaata

SEQ ID NO: 628689 - DNA, 25 bp, Homo sapien
attccacaagccaggtaataaatgc

SEQ ID NO: 628690 - DNA, 25 bp, Homo sapien
ggtaataaatgcagtcctgggttca

SEQ ID NO: 628691 - DNA, 25 bp, Homo sapien
aaatgcagtcctgggttcaacacca

SEQ ID NO: 628692 - DNA, 25 bp, Homo sapien
gcagtcctgggttcaacaccagctt

SEQ ID NO: 628693 - DNA, 25 bp, Homo sapien
gggcaacgtagggagtcctcgactc

SEQ ID NO: 628694 - DNA, 25 bp, Homo sapien
aacgtagggagtcctcgactctaca

SEQ ID NO: 628695 - DNA, 25 bp, Homo sapien
cgtagggagtcctcgactctacaaa

SEQ ID NO: 628696 - DNA, 25 bp, Homo sapien
aatatttgttctaagaatccacata

SEQ ID NO: 628697 - DNA, 25 bp, Homo sapien
tttgttctaagaatccacataaaaa

SEQ ID NO: 628698 - DNA, 25 bp, Homo sapien
ttctaagaatccacataaaaacaca

SEQ ID NO: 628699 - DNA, 25 bp, Homo sapien
gaatccacataaaaacacaaaagcc

SEQ ID NO: 628700 - DNA, 25 bp, Homo sapien
aaacacaaaagccatcttacatata

SEQ ID NO: 628701 - DNA, 25 bp, Homo sapien
acaaaagccatcttacatataacat

SEQ ID NO: 628702 - DNA, 25 bp, Homo sapien
aaaagccatcttacatataacatta

SEQ ID NO: 628703 - DNA, 25 bp, Homo sapien
aaagccatcttacatataacattaa

SEQ ID NO: 628704 - DNA, 25 bp, Homo sapien
agccatcttacatataacattaaat

SEQ ID NO: 628705 - DNA, 25 bp, Homo sapien
acattaaatgttctttgggaggccg

SEQ ID NO: 628706 - DNA, 25 bp, Homo sapien
cattaaatgttctttgggaggccga

SEQ ID NO: 628707 - DNA, 25 bp, Homo sapien
gaagatgaaactcagatctgtataa

SEQ ID NO: 628708 - DNA, 25 bp, Homo sapien
aactcagatctgtataaagtatttc

SEQ ID NO: 628709 - DNA, 25 bp, Homo sapien
aaccaaagagttgtgcttaatccag

SEQ ID NO: 628710 - DNA, 25 bp, Homo sapien
agagttgtgcttaatccagccacct

SEQ ID NO: 628711 - DNA, 25 bp, Homo sapien
ttgtgcttaatccagccacctgtaa

SEQ ID NO: 628712 - DNA, 25 bp, Homo sapien
gcttaatccagccacctgtaactaa

SEQ ID NO: 628713 - DNA, 25 bp, Homo sapien
tccagccacctgtaactaaatttct

SEQ ID NO: 628714 - DNA, 25 bp, Homo sapien
gccacctgtaactaaatttctgtct

SEQ ID NO: 628715 - DNA, 25 bp, Homo sapien
ctgtaactaaatttctgtctctata

SEQ ID NO: 628716 - DNA, 25 bp, Homo sapien
ttctgtctctatagtgtctcggaaa

SEQ ID NO: 628717 - DNA, 25 bp, Homo sapien
gtctctatagtgtctcggaaaaaag

SEQ ID NO: 628718 - DNA, 25 bp, Homo sapien
atgttaggcgagtgcccaatttcaa

SEQ ID NO: 628719 - DNA, 25 bp, Homo sapien
gagtgcccaatttcaaatactgttt

SEQ ID NO: 628720 - DNA, 25 bp, Homo sapien
ttctttggttgtagttcccatgctc

SEQ ID NO: 628721 - DNA, 25 bp, Homo sapien
tgtagttcccatgctccatatgcag

SEQ ID NO: 628722 - DNA, 25 bp, Homo sapien
atgctccatatgcagctttactgta

SEQ ID NO: 628723 - DNA, 25 bp, Homo sapien
tatgcagctttactgtagttcacag

SEQ ID NO: 628724 - DNA, 25 bp, Homo sapien
aaggtatcacctggacattgaaaac

SEQ ID NO: 628725 - DNA, 25 bp, Homo sapien
acctggacattgaaaactcaccaaa

SEQ ID NO: 628726 - DNA, 25 bp, Homo sapien
ctcaccaaaatccagccagtacatt

SEQ ID NO: 628727 - DNA, 25 bp, Homo sapien
cagtacatttaattgggcttagagt

SEQ ID NO: 628728 - DNA, 25 bp, Homo sapien
gggcttagagtgaaaccatttgggt

SEQ ID NO: 628729 - DNA, 25 bp, Homo sapien
tagatttcagttcacctctgtggat

SEQ ID NO: 628730 - DNA, 25 bp, Homo sapien
agatttcagttcacctctgtggatc

SEQ ID NO: 628731 - DNA, 25 bp, Homo sapien
gatttcagttcacctctgtggatct

SEQ ID NO: 628732 - DNA, 25 bp, Homo sapien
atttcagttcacctctgtggatctg

SEQ ID NO: 628733 - DNA, 25 bp, Homo sapien
tttcagttcacctctgtggatctgt

SEQ ID NO: 628734 - DNA, 25 bp, Homo sapien
cagtttcaaaaacgtagaaagcacg

SEQ ID NO: 628735 - DNA, 25 bp, Homo sapien
ttcaaaaacgtagaaagcacgggca

SEQ ID NO: 628736 - DNA, 25 bp, Homo sapien
tcaaaaacgtagaaagcacgggcat

SEQ ID NO: 628737 - DNA, 25 bp, Homo sapien
tacagacttaaagacacaacggttg

SEQ ID NO: 628738 - DNA, 25 bp, Homo sapien
acagacttaaagacacaacggttgg

SEQ ID NO: 628739 - DNA, 25 bp, Homo sapien
cagacttaaagacacaacggttggc

SEQ ID NO: 628740 - DNA, 25 bp, Homo sapien
gacttaaagacacaacggttggcca

SEQ ID NO: 628741 - DNA, 25 bp, Homo sapien
ttaaagacacaacggttggccaggc

SEQ ID NO: 628742 - DNA, 25 bp, Homo sapien
aaagacacaacggttggccaggcac

SEQ ID NO: 628743 - DNA, 25 bp, Homo sapien
aagacacaacggttggccaggcaca

SEQ ID NO: 628744 - DNA, 25 bp, Homo sapien
agacacaacggttggccaggcacag

SEQ ID NO: 628745 - DNA, 25 bp, Homo sapien
ccagcctcggcaacggagacattgt

SEQ ID NO: 628746 - DNA, 25 bp, Homo sapien
cagcctcggcaacggagacattgtc

SEQ ID NO: 628747 - DNA, 25 bp, Homo sapien
agcctcggcaacggagacattgtct

SEQ ID NO: 628748 - DNA, 25 bp, Homo sapien
gaaattcaacatgccactggctgca

SEQ ID NO: 628749 - DNA, 25 bp, Homo sapien
aattcaacatgccactggctgcagt

SEQ ID NO: 628750 - DNA, 25 bp, Homo sapien
attcaacatgccactggctgcagtg

SEQ ID NO: 628751 - DNA, 25 bp, Homo sapien
ttcaacatgccactggctgcagtgt

SEQ ID NO: 628752 - DNA, 25 bp, Homo sapien
tcaacatgccactggctgcagtgtc

SEQ ID NO: 628753 - DNA, 25 bp, Homo sapien
caacatgccactggctgcagtgtct

SEQ ID NO: 628754 - DNA, 25 bp, Homo sapien
acatgccactggctgcagtgtctca

SEQ ID NO: 628755 - DNA, 25 bp, Homo sapien
catgccactggctgcagtgtctcat

SEQ ID NO: 628756 - DNA, 25 bp, Homo sapien
atgccactggctgcagtgtctcatg

SEQ ID NO: 628757 - DNA, 25 bp, Homo sapien
tgccactggctgcagtgtctcatgc

SEQ ID NO: 628758 - DNA, 25 bp, Homo sapien
gccactggctgcagtgtctcatgcc

SEQ ID NO: 628759 - DNA, 25 bp, Homo sapien
gttttgctctgtttggcatgtgttt

SEQ ID NO: 628760 - DNA, 25 bp, Homo sapien
ttggcatgtgttttcctgcatcact

SEQ ID NO: 628761 - DNA, 25 bp, Homo sapien
tgcatcactgcatttccgagtctta

SEQ ID NO: 628762 - DNA, 25 bp, Homo sapien
aaagttcatgtcacatcacctcctg

SEQ ID NO: 628763 - DNA, 25 bp, Homo sapien
tgcaagaacattctctgatcctctc

SEQ ID NO: 628764 - DNA, 25 bp, Homo sapien
tgatcctctcctgcgtgcataatca

SEQ ID NO: 628765 - DNA, 25 bp, Homo sapien
gtgcataatcactccctcttttgga

SEQ ID NO: 628766 - DNA, 25 bp, Homo sapien
ttttggactcctgcaaccctgtgtg

SEQ ID NO: 628767 - DNA, 25 bp, Homo sapien
gtgccactctttcgcactgagtaaa

SEQ ID NO: 628768 - DNA, 25 bp, Homo sapien
agaaccactgtcttctccgttcatt

SEQ ID NO: 628769 - DNA, 25 bp, Homo sapien
cacttggttctacttctgggttttg

SEQ ID NO: 628770 - DNA, 25 bp, Homo sapien
tagaatctggcacaaacaaaacctg

SEQ ID NO: 628771 - DNA, 25 bp, Homo sapien
acctgaatctgggttgtgaactttc

SEQ ID NO: 628772 - DNA, 25 bp, Homo sapien
tgggttgtgaactttcaccacccgc

SEQ ID NO: 628773 - DNA, 25 bp, Homo sapien
cacccgccgcaactctttgataaaa

SEQ ID NO: 628774 - DNA, 25 bp, Homo sapien
gccgcaactctttgataaaacctca

SEQ ID NO: 628775 - DNA, 25 bp, Homo sapien
aacctcaagtgatatctattaccat

SEQ ID NO: 628776 - DNA, 25 bp, Homo sapien
aagtgatatctattaccattgtaaa

SEQ ID NO: 628777 - DNA, 25 bp, Homo sapien
taaaaataaagcctgcccctatgct

SEQ ID NO: 628778 - DNA, 25 bp, Homo sapien
aagcctgcccctatgcttagaatgg

SEQ ID NO: 628779 - DNA, 25 bp, Homo sapien
gcccctatgcttagaatgggagcga

SEQ ID NO: 628780 - DNA, 25 bp, Homo sapien
gaagtgggcagtaaatacaggtttt

SEQ ID NO: 628781 - DNA, 25 bp, Homo sapien
agcacaacttgagctacagtaaact

SEQ ID NO: 628782 - DNA, 25 bp, Homo sapien
gcacaacttgagctacagtaaacta

SEQ ID NO: 628783 - DNA, 25 bp, Homo sapien
caacttgagctacagtaaactacat

SEQ ID NO: 628784 - DNA, 25 bp, Homo sapien
cagtaaactacatgacagtgttttg

SEQ ID NO: 628785 - DNA, 25 bp, Homo sapien
tgttgtataaatcggtatagctcct

SEQ ID NO: 628786 - DNA, 25 bp, Homo sapien
tgtataaatcggtatagctcctctg

SEQ ID NO: 628787 - DNA, 25 bp, Homo sapien
gtataaatcggtatagctcctctgt

SEQ ID NO: 628788 - DNA, 25 bp, Homo sapien
tataaatcggtatagctcctctgtc

SEQ ID NO: 628789 - DNA, 25 bp, Homo sapien
ataaatcggtatagctcctctgtca

SEQ ID NO: 628790 - DNA, 25 bp, Homo sapien
taaatcggtatagctcctctgtcac

SEQ ID NO: 628791 - DNA, 25 bp, Homo sapien
aaatcggtatagctcctctgtcact

SEQ ID NO: 628792 - DNA, 25 bp, Homo sapien
aatatttgttctaagaatccacata

SEQ ID NO: 628793 - DNA, 25 bp, Homo sapien
tttgttctaagaatccacataaaaa

SEQ ID NO: 628794 - DNA, 25 bp, Homo sapien
ttctaagaatccacataaaaacaca

SEQ ID NO: 628795 - DNA, 25 bp, Homo sapien
gaatccacataaaaacacaaaagcc

SEQ ID NO: 628796 - DNA, 25 bp, Homo sapien
aaacacaaaagccatcttacatata

SEQ ID NO: 628797 - DNA, 25 bp, Homo sapien
acacaaaagccatcttacatataac

SEQ ID NO: 628798 - DNA, 25 bp, Homo sapien
acaaaagccatcttacatataacat

SEQ ID NO: 628799 - DNA, 25 bp, Homo sapien
aaaagccatcttacatataacatta

SEQ ID NO: 628800 - DNA, 25 bp, Homo sapien
aaagccatcttacatataacattaa

SEQ ID NO: 628801 - DNA, 25 bp, Homo sapien
agccatcttacatataacattaaat

SEQ ID NO: 628802 - DNA, 25 bp, Homo sapien
acattaaatgttctttgggaggccg

SEQ ID NO: 628803 - DNA, 25 bp, Homo sapien
accagaggcacaacgtgggccagct

SEQ ID NO: 628804 - DNA, 25 bp, Homo sapien
acaacgtgggccagctttcttacct

SEQ ID NO: 628805 - DNA, 25 bp, Homo sapien
gggagccttgccttgaggtctacac

SEQ ID NO: 628806 - DNA, 25 bp, Homo sapien
tgaggtctacacctgctctggacag

SEQ ID NO: 628807 - DNA, 25 bp, Homo sapien
ctgctctggacaggtgacaggagct

SEQ ID NO: 628808 - DNA, 25 bp, Homo sapien
agctgcagagcatctccatgtcgtg

SEQ ID NO: 628809 - DNA, 25 bp, Homo sapien
agcatctccatgtcgtgactgcctt

SEQ ID NO: 628810 - DNA, 25 bp, Homo sapien
ggataaccctgggatttgggacaga

SEQ ID NO: 628811 - DNA, 25 bp, Homo sapien
tgcctcgtggctgctctgcttttat

SEQ ID NO: 628812 - DNA, 25 bp, Homo sapien
gctgctctgcttttatctggcagaa

SEQ ID NO: 628813 - DNA, 25 bp, Homo sapien
gagccaccagctgaacaaatacaca

SEQ ID NO: 628814 - DNA, 25 bp, Homo sapien
ataggtccgcgaagctgcctgtcat

SEQ ID NO: 628815 - DNA, 25 bp, Homo sapien
tgcctgtcatctcgcataggtggag

SEQ ID NO: 628816 - DNA, 25 bp, Homo sapien
aatggcgtgcacagacggagctcta

SEQ ID NO: 628817 - DNA, 25 bp, Homo sapien
cacagacggagctctagttggcgcg

SEQ ID NO: 628818 - DNA, 25 bp, Homo sapien
aacggagacgctggcggtacagcct

SEQ ID NO: 628819 - DNA, 25 bp, Homo sapien
ggtacagcctcgagcgaaacctttc

SEQ ID NO: 628820 - DNA, 25 bp, Homo sapien
gagcgaaacctttccctacacgagg

SEQ ID NO: 628821 - DNA, 25 bp, Homo sapien
tcctctcctgaagagctctagactt

SEQ ID NO: 628822 - DNA, 25 bp, Homo sapien
tctagacttccccatttacaacaaa

SEQ ID NO: 628823 - DNA, 25 bp, Homo sapien
gggatgtatgttccttacaccttga

SEQ ID NO: 628824 - DNA, 25 bp, Homo sapien
ttacaccttgattccatacacacgt

SEQ ID NO: 628825 - DNA, 25 bp, Homo sapien
aaccctatgcatgtacagtatgtgg

SEQ ID NO: 628826 - DNA, 25 bp, Homo sapien
atcaaacctcactgaacatgagaaa

SEQ ID NO: 628827 - DNA, 25 bp, Homo sapien
accttatcattgtaatcaatgtggg

SEQ ID NO: 628828 - DNA, 25 bp, Homo sapien
gaaagctttcagtcagagacaaaat

SEQ ID NO: 628829 - DNA, 25 bp, Homo sapien
agctttcagtcagagacaaaatctt

SEQ ID NO: 628830 - DNA, 25 bp, Homo sapien
gaatctcatccctcactcttcatgt

SEQ ID NO: 628831 - DNA, 25 bp, Homo sapien
aatctcatccctcactcttcatgtg

SEQ ID NO: 628832 - DNA, 25 bp, Homo sapien
atctcatccctcactcttcatgtga

SEQ ID NO: 628833 - DNA, 25 bp, Homo sapien
tctcatccctcactcttcatgtgag

SEQ ID NO: 628834 - DNA, 25 bp, Homo sapien
tcatccctcactcttcatgtgagaa

SEQ ID NO: 628835 - DNA, 25 bp, Homo sapien
catccctcactcttcatgtgagaag

SEQ ID NO: 628836 - DNA, 25 bp, Homo sapien
tttaatcaaagtgcaccattcttgt

SEQ ID NO: 628837 - DNA, 25 bp, Homo sapien
gcaccattcttgtttcatatggcct

SEQ ID NO: 628838 - DNA, 25 bp, Homo sapien
ggcctgtggcacaatttatttaaaa

SEQ ID NO: 628839 - DNA, 25 bp, Homo sapien
aaaacacatggcctcagtaccttca

SEQ ID NO: 628840 - DNA, 25 bp, Homo sapien
gtaccttcatgaaatgggacttcaa

SEQ ID NO: 628841 - DNA, 25 bp, Homo sapien
tgggacttcaatatacatatttctt

SEQ ID NO: 628842 - DNA, 25 bp, Homo sapien
tacagctttatgcatgacttcattg

SEQ ID NO: 628843 - DNA, 25 bp, Homo sapien
cacttcactgctctgttgtgtcact

SEQ ID NO: 628844 - DNA, 25 bp, Homo sapien
gctctgttgtgtcactctaccaata

SEQ ID NO: 628845 - DNA, 25 bp, Homo sapien
ataaacctatacatcatactgagtg

SEQ ID NO: 628846 - DNA, 25 bp, Homo sapien
tgaagtatgttcacagtccctttac

SEQ ID NO: 628847 - DNA, 25 bp, Homo sapien
ctcatccccaaggacatgaaaacaa

SEQ ID NO: 628848 - DNA, 25 bp, Homo sapien
gagaattctatccattttgaaccct

SEQ ID NO: 628849 - DNA, 25 bp, Homo sapien
tatccattttgaaccctgtaactaa

SEQ ID NO: 628850 - DNA, 25 bp, Homo sapien
gtaactaacagtgaaatcaaccagg

SEQ ID NO: 628851 - DNA, 25 bp, Homo sapien
aatccttcatgatttcatctacttt

SEQ ID NO: 628852 - DNA, 25 bp, Homo sapien
atttcatctacttttcatttcatgg

SEQ ID NO: 628853 - DNA, 25 bp, Homo sapien
tttcatttcatggtatggatgctat

SEQ ID NO: 628854 - DNA, 25 bp, Homo sapien
ggatgctatataccactaaaaatta

SEQ ID NO: 628855 - DNA, 25 bp, Homo sapien
aaattagtactttagctggctgcag

SEQ ID NO: 628856 - DNA, 25 bp, Homo sapien
tgactcttgcctgtgatctcaccta

SEQ ID NO: 628857 - DNA, 25 bp, Homo sapien
ttgcctgtgatctcacctatttggg

SEQ ID NO: 628858 - DNA, 25 bp, Homo sapien
aagttaatatctttattccatctaa

SEQ ID NO: 628859 - DNA, 25 bp, Homo sapien
attccatctaaagtggtatgtgtac

SEQ ID NO: 628860 - DNA, 25 bp, Homo sapien
tggtatgtgtactattctttggaaa

SEQ ID NO: 628861 - DNA, 25 bp, Homo sapien
atgtgtactattctttggaaatgat

SEQ ID NO: 628862 - DNA, 25 bp, Homo sapien
aaggattaaaaacttgccagtgttg

SEQ ID NO: 628863 - DNA, 25 bp, Homo sapien
gattaaaaacttgccagtgttggaa

SEQ ID NO: 628864 - DNA, 25 bp, Homo sapien
gacatgaaatagatctgtctctaat

SEQ ID NO: 628865 - DNA, 25 bp, Homo sapien
gatctgtctctaattagaggtgcaa

SEQ ID NO: 628866 - DNA, 25 bp, Homo sapien
tctctaattagaggtgcaatgtcaa

SEQ ID NO: 628867 - DNA, 25 bp, Homo sapien
ttagaggtgcaatgtcaaatttttt

SEQ ID NO: 628868 - DNA, 25 bp, Homo sapien
agatcgttctaaaaatatcacttgt

SEQ ID NO: 628869 - DNA, 25 bp, Homo sapien
tagacagagacagaaaagccagtga

SEQ ID NO: 628870 - DNA, 25 bp, Homo sapien
agccagtgaaagacagacagagatg

SEQ ID NO: 628871 - DNA, 25 bp, Homo sapien
gaaagacagacagagatggagaaat

SEQ ID NO: 628872 - DNA, 25 bp, Homo sapien
aatagagagagaggcaaacatagag

SEQ ID NO: 628873 - DNA, 25 bp, Homo sapien
agggagagggacagagaccaacaga

SEQ ID NO: 628874 - DNA, 25 bp, Homo sapien
gacagagacagagtcacaacaggag

SEQ ID NO: 628875 - DNA, 25 bp, Homo sapien
agagacagagtcacaacaggagaaa

SEQ ID NO: 628876 - DNA, 25 bp, Homo sapien
gagacagagtcacaacaggagaaag

SEQ ID NO: 628877 - DNA, 25 bp, Homo sapien
aagacagagataaaagacactcaga

SEQ ID NO: 628878 - DNA, 25 bp, Homo sapien
cagagatggaacagagacaaacaga

SEQ ID NO: 628879 - DNA, 25 bp, Homo sapien
gcagatggagagacatacagagaca

SEQ ID NO: 628880 - DNA, 25 bp, Homo sapien
agtctcctgccccagtagctagggc

SEQ ID NO: 628881 - DNA, 25 bp, Homo sapien
gtctcctgccccagtagctagggct

SEQ ID NO: 628882 - DNA, 25 bp, Homo sapien
tagggctacaggtgcccatcactat

SEQ ID NO: 628883 - DNA, 25 bp, Homo sapien
aggtgcccatcactatgccaggcta

SEQ ID NO: 628884 - DNA, 25 bp, Homo sapien
taccacattggccagactaagcatt

SEQ ID NO: 628885 - DNA, 25 bp, Homo sapien
accacattggccagactaagcattt

SEQ ID NO: 628886 - DNA, 25 bp, Homo sapien
ccacattggccagactaagcatttt

SEQ ID NO: 628887 - DNA, 25 bp, Homo sapien
cacattggccagactaagcatttta

SEQ ID NO: 628888 - DNA, 25 bp, Homo sapien
cattggccagactaagcattttata

SEQ ID NO: 628889 - DNA, 25 bp, Homo sapien
ttgctctgtcagctaggaggttgca

SEQ ID NO: 628890 - DNA, 25 bp, Homo sapien
tctgtcagctaggaggttgcagtga

SEQ ID NO: 628891 - DNA, 25 bp, Homo sapien
aaatataaatccatgatgccgttac

SEQ ID NO: 628892 - DNA, 25 bp, Homo sapien
atgatgccgttactcaggggtagac

SEQ ID NO: 628893 - DNA, 25 bp, Homo sapien
gggtagacagactttctgtaaaagg

SEQ ID NO: 628894 - DNA, 25 bp, Homo sapien
aggccagataataaatctgctaggc

SEQ ID NO: 628895 - DNA, 25 bp, Homo sapien
ttgcaaaccatgtagggccttgttg

SEQ ID NO: 628896 - DNA, 25 bp, Homo sapien
catgtagggccttgttgcatacttt

SEQ ID NO: 628897 - DNA, 25 bp, Homo sapien
ggccttgttgcatacttttgttttt

SEQ ID NO: 628898 - DNA, 25 bp, Homo sapien
tcttagctcataggccgtataaaag

SEQ ID NO: 628899 - DNA, 25 bp, Homo sapien
aaaagcaggccagatgtgcagtaat

SEQ ID NO: 628900 - DNA, 25 bp, Homo sapien
atgtgcagtaatttgctgaccccag

SEQ ID NO: 628901 - DNA, 25 bp, Homo sapien
tgctgaccccaggatgttacccaat

SEQ ID NO: 628902 - DNA, 25 bp, Homo sapien
ataagagtcacgaaatccacaaaga

SEQ ID NO: 628903 - DNA, 25 bp, Homo sapien
aaagaagccagcgaagccaccactg

SEQ ID NO: 628904 - DNA, 25 bp, Homo sapien
actgctcaccttgaggagttccaaa

SEQ ID NO: 628905 - DNA, 25 bp, Homo sapien
aattctgcttggaagttctccatta

SEQ ID NO: 628906 - DNA, 25 bp, Homo sapien
ggaaattagatctacttcattgcat

SEQ ID NO: 628907 - DNA, 25 bp, Homo sapien
ctacttcattgcattgtatggagga

SEQ ID NO: 628908 - DNA, 25 bp, Homo sapien
gtcatccatggatactcttgctcaa

SEQ ID NO: 628909 - DNA, 25 bp, Homo sapien
atactcttgctcaaagtaactgctg

SEQ ID NO: 628910 - DNA, 25 bp, Homo sapien
aagcaggaggtactatagagagcaa

SEQ ID NO: 628911 - DNA, 25 bp, Homo sapien
aaaacccattctcagttctcaaatg

SEQ ID NO: 628912 - DNA, 25 bp, Homo sapien
ttctcaaatgttttaccagtcttta

SEQ ID NO: 628913 - DNA, 25 bp, Homo sapien
aatgccttgctaagggtggaccctt

SEQ ID NO: 628914 - DNA, 25 bp, Homo sapien
gggtggacccttgggcttggagcca

SEQ ID NO: 628915 - DNA, 25 bp, Homo sapien
ggcttggagccagcagtacaatagc

SEQ ID NO: 628916 - DNA, 25 bp, Homo sapien
gcagtacaatagctgtctggccgtc

SEQ ID NO: 628917 - DNA, 25 bp, Homo sapien
tctggccgtctcctgtgggcagaat

SEQ ID NO: 628918 - DNA, 25 bp, Homo sapien
ccctccaaaaggctatggactcctg

SEQ ID NO: 628919 - DNA, 25 bp, Homo sapien
caaaaggctatggactcctgagccc

SEQ ID NO: 628920 - DNA, 25 bp, Homo sapien
ggcagtgtgggttcaggctccctga

SEQ ID NO: 628921 - DNA, 25 bp, Homo sapien
tgtccctgcccggtactttgtcaga

SEQ ID NO: 628922 - DNA, 25 bp, Homo sapien
tgcccggtactttgtcagagactcg

SEQ ID NO: 628923 - DNA, 25 bp, Homo sapien
gaaattcctctccaggcttagggga

SEQ ID NO: 628924 - DNA, 25 bp, Homo sapien
atacgcctgctcttggaactctgag

SEQ ID NO: 628925 - DNA, 25 bp, Homo sapien
gcctgctcttggaactctgaggtag

SEQ ID NO: 628926 - DNA, 25 bp, Homo sapien
aggtaggcaggatgcttcctctcag

SEQ ID NO: 628927 - DNA, 25 bp, Homo sapien
tctcccctaatcctgactgtttttt

SEQ ID NO: 628928 - DNA, 25 bp, Homo sapien
ccttctgtgaactgtgaatgcgatt

SEQ ID NO: 628929 - DNA, 25 bp, Homo sapien
gaatgcgattattccttgtcgagtt

SEQ ID NO: 628930 - DNA, 25 bp, Homo sapien
gattattccttgtcgagttcacttg

SEQ ID NO: 628931 - DNA, 25 bp, Homo sapien
gtcgagttcacttggcaggcatgca

SEQ ID NO: 628932 - DNA, 25 bp, Homo sapien
acttggcaggcatgcataccagtat

SEQ ID NO: 628933 - DNA, 25 bp, Homo sapien
gtatgcaccttctattgtcctgaac

SEQ ID NO: 628934 - DNA, 25 bp, Homo sapien
accttctattgtcctgaactctgat

SEQ ID NO: 628935 - DNA, 25 bp, Homo sapien
caagacttaacaaagctttatgcta

SEQ ID NO: 628936 - DNA, 25 bp, Homo sapien
caaagctttatgctatagtttggat

SEQ ID NO: 628937 - DNA, 25 bp, Homo sapien
gatatagtttgtttgaccccttcca

SEQ ID NO: 628938 - DNA, 25 bp, Homo sapien
tgaccccttccaaatctgatgttga

SEQ ID NO: 628939 - DNA, 25 bp, Homo sapien
ttccagtgttggagatgggtcgtaa

SEQ ID NO: 628940 - DNA, 25 bp, Homo sapien
gtttgggtcatgaaggtagatccta

SEQ ID NO: 628941 - DNA, 25 bp, Homo sapien
tgtgaatagattaatccccctctct

SEQ ID NO: 628942 - DNA, 25 bp, Homo sapien
tgctttcttgcttgccatgtgatct

SEQ ID NO: 628943 - DNA, 25 bp, Homo sapien
gtgatctctgtacagctggctcccc

SEQ ID NO: 628944 - DNA, 25 bp, Homo sapien
tctctgtacagctggctcccctttg

SEQ ID NO: 628945 - DNA, 25 bp, Homo sapien
gcaaatactgacaccatgcttcttg

SEQ ID NO: 628946 - DNA, 25 bp, Homo sapien
ttcctgcgtaattcaagaaccccac

SEQ ID NO: 628947 - DNA, 25 bp, Homo sapien
tgcgtaattcaagaaccccaccttt

SEQ ID NO: 628948 - DNA, 25 bp, Homo sapien
taattcaagaaccccaccttttgtg

SEQ ID NO: 628949 - DNA, 25 bp, Homo sapien
aaatgagcagtctcaaccacctcag

SEQ ID NO: 628950 - DNA, 25 bp, Homo sapien
ctcagcctctgcaaatccagatcag

SEQ ID NO: 628951 - DNA, 25 bp, Homo sapien
tctgcaaatccagatcagatgcctg

SEQ ID NO: 628952 - DNA, 25 bp, Homo sapien
ttatgtcctcaaagtgtccaagtgt

SEQ ID NO: 628953 - DNA, 25 bp, Homo sapien
gtcctcaaagtgtccaagtgtccct

SEQ ID NO: 628954 - DNA, 25 bp, Homo sapien
tcaaagtgtccaagtgtccctgctt

SEQ ID NO: 628955 - DNA, 25 bp, Homo sapien
aaagtgtccaagtgtccctgcttgg

SEQ ID NO: 628956 - DNA, 25 bp, Homo sapien
aagtgtccctgcttggtcgactggg

SEQ ID NO: 628957 - DNA, 25 bp, Homo sapien
ggaggcaagcgttgcagtgaaccaa

SEQ ID NO: 628958 - DNA, 25 bp, Homo sapien
tctaggctggcctattaaaagcttc

SEQ ID NO: 628959 - DNA, 25 bp, Homo sapien
ctaggctggcctattaaaagcttcc

SEQ ID NO: 628960 - DNA, 25 bp, Homo sapien
taggctggcctattaaaagcttccc

SEQ ID NO: 628961 - DNA, 25 bp, Homo sapien
aggctggcctattaaaagcttccca

SEQ ID NO: 628962 - DNA, 25 bp, Homo sapien
ggctggcctattaaaagcttcccac

SEQ ID NO: 628963 - DNA, 25 bp, Homo sapien
gctggcctattaaaagcttcccacc

SEQ ID NO: 628964 - DNA, 25 bp, Homo sapien
tggcctattaaaagcttcccacccg

SEQ ID NO: 628965 - DNA, 25 bp, Homo sapien
tattaaaagcttcccacccggctgg

SEQ ID NO: 628966 - DNA, 25 bp, Homo sapien
taaaagcttcccacccggctgggtg

SEQ ID NO: 628967 - DNA, 25 bp, Homo sapien
aaagcttcccacccggctgggtgtg

SEQ ID NO: 628968 - DNA, 25 bp, Homo sapien
aggtcttctgactcttagtcctgtg

SEQ ID NO: 628969 - DNA, 25 bp, Homo sapien
tagtcctgtggtggttctactcctt

SEQ ID NO: 628970 - DNA, 25 bp, Homo sapien
ctgccacttctcctgtttgagtttt

SEQ ID NO: 628971 - DNA, 25 bp, Homo sapien
gtgaggacatttagccaatctggat

SEQ ID NO: 628972 - DNA, 25 bp, Homo sapien
agccaatctggatactgacatttga

SEQ ID NO: 628973 - DNA, 25 bp, Homo sapien
atttacccaatccattgtccaatct

SEQ ID NO: 628974 - DNA, 25 bp, Homo sapien
tccaatcttcagtcatgcaaatgta

SEQ ID NO: 628975 - DNA, 25 bp, Homo sapien
atgtaggaactggactttgcccaag

SEQ ID NO: 628976 - DNA, 25 bp, Homo sapien
gagacctttggatctaggaacacac

SEQ ID NO: 628977 - DNA, 25 bp, Homo sapien
ggaacacactgatcaagcccttaag

SEQ ID NO: 628978 - DNA, 25 bp, Homo sapien
tcaagcccttaagtgactgatgtag

SEQ ID NO: 628979 - DNA, 25 bp, Homo sapien
gttgaatattccatcctccaagaaa

SEQ ID NO: 628980 - DNA, 25 bp, Homo sapien
catcctccaagaaatctccaagcta

SEQ ID NO: 628981 - DNA, 25 bp, Homo sapien
gctatatagggccagctctgatctg

SEQ ID NO: 628982 - DNA, 25 bp, Homo sapien
ctctgatctgcagtttgggattgtg

SEQ ID NO: 628983 - DNA, 25 bp, Homo sapien
gggattgtggtatcctcccaggagt

SEQ ID NO: 628984 - DNA, 25 bp, Homo sapien
gagtggctgcctccatttatgaaat

SEQ ID NO: 628985 - DNA, 25 bp, Homo sapien
tttgaccctgaagtgtgactaggct

SEQ ID NO: 628986 - DNA, 25 bp, Homo sapien
gaggaatttattcacatctttattg

SEQ ID NO: 628987 - DNA, 25 bp, Homo sapien
tctttattgatcctaaaccttttag

SEQ ID NO: 628988 - DNA, 25 bp, Homo sapien
aatttgggtctcacaggtagtctgg

SEQ ID NO: 628989 - DNA, 25 bp, Homo sapien
gtagtctggacctttttgtgaaaat

SEQ ID NO: 628990 - DNA, 25 bp, Homo sapien
aaagtgtaacaagtaatttgaatca

SEQ ID NO: 628991 - DNA, 25 bp, Homo sapien
ccacactgaaacatcaacaccaggt

SEQ ID NO: 628992 - DNA, 25 bp, Homo sapien
acactgaaacatcaacaccaggtga

SEQ ID NO: 628993 - DNA, 25 bp, Homo sapien
tcaacaccaggtgaaggaaaataaa

SEQ ID NO: 628994 - DNA, 25 bp, Homo sapien
aaacagtaacaaaaagggcatctca

SEQ ID NO: 628995 - DNA, 25 bp, Homo sapien
aacaaaaagggcatctcagtataga

SEQ ID NO: 628996 - DNA, 25 bp, Homo sapien
aaagggcatctcagtatagagagca

SEQ ID NO: 628997 - DNA, 25 bp, Homo sapien
gggcatctcagtatagagagcagct

SEQ ID NO: 628998 - DNA, 25 bp, Homo sapien
gcatctcagtatagagagcagctta

SEQ ID NO: 628999 - DNA, 25 bp, Homo sapien
atctcagtatagagagcagcttaaa

SEQ ID NO: 629000 - DNA, 25 bp, Homo sapien
agtatagagagcagcttaaagttct

SEQ ID NO: 629001 - DNA, 25 bp, Homo sapien
acagtttaacatcctgcagtggtaa

SEQ ID NO: 629002 - DNA, 25 bp, Homo sapien
atcttaatggtaaaatcatcctcct

SEQ ID NO: 629003 - DNA, 25 bp, Homo sapien
aaaatcatcctcctgttgccattac

SEQ ID NO: 629004 - DNA, 25 bp, Homo sapien
ttgccattacactcttcaacttatg

SEQ ID NO: 629005 - DNA, 25 bp, Homo sapien
gaattctgttaactctaagcagcat

SEQ ID NO: 629006 - DNA, 25 bp, Homo sapien
aactctaagcagcatgtttaaagta

SEQ ID NO: 629007 - DNA, 25 bp, Homo sapien
caaagttgtgagatggttgcacatt

SEQ ID NO: 629008 - DNA, 25 bp, Homo sapien
gcacattttcagtaggtctaaaaat

SEQ ID NO: 629009 - DNA, 25 bp, Homo sapien
ggtctaaaaattaagttccacattg

SEQ ID NO: 629010 - DNA, 25 bp, Homo sapien
gttttaaagcactatggcaaacatt

SEQ ID NO: 629011 - DNA, 25 bp, Homo sapien
ttgaaacactttcattacagcaaca

SEQ ID NO: 629012 - DNA, 25 bp, Homo sapien
gaagtattccttcagatcctgcatg

SEQ ID NO: 629013 - DNA, 25 bp, Homo sapien
gatcctgcatgctgataaaactact

SEQ ID NO: 629014 - DNA, 25 bp, Homo sapien
gataaaactactgactcaactggtc

SEQ ID NO: 629015 - DNA, 25 bp, Homo sapien
tcaactggtccccatgaggagctgg

SEQ ID NO: 629016 - DNA, 25 bp, Homo sapien
tggtccccatgaggagctggctcac

SEQ ID NO: 629017 - DNA, 25 bp, Homo sapien
gctcaccaaagaatgcggtttccaa

SEQ ID NO: 629018 - DNA, 25 bp, Homo sapien
gaatgcggtttccaatcccaattat

SEQ ID NO: 629019 - DNA, 25 bp, Homo sapien
aatcccaattatttcatgccccttg

SEQ ID NO: 629020 - DNA, 25 bp, Homo sapien
atgccccttgcttaggcaatcaaca

SEQ ID NO: 629021 - DNA, 25 bp, Homo sapien
atctccaaacttggtgccctgcaat

SEQ ID NO: 629022 - DNA, 25 bp, Homo sapien
aaacttggtgccctgcaatcattaa

SEQ ID NO: 629023 - DNA, 25 bp, Homo sapien
gtatcagtggattcttccttttcct

SEQ ID NO: 629024 - DNA, 25 bp, Homo sapien
tgctaagtttcattctgttatatag

SEQ ID NO: 629025 - DNA, 25 bp, Homo sapien
tactgcaatttattgatcaattctc

SEQ ID NO: 629026 - DNA, 25 bp, Homo sapien
gatcaattctctgttaatggacatt

SEQ ID NO: 629027 - DNA, 25 bp, Homo sapien
attttgtataaaccgacagttcctg

SEQ ID NO: 629028 - DNA, 25 bp, Homo sapien
ataaaccgacagttcctgacttatg

SEQ ID NO: 629029 - DNA, 25 bp, Homo sapien
accgacagttcctgacttatgatgg

SEQ ID NO: 629030 - DNA, 25 bp, Homo sapien
acagttcctgacttatgatggttca

SEQ ID NO: 629031 - DNA, 25 bp, Homo sapien
atgatggttcaactttaacataatg

SEQ ID NO: 629032 - DNA, 25 bp, Homo sapien
gtagaattcatacttcaagtaccca

SEQ ID NO: 629033 - DNA, 25 bp, Homo sapien
ttcactttcagtacattgcttaata

SEQ ID NO: 629034 - DNA, 25 bp, Homo sapien
gaagtaagtagtatagcaaacacct

SEQ ID NO: 629035 - DNA, 25 bp, Homo sapien
agcaaacacctatttactcttcacc

SEQ ID NO: 629036 - DNA, 25 bp, Homo sapien
tttactcttcacctagattgactat

SEQ ID NO: 629037 - DNA, 25 bp, Homo sapien
gattgactattaacatttgcctgct

SEQ ID NO: 629038 - DNA, 25 bp, Homo sapien
gactattaacatttgcctgctgttc

SEQ ID NO: 629039 - DNA, 25 bp, Homo sapien
taaatataccttttccagaaccatt

SEQ ID NO: 629040 - DNA, 25 bp, Homo sapien
actttatctcttatgtatttcagca

SEQ ID NO: 629041 - DNA, 25 bp, Homo sapien
atgagaacattcacatacataacca

SEQ ID NO: 629042 - DNA, 25 bp, Homo sapien
taaccacgattttatcacacttaag

SEQ ID NO: 629043 - DNA, 25 bp, Homo sapien
aaattagcagtaatctcatgtcagc

SEQ ID NO: 629044 - DNA, 25 bp, Homo sapien
catgtcagctactttatagtccata

SEQ ID NO: 629045 - DNA, 25 bp, Homo sapien
tcctctgggcctgcaagaagtgaga

SEQ ID NO: 629046 - DNA, 25 bp, Homo sapien
aagtgagaggaggagactcccacag

SEQ ID NO: 629047 - DNA, 25 bp, Homo sapien
aagggagcaccacattcctgggtat

SEQ ID NO: 629048 - DNA, 25 bp, Homo sapien
gcaccacattcctgggtatgaacct

SEQ ID NO: 629049 - DNA, 25 bp, Homo sapien
attcctgggtatgaacctgtgggtt

SEQ ID NO: 629050 - DNA, 25 bp, Homo sapien
gaacctgtgggtttcagagacctca

SEQ ID NO: 629051 - DNA, 25 bp, Homo sapien
tttcagagacctcaggccctattta

SEQ ID NO: 629052 - DNA, 25 bp, Homo sapien
ctcaggccctatttacctcagaagc

SEQ ID NO: 629053 - DNA, 25 bp, Homo sapien
gaagcagaggcctccggtgtcaaag

SEQ ID NO: 629054 - DNA, 25 bp, Homo sapien
agaggcctccggtgtcaaagagaca

SEQ ID NO: 629055 - DNA, 25 bp, Homo sapien
gcctccggtgtcaaagagacagcag

SEQ ID NO: 629056 - DNA, 25 bp, Homo sapien
ggtccttttctgtgtgggccctact

SEQ ID NO: 629057 - DNA, 25 bp, Homo sapien
tgtgtgggccctacttgaagctggc

SEQ ID NO: 629058 - DNA, 25 bp, Homo sapien
gtgggccaaagcaacatacctagat

SEQ ID NO: 629059 - DNA, 25 bp, Homo sapien
aagcaacatacctagatgtggaaag

SEQ ID NO: 629060 - DNA, 25 bp, Homo sapien
atgtggaaagtggtgttgtcagaac

SEQ ID NO: 629061 - DNA, 25 bp, Homo sapien
ttgtcagaactggaagaggctcatc

SEQ ID NO: 629062 - DNA, 25 bp, Homo sapien
ggctcatcaggcagtgtgcttcctt

SEQ ID NO: 629063 - DNA, 25 bp, Homo sapien
tgcttccttctttctggtgaggatg

SEQ ID NO: 629064 - DNA, 25 bp, Homo sapien
acagtttgtctgttaccttggaggg

SEQ ID NO: 629065 - DNA, 25 bp, Homo sapien
attcccctaaacacttggccattgt

SEQ ID NO: 629066 - DNA, 25 bp, Homo sapien
acttggccattgttcacccataaaa

SEQ ID NO: 629067 - DNA, 25 bp, Homo sapien
aaccctatgcatgtacagtatgtgg

SEQ ID NO: 629068 - DNA, 25 bp, Homo sapien
atcaaacctcactgaacatgagaaa

SEQ ID NO: 629069 - DNA, 25 bp, Homo sapien
accttatcattgtaatcaatgtggg

SEQ ID NO: 629070 - DNA, 25 bp, Homo sapien
gggaaagctttcagtcagagacaaa

SEQ ID NO: 629071 - DNA, 25 bp, Homo sapien
gaaagctttcagtcagagacaaaat

SEQ ID NO: 629072 - DNA, 25 bp, Homo sapien
agctttcagtcagagacaaaatctt

SEQ ID NO: 629073 - DNA, 25 bp, Homo sapien
gagacaaaatcttcttgagcatgaa

SEQ ID NO: 629074 - DNA, 25 bp, Homo sapien
tgtggtaaagccttctctcgaatct

SEQ ID NO: 629075 - DNA, 25 bp, Homo sapien
gaatctcatccctcactcttcatgt

SEQ ID NO: 629076 - DNA, 25 bp, Homo sapien
tcatccctcactcttcatgtgagaa

SEQ ID NO: 629077 - DNA, 25 bp, Homo sapien
catccctcactcttcatgtgagaag

SEQ ID NO: 629078 - DNA, 25 bp, Homo sapien
aacagcatggtaaattaatttgtac

SEQ ID NO: 629079 - DNA, 25 bp, Homo sapien
tagtttgacaagtagccttatttgc

SEQ ID NO: 629080 - DNA, 25 bp, Homo sapien
agccttatttgctatagttgaaaga

SEQ ID NO: 629081 - DNA, 25 bp, Homo sapien
agttgaaagactctgcttgaagaaa

SEQ ID NO: 629082 - DNA, 25 bp, Homo sapien
attcacacttagaccctggctagaa

SEQ ID NO: 629083 - DNA, 25 bp, Homo sapien
cacacttagaccctggctagaagaa

SEQ ID NO: 629084 - DNA, 25 bp, Homo sapien
aagactgtactttcaggcctgggca

SEQ ID NO: 629085 - DNA, 25 bp, Homo sapien
actgtactttcaggcctgggcacag

SEQ ID NO: 629086 - DNA, 25 bp, Homo sapien
gatcactgaggctagaagttcgaga

SEQ ID NO: 629087 - DNA, 25 bp, Homo sapien
aagttcgagataacctgggctacgt

SEQ ID NO: 629088 - DNA, 25 bp, Homo sapien
tcgagataacctgggctacgtagtg

SEQ ID NO: 629089 - DNA, 25 bp, Homo sapien
accatcttggggccaggtgctgtgg

SEQ ID NO: 629090 - DNA, 25 bp, Homo sapien
ccatcttggggccaggtgctgtggc

SEQ ID NO: 629091 - DNA, 25 bp, Homo sapien
catcttggggccaggtgctgtggct

SEQ ID NO: 629092 - DNA, 25 bp, Homo sapien
atcttggggccaggtgctgtggctc

SEQ ID NO: 629093 - DNA, 25 bp, Homo sapien
tcttggccagcacggtgaaaccctg

SEQ ID NO: 629094 - DNA, 25 bp, Homo sapien
gtctctgctgaggatacaaaaaaat

SEQ ID NO: 629095 - DNA, 25 bp, Homo sapien
tctctgctgaggatacaaaaaaatt

SEQ ID NO: 629096 - DNA, 25 bp, Homo sapien
ctctgctgaggatacaaaaaaatta

SEQ ID NO: 629097 - DNA, 25 bp, Homo sapien
tctgctgaggatacaaaaaaattag

SEQ ID NO: 629098 - DNA, 25 bp, Homo sapien
atgccactgcgctgcagcttgggcg

SEQ ID NO: 629099 - DNA, 25 bp, Homo sapien
gcgctgcagcttgggcgacagagcg

SEQ ID NO: 629100 - DNA, 25 bp, Homo sapien
gcttgttgaaatgatcagctccatg

SEQ ID NO: 629101 - DNA, 25 bp, Homo sapien
agctccatgtgttcagcctgagtat

SEQ ID NO: 629102 - DNA, 25 bp, Homo sapien
gcaggaaactgcaccctaattttag

SEQ ID NO: 629103 - DNA, 25 bp, Homo sapien
tttagtgttctgcatggactctcat

SEQ ID NO: 629104 - DNA, 25 bp, Homo sapien
atggactctcattactgcccaagca

SEQ ID NO: 629105 - DNA, 25 bp, Homo sapien
ttactgcccaagcacatggctctca

SEQ ID NO: 629106 - DNA, 25 bp, Homo sapien
atggctctcacatgcataagtcctt

SEQ ID NO: 629107 - DNA, 25 bp, Homo sapien
taagtccttcttgagtactggttgc

SEQ ID NO: 629108 - DNA, 25 bp, Homo sapien
tgagtactggttgctaaccctcctc

SEQ ID NO: 629109 - DNA, 25 bp, Homo sapien
cacacttggtttgcagaggatattt

SEQ ID NO: 629110 - DNA, 25 bp, Homo sapien
aagagcaccagatattcaataaacc

SEQ ID NO: 629111 - DNA, 25 bp, Homo sapien
cattctcatcgctgtgattgcattc

SEQ ID NO: 629112 - DNA, 25 bp, Homo sapien
atcgctgtgattgcattcttgccgc

SEQ ID NO: 629113 - DNA, 25 bp, Homo sapien
gcattcttgccgcattgctgtaaaa

SEQ ID NO: 629114 - DNA, 25 bp, Homo sapien
cattgctgtaaaaacgtttcctctc

SEQ ID NO: 629115 - DNA, 25 bp, Homo sapien
caacttcacgaaaaccacgcagcaa

SEQ ID NO: 629116 - DNA, 25 bp, Homo sapien
gaggaacagcgcttgccgggaacct

SEQ ID NO: 629117 - DNA, 25 bp, Homo sapien
cttgccgggaacctgctctgtgctg

SEQ ID NO: 629118 - DNA, 25 bp, Homo sapien
cacctgcgccacgaaagggagtcag

SEQ ID NO: 629119 - DNA, 25 bp, Homo sapien
ctgcaaagcacccttctgaaaatca

SEQ ID NO: 629120 - DNA, 25 bp, Homo sapien
gcacccttctgaaaatcaacactcg

SEQ ID NO: 629121 - DNA, 25 bp, Homo sapien
cactcgggaaaggtttacaggcatc

SEQ ID NO: 629122 - DNA, 25 bp, Homo sapien
aagcacaatttgcaacgctccccgt

SEQ ID NO: 629123 - DNA, 25 bp, Homo sapien
gctccccgtgtgcatggacagcagt

SEQ ID NO: 629124 - DNA, 25 bp, Homo sapien
ggacagcagtgcagacccatccagg

SEQ ID NO: 629125 - DNA, 25 bp, Homo sapien
tgcatgcctcgtctcgtggcttaac

SEQ ID NO: 629126 - DNA, 25 bp, Homo sapien
ggtccaggcggctcccaaagatgta

SEQ ID NO: 629127 - DNA, 25 bp, Homo sapien
agatgtacggctccataaacctgcc

SEQ ID NO: 629128 - DNA, 25 bp, Homo sapien
tacggctccataaacctgccagaga

SEQ ID NO: 629129 - DNA, 25 bp, Homo sapien
tgccagagaccccaccaaggcaagg

SEQ ID NO: 629130 - DNA, 25 bp, Homo sapien
tggctccttgcaggaacacagacgc

SEQ ID NO: 629131 - DNA, 25 bp, Homo sapien
caggaacacagacgcccaccaggga

SEQ ID NO: 629132 - DNA, 25 bp, Homo sapien
ggcactatgggctgggaagcacaat

SEQ ID NO: 629133 - DNA, 25 bp, Homo sapien
cagatccccacagcaaaggcgaagt

SEQ ID NO: 629134 - DNA, 25 bp, Homo sapien
gatccccacagcaaaggcgaagtca

SEQ ID NO: 629135 - DNA, 25 bp, Homo sapien
atccccacagcaaaggcgaagtcac

SEQ ID NO: 629136 - DNA, 25 bp, Homo sapien
aggcgaagtcaccaactcaacaagg

SEQ ID NO: 629137 - DNA, 25 bp, Homo sapien
ggcgaagtcaccaactcaacaaggc

SEQ ID NO: 629138 - DNA, 25 bp, Homo sapien
gcgaagtcaccaactcaacaaggcg

SEQ ID NO: 629139 - DNA, 25 bp, Homo sapien
gaagtcaccaactcaacaaggcgcg

SEQ ID NO: 629140 - DNA, 25 bp, Homo sapien
aagtcaccaactcaacaaggcgcgt

SEQ ID NO: 629141 - DNA, 25 bp, Homo sapien
agtcaccaactcaacaaggcgcgtg

SEQ ID NO: 629142 - DNA, 25 bp, Homo sapien
gtcaccaactcaacaaggcgcgtgg

SEQ ID NO: 629143 - DNA, 25 bp, Homo sapien
tcaccaactcaacaaggcgcgtggc

SEQ ID NO: 629144 - DNA, 25 bp, Homo sapien
tctctcatgcctgaacttccaaata

SEQ ID NO: 629145 - DNA, 25 bp, Homo sapien
gcctgaacttccaaataagtttttg

SEQ ID NO: 629146 - DNA, 25 bp, Homo sapien
gggtttttagttgagcattctttct

SEQ ID NO: 629147 - DNA, 25 bp, Homo sapien
tagttgagcattctttctggtttga

SEQ ID NO: 629148 - DNA, 25 bp, Homo sapien
aaacaagtcacttttggccaaatat

SEQ ID NO: 629149 - DNA, 25 bp, Homo sapien
taaccaaatgataccatagatccat

SEQ ID NO: 629150 - DNA, 25 bp, Homo sapien
aatgataccatagatccatttagaa

SEQ ID NO: 629151 - DNA, 25 bp, Homo sapien
ggatttctgagacatattcataagt

SEQ ID NO: 629152 - DNA, 25 bp, Homo sapien
gatgagaaaacgaaagctttacaaa

SEQ ID NO: 629153 - DNA, 25 bp, Homo sapien
gaagaaagtagtctctcatgcctga

SEQ ID NO: 629154 - DNA, 25 bp, Homo sapien
gaaagtagtctctcatgcctgaact

SEQ ID NO: 629155 - DNA, 25 bp, Homo sapien
gtctttgaaaaacaagggagctata

SEQ ID NO: 629156 - DNA, 25 bp, Homo sapien
ctttgaaaaacaagggagctatata

SEQ ID NO: 629157 - DNA, 25 bp, Homo sapien
tttgaaaaacaagggagctatatat

SEQ ID NO: 629158 - DNA, 25 bp, Homo sapien
gaaaaacaagggagctatatataag

SEQ ID NO: 629159 - DNA, 25 bp, Homo sapien
aaacaagggagctatatataagaat

SEQ ID NO: 629160 - DNA, 25 bp, Homo sapien
aacaagggagctatatataagaata

SEQ ID NO: 629161 - DNA, 25 bp, Homo sapien
acaagggagctatatataagaatat

SEQ ID NO: 629162 - DNA, 25 bp, Homo sapien
gaatatataagagctggctcacacc

SEQ ID NO: 629163 - DNA, 25 bp, Homo sapien
aatatataagagctggctcacacct

SEQ ID NO: 629164 - DNA, 25 bp, Homo sapien
atatataagagctggctcacacctg

SEQ ID NO: 629165 - DNA, 25 bp, Homo sapien
tcacctacctgggaggtgtaggttg

SEQ ID NO: 629166 - DNA, 25 bp, Homo sapien
cttaaaaacggtatgctgagtgaaa

SEQ ID NO: 629167 - DNA, 25 bp, Homo sapien
gaaagaagccagtaacaagccacta

SEQ ID NO: 629168 - DNA, 25 bp, Homo sapien
gaagccagtaacaagccactacata

SEQ ID NO: 629169 - DNA, 25 bp, Homo sapien
gtaacaagccactacatactatata

SEQ ID NO: 629170 - DNA, 25 bp, Homo sapien
tagattattgattgcctagggcttg

SEQ ID NO: 629171 - DNA, 25 bp, Homo sapien
attgattgcctagggcttgcgtaaa

SEQ ID NO: 629172 - DNA, 25 bp, Homo sapien
attgcctagggcttgcgtaaatggg

SEQ ID NO: 629173 - DNA, 25 bp, Homo sapien
cctagggcttgcgtaaatgggagat

SEQ ID NO: 629174 - DNA, 25 bp, Homo sapien
atggctattgggtatggcatttctt

SEQ ID NO: 629175 - DNA, 25 bp, Homo sapien
tattgggtatggcatttcttttgaa

SEQ ID NO: 629176 - DNA, 25 bp, Homo sapien
aattgtgtgaattgtagggtacgtg

SEQ ID NO: 629177 - DNA, 25 bp, Homo sapien
tcacagttatgcaataattaccact

SEQ ID NO: 629178 - DNA, 25 bp, Homo sapien
atgcaataattaccactatcaattt

SEQ ID NO: 629179 - DNA, 25 bp, Homo sapien
taattaccactatcaattttagaac

SEQ ID NO: 629180 - DNA, 25 bp, Homo sapien
ccccaaagagaaacttgatacccat

SEQ ID NO: 629181 - DNA, 25 bp, Homo sapien
aagagaaacttgatacccattaaca

SEQ ID NO: 629182 - DNA, 25 bp, Homo sapien
gagaaacttgatacccattaacaat

SEQ ID NO: 629183 - DNA, 25 bp, Homo sapien
ccattaacaatcactcctcactctc

SEQ ID NO: 629184 - DNA, 25 bp, Homo sapien
cctggcaaccaccagtctatttttt

SEQ ID NO: 629185 - DNA, 25 bp, Homo sapien
ggcaaccaccagtctatttttttgt

SEQ ID NO: 629186 - DNA, 25 bp, Homo sapien
ttgtatctattgatttgcctattct

SEQ ID NO: 629187 - DNA, 25 bp, Homo sapien
aaatagaataatatctgtaatccta

SEQ ID NO: 629188 - DNA, 25 bp, Homo sapien
agaagaggtgctccacaccctgagt

SEQ ID NO: 629189 - DNA, 25 bp, Homo sapien
gagtcagaaccagaaagcagcgaag

SEQ ID NO: 629190 - DNA, 25 bp, Homo sapien
agcagcgaagaatccacacctgtgt

SEQ ID NO: 629191 - DNA, 25 bp, Homo sapien
tggagacctcccctgaagcatgcgt

SEQ ID NO: 629192 - DNA, 25 bp, Homo sapien
aagcatgcgtccttagaaacaccat

SEQ ID NO: 629193 - DNA, 25 bp, Homo sapien
agttaacagtgcatctcccagtgga

SEQ ID NO: 629194 - DNA, 25 bp, Homo sapien
cccagtggacgcgagcagggacaca

SEQ ID NO: 629195 - DNA, 25 bp, Homo sapien
gggacacactctcacctcaaggtag

SEQ ID NO: 629196 - DNA, 25 bp, Homo sapien
aacctcactctgaagggaagcaagg

SEQ ID NO: 629197 - DNA, 25 bp, Homo sapien
gaagcaaggcaagacacacaagggt

SEQ ID NO: 629198 - DNA, 25 bp, Homo sapien
acacaagggtccacagccaaggaaa

SEQ ID NO: 629199 - DNA, 25 bp, Homo sapien
gaggcatgaattacaggttttacac

SEQ ID NO: 629200 - DNA, 25 bp, Homo sapien
acatttatgaatgggctactcagat

SEQ ID NO: 629201 - DNA, 25 bp, Homo sapien
atgaatgggctactcagatttaaaa

SEQ ID NO: 629202 - DNA, 25 bp, Homo sapien
aaaatattgcctgttcattgaatgc

SEQ ID NO: 629203 - DNA, 25 bp, Homo sapien
gcctgttcattgaatgctttctgga

SEQ ID NO: 629204 - DNA, 25 bp, Homo sapien
actttctaattgtatacctctcttt

SEQ ID NO: 629205 - DNA, 25 bp, Homo sapien
taattgtatacctctctttctttct

SEQ ID NO: 629206 - DNA, 25 bp, Homo sapien
ctctctttctttcttaagataacta

SEQ ID NO: 629207 - DNA, 25 bp, Homo sapien
aactactatcatatatttgttttgg

SEQ ID NO: 629208 - DNA, 25 bp, Homo sapien
tatatttgttttggactgcatgtta

SEQ ID NO: 629209 - DNA, 25 bp, Homo sapien
acatagcaactgaggcatgaattac

SEQ ID NO: 629210 - DNA, 25 bp, Homo sapien
gaatgggaatgcctgtattgttcat

SEQ ID NO: 629211 - DNA, 25 bp, Homo sapien
gtattgttcatgtaactcgcaggga

SEQ ID NO: 629212 - DNA, 25 bp, Homo sapien
ttcatccaaatctacattgtacact

SEQ ID NO: 629213 - DNA, 25 bp, Homo sapien
tgtacacttgatgaggcagccgatt

SEQ ID NO: 629214 - DNA, 25 bp, Homo sapien
aaatcagccgggtctacccagagct

SEQ ID NO: 629215 - DNA, 25 bp, Homo sapien
gggtctacccagagcttacgtagct

SEQ ID NO: 629216 - DNA, 25 bp, Homo sapien
tacgtagctcagattgcgggcacat

SEQ ID NO: 629217 - DNA, 25 bp, Homo sapien
gattgcaaaagtctccagttaccag

SEQ ID NO: 629218 - DNA, 25 bp, Homo sapien
aagtctccagttaccagcaccctga

SEQ ID NO: 629219 - DNA, 25 bp, Homo sapien
accctgaacatgcaccctttgatta

SEQ ID NO: 629220 - DNA, 25 bp, Homo sapien
aacatgcaccctttgattaaatcac

SEQ ID NO: 629221 - DNA, 25 bp, Homo sapien
aaaagcagtgaagggcaaacagaag

SEQ ID NO: 629222 - DNA, 25 bp, Homo sapien
tttatttcactttcattcggatacg

SEQ ID NO: 629223 - DNA, 25 bp, Homo sapien
ctttcattcggatacgtttactaat

SEQ ID NO: 629224 - DNA, 25 bp, Homo sapien
gatacgtttactaattttctttgct

SEQ ID NO: 629225 - DNA, 25 bp, Homo sapien
tactaattttctttgctagctttaa

SEQ ID NO: 629226 - DNA, 25 bp, Homo sapien
ttctttgctagctttaagactttta

SEQ ID NO: 629227 - DNA, 25 bp, Homo sapien
taaaacattctttggccctgggagg

SEQ ID NO: 629228 - DNA, 25 bp, Homo sapien
ccctgggagggagttgtataaccat

SEQ ID NO: 629229 - DNA, 25 bp, Homo sapien
taaaacttgagaatcctggccctag

SEQ ID NO: 629230 - DNA, 25 bp, Homo sapien
acttgagaatcctggccctagaata

SEQ ID NO: 629231 - DNA, 25 bp, Homo sapien
ctggccctagaataaatgttccttt

SEQ ID NO: 629232 - DNA, 25 bp, Homo sapien
gctgaaattccacatctagtcagga

SEQ ID NO: 629233 - DNA, 25 bp, Homo sapien
ggaatgtggtaatgtgtccggaatt

SEQ ID NO: 629234 - DNA, 25 bp, Homo sapien
atgaagccacagaacctcacggtgg

SEQ ID NO: 629235 - DNA, 25 bp, Homo sapien
gaacctcacggtgggtgttccagtt

SEQ ID NO: 629236 - DNA, 25 bp, Homo sapien
gttccagttcttaaacacagtgtct

SEQ ID NO: 629237 - DNA, 25 bp, Homo sapien
aacacagtgtctggcgtttgttcct

SEQ ID NO: 629238 - DNA, 25 bp, Homo sapien
ttcggatgtgttaggaatttctttc

SEQ ID NO: 629239 - DNA, 25 bp, Homo sapien
tttctttcttctggtgagttcgtga

SEQ ID NO: 629240 - DNA, 25 bp, Homo sapien
tcttctggtgagttcgtgatctcgc

SEQ ID NO: 629241 - DNA, 25 bp, Homo sapien
agttcgtgatctcgctggctcagca

SEQ ID NO: 629242 - DNA, 25 bp, Homo sapien
agaccttcgtgagagactggattga

SEQ ID NO: 629243 - DNA, 25 bp, Homo sapien
atacctcttagtcatcaccattcta

SEQ ID NO: 629244 - DNA, 25 bp, Homo sapien
tcttagtcatcaccattctactctc

SEQ ID NO: 629245 - DNA, 25 bp, Homo sapien
gggatcagcttctttagattgcaca

SEQ ID NO: 629246 - DNA, 25 bp, Homo sapien
gatcagcttctttagattgcacata

SEQ ID NO: 629247 - DNA, 25 bp, Homo sapien
tcagcttctttagattgcacatatg

SEQ ID NO: 629248 - DNA, 25 bp, Homo sapien
gcttctttagattgcacatatgagt

SEQ ID NO: 629249 - DNA, 25 bp, Homo sapien
tcatgcagtatttatctttgtgtgt

SEQ ID NO: 629250 - DNA, 25 bp, Homo sapien
tgcagtatttatctttgtgtgtttg

SEQ ID NO: 629251 - DNA, 25 bp, Homo sapien
attgatagatgcttaagttgttttc

SEQ ID NO: 629252 - DNA, 25 bp, Homo sapien
gcttaagttgttttcatagcttggc

SEQ ID NO: 629253 - DNA, 25 bp, Homo sapien
aagttgttttcatagcttggctatt

SEQ ID NO: 629254 - DNA, 25 bp, Homo sapien
attagcctggcgtgatggtgaacgc

SEQ ID NO: 629255 - DNA, 25 bp, Homo sapien
ttagcctggcgtgatggtgaacgcc

SEQ ID NO: 629256 - DNA, 25 bp, Homo sapien
tagcctggcgtgatggtgaacgcct

SEQ ID NO: 629257 - DNA, 25 bp, Homo sapien
agcctggcgtgatggtgaacgcctg

SEQ ID NO: 629258 - DNA, 25 bp, Homo sapien
gcctggcgtgatggtgaacgcctgt

SEQ ID NO: 629259 - DNA, 25 bp, Homo sapien
cctggcgtgatggtgaacgcctgta

SEQ ID NO: 629260 - DNA, 25 bp, Homo sapien
ctggcgtgatggtgaacgcctgtaa

SEQ ID NO: 629261 - DNA, 25 bp, Homo sapien
tggcgtgatggtgaacgcctgtaat

SEQ ID NO: 629262 - DNA, 25 bp, Homo sapien
ggcgtgatggtgaacgcctgtaatc

SEQ ID NO: 629263 - DNA, 25 bp, Homo sapien
gcgtgatggtgaacgcctgtaatcc

SEQ ID NO: 629264 - DNA, 25 bp, Homo sapien
tcctcaggaggctgacgcgggagaa

SEQ ID NO: 629265 - DNA, 25 bp, Homo sapien
gtgccaaaaggtatggttccttcac

SEQ ID NO: 629266 - DNA, 25 bp, Homo sapien
ggttccttcacacttgctgataaga

SEQ ID NO: 629267 - DNA, 25 bp, Homo sapien
attgatcctctaatttccatgtatg

SEQ ID NO: 629268 - DNA, 25 bp, Homo sapien
actgtggtaagtctcgcatttttaa

SEQ ID NO: 629269 - DNA, 25 bp, Homo sapien
aacttgaacacaccagttctgccac

SEQ ID NO: 629270 - DNA, 25 bp, Homo sapien
actgcagtagccacatcttgattct

SEQ ID NO: 629271 - DNA, 25 bp, Homo sapien
gattcttaacagcagtcaccttcac

SEQ ID NO: 629272 - DNA, 25 bp, Homo sapien
ttcacctccataatttcccttttgt

SEQ ID NO: 629273 - DNA, 25 bp, Homo sapien
tttcccttttgttgcttcaaattat

SEQ ID NO: 629274 - DNA, 25 bp, Homo sapien
gttgtactaagcacactttctctac

SEQ ID NO: 629275 - DNA, 25 bp, Homo sapien
aagcacactttctctaccaataaat

SEQ ID NO: 629276 - DNA, 25 bp, Homo sapien
gggagagtaagcttctcttaccatt

SEQ ID NO: 629277 - DNA, 25 bp, Homo sapien
tctcttaccattgttctctattctc

SEQ ID NO: 629278 - DNA, 25 bp, Homo sapien
ctactcccatattcttccagtggga

SEQ ID NO: 629279 - DNA, 25 bp, Homo sapien
ttccagtgggacaaagtgccccaaa

SEQ ID NO: 629280 - DNA, 25 bp, Homo sapien
agtgccccaaagtataagtcagtgt

SEQ ID NO: 629281 - DNA, 25 bp, Homo sapien
ggtctggagtttaggtacctgaaca

SEQ ID NO: 629282 - DNA, 25 bp, Homo sapien
gtacctgaacatggaagagggcctt

SEQ ID NO: 629283 - DNA, 25 bp, Homo sapien
tctctcatccccagcaaagttctga

SEQ ID NO: 629284 - DNA, 25 bp, Homo sapien
caaagttctgaatgcgggttctgac

SEQ ID NO: 629285 - DNA, 25 bp, Homo sapien
ctgagctgaaggcatacttcatgaa

SEQ ID NO: 629286 - DNA, 25 bp, Homo sapien
ttcatgaagtttcctgctgcccttt

SEQ ID NO: 629287 - DNA, 25 bp, Homo sapien
gctcaagcctcagagatactgtctt

SEQ ID NO: 629288 - DNA, 25 bp, Homo sapien
gcctcagagatactgtcttgtgaca

SEQ ID NO: 629289 - DNA, 25 bp, Homo sapien
gatactgtcttgtgacaacactcac

SEQ ID NO: 629290 - DNA, 25 bp, Homo sapien
gacaacactcacagatctagtaagt

SEQ ID NO: 629291 - DNA, 25 bp, Homo sapien
cacagatctagtaagtaggtctctt

SEQ ID NO: 629292 - DNA, 25 bp, Homo sapien
gtaggtctcttctaaacttttgatt

SEQ ID NO: 629293 - DNA, 25 bp, Homo sapien
ctaaacttttgattccagcaatggt

SEQ ID NO: 629294 - DNA, 25 bp, Homo sapien
gattccagcaatggtaacctgctca

SEQ ID NO: 629295 - DNA, 25 bp, Homo sapien
atggtaacctgctcactccagaact

SEQ ID NO: 629296 - DNA, 25 bp, Homo sapien
ggatctgttttatttggctcagtat

SEQ ID NO: 629297 - DNA, 25 bp, Homo sapien
tgttttatttggctcagtattcccc

SEQ ID NO: 629298 - DNA, 25 bp, Homo sapien
agacatacgtcacaaggccgcctat

SEQ ID NO: 629299 - DNA, 25 bp, Homo sapien
aaggccgcctatgggcagggcttat

SEQ ID NO: 629300 - DNA, 25 bp, Homo sapien
gcttattaagtagcctctgatccag

SEQ ID NO: 629301 - DNA, 25 bp, Homo sapien
tctgatccagtcctgtaggtgttcg

SEQ ID NO: 629302 - DNA, 25 bp, Homo sapien
gtcctgtaggtgttcggtccagcta

SEQ ID NO: 629303 - DNA, 25 bp, Homo sapien
ttcggtccagctacatgtcacaata

SEQ ID NO: 629304 - DNA, 25 bp, Homo sapien
tacatcacctaagtgctggatccag

SEQ ID NO: 629305 - DNA, 25 bp, Homo sapien
atgtcacaatcctcttctttggcat

SEQ ID NO: 629306 - DNA, 25 bp, Homo sapien
ctcttctttggcatggccgaggaag

SEQ ID NO: 629307 - DNA, 25 bp, Homo sapien
atcacctaggcgttggaccaagcca

SEQ ID NO: 629308 - DNA, 25 bp, Homo sapien
acacaataaatgcagggctcatgaa

SEQ ID NO: 629309 - DNA, 25 bp, Homo sapien
taacattagagacctccttgggcat

SEQ ID NO: 629310 - DNA, 25 bp, Homo sapien
cctccttgggcatggttatgggtat

SEQ ID NO: 629311 - DNA, 25 bp, Homo sapien
ggtattggatacattcttgggagta

SEQ ID NO: 629312 - DNA, 25 bp, Homo sapien
ttgctagttctagccaacttacctt

SEQ ID NO: 629313 - DNA, 25 bp, Homo sapien
aacttaccttcacaagggctgtact

SEQ ID NO: 629314 - DNA, 25 bp, Homo sapien
gggctgtactaatttgggcttccac

SEQ ID NO: 629315 - DNA, 25 bp, Homo sapien
gggcttccactagtagttacagaga

SEQ ID NO: 629316 - DNA, 25 bp, Homo sapien
tacagagagggcattgagattccta

SEQ ID NO: 629317 - DNA, 25 bp, Homo sapien
gagattcctaatgctggtcagtcaa

SEQ ID NO: 629318 - DNA, 25 bp, Homo sapien
aatgctggtcagtcaatggctcaca

SEQ ID NO: 629319 - DNA, 25 bp, Homo sapien
gtcaatggctcacatcttagcaaat

SEQ ID NO: 629320 - DNA, 25 bp, Homo sapien
agaaaatgcagctctagcagtgata

SEQ ID NO: 629321 - DNA, 25 bp, Homo sapien
agcagtgatagattggttaccagta

SEQ ID NO: 629322 - DNA, 25 bp, Homo sapien
tggttaccagtaattgccaatttgg

SEQ ID NO: 629323 - DNA, 25 bp, Homo sapien
taattgccaatttgggaactccaga

SEQ ID NO: 629324 - DNA, 25 bp, Homo sapien
ggtctgtttagagactgggcagtca

SEQ ID NO: 629325 - DNA, 25 bp, Homo sapien
gactgggcagtcaatcatggtctga

SEQ ID NO: 629326 - DNA, 25 bp, Homo sapien
ggtctgatgccatggaacgtgcctt

SEQ ID NO: 629327 - DNA, 25 bp, Homo sapien
catggaacgtgccttgctctcaagt

SEQ ID NO: 629328 - DNA, 25 bp, Homo sapien
gtgccttgctctcaagtctatgtag

SEQ ID NO: 629329 - DNA, 25 bp, Homo sapien
ctatgtagagtcaatcaggaggcac

SEQ ID NO: 629330 - DNA, 25 bp, Homo sapien
ggaggcactcaacaagcaaatagtg

SEQ ID NO: 629331 - DNA, 25 bp, Homo sapien
ttgtcttctactattattccctttc

SEQ ID NO: 629332 - DNA, 25 bp, Homo sapien
attattccctttcaatatgacccct

SEQ ID NO: 629333 - DNA, 25 bp, Homo sapien
aatatgacccctcaatttactcttc

SEQ ID NO: 629334 - DNA, 25 bp, Homo sapien
cccctcaatttactcttcatattac

SEQ ID NO: 629335 - DNA, 25 bp, Homo sapien
attttaattatcatcctagagtaca

SEQ ID NO: 629336 - DNA, 25 bp, Homo sapien
gattttgtcaagacctaatttcaaa

SEQ ID NO: 629337 - DNA, 25 bp, Homo sapien
aagacatttgcttagcggcttacca

SEQ ID NO: 629338 - DNA, 25 bp, Homo sapien
agcggcttaccaacaacgcgacaag

SEQ ID NO: 629339 - DNA, 25 bp, Homo sapien
acgcgacaagacacattttacacag

SEQ ID NO: 629340 - DNA, 25 bp, Homo sapien
attttacacagtctcctcatacact

SEQ ID NO: 629341 - DNA, 25 bp, Homo sapien
ccagccacctttcccagtaaagaag

SEQ ID NO: 629342 - DNA, 25 bp, Homo sapien
taaattccttttaagtgtgctgaca

SEQ ID NO: 629343 - DNA, 25 bp, Homo sapien
gtgtgctgacaattaagtgccttaa

SEQ ID NO: 629344 - DNA, 25 bp, Homo sapien
gctgtgaggcataattccatgttat

SEQ ID NO: 629345 - DNA, 25 bp, Homo sapien
agatggtaattcatgtcacttataa

SEQ ID NO: 629346 - DNA, 25 bp, Homo sapien
aatactcaacttgaaattgccctga

SEQ ID NO: 629347 - DNA, 25 bp, Homo sapien
aaattgccctgaggattttatttct

SEQ ID NO: 629348 - DNA, 25 bp, Homo sapien
acaaataggcatgcttactttaatt

SEQ ID NO: 629349 - DNA, 25 bp, Homo sapien
tactttaatttgtcttgagtggaaa

SEQ ID NO: 629350 - DNA, 25 bp, Homo sapien
atatattgcattaaatctttccctg

SEQ ID NO: 629351 - DNA, 25 bp, Homo sapien
aatctttccctgttatccattacta

SEQ ID NO: 629352 - DNA, 25 bp, Homo sapien
atccattactatgtagaagacccta

SEQ ID NO: 629353 - DNA, 25 bp, Homo sapien
ttgtccctattcctttccactctct

SEQ ID NO: 629354 - DNA, 25 bp, Homo sapien
tattcctttccactctctgccttta

SEQ ID NO: 629355 - DNA, 25 bp, Homo sapien
actctctgcctttaaaagaagatat

SEQ ID NO: 629356 - DNA, 25 bp, Homo sapien
ctctctgcctttaaaagaagatatt

SEQ ID NO: 629357 - DNA, 25 bp, Homo sapien
gagctcaggcgttcgaggccagact

SEQ ID NO: 629358 - DNA, 25 bp, Homo sapien
gcgttcgaggccagactggcccaac

SEQ ID NO: 629359 - DNA, 25 bp, Homo sapien
gttcgaggccagactggcccaacgt

SEQ ID NO: 629360 - DNA, 25 bp, Homo sapien
ttcgaggccagactggcccaacgtg

SEQ ID NO: 629361 - DNA, 25 bp, Homo sapien
tcgaggccagactggcccaacgtgg

SEQ ID NO: 629362 - DNA, 25 bp, Homo sapien
cgaggccagactggcccaacgtggt

SEQ ID NO: 629363 - DNA, 25 bp, Homo sapien
ggccagactggcccaacgtggtgaa

SEQ ID NO: 629364 - DNA, 25 bp, Homo sapien
tcagtctcctgccccagtagctagg

SEQ ID NO: 629365 - DNA, 25 bp, Homo sapien
cagtctcctgccccagtagctaggg

SEQ ID NO: 629366 - DNA, 25 bp, Homo sapien
agtctcctgccccagtagctagggc

SEQ ID NO: 629367 - DNA, 25 bp, Homo sapien
gtctcctgccccagtagctagggct

SEQ ID NO: 629368 - DNA, 25 bp, Homo sapien
tctcctgccccagtagctagggcta

SEQ ID NO: 629369 - DNA, 25 bp, Homo sapien
ctcctgccccagtagctagggctac

SEQ ID NO: 629370 - DNA, 25 bp, Homo sapien
taccacattggccagactaagcatt

SEQ ID NO: 629371 - DNA, 25 bp, Homo sapien
accacattggccagactaagcattt

SEQ ID NO: 629372 - DNA, 25 bp, Homo sapien
ccacattggccagactaagcatttt

SEQ ID NO: 629373 - DNA, 25 bp, Homo sapien
cacattggccagactaagcatttta

SEQ ID NO: 629374 - DNA, 25 bp, Homo sapien
aattattgacaaacctatccaagga

SEQ ID NO: 629375 - DNA, 25 bp, Homo sapien
cctatccaaggagctaaatgacgtg

SEQ ID NO: 629376 - DNA, 25 bp, Homo sapien
taaatgacgtggtttaggagccaaa

SEQ ID NO: 629377 - DNA, 25 bp, Homo sapien
ggagccaaaacgtctctagaaacat

SEQ ID NO: 629378 - DNA, 25 bp, Homo sapien
aacattataacacatcccatcctga

SEQ ID NO: 629379 - DNA, 25 bp, Homo sapien
aacacatcccatcctgaacaaagaa

SEQ ID NO: 629380 - DNA, 25 bp, Homo sapien
gaatgttgtcatagtttcccacatg

SEQ ID NO: 629381 - DNA, 25 bp, Homo sapien
ttgcatctttttgtgtcactactgg

SEQ ID NO: 629382 - DNA, 25 bp, Homo sapien
gtgtcactactggaattctgtacaa

SEQ ID NO: 629383 - DNA, 25 bp, Homo sapien
catggccttctggatataggatcca

SEQ ID NO: 629384 - DNA, 25 bp, Homo sapien
taggatccagaaaattgtacttcat

SEQ ID NO: 629385 - DNA, 25 bp, Homo sapien
ttcagcttcccaacctcagagtagg

SEQ ID NO: 629386 - DNA, 25 bp, Homo sapien
tggctatcacgtcccagctccgagg

SEQ ID NO: 629387 - DNA, 25 bp, Homo sapien
aggcctggcagagggtcctcaagcc

SEQ ID NO: 629388 - DNA, 25 bp, Homo sapien
tcaagcctggagaggcggcgtccct

SEQ ID NO: 629389 - DNA, 25 bp, Homo sapien
tgtcccatgtgtcatcgcccacggg

SEQ ID NO: 629390 - DNA, 25 bp, Homo sapien
tcgcccacgggatactgcaaaagtt

SEQ ID NO: 629391 - DNA, 25 bp, Homo sapien
aagttaacatctttcccagcagaag

SEQ ID NO: 629392 - DNA, 25 bp, Homo sapien
atctttcccagcagaaggtcacaat

SEQ ID NO: 629393 - DNA, 25 bp, Homo sapien
aggtcacaatgtatttgcctccctg

SEQ ID NO: 629394 - DNA, 25 bp, Homo sapien
aatgtatttgcctccctgttgagat

SEQ ID NO: 629395 - DNA, 25 bp, Homo sapien
tgagatcaactgagcctccaaggcc

SEQ ID NO: 629396 - DNA, 25 bp, Homo sapien
taatttgaatcaggtttctcacact

SEQ ID NO: 629397 - DNA, 25 bp, Homo sapien
aatttgaatcaggtttctcacactc

SEQ ID NO: 629398 - DNA, 25 bp, Homo sapien
atttgaatcaggtttctcacactca

SEQ ID NO: 629399 - DNA, 25 bp, Homo sapien
tttgaatcaggtttctcacactcat

SEQ ID NO: 629400 - DNA, 25 bp, Homo sapien
ttgaatcaggtttctcacactcatg

SEQ ID NO: 629401 - DNA, 25 bp, Homo sapien
tgaatcaggtttctcacactcatga

SEQ ID NO: 629402 - DNA, 25 bp, Homo sapien
gaatcaggtttctcacactcatgaa

SEQ ID NO: 629403 - DNA, 25 bp, Homo sapien
aatcaggtttctcacactcatgaaa

SEQ ID NO: 629404 - DNA, 25 bp, Homo sapien
tgaaaattgcatgttgaaaaaggaa

SEQ ID NO: 629405 - DNA, 25 bp, Homo sapien
aataaatactttgaggacattaaga

SEQ ID NO: 629406 - DNA, 25 bp, Homo sapien
atactttgaggacattaagatttta

SEQ ID NO: 629407 - DNA, 25 bp, Homo sapien
aaaacctttatgtggtgctccctca

SEQ ID NO: 629408 - DNA, 25 bp, Homo sapien
ctggcatggtttcttgtttgaactc

SEQ ID NO: 629409 - DNA, 25 bp, Homo sapien
cttgtttgaactctttcttcttcgt

SEQ ID NO: 629410 - DNA, 25 bp, Homo sapien
ttcttcttcgtggaacatacacttg

SEQ ID NO: 629411 - DNA, 25 bp, Homo sapien
ggaacatacacttgcctggaccggg

SEQ ID NO: 629412 - DNA, 25 bp, Homo sapien
gctgtgggctgagcagtgttccctt

SEQ ID NO: 629413 - DNA, 25 bp, Homo sapien
acaactttgatacagtggagggaaa

SEQ ID NO: 629414 - DNA, 25 bp, Homo sapien
aaatttaagtgtccccttctatgag

SEQ ID NO: 629415 - DNA, 25 bp, Homo sapien
ggacattatgaccagaaactcagta

SEQ ID NO: 629416 - DNA, 25 bp, Homo sapien
tggacttggaccactggctgtgcaa

SEQ ID NO: 629417 - DNA, 25 bp, Homo sapien
actggctgtgcaatctctattttca

SEQ ID NO: 629418 - DNA, 25 bp, Homo sapien
taaaaacagcgttgggccggttgcg

SEQ ID NO: 629419 - DNA, 25 bp, Homo sapien
aaacagcgttgggccggttgcggtg

SEQ ID NO: 629420 - DNA, 25 bp, Homo sapien
aacagcgttgggccggttgcggtgg

SEQ ID NO: 629421 - DNA, 25 bp, Homo sapien
acagcgttgggccggttgcggtggc

SEQ ID NO: 629422 - DNA, 25 bp, Homo sapien
cagcgttgggccggttgcggtggct

SEQ ID NO: 629423 - DNA, 25 bp, Homo sapien
agcgttgggccggttgcggtggctc

SEQ ID NO: 629424 - DNA, 25 bp, Homo sapien
cctggctaacttggtgaaacatcat

SEQ ID NO: 629425 - DNA, 25 bp, Homo sapien
ctggctaacttggtgaaacatcatc

SEQ ID NO: 629426 - DNA, 25 bp, Homo sapien
tggctaacttggtgaaacatcatct

SEQ ID NO: 629427 - DNA, 25 bp, Homo sapien
ggctaacttggtgaaacatcatctc

SEQ ID NO: 629428 - DNA, 25 bp, Homo sapien
gctaacttggtgaaacatcatctct

SEQ ID NO: 629429 - DNA, 25 bp, Homo sapien
gaagagagcttgataactgtgttct

SEQ ID NO: 629430 - DNA, 25 bp, Homo sapien
agagagcttgataactgtgttctat

SEQ ID NO: 629431 - DNA, 25 bp, Homo sapien
agagcttgataactgtgttctatgt

SEQ ID NO: 629432 - DNA, 25 bp, Homo sapien
gataactgtgttctatgtggatcca

SEQ ID NO: 629433 - DNA, 25 bp, Homo sapien
gcattacaactgataagtgaaagaa

SEQ ID NO: 629434 - DNA, 25 bp, Homo sapien
ggattgctaacagctgtacaaactt

SEQ ID NO: 629435 - DNA, 25 bp, Homo sapien
attgctaacagctgtacaaacttag

SEQ ID NO: 629436 - DNA, 25 bp, Homo sapien
gaacagattttccatcgaagcctcc

SEQ ID NO: 629437 - DNA, 25 bp, Homo sapien
aacagattttccatcgaagcctcct

SEQ ID NO: 629438 - DNA, 25 bp, Homo sapien
acagattttccatcgaagcctcctg

SEQ ID NO: 629439 - DNA, 25 bp, Homo sapien
tccatcgaagcctcctgaagaaaca

SEQ ID NO: 629440 - DNA, 25 bp, Homo sapien
gatgatattcacactgttaattcca

SEQ ID NO: 629441 - DNA, 25 bp, Homo sapien
gttaattccaataaagacagagtag

SEQ ID NO: 629442 - DNA, 25 bp, Homo sapien
ggaatagcatgaagttgtcgatttt

SEQ ID NO: 629443 - DNA, 25 bp, Homo sapien
gaagttgtcgatttttaacaagtat

SEQ ID NO: 629444 - DNA, 25 bp, Homo sapien
gtcttttcactttcagatgagaatt

SEQ ID NO: 629445 - DNA, 25 bp, Homo sapien
ggttcactagatagtagttatccta

SEQ ID NO: 629446 - DNA, 25 bp, Homo sapien
gtagttatcctaattcagaagttca

SEQ ID NO: 629447 - DNA, 25 bp, Homo sapien
tgttgttttcagttacttgttgtag

SEQ ID NO: 629448 - DNA, 25 bp, Homo sapien
tttcagttacttgttgtagttttct

SEQ ID NO: 629449 - DNA, 25 bp, Homo sapien
gttttctttttggtgagtcttatga

SEQ ID NO: 629450 - DNA, 25 bp, Homo sapien
ttttggtgagtcttatgattggctt

SEQ ID NO: 629451 - DNA, 25 bp, Homo sapien
tgcgaatgacatttcaacgtgagat

SEQ ID NO: 629452 - DNA, 25 bp, Homo sapien
gggacatccagactgtatcagaaac

SEQ ID NO: 629453 - DNA, 25 bp, Homo sapien
aacaacttagtagacatattccaaa

SEQ ID NO: 629454 - DNA, 25 bp, Homo sapien
aaattatgacccacagggtgccgat

SEQ ID NO: 629455 - DNA, 25 bp, Homo sapien
tgacccacagggtgccgatcagtgt

SEQ ID NO: 629456 - DNA, 25 bp, Homo sapien
gccgatcagtgtgcagagaatgtct

SEQ ID NO: 629457 - DNA, 25 bp, Homo sapien
gagaatgtcttcatttacacacaaa

SEQ ID NO: 629458 - DNA, 25 bp, Homo sapien
caagacactcagcagaggttctcag

SEQ ID NO: 629459 - DNA, 25 bp, Homo sapien
tgcggaaggcttcgtgtgttcattt

SEQ ID NO: 629460 - DNA, 25 bp, Homo sapien
aaggcttcgtgtgttcatttttatt

SEQ ID NO: 629461 - DNA, 25 bp, Homo sapien
gctttataccatgagctgtgcttct

SEQ ID NO: 629462 - DNA, 25 bp, Homo sapien
ccgactaacaatttctaagcttagg

SEQ ID NO: 629463 - DNA, 25 bp, Homo sapien
ctaacaatttctaagcttaggtggg

SEQ ID NO: 629464 - DNA, 25 bp, Homo sapien
gacttttgtaactcagctcacatct

SEQ ID NO: 629465 - DNA, 25 bp, Homo sapien
gtaactcagctcacatctggccaat

SEQ ID NO: 629466 - DNA, 25 bp, Homo sapien
cagctcacatctggccaatcaggta

SEQ ID NO: 629467 - DNA, 25 bp, Homo sapien
gagctcattaaaataccaattagtc

SEQ ID NO: 629468 - DNA, 25 bp, Homo sapien
gaaataaatcatctctcgcctgaca

SEQ ID NO: 629469 - DNA, 25 bp, Homo sapien
ataaatcatctctcgcctgacagca

SEQ ID NO: 629470 - DNA, 25 bp, Homo sapien
tctctcgcctgacagcacagaggaa

SEQ ID NO: 629471 - DNA, 25 bp, Homo sapien
taaaccccaggcattcgagctggga

SEQ ID NO: 629472 - DNA, 25 bp, Homo sapien
aaccccaggcattcgagctgggagt

SEQ ID NO: 629473 - DNA, 25 bp, Homo sapien
ttgaggctcttaaattgtcctatcc

SEQ ID NO: 629474 - DNA, 25 bp, Homo sapien
attgtcctatcccagtggtcagagt

SEQ ID NO: 629475 - DNA, 25 bp, Homo sapien
agacagaggtagcattccagtccca

SEQ ID NO: 629476 - DNA, 25 bp, Homo sapien
aagtaggtggtgtgaggctcttcaa

SEQ ID NO: 629477 - DNA, 25 bp, Homo sapien
gtgaggctcttcaattgtcttatcc

SEQ ID NO: 629478 - DNA, 25 bp, Homo sapien
tgtcttatcccagtggtcagagtcc

SEQ ID NO: 629479 - DNA, 25 bp, Homo sapien
cagagggcccttggtttatttcact

SEQ ID NO: 629480 - DNA, 25 bp, Homo sapien
ttatttcactccagtcctgaagcag

SEQ ID NO: 629481 - DNA, 25 bp, Homo sapien
tcctgaagcaggtgggatactccct

SEQ ID NO: 629482 - DNA, 25 bp, Homo sapien
gatactccctgctgcctacagttga

SEQ ID NO: 629483 - DNA, 25 bp, Homo sapien
ccagaacccttgtgtgtcttctgtg

SEQ ID NO: 629484 - DNA, 25 bp, Homo sapien
gaagaaccaaacaagggctgggctt

SEQ ID NO: 629485 - DNA, 25 bp, Homo sapien
aagaaccaaacaagggctgggcttg

SEQ ID NO: 629486 - DNA, 25 bp, Homo sapien
agaaccaaacaagggctgggcttgg

SEQ ID NO: 629487 - DNA, 25 bp, Homo sapien
gaaccaaacaagggctgggcttggt

SEQ ID NO: 629488 - DNA, 25 bp, Homo sapien
aaccaaacaagggctgggcttggtg

SEQ ID NO: 629489 - DNA, 25 bp, Homo sapien
aaatataaaaactatccgggcatag

SEQ ID NO: 629490 - DNA, 25 bp, Homo sapien
aatataaaaactatccgggcatagt

SEQ ID NO: 629491 - DNA, 25 bp, Homo sapien
atataaaaactatccgggcatagtg

SEQ ID NO: 629492 - DNA, 25 bp, Homo sapien
tataaaaactatccgggcatagtgg

SEQ ID NO: 629493 - DNA, 25 bp, Homo sapien
ataaaaactatccgggcatagtggt

SEQ ID NO: 629494 - DNA, 25 bp, Homo sapien
taaaaactatccgggcatagtggtg

SEQ ID NO: 629495 - DNA, 25 bp, Homo sapien
ttctcacctccatagtttctgatga

SEQ ID NO: 629496 - DNA, 25 bp, Homo sapien
gatgagcactctgtagtcattcaca

SEQ ID NO: 629497 - DNA, 25 bp, Homo sapien
gtcattcacaatgttctcttgtaag

SEQ ID NO: 629498 - DNA, 25 bp, Homo sapien
agtaatgtgccattattctctggct

SEQ ID NO: 629499 - DNA, 25 bp, Homo sapien
ttctctggctactcacaagatttct

SEQ ID NO: 629500 - DNA, 25 bp, Homo sapien
gatttctttaactttagctttcagc

SEQ ID NO: 629501 - DNA, 25 bp, Homo sapien
ttagctttcagcagtttgattatgg

SEQ ID NO: 629502 - DNA, 25 bp, Homo sapien
gattatggtaagtctgggcaatgat

SEQ ID NO: 629503 - DNA, 25 bp, Homo sapien
gtgtttatcctgtttagagtttgct

SEQ ID NO: 629504 - DNA, 25 bp, Homo sapien
tagagtttgctgaggtttttgaacc

SEQ ID NO: 629505 - DNA, 25 bp, Homo sapien
tgtaggtttacgtctttcaccaaat

SEQ ID NO: 629506 - DNA, 25 bp, Homo sapien
aaactgttctgcctataagccttga

SEQ ID NO: 629507 - DNA, 25 bp, Homo sapien
ataagccttgaagtgccagggaatt

SEQ ID NO: 629508 - DNA, 25 bp, Homo sapien
acagtgactgatagcattgataacg

SEQ ID NO: 629509 - DNA, 25 bp, Homo sapien
gcattgataacgatacccaagcttc

SEQ ID NO: 629510 - DNA, 25 bp, Homo sapien
ggtgggataactgagctgcttgttc

SEQ ID NO: 629511 - DNA, 25 bp, Homo sapien
gagctgcttgttctataccatgttc

SEQ ID NO: 629512 - DNA, 25 bp, Homo sapien
ataccatgttctagagtttctccca

SEQ ID NO: 629513 - DNA, 25 bp, Homo sapien
gagtttctcccatgagtttaggttc

SEQ ID NO: 629514 - DNA, 25 bp, Homo sapien
gtttaggttctaatcatccacatgt

SEQ ID NO: 629515 - DNA, 25 bp, Homo sapien
gcttgataagaaaccttcattgact

SEQ ID NO: 629516 - DNA, 25 bp, Homo sapien
ttcattgactccttgtctcacttcc

SEQ ID NO: 629517 - DNA, 25 bp, Homo sapien
gtttgggaggctgagcctggtggat

SEQ ID NO: 629518 - DNA, 25 bp, Homo sapien
gggaggctgagcctggtggatcatg

SEQ ID NO: 629519 - DNA, 25 bp, Homo sapien
ggctgagcctggtggatcatgagct

SEQ ID NO: 629520 - DNA, 25 bp, Homo sapien
gctgagcctggtggatcatgagctc

SEQ ID NO: 629521 - DNA, 25 bp, Homo sapien
ctgagcctggtggatcatgagctca

SEQ ID NO: 629522 - DNA, 25 bp, Homo sapien
tgagcctggtggatcatgagctcag

SEQ ID NO: 629523 - DNA, 25 bp, Homo sapien
gagcctggtggatcatgagctcagg

SEQ ID NO: 629524 - DNA, 25 bp, Homo sapien
agcctggtggatcatgagctcagga

SEQ ID NO: 629525 - DNA, 25 bp, Homo sapien
taatgggtacaaacgtagatagaag

SEQ ID NO: 629526 - DNA, 25 bp, Homo sapien
ggtacaaacgtagatagaaggaata

SEQ ID NO: 629527 - DNA, 25 bp, Homo sapien
ttgaggtgatagatatcctaaacac

SEQ ID NO: 629528 - DNA, 25 bp, Homo sapien
gtgatagatatcctaaacaccctga

SEQ ID NO: 629529 - DNA, 25 bp, Homo sapien
gatagatatcctaaacaccctgatt

SEQ ID NO: 629530 - DNA, 25 bp, Homo sapien
tagatatcctaaacaccctgatttg

SEQ ID NO: 629531 - DNA, 25 bp, Homo sapien
tatgcatatatcaaactaccacacc

SEQ ID NO: 629532 - DNA, 25 bp, Homo sapien
atatatcaaactaccacaccccata

SEQ ID NO: 629533 - DNA, 25 bp, Homo sapien
tatcaaactaccacaccccataaat

SEQ ID NO: 629534 - DNA, 25 bp, Homo sapien
caaactaccacaccccataaatatg

SEQ ID NO: 629535 - DNA, 25 bp, Homo sapien
aataaaattgcaatttcctgcatgc

SEQ ID NO: 629536 - DNA, 25 bp, Homo sapien
aaacccattctcaggtcagtgctcg

SEQ ID NO: 629537 - DNA, 25 bp, Homo sapien
attctcaggtcagtgctcgcaatgt

SEQ ID NO: 629538 - DNA, 25 bp, Homo sapien
agtgctcgcaatgttcttatgttca

SEQ ID NO: 629539 - DNA, 25 bp, Homo sapien
atgttcttatgttcactgtgtcggg

SEQ ID NO: 629540 - DNA, 25 bp, Homo sapien
cttatgttcactgtgtcgggaagtt

SEQ ID NO: 629541 - DNA, 25 bp, Homo sapien
gtcgggaagttccatgaacacacaa

SEQ ID NO: 629542 - DNA, 25 bp, Homo sapien
gaacacacaaggcaacatcataagt

SEQ ID NO: 629543 - DNA, 25 bp, Homo sapien
aaccttcagatttggtgttagaact

SEQ ID NO: 629544 - DNA, 25 bp, Homo sapien
tttggtgttagaactcagagctgtc

SEQ ID NO: 629545 - DNA, 25 bp, Homo sapien
agctgtcatccttgattcagatatt

SEQ ID NO: 629546 - DNA, 25 bp, Homo sapien
ttatgtgaacttaaacctctttgta

SEQ ID NO: 629547 - DNA, 25 bp, Homo sapien
aactgggtgcttatgagtggcaaga

SEQ ID NO: 629548 - DNA, 25 bp, Homo sapien
gtggcaagaatggtcagctatgaat

SEQ ID NO: 629549 - DNA, 25 bp, Homo sapien
gaatggtcatatacgttatgttacg

SEQ ID NO: 629550 - DNA, 25 bp, Homo sapien
acatggatggcgttcctctctggag

SEQ ID NO: 629551 - DNA, 25 bp, Homo sapien
gagggcccctagagggctgacaaca

SEQ ID NO: 629552 - DNA, 25 bp, Homo sapien
acatttggcctctgattcatagtca

SEQ ID NO: 629553 - DNA, 25 bp, Homo sapien
ggcctctgattcatagtcacttaga

SEQ ID NO: 629554 - DNA, 25 bp, Homo sapien
ttagacacacgcacttttgcacttt

SEQ ID NO: 629555 - DNA, 25 bp, Homo sapien
acttttgcactttctcctgtgatat

SEQ ID NO: 629556 - DNA, 25 bp, Homo sapien
ctttctcctgtgatatgatattcca

SEQ ID NO: 629557 - DNA, 25 bp, Homo sapien
ttaaaacaagccaacaggcacccac

SEQ ID NO: 629558 - DNA, 25 bp, Homo sapien
atcaggtttctcacactcatgaaag

SEQ ID NO: 629559 - DNA, 25 bp, Homo sapien
atgatctctttcatgaaaattgcat

SEQ ID NO: 629560 - DNA, 25 bp, Homo sapien
taaaactggaagtagccacactgaa

SEQ ID NO: 629561 - DNA, 25 bp, Homo sapien
acactgaaacatcaacaccaggtga

SEQ ID NO: 629562 - DNA, 25 bp, Homo sapien
gaatgctgaacttcaaatgacccta

SEQ ID NO: 629563 - DNA, 25 bp, Homo sapien
caaatgaccctaaaactgaaacaga

SEQ ID NO: 629564 - DNA, 25 bp, Homo sapien
aaacagtaacaaaaagggcatctca

SEQ ID NO: 629565 - DNA, 25 bp, Homo sapien
aacaaaaagggcatctcagtataga

SEQ ID NO: 629566 - DNA, 25 bp, Homo sapien
ggcatctcagtatagagagcagctt

SEQ ID NO: 629567 - DNA, 25 bp, Homo sapien
cagtatagagagcagcttaaagttc

SEQ ID NO: 629568 - DNA, 25 bp, Homo sapien
agcagcttaaagttctgacggcaga

SEQ ID NO: 629569 - DNA, 25 bp, Homo sapien
aggaaaattatgctctactgtgtat

SEQ ID NO: 629570 - DNA, 25 bp, Homo sapien
aagctattcaaagaagacactacaa

SEQ ID NO: 629571 - DNA, 25 bp, Homo sapien
aaaacacttcatgcagatgtatcaa

SEQ ID NO: 629572 - DNA, 25 bp, Homo sapien
gtatcaattattagtatctcatcac

SEQ ID NO: 629573 - DNA, 25 bp, Homo sapien
gtatctcatcactgtatggcgttct

SEQ ID NO: 629574 - DNA, 25 bp, Homo sapien
tcatcactgtatggcgttcttaact

SEQ ID NO: 629575 - DNA, 25 bp, Homo sapien
gtatggcgttcttaactaagttgaa

SEQ ID NO: 629576 - DNA, 25 bp, Homo sapien
gaaatatgtgttcattcacccaccc

SEQ ID NO: 629577 - DNA, 25 bp, Homo sapien
cactgaacacctattttgtgccaga

SEQ ID NO: 629578 - DNA, 25 bp, Homo sapien
gtgccagacgttgttctggacacta

SEQ ID NO: 629579 - DNA, 25 bp, Homo sapien
gacgttgttctggacactagggatc

SEQ ID NO: 629580 - DNA, 25 bp, Homo sapien
tctctttcagatatgccatgaatta

SEQ ID NO: 629581 - DNA, 25 bp, Homo sapien
gaattaaatcagaatcccacagaga

SEQ ID NO: 629582 - DNA, 25 bp, Homo sapien
atcagaatcccacagagaacagttt

SEQ ID NO: 629583 - DNA, 25 bp, Homo sapien
acagagaacagtttggtcacagttt

SEQ ID NO: 629584 - DNA, 25 bp, Homo sapien
cagtttggtcacagtttgaaggcat

SEQ ID NO: 629585 - DNA, 25 bp, Homo sapien
gactaattttatccttgaaagtatt

SEQ ID NO: 629586 - DNA, 25 bp, Homo sapien
agtattaatggtccccttatctcaa

SEQ ID NO: 629587 - DNA, 25 bp, Homo sapien
aatggtccccttatctcaatgactg

SEQ ID NO: 629588 - DNA, 25 bp, Homo sapien
cttatctcaatgactggccagcttg

SEQ ID NO: 629589 - DNA, 25 bp, Homo sapien
gactggccagcttgtattatcttta

SEQ ID NO: 629590 - DNA, 25 bp, Homo sapien
ggccagcttgtattatctttacatc

SEQ ID NO: 629591 - DNA, 25 bp, Homo sapien
ctccatactgttctaatttacattc

SEQ ID NO: 629592 - DNA, 25 bp, Homo sapien
accaacagcgtatgaggattcccct

SEQ ID NO: 629593 - DNA, 25 bp, Homo sapien
acagcgtatgaggattcccctttct

SEQ ID NO: 629594 - DNA, 25 bp, Homo sapien
gcgtatgaggattcccctttctcca

SEQ ID NO: 629595 - DNA, 25 bp, Homo sapien
tttctccacatcttcgccagatctg

SEQ ID NO: 629596 - DNA, 25 bp, Homo sapien
cacatcttcgccagatctgttatcg

SEQ ID NO: 629597 - DNA, 25 bp, Homo sapien
atcttcgccagatctgttatcgcct

SEQ ID NO: 629598 - DNA, 25 bp, Homo sapien
cagatctgttatcgcctgcctttat

SEQ ID NO: 629599 - DNA, 25 bp, Homo sapien
tctgttatcgcctgcctttatttac

SEQ ID NO: 629600 - DNA, 25 bp, Homo sapien
tagacatgcaatctgtaataatcat

SEQ ID NO: 629601 - DNA, 25 bp, Homo sapien
attctttgtgttaccaacaattcaa

SEQ ID NO: 629602 - DNA, 25 bp, Homo sapien
atggttttgggatagatttttctgg

SEQ ID NO: 629603 - DNA, 25 bp, Homo sapien
tcccttctagctctctgcagattat

SEQ ID NO: 629604 - DNA, 25 bp, Homo sapien
ctgcagattatcagagccgccactg

SEQ ID NO: 629605 - DNA, 25 bp, Homo sapien
agagccgccactgcagggatttgct

SEQ ID NO: 629606 - DNA, 25 bp, Homo sapien
ggatttgctcccgtgggcctatatg

SEQ ID NO: 629607 - DNA, 25 bp, Homo sapien
gtgggcctatatgtctccccagata

SEQ ID NO: 629608 - DNA, 25 bp, Homo sapien
gataccttcctaaaactattagctt

SEQ ID NO: 629609 - DNA, 25 bp, Homo sapien
actattagcttttatctgtctgtgt

SEQ ID NO: 629610 - DNA, 25 bp, Homo sapien
tgtgtattcccctgttgtgaatggg

SEQ ID NO: 629611 - DNA, 25 bp, Homo sapien
ggttcttgataataaatacctcagg

SEQ ID NO: 629612 - DNA, 25 bp, Homo sapien
atacctcaggtttcacagagtaatc

SEQ ID NO: 629613 - DNA, 25 bp, Homo sapien
atcttttttctgaagaccaatctca

SEQ ID NO: 629614 - DNA, 25 bp, Homo sapien
ttttctgaagaccaatctcatgctt

SEQ ID NO: 629615 - DNA, 25 bp, Homo sapien
tctgaagaccaatctcatgctttag

SEQ ID NO: 629616 - DNA, 25 bp, Homo sapien
aagaccaatctcatgctttaggttg

SEQ ID NO: 629617 - DNA, 25 bp, Homo sapien
gaccaatctcatgctttaggttgaa

SEQ ID NO: 629618 - DNA, 25 bp, Homo sapien
ccaatctcatgctttaggttgaaaa

SEQ ID NO: 629619 - DNA, 25 bp, Homo sapien
taggttgaaaagttgggaatccaga

SEQ ID NO: 629620 - DNA, 25 bp, Homo sapien
taatatttgttcattctcacttcca

SEQ ID NO: 629621 - DNA, 25 bp, Homo sapien
aatatttgttcattctcacttccaa

SEQ ID NO: 629622 - DNA, 25 bp, Homo sapien
cccaccatcaccgaggcgggcaaat

SEQ ID NO: 629623 - DNA, 25 bp, Homo sapien
ctgggcgtggtagtaggcgccggta

SEQ ID NO: 629624 - DNA, 25 bp, Homo sapien
atgccaccccaaaaccaatgaaatg

SEQ ID NO: 629625 - DNA, 25 bp, Homo sapien
cttggtgacctctggtacagtagta

SEQ ID NO: 629626 - DNA, 25 bp, Homo sapien
ggtacagtagtagcaagcagtctaa

SEQ ID NO: 629627 - DNA, 25 bp, Homo sapien
agcaagcagtctaacacatgtctaa

SEQ ID NO: 629628 - DNA, 25 bp, Homo sapien
acatgtctaagtgagttcctaggaa

SEQ ID NO: 629629 - DNA, 25 bp, Homo sapien
ggaggagctgtcaaagaactttaat

SEQ ID NO: 629630 - DNA, 25 bp, Homo sapien
acagaaagtcacaccaagccagata

SEQ ID NO: 629631 - DNA, 25 bp, Homo sapien
aagccagataatattcaagttgtcg

SEQ ID NO: 629632 - DNA, 25 bp, Homo sapien
caagttgtcgaaaatcagtcataaa

SEQ ID NO: 629633 - DNA, 25 bp, Homo sapien
gaatgactgctggttgttcatcaag

SEQ ID NO: 629634 - DNA, 25 bp, Homo sapien
gttcatcaaggacaaatgccacccc

SEQ ID NO: 629635 - DNA, 25 bp, Homo sapien
gagcttgcagtgacctgatatcgca

SEQ ID NO: 629636 - DNA, 25 bp, Homo sapien
gcttgcagtgacctgatatcgcacc

SEQ ID NO: 629637 - DNA, 25 bp, Homo sapien
cttgcagtgacctgatatcgcacca

SEQ ID NO: 629638 - DNA, 25 bp, Homo sapien
ttgcagtgacctgatatcgcaccac

SEQ ID NO: 629639 - DNA, 25 bp, Homo sapien
tgcagtgacctgatatcgcaccact

SEQ ID NO: 629640 - DNA, 25 bp, Homo sapien
gcagtgacctgatatcgcaccactg

SEQ ID NO: 629641 - DNA, 25 bp, Homo sapien
cagtgacctgatatcgcaccactgc

SEQ ID NO: 629642 - DNA, 25 bp, Homo sapien
agtgacctgatatcgcaccactgca

SEQ ID NO: 629643 - DNA, 25 bp, Homo sapien
aaggctcagtgaataaccaggtgaa

SEQ ID NO: 629644 - DNA, 25 bp, Homo sapien
gtgttctgagctgaggtcacagaga

SEQ ID NO: 629645 - DNA, 25 bp, Homo sapien
tatgaccaacttgagaagcccgaag

SEQ ID NO: 629646 - DNA, 25 bp, Homo sapien
aagcccgaagaagaacagcatttta

SEQ ID NO: 629647 - DNA, 25 bp, Homo sapien
cagcattttaatatacagactcaag

SEQ ID NO: 629648 - DNA, 25 bp, Homo sapien
atgtaattataacctgacgagtgct

SEQ ID NO: 629649 - DNA, 25 bp, Homo sapien
taacctgacgagtgctactacggaa

SEQ ID NO: 629650 - DNA, 25 bp, Homo sapien
gctactacggaaaattacacagaat

SEQ ID NO: 629651 - DNA, 25 bp, Homo sapien
ggaaacgtttcctgagtgaactgag

SEQ ID NO: 629652 - DNA, 25 bp, Homo sapien
agtgaactgagacccgaaggctcag

SEQ ID NO: 629653 - DNA, 25 bp, Homo sapien
agacccgaaggctcagtgaataacc

SEQ ID NO: 629654 - DNA, 25 bp, Homo sapien
gaactgacaacgctgtcagccggaa

SEQ ID NO: 629655 - DNA, 25 bp, Homo sapien
gctgtcagccggaatacaggtttat

SEQ ID NO: 629656 - DNA, 25 bp, Homo sapien
acaggtttattctatgttgctccag

SEQ ID NO: 629657 - DNA, 25 bp, Homo sapien
tattctatgttgctccagaggccaa

SEQ ID NO: 629658 - DNA, 25 bp, Homo sapien
tgctccagaggccaaaagtaagaat

SEQ ID NO: 629659 - DNA, 25 bp, Homo sapien
ggtacctggaaatgaggtggtccac

SEQ ID NO: 629660 - DNA, 25 bp, Homo sapien
aaatgaggtggtccacgctgtgctc

SEQ ID NO: 629661 - DNA, 25 bp, Homo sapien
gtggtccacgctgtgctcgcatcgg

SEQ ID NO: 629662 - DNA, 25 bp, Homo sapien
ccccagagttttcaagggcaagcca

SEQ ID NO: 629663 - DNA, 25 bp, Homo sapien
agtggcctcgtgtccagttaggacg

SEQ ID NO: 629664 - DNA, 25 bp, Homo sapien
ctcgtgtccagttaggacgggtgca

SEQ ID NO: 629665 - DNA, 25 bp, Homo sapien
agaggagggagaggcttccttagaa

SEQ ID NO: 629666 - DNA, 25 bp, Homo sapien
aaacagccagcgaggctcagtggcc

SEQ ID NO: 629667 - DNA, 25 bp, Homo sapien
cagccagcgaggctcagtggcccat

SEQ ID NO: 629668 - DNA, 25 bp, Homo sapien
agccagcgaggctcagtggcccatg

SEQ ID NO: 629669 - DNA, 25 bp, Homo sapien
gccagcgaggctcagtggcccatgc

SEQ ID NO: 629670 - DNA, 25 bp, Homo sapien
ccagcgaggctcagtggcccatgcc

SEQ ID NO: 629671 - DNA, 25 bp, Homo sapien
cagcgaggctcagtggcccatgcct

SEQ ID NO: 629672 - DNA, 25 bp, Homo sapien
aattaaccagacatgatggtgggct

SEQ ID NO: 629673 - DNA, 25 bp, Homo sapien
attaaccagacatgatggtgggctc

SEQ ID NO: 629674 - DNA, 25 bp, Homo sapien
cagacatgatggtgggctcctgtag

SEQ ID NO: 629675 - DNA, 25 bp, Homo sapien
agacatgatggtgggctcctgtagt

SEQ ID NO: 629676 - DNA, 25 bp, Homo sapien
ttgaacctgggtgctcaagggacac

SEQ ID NO: 629677 - DNA, 25 bp, Homo sapien
caagggacaccctaggctgcttatc

SEQ ID NO: 629678 - DNA, 25 bp, Homo sapien
taggctgcttatcccactgattctg

SEQ ID NO: 629679 - DNA, 25 bp, Homo sapien
atcccactgattctgatctgactgt

SEQ ID NO: 629680 - DNA, 25 bp, Homo sapien
gattctgatctgactgtgttaagta

SEQ ID NO: 629681 - DNA, 25 bp, Homo sapien
ttcatcatgcagaaccaaaactggt

SEQ ID NO: 629682 - DNA, 25 bp, Homo sapien
aactggtgtagagtcttaaatgacc

SEQ ID NO: 629683 - DNA, 25 bp, Homo sapien
aatgacctgggtatctctacgcaga

SEQ ID NO: 629684 - DNA, 25 bp, Homo sapien
tctacgcagaagaaagcgctttcca

SEQ ID NO: 629685 - DNA, 25 bp, Homo sapien
agaaagcgctttccatgtaaaagga

SEQ ID NO: 629686 - DNA, 25 bp, Homo sapien
gattaacttgaacctgggtgctcaa

SEQ ID NO: 629687 - DNA, 25 bp, Homo sapien
ggacggcctaatcgagcgcatgtac

SEQ ID NO: 629688 - DNA, 25 bp, Homo sapien
taatcgagcgcatgtacccaatccc

SEQ ID NO: 629689 - DNA, 25 bp, Homo sapien
agaagccccggcagcggtctgccgt

SEQ ID NO: 629690 - DNA, 25 bp, Homo sapien
ttccctctcagccagatgttcttgt

SEQ ID NO: 629691 - DNA, 25 bp, Homo sapien
agatgttcttgtgctgctagctcat

SEQ ID NO: 629692 - DNA, 25 bp, Homo sapien
ttgtgctgctagctcatatctctct

SEQ ID NO: 629693 - DNA, 25 bp, Homo sapien
tatctctctcccgtacaatacaaag

SEQ ID NO: 629694 - DNA, 25 bp, Homo sapien
gtacaatacaaagacgggatgcgtt

SEQ ID NO: 629695 - DNA, 25 bp, Homo sapien
ggatgcgtttgaggtttgaacacat

SEQ ID NO: 629696 - DNA, 25 bp, Homo sapien
tgagttcaagcctcaccacagactg

SEQ ID NO: 629697 - DNA, 25 bp, Homo sapien
agcctcaccacagactgttctgaag

SEQ ID NO: 629698 - DNA, 25 bp, Homo sapien
ttgttttttctaagactgccggcat

SEQ ID NO: 629699 - DNA, 25 bp, Homo sapien
gttttttctaagactgccggcatcc

SEQ ID NO: 629700 - DNA, 25 bp, Homo sapien
ttttctaagactgccggcatccctt

SEQ ID NO: 629701 - DNA, 25 bp, Homo sapien
gactgccggcatcccttctttctag

SEQ ID NO: 629702 - DNA, 25 bp, Homo sapien
tattttcatggataagatcgctagg

SEQ ID NO: 629703 - DNA, 25 bp, Homo sapien
gagtatttttctgatggcacgatgc

SEQ ID NO: 629704 - DNA, 25 bp, Homo sapien
gtatttttctgatggcacgatgcta

SEQ ID NO: 629705 - DNA, 25 bp, Homo sapien
ttctgatggcacgatgctactactt

SEQ ID NO: 629706 - DNA, 25 bp, Homo sapien
atggcacgatgctactactttctga

SEQ ID NO: 629707 - DNA, 25 bp, Homo sapien
ggcacgatgctactactttctgata

SEQ ID NO: 629708 - DNA, 25 bp, Homo sapien
cattctcaatatttgaatctatgaa

SEQ ID NO: 629709 - DNA, 25 bp, Homo sapien
ggaatttgaagagagcttgataact

SEQ ID NO: 629710 - DNA, 25 bp, Homo sapien
gaagagagcttgataactgtgttct

SEQ ID NO: 629711 - DNA, 25 bp, Homo sapien
agagagcttgataactgtgttctat

SEQ ID NO: 629712 - DNA, 25 bp, Homo sapien
gagagcttgataactgtgttctatg

SEQ ID NO: 629713 - DNA, 25 bp, Homo sapien
agagcttgataactgtgttctatgt

SEQ ID NO: 629714 - DNA, 25 bp, Homo sapien
ggattgctaacagctgtacaaactt

SEQ ID NO: 629715 - DNA, 25 bp, Homo sapien
gattgctaacagctgtacaaactta

SEQ ID NO: 629716 - DNA, 25 bp, Homo sapien
attgctaacagctgtacaaacttag

SEQ ID NO: 629717 - DNA, 25 bp, Homo sapien
gaacagattttccatcgaagcctcc

SEQ ID NO: 629718 - DNA, 25 bp, Homo sapien
aacagattttccatcgaagcctcct

SEQ ID NO: 629719 - DNA, 25 bp, Homo sapien
acagattttccatcgaagcctcctg

SEQ ID NO: 629720 - DNA, 25 bp, Homo sapien
gaaaataattggacagagcctttga

SEQ ID NO: 629721 - DNA, 25 bp, Homo sapien
gacagagcctttgataatccaactt

SEQ ID NO: 629722 - DNA, 25 bp, Homo sapien
ctttgataatccaacttttccaggg

SEQ ID NO: 629723 - DNA, 25 bp, Homo sapien
gatgcccaaggaatggcttcagtgt

SEQ ID NO: 629724 - DNA, 25 bp, Homo sapien
ttatctgaaaatgctgatgggactt

SEQ ID NO: 629725 - DNA, 25 bp, Homo sapien
gctgatgggacttgtcatgctctac

SEQ ID NO: 629726 - DNA, 25 bp, Homo sapien
acttgtcatgctctacatacctggg

SEQ ID NO: 629727 - DNA, 25 bp, Homo sapien
tacctggggcccactaagaacaaag

SEQ ID NO: 629728 - DNA, 25 bp, Homo sapien
gaaaacaggttggataagcatgaaa

SEQ ID NO: 629729 - DNA, 25 bp, Homo sapien
aaaaatgatttctcacatagaagag

SEQ ID NO: 629730 - DNA, 25 bp, Homo sapien
tgattattgttagatttctgggcag

SEQ ID NO: 629731 - DNA, 25 bp, Homo sapien
gatatagcaaaaacatccatcaaaa

SEQ ID NO: 629732 - DNA, 25 bp, Homo sapien
caaaaatgtagctgatcaatgaaaa

SEQ ID NO: 629733 - DNA, 25 bp, Homo sapien
gtagtacgtataacaaatggtcttc

SEQ ID NO: 629734 - DNA, 25 bp, Homo sapien
caaatggtcttcaatggctgttaat

SEQ ID NO: 629735 - DNA, 25 bp, Homo sapien
ggtcttcaatggctgttaatataac

SEQ ID NO: 629736 - DNA, 25 bp, Homo sapien
aaaagatgaatgttctacaccaaat

SEQ ID NO: 629737 - DNA, 25 bp, Homo sapien
ttctacaccaaatattcatcgccac

SEQ ID NO: 629738 - DNA, 25 bp, Homo sapien
ctacaccaaatattcatcgccacat

SEQ ID NO: 629739 - DNA, 25 bp, Homo sapien
atattcatcgccacatatgcaaata

SEQ ID NO: 629740 - DNA, 25 bp, Homo sapien
tatgcaaatatcaccacacctaata

SEQ ID NO: 629741 - DNA, 25 bp, Homo sapien
tatcaccacacctaataagtttatt

SEQ ID NO: 629742 - DNA, 25 bp, Homo sapien
ctgccttatttgtgaccttctataa

SEQ ID NO: 629743 - DNA, 25 bp, Homo sapien
tgtgaccttctataattgccctacc

SEQ ID NO: 629744 - DNA, 25 bp, Homo sapien
taaaaggccatcatacatggtattt

SEQ ID NO: 629745 - DNA, 25 bp, Homo sapien
catggtatttttaacttctgtattt

SEQ ID NO: 629746 - DNA, 25 bp, Homo sapien
aagatcttgtcgttctgtcatgctc

SEQ ID NO: 629747 - DNA, 25 bp, Homo sapien
tcatgctcatcttctctactattga

SEQ ID NO: 629748 - DNA, 25 bp, Homo sapien
tactattgaccagaaccaacgcttg

SEQ ID NO: 629749 - DNA, 25 bp, Homo sapien
agaaccaacgcttgaactgcagaag

SEQ ID NO: 629750 - DNA, 25 bp, Homo sapien
gaactgcagaagcttctcagcattt

SEQ ID NO: 629751 - DNA, 25 bp, Homo sapien
tctcagcattttctcctaagaatga

SEQ ID NO: 629752 - DNA, 25 bp, Homo sapien
actataccagttgttgttattatct

SEQ ID NO: 629753 - DNA, 25 bp, Homo sapien
aaacagccagcgaggctcagtggcc

SEQ ID NO: 629754 - DNA, 25 bp, Homo sapien
aacagccagcgaggctcagtggccc

SEQ ID NO: 629755 - DNA, 25 bp, Homo sapien
acagccagcgaggctcagtggccca

SEQ ID NO: 629756 - DNA, 25 bp, Homo sapien
cagccagcgaggctcagtggcccat

SEQ ID NO: 629757 - DNA, 25 bp, Homo sapien
agccagcgaggctcagtggcccatg

SEQ ID NO: 629758 - DNA, 25 bp, Homo sapien
gccagcgaggctcagtggcccatgc

SEQ ID NO: 629759 - DNA, 25 bp, Homo sapien
ccagcgaggctcagtggcccatgcc

SEQ ID NO: 629760 - DNA, 25 bp, Homo sapien
cagcgaggctcagtggcccatgcct

SEQ ID NO: 629761 - DNA, 25 bp, Homo sapien
aattaaccagacatgatggtgggct

SEQ ID NO: 629762 - DNA, 25 bp, Homo sapien
attaaccagacatgatggtgggctc

SEQ ID NO: 629763 - DNA, 25 bp, Homo sapien
attctgttaaacactgtggcccttc

SEQ ID NO: 629764 - DNA, 25 bp, Homo sapien
gtggcccttctggaaacatgatggt

SEQ ID NO: 629765 - DNA, 25 bp, Homo sapien
atgatggtcttttcctgtagaggcc

SEQ ID NO: 629766 - DNA, 25 bp, Homo sapien
tcttccttttacttcctctgtgcca

SEQ ID NO: 629767 - DNA, 25 bp, Homo sapien
tgtgccaggtccatgggtaattccc

SEQ ID NO: 629768 - DNA, 25 bp, Homo sapien
ggtacctttctcataaattctatca

SEQ ID NO: 629769 - DNA, 25 bp, Homo sapien
gttttgattctcttctctacatctt

SEQ ID NO: 629770 - DNA, 25 bp, Homo sapien
tacatcttatttccccttggtgtag

SEQ ID NO: 629771 - DNA, 25 bp, Homo sapien
atttccccttggtgtagcacagtgg

SEQ ID NO: 629772 - DNA, 25 bp, Homo sapien
gcacagtggttgaaagcagggaatc

SEQ ID NO: 629773 - DNA, 25 bp, Homo sapien
ggaatctaaagccacagacctgagt

SEQ ID NO: 629774 - DNA, 25 bp, Homo sapien
agacagtaaatcatgtgaacccaca

SEQ ID NO: 629775 - DNA, 25 bp, Homo sapien
tgtgaacccacattccagacggtca

SEQ ID NO: 629776 - DNA, 25 bp, Homo sapien
acaccctccagtcttactgatataa

SEQ ID NO: 629777 - DNA, 25 bp, Homo sapien
actgatataacttcgtttctggcaa

SEQ ID NO: 629778 - DNA, 25 bp, Homo sapien
taacttcgtttctggcaaacaggcc

SEQ ID NO: 629779 - DNA, 25 bp, Homo sapien
ggcaaacaggccagctctctgatat

SEQ ID NO: 629780 - DNA, 25 bp, Homo sapien
aggccagctctctgatattaaagat

SEQ ID NO: 629781 - DNA, 25 bp, Homo sapien
ggaatcatatcttctgggtacccca

SEQ ID NO: 629782 - DNA, 25 bp, Homo sapien
atatcttctgggtaccccaactcat

SEQ ID NO: 629783 - DNA, 25 bp, Homo sapien
tacccactaagctcccaaatattat

SEQ ID NO: 629784 - DNA, 25 bp, Homo sapien
aagagagaggataagtgcacacaaa

SEQ ID NO: 629785 - DNA, 25 bp, Homo sapien
ggatataaaacctaggaatcaccat

SEQ ID NO: 629786 - DNA, 25 bp, Homo sapien
aacctaggaatcaccatctgatcga

SEQ ID NO: 629787 - DNA, 25 bp, Homo sapien
taggaatcaccatctgatcgaagat

SEQ ID NO: 629788 - DNA, 25 bp, Homo sapien
agatggagatgaatgacttcaccct

SEQ ID NO: 629789 - DNA, 25 bp, Homo sapien
aatgacttcaccctagggcaagaag

SEQ ID NO: 629790 - DNA, 25 bp, Homo sapien
gacttcaccctagggcaagaaggac

SEQ ID NO: 629791 - DNA, 25 bp, Homo sapien
tcaccctagggcaagaaggacttaa

SEQ ID NO: 629792 - DNA, 25 bp, Homo sapien
gatgagacactgaaacaatttgaag

SEQ ID NO: 629793 - DNA, 25 bp, Homo sapien
tggaaggtgagagtctgaggtccaa

SEQ ID NO: 629794 - DNA, 25 bp, Homo sapien
caccagttgttgaagaaccttgatc

SEQ ID NO: 629795 - DNA, 25 bp, Homo sapien
agttgttgaagaaccttgatcacag

SEQ ID NO: 629796 - DNA, 25 bp, Homo sapien
cttttaacatgagcagtccagatct

SEQ ID NO: 629797 - DNA, 25 bp, Homo sapien
tccagatctctcagcatgtcagact

SEQ ID NO: 629798 - DNA, 25 bp, Homo sapien
gatctctcagcatgtcagactgcag

SEQ ID NO: 629799 - DNA, 25 bp, Homo sapien
tctcagcatgtcagactgcagaaaa

SEQ ID NO: 629800 - DNA, 25 bp, Homo sapien
aaagttattagacacgacatgccgg

SEQ ID NO: 629801 - DNA, 25 bp, Homo sapien
attagacacgacatgccggatcgca

SEQ ID NO: 629802 - DNA, 25 bp, Homo sapien
gacatgccggatcgcacccttgcag

SEQ ID NO: 629803 - DNA, 25 bp, Homo sapien
acccttgcagctcaccaacaaaaat

SEQ ID NO: 629804 - DNA, 25 bp, Homo sapien
accaacaaaaattcaggctgccagc

SEQ ID NO: 629805 - DNA, 25 bp, Homo sapien
aaaattcaggctgccagcctctgca

SEQ ID NO: 629806 - DNA, 25 bp, Homo sapien
agcctctgcagaaccaaaaggaaat

SEQ ID NO: 629807 - DNA, 25 bp, Homo sapien
gaagtacagctttatgtttctttgt

SEQ ID NO: 629808 - DNA, 25 bp, Homo sapien
ggcttgcaagttgtaccaatattct

SEQ ID NO: 629809 - DNA, 25 bp, Homo sapien
aaatgctccattttatggcttactt

SEQ ID NO: 629810 - DNA, 25 bp, Homo sapien
gtgcatttttgcttctaatgagacc

SEQ ID NO: 629811 - DNA, 25 bp, Homo sapien
taatgagacctgactttctggccta

SEQ ID NO: 629812 - DNA, 25 bp, Homo sapien
gcctatttcaggactttacattgtt

SEQ ID NO: 629813 - DNA, 25 bp, Homo sapien
cattgttctgttggtctgtttttct

SEQ ID NO: 629814 - DNA, 25 bp, Homo sapien
tctgtttttctcctcctgtatcagt

SEQ ID NO: 629815 - DNA, 25 bp, Homo sapien
ctcctgtatcagtacctataatgtg

SEQ ID NO: 629816 - DNA, 25 bp, Homo sapien
tatatagggctagtttcccctcttg

SEQ ID NO: 629817 - DNA, 25 bp, Homo sapien
agtttcccctcttgactattcttat

SEQ ID NO: 629818 - DNA, 25 bp, Homo sapien
ttcttcaagcatctccattttgtgc

SEQ ID NO: 629819 - DNA, 25 bp, Homo sapien
gcatctccattttgtgctggtatca

SEQ ID NO: 629820 - DNA, 25 bp, Homo sapien
gtgctggtatcagcgtcttcagaac

SEQ ID NO: 629821 - DNA, 25 bp, Homo sapien
gcgtcttcagaacttcagttatctc

SEQ ID NO: 629822 - DNA, 25 bp, Homo sapien
gaacttcagttatctcaatggcaaa

SEQ ID NO: 629823 - DNA, 25 bp, Homo sapien
tctcaatggcaaagccagggcttct

SEQ ID NO: 629824 - DNA, 25 bp, Homo sapien
gggcttctggtacattatactgctg

SEQ ID NO: 629825 - DNA, 25 bp, Homo sapien
ctgatgttttttctctggttcctga

SEQ ID NO: 629826 - DNA, 25 bp, Homo sapien
ttttctctggttcctgaggctctac

SEQ ID NO: 629827 - DNA, 25 bp, Homo sapien
tgaggctctacctgcattacttggg

SEQ ID NO: 629828 - DNA, 25 bp, Homo sapien
ctacctgcattacttgggccagtgg

SEQ ID NO: 629829 - DNA, 25 bp, Homo sapien
gaagtgggactggaaacctcggatt

SEQ ID NO: 629830 - DNA, 25 bp, Homo sapien
aaacctcggattctattgtctcttc

SEQ ID NO: 629831 - DNA, 25 bp, Homo sapien
attctattgtctcttctctgtgaag

SEQ ID NO: 629832 - DNA, 25 bp, Homo sapien
tctgaacttgagcttggtaattact

SEQ ID NO: 629833 - DNA, 25 bp, Homo sapien
gtaattactgctcatttctcaacct

SEQ ID NO: 629834 - DNA, 25 bp, Homo sapien
tctcaaccttttccaagccacgtaa

SEQ ID NO: 629835 - DNA, 25 bp, Homo sapien
gaattgcgagatggtatgttcttca

SEQ ID NO: 629836 - DNA, 25 bp, Homo sapien
atgttcttcatcacgaggttgctat

SEQ ID NO: 629837 - DNA, 25 bp, Homo sapien
aagcaccaagcatggtccttggcat

SEQ ID NO: 629838 - DNA, 25 bp, Homo sapien
atgtacagcaagagagcttcaggct

SEQ ID NO: 629839 - DNA, 25 bp, Homo sapien
gactggcttccagcagaagtgggac

SEQ ID NO: 629840 - DNA, 25 bp, Homo sapien
atttgtgtaactttctaccagaaca

SEQ ID NO: 629841 - DNA, 25 bp, Homo sapien
tttggttacatacttctttgagagc

SEQ ID NO: 629842 - DNA, 25 bp, Homo sapien
tctttgagagcaactcttgattctg

SEQ ID NO: 629843 - DNA, 25 bp, Homo sapien
ctcttgattctgatagttacctaat

SEQ ID NO: 629844 - DNA, 25 bp, Homo sapien
gatagttacctaatgtacttgagtt

SEQ ID NO: 629845 - DNA, 25 bp, Homo sapien
gtacatttaattgcttgctacacca

SEQ ID NO: 629846 - DNA, 25 bp, Homo sapien
tgcttgctacaccatacaattatgt

SEQ ID NO: 629847 - DNA, 25 bp, Homo sapien
tgcttttacttttacaatctacttg

SEQ ID NO: 629848 - DNA, 25 bp, Homo sapien
aatctacttggctctaatactaata

SEQ ID NO: 629849 - DNA, 25 bp, Homo sapien
tactaatagtcgaatgtacccaatt

SEQ ID NO: 629850 - DNA, 25 bp, Homo sapien
gaatgtacccaatttgtatttgtgt

SEQ ID NO: 629851 - DNA, 25 bp, Homo sapien
aatagagactaaactagtgaggctg

SEQ ID NO: 629852 - DNA, 25 bp, Homo sapien
atagagactaaactagtgaggctgg

SEQ ID NO: 629853 - DNA, 25 bp, Homo sapien
tagagactaaactagtgaggctggt

SEQ ID NO: 629854 - DNA, 25 bp, Homo sapien
agagactaaactagtgaggctggtt

SEQ ID NO: 629855 - DNA, 25 bp, Homo sapien
gagactaaactagtgaggctggttg

SEQ ID NO: 629856 - DNA, 25 bp, Homo sapien
agactaaactagtgaggctggttgt

SEQ ID NO: 629857 - DNA, 25 bp, Homo sapien
gactaaactagtgaggctggttgtg

SEQ ID NO: 629858 - DNA, 25 bp, Homo sapien
actaaactagtgaggctggttgtgg

SEQ ID NO: 629859 - DNA, 25 bp, Homo sapien
ctaaactagtgaggctggttgtggt

SEQ ID NO: 629860 - DNA, 25 bp, Homo sapien
taaactagtgaggctggttgtggtg

SEQ ID NO: 629861 - DNA, 25 bp, Homo sapien
ctagtgaggctggttgtggtggctc

SEQ ID NO: 629862 - DNA, 25 bp, Homo sapien
acactggacaaatgagacatgagct

SEQ ID NO: 629863 - DNA, 25 bp, Homo sapien
atgagctcagcagctcagaggactg

SEQ ID NO: 629864 - DNA, 25 bp, Homo sapien
agaggaggcgttgctcaggtgctgg

SEQ ID NO: 629865 - DNA, 25 bp, Homo sapien
gggagggaagctgttcccctgacct

SEQ ID NO: 629866 - DNA, 25 bp, Homo sapien
cctcctgggctgctgtttagattgc

SEQ ID NO: 629867 - DNA, 25 bp, Homo sapien
ggctgctgtttagattgcctgacac

SEQ ID NO: 629868 - DNA, 25 bp, Homo sapien
tgctgtttagattgcctgacacggc

SEQ ID NO: 629869 - DNA, 25 bp, Homo sapien
gtttagattgcctgacacggcctcc

SEQ ID NO: 629870 - DNA, 25 bp, Homo sapien
gatctccatcttcattcgagtatgg

SEQ ID NO: 629871 - DNA, 25 bp, Homo sapien
ccatcttcattcgagtatggacggg

SEQ ID NO: 629872 - DNA, 25 bp, Homo sapien
gggctttcctggtgtctcgtctcct

SEQ ID NO: 629873 - DNA, 25 bp, Homo sapien
tggactccggaacacccgtggtgac

SEQ ID NO: 629874 - DNA, 25 bp, Homo sapien
gtgaccgccgggaccctgcctgtga

SEQ ID NO: 629875 - DNA, 25 bp, Homo sapien
ctgtgactctccaggactctgcgac

SEQ ID NO: 629876 - DNA, 25 bp, Homo sapien
caggactctgcgaccccgggatgga

SEQ ID NO: 629877 - DNA, 25 bp, Homo sapien
gcgaccccgggatggatattgcgat

SEQ ID NO: 629878 - DNA, 25 bp, Homo sapien
ccccgggatggatattgcgatgctg

SEQ ID NO: 629879 - DNA, 25 bp, Homo sapien
atattgcgatgctggtctcgaccct

SEQ ID NO: 629880 - DNA, 25 bp, Homo sapien
tgaaaccctccctcggatctgtgac

SEQ ID NO: 629881 - DNA, 25 bp, Homo sapien
ggatctgtgacctcggacccgtact

SEQ ID NO: 629882 - DNA, 25 bp, Homo sapien
cctcgggtccctggcagaaagacat

SEQ ID NO: 629883 - DNA, 25 bp, Homo sapien
cagaaagacattttaccccttcttg

SEQ ID NO: 629884 - DNA, 25 bp, Homo sapien
tgtgcccagcaccactggtaattaa

SEQ ID NO: 629885 - DNA, 25 bp, Homo sapien
gcaccactggtaattaatggcttgg

SEQ ID NO: 629886 - DNA, 25 bp, Homo sapien
ttccttctaatgcccttccaagtga

SEQ ID NO: 629887 - DNA, 25 bp, Homo sapien
taggagttttataccacatactgcc

SEQ ID NO: 629888 - DNA, 25 bp, Homo sapien
tactgccaggcaaatatacaaactg

SEQ ID NO: 629889 - DNA, 25 bp, Homo sapien
atacaaactgagttatgttgtttct

SEQ ID NO: 629890 - DNA, 25 bp, Homo sapien
attatgccaataacaatctttcttt

SEQ ID NO: 629891 - DNA, 25 bp, Homo sapien
aatattatttacttcagtgctccag

SEQ ID NO: 629892 - DNA, 25 bp, Homo sapien
atttacttcagtgctccagaacctg

SEQ ID NO: 629893 - DNA, 25 bp, Homo sapien
tccccggtaggtagaaaactctgat

SEQ ID NO: 629894 - DNA, 25 bp, Homo sapien
gtagaaaactctgatttgtactggt

SEQ ID NO: 629895 - DNA, 25 bp, Homo sapien
tcaacaatttctatctttaactggt

SEQ ID NO: 629896 - DNA, 25 bp, Homo sapien
aacaatttctatctttaactggtat

SEQ ID NO: 629897 - DNA, 25 bp, Homo sapien
aatttctatctttaactggtatatt

SEQ ID NO: 629898 - DNA, 25 bp, Homo sapien
ctggtatatttagaacattaacatc

SEQ ID NO: 629899 - DNA, 25 bp, Homo sapien
agttggataactatctactatgttt

SEQ ID NO: 629900 - DNA, 25 bp, Homo sapien
tctactatgtttataactgtattct

SEQ ID NO: 629901 - DNA, 25 bp, Homo sapien
ttctgtgattttaactgaccatgta

SEQ ID NO: 629902 - DNA, 25 bp, Homo sapien
gtgattttaactgaccatgtataat

SEQ ID NO: 629903 - DNA, 25 bp, Homo sapien
taactgaccatgtataatatttaat

SEQ ID NO: 629904 - DNA, 25 bp, Homo sapien
tatattagggtattaattgtacttc

SEQ ID NO: 629905 - DNA, 25 bp, Homo sapien
tgtaagttaatctgtctttacctcg

SEQ ID NO: 629906 - DNA, 25 bp, Homo sapien
actagtttctatcaatcacatccgc

SEQ ID NO: 629907 - DNA, 25 bp, Homo sapien
atcacatccgcatgctgtttcatca

SEQ ID NO: 629908 - DNA, 25 bp, Homo sapien
gtttcatcacaatagtaaccactgt

SEQ ID NO: 629909 - DNA, 25 bp, Homo sapien
ctggagcacagataacctacaagat

SEQ ID NO: 629910 - DNA, 25 bp, Homo sapien
gatctggactgaatctgctgtttca

SEQ ID NO: 629911 - DNA, 25 bp, Homo sapien
tttcaggcagcatgatgccctgggc

SEQ ID NO: 629912 - DNA, 25 bp, Homo sapien
ggaacaggcacaggccttccgtggc

SEQ ID NO: 629913 - DNA, 25 bp, Homo sapien
gatggcacaattatcattccccaca

SEQ ID NO: 629914 - DNA, 25 bp, Homo sapien
aacagggcccagctagcctcagatc

SEQ ID NO: 629915 - DNA, 25 bp, Homo sapien
ctctgctgaactctccatgacatgt

SEQ ID NO: 629916 - DNA, 25 bp, Homo sapien
tgacatgttggtcccactagtttct

SEQ ID NO: 629917 - DNA, 25 bp, Homo sapien
aaatttagtggttgcatttctgcag

SEQ ID NO: 629918 - DNA, 25 bp, Homo sapien
gcatttctgcagatgatgattttgg

SEQ ID NO: 629919 - DNA, 25 bp, Homo sapien
gattttggaagctataccaggcatg

SEQ ID NO: 629920 - DNA, 25 bp, Homo sapien
ataccaggcatggttatgagttgtt

SEQ ID NO: 629921 - DNA, 25 bp, Homo sapien
gagttgttttcttgtaggttatgta

SEQ ID NO: 629922 - DNA, 25 bp, Homo sapien
gagactagtctacaaaccaagattt

SEQ ID NO: 629923 - DNA, 25 bp, Homo sapien
gatttgtctagtaagaattgtcttt

SEQ ID NO: 629924 - DNA, 25 bp, Homo sapien
tgtcttttttatattgattggaacc

SEQ ID NO: 629925 - DNA, 25 bp, Homo sapien
ggaaccattcaagtataaccagtat

SEQ ID NO: 629926 - DNA, 25 bp, Homo sapien
gactgaatatattaacaagctggat

SEQ ID NO: 629927 - DNA, 25 bp, Homo sapien
ggattttcactgaagaccacaattt

SEQ ID NO: 629928 - DNA, 25 bp, Homo sapien
ttatgcatgtaaggattgttggaaa

SEQ ID NO: 629929 - DNA, 25 bp, Homo sapien
tcaaatctcattgaacatgagcgaa

SEQ ID NO: 629930 - DNA, 25 bp, Homo sapien
gccagaagcaaaatcttattgagca

SEQ ID NO: 629931 - DNA, 25 bp, Homo sapien
gtggtagagctttttctcgaatgtc

SEQ ID NO: 629932 - DNA, 25 bp, Homo sapien
gagctttttctcgaatgtcatctgt

SEQ ID NO: 629933 - DNA, 25 bp, Homo sapien
gctttttctcgaatgtcatctgtta

SEQ ID NO: 629934 - DNA, 25 bp, Homo sapien
tttctcgaatgtcatctgttacgct

SEQ ID NO: 629935 - DNA, 25 bp, Homo sapien
ctcgaatgtcatctgttacgctaca

SEQ ID NO: 629936 - DNA, 25 bp, Homo sapien
gaatgtcatctgttacgctacatat

SEQ ID NO: 629937 - DNA, 25 bp, Homo sapien
tgtcatctgttacgctacatatgag

SEQ ID NO: 629938 - DNA, 25 bp, Homo sapien
tctgttacgctacatatgagaagtc

SEQ ID NO: 629939 - DNA, 25 bp, Homo sapien
aatagagactaaactagtgaggctg

SEQ ID NO: 629940 - DNA, 25 bp, Homo sapien
atagagactaaactagtgaggctgg

SEQ ID NO: 629941 - DNA, 25 bp, Homo sapien
tagagactaaactagtgaggctggt

SEQ ID NO: 629942 - DNA, 25 bp, Homo sapien
agagactaaactagtgaggctggtt

SEQ ID NO: 629943 - DNA, 25 bp, Homo sapien
gagactaaactagtgaggctggttg

SEQ ID NO: 629944 - DNA, 25 bp, Homo sapien
agactaaactagtgaggctggttgt

SEQ ID NO: 629945 - DNA, 25 bp, Homo sapien
gactaaactagtgaggctggttgtg

SEQ ID NO: 629946 - DNA, 25 bp, Homo sapien
actaaactagtgaggctggttgtgg

SEQ ID NO: 629947 - DNA, 25 bp, Homo sapien
ctaaactagtgaggctggttgtggt

SEQ ID NO: 629948 - DNA, 25 bp, Homo sapien
ttaacgtatccttttaagaagctat

SEQ ID NO: 629949 - DNA, 25 bp, Homo sapien
taacgtatccttttaagaagctatg

SEQ ID NO: 629950 - DNA, 25 bp, Homo sapien
aacgtatccttttaagaagctatgg

SEQ ID NO: 629951 - DNA, 25 bp, Homo sapien
acgtatccttttaagaagctatggc

SEQ ID NO: 629952 - DNA, 25 bp, Homo sapien
cgtatccttttaagaagctatggcc

SEQ ID NO: 629953 - DNA, 25 bp, Homo sapien
gtatccttttaagaagctatggccg

SEQ ID NO: 629954 - DNA, 25 bp, Homo sapien
tatccttttaagaagctatggccgg

SEQ ID NO: 629955 - DNA, 25 bp, Homo sapien
atccttttaagaagctatggccggg

SEQ ID NO: 629956 - DNA, 25 bp, Homo sapien
cagtcgtggtggctagtgtctgtgg

SEQ ID NO: 629957 - DNA, 25 bp, Homo sapien
agtcgtggtggctagtgtctgtggt

SEQ ID NO: 629958 - DNA, 25 bp, Homo sapien
gtcgtggtggctagtgtctgtggtc

SEQ ID NO: 629959 - DNA, 25 bp, Homo sapien
tcgtggtggctagtgtctgtggtcc

SEQ ID NO: 629960 - DNA, 25 bp, Homo sapien
cgtggtggctagtgtctgtggtccc

SEQ ID NO: 629961 - DNA, 25 bp, Homo sapien
gtggtggctagtgtctgtggtccca

SEQ ID NO: 629962 - DNA, 25 bp, Homo sapien
ggtggctagtgtctgtggtcccagc

SEQ ID NO: 629963 - DNA, 25 bp, Homo sapien
tataggtgtaactgaaaagagaagg

SEQ ID NO: 629964 - DNA, 25 bp, Homo sapien
ataggtgtaactgaaaagagaaggg

SEQ ID NO: 629965 - DNA, 25 bp, Homo sapien
gaaaagagaaggggctggacacagt

SEQ ID NO: 629966 - DNA, 25 bp, Homo sapien
aaaagagaaggggctggacacagtg

SEQ ID NO: 629967 - DNA, 25 bp, Homo sapien
gatctgcagcatggaggagttaaaa

SEQ ID NO: 629968 - DNA, 25 bp, Homo sapien
atctgcagcatggaggagttaaaaa

SEQ ID NO: 629969 - DNA, 25 bp, Homo sapien
tctgcagcatggaggagttaaaaaa

SEQ ID NO: 629970 - DNA, 25 bp, Homo sapien
ctgcagcatggaggagttaaaaaaa

SEQ ID NO: 629971 - DNA, 25 bp, Homo sapien
tgcagcatggaggagttaaaaaaaa

SEQ ID NO: 629972 - DNA, 25 bp, Homo sapien
aagggctggggcacagtggcacgtg

SEQ ID NO: 629973 - DNA, 25 bp, Homo sapien
ccaggagtggagtttgcagcttgca

SEQ ID NO: 629974 - DNA, 25 bp, Homo sapien
caggagtggagtttgcagcttgcag

SEQ ID NO: 629975 - DNA, 25 bp, Homo sapien
ggagtggagtttgcagcttgcagtg

SEQ ID NO: 629976 - DNA, 25 bp, Homo sapien
gagctgagatagtgctactgcatgc

SEQ ID NO: 629977 - DNA, 25 bp, Homo sapien
agctgagatagtgctactgcatgcc

SEQ ID NO: 629978 - DNA, 25 bp, Homo sapien
gttaagacaaaaagtcaccaggcac

SEQ ID NO: 629979 - DNA, 25 bp, Homo sapien
ttaagacaaaaagtcaccaggcaca

SEQ ID NO: 629980 - DNA, 25 bp, Homo sapien
taagacaaaaagtcaccaggcacag

SEQ ID NO: 629981 - DNA, 25 bp, Homo sapien
aagacaaaaagtcaccaggcacagt

SEQ ID NO: 629982 - DNA, 25 bp, Homo sapien
agacaaaaagtcaccaggcacagtg

SEQ ID NO: 629983 - DNA, 25 bp, Homo sapien
gacaaaaagtcaccaggcacagtgg

SEQ ID NO: 629984 - DNA, 25 bp, Homo sapien
acaaaaagtcaccaggcacagtggc

SEQ ID NO: 629985 - DNA, 25 bp, Homo sapien
caaaaagtcaccaggcacagtggct

SEQ ID NO: 629986 - DNA, 25 bp, Homo sapien
cagaggttgtgggttgtggtgagct

SEQ ID NO: 629987 - DNA, 25 bp, Homo sapien
agaggttgtgggttgtggtgagctg

SEQ ID NO: 629988 - DNA, 25 bp, Homo sapien
gaggttgtgggttgtggtgagctga

SEQ ID NO: 629989 - DNA, 25 bp, Homo sapien
ctgcccatacatactccaggagaac

SEQ ID NO: 629990 - DNA, 25 bp, Homo sapien
gaacagtacctgtttacggtctctt

SEQ ID NO: 629991 - DNA, 25 bp, Homo sapien
ctcttggctctctggagtgtggagt

SEQ ID NO: 629992 - DNA, 25 bp, Homo sapien
acactggcatgccatgagcaggact

SEQ ID NO: 629993 - DNA, 25 bp, Homo sapien
gagcaggactgccttggagccaact

SEQ ID NO: 629994 - DNA, 25 bp, Homo sapien
ttggagccaactcacagctgagctt

SEQ ID NO: 629995 - DNA, 25 bp, Homo sapien
gtcttccagggaaggtggagcttca

SEQ ID NO: 629996 - DNA, 25 bp, Homo sapien
ttcaagaagcttgacctcctcatag

SEQ ID NO: 629997 - DNA, 25 bp, Homo sapien
atagcaccagcgtaaagggcagtta

SEQ ID NO: 629998 - DNA, 25 bp, Homo sapien
ggcagttaactgtttgggcatcaaa

SEQ ID NO: 629999 - DNA, 25 bp, Homo sapien
tgtgagttgttgtgtatccccagac

SEQ ID NO: 630000 - DNA, 25 bp, Homo sapien
agatgaaccccacctgactcacatg

SEQ ID NO: 630001 - DNA, 25 bp, Homo sapien
gactcacatgagctaactaaatgtt

SEQ ID NO: 630002 - DNA, 25 bp, Homo sapien
atgttatttacactctatcctcctg

SEQ ID NO: 630003 - DNA, 25 bp, Homo sapien
gaaggtgcacatgtgcctgacagta

SEQ ID NO: 630004 - DNA, 25 bp, Homo sapien
gtgcctgacagtacactactcaagt

SEQ ID NO: 630005 - DNA, 25 bp, Homo sapien
cagtacactactcaagtcgacttgg

SEQ ID NO: 630006 - DNA, 25 bp, Homo sapien
tcaagtcgacttggttgagacccat

SEQ ID NO: 630007 - DNA, 25 bp, Homo sapien
gacttggttgagacccatagtaaat

SEQ ID NO: 630008 - DNA, 25 bp, Homo sapien
tagatatatagttttccacctgaaa

SEQ ID NO: 630009 - DNA, 25 bp, Homo sapien
tatcagaaggtgacctatatctatt

SEQ ID NO: 630010 - DNA, 25 bp, Homo sapien
ttgtgtttgttgtttagagtctatt

SEQ ID NO: 630011 - DNA, 25 bp, Homo sapien
ttcaccgtctgtcgtcatctggtgg

SEQ ID NO: 630012 - DNA, 25 bp, Homo sapien
catctggtggtggaaaccacttcta

SEQ ID NO: 630013 - DNA, 25 bp, Homo sapien
gtggtggaaaccacttctaggtttg

SEQ ID NO: 630014 - DNA, 25 bp, Homo sapien
aaccacttctaggtttgaaggtgag

SEQ ID NO: 630015 - DNA, 25 bp, Homo sapien
gaaggtgagttattcatgctggaat

SEQ ID NO: 630016 - DNA, 25 bp, Homo sapien
tcatgctggaatttcgtgatctctg

SEQ ID NO: 630017 - DNA, 25 bp, Homo sapien
gctggaatttcgtgatctctgtggg

SEQ ID NO: 630018 - DNA, 25 bp, Homo sapien
gggactgtggcttattcattggagc

SEQ ID NO: 630019 - DNA, 25 bp, Homo sapien
ctgtggcttattcattggagcttga

SEQ ID NO: 630020 - DNA, 25 bp, Homo sapien
cattggagcttgaatatttttcagg

SEQ ID NO: 630021 - DNA, 25 bp, Homo sapien
atatttttcagggtttgctttggtg

SEQ ID NO: 630022 - DNA, 25 bp, Homo sapien
ggtgtaatctatagttagcatctta

SEQ ID NO: 630023 - DNA, 25 bp, Homo sapien
actaattaatatgaactcgcccaag

SEQ ID NO: 630024 - DNA, 25 bp, Homo sapien
tgaactcgcccaagttacatttttc

SEQ ID NO: 630025 - DNA, 25 bp, Homo sapien
ttacatacagtagaatcaccccttt

SEQ ID NO: 630026 - DNA, 25 bp, Homo sapien
agaatcaccccttttagcctagtgt

SEQ ID NO: 630027 - DNA, 25 bp, Homo sapien
tttagcctagtgttctgggacttca

SEQ ID NO: 630028 - DNA, 25 bp, Homo sapien
gcctagtgttctgggacttcagcaa

SEQ ID NO: 630029 - DNA, 25 bp, Homo sapien
gggacttcagcaaacacatacacca

SEQ ID NO: 630030 - DNA, 25 bp, Homo sapien
atacaccaccacagtctaggtcatt

SEQ ID NO: 630031 - DNA, 25 bp, Homo sapien
accacagtctaggtcattttaactt

SEQ ID NO: 630032 - DNA, 25 bp, Homo sapien
taacttatttatgctgggtgtggtg

SEQ ID NO: 630033 - DNA, 25 bp, Homo sapien
ttgctgttgccatgagtagctataa

SEQ ID NO: 630034 - DNA, 25 bp, Homo sapien
ttaacttaataatgccctgtctcac

SEQ ID NO: 630035 - DNA, 25 bp, Homo sapien
tcacaccataacacctaccttttag

SEQ ID NO: 630036 - DNA, 25 bp, Homo sapien
aacacctaccttttagcataacaat

SEQ ID NO: 630037 - DNA, 25 bp, Homo sapien
ttgtaccttatttgttttgcccttg

SEQ ID NO: 630038 - DNA, 25 bp, Homo sapien
gaaaacctgctttgaaaacctgctt

SEQ ID NO: 630039 - DNA, 25 bp, Homo sapien
acctgctttgaaaacctgcttgtaa

SEQ ID NO: 630040 - DNA, 25 bp, Homo sapien
acctgcttgtaacagaggccaaata

SEQ ID NO: 630041 - DNA, 25 bp, Homo sapien
gaggagttcatagccaagattactt

SEQ ID NO: 630042 - DNA, 25 bp, Homo sapien
ttggatctgagtcttttgggcagct

SEQ ID NO: 630043 - DNA, 25 bp, Homo sapien
tttgggcagctgtcctcactttggc

SEQ ID NO: 630044 - DNA, 25 bp, Homo sapien
cagtaataaatagtctcagtgacaa

SEQ ID NO: 630045 - DNA, 25 bp, Homo sapien
aaatgccacttagaaaatgtacaca

SEQ ID NO: 630046 - DNA, 25 bp, Homo sapien
acacataattttgttctattcagca

SEQ ID NO: 630047 - DNA, 25 bp, Homo sapien
gtaacaatcagttttaggaagggtg

SEQ ID NO: 630048 - DNA, 25 bp, Homo sapien
aaaaatatttttctgctggcaacta

SEQ ID NO: 630049 - DNA, 25 bp, Homo sapien
ttctgctggcaactatttgtatctc

SEQ ID NO: 630050 - DNA, 25 bp, Homo sapien
ggcaactatttgtatctccattttc

SEQ ID NO: 630051 - DNA, 25 bp, Homo sapien
tgtatctccattttcattgacatag

SEQ ID NO: 630052 - DNA, 25 bp, Homo sapien
ctccattttcattgacatagtcagt

SEQ ID NO: 630053 - DNA, 25 bp, Homo sapien
tcagtatatacccaccttctattaa

SEQ ID NO: 630054 - DNA, 25 bp, Homo sapien
gtatatacccaccttctattaaata

SEQ ID NO: 630055 - DNA, 25 bp, Homo sapien
gctgttactggccatggtgtcattc

SEQ ID NO: 630056 - DNA, 25 bp, Homo sapien
tggccatggtgtcattcttcttcca

SEQ ID NO: 630057 - DNA, 25 bp, Homo sapien
gatatcacaacaagcttgagttttg

SEQ ID NO: 630058 - DNA, 25 bp, Homo sapien
gattaatatcttggacaggacattc

SEQ ID NO: 630059 - DNA, 25 bp, Homo sapien
ggacaggacattctatgttccaaat

SEQ ID NO: 630060 - DNA, 25 bp, Homo sapien
gtgttacaaagtgactgcaggacca

SEQ ID NO: 630061 - DNA, 25 bp, Homo sapien
gtgactgcaggaccaaaaatgagta

SEQ ID NO: 630062 - DNA, 25 bp, Homo sapien
agtagcaaattcatgaacctcttag

SEQ ID NO: 630063 - DNA, 25 bp, Homo sapien
aaattcatgaacctcttagattttt

SEQ ID NO: 630064 - DNA, 25 bp, Homo sapien
aggacatgatgagattactgccagt

SEQ ID NO: 630065 - DNA, 25 bp, Homo sapien
gattactgccagtgactcaactttt

SEQ ID NO: 630066 - DNA, 25 bp, Homo sapien
gtttacatgattaaagacccgaagt

SEQ ID NO: 630067 - DNA, 25 bp, Homo sapien
aagacccgaagttagaaatagtgat

SEQ ID NO: 630068 - DNA, 25 bp, Homo sapien
gatgtgtctcaatagtaagttagga

SEQ ID NO: 630069 - DNA, 25 bp, Homo sapien
aagaaggatggtttcagcaaaggcc

SEQ ID NO: 630070 - DNA, 25 bp, Homo sapien
tcagcaaaggcccaagttaggtgac

SEQ ID NO: 630071 - DNA, 25 bp, Homo sapien
ggcccaagttaggtgacaatttcaa

SEQ ID NO: 630072 - DNA, 25 bp, Homo sapien
taacatttatggagtgtcttgcatg

SEQ ID NO: 630073 - DNA, 25 bp, Homo sapien
gagtgtcttgcatgttccaagcact

SEQ ID NO: 630074 - DNA, 25 bp, Homo sapien
tccaagcactgtactacttgcctta

SEQ ID NO: 630075 - DNA, 25 bp, Homo sapien
tgtactacttgccttataaaccttt

SEQ ID NO: 630076 - DNA, 25 bp, Homo sapien
ttgccttataaacctttcttcaata

SEQ ID NO: 630077 - DNA, 25 bp, Homo sapien
ggtgatgtaactctctggcctggtc

SEQ ID NO: 630078 - DNA, 25 bp, Homo sapien
ggtcctgcctacaaggttttctgta

SEQ ID NO: 630079 - DNA, 25 bp, Homo sapien
atatctatgcaccagtcaactttgt

SEQ ID NO: 630080 - DNA, 25 bp, Homo sapien
gtgttttgataatcctcttctacca

SEQ ID NO: 630081 - DNA, 25 bp, Homo sapien
ctcttctaccaatttctgctcaaaa

SEQ ID NO: 630082 - DNA, 25 bp, Homo sapien
aataattgggaccagcacctagctg

SEQ ID NO: 630083 - DNA, 25 bp, Homo sapien
agcacctagctgacattattctact

SEQ ID NO: 630084 - DNA, 25 bp, Homo sapien
tattctacttttctttcaaggtttg

SEQ ID NO: 630085 - DNA, 25 bp, Homo sapien
gtgacatgtcactaggctaacagac

SEQ ID NO: 630086 - DNA, 25 bp, Homo sapien
gacaggtgatattcttctgccttgg

SEQ ID NO: 630087 - DNA, 25 bp, Homo sapien
ttctgccttggctcttccaaaataa

SEQ ID NO: 630088 - DNA, 25 bp, Homo sapien
tggactacatgcctagaccccatcc

SEQ ID NO: 630089 - DNA, 25 bp, Homo sapien
attctaatctcttaatagaccctgg

SEQ ID NO: 630090 - DNA, 25 bp, Homo sapien
atctcttaatagaccctggaaaaca

SEQ ID NO: 630091 - DNA, 25 bp, Homo sapien
gatttttgtctgattaactgtagct

SEQ ID NO: 630092 - DNA, 25 bp, Homo sapien
tttgtctgattaactgtagctttta

SEQ ID NO: 630093 - DNA, 25 bp, Homo sapien
gtttccttgccacgatcatttaatt

SEQ ID NO: 630094 - DNA, 25 bp, Homo sapien
ttccttgccacgatcatttaattga

SEQ ID NO: 630095 - DNA, 25 bp, Homo sapien
cttgccacgatcatttaattgataa

SEQ ID NO: 630096 - DNA, 25 bp, Homo sapien
attaaattatttcagcatggcgagg

SEQ ID NO: 630097 - DNA, 25 bp, Homo sapien
aaattatttcagcatggcgaggcat

SEQ ID NO: 630098 - DNA, 25 bp, Homo sapien
attatttcagcatggcgaggcatgg

SEQ ID NO: 630099 - DNA, 25 bp, Homo sapien
actgccttgggtttatttcctcatc

SEQ ID NO: 630100 - DNA, 25 bp, Homo sapien
atttcctcatccatcagtgggtcaa

SEQ ID NO: 630101 - DNA, 25 bp, Homo sapien
gtgggtcaaagtaatttctgccgta

SEQ ID NO: 630102 - DNA, 25 bp, Homo sapien
taatttctgccgtattcatttcctc

SEQ ID NO: 630103 - DNA, 25 bp, Homo sapien
atttcctcccgttggtgtgtgtatg

SEQ ID NO: 630104 - DNA, 25 bp, Homo sapien
gtggcatcacgcagtctcaatatct

SEQ ID NO: 630105 - DNA, 25 bp, Homo sapien
aaatctgggtggcaggtttctactg

SEQ ID NO: 630106 - DNA, 25 bp, Homo sapien
ggtttctactgcctgtctagatttc

SEQ ID NO: 630107 - DNA, 25 bp, Homo sapien
tgtctagatttctccagcctggatc

SEQ ID NO: 630108 - DNA, 25 bp, Homo sapien
agtgcaagattgttccagaggctgg

SEQ ID NO: 630109 - DNA, 25 bp, Homo sapien
gtcgcacactgccttgggtttattt

SEQ ID NO: 630110 - DNA, 25 bp, Homo sapien
gctaaaaagaaatgattcggctgga

SEQ ID NO: 630111 - DNA, 25 bp, Homo sapien
ctaaaaagaaatgattcggctggac

SEQ ID NO: 630112 - DNA, 25 bp, Homo sapien
taaaaagaaatgattcggctggacc

SEQ ID NO: 630113 - DNA, 25 bp, Homo sapien
aaaagaaatgattcggctggaccca

SEQ ID NO: 630114 - DNA, 25 bp, Homo sapien
aaagaaatgattcggctggacccag

SEQ ID NO: 630115 - DNA, 25 bp, Homo sapien
aagaaatgattcggctggacccagt

SEQ ID NO: 630116 - DNA, 25 bp, Homo sapien
agaaatgattcggctggacccagtg

SEQ ID NO: 630117 - DNA, 25 bp, Homo sapien
gaaatgattcggctggacccagtgg

SEQ ID NO: 630118 - DNA, 25 bp, Homo sapien
agcatgaagtttccctgtgaggccg

SEQ ID NO: 630119 - DNA, 25 bp, Homo sapien
atgaagtttccctgtgaggccgtgg

SEQ ID NO: 630120 - DNA, 25 bp, Homo sapien
agtttccctgtgaggccgtggttag

SEQ ID NO: 630121 - DNA, 25 bp, Homo sapien
gccgtggttagcgtggacatcagcc

SEQ ID NO: 630122 - DNA, 25 bp, Homo sapien
gttagcgtggacatcagccagcact

SEQ ID NO: 630123 - DNA, 25 bp, Homo sapien
actgcacagacagctgcgaccagga

SEQ ID NO: 630124 - DNA, 25 bp, Homo sapien
acagacagctgcgaccaggacgtca

SEQ ID NO: 630125 - DNA, 25 bp, Homo sapien
gcgaccaggacgtcagccagcactg

SEQ ID NO: 630126 - DNA, 25 bp, Homo sapien
aggacgtcagccagcactgcacaga

SEQ ID NO: 630127 - DNA, 25 bp, Homo sapien
actgcacagacagctgcgaccagag

SEQ ID NO: 630128 - DNA, 25 bp, Homo sapien
cagacagctgcgaccagagactgga

SEQ ID NO: 630129 - DNA, 25 bp, Homo sapien
tgtaagaaattaaagttgccgggtg

SEQ ID NO: 630130 - DNA, 25 bp, Homo sapien
taagaaattaaagttgccgggtgcg

SEQ ID NO: 630131 - DNA, 25 bp, Homo sapien
gaaattaaagttgccgggtgcggtg

SEQ ID NO: 630132 - DNA, 25 bp, Homo sapien
atatggtgataccgcgtctctacta

SEQ ID NO: 630133 - DNA, 25 bp, Homo sapien
aatcgctggcacctgggaggcggaa

SEQ ID NO: 630134 - DNA, 25 bp, Homo sapien
agtgagccaagatcgaactactgca

SEQ ID NO: 630135 - DNA, 25 bp, Homo sapien
gtgagccaagatcgaactactgcac

SEQ ID NO: 630136 - DNA, 25 bp, Homo sapien
agccaagatcgaactactgcactcc

SEQ ID NO: 630137 - DNA, 25 bp, Homo sapien
gccaagatcgaactactgcactcca

SEQ ID NO: 630138 - DNA, 25 bp, Homo sapien
tttgggatgagagttggttgccccc

SEQ ID NO: 630139 - DNA, 25 bp, Homo sapien
atgagagttggttgcccccgcggtc

SEQ ID NO: 630140 - DNA, 25 bp, Homo sapien
ttgctcagcaacaagggaccccctt

SEQ ID NO: 630141 - DNA, 25 bp, Homo sapien
gggacccccttcactggactatgaa

SEQ ID NO: 630142 - DNA, 25 bp, Homo sapien
gactatgaagcctgagggttgtcta

SEQ ID NO: 630143 - DNA, 25 bp, Homo sapien
gaagcctgagggttgtctaaatcaa

SEQ ID NO: 630144 - DNA, 25 bp, Homo sapien
gcctgagggttgtctaaatcaatcc

SEQ ID NO: 630145 - DNA, 25 bp, Homo sapien
gggttgtctaaatcaatccttggcc

SEQ ID NO: 630146 - DNA, 25 bp, Homo sapien
gttgtctaaatcaatccttggccag

SEQ ID NO: 630147 - DNA, 25 bp, Homo sapien
tgtctaaatcaatccttggccaggc

SEQ ID NO: 630148 - DNA, 25 bp, Homo sapien
ctaaatcaatccttggccaggcgca

SEQ ID NO: 630149 - DNA, 25 bp, Homo sapien
aaagcgagactgttgtggtccagct

SEQ ID NO: 630150 - DNA, 25 bp, Homo sapien
gaacatgcctgtgcattgagaccta

SEQ ID NO: 630151 - DNA, 25 bp, Homo sapien
gtgcattgagacctaaagctcatag

SEQ ID NO: 630152 - DNA, 25 bp, Homo sapien
aagctcatagagatgctcactctag

SEQ ID NO: 630153 - DNA, 25 bp, Homo sapien
atcaccaaaaccactgttgttgcaa

SEQ ID NO: 630154 - DNA, 25 bp, Homo sapien
gggaacactctgacaactgttggac

SEQ ID NO: 630155 - DNA, 25 bp, Homo sapien
actgttggacagataccacatgcca

SEQ ID NO: 630156 - DNA, 25 bp, Homo sapien
taccacatgccaagacccagaagag

SEQ ID NO: 630157 - DNA, 25 bp, Homo sapien
atgtttttagctatgttgtgtattc

SEQ ID NO: 630158 - DNA, 25 bp, Homo sapien
gttgtgtattctcaaagagcttaca

SEQ ID NO: 630159 - DNA, 25 bp, Homo sapien
agagcttacaacctgatcaggagac

SEQ ID NO: 630160 - DNA, 25 bp, Homo sapien
gttagggagccaagctttgatgcat

SEQ ID NO: 630161 - DNA, 25 bp, Homo sapien
gatgcatttactacatgaaggtcaa

SEQ ID NO: 630162 - DNA, 25 bp, Homo sapien
tacttaggtcattataattctgccc

SEQ ID NO: 630163 - DNA, 25 bp, Homo sapien
gtgcatgcagtacaatgaagctctt

SEQ ID NO: 630164 - DNA, 25 bp, Homo sapien
tggtgctagcacattctcaagatga

SEQ ID NO: 630165 - DNA, 25 bp, Homo sapien
aaggtcacgtgttttcaggcattaa

SEQ ID NO: 630166 - DNA, 25 bp, Homo sapien
agagcatgatctactcttttttggt

SEQ ID NO: 630167 - DNA, 25 bp, Homo sapien
ttggttccctgttataagtggctgt

SEQ ID NO: 630168 - DNA, 25 bp, Homo sapien
gaaactggactaatgaatggctttt

SEQ ID NO: 630169 - DNA, 25 bp, Homo sapien
atggcttttgtctacctttgtacta

SEQ ID NO: 630170 - DNA, 25 bp, Homo sapien
attttttacttttcttgcacagaag

SEQ ID NO: 630171 - DNA, 25 bp, Homo sapien
tcacaagccctgtctgttcattcaa

SEQ ID NO: 630172 - DNA, 25 bp, Homo sapien
ctgtctgttcattcaaggctggttc

SEQ ID NO: 630173 - DNA, 25 bp, Homo sapien
attcaaggctggttcaggttcccct

SEQ ID NO: 630174 - DNA, 25 bp, Homo sapien
aggttccccttcactgtgctctctg

SEQ ID NO: 630175 - DNA, 25 bp, Homo sapien
gtgctctctgctatctttgcattta

SEQ ID NO: 630176 - DNA, 25 bp, Homo sapien
gctatctttgcatttattgcactgt

SEQ ID NO: 630177 - DNA, 25 bp, Homo sapien
tgcactgtaatgtaaaaggattgtt

SEQ ID NO: 630178 - DNA, 25 bp, Homo sapien
ttattattttcctaatgtcaagcat

SEQ ID NO: 630179 - DNA, 25 bp, Homo sapien
tgtcaagcatattaccatagtatgt

SEQ ID NO: 630180 - DNA, 25 bp, Homo sapien
atgcagactcaatatatgtttctta

SEQ ID NO: 630181 - DNA, 25 bp, Homo sapien
agacattcaacagagtgaggcaggt

SEQ ID NO: 630182 - DNA, 25 bp, Homo sapien
cccactcctgcccactgagcacctt

SEQ ID NO: 630183 - DNA, 25 bp, Homo sapien
actcctgcccactgagcaccttgcg

SEQ ID NO: 630184 - DNA, 25 bp, Homo sapien
cactcctacccaccagagaacaaat

SEQ ID NO: 630185 - DNA, 25 bp, Homo sapien
actcctacccaccagagaacaaatc

SEQ ID NO: 630186 - DNA, 25 bp, Homo sapien
ctcctacccaccagagaacaaatcc

SEQ ID NO: 630187 - DNA, 25 bp, Homo sapien
tcctacccaccagagaacaaatccc

SEQ ID NO: 630188 - DNA, 25 bp, Homo sapien
ctacccaccagagaacaaatcccct

SEQ ID NO: 630189 - DNA, 25 bp, Homo sapien
tacccaccagagaacaaatcccctt

SEQ ID NO: 630190 - DNA, 25 bp, Homo sapien
cccaccagagaacaaatcccctttg

SEQ ID NO: 630191 - DNA, 25 bp, Homo sapien
ccaccagagaacaaatcccctttga

SEQ ID NO: 630192 - DNA, 25 bp, Homo sapien
caccagagaacaaatcccctttgac

SEQ ID NO: 630193 - DNA, 25 bp, Homo sapien
gaagaaccaaacaagggctgggctt

SEQ ID NO: 630194 - DNA, 25 bp, Homo sapien
aagaaccaaacaagggctgggcttg

SEQ ID NO: 630195 - DNA, 25 bp, Homo sapien
agaaccaaacaagggctgggcttgg

SEQ ID NO: 630196 - DNA, 25 bp, Homo sapien
gaaccaaacaagggctgggcttggt

SEQ ID NO: 630197 - DNA, 25 bp, Homo sapien
aaccaaacaagggctgggcttggtg

SEQ ID NO: 630198 - DNA, 25 bp, Homo sapien
aaatataaaaactatccgggcatag

SEQ ID NO: 630199 - DNA, 25 bp, Homo sapien
aatataaaaactatccgggcatagt

SEQ ID NO: 630200 - DNA, 25 bp, Homo sapien
atataaaaactatccgggcatagtg

SEQ ID NO: 630201 - DNA, 25 bp, Homo sapien
tataaaaactatccgggcatagtgg

SEQ ID NO: 630202 - DNA, 25 bp, Homo sapien
taaaaactatccgggcatagtggtg

SEQ ID NO: 630203 - DNA, 25 bp, Homo sapien
aaaactatccgggcatagtggtgca

SEQ ID NO: 630204 - DNA, 25 bp, Homo sapien
gaacaggaaattagatctacttcat

SEQ ID NO: 630205 - DNA, 25 bp, Homo sapien
aattagatctacttcattgcattgt

SEQ ID NO: 630206 - DNA, 25 bp, Homo sapien
ctacttcattgcattgtatggagga

SEQ ID NO: 630207 - DNA, 25 bp, Homo sapien
gagatgagtcatccatggatactct

SEQ ID NO: 630208 - DNA, 25 bp, Homo sapien
gtcatccatggatactcttgctcaa

SEQ ID NO: 630209 - DNA, 25 bp, Homo sapien
atccatggatactcttgctcaaagt

SEQ ID NO: 630210 - DNA, 25 bp, Homo sapien
atactcttgctcaaagtaactgctg

SEQ ID NO: 630211 - DNA, 25 bp, Homo sapien
caaagtaactgctgtaatcagaagc

SEQ ID NO: 630212 - DNA, 25 bp, Homo sapien
gctgtaatcagaagcaggaggtact

SEQ ID NO: 630213 - DNA, 25 bp, Homo sapien
aagcaggaggtactatagagagcaa

SEQ ID NO: 630214 - DNA, 25 bp, Homo sapien
agcaaagattctaaaacccattctc

SEQ ID NO: 630215 - DNA, 25 bp, Homo sapien
acccaaggattgtctatcctctcct

SEQ ID NO: 630216 - DNA, 25 bp, Homo sapien
caaggattgtctatcctctcctaaa

SEQ ID NO: 630217 - DNA, 25 bp, Homo sapien
aaggattgtctatcctctcctaaat

SEQ ID NO: 630218 - DNA, 25 bp, Homo sapien
ggattgtctatcctctcctaaattt

SEQ ID NO: 630219 - DNA, 25 bp, Homo sapien
gattgtctatcctctcctaaatttt

SEQ ID NO: 630220 - DNA, 25 bp, Homo sapien
ttgtctatcctctcctaaattttat

SEQ ID NO: 630221 - DNA, 25 bp, Homo sapien
gtctatcctctcctaaattttattt

SEQ ID NO: 630222 - DNA, 25 bp, Homo sapien
tatcctctcctaaattttatttcta

SEQ ID NO: 630223 - DNA, 25 bp, Homo sapien
tatttctaatattcttgctacatag

SEQ ID NO: 630224 - DNA, 25 bp, Homo sapien
tctaatattcttgctacatagtcag

SEQ ID NO: 630225 - DNA, 25 bp, Homo sapien
aatattcttgctacatagtcaggtt

SEQ ID NO: 630226 - DNA, 25 bp, Homo sapien
gactacaacatagacactaagtgct

SEQ ID NO: 630227 - DNA, 25 bp, Homo sapien
gacactaagtgcttaccagttttgg

SEQ ID NO: 630228 - DNA, 25 bp, Homo sapien
ccagttttggttgaacttagcctag

SEQ ID NO: 630229 - DNA, 25 bp, Homo sapien
tagcctagatttacacttagttgga

SEQ ID NO: 630230 - DNA, 25 bp, Homo sapien
atgtgttgttgggactttctctgaa

SEQ ID NO: 630231 - DNA, 25 bp, Homo sapien
gttgggactttctctgaaacaaatc

SEQ ID NO: 630232 - DNA, 25 bp, Homo sapien
tttctctgaaacaaatctatgcatg

SEQ ID NO: 630233 - DNA, 25 bp, Homo sapien
aaatctatgcatgtaattcatttgc

SEQ ID NO: 630234 - DNA, 25 bp, Homo sapien
gtaattcatttgcatgtctgatatt

SEQ ID NO: 630235 - DNA, 25 bp, Homo sapien
gtctgatatttggtcccatgacata

SEQ ID NO: 630236 - DNA, 25 bp, Homo sapien
gatatttggtcccatgacatataaa

SEQ ID NO: 630237 - DNA, 25 bp, Homo sapien
ttgctggatagaggcatcccactgt

SEQ ID NO: 630238 - DNA, 25 bp, Homo sapien
atcccactgtccactcgttggtgta

SEQ ID NO: 630239 - DNA, 25 bp, Homo sapien
cactcgttggtgtatgttctcataa

SEQ ID NO: 630240 - DNA, 25 bp, Homo sapien
aatgtggctcaacaatccgatacta

SEQ ID NO: 630241 - DNA, 25 bp, Homo sapien
aatccgatactaaggagcactacct

SEQ ID NO: 630242 - DNA, 25 bp, Homo sapien
gagcactacctgaaatcacaaagac

SEQ ID NO: 630243 - DNA, 25 bp, Homo sapien
gtttctttgtgaatattgcaccttc

SEQ ID NO: 630244 - DNA, 25 bp, Homo sapien
attgcaccttcttcatagctgttgg

SEQ ID NO: 630245 - DNA, 25 bp, Homo sapien
agctgttggttcttagcactgttgt

SEQ ID NO: 630246 - DNA, 25 bp, Homo sapien
gcactgttgtgtgttcaatctttca

SEQ ID NO: 630247 - DNA, 25 bp, Homo sapien
ccttaagacaggatcaggagttata

SEQ ID NO: 630248 - DNA, 25 bp, Homo sapien
ctgttgtgacactcttgaaggaaaa

SEQ ID NO: 630249 - DNA, 25 bp, Homo sapien
tttatttttcacaagctttgctcat

SEQ ID NO: 630250 - DNA, 25 bp, Homo sapien
gctttgctcatgacttcaggacact

SEQ ID NO: 630251 - DNA, 25 bp, Homo sapien
caggacactggatgatgagctattt

SEQ ID NO: 630252 - DNA, 25 bp, Homo sapien
aaactatctgatcaattgctatata

SEQ ID NO: 630253 - DNA, 25 bp, Homo sapien
ttcagacatctcagctactattcgt

SEQ ID NO: 630254 - DNA, 25 bp, Homo sapien
tactattcgtctatgtggctcttta

SEQ ID NO: 630255 - DNA, 25 bp, Homo sapien
atgtggctctttaccattggagaaa

SEQ ID NO: 630256 - DNA, 25 bp, Homo sapien
agaaaggcggtgttgccttctggct

SEQ ID NO: 630257 - DNA, 25 bp, Homo sapien
tgccttctggcttcataggacttga

SEQ ID NO: 630258 - DNA, 25 bp, Homo sapien
ctggcttcataggacttgagttcaa

SEQ ID NO: 630259 - DNA, 25 bp, Homo sapien
gggagcttgctacaaaatgcacatt

SEQ ID NO: 630260 - DNA, 25 bp, Homo sapien
gcacattgctataccatagcctggg

SEQ ID NO: 630261 - DNA, 25 bp, Homo sapien
ggcttgcaatccaaggctggcaagg

SEQ ID NO: 630262 - DNA, 25 bp, Homo sapien
aggctggcaaggattcctgcacgtc

SEQ ID NO: 630263 - DNA, 25 bp, Homo sapien
aaggattcctgcacgtcaagggcct

SEQ ID NO: 630264 - DNA, 25 bp, Homo sapien
ctttcatgcacacccaagtcagaag

SEQ ID NO: 630265 - DNA, 25 bp, Homo sapien
aagtcagaaggctctcctgaatcct

SEQ ID NO: 630266 - DNA, 25 bp, Homo sapien
tgaatcctggatgtcaccttcctgc

SEQ ID NO: 630267 - DNA, 25 bp, Homo sapien
agatgaaatattgttcactgttggc

SEQ ID NO: 630268 - DNA, 25 bp, Homo sapien
cactgttggcatagaggaatactac

SEQ ID NO: 630269 - DNA, 25 bp, Homo sapien
ggaatactactgattttcgtatgtt

SEQ ID NO: 630270 - DNA, 25 bp, Homo sapien
gtgtctgatcattcaattaatcttg

SEQ ID NO: 630271 - DNA, 25 bp, Homo sapien
aatcttgtagaaattactcttagac

SEQ ID NO: 630272 - DNA, 25 bp, Homo sapien
ttactcttagactttcaacaacatg

SEQ ID NO: 630273 - DNA, 25 bp, Homo sapien
tgtaactataagcacatatcatttg

SEQ ID NO: 630274 - DNA, 25 bp, Homo sapien
tgtttcaatttaatacagtggctga

SEQ ID NO: 630275 - DNA, 25 bp, Homo sapien
aagaattgtttgtacctctgggcat

SEQ ID NO: 630276 - DNA, 25 bp, Homo sapien
gaattgtttgtacctctgggcatat

SEQ ID NO: 630277 - DNA, 25 bp, Homo sapien
tctgggcatatcttagtgagagact

SEQ ID NO: 630278 - DNA, 25 bp, Homo sapien
gtgagagacttctcatagcatttgt

SEQ ID NO: 630279 - DNA, 25 bp, Homo sapien
aaaactgtatttagtcatggactga

SEQ ID NO: 630280 - DNA, 25 bp, Homo sapien
aattgttcattggattcattaggga

SEQ ID NO: 630281 - DNA, 25 bp, Homo sapien
attaagacacgattatcattcagga

SEQ ID NO: 630282 - DNA, 25 bp, Homo sapien
cattcaggattcatgctgtttacag

SEQ ID NO: 630283 - DNA, 25 bp, Homo sapien
gctgtttacagtttgactacttcat

SEQ ID NO: 630284 - DNA, 25 bp, Homo sapien
gtgtctataaaacacctggtagttg

SEQ ID NO: 630285 - DNA, 25 bp, Homo sapien
agatacatgcatgctatttattcag

SEQ ID NO: 630286 - DNA, 25 bp, Homo sapien
tatttattcagctgccgggagccat

SEQ ID NO: 630287 - DNA, 25 bp, Homo sapien
caaggattgtctatcctctcctaaa

SEQ ID NO: 630288 - DNA, 25 bp, Homo sapien
gattgtctatcctctcctaaatttt

SEQ ID NO: 630289 - DNA, 25 bp, Homo sapien
gtctatcctctcctaaattttattt

SEQ ID NO: 630290 - DNA, 25 bp, Homo sapien
tctaatattcttgctacatagtcag

SEQ ID NO: 630291 - DNA, 25 bp, Homo sapien
aatattcttgctacatagtcaggtt

SEQ ID NO: 630292 - DNA, 25 bp, Homo sapien
tctaggctggcctattaaaagcttc

SEQ ID NO: 630293 - DNA, 25 bp, Homo sapien
ctaggctggcctattaaaagcttcc

SEQ ID NO: 630294 - DNA, 25 bp, Homo sapien
taggctggcctattaaaagcttccc

SEQ ID NO: 630295 - DNA, 25 bp, Homo sapien
aggctggcctattaaaagcttccca

SEQ ID NO: 630296 - DNA, 25 bp, Homo sapien
ggctggcctattaaaagcttcccac

SEQ ID NO: 630297 - DNA, 25 bp, Homo sapien
gctggcctattaaaagcttcccacc

SEQ ID NO: 630298 - DNA, 25 bp, Homo sapien
tggcctattaaaagcttcccacccg

SEQ ID NO: 630299 - DNA, 25 bp, Homo sapien
ctattaaaagcttcccacccggctg

SEQ ID NO: 630300 - DNA, 25 bp, Homo sapien
tattaaaagcttcccacccggctgg

SEQ ID NO: 630301 - DNA, 25 bp, Homo sapien
taaaagcttcccacccggctgggtg

SEQ ID NO: 630302 - DNA, 25 bp, Homo sapien
aaagcttcccacccggctgggtgtg

SEQ ID NO: 630303 - DNA, 25 bp, Homo sapien
caggtcttaagaaaggtacttagca

SEQ ID NO: 630304 - DNA, 25 bp, Homo sapien
gtacttagcaagtgctggtacattc

SEQ ID NO: 630305 - DNA, 25 bp, Homo sapien
ggtacattctaagcaatcaatattt

SEQ ID NO: 630306 - DNA, 25 bp, Homo sapien
aattatcttatacaaggatccactt

SEQ ID NO: 630307 - DNA, 25 bp, Homo sapien
gttttggataaattactgactcctt

SEQ ID NO: 630308 - DNA, 25 bp, Homo sapien
ttactgactccttatctcagttatg

SEQ ID NO: 630309 - DNA, 25 bp, Homo sapien
tatctcagttatgttatgtgttaaa

SEQ ID NO: 630310 - DNA, 25 bp, Homo sapien
acagtgttattttgtatctctcaag

SEQ ID NO: 630311 - DNA, 25 bp, Homo sapien
tgtatctctcaagggcttttgttag

SEQ ID NO: 630312 - DNA, 25 bp, Homo sapien
agggcttttgttagaattttcaatg

SEQ ID NO: 630313 - DNA, 25 bp, Homo sapien
caatgagataccttaaaacctctaa

SEQ ID NO: 630314 - DNA, 25 bp, Homo sapien
caagacttaacaaagctttatgcta

SEQ ID NO: 630315 - DNA, 25 bp, Homo sapien
caaagctttatgctatagtttggat

SEQ ID NO: 630316 - DNA, 25 bp, Homo sapien
tggatatagtttgtttgaccccttc

SEQ ID NO: 630317 - DNA, 25 bp, Homo sapien
gatatagtttgtttgaccccttcca

SEQ ID NO: 630318 - DNA, 25 bp, Homo sapien
ttccagtgttggagatgggtcgtaa

SEQ ID NO: 630319 - DNA, 25 bp, Homo sapien
gatcctatgtgaatagattaatccc

SEQ ID NO: 630320 - DNA, 25 bp, Homo sapien
tgtgaatagattaatccccctctct

SEQ ID NO: 630321 - DNA, 25 bp, Homo sapien
tgctttcttgcttgccatgtgatct

SEQ ID NO: 630322 - DNA, 25 bp, Homo sapien
gtgatctctgtacagctggctcccc

SEQ ID NO: 630323 - DNA, 25 bp, Homo sapien
tctctgtacagctggctcccctttg

SEQ ID NO: 630324 - DNA, 25 bp, Homo sapien
gcaaatactgacaccatgcttcttg

SEQ ID NO: 630325 - DNA, 25 bp, Homo sapien
aattcccattattgtaattactctg

SEQ ID NO: 630326 - DNA, 25 bp, Homo sapien
ttcccattattgtaattactctgtg

SEQ ID NO: 630327 - DNA, 25 bp, Homo sapien
cccattattgtaattactctgtgta

SEQ ID NO: 630328 - DNA, 25 bp, Homo sapien
attattgtaattactctgtgtacgt

SEQ ID NO: 630329 - DNA, 25 bp, Homo sapien
attgtaattactctgtgtacgtttt

SEQ ID NO: 630330 - DNA, 25 bp, Homo sapien
tgtaattactctgtgtacgtttttt

SEQ ID NO: 630331 - DNA, 25 bp, Homo sapien
tactctgtgtacgtttttttgttgt

SEQ ID NO: 630332 - DNA, 25 bp, Homo sapien
ctctgtgtacgtttttttgttgttg

SEQ ID NO: 630333 - DNA, 25 bp, Homo sapien
ttttttgatatggaattgcactcta

SEQ ID NO: 630334 - DNA, 25 bp, Homo sapien
ttttgatatggaattgcactctagc

SEQ ID NO: 630335 - DNA, 25 bp, Homo sapien
ttgatatggaattgcactctagcct

SEQ ID NO: 630336 - DNA, 25 bp, Homo sapien
taaggagaggtaaaagacccagaat

SEQ ID NO: 630337 - DNA, 25 bp, Homo sapien
gaatagtcaactcaatattgaaaga

SEQ ID NO: 630338 - DNA, 25 bp, Homo sapien
gaagagcaaggttggaggacccata

SEQ ID NO: 630339 - DNA, 25 bp, Homo sapien
gcaaggttggaggacccatagtacc

SEQ ID NO: 630340 - DNA, 25 bp, Homo sapien
ggttggaggacccatagtacccaat

SEQ ID NO: 630341 - DNA, 25 bp, Homo sapien
ggaggacccatagtacccaatttca

SEQ ID NO: 630342 - DNA, 25 bp, Homo sapien
ggacccatagtacccaatttcagta

SEQ ID NO: 630343 - DNA, 25 bp, Homo sapien
tacccaatttcagtacttttactat

SEQ ID NO: 630344 - DNA, 25 bp, Homo sapien
gtacttttactataaagccacagta

SEQ ID NO: 630345 - DNA, 25 bp, Homo sapien
tcaaggcagtgtggtattggtcaaa

SEQ ID NO: 630346 - DNA, 25 bp, Homo sapien
ggcagtgtggtattggtcaaaaaac

SEQ ID NO: 630347 - DNA, 25 bp, Homo sapien
ttaacgtatccttttaagaagctat

SEQ ID NO: 630348 - DNA, 25 bp, Homo sapien
taacgtatccttttaagaagctatg

SEQ ID NO: 630349 - DNA, 25 bp, Homo sapien
aacgtatccttttaagaagctatgg

SEQ ID NO: 630350 - DNA, 25 bp, Homo sapien
acgtatccttttaagaagctatggc

SEQ ID NO: 630351 - DNA, 25 bp, Homo sapien
cgtatccttttaagaagctatggcc

SEQ ID NO: 630352 - DNA, 25 bp, Homo sapien
gtatccttttaagaagctatggccg

SEQ ID NO: 630353 - DNA, 25 bp, Homo sapien
tatccttttaagaagctatggccgg

SEQ ID NO: 630354 - DNA, 25 bp, Homo sapien
atccttttaagaagctatggccggg

SEQ ID NO: 630355 - DNA, 25 bp, Homo sapien
cttttaagaagctatggccgggcac

SEQ ID NO: 630356 - DNA, 25 bp, Homo sapien
tttaagaagctatggccgggcacag

SEQ ID NO: 630357 - DNA, 25 bp, Homo sapien
agattgtgccatatcacttcagcct

SEQ ID NO: 630358 - DNA, 25 bp, Homo sapien
ccgacgaacaactctatgcacacaa

SEQ ID NO: 630359 - DNA, 25 bp, Homo sapien
gaacaactctatgcacacaaactag

SEQ ID NO: 630360 - DNA, 25 bp, Homo sapien
aactgataaattcgtggatgcatac

SEQ ID NO: 630361 - DNA, 25 bp, Homo sapien
ggatgcatacaacctcccaaggcag

SEQ ID NO: 630362 - DNA, 25 bp, Homo sapien
agatggattcatagctggattctag

SEQ ID NO: 630363 - DNA, 25 bp, Homo sapien
ttcatagctggattctagcagacgt

SEQ ID NO: 630364 - DNA, 25 bp, Homo sapien
agctggattctagcagacgtataaa

SEQ ID NO: 630365 - DNA, 25 bp, Homo sapien
tctagcagacgtataaagaagatct

SEQ ID NO: 630366 - DNA, 25 bp, Homo sapien
aagaagatctggtaccattcctatt

SEQ ID NO: 630367 - DNA, 25 bp, Homo sapien
gatctggtaccattcctattgaaac

SEQ ID NO: 630368 - DNA, 25 bp, Homo sapien
cattcctattgaaactattcccaaa

SEQ ID NO: 630369 - DNA, 25 bp, Homo sapien
tgagcctccctttagtacttattac

SEQ ID NO: 630370 - DNA, 25 bp, Homo sapien
gcctccctttagtacttattaccat

SEQ ID NO: 630371 - DNA, 25 bp, Homo sapien
gattgttactgttaaattgcgattt

SEQ ID NO: 630372 - DNA, 25 bp, Homo sapien
tgttaaattgcgatttcattgcctc

SEQ ID NO: 630373 - DNA, 25 bp, Homo sapien
attgcctcctatcctagactgtaaa

SEQ ID NO: 630374 - DNA, 25 bp, Homo sapien
ctcctatcctagactgtaaacttga

SEQ ID NO: 630375 - DNA, 25 bp, Homo sapien
taaacttgacaagagcagggacttt

SEQ ID NO: 630376 - DNA, 25 bp, Homo sapien
ggttttcttcatttgttgaacacct

SEQ ID NO: 630377 - DNA, 25 bp, Homo sapien
tcttcatttgttgaacacctactat

SEQ ID NO: 630378 - DNA, 25 bp, Homo sapien
ccctctgtcttgtgtccatctgtat

SEQ ID NO: 630379 - DNA, 25 bp, Homo sapien
gtcttgtgtccatctgtatccccag

SEQ ID NO: 630380 - DNA, 25 bp, Homo sapien
ctctgtaccatgactagagacccaa

SEQ ID NO: 630381 - DNA, 25 bp, Homo sapien
gagacccaagatttaattcagtagc

SEQ ID NO: 630382 - DNA, 25 bp, Homo sapien
agtagctgaagctttcactggtagc

SEQ ID NO: 630383 - DNA, 25 bp, Homo sapien
ttcactggtagctcttgtcagcaga

SEQ ID NO: 630384 - DNA, 25 bp, Homo sapien
gtagctcttgtcagcagaccctcag

SEQ ID NO: 630385 - DNA, 25 bp, Homo sapien
ggaaaatctattatgccctgtgcta

SEQ ID NO: 630386 - DNA, 25 bp, Homo sapien
ctgtgctatcagaaccaagtatcta

SEQ ID NO: 630387 - DNA, 25 bp, Homo sapien
caagtatctagtcattgagtcggaa

SEQ ID NO: 630388 - DNA, 25 bp, Homo sapien
tgagtcggaaaccaagccttttgtc

SEQ ID NO: 630389 - DNA, 25 bp, Homo sapien
ttttgtccactctgcctgaggaact

SEQ ID NO: 630390 - DNA, 25 bp, Homo sapien
ggaactgaattagtagccctcaccc

SEQ ID NO: 630391 - DNA, 25 bp, Homo sapien
aaatgcgaactattgactgcggtgg

SEQ ID NO: 630392 - DNA, 25 bp, Homo sapien
ctattgactgcggtggttgtgatgt

SEQ ID NO: 630393 - DNA, 25 bp, Homo sapien
gttgtgatgtggatccgtatgtcat

SEQ ID NO: 630394 - DNA, 25 bp, Homo sapien
tggatccgtatgtcataaatggcgt

SEQ ID NO: 630395 - DNA, 25 bp, Homo sapien
taaatggcgtggagccacactcaca

SEQ ID NO: 630396 - DNA, 25 bp, Homo sapien
actgtaccaacgtccagctaccggt

SEQ ID NO: 630397 - DNA, 25 bp, Homo sapien
gctaccggtctggatgttaaactct

SEQ ID NO: 630398 - DNA, 25 bp, Homo sapien
ggatgttaaactctagtgacgtaag

SEQ ID NO: 630399 - DNA, 25 bp, Homo sapien
gtaaagggcatctgagaccactctt

SEQ ID NO: 630400 - DNA, 25 bp, Homo sapien
ggcatctgagaccactcttcactat

SEQ ID NO: 630401 - DNA, 25 bp, Homo sapien
tgcagcttcttatggatctacaatt

SEQ ID NO: 630402 - DNA, 25 bp, Homo sapien
agccagtgaaagacagacagagatg

SEQ ID NO: 630403 - DNA, 25 bp, Homo sapien
gaaagacagacagagatggagaaat

SEQ ID NO: 630404 - DNA, 25 bp, Homo sapien
aatagagagagaggcaaacatagag

SEQ ID NO: 630405 - DNA, 25 bp, Homo sapien
aaacatagagagatggacggaggga

SEQ ID NO: 630406 - DNA, 25 bp, Homo sapien
gacagagacagagtcacaacaggag

SEQ ID NO: 630407 - DNA, 25 bp, Homo sapien
acagagacagagtcacaacaggaga

SEQ ID NO: 630408 - DNA, 25 bp, Homo sapien
agagacagagtcacaacaggagaaa

SEQ ID NO: 630409 - DNA, 25 bp, Homo sapien
gagacagagtcacaacaggagaaag

SEQ ID NO: 630410 - DNA, 25 bp, Homo sapien
aagacagagataaaagacactcaga

SEQ ID NO: 630411 - DNA, 25 bp, Homo sapien
acagagatggaacagagacaaacag

SEQ ID NO: 630412 - DNA, 25 bp, Homo sapien
cagagatggaacagagacaaacaga

SEQ ID NO: 630413 - DNA, 25 bp, Homo sapien
ttgcacactggctttgtgatcacag

SEQ ID NO: 630414 - DNA, 25 bp, Homo sapien
tgtgccttactttcctcatgtttaa

SEQ ID NO: 630415 - DNA, 25 bp, Homo sapien
ttcctcatgtttaaagtagtcataa

SEQ ID NO: 630416 - DNA, 25 bp, Homo sapien
gtagtcataatcatacttgcatcat

SEQ ID NO: 630417 - DNA, 25 bp, Homo sapien
acttgcatcatggtgttattcagaa

SEQ ID NO: 630418 - DNA, 25 bp, Homo sapien
atggtgttattcagaagatcaactg

SEQ ID NO: 630419 - DNA, 25 bp, Homo sapien
gaagatcaactgagagatgtatgta

SEQ ID NO: 630420 - DNA, 25 bp, Homo sapien
agtatttagcataggacttagaacc

SEQ ID NO: 630421 - DNA, 25 bp, Homo sapien
ggacttagaacctagttaatgctca

SEQ ID NO: 630422 - DNA, 25 bp, Homo sapien
agaacctagttaatgctcaattaat

SEQ ID NO: 630423 - DNA, 25 bp, Homo sapien
ttaatatgttatttttggccaggtg

SEQ ID NO: 630424 - DNA, 25 bp, Homo sapien
tctgccctcatgtttgacagcactc

SEQ ID NO: 630425 - DNA, 25 bp, Homo sapien
ctggccctcatgtttgacagcactc

SEQ ID NO: 630426 - DNA, 25 bp, Homo sapien
ctggccctgatttcctcagctgaat

SEQ ID NO: 630427 - DNA, 25 bp, Homo sapien
gatttcctcagctgaatcaagcttt

SEQ ID NO: 630428 - DNA, 25 bp, Homo sapien
aatcaagctttctctggccacaggg

SEQ ID NO: 630429 - DNA, 25 bp, Homo sapien
tggccacagggcttttgcataagct

SEQ ID NO: 630430 - DNA, 25 bp, Homo sapien
tttgcataagctgttcattcctcct

SEQ ID NO: 630431 - DNA, 25 bp, Homo sapien
tcctccaccttgtctgactaatttc

SEQ ID NO: 630432 - DNA, 25 bp, Homo sapien
taatttctattcatctttcctgcag

SEQ ID NO: 630433 - DNA, 25 bp, Homo sapien
catgtggattgcaagctttgagtga

SEQ ID NO: 630434 - DNA, 25 bp, Homo sapien
aagctttgagtgatcttgcccctgc

SEQ ID NO: 630435 - DNA, 25 bp, Homo sapien
acagagaagattctcctacagtaaa

SEQ ID NO: 630436 - DNA, 25 bp, Homo sapien
cagagaagattctcctacagtaaaa

SEQ ID NO: 630437 - DNA, 25 bp, Homo sapien
agagaagattctcctacagtaaaaa

SEQ ID NO: 630438 - DNA, 25 bp, Homo sapien
gagaagattctcctacagtaaaaat

SEQ ID NO: 630439 - DNA, 25 bp, Homo sapien
agaagattctcctacagtaaaaata

SEQ ID NO: 630440 - DNA, 25 bp, Homo sapien
gaagattctcctacagtaaaaatat

SEQ ID NO: 630441 - DNA, 25 bp, Homo sapien
aagattctcctacagtaaaaatatg

SEQ ID NO: 630442 - DNA, 25 bp, Homo sapien
gattctcctacagtaaaaatatgct

SEQ ID NO: 630443 - DNA, 25 bp, Homo sapien
ttctcctacagtaaaaatatgctgg

SEQ ID NO: 630444 - DNA, 25 bp, Homo sapien
tctcctacagtaaaaatatgctggc

SEQ ID NO: 630445 - DNA, 25 bp, Homo sapien
gaaacctcgcttctactaaagaaat

SEQ ID NO: 630446 - DNA, 25 bp, Homo sapien
ttcctcatgtttaaagtagtcataa

SEQ ID NO: 630447 - DNA, 25 bp, Homo sapien
gtagtcataatcatacttgcatcat

SEQ ID NO: 630448 - DNA, 25 bp, Homo sapien
gtcataatcatacttgcatcatggt

SEQ ID NO: 630449 - DNA, 25 bp, Homo sapien
aatcatacttgcatcatggtgttat

SEQ ID NO: 630450 - DNA, 25 bp, Homo sapien
acttgcatcatggtgttattcagaa

SEQ ID NO: 630451 - DNA, 25 bp, Homo sapien
ttgcatcatggtgttattcagaaga

SEQ ID NO: 630452 - DNA, 25 bp, Homo sapien
atggtgttattcagaagatcaactg

SEQ ID NO: 630453 - DNA, 25 bp, Homo sapien
gaagatcaactgagagatgtatgta

SEQ ID NO: 630454 - DNA, 25 bp, Homo sapien
agtatttagcataggacttagaacc

SEQ ID NO: 630455 - DNA, 25 bp, Homo sapien
ggacttagaacctagttaatgctca

SEQ ID NO: 630456 - DNA, 25 bp, Homo sapien
agaacctagttaatgctcaattaat

SEQ ID NO: 630457 - DNA, 25 bp, Homo sapien
tctccatcttgggaatgacagctct

SEQ ID NO: 630458 - DNA, 25 bp, Homo sapien
gggaatgacagctctatccttccag

SEQ ID NO: 630459 - DNA, 25 bp, Homo sapien
ttaaaaacgttggaggcatccttgc

SEQ ID NO: 630460 - DNA, 25 bp, Homo sapien
atgcctcccttcaatccattagcga

SEQ ID NO: 630461 - DNA, 25 bp, Homo sapien
ctcccttcaatccattagcgaattc

SEQ ID NO: 630462 - DNA, 25 bp, Homo sapien
attagcgaattctgctgtctctacc

SEQ ID NO: 630463 - DNA, 25 bp, Homo sapien
gaattctgctgtctctaccttaaaa

SEQ ID NO: 630464 - DNA, 25 bp, Homo sapien
gtctctaccttaaaaatggatccag

SEQ ID NO: 630465 - DNA, 25 bp, Homo sapien
gaccaccgttttctcttgcctggag

SEQ ID NO: 630466 - DNA, 25 bp, Homo sapien
ttgcagttgcctccttgctggtgtc

SEQ ID NO: 630467 - DNA, 25 bp, Homo sapien
ttgctggtgtccctgattctgtcct

SEQ ID NO: 630468 - DNA, 25 bp, Homo sapien
tgcagtcccagttatttgggaggtt

SEQ ID NO: 630469 - DNA, 25 bp, Homo sapien
cagccaatggcaggagcgtcaggcc

SEQ ID NO: 630470 - DNA, 25 bp, Homo sapien
agccaatggcaggagcgtcaggcca

SEQ ID NO: 630471 - DNA, 25 bp, Homo sapien
gccaatggcaggagcgtcaggccag

SEQ ID NO: 630472 - DNA, 25 bp, Homo sapien
ccaatggcaggagcgtcaggccagg

SEQ ID NO: 630473 - DNA, 25 bp, Homo sapien
caatggcaggagcgtcaggccaggt

SEQ ID NO: 630474 - DNA, 25 bp, Homo sapien
aatggcaggagcgtcaggccaggtg

SEQ ID NO: 630475 - DNA, 25 bp, Homo sapien
atggcaggagcgtcaggccaggtgg

SEQ ID NO: 630476 - DNA, 25 bp, Homo sapien
tggcaggagcgtcaggccaggtggg

SEQ ID NO: 630477 - DNA, 25 bp, Homo sapien
gcaggagcgtcaggccaggtgggcg

SEQ ID NO: 630478 - DNA, 25 bp, Homo sapien
gagcgtcaggccaggtgggcggatc

SEQ ID NO: 630479 - DNA, 25 bp, Homo sapien
atatgatcatcgcaagacacagaaa

SEQ ID NO: 630480 - DNA, 25 bp, Homo sapien
aaatccagttaccatttcatgataa

SEQ ID NO: 630481 - DNA, 25 bp, Homo sapien
aaaactgctcaacaaatacatagaa

SEQ ID NO: 630482 - DNA, 25 bp, Homo sapien
atacatagaaggctgcttcctcaac

SEQ ID NO: 630483 - DNA, 25 bp, Homo sapien
aaggctgcttcctcaacctaataaa

SEQ ID NO: 630484 - DNA, 25 bp, Homo sapien
aacccacaactaacatcctaataag

SEQ ID NO: 630485 - DNA, 25 bp, Homo sapien
aataatgtggatatcccctctcacc

SEQ ID NO: 630486 - DNA, 25 bp, Homo sapien
tctcaccacttctaaacattgcact

SEQ ID NO: 630487 - DNA, 25 bp, Homo sapien
acattgcactcagggaattagtcaa

SEQ ID NO: 630488 - DNA, 25 bp, Homo sapien
aaggcatcctgattggaaaggacta

SEQ ID NO: 630489 - DNA, 25 bp, Homo sapien
aaacactttgtacatgacagtatct

SEQ ID NO: 630490 - DNA, 25 bp, Homo sapien
gtaaactttagcatacagaacattt

SEQ ID NO: 630491 - DNA, 25 bp, Homo sapien
gcatacagaacatttaagttgcaat

SEQ ID NO: 630492 - DNA, 25 bp, Homo sapien
attagggatagttttgtttccattg

SEQ ID NO: 630493 - DNA, 25 bp, Homo sapien
gtttccattggtgtttgttgtataa

SEQ ID NO: 630494 - DNA, 25 bp, Homo sapien
gtttgttgtataaagtcttgaactt

SEQ ID NO: 630495 - DNA, 25 bp, Homo sapien
ttgaggttgtctggcaaaaggatat

SEQ ID NO: 630496 - DNA, 25 bp, Homo sapien
aaaaggatattgtgcctcacctctg

SEQ ID NO: 630497 - DNA, 25 bp, Homo sapien
aggatattgtgcctcacctctgttg

SEQ ID NO: 630498 - DNA, 25 bp, Homo sapien
ttgtgcctcacctctgttgtgtgaa

SEQ ID NO: 630499 - DNA, 25 bp, Homo sapien
aagtgttatgcgtatcatttttact

SEQ ID NO: 630500 - DNA, 25 bp, Homo sapien
tatgcgtatcatttttactaatgtc

SEQ ID NO: 630501 - DNA, 25 bp, Homo sapien
acagagaagattctcctacagtaaa

SEQ ID NO: 630502 - DNA, 25 bp, Homo sapien
cagagaagattctcctacagtaaaa

SEQ ID NO: 630503 - DNA, 25 bp, Homo sapien
gagaagattctcctacagtaaaaat

SEQ ID NO: 630504 - DNA, 25 bp, Homo sapien
agaagattctcctacagtaaaaata

SEQ ID NO: 630505 - DNA, 25 bp, Homo sapien
gaagattctcctacagtaaaaatat

SEQ ID NO: 630506 - DNA, 25 bp, Homo sapien
aagattctcctacagtaaaaatatg

SEQ ID NO: 630507 - DNA, 25 bp, Homo sapien
gattctcctacagtaaaaatatgct

SEQ ID NO: 630508 - DNA, 25 bp, Homo sapien
ttctcctacagtaaaaatatgctgg

SEQ ID NO: 630509 - DNA, 25 bp, Homo sapien
tctcctacagtaaaaatatgctggc

SEQ ID NO: 630510 - DNA, 25 bp, Homo sapien
acagtaaaaatatgctggccaggcg

SEQ ID NO: 630511 - DNA, 25 bp, Homo sapien
gaaacctcgcttctactaaagaaat

SEQ ID NO: 630512 - DNA, 25 bp, Homo sapien
ccaccttggtggaattcagtgattc

SEQ ID NO: 630513 - DNA, 25 bp, Homo sapien
caccattgtaagtgatgctttgatg

SEQ ID NO: 630514 - DNA, 25 bp, Homo sapien
gatgaaaagctttgtaggtttatct

SEQ ID NO: 630515 - DNA, 25 bp, Homo sapien
aggtttatctgtgctgcacctctga

SEQ ID NO: 630516 - DNA, 25 bp, Homo sapien
acctctgaccagtcttttctggaag

SEQ ID NO: 630517 - DNA, 25 bp, Homo sapien
cttttctggaagactctaaggaagg

SEQ ID NO: 630518 - DNA, 25 bp, Homo sapien
ggcatggaccactggcttttgaagg

SEQ ID NO: 630519 - DNA, 25 bp, Homo sapien
gaccactggcttttgaaggcattcg

SEQ ID NO: 630520 - DNA, 25 bp, Homo sapien
aaggcattcggtgggtcctgccatg

SEQ ID NO: 630521 - DNA, 25 bp, Homo sapien
ttcccacattccagaagggtggtcc

SEQ ID NO: 630522 - DNA, 25 bp, Homo sapien
caaggccagcgtccctatacaggaa

SEQ ID NO: 630523 - DNA, 25 bp, Homo sapien
aatggtgatacgaatatttgtgtac

SEQ ID NO: 630524 - DNA, 25 bp, Homo sapien
gtacaagtatccgtttgagtgccta

SEQ ID NO: 630525 - DNA, 25 bp, Homo sapien
aagtatccgtttgagtgcctatttt

SEQ ID NO: 630526 - DNA, 25 bp, Homo sapien
attttgggtatctacctagcagcag

SEQ ID NO: 630527 - DNA, 25 bp, Homo sapien
gggtatctacctagcagcagaattg

SEQ ID NO: 630528 - DNA, 25 bp, Homo sapien
gcagcagaattgctgagtcatttgt

SEQ ID NO: 630529 - DNA, 25 bp, Homo sapien
ttttttcgaggaatgacaacaatgc

SEQ ID NO: 630530 - DNA, 25 bp, Homo sapien
acaacaatgcacgagggttcaaatt

SEQ ID NO: 630531 - DNA, 25 bp, Homo sapien
cgagggttcaaatttctccatatcc

SEQ ID NO: 630532 - DNA, 25 bp, Homo sapien
ccatatccttgccaacacatgttat

SEQ ID NO: 630533 - DNA, 25 bp, Homo sapien
gccaacacatgttattttccattaa

SEQ ID NO: 630534 - DNA, 25 bp, Homo sapien
ggagcactcaccctggaagaacagg

SEQ ID NO: 630535 - DNA, 25 bp, Homo sapien
tggaagaacaggacgcccagcagag

SEQ ID NO: 630536 - DNA, 25 bp, Homo sapien
gctgcatcccggcagctcttcagat

SEQ ID NO: 630537 - DNA, 25 bp, Homo sapien
tcttcagatgcttgcacaccttgtt

SEQ ID NO: 630538 - DNA, 25 bp, Homo sapien
agatgcttgcacaccttgtttacag

SEQ ID NO: 630539 - DNA, 25 bp, Homo sapien
atgcttgcacaccttgtttacagct

SEQ ID NO: 630540 - DNA, 25 bp, Homo sapien
cacaccttgtttacagctcccggta

SEQ ID NO: 630541 - DNA, 25 bp, Homo sapien
aggtaacaccggaagtgacgtcaga

SEQ ID NO: 630542 - DNA, 25 bp, Homo sapien
aggaggccgagagacaacttaaatg

SEQ ID NO: 630543 - DNA, 25 bp, Homo sapien
gagacaacttaaatggcgatccgaa

SEQ ID NO: 630544 - DNA, 25 bp, Homo sapien
cttaaatggcgatccgaagttacca

SEQ ID NO: 630545 - DNA, 25 bp, Homo sapien
taaatgaagagagagtaagtgggcc

SEQ ID NO: 630546 - DNA, 25 bp, Homo sapien
aaatgaagagagagtaagtgggcca

SEQ ID NO: 630547 - DNA, 25 bp, Homo sapien
gaagagagagtaagtgggccaggaa

SEQ ID NO: 630548 - DNA, 25 bp, Homo sapien
aagagagagtaagtgggccaggaac

SEQ ID NO: 630549 - DNA, 25 bp, Homo sapien
gagagagtaagtgggccaggaacag

SEQ ID NO: 630550 - DNA, 25 bp, Homo sapien
gagtaagtgggccaggaacagtggc

SEQ ID NO: 630551 - DNA, 25 bp, Homo sapien
agtaagtgggccaggaacagtggct

SEQ ID NO: 630552 - DNA, 25 bp, Homo sapien
gtaagtgggccaggaacagtggctc

SEQ ID NO: 630553 - DNA, 25 bp, Homo sapien
ggaggtttgcagtgggtggatcact

SEQ ID NO: 630554 - DNA, 25 bp, Homo sapien
atcactttgggcccaggaagtggag

SEQ ID NO: 630555 - DNA, 25 bp, Homo sapien
gcctgagtgacagaacgagagcctt

SEQ ID NO: 630556 - DNA, 25 bp, Homo sapien
catttggaattgagtaccttgttaa

SEQ ID NO: 630557 - DNA, 25 bp, Homo sapien
gtaccttgttaactgtgtaataagt

SEQ ID NO: 630558 - DNA, 25 bp, Homo sapien
gagtatcataacatttttgcctata

SEQ ID NO: 630559 - DNA, 25 bp, Homo sapien
catttttgcctatatacacttttaa

SEQ ID NO: 630560 - DNA, 25 bp, Homo sapien
ggatgtgttgaaatgtagcctataa

SEQ ID NO: 630561 - DNA, 25 bp, Homo sapien
aaaccttatggatcttcacatgtct

SEQ ID NO: 630562 - DNA, 25 bp, Homo sapien
ttatggatcttcacatgtctggttc

SEQ ID NO: 630563 - DNA, 25 bp, Homo sapien
gatcttcacatgtctggttccaatt

SEQ ID NO: 630564 - DNA, 25 bp, Homo sapien
gtctggttccaattaatctgcttag

SEQ ID NO: 630565 - DNA, 25 bp, Homo sapien
ggttccaattaatctgcttagacta

SEQ ID NO: 630566 - DNA, 25 bp, Homo sapien
caattaatctgcttagactaatgga

SEQ ID NO: 630567 - DNA, 25 bp, Homo sapien
cacgcctggccaactcagaattgtt

SEQ ID NO: 630568 - DNA, 25 bp, Homo sapien
gcctggccaactcagaattgttttc

SEQ ID NO: 630569 - DNA, 25 bp, Homo sapien
tttcaaaaactaattcccattattg

SEQ ID NO: 630570 - DNA, 25 bp, Homo sapien
aattcccattattgtaattactctg

SEQ ID NO: 630571 - DNA, 25 bp, Homo sapien
ttcccattattgtaattactctgtg

SEQ ID NO: 630572 - DNA, 25 bp, Homo sapien
cattattgtaattactctgtgtacg

SEQ ID NO: 630573 - DNA, 25 bp, Homo sapien
tattgtaattactctgtgtacgttt

SEQ ID NO: 630574 - DNA, 25 bp, Homo sapien
tgtaattactctgtgtacgtttttt

SEQ ID NO: 630575 - DNA, 25 bp, Homo sapien
ctctgtgtacgtttttttgttgttg

SEQ ID NO: 630576 - DNA, 25 bp, Homo sapien
ttttgatatggaattgcactctagc

SEQ ID NO: 630577 - DNA, 25 bp, Homo sapien
ttgatatggaattgcactctagcct

SEQ ID NO: 630578 - DNA, 25 bp, Homo sapien
atttctaaaaagtgccacgcacctc

SEQ ID NO: 630579 - DNA, 25 bp, Homo sapien
acgcacctcccgagcaaataaaata

SEQ ID NO: 630580 - DNA, 25 bp, Homo sapien
gtactgttgtacgtgagaccctttt

SEQ ID NO: 630581 - DNA, 25 bp, Homo sapien
tacgtgagaccctttttctagacga

SEQ ID NO: 630582 - DNA, 25 bp, Homo sapien
gaccctttttctagacgatatgcaa

SEQ ID NO: 630583 - DNA, 25 bp, Homo sapien
aaatggttgcttactaatgtcttct

SEQ ID NO: 630584 - DNA, 25 bp, Homo sapien
ggttgcttactaatgtcttcttgac

SEQ ID NO: 630585 - DNA, 25 bp, Homo sapien
aatgtcttcttgactggtcttttga

SEQ ID NO: 630586 - DNA, 25 bp, Homo sapien
cttgactggtcttttgaaataagct

SEQ ID NO: 630587 - DNA, 25 bp, Homo sapien
gaaataagctttcttgcagggacat

SEQ ID NO: 630588 - DNA, 25 bp, Homo sapien
agctttcttgcagggacattacatt

SEQ ID NO: 630589 - DNA, 25 bp, Homo sapien
gactggtatcccaataagaagagag

SEQ ID NO: 630590 - DNA, 25 bp, Homo sapien
actggtatcccaataagaagagaga

SEQ ID NO: 630591 - DNA, 25 bp, Homo sapien
ctggtatcccaataagaagagagag

SEQ ID NO: 630592 - DNA, 25 bp, Homo sapien
tggtatcccaataagaagagagagg

SEQ ID NO: 630593 - DNA, 25 bp, Homo sapien
gtatcccaataagaagagagaggcc

SEQ ID NO: 630594 - DNA, 25 bp, Homo sapien
atcccaataagaagagagaggccgg

SEQ ID NO: 630595 - DNA, 25 bp, Homo sapien
ggaggttgagactgcgatgagccgg

SEQ ID NO: 630596 - DNA, 25 bp, Homo sapien
ggttgagactgcgatgagccgggat

SEQ ID NO: 630597 - DNA, 25 bp, Homo sapien
gttgagactgcgatgagccgggatt

SEQ ID NO: 630598 - DNA, 25 bp, Homo sapien
tgagactgcgatgagccgggattgt

SEQ ID NO: 630599 - DNA, 25 bp, Homo sapien
gagactgcgatgagccgggattgtg

SEQ ID NO: 630600 - DNA, 25 bp, Homo sapien
taaaagtatgttactgtctgggcgt

SEQ ID NO: 630601 - DNA, 25 bp, Homo sapien
aaaagtatgttactgtctgggcgtg

SEQ ID NO: 630602 - DNA, 25 bp, Homo sapien
aaagtatgttactgtctgggcgtgg

SEQ ID NO: 630603 - DNA, 25 bp, Homo sapien
aagtatgttactgtctgggcgtggt

SEQ ID NO: 630604 - DNA, 25 bp, Homo sapien
agtatgttactgtctgggcgtggtg

SEQ ID NO: 630605 - DNA, 25 bp, Homo sapien
gtatgttactgtctgggcgtggtgg

SEQ ID NO: 630606 - DNA, 25 bp, Homo sapien
atgttactgtctgggcgtggtggct

SEQ ID NO: 630607 - DNA, 25 bp, Homo sapien
tactgtctgggcgtggtggctgaag

SEQ ID NO: 630608 - DNA, 25 bp, Homo sapien
actgtctgggcgtggtggctgaagc

SEQ ID NO: 630609 - DNA, 25 bp, Homo sapien
ctgtctgggcgtggtggctgaagcc

SEQ ID NO: 630610 - DNA, 25 bp, Homo sapien
tgtctgggcgtggtggctgaagcct

SEQ ID NO: 630611 - DNA, 25 bp, Homo sapien
cgaagcaggcagatcgctaggtcag

SEQ ID NO: 630612 - DNA, 25 bp, Homo sapien
gaagcaggcagatcgctaggtcagg

SEQ ID NO: 630613 - DNA, 25 bp, Homo sapien
aagcaggcagatcgctaggtcagga

SEQ ID NO: 630614 - DNA, 25 bp, Homo sapien
agcaggcagatcgctaggtcaggag

SEQ ID NO: 630615 - DNA, 25 bp, Homo sapien
agtcccagaggctactgtactcagg

SEQ ID NO: 630616 - DNA, 25 bp, Homo sapien
gtcccagaggctactgtactcagga

SEQ ID NO: 630617 - DNA, 25 bp, Homo sapien
tcccagaggctactgtactcaggag

SEQ ID NO: 630618 - DNA, 25 bp, Homo sapien
cccagaggctactgtactcaggagg

SEQ ID NO: 630619 - DNA, 25 bp, Homo sapien
ccagaggctactgtactcaggaggc

SEQ ID NO: 630620 - DNA, 25 bp, Homo sapien
cagaggctactgtactcaggaggct

SEQ ID NO: 630621 - DNA, 25 bp, Homo sapien
agaggctactgtactcaggaggctg

SEQ ID NO: 630622 - DNA, 25 bp, Homo sapien
ctgatccggactgcacacagagaac

SEQ ID NO: 630623 - DNA, 25 bp, Homo sapien
tgatccggactgcacacagagaact

SEQ ID NO: 630624 - DNA, 25 bp, Homo sapien
gatccggactgcacacagagaactc

SEQ ID NO: 630625 - DNA, 25 bp, Homo sapien
atccggactgcacacagagaactca

SEQ ID NO: 630626 - DNA, 25 bp, Homo sapien
tccggactgcacacagagaactcac

SEQ ID NO: 630627 - DNA, 25 bp, Homo sapien
cggactgcacacagagaactcacca

SEQ ID NO: 630628 - DNA, 25 bp, Homo sapien
ggactgcacacagagaactcaccat

SEQ ID NO: 630629 - DNA, 25 bp, Homo sapien
gactgcacacagagaactcaccatg

SEQ ID NO: 630630 - DNA, 25 bp, Homo sapien
acagagaactcaccatggagtttgg

SEQ ID NO: 630631 - DNA, 25 bp, Homo sapien
ggactgagctgggttctccttgtag

SEQ ID NO: 630632 - DNA, 25 bp, Homo sapien
gctgggttctccttgtaggaatatt

SEQ ID NO: 630633 - DNA, 25 bp, Homo sapien
aggtaggtggattacctgatgtcaa

SEQ ID NO: 630634 - DNA, 25 bp, Homo sapien
ggtaggtggattacctgatgtcaag

SEQ ID NO: 630635 - DNA, 25 bp, Homo sapien
gtaggtggattacctgatgtcaaga

SEQ ID NO: 630636 - DNA, 25 bp, Homo sapien
taggtggattacctgatgtcaagag

SEQ ID NO: 630637 - DNA, 25 bp, Homo sapien
gtggattacctgatgtcaagagttt

SEQ ID NO: 630638 - DNA, 25 bp, Homo sapien
tggattacctgatgtcaagagtttg

SEQ ID NO: 630639 - DNA, 25 bp, Homo sapien
ggattacctgatgtcaagagtttga

SEQ ID NO: 630640 - DNA, 25 bp, Homo sapien
gattacctgatgtcaagagtttgag

SEQ ID NO: 630641 - DNA, 25 bp, Homo sapien
attacctgatgtcaagagtttgaga

SEQ ID NO: 630642 - DNA, 25 bp, Homo sapien
ttacctgatgtcaagagtttgagac

SEQ ID NO: 630643 - DNA, 25 bp, Homo sapien
cgtggtgatgcatgcctataatctc

SEQ ID NO: 630644 - DNA, 25 bp, Homo sapien
taatgcaaacttgacctttattggt

SEQ ID NO: 630645 - DNA, 25 bp, Homo sapien
aacccaccacatttctgttatcaac

SEQ ID NO: 630646 - DNA, 25 bp, Homo sapien
gttatcaacacagtacttccagagt

SEQ ID NO: 630647 - DNA, 25 bp, Homo sapien
acttccagagttgtgtttgtgttga

SEQ ID NO: 630648 - DNA, 25 bp, Homo sapien
gcgcgtaaagtgttgccatgcagag

SEQ ID NO: 630649 - DNA, 25 bp, Homo sapien
gttgccatgcagagtttcataagat

SEQ ID NO: 630650 - DNA, 25 bp, Homo sapien
taaatcctgcaatcgttactttcgc

SEQ ID NO: 630651 - DNA, 25 bp, Homo sapien
aatcgttactttcgcactaaccttg

SEQ ID NO: 630652 - DNA, 25 bp, Homo sapien
gttactttcgcactaaccttgtgca

SEQ ID NO: 630653 - DNA, 25 bp, Homo sapien
tttcgcactaaccttgtgcaaggca

SEQ ID NO: 630654 - DNA, 25 bp, Homo sapien
aaatcatgtttctcgtctgtcaaaa

SEQ ID NO: 630655 - DNA, 25 bp, Homo sapien
tctactggaacaaatatgcctaatg

SEQ ID NO: 630656 - DNA, 25 bp, Homo sapien
atgcctaatgtttatttcatgaagc

SEQ ID NO: 630657 - DNA, 25 bp, Homo sapien
gtttctcatttggtaagagcatatt

SEQ ID NO: 630658 - DNA, 25 bp, Homo sapien
tagttgtataacctaatggattttc

SEQ ID NO: 630659 - DNA, 25 bp, Homo sapien
aatggattttctcaaattacccaag

SEQ ID NO: 630660 - DNA, 25 bp, Homo sapien
attacccaagtttttaagcagaatg

SEQ ID NO: 630661 - DNA, 25 bp, Homo sapien
gtgtgttttcggaaactttcttcag

SEQ ID NO: 630662 - DNA, 25 bp, Homo sapien
aactttcttcaggatgtgtaacaca

SEQ ID NO: 630663 - DNA, 25 bp, Homo sapien
gaatacagacacactcgggacattt

SEQ ID NO: 630664 - DNA, 25 bp, Homo sapien
gacacactcgggacattttaataca

SEQ ID NO: 630665 - DNA, 25 bp, Homo sapien
cattttaactcaaacgataggtact

SEQ ID NO: 630666 - DNA, 25 bp, Homo sapien
agagatggagtcatagctgcgccct

SEQ ID NO: 630667 - DNA, 25 bp, Homo sapien
tggagtcatagctgcgccctgtcca

SEQ ID NO: 630668 - DNA, 25 bp, Homo sapien
tctcgggctgtcacacaagcctgga

SEQ ID NO: 630669 - DNA, 25 bp, Homo sapien
atttctcggccttgtcttcatcttg

SEQ ID NO: 630670 - DNA, 25 bp, Homo sapien
ttgtcttcatcttgggctaaccggt

SEQ ID NO: 630671 - DNA, 25 bp, Homo sapien
ttcatcttgggctaaccggtcgtct

SEQ ID NO: 630672 - DNA, 25 bp, Homo sapien
taaccggtcgtctcctgcaaacaga

SEQ ID NO: 630673 - DNA, 25 bp, Homo sapien
gtctcctgcaaacagacagcacgga

SEQ ID NO: 630674 - DNA, 25 bp, Homo sapien
cattacagcgctgattaaatacagg

SEQ ID NO: 630675 - DNA, 25 bp, Homo sapien
aaatacaggacattatctcaccata

SEQ ID NO: 630676 - DNA, 25 bp, Homo sapien
tcctggcggcgttcccaggaaaatt

SEQ ID NO: 630677 - DNA, 25 bp, Homo sapien
gattaaggagtgcaaccatgttgta

SEQ ID NO: 630678 - DNA, 25 bp, Homo sapien
gcaaccatgttgtagttctattatt

SEQ ID NO: 630679 - DNA, 25 bp, Homo sapien
gtagttctattattgagtacgtaaa

SEQ ID NO: 630680 - DNA, 25 bp, Homo sapien
gtaaattgatagatctcttccgtaa

SEQ ID NO: 630681 - DNA, 25 bp, Homo sapien
tgatagatctcttccgtaaaatgag

SEQ ID NO: 630682 - DNA, 25 bp, Homo sapien
gtaggttatattctttcctcttcac

SEQ ID NO: 630683 - DNA, 25 bp, Homo sapien
ggttatattctttcctcttcactac

SEQ ID NO: 630684 - DNA, 25 bp, Homo sapien
tattctttcctcttcactacctaaa

SEQ ID NO: 630685 - DNA, 25 bp, Homo sapien
ttcctcttcactacctaaacatttt

SEQ ID NO: 630686 - DNA, 25 bp, Homo sapien
actacctaaacattttaagctgtga

SEQ ID NO: 630687 - DNA, 25 bp, Homo sapien
aagctgtgaacaacctattattatt

SEQ ID NO: 630688 - DNA, 25 bp, Homo sapien
caagctttgtgagggcagagtcgta

SEQ ID NO: 630689 - DNA, 25 bp, Homo sapien
tgtgagggcagagtcgtaatctttt

SEQ ID NO: 630690 - DNA, 25 bp, Homo sapien
ttttttaaggctgtatccccaatgc

SEQ ID NO: 630691 - DNA, 25 bp, Homo sapien
tgtatccccaatgcctgggtaagta

SEQ ID NO: 630692 - DNA, 25 bp, Homo sapien
aacccttgtctgaccatacatctaa

SEQ ID NO: 630693 - DNA, 25 bp, Homo sapien
aacactctataaagacttggccttg

SEQ ID NO: 630694 - DNA, 25 bp, Homo sapien
aagacttggccttgctttatttcct

SEQ ID NO: 630695 - DNA, 25 bp, Homo sapien
tttatttccttctcagcactcatca

SEQ ID NO: 630696 - DNA, 25 bp, Homo sapien
agcactcatcactgtctgaaacaat

SEQ ID NO: 630697 - DNA, 25 bp, Homo sapien
ttattatcagtctcccttctcaaga

SEQ ID NO: 630698 - DNA, 25 bp, Homo sapien
gtctcccttctcaagaatgcaagct

SEQ ID NO: 630699 - DNA, 25 bp, Homo sapien
agctatatggcccagatctctgccg

SEQ ID NO: 630700 - DNA, 25 bp, Homo sapien
atggcccagatctctgccgctcaga

SEQ ID NO: 630701 - DNA, 25 bp, Homo sapien
tctgccgctcagacccattaagtac

SEQ ID NO: 630702 - DNA, 25 bp, Homo sapien
gacccattaagtaccccagcctgta

SEQ ID NO: 630703 - DNA, 25 bp, Homo sapien
ctgtaagcggcggtgagctctgtct

SEQ ID NO: 630704 - DNA, 25 bp, Homo sapien
ggcggtgagctctgtctggccctaa

SEQ ID NO: 630705 - DNA, 25 bp, Homo sapien
tgagctctgtctggccctaagttag

SEQ ID NO: 630706 - DNA, 25 bp, Homo sapien
ctctgtctggccctaagttagttgg

SEQ ID NO: 630707 - DNA, 25 bp, Homo sapien
gtctggccctaagttagttggccct

SEQ ID NO: 630708 - DNA, 25 bp, Homo sapien
gccctaagttagttggccctcaact

SEQ ID NO: 630709 - DNA, 25 bp, Homo sapien
agttagttggccctcaacttccgca

SEQ ID NO: 630710 - DNA, 25 bp, Homo sapien
gatagctcttcagtcaggctttgga

SEQ ID NO: 630711 - DNA, 25 bp, Homo sapien
cttcagtcaggctttggatgcaggc

SEQ ID NO: 630712 - DNA, 25 bp, Homo sapien
tggatgcaggcagatgtgtttattt

SEQ ID NO: 630713 - DNA, 25 bp, Homo sapien
ggacccatctcaagttcaggcgctg

SEQ ID NO: 630714 - DNA, 25 bp, Homo sapien
atctcaagttcaggcgctgggcatc

SEQ ID NO: 630715 - DNA, 25 bp, Homo sapien
atcgccctcttgtgctctcagagac

SEQ ID NO: 630716 - DNA, 25 bp, Homo sapien
tgggaggtcactgtccctggtcacc

SEQ ID NO: 630717 - DNA, 25 bp, Homo sapien
aagcaaactccctaaagctggcggt

SEQ ID NO: 630718 - DNA, 25 bp, Homo sapien
aaactccctaaagctggcggtctgg

SEQ ID NO: 630719 - DNA, 25 bp, Homo sapien
gcccctccaggctagagtgtgtggt

SEQ ID NO: 630720 - DNA, 25 bp, Homo sapien
gagtgtgtggtgcttttcttataac

SEQ ID NO: 630721 - DNA, 25 bp, Homo sapien
tcctgttcctagtgatctacattgt

SEQ ID NO: 630722 - DNA, 25 bp, Homo sapien
cctagtgatctacattgtcaccatg

SEQ ID NO: 630723 - DNA, 25 bp, Homo sapien
accatggtaggcaaccttggcttga

SEQ ID NO: 630724 - DNA, 25 bp, Homo sapien
ggtaggcaaccttggcttgatcact

SEQ ID NO: 630725 - DNA, 25 bp, Homo sapien
gcaaccttggcttgatcactctttt

SEQ ID NO: 630726 - DNA, 25 bp, Homo sapien
ccttggcttgatcactcttttcggt

SEQ ID NO: 630727 - DNA, 25 bp, Homo sapien
acacaccaatgtactatttcctctt

SEQ ID NO: 630728 - DNA, 25 bp, Homo sapien
acaccaatgtactatttcctcttca

SEQ ID NO: 630729 - DNA, 25 bp, Homo sapien
atgtactatttcctcttcaatctct

SEQ ID NO: 630730 - DNA, 25 bp, Homo sapien
tactatttcctcttcaatctctcct

SEQ ID NO: 630731 - DNA, 25 bp, Homo sapien
caatctctccttcattgatctctgt

SEQ ID NO: 630732 - DNA, 25 bp, Homo sapien
gattcattagtatcccgactcccta

SEQ ID NO: 630733 - DNA, 25 bp, Homo sapien
tcccgactccctaaaattgtatttg

SEQ ID NO: 630734 - DNA, 25 bp, Homo sapien
tgacagttcttgacaggttaccccg

SEQ ID NO: 630735 - DNA, 25 bp, Homo sapien
ttaccccgtaagacagtgaaaatat

SEQ ID NO: 630736 - DNA, 25 bp, Homo sapien
aaatatgactagttctctccgtgca

SEQ ID NO: 630737 - DNA, 25 bp, Homo sapien
gttctctccgtgcatctgagtgtaa

SEQ ID NO: 630738 - DNA, 25 bp, Homo sapien
ccgtgcatctgagtgtaatttcctt

SEQ ID NO: 630739 - DNA, 25 bp, Homo sapien
tccttattttatgagtccgaaagca

SEQ ID NO: 630740 - DNA, 25 bp, Homo sapien
ttaacttggatcctaaattgtgggc

SEQ ID NO: 630741 - DNA, 25 bp, Homo sapien
ttcttttgataggacttagtggctt

SEQ ID NO: 630742 - DNA, 25 bp, Homo sapien
agtggctttcaacagggcccatgat

SEQ ID NO: 630743 - DNA, 25 bp, Homo sapien
agtatgcaaaatgtggcaacctgga

SEQ ID NO: 630744 - DNA, 25 bp, Homo sapien
gtatgcaaaatgtggcaacctggag

SEQ ID NO: 630745 - DNA, 25 bp, Homo sapien
tatgcaaaatgtggcaacctggaga

SEQ ID NO: 630746 - DNA, 25 bp, Homo sapien
atgcaaaatgtggcaacctggagat

SEQ ID NO: 630747 - DNA, 25 bp, Homo sapien
atgaatgtttgcactttatgggaag

SEQ ID NO: 630748 - DNA, 25 bp, Homo sapien
ttgcactttatgggaagaccaacaa

SEQ ID NO: 630749 - DNA, 25 bp, Homo sapien
tgcactttatgggaagaccaacaag

SEQ ID NO: 630750 - DNA, 25 bp, Homo sapien
gcactttatgggaagaccaacaagt

SEQ ID NO: 630751 - DNA, 25 bp, Homo sapien
cactttatgggaagaccaacaagtt

SEQ ID NO: 630752 - DNA, 25 bp, Homo sapien
agatgtcagattaggactggtgaaa

SEQ ID NO: 630753 - DNA, 25 bp, Homo sapien
gaaaagcagatattctaggctccta

SEQ ID NO: 630754 - DNA, 25 bp, Homo sapien
tctaggctcctaaaataacgtggga

SEQ ID NO: 630755 - DNA, 25 bp, Homo sapien
aagcccagaacaaccttggacatgg

SEQ ID NO: 630756 - DNA, 25 bp, Homo sapien
ccttggacatggtgtgtttgtgcat

SEQ ID NO: 630757 - DNA, 25 bp, Homo sapien
gtgcatgggatgcttttcttttgag

SEQ ID NO: 630758 - DNA, 25 bp, Homo sapien
ttttgagacggaaggttgatgtgtt

SEQ ID NO: 630759 - DNA, 25 bp, Homo sapien
tgtgttgaagtcatggaaagtgttc

SEQ ID NO: 630760 - DNA, 25 bp, Homo sapien
ctgatctacttgcttaatgcagagg

SEQ ID NO: 630761 - DNA, 25 bp, Homo sapien
acttgcttaatgcagaggtgccaaa

SEQ ID NO: 630762 - DNA, 25 bp, Homo sapien
agaggtgccaaaaaccttcagttgt

SEQ ID NO: 630763 - DNA, 25 bp, Homo sapien
gtgtttccagcatagataagacagt

SEQ ID NO: 630764 - DNA, 25 bp, Homo sapien
cagtaacatgagatgtctgctgcat

SEQ ID NO: 630765 - DNA, 25 bp, Homo sapien
gtctgctgcattaaacagcgtctgt

SEQ ID NO: 630766 - DNA, 25 bp, Homo sapien
aacagcgtctgtggatcaagttgca

SEQ ID NO: 630767 - DNA, 25 bp, Homo sapien
atcaagttgcagtgcggatgtccaa

SEQ ID NO: 630768 - DNA, 25 bp, Homo sapien
gcagtgcggatgtccaaattgcttt

SEQ ID NO: 630769 - DNA, 25 bp, Homo sapien
aaattgctttactccccatgagacc

SEQ ID NO: 630770 - DNA, 25 bp, Homo sapien
gattatgttactgcaaactgatgtt

SEQ ID NO: 630771 - DNA, 25 bp, Homo sapien
ggagcagtacattccctgtctgaga

SEQ ID NO: 630772 - DNA, 25 bp, Homo sapien
acattccctgtctgagactggtgaa

SEQ ID NO: 630773 - DNA, 25 bp, Homo sapien
gaggcacctctaatgtgtttccagc

SEQ ID NO: 630774 - DNA, 25 bp, Homo sapien
atatttcctcctttattgatggtat

SEQ ID NO: 630775 - DNA, 25 bp, Homo sapien
ttcctcctttattgatggtatttaa

SEQ ID NO: 630776 - DNA, 25 bp, Homo sapien
aagtcaagactggagcttattttaa

SEQ ID NO: 630777 - DNA, 25 bp, Homo sapien
actggagcttattttaattgagcca

SEQ ID NO: 630778 - DNA, 25 bp, Homo sapien
attgagccagaatatttgcattttt

SEQ ID NO: 630779 - DNA, 25 bp, Homo sapien
ttctccttagaaatatgttaccttg

SEQ ID NO: 630780 - DNA, 25 bp, Homo sapien
tagaaatatgttaccttggtttctt

SEQ ID NO: 630781 - DNA, 25 bp, Homo sapien
atagaatcagtatatgcagtgttgg

SEQ ID NO: 630782 - DNA, 25 bp, Homo sapien
atgcagtgttggttatttggtaatt

SEQ ID NO: 630783 - DNA, 25 bp, Homo sapien
atttttatggtaattctgtcggaat

SEQ ID NO: 630784 - DNA, 25 bp, Homo sapien
tggtaattctgtcggaataaatgct

SEQ ID NO: 630785 - DNA, 25 bp, Homo sapien
tatattctatatctaccacagctat

SEQ ID NO: 630786 - DNA, 25 bp, Homo sapien
ccacagctattcaggcaacagtatt

SEQ ID NO: 630787 - DNA, 25 bp, Homo sapien
acagtattctaatagctagccttta

SEQ ID NO: 630788 - DNA, 25 bp, Homo sapien
taaaaatctgcctcattactaatgt

SEQ ID NO: 630789 - DNA, 25 bp, Homo sapien
ataggtctaatcctaggtagaaaag

SEQ ID NO: 630790 - DNA, 25 bp, Homo sapien
aaaggtgtttttccatacatcaaga

SEQ ID NO: 630791 - DNA, 25 bp, Homo sapien
aaggagattcagagtcatgctaaga

SEQ ID NO: 630792 - DNA, 25 bp, Homo sapien
catgctaagacagaatttcaatgct

SEQ ID NO: 630793 - DNA, 25 bp, Homo sapien
attgttctcctcaaagataaattca

SEQ ID NO: 630794 - DNA, 25 bp, Homo sapien
attcattcatctaaccatcttacag

SEQ ID NO: 630795 - DNA, 25 bp, Homo sapien
aaccatcttacagagtaatctttgt

SEQ ID NO: 630796 - DNA, 25 bp, Homo sapien
tctgtattaggatttggtacatctt

SEQ ID NO: 630797 - DNA, 25 bp, Homo sapien
ctgtattaggatttggtacatcttt

SEQ ID NO: 630798 - DNA, 25 bp, Homo sapien
gtattaggatttggtacatcttttg

SEQ ID NO: 630799 - DNA, 25 bp, Homo sapien
tattaggatttggtacatcttttgt

SEQ ID NO: 630800 - DNA, 25 bp, Homo sapien
attaggatttggtacatcttttgtt

SEQ ID NO: 630801 - DNA, 25 bp, Homo sapien
ttaggatttggtacatcttttgtta

SEQ ID NO: 630802 - DNA, 25 bp, Homo sapien
taggatttggtacatcttttgttat

SEQ ID NO: 630803 - DNA, 25 bp, Homo sapien
aggatttggtacatcttttgttata

SEQ ID NO: 630804 - DNA, 25 bp, Homo sapien
ggatttggtacatcttttgttatat

SEQ ID NO: 630805 - DNA, 25 bp, Homo sapien
gatttggtacatcttttgttatatt

SEQ ID NO: 630806 - DNA, 25 bp, Homo sapien
atttggtacatcttttgttatattt

SEQ ID NO: 630807 - DNA, 25 bp, Homo sapien
gcgcctggcctctcaattttttaag

SEQ ID NO: 630808 - DNA, 25 bp, Homo sapien
tggcctctcaattttttaaggtcgt

SEQ ID NO: 630809 - DNA, 25 bp, Homo sapien
tctgtattaggatttggtacatctt

SEQ ID NO: 630810 - DNA, 25 bp, Homo sapien
gtattaggatttggtacatcttttg

SEQ ID NO: 630811 - DNA, 25 bp, Homo sapien
attaggatttggtacatcttttgtt

SEQ ID NO: 630812 - DNA, 25 bp, Homo sapien
taggatttggtacatcttttgttat

SEQ ID NO: 630813 - DNA, 25 bp, Homo sapien
aggatttggtacatcttttgttata

SEQ ID NO: 630814 - DNA, 25 bp, Homo sapien
ggatttggtacatcttttgttatat

SEQ ID NO: 630815 - DNA, 25 bp, Homo sapien
gatttggtacatcttttgttatatt

SEQ ID NO: 630816 - DNA, 25 bp, Homo sapien
atttggtacatcttttgttatattt

SEQ ID NO: 630817 - DNA, 25 bp, Homo sapien
acatcttttgttatatttagtctaa

SEQ ID NO: 630818 - DNA, 25 bp, Homo sapien
gatggaagcagcactgatagatcaa

SEQ ID NO: 630819 - DNA, 25 bp, Homo sapien
gaagcagcactgatagatcaaaacc

SEQ ID NO: 630820 - DNA, 25 bp, Homo sapien
gcagcactgatagatcaaaaccacc

SEQ ID NO: 630821 - DNA, 25 bp, Homo sapien
actgatagatcaaaaccaccactgc

SEQ ID NO: 630822 - DNA, 25 bp, Homo sapien
tgatagatcaaaaccaccactgcat

SEQ ID NO: 630823 - DNA, 25 bp, Homo sapien
ttttgttcaccattttcctaagtgt

SEQ ID NO: 630824 - DNA, 25 bp, Homo sapien
ttgttcaccattttcctaagtgtgt

SEQ ID NO: 630825 - DNA, 25 bp, Homo sapien
gttcaccattttcctaagtgtgtta

SEQ ID NO: 630826 - DNA, 25 bp, Homo sapien
caccattttcctaagtgtgttattt

SEQ ID NO: 630827 - DNA, 25 bp, Homo sapien
cattttcctaagtgtgttatttaga

SEQ ID NO: 630828 - DNA, 25 bp, Homo sapien
agtgtctcatgggacttatctatag

SEQ ID NO: 630829 - DNA, 25 bp, Homo sapien
ttgcactccaaccagggcaatgaga

SEQ ID NO: 630830 - DNA, 25 bp, Homo sapien
tccaaccagggcaatgagagcaaaa

SEQ ID NO: 630831 - DNA, 25 bp, Homo sapien
ccaaccagggcaatgagagcaaaac

SEQ ID NO: 630832 - DNA, 25 bp, Homo sapien
caaccagggcaatgagagcaaaact

SEQ ID NO: 630833 - DNA, 25 bp, Homo sapien
aaccagggcaatgagagcaaaactc

SEQ ID NO: 630834 - DNA, 25 bp, Homo sapien
accagggcaatgagagcaaaactcc

SEQ ID NO: 630835 - DNA, 25 bp, Homo sapien
ccagggcaatgagagcaaaactccg

SEQ ID NO: 630836 - DNA, 25 bp, Homo sapien
cagggcaatgagagcaaaactccgt

SEQ ID NO: 630837 - DNA, 25 bp, Homo sapien
acttctggaggccgaaggaggcaga

SEQ ID NO: 630838 - DNA, 25 bp, Homo sapien
cttctggaggccgaaggaggcagat

SEQ ID NO: 630839 - DNA, 25 bp, Homo sapien
ttctggaggccgaaggaggcagatc

SEQ ID NO: 630840 - DNA, 25 bp, Homo sapien
tggtattaaagaaggactaagggct

SEQ ID NO: 630841 - DNA, 25 bp, Homo sapien
aaagaaggactaagggctaatgagt

SEQ ID NO: 630842 - DNA, 25 bp, Homo sapien
aaaaaatgccttatgataatcttga

SEQ ID NO: 630843 - DNA, 25 bp, Homo sapien
taatcttgaaatcatttacaatgta

SEQ ID NO: 630844 - DNA, 25 bp, Homo sapien
ttacaatgtaattcaaagtatgcat

SEQ ID NO: 630845 - DNA, 25 bp, Homo sapien
aattgagttatgtatcatcttgttt

SEQ ID NO: 630846 - DNA, 25 bp, Homo sapien
atgtatcatcttgtttatattgggc

SEQ ID NO: 630847 - DNA, 25 bp, Homo sapien
gtatcatcttgtttatattgggcta

SEQ ID NO: 630848 - DNA, 25 bp, Homo sapien
atcatcttgtttatattgggctaag

SEQ ID NO: 630849 - DNA, 25 bp, Homo sapien
tcttgtttatattgggctaagtctc

SEQ ID NO: 630850 - DNA, 25 bp, Homo sapien
cttgtttatattgggctaagtctct

SEQ ID NO: 630851 - DNA, 25 bp, Homo sapien
ttttcccaggcctactttatacact

SEQ ID NO: 630852 - DNA, 25 bp, Homo sapien
tactttatacactcactttcctttc

SEQ ID NO: 630853 - DNA, 25 bp, Homo sapien
actttcctttctcgagtctggcatt

SEQ ID NO: 630854 - DNA, 25 bp, Homo sapien
gagtctggcattctgcttgccatgg

SEQ ID NO: 630855 - DNA, 25 bp, Homo sapien
caaccctcttagatatacctctgta

SEQ ID NO: 630856 - DNA, 25 bp, Homo sapien
acctctgtacttactaatactcgag

SEQ ID NO: 630857 - DNA, 25 bp, Homo sapien
ttttttctgtattgtcactcccatg

SEQ ID NO: 630858 - DNA, 25 bp, Homo sapien
tgtattgtcactcccatgttctttc

SEQ ID NO: 630859 - DNA, 25 bp, Homo sapien
ttctttcacatgcattctgccttca

SEQ ID NO: 630860 - DNA, 25 bp, Homo sapien
ttctgccttcaccaggatgtcatta

SEQ ID NO: 630861 - DNA, 25 bp, Homo sapien
caccaggatgtcattaaactcgcct

SEQ ID NO: 630862 - DNA, 25 bp, Homo sapien
cagctcgtcttctgaaaacccttta

SEQ ID NO: 630863 - DNA, 25 bp, Homo sapien
agctcgtcttctgaaaaccctttag

SEQ ID NO: 630864 - DNA, 25 bp, Homo sapien
gctcgtcttctgaaaaccctttagg

SEQ ID NO: 630865 - DNA, 25 bp, Homo sapien
gtcttctgaaaaccctttagggatg

SEQ ID NO: 630866 - DNA, 25 bp, Homo sapien
cctttagggatggagaacctgggca

SEQ ID NO: 630867 - DNA, 25 bp, Homo sapien
ttagggatggagaacctgggcaaca

SEQ ID NO: 630868 - DNA, 25 bp, Homo sapien
aaaaaagccatctagtatggctgat

SEQ ID NO: 630869 - DNA, 25 bp, Homo sapien
ctagtatggctgataggagagctct

SEQ ID NO: 630870 - DNA, 25 bp, Homo sapien
gtatggctgataggagagctctatg

SEQ ID NO: 630871 - DNA, 25 bp, Homo sapien
gctgataggagagctctatgagttc

SEQ ID NO: 630872 - DNA, 25 bp, Homo sapien
ataggagagctctatgagttcaaat

SEQ ID NO: 630873 - DNA, 25 bp, Homo sapien
gaggttccaactgagagatcccacc

SEQ ID NO: 630874 - DNA, 25 bp, Homo sapien
gttccaactgagagatcccaccctt

SEQ ID NO: 630875 - DNA, 25 bp, Homo sapien
cagctctgatcagatacccctgaag

SEQ ID NO: 630876 - DNA, 25 bp, Homo sapien
cctgaagtttggaaggcaacagcta

SEQ ID NO: 630877 - DNA, 25 bp, Homo sapien
gcaacagctaaacaatctctctctc

SEQ ID NO: 630878 - DNA, 25 bp, Homo sapien
gaaagtaatggcagtgctcgctttg

SEQ ID NO: 630879 - DNA, 25 bp, Homo sapien
gaagattagcatgtgcaaggatgac

SEQ ID NO: 630880 - DNA, 25 bp, Homo sapien
gtgcaaggatgacacccaaatctgt

SEQ ID NO: 630881 - DNA, 25 bp, Homo sapien
gatgacacccaaatctgtgaagcct

SEQ ID NO: 630882 - DNA, 25 bp, Homo sapien
acccaaatctgtgaagccttctata

SEQ ID NO: 630883 - DNA, 25 bp, Homo sapien
aatctgtgaagccttctatatttaa

SEQ ID NO: 630884 - DNA, 25 bp, Homo sapien
tgggaatggtgcatgcagtgttaaa

SEQ ID NO: 630885 - DNA, 25 bp, Homo sapien
gtgcatgcagtgttaaagggaattt

SEQ ID NO: 630886 - DNA, 25 bp, Homo sapien
gttaaagggaatttatctgtcaaat

SEQ ID NO: 630887 - DNA, 25 bp, Homo sapien
ttttttaatgcacttcaattttgac

SEQ ID NO: 630888 - DNA, 25 bp, Homo sapien
gcttctaggaaattatccaacagat

SEQ ID NO: 630889 - DNA, 25 bp, Homo sapien
gcaagtgcaaaatggcatatacaca

SEQ ID NO: 630890 - DNA, 25 bp, Homo sapien
ttactgcagcattatctcagcaaaa

SEQ ID NO: 630891 - DNA, 25 bp, Homo sapien
gcattatctcagcaaaaggctagag

SEQ ID NO: 630892 - DNA, 25 bp, Homo sapien
aaggctagagataacccgaatgtcc

SEQ ID NO: 630893 - DNA, 25 bp, Homo sapien
agagataacccgaatgtccatcaga

SEQ ID NO: 630894 - DNA, 25 bp, Homo sapien
gataacccgaatgtccatcagaagg

SEQ ID NO: 630895 - DNA, 25 bp, Homo sapien
aaatagaaccggaacactgatgatt

SEQ ID NO: 630896 - DNA, 25 bp, Homo sapien
ggaacactgatgattccatcaactg

SEQ ID NO: 630897 - DNA, 25 bp, Homo sapien
catcaactgatggttccttttaatc

SEQ ID NO: 630898 - DNA, 25 bp, Homo sapien
gatggttccttttaatcagatctta

SEQ ID NO: 630899 - DNA, 25 bp, Homo sapien
gcaaagaactctgaatgcttagccg

SEQ ID NO: 630900 - DNA, 25 bp, Homo sapien
aaggagcccgcctggtactgcaagg

SEQ ID NO: 630901 - DNA, 25 bp, Homo sapien
gcctggtactgcaaggcatgactgc

SEQ ID NO: 630902 - DNA, 25 bp, Homo sapien
agaagatggcgccaaatgaccaaac

SEQ ID NO: 630903 - DNA, 25 bp, Homo sapien
atgaccaaactacatgcgactttcc

SEQ ID NO: 630904 - DNA, 25 bp, Homo sapien
tgcgactttcccttcccgcaagaaa

SEQ ID NO: 630905 - DNA, 25 bp, Homo sapien
ttcccttcccgcaagaaaagtgaat

SEQ ID NO: 630906 - DNA, 25 bp, Homo sapien
cccatcccagaaacctctggtatta

SEQ ID NO: 630907 - DNA, 25 bp, Homo sapien
ctggtattaggtcaagagctgtctt

SEQ ID NO: 630908 - DNA, 25 bp, Homo sapien
aggtcaagagctgtcttccatttcc

SEQ ID NO: 630909 - DNA, 25 bp, Homo sapien
tccatttcccttggcttagggactt

SEQ ID NO: 630910 - DNA, 25 bp, Homo sapien
cagctttcagaatttgtgtcccctt

SEQ ID NO: 630911 - DNA, 25 bp, Homo sapien
tttcagaatttgtgtccccttgacc

SEQ ID NO: 630912 - DNA, 25 bp, Homo sapien
gtccccttgaccctgagatacaggt

SEQ ID NO: 630913 - DNA, 25 bp, Homo sapien
gggatgttttatcatttataagcat

SEQ ID NO: 630914 - DNA, 25 bp, Homo sapien
tattctgcagaatggtggttggtgt

SEQ ID NO: 630915 - DNA, 25 bp, Homo sapien
tttatctcctgttctagtagctctg

SEQ ID NO: 630916 - DNA, 25 bp, Homo sapien
ttctagtagctctgtggaacctgac

SEQ ID NO: 630917 - DNA, 25 bp, Homo sapien
aaggacccaggctcttgggttctga

SEQ ID NO: 630918 - DNA, 25 bp, Homo sapien
ggtgaggctgtctgtcatgatgacc

SEQ ID NO: 630919 - DNA, 25 bp, Homo sapien
tcatgatgaccttgaccttttcctt

SEQ ID NO: 630920 - DNA, 25 bp, Homo sapien
cctctccccttctttaagagtggag

SEQ ID NO: 630921 - DNA, 25 bp, Homo sapien
gaccctccatttcagtctgtacaaa

SEQ ID NO: 630922 - DNA, 25 bp, Homo sapien
gtctgtacaaaccactaattccttc

SEQ ID NO: 630923 - DNA, 25 bp, Homo sapien
acaaaccactaattccttctgtgcc

SEQ ID NO: 630924 - DNA, 25 bp, Homo sapien
tccttctgtgcccttaggcaagtca

SEQ ID NO: 630925 - DNA, 25 bp, Homo sapien
aagtcactcgccctgcctggtcaat

SEQ ID NO: 630926 - DNA, 25 bp, Homo sapien
gcctggtcaataaagtctccttctt

SEQ ID NO: 630927 - DNA, 25 bp, Homo sapien
gtcaataaagtctccttctttactg

SEQ ID NO: 630928 - DNA, 25 bp, Homo sapien
ttcatttttatcagcttattttggg

SEQ ID NO: 630929 - DNA, 25 bp, Homo sapien
gtggcaaggactgttcattttgcgt

SEQ ID NO: 630930 - DNA, 25 bp, Homo sapien
caaggactgttcattttgcgtggtg

SEQ ID NO: 630931 - DNA, 25 bp, Homo sapien
aggactgttcattttgcgtggtgaa

SEQ ID NO: 630932 - DNA, 25 bp, Homo sapien
actgttcattttgcgtggtgaaggg

SEQ ID NO: 630933 - DNA, 25 bp, Homo sapien
gtaaaagtatcaactctgaacctta

SEQ ID NO: 630934 - DNA, 25 bp, Homo sapien
gtatcaactctgaaccttagaatgc

SEQ ID NO: 630935 - DNA, 25 bp, Homo sapien
aactctgaaccttagaatgcaagaa

SEQ ID NO: 630936 - DNA, 25 bp, Homo sapien
gaaccttagaatgcaagaagttaaa

SEQ ID NO: 630937 - DNA, 25 bp, Homo sapien
agttaaatcttgtgcttctctttgt

SEQ ID NO: 630938 - DNA, 25 bp, Homo sapien
ttgaacatatgcttaaatttgaaaa

SEQ ID NO: 630939 - DNA, 25 bp, Homo sapien
ggagaagtagaaatgccactgaaag

SEQ ID NO: 630940 - DNA, 25 bp, Homo sapien
tagaaatgccactgaaaggaagacg

SEQ ID NO: 630941 - DNA, 25 bp, Homo sapien
gaataggacctattaagccagcagg

SEQ ID NO: 630942 - DNA, 25 bp, Homo sapien
gacctattaagccagcaggacctgt

SEQ ID NO: 630943 - DNA, 25 bp, Homo sapien
ctattaagccagcaggacctgtcac

SEQ ID NO: 630944 - DNA, 25 bp, Homo sapien
taagccagcaggacctgtcacagct

SEQ ID NO: 630945 - DNA, 25 bp, Homo sapien
aggacctgtcacagctgtaccctgt

SEQ ID NO: 630946 - DNA, 25 bp, Homo sapien
gtcacagctgtaccctgtgatgata

SEQ ID NO: 630947 - DNA, 25 bp, Homo sapien
agctgtaccctgtgatgataaaata

SEQ ID NO: 630948 - DNA, 25 bp, Homo sapien
aaacgaagatctgggccaattaagc

SEQ ID NO: 630949 - DNA, 25 bp, Homo sapien
gatctgggccaattaagccagaaaa

SEQ ID NO: 630950 - DNA, 25 bp, Homo sapien
gtagagtgtaaaatcctggatgtcc

SEQ ID NO: 630951 - DNA, 25 bp, Homo sapien
tctcagcctgtctccttgagaggac

SEQ ID NO: 630952 - DNA, 25 bp, Homo sapien
tctccttgagaggacctgctgcctg

SEQ ID NO: 630953 - DNA, 25 bp, Homo sapien
tggagcacgtcattctcttcttgga

SEQ ID NO: 630954 - DNA, 25 bp, Homo sapien
gcacgtcattctcttcttggatgac

SEQ ID NO: 630955 - DNA, 25 bp, Homo sapien
gaaatgaaaactccttatctcctta

SEQ ID NO: 630956 - DNA, 25 bp, Homo sapien
gaaaactccttatctccttatagga

SEQ ID NO: 630957 - DNA, 25 bp, Homo sapien
ctccttataggatctgagctcagtg

SEQ ID NO: 630958 - DNA, 25 bp, Homo sapien
caataattgaccaatcacacattta

SEQ ID NO: 630959 - DNA, 25 bp, Homo sapien
aattaggccgttggtgttcagcagc

SEQ ID NO: 630960 - DNA, 25 bp, Homo sapien
aggccgttggtgttcagcagcaatt

SEQ ID NO: 630961 - DNA, 25 bp, Homo sapien
tattacatctaaactaaaacttctg

SEQ ID NO: 630962 - DNA, 25 bp, Homo sapien
aaacttctgtaatcactatattcta

SEQ ID NO: 630963 - DNA, 25 bp, Homo sapien
gtaatcactatattctattgaaaag

SEQ ID NO: 630964 - DNA, 25 bp, Homo sapien
atcaggacaatgcaaaaggagaaat

SEQ ID NO: 630965 - DNA, 25 bp, Homo sapien
gatctatatagagaatacatgcaaa

SEQ ID NO: 630966 - DNA, 25 bp, Homo sapien
atcagttgatgaattcctttttggt

SEQ ID NO: 630967 - DNA, 25 bp, Homo sapien
cagttgatgaattcctttttggtaa

SEQ ID NO: 630968 - DNA, 25 bp, Homo sapien
gaacagcctgttctaacatgccaaa

SEQ ID NO: 630969 - DNA, 25 bp, Homo sapien
aacagcctgttctaacatgccaaaa

SEQ ID NO: 630970 - DNA, 25 bp, Homo sapien
aaattcagccataatggaatccaca

SEQ ID NO: 630971 - DNA, 25 bp, Homo sapien
tgacagatattcaacttattacatc

SEQ ID NO: 630972 - DNA, 25 bp, Homo sapien
gtaaataattttagagctgggcatg

SEQ ID NO: 630973 - DNA, 25 bp, Homo sapien
taatcccagccactgtgtccggaat

SEQ ID NO: 630974 - DNA, 25 bp, Homo sapien
cagccactgtgtccggaattggcgg

SEQ ID NO: 630975 - DNA, 25 bp, Homo sapien
tatgaagccgcggacacttgtggtg

SEQ ID NO: 630976 - DNA, 25 bp, Homo sapien
atgaagccgcggacacttgtggtga

SEQ ID NO: 630977 - DNA, 25 bp, Homo sapien
tgaagccgcggacacttgtggtgag

SEQ ID NO: 630978 - DNA, 25 bp, Homo sapien
gaagccgcggacacttgtggtgagt

SEQ ID NO: 630979 - DNA, 25 bp, Homo sapien
aagccgcggacacttgtggtgagtg

SEQ ID NO: 630980 - DNA, 25 bp, Homo sapien
agccgcggacacttgtggtgagtgt

SEQ ID NO: 630981 - DNA, 25 bp, Homo sapien
gccgcggacacttgtggtgagtgtt

SEQ ID NO: 630982 - DNA, 25 bp, Homo sapien
gcggacacttgtggtgagtgttaca

SEQ ID NO: 630983 - DNA, 25 bp, Homo sapien
ccttttccagccttttgattcattt

SEQ ID NO: 630984 - DNA, 25 bp, Homo sapien
ttcatttttatcagcttattttggg

SEQ ID NO: 630985 - DNA, 25 bp, Homo sapien
gtggcaaggactgttcattttgcgt

SEQ ID NO: 630986 - DNA, 25 bp, Homo sapien
aaggactgttcattttgcgtggtga

SEQ ID NO: 630987 - DNA, 25 bp, Homo sapien
gactgttcattttgcgtggtgaagg

SEQ ID NO: 630988 - DNA, 25 bp, Homo sapien
gtaaaagtatcaactctgaacctta

SEQ ID NO: 630989 - DNA, 25 bp, Homo sapien
gtatcaactctgaaccttagaatgc

SEQ ID NO: 630990 - DNA, 25 bp, Homo sapien
aactctgaaccttagaatgcaagaa

SEQ ID NO: 630991 - DNA, 25 bp, Homo sapien
agttaaatcttgtgcttctctttgt

SEQ ID NO: 630992 - DNA, 25 bp, Homo sapien
taaatcttgtgcttctctttgtatt

SEQ ID NO: 630993 - DNA, 25 bp, Homo sapien
ttgaacatatgcttaaatttgaaaa

SEQ ID NO: 630994 - DNA, 25 bp, Homo sapien
ggggtggagagaccatcccgggcgt

SEQ ID NO: 630995 - DNA, 25 bp, Homo sapien
gggtggagagaccatcccgggcgtc

SEQ ID NO: 630996 - DNA, 25 bp, Homo sapien
ggtggagagaccatcccgggcgtcc

SEQ ID NO: 630997 - DNA, 25 bp, Homo sapien
gtggagagaccatcccgggcgtccc

SEQ ID NO: 630998 - DNA, 25 bp, Homo sapien
tggagagaccatcccgggcgtcccc

SEQ ID NO: 630999 - DNA, 25 bp, Homo sapien
ggagagaccatcccgggcgtccccg

SEQ ID NO: 631000 - DNA, 25 bp, Homo sapien
gagagaccatcccgggcgtccccgc

SEQ ID NO: 631001 - DNA, 25 bp, Homo sapien
agagaccatcccgggcgtccccgcg

SEQ ID NO: 631002 - DNA, 25 bp, Homo sapien
gagaccatcccgggcgtccccgcgt

SEQ ID NO: 631003 - DNA, 25 bp, Homo sapien
gaccatcccgggcgtccccgcgtct

SEQ ID NO: 631004 - DNA, 25 bp, Homo sapien
accatcccgggcgtccccgcgtctg

SEQ ID NO: 631005 - DNA, 25 bp, Homo sapien
gaaagaaggggctaggcacagtggc

SEQ ID NO: 631006 - DNA, 25 bp, Homo sapien
aaagaaggggctaggcacagtggct

SEQ ID NO: 631007 - DNA, 25 bp, Homo sapien
aagaaggggctaggcacagtggctc

SEQ ID NO: 631008 - DNA, 25 bp, Homo sapien
agaaggggctaggcacagtggctcg

SEQ ID NO: 631009 - DNA, 25 bp, Homo sapien
gaaggggctaggcacagtggctcgt

SEQ ID NO: 631010 - DNA, 25 bp, Homo sapien
aaggggctaggcacagtggctcgtg

SEQ ID NO: 631011 - DNA, 25 bp, Homo sapien
aggggctaggcacagtggctcgtgc

SEQ ID NO: 631012 - DNA, 25 bp, Homo sapien
taggcacagtggctcgtgcctgtca

SEQ ID NO: 631013 - DNA, 25 bp, Homo sapien
attgcactctagcccggacgacaga

SEQ ID NO: 631014 - DNA, 25 bp, Homo sapien
cactctagcccggacgacagagcga

SEQ ID NO: 631015 - DNA, 25 bp, Homo sapien
actctagcccggacgacagagcgag

SEQ ID NO: 631016 - DNA, 25 bp, Homo sapien
atgctgctcagctgttgactctgga

SEQ ID NO: 631017 - DNA, 25 bp, Homo sapien
gcacagtactgtggaagatgccaga

SEQ ID NO: 631018 - DNA, 25 bp, Homo sapien
gatgccagaaagatgcacctcccta

SEQ ID NO: 631019 - DNA, 25 bp, Homo sapien
gcacctccctatagcaaatgaagta

SEQ ID NO: 631020 - DNA, 25 bp, Homo sapien
gaattatcttctttacaaactccag

SEQ ID NO: 631021 - DNA, 25 bp, Homo sapien
aactccagaggatagcagaatgatt

SEQ ID NO: 631022 - DNA, 25 bp, Homo sapien
gttgatatgcagaacatttgtcttt

SEQ ID NO: 631023 - DNA, 25 bp, Homo sapien
gggcacttttagttcacaagatggc

SEQ ID NO: 631024 - DNA, 25 bp, Homo sapien
ttcacaagatggcatattgctctcc

SEQ ID NO: 631025 - DNA, 25 bp, Homo sapien
ttgggaattatttcccttctgccct

SEQ ID NO: 631026 - DNA, 25 bp, Homo sapien
aatcataggctacatcatgctgctc

SEQ ID NO: 631027 - DNA, 25 bp, Homo sapien
gggtgcaagagatcacgtcttcact

SEQ ID NO: 631028 - DNA, 25 bp, Homo sapien
aagagatcacgtcttcactcagggc

SEQ ID NO: 631029 - DNA, 25 bp, Homo sapien
tcacgtcttcactcagggctttggg

SEQ ID NO: 631030 - DNA, 25 bp, Homo sapien
gcagccaattaataattaatcccct

SEQ ID NO: 631031 - DNA, 25 bp, Homo sapien
agctttattatctcttctgggcgac

SEQ ID NO: 631032 - DNA, 25 bp, Homo sapien
tttattatctcttctgggcgacaga

SEQ ID NO: 631033 - DNA, 25 bp, Homo sapien
gggcgacagagatttgtctgataac

SEQ ID NO: 631034 - DNA, 25 bp, Homo sapien
agatttgtctgataaccccctgaag

SEQ ID NO: 631035 - DNA, 25 bp, Homo sapien
ccaaatgtcaagtttaaccaaatag

SEQ ID NO: 631036 - DNA, 25 bp, Homo sapien
gttattgctttatcaacccgagtct

SEQ ID NO: 631037 - DNA, 25 bp, Homo sapien
ctttatcaacccgagtctgcaaata

SEQ ID NO: 631038 - DNA, 25 bp, Homo sapien
attcactctagaatcggccaggtct

SEQ ID NO: 631039 - DNA, 25 bp, Homo sapien
gaatcggccaggtcttaccaaaatg

SEQ ID NO: 631040 - DNA, 25 bp, Homo sapien
agctacttcaaaactcatctgtcta

SEQ ID NO: 631041 - DNA, 25 bp, Homo sapien
catctgtctaacttattttcactaa

SEQ ID NO: 631042 - DNA, 25 bp, Homo sapien
cactaataagtgtaacttgcctgga

SEQ ID NO: 631043 - DNA, 25 bp, Homo sapien
acttgcctggaatttggcagatcta

SEQ ID NO: 631044 - DNA, 25 bp, Homo sapien
gcagatctaagctgggcttgggcta

SEQ ID NO: 631045 - DNA, 25 bp, Homo sapien
ctgggcttgggctagatggtttcaa

SEQ ID NO: 631046 - DNA, 25 bp, Homo sapien
agatggtttcaagcctgagtcatta

SEQ ID NO: 631047 - DNA, 25 bp, Homo sapien
caagcctgagtcattaagatgtgaa

SEQ ID NO: 631048 - DNA, 25 bp, Homo sapien
gacactctaatggtgcagtctgcat

SEQ ID NO: 631049 - DNA, 25 bp, Homo sapien
tcttaaaaaatctggaagcaggctg

SEQ ID NO: 631050 - DNA, 25 bp, Homo sapien
cttaaaaaatctggaagcaggctgg

SEQ ID NO: 631051 - DNA, 25 bp, Homo sapien
ttaaaaaatctggaagcaggctggg

SEQ ID NO: 631052 - DNA, 25 bp, Homo sapien
taaaaaatctggaagcaggctgggt

SEQ ID NO: 631053 - DNA, 25 bp, Homo sapien
aaaaaatctggaagcaggctgggtg

SEQ ID NO: 631054 - DNA, 25 bp, Homo sapien
aaaaatctggaagcaggctgggtgc

SEQ ID NO: 631055 - DNA, 25 bp, Homo sapien
aaaatctggaagcaggctgggtgcg

SEQ ID NO: 631056 - DNA, 25 bp, Homo sapien
ccagctatttgggaaactgagatag

SEQ ID NO: 631057 - DNA, 25 bp, Homo sapien
cagctatttgggaaactgagatagg

SEQ ID NO: 631058 - DNA, 25 bp, Homo sapien
agctatttgggaaactgagatagga

SEQ ID NO: 631059 - DNA, 25 bp, Homo sapien
tatttgggaaactgagataggagaa

SEQ ID NO: 631060 - DNA, 25 bp, Homo sapien
aaggaagatgctttttggcaaggca

SEQ ID NO: 631061 - DNA, 25 bp, Homo sapien
tggcaaggcataaattcagaggatc

SEQ ID NO: 631062 - DNA, 25 bp, Homo sapien
gatgtttcaacaacacaaagctgat

SEQ ID NO: 631063 - DNA, 25 bp, Homo sapien
aagctgattgtttggcagttgcatc

SEQ ID NO: 631064 - DNA, 25 bp, Homo sapien
ggcagttgcatctatttcatgcata

SEQ ID NO: 631065 - DNA, 25 bp, Homo sapien
tatttcatgcatagaacttctccag

SEQ ID NO: 631066 - DNA, 25 bp, Homo sapien
gaacttctccagatggactaccaag

SEQ ID NO: 631067 - DNA, 25 bp, Homo sapien
tggactaccaagaaacactgtgctt

SEQ ID NO: 631068 - DNA, 25 bp, Homo sapien
gaaacactgtgcttcaaagaatttg

SEQ ID NO: 631069 - DNA, 25 bp, Homo sapien
aacagagctgtgatggaactcgaga

SEQ ID NO: 631070 - DNA, 25 bp, Homo sapien
ggaactcgagatctaagtgattcta

SEQ ID NO: 631071 - DNA, 25 bp, Homo sapien
gatggaagcagcactgatagatcaa

SEQ ID NO: 631072 - DNA, 25 bp, Homo sapien
gaagcagcactgatagatcaaaacc

SEQ ID NO: 631073 - DNA, 25 bp, Homo sapien
tgatagatcaaaaccaccactgcat

SEQ ID NO: 631074 - DNA, 25 bp, Homo sapien
ccaccactgcatatgtattacactg

SEQ ID NO: 631075 - DNA, 25 bp, Homo sapien
ttttgttcaccattttcctaagtgt

SEQ ID NO: 631076 - DNA, 25 bp, Homo sapien
ttgttcaccattttcctaagtgtgt

SEQ ID NO: 631077 - DNA, 25 bp, Homo sapien
gttcaccattttcctaagtgtgtta

SEQ ID NO: 631078 - DNA, 25 bp, Homo sapien
caccattttcctaagtgtgttattt

SEQ ID NO: 631079 - DNA, 25 bp, Homo sapien
cattttcctaagtgtgttatttaga

SEQ ID NO: 631080 - DNA, 25 bp, Homo sapien
gaatcttttgccagaagtgtctcat

SEQ ID NO: 631081 - DNA, 25 bp, Homo sapien
agtgtctcatgggacttatctatag

SEQ ID NO: 631082 - DNA, 25 bp, Homo sapien
ctatctctgataataaaatgtgaca

SEQ ID NO: 631083 - DNA, 25 bp, Homo sapien
caaagttaaacctaataagcagcta

SEQ ID NO: 631084 - DNA, 25 bp, Homo sapien
taagcagctatataggttgttcaag

SEQ ID NO: 631085 - DNA, 25 bp, Homo sapien
gcagctatataggttgttcaagtat

SEQ ID NO: 631086 - DNA, 25 bp, Homo sapien
atataggttgttcaagtatgcttga

SEQ ID NO: 631087 - DNA, 25 bp, Homo sapien
gttgttcaagtatgcttgattgtac

SEQ ID NO: 631088 - DNA, 25 bp, Homo sapien
gcttgattgtacatattgagacaga

SEQ ID NO: 631089 - DNA, 25 bp, Homo sapien
gattagagcataataacaactgaaa

SEQ ID NO: 631090 - DNA, 25 bp, Homo sapien
gaaaaactcagtaggagagcaatat

SEQ ID NO: 631091 - DNA, 25 bp, Homo sapien
gagcaatatagattatgtagccaaa

SEQ ID NO: 631092 - DNA, 25 bp, Homo sapien
gtgaaagagttctgcttttaaaata

SEQ ID NO: 631093 - DNA, 25 bp, Homo sapien
gagtttgcagctacagtgaaccttg

SEQ ID NO: 631094 - DNA, 25 bp, Homo sapien
gtttgcagctacagtgaaccttgat

SEQ ID NO: 631095 - DNA, 25 bp, Homo sapien
tgcagctacagtgaaccttgatcac

SEQ ID NO: 631096 - DNA, 25 bp, Homo sapien
gcagctacagtgaaccttgatcaca

SEQ ID NO: 631097 - DNA, 25 bp, Homo sapien
agctacagtgaaccttgatcacacc

SEQ ID NO: 631098 - DNA, 25 bp, Homo sapien
ctccagcctggaagaaataggagcc

SEQ ID NO: 631099 - DNA, 25 bp, Homo sapien
tgtggtggctggaatcccagcacat

SEQ ID NO: 631100 - DNA, 25 bp, Homo sapien
ttgagcacaggaggtctaggctata

SEQ ID NO: 631101 - DNA, 25 bp, Homo sapien
ggctatagtgagctaagatcttgta

SEQ ID NO: 631102 - DNA, 25 bp, Homo sapien
gctatagtgagctaagatcttgtat

SEQ ID NO: 631103 - DNA, 25 bp, Homo sapien
ctatagtgagctaagatcttgtatc

SEQ ID NO: 631104 - DNA, 25 bp, Homo sapien
ctgagacgtgtattatgagaaagaa

SEQ ID NO: 631105 - DNA, 25 bp, Homo sapien
aagaaaaattgtgggccagttctat

SEQ ID NO: 631106 - DNA, 25 bp, Homo sapien
aaaattgtgggccagttctatttat

SEQ ID NO: 631107 - DNA, 25 bp, Homo sapien
aattgtgggccagttctatttatga

SEQ ID NO: 631108 - DNA, 25 bp, Homo sapien
attgtgggccagttctatttatgaa

SEQ ID NO: 631109 - DNA, 25 bp, Homo sapien
ttgtgggccagttctatttatgaat

SEQ ID NO: 631110 - DNA, 25 bp, Homo sapien
ggccagttctatttatgaatggaca

SEQ ID NO: 631111 - DNA, 25 bp, Homo sapien
aaatcaccagaatgccaggaaacaa

SEQ ID NO: 631112 - DNA, 25 bp, Homo sapien
ataaatttagatatccacttgtagt

SEQ ID NO: 631113 - DNA, 25 bp, Homo sapien
atttagatatccacttgtagttgag

SEQ ID NO: 631114 - DNA, 25 bp, Homo sapien
tttagatatccacttgtagttgaga

SEQ ID NO: 631115 - DNA, 25 bp, Homo sapien
gcagcccagctacataaccctgaaa

SEQ ID NO: 631116 - DNA, 25 bp, Homo sapien
tacataaccctgaaagccccttttg

SEQ ID NO: 631117 - DNA, 25 bp, Homo sapien
tgaaagccccttttggcctgaaggg

SEQ ID NO: 631118 - DNA, 25 bp, Homo sapien
ggacacacagtctgatgggtacaga

SEQ ID NO: 631119 - DNA, 25 bp, Homo sapien
atgtgagctctggagtatagctttc

SEQ ID NO: 631120 - DNA, 25 bp, Homo sapien
gtatagctttctgggctcgaattct

SEQ ID NO: 631121 - DNA, 25 bp, Homo sapien
atttgctgaccatgtgaccttgggc

SEQ ID NO: 631122 - DNA, 25 bp, Homo sapien
gtgaccttgggcaaactgcttaacc

SEQ ID NO: 631123 - DNA, 25 bp, Homo sapien
gggcaaactgcttaacctctctctg

SEQ ID NO: 631124 - DNA, 25 bp, Homo sapien
tctgccttgccttgccaatctgtaa

SEQ ID NO: 631125 - DNA, 25 bp, Homo sapien
cttgccttgccaatctgtaagtggg

SEQ ID NO: 631126 - DNA, 25 bp, Homo sapien
tgcgctcacttctggaactttcctt

SEQ ID NO: 631127 - DNA, 25 bp, Homo sapien
cgctgcgtggttcagtttgtgcaaa

SEQ ID NO: 631128 - DNA, 25 bp, Homo sapien
ttgtttctcatttactgaccactcg

SEQ ID NO: 631129 - DNA, 25 bp, Homo sapien
cactcgggagaagcctttagcaata

SEQ ID NO: 631130 - DNA, 25 bp, Homo sapien
tagcaatagtttttcccgacacaaa

SEQ ID NO: 631131 - DNA, 25 bp, Homo sapien
ttgaataaagtcgacccctgcagtt

SEQ ID NO: 631132 - DNA, 25 bp, Homo sapien
tgaggctctacaagcttcctggatg

SEQ ID NO: 631133 - DNA, 25 bp, Homo sapien
cctggatgcaggaaccatgtgctgt

SEQ ID NO: 631134 - DNA, 25 bp, Homo sapien
aaccatgtgctgttctgacgacgct

SEQ ID NO: 631135 - DNA, 25 bp, Homo sapien
tgacgacgctccgaaacctagttca

SEQ ID NO: 631136 - DNA, 25 bp, Homo sapien
gaaacctagttcagtgcctggcact

SEQ ID NO: 631137 - DNA, 25 bp, Homo sapien
gattctggctgagagacgcaagccg

SEQ ID NO: 631138 - DNA, 25 bp, Homo sapien
attctggctgagagacgcaagccgc

SEQ ID NO: 631139 - DNA, 25 bp, Homo sapien
ttctggctgagagacgcaagccgct

SEQ ID NO: 631140 - DNA, 25 bp, Homo sapien
tctggctgagagacgcaagccgctc

SEQ ID NO: 631141 - DNA, 25 bp, Homo sapien
ctggctgagagacgcaagccgctca

SEQ ID NO: 631142 - DNA, 25 bp, Homo sapien
tggctgagagacgcaagccgctcaa

SEQ ID NO: 631143 - DNA, 25 bp, Homo sapien
caccttggtgaagacaaactgaggg

SEQ ID NO: 631144 - DNA, 25 bp, Homo sapien
accttggtgaagacaaactgaggga

SEQ ID NO: 631145 - DNA, 25 bp, Homo sapien
atagttccatttttagcatcctcct

SEQ ID NO: 631146 - DNA, 25 bp, Homo sapien
tttagcatcctccttcttagaaaaa

SEQ ID NO: 631147 - DNA, 25 bp, Homo sapien
ggatgatatgtacaaatacccatgt

SEQ ID NO: 631148 - DNA, 25 bp, Homo sapien
caaatacccatgtaagttttataca

SEQ ID NO: 631149 - DNA, 25 bp, Homo sapien
caatttgttaacgtgtaaggtgata

SEQ ID NO: 631150 - DNA, 25 bp, Homo sapien
acgtgtaaggtgatactgtttataa

SEQ ID NO: 631151 - DNA, 25 bp, Homo sapien
caaaatatgcttaatctcttatctt

SEQ ID NO: 631152 - DNA, 25 bp, Homo sapien
atcttttgttaagagagctacagaa

SEQ ID NO: 631153 - DNA, 25 bp, Homo sapien
gaaataaatagttacatgcatgcag

SEQ ID NO: 631154 - DNA, 25 bp, Homo sapien
catgcatgcagttcttttttaccct

SEQ ID NO: 631155 - DNA, 25 bp, Homo sapien
gtggtttttcctaaacatataggca

SEQ ID NO: 631156 - DNA, 25 bp, Homo sapien
tgctcaccactgtcatggaagctac

SEQ ID NO: 631157 - DNA, 25 bp, Homo sapien
ggaagctacaggatttaagtgtcat

SEQ ID NO: 631158 - DNA, 25 bp, Homo sapien
gtgtcatgagcttggtggatttaat

SEQ ID NO: 631159 - DNA, 25 bp, Homo sapien
ggatttaatagtttgccctgtcagt

SEQ ID NO: 631160 - DNA, 25 bp, Homo sapien
ttgccctgtcagtctttaaatttaa

SEQ ID NO: 631161 - DNA, 25 bp, Homo sapien
cataacatgataacggaggcactcc

SEQ ID NO: 631162 - DNA, 25 bp, Homo sapien
ggcactcccacctgcagaatttcta

SEQ ID NO: 631163 - DNA, 25 bp, Homo sapien
gaagcatttggtgtgtagctcttta

SEQ ID NO: 631164 - DNA, 25 bp, Homo sapien
agctctttaggtgacagtttctttc

SEQ ID NO: 631165 - DNA, 25 bp, Homo sapien
ttctttcactgaatgatcctgtttc

SEQ ID NO: 631166 - DNA, 25 bp, Homo sapien
gtttcacatatatttccctaatttg

SEQ ID NO: 631167 - DNA, 25 bp, Homo sapien
gattataatccttgtttatttccaa

SEQ ID NO: 631168 - DNA, 25 bp, Homo sapien
aaaaattcctcaagactgcagcatt

SEQ ID NO: 631169 - DNA, 25 bp, Homo sapien
tcagataagccaccctcacaagaac

SEQ ID NO: 631170 - DNA, 25 bp, Homo sapien
gaacacttgcctagcaatggctgtt

SEQ ID NO: 631171 - DNA, 25 bp, Homo sapien
aatggctgtttctgccagtaagtta

SEQ ID NO: 631172 - DNA, 25 bp, Homo sapien
tgccagtaagttaacaccagctcct

SEQ ID NO: 631173 - DNA, 25 bp, Homo sapien
tgcatcagaccctgtgaccaatgat

SEQ ID NO: 631174 - DNA, 25 bp, Homo sapien
aacagcttgcatggacttctttttg

SEQ ID NO: 631175 - DNA, 25 bp, Homo sapien
gcatggacttctttttgtctttaca

SEQ ID NO: 631176 - DNA, 25 bp, Homo sapien
tcaacctcttgggatgcacctatga

SEQ ID NO: 631177 - DNA, 25 bp, Homo sapien
ttgggatgcacctatgattgatcat

SEQ ID NO: 631178 - DNA, 25 bp, Homo sapien
cagacatggtggattgcccctgtaa

SEQ ID NO: 631179 - DNA, 25 bp, Homo sapien
agacatggtggattgcccctgtaat

SEQ ID NO: 631180 - DNA, 25 bp, Homo sapien
tgtagccccagcaactcagatcact

SEQ ID NO: 631181 - DNA, 25 bp, Homo sapien
gccccagcaactcagatcacttgag

SEQ ID NO: 631182 - DNA, 25 bp, Homo sapien
tgctctcagtggagttaagattcat

SEQ ID NO: 631183 - DNA, 25 bp, Homo sapien
gagttaagattcatacttttcccag

SEQ ID NO: 631184 - DNA, 25 bp, Homo sapien
aagattcatacttttcccagacatg

SEQ ID NO: 631185 - DNA, 25 bp, Homo sapien
gattcatacttttcccagacatggt

SEQ ID NO: 631186 - DNA, 25 bp, Homo sapien
tcatacttttcccagacatggtgga

SEQ ID NO: 631187 - DNA, 25 bp, Homo sapien
tacttttcccagacatggtggattg

SEQ ID NO: 631188 - DNA, 25 bp, Homo sapien
tttcccagacatggtggattgcccc

SEQ ID NO: 631189 - DNA, 25 bp, Homo sapien
gacacgtgacgtcagcaatagccct

SEQ ID NO: 631190 - DNA, 25 bp, Homo sapien
tgacgtcagcaatagccctgtccat

SEQ ID NO: 631191 - DNA, 25 bp, Homo sapien
cagcacctggacaccccgagtggtt

SEQ ID NO: 631192 - DNA, 25 bp, Homo sapien
ccgagtggttccttctatgggaggc

SEQ ID NO: 631193 - DNA, 25 bp, Homo sapien
agtggttccttctatgggaggcaga

SEQ ID NO: 631194 - DNA, 25 bp, Homo sapien
tgctgtgcaattcctggggtcttca

SEQ ID NO: 631195 - DNA, 25 bp, Homo sapien
tgaggtctcttaccttttccaagct

SEQ ID NO: 631196 - DNA, 25 bp, Homo sapien
tcttaccttttccaagctactcaga

SEQ ID NO: 631197 - DNA, 25 bp, Homo sapien
cagccctactaacccaatctgaggg

SEQ ID NO: 631198 - DNA, 25 bp, Homo sapien
tcctgcagagatctcagactctgtg

SEQ ID NO: 631199 - DNA, 25 bp, Homo sapien
gagatctcagactctgtggtagagt

SEQ ID NO: 631200 - DNA, 25 bp, Homo sapien
tttcccatcggaccgcgtggagaac

SEQ ID NO: 631201 - DNA, 25 bp, Homo sapien
gaccgcgtggagaacggcacaccat

SEQ ID NO: 631202 - DNA, 25 bp, Homo sapien
gtggagaacggcacaccattgccaa

SEQ ID NO: 631203 - DNA, 25 bp, Homo sapien
acaccattgccaactgcttgtttag

SEQ ID NO: 631204 - DNA, 25 bp, Homo sapien
attgccaactgcttgtttaggacta

SEQ ID NO: 631205 - DNA, 25 bp, Homo sapien
gccaactgcttgtttaggactatga

SEQ ID NO: 631206 - DNA, 25 bp, Homo sapien
actgcttgtttaggactatgaaggg

SEQ ID NO: 631207 - DNA, 25 bp, Homo sapien
tatgaaggggtcacttttccagacc

SEQ ID NO: 631208 - DNA, 25 bp, Homo sapien
ggctgcagaagccacgagtcgctaa

SEQ ID NO: 631209 - DNA, 25 bp, Homo sapien
tgcagaagccacgagtcgctaaggg

SEQ ID NO: 631210 - DNA, 25 bp, Homo sapien
tcccgagctagcaaagcccacatgg

SEQ ID NO: 631211 - DNA, 25 bp, Homo sapien
gctgaattacaacagtatacactaa

SEQ ID NO: 631212 - DNA, 25 bp, Homo sapien
aacagtatacactaaatgtgcctaa

SEQ ID NO: 631213 - DNA, 25 bp, Homo sapien
gtatacactaaatgtgcctaagaaa

SEQ ID NO: 631214 - DNA, 25 bp, Homo sapien
tatgtacaggattttctacccccaa

SEQ ID NO: 631215 - DNA, 25 bp, Homo sapien
tacaggattttctacccccaaatca

SEQ ID NO: 631216 - DNA, 25 bp, Homo sapien
catccttctcaagtgcgcatgaaac

SEQ ID NO: 631217 - DNA, 25 bp, Homo sapien
tccttctcaagtgcgcatgaaacgt

SEQ ID NO: 631218 - DNA, 25 bp, Homo sapien
ttctcaagtgcgcatgaaacgttct

SEQ ID NO: 631219 - DNA, 25 bp, Homo sapien
ctcaagtgcgcatgaaacgttcttc

SEQ ID NO: 631220 - DNA, 25 bp, Homo sapien
caagtgcgcatgaaacgttcttcag

SEQ ID NO: 631221 - DNA, 25 bp, Homo sapien
gtgaaaactaaacatacagttgaac

SEQ ID NO: 631222 - DNA, 25 bp, Homo sapien
ttaaaaagtagcagttttgggctgg

SEQ ID NO: 631223 - DNA, 25 bp, Homo sapien
aaagtagcagttttgggctgggtat

SEQ ID NO: 631224 - DNA, 25 bp, Homo sapien
aagtagcagttttgggctgggtatt

SEQ ID NO: 631225 - DNA, 25 bp, Homo sapien
agtagcagttttgggctgggtattg

SEQ ID NO: 631226 - DNA, 25 bp, Homo sapien
gtagcagttttgggctgggtattgt

SEQ ID NO: 631227 - DNA, 25 bp, Homo sapien
tagcagttttgggctgggtattgtg

SEQ ID NO: 631228 - DNA, 25 bp, Homo sapien
agcagttttgggctgggtattgtgg

SEQ ID NO: 631229 - DNA, 25 bp, Homo sapien
gcagttttgggctgggtattgtggc

SEQ ID NO: 631230 - DNA, 25 bp, Homo sapien
cagttttgggctgggtattgtggct

SEQ ID NO: 631231 - DNA, 25 bp, Homo sapien
aagggcatgcctataaattgatcat

SEQ ID NO: 631232 - DNA, 25 bp, Homo sapien
taaatatgtgtgtccgcggtacttt

SEQ ID NO: 631233 - DNA, 25 bp, Homo sapien
tccgcggtactttgagtagcaggca

SEQ ID NO: 631234 - DNA, 25 bp, Homo sapien
gtagcaggcagatcctatagtctgt

SEQ ID NO: 631235 - DNA, 25 bp, Homo sapien
agtgtttgcagtctgtatcgcaaaa

SEQ ID NO: 631236 - DNA, 25 bp, Homo sapien
agaagcacgccaggaagcttctgct

SEQ ID NO: 631237 - DNA, 25 bp, Homo sapien
aagcttctgctctgtactgtactgt

SEQ ID NO: 631238 - DNA, 25 bp, Homo sapien
actgtactgtttggtatctgcacac

SEQ ID NO: 631239 - DNA, 25 bp, Homo sapien
gtatctgcacacgaaaatgtttcca

SEQ ID NO: 631240 - DNA, 25 bp, Homo sapien
gtttccatgagcaatgacttccaga

SEQ ID NO: 631241 - DNA, 25 bp, Homo sapien
gacttccagattccacggcaagaaa

SEQ ID NO: 631242 - DNA, 25 bp, Homo sapien
tgaaatgtactagggtttttgcttg

SEQ ID NO: 631243 - DNA, 25 bp, Homo sapien
ttttgcttggttaaggtgcctaaat

SEQ ID NO: 631244 - DNA, 25 bp, Homo sapien
aaatgcttaggtcaaataccctggc

SEQ ID NO: 631245 - DNA, 25 bp, Homo sapien
ggtcaaataccctggcaatctgcat

SEQ ID NO: 631246 - DNA, 25 bp, Homo sapien
taccctggcaatctgcatgttacat

SEQ ID NO: 631247 - DNA, 25 bp, Homo sapien
gcatgttacatgctatctgctggca

SEQ ID NO: 631248 - DNA, 25 bp, Homo sapien
gttacatgctatctgctggcagttt

SEQ ID NO: 631249 - DNA, 25 bp, Homo sapien
ggacacagaatttctaattccagtg

SEQ ID NO: 631250 - DNA, 25 bp, Homo sapien
cagtttcttataattgtacttggag

SEQ ID NO: 631251 - DNA, 25 bp, Homo sapien
ggagaaacagatactgatcagtgtt

SEQ ID NO: 631252 - DNA, 25 bp, Homo sapien
atattctaaaagacagccaagttga

SEQ ID NO: 631253 - DNA, 25 bp, Homo sapien
aaagctgcattatttgtgagatttg

SEQ ID NO: 631254 - DNA, 25 bp, Homo sapien
tatgagcaggatatcttagtttgta

SEQ ID NO: 631255 - DNA, 25 bp, Homo sapien
atcttagtttgtattgcctttctac

SEQ ID NO: 631256 - DNA, 25 bp, Homo sapien
gggctgtgatattgaaactgctcct

SEQ ID NO: 631257 - DNA, 25 bp, Homo sapien
gatattgaaactgctcctgtgttac

SEQ ID NO: 631258 - DNA, 25 bp, Homo sapien
gaaactgctcctgtgttactaatag

SEQ ID NO: 631259 - DNA, 25 bp, Homo sapien
tgctcctgtgttactaatagtgtat

SEQ ID NO: 631260 - DNA, 25 bp, Homo sapien
atgattctgatcaatgctgtttcca

SEQ ID NO: 631261 - DNA, 25 bp, Homo sapien
gctgtttccattttgagcccatgtg

SEQ ID NO: 631262 - DNA, 25 bp, Homo sapien
gtttccattttgagcccatgtggct

SEQ ID NO: 631263 - DNA, 25 bp, Homo sapien
agcccatgtggcttgagatgaatga

SEQ ID NO: 631264 - DNA, 25 bp, Homo sapien
gaaatacccagaatagtcacattca

SEQ ID NO: 631265 - DNA, 25 bp, Homo sapien
gaatagtcacattcacagggacaga

SEQ ID NO: 631266 - DNA, 25 bp, Homo sapien
agtcacattcacagggacagaaagt

SEQ ID NO: 631267 - DNA, 25 bp, Homo sapien
aaagtagaccagagcttattcaggg

SEQ ID NO: 631268 - DNA, 25 bp, Homo sapien
ggagtgaatatttaatgggtacata

SEQ ID NO: 631269 - DNA, 25 bp, Homo sapien
aatggatggtggtgacttttgcata

SEQ ID NO: 631270 - DNA, 25 bp, Homo sapien
gatggtggtgacttttgcataacac

SEQ ID NO: 631271 - DNA, 25 bp, Homo sapien
ggtggtgacttttgcataacactgt

SEQ ID NO: 631272 - DNA, 25 bp, Homo sapien
tgacttttgcataacactgtgaatg

SEQ ID NO: 631273 - DNA, 25 bp, Homo sapien
ggtggagtggcaagttttacgttat

SEQ ID NO: 631274 - DNA, 25 bp, Homo sapien
gagtggcaagttttacgttatgtat

SEQ ID NO: 631275 - DNA, 25 bp, Homo sapien
gctgagagcaaccttttccacagcc

SEQ ID NO: 631276 - DNA, 25 bp, Homo sapien
agcttttcttctattgctggcccct

SEQ ID NO: 631277 - DNA, 25 bp, Homo sapien
tttcttctattgctggcccctctat

SEQ ID NO: 631278 - DNA, 25 bp, Homo sapien
gggctccgatcacttcacgttttca

SEQ ID NO: 631279 - DNA, 25 bp, Homo sapien
atcacttcacgttttcaccccattg

SEQ ID NO: 631280 - DNA, 25 bp, Homo sapien
ggaagtcttgtagccccctgtagta

SEQ ID NO: 631281 - DNA, 25 bp, Homo sapien
cccctgtagtacaaatgctgaaata

SEQ ID NO: 631282 - DNA, 25 bp, Homo sapien
atgacctcagttaccttggggccaa

SEQ ID NO: 631283 - DNA, 25 bp, Homo sapien
agggcttcgaaaacagccaccttct

SEQ ID NO: 631284 - DNA, 25 bp, Homo sapien
ccccttatgattatattttgcagta

SEQ ID NO: 631285 - DNA, 25 bp, Homo sapien
ttatattacactgcacttctgttgg

SEQ ID NO: 631286 - DNA, 25 bp, Homo sapien
cagacatggtggattgcccctgtaa

SEQ ID NO: 631287 - DNA, 25 bp, Homo sapien
agacatggtggattgcccctgtaat

SEQ ID NO: 631288 - DNA, 25 bp, Homo sapien
tgtagccccagcaactcagatcact

SEQ ID NO: 631289 - DNA, 25 bp, Homo sapien
gccccagcaactcagatcacttgag

SEQ ID NO: 631290 - DNA, 25 bp, Homo sapien
actgcagggagctatggtcacacaa

SEQ ID NO: 631291 - DNA, 25 bp, Homo sapien
gcaccccagcctatgcaatagagtg

SEQ ID NO: 631292 - DNA, 25 bp, Homo sapien
tgctctcagtggagttaagattcat

SEQ ID NO: 631293 - DNA, 25 bp, Homo sapien
gagttaagattcatacttttcccag

SEQ ID NO: 631294 - DNA, 25 bp, Homo sapien
gattcatacttttcccagacatggt

SEQ ID NO: 631295 - DNA, 25 bp, Homo sapien
catacttttcccagacatggtggat

SEQ ID NO: 631296 - DNA, 25 bp, Homo sapien
ttttcccagacatggtggattgccc

SEQ ID NO: 631297 - DNA, 25 bp, Homo sapien
aagctcaatcttgttacctgtttgg

SEQ ID NO: 631298 - DNA, 25 bp, Homo sapien
acctgtttggtgaacaactctggaa

SEQ ID NO: 631299 - DNA, 25 bp, Homo sapien
gccaagtcgacagctgctttatcta

SEQ ID NO: 631300 - DNA, 25 bp, Homo sapien
agaatatgcagatgggaccctcttc

SEQ ID NO: 631301 - DNA, 25 bp, Homo sapien
tcttctgttctcctaccatgtttgt

SEQ ID NO: 631302 - DNA, 25 bp, Homo sapien
ctaccatgtttgttccaggattcca

SEQ ID NO: 631303 - DNA, 25 bp, Homo sapien
gtttgttccaggattccaatttgaa

SEQ ID NO: 631304 - DNA, 25 bp, Homo sapien
gtatgtgccccttgacacctcaatg

SEQ ID NO: 631305 - DNA, 25 bp, Homo sapien
acacctcaatgctttgtcaagcacc

SEQ ID NO: 631306 - DNA, 25 bp, Homo sapien
caagcacctcatttctctggcttta

SEQ ID NO: 631307 - DNA, 25 bp, Homo sapien
ggtgatggagcagcttatcacagta

SEQ ID NO: 631308 - DNA, 25 bp, Homo sapien
agaacgggctggagccgcatctcca

SEQ ID NO: 631309 - DNA, 25 bp, Homo sapien
cttccagatgcaaactcctacgcat

SEQ ID NO: 631310 - DNA, 25 bp, Homo sapien
tgcaaactcctacgcatccttcaaa

SEQ ID NO: 631311 - DNA, 25 bp, Homo sapien
caaaacccagctaaatgtcacttcc

SEQ ID NO: 631312 - DNA, 25 bp, Homo sapien
aaatgtcacttcctccggaaagcct

SEQ ID NO: 631313 - DNA, 25 bp, Homo sapien
ccacctctctagcaggcagttgagc

SEQ ID NO: 631314 - DNA, 25 bp, Homo sapien
tagcaggcagttgagcccagcttac

SEQ ID NO: 631315 - DNA, 25 bp, Homo sapien
agttgagcccagcttacatttccga

SEQ ID NO: 631316 - DNA, 25 bp, Homo sapien
ttacatttccgacaggccctcactg

SEQ ID NO: 631317 - DNA, 25 bp, Homo sapien
tcactgcccgggattgcagctgcgg

SEQ ID NO: 631318 - DNA, 25 bp, Homo sapien
tcattcatcctgattccatgccaag

SEQ ID NO: 631319 - DNA, 25 bp, Homo sapien
taaaatagcatctttatggcagata

SEQ ID NO: 631320 - DNA, 25 bp, Homo sapien
atagcatctttatggcagataaatt

SEQ ID NO: 631321 - DNA, 25 bp, Homo sapien
aaagatgctcaacaaggtcaacagg

SEQ ID NO: 631322 - DNA, 25 bp, Homo sapien
gatgctcaacaaggtcaacaggata

SEQ ID NO: 631323 - DNA, 25 bp, Homo sapien
caaggtcaacaggataccaaggtca

SEQ ID NO: 631324 - DNA, 25 bp, Homo sapien
gtcaacaggataccaaggtcagcat

SEQ ID NO: 631325 - DNA, 25 bp, Homo sapien
ggataccaaggtcagcataaataaa

SEQ ID NO: 631326 - DNA, 25 bp, Homo sapien
aattctatgaaaatttaccaaacag

SEQ ID NO: 631327 - DNA, 25 bp, Homo sapien
gatctgaagaatgcaataactgaat

SEQ ID NO: 631328 - DNA, 25 bp, Homo sapien
gaattgaaacattcactagaagatt

SEQ ID NO: 631329 - DNA, 25 bp, Homo sapien
cagcagcagactagattaggttaaa

SEQ ID NO: 631330 - DNA, 25 bp, Homo sapien
ataatcaggttttcagctgtgtgtg

SEQ ID NO: 631331 - DNA, 25 bp, Homo sapien
tgccccaacccttgtatgcttcagg

SEQ ID NO: 631332 - DNA, 25 bp, Homo sapien
gggtctcctgtatatacttcatatc

SEQ ID NO: 631333 - DNA, 25 bp, Homo sapien
acttcatatctacatgaatctcctt

SEQ ID NO: 631334 - DNA, 25 bp, Homo sapien
tgaatctccttatgtgcatgtgtac

SEQ ID NO: 631335 - DNA, 25 bp, Homo sapien
cacgtacacacacagatttactata

SEQ ID NO: 631336 - DNA, 25 bp, Homo sapien
ttactataaggaactgactcacatg

SEQ ID NO: 631337 - DNA, 25 bp, Homo sapien
gactcacatgattatgaagctgaca

SEQ ID NO: 631338 - DNA, 25 bp, Homo sapien
gaagctgacaagaccgaagacctga

SEQ ID NO: 631339 - DNA, 25 bp, Homo sapien
taagtcagcaagttggagaccagga

SEQ ID NO: 631340 - DNA, 25 bp, Homo sapien
ggagaccaggaaagctggtgtttta

SEQ ID NO: 631341 - DNA, 25 bp, Homo sapien
aacttgcaaaggtcatggagtgatc

SEQ ID NO: 631342 - DNA, 25 bp, Homo sapien
gcatataatcccaagagtagtctgt

SEQ ID NO: 631343 - DNA, 25 bp, Homo sapien
ccaagagtagtctgtgtgaaagctt

SEQ ID NO: 631344 - DNA, 25 bp, Homo sapien
atgtgctctatgctgcttttctaca

SEQ ID NO: 631345 - DNA, 25 bp, Homo sapien
gcttttctacatcagaaaggtggaa

SEQ ID NO: 631346 - DNA, 25 bp, Homo sapien
gtatccctcacagaatgaccacatg

SEQ ID NO: 631347 - DNA, 25 bp, Homo sapien
gaccacatgattattctgatagctt

SEQ ID NO: 631348 - DNA, 25 bp, Homo sapien
atgaaaagtgtgatcctggctaggc

SEQ ID NO: 631349 - DNA, 25 bp, Homo sapien
tcctggctaggcaaacttctcattt

SEQ ID NO: 631350 - DNA, 25 bp, Homo sapien
acttctcatttgcttagttcagtgc

SEQ ID NO: 631351 - DNA, 25 bp, Homo sapien
catttgcttagttcagtgctggata

SEQ ID NO: 631352 - DNA, 25 bp, Homo sapien
atcacaggcatgagtgactgctcct

SEQ ID NO: 631353 - DNA, 25 bp, Homo sapien
gtgactgctcctagccatggacagg

SEQ ID NO: 631354 - DNA, 25 bp, Homo sapien
atggacaggctacttcatcttctca

SEQ ID NO: 631355 - DNA, 25 bp, Homo sapien
aaaaatagcatgcacctcagagggt

SEQ ID NO: 631356 - DNA, 25 bp, Homo sapien
agcatgcacctcagagggttgctat

SEQ ID NO: 631357 - DNA, 25 bp, Homo sapien
caggtaaagggcagtgaatgttcaa

SEQ ID NO: 631358 - DNA, 25 bp, Homo sapien
ggttggctatatttattacgtactg

SEQ ID NO: 631359 - DNA, 25 bp, Homo sapien
gtactgggtatgtcaatgggtcttc

SEQ ID NO: 631360 - DNA, 25 bp, Homo sapien
aatgggtcttcagcatctattccta

SEQ ID NO: 631361 - DNA, 25 bp, Homo sapien
agcatctattcctacttctttctat

SEQ ID NO: 631362 - DNA, 25 bp, Homo sapien
ctattcctacttctttctatgggat

SEQ ID NO: 631363 - DNA, 25 bp, Homo sapien
cagacagcccgggaaatgaagaaga

SEQ ID NO: 631364 - DNA, 25 bp, Homo sapien
ggctgagagacgcaagccgctcaaa

SEQ ID NO: 631365 - DNA, 25 bp, Homo sapien
agacgcaagccgctcaaacatcgat

SEQ ID NO: 631366 - DNA, 25 bp, Homo sapien
gctcaaacatcgatcaccttggtga

SEQ ID NO: 631367 - DNA, 25 bp, Homo sapien
atcaccttggtgaagacaaactgag

SEQ ID NO: 631368 - DNA, 25 bp, Homo sapien
agctctgggagaccccacaatcctg

SEQ ID NO: 631369 - DNA, 25 bp, Homo sapien
gggagaccccacaatcctgtcaggg

SEQ ID NO: 631370 - DNA, 25 bp, Homo sapien
gtggagagaccatcccgggcgtccc

SEQ ID NO: 631371 - DNA, 25 bp, Homo sapien
ggcgtccccgcgtctgtgtccttgg

SEQ ID NO: 631372 - DNA, 25 bp, Homo sapien
tgtgtccttggctgcttcatcccct

SEQ ID NO: 631373 - DNA, 25 bp, Homo sapien
gtccttggctgcttcatcccctggg

SEQ ID NO: 631374 - DNA, 25 bp, Homo sapien
tggtattaaagaaggactaagggct

SEQ ID NO: 631375 - DNA, 25 bp, Homo sapien
aaagaaggactaagggctaatgagt

SEQ ID NO: 631376 - DNA, 25 bp, Homo sapien
aaaaaatgccttatgataatcttga

SEQ ID NO: 631377 - DNA, 25 bp, Homo sapien
taatcttgaaatcatttacaatgta

SEQ ID NO: 631378 - DNA, 25 bp, Homo sapien
ttacaatgtaattcaaagtatgcat

SEQ ID NO: 631379 - DNA, 25 bp, Homo sapien
aaagtatgcattttgttgagtttct

SEQ ID NO: 631380 - DNA, 25 bp, Homo sapien
atgcattttgttgagtttcttttaa

SEQ ID NO: 631381 - DNA, 25 bp, Homo sapien
aattgagttatgtatcatcttgttt

SEQ ID NO: 631382 - DNA, 25 bp, Homo sapien
gtatcatcttgtttatattgggcta

SEQ ID NO: 631383 - DNA, 25 bp, Homo sapien
atcatcttgtttatattgggctaag

SEQ ID NO: 631384 - DNA, 25 bp, Homo sapien
cttgtttatattgggctaagtctct

SEQ ID NO: 631385 - DNA, 25 bp, Homo sapien
tccctgctgcatggaatcctggtat

SEQ ID NO: 631386 - DNA, 25 bp, Homo sapien
gaatcctggtatgggctccctacag

SEQ ID NO: 631387 - DNA, 25 bp, Homo sapien
actgccagcatttgggtcccatgaa

SEQ ID NO: 631388 - DNA, 25 bp, Homo sapien
gactaactgcaagaactgggctgtt

SEQ ID NO: 631389 - DNA, 25 bp, Homo sapien
caagaactgggctgttactaaaaca

SEQ ID NO: 631390 - DNA, 25 bp, Homo sapien
aacaggtgccaagaaccatggttcc

SEQ ID NO: 631391 - DNA, 25 bp, Homo sapien
agaaccatggttccagcgtcccagg

SEQ ID NO: 631392 - DNA, 25 bp, Homo sapien
ccaggccataagattcccagtgaca

SEQ ID NO: 631393 - DNA, 25 bp, Homo sapien
gattcccagtgacagggacctggtt

SEQ ID NO: 631394 - DNA, 25 bp, Homo sapien
gacagggacctggtttcccaaggag

SEQ ID NO: 631395 - DNA, 25 bp, Homo sapien
gcctcacagctcacatcattggaga

SEQ ID NO: 631396 - DNA, 25 bp, Homo sapien
tagccaacgcagtactgaaggagaa

SEQ ID NO: 631397 - DNA, 25 bp, Homo sapien
ccagaggactggcactacttaacgt

SEQ ID NO: 631398 - DNA, 25 bp, Homo sapien
gaggactggcactacttaacgtcaa

SEQ ID NO: 631399 - DNA, 25 bp, Homo sapien
ggcactacttaacgtcaagacttac

SEQ ID NO: 631400 - DNA, 25 bp, Homo sapien
tcaagacttaccgtaaagcgacagt

SEQ ID NO: 631401 - DNA, 25 bp, Homo sapien
gtaaagcgacagtaatcacgacagt

SEQ ID NO: 631402 - DNA, 25 bp, Homo sapien
gaatagacctctaccaatagttcag

SEQ ID NO: 631403 - DNA, 25 bp, Homo sapien
gacctctaccaatagttcagtggaa

SEQ ID NO: 631404 - DNA, 25 bp, Homo sapien
aatagagggcctagaaatagaccca

SEQ ID NO: 631405 - DNA, 25 bp, Homo sapien
ggatattgacaaactagttctaaag

SEQ ID NO: 631406 - DNA, 25 bp, Homo sapien
cccagaatagccaacgcagtactga

SEQ ID NO: 631407 - DNA, 25 bp, Homo sapien
aatgagcatttagacggagatttcc

SEQ ID NO: 631408 - DNA, 25 bp, Homo sapien
gggtaatgcctaattgtcataatcg

SEQ ID NO: 631409 - DNA, 25 bp, Homo sapien
tgtcataatcggtgaatccatagcc

SEQ ID NO: 631410 - DNA, 25 bp, Homo sapien
cggtgaatccatagccgaatgatga

SEQ ID NO: 631411 - DNA, 25 bp, Homo sapien
gccgaatgatgagacacgctgtgaa

SEQ ID NO: 631412 - DNA, 25 bp, Homo sapien
gacacgctgtgaattgaaacatctc

SEQ ID NO: 631413 - DNA, 25 bp, Homo sapien
aattgaaacatctcagtagcagcag

SEQ ID NO: 631414 - DNA, 25 bp, Homo sapien
aagtcgatgaaggacgtgattacct

SEQ ID NO: 631415 - DNA, 25 bp, Homo sapien
ggacgtgattacctgcgataagctt

SEQ ID NO: 631416 - DNA, 25 bp, Homo sapien
ttacctgcgataagcttcgtttagc

SEQ ID NO: 631417 - DNA, 25 bp, Homo sapien
gcttcgtttagctggaaatgagcat

SEQ ID NO: 631418 - DNA, 25 bp, Homo sapien
gggtattgcttcgtacattgatggc

SEQ ID NO: 631419 - DNA, 25 bp, Homo sapien
tggcaggagatagtacgttgtcgac

SEQ ID NO: 631420 - DNA, 25 bp, Homo sapien
gtacgttgtcgactgtgacacatgt

SEQ ID NO: 631421 - DNA, 25 bp, Homo sapien
gactgtgacacatgttatcgtggat

SEQ ID NO: 631422 - DNA, 25 bp, Homo sapien
gaagtgcatgaaagggatcgattta

SEQ ID NO: 631423 - DNA, 25 bp, Homo sapien
gatttgttgcaaaagcacccaactt

SEQ ID NO: 631424 - DNA, 25 bp, Homo sapien
gcaaaagcacccaactttgaaacta

SEQ ID NO: 631425 - DNA, 25 bp, Homo sapien
taattctttctagtgctgccttgga

SEQ ID NO: 631426 - DNA, 25 bp, Homo sapien
gtgctgccttggatgtaaatctctt

SEQ ID NO: 631427 - DNA, 25 bp, Homo sapien
ggaagttgtccagtgatatatatac

SEQ ID NO: 631428 - DNA, 25 bp, Homo sapien
atacagggaagaccatttgaagtaa

SEQ ID NO: 631429 - DNA, 25 bp, Homo sapien
tcaccgtctgctggcttaataattt

SEQ ID NO: 631430 - DNA, 25 bp, Homo sapien
tcttcattttgaactgggtcctaca

SEQ ID NO: 631431 - DNA, 25 bp, Homo sapien
cctacaaattatatcctgaccccag

SEQ ID NO: 631432 - DNA, 25 bp, Homo sapien
accccaggctgacaaacttggtcta

SEQ ID NO: 631433 - DNA, 25 bp, Homo sapien
gtgtttgaacagcaatcccacattt

SEQ ID NO: 631434 - DNA, 25 bp, Homo sapien
atcccacatttacggtgagttctcc

SEQ ID NO: 631435 - DNA, 25 bp, Homo sapien
gtgagttctccagtacaaacctgaa

SEQ ID NO: 631436 - DNA, 25 bp, Homo sapien
atctgctgctcacttaggtgctctt

SEQ ID NO: 631437 - DNA, 25 bp, Homo sapien
ttaggtgctcttggacatgtcattc

SEQ ID NO: 631438 - DNA, 25 bp, Homo sapien
ggacatgtcattcagtcttcctaca

SEQ ID NO: 631439 - DNA, 25 bp, Homo sapien
ttcagtcttcctacatttcagtttc

SEQ ID NO: 631440 - DNA, 25 bp, Homo sapien
gaagtagtctttaggttgtgctgta

SEQ ID NO: 631441 - DNA, 25 bp, Homo sapien
gtagtctttaggttgtgctgtacat

SEQ ID NO: 631442 - DNA, 25 bp, Homo sapien
gtctttaggttgtgctgtacatttt

SEQ ID NO: 631443 - DNA, 25 bp, Homo sapien
atgcttaaatcacagtttagcttgt

SEQ ID NO: 631444 - DNA, 25 bp, Homo sapien
aatcacagtttagcttgtacacatt

SEQ ID NO: 631445 - DNA, 25 bp, Homo sapien
ttgtacacattttcctttattagaa

SEQ ID NO: 631446 - DNA, 25 bp, Homo sapien
acacattttcctttattagaattgg

SEQ ID NO: 631447 - DNA, 25 bp, Homo sapien
attttagcctgacaatatttattct

SEQ ID NO: 631448 - DNA, 25 bp, Homo sapien
ttagcctgacaatatttattctatc

SEQ ID NO: 631449 - DNA, 25 bp, Homo sapien
atttattctatcttcatatgttttt

SEQ ID NO: 631450 - DNA, 25 bp, Homo sapien
atattttaaactaggcacggtggct

SEQ ID NO: 631451 - DNA, 25 bp, Homo sapien
gaaaaaaatatatagggccgggcat

SEQ ID NO: 631452 - DNA, 25 bp, Homo sapien
aaaaaaatatatagggccgggcatg

SEQ ID NO: 631453 - DNA, 25 bp, Homo sapien
aaaaaatatatagggccgggcatgg

SEQ ID NO: 631454 - DNA, 25 bp, Homo sapien
aaaaatatatagggccgggcatggt

SEQ ID NO: 631455 - DNA, 25 bp, Homo sapien
aaaatatatagggccgggcatggtg

SEQ ID NO: 631456 - DNA, 25 bp, Homo sapien
aaatatatagggccgggcatggtgg

SEQ ID NO: 631457 - DNA, 25 bp, Homo sapien
gcgggcggatcccacttgaggtcag

SEQ ID NO: 631458 - DNA, 25 bp, Homo sapien
cgggcggatcccacttgaggtcagg

SEQ ID NO: 631459 - DNA, 25 bp, Homo sapien
ctaaaaaatgcaaaattagcctggt

SEQ ID NO: 631460 - DNA, 25 bp, Homo sapien
taaaaaatgcaaaattagcctggtg

SEQ ID NO: 631461 - DNA, 25 bp, Homo sapien
cattgcactcaagcctgggggcaag

SEQ ID NO: 631462 - DNA, 25 bp, Homo sapien
gtaagagaacgaagctcagtaacac

SEQ ID NO: 631463 - DNA, 25 bp, Homo sapien
gaagctcagtaacacaaactccaat

SEQ ID NO: 631464 - DNA, 25 bp, Homo sapien
aacacaaactccaattctgttccct

SEQ ID NO: 631465 - DNA, 25 bp, Homo sapien
aaactccaattctgttcccttgcac

SEQ ID NO: 631466 - DNA, 25 bp, Homo sapien
tcccttgcacccttcctaataaatt

SEQ ID NO: 631467 - DNA, 25 bp, Homo sapien
ttatggacagtctgggtcaggttgt

SEQ ID NO: 631468 - DNA, 25 bp, Homo sapien
gtcaggttgtggctggatttctata

SEQ ID NO: 631469 - DNA, 25 bp, Homo sapien
gtggctggatttctatattgcttga

SEQ ID NO: 631470 - DNA, 25 bp, Homo sapien
gtattatttcatacatgcttctgta

SEQ ID NO: 631471 - DNA, 25 bp, Homo sapien
ttcccaatgggttattaatttcaca

SEQ ID NO: 631472 - DNA, 25 bp, Homo sapien
tgggttattaatttcacatcagaga

SEQ ID NO: 631473 - DNA, 25 bp, Homo sapien
gtgcaagtgttacaaatgtcttccc

SEQ ID NO: 631474 - DNA, 25 bp, Homo sapien
caagtgttacaaatgtcttccctaa

SEQ ID NO: 631475 - DNA, 25 bp, Homo sapien
tgtcttccctaattaatcacactcc

SEQ ID NO: 631476 - DNA, 25 bp, Homo sapien
cttccctaattaatcacactcctat

SEQ ID NO: 631477 - DNA, 25 bp, Homo sapien
ctaattaatcacactcctatataag

SEQ ID NO: 631478 - DNA, 25 bp, Homo sapien
atcacactcctatataagtgaaaag

SEQ ID NO: 631479 - DNA, 25 bp, Homo sapien
aattacttctgctgaaactaatctt

SEQ ID NO: 631480 - DNA, 25 bp, Homo sapien
acttctgctgaaactaatcttaagg

SEQ ID NO: 631481 - DNA, 25 bp, Homo sapien
ctgaaactaatcttaaggttggact

SEQ ID NO: 631482 - DNA, 25 bp, Homo sapien
aggttggacttctttattcattagt

SEQ ID NO: 631483 - DNA, 25 bp, Homo sapien
ttggacttctttattcattagtttc

SEQ ID NO: 631484 - DNA, 25 bp, Homo sapien
cacctcctgagatctaattgggaag

SEQ ID NO: 631485 - DNA, 25 bp, Homo sapien
ctaattgggaagctggtgattacca

SEQ ID NO: 631486 - DNA, 25 bp, Homo sapien
ggtgattaccagtttcaggtttgtc

SEQ ID NO: 631487 - DNA, 25 bp, Homo sapien
accagtttcaggtttgtctgtttat

SEQ ID NO: 631488 - DNA, 25 bp, Homo sapien
tgtttattttccttggtgctggctg

SEQ ID NO: 631489 - DNA, 25 bp, Homo sapien
gatacagctaacaacagtctgactg

SEQ ID NO: 631490 - DNA, 25 bp, Homo sapien
gactgtcatctaatggtcacctgaa

SEQ ID NO: 631491 - DNA, 25 bp, Homo sapien
taatggtcacctgaattcctggcgt

SEQ ID NO: 631492 - DNA, 25 bp, Homo sapien
acctgaattcctggcgtgtgtgtgt

SEQ ID NO: 631493 - DNA, 25 bp, Homo sapien
tactgtgctcatgtctgacctactg

SEQ ID NO: 631494 - DNA, 25 bp, Homo sapien
ccaaatgggccatcaaattagagaa

SEQ ID NO: 631495 - DNA, 25 bp, Homo sapien
gtgatctgtacatctcagctactca

SEQ ID NO: 631496 - DNA, 25 bp, Homo sapien
tgatctgtacatctcagctactcag

SEQ ID NO: 631497 - DNA, 25 bp, Homo sapien
agctactcaggaggttgagtcaggg

SEQ ID NO: 631498 - DNA, 25 bp, Homo sapien
actcaggaggttgagtcaggggaac

SEQ ID NO: 631499 - DNA, 25 bp, Homo sapien
ctcaggaggttgagtcaggggaacc

SEQ ID NO: 631500 - DNA, 25 bp, Homo sapien
aggttgagtcaggggaacctcttga

SEQ ID NO: 631501 - DNA, 25 bp, Homo sapien
ggttgagtcaggggaacctcttgaa

SEQ ID NO: 631502 - DNA, 25 bp, Homo sapien
gttgagtcaggggaacctcttgaac

SEQ ID NO: 631503 - DNA, 25 bp, Homo sapien
ttgagtcaggggaacctcttgaacc

SEQ ID NO: 631504 - DNA, 25 bp, Homo sapien
tgagtcaggggaacctcttgaaccc

SEQ ID NO: 631505 - DNA, 25 bp, Homo sapien
gagtcaggggaacctcttgaacccg

SEQ ID NO: 631506 - DNA, 25 bp, Homo sapien
attacagaaagttaaaatttgccag

SEQ ID NO: 631507 - DNA, 25 bp, Homo sapien
ttacagaaagttaaaatttgccagg

SEQ ID NO: 631508 - DNA, 25 bp, Homo sapien
tacagaaagttaaaatttgccaggc

SEQ ID NO: 631509 - DNA, 25 bp, Homo sapien
acagaaagttaaaatttgccaggcg

SEQ ID NO: 631510 - DNA, 25 bp, Homo sapien
cagaaagttaaaatttgccaggcgt

SEQ ID NO: 631511 - DNA, 25 bp, Homo sapien
agaaagttaaaatttgccaggcgtg

SEQ ID NO: 631512 - DNA, 25 bp, Homo sapien
gaaagttaaaatttgccaggcgtgg

SEQ ID NO: 631513 - DNA, 25 bp, Homo sapien
aagttaaaatttgccaggcgtggtg

SEQ ID NO: 631514 - DNA, 25 bp, Homo sapien
ctgtaatgttagtactttgggaagc

SEQ ID NO: 631515 - DNA, 25 bp, Homo sapien
gctgccatgagccaagactgcgcca

SEQ ID NO: 631516 - DNA, 25 bp, Homo sapien
ctgccatgagccaagactgcgccat

SEQ ID NO: 631517 - DNA, 25 bp, Homo sapien
acttggccatgctcttagaaaaatg

SEQ ID NO: 631518 - DNA, 25 bp, Homo sapien
cttggccatgctcttagaaaaatga

SEQ ID NO: 631519 - DNA, 25 bp, Homo sapien
ttggccatgctcttagaaaaatgat

SEQ ID NO: 631520 - DNA, 25 bp, Homo sapien
tggccatgctcttagaaaaatgatt

SEQ ID NO: 631521 - DNA, 25 bp, Homo sapien
ggccatgctcttagaaaaatgattc

SEQ ID NO: 631522 - DNA, 25 bp, Homo sapien
tcttagaaaaatgattcagaggctg

SEQ ID NO: 631523 - DNA, 25 bp, Homo sapien
cttagaaaaatgattcagaggctgg

SEQ ID NO: 631524 - DNA, 25 bp, Homo sapien
tagaaaaatgattcagaggctgggc

SEQ ID NO: 631525 - DNA, 25 bp, Homo sapien
aaaaatgattcagaggctgggcgca

SEQ ID NO: 631526 - DNA, 25 bp, Homo sapien
gacaggcagatcacatgcagtcagg

SEQ ID NO: 631527 - DNA, 25 bp, Homo sapien
agatcacatgcagtcaggagttgga

SEQ ID NO: 631528 - DNA, 25 bp, Homo sapien
ccactgcagcaggattattaggaat

SEQ ID NO: 631529 - DNA, 25 bp, Homo sapien
taggaataaatgttactgctgcttc

SEQ ID NO: 631530 - DNA, 25 bp, Homo sapien
gttactgctgcttccaaaacacaaa

SEQ ID NO: 631531 - DNA, 25 bp, Homo sapien
acacaaacgatcactccattggcgg

SEQ ID NO: 631532 - DNA, 25 bp, Homo sapien
gatcactccattggcggctgcaaag

SEQ ID NO: 631533 - DNA, 25 bp, Homo sapien
tgcaaagagccctcacactggtgag

SEQ ID NO: 631534 - DNA, 25 bp, Homo sapien
aaatgtgctatgtgagcaactctaa

SEQ ID NO: 631535 - DNA, 25 bp, Homo sapien
gcaactctaaaacccacaatactca

SEQ ID NO: 631536 - DNA, 25 bp, Homo sapien
cacaatactcaaccactgcggtggg

SEQ ID NO: 631537 - DNA, 25 bp, Homo sapien
cactgcggtgggatgattgcgaatc

SEQ ID NO: 631538 - DNA, 25 bp, Homo sapien
gattgcgaatccattttatgtctcc

SEQ ID NO: 631539 - DNA, 25 bp, Homo sapien
agctggcggccattatcctaagata

SEQ ID NO: 631540 - DNA, 25 bp, Homo sapien
ggcggccattatcctaagataatta

SEQ ID NO: 631541 - DNA, 25 bp, Homo sapien
gcaggagcagaaaactaaatgccat

SEQ ID NO: 631542 - DNA, 25 bp, Homo sapien
taaacattgggcactcgcggacata

SEQ ID NO: 631543 - DNA, 25 bp, Homo sapien
gggcactcgcggacataaagatgga

SEQ ID NO: 631544 - DNA, 25 bp, Homo sapien
gaatcagtaggtgctggagactacc

SEQ ID NO: 631545 - DNA, 25 bp, Homo sapien
gaaaaaactacctgttgggagctgt

SEQ ID NO: 631546 - DNA, 25 bp, Homo sapien
tgttgggagctgtgctcactgcctc

SEQ ID NO: 631547 - DNA, 25 bp, Homo sapien
gtgctcactgcctcggtgaagggat

SEQ ID NO: 631548 - DNA, 25 bp, Homo sapien
cactgcctcggtgaagggatcaact

SEQ ID NO: 631549 - DNA, 25 bp, Homo sapien
tgaagggatcaactgtaccccaaac

SEQ ID NO: 631550 - DNA, 25 bp, Homo sapien
cagagcaagactccggctgggcacg

SEQ ID NO: 631551 - DNA, 25 bp, Homo sapien
agagcaagactccggctgggcacgg

SEQ ID NO: 631552 - DNA, 25 bp, Homo sapien
gagcaagactccggctgggcacggt

SEQ ID NO: 631553 - DNA, 25 bp, Homo sapien
agcaagactccggctgggcacggtg

SEQ ID NO: 631554 - DNA, 25 bp, Homo sapien
gcaagactccggctgggcacggtgg

SEQ ID NO: 631555 - DNA, 25 bp, Homo sapien
aaaaatgcaggaattggccgggtgt

SEQ ID NO: 631556 - DNA, 25 bp, Homo sapien
aaaatgcaggaattggccgggtgtg

SEQ ID NO: 631557 - DNA, 25 bp, Homo sapien
aaatgcaggaattggccgggtgtgg

SEQ ID NO: 631558 - DNA, 25 bp, Homo sapien
aatgcaggaattggccgggtgtggt

SEQ ID NO: 631559 - DNA, 25 bp, Homo sapien
atgcaggaattggccgggtgtggtg

SEQ ID NO: 631560 - DNA, 25 bp, Homo sapien
tgcaggaattggccgggtgtggtgg

SEQ ID NO: 631561 - DNA, 25 bp, Homo sapien
caagttacagaacctcaaatcctcc

SEQ ID NO: 631562 - DNA, 25 bp, Homo sapien
agttacagaacctcaaatcctccct

SEQ ID NO: 631563 - DNA, 25 bp, Homo sapien
gttacagaacctcaaatcctccctc

SEQ ID NO: 631564 - DNA, 25 bp, Homo sapien
ttacagaacctcaaatcctccctcc

SEQ ID NO: 631565 - DNA, 25 bp, Homo sapien
tacagaacctcaaatcctccctccc

SEQ ID NO: 631566 - DNA, 25 bp, Homo sapien
acagaacctcaaatcctccctccct

SEQ ID NO: 631567 - DNA, 25 bp, Homo sapien
cagaacctcaaatcctccctccctc

SEQ ID NO: 631568 - DNA, 25 bp, Homo sapien
ccccaatctgtaaagcagaatgata

SEQ ID NO: 631569 - DNA, 25 bp, Homo sapien
cccaatctgtaaagcagaatgatag

SEQ ID NO: 631570 - DNA, 25 bp, Homo sapien
ccaatctgtaaagcagaatgatagt

SEQ ID NO: 631571 - DNA, 25 bp, Homo sapien
atctgtaaagcagaatgatagtatc

SEQ ID NO: 631572 - DNA, 25 bp, Homo sapien
taaacccaaacatctatggtgaact

SEQ ID NO: 631573 - DNA, 25 bp, Homo sapien
tctatggtgaactgattattgacaa

SEQ ID NO: 631574 - DNA, 25 bp, Homo sapien
gggccaagatcattcaataaggaaa

SEQ ID NO: 631575 - DNA, 25 bp, Homo sapien
attcaataaggaaagaacagtctct

SEQ ID NO: 631576 - DNA, 25 bp, Homo sapien
tctcttcagtgaatgttcctggagc

SEQ ID NO: 631577 - DNA, 25 bp, Homo sapien
gtgaatgttcctggagcaactggat

SEQ ID NO: 631578 - DNA, 25 bp, Homo sapien
gttcctggagcaactggataaccac

SEQ ID NO: 631579 - DNA, 25 bp, Homo sapien
ggaagattcatacgtcctgatttca

SEQ ID NO: 631580 - DNA, 25 bp, Homo sapien
gattcatacgtcctgatttcaaaac

SEQ ID NO: 631581 - DNA, 25 bp, Homo sapien
acttactacaagtcaaaaccttatg

SEQ ID NO: 631582 - DNA, 25 bp, Homo sapien
gtcaaaaccttatggtactggcata

SEQ ID NO: 631583 - DNA, 25 bp, Homo sapien
ctgcactctagtctcagcaacaaga

SEQ ID NO: 631584 - DNA, 25 bp, Homo sapien
tgcactctagtctcagcaacaagag

SEQ ID NO: 631585 - DNA, 25 bp, Homo sapien
gcactctagtctcagcaacaagagc

SEQ ID NO: 631586 - DNA, 25 bp, Homo sapien
gtgtgtagaaaaaagatggcgggcc

SEQ ID NO: 631587 - DNA, 25 bp, Homo sapien
tgtgtagaaaaaagatggcgggccg

SEQ ID NO: 631588 - DNA, 25 bp, Homo sapien
gtgtagaaaaaagatggcgggccgg

SEQ ID NO: 631589 - DNA, 25 bp, Homo sapien
tgtagaaaaaagatggcgggccggg

SEQ ID NO: 631590 - DNA, 25 bp, Homo sapien
tagaaaaaagatggcgggccgggcg

SEQ ID NO: 631591 - DNA, 25 bp, Homo sapien
gaaaaaagatggcgggccgggcgca

SEQ ID NO: 631592 - DNA, 25 bp, Homo sapien
aaaaaagatggcgggccgggcgcag

SEQ ID NO: 631593 - DNA, 25 bp, Homo sapien
aaaaagatggcgggccgggcgcagt

SEQ ID NO: 631594 - DNA, 25 bp, Homo sapien
tcacaaaggaccacaatttatgaat

SEQ ID NO: 631595 - DNA, 25 bp, Homo sapien
gaccacaatttatgaatccgttttt

SEQ ID NO: 631596 - DNA, 25 bp, Homo sapien
tatgaatccgtttttatgaaatgtc

SEQ ID NO: 631597 - DNA, 25 bp, Homo sapien
gaaagcagattcgtggttgcccaag

SEQ ID NO: 631598 - DNA, 25 bp, Homo sapien
cagattcgtggttgcccaagaccaa

SEQ ID NO: 631599 - DNA, 25 bp, Homo sapien
gatggctaaagggtgcaaaggttct

SEQ ID NO: 631600 - DNA, 25 bp, Homo sapien
atattctggaacttattgtggtgac

SEQ ID NO: 631601 - DNA, 25 bp, Homo sapien
tggaacttattgtggtgacgattac

SEQ ID NO: 631602 - DNA, 25 bp, Homo sapien
gtggtgacgattacacatctctgtg

SEQ ID NO: 631603 - DNA, 25 bp, Homo sapien
gtgacgattacacatctctgtgaat

SEQ ID NO: 631604 - DNA, 25 bp, Homo sapien
aaatgggtcagttgtatgctatgtg

SEQ ID NO: 631605 - DNA, 25 bp, Homo sapien
aggttcaagctattctgcctcggcc

SEQ ID NO: 631606 - DNA, 25 bp, Homo sapien
ggcctcccgagtagttgggattgca

SEQ ID NO: 631607 - DNA, 25 bp, Homo sapien
tggtcaggctgttctcaaactccca

SEQ ID NO: 631608 - DNA, 25 bp, Homo sapien
ggtcaggctgttctcaaactcccaa

SEQ ID NO: 631609 - DNA, 25 bp, Homo sapien
gtcaggctgttctcaaactcccaac

SEQ ID NO: 631610 - DNA, 25 bp, Homo sapien
tcaggctgttctcaaactcccaacc

SEQ ID NO: 631611 - DNA, 25 bp, Homo sapien
caggctgttctcaaactcccaacct

SEQ ID NO: 631612 - DNA, 25 bp, Homo sapien
aggctgttctcaaactcccaacctc

SEQ ID NO: 631613 - DNA, 25 bp, Homo sapien
gctgttctcaaactcccaacctcag

SEQ ID NO: 631614 - DNA, 25 bp, Homo sapien
tggaattataggcgtgagcaactgc

SEQ ID NO: 631615 - DNA, 25 bp, Homo sapien
cgtgagcaactgcacccagcaacta

SEQ ID NO: 631616 - DNA, 25 bp, Homo sapien
gttgtttaactatgactcctaactg

SEQ ID NO: 631617 - DNA, 25 bp, Homo sapien
atgactcctaactgagtagtcttat

SEQ ID NO: 631618 - DNA, 25 bp, Homo sapien
gagtagtcttatatttcaattacaa

SEQ ID NO: 631619 - DNA, 25 bp, Homo sapien
gtaatatttcctttactcttaacag

SEQ ID NO: 631620 - DNA, 25 bp, Homo sapien
ggattatatatagaacatgctcact

SEQ ID NO: 631621 - DNA, 25 bp, Homo sapien
gaacatgctcacttacaaaaatagg

SEQ ID NO: 631622 - DNA, 25 bp, Homo sapien
agagcataaggcaggcttcttgtat

SEQ ID NO: 631623 - DNA, 25 bp, Homo sapien
aggcaggcttcttgtatatacttat

SEQ ID NO: 631624 - DNA, 25 bp, Homo sapien
gtatatacttatgctgtcaaatgtt

SEQ ID NO: 631625 - DNA, 25 bp, Homo sapien
atattgtttttaatggagtcccatt

SEQ ID NO: 631626 - DNA, 25 bp, Homo sapien
tggagtcccattgtgtaatatttat

SEQ ID NO: 631627 - DNA, 25 bp, Homo sapien
ttctctttattccttactacccaat

SEQ ID NO: 631628 - DNA, 25 bp, Homo sapien
cccattccaatcctctgttaataac

SEQ ID NO: 631629 - DNA, 25 bp, Homo sapien
taataactcttacggacagtcccca

SEQ ID NO: 631630 - DNA, 25 bp, Homo sapien
ccccaactcatgatgacttgactta

SEQ ID NO: 631631 - DNA, 25 bp, Homo sapien
gatgacttgacttaggatttttcta

SEQ ID NO: 631632 - DNA, 25 bp, Homo sapien
gatttttctactttgcaatggtgca

SEQ ID NO: 631633 - DNA, 25 bp, Homo sapien
ggtgcaaaagtgatccgcattcagt

SEQ ID NO: 631634 - DNA, 25 bp, Homo sapien
tcagtagaaactgttcctcaagtac

SEQ ID NO: 631635 - DNA, 25 bp, Homo sapien
ctcaagtactcatacgacctctatt

SEQ ID NO: 631636 - DNA, 25 bp, Homo sapien
ctcatacgacctctatttttcactt

SEQ ID NO: 631637 - DNA, 25 bp, Homo sapien
aaattgcgtgagattttcaatactt

SEQ ID NO: 631638 - DNA, 25 bp, Homo sapien
tctggcctgtcctcatttaatctta

SEQ ID NO: 631639 - DNA, 25 bp, Homo sapien
tggcctgtcctcatttaatcttatc

SEQ ID NO: 631640 - DNA, 25 bp, Homo sapien
ctgtcctcatttaatcttatccctt

SEQ ID NO: 631641 - DNA, 25 bp, Homo sapien
ggtactaggagttagggcttcaaca

SEQ ID NO: 631642 - DNA, 25 bp, Homo sapien
gggacatatattggtccacaatact

SEQ ID NO: 631643 - DNA, 25 bp, Homo sapien
catatattggtccacaatacttggt

SEQ ID NO: 631644 - DNA, 25 bp, Homo sapien
gacaacaacatcattatcactggaa

SEQ ID NO: 631645 - DNA, 25 bp, Homo sapien
ttatcactggaaaacactgtgccaa

SEQ ID NO: 631646 - DNA, 25 bp, Homo sapien
aacactgtgccaatgcagtggcatt

SEQ ID NO: 631647 - DNA, 25 bp, Homo sapien
aatgcagtggcattggtaccaaggt

SEQ ID NO: 631648 - DNA, 25 bp, Homo sapien
cagtggcattggtaccaaggtaaaa

SEQ ID NO: 631649 - DNA, 25 bp, Homo sapien
gaagagtaacagtgtctactcagta

SEQ ID NO: 631650 - DNA, 25 bp, Homo sapien
gtgtctactcagtaacaagcgtttt

SEQ ID NO: 631651 - DNA, 25 bp, Homo sapien
tcagtaacaagcgttttacgagtta

SEQ ID NO: 631652 - DNA, 25 bp, Homo sapien
aagacatccaaatgcagtactgaaa

SEQ ID NO: 631653 - DNA, 25 bp, Homo sapien
aagtcttgatttgtctcactgatga

SEQ ID NO: 631654 - DNA, 25 bp, Homo sapien
atttgtctcactgatgactccgttt

SEQ ID NO: 631655 - DNA, 25 bp, Homo sapien
gatgactccgtttttcctagagcag

SEQ ID NO: 631656 - DNA, 25 bp, Homo sapien
ccgtttttcctagagcagtctgttt

SEQ ID NO: 631657 - DNA, 25 bp, Homo sapien
gagcagtctgtttaatgcttactgg

SEQ ID NO: 631658 - DNA, 25 bp, Homo sapien
tctgtttaatgcttactggagataa

SEQ ID NO: 631659 - DNA, 25 bp, Homo sapien
gaaagatatagggagaggcctcaag

SEQ ID NO: 631660 - DNA, 25 bp, Homo sapien
atttgatattatcagtgtcctggct

SEQ ID NO: 631661 - DNA, 25 bp, Homo sapien
gatattatcagtgtcctggctactc

SEQ ID NO: 631662 - DNA, 25 bp, Homo sapien
ttatcagtgtcctggctactcaaat

SEQ ID NO: 631663 - DNA, 25 bp, Homo sapien
tcagtgtcctggctactcaaatagg

SEQ ID NO: 631664 - DNA, 25 bp, Homo sapien
gtgtcctggctactcaaataggaaa

SEQ ID NO: 631665 - DNA, 25 bp, Homo sapien
ttttctgtgagctggtgctgatgtt

SEQ ID NO: 631666 - DNA, 25 bp, Homo sapien
tgatgttgtatgttccagcagatct

SEQ ID NO: 631667 - DNA, 25 bp, Homo sapien
ttttctgagttctacttgattgcct

SEQ ID NO: 631668 - DNA, 25 bp, Homo sapien
cttgattgcctaaaagttacatttt

SEQ ID NO: 631669 - DNA, 25 bp, Homo sapien
tcgattacactgtgtgaatgactgc

SEQ ID NO: 631670 - DNA, 25 bp, Homo sapien
atgactgcatggacaagcatcattt

SEQ ID NO: 631671 - DNA, 25 bp, Homo sapien
ggcctggtagagttggttgacccat

SEQ ID NO: 631672 - DNA, 25 bp, Homo sapien
agagttggttgacccatgacccagt

SEQ ID NO: 631673 - DNA, 25 bp, Homo sapien
atgacccagtttccacgaggtattt

SEQ ID NO: 631674 - DNA, 25 bp, Homo sapien
cagtttccacgaggtatttccctgt

SEQ ID NO: 631675 - DNA, 25 bp, Homo sapien
tatttccctgtcgttactaccagtg

SEQ ID NO: 631676 - DNA, 25 bp, Homo sapien
actaccagtgcccttgatttgggta

SEQ ID NO: 631677 - DNA, 25 bp, Homo sapien
ataaatgacttgaccactctacctg

SEQ ID NO: 631678 - DNA, 25 bp, Homo sapien
tctacctgtgaagcatgagtgtcta

SEQ ID NO: 631679 - DNA, 25 bp, Homo sapien
agtgtctaaggtagtttgcctgcaa

SEQ ID NO: 631680 - DNA, 25 bp, Homo sapien
tctttgtgtcattgtaggctttttt

SEQ ID NO: 631681 - DNA, 25 bp, Homo sapien
aattgattcagatttcctggaaggg

SEQ ID NO: 631682 - DNA, 25 bp, Homo sapien
ccttgggtagatattagctatacat

SEQ ID NO: 631683 - DNA, 25 bp, Homo sapien
ttagctatacataccactcaggatt

SEQ ID NO: 631684 - DNA, 25 bp, Homo sapien
ttaactatttatttctacgataggg

SEQ ID NO: 631685 - DNA, 25 bp, Homo sapien
gggataagttctgtccacacaccac

SEQ ID NO: 631686 - DNA, 25 bp, Homo sapien
ccccaatactcatgccttttatatg

SEQ ID NO: 631687 - DNA, 25 bp, Homo sapien
gtcataaattttctacttacttcct

SEQ ID NO: 631688 - DNA, 25 bp, Homo sapien
acttacttccttatgttcttctcaa

SEQ ID NO: 631689 - DNA, 25 bp, Homo sapien
cagtttctattagttcttttggcta

SEQ ID NO: 631690 - DNA, 25 bp, Homo sapien
agttcttttggctagactggacatt

SEQ ID NO: 631691 - DNA, 25 bp, Homo sapien
ggctagactggacatttgatacttt

SEQ ID NO: 631692 - DNA, 25 bp, Homo sapien
gttttctattattctgcttttctgt

SEQ ID NO: 631693 - DNA, 25 bp, Homo sapien
gggccttcagggtgccatctgtctg

SEQ ID NO: 631694 - DNA, 25 bp, Homo sapien
gccatctgtctgtttacgccagaaa

SEQ ID NO: 631695 - DNA, 25 bp, Homo sapien
atctgtctgtttacgccagaaaaca

SEQ ID NO: 631696 - DNA, 25 bp, Homo sapien
atttctgttttctttcgctgggctc

SEQ ID NO: 631697 - DNA, 25 bp, Homo sapien
gttttctttcgctgggctcacagca

SEQ ID NO: 631698 - DNA, 25 bp, Homo sapien
tgggctcacagcaggtgcttaataa

SEQ ID NO: 631699 - DNA, 25 bp, Homo sapien
aggacagcgaggttcaggcacgact

SEQ ID NO: 631700 - DNA, 25 bp, Homo sapien
cgaggttcaggcacgactccaggag

SEQ ID NO: 631701 - DNA, 25 bp, Homo sapien
gttcaggcacgactccaggagtcaa

SEQ ID NO: 631702 - DNA, 25 bp, Homo sapien
aggagtcaacccctggatctcggag

SEQ ID NO: 631703 - DNA, 25 bp, Homo sapien
agtcaacccctggatctcggaggct

SEQ ID NO: 631704 - DNA, 25 bp, Homo sapien
gaaactatcaaacactatgcacaga

SEQ ID NO: 631705 - DNA, 25 bp, Homo sapien
aaacactatgcacagactttaagcg

SEQ ID NO: 631706 - DNA, 25 bp, Homo sapien
tgcacagactttaagcgaggtgata

SEQ ID NO: 631707 - DNA, 25 bp, Homo sapien
cgaggtgataggacagagcccctcc

SEQ ID NO: 631708 - DNA, 25 bp, Homo sapien
atacttgaaaataaccacaggaaat

SEQ ID NO: 631709 - DNA, 25 bp, Homo sapien
aaatgtggcataggaaagtccaaag

SEQ ID NO: 631710 - DNA, 25 bp, Homo sapien
cattgagaaccctgtggaatggttt

SEQ ID NO: 631711 - DNA, 25 bp, Homo sapien
ccctgtggaatggtttagtagctag

SEQ ID NO: 631712 - DNA, 25 bp, Homo sapien
tagtagctagaatctatcacctgaa

SEQ ID NO: 631713 - DNA, 25 bp, Homo sapien
gctagaatctatcacctgaacacag

SEQ ID NO: 631714 - DNA, 25 bp, Homo sapien
gaactgcatttaaagagacaaaacc

SEQ ID NO: 631715 - DNA, 25 bp, Homo sapien
tatatttggaaagtacagcctgggc

SEQ ID NO: 631716 - DNA, 25 bp, Homo sapien
atatttggaaagtacagcctgggca

SEQ ID NO: 631717 - DNA, 25 bp, Homo sapien
tatttggaaagtacagcctgggcac

SEQ ID NO: 631718 - DNA, 25 bp, Homo sapien
atttggaaagtacagcctgggcaca

SEQ ID NO: 631719 - DNA, 25 bp, Homo sapien
tttggaaagtacagcctgggcacag

SEQ ID NO: 631720 - DNA, 25 bp, Homo sapien
ttggaaagtacagcctgggcacagt

SEQ ID NO: 631721 - DNA, 25 bp, Homo sapien
actgcagtgaggcatgttgcaccac

SEQ ID NO: 631722 - DNA, 25 bp, Homo sapien
aggcatgttgcaccactgcaatact

SEQ ID NO: 631723 - DNA, 25 bp, Homo sapien
ggcatgttgcaccactgcaatactc

SEQ ID NO: 631724 - DNA, 25 bp, Homo sapien
gcatgttgcaccactgcaatactcc

SEQ ID NO: 631725 - DNA, 25 bp, Homo sapien
catgttgcaccactgcaatactcca

SEQ ID NO: 631726 - DNA, 25 bp, Homo sapien
tttaaataccattctcaatgaaagg

SEQ ID NO: 631727 - DNA, 25 bp, Homo sapien
attctcaatgaaaggaaccaggatt

SEQ ID NO: 631728 - DNA, 25 bp, Homo sapien
gagaagtggctgatttcagggctag

SEQ ID NO: 631729 - DNA, 25 bp, Homo sapien
cagttgggccgcgtcaaaaggacac

SEQ ID NO: 631730 - DNA, 25 bp, Homo sapien
tgggccgcgtcaaaaggacacagaa

SEQ ID NO: 631731 - DNA, 25 bp, Homo sapien
ggacacagaagcaacctgagaaact

SEQ ID NO: 631732 - DNA, 25 bp, Homo sapien
aacctgagaaacttccccctggctg

SEQ ID NO: 631733 - DNA, 25 bp, Homo sapien
cccctggctggagctagcattattt

SEQ ID NO: 631734 - DNA, 25 bp, Homo sapien
ggctggagctagcattatttgagca

SEQ ID NO: 631735 - DNA, 25 bp, Homo sapien
aataacagtggtattggattataac

SEQ ID NO: 631736 - DNA, 25 bp, Homo sapien
aatatctgagactatatgatacaag

SEQ ID NO: 631737 - DNA, 25 bp, Homo sapien
aatatattggccattcagctcacgt

SEQ ID NO: 631738 - DNA, 25 bp, Homo sapien
tcagctcacgtaactaatgtcagat

SEQ ID NO: 631739 - DNA, 25 bp, Homo sapien
gtcagatggtcacatgattatcagt

SEQ ID NO: 631740 - DNA, 25 bp, Homo sapien
gtgggttatttctattggtggagca

SEQ ID NO: 631741 - DNA, 25 bp, Homo sapien
gcagatcactctgtctttcagtgga

SEQ ID NO: 631742 - DNA, 25 bp, Homo sapien
aagatgctgttcacatagcacccca

SEQ ID NO: 631743 - DNA, 25 bp, Homo sapien
agcaccccaagaaagtctggctgac

SEQ ID NO: 631744 - DNA, 25 bp, Homo sapien
agtctggctgactctcatagtgatg

SEQ ID NO: 631745 - DNA, 25 bp, Homo sapien
gatctgtctgatgttccagaactgg

SEQ ID NO: 631746 - DNA, 25 bp, Homo sapien
gaacaagagacacagctcacctacc

SEQ ID NO: 631747 - DNA, 25 bp, Homo sapien
tcacctaccgtcgacaggtttacaa

SEQ ID NO: 631748 - DNA, 25 bp, Homo sapien
taaaaacgtgtttgccatttgaagg

SEQ ID NO: 631749 - DNA, 25 bp, Homo sapien
cgatgacctctggagattgatccca

SEQ ID NO: 631750 - DNA, 25 bp, Homo sapien
gattgatcccagtgttctgacagag

SEQ ID NO: 631751 - DNA, 25 bp, Homo sapien
gttagcttctgttatcaggtgctat

SEQ ID NO: 631752 - DNA, 25 bp, Homo sapien
gttatcaggtgctatagtttttcat

SEQ ID NO: 631753 - DNA, 25 bp, Homo sapien
agtgatgctgatagagcctactcaa

SEQ ID NO: 631754 - DNA, 25 bp, Homo sapien
gcctactcaaggattggactcattc

SEQ ID NO: 631755 - DNA, 25 bp, Homo sapien
tgttccatgaatgccaattctgcag

SEQ ID NO: 631756 - DNA, 25 bp, Homo sapien
aagccactgtggtagaaattcaaat

SEQ ID NO: 631757 - DNA, 25 bp, Homo sapien
ttattatcactatttgcctgccaca

SEQ ID NO: 631758 - DNA, 25 bp, Homo sapien
atttgcctgccacaaagacagattt

SEQ ID NO: 631759 - DNA, 25 bp, Homo sapien
gtggtagtaagcacactcacattgt

SEQ ID NO: 631760 - DNA, 25 bp, Homo sapien
ggtagtaagcacactcacattgtcg

SEQ ID NO: 631761 - DNA, 25 bp, Homo sapien
tagtaagcacactcacattgtcgtg

SEQ ID NO: 631762 - DNA, 25 bp, Homo sapien
gtaagcacactcacattgtcgtgcg

SEQ ID NO: 631763 - DNA, 25 bp, Homo sapien
aagcacactcacattgtcgtgcgtc

SEQ ID NO: 631764 - DNA, 25 bp, Homo sapien
acactcacattgtcgtgcgtccatc

SEQ ID NO: 631765 - DNA, 25 bp, Homo sapien
attgtcgtgcgtccatcaccaccat

SEQ ID NO: 631766 - DNA, 25 bp, Homo sapien
atctcaagaactttttgcatctctg

SEQ ID NO: 631767 - DNA, 25 bp, Homo sapien
tctcaagaactttttgcatctctgc

SEQ ID NO: 631768 - DNA, 25 bp, Homo sapien
tttttgcatctctgcaaactataac

SEQ ID NO: 631769 - DNA, 25 bp, Homo sapien
ctgcaaactataactctgtcctgtc

SEQ ID NO: 631770 - DNA, 25 bp, Homo sapien
taataccaaacaacgtcttctttgt

SEQ ID NO: 631771 - DNA, 25 bp, Homo sapien
cgtcttctttgtttattatctgtct

SEQ ID NO: 631772 - DNA, 25 bp, Homo sapien
attgctatatccaaaatgcctagag

SEQ ID NO: 631773 - DNA, 25 bp, Homo sapien
aaatgcctagagttgttactggaac

SEQ ID NO: 631774 - DNA, 25 bp, Homo sapien
tgcctagagttgttactggaacata

SEQ ID NO: 631775 - DNA, 25 bp, Homo sapien
gaacatagtaggtggtctgtacaca

SEQ ID NO: 631776 - DNA, 25 bp, Homo sapien
agtaggtggtctgtacacatgaacc

SEQ ID NO: 631777 - DNA, 25 bp, Homo sapien
ggtggtctgtacacatgaaccaaat

SEQ ID NO: 631778 - DNA, 25 bp, Homo sapien
gaagtttccttgatacaccaaagtc

SEQ ID NO: 631779 - DNA, 25 bp, Homo sapien
gatacaccaaagtctacaccagtag

SEQ ID NO: 631780 - DNA, 25 bp, Homo sapien
aagtctacaccagtagaatcgaatt

SEQ ID NO: 631781 - DNA, 25 bp, Homo sapien
aacccagtgttgaatgagtctctgt

SEQ ID NO: 631782 - DNA, 25 bp, Homo sapien
tagaaccaccacttgggaagggcaa

SEQ ID NO: 631783 - DNA, 25 bp, Homo sapien
agcagacagcctcaacagtggtgga

SEQ ID NO: 631784 - DNA, 25 bp, Homo sapien
gtggtggagccaaccatgaacttct

SEQ ID NO: 631785 - DNA, 25 bp, Homo sapien
gccaaccatgaacttctcaggagtg

SEQ ID NO: 631786 - DNA, 25 bp, Homo sapien
agtgacctgtgcttccttcaaggca

SEQ ID NO: 631787 - DNA, 25 bp, Homo sapien
ggcagtttctgttatgtgtatcctt

SEQ ID NO: 631788 - DNA, 25 bp, Homo sapien
gtgtatccttctaagacctgcattt

SEQ ID NO: 631789 - DNA, 25 bp, Homo sapien
aagacctgcatttctttcaagactg

SEQ ID NO: 631790 - DNA, 25 bp, Homo sapien
aagactgatcctgtccattttgtag

SEQ ID NO: 631791 - DNA, 25 bp, Homo sapien
ctgtccattttgtagcccatttttc

SEQ ID NO: 631792 - DNA, 25 bp, Homo sapien
caaaagcagtgttaagtggaaagtt

SEQ ID NO: 631793 - DNA, 25 bp, Homo sapien
tttagagcactaaatacctacatca

SEQ ID NO: 631794 - DNA, 25 bp, Homo sapien
ttagagcactaaatacctacatcaa

SEQ ID NO: 631795 - DNA, 25 bp, Homo sapien
tagagcactaaatacctacatcaaa

SEQ ID NO: 631796 - DNA, 25 bp, Homo sapien
agagcactaaatacctacatcaaaa

SEQ ID NO: 631797 - DNA, 25 bp, Homo sapien
gagcactaaatacctacatcaaaaa

SEQ ID NO: 631798 - DNA, 25 bp, Homo sapien
agcactaaatacctacatcaaaaaa

SEQ ID NO: 631799 - DNA, 25 bp, Homo sapien
gcactaaatacctacatcaaaaaaa

SEQ ID NO: 631800 - DNA, 25 bp, Homo sapien
cactaaatacctacatcaaaaaaat

SEQ ID NO: 631801 - DNA, 25 bp, Homo sapien
catcaaaaaaatatgtaatcccagc

SEQ ID NO: 631802 - DNA, 25 bp, Homo sapien
atcaaaaaaatatgtaatcccagca

SEQ ID NO: 631803 - DNA, 25 bp, Homo sapien
ttaaaaagtagcagttttgggctgg

SEQ ID NO: 631804 - DNA, 25 bp, Homo sapien
aaagtagcagttttgggctgggtat

SEQ ID NO: 631805 - DNA, 25 bp, Homo sapien
aagtagcagttttgggctgggtatt

SEQ ID NO: 631806 - DNA, 25 bp, Homo sapien
agtagcagttttgggctgggtattg

SEQ ID NO: 631807 - DNA, 25 bp, Homo sapien
gtagcagttttgggctgggtattgt

SEQ ID NO: 631808 - DNA, 25 bp, Homo sapien
tagcagttttgggctgggtattgtg

SEQ ID NO: 631809 - DNA, 25 bp, Homo sapien
agcagttttgggctgggtattgtgg

SEQ ID NO: 631810 - DNA, 25 bp, Homo sapien
gcagttttgggctgggtattgtggc

SEQ ID NO: 631811 - DNA, 25 bp, Homo sapien
cagttttgggctgggtattgtggct

SEQ ID NO: 631812 - DNA, 25 bp, Homo sapien
agttttgggctgggtattgtggctc

SEQ ID NO: 631813 - DNA, 25 bp, Homo sapien
tttgggctgggtattgtggctcatg

SEQ ID NO: 631814 - DNA, 25 bp, Homo sapien
tgtgaaagcattcagcatagtgctg

SEQ ID NO: 631815 - DNA, 25 bp, Homo sapien
ttattttctatttcagcaactggta

SEQ ID NO: 631816 - DNA, 25 bp, Homo sapien
gcaactggtagatcatactatgagc

SEQ ID NO: 631817 - DNA, 25 bp, Homo sapien
actatttagtacatattgctggtga

SEQ ID NO: 631818 - DNA, 25 bp, Homo sapien
gtgataatgggctaacggaccgtta

SEQ ID NO: 631819 - DNA, 25 bp, Homo sapien
acggaccgttactatatgttctagc

SEQ ID NO: 631820 - DNA, 25 bp, Homo sapien
atgttctagcttaacctttgcaagt

SEQ ID NO: 631821 - DNA, 25 bp, Homo sapien
cagcattctgccatatttagtgcat

SEQ ID NO: 631822 - DNA, 25 bp, Homo sapien
gtgcattccattttgtattaaccta

SEQ ID NO: 631823 - DNA, 25 bp, Homo sapien
aacctactgaggatactttgattgt

SEQ ID NO: 631824 - DNA, 25 bp, Homo sapien
ctttgattgtctcctaaattaacaa

SEQ ID NO: 631825 - DNA, 25 bp, Homo sapien
tatctgtaagatgagaatcctcttc

SEQ ID NO: 631826 - DNA, 25 bp, Homo sapien
ctgtaagatgagaatcctcttctgc

SEQ ID NO: 631827 - DNA, 25 bp, Homo sapien
gtaagatgagaatcctcttctgcaa

SEQ ID NO: 631828 - DNA, 25 bp, Homo sapien
taagatgagaatcctcttctgcaaa

SEQ ID NO: 631829 - DNA, 25 bp, Homo sapien
agtgatgtagcaacattttctctag

SEQ ID NO: 631830 - DNA, 25 bp, Homo sapien
actataatgttaagtctgtgacttt

SEQ ID NO: 631831 - DNA, 25 bp, Homo sapien
taatgttaagtctgtgactttattt

SEQ ID NO: 631832 - DNA, 25 bp, Homo sapien
ttgctaaatgtccatctcagagaag

SEQ ID NO: 631833 - DNA, 25 bp, Homo sapien
agaagaatatgactttatatagcga

SEQ ID NO: 631834 - DNA, 25 bp, Homo sapien
aaaaaatagccttagtaatgcatat

SEQ ID NO: 631835 - DNA, 25 bp, Homo sapien
atagccttagtaatgcatatttgca

SEQ ID NO: 631836 - DNA, 25 bp, Homo sapien
ataaacaactttggcgaggtaagat

SEQ ID NO: 631837 - DNA, 25 bp, Homo sapien
cagccggtacggaaatgttcgatgg

SEQ ID NO: 631838 - DNA, 25 bp, Homo sapien
gttcgatggacaaatgagaggactt

SEQ ID NO: 631839 - DNA, 25 bp, Homo sapien
gaagatgaatgatagagccccggac

SEQ ID NO: 631840 - DNA, 25 bp, Homo sapien
agagccccggacagaatgcaatagt

SEQ ID NO: 631841 - DNA, 25 bp, Homo sapien
agtggcaataggcatgcattctttg

SEQ ID NO: 631842 - DNA, 25 bp, Homo sapien
ttgcagatgtgcaccgaaggctaca

SEQ ID NO: 631843 - DNA, 25 bp, Homo sapien
gaaggctacaggctactgtgtcttt

SEQ ID NO: 631844 - DNA, 25 bp, Homo sapien
cttgagcttctgacactgcacagaa

SEQ ID NO: 631845 - DNA, 25 bp, Homo sapien
tgcacagaaagtgggtcggtcctct

SEQ ID NO: 631846 - DNA, 25 bp, Homo sapien
gtcggtcctctgacaggcttgaaaa

SEQ ID NO: 631847 - DNA, 25 bp, Homo sapien
tggatcctgtaggtaagaaattcag

SEQ ID NO: 631848 - DNA, 25 bp, Homo sapien
ggatcctgtaggtaagaaattcagg

SEQ ID NO: 631849 - DNA, 25 bp, Homo sapien
gatcctgtaggtaagaaattcaggc

SEQ ID NO: 631850 - DNA, 25 bp, Homo sapien
atcctgtaggtaagaaattcaggct

SEQ ID NO: 631851 - DNA, 25 bp, Homo sapien
tcctgtaggtaagaaattcaggctt

SEQ ID NO: 631852 - DNA, 25 bp, Homo sapien
cctgtaggtaagaaattcaggcttg

SEQ ID NO: 631853 - DNA, 25 bp, Homo sapien
ctgtaggtaagaaattcaggcttgg

SEQ ID NO: 631854 - DNA, 25 bp, Homo sapien
gtaggtaagaaattcaggcttggcc

SEQ ID NO: 631855 - DNA, 25 bp, Homo sapien
taggtaagaaattcaggcttggcct

SEQ ID NO: 631856 - DNA, 25 bp, Homo sapien
aaattcaggcttggcctggtggctc

SEQ ID NO: 631857 - DNA, 25 bp, Homo sapien
aggagggcggaccacttgaggttag

SEQ ID NO: 631858 - DNA, 25 bp, Homo sapien
gctgaggtgggcatgattgcgtcag

SEQ ID NO: 631859 - DNA, 25 bp, Homo sapien
ctgaggtgggcatgattgcgtcagc

SEQ ID NO: 631860 - DNA, 25 bp, Homo sapien
tgaggtgggcatgattgcgtcagcc

SEQ ID NO: 631861 - DNA, 25 bp, Homo sapien
gaggtgggcatgattgcgtcagccc

SEQ ID NO: 631862 - DNA, 25 bp, Homo sapien
aggtgggcatgattgcgtcagccca

SEQ ID NO: 631863 - DNA, 25 bp, Homo sapien
ggtgggcatgattgcgtcagcccag

SEQ ID NO: 631864 - DNA, 25 bp, Homo sapien
gtgggcatgattgcgtcagcccagg

SEQ ID NO: 631865 - DNA, 25 bp, Homo sapien
tgggcatgattgcgtcagcccagga

SEQ ID NO: 631866 - DNA, 25 bp, Homo sapien
gggcatgattgcgtcagcccaggag

SEQ ID NO: 631867 - DNA, 25 bp, Homo sapien
ggcatgattgcgtcagcccaggagt

SEQ ID NO: 631868 - DNA, 25 bp, Homo sapien
atcgtgccattgccccctggcctgg

SEQ ID NO: 631869 - DNA, 25 bp, Homo sapien
tgccattgccccctggcctgggcga

SEQ ID NO: 631870 - DNA, 25 bp, Homo sapien
gccattgccccctggcctgggcgac

SEQ ID NO: 631871 - DNA, 25 bp, Homo sapien
ccattgccccctggcctgggcgaca

SEQ ID NO: 631872 - DNA, 25 bp, Homo sapien
attgccccctggcctgggcgacagt

SEQ ID NO: 631873 - DNA, 25 bp, Homo sapien
ttgccccctggcctgggcgacagtg

SEQ ID NO: 631874 - DNA, 25 bp, Homo sapien
tgccccctggcctgggcgacagtgc

SEQ ID NO: 631875 - DNA, 25 bp, Homo sapien
gccccctggcctgggcgacagtgcg

SEQ ID NO: 631876 - DNA, 25 bp, Homo sapien
ccccctggcctgggcgacagtgcga

SEQ ID NO: 631877 - DNA, 25 bp, Homo sapien
cccctggcctgggcgacagtgcgag

SEQ ID NO: 631878 - DNA, 25 bp, Homo sapien
ccctggcctgggcgacagtgcgaga

SEQ ID NO: 631879 - DNA, 25 bp, Homo sapien
tttctataatttctgatcatgacca

SEQ ID NO: 631880 - DNA, 25 bp, Homo sapien
tcagatatttctgacagctggcaaa

SEQ ID NO: 631881 - DNA, 25 bp, Homo sapien
agctggcaaaaagcccaaaccttct

SEQ ID NO: 631882 - DNA, 25 bp, Homo sapien
aaaccttctgccttctgatcatcct

SEQ ID NO: 631883 - DNA, 25 bp, Homo sapien
tgatcatcctgctaagtcatgcctt

SEQ ID NO: 631884 - DNA, 25 bp, Homo sapien
agtcatgcctttttctgcttaatga

SEQ ID NO: 631885 - DNA, 25 bp, Homo sapien
gcctttttctgcttaatgacaataa

SEQ ID NO: 631886 - DNA, 25 bp, Homo sapien
atgaaaacatctagtgaacttctaa

SEQ ID NO: 631887 - DNA, 25 bp, Homo sapien
aagtcatttacattccagtggtgct

SEQ ID NO: 631888 - DNA, 25 bp, Homo sapien
gtgcttctcttcatttatttaaaca

SEQ ID NO: 631889 - DNA, 25 bp, Homo sapien
tgaacaagtttgctaccatactaag

SEQ ID NO: 631890 - DNA, 25 bp, Homo sapien
gagacactccctatatggtacagcc

SEQ ID NO: 631891 - DNA, 25 bp, Homo sapien
atggtacagcccctcaacaagacgg

SEQ ID NO: 631892 - DNA, 25 bp, Homo sapien
gaacgtgctggcagtgcgacttaca

SEQ ID NO: 631893 - DNA, 25 bp, Homo sapien
caaatttgagcatgttccagtcgaa

SEQ ID NO: 631894 - DNA, 25 bp, Homo sapien
gttccagtcgaacacgtagtcatag

SEQ ID NO: 631895 - DNA, 25 bp, Homo sapien
tagtcataggagaagccctggcgat

SEQ ID NO: 631896 - DNA, 25 bp, Homo sapien
agccctggcgatggaacagattccg

SEQ ID NO: 631897 - DNA, 25 bp, Homo sapien
acagattccggaaaagctgccgcag

SEQ ID NO: 631898 - DNA, 25 bp, Homo sapien
aagctgccgcaggtacgagtagtca

SEQ ID NO: 631899 - DNA, 25 bp, Homo sapien
gtagtcaggcttgtcgtcaaaacgc

SEQ ID NO: 631900 - DNA, 25 bp, Homo sapien
caggtatgtggcaaattcggctaca

SEQ ID NO: 631901 - DNA, 25 bp, Homo sapien
aagaatacaatagttagcttggcgt

SEQ ID NO: 631902 - DNA, 25 bp, Homo sapien
agaatacaatagttagcttggcgtg

SEQ ID NO: 631903 - DNA, 25 bp, Homo sapien
gaatacaatagttagcttggcgtgg

SEQ ID NO: 631904 - DNA, 25 bp, Homo sapien
gctgggctgagtggctcgcgcctgc

SEQ ID NO: 631905 - DNA, 25 bp, Homo sapien
tgggctgagtggctcgcgcctgcga

SEQ ID NO: 631906 - DNA, 25 bp, Homo sapien
gggctgagtggctcgcgcctgcgat

SEQ ID NO: 631907 - DNA, 25 bp, Homo sapien
tcgcgcctgcgatcccgacagtttg

SEQ ID NO: 631908 - DNA, 25 bp, Homo sapien
cgcgcctgcgatcccgacagtttgg

SEQ ID NO: 631909 - DNA, 25 bp, Homo sapien
gcctgcgatcccgacagtttgggag

SEQ ID NO: 631910 - DNA, 25 bp, Homo sapien
cctgcgatcccgacagtttgggagg

SEQ ID NO: 631911 - DNA, 25 bp, Homo sapien
tgcgatcccgacagtttgggaggcc

SEQ ID NO: 631912 - DNA, 25 bp, Homo sapien
aaatcattctgctatcctctggagt

SEQ ID NO: 631913 - DNA, 25 bp, Homo sapien
tctgctatcctctggagtttgtaaa

SEQ ID NO: 631914 - DNA, 25 bp, Homo sapien
aattcttacttcatttgctataggg

SEQ ID NO: 631915 - DNA, 25 bp, Homo sapien
gagcaatatgccatcttgtgaacta

SEQ ID NO: 631916 - DNA, 25 bp, Homo sapien
tagggaggtgcatctttctggcatc

SEQ ID NO: 631917 - DNA, 25 bp, Homo sapien
tttctggcatcttccacagtactgt

SEQ ID NO: 631918 - DNA, 25 bp, Homo sapien
ttccacagtactgtgctgtcctgga

SEQ ID NO: 631919 - DNA, 25 bp, Homo sapien
tccagagtcaacagctgagcagcat

SEQ ID NO: 631920 - DNA, 25 bp, Homo sapien
gcagcatgatgtagcctatgattca

SEQ ID NO: 631921 - DNA, 25 bp, Homo sapien
aaataattcccaatgccctttgtct

SEQ ID NO: 631922 - DNA, 25 bp, Homo sapien
gttctgcatatcaactgcaatgcaa

SEQ ID NO: 631923 - DNA, 25 bp, Homo sapien
cctataatctgttgaatatgtacac

SEQ ID NO: 631924 - DNA, 25 bp, Homo sapien
gaatatgtacacttaaccactcaac

SEQ ID NO: 631925 - DNA, 25 bp, Homo sapien
tacacttaaccactcaacttaccat

SEQ ID NO: 631926 - DNA, 25 bp, Homo sapien
tcaacttaccatacgtttctgttcc

SEQ ID NO: 631927 - DNA, 25 bp, Homo sapien
aagtatctgtttttggcttctgacc

SEQ ID NO: 631928 - DNA, 25 bp, Homo sapien
ctgtttttggcttctgaccagagac

SEQ ID NO: 631929 - DNA, 25 bp, Homo sapien
ttggcttctgaccagagactacact

SEQ ID NO: 631930 - DNA, 25 bp, Homo sapien
ttctgaccagagactacacttccca

SEQ ID NO: 631931 - DNA, 25 bp, Homo sapien
gactacacttcccagcctctgggaa

SEQ ID NO: 631932 - DNA, 25 bp, Homo sapien
accctgcaggctgaaactcttcatg

SEQ ID NO: 631933 - DNA, 25 bp, Homo sapien
gcaggctgaaactcttcatgagaaa

SEQ ID NO: 631934 - DNA, 25 bp, Homo sapien
gggtgaaggataggtctccagacca

SEQ ID NO: 631935 - DNA, 25 bp, Homo sapien
taggtctccagaccaagcagggata

SEQ ID NO: 631936 - DNA, 25 bp, Homo sapien
gcaggaatggctgctctagggtctg

SEQ ID NO: 631937 - DNA, 25 bp, Homo sapien
ctctagggtctggatatgaacggga

SEQ ID NO: 631938 - DNA, 25 bp, Homo sapien
ggtctggatatgaacgggacatctg

SEQ ID NO: 631939 - DNA, 25 bp, Homo sapien
ggatatgaacgggacatctggaaag

SEQ ID NO: 631940 - DNA, 25 bp, Homo sapien
gaaagcaggcccaggaatgacagac

SEQ ID NO: 631941 - DNA, 25 bp, Homo sapien
agcaggcccaggaatgacagacagg

SEQ ID NO: 631942 - DNA, 25 bp, Homo sapien
atctcagggaggtggggactcactt

SEQ ID NO: 631943 - DNA, 25 bp, Homo sapien
gaagggtaggctcagggagttcagt

SEQ ID NO: 631944 - DNA, 25 bp, Homo sapien
ggtcaggatctggacagcggctcta

SEQ ID NO: 631945 - DNA, 25 bp, Homo sapien
tgccccacaggactggtgtcaagat

SEQ ID NO: 631946 - DNA, 25 bp, Homo sapien
tgtaaacgtatatagctcggcacct

SEQ ID NO: 631947 - DNA, 25 bp, Homo sapien
agctcggcaccttggtttcataaat

SEQ ID NO: 631948 - DNA, 25 bp, Homo sapien
atattagccttttcctcacatggaa

SEQ ID NO: 631949 - DNA, 25 bp, Homo sapien
ggaaaagtgctttgagaaccagaaa

SEQ ID NO: 631950 - DNA, 25 bp, Homo sapien
gagaaccagaaagcccgataaacca

SEQ ID NO: 631951 - DNA, 25 bp, Homo sapien
gcccgataaaccatatggcttttga

SEQ ID NO: 631952 - DNA, 25 bp, Homo sapien
aaacgaggcacattttggagtcaga

SEQ ID NO: 631953 - DNA, 25 bp, Homo sapien
tccctttatgagctgtgcacctgag

SEQ ID NO: 631954 - DNA, 25 bp, Homo sapien
aggcaaattgcacagcctctctggg

SEQ ID NO: 631955 - DNA, 25 bp, Homo sapien
ctgggcttcaatttttcacctgtag

SEQ ID NO: 631956 - DNA, 25 bp, Homo sapien
acagcagcgggaggaatccaaccgt

SEQ ID NO: 631957 - DNA, 25 bp, Homo sapien
ggaggaatccaaccgtaccatgctg

SEQ ID NO: 631958 - DNA, 25 bp, Homo sapien
caaccgtaccatgctgtctgtagat

SEQ ID NO: 631959 - DNA, 25 bp, Homo sapien
cgtaccatgctgtctgtagataggg

SEQ ID NO: 631960 - DNA, 25 bp, Homo sapien
gggtttcctatagatgttatctttt

SEQ ID NO: 631961 - DNA, 25 bp, Homo sapien
agatgttatcttttacgccagtgtt

SEQ ID NO: 631962 - DNA, 25 bp, Homo sapien
tgttatcttttacgccagtgttgtt

SEQ ID NO: 631963 - DNA, 25 bp, Homo sapien
gctaagggccttggtggtgccttca

SEQ ID NO: 631964 - DNA, 25 bp, Homo sapien
ggtgccttcactgcatttatcagaa

SEQ ID NO: 631965 - DNA, 25 bp, Homo sapien
actgcatttatcagaacacaacaaa

SEQ ID NO: 631966 - DNA, 25 bp, Homo sapien
aacaaaaggatgcattcagaagcag

SEQ ID NO: 631967 - DNA, 25 bp, Homo sapien
tttttcccgctggggcgaggtggct

SEQ ID NO: 631968 - DNA, 25 bp, Homo sapien
ttttcccgctggggcgaggtggctc

SEQ ID NO: 631969 - DNA, 25 bp, Homo sapien
tttcccgctggggcgaggtggctca

SEQ ID NO: 631970 - DNA, 25 bp, Homo sapien
ttcccgctggggcgaggtggctcag

SEQ ID NO: 631971 - DNA, 25 bp, Homo sapien
tcccgctggggcgaggtggctcagg

SEQ ID NO: 631972 - DNA, 25 bp, Homo sapien
cccgctggggcgaggtggctcaggc

SEQ ID NO: 631973 - DNA, 25 bp, Homo sapien
cgctggggcgaggtggctcaggcct

SEQ ID NO: 631974 - DNA, 25 bp, Homo sapien
gctggggcgaggtggctcaggccta

SEQ ID NO: 631975 - DNA, 25 bp, Homo sapien
ctggggcgaggtggctcaggcctat

SEQ ID NO: 631976 - DNA, 25 bp, Homo sapien
tggggcgaggtggctcaggcctata

SEQ ID NO: 631977 - DNA, 25 bp, Homo sapien
ggggcgaggtggctcaggcctataa

SEQ ID NO: 631978 - DNA, 25 bp, Homo sapien
acaaaggagcaaatgcaatacaggg

SEQ ID NO: 631979 - DNA, 25 bp, Homo sapien
gaaaaaacagccctttcaacaaatg

SEQ ID NO: 631980 - DNA, 25 bp, Homo sapien
aaaacagccctttcaacaaatggtg

SEQ ID NO: 631981 - DNA, 25 bp, Homo sapien
tggtgctgaacaattggacatccac

SEQ ID NO: 631982 - DNA, 25 bp, Homo sapien
gaaactagacacagaccttatattt

SEQ ID NO: 631983 - DNA, 25 bp, Homo sapien
aactagacacagaccttatattttt

SEQ ID NO: 631984 - DNA, 25 bp, Homo sapien
gacacagaccttatattttttacaa

SEQ ID NO: 631985 - DNA, 25 bp, Homo sapien
cactacccaacttcaagacttataa

SEQ ID NO: 631986 - DNA, 25 bp, Homo sapien
acccaacttcaagacttataataag

SEQ ID NO: 631987 - DNA, 25 bp, Homo sapien
gacttataataaggctacagtaatc

SEQ ID NO: 631988 - DNA, 25 bp, Homo sapien
caaaacaatgtggtattagtgataa

SEQ ID NO: 631989 - DNA, 25 bp, Homo sapien
gcgcccggccgactcacggtatttt

SEQ ID NO: 631990 - DNA, 25 bp, Homo sapien
gccgactcacggtattttttgatag

SEQ ID NO: 631991 - DNA, 25 bp, Homo sapien
atgagttctctcattaggcacctcc

SEQ ID NO: 631992 - DNA, 25 bp, Homo sapien
tctctcattaggcacctcctataat

SEQ ID NO: 631993 - DNA, 25 bp, Homo sapien
aggcacctcctataatgtatataac

SEQ ID NO: 631994 - DNA, 25 bp, Homo sapien
acactgtgtatgcttagcttggtga

SEQ ID NO: 631995 - DNA, 25 bp, Homo sapien
tgtatgcttagcttggtgagttaaa

SEQ ID NO: 631996 - DNA, 25 bp, Homo sapien
cttagcttggtgagttaaatcactc

SEQ ID NO: 631997 - DNA, 25 bp, Homo sapien
ttaaatcactcacattctccaccaa

SEQ ID NO: 631998 - DNA, 25 bp, Homo sapien
accaagcgctccagctggggaatta

SEQ ID NO: 631999 - DNA, 25 bp, Homo sapien
cgtttggcaccacccctctgagggt

SEQ ID NO: 632000 - DNA, 25 bp, Homo sapien
tatatttggaaagtacagcctgggc

SEQ ID NO: 632001 - DNA, 25 bp, Homo sapien
tatttggaaagtacagcctgggcac

SEQ ID NO: 632002 - DNA, 25 bp, Homo sapien
atttggaaagtacagcctgggcaca

SEQ ID NO: 632003 - DNA, 25 bp, Homo sapien
tttggaaagtacagcctgggcacag

SEQ ID NO: 632004 - DNA, 25 bp, Homo sapien
ttggaaagtacagcctgggcacagt

SEQ ID NO: 632005 - DNA, 25 bp, Homo sapien
aacatattgggacctcgtctctacg

SEQ ID NO: 632006 - DNA, 25 bp, Homo sapien
gacctcgtctctacgcataatttaa

SEQ ID NO: 632007 - DNA, 25 bp, Homo sapien
actgcagtgaggcatgttgcaccac

SEQ ID NO: 632008 - DNA, 25 bp, Homo sapien
aggcatgttgcaccactgcaatact

SEQ ID NO: 632009 - DNA, 25 bp, Homo sapien
ggcatgttgcaccactgcaatactc

SEQ ID NO: 632010 - DNA, 25 bp, Homo sapien
catgttgcaccactgcaatactcca

SEQ ID NO: 632011 - DNA, 25 bp, Homo sapien
gggtcagggagcctgaacccacact

SEQ ID NO: 632012 - DNA, 25 bp, Homo sapien
gctcaggagtccatagccttttgga

SEQ ID NO: 632013 - DNA, 25 bp, Homo sapien
gaggctggattctgcccacaggaga

SEQ ID NO: 632014 - DNA, 25 bp, Homo sapien
ggagacggccagacagctattgtac

SEQ ID NO: 632015 - DNA, 25 bp, Homo sapien
agctattgtactgctggctccaagc

SEQ ID NO: 632016 - DNA, 25 bp, Homo sapien
aagggtccacccttagcaaggcatt

SEQ ID NO: 632017 - DNA, 25 bp, Homo sapien
cccttagcaaggcattcattcctca

SEQ ID NO: 632018 - DNA, 25 bp, Homo sapien
gctatcccctaagcctggagaggaa

SEQ ID NO: 632019 - DNA, 25 bp, Homo sapien
ggaatttcctgtttgcttgtcttgc

SEQ ID NO: 632020 - DNA, 25 bp, Homo sapien
tttgcttgtcttgctcagggtggtg

SEQ ID NO: 632021 - DNA, 25 bp, Homo sapien
gtggctgaccacagagaacagtgca

SEQ ID NO: 632022 - DNA, 25 bp, Homo sapien
tttaactttctgtaatagatctgtg

SEQ ID NO: 632023 - DNA, 25 bp, Homo sapien
aactttctgtaatagatctgtgttc

SEQ ID NO: 632024 - DNA, 25 bp, Homo sapien
actttctgtaatagatctgtgttca

SEQ ID NO: 632025 - DNA, 25 bp, Homo sapien
ctttctgtaatagatctgtgttcat

SEQ ID NO: 632026 - DNA, 25 bp, Homo sapien
ttctgtaatagatctgtgttcattt

SEQ ID NO: 632027 - DNA, 25 bp, Homo sapien
tctgtaatagatctgtgttcatttt

SEQ ID NO: 632028 - DNA, 25 bp, Homo sapien
ctgtaatagatctgtgttcatttta

SEQ ID NO: 632029 - DNA, 25 bp, Homo sapien
gtaatagatctgtgttcattttatg

SEQ ID NO: 632030 - DNA, 25 bp, Homo sapien
aatagatctgtgttcattttatggt

SEQ ID NO: 632031 - DNA, 25 bp, Homo sapien
atagatctgtgttcattttatggta

SEQ ID NO: 632032 - DNA, 25 bp, Homo sapien
tagatctgtgttcattttatggtag

SEQ ID NO: 632033 - DNA, 25 bp, Homo sapien
caatttgactgagttatagggtgaa

SEQ ID NO: 632034 - DNA, 25 bp, Homo sapien
gactgagttatagggtgaatgaaag

SEQ ID NO: 632035 - DNA, 25 bp, Homo sapien
gaagctggaaagatttcctaacact

SEQ ID NO: 632036 - DNA, 25 bp, Homo sapien
gctggaaagatttcctaacactagg

SEQ ID NO: 632037 - DNA, 25 bp, Homo sapien
ggaaagatttcctaacactaggtgg

SEQ ID NO: 632038 - DNA, 25 bp, Homo sapien
gaaagatttcctaacactaggtggt

SEQ ID NO: 632039 - DNA, 25 bp, Homo sapien
tggtaaaaggaacttctctaacctg

SEQ ID NO: 632040 - DNA, 25 bp, Homo sapien
ggaacttctctaacctggtaagaag

SEQ ID NO: 632041 - DNA, 25 bp, Homo sapien
gaacttctctaacctggtaagaagt

SEQ ID NO: 632042 - DNA, 25 bp, Homo sapien
ttctctaacctggtaagaagtttgg

SEQ ID NO: 632043 - DNA, 25 bp, Homo sapien
ctctaacctggtaagaagtttggat

SEQ ID NO: 632044 - DNA, 25 bp, Homo sapien
cgcctggcaaattttaactttctgt

SEQ ID NO: 632045 - DNA, 25 bp, Homo sapien
aactttctgtaatagatctgtgttc

SEQ ID NO: 632046 - DNA, 25 bp, Homo sapien
actttctgtaatagatctgtgttca

SEQ ID NO: 632047 - DNA, 25 bp, Homo sapien
ctttctgtaatagatctgtgttcat

SEQ ID NO: 632048 - DNA, 25 bp, Homo sapien
ttctgtaatagatctgtgttcattt

SEQ ID NO: 632049 - DNA, 25 bp, Homo sapien
ctgtaatagatctgtgttcatttta

SEQ ID NO: 632050 - DNA, 25 bp, Homo sapien
gtaatagatctgtgttcattttatg

SEQ ID NO: 632051 - DNA, 25 bp, Homo sapien
aatagatctgtgttcattttatggt

SEQ ID NO: 632052 - DNA, 25 bp, Homo sapien
atagatctgtgttcattttatggta

SEQ ID NO: 632053 - DNA, 25 bp, Homo sapien
tagatctgtgttcattttatggtag

SEQ ID NO: 632054 - DNA, 25 bp, Homo sapien
atctgtgttcattttatggtagtaa

SEQ ID NO: 632055 - DNA, 25 bp, Homo sapien
aattacccactgtcacactgggttg

SEQ ID NO: 632056 - DNA, 25 bp, Homo sapien
cacactgggttgtgacagagttata

SEQ ID NO: 632057 - DNA, 25 bp, Homo sapien
gttataaaaccttaagcactctagt

SEQ ID NO: 632058 - DNA, 25 bp, Homo sapien
aagcactctagttcagtgttctgag

SEQ ID NO: 632059 - DNA, 25 bp, Homo sapien
gtaaggttcaggttcttgtgatctt

SEQ ID NO: 632060 - DNA, 25 bp, Homo sapien
ggttcttgtgatctttgctgagttc

SEQ ID NO: 632061 - DNA, 25 bp, Homo sapien
ttgtgatctttgctgagttctttgt

SEQ ID NO: 632062 - DNA, 25 bp, Homo sapien
ttaggattctgtctcctttgtacat

SEQ ID NO: 632063 - DNA, 25 bp, Homo sapien
gattctgtctcctttgtacattttt

SEQ ID NO: 632064 - DNA, 25 bp, Homo sapien
tgtacatttttctggtgttgattct

SEQ ID NO: 632065 - DNA, 25 bp, Homo sapien
taaattctagttcctaaagagcacc

SEQ ID NO: 632066 - DNA, 25 bp, Homo sapien
tgaaaccctgtctgagagagagaga

SEQ ID NO: 632067 - DNA, 25 bp, Homo sapien
gagagaaaatactactatggtgctt

SEQ ID NO: 632068 - DNA, 25 bp, Homo sapien
gagaaaatactactatggtgcttat

SEQ ID NO: 632069 - DNA, 25 bp, Homo sapien
agaaaatactactatggtgcttata

SEQ ID NO: 632070 - DNA, 25 bp, Homo sapien
gaaaatactactatggtgcttataa

SEQ ID NO: 632071 - DNA, 25 bp, Homo sapien
tactactatggtgcttataaaagtt

SEQ ID NO: 632072 - DNA, 25 bp, Homo sapien
ctactatggtgcttataaaagttca

SEQ ID NO: 632073 - DNA, 25 bp, Homo sapien
actatggtgcttataaaagttcaat

SEQ ID NO: 632074 - DNA, 25 bp, Homo sapien
tatggtgcttataaaagttcaataa

SEQ ID NO: 632075 - DNA, 25 bp, Homo sapien
caataaattttagctgttgttagta

SEQ ID NO: 632076 - DNA, 25 bp, Homo sapien
agctgttgttagtattattaaagta

SEQ ID NO: 632077 - DNA, 25 bp, Homo sapien
tgaagaatacaatgtcccacgagac

SEQ ID NO: 632078 - DNA, 25 bp, Homo sapien
acgagactatgtggccatcaggaaa

SEQ ID NO: 632079 - DNA, 25 bp, Homo sapien
ttaacttttctgacctaatggccca

SEQ ID NO: 632080 - DNA, 25 bp, Homo sapien
ctaatggcccaggaagcactgcggg

SEQ ID NO: 632081 - DNA, 25 bp, Homo sapien
gtgtaacgcagcacccgcagaagtg

SEQ ID NO: 632082 - DNA, 25 bp, Homo sapien
agaagtgcccgggatcagcctttgc

SEQ ID NO: 632083 - DNA, 25 bp, Homo sapien
ggatcagcctttgcctcggcgggat

SEQ ID NO: 632084 - DNA, 25 bp, Homo sapien
ggatcctggttcctggttcttccaa

SEQ ID NO: 632085 - DNA, 25 bp, Homo sapien
cccgctcccttatcttgaggaaagt

SEQ ID NO: 632086 - DNA, 25 bp, Homo sapien
ataagtaacccagctctttcaactc

SEQ ID NO: 632087 - DNA, 25 bp, Homo sapien
gctctttcaactcccaaggttactt

SEQ ID NO: 632088 - DNA, 25 bp, Homo sapien
agggtgaaggataggtctccagacc

SEQ ID NO: 632089 - DNA, 25 bp, Homo sapien
ggtgaaggataggtctccagaccaa

SEQ ID NO: 632090 - DNA, 25 bp, Homo sapien
gcaggaatggctgctctagggtctg

SEQ ID NO: 632091 - DNA, 25 bp, Homo sapien
ctctagggtctggatatgaacggga

SEQ ID NO: 632092 - DNA, 25 bp, Homo sapien
ggtctggatatgaacgggacatctg

SEQ ID NO: 632093 - DNA, 25 bp, Homo sapien
ggatatgaacgggacatctggaaag

SEQ ID NO: 632094 - DNA, 25 bp, Homo sapien
gaaagcaggcccaggaatgacagac

SEQ ID NO: 632095 - DNA, 25 bp, Homo sapien
agcaggcccaggaatgacagacagg

SEQ ID NO: 632096 - DNA, 25 bp, Homo sapien
atctcagggaggtggggactcactt

SEQ ID NO: 632097 - DNA, 25 bp, Homo sapien
ggcagaagggtaggctcagggagtt

SEQ ID NO: 632098 - DNA, 25 bp, Homo sapien
aagggtaggctcagggagttcagtg

SEQ ID NO: 632099 - DNA, 25 bp, Homo sapien
aaaacttcatatttcagccaatgta

SEQ ID NO: 632100 - DNA, 25 bp, Homo sapien
ggaaatcccattatcaatttatgag

SEQ ID NO: 632101 - DNA, 25 bp, Homo sapien
tatgagactatcttttccctcaacc

SEQ ID NO: 632102 - DNA, 25 bp, Homo sapien
tcaaccactcttcgcgaagctatgc

SEQ ID NO: 632103 - DNA, 25 bp, Homo sapien
ttcgcgaagctatgccactttattt

SEQ ID NO: 632104 - DNA, 25 bp, Homo sapien
agctatgccactttatttgattcta

SEQ ID NO: 632105 - DNA, 25 bp, Homo sapien
gatttgctagttttatttgttgcgc

SEQ ID NO: 632106 - DNA, 25 bp, Homo sapien
ttgttgcgcaaaatcaaacttgatc

SEQ ID NO: 632107 - DNA, 25 bp, Homo sapien
ggtaacattagcagtggaaccacat

SEQ ID NO: 632108 - DNA, 25 bp, Homo sapien
gtggaaccacatgggtcaaaaatca

SEQ ID NO: 632109 - DNA, 25 bp, Homo sapien
acaatcaagggtgtgtgtccattaa

SEQ ID NO: 632110 - DNA, 25 bp, Homo sapien
actgtcctctgcatgatgttaccga

SEQ ID NO: 632111 - DNA, 25 bp, Homo sapien
gatgttaccgaaatggagacaacca

SEQ ID NO: 632112 - DNA, 25 bp, Homo sapien
aactggacaacttagtcagctggac

SEQ ID NO: 632113 - DNA, 25 bp, Homo sapien
acttagtcagctggactggaagact

SEQ ID NO: 632114 - DNA, 25 bp, Homo sapien
gaagactgcacttccaaatggaaag

SEQ ID NO: 632115 - DNA, 25 bp, Homo sapien
ggctcctttggaaatgtggcttcaa

SEQ ID NO: 632116 - DNA, 25 bp, Homo sapien
ttgctggtgttgcttgcccttacgc

SEQ ID NO: 632117 - DNA, 25 bp, Homo sapien
ttacgctctgtcaaatctcaggcag

SEQ ID NO: 632118 - DNA, 25 bp, Homo sapien
agatgtaagctttctaaattatcaa

SEQ ID NO: 632119 - DNA, 25 bp, Homo sapien
aaattatcaatagagggcctgtcat

SEQ ID NO: 632120 - DNA, 25 bp, Homo sapien
tagagggcctgtcattcaaatggaa

SEQ ID NO: 632121 - DNA, 25 bp, Homo sapien
gacaaagcaccaaagaactcgctct

SEQ ID NO: 632122 - DNA, 25 bp, Homo sapien
ggacccagcaagaaaggagctgtct

SEQ ID NO: 632123 - DNA, 25 bp, Homo sapien
gggcccactggacatcagatcttgg

SEQ ID NO: 632124 - DNA, 25 bp, Homo sapien
ctggacatcagatcttggacttcct

SEQ ID NO: 632125 - DNA, 25 bp, Homo sapien
ttggacttcctaactgcagaaccgt

SEQ ID NO: 632126 - DNA, 25 bp, Homo sapien
ttcctaactgcagaaccgtgagaaa

SEQ ID NO: 632127 - DNA, 25 bp, Homo sapien
ataaatgtttgagctcctgcctgga

SEQ ID NO: 632128 - DNA, 25 bp, Homo sapien
gtttgagctcctgcctggattccca

SEQ ID NO: 632129 - DNA, 25 bp, Homo sapien
tgcagttgccttcatgatggcatta

SEQ ID NO: 632130 - DNA, 25 bp, Homo sapien
gtagatcattgtattagttccctga

SEQ ID NO: 632131 - DNA, 25 bp, Homo sapien
agttccctgataagacaaagcacca

SEQ ID NO: 632132 - DNA, 25 bp, Homo sapien
ggtaaattccatgtcacgagggttt

SEQ ID NO: 632133 - DNA, 25 bp, Homo sapien
agattatttcatcactcaggtgata

SEQ ID NO: 632134 - DNA, 25 bp, Homo sapien
gcatagtacccaattggtatcatct

SEQ ID NO: 632135 - DNA, 25 bp, Homo sapien
ggtatcatctagcattttccaaact

SEQ ID NO: 632136 - DNA, 25 bp, Homo sapien
agcattttccaaactaacttagcct

SEQ ID NO: 632137 - DNA, 25 bp, Homo sapien
actaacttagccttatggactgccc

SEQ ID NO: 632138 - DNA, 25 bp, Homo sapien
ttagccttatggactgcccctggac

SEQ ID NO: 632139 - DNA, 25 bp, Homo sapien
tggaccatcacctatttttcttttc

SEQ ID NO: 632140 - DNA, 25 bp, Homo sapien
tttcttttctctttgcggaatggct

SEQ ID NO: 632141 - DNA, 25 bp, Homo sapien
gcggaatggctattaatatctcaca

SEQ ID NO: 632142 - DNA, 25 bp, Homo sapien
gattgaatatcttatggaacactgg

SEQ ID NO: 632143 - DNA, 25 bp, Homo sapien
agtgtagtggttcaatcatctctca

SEQ ID NO: 632144 - DNA, 25 bp, Homo sapien
gtgtagtggttcaatcatctctcac

SEQ ID NO: 632145 - DNA, 25 bp, Homo sapien
gagccactatgtcttgctgattaaa

SEQ ID NO: 632146 - DNA, 25 bp, Homo sapien
gccactatgtcttgctgattaaaaa

SEQ ID NO: 632147 - DNA, 25 bp, Homo sapien
ctatgtcttgctgattaaaaattgt

SEQ ID NO: 632148 - DNA, 25 bp, Homo sapien
tgtcttgctgattaaaaattgtttt

SEQ ID NO: 632149 - DNA, 25 bp, Homo sapien
gcatgagtcaatatgcccagtctct

SEQ ID NO: 632150 - DNA, 25 bp, Homo sapien
atgagtcaatatgcccagtctcttt

SEQ ID NO: 632151 - DNA, 25 bp, Homo sapien
agttactctagaaaatggcttgttg

SEQ ID NO: 632152 - DNA, 25 bp, Homo sapien
tactctagaaaatggcttgttgatt

SEQ ID NO: 632153 - DNA, 25 bp, Homo sapien
agaaaatggcttgttgattttgtta

SEQ ID NO: 632154 - DNA, 25 bp, Homo sapien
cgtaacctactctcagaagtgacat

SEQ ID NO: 632155 - DNA, 25 bp, Homo sapien
ctcagaagtgacatcccggctgagt

SEQ ID NO: 632156 - DNA, 25 bp, Homo sapien
tcagaagtgacatcccggctgagtc

SEQ ID NO: 632157 - DNA, 25 bp, Homo sapien
cagaagtgacatcccggctgagtct

SEQ ID NO: 632158 - DNA, 25 bp, Homo sapien
aagtgacatcccggctgagtctggt

SEQ ID NO: 632159 - DNA, 25 bp, Homo sapien
agtgacatcccggctgagtctggtg

SEQ ID NO: 632160 - DNA, 25 bp, Homo sapien
tgacatcccggctgagtctggtggc

SEQ ID NO: 632161 - DNA, 25 bp, Homo sapien
gacatcccggctgagtctggtggct

SEQ ID NO: 632162 - DNA, 25 bp, Homo sapien
acatcccggctgagtctggtggctc

SEQ ID NO: 632163 - DNA, 25 bp, Homo sapien
catcccggctgagtctggtggctca

SEQ ID NO: 632164 - DNA, 25 bp, Homo sapien
atcccggctgagtctggtggctcat

SEQ ID NO: 632165 - DNA, 25 bp, Homo sapien
aagatcacaagtcagcactacctcc

SEQ ID NO: 632166 - DNA, 25 bp, Homo sapien
agatcacaagtcagcactacctcct

SEQ ID NO: 632167 - DNA, 25 bp, Homo sapien
ctcccttcttgagttctcaactgag

SEQ ID NO: 632168 - DNA, 25 bp, Homo sapien
cttgagttctcaactgagtgagcat

SEQ ID NO: 632169 - DNA, 25 bp, Homo sapien
aactgagtgagcatcatggagggag

SEQ ID NO: 632170 - DNA, 25 bp, Homo sapien
tcagcctgggtgtgtgaagctgtaa

SEQ ID NO: 632171 - DNA, 25 bp, Homo sapien
gaacccaaacccattttagagacag

SEQ ID NO: 632172 - DNA, 25 bp, Homo sapien
cccaaacccattttagagacagaag

SEQ ID NO: 632173 - DNA, 25 bp, Homo sapien
gagacagaagaaactaccctctgga

SEQ ID NO: 632174 - DNA, 25 bp, Homo sapien
atgaagctgagatgggacaggatca

SEQ ID NO: 632175 - DNA, 25 bp, Homo sapien
gagatgggacaggatcaaagttgat

SEQ ID NO: 632176 - DNA, 25 bp, Homo sapien
ggtaacaagattgagctttaagtct

SEQ ID NO: 632177 - DNA, 25 bp, Homo sapien
cttatggctccatgttgtaagtaaa

SEQ ID NO: 632178 - DNA, 25 bp, Homo sapien
agtaaaaagtcatttgaccaactgt

SEQ ID NO: 632179 - DNA, 25 bp, Homo sapien
accaactgtttggaattcttgtcaa

SEQ ID NO: 632180 - DNA, 25 bp, Homo sapien
actgtttggaattcttgtcaataac

SEQ ID NO: 632181 - DNA, 25 bp, Homo sapien
tattgagcacccatgttagtgaatt

SEQ ID NO: 632182 - DNA, 25 bp, Homo sapien
acccatgttagtgaatttctgtgtg

SEQ ID NO: 632183 - DNA, 25 bp, Homo sapien
ggttgagagcaaataccttgggtat

SEQ ID NO: 632184 - DNA, 25 bp, Homo sapien
gagcaaataccttgggtatactttg

SEQ ID NO: 632185 - DNA, 25 bp, Homo sapien
ggaaccatgatcagcttgtcatgca

SEQ ID NO: 632186 - DNA, 25 bp, Homo sapien
gatcagcttgtcatgcaaacatatg

SEQ ID NO: 632187 - DNA, 25 bp, Homo sapien
attaacagaatgatgggcaaaaacc

SEQ ID NO: 632188 - DNA, 25 bp, Homo sapien
tgggcaaaaaccatgtgatcatctc

SEQ ID NO: 632189 - DNA, 25 bp, Homo sapien
ggcattttgcaaaactccaaaaact

SEQ ID NO: 632190 - DNA, 25 bp, Homo sapien
gacaaactaatcttctcaaactctt

SEQ ID NO: 632191 - DNA, 25 bp, Homo sapien
actaatcttctcaaactcttcagaa

SEQ ID NO: 632192 - DNA, 25 bp, Homo sapien
cttgatgcaaaatccctcaacaaaa

SEQ ID NO: 632193 - DNA, 25 bp, Homo sapien
gcaaaccaaatccataacacattag

SEQ ID NO: 632194 - DNA, 25 bp, Homo sapien
ttagaaggattatacatcatgacta

SEQ ID NO: 632195 - DNA, 25 bp, Homo sapien
catcatgactaagtggagtttattc

SEQ ID NO: 632196 - DNA, 25 bp, Homo sapien
gagtttattcctggaacgtgaggat

SEQ ID NO: 632197 - DNA, 25 bp, Homo sapien
ctggaacgtgaggatggttcaacat

SEQ ID NO: 632198 - DNA, 25 bp, Homo sapien
ttccttctttctaccatggtatttg

SEQ ID NO: 632199 - DNA, 25 bp, Homo sapien
cttctttctaccatggtatttgtct

SEQ ID NO: 632200 - DNA, 25 bp, Homo sapien
tctaccatggtatttgtctttaaag

SEQ ID NO: 632201 - DNA, 25 bp, Homo sapien
accatggtatttgtctttaaagatt

SEQ ID NO: 632202 - DNA, 25 bp, Homo sapien
ggtgagagggtcagtgaggccagga

SEQ ID NO: 632203 - DNA, 25 bp, Homo sapien
ccaggtgttgtggtccatgccggta

SEQ ID NO: 632204 - DNA, 25 bp, Homo sapien
caggtgttgtggtccatgccggtac

SEQ ID NO: 632205 - DNA, 25 bp, Homo sapien
gtgttgtggtccatgccggtactcc

SEQ ID NO: 632206 - DNA, 25 bp, Homo sapien
gttgtggtccatgccggtactccca

SEQ ID NO: 632207 - DNA, 25 bp, Homo sapien
tggtccatgccggtactcccaggta

SEQ ID NO: 632208 - DNA, 25 bp, Homo sapien
catgccggtactcccaggtacttga

SEQ ID NO: 632209 - DNA, 25 bp, Homo sapien
tttccctacatgtttcccatgcatg

SEQ ID NO: 632210 - DNA, 25 bp, Homo sapien
acatgtttcccatgcatggtttata

SEQ ID NO: 632211 - DNA, 25 bp, Homo sapien
tgtttcccatgcatggtttatattt

SEQ ID NO: 632212 - DNA, 25 bp, Homo sapien
attttacataaatgacactatgctg

SEQ ID NO: 632213 - DNA, 25 bp, Homo sapien
gaaaataactgacatccctgcacct

SEQ ID NO: 632214 - DNA, 25 bp, Homo sapien
cctgcacctaccatcaagacaaaat

SEQ ID NO: 632215 - DNA, 25 bp, Homo sapien
gatatggccaaaatcctattgtcct

SEQ ID NO: 632216 - DNA, 25 bp, Homo sapien
atggccaaaatcctattgtcctgaa

SEQ ID NO: 632217 - DNA, 25 bp, Homo sapien
aaatcctattgtcctgaagccagaa

SEQ ID NO: 632218 - DNA, 25 bp, Homo sapien
tcctgaagccagaagtcattatatg

SEQ ID NO: 632219 - DNA, 25 bp, Homo sapien
ttcttttccctacatgtttcccatg

SEQ ID NO: 632220 - DNA, 25 bp, Homo sapien
ctgagaagatgaagtagcctgtcca

SEQ ID NO: 632221 - DNA, 25 bp, Homo sapien
agaagatgaagtagcctgtccatgg

SEQ ID NO: 632222 - DNA, 25 bp, Homo sapien
gatgaagtagcctgtccatggctag

SEQ ID NO: 632223 - DNA, 25 bp, Homo sapien
aagtagcctgtccatggctaggagc

SEQ ID NO: 632224 - DNA, 25 bp, Homo sapien
tagcctgtccatggctaggagcagt

SEQ ID NO: 632225 - DNA, 25 bp, Homo sapien
atgcctgtgatctccccacattggg

SEQ ID NO: 632226 - DNA, 25 bp, Homo sapien
tgtgatctccccacattgggaggat

SEQ ID NO: 632227 - DNA, 25 bp, Homo sapien
gatctccccacattgggaggatgag

SEQ ID NO: 632228 - DNA, 25 bp, Homo sapien
acccaggaagtcgaaattgtagtgt

SEQ ID NO: 632229 - DNA, 25 bp, Homo sapien
aaattgtagtgtgaactgtgtttac

SEQ ID NO: 632230 - DNA, 25 bp, Homo sapien
aactgtgtttacatcactgtactcc

SEQ ID NO: 632231 - DNA, 25 bp, Homo sapien
aagatggtcggtgtaacgcgcttgt

SEQ ID NO: 632232 - DNA, 25 bp, Homo sapien
gtgtaacgcgcttgtgatgctcaaa

SEQ ID NO: 632233 - DNA, 25 bp, Homo sapien
acgcgcttgtgatgctcaaagagaa

SEQ ID NO: 632234 - DNA, 25 bp, Homo sapien
aagatggtcggtgtcatgcgcttct

SEQ ID NO: 632235 - DNA, 25 bp, Homo sapien
gtgtcatgcgcttctgatgctcaaa

SEQ ID NO: 632236 - DNA, 25 bp, Homo sapien
catgcgcttctgatgctcaaagaga

SEQ ID NO: 632237 - DNA, 25 bp, Homo sapien
atgctcaaagagatcggtgtcacgc

SEQ ID NO: 632238 - DNA, 25 bp, Homo sapien
aaagagatcggtgtcacgcgcatcc

SEQ ID NO: 632239 - DNA, 25 bp, Homo sapien
agatcggtgtcacgcgcatccgtgt

SEQ ID NO: 632240 - DNA, 25 bp, Homo sapien
gcatccgtgtgaagacaccgccaaa

SEQ ID NO: 632241 - DNA, 25 bp, Homo sapien
ggggacagaatctctctatgttgcc

SEQ ID NO: 632242 - DNA, 25 bp, Homo sapien
tacaaaaatttcgctgggcataatg

SEQ ID NO: 632243 - DNA, 25 bp, Homo sapien
acaaaaatttcgctgggcataatgg

SEQ ID NO: 632244 - DNA, 25 bp, Homo sapien
caaaaatttcgctgggcataatggc

SEQ ID NO: 632245 - DNA, 25 bp, Homo sapien
aaaaatttcgctgggcataatggca

SEQ ID NO: 632246 - DNA, 25 bp, Homo sapien
aaaatttcgctgggcataatggcac

SEQ ID NO: 632247 - DNA, 25 bp, Homo sapien
aaatttcgctgggcataatggcacg

SEQ ID NO: 632248 - DNA, 25 bp, Homo sapien
aatttcgctgggcataatggcacgc

SEQ ID NO: 632249 - DNA, 25 bp, Homo sapien
atttcgctgggcataatggcacgca

SEQ ID NO: 632250 - DNA, 25 bp, Homo sapien
tttcgctgggcataatggcacgcac

SEQ ID NO: 632251 - DNA, 25 bp, Homo sapien
gaagactggtaccttctacggttag

SEQ ID NO: 632252 - DNA, 25 bp, Homo sapien
gttagaacattctccatacacaccc

SEQ ID NO: 632253 - DNA, 25 bp, Homo sapien
caccatctcttgctgcataggagga

SEQ ID NO: 632254 - DNA, 25 bp, Homo sapien
gggcacagcaaggtactttgcctgt

SEQ ID NO: 632255 - DNA, 25 bp, Homo sapien
actttgcctgtaccggcaggatgca

SEQ ID NO: 632256 - DNA, 25 bp, Homo sapien
gatgcaccgaccagactgccaagaa

SEQ ID NO: 632257 - DNA, 25 bp, Homo sapien
agaacttcgacccaacggcgaggag

SEQ ID NO: 632258 - DNA, 25 bp, Homo sapien
agtgacgacggcagctgcctttaca

SEQ ID NO: 632259 - DNA, 25 bp, Homo sapien
tttacaccttttaagcatgccaatt

SEQ ID NO: 632260 - DNA, 25 bp, Homo sapien
tttgtacctaagtaccgcatcgcat

SEQ ID NO: 632261 - DNA, 25 bp, Homo sapien
gcatccaagcgattgctgggcatgt

SEQ ID NO: 632262 - DNA, 25 bp, Homo sapien
caagttacagaacctcaaatcctcc

SEQ ID NO: 632263 - DNA, 25 bp, Homo sapien
agttacagaacctcaaatcctccct

SEQ ID NO: 632264 - DNA, 25 bp, Homo sapien
gttacagaacctcaaatcctccctc

SEQ ID NO: 632265 - DNA, 25 bp, Homo sapien
ttacagaacctcaaatcctccctcc

SEQ ID NO: 632266 - DNA, 25 bp, Homo sapien
tctttcctcctttccccaatctgta

SEQ ID NO: 632267 - DNA, 25 bp, Homo sapien
ctcctttccccaatctgtaaagcag

SEQ ID NO: 632268 - DNA, 25 bp, Homo sapien
ccccaatctgtaaagcagaatgata

SEQ ID NO: 632269 - DNA, 25 bp, Homo sapien
cccaatctgtaaagcagaatgatag

SEQ ID NO: 632270 - DNA, 25 bp, Homo sapien
atctgtaaagcagaatgatagtatc

SEQ ID NO: 632271 - DNA, 25 bp, Homo sapien
gtatcttttttatgtatgtaaatca

SEQ ID NO: 632272 - DNA, 25 bp, Homo sapien
gacaatatatgatatgtcatcaata

SEQ ID NO: 632273 - DNA, 25 bp, Homo sapien
agagactggcccatggtcagggctc

SEQ ID NO: 632274 - DNA, 25 bp, Homo sapien
ggtcagggctcaataaggatttgct

SEQ ID NO: 632275 - DNA, 25 bp, Homo sapien
gtttaaactgatgcttcctctcatt

SEQ ID NO: 632276 - DNA, 25 bp, Homo sapien
gatgcttcctctcattatagtaaag

SEQ ID NO: 632277 - DNA, 25 bp, Homo sapien
tagtcaatgaatggtctcagggaat

SEQ ID NO: 632278 - DNA, 25 bp, Homo sapien
cagggaatggcgagtatttgtcaca

SEQ ID NO: 632279 - DNA, 25 bp, Homo sapien
tatttgtcacattgtcccattcccc

SEQ ID NO: 632280 - DNA, 25 bp, Homo sapien
aggcttccccagaactgtcatgaga

SEQ ID NO: 632281 - DNA, 25 bp, Homo sapien
tcatgagagcatcaccttaggcctt

SEQ ID NO: 632282 - DNA, 25 bp, Homo sapien
actcctcacattacatgtaacctgg

SEQ ID NO: 632283 - DNA, 25 bp, Homo sapien
tgtaacctgggccacatcgtttaac

SEQ ID NO: 632284 - DNA, 25 bp, Homo sapien
gactcacctccctgtgaggacatag

SEQ ID NO: 632285 - DNA, 25 bp, Homo sapien
gaggagacacagtctacaggtagac

SEQ ID NO: 632286 - DNA, 25 bp, Homo sapien
gactaggtcgagttcagaagcctga

SEQ ID NO: 632287 - DNA, 25 bp, Homo sapien
gaagcctgaagaacaccagtgttta

SEQ ID NO: 632288 - DNA, 25 bp, Homo sapien
gtggtgactcacactgggaacactt

SEQ ID NO: 632289 - DNA, 25 bp, Homo sapien
actgggaacacttcggcccattgtg

SEQ ID NO: 632290 - DNA, 25 bp, Homo sapien
ttcggcccattgtgtttatgcttat

SEQ ID NO: 632291 - DNA, 25 bp, Homo sapien
gtgtttatgcttatagtttcccaag

SEQ ID NO: 632292 - DNA, 25 bp, Homo sapien
tagtttcccaagtttatcttttcag

SEQ ID NO: 632293 - DNA, 25 bp, Homo sapien
caagtttatcttttcagggttatga

SEQ ID NO: 632294 - DNA, 25 bp, Homo sapien
ttatgattacgttaacctcacctcc

SEQ ID NO: 632295 - DNA, 25 bp, Homo sapien
cgtaacctactctcagaagtgacat

SEQ ID NO: 632296 - DNA, 25 bp, Homo sapien
ctcagaagtgacatcccggctgagt

SEQ ID NO: 632297 - DNA, 25 bp, Homo sapien
tcagaagtgacatcccggctgagtc

SEQ ID NO: 632298 - DNA, 25 bp, Homo sapien
gaagtgacatcccggctgagtctgg

SEQ ID NO: 632299 - DNA, 25 bp, Homo sapien
aagtgacatcccggctgagtctggt

SEQ ID NO: 632300 - DNA, 25 bp, Homo sapien
agtgacatcccggctgagtctggtg

SEQ ID NO: 632301 - DNA, 25 bp, Homo sapien
gtgacatcccggctgagtctggtgg

SEQ ID NO: 632302 - DNA, 25 bp, Homo sapien
tgacatcccggctgagtctggtggc

SEQ ID NO: 632303 - DNA, 25 bp, Homo sapien
gacatcccggctgagtctggtggct

SEQ ID NO: 632304 - DNA, 25 bp, Homo sapien
atatgttaggcacccattttcagag

SEQ ID NO: 632305 - DNA, 25 bp, Homo sapien
ttaggcacccattttcagagaaaga

SEQ ID NO: 632306 - DNA, 25 bp, Homo sapien
tatgaccttttgaattgatgagaca

SEQ ID NO: 632307 - DNA, 25 bp, Homo sapien
aacaatggtcaatattttgaaactc

SEQ ID NO: 632308 - DNA, 25 bp, Homo sapien
gaaactctttggaagttaccatcca

SEQ ID NO: 632309 - DNA, 25 bp, Homo sapien
tggaagttaccatccaagtttttct

SEQ ID NO: 632310 - DNA, 25 bp, Homo sapien
tctccaatacttgtacatttctttt

SEQ ID NO: 632311 - DNA, 25 bp, Homo sapien
tgtacatttcttttctcaggtaaat

SEQ ID NO: 632312 - DNA, 25 bp, Homo sapien
gagataaacaatagctgagtccaga

SEQ ID NO: 632313 - DNA, 25 bp, Homo sapien
aacaatagctgagtccagatttttt

SEQ ID NO: 632314 - DNA, 25 bp, Homo sapien
atcagtctttatatgttaggcaccc

SEQ ID NO: 632315 - DNA, 25 bp, Homo sapien
gagaagatgaagtagcctgtccatg

SEQ ID NO: 632316 - DNA, 25 bp, Homo sapien
tgaagtagcctgtccatggctagga

SEQ ID NO: 632317 - DNA, 25 bp, Homo sapien
tagcctgtccatggctaggagcagt

SEQ ID NO: 632318 - DNA, 25 bp, Homo sapien
tggctaggagcagtcactcatgcct

SEQ ID NO: 632319 - DNA, 25 bp, Homo sapien
atgcctgtgatctccccacattggg

SEQ ID NO: 632320 - DNA, 25 bp, Homo sapien
tgtgatctccccacattgggaggat

SEQ ID NO: 632321 - DNA, 25 bp, Homo sapien
gatctccccacattgggaggatgag

SEQ ID NO: 632322 - DNA, 25 bp, Homo sapien
acccaggaagtcgaaattgtagtgt

SEQ ID NO: 632323 - DNA, 25 bp, Homo sapien
aaattgtagtgtgaactgtgtttac

SEQ ID NO: 632324 - DNA, 25 bp, Homo sapien
aactgtgtttacatcactgtactcc

SEQ ID NO: 632325 - DNA, 25 bp, Homo sapien
gtgtttacatcactgtactccaacc

SEQ ID NO: 632326 - DNA, 25 bp, Homo sapien
caaagtaatcattaagctgaaggta

SEQ ID NO: 632327 - DNA, 25 bp, Homo sapien
aacaagttcaaggaagtcacaccat

SEQ ID NO: 632328 - DNA, 25 bp, Homo sapien
aagttcaaggaagtcacaccatggg

SEQ ID NO: 632329 - DNA, 25 bp, Homo sapien
aaaagtcaagtttagggctgcctct

SEQ ID NO: 632330 - DNA, 25 bp, Homo sapien
aagtcaagtttagggctgcctcttc

SEQ ID NO: 632331 - DNA, 25 bp, Homo sapien
ctcttccgggaagtgtcaaatcttt

SEQ ID NO: 632332 - DNA, 25 bp, Homo sapien
aggaataaaggtgccaaaccttatg

SEQ ID NO: 632333 - DNA, 25 bp, Homo sapien
ttcatcggttagattaccagtttca

SEQ ID NO: 632334 - DNA, 25 bp, Homo sapien
agattaccagtttcattttccttat

SEQ ID NO: 632335 - DNA, 25 bp, Homo sapien
gtttcattttccttattgactcaag

SEQ ID NO: 632336 - DNA, 25 bp, Homo sapien
cattttccttattgactcaagaggg

SEQ ID NO: 632337 - DNA, 25 bp, Homo sapien
ataatgcttttaaccagttgaatgt

SEQ ID NO: 632338 - DNA, 25 bp, Homo sapien
aatgcttttaaccagttgaatgttg

SEQ ID NO: 632339 - DNA, 25 bp, Homo sapien
accagttgaatgttgccttctctaa

SEQ ID NO: 632340 - DNA, 25 bp, Homo sapien
tgaatgttgccttctctaatactac

SEQ ID NO: 632341 - DNA, 25 bp, Homo sapien
ccaaatcgcctctctgttgaaaact

SEQ ID NO: 632342 - DNA, 25 bp, Homo sapien
aaatcgcctctctgttgaaaactgt

SEQ ID NO: 632343 - DNA, 25 bp, Homo sapien
atcgcctctctgttgaaaactgttt

SEQ ID NO: 632344 - DNA, 25 bp, Homo sapien
cgcctctctgttgaaaactgtttta

SEQ ID NO: 632345 - DNA, 25 bp, Homo sapien
tgaaaactgttttatcactcaataa

SEQ ID NO: 632346 - DNA, 25 bp, Homo sapien
ccccacctattgtatcactcaataa

SEQ ID NO: 632347 - DNA, 25 bp, Homo sapien
ttgtatcactcaataaaatctccac

SEQ ID NO: 632348 - DNA, 25 bp, Homo sapien
gaaggtccagcattctgggtaccag

SEQ ID NO: 632349 - DNA, 25 bp, Homo sapien
gctgcccctgacaaggattaagtgc

SEQ ID NO: 632350 - DNA, 25 bp, Homo sapien
aagtgcatccttatttattggaatg

SEQ ID NO: 632351 - DNA, 25 bp, Homo sapien
ctgatgaaaactgaggcagcagcct

SEQ ID NO: 632352 - DNA, 25 bp, Homo sapien
gcagggtgcctgtactttggcgaaa

SEQ ID NO: 632353 - DNA, 25 bp, Homo sapien
cctccttatggaatactgtgtagca

SEQ ID NO: 632354 - DNA, 25 bp, Homo sapien
tactgtgtagcagaagggctctcat

SEQ ID NO: 632355 - DNA, 25 bp, Homo sapien
gggctctcataaaactgttgcggtg

SEQ ID NO: 632356 - DNA, 25 bp, Homo sapien
gttgcggtggcagcatgactccaaa

SEQ ID NO: 632357 - DNA, 25 bp, Homo sapien
ggtctttaaaatattccctacacat

SEQ ID NO: 632358 - DNA, 25 bp, Homo sapien
attccctacacatgaccaatacatt

SEQ ID NO: 632359 - DNA, 25 bp, Homo sapien
gcatggtggcaggcgacttaatccc

SEQ ID NO: 632360 - DNA, 25 bp, Homo sapien
gagatcgagccgttgcactcaaacc

SEQ ID NO: 632361 - DNA, 25 bp, Homo sapien
atcgagccgttgcactcaaacctgg

SEQ ID NO: 632362 - DNA, 25 bp, Homo sapien
agccgttgcactcaaacctggggga

SEQ ID NO: 632363 - DNA, 25 bp, Homo sapien
gttgcactcaaacctgggggataag

SEQ ID NO: 632364 - DNA, 25 bp, Homo sapien
tgatgaaattactggtccaggcgca

SEQ ID NO: 632365 - DNA, 25 bp, Homo sapien
gatgaaattactggtccaggcgcag

SEQ ID NO: 632366 - DNA, 25 bp, Homo sapien
atgaaattactggtccaggcgcagt

SEQ ID NO: 632367 - DNA, 25 bp, Homo sapien
tgaaattactggtccaggcgcagtg

SEQ ID NO: 632368 - DNA, 25 bp, Homo sapien
aaattactggtccaggcgcagtggc

SEQ ID NO: 632369 - DNA, 25 bp, Homo sapien
aattactggtccaggcgcagtggct

SEQ ID NO: 632370 - DNA, 25 bp, Homo sapien
aacagtgcacttcattgaggtgtga

SEQ ID NO: 632371 - DNA, 25 bp, Homo sapien
gaggtgtgatataattgcttcagga

SEQ ID NO: 632372 - DNA, 25 bp, Homo sapien
gatataattgcttcaggagagagtt

SEQ ID NO: 632373 - DNA, 25 bp, Homo sapien
atgctaatctcacgaatggccctgt

SEQ ID NO: 632374 - DNA, 25 bp, Homo sapien
gaatggccctgttccgccagtggga

SEQ ID NO: 632375 - DNA, 25 bp, Homo sapien
tcttttgctcccgtgtccatggaaa

SEQ ID NO: 632376 - DNA, 25 bp, Homo sapien
gtgtccatggaaagctcccctttct

SEQ ID NO: 632377 - DNA, 25 bp, Homo sapien
agctcccctttctccttgcatggtt

SEQ ID NO: 632378 - DNA, 25 bp, Homo sapien
aaactggcttcccttgtgtatctgc

SEQ ID NO: 632379 - DNA, 25 bp, Homo sapien
gggcacaaaagaccatgtcttcatt

SEQ ID NO: 632380 - DNA, 25 bp, Homo sapien
atttcagcacaaaacagtgcacttc

SEQ ID NO: 632381 - DNA, 25 bp, Homo sapien
aaggccgcttaggaacatctgatta

SEQ ID NO: 632382 - DNA, 25 bp, Homo sapien
tatcagcaagtcttgggaaccactg

SEQ ID NO: 632383 - DNA, 25 bp, Homo sapien
gaaccactgataatacaacgcgccc

SEQ ID NO: 632384 - DNA, 25 bp, Homo sapien
gaatgcttcccaacaaggtctctaa

SEQ ID NO: 632385 - DNA, 25 bp, Homo sapien
aggtctctaaatgcttcttccaaag

SEQ ID NO: 632386 - DNA, 25 bp, Homo sapien
gagattcagctcaaatgctctgaca

SEQ ID NO: 632387 - DNA, 25 bp, Homo sapien
gacacagactgtcctaaactggtat

SEQ ID NO: 632388 - DNA, 25 bp, Homo sapien
taaactggtatcatcccagcctgtg

SEQ ID NO: 632389 - DNA, 25 bp, Homo sapien
gagccaatctggagaactcgagcaa

SEQ ID NO: 632390 - DNA, 25 bp, Homo sapien
tcgagcaaaggccttctgaccaaga

SEQ ID NO: 632391 - DNA, 25 bp, Homo sapien
gaatctgaacttttaaaggccgctt

SEQ ID NO: 632392 - DNA, 25 bp, Homo sapien
atcgcttagccccaggaggtagagg

SEQ ID NO: 632393 - DNA, 25 bp, Homo sapien
ttgcagtgaaccgtgactgtaccac

SEQ ID NO: 632394 - DNA, 25 bp, Homo sapien
gaaggtgggtggattgtatgagctc

SEQ ID NO: 632395 - DNA, 25 bp, Homo sapien
acaaaaatttcgctgggcataatgg

SEQ ID NO: 632396 - DNA, 25 bp, Homo sapien
caaaaatttcgctgggcataatggc

SEQ ID NO: 632397 - DNA, 25 bp, Homo sapien
aaaaatttcgctgggcataatggca

SEQ ID NO: 632398 - DNA, 25 bp, Homo sapien
aaaatttcgctgggcataatggcac

SEQ ID NO: 632399 - DNA, 25 bp, Homo sapien
aaatttcgctgggcataatggcacg

SEQ ID NO: 632400 - DNA, 25 bp, Homo sapien
atttcgctgggcataatggcacgca

SEQ ID NO: 632401 - DNA, 25 bp, Homo sapien
tttcgctgggcataatggcacgcac

SEQ ID NO: 632402 - DNA, 25 bp, Homo sapien
ttcgctgggcataatggcacgcacc

SEQ ID NO: 632403 - DNA, 25 bp, Homo sapien
ttccttctttctaccatggtatttg

SEQ ID NO: 632404 - DNA, 25 bp, Homo sapien
cttctttctaccatggtatttgtct

SEQ ID NO: 632405 - DNA, 25 bp, Homo sapien
tctaccatggtatttgtctttaaag

SEQ ID NO: 632406 - DNA, 25 bp, Homo sapien
accatggtatttgtctttaaagatt

SEQ ID NO: 632407 - DNA, 25 bp, Homo sapien
ggtgagagggtcagtgaggccagga

SEQ ID NO: 632408 - DNA, 25 bp, Homo sapien
catagtgggaccttgcctttacaaa

SEQ ID NO: 632409 - DNA, 25 bp, Homo sapien
ccaggtgttgtggtccatgccggta

SEQ ID NO: 632410 - DNA, 25 bp, Homo sapien
caggtgttgtggtccatgccggtac

SEQ ID NO: 632411 - DNA, 25 bp, Homo sapien
gtgttgtggtccatgccggtactcc

SEQ ID NO: 632412 - DNA, 25 bp, Homo sapien
tggtccatgccggtactcccaggta

SEQ ID NO: 632413 - DNA, 25 bp, Homo sapien
catgccggtactcccaggtacttga

SEQ ID NO: 632414 - DNA, 25 bp, Homo sapien
gaaatagaataatacctactcatgg

SEQ ID NO: 632415 - DNA, 25 bp, Homo sapien
tagaataatacctactcatggcctg

SEQ ID NO: 632416 - DNA, 25 bp, Homo sapien
agaataatacctactcatggcctga

SEQ ID NO: 632417 - DNA, 25 bp, Homo sapien
gaataatacctactcatggcctgac

SEQ ID NO: 632418 - DNA, 25 bp, Homo sapien
aataatacctactcatggcctgacg

SEQ ID NO: 632419 - DNA, 25 bp, Homo sapien
ataatacctactcatggcctgacgc

SEQ ID NO: 632420 - DNA, 25 bp, Homo sapien
taatacctactcatggcctgacgcg

SEQ ID NO: 632421 - DNA, 25 bp, Homo sapien
cctactcatggcctgacgcggtggc

SEQ ID NO: 632422 - DNA, 25 bp, Homo sapien
ctactcatggcctgacgcggtggct

SEQ ID NO: 632423 - DNA, 25 bp, Homo sapien
tactcatggcctgacgcggtggctc

SEQ ID NO: 632424 - DNA, 25 bp, Homo sapien
gcagttaaccaggatcgcgccattg

SEQ ID NO: 632425 - DNA, 25 bp, Homo sapien
tgacccgagatcaggccactgttct

SEQ ID NO: 632426 - DNA, 25 bp, Homo sapien
gacccgagatcaggccactgttctc

SEQ ID NO: 632427 - DNA, 25 bp, Homo sapien
acccgagatcaggccactgttctcc

SEQ ID NO: 632428 - DNA, 25 bp, Homo sapien
cccgagatcaggccactgttctcca

SEQ ID NO: 632429 - DNA, 25 bp, Homo sapien
ggtggcaggtgcctggctacttggg

SEQ ID NO: 632430 - DNA, 25 bp, Homo sapien
gtggcaggtgcctggctacttggga

SEQ ID NO: 632431 - DNA, 25 bp, Homo sapien
tggcaggtgcctggctacttgggag

SEQ ID NO: 632432 - DNA, 25 bp, Homo sapien
aatcgctcgaacccgagagtggagg

SEQ ID NO: 632433 - DNA, 25 bp, Homo sapien
tcgctcgaacccgagagtggaggtt

SEQ ID NO: 632434 - DNA, 25 bp, Homo sapien
gctcgaacccgagagtggaggttgc

SEQ ID NO: 632435 - DNA, 25 bp, Homo sapien
gctaagatcgcactattgcactcta

SEQ ID NO: 632436 - DNA, 25 bp, Homo sapien
ccctgagcccatctacaatagcgag

SEQ ID NO: 632437 - DNA, 25 bp, Homo sapien
ggaagcggcttaacacccgagagtt

SEQ ID NO: 632438 - DNA, 25 bp, Homo sapien
ccgagagttccgcacccgcaaaaag

SEQ ID NO: 632439 - DNA, 25 bp, Homo sapien
gaagaggagcggcacaacctcatca

SEQ ID NO: 632440 - DNA, 25 bp, Homo sapien
agcggcacaacctcatcacagagat

SEQ ID NO: 632441 - DNA, 25 bp, Homo sapien
agagatggttgcactcaatccggat

SEQ ID NO: 632442 - DNA, 25 bp, Homo sapien
ggttgcactcaatccggatttcaag

SEQ ID NO: 632443 - DNA, 25 bp, Homo sapien
ggatttcaagccacctgcagattac

SEQ ID NO: 632444 - DNA, 25 bp, Homo sapien
caagccacctgcagattacaaacct

SEQ ID NO: 632445 - DNA, 25 bp, Homo sapien
agattacaaacctccagcaacacgt

SEQ ID NO: 632446 - DNA, 25 bp, Homo sapien
aacctccagcaacacgtgtgagtga

SEQ ID NO: 632447 - DNA, 25 bp, Homo sapien
gttcctccgaagagtgttgtattaa

SEQ ID NO: 632448 - DNA, 25 bp, Homo sapien
ctccgaagagtgttgtattaaggtc

SEQ ID NO: 632449 - DNA, 25 bp, Homo sapien
gtgttgtattaaggtctgagaggca

SEQ ID NO: 632450 - DNA, 25 bp, Homo sapien
ggctgggaaagacttgttatagtcc

SEQ ID NO: 632451 - DNA, 25 bp, Homo sapien
agacttgttatagtccgtgtgggaa

SEQ ID NO: 632452 - DNA, 25 bp, Homo sapien
ttatagtccgtgtgggaatgagaga

SEQ ID NO: 632453 - DNA, 25 bp, Homo sapien
gaatgagagaagtcggtgcagaata

SEQ ID NO: 632454 - DNA, 25 bp, Homo sapien
aagtcggtgcagaatagtaaacgga

SEQ ID NO: 632455 - DNA, 25 bp, Homo sapien
agtaaacggagtctgtttcccacag

SEQ ID NO: 632456 - DNA, 25 bp, Homo sapien
taaacggagtctgtttcccacaggt

SEQ ID NO: 632457 - DNA, 25 bp, Homo sapien
gagtctgtttcccacaggtcccctt

SEQ ID NO: 632458 - DNA, 25 bp, Homo sapien
aagaatacaatagttagcttggcgt

SEQ ID NO: 632459 - DNA, 25 bp, Homo sapien
agaatacaatagttagcttggcgtg

SEQ ID NO: 632460 - DNA, 25 bp, Homo sapien
gaatacaatagttagcttggcgtgg

SEQ ID NO: 632461 - DNA, 25 bp, Homo sapien
acagggctgggctgagtggctcgcg

SEQ ID NO: 632462 - DNA, 25 bp, Homo sapien
tgggctgagtggctcgcgcctgcga

SEQ ID NO: 632463 - DNA, 25 bp, Homo sapien
gggctgagtggctcgcgcctgcgat

SEQ ID NO: 632464 - DNA, 25 bp, Homo sapien
tcgcgcctgcgatcccgacagtttg

SEQ ID NO: 632465 - DNA, 25 bp, Homo sapien
cgcgcctgcgatcccgacagtttgg

SEQ ID NO: 632466 - DNA, 25 bp, Homo sapien
gcctgcgatcccgacagtttgggag

SEQ ID NO: 632467 - DNA, 25 bp, Homo sapien
cctgcgatcccgacagtttgggagg

SEQ ID NO: 632468 - DNA, 25 bp, Homo sapien
tgcgatcccgacagtttgggaggcc

SEQ ID NO: 632469 - DNA, 25 bp, Homo sapien
tgagaagtgcccctgggccgggcgc

SEQ ID NO: 632470 - DNA, 25 bp, Homo sapien
gagaagtgcccctgggccgggcgcg

SEQ ID NO: 632471 - DNA, 25 bp, Homo sapien
agaagtgcccctgggccgggcgcgg

SEQ ID NO: 632472 - DNA, 25 bp, Homo sapien
gaagtgcccctgggccgggcgcggt

SEQ ID NO: 632473 - DNA, 25 bp, Homo sapien
tggcaggcgcctctagtactagcta

SEQ ID NO: 632474 - DNA, 25 bp, Homo sapien
ggcaggcgcctctagtactagctac

SEQ ID NO: 632475 - DNA, 25 bp, Homo sapien
gcaggcgcctctagtactagctact

SEQ ID NO: 632476 - DNA, 25 bp, Homo sapien
caggcgcctctagtactagctactc

SEQ ID NO: 632477 - DNA, 25 bp, Homo sapien
aggcgcctctagtactagctactcg

SEQ ID NO: 632478 - DNA, 25 bp, Homo sapien
ggcgcctctagtactagctactcgg

SEQ ID NO: 632479 - DNA, 25 bp, Homo sapien
gcgcctctagtactagctactcggg

SEQ ID NO: 632480 - DNA, 25 bp, Homo sapien
tatcggaaaatgtttggagatttgc

SEQ ID NO: 632481 - DNA, 25 bp, Homo sapien
tttggagatttgcaacactgaaaaa

SEQ ID NO: 632482 - DNA, 25 bp, Homo sapien
aaaacagaaaaatcgcataacctat

SEQ ID NO: 632483 - DNA, 25 bp, Homo sapien
agttgatctcgtagaactagattgt

SEQ ID NO: 632484 - DNA, 25 bp, Homo sapien
gttggtcagaggatacagtttcagc

SEQ ID NO: 632485 - DNA, 25 bp, Homo sapien
gaggatacagtttcagctggataga

SEQ ID NO: 632486 - DNA, 25 bp, Homo sapien
gtttcagctggatagaataagttct

SEQ ID NO: 632487 - DNA, 25 bp, Homo sapien
caattgtgaaacgtgatgactataa

SEQ ID NO: 632488 - DNA, 25 bp, Homo sapien
tgactataataatacagttgaccct

SEQ ID NO: 632489 - DNA, 25 bp, Homo sapien
ttttaactgggtggcgacattatac

SEQ ID NO: 632490 - DNA, 25 bp, Homo sapien
ctgggtggcgacattatacatgaat

SEQ ID NO: 632491 - DNA, 25 bp, Homo sapien
aaagttagacctgattttacactga

SEQ ID NO: 632492 - DNA, 25 bp, Homo sapien
agacctgattttacactgaagacta

SEQ ID NO: 632493 - DNA, 25 bp, Homo sapien
tttacactgaagactagaggtagtt

SEQ ID NO: 632494 - DNA, 25 bp, Homo sapien
gaggtagttactatcctattactgt

SEQ ID NO: 632495 - DNA, 25 bp, Homo sapien
gttactatcctattactgtacttag

SEQ ID NO: 632496 - DNA, 25 bp, Homo sapien
actgtacttagttggctatgctggc

SEQ ID NO: 632497 - DNA, 25 bp, Homo sapien
acttagttggctatgctggcatgtc

SEQ ID NO: 632498 - DNA, 25 bp, Homo sapien
atgctggcatgtcattatgggtaaa

SEQ ID NO: 632499 - DNA, 25 bp, Homo sapien
taacacacataacaagtctatgatc

SEQ ID NO: 632500 - DNA, 25 bp, Homo sapien
gtctatgatcattttgcatttctgt

SEQ ID NO: 632501 - DNA, 25 bp, Homo sapien
atagttctgcaatatttcatgtata

SEQ ID NO: 632502 - DNA, 25 bp, Homo sapien
aggtgggcatgattgcgtcagccca

SEQ ID NO: 632503 - DNA, 25 bp, Homo sapien
ggtgggcatgattgcgtcagcccag

SEQ ID NO: 632504 - DNA, 25 bp, Homo sapien
gtgggcatgattgcgtcagcccagg

SEQ ID NO: 632505 - DNA, 25 bp, Homo sapien
ggcatgattgcgtcagcccaggagt

SEQ ID NO: 632506 - DNA, 25 bp, Homo sapien
gcatgattgcgtcagcccaggagtt

SEQ ID NO: 632507 - DNA, 25 bp, Homo sapien
catgattgcgtcagcccaggagttt

SEQ ID NO: 632508 - DNA, 25 bp, Homo sapien
atgattgcgtcagcccaggagttta

SEQ ID NO: 632509 - DNA, 25 bp, Homo sapien
tgattgcgtcagcccaggagtttaa

SEQ ID NO: 632510 - DNA, 25 bp, Homo sapien
gagaatcacctgagtctggggaggc

SEQ ID NO: 632511 - DNA, 25 bp, Homo sapien
gaggctgaggctgcatgagccgaga

SEQ ID NO: 632512 - DNA, 25 bp, Homo sapien
aggctgaggctgcatgagccgagat

SEQ ID NO: 632513 - DNA, 25 bp, Homo sapien
ataatgcttttaaccagttgaatgt

SEQ ID NO: 632514 - DNA, 25 bp, Homo sapien
aatgcttttaaccagttgaatgttg

SEQ ID NO: 632515 - DNA, 25 bp, Homo sapien
ccccaaatcgcctctctgttgaaaa

SEQ ID NO: 632516 - DNA, 25 bp, Homo sapien
ccaaatcgcctctctgttgaaaact

SEQ ID NO: 632517 - DNA, 25 bp, Homo sapien
aaatcgcctctctgttgaaaactgt

SEQ ID NO: 632518 - DNA, 25 bp, Homo sapien
aatcgcctctctgttgaaaactgtt

SEQ ID NO: 632519 - DNA, 25 bp, Homo sapien
atcgcctctctgttgaaaactgttt

SEQ ID NO: 632520 - DNA, 25 bp, Homo sapien
tcgcctctctgttgaaaactgtttt

SEQ ID NO: 632521 - DNA, 25 bp, Homo sapien
cgcctctctgttgaaaactgtttta

SEQ ID NO: 632522 - DNA, 25 bp, Homo sapien
ccccacctattgtatcactcaataa

SEQ ID NO: 632523 - DNA, 25 bp, Homo sapien
ttgtatcactcaataaaatctccac

SEQ ID NO: 632524 - DNA, 25 bp, Homo sapien
gtatgtttatacttttatgctttgg

SEQ ID NO: 632525 - DNA, 25 bp, Homo sapien
tttatacttttatgctttggtttca

SEQ ID NO: 632526 - DNA, 25 bp, Homo sapien
gctttggtttcattttctacttatt

SEQ ID NO: 632527 - DNA, 25 bp, Homo sapien
aacattactgtgtttctatagagag

SEQ ID NO: 632528 - DNA, 25 bp, Homo sapien
gtgtttctatagagagttctgctgt

SEQ ID NO: 632529 - DNA, 25 bp, Homo sapien
gagagttctgctgtaatgcagtgat

SEQ ID NO: 632530 - DNA, 25 bp, Homo sapien
tgcagtgattatgaaatgatctcaa

SEQ ID NO: 632531 - DNA, 25 bp, Homo sapien
taattcttccccaaatcacattaaa

SEQ ID NO: 632532 - DNA, 25 bp, Homo sapien
tcacattaaaacgatccttttgcac

SEQ ID NO: 632533 - DNA, 25 bp, Homo sapien
tataacaacgaaagttcttaaactg

SEQ ID NO: 632534 - DNA, 25 bp, Homo sapien
aactggtccccttaataccattgtg

SEQ ID NO: 632535 - DNA, 25 bp, Homo sapien
gcattcatccattcaagacatttta

SEQ ID NO: 632536 - DNA, 25 bp, Homo sapien
agacattttaattgaactcttacaa

SEQ ID NO: 632537 - DNA, 25 bp, Homo sapien
aattgaactcttacaatgttcttaa

SEQ ID NO: 632538 - DNA, 25 bp, Homo sapien
gttcttaatactatgataagccctg

SEQ ID NO: 632539 - DNA, 25 bp, Homo sapien
agccctgaaggtaaactgtgactaa

SEQ ID NO: 632540 - DNA, 25 bp, Homo sapien
gaaggtaaactgtgactaaaaatgt

SEQ ID NO: 632541 - DNA, 25 bp, Homo sapien
aatgttgcaggataaaatacaggat

SEQ ID NO: 632542 - DNA, 25 bp, Homo sapien
gataaacaacattcttatactaaaa

SEQ ID NO: 632543 - DNA, 25 bp, Homo sapien
taaaaattattccatgtttatctga

SEQ ID NO: 632544 - DNA, 25 bp, Homo sapien
ttacttgtttgtctgtgataaatat

SEQ ID NO: 632545 - DNA, 25 bp, Homo sapien
gataaatatggcagccctagtaaaa

SEQ ID NO: 632546 - DNA, 25 bp, Homo sapien
aataactaattagggctgagctcgg

SEQ ID NO: 632547 - DNA, 25 bp, Homo sapien
gtggtgcgcacttgtagttctccta

SEQ ID NO: 632548 - DNA, 25 bp, Homo sapien
tggtgcgcacttgtagttctcctac

SEQ ID NO: 632549 - DNA, 25 bp, Homo sapien
ggtgcgcacttgtagttctcctact

SEQ ID NO: 632550 - DNA, 25 bp, Homo sapien
tgcgcacttgtagttctcctactta

SEQ ID NO: 632551 - DNA, 25 bp, Homo sapien
gcgcacttgtagttctcctacttag

SEQ ID NO: 632552 - DNA, 25 bp, Homo sapien
gcacttgtagttctcctacttagga

SEQ ID NO: 632553 - DNA, 25 bp, Homo sapien
cacttgtagttctcctacttaggag

SEQ ID NO: 632554 - DNA, 25 bp, Homo sapien
agctgtgaatcataccactgtggta

SEQ ID NO: 632555 - DNA, 25 bp, Homo sapien
gctgtgaatcataccactgtggtac

SEQ ID NO: 632556 - DNA, 25 bp, Homo sapien
tgaatcataccactgtggtacagcc

SEQ ID NO: 632557 - DNA, 25 bp, Homo sapien
gcagctgtctgcaggaatctttctg

SEQ ID NO: 632558 - DNA, 25 bp, Homo sapien
agctgtctgcaggaatctttctgtc

SEQ ID NO: 632559 - DNA, 25 bp, Homo sapien
gtctgcaggaatctttctgtcttta

SEQ ID NO: 632560 - DNA, 25 bp, Homo sapien
tctttctgtctttagcacaattcca

SEQ ID NO: 632561 - DNA, 25 bp, Homo sapien
gtctttagcacaattccaacaacat

SEQ ID NO: 632562 - DNA, 25 bp, Homo sapien
agcacaattccaacaacattaacag

SEQ ID NO: 632563 - DNA, 25 bp, Homo sapien
aacaacattaacagctccccgaatg

SEQ ID NO: 632564 - DNA, 25 bp, Homo sapien
acattaacagctccccgaatgaagg

SEQ ID NO: 632565 - DNA, 25 bp, Homo sapien
acagctccccgaatgaaggaggctg

SEQ ID NO: 632566 - DNA, 25 bp, Homo sapien
gaatccatcagcgaactagtcaacc

SEQ ID NO: 632567 - DNA, 25 bp, Homo sapien
atcagcgaactagtcaaccccatct

SEQ ID NO: 632568 - DNA, 25 bp, Homo sapien
aacaagtttgagactatggttaggt

SEQ ID NO: 632569 - DNA, 25 bp, Homo sapien
ggaaggcaggctcagcacccaagcc

SEQ ID NO: 632570 - DNA, 25 bp, Homo sapien
atcccaggcactcaggtggagcagg

SEQ ID NO: 632571 - DNA, 25 bp, Homo sapien
gagcaggtggtctgtcctagagaac

SEQ ID NO: 632572 - DNA, 25 bp, Homo sapien
ggtctgtcctagagaacgttccatg

SEQ ID NO: 632573 - DNA, 25 bp, Homo sapien
agaacgttccatgtggatttgagaa

SEQ ID NO: 632574 - DNA, 25 bp, Homo sapien
tctcatgttggatgcagtgctgtgc

SEQ ID NO: 632575 - DNA, 25 bp, Homo sapien
cagtgctgtgcatatgtttgttagg

SEQ ID NO: 632576 - DNA, 25 bp, Homo sapien
tgttgttgttcatgttttctatttt

SEQ ID NO: 632577 - DNA, 25 bp, Homo sapien
taagtgaagcattaaagtctccaac

SEQ ID NO: 632578 - DNA, 25 bp, Homo sapien
attaaagtctccaactattactgtt

SEQ ID NO: 632579 - DNA, 25 bp, Homo sapien
tacctgtggtcccaggctaagatgg

SEQ ID NO: 632580 - DNA, 25 bp, Homo sapien
cccaggctaagatgggacgattgct

SEQ ID NO: 632581 - DNA, 25 bp, Homo sapien
aggtcaaggcctcagtcatgccact

SEQ ID NO: 632582 - DNA, 25 bp, Homo sapien
aaggcctcagtcatgccactgcttg

SEQ ID NO: 632583 - DNA, 25 bp, Homo sapien
ctcagtcatgccactgcttgagtga

SEQ ID NO: 632584 - DNA, 25 bp, Homo sapien
agtcatgccactgcttgagtgacag

SEQ ID NO: 632585 - DNA, 25 bp, Homo sapien
ttggacatgattgaacacaaatggg

SEQ ID NO: 632586 - DNA, 25 bp, Homo sapien
ttgaacacaaatgggaagagtacag

SEQ ID NO: 632587 - DNA, 25 bp, Homo sapien
agagtacagaaacaagagtggacca

SEQ ID NO: 632588 - DNA, 25 bp, Homo sapien
agtggaccaggctcatatgtgtaat

SEQ ID NO: 632589 - DNA, 25 bp, Homo sapien
gaccaggctcatatgtgtaatccca

SEQ ID NO: 632590 - DNA, 25 bp, Homo sapien
aggatactcaggctcaggtttgtgt

SEQ ID NO: 632591 - DNA, 25 bp, Homo sapien
tactcaggctcaggtttgtgtgggt

SEQ ID NO: 632592 - DNA, 25 bp, Homo sapien
gggtggaaaacatggtcttcagaaa

SEQ ID NO: 632593 - DNA, 25 bp, Homo sapien
atgagtgcaagacaggaggaaatcc

SEQ ID NO: 632594 - DNA, 25 bp, Homo sapien
gaggaaatccatcagaggccccagc

SEQ ID NO: 632595 - DNA, 25 bp, Homo sapien
gctgaggactgaccacggcttgtta

SEQ ID NO: 632596 - DNA, 25 bp, Homo sapien
gaccacggcttgttatttctcttgc

SEQ ID NO: 632597 - DNA, 25 bp, Homo sapien
agagcctgcaatccttgctttgtga

SEQ ID NO: 632598 - DNA, 25 bp, Homo sapien
gtgagtttatagctcagtccagaga

SEQ ID NO: 632599 - DNA, 25 bp, Homo sapien
agctcagtccagagaatggctaaga

SEQ ID NO: 632600 - DNA, 25 bp, Homo sapien
tttaggattctttcaacacccactc

SEQ ID NO: 632601 - DNA, 25 bp, Homo sapien
aaattaaaagtaaagccaggcgcag

SEQ ID NO: 632602 - DNA, 25 bp, Homo sapien
aattaaaagtaaagccaggcgcagt

SEQ ID NO: 632603 - DNA, 25 bp, Homo sapien
attaaaagtaaagccaggcgcagtg

SEQ ID NO: 632604 - DNA, 25 bp, Homo sapien
ttaaaagtaaagccaggcgcagtgg

SEQ ID NO: 632605 - DNA, 25 bp, Homo sapien
ctgggaggcggatgttgcggtgagt

SEQ ID NO: 632606 - DNA, 25 bp, Homo sapien
tgggaggcggatgttgcggtgagtg

SEQ ID NO: 632607 - DNA, 25 bp, Homo sapien
gggaggcggatgttgcggtgagtgg

SEQ ID NO: 632608 - DNA, 25 bp, Homo sapien
ggaggcggatgttgcggtgagtgga

SEQ ID NO: 632609 - DNA, 25 bp, Homo sapien
gaggcggatgttgcggtgagtggag

SEQ ID NO: 632610 - DNA, 25 bp, Homo sapien
aggcggatgttgcggtgagtggaga

SEQ ID NO: 632611 - DNA, 25 bp, Homo sapien
atgttcacctgtgttgtgcgtttta

SEQ ID NO: 632612 - DNA, 25 bp, Homo sapien
gtgttgtgcgttttaatttctgtta

SEQ ID NO: 632613 - DNA, 25 bp, Homo sapien
gttttaatttctgttattatctgcc

SEQ ID NO: 632614 - DNA, 25 bp, Homo sapien
tctttcctagagctttgacttgaag

SEQ ID NO: 632615 - DNA, 25 bp, Homo sapien
gagctttgacttgaagcttgacatt

SEQ ID NO: 632616 - DNA, 25 bp, Homo sapien
gaagcttgacattgagtttcagaca

SEQ ID NO: 632617 - DNA, 25 bp, Homo sapien
gtttgcgtggactccttatcgtaat

SEQ ID NO: 632618 - DNA, 25 bp, Homo sapien
gactccttatcgtaatccaaatgct

SEQ ID NO: 632619 - DNA, 25 bp, Homo sapien
ttatcgtaatccaaatgctaaggtg

SEQ ID NO: 632620 - DNA, 25 bp, Homo sapien
aagggtgtcttgtgacatggccaga

SEQ ID NO: 632621 - DNA, 25 bp, Homo sapien
gtcttgtgacatggccagataactg

SEQ ID NO: 632622 - DNA, 25 bp, Homo sapien
tgtgatctctgcataccagctacct

SEQ ID NO: 632623 - DNA, 25 bp, Homo sapien
ataccagctaccttttgccttctga

SEQ ID NO: 632624 - DNA, 25 bp, Homo sapien
catgaacggaagaagcctgcagccc

SEQ ID NO: 632625 - DNA, 25 bp, Homo sapien
ttgtacagccggcagaactagctca

SEQ ID NO: 632626 - DNA, 25 bp, Homo sapien
agccggcagaactagctcagttgat

SEQ ID NO: 632627 - DNA, 25 bp, Homo sapien
actagctcagttgatcgtggataac

SEQ ID NO: 632628 - DNA, 25 bp, Homo sapien
ggataactgacacaaggaaggcaaa

SEQ ID NO: 632629 - DNA, 25 bp, Homo sapien
gtgggtgaaggaggcctgctgaatt

SEQ ID NO: 632630 - DNA, 25 bp, Homo sapien
tacaacggctgaacagtgcttgtca

SEQ ID NO: 632631 - DNA, 25 bp, Homo sapien
agtgcttgtcatttcagtgctgtac

SEQ ID NO: 632632 - DNA, 25 bp, Homo sapien
aatgatgtggaaagctgtccattat

SEQ ID NO: 632633 - DNA, 25 bp, Homo sapien
aagaaaaattgtgggccagttctat

SEQ ID NO: 632634 - DNA, 25 bp, Homo sapien
aaaattgtgggccagttctatttat

SEQ ID NO: 632635 - DNA, 25 bp, Homo sapien
aaattgtgggccagttctatttatg

SEQ ID NO: 632636 - DNA, 25 bp, Homo sapien
aattgtgggccagttctatttatga

SEQ ID NO: 632637 - DNA, 25 bp, Homo sapien
attgtgggccagttctatttatgaa

SEQ ID NO: 632638 - DNA, 25 bp, Homo sapien
ttgtgggccagttctatttatgaat

SEQ ID NO: 632639 - DNA, 25 bp, Homo sapien
cagaattaaggagaaatgttgtttt

SEQ ID NO: 632640 - DNA, 25 bp, Homo sapien
gataaatttagatatccacttgtag

SEQ ID NO: 632641 - DNA, 25 bp, Homo sapien
ataaatttagatatccacttgtagt

SEQ ID NO: 632642 - DNA, 25 bp, Homo sapien
atttagatatccacttgtagttgag

SEQ ID NO: 632643 - DNA, 25 bp, Homo sapien
tttagatatccacttgtagttgaga

SEQ ID NO: 632644 - DNA, 25 bp, Homo sapien
taaaatgccacactatttcattagt

SEQ ID NO: 632645 - DNA, 25 bp, Homo sapien
tttcattagtttgcaacaaccactg

SEQ ID NO: 632646 - DNA, 25 bp, Homo sapien
gtttgcaacaaccactgattagtat

SEQ ID NO: 632647 - DNA, 25 bp, Homo sapien
acaaccactgattagtatcacagag

SEQ ID NO: 632648 - DNA, 25 bp, Homo sapien
gtatcacagaggactatatttatta

SEQ ID NO: 632649 - DNA, 25 bp, Homo sapien
taaaccttaacctaactgatggatg

SEQ ID NO: 632650 - DNA, 25 bp, Homo sapien
ccttaacctaactgatggatgagat

SEQ ID NO: 632651 - DNA, 25 bp, Homo sapien
aaaagagacagtcacgtgtggcagt

SEQ ID NO: 632652 - DNA, 25 bp, Homo sapien
tcacgtgtggcagtgcgtcctgtaa

SEQ ID NO: 632653 - DNA, 25 bp, Homo sapien
tggcagtgcgtcctgtaacccgtta

SEQ ID NO: 632654 - DNA, 25 bp, Homo sapien
tgcgtcctgtaacccgttacttggg

SEQ ID NO: 632655 - DNA, 25 bp, Homo sapien
aataactaattagggctgagctcgg

SEQ ID NO: 632656 - DNA, 25 bp, Homo sapien
aagtatctggctgtggtggtgcgca

SEQ ID NO: 632657 - DNA, 25 bp, Homo sapien
gtggtgcgcacttgtagttctccta

SEQ ID NO: 632658 - DNA, 25 bp, Homo sapien
tggtgcgcacttgtagttctcctac

SEQ ID NO: 632659 - DNA, 25 bp, Homo sapien
tgcgcacttgtagttctcctactta

SEQ ID NO: 632660 - DNA, 25 bp, Homo sapien
gcacttgtagttctcctacttagga

SEQ ID NO: 632661 - DNA, 25 bp, Homo sapien
cacttgtagttctcctacttaggag

SEQ ID NO: 632662 - DNA, 25 bp, Homo sapien
ggattacttgagcttcagcccagga

SEQ ID NO: 632663 - DNA, 25 bp, Homo sapien
agctgtgaatcataccactgtggta

SEQ ID NO: 632664 - DNA, 25 bp, Homo sapien
tgaatcataccactgtggtacagcc

SEQ ID NO: 632665 - DNA, 25 bp, Homo sapien
accactgtggtacagcccaaggcaa

SEQ ID NO: 632666 - DNA, 25 bp, Homo sapien
ataattccccagctggagcgcttgg

SEQ ID NO: 632667 - DNA, 25 bp, Homo sapien
ttccccagctggagcgcttggtgga

SEQ ID NO: 632668 - DNA, 25 bp, Homo sapien
gagtgatttaactcaccaagctaag

SEQ ID NO: 632669 - DNA, 25 bp, Homo sapien
gatttaactcaccaagctaagcata

SEQ ID NO: 632670 - DNA, 25 bp, Homo sapien
accaagctaagcatacacagtgtta

SEQ ID NO: 632671 - DNA, 25 bp, Homo sapien
caagctaagcatacacagtgttatt

SEQ ID NO: 632672 - DNA, 25 bp, Homo sapien
gttatatacattataggaggtgcct

SEQ ID NO: 632673 - DNA, 25 bp, Homo sapien
aggaggtgcctaatgagagaactca

SEQ ID NO: 632674 - DNA, 25 bp, Homo sapien
gagagaactcattcctctatcaaaa

SEQ ID NO: 632675 - DNA, 25 bp, Homo sapien
cattcctctatcaaaaaataccgtg

SEQ ID NO: 632676 - DNA, 25 bp, Homo sapien
tcaaaaaataccgtgagtcggccgg

SEQ ID NO: 632677 - DNA, 25 bp, Homo sapien
gatataaaatatgtaacagatggcc

SEQ ID NO: 632678 - DNA, 25 bp, Homo sapien
atataaaatatgtaacagatggccg

SEQ ID NO: 632679 - DNA, 25 bp, Homo sapien
tataaaatatgtaacagatggccgg

SEQ ID NO: 632680 - DNA, 25 bp, Homo sapien
aaaatatgtaacagatggccgggca

SEQ ID NO: 632681 - DNA, 25 bp, Homo sapien
aaatatgtaacagatggccgggcac

SEQ ID NO: 632682 - DNA, 25 bp, Homo sapien
aatatgtaacagatggccgggcacg

SEQ ID NO: 632683 - DNA, 25 bp, Homo sapien
atatgtaacagatggccgggcacgg

SEQ ID NO: 632684 - DNA, 25 bp, Homo sapien
tatgtaacagatggccgggcacggt

SEQ ID NO: 632685 - DNA, 25 bp, Homo sapien
atgtaacagatggccgggcacggtg

SEQ ID NO: 632686 - DNA, 25 bp, Homo sapien
tgtaacagatggccgggcacggtgg

SEQ ID NO: 632687 - DNA, 25 bp, Homo sapien
gtttatttcctatcacttgcaggca

SEQ ID NO: 632688 - DNA, 25 bp, Homo sapien
acttgcaggcaaactaccttagaca

SEQ ID NO: 632689 - DNA, 25 bp, Homo sapien
taccttagacactcatgcttcacag

SEQ ID NO: 632690 - DNA, 25 bp, Homo sapien
catgcttcacaggtagagtggtcaa

SEQ ID NO: 632691 - DNA, 25 bp, Homo sapien
gagtggtcaagtcatttattaccca

SEQ ID NO: 632692 - DNA, 25 bp, Homo sapien
atttattacccaaatcaagggcact

SEQ ID NO: 632693 - DNA, 25 bp, Homo sapien
atcaagggcactggtagtaacgaca

SEQ ID NO: 632694 - DNA, 25 bp, Homo sapien
gacagggaaatacctcgtggaaact

SEQ ID NO: 632695 - DNA, 25 bp, Homo sapien
ctcgtggaaactgggtcatgggtca

SEQ ID NO: 632696 - DNA, 25 bp, Homo sapien
tcatgggtcaaccaactctaccagg

SEQ ID NO: 632697 - DNA, 25 bp, Homo sapien
aaaagcctacaatgacacaaagact

SEQ ID NO: 632698 - DNA, 25 bp, Homo sapien
gcaattttgatgacgtattcgctga

SEQ ID NO: 632699 - DNA, 25 bp, Homo sapien
tgatgacgtattcgctgatgcacag

SEQ ID NO: 632700 - DNA, 25 bp, Homo sapien
gacgtattcgctgatgcacagacat

SEQ ID NO: 632701 - DNA, 25 bp, Homo sapien
tcgctgatgcacagacattggaatt

SEQ ID NO: 632702 - DNA, 25 bp, Homo sapien
gcacagacattggaattcattacat

SEQ ID NO: 632703 - DNA, 25 bp, Homo sapien
tcattacattatctagccatcgtaa

SEQ ID NO: 632704 - DNA, 25 bp, Homo sapien
gccatcgtaatacaaatgacctttg

SEQ ID NO: 632705 - DNA, 25 bp, Homo sapien
atgacctttggatttctctatcacg

SEQ ID NO: 632706 - DNA, 25 bp, Homo sapien
tggatttctctatcacggcgcttat

SEQ ID NO: 632707 - DNA, 25 bp, Homo sapien
acggcgcttatcctcctattaagga

SEQ ID NO: 632708 - DNA, 25 bp, Homo sapien
ggcgcttatcctcctattaaggatc

SEQ ID NO: 632709 - DNA, 25 bp, Homo sapien
aaagaggctcaagaggccgggcgca

SEQ ID NO: 632710 - DNA, 25 bp, Homo sapien
aagaggctcaagaggccgggcgcag

SEQ ID NO: 632711 - DNA, 25 bp, Homo sapien
agaggctcaagaggccgggcgcagt

SEQ ID NO: 632712 - DNA, 25 bp, Homo sapien
gaggctcaagaggccgggcgcagtg

SEQ ID NO: 632713 - DNA, 25 bp, Homo sapien
agagcttgcagtgaggtaagatcga

SEQ ID NO: 632714 - DNA, 25 bp, Homo sapien
gagcttgcagtgaggtaagatcgag

SEQ ID NO: 632715 - DNA, 25 bp, Homo sapien
agcttgcagtgaggtaagatcgagc

SEQ ID NO: 632716 - DNA, 25 bp, Homo sapien
gcttgcagtgaggtaagatcgagcc

SEQ ID NO: 632717 - DNA, 25 bp, Homo sapien
cttgcagtgaggtaagatcgagcca

SEQ ID NO: 632718 - DNA, 25 bp, Homo sapien
cagtgaggtaagatcgagccactgc

SEQ ID NO: 632719 - DNA, 25 bp, Homo sapien
agtgaggtaagatcgagccactgca

SEQ ID NO: 632720 - DNA, 25 bp, Homo sapien
aacaggcaaccataattgagtttag

SEQ ID NO: 632721 - DNA, 25 bp, Homo sapien
ttttttctcctgcatacccttttat

SEQ ID NO: 632722 - DNA, 25 bp, Homo sapien
cctgcatacccttttataccagttg

SEQ ID NO: 632723 - DNA, 25 bp, Homo sapien
ataccagttgagttttgtcccatgt

SEQ ID NO: 632724 - DNA, 25 bp, Homo sapien
tgagttttgtcccatgtgtgcatac

SEQ ID NO: 632725 - DNA, 25 bp, Homo sapien
gtcccatgtgtgcatactattaaaa

SEQ ID NO: 632726 - DNA, 25 bp, Homo sapien
gatataagaggcaacaactagcata

SEQ ID NO: 632727 - DNA, 25 bp, Homo sapien
ggcaacaactagcataactcattaa

SEQ ID NO: 632728 - DNA, 25 bp, Homo sapien
attgactgacaggatatatgcacgt

SEQ ID NO: 632729 - DNA, 25 bp, Homo sapien
gacaggatatatgcacgtgatgtat

SEQ ID NO: 632730 - DNA, 25 bp, Homo sapien
atgcacgtgatgtatttataaattc

SEQ ID NO: 632731 - DNA, 25 bp, Homo sapien
tgtcaatacccatctgcttctgaat

SEQ ID NO: 632732 - DNA, 25 bp, Homo sapien
atacccatctgcttctgaatgcatc

SEQ ID NO: 632733 - DNA, 25 bp, Homo sapien
gcttctgaatgcatccttttgttgt

SEQ ID NO: 632734 - DNA, 25 bp, Homo sapien
aatgcatccttttgttgtgttctga

SEQ ID NO: 632735 - DNA, 25 bp, Homo sapien
gttgtgttctgataaatgcagtgaa

SEQ ID NO: 632736 - DNA, 25 bp, Homo sapien
aacactggcgtaaaagataacatct

SEQ ID NO: 632737 - DNA, 25 bp, Homo sapien
atgcagtgaaggcaccaccaaggcc

SEQ ID NO: 632738 - DNA, 25 bp, Homo sapien
agataacatctataggaaaccccct

SEQ ID NO: 632739 - DNA, 25 bp, Homo sapien
ccctatctacagacagcatggtacg

SEQ ID NO: 632740 - DNA, 25 bp, Homo sapien
agcatggtacggttggattcctccc

SEQ ID NO: 632741 - DNA, 25 bp, Homo sapien
acggttggattcctcccgctgctgt

SEQ ID NO: 632742 - DNA, 25 bp, Homo sapien
gagctggaatggaatacatcaatca

SEQ ID NO: 632743 - DNA, 25 bp, Homo sapien
acatcaatcatctaattccctcagt

SEQ ID NO: 632744 - DNA, 25 bp, Homo sapien
aatcatctaattccctcagtttata

SEQ ID NO: 632745 - DNA, 25 bp, Homo sapien
taattccctcagtttatagatttgg

SEQ ID NO: 632746 - DNA, 25 bp, Homo sapien
gatttggaaattaaggcccaagaat

SEQ ID NO: 632747 - DNA, 25 bp, Homo sapien
agaattcaggtgacttgaccaaatt

SEQ ID NO: 632748 - DNA, 25 bp, Homo sapien
gacttgaccaaattcacatgactaa

SEQ ID NO: 632749 - DNA, 25 bp, Homo sapien
gcaaggaacagaagccactactttt

SEQ ID NO: 632750 - DNA, 25 bp, Homo sapien
tttccactttactactctgtcctgt

SEQ ID NO: 632751 - DNA, 25 bp, Homo sapien
ccactttactactctgtcctgttat

SEQ ID NO: 632752 - DNA, 25 bp, Homo sapien
taccccctcctctgtaatatgaaat

SEQ ID NO: 632753 - DNA, 25 bp, Homo sapien
cctgcgccggaaggaggctgttagc

SEQ ID NO: 632754 - DNA, 25 bp, Homo sapien
aggctgttagcgtgctggactctgc

SEQ ID NO: 632755 - DNA, 25 bp, Homo sapien
gttagcgtgctggactctgcggaca

SEQ ID NO: 632756 - DNA, 25 bp, Homo sapien
agcgtgctggactctgcggacatag

SEQ ID NO: 632757 - DNA, 25 bp, Homo sapien
gactctgcggacatagaggtcacag

SEQ ID NO: 632758 - DNA, 25 bp, Homo sapien
atagaggtcacagacagtcgcctgc

SEQ ID NO: 632759 - DNA, 25 bp, Homo sapien
agaggtcacagacagtcgcctgcct

SEQ ID NO: 632760 - DNA, 25 bp, Homo sapien
gtcacagacagtcgcctgcctcatg

SEQ ID NO: 632761 - DNA, 25 bp, Homo sapien
tcgcctgcctcatgccactattgtg

SEQ ID NO: 632762 - DNA, 25 bp, Homo sapien
actattgtggatcaccggccccagg

SEQ ID NO: 632763 - DNA, 25 bp, Homo sapien
tcgtgctccacatcaacggagagtc

SEQ ID NO: 632764 - DNA, 25 bp, Homo sapien
ttcagccgggcaaagctaagctgtg

SEQ ID NO: 632765 - DNA, 25 bp, Homo sapien
taagctgtgaggagtccctttggca

SEQ ID NO: 632766 - DNA, 25 bp, Homo sapien
taggtagagatccacgtctcgtcgt

SEQ ID NO: 632767 - DNA, 25 bp, Homo sapien
gtctcgtcgtcagggcttagactga

SEQ ID NO: 632768 - DNA, 25 bp, Homo sapien
cacctcccgaatagcatgagataga

SEQ ID NO: 632769 - DNA, 25 bp, Homo sapien
atttgttgctaattgggtgtggtca

SEQ ID NO: 632770 - DNA, 25 bp, Homo sapien
gtgtggtcaattgtgtttccccgaa

SEQ ID NO: 632771 - DNA, 25 bp, Homo sapien
tgtgtttccccgaagctgggaggta

SEQ ID NO: 632772 - DNA, 25 bp, Homo sapien
gcctgcactgctgctttgaggactt

SEQ ID NO: 632773 - DNA, 25 bp, Homo sapien
gaggacttgcattctactgtgcttg

SEQ ID NO: 632774 - DNA, 25 bp, Homo sapien
tctactgtgcttgatgaagctacta

SEQ ID NO: 632775 - DNA, 25 bp, Homo sapien
tctgattgccctaagagtggtcctg

SEQ ID NO: 632776 - DNA, 25 bp, Homo sapien
attgccctaagagtggtcctgaaac

SEQ ID NO: 632777 - DNA, 25 bp, Homo sapien
gagtggtcctgaaacggtaagtcct

SEQ ID NO: 632778 - DNA, 25 bp, Homo sapien
tgaaacggtaagtcctttcaaagag

SEQ ID NO: 632779 - DNA, 25 bp, Homo sapien
caaagagcttactggatacttggga

SEQ ID NO: 632780 - DNA, 25 bp, Homo sapien
gagcttactggatacttgggaagaa

SEQ ID NO: 632781 - DNA, 25 bp, Homo sapien
catgtaggctaaatatctggtgagt

SEQ ID NO: 632782 - DNA, 25 bp, Homo sapien
atctggtgagtatcaaaattgcaat

SEQ ID NO: 632783 - DNA, 25 bp, Homo sapien
acttctgctttaattggcctaggac

SEQ ID NO: 632784 - DNA, 25 bp, Homo sapien
gctttaattggcctaggactcctta

SEQ ID NO: 632785 - DNA, 25 bp, Homo sapien
ctaggactccttagttaaagccaag

SEQ ID NO: 632786 - DNA, 25 bp, Homo sapien
gctggcctcggtgatacaggtgtca

SEQ ID NO: 632787 - DNA, 25 bp, Homo sapien
agatggattctccagctgttcaggc

SEQ ID NO: 632788 - DNA, 25 bp, Homo sapien
ttctccagctgttcaggcagtggaa

SEQ ID NO: 632789 - DNA, 25 bp, Homo sapien
ggctgaggaatttggcaacgccctg

SEQ ID NO: 632790 - DNA, 25 bp, Homo sapien
tgtccacacacttttgcttctagga

SEQ ID NO: 632791 - DNA, 25 bp, Homo sapien
cacttttgcttctaggacttctgta

SEQ ID NO: 632792 - DNA, 25 bp, Homo sapien
gacttctgtatgtctgttacaccca

SEQ ID NO: 632793 - DNA, 25 bp, Homo sapien
tgttacacccactatactgcaaact

SEQ ID NO: 632794 - DNA, 25 bp, Homo sapien
ctgcaaactcctcaagaatgccttg

SEQ ID NO: 632795 - DNA, 25 bp, Homo sapien
gcaagcagagctgtctaattcatct

SEQ ID NO: 632796 - DNA, 25 bp, Homo sapien
taattcatctgtgcatcgccagagc

SEQ ID NO: 632797 - DNA, 25 bp, Homo sapien
ttgcaccctctgagccgtctggtta

SEQ ID NO: 632798 - DNA, 25 bp, Homo sapien
gagccgtctggttatggtccctcag

SEQ ID NO: 632799 - DNA, 25 bp, Homo sapien
aaggctggcagtgggacagacccca

SEQ ID NO: 632800 - DNA, 25 bp, Homo sapien
tgctccttctttcagttccctgcaa

SEQ ID NO: 632801 - DNA, 25 bp, Homo sapien
ttcagttccctgcaaacctactgct

SEQ ID NO: 632802 - DNA, 25 bp, Homo sapien
aaacctactgctctaggctctatga

SEQ ID NO: 632803 - DNA, 25 bp, Homo sapien
actgctctaggctctatgagtgcat

SEQ ID NO: 632804 - DNA, 25 bp, Homo sapien
aggctctatgagtgcatcaaacatt

SEQ ID NO: 632805 - DNA, 25 bp, Homo sapien
gtgcatcaaacattcctgaaggctt

SEQ ID NO: 632806 - DNA, 25 bp, Homo sapien
attcctgaaggcttgtgtctaacaa

SEQ ID NO: 632807 - DNA, 25 bp, Homo sapien
aaattgtgtacaaaatgtgtcctct

SEQ ID NO: 632808 - DNA, 25 bp, Homo sapien
cttggatttttttctgatcacctca

SEQ ID NO: 632809 - DNA, 25 bp, Homo sapien
cagccagaagtgatcactcttcctt

SEQ ID NO: 632810 - DNA, 25 bp, Homo sapien
aagtgatcactcttcctttgaacca

SEQ ID NO: 632811 - DNA, 25 bp, Homo sapien
atcactcttcctttgaaccacatca

SEQ ID NO: 632812 - DNA, 25 bp, Homo sapien
atcacccacttcaacacttttatag

SEQ ID NO: 632813 - DNA, 25 bp, Homo sapien
atgtctgatattctctaccaaatgg

SEQ ID NO: 632814 - DNA, 25 bp, Homo sapien
gaatccatcctttgttaccctttgt

SEQ ID NO: 632815 - DNA, 25 bp, Homo sapien
gataaaattcctaaagtgctgatat

SEQ ID NO: 632816 - DNA, 25 bp, Homo sapien
aagtgctgatatatttcctgacata

SEQ ID NO: 632817 - DNA, 25 bp, Homo sapien
gacatataaataccactttctcttt

SEQ ID NO: 632818 - DNA, 25 bp, Homo sapien
aataccactttctctttgtattcct

SEQ ID NO: 632819 - DNA, 25 bp, Homo sapien
aataagacaacagggccgggcacgg

SEQ ID NO: 632820 - DNA, 25 bp, Homo sapien
ataagacaacagggccgggcacggt

SEQ ID NO: 632821 - DNA, 25 bp, Homo sapien
taagacaacagggccgggcacggtg

SEQ ID NO: 632822 - DNA, 25 bp, Homo sapien
aagacaacagggccgggcacggtgc

SEQ ID NO: 632823 - DNA, 25 bp, Homo sapien
agacaacagggccgggcacggtgcc

SEQ ID NO: 632824 - DNA, 25 bp, Homo sapien
gacaacagggccgggcacggtgcct

SEQ ID NO: 632825 - DNA, 25 bp, Homo sapien
acaacagggccgggcacggtgcctc

SEQ ID NO: 632826 - DNA, 25 bp, Homo sapien
caacagggccgggcacggtgcctca

SEQ ID NO: 632827 - DNA, 25 bp, Homo sapien
aacagggccgggcacggtgcctcac

SEQ ID NO: 632828 - DNA, 25 bp, Homo sapien
acagggccgggcacggtgcctcacg

SEQ ID NO: 632829 - DNA, 25 bp, Homo sapien
cagggccgggcacggtgcctcacgc

SEQ ID NO: 632830 - DNA, 25 bp, Homo sapien
caatctgggttttaagtgtggattc

SEQ ID NO: 632831 - DNA, 25 bp, Homo sapien
atctgggttttaagtgtggattcat

SEQ ID NO: 632832 - DNA, 25 bp, Homo sapien
ctgggttttaagtgtggattcatta

SEQ ID NO: 632833 - DNA, 25 bp, Homo sapien
ttatgctgacatgaattatttgtat

SEQ ID NO: 632834 - DNA, 25 bp, Homo sapien
tgctgacatgaattatttgtatgtt

SEQ ID NO: 632835 - DNA, 25 bp, Homo sapien
tggctgtcttcctgctcccatagtg

SEQ ID NO: 632836 - DNA, 25 bp, Homo sapien
gctgtcttcctgctcccatagtgga

SEQ ID NO: 632837 - DNA, 25 bp, Homo sapien
ctgtcttcctgctcccatagtggat

SEQ ID NO: 632838 - DNA, 25 bp, Homo sapien
tgtcttcctgctcccatagtggata

SEQ ID NO: 632839 - DNA, 25 bp, Homo sapien
tcttcctgctcccatagtggataaa

SEQ ID NO: 632840 - DNA, 25 bp, Homo sapien
cttcctgctcccatagtggataaaa

SEQ ID NO: 632841 - DNA, 25 bp, Homo sapien
ccatctgtatcacaattatgtcgta

SEQ ID NO: 632842 - DNA, 25 bp, Homo sapien
atctgtatcacaattatgtcgtagt

SEQ ID NO: 632843 - DNA, 25 bp, Homo sapien
gtatcacaattatgtcgtagtggct

SEQ ID NO: 632844 - DNA, 25 bp, Homo sapien
cacaattatgtcgtagtggctgata

SEQ ID NO: 632845 - DNA, 25 bp, Homo sapien
acaattatgtcgtagtggctgatat

SEQ ID NO: 632846 - DNA, 25 bp, Homo sapien
attatgtcgtagtggctgatattca

SEQ ID NO: 632847 - DNA, 25 bp, Homo sapien
atgtcgtagtggctgatattcacta

SEQ ID NO: 632848 - DNA, 25 bp, Homo sapien
gtcgtagtggctgatattcactatt

SEQ ID NO: 632849 - DNA, 25 bp, Homo sapien
gtagtggctgatattcactatttga

SEQ ID NO: 632850 - DNA, 25 bp, Homo sapien
gtggctgatattcactatttgaaat

SEQ ID NO: 632851 - DNA, 25 bp, Homo sapien
ctatttgaaatacagtcccagcact

SEQ ID NO: 632852 - DNA, 25 bp, Homo sapien
cccattctcaattttacttatagtt

SEQ ID NO: 632853 - DNA, 25 bp, Homo sapien
taaaatcctgtgctccaccaattag

SEQ ID NO: 632854 - DNA, 25 bp, Homo sapien
gtgctccaccaattagtggtttaca

SEQ ID NO: 632855 - DNA, 25 bp, Homo sapien
tttagatgaaaccatggcccttgcc

SEQ ID NO: 632856 - DNA, 25 bp, Homo sapien
gaaaccatggcccttgccctataaa

SEQ ID NO: 632857 - DNA, 25 bp, Homo sapien
aatatacagttctccttgggtgaat

SEQ ID NO: 632858 - DNA, 25 bp, Homo sapien
gttctccttgggtgaatacttctct

SEQ ID NO: 632859 - DNA, 25 bp, Homo sapien
gaatacttctctagaaccacctgtt

SEQ ID NO: 632860 - DNA, 25 bp, Homo sapien
tagaaccacctgtttcctagcaaaa

SEQ ID NO: 632861 - DNA, 25 bp, Homo sapien
gcaaaacgatgagctgatgactatg

SEQ ID NO: 632862 - DNA, 25 bp, Homo sapien
atgactatgcatctgtacttgtttg

SEQ ID NO: 632863 - DNA, 25 bp, Homo sapien
tttaaatactgtgtatccccacctg

SEQ ID NO: 632864 - DNA, 25 bp, Homo sapien
tgtatccccacctgtgcttgcaaga

SEQ ID NO: 632865 - DNA, 25 bp, Homo sapien
cccacctgtgcttgcaagacaggaa

SEQ ID NO: 632866 - DNA, 25 bp, Homo sapien
tgggagctgacccactagacacaat

SEQ ID NO: 632867 - DNA, 25 bp, Homo sapien
gctctgctcctcactgggtctgtga

SEQ ID NO: 632868 - DNA, 25 bp, Homo sapien
tcctcactgggtctgtgattgtcag

SEQ ID NO: 632869 - DNA, 25 bp, Homo sapien
tcactgggtctgtgattgtcagaaa

SEQ ID NO: 632870 - DNA, 25 bp, Homo sapien
gaagattaatgcctggagggtccac

SEQ ID NO: 632871 - DNA, 25 bp, Homo sapien
gattaatgcctggagggtccacgtt

SEQ ID NO: 632872 - DNA, 25 bp, Homo sapien
catatatccagtacaccagtgaaaa

SEQ ID NO: 632873 - DNA, 25 bp, Homo sapien
gaaaaggtacatgacgctgggcaca

SEQ ID NO: 632874 - DNA, 25 bp, Homo sapien
gaacatgtgcttggacttctgaact

SEQ ID NO: 632875 - DNA, 25 bp, Homo sapien
acatgtgcttggacttctgaactac

SEQ ID NO: 632876 - DNA, 25 bp, Homo sapien
aagttgctaaatttgtagtcatata

SEQ ID NO: 632877 - DNA, 25 bp, Homo sapien
tagaaaacaagtgcaatcatttagc

SEQ ID NO: 632878 - DNA, 25 bp, Homo sapien
gcaatcatttagcacattaataagt

SEQ ID NO: 632879 - DNA, 25 bp, Homo sapien
aattattgtgagtttttgagcatgg

SEQ ID NO: 632880 - DNA, 25 bp, Homo sapien
ttttgagcatgggaactatgtctta

SEQ ID NO: 632881 - DNA, 25 bp, Homo sapien
ttatcttttttatgctcaatcccta

SEQ ID NO: 632882 - DNA, 25 bp, Homo sapien
ttttatgctcaatccctatcagaag

SEQ ID NO: 632883 - DNA, 25 bp, Homo sapien
gctcaatccctatcagaagttgtgt

SEQ ID NO: 632884 - DNA, 25 bp, Homo sapien
aatccctatcagaagttgtgtatta

SEQ ID NO: 632885 - DNA, 25 bp, Homo sapien
caagcccaaggatgccagccagcgg

SEQ ID NO: 632886 - DNA, 25 bp, Homo sapien
tggagcccgccgagaacgtgcacgg

SEQ ID NO: 632887 - DNA, 25 bp, Homo sapien
cgagaacgtgcacggcgctggcggg

SEQ ID NO: 632888 - DNA, 25 bp, Homo sapien
gccgccgagcccaagctgttcggag

SEQ ID NO: 632889 - DNA, 25 bp, Homo sapien
agcccaagctgttcggaggcttcaa

SEQ ID NO: 632890 - DNA, 25 bp, Homo sapien
aagctgttcggaggcttcaactcct

SEQ ID NO: 632891 - DNA, 25 bp, Homo sapien
tgttcggaggcttcaactcctcgga

SEQ ID NO: 632892 - DNA, 25 bp, Homo sapien
gaggcttcaactcctcggacaccgt

SEQ ID NO: 632893 - DNA, 25 bp, Homo sapien
gctggccggtggagtgaccaccttt

SEQ ID NO: 632894 - DNA, 25 bp, Homo sapien
tttgtggccctctatgactatgagt

SEQ ID NO: 632895 - DNA, 25 bp, Homo sapien
tgtggccctctatgactatgagtct

SEQ ID NO: 632896 - DNA, 25 bp, Homo sapien
cagctgcagtgtggcttagggcccc

SEQ ID NO: 632897 - DNA, 25 bp, Homo sapien
tgcagtgtggcttagggccccacgc

SEQ ID NO: 632898 - DNA, 25 bp, Homo sapien
gggacttcctctggctgctttcctg

SEQ ID NO: 632899 - DNA, 25 bp, Homo sapien
gctgctttcctgatgctctggacaa

SEQ ID NO: 632900 - DNA, 25 bp, Homo sapien
gctttcctgatgctctggacaaatt

SEQ ID NO: 632901 - DNA, 25 bp, Homo sapien
gatgctctggacaaattcctttctc

SEQ ID NO: 632902 - DNA, 25 bp, Homo sapien
tggacaaattcctttctctttagtt

SEQ ID NO: 632903 - DNA, 25 bp, Homo sapien
aattcctttctctttagttcagcgg

SEQ ID NO: 632904 - DNA, 25 bp, Homo sapien
ttcctttctctttagttcagcggag

SEQ ID NO: 632905 - DNA, 25 bp, Homo sapien
ctctttagttcagcggagacatggg

SEQ ID NO: 632906 - DNA, 25 bp, Homo sapien
gagacatgggtggaagtttttgaaa

SEQ ID NO: 632907 - DNA, 25 bp, Homo sapien
tagtccacatcgaggttaaaaaaag

SEQ ID NO: 632908 - DNA, 25 bp, Homo sapien
gtccacatcgaggttaaaaaaagtg

SEQ ID NO: 632909 - DNA, 25 bp, Homo sapien
tccacatcgaggttaaaaaaagtga

SEQ ID NO: 632910 - DNA, 25 bp, Homo sapien
aagtgaaataggccgggcgcggtga

SEQ ID NO: 632911 - DNA, 25 bp, Homo sapien
cccagaactctgtgaggccgaggct

SEQ ID NO: 632912 - DNA, 25 bp, Homo sapien
ccagaactctgtgaggccgaggctg

SEQ ID NO: 632913 - DNA, 25 bp, Homo sapien
cagaactctgtgaggccgaggctgg

SEQ ID NO: 632914 - DNA, 25 bp, Homo sapien
agaactctgtgaggccgaggctggc

SEQ ID NO: 632915 - DNA, 25 bp, Homo sapien
atgtgcctgcaatcccagatactgg

SEQ ID NO: 632916 - DNA, 25 bp, Homo sapien
tgtgcctgcaatcccagatactggg

SEQ ID NO: 632917 - DNA, 25 bp, Homo sapien
gtgcctgcaatcccagatactgggg

SEQ ID NO: 632918 - DNA, 25 bp, Homo sapien
agccttccttccatttgggtgcaat

SEQ ID NO: 632919 - DNA, 25 bp, Homo sapien
gccttccttccatttgggtgcaatt

SEQ ID NO: 632920 - DNA, 25 bp, Homo sapien
ccttccttccatttgggtgcaattt

SEQ ID NO: 632921 - DNA, 25 bp, Homo sapien
cttccttccatttgggtgcaatttc

SEQ ID NO: 632922 - DNA, 25 bp, Homo sapien
ttccttccatttgggtgcaatttcc

SEQ ID NO: 632923 - DNA, 25 bp, Homo sapien
ccttccatttgggtgcaatttccac

SEQ ID NO: 632924 - DNA, 25 bp, Homo sapien
cttccatttgggtgcaatttccact

SEQ ID NO: 632925 - DNA, 25 bp, Homo sapien
ttccatttgggtgcaatttccactt

SEQ ID NO: 632926 - DNA, 25 bp, Homo sapien
tccatttgggtgcaatttccacttg

SEQ ID NO: 632927 - DNA, 25 bp, Homo sapien
ccatttgggtgcaatttccacttgg

SEQ ID NO: 632928 - DNA, 25 bp, Homo sapien
catttgggtgcaatttccacttggg

SEQ ID NO: 632929 - DNA, 25 bp, Homo sapien
cccctcaccgtctgggatgttagga

SEQ ID NO: 632930 - DNA, 25 bp, Homo sapien
tcaccgtctgggatgttaggagcac

SEQ ID NO: 632931 - DNA, 25 bp, Homo sapien
accgtctgggatgttaggagcacct

SEQ ID NO: 632932 - DNA, 25 bp, Homo sapien
ggaatgtgaggagcgactctgccaa

SEQ ID NO: 632933 - DNA, 25 bp, Homo sapien
aatgtgaggagcgactctgccaagc

SEQ ID NO: 632934 - DNA, 25 bp, Homo sapien
atgtgaggagcgactctgccaagct

SEQ ID NO: 632935 - DNA, 25 bp, Homo sapien
gtgaggagcgactctgccaagctgc

SEQ ID NO: 632936 - DNA, 25 bp, Homo sapien
gaggagcgactctgccaagctgccg

SEQ ID NO: 632937 - DNA, 25 bp, Homo sapien
aagctgccgccctgtgtggcaagtg

SEQ ID NO: 632938 - DNA, 25 bp, Homo sapien
agctgccgccctgtgtggcaagtga

SEQ ID NO: 632939 - DNA, 25 bp, Homo sapien
cctgtgtggcaagtgaggagcacct

SEQ ID NO: 632940 - DNA, 25 bp, Homo sapien
aaccattaagaatcagtggatcagc

SEQ ID NO: 632941 - DNA, 25 bp, Homo sapien
cattaagaatcagtggatcagccag

SEQ ID NO: 632942 - DNA, 25 bp, Homo sapien
attaagaatcagtggatcagccagg

SEQ ID NO: 632943 - DNA, 25 bp, Homo sapien
ttaagaatcagtggatcagccaggt

SEQ ID NO: 632944 - DNA, 25 bp, Homo sapien
taagaatcagtggatcagccaggtg

SEQ ID NO: 632945 - DNA, 25 bp, Homo sapien
aagaatcagtggatcagccaggtgt

SEQ ID NO: 632946 - DNA, 25 bp, Homo sapien
agaatcagtggatcagccaggtgtg

SEQ ID NO: 632947 - DNA, 25 bp, Homo sapien
gaatcagtggatcagccaggtgtga

SEQ ID NO: 632948 - DNA, 25 bp, Homo sapien
atcagtggatcagccaggtgtgatg

SEQ ID NO: 632949 - DNA, 25 bp, Homo sapien
tgagccacgaagacgccactgtact

SEQ ID NO: 632950 - DNA, 25 bp, Homo sapien
gagccacgaagacgccactgtactc

SEQ ID NO: 632951 - DNA, 25 bp, Homo sapien
aatactaacttaatccctcctacat

SEQ ID NO: 632952 - DNA, 25 bp, Homo sapien
acttaatccctcctacatcaagcag

SEQ ID NO: 632953 - DNA, 25 bp, Homo sapien
ttgagccaagtaactggtgtttgtc

SEQ ID NO: 632954 - DNA, 25 bp, Homo sapien
gccaagtaactggtgtttgtctttg

SEQ ID NO: 632955 - DNA, 25 bp, Homo sapien
ctggtgtttgtctttgttatgcgta

SEQ ID NO: 632956 - DNA, 25 bp, Homo sapien
gtgtttgtctttgttatgcgtatat

SEQ ID NO: 632957 - DNA, 25 bp, Homo sapien
ttgtctttgttatgcgtatattgta

SEQ ID NO: 632958 - DNA, 25 bp, Homo sapien
gttatgcgtatattgtaattttgtc

SEQ ID NO: 632959 - DNA, 25 bp, Homo sapien
taattttgtcttggtcgatacggga

SEQ ID NO: 632960 - DNA, 25 bp, Homo sapien
ttttgtcttggtcgatacgggaaat

SEQ ID NO: 632961 - DNA, 25 bp, Homo sapien
tggtcgatacgggaaatactaactt

SEQ ID NO: 632962 - DNA, 25 bp, Homo sapien
gaaggtgtagccataaatctgtcca

SEQ ID NO: 632963 - DNA, 25 bp, Homo sapien
aaggtgtagccataaatctgtccaa

SEQ ID NO: 632964 - DNA, 25 bp, Homo sapien
aggtgtagccataaatctgtccaag

SEQ ID NO: 632965 - DNA, 25 bp, Homo sapien
ggtgtagccataaatctgtccaagg

SEQ ID NO: 632966 - DNA, 25 bp, Homo sapien
gtgtagccataaatctgtccaaggc

SEQ ID NO: 632967 - DNA, 25 bp, Homo sapien
gtagccataaatctgtccaaggctg

SEQ ID NO: 632968 - DNA, 25 bp, Homo sapien
tagccataaatctgtccaaggctgc

SEQ ID NO: 632969 - DNA, 25 bp, Homo sapien
gccataaatctgtccaaggctgctg

SEQ ID NO: 632970 - DNA, 25 bp, Homo sapien
ccataaatctgtccaaggctgctgg

SEQ ID NO: 632971 - DNA, 25 bp, Homo sapien
cataaatctgtccaaggctgctggc

SEQ ID NO: 632972 - DNA, 25 bp, Homo sapien
aaatctgtccaaggctgctggcaca

SEQ ID NO: 632973 - DNA, 25 bp, Homo sapien
tctttaactggcctaactaaatatt

SEQ ID NO: 632974 - DNA, 25 bp, Homo sapien
tacctcaaacctctcacgtgtgaaa

SEQ ID NO: 632975 - DNA, 25 bp, Homo sapien
aaacctctcacgtgtgaaagctcta

SEQ ID NO: 632976 - DNA, 25 bp, Homo sapien
tctcacgtgtgaaagctctactggt

SEQ ID NO: 632977 - DNA, 25 bp, Homo sapien
aaagctctactggttagccctagag

SEQ ID NO: 632978 - DNA, 25 bp, Homo sapien
gctctactggttagccctagagtta

SEQ ID NO: 632979 - DNA, 25 bp, Homo sapien
tactggttagccctagagttaatta

SEQ ID NO: 632980 - DNA, 25 bp, Homo sapien
ggttagccctagagttaattatatt

SEQ ID NO: 632981 - DNA, 25 bp, Homo sapien
attgtattgcttggctcataggagg

SEQ ID NO: 632982 - DNA, 25 bp, Homo sapien
attgcttggctcataggaggtattt

SEQ ID NO: 632983 - DNA, 25 bp, Homo sapien
ggctcataggaggtatttaataaac

SEQ ID NO: 632984 - DNA, 25 bp, Homo sapien
gtggtggttgctactattcttggac

SEQ ID NO: 632985 - DNA, 25 bp, Homo sapien
ggttgctactattcttggacaggat

SEQ ID NO: 632986 - DNA, 25 bp, Homo sapien
gctactattcttggacaggatacag

SEQ ID NO: 632987 - DNA, 25 bp, Homo sapien
caggatacagttattgcctcctcca

SEQ ID NO: 632988 - DNA, 25 bp, Homo sapien
tcctccatctctaaacaatgtttgt

SEQ ID NO: 632989 - DNA, 25 bp, Homo sapien
ttcactcatgagtaagatacctgtc

SEQ ID NO: 632990 - DNA, 25 bp, Homo sapien
gagtaagatacctgtctctttctga

SEQ ID NO: 632991 - DNA, 25 bp, Homo sapien
tacctgtctctttctgaagtgtgcc

SEQ ID NO: 632992 - DNA, 25 bp, Homo sapien
tctttctgaagtgtgcctctgatgt

SEQ ID NO: 632993 - DNA, 25 bp, Homo sapien
atgttctctagccatctttattgaa

SEQ ID NO: 632994 - DNA, 25 bp, Homo sapien
gccatctttattgaaacataggctg

SEQ ID NO: 632995 - DNA, 25 bp, Homo sapien
tttactatgagacattaaggataaa

SEQ ID NO: 632996 - DNA, 25 bp, Homo sapien
ttaaggataaagagctaagggccgt

SEQ ID NO: 632997 - DNA, 25 bp, Homo sapien
aggataaagagctaagggccgtttg

SEQ ID NO: 632998 - DNA, 25 bp, Homo sapien
ggataaagagctaagggccgtttgc

SEQ ID NO: 632999 - DNA, 25 bp, Homo sapien
gataaagagctaagggccgtttgca

SEQ ID NO: 633000 - DNA, 25 bp, Homo sapien
ataaagagctaagggccgtttgcag

SEQ ID NO: 633001 - DNA, 25 bp, Homo sapien
agctaagggccgtttgcagtggctc

SEQ ID NO: 633002 - DNA, 25 bp, Homo sapien
gctaagggccgtttgcagtggctca

SEQ ID NO: 633003 - DNA, 25 bp, Homo sapien
ctaagggccgtttgcagtggctcaa

SEQ ID NO: 633004 - DNA, 25 bp, Homo sapien
gggatgctgaggctaccgtgagcca

SEQ ID NO: 633005 - DNA, 25 bp, Homo sapien
atgctgaggctaccgtgagccaaga

SEQ ID NO: 633006 - DNA, 25 bp, Homo sapien
acctagacattattttactgatatt

SEQ ID NO: 633007 - DNA, 25 bp, Homo sapien
agccttccttccatttgggtgcaat

SEQ ID NO: 633008 - DNA, 25 bp, Homo sapien
gccttccttccatttgggtgcaatt

SEQ ID NO: 633009 - DNA, 25 bp, Homo sapien
cttccttccatttgggtgcaatttc

SEQ ID NO: 633010 - DNA, 25 bp, Homo sapien
ttccttccatttgggtgcaatttcc

SEQ ID NO: 633011 - DNA, 25 bp, Homo sapien
ccttccatttgggtgcaatttccac

SEQ ID NO: 633012 - DNA, 25 bp, Homo sapien
ttccatttgggtgcaatttccactt

SEQ ID NO: 633013 - DNA, 25 bp, Homo sapien
tccatttgggtgcaatttccacttg

SEQ ID NO: 633014 - DNA, 25 bp, Homo sapien
catttgggtgcaatttccacttggg

SEQ ID NO: 633015 - DNA, 25 bp, Homo sapien
gggaaaatctcattccccatcctct

SEQ ID NO: 633016 - DNA, 25 bp, Homo sapien
cattccccatcctcttgtaattaaa

SEQ ID NO: 633017 - DNA, 25 bp, Homo sapien
actggatgccatacttgtgttatta

SEQ ID NO: 633018 - DNA, 25 bp, Homo sapien
gtgttattagctatctctatctgcc

SEQ ID NO: 633019 - DNA, 25 bp, Homo sapien
tctatctgcctaagcctctggtttg

SEQ ID NO: 633020 - DNA, 25 bp, Homo sapien
ctggtttgcttcctcttgggaatta

SEQ ID NO: 633021 - DNA, 25 bp, Homo sapien
aaaaatcatcattctttcagctttg

SEQ ID NO: 633022 - DNA, 25 bp, Homo sapien
tttcagctttgaccatattgttttg

SEQ ID NO: 633023 - DNA, 25 bp, Homo sapien
gaaattcatcacgatttattacctg

SEQ ID NO: 633024 - DNA, 25 bp, Homo sapien
gatttattacctgaacatttgtgaa

SEQ ID NO: 633025 - DNA, 25 bp, Homo sapien
gagagaatcccaaaagaatcatttt

SEQ ID NO: 633026 - DNA, 25 bp, Homo sapien
gaatcattttaattgaagccaccta

SEQ ID NO: 633027 - DNA, 25 bp, Homo sapien
tgaagccacctaattacttgtaatt

SEQ ID NO: 633028 - DNA, 25 bp, Homo sapien
tgatactaaacagccctttattctg

SEQ ID NO: 633029 - DNA, 25 bp, Homo sapien
taaacagccctttattctggtagga

SEQ ID NO: 633030 - DNA, 25 bp, Homo sapien
cagccctttattctggtaggaccag

SEQ ID NO: 633031 - DNA, 25 bp, Homo sapien
gttgtggatttattcctgccgcccc

SEQ ID NO: 633032 - DNA, 25 bp, Homo sapien
ctgccgcccctaattgatttaatgg

SEQ ID NO: 633033 - DNA, 25 bp, Homo sapien
cgcccctaattgatttaatggcttt

SEQ ID NO: 633034 - DNA, 25 bp, Homo sapien
ggttaaagtagcatttacattttca

SEQ ID NO: 633035 - DNA, 25 bp, Homo sapien
tacattttcatggaagattcatttt

SEQ ID NO: 633036 - DNA, 25 bp, Homo sapien
aatagtgtgtccttttctttgccag

SEQ ID NO: 633037 - DNA, 25 bp, Homo sapien
ctttgccaggttgtgtgatttctac

SEQ ID NO: 633038 - DNA, 25 bp, Homo sapien
gtgatttctactggaaagacagcaa

SEQ ID NO: 633039 - DNA, 25 bp, Homo sapien
actagcctctgagattctttttttt

SEQ ID NO: 633040 - DNA, 25 bp, Homo sapien
taacctgtaaaggaggctcttacac

SEQ ID NO: 633041 - DNA, 25 bp, Homo sapien
taaaggaggctcttacactaattac

SEQ ID NO: 633042 - DNA, 25 bp, Homo sapien
aaggaggctcttacactaattacct

SEQ ID NO: 633043 - DNA, 25 bp, Homo sapien
ggaggctcttacactaattacctga

SEQ ID NO: 633044 - DNA, 25 bp, Homo sapien
gaggctcttacactaattacctgaa

SEQ ID NO: 633045 - DNA, 25 bp, Homo sapien
ggctcttacactaattacctgaaca

SEQ ID NO: 633046 - DNA, 25 bp, Homo sapien
tcttacactaattacctgaacaaat

SEQ ID NO: 633047 - DNA, 25 bp, Homo sapien
cctgaacaaatttattgtgagtttc

SEQ ID NO: 633048 - DNA, 25 bp, Homo sapien
gtgagtttcacatgagataatgact

SEQ ID NO: 633049 - DNA, 25 bp, Homo sapien
gtttcacatgagataatgactaata

SEQ ID NO: 633050 - DNA, 25 bp, Homo sapien
gcattcgacacagagttgcagcctg

SEQ ID NO: 633051 - DNA, 25 bp, Homo sapien
attcgacacagagttgcagcctgtc

SEQ ID NO: 633052 - DNA, 25 bp, Homo sapien
tcgacacagagttgcagcctgtcaa

SEQ ID NO: 633053 - DNA, 25 bp, Homo sapien
gacacagagttgcagcctgtcaaga

SEQ ID NO: 633054 - DNA, 25 bp, Homo sapien
cacagagttgcagcctgtcaagacc

SEQ ID NO: 633055 - DNA, 25 bp, Homo sapien
tcctgattcagccatccatcgttat

SEQ ID NO: 633056 - DNA, 25 bp, Homo sapien
ctgattcagccatccatcgttatta

SEQ ID NO: 633057 - DNA, 25 bp, Homo sapien
tgattcagccatccatcgttattag

SEQ ID NO: 633058 - DNA, 25 bp, Homo sapien
cggagacaagcattcgacacagagt

SEQ ID NO: 633059 - DNA, 25 bp, Homo sapien
ggagacaagcattcgacacagagtt

SEQ ID NO: 633060 - DNA, 25 bp, Homo sapien
gacaagcattcgacacagagttgca

SEQ ID NO: 633061 - DNA, 25 bp, Homo sapien
ttacagtcaattcccaaggctcatt

SEQ ID NO: 633062 - DNA, 25 bp, Homo sapien
aggctcattgtgcagtcagtggttc

SEQ ID NO: 633063 - DNA, 25 bp, Homo sapien
cagtggttctgcatcatttagagtt

SEQ ID NO: 633064 - DNA, 25 bp, Homo sapien
ttccaagtgccttgatatttacaag

SEQ ID NO: 633065 - DNA, 25 bp, Homo sapien
tacaagtctcatattttaccatagg

SEQ ID NO: 633066 - DNA, 25 bp, Homo sapien
gcatattcatgtgttgacagttcta

SEQ ID NO: 633067 - DNA, 25 bp, Homo sapien
tacaagtaattagccctgacagaac

SEQ ID NO: 633068 - DNA, 25 bp, Homo sapien
ggagacccattcataaatttgctaa

SEQ ID NO: 633069 - DNA, 25 bp, Homo sapien
tttgctaattatgttactctgctca

SEQ ID NO: 633070 - DNA, 25 bp, Homo sapien
gaatttaatcgcagtctagtcttta

SEQ ID NO: 633071 - DNA, 25 bp, Homo sapien
gtctagtctttaatcatatctgtat

SEQ ID NO: 633072 - DNA, 25 bp, Homo sapien
ttaattgaagtatagttggtgaaca

SEQ ID NO: 633073 - DNA, 25 bp, Homo sapien
gaatgaatctttggataacagaaag

SEQ ID NO: 633074 - DNA, 25 bp, Homo sapien
aaactaagagatttgtgaccagcag

SEQ ID NO: 633075 - DNA, 25 bp, Homo sapien
actaagagatttgtgaccagcagat

SEQ ID NO: 633076 - DNA, 25 bp, Homo sapien
aagagatttgtgaccagcagatcta

SEQ ID NO: 633077 - DNA, 25 bp, Homo sapien
gagatttgtgaccagcagatctatt

SEQ ID NO: 633078 - DNA, 25 bp, Homo sapien
atttgtgaccagcagatctattcta

SEQ ID NO: 633079 - DNA, 25 bp, Homo sapien
ttgtgaccagcagatctattctaaa

SEQ ID NO: 633080 - DNA, 25 bp, Homo sapien
gtgaccagcagatctattctaaaat

SEQ ID NO: 633081 - DNA, 25 bp, Homo sapien
gaccagcagatctattctaaaatga

SEQ ID NO: 633082 - DNA, 25 bp, Homo sapien
gcagatctattctaaaatgacagtt

SEQ ID NO: 633083 - DNA, 25 bp, Homo sapien
gaccagcgtggcgaaaccctgtatc

SEQ ID NO: 633084 - DNA, 25 bp, Homo sapien
accagcgtggcgaaaccctgtatct

SEQ ID NO: 633085 - DNA, 25 bp, Homo sapien
ccagcgtggcgaaaccctgtatcta

SEQ ID NO: 633086 - DNA, 25 bp, Homo sapien
cagcgtggcgaaaccctgtatctac

SEQ ID NO: 633087 - DNA, 25 bp, Homo sapien
agcgtggcgaaaccctgtatctact

SEQ ID NO: 633088 - DNA, 25 bp, Homo sapien
gcgtggcgaaaccctgtatctacta

SEQ ID NO: 633089 - DNA, 25 bp, Homo sapien
aaatacaaaattagtggagtgtggt

SEQ ID NO: 633090 - DNA, 25 bp, Homo sapien
aattagtggagtgtggtggtgcgtg

SEQ ID NO: 633091 - DNA, 25 bp, Homo sapien
attagtggagtgtggtggtgcgtgc

SEQ ID NO: 633092 - DNA, 25 bp, Homo sapien
ttagtggagtgtggtggtgcgtgcc

SEQ ID NO: 633093 - DNA, 25 bp, Homo sapien
gctgggggaggagaatcgcttgggc

SEQ ID NO: 633094 - DNA, 25 bp, Homo sapien
acacaactggattctactgaaatta

SEQ ID NO: 633095 - DNA, 25 bp, Homo sapien
aactggattctactgaaattaccac

SEQ ID NO: 633096 - DNA, 25 bp, Homo sapien
tggattctactgaaattaccacata

SEQ ID NO: 633097 - DNA, 25 bp, Homo sapien
gaaattaccacatatttgaggtcca

SEQ ID NO: 633098 - DNA, 25 bp, Homo sapien
ttaccacatatttgaggtccacaag

SEQ ID NO: 633099 - DNA, 25 bp, Homo sapien
cacatatttgaggtccacaagcaca

SEQ ID NO: 633100 - DNA, 25 bp, Homo sapien
atatttgaggtccacaagcacaagt

SEQ ID NO: 633101 - DNA, 25 bp, Homo sapien
tttgaggtccacaagcacaagtata

SEQ ID NO: 633102 - DNA, 25 bp, Homo sapien
gaggtccacaagcacaagtatagat

SEQ ID NO: 633103 - DNA, 25 bp, Homo sapien
gtccacaagcacaagtatagatcta

SEQ ID NO: 633104 - DNA, 25 bp, Homo sapien
atagatctaatgcaaactgggctca

SEQ ID NO: 633105 - DNA, 25 bp, Homo sapien
tttactatgagacattaaggataaa

SEQ ID NO: 633106 - DNA, 25 bp, Homo sapien
ttaaggataaagagctaagggccgt

SEQ ID NO: 633107 - DNA, 25 bp, Homo sapien
taaggataaagagctaagggccgtt

SEQ ID NO: 633108 - DNA, 25 bp, Homo sapien
aggataaagagctaagggccgtttg

SEQ ID NO: 633109 - DNA, 25 bp, Homo sapien
ggataaagagctaagggccgtttgc

SEQ ID NO: 633110 - DNA, 25 bp, Homo sapien
gataaagagctaagggccgtttgca

SEQ ID NO: 633111 - DNA, 25 bp, Homo sapien
ataaagagctaagggccgtttgcag

SEQ ID NO: 633112 - DNA, 25 bp, Homo sapien
agctaagggccgtttgcagtggctc

SEQ ID NO: 633113 - DNA, 25 bp, Homo sapien
gctaagggccgtttgcagtggctca

SEQ ID NO: 633114 - DNA, 25 bp, Homo sapien
ctaagggccgtttgcagtggctcaa

SEQ ID NO: 633115 - DNA, 25 bp, Homo sapien
gggatgctgaggctaccgtgagcca

SEQ ID NO: 633116 - DNA, 25 bp, Homo sapien
aaatgcaagggcttaggtcctatta

SEQ ID NO: 633117 - DNA, 25 bp, Homo sapien
ggtcctattattggttttggaatgt

SEQ ID NO: 633118 - DNA, 25 bp, Homo sapien
tattgattacttttgtccaagttta

SEQ ID NO: 633119 - DNA, 25 bp, Homo sapien
ataaaatccttatggaattctggtc

SEQ ID NO: 633120 - DNA, 25 bp, Homo sapien
actgtgttctctgtgtcttgcaggt

SEQ ID NO: 633121 - DNA, 25 bp, Homo sapien
gtcttgcaggtttttaatgctgtaa

SEQ ID NO: 633122 - DNA, 25 bp, Homo sapien
aatgctgtaagtgtgtttctcttga

SEQ ID NO: 633123 - DNA, 25 bp, Homo sapien
ttttttcatgaccttttccacaatg

SEQ ID NO: 633124 - DNA, 25 bp, Homo sapien
atgaccttttccacaatgataggga

SEQ ID NO: 633125 - DNA, 25 bp, Homo sapien
gaattttacaagtcaaccctggttg

SEQ ID NO: 633126 - DNA, 25 bp, Homo sapien
aaccctggttgagttctttcacaga

SEQ ID NO: 633127 - DNA, 25 bp, Homo sapien
cccggtcctgctgtattcttaaaat

SEQ ID NO: 633128 - DNA, 25 bp, Homo sapien
cctgctgtattcttaaaatggtcat

SEQ ID NO: 633129 - DNA, 25 bp, Homo sapien
aatggtcatttgctgagtgctagat

SEQ ID NO: 633130 - DNA, 25 bp, Homo sapien
gtcatttgctgagtgctagattcaa

SEQ ID NO: 633131 - DNA, 25 bp, Homo sapien
ctagattcaaattttcagttgcctc

SEQ ID NO: 633132 - DNA, 25 bp, Homo sapien
cagttgcctcatatattccatcttg

SEQ ID NO: 633133 - DNA, 25 bp, Homo sapien
ttgcctcatatattccatcttggtc

SEQ ID NO: 633134 - DNA, 25 bp, Homo sapien
cctcatatattccatcttggtcttc

SEQ ID NO: 633135 - DNA, 25 bp, Homo sapien
ggtcttccttgtcacgatcattgat

SEQ ID NO: 633136 - DNA, 25 bp, Homo sapien
ttccttgtcacgatcattgatatat

SEQ ID NO: 633137 - DNA, 25 bp, Homo sapien
cattgatatatagtaacacagctgc

SEQ ID NO: 633138 - DNA, 25 bp, Homo sapien
tgcctcaccttagctgatgacattc

SEQ ID NO: 633139 - DNA, 25 bp, Homo sapien
gcctcaccttagctgatgacattct

SEQ ID NO: 633140 - DNA, 25 bp, Homo sapien
cctcaccttagctgatgacattcta

SEQ ID NO: 633141 - DNA, 25 bp, Homo sapien
ctcaccttagctgatgacattctac

SEQ ID NO: 633142 - DNA, 25 bp, Homo sapien
tcaccttagctgatgacattctacc

SEQ ID NO: 633143 - DNA, 25 bp, Homo sapien
aagcacccccactgagcaccttgcc

SEQ ID NO: 633144 - DNA, 25 bp, Homo sapien
agcacccccactgagcaccttgcca

SEQ ID NO: 633145 - DNA, 25 bp, Homo sapien
gcacccccactgagcaccttgccac

SEQ ID NO: 633146 - DNA, 25 bp, Homo sapien
cacccccactgagcaccttgccacc

SEQ ID NO: 633147 - DNA, 25 bp, Homo sapien
acccccactgagcaccttgccaccc

SEQ ID NO: 633148 - DNA, 25 bp, Homo sapien
ggccccacccttatctcccttcgct

SEQ ID NO: 633149 - DNA, 25 bp, Homo sapien
gcatctaaaggtacgtctttaaggc

SEQ ID NO: 633150 - DNA, 25 bp, Homo sapien
tctttaaggcaactttgtagaccta

SEQ ID NO: 633151 - DNA, 25 bp, Homo sapien
gcaactttgtagacctaacctttag

SEQ ID NO: 633152 - DNA, 25 bp, Homo sapien
ttgtagacctaacctttagcagcta

SEQ ID NO: 633153 - DNA, 25 bp, Homo sapien
agacctaacctttagcagctaatca

SEQ ID NO: 633154 - DNA, 25 bp, Homo sapien
tagcagctaatcaaagcctagggaa

SEQ ID NO: 633155 - DNA, 25 bp, Homo sapien
gtaactttaggaggtctataaatgt

SEQ ID NO: 633156 - DNA, 25 bp, Homo sapien
gtgcctctttcagactgtctttaag

SEQ ID NO: 633157 - DNA, 25 bp, Homo sapien
gcctctttcagactgtctttaagaa

SEQ ID NO: 633158 - DNA, 25 bp, Homo sapien
gtctttaagaactagcactttctgt

SEQ ID NO: 633159 - DNA, 25 bp, Homo sapien
tttaagaactagcactttctgtttt

SEQ ID NO: 633160 - DNA, 25 bp, Homo sapien
gccaaccagaaatttattacaactg

SEQ ID NO: 633161 - DNA, 25 bp, Homo sapien
ttattacaactgttagaagaattca

SEQ ID NO: 633162 - DNA, 25 bp, Homo sapien
gttagaagaattcagttaggtgact

SEQ ID NO: 633163 - DNA, 25 bp, Homo sapien
gaattcagttaggtgactgggaaca

SEQ ID NO: 633164 - DNA, 25 bp, Homo sapien
aattcagttaggtgactgggaacaa

SEQ ID NO: 633165 - DNA, 25 bp, Homo sapien
gggaacaaaattagaatgcagaaat

SEQ ID NO: 633166 - DNA, 25 bp, Homo sapien
gaaatcaatagttttcatgcagaaa

SEQ ID NO: 633167 - DNA, 25 bp, Homo sapien
gaaaacaaaagccatatgcaacata

SEQ ID NO: 633168 - DNA, 25 bp, Homo sapien
aaacaaaagccatatgcaacataat

SEQ ID NO: 633169 - DNA, 25 bp, Homo sapien
aaagccatatgcaacataatgaaag

SEQ ID NO: 633170 - DNA, 25 bp, Homo sapien
aacattaacatattcatatcaagaa

SEQ ID NO: 633171 - DNA, 25 bp, Homo sapien
ttaaacagacttttcattatgaaaa

SEQ ID NO: 633172 - DNA, 25 bp, Homo sapien
tgaaaagagttcaaattgctgggcg

SEQ ID NO: 633173 - DNA, 25 bp, Homo sapien
gaaaagagttcaaattgctgggcgc

SEQ ID NO: 633174 - DNA, 25 bp, Homo sapien
aaaagagttcaaattgctgggcgcg

SEQ ID NO: 633175 - DNA, 25 bp, Homo sapien
aaagagttcaaattgctgggcgcgg

SEQ ID NO: 633176 - DNA, 25 bp, Homo sapien
aagagttcaaattgctgggcgcggt

SEQ ID NO: 633177 - DNA, 25 bp, Homo sapien
agagttcaaattgctgggcgcggtg

SEQ ID NO: 633178 - DNA, 25 bp, Homo sapien
gagttcaaattgctgggcgcggtgg

SEQ ID NO: 633179 - DNA, 25 bp, Homo sapien
ccgggcatggttgctatttgggagg

SEQ ID NO: 633180 - DNA, 25 bp, Homo sapien
gggcatggttgctatttgggaggct

SEQ ID NO: 633181 - DNA, 25 bp, Homo sapien
agaatcacttgcaggagaatcactt

SEQ ID NO: 633182 - DNA, 25 bp, Homo sapien
atatactccaggaagaaggaatttg

SEQ ID NO: 633183 - DNA, 25 bp, Homo sapien
tgaacaacgaacaacaaaacattgg

SEQ ID NO: 633184 - DNA, 25 bp, Homo sapien
aaaatgcctttctagcttgggagga

SEQ ID NO: 633185 - DNA, 25 bp, Homo sapien
tgcctttctagcttgggaggacaaa

SEQ ID NO: 633186 - DNA, 25 bp, Homo sapien
tctagcttgggaggacaaacaaaca

SEQ ID NO: 633187 - DNA, 25 bp, Homo sapien
aacaaaatgtctagagcgggttatt

SEQ ID NO: 633188 - DNA, 25 bp, Homo sapien
tgtctagagcgggttattgtaattg

SEQ ID NO: 633189 - DNA, 25 bp, Homo sapien
gagcgggttattgtaattgaacaga

SEQ ID NO: 633190 - DNA, 25 bp, Homo sapien
taatgcccttactttgtttaggtag

SEQ ID NO: 633191 - DNA, 25 bp, Homo sapien
tatagtatccaagctagcagagata

SEQ ID NO: 633192 - DNA, 25 bp, Homo sapien
tccaagctagcagagatatgaagtg

SEQ ID NO: 633193 - DNA, 25 bp, Homo sapien
aattctgacatcctagagatggtat

SEQ ID NO: 633194 - DNA, 25 bp, Homo sapien
gatggtatttcagagacaggatgta

SEQ ID NO: 633195 - DNA, 25 bp, Homo sapien
ttttttgggtagtgttggctaaatg

SEQ ID NO: 633196 - DNA, 25 bp, Homo sapien
agtgttggctaaatgtaaggtttca

SEQ ID NO: 633197 - DNA, 25 bp, Homo sapien
aaatacaaacagcaacagcggaatt

SEQ ID NO: 633198 - DNA, 25 bp, Homo sapien
cagcaacagcggaattgaccagatt

SEQ ID NO: 633199 - DNA, 25 bp, Homo sapien
cagcggaattgaccagattattttc

SEQ ID NO: 633200 - DNA, 25 bp, Homo sapien
tttaaaagtaagatgagccctggcc

SEQ ID NO: 633201 - DNA, 25 bp, Homo sapien
tgcccaccctctgagaatatgctcc

SEQ ID NO: 633202 - DNA, 25 bp, Homo sapien
gaatatgctccctccgcgtatatat

SEQ ID NO: 633203 - DNA, 25 bp, Homo sapien
gctccctccgcgtatatatttacat

SEQ ID NO: 633204 - DNA, 25 bp, Homo sapien
cctattaatcccaggtactaaggag

SEQ ID NO: 633205 - DNA, 25 bp, Homo sapien
ctattaatcccaggtactaaggagg

SEQ ID NO: 633206 - DNA, 25 bp, Homo sapien
tattaatcccaggtactaaggaggt

SEQ ID NO: 633207 - DNA, 25 bp, Homo sapien
ttaatcccaggtactaaggaggttg

SEQ ID NO: 633208 - DNA, 25 bp, Homo sapien
aattctgtaaagactaggattagaa

SEQ ID NO: 633209 - DNA, 25 bp, Homo sapien
tctgtaaagactaggattagaaaca

SEQ ID NO: 633210 - DNA, 25 bp, Homo sapien
ctgtaaagactaggattagaaacat

SEQ ID NO: 633211 - DNA, 25 bp, Homo sapien
taaagactaggattagaaacatgac

SEQ ID NO: 633212 - DNA, 25 bp, Homo sapien
aaagactaggattagaaacatgaca

SEQ ID NO: 633213 - DNA, 25 bp, Homo sapien
aagactaggattagaaacatgacaa

SEQ ID NO: 633214 - DNA, 25 bp, Homo sapien
gactaggattagaaacatgacaaaa

SEQ ID NO: 633215 - DNA, 25 bp, Homo sapien
tttgcagctcaaaaaatatggacag

SEQ ID NO: 633216 - DNA, 25 bp, Homo sapien
gcagctcaaaaaatatggacagtaa

SEQ ID NO: 633217 - DNA, 25 bp, Homo sapien
aaatatggacagtaattcagggaaa

SEQ ID NO: 633218 - DNA, 25 bp, Homo sapien
atatggacagtaattcagggaaaat

SEQ ID NO: 633219 - DNA, 25 bp, Homo sapien
cagtaattcagggaaaatgtgacaa

SEQ ID NO: 633220 - DNA, 25 bp, Homo sapien
gacaaaagtacattttagttcatgc

SEQ ID NO: 633221 - DNA, 25 bp, Homo sapien
tgcatttaaaattcactctgggcca

SEQ ID NO: 633222 - DNA, 25 bp, Homo sapien
gcatttaaaattcactctgggccag

SEQ ID NO: 633223 - DNA, 25 bp, Homo sapien
catttaaaattcactctgggccagg

SEQ ID NO: 633224 - DNA, 25 bp, Homo sapien
atttaaaattcactctgggccaggt

SEQ ID NO: 633225 - DNA, 25 bp, Homo sapien
tttaaaattcactctgggccaggtg

SEQ ID NO: 633226 - DNA, 25 bp, Homo sapien
attctcaaactcatgtcagttactg

SEQ ID NO: 633227 - DNA, 25 bp, Homo sapien
tcaaactcatgtcagttactgggcc

SEQ ID NO: 633228 - DNA, 25 bp, Homo sapien
aactcatgtcagttactgggcctgc

SEQ ID NO: 633229 - DNA, 25 bp, Homo sapien
tcatgtcagttactgggcctgccgg

SEQ ID NO: 633230 - DNA, 25 bp, Homo sapien
atgtcagttactgggcctgccgggt

SEQ ID NO: 633231 - DNA, 25 bp, Homo sapien
agttactgggcctgccgggtgtggt

SEQ ID NO: 633232 - DNA, 25 bp, Homo sapien
caaaacaaattgtttgaattggcgg

SEQ ID NO: 633233 - DNA, 25 bp, Homo sapien
tgtagtcctagcaacctttccactt

SEQ ID NO: 633234 - DNA, 25 bp, Homo sapien
gtcctagcaacctttccacttggga

SEQ ID NO: 633235 - DNA, 25 bp, Homo sapien
tagcaacctttccacttgggaggct

SEQ ID NO: 633236 - DNA, 25 bp, Homo sapien
agcaacctttccacttgggaggctg

SEQ ID NO: 633237 - DNA, 25 bp, Homo sapien
atttggtgcatatgtttttgtggtc

SEQ ID NO: 633238 - DNA, 25 bp, Homo sapien
gtttttgtggtcaagacagacccaa

SEQ ID NO: 633239 - DNA, 25 bp, Homo sapien
tcaagacagacccaagattatcacg

SEQ ID NO: 633240 - DNA, 25 bp, Homo sapien
cctggataatgtaagtctggataac

SEQ ID NO: 633241 - DNA, 25 bp, Homo sapien
agtctggataacttgttaaattgct

SEQ ID NO: 633242 - DNA, 25 bp, Homo sapien
ggtgtatctgatttactctggactt

SEQ ID NO: 633243 - DNA, 25 bp, Homo sapien
gatttactctggacttgaatttatg

SEQ ID NO: 633244 - DNA, 25 bp, Homo sapien
aaattaattagttctcattgttttg

SEQ ID NO: 633245 - DNA, 25 bp, Homo sapien
actatgaaacctgtttcctccctag

SEQ ID NO: 633246 - DNA, 25 bp, Homo sapien
tttcctccctagctttgcagaaatt

SEQ ID NO: 633247 - DNA, 25 bp, Homo sapien
agctttgcagaaattttgtctcaat

SEQ ID NO: 633248 - DNA, 25 bp, Homo sapien
cctattaatcccaggtactaaggag

SEQ ID NO: 633249 - DNA, 25 bp, Homo sapien
ctattaatcccaggtactaaggagg

SEQ ID NO: 633250 - DNA, 25 bp, Homo sapien
tattaatcccaggtactaaggaggt

SEQ ID NO: 633251 - DNA, 25 bp, Homo sapien
aattctgtaaagactaggattagaa

SEQ ID NO: 633252 - DNA, 25 bp, Homo sapien
tctgtaaagactaggattagaaaca

SEQ ID NO: 633253 - DNA, 25 bp, Homo sapien
ctgtaaagactaggattagaaacat

SEQ ID NO: 633254 - DNA, 25 bp, Homo sapien
taaagactaggattagaaacatgac

SEQ ID NO: 633255 - DNA, 25 bp, Homo sapien
aaagactaggattagaaacatgaca

SEQ ID NO: 633256 - DNA, 25 bp, Homo sapien
aagactaggattagaaacatgacaa

SEQ ID NO: 633257 - DNA, 25 bp, Homo sapien
agactaggattagaaacatgacaaa

SEQ ID NO: 633258 - DNA, 25 bp, Homo sapien
gactaggattagaaacatgacaaaa

SEQ ID NO: 633259 - DNA, 25 bp, Homo sapien
gtgtgcaataatcaggtcccatggg

SEQ ID NO: 633260 - DNA, 25 bp, Homo sapien
gtctggtgatttgtttaggtgtctt

SEQ ID NO: 633261 - DNA, 25 bp, Homo sapien
aggtgtctttgggtgatagaatcat

SEQ ID NO: 633262 - DNA, 25 bp, Homo sapien
gatagaatcatacctgagaccccag

SEQ ID NO: 633263 - DNA, 25 bp, Homo sapien
ttactgcctcccttctacctgggtt

SEQ ID NO: 633264 - DNA, 25 bp, Homo sapien
tacctgggtttcacagggtctctct

SEQ ID NO: 633265 - DNA, 25 bp, Homo sapien
gggtctctctcacataggcaggaaa

SEQ ID NO: 633266 - DNA, 25 bp, Homo sapien
gtccaaattggagaagtactctcac

SEQ ID NO: 633267 - DNA, 25 bp, Homo sapien
gttgctttttcagactgtgagttgg

SEQ ID NO: 633268 - DNA, 25 bp, Homo sapien
gttggttctgaaaaactgctcttct

SEQ ID NO: 633269 - DNA, 25 bp, Homo sapien
ctgctcttctgactcattgctgaaa

SEQ ID NO: 633270 - DNA, 25 bp, Homo sapien
aaagctggtaagaaacaatcctaca

SEQ ID NO: 633271 - DNA, 25 bp, Homo sapien
ggtaagaaacaatcctacagaaaat

SEQ ID NO: 633272 - DNA, 25 bp, Homo sapien
ggtgacagaataatccagatatgga

SEQ ID NO: 633273 - DNA, 25 bp, Homo sapien
agactggaatcctagtgatgtcgag

SEQ ID NO: 633274 - DNA, 25 bp, Homo sapien
ctggaatcctagtgatgtcgagttt

SEQ ID NO: 633275 - DNA, 25 bp, Homo sapien
atcctagtgatgtcgagttttgtgc

SEQ ID NO: 633276 - DNA, 25 bp, Homo sapien
cctagtgatgtcgagttttgtgcat

SEQ ID NO: 633277 - DNA, 25 bp, Homo sapien
tagtgatgtcgagttttgtgcattt

SEQ ID NO: 633278 - DNA, 25 bp, Homo sapien
ttctgtcaagactgcgatattattt

SEQ ID NO: 633279 - DNA, 25 bp, Homo sapien
tgtcaagactgcgatattattttta

SEQ ID NO: 633280 - DNA, 25 bp, Homo sapien
aagactgcgatattatttttatctt

SEQ ID NO: 633281 - DNA, 25 bp, Homo sapien
tccatctcctgtactcaccttttaa

SEQ ID NO: 633282 - DNA, 25 bp, Homo sapien
taactccagttaagaagctatcatg

SEQ ID NO: 633283 - DNA, 25 bp, Homo sapien
aagaagctatcatgtacaccccatc

SEQ ID NO: 633284 - DNA, 25 bp, Homo sapien
agaggtttagtaacttctccaacat

SEQ ID NO: 633285 - DNA, 25 bp, Homo sapien
agtaacttctccaacatcacacagt

SEQ ID NO: 633286 - DNA, 25 bp, Homo sapien
cacacagtaacttttaagggccagt

SEQ ID NO: 633287 - DNA, 25 bp, Homo sapien
agtccctgaactgtcatcctaaaac

SEQ ID NO: 633288 - DNA, 25 bp, Homo sapien
gaactgtcatcctaaaactcattag

SEQ ID NO: 633289 - DNA, 25 bp, Homo sapien
aactcattaggtgtgtgatcctttc

SEQ ID NO: 633290 - DNA, 25 bp, Homo sapien
gtgatcctttcaaaatgctctactg

SEQ ID NO: 633291 - DNA, 25 bp, Homo sapien
caaaatgctctactggccggcatgt

SEQ ID NO: 633292 - DNA, 25 bp, Homo sapien
caggataaaaacaaagcaggctgag

SEQ ID NO: 633293 - DNA, 25 bp, Homo sapien
aggataaaaacaaagcaggctgagt

SEQ ID NO: 633294 - DNA, 25 bp, Homo sapien
ggataaaaacaaagcaggctgagtg

SEQ ID NO: 633295 - DNA, 25 bp, Homo sapien
gataaaaacaaagcaggctgagtgc

SEQ ID NO: 633296 - DNA, 25 bp, Homo sapien
ataaaaacaaagcaggctgagtgca

SEQ ID NO: 633297 - DNA, 25 bp, Homo sapien
tgagccgtgagtatgccactactct

SEQ ID NO: 633298 - DNA, 25 bp, Homo sapien
gagccgtgagtatgccactactctc

SEQ ID NO: 633299 - DNA, 25 bp, Homo sapien
agccgtgagtatgccactactctcc

SEQ ID NO: 633300 - DNA, 25 bp, Homo sapien
ccggtaagatgtctcgcacaataat

SEQ ID NO: 633301 - DNA, 25 bp, Homo sapien
gcacaataataaatggccgtgtctg

SEQ ID NO: 633302 - DNA, 25 bp, Homo sapien
gtccataccgtagtagtagcacggg

SEQ ID NO: 633303 - DNA, 25 bp, Homo sapien
cgtagtagtagcacggggcccaact

SEQ ID NO: 633304 - DNA, 25 bp, Homo sapien
gggcccaactgctactaatacaata

SEQ ID NO: 633305 - DNA, 25 bp, Homo sapien
actgctactaatacaataccacccg

SEQ ID NO: 633306 - DNA, 25 bp, Homo sapien
ctgctactaatacaataccacccgg

SEQ ID NO: 633307 - DNA, 25 bp, Homo sapien
gctactaatacaataccacccggta

SEQ ID NO: 633308 - DNA, 25 bp, Homo sapien
ataccacccggtaagatgtctcgca

SEQ ID NO: 633309 - DNA, 25 bp, Homo sapien
cacccggtaagatgtctcgcacaat

SEQ ID NO: 633310 - DNA, 25 bp, Homo sapien
acccggtaagatgtctcgcacaata

SEQ ID NO: 633311 - DNA, 25 bp, Homo sapien
aagctggtggccagacctcctgtga

SEQ ID NO: 633312 - DNA, 25 bp, Homo sapien
tgtgacctccactcattgcctgtgt

SEQ ID NO: 633313 - DNA, 25 bp, Homo sapien
actcattgcctgtgtgtccaggtgg

SEQ ID NO: 633314 - DNA, 25 bp, Homo sapien
tcagctgccccgcttggcgttataa

SEQ ID NO: 633315 - DNA, 25 bp, Homo sapien
cccgcttggcgttataaccattgtg

SEQ ID NO: 633316 - DNA, 25 bp, Homo sapien
aaccattgtggtgttagccagggac

SEQ ID NO: 633317 - DNA, 25 bp, Homo sapien
tagccagggacgaggcttctgaagt

SEQ ID NO: 633318 - DNA, 25 bp, Homo sapien
tctgaagtagcctgcactgtgagcc

SEQ ID NO: 633319 - DNA, 25 bp, Homo sapien
agccccgctggctgccaggtaataa

SEQ ID NO: 633320 - DNA, 25 bp, Homo sapien
tttttctccaaggaacaggccttct

SEQ ID NO: 633321 - DNA, 25 bp, Homo sapien
caggccttctactttatacatggag

SEQ ID NO: 633322 - DNA, 25 bp, Homo sapien
atagatttttaggccgggcgaggtg

SEQ ID NO: 633323 - DNA, 25 bp, Homo sapien
tagatttttaggccgggcgaggtgg

SEQ ID NO: 633324 - DNA, 25 bp, Homo sapien
gatttttaggccgggcgaggtggct

SEQ ID NO: 633325 - DNA, 25 bp, Homo sapien
taggccgggcgaggtggctcgtgcc

SEQ ID NO: 633326 - DNA, 25 bp, Homo sapien
aggccgggcgaggtggctcgtgcct

SEQ ID NO: 633327 - DNA, 25 bp, Homo sapien
aattagctgggcgcggtggggggca

SEQ ID NO: 633328 - DNA, 25 bp, Homo sapien
attagctgggcgcggtggggggcac

SEQ ID NO: 633329 - DNA, 25 bp, Homo sapien
ttagctgggcgcggtggggggcacc

SEQ ID NO: 633330 - DNA, 25 bp, Homo sapien
gcgcggtggggggcacctgtagtac

SEQ ID NO: 633331 - DNA, 25 bp, Homo sapien
gcggtggggggcacctgtagtacca

SEQ ID NO: 633332 - DNA, 25 bp, Homo sapien
cggtggggggcacctgtagtaccag

SEQ ID NO: 633333 - DNA, 25 bp, Homo sapien
ggcctttgtttcagacatggttact

SEQ ID NO: 633334 - DNA, 25 bp, Homo sapien
cagacatggttactaatactttaag

SEQ ID NO: 633335 - DNA, 25 bp, Homo sapien
gcctaagtttttactctagattggc

SEQ ID NO: 633336 - DNA, 25 bp, Homo sapien
ttactctagattggctttcctttct

SEQ ID NO: 633337 - DNA, 25 bp, Homo sapien
tgcatgaaaatacgagactatgttt

SEQ ID NO: 633338 - DNA, 25 bp, Homo sapien
aacaaaagccatgaatcctctcctg

SEQ ID NO: 633339 - DNA, 25 bp, Homo sapien
atgaatcctctcctgtgacacaaat

SEQ ID NO: 633340 - DNA, 25 bp, Homo sapien
cctctcctgtgacacaaatgctcaa

SEQ ID NO: 633341 - DNA, 25 bp, Homo sapien
aaatgctcaacagctgactctatag

SEQ ID NO: 633342 - DNA, 25 bp, Homo sapien
agctgactctatagcgatggccttt

SEQ ID NO: 633343 - DNA, 25 bp, Homo sapien
ctctatagcgatggcctttgtttca

SEQ ID NO: 633344 - DNA, 25 bp, Homo sapien
gttgggcatggcggcaggcacttgt

SEQ ID NO: 633345 - DNA, 25 bp, Homo sapien
ttgggcatggcggcaggcacttgta

SEQ ID NO: 633346 - DNA, 25 bp, Homo sapien
tgggcatggcggcaggcacttgtaa

SEQ ID NO: 633347 - DNA, 25 bp, Homo sapien
catggcggcaggcacttgtaatcct

SEQ ID NO: 633348 - DNA, 25 bp, Homo sapien
atggcggcaggcacttgtaatccta

SEQ ID NO: 633349 - DNA, 25 bp, Homo sapien
tggcggcaggcacttgtaatcctag

SEQ ID NO: 633350 - DNA, 25 bp, Homo sapien
gcggcaggcacttgtaatcctagct

SEQ ID NO: 633351 - DNA, 25 bp, Homo sapien
cggcaggcacttgtaatcctagcta

SEQ ID NO: 633352 - DNA, 25 bp, Homo sapien
tctagcctggacaagaagagtgaga

SEQ ID NO: 633353 - DNA, 25 bp, Homo sapien
ctagcctggacaagaagagtgagac

SEQ ID NO: 633354 - DNA, 25 bp, Homo sapien
tagcctggacaagaagagtgagact

SEQ ID NO: 633355 - DNA, 25 bp, Homo sapien
ttatcctgttattcactcacttctg

SEQ ID NO: 633356 - DNA, 25 bp, Homo sapien
ctgttattcactcacttctgtgaag

SEQ ID NO: 633357 - DNA, 25 bp, Homo sapien
cacttctgtgaagatactttagtat

SEQ ID NO: 633358 - DNA, 25 bp, Homo sapien
ctttagtattttcttctgctaccat

SEQ ID NO: 633359 - DNA, 25 bp, Homo sapien
tctgctaccattactcacttgttaa

SEQ ID NO: 633360 - DNA, 25 bp, Homo sapien
cattactcacttgttaaatctctag

SEQ ID NO: 633361 - DNA, 25 bp, Homo sapien
gttaaatctctagtttacagctata

SEQ ID NO: 633362 - DNA, 25 bp, Homo sapien
ttttgattgccgaatagtattacag

SEQ ID NO: 633363 - DNA, 25 bp, Homo sapien
gacttaaaatgtttccctgtgagaa

SEQ ID NO: 633364 - DNA, 25 bp, Homo sapien
gtttccctgtgagaactgatatgaa

SEQ ID NO: 633365 - DNA, 25 bp, Homo sapien
gcctcaatataatgctgtttgcctg

SEQ ID NO: 633366 - DNA, 25 bp, Homo sapien
gaaagcagcatagtccagcagtaat

SEQ ID NO: 633367 - DNA, 25 bp, Homo sapien
gcagcatagtccagcagtaatgaat

SEQ ID NO: 633368 - DNA, 25 bp, Homo sapien
gtccagcagtaatgaatatagtccc

SEQ ID NO: 633369 - DNA, 25 bp, Homo sapien
tgaatatagtccctacagtcagatc

SEQ ID NO: 633370 - DNA, 25 bp, Homo sapien
ggatgttatacagtgtcttcccctg

SEQ ID NO: 633371 - DNA, 25 bp, Homo sapien
tatacagtgtcttcccctgtttcaa

SEQ ID NO: 633372 - DNA, 25 bp, Homo sapien
agtgtcttcccctgtttcaagtgca

SEQ ID NO: 633373 - DNA, 25 bp, Homo sapien
tcttcccctgtttcaagtgcagcgt

SEQ ID NO: 633374 - DNA, 25 bp, Homo sapien
cctgtttcaagtgcagcgtgctatt

SEQ ID NO: 633375 - DNA, 25 bp, Homo sapien
gtttcaagtgcagcgtgctattttt

SEQ ID NO: 633376 - DNA, 25 bp, Homo sapien
caagtgcagcgtgctatttttaaaa

SEQ ID NO: 633377 - DNA, 25 bp, Homo sapien
ataatcacccttgaacggtctcttg

SEQ ID NO: 633378 - DNA, 25 bp, Homo sapien
acccttgaacggtctcttggtcaat

SEQ ID NO: 633379 - DNA, 25 bp, Homo sapien
gaacggtctcttggtcaatgacaac

SEQ ID NO: 633380 - DNA, 25 bp, Homo sapien
ggtctcttggtcaatgacaacttaa

SEQ ID NO: 633381 - DNA, 25 bp, Homo sapien
gggaggcacagaatagcctttaaaa

SEQ ID NO: 633382 - DNA, 25 bp, Homo sapien
tagcctttaaaagcaagagccaaat

SEQ ID NO: 633383 - DNA, 25 bp, Homo sapien
gggacagcatattcagttaacttat

SEQ ID NO: 633384 - DNA, 25 bp, Homo sapien
gcaacagtgaattacatgcattccc

SEQ ID NO: 633385 - DNA, 25 bp, Homo sapien
gaattacatgcattccctatctggc

SEQ ID NO: 633386 - DNA, 25 bp, Homo sapien
atgcattccctatctggcagagaca

SEQ ID NO: 633387 - DNA, 25 bp, Homo sapien
atctggcagagacatcacttggaaa

SEQ ID NO: 633388 - DNA, 25 bp, Homo sapien
aggcattctcccaaggcctggcaga

SEQ ID NO: 633389 - DNA, 25 bp, Homo sapien
tataggaagcaggatctgctcctga

SEQ ID NO: 633390 - DNA, 25 bp, Homo sapien
gtgctgccgcccagacaatgaggaa

SEQ ID NO: 633391 - DNA, 25 bp, Homo sapien
gaagccagctgggatagctagaaac

SEQ ID NO: 633392 - DNA, 25 bp, Homo sapien
aaatctcagcatcaagtgcttatct

SEQ ID NO: 633393 - DNA, 25 bp, Homo sapien
gtgcttatctatgtcttcaatctgt

SEQ ID NO: 633394 - DNA, 25 bp, Homo sapien
ttcaatctgtcacatttggctccga

SEQ ID NO: 633395 - DNA, 25 bp, Homo sapien
tcacatttggctccgactccttttt

SEQ ID NO: 633396 - DNA, 25 bp, Homo sapien
actcctttttctcatgcatctatta

SEQ ID NO: 633397 - DNA, 25 bp, Homo sapien
aaatgtttcattcagcaatagctta

SEQ ID NO: 633398 - DNA, 25 bp, Homo sapien
agcttagaatctcatgcccattata

SEQ ID NO: 633399 - DNA, 25 bp, Homo sapien
tctcagtgaggccttgtatcaccac

SEQ ID NO: 633400 - DNA, 25 bp, Homo sapien
tgtatcaccaccctaactaaaatta

SEQ ID NO: 633401 - DNA, 25 bp, Homo sapien
ttattccttgtcttacatctccctg

SEQ ID NO: 633402 - DNA, 25 bp, Homo sapien
tctccctgcttattttgttcttagc

SEQ ID NO: 633403 - DNA, 25 bp, Homo sapien
tgttcttagcattcaccattttctt

SEQ ID NO: 633404 - DNA, 25 bp, Homo sapien
attttcttatgtgcaacgtgtttgt

SEQ ID NO: 633405 - DNA, 25 bp, Homo sapien
caggaatcagatttttgcccttatt

SEQ ID NO: 633406 - DNA, 25 bp, Homo sapien
aaaattactgtatccctggtgctta

SEQ ID NO: 633407 - DNA, 25 bp, Homo sapien
atccctggtgcttagaagaatgcct

SEQ ID NO: 633408 - DNA, 25 bp, Homo sapien
tgcctggctcagtagttatatttgt

SEQ ID NO: 633409 - DNA, 25 bp, Homo sapien
aatgaatgatgctccatgaatgata

SEQ ID NO: 633410 - DNA, 25 bp, Homo sapien
agctgagctgttgtaaaattgtgga

SEQ ID NO: 633411 - DNA, 25 bp, Homo sapien
gagctgttgtaaaattgtggaattc

SEQ ID NO: 633412 - DNA, 25 bp, Homo sapien
attgtggaattcacattggatattc

SEQ ID NO: 633413 - DNA, 25 bp, Homo sapien
atttcttactattaatgacaaccaa

SEQ ID NO: 633414 - DNA, 25 bp, Homo sapien
gacaaccaatagttatggatatttc

SEQ ID NO: 633415 - DNA, 25 bp, Homo sapien
aacatgacactaataagctcaataa

SEQ ID NO: 633416 - DNA, 25 bp, Homo sapien
ctcaataaatgtttggcctgtctag

SEQ ID NO: 633417 - DNA, 25 bp, Homo sapien
aaaaatctaagacctgtatatcaaa

SEQ ID NO: 633418 - DNA, 25 bp, Homo sapien
tctaagacctgtatatcaaattttg

SEQ ID NO: 633419 - DNA, 25 bp, Homo sapien
gtacctcaatagttacatttatcaa

SEQ ID NO: 633420 - DNA, 25 bp, Homo sapien
acatttatcaaaaagctgagctgtt

SEQ ID NO: 633421 - DNA, 25 bp, Homo sapien
aggtgccagccagtttagttcctag

SEQ ID NO: 633422 - DNA, 25 bp, Homo sapien
gccagtttagttcctagtgagcagc

SEQ ID NO: 633423 - DNA, 25 bp, Homo sapien
tgtagacggttgctttctcctgtat

SEQ ID NO: 633424 - DNA, 25 bp, Homo sapien
tctcctgtatcctcatgtggccttt

SEQ ID NO: 633425 - DNA, 25 bp, Homo sapien
tttccttcctgtgtgcgcgcagaga

SEQ ID NO: 633426 - DNA, 25 bp, Homo sapien
agagggatctccctctctatttcgt

SEQ ID NO: 633427 - DNA, 25 bp, Homo sapien
tatttcgtcttatttggcctctcaa

SEQ ID NO: 633428 - DNA, 25 bp, Homo sapien
ttggcctctcaatttattacattag

SEQ ID NO: 633429 - DNA, 25 bp, Homo sapien
gaacgtctacctttatgagctcatt

SEQ ID NO: 633430 - DNA, 25 bp, Homo sapien
tacctcttaaaagctctatctctaa

SEQ ID NO: 633431 - DNA, 25 bp, Homo sapien
gggtgacacaatagcccatggcaca

SEQ ID NO: 633432 - DNA, 25 bp, Homo sapien
attctgcaaactttatttcgcccga

SEQ ID NO: 633433 - DNA, 25 bp, Homo sapien
tatttcgcccgaactatcagggtgt

SEQ ID NO: 633434 - DNA, 25 bp, Homo sapien
gtgtgtgatggcaagctgtcctacc

SEQ ID NO: 633435 - DNA, 25 bp, Homo sapien
gcaagctgtcctaccggtggtgctg

SEQ ID NO: 633436 - DNA, 25 bp, Homo sapien
gtgctggcctcttgtggatacattc

SEQ ID NO: 633437 - DNA, 25 bp, Homo sapien
aaacctctggattctgtatgctgtg

SEQ ID NO: 633438 - DNA, 25 bp, Homo sapien
gaaaaactccaatatacgtgactgt

SEQ ID NO: 633439 - DNA, 25 bp, Homo sapien
gactgtatttagcaccttattgtac

SEQ ID NO: 633440 - DNA, 25 bp, Homo sapien
attgtactatacattggcacctgtg

SEQ ID NO: 633441 - DNA, 25 bp, Homo sapien
ttggcacctgtgtcagcagactggg

SEQ ID NO: 633442 - DNA, 25 bp, Homo sapien
tcctttcacttgctacacttgggaa

SEQ ID NO: 633443 - DNA, 25 bp, Homo sapien
caatccatatgttaaagccctaccc

SEQ ID NO: 633444 - DNA, 25 bp, Homo sapien
taccccaccccaatatgttggtatt

SEQ ID NO: 633445 - DNA, 25 bp, Homo sapien
caccccaatatgttggtatttggag

SEQ ID NO: 633446 - DNA, 25 bp, Homo sapien
tgggtcccccatggcgagattagtg

SEQ ID NO: 633447 - DNA, 25 bp, Homo sapien
acaacgaagagcttgttctcctctg

SEQ ID NO: 633448 - DNA, 25 bp, Homo sapien
acgaagagcttgttctcctctgtgt

SEQ ID NO: 633449 - DNA, 25 bp, Homo sapien
gcaagaaggggctttcacctggaac

SEQ ID NO: 633450 - DNA, 25 bp, Homo sapien
aaactgccccatctttatctgggac

SEQ ID NO: 633451 - DNA, 25 bp, Homo sapien
atctttatctgggacttagcctcca

SEQ ID NO: 633452 - DNA, 25 bp, Homo sapien
tgggacttagcctccagaattgaga

SEQ ID NO: 633453 - DNA, 25 bp, Homo sapien
ggacttagcctccagaattgagaga

SEQ ID NO: 633454 - DNA, 25 bp, Homo sapien
actggtgtgtctcataagtgacttc

SEQ ID NO: 633455 - DNA, 25 bp, Homo sapien
aagtgacttctacccgggagccgtg

SEQ ID NO: 633456 - DNA, 25 bp, Homo sapien
cttctacccgggagccgtgacagtg

SEQ ID NO: 633457 - DNA, 25 bp, Homo sapien
ttctacccgggagccgtgacagtgg

SEQ ID NO: 633458 - DNA, 25 bp, Homo sapien
tctacccgggagccgtgacagtggc

SEQ ID NO: 633459 - DNA, 25 bp, Homo sapien
acccgggagccgtgacagtggcctg

SEQ ID NO: 633460 - DNA, 25 bp, Homo sapien
ggagcaaccgtaggagaagcacagt

SEQ ID NO: 633461 - DNA, 25 bp, Homo sapien
gagcaaccgtaggagaagcacagtt

SEQ ID NO: 633462 - DNA, 25 bp, Homo sapien
ggagaagcacagttgggcccttacc

SEQ ID NO: 633463 - DNA, 25 bp, Homo sapien
gagaagcacagttgggcccttacca

SEQ ID NO: 633464 - DNA, 25 bp, Homo sapien
agaagcacagttgggcccttaccag

SEQ ID NO: 633465 - DNA, 25 bp, Homo sapien
gtttatcaccgcaagagctaccatt

SEQ ID NO: 633466 - DNA, 25 bp, Homo sapien
tatcaccgcaagagctaccattcat

SEQ ID NO: 633467 - DNA, 25 bp, Homo sapien
accgcaagagctaccattcatctag

SEQ ID NO: 633468 - DNA, 25 bp, Homo sapien
aagagctaccattcatctagcacaa

SEQ ID NO: 633469 - DNA, 25 bp, Homo sapien
taccattcatctagcacaacctgac

SEQ ID NO: 633470 - DNA, 25 bp, Homo sapien
attcatctagcacaacctgaccatc

SEQ ID NO: 633471 - DNA, 25 bp, Homo sapien
aacctgaccatcctcacactggtca

SEQ ID NO: 633472 - DNA, 25 bp, Homo sapien
tgttgactggctgtggcacctcaag

SEQ ID NO: 633473 - DNA, 25 bp, Homo sapien
gactggctgtggcacctcaagcagc

SEQ ID NO: 633474 - DNA, 25 bp, Homo sapien
tctagcctcagtttatcaccgcaag

SEQ ID NO: 633475 - DNA, 25 bp, Homo sapien
agcctcagtttatcaccgcaagagc

SEQ ID NO: 633476 - DNA, 25 bp, Homo sapien
tcacctaaggccaggagttccagat

SEQ ID NO: 633477 - DNA, 25 bp, Homo sapien
cacctaaggccaggagttccagatc

SEQ ID NO: 633478 - DNA, 25 bp, Homo sapien
acctaaggccaggagttccagatca

SEQ ID NO: 633479 - DNA, 25 bp, Homo sapien
cctaaggccaggagttccagatcag

SEQ ID NO: 633480 - DNA, 25 bp, Homo sapien
ctaaggccaggagttccagatcagc

SEQ ID NO: 633481 - DNA, 25 bp, Homo sapien
taaggccaggagttccagatcagcc

SEQ ID NO: 633482 - DNA, 25 bp, Homo sapien
aaattagctgggcttggtgtggggg

SEQ ID NO: 633483 - DNA, 25 bp, Homo sapien
gtgtgggggggcctgtaacccagct

SEQ ID NO: 633484 - DNA, 25 bp, Homo sapien
tgtgggggggcctgtaacccagcta

SEQ ID NO: 633485 - DNA, 25 bp, Homo sapien
tgggggggcctgtaacccagctact

SEQ ID NO: 633486 - DNA, 25 bp, Homo sapien
attgcttgaactagagaggcggagg

SEQ ID NO: 633487 - DNA, 25 bp, Homo sapien
atgagctaatgagcagtgtgggttt

SEQ ID NO: 633488 - DNA, 25 bp, Homo sapien
gggttttggagttggttgaattcat

SEQ ID NO: 633489 - DNA, 25 bp, Homo sapien
caaaaagatagtctggcatgtggta

SEQ ID NO: 633490 - DNA, 25 bp, Homo sapien
gaagggcatgggatgttctatcaac

SEQ ID NO: 633491 - DNA, 25 bp, Homo sapien
ggatgttctatcaacgataagctga

SEQ ID NO: 633492 - DNA, 25 bp, Homo sapien
gctgaatgcttagcaacaggtgctt

SEQ ID NO: 633493 - DNA, 25 bp, Homo sapien
gcaacaggtgctttaccgggtagaa

SEQ ID NO: 633494 - DNA, 25 bp, Homo sapien
atatccagataaggcaatgaattgt

SEQ ID NO: 633495 - DNA, 25 bp, Homo sapien
gaattgtgaaatcctaagtttgtaa

SEQ ID NO: 633496 - DNA, 25 bp, Homo sapien
gtttgtaaatgacaccacttttttg

SEQ ID NO: 633497 - DNA, 25 bp, Homo sapien
gtgtccttaaatgatgagctaatga

SEQ ID NO: 633498 - DNA, 25 bp, Homo sapien
aggataaaaacaaagcaggctgagt

SEQ ID NO: 633499 - DNA, 25 bp, Homo sapien
ggataaaaacaaagcaggctgagtg

SEQ ID NO: 633500 - DNA, 25 bp, Homo sapien
gataaaaacaaagcaggctgagtgc

SEQ ID NO: 633501 - DNA, 25 bp, Homo sapien
ataaaaacaaagcaggctgagtgca

SEQ ID NO: 633502 - DNA, 25 bp, Homo sapien
aaaaacaaagcaggctgagtgcagt

SEQ ID NO: 633503 - DNA, 25 bp, Homo sapien
tgagccgtgagtatgccactactct

SEQ ID NO: 633504 - DNA, 25 bp, Homo sapien
gagccgtgagtatgccactactctc

SEQ ID NO: 633505 - DNA, 25 bp, Homo sapien
agccgtgagtatgccactactctcc

SEQ ID NO: 633506 - DNA, 25 bp, Homo sapien
ccgtgagtatgccactactctccaa

SEQ ID NO: 633507 - DNA, 25 bp, Homo sapien
cgtgagtatgccactactctccaac

SEQ ID NO: 633508 - DNA, 25 bp, Homo sapien
agtatgccactactctccaacctgg

SEQ ID NO: 633509 - DNA, 25 bp, Homo sapien
aatactatgcaataacaggaattta

SEQ ID NO: 633510 - DNA, 25 bp, Homo sapien
ataccactttcctcaaaatatgctt

SEQ ID NO: 633511 - DNA, 25 bp, Homo sapien
ctgcacaagatttccccatattgct

SEQ ID NO: 633512 - DNA, 25 bp, Homo sapien
acaagatttccccatattgctacct

SEQ ID NO: 633513 - DNA, 25 bp, Homo sapien
aagatttccccatattgctacctag

SEQ ID NO: 633514 - DNA, 25 bp, Homo sapien
gatttccccatattgctacctagaa

SEQ ID NO: 633515 - DNA, 25 bp, Homo sapien
tttccccatattgctacctagaaat

SEQ ID NO: 633516 - DNA, 25 bp, Homo sapien
gctacctagaaatctaacaatgaag

SEQ ID NO: 633517 - DNA, 25 bp, Homo sapien
tgggggtcacgatgaaaacatttgt

SEQ ID NO: 633518 - DNA, 25 bp, Homo sapien
atttgcattaaaagccactttaaag

SEQ ID NO: 633519 - DNA, 25 bp, Homo sapien
gccactttaaagcagactttaggca

SEQ ID NO: 633520 - DNA, 25 bp, Homo sapien
ggtacatgaaaaacagtgtgccata

SEQ ID NO: 633521 - DNA, 25 bp, Homo sapien
taaaagatggtgacgacagtgaggt

SEQ ID NO: 633522 - DNA, 25 bp, Homo sapien
aatgctctgcacttgccctcggaag

SEQ ID NO: 633523 - DNA, 25 bp, Homo sapien
acttgccctcggaagactggatttt

SEQ ID NO: 633524 - DNA, 25 bp, Homo sapien
aaggagggacccagtgagatttact

SEQ ID NO: 633525 - DNA, 25 bp, Homo sapien
gacccagtgagatttactgcagaga

SEQ ID NO: 633526 - DNA, 25 bp, Homo sapien
cagagaagatcatgagctgcttttc

SEQ ID NO: 633527 - DNA, 25 bp, Homo sapien
agactactttgtttggcttccatga

SEQ ID NO: 633528 - DNA, 25 bp, Homo sapien
gcttccatgaattccccgcttttgg

SEQ ID NO: 633529 - DNA, 25 bp, Homo sapien
aattccccgcttttggttgctgcag

SEQ ID NO: 633530 - DNA, 25 bp, Homo sapien
gcttttggttgctgcaggtacatga

SEQ ID NO: 633531 - DNA, 25 bp, Homo sapien
aatgggagagtaatgcctgcaccac

SEQ ID NO: 633532 - DNA, 25 bp, Homo sapien
tgggagagtaatgcctgcaccacag

SEQ ID NO: 633533 - DNA, 25 bp, Homo sapien
ggaataaagcacataggccacgggt

SEQ ID NO: 633534 - DNA, 25 bp, Homo sapien
cataggccacgggtgaatgctcagt

SEQ ID NO: 633535 - DNA, 25 bp, Homo sapien
ggccacgggtgaatgctcagtaatt

SEQ ID NO: 633536 - DNA, 25 bp, Homo sapien
gggtgaatgctcagtaattgattgt

SEQ ID NO: 633537 - DNA, 25 bp, Homo sapien
gatcaacctgaaatacacattttgt

SEQ ID NO: 633538 - DNA, 25 bp, Homo sapien
tttgctagtgtaattattaagccta

SEQ ID NO: 633539 - DNA, 25 bp, Homo sapien
aattattcacttaatgggtactcca

SEQ ID NO: 633540 - DNA, 25 bp, Homo sapien
atgggtactccaagttatctaatga

SEQ ID NO: 633541 - DNA, 25 bp, Homo sapien
ggtactccaagttatctaatgaaat

SEQ ID NO: 633542 - DNA, 25 bp, Homo sapien
tagcattgtacctattcagcagtat

SEQ ID NO: 633543 - DNA, 25 bp, Homo sapien
tttgagagttatgtcccagccctgt

SEQ ID NO: 633544 - DNA, 25 bp, Homo sapien
tatgtcccagccctgtgtcatgttt

SEQ ID NO: 633545 - DNA, 25 bp, Homo sapien
ttatatgcagaggttgacttagtcc

SEQ ID NO: 633546 - DNA, 25 bp, Homo sapien
gacttagtcctcattatatagctga

SEQ ID NO: 633547 - DNA, 25 bp, Homo sapien
ttatatagctgagggaactgggtct

SEQ ID NO: 633548 - DNA, 25 bp, Homo sapien
gggtctagttcattaactacactaa

SEQ ID NO: 633549 - DNA, 25 bp, Homo sapien
taagttgtcacagagctaggatttg

SEQ ID NO: 633550 - DNA, 25 bp, Homo sapien
taattccctccctatattgtctcaa

SEQ ID NO: 633551 - DNA, 25 bp, Homo sapien
ctatattgtctcaaccacaggaaaa

SEQ ID NO: 633552 - DNA, 25 bp, Homo sapien
ctttgaaacctgattaactgagttc

SEQ ID NO: 633553 - DNA, 25 bp, Homo sapien
ggctttccataagatgcctcagcta

SEQ ID NO: 633554 - DNA, 25 bp, Homo sapien
agatgcctcagctataagctccatc

SEQ ID NO: 633555 - DNA, 25 bp, Homo sapien
acccttgaggtctgcagtccatttc

SEQ ID NO: 633556 - DNA, 25 bp, Homo sapien
atttcactgcttcctttccaaaggg

SEQ ID NO: 633557 - DNA, 25 bp, Homo sapien
ggtacatatttgcttctgtgctcag

SEQ ID NO: 633558 - DNA, 25 bp, Homo sapien
aagcctgatgaatcgggatggttcc

SEQ ID NO: 633559 - DNA, 25 bp, Homo sapien
gaatttcagtttcacaacctgggag

SEQ ID NO: 633560 - DNA, 25 bp, Homo sapien
tgggagaactgtcgccttgctcgat

SEQ ID NO: 633561 - DNA, 25 bp, Homo sapien
ttgctcgatgtattcccaagggttc

SEQ ID NO: 633562 - DNA, 25 bp, Homo sapien
caagggttcacctggccctgggatt

SEQ ID NO: 633563 - DNA, 25 bp, Homo sapien
tggccctgggattcaggcgtgccaa

SEQ ID NO: 633564 - DNA, 25 bp, Homo sapien
gcccctggtcactttttacagttag

SEQ ID NO: 633565 - DNA, 25 bp, Homo sapien
ggtcactttttacagttaggtatca

SEQ ID NO: 633566 - DNA, 25 bp, Homo sapien
cagttaggtatcactagagagacta

SEQ ID NO: 633567 - DNA, 25 bp, Homo sapien
gactaaatacccaacaggaaacatt

SEQ ID NO: 633568 - DNA, 25 bp, Homo sapien
tctcatttctattttcccatgatag

SEQ ID NO: 633569 - DNA, 25 bp, Homo sapien
tctattttcccatgatagataccga

SEQ ID NO: 633570 - DNA, 25 bp, Homo sapien
aggcaacagttcaagtccctctgaa

SEQ ID NO: 633571 - DNA, 25 bp, Homo sapien
agttcaagtccctctgaatccacag

SEQ ID NO: 633572 - DNA, 25 bp, Homo sapien
gaatccacagctacatgcacagctt

SEQ ID NO: 633573 - DNA, 25 bp, Homo sapien
gctacatgcacagcttcagagcaat

SEQ ID NO: 633574 - DNA, 25 bp, Homo sapien
acatgcacagcttcagagcaataca

SEQ ID NO: 633575 - DNA, 25 bp, Homo sapien
tcaagctggcccctcaataggagga

SEQ ID NO: 633576 - DNA, 25 bp, Homo sapien
gctggcccctcaataggaggaacat

SEQ ID NO: 633577 - DNA, 25 bp, Homo sapien
ggaggaacataccactctctcgtgg

SEQ ID NO: 633578 - DNA, 25 bp, Homo sapien
aagaagtgtgacatccttagggacg

SEQ ID NO: 633579 - DNA, 25 bp, Homo sapien
gacatccttagggacgatatcctcc

SEQ ID NO: 633580 - DNA, 25 bp, Homo sapien
ccttagggacgatatcctccagatt

SEQ ID NO: 633581 - DNA, 25 bp, Homo sapien
ccttttctgcccacatgaatagata

SEQ ID NO: 633582 - DNA, 25 bp, Homo sapien
tcttgcttttatttgtgactatccc

SEQ ID NO: 633583 - DNA, 25 bp, Homo sapien
tgtgactatcccatagacaatgcag

SEQ ID NO: 633584 - DNA, 25 bp, Homo sapien
tagacaatgcagatttctatagcaa

SEQ ID NO: 633585 - DNA, 25 bp, Homo sapien
gttcataatgatgcacttataagac

SEQ ID NO: 633586 - DNA, 25 bp, Homo sapien
gatccattggatccaattttatgtt

SEQ ID NO: 633587 - DNA, 25 bp, Homo sapien
cagtttctttcttgagtagttctat

SEQ ID NO: 633588 - DNA, 25 bp, Homo sapien
cttgagtagttctatttgtaaggat

SEQ ID NO: 633589 - DNA, 25 bp, Homo sapien
gtaaggattgatacttcataaattt

SEQ ID NO: 633590 - DNA, 25 bp, Homo sapien
gtcttggaattaccacatggatcca

SEQ ID NO: 633591 - DNA, 25 bp, Homo sapien
ggaattaccacatggatccagtgaa

SEQ ID NO: 633592 - DNA, 25 bp, Homo sapien
atggatccagtgaatcaacctaagt

SEQ ID NO: 633593 - DNA, 25 bp, Homo sapien
tcaacctaagttacattacaagatc

SEQ ID NO: 633594 - DNA, 25 bp, Homo sapien
aactaacttgtttttctatatcctg

SEQ ID NO: 633595 - DNA, 25 bp, Homo sapien
gaaacatttagcgatttcatcattc

SEQ ID NO: 633596 - DNA, 25 bp, Homo sapien
tagcgatttcatcattctaaaaatt

SEQ ID NO: 633597 - DNA, 25 bp, Homo sapien
ttatcctgttattcactcacttctg

SEQ ID NO: 633598 - DNA, 25 bp, Homo sapien
atcctgttattcactcacttctgtg

SEQ ID NO: 633599 - DNA, 25 bp, Homo sapien
ctgttattcactcacttctgtgaag

SEQ ID NO: 633600 - DNA, 25 bp, Homo sapien
ctttagtattttcttctgctaccat

SEQ ID NO: 633601 - DNA, 25 bp, Homo sapien
gctaccattactcacttgttaaatc

SEQ ID NO: 633602 - DNA, 25 bp, Homo sapien
cattactcacttgttaaatctctag

SEQ ID NO: 633603 - DNA, 25 bp, Homo sapien
gttaaatctctagtttacagctata

SEQ ID NO: 633604 - DNA, 25 bp, Homo sapien
ttttgattgccgaatagtattacag

SEQ ID NO: 633605 - DNA, 25 bp, Homo sapien
gattgccgaatagtattacagatga

SEQ ID NO: 633606 - DNA, 25 bp, Homo sapien
gtttccctgtgagaactgatatgaa

SEQ ID NO: 633607 - DNA, 25 bp, Homo sapien
gcctcaatataatgctgtttgcctg

SEQ ID NO: 633608 - DNA, 25 bp, Homo sapien
gggatacttacactttaatgcctaa

SEQ ID NO: 633609 - DNA, 25 bp, Homo sapien
aatgcctaatagaccctccaagaac

SEQ ID NO: 633610 - DNA, 25 bp, Homo sapien
aagaacagcagttaggtaagtctct

SEQ ID NO: 633611 - DNA, 25 bp, Homo sapien
ggtaagtctctgtgtattgcatagt

SEQ ID NO: 633612 - DNA, 25 bp, Homo sapien
taagtcaccacgcatggaaagcaat

SEQ ID NO: 633613 - DNA, 25 bp, Homo sapien
aatgcattccttccttttcagtcaa

SEQ ID NO: 633614 - DNA, 25 bp, Homo sapien
cagtcaattgtaatcatgagacctt

SEQ ID NO: 633615 - DNA, 25 bp, Homo sapien
gagaccttttagacttagccacaat

SEQ ID NO: 633616 - DNA, 25 bp, Homo sapien
gacttagccacaataaatcctattt

SEQ ID NO: 633617 - DNA, 25 bp, Homo sapien
caaatgttgttcctccaattttaat

SEQ ID NO: 633618 - DNA, 25 bp, Homo sapien
gtccctgtagatttgagagcagaaa

SEQ ID NO: 633619 - DNA, 25 bp, Homo sapien
caaggacccctgtatgttggggcgt

SEQ ID NO: 633620 - DNA, 25 bp, Homo sapien
gacccctgtatgttggggcgtgtcc

SEQ ID NO: 633621 - DNA, 25 bp, Homo sapien
aggcggccctccatggtgcccagca

SEQ ID NO: 633622 - DNA, 25 bp, Homo sapien
tgcttgcggaccctctttagtcccc

SEQ ID NO: 633623 - DNA, 25 bp, Homo sapien
ttgcggaccctctttagtccccact

SEQ ID NO: 633624 - DNA, 25 bp, Homo sapien
gcggaccctctttagtccccactgt

SEQ ID NO: 633625 - DNA, 25 bp, Homo sapien
ttcagtgaaaattgacactagctgg

SEQ ID NO: 633626 - DNA, 25 bp, Homo sapien
tcagtgaaaattgacactagctggg

SEQ ID NO: 633627 - DNA, 25 bp, Homo sapien
cagtgaaaattgacactagctgggc

SEQ ID NO: 633628 - DNA, 25 bp, Homo sapien
agtgaaaattgacactagctgggca

SEQ ID NO: 633629 - DNA, 25 bp, Homo sapien
gtgaaaattgacactagctgggcat

SEQ ID NO: 633630 - DNA, 25 bp, Homo sapien
atcaaactaagctgtgttcccatcc

SEQ ID NO: 633631 - DNA, 25 bp, Homo sapien
acaggatcttatggtgctttagccc

SEQ ID NO: 633632 - DNA, 25 bp, Homo sapien
tgctttagcccaggacgtcaagtat

SEQ ID NO: 633633 - DNA, 25 bp, Homo sapien
gacgtcaagtatcccctaggtatga

SEQ ID NO: 633634 - DNA, 25 bp, Homo sapien
ggagcatgctttgaaggtccctcag

SEQ ID NO: 633635 - DNA, 25 bp, Homo sapien
gtccctcagctacatgcagactaga

SEQ ID NO: 633636 - DNA, 25 bp, Homo sapien
gactagactgcatgtagctgactct

SEQ ID NO: 633637 - DNA, 25 bp, Homo sapien
agctgactctaactgccctgggaaa

SEQ ID NO: 633638 - DNA, 25 bp, Homo sapien
tgggaaactatcctgagctttgaca

SEQ ID NO: 633639 - DNA, 25 bp, Homo sapien
gagctttgacagacctgccatgaat

SEQ ID NO: 633640 - DNA, 25 bp, Homo sapien
ttaagcttttattgtcccttgctgc

SEQ ID NO: 633641 - DNA, 25 bp, Homo sapien
ggcgtgggtgtgtccaggccctggc

SEQ ID NO: 633642 - DNA, 25 bp, Homo sapien
ggagttgaccctctccggaaggctt

SEQ ID NO: 633643 - DNA, 25 bp, Homo sapien
accctctccggaaggcttctggaag

SEQ ID NO: 633644 - DNA, 25 bp, Homo sapien
gaagcacagctgagtggcatgggta

SEQ ID NO: 633645 - DNA, 25 bp, Homo sapien
ggctggctactgcaaggtcctctca

SEQ ID NO: 633646 - DNA, 25 bp, Homo sapien
ggctactgcaaggtcctctcaggac

SEQ ID NO: 633647 - DNA, 25 bp, Homo sapien
tcagcctgcctctgtcccagttaga

SEQ ID NO: 633648 - DNA, 25 bp, Homo sapien
tctgtcccagttagacctcagagac

SEQ ID NO: 633649 - DNA, 25 bp, Homo sapien
gtcccagttagacctcagagacaca

SEQ ID NO: 633650 - DNA, 25 bp, Homo sapien
tagacctcagagacacagaggccag

SEQ ID NO: 633651 - DNA, 25 bp, Homo sapien
gacacagaggccagaaatacttctt

SEQ ID NO: 633652 - DNA, 25 bp, Homo sapien
gtgggcccaacagggtttgcacctt

SEQ ID NO: 633653 - DNA, 25 bp, Homo sapien
gcccaacagggtttgcaccttatat

SEQ ID NO: 633654 - DNA, 25 bp, Homo sapien
cagggtttgcaccttatataaaact

SEQ ID NO: 633655 - DNA, 25 bp, Homo sapien
acttattctgaactacaatggctta

SEQ ID NO: 633656 - DNA, 25 bp, Homo sapien
caatggcttaagtgtcttggtactg

SEQ ID NO: 633657 - DNA, 25 bp, Homo sapien
aagtgtcttggtactgttattttag

SEQ ID NO: 633658 - DNA, 25 bp, Homo sapien
tagttactctagttaattcttatta

SEQ ID NO: 633659 - DNA, 25 bp, Homo sapien
agccttttccttctcaggtgaaaga

SEQ ID NO: 633660 - DNA, 25 bp, Homo sapien
ttccaagagtctcctgtcataagag

SEQ ID NO: 633661 - DNA, 25 bp, Homo sapien
gagtctcctgtcataagagtttaaa

SEQ ID NO: 633662 - DNA, 25 bp, Homo sapien
atttatcaatggagagattacgtca

SEQ ID NO: 633663 - DNA, 25 bp, Homo sapien
acaagcaccgtgagctgcgtggtct

SEQ ID NO: 633664 - DNA, 25 bp, Homo sapien
tgcgtggtctcacctctgcaggaaa

SEQ ID NO: 633665 - DNA, 25 bp, Homo sapien
agaaattccgtggtctgcgtggcaa

SEQ ID NO: 633666 - DNA, 25 bp, Homo sapien
ggaagaggaaccagaccgtctccct

SEQ ID NO: 633667 - DNA, 25 bp, Homo sapien
gccgctaccgttaagcttacgtggt

SEQ ID NO: 633668 - DNA, 25 bp, Homo sapien
tacgtggtgttatgtcctgtggaac

SEQ ID NO: 633669 - DNA, 25 bp, Homo sapien
gtggaacctgtcctatgctggagtc

SEQ ID NO: 633670 - DNA, 25 bp, Homo sapien
atgctggagtcttttccaccgtcaa

SEQ ID NO: 633671 - DNA, 25 bp, Homo sapien
caaattttgctacctttctgtggct

SEQ ID NO: 633672 - DNA, 25 bp, Homo sapien
tttctgtggctgaacgtccaggcat

SEQ ID NO: 633673 - DNA, 25 bp, Homo sapien
ggcatgcctgttgaactatttgcta

SEQ ID NO: 633674 - DNA, 25 bp, Homo sapien
atctacctcacctcagaaggcagaa

SEQ ID NO: 633675 - DNA, 25 bp, Homo sapien
acagagtggcgagtccttgtctagt

SEQ ID NO: 633676 - DNA, 25 bp, Homo sapien
agtggcgagtccttgtctagtacag

SEQ ID NO: 633677 - DNA, 25 bp, Homo sapien
gagtccttgtctagtacagccctgg

SEQ ID NO: 633678 - DNA, 25 bp, Homo sapien
ttgtctagtacagccctgggaactc

SEQ ID NO: 633679 - DNA, 25 bp, Homo sapien
ctgggaactcctgaacggcgcaagg

SEQ ID NO: 633680 - DNA, 25 bp, Homo sapien
tcctgaacggcgcaagggcagttta

SEQ ID NO: 633681 - DNA, 25 bp, Homo sapien
tgaacggcgcaagggcagtttagct

SEQ ID NO: 633682 - DNA, 25 bp, Homo sapien
gcagtttagctgatgttgttgacac

SEQ ID NO: 633683 - DNA, 25 bp, Homo sapien
ttagctgatgttgttgacaccttga

SEQ ID NO: 633684 - DNA, 25 bp, Homo sapien
agagctcatcaaaaacgagccggaa

SEQ ID NO: 633685 - DNA, 25 bp, Homo sapien
ttctcacctatgctatttcactatc

SEQ ID NO: 633686 - DNA, 25 bp, Homo sapien
tatttcactatctttccagctgttc

SEQ ID NO: 633687 - DNA, 25 bp, Homo sapien
tgttctttctactttataataccct

SEQ ID NO: 633688 - DNA, 25 bp, Homo sapien
tataataccctccatacaaaaccca

SEQ ID NO: 633689 - DNA, 25 bp, Homo sapien
aaaacccactgtgccatcggaagga

SEQ ID NO: 633690 - DNA, 25 bp, Homo sapien
gtgccatcggaaggatcttttaaaa

SEQ ID NO: 633691 - DNA, 25 bp, Homo sapien
aaatatagctctagccacgtcactc

SEQ ID NO: 633692 - DNA, 25 bp, Homo sapien
agtgacttctcattgctataggatt

SEQ ID NO: 633693 - DNA, 25 bp, Homo sapien
ggattaaattcgcagtcacctcaac

SEQ ID NO: 633694 - DNA, 25 bp, Homo sapien
agtcacctcaacctatgttttcagc

SEQ ID NO: 633695 - DNA, 25 bp, Homo sapien
ttttcagccagcctgctttcttcac

SEQ ID NO: 633696 - DNA, 25 bp, Homo sapien
gaagtaggaggatcaatcaagcccg

SEQ ID NO: 633697 - DNA, 25 bp, Homo sapien
agtaggaggatcaatcaagcccggg

SEQ ID NO: 633698 - DNA, 25 bp, Homo sapien
tcaagatctggcagactgccttaca

SEQ ID NO: 633699 - DNA, 25 bp, Homo sapien
gatctggcagactgccttacatcat

SEQ ID NO: 633700 - DNA, 25 bp, Homo sapien
tggcagactgccttacatcatggct

SEQ ID NO: 633701 - DNA, 25 bp, Homo sapien
gcagactgccttacatcatggctca

SEQ ID NO: 633702 - DNA, 25 bp, Homo sapien
agactgccttacatcatggctcatg

SEQ ID NO: 633703 - DNA, 25 bp, Homo sapien
gactgccttacatcatggctcatgc

SEQ ID NO: 633704 - DNA, 25 bp, Homo sapien
gaggccgaggtttgcttgcttaagc

SEQ ID NO: 633705 - DNA, 25 bp, Homo sapien
ggccgaggtttgcttgcttaagccc

SEQ ID NO: 633706 - DNA, 25 bp, Homo sapien
ccgaggtttgcttgcttaagcccag

SEQ ID NO: 633707 - DNA, 25 bp, Homo sapien
gaagtgtagcatagaaaccccgcct

SEQ ID NO: 633708 - DNA, 25 bp, Homo sapien
aagtgtagcatagaaaccccgcctg

SEQ ID NO: 633709 - DNA, 25 bp, Homo sapien
agtgtagcatagaaaccccgcctgc

SEQ ID NO: 633710 - DNA, 25 bp, Homo sapien
gtgtagcatagaaaccccgcctgct

SEQ ID NO: 633711 - DNA, 25 bp, Homo sapien
tgtagcatagaaaccccgcctgctg

SEQ ID NO: 633712 - DNA, 25 bp, Homo sapien
gtagcatagaaaccccgcctgctgg

SEQ ID NO: 633713 - DNA, 25 bp, Homo sapien
tagaaaccccgcctgctggctgtgg

SEQ ID NO: 633714 - DNA, 25 bp, Homo sapien
agaaaccccgcctgctggctgtgga

SEQ ID NO: 633715 - DNA, 25 bp, Homo sapien
gaaaccccgcctgctggctgtggaa

SEQ ID NO: 633716 - DNA, 25 bp, Homo sapien
cgcctgctggctgtggaacagaaat

SEQ ID NO: 633717 - DNA, 25 bp, Homo sapien
tggctgtggaacagaaataaactcc

SEQ ID NO: 633718 - DNA, 25 bp, Homo sapien
ctcttgtctaattgacttcaaagat

SEQ ID NO: 633719 - DNA, 25 bp, Homo sapien
caaagatactgtgtaatgctgctgc

SEQ ID NO: 633720 - DNA, 25 bp, Homo sapien
tactgtgtaatgctgctgcactcat

SEQ ID NO: 633721 - DNA, 25 bp, Homo sapien
ctgtgtaatgctgctgcactcatac

SEQ ID NO: 633722 - DNA, 25 bp, Homo sapien
tgtgtaatgctgctgcactcataca

SEQ ID NO: 633723 - DNA, 25 bp, Homo sapien
tgtaatgctgctgcactcatacacc

SEQ ID NO: 633724 - DNA, 25 bp, Homo sapien
taatgctgctgcactcatacaccca

SEQ ID NO: 633725 - DNA, 25 bp, Homo sapien
atacacccacccacacttacatcta

SEQ ID NO: 633726 - DNA, 25 bp, Homo sapien
atgcagtccgcgtccacgcttacac

SEQ ID NO: 633727 - DNA, 25 bp, Homo sapien
acgcccacacttacactcatgctta

SEQ ID NO: 633728 - DNA, 25 bp, Homo sapien
actcatgcttacatctacctccacg

SEQ ID NO: 633729 - DNA, 25 bp, Homo sapien
gagaaacaactgacctccccacaaa

SEQ ID NO: 633730 - DNA, 25 bp, Homo sapien
ctccccacaaaatctaacttcaatt

SEQ ID NO: 633731 - DNA, 25 bp, Homo sapien
aacttcaattaactatctaaggatg

SEQ ID NO: 633732 - DNA, 25 bp, Homo sapien
attcagtgtttctcacattaaagga

SEQ ID NO: 633733 - DNA, 25 bp, Homo sapien
tctcacattaaaggagttcagaatc

SEQ ID NO: 633734 - DNA, 25 bp, Homo sapien
gttcagaatcatgctctggctgtaa

SEQ ID NO: 633735 - DNA, 25 bp, Homo sapien
atcatgctctggctgtaacaggaat

SEQ ID NO: 633736 - DNA, 25 bp, Homo sapien
tctggctgtaacaggaatgagcaca

SEQ ID NO: 633737 - DNA, 25 bp, Homo sapien
gaatgagcacagagcacttcatgtt

SEQ ID NO: 633738 - DNA, 25 bp, Homo sapien
acagagcacttcatgttagctgttt

SEQ ID NO: 633739 - DNA, 25 bp, Homo sapien
aacgcatgagttttttatttgagga

SEQ ID NO: 633740 - DNA, 25 bp, Homo sapien
acatgcacacatgtatctggtgtat

SEQ ID NO: 633741 - DNA, 25 bp, Homo sapien
gtatctggtgtatatgtgcaacaca

SEQ ID NO: 633742 - DNA, 25 bp, Homo sapien
gggcatgtgcacacgcatctcttat

SEQ ID NO: 633743 - DNA, 25 bp, Homo sapien
acacgcatctcttatgtgcacatac

SEQ ID NO: 633744 - DNA, 25 bp, Homo sapien
tatgtgcccacgtttttctagcaca

SEQ ID NO: 633745 - DNA, 25 bp, Homo sapien
ccacgtttttctagcacacatgcac

SEQ ID NO: 633746 - DNA, 25 bp, Homo sapien
cacatctctctagcatatgtacaca

SEQ ID NO: 633747 - DNA, 25 bp, Homo sapien
atgtatttgtagtgtgtgtgcacat

SEQ ID NO: 633748 - DNA, 25 bp, Homo sapien
atctgtgtctctagtatgtgtgcat

SEQ ID NO: 633749 - DNA, 25 bp, Homo sapien
gtgcatacacgtacacatgtaggct

SEQ ID NO: 633750 - DNA, 25 bp, Homo sapien
cgtacacatgtaggctttgagttaa

SEQ ID NO: 633751 - DNA, 25 bp, Homo sapien
aaaacgagccggaaggctctcatta

SEQ ID NO: 633752 - DNA, 25 bp, Homo sapien
agccggaaggctctcattaactttc

SEQ ID NO: 633753 - DNA, 25 bp, Homo sapien
ggaaggctctcattaactttcaagt

SEQ ID NO: 633754 - DNA, 25 bp, Homo sapien
aaggctctcattaactttcaagtgg

SEQ ID NO: 633755 - DNA, 25 bp, Homo sapien
gctctcattaactttcaagtggaaa

SEQ ID NO: 633756 - DNA, 25 bp, Homo sapien
tattttggcaatactaaacgtaaag

SEQ ID NO: 633757 - DNA, 25 bp, Homo sapien
tactaaacgtaaagtatttccagtg

SEQ ID NO: 633758 - DNA, 25 bp, Homo sapien
tttccagtgtttaattcacttcagg

SEQ ID NO: 633759 - DNA, 25 bp, Homo sapien
gtttaattcacttcaggacaatcac

SEQ ID NO: 633760 - DNA, 25 bp, Homo sapien
aattcacttcaggacaatcacatat

SEQ ID NO: 633761 - DNA, 25 bp, Homo sapien
tcacttcaggacaatcacatataaa

SEQ ID NO: 633762 - DNA, 25 bp, Homo sapien
aaagatgtttcttaggatctcacaa

SEQ ID NO: 633763 - DNA, 25 bp, Homo sapien
gatgtttcttaggatctcacaagat

SEQ ID NO: 633764 - DNA, 25 bp, Homo sapien
ggatctcacaagatacactctactt

SEQ ID NO: 633765 - DNA, 25 bp, Homo sapien
acaagatacactctacttacttccc

SEQ ID NO: 633766 - DNA, 25 bp, Homo sapien
ataattttagcacatgcagccagaa

SEQ ID NO: 633767 - DNA, 25 bp, Homo sapien
ttttagcacatgcagccagaaaaaa

SEQ ID NO: 633768 - DNA, 25 bp, Homo sapien
acatctgccaagatatttcccaaaa

SEQ ID NO: 633769 - DNA, 25 bp, Homo sapien
tttcccaaaataagaccgctgtcag

SEQ ID NO: 633770 - DNA, 25 bp, Homo sapien
ataagaccgctgtcagatgaacaat

SEQ ID NO: 633771 - DNA, 25 bp, Homo sapien
gaccgctgtcagatgaacaatgagg

SEQ ID NO: 633772 - DNA, 25 bp, Homo sapien
aatgtagcttttccaaagccttgtc

SEQ ID NO: 633773 - DNA, 25 bp, Homo sapien
cagaacattgacgtctatactagaa

SEQ ID NO: 633774 - DNA, 25 bp, Homo sapien
tgacgtctatactagaatgcctgat

SEQ ID NO: 633775 - DNA, 25 bp, Homo sapien
actagaatgcctgattattgctcat

SEQ ID NO: 633776 - DNA, 25 bp, Homo sapien
ttattgctcattcagttggagtgga

SEQ ID NO: 633777 - DNA, 25 bp, Homo sapien
cagttggagtggaaagtctttttgc

SEQ ID NO: 633778 - DNA, 25 bp, Homo sapien
gtctttttgctgactgcatgaagtg

SEQ ID NO: 633779 - DNA, 25 bp, Homo sapien
aaagcattttgcaaggttttggtct

SEQ ID NO: 633780 - DNA, 25 bp, Homo sapien
gttttggtctgagagaagctttgca

SEQ ID NO: 633781 - DNA, 25 bp, Homo sapien
gaagctttgcaaatatacctcctga

SEQ ID NO: 633782 - DNA, 25 bp, Homo sapien
tttgcaaatatacctcctgagattc

SEQ ID NO: 633783 - DNA, 25 bp, Homo sapien
cagggtgcactcacagcacagaaca

SEQ ID NO: 633784 - DNA, 25 bp, Homo sapien
ggcttgaaggggagcaaccgtagga

SEQ ID NO: 633785 - DNA, 25 bp, Homo sapien
gcttgaaggggagcaaccgtaggag

SEQ ID NO: 633786 - DNA, 25 bp, Homo sapien
cttgaaggggagcaaccgtaggaga

SEQ ID NO: 633787 - DNA, 25 bp, Homo sapien
ttgaaggggagcaaccgtaggagaa

SEQ ID NO: 633788 - DNA, 25 bp, Homo sapien
tgaaggggagcaaccgtaggagaag

SEQ ID NO: 633789 - DNA, 25 bp, Homo sapien
gaaggggagcaaccgtaggagaagc

SEQ ID NO: 633790 - DNA, 25 bp, Homo sapien
aaggggagcaaccgtaggagaagca

SEQ ID NO: 633791 - DNA, 25 bp, Homo sapien
aggggagcaaccgtaggagaagcac

SEQ ID NO: 633792 - DNA, 25 bp, Homo sapien
ggggagcaaccgtaggagaagcaca

SEQ ID NO: 633793 - DNA, 25 bp, Homo sapien
agtagtccaggcaaatatcatcagc

SEQ ID NO: 633794 - DNA, 25 bp, Homo sapien
gtagtccaggcaaatatcatcagct

SEQ ID NO: 633795 - DNA, 25 bp, Homo sapien
tagtccaggcaaatatcatcagctc

SEQ ID NO: 633796 - DNA, 25 bp, Homo sapien
gtccaggcaaatatcatcagctcca

SEQ ID NO: 633797 - DNA, 25 bp, Homo sapien
ccaggcaaatatcatcagctccatt

SEQ ID NO: 633798 - DNA, 25 bp, Homo sapien
caggcaaatatcatcagctccattt

SEQ ID NO: 633799 - DNA, 25 bp, Homo sapien
aggcaaatatcatcagctccatttt

SEQ ID NO: 633800 - DNA, 25 bp, Homo sapien
ggcaaatatcatcagctccatttta

SEQ ID NO: 633801 - DNA, 25 bp, Homo sapien
gcaaatatcatcagctccattttag

SEQ ID NO: 633802 - DNA, 25 bp, Homo sapien
aaatatcatcagctccattttagag

SEQ ID NO: 633803 - DNA, 25 bp, Homo sapien
aatatcatcagctccattttagagg

SEQ ID NO: 633804 - DNA, 25 bp, Homo sapien
gatgttataatcttatgggcctacc

SEQ ID NO: 633805 - DNA, 25 bp, Homo sapien
atcttatgggcctaccatcatgtag

SEQ ID NO: 633806 - DNA, 25 bp, Homo sapien
taccatcatgtaggcagcatgtcct

SEQ ID NO: 633807 - DNA, 25 bp, Homo sapien
gtaggcagcatgtccttggccaaaa

SEQ ID NO: 633808 - DNA, 25 bp, Homo sapien
gcagcatgtccttggccaaaacctt

SEQ ID NO: 633809 - DNA, 25 bp, Homo sapien
ttggccaaaaccttgttatgcagta

SEQ ID NO: 633810 - DNA, 25 bp, Homo sapien
ccaaaaccttgttatgcagtacgtg

SEQ ID NO: 633811 - DNA, 25 bp, Homo sapien
attttgaacttcaacaaggattcag

SEQ ID NO: 633812 - DNA, 25 bp, Homo sapien
agcagatctaatatcccaagtccat

SEQ ID NO: 633813 - DNA, 25 bp, Homo sapien
ttttctctacattcctaaaacctag

SEQ ID NO: 633814 - DNA, 25 bp, Homo sapien
ctagccccttattaccaatttggat

SEQ ID NO: 633815 - DNA, 25 bp, Homo sapien
agaaagcagattccccaattcatgg

SEQ ID NO: 633816 - DNA, 25 bp, Homo sapien
aaaagtcccaccaggaagccaggat

SEQ ID NO: 633817 - DNA, 25 bp, Homo sapien
taaccctccaagaggcagctgtcaa

SEQ ID NO: 633818 - DNA, 25 bp, Homo sapien
agctgtcaacattctgggcctgcag

SEQ ID NO: 633819 - DNA, 25 bp, Homo sapien
gagcttggcccacgatgacttggct

SEQ ID NO: 633820 - DNA, 25 bp, Homo sapien
gacgatgcagcatccgatggctcca

SEQ ID NO: 633821 - DNA, 25 bp, Homo sapien
atccgatggctccactgggcatatt

SEQ ID NO: 633822 - DNA, 25 bp, Homo sapien
ggcatattctaaaatgtatcttccc

SEQ ID NO: 633823 - DNA, 25 bp, Homo sapien
gtatcttccctattataaccccgat

SEQ ID NO: 633824 - DNA, 25 bp, Homo sapien
taaccccgatgtagtaggattcctt

SEQ ID NO: 633825 - DNA, 25 bp, Homo sapien
agtaggattcctttcaaccaccagc

SEQ ID NO: 633826 - DNA, 25 bp, Homo sapien
ggtgattgagaaacacatacttctg

SEQ ID NO: 633827 - DNA, 25 bp, Homo sapien
gtgattgagaaacacatacttctga

SEQ ID NO: 633828 - DNA, 25 bp, Homo sapien
gattgagaaacacatacttctgatt

SEQ ID NO: 633829 - DNA, 25 bp, Homo sapien
ttgagaaacacatacttctgattac

SEQ ID NO: 633830 - DNA, 25 bp, Homo sapien
gagaaacacatacttctgattactt

SEQ ID NO: 633831 - DNA, 25 bp, Homo sapien
gaaacacatacttctgattacttaa

SEQ ID NO: 633832 - DNA, 25 bp, Homo sapien
aaacacatacttctgattacttaat

SEQ ID NO: 633833 - DNA, 25 bp, Homo sapien
aacacatacttctgattacttaata

SEQ ID NO: 633834 - DNA, 25 bp, Homo sapien
acacatacttctgattacttaatat

SEQ ID NO: 633835 - DNA, 25 bp, Homo sapien
cacatacttctgattacttaatata

SEQ ID NO: 633836 - DNA, 25 bp, Homo sapien
catacttctgattacttaatatata

SEQ ID NO: 633837 - DNA, 25 bp, Homo sapien
agtggctcacgactataatccccag

SEQ ID NO: 633838 - DNA, 25 bp, Homo sapien
ctcacgactataatccccagcactc

SEQ ID NO: 633839 - DNA, 25 bp, Homo sapien
tcacgactataatccccagcactct

SEQ ID NO: 633840 - DNA, 25 bp, Homo sapien
cacgactataatccccagcactctg

SEQ ID NO: 633841 - DNA, 25 bp, Homo sapien
aattagccgggagcagtggcatgca

SEQ ID NO: 633842 - DNA, 25 bp, Homo sapien
attagccgggagcagtggcatgcac

SEQ ID NO: 633843 - DNA, 25 bp, Homo sapien
agccgggagcagtggcatgcacctg

SEQ ID NO: 633844 - DNA, 25 bp, Homo sapien
gccgggagcagtggcatgcacctgt

SEQ ID NO: 633845 - DNA, 25 bp, Homo sapien
ggagcagtggcatgcacctgtgatc

SEQ ID NO: 633846 - DNA, 25 bp, Homo sapien
gagcagtggcatgcacctgtgatcc

SEQ ID NO: 633847 - DNA, 25 bp, Homo sapien
agcagtggcatgcacctgtgatccc

SEQ ID NO: 633848 - DNA, 25 bp, Homo sapien
tattcaataaagattgctgccaggc

SEQ ID NO: 633849 - DNA, 25 bp, Homo sapien
ttcaataaagattgctgccaggcat

SEQ ID NO: 633850 - DNA, 25 bp, Homo sapien
tcaataaagattgctgccaggcatg

SEQ ID NO: 633851 - DNA, 25 bp, Homo sapien
aataaagattgctgccaggcatggt

SEQ ID NO: 633852 - DNA, 25 bp, Homo sapien
ggacaacatggtgagccactatctc

SEQ ID NO: 633853 - DNA, 25 bp, Homo sapien
ggtgagccactatctctgcagaaat

SEQ ID NO: 633854 - DNA, 25 bp, Homo sapien
gtagtggcctgtgcctatagcctca

SEQ ID NO: 633855 - DNA, 25 bp, Homo sapien
ggaagtccaggcaacagtaagccat

SEQ ID NO: 633856 - DNA, 25 bp, Homo sapien
gaagtccaggcaacagtaagccatg

SEQ ID NO: 633857 - DNA, 25 bp, Homo sapien
aagtccaggcaacagtaagccatga

SEQ ID NO: 633858 - DNA, 25 bp, Homo sapien
agtccaggcaacagtaagccatgat

SEQ ID NO: 633859 - DNA, 25 bp, Homo sapien
atgaatcctgccaatgaccatgaga

SEQ ID NO: 633860 - DNA, 25 bp, Homo sapien
gagtttgaggagtggattcttcccc

SEQ ID NO: 633861 - DNA, 25 bp, Homo sapien
aagccttgagatgtctaaagcccag

SEQ ID NO: 633862 - DNA, 25 bp, Homo sapien
ccaggaggcactttgattgcagcct

SEQ ID NO: 633863 - DNA, 25 bp, Homo sapien
gattgcagcctgtgagaaaccacca

SEQ ID NO: 633864 - DNA, 25 bp, Homo sapien
gaaaccaccaagaagacacagctaa

SEQ ID NO: 633865 - DNA, 25 bp, Homo sapien
gacacagctaaaccttacctaaaag

SEQ ID NO: 633866 - DNA, 25 bp, Homo sapien
gtttcaagtcactactttgggagca

SEQ ID NO: 633867 - DNA, 25 bp, Homo sapien
cactactttgggagcatatttctta

SEQ ID NO: 633868 - DNA, 25 bp, Homo sapien
gaaatgttacctgacttggaacatc

SEQ ID NO: 633869 - DNA, 25 bp, Homo sapien
catcacagattgttattgtctgctt

SEQ ID NO: 633870 - DNA, 25 bp, Homo sapien
gattcttaaaacctgactgtggcac

SEQ ID NO: 633871 - DNA, 25 bp, Homo sapien
tgactgtggcactcttctccaaata

SEQ ID NO: 633872 - DNA, 25 bp, Homo sapien
gcactcttctccaaatacctctgtt

SEQ ID NO: 633873 - DNA, 25 bp, Homo sapien
atttctcagcccctttgaagaggca

SEQ ID NO: 633874 - DNA, 25 bp, Homo sapien
gaggcaggcccatgggatgaattct

SEQ ID NO: 633875 - DNA, 25 bp, Homo sapien
gatttaagagccagtgcaccatcct

SEQ ID NO: 633876 - DNA, 25 bp, Homo sapien
gtgcaccatccttcagctaactctt

SEQ ID NO: 633877 - DNA, 25 bp, Homo sapien
aatggcacaaagatagagcaccttg

SEQ ID NO: 633878 - DNA, 25 bp, Homo sapien
gagcaccttgaattgttactgcaaa

SEQ ID NO: 633879 - DNA, 25 bp, Homo sapien
acatcttttctggagagtcacccaa

SEQ ID NO: 633880 - DNA, 25 bp, Homo sapien
cacccaagcagtggatttgtgaata

SEQ ID NO: 633881 - DNA, 25 bp, Homo sapien
atccatatcacaatttgattcatgc

SEQ ID NO: 633882 - DNA, 25 bp, Homo sapien
gattcatgcagctgatgtcactcaa

SEQ ID NO: 633883 - DNA, 25 bp, Homo sapien
gctgatgtcactcaaactgtgcatt

SEQ ID NO: 633884 - DNA, 25 bp, Homo sapien
gtcactcaaactgtgcattacataa

SEQ ID NO: 633885 - DNA, 25 bp, Homo sapien
ttacataatgcttcatacaggtatc

SEQ ID NO: 633886 - DNA, 25 bp, Homo sapien
tacaggtatcatgcactggctcact

SEQ ID NO: 633887 - DNA, 25 bp, Homo sapien
atgcactggctcactgaactggaaa

SEQ ID NO: 633888 - DNA, 25 bp, Homo sapien
ctggctcactgaactggaaatttta

SEQ ID NO: 633889 - DNA, 25 bp, Homo sapien
tggaaattttagcaatggtctttgc

SEQ ID NO: 633890 - DNA, 25 bp, Homo sapien
ggtctttgctgctgccattcatgat

SEQ ID NO: 633891 - DNA, 25 bp, Homo sapien
tgctgctgccattcatgattatgag

SEQ ID NO: 633892 - DNA, 25 bp, Homo sapien
attctcaaactcatgtcagttactg

SEQ ID NO: 633893 - DNA, 25 bp, Homo sapien
aactcatgtcagttactgggcctgc

SEQ ID NO: 633894 - DNA, 25 bp, Homo sapien
atgtcagttactgggcctgccgggt

SEQ ID NO: 633895 - DNA, 25 bp, Homo sapien
agttactgggcctgccgggtgtggt

SEQ ID NO: 633896 - DNA, 25 bp, Homo sapien
tcatacctgtcatcccaaagctttg

SEQ ID NO: 633897 - DNA, 25 bp, Homo sapien
ggattgcttgcagccgggagttcgg

SEQ ID NO: 633898 - DNA, 25 bp, Homo sapien
caaaacaaattgtttgaattggcgg

SEQ ID NO: 633899 - DNA, 25 bp, Homo sapien
tgtagtcctagcaacctttccactt

SEQ ID NO: 633900 - DNA, 25 bp, Homo sapien
gtcctagcaacctttccacttggga

SEQ ID NO: 633901 - DNA, 25 bp, Homo sapien
tagcaacctttccacttgggaggct

SEQ ID NO: 633902 - DNA, 25 bp, Homo sapien
agcaacctttccacttgggaggctg

SEQ ID NO: 633903 - DNA, 25 bp, Homo sapien
ttatgtaaagaactgtccctcgtgg

SEQ ID NO: 633904 - DNA, 25 bp, Homo sapien
atgtaaagaactgtccctcgtgggc

SEQ ID NO: 633905 - DNA, 25 bp, Homo sapien
tgtaaagaactgtccctcgtgggct

SEQ ID NO: 633906 - DNA, 25 bp, Homo sapien
gtaaagaactgtccctcgtgggctg

SEQ ID NO: 633907 - DNA, 25 bp, Homo sapien
aaagaactgtccctcgtgggctgtg

SEQ ID NO: 633908 - DNA, 25 bp, Homo sapien
aagaactgtccctcgtgggctgtgt

SEQ ID NO: 633909 - DNA, 25 bp, Homo sapien
gaactgtccctcgtgggctgtgtgt

SEQ ID NO: 633910 - DNA, 25 bp, Homo sapien
aactgtccctcgtgggctgtgtgtg

SEQ ID NO: 633911 - DNA, 25 bp, Homo sapien
gggctgtgtgtggttgcacaggcct

SEQ ID NO: 633912 - DNA, 25 bp, Homo sapien
gcccagcaattgagacctgcttggg

SEQ ID NO: 633913 - DNA, 25 bp, Homo sapien
acacagaaattaacccagcgtggta

SEQ ID NO: 633914 - DNA, 25 bp, Homo sapien
tggtgcttcgagagctgatcctcct

SEQ ID NO: 633915 - DNA, 25 bp, Homo sapien
gtttttcagagttcctaagttgcat

SEQ ID NO: 633916 - DNA, 25 bp, Homo sapien
gagttcctaagttgcattctgttca

SEQ ID NO: 633917 - DNA, 25 bp, Homo sapien
ggtcttgcttatgtcattttcccta

SEQ ID NO: 633918 - DNA, 25 bp, Homo sapien
tgtcattttccctagaactggaacc

SEQ ID NO: 633919 - DNA, 25 bp, Homo sapien
tggaaccccactacccagaaatcaa

SEQ ID NO: 633920 - DNA, 25 bp, Homo sapien
gaaatcaacactgccaatattttgg

SEQ ID NO: 633921 - DNA, 25 bp, Homo sapien
gagtctttttgtccagtgtatattc

SEQ ID NO: 633922 - DNA, 25 bp, Homo sapien
cactcactgttgaaatcacacccta

SEQ ID NO: 633923 - DNA, 25 bp, Homo sapien
aatcacaccctatgtacagtttagt

SEQ ID NO: 633924 - DNA, 25 bp, Homo sapien
gtacagtttagtcatttacttcttt

SEQ ID NO: 633925 - DNA, 25 bp, Homo sapien
agattgtggctctttaggcgcggca

SEQ ID NO: 633926 - DNA, 25 bp, Homo sapien
taggcgcggcacacacgtggttttt

SEQ ID NO: 633927 - DNA, 25 bp, Homo sapien
acgtggtttttgatccgtctcatca

SEQ ID NO: 633928 - DNA, 25 bp, Homo sapien
ttggaatgtccatcgcggtgcggca

SEQ ID NO: 633929 - DNA, 25 bp, Homo sapien
ttatacagctgggtgcacagttgcc

SEQ ID NO: 633930 - DNA, 25 bp, Homo sapien
tgcacagttgcccatcacagtgata

SEQ ID NO: 633931 - DNA, 25 bp, Homo sapien
agagagtaagcttctgggccgcttt

SEQ ID NO: 633932 - DNA, 25 bp, Homo sapien
gttttgcttgtaactggcatgcccg

SEQ ID NO: 633933 - DNA, 25 bp, Homo sapien
gtgtgaccacgtttgtgtacctggg

SEQ ID NO: 633934 - DNA, 25 bp, Homo sapien
gtacctgggtgtgaatgcttgtgaa

SEQ ID NO: 633935 - DNA, 25 bp, Homo sapien
atatgaatgctgttgctgcctatct

SEQ ID NO: 633936 - DNA, 25 bp, Homo sapien
ccttcgggaggtgatagatcatgac

SEQ ID NO: 633937 - DNA, 25 bp, Homo sapien
atagatcatgacatggagccctcat

SEQ ID NO: 633938 - DNA, 25 bp, Homo sapien
tgaatgggattcatgctctttcgaa

SEQ ID NO: 633939 - DNA, 25 bp, Homo sapien
atgggattcatgctctttcgaaaga

SEQ ID NO: 633940 - DNA, 25 bp, Homo sapien
tctttcgaaagaggccccacgactg

SEQ ID NO: 633941 - DNA, 25 bp, Homo sapien
caccatttgaggacacagctaggag

SEQ ID NO: 633942 - DNA, 25 bp, Homo sapien
ggacacagctaggagataccgtcta

SEQ ID NO: 633943 - DNA, 25 bp, Homo sapien
aggagataccgtctatataccagaa

SEQ ID NO: 633944 - DNA, 25 bp, Homo sapien
ataccagaaatacacaagagaagag

SEQ ID NO: 633945 - DNA, 25 bp, Homo sapien
gagaagagacctcattgaaacctca

SEQ ID NO: 633946 - DNA, 25 bp, Homo sapien
tccccagcgtccacaactgcaagaa

SEQ ID NO: 633947 - DNA, 25 bp, Homo sapien
tattcaataaagattgctgccaggc

SEQ ID NO: 633948 - DNA, 25 bp, Homo sapien
attcaataaagattgctgccaggca

SEQ ID NO: 633949 - DNA, 25 bp, Homo sapien
ttcaataaagattgctgccaggcat

SEQ ID NO: 633950 - DNA, 25 bp, Homo sapien
tcaataaagattgctgccaggcatg

SEQ ID NO: 633951 - DNA, 25 bp, Homo sapien
caataaagattgctgccaggcatgg

SEQ ID NO: 633952 - DNA, 25 bp, Homo sapien
aataaagattgctgccaggcatggt

SEQ ID NO: 633953 - DNA, 25 bp, Homo sapien
tggaagtccaggcaacagtaagcca

SEQ ID NO: 633954 - DNA, 25 bp, Homo sapien
ggaagtccaggcaacagtaagccat

SEQ ID NO: 633955 - DNA, 25 bp, Homo sapien
gaagtccaggcaacagtaagccatg

SEQ ID NO: 633956 - DNA, 25 bp, Homo sapien
aagtccaggcaacagtaagccatga

SEQ ID NO: 633957 - DNA, 25 bp, Homo sapien
agtccaggcaacagtaagccatgat

SEQ ID NO: 633958 - DNA, 25 bp, Homo sapien
ttatgtaaagaactgtccctcgtgg

SEQ ID NO: 633959 - DNA, 25 bp, Homo sapien
atgtaaagaactgtccctcgtgggc

SEQ ID NO: 633960 - DNA, 25 bp, Homo sapien
gtaaagaactgtccctcgtgggctg

SEQ ID NO: 633961 - DNA, 25 bp, Homo sapien
aagaactgtccctcgtgggctgtgt

SEQ ID NO: 633962 - DNA, 25 bp, Homo sapien
aactgtccctcgtgggctgtgtgtg

SEQ ID NO: 633963 - DNA, 25 bp, Homo sapien
gggctgtgtgtggttgcacaggcct

SEQ ID NO: 633964 - DNA, 25 bp, Homo sapien
tgcacaggcctgtattcccagcgct

SEQ ID NO: 633965 - DNA, 25 bp, Homo sapien
caaggcaaggcaggctgatttcttg

SEQ ID NO: 633966 - DNA, 25 bp, Homo sapien
gcccagcaattgagacctgcttggg

SEQ ID NO: 633967 - DNA, 25 bp, Homo sapien
acacagaaattaacccagcgtggta

SEQ ID NO: 633968 - DNA, 25 bp, Homo sapien
taacccagcgtggtagtcccaacta

SEQ ID NO: 633969 - DNA, 25 bp, Homo sapien
tcctttattattgttcaccaactat

SEQ ID NO: 633970 - DNA, 25 bp, Homo sapien
ttattgttcaccaactatacttcaa

SEQ ID NO: 633971 - DNA, 25 bp, Homo sapien
gttcaccaactatacttcaattaaa

SEQ ID NO: 633972 - DNA, 25 bp, Homo sapien
gaatttccttaaactgtcattttag

SEQ ID NO: 633973 - DNA, 25 bp, Homo sapien
attttagaatagatctgctggtcac

SEQ ID NO: 633974 - DNA, 25 bp, Homo sapien
tagaatagatctgctggtcacaaat

SEQ ID NO: 633975 - DNA, 25 bp, Homo sapien
tagatctgctggtcacaaatctctt

SEQ ID NO: 633976 - DNA, 25 bp, Homo sapien
gatctgctggtcacaaatctcttag

SEQ ID NO: 633977 - DNA, 25 bp, Homo sapien
ctgctggtcacaaatctcttagttt

SEQ ID NO: 633978 - DNA, 25 bp, Homo sapien
gctggtcacaaatctcttagttttt

SEQ ID NO: 633979 - DNA, 25 bp, Homo sapien
tccaaagattcattcttattatcat

SEQ ID NO: 633980 - DNA, 25 bp, Homo sapien
agtggccttctaggcacacctgtaa

SEQ ID NO: 633981 - DNA, 25 bp, Homo sapien
ggcacacctgtaaaaacagctggag

SEQ ID NO: 633982 - DNA, 25 bp, Homo sapien
taagctatgcctcccattagtggat

SEQ ID NO: 633983 - DNA, 25 bp, Homo sapien
gcctcccattagtggatctttccat

SEQ ID NO: 633984 - DNA, 25 bp, Homo sapien
ataagggtcaacattgttctggaaa

SEQ ID NO: 633985 - DNA, 25 bp, Homo sapien
aaacatatgcacattggatcatgac

SEQ ID NO: 633986 - DNA, 25 bp, Homo sapien
taaaatatgtctctaaagtgtggat

SEQ ID NO: 633987 - DNA, 25 bp, Homo sapien
ggaagatagcactaacagagtcata

SEQ ID NO: 633988 - DNA, 25 bp, Homo sapien
gagtcatacagaacaggtgcacatc

SEQ ID NO: 633989 - DNA, 25 bp, Homo sapien
ggtgcacatcagctgtatgaaggca

SEQ ID NO: 633990 - DNA, 25 bp, Homo sapien
aaggcaagtggccttctaggcacac

SEQ ID NO: 633991 - DNA, 25 bp, Homo sapien
ggcgtgggtgtgtccaggccctggc

SEQ ID NO: 633992 - DNA, 25 bp, Homo sapien
ggagttgaccctctccggaaggctt

SEQ ID NO: 633993 - DNA, 25 bp, Homo sapien
accctctccggaaggcttctggaag

SEQ ID NO: 633994 - DNA, 25 bp, Homo sapien
ttctggaagcacagctgagtggcat

SEQ ID NO: 633995 - DNA, 25 bp, Homo sapien
gagtggcatgggtatctcaggctcc

SEQ ID NO: 633996 - DNA, 25 bp, Homo sapien
ggctggctactgcaaggtcctctca

SEQ ID NO: 633997 - DNA, 25 bp, Homo sapien
ggctactgcaaggtcctctcaggac

SEQ ID NO: 633998 - DNA, 25 bp, Homo sapien
tcagcctgcctctgtcccagttaga

SEQ ID NO: 633999 - DNA, 25 bp, Homo sapien
tctgtcccagttagacctcagagac

SEQ ID NO: 634000 - DNA, 25 bp, Homo sapien
tagacctcagagacacagaggccag

SEQ ID NO: 634001 - DNA, 25 bp, Homo sapien
gacacagaggccagaaatacttctt

SEQ ID NO: 634002 - DNA, 25 bp, Homo sapien
gggtcaagtgtcttcatgtctgtgc

SEQ ID NO: 634003 - DNA, 25 bp, Homo sapien
ggtcaagtgtcttcatgtctgtgct

SEQ ID NO: 634004 - DNA, 25 bp, Homo sapien
gtcaagtgtcttcatgtctgtgctt

SEQ ID NO: 634005 - DNA, 25 bp, Homo sapien
tcaagtgtcttcatgtctgtgcttt

SEQ ID NO: 634006 - DNA, 25 bp, Homo sapien
caagtgtcttcatgtctgtgctttc

SEQ ID NO: 634007 - DNA, 25 bp, Homo sapien
aagtgtcttcatgtctgtgctttca

SEQ ID NO: 634008 - DNA, 25 bp, Homo sapien
agtgtcttcatgtctgtgctttcaa

SEQ ID NO: 634009 - DNA, 25 bp, Homo sapien
gtgtcttcatgtctgtgctttcaaa

SEQ ID NO: 634010 - DNA, 25 bp, Homo sapien
tgtcttcatgtctgtgctttcaaat

SEQ ID NO: 634011 - DNA, 25 bp, Homo sapien
gtcttcatgtctgtgctttcaaatg

SEQ ID NO: 634012 - DNA, 25 bp, Homo sapien
tcttcatgtctgtgctttcaaatgg

SEQ ID NO: 634013 - DNA, 25 bp, Homo sapien
agctctgcttgcaaggcattcttga

SEQ ID NO: 634014 - DNA, 25 bp, Homo sapien
gcagtatagtgggtgtaacagacat

SEQ ID NO: 634015 - DNA, 25 bp, Homo sapien
gtggacagggcgttgccaaattcct

SEQ ID NO: 634016 - DNA, 25 bp, Homo sapien
gttgccaaattcctcagccagctgc

SEQ ID NO: 634017 - DNA, 25 bp, Homo sapien
agccagctgccaggtactgctaatt

SEQ ID NO: 634018 - DNA, 25 bp, Homo sapien
taattccactgcctgaacagctgga

SEQ ID NO: 634019 - DNA, 25 bp, Homo sapien
ctgcctgaacagctggagaatccat

SEQ ID NO: 634020 - DNA, 25 bp, Homo sapien
tgacacctgtatcaccgaggccagc

SEQ ID NO: 634021 - DNA, 25 bp, Homo sapien
actatgtgctcagcacggtgctggg

SEQ ID NO: 634022 - DNA, 25 bp, Homo sapien
ctgggctctggcgatgcacagatga

SEQ ID NO: 634023 - DNA, 25 bp, Homo sapien
gaattagacagctctgcttgcaagg

SEQ ID NO: 634024 - DNA, 25 bp, Homo sapien
agggccaaagagctgtggctcataa

SEQ ID NO: 634025 - DNA, 25 bp, Homo sapien
aagagctgtggctcataaagagatg

SEQ ID NO: 634026 - DNA, 25 bp, Homo sapien
ggccctggatttaactttagtatat

SEQ ID NO: 634027 - DNA, 25 bp, Homo sapien
tagtatattaaaggccacagatgga

SEQ ID NO: 634028 - DNA, 25 bp, Homo sapien
aggccacagatggaacgaggtgcca

SEQ ID NO: 634029 - DNA, 25 bp, Homo sapien
cacagatggaacgaggtgccaggaa

SEQ ID NO: 634030 - DNA, 25 bp, Homo sapien
aggtgccaggaaaagactgcgcttt

SEQ ID NO: 634031 - DNA, 25 bp, Homo sapien
gtgccaggaaaagactgcgctttaa

SEQ ID NO: 634032 - DNA, 25 bp, Homo sapien
gactgcgctttaaaattggccccga

SEQ ID NO: 634033 - DNA, 25 bp, Homo sapien
tgcgctttaaaattggccccgactt

SEQ ID NO: 634034 - DNA, 25 bp, Homo sapien
gcgctttaaaattggccccgacttg

SEQ ID NO: 634035 - DNA, 25 bp, Homo sapien
gtttatcaccgcaagagctaccatt

SEQ ID NO: 634036 - DNA, 25 bp, Homo sapien
accgcaagagctaccattcatctag

SEQ ID NO: 634037 - DNA, 25 bp, Homo sapien
gagctaccattcatctagcacaacc

SEQ ID NO: 634038 - DNA, 25 bp, Homo sapien
attcatctagcacaacctgaccatc

SEQ ID NO: 634039 - DNA, 25 bp, Homo sapien
tgaccatcctcacactggtcagttc

SEQ ID NO: 634040 - DNA, 25 bp, Homo sapien
gccatgttcactccggttttacaga

SEQ ID NO: 634041 - DNA, 25 bp, Homo sapien
gcaacttgcccagctatgagagaga

SEQ ID NO: 634042 - DNA, 25 bp, Homo sapien
aaagccacttgcctagggacacaca

SEQ ID NO: 634043 - DNA, 25 bp, Homo sapien
tgttgactggctgtggcacctcaag

SEQ ID NO: 634044 - DNA, 25 bp, Homo sapien
gactggctgtggcacctcaagcagc

SEQ ID NO: 634045 - DNA, 25 bp, Homo sapien
tctagcctcagtttatcaccgcaag

SEQ ID NO: 634046 - DNA, 25 bp, Homo sapien
cagatgactgaaatcctcttatcac

SEQ ID NO: 634047 - DNA, 25 bp, Homo sapien
agatgactgaaatcctcttatcact

SEQ ID NO: 634048 - DNA, 25 bp, Homo sapien
gatgactgaaatcctcttatcactg

SEQ ID NO: 634049 - DNA, 25 bp, Homo sapien
tgactgaaatcctcttatcactggc

SEQ ID NO: 634050 - DNA, 25 bp, Homo sapien
actgaaatcctcttatcactggctg

SEQ ID NO: 634051 - DNA, 25 bp, Homo sapien
tgaaatcctcttatcactggctgga

SEQ ID NO: 634052 - DNA, 25 bp, Homo sapien
aaatcctcttatcactggctggaca

SEQ ID NO: 634053 - DNA, 25 bp, Homo sapien
atcctcttatcactggctggacatg

SEQ ID NO: 634054 - DNA, 25 bp, Homo sapien
cctcttatcactggctggacatggt

SEQ ID NO: 634055 - DNA, 25 bp, Homo sapien
ggctgaggcagattcatcatctgag

SEQ ID NO: 634056 - DNA, 25 bp, Homo sapien
gctgaggcagattcatcatctgagg

SEQ ID NO: 634057 - DNA, 25 bp, Homo sapien
ctgcttgatgtaggagggattaagt

SEQ ID NO: 634058 - DNA, 25 bp, Homo sapien
gattaagttagtatttcccgtatcg

SEQ ID NO: 634059 - DNA, 25 bp, Homo sapien
ttagtatttcccgtatcgaccaaga

SEQ ID NO: 634060 - DNA, 25 bp, Homo sapien
agtatttcccgtatcgaccaagaca

SEQ ID NO: 634061 - DNA, 25 bp, Homo sapien
tatttcccgtatcgaccaagacaaa

SEQ ID NO: 634062 - DNA, 25 bp, Homo sapien
tttcccgtatcgaccaagacaaaat

SEQ ID NO: 634063 - DNA, 25 bp, Homo sapien
tcccgtatcgaccaagacaaaatta

SEQ ID NO: 634064 - DNA, 25 bp, Homo sapien
atcgaccaagacaaaattacaatat

SEQ ID NO: 634065 - DNA, 25 bp, Homo sapien
tacaatatacgcataacaaagacaa

SEQ ID NO: 634066 - DNA, 25 bp, Homo sapien
aagacaaacaccagttacttggctc

SEQ ID NO: 634067 - DNA, 25 bp, Homo sapien
acaaacaccagttacttggctcaat

SEQ ID NO: 634068 - DNA, 25 bp, Homo sapien
cacaagagagccaaccagaaattta

SEQ ID NO: 634069 - DNA, 25 bp, Homo sapien
gccaaccagaaatttattacaactg

SEQ ID NO: 634070 - DNA, 25 bp, Homo sapien
gttagaagaattcagttaggtgact

SEQ ID NO: 634071 - DNA, 25 bp, Homo sapien
aattcagttaggtgactgggaacaa

SEQ ID NO: 634072 - DNA, 25 bp, Homo sapien
gggaacaaaattagaatgcagaaat

SEQ ID NO: 634073 - DNA, 25 bp, Homo sapien
gaaatcaatagttttcatgcagaaa

SEQ ID NO: 634074 - DNA, 25 bp, Homo sapien
gaaaacaaaagccatatgcaacata

SEQ ID NO: 634075 - DNA, 25 bp, Homo sapien
aaagccatatgcaacataatgaaag

SEQ ID NO: 634076 - DNA, 25 bp, Homo sapien
aacattaacatattcatatcaagaa

SEQ ID NO: 634077 - DNA, 25 bp, Homo sapien
ggtgattgagaaacacatacttctg

SEQ ID NO: 634078 - DNA, 25 bp, Homo sapien
gaaacacatacttctgattacttaa

SEQ ID NO: 634079 - DNA, 25 bp, Homo sapien
atccctgaatgactccatggaccca

SEQ ID NO: 634080 - DNA, 25 bp, Homo sapien
tcccactttggccagctaggtacaa

SEQ ID NO: 634081 - DNA, 25 bp, Homo sapien
ccactttggccagctaggtacaaat

SEQ ID NO: 634082 - DNA, 25 bp, Homo sapien
ttggccagctaggtacaaatacatg

SEQ ID NO: 634083 - DNA, 25 bp, Homo sapien
ggccagctaggtacaaatacatgga

SEQ ID NO: 634084 - DNA, 25 bp, Homo sapien
tggaactttctatgagcaggtaaca

SEQ ID NO: 634085 - DNA, 25 bp, Homo sapien
gaactttctatgagcaggtaacaaa

SEQ ID NO: 634086 - DNA, 25 bp, Homo sapien
gagcaggtaacaaacatcctttatg

SEQ ID NO: 634087 - DNA, 25 bp, Homo sapien
aacatcctttatgttaagtcactga

SEQ ID NO: 634088 - DNA, 25 bp, Homo sapien
ctgagattctgggatgcctctatta

SEQ ID NO: 634089 - DNA, 25 bp, Homo sapien
agattctgggatgcctctattaaag

SEQ ID NO: 634090 - DNA, 25 bp, Homo sapien
tctcaatcaccttttaaagacttct

SEQ ID NO: 634091 - DNA, 25 bp, Homo sapien
gttttctttcattatgttgcatatg

SEQ ID NO: 634092 - DNA, 25 bp, Homo sapien
attatgttgcatatggcttttgttt

SEQ ID NO: 634093 - DNA, 25 bp, Homo sapien
aaaactattgatttctgcattctaa

SEQ ID NO: 634094 - DNA, 25 bp, Homo sapien
atttctgcattctaattttgttccc

SEQ ID NO: 634095 - DNA, 25 bp, Homo sapien
ttgttcccagtcacctaactgaatt

SEQ ID NO: 634096 - DNA, 25 bp, Homo sapien
gttcccagtcacctaactgaattct

SEQ ID NO: 634097 - DNA, 25 bp, Homo sapien
gtcacctaactgaattcttctaaca

SEQ ID NO: 634098 - DNA, 25 bp, Homo sapien
gtaataaatttctggttggctctct

SEQ ID NO: 634099 - DNA, 25 bp, Homo sapien
ataaatttctggttggctctcttgt

SEQ ID NO: 634100 - DNA, 25 bp, Homo sapien
taaatttctggttggctctcttgtg

SEQ ID NO: 634101 - DNA, 25 bp, Homo sapien
tttgtcttttttggctcaaaattgt

SEQ ID NO: 634102 - DNA, 25 bp, Homo sapien
ggctcaaaattgtcttcatctggga

SEQ ID NO: 634103 - DNA, 25 bp, Homo sapien
gtaaatagcaagaatatacacccta

SEQ ID NO: 634104 - DNA, 25 bp, Homo sapien
atacaccctatttcacagtttctgt

SEQ ID NO: 634105 - DNA, 25 bp, Homo sapien
ggctgccttcagcaggtacctagct

SEQ ID NO: 634106 - DNA, 25 bp, Homo sapien
aggtacctagctccacattgcaaat

SEQ ID NO: 634107 - DNA, 25 bp, Homo sapien
cattgcaaatctacatcctgtcacg

SEQ ID NO: 634108 - DNA, 25 bp, Homo sapien
gcaaatctacatcctgtcacgaaga

SEQ ID NO: 634109 - DNA, 25 bp, Homo sapien
tcctgtcacgaagatgtggatgttt

SEQ ID NO: 634110 - DNA, 25 bp, Homo sapien
aaacccagatgacctctcaaattac

SEQ ID NO: 634111 - DNA, 25 bp, Homo sapien
gatgacctctcaaattacatgatga

SEQ ID NO: 634112 - DNA, 25 bp, Homo sapien
aatgttttcattcttccctatgact

SEQ ID NO: 634113 - DNA, 25 bp, Homo sapien
tttcattcttccctatgactttcca

SEQ ID NO: 634114 - DNA, 25 bp, Homo sapien
cttccctatgactttccactataaa

SEQ ID NO: 634115 - DNA, 25 bp, Homo sapien
taaaaactggccctccaatttggtg

SEQ ID NO: 634116 - DNA, 25 bp, Homo sapien
tccaatttggtgaaaagaccttggg

SEQ ID NO: 634117 - DNA, 25 bp, Homo sapien
gggacagagacttggctatgccttc

SEQ ID NO: 634118 - DNA, 25 bp, Homo sapien
agagacttggctatgccttcctctt

SEQ ID NO: 634119 - DNA, 25 bp, Homo sapien
cacacgcaggtttccagtgcaggct

SEQ ID NO: 634120 - DNA, 25 bp, Homo sapien
gtgcaggcttcttgatatcactgaa

SEQ ID NO: 634121 - DNA, 25 bp, Homo sapien
ggcttcttgatatcactgaagataa

SEQ ID NO: 634122 - DNA, 25 bp, Homo sapien
tcactgaagataaagagcgattaac

SEQ ID NO: 634123 - DNA, 25 bp, Homo sapien
gtcatgtttcctgcctatgtgagag

SEQ ID NO: 634124 - DNA, 25 bp, Homo sapien
agagagaccctgtgaaacccaggta

SEQ ID NO: 634125 - DNA, 25 bp, Homo sapien
gcagtaaggttaatggcccagccat

SEQ ID NO: 634126 - DNA, 25 bp, Homo sapien
taatggcccagccatcttttgctga

SEQ ID NO: 634127 - DNA, 25 bp, Homo sapien
gggtctcaggtatgattctatcacc

SEQ ID NO: 634128 - DNA, 25 bp, Homo sapien
gattctatcacccaaagacacctaa

SEQ ID NO: 634129 - DNA, 25 bp, Homo sapien
aaatcaccagactacattccaatcc

SEQ ID NO: 634130 - DNA, 25 bp, Homo sapien
atccccatgggacctgattattgca

SEQ ID NO: 634131 - DNA, 25 bp, Homo sapien
attattgcacacagcttctttcagc

SEQ ID NO: 634132 - DNA, 25 bp, Homo sapien
gtttttcagaaccaactcacagtct

SEQ ID NO: 634133 - DNA, 25 bp, Homo sapien
tcacagtctgaaaaagcaacctcct

SEQ ID NO: 634134 - DNA, 25 bp, Homo sapien
ggaggcttgtgtaagctcttctaaa

SEQ ID NO: 634135 - DNA, 25 bp, Homo sapien
tactgatttgtttcataccttactt

SEQ ID NO: 634136 - DNA, 25 bp, Homo sapien
gtataattcttacagagagcccatc

SEQ ID NO: 634137 - DNA, 25 bp, Homo sapien
gagcccatcacatagtagtcaacgt

SEQ ID NO: 634138 - DNA, 25 bp, Homo sapien
gtcaacgttctaagttttttatgca

SEQ ID NO: 634139 - DNA, 25 bp, Homo sapien
tgcatattagttcattcagtcctca

SEQ ID NO: 634140 - DNA, 25 bp, Homo sapien
agcagccatcatcactgtgtgattc

SEQ ID NO: 634141 - DNA, 25 bp, Homo sapien
actgtgtgattcttgaagctctgga

SEQ ID NO: 634142 - DNA, 25 bp, Homo sapien
gaagctctggaaatctaggatttct

SEQ ID NO: 634143 - DNA, 25 bp, Homo sapien
aggatttctatatagtacaccaaca

SEQ ID NO: 634144 - DNA, 25 bp, Homo sapien
gtacaccaacataccagtttacata

SEQ ID NO: 634145 - DNA, 25 bp, Homo sapien
tattgaggtaacgagatgtgagcag

SEQ ID NO: 634146 - DNA, 25 bp, Homo sapien
atgtgagcagaaacaacctgtgtca

SEQ ID NO: 634147 - DNA, 25 bp, Homo sapien
cagaagctttaaaggccagtgctgc

SEQ ID NO: 634148 - DNA, 25 bp, Homo sapien
agtgctgcccttgttggggaagcaa

SEQ ID NO: 634149 - DNA, 25 bp, Homo sapien
caagtatagatatgaatcgttccac

SEQ ID NO: 634150 - DNA, 25 bp, Homo sapien
tgccgacccatgctgggcgtgtact

SEQ ID NO: 634151 - DNA, 25 bp, Homo sapien
cccatgctgggcgtgtactataggt

SEQ ID NO: 634152 - DNA, 25 bp, Homo sapien
catgctgggcgtgtactataggtat

SEQ ID NO: 634153 - DNA, 25 bp, Homo sapien
ctgggcgtgtactataggtataaga

SEQ ID NO: 634154 - DNA, 25 bp, Homo sapien
gaatagtctttggagcatcatctga

SEQ ID NO: 634155 - DNA, 25 bp, Homo sapien
agcatcatctgagatagtgagccaa

SEQ ID NO: 634156 - DNA, 25 bp, Homo sapien
atttttgaacgtagggaactcactg

SEQ ID NO: 634157 - DNA, 25 bp, Homo sapien
ttgaacgtagggaactcactgataa

SEQ ID NO: 634158 - DNA, 25 bp, Homo sapien
aattatacataaaccctagaccaca

SEQ ID NO: 634159 - DNA, 25 bp, Homo sapien
atacataaaccctagaccacatctc

SEQ ID NO: 634160 - DNA, 25 bp, Homo sapien
cctagaccacatctctcgtgatatt

SEQ ID NO: 634161 - DNA, 25 bp, Homo sapien
gaccacatctctcgtgatattatta

SEQ ID NO: 634162 - DNA, 25 bp, Homo sapien
atctctcgtgatattattagtatag

SEQ ID NO: 634163 - DNA, 25 bp, Homo sapien
gaagtagagttgctatgtcaaaagt

SEQ ID NO: 634164 - DNA, 25 bp, Homo sapien
ttctattttcatctttaatcggatt

SEQ ID NO: 634165 - DNA, 25 bp, Homo sapien
catctttaatcggattttcattata

SEQ ID NO: 634166 - DNA, 25 bp, Homo sapien
ttgagaacagcccacgcgacatggc

SEQ ID NO: 634167 - DNA, 25 bp, Homo sapien
actcagcaaatgaccattttaagaa

SEQ ID NO: 634168 - DNA, 25 bp, Homo sapien
ctcagcaaatgaccattttaagaat

SEQ ID NO: 634169 - DNA, 25 bp, Homo sapien
gcaaatgaccattttaagaatacag

SEQ ID NO: 634170 - DNA, 25 bp, Homo sapien
caaatgaccattttaagaatacagc

SEQ ID NO: 634171 - DNA, 25 bp, Homo sapien
aaatgaccattttaagaatacagca

SEQ ID NO: 634172 - DNA, 25 bp, Homo sapien
aatgaccattttaagaatacagcag

SEQ ID NO: 634173 - DNA, 25 bp, Homo sapien
atgaccattttaagaatacagcagg

SEQ ID NO: 634174 - DNA, 25 bp, Homo sapien
tttaagaatacagcaggaccgggtg

SEQ ID NO: 634175 - DNA, 25 bp, Homo sapien
ttaagaatacagcaggaccgggtgt

SEQ ID NO: 634176 - DNA, 25 bp, Homo sapien
taagaatacagcaggaccgggtgtg

SEQ ID NO: 634177 - DNA, 25 bp, Homo sapien
aatacagcaggaccgggtgtggtgg

SEQ ID NO: 634178 - DNA, 25 bp, Homo sapien
ggaaggagacattaacaggaaggct

SEQ ID NO: 634179 - DNA, 25 bp, Homo sapien
atgaggtgtgtctctatgcaaagta

SEQ ID NO: 634180 - DNA, 25 bp, Homo sapien
gtgtctctatgcaaagtaggcacag

SEQ ID NO: 634181 - DNA, 25 bp, Homo sapien
ctgattgttgttctgtttcagccaa

SEQ ID NO: 634182 - DNA, 25 bp, Homo sapien
tgttctgtttcagccaatttcctca

SEQ ID NO: 634183 - DNA, 25 bp, Homo sapien
ttcagccaatttcctcactgttctg

SEQ ID NO: 634184 - DNA, 25 bp, Homo sapien
aaagtacagctggaatcaggactgc

SEQ ID NO: 634185 - DNA, 25 bp, Homo sapien
gaatcaggactgcagtctacagtta

SEQ ID NO: 634186 - DNA, 25 bp, Homo sapien
tgcagtctacagttaacatatgaat

SEQ ID NO: 634187 - DNA, 25 bp, Homo sapien
tagaaggaaattggccaagggtcat

SEQ ID NO: 634188 - DNA, 25 bp, Homo sapien
ccaagggtcattggtgtgtgtgata

SEQ ID NO: 634189 - DNA, 25 bp, Homo sapien
caacagcgatccaggtgagtggcga

SEQ ID NO: 634190 - DNA, 25 bp, Homo sapien
agtggcgaggtctctgctcccatgg

SEQ ID NO: 634191 - DNA, 25 bp, Homo sapien
cagggtggcatccacttggtacttg

SEQ ID NO: 634192 - DNA, 25 bp, Homo sapien
agggtggcatccacttggtacttgg

SEQ ID NO: 634193 - DNA, 25 bp, Homo sapien
tggagtttgtaactttgatttctgt

SEQ ID NO: 634194 - DNA, 25 bp, Homo sapien
tttctgttccattcagctgagcatg

SEQ ID NO: 634195 - DNA, 25 bp, Homo sapien
tgttccattcagctgagcatgccat

SEQ ID NO: 634196 - DNA, 25 bp, Homo sapien
ttccattcagctgagcatgccatgt

SEQ ID NO: 634197 - DNA, 25 bp, Homo sapien
cattcagctgagcatgccatgtgtt

SEQ ID NO: 634198 - DNA, 25 bp, Homo sapien
gctgagcatgccatgtgttgaactc

SEQ ID NO: 634199 - DNA, 25 bp, Homo sapien
ccatgtgttgaactccagtgttgga

SEQ ID NO: 634200 - DNA, 25 bp, Homo sapien
gatactcaccagatatttagcctac

SEQ ID NO: 634201 - DNA, 25 bp, Homo sapien
tttagcctacatgtcatttctaaca

SEQ ID NO: 634202 - DNA, 25 bp, Homo sapien
cttcccaagtatccagtaagctctt

SEQ ID NO: 634203 - DNA, 25 bp, Homo sapien
atccagtaagctctttgaaaggact

SEQ ID NO: 634204 - DNA, 25 bp, Homo sapien
ttcaggaccactcttagggcaatca

SEQ ID NO: 634205 - DNA, 25 bp, Homo sapien
cttggctttaactaaggagtcctag

SEQ ID NO: 634206 - DNA, 25 bp, Homo sapien
ggagtcctaggccaattaaagcaga

SEQ ID NO: 634207 - DNA, 25 bp, Homo sapien
ttaaccttgccaatacagtatattt

SEQ ID NO: 634208 - DNA, 25 bp, Homo sapien
gtatatttttccctactgaatctct

SEQ ID NO: 634209 - DNA, 25 bp, Homo sapien
ttttccctactgaatctctattagt

SEQ ID NO: 634210 - DNA, 25 bp, Homo sapien
gaatctctattagttacattgcaat

SEQ ID NO: 634211 - DNA, 25 bp, Homo sapien
caggaagcccgttcatgaggtgggt

SEQ ID NO: 634212 - DNA, 25 bp, Homo sapien
cacagtcgcacccttttgcggtgac

SEQ ID NO: 634213 - DNA, 25 bp, Homo sapien
ttgcggtgacccacattactgggca

SEQ ID NO: 634214 - DNA, 25 bp, Homo sapien
acattactgggcactcgggagggct

SEQ ID NO: 634215 - DNA, 25 bp, Homo sapien
gcactcgggagggctgttttctttc

SEQ ID NO: 634216 - DNA, 25 bp, Homo sapien
ttcccaggagccctaaggacagatg

SEQ ID NO: 634217 - DNA, 25 bp, Homo sapien
ggagccctaaggacagatgccgcag

SEQ ID NO: 634218 - DNA, 25 bp, Homo sapien
atgccgcagggcttggagttgtacc

SEQ ID NO: 634219 - DNA, 25 bp, Homo sapien
gcagggcttggagttgtaccccgta

SEQ ID NO: 634220 - DNA, 25 bp, Homo sapien
ggcttggagttgtaccccgtagcct

SEQ ID NO: 634221 - DNA, 25 bp, Homo sapien
tgaggttcttcttctcttaaaaaat

SEQ ID NO: 634222 - DNA, 25 bp, Homo sapien
atgttgaccaccctcatatttttgg

SEQ ID NO: 634223 - DNA, 25 bp, Homo sapien
ttttgcatgcataagctccagtatc

SEQ ID NO: 634224 - DNA, 25 bp, Homo sapien
agctccagtatcacacttaattttg

SEQ ID NO: 634225 - DNA, 25 bp, Homo sapien
taattttgcttgcttgctctctgaa

SEQ ID NO: 634226 - DNA, 25 bp, Homo sapien
ctctctgaagggagttcggatgacc

SEQ ID NO: 634227 - DNA, 25 bp, Homo sapien
ttcggatgaccgttacagcaaagtg

SEQ ID NO: 634228 - DNA, 25 bp, Homo sapien
ttttgcgtccaaagtgataagccaa

SEQ ID NO: 634229 - DNA, 25 bp, Homo sapien
tatcaggattttcccagtttctccg

SEQ ID NO: 634230 - DNA, 25 bp, Homo sapien
agtttctccgtaggactgatgttta

SEQ ID NO: 634231 - DNA, 25 bp, Homo sapien
gatgtttagaggaaagccttccctg

SEQ ID NO: 634232 - DNA, 25 bp, Homo sapien
gccttccctgactcaaatatgtttc

SEQ ID NO: 634233 - DNA, 25 bp, Homo sapien
agtttgagaacatatcctcccctga

SEQ ID NO: 634234 - DNA, 25 bp, Homo sapien
tttgagaacatatcctcccctgaga

SEQ ID NO: 634235 - DNA, 25 bp, Homo sapien
tgagaacatatcctcccctgagagt

SEQ ID NO: 634236 - DNA, 25 bp, Homo sapien
agaacatatcctcccctgagagttc

SEQ ID NO: 634237 - DNA, 25 bp, Homo sapien
ctgagagttcccctgcgcataggcc

SEQ ID NO: 634238 - DNA, 25 bp, Homo sapien
agttcccctgcgcataggcccgagt

SEQ ID NO: 634239 - DNA, 25 bp, Homo sapien
cgagtccctgtcacccgagcttggt

SEQ ID NO: 634240 - DNA, 25 bp, Homo sapien
tgtcacccgagcttggtcaccgaaa

SEQ ID NO: 634241 - DNA, 25 bp, Homo sapien
cacccgagcttggtcaccgaaaaga

SEQ ID NO: 634242 - DNA, 25 bp, Homo sapien
gtaggatacctggactccaacataa

SEQ ID NO: 634243 - DNA, 25 bp, Homo sapien
aggatacctggactccaacataaca

SEQ ID NO: 634244 - DNA, 25 bp, Homo sapien
caacagcgatccaggtgagtggcga

SEQ ID NO: 634245 - DNA, 25 bp, Homo sapien
agtggcgaggtctctgctcccatgg

SEQ ID NO: 634246 - DNA, 25 bp, Homo sapien
gtctctgctcccatggagaagggag

SEQ ID NO: 634247 - DNA, 25 bp, Homo sapien
cagggtggcatccacttggtacttg

SEQ ID NO: 634248 - DNA, 25 bp, Homo sapien
tggagtttgtaactttgatttctgt

SEQ ID NO: 634249 - DNA, 25 bp, Homo sapien
tttctgttccattcagctgagcatg

SEQ ID NO: 634250 - DNA, 25 bp, Homo sapien
gttccattcagctgagcatgccatg

SEQ ID NO: 634251 - DNA, 25 bp, Homo sapien
cattcagctgagcatgccatgtgtt

SEQ ID NO: 634252 - DNA, 25 bp, Homo sapien
gctgagcatgccatgtgttgaactc

SEQ ID NO: 634253 - DNA, 25 bp, Homo sapien
ccatgtgttgaactccagtgttgga

SEQ ID NO: 634254 - DNA, 25 bp, Homo sapien
agtagtacatagttgccacagcgga

SEQ ID NO: 634255 - DNA, 25 bp, Homo sapien
tctgcttttgacaccccgtcattaa

SEQ ID NO: 634256 - DNA, 25 bp, Homo sapien
gacaccccgtcattaagagatcagc

SEQ ID NO: 634257 - DNA, 25 bp, Homo sapien
agctcattagaaacgctctcctgtg

SEQ ID NO: 634258 - DNA, 25 bp, Homo sapien
tgtgctgtgtccctcatttctccgt

SEQ ID NO: 634259 - DNA, 25 bp, Homo sapien
ggaagagctacttgaaaggcctgtt

SEQ ID NO: 634260 - DNA, 25 bp, Homo sapien
gaaaggcctgttgttttaatggcaa

SEQ ID NO: 634261 - DNA, 25 bp, Homo sapien
atggcaaattcttggtgtcatttat

SEQ ID NO: 634262 - DNA, 25 bp, Homo sapien
agctgacccagccatttagagtgat

SEQ ID NO: 634263 - DNA, 25 bp, Homo sapien
gatcaaaggagctagtggtttaaca

SEQ ID NO: 634264 - DNA, 25 bp, Homo sapien
agccgaaatatccttcttgtggaga

SEQ ID NO: 634265 - DNA, 25 bp, Homo sapien
agttgccatgaattctgctctgctt

SEQ ID NO: 634266 - DNA, 25 bp, Homo sapien
gaaatacaaattacacactggcaat

SEQ ID NO: 634267 - DNA, 25 bp, Homo sapien
caaattacacactggcaattattat

SEQ ID NO: 634268 - DNA, 25 bp, Homo sapien
atttatgacatatattcagatgaag

SEQ ID NO: 634269 - DNA, 25 bp, Homo sapien
ataacactcttagatatttcagatg

SEQ ID NO: 634270 - DNA, 25 bp, Homo sapien
agaaggtccttctaagtgcgagtca

SEQ ID NO: 634271 - DNA, 25 bp, Homo sapien
aaggtccttctaagtgcgagtcaaa

SEQ ID NO: 634272 - DNA, 25 bp, Homo sapien
ggtccttctaagtgcgagtcaaaca

SEQ ID NO: 634273 - DNA, 25 bp, Homo sapien
ttctaagtgcgagtcaaacaccatg

SEQ ID NO: 634274 - DNA, 25 bp, Homo sapien
taagtgcgagtcaaacaccatgaat

SEQ ID NO: 634275 - DNA, 25 bp, Homo sapien
gtgcgagtcaaacaccatgaattta

SEQ ID NO: 634276 - DNA, 25 bp, Homo sapien
gagtcaaacaccatgaatttaaagg

SEQ ID NO: 634277 - DNA, 25 bp, Homo sapien
gaagtgtagcatagaaaccccgcct

SEQ ID NO: 634278 - DNA, 25 bp, Homo sapien
aagtgtagcatagaaaccccgcctg

SEQ ID NO: 634279 - DNA, 25 bp, Homo sapien
agtgtagcatagaaaccccgcctgc

SEQ ID NO: 634280 - DNA, 25 bp, Homo sapien
gtgtagcatagaaaccccgcctgct

SEQ ID NO: 634281 - DNA, 25 bp, Homo sapien
tgtagcatagaaaccccgcctgctg

SEQ ID NO: 634282 - DNA, 25 bp, Homo sapien
gtagcatagaaaccccgcctgctgg

SEQ ID NO: 634283 - DNA, 25 bp, Homo sapien
tagaaaccccgcctgctggctgtgg

SEQ ID NO: 634284 - DNA, 25 bp, Homo sapien
agaaaccccgcctgctggctgtgga

SEQ ID NO: 634285 - DNA, 25 bp, Homo sapien
gaaaccccgcctgctggctgtggaa

SEQ ID NO: 634286 - DNA, 25 bp, Homo sapien
ctggctgtggaacagaaataaactc

SEQ ID NO: 634287 - DNA, 25 bp, Homo sapien
tggctgtggaacagaaataaactcc

SEQ ID NO: 634288 - DNA, 25 bp, Homo sapien
gtgtggctgagacatttggtccatt

SEQ ID NO: 634289 - DNA, 25 bp, Homo sapien
agctcagtgcctaggacagggcctg

SEQ ID NO: 634290 - DNA, 25 bp, Homo sapien
ggcctgggacctggtagtcactcta

SEQ ID NO: 634291 - DNA, 25 bp, Homo sapien
ggtagtcactctatgcatttttgtt

SEQ ID NO: 634292 - DNA, 25 bp, Homo sapien
ggtgcaaatatctctgctgctgatg

SEQ ID NO: 634293 - DNA, 25 bp, Homo sapien
tctcccagagggaaggtcttgctgt

SEQ ID NO: 634294 - DNA, 25 bp, Homo sapien
tgctgtttggatgtgccagttattc

SEQ ID NO: 634295 - DNA, 25 bp, Homo sapien
ggatgtgccagttattctctctata

SEQ ID NO: 634296 - DNA, 25 bp, Homo sapien
tctctctataagatccacactcagc

SEQ ID NO: 634297 - DNA, 25 bp, Homo sapien
agatccacactcagcatttttcctt

SEQ ID NO: 634298 - DNA, 25 bp, Homo sapien
tacttcctggttttacctgtcttct

SEQ ID NO: 634299 - DNA, 25 bp, Homo sapien
ccagcacctgtcactatcggaaagg

SEQ ID NO: 634300 - DNA, 25 bp, Homo sapien
gaaacatctgtttaccgtttgtctc

SEQ ID NO: 634301 - DNA, 25 bp, Homo sapien
cactgttgtttatttgtctgaaatg

SEQ ID NO: 634302 - DNA, 25 bp, Homo sapien
gtctgaaatgtttggccccagggca

SEQ ID NO: 634303 - DNA, 25 bp, Homo sapien
cagggcagcatctactgatcactga

SEQ ID NO: 634304 - DNA, 25 bp, Homo sapien
gcatctactgatcactgaccagttg

SEQ ID NO: 634305 - DNA, 25 bp, Homo sapien
tgaccagttggctactgaacggtga

SEQ ID NO: 634306 - DNA, 25 bp, Homo sapien
ggctactgaacggtgaaggtctgat

SEQ ID NO: 634307 - DNA, 25 bp, Homo sapien
gtctgatgagctgatgagccgtccc

SEQ ID NO: 634308 - DNA, 25 bp, Homo sapien
atgagccgtcccctgggcttgaaat

SEQ ID NO: 634309 - DNA, 25 bp, Homo sapien
tgggcttgaaatctttcccgcggca

SEQ ID NO: 634310 - DNA, 25 bp, Homo sapien
cccagttttcctttgatcattccaa

SEQ ID NO: 634311 - DNA, 25 bp, Homo sapien
gcgaaatacctctttaatgcttaat

SEQ ID NO: 634312 - DNA, 25 bp, Homo sapien
taatgcttaatgtggcagtcacctt

SEQ ID NO: 634313 - DNA, 25 bp, Homo sapien
gtttctcctaaaacattttgctggc

SEQ ID NO: 634314 - DNA, 25 bp, Homo sapien
tcctaaaacattttgctggccttca

SEQ ID NO: 634315 - DNA, 25 bp, Homo sapien
aaacattttgctggccttcaataat

SEQ ID NO: 634316 - DNA, 25 bp, Homo sapien
cctaccaccgttttatgtctctgtg

SEQ ID NO: 634317 - DNA, 25 bp, Homo sapien
caccgttttatgtctctgtgggtta

SEQ ID NO: 634318 - DNA, 25 bp, Homo sapien
ccgttttatgtctctgtgggttaca

SEQ ID NO: 634319 - DNA, 25 bp, Homo sapien
atgtctctgtgggttacaattttct

SEQ ID NO: 634320 - DNA, 25 bp, Homo sapien
tctctgtgggttacaattttcttgg

SEQ ID NO: 634321 - DNA, 25 bp, Homo sapien
caaggacccctgtatgttggggcgt

SEQ ID NO: 634322 - DNA, 25 bp, Homo sapien
gacccctgtatgttggggcgtgtcc

SEQ ID NO: 634323 - DNA, 25 bp, Homo sapien
aggcggccctccatggtgcccagca

SEQ ID NO: 634324 - DNA, 25 bp, Homo sapien
atggtgcccagcagcagccctgctt

SEQ ID NO: 634325 - DNA, 25 bp, Homo sapien
tgcttgcggaccctctttagtcccc

SEQ ID NO: 634326 - DNA, 25 bp, Homo sapien
ttgcggaccctctttagtccccact

SEQ ID NO: 634327 - DNA, 25 bp, Homo sapien
gcggaccctctttagtccccactgt

SEQ ID NO: 634328 - DNA, 25 bp, Homo sapien
ttcagtgaaaattgacactagctgg

SEQ ID NO: 634329 - DNA, 25 bp, Homo sapien
cagtgaaaattgacactagctgggc

SEQ ID NO: 634330 - DNA, 25 bp, Homo sapien
agtgaaaattgacactagctgggca

SEQ ID NO: 634331 - DNA, 25 bp, Homo sapien
gtgaaaattgacactagctgggcat

SEQ ID NO: 634332 - DNA, 25 bp, Homo sapien
cgtgataatcttgggtctgtcttga

SEQ ID NO: 634333 - DNA, 25 bp, Homo sapien
atcttgggtctgtcttgaccacaaa

SEQ ID NO: 634334 - DNA, 25 bp, Homo sapien
gaccacaaaaacatatgcaccaaat

SEQ ID NO: 634335 - DNA, 25 bp, Homo sapien
acatagtttaagttgtgcttcatat

SEQ ID NO: 634336 - DNA, 25 bp, Homo sapien
atattttattgactgctttgcttct

SEQ ID NO: 634337 - DNA, 25 bp, Homo sapien
gcttctgacaggacagtttcctgaa

SEQ ID NO: 634338 - DNA, 25 bp, Homo sapien
agttacaacacccacataccaaaga

SEQ ID NO: 634339 - DNA, 25 bp, Homo sapien
tttgttacaggaagtgacatctgct

SEQ ID NO: 634340 - DNA, 25 bp, Homo sapien
gtgacatctgctataattttaacat

SEQ ID NO: 634341 - DNA, 25 bp, Homo sapien
tttaacatttacttcccagtaggag

SEQ ID NO: 634342 - DNA, 25 bp, Homo sapien
tacttcccagtaggagttccattta

SEQ ID NO: 634343 - DNA, 25 bp, Homo sapien
tccttctaaacccagtatgtattct

SEQ ID NO: 634344 - DNA, 25 bp, Homo sapien
ctaaacccagtatgtattctatgta

SEQ ID NO: 634345 - DNA, 25 bp, Homo sapien
ccagtatgtattctatgtatgcacc

SEQ ID NO: 634346 - DNA, 25 bp, Homo sapien
gtatgcaccttacaataagattagc

SEQ ID NO: 634347 - DNA, 25 bp, Homo sapien
ttcctgtcttttaaactaaatcata

SEQ ID NO: 634348 - DNA, 25 bp, Homo sapien
ttacagcacatcttactggtcatgc

SEQ ID NO: 634349 - DNA, 25 bp, Homo sapien
acagcacatcttactggtcatgcat

SEQ ID NO: 634350 - DNA, 25 bp, Homo sapien
gcacatcttactggtcatgcattta

SEQ ID NO: 634351 - DNA, 25 bp, Homo sapien
acatcttactggtcatgcatttaaa

SEQ ID NO: 634352 - DNA, 25 bp, Homo sapien
cttactggtcatgcatttaaatcta

SEQ ID NO: 634353 - DNA, 25 bp, Homo sapien
ctggtcatgcatttaaatctatatt

SEQ ID NO: 634354 - DNA, 25 bp, Homo sapien
atccagttgtgttgggattggttcc

SEQ ID NO: 634355 - DNA, 25 bp, Homo sapien
tgagcccagtttgcattagatctat

SEQ ID NO: 634356 - DNA, 25 bp, Homo sapien
agcccagtttgcattagatctatac

SEQ ID NO: 634357 - DNA, 25 bp, Homo sapien
agatctatacttgtgcttgtggacc

SEQ ID NO: 634358 - DNA, 25 bp, Homo sapien
atctatacttgtgcttgtggacctc

SEQ ID NO: 634359 - DNA, 25 bp, Homo sapien
ctatacttgtgcttgtggacctcaa

SEQ ID NO: 634360 - DNA, 25 bp, Homo sapien
atacttgtgcttgtggacctcaaat

SEQ ID NO: 634361 - DNA, 25 bp, Homo sapien
acttgtgcttgtggacctcaaatat

SEQ ID NO: 634362 - DNA, 25 bp, Homo sapien
tgtgcttgtggacctcaaatatgtg

SEQ ID NO: 634363 - DNA, 25 bp, Homo sapien
acctcaaatatgtggtaatttcagt

SEQ ID NO: 634364 - DNA, 25 bp, Homo sapien
taatttcagtagaatccagttgtgt

SEQ ID NO: 634365 - DNA, 25 bp, Homo sapien
gggacaagacttgctgcttatcaat

SEQ ID NO: 634366 - DNA, 25 bp, Homo sapien
gacttgctgcttatcaatctttgca

SEQ ID NO: 634367 - DNA, 25 bp, Homo sapien
caatctttgcagtagagggaattct

SEQ ID NO: 634368 - DNA, 25 bp, Homo sapien
agggaattctgtggcaggcagctat

SEQ ID NO: 634369 - DNA, 25 bp, Homo sapien
tggcaggcagctatcagacttgaac

SEQ ID NO: 634370 - DNA, 25 bp, Homo sapien
atcagacttgaactgcaataccggc

SEQ ID NO: 634371 - DNA, 25 bp, Homo sapien
tcttcctggctttccagcttgtggg

SEQ ID NO: 634372 - DNA, 25 bp, Homo sapien
aatcatgtgaaccatttccttaaaa

SEQ ID NO: 634373 - DNA, 25 bp, Homo sapien
tatgtatatgatctgtttctctggg

SEQ ID NO: 634374 - DNA, 25 bp, Homo sapien
acaatgatctaaaccaattttctgt

SEQ ID NO: 634375 - DNA, 25 bp, Homo sapien
agctttgtattacggcaatttgcta

SEQ ID NO: 634376 - DNA, 25 bp, Homo sapien
attattgtgcgagacatcttaccgg

SEQ ID NO: 634377 - DNA, 25 bp, Homo sapien
tattgtgcgagacatcttaccgggt

SEQ ID NO: 634378 - DNA, 25 bp, Homo sapien
ttgtgcgagacatcttaccgggtgg

SEQ ID NO: 634379 - DNA, 25 bp, Homo sapien
gtgcgagacatcttaccgggtggta

SEQ ID NO: 634380 - DNA, 25 bp, Homo sapien
gcgagacatcttaccgggtggtatt

SEQ ID NO: 634381 - DNA, 25 bp, Homo sapien
acatcttaccgggtggtattgtatt

SEQ ID NO: 634382 - DNA, 25 bp, Homo sapien
accgggtggtattgtattagtagca

SEQ ID NO: 634383 - DNA, 25 bp, Homo sapien
cgggtggtattgtattagtagcagt

SEQ ID NO: 634384 - DNA, 25 bp, Homo sapien
agttgggccccgtgctactactacg

SEQ ID NO: 634385 - DNA, 25 bp, Homo sapien
tgggccccgtgctactactacggta

SEQ ID NO: 634386 - DNA, 25 bp, Homo sapien
ccccgtgctactactacggtatgga

SEQ ID NO: 634387 - DNA, 25 bp, Homo sapien
tgcccaaatcagagagacctagaaa

SEQ ID NO: 634388 - DNA, 25 bp, Homo sapien
gcttccttcttccttaaccagcaaa

SEQ ID NO: 634389 - DNA, 25 bp, Homo sapien
tccatgccctatgtctcctaaatgt

SEQ ID NO: 634390 - DNA, 25 bp, Homo sapien
gtctcctaaatgtccttcaaatcca

SEQ ID NO: 634391 - DNA, 25 bp, Homo sapien
tctccctcacattctaacactggaa

SEQ ID NO: 634392 - DNA, 25 bp, Homo sapien
aacactggaatagtctctgtcctaa

SEQ ID NO: 634393 - DNA, 25 bp, Homo sapien
aatagtctctgtcctaatatgcagc

SEQ ID NO: 634394 - DNA, 25 bp, Homo sapien
aaactggaaattgctaccctctcct

SEQ ID NO: 634395 - DNA, 25 bp, Homo sapien
ttaaaccccttccttgaatatctgc

SEQ ID NO: 634396 - DNA, 25 bp, Homo sapien
tgaatatctgcccacactcacagtc

SEQ ID NO: 634397 - DNA, 25 bp, Homo sapien
ctcacagtcctcttcccaggagaaa

SEQ ID NO: 634398 - DNA, 25 bp, Homo sapien
atgctgatatgtcccctggtatttt

SEQ ID NO: 634399 - DNA, 25 bp, Homo sapien
tgctgatatgtcccctggtattttt

SEQ ID NO: 634400 - DNA, 25 bp, Homo sapien
gctgatatgtcccctggtatttttt

SEQ ID NO: 634401 - DNA, 25 bp, Homo sapien
ctgatatgtcccctggtatttttta

SEQ ID NO: 634402 - DNA, 25 bp, Homo sapien
tgatatgtcccctggtattttttaa

SEQ ID NO: 634403 - DNA, 25 bp, Homo sapien
atttttggccgggtacagtggctca

SEQ ID NO: 634404 - DNA, 25 bp, Homo sapien
tttttggccgggtacagtggctcat

SEQ ID NO: 634405 - DNA, 25 bp, Homo sapien
ggaggttacagtgagttgcgatcgc

SEQ ID NO: 634406 - DNA, 25 bp, Homo sapien
gaggttacagtgagttgcgatcgcg

SEQ ID NO: 634407 - DNA, 25 bp, Homo sapien
gttacagtgagttgcgatcgcgcca

SEQ ID NO: 634408 - DNA, 25 bp, Homo sapien
ttacagtgagttgcgatcgcgccac

SEQ ID NO: 634409 - DNA, 25 bp, Homo sapien
gatccaaatatgtaattagtcattt

SEQ ID NO: 634410 - DNA, 25 bp, Homo sapien
gtcatttatgtatctaagctgtttg

SEQ ID NO: 634411 - DNA, 25 bp, Homo sapien
gtatctaagctgtttgtatgtatga

SEQ ID NO: 634412 - DNA, 25 bp, Homo sapien
gtatgtatgatacaagttttcacat

SEQ ID NO: 634413 - DNA, 25 bp, Homo sapien
gttttcacatacaaatttcttcttt

SEQ ID NO: 634414 - DNA, 25 bp, Homo sapien
cagtgcctggcccaaattattgtag

SEQ ID NO: 634415 - DNA, 25 bp, Homo sapien
gtgcctggcccaaattattgtagtt

SEQ ID NO: 634416 - DNA, 25 bp, Homo sapien
gcctggcccaaattattgtagttat

SEQ ID NO: 634417 - DNA, 25 bp, Homo sapien
tattgtagttatttccaattccttt

SEQ ID NO: 634418 - DNA, 25 bp, Homo sapien
cccttctcacatcccaattaaagaa

SEQ ID NO: 634419 - DNA, 25 bp, Homo sapien
tcccaattaaagaattccactcagg

SEQ ID NO: 634420 - DNA, 25 bp, Homo sapien
taacggcagatcctagccctgagtg

SEQ ID NO: 634421 - DNA, 25 bp, Homo sapien
gccctgagtgcccagaaattctatg

SEQ ID NO: 634422 - DNA, 25 bp, Homo sapien
gagtgcccagaaattctatgtaaag

SEQ ID NO: 634423 - DNA, 25 bp, Homo sapien
aagaatgagaaccaaaccaggctcc

SEQ ID NO: 634424 - DNA, 25 bp, Homo sapien
aggctcccactaatttagaattcaa

SEQ ID NO: 634425 - DNA, 25 bp, Homo sapien
ttagaattcaaacaaccccaaagct

SEQ ID NO: 634426 - DNA, 25 bp, Homo sapien
attgcatagtcatcagtgagcttta

SEQ ID NO: 634427 - DNA, 25 bp, Homo sapien
ttggcctatcaaagtaagactcatt

SEQ ID NO: 634428 - DNA, 25 bp, Homo sapien
gtaagactcatttatgttcagtcta

SEQ ID NO: 634429 - DNA, 25 bp, Homo sapien
tgtgttttgtgctatcctgattcct

SEQ ID NO: 634430 - DNA, 25 bp, Homo sapien
ttttgtgctatcctgattcctttaa

SEQ ID NO: 634431 - DNA, 25 bp, Homo sapien
gaagtagtccctttcgtgtgaattt

SEQ ID NO: 634432 - DNA, 25 bp, Homo sapien
gtagtccctttcgtgtgaatttcca

SEQ ID NO: 634433 - DNA, 25 bp, Homo sapien
tagtccctttcgtgtgaatttccaa

SEQ ID NO: 634434 - DNA, 25 bp, Homo sapien
cgtgtgaatttccaaaccactcgcc

SEQ ID NO: 634435 - DNA, 25 bp, Homo sapien
gtgtgaatttccaaaccactcgccc

SEQ ID NO: 634436 - DNA, 25 bp, Homo sapien
aaaccactcgccctccctcgcacag

SEQ ID NO: 634437 - DNA, 25 bp, Homo sapien
accactcgccctccctcgcacagta

SEQ ID NO: 634438 - DNA, 25 bp, Homo sapien
ccactcgccctccctcgcacagtaa

SEQ ID NO: 634439 - DNA, 25 bp, Homo sapien
acagtaataaatggcagtgtcctca

SEQ ID NO: 634440 - DNA, 25 bp, Homo sapien
cagtaataaatggcagtgtcctcag

SEQ ID NO: 634441 - DNA, 25 bp, Homo sapien
agtaataaatggcagtgtcctcagc

SEQ ID NO: 634442 - DNA, 25 bp, Homo sapien
gcatgcaccatcataaccagatcat

SEQ ID NO: 634443 - DNA, 25 bp, Homo sapien
catgcaccatcataaccagatcatt

SEQ ID NO: 634444 - DNA, 25 bp, Homo sapien
atgcaccatcataaccagatcattt

SEQ ID NO: 634445 - DNA, 25 bp, Homo sapien
tgcaccatcataaccagatcatttt

SEQ ID NO: 634446 - DNA, 25 bp, Homo sapien
gcaccatcataaccagatcattttt

SEQ ID NO: 634447 - DNA, 25 bp, Homo sapien
caccatcataaccagatcatttttt

SEQ ID NO: 634448 - DNA, 25 bp, Homo sapien
accatcataaccagatcattttttg

SEQ ID NO: 634449 - DNA, 25 bp, Homo sapien
ccatcataaccagatcattttttgt

SEQ ID NO: 634450 - DNA, 25 bp, Homo sapien
gaaaagcagctcatgatcttctctg

SEQ ID NO: 634451 - DNA, 25 bp, Homo sapien
gctcatgatcttctctgcagtaaat

SEQ ID NO: 634452 - DNA, 25 bp, Homo sapien
tgcagtaaatctcactgggtccctc

SEQ ID NO: 634453 - DNA, 25 bp, Homo sapien
atcttcatctcctacatttgcatcc

SEQ ID NO: 634454 - DNA, 25 bp, Homo sapien
atctcctacatttgcatcctctttt

SEQ ID NO: 634455 - DNA, 25 bp, Homo sapien
aaaaatccagtcttccgagggcaag

SEQ ID NO: 634456 - DNA, 25 bp, Homo sapien
cttccgagggcaagtgcagagcatt

SEQ ID NO: 634457 - DNA, 25 bp, Homo sapien
actgtcgtcaccatcttttatggca

SEQ ID NO: 634458 - DNA, 25 bp, Homo sapien
tatggcacactgtttttcatgtacc

SEQ ID NO: 634459 - DNA, 25 bp, Homo sapien
ggaagccaaacaaagtagtctctgt

SEQ ID NO: 634460 - DNA, 25 bp, Homo sapien
aagtagtctctgtgttttatagtct

SEQ ID NO: 634461 - DNA, 25 bp, Homo sapien
gacttctactcccataaactaggtt

SEQ ID NO: 634462 - DNA, 25 bp, Homo sapien
ttctactcccataaactaggtttgc

SEQ ID NO: 634463 - DNA, 25 bp, Homo sapien
actcccataaactaggtttgcttgt

SEQ ID NO: 634464 - DNA, 25 bp, Homo sapien
aactaggtttgcttgtttgtgaact

SEQ ID NO: 634465 - DNA, 25 bp, Homo sapien
aggtttgcttgtttgtgaacttcat

SEQ ID NO: 634466 - DNA, 25 bp, Homo sapien
gtttttgagatttatccaggtgatt

SEQ ID NO: 634467 - DNA, 25 bp, Homo sapien
gatttatccaggtgattgtatcagt

SEQ ID NO: 634468 - DNA, 25 bp, Homo sapien
catttggatcctttccagtttgggc

SEQ ID NO: 634469 - DNA, 25 bp, Homo sapien
tttggatcctttccagtttgggcat

SEQ ID NO: 634470 - DNA, 25 bp, Homo sapien
ggatcctttccagtttgggcatatt

SEQ ID NO: 634471 - DNA, 25 bp, Homo sapien
tcctttccagtttgggcatattgtg

SEQ ID NO: 634472 - DNA, 25 bp, Homo sapien
agcctgtctcttcacatgagtcaga

SEQ ID NO: 634473 - DNA, 25 bp, Homo sapien
tctcttcacatgagtcagacgtgca

SEQ ID NO: 634474 - DNA, 25 bp, Homo sapien
tcacatgagtcagacgtgcagggta

SEQ ID NO: 634475 - DNA, 25 bp, Homo sapien
gggtaggatcagaaggagatactct

SEQ ID NO: 634476 - DNA, 25 bp, Homo sapien
tcagactccgcccttgggaaagata

SEQ ID NO: 634477 - DNA, 25 bp, Homo sapien
ccttgggaaagataaccaccatctg

SEQ ID NO: 634478 - DNA, 25 bp, Homo sapien
cagagtcctcttcagtcattgattg

SEQ ID NO: 634479 - DNA, 25 bp, Homo sapien
atctgctctaatcatgtagacgtac

SEQ ID NO: 634480 - DNA, 25 bp, Homo sapien
taatcatgtagacgtactgccgcct

SEQ ID NO: 634481 - DNA, 25 bp, Homo sapien
catgtagacgtactgccgcctggtt

SEQ ID NO: 634482 - DNA, 25 bp, Homo sapien
gtcctcttcagtcattgattgattg

SEQ ID NO: 634483 - DNA, 25 bp, Homo sapien
gaggaccccaagaactggataaaag

SEQ ID NO: 634484 - DNA, 25 bp, Homo sapien
cagaggaggtgaactttttctcaca

SEQ ID NO: 634485 - DNA, 25 bp, Homo sapien
gaactttttctcacaatccttctaa

SEQ ID NO: 634486 - DNA, 25 bp, Homo sapien
ttttctcacaatccttctaaaccca

SEQ ID NO: 634487 - DNA, 25 bp, Homo sapien
aaagggcttcattcacaatagcatc

SEQ ID NO: 634488 - DNA, 25 bp, Homo sapien
ttcacaatagcatcatggtcctccc

SEQ ID NO: 634489 - DNA, 25 bp, Homo sapien
atggtcctccctcgacagacttgtg

SEQ ID NO: 634490 - DNA, 25 bp, Homo sapien
cctcgacagacttgtgggttgttca

SEQ ID NO: 634491 - DNA, 25 bp, Homo sapien
acagacttgtgggttgttcactcac

SEQ ID NO: 634492 - DNA, 25 bp, Homo sapien
tgggttgttcactcacactattttc

SEQ ID NO: 634493 - DNA, 25 bp, Homo sapien
ttgttcactcacactattttctaca

SEQ ID NO: 634494 - DNA, 25 bp, Homo sapien
atcacgtccacatgcccgtttgtga

SEQ ID NO: 634495 - DNA, 25 bp, Homo sapien
tcacgtccacatgcccgtttgtgag

SEQ ID NO: 634496 - DNA, 25 bp, Homo sapien
cacgtccacatgcccgtttgtgagc

SEQ ID NO: 634497 - DNA, 25 bp, Homo sapien
acgtccacatgcccgtttgtgagcc

SEQ ID NO: 634498 - DNA, 25 bp, Homo sapien
cgtccacatgcccgtttgtgagcca

SEQ ID NO: 634499 - DNA, 25 bp, Homo sapien
gtccacatgcccgtttgtgagccag

SEQ ID NO: 634500 - DNA, 25 bp, Homo sapien
tccacatgcccgtttgtgagccagg

SEQ ID NO: 634501 - DNA, 25 bp, Homo sapien
ccacatgcccgtttgtgagccaggg

SEQ ID NO: 634502 - DNA, 25 bp, Homo sapien
cacatgcccgtttgtgagccagggg

SEQ ID NO: 634503 - DNA, 25 bp, Homo sapien
acatgcccgtttgtgagccaggggg

SEQ ID NO: 634504 - DNA, 25 bp, Homo sapien
taaatattacaaggccttggcccag

SEQ ID NO: 634505 - DNA, 25 bp, Homo sapien
atattacaaggccttggcccagtgc

SEQ ID NO: 634506 - DNA, 25 bp, Homo sapien
ttacaaggccttggcccagtgcggt

SEQ ID NO: 634507 - DNA, 25 bp, Homo sapien
cagcctggctggtggagcctcgtct

SEQ ID NO: 634508 - DNA, 25 bp, Homo sapien
tggagcctcgtctctactgggaatg

SEQ ID NO: 634509 - DNA, 25 bp, Homo sapien
gagcctcgtctctactgggaatgca

SEQ ID NO: 634510 - DNA, 25 bp, Homo sapien
gcctcgtctctactgggaatgcaga

SEQ ID NO: 634511 - DNA, 25 bp, Homo sapien
ctactgggaatgcagaggttagcca

SEQ ID NO: 634512 - DNA, 25 bp, Homo sapien
gaatgcagaggttagccaggcgtgg

SEQ ID NO: 634513 - DNA, 25 bp, Homo sapien
tgcactccagcataagctgcagggt

SEQ ID NO: 634514 - DNA, 25 bp, Homo sapien
agcataagctgcagggtgagactct

SEQ ID NO: 634515 - DNA, 25 bp, Homo sapien
gggaagacactgtataacatccaaa

SEQ ID NO: 634516 - DNA, 25 bp, Homo sapien
gaagacactgtataacatccaaatg

SEQ ID NO: 634517 - DNA, 25 bp, Homo sapien
gatctgactgtagggactatattca

SEQ ID NO: 634518 - DNA, 25 bp, Homo sapien
gggactatattcattactgctggac

SEQ ID NO: 634519 - DNA, 25 bp, Homo sapien
gactatattcattactgctggacta

SEQ ID NO: 634520 - DNA, 25 bp, Homo sapien
attcattactgctggactatgctgc

SEQ ID NO: 634521 - DNA, 25 bp, Homo sapien
cattactgctggactatgctgcttt

SEQ ID NO: 634522 - DNA, 25 bp, Homo sapien
tgctggactatgctgctttccccaa

SEQ ID NO: 634523 - DNA, 25 bp, Homo sapien
ttttaaaaatagcacgctgcacttg

SEQ ID NO: 634524 - DNA, 25 bp, Homo sapien
aaatagcacgctgcacttgaaacag

SEQ ID NO: 634525 - DNA, 25 bp, Homo sapien
atagcacgctgcacttgaaacaggg

SEQ ID NO: 634526 - DNA, 25 bp, Homo sapien
cagcgtttcttattggaggcatttt

SEQ ID NO: 634527 - DNA, 25 bp, Homo sapien
ttatagctacaaacaatcgatcaag

SEQ ID NO: 634528 - DNA, 25 bp, Homo sapien
tcgatcaagcctaaaagggcattta

SEQ ID NO: 634529 - DNA, 25 bp, Homo sapien
gatggatttaaaaagccgtttcaag

SEQ ID NO: 634530 - DNA, 25 bp, Homo sapien
agccgtttcaagatgaaatcttaca

SEQ ID NO: 634531 - DNA, 25 bp, Homo sapien
gaaatcttacaagtctttttcatgt

SEQ ID NO: 634532 - DNA, 25 bp, Homo sapien
gtctttttcatgtcttctgagggct

SEQ ID NO: 634533 - DNA, 25 bp, Homo sapien
tcatgtcttctgagggctgagatat

SEQ ID NO: 634534 - DNA, 25 bp, Homo sapien
ctgagggctgagatataactttgaa

SEQ ID NO: 634535 - DNA, 25 bp, Homo sapien
tcatgaagacggcttcttctccaaa

SEQ ID NO: 634536 - DNA, 25 bp, Homo sapien
gacggcttcttctccaaatgatgtt

SEQ ID NO: 634537 - DNA, 25 bp, Homo sapien
gaggccagaagcatggaatgacata

SEQ ID NO: 634538 - DNA, 25 bp, Homo sapien
tggaatgacatattcaaagtgcccc

SEQ ID NO: 634539 - DNA, 25 bp, Homo sapien
gacatattcaaagtgccccctaaag

SEQ ID NO: 634540 - DNA, 25 bp, Homo sapien
ggttaaccaaggaccctatatctag

SEQ ID NO: 634541 - DNA, 25 bp, Homo sapien
accaaggaccctatatctagcaaag

SEQ ID NO: 634542 - DNA, 25 bp, Homo sapien
ggaccctatatctagcaaagtgatc

SEQ ID NO: 634543 - DNA, 25 bp, Homo sapien
acagaatttgttgctaccagaccca

SEQ ID NO: 634544 - DNA, 25 bp, Homo sapien
tgctaccagacccaccttacaagaa

SEQ ID NO: 634545 - DNA, 25 bp, Homo sapien
ccaccttacaagaaatactagagtt

SEQ ID NO: 634546 - DNA, 25 bp, Homo sapien
ggctgaaagtaagtgaccacagaca

SEQ ID NO: 634547 - DNA, 25 bp, Homo sapien
gtgaccacagacaataattcaaatt

SEQ ID NO: 634548 - DNA, 25 bp, Homo sapien
gaagtaggaggatcaatcaagcccg

SEQ ID NO: 634549 - DNA, 25 bp, Homo sapien
agtaggaggatcaatcaagcccggg

SEQ ID NO: 634550 - DNA, 25 bp, Homo sapien
gagttgtgattgcactgctgccctc

SEQ ID NO: 634551 - DNA, 25 bp, Homo sapien
ggtgacagtgagaccttctttcaaa

SEQ ID NO: 634552 - DNA, 25 bp, Homo sapien
tggctgtcaagatctggcagactgc

SEQ ID NO: 634553 - DNA, 25 bp, Homo sapien
gatctggcagactgccttacatcat

SEQ ID NO: 634554 - DNA, 25 bp, Homo sapien
tggcagactgccttacatcatggct

SEQ ID NO: 634555 - DNA, 25 bp, Homo sapien
agactgccttacatcatggctcatg

SEQ ID NO: 634556 - DNA, 25 bp, Homo sapien
gactgccttacatcatggctcatgc

SEQ ID NO: 634557 - DNA, 25 bp, Homo sapien
gaggccgaggtttgcttgcttaagc

SEQ ID NO: 634558 - DNA, 25 bp, Homo sapien
ccgaggtttgcttgcttaagcccag

SEQ ID NO: 634559 - DNA, 25 bp, Homo sapien
gaatgcattgctttccatgcgtggt

SEQ ID NO: 634560 - DNA, 25 bp, Homo sapien
attgctttccatgcgtggtgactta

SEQ ID NO: 634561 - DNA, 25 bp, Homo sapien
gcgtggtgacttaattttatgtgca

SEQ ID NO: 634562 - DNA, 25 bp, Homo sapien
actatgcaatacacagagacttacc

SEQ ID NO: 634563 - DNA, 25 bp, Homo sapien
gagacttacctaactgctgttcttg

SEQ ID NO: 634564 - DNA, 25 bp, Homo sapien
cttggagggtctattaggcattaaa

SEQ ID NO: 634565 - DNA, 25 bp, Homo sapien
ggcattaaagtgtaagtatccctat

SEQ ID NO: 634566 - DNA, 25 bp, Homo sapien
aagtatccctattgttatttacact

SEQ ID NO: 634567 - DNA, 25 bp, Homo sapien
aaaagcatacctcaggtctttgaga

SEQ ID NO: 634568 - DNA, 25 bp, Homo sapien
acctcaggtctttgagaatccagga

SEQ ID NO: 634569 - DNA, 25 bp, Homo sapien
aagctttgttttagaatattgctcc

SEQ ID NO: 634570 - DNA, 25 bp, Homo sapien
tatttggtattcctggtcctgtgtt

SEQ ID NO: 634571 - DNA, 25 bp, Homo sapien
ggtattcctggtcctgtgttagttt

SEQ ID NO: 634572 - DNA, 25 bp, Homo sapien
ctgtgttagtttgcttacaataatg

SEQ ID NO: 634573 - DNA, 25 bp, Homo sapien
actccctccatgttgctacaaagga

SEQ ID NO: 634574 - DNA, 25 bp, Homo sapien
aatattgttcttttacatggctgtg

SEQ ID NO: 634575 - DNA, 25 bp, Homo sapien
gttcttttacatggctgtgtagcat

SEQ ID NO: 634576 - DNA, 25 bp, Homo sapien
ggctgtgtagcataccatgctgtac

SEQ ID NO: 634577 - DNA, 25 bp, Homo sapien
gcataccatgctgtacatgcatcac

SEQ ID NO: 634578 - DNA, 25 bp, Homo sapien
catgctgtacatgcatcacattttc

SEQ ID NO: 634579 - DNA, 25 bp, Homo sapien
tccatatatctgcaattgtgaatag

SEQ ID NO: 634580 - DNA, 25 bp, Homo sapien
ttctattcctttggatatgtatgaa

SEQ ID NO: 634581 - DNA, 25 bp, Homo sapien
gcgcccagcaatttgaactcttttc

SEQ ID NO: 634582 - DNA, 25 bp, Homo sapien
gctggtttcagtccccacttttgga

SEQ ID NO: 634583 - DNA, 25 bp, Homo sapien
agtccccacttttggatcgctcatt

SEQ ID NO: 634584 - DNA, 25 bp, Homo sapien
ttttggatcgctcattccctggcat

SEQ ID NO: 634585 - DNA, 25 bp, Homo sapien
ggatcgctcattccctggcatgcag

SEQ ID NO: 634586 - DNA, 25 bp, Homo sapien
atgcagggattgttggagccacatg

SEQ ID NO: 634587 - DNA, 25 bp, Homo sapien
ttgttggagccacatggaccatgcc

SEQ ID NO: 634588 - DNA, 25 bp, Homo sapien
ggagccacatggaccatgccagtca

SEQ ID NO: 634589 - DNA, 25 bp, Homo sapien
tgccagtcactctgccctagtgaat

SEQ ID NO: 634590 - DNA, 25 bp, Homo sapien
tctgccctagtgaattcgagtggtg

SEQ ID NO: 634591 - DNA, 25 bp, Homo sapien
cctagtgaattcgagtggtgaccag

SEQ ID NO: 634592 - DNA, 25 bp, Homo sapien
tcccctgcaaagaccctcgaaagat

SEQ ID NO: 634593 - DNA, 25 bp, Homo sapien
gaccctcgaaagatctcttggctgt

SEQ ID NO: 634594 - DNA, 25 bp, Homo sapien
gtgatttgatttgagctcttctgga

SEQ ID NO: 634595 - DNA, 25 bp, Homo sapien
gagctcttctggaaggtcctataga

SEQ ID NO: 634596 - DNA, 25 bp, Homo sapien
aggtcctatagagggccttatctag

SEQ ID NO: 634597 - DNA, 25 bp, Homo sapien
gagggccttatctaggttgttgaat

SEQ ID NO: 634598 - DNA, 25 bp, Homo sapien
gccttatctaggttgttgaatcttt

SEQ ID NO: 634599 - DNA, 25 bp, Homo sapien
ccagggcccacctgtggcaaaggag

SEQ ID NO: 634600 - DNA, 25 bp, Homo sapien
aaaggaggccccaaataatagccat

SEQ ID NO: 634601 - DNA, 25 bp, Homo sapien
aggccccaaataatagccatcctgg

SEQ ID NO: 634602 - DNA, 25 bp, Homo sapien
gccatcctggttttcttgcaaaaaa

SEQ ID NO: 634603 - DNA, 25 bp, Homo sapien
gatgctgcagccttataaactaagt

SEQ ID NO: 634604 - DNA, 25 bp, Homo sapien
atgctgcagccttataaactaagtc

SEQ ID NO: 634605 - DNA, 25 bp, Homo sapien
tgctgcagccttataaactaagtca

SEQ ID NO: 634606 - DNA, 25 bp, Homo sapien
gctgcagccttataaactaagtcaa

SEQ ID NO: 634607 - DNA, 25 bp, Homo sapien
ctgcagccttataaactaagtcaaa

SEQ ID NO: 634608 - DNA, 25 bp, Homo sapien
aaactaagtcaaaaatcttgatctt

SEQ ID NO: 634609 - DNA, 25 bp, Homo sapien
aaaaatcttgatcttggctaggtgc

SEQ ID NO: 634610 - DNA, 25 bp, Homo sapien
ggccgaggcggaagggtcaccaggt

SEQ ID NO: 634611 - DNA, 25 bp, Homo sapien
gccgaggcggaagggtcaccaggtc

SEQ ID NO: 634612 - DNA, 25 bp, Homo sapien
aggcggaagggtcaccaggtcagga

SEQ ID NO: 634613 - DNA, 25 bp, Homo sapien
ggcggaagggtcaccaggtcaggag

SEQ ID NO: 634614 - DNA, 25 bp, Homo sapien
aaggtttggattcaaagcctggtca

SEQ ID NO: 634615 - DNA, 25 bp, Homo sapien
aggtttggattcaaagcctggtcat

SEQ ID NO: 634616 - DNA, 25 bp, Homo sapien
gtttggattcaaagcctggtcatat

SEQ ID NO: 634617 - DNA, 25 bp, Homo sapien
tttggattcaaagcctggtcatatg

SEQ ID NO: 634618 - DNA, 25 bp, Homo sapien
tggattcaaagcctggtcatatggt

SEQ ID NO: 634619 - DNA, 25 bp, Homo sapien
ggattcaaagcctggtcatatggtt

SEQ ID NO: 634620 - DNA, 25 bp, Homo sapien
gattcaaagcctggtcatatggttt

SEQ ID NO: 634621 - DNA, 25 bp, Homo sapien
attcaaagcctggtcatatggtttg

SEQ ID NO: 634622 - DNA, 25 bp, Homo sapien
tcaaagcctggtcatatggtttggc

SEQ ID NO: 634623 - DNA, 25 bp, Homo sapien
aaagcctggtcatatggtttggctg

SEQ ID NO: 634624 - DNA, 25 bp, Homo sapien
ccacatgttgcaggagggaatcagt

SEQ ID NO: 634625 - DNA, 25 bp, Homo sapien
aaccattaagaatcagtggatcagc

SEQ ID NO: 634626 - DNA, 25 bp, Homo sapien
accattaagaatcagtggatcagcc

SEQ ID NO: 634627 - DNA, 25 bp, Homo sapien
cattaagaatcagtggatcagccag

SEQ ID NO: 634628 - DNA, 25 bp, Homo sapien
attaagaatcagtggatcagccagg

SEQ ID NO: 634629 - DNA, 25 bp, Homo sapien
ttaagaatcagtggatcagccaggt

SEQ ID NO: 634630 - DNA, 25 bp, Homo sapien
taagaatcagtggatcagccaggtg

SEQ ID NO: 634631 - DNA, 25 bp, Homo sapien
aagaatcagtggatcagccaggtgt

SEQ ID NO: 634632 - DNA, 25 bp, Homo sapien
agaatcagtggatcagccaggtgtg

SEQ ID NO: 634633 - DNA, 25 bp, Homo sapien
gaatcagtggatcagccaggtgtga

SEQ ID NO: 634634 - DNA, 25 bp, Homo sapien
tgagccacgaagacgccactgtact

SEQ ID NO: 634635 - DNA, 25 bp, Homo sapien
gagccacgaagacgccactgtactc

SEQ ID NO: 634636 - DNA, 25 bp, Homo sapien
tcatttggactgtgcctctcttttc

SEQ ID NO: 634637 - DNA, 25 bp, Homo sapien
tctcttttcgtttcagttcctcttt

SEQ ID NO: 634638 - DNA, 25 bp, Homo sapien
gttcctcttttcttgaaagttgcgt

SEQ ID NO: 634639 - DNA, 25 bp, Homo sapien
ttgaaagttgcgtcttccattcttc

SEQ ID NO: 634640 - DNA, 25 bp, Homo sapien
tcttccattcttctgtcttgaggtc

SEQ ID NO: 634641 - DNA, 25 bp, Homo sapien
tctgtcttgaggtcgcgtctgttct

SEQ ID NO: 634642 - DNA, 25 bp, Homo sapien
tccgctcttcattggccaccgatga

SEQ ID NO: 634643 - DNA, 25 bp, Homo sapien
ccaccgatgacctttactttgattt

SEQ ID NO: 634644 - DNA, 25 bp, Homo sapien
ggatatgattttgcttctcattgaa

SEQ ID NO: 634645 - DNA, 25 bp, Homo sapien
tgaaatcctaaaatagcctcccctt

SEQ ID NO: 634646 - DNA, 25 bp, Homo sapien
tcccctcaaactatcgaccagagaa

SEQ ID NO: 634647 - DNA, 25 bp, Homo sapien
gcccagcctaaaaatctcttactat

SEQ ID NO: 634648 - DNA, 25 bp, Homo sapien
tattatagaaacaacacctgtgtat

SEQ ID NO: 634649 - DNA, 25 bp, Homo sapien
acatcatgtttccaccaccagagta

SEQ ID NO: 634650 - DNA, 25 bp, Homo sapien
atgtttccaccaccagagtagcact

SEQ ID NO: 634651 - DNA, 25 bp, Homo sapien
agagtagcactcttagcaccttagt

SEQ ID NO: 634652 - DNA, 25 bp, Homo sapien
gcaccttagtgcttattcttttata

SEQ ID NO: 634653 - DNA, 25 bp, Homo sapien
aatgataaatgacatcttactgtga

SEQ ID NO: 634654 - DNA, 25 bp, Homo sapien
ctgtgaaaactgttgaacctgcttt

SEQ ID NO: 634655 - DNA, 25 bp, Homo sapien
gaacctgctttttcaatcaagtgta

SEQ ID NO: 634656 - DNA, 25 bp, Homo sapien
attttcaccttatctagtatctaca

SEQ ID NO: 634657 - DNA, 25 bp, Homo sapien
atctacactatcttcaaatttcccc

SEQ ID NO: 634658 - DNA, 25 bp, Homo sapien
gacaattcttgtatatcctagagac

SEQ ID NO: 634659 - DNA, 25 bp, Homo sapien
gtatatcctagagaccaacacattt

SEQ ID NO: 634660 - DNA, 25 bp, Homo sapien
atcctagagaccaacacatttaatg

SEQ ID NO: 634661 - DNA, 25 bp, Homo sapien
acatttaatgtagtggaggctatct

SEQ ID NO: 634662 - DNA, 25 bp, Homo sapien
tagtggaggctatcttttatgaaat

SEQ ID NO: 634663 - DNA, 25 bp, Homo sapien
gaggctatcttttatgaaatattgc

SEQ ID NO: 634664 - DNA, 25 bp, Homo sapien
gaattctcagaaatgcttacagtaa

SEQ ID NO: 634665 - DNA, 25 bp, Homo sapien
gcttacagtaagagtcaataaccct

SEQ ID NO: 634666 - DNA, 25 bp, Homo sapien
gagtcaataacccttaaagctacct

SEQ ID NO: 634667 - DNA, 25 bp, Homo sapien
aaggcctaataactcttattcagaa

SEQ ID NO: 634668 - DNA, 25 bp, Homo sapien
ttcagaatatgaattctggctgggt

SEQ ID NO: 634669 - DNA, 25 bp, Homo sapien
ttgtggcatcatcactccagtattc

SEQ ID NO: 634670 - DNA, 25 bp, Homo sapien
ggcatcatcactccagtattcatgt

SEQ ID NO: 634671 - DNA, 25 bp, Homo sapien
cactccagtattcatgtgatattct

SEQ ID NO: 634672 - DNA, 25 bp, Homo sapien
gtgtctctatgtcaagatttcccct

SEQ ID NO: 634673 - DNA, 25 bp, Homo sapien
atgtcaagatttcccctgtttataa

SEQ ID NO: 634674 - DNA, 25 bp, Homo sapien
ttgggttagtggttgagcccacctt

SEQ ID NO: 634675 - DNA, 25 bp, Homo sapien
gttgagcccaccttactgaccaaat

SEQ ID NO: 634676 - DNA, 25 bp, Homo sapien
caacatgtacattttagagggacac

SEQ ID NO: 634677 - DNA, 25 bp, Homo sapien
ttttcttttgggtatctaccagtca

SEQ ID NO: 634678 - DNA, 25 bp, Homo sapien
gggtatctaccagtcaccaagatat

SEQ ID NO: 634679 - DNA, 25 bp, Homo sapien
caagatatttatccctacttgacca

SEQ ID NO: 634680 - DNA, 25 bp, Homo sapien
ctggcccagagtgaattttaaatgc

SEQ ID NO: 634681 - DNA, 25 bp, Homo sapien
tggcccagagtgaattttaaatgca

SEQ ID NO: 634682 - DNA, 25 bp, Homo sapien
atgcatgaactaaaatgtacttttg

SEQ ID NO: 634683 - DNA, 25 bp, Homo sapien
gcatgaactaaaatgtacttttgtc

SEQ ID NO: 634684 - DNA, 25 bp, Homo sapien
atgtacttttgtcacattttccctg

SEQ ID NO: 634685 - DNA, 25 bp, Homo sapien
tgtacttttgtcacattttccctga

SEQ ID NO: 634686 - DNA, 25 bp, Homo sapien
tactgtccatattttttgagctgca

SEQ ID NO: 634687 - DNA, 25 bp, Homo sapien
actgtccatattttttgagctgcaa

SEQ ID NO: 634688 - DNA, 25 bp, Homo sapien
ctgtccatattttttgagctgcaaa

SEQ ID NO: 634689 - DNA, 25 bp, Homo sapien
tgtccatattttttgagctgcaaat

SEQ ID NO: 634690 - DNA, 25 bp, Homo sapien
gtccatattttttgagctgcaaata

SEQ ID NO: 634691 - DNA, 25 bp, Homo sapien
aatgttgggccatctgtccttttga

SEQ ID NO: 634692 - DNA, 25 bp, Homo sapien
gagacagaagtcctgtcacttgccc

SEQ ID NO: 634693 - DNA, 25 bp, Homo sapien
acttgcccctgctgttaggaggtgg

SEQ ID NO: 634694 - DNA, 25 bp, Homo sapien
aggtgggcttcctgaatggctttct

SEQ ID NO: 634695 - DNA, 25 bp, Homo sapien
gaatggctttctgtatacatgaaga

SEQ ID NO: 634696 - DNA, 25 bp, Homo sapien
caagaccttccgttaaggtggtcag

SEQ ID NO: 634697 - DNA, 25 bp, Homo sapien
ggtggtcagagctaagtttcagcgt

SEQ ID NO: 634698 - DNA, 25 bp, Homo sapien
agtttcagcgtttacaagaggtctc

SEQ ID NO: 634699 - DNA, 25 bp, Homo sapien
gtctcttggctgacttgctataact

SEQ ID NO: 634700 - DNA, 25 bp, Homo sapien
ataacttacagcaacctgatgtttg

SEQ ID NO: 634701 - DNA, 25 bp, Homo sapien
gcaacctgatgtttggacacctttt

SEQ ID NO: 634702 - DNA, 25 bp, Homo sapien
ggctaggctatgaggccccagctgt

SEQ ID NO: 634703 - DNA, 25 bp, Homo sapien
ccccagctgtcttggccgtatttgg

SEQ ID NO: 634704 - DNA, 25 bp, Homo sapien
gtatttggcgctgagcctggtctct

SEQ ID NO: 634705 - DNA, 25 bp, Homo sapien
tggtctctctcccttatcgtgacag

SEQ ID NO: 634706 - DNA, 25 bp, Homo sapien
gtgacagtcttgacgctgatagcac

SEQ ID NO: 634707 - DNA, 25 bp, Homo sapien
tgatagcacaattgtcctgtacggt

SEQ ID NO: 634708 - DNA, 25 bp, Homo sapien
cctgtacggtcttcctgcttaacaa

SEQ ID NO: 634709 - DNA, 25 bp, Homo sapien
caagagtccaaatacttgtttcttt

SEQ ID NO: 634710 - DNA, 25 bp, Homo sapien
taacacattatccattatcataggg

SEQ ID NO: 634711 - DNA, 25 bp, Homo sapien
attagatgtataccaattgccaagt

SEQ ID NO: 634712 - DNA, 25 bp, Homo sapien
attgccaagtacacccagatttgag

SEQ ID NO: 634713 - DNA, 25 bp, Homo sapien
ttctgtcaaatatgtggtgttcgca

SEQ ID NO: 634714 - DNA, 25 bp, Homo sapien
tggtgttcgcaaattgaaagcatct

SEQ ID NO: 634715 - DNA, 25 bp, Homo sapien
gcatcttggatttcaggttagtatc

SEQ ID NO: 634716 - DNA, 25 bp, Homo sapien
ggttagtatccctagtacatatttt

SEQ ID NO: 634717 - DNA, 25 bp, Homo sapien
tatttgagtctatgtccacctttct

SEQ ID NO: 634718 - DNA, 25 bp, Homo sapien
tccacctttctcctgaggcagagaa

SEQ ID NO: 634719 - DNA, 25 bp, Homo sapien
gaggcagagaatgcctctgccacag

SEQ ID NO: 634720 - DNA, 25 bp, Homo sapien
tctgccacaggtctcaaaatcctct

SEQ ID NO: 634721 - DNA, 25 bp, Homo sapien
ctcaaaatcctctggttaacacaaa

SEQ ID NO: 634722 - DNA, 25 bp, Homo sapien
taggaattaaacactctcatgtgta

SEQ ID NO: 634723 - DNA, 25 bp, Homo sapien
actctcatgtgtaaatttgtgtaat

SEQ ID NO: 634724 - DNA, 25 bp, Homo sapien
gaaagcaaccgtctacaagccagga

SEQ ID NO: 634725 - DNA, 25 bp, Homo sapien
agagagctgctcactaggaactaaa

SEQ ID NO: 634726 - DNA, 25 bp, Homo sapien
aggaactaaactggctggcacctgg

SEQ ID NO: 634727 - DNA, 25 bp, Homo sapien
cacatattctgtggagtttctcatg

SEQ ID NO: 634728 - DNA, 25 bp, Homo sapien
gagtttctcatggtagccagagcag

SEQ ID NO: 634729 - DNA, 25 bp, Homo sapien
aataagacagcttacattctggaac

SEQ ID NO: 634730 - DNA, 25 bp, Homo sapien
aagtgcgatatgtctgccattccag

SEQ ID NO: 634731 - DNA, 25 bp, Homo sapien
ctgccattccagaaatcttccattt

SEQ ID NO: 634732 - DNA, 25 bp, Homo sapien
tttctaacatttatggccactcacc

SEQ ID NO: 634733 - DNA, 25 bp, Homo sapien
tggccactcaccatgattcttaggt

SEQ ID NO: 634734 - DNA, 25 bp, Homo sapien
gattgcactgattctactttagtca

SEQ ID NO: 634735 - DNA, 25 bp, Homo sapien
gtggagccatcggatgctgcatcgt

SEQ ID NO: 634736 - DNA, 25 bp, Homo sapien
tgcatcgtccccagagagccaagtc

SEQ ID NO: 634737 - DNA, 25 bp, Homo sapien
gagccaagtcatcgtgggccaagct

SEQ ID NO: 634738 - DNA, 25 bp, Homo sapien
aactgcaggcccagaatgttgacag

SEQ ID NO: 634739 - DNA, 25 bp, Homo sapien
aatgttgacagctgcctcttggagg

SEQ ID NO: 634740 - DNA, 25 bp, Homo sapien
gttatgggagcctgtgaatgccaac

SEQ ID NO: 634741 - DNA, 25 bp, Homo sapien
tgtgaatgccaacatccccatttgc

SEQ ID NO: 634742 - DNA, 25 bp, Homo sapien
cttcctggtgggacttttccatgaa

SEQ ID NO: 634743 - DNA, 25 bp, Homo sapien
aaatttctgagcattgcccatttct

SEQ ID NO: 634744 - DNA, 25 bp, Homo sapien
gagcattgcccatttcttttgcttt

SEQ ID NO: 634745 - DNA, 25 bp, Homo sapien
gctttatctgtaggacatgggctgt

SEQ ID NO: 634746 - DNA, 25 bp, Homo sapien
attaaggttcgtgatcaggccgggc

SEQ ID NO: 634747 - DNA, 25 bp, Homo sapien
ttaaggttcgtgatcaggccgggct

SEQ ID NO: 634748 - DNA, 25 bp, Homo sapien
taaggttcgtgatcaggccgggctc

SEQ ID NO: 634749 - DNA, 25 bp, Homo sapien
aaggttcgtgatcaggccgggctcg

SEQ ID NO: 634750 - DNA, 25 bp, Homo sapien
aggttcgtgatcaggccgggctcgg

SEQ ID NO: 634751 - DNA, 25 bp, Homo sapien
ggttcgtgatcaggccgggctcggt

SEQ ID NO: 634752 - DNA, 25 bp, Homo sapien
gttcgtgatcaggccgggctcggtg

SEQ ID NO: 634753 - DNA, 25 bp, Homo sapien
ttcgtgatcaggccgggctcggtgg

SEQ ID NO: 634754 - DNA, 25 bp, Homo sapien
tcgtgatcaggccgggctcggtggc

SEQ ID NO: 634755 - DNA, 25 bp, Homo sapien
ggctcggtggcttatgcccataatc

SEQ ID NO: 634756 - DNA, 25 bp, Homo sapien
gtagaagttacagtgagccacgatt

SEQ ID NO: 634757 - DNA, 25 bp, Homo sapien
gtttatcttggtataactcaaatcg

SEQ ID NO: 634758 - DNA, 25 bp, Homo sapien
ggtataactcaaatcgtttagaaca

SEQ ID NO: 634759 - DNA, 25 bp, Homo sapien
tttaaaatacttaactgtgtcttct

SEQ ID NO: 634760 - DNA, 25 bp, Homo sapien
tgtcttcttagttttcacacacaaa

SEQ ID NO: 634761 - DNA, 25 bp, Homo sapien
aaaactatgcctgcttctagagtgc

SEQ ID NO: 634762 - DNA, 25 bp, Homo sapien
tatgcctgcttctagagtgctgata

SEQ ID NO: 634763 - DNA, 25 bp, Homo sapien
ctgcttctagagtgctgataggtaa

SEQ ID NO: 634764 - DNA, 25 bp, Homo sapien
gagtaatttatctacaaggcctaat

SEQ ID NO: 634765 - DNA, 25 bp, Homo sapien
aggcctaattgtacctcacattctg

SEQ ID NO: 634766 - DNA, 25 bp, Homo sapien
attgtacctcacattctgtgataaa

SEQ ID NO: 634767 - DNA, 25 bp, Homo sapien
ctgtgataaatatttcttgtgctcc

SEQ ID NO: 634768 - DNA, 25 bp, Homo sapien
gacttctactcccataaactaggtt

SEQ ID NO: 634769 - DNA, 25 bp, Homo sapien
ttctactcccataaactaggtttgc

SEQ ID NO: 634770 - DNA, 25 bp, Homo sapien
actcccataaactaggtttgcttgt

SEQ ID NO: 634771 - DNA, 25 bp, Homo sapien
aactaggtttgcttgtttgtgaact

SEQ ID NO: 634772 - DNA, 25 bp, Homo sapien
aggtttgcttgtttgtgaacttcat

SEQ ID NO: 634773 - DNA, 25 bp, Homo sapien
agaatgtactcttgcatctggcttc

SEQ ID NO: 634774 - DNA, 25 bp, Homo sapien
gtttttgagatttatccaggtgatt

SEQ ID NO: 634775 - DNA, 25 bp, Homo sapien
gatttatccaggtgattgtatcagt

SEQ ID NO: 634776 - DNA, 25 bp, Homo sapien
atttggatcctttccagtttgggca

SEQ ID NO: 634777 - DNA, 25 bp, Homo sapien
ggatcctttccagtttgggcatatt

SEQ ID NO: 634778 - DNA, 25 bp, Homo sapien
tcctttccagtttgggcatattgtg

SEQ ID NO: 634779 - DNA, 25 bp, Homo sapien
gagtccagcctatggaatgacacaa

SEQ ID NO: 634780 - DNA, 25 bp, Homo sapien
acaaagttatgaaacccagtggtgt

SEQ ID NO: 634781 - DNA, 25 bp, Homo sapien
cccagtggtgtgtgtcaggatccac

SEQ ID NO: 634782 - DNA, 25 bp, Homo sapien
tggtgtgtgtcaggatccacagaca

SEQ ID NO: 634783 - DNA, 25 bp, Homo sapien
ggatccacagacaggttcatgtgac

SEQ ID NO: 634784 - DNA, 25 bp, Homo sapien
acagacaggttcatgtgactaaaat

SEQ ID NO: 634785 - DNA, 25 bp, Homo sapien
aagggaattggcaagacatcaaaat

SEQ ID NO: 634786 - DNA, 25 bp, Homo sapien
gcgttttaacaactaggagttcacg

SEQ ID NO: 634787 - DNA, 25 bp, Homo sapien
acaactaggagttcacgaggcagga

SEQ ID NO: 634788 - DNA, 25 bp, Homo sapien
taggagttcacgaggcaggaaagaa

SEQ ID NO: 634789 - DNA, 25 bp, Homo sapien
agaaatggagtccagcctatggaat

SEQ ID NO: 634790 - DNA, 25 bp, Homo sapien
catgttgttgagagactggtgtctt

SEQ ID NO: 634791 - DNA, 25 bp, Homo sapien
gactggtgtctttaagctaagctaa

SEQ ID NO: 634792 - DNA, 25 bp, Homo sapien
aatcagagcatattagagcagagca

SEQ ID NO: 634793 - DNA, 25 bp, Homo sapien
aaagaaggaccgtctctacttccat

SEQ ID NO: 634794 - DNA, 25 bp, Homo sapien
atttccccttcttagccattgtgct

SEQ ID NO: 634795 - DNA, 25 bp, Homo sapien
attgtgctattattctcaaggagaa

SEQ ID NO: 634796 - DNA, 25 bp, Homo sapien
gaaggagggaatcattttatttcta

SEQ ID NO: 634797 - DNA, 25 bp, Homo sapien
tatttttgctttgaactataccttt

SEQ ID NO: 634798 - DNA, 25 bp, Homo sapien
gaactatacctttaaagagatctga

SEQ ID NO: 634799 - DNA, 25 bp, Homo sapien
tactcacataattactatttctgca

SEQ ID NO: 634800 - DNA, 25 bp, Homo sapien
tactatttctgcaacatagacctca

SEQ ID NO: 634801 - DNA, 25 bp, Homo sapien
ggaataaaaccccattatattacag

SEQ ID NO: 634802 - DNA, 25 bp, Homo sapien
accccattatattacaggatttcca

SEQ ID NO: 634803 - DNA, 25 bp, Homo sapien
aggatttccaaatactcacttacag

SEQ ID NO: 634804 - DNA, 25 bp, Homo sapien
atactcacttacagaattaaacatc

SEQ ID NO: 634805 - DNA, 25 bp, Homo sapien
gaggacatagtacagttcattaatt

SEQ ID NO: 634806 - DNA, 25 bp, Homo sapien
tatatctatgacacatttgcacaaa

SEQ ID NO: 634807 - DNA, 25 bp, Homo sapien
caaatgaatgatgaattggccacat

SEQ ID NO: 634808 - DNA, 25 bp, Homo sapien
gatgaattggccacatgaaaacatt

SEQ ID NO: 634809 - DNA, 25 bp, Homo sapien
gatttgacactcaaaattccctggt

SEQ ID NO: 634810 - DNA, 25 bp, Homo sapien
gacactcaaaattccctggtaataa

SEQ ID NO: 634811 - DNA, 25 bp, Homo sapien
caaaattccctggtaataattcagt

SEQ ID NO: 634812 - DNA, 25 bp, Homo sapien
gatgctgcagccttataaactaagt

SEQ ID NO: 634813 - DNA, 25 bp, Homo sapien
atgctgcagccttataaactaagtc

SEQ ID NO: 634814 - DNA, 25 bp, Homo sapien
tgctgcagccttataaactaagtca

SEQ ID NO: 634815 - DNA, 25 bp, Homo sapien
gctgcagccttataaactaagtcaa

SEQ ID NO: 634816 - DNA, 25 bp, Homo sapien
ctgcagccttataaactaagtcaaa

SEQ ID NO: 634817 - DNA, 25 bp, Homo sapien
aaactaagtcaaaaatcttgatctt

SEQ ID NO: 634818 - DNA, 25 bp, Homo sapien
ggccgaggcggaagggtcaccaggt

SEQ ID NO: 634819 - DNA, 25 bp, Homo sapien
gccgaggcggaagggtcaccaggtc

SEQ ID NO: 634820 - DNA, 25 bp, Homo sapien
gaggcggaagggtcaccaggtcagg

SEQ ID NO: 634821 - DNA, 25 bp, Homo sapien
aggcggaagggtcaccaggtcagga

SEQ ID NO: 634822 - DNA, 25 bp, Homo sapien
ggcggaagggtcaccaggtcaggag

SEQ ID NO: 634823 - DNA, 25 bp, Homo sapien
tgtctgcgaagtgagcagcgcctct

SEQ ID NO: 634824 - DNA, 25 bp, Homo sapien
cccctcaccgtctgggatgttagga

SEQ ID NO: 634825 - DNA, 25 bp, Homo sapien
tcaccgtctgggatgttaggagcac

SEQ ID NO: 634826 - DNA, 25 bp, Homo sapien
accgtctgggatgttaggagcacct

SEQ ID NO: 634827 - DNA, 25 bp, Homo sapien
ggaatgtgaggagcgactctgccaa

SEQ ID NO: 634828 - DNA, 25 bp, Homo sapien
atgtgaggagcgactctgccaagct

SEQ ID NO: 634829 - DNA, 25 bp, Homo sapien
gtgaggagcgactctgccaagctgc

SEQ ID NO: 634830 - DNA, 25 bp, Homo sapien
gaggagcgactctgccaagctgccg

SEQ ID NO: 634831 - DNA, 25 bp, Homo sapien
aagctgccgccctgtgtggcaagtg

SEQ ID NO: 634832 - DNA, 25 bp, Homo sapien
cctgtgtggcaagtgaggagcacct

SEQ ID NO: 634833 - DNA, 25 bp, Homo sapien
ttgtgtgtgatctttctgctctccc

SEQ ID NO: 634834 - DNA, 25 bp, Homo sapien
caaatcctagctctgtgacaactta

SEQ ID NO: 634835 - DNA, 25 bp, Homo sapien
gtgacaacttactgattataacctt

SEQ ID NO: 634836 - DNA, 25 bp, Homo sapien
ataaccttagtgtagttaatgaact

SEQ ID NO: 634837 - DNA, 25 bp, Homo sapien
atgaactagacccagttccctcagc

SEQ ID NO: 634838 - DNA, 25 bp, Homo sapien
cccagttccctcagctatataatga

SEQ ID NO: 634839 - DNA, 25 bp, Homo sapien
ggactaagtcaacctctgcatataa

SEQ ID NO: 634840 - DNA, 25 bp, Homo sapien
taaaaacatgacacagggctgggac

SEQ ID NO: 634841 - DNA, 25 bp, Homo sapien
acagggctgggacataactctcaaa

SEQ ID NO: 634842 - DNA, 25 bp, Homo sapien
gatactgctgaataggtacaatgct

SEQ ID NO: 634843 - DNA, 25 bp, Homo sapien
gctgaataggtacaatgctatgcaa

SEQ ID NO: 634844 - DNA, 25 bp, Homo sapien
taacccccaatatgatggtatatga

SEQ ID NO: 634845 - DNA, 25 bp, Homo sapien
ttaaggaaccatcccgattcatcag

SEQ ID NO: 634846 - DNA, 25 bp, Homo sapien
tcccgattcatcaggcttctaacta

SEQ ID NO: 634847 - DNA, 25 bp, Homo sapien
ggcttctaactaacctgagcacaga

SEQ ID NO: 634848 - DNA, 25 bp, Homo sapien
gcacagaagcaaatatgtacccttt

SEQ ID NO: 634849 - DNA, 25 bp, Homo sapien
gaaatggactgcagacctcaagggt

SEQ ID NO: 634850 - DNA, 25 bp, Homo sapien
acctcaagggtggtccccagggatg

SEQ ID NO: 634851 - DNA, 25 bp, Homo sapien
gagcttatagctgaggcatcttatg

SEQ ID NO: 634852 - DNA, 25 bp, Homo sapien
gcaggaagaggcacttagtccatct

SEQ ID NO: 634853 - DNA, 25 bp, Homo sapien
gaggcacttagtccatctgagaaca

SEQ ID NO: 634854 - DNA, 25 bp, Homo sapien
agaacaaagcttctccttcctagtg

SEQ ID NO: 634855 - DNA, 25 bp, Homo sapien
gccggcagcctgagacacctggaga

SEQ ID NO: 634856 - DNA, 25 bp, Homo sapien
aagctggactgaagaagtgttcggt

SEQ ID NO: 634857 - DNA, 25 bp, Homo sapien
gaagtgttcggtgggttttccgcat

SEQ ID NO: 634858 - DNA, 25 bp, Homo sapien
tcggtgggttttccgcatgatgcta

SEQ ID NO: 634859 - DNA, 25 bp, Homo sapien
gttttccgcatgatgctaagccacg

SEQ ID NO: 634860 - DNA, 25 bp, Homo sapien
gcatgatgctaagccacggcagggt

SEQ ID NO: 634861 - DNA, 25 bp, Homo sapien
agcccgagatggaggaaagactgtt

SEQ ID NO: 634862 - DNA, 25 bp, Homo sapien
aagactgttagatgaaggccgatta

SEQ ID NO: 634863 - DNA, 25 bp, Homo sapien
gaaggccgattagaagtccataggt

SEQ ID NO: 634864 - DNA, 25 bp, Homo sapien
gaagtccataggtgacagtctgaag

SEQ ID NO: 634865 - DNA, 25 bp, Homo sapien
ccagtggtgtggctgatgacataaa

SEQ ID NO: 634866 - DNA, 25 bp, Homo sapien
gtgtggctgatgacataaatcttaa

SEQ ID NO: 634867 - DNA, 25 bp, Homo sapien
gaagcacttgtttcttcgtgggtac

SEQ ID NO: 634868 - DNA, 25 bp, Homo sapien
cacttgtttcttcgtgggtacacca

SEQ ID NO: 634869 - DNA, 25 bp, Homo sapien
gggtacaccaccagctgagaaagaa

SEQ ID NO: 634870 - DNA, 25 bp, Homo sapien
gaagcctcatgatgattgttgtctt

SEQ ID NO: 634871 - DNA, 25 bp, Homo sapien
attgttgtcttatggatgcttctca

SEQ ID NO: 634872 - DNA, 25 bp, Homo sapien
ggatgcttctcattgcaggaaccat

SEQ ID NO: 634873 - DNA, 25 bp, Homo sapien
gcttctcattgcaggaaccatgtgg

SEQ ID NO: 634874 - DNA, 25 bp, Homo sapien
aggagctgccatgctgggccatcca

SEQ ID NO: 634875 - DNA, 25 bp, Homo sapien
tgctgggccatccaccatctggatt

SEQ ID NO: 634876 - DNA, 25 bp, Homo sapien
catctggattcctacgactcaggga

SEQ ID NO: 634877 - DNA, 25 bp, Homo sapien
tcagggaatagaacactgcaccttc

SEQ ID NO: 634878 - DNA, 25 bp, Homo sapien
gtagaaccacaagaaacttgaggat

SEQ ID NO: 634879 - DNA, 25 bp, Homo sapien
agtcctggccttcattccgtacttg

SEQ ID NO: 634880 - DNA, 25 bp, Homo sapien
ttcattccgtacttgcatgaccaac

SEQ ID NO: 634881 - DNA, 25 bp, Homo sapien
ccgtacttgcatgaccaacatctaa

SEQ ID NO: 634882 - DNA, 25 bp, Homo sapien
gcatgaccaacatctaagagtacta

SEQ ID NO: 634883 - DNA, 25 bp, Homo sapien
gattcaagaggatacacatattttc

SEQ ID NO: 634884 - DNA, 25 bp, Homo sapien
ttttctttgtccaatgttgctaata

SEQ ID NO: 634885 - DNA, 25 bp, Homo sapien
gtccaatgttgctaatatccacctg

SEQ ID NO: 634886 - DNA, 25 bp, Homo sapien
gttgctaatatccacctgagagttt

SEQ ID NO: 634887 - DNA, 25 bp, Homo sapien
atccacctgagagtttattatccat

SEQ ID NO: 634888 - DNA, 25 bp, Homo sapien
tgtggaatccagtctgtacaccatg

SEQ ID NO: 634889 - DNA, 25 bp, Homo sapien
gggtgtatgagtgcagcagcattac

SEQ ID NO: 634890 - DNA, 25 bp, Homo sapien
tgcagcagcattacacagtatcttt

SEQ ID NO: 634891 - DNA, 25 bp, Homo sapien
cattacacagtatctttgaagtcaa

SEQ ID NO: 634892 - DNA, 25 bp, Homo sapien
tttactagctacatgacctcaggag

SEQ ID NO: 634893 - DNA, 25 bp, Homo sapien
tgacctcaggagatttaattaaccc

SEQ ID NO: 634894 - DNA, 25 bp, Homo sapien
taattaaccctttcaaacacaatcg

SEQ ID NO: 634895 - DNA, 25 bp, Homo sapien
aaacacaatcgcctcacttatgaaa

SEQ ID NO: 634896 - DNA, 25 bp, Homo sapien
ggagtgataatacttgccttgcaag

SEQ ID NO: 634897 - DNA, 25 bp, Homo sapien
cttgccttgcaagcttgttgagaaa

SEQ ID NO: 634898 - DNA, 25 bp, Homo sapien
aaggcttgtgaagcacctggcatgt

SEQ ID NO: 634899 - DNA, 25 bp, Homo sapien
gtagacacatatgccattgctctcc

SEQ ID NO: 634900 - DNA, 25 bp, Homo sapien
tgtgcccagccgatgagctcattta

SEQ ID NO: 634901 - DNA, 25 bp, Homo sapien
gcccagccgatgagctcatttagat

SEQ ID NO: 634902 - DNA, 25 bp, Homo sapien
gagctcatttagatggctgcatggg

SEQ ID NO: 634903 - DNA, 25 bp, Homo sapien
tggcacccaacttcttccagtcgaa

SEQ ID NO: 634904 - DNA, 25 bp, Homo sapien
aacttcttccagtcgaatcctgctt

SEQ ID NO: 634905 - DNA, 25 bp, Homo sapien
tccagtcgaatcctgcttcttggtg

SEQ ID NO: 634906 - DNA, 25 bp, Homo sapien
cttcttggtgccctgatatggcaga

SEQ ID NO: 634907 - DNA, 25 bp, Homo sapien
agcccctgaaataaaccactccaga

SEQ ID NO: 634908 - DNA, 25 bp, Homo sapien
gaaataaaccactccagacaatttt

SEQ ID NO: 634909 - DNA, 25 bp, Homo sapien
cactccagacaattttatttttcca

SEQ ID NO: 634910 - DNA, 25 bp, Homo sapien
aaaagatcacacagaatttgccaac

SEQ ID NO: 634911 - DNA, 25 bp, Homo sapien
gatatacacgaatccatctcacacc

SEQ ID NO: 634912 - DNA, 25 bp, Homo sapien
ctcacaccagatattcttctgctgt

SEQ ID NO: 634913 - DNA, 25 bp, Homo sapien
tcttctgctgtagacttccaagtgt

SEQ ID NO: 634914 - DNA, 25 bp, Homo sapien
gtgtttcagtccaccattaatcatg

SEQ ID NO: 634915 - DNA, 25 bp, Homo sapien
aatcatggactctcacaattagcag

SEQ ID NO: 634916 - DNA, 25 bp, Homo sapien
agagtgacctaatccaacatcccag

SEQ ID NO: 634917 - DNA, 25 bp, Homo sapien
aacatcccagctgaaacgtgaacaa

SEQ ID NO: 634918 - DNA, 25 bp, Homo sapien
acccaccaaagctgttttccaatgt

SEQ ID NO: 634919 - DNA, 25 bp, Homo sapien
ccaatgtgacttaaccttgggcaca

SEQ ID NO: 634920 - DNA, 25 bp, Homo sapien
aggaagcaaccccttccatctttgg

SEQ ID NO: 634921 - DNA, 25 bp, Homo sapien
tgggttaatgttggcttccttctaa

SEQ ID NO: 634922 - DNA, 25 bp, Homo sapien
cagacacggccatttattattgtgc

SEQ ID NO: 634923 - DNA, 25 bp, Homo sapien
attattgtgcgagacatcttaccgg

SEQ ID NO: 634924 - DNA, 25 bp, Homo sapien
attgtgcgagacatcttaccgggtg

SEQ ID NO: 634925 - DNA, 25 bp, Homo sapien
gtgcgagacatcttaccgggtggta

SEQ ID NO: 634926 - DNA, 25 bp, Homo sapien
gcgagacatcttaccgggtggtatt

SEQ ID NO: 634927 - DNA, 25 bp, Homo sapien
acatcttaccgggtggtattgtatt

SEQ ID NO: 634928 - DNA, 25 bp, Homo sapien
accgggtggtattgtattagtagca

SEQ ID NO: 634929 - DNA, 25 bp, Homo sapien
gtattagtagcagttgggccccgtg

SEQ ID NO: 634930 - DNA, 25 bp, Homo sapien
agttgggccccgtgctactactacg

SEQ ID NO: 634931 - DNA, 25 bp, Homo sapien
tgggccccgtgctactactacggta

SEQ ID NO: 634932 - DNA, 25 bp, Homo sapien
ccccgtgctactactacggtatgga

SEQ ID NO: 634933 - DNA, 25 bp, Homo sapien
aaggtttggattcaaagcctggtca

SEQ ID NO: 634934 - DNA, 25 bp, Homo sapien
aggtttggattcaaagcctggtcat

SEQ ID NO: 634935 - DNA, 25 bp, Homo sapien
ggtttggattcaaagcctggtcata

SEQ ID NO: 634936 - DNA, 25 bp, Homo sapien
gtttggattcaaagcctggtcatat

SEQ ID NO: 634937 - DNA, 25 bp, Homo sapien
tttggattcaaagcctggtcatatg

SEQ ID NO: 634938 - DNA, 25 bp, Homo sapien
tggattcaaagcctggtcatatggt

SEQ ID NO: 634939 - DNA, 25 bp, Homo sapien
ggattcaaagcctggtcatatggtt

SEQ ID NO: 634940 - DNA, 25 bp, Homo sapien
gattcaaagcctggtcatatggttt

SEQ ID NO: 634941 - DNA, 25 bp, Homo sapien
attcaaagcctggtcatatggtttg

SEQ ID NO: 634942 - DNA, 25 bp, Homo sapien
tcaaagcctggtcatatggtttggc

SEQ ID NO: 634943 - DNA, 25 bp, Homo sapien
aaagcctggtcatatggtttggctg

SEQ ID NO: 634944 - DNA, 25 bp, Homo sapien
tttgcaaagctgtgaataaaaccac

SEQ ID NO: 634945 - DNA, 25 bp, Homo sapien
aaaccacaaactctaaagtagcaca

SEQ ID NO: 634946 - DNA, 25 bp, Homo sapien
taaagtagcacaagcctccttcaat

SEQ ID NO: 634947 - DNA, 25 bp, Homo sapien
agcctccttcaatgcttgacttgaa

SEQ ID NO: 634948 - DNA, 25 bp, Homo sapien
caatgcttgacttgaatggatttat

SEQ ID NO: 634949 - DNA, 25 bp, Homo sapien
atggatttatgacgtaccgttgaga

SEQ ID NO: 634950 - DNA, 25 bp, Homo sapien
gacgtaccgttgagaagatcaattt

SEQ ID NO: 634951 - DNA, 25 bp, Homo sapien
atttcagctacaatactcatctgaa

SEQ ID NO: 634952 - DNA, 25 bp, Homo sapien
tgaaaatcattaatgccaacttgct

SEQ ID NO: 634953 - DNA, 25 bp, Homo sapien
atgccaacttgctctgatatgtgaa

SEQ ID NO: 634954 - DNA, 25 bp, Homo sapien
cagtcatcaggtaaattgcaagctg

SEQ ID NO: 634955 - DNA, 25 bp, Homo sapien
cgtgcacggcctctcttctttttta

SEQ ID NO: 634956 - DNA, 25 bp, Homo sapien
aatgctgaaatctgaatgcccaggg

SEQ ID NO: 634957 - DNA, 25 bp, Homo sapien
cagggagattggtggcccttgccag

SEQ ID NO: 634958 - DNA, 25 bp, Homo sapien
cccttgccaggaagtgtcttaacac

SEQ ID NO: 634959 - DNA, 25 bp, Homo sapien
gtgtcttaacactttgtggatactg

SEQ ID NO: 634960 - DNA, 25 bp, Homo sapien
aacactttgtggatactgctgcctg

SEQ ID NO: 634961 - DNA, 25 bp, Homo sapien
actttgtggatactgctgcctgttg

SEQ ID NO: 634962 - DNA, 25 bp, Homo sapien
gatactgctgcctgttgtctttaaa

SEQ ID NO: 634963 - DNA, 25 bp, Homo sapien
tactgctgcctgttgtctttaaaag

SEQ ID NO: 634964 - DNA, 25 bp, Homo sapien
gctgcctgttgtctttaaaagctgg

SEQ ID NO: 634965 - DNA, 25 bp, Homo sapien
tgtctttaaaagctgggactcatca

SEQ ID NO: 634966 - DNA, 25 bp, Homo sapien
ttggggccgtccaacactgaaaccg

SEQ ID NO: 634967 - DNA, 25 bp, Homo sapien
actgaaaccgcctgaccgctgctgt

SEQ ID NO: 634968 - DNA, 25 bp, Homo sapien
attttggacacgatttcgagagcgt

SEQ ID NO: 634969 - DNA, 25 bp, Homo sapien
tcgagagcgtgagagctactgttca

SEQ ID NO: 634970 - DNA, 25 bp, Homo sapien
gaatccagggccagcctcgtgtctg

SEQ ID NO: 634971 - DNA, 25 bp, Homo sapien
gggccagcctcgtgtctgtcttcct

SEQ ID NO: 634972 - DNA, 25 bp, Homo sapien
ctttaaagcacctggcttggtacct

SEQ ID NO: 634973 - DNA, 25 bp, Homo sapien
aagcacctggcttggtacctaaaat

SEQ ID NO: 634974 - DNA, 25 bp, Homo sapien
tggcttggtacctaaaatgttcctt

SEQ ID NO: 634975 - DNA, 25 bp, Homo sapien
ggcgttgatgtagacagatctccat

SEQ ID NO: 634976 - DNA, 25 bp, Homo sapien
tagacagatctccatctttttggtt

SEQ ID NO: 634977 - DNA, 25 bp, Homo sapien
gcaatcgatgagtatatcggcaaaa

SEQ ID NO: 634978 - DNA, 25 bp, Homo sapien
aactctgatcaatttccaggttttt

SEQ ID NO: 634979 - DNA, 25 bp, Homo sapien
tctgatcaatttccaggtttttgag

SEQ ID NO: 634980 - DNA, 25 bp, Homo sapien
gagatattgatcatattattccaca

SEQ ID NO: 634981 - DNA, 25 bp, Homo sapien
gatattgatcatattattccacaag

SEQ ID NO: 634982 - DNA, 25 bp, Homo sapien
gatcatattattccacaagatatat

SEQ ID NO: 634983 - DNA, 25 bp, Homo sapien
tatttgataaaatagatcactccaa

SEQ ID NO: 634984 - DNA, 25 bp, Homo sapien
tgagtatatcggcaaaacaaaaaga

SEQ ID NO: 634985 - DNA, 25 bp, Homo sapien
aataaaactcaatgcctggattttg

SEQ ID NO: 634986 - DNA, 25 bp, Homo sapien
atgcctggattttgcaggtagagag

SEQ ID NO: 634987 - DNA, 25 bp, Homo sapien
ggattttgcaggtagagagattatt

SEQ ID NO: 634988 - DNA, 25 bp, Homo sapien
caccacccagggaggaattcatgat

SEQ ID NO: 634989 - DNA, 25 bp, Homo sapien
gtatgtctaaggataaaagtgccac

SEQ ID NO: 634990 - DNA, 25 bp, Homo sapien
aagtgccactttgatcaaaactatt

SEQ ID NO: 634991 - DNA, 25 bp, Homo sapien
gaataaatatgaacttagaccctga

SEQ ID NO: 634992 - DNA, 25 bp, Homo sapien
gaacttagaccctgaattctcattt

SEQ ID NO: 634993 - DNA, 25 bp, Homo sapien
tgaattctcattttgggcgtaatag

SEQ ID NO: 634994 - DNA, 25 bp, Homo sapien
ctcattttgggcgtaatagacttga

SEQ ID NO: 634995 - DNA, 25 bp, Homo sapien
aatagacttgaaatggccgctgaaa

SEQ ID NO: 634996 - DNA, 25 bp, Homo sapien
aaatggccgctgaaattatactatc

SEQ ID NO: 634997 - DNA, 25 bp, Homo sapien
ggccgctgaaattatactatcaatg

SEQ ID NO: 634998 - DNA, 25 bp, Homo sapien
agcgcagatactggcaagggctcca

SEQ ID NO: 634999 - DNA, 25 bp, Homo sapien
gtgttgacactgtacaatccctatg

SEQ ID NO: 635000 - DNA, 25 bp, Homo sapien
gacactgtacaatccctatgagttt

SEQ ID NO: 635001 - DNA, 25 bp, Homo sapien
gtacaatccctatgagtttgcctta

SEQ ID NO: 635002 - DNA, 25 bp, Homo sapien
aatccctatgagtttgccttaaagt

SEQ ID NO: 635003 - DNA, 25 bp, Homo sapien
agttttgtgtactactccaaataag

SEQ ID NO: 635004 - DNA, 25 bp, Homo sapien
aagtatgttgtcgttgatgctgcag

SEQ ID NO: 635005 - DNA, 25 bp, Homo sapien
atgttgtcgttgatgctgcaggtgc

SEQ ID NO: 635006 - DNA, 25 bp, Homo sapien
tgtcgttgatgctgcaggtgcagta

SEQ ID NO: 635007 - DNA, 25 bp, Homo sapien
gcaggtgcagtaaagcctcagtgtt

SEQ ID NO: 635008 - DNA, 25 bp, Homo sapien
gtgcagtaaagcctcagtgttgtgt

SEQ ID NO: 635009 - DNA, 25 bp, Homo sapien
taaagcctcagtgttgtgtggatat

SEQ ID NO: 635010 - DNA, 25 bp, Homo sapien
gaatgctacataaatcgctcagtct

SEQ ID NO: 635011 - DNA, 25 bp, Homo sapien
aatcgctcagtctgacttcaaaggg

SEQ ID NO: 635012 - DNA, 25 bp, Homo sapien
gaattgatttatgtcctcagagcca

SEQ ID NO: 635013 - DNA, 25 bp, Homo sapien
tccatttatcagttccaaaggagct

SEQ ID NO: 635014 - DNA, 25 bp, Homo sapien
aaaggagctgatttacggcccacct

SEQ ID NO: 635015 - DNA, 25 bp, Homo sapien
gcccacctcttctagtttgtattct

SEQ ID NO: 635016 - DNA, 25 bp, Homo sapien
gtattctgtccagctcagaaagtta

SEQ ID NO: 635017 - DNA, 25 bp, Homo sapien
aagaaatatcctctgtctcattgca

SEQ ID NO: 635018 - DNA, 25 bp, Homo sapien
gtctcattgcagatgacgggttata

SEQ ID NO: 635019 - DNA, 25 bp, Homo sapien
aaatgagcacaacttgattctctgt

SEQ ID NO: 635020 - DNA, 25 bp, Homo sapien
gattctctgttctggaaaattagtg

SEQ ID NO: 635021 - DNA, 25 bp, Homo sapien
gtgtcactgcacgtgagacaggtac

SEQ ID NO: 635022 - DNA, 25 bp, Homo sapien
gattcttacgatgttacgttcacca

SEQ ID NO: 635023 - DNA, 25 bp, Homo sapien
gatgttacgttcaccattatggata

SEQ ID NO: 635024 - DNA, 25 bp, Homo sapien
attattcaaactgagactgtctgtg

SEQ ID NO: 635025 - DNA, 25 bp, Homo sapien
actgtctgtgacaattactgttcag

SEQ ID NO: 635026 - DNA, 25 bp, Homo sapien
ggcagcaagtcttctggttcttaat

SEQ ID NO: 635027 - DNA, 25 bp, Homo sapien
atccagtggtgtttttgtgcaattc

SEQ ID NO: 635028 - DNA, 25 bp, Homo sapien
aagacatgtatgttgttcccagtaa

SEQ ID NO: 635029 - DNA, 25 bp, Homo sapien
gttcccagtaatgacttggtgtgtt

SEQ ID NO: 635030 - DNA, 25 bp, Homo sapien
cttggtgtgtttgctgaggtagttc

SEQ ID NO: 635031 - DNA, 25 bp, Homo sapien
gttcggtaggactgctagagctagc

SEQ ID NO: 635032 - DNA, 25 bp, Homo sapien
tgagccaccgcgctggcaaatacgt

SEQ ID NO: 635033 - DNA, 25 bp, Homo sapien
cgcgctggcaaatacgtactacatt

SEQ ID NO: 635034 - DNA, 25 bp, Homo sapien
aatacgtactacattttaacaccag

SEQ ID NO: 635035 - DNA, 25 bp, Homo sapien
taacaccagttttattattacacac

SEQ ID NO: 635036 - DNA, 25 bp, Homo sapien
gttttattattacacacaccgataa

SEQ ID NO: 635037 - DNA, 25 bp, Homo sapien
ttacacacaccgataaaaaggcctg

SEQ ID NO: 635038 - DNA, 25 bp, Homo sapien
aaaggcctgggtatacaatcacata

SEQ ID NO: 635039 - DNA, 25 bp, Homo sapien
ggcctgggtatacaatcacataatc

SEQ ID NO: 635040 - DNA, 25 bp, Homo sapien
gggtatacaatcacataatcatggg

SEQ ID NO: 635041 - DNA, 25 bp, Homo sapien
acataatcatgggtgtggaacatat

SEQ ID NO: 635042 - DNA, 25 bp, Homo sapien
tgggtgtggaacatattttcttgct

SEQ ID NO: 635043 - DNA, 25 bp, Homo sapien
tccttttgcctattgatttccattg

SEQ ID NO: 635044 - DNA, 25 bp, Homo sapien
gatttccattgcctatgcatcttac

SEQ ID NO: 635045 - DNA, 25 bp, Homo sapien
tatgcatcttacctgtggctcaaga

SEQ ID NO: 635046 - DNA, 25 bp, Homo sapien
atccaattagccttttcactttggc

SEQ ID NO: 635047 - DNA, 25 bp, Homo sapien
tttggcagcccttaccaattggcaa

SEQ ID NO: 635048 - DNA, 25 bp, Homo sapien
caattggcaacttctttgtctcttg

SEQ ID NO: 635049 - DNA, 25 bp, Homo sapien
tgtctcttggtttgcttttgggcaa

SEQ ID NO: 635050 - DNA, 25 bp, Homo sapien
ccttcttctttagtttttgagtcat

SEQ ID NO: 635051 - DNA, 25 bp, Homo sapien
tatatcctcttggttttcttcctac

SEQ ID NO: 635052 - DNA, 25 bp, Homo sapien
ttttcttcctacctttctgacttct

SEQ ID NO: 635053 - DNA, 25 bp, Homo sapien
gtctcctttgaaagtttacagcttc

SEQ ID NO: 635054 - DNA, 25 bp, Homo sapien
cccagagttgtacataggattgaag

SEQ ID NO: 635055 - DNA, 25 bp, Homo sapien
agcaactggcctgtactaattattc

SEQ ID NO: 635056 - DNA, 25 bp, Homo sapien
gtactaattattcccaggatacgca

SEQ ID NO: 635057 - DNA, 25 bp, Homo sapien
atacgcatatccctttgtggcagca

SEQ ID NO: 635058 - DNA, 25 bp, Homo sapien
tcagtctccttcaacttgccacgta

SEQ ID NO: 635059 - DNA, 25 bp, Homo sapien
ttgccacgtagctttctccagaata

SEQ ID NO: 635060 - DNA, 25 bp, Homo sapien
agctttctccagaataagtccaccc

SEQ ID NO: 635061 - DNA, 25 bp, Homo sapien
ccctcagggtgctaccgtgaaggag

SEQ ID NO: 635062 - DNA, 25 bp, Homo sapien
ggttttggcatttgagagcccagag

SEQ ID NO: 635063 - DNA, 25 bp, Homo sapien
gagagcccagagagatatacatgaa

SEQ ID NO: 635064 - DNA, 25 bp, Homo sapien
catgaagatctggtctctggagagt

SEQ ID NO: 635065 - DNA, 25 bp, Homo sapien
aagctgaggaactggaagtgataat

SEQ ID NO: 635066 - DNA, 25 bp, Homo sapien
ataatgtggagaatgctcccgtctc

SEQ ID NO: 635067 - DNA, 25 bp, Homo sapien
gtggagaatgctcccgtctccgcaa

SEQ ID NO: 635068 - DNA, 25 bp, Homo sapien
agtgaccttaaggagctatctgaag

SEQ ID NO: 635069 - DNA, 25 bp, Homo sapien
acactcatctacacaatatagttct

SEQ ID NO: 635070 - DNA, 25 bp, Homo sapien
cacaatatagttctacccagatgga

SEQ ID NO: 635071 - DNA, 25 bp, Homo sapien
tctacccagatggaatccaatcaaa

SEQ ID NO: 635072 - DNA, 25 bp, Homo sapien
gaatccaatcaaatccatctttata

SEQ ID NO: 635073 - DNA, 25 bp, Homo sapien
atatcaaatcaatcaaatccatctt

SEQ ID NO: 635074 - DNA, 25 bp, Homo sapien
catctttataatatgttgagtaact

SEQ ID NO: 635075 - DNA, 25 bp, Homo sapien
gagtaactacatattgagaatcata

SEQ ID NO: 635076 - DNA, 25 bp, Homo sapien
gtgaagggcaaccacaggttccaag

SEQ ID NO: 635077 - DNA, 25 bp, Homo sapien
ggtgtgcttggtatggcttgagccc

SEQ ID NO: 635078 - DNA, 25 bp, Homo sapien
gaagggcaaccacaggttccaagga

SEQ ID NO: 635079 - DNA, 25 bp, Homo sapien
agggcaaccacaggttccaaggaag

SEQ ID NO: 635080 - DNA, 25 bp, Homo sapien
tttgaggctgcaccgagcaatgact

SEQ ID NO: 635081 - DNA, 25 bp, Homo sapien
acaggttccaaggaagacaagctga

SEQ ID NO: 635082 - DNA, 25 bp, Homo sapien
gacaagctgaaacaatgcaaactgg

SEQ ID NO: 635083 - DNA, 25 bp, Homo sapien
actggttttatattagatacgtgac

SEQ ID NO: 635084 - DNA, 25 bp, Homo sapien
gatacgtgacttaaaatatctcaat

SEQ ID NO: 635085 - DNA, 25 bp, Homo sapien
aaatatctcaatacagttttctcca

SEQ ID NO: 635086 - DNA, 25 bp, Homo sapien
atatctcaatacagttttctccaaa

SEQ ID NO: 635087 - DNA, 25 bp, Homo sapien
attgtgcacacttcccacgtcagca

SEQ ID NO: 635088 - DNA, 25 bp, Homo sapien
gtcagcacacagaagagtagaatgg

SEQ ID NO: 635089 - DNA, 25 bp, Homo sapien
tagaatggcatgtacttgagtttag

SEQ ID NO: 635090 - DNA, 25 bp, Homo sapien
agtaaaattaggacttttgcaggcg

SEQ ID NO: 635091 - DNA, 25 bp, Homo sapien
gtggttcacttgaggacgagttcaa

SEQ ID NO: 635092 - DNA, 25 bp, Homo sapien
gctggcagcttagagacgagcgctt

SEQ ID NO: 635093 - DNA, 25 bp, Homo sapien
tagagacgagcgcttttcacagaga

SEQ ID NO: 635094 - DNA, 25 bp, Homo sapien
gacgagcgcttttcacagagagttg

SEQ ID NO: 635095 - DNA, 25 bp, Homo sapien
ttcacagagagttgggtttgcagca

SEQ ID NO: 635096 - DNA, 25 bp, Homo sapien
gggtttgcagcaacaggcattgtgc

SEQ ID NO: 635097 - DNA, 25 bp, Homo sapien
agcaacaggcattgtgcacacttcc

SEQ ID NO: 635098 - DNA, 25 bp, Homo sapien
ttgcacaggtgtgccctctcgcatg

SEQ ID NO: 635099 - DNA, 25 bp, Homo sapien
ctcgcatgcccttcttcccttgttt

SEQ ID NO: 635100 - DNA, 25 bp, Homo sapien
tattcatctttcattcttcattctc

SEQ ID NO: 635101 - DNA, 25 bp, Homo sapien
ttcatctttcattcttcattctctg

SEQ ID NO: 635102 - DNA, 25 bp, Homo sapien
catctttcattcttcattctctgta

SEQ ID NO: 635103 - DNA, 25 bp, Homo sapien
atctttcattcttcattctctgtaa

SEQ ID NO: 635104 - DNA, 25 bp, Homo sapien
ctttcattcttcattctctgtaaaa

SEQ ID NO: 635105 - DNA, 25 bp, Homo sapien
tcattcttcattctctgtaaaatct

SEQ ID NO: 635106 - DNA, 25 bp, Homo sapien
tgtaaaatcttctctgattcctcaa

SEQ ID NO: 635107 - DNA, 25 bp, Homo sapien
gtaaaatcttctctgattcctcaaa

SEQ ID NO: 635108 - DNA, 25 bp, Homo sapien
aaatcttctctgattcctcaaatta

SEQ ID NO: 635109 - DNA, 25 bp, Homo sapien
aaatagttagccgagtatgggggtg

SEQ ID NO: 635110 - DNA, 25 bp, Homo sapien
aatagttagccgagtatgggggtgt

SEQ ID NO: 635111 - DNA, 25 bp, Homo sapien
atagttagccgagtatgggggtgtg

SEQ ID NO: 635112 - DNA, 25 bp, Homo sapien
tagttagccgagtatgggggtgtgc

SEQ ID NO: 635113 - DNA, 25 bp, Homo sapien
gttagccgagtatgggggtgtgctt

SEQ ID NO: 635114 - DNA, 25 bp, Homo sapien
gggtgtgcttggtatggcttgagcc

SEQ ID NO: 635115 - DNA, 25 bp, Homo sapien
ggtgtgcttggtatggcttgagccc

SEQ ID NO: 635116 - DNA, 25 bp, Homo sapien
gatacgtgacttaaaatatctcaat

SEQ ID NO: 635117 - DNA, 25 bp, Homo sapien
atacgtgacttaaaatatctcaata

SEQ ID NO: 635118 - DNA, 25 bp, Homo sapien
aaatatctcaatacagttttctcca

SEQ ID NO: 635119 - DNA, 25 bp, Homo sapien
atatctcaatacagttttctccaaa

SEQ ID NO: 635120 - DNA, 25 bp, Homo sapien
attgtgtttctcgtgtctgaggcac

SEQ ID NO: 635121 - DNA, 25 bp, Homo sapien
tttctcgtgtctgaggcacctctga

SEQ ID NO: 635122 - DNA, 25 bp, Homo sapien
gaggcacctctgaaagcatttatct

SEQ ID NO: 635123 - DNA, 25 bp, Homo sapien
gcatttatcttttcagagagttcag

SEQ ID NO: 635124 - DNA, 25 bp, Homo sapien
gggcctgttgacaaaagagaataat

SEQ ID NO: 635125 - DNA, 25 bp, Homo sapien
tttcagagagttcagcacttcatct

SEQ ID NO: 635126 - DNA, 25 bp, Homo sapien
cagcacttcatctcacgggttaatt

SEQ ID NO: 635127 - DNA, 25 bp, Homo sapien
taaaccaacctgtagtggcaaagtt

SEQ ID NO: 635128 - DNA, 25 bp, Homo sapien
cctgtagtggcaaagtttagtggta

SEQ ID NO: 635129 - DNA, 25 bp, Homo sapien
caggtgtcctcctgaaactgtcacc

SEQ ID NO: 635130 - DNA, 25 bp, Homo sapien
aaactgtcaccacagtgaccttcct

SEQ ID NO: 635131 - DNA, 25 bp, Homo sapien
ggacattactaccatgacaaccaat

SEQ ID NO: 635132 - DNA, 25 bp, Homo sapien
atgacaaccaatgaaaagttctttc

SEQ ID NO: 635133 - DNA, 25 bp, Homo sapien
atataacgttccttactctctaggc

SEQ ID NO: 635134 - DNA, 25 bp, Homo sapien
taacgttccttactctctaggctct

SEQ ID NO: 635135 - DNA, 25 bp, Homo sapien
gtcaaaaacacagagggtcgtcata

SEQ ID NO: 635136 - DNA, 25 bp, Homo sapien
gagggtcgtcataaagtttccgtca

SEQ ID NO: 635137 - DNA, 25 bp, Homo sapien
gtcataaagtttccgtcagaccaaa

SEQ ID NO: 635138 - DNA, 25 bp, Homo sapien
tccgtcagaccaaaggaaccaagat

SEQ ID NO: 635139 - DNA, 25 bp, Homo sapien
ggaaccaagatgaaagcatgtttaa

SEQ ID NO: 635140 - DNA, 25 bp, Homo sapien
gtttaagagctactaggttctggga

SEQ ID NO: 635141 - DNA, 25 bp, Homo sapien
gctactaggttctgggagatttcaa

SEQ ID NO: 635142 - DNA, 25 bp, Homo sapien
gaaggttttgaactctaatctttgt

SEQ ID NO: 635143 - DNA, 25 bp, Homo sapien
atctttgtttcctcagcacactgaa

SEQ ID NO: 635144 - DNA, 25 bp, Homo sapien
ctgcttttcaggctttctggtgagc

SEQ ID NO: 635145 - DNA, 25 bp, Homo sapien
ttctggtgagcctcttagcctcctt

SEQ ID NO: 635146 - DNA, 25 bp, Homo sapien
gcctccttcccttcagagtttggca

SEQ ID NO: 635147 - DNA, 25 bp, Homo sapien
attcagttttctgtatacaccctcc

SEQ ID NO: 635148 - DNA, 25 bp, Homo sapien
ctcctcaccaggatattgacttctg

SEQ ID NO: 635149 - DNA, 25 bp, Homo sapien
ggatattgacttctgaattcttaag

SEQ ID NO: 635150 - DNA, 25 bp, Homo sapien
ttcccagctctatgaggccactaat

SEQ ID NO: 635151 - DNA, 25 bp, Homo sapien
gaggccactaatagctctatcaatg

SEQ ID NO: 635152 - DNA, 25 bp, Homo sapien
ctatcaatgttattggccctcatcc

SEQ ID NO: 635153 - DNA, 25 bp, Homo sapien
agagctgagcccatgaggatagttc

SEQ ID NO: 635154 - DNA, 25 bp, Homo sapien
gctgagcccatgaggatagttcgcc

SEQ ID NO: 635155 - DNA, 25 bp, Homo sapien
tgagcccatgaggatagttcgccag

SEQ ID NO: 635156 - DNA, 25 bp, Homo sapien
gagcccatgaggatagttcgccagc

SEQ ID NO: 635157 - DNA, 25 bp, Homo sapien
agcccatgaggatagttcgccagcc

SEQ ID NO: 635158 - DNA, 25 bp, Homo sapien
gcccatgaggatagttcgccagcca

SEQ ID NO: 635159 - DNA, 25 bp, Homo sapien
ccatgaggatagttcgccagccaac

SEQ ID NO: 635160 - DNA, 25 bp, Homo sapien
atgaggatagttcgccagccaacgc

SEQ ID NO: 635161 - DNA, 25 bp, Homo sapien
aggatagttcgccagccaacgcctc

SEQ ID NO: 635162 - DNA, 25 bp, Homo sapien
agaccctctggagagcccaccaaca

SEQ ID NO: 635163 - DNA, 25 bp, Homo sapien
ggagagcccaccaacagccccagat

SEQ ID NO: 635164 - DNA, 25 bp, Homo sapien
gacaataacctgtcagattgcctat

SEQ ID NO: 635165 - DNA, 25 bp, Homo sapien
gattgcctatagtttccacttttgg

SEQ ID NO: 635166 - DNA, 25 bp, Homo sapien
gttttggattaccacatcagctttc

SEQ ID NO: 635167 - DNA, 25 bp, Homo sapien
atcagctttctagtggatcttcctg

SEQ ID NO: 635168 - DNA, 25 bp, Homo sapien
gatcttcctgtatgcaggctttcta

SEQ ID NO: 635169 - DNA, 25 bp, Homo sapien
gcaggctttctaatgcatactgtgt

SEQ ID NO: 635170 - DNA, 25 bp, Homo sapien
gcatactgtgtattactgctctaat

SEQ ID NO: 635171 - DNA, 25 bp, Homo sapien
ctgctctaatcatcaaagtgcttac

SEQ ID NO: 635172 - DNA, 25 bp, Homo sapien
gcagatgcaaggttttgactagaat

SEQ ID NO: 635173 - DNA, 25 bp, Homo sapien
aagtctcaaactaggtctctcaaca

SEQ ID NO: 635174 - DNA, 25 bp, Homo sapien
aggtctctcaacaaatttattcagg

SEQ ID NO: 635175 - DNA, 25 bp, Homo sapien
tatttcgttaatactatcataggtt

SEQ ID NO: 635176 - DNA, 25 bp, Homo sapien
tcgttaatactatcataggtttcta

SEQ ID NO: 635177 - DNA, 25 bp, Homo sapien
ggttacaggttgctcgcttctgtaa

SEQ ID NO: 635178 - DNA, 25 bp, Homo sapien
acaggttgctcgcttctgtaatctc

SEQ ID NO: 635179 - DNA, 25 bp, Homo sapien
caggttgctcgcttctgtaatctca

SEQ ID NO: 635180 - DNA, 25 bp, Homo sapien
agccaagatcggatcacttcacttt

SEQ ID NO: 635181 - DNA, 25 bp, Homo sapien
ccaagatcggatcacttcactttag

SEQ ID NO: 635182 - DNA, 25 bp, Homo sapien
agatcggatcacttcactttagcct

SEQ ID NO: 635183 - DNA, 25 bp, Homo sapien
atcggatcacttcactttagccttg

SEQ ID NO: 635184 - DNA, 25 bp, Homo sapien
tcggatcacttcactttagccttgg

SEQ ID NO: 635185 - DNA, 25 bp, Homo sapien
ggatcacttcactttagccttggtg

SEQ ID NO: 635186 - DNA, 25 bp, Homo sapien
tttgtcctcgagattttaggaaggg

SEQ ID NO: 635187 - DNA, 25 bp, Homo sapien
ttgtcctcgagattttaggaagggt

SEQ ID NO: 635188 - DNA, 25 bp, Homo sapien
gtcctcgagattttaggaagggtgt

SEQ ID NO: 635189 - DNA, 25 bp, Homo sapien
cctcgagattttaggaagggtgtag

SEQ ID NO: 635190 - DNA, 25 bp, Homo sapien
tttgagtgccactattaatgtaaaa

SEQ ID NO: 635191 - DNA, 25 bp, Homo sapien
ggggggggctctacagcagtcgtga

SEQ ID NO: 635192 - DNA, 25 bp, Homo sapien
tacagcagtcgtgatgaaacttaaa

SEQ ID NO: 635193 - DNA, 25 bp, Homo sapien
acagcagtcgtgatgaaacttaaat

SEQ ID NO: 635194 - DNA, 25 bp, Homo sapien
cagcagtcgtgatgaaacttaaata

SEQ ID NO: 635195 - DNA, 25 bp, Homo sapien
gcagtcgtgatgaaacttaaatata

SEQ ID NO: 635196 - DNA, 25 bp, Homo sapien
ctttgtcctcgagattttaggaagg

SEQ ID NO: 635197 - DNA, 25 bp, Homo sapien
tcagccttttcccaatcaatcagag

SEQ ID NO: 635198 - DNA, 25 bp, Homo sapien
agccttttcccaatcaatcagagat

SEQ ID NO: 635199 - DNA, 25 bp, Homo sapien
atcagagatttgcatagggtgtaac

SEQ ID NO: 635200 - DNA, 25 bp, Homo sapien
tttgcatagggtgtaactttgaaac

SEQ ID NO: 635201 - DNA, 25 bp, Homo sapien
tgcttcagcctctgataggtcccct

SEQ ID NO: 635202 - DNA, 25 bp, Homo sapien
aatcagactgattgtgggcactact

SEQ ID NO: 635203 - DNA, 25 bp, Homo sapien
tgattgtgggcactacttcatttac

SEQ ID NO: 635204 - DNA, 25 bp, Homo sapien
cttcatttacaagggtgtacatcaa

SEQ ID NO: 635205 - DNA, 25 bp, Homo sapien
acaagggtgtacatcaagtaaccaa

SEQ ID NO: 635206 - DNA, 25 bp, Homo sapien
ttgaaccacttgctcaagccactcc

SEQ ID NO: 635207 - DNA, 25 bp, Homo sapien
actcccaccctgtgaagtgtacctt

SEQ ID NO: 635208 - DNA, 25 bp, Homo sapien
taccgatgacagtagagtattgaaa

SEQ ID NO: 635209 - DNA, 25 bp, Homo sapien
agagtattgaaaaaccaggtgcacc

SEQ ID NO: 635210 - DNA, 25 bp, Homo sapien
aaaccaggtgcaccaggttcttgtt

SEQ ID NO: 635211 - DNA, 25 bp, Homo sapien
aggtgcaccaggttcttgttttcat

SEQ ID NO: 635212 - DNA, 25 bp, Homo sapien
cattcttgataggttctaagttcat

SEQ ID NO: 635213 - DNA, 25 bp, Homo sapien
aagttcattaaaccagtctcgcagt

SEQ ID NO: 635214 - DNA, 25 bp, Homo sapien
aaaccagtctcgcagttactcagag

SEQ ID NO: 635215 - DNA, 25 bp, Homo sapien
ctcgcagttactcagagaatcacaa

SEQ ID NO: 635216 - DNA, 25 bp, Homo sapien
gaatcacaaaaccaagtgttcctct

SEQ ID NO: 635217 - DNA, 25 bp, Homo sapien
gtgttcctcttattatcttgcttag

SEQ ID NO: 635218 - DNA, 25 bp, Homo sapien
cctcttattatcttgcttagctcat

SEQ ID NO: 635219 - DNA, 25 bp, Homo sapien
acaccttacctacagagacacaaag

SEQ ID NO: 635220 - DNA, 25 bp, Homo sapien
gagacacaaagataagaactgcatt

SEQ ID NO: 635221 - DNA, 25 bp, Homo sapien
agataagaactgcattcaacattgc

SEQ ID NO: 635222 - DNA, 25 bp, Homo sapien
gcattcaacattgcagaaactgtga

SEQ ID NO: 635223 - DNA, 25 bp, Homo sapien
caacctaagtttctgtacccactga

SEQ ID NO: 635224 - DNA, 25 bp, Homo sapien
taagtttctgtacccactgaaaaca

SEQ ID NO: 635225 - DNA, 25 bp, Homo sapien
ctgaaaacacccttcaaaagtgaag

SEQ ID NO: 635226 - DNA, 25 bp, Homo sapien
gagaattaaggccttcctcagaaaa

SEQ ID NO: 635227 - DNA, 25 bp, Homo sapien
tcaagaaacttgttgccaggagacc

SEQ ID NO: 635228 - DNA, 25 bp, Homo sapien
gaaacttgttgccaggagacctgtc

SEQ ID NO: 635229 - DNA, 25 bp, Homo sapien
acttgttgccaggagacctgtcttg

SEQ ID NO: 635230 - DNA, 25 bp, Homo sapien
cctggagatagtttgctgtggttat

SEQ ID NO: 635231 - DNA, 25 bp, Homo sapien
gatagtttgctgtggttattgtata

SEQ ID NO: 635232 - DNA, 25 bp, Homo sapien
gctgtggttattgtataggtttgta

SEQ ID NO: 635233 - DNA, 25 bp, Homo sapien
atggagatttacatgccaggcaaca

SEQ ID NO: 635234 - DNA, 25 bp, Homo sapien
gatttacatgccaggcaacagtctt

SEQ ID NO: 635235 - DNA, 25 bp, Homo sapien
acatgccaggcaacagtcttaatat

SEQ ID NO: 635236 - DNA, 25 bp, Homo sapien
gccaggcaacagtcttaatatacaa

SEQ ID NO: 635237 - DNA, 25 bp, Homo sapien
aggagtaatgtcacttattcaggga

SEQ ID NO: 635238 - DNA, 25 bp, Homo sapien
gtaatgtcacttattcagggacctg

SEQ ID NO: 635239 - DNA, 25 bp, Homo sapien
atgtcacttattcagggacctggag

SEQ ID NO: 635240 - DNA, 25 bp, Homo sapien
ttcagggacctggagatagtttgct

SEQ ID NO: 635241 - DNA, 25 bp, Homo sapien
atgaaagatttaatccaaccttctt

SEQ ID NO: 635242 - DNA, 25 bp, Homo sapien
gcaaactgttcattagccaaacccc

SEQ ID NO: 635243 - DNA, 25 bp, Homo sapien
tgttcattagccaaaccccaccatt

SEQ ID NO: 635244 - DNA, 25 bp, Homo sapien
taaataattgcgatcacctcctacc

SEQ ID NO: 635245 - DNA, 25 bp, Homo sapien
tacctagccttgtagccagcagtct

SEQ ID NO: 635246 - DNA, 25 bp, Homo sapien
agcagtctctcccattcatctactg

SEQ ID NO: 635247 - DNA, 25 bp, Homo sapien
attcatctactgtcatcagtcagat

SEQ ID NO: 635248 - DNA, 25 bp, Homo sapien
ggaggagaacagtgcataaaacata

SEQ ID NO: 635249 - DNA, 25 bp, Homo sapien
taacatttctagttcaggatatgat

SEQ ID NO: 635250 - DNA, 25 bp, Homo sapien
aagcactcaataactgttacttgat

SEQ ID NO: 635251 - DNA, 25 bp, Homo sapien
gttacttgatattactacttcatca

SEQ ID NO: 635252 - DNA, 25 bp, Homo sapien
aaatgtggttaaattgcttctcaaa

SEQ ID NO: 635253 - DNA, 25 bp, Homo sapien
gcttctcaaaaggatagtattacta

SEQ ID NO: 635254 - DNA, 25 bp, Homo sapien
gtattactagtactgtttcactgta

SEQ ID NO: 635255 - DNA, 25 bp, Homo sapien
gtactgtttcactgtattcttttag

SEQ ID NO: 635256 - DNA, 25 bp, Homo sapien
cactgtattcttttagattgggtat

SEQ ID NO: 635257 - DNA, 25 bp, Homo sapien
tttagattgggtattagtgctgttt

SEQ ID NO: 635258 - DNA, 25 bp, Homo sapien
tactaggcgagaaaggtacttcact

SEQ ID NO: 635259 - DNA, 25 bp, Homo sapien
ggtacttcactgttgtggttttaga

SEQ ID NO: 635260 - DNA, 25 bp, Homo sapien
ggttttagagtgcatttctttatgt

SEQ ID NO: 635261 - DNA, 25 bp, Homo sapien
tccttaaggtaggttcccaggtatg

SEQ ID NO: 635262 - DNA, 25 bp, Homo sapien
aggttcccaggtatgatttttgagt

SEQ ID NO: 635263 - DNA, 25 bp, Homo sapien
tttttagctttgtgcctgtttttgc

SEQ ID NO: 635264 - DNA, 25 bp, Homo sapien
gcctgtttttgcatagtttaccaaa

SEQ ID NO: 635265 - DNA, 25 bp, Homo sapien
gctaccagagctatgcattttgcta

SEQ ID NO: 635266 - DNA, 25 bp, Homo sapien
gcattttgctatgtcttgattcatt

SEQ ID NO: 635267 - DNA, 25 bp, Homo sapien
ggaaattattcccttggcaatgcac

SEQ ID NO: 635268 - DNA, 25 bp, Homo sapien
ggcaatgcacaactgaacttttata

SEQ ID NO: 635269 - DNA, 25 bp, Homo sapien
tatactcatctctatatacgtgtgt

SEQ ID NO: 635270 - DNA, 25 bp, Homo sapien
gtatttttctacatatgcctatatt

SEQ ID NO: 635271 - DNA, 25 bp, Homo sapien
ggatattttgggtagcaagctttgt

SEQ ID NO: 635272 - DNA, 25 bp, Homo sapien
agctttgtaatgatttctcctagtc

SEQ ID NO: 635273 - DNA, 25 bp, Homo sapien
tctcctagtctgttacatttattcc

SEQ ID NO: 635274 - DNA, 25 bp, Homo sapien
gtaaaaacacttgcagattcgtcat

SEQ ID NO: 635275 - DNA, 25 bp, Homo sapien
gattcgtcatcaaattagcagtcaa

SEQ ID NO: 635276 - DNA, 25 bp, Homo sapien
tagcagtcaagtgggtcttctcata

SEQ ID NO: 635277 - DNA, 25 bp, Homo sapien
gtcaagtgggtcttctcataactga

SEQ ID NO: 635278 - DNA, 25 bp, Homo sapien
gggtcttctcataactgaattttcc

SEQ ID NO: 635279 - DNA, 25 bp, Homo sapien
tgaattttccaggataaatatctgt

SEQ ID NO: 635280 - DNA, 25 bp, Homo sapien
tatctgttaaaaattcctaagcctg

SEQ ID NO: 635281 - DNA, 25 bp, Homo sapien
ttgaaagcccttagtacctataaag

SEQ ID NO: 635282 - DNA, 25 bp, Homo sapien
gcccttagtacctataaagacctat

SEQ ID NO: 635283 - DNA, 25 bp, Homo sapien
ataaagacctatgttcttatcatca

SEQ ID NO: 635284 - DNA, 25 bp, Homo sapien
atcatcaactagaaaagtcctttgt

SEQ ID NO: 635285 - DNA, 25 bp, Homo sapien
tgttgagggctcaagtaagctggag

SEQ ID NO: 635286 - DNA, 25 bp, Homo sapien
gagcatgtgtcctatcaaaaggagg

SEQ ID NO: 635287 - DNA, 25 bp, Homo sapien
aaggaggaaactactattcagctac

SEQ ID NO: 635288 - DNA, 25 bp, Homo sapien
gaaactactattcagctacagtgct

SEQ ID NO: 635289 - DNA, 25 bp, Homo sapien
actattcagctacagtgctgctgac

SEQ ID NO: 635290 - DNA, 25 bp, Homo sapien
agtgctgctgactgaatgggaatgc

SEQ ID NO: 635291 - DNA, 25 bp, Homo sapien
taacataagaggactaaggacagcc

SEQ ID NO: 635292 - DNA, 25 bp, Homo sapien
taaggacagccaagcatacaatgat

SEQ ID NO: 635293 - DNA, 25 bp, Homo sapien
gacagccaagcatacaatgatgcat

SEQ ID NO: 635294 - DNA, 25 bp, Homo sapien
aatgatgcatggcagtgacagctga

SEQ ID NO: 635295 - DNA, 25 bp, Homo sapien
cagtgacagctgacctcaacgtggg

SEQ ID NO: 635296 - DNA, 25 bp, Homo sapien
tagtaaaggacaagaaaacgtcatc

SEQ ID NO: 635297 - DNA, 25 bp, Homo sapien
aaatggactgttgacttgtaactaa

SEQ ID NO: 635298 - DNA, 25 bp, Homo sapien
gactgttgacttgtaactaatgcaa

SEQ ID NO: 635299 - DNA, 25 bp, Homo sapien
ttgacttgtaactaatgcaatagcc

SEQ ID NO: 635300 - DNA, 25 bp, Homo sapien
tactaactattcttcttggttactt

SEQ ID NO: 635301 - DNA, 25 bp, Homo sapien
ttttttttacagcaagacagggaag

SEQ ID NO: 635302 - DNA, 25 bp, Homo sapien
acaaactgtctaggctataagtgct

SEQ ID NO: 635303 - DNA, 25 bp, Homo sapien
aactgtctaggctataagtgctata

SEQ ID NO: 635304 - DNA, 25 bp, Homo sapien
gtctaggctataagtgctataatat

SEQ ID NO: 635305 - DNA, 25 bp, Homo sapien
acgagagttgttaaatatggtctac

SEQ ID NO: 635306 - DNA, 25 bp, Homo sapien
gagagttgttaaatatggtctacat

SEQ ID NO: 635307 - DNA, 25 bp, Homo sapien
tgccctccagtagagtgagattccg

SEQ ID NO: 635308 - DNA, 25 bp, Homo sapien
ggagatacaaacttactacctacct

SEQ ID NO: 635309 - DNA, 25 bp, Homo sapien
caacctaccctcacagtattactgt

SEQ ID NO: 635310 - DNA, 25 bp, Homo sapien
gtgtgtgtagcactgggaacactat

SEQ ID NO: 635311 - DNA, 25 bp, Homo sapien
ggaacactattcacagagcactcat

SEQ ID NO: 635312 - DNA, 25 bp, Homo sapien
gagcactcatgaatgtttgttcttt

SEQ ID NO: 635313 - DNA, 25 bp, Homo sapien
tttgttctttgttattagttactag

SEQ ID NO: 635314 - DNA, 25 bp, Homo sapien
gaggcaaatgtctgccagggctgaa

SEQ ID NO: 635315 - DNA, 25 bp, Homo sapien
ctgccagggctgaataatatgtgtg

SEQ ID NO: 635316 - DNA, 25 bp, Homo sapien
atatgtgtgaattggtgattgtcgc

SEQ ID NO: 635317 - DNA, 25 bp, Homo sapien
ggtgattgtcgcacatatctaaaga

SEQ ID NO: 635318 - DNA, 25 bp, Homo sapien
gagaaacctatgaaatcagccacca

SEQ ID NO: 635319 - DNA, 25 bp, Homo sapien
aatcagccaccaacatggctgtgtc

SEQ ID NO: 635320 - DNA, 25 bp, Homo sapien
gcactggagaatctaaactcttttg

SEQ ID NO: 635321 - DNA, 25 bp, Homo sapien
ggctgtgtcactttggtgctcccac

SEQ ID NO: 635322 - DNA, 25 bp, Homo sapien
tgtcactttggtgctcccacaacaa

SEQ ID NO: 635323 - DNA, 25 bp, Homo sapien
tgctcccacaacaacttgaagcatt

SEQ ID NO: 635324 - DNA, 25 bp, Homo sapien
tctaaactcttttggagatgtccca

SEQ ID NO: 635325 - DNA, 25 bp, Homo sapien
tggagatgtcccaaggcctaacctg

SEQ ID NO: 635326 - DNA, 25 bp, Homo sapien
tgcacctcttcacagcataggcaag

SEQ ID NO: 635327 - DNA, 25 bp, Homo sapien
cataggcaagaaaattctgtctgac

SEQ ID NO: 635328 - DNA, 25 bp, Homo sapien
tgtctgacctttctgccgggaggag

SEQ ID NO: 635329 - DNA, 25 bp, Homo sapien
gcacgactgcccagaacatgaggtt

SEQ ID NO: 635330 - DNA, 25 bp, Homo sapien
acatgaggtttagccctggattaaa

SEQ ID NO: 635331 - DNA, 25 bp, Homo sapien
aactagttttcttacatcctgccct

SEQ ID NO: 635332 - DNA, 25 bp, Homo sapien
agttttcttacatcctgcccttgat

SEQ ID NO: 635333 - DNA, 25 bp, Homo sapien
ctgcccttgatcttacccaaaataa

SEQ ID NO: 635334 - DNA, 25 bp, Homo sapien
tgatcttacccaaaataacttctgt

SEQ ID NO: 635335 - DNA, 25 bp, Homo sapien
taacttctgttctgtaccagttccc

SEQ ID NO: 635336 - DNA, 25 bp, Homo sapien
tactcatacttcctcatattcgtgg

SEQ ID NO: 635337 - DNA, 25 bp, Homo sapien
atacttcctcatattcgtggagtac

SEQ ID NO: 635338 - DNA, 25 bp, Homo sapien
aaaacacagattggatgcttttccc

SEQ ID NO: 635339 - DNA, 25 bp, Homo sapien
ggatgcttttcccatagtgaattaa

SEQ ID NO: 635340 - DNA, 25 bp, Homo sapien
tgacttccccatgccatattaataa

SEQ ID NO: 635341 - DNA, 25 bp, Homo sapien
aatcatgacagctaatggttgacat

SEQ ID NO: 635342 - DNA, 25 bp, Homo sapien
caagaagagaacctgtaatcacccc

SEQ ID NO: 635343 - DNA, 25 bp, Homo sapien
tatgcagcagccacgtcacatgatc

SEQ ID NO: 635344 - DNA, 25 bp, Homo sapien
tccccgttccttggatggcctataa

SEQ ID NO: 635345 - DNA, 25 bp, Homo sapien
tggcctataaggtggtcttcctcta

SEQ ID NO: 635346 - DNA, 25 bp, Homo sapien
gtggtcttcctctagtagctgggcc

SEQ ID NO: 635347 - DNA, 25 bp, Homo sapien
ccagaatttgaactcatcccattta

SEQ ID NO: 635348 - DNA, 25 bp, Homo sapien
tcatcccatttaagagcctgcacat

SEQ ID NO: 635349 - DNA, 25 bp, Homo sapien
agcctgcacatataccactatgcta

SEQ ID NO: 635350 - DNA, 25 bp, Homo sapien
actatgctacagtgacttccccatg

SEQ ID NO: 635351 - DNA, 25 bp, Homo sapien
gaattctctaatactgttaaggtgg

SEQ ID NO: 635352 - DNA, 25 bp, Homo sapien
atactgttaaggtggtgtgtgaagc

SEQ ID NO: 635353 - DNA, 25 bp, Homo sapien
gtggtgtgtgaagcaatcttattac

SEQ ID NO: 635354 - DNA, 25 bp, Homo sapien
gaagcaatcttattactactaggag

SEQ ID NO: 635355 - DNA, 25 bp, Homo sapien
gcaatcttattactactaggagggt

SEQ ID NO: 635356 - DNA, 25 bp, Homo sapien
tattactactaggagggttaagaga

SEQ ID NO: 635357 - DNA, 25 bp, Homo sapien
ctgcagctacagtatattgttaaag

SEQ ID NO: 635358 - DNA, 25 bp, Homo sapien
gctacagtatattgttaaaggacac

SEQ ID NO: 635359 - DNA, 25 bp, Homo sapien
ggcaaattgttatcagtttaaagcc

SEQ ID NO: 635360 - DNA, 25 bp, Homo sapien
tgttatcagtttaaagcctgtttta

SEQ ID NO: 635361 - DNA, 25 bp, Homo sapien
aaaatattttatgtaagcctcatgg

SEQ ID NO: 635362 - DNA, 25 bp, Homo sapien
taggaaatctgtttcagtgtctttt

SEQ ID NO: 635363 - DNA, 25 bp, Homo sapien
gtgtgtaacttttacttgcaaacca

SEQ ID NO: 635364 - DNA, 25 bp, Homo sapien
ttttacttgcaaaccaatggaacca

SEQ ID NO: 635365 - DNA, 25 bp, Homo sapien
ggaaccaagaaagtcatcatttgcc

SEQ ID NO: 635366 - DNA, 25 bp, Homo sapien
atactatgtgagttaattgccttca

SEQ ID NO: 635367 - DNA, 25 bp, Homo sapien
gagttaattgccttcatctcattaa

SEQ ID NO: 635368 - DNA, 25 bp, Homo sapien
tgccttcatctcattaatggccaag

SEQ ID NO: 635369 - DNA, 25 bp, Homo sapien
catctcattaatggccaaggaggga

SEQ ID NO: 635370 - DNA, 25 bp, Homo sapien
tgttcattttgactcaccaggaggg

SEQ ID NO: 635371 - DNA, 25 bp, Homo sapien
atgtatagtaggtcaacattggtgc

SEQ ID NO: 635372 - DNA, 25 bp, Homo sapien
ttggtgcatccagaaaatgaagcat

SEQ ID NO: 635373 - DNA, 25 bp, Homo sapien
tgtgggacttagcatctctgtgagt

SEQ ID NO: 635374 - DNA, 25 bp, Homo sapien
aggccaccattgtcattaggagcta

SEQ ID NO: 635375 - DNA, 25 bp, Homo sapien
taggagctaattactttgcctctgc

SEQ ID NO: 635376 - DNA, 25 bp, Homo sapien
tgtgtcatccttattgcttctctat

SEQ ID NO: 635377 - DNA, 25 bp, Homo sapien
tctaatacttatttcagcttcccca

SEQ ID NO: 635378 - DNA, 25 bp, Homo sapien
ctaccacaggacagatacatcagat

SEQ ID NO: 635379 - DNA, 25 bp, Homo sapien
cagatgcaattttcacagttgtgac

SEQ ID NO: 635380 - DNA, 25 bp, Homo sapien
gactcttcaaaccatcccagttcag

SEQ ID NO: 635381 - DNA, 25 bp, Homo sapien
tcccagttcaggatgtagcactctg

SEQ ID NO: 635382 - DNA, 25 bp, Homo sapien
atgtagcactctgcagggctgattt

SEQ ID NO: 635383 - DNA, 25 bp, Homo sapien
ttcagtttcatatgtgctgcctttt

SEQ ID NO: 635384 - DNA, 25 bp, Homo sapien
aagctttatttcacaatcacacaaa

SEQ ID NO: 635385 - DNA, 25 bp, Homo sapien
tcacaatcacacaaagtttcatatg

SEQ ID NO: 635386 - DNA, 25 bp, Homo sapien
gaataaggtagctctcttccatctc

SEQ ID NO: 635387 - DNA, 25 bp, Homo sapien
aaggtagctctcttccatctcagaa

SEQ ID NO: 635388 - DNA, 25 bp, Homo sapien
agaacccatgacctccatggtgaat

SEQ ID NO: 635389 - DNA, 25 bp, Homo sapien
atgacctccatggtgaatcatgtag

SEQ ID NO: 635390 - DNA, 25 bp, Homo sapien
gtgaatcatgtagcctccaagagaa

SEQ ID NO: 635391 - DNA, 25 bp, Homo sapien
aaaaagaaggcacatcgggctgggt

SEQ ID NO: 635392 - DNA, 25 bp, Homo sapien
gacagactatgctatagtaacaaat

SEQ ID NO: 635393 - DNA, 25 bp, Homo sapien
aaatacatcccaaatgcttagtgga

SEQ ID NO: 635394 - DNA, 25 bp, Homo sapien
ccaaatgcttagtggatttacacaa

SEQ ID NO: 635395 - DNA, 25 bp, Homo sapien
gatatttttcaggtaacgaagcatg

SEQ ID NO: 635396 - DNA, 25 bp, Homo sapien
ggtaacgaagcatgtaaacttacat

SEQ ID NO: 635397 - DNA, 25 bp, Homo sapien
catgtcaagcccagcagaagagata

SEQ ID NO: 635398 - DNA, 25 bp, Homo sapien
aacagtctattttgggctttggctc

SEQ ID NO: 635399 - DNA, 25 bp, Homo sapien
tctattttgggctttggctcctacc

SEQ ID NO: 635400 - DNA, 25 bp, Homo sapien
ggctcctacctaaatctagcttgtt

SEQ ID NO: 635401 - DNA, 25 bp, Homo sapien
gataaaggtattagactggtctgta

SEQ ID NO: 635402 - DNA, 25 bp, Homo sapien
actggtctgtaaatttcaatgccta

SEQ ID NO: 635403 - DNA, 25 bp, Homo sapien
tgcctaaaaatatccaccaagctgt

SEQ ID NO: 635404 - DNA, 25 bp, Homo sapien
accaagctgtagatcttcccaagat

SEQ ID NO: 635405 - DNA, 25 bp, Homo sapien
gatcttcccaagatatttttcaggt

SEQ ID NO: 635406 - DNA, 25 bp, Homo sapien
gagtagggccatttttaatttcctg

SEQ ID NO: 635407 - DNA, 25 bp, Homo sapien
cttttccaccagtgcgagagaggga

SEQ ID NO: 635408 - DNA, 25 bp, Homo sapien
tacttttcagggtgttgcctatttt

SEQ ID NO: 635409 - DNA, 25 bp, Homo sapien
tttcagggtgttgcctattttcccg

SEQ ID NO: 635410 - DNA, 25 bp, Homo sapien
tcagggtgttgcctattttcccgtt

SEQ ID NO: 635411 - DNA, 25 bp, Homo sapien
gtgttgcctattttcccgtttgcag

SEQ ID NO: 635412 - DNA, 25 bp, Homo sapien
ggctaaatttgggttgattatggcc

SEQ ID NO: 635413 - DNA, 25 bp, Homo sapien
taaatttgggttgattatggccctg

SEQ ID NO: 635414 - DNA, 25 bp, Homo sapien
gggctctacagcagtcgtgatgaaa

SEQ ID NO: 635415 - DNA, 25 bp, Homo sapien
aaatatatatcctttgtcctcgaga

SEQ ID NO: 635416 - DNA, 25 bp, Homo sapien
atatcctttgtcctcgagattttag

SEQ ID NO: 635417 - DNA, 25 bp, Homo sapien
tacttttcagggtgttgcctatttt

SEQ ID NO: 635418 - DNA, 25 bp, Homo sapien
tttcagggtgttgcctattttcccg

SEQ ID NO: 635419 - DNA, 25 bp, Homo sapien
ttcagggtgttgcctattttcccgt

SEQ ID NO: 635420 - DNA, 25 bp, Homo sapien
tcagggtgttgcctattttcccgtt

SEQ ID NO: 635421 - DNA, 25 bp, Homo sapien
ggtgttgcctattttcccgtttgca

SEQ ID NO: 635422 - DNA, 25 bp, Homo sapien
gtgttgcctattttcccgtttgcag

SEQ ID NO: 635423 - DNA, 25 bp, Homo sapien
gggcctggtccaggggctaaatttg

SEQ ID NO: 635424 - DNA, 25 bp, Homo sapien
ggctaaatttgggttgattatggcc

SEQ ID NO: 635425 - DNA, 25 bp, Homo sapien
gctaaatttgggttgattatggccc

SEQ ID NO: 635426 - DNA, 25 bp, Homo sapien
ctaaatttgggttgattatggccct

SEQ ID NO: 635427 - DNA, 25 bp, Homo sapien
taaatttgggttgattatggccctg

SEQ ID NO: 635428 - DNA, 25 bp, Homo sapien
gcttccacataaccacttcctttat

SEQ ID NO: 635429 - DNA, 25 bp, Homo sapien
ataaccacttcctttatgctgggac

SEQ ID NO: 635430 - DNA, 25 bp, Homo sapien
cacttcctttatgctgggactgtgg

SEQ ID NO: 635431 - DNA, 25 bp, Homo sapien
tttatgctgggactgtggtttcttt

SEQ ID NO: 635432 - DNA, 25 bp, Homo sapien
tgtgtttttatgtcttttccatgtc

SEQ ID NO: 635433 - DNA, 25 bp, Homo sapien
ttttatgtcttttccatgtctgggt

SEQ ID NO: 635434 - DNA, 25 bp, Homo sapien
gtcttttccatgtctgggtctgggt

SEQ ID NO: 635435 - DNA, 25 bp, Homo sapien
tttgcctcccctgagagaccgtaaa

SEQ ID NO: 635436 - DNA, 25 bp, Homo sapien
tcccctgagagaccgtaaacttcta

SEQ ID NO: 635437 - DNA, 25 bp, Homo sapien
tgagagaccgtaaacttctaaagaa

SEQ ID NO: 635438 - DNA, 25 bp, Homo sapien
gaacaagaactgtgttgtctccttt

SEQ ID NO: 635439 - DNA, 25 bp, Homo sapien
atccagacaattcaagatgctttga

SEQ ID NO: 635440 - DNA, 25 bp, Homo sapien
tcatagaactgtatgtgaactgctt

SEQ ID NO: 635441 - DNA, 25 bp, Homo sapien
atgtgaactgcttggcaaggaggta

SEQ ID NO: 635442 - DNA, 25 bp, Homo sapien
ttatcactatgaatcctgctggaaa

SEQ ID NO: 635443 - DNA, 25 bp, Homo sapien
gacaaaaactgcctgataatcttaa

SEQ ID NO: 635444 - DNA, 25 bp, Homo sapien
atcttaaacagcttttcaggcccgt

SEQ ID NO: 635445 - DNA, 25 bp, Homo sapien
tttcaggcccgtagctatgtctcat

SEQ ID NO: 635446 - DNA, 25 bp, Homo sapien
atgtctcatccagacaatgagctta

SEQ ID NO: 635447 - DNA, 25 bp, Homo sapien
gagcttattgcagaagttattctct

SEQ ID NO: 635448 - DNA, 25 bp, Homo sapien
gttattctctattcggaaggcttta

SEQ ID NO: 635449 - DNA, 25 bp, Homo sapien
ggtagctattttcaatctatctagg

SEQ ID NO: 635450 - DNA, 25 bp, Homo sapien
taaaatttatttatggggccaggca

SEQ ID NO: 635451 - DNA, 25 bp, Homo sapien
aaatttatttatggggccaggcatg

SEQ ID NO: 635452 - DNA, 25 bp, Homo sapien
aatacaaaaaatgatctggttatga

SEQ ID NO: 635453 - DNA, 25 bp, Homo sapien
tacaaaaaatgatctggttatgatg

SEQ ID NO: 635454 - DNA, 25 bp, Homo sapien
caaaaaatgatctggttatgatggt

SEQ ID NO: 635455 - DNA, 25 bp, Homo sapien
aaaaatgatctggttatgatggtgc

SEQ ID NO: 635456 - DNA, 25 bp, Homo sapien
aaaatgatctggttatgatggtgca

SEQ ID NO: 635457 - DNA, 25 bp, Homo sapien
aaatgatctggttatgatggtgcat

SEQ ID NO: 635458 - DNA, 25 bp, Homo sapien
aatgatctggttatgatggtgcatg

SEQ ID NO: 635459 - DNA, 25 bp, Homo sapien
atgatctggttatgatggtgcatgc

SEQ ID NO: 635460 - DNA, 25 bp, Homo sapien
tgatctggttatgatggtgcatgcc

SEQ ID NO: 635461 - DNA, 25 bp, Homo sapien
gcatgcaccatcataaccagatcat

SEQ ID NO: 635462 - DNA, 25 bp, Homo sapien
catgcaccatcataaccagatcatt

SEQ ID NO: 635463 - DNA, 25 bp, Homo sapien
atgcaccatcataaccagatcattt

SEQ ID NO: 635464 - DNA, 25 bp, Homo sapien
tgcaccatcataaccagatcatttt

SEQ ID NO: 635465 - DNA, 25 bp, Homo sapien
gcaccatcataaccagatcattttt

SEQ ID NO: 635466 - DNA, 25 bp, Homo sapien
caccatcataaccagatcatttttt

SEQ ID NO: 635467 - DNA, 25 bp, Homo sapien
accatcataaccagatcattttttg

SEQ ID NO: 635468 - DNA, 25 bp, Homo sapien
ccatcataaccagatcattttttgt

SEQ ID NO: 635469 - DNA, 25 bp, Homo sapien
atcataaccagatcattttttgtat

SEQ ID NO: 635470 - DNA, 25 bp, Homo sapien
tcataaccagatcattttttgtatt

SEQ ID NO: 635471 - DNA, 25 bp, Homo sapien
atgcctggccccataaataaatttt

SEQ ID NO: 635472 - DNA, 25 bp, Homo sapien
ggaaccagtatatgctaggctggta

SEQ ID NO: 635473 - DNA, 25 bp, Homo sapien
ctaggctggtagttttatgttgagg

SEQ ID NO: 635474 - DNA, 25 bp, Homo sapien
atgttgaggattcacttcacttatc

SEQ ID NO: 635475 - DNA, 25 bp, Homo sapien
tcacttcacttatctatgcattttt

SEQ ID NO: 635476 - DNA, 25 bp, Homo sapien
taatgtttagaatctacttcagatg

SEQ ID NO: 635477 - DNA, 25 bp, Homo sapien
gaatctacttcagatgtactgactc

SEQ ID NO: 635478 - DNA, 25 bp, Homo sapien
gatgtactgactctatttacttgat

SEQ ID NO: 635479 - DNA, 25 bp, Homo sapien
gactctatttacttgataactttga

SEQ ID NO: 635480 - DNA, 25 bp, Homo sapien
gtggcatctaatgtctcaggatttt

SEQ ID NO: 635481 - DNA, 25 bp, Homo sapien
attggatgtaatatagcctctttga

SEQ ID NO: 635482 - DNA, 25 bp, Homo sapien
ggatgtaatatagcctctttgaaaa

SEQ ID NO: 635483 - DNA, 25 bp, Homo sapien
acaggatggatgagacttggcagca

SEQ ID NO: 635484 - DNA, 25 bp, Homo sapien
gagacttggcagcagtatatatgga

SEQ ID NO: 635485 - DNA, 25 bp, Homo sapien
gagggccaactgtgcaattcatctg

SEQ ID NO: 635486 - DNA, 25 bp, Homo sapien
aactgtgcaattcatctgctaagta

SEQ ID NO: 635487 - DNA, 25 bp, Homo sapien
gctaagtaagctaatgccatctcag

SEQ ID NO: 635488 - DNA, 25 bp, Homo sapien
atagaagcagtgtgtccagaggata

SEQ ID NO: 635489 - DNA, 25 bp, Homo sapien
gaaataatggttcccctgcagtttt

SEQ ID NO: 635490 - DNA, 25 bp, Homo sapien
aatggttcccctgcagtttttactg

SEQ ID NO: 635491 - DNA, 25 bp, Homo sapien
gcagtttttactggttagaccacac

SEQ ID NO: 635492 - DNA, 25 bp, Homo sapien
actggttagaccacacctagaggaa

SEQ ID NO: 635493 - DNA, 25 bp, Homo sapien
cctagaggaaggttgtacaggtctg

SEQ ID NO: 635494 - DNA, 25 bp, Homo sapien
aacggagcagtgatgtggttttcaa

SEQ ID NO: 635495 - DNA, 25 bp, Homo sapien
gtgatgtggttttcaaggcagcagt

SEQ ID NO: 635496 - DNA, 25 bp, Homo sapien
agcagtggcagaggtcccatgtaat

SEQ ID NO: 635497 - DNA, 25 bp, Homo sapien
ggtcccatgtaatggtgcaaggtgt

SEQ ID NO: 635498 - DNA, 25 bp, Homo sapien
gaggctttgcttagcagtttttccc

SEQ ID NO: 635499 - DNA, 25 bp, Homo sapien
tgacctccacgcctgtgacttgtga

SEQ ID NO: 635500 - DNA, 25 bp, Homo sapien
gcctgtgacttgtgagccattttat

SEQ ID NO: 635501 - DNA, 25 bp, Homo sapien
aactagctagtgtagatcctgttgt

SEQ ID NO: 635502 - DNA, 25 bp, Homo sapien
gtgtagatcctgttgtttgtaacca

SEQ ID NO: 635503 - DNA, 25 bp, Homo sapien
gagtgttgacatacagccactattt

SEQ ID NO: 635504 - DNA, 25 bp, Homo sapien
gccactatttaattgtaaccactgt

SEQ ID NO: 635505 - DNA, 25 bp, Homo sapien
tgggaaaaccagcacgctctgggac

SEQ ID NO: 635506 - DNA, 25 bp, Homo sapien
ctctgggaccacctctgaagtgatc

SEQ ID NO: 635507 - DNA, 25 bp, Homo sapien
ggaccacctctgaagtgatctcaca

SEQ ID NO: 635508 - DNA, 25 bp, Homo sapien
tgaagtgatctcacaccctgaccac

SEQ ID NO: 635509 - DNA, 25 bp, Homo sapien
tgaccacacactctaaactcactgt

SEQ ID NO: 635510 - DNA, 25 bp, Homo sapien
taaactcactgtcataatccttccc

SEQ ID NO: 635511 - DNA, 25 bp, Homo sapien
aaaaaagtcaatgggtctgagccaa

SEQ ID NO: 635512 - DNA, 25 bp, Homo sapien
tgggtctgagccaagaggatctact

SEQ ID NO: 635513 - DNA, 25 bp, Homo sapien
agtggaggtgtttcagcggatgctg

SEQ ID NO: 635514 - DNA, 25 bp, Homo sapien
cttacccttgtagcctggatgacca

SEQ ID NO: 635515 - DNA, 25 bp, Homo sapien
gtagcctggatgaccagacagatca

SEQ ID NO: 635516 - DNA, 25 bp, Homo sapien
ttatcattgtaatttgccactgaga

SEQ ID NO: 635517 - DNA, 25 bp, Homo sapien
ttgtaatttgccactgagaacccac

SEQ ID NO: 635518 - DNA, 25 bp, Homo sapien
aacagtccaacttcaaattgcttca

SEQ ID NO: 635519 - DNA, 25 bp, Homo sapien
gtccaacttcaaattgcttcagtga

SEQ ID NO: 635520 - DNA, 25 bp, Homo sapien
attgttaatatttcctagcttccag

SEQ ID NO: 635521 - DNA, 25 bp, Homo sapien
atatttcctagcttccagaattgaa

SEQ ID NO: 635522 - DNA, 25 bp, Homo sapien
tagcttccagaattgaatctcatga

SEQ ID NO: 635523 - DNA, 25 bp, Homo sapien
ttggatcaatgtgtgtgggtactgt

SEQ ID NO: 635524 - DNA, 25 bp, Homo sapien
tgggtactgtggtgatccattccct

SEQ ID NO: 635525 - DNA, 25 bp, Homo sapien
tgtggtgatccattccctcctgtgg

SEQ ID NO: 635526 - DNA, 25 bp, Homo sapien
tcattcttttgccttatattgtagt

SEQ ID NO: 635527 - DNA, 25 bp, Homo sapien
ctttaccttgcccttcaccccagag

SEQ ID NO: 635528 - DNA, 25 bp, Homo sapien
tttaccttgcccttcaccccagagc

SEQ ID NO: 635529 - DNA, 25 bp, Homo sapien
tgctggctcaggtgggatacctgga

SEQ ID NO: 635530 - DNA, 25 bp, Homo sapien
gctggctcaggtgggatacctggaa

SEQ ID NO: 635531 - DNA, 25 bp, Homo sapien
ctggctcaggtgggatacctggaag

SEQ ID NO: 635532 - DNA, 25 bp, Homo sapien
tggctcaggtgggatacctggaagt

SEQ ID NO: 635533 - DNA, 25 bp, Homo sapien
ggctcaggtgggatacctggaagtt

SEQ ID NO: 635534 - DNA, 25 bp, Homo sapien
gctcaggtgggatacctggaagttc

SEQ ID NO: 635535 - DNA, 25 bp, Homo sapien
ctcaggtgggatacctggaagttcc

SEQ ID NO: 635536 - DNA, 25 bp, Homo sapien
tcaggtgggatacctggaagttccc

SEQ ID NO: 635537 - DNA, 25 bp, Homo sapien
agccaaatccatgtaagcagaaagt

SEQ ID NO: 635538 - DNA, 25 bp, Homo sapien
agatttgtggtttccagagtccagc

SEQ ID NO: 635539 - DNA, 25 bp, Homo sapien
tgtggtttccagagtccagcttgaa

SEQ ID NO: 635540 - DNA, 25 bp, Homo sapien
ggtttccagagtccagcttgaagtg

SEQ ID NO: 635541 - DNA, 25 bp, Homo sapien
ggctgctaataggtattgggcctct

SEQ ID NO: 635542 - DNA, 25 bp, Homo sapien
ctaataggtattgggcctctttttg

SEQ ID NO: 635543 - DNA, 25 bp, Homo sapien
cctctttttggaggagtgatgaaaa

SEQ ID NO: 635544 - DNA, 25 bp, Homo sapien
gatgtttgcacactttgtatgttca

SEQ ID NO: 635545 - DNA, 25 bp, Homo sapien
tgcacactttgtatgttcacagagt

SEQ ID NO: 635546 - DNA, 25 bp, Homo sapien
gttcacagagtactaaaacccattg

SEQ ID NO: 635547 - DNA, 25 bp, Homo sapien
gtactaaaacccattgaactatata

SEQ ID NO: 635548 - DNA, 25 bp, Homo sapien
agggcaggctggaacctgatactat

SEQ ID NO: 635549 - DNA, 25 bp, Homo sapien
ctgatactatcaacccaagggctgc

SEQ ID NO: 635550 - DNA, 25 bp, Homo sapien
ggctgctaaagcaatcaggttcaac

SEQ ID NO: 635551 - DNA, 25 bp, Homo sapien
ggttcaacaacaaccatatatgttc

SEQ ID NO: 635552 - DNA, 25 bp, Homo sapien
tatatgttccctaatgtcgctttgc

SEQ ID NO: 635553 - DNA, 25 bp, Homo sapien
tccctaatgtcgctttgccacaaag

SEQ ID NO: 635554 - DNA, 25 bp, Homo sapien
ggcaaaagcaagctatttctagtaa

SEQ ID NO: 635555 - DNA, 25 bp, Homo sapien
attaattcaatggtctaaacgtgca

SEQ ID NO: 635556 - DNA, 25 bp, Homo sapien
acaatagaagtgaactttccctgaa

SEQ ID NO: 635557 - DNA, 25 bp, Homo sapien
aagccctgggtccacgttgacctag

SEQ ID NO: 635558 - DNA, 25 bp, Homo sapien
tccacgttgacctagcagggcaggc

SEQ ID NO: 635559 - DNA, 25 bp, Homo sapien
ggaggctgttttccctaagcagttc

SEQ ID NO: 635560 - DNA, 25 bp, Homo sapien
cttgactttccctttagctgaggat

SEQ ID NO: 635561 - DNA, 25 bp, Homo sapien
ttgtatcaactacacagcgccttga

SEQ ID NO: 635562 - DNA, 25 bp, Homo sapien
gtatcaactacacagcgccttgaac

SEQ ID NO: 635563 - DNA, 25 bp, Homo sapien
tacacagcgccttgaaccatacagt

SEQ ID NO: 635564 - DNA, 25 bp, Homo sapien
acagcgccttgaaccatacagttga

SEQ ID NO: 635565 - DNA, 25 bp, Homo sapien
agcgccttgaaccatacagttgagg

SEQ ID NO: 635566 - DNA, 25 bp, Homo sapien
gaaccatacagttgagggaggtacc

SEQ ID NO: 635567 - DNA, 25 bp, Homo sapien
atacagttgagggaggtaccccatt

SEQ ID NO: 635568 - DNA, 25 bp, Homo sapien
agttgagggaggtaccccattgcaa

SEQ ID NO: 635569 - DNA, 25 bp, Homo sapien
gtttgtgctcacactcttatctaca

SEQ ID NO: 635570 - DNA, 25 bp, Homo sapien
gggatactaaagtatgcattctcgg

SEQ ID NO: 635571 - DNA, 25 bp, Homo sapien
ggatactaaagtatgcattctcggc

SEQ ID NO: 635572 - DNA, 25 bp, Homo sapien
gatactaaagtatgcattctcggcc

SEQ ID NO: 635573 - DNA, 25 bp, Homo sapien
atactaaagtatgcattctcggcca

SEQ ID NO: 635574 - DNA, 25 bp, Homo sapien
tactaaagtatgcattctcggccag

SEQ ID NO: 635575 - DNA, 25 bp, Homo sapien
actaaagtatgcattctcggccagg

SEQ ID NO: 635576 - DNA, 25 bp, Homo sapien
ctaaagtatgcattctcggccaggc

SEQ ID NO: 635577 - DNA, 25 bp, Homo sapien
taaagtatgcattctcggccaggcg

SEQ ID NO: 635578 - DNA, 25 bp, Homo sapien
aaagtatgcattctcggccaggcgc

SEQ ID NO: 635579 - DNA, 25 bp, Homo sapien
aagtatgcattctcggccaggcgcg

SEQ ID NO: 635580 - DNA, 25 bp, Homo sapien
caatgtgggtttgacacgaagcctt

SEQ ID NO: 635581 - DNA, 25 bp, Homo sapien
ttgacacgaagcctttgaaagatag

SEQ ID NO: 635582 - DNA, 25 bp, Homo sapien
catatgccaatatatagccacctcc

SEQ ID NO: 635583 - DNA, 25 bp, Homo sapien
atgccaatatatagccacctcccag

SEQ ID NO: 635584 - DNA, 25 bp, Homo sapien
ttcccctttgtaaaccttcagcagg

SEQ ID NO: 635585 - DNA, 25 bp, Homo sapien
aaccttcagcaggtaagcactcctg

SEQ ID NO: 635586 - DNA, 25 bp, Homo sapien
acgtttaagtacaaagatcacgctt

SEQ ID NO: 635587 - DNA, 25 bp, Homo sapien
aaagatcacgctttgttgtgtgtgg

SEQ ID NO: 635588 - DNA, 25 bp, Homo sapien
gtttggaagaattgtgatgtggcat

SEQ ID NO: 635589 - DNA, 25 bp, Homo sapien
aagactgttgttattgaacccatct

SEQ ID NO: 635590 - DNA, 25 bp, Homo sapien
gttgttattgaacccatctctaaat

SEQ ID NO: 635591 - DNA, 25 bp, Homo sapien
aaaccctgcgaataaatattctcat

SEQ ID NO: 635592 - DNA, 25 bp, Homo sapien
ataaatatactgcagtcccaaggtt

SEQ ID NO: 635593 - DNA, 25 bp, Homo sapien
aatatactgcagtcccaaggttcat

SEQ ID NO: 635594 - DNA, 25 bp, Homo sapien
atactgcagtcccaaggttcatccc

SEQ ID NO: 635595 - DNA, 25 bp, Homo sapien
aaggttcatccctcatcagaatcgg

SEQ ID NO: 635596 - DNA, 25 bp, Homo sapien
ggttcatccctcatcagaatcggtc

SEQ ID NO: 635597 - DNA, 25 bp, Homo sapien
tcatccctcatcagaatcggtcttg

SEQ ID NO: 635598 - DNA, 25 bp, Homo sapien
atccctcatcagaatcggtcttgag

SEQ ID NO: 635599 - DNA, 25 bp, Homo sapien
atcagaatcggtcttgagcactctc

SEQ ID NO: 635600 - DNA, 25 bp, Homo sapien
agaatcggtcttgagcactctccag

SEQ ID NO: 635601 - DNA, 25 bp, Homo sapien
atcggtcttgagcactctccagcct

SEQ ID NO: 635602 - DNA, 25 bp, Homo sapien
ttgtggagggcacagcctaatctct

SEQ ID NO: 635603 - DNA, 25 bp, Homo sapien
atcaaggtcagcaccatgcacactt

SEQ ID NO: 635604 - DNA, 25 bp, Homo sapien
atgcacacttagtttcctcatgata

SEQ ID NO: 635605 - DNA, 25 bp, Homo sapien
aagaagtgacttaccaactgctaca

SEQ ID NO: 635606 - DNA, 25 bp, Homo sapien
aactgctacacaaaggatgacactg

SEQ ID NO: 635607 - DNA, 25 bp, Homo sapien
ggatgacactgatgtggtacctcaa

SEQ ID NO: 635608 - DNA, 25 bp, Homo sapien
gtggtacctcaagattttactgtaa

SEQ ID NO: 635609 - DNA, 25 bp, Homo sapien
ctccaaatacatggctgacctatat

SEQ ID NO: 635610 - DNA, 25 bp, Homo sapien
ggctgacctatatagagggcagact

SEQ ID NO: 635611 - DNA, 25 bp, Homo sapien
agggcagacttctctttcacagtaa

SEQ ID NO: 635612 - DNA, 25 bp, Homo sapien
gtaataaagccctttctcagccttt

SEQ ID NO: 635613 - DNA, 25 bp, Homo sapien
tgtcagttcacctggacctcagggg

SEQ ID NO: 635614 - DNA, 25 bp, Homo sapien
agttcacctggacctcaggggctga

SEQ ID NO: 635615 - DNA, 25 bp, Homo sapien
gatactaaagtatgcattctcggcc

SEQ ID NO: 635616 - DNA, 25 bp, Homo sapien
atactaaagtatgcattctcggcca

SEQ ID NO: 635617 - DNA, 25 bp, Homo sapien
tactaaagtatgcattctcggccag

SEQ ID NO: 635618 - DNA, 25 bp, Homo sapien
actaaagtatgcattctcggccagg

SEQ ID NO: 635619 - DNA, 25 bp, Homo sapien
ctaaagtatgcattctcggccaggc

SEQ ID NO: 635620 - DNA, 25 bp, Homo sapien
taaagtatgcattctcggccaggcg

SEQ ID NO: 635621 - DNA, 25 bp, Homo sapien
aaagtatgcattctcggccaggcgc

SEQ ID NO: 635622 - DNA, 25 bp, Homo sapien
aagtatgcattctcggccaggcgcg

SEQ ID NO: 635623 - DNA, 25 bp, Homo sapien
agtatgcattctcggccaggcgcgg

SEQ ID NO: 635624 - DNA, 25 bp, Homo sapien
tccctcaggtaacatttttgttaca

SEQ ID NO: 635625 - DNA, 25 bp, Homo sapien
cctcaggtaacatttttgttacaat

SEQ ID NO: 635626 - DNA, 25 bp, Homo sapien
ctcaggtaacatttttgttacaatg

SEQ ID NO: 635627 - DNA, 25 bp, Homo sapien
caggtaacatttttgttacaatggt

SEQ ID NO: 635628 - DNA, 25 bp, Homo sapien
tcttctgaaaaaattgccttataaa

SEQ ID NO: 635629 - DNA, 25 bp, Homo sapien
gaaatatgaatgtttagtctgaaaa

SEQ ID NO: 635630 - DNA, 25 bp, Homo sapien
tatgaatgtttagtctgaaaatagc

SEQ ID NO: 635631 - DNA, 25 bp, Homo sapien
atgaatgtttagtctgaaaatagca

SEQ ID NO: 635632 - DNA, 25 bp, Homo sapien
gaatgtttagtctgaaaatagcaga

SEQ ID NO: 635633 - DNA, 25 bp, Homo sapien
gtttagtctgaaaatagcagatttt

SEQ ID NO: 635634 - DNA, 25 bp, Homo sapien
ttagtctgaaaatagcagattttta

SEQ ID NO: 635635 - DNA, 25 bp, Homo sapien
gagacacaaagataagaactgcatt

SEQ ID NO: 635636 - DNA, 25 bp, Homo sapien
agataagaactgcattcaacattgc

SEQ ID NO: 635637 - DNA, 25 bp, Homo sapien
gcattcaacattgcagaaactgtga

SEQ ID NO: 635638 - DNA, 25 bp, Homo sapien
caacctaagtttctgtacccactga

SEQ ID NO: 635639 - DNA, 25 bp, Homo sapien
ctgaaaacacccttcaaaagtgaag

SEQ ID NO: 635640 - DNA, 25 bp, Homo sapien
tcaagaaacttgttgccaggagacc

SEQ ID NO: 635641 - DNA, 25 bp, Homo sapien
aagaaacttgttgccaggagacctg

SEQ ID NO: 635642 - DNA, 25 bp, Homo sapien
gaaacttgttgccaggagacctgtc

SEQ ID NO: 635643 - DNA, 25 bp, Homo sapien
aacttgttgccaggagacctgtctt

SEQ ID NO: 635644 - DNA, 25 bp, Homo sapien
acttgttgccaggagacctgtcttg

SEQ ID NO: 635645 - DNA, 25 bp, Homo sapien
cttgttgccaggagacctgtcttgc

SEQ ID NO: 635646 - DNA, 25 bp, Homo sapien
gtctttaaacctttagctgttgctt

SEQ ID NO: 635647 - DNA, 25 bp, Homo sapien
aaacctttagctgttgctttctgga

SEQ ID NO: 635648 - DNA, 25 bp, Homo sapien
tctggacctttgtattgcctaaggg

SEQ ID NO: 635649 - DNA, 25 bp, Homo sapien
gacctttgtattgcctaagggatgc

SEQ ID NO: 635650 - DNA, 25 bp, Homo sapien
tgtattgcctaagggatgcaaactt

SEQ ID NO: 635651 - DNA, 25 bp, Homo sapien
taaagtagacagtaatttcacaatt

SEQ ID NO: 635652 - DNA, 25 bp, Homo sapien
atttcacaattacagtatccactct

SEQ ID NO: 635653 - DNA, 25 bp, Homo sapien
acaattacagtatccactctcatga

SEQ ID NO: 635654 - DNA, 25 bp, Homo sapien
acagtatccactctcatgaaattta

SEQ ID NO: 635655 - DNA, 25 bp, Homo sapien
atccactctcatgaaatttactaac

SEQ ID NO: 635656 - DNA, 25 bp, Homo sapien
aatttactaactacattaatgagca

SEQ ID NO: 635657 - DNA, 25 bp, Homo sapien
gaacaagtcccacaagttactaaag

SEQ ID NO: 635658 - DNA, 25 bp, Homo sapien
gtcccacaagttactaaagttggtg

SEQ ID NO: 635659 - DNA, 25 bp, Homo sapien
aatacatcatgagttcttcttttat

SEQ ID NO: 635660 - DNA, 25 bp, Homo sapien
tcttcttttatgtttacgttgtttg

SEQ ID NO: 635661 - DNA, 25 bp, Homo sapien
tatgtttacgttgtttggatgtttt

SEQ ID NO: 635662 - DNA, 25 bp, Homo sapien
tggatgttttacgtttaggtactat

SEQ ID NO: 635663 - DNA, 25 bp, Homo sapien
tttacgtttaggtactattgccacg

SEQ ID NO: 635664 - DNA, 25 bp, Homo sapien
ttacctttatagaaaccacaatttg

SEQ ID NO: 635665 - DNA, 25 bp, Homo sapien
caatttgaacaagcatggtgaggta

SEQ ID NO: 635666 - DNA, 25 bp, Homo sapien
aagcatggtgaggtaatgattttcc

SEQ ID NO: 635667 - DNA, 25 bp, Homo sapien
gattttcctgaacaagtcccacaag

SEQ ID NO: 635668 - DNA, 25 bp, Homo sapien
caatgtaaggcagtacagtattata

SEQ ID NO: 635669 - DNA, 25 bp, Homo sapien
aatgtaaggcagtacagtattatag

SEQ ID NO: 635670 - DNA, 25 bp, Homo sapien
atgtaaggcagtacagtattatagt

SEQ ID NO: 635671 - DNA, 25 bp, Homo sapien
tgtaaggcagtacagtattatagta

SEQ ID NO: 635672 - DNA, 25 bp, Homo sapien
gtaaggcagtacagtattatagtat

SEQ ID NO: 635673 - DNA, 25 bp, Homo sapien
taaggcagtacagtattatagtata

SEQ ID NO: 635674 - DNA, 25 bp, Homo sapien
aaggcagtacagtattatagtatat

SEQ ID NO: 635675 - DNA, 25 bp, Homo sapien
aggcagtacagtattatagtatata

SEQ ID NO: 635676 - DNA, 25 bp, Homo sapien
ggcagtacagtattatagtatatag

SEQ ID NO: 635677 - DNA, 25 bp, Homo sapien
gcagtacagtattatagtatatagt

SEQ ID NO: 635678 - DNA, 25 bp, Homo sapien
tattatagtatatagtaggctgggt

SEQ ID NO: 635679 - DNA, 25 bp, Homo sapien
gaatagagttgatatccagccagta

SEQ ID NO: 635680 - DNA, 25 bp, Homo sapien
gagttgatatccagccagtatacac

SEQ ID NO: 635681 - DNA, 25 bp, Homo sapien
gatatccagccagtatacactttga

SEQ ID NO: 635682 - DNA, 25 bp, Homo sapien
atccagccagtatacactttgagtg

SEQ ID NO: 635683 - DNA, 25 bp, Homo sapien
acactttgagtgatctcattcacac

SEQ ID NO: 635684 - DNA, 25 bp, Homo sapien
gtgatctcattcacactcagtgtat

SEQ ID NO: 635685 - DNA, 25 bp, Homo sapien
tcacactcagtgtatcttcagctac

SEQ ID NO: 635686 - DNA, 25 bp, Homo sapien
agtgtatcttcagctaccctcatat

SEQ ID NO: 635687 - DNA, 25 bp, Homo sapien
gtatcttcagctaccctcatatgaa

SEQ ID NO: 635688 - DNA, 25 bp, Homo sapien
agctaccctcatatgaagtcacaga

SEQ ID NO: 635689 - DNA, 25 bp, Homo sapien
tatgaagtcacagactcacacctgt

SEQ ID NO: 635690 - DNA, 25 bp, Homo sapien
atctctgtatcggtattgtgcacag

SEQ ID NO: 635691 - DNA, 25 bp, Homo sapien
gtattgtgcacagctgaattgttac

SEQ ID NO: 635692 - DNA, 25 bp, Homo sapien
gaattgttacctacttgtgtgtgcc

SEQ ID NO: 635693 - DNA, 25 bp, Homo sapien
acttgtgtgtgccttgattttccag

SEQ ID NO: 635694 - DNA, 25 bp, Homo sapien
aggtctcctatcactgtatcattgt

SEQ ID NO: 635695 - DNA, 25 bp, Homo sapien
gcattgtactttcttgctctacatg

SEQ ID NO: 635696 - DNA, 25 bp, Homo sapien
gctctacatgactatcatacgtgtt

SEQ ID NO: 635697 - DNA, 25 bp, Homo sapien
tatggattgaactgtctccactccc

SEQ ID NO: 635698 - DNA, 25 bp, Homo sapien
aaattcatatgcctcaatcctcagt

SEQ ID NO: 635699 - DNA, 25 bp, Homo sapien
ctcagtacctcaccatgtgacctta

SEQ ID NO: 635700 - DNA, 25 bp, Homo sapien
gttttttcaccttacttggagagag

SEQ ID NO: 635701 - DNA, 25 bp, Homo sapien
attttaatgacgatgctgttttgag

SEQ ID NO: 635702 - DNA, 25 bp, Homo sapien
gagatagtgtttttatagtaactgt

SEQ ID NO: 635703 - DNA, 25 bp, Homo sapien
gatttttcaaaatagtgtgtacctt

SEQ ID NO: 635704 - DNA, 25 bp, Homo sapien
gtgtgtacctttataaacataattt

SEQ ID NO: 635705 - DNA, 25 bp, Homo sapien
gtatttacagtcacatatatggcct

SEQ ID NO: 635706 - DNA, 25 bp, Homo sapien
tacagtcacatatatggcctagaat

SEQ ID NO: 635707 - DNA, 25 bp, Homo sapien
atggcctagaatttcctatcagttt

SEQ ID NO: 635708 - DNA, 25 bp, Homo sapien
tagaatttcctatcagtttgcaaaa

SEQ ID NO: 635709 - DNA, 25 bp, Homo sapien
gaaaatacatgataggcagcaaaag

SEQ ID NO: 635710 - DNA, 25 bp, Homo sapien
gttgaggcaggatacttgtttgttc

SEQ ID NO: 635711 - DNA, 25 bp, Homo sapien
ggatacttgtttgttcaggagaatt

SEQ ID NO: 635712 - DNA, 25 bp, Homo sapien
gacagatgattagaaaaagtcactg

SEQ ID NO: 635713 - DNA, 25 bp, Homo sapien
acagatgattagaaaaagtcactgg

SEQ ID NO: 635714 - DNA, 25 bp, Homo sapien
gatgattagaaaaagtcactggagc

SEQ ID NO: 635715 - DNA, 25 bp, Homo sapien
atgattagaaaaagtcactggagcc

SEQ ID NO: 635716 - DNA, 25 bp, Homo sapien
tgattagaaaaagtcactggagcca

SEQ ID NO: 635717 - DNA, 25 bp, Homo sapien
aaagtcactggagccagatgtggtg

SEQ ID NO: 635718 - DNA, 25 bp, Homo sapien
aaggccagagggttgtttgagccca

SEQ ID NO: 635719 - DNA, 25 bp, Homo sapien
ttaaacaatttaggtgggcgtggtg

SEQ ID NO: 635720 - DNA, 25 bp, Homo sapien
atctgtatttttatctactcaggag

SEQ ID NO: 635721 - DNA, 25 bp, Homo sapien
tctgtatttttatctactcaggagg

SEQ ID NO: 635722 - DNA, 25 bp, Homo sapien
ctgtatttttatctactcaggaggc

SEQ ID NO: 635723 - DNA, 25 bp, Homo sapien
ttgacacgaagcctttgaaagatag

SEQ ID NO: 635724 - DNA, 25 bp, Homo sapien
catatgccaatatatagccacctcc

SEQ ID NO: 635725 - DNA, 25 bp, Homo sapien
atgccaatatatagccacctcccag

SEQ ID NO: 635726 - DNA, 25 bp, Homo sapien
cctttgtaaaccttcagcaggtaag

SEQ ID NO: 635727 - DNA, 25 bp, Homo sapien
aaccttcagcaggtaagcactcctg

SEQ ID NO: 635728 - DNA, 25 bp, Homo sapien
acgtttaagtacaaagatcacgctt

SEQ ID NO: 635729 - DNA, 25 bp, Homo sapien
aaagatcacgctttgttgtgtgtgg

SEQ ID NO: 635730 - DNA, 25 bp, Homo sapien
gtttggaagaattgtgatgtggcat

SEQ ID NO: 635731 - DNA, 25 bp, Homo sapien
taaagactgttgttattgaacccat

SEQ ID NO: 635732 - DNA, 25 bp, Homo sapien
gactgttgttattgaacccatctct

SEQ ID NO: 635733 - DNA, 25 bp, Homo sapien
gttgttattgaacccatctctaaat

SEQ ID NO: 635734 - DNA, 25 bp, Homo sapien
aaatcaattgtatcagcatagtcta

SEQ ID NO: 635735 - DNA, 25 bp, Homo sapien
agcatagtctaattgccctttctac

SEQ ID NO: 635736 - DNA, 25 bp, Homo sapien
agtctaattgccctttctactgata

SEQ ID NO: 635737 - DNA, 25 bp, Homo sapien
tttctactgatagatactcctcctc

SEQ ID NO: 635738 - DNA, 25 bp, Homo sapien
agatactcctcctcctgcatcttag

SEQ ID NO: 635739 - DNA, 25 bp, Homo sapien
tagcagcttctaaccccagtgcatt

SEQ ID NO: 635740 - DNA, 25 bp, Homo sapien
taaccccagtgcattctcaaacttg

SEQ ID NO: 635741 - DNA, 25 bp, Homo sapien
accccagtgcattctcaaacttgac

SEQ ID NO: 635742 - DNA, 25 bp, Homo sapien
aaagatgccacaaatataacagaaa

SEQ ID NO: 635743 - DNA, 25 bp, Homo sapien
tagttttgtcatactgctattctat

SEQ ID NO: 635744 - DNA, 25 bp, Homo sapien
atactgctattctatgacaaaataa

SEQ ID NO: 635745 - DNA, 25 bp, Homo sapien
tcaggcatagcagagtcagttttgt

SEQ ID NO: 635746 - DNA, 25 bp, Homo sapien
gaaactgaagctagtattttctaga

SEQ ID NO: 635747 - DNA, 25 bp, Homo sapien
tagggttaagaatgggacagtgaca

SEQ ID NO: 635748 - DNA, 25 bp, Homo sapien
gacagtgacatggatgagccagttt

SEQ ID NO: 635749 - DNA, 25 bp, Homo sapien
aatggtaaattctcacttcttgttt

SEQ ID NO: 635750 - DNA, 25 bp, Homo sapien
cctgttatactcaacattagctttg

SEQ ID NO: 635751 - DNA, 25 bp, Homo sapien
attagctttgaatccctttttcctg

SEQ ID NO: 635752 - DNA, 25 bp, Homo sapien
tttgaatccctttttcctgctttct

SEQ ID NO: 635753 - DNA, 25 bp, Homo sapien
tcctgctttctctaaactgtgctga

SEQ ID NO: 635754 - DNA, 25 bp, Homo sapien
ggcaaacaactccagggacagctga

SEQ ID NO: 635755 - DNA, 25 bp, Homo sapien
gacagctgaatctaagctatgcctt

SEQ ID NO: 635756 - DNA, 25 bp, Homo sapien
agtgtgattcactgagctacatgaa

SEQ ID NO: 635757 - DNA, 25 bp, Homo sapien
gattcactgagctacatgaaagcat

SEQ ID NO: 635758 - DNA, 25 bp, Homo sapien
gaaagcatgagtgactattattcct

SEQ ID NO: 635759 - DNA, 25 bp, Homo sapien
gagtgactattattcctctacccac

SEQ ID NO: 635760 - DNA, 25 bp, Homo sapien
ctccctgccaacatgtaaattgtgt

SEQ ID NO: 635761 - DNA, 25 bp, Homo sapien
acaatttgtcttttatctacccaca

SEQ ID NO: 635762 - DNA, 25 bp, Homo sapien
tgtcttttatctacccacaacttta

SEQ ID NO: 635763 - DNA, 25 bp, Homo sapien
gagaaaggcacagacatgtttgctt

SEQ ID NO: 635764 - DNA, 25 bp, Homo sapien
ggcacagacatgtttgcttggtgta

SEQ ID NO: 635765 - DNA, 25 bp, Homo sapien
agacatgtttgcttggtgtacatat

SEQ ID NO: 635766 - DNA, 25 bp, Homo sapien
ggtgtacatatttaaccttggcaaa

SEQ ID NO: 635767 - DNA, 25 bp, Homo sapien
ctctgtgactgcttggacgtcatga

SEQ ID NO: 635768 - DNA, 25 bp, Homo sapien
gacgtcatgattagtgagctgtgtt

SEQ ID NO: 635769 - DNA, 25 bp, Homo sapien
gaacacattgtgtttgaaacgcaca

SEQ ID NO: 635770 - DNA, 25 bp, Homo sapien
gaaacgcacaggcttagctgggcca

SEQ ID NO: 635771 - DNA, 25 bp, Homo sapien
agctgggccagattggaatgcttca

SEQ ID NO: 635772 - DNA, 25 bp, Homo sapien
gaatgcttcagattcatgcttcctg

SEQ ID NO: 635773 - DNA, 25 bp, Homo sapien
tgtccttcctgaaaactggcagtgt

SEQ ID NO: 635774 - DNA, 25 bp, Homo sapien
aactggcagtgtgtttggcttaaag

SEQ ID NO: 635775 - DNA, 25 bp, Homo sapien
ggcttaaagtatgcttgttgacaga

SEQ ID NO: 635776 - DNA, 25 bp, Homo sapien
gaagtgtcctttgtctatctaaacc

SEQ ID NO: 635777 - DNA, 25 bp, Homo sapien
agctgttgagctttggttttgttct

SEQ ID NO: 635778 - DNA, 25 bp, Homo sapien
ggatacaaatgccattcctgggtaa

SEQ ID NO: 635779 - DNA, 25 bp, Homo sapien
aatgccattcctgggtaactaaaat

SEQ ID NO: 635780 - DNA, 25 bp, Homo sapien
actaaaatggtctttgctacaatta

SEQ ID NO: 635781 - DNA, 25 bp, Homo sapien
ggtctttgctacaattattattcca

SEQ ID NO: 635782 - DNA, 25 bp, Homo sapien
atgtgtgagtaccttgtgcatgctt

SEQ ID NO: 635783 - DNA, 25 bp, Homo sapien
gtaccttgtgcatgcttggacatta

SEQ ID NO: 635784 - DNA, 25 bp, Homo sapien
ggacattatcagcaaagccatggga

SEQ ID NO: 635785 - DNA, 25 bp, Homo sapien
aagccatgggatttgattctaatgt

SEQ ID NO: 635786 - DNA, 25 bp, Homo sapien
gtttattttaattcagctggttcac

SEQ ID NO: 635787 - DNA, 25 bp, Homo sapien
aattcagctggttcacattatataa

SEQ ID NO: 635788 - DNA, 25 bp, Homo sapien
gttaagactactgtgatttcctgaa

SEQ ID NO: 635789 - DNA, 25 bp, Homo sapien
atgtacttaggtaatatgattctta

SEQ ID NO: 635790 - DNA, 25 bp, Homo sapien
gaaatgttcattgaggtcaaaaggt

SEQ ID NO: 635791 - DNA, 25 bp, Homo sapien
agcatcatccagctattctgactgc

SEQ ID NO: 635792 - DNA, 25 bp, Homo sapien
agctattctgactgcattatcaaca

SEQ ID NO: 635793 - DNA, 25 bp, Homo sapien
gactgcattatcaacacttctttct

SEQ ID NO: 635794 - DNA, 25 bp, Homo sapien
atcaacacttctttctgtggtaaag

SEQ ID NO: 635795 - DNA, 25 bp, Homo sapien
cttctttctgtggtaaaggtactgt

SEQ ID NO: 635796 - DNA, 25 bp, Homo sapien
gtttaagagtaattcatggcagtgt

SEQ ID NO: 635797 - DNA, 25 bp, Homo sapien
cagtgtgataatgccagccaattca

SEQ ID NO: 635798 - DNA, 25 bp, Homo sapien
taatgccagccaattcacagaagag

SEQ ID NO: 635799 - DNA, 25 bp, Homo sapien
tagtaataagaatgtgggccaggca

SEQ ID NO: 635800 - DNA, 25 bp, Homo sapien
ttctgcagaaatcaacaggctgatc

SEQ ID NO: 635801 - DNA, 25 bp, Homo sapien
caggctgatcctaaaacgtacatgg

SEQ ID NO: 635802 - DNA, 25 bp, Homo sapien
atgcaaaggacctaggatagtcaaa

SEQ ID NO: 635803 - DNA, 25 bp, Homo sapien
ggatagtcaaaacccaacattattt

SEQ ID NO: 635804 - DNA, 25 bp, Homo sapien
ggagactgtacactacccaatttca

SEQ ID NO: 635805 - DNA, 25 bp, Homo sapien
ctgtacactacccaatttcaaaact

SEQ ID NO: 635806 - DNA, 25 bp, Homo sapien
gttacaagtaaccacaatagcaaca

SEQ ID NO: 635807 - DNA, 25 bp, Homo sapien
atagcaacagacacataaatcaatg

SEQ ID NO: 635808 - DNA, 25 bp, Homo sapien
gaaagccgagaaataaaccactaca

SEQ ID NO: 635809 - DNA, 25 bp, Homo sapien
accactacatttatgaccagttgat

SEQ ID NO: 635810 - DNA, 25 bp, Homo sapien
ccagttgattctgccaagggaattc

SEQ ID NO: 635811 - DNA, 25 bp, Homo sapien
gatagttatttgaactggtaccaac

SEQ ID NO: 635812 - DNA, 25 bp, Homo sapien
gtaccaacagattccaggacagcca

SEQ ID NO: 635813 - DNA, 25 bp, Homo sapien
tccaatctagtttctgggatcccac

SEQ ID NO: 635814 - DNA, 25 bp, Homo sapien
gatcccacccaggtttagtggcagt

SEQ ID NO: 635815 - DNA, 25 bp, Homo sapien
accctcaacatccatcctgtggaga

SEQ ID NO: 635816 - DNA, 25 bp, Homo sapien
ggtggatgctgcaacctatcactgt

SEQ ID NO: 635817 - DNA, 25 bp, Homo sapien
gcaacctatcactgtcagcaaagta

SEQ ID NO: 635818 - DNA, 25 bp, Homo sapien
agtctccagcttctttggctgtgtc

SEQ ID NO: 635819 - DNA, 25 bp, Homo sapien
aagtactgaggatccgtggacgttc

SEQ ID NO: 635820 - DNA, 25 bp, Homo sapien
tgtctctagggcagagggccaccat

SEQ ID NO: 635821 - DNA, 25 bp, Homo sapien
gcaaggccagccaaagtgttgatta

SEQ ID NO: 635822 - DNA, 25 bp, Homo sapien
aatggatgtgtctacgcggcccagt

SEQ ID NO: 635823 - DNA, 25 bp, Homo sapien
ctacgcggcccagtctgtgagcgtg

SEQ ID NO: 635824 - DNA, 25 bp, Homo sapien
tgagagcaccctgtgctgggatggc

SEQ ID NO: 635825 - DNA, 25 bp, Homo sapien
atggcgtccagttcagggctggttc

SEQ ID NO: 635826 - DNA, 25 bp, Homo sapien
agggctggttcccaacttggactct

SEQ ID NO: 635827 - DNA, 25 bp, Homo sapien
gttcccaacttggactctgaattgc

SEQ ID NO: 635828 - DNA, 25 bp, Homo sapien
tctgaattgccaagaaaggctccag

SEQ ID NO: 635829 - DNA, 25 bp, Homo sapien
cagccattgagaccctgaactggaa

SEQ ID NO: 635830 - DNA, 25 bp, Homo sapien
cattgagaccctgaactggaagagg

SEQ ID NO: 635831 - DNA, 25 bp, Homo sapien
agagggaggcaaataattatctttt

SEQ ID NO: 635832 - DNA, 25 bp, Homo sapien
tttcttaaatgtatacacagctcac

SEQ ID NO: 635833 - DNA, 25 bp, Homo sapien
aacagtttgattactaccttccatg

SEQ ID NO: 635834 - DNA, 25 bp, Homo sapien
gattactaccttccatggttctgga

SEQ ID NO: 635835 - DNA, 25 bp, Homo sapien
ctaccttccatggttctggaaaatt

SEQ ID NO: 635836 - DNA, 25 bp, Homo sapien
aacctttttcaatcacgtatcacat

SEQ ID NO: 635837 - DNA, 25 bp, Homo sapien
tgagctttacatcattcttagtttt

SEQ ID NO: 635838 - DNA, 25 bp, Homo sapien
ttcaatcacgtatcacataccctta

SEQ ID NO: 635839 - DNA, 25 bp, Homo sapien
gccttttgtgagttgggaaattatg

SEQ ID NO: 635840 - DNA, 25 bp, Homo sapien
ttatgtcaaaactcagtggactgaa

SEQ ID NO: 635841 - DNA, 25 bp, Homo sapien
gtatcacatacccttattcaaatat

SEQ ID NO: 635842 - DNA, 25 bp, Homo sapien
ttcaaagtcccaataaatttgtatt

SEQ ID NO: 635843 - DNA, 25 bp, Homo sapien
atttgtattgtcttctgtttaacag

SEQ ID NO: 635844 - DNA, 25 bp, Homo sapien
aaacactcacagagcagaagggtca

SEQ ID NO: 635845 - DNA, 25 bp, Homo sapien
gaagggtcagcaggactccaagcca

SEQ ID NO: 635846 - DNA, 25 bp, Homo sapien
agcaggactccaagccacatcgtgg

SEQ ID NO: 635847 - DNA, 25 bp, Homo sapien
gaagactgcaggcacagttagttct

SEQ ID NO: 635848 - DNA, 25 bp, Homo sapien
agttagttctgccttcgggccatga

SEQ ID NO: 635849 - DNA, 25 bp, Homo sapien
cgggccatgactcgctcagcagaag

SEQ ID NO: 635850 - DNA, 25 bp, Homo sapien
agcagaaggcactgcccacaagtca

SEQ ID NO: 635851 - DNA, 25 bp, Homo sapien
actgcccacaagtcaccgttgagaa

SEQ ID NO: 635852 - DNA, 25 bp, Homo sapien
cacaagtcaccgttgagaaacccgc

SEQ ID NO: 635853 - DNA, 25 bp, Homo sapien
gaaacccgccctgtgaaaagcagaa

SEQ ID NO: 635854 - DNA, 25 bp, Homo sapien
gtaatggcagccatggctggaaacc

SEQ ID NO: 635855 - DNA, 25 bp, Homo sapien
gcagtgatgagagcaatgcacatgt

SEQ ID NO: 635856 - DNA, 25 bp, Homo sapien
atgcacatgtactgccccattaaga

SEQ ID NO: 635857 - DNA, 25 bp, Homo sapien
actgccccattaagagagagacccc

SEQ ID NO: 635858 - DNA, 25 bp, Homo sapien
tcctccttagcacatctcaggtagg

SEQ ID NO: 635859 - DNA, 25 bp, Homo sapien
gcacatctcaggtaggagagacctt

SEQ ID NO: 635860 - DNA, 25 bp, Homo sapien
gaaacaggactgatccgggctaaca

SEQ ID NO: 635861 - DNA, 25 bp, Homo sapien
atccgggctaacatcatgggcttta

SEQ ID NO: 635862 - DNA, 25 bp, Homo sapien
catgggctttaaatttaacagacct

SEQ ID NO: 635863 - DNA, 25 bp, Homo sapien
gagaatgaaacccaggtctcatcca

SEQ ID NO: 635864 - DNA, 25 bp, Homo sapien
ataggccagccctcctttgagcgga

SEQ ID NO: 635865 - DNA, 25 bp, Homo sapien
ctttgagcggagagctaaggaccaa

SEQ ID NO: 635866 - DNA, 25 bp, Homo sapien
cgaaacctagcaaaaaatctgaaag

SEQ ID NO: 635867 - DNA, 25 bp, Homo sapien
gaaagatttaacgtgcatgtacatt

SEQ ID NO: 635868 - DNA, 25 bp, Homo sapien
gatttaacgtgcatgtacatttcat

SEQ ID NO: 635869 - DNA, 25 bp, Homo sapien
attcatgtttttactctctttacca

SEQ ID NO: 635870 - DNA, 25 bp, Homo sapien
gagaaaacaaattggcatcagtcaa

SEQ ID NO: 635871 - DNA, 25 bp, Homo sapien
agtcaatattattacctcccagtgg

SEQ ID NO: 635872 - DNA, 25 bp, Homo sapien
aatattattacctcccagtggctac

SEQ ID NO: 635873 - DNA, 25 bp, Homo sapien
attattacctcccagtggctactgt

SEQ ID NO: 635874 - DNA, 25 bp, Homo sapien
tcccagtggctactgtcagagttga

SEQ ID NO: 635875 - DNA, 25 bp, Homo sapien
gtggctactgtcagagttgagaagt

SEQ ID NO: 635876 - DNA, 25 bp, Homo sapien
gagaagtagaaaacgaaacctagca

SEQ ID NO: 635877 - DNA, 25 bp, Homo sapien
gtgtttgtgtatctaagtcactaca

SEQ ID NO: 635878 - DNA, 25 bp, Homo sapien
gtgtatctaagtcactacaaatata

SEQ ID NO: 635879 - DNA, 25 bp, Homo sapien
catagaattgggaactttgtcggtt

SEQ ID NO: 635880 - DNA, 25 bp, Homo sapien
taggaggacattcttttaaaatagc

SEQ ID NO: 635881 - DNA, 25 bp, Homo sapien
atagccttgccgaaaacctgaaaag

SEQ ID NO: 635882 - DNA, 25 bp, Homo sapien
aacctgaaaaggactctagcattca

SEQ ID NO: 635883 - DNA, 25 bp, Homo sapien
aaggactctagcattcaataaacag

SEQ ID NO: 635884 - DNA, 25 bp, Homo sapien
ataaacagtacatttctccctcatt

SEQ ID NO: 635885 - DNA, 25 bp, Homo sapien
aacagtacatttctccctcattggg

SEQ ID NO: 635886 - DNA, 25 bp, Homo sapien
aagaagtagctttaaaccacctatg

SEQ ID NO: 635887 - DNA, 25 bp, Homo sapien
aaaccacctatgtttgattaggaat

SEQ ID NO: 635888 - DNA, 25 bp, Homo sapien
caatgtaaggcagtacagtattata

SEQ ID NO: 635889 - DNA, 25 bp, Homo sapien
aatgtaaggcagtacagtattatag

SEQ ID NO: 635890 - DNA, 25 bp, Homo sapien
atgtaaggcagtacagtattatagt

SEQ ID NO: 635891 - DNA, 25 bp, Homo sapien
gtaaggcagtacagtattatagtat

SEQ ID NO: 635892 - DNA, 25 bp, Homo sapien
taaggcagtacagtattatagtata

SEQ ID NO: 635893 - DNA, 25 bp, Homo sapien
aaggcagtacagtattatagtatat

SEQ ID NO: 635894 - DNA, 25 bp, Homo sapien
aggcagtacagtattatagtatata

SEQ ID NO: 635895 - DNA, 25 bp, Homo sapien
ggcagtacagtattatagtatatag

SEQ ID NO: 635896 - DNA, 25 bp, Homo sapien
gcagtacagtattatagtatatagt

SEQ ID NO: 635897 - DNA, 25 bp, Homo sapien
tattatagtatatagtaggctgggt

SEQ ID NO: 635898 - DNA, 25 bp, Homo sapien
tatagtatatagtaggctgggtgca

SEQ ID NO: 635899 - DNA, 25 bp, Homo sapien
ggctatgtatatttaaggtgcagaa

SEQ ID NO: 635900 - DNA, 25 bp, Homo sapien
atatcttttctattttgagctttga

SEQ ID NO: 635901 - DNA, 25 bp, Homo sapien
agtactatttccaacctgaagcctc

SEQ ID NO: 635902 - DNA, 25 bp, Homo sapien
ttctgtcctagacttatggcgtcct

SEQ ID NO: 635903 - DNA, 25 bp, Homo sapien
tagacttatggcgtcctctagtggc

SEQ ID NO: 635904 - DNA, 25 bp, Homo sapien
atggcgtcctctagtggccactatg

SEQ ID NO: 635905 - DNA, 25 bp, Homo sapien
gccactatgggcagctatgatcctg

SEQ ID NO: 635906 - DNA, 25 bp, Homo sapien
tgggcagctatgatcctgttacctt

SEQ ID NO: 635907 - DNA, 25 bp, Homo sapien
gatcctgttaccttccccagcagtt

SEQ ID NO: 635908 - DNA, 25 bp, Homo sapien
ccactgctctggcttgggtcaagcc

SEQ ID NO: 635909 - DNA, 25 bp, Homo sapien
ctggcttgggtcaagccaggcctgc

SEQ ID NO: 635910 - DNA, 25 bp, Homo sapien
ataggcccaagttatttctctgtct

SEQ ID NO: 635911 - DNA, 25 bp, Homo sapien
ttgccttctttgaaatcttgttaat

SEQ ID NO: 635912 - DNA, 25 bp, Homo sapien
tcttgttaatttcacccttacgttg

SEQ ID NO: 635913 - DNA, 25 bp, Homo sapien
acccttacgttgatccagcttgtgg

SEQ ID NO: 635914 - DNA, 25 bp, Homo sapien
aatggctgctggagtatcctgtatc

SEQ ID NO: 635915 - DNA, 25 bp, Homo sapien
atcctgtatcacatgctttctgctt

SEQ ID NO: 635916 - DNA, 25 bp, Homo sapien
aacaaagattctgggcttccctttg

SEQ ID NO: 635917 - DNA, 25 bp, Homo sapien
ttccctttgatgctgtcacttctac

SEQ ID NO: 635918 - DNA, 25 bp, Homo sapien
gtaggacgagcttcaggcaaggctt

SEQ ID NO: 635919 - DNA, 25 bp, Homo sapien
aaggcttggtgcagcagctcagtga

SEQ ID NO: 635920 - DNA, 25 bp, Homo sapien
gctcagtgatgtaaccataggccca

SEQ ID NO: 635921 - DNA, 25 bp, Homo sapien
gtgataatgaattgcctaactacgc

SEQ ID NO: 635922 - DNA, 25 bp, Homo sapien
tgaattgcctaactacgcagcctgc

SEQ ID NO: 635923 - DNA, 25 bp, Homo sapien
cttcttctcttctagcatgtatttg

SEQ ID NO: 635924 - DNA, 25 bp, Homo sapien
ttctcttctagcatgtatttgatta

SEQ ID NO: 635925 - DNA, 25 bp, Homo sapien
gggcctgctgaaaccaattaagtaa

SEQ ID NO: 635926 - DNA, 25 bp, Homo sapien
tatgactttatgaactacctactac

SEQ ID NO: 635927 - DNA, 25 bp, Homo sapien
gaactacctactacatgcatggctt

SEQ ID NO: 635928 - DNA, 25 bp, Homo sapien
tactacatgcatggcttaacacagg

SEQ ID NO: 635929 - DNA, 25 bp, Homo sapien
gaaaaagcacaacttatagtccagc

SEQ ID NO: 635930 - DNA, 25 bp, Homo sapien
atagtccagctatagagacagactt

SEQ ID NO: 635931 - DNA, 25 bp, Homo sapien
aagtgatagctgactaatcaaagat

SEQ ID NO: 635932 - DNA, 25 bp, Homo sapien
tgcaaccagagctcagcaaaccggg

SEQ ID NO: 635933 - DNA, 25 bp, Homo sapien
gcaaaccgggaccagagggcacatc

SEQ ID NO: 635934 - DNA, 25 bp, Homo sapien
ctgcctgcccatgtcaacagagttg

SEQ ID NO: 635935 - DNA, 25 bp, Homo sapien
acagctctgtccctggaagcatatg

SEQ ID NO: 635936 - DNA, 25 bp, Homo sapien
tctgtccctggaagcatatgctgca

SEQ ID NO: 635937 - DNA, 25 bp, Homo sapien
ggaagcatatgctgcagacacttgc

SEQ ID NO: 635938 - DNA, 25 bp, Homo sapien
cagacacttgctctgctgcagattt

SEQ ID NO: 635939 - DNA, 25 bp, Homo sapien
gtttggtacctgaatgaggcctctt

SEQ ID NO: 635940 - DNA, 25 bp, Homo sapien
gaatgaggcctcttttgacctctat

SEQ ID NO: 635941 - DNA, 25 bp, Homo sapien
gacctctattcctatcactattttt

SEQ ID NO: 635942 - DNA, 25 bp, Homo sapien
atcactatttttggtgacctcaata

SEQ ID NO: 635943 - DNA, 25 bp, Homo sapien
aatcttgagtctgacttttcctggc

SEQ ID NO: 635944 - DNA, 25 bp, Homo sapien
cttgagtctgacttttcctggccag

SEQ ID NO: 635945 - DNA, 25 bp, Homo sapien
tcctggccagaattaagcttgtact

SEQ ID NO: 635946 - DNA, 25 bp, Homo sapien
aagcttgtacttatccctgaaaaat

SEQ ID NO: 635947 - DNA, 25 bp, Homo sapien
tgaaaaatcatcaatgctacagtga

SEQ ID NO: 635948 - DNA, 25 bp, Homo sapien
gaatttaccaattgaggcagaattt

SEQ ID NO: 635949 - DNA, 25 bp, Homo sapien
gaggcagaatttaggtcacatgacg

SEQ ID NO: 635950 - DNA, 25 bp, Homo sapien
taggtcacatgacgctccaaagcct

SEQ ID NO: 635951 - DNA, 25 bp, Homo sapien
aaagcctcttcaaaaccgcatgact

SEQ ID NO: 635952 - DNA, 25 bp, Homo sapien
gtgaggcagaagtatttgggatatt

SEQ ID NO: 635953 - DNA, 25 bp, Homo sapien
gagagtgccaaaacaacttatgtca

SEQ ID NO: 635954 - DNA, 25 bp, Homo sapien
tatagtttcatatgtcttaaggacc

SEQ ID NO: 635955 - DNA, 25 bp, Homo sapien
tcatatgtcttaaggaccattaaaa

SEQ ID NO: 635956 - DNA, 25 bp, Homo sapien
ttattcatattttgcttatttctca

SEQ ID NO: 635957 - DNA, 25 bp, Homo sapien
aagttcttcaagtattagggataat

SEQ ID NO: 635958 - DNA, 25 bp, Homo sapien
gtcattatctgtgaagtgttttgca

SEQ ID NO: 635959 - DNA, 25 bp, Homo sapien
ttgcatatatttgctcagcttgttt

SEQ ID NO: 635960 - DNA, 25 bp, Homo sapien
tatttgctcagcttgttttttgact

SEQ ID NO: 635961 - DNA, 25 bp, Homo sapien
tgctcagcttgttttttgactttgc

SEQ ID NO: 635962 - DNA, 25 bp, Homo sapien
ctcagcttgttttttgactttgctt

SEQ ID NO: 635963 - DNA, 25 bp, Homo sapien
ctgcgcacagcccatttatattaaa

SEQ ID NO: 635964 - DNA, 25 bp, Homo sapien
gcgcacagcccatttatattaaagt

SEQ ID NO: 635965 - DNA, 25 bp, Homo sapien
cttgccagagatgataaggagctca

SEQ ID NO: 635966 - DNA, 25 bp, Homo sapien
gatgataaggagctcaatcttgaat

SEQ ID NO: 635967 - DNA, 25 bp, Homo sapien
aaggagctcaatcttgaatacttgt

SEQ ID NO: 635968 - DNA, 25 bp, Homo sapien
gagctcaatcttgaatacttgttca

SEQ ID NO: 635969 - DNA, 25 bp, Homo sapien
gaatacttgttcaagcttttgaata

SEQ ID NO: 635970 - DNA, 25 bp, Homo sapien
agaagaattgcgaaatcaccggaaa

SEQ ID NO: 635971 - DNA, 25 bp, Homo sapien
agaattgcgaaatcaccggaaataa

SEQ ID NO: 635972 - DNA, 25 bp, Homo sapien
attgcgaaatcaccggaaataaccg

SEQ ID NO: 635973 - DNA, 25 bp, Homo sapien
cccctgtttgactttcaacattctt

SEQ ID NO: 635974 - DNA, 25 bp, Homo sapien
cctgtttgactttcaacattcttga

SEQ ID NO: 635975 - DNA, 25 bp, Homo sapien
gtttgactttcaacattcttgaatg

SEQ ID NO: 635976 - DNA, 25 bp, Homo sapien
gcctcctgaggtttttaatacaaag

SEQ ID NO: 635977 - DNA, 25 bp, Homo sapien
aatacaaagttctcgctgggacatt

SEQ ID NO: 635978 - DNA, 25 bp, Homo sapien
aaagttctcgctgggacatttagtc

SEQ ID NO: 635979 - DNA, 25 bp, Homo sapien
gttctcgctgggacatttagtctgt

SEQ ID NO: 635980 - DNA, 25 bp, Homo sapien
ctcgctgggacatttagtctgtgtt

SEQ ID NO: 635981 - DNA, 25 bp, Homo sapien
gaatgtaacattcaatctgcaaaca

SEQ ID NO: 635982 - DNA, 25 bp, Homo sapien
gtaacattcaatctgcaaacacatg

SEQ ID NO: 635983 - DNA, 25 bp, Homo sapien
tgtgacacaggtttgttggatgttc

SEQ ID NO: 635984 - DNA, 25 bp, Homo sapien
gaatgaactcttactgtctcatact

SEQ ID NO: 635985 - DNA, 25 bp, Homo sapien
gaactcttactgtctcatactaata

SEQ ID NO: 635986 - DNA, 25 bp, Homo sapien
tctcatactaataagacccatcatt

SEQ ID NO: 635987 - DNA, 25 bp, Homo sapien
tgcctgccacacaaatcatgagtaa

SEQ ID NO: 635988 - DNA, 25 bp, Homo sapien
catgagtaactattgcaggtttcac

SEQ ID NO: 635989 - DNA, 25 bp, Homo sapien
tattgcaggtttcacaaatggctgg

SEQ ID NO: 635990 - DNA, 25 bp, Homo sapien
aaatggctggaaatgggagacacaa

SEQ ID NO: 635991 - DNA, 25 bp, Homo sapien
gatgaattagatataggcccagacc

SEQ ID NO: 635992 - DNA, 25 bp, Homo sapien
gaattagatataggcccagacctta

SEQ ID NO: 635993 - DNA, 25 bp, Homo sapien
ggaggaaataaaacatacacacaaa

SEQ ID NO: 635994 - DNA, 25 bp, Homo sapien
ttaataatgcctacctgacaaaggg

SEQ ID NO: 635995 - DNA, 25 bp, Homo sapien
gttcaagttttaatatggtgtccat

SEQ ID NO: 635996 - DNA, 25 bp, Homo sapien
tatggtgtccatattgtaccatgta

SEQ ID NO: 635997 - DNA, 25 bp, Homo sapien
taccccaaatttaggacaaacaatg

SEQ ID NO: 635998 - DNA, 25 bp, Homo sapien
caggcctggcctttgccagcctggg

SEQ ID NO: 635999 - DNA, 25 bp, Homo sapien
gcaacgtggcaagaagataacatgt

SEQ ID NO: 636000 - DNA, 25 bp, Homo sapien
gaagataacatgtagacaagcagtc

SEQ ID NO: 636001 - DNA, 25 bp, Homo sapien
gacaagcagtcaaacatgtattctt

SEQ ID NO: 636002 - DNA, 25 bp, Homo sapien
atatgactgatagaattctctgccc

SEQ ID NO: 636003 - DNA, 25 bp, Homo sapien
gactgatagaattctctgcccactg

SEQ ID NO: 636004 - DNA, 25 bp, Homo sapien
tgcccactgatctaccatcttgttt

SEQ ID NO: 636005 - DNA, 25 bp, Homo sapien
ccactgatctaccatcttgtttttt

SEQ ID NO: 636006 - DNA, 25 bp, Homo sapien
ttttttcacttaactatgtgtctca

SEQ ID NO: 636007 - DNA, 25 bp, Homo sapien
aactatgtgtctcagtggtttttaa

SEQ ID NO: 636008 - DNA, 25 bp, Homo sapien
aaaaatatttatggctgggtgcaat

SEQ ID NO: 636009 - DNA, 25 bp, Homo sapien
attactttaattgaagagggcttct

SEQ ID NO: 636010 - DNA, 25 bp, Homo sapien
gaagagggcttctctaaatatccta

SEQ ID NO: 636011 - DNA, 25 bp, Homo sapien
agagggcttctctaaatatcctacc

SEQ ID NO: 636012 - DNA, 25 bp, Homo sapien
gagggcttctctaaatatcctacct

SEQ ID NO: 636013 - DNA, 25 bp, Homo sapien
agggcttctctaaatatcctacctg

SEQ ID NO: 636014 - DNA, 25 bp, Homo sapien
cactctgtgttcctcttactctgct

SEQ ID NO: 636015 - DNA, 25 bp, Homo sapien
tgtgttcctcttactctgcttatgt

SEQ ID NO: 636016 - DNA, 25 bp, Homo sapien
tgttcctcttactctgcttatgttt

SEQ ID NO: 636017 - DNA, 25 bp, Homo sapien
ttcctcttactctgcttatgtttct

SEQ ID NO: 636018 - DNA, 25 bp, Homo sapien
cctcttactctgcttatgtttcttc

SEQ ID NO: 636019 - DNA, 25 bp, Homo sapien
gtttcttcataacacttattattgt

SEQ ID NO: 636020 - DNA, 25 bp, Homo sapien
aatataagccctcatactgttctcc

SEQ ID NO: 636021 - DNA, 25 bp, Homo sapien
taagccctcatactgttctccacta

SEQ ID NO: 636022 - DNA, 25 bp, Homo sapien
tcatactgttctccactagccttgt

SEQ ID NO: 636023 - DNA, 25 bp, Homo sapien
atactgttctccactagccttgtgc

SEQ ID NO: 636024 - DNA, 25 bp, Homo sapien
tgttctccactagccttgtgctttg

SEQ ID NO: 636025 - DNA, 25 bp, Homo sapien
ccttgtgctttgaggcttggtgtca

SEQ ID NO: 636026 - DNA, 25 bp, Homo sapien
tgtgctttgaggcttggtgtcaccc

SEQ ID NO: 636027 - DNA, 25 bp, Homo sapien
tgctttgaggcttggtgtcaccctg

SEQ ID NO: 636028 - DNA, 25 bp, Homo sapien
agcagctccccgagcttctgttttt

SEQ ID NO: 636029 - DNA, 25 bp, Homo sapien
aaatgcgcatgtacataaatttttt

SEQ ID NO: 636030 - DNA, 25 bp, Homo sapien
taccatttcccaaaagattgaaaat

SEQ ID NO: 636031 - DNA, 25 bp, Homo sapien
gctacctgaggtagccaccaaacct

SEQ ID NO: 636032 - DNA, 25 bp, Homo sapien
tagccaccaaacctacgtgcagaga

SEQ ID NO: 636033 - DNA, 25 bp, Homo sapien
acctacgtgcagagatcagaagaac

SEQ ID NO: 636034 - DNA, 25 bp, Homo sapien
atacagtaaacgtgctgagggccag

SEQ ID NO: 636035 - DNA, 25 bp, Homo sapien
gcagctgttcagagttgctgttctc

SEQ ID NO: 636036 - DNA, 25 bp, Homo sapien
ctgtctgctttggtgttccagaagg

SEQ ID NO: 636037 - DNA, 25 bp, Homo sapien
ctgctttggtgttccagaagggtgt

SEQ ID NO: 636038 - DNA, 25 bp, Homo sapien
gtgtggccccagtattagcttggca

SEQ ID NO: 636039 - DNA, 25 bp, Homo sapien
tggccccagtattagcttggcatgg

SEQ ID NO: 636040 - DNA, 25 bp, Homo sapien
gcaggaagatagtttgagcccatga

SEQ ID NO: 636041 - DNA, 25 bp, Homo sapien
gtgaagtatgatcctgcactccact

SEQ ID NO: 636042 - DNA, 25 bp, Homo sapien
gttggcttcttttgatcacactttc

SEQ ID NO: 636043 - DNA, 25 bp, Homo sapien
ttcttttgatcacactttctgggag

SEQ ID NO: 636044 - DNA, 25 bp, Homo sapien
actttctgggagtgtgtgatgaacg

SEQ ID NO: 636045 - DNA, 25 bp, Homo sapien
acgtgtcgcatcctctatgctggca

SEQ ID NO: 636046 - DNA, 25 bp, Homo sapien
tatgctggcaccctggcacgtgtca

SEQ ID NO: 636047 - DNA, 25 bp, Homo sapien
tggcacgtgtcacaacctctgttta

SEQ ID NO: 636048 - DNA, 25 bp, Homo sapien
gtgtcacaacctctgtttagtctag

SEQ ID NO: 636049 - DNA, 25 bp, Homo sapien
acaacctctgtttagtctagtcaca

SEQ ID NO: 636050 - DNA, 25 bp, Homo sapien
tagtctagtcacaacctaggactgt

SEQ ID NO: 636051 - DNA, 25 bp, Homo sapien
gtcacaacctaggactgtaagccag

SEQ ID NO: 636052 - DNA, 25 bp, Homo sapien
gactgtaagccagtgttggcttctt

SEQ ID NO: 636053 - DNA, 25 bp, Homo sapien
gatcacttaggccaaggaggtcgaa

SEQ ID NO: 636054 - DNA, 25 bp, Homo sapien
acacaacttattaggaatctaggcc

SEQ ID NO: 636055 - DNA, 25 bp, Homo sapien
aatctaggcctagtaatctgaactt

SEQ ID NO: 636056 - DNA, 25 bp, Homo sapien
gtaatctgaacttttagtctcctaa

SEQ ID NO: 636057 - DNA, 25 bp, Homo sapien
tttagtctcctaacaagtgttgaaa

SEQ ID NO: 636058 - DNA, 25 bp, Homo sapien
aaaacactatcaaccatttgggaca

SEQ ID NO: 636059 - DNA, 25 bp, Homo sapien
catttgggacaccaactcttttaga

SEQ ID NO: 636060 - DNA, 25 bp, Homo sapien
aactcttttagactgactacattag

SEQ ID NO: 636061 - DNA, 25 bp, Homo sapien
gactgactacattaggaagactaca

SEQ ID NO: 636062 - DNA, 25 bp, Homo sapien
gactacagagtcttacaaacaaaga

SEQ ID NO: 636063 - DNA, 25 bp, Homo sapien
tacaaacaaagagccacgctgtttt

SEQ ID NO: 636064 - DNA, 25 bp, Homo sapien
gagactttagttttgtacttgcttg

SEQ ID NO: 636065 - DNA, 25 bp, Homo sapien
gtacttgcttgatttctctatccat

SEQ ID NO: 636066 - DNA, 25 bp, Homo sapien
gatttctctatccatcattctagtc

SEQ ID NO: 636067 - DNA, 25 bp, Homo sapien
cattctagtcaaaaccttgcatctg

SEQ ID NO: 636068 - DNA, 25 bp, Homo sapien
aaaaccttgcatctgcttttggtaa

SEQ ID NO: 636069 - DNA, 25 bp, Homo sapien
gcatctgcttttggtaagcactttg

SEQ ID NO: 636070 - DNA, 25 bp, Homo sapien
agcactttgatgattagagcagtaa

SEQ ID NO: 636071 - DNA, 25 bp, Homo sapien
atgcattagaaagcctgcatacagg

SEQ ID NO: 636072 - DNA, 25 bp, Homo sapien
ggaagatccactagaaagctgatgt

SEQ ID NO: 636073 - DNA, 25 bp, Homo sapien
aactataggcaatctgacaggttat

SEQ ID NO: 636074 - DNA, 25 bp, Homo sapien
gacaggttattgtccccagaaagta

SEQ ID NO: 636075 - DNA, 25 bp, Homo sapien
ttctcttctctaacgtcagagaaaa

SEQ ID NO: 636076 - DNA, 25 bp, Homo sapien
tgtcttgctcctgggaagcatgatg

SEQ ID NO: 636077 - DNA, 25 bp, Homo sapien
gcatgatggaaaggcttagcagcta

SEQ ID NO: 636078 - DNA, 25 bp, Homo sapien
gaggtagtaagtcatctctgtcatg

SEQ ID NO: 636079 - DNA, 25 bp, Homo sapien
tttcacaggccattgaaacatgggc

SEQ ID NO: 636080 - DNA, 25 bp, Homo sapien
atgggcaagacccagtgcctagagt

SEQ ID NO: 636081 - DNA, 25 bp, Homo sapien
aagattggtcctaaagacatccacc

SEQ ID NO: 636082 - DNA, 25 bp, Homo sapien
gacatccaccacgtgtattgcgagt

SEQ ID NO: 636083 - DNA, 25 bp, Homo sapien
aattcatgtttgactcaagctttag

SEQ ID NO: 636084 - DNA, 25 bp, Homo sapien
gactcaagctttagagattttgtaa

SEQ ID NO: 636085 - DNA, 25 bp, Homo sapien
gattttgtaattctgtgagcattta

SEQ ID NO: 636086 - DNA, 25 bp, Homo sapien
gtttacacagttacacttttggcta

SEQ ID NO: 636087 - DNA, 25 bp, Homo sapien
gggacttgctaccatgatggacaca

SEQ ID NO: 636088 - DNA, 25 bp, Homo sapien
gatggacacatgttccttggtgagc

SEQ ID NO: 636089 - DNA, 25 bp, Homo sapien
tccttggtgagcaggtctgtgcaaa

SEQ ID NO: 636090 - DNA, 25 bp, Homo sapien
gtctgtgcaaacctaccctccaagg

SEQ ID NO: 636091 - DNA, 25 bp, Homo sapien
accctccaaggccaagggagctgag

SEQ ID NO: 636092 - DNA, 25 bp, Homo sapien
aagggagctgagagcgccagtttct

SEQ ID NO: 636093 - DNA, 25 bp, Homo sapien
gggacttctgaacagaaccatgtct

SEQ ID NO: 636094 - DNA, 25 bp, Homo sapien
aaatgagatggtggtctctacaccc

SEQ ID NO: 636095 - DNA, 25 bp, Homo sapien
gttttgcagacgacaatgcttgtac

SEQ ID NO: 636096 - DNA, 25 bp, Homo sapien
gacaatgcttgtacagaaactattc

SEQ ID NO: 636097 - DNA, 25 bp, Homo sapien
gcaaacttcccaagacttctatttg

SEQ ID NO: 636098 - DNA, 25 bp, Homo sapien
gaaacaggatacagttgtcacactt

SEQ ID NO: 636099 - DNA, 25 bp, Homo sapien
gttgtcacactttgaatctgtggtt

SEQ ID NO: 636100 - DNA, 25 bp, Homo sapien
ctgtggttatttaatctgattctgg

SEQ ID NO: 636101 - DNA, 25 bp, Homo sapien
gattctggagctcacttgagcacaa

SEQ ID NO: 636102 - DNA, 25 bp, Homo sapien
gctcacttgagcacaattagaggaa

SEQ ID NO: 636103 - DNA, 25 bp, Homo sapien
aaacatttcaggctacaacagtcaa

SEQ ID NO: 636104 - DNA, 25 bp, Homo sapien
ggctacaacagtcaaccctatatag

SEQ ID NO: 636105 - DNA, 25 bp, Homo sapien
aaacaatgtctaccatctcaagcct

SEQ ID NO: 636106 - DNA, 25 bp, Homo sapien
gtggctggacaaacttgggcagcta

SEQ ID NO: 636107 - DNA, 25 bp, Homo sapien
aacttgggcagctaacctttacaat

SEQ ID NO: 636108 - DNA, 25 bp, Homo sapien
aaaaatacctggatgtctctaggaa

SEQ ID NO: 636109 - DNA, 25 bp, Homo sapien
tacctggatgtctctaggaaagaaa

SEQ ID NO: 636110 - DNA, 25 bp, Homo sapien
aattgtaataatccttctagtcaag

SEQ ID NO: 636111 - DNA, 25 bp, Homo sapien
tctagtcaagaagctttctcctcaa

SEQ ID NO: 636112 - DNA, 25 bp, Homo sapien
agaagctttctcctcaaactaacag

SEQ ID NO: 636113 - DNA, 25 bp, Homo sapien
agctttctcctcaaactaacagatc

SEQ ID NO: 636114 - DNA, 25 bp, Homo sapien
ctaacagatctgtagtaaaggaata

SEQ ID NO: 636115 - DNA, 25 bp, Homo sapien
catcagggaaagtatgaccactaca

SEQ ID NO: 636116 - DNA, 25 bp, Homo sapien
gggaaagtatgaccactacaactaa

SEQ ID NO: 636117 - DNA, 25 bp, Homo sapien
gaccactacaactaaaaagccctag

SEQ ID NO: 636118 - DNA, 25 bp, Homo sapien
tgcagaacacagctgaatagcaaga

SEQ ID NO: 636119 - DNA, 25 bp, Homo sapien
tatccaggaccttatagggttttca

SEQ ID NO: 636120 - DNA, 25 bp, Homo sapien
gaccttatagggttttcagtatgta

SEQ ID NO: 636121 - DNA, 25 bp, Homo sapien
ggttttcagtatgtaccaggcttga

SEQ ID NO: 636122 - DNA, 25 bp, Homo sapien
cagtatgtaccaggcttgatgcaca

SEQ ID NO: 636123 - DNA, 25 bp, Homo sapien
tgtaccaggcttgatgcacatctta

SEQ ID NO: 636124 - DNA, 25 bp, Homo sapien
accaggcttgatgcacatcttagaa

SEQ ID NO: 636125 - DNA, 25 bp, Homo sapien
acaggacattatcttgctgggatca

SEQ ID NO: 636126 - DNA, 25 bp, Homo sapien
ggacattatcttgctgggatcatta

SEQ ID NO: 636127 - DNA, 25 bp, Homo sapien
tatcttgctgggatcattagggtat

SEQ ID NO: 636128 - DNA, 25 bp, Homo sapien
ctgggatcattagggtatgactgaa

SEQ ID NO: 636129 - DNA, 25 bp, Homo sapien
tgtaaaacatttaccctaataatag

SEQ ID NO: 636130 - DNA, 25 bp, Homo sapien
gaagaagtatgttagtgctctctct

SEQ ID NO: 636131 - DNA, 25 bp, Homo sapien
atgttagtgctctctcttggattta

SEQ ID NO: 636132 - DNA, 25 bp, Homo sapien
agtgctctctcttggatttataaca

SEQ ID NO: 636133 - DNA, 25 bp, Homo sapien
gtaactgaacttactcttgtacttt

SEQ ID NO: 636134 - DNA, 25 bp, Homo sapien
ctttcttttactctctcttcctcaa

SEQ ID NO: 636135 - DNA, 25 bp, Homo sapien
ttaaaaatcatggttcttggagcca

SEQ ID NO: 636136 - DNA, 25 bp, Homo sapien
tttccctttgccataagagagagag

SEQ ID NO: 636137 - DNA, 25 bp, Homo sapien
gagagagagcagaacttaccaagtt

SEQ ID NO: 636138 - DNA, 25 bp, Homo sapien
agcagaacttaccaagttgggtgta

SEQ ID NO: 636139 - DNA, 25 bp, Homo sapien
accaagttgggtgtagtatatacgt

SEQ ID NO: 636140 - DNA, 25 bp, Homo sapien
gtatatacgtttgacttgggaggaa

SEQ ID NO: 636141 - DNA, 25 bp, Homo sapien
gccaggccttcacagtcatctttag

SEQ ID NO: 636142 - DNA, 25 bp, Homo sapien
caggccttcacagtcatctttagta

SEQ ID NO: 636143 - DNA, 25 bp, Homo sapien
aggccttcacagtcatctttagtat

SEQ ID NO: 636144 - DNA, 25 bp, Homo sapien
gtatgtataacatttcatcctgtgg

SEQ ID NO: 636145 - DNA, 25 bp, Homo sapien
atgtataacatttcatcctgtggtg

SEQ ID NO: 636146 - DNA, 25 bp, Homo sapien
gtataacatttcatcctgtggtgta

SEQ ID NO: 636147 - DNA, 25 bp, Homo sapien
ataacatttcatcctgtggtgtatt

SEQ ID NO: 636148 - DNA, 25 bp, Homo sapien
aacatttcatcctgtggtgtattat

SEQ ID NO: 636149 - DNA, 25 bp, Homo sapien
catttcatcctgtggtgtattatta

SEQ ID NO: 636150 - DNA, 25 bp, Homo sapien
ttcatcctgtggtgtattattactt

SEQ ID NO: 636151 - DNA, 25 bp, Homo sapien
catcctgtggtgtattattacttgt

SEQ ID NO: 636152 - DNA, 25 bp, Homo sapien
gcaaagcggatggtggaccatagca

SEQ ID NO: 636153 - DNA, 25 bp, Homo sapien
agcggatggtggaccatagcatagt

SEQ ID NO: 636154 - DNA, 25 bp, Homo sapien
caaaacagacgaaatttatgggatt

SEQ ID NO: 636155 - DNA, 25 bp, Homo sapien
atttatgggattttatacccagaag

SEQ ID NO: 636156 - DNA, 25 bp, Homo sapien
ctttctctgggctggatattgctcc

SEQ ID NO: 636157 - DNA, 25 bp, Homo sapien
tctctgggctggatattgctccaga

SEQ ID NO: 636158 - DNA, 25 bp, Homo sapien
gggctggatattgctccagagctga

SEQ ID NO: 636159 - DNA, 25 bp, Homo sapien
gagctgagaatacaactctggtcaa

SEQ ID NO: 636160 - DNA, 25 bp, Homo sapien
gctgagaatacaactctggtcaaaa

SEQ ID NO: 636161 - DNA, 25 bp, Homo sapien
tctggtcaaaaagagcttctgcctt

SEQ ID NO: 636162 - DNA, 25 bp, Homo sapien
tcaaaaagagcttctgccttccagt

SEQ ID NO: 636163 - DNA, 25 bp, Homo sapien
tttctcagatgacgaatgcagttca

SEQ ID NO: 636164 - DNA, 25 bp, Homo sapien
gcagttcatttttttaccaaggata

SEQ ID NO: 636165 - DNA, 25 bp, Homo sapien
aattgtagaactcacttccatcccc

SEQ ID NO: 636166 - DNA, 25 bp, Homo sapien
ttccatccccacattgtggaaacgt

SEQ ID NO: 636167 - DNA, 25 bp, Homo sapien
cttctgggcgggtttgaatctccca

SEQ ID NO: 636168 - DNA, 25 bp, Homo sapien
agggatggagtagacaagagtttct

SEQ ID NO: 636169 - DNA, 25 bp, Homo sapien
ttagccattctatgagtatgccgag

SEQ ID NO: 636170 - DNA, 25 bp, Homo sapien
atgagtatgccgaggtatcacaccg

SEQ ID NO: 636171 - DNA, 25 bp, Homo sapien
tatgccgaggtatcacaccgtggtt

SEQ ID NO: 636172 - DNA, 25 bp, Homo sapien
cgaggtatcacaccgtggttttaat

SEQ ID NO: 636173 - DNA, 25 bp, Homo sapien
tatcacaccgtggttttaattttat

SEQ ID NO: 636174 - DNA, 25 bp, Homo sapien
taaatccgtggcgtggtaggcttat

SEQ ID NO: 636175 - DNA, 25 bp, Homo sapien
gtggtaggcttatgctttatcttct

SEQ ID NO: 636176 - DNA, 25 bp, Homo sapien
atcttctgatatttactgagtttac

SEQ ID NO: 636177 - DNA, 25 bp, Homo sapien
ggacctttcataggtaatgctatct

SEQ ID NO: 636178 - DNA, 25 bp, Homo sapien
ggtaatgctatctaccaggttatta

SEQ ID NO: 636179 - DNA, 25 bp, Homo sapien
atctaccaggttattacttctatat

SEQ ID NO: 636180 - DNA, 25 bp, Homo sapien
aatctccaagatatcaccctacaaa

SEQ ID NO: 636181 - DNA, 25 bp, Homo sapien
atttgtaatcgttgcatcgggctgc

SEQ ID NO: 636182 - DNA, 25 bp, Homo sapien
catcgggctgcactttgaggagaca

SEQ ID NO: 636183 - DNA, 25 bp, Homo sapien
gctgcactttgaggagacattagga

SEQ ID NO: 636184 - DNA, 25 bp, Homo sapien
gacattaggagtaaatccgtggcgt

SEQ ID NO: 636185 - DNA, 25 bp, Homo sapien
caacattcttgaatgcaccaagata

SEQ ID NO: 636186 - DNA, 25 bp, Homo sapien
cttgaatgcaccaagatagcctctt

SEQ ID NO: 636187 - DNA, 25 bp, Homo sapien
gaataaatgcctccatatttttcaa

SEQ ID NO: 636188 - DNA, 25 bp, Homo sapien
caaatttaggcttcttgatgcaggc

SEQ ID NO: 636189 - DNA, 25 bp, Homo sapien
atttaggcttcttgatgcaggcatg

SEQ ID NO: 636190 - DNA, 25 bp, Homo sapien
ttaggcttcttgatgcaggcatggt

SEQ ID NO: 636191 - DNA, 25 bp, Homo sapien
aggcttcttgatgcaggcatggtgt

SEQ ID NO: 636192 - DNA, 25 bp, Homo sapien
atgcaggcatggtgtagattactac

SEQ ID NO: 636193 - DNA, 25 bp, Homo sapien
agattactacttctgtattgtccca

SEQ ID NO: 636194 - DNA, 25 bp, Homo sapien
attactacttctgtattgtcccagg

SEQ ID NO: 636195 - DNA, 25 bp, Homo sapien
actacttctgtattgtcccaggagc

SEQ ID NO: 636196 - DNA, 25 bp, Homo sapien
tgcaaaacatgccatttaagactag

SEQ ID NO: 636197 - DNA, 25 bp, Homo sapien
gcaaaacatgccatttaagactaga

SEQ ID NO: 636198 - DNA, 25 bp, Homo sapien
aaacatgccatttaagactagaaac

SEQ ID NO: 636199 - DNA, 25 bp, Homo sapien
acatgccatttaagactagaaacag

SEQ ID NO: 636200 - DNA, 25 bp, Homo sapien
atgccatttaagactagaaacagga

SEQ ID NO: 636201 - DNA, 25 bp, Homo sapien
gccatttaagactagaaacaggaaa

SEQ ID NO: 636202 - DNA, 25 bp, Homo sapien
gaaactgatgacctgtactatataa

SEQ ID NO: 636203 - DNA, 25 bp, Homo sapien
aaactgatgacctgtactatataat

SEQ ID NO: 636204 - DNA, 25 bp, Homo sapien
aactgatgacctgtactatataatg

SEQ ID NO: 636205 - DNA, 25 bp, Homo sapien
gtactatataatgcatgtagctatt

SEQ ID NO: 636206 - DNA, 25 bp, Homo sapien
tataatgcatgtagctattaattta

SEQ ID NO: 636207 - DNA, 25 bp, Homo sapien
aagacatttagttgagatctgtgca

SEQ ID NO: 636208 - DNA, 25 bp, Homo sapien
ttagttgagatctgtgcatattcac

SEQ ID NO: 636209 - DNA, 25 bp, Homo sapien
gatctgtgcatattcacatatccca

SEQ ID NO: 636210 - DNA, 25 bp, Homo sapien
gcatattcacatatcccacccatat

SEQ ID NO: 636211 - DNA, 25 bp, Homo sapien
acatatcccacccatatttagctat

SEQ ID NO: 636212 - DNA, 25 bp, Homo sapien
atcccacccatatttagctataagt

SEQ ID NO: 636213 - DNA, 25 bp, Homo sapien
gaaagggtataatacttcagatttt

SEQ ID NO: 636214 - DNA, 25 bp, Homo sapien
acttcagatttttaatactcatttc

SEQ ID NO: 636215 - DNA, 25 bp, Homo sapien
aatactcatttcttaaatactcttt

SEQ ID NO: 636216 - DNA, 25 bp, Homo sapien
tactaaatttttgtttaccagtgat

SEQ ID NO: 636217 - DNA, 25 bp, Homo sapien
taaatttttgtttaccagtgatttg

SEQ ID NO: 636218 - DNA, 25 bp, Homo sapien
gaattgtttagttgtctagaactct

SEQ ID NO: 636219 - DNA, 25 bp, Homo sapien
tgccatgatgtatatgaaaccccga

SEQ ID NO: 636220 - DNA, 25 bp, Homo sapien
tgctctcacacatatactacagatt

SEQ ID NO: 636221 - DNA, 25 bp, Homo sapien
tatgaaaccccgactgagttgctgt

SEQ ID NO: 636222 - DNA, 25 bp, Homo sapien
gactgagttgctgtcttggcatgat

SEQ ID NO: 636223 - DNA, 25 bp, Homo sapien
gtcttggcatgatgtcagagagcta

SEQ ID NO: 636224 - DNA, 25 bp, Homo sapien
agagagctaaaggagccatggtgat

SEQ ID NO: 636225 - DNA, 25 bp, Homo sapien
ccatggtgatggtacttagactctc

SEQ ID NO: 636226 - DNA, 25 bp, Homo sapien
acttagactctcaatgctcacacag

SEQ ID NO: 636227 - DNA, 25 bp, Homo sapien
cagatttggtctgaagaaaggctta

SEQ ID NO: 636228 - DNA, 25 bp, Homo sapien
gaaagccatcttctcttagcattgg

SEQ ID NO: 636229 - DNA, 25 bp, Homo sapien
aaatctaaactcaagtacatgccat

SEQ ID NO: 636230 - DNA, 25 bp, Homo sapien
caagtacatgccattctactcttct

SEQ ID NO: 636231 - DNA, 25 bp, Homo sapien
attctactcttctgtgtgctgacgt

SEQ ID NO: 636232 - DNA, 25 bp, Homo sapien
actcttctgtgtgctgacgtgggaa

SEQ ID NO: 636233 - DNA, 25 bp, Homo sapien
tgctgacgtgggaagtgtgcacaat

SEQ ID NO: 636234 - DNA, 25 bp, Homo sapien
aagtgtgcacaatgcctgttgctgc

SEQ ID NO: 636235 - DNA, 25 bp, Homo sapien
gtgcacaatgcctgttgctgcaaac

SEQ ID NO: 636236 - DNA, 25 bp, Homo sapien
tgctgcaaacccaactctctgtgaa

SEQ ID NO: 636237 - DNA, 25 bp, Homo sapien
aactctctgtgaaaagcgctcgtct

SEQ ID NO: 636238 - DNA, 25 bp, Homo sapien
gtgaaaagcgctcgtctctaagctg

SEQ ID NO: 636239 - DNA, 25 bp, Homo sapien
aaagcgctcgtctctaagctgccag

SEQ ID NO: 636240 - DNA, 25 bp, Homo sapien
aggtggtagctggtaattgataatt

SEQ ID NO: 636241 - DNA, 25 bp, Homo sapien
gtatgtgtattcattgtggttggta

SEQ ID NO: 636242 - DNA, 25 bp, Homo sapien
gtggttggtagtaatacagcatttt

SEQ ID NO: 636243 - DNA, 25 bp, Homo sapien
acagcatttttatctgcagatctca

SEQ ID NO: 636244 - DNA, 25 bp, Homo sapien
tatctgcagatctcaaagcatgtgt

SEQ ID NO: 636245 - DNA, 25 bp, Homo sapien
tgcagatctcaaagcatgtgtgaat

SEQ ID NO: 636246 - DNA, 25 bp, Homo sapien
atatgcattatttccctattttaag

SEQ ID NO: 636247 - DNA, 25 bp, Homo sapien
atttccctattttaagtagccagag

SEQ ID NO: 636248 - DNA, 25 bp, Homo sapien
gtagccagagactcactgaacgtta

SEQ ID NO: 636249 - DNA, 25 bp, Homo sapien
gagactcactgaacgttaattagat

SEQ ID NO: 636250 - DNA, 25 bp, Homo sapien
gaacgttaattagatataagcagac

SEQ ID NO: 636251 - DNA, 25 bp, Homo sapien
tcctgtcacttcagtctacagaaaa

SEQ ID NO: 636252 - DNA, 25 bp, Homo sapien
agcaggagcaggacatgtgccacaa

SEQ ID NO: 636253 - DNA, 25 bp, Homo sapien
gacatgtgccacaaagttactttgc

SEQ ID NO: 636254 - DNA, 25 bp, Homo sapien
gtgccacaaagttactttgcttgga

SEQ ID NO: 636255 - DNA, 25 bp, Homo sapien
aaataaagtcagtacccagagttga

SEQ ID NO: 636256 - DNA, 25 bp, Homo sapien
gtcagtacccagagttgaaatgatg

SEQ ID NO: 636257 - DNA, 25 bp, Homo sapien
ggaagttcacagagataagcgaata

SEQ ID NO: 636258 - DNA, 25 bp, Homo sapien
gatcaaaatgacgtgctattctact

SEQ ID NO: 636259 - DNA, 25 bp, Homo sapien
tcaaaatgacgtgctattctactac

SEQ ID NO: 636260 - DNA, 25 bp, Homo sapien
gaaggctcaagactttcaacaaaga

SEQ ID NO: 636261 - DNA, 25 bp, Homo sapien
tcaacaaagagggagcctgggctga

SEQ ID NO: 636262 - DNA, 25 bp, Homo sapien
tatgtgattgtatacccaggccttt

SEQ ID NO: 636263 - DNA, 25 bp, Homo sapien
gattgtatacccaggcctttttatc

SEQ ID NO: 636264 - DNA, 25 bp, Homo sapien
atacccaggcctttttatcggtgtg

SEQ ID NO: 636265 - DNA, 25 bp, Homo sapien
caggcctttttatcggtgtgtgtaa

SEQ ID NO: 636266 - DNA, 25 bp, Homo sapien
gcctttttatcggtgtgtgtaataa

SEQ ID NO: 636267 - DNA, 25 bp, Homo sapien
aatgtagtacgtatttgccagcgcg

SEQ ID NO: 636268 - DNA, 25 bp, Homo sapien
tagtacgtatttgccagcgcggtgg

SEQ ID NO: 636269 - DNA, 25 bp, Homo sapien
gcaagaaaatatgttccacacccat

SEQ ID NO: 636270 - DNA, 25 bp, Homo sapien
atatgttccacacccatgattatgt

SEQ ID NO: 636271 - DNA, 25 bp, Homo sapien
gttccacacccatgattatgtgatt

SEQ ID NO: 636272 - DNA, 25 bp, Homo sapien
gattatgtgattgtatacccaggcc

SEQ ID NO: 636273 - DNA, 25 bp, Homo sapien
cttccttgtcagagtaagccatgca

SEQ ID NO: 636274 - DNA, 25 bp, Homo sapien
agtaagccatgcactctgctggaac

SEQ ID NO: 636275 - DNA, 25 bp, Homo sapien
ctggaaccagctctcaataatctag

SEQ ID NO: 636276 - DNA, 25 bp, Homo sapien
atctagaccttgatattgagcttag

SEQ ID NO: 636277 - DNA, 25 bp, Homo sapien
ttgcagaccatctcagtcccatata

SEQ ID NO: 636278 - DNA, 25 bp, Homo sapien
gaccatctcagtcccatatacagaa

SEQ ID NO: 636279 - DNA, 25 bp, Homo sapien
atacagaatctgaaccccaaaaggg

SEQ ID NO: 636280 - DNA, 25 bp, Homo sapien
aaagcttctagttccccatgcaaat

SEQ ID NO: 636281 - DNA, 25 bp, Homo sapien
ttccccatgcaaatttggccacatt

SEQ ID NO: 636282 - DNA, 25 bp, Homo sapien
tgcaaatttggccacattctcccca

SEQ ID NO: 636283 - DNA, 25 bp, Homo sapien
ataccactcctgcataccatggagt

SEQ ID NO: 636284 - DNA, 25 bp, Homo sapien
ggtgatgactgcattttaggcaaat

SEQ ID NO: 636285 - DNA, 25 bp, Homo sapien
gcaaatgatgactttcttggttcca

SEQ ID NO: 636286 - DNA, 25 bp, Homo sapien
gatgactttcttggttccattggtt

SEQ ID NO: 636287 - DNA, 25 bp, Homo sapien
ggtttgcaagtaaaagttacacaca

SEQ ID NO: 636288 - DNA, 25 bp, Homo sapien
gaaacagatttcctaaatgcttcat

SEQ ID NO: 636289 - DNA, 25 bp, Homo sapien
taaatgcttcattttctggatgcac

SEQ ID NO: 636290 - DNA, 25 bp, Homo sapien
atgcttcattttctggatgcaccaa

SEQ ID NO: 636291 - DNA, 25 bp, Homo sapien
ggatgcaccaatgttgacctactat

SEQ ID NO: 636292 - DNA, 25 bp, Homo sapien
gttgacctactatacatgttaaatg

SEQ ID NO: 636293 - DNA, 25 bp, Homo sapien
tccctccttggccattaatgagatg

SEQ ID NO: 636294 - DNA, 25 bp, Homo sapien
gatgaaggcaattaactcacatagt

SEQ ID NO: 636295 - DNA, 25 bp, Homo sapien
tgcaaaacatgccatttaagactag

SEQ ID NO: 636296 - DNA, 25 bp, Homo sapien
gcaaaacatgccatttaagactaga

SEQ ID NO: 636297 - DNA, 25 bp, Homo sapien
aaacatgccatttaagactagaaac

SEQ ID NO: 636298 - DNA, 25 bp, Homo sapien
acatgccatttaagactagaaacag

SEQ ID NO: 636299 - DNA, 25 bp, Homo sapien
atgccatttaagactagaaacagga

SEQ ID NO: 636300 - DNA, 25 bp, Homo sapien
gccatttaagactagaaacaggaaa

SEQ ID NO: 636301 - DNA, 25 bp, Homo sapien
gaaactgatgacctgtactatataa

SEQ ID NO: 636302 - DNA, 25 bp, Homo sapien
aactgatgacctgtactatataatg

SEQ ID NO: 636303 - DNA, 25 bp, Homo sapien
gtactatataatgcatgtagctatt

SEQ ID NO: 636304 - DNA, 25 bp, Homo sapien
tataatgcatgtagctattaattta

SEQ ID NO: 636305 - DNA, 25 bp, Homo sapien
taaaaattttgttcttggctgggtg

SEQ ID NO: 636306 - DNA, 25 bp, Homo sapien
tatggcggctctgaatggaggactt

SEQ ID NO: 636307 - DNA, 25 bp, Homo sapien
ggacttggcgccacaggcttgacga

SEQ ID NO: 636308 - DNA, 25 bp, Homo sapien
acttggcgccacaggcttgacgaat

SEQ ID NO: 636309 - DNA, 25 bp, Homo sapien
ggcgccacaggcttgacgaatggca

SEQ ID NO: 636310 - DNA, 25 bp, Homo sapien
cacaggcttgacgaatggcacggct

SEQ ID NO: 636311 - DNA, 25 bp, Homo sapien
ttgacgaatggcacggctggcacca

SEQ ID NO: 636312 - DNA, 25 bp, Homo sapien
aatggcacggctggcaccatggacg

SEQ ID NO: 636313 - DNA, 25 bp, Homo sapien
cctcacccaggcctactcaggaatt

SEQ ID NO: 636314 - DNA, 25 bp, Homo sapien
aggaattcaacagtacgcagccgcc

SEQ ID NO: 636315 - DNA, 25 bp, Homo sapien
aattcaacagtacgcagccgccgcg

SEQ ID NO: 636316 - DNA, 25 bp, Homo sapien
tgcccactctgtacagccagagcct

SEQ ID NO: 636317 - DNA, 25 bp, Homo sapien
tgtagggcctttgggaagtttctca

SEQ ID NO: 636318 - DNA, 25 bp, Homo sapien
ggaagtttctcaacactctaggtca

SEQ ID NO: 636319 - DNA, 25 bp, Homo sapien
aacactctaggtcatcaccttcttc

SEQ ID NO: 636320 - DNA, 25 bp, Homo sapien
caactacaacctgaaaacaatgatg

SEQ ID NO: 636321 - DNA, 25 bp, Homo sapien
aacaatgatgtgagccttacagggt

SEQ ID NO: 636322 - DNA, 25 bp, Homo sapien
agccttacagggtgcagactgctaa

SEQ ID NO: 636323 - DNA, 25 bp, Homo sapien
gggtgcagactgctaaactttttct

SEQ ID NO: 636324 - DNA, 25 bp, Homo sapien
ctttttctgttaatggagcccttag

SEQ ID NO: 636325 - DNA, 25 bp, Homo sapien
acggacgagagaaggcatgagtttt

SEQ ID NO: 636326 - DNA, 25 bp, Homo sapien
aattgaatcctaggtctgacactga

SEQ ID NO: 636327 - DNA, 25 bp, Homo sapien
tgacactgactagtgtagggccttt

SEQ ID NO: 636328 - DNA, 25 bp, Homo sapien
tccagaattgggttcaccgtgggct

SEQ ID NO: 636329 - DNA, 25 bp, Homo sapien
tgatccattcttgtgagccgtgtgt

SEQ ID NO: 636330 - DNA, 25 bp, Homo sapien
ggcttcagaggcaagttcttggtct

SEQ ID NO: 636331 - DNA, 25 bp, Homo sapien
agttcttggtctcacctcctgcaac

SEQ ID NO: 636332 - DNA, 25 bp, Homo sapien
ctcctgcaactgttccagagagtgt

SEQ ID NO: 636333 - DNA, 25 bp, Homo sapien
cagagagtgtttttccagagggcct

SEQ ID NO: 636334 - DNA, 25 bp, Homo sapien
gggcctgggaccactgggacattct

SEQ ID NO: 636335 - DNA, 25 bp, Homo sapien
tgggacattctccagagccctcagg

SEQ ID NO: 636336 - DNA, 25 bp, Homo sapien
gagccctcaggcatgttttaatgtg

SEQ ID NO: 636337 - DNA, 25 bp, Homo sapien
gactgttaagtgcttggcaaataat

SEQ ID NO: 636338 - DNA, 25 bp, Homo sapien
aactgtagctgttaacatcatcatc

SEQ ID NO: 636339 - DNA, 25 bp, Homo sapien
gacagatgattagaaaaagtcactg

SEQ ID NO: 636340 - DNA, 25 bp, Homo sapien
acagatgattagaaaaagtcactgg

SEQ ID NO: 636341 - DNA, 25 bp, Homo sapien
cagatgattagaaaaagtcactgga

SEQ ID NO: 636342 - DNA, 25 bp, Homo sapien
agatgattagaaaaagtcactggag

SEQ ID NO: 636343 - DNA, 25 bp, Homo sapien
gatgattagaaaaagtcactggagc

SEQ ID NO: 636344 - DNA, 25 bp, Homo sapien
atgattagaaaaagtcactggagcc

SEQ ID NO: 636345 - DNA, 25 bp, Homo sapien
tgattagaaaaagtcactggagcca

SEQ ID NO: 636346 - DNA, 25 bp, Homo sapien
atctgtatttttatctactcaggag

SEQ ID NO: 636347 - DNA, 25 bp, Homo sapien
ggccctcttctcacattaagcttga

SEQ ID NO: 636348 - DNA, 25 bp, Homo sapien
atatatactgctgccaagtctcatc

SEQ ID NO: 636349 - DNA, 25 bp, Homo sapien
caagtctcatccatcctgtgaaaaa

SEQ ID NO: 636350 - DNA, 25 bp, Homo sapien
gtctttcatgcctagtccttgaacc

SEQ ID NO: 636351 - DNA, 25 bp, Homo sapien
agtccttgaaccgtgtcaattgggt

SEQ ID NO: 636352 - DNA, 25 bp, Homo sapien
aagggtctttgaagtatgtcttgaa

SEQ ID NO: 636353 - DNA, 25 bp, Homo sapien
atatttatcatgtccctattaggtg

SEQ ID NO: 636354 - DNA, 25 bp, Homo sapien
cctattaggtgtcgagcactgtgca

SEQ ID NO: 636355 - DNA, 25 bp, Homo sapien
gcactgtgcagggaacaagacatga

SEQ ID NO: 636356 - DNA, 25 bp, Homo sapien
gacatgaacatagtccttggtcttg

SEQ ID NO: 636357 - DNA, 25 bp, Homo sapien
acatagtccttggtcttgtagaatt

SEQ ID NO: 636358 - DNA, 25 bp, Homo sapien
ttaaatctaagagtctatttttcaa

SEQ ID NO: 636359 - DNA, 25 bp, Homo sapien
tctatttttcaaccccgcctaatga

SEQ ID NO: 636360 - DNA, 25 bp, Homo sapien
cccgcctaatgatttctaagctgtt

SEQ ID NO: 636361 - DNA, 25 bp, Homo sapien
gcctaatgatttctaagctgttctg

SEQ ID NO: 636362 - DNA, 25 bp, Homo sapien
aatgatttctaagctgttctggtag

SEQ ID NO: 636363 - DNA, 25 bp, Homo sapien
gatttctaagctgttctggtagctt

SEQ ID NO: 636364 - DNA, 25 bp, Homo sapien
ctgttctggtagctttggttttgga

SEQ ID NO: 636365 - DNA, 25 bp, Homo sapien
ctggtagctttggttttggaaatgg

SEQ ID NO: 636366 - DNA, 25 bp, Homo sapien
gaaatggtcctggaataatagggaa

SEQ ID NO: 636367 - DNA, 25 bp, Homo sapien
tagggaatagagtagcactgggatt

SEQ ID NO: 636368 - DNA, 25 bp, Homo sapien
gagtagcactgggatttaggaattt

SEQ ID NO: 636369 - DNA, 25 bp, Homo sapien
caggcctggcctttgccagcctggg

SEQ ID NO: 636370 - DNA, 25 bp, Homo sapien
gcaacgtggcaagaagataacatgt

SEQ ID NO: 636371 - DNA, 25 bp, Homo sapien
gaagataacatgtagacaagcagtc

SEQ ID NO: 636372 - DNA, 25 bp, Homo sapien
tgtagacaagcagtcaaacatgtat

SEQ ID NO: 636373 - DNA, 25 bp, Homo sapien
gacaagcagtcaaacatgtattctt

SEQ ID NO: 636374 - DNA, 25 bp, Homo sapien
atatgactgatagaattctctgccc

SEQ ID NO: 636375 - DNA, 25 bp, Homo sapien
atgactgatagaattctctgcccac

SEQ ID NO: 636376 - DNA, 25 bp, Homo sapien
gactgatagaattctctgcccactg

SEQ ID NO: 636377 - DNA, 25 bp, Homo sapien
tgcccactgatctaccatcttgttt

SEQ ID NO: 636378 - DNA, 25 bp, Homo sapien
ccactgatctaccatcttgtttttt

SEQ ID NO: 636379 - DNA, 25 bp, Homo sapien
ttttttcacttaactatgtgtctca

SEQ ID NO: 636380 - DNA, 25 bp, Homo sapien
tattgtcccaggagctcagcacatt

SEQ ID NO: 636381 - DNA, 25 bp, Homo sapien
gccagagatgataaggagctcaatc

SEQ ID NO: 636382 - DNA, 25 bp, Homo sapien
ggagctcaatcttgaatacttgttc

SEQ ID NO: 636383 - DNA, 25 bp, Homo sapien
gaatacttgttcaagcttttgaata

SEQ ID NO: 636384 - DNA, 25 bp, Homo sapien
gaagaattgcgaaatcaccggaaat

SEQ ID NO: 636385 - DNA, 25 bp, Homo sapien
attgcgaaatcaccggaaataaccg

SEQ ID NO: 636386 - DNA, 25 bp, Homo sapien
cccctgtttgactttcaacattctt

SEQ ID NO: 636387 - DNA, 25 bp, Homo sapien
gtttgactttcaacattcttgaatg

SEQ ID NO: 636388 - DNA, 25 bp, Homo sapien
atgcaccaagatagcctctttctgt

SEQ ID NO: 636389 - DNA, 25 bp, Homo sapien
tttaggcttcttgatgcaggcatgg

SEQ ID NO: 636390 - DNA, 25 bp, Homo sapien
gattactacttctgtattgtcccag

SEQ ID NO: 636391 - DNA, 25 bp, Homo sapien
acaaaggacttttctagttgatgat

SEQ ID NO: 636392 - DNA, 25 bp, Homo sapien
aggacttttctagttgatgataaga

SEQ ID NO: 636393 - DNA, 25 bp, Homo sapien
gaacataggtctttataggtactaa

SEQ ID NO: 636394 - DNA, 25 bp, Homo sapien
ttaacagatatttatcctggaaaat

SEQ ID NO: 636395 - DNA, 25 bp, Homo sapien
attcagttatgagaagacccacttg

SEQ ID NO: 636396 - DNA, 25 bp, Homo sapien
gttatgagaagacccacttgactgc

SEQ ID NO: 636397 - DNA, 25 bp, Homo sapien
gagaagacccacttgactgctaatt

SEQ ID NO: 636398 - DNA, 25 bp, Homo sapien
gaagacccacttgactgctaatttg

SEQ ID NO: 636399 - DNA, 25 bp, Homo sapien
gacccacttgactgctaatttgatg

SEQ ID NO: 636400 - DNA, 25 bp, Homo sapien
acttgactgctaatttgatgacgaa

SEQ ID NO: 636401 - DNA, 25 bp, Homo sapien
gctaatttgatgacgaatctgcaag

SEQ ID NO: 636402 - DNA, 25 bp, Homo sapien
caccaaggagccaatgaatcccatt

SEQ ID NO: 636403 - DNA, 25 bp, Homo sapien
aaggagccaatgaatcccattaaac

SEQ ID NO: 636404 - DNA, 25 bp, Homo sapien
gagccaatgaatcccattaaacaat

SEQ ID NO: 636405 - DNA, 25 bp, Homo sapien
aggatggaaagctacgctatgtggc

SEQ ID NO: 636406 - DNA, 25 bp, Homo sapien
ggaaagctacgctatgtggcgaata

SEQ ID NO: 636407 - DNA, 25 bp, Homo sapien
acgctatgtggcgaatatcttccct

SEQ ID NO: 636408 - DNA, 25 bp, Homo sapien
ctatgtggcgaatatcttcccttac

SEQ ID NO: 636409 - DNA, 25 bp, Homo sapien
atgtggcgaatatcttcccttacaa

SEQ ID NO: 636410 - DNA, 25 bp, Homo sapien
gtggcgaatatcttcccttacaagg

SEQ ID NO: 636411 - DNA, 25 bp, Homo sapien
ggcgaatatcttcccttacaagggt

SEQ ID NO: 636412 - DNA, 25 bp, Homo sapien
gaatatcttcccttacaagggttat

SEQ ID NO: 636413 - DNA, 25 bp, Homo sapien
gtagtctaccatttagtccatgttt

SEQ ID NO: 636414 - DNA, 25 bp, Homo sapien
agtccatgttttatgcacgtttaga

SEQ ID NO: 636415 - DNA, 25 bp, Homo sapien
tgcacgtttagaccattgaattaat

SEQ ID NO: 636416 - DNA, 25 bp, Homo sapien
tgcttttgccttggctttgtggcaa

SEQ ID NO: 636417 - DNA, 25 bp, Homo sapien
ggcaaagcgacattagggaacatat

SEQ ID NO: 636418 - DNA, 25 bp, Homo sapien
gaacctgattgctttagcagccctt

SEQ ID NO: 636419 - DNA, 25 bp, Homo sapien
gcagcccttgggttgatagtatcag

SEQ ID NO: 636420 - DNA, 25 bp, Homo sapien
gatagtatcaggttccagcctgccc

SEQ ID NO: 636421 - DNA, 25 bp, Homo sapien
agcctgccctgctaggtcaacgtgg

SEQ ID NO: 636422 - DNA, 25 bp, Homo sapien
taggtcaacgtggacccagggcttt

SEQ ID NO: 636423 - DNA, 25 bp, Homo sapien
cagggaaagttcacttctattgttt

SEQ ID NO: 636424 - DNA, 25 bp, Homo sapien
gaacttttcattggttgtcatggta

SEQ ID NO: 636425 - DNA, 25 bp, Homo sapien
gttgtcatggtagtaatgtcctgat

SEQ ID NO: 636426 - DNA, 25 bp, Homo sapien
gaaatctcccagaacctagtagctc

SEQ ID NO: 636427 - DNA, 25 bp, Homo sapien
gaacctagtagctcttaaacatgct

SEQ ID NO: 636428 - DNA, 25 bp, Homo sapien
aaacatgctttcatcttggttcctt

SEQ ID NO: 636429 - DNA, 25 bp, Homo sapien
ttcatcttggttcctttggtctgac

SEQ ID NO: 636430 - DNA, 25 bp, Homo sapien
tggttcctttggtctgacggaaact

SEQ ID NO: 636431 - DNA, 25 bp, Homo sapien
acggaaactttatgacgaccctctg

SEQ ID NO: 636432 - DNA, 25 bp, Homo sapien
tgacgaccctctgtgtttttgacat

SEQ ID NO: 636433 - DNA, 25 bp, Homo sapien
gagcctagagagtaaggaacgttat

SEQ ID NO: 636434 - DNA, 25 bp, Homo sapien
aggttcacttgaaagaacttttcat

SEQ ID NO: 636435 - DNA, 25 bp, Homo sapien
tgaaactttcaccttctggttttat

SEQ ID NO: 636436 - DNA, 25 bp, Homo sapien
tttcaccttctggttttatagccaa

SEQ ID NO: 636437 - DNA, 25 bp, Homo sapien
ttctggttttatagccaaagtctaa

SEQ ID NO: 636438 - DNA, 25 bp, Homo sapien
gccaaagtctaagcagaagcccctg

SEQ ID NO: 636439 - DNA, 25 bp, Homo sapien
aagtctaagcagaagcccctgcgac

SEQ ID NO: 636440 - DNA, 25 bp, Homo sapien
tgcgaccattccaacactgacagaa

SEQ ID NO: 636441 - DNA, 25 bp, Homo sapien
aacactgacagaacattcctctgcc

SEQ ID NO: 636442 - DNA, 25 bp, Homo sapien
ctgccttgttttacagatacattgg

SEQ ID NO: 636443 - DNA, 25 bp, Homo sapien
ggaaacttaaggatgagaactttag

SEQ ID NO: 636444 - DNA, 25 bp, Homo sapien
cttggaaacccacttgcttgtaaat

SEQ ID NO: 636445 - DNA, 25 bp, Homo sapien
tggaaacccacttgcttgtaaatca

SEQ ID NO: 636446 - DNA, 25 bp, Homo sapien
gtactccacgaatatgaggaagtat

SEQ ID NO: 636447 - DNA, 25 bp, Homo sapien
ggaactggtacagaacagaagttat

SEQ ID NO: 636448 - DNA, 25 bp, Homo sapien
ttttgggtaagatcaagggcaggat

SEQ ID NO: 636449 - DNA, 25 bp, Homo sapien
gggcaggatgtaagaaaactagttt

SEQ ID NO: 636450 - DNA, 25 bp, Homo sapien
ttaatccagggctaaacctcatgtt

SEQ ID NO: 636451 - DNA, 25 bp, Homo sapien
agggctaaacctcatgttctgggca

SEQ ID NO: 636452 - DNA, 25 bp, Homo sapien
aaacctcatgttctgggcagtcgtg

SEQ ID NO: 636453 - DNA, 25 bp, Homo sapien
cccctgtagtgctttaattcactat

SEQ ID NO: 636454 - DNA, 25 bp, Homo sapien
gtgctttaattcactatgggaaaag

SEQ ID NO: 636455 - DNA, 25 bp, Homo sapien
tgggaaaagcatccaatctgtgttt

SEQ ID NO: 636456 - DNA, 25 bp, Homo sapien
agcatccaatctgtgttttacaaaa

SEQ ID NO: 636457 - DNA, 25 bp, Homo sapien
gaggctaggtaattcaaagtcacac

SEQ ID NO: 636458 - DNA, 25 bp, Homo sapien
aggtaattcaaagtcacacagttaa

SEQ ID NO: 636459 - DNA, 25 bp, Homo sapien
tctgtggcttcagagcttacactct

SEQ ID NO: 636460 - DNA, 25 bp, Homo sapien
agcttacactctcctacttttatgg

SEQ ID NO: 636461 - DNA, 25 bp, Homo sapien
tctcctacttttatggagtacacta

SEQ ID NO: 636462 - DNA, 25 bp, Homo sapien
tgtcatcttacaaatcctcctcata

SEQ ID NO: 636463 - DNA, 25 bp, Homo sapien
tacaaatcctcctcataaaccttat

SEQ ID NO: 636464 - DNA, 25 bp, Homo sapien
aatcctcctcataaaccttatctgt

SEQ ID NO: 636465 - DNA, 25 bp, Homo sapien
aaaccttatctgtaatatcaggaga

SEQ ID NO: 636466 - DNA, 25 bp, Homo sapien
caggagaagaatacctactttgtat

SEQ ID NO: 636467 - DNA, 25 bp, Homo sapien
taaaaatatttagcacagcctggta

SEQ ID NO: 636468 - DNA, 25 bp, Homo sapien
ttgtatcaactacacagcgccttga

SEQ ID NO: 636469 - DNA, 25 bp, Homo sapien
gtatcaactacacagcgccttgaac

SEQ ID NO: 636470 - DNA, 25 bp, Homo sapien
tacacagcgccttgaaccatacagt

SEQ ID NO: 636471 - DNA, 25 bp, Homo sapien
acacagcgccttgaaccatacagtt

SEQ ID NO: 636472 - DNA, 25 bp, Homo sapien
acagcgccttgaaccatacagttga

SEQ ID NO: 636473 - DNA, 25 bp, Homo sapien
cagcgccttgaaccatacagttgag

SEQ ID NO: 636474 - DNA, 25 bp, Homo sapien
gcgccttgaaccatacagttgaggg

SEQ ID NO: 636475 - DNA, 25 bp, Homo sapien
gccttgaaccatacagttgagggag

SEQ ID NO: 636476 - DNA, 25 bp, Homo sapien
gaaccatacagttgagggaggtacc

SEQ ID NO: 636477 - DNA, 25 bp, Homo sapien
atacagttgagggaggtaccccatt

SEQ ID NO: 636478 - DNA, 25 bp, Homo sapien
agttgagggaggtaccccattgcaa

SEQ ID NO: 636479 - DNA, 25 bp, Homo sapien
ggagagaagtgtcttctagtcctaa

SEQ ID NO: 636480 - DNA, 25 bp, Homo sapien
gagaagtgtcttctagtcctaaaaa

SEQ ID NO: 636481 - DNA, 25 bp, Homo sapien
tgggctggcatggtggaacaaacct

SEQ ID NO: 636482 - DNA, 25 bp, Homo sapien
gctggcatggtggaacaaacctgta

SEQ ID NO: 636483 - DNA, 25 bp, Homo sapien
ggtggaacaaacctgtaagtcccag

SEQ ID NO: 636484 - DNA, 25 bp, Homo sapien
ggaacaaacctgtaagtcccagcac

SEQ ID NO: 636485 - DNA, 25 bp, Homo sapien
caaggtaagaggatcatctgcttga

SEQ ID NO: 636486 - DNA, 25 bp, Homo sapien
ggaggtcaagtctgcagtgacgcat

SEQ ID NO: 636487 - DNA, 25 bp, Homo sapien
ggtcaagtctgcagtgacgcatgat

SEQ ID NO: 636488 - DNA, 25 bp, Homo sapien
tcaagtctgcagtgacgcatgatct

SEQ ID NO: 636489 - DNA, 25 bp, Homo sapien
agtctgcagtgacgcatgatctcgc

SEQ ID NO: 636490 - DNA, 25 bp, Homo sapien
ttactttacattaagtgtttctggc

SEQ ID NO: 636491 - DNA, 25 bp, Homo sapien
ctttacattaagtgtttctggctgt

SEQ ID NO: 636492 - DNA, 25 bp, Homo sapien
tgtttctggctgtgcgtgatggctc

SEQ ID NO: 636493 - DNA, 25 bp, Homo sapien
gtttctggctgtgcgtgatggctca

SEQ ID NO: 636494 - DNA, 25 bp, Homo sapien
ggctgtgcgtgatggctcatgtctg

SEQ ID NO: 636495 - DNA, 25 bp, Homo sapien
tggcaagacctcaactcttctaaat

SEQ ID NO: 636496 - DNA, 25 bp, Homo sapien
ggcaagacctcaactcttctaaata

SEQ ID NO: 636497 - DNA, 25 bp, Homo sapien
caagacctcaactcttctaaatatg

SEQ ID NO: 636498 - DNA, 25 bp, Homo sapien
tggtgtgcatctgtggttccacctg

SEQ ID NO: 636499 - DNA, 25 bp, Homo sapien
ggtgtgcatctgtggttccacctgc

SEQ ID NO: 636500 - DNA, 25 bp, Homo sapien
gtgtgcatctgtggttccacctgct

SEQ ID NO: 636501 - DNA, 25 bp, Homo sapien
aggcgtgggccatgacctgcttttt

SEQ ID NO: 636502 - DNA, 25 bp, Homo sapien
ggcgtgggccatgacctgcttttta

SEQ ID NO: 636503 - DNA, 25 bp, Homo sapien
gcgtgggccatgacctgctttttat

SEQ ID NO: 636504 - DNA, 25 bp, Homo sapien
cgtgggccatgacctgctttttatt

SEQ ID NO: 636505 - DNA, 25 bp, Homo sapien
gtgggccatgacctgctttttatta

SEQ ID NO: 636506 - DNA, 25 bp, Homo sapien
tgggccatgacctgctttttattat

SEQ ID NO: 636507 - DNA, 25 bp, Homo sapien
gggccatgacctgctttttattatc

SEQ ID NO: 636508 - DNA, 25 bp, Homo sapien
atctataataatatgtattgttcct

SEQ ID NO: 636509 - DNA, 25 bp, Homo sapien
tctataataatatgtattgttccta

SEQ ID NO: 636510 - DNA, 25 bp, Homo sapien
ctataataatatgtattgttcctat

SEQ ID NO: 636511 - DNA, 25 bp, Homo sapien
ctcttcgaggtctagatatagctgt

SEQ ID NO: 636512 - DNA, 25 bp, Homo sapien
tatagctgtggcaagaggcacgctg

SEQ ID NO: 636513 - DNA, 25 bp, Homo sapien
gagtttcagaatgtagtcgtggcct

SEQ ID NO: 636514 - DNA, 25 bp, Homo sapien
agaatgtagtcgtggccttggcttg

SEQ ID NO: 636515 - DNA, 25 bp, Homo sapien
gtgtggaagtaatagcaaactcagc

SEQ ID NO: 636516 - DNA, 25 bp, Homo sapien
gcaaactcagcaagataccttttat

SEQ ID NO: 636517 - DNA, 25 bp, Homo sapien
taccttttatgttttgataacggct

SEQ ID NO: 636518 - DNA, 25 bp, Homo sapien
ttgcataccattcaattcacccctg

SEQ ID NO: 636519 - DNA, 25 bp, Homo sapien
attcacccctgtaaagtgtataaat

SEQ ID NO: 636520 - DNA, 25 bp, Homo sapien
agtacattcatggagttgtgcaatc

SEQ ID NO: 636521 - DNA, 25 bp, Homo sapien
ggagttgtgcaatcattaccatcat

SEQ ID NO: 636522 - DNA, 25 bp, Homo sapien
gtgggacttgttcaggaaaatcatt

SEQ ID NO: 636523 - DNA, 25 bp, Homo sapien
gaaaatcattacctcaccatgcttg

SEQ ID NO: 636524 - DNA, 25 bp, Homo sapien
aaatcattacctcaccatgcttgtt

SEQ ID NO: 636525 - DNA, 25 bp, Homo sapien
attacctcaccatgcttgttcaaat

SEQ ID NO: 636526 - DNA, 25 bp, Homo sapien
tacctcaccatgcttgttcaaattg

SEQ ID NO: 636527 - DNA, 25 bp, Homo sapien
catgcttgttcaaattgtggtttct

SEQ ID NO: 636528 - DNA, 25 bp, Homo sapien
gcttgttcaaattgtggtttctata

SEQ ID NO: 636529 - DNA, 25 bp, Homo sapien
gcaatagtacctaaacgtaaaacat

SEQ ID NO: 636530 - DNA, 25 bp, Homo sapien
agaagaactcatgatgtattaacat

SEQ ID NO: 636531 - DNA, 25 bp, Homo sapien
tgtattaacatcaccaactttagta

SEQ ID NO: 636532 - DNA, 25 bp, Homo sapien
taacatcaccaactttagtaacttg

SEQ ID NO: 636533 - DNA, 25 bp, Homo sapien
ggatttgattggattccatctgggt

SEQ ID NO: 636534 - DNA, 25 bp, Homo sapien
gattggattccatctgggtagaact

SEQ ID NO: 636535 - DNA, 25 bp, Homo sapien
gattccatctgggtagaactatatt

SEQ ID NO: 636536 - DNA, 25 bp, Homo sapien
ctccttaaggtcactacttaatttg

SEQ ID NO: 636537 - DNA, 25 bp, Homo sapien
ttgcggagacgggagcattctccac

SEQ ID NO: 636538 - DNA, 25 bp, Homo sapien
gagacgggagcattctccacattat

SEQ ID NO: 636539 - DNA, 25 bp, Homo sapien
gggagcattctccacattatcactt

SEQ ID NO: 636540 - DNA, 25 bp, Homo sapien
attctccacattatcacttccagtt

SEQ ID NO: 636541 - DNA, 25 bp, Homo sapien
ttatcacttccagttcctcagcttt

SEQ ID NO: 636542 - DNA, 25 bp, Homo sapien
gattctcaatatgtagttactcaac

SEQ ID NO: 636543 - DNA, 25 bp, Homo sapien
tgatttgatatagttattctccata

SEQ ID NO: 636544 - DNA, 25 bp, Homo sapien
ggattcaacctcactgaacctcaat

SEQ ID NO: 636545 - DNA, 25 bp, Homo sapien
gtgctggctgttgttcaatggaaga

SEQ ID NO: 636546 - DNA, 25 bp, Homo sapien
caagaatcgcatcaagttgtgttgt

SEQ ID NO: 636547 - DNA, 25 bp, Homo sapien
gaataacatgcacagatgagcttca

SEQ ID NO: 636548 - DNA, 25 bp, Homo sapien
gaatgagcaaacttactggttacac

SEQ ID NO: 636549 - DNA, 25 bp, Homo sapien
actggttacactctgcatccattta

SEQ ID NO: 636550 - DNA, 25 bp, Homo sapien
gagcgaacctcaaagtcatgcaaag

SEQ ID NO: 636551 - DNA, 25 bp, Homo sapien
catgcaaagggcttcttagcctggc

SEQ ID NO: 636552 - DNA, 25 bp, Homo sapien
cttagcctggcttgaccactttgga

SEQ ID NO: 636553 - DNA, 25 bp, Homo sapien
gaccactttggaacaggctgtctgt

SEQ ID NO: 636554 - DNA, 25 bp, Homo sapien
caggctgtctgtgggcaaaggattc

SEQ ID NO: 636555 - DNA, 25 bp, Homo sapien
tgtgtcttccccacgttgaggtcag

SEQ ID NO: 636556 - DNA, 25 bp, Homo sapien
acgttgaggtcagctgtcactgcca

SEQ ID NO: 636557 - DNA, 25 bp, Homo sapien
gaggtcagctgtcactgccatgcat

SEQ ID NO: 636558 - DNA, 25 bp, Homo sapien
tgtcactgccatgcatcattgtatg

SEQ ID NO: 636559 - DNA, 25 bp, Homo sapien
atcattgtatgcttggctgtcctta

SEQ ID NO: 636560 - DNA, 25 bp, Homo sapien
gctgtccttagtcctcttatgttat

SEQ ID NO: 636561 - DNA, 25 bp, Homo sapien
ccttagtcctcttatgttatttgcc

SEQ ID NO: 636562 - DNA, 25 bp, Homo sapien
cattcagtcagcagcactgtagctg

SEQ ID NO: 636563 - DNA, 25 bp, Homo sapien
gtagctgaatagtagtttcctcctt

SEQ ID NO: 636564 - DNA, 25 bp, Homo sapien
aatagtagtttcctccttttgatag

SEQ ID NO: 636565 - DNA, 25 bp, Homo sapien
gtttcctccttttgataggacacat

SEQ ID NO: 636566 - DNA, 25 bp, Homo sapien
tcacctgggagtggtgatgtgcacc

SEQ ID NO: 636567 - DNA, 25 bp, Homo sapien
tgcaccactgtactcgagccttgag

SEQ ID NO: 636568 - DNA, 25 bp, Homo sapien
gcaccactgtactcgagccttgagg

SEQ ID NO: 636569 - DNA, 25 bp, Homo sapien
caccactgtactcgagccttgagga

SEQ ID NO: 636570 - DNA, 25 bp, Homo sapien
accactgtactcgagccttgaggac

SEQ ID NO: 636571 - DNA, 25 bp, Homo sapien
ccactgtactcgagccttgaggaca

SEQ ID NO: 636572 - DNA, 25 bp, Homo sapien
cactgtactcgagccttgaggacag

SEQ ID NO: 636573 - DNA, 25 bp, Homo sapien
ctgtactcgagccttgaggacagag

SEQ ID NO: 636574 - DNA, 25 bp, Homo sapien
tgtactcgagccttgaggacagagt

SEQ ID NO: 636575 - DNA, 25 bp, Homo sapien
tactcgagccttgaggacagagtga

SEQ ID NO: 636576 - DNA, 25 bp, Homo sapien
accctgtctctgaataaattaatta

SEQ ID NO: 636577 - DNA, 25 bp, Homo sapien
gaaagtatgcaggagccagttttat

SEQ ID NO: 636578 - DNA, 25 bp, Homo sapien
gcaggagccagttttatttcaagag

SEQ ID NO: 636579 - DNA, 25 bp, Homo sapien
tcaagagcctcctgaaatataacag

SEQ ID NO: 636580 - DNA, 25 bp, Homo sapien
atgggtgattggtattttctggaac

SEQ ID NO: 636581 - DNA, 25 bp, Homo sapien
caacctaactgtattgagtactcaa

SEQ ID NO: 636582 - DNA, 25 bp, Homo sapien
tattgagtactcaaatgccagactt

SEQ ID NO: 636583 - DNA, 25 bp, Homo sapien
aatgccagacttcacatgttttaag

SEQ ID NO: 636584 - DNA, 25 bp, Homo sapien
gacttcacatgttttaagctcaaga

SEQ ID NO: 636585 - DNA, 25 bp, Homo sapien
cctgatcaagctgtatctggtttca

SEQ ID NO: 636586 - DNA, 25 bp, Homo sapien
tatctggtttcagatggcagtctga

SEQ ID NO: 636587 - DNA, 25 bp, Homo sapien
ggcagtctgaaggaatatttacttt

SEQ ID NO: 636588 - DNA, 25 bp, Homo sapien
atttttgaacagatgcctttttgga

SEQ ID NO: 636589 - DNA, 25 bp, Homo sapien
cagatgcctttttggaaatcttaaa

SEQ ID NO: 636590 - DNA, 25 bp, Homo sapien
gcaaacatttcaaacagttggctaa

SEQ ID NO: 636591 - DNA, 25 bp, Homo sapien
aaacagttggctaacacgcatgaac

SEQ ID NO: 636592 - DNA, 25 bp, Homo sapien
tggctaacacgcatgaactaacact

SEQ ID NO: 636593 - DNA, 25 bp, Homo sapien
gcatgaactaacactcattcagttt

SEQ ID NO: 636594 - DNA, 25 bp, Homo sapien
cggatgatatccgtattaacattat

SEQ ID NO: 636595 - DNA, 25 bp, Homo sapien
gactctatactacagattgacatgg

SEQ ID NO: 636596 - DNA, 25 bp, Homo sapien
atcagtagaaagtttgagagctcat

SEQ ID NO: 636597 - DNA, 25 bp, Homo sapien
gagagctcatttttacccaaatact

SEQ ID NO: 636598 - DNA, 25 bp, Homo sapien
ttacccaaatactaattttcatgtt

SEQ ID NO: 636599 - DNA, 25 bp, Homo sapien
gcattcattttgcaaggagatctta

SEQ ID NO: 636600 - DNA, 25 bp, Homo sapien
gagatcttagtagaatctgcattcc

SEQ ID NO: 636601 - DNA, 25 bp, Homo sapien
tagtagaatctgcattccttgaaaa

SEQ ID NO: 636602 - DNA, 25 bp, Homo sapien
acaaggtgcttaatactgtttctaa

SEQ ID NO: 636603 - DNA, 25 bp, Homo sapien
ggaaaactcagcattagagcagcat

SEQ ID NO: 636604 - DNA, 25 bp, Homo sapien
tacagagtcataaatccttcaggga

SEQ ID NO: 636605 - DNA, 25 bp, Homo sapien
aatccttcagggaatcagctccgag

SEQ ID NO: 636606 - DNA, 25 bp, Homo sapien
tcagctccgagccacataaagtcat

SEQ ID NO: 636607 - DNA, 25 bp, Homo sapien
gagccacataaagtcatttccatac

SEQ ID NO: 636608 - DNA, 25 bp, Homo sapien
atttccatacagactgcttagcttt

SEQ ID NO: 636609 - DNA, 25 bp, Homo sapien
catacagactgcttagctttttatt

SEQ ID NO: 636610 - DNA, 25 bp, Homo sapien
gacacttttactatactcataccta

SEQ ID NO: 636611 - DNA, 25 bp, Homo sapien
ctgtgccatacgaggttattattgc

SEQ ID NO: 636612 - DNA, 25 bp, Homo sapien
gcatagtagctatggagatccatca

SEQ ID NO: 636613 - DNA, 25 bp, Homo sapien
ggagatccatcatatttgaccaatc

SEQ ID NO: 636614 - DNA, 25 bp, Homo sapien
tttgaccaatcacttttctgtttta

SEQ ID NO: 636615 - DNA, 25 bp, Homo sapien
ttctgttttacataaatcccctcat

SEQ ID NO: 636616 - DNA, 25 bp, Homo sapien
tacataaatcccctcatggagtgcc

SEQ ID NO: 636617 - DNA, 25 bp, Homo sapien
atggagtgccctcagctagagttcc

SEQ ID NO: 636618 - DNA, 25 bp, Homo sapien
tctagccacctttcatgggaattgt

SEQ ID NO: 636619 - DNA, 25 bp, Homo sapien
gaattgttggttcatcctctgaggc

SEQ ID NO: 636620 - DNA, 25 bp, Homo sapien
cctctgaggctgcagtagtaacttt

SEQ ID NO: 636621 - DNA, 25 bp, Homo sapien
aaagattagccccattctagtcgcc

SEQ ID NO: 636622 - DNA, 25 bp, Homo sapien
attctagtcgcctcaggcacactga

SEQ ID NO: 636623 - DNA, 25 bp, Homo sapien
aggcacactgaacacttaaccagct

SEQ ID NO: 636624 - DNA, 25 bp, Homo sapien
taaccagctggtcaaagttctaaat

SEQ ID NO: 636625 - DNA, 25 bp, Homo sapien
cattctctgtctcctataatcatta

SEQ ID NO: 636626 - DNA, 25 bp, Homo sapien
tattgaaatttctcttaaacctatt

SEQ ID NO: 636627 - DNA, 25 bp, Homo sapien
taaacctattttatgttaagccaag

SEQ ID NO: 636628 - DNA, 25 bp, Homo sapien
aaactttccaagatgttcagatgtt

SEQ ID NO: 636629 - DNA, 25 bp, Homo sapien
ctgtttggtctcctagaaatatcat

SEQ ID NO: 636630 - DNA, 25 bp, Homo sapien
atatcatttctaacaaagggctata

SEQ ID NO: 636631 - DNA, 25 bp, Homo sapien
taccaaagcttgcaaaacatgtttc

SEQ ID NO: 636632 - DNA, 25 bp, Homo sapien
cctgcaaacgggaaaataggcaaca

SEQ ID NO: 636633 - DNA, 25 bp, Homo sapien
atccctctctcgcactggtggaaaa

SEQ ID NO: 636634 - DNA, 25 bp, Homo sapien
cctctctcgcactggtggaaaaggg

SEQ ID NO: 636635 - DNA, 25 bp, Homo sapien
taaaaatggccctactcaccctaca

SEQ ID NO: 636636 - DNA, 25 bp, Homo sapien
ctacacccttcctaaaatctcgagg

SEQ ID NO: 636637 - DNA, 25 bp, Homo sapien
cacccttcctaaaatctcgaggaca

SEQ ID NO: 636638 - DNA, 25 bp, Homo sapien
tctcgaggacaaaggatatatattt

SEQ ID NO: 636639 - DNA, 25 bp, Homo sapien
tatttaagtttcatcacgactgctg

SEQ ID NO: 636640 - DNA, 25 bp, Homo sapien
gtttcatcacgactgctgtagagcc

SEQ ID NO: 636641 - DNA, 25 bp, Homo sapien
gggccataatcaacccaaatttagc

SEQ ID NO: 636642 - DNA, 25 bp, Homo sapien
ataatcaacccaaatttagcccctg

SEQ ID NO: 636643 - DNA, 25 bp, Homo sapien
attagctgggcatcaggcatcgtgc

SEQ ID NO: 636644 - DNA, 25 bp, Homo sapien
ttagctgggcatcaggcatcgtgca

SEQ ID NO: 636645 - DNA, 25 bp, Homo sapien
ctgggcatcaggcatcgtgcacaat

SEQ ID NO: 636646 - DNA, 25 bp, Homo sapien
tgggcatcaggcatcgtgcacaatc

SEQ ID NO: 636647 - DNA, 25 bp, Homo sapien
ggcatcaggcatcgtgcacaatcct

SEQ ID NO: 636648 - DNA, 25 bp, Homo sapien
atcaggcatcgtgcacaatcctgta

SEQ ID NO: 636649 - DNA, 25 bp, Homo sapien
tcaggcatcgtgcacaatcctgtac

SEQ ID NO: 636650 - DNA, 25 bp, Homo sapien
aggcatcgtgcacaatcctgtactc

SEQ ID NO: 636651 - DNA, 25 bp, Homo sapien
ggcatcgtgcacaatcctgtactcc

SEQ ID NO: 636652 - DNA, 25 bp, Homo sapien
atcgtgcacaatcctgtactcccgg

SEQ ID NO: 636653 - DNA, 25 bp, Homo sapien
atatagcaagctggtttggagtgag

SEQ ID NO: 636654 - DNA, 25 bp, Homo sapien
tccagaagcagtcagctcttataat

SEQ ID NO: 636655 - DNA, 25 bp, Homo sapien
agcagtcagctcttataatcctagg

SEQ ID NO: 636656 - DNA, 25 bp, Homo sapien
gcagtcagctcttataatcctagga

SEQ ID NO: 636657 - DNA, 25 bp, Homo sapien
ctcttataatcctaggagctcccca

SEQ ID NO: 636658 - DNA, 25 bp, Homo sapien
ctgaattttctatttccattcattt

SEQ ID NO: 636659 - DNA, 25 bp, Homo sapien
tcatttctgccctcaaatctgtcag

SEQ ID NO: 636660 - DNA, 25 bp, Homo sapien
atttctgccctcaaatctgtcagtg

SEQ ID NO: 636661 - DNA, 25 bp, Homo sapien
tctgtcagtgcttgcctgtgcacat

SEQ ID NO: 636662 - DNA, 25 bp, Homo sapien
gtcagtgcttgcctgtgcacatttc

SEQ ID NO: 636663 - DNA, 25 bp, Homo sapien
cagtgcttgcctgtgcacatttctt

SEQ ID NO: 636664 - DNA, 25 bp, Homo sapien
ttttttccaccctgtcgctcaggct

SEQ ID NO: 636665 - DNA, 25 bp, Homo sapien
ttactcctaatacttttttgtatat

SEQ ID NO: 636666 - DNA, 25 bp, Homo sapien
gtatattaagactgttgcctggcat

SEQ ID NO: 636667 - DNA, 25 bp, Homo sapien
atattaagactgttgcctggcatgt

SEQ ID NO: 636668 - DNA, 25 bp, Homo sapien
ctgttgcctggcatgtaaatctcca

SEQ ID NO: 636669 - DNA, 25 bp, Homo sapien
gtaaatctccatgcatttgtttgcc

SEQ ID NO: 636670 - DNA, 25 bp, Homo sapien
atctccatgcatttgtttgcctagc

SEQ ID NO: 636671 - DNA, 25 bp, Homo sapien
ccatgcatttgtttgcctagctcac

SEQ ID NO: 636672 - DNA, 25 bp, Homo sapien
atacaaacctatacaataaccacag

SEQ ID NO: 636673 - DNA, 25 bp, Homo sapien
atacaataaccacagcaaactatct

SEQ ID NO: 636674 - DNA, 25 bp, Homo sapien
acagcaaactatctccaggtccctg

SEQ ID NO: 636675 - DNA, 25 bp, Homo sapien
aggtccctgaataagtgacattact

SEQ ID NO: 636676 - DNA, 25 bp, Homo sapien
gagactgctggctacaaggctaggt

SEQ ID NO: 636677 - DNA, 25 bp, Homo sapien
tgctggctacaaggctaggtaggta

SEQ ID NO: 636678 - DNA, 25 bp, Homo sapien
gtaggtaggaggtgatcgcaattat

SEQ ID NO: 636679 - DNA, 25 bp, Homo sapien
ggaggtgatcgcaattatttaaaca

SEQ ID NO: 636680 - DNA, 25 bp, Homo sapien
ggtttggctaatgaacagtttgcct

SEQ ID NO: 636681 - DNA, 25 bp, Homo sapien
tgaacagtttgcctttggttttgaa

SEQ ID NO: 636682 - DNA, 25 bp, Homo sapien
gattaaatctttcattcctggtgtc

SEQ ID NO: 636683 - DNA, 25 bp, Homo sapien
aaatctttcattcctggtgtcttat

SEQ ID NO: 636684 - DNA, 25 bp, Homo sapien
ctatgttttatgcactgttctcctc

SEQ ID NO: 636685 - DNA, 25 bp, Homo sapien
ttttatgcactgttctcctcctcta

SEQ ID NO: 636686 - DNA, 25 bp, Homo sapien
atcatatcctgaactagaaatgtta

SEQ ID NO: 636687 - DNA, 25 bp, Homo sapien
ggcagcctgcaatggaccctggaag

SEQ ID NO: 636688 - DNA, 25 bp, Homo sapien
agcctgcaatggaccctggaagagg

SEQ ID NO: 636689 - DNA, 25 bp, Homo sapien
gaggaaggagaccagcagttccact

SEQ ID NO: 636690 - DNA, 25 bp, Homo sapien
gaaggagaccagcagttccactatc

SEQ ID NO: 636691 - DNA, 25 bp, Homo sapien
aggagaccagcagttccactatcca

SEQ ID NO: 636692 - DNA, 25 bp, Homo sapien
agaccagcagttccactatccacag

SEQ ID NO: 636693 - DNA, 25 bp, Homo sapien
actatccacagccagatgacatgga

SEQ ID NO: 636694 - DNA, 25 bp, Homo sapien
ggctttgcacagctcagcagcacct

SEQ ID NO: 636695 - DNA, 25 bp, Homo sapien
agcacctgcctcaaaggcctagagc

SEQ ID NO: 636696 - DNA, 25 bp, Homo sapien
acctgcctcaaaggcctagagcagt

SEQ ID NO: 636697 - DNA, 25 bp, Homo sapien
tcatcctacttggccattagaatta

SEQ ID NO: 636698 - DNA, 25 bp, Homo sapien
ctcagacacaagaaaacagctagta

SEQ ID NO: 636699 - DNA, 25 bp, Homo sapien
cagctagtacgactgtttacatgat

SEQ ID NO: 636700 - DNA, 25 bp, Homo sapien
ttacatgatgtctgccttctactga

SEQ ID NO: 636701 - DNA, 25 bp, Homo sapien
atgtctgccttctactgagcagttg

SEQ ID NO: 636702 - DNA, 25 bp, Homo sapien
tactgagcagttgtcacctttccca

SEQ ID NO: 636703 - DNA, 25 bp, Homo sapien
tgtcacctttcccattgcagtgttg

SEQ ID NO: 636704 - DNA, 25 bp, Homo sapien
aaagtggccagttctactcttctta

SEQ ID NO: 636705 - DNA, 25 bp, Homo sapien
actcttcttagactgattatgcaat

SEQ ID NO: 636706 - DNA, 25 bp, Homo sapien
attgcttttcactctgtactttttc

SEQ ID NO: 636707 - DNA, 25 bp, Homo sapien
ccctgtctctaacttgatgcttact

SEQ ID NO: 636708 - DNA, 25 bp, Homo sapien
gatgcttactcttggctttttaaca

SEQ ID NO: 636709 - DNA, 25 bp, Homo sapien
aagcatgtgatacaggatactccag

SEQ ID NO: 636710 - DNA, 25 bp, Homo sapien
acaggatactccagcagccatttca

SEQ ID NO: 636711 - DNA, 25 bp, Homo sapien
agccatttcactaccacaagctgga

SEQ ID NO: 636712 - DNA, 25 bp, Homo sapien
ccacaagctggatcaacgtaagggt

SEQ ID NO: 636713 - DNA, 25 bp, Homo sapien
agacagagaaataacttgggcctat

SEQ ID NO: 636714 - DNA, 25 bp, Homo sapien
aacttgggcctatggttacatcact

SEQ ID NO: 636715 - DNA, 25 bp, Homo sapien
cctatggttacatcactgagctgct

SEQ ID NO: 636716 - DNA, 25 bp, Homo sapien
tgagctgctgcaccaagccttgcct

SEQ ID NO: 636717 - DNA, 25 bp, Homo sapien
ctcgtcctacttctttcacttataa

SEQ ID NO: 636718 - DNA, 25 bp, Homo sapien
agcatcaaagggaagcccagaatct

SEQ ID NO: 636719 - DNA, 25 bp, Homo sapien
gatggctggaggagagacttctctc

SEQ ID NO: 636720 - DNA, 25 bp, Homo sapien
catgtgcaaaggttctgtggcagga

SEQ ID NO: 636721 - DNA, 25 bp, Homo sapien
gaatgatggtgtatggtgactgccc

SEQ ID NO: 636722 - DNA, 25 bp, Homo sapien
atggtgactgcccatcttggtctac

SEQ ID NO: 636723 - DNA, 25 bp, Homo sapien
ttggtctaccccaggtagtccctat

SEQ ID NO: 636724 - DNA, 25 bp, Homo sapien
aggtagtccctattgtcttggctta

SEQ ID NO: 636725 - DNA, 25 bp, Homo sapien
gtccctattgtcttggcttattgat

SEQ ID NO: 636726 - DNA, 25 bp, Homo sapien
gattaatagcattctcttcctttct

SEQ ID NO: 636727 - DNA, 25 bp, Homo sapien
ttcctttctccaaagtggcctggtt

SEQ ID NO: 636728 - DNA, 25 bp, Homo sapien
ggtaaattatatggttgactaactg

SEQ ID NO: 636729 - DNA, 25 bp, Homo sapien
aagaagctggctggccacagtgtct

SEQ ID NO: 636730 - DNA, 25 bp, Homo sapien
ggccacagtgtctcacggctctaat

SEQ ID NO: 636731 - DNA, 25 bp, Homo sapien
gactactaatgtctgccatggaagt

SEQ ID NO: 636732 - DNA, 25 bp, Homo sapien
acttaagcactttgaaggctccaca

SEQ ID NO: 636733 - DNA, 25 bp, Homo sapien
gagtgtcatatttttgccagttctg

SEQ ID NO: 636734 - DNA, 25 bp, Homo sapien
ccagttctgactgaaggctctgact

SEQ ID NO: 636735 - DNA, 25 bp, Homo sapien
gacttcaaagcccaggatctttcta

SEQ ID NO: 636736 - DNA, 25 bp, Homo sapien
gatctttctagcctctacccagtgt

SEQ ID NO: 636737 - DNA, 25 bp, Homo sapien
agtgtcactgactttctagctcatt

SEQ ID NO: 636738 - DNA, 25 bp, Homo sapien
tagctcattgccctagtgaaattgg

SEQ ID NO: 636739 - DNA, 25 bp, Homo sapien
gaaggctccacattacaatgccaaa

SEQ ID NO: 636740 - DNA, 25 bp, Homo sapien
gtattggctgcctgtagtgctttag

SEQ ID NO: 636741 - DNA, 25 bp, Homo sapien
ttatgaggcctacttgaggctctga

SEQ ID NO: 636742 - DNA, 25 bp, Homo sapien
ttactttacattaagtgtttctggc

SEQ ID NO: 636743 - DNA, 25 bp, Homo sapien
ctttacattaagtgtttctggctgt

SEQ ID NO: 636744 - DNA, 25 bp, Homo sapien
gtttctggctgtgcgtgatggctca

SEQ ID NO: 636745 - DNA, 25 bp, Homo sapien
ggctgtgcgtgatggctcatgtctg

SEQ ID NO: 636746 - DNA, 25 bp, Homo sapien
cacactttgggacaccaaggccgga

SEQ ID NO: 636747 - DNA, 25 bp, Homo sapien
tggcaagacctcaactcttctaaat

SEQ ID NO: 636748 - DNA, 25 bp, Homo sapien
ggcaagacctcaactcttctaaata

SEQ ID NO: 636749 - DNA, 25 bp, Homo sapien
caagacctcaactcttctaaatatg

SEQ ID NO: 636750 - DNA, 25 bp, Homo sapien
tggtgtgcatctgtggttccacctg

SEQ ID NO: 636751 - DNA, 25 bp, Homo sapien
gtgtgcatctgtggttccacctgct

SEQ ID NO: 636752 - DNA, 25 bp, Homo sapien
atctgtggttccacctgctcgggag

SEQ ID NO: 636753 - DNA, 25 bp, Homo sapien
tttaatatcatgtcacactgcttgg

SEQ ID NO: 636754 - DNA, 25 bp, Homo sapien
aatatcatgtcacactgcttgggaa

SEQ ID NO: 636755 - DNA, 25 bp, Homo sapien
tatcatgtcacactgcttgggaaga

SEQ ID NO: 636756 - DNA, 25 bp, Homo sapien
tcatgtcacactgcttgggaagagg

SEQ ID NO: 636757 - DNA, 25 bp, Homo sapien
cttgggaagaggtcttgggttcatt

SEQ ID NO: 636758 - DNA, 25 bp, Homo sapien
gggaagaggtcttgggttcatttat

SEQ ID NO: 636759 - DNA, 25 bp, Homo sapien
ggtcttgggttcatttatgctgctt

SEQ ID NO: 636760 - DNA, 25 bp, Homo sapien
gtcttgggttcatttatgctgctta

SEQ ID NO: 636761 - DNA, 25 bp, Homo sapien
cttgggttcatttatgctgcttaga

SEQ ID NO: 636762 - DNA, 25 bp, Homo sapien
gggttcatttatgctgcttagaaac

SEQ ID NO: 636763 - DNA, 25 bp, Homo sapien
gttcatttatgctgcttagaaacct

SEQ ID NO: 636764 - DNA, 25 bp, Homo sapien
tcctcccggcagaaaggtcagacag

SEQ ID NO: 636765 - DNA, 25 bp, Homo sapien
gtcagacagaattttcttgcctatg

SEQ ID NO: 636766 - DNA, 25 bp, Homo sapien
cttgcctatgctgtgaagaggtgca

SEQ ID NO: 636767 - DNA, 25 bp, Homo sapien
aggtgcaggttaggccttgggacat

SEQ ID NO: 636768 - DNA, 25 bp, Homo sapien
tgggacatctccaaaagagtttaga

SEQ ID NO: 636769 - DNA, 25 bp, Homo sapien
aaaagagtttagattctccagtgca

SEQ ID NO: 636770 - DNA, 25 bp, Homo sapien
gcttcaagttgttgtgggagcacca

SEQ ID NO: 636771 - DNA, 25 bp, Homo sapien
gtgggagcaccaaagtgacacagcc

SEQ ID NO: 636772 - DNA, 25 bp, Homo sapien
caaagtgacacagccatgttggtgg

SEQ ID NO: 636773 - DNA, 25 bp, Homo sapien
ccatgttggtggctgatttcatagg

SEQ ID NO: 636774 - DNA, 25 bp, Homo sapien
gtggctgatttcataggtttctcat

SEQ ID NO: 636775 - DNA, 25 bp, Homo sapien
taattcattcatcttgcatccccaa

SEQ ID NO: 636776 - DNA, 25 bp, Homo sapien
ttgcatccccaagtaataaagttat

SEQ ID NO: 636777 - DNA, 25 bp, Homo sapien
gaaaatctctgtttgagtttgtctt

SEQ ID NO: 636778 - DNA, 25 bp, Homo sapien
gtttgtctttgccttgtaatacgta

SEQ ID NO: 636779 - DNA, 25 bp, Homo sapien
aatacgtatttgtcactaggcctcc

SEQ ID NO: 636780 - DNA, 25 bp, Homo sapien
tatttgtcactaggcctccattatt

SEQ ID NO: 636781 - DNA, 25 bp, Homo sapien
cactaggcctccattattaaataag

SEQ ID NO: 636782 - DNA, 25 bp, Homo sapien
gtattggatagcacattccatctga

SEQ ID NO: 636783 - DNA, 25 bp, Homo sapien
gcacattccatctgaatatttcaaa

SEQ ID NO: 636784 - DNA, 25 bp, Homo sapien
tttcaaattggcatggtcccttcta

SEQ ID NO: 636785 - DNA, 25 bp, Homo sapien
ggtcccttctaactggcattaattc

SEQ ID NO: 636786 - DNA, 25 bp, Homo sapien
aaagaggctatcttggtgcattcaa

SEQ ID NO: 636787 - DNA, 25 bp, Homo sapien
cggttatttccggtgatttcgcaat

SEQ ID NO: 636788 - DNA, 25 bp, Homo sapien
tatttccggtgatttcgcaattctt

SEQ ID NO: 636789 - DNA, 25 bp, Homo sapien
ggtgatttcgcaattcttcttcttc

SEQ ID NO: 636790 - DNA, 25 bp, Homo sapien
ttcttcttctttgaggaactgtggt

SEQ ID NO: 636791 - DNA, 25 bp, Homo sapien
tcttctttgaggaactgtggttttt

SEQ ID NO: 636792 - DNA, 25 bp, Homo sapien
caagtattcaagattgagctcctta

SEQ ID NO: 636793 - DNA, 25 bp, Homo sapien
agattgagctccttatcatctctgg

SEQ ID NO: 636794 - DNA, 25 bp, Homo sapien
ttgagctccttatcatctctggcaa

SEQ ID NO: 636795 - DNA, 25 bp, Homo sapien
agctccttatcatctctggcaagga

SEQ ID NO: 636796 - DNA, 25 bp, Homo sapien
cttatcatctctggcaaggaatgtg

SEQ ID NO: 636797 - DNA, 25 bp, Homo sapien
agttctaggacttctgttccacatg

SEQ ID NO: 636798 - DNA, 25 bp, Homo sapien
ggccaatccatgtagcctctacaga

SEQ ID NO: 636799 - DNA, 25 bp, Homo sapien
gcctctacagaaagatagccgactt

SEQ ID NO: 636800 - DNA, 25 bp, Homo sapien
gatagccgacttcttacatgcaagc

SEQ ID NO: 636801 - DNA, 25 bp, Homo sapien
acatgcaagctcagagttcccaaga

SEQ ID NO: 636802 - DNA, 25 bp, Homo sapien
ggtttagaactaacacactgtcact

SEQ ID NO: 636803 - DNA, 25 bp, Homo sapien
acactgtcacttctgttacattcta

SEQ ID NO: 636804 - DNA, 25 bp, Homo sapien
gaaataacaggcctagagtcaagag

SEQ ID NO: 636805 - DNA, 25 bp, Homo sapien
gggccaccaattgatgtaaccaact

SEQ ID NO: 636806 - DNA, 25 bp, Homo sapien
actaccacagattgtcactgggcaa

SEQ ID NO: 636807 - DNA, 25 bp, Homo sapien
aataaccacacgctctttacaaggg

SEQ ID NO: 636808 - DNA, 25 bp, Homo sapien
cccctgttgagctaagttttataat

SEQ ID NO: 636809 - DNA, 25 bp, Homo sapien
agttttataatcctcttgttacaga

SEQ ID NO: 636810 - DNA, 25 bp, Homo sapien
aatcctcttgttacagataactgag

SEQ ID NO: 636811 - DNA, 25 bp, Homo sapien
ggctgattctacatgtcttggactc

SEQ ID NO: 636812 - DNA, 25 bp, Homo sapien
tggactccaaggctactggttttcc

SEQ ID NO: 636813 - DNA, 25 bp, Homo sapien
caaggctactggttttccctgtgaa

SEQ ID NO: 636814 - DNA, 25 bp, Homo sapien
ttccctgtgaaccaccttgagatta

SEQ ID NO: 636815 - DNA, 25 bp, Homo sapien
gaagctgcaatatggctatctaagc

SEQ ID NO: 636816 - DNA, 25 bp, Homo sapien
ggctatctaagctgagtacttccct

SEQ ID NO: 636817 - DNA, 25 bp, Homo sapien
agctgagtacttccctacatacatt

SEQ ID NO: 636818 - DNA, 25 bp, Homo sapien
cttccctacatacattatcccattt

SEQ ID NO: 636819 - DNA, 25 bp, Homo sapien
ctaattacaatttctctcttctgtg

SEQ ID NO: 636820 - DNA, 25 bp, Homo sapien
aatttctctcttctgtgaattggct

SEQ ID NO: 636821 - DNA, 25 bp, Homo sapien
ctctcttctgtgaattggctggcat

SEQ ID NO: 636822 - DNA, 25 bp, Homo sapien
ttggctggcattatcacactgccat

SEQ ID NO: 636823 - DNA, 25 bp, Homo sapien
cacactgccatgaattactcttaaa

SEQ ID NO: 636824 - DNA, 25 bp, Homo sapien
tcttaaacagtacctttaccacaga

SEQ ID NO: 636825 - DNA, 25 bp, Homo sapien
gtacctttaccacagaaagaagtgt

SEQ ID NO: 636826 - DNA, 25 bp, Homo sapien
gaagtgttgataatgcagtcagaat

SEQ ID NO: 636827 - DNA, 25 bp, Homo sapien
gcagtcagaatagctggatgatgct

SEQ ID NO: 636828 - DNA, 25 bp, Homo sapien
accttttgacctcaatgaacatttc

SEQ ID NO: 636829 - DNA, 25 bp, Homo sapien
gaatcatattacctaagtacataca

SEQ ID NO: 636830 - DNA, 25 bp, Homo sapien
taaagcccatgatgttagcccggat

SEQ ID NO: 636831 - DNA, 25 bp, Homo sapien
atgttagcccggatcagtcctgttt

SEQ ID NO: 636832 - DNA, 25 bp, Homo sapien
cggatcagtcctgtttctcaaggtc

SEQ ID NO: 636833 - DNA, 25 bp, Homo sapien
tttctcaaggtctctcctacctgag

SEQ ID NO: 636834 - DNA, 25 bp, Homo sapien
gtctctcctacctgagatgtgctaa

SEQ ID NO: 636835 - DNA, 25 bp, Homo sapien
gggcagtacatgtgcattgctctca

SEQ ID NO: 636836 - DNA, 25 bp, Homo sapien
gcattgctctcatcactgccttggt

SEQ ID NO: 636837 - DNA, 25 bp, Homo sapien
ttggtccttagctctccgctcaaag

SEQ ID NO: 636838 - DNA, 25 bp, Homo sapien
tccgctcaaaggagggctggcctat

SEQ ID NO: 636839 - DNA, 25 bp, Homo sapien
ctggcctatggatgagacctgggtt

SEQ ID NO: 636840 - DNA, 25 bp, Homo sapien
atgagacctgggtttcattctctga

SEQ ID NO: 636841 - DNA, 25 bp, Homo sapien
agtttctgattataccctgactcca

SEQ ID NO: 636842 - DNA, 25 bp, Homo sapien
ccaccactgacgagctatgtaatat

SEQ ID NO: 636843 - DNA, 25 bp, Homo sapien
agtgatttgatttctctgagcgctg

SEQ ID NO: 636844 - DNA, 25 bp, Homo sapien
ttcccttccttcctaatgtgttgtg

SEQ ID NO: 636845 - DNA, 25 bp, Homo sapien
agcatgcacattgaaccgccagagt

SEQ ID NO: 636846 - DNA, 25 bp, Homo sapien
gagttatcaggtcagcctctgtaaa

SEQ ID NO: 636847 - DNA, 25 bp, Homo sapien
tgatggctcttcactgcctatgaga

SEQ ID NO: 636848 - DNA, 25 bp, Homo sapien
gtacaaatcttagtatggcattcaa

SEQ ID NO: 636849 - DNA, 25 bp, Homo sapien
tcaagattgttcacagcctaccttt

SEQ ID NO: 636850 - DNA, 25 bp, Homo sapien
cctacctttccactttgctattaga

SEQ ID NO: 636851 - DNA, 25 bp, Homo sapien
ggacttttggtcatgcacggtggct

SEQ ID NO: 636852 - DNA, 25 bp, Homo sapien
aagggattcaaagctaatgttgagt

SEQ ID NO: 636853 - DNA, 25 bp, Homo sapien
gagaatttaccattgctcattttgt

SEQ ID NO: 636854 - DNA, 25 bp, Homo sapien
taccattgctcattttgtaacctca

SEQ ID NO: 636855 - DNA, 25 bp, Homo sapien
gaaaatactagcttcagtttcctct

SEQ ID NO: 636856 - DNA, 25 bp, Homo sapien
tcttccctcctatcttgatgtgttt

SEQ ID NO: 636857 - DNA, 25 bp, Homo sapien
tcctatcttgatgtgttttctatat

SEQ ID NO: 636858 - DNA, 25 bp, Homo sapien
ttctatatacaaaactgactctgct

SEQ ID NO: 636859 - DNA, 25 bp, Homo sapien
atagcttagattcagctgtccctgg

SEQ ID NO: 636860 - DNA, 25 bp, Homo sapien
agctgtccctggagttgtttgccat

SEQ ID NO: 636861 - DNA, 25 bp, Homo sapien
ggagttgtttgccattcattctcag

SEQ ID NO: 636862 - DNA, 25 bp, Homo sapien
tgtttgccattcattctcagcacag

SEQ ID NO: 636863 - DNA, 25 bp, Homo sapien
ttctttaaagagatatccatatttt

SEQ ID NO: 636864 - DNA, 25 bp, Homo sapien
atccatatttttgagcactagtatg

SEQ ID NO: 636865 - DNA, 25 bp, Homo sapien
atatttttgagcactagtatgttcc

SEQ ID NO: 636866 - DNA, 25 bp, Homo sapien
acagagtaagtcctgttctcataaa

SEQ ID NO: 636867 - DNA, 25 bp, Homo sapien
gagtaagtcctgttctcataaagca

SEQ ID NO: 636868 - DNA, 25 bp, Homo sapien
gtaagtcctgttctcataaagcatg

SEQ ID NO: 636869 - DNA, 25 bp, Homo sapien
taagtcctgttctcataaagcatgt

SEQ ID NO: 636870 - DNA, 25 bp, Homo sapien
agtcctgttctcataaagcatgtgt

SEQ ID NO: 636871 - DNA, 25 bp, Homo sapien
gtcctgttctcataaagcatgtgtt

SEQ ID NO: 636872 - DNA, 25 bp, Homo sapien
cctgttctcataaagcatgtgttat

SEQ ID NO: 636873 - DNA, 25 bp, Homo sapien
cataaagcatgtgttataagagccc

SEQ ID NO: 636874 - DNA, 25 bp, Homo sapien
agattccttcaaacctagggatcct

SEQ ID NO: 636875 - DNA, 25 bp, Homo sapien
attccttcaaacctagggatcctga

SEQ ID NO: 636876 - DNA, 25 bp, Homo sapien
tgcagattctcagagggagagagtc

SEQ ID NO: 636877 - DNA, 25 bp, Homo sapien
aaaactacctactggataccatgct

SEQ ID NO: 636878 - DNA, 25 bp, Homo sapien
tacctactggataccatgctaagtg

SEQ ID NO: 636879 - DNA, 25 bp, Homo sapien
taccatgctaagtgatgcgatcctt

SEQ ID NO: 636880 - DNA, 25 bp, Homo sapien
gctaagtgatgcgatccttactgca

SEQ ID NO: 636881 - DNA, 25 bp, Homo sapien
agtgatgcgatccttactgcagacc

SEQ ID NO: 636882 - DNA, 25 bp, Homo sapien
atgcgatccttactgcagacctcag

SEQ ID NO: 636883 - DNA, 25 bp, Homo sapien
gatccttactgcagacctcagcatc

SEQ ID NO: 636884 - DNA, 25 bp, Homo sapien
gcagacctcagcatcacgcgatata

SEQ ID NO: 636885 - DNA, 25 bp, Homo sapien
aaagtggcttttccagagccagcat

SEQ ID NO: 636886 - DNA, 25 bp, Homo sapien
agccagcatcaaagaatcaagcact

SEQ ID NO: 636887 - DNA, 25 bp, Homo sapien
gaatcaagcactgaagacatagctg

SEQ ID NO: 636888 - DNA, 25 bp, Homo sapien
tgaagacatagctggctctgaggtg

SEQ ID NO: 636889 - DNA, 25 bp, Homo sapien
gcgggatcacagaccgcatgtcatc

SEQ ID NO: 636890 - DNA, 25 bp, Homo sapien
gggtatatctgtgtctagcaacgat

SEQ ID NO: 636891 - DNA, 25 bp, Homo sapien
ctgtgtctagcaacgatgtctcatg

SEQ ID NO: 636892 - DNA, 25 bp, Homo sapien
aacgatgtctcatggcgtgacagac

SEQ ID NO: 636893 - DNA, 25 bp, Homo sapien
catggcgtgacagactagaggatac

SEQ ID NO: 636894 - DNA, 25 bp, Homo sapien
gactagaggatacgcatccctggaa

SEQ ID NO: 636895 - DNA, 25 bp, Homo sapien
cgcatccctggaatgtgagtcaaca

SEQ ID NO: 636896 - DNA, 25 bp, Homo sapien
gagtaagttcagttactgtttttca

SEQ ID NO: 636897 - DNA, 25 bp, Homo sapien
aatgtttggcattctaccaactttt

SEQ ID NO: 636898 - DNA, 25 bp, Homo sapien
tttggcattctaccaactttttgtt

SEQ ID NO: 636899 - DNA, 25 bp, Homo sapien
gttataaatccaagagagagcacta

SEQ ID NO: 636900 - DNA, 25 bp, Homo sapien
agagcactaacatacttcttccttc

SEQ ID NO: 636901 - DNA, 25 bp, Homo sapien
cttcctcccaagtcaaacgtatata

SEQ ID NO: 636902 - DNA, 25 bp, Homo sapien
aacgtatatactacacccaacttgg

SEQ ID NO: 636903 - DNA, 25 bp, Homo sapien
gtatatactacacccaacttggtaa

SEQ ID NO: 636904 - DNA, 25 bp, Homo sapien
aacttggtaagttctgctctctctc

SEQ ID NO: 636905 - DNA, 25 bp, Homo sapien
tctgctctctctcttatggcaaagg

SEQ ID NO: 636906 - DNA, 25 bp, Homo sapien
gctctctctcttatggcaaagggaa

SEQ ID NO: 636907 - DNA, 25 bp, Homo sapien
gagagaactctgaggcatgtagttt

SEQ ID NO: 636908 - DNA, 25 bp, Homo sapien
atgtagtttacactggctcccagag

SEQ ID NO: 636909 - DNA, 25 bp, Homo sapien
gtagtttacactggctcccagagtc

SEQ ID NO: 636910 - DNA, 25 bp, Homo sapien
aagcctgataacacatgcctctatt

SEQ ID NO: 636911 - DNA, 25 bp, Homo sapien
gataacacatgcctctattggccac

SEQ ID NO: 636912 - DNA, 25 bp, Homo sapien
aacacatgcctctattggccacctt

SEQ ID NO: 636913 - DNA, 25 bp, Homo sapien
ttcacctcccagtaaattcctgtac

SEQ ID NO: 636914 - DNA, 25 bp, Homo sapien
acagatccttgtctccgggtctgct

SEQ ID NO: 636915 - DNA, 25 bp, Homo sapien
gataaggatgtctgctattctatta

SEQ ID NO: 636916 - DNA, 25 bp, Homo sapien
ggatgtctgctattctattacgatt

SEQ ID NO: 636917 - DNA, 25 bp, Homo sapien
attctattacgattcagcattttac

SEQ ID NO: 636918 - DNA, 25 bp, Homo sapien
tcagttcatactcttggtgacagtt

SEQ ID NO: 636919 - DNA, 25 bp, Homo sapien
agttcatactcttggtgacagtttg

SEQ ID NO: 636920 - DNA, 25 bp, Homo sapien
tttgtttttgtggactatttaggat

SEQ ID NO: 636921 - DNA, 25 bp, Homo sapien
ttttgtggactatttaggatactaa

SEQ ID NO: 636922 - DNA, 25 bp, Homo sapien
attgaaatagataggcttccggcca

SEQ ID NO: 636923 - DNA, 25 bp, Homo sapien
gaaatagataggcttccggccaagt

SEQ ID NO: 636924 - DNA, 25 bp, Homo sapien
aatagataggcttccggccaagtgc

SEQ ID NO: 636925 - DNA, 25 bp, Homo sapien
atagataggcttccggccaagtgca

SEQ ID NO: 636926 - DNA, 25 bp, Homo sapien
ataggcttccggccaagtgcagcag

SEQ ID NO: 636927 - DNA, 25 bp, Homo sapien
gcagcagctcatgcccacaatctca

SEQ ID NO: 636928 - DNA, 25 bp, Homo sapien
aaaataaatctagctgggttcagtg

SEQ ID NO: 636929 - DNA, 25 bp, Homo sapien
tgtcattttatcttcgaaaagtaat

SEQ ID NO: 636930 - DNA, 25 bp, Homo sapien
aggtcgcaaggtatgtatgacattt

SEQ ID NO: 636931 - DNA, 25 bp, Homo sapien
gtaatgtaatctcatataagactta

SEQ ID NO: 636932 - DNA, 25 bp, Homo sapien
gacttaagatataatccttttaaat

SEQ ID NO: 636933 - DNA, 25 bp, Homo sapien
ttttgtcatgtgttaataaagctca

SEQ ID NO: 636934 - DNA, 25 bp, Homo sapien
gtatgtatgacattttgacacagaa

SEQ ID NO: 636935 - DNA, 25 bp, Homo sapien
tgtatgacattttgacacagaatat

SEQ ID NO: 636936 - DNA, 25 bp, Homo sapien
gggattaagtgattgcttcttttta

SEQ ID NO: 636937 - DNA, 25 bp, Homo sapien
taagtgattgcttctttttaaggat

SEQ ID NO: 636938 - DNA, 25 bp, Homo sapien
gtgattgcttctttttaaggataaa

SEQ ID NO: 636939 - DNA, 25 bp, Homo sapien
aaggataaatgttttcaactgtcat

SEQ ID NO: 636940 - DNA, 25 bp, Homo sapien
tccagaagcagtcagctcttataat

SEQ ID NO: 636941 - DNA, 25 bp, Homo sapien
gcagtcagctcttataatcctagga

SEQ ID NO: 636942 - DNA, 25 bp, Homo sapien
ctcttataatcctaggagctcccca

SEQ ID NO: 636943 - DNA, 25 bp, Homo sapien
taggagctccccaaatttctgaatt

SEQ ID NO: 636944 - DNA, 25 bp, Homo sapien
ctgaattttctatttccattcattt

SEQ ID NO: 636945 - DNA, 25 bp, Homo sapien
tcatttctgccctcaaatctgtcag

SEQ ID NO: 636946 - DNA, 25 bp, Homo sapien
atttctgccctcaaatctgtcagtg

SEQ ID NO: 636947 - DNA, 25 bp, Homo sapien
tctgtcagtgcttgcctgtgcacat

SEQ ID NO: 636948 - DNA, 25 bp, Homo sapien
gtcagtgcttgcctgtgcacatttc

SEQ ID NO: 636949 - DNA, 25 bp, Homo sapien
tgcttgcctgtgcacatttcttatt

SEQ ID NO: 636950 - DNA, 25 bp, Homo sapien
ttttttccaccctgtcgctcaggct

SEQ ID NO: 636951 - DNA, 25 bp, Homo sapien
cttaaagttcaaaggtgagtctcct

SEQ ID NO: 636952 - DNA, 25 bp, Homo sapien
aaagttcaaaggtgagtctcctagc

SEQ ID NO: 636953 - DNA, 25 bp, Homo sapien
aagttcaaaggtgagtctcctagct

SEQ ID NO: 636954 - DNA, 25 bp, Homo sapien
agttcaaaggtgagtctcctagctc

SEQ ID NO: 636955 - DNA, 25 bp, Homo sapien
gttcaaaggtgagtctcctagctct

SEQ ID NO: 636956 - DNA, 25 bp, Homo sapien
ttcaaaggtgagtctcctagctcta

SEQ ID NO: 636957 - DNA, 25 bp, Homo sapien
tcaaaggtgagtctcctagctctat

SEQ ID NO: 636958 - DNA, 25 bp, Homo sapien
caaaggtgagtctcctagctctatt

SEQ ID NO: 636959 - DNA, 25 bp, Homo sapien
aaaaacactaatggccattgtgact

SEQ ID NO: 636960 - DNA, 25 bp, Homo sapien
aaacactaatggccattgtgacttt

SEQ ID NO: 636961 - DNA, 25 bp, Homo sapien
gtgttgtgtggatatgtaagtcaag

SEQ ID NO: 636962 - DNA, 25 bp, Homo sapien
tggcctcatattcctgttgtcattt

SEQ ID NO: 636963 - DNA, 25 bp, Homo sapien
atattcctgttgtcatttactggcg

SEQ ID NO: 636964 - DNA, 25 bp, Homo sapien
tcctgttgtcatttactggcgtagt

SEQ ID NO: 636965 - DNA, 25 bp, Homo sapien
actggcgtagtagacaattcataac

SEQ ID NO: 636966 - DNA, 25 bp, Homo sapien
attcataactgggaaaatcctttgg

SEQ ID NO: 636967 - DNA, 25 bp, Homo sapien
ggttttatagaatcagaggttccaa

SEQ ID NO: 636968 - DNA, 25 bp, Homo sapien
gaggttccaaaattgtgtttaactg

SEQ ID NO: 636969 - DNA, 25 bp, Homo sapien
ttgtgtttaactgattctatagaag

SEQ ID NO: 636970 - DNA, 25 bp, Homo sapien
caaaaacctttgtgccataaaatca

SEQ ID NO: 636971 - DNA, 25 bp, Homo sapien
taaaatcactatttaggccaggtgt

SEQ ID NO: 636972 - DNA, 25 bp, Homo sapien
cactttgagagaggcctaggcggga

SEQ ID NO: 636973 - DNA, 25 bp, Homo sapien
gtaaatggattacctttctgtccta

SEQ ID NO: 636974 - DNA, 25 bp, Homo sapien
tggattacctttctgtcctacagta

SEQ ID NO: 636975 - DNA, 25 bp, Homo sapien
tacctttctgtcctacagtaggtaa

SEQ ID NO: 636976 - DNA, 25 bp, Homo sapien
tacccaatatacatataggcttctc

SEQ ID NO: 636977 - DNA, 25 bp, Homo sapien
atataggcttctcaattacccggtt

SEQ ID NO: 636978 - DNA, 25 bp, Homo sapien
taggcttctcaattacccggttaat

SEQ ID NO: 636979 - DNA, 25 bp, Homo sapien
gctgttaagtcttctacttaaagac

SEQ ID NO: 636980 - DNA, 25 bp, Homo sapien
ggtgatttttatctctgcttttgta

SEQ ID NO: 636981 - DNA, 25 bp, Homo sapien
tctctgcttttgtaatctcagcaga

SEQ ID NO: 636982 - DNA, 25 bp, Homo sapien
aatctcagcagattgcctatgatgg

SEQ ID NO: 636983 - DNA, 25 bp, Homo sapien
cagcagattgcctatgatgggtatc

SEQ ID NO: 636984 - DNA, 25 bp, Homo sapien
agaatggctggaactcactgtgaga

SEQ ID NO: 636985 - DNA, 25 bp, Homo sapien
agaaatgcactttatggcaccccac

SEQ ID NO: 636986 - DNA, 25 bp, Homo sapien
tatggcaccccacataacacacata

SEQ ID NO: 636987 - DNA, 25 bp, Homo sapien
tctccaaaatacacttaaggtgcaa

SEQ ID NO: 636988 - DNA, 25 bp, Homo sapien
aggtgcaaattaccctgatgttttc

SEQ ID NO: 636989 - DNA, 25 bp, Homo sapien
ttttctatgttatcctatcccatcc

SEQ ID NO: 636990 - DNA, 25 bp, Homo sapien
tatgttatcctatcccatcccttgc

SEQ ID NO: 636991 - DNA, 25 bp, Homo sapien
aaaatgcgaattatgacctacctaa

SEQ ID NO: 636992 - DNA, 25 bp, Homo sapien
ttatgacctacctaaatgactttac

SEQ ID NO: 636993 - DNA, 25 bp, Homo sapien
aatgactttacaacctacaatttga

SEQ ID NO: 636994 - DNA, 25 bp, Homo sapien
ttacttaattggtggatttctcggg

SEQ ID NO: 636995 - DNA, 25 bp, Homo sapien
gaatgagctggtagaaatagttctt

SEQ ID NO: 636996 - DNA, 25 bp, Homo sapien
gggaagcattattagcttttctcta

SEQ ID NO: 636997 - DNA, 25 bp, Homo sapien
agcttttctctaagcattagtgtgg

SEQ ID NO: 636998 - DNA, 25 bp, Homo sapien
ctctaagcattagtgtggttttcta

SEQ ID NO: 636999 - DNA, 25 bp, Homo sapien
tattcagaattaataggcacctatc

SEQ ID NO: 637000 - DNA, 25 bp, Homo sapien
aaactcatggctctattataaaagg

SEQ ID NO: 637001 - DNA, 25 bp, Homo sapien
taaaaggttctctcagggtcagctt

SEQ ID NO: 637002 - DNA, 25 bp, Homo sapien
aaggttctctcagggtcagctttac

SEQ ID NO: 637003 - DNA, 25 bp, Homo sapien
tcagctttacccgtgggtggaatgg

SEQ ID NO: 637004 - DNA, 25 bp, Homo sapien
ggatttcctccaaatagcttcttta

SEQ ID NO: 637005 - DNA, 25 bp, Homo sapien
agcttctttatctattcactgtttg

SEQ ID NO: 637006 - DNA, 25 bp, Homo sapien
atgattcacactcaaaggactcttg

SEQ ID NO: 637007 - DNA, 25 bp, Homo sapien
gaactttgttgtttagtctggcaaa

SEQ ID NO: 637008 - DNA, 25 bp, Homo sapien
aatgaaaaccatgctccctgaatct

SEQ ID NO: 637009 - DNA, 25 bp, Homo sapien
tccctgaatcttccagctatctatg

SEQ ID NO: 637010 - DNA, 25 bp, Homo sapien
cagctatctatgtgaaatgctctta

SEQ ID NO: 637011 - DNA, 25 bp, Homo sapien
gctcttaatttcataggtggttggt

SEQ ID NO: 637012 - DNA, 25 bp, Homo sapien
aattactttcgacatgtgaatgaaa

SEQ ID NO: 637013 - DNA, 25 bp, Homo sapien
aatgacatcatctttgccaaacaat

SEQ ID NO: 637014 - DNA, 25 bp, Homo sapien
atctttgccaaacaatgtgcagtga

SEQ ID NO: 637015 - DNA, 25 bp, Homo sapien
agagaccaccttccttatggcatgt

SEQ ID NO: 637016 - DNA, 25 bp, Homo sapien
ccaccttccttatggcatgtttcat

SEQ ID NO: 637017 - DNA, 25 bp, Homo sapien
ttctcttctctattgttgggttttt

SEQ ID NO: 637018 - DNA, 25 bp, Homo sapien
ttttttgtaaagttgctcaaatgct

SEQ ID NO: 637019 - DNA, 25 bp, Homo sapien
tcctttggaaagcactaatgaataa

SEQ ID NO: 637020 - DNA, 25 bp, Homo sapien
atgaataagtgctgtttctcttctc

SEQ ID NO: 637021 - DNA, 25 bp, Homo sapien
gaataagtgctgtttctcttctcta

SEQ ID NO: 637022 - DNA, 25 bp, Homo sapien
ataagtgctgtttctcttctctatt

SEQ ID NO: 637023 - DNA, 25 bp, Homo sapien
aagtgctgtttctcttctctattgt

SEQ ID NO: 637024 - DNA, 25 bp, Homo sapien
gtgctgtttctcttctctattgttg

SEQ ID NO: 637025 - DNA, 25 bp, Homo sapien
gctgtttctcttctctattgttggg

SEQ ID NO: 637026 - DNA, 25 bp, Homo sapien
tgtttctcttctctattgttgggtt

SEQ ID NO: 637027 - DNA, 25 bp, Homo sapien
gtttctcttctctattgttgggttt

SEQ ID NO: 637028 - DNA, 25 bp, Homo sapien
aagcctcagaaaatgtatcacgtat

SEQ ID NO: 637029 - DNA, 25 bp, Homo sapien
atgtatcacgtatattttctcagaa

SEQ ID NO: 637030 - DNA, 25 bp, Homo sapien
aaaactatttgaggagaccctccat

SEQ ID NO: 637031 - DNA, 25 bp, Homo sapien
gaaacagaacctaacacagatatga

SEQ ID NO: 637032 - DNA, 25 bp, Homo sapien
ggaaatcacaagcacaattagtaaa

SEQ ID NO: 637033 - DNA, 25 bp, Homo sapien
aatatctcaattcggaagccccagg

SEQ ID NO: 637034 - DNA, 25 bp, Homo sapien
ctacgtcccaggtagagggcatgtt

SEQ ID NO: 637035 - DNA, 25 bp, Homo sapien
gggcatgttgaaggccatcatcact

SEQ ID NO: 637036 - DNA, 25 bp, Homo sapien
catcactggatgttctgttctactg

SEQ ID NO: 637037 - DNA, 25 bp, Homo sapien
gatgttctgttctactgtacaacct

SEQ ID NO: 637038 - DNA, 25 bp, Homo sapien
tactgtacaaccttttcaaccccag

SEQ ID NO: 637039 - DNA, 25 bp, Homo sapien
cggttatttccggtgatttcgcaat

SEQ ID NO: 637040 - DNA, 25 bp, Homo sapien
gttatttccggtgatttcgcaattc

SEQ ID NO: 637041 - DNA, 25 bp, Homo sapien
tatttccggtgatttcgcaattctt

SEQ ID NO: 637042 - DNA, 25 bp, Homo sapien
caagtattcaagattgagctcctta

SEQ ID NO: 637043 - DNA, 25 bp, Homo sapien
attcaagattgagctccttatcatc

SEQ ID NO: 637044 - DNA, 25 bp, Homo sapien
aagattgagctccttatcatctctg

SEQ ID NO: 637045 - DNA, 25 bp, Homo sapien
gattgagctccttatcatctctggc

SEQ ID NO: 637046 - DNA, 25 bp, Homo sapien
ttgagctccttatcatctctggcaa

SEQ ID NO: 637047 - DNA, 25 bp, Homo sapien
gagctccttatcatctctggcaagg

SEQ ID NO: 637048 - DNA, 25 bp, Homo sapien
gctccttatcatctctggcaaggaa

SEQ ID NO: 637049 - DNA, 25 bp, Homo sapien
cttatcatctctggcaaggaatgtg

SEQ ID NO: 637050 - DNA, 25 bp, Homo sapien
gaacatccaacaaacctgtgtcaca

SEQ ID NO: 637051 - DNA, 25 bp, Homo sapien
aacattcatgtgtttgcagattgaa

SEQ ID NO: 637052 - DNA, 25 bp, Homo sapien
gtttgcagattgaatgttacattct

SEQ ID NO: 637053 - DNA, 25 bp, Homo sapien
actccacagttttcatgggaatcca

SEQ ID NO: 637054 - DNA, 25 bp, Homo sapien
aacacagactaaatgtcccagcgag

SEQ ID NO: 637055 - DNA, 25 bp, Homo sapien
gactaaatgtcccagcgagaacttt

SEQ ID NO: 637056 - DNA, 25 bp, Homo sapien
aatgtcccagcgagaactttgtatt

SEQ ID NO: 637057 - DNA, 25 bp, Homo sapien
gtcccagcgagaactttgtattaaa

SEQ ID NO: 637058 - DNA, 25 bp, Homo sapien
ttgtattaaaaacctcaggaggccg

SEQ ID NO: 637059 - DNA, 25 bp, Homo sapien
aatgatgggtcttattagtatgaga

SEQ ID NO: 637060 - DNA, 25 bp, Homo sapien
cacatcttcagtgaacatccaacaa

SEQ ID NO: 637061 - DNA, 25 bp, Homo sapien
aacatcgggcagaagaaacatttat

SEQ ID NO: 637062 - DNA, 25 bp, Homo sapien
caaactggctttctcaatatgacta

SEQ ID NO: 637063 - DNA, 25 bp, Homo sapien
attctgctgagctcaaactttacat

SEQ ID NO: 637064 - DNA, 25 bp, Homo sapien
ggaataaccacatgtagatactgca

SEQ ID NO: 637065 - DNA, 25 bp, Homo sapien
gatactgcagagatcaacttggcta

SEQ ID NO: 637066 - DNA, 25 bp, Homo sapien
gatcaacttggctagtggactctga

SEQ ID NO: 637067 - DNA, 25 bp, Homo sapien
ggctagtggactctgatgctgaaaa

SEQ ID NO: 637068 - DNA, 25 bp, Homo sapien
cacactggaccaggtttgaatctga

SEQ ID NO: 637069 - DNA, 25 bp, Homo sapien
gaatctgagttcagctactcaccaa

SEQ ID NO: 637070 - DNA, 25 bp, Homo sapien
aaccataacctctctgatctttcaa

SEQ ID NO: 637071 - DNA, 25 bp, Homo sapien
gatctttcaactactacctttataa

SEQ ID NO: 637072 - DNA, 25 bp, Homo sapien
tagtggtttatttctcggctttcaa

SEQ ID NO: 637073 - DNA, 25 bp, Homo sapien
atttctcggctttcaattctgttcc

SEQ ID NO: 637074 - DNA, 25 bp, Homo sapien
gatttatgtgtctgttgctattgtg

SEQ ID NO: 637075 - DNA, 25 bp, Homo sapien
gggtagtgtacagtctccatttttg

SEQ ID NO: 637076 - DNA, 25 bp, Homo sapien
cagtctccatttttgttcctctttt

SEQ ID NO: 637077 - DNA, 25 bp, Homo sapien
aatgttgggttttgactatcctagg

SEQ ID NO: 637078 - DNA, 25 bp, Homo sapien
tgactatcctaggtcctttgcattt

SEQ ID NO: 637079 - DNA, 25 bp, Homo sapien
tttgcatttccatgtacgttttagg

SEQ ID NO: 637080 - DNA, 25 bp, Homo sapien
gtacgttttaggatcagcctgttga

SEQ ID NO: 637081 - DNA, 25 bp, Homo sapien
aaaagaccatcctttcttcctgaat

SEQ ID NO: 637082 - DNA, 25 bp, Homo sapien
gaattcccttggcagaatcaactgg

SEQ ID NO: 637083 - DNA, 25 bp, Homo sapien
aagaacttgcctctgaagccccttg

SEQ ID NO: 637084 - DNA, 25 bp, Homo sapien
agccccttggttggaggaggacaca

SEQ ID NO: 637085 - DNA, 25 bp, Homo sapien
aggacacacggctcacaagaatgga

SEQ ID NO: 637086 - DNA, 25 bp, Homo sapien
agggagagcccacggtgaacccaat

SEQ ID NO: 637087 - DNA, 25 bp, Homo sapien
ggtgaacccaattctggattcatta

SEQ ID NO: 637088 - DNA, 25 bp, Homo sapien
aaaacatgcctgagggctctggaga

SEQ ID NO: 637089 - DNA, 25 bp, Homo sapien
tgagtatattatttgccaagcactt

SEQ ID NO: 637090 - DNA, 25 bp, Homo sapien
agaatgtcccagtggtcccaggccc

SEQ ID NO: 637091 - DNA, 25 bp, Homo sapien
gccctctggaaaaacactctctgga

SEQ ID NO: 637092 - DNA, 25 bp, Homo sapien
aaaacactctctggaacagttgcag

SEQ ID NO: 637093 - DNA, 25 bp, Homo sapien
gaacagttgcaggaggtgagaccaa

SEQ ID NO: 637094 - DNA, 25 bp, Homo sapien
ttgaatgaatgtgagctgtgtatac

SEQ ID NO: 637095 - DNA, 25 bp, Homo sapien
cctcttccagttcagggtctcaatg

SEQ ID NO: 637096 - DNA, 25 bp, Homo sapien
ttccagttcagggtctcaatggctg

SEQ ID NO: 637097 - DNA, 25 bp, Homo sapien
aatggctggagcctttcttggcaat

SEQ ID NO: 637098 - DNA, 25 bp, Homo sapien
agcctttcttggcaattcagagtcc

SEQ ID NO: 637099 - DNA, 25 bp, Homo sapien
tggcaattcagagtccaagttggga

SEQ ID NO: 637100 - DNA, 25 bp, Homo sapien
gtccaagttgggaaccagccctgaa

SEQ ID NO: 637101 - DNA, 25 bp, Homo sapien
gaaccagccctgaactggacgccat

SEQ ID NO: 637102 - DNA, 25 bp, Homo sapien
ggacgccatcccagcacagggtgct

SEQ ID NO: 637103 - DNA, 25 bp, Homo sapien
acgctcacagactgggccgcgtaga

SEQ ID NO: 637104 - DNA, 25 bp, Homo sapien
actgggccgcgtagacacatccatt

SEQ ID NO: 637105 - DNA, 25 bp, Homo sapien
atctatgaattttcccagttttcat

SEQ ID NO: 637106 - DNA, 25 bp, Homo sapien
aaattcctaaatcccagtgctactc

SEQ ID NO: 637107 - DNA, 25 bp, Homo sapien
tcctaaatcccagtgctactctatt

SEQ ID NO: 637108 - DNA, 25 bp, Homo sapien
agtgctactctattccctattattc

SEQ ID NO: 637109 - DNA, 25 bp, Homo sapien
ctactctattccctattattccagg

SEQ ID NO: 637110 - DNA, 25 bp, Homo sapien
tattccctattattccaggaccatt

SEQ ID NO: 637111 - DNA, 25 bp, Homo sapien
tccaggaccatttccaaaaccaaag

SEQ ID NO: 637112 - DNA, 25 bp, Homo sapien
aaccaaagctaccagaacagcttag

SEQ ID NO: 637113 - DNA, 25 bp, Homo sapien
aacagcttagaaatcattaggcggg

SEQ ID NO: 637114 - DNA, 25 bp, Homo sapien
gggttgaaaaatagactcttagatt

SEQ ID NO: 637115 - DNA, 25 bp, Homo sapien
tagatttaaatatacggttttggtg

SEQ ID NO: 637116 - DNA, 25 bp, Homo sapien
agaatatggggtaggctgggtgcag

SEQ ID NO: 637117 - DNA, 25 bp, Homo sapien
gctgggtgcagtggtcacagctgta

SEQ ID NO: 637118 - DNA, 25 bp, Homo sapien
ctgggtgcagtggtcacagctgtaa

SEQ ID NO: 637119 - DNA, 25 bp, Homo sapien
gcagtggtcacagctgtaattccag

SEQ ID NO: 637120 - DNA, 25 bp, Homo sapien
cagtggtcacagctgtaattccagc

SEQ ID NO: 637121 - DNA, 25 bp, Homo sapien
agtggtcacagctgtaattccagca

SEQ ID NO: 637122 - DNA, 25 bp, Homo sapien
gtggtcacagctgtaattccagcac

SEQ ID NO: 637123 - DNA, 25 bp, Homo sapien
tagctactcagaaagttgaagtggg

SEQ ID NO: 637124 - DNA, 25 bp, Homo sapien
gatcccttgagccctgggaagttga

SEQ ID NO: 637125 - DNA, 25 bp, Homo sapien
atcccttgagccctgggaagttgag

SEQ ID NO: 637126 - DNA, 25 bp, Homo sapien
tcccttgagccctgggaagttgagg

SEQ ID NO: 637127 - DNA, 25 bp, Homo sapien
ttgctaggtttcgttttctacttct

SEQ ID NO: 637128 - DNA, 25 bp, Homo sapien
gctaggtttcgttttctacttctca

SEQ ID NO: 637129 - DNA, 25 bp, Homo sapien
gtttcgttttctacttctcaactct

SEQ ID NO: 637130 - DNA, 25 bp, Homo sapien
gttttctacttctcaactctgacag

SEQ ID NO: 637131 - DNA, 25 bp, Homo sapien
ttctcaactctgacagtagccactg

SEQ ID NO: 637132 - DNA, 25 bp, Homo sapien
aactctgacagtagccactgggagg

SEQ ID NO: 637133 - DNA, 25 bp, Homo sapien
ctgacagtagccactgggaggtaat

SEQ ID NO: 637134 - DNA, 25 bp, Homo sapien
gtagccactgggaggtaataatatt

SEQ ID NO: 637135 - DNA, 25 bp, Homo sapien
ccactgggaggtaataatattgact

SEQ ID NO: 637136 - DNA, 25 bp, Homo sapien
aatgtacatgcacgttaaatctttc

SEQ ID NO: 637137 - DNA, 25 bp, Homo sapien
acatgcacgttaaatctttcagatt

SEQ ID NO: 637138 - DNA, 25 bp, Homo sapien
aagcttggccattcaacatggcata

SEQ ID NO: 637139 - DNA, 25 bp, Homo sapien
ggcatatttctgaaaatactgactt

SEQ ID NO: 637140 - DNA, 25 bp, Homo sapien
gtatttattctcctatatctgccaa

SEQ ID NO: 637141 - DNA, 25 bp, Homo sapien
ttattctcctatatctgccaagtga

SEQ ID NO: 637142 - DNA, 25 bp, Homo sapien
tctgccaagtgagaccacagtgcct

SEQ ID NO: 637143 - DNA, 25 bp, Homo sapien
ggattcatgaggaaggtctatctag

SEQ ID NO: 637144 - DNA, 25 bp, Homo sapien
acagcagcctctttaattgtagaaa

SEQ ID NO: 637145 - DNA, 25 bp, Homo sapien
gactgtatcagtgaaaagccaagaa

SEQ ID NO: 637146 - DNA, 25 bp, Homo sapien
gagagaattcctaaggtattctaaa

SEQ ID NO: 637147 - DNA, 25 bp, Homo sapien
tcttcttttatgtaatccatcttgc

SEQ ID NO: 637148 - DNA, 25 bp, Homo sapien
atgtaatccatcttgcttatatgtc

SEQ ID NO: 637149 - DNA, 25 bp, Homo sapien
gaagcagatatgttaatatttgaca

SEQ ID NO: 637150 - DNA, 25 bp, Homo sapien
ttccattttaaactatcccattgct

SEQ ID NO: 637151 - DNA, 25 bp, Homo sapien
cattttaaactatcccattgcttgt

SEQ ID NO: 637152 - DNA, 25 bp, Homo sapien
taaactatcccattgcttgtttcaa

SEQ ID NO: 637153 - DNA, 25 bp, Homo sapien
aactatcccattgcttgtttcaaat

SEQ ID NO: 637154 - DNA, 25 bp, Homo sapien
atcccattgcttgtttcaaatgcct

SEQ ID NO: 637155 - DNA, 25 bp, Homo sapien
ccattgcttgtttcaaatgcctaag

SEQ ID NO: 637156 - DNA, 25 bp, Homo sapien
tgcttgtttcaaatgcctaagaaaa

SEQ ID NO: 637157 - DNA, 25 bp, Homo sapien
gaaaatgtgtcaatcttaaaacaga

SEQ ID NO: 637158 - DNA, 25 bp, Homo sapien
cagaagagcatatgttgttaacttt

SEQ ID NO: 637159 - DNA, 25 bp, Homo sapien
gcatatgttgttaactttattcaca

SEQ ID NO: 637160 - DNA, 25 bp, Homo sapien
gaattgatgtagacctaccttgcaa

SEQ ID NO: 637161 - DNA, 25 bp, Homo sapien
gatgtagacctaccttgcaaagaag

SEQ ID NO: 637162 - DNA, 25 bp, Homo sapien
gacctaccttgcaaagaaggattac

SEQ ID NO: 637163 - DNA, 25 bp, Homo sapien
atggtgtaggtcagaaacttgggtc

SEQ ID NO: 637164 - DNA, 25 bp, Homo sapien
agaaacttgggtctgcataagcaac

SEQ ID NO: 637165 - DNA, 25 bp, Homo sapien
gtctgcataagcaacagggagcatc

SEQ ID NO: 637166 - DNA, 25 bp, Homo sapien
tcaggaaagaagttaggttgtcaat

SEQ ID NO: 637167 - DNA, 25 bp, Homo sapien
ggttgtcaataaaagagccacgaga

SEQ ID NO: 637168 - DNA, 25 bp, Homo sapien
ttgctgctttctgaatcactgatga

SEQ ID NO: 637169 - DNA, 25 bp, Homo sapien
ctgaatcactgatgaatctgagtca

SEQ ID NO: 637170 - DNA, 25 bp, Homo sapien
gatgaatctgagtcagttaaggtat

SEQ ID NO: 637171 - DNA, 25 bp, Homo sapien
gccggcctggccaggactgagtgca

SEQ ID NO: 637172 - DNA, 25 bp, Homo sapien
aagaatgcagctttattcatgtcca

SEQ ID NO: 637173 - DNA, 25 bp, Homo sapien
tgcagctttattcatgtccattggg

SEQ ID NO: 637174 - DNA, 25 bp, Homo sapien
attcatgtccattggggcagctcaa

SEQ ID NO: 637175 - DNA, 25 bp, Homo sapien
gggcagctcaaaacgtagttgataa

SEQ ID NO: 637176 - DNA, 25 bp, Homo sapien
aaaacgtagttgataaatctattca

SEQ ID NO: 637177 - DNA, 25 bp, Homo sapien
atttattttcctagtagaagccctg

SEQ ID NO: 637178 - DNA, 25 bp, Homo sapien
ttttcctagtagaagccctgaaggg

SEQ ID NO: 637179 - DNA, 25 bp, Homo sapien
ggttgtttgctgtttgttgaaatga

SEQ ID NO: 637180 - DNA, 25 bp, Homo sapien
gttgaaatgaaatccacgtaacata

SEQ ID NO: 637181 - DNA, 25 bp, Homo sapien
aatccacgtaacataaagcggactg

SEQ ID NO: 637182 - DNA, 25 bp, Homo sapien
atttgcggtctgaaatgcagaagac

SEQ ID NO: 637183 - DNA, 25 bp, Homo sapien
ggcttgaggagctctgacactggtc

SEQ ID NO: 637184 - DNA, 25 bp, Homo sapien
tgaggagctctgacactggtcaggt

SEQ ID NO: 637185 - DNA, 25 bp, Homo sapien
gtagctgtcttccacatcgttgatc

SEQ ID NO: 637186 - DNA, 25 bp, Homo sapien
ttccacatcgttgatccagcggtca

SEQ ID NO: 637187 - DNA, 25 bp, Homo sapien
atcgttgatccagcggtcatcccag

SEQ ID NO: 637188 - DNA, 25 bp, Homo sapien
agcggtcatcccagtccactcggag

SEQ ID NO: 637189 - DNA, 25 bp, Homo sapien
actcggaggcccaacaggtgaattg

SEQ ID NO: 637190 - DNA, 25 bp, Homo sapien
aattgggaggaagccgttctcagcc

SEQ ID NO: 637191 - DNA, 25 bp, Homo sapien
aggaagccgttctcagccagaatca

SEQ ID NO: 637192 - DNA, 25 bp, Homo sapien
gattcccatctgataaacaaatgtt

SEQ ID NO: 637193 - DNA, 25 bp, Homo sapien
tgcactgcatggcatccgataggct

SEQ ID NO: 637194 - DNA, 25 bp, Homo sapien
gcatggcatccgataggcttgaaga

SEQ ID NO: 637195 - DNA, 25 bp, Homo sapien
catccgataggcttgaagaaggcgt

SEQ ID NO: 637196 - DNA, 25 bp, Homo sapien
cttgaagaaggcgtgaatgacattc

SEQ ID NO: 637197 - DNA, 25 bp, Homo sapien
gaatgacattcaaagggccacatca

SEQ ID NO: 637198 - DNA, 25 bp, Homo sapien
agggccacatcatctaagtcgcact

SEQ ID NO: 637199 - DNA, 25 bp, Homo sapien
catcccttgttgtcctttacatgat

SEQ ID NO: 637200 - DNA, 25 bp, Homo sapien
gttgtcctttacatgattcccattc

SEQ ID NO: 637201 - DNA, 25 bp, Homo sapien
atgattcccattcatctttcttctc

SEQ ID NO: 637202 - DNA, 25 bp, Homo sapien
gctggtgaatgtttaacagccactc

SEQ ID NO: 637203 - DNA, 25 bp, Homo sapien
tttaacagccactccatgaaaaaat

SEQ ID NO: 637204 - DNA, 25 bp, Homo sapien
tgatgtggtatcacacttacgtgtg

SEQ ID NO: 637205 - DNA, 25 bp, Homo sapien
tcaaaccttcttcctacaggttggc

SEQ ID NO: 637206 - DNA, 25 bp, Homo sapien
cttcttcctacaggttggcactttg

SEQ ID NO: 637207 - DNA, 25 bp, Homo sapien
cactttgcccacctgacatgaaaaa

SEQ ID NO: 637208 - DNA, 25 bp, Homo sapien
ggctaaaactcacttgtcctgtaaa

SEQ ID NO: 637209 - DNA, 25 bp, Homo sapien
tcacttgtcctgtaaacaactgaag

SEQ ID NO: 637210 - DNA, 25 bp, Homo sapien
acaactgaagacaagccagtctttg

SEQ ID NO: 637211 - DNA, 25 bp, Homo sapien
gccagtctttgagatgaaagcctgc

SEQ ID NO: 637212 - DNA, 25 bp, Homo sapien
agatgaaagcctgcaggtgctagcc

SEQ ID NO: 637213 - DNA, 25 bp, Homo sapien
ggtttttactcacatatgcccatag

SEQ ID NO: 637214 - DNA, 25 bp, Homo sapien
atatgcccatagaagctgtgtgtaa

SEQ ID NO: 637215 - DNA, 25 bp, Homo sapien
tttcaggctgtactgcattatgact

SEQ ID NO: 637216 - DNA, 25 bp, Homo sapien
gtactgcattatgactgcacctgtg

SEQ ID NO: 637217 - DNA, 25 bp, Homo sapien
gcattatgactgcacctgtgaatag

SEQ ID NO: 637218 - DNA, 25 bp, Homo sapien
tttactacaggttcacaaaaggcat

SEQ ID NO: 637219 - DNA, 25 bp, Homo sapien
ttctcaaatagccaaagcctcctat

SEQ ID NO: 637220 - DNA, 25 bp, Homo sapien
tagccaaagcctcctatatatcttc

SEQ ID NO: 637221 - DNA, 25 bp, Homo sapien
aaagcctcctatatatcttctcttg

SEQ ID NO: 637222 - DNA, 25 bp, Homo sapien
gcctcctatatatcttctcttgttt

SEQ ID NO: 637223 - DNA, 25 bp, Homo sapien
ctcttgtttatcattcataggtatg

SEQ ID NO: 637224 - DNA, 25 bp, Homo sapien
atttattcctgtgctagtaatttgc

SEQ ID NO: 637225 - DNA, 25 bp, Homo sapien
ttcctgtgctagtaatttgcatatt

SEQ ID NO: 637226 - DNA, 25 bp, Homo sapien
aaaatagttgtgttagctgggcgca

SEQ ID NO: 637227 - DNA, 25 bp, Homo sapien
aaatagttgtgttagctgggcgcag

SEQ ID NO: 637228 - DNA, 25 bp, Homo sapien
aatagttgtgttagctgggcgcagt

SEQ ID NO: 637229 - DNA, 25 bp, Homo sapien
tggattagtggaggtcagcagtttg

SEQ ID NO: 637230 - DNA, 25 bp, Homo sapien
gtgtggtgacatatgccagtagtcc

SEQ ID NO: 637231 - DNA, 25 bp, Homo sapien
ggaggtcaaggttgtactgagccaa

SEQ ID NO: 637232 - DNA, 25 bp, Homo sapien
ggtcaaggttgtactgagccaagat

SEQ ID NO: 637233 - DNA, 25 bp, Homo sapien
gactgggcaacagggttagactcct

SEQ ID NO: 637234 - DNA, 25 bp, Homo sapien
ctgggcaacagggttagactccttt

SEQ ID NO: 637235 - DNA, 25 bp, Homo sapien
ggcaacagggttagactccttttca

SEQ ID NO: 637236 - DNA, 25 bp, Homo sapien
gcaacagggttagactccttttcaa

SEQ ID NO: 637237 - DNA, 25 bp, Homo sapien
tctgctgtttgcctcaggatgtaca

SEQ ID NO: 637238 - DNA, 25 bp, Homo sapien
ggatgtacatacagagatgtgctga

SEQ ID NO: 637239 - DNA, 25 bp, Homo sapien
gatgtgctgattctcagaacttcta

SEQ ID NO: 637240 - DNA, 25 bp, Homo sapien
atagaattccattagccagtcctgc

SEQ ID NO: 637241 - DNA, 25 bp, Homo sapien
agccagtcctgccaattgaaatttg

SEQ ID NO: 637242 - DNA, 25 bp, Homo sapien
attcttgcctaggaaaggagctcgt

SEQ ID NO: 637243 - DNA, 25 bp, Homo sapien
aaggagctcgtcacatacctagttt

SEQ ID NO: 637244 - DNA, 25 bp, Homo sapien
cacatacctagtttagtgatggaaa

SEQ ID NO: 637245 - DNA, 25 bp, Homo sapien
gggctcaggctcaagaatacaatga

SEQ ID NO: 637246 - DNA, 25 bp, Homo sapien
gaagcctttcttccaatagcagaga

SEQ ID NO: 637247 - DNA, 25 bp, Homo sapien
gatttggtgtcatgtggtgttcatc

SEQ ID NO: 637248 - DNA, 25 bp, Homo sapien
gaaaatcttcccaatctatacatcc

SEQ ID NO: 637249 - DNA, 25 bp, Homo sapien
aaaatcttcccaatctatacatccg

SEQ ID NO: 637250 - DNA, 25 bp, Homo sapien
aaatcttcccaatctatacatccga

SEQ ID NO: 637251 - DNA, 25 bp, Homo sapien
aatcttcccaatctatacatccgac

SEQ ID NO: 637252 - DNA, 25 bp, Homo sapien
atcttcccaatctatacatccgaca

SEQ ID NO: 637253 - DNA, 25 bp, Homo sapien
tcttcccaatctatacatccgacaa

SEQ ID NO: 637254 - DNA, 25 bp, Homo sapien
cttcccaatctatacatccgacaaa

SEQ ID NO: 637255 - DNA, 25 bp, Homo sapien
tacgaggaactcaaattagcaagaa

SEQ ID NO: 637256 - DNA, 25 bp, Homo sapien
tttctttcttgtgcattattacatt

SEQ ID NO: 637257 - DNA, 25 bp, Homo sapien
gtgcattattacatttactcatacc

SEQ ID NO: 637258 - DNA, 25 bp, Homo sapien
tattacatttactcatacctccagg

SEQ ID NO: 637259 - DNA, 25 bp, Homo sapien
ttacatttactcatacctccaggac

SEQ ID NO: 637260 - DNA, 25 bp, Homo sapien
acatttactcatacctccaggacaa

SEQ ID NO: 637261 - DNA, 25 bp, Homo sapien
tttactcatacctccaggacaatgt

SEQ ID NO: 637262 - DNA, 25 bp, Homo sapien
tactcatacctccaggacaatgttg

SEQ ID NO: 637263 - DNA, 25 bp, Homo sapien
ataaagaactgcctgtattagccta

SEQ ID NO: 637264 - DNA, 25 bp, Homo sapien
aaagaactgcctgtattagcctagc

SEQ ID NO: 637265 - DNA, 25 bp, Homo sapien
agaactgcctgtattagcctagcat

SEQ ID NO: 637266 - DNA, 25 bp, Homo sapien
aactgcctgtattagcctagcatgg

SEQ ID NO: 637267 - DNA, 25 bp, Homo sapien
gaggcccacagcttgcccatttgta

SEQ ID NO: 637268 - DNA, 25 bp, Homo sapien
ttgcccatttgtatgctcctctaga

SEQ ID NO: 637269 - DNA, 25 bp, Homo sapien
gctcctctagaggtttgatcagcag

SEQ ID NO: 637270 - DNA, 25 bp, Homo sapien
acacccacattgcatgacctgagag

SEQ ID NO: 637271 - DNA, 25 bp, Homo sapien
ttcctgtttcactagtttgcagctg

SEQ ID NO: 637272 - DNA, 25 bp, Homo sapien
gcagctgttatttggtgcagacaca

SEQ ID NO: 637273 - DNA, 25 bp, Homo sapien
gtctttttggtggactgaccctata

SEQ ID NO: 637274 - DNA, 25 bp, Homo sapien
ttacataatatctctccttgactct

SEQ ID NO: 637275 - DNA, 25 bp, Homo sapien
ttgactctggtacttttctttgctc

SEQ ID NO: 637276 - DNA, 25 bp, Homo sapien
ttctttgctctgaagtatgctttat

SEQ ID NO: 637277 - DNA, 25 bp, Homo sapien
atcaatatagccactcctactttct

SEQ ID NO: 637278 - DNA, 25 bp, Homo sapien
agagggattctagaggatgagcaat

SEQ ID NO: 637279 - DNA, 25 bp, Homo sapien
gaggatgagcaatattacgttttct

SEQ ID NO: 637280 - DNA, 25 bp, Homo sapien
tttcttctttaggtgttgtttacat

SEQ ID NO: 637281 - DNA, 25 bp, Homo sapien
gtgttgtttacatgtgtctgctaac

SEQ ID NO: 637282 - DNA, 25 bp, Homo sapien
gctaactttgttagtattgagctaa

SEQ ID NO: 637283 - DNA, 25 bp, Homo sapien
aactttgtattgagctatgtagtca

SEQ ID NO: 637284 - DNA, 25 bp, Homo sapien
cattttttccatgcattcatactac

SEQ ID NO: 637285 - DNA, 25 bp, Homo sapien
aaactggctttactgctgatttggg

SEQ ID NO: 637286 - DNA, 25 bp, Homo sapien
ggttgaattatgcaaactgtagtca

SEQ ID NO: 637287 - DNA, 25 bp, Homo sapien
aatcggtgtgttaattatttcaaag

SEQ ID NO: 637288 - DNA, 25 bp, Homo sapien
aagttacttcatttggacttgatcc

SEQ ID NO: 637289 - DNA, 25 bp, Homo sapien
gaatgtcatggtagtttgataggaa

SEQ ID NO: 637290 - DNA, 25 bp, Homo sapien
aagcagtatgaccactttaataata

SEQ ID NO: 637291 - DNA, 25 bp, Homo sapien
agcagtatgaccactttaataatac

SEQ ID NO: 637292 - DNA, 25 bp, Homo sapien
atgaccactttaataatactgattc

SEQ ID NO: 637293 - DNA, 25 bp, Homo sapien
gaccactttaataatactgattctt

SEQ ID NO: 637294 - DNA, 25 bp, Homo sapien
aatactgattcttcctatctatgag

SEQ ID NO: 637295 - DNA, 25 bp, Homo sapien
cctatctatgagcatggaatttttt

SEQ ID NO: 637296 - DNA, 25 bp, Homo sapien
tttttcatttgatagggtggagggt

SEQ ID NO: 637297 - DNA, 25 bp, Homo sapien
gctattagatactaggcttagtacc

SEQ ID NO: 637298 - DNA, 25 bp, Homo sapien
aataatctttataatgacccccatg

SEQ ID NO: 637299 - DNA, 25 bp, Homo sapien
taatgacccccatggcacaagttta

SEQ ID NO: 637300 - DNA, 25 bp, Homo sapien
tattttctcatttgttcctttcatc

SEQ ID NO: 637301 - DNA, 25 bp, Homo sapien
ttgttcctttcatcaagcatccaac

SEQ ID NO: 637302 - DNA, 25 bp, Homo sapien
tgttcctttcatcaagcatccaacc

SEQ ID NO: 637303 - DNA, 25 bp, Homo sapien
gttcctttcatcaagcatccaacct

SEQ ID NO: 637304 - DNA, 25 bp, Homo sapien
tttcatcaagcatccaacctgccag

SEQ ID NO: 637305 - DNA, 25 bp, Homo sapien
ttcatcaagcatccaacctgccaga

SEQ ID NO: 637306 - DNA, 25 bp, Homo sapien
caagcatccaacctgccagaccctg

SEQ ID NO: 637307 - DNA, 25 bp, Homo sapien
tccaacctgccagaccctgcacttg

SEQ ID NO: 637308 - DNA, 25 bp, Homo sapien
gtgatttcatccctgtcaaccagca

SEQ ID NO: 637309 - DNA, 25 bp, Homo sapien
tgatttcatccctgtcaaccagcac

SEQ ID NO: 637310 - DNA, 25 bp, Homo sapien
gatttcatccctgtcaaccagcact

SEQ ID NO: 637311 - DNA, 25 bp, Homo sapien
gtgttctccagggatttgccatcca

SEQ ID NO: 637312 - DNA, 25 bp, Homo sapien
atccacctgggtgctggtctgatgt

SEQ ID NO: 637313 - DNA, 25 bp, Homo sapien
cagcagcatttttatgggcagaaag

SEQ ID NO: 637314 - DNA, 25 bp, Homo sapien
cagaaagatcaatgcccgtaaatag

SEQ ID NO: 637315 - DNA, 25 bp, Homo sapien
gggcatcctccctgtcaaataaagg

SEQ ID NO: 637316 - DNA, 25 bp, Homo sapien
gacctaagattctaccagttcgggc

SEQ ID NO: 637317 - DNA, 25 bp, Homo sapien
agttcgggctgagctctgagtcacc

SEQ ID NO: 637318 - DNA, 25 bp, Homo sapien
gttataattactgagctccactgca

SEQ ID NO: 637319 - DNA, 25 bp, Homo sapien
ttactgagctccactgcagaggctg

SEQ ID NO: 637320 - DNA, 25 bp, Homo sapien
gacacacccctatttcctagaaatg

SEQ ID NO: 637321 - DNA, 25 bp, Homo sapien
aaatggaactctttctagcaccgtg

SEQ ID NO: 637322 - DNA, 25 bp, Homo sapien
ttcaattttctttaaactgcctatc

SEQ ID NO: 637323 - DNA, 25 bp, Homo sapien
taaactgcctatctttggtaaactt

SEQ ID NO: 637324 - DNA, 25 bp, Homo sapien
ctgcctatctttggtaaacttacat

SEQ ID NO: 637325 - DNA, 25 bp, Homo sapien
gaaagtggcccacaagtcttgagga

SEQ ID NO: 637326 - DNA, 25 bp, Homo sapien
ggcccacaagtcttgaggacattaa

SEQ ID NO: 637327 - DNA, 25 bp, Homo sapien
ggacattaaggttcttttctctaat

SEQ ID NO: 637328 - DNA, 25 bp, Homo sapien
ggttcttttctctaataaaggtcag

SEQ ID NO: 637329 - DNA, 25 bp, Homo sapien
tttttattctctctgttcacagtac

SEQ ID NO: 637330 - DNA, 25 bp, Homo sapien
tattctctctgttcacagtactgat

SEQ ID NO: 637331 - DNA, 25 bp, Homo sapien
cagtactgattgttgggagcccttg

SEQ ID NO: 637332 - DNA, 25 bp, Homo sapien
tgttgggagcccttgaggaaaatga

SEQ ID NO: 637333 - DNA, 25 bp, Homo sapien
tgaggatccactgggttgccactga

SEQ ID NO: 637334 - DNA, 25 bp, Homo sapien
ggttgccactgacccattgcctgag

SEQ ID NO: 637335 - DNA, 25 bp, Homo sapien
cccattgcctgagggtatgcgatga

SEQ ID NO: 637336 - DNA, 25 bp, Homo sapien
gtatgcgatgaaaccagaatcagca

SEQ ID NO: 637337 - DNA, 25 bp, Homo sapien
gaatcagcaactgtagatggcagct

SEQ ID NO: 637338 - DNA, 25 bp, Homo sapien
aacgacacatctaataaccaacagg

SEQ ID NO: 637339 - DNA, 25 bp, Homo sapien
gatactgtatgaaagtctgaccaac

SEQ ID NO: 637340 - DNA, 25 bp, Homo sapien
ataaagggtgctacaaggatgcccc

SEQ ID NO: 637341 - DNA, 25 bp, Homo sapien
cccaaggctcaggatgttggagagt

SEQ ID NO: 637342 - DNA, 25 bp, Homo sapien
gagagttgaggcaccatgagtaacc

SEQ ID NO: 637343 - DNA, 25 bp, Homo sapien
ggcaccatgagtaaccacaatgcag

SEQ ID NO: 637344 - DNA, 25 bp, Homo sapien
ggacgctctggaatttaaatacctt

SEQ ID NO: 637345 - DNA, 25 bp, Homo sapien
gacgctctggaatttaaataccttg

SEQ ID NO: 637346 - DNA, 25 bp, Homo sapien
cgctctggaatttaaataccttgcc

SEQ ID NO: 637347 - DNA, 25 bp, Homo sapien
gctctggaatttaaataccttgcca

SEQ ID NO: 637348 - DNA, 25 bp, Homo sapien
ggaatttaaataccttgccaagatc

SEQ ID NO: 637349 - DNA, 25 bp, Homo sapien
gaatttaaataccttgccaagatca

SEQ ID NO: 637350 - DNA, 25 bp, Homo sapien
ataccttgccaagatcatacagatt

SEQ ID NO: 637351 - DNA, 25 bp, Homo sapien
accttgccaagatcatacagattaa

SEQ ID NO: 637352 - DNA, 25 bp, Homo sapien
cttgccaagatcatacagattaagt

SEQ ID NO: 637353 - DNA, 25 bp, Homo sapien
gccaagatcatacagattaagtggt

SEQ ID NO: 637354 - DNA, 25 bp, Homo sapien
agcagggatttgaacggagagaaac

SEQ ID NO: 637355 - DNA, 25 bp, Homo sapien
ctagcaacaggctgccaggtcggga

SEQ ID NO: 637356 - DNA, 25 bp, Homo sapien
cttgggtgcatctgggccccgcctg

SEQ ID NO: 637357 - DNA, 25 bp, Homo sapien
aagtgggcccggtgcatctccctag

SEQ ID NO: 637358 - DNA, 25 bp, Homo sapien
gtgcatctccctagttcaggctctg

SEQ ID NO: 637359 - DNA, 25 bp, Homo sapien
agttcaggctctgcagcctgacaag

SEQ ID NO: 637360 - DNA, 25 bp, Homo sapien
aagccaactaagtattggcccaggt

SEQ ID NO: 637361 - DNA, 25 bp, Homo sapien
taagtattggcccaggtggttcaca

SEQ ID NO: 637362 - DNA, 25 bp, Homo sapien
gtattggcccaggtggttcacaaaa

SEQ ID NO: 637363 - DNA, 25 bp, Homo sapien
gcccaggtggttcacaaaagacttt

SEQ ID NO: 637364 - DNA, 25 bp, Homo sapien
ttagttaaatctgcataaagttgga

SEQ ID NO: 637365 - DNA, 25 bp, Homo sapien
tgcataaagttggatgcagtcgttt

SEQ ID NO: 637366 - DNA, 25 bp, Homo sapien
tttttgcatcctaaatacttagctg

SEQ ID NO: 637367 - DNA, 25 bp, Homo sapien
tttgcatcctaaatacttagctgag

SEQ ID NO: 637368 - DNA, 25 bp, Homo sapien
ttgcatcctaaatacttagctgagg

SEQ ID NO: 637369 - DNA, 25 bp, Homo sapien
aatacgttaatttccacttcaaatg

SEQ ID NO: 637370 - DNA, 25 bp, Homo sapien
atacgttaatttccacttcaaatgc

SEQ ID NO: 637371 - DNA, 25 bp, Homo sapien
tacgttaatttccacttcaaatgca

SEQ ID NO: 637372 - DNA, 25 bp, Homo sapien
acgttaatttccacttcaaatgcag

SEQ ID NO: 637373 - DNA, 25 bp, Homo sapien
cgttaatttccacttcaaatgcagt

SEQ ID NO: 637374 - DNA, 25 bp, Homo sapien
gttaatttccacttcaaatgcagtt

SEQ ID NO: 637375 - DNA, 25 bp, Homo sapien
ttaatttccacttcaaatgcagttt

SEQ ID NO: 637376 - DNA, 25 bp, Homo sapien
taatttccacttcaaatgcagtttt

SEQ ID NO: 637377 - DNA, 25 bp, Homo sapien
catgcagtttgaaatgcagcagagt

SEQ ID NO: 637378 - DNA, 25 bp, Homo sapien
gcagtttgaaatgcagcagagtggt

SEQ ID NO: 637379 - DNA, 25 bp, Homo sapien
cagtttgaaatgcagcagagtggtc

SEQ ID NO: 637380 - DNA, 25 bp, Homo sapien
gtttgaaatgcagcagagtggtcga

SEQ ID NO: 637381 - DNA, 25 bp, Homo sapien
ttgaaatgcagcagagtggtcgagc

SEQ ID NO: 637382 - DNA, 25 bp, Homo sapien
gaaatgcagcagagtggtcgagcgc

SEQ ID NO: 637383 - DNA, 25 bp, Homo sapien
aaatgcagcagagtggtcgagcgcg

SEQ ID NO: 637384 - DNA, 25 bp, Homo sapien
atgcagcagagtggtcgagcgcggt

SEQ ID NO: 637385 - DNA, 25 bp, Homo sapien
tgcagcagagtggtcgagcgcggtg

SEQ ID NO: 637386 - DNA, 25 bp, Homo sapien
gcagcagagtggtcgagcgcggtgg

SEQ ID NO: 637387 - DNA, 25 bp, Homo sapien
ggcggggagtggcttggacctggga

SEQ ID NO: 637388 - DNA, 25 bp, Homo sapien
tatgttagcaagatattagtatgga

SEQ ID NO: 637389 - DNA, 25 bp, Homo sapien
atgttagcaagatattagtatggat

SEQ ID NO: 637390 - DNA, 25 bp, Homo sapien
tgttagcaagatattagtatggatt

SEQ ID NO: 637391 - DNA, 25 bp, Homo sapien
gttagcaagatattagtatggattt

SEQ ID NO: 637392 - DNA, 25 bp, Homo sapien
ttagcaagatattagtatggatttt

SEQ ID NO: 637393 - DNA, 25 bp, Homo sapien
aaaaacacaaaagcacctgtaatct

SEQ ID NO: 637394 - DNA, 25 bp, Homo sapien
aaaacacaaaagcacctgtaatctc

SEQ ID NO: 637395 - DNA, 25 bp, Homo sapien
aaacacaaaagcacctgtaatctca

SEQ ID NO: 637396 - DNA, 25 bp, Homo sapien
aaatagcatctttcaggccaagtag

SEQ ID NO: 637397 - DNA, 25 bp, Homo sapien
cctgtaagtctaaggatggcacaat

SEQ ID NO: 637398 - DNA, 25 bp, Homo sapien
ggatggcacaatggcaaccactgtt

SEQ ID NO: 637399 - DNA, 25 bp, Homo sapien
accactgttatggagcactaactgc

SEQ ID NO: 637400 - DNA, 25 bp, Homo sapien
agcactaactgctttctggtattat

SEQ ID NO: 637401 - DNA, 25 bp, Homo sapien
attgtttagttatgagggcaaccta

SEQ ID NO: 637402 - DNA, 25 bp, Homo sapien
gcaacctaggttgttcatgtctata

SEQ ID NO: 637403 - DNA, 25 bp, Homo sapien
gatctgttaaggattttcactctct

SEQ ID NO: 637404 - DNA, 25 bp, Homo sapien
aaggattttcactctctttcactgg

SEQ ID NO: 637405 - DNA, 25 bp, Homo sapien
tcactctctttcactgggctgcttt

SEQ ID NO: 637406 - DNA, 25 bp, Homo sapien
gggctgcttttcaatcttatttcac

SEQ ID NO: 637407 - DNA, 25 bp, Homo sapien
atattgttgatgagaagttacttaa

SEQ ID NO: 637408 - DNA, 25 bp, Homo sapien
attctaatcgatttctagatgtcca

SEQ ID NO: 637409 - DNA, 25 bp, Homo sapien
ctaatcgatttctagatgtccaaat

SEQ ID NO: 637410 - DNA, 25 bp, Homo sapien
aatcgatttctagatgtccaaatga

SEQ ID NO: 637411 - DNA, 25 bp, Homo sapien
tcgatttctagatgtccaaatgaca

SEQ ID NO: 637412 - DNA, 25 bp, Homo sapien
gatttctagatgtccaaatgacaag

SEQ ID NO: 637413 - DNA, 25 bp, Homo sapien
gacaagatagcatttatataccatc

SEQ ID NO: 637414 - DNA, 25 bp, Homo sapien
caagatagcatttatataccatcag

SEQ ID NO: 637415 - DNA, 25 bp, Homo sapien
atgtctttgtgagaatgctatatgt

SEQ ID NO: 637416 - DNA, 25 bp, Homo sapien
ttgtgagaatgctatatgtaatttt

SEQ ID NO: 637417 - DNA, 25 bp, Homo sapien
gtgtacgtacaatgtaattatattg

SEQ ID NO: 637418 - DNA, 25 bp, Homo sapien
aatattgggcacattcatgtttcat

SEQ ID NO: 637419 - DNA, 25 bp, Homo sapien
tgatgataatcaagatgccctgtgc

SEQ ID NO: 637420 - DNA, 25 bp, Homo sapien
acagtctcttatataaccctttagg

SEQ ID NO: 637421 - DNA, 25 bp, Homo sapien
aaagaaagtcttcttaagcttgagg

SEQ ID NO: 637422 - DNA, 25 bp, Homo sapien
gaatcttggaggtataaaggtcttt

SEQ ID NO: 637423 - DNA, 25 bp, Homo sapien
aaggtctttagagttcacatagcac

SEQ ID NO: 637424 - DNA, 25 bp, Homo sapien
gagttcacatagcacaacttggtca

SEQ ID NO: 637425 - DNA, 25 bp, Homo sapien
tagcacaacttggtcatttcacatg

SEQ ID NO: 637426 - DNA, 25 bp, Homo sapien
aactgagggctaggtcttgatggct

SEQ ID NO: 637427 - DNA, 25 bp, Homo sapien
gggctaggtcttgatggctcagatt

SEQ ID NO: 637428 - DNA, 25 bp, Homo sapien
atggctcagatttcttcaattaatt

SEQ ID NO: 637429 - DNA, 25 bp, Homo sapien
ttagctggatatggtcgctcacacc

SEQ ID NO: 637430 - DNA, 25 bp, Homo sapien
tagctggatatggtcgctcacacct

SEQ ID NO: 637431 - DNA, 25 bp, Homo sapien
ctgtaatctcaacgactcaggagaa

SEQ ID NO: 637432 - DNA, 25 bp, Homo sapien
tgtaatctcaacgactcaggagaat

SEQ ID NO: 637433 - DNA, 25 bp, Homo sapien
gtaatctcaacgactcaggagaatc

SEQ ID NO: 637434 - DNA, 25 bp, Homo sapien
taatctcaacgactcaggagaatcg

SEQ ID NO: 637435 - DNA, 25 bp, Homo sapien
aatctcaacgactcaggagaatcgc

SEQ ID NO: 637436 - DNA, 25 bp, Homo sapien
acagagggacacgctatctcaaaat

SEQ ID NO: 637437 - DNA, 25 bp, Homo sapien
cagagggacacgctatctcaaaata

SEQ ID NO: 637438 - DNA, 25 bp, Homo sapien
agagggacacgctatctcaaaataa

SEQ ID NO: 637439 - DNA, 25 bp, Homo sapien
gagggacacgctatctcaaaataaa

SEQ ID NO: 637440 - DNA, 25 bp, Homo sapien
agaagcaaaaaatggcatttgcggc

SEQ ID NO: 637441 - DNA, 25 bp, Homo sapien
gaagcaaaaaatggcatttgcggct

SEQ ID NO: 637442 - DNA, 25 bp, Homo sapien
aagcaaaaaatggcatttgcggctg

SEQ ID NO: 637443 - DNA, 25 bp, Homo sapien
agcaaaaaatggcatttgcggctgg

SEQ ID NO: 637444 - DNA, 25 bp, Homo sapien
gcaaaaaatggcatttgcggctggg

SEQ ID NO: 637445 - DNA, 25 bp, Homo sapien
caaaaaatggcatttgcggctgggc

SEQ ID NO: 637446 - DNA, 25 bp, Homo sapien
aaaaaatggcatttgcggctgggca

SEQ ID NO: 637447 - DNA, 25 bp, Homo sapien
aaaaatggcatttgcggctgggcac

SEQ ID NO: 637448 - DNA, 25 bp, Homo sapien
aaaatggcatttgcggctgggcacg

SEQ ID NO: 637449 - DNA, 25 bp, Homo sapien
aggttgtggtaggccgagatcctgc

SEQ ID NO: 637450 - DNA, 25 bp, Homo sapien
taagtttctagacccactgcccatt

SEQ ID NO: 637451 - DNA, 25 bp, Homo sapien
ctgcccattccccaaatattgttta

SEQ ID NO: 637452 - DNA, 25 bp, Homo sapien
tttatgaccataatcctctctctga

SEQ ID NO: 637453 - DNA, 25 bp, Homo sapien
tctctctgacttcctattttcattc

SEQ ID NO: 637454 - DNA, 25 bp, Homo sapien
gacttggtctttgccaaacactgcg

SEQ ID NO: 637455 - DNA, 25 bp, Homo sapien
aacactgcgtgtttcagaaaggact

SEQ ID NO: 637456 - DNA, 25 bp, Homo sapien
gtaccagactcttaggaatcgcatg

SEQ ID NO: 637457 - DNA, 25 bp, Homo sapien
gcaatgggaggtcaaatagcttact

SEQ ID NO: 637458 - DNA, 25 bp, Homo sapien
gtcaaatagcttactgatttctcta

SEQ ID NO: 637459 - DNA, 25 bp, Homo sapien
gatttctctatgtctaagtcaccaa

SEQ ID NO: 637460 - DNA, 25 bp, Homo sapien
gtcaccaactcattgtgtttgctga

SEQ ID NO: 637461 - DNA, 25 bp, Homo sapien
accttatcatcatatacccaacact

SEQ ID NO: 637462 - DNA, 25 bp, Homo sapien
atcatatacccaacactcaaaggag

SEQ ID NO: 637463 - DNA, 25 bp, Homo sapien
actcaaaggagaacctagtgacatt

SEQ ID NO: 637464 - DNA, 25 bp, Homo sapien
ttttctgttctcagacttagcagat

SEQ ID NO: 637465 - DNA, 25 bp, Homo sapien
gttctcagacttagcagataacttg

SEQ ID NO: 637466 - DNA, 25 bp, Homo sapien
agcagataacttgttggctcaacct

SEQ ID NO: 637467 - DNA, 25 bp, Homo sapien
ataacttgttggctcaacctccaaa

SEQ ID NO: 637468 - DNA, 25 bp, Homo sapien
acttgttggctcaacctccaaaatg

SEQ ID NO: 637469 - DNA, 25 bp, Homo sapien
ggctcaacctccaaaatgtatcttt

SEQ ID NO: 637470 - DNA, 25 bp, Homo sapien
tcaacctccaaaatgtatctttatt

SEQ ID NO: 637471 - DNA, 25 bp, Homo sapien
tgccaagatgaaagttcagtggcat

SEQ ID NO: 637472 - DNA, 25 bp, Homo sapien
atgcctggattattaggtatacgcc

SEQ ID NO: 637473 - DNA, 25 bp, Homo sapien
ttaggtatacgccatatcatgaagg

SEQ ID NO: 637474 - DNA, 25 bp, Homo sapien
gaaagtcaaagatacccagatagga

SEQ ID NO: 637475 - DNA, 25 bp, Homo sapien
gatctttcctcagaaccatttactt

SEQ ID NO: 637476 - DNA, 25 bp, Homo sapien
ctcagaaccatttacttatgcacat

SEQ ID NO: 637477 - DNA, 25 bp, Homo sapien
ttatgcacattcacccacatttgta

SEQ ID NO: 637478 - DNA, 25 bp, Homo sapien
agcaaaaggcttgggctccagtcat

SEQ ID NO: 637479 - DNA, 25 bp, Homo sapien
tccagtcattcagagtagccacact

SEQ ID NO: 637480 - DNA, 25 bp, Homo sapien
gagtagccacactgcccaggaatat

SEQ ID NO: 637481 - DNA, 25 bp, Homo sapien
cactgcccaggaatatataacttta

SEQ ID NO: 637482 - DNA, 25 bp, Homo sapien
taagggactattcattctgtaaatc

SEQ ID NO: 637483 - DNA, 25 bp, Homo sapien
ggtagcaacccattagaaacttgtc

SEQ ID NO: 637484 - DNA, 25 bp, Homo sapien
ataccatgtcctagcaatctcattc

SEQ ID NO: 637485 - DNA, 25 bp, Homo sapien
aatctcattcttaggtatatgcacc

SEQ ID NO: 637486 - DNA, 25 bp, Homo sapien
gtatatgcaccagaaaacctgatgc

SEQ ID NO: 637487 - DNA, 25 bp, Homo sapien
gaaaacctgatgcacatgtagcagt

SEQ ID NO: 637488 - DNA, 25 bp, Homo sapien
gcacatgtagcagtacttacgtgga

SEQ ID NO: 637489 - DNA, 25 bp, Homo sapien
cttacgtggaagtttatcacagcat

SEQ ID NO: 637490 - DNA, 25 bp, Homo sapien
atcacagcatgttggttatagcaaa

SEQ ID NO: 637491 - DNA, 25 bp, Homo sapien
tcagaaacaacctcaacatccatca

SEQ ID NO: 637492 - DNA, 25 bp, Homo sapien
gtcattcaaggaattaccacatttt

SEQ ID NO: 637493 - DNA, 25 bp, Homo sapien
gtatgtttcaacatggatgcatgtc

SEQ ID NO: 637494 - DNA, 25 bp, Homo sapien
tgcccagactggtgcaatcttatct

SEQ ID NO: 637495 - DNA, 25 bp, Homo sapien
gcccagactggtgcaatcttatctc

SEQ ID NO: 637496 - DNA, 25 bp, Homo sapien
cccagactggtgcaatcttatctca

SEQ ID NO: 637497 - DNA, 25 bp, Homo sapien
cagactggtgcaatcttatctcact

SEQ ID NO: 637498 - DNA, 25 bp, Homo sapien
agacaaggtctagctaaactcccca

SEQ ID NO: 637499 - DNA, 25 bp, Homo sapien
gacaaggtctagctaaactccccag

SEQ ID NO: 637500 - DNA, 25 bp, Homo sapien
acaaggtctagctaaactccccagg

SEQ ID NO: 637501 - DNA, 25 bp, Homo sapien
aaggtctagctaaactccccaggct

SEQ ID NO: 637502 - DNA, 25 bp, Homo sapien
aggtctagctaaactccccaggcta

SEQ ID NO: 637503 - DNA, 25 bp, Homo sapien
gtctagctaaactccccaggctaat

SEQ ID NO: 637504 - DNA, 25 bp, Homo sapien
agctaaactccccaggctaatctca

SEQ ID NO: 637505 - DNA, 25 bp, Homo sapien
gatggcccaggaattaaccttccca

SEQ ID NO: 637506 - DNA, 25 bp, Homo sapien
attaaccttcccattgtgggtagca

SEQ ID NO: 637507 - DNA, 25 bp, Homo sapien
gtagcaagaaagtggtctggcccaa

SEQ ID NO: 637508 - DNA, 25 bp, Homo sapien
tgtgcacccgttgcctatgccatat

SEQ ID NO: 637509 - DNA, 25 bp, Homo sapien
ctatgccatatgtagcttgaacccc

SEQ ID NO: 637510 - DNA, 25 bp, Homo sapien
tagccaataaacttcacatagaggg

SEQ ID NO: 637511 - DNA, 25 bp, Homo sapien
gttgttccaaccagatgttatttgc

SEQ ID NO: 637512 - DNA, 25 bp, Homo sapien
gttatttgcagaaaagatctcatga

SEQ ID NO: 637513 - DNA, 25 bp, Homo sapien
gatcttgaattagtagtagttctca

SEQ ID NO: 637514 - DNA, 25 bp, Homo sapien
aaatgggtcttggaaacctgctgga

SEQ ID NO: 637515 - DNA, 25 bp, Homo sapien
tcttggaaacctgctggatggccca

SEQ ID NO: 637516 - DNA, 25 bp, Homo sapien
gatagagccagaggccattatccta

SEQ ID NO: 637517 - DNA, 25 bp, Homo sapien
gccattatcctaagtcaattaacac

SEQ ID NO: 637518 - DNA, 25 bp, Homo sapien
tgcatgttctcactgctaagcagga

SEQ ID NO: 637519 - DNA, 25 bp, Homo sapien
gagttaaacattgagaacacttgga

SEQ ID NO: 637520 - DNA, 25 bp, Homo sapien
aggaacagtagacgtcgggcctact

SEQ ID NO: 637521 - DNA, 25 bp, Homo sapien
aaactacctatctgatactatgttc

SEQ ID NO: 637522 - DNA, 25 bp, Homo sapien
acctatctgatactatgttcattac

SEQ ID NO: 637523 - DNA, 25 bp, Homo sapien
gtacacaaaactcccatgacaggca

SEQ ID NO: 637524 - DNA, 25 bp, Homo sapien
atgacaggcagtttacccatgtagc

SEQ ID NO: 637525 - DNA, 25 bp, Homo sapien
ggcagtttacccatgtagcaaacct

SEQ ID NO: 637526 - DNA, 25 bp, Homo sapien
gcaaacctgcatatgtactccttga

SEQ ID NO: 637527 - DNA, 25 bp, Homo sapien
gattatgtcactcatctgctcaaac

SEQ ID NO: 637528 - DNA, 25 bp, Homo sapien
tattgtagctccctatttcactcgg

SEQ ID NO: 637529 - DNA, 25 bp, Homo sapien
tttcactcggtgtaaaagccaaagc

SEQ ID NO: 637530 - DNA, 25 bp, Homo sapien
aagccaaagcactcaccatgtcctg

SEQ ID NO: 637531 - DNA, 25 bp, Homo sapien
tggctcttttcacccctcatgttat

SEQ ID NO: 637532 - DNA, 25 bp, Homo sapien
ctcatgttatttcccatacctttct

SEQ ID NO: 637533 - DNA, 25 bp, Homo sapien
atgaccaattgcttttgctggaaag

SEQ ID NO: 637534 - DNA, 25 bp, Homo sapien
ggcttttccctctacctagaatatt

SEQ ID NO: 637535 - DNA, 25 bp, Homo sapien
agaatattttcctcacatacctgca

SEQ ID NO: 637536 - DNA, 25 bp, Homo sapien
acatacctgcatagctctttcgctt

SEQ ID NO: 637537 - DNA, 25 bp, Homo sapien
agctctttcgcttactttttcatga

SEQ ID NO: 637538 - DNA, 25 bp, Homo sapien
ttaagcataaacaacacattcacac

SEQ ID NO: 637539 - DNA, 25 bp, Homo sapien
acattcacacattcaaagataacaa

SEQ ID NO: 637540 - DNA, 25 bp, Homo sapien
gataacaagactaagggccgggtgc

SEQ ID NO: 637541 - DNA, 25 bp, Homo sapien
ataacaagactaagggccgggtgcg

SEQ ID NO: 637542 - DNA, 25 bp, Homo sapien
gccgggtgcggtaagtatctttgtc

SEQ ID NO: 637543 - DNA, 25 bp, Homo sapien
cgggtgcggtaagtatctttgtctt

SEQ ID NO: 637544 - DNA, 25 bp, Homo sapien
aagtatctttgtcttacaccagagg

SEQ ID NO: 637545 - DNA, 25 bp, Homo sapien
gtatctttgtcttacaccagaggcg

SEQ ID NO: 637546 - DNA, 25 bp, Homo sapien
atctttgtcttacaccagaggcggg

SEQ ID NO: 637547 - DNA, 25 bp, Homo sapien
tctttgtcttacaccagaggcgggt

SEQ ID NO: 637548 - DNA, 25 bp, Homo sapien
ttgtcttacaccagaggcgggtgga

SEQ ID NO: 637549 - DNA, 25 bp, Homo sapien
agatcctgtcaaaacttcactcaca

SEQ ID NO: 637550 - DNA, 25 bp, Homo sapien
ttcaacctgacctaatccatcatgg

SEQ ID NO: 637551 - DNA, 25 bp, Homo sapien
gacctaatccatcatgggagttcac

SEQ ID NO: 637552 - DNA, 25 bp, Homo sapien
gggagttcacattgcctcagccaaa

SEQ ID NO: 637553 - DNA, 25 bp, Homo sapien
gttcacattgcctcagccaaaataa

SEQ ID NO: 637554 - DNA, 25 bp, Homo sapien
taaatagagagacgcccttctgcac

SEQ ID NO: 637555 - DNA, 25 bp, Homo sapien
gagacgcccttctgcacaacggaga

SEQ ID NO: 637556 - DNA, 25 bp, Homo sapien
ccttctgcacaacggagacttgtct

SEQ ID NO: 637557 - DNA, 25 bp, Homo sapien
agacttgtctagctgtgactgccta

SEQ ID NO: 637558 - DNA, 25 bp, Homo sapien
tctagctgtgactgcctactcgtca

SEQ ID NO: 637559 - DNA, 25 bp, Homo sapien
actcaaacccccaagctactgaatg

SEQ ID NO: 637560 - DNA, 25 bp, Homo sapien
ttgtatgcagttggtattctctcca

SEQ ID NO: 637561 - DNA, 25 bp, Homo sapien
gtatgcagttggtattctctccagt

SEQ ID NO: 637562 - DNA, 25 bp, Homo sapien
atgcagttggtattctctccagtat

SEQ ID NO: 637563 - DNA, 25 bp, Homo sapien
tgcagttggtattctctccagtata

SEQ ID NO: 637564 - DNA, 25 bp, Homo sapien
gcagttggtattctctccagtatat

SEQ ID NO: 637565 - DNA, 25 bp, Homo sapien
agttggtattctctccagtatatag

SEQ ID NO: 637566 - DNA, 25 bp, Homo sapien
gttggtattctctccagtatataga

SEQ ID NO: 637567 - DNA, 25 bp, Homo sapien
ggtattctctccagtatatagatga

SEQ ID NO: 637568 - DNA, 25 bp, Homo sapien
tattctctccagtatatagatgagg

SEQ ID NO: 637569 - DNA, 25 bp, Homo sapien
tctctccagtatatagatgaggaaa

SEQ ID NO: 637570 - DNA, 25 bp, Homo sapien
gaggttaaatagtgaaggaggccaa

SEQ ID NO: 637571 - DNA, 25 bp, Homo sapien
aatatcatctattatacagtccata

SEQ ID NO: 637572 - DNA, 25 bp, Homo sapien
aaatttctctgcttatttcagaagt

SEQ ID NO: 637573 - DNA, 25 bp, Homo sapien
tattgtgctattttccaatccagaa

SEQ ID NO: 637574 - DNA, 25 bp, Homo sapien
tttcagtattgaacagcccctctgc

SEQ ID NO: 637575 - DNA, 25 bp, Homo sapien
ccctctgctttttatccttatggca

SEQ ID NO: 637576 - DNA, 25 bp, Homo sapien
tatccttatggcattgttaattgag

SEQ ID NO: 637577 - DNA, 25 bp, Homo sapien
attgagaagtccctaagccacgttg

SEQ ID NO: 637578 - DNA, 25 bp, Homo sapien
agccacgttgtcttatacaatgtcc

SEQ ID NO: 637579 - DNA, 25 bp, Homo sapien
tatacaatgtcccattttctggatt

SEQ ID NO: 637580 - DNA, 25 bp, Homo sapien
gatttgtctgatcgttttctcctga

SEQ ID NO: 637581 - DNA, 25 bp, Homo sapien
gatcgttttctcctgagtagattca

SEQ ID NO: 637582 - DNA, 25 bp, Homo sapien
acattgagataattcctgccttaac

SEQ ID NO: 637583 - DNA, 25 bp, Homo sapien
gagataattcctgccttaacatata

SEQ ID NO: 637584 - DNA, 25 bp, Homo sapien
acatatagtatccagtgttgcttct

SEQ ID NO: 637585 - DNA, 25 bp, Homo sapien
tagtatccagtgttgcttctgagca

SEQ ID NO: 637586 - DNA, 25 bp, Homo sapien
atccagtgttgcttctgagcagtca

SEQ ID NO: 637587 - DNA, 25 bp, Homo sapien
gtgttgcttctgagcagtcagatac

SEQ ID NO: 637588 - DNA, 25 bp, Homo sapien
gcttctgagcagtcagatactattg

SEQ ID NO: 637589 - DNA, 25 bp, Homo sapien
gatactattgtgatttttactcctc

SEQ ID NO: 637590 - DNA, 25 bp, Homo sapien
gatttttactcctcactgtttactt

SEQ ID NO: 637591 - DNA, 25 bp, Homo sapien
tttactcctcactgtttacttataa

SEQ ID NO: 637592 - DNA, 25 bp, Homo sapien
ctcctcactgtttacttataatttc

SEQ ID NO: 637593 - DNA, 25 bp, Homo sapien
ctttttattaatgaacttggttgca

SEQ ID NO: 637594 - DNA, 25 bp, Homo sapien
cttggttgcagttaagggcagccat

SEQ ID NO: 637595 - DNA, 25 bp, Homo sapien
catgtcatttttagtatcattacct

SEQ ID NO: 637596 - DNA, 25 bp, Homo sapien
ttttagtatcattacctatcgttgg

SEQ ID NO: 637597 - DNA, 25 bp, Homo sapien
ttacctatcgttggttaagccagca

SEQ ID NO: 637598 - DNA, 25 bp, Homo sapien
tatcgttggttaagccagcaaaatc

SEQ ID NO: 637599 - DNA, 25 bp, Homo sapien
tatgcatctttgcaagtaggcttga

SEQ ID NO: 637600 - DNA, 25 bp, Homo sapien
gtaggcttgattcacttagcacaga

SEQ ID NO: 637601 - DNA, 25 bp, Homo sapien
gcacagatagtaactacagctctca

SEQ ID NO: 637602 - DNA, 25 bp, Homo sapien
agtaactacagctctcagtttagat

SEQ ID NO: 637603 - DNA, 25 bp, Homo sapien
ctacagctctcagtttagatttttc

SEQ ID NO: 637604 - DNA, 25 bp, Homo sapien
gttgggccatttattaagctgggaa

SEQ ID NO: 637605 - DNA, 25 bp, Homo sapien
ttgggccatttattaagctgggaat

SEQ ID NO: 637606 - DNA, 25 bp, Homo sapien
catttattaagctgggaattttgtc

SEQ ID NO: 637607 - DNA, 25 bp, Homo sapien
tattaagctgggaattttgtctttg

SEQ ID NO: 637608 - DNA, 25 bp, Homo sapien
gaattttgtctttgggctcatggac

SEQ ID NO: 637609 - DNA, 25 bp, Homo sapien
aattttgtctttgggctcatggaca

SEQ ID NO: 637610 - DNA, 25 bp, Homo sapien
tcagtttcttcctagtgtagggcaa

SEQ ID NO: 637611 - DNA, 25 bp, Homo sapien
cagtttcttcctagtgtagggcaat

SEQ ID NO: 637612 - DNA, 25 bp, Homo sapien
gtttcttcctagtgtagggcaattc

SEQ ID NO: 637613 - DNA, 25 bp, Homo sapien
ttcttcctagtgtagggcaattcaa

SEQ ID NO: 637614 - DNA, 25 bp, Homo sapien
cttcctagtgtagggcaattcaaaa

SEQ ID NO: 637615 - DNA, 25 bp, Homo sapien
aggctgggcttccagtcctattgct

SEQ ID NO: 637616 - DNA, 25 bp, Homo sapien
agtcctattgctactgtggaagctg

SEQ ID NO: 637617 - DNA, 25 bp, Homo sapien
aaagagccagcctgtatggtcagct

SEQ ID NO: 637618 - DNA, 25 bp, Homo sapien
gtcagctgggattctagttgaccaa

SEQ ID NO: 637619 - DNA, 25 bp, Homo sapien
ggattctagttgaccaaagctgttg

SEQ ID NO: 637620 - DNA, 25 bp, Homo sapien
gctgttgggagaactcaagctcatc

SEQ ID NO: 637621 - DNA, 25 bp, Homo sapien
gaactcaagctcatcagtgtggcaa

SEQ ID NO: 637622 - DNA, 25 bp, Homo sapien
catcagtgtggcaagttagacaact

SEQ ID NO: 637623 - DNA, 25 bp, Homo sapien
gacaacttgatctggacacatgcat

SEQ ID NO: 637624 - DNA, 25 bp, Homo sapien
ggtccagatacccacaggattaata

SEQ ID NO: 637625 - DNA, 25 bp, Homo sapien
gcttaagcagcaaaactcggtttat

SEQ ID NO: 637626 - DNA, 25 bp, Homo sapien
atgtgttgtagccttcaaagttagg

SEQ ID NO: 637627 - DNA, 25 bp, Homo sapien
gtgttgtagccttcaaagttaggaa

SEQ ID NO: 637628 - DNA, 25 bp, Homo sapien
gtagccttcaaagttaggaatatat

SEQ ID NO: 637629 - DNA, 25 bp, Homo sapien
ggaatatatagtctgcaatcgtacc

SEQ ID NO: 637630 - DNA, 25 bp, Homo sapien
atatatagtctgcaatcgtaccatg

SEQ ID NO: 637631 - DNA, 25 bp, Homo sapien
tatagtctgcaatcgtaccatgaaa

SEQ ID NO: 637632 - DNA, 25 bp, Homo sapien
tagtctgcaatcgtaccatgaaaac

SEQ ID NO: 637633 - DNA, 25 bp, Homo sapien
gtctgcaatcgtaccatgaaaacct

SEQ ID NO: 637634 - DNA, 25 bp, Homo sapien
tgcaatcgtaccatgaaaacctccc

SEQ ID NO: 637635 - DNA, 25 bp, Homo sapien
ctcccaaaatgtaaggtcttaagtg

SEQ ID NO: 637636 - DNA, 25 bp, Homo sapien
caaaatgtaaggtcttaagtgtaca

SEQ ID NO: 637637 - DNA, 25 bp, Homo sapien
gtgtattaatacttctttatatgtt

SEQ ID NO: 637638 - DNA, 25 bp, Homo sapien
tatatgtttgggcttttatttcatt

SEQ ID NO: 637639 - DNA, 25 bp, Homo sapien
tcatttttaagatttagcatgcaaa

SEQ ID NO: 637640 - DNA, 25 bp, Homo sapien
tttagcatgcaaattatgaagttca

SEQ ID NO: 637641 - DNA, 25 bp, Homo sapien
tcaaatttaaatcccttgtgctttc

SEQ ID NO: 637642 - DNA, 25 bp, Homo sapien
tattatcaagtattgcagtcagctt

SEQ ID NO: 637643 - DNA, 25 bp, Homo sapien
aagtattgcagtcagcttgtacata

SEQ ID NO: 637644 - DNA, 25 bp, Homo sapien
attgcagtcagcttgtacataattg

SEQ ID NO: 637645 - DNA, 25 bp, Homo sapien
gcagtcagcttgtacataattgaac

SEQ ID NO: 637646 - DNA, 25 bp, Homo sapien
attgaacaatgttttgtcctattta

SEQ ID NO: 637647 - DNA, 25 bp, Homo sapien
caatgttttgtcctatttaaacagt

SEQ ID NO: 637648 - DNA, 25 bp, Homo sapien
gacaaagtcagcaacgtagaccatg

SEQ ID NO: 637649 - DNA, 25 bp, Homo sapien
gcaacgtagaccatgtaaacctcat

SEQ ID NO: 637650 - DNA, 25 bp, Homo sapien
gtaaacctcatgattccttatagtg

SEQ ID NO: 637651 - DNA, 25 bp, Homo sapien
aacctcatgattccttatagtgaaa

SEQ ID NO: 637652 - DNA, 25 bp, Homo sapien
ataaacagtgaggaagtgacataac

SEQ ID NO: 637653 - DNA, 25 bp, Homo sapien
gacataactggcattgatgatggaa

SEQ ID NO: 637654 - DNA, 25 bp, Homo sapien
aagattgttttcctacagcatcaat

SEQ ID NO: 637655 - DNA, 25 bp, Homo sapien
gttttcctacagcatcaattttata

SEQ ID NO: 637656 - DNA, 25 bp, Homo sapien
tactgtgaaaggtcaatggctactt

SEQ ID NO: 637657 - DNA, 25 bp, Homo sapien
ggtcaatggctacttatccataaat

SEQ ID NO: 637658 - DNA, 25 bp, Homo sapien
gtatttttcattactggtagaagaa

SEQ ID NO: 637659 - DNA, 25 bp, Homo sapien
tttcctatccttgggcaggtctttt

SEQ ID NO: 637660 - DNA, 25 bp, Homo sapien
catagacatatttaaccccacctac

SEQ ID NO: 637661 - DNA, 25 bp, Homo sapien
cttttgggccaagtgtttatggact

SEQ ID NO: 637662 - DNA, 25 bp, Homo sapien
tatggactagacttgttcttcccct

SEQ ID NO: 637663 - DNA, 25 bp, Homo sapien
gactagacttgttcttccccttagt

SEQ ID NO: 637664 - DNA, 25 bp, Homo sapien
tccccttagttttggaggtccagtg

SEQ ID NO: 637665 - DNA, 25 bp, Homo sapien
aggtccagtggtgagtacctctcac

SEQ ID NO: 637666 - DNA, 25 bp, Homo sapien
tacctctcacttttcagagccagaa

SEQ ID NO: 637667 - DNA, 25 bp, Homo sapien
gagccagaagtgctgcttaaaaatg

SEQ ID NO: 637668 - DNA, 25 bp, Homo sapien
aaatgtgttcagatcctggccgggc

SEQ ID NO: 637669 - DNA, 25 bp, Homo sapien
aaggtgggcgtatcacctgccgtca

SEQ ID NO: 637670 - DNA, 25 bp, Homo sapien
cttttgaaaggtgtactgcaaggaa

SEQ ID NO: 637671 - DNA, 25 bp, Homo sapien
ttttgaaaggtgtactgcaaggaac

SEQ ID NO: 637672 - DNA, 25 bp, Homo sapien
tttgaaaggtgtactgcaaggaaca

SEQ ID NO: 637673 - DNA, 25 bp, Homo sapien
ttgaaaggtgtactgcaaggaacaa

SEQ ID NO: 637674 - DNA, 25 bp, Homo sapien
tgaaaggtgtactgcaaggaacaaa

SEQ ID NO: 637675 - DNA, 25 bp, Homo sapien
gaaaggtgtactgcaaggaacaaaa

SEQ ID NO: 637676 - DNA, 25 bp, Homo sapien
aaaggtgtactgcaaggaacaaaat

SEQ ID NO: 637677 - DNA, 25 bp, Homo sapien
aaggtgtactgcaaggaacaaaatg

SEQ ID NO: 637678 - DNA, 25 bp, Homo sapien
aggtgtactgcaaggaacaaaatgt

SEQ ID NO: 637679 - DNA, 25 bp, Homo sapien
ggtgtactgcaaggaacaaaatgtt

SEQ ID NO: 637680 - DNA, 25 bp, Homo sapien
gaaattaatccacatctttagggtc

SEQ ID NO: 637681 - DNA, 25 bp, Homo sapien
ggtcaaatgatctacaacgaaggta

SEQ ID NO: 637682 - DNA, 25 bp, Homo sapien
gatctacaacgaaggtaccaaaaat

SEQ ID NO: 637683 - DNA, 25 bp, Homo sapien
gcaaaatagggaaaggacagcatct

SEQ ID NO: 637684 - DNA, 25 bp, Homo sapien
ctggatatctacatgaggaagaatg

SEQ ID NO: 637685 - DNA, 25 bp, Homo sapien
gaatgaaattagacccttatctcgt

SEQ ID NO: 637686 - DNA, 25 bp, Homo sapien
gaaattagacccttatctcgtacaa

SEQ ID NO: 637687 - DNA, 25 bp, Homo sapien
agacccttatctcgtacaatacaca

SEQ ID NO: 637688 - DNA, 25 bp, Homo sapien
ctcgtacaatacacaaaattcaact

SEQ ID NO: 637689 - DNA, 25 bp, Homo sapien
aaaaagcttcttgatattggtaggg

SEQ ID NO: 637690 - DNA, 25 bp, Homo sapien
tttttggatatgatccccaaaacac

SEQ ID NO: 637691 - DNA, 25 bp, Homo sapien
ttacaagcatgcgtcaccacagcag

SEQ ID NO: 637692 - DNA, 25 bp, Homo sapien
gtcaccacagcaggcccaattagat

SEQ ID NO: 637693 - DNA, 25 bp, Homo sapien
gtttgaagtatgtctacacctgcaa

SEQ ID NO: 637694 - DNA, 25 bp, Homo sapien
gaccaccaccacaatcgacataatg

SEQ ID NO: 637695 - DNA, 25 bp, Homo sapien
taatgaacatcacccgatgctcgtg

SEQ ID NO: 637696 - DNA, 25 bp, Homo sapien
tgctcgtgttcatcaaagtctctgc

SEQ ID NO: 637697 - DNA, 25 bp, Homo sapien
gttcatcaaagtctctgctctctct

SEQ ID NO: 637698 - DNA, 25 bp, Homo sapien
tctctcttcctatgatcacagcatg

SEQ ID NO: 637699 - DNA, 25 bp, Homo sapien
gcatgtcactgtacactcatttgtt

SEQ ID NO: 637700 - DNA, 25 bp, Homo sapien
tgtttgccttcgtgcttgtgatgtc

SEQ ID NO: 637701 - DNA, 25 bp, Homo sapien
gtgcttgtgatgtcttccccattaa

SEQ ID NO: 637702 - DNA, 25 bp, Homo sapien
taaacagttaccttgcaagctcggg

SEQ ID NO: 637703 - DNA, 25 bp, Homo sapien
taccttgcaagctcgggatgttttc

SEQ ID NO: 637704 - DNA, 25 bp, Homo sapien
gcaagctcgggatgttttcctttaa

SEQ ID NO: 637705 - DNA, 25 bp, Homo sapien
ttatccacttaaaacgtgttcactt

SEQ ID NO: 637706 - DNA, 25 bp, Homo sapien
gctgatatcgctaacaatgtgaaac

SEQ ID NO: 637707 - DNA, 25 bp, Homo sapien
acattttttaattggtaagcctgcg

SEQ ID NO: 637708 - DNA, 25 bp, Homo sapien
taagcctgcgatttggaggaccaat

SEQ ID NO: 637709 - DNA, 25 bp, Homo sapien
ggaccaatgatagcttcctctagcc

SEQ ID NO: 637710 - DNA, 25 bp, Homo sapien
gatagcttcctctagcctaaatctt

SEQ ID NO: 637711 - DNA, 25 bp, Homo sapien
ttcctctagcctaaatcttccatta

SEQ ID NO: 637712 - DNA, 25 bp, Homo sapien
gcctaaatcttccattagagggaga

SEQ ID NO: 637713 - DNA, 25 bp, Homo sapien
gttgaaatgtagtccctaatgttgg

SEQ ID NO: 637714 - DNA, 25 bp, Homo sapien
gggtttggatcatggatccttcatg

SEQ ID NO: 637715 - DNA, 25 bp, Homo sapien
cttcatgaatgtcttggtgccatcc

SEQ ID NO: 637716 - DNA, 25 bp, Homo sapien
catcctccccagtaatgagtgaatt

SEQ ID NO: 637717 - DNA, 25 bp, Homo sapien
gaattctcagttatgagttcacaca

SEQ ID NO: 637718 - DNA, 25 bp, Homo sapien
ctcagttatgagttcacacaatatc

SEQ ID NO: 637719 - DNA, 25 bp, Homo sapien
tctcaccatgtgattcagggaccgc

SEQ ID NO: 637720 - DNA, 25 bp, Homo sapien
accatgtgattcagggaccgcttca

SEQ ID NO: 637721 - DNA, 25 bp, Homo sapien
gtgattcagggaccgcttcatcttc

SEQ ID NO: 637722 - DNA, 25 bp, Homo sapien
agggaccgcttcatcttctgccatg

SEQ ID NO: 637723 - DNA, 25 bp, Homo sapien
gcactatgcttcatgtacagcctac

SEQ ID NO: 637724 - DNA, 25 bp, Homo sapien
taacaaggcatgatcctggaaaact

SEQ ID NO: 637725 - DNA, 25 bp, Homo sapien
gtgtttcacataagctaaatatcct

SEQ ID NO: 637726 - DNA, 25 bp, Homo sapien
gacatttttgcgtaaaggaccagat

SEQ ID NO: 637727 - DNA, 25 bp, Homo sapien
gattttgcaggtcataccatctctg

SEQ ID NO: 637728 - DNA, 25 bp, Homo sapien
ggtcataccatctctgttgcaccta

SEQ ID NO: 637729 - DNA, 25 bp, Homo sapien
tgttgcaccttgtagcatgagaaca

SEQ ID NO: 637730 - DNA, 25 bp, Homo sapien
agcatgagaacagccacagaaaata

SEQ ID NO: 637731 - DNA, 25 bp, Homo sapien
gtaaatagatgtgttccagtaatac

SEQ ID NO: 637732 - DNA, 25 bp, Homo sapien
ataggtagtggactgcatttggccc

SEQ ID NO: 637733 - DNA, 25 bp, Homo sapien
gcatttggcccacagatccatagtt

SEQ ID NO: 637734 - DNA, 25 bp, Homo sapien
gatccatagtttgccaatttctaaa

SEQ ID NO: 637735 - DNA, 25 bp, Homo sapien
gagttcaagttcagccagagcaacc

SEQ ID NO: 637736 - DNA, 25 bp, Homo sapien
cagccagagcaaccctcaggctgag

SEQ ID NO: 637737 - DNA, 25 bp, Homo sapien
gtcacttgacccagggaggtcgatg

SEQ ID NO: 637738 - DNA, 25 bp, Homo sapien
acttgacccagggaggtcgatgctg

SEQ ID NO: 637739 - DNA, 25 bp, Homo sapien
tcattactttaaagggcttccaaag

SEQ ID NO: 637740 - DNA, 25 bp, Homo sapien
agtctatatagaatgaactgccagc

SEQ ID NO: 637741 - DNA, 25 bp, Homo sapien
gcagcccaaggaactataaatggag

SEQ ID NO: 637742 - DNA, 25 bp, Homo sapien
aatggagctccatgtatttatgcaa

SEQ ID NO: 637743 - DNA, 25 bp, Homo sapien
tgcaaatgttgagggcatatattca

SEQ ID NO: 637744 - DNA, 25 bp, Homo sapien
caaagagtgtttggttcctgctgta

SEQ ID NO: 637745 - DNA, 25 bp, Homo sapien
agagtgtttggttcctgctgtatta

SEQ ID NO: 637746 - DNA, 25 bp, Homo sapien
caagtgatcacccatctaagtcttc

SEQ ID NO: 637747 - DNA, 25 bp, Homo sapien
atcacccatctaagtcttccaaagt

SEQ ID NO: 637748 - DNA, 25 bp, Homo sapien
gtttttattaaactgttgcaatgac

SEQ ID NO: 637749 - DNA, 25 bp, Homo sapien
aactgttgcaatgacagcaagacgt

SEQ ID NO: 637750 - DNA, 25 bp, Homo sapien
gacagcaagacgtggtggtgctcac

SEQ ID NO: 637751 - DNA, 25 bp, Homo sapien
ggtgctcacctgtaggcctggttac

SEQ ID NO: 637752 - DNA, 25 bp, Homo sapien
tcacctgtaggcctggttacttagg

SEQ ID NO: 637753 - DNA, 25 bp, Homo sapien
tgtaggcctggttacttaggaggat

SEQ ID NO: 637754 - DNA, 25 bp, Homo sapien
gagggatgagtactgcctgggccca

SEQ ID NO: 637755 - DNA, 25 bp, Homo sapien
tgcagtgcactatgactgactgtga

SEQ ID NO: 637756 - DNA, 25 bp, Homo sapien
tgcactatgactgactgtgaatagc

SEQ ID NO: 637757 - DNA, 25 bp, Homo sapien
aaggcagcacgatttattatcttgt

SEQ ID NO: 637758 - DNA, 25 bp, Homo sapien
ttatcttgtacatgcctgggcaggc

SEQ ID NO: 637759 - DNA, 25 bp, Homo sapien
cctgggcaggcctttaattttgtct

SEQ ID NO: 637760 - DNA, 25 bp, Homo sapien
acacaggatggatttacctaaaata

SEQ ID NO: 637761 - DNA, 25 bp, Homo sapien
acaagtggcactgtataaacaaaat

SEQ ID NO: 637762 - DNA, 25 bp, Homo sapien
ttcactttggaaggctcagagtcat

SEQ ID NO: 637763 - DNA, 25 bp, Homo sapien
tggaaggctcagagtcatctctaca

SEQ ID NO: 637764 - DNA, 25 bp, Homo sapien
cctgtggttgccagtgggaaaagcc

SEQ ID NO: 637765 - DNA, 25 bp, Homo sapien
tgggaaaagccattccacgggtagg

SEQ ID NO: 637766 - DNA, 25 bp, Homo sapien
attccacgggtaggaagacctcata

SEQ ID NO: 637767 - DNA, 25 bp, Homo sapien
gaagacctcatagacatcgaagaca

SEQ ID NO: 637768 - DNA, 25 bp, Homo sapien
aagcagtatgaccactttaataata

SEQ ID NO: 637769 - DNA, 25 bp, Homo sapien
agcagtatgaccactttaataatac

SEQ ID NO: 637770 - DNA, 25 bp, Homo sapien
gcagtatgaccactttaataatact

SEQ ID NO: 637771 - DNA, 25 bp, Homo sapien
gtatgaccactttaataatactgat

SEQ ID NO: 637772 - DNA, 25 bp, Homo sapien
tatgaccactttaataatactgatt

SEQ ID NO: 637773 - DNA, 25 bp, Homo sapien
atgaccactttaataatactgattc

SEQ ID NO: 637774 - DNA, 25 bp, Homo sapien
tgaccactttaataatactgattct

SEQ ID NO: 637775 - DNA, 25 bp, Homo sapien
gaccactttaataatactgattctt

SEQ ID NO: 637776 - DNA, 25 bp, Homo sapien
accactttaataatactgattcttc

SEQ ID NO: 637777 - DNA, 25 bp, Homo sapien
tatctatgagcatggaatttttttt

SEQ ID NO: 637778 - DNA, 25 bp, Homo sapien
tttttcatttgatagggtggagggt

SEQ ID NO: 637779 - DNA, 25 bp, Homo sapien
aagcttcctaactgaggagccccac

SEQ ID NO: 637780 - DNA, 25 bp, Homo sapien
tctgggcacccctgccaaatgagcg

SEQ ID NO: 637781 - DNA, 25 bp, Homo sapien
aaatgagcgggcacctctatgttcc

SEQ ID NO: 637782 - DNA, 25 bp, Homo sapien
agcgggcacctctatgttccagcag

SEQ ID NO: 637783 - DNA, 25 bp, Homo sapien
gctgcccagcttctgagctgcaagc

SEQ ID NO: 637784 - DNA, 25 bp, Homo sapien
agccagcttccttccacagaattct

SEQ ID NO: 637785 - DNA, 25 bp, Homo sapien
acagaattctctgcaccttggcttc

SEQ ID NO: 637786 - DNA, 25 bp, Homo sapien
ttggcttccggtggctccaagcact

SEQ ID NO: 637787 - DNA, 25 bp, Homo sapien
aagcactttgccatctgccgagtca

SEQ ID NO: 637788 - DNA, 25 bp, Homo sapien
tgccgagtcagttctgccagagatg

SEQ ID NO: 637789 - DNA, 25 bp, Homo sapien
aggtcacctttactctcagaaggaa

SEQ ID NO: 637790 - DNA, 25 bp, Homo sapien
attccccaaagtttatgtgttgtca

SEQ ID NO: 637791 - DNA, 25 bp, Homo sapien
gttgattaagtcacaaggactgctt

SEQ ID NO: 637792 - DNA, 25 bp, Homo sapien
caaggactgctttcgtgactggatt

SEQ ID NO: 637793 - DNA, 25 bp, Homo sapien
gctttcgtgactggattaatgttgt

SEQ ID NO: 637794 - DNA, 25 bp, Homo sapien
ggttagttatcataagagtgacttc

SEQ ID NO: 637795 - DNA, 25 bp, Homo sapien
gagtgacttcgttacaaaacctttg

SEQ ID NO: 637796 - DNA, 25 bp, Homo sapien
ccctcttgatcttttgctctcaata

SEQ ID NO: 637797 - DNA, 25 bp, Homo sapien
gatcttttgctctcaatacttcttg

SEQ ID NO: 637798 - DNA, 25 bp, Homo sapien
gatgatgctgcacaaaagtcctcat

SEQ ID NO: 637799 - DNA, 25 bp, Homo sapien
aaagtcctcatcagatgccatgctc

SEQ ID NO: 637800 - DNA, 25 bp, Homo sapien
tcctcatcagatgccatgctcttgg

SEQ ID NO: 637801 - DNA, 25 bp, Homo sapien
ttattttgtgcgtctcagatgatga

SEQ ID NO: 637802 - DNA, 25 bp, Homo sapien
gcgtctcagatgatgacatgtattg

SEQ ID NO: 637803 - DNA, 25 bp, Homo sapien
tattctatcacatatgacttttaca

SEQ ID NO: 637804 - DNA, 25 bp, Homo sapien
aaatgttgtcagcttggtaaacaaa

SEQ ID NO: 637805 - DNA, 25 bp, Homo sapien
attatcacgctttagtttttcttcg

SEQ ID NO: 637806 - DNA, 25 bp, Homo sapien
gctttagtttttcttcgttgatcat

SEQ ID NO: 637807 - DNA, 25 bp, Homo sapien
gaagattagtgtctcctcatttcat

SEQ ID NO: 637808 - DNA, 25 bp, Homo sapien
cctcatttcatggatgtcacaacta

SEQ ID NO: 637809 - DNA, 25 bp, Homo sapien
ggatgtcacaactacatgttcttaa

SEQ ID NO: 637810 - DNA, 25 bp, Homo sapien
gtgttttccctgttaatgttggata

SEQ ID NO: 637811 - DNA, 25 bp, Homo sapien
taatgttggatactccagtgttcag

SEQ ID NO: 637812 - DNA, 25 bp, Homo sapien
ggattgtctagcgattagccaaacc

SEQ ID NO: 637813 - DNA, 25 bp, Homo sapien
gcgattagccaaaccgactggattt

SEQ ID NO: 637814 - DNA, 25 bp, Homo sapien
aaatatcccgttagcactacttctg

SEQ ID NO: 637815 - DNA, 25 bp, Homo sapien
tgccgagtccacatggccatgaagc

SEQ ID NO: 637816 - DNA, 25 bp, Homo sapien
gagacatacgggagctcggtaatga

SEQ ID NO: 637817 - DNA, 25 bp, Homo sapien
atggaaaccttcttttctggtgttg

SEQ ID NO: 637818 - DNA, 25 bp, Homo sapien
ttctggtgttgctcactcataaatg

SEQ ID NO: 637819 - DNA, 25 bp, Homo sapien
gaagctgctttatggagcacgagca

SEQ ID NO: 637820 - DNA, 25 bp, Homo sapien
gagggaaaatgactgcgcccagcct

SEQ ID NO: 637821 - DNA, 25 bp, Homo sapien
cagcctgatttatctgctcagacgc

SEQ ID NO: 637822 - DNA, 25 bp, Homo sapien
gctcagacgctttgtagtgcttcag

SEQ ID NO: 637823 - DNA, 25 bp, Homo sapien
atttgtgggttaattgagctctgac

SEQ ID NO: 637824 - DNA, 25 bp, Homo sapien
gtgggttaattgagctctgactgca

SEQ ID NO: 637825 - DNA, 25 bp, Homo sapien
caggggtacctgtgcagaacatgca

SEQ ID NO: 637826 - DNA, 25 bp, Homo sapien
cgccctgacgggagttttatgtgtt

SEQ ID NO: 637827 - DNA, 25 bp, Homo sapien
cctgacgggagttttatgtgttaat

SEQ ID NO: 637828 - DNA, 25 bp, Homo sapien
taatatgagtgtctgctatgggcca

SEQ ID NO: 637829 - DNA, 25 bp, Homo sapien
atgagtgtctgctatgggccattca

SEQ ID NO: 637830 - DNA, 25 bp, Homo sapien
tgctatgggccattcattgtgctag

SEQ ID NO: 637831 - DNA, 25 bp, Homo sapien
atgggccattcattgtgctagatgc

SEQ ID NO: 637832 - DNA, 25 bp, Homo sapien
gtgctagatgcttaccataaaaatg

SEQ ID NO: 637833 - DNA, 25 bp, Homo sapien
aaatgtcttcatttgtacaataacc

SEQ ID NO: 637834 - DNA, 25 bp, Homo sapien
ttatcctaagtcaattaacacagga

SEQ ID NO: 637835 - DNA, 25 bp, Homo sapien
gagttaaacattgagaacacttgga

SEQ ID NO: 637836 - DNA, 25 bp, Homo sapien
gaaaggaacagtagacgtcgggcct

SEQ ID NO: 637837 - DNA, 25 bp, Homo sapien
gaacagtagacgtcgggcctactgg

SEQ ID NO: 637838 - DNA, 25 bp, Homo sapien
aaactacctatctgatactatgttc

SEQ ID NO: 637839 - DNA, 25 bp, Homo sapien
acctatctgatactatgttcattac

SEQ ID NO: 637840 - DNA, 25 bp, Homo sapien
tgtacacaaaactcccatgacaggc

SEQ ID NO: 637841 - DNA, 25 bp, Homo sapien
aaaactcccatgacaggcagtttac

SEQ ID NO: 637842 - DNA, 25 bp, Homo sapien
atgacaggcagtttacccatgtagc

SEQ ID NO: 637843 - DNA, 25 bp, Homo sapien
gacaggcagtttacccatgtagcaa

SEQ ID NO: 637844 - DNA, 25 bp, Homo sapien
ggcagtttacccatgtagcaaacct

SEQ ID NO: 637845 - DNA, 25 bp, Homo sapien
tggcgcagtcggtttaataatgata

SEQ ID NO: 637846 - DNA, 25 bp, Homo sapien
taccaaggtaaagatcaaattttat

SEQ ID NO: 637847 - DNA, 25 bp, Homo sapien
gtttaagcatttagttgtattgccc

SEQ ID NO: 637848 - DNA, 25 bp, Homo sapien
tttaagcatttagttgtattgccct

SEQ ID NO: 637849 - DNA, 25 bp, Homo sapien
ttaagcatttagttgtattgccctg

SEQ ID NO: 637850 - DNA, 25 bp, Homo sapien
taagcatttagttgtattgccctgt

SEQ ID NO: 637851 - DNA, 25 bp, Homo sapien
aagcatttagttgtattgccctgtt

SEQ ID NO: 637852 - DNA, 25 bp, Homo sapien
agcatttagttgtattgccctgtta

SEQ ID NO: 637853 - DNA, 25 bp, Homo sapien
gcatttagttgtattgccctgttaa

SEQ ID NO: 637854 - DNA, 25 bp, Homo sapien
catttagttgtattgccctgttaag

SEQ ID NO: 637855 - DNA, 25 bp, Homo sapien
atttagttgtattgccctgttaagt

SEQ ID NO: 637856 - DNA, 25 bp, Homo sapien
gttgggccatttattaagctgggaa

SEQ ID NO: 637857 - DNA, 25 bp, Homo sapien
catttattaagctgggaattttgtc

SEQ ID NO: 637858 - DNA, 25 bp, Homo sapien
gaattttgtctttgggctcatggac

SEQ ID NO: 637859 - DNA, 25 bp, Homo sapien
tctttgggctcatggacattattcc

SEQ ID NO: 637860 - DNA, 25 bp, Homo sapien
cattattccaaaggttgtcttgtct

SEQ ID NO: 637861 - DNA, 25 bp, Homo sapien
ttgtctttgggctcatgaacattat

SEQ ID NO: 637862 - DNA, 25 bp, Homo sapien
gggctcatgaacattattccaaagg

SEQ ID NO: 637863 - DNA, 25 bp, Homo sapien
aaattatgatttcagtttcttccta

SEQ ID NO: 637864 - DNA, 25 bp, Homo sapien
tcagtttcttcctagtgtagggcaa

SEQ ID NO: 637865 - DNA, 25 bp, Homo sapien
gtttcttcctagtgtagggcaattc

SEQ ID NO: 637866 - DNA, 25 bp, Homo sapien
cttcctagtgtagggcaattcaaaa

SEQ ID NO: 637867 - DNA, 25 bp, Homo sapien
gaaactaatactgttgggatcccat

SEQ ID NO: 637868 - DNA, 25 bp, Homo sapien
ggctttgagcttttaatgggctgct

SEQ ID NO: 637869 - DNA, 25 bp, Homo sapien
atgggctgctattgaggacctctta

SEQ ID NO: 637870 - DNA, 25 bp, Homo sapien
attgaggacctcttatgtgtcagac

SEQ ID NO: 637871 - DNA, 25 bp, Homo sapien
gagctaagcatttcacctgcgttat

SEQ ID NO: 637872 - DNA, 25 bp, Homo sapien
atcaaaatggtgttgctgtccccat

SEQ ID NO: 637873 - DNA, 25 bp, Homo sapien
cagatgagggctttggaagtccagt

SEQ ID NO: 637874 - DNA, 25 bp, Homo sapien
aagtccagtcaggtgaagtcactta

SEQ ID NO: 637875 - DNA, 25 bp, Homo sapien
ggtgaagtcacttacgcaatatcaa

SEQ ID NO: 637876 - DNA, 25 bp, Homo sapien
cgcaatatcaaacactcaggcagag

SEQ ID NO: 637877 - DNA, 25 bp, Homo sapien
gactgaaagtcaattttgcctgacc

SEQ ID NO: 637878 - DNA, 25 bp, Homo sapien
cacaaaaccagaaggcaatttaaca

SEQ ID NO: 637879 - DNA, 25 bp, Homo sapien
caatttaacatatctgcctggaggc

SEQ ID NO: 637880 - DNA, 25 bp, Homo sapien
ctgcctggaggcaagaagagaaacc

SEQ ID NO: 637881 - DNA, 25 bp, Homo sapien
gaaaccaaagaacttctaacacctg

SEQ ID NO: 637882 - DNA, 25 bp, Homo sapien
ttctaacacctgttcttctagctag

SEQ ID NO: 637883 - DNA, 25 bp, Homo sapien
aacacctgttcttctagctagaaaa

SEQ ID NO: 637884 - DNA, 25 bp, Homo sapien
aatattaacaattgcttgccagctt

SEQ ID NO: 637885 - DNA, 25 bp, Homo sapien
aattgcttgccagcttcaaattccc

SEQ ID NO: 637886 - DNA, 25 bp, Homo sapien
gccagcttcaaattcccacaaattt

SEQ ID NO: 637887 - DNA, 25 bp, Homo sapien
tatgaagccagtttccaaaagaaaa

SEQ ID NO: 637888 - DNA, 25 bp, Homo sapien
aaagtgatcttttaccttaatgata

SEQ ID NO: 637889 - DNA, 25 bp, Homo sapien
tgcccagcctcaagtgttgagttgt

SEQ ID NO: 637890 - DNA, 25 bp, Homo sapien
tcaagtgttgagttgttaacctttc

SEQ ID NO: 637891 - DNA, 25 bp, Homo sapien
gtgttgagttgttaacctttcttat

SEQ ID NO: 637892 - DNA, 25 bp, Homo sapien
tgagttgttaacctttcttattgta

SEQ ID NO: 637893 - DNA, 25 bp, Homo sapien
ataacaaaatttgccgttttcacag

SEQ ID NO: 637894 - DNA, 25 bp, Homo sapien
tcagcaacattaagcacattcacaa

SEQ ID NO: 637895 - DNA, 25 bp, Homo sapien
gcaacattaagcacattcacaacgt

SEQ ID NO: 637896 - DNA, 25 bp, Homo sapien
acattaagcacattcacaacgttgt

SEQ ID NO: 637897 - DNA, 25 bp, Homo sapien
gtaaccatcaccacgtatccctttc

SEQ ID NO: 637898 - DNA, 25 bp, Homo sapien
cgtatccctttccagaacttttcat

SEQ ID NO: 637899 - DNA, 25 bp, Homo sapien
aataatagctccctattccttctac

SEQ ID NO: 637900 - DNA, 25 bp, Homo sapien
attctataaactcttccactattag

SEQ ID NO: 637901 - DNA, 25 bp, Homo sapien
gaagtttgtttcgagtcattatgaa

SEQ ID NO: 637902 - DNA, 25 bp, Homo sapien
atgaacattccatacttgtctgctg

SEQ ID NO: 637903 - DNA, 25 bp, Homo sapien
ttgtctgctggtaagattcctttct

SEQ ID NO: 637904 - DNA, 25 bp, Homo sapien
gattcctttcttagggcatatatac

SEQ ID NO: 637905 - DNA, 25 bp, Homo sapien
gcttaaaaactcttaatcgtggcca

SEQ ID NO: 637906 - DNA, 25 bp, Homo sapien
aatcgtggccaaaagtaatacattt

SEQ ID NO: 637907 - DNA, 25 bp, Homo sapien
tgtcacaacgctgaaacacatatgt

SEQ ID NO: 637908 - DNA, 25 bp, Homo sapien
aattcacgagaatatatcccttagt

SEQ ID NO: 637909 - DNA, 25 bp, Homo sapien
atatcccttagtatgtttttatgca

SEQ ID NO: 637910 - DNA, 25 bp, Homo sapien
gtatgtttttatgcacaccaattta

SEQ ID NO: 637911 - DNA, 25 bp, Homo sapien
acagcggccggcctactttttcagt

SEQ ID NO: 637912 - DNA, 25 bp, Homo sapien
cggccggcctactttttcagtctct

SEQ ID NO: 637913 - DNA, 25 bp, Homo sapien
cttagatagataattcagttctcct

SEQ ID NO: 637914 - DNA, 25 bp, Homo sapien
ttcagttctcctttgtgtgaaaaat

SEQ ID NO: 637915 - DNA, 25 bp, Homo sapien
agttctcctttgtgtgaaaaatatc

SEQ ID NO: 637916 - DNA, 25 bp, Homo sapien
gtgtgaaaaatatctttgactaagt

SEQ ID NO: 637917 - DNA, 25 bp, Homo sapien
atctttgactaagttgtgttgcttt

SEQ ID NO: 637918 - DNA, 25 bp, Homo sapien
tttctttttagcagccaactcttcc

SEQ ID NO: 637919 - DNA, 25 bp, Homo sapien
ttctttttagcagccaactcttcct

SEQ ID NO: 637920 - DNA, 25 bp, Homo sapien
agagtcatcagtcatcctactcttc

SEQ ID NO: 637921 - DNA, 25 bp, Homo sapien
ttccgatcagcatcactgctcatga

SEQ ID NO: 637922 - DNA, 25 bp, Homo sapien
gcaggctttcaaatagcatatactc

SEQ ID NO: 637923 - DNA, 25 bp, Homo sapien
actctgtgggagcaattccacttct

SEQ ID NO: 637924 - DNA, 25 bp, Homo sapien
ccacttctggagatagattttttaa

SEQ ID NO: 637925 - DNA, 25 bp, Homo sapien
tgttcgtagcagcatcatacacaat

SEQ ID NO: 637926 - DNA, 25 bp, Homo sapien
gcagcatcatacacaatagcccaga

SEQ ID NO: 637927 - DNA, 25 bp, Homo sapien
atagcccagaggtagaagcaaccca

SEQ ID NO: 637928 - DNA, 25 bp, Homo sapien
agcaacccaggcgttcattgacgga

SEQ ID NO: 637929 - DNA, 25 bp, Homo sapien
aggcgttcattgacggatgcatgga

SEQ ID NO: 637930 - DNA, 25 bp, Homo sapien
ggaacattcagccttcaagaggaaa

SEQ ID NO: 637931 - DNA, 25 bp, Homo sapien
aagggattctgtcaaggatgctgca

SEQ ID NO: 637932 - DNA, 25 bp, Homo sapien
ggatgctgcagcgtggataaagctt

SEQ ID NO: 637933 - DNA, 25 bp, Homo sapien
gtacaatgctgcaattatctgtgca

SEQ ID NO: 637934 - DNA, 25 bp, Homo sapien
tgtttccccttctggacagagacac

SEQ ID NO: 637935 - DNA, 25 bp, Homo sapien
gagacactcaccctttgttgtatac

SEQ ID NO: 637936 - DNA, 25 bp, Homo sapien
gtatacttgcactgagagctacatg

SEQ ID NO: 637937 - DNA, 25 bp, Homo sapien
gagctacatgtgtcccactagttta

SEQ ID NO: 637938 - DNA, 25 bp, Homo sapien
gggcaactctgaaaggtgcttctct

SEQ ID NO: 637939 - DNA, 25 bp, Homo sapien
gaaaggtgcttctctctccagaact

SEQ ID NO: 637940 - DNA, 25 bp, Homo sapien
cagaacttcccttatgacccatgaa

SEQ ID NO: 637941 - DNA, 25 bp, Homo sapien
cttatgacccatgaaggcttctgtt

SEQ ID NO: 637942 - DNA, 25 bp, Homo sapien
aggcttctgttacaactgcgttgca

SEQ ID NO: 637943 - DNA, 25 bp, Homo sapien
tgcgttgcagtttaacttctccttc

SEQ ID NO: 637944 - DNA, 25 bp, Homo sapien
ccagctagctgggtgaagttctcac

SEQ ID NO: 637945 - DNA, 25 bp, Homo sapien
gggtgaagttctcacagtgtccact

SEQ ID NO: 637946 - DNA, 25 bp, Homo sapien
tcacagtgtccactagatgccgcgc

SEQ ID NO: 637947 - DNA, 25 bp, Homo sapien
gtgtccactagatgccgcgcctaca

SEQ ID NO: 637948 - DNA, 25 bp, Homo sapien
tctctgtgcagggtgtgtgatgtgt

SEQ ID NO: 637949 - DNA, 25 bp, Homo sapien
gtggcttcccagacagtcatccgac

SEQ ID NO: 637950 - DNA, 25 bp, Homo sapien
agacagtcatccgacaggcactttc

SEQ ID NO: 637951 - DNA, 25 bp, Homo sapien
tcatccgacaggcactttccaagtc

SEQ ID NO: 637952 - DNA, 25 bp, Homo sapien
agggcttcctgagtggcaagagcta

SEQ ID NO: 637953 - DNA, 25 bp, Homo sapien
cttcctgagtggcaagagctacgcc

SEQ ID NO: 637954 - DNA, 25 bp, Homo sapien
caagagctacgcctgggctgggtgc

SEQ ID NO: 637955 - DNA, 25 bp, Homo sapien
gattatctctcaaaggagaaatgga

SEQ ID NO: 637956 - DNA, 25 bp, Homo sapien
gtgatagaggtctgggctgggtgca

SEQ ID NO: 637957 - DNA, 25 bp, Homo sapien
ttgtaatgtttggagtttttagcct

SEQ ID NO: 637958 - DNA, 25 bp, Homo sapien
gagtttttagcctcacagtggattt

SEQ ID NO: 637959 - DNA, 25 bp, Homo sapien
agtttttagcctcacagtggatttg

SEQ ID NO: 637960 - DNA, 25 bp, Homo sapien
gtttttagcctcacagtggatttga

SEQ ID NO: 637961 - DNA, 25 bp, Homo sapien
tttttagcctcacagtggatttgat

SEQ ID NO: 637962 - DNA, 25 bp, Homo sapien
ttttagcctcacagtggatttgata

SEQ ID NO: 637963 - DNA, 25 bp, Homo sapien
ttagcctcacagtggatttgataaa

SEQ ID NO: 637964 - DNA, 25 bp, Homo sapien
agcctcacagtggatttgataaatt

SEQ ID NO: 637965 - DNA, 25 bp, Homo sapien
gcctcacagtggatttgataaatta

SEQ ID NO: 637966 - DNA, 25 bp, Homo sapien
tatgaatgcatttggactgagcctc

SEQ ID NO: 637967 - DNA, 25 bp, Homo sapien
gtagtttgaggtcttggaacaccat

SEQ ID NO: 637968 - DNA, 25 bp, Homo sapien
aggtcttggaacaccattgcgtttc

SEQ ID NO: 637969 - DNA, 25 bp, Homo sapien
tggaacaccattgcgtttccagcac

SEQ ID NO: 637970 - DNA, 25 bp, Homo sapien
tttccagcaccgtgtctttatgtga

SEQ ID NO: 637971 - DNA, 25 bp, Homo sapien
caccgtgtctttatgtgaacaggtc

SEQ ID NO: 637972 - DNA, 25 bp, Homo sapien
tgaacaggtctgtctttaagccaat

SEQ ID NO: 637973 - DNA, 25 bp, Homo sapien
aagccaatgactattttgctcgatt

SEQ ID NO: 637974 - DNA, 25 bp, Homo sapien
gagtaggacaaaaaacaacggccat

SEQ ID NO: 637975 - DNA, 25 bp, Homo sapien
aacaacggccatacatatgatttga

SEQ ID NO: 637976 - DNA, 25 bp, Homo sapien
cagataatcaccattcatgacctgt

SEQ ID NO: 637977 - DNA, 25 bp, Homo sapien
gagggttcaggagctctgtgaatac

SEQ ID NO: 637978 - DNA, 25 bp, Homo sapien
gctctgtgaatactctgggaggatc

SEQ ID NO: 637979 - DNA, 25 bp, Homo sapien
ctgggaggatccagcgggttccaca

SEQ ID NO: 637980 - DNA, 25 bp, Homo sapien
gggtccccacgtgaaagcagaagaa

SEQ ID NO: 637981 - DNA, 25 bp, Homo sapien
gctcaatgaacaaaaaaggaccttt

SEQ ID NO: 637982 - DNA, 25 bp, Homo sapien
gacctttgttgctttcttggctgta

SEQ ID NO: 637983 - DNA, 25 bp, Homo sapien
ttgctttcttggctgtagccctcaa

SEQ ID NO: 637984 - DNA, 25 bp, Homo sapien
tttcttggctgtagccctcaacaca

SEQ ID NO: 637985 - DNA, 25 bp, Homo sapien
agaagcaccctggtttctccagcaa

SEQ ID NO: 637986 - DNA, 25 bp, Homo sapien
gcaccctggtttctccagcaaaaaa

SEQ ID NO: 637987 - DNA, 25 bp, Homo sapien
agaaagtcaactgggaaattctgaa

SEQ ID NO: 637988 - DNA, 25 bp, Homo sapien
ttttcagccatcaaacgtaatttag

SEQ ID NO: 637989 - DNA, 25 bp, Homo sapien
tttcagccatcaaacgtaatttaga

SEQ ID NO: 637990 - DNA, 25 bp, Homo sapien
tttagaaaactcaagggccaggcgt

SEQ ID NO: 637991 - DNA, 25 bp, Homo sapien
ttagaaaactcaagggccaggcgtg

SEQ ID NO: 637992 - DNA, 25 bp, Homo sapien
tagaaaactcaagggccaggcgtgg

SEQ ID NO: 637993 - DNA, 25 bp, Homo sapien
agaaaactcaagggccaggcgtggt

SEQ ID NO: 637994 - DNA, 25 bp, Homo sapien
gaaaactcaagggccaggcgtggtg

SEQ ID NO: 637995 - DNA, 25 bp, Homo sapien
aaaactcaagggccaggcgtggtgg

SEQ ID NO: 637996 - DNA, 25 bp, Homo sapien
tggcaaacatggcgaaccctgtctc

SEQ ID NO: 637997 - DNA, 25 bp, Homo sapien
caagatcatgacattgcactctagc

SEQ ID NO: 637998 - DNA, 25 bp, Homo sapien
aagatcatgacattgcactctagcc

SEQ ID NO: 637999 - DNA, 25 bp, Homo sapien
taccagtaaggaattcattttttat

SEQ ID NO: 638000 - DNA, 25 bp, Homo sapien
tattacattgtatgtgccaaatgaa

SEQ ID NO: 638001 - DNA, 25 bp, Homo sapien
tatttatgagttagtcccagcccca

SEQ ID NO: 638002 - DNA, 25 bp, Homo sapien
tccggccttggcctctggaaagcct

SEQ ID NO: 638003 - DNA, 25 bp, Homo sapien
gaaagcctctgaaacagtagggatt

SEQ ID NO: 638004 - DNA, 25 bp, Homo sapien
ggaggccaaggatctgctgcgcctt

SEQ ID NO: 638005 - DNA, 25 bp, Homo sapien
ctgctgcgcctttccagtcaggtgg

SEQ ID NO: 638006 - DNA, 25 bp, Homo sapien
caggtgggtcacaatgagatggtta

SEQ ID NO: 638007 - DNA, 25 bp, Homo sapien
gagatggttaagtgtttgagcagac

SEQ ID NO: 638008 - DNA, 25 bp, Homo sapien
gtttgagcagactgtgaccacacta

SEQ ID NO: 638009 - DNA, 25 bp, Homo sapien
cactaaaagtgatgcttcacctggg

SEQ ID NO: 638010 - DNA, 25 bp, Homo sapien
ggtatcattcaatcctttcactttt

SEQ ID NO: 638011 - DNA, 25 bp, Homo sapien
cattcaatcctttcactttttatgg

SEQ ID NO: 638012 - DNA, 25 bp, Homo sapien
taccacattggtaggttaatgatac

SEQ ID NO: 638013 - DNA, 25 bp, Homo sapien
ggtaggttaatgatacattcatcaa

SEQ ID NO: 638014 - DNA, 25 bp, Homo sapien
gtaacaaccttgttaggaggagttg

SEQ ID NO: 638015 - DNA, 25 bp, Homo sapien
ccttgttaggaggagttgtttacag

SEQ ID NO: 638016 - DNA, 25 bp, Homo sapien
gaggatatactagtactctttcagt

SEQ ID NO: 638017 - DNA, 25 bp, Homo sapien
tatactagtactctttcagttttaa

SEQ ID NO: 638018 - DNA, 25 bp, Homo sapien
ttaactaaagcttccatttactgat

SEQ ID NO: 638019 - DNA, 25 bp, Homo sapien
gcttccatttactgatagctcaatt

SEQ ID NO: 638020 - DNA, 25 bp, Homo sapien
tgatagctcaattttgtgccattgc

SEQ ID NO: 638021 - DNA, 25 bp, Homo sapien
aaaggccaacgcaggcggatcaccg

SEQ ID NO: 638022 - DNA, 25 bp, Homo sapien
atagataaatagatccaacatccag

SEQ ID NO: 638023 - DNA, 25 bp, Homo sapien
tagataaatagatccaacatccagg

SEQ ID NO: 638024 - DNA, 25 bp, Homo sapien
agataaatagatccaacatccagga

SEQ ID NO: 638025 - DNA, 25 bp, Homo sapien
gataaatagatccaacatccaggag

SEQ ID NO: 638026 - DNA, 25 bp, Homo sapien
ataaatagatccaacatccaggagg

SEQ ID NO: 638027 - DNA, 25 bp, Homo sapien
taaatagatccaacatccaggaggt

SEQ ID NO: 638028 - DNA, 25 bp, Homo sapien
aaatagatccaacatccaggaggtg

SEQ ID NO: 638029 - DNA, 25 bp, Homo sapien
aatagatccaacatccaggaggtgt

SEQ ID NO: 638030 - DNA, 25 bp, Homo sapien
atagatccaacatccaggaggtgtt

SEQ ID NO: 638031 - DNA, 25 bp, Homo sapien
tagatccaacatccaggaggtgttg

SEQ ID NO: 638032 - DNA, 25 bp, Homo sapien
ggagctcgattcacgtacagcactt

SEQ ID NO: 638033 - DNA, 25 bp, Homo sapien
gattcacgtacagcacttctgtggg

SEQ ID NO: 638034 - DNA, 25 bp, Homo sapien
gaagaacacatcatatgcaactaat

SEQ ID NO: 638035 - DNA, 25 bp, Homo sapien
tcattatttaagagtcccctgttac

SEQ ID NO: 638036 - DNA, 25 bp, Homo sapien
agtcccctgttacttctttagtcat

SEQ ID NO: 638037 - DNA, 25 bp, Homo sapien
tcatttcctttgactctgctacaga

SEQ ID NO: 638038 - DNA, 25 bp, Homo sapien
actctgctacagataggattatagg

SEQ ID NO: 638039 - DNA, 25 bp, Homo sapien
gggaccttgaacctattcaccatta

SEQ ID NO: 638040 - DNA, 25 bp, Homo sapien
tgtctctttaagctggcaaacccat

SEQ ID NO: 638041 - DNA, 25 bp, Homo sapien
tggcaaacccatcattaaatagcac

SEQ ID NO: 638042 - DNA, 25 bp, Homo sapien
tatgggataagtagtacagcttcag

SEQ ID NO: 638043 - DNA, 25 bp, Homo sapien
caggacacaaatgcttattattggg

SEQ ID NO: 638044 - DNA, 25 bp, Homo sapien
ggtctcaacattaacgttaccttgc

SEQ ID NO: 638045 - DNA, 25 bp, Homo sapien
agtcactgaacaagcaattactgtg

SEQ ID NO: 638046 - DNA, 25 bp, Homo sapien
aagcaattactgtgaaggtcgacgt

SEQ ID NO: 638047 - DNA, 25 bp, Homo sapien
attactgtgaaggtcgacgtggaaa

SEQ ID NO: 638048 - DNA, 25 bp, Homo sapien
ggtcgacgtggaaaaatgaggcaat

SEQ ID NO: 638049 - DNA, 25 bp, Homo sapien
cggtgttctaccagattccaagttg

SEQ ID NO: 638050 - DNA, 25 bp, Homo sapien
gttctaccagattccaagttgaaga

SEQ ID NO: 638051 - DNA, 25 bp, Homo sapien
attccaagttgaagaggtgctcgac

SEQ ID NO: 638052 - DNA, 25 bp, Homo sapien
agaggtgctcgacaggcacacacat

SEQ ID NO: 638053 - DNA, 25 bp, Homo sapien
gcacacacatcccatgactaaacaa

SEQ ID NO: 638054 - DNA, 25 bp, Homo sapien
cttttaggtaatcaagttcagttat

SEQ ID NO: 638055 - DNA, 25 bp, Homo sapien
ggtaatcaagttcagttattaagaa

SEQ ID NO: 638056 - DNA, 25 bp, Homo sapien
gaaatggatgtttgcaacattcata

SEQ ID NO: 638057 - DNA, 25 bp, Homo sapien
gatgtttgcaacattcatagtaatt

SEQ ID NO: 638058 - DNA, 25 bp, Homo sapien
aaattatattttcatcccattcaga

SEQ ID NO: 638059 - DNA, 25 bp, Homo sapien
atattttcatcccattcagatatta

SEQ ID NO: 638060 - DNA, 25 bp, Homo sapien
ttttcatcccattcagatattatat

SEQ ID NO: 638061 - DNA, 25 bp, Homo sapien
ttaactgtgagataattctcagaga

SEQ ID NO: 638062 - DNA, 25 bp, Homo sapien
tcaaaatatccactctaaaataaat

SEQ ID NO: 638063 - DNA, 25 bp, Homo sapien
aaattagctccgattatttcttctt

SEQ ID NO: 638064 - DNA, 25 bp, Homo sapien
aaataaagtgaacgttttggctcat

SEQ ID NO: 638065 - DNA, 25 bp, Homo sapien
gagacaacaaaccttcctgtacaga

SEQ ID NO: 638066 - DNA, 25 bp, Homo sapien
gtacagataaactctcggtgcctca

SEQ ID NO: 638067 - DNA, 25 bp, Homo sapien
gtgcatgagatgtggcttactcagc

SEQ ID NO: 638068 - DNA, 25 bp, Homo sapien
gttgtcgtggagtcaggtcctctgc

SEQ ID NO: 638069 - DNA, 25 bp, Homo sapien
ggtcctctgctttatgtgattgttt

SEQ ID NO: 638070 - DNA, 25 bp, Homo sapien
gagctgtgcttccagagatgtctgc

SEQ ID NO: 638071 - DNA, 25 bp, Homo sapien
agagatgtctgcacctgtgcactgc

SEQ ID NO: 638072 - DNA, 25 bp, Homo sapien
ctgtgcactgcattttggactatat

SEQ ID NO: 638073 - DNA, 25 bp, Homo sapien
tggactatatgctctgtggacgctg

SEQ ID NO: 638074 - DNA, 25 bp, Homo sapien
tgtggacgctgtgagaatcccctaa

SEQ ID NO: 638075 - DNA, 25 bp, Homo sapien
tgagaatcccctaactttgcttttt

SEQ ID NO: 638076 - DNA, 25 bp, Homo sapien
tactctgccttcactagggaatgat

SEQ ID NO: 638077 - DNA, 25 bp, Homo sapien
ctgccttcactagggaatgatgtac

SEQ ID NO: 638078 - DNA, 25 bp, Homo sapien
ttcccctggctccttgtaggcaaat

SEQ ID NO: 638079 - DNA, 25 bp, Homo sapien
cctggctccttgtaggcaaatgcta

SEQ ID NO: 638080 - DNA, 25 bp, Homo sapien
tgtaggcaaatgctactcctcttgc

SEQ ID NO: 638081 - DNA, 25 bp, Homo sapien
tcctcttgcttcttttgacagtaac

SEQ ID NO: 638082 - DNA, 25 bp, Homo sapien
tcttgcttcttttgacagtaacatt

SEQ ID NO: 638083 - DNA, 25 bp, Homo sapien
gcttcttttgacagtaacattatta

SEQ ID NO: 638084 - DNA, 25 bp, Homo sapien
gtaacattattatgactgtaagcaa

SEQ ID NO: 638085 - DNA, 25 bp, Homo sapien
agcaatgctactctgccttcactag

SEQ ID NO: 638086 - DNA, 25 bp, Homo sapien
atgctactctgccttcactagggaa

SEQ ID NO: 638087 - DNA, 25 bp, Homo sapien
aatagataaatagatccaacatcca

SEQ ID NO: 638088 - DNA, 25 bp, Homo sapien
atagataaatagatccaacatccag

SEQ ID NO: 638089 - DNA, 25 bp, Homo sapien
tagataaatagatccaacatccagg

SEQ ID NO: 638090 - DNA, 25 bp, Homo sapien
agataaatagatccaacatccagga

SEQ ID NO: 638091 - DNA, 25 bp, Homo sapien
gataaatagatccaacatccaggag

SEQ ID NO: 638092 - DNA, 25 bp, Homo sapien
ataaatagatccaacatccaggagg

SEQ ID NO: 638093 - DNA, 25 bp, Homo sapien
taaatagatccaacatccaggaggt

SEQ ID NO: 638094 - DNA, 25 bp, Homo sapien
aaatagatccaacatccaggaggtg

SEQ ID NO: 638095 - DNA, 25 bp, Homo sapien
aatagatccaacatccaggaggtgt

SEQ ID NO: 638096 - DNA, 25 bp, Homo sapien
atagatccaacatccaggaggtgtt

SEQ ID NO: 638097 - DNA, 25 bp, Homo sapien
tagatccaacatccaggaggtgttg

SEQ ID NO: 638098 - DNA, 25 bp, Homo sapien
agaaactcctagtgttccctattga

SEQ ID NO: 638099 - DNA, 25 bp, Homo sapien
caaacacacacttaaggctcttata

SEQ ID NO: 638100 - DNA, 25 bp, Homo sapien
ataatacattctgcccagatcccaa

SEQ ID NO: 638101 - DNA, 25 bp, Homo sapien
gatcccaagattttggagcttcctt

SEQ ID NO: 638102 - DNA, 25 bp, Homo sapien
gattttggagcttcctttagctacc

SEQ ID NO: 638103 - DNA, 25 bp, Homo sapien
tttagctacctcctagcaacagcta

SEQ ID NO: 638104 - DNA, 25 bp, Homo sapien
gcaacagctactagatcacttcttt

SEQ ID NO: 638105 - DNA, 25 bp, Homo sapien
tcagcttttctaacgagcctctaaa

SEQ ID NO: 638106 - DNA, 25 bp, Homo sapien
acgagcctctaaaatgactttcagc

SEQ ID NO: 638107 - DNA, 25 bp, Homo sapien
gttttattctgctgttatccatcat

SEQ ID NO: 638108 - DNA, 25 bp, Homo sapien
gctgttatccatcatttatcaattc

SEQ ID NO: 638109 - DNA, 25 bp, Homo sapien
gactgtggttcaacaaggtcaaaca

SEQ ID NO: 638110 - DNA, 25 bp, Homo sapien
attctagtggactcaggctctgtag

SEQ ID NO: 638111 - DNA, 25 bp, Homo sapien
gatgagcctccaaaatccataatct

SEQ ID NO: 638112 - DNA, 25 bp, Homo sapien
tttggctgtgctgtcatgttactca

SEQ ID NO: 638113 - DNA, 25 bp, Homo sapien
gagactatcctctgtgggaatttga

SEQ ID NO: 638114 - DNA, 25 bp, Homo sapien
ggtttgacagcatctgatcccttaa

SEQ ID NO: 638115 - DNA, 25 bp, Homo sapien
gatcccttaacatttgtgattccga

SEQ ID NO: 638116 - DNA, 25 bp, Homo sapien
gtgattccgaagtcccctgatcctg

SEQ ID NO: 638117 - DNA, 25 bp, Homo sapien
tgatcctggatctcacgtggatgat

SEQ ID NO: 638118 - DNA, 25 bp, Homo sapien
gggtgtctactgtatgttgcatatt

SEQ ID NO: 638119 - DNA, 25 bp, Homo sapien
ttggtcaggtcattgacagccacca

SEQ ID NO: 638120 - DNA, 25 bp, Homo sapien
gggtttggatcatggatccttcatg

SEQ ID NO: 638121 - DNA, 25 bp, Homo sapien
cttcatgaatgtcttggtgccatcc

SEQ ID NO: 638122 - DNA, 25 bp, Homo sapien
catcctccccagtaatgagtgaatt

SEQ ID NO: 638123 - DNA, 25 bp, Homo sapien
cctccccagtaatgagtgaattctc

SEQ ID NO: 638124 - DNA, 25 bp, Homo sapien
gaattctcagttatgagttcacaca

SEQ ID NO: 638125 - DNA, 25 bp, Homo sapien
ctcagttatgagttcacacaatatc

SEQ ID NO: 638126 - DNA, 25 bp, Homo sapien
tctcaccatgtgattcagggaccgc

SEQ ID NO: 638127 - DNA, 25 bp, Homo sapien
accatgtgattcagggaccgcttca

SEQ ID NO: 638128 - DNA, 25 bp, Homo sapien
atgtgattcagggaccgcttcatct

SEQ ID NO: 638129 - DNA, 25 bp, Homo sapien
gtgattcagggaccgcttcatcttc

SEQ ID NO: 638130 - DNA, 25 bp, Homo sapien
agggaccgcttcatcttctgccatg

SEQ ID NO: 638131 - DNA, 25 bp, Homo sapien
ggaagtattcctttattctcgctga

SEQ ID NO: 638132 - DNA, 25 bp, Homo sapien
attctcgctgatgggttatctccaa

SEQ ID NO: 638133 - DNA, 25 bp, Homo sapien
gagtgctgtcactaacctttcagca

SEQ ID NO: 638134 - DNA, 25 bp, Homo sapien
gtcatggccatagaatcaaccctag

SEQ ID NO: 638135 - DNA, 25 bp, Homo sapien
gaatatcatactgttgctcccagcc

SEQ ID NO: 638136 - DNA, 25 bp, Homo sapien
gccttgggttggtagattttcttat

SEQ ID NO: 638137 - DNA, 25 bp, Homo sapien
accagcattgccacgggttcaaaga

SEQ ID NO: 638138 - DNA, 25 bp, Homo sapien
gggttcaaagatcccatgtccagcc

SEQ ID NO: 638139 - DNA, 25 bp, Homo sapien
atgtccagccacacatatctgggct

SEQ ID NO: 638140 - DNA, 25 bp, Homo sapien
atatctgggctggttctgctctgag

SEQ ID NO: 638141 - DNA, 25 bp, Homo sapien
tgaggctgctctaacactgggaagt

SEQ ID NO: 638142 - DNA, 25 bp, Homo sapien
gctgtttctgcttgctgatccggac

SEQ ID NO: 638143 - DNA, 25 bp, Homo sapien
ctgatccggactgcagcagcagagg

SEQ ID NO: 638144 - DNA, 25 bp, Homo sapien
atccggactgcagcagcagaggaac

SEQ ID NO: 638145 - DNA, 25 bp, Homo sapien
gcagaggaactgcaccatggagttt

SEQ ID NO: 638146 - DNA, 25 bp, Homo sapien
cagaggaactgcaccatggagtttg

SEQ ID NO: 638147 - DNA, 25 bp, Homo sapien
agaggaactgcaccatggagtttgg

SEQ ID NO: 638148 - DNA, 25 bp, Homo sapien
aactgcaccatggagtttggactga

SEQ ID NO: 638149 - DNA, 25 bp, Homo sapien
gtttggactgaggtggattctcctt

SEQ ID NO: 638150 - DNA, 25 bp, Homo sapien
ggactgaggtggattctccttgtag

SEQ ID NO: 638151 - DNA, 25 bp, Homo sapien
tgaggtggattctccttgtaggaat

SEQ ID NO: 638152 - DNA, 25 bp, Homo sapien
ggtggattctccttgtaggaatatt

SEQ ID NO: 638153 - DNA, 25 bp, Homo sapien
gattctatttgcaaagcaaggctta

SEQ ID NO: 638154 - DNA, 25 bp, Homo sapien
tatagatttaagttttccatgatag

SEQ ID NO: 638155 - DNA, 25 bp, Homo sapien
gggaaagttttcaagatagctctat

SEQ ID NO: 638156 - DNA, 25 bp, Homo sapien
gatagctctataaacataatctcct

SEQ ID NO: 638157 - DNA, 25 bp, Homo sapien
taatctcctaaatctgatgagtctc

SEQ ID NO: 638158 - DNA, 25 bp, Homo sapien
gatgagtctctgctagacatgaaaa

SEQ ID NO: 638159 - DNA, 25 bp, Homo sapien
atacattgtctttcacatctttctg

SEQ ID NO: 638160 - DNA, 25 bp, Homo sapien
gtctttcacatctttctgtgctaag

SEQ ID NO: 638161 - DNA, 25 bp, Homo sapien
gtgctaagaatttaggctgcaaaga

SEQ ID NO: 638162 - DNA, 25 bp, Homo sapien
aggcgaaatccttatgtgaacttat

SEQ ID NO: 638163 - DNA, 25 bp, Homo sapien
tcattttgtctaatcattattgatc

SEQ ID NO: 638164 - DNA, 25 bp, Homo sapien
aatcctctgtaccctaccagttcat

SEQ ID NO: 638165 - DNA, 25 bp, Homo sapien
gcaaccactgatcttgttatactct

SEQ ID NO: 638166 - DNA, 25 bp, Homo sapien
gttatactcttcatagtttcacctt

SEQ ID NO: 638167 - DNA, 25 bp, Homo sapien
catgccttttcatggcttcgcagct

SEQ ID NO: 638168 - DNA, 25 bp, Homo sapien
atggcttcgcagctcaattctcttt

SEQ ID NO: 638169 - DNA, 25 bp, Homo sapien
gctcaattctctttggcgctaagta

SEQ ID NO: 638170 - DNA, 25 bp, Homo sapien
cgctaagtaatacgccattgtctgc

SEQ ID NO: 638171 - DNA, 25 bp, Homo sapien
taagtaatacgccattgtctgcatg

SEQ ID NO: 638172 - DNA, 25 bp, Homo sapien
ttgtctgcatgtaccccagtttatc

SEQ ID NO: 638173 - DNA, 25 bp, Homo sapien
tttatcccctcacctactgaaggat

SEQ ID NO: 638174 - DNA, 25 bp, Homo sapien
cctcacctactgaaggatatcttgg

SEQ ID NO: 638175 - DNA, 25 bp, Homo sapien
cagaatctgaagtgtcctctaaagt

SEQ ID NO: 638176 - DNA, 25 bp, Homo sapien
atctgaagtgtcctctaaagtcata

SEQ ID NO: 638177 - DNA, 25 bp, Homo sapien
gaagtgtcctctaaagtcataaaga

SEQ ID NO: 638178 - DNA, 25 bp, Homo sapien
agtcataaagactagaaggcattga

SEQ ID NO: 638179 - DNA, 25 bp, Homo sapien
aaggcattgaataatgtttcttaac

SEQ ID NO: 638180 - DNA, 25 bp, Homo sapien
gtttcttaactatgcaaggacttca

SEQ ID NO: 638181 - DNA, 25 bp, Homo sapien
ttaactatgcaaggacttcagaatt

SEQ ID NO: 638182 - DNA, 25 bp, Homo sapien
ggacttcagaattagatctcacata

SEQ ID NO: 638183 - DNA, 25 bp, Homo sapien
catagatatatacaactgtgtgtag

SEQ ID NO: 638184 - DNA, 25 bp, Homo sapien
acaactgtgtgtagattcgaaaaac

SEQ ID NO: 638185 - DNA, 25 bp, Homo sapien
gatcacagtgttaaatgtgtctttt

SEQ ID NO: 638186 - DNA, 25 bp, Homo sapien
atctttgtggtgacgggacagttct

SEQ ID NO: 638187 - DNA, 25 bp, Homo sapien
ggtgacgggacagttctgtatcttg

SEQ ID NO: 638188 - DNA, 25 bp, Homo sapien
ggtggtggttatacaaatctacgtg

SEQ ID NO: 638189 - DNA, 25 bp, Homo sapien
acaaatgcatgtaaccctggtgaaa

SEQ ID NO: 638190 - DNA, 25 bp, Homo sapien
gtaaccctggtgaaatctgaataag

SEQ ID NO: 638191 - DNA, 25 bp, Homo sapien
aaggtctgtggattgtgccaatacc

SEQ ID NO: 638192 - DNA, 25 bp, Homo sapien
gtgccaataccagtgacctggtttt

SEQ ID NO: 638193 - DNA, 25 bp, Homo sapien
ccagtgacctggttttgatactgta

SEQ ID NO: 638194 - DNA, 25 bp, Homo sapien
agctatctaagacattattatcagg

SEQ ID NO: 638195 - DNA, 25 bp, Homo sapien
atttttgcaacttctcgtgaatctg

SEQ ID NO: 638196 - DNA, 25 bp, Homo sapien
tgcaacttctcgtgaatctgttact

SEQ ID NO: 638197 - DNA, 25 bp, Homo sapien
tgctggagaaggacgccctaggccc

SEQ ID NO: 638198 - DNA, 25 bp, Homo sapien
cccgtctcggccaggtgatgctgga

SEQ ID NO: 638199 - DNA, 25 bp, Homo sapien
tccgtctcggccaggtgatgctgga

SEQ ID NO: 638200 - DNA, 25 bp, Homo sapien
tgctggagaaggacgccctaggtcc

SEQ ID NO: 638201 - DNA, 25 bp, Homo sapien
cctaggtccgtctcggccaggtgat

SEQ ID NO: 638202 - DNA, 25 bp, Homo sapien
gggaggcttcgtggcagggctacgc

SEQ ID NO: 638203 - DNA, 25 bp, Homo sapien
gtggcagggctacgccgtggaaggc

SEQ ID NO: 638204 - DNA, 25 bp, Homo sapien
tggaaggcccgtggtcctcggagga

SEQ ID NO: 638205 - DNA, 25 bp, Homo sapien
tggtcctcggaggagcctcacgagc

SEQ ID NO: 638206 - DNA, 25 bp, Homo sapien
cggaggagcctcacgagccaaggct

SEQ ID NO: 638207 - DNA, 25 bp, Homo sapien
cctcacgagccaaggctgggaagga

SEQ ID NO: 638208 - DNA, 25 bp, Homo sapien
cattagtggcatgaactcggaatcc

SEQ ID NO: 638209 - DNA, 25 bp, Homo sapien
atgaactcggaatccactgctcaga

SEQ ID NO: 638210 - DNA, 25 bp, Homo sapien
gaactcggaatccactgctcagatt

SEQ ID NO: 638211 - DNA, 25 bp, Homo sapien
tccactgctcagattcaaatccact

SEQ ID NO: 638212 - DNA, 25 bp, Homo sapien
agattcaaatccacttttctacctg

SEQ ID NO: 638213 - DNA, 25 bp, Homo sapien
tggacatttatttgcctcagttcta

SEQ ID NO: 638214 - DNA, 25 bp, Homo sapien
acctgtataatggatatgacgtgaa

SEQ ID NO: 638215 - DNA, 25 bp, Homo sapien
tgacgtgaatagttttatctatatc

SEQ ID NO: 638216 - DNA, 25 bp, Homo sapien
aaatgcctacacaagtaaaagctaa

SEQ ID NO: 638217 - DNA, 25 bp, Homo sapien
ttttgtctaaacgtatttgtgtcat

SEQ ID NO: 638218 - DNA, 25 bp, Homo sapien
gtctaaacgtatttgtgtcatatat

SEQ ID NO: 638219 - DNA, 25 bp, Homo sapien
tgcctcccagtggtaacattctatg

SEQ ID NO: 638220 - DNA, 25 bp, Homo sapien
acattctatggtttcatgattctaa

SEQ ID NO: 638221 - DNA, 25 bp, Homo sapien
ttctaaacaacgtttggcctccagg

SEQ ID NO: 638222 - DNA, 25 bp, Homo sapien
ggcctccaggtattggttggttgtt

SEQ ID NO: 638223 - DNA, 25 bp, Homo sapien
acatgaaatacaaccccagcaatga

SEQ ID NO: 638224 - DNA, 25 bp, Homo sapien
aatattgggccttctggccttgcca

SEQ ID NO: 638225 - DNA, 25 bp, Homo sapien
acctggcatcagatgtctgaacttg

SEQ ID NO: 638226 - DNA, 25 bp, Homo sapien
gaacttgatatacacctgcaggtac

SEQ ID NO: 638227 - DNA, 25 bp, Homo sapien
ctgcaggtacacttacggctgttaa

SEQ ID NO: 638228 - DNA, 25 bp, Homo sapien
acggctgttaatctgccaagctctg

SEQ ID NO: 638229 - DNA, 25 bp, Homo sapien
caagctctgttgttcaagctgtttg

SEQ ID NO: 638230 - DNA, 25 bp, Homo sapien
acaacactttgagtaacagagaact

SEQ ID NO: 638231 - DNA, 25 bp, Homo sapien
gagaactagattatcattcgtcttt

SEQ ID NO: 638232 - DNA, 25 bp, Homo sapien
gattatcattcgtcttttgtttgga

SEQ ID NO: 638233 - DNA, 25 bp, Homo sapien
gtaatgatgaaaatcctgatgcccc

SEQ ID NO: 638234 - DNA, 25 bp, Homo sapien
tgttgaacctagatctccccacatc

SEQ ID NO: 638235 - DNA, 25 bp, Homo sapien
tgacttgctaaataacttgcccttt

SEQ ID NO: 638236 - DNA, 25 bp, Homo sapien
gctaaataacttgccctttcattct

SEQ ID NO: 638237 - DNA, 25 bp, Homo sapien
gccctttcattctttgcatggttaa

SEQ ID NO: 638238 - DNA, 25 bp, Homo sapien
aaggctgaaaactactttgcggtat

SEQ ID NO: 638239 - DNA, 25 bp, Homo sapien
gaaaggattttgcaaccatagttta

SEQ ID NO: 638240 - DNA, 25 bp, Homo sapien
gcaaccatagtttacctccttaatg

SEQ ID NO: 638241 - DNA, 25 bp, Homo sapien
gctctgtgaatactctgggaggatc

SEQ ID NO: 638242 - DNA, 25 bp, Homo sapien
ctgggaggatccagcgggttccaca

SEQ ID NO: 638243 - DNA, 25 bp, Homo sapien
gctcaatgaacaaaaaaggaccttt

SEQ ID NO: 638244 - DNA, 25 bp, Homo sapien
gacctttgttgctttcttggctgta

SEQ ID NO: 638245 - DNA, 25 bp, Homo sapien
tttgttgctttcttggctgtagccc

SEQ ID NO: 638246 - DNA, 25 bp, Homo sapien
ttgctttcttggctgtagccctcaa

SEQ ID NO: 638247 - DNA, 25 bp, Homo sapien
tttcttggctgtagccctcaacaca

SEQ ID NO: 638248 - DNA, 25 bp, Homo sapien
agaagcaccctggtttctccagcaa

SEQ ID NO: 638249 - DNA, 25 bp, Homo sapien
gcaccctggtttctccagcaaaaaa

SEQ ID NO: 638250 - DNA, 25 bp, Homo sapien
caacaggttaagaaagtcaactggg

SEQ ID NO: 638251 - DNA, 25 bp, Homo sapien
agaaagtcaactgggaaattctgaa

SEQ ID NO: 638252 - DNA, 25 bp, Homo sapien
cagaacgagaccctgatagtttgag

SEQ ID NO: 638253 - DNA, 25 bp, Homo sapien
agaacgagaccctgatagtttgagg

SEQ ID NO: 638254 - DNA, 25 bp, Homo sapien
gaacgagaccctgatagtttgagga

SEQ ID NO: 638255 - DNA, 25 bp, Homo sapien
aacgagaccctgatagtttgaggat

SEQ ID NO: 638256 - DNA, 25 bp, Homo sapien
acgagaccctgatagtttgaggatg

SEQ ID NO: 638257 - DNA, 25 bp, Homo sapien
gagaccctgatagtttgaggatgca

SEQ ID NO: 638258 - DNA, 25 bp, Homo sapien
agaccctgatagtttgaggatgcag

SEQ ID NO: 638259 - DNA, 25 bp, Homo sapien
agagagaccctgatggtttgaggat

SEQ ID NO: 638260 - DNA, 25 bp, Homo sapien
agagaccctgatggtttgaggatgc

SEQ ID NO: 638261 - DNA, 25 bp, Homo sapien
gagaccctgatggtttgaggatgca

SEQ ID NO: 638262 - DNA, 25 bp, Homo sapien
agaccctgatggtttgaggatgcag

SEQ ID NO: 638263 - DNA, 25 bp, Homo sapien
gagtgggatggatatgactataaac

SEQ ID NO: 638264 - DNA, 25 bp, Homo sapien
ggatatgactataaacaggtagcat

SEQ ID NO: 638265 - DNA, 25 bp, Homo sapien
taaacaggtagcatgagggatcttt

SEQ ID NO: 638266 - DNA, 25 bp, Homo sapien
gtagcatgagggatctttgcaatga

SEQ ID NO: 638267 - DNA, 25 bp, Homo sapien
tgagggatctttgcaatgatgaagc

SEQ ID NO: 638268 - DNA, 25 bp, Homo sapien
aatgatgaagcagttctgtatcttg

SEQ ID NO: 638269 - DNA, 25 bp, Homo sapien
ttgcatagaagtacacacacaaatg

SEQ ID NO: 638270 - DNA, 25 bp, Homo sapien
acatgaaatttgaggttgtggatta

SEQ ID NO: 638271 - DNA, 25 bp, Homo sapien
ggttgtggattatatcaatgtcaat

SEQ ID NO: 638272 - DNA, 25 bp, Homo sapien
tgatattgaactgtgcttatgtaat

SEQ ID NO: 638273 - DNA, 25 bp, Homo sapien
tgaactgtgcttatgtaatatatta

SEQ ID NO: 638274 - DNA, 25 bp, Homo sapien
gtgatagaggtctgggctgggtgca

SEQ ID NO: 638275 - DNA, 25 bp, Homo sapien
ttgtaatgtttggagtttttagcct

SEQ ID NO: 638276 - DNA, 25 bp, Homo sapien
tgtaatgtttggagtttttagcctc

SEQ ID NO: 638277 - DNA, 25 bp, Homo sapien
gagtttttagcctcacagtggattt

SEQ ID NO: 638278 - DNA, 25 bp, Homo sapien
agtttttagcctcacagtggatttg

SEQ ID NO: 638279 - DNA, 25 bp, Homo sapien
gtttttagcctcacagtggatttga

SEQ ID NO: 638280 - DNA, 25 bp, Homo sapien
tttttagcctcacagtggatttgat

SEQ ID NO: 638281 - DNA, 25 bp, Homo sapien
ttttagcctcacagtggatttgata

SEQ ID NO: 638282 - DNA, 25 bp, Homo sapien
ttagcctcacagtggatttgataaa

SEQ ID NO: 638283 - DNA, 25 bp, Homo sapien
agcctcacagtggatttgataaatt

SEQ ID NO: 638284 - DNA, 25 bp, Homo sapien
gcctcacagtggatttgataaatta

SEQ ID NO: 638285 - DNA, 25 bp, Homo sapien
gttccactgtggatagctctaacca

SEQ ID NO: 638286 - DNA, 25 bp, Homo sapien
ggatagctctaaccaacaaattgtg

SEQ ID NO: 638287 - DNA, 25 bp, Homo sapien
tgggtgcgggagtatccacatccca

SEQ ID NO: 638288 - DNA, 25 bp, Homo sapien
tatccccttgtctggaagaattctg

SEQ ID NO: 638289 - DNA, 25 bp, Homo sapien
gaattctgaggcatatgttttacac

SEQ ID NO: 638290 - DNA, 25 bp, Homo sapien
tgttttacaccatttcccaaagctt

SEQ ID NO: 638291 - DNA, 25 bp, Homo sapien
ttcccaaagcttccctgtgagatta

SEQ ID NO: 638292 - DNA, 25 bp, Homo sapien
attattcccctatcagtgtactggc

SEQ ID NO: 638293 - DNA, 25 bp, Homo sapien
tatcagtgtactggcacctgccaaa

SEQ ID NO: 638294 - DNA, 25 bp, Homo sapien
atgtgcatttagtccttatcatgag

SEQ ID NO: 638295 - DNA, 25 bp, Homo sapien
cttatcatgagatctgcttcttggg

SEQ ID NO: 638296 - DNA, 25 bp, Homo sapien
agaagttcgtgtggcatcgctgtct

SEQ ID NO: 638297 - DNA, 25 bp, Homo sapien
ctgtctgctgcgtccaagagatgat

SEQ ID NO: 638298 - DNA, 25 bp, Homo sapien
gagatgatagggtccttccagaaga

SEQ ID NO: 638299 - DNA, 25 bp, Homo sapien
aacagcagggtagcgcagaaatgga

SEQ ID NO: 638300 - DNA, 25 bp, Homo sapien
tggaaggaagaccactcttcccagt

SEQ ID NO: 638301 - DNA, 25 bp, Homo sapien
gtgatgggcatcagttacagaactc

SEQ ID NO: 638302 - DNA, 25 bp, Homo sapien
tacagaactcattcacaccttcaat

SEQ ID NO: 638303 - DNA, 25 bp, Homo sapien
aatggttttggaagccacatgctcc

SEQ ID NO: 638304 - DNA, 25 bp, Homo sapien
gatggcagagctaccctggaaagaa

SEQ ID NO: 638305 - DNA, 25 bp, Homo sapien
gaaggttgcatctgagtcaccacgt

SEQ ID NO: 638306 - DNA, 25 bp, Homo sapien
ccacgtggagatcaactttgtacat

SEQ ID NO: 638307 - DNA, 25 bp, Homo sapien
tattgctacctgatctgtcacatcc

SEQ ID NO: 638308 - DNA, 25 bp, Homo sapien
gtctctctcgtcctttaaatggaat

SEQ ID NO: 638309 - DNA, 25 bp, Homo sapien
ggaatctgttcggttcaaattttag

SEQ ID NO: 638310 - DNA, 25 bp, Homo sapien
gaatttcacacgcaaaacggcatat

SEQ ID NO: 638311 - DNA, 25 bp, Homo sapien
aacggcatataacggcttttgtctc

SEQ ID NO: 638312 - DNA, 25 bp, Homo sapien
ggcttttgtctctgacagtcacaca

SEQ ID NO: 638313 - DNA, 25 bp, Homo sapien
agtcacacaaaccaggcatttccgt

SEQ ID NO: 638314 - DNA, 25 bp, Homo sapien
aggcatttccgtcttcttggtagcg

SEQ ID NO: 638315 - DNA, 25 bp, Homo sapien
gcggctctcagacagtaatcctatg

SEQ ID NO: 638316 - DNA, 25 bp, Homo sapien
atggtatacgccagtgttctaggta

SEQ ID NO: 638317 - DNA, 25 bp, Homo sapien
gggttccccaattgcttagattgaa

SEQ ID NO: 638318 - DNA, 25 bp, Homo sapien
gacacacagccagtatgtggtggct

SEQ ID NO: 638319 - DNA, 25 bp, Homo sapien
cttcagaactgtgctacccaggagg

SEQ ID NO: 638320 - DNA, 25 bp, Homo sapien
tcagaactgtgctacccaggagggc

SEQ ID NO: 638321 - DNA, 25 bp, Homo sapien
agccctgagtgaccattgagcacta

SEQ ID NO: 638322 - DNA, 25 bp, Homo sapien
gtgaccattgagcactagagatgtg

SEQ ID NO: 638323 - DNA, 25 bp, Homo sapien
cactagagatgtggctggtgtgaat

SEQ ID NO: 638324 - DNA, 25 bp, Homo sapien
gtgaatcgagacaagctgtgagtgt

SEQ ID NO: 638325 - DNA, 25 bp, Homo sapien
gagtgtgtaatggacaccaggtttt

SEQ ID NO: 638326 - DNA, 25 bp, Homo sapien
ccaggttttgaatggttggtgtgac

SEQ ID NO: 638327 - DNA, 25 bp, Homo sapien
ttatattgatttcatggtgacattt

SEQ ID NO: 638328 - DNA, 25 bp, Homo sapien
ggtgacattttccatatattgagtt

SEQ ID NO: 638329 - DNA, 25 bp, Homo sapien
gataatttaggccacaatccttgta

SEQ ID NO: 638330 - DNA, 25 bp, Homo sapien
aatttaggccacaatccttgtattt

SEQ ID NO: 638331 - DNA, 25 bp, Homo sapien
gagatcacacaaagtaattatcttt

SEQ ID NO: 638332 - DNA, 25 bp, Homo sapien
gataagtcgaagatgtttatttctc

SEQ ID NO: 638333 - DNA, 25 bp, Homo sapien
gtttatttctcaaatcacctctaaa

SEQ ID NO: 638334 - DNA, 25 bp, Homo sapien
ttctcaaatcacctctaaaagcatt

SEQ ID NO: 638335 - DNA, 25 bp, Homo sapien
gagaataacccaaatcatgtgcttt

SEQ ID NO: 638336 - DNA, 25 bp, Homo sapien
aacccaaatcatgtgctttagacag

SEQ ID NO: 638337 - DNA, 25 bp, Homo sapien
gctttagacaggaagcatgctagat

SEQ ID NO: 638338 - DNA, 25 bp, Homo sapien
catgctagatagagtcaattgttca

SEQ ID NO: 638339 - DNA, 25 bp, Homo sapien
gagtcaattgttcagtaaatttgct

SEQ ID NO: 638340 - DNA, 25 bp, Homo sapien
tgaagcccatctaaggtgagccaac

SEQ ID NO: 638341 - DNA, 25 bp, Homo sapien
aggtgagccaactttacttataatt

SEQ ID NO: 638342 - DNA, 25 bp, Homo sapien
gtatttgagcaccattttattgcca

SEQ ID NO: 638343 - DNA, 25 bp, Homo sapien
tgccaaacaatacacccaacaaagt

SEQ ID NO: 638344 - DNA, 25 bp, Homo sapien
cttcccttaacaagaatatcaggtt

SEQ ID NO: 638345 - DNA, 25 bp, Homo sapien
caggtttgtctatattatgattgga

SEQ ID NO: 638346 - DNA, 25 bp, Homo sapien
tatatttgttttcctagacagtcta

SEQ ID NO: 638347 - DNA, 25 bp, Homo sapien
acagtctaaggtttcaatgggttgc

SEQ ID NO: 638348 - DNA, 25 bp, Homo sapien
agaaagctgcaccaactggtgtttt

SEQ ID NO: 638349 - DNA, 25 bp, Homo sapien
gcaccaactggtgttttgaaattca

SEQ ID NO: 638350 - DNA, 25 bp, Homo sapien
tcaaatacccttagtttaagccaca

SEQ ID NO: 638351 - DNA, 25 bp, Homo sapien
actaggtatgtgacgagctcctttc

SEQ ID NO: 638352 - DNA, 25 bp, Homo sapien
acgagctcctttcctaggcaagaat

SEQ ID NO: 638353 - DNA, 25 bp, Homo sapien
caaatttcaattggcaggactggct

SEQ ID NO: 638354 - DNA, 25 bp, Homo sapien
gcaggactggctaatggaattctat

SEQ ID NO: 638355 - DNA, 25 bp, Homo sapien
tctgagaatcagcacatctctgtat

SEQ ID NO: 638356 - DNA, 25 bp, Homo sapien
atctctgtatgtacatcctgaggca

SEQ ID NO: 638357 - DNA, 25 bp, Homo sapien
aactgatgaacaccacatgacacca

SEQ ID NO: 638358 - DNA, 25 bp, Homo sapien
cacatgacaccaaatctctgctatt

SEQ ID NO: 638359 - DNA, 25 bp, Homo sapien
attgtattcttgagcctgagcccca

SEQ ID NO: 638360 - DNA, 25 bp, Homo sapien
tgagccccactctctaaaactttct

SEQ ID NO: 638361 - DNA, 25 bp, Homo sapien
actttctccaaatactttccatcac

SEQ ID NO: 638362 - DNA, 25 bp, Homo sapien
gtggtagttacgtgggtttctatga

SEQ ID NO: 638363 - DNA, 25 bp, Homo sapien
aaaaactcttggtgtggcagaccca

SEQ ID NO: 638364 - DNA, 25 bp, Homo sapien
gtggcagacccaagctctgggcacc

SEQ ID NO: 638365 - DNA, 25 bp, Homo sapien
atgccatgcagcagctcgatctgtg

SEQ ID NO: 638366 - DNA, 25 bp, Homo sapien
gcagcagctcgatctgtgacagcga

SEQ ID NO: 638367 - DNA, 25 bp, Homo sapien
tgacagcgagtcctgtgttccatga

SEQ ID NO: 638368 - DNA, 25 bp, Homo sapien
acttgacagagtgaatgccgaacct

SEQ ID NO: 638369 - DNA, 25 bp, Homo sapien
atgccgaacctctgctcctaaggga

SEQ ID NO: 638370 - DNA, 25 bp, Homo sapien
aatagagggccaggttcctacgagc

SEQ ID NO: 638371 - DNA, 25 bp, Homo sapien
agccttttcagcaaccaatcagtac

SEQ ID NO: 638372 - DNA, 25 bp, Homo sapien
taatatatgtcactaaactcccggc

SEQ ID NO: 638373 - DNA, 25 bp, Homo sapien
acccaagaatctgtgtgaggttgaa

SEQ ID NO: 638374 - DNA, 25 bp, Homo sapien
aggttgaataagatcctgtgtctcc

SEQ ID NO: 638375 - DNA, 25 bp, Homo sapien
gggagacacagatctaaattttaaa

SEQ ID NO: 638376 - DNA, 25 bp, Homo sapien
taaaggtggtttgggccttctcaat

SEQ ID NO: 638377 - DNA, 25 bp, Homo sapien
ggtttgggccttctcaatcatatat

SEQ ID NO: 638378 - DNA, 25 bp, Homo sapien
ctcaatcatatattaaggtcctttt

SEQ ID NO: 638379 - DNA, 25 bp, Homo sapien
tagataagtaaattaaggcccagaa

SEQ ID NO: 638380 - DNA, 25 bp, Homo sapien
gtcccaagacctgcttgagacctgt

SEQ ID NO: 638381 - DNA, 25 bp, Homo sapien
aagacctgcttgagacctgtgcccc

SEQ ID NO: 638382 - DNA, 25 bp, Homo sapien
catttctgactaatattcttcatga

SEQ ID NO: 638383 - DNA, 25 bp, Homo sapien
gtatcactctgtatcaaaaccaacc

SEQ ID NO: 638384 - DNA, 25 bp, Homo sapien
acagcggccggcctactttttcagt

SEQ ID NO: 638385 - DNA, 25 bp, Homo sapien
agcggccggcctactttttcagtct

SEQ ID NO: 638386 - DNA, 25 bp, Homo sapien
cggccggcctactttttcagtctct

SEQ ID NO: 638387 - DNA, 25 bp, Homo sapien
cttagatagataattcagttctcct

SEQ ID NO: 638388 - DNA, 25 bp, Homo sapien
ttcagttctcctttgtgtgaaaaat

SEQ ID NO: 638389 - DNA, 25 bp, Homo sapien
agttctcctttgtgtgaaaaatatc

SEQ ID NO: 638390 - DNA, 25 bp, Homo sapien
gtgtgaaaaatatctttgactaagt

SEQ ID NO: 638391 - DNA, 25 bp, Homo sapien
aatatctttgactaagttgtgttgc

SEQ ID NO: 638392 - DNA, 25 bp, Homo sapien
atctttgactaagttgtgttgcttt

SEQ ID NO: 638393 - DNA, 25 bp, Homo sapien
tttctttttagcagccaactcttcc

SEQ ID NO: 638394 - DNA, 25 bp, Homo sapien
ttctttttagcagccaactcttcct

SEQ ID NO: 638395 - DNA, 25 bp, Homo sapien
atctcatgccatgtcagcaaatgca

SEQ ID NO: 638396 - DNA, 25 bp, Homo sapien
atggtacaagcacattcccacttga

SEQ ID NO: 638397 - DNA, 25 bp, Homo sapien
ttgacctcctgcacacttgggcttg

SEQ ID NO: 638398 - DNA, 25 bp, Homo sapien
gcacacttgggcttgctcactcctg

SEQ ID NO: 638399 - DNA, 25 bp, Homo sapien
ttgccatgagaacacatctcagcca

SEQ ID NO: 638400 - DNA, 25 bp, Homo sapien
atctcagccagcctcattgagtgat

SEQ ID NO: 638401 - DNA, 25 bp, Homo sapien
cagcctcattgagtgatgcgagaga

SEQ ID NO: 638402 - DNA, 25 bp, Homo sapien
ggagaagagccaagatcatcttaga

SEQ ID NO: 638403 - DNA, 25 bp, Homo sapien
tagaacaagctgacgggccagctga

SEQ ID NO: 638404 - DNA, 25 bp, Homo sapien
ccagctgatcccctaaaatgtgagt

SEQ ID NO: 638405 - DNA, 25 bp, Homo sapien
aaatgtgagtgagcccagccaaggt

SEQ ID NO: 638406 - DNA, 25 bp, Homo sapien
taatactccatcctaagcagtatgg

SEQ ID NO: 638407 - DNA, 25 bp, Homo sapien
tactccatcctaagcagtatggttt

SEQ ID NO: 638408 - DNA, 25 bp, Homo sapien
tgaaagtatgtatatttccatgttc

SEQ ID NO: 638409 - DNA, 25 bp, Homo sapien
gttctatataaactggttttctaca

SEQ ID NO: 638410 - DNA, 25 bp, Homo sapien
ctggttttctacaaattacaaagca

SEQ ID NO: 638411 - DNA, 25 bp, Homo sapien
gttttctacaaattacaaagcaaca

SEQ ID NO: 638412 - DNA, 25 bp, Homo sapien
aagcaacaactaaccaagttaattg

SEQ ID NO: 638413 - DNA, 25 bp, Homo sapien
accaagttaattgaaatcgagtact

SEQ ID NO: 638414 - DNA, 25 bp, Homo sapien
gaaatcgagtactttattcaagtaa

SEQ ID NO: 638415 - DNA, 25 bp, Homo sapien
aattgaaaatcatagtacataacga

SEQ ID NO: 638416 - DNA, 25 bp, Homo sapien
tcatagtacataacgaaaattcata

SEQ ID NO: 638417 - DNA, 25 bp, Homo sapien
tccagttccgctttgtggtttgtga

SEQ ID NO: 638418 - DNA, 25 bp, Homo sapien
ttccgctttgtggtttgtgagtgac

SEQ ID NO: 638419 - DNA, 25 bp, Homo sapien
tggtttgtgagtgaccagtgcatcc

SEQ ID NO: 638420 - DNA, 25 bp, Homo sapien
ctgcagcagctgcaatgtgcactgt

SEQ ID NO: 638421 - DNA, 25 bp, Homo sapien
agctgcaatgtgcactgtcctgcag

SEQ ID NO: 638422 - DNA, 25 bp, Homo sapien
tgtgggaagctcagcaacaaggtaa

SEQ ID NO: 638423 - DNA, 25 bp, Homo sapien
aacaaggtaagggaatgggcagctt

SEQ ID NO: 638424 - DNA, 25 bp, Homo sapien
aattatctcaccttattacacttta

SEQ ID NO: 638425 - DNA, 25 bp, Homo sapien
tatcgatctttacacaatacacttg

SEQ ID NO: 638426 - DNA, 25 bp, Homo sapien
tacacaatacacttgaactgtggaa

SEQ ID NO: 638427 - DNA, 25 bp, Homo sapien
aactgtggaataaagcaggaccaga

SEQ ID NO: 638428 - DNA, 25 bp, Homo sapien
taagtgaatacccagaagacaagtt

SEQ ID NO: 638429 - DNA, 25 bp, Homo sapien
gacaagttcagatatgccaaggcat

SEQ ID NO: 638430 - DNA, 25 bp, Homo sapien
aaggcatctcaagacaaaggctgaa

SEQ ID NO: 638431 - DNA, 25 bp, Homo sapien
aggctgaatactgatcttgggtgtt

SEQ ID NO: 638432 - DNA, 25 bp, Homo sapien
ttggtgtctctttggtaactacggt

SEQ ID NO: 638433 - DNA, 25 bp, Homo sapien
ttaaacgctatgtgttggaaattcc

SEQ ID NO: 638434 - DNA, 25 bp, Homo sapien
gaatcagtgatgaatcccttgcctt

SEQ ID NO: 638435 - DNA, 25 bp, Homo sapien
tgatgaatcccttgcctttggtgaa

SEQ ID NO: 638436 - DNA, 25 bp, Homo sapien
ggaaatctatgcttgaagacttcag

SEQ ID NO: 638437 - DNA, 25 bp, Homo sapien
gtaatagaagtttcagctagtcaat

SEQ ID NO: 638438 - DNA, 25 bp, Homo sapien
aaagaataatccctaactcatttgc

SEQ ID NO: 638439 - DNA, 25 bp, Homo sapien
gtcagttctccctaatacattcata

SEQ ID NO: 638440 - DNA, 25 bp, Homo sapien
gtatatgtatattctcctctgcaga

SEQ ID NO: 638441 - DNA, 25 bp, Homo sapien
aatacagccatgtcctcttagtctt

SEQ ID NO: 638442 - DNA, 25 bp, Homo sapien
gtcctcttagtctttcttcgtttat

SEQ ID NO: 638443 - DNA, 25 bp, Homo sapien
gtctttcttcgtttattcagccttt

SEQ ID NO: 638444 - DNA, 25 bp, Homo sapien
gaatagtttttactgccctgtcttc

SEQ ID NO: 638445 - DNA, 25 bp, Homo sapien
ctgatcttttcttctgcactatcta

SEQ ID NO: 638446 - DNA, 25 bp, Homo sapien
tcttctgcactatctaatctgatct

SEQ ID NO: 638447 - DNA, 25 bp, Homo sapien
aatctgatcttagtcctatccagtt

SEQ ID NO: 638448 - DNA, 25 bp, Homo sapien
attgcagatgttgtattttgagctc

SEQ ID NO: 638449 - DNA, 25 bp, Homo sapien
gtattttgagctctagaagttctat

SEQ ID NO: 638450 - DNA, 25 bp, Homo sapien
atttaggactgcgtcgtaggagact

SEQ ID NO: 638451 - DNA, 25 bp, Homo sapien
ggagactgggacacatatccacttt

SEQ ID NO: 638452 - DNA, 25 bp, Homo sapien
tatccactttgctggcttgatgaag

SEQ ID NO: 638453 - DNA, 25 bp, Homo sapien
actgctaagttgaggaagcccacat

SEQ ID NO: 638454 - DNA, 25 bp, Homo sapien
ggcaaggaactgtgggcagccttca

SEQ ID NO: 638455 - DNA, 25 bp, Homo sapien
agccttcagccaacaggcagcaaaa

SEQ ID NO: 638456 - DNA, 25 bp, Homo sapien
gcaaaaagctgagctcctcggagct

SEQ ID NO: 638457 - DNA, 25 bp, Homo sapien
agctcctcggagctacagcctcaag

SEQ ID NO: 638458 - DNA, 25 bp, Homo sapien
tacagcctcaaggaagttacttctg

SEQ ID NO: 638459 - DNA, 25 bp, Homo sapien
aagcttggaagctagtttctctcta

SEQ ID NO: 638460 - DNA, 25 bp, Homo sapien
gagcatggcccaggcaagataaata

SEQ ID NO: 638461 - DNA, 25 bp, Homo sapien
gaacatcgtcatattcaacttcaga

SEQ ID NO: 638462 - DNA, 25 bp, Homo sapien
ttcagatgatcatgctccagatagt

SEQ ID NO: 638463 - DNA, 25 bp, Homo sapien
tgctccagatagtattccaaccatg

SEQ ID NO: 638464 - DNA, 25 bp, Homo sapien
gtattccaaccatgactgaccttat

SEQ ID NO: 638465 - DNA, 25 bp, Homo sapien
gaccttatcattcctagccatgtat

SEQ ID NO: 638466 - DNA, 25 bp, Homo sapien
agccatgtatggtcttgtctgactt

SEQ ID NO: 638467 - DNA, 25 bp, Homo sapien
tgtctgacttttttataactttggc

SEQ ID NO: 638468 - DNA, 25 bp, Homo sapien
aactttggccacaatatgatatgtt

SEQ ID NO: 638469 - DNA, 25 bp, Homo sapien
taatagcagtattctcatgagatga

SEQ ID NO: 638470 - DNA, 25 bp, Homo sapien
tgccttcaaaatgaattgctcagtt

SEQ ID NO: 638471 - DNA, 25 bp, Homo sapien
aaataaagcaatctgtgtgatctat

SEQ ID NO: 638472 - DNA, 25 bp, Homo sapien
atccacttataacgctcacttgaaa

SEQ ID NO: 638473 - DNA, 25 bp, Homo sapien
ccacttataacgctcacttgaaata

SEQ ID NO: 638474 - DNA, 25 bp, Homo sapien
cacttataacgctcacttgaaatag

SEQ ID NO: 638475 - DNA, 25 bp, Homo sapien
acttataacgctcacttgaaatagg

SEQ ID NO: 638476 - DNA, 25 bp, Homo sapien
ttataacgctcacttgaaataggga

SEQ ID NO: 638477 - DNA, 25 bp, Homo sapien
tataacgctcacttgaaatagggag

SEQ ID NO: 638478 - DNA, 25 bp, Homo sapien
ataacgctcacttgaaatagggaga

SEQ ID NO: 638479 - DNA, 25 bp, Homo sapien
aacgctcacttgaaatagggagagt

SEQ ID NO: 638480 - DNA, 25 bp, Homo sapien
acgctcacttgaaatagggagagtt

SEQ ID NO: 638481 - DNA, 25 bp, Homo sapien
cgctcacttgaaatagggagagttg

SEQ ID NO: 638482 - DNA, 25 bp, Homo sapien
ctcacttgaaatagggagagttggc

SEQ ID NO: 638483 - DNA, 25 bp, Homo sapien
atctgggtgggcctcaatcacaagg

SEQ ID NO: 638484 - DNA, 25 bp, Homo sapien
gggatttgaagctgctacacttttg

SEQ ID NO: 638485 - DNA, 25 bp, Homo sapien
gctgctacacttttggctttgataa

SEQ ID NO: 638486 - DNA, 25 bp, Homo sapien
cacttttggctttgataatgcagga

SEQ ID NO: 638487 - DNA, 25 bp, Homo sapien
aatgcaggaagggaccagaagccac

SEQ ID NO: 638488 - DNA, 25 bp, Homo sapien
aagggaccagaagccacggaactca

SEQ ID NO: 638489 - DNA, 25 bp, Homo sapien
agaagccacggaactcaggcggcct

SEQ ID NO: 638490 - DNA, 25 bp, Homo sapien
tcaggcggcctctagaaggtggaaa

SEQ ID NO: 638491 - DNA, 25 bp, Homo sapien
cctctggagtctttagaaggaacca

SEQ ID NO: 638492 - DNA, 25 bp, Homo sapien
ccctgccaattccttgatttttgga

SEQ ID NO: 638493 - DNA, 25 bp, Homo sapien
ttgatttttggatttctgacctcta

SEQ ID NO: 638494 - DNA, 25 bp, Homo sapien
aatactagttttggcatggcggata

SEQ ID NO: 638495 - DNA, 25 bp, Homo sapien
gcctacagaatgtgtctgattctct

SEQ ID NO: 638496 - DNA, 25 bp, Homo sapien
aatgtgtctgattctctgaagtata

SEQ ID NO: 638497 - DNA, 25 bp, Homo sapien
atattttttctaaatgccagattca

SEQ ID NO: 638498 - DNA, 25 bp, Homo sapien
aactgacttgagtaaccaccagccc

SEQ ID NO: 638499 - DNA, 25 bp, Homo sapien
ccagcccaacattcgggactttgtg

SEQ ID NO: 638500 - DNA, 25 bp, Homo sapien
gattgctatggctctgccggactta

SEQ ID NO: 638501 - DNA, 25 bp, Homo sapien
ggctctgccggacttacaagcaata

SEQ ID NO: 638502 - DNA, 25 bp, Homo sapien
gcatgtgtaatgcttgtcaaaaaat

SEQ ID NO: 638503 - DNA, 25 bp, Homo sapien
gttttaattttcactggtcagtgca

SEQ ID NO: 638504 - DNA, 25 bp, Homo sapien
ggtcagtgcactaccaatactagtt

SEQ ID NO: 638505 - DNA, 25 bp, Homo sapien
tcctgctgctgctgatattgtttgg

SEQ ID NO: 638506 - DNA, 25 bp, Homo sapien
gctgctgatattgtttggtagctgc

SEQ ID NO: 638507 - DNA, 25 bp, Homo sapien
tttggtagctgctgccactcaacag

SEQ ID NO: 638508 - DNA, 25 bp, Homo sapien
gccactcaacagtttttactccatt

SEQ ID NO: 638509 - DNA, 25 bp, Homo sapien
gtttttactccattttatgatgaca

SEQ ID NO: 638510 - DNA, 25 bp, Homo sapien
tgatgacacaagactctgagttctc

SEQ ID NO: 638511 - DNA, 25 bp, Homo sapien
gtctatgctcttgaaccaattcaag

SEQ ID NO: 638512 - DNA, 25 bp, Homo sapien
caagctatgcttttgaggaaaggca

SEQ ID NO: 638513 - DNA, 25 bp, Homo sapien
aaaggcatggccctgcttggtctca

SEQ ID NO: 638514 - DNA, 25 bp, Homo sapien
ctgcttggtctcaattctgtatggg

SEQ ID NO: 638515 - DNA, 25 bp, Homo sapien
gatggaagtgccctcaataagctgg

SEQ ID NO: 638516 - DNA, 25 bp, Homo sapien
aattcaagatcataaattcctcatg

SEQ ID NO: 638517 - DNA, 25 bp, Homo sapien
attcctcatgagatcttttctgcaa

SEQ ID NO: 638518 - DNA, 25 bp, Homo sapien
ttttctgcaaataacatctggttgg

SEQ ID NO: 638519 - DNA, 25 bp, Homo sapien
aacaaaattactggcccctctatgt

SEQ ID NO: 638520 - DNA, 25 bp, Homo sapien
ctggcccctctatgtgaagtttatt

SEQ ID NO: 638521 - DNA, 25 bp, Homo sapien
tggctaatataagtttactcttggg

SEQ ID NO: 638522 - DNA, 25 bp, Homo sapien
gggttcaagctacatatggcatagg

SEQ ID NO: 638523 - DNA, 25 bp, Homo sapien
atggcataggcaacgggtgcacacc

SEQ ID NO: 638524 - DNA, 25 bp, Homo sapien
ttcttgctacccacaatgggaaggt

SEQ ID NO: 638525 - DNA, 25 bp, Homo sapien
aaggttaattcctgggccatccagc

SEQ ID NO: 638526 - DNA, 25 bp, Homo sapien
aattcctgggccatccagcaggttt

SEQ ID NO: 638527 - DNA, 25 bp, Homo sapien
ggattgccacagctcgggagtttga

SEQ ID NO: 638528 - DNA, 25 bp, Homo sapien
gtggcgcacacttgaggtcccggct

SEQ ID NO: 638529 - DNA, 25 bp, Homo sapien
ggcgcacacttgaggtcccggctgt

SEQ ID NO: 638530 - DNA, 25 bp, Homo sapien
cacacttgaggtcccggctgtctgg

SEQ ID NO: 638531 - DNA, 25 bp, Homo sapien
ggtcccggctgtctgggagtctgag

SEQ ID NO: 638532 - DNA, 25 bp, Homo sapien
gcatgagaatttgcttgagctcctt

SEQ ID NO: 638533 - DNA, 25 bp, Homo sapien
gagaatttgcttgagctccttgagc

SEQ ID NO: 638534 - DNA, 25 bp, Homo sapien
gaatttgcttgagctccttgagcct

SEQ ID NO: 638535 - DNA, 25 bp, Homo sapien
atttgcttgagctccttgagcctgg

SEQ ID NO: 638536 - DNA, 25 bp, Homo sapien
ttgcttgagctccttgagcctggaa

SEQ ID NO: 638537 - DNA, 25 bp, Homo sapien
gcttgagctccttgagcctggaagg

SEQ ID NO: 638538 - DNA, 25 bp, Homo sapien
gctgtttttcatgaggactagctcc

SEQ ID NO: 638539 - DNA, 25 bp, Homo sapien
aggactagctcctttccaaaccaca

SEQ ID NO: 638540 - DNA, 25 bp, Homo sapien
tagctcctttccaaaccacaaatct

SEQ ID NO: 638541 - DNA, 25 bp, Homo sapien
caaaccacaaatctgcttctgtatt

SEQ ID NO: 638542 - DNA, 25 bp, Homo sapien
ctgcttctgtattttcagttccacc

SEQ ID NO: 638543 - DNA, 25 bp, Homo sapien
tgtattttcagttccacctctcagt

SEQ ID NO: 638544 - DNA, 25 bp, Homo sapien
gttccacctctcagtttctttagat

SEQ ID NO: 638545 - DNA, 25 bp, Homo sapien
cacctctcagtttctttagattttt

SEQ ID NO: 638546 - DNA, 25 bp, Homo sapien
ttttttcggtgtcctaattctgttg

SEQ ID NO: 638547 - DNA, 25 bp, Homo sapien
ttcggtgtcctaattctgttgtaaa

SEQ ID NO: 638548 - DNA, 25 bp, Homo sapien
ggtgtcctaattctgttgtaaatga

SEQ ID NO: 638549 - DNA, 25 bp, Homo sapien
gcaggatcatcgagttgaaaagttg

SEQ ID NO: 638550 - DNA, 25 bp, Homo sapien
gaggatatttatcccgctatttatt

SEQ ID NO: 638551 - DNA, 25 bp, Homo sapien
tttcaataactgtgacctcctgcac

SEQ ID NO: 638552 - DNA, 25 bp, Homo sapien
gctctgtgacatgagattcttagtt

SEQ ID NO: 638553 - DNA, 25 bp, Homo sapien
attgatattattggttactgaacac

SEQ ID NO: 638554 - DNA, 25 bp, Homo sapien
tattggttactgaacactggcatga

SEQ ID NO: 638555 - DNA, 25 bp, Homo sapien
ctgaacactggcatgagtttatttt

SEQ ID NO: 638556 - DNA, 25 bp, Homo sapien
tacagcaatctaaactaaacctttc

SEQ ID NO: 638557 - DNA, 25 bp, Homo sapien
cctttctaagaaatctagcagtcag

SEQ ID NO: 638558 - DNA, 25 bp, Homo sapien
gaaatctagcagtcagtattgtaat

SEQ ID NO: 638559 - DNA, 25 bp, Homo sapien
ctagcagtcagtattgtaatgcaat

SEQ ID NO: 638560 - DNA, 25 bp, Homo sapien
taacaagtaatgtgccaggttttta

SEQ ID NO: 638561 - DNA, 25 bp, Homo sapien
tactgtattttactttgctacaaac

SEQ ID NO: 638562 - DNA, 25 bp, Homo sapien
gctacaaacatgtactagaggacat

SEQ ID NO: 638563 - DNA, 25 bp, Homo sapien
acttgtcacatttctgatggaacat

SEQ ID NO: 638564 - DNA, 25 bp, Homo sapien
ctgatggaacatctcgctgttataa

SEQ ID NO: 638565 - DNA, 25 bp, Homo sapien
tcgctgttataattaggtagttctc

SEQ ID NO: 638566 - DNA, 25 bp, Homo sapien
ggtagttctctctaattacgttcag

SEQ ID NO: 638567 - DNA, 25 bp, Homo sapien
aattacgttcagtataattcctgta

SEQ ID NO: 638568 - DNA, 25 bp, Homo sapien
gtaaaatcccagtgaagctctttct

SEQ ID NO: 638569 - DNA, 25 bp, Homo sapien
cccagtgaagctctttctagaattt

SEQ ID NO: 638570 - DNA, 25 bp, Homo sapien
gagtaggtcctaaagtttggctaat

SEQ ID NO: 638571 - DNA, 25 bp, Homo sapien
tctcacctgggcatctacattgctc

SEQ ID NO: 638572 - DNA, 25 bp, Homo sapien
atccctgacctttaagtatctccta

SEQ ID NO: 638573 - DNA, 25 bp, Homo sapien
tatctcctaagatacccgcttcctt

SEQ ID NO: 638574 - DNA, 25 bp, Homo sapien
tctcagagccccatgttacgactac

SEQ ID NO: 638575 - DNA, 25 bp, Homo sapien
ttacgactacccatttactctgtgt

SEQ ID NO: 638576 - DNA, 25 bp, Homo sapien
acccatttactctgtgtcaatacca

SEQ ID NO: 638577 - DNA, 25 bp, Homo sapien
gtgctacattagaacagaggccata

SEQ ID NO: 638578 - DNA, 25 bp, Homo sapien
gaggccatatgtatcttgctcacat

SEQ ID NO: 638579 - DNA, 25 bp, Homo sapien
ttgctcacatctgtgcctagaacag

SEQ ID NO: 638580 - DNA, 25 bp, Homo sapien
gtgtctggtacctacaagtgctcaa

SEQ ID NO: 638581 - DNA, 25 bp, Homo sapien
aaattcttttggatgactggcaatt

SEQ ID NO: 638582 - DNA, 25 bp, Homo sapien
gcctgatacgtacattttccctgaa

SEQ ID NO: 638583 - DNA, 25 bp, Homo sapien
aggatggctgctgagagctctgcca

SEQ ID NO: 638584 - DNA, 25 bp, Homo sapien
agaggaacagccttgtgagcccaga

SEQ ID NO: 638585 - DNA, 25 bp, Homo sapien
aacagccttgtgagcccagagggca

SEQ ID NO: 638586 - DNA, 25 bp, Homo sapien
actggccaatgcatccgtccatctg

SEQ ID NO: 638587 - DNA, 25 bp, Homo sapien
atctgtcacaccagtgacgcagtat

SEQ ID NO: 638588 - DNA, 25 bp, Homo sapien
gacgcagtatactcattttgtaaga

SEQ ID NO: 638589 - DNA, 25 bp, Homo sapien
agattaaggcactccactgctatca

SEQ ID NO: 638590 - DNA, 25 bp, Homo sapien
cactgctatcagacatttttcataa

SEQ ID NO: 638591 - DNA, 25 bp, Homo sapien
aaacacaccagtgattcctccttgg

SEQ ID NO: 638592 - DNA, 25 bp, Homo sapien
tgattcctccttggagtcaacagga

SEQ ID NO: 638593 - DNA, 25 bp, Homo sapien
aaaattctgacatattactgacaat

SEQ ID NO: 638594 - DNA, 25 bp, Homo sapien
attctgacatattactgacaatttc

SEQ ID NO: 638595 - DNA, 25 bp, Homo sapien
gacatattactgacaatttcaaaaa

SEQ ID NO: 638596 - DNA, 25 bp, Homo sapien
attactgacaatttcaaaaacagga

SEQ ID NO: 638597 - DNA, 25 bp, Homo sapien
acaggaaaagtctgacagtattagt

SEQ ID NO: 638598 - DNA, 25 bp, Homo sapien
aaagtctgacagtattagtagggtt

SEQ ID NO: 638599 - DNA, 25 bp, Homo sapien
agtctgacagtattagtagggttga

SEQ ID NO: 638600 - DNA, 25 bp, Homo sapien
tctgacagtattagtagggttgact

SEQ ID NO: 638601 - DNA, 25 bp, Homo sapien
gacagtattagtagggttgactaaa

SEQ ID NO: 638602 - DNA, 25 bp, Homo sapien
gtagggttgactaaaacaatatgaa

SEQ ID NO: 638603 - DNA, 25 bp, Homo sapien
gaaattgactaaaataagtggactg

SEQ ID NO: 638604 - DNA, 25 bp, Homo sapien
ggatgctgatttagtccacacgaca

SEQ ID NO: 638605 - DNA, 25 bp, Homo sapien
agtccacacgacagcctgtgagtag

SEQ ID NO: 638606 - DNA, 25 bp, Homo sapien
gagtaggaatcagtcgtgcaacaaa

SEQ ID NO: 638607 - DNA, 25 bp, Homo sapien
tgttatttgcaaactctcctctctg

SEQ ID NO: 638608 - DNA, 25 bp, Homo sapien
tcctctctgtctggtgtagcgactg

SEQ ID NO: 638609 - DNA, 25 bp, Homo sapien
gtagcgactgccctggctaatgaag

SEQ ID NO: 638610 - DNA, 25 bp, Homo sapien
gctaatgaagatttgccttgaaggc

SEQ ID NO: 638611 - DNA, 25 bp, Homo sapien
ttgaaggcaggcacggtctcacagc

SEQ ID NO: 638612 - DNA, 25 bp, Homo sapien
cacggtctcacagctaacatttaca

SEQ ID NO: 638613 - DNA, 25 bp, Homo sapien
agcagtaagtgcagtgccaggctca

SEQ ID NO: 638614 - DNA, 25 bp, Homo sapien
agtgccaggctcatcacaggtggat

SEQ ID NO: 638615 - DNA, 25 bp, Homo sapien
ttcctccatctgtgattttccgcgc

SEQ ID NO: 638616 - DNA, 25 bp, Homo sapien
ttttccgcgctcctgtaacttgtta

SEQ ID NO: 638617 - DNA, 25 bp, Homo sapien
gtaacttgttactctcagatcagat

SEQ ID NO: 638618 - DNA, 25 bp, Homo sapien
tcagatcagatctcctgggcccgac

SEQ ID NO: 638619 - DNA, 25 bp, Homo sapien
gctgtgtctgcctagctgtttctca

SEQ ID NO: 638620 - DNA, 25 bp, Homo sapien
tcgggtcagcgtctgcatcaagagt

SEQ ID NO: 638621 - DNA, 25 bp, Homo sapien
agagtgagtcttcaatcgtctgccg

SEQ ID NO: 638622 - DNA, 25 bp, Homo sapien
gatgttttcatgatgcgggccaatt

SEQ ID NO: 638623 - DNA, 25 bp, Homo sapien
gatgcgggccaattttgaagctcct

SEQ ID NO: 638624 - DNA, 25 bp, Homo sapien
ttgaagctcctggacttcgttcgcg

SEQ ID NO: 638625 - DNA, 25 bp, Homo sapien
ggaattgggatcttctcacgtgccc

SEQ ID NO: 638626 - DNA, 25 bp, Homo sapien
aaatgctcgctttcagctcagtttt

SEQ ID NO: 638627 - DNA, 25 bp, Homo sapien
gaaggaataatatctttagctttta

SEQ ID NO: 638628 - DNA, 25 bp, Homo sapien
taatagcaggacacatttaggaaat

SEQ ID NO: 638629 - DNA, 25 bp, Homo sapien
acaggagaggtcatcagtgcatttc

SEQ ID NO: 638630 - DNA, 25 bp, Homo sapien
agtgcatttctgcaagtagaagctt

SEQ ID NO: 638631 - DNA, 25 bp, Homo sapien
gtagaagcttgtttagtcagataat

SEQ ID NO: 638632 - DNA, 25 bp, Homo sapien
gtcagataatgtggtctcaacagat

SEQ ID NO: 638633 - DNA, 25 bp, Homo sapien
aagtgaaccattctgttcgttccat

SEQ ID NO: 638634 - DNA, 25 bp, Homo sapien
aaccattctgttcgttccatgtatt

SEQ ID NO: 638635 - DNA, 25 bp, Homo sapien
ttctgttcgttccatgtattagatg

SEQ ID NO: 638636 - DNA, 25 bp, Homo sapien
gatgggaacagccaaattaatttga

SEQ ID NO: 638637 - DNA, 25 bp, Homo sapien
gaaagaacatggtgcactatttgct

SEQ ID NO: 638638 - DNA, 25 bp, Homo sapien
gaacatggtgcactatttgcttcac

SEQ ID NO: 638639 - DNA, 25 bp, Homo sapien
actatttgcttcacactcaagaagt

SEQ ID NO: 638640 - DNA, 25 bp, Homo sapien
actcaagaagttaatatggaacctt

SEQ ID NO: 638641 - DNA, 25 bp, Homo sapien
caaattaaggagatccttcagagat

SEQ ID NO: 638642 - DNA, 25 bp, Homo sapien
aaccttatattttgtctctgcgact

SEQ ID NO: 638643 - DNA, 25 bp, Homo sapien
tgtctctgcgactataactttgtaa

SEQ ID NO: 638644 - DNA, 25 bp, Homo sapien
aactttgtaaataaccataactatg

SEQ ID NO: 638645 - DNA, 25 bp, Homo sapien
gttatcagacattctcaaccttgtt

SEQ ID NO: 638646 - DNA, 25 bp, Homo sapien
gacattctcaaccttgtttccaagg

SEQ ID NO: 638647 - DNA, 25 bp, Homo sapien
gtttccaaggttatgtaatgtttat

SEQ ID NO: 638648 - DNA, 25 bp, Homo sapien
gtccgatggtgctcactgcttggtg

SEQ ID NO: 638649 - DNA, 25 bp, Homo sapien
gatggtgctcactgcttggtgatag

SEQ ID NO: 638650 - DNA, 25 bp, Homo sapien
gtgctcactgcttggtgatagtcga

SEQ ID NO: 638651 - DNA, 25 bp, Homo sapien
gcttggtgatagtcgattggcccca

SEQ ID NO: 638652 - DNA, 25 bp, Homo sapien
tggtgatagtcgattggccccacat

SEQ ID NO: 638653 - DNA, 25 bp, Homo sapien
tgatagtcgattggccccacattgg

SEQ ID NO: 638654 - DNA, 25 bp, Homo sapien
gattggccccacattgggtgccaaa

SEQ ID NO: 638655 - DNA, 25 bp, Homo sapien
attgggtgccaaagtgtgtccggaa

SEQ ID NO: 638656 - DNA, 25 bp, Homo sapien
ttcgagactagcctcaccaagatgt

SEQ ID NO: 638657 - DNA, 25 bp, Homo sapien
gagactagcctcaccaagatgtaga

SEQ ID NO: 638658 - DNA, 25 bp, Homo sapien
tagcctcaccaagatgtagagaccc

SEQ ID NO: 638659 - DNA, 25 bp, Homo sapien
aaagcatagccaatgcctgctggga

SEQ ID NO: 638660 - DNA, 25 bp, Homo sapien
ggcagcagttagaagtccaggctct

SEQ ID NO: 638661 - DNA, 25 bp, Homo sapien
gaagtccaggctctagatctcacaa

SEQ ID NO: 638662 - DNA, 25 bp, Homo sapien
caggctctagatctcacaaagcaga

SEQ ID NO: 638663 - DNA, 25 bp, Homo sapien
agcagagaccaaatcttcaaaaagc

SEQ ID NO: 638664 - DNA, 25 bp, Homo sapien
agcagagaccaaatcctgtctgtcc

SEQ ID NO: 638665 - DNA, 25 bp, Homo sapien
tgcgacctgccagctttgtcaggtt

SEQ ID NO: 638666 - DNA, 25 bp, Homo sapien
agctttgtcaggttggcctgttcaa

SEQ ID NO: 638667 - DNA, 25 bp, Homo sapien
tcaggttggcctgttcaaacaccag

SEQ ID NO: 638668 - DNA, 25 bp, Homo sapien
aaaaacctactttcatctccactga

SEQ ID NO: 638669 - DNA, 25 bp, Homo sapien
agttattttgtgttagcttctattt

SEQ ID NO: 638670 - DNA, 25 bp, Homo sapien
gtccaaatgtggtctcagttcgtaa

SEQ ID NO: 638671 - DNA, 25 bp, Homo sapien
gtggtctcagttcgtaatgatttaa

SEQ ID NO: 638672 - DNA, 25 bp, Homo sapien
acacttgattcaaatagtacttcat

SEQ ID NO: 638673 - DNA, 25 bp, Homo sapien
agtacttcattagttgctttcatat

SEQ ID NO: 638674 - DNA, 25 bp, Homo sapien
gttgctttcatataaaatttcatgt

SEQ ID NO: 638675 - DNA, 25 bp, Homo sapien
atgactatctcataattatctggta

SEQ ID NO: 638676 - DNA, 25 bp, Homo sapien
gataaccttgacatcttgaaatgaa

SEQ ID NO: 638677 - DNA, 25 bp, Homo sapien
aatgaaacaggatcttgtccatgga

SEQ ID NO: 638678 - DNA, 25 bp, Homo sapien
ggatcttgtccatggattttcatta

SEQ ID NO: 638679 - DNA, 25 bp, Homo sapien
ttgtccatggattttcattagttcc

SEQ ID NO: 638680 - DNA, 25 bp, Homo sapien
tagttcctgtatggcctgtatttaa

SEQ ID NO: 638681 - DNA, 25 bp, Homo sapien
gcagaagccatgaggcctctgaggc

SEQ ID NO: 638682 - DNA, 25 bp, Homo sapien
ggctcagattgaatcatggcctttg

SEQ ID NO: 638683 - DNA, 25 bp, Homo sapien
atcatggcctttgaggcctaggctc

SEQ ID NO: 638684 - DNA, 25 bp, Homo sapien
taggctcagattgaacacaccatcc

SEQ ID NO: 638685 - DNA, 25 bp, Homo sapien
tctattggccaaatcgagtcacagg

SEQ ID NO: 638686 - DNA, 25 bp, Homo sapien
gagtcacagggatggcctagattca

SEQ ID NO: 638687 - DNA, 25 bp, Homo sapien
gaaaacagattccacctcttgatgg

SEQ ID NO: 638688 - DNA, 25 bp, Homo sapien
tccacctcttgatggaataagctgc

SEQ ID NO: 638689 - DNA, 25 bp, Homo sapien
gctgcaaagtcacatggtcaatggc

SEQ ID NO: 638690 - DNA, 25 bp, Homo sapien
atttgagacttttctgcaataaacc

SEQ ID NO: 638691 - DNA, 25 bp, Homo sapien
gcaataaaccaaccacaaatatctt

SEQ ID NO: 638692 - DNA, 25 bp, Homo sapien
ggatggattcccctattgaagttta

SEQ ID NO: 638693 - DNA, 25 bp, Homo sapien
atgcctgggccgattgatgatggct

SEQ ID NO: 638694 - DNA, 25 bp, Homo sapien
ggtatgaataccctccaatttgttt

SEQ ID NO: 638695 - DNA, 25 bp, Homo sapien
ggaattgctccttgatgtttaccat

SEQ ID NO: 638696 - DNA, 25 bp, Homo sapien
gctccttgatgtttaccattgcaaa

SEQ ID NO: 638697 - DNA, 25 bp, Homo sapien
atgatcttggctgccttgatggtaa

SEQ ID NO: 638698 - DNA, 25 bp, Homo sapien
cttgatggtaattaccgcggcggta

SEQ ID NO: 638699 - DNA, 25 bp, Homo sapien
tccctgctgtctggactgaagaaaa

SEQ ID NO: 638700 - DNA, 25 bp, Homo sapien
ttacatactggcttctgttccattt

SEQ ID NO: 638701 - DNA, 25 bp, Homo sapien
ctcctttaattaggccagttacttg

SEQ ID NO: 638702 - DNA, 25 bp, Homo sapien
gccagttacttggatggattcccct

SEQ ID NO: 638703 - DNA, 25 bp, Homo sapien
atggcatgaatgagacttgaagcta

SEQ ID NO: 638704 - DNA, 25 bp, Homo sapien
tttgaagaacattaactgtggctgt

SEQ ID NO: 638705 - DNA, 25 bp, Homo sapien
taactgtggctgtttgtgacctggc

SEQ ID NO: 638706 - DNA, 25 bp, Homo sapien
actgtggctgtttgtgacctggctg

SEQ ID NO: 638707 - DNA, 25 bp, Homo sapien
gaaaggacaacccatcatcacatct

SEQ ID NO: 638708 - DNA, 25 bp, Homo sapien
catcacatctactggtaaacttatg

SEQ ID NO: 638709 - DNA, 25 bp, Homo sapien
tggtaaacttatggtatccagaaaa

SEQ ID NO: 638710 - DNA, 25 bp, Homo sapien
aaagccaaaggactctattgcaaga

SEQ ID NO: 638711 - DNA, 25 bp, Homo sapien
tattgcaagacagcatcacctggct

SEQ ID NO: 638712 - DNA, 25 bp, Homo sapien
agcatcacctggctgcagagactta

SEQ ID NO: 638713 - DNA, 25 bp, Homo sapien
tcacctggctgcagagacttactaa

SEQ ID NO: 638714 - DNA, 25 bp, Homo sapien
agggcatttgccaactgtttatata

SEQ ID NO: 638715 - DNA, 25 bp, Homo sapien
aacaaatattaccatgtgcacattc

SEQ ID NO: 638716 - DNA, 25 bp, Homo sapien
gtgcacattcatagcagcactactc

SEQ ID NO: 638717 - DNA, 25 bp, Homo sapien
cagcactactcacagtagctaaaat

SEQ ID NO: 638718 - DNA, 25 bp, Homo sapien
agctaaaatgtagggacaatccaga

SEQ ID NO: 638719 - DNA, 25 bp, Homo sapien
tgaatgcatcgacaaaacatggaat

SEQ ID NO: 638720 - DNA, 25 bp, Homo sapien
ggaatattcatataatagactctca

SEQ ID NO: 638721 - DNA, 25 bp, Homo sapien
atagactctcattcagccataagaa

SEQ ID NO: 638722 - DNA, 25 bp, Homo sapien
agaatgagctactgatgcatcctcc

SEQ ID NO: 638723 - DNA, 25 bp, Homo sapien
tgatgcatcctccaacatgaccgag

SEQ ID NO: 638724 - DNA, 25 bp, Homo sapien
tccaacatgaccgagccttgaaaac

SEQ ID NO: 638725 - DNA, 25 bp, Homo sapien
tatttagggaaggtaggccgggcat

SEQ ID NO: 638726 - DNA, 25 bp, Homo sapien
atttagggaaggtaggccgggcatg

SEQ ID NO: 638727 - DNA, 25 bp, Homo sapien
tttagggaaggtaggccgggcatgg

SEQ ID NO: 638728 - DNA, 25 bp, Homo sapien
ttagggaaggtaggccgggcatggt

SEQ ID NO: 638729 - DNA, 25 bp, Homo sapien
ggtggctcacgcctagcactttggg

SEQ ID NO: 638730 - DNA, 25 bp, Homo sapien
gtggctcacgcctagcactttggga

SEQ ID NO: 638731 - DNA, 25 bp, Homo sapien
gctgaggtgggtggaggattacttg

SEQ ID NO: 638732 - DNA, 25 bp, Homo sapien
ctgaggtgggtggaggattacttga

SEQ ID NO: 638733 - DNA, 25 bp, Homo sapien
aggtgggtggaggattacttgaggt

SEQ ID NO: 638734 - DNA, 25 bp, Homo sapien
cactttatctttccagaaaaaatat

SEQ ID NO: 638735 - DNA, 25 bp, Homo sapien
tatctttccagaaaaaatatttagg

SEQ ID NO: 638736 - DNA, 25 bp, Homo sapien
ctgccaaatcaaatattggaggtct

SEQ ID NO: 638737 - DNA, 25 bp, Homo sapien
tcaaatattggaggtctttctccaa

SEQ ID NO: 638738 - DNA, 25 bp, Homo sapien
ttaaaccattgtcacctgctaccaa

SEQ ID NO: 638739 - DNA, 25 bp, Homo sapien
aaaccattgtcacctgctaccaatt

SEQ ID NO: 638740 - DNA, 25 bp, Homo sapien
attgtcacctgctaccaattgtcta

SEQ ID NO: 638741 - DNA, 25 bp, Homo sapien
gtcacctgctaccaattgtctacta

SEQ ID NO: 638742 - DNA, 25 bp, Homo sapien
cacctgctaccaattgtctactagc

SEQ ID NO: 638743 - DNA, 25 bp, Homo sapien
ggataagccacaagtaaataagaac

SEQ ID NO: 638744 - DNA, 25 bp, Homo sapien
gaacaagaacaaccaaagccttgga

SEQ ID NO: 638745 - DNA, 25 bp, Homo sapien
aaagccttggaaacacaccatcatt

SEQ ID NO: 638746 - DNA, 25 bp, Homo sapien
gccttggaaacacaccatcattctt

SEQ ID NO: 638747 - DNA, 25 bp, Homo sapien
ctttctttgatctttagactaaagc

SEQ ID NO: 638748 - DNA, 25 bp, Homo sapien
gcaattttaaataccaggcttactt

SEQ ID NO: 638749 - DNA, 25 bp, Homo sapien
ttctttattctaagctggaaatgca

SEQ ID NO: 638750 - DNA, 25 bp, Homo sapien
gtagattttcagtaatcccttgtta

SEQ ID NO: 638751 - DNA, 25 bp, Homo sapien
cagtaatcccttgttatatcattaa

SEQ ID NO: 638752 - DNA, 25 bp, Homo sapien
tcattaactctttgatccgttttaa

SEQ ID NO: 638753 - DNA, 25 bp, Homo sapien
gatccgttttaacatgcagttttca

SEQ ID NO: 638754 - DNA, 25 bp, Homo sapien
atgcagttttcatccatcctttttt

SEQ ID NO: 638755 - DNA, 25 bp, Homo sapien
gaattgatcatagtgactaagctgc

SEQ ID NO: 638756 - DNA, 25 bp, Homo sapien
gtgactaagctgcaatactaaatta

SEQ ID NO: 638757 - DNA, 25 bp, Homo sapien
cagatttatccacatatttaccact

SEQ ID NO: 638758 - DNA, 25 bp, Homo sapien
atccacttataacgctcacttgaaa

SEQ ID NO: 638759 - DNA, 25 bp, Homo sapien
ccacttataacgctcacttgaaata

SEQ ID NO: 638760 - DNA, 25 bp, Homo sapien
cacttataacgctcacttgaaatag

SEQ ID NO: 638761 - DNA, 25 bp, Homo sapien
acttataacgctcacttgaaatagg

SEQ ID NO: 638762 - DNA, 25 bp, Homo sapien
ttataacgctcacttgaaataggga

SEQ ID NO: 638763 - DNA, 25 bp, Homo sapien
ataacgctcacttgaaatagggaga

SEQ ID NO: 638764 - DNA, 25 bp, Homo sapien
aacgctcacttgaaatagggagagt

SEQ ID NO: 638765 - DNA, 25 bp, Homo sapien
acgctcacttgaaatagggagagtt

SEQ ID NO: 638766 - DNA, 25 bp, Homo sapien
cgctcacttgaaatagggagagttg

SEQ ID NO: 638767 - DNA, 25 bp, Homo sapien
ctcacttgaaatagggagagttggc

SEQ ID NO: 638768 - DNA, 25 bp, Homo sapien
aatagggagagttggctgggtgcga

SEQ ID NO: 638769 - DNA, 25 bp, Homo sapien
aatacaacttagtgcccagtatagg

SEQ ID NO: 638770 - DNA, 25 bp, Homo sapien
tagtgcccagtataggttattagct

SEQ ID NO: 638771 - DNA, 25 bp, Homo sapien
gttattagctaatggcctggaaaga

SEQ ID NO: 638772 - DNA, 25 bp, Homo sapien
cactgtttaaatagtcatccctcct

SEQ ID NO: 638773 - DNA, 25 bp, Homo sapien
tagtcatccctcctgttcattttca

SEQ ID NO: 638774 - DNA, 25 bp, Homo sapien
gttcattttcacctctatgttcatt

SEQ ID NO: 638775 - DNA, 25 bp, Homo sapien
ttcacctctatgttcattttcaagt

SEQ ID NO: 638776 - DNA, 25 bp, Homo sapien
tttgtaatccagaaaagcctgtttt

SEQ ID NO: 638777 - DNA, 25 bp, Homo sapien
gcaatcatggaagtgcatacttgaa

SEQ ID NO: 638778 - DNA, 25 bp, Homo sapien
aaaagcctgctctaagtgatcgtgt

SEQ ID NO: 638779 - DNA, 25 bp, Homo sapien
ttattaacttcacagactgctttgc

SEQ ID NO: 638780 - DNA, 25 bp, Homo sapien
gaaaattcagattcccagaagatgc

SEQ ID NO: 638781 - DNA, 25 bp, Homo sapien
gcaaagggcattccctatgtgcctg

SEQ ID NO: 638782 - DNA, 25 bp, Homo sapien
agggcattccctatgtgcctggcaa

SEQ ID NO: 638783 - DNA, 25 bp, Homo sapien
ttccctatgtgcctggcaacaggaa

SEQ ID NO: 638784 - DNA, 25 bp, Homo sapien
gcctggcaacaggaaggtaattcca

SEQ ID NO: 638785 - DNA, 25 bp, Homo sapien
gaaggtaattccacatctatcccac

SEQ ID NO: 638786 - DNA, 25 bp, Homo sapien
tatcccacacccatctcatgatggg

SEQ ID NO: 638787 - DNA, 25 bp, Homo sapien
tcaccactgtagagtcagccacgta

SEQ ID NO: 638788 - DNA, 25 bp, Homo sapien
gagtcagccacgtaattattttaac

SEQ ID NO: 638789 - DNA, 25 bp, Homo sapien
tattttaacatctctagtatccaca

SEQ ID NO: 638790 - DNA, 25 bp, Homo sapien
aacatctctagtatccacattaata

SEQ ID NO: 638791 - DNA, 25 bp, Homo sapien
ttgtacttccataaccttggcagat

SEQ ID NO: 638792 - DNA, 25 bp, Homo sapien
gcagattaggaaatgtcaattaccc

SEQ ID NO: 638793 - DNA, 25 bp, Homo sapien
aatccaacctcctatatagagccac

SEQ ID NO: 638794 - DNA, 25 bp, Homo sapien
atagagccacacactggtttcctag

SEQ ID NO: 638795 - DNA, 25 bp, Homo sapien
ttcctagccttttatgtattgaaaa

SEQ ID NO: 638796 - DNA, 25 bp, Homo sapien
gatgttatcctataaattttcttct

SEQ ID NO: 638797 - DNA, 25 bp, Homo sapien
cttttccaatgtgttctataaatat

SEQ ID NO: 638798 - DNA, 25 bp, Homo sapien
gaggttatatccatgtttcatttct

SEQ ID NO: 638799 - DNA, 25 bp, Homo sapien
tccatgtttcatttctgtggaaaac

SEQ ID NO: 638800 - DNA, 25 bp, Homo sapien
ccaagtataactgggcaccatggct

SEQ ID NO: 638801 - DNA, 25 bp, Homo sapien
atattttctcattatcagctcaaat

SEQ ID NO: 638802 - DNA, 25 bp, Homo sapien
agaaatgtccaagaacattctcttg

SEQ ID NO: 638803 - DNA, 25 bp, Homo sapien
gaacattctcttggggtttggatca

SEQ ID NO: 638804 - DNA, 25 bp, Homo sapien
tcaggacccctttctggtaacatct

SEQ ID NO: 638805 - DNA, 25 bp, Homo sapien
tggtaacatcttcctgatgaatccc

SEQ ID NO: 638806 - DNA, 25 bp, Homo sapien
acatcttcctgatgaatcccaaaga

SEQ ID NO: 638807 - DNA, 25 bp, Homo sapien
ttcctgatgaatcccaaagaagtga

SEQ ID NO: 638808 - DNA, 25 bp, Homo sapien
gaatcccaaagaagtgatactgagg

SEQ ID NO: 638809 - DNA, 25 bp, Homo sapien
gcagcactgattggctgactctgga

SEQ ID NO: 638810 - DNA, 25 bp, Homo sapien
gaaaactttcaagttacttacagct

SEQ ID NO: 638811 - DNA, 25 bp, Homo sapien
tttcaagttacttacagcttttatc

SEQ ID NO: 638812 - DNA, 25 bp, Homo sapien
ttgagtaaagtctattcctgtgacc

SEQ ID NO: 638813 - DNA, 25 bp, Homo sapien
tgtgctataagtctaaacattcttt

SEQ ID NO: 638814 - DNA, 25 bp, Homo sapien
aagtctaaacattctttatccacag

SEQ ID NO: 638815 - DNA, 25 bp, Homo sapien
aaacattctttatccacagacataa

SEQ ID NO: 638816 - DNA, 25 bp, Homo sapien
tatccacagacataaaagcctaaat

SEQ ID NO: 638817 - DNA, 25 bp, Homo sapien
agcctaaattcccaactgtgtgatt

SEQ ID NO: 638818 - DNA, 25 bp, Homo sapien
tcccaactgtgtgatttcatcttga

SEQ ID NO: 638819 - DNA, 25 bp, Homo sapien
caactgtgtgatttcatcttgattt

SEQ ID NO: 638820 - DNA, 25 bp, Homo sapien
gtgtgatttcatcttgatttattcc

SEQ ID NO: 638821 - DNA, 25 bp, Homo sapien
gatttcatcttgatttattccaaaa

SEQ ID NO: 638822 - DNA, 25 bp, Homo sapien
cctatttaagtgcatggattttaat

SEQ ID NO: 638823 - DNA, 25 bp, Homo sapien
aaatatgctatattgttaccaaaaa

SEQ ID NO: 638824 - DNA, 25 bp, Homo sapien
tctctgctgcaagcctagaaactga

SEQ ID NO: 638825 - DNA, 25 bp, Homo sapien
tctgctgcaagcctagaaactgact

SEQ ID NO: 638826 - DNA, 25 bp, Homo sapien
gctgcaagcctagaaactgactaat

SEQ ID NO: 638827 - DNA, 25 bp, Homo sapien
gcaagcctagaaactgactaatgta

SEQ ID NO: 638828 - DNA, 25 bp, Homo sapien
atggaaccgtttaactcagaactag

SEQ ID NO: 638829 - DNA, 25 bp, Homo sapien
gaaccgtttaactcagaactagctg

SEQ ID NO: 638830 - DNA, 25 bp, Homo sapien
accgtttaactcagaactagctgtt

SEQ ID NO: 638831 - DNA, 25 bp, Homo sapien
gtttaactcagaactagctgttaga

SEQ ID NO: 638832 - DNA, 25 bp, Homo sapien
actcagaactagctgttagatgact

SEQ ID NO: 638833 - DNA, 25 bp, Homo sapien
cagaactagctgttagatgactaaa

SEQ ID NO: 638834 - DNA, 25 bp, Homo sapien
gatgactaaagttaatgttgcattt

SEQ ID NO: 638835 - DNA, 25 bp, Homo sapien
gttatgtttgggtgatctgcaatcc

SEQ ID NO: 638836 - DNA, 25 bp, Homo sapien
atctgcaatcccataggtgtcatcg

SEQ ID NO: 638837 - DNA, 25 bp, Homo sapien
ggtgtcatcgctagcctggttaaaa

SEQ ID NO: 638838 - DNA, 25 bp, Homo sapien
ggttaaaactagagtactgccttct

SEQ ID NO: 638839 - DNA, 25 bp, Homo sapien
agagtactgccttctttgtattctt

SEQ ID NO: 638840 - DNA, 25 bp, Homo sapien
gtattcttgtcatttgtgccaatca

SEQ ID NO: 638841 - DNA, 25 bp, Homo sapien
gagtgtatctacaggtgcatattag

SEQ ID NO: 638842 - DNA, 25 bp, Homo sapien
gtgcatattagttcacaggtttggt

SEQ ID NO: 638843 - DNA, 25 bp, Homo sapien
aaagtcatctgtttgcgatcaagag

SEQ ID NO: 638844 - DNA, 25 bp, Homo sapien
gggcatggcagggttatacaaatgt

SEQ ID NO: 638845 - DNA, 25 bp, Homo sapien
ggattgtctccaagcttccatggat

SEQ ID NO: 638846 - DNA, 25 bp, Homo sapien
gggaagtaataccaagaaagtcagc

SEQ ID NO: 638847 - DNA, 25 bp, Homo sapien
gacaagactcttagtctctggccaa

SEQ ID NO: 638848 - DNA, 25 bp, Homo sapien
ttagtctctggccaactttgggaga

SEQ ID NO: 638849 - DNA, 25 bp, Homo sapien
caactttgggagacttaattcactt

SEQ ID NO: 638850 - DNA, 25 bp, Homo sapien
gagacttaattcactttccaggcct

SEQ ID NO: 638851 - DNA, 25 bp, Homo sapien
taattcactttccaggcctcagttt

SEQ ID NO: 638852 - DNA, 25 bp, Homo sapien
cagtttcctcaatcaagaaattgga

SEQ ID NO: 638853 - DNA, 25 bp, Homo sapien
aagaaattggattttaggcatcttt

SEQ ID NO: 638854 - DNA, 25 bp, Homo sapien
aggcatcttttatccgtaattctaa

SEQ ID NO: 638855 - DNA, 25 bp, Homo sapien
cgtaattctaaatccgagttgcgag

SEQ ID NO: 638856 - DNA, 25 bp, Homo sapien
aatccgagttgcgaggacagagaac

SEQ ID NO: 638857 - DNA, 25 bp, Homo sapien
ttcctttttattatcatctaccata

SEQ ID NO: 638858 - DNA, 25 bp, Homo sapien
tattatcatctaccatagcctgtta

SEQ ID NO: 638859 - DNA, 25 bp, Homo sapien
atcatctaccatagcctgttattat

SEQ ID NO: 638860 - DNA, 25 bp, Homo sapien
tagctgtttctctgcaaatgtagga

SEQ ID NO: 638861 - DNA, 25 bp, Homo sapien
gtttctctgcaaatgtaggacaatt

SEQ ID NO: 638862 - DNA, 25 bp, Homo sapien
acaattgcattgtcttgtcctctga

SEQ ID NO: 638863 - DNA, 25 bp, Homo sapien
attgtcttgtcctctgatgtattca

SEQ ID NO: 638864 - DNA, 25 bp, Homo sapien
cttgtcctctgatgtattcaaaaca

SEQ ID NO: 638865 - DNA, 25 bp, Homo sapien
attcaaaacagttggtgactggcac

SEQ ID NO: 638866 - DNA, 25 bp, Homo sapien
ggtgactggcacgtcaaagacactt

SEQ ID NO: 638867 - DNA, 25 bp, Homo sapien
tggcacgtcaaagacacttattgaa

SEQ ID NO: 638868 - DNA, 25 bp, Homo sapien
gtattatcgttttcatttcaaactg

SEQ ID NO: 638869 - DNA, 25 bp, Homo sapien
tattatcgttttcatttcaaactgg

SEQ ID NO: 638870 - DNA, 25 bp, Homo sapien
attatcgttttcatttcaaactggg

SEQ ID NO: 638871 - DNA, 25 bp, Homo sapien
ttatcgttttcatttcaaactgggg

SEQ ID NO: 638872 - DNA, 25 bp, Homo sapien
tatcgttttcatttcaaactggggc

SEQ ID NO: 638873 - DNA, 25 bp, Homo sapien
atcgttttcatttcaaactggggct

SEQ ID NO: 638874 - DNA, 25 bp, Homo sapien
tcgttttcatttcaaactggggcta

SEQ ID NO: 638875 - DNA, 25 bp, Homo sapien
gttttcatttcaaactggggctact

SEQ ID NO: 638876 - DNA, 25 bp, Homo sapien
ttttcatttcaaactggggctactg

SEQ ID NO: 638877 - DNA, 25 bp, Homo sapien
tttcatttcaaactggggctactgg

SEQ ID NO: 638878 - DNA, 25 bp, Homo sapien
ttcatttcaaactggggctactggc

SEQ ID NO: 638879 - DNA, 25 bp, Homo sapien
ggtttgatcaacctagaaagacata

SEQ ID NO: 638880 - DNA, 25 bp, Homo sapien
gtttgatcaacctagaaagacataa

SEQ ID NO: 638881 - DNA, 25 bp, Homo sapien
tttgatcaacctagaaagacataaa

SEQ ID NO: 638882 - DNA, 25 bp, Homo sapien
ttgatcaacctagaaagacataaag

SEQ ID NO: 638883 - DNA, 25 bp, Homo sapien
tgatcaacctagaaagacataaagt

SEQ ID NO: 638884 - DNA, 25 bp, Homo sapien
gatcaacctagaaagacataaagtt

SEQ ID NO: 638885 - DNA, 25 bp, Homo sapien
gaaagacataaagttctgggccggg

SEQ ID NO: 638886 - DNA, 25 bp, Homo sapien
aagacataaagttctgggccgggag

SEQ ID NO: 638887 - DNA, 25 bp, Homo sapien
agacataaagttctgggccgggagt

SEQ ID NO: 638888 - DNA, 25 bp, Homo sapien
gacataaagttctgggccgggagtg

SEQ ID NO: 638889 - DNA, 25 bp, Homo sapien
acataaagttctgggccgggagtgg

SEQ ID NO: 638890 - DNA, 25 bp, Homo sapien
tggctcctccgttataggacataat

SEQ ID NO: 638891 - DNA, 25 bp, Homo sapien
ttgtgtggtatacgaggacccctcc

SEQ ID NO: 638892 - DNA, 25 bp, Homo sapien
aggacccctccattgccggagcaat

SEQ ID NO: 638893 - DNA, 25 bp, Homo sapien
ggagcaattccagtaaaccgggtct

SEQ ID NO: 638894 - DNA, 25 bp, Homo sapien
cagtaaaccgggtctagccttcact

SEQ ID NO: 638895 - DNA, 25 bp, Homo sapien
gactctacatagagggtcctgagat

SEQ ID NO: 638896 - DNA, 25 bp, Homo sapien
agggtcctgagattccaggccttta

SEQ ID NO: 638897 - DNA, 25 bp, Homo sapien
agattccaggcctttactcatcctg

SEQ ID NO: 638898 - DNA, 25 bp, Homo sapien
tgcatcccctacctacttggatgaa

SEQ ID NO: 638899 - DNA, 25 bp, Homo sapien
ccctacctacttggatgaatattaa

SEQ ID NO: 638900 - DNA, 25 bp, Homo sapien
aaagttctccagaatgtctgggagg

SEQ ID NO: 638901 - DNA, 25 bp, Homo sapien
cacctgctgttaccgcggcctggaa

SEQ ID NO: 638902 - DNA, 25 bp, Homo sapien
tgaaaccctgtgactcccacttagt

SEQ ID NO: 638903 - DNA, 25 bp, Homo sapien
tgactcccacttagtgaggcgacca

SEQ ID NO: 638904 - DNA, 25 bp, Homo sapien
gaggcgaccacctattgaaaaccgt

SEQ ID NO: 638905 - DNA, 25 bp, Homo sapien
cttcctatacagatgctcctgtcat

SEQ ID NO: 638906 - DNA, 25 bp, Homo sapien
ggttagattccccatcatcccatca

SEQ ID NO: 638907 - DNA, 25 bp, Homo sapien
tcatcccatcataggttaaagcatt

SEQ ID NO: 638908 - DNA, 25 bp, Homo sapien
tttatccggatgtaaccccatctgt

SEQ ID NO: 638909 - DNA, 25 bp, Homo sapien
taaccccatctgtaagcggaggagt

SEQ ID NO: 638910 - DNA, 25 bp, Homo sapien
gtgtatggcgtttgtaccatggcaa

SEQ ID NO: 638911 - DNA, 25 bp, Homo sapien
gcgtttgtaccatggcaaagccaaa

SEQ ID NO: 638912 - DNA, 25 bp, Homo sapien
acttacttgaggccaagttcagtaa

SEQ ID NO: 638913 - DNA, 25 bp, Homo sapien
gccaagttcagtaacaaagtattgt

SEQ ID NO: 638914 - DNA, 25 bp, Homo sapien
cagtaacaaagtattgtgaccccta

SEQ ID NO: 638915 - DNA, 25 bp, Homo sapien
tgtgacccctaaaattgaaagccct

SEQ ID NO: 638916 - DNA, 25 bp, Homo sapien
tgaaagccctttagaggttctttgt

SEQ ID NO: 638917 - DNA, 25 bp, Homo sapien
agccctttagaggttctttgtaatg

SEQ ID NO: 638918 - DNA, 25 bp, Homo sapien
ctttagaggttctttgtaatggtat

SEQ ID NO: 638919 - DNA, 25 bp, Homo sapien
gttattaccttataaataggcgttg

SEQ ID NO: 638920 - DNA, 25 bp, Homo sapien
taccttataaataggcgttgtaact

SEQ ID NO: 638921 - DNA, 25 bp, Homo sapien
aatgtaaaatttgtgttctgtcttt

SEQ ID NO: 638922 - DNA, 25 bp, Homo sapien
tgaatataacatctcttaatttatt

SEQ ID NO: 638923 - DNA, 25 bp, Homo sapien
aaagcccttgtgcaccatcttgaac

SEQ ID NO: 638924 - DNA, 25 bp, Homo sapien
tgtgcaccatcttgaactttacctt

SEQ ID NO: 638925 - DNA, 25 bp, Homo sapien
ttgaactttaccttgaatgcaatgg

SEQ ID NO: 638926 - DNA, 25 bp, Homo sapien
gagagctgtgaaagggctttaagca

SEQ ID NO: 638927 - DNA, 25 bp, Homo sapien
ggctttaagcaaggcccaggcctca

SEQ ID NO: 638928 - DNA, 25 bp, Homo sapien
aggcctcactgaatctgtggtttag

SEQ ID NO: 638929 - DNA, 25 bp, Homo sapien
gtggtttagaaagaactctctggtt

SEQ ID NO: 638930 - DNA, 25 bp, Homo sapien
gaactctctggttacaagatggagc

SEQ ID NO: 638931 - DNA, 25 bp, Homo sapien
agcatggatgcaagcgaggttagaa

SEQ ID NO: 638932 - DNA, 25 bp, Homo sapien
aaatgaggactcttgactgtaagga

SEQ ID NO: 638933 - DNA, 25 bp, Homo sapien
gaaccaagtgtaacttcatccaagt

SEQ ID NO: 638934 - DNA, 25 bp, Homo sapien
atattcctaactttgaaggctacaa

SEQ ID NO: 638935 - DNA, 25 bp, Homo sapien
atatttgctttgtacacttaagacc

SEQ ID NO: 638936 - DNA, 25 bp, Homo sapien
ttgctttgtacacttaagaccttac

SEQ ID NO: 638937 - DNA, 25 bp, Homo sapien
gtacacttaagaccttacattttgg

SEQ ID NO: 638938 - DNA, 25 bp, Homo sapien
cacttaagaccttacattttgggag

SEQ ID NO: 638939 - DNA, 25 bp, Homo sapien
gggaggttttcatggtacgattgca

SEQ ID NO: 638940 - DNA, 25 bp, Homo sapien
ggttttcatggtacgattgcagact

SEQ ID NO: 638941 - DNA, 25 bp, Homo sapien
ttcatggtacgattgcagactatat

SEQ ID NO: 638942 - DNA, 25 bp, Homo sapien
ggtacgattgcagactatatattcc

SEQ ID NO: 638943 - DNA, 25 bp, Homo sapien
gattgcagactatatattcctaact

SEQ ID NO: 638944 - DNA, 25 bp, Homo sapien
gcagactatatattcctaactttga

SEQ ID NO: 638945 - DNA, 25 bp, Homo sapien
gaacaggctttgaagaagagatggt

SEQ ID NO: 638946 - DNA, 25 bp, Homo sapien
ggtgtttgagcaatattttctacaa

SEQ ID NO: 638947 - DNA, 25 bp, Homo sapien
ttttctacaagtaaaagtgcctgaa

SEQ ID NO: 638948 - DNA, 25 bp, Homo sapien
gaaaatacccgatgtgtgcttgcag

SEQ ID NO: 638949 - DNA, 25 bp, Homo sapien
aatacccgatgtgtgcttgcaggaa

SEQ ID NO: 638950 - DNA, 25 bp, Homo sapien
cccgatgtgtgcttgcaggaaggtt

SEQ ID NO: 638951 - DNA, 25 bp, Homo sapien
gcttgcaggaaggttagagtgaaaa

SEQ ID NO: 638952 - DNA, 25 bp, Homo sapien
gaaaatccaattattgtggctgaat

SEQ ID NO: 638953 - DNA, 25 bp, Homo sapien
gtggctgaatatattgagcaggaca

SEQ ID NO: 638954 - DNA, 25 bp, Homo sapien
gggcaaaggctaaagatgaagctac

SEQ ID NO: 638955 - DNA, 25 bp, Homo sapien
gacaaacacatgacagcaacattca

SEQ ID NO: 638956 - DNA, 25 bp, Homo sapien
aagagatcatgcatcagtctagcct

SEQ ID NO: 638957 - DNA, 25 bp, Homo sapien
atcagtctagcctgcattaaagata

SEQ ID NO: 638958 - DNA, 25 bp, Homo sapien
ctaatctctcataatctgttgtggg

SEQ ID NO: 638959 - DNA, 25 bp, Homo sapien
gaaagaccatgcttctgacagtact

SEQ ID NO: 638960 - DNA, 25 bp, Homo sapien
gacagtactgttgattccggaggca

SEQ ID NO: 638961 - DNA, 25 bp, Homo sapien
ggacacttcagccatccaggtaaag

SEQ ID NO: 638962 - DNA, 25 bp, Homo sapien
taaagagaacagcaggtcctggact

SEQ ID NO: 638963 - DNA, 25 bp, Homo sapien
gcaggtcctggactaaagcagaaaa

SEQ ID NO: 638964 - DNA, 25 bp, Homo sapien
atggtccaatcaaacatcaacgaag

SEQ ID NO: 638965 - DNA, 25 bp, Homo sapien
agcttctgaagtcattttcctgttc

SEQ ID NO: 638966 - DNA, 25 bp, Homo sapien
ttcctgttcttggtactgtttcctc

SEQ ID NO: 638967 - DNA, 25 bp, Homo sapien
actttggccttcagtattgtataaa

SEQ ID NO: 638968 - DNA, 25 bp, Homo sapien
acctatgaagtctgtagtagtatac

SEQ ID NO: 638969 - DNA, 25 bp, Homo sapien
gtagtatacagatgctctaatagtt

SEQ ID NO: 638970 - DNA, 25 bp, Homo sapien
ttagttcctgtctctcattgggtag

SEQ ID NO: 638971 - DNA, 25 bp, Homo sapien
tctctcattgggtaggtagacagat

SEQ ID NO: 638972 - DNA, 25 bp, Homo sapien
gagattaacctacatgaaactgcaa

SEQ ID NO: 638973 - DNA, 25 bp, Homo sapien
tccaagttccctattaggttaagcg

SEQ ID NO: 638974 - DNA, 25 bp, Homo sapien
ttaagcgaataaactatctctgacg

SEQ ID NO: 638975 - DNA, 25 bp, Homo sapien
aaactatctctgacgttgcttcaca

SEQ ID NO: 638976 - DNA, 25 bp, Homo sapien
tctgacgttgcttcacatatcctac

SEQ ID NO: 638977 - DNA, 25 bp, Homo sapien
acatatcctactttggccttcagta

SEQ ID NO: 638978 - DNA, 25 bp, Homo sapien
agaaatgtccaagaacattctcttg

SEQ ID NO: 638979 - DNA, 25 bp, Homo sapien
gaacattctcttggggtttggatca

SEQ ID NO: 638980 - DNA, 25 bp, Homo sapien
ctggtaacatcttcctgatgaatcc

SEQ ID NO: 638981 - DNA, 25 bp, Homo sapien
gtaacatcttcctgatgaatcccaa

SEQ ID NO: 638982 - DNA, 25 bp, Homo sapien
acatcttcctgatgaatcccaaaga

SEQ ID NO: 638983 - DNA, 25 bp, Homo sapien
ttcctgatgaatcccaaagaagtga

SEQ ID NO: 638984 - DNA, 25 bp, Homo sapien
gaatcccaaagaagtgatactgagg

SEQ ID NO: 638985 - DNA, 25 bp, Homo sapien
gaaaactttcaagttacttacagct

SEQ ID NO: 638986 - DNA, 25 bp, Homo sapien
tttcaagttacttacagcttttatc

SEQ ID NO: 638987 - DNA, 25 bp, Homo sapien
atcaattgagtaaagtctattcctg

SEQ ID NO: 638988 - DNA, 25 bp, Homo sapien
ttgagtaaagtctattcctgtgacc

SEQ ID NO: 638989 - DNA, 25 bp, Homo sapien
catgcagtttgaaatgcagcagagt

SEQ ID NO: 638990 - DNA, 25 bp, Homo sapien
cagtttgaaatgcagcagagtggtc

SEQ ID NO: 638991 - DNA, 25 bp, Homo sapien
gtttgaaatgcagcagagtggtcga

SEQ ID NO: 638992 - DNA, 25 bp, Homo sapien
ttgaaatgcagcagagtggtcgagc

SEQ ID NO: 638993 - DNA, 25 bp, Homo sapien
aaatgcagcagagtggtcgagcgcg

SEQ ID NO: 638994 - DNA, 25 bp, Homo sapien
atgcagcagagtggtcgagcgcggt

SEQ ID NO: 638995 - DNA, 25 bp, Homo sapien
tgcagcagagtggtcgagcgcggtg

SEQ ID NO: 638996 - DNA, 25 bp, Homo sapien
gcagcagagtggtcgagcgcggtgg

SEQ ID NO: 638997 - DNA, 25 bp, Homo sapien
tgtggtctcacctacttggagggct

SEQ ID NO: 638998 - DNA, 25 bp, Homo sapien
ggtctcacctacttggagggctgag

SEQ ID NO: 638999 - DNA, 25 bp, Homo sapien
ggcggggagtggcttggacctggga

SEQ ID NO: 639000 - DNA, 25 bp, Homo sapien
cccaatcttttctttcttgtgcatt

SEQ ID NO: 639001 - DNA, 25 bp, Homo sapien
tttctttcttgtgcattattacatt

SEQ ID NO: 639002 - DNA, 25 bp, Homo sapien
tattacatttactcatacctccagg

SEQ ID NO: 639003 - DNA, 25 bp, Homo sapien
ttacatttactcatacctccaggac

SEQ ID NO: 639004 - DNA, 25 bp, Homo sapien
acatttactcatacctccaggacaa

SEQ ID NO: 639005 - DNA, 25 bp, Homo sapien
tactcatacctccaggacaatgttg

SEQ ID NO: 639006 - DNA, 25 bp, Homo sapien
atacctccaggacaatgttgaagag

SEQ ID NO: 639007 - DNA, 25 bp, Homo sapien
taaagaactgcctgtattagcctag

SEQ ID NO: 639008 - DNA, 25 bp, Homo sapien
agaactgcctgtattagcctagcat

SEQ ID NO: 639009 - DNA, 25 bp, Homo sapien
aactgcctgtattagcctagcatgg

SEQ ID NO: 639010 - DNA, 25 bp, Homo sapien
agctatgcaagaggctgagacgaga

SEQ ID NO: 639011 - DNA, 25 bp, Homo sapien
tggcgcagtcggtttaataatgata

SEQ ID NO: 639012 - DNA, 25 bp, Homo sapien
agtttaagcatttagttgtattgcc

SEQ ID NO: 639013 - DNA, 25 bp, Homo sapien
gtttaagcatttagttgtattgccc

SEQ ID NO: 639014 - DNA, 25 bp, Homo sapien
tttaagcatttagttgtattgccct

SEQ ID NO: 639015 - DNA, 25 bp, Homo sapien
ttaagcatttagttgtattgccctg

SEQ ID NO: 639016 - DNA, 25 bp, Homo sapien
taagcatttagttgtattgccctgt

SEQ ID NO: 639017 - DNA, 25 bp, Homo sapien
aagcatttagttgtattgccctgtt

SEQ ID NO: 639018 - DNA, 25 bp, Homo sapien
agcatttagttgtattgccctgtta

SEQ ID NO: 639019 - DNA, 25 bp, Homo sapien
gcatttagttgtattgccctgttaa

SEQ ID NO: 639020 - DNA, 25 bp, Homo sapien
catttagttgtattgccctgttaag

SEQ ID NO: 639021 - DNA, 25 bp, Homo sapien
atttagttgtattgccctgttaagt

SEQ ID NO: 639022 - DNA, 25 bp, Homo sapien
aggcggaccaggacatgtagagcaa

SEQ ID NO: 639023 - DNA, 25 bp, Homo sapien
aagagcagcaccacgaaggcagcca

SEQ ID NO: 639024 - DNA, 25 bp, Homo sapien
aggctcacccagaatgcgatcacga

SEQ ID NO: 639025 - DNA, 25 bp, Homo sapien
tgcgatcacgatggaatctgcggga

SEQ ID NO: 639026 - DNA, 25 bp, Homo sapien
gagatgcatctcagcgctgggttat

SEQ ID NO: 639027 - DNA, 25 bp, Homo sapien
tctcagcgctgggttatgtcaacat

SEQ ID NO: 639028 - DNA, 25 bp, Homo sapien
tatgtcaacataaagcaacgctgag

SEQ ID NO: 639029 - DNA, 25 bp, Homo sapien
tattgtggaatgagggccctgagtt

SEQ ID NO: 639030 - DNA, 25 bp, Homo sapien
atgagggccctgagtttcggttgtc

SEQ ID NO: 639031 - DNA, 25 bp, Homo sapien
tgagtttcggttgtcctccagcctc

SEQ ID NO: 639032 - DNA, 25 bp, Homo sapien
ggaagatctcccattaacaataact

SEQ ID NO: 639033 - DNA, 25 bp, Homo sapien
aagggagcacacttgttttgggaat

SEQ ID NO: 639034 - DNA, 25 bp, Homo sapien
caagggctggctgcactgtgaatgt

SEQ ID NO: 639035 - DNA, 25 bp, Homo sapien
tgtgaatgtgttttgctgctccagc

SEQ ID NO: 639036 - DNA, 25 bp, Homo sapien
ttcttatggccccagatttctgatc

SEQ ID NO: 639037 - DNA, 25 bp, Homo sapien
tctgatcatattctgcatccttggc

SEQ ID NO: 639038 - DNA, 25 bp, Homo sapien
gcatccttggctaattctctcagga

SEQ ID NO: 639039 - DNA, 25 bp, Homo sapien
gatcaagaaaggtctcttctcacca

SEQ ID NO: 639040 - DNA, 25 bp, Homo sapien
ggtctcttctcaccagtgctataat

SEQ ID NO: 639041 - DNA, 25 bp, Homo sapien
gtgctataatccacctgaaaagctg

SEQ ID NO: 639042 - DNA, 25 bp, Homo sapien
tgaaaagctgtagccacttgcacta

SEQ ID NO: 639043 - DNA, 25 bp, Homo sapien
gccacttgcactactaaaaccagtc

SEQ ID NO: 639044 - DNA, 25 bp, Homo sapien
taggagcgcaaaccctatgtgaact

SEQ ID NO: 639045 - DNA, 25 bp, Homo sapien
gaactgcacacaagaaggatctagg

SEQ ID NO: 639046 - DNA, 25 bp, Homo sapien
aagaaggatctaggttgcgtgctcc

SEQ ID NO: 639047 - DNA, 25 bp, Homo sapien
ggtggaagtttcatcccaaaaccat

SEQ ID NO: 639048 - DNA, 25 bp, Homo sapien
cccaacccttctgatctgtggaaag

SEQ ID NO: 639049 - DNA, 25 bp, Homo sapien
gatctgtggaaagattgtcttctct

SEQ ID NO: 639050 - DNA, 25 bp, Homo sapien
tggaaagattgtcttctctgaggct

SEQ ID NO: 639051 - DNA, 25 bp, Homo sapien
aagattgtcttctctgaggctgggc

SEQ ID NO: 639052 - DNA, 25 bp, Homo sapien
gattgtcttctctgaggctgggcac

SEQ ID NO: 639053 - DNA, 25 bp, Homo sapien
ggctcgcgcctgtaacgcccaatgc

SEQ ID NO: 639054 - DNA, 25 bp, Homo sapien
acgcccaatgctttgagagttcaag

SEQ ID NO: 639055 - DNA, 25 bp, Homo sapien
ggaaacaactcctccagtccttcag

SEQ ID NO: 639056 - DNA, 25 bp, Homo sapien
agtccttcagactacagctctgttg

SEQ ID NO: 639057 - DNA, 25 bp, Homo sapien
tcagactacagctctgttgtccctt

SEQ ID NO: 639058 - DNA, 25 bp, Homo sapien
tgactagtcacatccctttattctc

SEQ ID NO: 639059 - DNA, 25 bp, Homo sapien
tttattctcactcataaccccaact

SEQ ID NO: 639060 - DNA, 25 bp, Homo sapien
ataaccccaactgctgagtacagat

SEQ ID NO: 639061 - DNA, 25 bp, Homo sapien
tgctgagtacagatctggcacatag

SEQ ID NO: 639062 - DNA, 25 bp, Homo sapien
gtaggctctcaataattgctgactg

SEQ ID NO: 639063 - DNA, 25 bp, Homo sapien
ctaaccttaggtgagtgacttctga

SEQ ID NO: 639064 - DNA, 25 bp, Homo sapien
ggtgagtgacttctgagcctctatt

SEQ ID NO: 639065 - DNA, 25 bp, Homo sapien
agttgctacctagcaggaatgctat

SEQ ID NO: 639066 - DNA, 25 bp, Homo sapien
caccacactcgccaatcaattgtat

SEQ ID NO: 639067 - DNA, 25 bp, Homo sapien
cacactcgccaatcaattgtatttc

SEQ ID NO: 639068 - DNA, 25 bp, Homo sapien
ctaagaactaacaacaaaccatatt

SEQ ID NO: 639069 - DNA, 25 bp, Homo sapien
tgattacaatatcatgtacaacagc

SEQ ID NO: 639070 - DNA, 25 bp, Homo sapien
gaaatacttagacatagttttaaca

SEQ ID NO: 639071 - DNA, 25 bp, Homo sapien
aatatgtgcaagatctttatatgaa

SEQ ID NO: 639072 - DNA, 25 bp, Homo sapien
tgtttctttctgctcaaattgattt

SEQ ID NO: 639073 - DNA, 25 bp, Homo sapien
tgatttttggattccgtgcaacccc

SEQ ID NO: 639074 - DNA, 25 bp, Homo sapien
tttttggattccgtgcaaccccagt

SEQ ID NO: 639075 - DNA, 25 bp, Homo sapien
ttggattccgtgcaaccccagtgaa

SEQ ID NO: 639076 - DNA, 25 bp, Homo sapien
gattccgtgcaaccccagtgaaaaa

SEQ ID NO: 639077 - DNA, 25 bp, Homo sapien
aacaaaaacaccacagaattagctg

SEQ ID NO: 639078 - DNA, 25 bp, Homo sapien
aaaacaccacagaattagctggatg

SEQ ID NO: 639079 - DNA, 25 bp, Homo sapien
aacaccacagaattagctggatgcc

SEQ ID NO: 639080 - DNA, 25 bp, Homo sapien
caccacagaattagctggatgccgt

SEQ ID NO: 639081 - DNA, 25 bp, Homo sapien
accacagaattagctggatgccgtg

SEQ ID NO: 639082 - DNA, 25 bp, Homo sapien
cacagaattagctggatgccgtggc

SEQ ID NO: 639083 - DNA, 25 bp, Homo sapien
acagaattagctggatgccgtggct

SEQ ID NO: 639084 - DNA, 25 bp, Homo sapien
cagaattagctggatgccgtggctc

SEQ ID NO: 639085 - DNA, 25 bp, Homo sapien
agaattagctggatgccgtggctca

SEQ ID NO: 639086 - DNA, 25 bp, Homo sapien
gaattagctggatgccgtggctcac

SEQ ID NO: 639087 - DNA, 25 bp, Homo sapien
aattagctggatgccgtggctcaca

SEQ ID NO: 639088 - DNA, 25 bp, Homo sapien
aaaggagacctctgattccaaggac

SEQ ID NO: 639089 - DNA, 25 bp, Homo sapien
agacctctgattccaaggactcgtt

SEQ ID NO: 639090 - DNA, 25 bp, Homo sapien
gattccaaggactcgttcaaaagat

SEQ ID NO: 639091 - DNA, 25 bp, Homo sapien
ccaaggactcgttcaaaagatgctg

SEQ ID NO: 639092 - DNA, 25 bp, Homo sapien
aaaagatgctgagaccgaggcttaa

SEQ ID NO: 639093 - DNA, 25 bp, Homo sapien
tgctgagaccgaggcttaagcttca

SEQ ID NO: 639094 - DNA, 25 bp, Homo sapien
tgagaccgaggcttaagcttcaggg

SEQ ID NO: 639095 - DNA, 25 bp, Homo sapien
tgctggccggagacggtagcgctgc

SEQ ID NO: 639096 - DNA, 25 bp, Homo sapien
tgccccagccgctcagtgcttatgg

SEQ ID NO: 639097 - DNA, 25 bp, Homo sapien
ggaagaagaggtcgctgaggccccg

SEQ ID NO: 639098 - DNA, 25 bp, Homo sapien
cccaggcagtatactgtggagaatg

SEQ ID NO: 639099 - DNA, 25 bp, Homo sapien
aacggaggcccagaaagcagaaatg

SEQ ID NO: 639100 - DNA, 25 bp, Homo sapien
gaggcccagaaagcagaaatgatgt

SEQ ID NO: 639101 - DNA, 25 bp, Homo sapien
gaaatgatgtgttaagatcactcat

SEQ ID NO: 639102 - DNA, 25 bp, Homo sapien
gttaagatcactcatcaagctgatg

SEQ ID NO: 639103 - DNA, 25 bp, Homo sapien
catcaagctgatggtacagaggtta

SEQ ID NO: 639104 - DNA, 25 bp, Homo sapien
tggtacagaggttagagcctctgct

SEQ ID NO: 639105 - DNA, 25 bp, Homo sapien
gcctgtctcttccaatgggtcggca

SEQ ID NO: 639106 - DNA, 25 bp, Homo sapien
gtctcttccaatgggtcggcatcca

SEQ ID NO: 639107 - DNA, 25 bp, Homo sapien
caatgggtcggcatccaccctgaca

SEQ ID NO: 639108 - DNA, 25 bp, Homo sapien
tccaccctgacacattaaagccaaa

SEQ ID NO: 639109 - DNA, 25 bp, Homo sapien
gaaggggctccagaactttagtgaa

SEQ ID NO: 639110 - DNA, 25 bp, Homo sapien
gcggattgcacgcaaggtgaaacaa

SEQ ID NO: 639111 - DNA, 25 bp, Homo sapien
cggattgcacgcaaggtgaaacaag

SEQ ID NO: 639112 - DNA, 25 bp, Homo sapien
gattgcacgcaaggtgaaacaaggt

SEQ ID NO: 639113 - DNA, 25 bp, Homo sapien
ttgcacgcaaggtgaaacaaggtat

SEQ ID NO: 639114 - DNA, 25 bp, Homo sapien
gcacgcaaggtgaaacaaggtattt

SEQ ID NO: 639115 - DNA, 25 bp, Homo sapien
cacgcaaggtgaaacaaggtattta

SEQ ID NO: 639116 - DNA, 25 bp, Homo sapien
cgcaaggtgaaacaaggtatttaag

SEQ ID NO: 639117 - DNA, 25 bp, Homo sapien
ggtgaaacaaggtatttaagggctg

SEQ ID NO: 639118 - DNA, 25 bp, Homo sapien
tgaaacaaggtatttaagggctggg

SEQ ID NO: 639119 - DNA, 25 bp, Homo sapien
cctaggaagttgaggctgtgattgt

SEQ ID NO: 639120 - DNA, 25 bp, Homo sapien
aggaagttgaggctgtgattgtgcc

SEQ ID NO: 639121 - DNA, 25 bp, Homo sapien
taggagcgcaaaccctatgtgaact

SEQ ID NO: 639122 - DNA, 25 bp, Homo sapien
gaactgcacacaagaaggatctagg

SEQ ID NO: 639123 - DNA, 25 bp, Homo sapien
actgcacacaagaaggatctaggtt

SEQ ID NO: 639124 - DNA, 25 bp, Homo sapien
caagaaggatctaggttgcgtgctc

SEQ ID NO: 639125 - DNA, 25 bp, Homo sapien
aagaaggatctaggttgcgtgctcc

SEQ ID NO: 639126 - DNA, 25 bp, Homo sapien
cccaacccttctgatctgtggaaag

SEQ ID NO: 639127 - DNA, 25 bp, Homo sapien
gatctgtggaaagattgtcttctct

SEQ ID NO: 639128 - DNA, 25 bp, Homo sapien
ctgtggaaagattgtcttctctgag

SEQ ID NO: 639129 - DNA, 25 bp, Homo sapien
tggaaagattgtcttctctgaggct

SEQ ID NO: 639130 - DNA, 25 bp, Homo sapien
ggctcgcgcctgtaacgcccaatgc

SEQ ID NO: 639131 - DNA, 25 bp, Homo sapien
acgcccaatgctttgagagttcaag

SEQ ID NO: 639132 - DNA, 25 bp, Homo sapien
gaggaagattacagactgcagggat

SEQ ID NO: 639133 - DNA, 25 bp, Homo sapien
gattacagactgcagggatgagcaa

SEQ ID NO: 639134 - DNA, 25 bp, Homo sapien
tgcagggatgagcaaataccatttc

SEQ ID NO: 639135 - DNA, 25 bp, Homo sapien
tcccaggatttcctgaagtttttct

SEQ ID NO: 639136 - DNA, 25 bp, Homo sapien
aagcccaaatctgcctctttctggg

SEQ ID NO: 639137 - DNA, 25 bp, Homo sapien
gaagacagagatcctagaaaaagca

SEQ ID NO: 639138 - DNA, 25 bp, Homo sapien
aaaccgccagggaacagaactcttg

SEQ ID NO: 639139 - DNA, 25 bp, Homo sapien
agaactcttggtccaggaggcgcaa

SEQ ID NO: 639140 - DNA, 25 bp, Homo sapien
gtccaggaggcgcaaaccacaagtg

SEQ ID NO: 639141 - DNA, 25 bp, Homo sapien
ggaggcgcaaaccacaagtgcaatt

SEQ ID NO: 639142 - DNA, 25 bp, Homo sapien
aaaccacaagtgcaattagtcaaaa

SEQ ID NO: 639143 - DNA, 25 bp, Homo sapien
tgttcaggaggctacccctcttggg

SEQ ID NO: 639144 - DNA, 25 bp, Homo sapien
ttcaggaggctacccctcttgggtt

SEQ ID NO: 639145 - DNA, 25 bp, Homo sapien
aataaacctgtccttaattgtcaag

SEQ ID NO: 639146 - DNA, 25 bp, Homo sapien
aattgtcaagacaccgttcatgttt

SEQ ID NO: 639147 - DNA, 25 bp, Homo sapien
aagacaccgttcatgtttctttcct

SEQ ID NO: 639148 - DNA, 25 bp, Homo sapien
gacaccgttcatgtttctttcctct

SEQ ID NO: 639149 - DNA, 25 bp, Homo sapien
gtaacatctcttcaaatatgcgcac

SEQ ID NO: 639150 - DNA, 25 bp, Homo sapien
atctcttcaaatatgcgcacttcta

SEQ ID NO: 639151 - DNA, 25 bp, Homo sapien
aaatatgcgcacttctattcacaat

SEQ ID NO: 639152 - DNA, 25 bp, Homo sapien
atatgcgcacttctattcacaatag

SEQ ID NO: 639153 - DNA, 25 bp, Homo sapien
tgcgcacttctattcacaatagtat

SEQ ID NO: 639154 - DNA, 25 bp, Homo sapien
acttttatatgactggtatcacagt

SEQ ID NO: 639155 - DNA, 25 bp, Homo sapien
tgactggtatcacagtaggtttgtt

SEQ ID NO: 639156 - DNA, 25 bp, Homo sapien
cacgtgagtaatatgttgcactgac

SEQ ID NO: 639157 - DNA, 25 bp, Homo sapien
gagtaatatgttgcactgacacatt

SEQ ID NO: 639158 - DNA, 25 bp, Homo sapien
gttgcactgacacattataatgggt

SEQ ID NO: 639159 - DNA, 25 bp, Homo sapien
ataatgggtatgacatcactaggta

SEQ ID NO: 639160 - DNA, 25 bp, Homo sapien
gggtatgacatcactaggtagtaga

SEQ ID NO: 639161 - DNA, 25 bp, Homo sapien
taattattatcttggctgttgtggt

SEQ ID NO: 639162 - DNA, 25 bp, Homo sapien
attatcttggctgttgtggtggctc

SEQ ID NO: 639163 - DNA, 25 bp, Homo sapien
ggagtttaaaatgagcatggcaaca

SEQ ID NO: 639164 - DNA, 25 bp, Homo sapien
aaatgagcatggcaacatagggaga

SEQ ID NO: 639165 - DNA, 25 bp, Homo sapien
gtattatcgttttcatttcaaactg

SEQ ID NO: 639166 - DNA, 25 bp, Homo sapien
tattatcgttttcatttcaaactgg

SEQ ID NO: 639167 - DNA, 25 bp, Homo sapien
attatcgttttcatttcaaactggg

SEQ ID NO: 639168 - DNA, 25 bp, Homo sapien
ttatcgttttcatttcaaactgggg

SEQ ID NO: 639169 - DNA, 25 bp, Homo sapien
tatcgttttcatttcaaactggggc

SEQ ID NO: 639170 - DNA, 25 bp, Homo sapien
atcgttttcatttcaaactggggct

SEQ ID NO: 639171 - DNA, 25 bp, Homo sapien
tcgttttcatttcaaactggggcta

SEQ ID NO: 639172 - DNA, 25 bp, Homo sapien
ttttcatttcaaactggggctactg

SEQ ID NO: 639173 - DNA, 25 bp, Homo sapien
tttcatttcaaactggggctactgg

SEQ ID NO: 639174 - DNA, 25 bp, Homo sapien
ttcatttcaaactggggctactggc

SEQ ID NO: 639175 - DNA, 25 bp, Homo sapien
tcatttcaaactggggctactggct

SEQ ID NO: 639176 - DNA, 25 bp, Homo sapien
gttttctgtctaaagactcactttt

SEQ ID NO: 639177 - DNA, 25 bp, Homo sapien
aacatgggagtgattgacattggaa

SEQ ID NO: 639178 - DNA, 25 bp, Homo sapien
aagatttcttacttccaggcaagcc

SEQ ID NO: 639179 - DNA, 25 bp, Homo sapien
tttcttacttccaggcaagccccat

SEQ ID NO: 639180 - DNA, 25 bp, Homo sapien
gaatggcgttcctttgatctcaaca

SEQ ID NO: 639181 - DNA, 25 bp, Homo sapien
tggcgttcctttgatctcaacaaga

SEQ ID NO: 639182 - DNA, 25 bp, Homo sapien
gatctcaacaagacaagcatatcag

SEQ ID NO: 639183 - DNA, 25 bp, Homo sapien
aacatcttaataattcatctgagtg

SEQ ID NO: 639184 - DNA, 25 bp, Homo sapien
catctgagtgatgcatacataatgt

SEQ ID NO: 639185 - DNA, 25 bp, Homo sapien
aaaagggttgctacatccctagctc

SEQ ID NO: 639186 - DNA, 25 bp, Homo sapien
gttgctacatccctagctccaagca

SEQ ID NO: 639187 - DNA, 25 bp, Homo sapien
gggaggcttcgtggcagggctacgc

SEQ ID NO: 639188 - DNA, 25 bp, Homo sapien
aggcttcgtggcagggctacgccgt

SEQ ID NO: 639189 - DNA, 25 bp, Homo sapien
gtggcagggctacgccgtggaaggc

SEQ ID NO: 639190 - DNA, 25 bp, Homo sapien
cgtggaaggcccgtggtcctcggag

SEQ ID NO: 639191 - DNA, 25 bp, Homo sapien
ggaaggcccgtggtcctcggaggag

SEQ ID NO: 639192 - DNA, 25 bp, Homo sapien
cgtggtcctcggaggagcctcacga

SEQ ID NO: 639193 - DNA, 25 bp, Homo sapien
tggtcctcggaggagcctcacgagc

SEQ ID NO: 639194 - DNA, 25 bp, Homo sapien
ggtcctcggaggagcctcacgagcc

SEQ ID NO: 639195 - DNA, 25 bp, Homo sapien
ctcggaggagcctcacgagccaagg

SEQ ID NO: 639196 - DNA, 25 bp, Homo sapien
cggaggagcctcacgagccaaggct

SEQ ID NO: 639197 - DNA, 25 bp, Homo sapien
cctcacgagccaaggctgggaagga

SEQ ID NO: 639198 - DNA, 25 bp, Homo sapien
tcctggtctgtaaacttttgaaaat

SEQ ID NO: 639199 - DNA, 25 bp, Homo sapien
gttcaattttattctcagtgtctag

SEQ ID NO: 639200 - DNA, 25 bp, Homo sapien
ttttattctcagtgtctagcagctc

SEQ ID NO: 639201 - DNA, 25 bp, Homo sapien
gaatgcacaagtcagttataaagtc

SEQ ID NO: 639202 - DNA, 25 bp, Homo sapien
ataatatttgcatttctgcctttct

SEQ ID NO: 639203 - DNA, 25 bp, Homo sapien
tttctgcctttctatattaaatact

SEQ ID NO: 639204 - DNA, 25 bp, Homo sapien
attaaatactttgttgggcatagca

SEQ ID NO: 639205 - DNA, 25 bp, Homo sapien
tgaactcctcaccacgcatgtttac

SEQ ID NO: 639206 - DNA, 25 bp, Homo sapien
atgtttaccatatgccctgatacca

SEQ ID NO: 639207 - DNA, 25 bp, Homo sapien
tgataccaagccttctttctcatgg

SEQ ID NO: 639208 - DNA, 25 bp, Homo sapien
agtacaggaagtgtcctgacacagt

SEQ ID NO: 639209 - DNA, 25 bp, Homo sapien
gctgtttgtttcaagcccagagcta

SEQ ID NO: 639210 - DNA, 25 bp, Homo sapien
tttcaagcccagagctatgagcctg

SEQ ID NO: 639211 - DNA, 25 bp, Homo sapien
agagctatgagcctgactctcagca

SEQ ID NO: 639212 - DNA, 25 bp, Homo sapien
gagatggtcagataaagggttacaa

SEQ ID NO: 639213 - DNA, 25 bp, Homo sapien
gaaaatatttctacgtcccaattag

SEQ ID NO: 639214 - DNA, 25 bp, Homo sapien
tacgtcccaattagagccctggttt

SEQ ID NO: 639215 - DNA, 25 bp, Homo sapien
caattagagccctggttttaagcaa

SEQ ID NO: 639216 - DNA, 25 bp, Homo sapien
gcaatgcttgatgctgtcaatgaga

SEQ ID NO: 639217 - DNA, 25 bp, Homo sapien
caatgagactctggtataatcagta

SEQ ID NO: 639218 - DNA, 25 bp, Homo sapien
gtaaatgatgtggagtgtcttctta

SEQ ID NO: 639219 - DNA, 25 bp, Homo sapien
ggattttgaccttattacatatgaa

SEQ ID NO: 639220 - DNA, 25 bp, Homo sapien
gggagaatctttcaacgcttacaat

SEQ ID NO: 639221 - DNA, 25 bp, Homo sapien
ggagaatctttcaacgcttacaatc

SEQ ID NO: 639222 - DNA, 25 bp, Homo sapien
gagaatctttcaacgcttacaatcc

SEQ ID NO: 639223 - DNA, 25 bp, Homo sapien
agaatctttcaacgcttacaatccc

SEQ ID NO: 639224 - DNA, 25 bp, Homo sapien
gaatctttcaacgcttacaatccca

SEQ ID NO: 639225 - DNA, 25 bp, Homo sapien
aatctttcaacgcttacaatcccag

SEQ ID NO: 639226 - DNA, 25 bp, Homo sapien
atctttcaacgcttacaatcccagc

SEQ ID NO: 639227 - DNA, 25 bp, Homo sapien
tctttcaacgcttacaatcccagca

SEQ ID NO: 639228 - DNA, 25 bp, Homo sapien
tttcaacgcttacaatcccagcact

SEQ ID NO: 639229 - DNA, 25 bp, Homo sapien
agatcgcgaccatccagaccaacat

SEQ ID NO: 639230 - DNA, 25 bp, Homo sapien
atcgcgaccatccagaccaacatgg

SEQ ID NO: 639231 - DNA, 25 bp, Homo sapien
gagggccttgcagatttcagaaatg

SEQ ID NO: 639232 - DNA, 25 bp, Homo sapien
agaaatgaagtgacctgccttgagt

SEQ ID NO: 639233 - DNA, 25 bp, Homo sapien
aagtgacctgccttgagtcttccct

SEQ ID NO: 639234 - DNA, 25 bp, Homo sapien
ctcactccactgtagtctcaggaga

SEQ ID NO: 639235 - DNA, 25 bp, Homo sapien
attaccacttcagcgctgacctgtg

SEQ ID NO: 639236 - DNA, 25 bp, Homo sapien
gctgacctgtggcttgagaatctaa

SEQ ID NO: 639237 - DNA, 25 bp, Homo sapien
gagaatctaatctgtgtgcaccgtg

SEQ ID NO: 639238 - DNA, 25 bp, Homo sapien
gtgcaccgtggcaaagtcttggttt

SEQ ID NO: 639239 - DNA, 25 bp, Homo sapien
ttggttttacaggtctcacctgaca

SEQ ID NO: 639240 - DNA, 25 bp, Homo sapien
tcacctgacagctagtcctgatttt

SEQ ID NO: 639241 - DNA, 25 bp, Homo sapien
acagctagtcctgatttttccatga

SEQ ID NO: 639242 - DNA, 25 bp, Homo sapien
gtagctgttgctaggaggtagctaa

SEQ ID NO: 639243 - DNA, 25 bp, Homo sapien
gaagctccaaaatcttgggatctgg

SEQ ID NO: 639244 - DNA, 25 bp, Homo sapien
caaaatcttgggatctgggcagaat

SEQ ID NO: 639245 - DNA, 25 bp, Homo sapien
attataagagccttaagtgtgtgtt

SEQ ID NO: 639246 - DNA, 25 bp, Homo sapien
gtttgtgtcaatagggaacactagg

SEQ ID NO: 639247 - DNA, 25 bp, Homo sapien
gaacactaggagtttcttttagcca

SEQ ID NO: 639248 - DNA, 25 bp, Homo sapien
cactaggagtttcttttagccattt

SEQ ID NO: 639249 - DNA, 25 bp, Homo sapien
agccattttgattcacattgttttg

SEQ ID NO: 639250 - DNA, 25 bp, Homo sapien
gaaagtcattttagaggctcgttag

SEQ ID NO: 639251 - DNA, 25 bp, Homo sapien
ggctcgttagaaaagctgaggtttt

SEQ ID NO: 639252 - DNA, 25 bp, Homo sapien
agaagtgatctagtagctgttgcta

SEQ ID NO: 639253 - DNA, 25 bp, Homo sapien
cctgtctggcagatgtgtaagagca

SEQ ID NO: 639254 - DNA, 25 bp, Homo sapien
aaatgagagtgcacagagccccgcg

SEQ ID NO: 639255 - DNA, 25 bp, Homo sapien
tgagagtgcacagagccccgcgctg

SEQ ID NO: 639256 - DNA, 25 bp, Homo sapien
acatggatgctgaaatctttggagt

SEQ ID NO: 639257 - DNA, 25 bp, Homo sapien
atctttggagttcagaaatactttt

SEQ ID NO: 639258 - DNA, 25 bp, Homo sapien
aaagtttattggtatcacagagcac

SEQ ID NO: 639259 - DNA, 25 bp, Homo sapien
tattggtatcacagagcacatatca

SEQ ID NO: 639260 - DNA, 25 bp, Homo sapien
gcattttaaccacataaggatcgtc

SEQ ID NO: 639261 - DNA, 25 bp, Homo sapien
ttaaccacataaggatcgtctgagt

SEQ ID NO: 639262 - DNA, 25 bp, Homo sapien
cacataaggatcgtctgagtaacaa

SEQ ID NO: 639263 - DNA, 25 bp, Homo sapien
ggatcgtctgagtaacaaaaacggg

SEQ ID NO: 639264 - DNA, 25 bp, Homo sapien
aggcaaattcaccagagcctttgaa

SEQ ID NO: 639265 - DNA, 25 bp, Homo sapien
gctggtggtagcagtccttgcacag

SEQ ID NO: 639266 - DNA, 25 bp, Homo sapien
tggtagcagtccttgcacaggccct

SEQ ID NO: 639267 - DNA, 25 bp, Homo sapien
ctccaggtgattctcatccagggaa

SEQ ID NO: 639268 - DNA, 25 bp, Homo sapien
gattctcatccagggaagcctgcga

SEQ ID NO: 639269 - DNA, 25 bp, Homo sapien
gcctgcgagcccttgaggtggaata

SEQ ID NO: 639270 - DNA, 25 bp, Homo sapien
ggtggaatattctcaggaatccctg

SEQ ID NO: 639271 - DNA, 25 bp, Homo sapien
aagaactgatggcataggctatttc

SEQ ID NO: 639272 - DNA, 25 bp, Homo sapien
ggcataggctatttctagggaggaa

SEQ ID NO: 639273 - DNA, 25 bp, Homo sapien
ggagacctctgtaattgtgtaccat

SEQ ID NO: 639274 - DNA, 25 bp, Homo sapien
gtgtaccatgtgcatatattaccta

SEQ ID NO: 639275 - DNA, 25 bp, Homo sapien
tagtatataattcctgagcacgttt

SEQ ID NO: 639276 - DNA, 25 bp, Homo sapien
taattcctgagcacgttttgttaga

SEQ ID NO: 639277 - DNA, 25 bp, Homo sapien
tcctgagcacgttttgttagaattt

SEQ ID NO: 639278 - DNA, 25 bp, Homo sapien
gagcacgttttgttagaatttaagt

SEQ ID NO: 639279 - DNA, 25 bp, Homo sapien
gaaatccaattgttgattgccacta

SEQ ID NO: 639280 - DNA, 25 bp, Homo sapien
caattgttgattgccactatctaga

SEQ ID NO: 639281 - DNA, 25 bp, Homo sapien
gttgattgccactatctagaaaaat

SEQ ID NO: 639282 - DNA, 25 bp, Homo sapien
aatggttgacttttgtaattctgca

SEQ ID NO: 639283 - DNA, 25 bp, Homo sapien
tgacttttgtaattctgcaacctca

SEQ ID NO: 639284 - DNA, 25 bp, Homo sapien
acctcagtaatttattaattctagg

SEQ ID NO: 639285 - DNA, 25 bp, Homo sapien
aattctaggagcattttggtgggtt

SEQ ID NO: 639286 - DNA, 25 bp, Homo sapien
atctgtagcctagttttttccctca

SEQ ID NO: 639287 - DNA, 25 bp, Homo sapien
agttttttccctcagcattatatca

SEQ ID NO: 639288 - DNA, 25 bp, Homo sapien
ttccctcagcattatatcatctttt

SEQ ID NO: 639289 - DNA, 25 bp, Homo sapien
atcatcttttcgatacggttaggga

SEQ ID NO: 639290 - DNA, 25 bp, Homo sapien
tgcaccctacgtacattttttgaga

SEQ ID NO: 639291 - DNA, 25 bp, Homo sapien
ttaatgctaactacaaacgtcagag

SEQ ID NO: 639292 - DNA, 25 bp, Homo sapien
acgtcagagtaccagttgttcaaaa

SEQ ID NO: 639293 - DNA, 25 bp, Homo sapien
acattcttattttctcaactcagag

SEQ ID NO: 639294 - DNA, 25 bp, Homo sapien
agataaccacttacagtatttgcat

SEQ ID NO: 639295 - DNA, 25 bp, Homo sapien
agtatttgcatacttccttttagta

SEQ ID NO: 639296 - DNA, 25 bp, Homo sapien
ataatgtgtgtcgatctgtagccta

SEQ ID NO: 639297 - DNA, 25 bp, Homo sapien
tatgttagcaagatattagtatgga

SEQ ID NO: 639298 - DNA, 25 bp, Homo sapien
atgttagcaagatattagtatggat

SEQ ID NO: 639299 - DNA, 25 bp, Homo sapien
tgttagcaagatattagtatggatt

SEQ ID NO: 639300 - DNA, 25 bp, Homo sapien
gttagcaagatattagtatggattt

SEQ ID NO: 639301 - DNA, 25 bp, Homo sapien
ttagcaagatattagtatggatttt

SEQ ID NO: 639302 - DNA, 25 bp, Homo sapien
tagcaagatattagtatggattttt

SEQ ID NO: 639303 - DNA, 25 bp, Homo sapien
agcaagatattagtatggatttttt

SEQ ID NO: 639304 - DNA, 25 bp, Homo sapien
caagatattagtatggatttttttc

SEQ ID NO: 639305 - DNA, 25 bp, Homo sapien
aaaaacacaaaagcacctgtaatct

SEQ ID NO: 639306 - DNA, 25 bp, Homo sapien
aaaacacaaaagcacctgtaatctc

SEQ ID NO: 639307 - DNA, 25 bp, Homo sapien
aaacacaaaagcacctgtaatctca

SEQ ID NO: 639308 - DNA, 25 bp, Homo sapien
aaaatcttcccaatctatacatccg

SEQ ID NO: 639309 - DNA, 25 bp, Homo sapien
aaatcttcccaatctatacatccga

SEQ ID NO: 639310 - DNA, 25 bp, Homo sapien
aatcttcccaatctatacatccgac

SEQ ID NO: 639311 - DNA, 25 bp, Homo sapien
atcttcccaatctatacatccgaca

SEQ ID NO: 639312 - DNA, 25 bp, Homo sapien
tcttcccaatctatacatccgacaa

SEQ ID NO: 639313 - DNA, 25 bp, Homo sapien
cttcccaatctatacatccgacaaa

SEQ ID NO: 639314 - DNA, 25 bp, Homo sapien
tcccaatctatacatccgacaaagg

SEQ ID NO: 639315 - DNA, 25 bp, Homo sapien
atctatacatccgacaaaggactaa

SEQ ID NO: 639316 - DNA, 25 bp, Homo sapien
acatccgacaaaggactaacatcca

SEQ ID NO: 639317 - DNA, 25 bp, Homo sapien
ggactaacatccagaatctacgagg

SEQ ID NO: 639318 - DNA, 25 bp, Homo sapien
tacgaggaactcaaattagcaagaa

SEQ ID NO: 639319 - DNA, 25 bp, Homo sapien
agccttgtaatctgggctctgctcg

SEQ ID NO: 639320 - DNA, 25 bp, Homo sapien
atgtgctctgtgctagtgaaactgc

SEQ ID NO: 639321 - DNA, 25 bp, Homo sapien
taaactgttggctctcaagtttttc

SEQ ID NO: 639322 - DNA, 25 bp, Homo sapien
ttttccagactaaccggactggcca

SEQ ID NO: 639323 - DNA, 25 bp, Homo sapien
agactaaccggactggccaatgcct

SEQ ID NO: 639324 - DNA, 25 bp, Homo sapien
ggactggccaatgcctgaggctctg

SEQ ID NO: 639325 - DNA, 25 bp, Homo sapien
aatgcctgaggctctgtgttcaaga

SEQ ID NO: 639326 - DNA, 25 bp, Homo sapien
ctgtgttcaagataaaagtgcctaa

SEQ ID NO: 639327 - DNA, 25 bp, Homo sapien
aaaagtgcaggtaggcagtccccac

SEQ ID NO: 639328 - DNA, 25 bp, Homo sapien
aggcagtccccacttctgcagggct

SEQ ID NO: 639329 - DNA, 25 bp, Homo sapien
ggatcctgtctcagcctgctgaaca

SEQ ID NO: 639330 - DNA, 25 bp, Homo sapien
attagttctctcgagtatattttca

SEQ ID NO: 639331 - DNA, 25 bp, Homo sapien
atgctttttggccattttacaccat

SEQ ID NO: 639332 - DNA, 25 bp, Homo sapien
tggccattttacaccatctttaaga

SEQ ID NO: 639333 - DNA, 25 bp, Homo sapien
tgcccatttttgaatgaggtagttt

SEQ ID NO: 639334 - DNA, 25 bp, Homo sapien
gttgttgtttagttatagcagttct

SEQ ID NO: 639335 - DNA, 25 bp, Homo sapien
attccagatattaatctcttatcag

SEQ ID NO: 639336 - DNA, 25 bp, Homo sapien
atctcttatcagatgtatgatgtgc

SEQ ID NO: 639337 - DNA, 25 bp, Homo sapien
atgtatgatgtgcaaatattttccc

SEQ ID NO: 639338 - DNA, 25 bp, Homo sapien
atattttcccatgctgtgcattgct

SEQ ID NO: 639339 - DNA, 25 bp, Homo sapien
ccatgctgtgcattgctttgcaata

SEQ ID NO: 639340 - DNA, 25 bp, Homo sapien
gttgataatatcctttaatgtgtaa

SEQ ID NO: 639341 - DNA, 25 bp, Homo sapien
gaagcaaaaaatggcatttgcggct

SEQ ID NO: 639342 - DNA, 25 bp, Homo sapien
agcaaaaaatggcatttgcggctgg

SEQ ID NO: 639343 - DNA, 25 bp, Homo sapien
gcaaaaaatggcatttgcggctggg

SEQ ID NO: 639344 - DNA, 25 bp, Homo sapien
caaaaaatggcatttgcggctgggc

SEQ ID NO: 639345 - DNA, 25 bp, Homo sapien
aaaaaatggcatttgcggctgggca

SEQ ID NO: 639346 - DNA, 25 bp, Homo sapien
aaaaatggcatttgcggctgggcac

SEQ ID NO: 639347 - DNA, 25 bp, Homo sapien
aaaatggcatttgcggctgggcacg

SEQ ID NO: 639348 - DNA, 25 bp, Homo sapien
aatggcatttgcggctgggcacggt

SEQ ID NO: 639349 - DNA, 25 bp, Homo sapien
cggaaggctgaggcgtgaaaattgc

SEQ ID NO: 639350 - DNA, 25 bp, Homo sapien
gaggttgtggtaggccgagatcctg

SEQ ID NO: 639351 - DNA, 25 bp, Homo sapien
aggttgtggtaggccgagatcctgc

SEQ ID NO: 639352 - DNA, 25 bp, Homo sapien
tactgctgctcccagctgacagagg

SEQ ID NO: 639353 - DNA, 25 bp, Homo sapien
gctgacagaggtttggctgaagatt

SEQ ID NO: 639354 - DNA, 25 bp, Homo sapien
gctgaagattctgcaaggacccgtg

SEQ ID NO: 639355 - DNA, 25 bp, Homo sapien
gattctgcaaggacccgtgcatcag

SEQ ID NO: 639356 - DNA, 25 bp, Homo sapien
aaggacccgtgcatcagtattccca

SEQ ID NO: 639357 - DNA, 25 bp, Homo sapien
gtgcatcagtattcccacaaggagc

SEQ ID NO: 639358 - DNA, 25 bp, Homo sapien
ccaagaaagatggaacccacgtggg

SEQ ID NO: 639359 - DNA, 25 bp, Homo sapien
ggcattgctaatgctgtcccagaaa

SEQ ID NO: 639360 - DNA, 25 bp, Homo sapien
attttcccagctctatacattgctt

SEQ ID NO: 639361 - DNA, 25 bp, Homo sapien
gtgtttatcagtgctttgaccagca

SEQ ID NO: 639362 - DNA, 25 bp, Homo sapien
gctttgaccagcagctattcatttg

SEQ ID NO: 639363 - DNA, 25 bp, Homo sapien
aataaacttgtgagctggccccaac

SEQ ID NO: 639364 - DNA, 25 bp, Homo sapien
taggaatcacagctccccgtactgg

SEQ ID NO: 639365 - DNA, 25 bp, Homo sapien
tgccgccgcagtggccaagttgcga

SEQ ID NO: 639366 - DNA, 25 bp, Homo sapien
ggccaagttgcgacactgcccacgg

SEQ ID NO: 639367 - DNA, 25 bp, Homo sapien
ccctccctctgatgcagattcaggg

SEQ ID NO: 639368 - DNA, 25 bp, Homo sapien
agattcagggcttctcttcgatcat

SEQ ID NO: 639369 - DNA, 25 bp, Homo sapien
gcttctcttcgatcatgttgggttt

SEQ ID NO: 639370 - DNA, 25 bp, Homo sapien
tgtttttccttgactgcaaaaccct

SEQ ID NO: 639371 - DNA, 25 bp, Homo sapien
tcttttgggacaagagccctggttt

SEQ ID NO: 639372 - DNA, 25 bp, Homo sapien
actgcctgccccacgagctgggagg

SEQ ID NO: 639373 - DNA, 25 bp, Homo sapien
gaggcaggttttgtacggtacgttg

SEQ ID NO: 639374 - DNA, 25 bp, Homo sapien
gatggataagcacattaatagatgc

SEQ ID NO: 639375 - DNA, 25 bp, Homo sapien
aaaccacatgtggtatcacttcaca

SEQ ID NO: 639376 - DNA, 25 bp, Homo sapien
tggtatcacttcacaccacaggata

SEQ ID NO: 639377 - DNA, 25 bp, Homo sapien
gtatcacttcacaccacaggataaa

SEQ ID NO: 639378 - DNA, 25 bp, Homo sapien
ccacaggataaaatctttgttcaag

SEQ ID NO: 639379 - DNA, 25 bp, Homo sapien
taaaacccttatctaatgctgctgg

SEQ ID NO: 639380 - DNA, 25 bp, Homo sapien
acccttatctaatgctgctgggaat

SEQ ID NO: 639381 - DNA, 25 bp, Homo sapien
actggcagctccttaaagggttaag

SEQ ID NO: 639382 - DNA, 25 bp, Homo sapien
ggcagctccttaaagggttaagcat

SEQ ID NO: 639383 - DNA, 25 bp, Homo sapien
agggttaagcataaagttaccatat

SEQ ID NO: 639384 - DNA, 25 bp, Homo sapien
ttaccatatgacacagaaattccag

SEQ ID NO: 639385 - DNA, 25 bp, Homo sapien
agcccctacgggtgtgcatttcaat

SEQ ID NO: 639386 - DNA, 25 bp, Homo sapien
ccctacgggtgtgcatttcaatcag

SEQ ID NO: 639387 - DNA, 25 bp, Homo sapien
gtgagagtgagaatcttcccagacc

SEQ ID NO: 639388 - DNA, 25 bp, Homo sapien
gagagtgagaatcttcccagaccgc

SEQ ID NO: 639389 - DNA, 25 bp, Homo sapien
agtgagaatcttcccagaccgcctg

SEQ ID NO: 639390 - DNA, 25 bp, Homo sapien
ttcccagaccgcctgctatggactg

SEQ ID NO: 639391 - DNA, 25 bp, Homo sapien
ggactgaattgtctctctaaccccc

SEQ ID NO: 639392 - DNA, 25 bp, Homo sapien
ttgtctctctaacccccagtgtggt

SEQ ID NO: 639393 - DNA, 25 bp, Homo sapien
agaaggcacttgtctgcaagctagg

SEQ ID NO: 639394 - DNA, 25 bp, Homo sapien
ggcacttgtctgcaagctaggaaga

SEQ ID NO: 639395 - DNA, 25 bp, Homo sapien
ttgtctgcaagctaggaagacagcc

SEQ ID NO: 639396 - DNA, 25 bp, Homo sapien
actgatttatttaatggatctcaaa

SEQ ID NO: 639397 - DNA, 25 bp, Homo sapien
acattgaaacggttcactataaaat

SEQ ID NO: 639398 - DNA, 25 bp, Homo sapien
aacaaatggctaatgtacctgaatt

SEQ ID NO: 639399 - DNA, 25 bp, Homo sapien
atggctaatgtacctgaatttttca

SEQ ID NO: 639400 - DNA, 25 bp, Homo sapien
gaacttctaataccagttgcctagt

SEQ ID NO: 639401 - DNA, 25 bp, Homo sapien
aataccagttgcctagtgtccacct

SEQ ID NO: 639402 - DNA, 25 bp, Homo sapien
tagtgtccacctcctatcaatgtta

SEQ ID NO: 639403 - DNA, 25 bp, Homo sapien
gtccacctcctatcaatgttacaag

SEQ ID NO: 639404 - DNA, 25 bp, Homo sapien
caatgttacaagcatggcactcaga

SEQ ID NO: 639405 - DNA, 25 bp, Homo sapien
ttacaagcatggcactcagaacaga

SEQ ID NO: 639406 - DNA, 25 bp, Homo sapien
gcatggcactcagaacagagacaat

SEQ ID NO: 639407 - DNA, 25 bp, Homo sapien
ggagcagtcacggagctgtaaccct

SEQ ID NO: 639408 - DNA, 25 bp, Homo sapien
gagcagtcacggagctgtaaccctg

SEQ ID NO: 639409 - DNA, 25 bp, Homo sapien
cagtcacggagctgtaaccctgcct

SEQ ID NO: 639410 - DNA, 25 bp, Homo sapien
gtcacggagctgtaaccctgcctct

SEQ ID NO: 639411 - DNA, 25 bp, Homo sapien
ggagctgtaaccctgcctcttcaat

SEQ ID NO: 639412 - DNA, 25 bp, Homo sapien
agctgtaaccctgcctcttcaataa

SEQ ID NO: 639413 - DNA, 25 bp, Homo sapien
aaaccgccccttaatctctatgcaa

SEQ ID NO: 639414 - DNA, 25 bp, Homo sapien
ccgccccttaatctctatgcaatta

SEQ ID NO: 639415 - DNA, 25 bp, Homo sapien
gccccttaatctctatgcaattaaa

SEQ ID NO: 639416 - DNA, 25 bp, Homo sapien
tatataactgcaaaactgccctgag

SEQ ID NO: 639417 - DNA, 25 bp, Homo sapien
ataactgcaaaactgccctgagctg

SEQ ID NO: 639418 - DNA, 25 bp, Homo sapien
gtttttcatactgctagtgctgaga

SEQ ID NO: 639419 - DNA, 25 bp, Homo sapien
gaagaaaggcaacggcttctcaccc

SEQ ID NO: 639420 - DNA, 25 bp, Homo sapien
ttctcacccgtgttaacttatactt

SEQ ID NO: 639421 - DNA, 25 bp, Homo sapien
tatactttctcttaacccaaggaat

SEQ ID NO: 639422 - DNA, 25 bp, Homo sapien
atactgtatcacttagtcctgggaa

SEQ ID NO: 639423 - DNA, 25 bp, Homo sapien
gttgcctgaatgaacctttggcatt

SEQ ID NO: 639424 - DNA, 25 bp, Homo sapien
ggcattcatttatctacagaaccct

SEQ ID NO: 639425 - DNA, 25 bp, Homo sapien
gaaaggaaacctgcacagcaccagc

SEQ ID NO: 639426 - DNA, 25 bp, Homo sapien
gcacagcaccagcttgtaccttgca

SEQ ID NO: 639427 - DNA, 25 bp, Homo sapien
gtaccttgcacctgttctgttaaag

SEQ ID NO: 639428 - DNA, 25 bp, Homo sapien
gttaaagtcattcacagagcagaat

SEQ ID NO: 639429 - DNA, 25 bp, Homo sapien
tagtctggtagggaaatacttctat

SEQ ID NO: 639430 - DNA, 25 bp, Homo sapien
acttctatgagtatgttacaatgga

SEQ ID NO: 639431 - DNA, 25 bp, Homo sapien
ggaagttgtattgtgcctattttat

SEQ ID NO: 639432 - DNA, 25 bp, Homo sapien
gttttagttaattccattgcttcgg

SEQ ID NO: 639433 - DNA, 25 bp, Homo sapien
ttgcttcggaagataagtggacgtc

SEQ ID NO: 639434 - DNA, 25 bp, Homo sapien
agtggacgtcatagatccatcgcaa

SEQ ID NO: 639435 - DNA, 25 bp, Homo sapien
agatccatcgcaagttctcgttttt

SEQ ID NO: 639436 - DNA, 25 bp, Homo sapien
tcgcaagttctcgtttttggatttt

SEQ ID NO: 639437 - DNA, 25 bp, Homo sapien
ttgaccattaagttttctacgatag

SEQ ID NO: 639438 - DNA, 25 bp, Homo sapien
tctacgatagataaacatgttgtgg

SEQ ID NO: 639439 - DNA, 25 bp, Homo sapien
gtagcatctgattagccaagtcggg

SEQ ID NO: 639440 - DNA, 25 bp, Homo sapien
gggccttgattagtattcagggtct

SEQ ID NO: 639441 - DNA, 25 bp, Homo sapien
gaagtgtgagaaactgacccctcaa

SEQ ID NO: 639442 - DNA, 25 bp, Homo sapien
accagcaacagagggacttctccta

SEQ ID NO: 639443 - DNA, 25 bp, Homo sapien
ttctcctaaagtccatcatgccgaa

SEQ ID NO: 639444 - DNA, 25 bp, Homo sapien
tcatgccgaactttgatccatttga

SEQ ID NO: 639445 - DNA, 25 bp, Homo sapien
ggcagtgaaacacctcagaactttg

SEQ ID NO: 639446 - DNA, 25 bp, Homo sapien
ttttctttacaactacgcatgcctg

SEQ ID NO: 639447 - DNA, 25 bp, Homo sapien
acgcatgcctgctttcaagaagctt

SEQ ID NO: 639448 - DNA, 25 bp, Homo sapien
gaagctttggccctctcagggagat

SEQ ID NO: 639449 - DNA, 25 bp, Homo sapien
gggagatttccctgagacaaacaat

SEQ ID NO: 639450 - DNA, 25 bp, Homo sapien
tgagacaaacaatttcccatgggaa

SEQ ID NO: 639451 - DNA, 25 bp, Homo sapien
agtggagtgttaattagtacaacca

SEQ ID NO: 639452 - DNA, 25 bp, Homo sapien
caaccactttgggaaactgttctgt

SEQ ID NO: 639453 - DNA, 25 bp, Homo sapien
ccactttgggaaactgttctgttgt

SEQ ID NO: 639454 - DNA, 25 bp, Homo sapien
tgggaaactgttctgttgtttctaa

SEQ ID NO: 639455 - DNA, 25 bp, Homo sapien
aaagttaaacactcacctatcccat

SEQ ID NO: 639456 - DNA, 25 bp, Homo sapien
gttaaacactcacctatcccatgac

SEQ ID NO: 639457 - DNA, 25 bp, Homo sapien
acctatcccatgacccagaaatcca

SEQ ID NO: 639458 - DNA, 25 bp, Homo sapien
tagccaaaacctagaaacaatcaat

SEQ ID NO: 639459 - DNA, 25 bp, Homo sapien
taatcatacaacagaactcggcaag

SEQ ID NO: 639460 - DNA, 25 bp, Homo sapien
atacaacagaactcggcaagaaaaa

SEQ ID NO: 639461 - DNA, 25 bp, Homo sapien
aaaagagtaactcataccaccacca

SEQ ID NO: 639462 - DNA, 25 bp, Homo sapien
attctaagtcaaagaagctagacac

SEQ ID NO: 639463 - DNA, 25 bp, Homo sapien
gagacaaaaagtggattagtggttc

SEQ ID NO: 639464 - DNA, 25 bp, Homo sapien
ttagtggttcccagggactaagaga

SEQ ID NO: 639465 - DNA, 25 bp, Homo sapien
tagtggttcccagggactaagagag

SEQ ID NO: 639466 - DNA, 25 bp, Homo sapien
ctaatgggtacatggtttcttcctg

SEQ ID NO: 639467 - DNA, 25 bp, Homo sapien
taatgggtacatggtttcttcctgg

SEQ ID NO: 639468 - DNA, 25 bp, Homo sapien
aatgggtacatggtttcttcctggg

SEQ ID NO: 639469 - DNA, 25 bp, Homo sapien
gtacatggtttcttcctggggtgat

SEQ ID NO: 639470 - DNA, 25 bp, Homo sapien
ctaaaattagatagtcgcaataaat

SEQ ID NO: 639471 - DNA, 25 bp, Homo sapien
cgcaataaattgcacagctctctga

SEQ ID NO: 639472 - DNA, 25 bp, Homo sapien
ctctctgaacataaccaaataaaga

SEQ ID NO: 639473 - DNA, 25 bp, Homo sapien
aaagtagaccgtgttttctcagtat

SEQ ID NO: 639474 - DNA, 25 bp, Homo sapien
gaccgtgttttctcagtatgtgtta

SEQ ID NO: 639475 - DNA, 25 bp, Homo sapien
gtgttttctcagtatgtgttatcaa

SEQ ID NO: 639476 - DNA, 25 bp, Homo sapien
taatttttgcccctcagccaggttg

SEQ ID NO: 639477 - DNA, 25 bp, Homo sapien
ttgcccctcagccaggttgtaatat

SEQ ID NO: 639478 - DNA, 25 bp, Homo sapien
gcccctcagccaggttgtaatattt

SEQ ID NO: 639479 - DNA, 25 bp, Homo sapien
tcagccaggttgtaatattttcctt

SEQ ID NO: 639480 - DNA, 25 bp, Homo sapien
tcctttagtttatctctttaataat

SEQ ID NO: 639481 - DNA, 25 bp, Homo sapien
taataattgtttacgttaatccatt

SEQ ID NO: 639482 - DNA, 25 bp, Homo sapien
gagagaattaaactggcataaagat

SEQ ID NO: 639483 - DNA, 25 bp, Homo sapien
aattcaagcaagatacgttattccc

SEQ ID NO: 639484 - DNA, 25 bp, Homo sapien
tttacctcattcacttctcttaatc

SEQ ID NO: 639485 - DNA, 25 bp, Homo sapien
attcacttctcttaatcgaaaaatc

SEQ ID NO: 639486 - DNA, 25 bp, Homo sapien
tcacttctcttaatcgaaaaatcac

SEQ ID NO: 639487 - DNA, 25 bp, Homo sapien
tctcttaatcgaaaaatcacacagg

SEQ ID NO: 639488 - DNA, 25 bp, Homo sapien
tcttaatcgaaaaatcacacaggct

SEQ ID NO: 639489 - DNA, 25 bp, Homo sapien
cttaatcgaaaaatcacacaggctg

SEQ ID NO: 639490 - DNA, 25 bp, Homo sapien
ttaatcgaaaaatcacacaggctgg

SEQ ID NO: 639491 - DNA, 25 bp, Homo sapien
taatcgaaaaatcacacaggctggg

SEQ ID NO: 639492 - DNA, 25 bp, Homo sapien
aatcgaaaaatcacacaggctgggt

SEQ ID NO: 639493 - DNA, 25 bp, Homo sapien
atcgaaaaatcacacaggctgggtg

SEQ ID NO: 639494 - DNA, 25 bp, Homo sapien
gaaaaatcacacaggctgggtgcag

SEQ ID NO: 639495 - DNA, 25 bp, Homo sapien
ggtctctgtcccagataaaattcta

SEQ ID NO: 639496 - DNA, 25 bp, Homo sapien
acagcggcccgagacattctgtaaa

SEQ ID NO: 639497 - DNA, 25 bp, Homo sapien
tgcccatgggttcaaacacttattt

SEQ ID NO: 639498 - DNA, 25 bp, Homo sapien
acacttatttactagatgccaggct

SEQ ID NO: 639499 - DNA, 25 bp, Homo sapien
tagatgccaggcttatgccagggct

SEQ ID NO: 639500 - DNA, 25 bp, Homo sapien
ttatgccagggctgagaccagatag

SEQ ID NO: 639501 - DNA, 25 bp, Homo sapien
agaccagataggagactgccccagc

SEQ ID NO: 639502 - DNA, 25 bp, Homo sapien
gcctgcaaggtgctttgcctgcaaa

SEQ ID NO: 639503 - DNA, 25 bp, Homo sapien
acacaccaagcagcatgggttactt

SEQ ID NO: 639504 - DNA, 25 bp, Homo sapien
gggttacttgctgggccaaggctaa

SEQ ID NO: 639505 - DNA, 25 bp, Homo sapien
atattttgggcttttcccgccatag

SEQ ID NO: 639506 - DNA, 25 bp, Homo sapien
aaggctctcaagtgtaacacctttc

SEQ ID NO: 639507 - DNA, 25 bp, Homo sapien
tcaagtgtaacacctttctgtagtg

SEQ ID NO: 639508 - DNA, 25 bp, Homo sapien
gctgtagatcattaatctgggtgtg

SEQ ID NO: 639509 - DNA, 25 bp, Homo sapien
atctgggtgtgtgatgaccatctga

SEQ ID NO: 639510 - DNA, 25 bp, Homo sapien
gtgatgaccatctgatctagcacat

SEQ ID NO: 639511 - DNA, 25 bp, Homo sapien
gaccatctgatctagcacatccagt

SEQ ID NO: 639512 - DNA, 25 bp, Homo sapien
cacatccagtggcattgtgcatatt

SEQ ID NO: 639513 - DNA, 25 bp, Homo sapien
gcattgtgcatattgggataggaat

SEQ ID NO: 639514 - DNA, 25 bp, Homo sapien
tcaagctattcagcagggcccatga

SEQ ID NO: 639515 - DNA, 25 bp, Homo sapien
agctattcagcagggcccatgaaaa

SEQ ID NO: 639516 - DNA, 25 bp, Homo sapien
tgccactgtctgatgtttcaaagat

SEQ ID NO: 639517 - DNA, 25 bp, Homo sapien
tattgacagccatctgtcactacag

SEQ ID NO: 639518 - DNA, 25 bp, Homo sapien
atctgtcactacagacacctggctg

SEQ ID NO: 639519 - DNA, 25 bp, Homo sapien
cacctggctgcctcttaaaatagga

SEQ ID NO: 639520 - DNA, 25 bp, Homo sapien
atgaagctgtgcacatatcatgggc

SEQ ID NO: 639521 - DNA, 25 bp, Homo sapien
atgggcataccctgtagttcttgca

SEQ ID NO: 639522 - DNA, 25 bp, Homo sapien
accctgtagttcttgcaataatctt

SEQ ID NO: 639523 - DNA, 25 bp, Homo sapien
gatgaaacccaatctaggaattttg

SEQ ID NO: 639524 - DNA, 25 bp, Homo sapien
gaactttatctggtactccaactta

SEQ ID NO: 639525 - DNA, 25 bp, Homo sapien
tggtattattccatttgggcaaatg

SEQ ID NO: 639526 - DNA, 25 bp, Homo sapien
gaagacagactgaacccatgtgaca

SEQ ID NO: 639527 - DNA, 25 bp, Homo sapien
gaacccatgtgacaattcatgcaaa

SEQ ID NO: 639528 - DNA, 25 bp, Homo sapien
tacaaaattatccaggcccatgcct

SEQ ID NO: 639529 - DNA, 25 bp, Homo sapien
acaaaattatccaggcccatgcctg

SEQ ID NO: 639530 - DNA, 25 bp, Homo sapien
attatccaggcccatgcctgcatgc

SEQ ID NO: 639531 - DNA, 25 bp, Homo sapien
cctgcatgcctgcaaggctacatgc

SEQ ID NO: 639532 - DNA, 25 bp, Homo sapien
tgcatgcctgcaaggctacatgcct

SEQ ID NO: 639533 - DNA, 25 bp, Homo sapien
gcatgcctgcaaggctacatgcctg

SEQ ID NO: 639534 - DNA, 25 bp, Homo sapien
atgcctgcaaggctacatgcctgta

SEQ ID NO: 639535 - DNA, 25 bp, Homo sapien
tgcctgcaaggctacatgcctgtag

SEQ ID NO: 639536 - DNA, 25 bp, Homo sapien
cctgcaaggctacatgcctgtagtc

SEQ ID NO: 639537 - DNA, 25 bp, Homo sapien
tacttggaggccgaagcaagaggat

SEQ ID NO: 639538 - DNA, 25 bp, Homo sapien
acttggaggccgaagcaagaggatt

SEQ ID NO: 639539 - DNA, 25 bp, Homo sapien
gcacccggcctctgctaagtttaca

SEQ ID NO: 639540 - DNA, 25 bp, Homo sapien
cggcctctgctaagtttacaacctg

SEQ ID NO: 639541 - DNA, 25 bp, Homo sapien
ggcctctgctaagtttacaacctgc

SEQ ID NO: 639542 - DNA, 25 bp, Homo sapien
gcctctgctaagtttacaacctgca

SEQ ID NO: 639543 - DNA, 25 bp, Homo sapien
cctctgctaagtttacaacctgcaa

SEQ ID NO: 639544 - DNA, 25 bp, Homo sapien
tctgctaagtttacaacctgcaaat

SEQ ID NO: 639545 - DNA, 25 bp, Homo sapien
gctaagtttacaacctgcaaattct

SEQ ID NO: 639546 - DNA, 25 bp, Homo sapien
aagtttacaacctgcaaattctatc

SEQ ID NO: 639547 - DNA, 25 bp, Homo sapien
gtttacaacctgcaaattctatcca

SEQ ID NO: 639548 - DNA, 25 bp, Homo sapien
tttacaacctgcaaattctatccaa

SEQ ID NO: 639549 - DNA, 25 bp, Homo sapien
tacaacctgcaaattctatccaaaa

SEQ ID NO: 639550 - DNA, 25 bp, Homo sapien
ctgcctacccacactgaagttatga

SEQ ID NO: 639551 - DNA, 25 bp, Homo sapien
cacactgaagttatgactagacgtc

SEQ ID NO: 639552 - DNA, 25 bp, Homo sapien
gactagacgtcaacactgtctgtta

SEQ ID NO: 639553 - DNA, 25 bp, Homo sapien
cactgtctgttacttgggtcatcta

SEQ ID NO: 639554 - DNA, 25 bp, Homo sapien
ctgttacttgggtcatctaaacttt

SEQ ID NO: 639555 - DNA, 25 bp, Homo sapien
gggtcatctaaactttgaaagcaat

SEQ ID NO: 639556 - DNA, 25 bp, Homo sapien
tgaaatgtttccctaaatgaattct

SEQ ID NO: 639557 - DNA, 25 bp, Homo sapien
gaattctttttgactattgttccta

SEQ ID NO: 639558 - DNA, 25 bp, Homo sapien
gactattgttcctaagattgcttca

SEQ ID NO: 639559 - DNA, 25 bp, Homo sapien
gttcctaagattgcttcaacttttg

SEQ ID NO: 639560 - DNA, 25 bp, Homo sapien
gaaaatcctatcatcagaggactga

SEQ ID NO: 639561 - DNA, 25 bp, Homo sapien
ttagtctaccacataaaaccaggaa

SEQ ID NO: 639562 - DNA, 25 bp, Homo sapien
ggaatgtttttacctcttctatgga

SEQ ID NO: 639563 - DNA, 25 bp, Homo sapien
ggaaattcactacagccatcagttg

SEQ ID NO: 639564 - DNA, 25 bp, Homo sapien
tacagccatcagttgcaccattgca

SEQ ID NO: 639565 - DNA, 25 bp, Homo sapien
attgcaattgcacacttcctactgg

SEQ ID NO: 639566 - DNA, 25 bp, Homo sapien
acttcctactggatgcaacacatag

SEQ ID NO: 639567 - DNA, 25 bp, Homo sapien
gagtactaatacgtgccaagccatg

SEQ ID NO: 639568 - DNA, 25 bp, Homo sapien
ttgtggaaaacatgcagtctggtaa

SEQ ID NO: 639569 - DNA, 25 bp, Homo sapien
aaatgttaatcaccctctagaagta

SEQ ID NO: 639570 - DNA, 25 bp, Homo sapien
gtaataacccgtgtaatggcaggta

SEQ ID NO: 639571 - DNA, 25 bp, Homo sapien
ggcaggtatactaacactttacatg

SEQ ID NO: 639572 - DNA, 25 bp, Homo sapien
ctcaggccacccaaggcagaggctc

SEQ ID NO: 639573 - DNA, 25 bp, Homo sapien
cagaggctcacagatggaactgcag

SEQ ID NO: 639574 - DNA, 25 bp, Homo sapien
gaggctcacagatggaactgcaggc

SEQ ID NO: 639575 - DNA, 25 bp, Homo sapien
ggctcacagatggaactgcaggcca

SEQ ID NO: 639576 - DNA, 25 bp, Homo sapien
gctcacagatggaactgcaggccac

SEQ ID NO: 639577 - DNA, 25 bp, Homo sapien
agatggaactgcaggccacagtatc

SEQ ID NO: 639578 - DNA, 25 bp, Homo sapien
gatggaactgcaggccacagtatca

SEQ ID NO: 639579 - DNA, 25 bp, Homo sapien
ggaactgcaggccacagtatcaccc

SEQ ID NO: 639580 - DNA, 25 bp, Homo sapien
catccctcactcttatgacaactaa

SEQ ID NO: 639581 - DNA, 25 bp, Homo sapien
tccctcactcttatgacaactaatt

SEQ ID NO: 639582 - DNA, 25 bp, Homo sapien
actcttatgacaactaattatcaag

SEQ ID NO: 639583 - DNA, 25 bp, Homo sapien
ccccagcccacagtgaatggaattg

SEQ ID NO: 639584 - DNA, 25 bp, Homo sapien
ggaattggattattctgaagcacaa

SEQ ID NO: 639585 - DNA, 25 bp, Homo sapien
gcacaatcagtattccaagtacatg

SEQ ID NO: 639586 - DNA, 25 bp, Homo sapien
gtattccaagtacatggtttctgta

SEQ ID NO: 639587 - DNA, 25 bp, Homo sapien
aatgggataattggctgcccctggt

SEQ ID NO: 639588 - DNA, 25 bp, Homo sapien
attggctgcccctggtcctagacaa

SEQ ID NO: 639589 - DNA, 25 bp, Homo sapien
tctctgaaaggctctgccttgagct

SEQ ID NO: 639590 - DNA, 25 bp, Homo sapien
ggctctgccttgagcttgctttaaa

SEQ ID NO: 639591 - DNA, 25 bp, Homo sapien
ggaaacttctacaccgcacagctat

SEQ ID NO: 639592 - DNA, 25 bp, Homo sapien
ttctacaccgcacagctatttttaa

SEQ ID NO: 639593 - DNA, 25 bp, Homo sapien
gatctccatgtttctgcaatgcatg

SEQ ID NO: 639594 - DNA, 25 bp, Homo sapien
catgagagggcctgtgcaacattgc

SEQ ID NO: 639595 - DNA, 25 bp, Homo sapien
caacattgccttagagatggagagc

SEQ ID NO: 639596 - DNA, 25 bp, Homo sapien
ggctgccccttgtgatcttgaatgg

SEQ ID NO: 639597 - DNA, 25 bp, Homo sapien
cttgtgatcttgaatggctcctgac

SEQ ID NO: 639598 - DNA, 25 bp, Homo sapien
aatggctcctgacaagaggctgctg

SEQ ID NO: 639599 - DNA, 25 bp, Homo sapien
ggactgccgtggattgcccattgat

SEQ ID NO: 639600 - DNA, 25 bp, Homo sapien
atgggtcaaaatccagctacctggt

SEQ ID NO: 639601 - DNA, 25 bp, Homo sapien
gctacctggtaattcaatgagtccc

SEQ ID NO: 639602 - DNA, 25 bp, Homo sapien
ttcaatgagtccctagtgtgcatcc

SEQ ID NO: 639603 - DNA, 25 bp, Homo sapien
gtgtgcatccaataaattatcttct

SEQ ID NO: 639604 - DNA, 25 bp, Homo sapien
gaaactgtttttaatctgtgtgcta

SEQ ID NO: 639605 - DNA, 25 bp, Homo sapien
tatgtttacggtccttgggaaactg

SEQ ID NO: 639606 - DNA, 25 bp, Homo sapien
gaaaagcatttcctgtgatgtccca

SEQ ID NO: 639607 - DNA, 25 bp, Homo sapien
acaggagccagccttgaagtggaaa

SEQ ID NO: 639608 - DNA, 25 bp, Homo sapien
ttgaagtggaaaccccaggccatcc

SEQ ID NO: 639609 - DNA, 25 bp, Homo sapien
aggccatccacccacaatctgagta

SEQ ID NO: 639610 - DNA, 25 bp, Homo sapien
acaatctgagtatccttgggtgagt

SEQ ID NO: 639611 - DNA, 25 bp, Homo sapien
ttgggtgagtgatctctctaacctc

SEQ ID NO: 639612 - DNA, 25 bp, Homo sapien
tgatctctctaacctcccatcgagt

SEQ ID NO: 639613 - DNA, 25 bp, Homo sapien
ccatcgagtcccctgtaaactagaa

SEQ ID NO: 639614 - DNA, 25 bp, Homo sapien
ataattatagctgcccacatcactg

SEQ ID NO: 639615 - DNA, 25 bp, Homo sapien
cccacatcactgtcttactataaga

SEQ ID NO: 639616 - DNA, 25 bp, Homo sapien
aaaaaatgtccatctgattctgaaa

SEQ ID NO: 639617 - DNA, 25 bp, Homo sapien
taagcaatgtggagtggagccaagt

SEQ ID NO: 639618 - DNA, 25 bp, Homo sapien
agccaagtggaagagctgaatagct

SEQ ID NO: 639619 - DNA, 25 bp, Homo sapien
gaatagctgtgaagctctcctggtt

SEQ ID NO: 639620 - DNA, 25 bp, Homo sapien
ggttctcaggcttttagaattggaa

SEQ ID NO: 639621 - DNA, 25 bp, Homo sapien
gaatggaatctacaccaccaggtct

SEQ ID NO: 639622 - DNA, 25 bp, Homo sapien
ggaatctacaccaccaggtctctgg

SEQ ID NO: 639623 - DNA, 25 bp, Homo sapien
acaccaccaggtctctggctttcag

SEQ ID NO: 639624 - DNA, 25 bp, Homo sapien
tggctttcaggccttcaaaccacac

SEQ ID NO: 639625 - DNA, 25 bp, Homo sapien
tcaggccttcaaaccacacaactgg

SEQ ID NO: 639626 - DNA, 25 bp, Homo sapien
aaccacacaactggctttcctgggt

SEQ ID NO: 639627 - DNA, 25 bp, Homo sapien
catctgtttgggtgctaaaacatta

SEQ ID NO: 639628 - DNA, 25 bp, Homo sapien
atctgtttgggtgctaaaacattag

SEQ ID NO: 639629 - DNA, 25 bp, Homo sapien
tctgtttgggtgctaaaacattagc

SEQ ID NO: 639630 - DNA, 25 bp, Homo sapien
gtttgggtgctaaaacattagcatc

SEQ ID NO: 639631 - DNA, 25 bp, Homo sapien
aaacattagcatcaggccaggcgca

SEQ ID NO: 639632 - DNA, 25 bp, Homo sapien
aacattagcatcaggccaggcgcag

SEQ ID NO: 639633 - DNA, 25 bp, Homo sapien
acattagcatcaggccaggcgcagt

SEQ ID NO: 639634 - DNA, 25 bp, Homo sapien
gtaatcctaagtactcgggagacta

SEQ ID NO: 639635 - DNA, 25 bp, Homo sapien
taatcctaagtactcgggagactaa

SEQ ID NO: 639636 - DNA, 25 bp, Homo sapien
aatcctaagtactcgggagactaag

SEQ ID NO: 639637 - DNA, 25 bp, Homo sapien
cctaagtactcgggagactaaggca

SEQ ID NO: 639638 - DNA, 25 bp, Homo sapien
tgcttccccattgatgcgccgagaa

SEQ ID NO: 639639 - DNA, 25 bp, Homo sapien
ggacacagcattgctcatgcagcat

SEQ ID NO: 639640 - DNA, 25 bp, Homo sapien
gctcatgcagcatccttgtcaaaaa

SEQ ID NO: 639641 - DNA, 25 bp, Homo sapien
atccttgtcaaaaatgcgtaaacgg

SEQ ID NO: 639642 - DNA, 25 bp, Homo sapien
aatcatgagaaaactgccagacagc

SEQ ID NO: 639643 - DNA, 25 bp, Homo sapien
gccagacagccaaactcttcagaaa

SEQ ID NO: 639644 - DNA, 25 bp, Homo sapien
agattgagaataactttaccaggtt

SEQ ID NO: 639645 - DNA, 25 bp, Homo sapien
agatatgacaactgactgcaacgca

SEQ ID NO: 639646 - DNA, 25 bp, Homo sapien
tgcaacgcagaatcctggaccagac

SEQ ID NO: 639647 - DNA, 25 bp, Homo sapien
cagaccctggatctggtcaaaagaa

SEQ ID NO: 639648 - DNA, 25 bp, Homo sapien
atgctttaaacgacagtattgggac

SEQ ID NO: 639649 - DNA, 25 bp, Homo sapien
ggctggcattcctgattgatggaaa

SEQ ID NO: 639650 - DNA, 25 bp, Homo sapien
gattgatggaaagcacagactagtc

SEQ ID NO: 639651 - DNA, 25 bp, Homo sapien
gatggaaagcacagactagtcaatt

SEQ ID NO: 639652 - DNA, 25 bp, Homo sapien
cacagactagtcaattaatgcaata

SEQ ID NO: 639653 - DNA, 25 bp, Homo sapien
atgcaatagttggtcattcatatga

SEQ ID NO: 639654 - DNA, 25 bp, Homo sapien
caatagttggtcattcatatgagga

SEQ ID NO: 639655 - DNA, 25 bp, Homo sapien
gaaattaggttagcttataccatac

SEQ ID NO: 639656 - DNA, 25 bp, Homo sapien
gcttataccatacaaaattcaatca

SEQ ID NO: 639657 - DNA, 25 bp, Homo sapien
gagataaatgattccttaaggtaca

SEQ ID NO: 639658 - DNA, 25 bp, Homo sapien
gattccttaaggtacaaaacagcaa

SEQ ID NO: 639659 - DNA, 25 bp, Homo sapien
acagcaaaaaatgacaacctttatt

SEQ ID NO: 639660 - DNA, 25 bp, Homo sapien
agtcagaaacagatcctcagttgca

SEQ ID NO: 639661 - DNA, 25 bp, Homo sapien
agatcctcagttgcacaccatttat

SEQ ID NO: 639662 - DNA, 25 bp, Homo sapien
tcagttgcacaccatttatatagta

SEQ ID NO: 639663 - DNA, 25 bp, Homo sapien
atatagtatgtcaaccatgcagata

SEQ ID NO: 639664 - DNA, 25 bp, Homo sapien
gtcaaccatgcagatacaatagatg

SEQ ID NO: 639665 - DNA, 25 bp, Homo sapien
atggctagatttaacaactggctta

SEQ ID NO: 639666 - DNA, 25 bp, Homo sapien
aactggcttagaaaaccgctgaaat

SEQ ID NO: 639667 - DNA, 25 bp, Homo sapien
gaaattttaacagccaactgtcgtg

SEQ ID NO: 639668 - DNA, 25 bp, Homo sapien
agccaactgtcgtgagctggtatga

SEQ ID NO: 639669 - DNA, 25 bp, Homo sapien
gagctggtatgagctggcatcagca

SEQ ID NO: 639670 - DNA, 25 bp, Homo sapien
ggcatcagcacaccacagtatatac

SEQ ID NO: 639671 - DNA, 25 bp, Homo sapien
ggatggaccccagagacagttatta

SEQ ID NO: 639672 - DNA, 25 bp, Homo sapien
gagacagttattactgcagcagttc

SEQ ID NO: 639673 - DNA, 25 bp, Homo sapien
gcagcagttctcacactacttggcc

SEQ ID NO: 639674 - DNA, 25 bp, Homo sapien
gttctcacactacttggccttgaaa

SEQ ID NO: 639675 - DNA, 25 bp, Homo sapien
ggaccctaagtagattttattcatg

SEQ ID NO: 639676 - DNA, 25 bp, Homo sapien
gatttacatctattgatatttcttg

SEQ ID NO: 639677 - DNA, 25 bp, Homo sapien
gatattgcactagctggcagagtga

SEQ ID NO: 639678 - DNA, 25 bp, Homo sapien
ggcagagtgatgatgtcattgcata

SEQ ID NO: 639679 - DNA, 25 bp, Homo sapien
tgatgtcattgcatatcatctactc

SEQ ID NO: 639680 - DNA, 25 bp, Homo sapien
tatcatctactctccggaaaattct

SEQ ID NO: 639681 - DNA, 25 bp, Homo sapien
tactctccggaaaattctaccatag

SEQ ID NO: 639682 - DNA, 25 bp, Homo sapien
agttgccatttggagctgcccgttt

SEQ ID NO: 639683 - DNA, 25 bp, Homo sapien
ggagctgcccgtttagaaagcaaat

SEQ ID NO: 639684 - DNA, 25 bp, Homo sapien
aaagcaaatctgcatttccctcatt

SEQ ID NO: 639685 - DNA, 25 bp, Homo sapien
ttccctcattcctagtttccttcat

SEQ ID NO: 639686 - DNA, 25 bp, Homo sapien
catcttttccatgaagcctactaga

SEQ ID NO: 639687 - DNA, 25 bp, Homo sapien
aattgcaaagtcttcacaccgcagc

SEQ ID NO: 639688 - DNA, 25 bp, Homo sapien
tgctttggttttctccgtgggactt

SEQ ID NO: 639689 - DNA, 25 bp, Homo sapien
gacttcccaccatccgtaaaattag

SEQ ID NO: 639690 - DNA, 25 bp, Homo sapien
ttgcctgttttattcactgctacgt

SEQ ID NO: 639691 - DNA, 25 bp, Homo sapien
tattcactgctacgtctccaatggt

SEQ ID NO: 639692 - DNA, 25 bp, Homo sapien
gtctccaatggttagaacctgacat

SEQ ID NO: 639693 - DNA, 25 bp, Homo sapien
taaaccctcactggcattaactgga

SEQ ID NO: 639694 - DNA, 25 bp, Homo sapien
tatttaacaccccattcatctagtc

SEQ ID NO: 639695 - DNA, 25 bp, Homo sapien
tagaatgtgcttttatctcctgtga

SEQ ID NO: 639696 - DNA, 25 bp, Homo sapien
atctcctgtgataaccaaagaccca

SEQ ID NO: 639697 - DNA, 25 bp, Homo sapien
gataaccaaagacccactggatcct

SEQ ID NO: 639698 - DNA, 25 bp, Homo sapien
ctctctcaccataagggcctcaatg

SEQ ID NO: 639699 - DNA, 25 bp, Homo sapien
gggcctcaatgcaagttaatgtctc

SEQ ID NO: 639700 - DNA, 25 bp, Homo sapien
ttaatgtctccattttccacattcc

SEQ ID NO: 639701 - DNA, 25 bp, Homo sapien
tctccattttccacattcctattat

SEQ ID NO: 639702 - DNA, 25 bp, Homo sapien
gatggttctgtacaatttcatgttt

SEQ ID NO: 639703 - DNA, 25 bp, Homo sapien
gttttacagacttgttcaaccattg

SEQ ID NO: 639704 - DNA, 25 bp, Homo sapien
tgcattcccagacggatcaccaagg

SEQ ID NO: 639705 - DNA, 25 bp, Homo sapien
attcccagacggatcaccaaggatt

SEQ ID NO: 639706 - DNA, 25 bp, Homo sapien
ggatcaccaaggattcagaccgata

SEQ ID NO: 639707 - DNA, 25 bp, Homo sapien
accaaggattcagaccgataccaat

SEQ ID NO: 639708 - DNA, 25 bp, Homo sapien
aaagacatcatttttcctccaggaa

SEQ ID NO: 639709 - DNA, 25 bp, Homo sapien
gagaaatatgggtttagtcaccaag

SEQ ID NO: 639710 - DNA, 25 bp, Homo sapien
tatgggtttagtcaccaaggaagaa

SEQ ID NO: 639711 - DNA, 25 bp, Homo sapien
gaaggcagtaaatagctttgaacac

SEQ ID NO: 639712 - DNA, 25 bp, Homo sapien
atagctttgaacactcacatttaca

SEQ ID NO: 639713 - DNA, 25 bp, Homo sapien
gaacactcacatttacactctaata

SEQ ID NO: 639714 - DNA, 25 bp, Homo sapien
tcacatttacactctaatatatctg

SEQ ID NO: 639715 - DNA, 25 bp, Homo sapien
gatcagtcagctacaaacaaatgtc

SEQ ID NO: 639716 - DNA, 25 bp, Homo sapien
atcagtcagctacaaacaaatgtca

SEQ ID NO: 639717 - DNA, 25 bp, Homo sapien
tcagtcagctacaaacaaatgtcag

SEQ ID NO: 639718 - DNA, 25 bp, Homo sapien
cagtcagctacaaacaaatgtcagt

SEQ ID NO: 639719 - DNA, 25 bp, Homo sapien
agtcagctacaaacaaatgtcagta

SEQ ID NO: 639720 - DNA, 25 bp, Homo sapien
gtcagctacaaacaaatgtcagtat

SEQ ID NO: 639721 - DNA, 25 bp, Homo sapien
tcagctacaaacaaatgtcagtata

SEQ ID NO: 639722 - DNA, 25 bp, Homo sapien
cagctacaaacaaatgtcagtataa

SEQ ID NO: 639723 - DNA, 25 bp, Homo sapien
agctacaaacaaatgtcagtataag

SEQ ID NO: 639724 - DNA, 25 bp, Homo sapien
gctacaaacaaatgtcagtataaga

SEQ ID NO: 639725 - DNA, 25 bp, Homo sapien
aacaaatgtcagtataagaaggaag

SEQ ID NO: 639726 - DNA, 25 bp, Homo sapien
gggcaacacgccttttaaacctgag

SEQ ID NO: 639727 - DNA, 25 bp, Homo sapien
acgccttttaaacctgagcgagtgg

SEQ ID NO: 639728 - DNA, 25 bp, Homo sapien
ggcgcgagtgacagagcgaccttaa

SEQ ID NO: 639729 - DNA, 25 bp, Homo sapien
gcgaccttaacggattagcacctta

SEQ ID NO: 639730 - DNA, 25 bp, Homo sapien
cttaacggattagcgtggcaaggta

SEQ ID NO: 639731 - DNA, 25 bp, Homo sapien
tggcaaggtatgcaagcaagtcacc

SEQ ID NO: 639732 - DNA, 25 bp, Homo sapien
gcaagtcaccagctggcaatttggg

SEQ ID NO: 639733 - DNA, 25 bp, Homo sapien
gggaggtgcgcaatacatactggaa

SEQ ID NO: 639734 - DNA, 25 bp, Homo sapien
atactggaaggagaggcacccacac

SEQ ID NO: 639735 - DNA, 25 bp, Homo sapien
ggcacccacacaaaggacgcaggaa

SEQ ID NO: 639736 - DNA, 25 bp, Homo sapien
agaacaggtgcgcacaaaggcacaa

SEQ ID NO: 639737 - DNA, 25 bp, Homo sapien
aattcagggctgtggaacgactcca

SEQ ID NO: 639738 - DNA, 25 bp, Homo sapien
gaacgactccacatgatacggtact

SEQ ID NO: 639739 - DNA, 25 bp, Homo sapien
catgatacggtactggtggaaacac

SEQ ID NO: 639740 - DNA, 25 bp, Homo sapien
ggtggaaacacgtcattctacagct

SEQ ID NO: 639741 - DNA, 25 bp, Homo sapien
tcattctacagctgtcaaaacccac

SEQ ID NO: 639742 - DNA, 25 bp, Homo sapien
atgtacacaccaagagtgcaccctg

SEQ ID NO: 639743 - DNA, 25 bp, Homo sapien
caccaagagtgcaccctgatgggaa

SEQ ID NO: 639744 - DNA, 25 bp, Homo sapien
caccctgatgggaactatggaagct

SEQ ID NO: 639745 - DNA, 25 bp, Homo sapien
tgttgacgtgggttcatggattcta

SEQ ID NO: 639746 - DNA, 25 bp, Homo sapien
atggattctaacaaacgcaccaccc

SEQ ID NO: 639747 - DNA, 25 bp, Homo sapien
gggtatgggaagtctctgtactaaa

SEQ ID NO: 639748 - DNA, 25 bp, Homo sapien
ataggttttaactaggctgggtatg

SEQ ID NO: 639749 - DNA, 25 bp, Homo sapien
taggttttaactaggctgggtatgg

SEQ ID NO: 639750 - DNA, 25 bp, Homo sapien
gccagtaattgcagcctcccttagg

SEQ ID NO: 639751 - DNA, 25 bp, Homo sapien
ccagtaattgcagcctcccttagga

SEQ ID NO: 639752 - DNA, 25 bp, Homo sapien
cagtaattgcagcctcccttaggag

SEQ ID NO: 639753 - DNA, 25 bp, Homo sapien
agtaattgcagcctcccttaggagg

SEQ ID NO: 639754 - DNA, 25 bp, Homo sapien
gtaattgcagcctcccttaggaggc

SEQ ID NO: 639755 - DNA, 25 bp, Homo sapien
taattgcagcctcccttaggaggct

SEQ ID NO: 639756 - DNA, 25 bp, Homo sapien
gggcagaactttgtttacgtagatt

SEQ ID NO: 639757 - DNA, 25 bp, Homo sapien
actttgtttacgtagatttctgagg

SEQ ID NO: 639758 - DNA, 25 bp, Homo sapien
ttctgaggatgggttgagacgccaa

SEQ ID NO: 639759 - DNA, 25 bp, Homo sapien
ggttgagacgccaaattctgcttgt

SEQ ID NO: 639760 - DNA, 25 bp, Homo sapien
gaatttctatttcactgggcttagt

SEQ ID NO: 639761 - DNA, 25 bp, Homo sapien
tttcactgggcttagtgagggtgcc

SEQ ID NO: 639762 - DNA, 25 bp, Homo sapien
tgagggtgcccatgttttgcaatcc

SEQ ID NO: 639763 - DNA, 25 bp, Homo sapien
atgttttgcaatcctgtgctctaga

SEQ ID NO: 639764 - DNA, 25 bp, Homo sapien
aatcctgtgctctagaatctatcat

SEQ ID NO: 639765 - DNA, 25 bp, Homo sapien
aaacagattcttctaattgtttgac

SEQ ID NO: 639766 - DNA, 25 bp, Homo sapien
tgtgtctgctcaaatataaaatgtc

SEQ ID NO: 639767 - DNA, 25 bp, Homo sapien
ggagcagtcacggagctgtaaccct

SEQ ID NO: 639768 - DNA, 25 bp, Homo sapien
cagtcacggagctgtaaccctgcct

SEQ ID NO: 639769 - DNA, 25 bp, Homo sapien
agctgtaaccctgcctcttcaataa

SEQ ID NO: 639770 - DNA, 25 bp, Homo sapien
accctgcctcttcaataaagctgtt

SEQ ID NO: 639771 - DNA, 25 bp, Homo sapien
tttaccgttgccatgtcaataccag

SEQ ID NO: 639772 - DNA, 25 bp, Homo sapien
atgtcaataccagggagttaccgcc

SEQ ID NO: 639773 - DNA, 25 bp, Homo sapien
aaaccgccccttaatctctatgcaa

SEQ ID NO: 639774 - DNA, 25 bp, Homo sapien
ccgccccttaatctctatgcaatta

SEQ ID NO: 639775 - DNA, 25 bp, Homo sapien
gccccttaatctctatgcaattaaa

SEQ ID NO: 639776 - DNA, 25 bp, Homo sapien
tatataactgcaaaactgccctgag

SEQ ID NO: 639777 - DNA, 25 bp, Homo sapien
ataactgcaaaactgccctgagctg

SEQ ID NO: 639778 - DNA, 25 bp, Homo sapien
acggatggtgcccttatgggagaga

SEQ ID NO: 639779 - DNA, 25 bp, Homo sapien
ttggtttcctgggttacggaatgct

SEQ ID NO: 639780 - DNA, 25 bp, Homo sapien
ttacggaatgctgggtgtgtgtgaa

SEQ ID NO: 639781 - DNA, 25 bp, Homo sapien
gtgtgaagtaggaggcaccagccac

SEQ ID NO: 639782 - DNA, 25 bp, Homo sapien
tgggccccacccttgtgactctggg

SEQ ID NO: 639783 - DNA, 25 bp, Homo sapien
ttctggatgatgacctctccccaga

SEQ ID NO: 639784 - DNA, 25 bp, Homo sapien
tcacccatgatttccccgtggattg

SEQ ID NO: 639785 - DNA, 25 bp, Homo sapien
aaaattcaatgcaaggtccaggtca

SEQ ID NO: 639786 - DNA, 25 bp, Homo sapien
attcaatgcaaggtccaggtcaata

SEQ ID NO: 639787 - DNA, 25 bp, Homo sapien
ggtccaggtcaataatgcacccaaa

SEQ ID NO: 639788 - DNA, 25 bp, Homo sapien
aataatgcacccaaaataaagctga

SEQ ID NO: 639789 - DNA, 25 bp, Homo sapien
ccgggagcctgatcctggcggacca

SEQ ID NO: 639790 - DNA, 25 bp, Homo sapien
tcggacctgtcccatagccgcaagt

SEQ ID NO: 639791 - DNA, 25 bp, Homo sapien
atagccgcaagttcagcgcagcctg

SEQ ID NO: 639792 - DNA, 25 bp, Homo sapien
aagttcagcgcagcctgtaacttca

SEQ ID NO: 639793 - DNA, 25 bp, Homo sapien
gcagcctgtaacttcagcaacattc

SEQ ID NO: 639794 - DNA, 25 bp, Homo sapien
ttcagcaacattctagtgaatcagg

SEQ ID NO: 639795 - DNA, 25 bp, Homo sapien
atctctggatgccacagacctgagc

SEQ ID NO: 639796 - DNA, 25 bp, Homo sapien
aatcctgcaccttccgtttttctgt

SEQ ID NO: 639797 - DNA, 25 bp, Homo sapien
ttttctgtgcttgtacggcctactg

SEQ ID NO: 639798 - DNA, 25 bp, Homo sapien
gcttgtacggcctactgggcttcct

SEQ ID NO: 639799 - DNA, 25 bp, Homo sapien
gggcttcctccctagccagagagct

SEQ ID NO: 639800 - DNA, 25 bp, Homo sapien
gaagaaaaataccttctcactccca

SEQ ID NO: 639801 - DNA, 25 bp, Homo sapien
aatccactccaagcaatagtagtag

SEQ ID NO: 639802 - DNA, 25 bp, Homo sapien
gtagtagagtaacaactcagctgaa

SEQ ID NO: 639803 - DNA, 25 bp, Homo sapien
gtggtagcaagcaagactaaaattt

SEQ ID NO: 639804 - DNA, 25 bp, Homo sapien
gcaataacactgacatctgtctgtc

SEQ ID NO: 639805 - DNA, 25 bp, Homo sapien
acatctgtctgtcttagcccaagta

SEQ ID NO: 639806 - DNA, 25 bp, Homo sapien
ctgtctgtcttagcccaagtatgaa

SEQ ID NO: 639807 - DNA, 25 bp, Homo sapien
gaaattacagaacttagcagacatg

SEQ ID NO: 639808 - DNA, 25 bp, Homo sapien
gacatgtttaaatcttacactctta

SEQ ID NO: 639809 - DNA, 25 bp, Homo sapien
tacactcttacatactttttccaca

SEQ ID NO: 639810 - DNA, 25 bp, Homo sapien
gtttgtgttagcttacatgggatac

SEQ ID NO: 639811 - DNA, 25 bp, Homo sapien
aaggaccgcagcagctgcacgctca

SEQ ID NO: 639812 - DNA, 25 bp, Homo sapien
gcacgctcaccgtctatgacaaaga

SEQ ID NO: 639813 - DNA, 25 bp, Homo sapien
aagtcagttgtagcatccatcaccg

SEQ ID NO: 639814 - DNA, 25 bp, Homo sapien
atccatcaccgagagtctgcagaag

SEQ ID NO: 639815 - DNA, 25 bp, Homo sapien
aagcacctcatgtgagctccagcca

SEQ ID NO: 639816 - DNA, 25 bp, Homo sapien
gcccaggcatcaggaggctgttatg

SEQ ID NO: 639817 - DNA, 25 bp, Homo sapien
atgtggagtttcttggcctgtcctc

SEQ ID NO: 639818 - DNA, 25 bp, Homo sapien
catggcccagtgtaggaagcccagt

SEQ ID NO: 639819 - DNA, 25 bp, Homo sapien
gaagcccagtttgctctctggtgtt

SEQ ID NO: 639820 - DNA, 25 bp, Homo sapien
tgctctctggtgtttgttaatgtaa

SEQ ID NO: 639821 - DNA, 25 bp, Homo sapien
gggcaataaacgtaactcatccttt

SEQ ID NO: 639822 - DNA, 25 bp, Homo sapien
ggtgatatgatttagtttcttgctt

SEQ ID NO: 639823 - DNA, 25 bp, Homo sapien
gttttttgtttgagatcaccgtgaa

SEQ ID NO: 639824 - DNA, 25 bp, Homo sapien
gagatcaccgtgaagcttgcaaata

SEQ ID NO: 639825 - DNA, 25 bp, Homo sapien
gtgaagcttgcaaataccatctttt

SEQ ID NO: 639826 - DNA, 25 bp, Homo sapien
gcaaataccatcttttaaaccatta

SEQ ID NO: 639827 - DNA, 25 bp, Homo sapien
tttaaaccattatttcaatccgata

SEQ ID NO: 639828 - DNA, 25 bp, Homo sapien
aatccgataactacttaacactgtg

SEQ ID NO: 639829 - DNA, 25 bp, Homo sapien
gataactacttaacactgtgtgtat

SEQ ID NO: 639830 - DNA, 25 bp, Homo sapien
gtatatgccttaacttcatccttca

SEQ ID NO: 639831 - DNA, 25 bp, Homo sapien
gccttaacttcatccttcaactttt

SEQ ID NO: 639832 - DNA, 25 bp, Homo sapien
ttcctgtttctatgtatatcttatt

SEQ ID NO: 639833 - DNA, 25 bp, Homo sapien
caaaattatccaggcccatgcctgc

SEQ ID NO: 639834 - DNA, 25 bp, Homo sapien
aaaattatccaggcccatgcctgca

SEQ ID NO: 639835 - DNA, 25 bp, Homo sapien
cctgcatgcctgcaaggctacatgc

SEQ ID NO: 639836 - DNA, 25 bp, Homo sapien
ctgcatgcctgcaaggctacatgcc

SEQ ID NO: 639837 - DNA, 25 bp, Homo sapien
tgcatgcctgcaaggctacatgcct

SEQ ID NO: 639838 - DNA, 25 bp, Homo sapien
gcatgcctgcaaggctacatgcctg

SEQ ID NO: 639839 - DNA, 25 bp, Homo sapien
catgcctgcaaggctacatgcctgt

SEQ ID NO: 639840 - DNA, 25 bp, Homo sapien
atgcctgcaaggctacatgcctgta

SEQ ID NO: 639841 - DNA, 25 bp, Homo sapien
tgcctgcaaggctacatgcctgtag

SEQ ID NO: 639842 - DNA, 25 bp, Homo sapien
tacttggaggccgaagcaagaggat

SEQ ID NO: 639843 - DNA, 25 bp, Homo sapien
acttggaggccgaagcaagaggatt

SEQ ID NO: 639844 - DNA, 25 bp, Homo sapien
gagtagagaggtcttaaccaccgaa

SEQ ID NO: 639845 - DNA, 25 bp, Homo sapien
gtcttaaccaccgaaaacactgata

SEQ ID NO: 639846 - DNA, 25 bp, Homo sapien
gatatctttatgtgggcatgctcat

SEQ ID NO: 639847 - DNA, 25 bp, Homo sapien
gtgggcatgctcatgcaaacacatg

SEQ ID NO: 639848 - DNA, 25 bp, Homo sapien
taaagcacagcctaattgattatat

SEQ ID NO: 639849 - DNA, 25 bp, Homo sapien
ggaccctgggtcagtataaatgcta

SEQ ID NO: 639850 - DNA, 25 bp, Homo sapien
aatgctaatggctgacaaagttcac

SEQ ID NO: 639851 - DNA, 25 bp, Homo sapien
gatgtattgggcttactcctctgta

SEQ ID NO: 639852 - DNA, 25 bp, Homo sapien
tctgtacaatcctcgggttgcctgc

SEQ ID NO: 639853 - DNA, 25 bp, Homo sapien
gttgcctgccagtgtatatgtgtgt

SEQ ID NO: 639854 - DNA, 25 bp, Homo sapien
gggacagacattcatttatggtcat

SEQ ID NO: 639855 - DNA, 25 bp, Homo sapien
gaagattcttaacagggagaccctc

SEQ ID NO: 639856 - DNA, 25 bp, Homo sapien
gagaccctctctgggcttgtggtga

SEQ ID NO: 639857 - DNA, 25 bp, Homo sapien
tctctgggcttgtggtgagatctcc

SEQ ID NO: 639858 - DNA, 25 bp, Homo sapien
acccattgtaaactggtgcatatag

SEQ ID NO: 639859 - DNA, 25 bp, Homo sapien
gtgttgatataacaggcccatgact

SEQ ID NO: 639860 - DNA, 25 bp, Homo sapien
gcccatgacttccagtgttgtcaga

SEQ ID NO: 639861 - DNA, 25 bp, Homo sapien
tcagaaaaggccacctcaggcctgt

SEQ ID NO: 639862 - DNA, 25 bp, Homo sapien
cctgttcaacagaagtgccaacctc

SEQ ID NO: 639863 - DNA, 25 bp, Homo sapien
agaagtgccaacctcaacattcgct

SEQ ID NO: 639864 - DNA, 25 bp, Homo sapien
caacattcgcttcctagaaggctca

SEQ ID NO: 639865 - DNA, 25 bp, Homo sapien
agaaatcagattcaccctcccggtg

SEQ ID NO: 639866 - DNA, 25 bp, Homo sapien
ggaaggaacaccagttccccatgtc

SEQ ID NO: 639867 - DNA, 25 bp, Homo sapien
agaagcccacctcggtacatgccga

SEQ ID NO: 639868 - DNA, 25 bp, Homo sapien
ggtacatgccgaagaagccctccgc

SEQ ID NO: 639869 - DNA, 25 bp, Homo sapien
gcccgagccgtcttcatcaggcagt

SEQ ID NO: 639870 - DNA, 25 bp, Homo sapien
catcaggcagtcgatcctggaagca

SEQ ID NO: 639871 - DNA, 25 bp, Homo sapien
aggagcgggaggcagactgtgaaca

SEQ ID NO: 639872 - DNA, 25 bp, Homo sapien
agagtagatgatagtgggcctttca

SEQ ID NO: 639873 - DNA, 25 bp, Homo sapien
atgatagtgggcctttcacaaagga

SEQ ID NO: 639874 - DNA, 25 bp, Homo sapien
tagtgggcctttcacaaaggaagaa

SEQ ID NO: 639875 - DNA, 25 bp, Homo sapien
cacaaaggaagaaacttgggacgat

SEQ ID NO: 639876 - DNA, 25 bp, Homo sapien
aacttgggacgataaagagaactgt

SEQ ID NO: 639877 - DNA, 25 bp, Homo sapien
ttgaaaaaaattcatgtggcctggc

SEQ ID NO: 639878 - DNA, 25 bp, Homo sapien
tgaaaaaaattcatgtggcctggca

SEQ ID NO: 639879 - DNA, 25 bp, Homo sapien
gaaaaaaattcatgtggcctggcat

SEQ ID NO: 639880 - DNA, 25 bp, Homo sapien
aaaaaaattcatgtggcctggcatg

SEQ ID NO: 639881 - DNA, 25 bp, Homo sapien
aaaaaattcatgtggcctggcatgg

SEQ ID NO: 639882 - DNA, 25 bp, Homo sapien
aaaaattcatgtggcctggcatggt

SEQ ID NO: 639883 - DNA, 25 bp, Homo sapien
aaaattcatgtggcctggcatggtg

SEQ ID NO: 639884 - DNA, 25 bp, Homo sapien
aaattcatgtggcctggcatggtgg

SEQ ID NO: 639885 - DNA, 25 bp, Homo sapien
aattcatgtggcctggcatggtggc

SEQ ID NO: 639886 - DNA, 25 bp, Homo sapien
attcatgtggcctggcatggtggct

SEQ ID NO: 639887 - DNA, 25 bp, Homo sapien
ttcatgtggcctggcatggtggctc

SEQ ID NO: 639888 - DNA, 25 bp, Homo sapien
ctcagccttgctaggtccagaagta

SEQ ID NO: 639889 - DNA, 25 bp, Homo sapien
gctaggtccagaagtaggtgccatt

SEQ ID NO: 639890 - DNA, 25 bp, Homo sapien
aagtaggtgccattgacccaccttc

SEQ ID NO: 639891 - DNA, 25 bp, Homo sapien
atgcaacattgttatacctacacaa

SEQ ID NO: 639892 - DNA, 25 bp, Homo sapien
gttatacctacacaaaagcgttctg

SEQ ID NO: 639893 - DNA, 25 bp, Homo sapien
aaaagcgttctgtgattcctatggc

SEQ ID NO: 639894 - DNA, 25 bp, Homo sapien
gcgttctgtgattcctatggcttaa

SEQ ID NO: 639895 - DNA, 25 bp, Homo sapien
gttaatgacattcaaggcatgcctt

SEQ ID NO: 639896 - DNA, 25 bp, Homo sapien
attattcacactagctgacctgtct

SEQ ID NO: 639897 - DNA, 25 bp, Homo sapien
agctgacctgtctgattaatcataa

SEQ ID NO: 639898 - DNA, 25 bp, Homo sapien
gggcagatttattcatcctttacct

SEQ ID NO: 639899 - DNA, 25 bp, Homo sapien
tgcagctctagtgctggaaagccct

SEQ ID NO: 639900 - DNA, 25 bp, Homo sapien
gcagctctagtgctggaaagccctg

SEQ ID NO: 639901 - DNA, 25 bp, Homo sapien
gaagggccagatttggaagcatgca

SEQ ID NO: 639902 - DNA, 25 bp, Homo sapien
gggccagatttggaagcatgcagac

SEQ ID NO: 639903 - DNA, 25 bp, Homo sapien
tttggaagcatgcagacagcctttc

SEQ ID NO: 639904 - DNA, 25 bp, Homo sapien
tttcccccaagaatgagactctcca

SEQ ID NO: 639905 - DNA, 25 bp, Homo sapien
caagaatgagactctccaccacctg

SEQ ID NO: 639906 - DNA, 25 bp, Homo sapien
caccacctggaaacaacttgccgag

SEQ ID NO: 639907 - DNA, 25 bp, Homo sapien
ccacctggaaacaacttgccgaggg

SEQ ID NO: 639908 - DNA, 25 bp, Homo sapien
ctggaaacaacttgccgagggccaa

SEQ ID NO: 639909 - DNA, 25 bp, Homo sapien
tggaaacaacttgccgagggccaag

SEQ ID NO: 639910 - DNA, 25 bp, Homo sapien
tgtgttgtgaacattcccgttgtgc

SEQ ID NO: 639911 - DNA, 25 bp, Homo sapien
tgaacattcccgttgtgctctctta

SEQ ID NO: 639912 - DNA, 25 bp, Homo sapien
ccgttgtgctctcttagttattctg

SEQ ID NO: 639913 - DNA, 25 bp, Homo sapien
gtacaagaaattattgctgactata

SEQ ID NO: 639914 - DNA, 25 bp, Homo sapien
atcaaatactagacctcattcgtgg

SEQ ID NO: 639915 - DNA, 25 bp, Homo sapien
actagacctcattcgtggtatctaa

SEQ ID NO: 639916 - DNA, 25 bp, Homo sapien
cctcattcgtggtatctaactatat

SEQ ID NO: 639917 - DNA, 25 bp, Homo sapien
catccttcgtctatctccacgagtt

SEQ ID NO: 639918 - DNA, 25 bp, Homo sapien
gtctatctccacgagttcaattgaa

SEQ ID NO: 639919 - DNA, 25 bp, Homo sapien
atccatcccttcaagcattcatgat

SEQ ID NO: 639920 - DNA, 25 bp, Homo sapien
ccttcaagcattcatgatttctttg

SEQ ID NO: 639921 - DNA, 25 bp, Homo sapien
aagtattttctttactgaatgtaag

SEQ ID NO: 639922 - DNA, 25 bp, Homo sapien
tactgaatgtaagtataaatgcttt

SEQ ID NO: 639923 - DNA, 25 bp, Homo sapien
aatgctttaaattgttacttgactc

SEQ ID NO: 639924 - DNA, 25 bp, Homo sapien
atgctttaaattgttacttgactca

SEQ ID NO: 639925 - DNA, 25 bp, Homo sapien
tgctttaaattgttacttgactcag

SEQ ID NO: 639926 - DNA, 25 bp, Homo sapien
ttacttgactcagtttttaaaggtg

SEQ ID NO: 639927 - DNA, 25 bp, Homo sapien
tacttgactcagtttttaaaggtgt

SEQ ID NO: 639928 - DNA, 25 bp, Homo sapien
atgagatatgtagttaagtgatttc

SEQ ID NO: 639929 - DNA, 25 bp, Homo sapien
aagtgatttctgatttatcttagaa

SEQ ID NO: 639930 - DNA, 25 bp, Homo sapien
tattttgttatatatggctgaaaaa

SEQ ID NO: 639931 - DNA, 25 bp, Homo sapien
atatggctgaaaaagagaatttctt

SEQ ID NO: 639932 - DNA, 25 bp, Homo sapien
ttattccagataactgggctaggaa

SEQ ID NO: 639933 - DNA, 25 bp, Homo sapien
agataactgggctaggaatggaaat

SEQ ID NO: 639934 - DNA, 25 bp, Homo sapien
ggaatggaaataggttgtacaccca

SEQ ID NO: 639935 - DNA, 25 bp, Homo sapien
ggaaataggttgtacacccattgtc

SEQ ID NO: 639936 - DNA, 25 bp, Homo sapien
gaaataggttgtacacccattgtct

SEQ ID NO: 639937 - DNA, 25 bp, Homo sapien
aataggttgtacacccattgtcttt

SEQ ID NO: 639938 - DNA, 25 bp, Homo sapien
ataggttgtacacccattgtctttt

SEQ ID NO: 639939 - DNA, 25 bp, Homo sapien
taggttgtacacccattgtctttta

SEQ ID NO: 639940 - DNA, 25 bp, Homo sapien
aacacagagagacctagtctcttaa

SEQ ID NO: 639941 - DNA, 25 bp, Homo sapien
aaaaatcttattccagataactggg

SEQ ID NO: 639942 - DNA, 25 bp, Homo sapien
atcttattccagataactgggctag

SEQ ID NO: 639943 - DNA, 25 bp, Homo sapien
aatagccacttattagttcctgcct

SEQ ID NO: 639944 - DNA, 25 bp, Homo sapien
agccacttattagttcctgcctcaa

SEQ ID NO: 639945 - DNA, 25 bp, Homo sapien
ccacttattagttcctgcctcaact

SEQ ID NO: 639946 - DNA, 25 bp, Homo sapien
gacaatgaatctcaggagctcccca

SEQ ID NO: 639947 - DNA, 25 bp, Homo sapien
agagaacaccccctttcactgtaat

SEQ ID NO: 639948 - DNA, 25 bp, Homo sapien
ttcactgtaattttccacgacctgc

SEQ ID NO: 639949 - DNA, 25 bp, Homo sapien
gtaattttccacgacctgcccgaat

SEQ ID NO: 639950 - DNA, 25 bp, Homo sapien
gacctgcccgaatcctataaaactg

SEQ ID NO: 639951 - DNA, 25 bp, Homo sapien
tgactccttttacggactcagtctg

SEQ ID NO: 639952 - DNA, 25 bp, Homo sapien
ttttacggactcagtctgcctgcat

SEQ ID NO: 639953 - DNA, 25 bp, Homo sapien
ttacggactcagtctgcctgcatcc

SEQ ID NO: 639954 - DNA, 25 bp, Homo sapien
ggaatacaagcgcaagccaccgcgc

SEQ ID NO: 639955 - DNA, 25 bp, Homo sapien
ctcatagtctctttctcagaggctt

SEQ ID NO: 639956 - DNA, 25 bp, Homo sapien
tttctcagaggctttggcttcatgt

SEQ ID NO: 639957 - DNA, 25 bp, Homo sapien
ttggcttcatgtgggaatggtctct

SEQ ID NO: 639958 - DNA, 25 bp, Homo sapien
ggcaggactttgaacctcatccctg

SEQ ID NO: 639959 - DNA, 25 bp, Homo sapien
tttgaacctcatccctgccgtattg

SEQ ID NO: 639960 - DNA, 25 bp, Homo sapien
cctgccgtattgtccccaataaggg

SEQ ID NO: 639961 - DNA, 25 bp, Homo sapien
tgcctagcagtcagaatggaagcct

SEQ ID NO: 639962 - DNA, 25 bp, Homo sapien
atggaagcctagaacgaatctcaga

SEQ ID NO: 639963 - DNA, 25 bp, Homo sapien
gcctagaacgaatctcagagctggg

SEQ ID NO: 639964 - DNA, 25 bp, Homo sapien
gatattaaaggtctcctagtctgaa

SEQ ID NO: 639965 - DNA, 25 bp, Homo sapien
attcacttctcttaatcgaaaaatc

SEQ ID NO: 639966 - DNA, 25 bp, Homo sapien
ttcacttctcttaatcgaaaaatca

SEQ ID NO: 639967 - DNA, 25 bp, Homo sapien
tcacttctcttaatcgaaaaatcac

SEQ ID NO: 639968 - DNA, 25 bp, Homo sapien
acttctcttaatcgaaaaatcacac

SEQ ID NO: 639969 - DNA, 25 bp, Homo sapien
tctcttaatcgaaaaatcacacagg

SEQ ID NO: 639970 - DNA, 25 bp, Homo sapien
tcttaatcgaaaaatcacacaggct

SEQ ID NO: 639971 - DNA, 25 bp, Homo sapien
cttaatcgaaaaatcacacaggctg

SEQ ID NO: 639972 - DNA, 25 bp, Homo sapien
ttaatcgaaaaatcacacaggctgg

SEQ ID NO: 639973 - DNA, 25 bp, Homo sapien
taatcgaaaaatcacacaggctggg

SEQ ID NO: 639974 - DNA, 25 bp, Homo sapien
aatcgaaaaatcacacaggctgggt

SEQ ID NO: 639975 - DNA, 25 bp, Homo sapien
atcgaaaaatcacacaggctgggtg

SEQ ID NO: 639976 - DNA, 25 bp, Homo sapien
tgcattcccagacggatcaccaagg

SEQ ID NO: 639977 - DNA, 25 bp, Homo sapien
attcccagacggatcaccaaggatt

SEQ ID NO: 639978 - DNA, 25 bp, Homo sapien
agacggatcaccaaggattcagacc

SEQ ID NO: 639979 - DNA, 25 bp, Homo sapien
ggatcaccaaggattcagaccgata

SEQ ID NO: 639980 - DNA, 25 bp, Homo sapien
accaaggattcagaccgataccaat

SEQ ID NO: 639981 - DNA, 25 bp, Homo sapien
gagaaatatgggtttagtcaccaag

SEQ ID NO: 639982 - DNA, 25 bp, Homo sapien
tatgggtttagtcaccaaggaagaa

SEQ ID NO: 639983 - DNA, 25 bp, Homo sapien
gaaggcagtaaatagctttgaacac

SEQ ID NO: 639984 - DNA, 25 bp, Homo sapien
atagctttgaacactcacatttaca

SEQ ID NO: 639985 - DNA, 25 bp, Homo sapien
gaacactcacatttacactctaata

SEQ ID NO: 639986 - DNA, 25 bp, Homo sapien
tcacatttacactctaatatatctg

SEQ ID NO: 639987 - DNA, 25 bp, Homo sapien
gtcattacaatagcaacttctgttg

SEQ ID NO: 639988 - DNA, 25 bp, Homo sapien
cttctgttgataagttggtggacaa

SEQ ID NO: 639989 - DNA, 25 bp, Homo sapien
ggtggacaagcgcaaccaagcctaa

SEQ ID NO: 639990 - DNA, 25 bp, Homo sapien
caagcctaaaggcaagtgctgttgc

SEQ ID NO: 639991 - DNA, 25 bp, Homo sapien
aagtgctgttgcgaggtcgacatcc

SEQ ID NO: 639992 - DNA, 25 bp, Homo sapien
ttgcgaggtcgacatccaggaacca

SEQ ID NO: 639993 - DNA, 25 bp, Homo sapien
ggtcgacatccaggaaccagaggag

SEQ ID NO: 639994 - DNA, 25 bp, Homo sapien
gaggagggcagagcaatccacagaa

SEQ ID NO: 639995 - DNA, 25 bp, Homo sapien
gagcaatccacagaatggatctggg

SEQ ID NO: 639996 - DNA, 25 bp, Homo sapien
tggaaaattataccatacccagaat

SEQ ID NO: 639997 - DNA, 25 bp, Homo sapien
atagagggtatattgcatttacatt

SEQ ID NO: 639998 - DNA, 25 bp, Homo sapien
aatacagatcagctccgcaagccct

SEQ ID NO: 639999 - DNA, 25 bp, Homo sapien
gctccgcaagccctagaaatagcaa

SEQ ID NO: 640000 - DNA, 25 bp, Homo sapien
ctggcctgccatgagaaatacctca

SEQ ID NO: 640001 - DNA, 25 bp, Homo sapien
gagaaatacctcaagagtactccag

SEQ ID NO: 640002 - DNA, 25 bp, Homo sapien
agagtactccagagaattccacaag

SEQ ID NO: 640003 - DNA, 25 bp, Homo sapien
gagaattccacaaggcccagaaata

SEQ ID NO: 640004 - DNA, 25 bp, Homo sapien
aaaactatacgtaaatctgctcagg

SEQ ID NO: 640005 - DNA, 25 bp, Homo sapien
aatctgctcaggatattcaacagct

SEQ ID NO: 640006 - DNA, 25 bp, Homo sapien
caggatattcaacagctagccagtg

SEQ ID NO: 640007 - DNA, 25 bp, Homo sapien
agctagccagtgcatatgacatata

SEQ ID NO: 640008 - DNA, 25 bp, Homo sapien
gcatatgacatatactgggtactta

SEQ ID NO: 640009 - DNA, 25 bp, Homo sapien
tcttattccagataactgggctagg

SEQ ID NO: 640010 - DNA, 25 bp, Homo sapien
tattccagataactgggctaggaat

SEQ ID NO: 640011 - DNA, 25 bp, Homo sapien
agataactgggctaggaatggaaat

SEQ ID NO: 640012 - DNA, 25 bp, Homo sapien
ggaatggaaataggttgtacaccca

SEQ ID NO: 640013 - DNA, 25 bp, Homo sapien
ggaaataggttgtacacccattgtc

SEQ ID NO: 640014 - DNA, 25 bp, Homo sapien
gaaataggttgtacacccattgtct

SEQ ID NO: 640015 - DNA, 25 bp, Homo sapien
aataggttgtacacccattgtcttt

SEQ ID NO: 640016 - DNA, 25 bp, Homo sapien
ataggttgtacacccattgtctttt

SEQ ID NO: 640017 - DNA, 25 bp, Homo sapien
taggttgtacacccattgtctttta

SEQ ID NO: 640018 - DNA, 25 bp, Homo sapien
aaaaatcttattccagataactggg

SEQ ID NO: 640019 - DNA, 25 bp, Homo sapien
aatcttattccagataactgggcta

SEQ ID NO: 640020 - DNA, 25 bp, Homo sapien
attgcttagagcttcacgttggtgg

SEQ ID NO: 640021 - DNA, 25 bp, Homo sapien
ggtgggaagcttgtttggtcataaa

SEQ ID NO: 640022 - DNA, 25 bp, Homo sapien
ggtcataaaaagaactgccaagcac

SEQ ID NO: 640023 - DNA, 25 bp, Homo sapien
gaactgccaagcacagatacgctat

SEQ ID NO: 640024 - DNA, 25 bp, Homo sapien
agatacgctatgaccctgcaggttc

SEQ ID NO: 640025 - DNA, 25 bp, Homo sapien
gagaggcaacacatcttcattggag

SEQ ID NO: 640026 - DNA, 25 bp, Homo sapien
ggacagttgaatatgtctcctctga

SEQ ID NO: 640027 - DNA, 25 bp, Homo sapien
atatgtctcctctgacacaactaca

SEQ ID NO: 640028 - DNA, 25 bp, Homo sapien
catcctccccacctaatgaaataaa

SEQ ID NO: 640029 - DNA, 25 bp, Homo sapien
ttctgttgtttaattgcacctaata

SEQ ID NO: 640030 - DNA, 25 bp, Homo sapien
acttcttacacggatcagcaattca

SEQ ID NO: 640031 - DNA, 25 bp, Homo sapien
ataggttttaactaggctgggtatg

SEQ ID NO: 640032 - DNA, 25 bp, Homo sapien
taggttttaactaggctgggtatgg

SEQ ID NO: 640033 - DNA, 25 bp, Homo sapien
gccagtaattgcagcctcccttagg

SEQ ID NO: 640034 - DNA, 25 bp, Homo sapien
ccagtaattgcagcctcccttagga

SEQ ID NO: 640035 - DNA, 25 bp, Homo sapien
cagtaattgcagcctcccttaggag

SEQ ID NO: 640036 - DNA, 25 bp, Homo sapien
agtaattgcagcctcccttaggagg

SEQ ID NO: 640037 - DNA, 25 bp, Homo sapien
gtaattgcagcctcccttaggaggc

SEQ ID NO: 640038 - DNA, 25 bp, Homo sapien
taattgcagcctcccttaggaggct

SEQ ID NO: 640039 - DNA, 25 bp, Homo sapien
aattgcagcctcccttaggaggctg

SEQ ID NO: 640040 - DNA, 25 bp, Homo sapien
ttgcagcctcccttaggaggctgag

SEQ ID NO: 640041 - DNA, 25 bp, Homo sapien
tgcagcctcccttaggaggctgagg

SEQ ID NO: 640042 - DNA, 25 bp, Homo sapien
attagaagtgaattgggctgggtac

SEQ ID NO: 640043 - DNA, 25 bp, Homo sapien
ttagaagtgaattgggctgggtaca

SEQ ID NO: 640044 - DNA, 25 bp, Homo sapien
tagaagtgaattgggctgggtacag

SEQ ID NO: 640045 - DNA, 25 bp, Homo sapien
tgggctgggtacagtagctcagacc

SEQ ID NO: 640046 - DNA, 25 bp, Homo sapien
gggctgggtacagtagctcagacct

SEQ ID NO: 640047 - DNA, 25 bp, Homo sapien
catctctattaaaagtccaaaattt

SEQ ID NO: 640048 - DNA, 25 bp, Homo sapien
tctctattaaaagtccaaaatttag

SEQ ID NO: 640049 - DNA, 25 bp, Homo sapien
aagtccaaaatttagccgggcattg

SEQ ID NO: 640050 - DNA, 25 bp, Homo sapien
agtccaaaatttagccgggcattgt

SEQ ID NO: 640051 - DNA, 25 bp, Homo sapien
aattgcctgaacccaagtggcagag

SEQ ID NO: 640052 - DNA, 25 bp, Homo sapien
tgcctgaacccaagtggcagaggtt

SEQ ID NO: 640053 - DNA, 25 bp, Homo sapien
ttggaaaagtctgcagtcccaggga

SEQ ID NO: 640054 - DNA, 25 bp, Homo sapien
gatgggttaaatgctgtttgttgac

SEQ ID NO: 640055 - DNA, 25 bp, Homo sapien
tgctgtttgttgactgtggactgca

SEQ ID NO: 640056 - DNA, 25 bp, Homo sapien
gtggactgcagatggctcagctctt

SEQ ID NO: 640057 - DNA, 25 bp, Homo sapien
agatggctcagctcttaccttgaca

SEQ ID NO: 640058 - DNA, 25 bp, Homo sapien
gctcagctcttaccttgacaaggac

SEQ ID NO: 640059 - DNA, 25 bp, Homo sapien
taccttgacaaggacggtgaggacg

SEQ ID NO: 640060 - DNA, 25 bp, Homo sapien
tgaggacggcagacatgggcgcccg

SEQ ID NO: 640061 - DNA, 25 bp, Homo sapien
cagacactgggagcccatggccaaa

SEQ ID NO: 640062 - DNA, 25 bp, Homo sapien
actgggagcccatggccaaactggt

SEQ ID NO: 640063 - DNA, 25 bp, Homo sapien
gcccatggccaaactggtgtgtctt

SEQ ID NO: 640064 - DNA, 25 bp, Homo sapien
tgttaaccattttctcaacttgtcc

SEQ ID NO: 640065 - DNA, 25 bp, Homo sapien
attttctcaacttgtcccttcatgc

SEQ ID NO: 640066 - DNA, 25 bp, Homo sapien
gtcccttcatgcctagaggtaatag

SEQ ID NO: 640067 - DNA, 25 bp, Homo sapien
gaatgctgtgctattccatttggtt

SEQ ID NO: 640068 - DNA, 25 bp, Homo sapien
gtgctattccatttggttttcctgc

SEQ ID NO: 640069 - DNA, 25 bp, Homo sapien
tgcacccttcccatgtttgtatgta

SEQ ID NO: 640070 - DNA, 25 bp, Homo sapien
tttgtatgtagtccctttcatcaaa

SEQ ID NO: 640071 - DNA, 25 bp, Homo sapien
tcatcaaagtactgggactgtccta

SEQ ID NO: 640072 - DNA, 25 bp, Homo sapien
gactgtcctaattcgaatgtgccat

SEQ ID NO: 640073 - DNA, 25 bp, Homo sapien
gaactgttcaactcactctggatac

SEQ ID NO: 640074 - DNA, 25 bp, Homo sapien
tcaactcactctggatacactcaat

SEQ ID NO: 640075 - DNA, 25 bp, Homo sapien
tctcaccttggtttgtaatcatctc

SEQ ID NO: 640076 - DNA, 25 bp, Homo sapien
tcaccttggtttgtaatcatctcca

SEQ ID NO: 640077 - DNA, 25 bp, Homo sapien
ccttggtttgtaatcatctccatgt

SEQ ID NO: 640078 - DNA, 25 bp, Homo sapien
aatcatctccatgtgtcaagaatgg

SEQ ID NO: 640079 - DNA, 25 bp, Homo sapien
atcatctccatgtgtcaagaatggg

SEQ ID NO: 640080 - DNA, 25 bp, Homo sapien
gagttcccctgcacaggctcttttt

SEQ ID NO: 640081 - DNA, 25 bp, Homo sapien
gttcccctgcacaggctctttttgc

SEQ ID NO: 640082 - DNA, 25 bp, Homo sapien
ttgcctgccaccatggaagacaccc

SEQ ID NO: 640083 - DNA, 25 bp, Homo sapien
ccctagctatgtggaattgtgagtg

SEQ ID NO: 640084 - DNA, 25 bp, Homo sapien
ctagctatgtggaattgtgagtgca

SEQ ID NO: 640085 - DNA, 25 bp, Homo sapien
ctatgtggaattgtgagtgcattaa

SEQ ID NO: 640086 - DNA, 25 bp, Homo sapien
agagaaattccatggccaaatcctg

SEQ ID NO: 640087 - DNA, 25 bp, Homo sapien
gggcactccaatattgggagggtaa

SEQ ID NO: 640088 - DNA, 25 bp, Homo sapien
tgaaaggcagcatctaggaagtcat

SEQ ID NO: 640089 - DNA, 25 bp, Homo sapien
aggaagtcatgaaagctagcgctga

SEQ ID NO: 640090 - DNA, 25 bp, Homo sapien
gctagcgctgagttgtggaatccct

SEQ ID NO: 640091 - DNA, 25 bp, Homo sapien
ctgagttgtggaatccctgggcaga

SEQ ID NO: 640092 - DNA, 25 bp, Homo sapien
gtttcaggtaggaggcatcagctga

SEQ ID NO: 640093 - DNA, 25 bp, Homo sapien
aggcatcagctgagcggtgtgataa

SEQ ID NO: 640094 - DNA, 25 bp, Homo sapien
agcggtgtgataaacttgggccaga

SEQ ID NO: 640095 - DNA, 25 bp, Homo sapien
gtttttaaacttcatgagctgatta

SEQ ID NO: 640096 - DNA, 25 bp, Homo sapien
tgattaaaccacacagatgagctgt

SEQ ID NO: 640097 - DNA, 25 bp, Homo sapien
gatcagtcagctacaaacaaatgtc

SEQ ID NO: 640098 - DNA, 25 bp, Homo sapien
atcagtcagctacaaacaaatgtca

SEQ ID NO: 640099 - DNA, 25 bp, Homo sapien
tcagtcagctacaaacaaatgtcag

SEQ ID NO: 640100 - DNA, 25 bp, Homo sapien
cagtcagctacaaacaaatgtcagt

SEQ ID NO: 640101 - DNA, 25 bp, Homo sapien
agtcagctacaaacaaatgtcagta

SEQ ID NO: 640102 - DNA, 25 bp, Homo sapien
gtcagctacaaacaaatgtcagtat

SEQ ID NO: 640103 - DNA, 25 bp, Homo sapien
tcagctacaaacaaatgtcagtata

SEQ ID NO: 640104 - DNA, 25 bp, Homo sapien
cagctacaaacaaatgtcagtataa

SEQ ID NO: 640105 - DNA, 25 bp, Homo sapien
agctacaaacaaatgtcagtataag

SEQ ID NO: 640106 - DNA, 25 bp, Homo sapien
gctacaaacaaatgtcagtataaga

SEQ ID NO: 640107 - DNA, 25 bp, Homo sapien
aacaaagttggaccctgcgatggtt

SEQ ID NO: 640108 - DNA, 25 bp, Homo sapien
gttggaccctgcgatggttaacttc

SEQ ID NO: 640109 - DNA, 25 bp, Homo sapien
gaccctgcgatggttaacttcatgt

SEQ ID NO: 640110 - DNA, 25 bp, Homo sapien
tgcgatggttaacttcatgtgtcat

SEQ ID NO: 640111 - DNA, 25 bp, Homo sapien
ttcatgtgtcatcttgggtaggcca

SEQ ID NO: 640112 - DNA, 25 bp, Homo sapien
gtgtcatcttgggtaggccacatta

SEQ ID NO: 640113 - DNA, 25 bp, Homo sapien
gtaggccacattacccagatatttg

SEQ ID NO: 640114 - DNA, 25 bp, Homo sapien
aaaataccagtctgaatgttgctgt

SEQ ID NO: 640115 - DNA, 25 bp, Homo sapien
ataattgcgcagatttatagcatgc

SEQ ID NO: 640116 - DNA, 25 bp, Homo sapien
gatttatagcatgcaaagttgtgtt

SEQ ID NO: 640117 - DNA, 25 bp, Homo sapien
gcaaagttgtgttataatctatgaa

SEQ ID NO: 640118 - DNA, 25 bp, Homo sapien
tgctgctgtctcagtttacctgggc

SEQ ID NO: 640119 - DNA, 25 bp, Homo sapien
gtctcagtttacctgggcagttgcc

SEQ ID NO: 640120 - DNA, 25 bp, Homo sapien
ttacctgggcagttgcccctggcta

SEQ ID NO: 640121 - DNA, 25 bp, Homo sapien
ttgcccctggctatccggctgggat

SEQ ID NO: 640122 - DNA, 25 bp, Homo sapien
tccggctgggatgggacttggactt

SEQ ID NO: 640123 - DNA, 25 bp, Homo sapien
acttggacttagaagcaggcccctc

SEQ ID NO: 640124 - DNA, 25 bp, Homo sapien
tcctctggaaagctgtgtcctcggg

SEQ ID NO: 640125 - DNA, 25 bp, Homo sapien
tctggaaagctgtgtcctcgggcca

SEQ ID NO: 640126 - DNA, 25 bp, Homo sapien
tctaccttcctgagacagggaccct

SEQ ID NO: 640127 - DNA, 25 bp, Homo sapien
aagactggaatcagcagcaccttga

SEQ ID NO: 640128 - DNA, 25 bp, Homo sapien
ctggaatcagcagcaccttgatatt

SEQ ID NO: 640129 - DNA, 25 bp, Homo sapien
ggaccgtgggatactcaccccttag

SEQ ID NO: 640130 - DNA, 25 bp, Homo sapien
gaccgtgggatactcaccccttagg

SEQ ID NO: 640131 - DNA, 25 bp, Homo sapien
cggagccccgttgccgctcggcacg

SEQ ID NO: 640132 - DNA, 25 bp, Homo sapien
tcttcctccattttgatctccgtcg

SEQ ID NO: 640133 - DNA, 25 bp, Homo sapien
tccattttgatctccgtcgccgcca

SEQ ID NO: 640134 - DNA, 25 bp, Homo sapien
gcgtctgggctttgtgtgagcgaac

SEQ ID NO: 640135 - DNA, 25 bp, Homo sapien
ctttgtgtgagcgaacgggctgcac

SEQ ID NO: 640136 - DNA, 25 bp, Homo sapien
tttgtgtgagcgaacgggctgcacc

SEQ ID NO: 640137 - DNA, 25 bp, Homo sapien
ccacgtgacccgacgcaaccagtaa

SEQ ID NO: 640138 - DNA, 25 bp, Homo sapien
gacccgacgcaaccagtaacacctg

SEQ ID NO: 640139 - DNA, 25 bp, Homo sapien
acgcaaccagtaacacctgcgcccg

SEQ ID NO: 640140 - DNA, 25 bp, Homo sapien
tgcccgcacactctttacggcagaa

SEQ ID NO: 640141 - DNA, 25 bp, Homo sapien
gcacactctttacggcagaagcagt

SEQ ID NO: 640142 - DNA, 25 bp, Homo sapien
tttacggcagaagcagtgacatttc

SEQ ID NO: 640143 - DNA, 25 bp, Homo sapien
agcagtgacatttcccttgctgtgc

SEQ ID NO: 640144 - DNA, 25 bp, Homo sapien
tgacatttcccttgctgtgcccatg

SEQ ID NO: 640145 - DNA, 25 bp, Homo sapien
tttcccttgctgtgcccatggcagg

SEQ ID NO: 640146 - DNA, 25 bp, Homo sapien
cagggacgggcccatggcaggtgct

SEQ ID NO: 640147 - DNA, 25 bp, Homo sapien
cccatggcaggtgctgtgagcatgt

SEQ ID NO: 640148 - DNA, 25 bp, Homo sapien
agcccagagggccacattcttgtca

SEQ ID NO: 640149 - DNA, 25 bp, Homo sapien
cagagggccacattcttgtcactgc

SEQ ID NO: 640150 - DNA, 25 bp, Homo sapien
ttcttggagccgcagctcatgccaa

SEQ ID NO: 640151 - DNA, 25 bp, Homo sapien
tggaccaaacgttctgcacagagat

SEQ ID NO: 640152 - DNA, 25 bp, Homo sapien
aaacgttctgcacagagatgcccat

SEQ ID NO: 640153 - DNA, 25 bp, Homo sapien
gttctgcacagagatgcccattccg

SEQ ID NO: 640154 - DNA, 25 bp, Homo sapien
gttaaaaagcgaacgatctcaccat

SEQ ID NO: 640155 - DNA, 25 bp, Homo sapien
aaaaagcgaacgatctcaccatgaa

SEQ ID NO: 640156 - DNA, 25 bp, Homo sapien
aaagcgaacgatctcaccatgaaat

SEQ ID NO: 640157 - DNA, 25 bp, Homo sapien
gcgaacgatctcaccatgaaattta

SEQ ID NO: 640158 - DNA, 25 bp, Homo sapien
aacgatctcaccatgaaatttaaag

SEQ ID NO: 640159 - DNA, 25 bp, Homo sapien
tttaaagtagccattcagatatatt

SEQ ID NO: 640160 - DNA, 25 bp, Homo sapien
gaaaggccatgttatgatggtgagt

SEQ ID NO: 640161 - DNA, 25 bp, Homo sapien
gaagcaggacgcaatatagcaatgc

SEQ ID NO: 640162 - DNA, 25 bp, Homo sapien
ttgcaactatcctctattctttttc

SEQ ID NO: 640163 - DNA, 25 bp, Homo sapien
gggaaggtttttactgataatcatc

SEQ ID NO: 640164 - DNA, 25 bp, Homo sapien
ataatcatcctatcctgagtcatcc

SEQ ID NO: 640165 - DNA, 25 bp, Homo sapien
tgagtcatcccacaaaccaatctgt

SEQ ID NO: 640166 - DNA, 25 bp, Homo sapien
aaaccaatctgtctcactaatcatt

SEQ ID NO: 640167 - DNA, 25 bp, Homo sapien
actaatcattgcttctaacctacag

SEQ ID NO: 640168 - DNA, 25 bp, Homo sapien
taacctacagactaagcataacttc

SEQ ID NO: 640169 - DNA, 25 bp, Homo sapien
ataacttctgctaaatgatctttga

SEQ ID NO: 640170 - DNA, 25 bp, Homo sapien
ctttgataagatgctatgactctat

SEQ ID NO: 640171 - DNA, 25 bp, Homo sapien
aatctttcacttctacaattgggag

SEQ ID NO: 640172 - DNA, 25 bp, Homo sapien
ttaaacagttcctctatcacgcttt

SEQ ID NO: 640173 - DNA, 25 bp, Homo sapien
gggagcacatctttgctcaacaaga

SEQ ID NO: 640174 - DNA, 25 bp, Homo sapien
gctcaacaagagatcctgacaacta

SEQ ID NO: 640175 - DNA, 25 bp, Homo sapien
aacaactaacaaccatctgcctgag

SEQ ID NO: 640176 - DNA, 25 bp, Homo sapien
tctgcctgagacacagttcgagttt

SEQ ID NO: 640177 - DNA, 25 bp, Homo sapien
ttttaagatgcatcagttccccttt

SEQ ID NO: 640178 - DNA, 25 bp, Homo sapien
gcctgaagcctcatcatcaaacaat

SEQ ID NO: 640179 - DNA, 25 bp, Homo sapien
atgcttccaatgcttggcatgttta

SEQ ID NO: 640180 - DNA, 25 bp, Homo sapien
attagagcttgcttccttggcaatt

SEQ ID NO: 640181 - DNA, 25 bp, Homo sapien
ttggcaattatgtgaggcaaccctc

SEQ ID NO: 640182 - DNA, 25 bp, Homo sapien
gaggcaaccctcaaactttccagag

SEQ ID NO: 640183 - DNA, 25 bp, Homo sapien
tggtatttcaaggtcatgcatctat

SEQ ID NO: 640184 - DNA, 25 bp, Homo sapien
tttgactgtttagaataatgctgct

SEQ ID NO: 640185 - DNA, 25 bp, Homo sapien
tggatgtatgttttcggtcctcttg

SEQ ID NO: 640186 - DNA, 25 bp, Homo sapien
atgttttcggtcctcttggttatat

SEQ ID NO: 640187 - DNA, 25 bp, Homo sapien
ttttcggtcctcttggttatatatt

SEQ ID NO: 640188 - DNA, 25 bp, Homo sapien
tttaggagtgacatttctgggtcat

SEQ ID NO: 640189 - DNA, 25 bp, Homo sapien
tagggtaattctatgcctaacattc

SEQ ID NO: 640190 - DNA, 25 bp, Homo sapien
caaagtggctgtgcccttttacctt

SEQ ID NO: 640191 - DNA, 25 bp, Homo sapien
agcaatgtacgaggtttccaattcc

SEQ ID NO: 640192 - DNA, 25 bp, Homo sapien
gaggtttccaattcctctatatcct

SEQ ID NO: 640193 - DNA, 25 bp, Homo sapien
ctctatatccttcccattactgatt

SEQ ID NO: 640194 - DNA, 25 bp, Homo sapien
tccttcccattactgattattgtca

SEQ ID NO: 640195 - DNA, 25 bp, Homo sapien
ggaaacagccttgagatctgtgatt

SEQ ID NO: 640196 - DNA, 25 bp, Homo sapien
gagatctgtgattactaagacatac

SEQ ID NO: 640197 - DNA, 25 bp, Homo sapien
gacatacataacattcttatcacat

SEQ ID NO: 640198 - DNA, 25 bp, Homo sapien
gcaagaattgactgttgcttgtctt

SEQ ID NO: 640199 - DNA, 25 bp, Homo sapien
gttgcttgtcttgttcctgttgtct

SEQ ID NO: 640200 - DNA, 25 bp, Homo sapien
ttgtcttgttcctgttgtcttgtcc

SEQ ID NO: 640201 - DNA, 25 bp, Homo sapien
tgttcctgttgtcttgtcccctgaa

SEQ ID NO: 640202 - DNA, 25 bp, Homo sapien
tatctttgattgtatgtgggacatt

SEQ ID NO: 640203 - DNA, 25 bp, Homo sapien
gtagaaataatgtgaagcctataaa

SEQ ID NO: 640204 - DNA, 25 bp, Homo sapien
gcctataaagatgttctctgcctcc

SEQ ID NO: 640205 - DNA, 25 bp, Homo sapien
tatacattcctaaagattgatttct

SEQ ID NO: 640206 - DNA, 25 bp, Homo sapien
ataccagcactgcaggacttgtggc

SEQ ID NO: 640207 - DNA, 25 bp, Homo sapien
tgcaggacttgtggccagtcaccca

SEQ ID NO: 640208 - DNA, 25 bp, Homo sapien
ccagccactctaagcctcagtgtgt

SEQ ID NO: 640209 - DNA, 25 bp, Homo sapien
gccactctaagcctcagtgtgtctg

SEQ ID NO: 640210 - DNA, 25 bp, Homo sapien
tctaagcctcagtgtgtctgtctat

SEQ ID NO: 640211 - DNA, 25 bp, Homo sapien
taagcctcagtgtgtctgtctataa

SEQ ID NO: 640212 - DNA, 25 bp, Homo sapien
agcctcagtgtgtctgtctataaaa

SEQ ID NO: 640213 - DNA, 25 bp, Homo sapien
cctcagtgtgtctgtctataaaatg

SEQ ID NO: 640214 - DNA, 25 bp, Homo sapien
gatattagaagacctgcttggccag

SEQ ID NO: 640215 - DNA, 25 bp, Homo sapien
tagaagacctgcttggccaggcgga

SEQ ID NO: 640216 - DNA, 25 bp, Homo sapien
agactctgtctctgtaaagtaataa

SEQ ID NO: 640217 - DNA, 25 bp, Homo sapien
cgcacactctttacggcagaagcag

SEQ ID NO: 640218 - DNA, 25 bp, Homo sapien
tttacggcagaagcagtgacatttc

SEQ ID NO: 640219 - DNA, 25 bp, Homo sapien
agcagtgacatttcccttgctgtgc

SEQ ID NO: 640220 - DNA, 25 bp, Homo sapien
tttcccttgctgtgcccatggcagg

SEQ ID NO: 640221 - DNA, 25 bp, Homo sapien
cccatggcaggtgctgtgagcatgt

SEQ ID NO: 640222 - DNA, 25 bp, Homo sapien
ggtgctgtgagcatgtgcttgccaa

SEQ ID NO: 640223 - DNA, 25 bp, Homo sapien
agcccagagggccacattcttgtca

SEQ ID NO: 640224 - DNA, 25 bp, Homo sapien
cagagggccacattcttgtcactgc

SEQ ID NO: 640225 - DNA, 25 bp, Homo sapien
ttcttggagccgcagctcatgccaa

SEQ ID NO: 640226 - DNA, 25 bp, Homo sapien
ctctctgggctctaactttgtgctg

SEQ ID NO: 640227 - DNA, 25 bp, Homo sapien
tctaactttgtgctgcctcagatgt

SEQ ID NO: 640228 - DNA, 25 bp, Homo sapien
agctaccagaggatgtgcttcaccc

SEQ ID NO: 640229 - DNA, 25 bp, Homo sapien
taccagaggatgtgcttcacccaaa

SEQ ID NO: 640230 - DNA, 25 bp, Homo sapien
gagaacactggacttaagaaatcca

SEQ ID NO: 640231 - DNA, 25 bp, Homo sapien
gacttaagaaatccaacaatgagaa

SEQ ID NO: 640232 - DNA, 25 bp, Homo sapien
gaagcaaagggaatctcctggatga

SEQ ID NO: 640233 - DNA, 25 bp, Homo sapien
aaagggaatctcctggatgatgata

SEQ ID NO: 640234 - DNA, 25 bp, Homo sapien
gagagagcccaggatgaaagctgta

SEQ ID NO: 640235 - DNA, 25 bp, Homo sapien
agagcccaggatgaaagctgtatgc

SEQ ID NO: 640236 - DNA, 25 bp, Homo sapien
gcccaggatgaaagctgtatgccag

SEQ ID NO: 640237 - DNA, 25 bp, Homo sapien
aaagctgtatgccagggaaagtcct

SEQ ID NO: 640238 - DNA, 25 bp, Homo sapien
agctgtatgccagggaaagtcctga

SEQ ID NO: 640239 - DNA, 25 bp, Homo sapien
tgtggctacacggatggcaggctct

SEQ ID NO: 640240 - DNA, 25 bp, Homo sapien
acacggatggcaggctcttgaggct

SEQ ID NO: 640241 - DNA, 25 bp, Homo sapien
gcaggctcttgaggctagatggcct

SEQ ID NO: 640242 - DNA, 25 bp, Homo sapien
gatggcctaggagattttattgtga

SEQ ID NO: 640243 - DNA, 25 bp, Homo sapien
gattttattgtgatagaaggcctac

SEQ ID NO: 640244 - DNA, 25 bp, Homo sapien
gcctacagaagatgatgcctaacct

SEQ ID NO: 640245 - DNA, 25 bp, Homo sapien
gatgatgcctaacctaaagaatgag

SEQ ID NO: 640246 - DNA, 25 bp, Homo sapien
gattacatattctgtcttcaagcca

SEQ ID NO: 640247 - DNA, 25 bp, Homo sapien
gtcttcaagccaaaactgacctttg

SEQ ID NO: 640248 - DNA, 25 bp, Homo sapien
gacctttgatgttccaatttgctta

SEQ ID NO: 640249 - DNA, 25 bp, Homo sapien
gagattgtatgattcaactgacatc

SEQ ID NO: 640250 - DNA, 25 bp, Homo sapien
gaacttccgcagcatcggcaagaac

SEQ ID NO: 640251 - DNA, 25 bp, Homo sapien
gaacgtcagccccatcgaggtcaag

SEQ ID NO: 640252 - DNA, 25 bp, Homo sapien
atcgaggtcaagttcaccggcaaga

SEQ ID NO: 640253 - DNA, 25 bp, Homo sapien
ggcaagaactccttcgacatctaat

SEQ ID NO: 640254 - DNA, 25 bp, Homo sapien
gacatctaatctcgtacgtcgtata

SEQ ID NO: 640255 - DNA, 25 bp, Homo sapien
tacgtcgtatatgcgtacgtgctag

SEQ ID NO: 640256 - DNA, 25 bp, Homo sapien
gtacgtgctagttcatcgaccggta

SEQ ID NO: 640257 - DNA, 25 bp, Homo sapien
gttcatcgaccggtagttattggcg

SEQ ID NO: 640258 - DNA, 25 bp, Homo sapien
gatggacgtcctgtaattttaattg

SEQ ID NO: 640259 - DNA, 25 bp, Homo sapien
attcgatcggtgataatgatgcatc

SEQ ID NO: 640260 - DNA, 25 bp, Homo sapien
tactgctgtatgttaacgttgttca

SEQ ID NO: 640261 - DNA, 25 bp, Homo sapien
tctcaccttggtttgtaatcatctc

SEQ ID NO: 640262 - DNA, 25 bp, Homo sapien
ccttggtttgtaatcatctccatgt

SEQ ID NO: 640263 - DNA, 25 bp, Homo sapien
aatcatctccatgtgtcaagaatgg

SEQ ID NO: 640264 - DNA, 25 bp, Homo sapien
ctccatgtgtcaagaatgggaccag

SEQ ID NO: 640265 - DNA, 25 bp, Homo sapien
agtttcccacatactgttcacatgg

SEQ ID NO: 640266 - DNA, 25 bp, Homo sapien
ccacatactgttcacatggtagtaa

SEQ ID NO: 640267 - DNA, 25 bp, Homo sapien
agttcccctgcacaggctctttttg

SEQ ID NO: 640268 - DNA, 25 bp, Homo sapien
ttgcctgccaccatggaagacaccc

SEQ ID NO: 640269 - DNA, 25 bp, Homo sapien
cctttattttctgccacaattgtga

SEQ ID NO: 640270 - DNA, 25 bp, Homo sapien
ccctagctatgtggaattgtgagtg

SEQ ID NO: 640271 - DNA, 25 bp, Homo sapien
ctatgtggaattgtgagtgcattaa

SEQ ID NO: 640272 - DNA, 25 bp, Homo sapien
gagatggaacaccttggcctgaaaa

SEQ ID NO: 640273 - DNA, 25 bp, Homo sapien
cctgaaaatgttgtggcctcttgat

SEQ ID NO: 640274 - DNA, 25 bp, Homo sapien
ggcctcttgattcgagtactcgcga

SEQ ID NO: 640275 - DNA, 25 bp, Homo sapien
tcgcgagctcgaatcttgctgtaaa

SEQ ID NO: 640276 - DNA, 25 bp, Homo sapien
aactgctgagcaactgtatctgttt

SEQ ID NO: 640277 - DNA, 25 bp, Homo sapien
gtgtaatctaggtttcctcacttga

SEQ ID NO: 640278 - DNA, 25 bp, Homo sapien
tcttgatgacatacccacacctgaa

SEQ ID NO: 640279 - DNA, 25 bp, Homo sapien
atcacagcaatacgtcccaagggtt

SEQ ID NO: 640280 - DNA, 25 bp, Homo sapien
ggtttttggcttcaaacttcacaag

SEQ ID NO: 640281 - DNA, 25 bp, Homo sapien
gcagtcatgacgaacttttaccagt

SEQ ID NO: 640282 - DNA, 25 bp, Homo sapien
taccagtgggcgctatttgttttta

SEQ ID NO: 640283 - DNA, 25 bp, Homo sapien
agccaatgcatgaagaaagagaata

SEQ ID NO: 640284 - DNA, 25 bp, Homo sapien
gggaatttcagtacgacgtctggaa

SEQ ID NO: 640285 - DNA, 25 bp, Homo sapien
atttcagtacgacgtctggaaggga

SEQ ID NO: 640286 - DNA, 25 bp, Homo sapien
tctggaagggacacccacttccact

SEQ ID NO: 640287 - DNA, 25 bp, Homo sapien
agaactcaggcgcacggccacgctg

SEQ ID NO: 640288 - DNA, 25 bp, Homo sapien
gcacggccacgctgattgccgagga

SEQ ID NO: 640289 - DNA, 25 bp, Homo sapien
acaatttctgtaagtacgtagctgt

SEQ ID NO: 640290 - DNA, 25 bp, Homo sapien
gtaagtacgtagctgtttatgtcac

SEQ ID NO: 640291 - DNA, 25 bp, Homo sapien
gtacgtagctgtttatgtcacagta

SEQ ID NO: 640292 - DNA, 25 bp, Homo sapien
agctgtttatgtcacagtatttaaa

SEQ ID NO: 640293 - DNA, 25 bp, Homo sapien
aaaccagatcacattaaagagtaat

SEQ ID NO: 640294 - DNA, 25 bp, Homo sapien
tcatgtcaggccttccacaagaagt

SEQ ID NO: 640295 - DNA, 25 bp, Homo sapien
tccctttgccggtctgctaagtgac

SEQ ID NO: 640296 - DNA, 25 bp, Homo sapien
gctaagtgaccggtgccttcccagg

SEQ ID NO: 640297 - DNA, 25 bp, Homo sapien
ctctagtggccatgtctgggcataa

SEQ ID NO: 640298 - DNA, 25 bp, Homo sapien
gtggccatgtctgggcataactgag

SEQ ID NO: 640299 - DNA, 25 bp, Homo sapien
catgtctgggcataactgagggctc

SEQ ID NO: 640300 - DNA, 25 bp, Homo sapien
gtctgggcataactgagggctcaca

SEQ ID NO: 640301 - DNA, 25 bp, Homo sapien
gggcataactgagggctcacactct

SEQ ID NO: 640302 - DNA, 25 bp, Homo sapien
tcttctggtcacttatcacccttca

SEQ ID NO: 640303 - DNA, 25 bp, Homo sapien
tctggtcacttatcacccttcagct

SEQ ID NO: 640304 - DNA, 25 bp, Homo sapien
ggttataattgtagaacggacatta

SEQ ID NO: 640305 - DNA, 25 bp, Homo sapien
ggagcagagttagggtgcacgctat

SEQ ID NO: 640306 - DNA, 25 bp, Homo sapien
ttagggtgcacgctatggcgcacac

SEQ ID NO: 640307 - DNA, 25 bp, Homo sapien
tagggtgcacgctatggcgcacaca

SEQ ID NO: 640308 - DNA, 25 bp, Homo sapien
gggtgcacgctatggcgcacacaca

SEQ ID NO: 640309 - DNA, 25 bp, Homo sapien
acacagtgcacgtccacagtgccat

SEQ ID NO: 640310 - DNA, 25 bp, Homo sapien
acagtgcacgtccacagtgccatac

SEQ ID NO: 640311 - DNA, 25 bp, Homo sapien
agtgcacgtccacagtgccatacca

SEQ ID NO: 640312 - DNA, 25 bp, Homo sapien
ctggccacggccaggtgtgggaggg

SEQ ID NO: 640313 - DNA, 25 bp, Homo sapien
tgggagggacttcgaagataagagt

SEQ ID NO: 640314 - DNA, 25 bp, Homo sapien
tgagcggctgcctccgggagcttac

SEQ ID NO: 640315 - DNA, 25 bp, Homo sapien
gctgcctccgggagcttacatccta

SEQ ID NO: 640316 - DNA, 25 bp, Homo sapien
aagcaaacaaaatggtattactagc

SEQ ID NO: 640317 - DNA, 25 bp, Homo sapien
gcaaacaaaatggtattactagctt

SEQ ID NO: 640318 - DNA, 25 bp, Homo sapien
aacaaaatggtattactagctttat

SEQ ID NO: 640319 - DNA, 25 bp, Homo sapien
caaaatggtattactagctttataa

SEQ ID NO: 640320 - DNA, 25 bp, Homo sapien
ataaaaagatcatatgtcctagcac

SEQ ID NO: 640321 - DNA, 25 bp, Homo sapien
taaaaagatcatatgtcctagcact

SEQ ID NO: 640322 - DNA, 25 bp, Homo sapien
aaaaagatcatatgtcctagcactt

SEQ ID NO: 640323 - DNA, 25 bp, Homo sapien
aaaagatcatatgtcctagcacttt

SEQ ID NO: 640324 - DNA, 25 bp, Homo sapien
aaagatcatatgtcctagcactttt

SEQ ID NO: 640325 - DNA, 25 bp, Homo sapien
aagatcatatgtcctagcacttttg

SEQ ID NO: 640326 - DNA, 25 bp, Homo sapien
agatcatatgtcctagcacttttgg

SEQ ID NO: 640327 - DNA, 25 bp, Homo sapien
gattgaggacgctaatggagatggg

SEQ ID NO: 640328 - DNA, 25 bp, Homo sapien
aggagaaaagcagtccttctggtac

SEQ ID NO: 640329 - DNA, 25 bp, Homo sapien
ggagaaaagcagtccttctggtact

SEQ ID NO: 640330 - DNA, 25 bp, Homo sapien
gagaaaagcagtccttctggtactg

SEQ ID NO: 640331 - DNA, 25 bp, Homo sapien
gaaaagcagtccttctggtactggc

SEQ ID NO: 640332 - DNA, 25 bp, Homo sapien
aaaagcagtccttctggtactggct

SEQ ID NO: 640333 - DNA, 25 bp, Homo sapien
aaagcagtccttctggtactggctg

SEQ ID NO: 640334 - DNA, 25 bp, Homo sapien
aagcagtccttctggtactggctgg

SEQ ID NO: 640335 - DNA, 25 bp, Homo sapien
agcagtccttctggtactggctggg

SEQ ID NO: 640336 - DNA, 25 bp, Homo sapien
gcagtccttctggtactggctgggt

SEQ ID NO: 640337 - DNA, 25 bp, Homo sapien
agtccttctggtactggctgggtgt

SEQ ID NO: 640338 - DNA, 25 bp, Homo sapien
gagtagttttgttgactttgtcctg

SEQ ID NO: 640339 - DNA, 25 bp, Homo sapien
gttgactttgtcctgtgaggtctaa

SEQ ID NO: 640340 - DNA, 25 bp, Homo sapien
tgtcctgtgaggtctaaggccagag

SEQ ID NO: 640341 - DNA, 25 bp, Homo sapien
aaggaggaacctctattttcatgcc

SEQ ID NO: 640342 - DNA, 25 bp, Homo sapien
tattttcatgccttagtgaccctgc

SEQ ID NO: 640343 - DNA, 25 bp, Homo sapien
catgccttagtgaccctgcttttca

SEQ ID NO: 640344 - DNA, 25 bp, Homo sapien
gaagcaaaaatgcagtagcctccat

SEQ ID NO: 640345 - DNA, 25 bp, Homo sapien
gcagtagcctccataaagaagcttg

SEQ ID NO: 640346 - DNA, 25 bp, Homo sapien
atttgaaactttgactgacgtagca

SEQ ID NO: 640347 - DNA, 25 bp, Homo sapien
attgtaggtctgattcttctctttc

SEQ ID NO: 640348 - DNA, 25 bp, Homo sapien
attcttctctttctctgcaggtgca

SEQ ID NO: 640349 - DNA, 25 bp, Homo sapien
ccagccactctaagcctcagtgtgt

SEQ ID NO: 640350 - DNA, 25 bp, Homo sapien
gccactctaagcctcagtgtgtctg

SEQ ID NO: 640351 - DNA, 25 bp, Homo sapien
tctaagcctcagtgtgtctgtctat

SEQ ID NO: 640352 - DNA, 25 bp, Homo sapien
taagcctcagtgtgtctgtctataa

SEQ ID NO: 640353 - DNA, 25 bp, Homo sapien
agcctcagtgtgtctgtctataaaa

SEQ ID NO: 640354 - DNA, 25 bp, Homo sapien
cctcagtgtgtctgtctataaaatg

SEQ ID NO: 640355 - DNA, 25 bp, Homo sapien
ggatattagaagacctgcttggcca

SEQ ID NO: 640356 - DNA, 25 bp, Homo sapien
gatattagaagacctgcttggccag

SEQ ID NO: 640357 - DNA, 25 bp, Homo sapien
atattagaagacctgcttggccagg

SEQ ID NO: 640358 - DNA, 25 bp, Homo sapien
agactctgtctctgtaaagtaataa

SEQ ID NO: 640359 - DNA, 25 bp, Homo sapien
gactctgtctctgtaaagtaataat

SEQ ID NO: 640360 - DNA, 25 bp, Homo sapien
aatgtttaaggtgattgagattttt

SEQ ID NO: 640361 - DNA, 25 bp, Homo sapien
tctctaaagaagacatacaatggcc

SEQ ID NO: 640362 - DNA, 25 bp, Homo sapien
tacaatggccaagtggtttatgaaa

SEQ ID NO: 640363 - DNA, 25 bp, Homo sapien
acaatggccaagtggtttatgaaaa

SEQ ID NO: 640364 - DNA, 25 bp, Homo sapien
caatggccaagtggtttatgaaaag

SEQ ID NO: 640365 - DNA, 25 bp, Homo sapien
aatggccaagtggtttatgaaaaga

SEQ ID NO: 640366 - DNA, 25 bp, Homo sapien
atggccaagtggtttatgaaaagat

SEQ ID NO: 640367 - DNA, 25 bp, Homo sapien
tggccaagtggtttatgaaaagatg

SEQ ID NO: 640368 - DNA, 25 bp, Homo sapien
ggccaagtggtttatgaaaagatgc

SEQ ID NO: 640369 - DNA, 25 bp, Homo sapien
gccaagtggtttatgaaaagatgct

SEQ ID NO: 640370 - DNA, 25 bp, Homo sapien
ccaagtggtttatgaaaagatgctc

SEQ ID NO: 640371 - DNA, 25 bp, Homo sapien
cttcatagcagagaatcgacaccca

SEQ ID NO: 640372 - DNA, 25 bp, Homo sapien
tcatagcagagaatcgacacccaat

SEQ ID NO: 640373 - DNA, 25 bp, Homo sapien
gatgtttagaaagggttatcttcga

SEQ ID NO: 640374 - DNA, 25 bp, Homo sapien
gaaagggttatcttcgaagagacgc

SEQ ID NO: 640375 - DNA, 25 bp, Homo sapien
agggttatcttcgaagagacgcttc

SEQ ID NO: 640376 - DNA, 25 bp, Homo sapien
gttatcttcgaagagacgcttcaga

SEQ ID NO: 640377 - DNA, 25 bp, Homo sapien
atcttcgaagagacgcttcagaaag

SEQ ID NO: 640378 - DNA, 25 bp, Homo sapien
aagagacgcttcagaaaggagagag

SEQ ID NO: 640379 - DNA, 25 bp, Homo sapien
aaccttttccatgatttgaagaaga

SEQ ID NO: 640380 - DNA, 25 bp, Homo sapien
tttccatgatttgaagaagacggca

SEQ ID NO: 640381 - DNA, 25 bp, Homo sapien
gaagaagacggcaagaagcctctca

SEQ ID NO: 640382 - DNA, 25 bp, Homo sapien
catctgtttgggtgctaaaacatta

SEQ ID NO: 640383 - DNA, 25 bp, Homo sapien
atctgtttgggtgctaaaacattag

SEQ ID NO: 640384 - DNA, 25 bp, Homo sapien
tctgtttgggtgctaaaacattagc

SEQ ID NO: 640385 - DNA, 25 bp, Homo sapien
ctgtttgggtgctaaaacattagca

SEQ ID NO: 640386 - DNA, 25 bp, Homo sapien
gtttgggtgctaaaacattagcatc

SEQ ID NO: 640387 - DNA, 25 bp, Homo sapien
tttgggtgctaaaacattagcatca

SEQ ID NO: 640388 - DNA, 25 bp, Homo sapien
ttgggtgctaaaacattagcatcag

SEQ ID NO: 640389 - DNA, 25 bp, Homo sapien
gggtgctaaaacattagcatcaggc

SEQ ID NO: 640390 - DNA, 25 bp, Homo sapien
aaacattagcatcaggccaggcgca

SEQ ID NO: 640391 - DNA, 25 bp, Homo sapien
gtaatcctaagtactcgggagacta

SEQ ID NO: 640392 - DNA, 25 bp, Homo sapien
taatcctaagtactcgggagactaa

SEQ ID NO: 640393 - DNA, 25 bp, Homo sapien
ttatgctagcgtaaaggcctgttgt

SEQ ID NO: 640394 - DNA, 25 bp, Homo sapien
agttgaaatttgtccctgaaacata

SEQ ID NO: 640395 - DNA, 25 bp, Homo sapien
tcttcttgtaaattccctcatgacc

SEQ ID NO: 640396 - DNA, 25 bp, Homo sapien
attccctcatgacctagagttttga

SEQ ID NO: 640397 - DNA, 25 bp, Homo sapien
gttttgatttatgccatcctagccc

SEQ ID NO: 640398 - DNA, 25 bp, Homo sapien
tagcccactttaagctctgactcat

SEQ ID NO: 640399 - DNA, 25 bp, Homo sapien
tctgactcatgctgggattgcccta

SEQ ID NO: 640400 - DNA, 25 bp, Homo sapien
gaatgcgttgcattgtcctaacatt

SEQ ID NO: 640401 - DNA, 25 bp, Homo sapien
ttgtcctaacatttcttaacctgcc

SEQ ID NO: 640402 - DNA, 25 bp, Homo sapien
taacctgcccaaggttgaacatgct

SEQ ID NO: 640403 - DNA, 25 bp, Homo sapien
tgctctccaaaaatctttatgctag

SEQ ID NO: 640404 - DNA, 25 bp, Homo sapien
aaaggccctggatcgtgtgtgtgac

SEQ ID NO: 640405 - DNA, 25 bp, Homo sapien
ggatcgtgtgtgtgaccctggtact

SEQ ID NO: 640406 - DNA, 25 bp, Homo sapien
gtgtgaccctggtactgggcaaccc

SEQ ID NO: 640407 - DNA, 25 bp, Homo sapien
gtgacggaatgttctggaccttgat

SEQ ID NO: 640408 - DNA, 25 bp, Homo sapien
ggaatgttctggaccttgatatagg

SEQ ID NO: 640409 - DNA, 25 bp, Homo sapien
tataggtggtggatactcagccctg

SEQ ID NO: 640410 - DNA, 25 bp, Homo sapien
gccctgtgagtgcaataaatgccac

SEQ ID NO: 640411 - DNA, 25 bp, Homo sapien
taaatgccaccaaattctcacttca

SEQ ID NO: 640412 - DNA, 25 bp, Homo sapien
tgccaccaaattctcacttcaaaat

SEQ ID NO: 640413 - DNA, 25 bp, Homo sapien
tatgctatgtgaattctgctccaat

SEQ ID NO: 640414 - DNA, 25 bp, Homo sapien
gtgaattctgctccaattaaaacac

SEQ ID NO: 640415 - DNA, 25 bp, Homo sapien
tgcaaaccatttatccaacaaggga

SEQ ID NO: 640416 - DNA, 25 bp, Homo sapien
caaaccatttatccaacaagggact

SEQ ID NO: 640417 - DNA, 25 bp, Homo sapien
accatttatccaacaagggactaat

SEQ ID NO: 640418 - DNA, 25 bp, Homo sapien
tccaacaagggactaatatctataa

SEQ ID NO: 640419 - DNA, 25 bp, Homo sapien
caacaagggactaatatctataata

SEQ ID NO: 640420 - DNA, 25 bp, Homo sapien
gggactaatatctataatatacaga

SEQ ID NO: 640421 - DNA, 25 bp, Homo sapien
taatatacagagaactcaacaggaa

SEQ ID NO: 640422 - DNA, 25 bp, Homo sapien
tacagagaactcaacaggaataaaa

SEQ ID NO: 640423 - DNA, 25 bp, Homo sapien
caggaataaaacagataatcccatt

SEQ ID NO: 640424 - DNA, 25 bp, Homo sapien
ggaataaaacagataatcccattaa

SEQ ID NO: 640425 - DNA, 25 bp, Homo sapien
aagtgggcaaagtttgtgaccagcc

SEQ ID NO: 640426 - DNA, 25 bp, Homo sapien
gaatcgcttgatcttgagaggtgga

SEQ ID NO: 640427 - DNA, 25 bp, Homo sapien
aatcgcttgatcttgagaggtggag

SEQ ID NO: 640428 - DNA, 25 bp, Homo sapien
atcgcttgatcttgagaggtggagg

SEQ ID NO: 640429 - DNA, 25 bp, Homo sapien
cgcttgatcttgagaggtggaggtt

SEQ ID NO: 640430 - DNA, 25 bp, Homo sapien
gcttgatcttgagaggtggaggttg

SEQ ID NO: 640431 - DNA, 25 bp, Homo sapien
cttgatcttgagaggtggaggttgc

SEQ ID NO: 640432 - DNA, 25 bp, Homo sapien
ttgatcttgagaggtggaggttgca

SEQ ID NO: 640433 - DNA, 25 bp, Homo sapien
agctgggtgtgctggcgcacctgta

SEQ ID NO: 640434 - DNA, 25 bp, Homo sapien
gctgggtgtgctggcgcacctgtag

SEQ ID NO: 640435 - DNA, 25 bp, Homo sapien
gggtgtgctggcgcacctgtagtcc

SEQ ID NO: 640436 - DNA, 25 bp, Homo sapien
ggtgtgctggcgcacctgtagtccc

SEQ ID NO: 640437 - DNA, 25 bp, Homo sapien
ccatgttttctcacttataagtcgg

SEQ ID NO: 640438 - DNA, 25 bp, Homo sapien
tgttttctcacttataagtcggagc

SEQ ID NO: 640439 - DNA, 25 bp, Homo sapien
ctagggtctacttgagcggggagga

SEQ ID NO: 640440 - DNA, 25 bp, Homo sapien
gatgaaatagtatgtacaacaggcc

SEQ ID NO: 640441 - DNA, 25 bp, Homo sapien
atgaaatagtatgtacaacaggcca

SEQ ID NO: 640442 - DNA, 25 bp, Homo sapien
tgaaatagtatgtacaacaggccag

SEQ ID NO: 640443 - DNA, 25 bp, Homo sapien
gaaatagtatgtacaacaggccagg

SEQ ID NO: 640444 - DNA, 25 bp, Homo sapien
aaatagtatgtacaacaggccaggc

SEQ ID NO: 640445 - DNA, 25 bp, Homo sapien
aatagtatgtacaacaggccaggcg

SEQ ID NO: 640446 - DNA, 25 bp, Homo sapien
atagtatgtacaacaggccaggcgc

SEQ ID NO: 640447 - DNA, 25 bp, Homo sapien
tagtatgtacaacaggccaggcgcg

SEQ ID NO: 640448 - DNA, 25 bp, Homo sapien
tcaattcttatgacttttatttcca

SEQ ID NO: 640449 - DNA, 25 bp, Homo sapien
atgacttttatttccatgtctttgg

SEQ ID NO: 640450 - DNA, 25 bp, Homo sapien
tggaccccccctagaattatatagt

SEQ ID NO: 640451 - DNA, 25 bp, Homo sapien
ggaaagattcactattactgaagcc

SEQ ID NO: 640452 - DNA, 25 bp, Homo sapien
gattcactattactgaagccataat

SEQ ID NO: 640453 - DNA, 25 bp, Homo sapien
ttgaagtttaacacagagatatctg

SEQ ID NO: 640454 - DNA, 25 bp, Homo sapien
gatatctgaagcaataaaggccatt

SEQ ID NO: 640455 - DNA, 25 bp, Homo sapien
tgaagcaataaaggccattttctgt

SEQ ID NO: 640456 - DNA, 25 bp, Homo sapien
gccattttctgtatgctatgaactg

SEQ ID NO: 640457 - DNA, 25 bp, Homo sapien
gcataagtaacttaatatttacctg

SEQ ID NO: 640458 - DNA, 25 bp, Homo sapien
tacctgaagaaatttcgactggttt

SEQ ID NO: 640459 - DNA, 25 bp, Homo sapien
tggtgagggcataccagctttgttt

SEQ ID NO: 640460 - DNA, 25 bp, Homo sapien
aagcagtaatcatgcctgtgtgact

SEQ ID NO: 640461 - DNA, 25 bp, Homo sapien
gtaatcatgcctgtgtgactgtaat

SEQ ID NO: 640462 - DNA, 25 bp, Homo sapien
atgcctgtgtgactgtaatgaaaga

SEQ ID NO: 640463 - DNA, 25 bp, Homo sapien
aagctgctggaaggaattcattccc

SEQ ID NO: 640464 - DNA, 25 bp, Homo sapien
ttccactgtgtgaggacactgcaag

SEQ ID NO: 640465 - DNA, 25 bp, Homo sapien
tgtgtgaggacactgcaagaaagcc

SEQ ID NO: 640466 - DNA, 25 bp, Homo sapien
cctagatcttggaattctcagcctc

SEQ ID NO: 640467 - DNA, 25 bp, Homo sapien
gagaaacacgtttctgtttttctat

SEQ ID NO: 640468 - DNA, 25 bp, Homo sapien
aaatcaagttcaaaggtcctgtggt

SEQ ID NO: 640469 - DNA, 25 bp, Homo sapien
caagttcaaaggtcctgtggtgagg

SEQ ID NO: 640470 - DNA, 25 bp, Homo sapien
ttcttggcccggctgctgagccttt

SEQ ID NO: 640471 - DNA, 25 bp, Homo sapien
tgagcctttccccaaacgagccagg

SEQ ID NO: 640472 - DNA, 25 bp, Homo sapien
gccagggaactttgcccacgtcatt

SEQ ID NO: 640473 - DNA, 25 bp, Homo sapien
ccacgtcattttacctccgagaatg

SEQ ID NO: 640474 - DNA, 25 bp, Homo sapien
tttacctccgagaatgtgcctacct

SEQ ID NO: 640475 - DNA, 25 bp, Homo sapien
gaagtaaagtgttttgtcaagcgta

SEQ ID NO: 640476 - DNA, 25 bp, Homo sapien
attattcgtctgagcttattgtata

SEQ ID NO: 640477 - DNA, 25 bp, Homo sapien
aaaaagactgtcacctttcaccatg

SEQ ID NO: 640478 - DNA, 25 bp, Homo sapien
ttcaccatgttgattgtcggcatta

SEQ ID NO: 640479 - DNA, 25 bp, Homo sapien
gattgtcggcattactgcagtattt

SEQ ID NO: 640480 - DNA, 25 bp, Homo sapien
tacagcgtatttttcagcaagccaa

SEQ ID NO: 640481 - DNA, 25 bp, Homo sapien
tggtgagggcataccagctttgttt

SEQ ID NO: 640482 - DNA, 25 bp, Homo sapien
tgagaagcagtaatcatgcctgtgt

SEQ ID NO: 640483 - DNA, 25 bp, Homo sapien
aagcagtaatcatgcctgtgtgact

SEQ ID NO: 640484 - DNA, 25 bp, Homo sapien
gtaatcatgcctgtgtgactgtaat

SEQ ID NO: 640485 - DNA, 25 bp, Homo sapien
atcatgcctgtgtgactgtaatgaa

SEQ ID NO: 640486 - DNA, 25 bp, Homo sapien
gcctgtgtgactgtaatgaaagaat

SEQ ID NO: 640487 - DNA, 25 bp, Homo sapien
aagctgctggaaggaattcattccc

SEQ ID NO: 640488 - DNA, 25 bp, Homo sapien
tgtgtgaggacactgcaagaaagcc

SEQ ID NO: 640489 - DNA, 25 bp, Homo sapien
gagaaacacgtttctgtttttctat

SEQ ID NO: 640490 - DNA, 25 bp, Homo sapien
aaatcaagttcaaaggtcctgtggt

SEQ ID NO: 640491 - DNA, 25 bp, Homo sapien
caagttcaaaggtcctgtggtgagg

SEQ ID NO: 640492 - DNA, 25 bp, Homo sapien
tccattttattgttaggactttctt

SEQ ID NO: 640493 - DNA, 25 bp, Homo sapien
attgttaggactttcttttctctct

SEQ ID NO: 640494 - DNA, 25 bp, Homo sapien
tctctttcactccttcaactcattt

SEQ ID NO: 640495 - DNA, 25 bp, Homo sapien
tcttagttagatttacctagaagta

SEQ ID NO: 640496 - DNA, 25 bp, Homo sapien
tagaagtactctggcaggtactcct

SEQ ID NO: 640497 - DNA, 25 bp, Homo sapien
tggcaggtactccttgattataatc

SEQ ID NO: 640498 - DNA, 25 bp, Homo sapien
gcaggtactccttgattataatctt

SEQ ID NO: 640499 - DNA, 25 bp, Homo sapien
taatcttcacacaaaaatgttctga

SEQ ID NO: 640500 - DNA, 25 bp, Homo sapien
aaaaatgttctgacatgccaggtgc

SEQ ID NO: 640501 - DNA, 25 bp, Homo sapien
aaatgttctgacatgccaggtgcag

SEQ ID NO: 640502 - DNA, 25 bp, Homo sapien
atgttctgacatgccaggtgcagtg

SEQ ID NO: 640503 - DNA, 25 bp, Homo sapien
aaatgtcgtatcttctgactgctcc

SEQ ID NO: 640504 - DNA, 25 bp, Homo sapien
tcgtatcttctgactgctccactga

SEQ ID NO: 640505 - DNA, 25 bp, Homo sapien
ttctgactgctccactgactgactg

SEQ ID NO: 640506 - DNA, 25 bp, Homo sapien
tccactgactgactgttctcctatg

SEQ ID NO: 640507 - DNA, 25 bp, Homo sapien
tgactgactgttctcctatgtctcc

SEQ ID NO: 640508 - DNA, 25 bp, Homo sapien
aattttaggcgaattcacaaccctg

SEQ ID NO: 640509 - DNA, 25 bp, Homo sapien
aggcgaattcacaaccctgcagtgg

SEQ ID NO: 640510 - DNA, 25 bp, Homo sapien
tgcagtggcctttatgtatttaagt

SEQ ID NO: 640511 - DNA, 25 bp, Homo sapien
gaaagacagagttgcacgcctctca

SEQ ID NO: 640512 - DNA, 25 bp, Homo sapien
agagttgcacgcctctcactttcag

SEQ ID NO: 640513 - DNA, 25 bp, Homo sapien
ttcagtcagaagctaggtggctcac

SEQ ID NO: 640514 - DNA, 25 bp, Homo sapien
gaaaacttgtgtcctgaatacccag

SEQ ID NO: 640515 - DNA, 25 bp, Homo sapien
gaatacccagtattttgtcccaaca

SEQ ID NO: 640516 - DNA, 25 bp, Homo sapien
ttgtcccaacaattgtgcgaagatt

SEQ ID NO: 640517 - DNA, 25 bp, Homo sapien
gtagatgaacacctggctgtatgtc

SEQ ID NO: 640518 - DNA, 25 bp, Homo sapien
gctgagcaagactgtccttttaagc

SEQ ID NO: 640519 - DNA, 25 bp, Homo sapien
agactgtccttttaagcactatggc

SEQ ID NO: 640520 - DNA, 25 bp, Homo sapien
cactatggctgtgctgtaacggata

SEQ ID NO: 640521 - DNA, 25 bp, Homo sapien
tgtaacggataaacggaggaacctg

SEQ ID NO: 640522 - DNA, 25 bp, Homo sapien
gaacctgcagcaacatgagcattca

SEQ ID NO: 640523 - DNA, 25 bp, Homo sapien
tgagcattcagccttacgggagcac

SEQ ID NO: 640524 - DNA, 25 bp, Homo sapien
gggagcacatgcgtttggttttaga

SEQ ID NO: 640525 - DNA, 25 bp, Homo sapien
gcaaacaaaatggtattactagctt

SEQ ID NO: 640526 - DNA, 25 bp, Homo sapien
aacaaaatggtattactagctttat

SEQ ID NO: 640527 - DNA, 25 bp, Homo sapien
caaaatggtattactagctttataa

SEQ ID NO: 640528 - DNA, 25 bp, Homo sapien
atggtattactagctttataaaaag

SEQ ID NO: 640529 - DNA, 25 bp, Homo sapien
ataaaaagatcatatgtcctagcac

SEQ ID NO: 640530 - DNA, 25 bp, Homo sapien
taaaaagatcatatgtcctagcact

SEQ ID NO: 640531 - DNA, 25 bp, Homo sapien
aaaaagatcatatgtcctagcactt

SEQ ID NO: 640532 - DNA, 25 bp, Homo sapien
aaaagatcatatgtcctagcacttt

SEQ ID NO: 640533 - DNA, 25 bp, Homo sapien
aaagatcatatgtcctagcactttt

SEQ ID NO: 640534 - DNA, 25 bp, Homo sapien
aagatcatatgtcctagcacttttg

SEQ ID NO: 640535 - DNA, 25 bp, Homo sapien
agatcatatgtcctagcacttttgg

SEQ ID NO: 640536 - DNA, 25 bp, Homo sapien
gacaaccctttgttttattgcactt

SEQ ID NO: 640537 - DNA, 25 bp, Homo sapien
ccctttgttttattgcactttctct

SEQ ID NO: 640538 - DNA, 25 bp, Homo sapien
cctttgttttattgcactttctcta

SEQ ID NO: 640539 - DNA, 25 bp, Homo sapien
ctttgttttattgcactttctctat

SEQ ID NO: 640540 - DNA, 25 bp, Homo sapien
tttgttttattgcactttctctatt

SEQ ID NO: 640541 - DNA, 25 bp, Homo sapien
ttgttttattgcactttctctattt

SEQ ID NO: 640542 - DNA, 25 bp, Homo sapien
tgttttattgcactttctctatttc

SEQ ID NO: 640543 - DNA, 25 bp, Homo sapien
tttctctatttcagaatcatgagga

SEQ ID NO: 640544 - DNA, 25 bp, Homo sapien
ttctctatttcagaatcatgaggaa

SEQ ID NO: 640545 - DNA, 25 bp, Homo sapien
gaatgatggttgtcaaaggctagga

SEQ ID NO: 640546 - DNA, 25 bp, Homo sapien
gttgtcaaaggctaggaggagatat

SEQ ID NO: 640547 - DNA, 25 bp, Homo sapien
aagggtgcaaaattttagtcagact

SEQ ID NO: 640548 - DNA, 25 bp, Homo sapien
ggtgcaaaattttagtcagactgga

SEQ ID NO: 640549 - DNA, 25 bp, Homo sapien
agtcagactggagggataagttcaa

SEQ ID NO: 640550 - DNA, 25 bp, Homo sapien
taagttcaaaagatctacagtccat

SEQ ID NO: 640551 - DNA, 25 bp, Homo sapien
aaaagatctacagtccatcatggtg

SEQ ID NO: 640552 - DNA, 25 bp, Homo sapien
tgatagatatgataactggcttagt

SEQ ID NO: 640553 - DNA, 25 bp, Homo sapien
aactggcttagtttagtcattctac

SEQ ID NO: 640554 - DNA, 25 bp, Homo sapien
ggcttagtttagtcattctacgatg

SEQ ID NO: 640555 - DNA, 25 bp, Homo sapien
gtcattctacgatgtatatatactt

SEQ ID NO: 640556 - DNA, 25 bp, Homo sapien
ttcccttgaagaattgcctctcgtt

SEQ ID NO: 640557 - DNA, 25 bp, Homo sapien
cccttgaagaattgcctctcgttgg

SEQ ID NO: 640558 - DNA, 25 bp, Homo sapien
gaagaattgcctctcgttggcatgc

SEQ ID NO: 640559 - DNA, 25 bp, Homo sapien
aagaattgcctctcgttggcatgca

SEQ ID NO: 640560 - DNA, 25 bp, Homo sapien
gaattgcctctcgttggcatgcaaa

SEQ ID NO: 640561 - DNA, 25 bp, Homo sapien
attgcctctcgttggcatgcaaatt

SEQ ID NO: 640562 - DNA, 25 bp, Homo sapien
gcctctcgttggcatgcaaattgag

SEQ ID NO: 640563 - DNA, 25 bp, Homo sapien
ctctcgttggcatgcaaattgagca

SEQ ID NO: 640564 - DNA, 25 bp, Homo sapien
ctcgttggcatgcaaattgagcata

SEQ ID NO: 640565 - DNA, 25 bp, Homo sapien
attgagcataaaagaggtgcccgta

SEQ ID NO: 640566 - DNA, 25 bp, Homo sapien
agcataaaagaggtgcccgtaatcc

SEQ ID NO: 640567 - DNA, 25 bp, Homo sapien
gggcttcaagataacgatggacgga

SEQ ID NO: 640568 - DNA, 25 bp, Homo sapien
ttctctcaccgctgaatatctccta

SEQ ID NO: 640569 - DNA, 25 bp, Homo sapien
tcaccgctgaatatctcctaaggca

SEQ ID NO: 640570 - DNA, 25 bp, Homo sapien
ccgctgaatatctcctaaggcatta

SEQ ID NO: 640571 - DNA, 25 bp, Homo sapien
gaatatctcctaaggcattagtaaa

SEQ ID NO: 640572 - DNA, 25 bp, Homo sapien
tcctctgtaactcagttgtgctatt

SEQ ID NO: 640573 - DNA, 25 bp, Homo sapien
gtaactcagttgtgctattaaagct

SEQ ID NO: 640574 - DNA, 25 bp, Homo sapien
gttgtgctattaaagctctgtttct

SEQ ID NO: 640575 - DNA, 25 bp, Homo sapien
gagagagtgagtgtctcatgagaat

SEQ ID NO: 640576 - DNA, 25 bp, Homo sapien
ttctgctttcgtttgaagataatct

SEQ ID NO: 640577 - DNA, 25 bp, Homo sapien
gctgaaggctgagtttgggtgccaa

SEQ ID NO: 640578 - DNA, 25 bp, Homo sapien
tgcagctctagtgctggaaagccct

SEQ ID NO: 640579 - DNA, 25 bp, Homo sapien
gcagctctagtgctggaaagccctg

SEQ ID NO: 640580 - DNA, 25 bp, Homo sapien
gaagggccagatttggaagcatgca

SEQ ID NO: 640581 - DNA, 25 bp, Homo sapien
gggccagatttggaagcatgcagac

SEQ ID NO: 640582 - DNA, 25 bp, Homo sapien
tttcccccaagaatgagactctcca

SEQ ID NO: 640583 - DNA, 25 bp, Homo sapien
caccacctggaaacaacttgccgag

SEQ ID NO: 640584 - DNA, 25 bp, Homo sapien
accacctggaaacaacttgccgagg

SEQ ID NO: 640585 - DNA, 25 bp, Homo sapien
cacctggaaacaacttgccgagggc

SEQ ID NO: 640586 - DNA, 25 bp, Homo sapien
cctggaaacaacttgccgagggcca

SEQ ID NO: 640587 - DNA, 25 bp, Homo sapien
ctggaaacaacttgccgagggccaa

SEQ ID NO: 640588 - DNA, 25 bp, Homo sapien
tggaaacaacttgccgagggccaag

SEQ ID NO: 640589 - DNA, 25 bp, Homo sapien
gcagaacgctgattttgattctcaa

SEQ ID NO: 640590 - DNA, 25 bp, Homo sapien
gattctcaattcagtattcctacta

SEQ ID NO: 640591 - DNA, 25 bp, Homo sapien
aattcagtattcctactagctcagg

SEQ ID NO: 640592 - DNA, 25 bp, Homo sapien
agtattcctactagctcaggcctct

SEQ ID NO: 640593 - DNA, 25 bp, Homo sapien
tcccaggcagtgtcttcatggtgtt

SEQ ID NO: 640594 - DNA, 25 bp, Homo sapien
gtgtcttcatggtgttaagtgtgca

SEQ ID NO: 640595 - DNA, 25 bp, Homo sapien
gtgtgcacctaagaacagcctgtag

SEQ ID NO: 640596 - DNA, 25 bp, Homo sapien
cagcctgtagacctatatactgtgt

SEQ ID NO: 640597 - DNA, 25 bp, Homo sapien
tatactgtgtctctcataagtgtac

SEQ ID NO: 640598 - DNA, 25 bp, Homo sapien
gtctctcataagtgtactgcgttct

SEQ ID NO: 640599 - DNA, 25 bp, Homo sapien
agtgtactgcgttctattttttatg

SEQ ID NO: 640600 - DNA, 25 bp, Homo sapien
ctgtcccttctaaaaataactatat

SEQ ID NO: 640601 - DNA, 25 bp, Homo sapien
tgtcccttctaaaaataactatata

SEQ ID NO: 640602 - DNA, 25 bp, Homo sapien
gtcccttctaaaaataactatatat

SEQ ID NO: 640603 - DNA, 25 bp, Homo sapien
tcccttctaaaaataactatatata

SEQ ID NO: 640604 - DNA, 25 bp, Homo sapien
atatatatatattagctgggcattg

SEQ ID NO: 640605 - DNA, 25 bp, Homo sapien
tatatattagctgggcattgtggca

SEQ ID NO: 640606 - DNA, 25 bp, Homo sapien
atatattagctgggcattgtggcag

SEQ ID NO: 640607 - DNA, 25 bp, Homo sapien
tatattagctgggcattgtggcagg

SEQ ID NO: 640608 - DNA, 25 bp, Homo sapien
atattagctgggcattgtggcaggt

SEQ ID NO: 640609 - DNA, 25 bp, Homo sapien
tgggcattgtggcaggtgtctgtaa

SEQ ID NO: 640610 - DNA, 25 bp, Homo sapien
ttataattgctggctgggcacagtg

SEQ ID NO: 640611 - DNA, 25 bp, Homo sapien
catcctttgttacagactggctgac

SEQ ID NO: 640612 - DNA, 25 bp, Homo sapien
tacagactggctgactctgaatata

SEQ ID NO: 640613 - DNA, 25 bp, Homo sapien
aggaatgtacttcctagaccccagg

SEQ ID NO: 640614 - DNA, 25 bp, Homo sapien
ttcctagaccccaggactcaaatat

SEQ ID NO: 640615 - DNA, 25 bp, Homo sapien
gaccccaggactcaaatataaccag

SEQ ID NO: 640616 - DNA, 25 bp, Homo sapien
tataaccagagtgacagatagggca

SEQ ID NO: 640617 - DNA, 25 bp, Homo sapien
ggcaggtctgagagaagtagcaaac

SEQ ID NO: 640618 - DNA, 25 bp, Homo sapien
tagcaaacgtacttcatcttagggt

SEQ ID NO: 640619 - DNA, 25 bp, Homo sapien
acgtacttcatcttagggtcagaaa

SEQ ID NO: 640620 - DNA, 25 bp, Homo sapien
gctgctgcctctgagttattaaaaa

SEQ ID NO: 640621 - DNA, 25 bp, Homo sapien
tactaacaggcttctgatcaactaa

SEQ ID NO: 640622 - DNA, 25 bp, Homo sapien
gcatccctgcctgttatttggagat

SEQ ID NO: 640623 - DNA, 25 bp, Homo sapien
atgaaaagcgccctagggtcatctc

SEQ ID NO: 640624 - DNA, 25 bp, Homo sapien
agggtcatctctccaggacgaagat

SEQ ID NO: 640625 - DNA, 25 bp, Homo sapien
agggcatcctccagctggattcatt

SEQ ID NO: 640626 - DNA, 25 bp, Homo sapien
cctccagctggattcattcatgaaa

SEQ ID NO: 640627 - DNA, 25 bp, Homo sapien
atgaaaccaggacccatttcctctg

SEQ ID NO: 640628 - DNA, 25 bp, Homo sapien
tttcctctgggcagagttctctcca

SEQ ID NO: 640629 - DNA, 25 bp, Homo sapien
agagttctctccactgagggcccag

SEQ ID NO: 640630 - DNA, 25 bp, Homo sapien
gaggaactagtgatcctgctcccag

SEQ ID NO: 640631 - DNA, 25 bp, Homo sapien
agccctggttcaccaagtgactgca

SEQ ID NO: 640632 - DNA, 25 bp, Homo sapien
ccaagtgactgcatgtatgcctctt

SEQ ID NO: 640633 - DNA, 25 bp, Homo sapien
gaatttgtaagtcataaccgttgaa

SEQ ID NO: 640634 - DNA, 25 bp, Homo sapien
aaatgtggtccagaagtgttttgag

SEQ ID NO: 640635 - DNA, 25 bp, Homo sapien
agaagtgttttgagggactcctgga

SEQ ID NO: 640636 - DNA, 25 bp, Homo sapien
ggactcctggaaagtgactcactca

SEQ ID NO: 640637 - DNA, 25 bp, Homo sapien
tgactcactcaactgctttgtggaa

SEQ ID NO: 640638 - DNA, 25 bp, Homo sapien
tgtggaaggatagccttgtctttcc

SEQ ID NO: 640639 - DNA, 25 bp, Homo sapien
acattcccagtgcagccgagagagg

SEQ ID NO: 640640 - DNA, 25 bp, Homo sapien
agagagggagttttggcttcgctaa

SEQ ID NO: 640641 - DNA, 25 bp, Homo sapien
gagttttggcttcgctaagagcaga

SEQ ID NO: 640642 - DNA, 25 bp, Homo sapien
ggcttcgctaagagcagagtgctgt

SEQ ID NO: 640643 - DNA, 25 bp, Homo sapien
caaaattctgtaaagtatacctggt

SEQ ID NO: 640644 - DNA, 25 bp, Homo sapien
caggagttctgcaggaattggattt

SEQ ID NO: 640645 - DNA, 25 bp, Homo sapien
ggagttctgcaggaattggatttgc

SEQ ID NO: 640646 - DNA, 25 bp, Homo sapien
gttctgcaggaattggatttgcaac

SEQ ID NO: 640647 - DNA, 25 bp, Homo sapien
gcaggaattggatttgcaactcaaa

SEQ ID NO: 640648 - DNA, 25 bp, Homo sapien
ttgcaactcaaaaccaaaggctccc

SEQ ID NO: 640649 - DNA, 25 bp, Homo sapien
tccccactgctgcaagatatttctg

SEQ ID NO: 640650 - DNA, 25 bp, Homo sapien
ccccactgctgcaagatatttctgc

SEQ ID NO: 640651 - DNA, 25 bp, Homo sapien
cccactgctgcaagatatttctgca

SEQ ID NO: 640652 - DNA, 25 bp, Homo sapien
cactgctgcaagatatttctgcaga

SEQ ID NO: 640653 - DNA, 25 bp, Homo sapien
aaagatcaccaaatggagtacaatt

SEQ ID NO: 640654 - DNA, 25 bp, Homo sapien
aatggagtacaattggagagaagca

SEQ ID NO: 640655 - DNA, 25 bp, Homo sapien
taacatcacacttagtggtgaaaag

SEQ ID NO: 640656 - DNA, 25 bp, Homo sapien
cacacttagtggtgaaaagcagaaa

SEQ ID NO: 640657 - DNA, 25 bp, Homo sapien
gaaagattttcctctaagatcacga

SEQ ID NO: 640658 - DNA, 25 bp, Homo sapien
aagattttcctctaagatcacgaac

SEQ ID NO: 640659 - DNA, 25 bp, Homo sapien
gattttcctctaagatcacgaacaa

SEQ ID NO: 640660 - DNA, 25 bp, Homo sapien
attttcctctaagatcacgaacaag

SEQ ID NO: 640661 - DNA, 25 bp, Homo sapien
cacttctattcaatacagtactaga

SEQ ID NO: 640662 - DNA, 25 bp, Homo sapien
atacaaggcatgcaaattgaacagg

SEQ ID NO: 640663 - DNA, 25 bp, Homo sapien
gaagtaaaattgtctctttctacag

SEQ ID NO: 640664 - DNA, 25 bp, Homo sapien
gtaaaattgtctctttctacagatg

SEQ ID NO: 640665 - DNA, 25 bp, Homo sapien
aaattgtctctttctacagatgact

SEQ ID NO: 640666 - DNA, 25 bp, Homo sapien
agaaggcgccaaacagatatgcaca

SEQ ID NO: 640667 - DNA, 25 bp, Homo sapien
ggcgccaaacagatatgcacagatt

SEQ ID NO: 640668 - DNA, 25 bp, Homo sapien
acagatatgcacagatttcttccaa

SEQ ID NO: 640669 - DNA, 25 bp, Homo sapien
atatgcacagatttcttccaaagtc

SEQ ID NO: 640670 - DNA, 25 bp, Homo sapien
aactacttcaaagaagcccttctga

SEQ ID NO: 640671 - DNA, 25 bp, Homo sapien
tctgtaatatggttgaaagtgtttt

SEQ ID NO: 640672 - DNA, 25 bp, Homo sapien
tcagagttcgctactgtactattta

SEQ ID NO: 640673 - DNA, 25 bp, Homo sapien
gagttcgctactgtactatttatgt

SEQ ID NO: 640674 - DNA, 25 bp, Homo sapien
gttcgctactgtactatttatgtta

SEQ ID NO: 640675 - DNA, 25 bp, Homo sapien
gctactgtactatttatgttacaac

SEQ ID NO: 640676 - DNA, 25 bp, Homo sapien
atgttacaacttagattaattagca

SEQ ID NO: 640677 - DNA, 25 bp, Homo sapien
gtgaaagattaatatccagccattt

SEQ ID NO: 640678 - DNA, 25 bp, Homo sapien
tatccagccatttataaacctccaa

SEQ ID NO: 640679 - DNA, 25 bp, Homo sapien
gccatttataaacctccaaatcctt

SEQ ID NO: 640680 - DNA, 25 bp, Homo sapien
aatcatgtccttgaactgttgaacc

SEQ ID NO: 640681 - DNA, 25 bp, Homo sapien
catgtccttgaactgttgaaccata

SEQ ID NO: 640682 - DNA, 25 bp, Homo sapien
gtccttgaactgttgaaccatattt

SEQ ID NO: 640683 - DNA, 25 bp, Homo sapien
tgaactgttgaaccatatttgtaat

SEQ ID NO: 640684 - DNA, 25 bp, Homo sapien
tgagaaaattaagcctcttctactt

SEQ ID NO: 640685 - DNA, 25 bp, Homo sapien
gaaaaatttgactctaccaattata

SEQ ID NO: 640686 - DNA, 25 bp, Homo sapien
taaccacaaggaatgttctccagac

SEQ ID NO: 640687 - DNA, 25 bp, Homo sapien
gttctccagacttgaatattttaag

SEQ ID NO: 640688 - DNA, 25 bp, Homo sapien
gggtcaggcacagctctaatagtct

SEQ ID NO: 640689 - DNA, 25 bp, Homo sapien
agtctaatctcatctaatctcaata

SEQ ID NO: 640690 - DNA, 25 bp, Homo sapien
tctcatctaatctcaatacgttcat

SEQ ID NO: 640691 - DNA, 25 bp, Homo sapien
ggttgttattcccatatgatcccaa

SEQ ID NO: 640692 - DNA, 25 bp, Homo sapien
atgatcccaatgacgaaactgaagc

SEQ ID NO: 640693 - DNA, 25 bp, Homo sapien
aataatgtgccctaatttacagaat

SEQ ID NO: 640694 - DNA, 25 bp, Homo sapien
aaactggtactggaattatgcaaag

SEQ ID NO: 640695 - DNA, 25 bp, Homo sapien
gcaaagataatcaggcatcagagtt

SEQ ID NO: 640696 - DNA, 25 bp, Homo sapien
atcagagtttgtgatgtcaactgtt

SEQ ID NO: 640697 - DNA, 25 bp, Homo sapien
gtcaactgttatgtgatactgcaat

SEQ ID NO: 640698 - DNA, 25 bp, Homo sapien
gcaataaacgttgtataaacctctg

SEQ ID NO: 640699 - DNA, 25 bp, Homo sapien
tccaggaacaatgagcacatctagc

SEQ ID NO: 640700 - DNA, 25 bp, Homo sapien
aggaacaatgagcacatctagcacc

SEQ ID NO: 640701 - DNA, 25 bp, Homo sapien
ggcttctacacatcattctctatta

SEQ ID NO: 640702 - DNA, 25 bp, Homo sapien
gcttctacacatcattctctattaa

SEQ ID NO: 640703 - DNA, 25 bp, Homo sapien
taagcaagtgctcaaagaattatgg

SEQ ID NO: 640704 - DNA, 25 bp, Homo sapien
gcaagtgctcaaagaattatggcaa

SEQ ID NO: 640705 - DNA, 25 bp, Homo sapien
agaattatggcaatagaaaccagct

SEQ ID NO: 640706 - DNA, 25 bp, Homo sapien
aaaccagcttggcaactggacaaaa

SEQ ID NO: 640707 - DNA, 25 bp, Homo sapien
gcttggcaactggacaaaatctggg

SEQ ID NO: 640708 - DNA, 25 bp, Homo sapien
gcaactggacaaaatctgggaaatt

SEQ ID NO: 640709 - DNA, 25 bp, Homo sapien
caaaatctgggaaattgagcatcaa

SEQ ID NO: 640710 - DNA, 25 bp, Homo sapien
tactgaatgtaagtataaatgcttt

SEQ ID NO: 640711 - DNA, 25 bp, Homo sapien
aatgctttaaattgttacttgactc

SEQ ID NO: 640712 - DNA, 25 bp, Homo sapien
atgctttaaattgttacttgactca

SEQ ID NO: 640713 - DNA, 25 bp, Homo sapien
tgctttaaattgttacttgactcag

SEQ ID NO: 640714 - DNA, 25 bp, Homo sapien
ttacttgactcagtttttaaaggtg

SEQ ID NO: 640715 - DNA, 25 bp, Homo sapien
tacttgactcagtttttaaaggtgt

SEQ ID NO: 640716 - DNA, 25 bp, Homo sapien
atgagatatgtagttaagtgatttc

SEQ ID NO: 640717 - DNA, 25 bp, Homo sapien
tattttgttatatatggctgaaaaa

SEQ ID NO: 640718 - DNA, 25 bp, Homo sapien
attttgttatatatggctgaaaaag

SEQ ID NO: 640719 - DNA, 25 bp, Homo sapien
ttttgttatatatggctgaaaaaga

SEQ ID NO: 640720 - DNA, 25 bp, Homo sapien
tttgttatatatggctgaaaaagag

SEQ ID NO: 640721 - DNA, 25 bp, Homo sapien
aaggaaggagaaatagcgccggtct

SEQ ID NO: 640722 - DNA, 25 bp, Homo sapien
gaaatagcgccggtctcctaaggtg

SEQ ID NO: 640723 - DNA, 25 bp, Homo sapien
agcgccggtctcctaaggtgttgaa

SEQ ID NO: 640724 - DNA, 25 bp, Homo sapien
cggtctcctaaggtgttgaaggcag

SEQ ID NO: 640725 - DNA, 25 bp, Homo sapien
gcagagctggaatcttgtggaacac

SEQ ID NO: 640726 - DNA, 25 bp, Homo sapien
gtcttacctcatctagtccgtcaca

SEQ ID NO: 640727 - DNA, 25 bp, Homo sapien
agcaaaacttggactacacggagat

SEQ ID NO: 640728 - DNA, 25 bp, Homo sapien
aaatgagatgtaccttaccacctgg

SEQ ID NO: 640729 - DNA, 25 bp, Homo sapien
ttaccacctggtgctctgaaaaaag

SEQ ID NO: 640730 - DNA, 25 bp, Homo sapien
gctctgaaaaaagcctgctgtttgg

SEQ ID NO: 640731 - DNA, 25 bp, Homo sapien
gggcacattttgtaatatgtcacta

SEQ ID NO: 640732 - DNA, 25 bp, Homo sapien
agtgctgggacgcaccatttctgtg

SEQ ID NO: 640733 - DNA, 25 bp, Homo sapien
caccatttctgtgcgtagctggatg

SEQ ID NO: 640734 - DNA, 25 bp, Homo sapien
ggcagcgtagcctgagccactgcct

SEQ ID NO: 640735 - DNA, 25 bp, Homo sapien
tgcctcacacagcttcagagcacat

SEQ ID NO: 640736 - DNA, 25 bp, Homo sapien
gcttcagagcacatcttatgctagt

SEQ ID NO: 640737 - DNA, 25 bp, Homo sapien
gcacatcttatgctagtgagctgta

SEQ ID NO: 640738 - DNA, 25 bp, Homo sapien
gtgagctgtaactttgagcctgcca

SEQ ID NO: 640739 - DNA, 25 bp, Homo sapien
ctgtaactttgagcctgccaggaac

SEQ ID NO: 640740 - DNA, 25 bp, Homo sapien
ggaacccaagcatcaggctcaggtg

SEQ ID NO: 640741 - DNA, 25 bp, Homo sapien
aagcatcaggctcaggtgtcccaga

SEQ ID NO: 640742 - DNA, 25 bp, Homo sapien
aggctcaggtgtcccagactctgac

SEQ ID NO: 640743 - DNA, 25 bp, Homo sapien
cttactattgagttgtttcaattcc

SEQ ID NO: 640744 - DNA, 25 bp, Homo sapien
gatattaaccccttgtcagatgttt

SEQ ID NO: 640745 - DNA, 25 bp, Homo sapien
ccccttgtcagatgtttggtttgca

SEQ ID NO: 640746 - DNA, 25 bp, Homo sapien
atattttctcattctgcaggttgtc

SEQ ID NO: 640747 - DNA, 25 bp, Homo sapien
attttctcattctgcaggttgtctc

SEQ ID NO: 640748 - DNA, 25 bp, Homo sapien
tcattctgcaggttgtctccttact

SEQ ID NO: 640749 - DNA, 25 bp, Homo sapien
gttgtctccttactctgttcattat

SEQ ID NO: 640750 - DNA, 25 bp, Homo sapien
tctccttactctgttcattattttt

SEQ ID NO: 640751 - DNA, 25 bp, Homo sapien
tatttttgtagttatgcagaagctt

SEQ ID NO: 640752 - DNA, 25 bp, Homo sapien
atcccagttgtccaattttgctttt

SEQ ID NO: 640753 - DNA, 25 bp, Homo sapien
ctgagaagtgatttgggtcatatta

SEQ ID NO: 640754 - DNA, 25 bp, Homo sapien
agcctgggcaaaaactgcgtctcaa

SEQ ID NO: 640755 - DNA, 25 bp, Homo sapien
aagttttcctaagaggaggagtgat

SEQ ID NO: 640756 - DNA, 25 bp, Homo sapien
gctttttgttataaacccttctgtg

SEQ ID NO: 640757 - DNA, 25 bp, Homo sapien
gttataaacccttctgtgatcttgc

SEQ ID NO: 640758 - DNA, 25 bp, Homo sapien
ataaacccttctgtgatcttgcttt

SEQ ID NO: 640759 - DNA, 25 bp, Homo sapien
aaacccttctgtgatcttgcttttt

SEQ ID NO: 640760 - DNA, 25 bp, Homo sapien
acccttctgtgatcttgctttttta

SEQ ID NO: 640761 - DNA, 25 bp, Homo sapien
ccttctgtgatcttgcttttttagt

SEQ ID NO: 640762 - DNA, 25 bp, Homo sapien
tctgtgatcttgcttttttagttac

SEQ ID NO: 640763 - DNA, 25 bp, Homo sapien
gtgatcttgcttttttagttacttg

SEQ ID NO: 640764 - DNA, 25 bp, Homo sapien
atcttgcttttttagttacttgcac

SEQ ID NO: 640765 - DNA, 25 bp, Homo sapien
gtaacttgctattgagaacctttga

SEQ ID NO: 640766 - DNA, 25 bp, Homo sapien
gagaacctttgatttcttaggtatt

SEQ ID NO: 640767 - DNA, 25 bp, Homo sapien
ttttgttgcctctcctgaagaaaat

SEQ ID NO: 640768 - DNA, 25 bp, Homo sapien
aaatagtggcaatttgtactcagct

SEQ ID NO: 640769 - DNA, 25 bp, Homo sapien
aatttgtactcagctgtggaataaa

SEQ ID NO: 640770 - DNA, 25 bp, Homo sapien
aagagtctcagcctccaagagatgg

SEQ ID NO: 640771 - DNA, 25 bp, Homo sapien
ttaagttcacttgattcattagcct

SEQ ID NO: 640772 - DNA, 25 bp, Homo sapien
gattcattagcctaagtgctcaagt

SEQ ID NO: 640773 - DNA, 25 bp, Homo sapien
gcctaagtgctcaagtaaatttcaa

SEQ ID NO: 640774 - DNA, 25 bp, Homo sapien
gttatgtgtgattgtccacgtcctt

SEQ ID NO: 640775 - DNA, 25 bp, Homo sapien
aagggcccatgtaacttgctattga

SEQ ID NO: 640776 - DNA, 25 bp, Homo sapien
taaataaacaaacctgagtaagttg

SEQ ID NO: 640777 - DNA, 25 bp, Homo sapien
acctaggacctagtatatatgtgtt

SEQ ID NO: 640778 - DNA, 25 bp, Homo sapien
ctaggacctagtatatatgtgttat

SEQ ID NO: 640779 - DNA, 25 bp, Homo sapien
atatgtgttattaaggctctatccc

SEQ ID NO: 640780 - DNA, 25 bp, Homo sapien
atgtgttattaaggctctatccctg

SEQ ID NO: 640781 - DNA, 25 bp, Homo sapien
gttattaaggctctatccctgaatt

SEQ ID NO: 640782 - DNA, 25 bp, Homo sapien
aggctctatccctgaatttttaatg

SEQ ID NO: 640783 - DNA, 25 bp, Homo sapien
agttatctatttttcatggattctt

SEQ ID NO: 640784 - DNA, 25 bp, Homo sapien
tctatttttcatggattctttgttt

SEQ ID NO: 640785 - DNA, 25 bp, Homo sapien
tttttcatggattctttgtttattc

SEQ ID NO: 640786 - DNA, 25 bp, Homo sapien
ggattctttgtttattccccataag

SEQ ID NO: 640787 - DNA, 25 bp, Homo sapien
atataacatttagactttgccataa

SEQ ID NO: 640788 - DNA, 25 bp, Homo sapien
aagatcaagacattcatgtacagtc

SEQ ID NO: 640789 - DNA, 25 bp, Homo sapien
gcccataaaaattcccagtatgcat

SEQ ID NO: 640790 - DNA, 25 bp, Homo sapien
cagtatgcatgttttatgctcacca

SEQ ID NO: 640791 - DNA, 25 bp, Homo sapien
gcatgttttatgctcaccattatga

SEQ ID NO: 640792 - DNA, 25 bp, Homo sapien
gaaagcacttgaaagggctccccgg

SEQ ID NO: 640793 - DNA, 25 bp, Homo sapien
aatcattcacattaggtacctcgga

SEQ ID NO: 640794 - DNA, 25 bp, Homo sapien
gtacctcggagttgcgggtctcaga

SEQ ID NO: 640795 - DNA, 25 bp, Homo sapien
gttgcgggtctcagatgtggattca

SEQ ID NO: 640796 - DNA, 25 bp, Homo sapien
gggtctcagatgtggattcatgcat

SEQ ID NO: 640797 - DNA, 25 bp, Homo sapien
gtggattcatgcatcatttgtgcaa

SEQ ID NO: 640798 - DNA, 25 bp, Homo sapien
taacatcacacttagtggtgaaaag

SEQ ID NO: 640799 - DNA, 25 bp, Homo sapien
cacacttagtggtgaaaagcagaaa

SEQ ID NO: 640800 - DNA, 25 bp, Homo sapien
gaaagattttcctctaagatcacga

SEQ ID NO: 640801 - DNA, 25 bp, Homo sapien
agattttcctctaagatcacgaaca

SEQ ID NO: 640802 - DNA, 25 bp, Homo sapien
attttcctctaagatcacgaacaag

SEQ ID NO: 640803 - DNA, 25 bp, Homo sapien
actcttgccacttctattcaataca

SEQ ID NO: 640804 - DNA, 25 bp, Homo sapien
cacttctattcaatacagtactaga

SEQ ID NO: 640805 - DNA, 25 bp, Homo sapien
atacaaggcatgcaaattgaacagg

SEQ ID NO: 640806 - DNA, 25 bp, Homo sapien
gaagtaaaattgtctctttctacag

SEQ ID NO: 640807 - DNA, 25 bp, Homo sapien
aaattgtctctttctacagatgact

SEQ ID NO: 640808 - DNA, 25 bp, Homo sapien
ctacagatgacttgattttttataa

SEQ ID NO: 640809 - DNA, 25 bp, Homo sapien
gagacgcgtccagatggtaacgact

SEQ ID NO: 640810 - DNA, 25 bp, Homo sapien
atggtaacgacttcagccagcctga

SEQ ID NO: 640811 - DNA, 25 bp, Homo sapien
gaagccacatcctttcctaagttgg

SEQ ID NO: 640812 - DNA, 25 bp, Homo sapien
ttcctaagttggcagttcctgtcag

SEQ ID NO: 640813 - DNA, 25 bp, Homo sapien
cagttcctgtcagaggcgtggacaa

SEQ ID NO: 640814 - DNA, 25 bp, Homo sapien
gcgtggacaagaaagtggcttcgtt

SEQ ID NO: 640815 - DNA, 25 bp, Homo sapien
aaagtggcttcgtttctttccagct

SEQ ID NO: 640816 - DNA, 25 bp, Homo sapien
cttcgtttctttccagcttgataaa

SEQ ID NO: 640817 - DNA, 25 bp, Homo sapien
gccgacataaataggagcacttcat

SEQ ID NO: 640818 - DNA, 25 bp, Homo sapien
ggagcacttcatttctgaattacac

SEQ ID NO: 640819 - DNA, 25 bp, Homo sapien
ttacacaccattactcttatcacat

SEQ ID NO: 640820 - DNA, 25 bp, Homo sapien
ctagggtctacttgagcggggagga

SEQ ID NO: 640821 - DNA, 25 bp, Homo sapien
tagggtctacttgagcggggaggat

SEQ ID NO: 640822 - DNA, 25 bp, Homo sapien
gatgtgaggagggaagcagaaaaga

SEQ ID NO: 640823 - DNA, 25 bp, Homo sapien
gatgaaatagtatgtacaacaggcc

SEQ ID NO: 640824 - DNA, 25 bp, Homo sapien
atgaaatagtatgtacaacaggcca

SEQ ID NO: 640825 - DNA, 25 bp, Homo sapien
tgaaatagtatgtacaacaggccag

SEQ ID NO: 640826 - DNA, 25 bp, Homo sapien
gaaatagtatgtacaacaggccagg

SEQ ID NO: 640827 - DNA, 25 bp, Homo sapien
aaatagtatgtacaacaggccaggc

SEQ ID NO: 640828 - DNA, 25 bp, Homo sapien
aatagtatgtacaacaggccaggcg

SEQ ID NO: 640829 - DNA, 25 bp, Homo sapien
atagtatgtacaacaggccaggcgc

SEQ ID NO: 640830 - DNA, 25 bp, Homo sapien
tagtatgtacaacaggccaggcgcg

SEQ ID NO: 640831 - DNA, 25 bp, Homo sapien
gtagagattgctatcacagaattaa

SEQ ID NO: 640832 - DNA, 25 bp, Homo sapien
tgctggtccttagagcaggctgtgc

SEQ ID NO: 640833 - DNA, 25 bp, Homo sapien
ccgtgtgacattgtggcaagagagc

SEQ ID NO: 640834 - DNA, 25 bp, Homo sapien
agagagcaagctggtagttcgcaaa

SEQ ID NO: 640835 - DNA, 25 bp, Homo sapien
gtagttcgcaaagggctgccgccat

SEQ ID NO: 640836 - DNA, 25 bp, Homo sapien
tgccgccattcagaggctgggacct

SEQ ID NO: 640837 - DNA, 25 bp, Homo sapien
ggctgggacctcaggaagatctttg

SEQ ID NO: 640838 - DNA, 25 bp, Homo sapien
gatctttggcacaatctactagaca

SEQ ID NO: 640839 - DNA, 25 bp, Homo sapien
caatctactagacacgtttcattaa

SEQ ID NO: 640840 - DNA, 25 bp, Homo sapien
tagatttgcaaatcttgtcagtaga

SEQ ID NO: 640841 - DNA, 25 bp, Homo sapien
tcttgtcagtagagattgctatcac

SEQ ID NO: 640842 - DNA, 25 bp, Homo sapien
gtgccagtgcacagacaggacacct

SEQ ID NO: 640843 - DNA, 25 bp, Homo sapien
gtcaccactccatgggacagcagga

SEQ ID NO: 640844 - DNA, 25 bp, Homo sapien
caggactgatgtgccctgcactgac

SEQ ID NO: 640845 - DNA, 25 bp, Homo sapien
ctgcactgaccacgaggactcgagc

SEQ ID NO: 640846 - DNA, 25 bp, Homo sapien
aggactcgagccctgtctaaggcga

SEQ ID NO: 640847 - DNA, 25 bp, Homo sapien
agccctgtctaaggcgagtcctgct

SEQ ID NO: 640848 - DNA, 25 bp, Homo sapien
agtcctgctggctaatgccaggtgg

SEQ ID NO: 640849 - DNA, 25 bp, Homo sapien
aatgccaggtggaagtattaaggtc

SEQ ID NO: 640850 - DNA, 25 bp, Homo sapien
aaggtcagagcagtgatccatccca

SEQ ID NO: 640851 - DNA, 25 bp, Homo sapien
gtgatccatcccatgtgatgaggtt

SEQ ID NO: 640852 - DNA, 25 bp, Homo sapien
gaggttggagatacttatcccttaa

SEQ ID NO: 640853 - DNA, 25 bp, Homo sapien
aaatgagttctgctctcagggtctt

SEQ ID NO: 640854 - DNA, 25 bp, Homo sapien
tctgctctcagggtcttcatacttg

SEQ ID NO: 640855 - DNA, 25 bp, Homo sapien
agggtcttcatacttgcccttccct

SEQ ID NO: 640856 - DNA, 25 bp, Homo sapien
ttttttggctctctccatcacttta

SEQ ID NO: 640857 - DNA, 25 bp, Homo sapien
ctccatcactttaggtctccattaa

SEQ ID NO: 640858 - DNA, 25 bp, Homo sapien
ttaggtctccattaaaactgtcagc

SEQ ID NO: 640859 - DNA, 25 bp, Homo sapien
taattcaaataccaatccttccccg

SEQ ID NO: 640860 - DNA, 25 bp, Homo sapien
cgcctccgtttggtaactctctagt

SEQ ID NO: 640861 - DNA, 25 bp, Homo sapien
gtttggtaactctctagtctcttat

SEQ ID NO: 640862 - DNA, 25 bp, Homo sapien
actctctagtctcttatctccttta

SEQ ID NO: 640863 - DNA, 25 bp, Homo sapien
tcttcatttcgtttatttacttgac

SEQ ID NO: 640864 - DNA, 25 bp, Homo sapien
gggacttgaacctcttctaactttg

SEQ ID NO: 640865 - DNA, 25 bp, Homo sapien
gaacctcttctaactttgaacaagc

SEQ ID NO: 640866 - DNA, 25 bp, Homo sapien
gatattacttctttgtcgtcattga

SEQ ID NO: 640867 - DNA, 25 bp, Homo sapien
aaatattttctagcctgttgttctt

SEQ ID NO: 640868 - DNA, 25 bp, Homo sapien
gttttaattgcttcagtgctgacaa

SEQ ID NO: 640869 - DNA, 25 bp, Homo sapien
ttgcttcagtgctgacaaagtgagc

SEQ ID NO: 640870 - DNA, 25 bp, Homo sapien
tgctgcccatctgatagtctttttt

SEQ ID NO: 640871 - DNA, 25 bp, Homo sapien
gcccatctgatagtcttttttctgc

SEQ ID NO: 640872 - DNA, 25 bp, Homo sapien
tcttttttctgctagttttgtacaa

SEQ ID NO: 640873 - DNA, 25 bp, Homo sapien
cattctctgatgactatcccgattt

SEQ ID NO: 640874 - DNA, 25 bp, Homo sapien
tctgatgactatcccgattttattt

SEQ ID NO: 640875 - DNA, 25 bp, Homo sapien
ctccgctgggataaggtgggtacct

SEQ ID NO: 640876 - DNA, 25 bp, Homo sapien
gataaggtgggtacctggtcagccc

SEQ ID NO: 640877 - DNA, 25 bp, Homo sapien
gtgggtacctggtcagcccggcaaa

SEQ ID NO: 640878 - DNA, 25 bp, Homo sapien
cagaggagatggctcgggacaccga

SEQ ID NO: 640879 - DNA, 25 bp, Homo sapien
ttgctccttcggactgccagagccg

SEQ ID NO: 640880 - DNA, 25 bp, Homo sapien
agagccgggcggcaacatctgcatc

SEQ ID NO: 640881 - DNA, 25 bp, Homo sapien
tctgcatcgcttccttctgcagtgc

SEQ ID NO: 640882 - DNA, 25 bp, Homo sapien
tctgcagtgctctcaattgtaacct

SEQ ID NO: 640883 - DNA, 25 bp, Homo sapien
agtgctctcaattgtaacctccctt

SEQ ID NO: 640884 - DNA, 25 bp, Homo sapien
cctctttcctttcaagtgctgtctt

SEQ ID NO: 640885 - DNA, 25 bp, Homo sapien
ctttcaagtgctgtcttccctcttt

SEQ ID NO: 640886 - DNA, 25 bp, Homo sapien
gaaattttgttagaacttcatctca

SEQ ID NO: 640887 - DNA, 25 bp, Homo sapien
tctcaatggctatttaactcattct

SEQ ID NO: 640888 - DNA, 25 bp, Homo sapien
ggctatttaactcattctttaatac

SEQ ID NO: 640889 - DNA, 25 bp, Homo sapien
aggaagtatttgtgctccataagtt

SEQ ID NO: 640890 - DNA, 25 bp, Homo sapien
atttgtgctccataagttttctctt

SEQ ID NO: 640891 - DNA, 25 bp, Homo sapien
ttattaccatggcatgccgtggcat

SEQ ID NO: 640892 - DNA, 25 bp, Homo sapien
catgccgtggcatttgcttacagtt

SEQ ID NO: 640893 - DNA, 25 bp, Homo sapien
cgtggcatttgcttacagttatatt

SEQ ID NO: 640894 - DNA, 25 bp, Homo sapien
gttatatttattagtgtcatctggc

SEQ ID NO: 640895 - DNA, 25 bp, Homo sapien
agtgtcatctggcttttgttgtata

SEQ ID NO: 640896 - DNA, 25 bp, Homo sapien
gtcatctggcttttgttgtataaga

SEQ ID NO: 640897 - DNA, 25 bp, Homo sapien
gaaaagtttacaccattatcaagca

SEQ ID NO: 640898 - DNA, 25 bp, Homo sapien
gtttacaccattatcaagcaatcct

SEQ ID NO: 640899 - DNA, 25 bp, Homo sapien
aagcaatccttagctctaggctgat

SEQ ID NO: 640900 - DNA, 25 bp, Homo sapien
aatccttagctctaggctgatatta

SEQ ID NO: 640901 - DNA, 25 bp, Homo sapien
gctgatattattaacacccctgtgt

SEQ ID NO: 640902 - DNA, 25 bp, Homo sapien
aaggccaggcatggttgccacgtaa

SEQ ID NO: 640903 - DNA, 25 bp, Homo sapien
ttgccacgtaattggctgagctcat

SEQ ID NO: 640904 - DNA, 25 bp, Homo sapien
tgagctcattcaataattaggtcct

SEQ ID NO: 640905 - DNA, 25 bp, Homo sapien
taattaggtcctcccttagccatag

SEQ ID NO: 640906 - DNA, 25 bp, Homo sapien
aatggagcagcactaaaaggtcttg

SEQ ID NO: 640907 - DNA, 25 bp, Homo sapien
aaaaggtcttgctcggctgggcaca

SEQ ID NO: 640908 - DNA, 25 bp, Homo sapien
tgaattttgaaagggtgtgtgtacg

SEQ ID NO: 640909 - DNA, 25 bp, Homo sapien
gtgtgtgtacgtgtttaggtcatgc

SEQ ID NO: 640910 - DNA, 25 bp, Homo sapien
gtgtgtacgtgtttaggtcatgctt

SEQ ID NO: 640911 - DNA, 25 bp, Homo sapien
gtacgtgtttaggtcatgctttttt

SEQ ID NO: 640912 - DNA, 25 bp, Homo sapien
gtttaggtcatgcttttttgggcta

SEQ ID NO: 640913 - DNA, 25 bp, Homo sapien
taggtcatgcttttttgggctagtt

SEQ ID NO: 640914 - DNA, 25 bp, Homo sapien
gtcatgcttttttgggctagttagt

SEQ ID NO: 640915 - DNA, 25 bp, Homo sapien
gcttttttgggctagttagtatgaa

SEQ ID NO: 640916 - DNA, 25 bp, Homo sapien
gggctagttagtatgaaatctattt

SEQ ID NO: 640917 - DNA, 25 bp, Homo sapien
gaaatctatttacctaaattctgta

SEQ ID NO: 640918 - DNA, 25 bp, Homo sapien
tacctaaattctgtaagactactta

SEQ ID NO: 640919 - DNA, 25 bp, Homo sapien
gcaagctttgtagaaactttaccca

SEQ ID NO: 640920 - DNA, 25 bp, Homo sapien
aggaaaaccagattcccactcaggc

SEQ ID NO: 640921 - DNA, 25 bp, Homo sapien
gattcccactcaggctgttttgtaa

SEQ ID NO: 640922 - DNA, 25 bp, Homo sapien
caggctgttttgtaagagacggcac

SEQ ID NO: 640923 - DNA, 25 bp, Homo sapien
gagacggcacaaactctgggagttt

SEQ ID NO: 640924 - DNA, 25 bp, Homo sapien
aactctgggagtttgacctcaaaga

SEQ ID NO: 640925 - DNA, 25 bp, Homo sapien
acaaaataggcctgttatttctgga

SEQ ID NO: 640926 - DNA, 25 bp, Homo sapien
atttctggaacccatggttctcatg

SEQ ID NO: 640927 - DNA, 25 bp, Homo sapien
ggttctcatgtagttctgtatcagg

SEQ ID NO: 640928 - DNA, 25 bp, Homo sapien
ggttcagtcattgttacttcttttt

SEQ ID NO: 640929 - DNA, 25 bp, Homo sapien
atatatgctcttcgtgaaacactga

SEQ ID NO: 640930 - DNA, 25 bp, Homo sapien
gcatttttcatatacaaacgtcgtc

SEQ ID NO: 640931 - DNA, 25 bp, Homo sapien
aaacgtcgtctaaatgagaacactg

SEQ ID NO: 640932 - DNA, 25 bp, Homo sapien
gagaacactgacttcccagatgtaa

SEQ ID NO: 640933 - DNA, 25 bp, Homo sapien
cactgacttcccagatgtaactgtg

SEQ ID NO: 640934 - DNA, 25 bp, Homo sapien
gaaactgacttgtaactggatcatc

SEQ ID NO: 640935 - DNA, 25 bp, Homo sapien
actggatcatcattgtgattgcaga

SEQ ID NO: 640936 - DNA, 25 bp, Homo sapien
gattctccaagatttgtttctgtgc

SEQ ID NO: 640937 - DNA, 25 bp, Homo sapien
tttctgtgcccaactttcagaagag

SEQ ID NO: 640938 - DNA, 25 bp, Homo sapien
gaagaggaaaatcacacattatgtt

SEQ ID NO: 640939 - DNA, 25 bp, Homo sapien
tatggtgatctgcattttcataata

SEQ ID NO: 640940 - DNA, 25 bp, Homo sapien
taataaagtgtcctattgtgaaaca

SEQ ID NO: 640941 - DNA, 25 bp, Homo sapien
aactaatcaaactgtactacggcaa

SEQ ID NO: 640942 - DNA, 25 bp, Homo sapien
caaactgtactacggcaacttcaaa

SEQ ID NO: 640943 - DNA, 25 bp, Homo sapien
ttcaaaaaaccaactgtgcccctag

SEQ ID NO: 640944 - DNA, 25 bp, Homo sapien
caactgtgcccctagatgagtcaaa

SEQ ID NO: 640945 - DNA, 25 bp, Homo sapien
gatgagtcaaatgccgccttcaatt

SEQ ID NO: 640946 - DNA, 25 bp, Homo sapien
gccttcaattctccctgacaaaagt

SEQ ID NO: 640947 - DNA, 25 bp, Homo sapien
aaaataccaaagacatcagcttatg

SEQ ID NO: 640948 - DNA, 25 bp, Homo sapien
aaaaatgtccagaaggccacatggt

SEQ ID NO: 640949 - DNA, 25 bp, Homo sapien
aaggccacatggtctttggcaacca

SEQ ID NO: 640950 - DNA, 25 bp, Homo sapien
atggtctttggcaaccactggataa

SEQ ID NO: 640951 - DNA, 25 bp, Homo sapien
ttggcaaccactggataaacagcag

SEQ ID NO: 640952 - DNA, 25 bp, Homo sapien
gtctttgactctgaattagctgagg

SEQ ID NO: 640953 - DNA, 25 bp, Homo sapien
gagaagttcaccacaggaaggtcct

SEQ ID NO: 640954 - DNA, 25 bp, Homo sapien
accacaggaaggtcctgccctttgt

SEQ ID NO: 640955 - DNA, 25 bp, Homo sapien
tgccctttgtttgctcctaaaggtt

SEQ ID NO: 640956 - DNA, 25 bp, Homo sapien
tcaacttgaccaacacaccattgca

SEQ ID NO: 640957 - DNA, 25 bp, Homo sapien
acaccattgcaagcactccagagga

SEQ ID NO: 640958 - DNA, 25 bp, Homo sapien
gagaagacagccttgctgtgtcaaa

SEQ ID NO: 640959 - DNA, 25 bp, Homo sapien
gccttgctgtgtcaaatccacttta

SEQ ID NO: 640960 - DNA, 25 bp, Homo sapien
tttgtaaatttcttgtcagtcactt

SEQ ID NO: 640961 - DNA, 25 bp, Homo sapien
ttcttgtcagtcacttttatgcccc

SEQ ID NO: 640962 - DNA, 25 bp, Homo sapien
ttttatgcccccactgaataggaca

SEQ ID NO: 640963 - DNA, 25 bp, Homo sapien
tgcatgcggtcatcggctcgcccct

SEQ ID NO: 640964 - DNA, 25 bp, Homo sapien
acgtgcagggtggacgatctgcatt

SEQ ID NO: 640965 - DNA, 25 bp, Homo sapien
cagggtggacgatctgcattaacga

SEQ ID NO: 640966 - DNA, 25 bp, Homo sapien
agggtggacgatctgcattaacgaa

SEQ ID NO: 640967 - DNA, 25 bp, Homo sapien
ggtggacgatctgcattaacgaagg

SEQ ID NO: 640968 - DNA, 25 bp, Homo sapien
tggacgatctgcattaacgaaggga

SEQ ID NO: 640969 - DNA, 25 bp, Homo sapien
gacgatctgcattaacgaagggaag

SEQ ID NO: 640970 - DNA, 25 bp, Homo sapien
gatctgcattaacgaagggaagcac

SEQ ID NO: 640971 - DNA, 25 bp, Homo sapien
cattaacgaagggaagcacggcatg

SEQ ID NO: 640972 - DNA, 25 bp, Homo sapien
taacgaagggaagcacggcatggac

SEQ ID NO: 640973 - DNA, 25 bp, Homo sapien
cgaagggaagcacggcatggacggt

SEQ ID NO: 640974 - DNA, 25 bp, Homo sapien
ctagaaaaaataataaactggccag

SEQ ID NO: 640975 - DNA, 25 bp, Homo sapien
tagaaaaaataataaactggccagg

SEQ ID NO: 640976 - DNA, 25 bp, Homo sapien
aaataataaactggccaggcacggt

SEQ ID NO: 640977 - DNA, 25 bp, Homo sapien
aataataaactggccaggcacggtg

SEQ ID NO: 640978 - DNA, 25 bp, Homo sapien
ataataaactggccaggcacggtgg

SEQ ID NO: 640979 - DNA, 25 bp, Homo sapien
aggccgtcgtgggcagatcatctga

SEQ ID NO: 640980 - DNA, 25 bp, Homo sapien
gaccagcctggtgaacatggtaaaa

SEQ ID NO: 640981 - DNA, 25 bp, Homo sapien
accagcctggtgaacatggtaaaac

SEQ ID NO: 640982 - DNA, 25 bp, Homo sapien
ccagcctggtgaacatggtaaaacc

SEQ ID NO: 640983 - DNA, 25 bp, Homo sapien
atataaaaattggtcaggcatggtg

SEQ ID NO: 640984 - DNA, 25 bp, Homo sapien
tataaaaattggtcaggcatggtgg

SEQ ID NO: 640985 - DNA, 25 bp, Homo sapien
tcctaagcgaatttatgcaagaaca

SEQ ID NO: 640986 - DNA, 25 bp, Homo sapien
gaaacgttgaatacacacagacata

SEQ ID NO: 640987 - DNA, 25 bp, Homo sapien
gaatacacacagacataacgatgag

SEQ ID NO: 640988 - DNA, 25 bp, Homo sapien
actggggactactaaatgcgggaga

SEQ ID NO: 640989 - DNA, 25 bp, Homo sapien
gggcgtgcacttattgggtactatg

SEQ ID NO: 640990 - DNA, 25 bp, Homo sapien
ggcgtgcacttattgggtactatgc

SEQ ID NO: 640991 - DNA, 25 bp, Homo sapien
ctatctgacaggatcatttgtaccc

SEQ ID NO: 640992 - DNA, 25 bp, Homo sapien
taccccaagcctcagacatgcaata

SEQ ID NO: 640993 - DNA, 25 bp, Homo sapien
cccaagcctcagacatgcaatacag

SEQ ID NO: 640994 - DNA, 25 bp, Homo sapien
agcctcagacatgcaatacagccat

SEQ ID NO: 640995 - DNA, 25 bp, Homo sapien
gacatgcaatacagccatgtaacaa

SEQ ID NO: 640996 - DNA, 25 bp, Homo sapien
tgacatgcacccgtaatcccaggtc

SEQ ID NO: 640997 - DNA, 25 bp, Homo sapien
gacatgcacccgtaatcccaggtcc

SEQ ID NO: 640998 - DNA, 25 bp, Homo sapien
acatgcacccgtaatcccaggtcct

SEQ ID NO: 640999 - DNA, 25 bp, Homo sapien
atgcacccgtaatcccaggtcctcg

SEQ ID NO: 641000 - DNA, 25 bp, Homo sapien
tgcacccgtaatcccaggtcctcgg

SEQ ID NO: 641001 - DNA, 25 bp, Homo sapien
atacaggaagacaaggtcgggtgca

SEQ ID NO: 641002 - DNA, 25 bp, Homo sapien
tacaggaagacaaggtcgggtgcag

SEQ ID NO: 641003 - DNA, 25 bp, Homo sapien
acaggaagacaaggtcgggtgcagt

SEQ ID NO: 641004 - DNA, 25 bp, Homo sapien
caggaagacaaggtcgggtgcagtg

SEQ ID NO: 641005 - DNA, 25 bp, Homo sapien
aggaagacaaggtcgggtgcagtgg

SEQ ID NO: 641006 - DNA, 25 bp, Homo sapien
ggaagacaaggtcgggtgcagtggc

SEQ ID NO: 641007 - DNA, 25 bp, Homo sapien
taaataaacaaacctgagtaagttg

SEQ ID NO: 641008 - DNA, 25 bp, Homo sapien
acctaggacctagtatatatgtgtt

SEQ ID NO: 641009 - DNA, 25 bp, Homo sapien
cctaggacctagtatatatgtgtta

SEQ ID NO: 641010 - DNA, 25 bp, Homo sapien
taggacctagtatatatgtgttatt

SEQ ID NO: 641011 - DNA, 25 bp, Homo sapien
atatgtgttattaaggctctatccc

SEQ ID NO: 641012 - DNA, 25 bp, Homo sapien
atgtgttattaaggctctatccctg

SEQ ID NO: 641013 - DNA, 25 bp, Homo sapien
tgtgttattaaggctctatccctga

SEQ ID NO: 641014 - DNA, 25 bp, Homo sapien
agttatctatttttcatggattctt

SEQ ID NO: 641015 - DNA, 25 bp, Homo sapien
tatctatttttcatggattctttgt

SEQ ID NO: 641016 - DNA, 25 bp, Homo sapien
ctatttttcatggattctttgttta

SEQ ID NO: 641017 - DNA, 25 bp, Homo sapien
tttttcatggattctttgtttattc

SEQ ID NO: 641018 - DNA, 25 bp, Homo sapien
taatatatatagcatggtaacgatc

SEQ ID NO: 641019 - DNA, 25 bp, Homo sapien
gcatggtaacgatcattaattatac

SEQ ID NO: 641020 - DNA, 25 bp, Homo sapien
aacgatcattaattataccatattg

SEQ ID NO: 641021 - DNA, 25 bp, Homo sapien
gctgaaagtaaatcttaagggttct

SEQ ID NO: 641022 - DNA, 25 bp, Homo sapien
taaatcttaagggttctcaacaaat

SEQ ID NO: 641023 - DNA, 25 bp, Homo sapien
cttaagggttctcaacaaatacata

SEQ ID NO: 641024 - DNA, 25 bp, Homo sapien
aaagatcaccttacattactatgaa

SEQ ID NO: 641025 - DNA, 25 bp, Homo sapien
gatcaccttacattactatgaaaga

SEQ ID NO: 641026 - DNA, 25 bp, Homo sapien
taccgttttgtatgtggattacctc

SEQ ID NO: 641027 - DNA, 25 bp, Homo sapien
ccgttttgtatgtggattacctcaa

SEQ ID NO: 641028 - DNA, 25 bp, Homo sapien
ttttgtatgtggattacctcaataa

SEQ ID NO: 641029 - DNA, 25 bp, Homo sapien
atacttcttgcctacttgttagtag

SEQ ID NO: 641030 - DNA, 25 bp, Homo sapien
acttcttgcctacttgttagtagat

SEQ ID NO: 641031 - DNA, 25 bp, Homo sapien
cttgcctacttgttagtagatatgt

SEQ ID NO: 641032 - DNA, 25 bp, Homo sapien
agatatgtatagttgccattgctag

SEQ ID NO: 641033 - DNA, 25 bp, Homo sapien
atatgtatagttgccattgctagaa

SEQ ID NO: 641034 - DNA, 25 bp, Homo sapien
gtatagttgccattgctagaagaca

SEQ ID NO: 641035 - DNA, 25 bp, Homo sapien
atagttgccattgctagaagacagg

SEQ ID NO: 641036 - DNA, 25 bp, Homo sapien
gttgccattgctagaagacagggat

SEQ ID NO: 641037 - DNA, 25 bp, Homo sapien
gccattgctagaagacagggatgtc

SEQ ID NO: 641038 - DNA, 25 bp, Homo sapien
gaaagactccaactttcacagagaa

SEQ ID NO: 641039 - DNA, 25 bp, Homo sapien
aagactccaactttcacagagaaaa

SEQ ID NO: 641040 - DNA, 25 bp, Homo sapien
gagcaatgatggagctgcatctctt

SEQ ID NO: 641041 - DNA, 25 bp, Homo sapien
gggcatttgattcccaagagaccaa

SEQ ID NO: 641042 - DNA, 25 bp, Homo sapien
ccatgacttagctatttaactgctt

SEQ ID NO: 641043 - DNA, 25 bp, Homo sapien
atgaatgctgcttcaagttctttca

SEQ ID NO: 641044 - DNA, 25 bp, Homo sapien
aagttctttcaaataccccacatct

SEQ ID NO: 641045 - DNA, 25 bp, Homo sapien
taccccacatcttggcaacaacgaa

SEQ ID NO: 641046 - DNA, 25 bp, Homo sapien
ggcaacaacgaaaggaattaacatg

SEQ ID NO: 641047 - DNA, 25 bp, Homo sapien
aatttacaatctttcatcacatcga

SEQ ID NO: 641048 - DNA, 25 bp, Homo sapien
catcacatcgaacaatgtcccacat

SEQ ID NO: 641049 - DNA, 25 bp, Homo sapien
gaacaatgtcccacatttgaaaagt

SEQ ID NO: 641050 - DNA, 25 bp, Homo sapien
cagcacagatttctggttactgaaa

SEQ ID NO: 641051 - DNA, 25 bp, Homo sapien
tgaggaatttgaccgctaagcccca

SEQ ID NO: 641052 - DNA, 25 bp, Homo sapien
gaatttgaccgctaagccccagggt

SEQ ID NO: 641053 - DNA, 25 bp, Homo sapien
agcttcgtggacaggccttgaggac

SEQ ID NO: 641054 - DNA, 25 bp, Homo sapien
caggccttgaggacgctttggtgca

SEQ ID NO: 641055 - DNA, 25 bp, Homo sapien
gacgctttggtgcatttcctgaatt

SEQ ID NO: 641056 - DNA, 25 bp, Homo sapien
catttcctgaattgtccctgtgaga

SEQ ID NO: 641057 - DNA, 25 bp, Homo sapien
attgtccctgtgagaacatgcctta

SEQ ID NO: 641058 - DNA, 25 bp, Homo sapien
gagaacatgccttatctgcagcagt

SEQ ID NO: 641059 - DNA, 25 bp, Homo sapien
aacatgccttatctgcagcagtcag

SEQ ID NO: 641060 - DNA, 25 bp, Homo sapien
atctgcagcagtcaggaaggctgat

SEQ ID NO: 641061 - DNA, 25 bp, Homo sapien
gaaagttacctagaaagccgggcat

SEQ ID NO: 641062 - DNA, 25 bp, Homo sapien
gccacaaaaccatgcaaatatggaa

SEQ ID NO: 641063 - DNA, 25 bp, Homo sapien
aaataacctgctcctgagtgatcgt

SEQ ID NO: 641064 - DNA, 25 bp, Homo sapien
aacctgctcctgagtgatcgttggg

SEQ ID NO: 641065 - DNA, 25 bp, Homo sapien
tgctcctgagtgatcgttgggtcaa

SEQ ID NO: 641066 - DNA, 25 bp, Homo sapien
tcctgagtgatcgttgggtcaacaa

SEQ ID NO: 641067 - DNA, 25 bp, Homo sapien
gatcgttgggtcaacaaggaagtca

SEQ ID NO: 641068 - DNA, 25 bp, Homo sapien
gggtcaacaaggaagtcaagataga

SEQ ID NO: 641069 - DNA, 25 bp, Homo sapien
ctgaacaataatagtggcacaacct

SEQ ID NO: 641070 - DNA, 25 bp, Homo sapien
aataatagtggcacaacctatcaaa

SEQ ID NO: 641071 - DNA, 25 bp, Homo sapien
aagtagtgctaagtggaaagttcat

SEQ ID NO: 641072 - DNA, 25 bp, Homo sapien
aaatagacaatctaaggccatacct

SEQ ID NO: 641073 - DNA, 25 bp, Homo sapien
ttctcagtgcccaagacagggaaca

SEQ ID NO: 641074 - DNA, 25 bp, Homo sapien
gagcacagcactgaacacattttag

SEQ ID NO: 641075 - DNA, 25 bp, Homo sapien
cacattttagtgctcttttagttca

SEQ ID NO: 641076 - DNA, 25 bp, Homo sapien
ttagttcatgtgctgcttgctgaat

SEQ ID NO: 641077 - DNA, 25 bp, Homo sapien
tgcttgctgaatttccctgaattca

SEQ ID NO: 641078 - DNA, 25 bp, Homo sapien
aagcatctgagatcttctgtatgtt

SEQ ID NO: 641079 - DNA, 25 bp, Homo sapien
tctgtatgttttctcgtctgtgcaa

SEQ ID NO: 641080 - DNA, 25 bp, Homo sapien
gtgttttcaactctttcaaaggtcg

SEQ ID NO: 641081 - DNA, 25 bp, Homo sapien
aggtcggcattcactgatttcagct

SEQ ID NO: 641082 - DNA, 25 bp, Homo sapien
cccttggcttgatctctcatacaaa

SEQ ID NO: 641083 - DNA, 25 bp, Homo sapien
gatctctcatacaaaggttctcaaa

SEQ ID NO: 641084 - DNA, 25 bp, Homo sapien
gtaatagcaagaatcatgtctgttt

SEQ ID NO: 641085 - DNA, 25 bp, Homo sapien
tagcaagaatcatgtctgtttgctt

SEQ ID NO: 641086 - DNA, 25 bp, Homo sapien
gctttaaaggcccaggaaggactga

SEQ ID NO: 641087 - DNA, 25 bp, Homo sapien
aaggcccaggaaggactgagatact

SEQ ID NO: 641088 - DNA, 25 bp, Homo sapien
gaaggactgagatactaatggagga

SEQ ID NO: 641089 - DNA, 25 bp, Homo sapien
gagatactaatggaggagatcgata

SEQ ID NO: 641090 - DNA, 25 bp, Homo sapien
tctaatgtaacactatcttctgtca

SEQ ID NO: 641091 - DNA, 25 bp, Homo sapien
attcttaactttggagtcactctct

SEQ ID NO: 641092 - DNA, 25 bp, Homo sapien
cttaactttggagtcactctcttat

SEQ ID NO: 641093 - DNA, 25 bp, Homo sapien
ggagtcactctcttatgtttgagta

SEQ ID NO: 641094 - DNA, 25 bp, Homo sapien
gtcactctcttatgtttgagtagcc

SEQ ID NO: 641095 - DNA, 25 bp, Homo sapien
gtatacacctggagcattggaccat

SEQ ID NO: 641096 - DNA, 25 bp, Homo sapien
attggaccattccatactggctcgc

SEQ ID NO: 641097 - DNA, 25 bp, Homo sapien
ggctcgccaggttgcgttgcacaaa

SEQ ID NO: 641098 - DNA, 25 bp, Homo sapien
gcgttgcacaaacaccaagactgat

SEQ ID NO: 641099 - DNA, 25 bp, Homo sapien
ctggttttattattgggcccctgag

SEQ ID NO: 641100 - DNA, 25 bp, Homo sapien
gcccctgagttttggttgccgtagc

SEQ ID NO: 641101 - DNA, 25 bp, Homo sapien
gttgccgtagccaattccatagcag

SEQ ID NO: 641102 - DNA, 25 bp, Homo sapien
aagccttaaaccctgagactcaagt

SEQ ID NO: 641103 - DNA, 25 bp, Homo sapien
actcaagtgggattctgtgggcaga

SEQ ID NO: 641104 - DNA, 25 bp, Homo sapien
ttccacacgtgtctatagtttgctg

SEQ ID NO: 641105 - DNA, 25 bp, Homo sapien
aacccctggattgcaatccttggag

SEQ ID NO: 641106 - DNA, 25 bp, Homo sapien
aggtggctgcgcagagctcgggagc

SEQ ID NO: 641107 - DNA, 25 bp, Homo sapien
acacagctgcgatccccgtggctaa

SEQ ID NO: 641108 - DNA, 25 bp, Homo sapien
gatccccgtggctaacggcactggg

SEQ ID NO: 641109 - DNA, 25 bp, Homo sapien
gaaaacagcatcctgacgttggtca

SEQ ID NO: 641110 - DNA, 25 bp, Homo sapien
tgacgttggtcacggtgcaaaacct

SEQ ID NO: 641111 - DNA, 25 bp, Homo sapien
gttggtcacggtgcaaaacctgaac

SEQ ID NO: 641112 - DNA, 25 bp, Homo sapien
gtcacggtgcaaaacctgaacagaa

SEQ ID NO: 641113 - DNA, 25 bp, Homo sapien
tgaacagaatcccaggccccgtgtg

SEQ ID NO: 641114 - DNA, 25 bp, Homo sapien
cccgtgtggctcaatctttgtttaa

SEQ ID NO: 641115 - DNA, 25 bp, Homo sapien
ggctcaatctttgtttaaagttaca

SEQ ID NO: 641116 - DNA, 25 bp, Homo sapien
tacattcaaataacagactcactgc

SEQ ID NO: 641117 - DNA, 25 bp, Homo sapien
acacctggcccagagaactgttaag

SEQ ID NO: 641118 - DNA, 25 bp, Homo sapien
ggcccagagaactgttaagaactgt

SEQ ID NO: 641119 - DNA, 25 bp, Homo sapien
gaactgttattctaaccacaggctt

SEQ ID NO: 641120 - DNA, 25 bp, Homo sapien
tgttattctaaccacaggcttcctc

SEQ ID NO: 641121 - DNA, 25 bp, Homo sapien
tctctctcctgaactgaggaccggg

SEQ ID NO: 641122 - DNA, 25 bp, Homo sapien
tctcctgaactgaggaccgggaacc

SEQ ID NO: 641123 - DNA, 25 bp, Homo sapien
gaaccccactttgacagttcctgat

SEQ ID NO: 641124 - DNA, 25 bp, Homo sapien
tgacagttcctgatctcaagttgag

SEQ ID NO: 641125 - DNA, 25 bp, Homo sapien
caagttgaggaatgtgctggcgtca

SEQ ID NO: 641126 - DNA, 25 bp, Homo sapien
atgtgctggcgtcaggaggcagcat

SEQ ID NO: 641127 - DNA, 25 bp, Homo sapien
aatacaaaatatgtgcagctggagg

SEQ ID NO: 641128 - DNA, 25 bp, Homo sapien
gggctgaatatgaaggcaactcgga

SEQ ID NO: 641129 - DNA, 25 bp, Homo sapien
gaatatgaaggcaactcggactaag

SEQ ID NO: 641130 - DNA, 25 bp, Homo sapien
tatgaaggcaactcggactaagaag

SEQ ID NO: 641131 - DNA, 25 bp, Homo sapien
gaaggcaactcggactaagaagacg

SEQ ID NO: 641132 - DNA, 25 bp, Homo sapien
ggcaactcggactaagaagacgact

SEQ ID NO: 641133 - DNA, 25 bp, Homo sapien
actcggactaagaagacgactgctt

SEQ ID NO: 641134 - DNA, 25 bp, Homo sapien
gactaagaagacgactgcttaccaa

SEQ ID NO: 641135 - DNA, 25 bp, Homo sapien
agaagacgactgcttaccaactgcc

SEQ ID NO: 641136 - DNA, 25 bp, Homo sapien
aagacgactgcttaccaactgccct

SEQ ID NO: 641137 - DNA, 25 bp, Homo sapien
cccctagtgcacatgtgaggcagcg

SEQ ID NO: 641138 - DNA, 25 bp, Homo sapien
tagtgcacatgtgaggcagcgcgcc

SEQ ID NO: 641139 - DNA, 25 bp, Homo sapien
gaatctcattatactagcagggtct

SEQ ID NO: 641140 - DNA, 25 bp, Homo sapien
ctcattatactagcagggtctgaat

SEQ ID NO: 641141 - DNA, 25 bp, Homo sapien
caggagttctgcaggaattggattt

SEQ ID NO: 641142 - DNA, 25 bp, Homo sapien
ggagttctgcaggaattggatttgc

SEQ ID NO: 641143 - DNA, 25 bp, Homo sapien
gcaggaattggatttgcaactcaaa

SEQ ID NO: 641144 - DNA, 25 bp, Homo sapien
ttgcaactcaaaaccaaaggctccc

SEQ ID NO: 641145 - DNA, 25 bp, Homo sapien
tccccactgctgcaagatatttctg

SEQ ID NO: 641146 - DNA, 25 bp, Homo sapien
cccactgctgcaagatatttctgca

SEQ ID NO: 641147 - DNA, 25 bp, Homo sapien
cactgctgcaagatatttctgcaga

SEQ ID NO: 641148 - DNA, 25 bp, Homo sapien
aaagatcaccaaatggagtacaatt

SEQ ID NO: 641149 - DNA, 25 bp, Homo sapien
aatggagtacaattggagagaagca

SEQ ID NO: 641150 - DNA, 25 bp, Homo sapien
ttatctttcaaaggtgttttctgtg

SEQ ID NO: 641151 - DNA, 25 bp, Homo sapien
ttactttctgacaacatctctaaat

SEQ ID NO: 641152 - DNA, 25 bp, Homo sapien
gacaacatctctaaatcataatatt

SEQ ID NO: 641153 - DNA, 25 bp, Homo sapien
attcataatatttccagcagtgcct

SEQ ID NO: 641154 - DNA, 25 bp, Homo sapien
tatttccagcagtgcctaacacagt

SEQ ID NO: 641155 - DNA, 25 bp, Homo sapien
cagcagtgcctaacacagtgtctta

SEQ ID NO: 641156 - DNA, 25 bp, Homo sapien
agtgcctaacacagtgtcttaccca

SEQ ID NO: 641157 - DNA, 25 bp, Homo sapien
cctaacacagtgtcttacccatagt

SEQ ID NO: 641158 - DNA, 25 bp, Homo sapien
cagtgtcttacccatagtgagcagt

SEQ ID NO: 641159 - DNA, 25 bp, Homo sapien
tgtcttacccatagtgagcagtcaa

SEQ ID NO: 641160 - DNA, 25 bp, Homo sapien
tagtgagcagtcaagaagtgtttgt

SEQ ID NO: 641161 - DNA, 25 bp, Homo sapien
cccggtgcagtgttgtcatgtggaa

SEQ ID NO: 641162 - DNA, 25 bp, Homo sapien
gtcatgtggaacctgctttatccat

SEQ ID NO: 641163 - DNA, 25 bp, Homo sapien
tgggtaatggttagggctttccaga

SEQ ID NO: 641164 - DNA, 25 bp, Homo sapien
tttccagatctcagcagccaaagac

SEQ ID NO: 641165 - DNA, 25 bp, Homo sapien
tcagcagccaaagacagttattgtt

SEQ ID NO: 641166 - DNA, 25 bp, Homo sapien
ggaagactgtcatgtagataaccat

SEQ ID NO: 641167 - DNA, 25 bp, Homo sapien
agataaccatgagcaatggctcgcc

SEQ ID NO: 641168 - DNA, 25 bp, Homo sapien
ggctcgcctcagaatcagttcataa

SEQ ID NO: 641169 - DNA, 25 bp, Homo sapien
taaaattctatggtactggcccctt

SEQ ID NO: 641170 - DNA, 25 bp, Homo sapien
gccccttcgtgggtattgtgtgaaa

SEQ ID NO: 641171 - DNA, 25 bp, Homo sapien
atgctttgggaagtccttgcccctg

SEQ ID NO: 641172 - DNA, 25 bp, Homo sapien
agaagagcaggaatgactcatttta

SEQ ID NO: 641173 - DNA, 25 bp, Homo sapien
ttaagataattgtgactgcagggct

SEQ ID NO: 641174 - DNA, 25 bp, Homo sapien
aaaacaggtgagttgcagtggaatt

SEQ ID NO: 641175 - DNA, 25 bp, Homo sapien
aatgtcacatgagttttggcaaaaa

SEQ ID NO: 641176 - DNA, 25 bp, Homo sapien
catctaatcatggaagctaaaagtg

SEQ ID NO: 641177 - DNA, 25 bp, Homo sapien
gaaagattaaatgcataccagaaat

SEQ ID NO: 641178 - DNA, 25 bp, Homo sapien
tgagaatgcacactgtctctgccat

SEQ ID NO: 641179 - DNA, 25 bp, Homo sapien
cacactgtctctgccatatcaagaa

SEQ ID NO: 641180 - DNA, 25 bp, Homo sapien
gccatatcaagaaactacaacccta

SEQ ID NO: 641181 - DNA, 25 bp, Homo sapien
aaccctaaacacaggagcattccaa

SEQ ID NO: 641182 - DNA, 25 bp, Homo sapien
caggagcattccaataaaagttaac

SEQ ID NO: 641183 - DNA, 25 bp, Homo sapien
acctgaattctccaaggactcgggt

SEQ ID NO: 641184 - DNA, 25 bp, Homo sapien
attctccaaggactcgggtttcctg

SEQ ID NO: 641185 - DNA, 25 bp, Homo sapien
aggactcgggtttcctggaagagct

SEQ ID NO: 641186 - DNA, 25 bp, Homo sapien
cagaagataacctctcctcctgggc

SEQ ID NO: 641187 - DNA, 25 bp, Homo sapien
gggcaccttaccaccggagccgaat

SEQ ID NO: 641188 - DNA, 25 bp, Homo sapien
ccttaccaccggagccgaatctggt

SEQ ID NO: 641189 - DNA, 25 bp, Homo sapien
cagtttctcttcagacactgacctt

SEQ ID NO: 641190 - DNA, 25 bp, Homo sapien
agacactgaccttctgctgggaaag

SEQ ID NO: 641191 - DNA, 25 bp, Homo sapien
cttctgctgggaaagcagccctgag

SEQ ID NO: 641192 - DNA, 25 bp, Homo sapien
tcagaaattgaggacagcgatgcgg

SEQ ID NO: 641193 - DNA, 25 bp, Homo sapien
gagagcacccagaggaccgaggaca

SEQ ID NO: 641194 - DNA, 25 bp, Homo sapien
ggatgagttctacaatagacataga

SEQ ID NO: 641195 - DNA, 25 bp, Homo sapien
ggaatagaattagtgtgagccaatc

SEQ ID NO: 641196 - DNA, 25 bp, Homo sapien
agtgtgagccaatcagatcctacta

SEQ ID NO: 641197 - DNA, 25 bp, Homo sapien
gagccaatcagatcctactagcata

SEQ ID NO: 641198 - DNA, 25 bp, Homo sapien
agatcctactagcataagcaacccc

SEQ ID NO: 641199 - DNA, 25 bp, Homo sapien
aagcaacccccataaggtgatcatg

SEQ ID NO: 641200 - DNA, 25 bp, Homo sapien
ggtgatcatgatgtacaacgccaat

SEQ ID NO: 641201 - DNA, 25 bp, Homo sapien
catgatgtacaacgccaatgctagt

SEQ ID NO: 641202 - DNA, 25 bp, Homo sapien
tacaacgccaatgctagtactcttg

SEQ ID NO: 641203 - DNA, 25 bp, Homo sapien
caatgctagtactcttgggtgcaat

SEQ ID NO: 641204 - DNA, 25 bp, Homo sapien
gctagtactcttgggtgcaataatt

SEQ ID NO: 641205 - DNA, 25 bp, Homo sapien
acatgtatttagatcttcaaccagt

SEQ ID NO: 641206 - DNA, 25 bp, Homo sapien
gtatttagatcttcaaccagttgag

SEQ ID NO: 641207 - DNA, 25 bp, Homo sapien
aaccagttgaggattatactcccaa

SEQ ID NO: 641208 - DNA, 25 bp, Homo sapien
gaggattatactcccaaatagaata

SEQ ID NO: 641209 - DNA, 25 bp, Homo sapien
cattgttgatgagctgtatattcct

SEQ ID NO: 641210 - DNA, 25 bp, Homo sapien
tgatgagctgtatattccttagagt

SEQ ID NO: 641211 - DNA, 25 bp, Homo sapien
ttccttagagttaaagccctacctg

SEQ ID NO: 641212 - DNA, 25 bp, Homo sapien
gagttaaagccctacctgctttggt

SEQ ID NO: 641213 - DNA, 25 bp, Homo sapien
acctgctttggttttattgctcagc

SEQ ID NO: 641214 - DNA, 25 bp, Homo sapien
gttttattgctcagcttgcctataa

SEQ ID NO: 641215 - DNA, 25 bp, Homo sapien
tgctcagcttgcctataaaatctta

SEQ ID NO: 641216 - DNA, 25 bp, Homo sapien
tgggtttctgagggctgtcaatttc

SEQ ID NO: 641217 - DNA, 25 bp, Homo sapien
aaagctgcatagtataagatttcat

SEQ ID NO: 641218 - DNA, 25 bp, Homo sapien
attgcttctttcttttcagagctaa

SEQ ID NO: 641219 - DNA, 25 bp, Homo sapien
gcttctttcttttcagagctaaaga

SEQ ID NO: 641220 - DNA, 25 bp, Homo sapien
acaagagatacctggaaattatcaa

SEQ ID NO: 641221 - DNA, 25 bp, Homo sapien
accaggttaaagtcgttatcagaat

SEQ ID NO: 641222 - DNA, 25 bp, Homo sapien
cgttatcagaattatagatttggct

SEQ ID NO: 641223 - DNA, 25 bp, Homo sapien
gatttggctaggaagtattcttttc

SEQ ID NO: 641224 - DNA, 25 bp, Homo sapien
ggaagtattcttttcatgtgacaat

SEQ ID NO: 641225 - DNA, 25 bp, Homo sapien
tcttttcatgtgacaatttggtcta

SEQ ID NO: 641226 - DNA, 25 bp, Homo sapien
gacaatttggtctatataatttgtg

SEQ ID NO: 641227 - DNA, 25 bp, Homo sapien
agaaggcgccaaacagatatgcaca

SEQ ID NO: 641228 - DNA, 25 bp, Homo sapien
ggcgccaaacagatatgcacagatt

SEQ ID NO: 641229 - DNA, 25 bp, Homo sapien
acagatatgcacagatttcttccaa

SEQ ID NO: 641230 - DNA, 25 bp, Homo sapien
atatgcacagatttcttccaaagtc

SEQ ID NO: 641231 - DNA, 25 bp, Homo sapien
aactacttcaaagaagcccttctga

SEQ ID NO: 641232 - DNA, 25 bp, Homo sapien
agaagcccttctgaattctgtaata

SEQ ID NO: 641233 - DNA, 25 bp, Homo sapien
tctgtaatatggttgaaagtgtttt

SEQ ID NO: 641234 - DNA, 25 bp, Homo sapien
tcagagttcgctactgtactattta

SEQ ID NO: 641235 - DNA, 25 bp, Homo sapien
gttcgctactgtactatttatgtta

SEQ ID NO: 641236 - DNA, 25 bp, Homo sapien
gtactatttatgttacaacttagat

SEQ ID NO: 641237 - DNA, 25 bp, Homo sapien
taaaagctttatgtggtcctggaat

SEQ ID NO: 641238 - DNA, 25 bp, Homo sapien
gaattaaaagttaaaagccaggctg

SEQ ID NO: 641239 - DNA, 25 bp, Homo sapien
taaaagttaaaagccaggctgggca

SEQ ID NO: 641240 - DNA, 25 bp, Homo sapien
aaaagttaaaagccaggctgggcat

SEQ ID NO: 641241 - DNA, 25 bp, Homo sapien
aaagttaaaagccaggctgggcatg

SEQ ID NO: 641242 - DNA, 25 bp, Homo sapien
aagttaaaagccaggctgggcatgg

SEQ ID NO: 641243 - DNA, 25 bp, Homo sapien
agttaaaagccaggctgggcatggt

SEQ ID NO: 641244 - DNA, 25 bp, Homo sapien
tgtgatgaggggcacctgtagtctc

SEQ ID NO: 641245 - DNA, 25 bp, Homo sapien
gtgatgaggggcacctgtagtctca

SEQ ID NO: 641246 - DNA, 25 bp, Homo sapien
tgatgaggggcacctgtagtctcag

SEQ ID NO: 641247 - DNA, 25 bp, Homo sapien
agtggagatcctgacactgcactcc

SEQ ID NO: 641248 - DNA, 25 bp, Homo sapien
gtggagatcctgacactgcactcca

SEQ ID NO: 641249 - DNA, 25 bp, Homo sapien
tggagaaactgtctatggccctacc

SEQ ID NO: 641250 - DNA, 25 bp, Homo sapien
agaaactgtctatggccctaccact

SEQ ID NO: 641251 - DNA, 25 bp, Homo sapien
ctaccactctgaacacgccggatgt

SEQ ID NO: 641252 - DNA, 25 bp, Homo sapien
ctgaacacgccggatgtcatctcat

SEQ ID NO: 641253 - DNA, 25 bp, Homo sapien
atgtcatctcatctcggaagctaag

SEQ ID NO: 641254 - DNA, 25 bp, Homo sapien
ggtcgggcctgcttaggacttgggt

SEQ ID NO: 641255 - DNA, 25 bp, Homo sapien
gaaattgatggacttttgacgatgc

SEQ ID NO: 641256 - DNA, 25 bp, Homo sapien
gacttttgacgatgcaggttttaac

SEQ ID NO: 641257 - DNA, 25 bp, Homo sapien
tttaacatcagatctgagccctaat

SEQ ID NO: 641258 - DNA, 25 bp, Homo sapien
ctgagccctaatagctgtgtgtctc

SEQ ID NO: 641259 - DNA, 25 bp, Homo sapien
tgtgtgtctcagctgtctgggccac

SEQ ID NO: 641260 - DNA, 25 bp, Homo sapien
caaggaaggaaagagcctccctcca

SEQ ID NO: 641261 - DNA, 25 bp, Homo sapien
agatacctcttgcactgctggatcc

SEQ ID NO: 641262 - DNA, 25 bp, Homo sapien
gctggatcctttacttcttcattta

SEQ ID NO: 641263 - DNA, 25 bp, Homo sapien
taaggaaagcagtccttggcccgtc

SEQ ID NO: 641264 - DNA, 25 bp, Homo sapien
gggccagaacacgagaaagagtatt

SEQ ID NO: 641265 - DNA, 25 bp, Homo sapien
tattcagtgactgaggcactcctct

SEQ ID NO: 641266 - DNA, 25 bp, Homo sapien
gaagagaggacagggtcccttccag

SEQ ID NO: 641267 - DNA, 25 bp, Homo sapien
agggtcccttccaggctttgagaag

SEQ ID NO: 641268 - DNA, 25 bp, Homo sapien
agaaggtcaaagctcaagaagatct

SEQ ID NO: 641269 - DNA, 25 bp, Homo sapien
gatctgaggttatctagtccagccc

SEQ ID NO: 641270 - DNA, 25 bp, Homo sapien
gttatctagtccagccccattggga

SEQ ID NO: 641271 - DNA, 25 bp, Homo sapien
taacccacttaagcaatgacagatt

SEQ ID NO: 641272 - DNA, 25 bp, Homo sapien
gatgcccaaattcaccagcgataat

SEQ ID NO: 641273 - DNA, 25 bp, Homo sapien
cgataatccgctggcaaatatttga

SEQ ID NO: 641274 - DNA, 25 bp, Homo sapien
tatttgaactatagccatcctggga

SEQ ID NO: 641275 - DNA, 25 bp, Homo sapien
ccatcctgggaaaaaatactgcttt

SEQ ID NO: 641276 - DNA, 25 bp, Homo sapien
aatagcagcatgctgtgtcacccag

SEQ ID NO: 641277 - DNA, 25 bp, Homo sapien
agcctcttgccatgctggaaccatg

SEQ ID NO: 641278 - DNA, 25 bp, Homo sapien
tgccatgctggaaccatgtggcaca

SEQ ID NO: 641279 - DNA, 25 bp, Homo sapien
gggcttggttgaatcccaactgtgc

SEQ ID NO: 641280 - DNA, 25 bp, Homo sapien
gaatcccaactgtgccacgtgttag

SEQ ID NO: 641281 - DNA, 25 bp, Homo sapien
gtgccacgtgttagctgtgcagctg

SEQ ID NO: 641282 - DNA, 25 bp, Homo sapien
aatacttatgggtaaatctgacaaa

SEQ ID NO: 641283 - DNA, 25 bp, Homo sapien
gacaaaataagtgtaagacctgtac

SEQ ID NO: 641284 - DNA, 25 bp, Homo sapien
aatcggagagatatactttgtttaa

SEQ ID NO: 641285 - DNA, 25 bp, Homo sapien
gatatactttgtttaaaggtcagaa

SEQ ID NO: 641286 - DNA, 25 bp, Homo sapien
agaagtctcagtattgctaaaatga

SEQ ID NO: 641287 - DNA, 25 bp, Homo sapien
gtattgctaaaatgagaactcttcc

SEQ ID NO: 641288 - DNA, 25 bp, Homo sapien
aatgagaactcttcccaatgcagtg

SEQ ID NO: 641289 - DNA, 25 bp, Homo sapien
caatgcagtgctaatcaaatttcta

SEQ ID NO: 641290 - DNA, 25 bp, Homo sapien
taatcaaatttctagcaggcttttt

SEQ ID NO: 641291 - DNA, 25 bp, Homo sapien
aaatttctagcaggctttttgtaga

SEQ ID NO: 641292 - DNA, 25 bp, Homo sapien
agcagatttgaaattcatatggaag

SEQ ID NO: 641293 - DNA, 25 bp, Homo sapien
tacatttataagaatcccgggacga

SEQ ID NO: 641294 - DNA, 25 bp, Homo sapien
acatttataagaatcccgggacgag

SEQ ID NO: 641295 - DNA, 25 bp, Homo sapien
atttataagaatcccgggacgagtg

SEQ ID NO: 641296 - DNA, 25 bp, Homo sapien
taagaatcccgggacgagtgccgtg

SEQ ID NO: 641297 - DNA, 25 bp, Homo sapien
aagaatcccgggacgagtgccgtga

SEQ ID NO: 641298 - DNA, 25 bp, Homo sapien
gaatcccgggacgagtgccgtgact

SEQ ID NO: 641299 - DNA, 25 bp, Homo sapien
aatcccgggacgagtgccgtgactc

SEQ ID NO: 641300 - DNA, 25 bp, Homo sapien
atcccgggacgagtgccgtgactca

SEQ ID NO: 641301 - DNA, 25 bp, Homo sapien
tcccgggacgagtgccgtgactcat

SEQ ID NO: 641302 - DNA, 25 bp, Homo sapien
cccgggacgagtgccgtgactcatg

SEQ ID NO: 641303 - DNA, 25 bp, Homo sapien
gggacgagtgccgtgactcatgcct

SEQ ID NO: 641304 - DNA, 25 bp, Homo sapien
ttgactattctaagtacctcatgta

SEQ ID NO: 641305 - DNA, 25 bp, Homo sapien
attctaagtacctcatgtaagtgta

SEQ ID NO: 641306 - DNA, 25 bp, Homo sapien
gtacctcatgtaagtgtaattatac

SEQ ID NO: 641307 - DNA, 25 bp, Homo sapien
tgttttttgtatctgacttatttca

SEQ ID NO: 641308 - DNA, 25 bp, Homo sapien
cacaatgttttcaaggttaatctat

SEQ ID NO: 641309 - DNA, 25 bp, Homo sapien
tcaaggttaatctatgttgcaacaa

SEQ ID NO: 641310 - DNA, 25 bp, Homo sapien
atgttgcaacaatgtcagaatttct

SEQ ID NO: 641311 - DNA, 25 bp, Homo sapien
ctattcatctgcccatggacatttg

SEQ ID NO: 641312 - DNA, 25 bp, Homo sapien
gaataatgctactaatctgtcatgg

SEQ ID NO: 641313 - DNA, 25 bp, Homo sapien
taatgctactaatctgtcatgggat

SEQ ID NO: 641314 - DNA, 25 bp, Homo sapien
atgctactaatctgtcatgggatta

SEQ ID NO: 641315 - DNA, 25 bp, Homo sapien
atattgtggacatagtgcagttttt

SEQ ID NO: 641316 - DNA, 25 bp, Homo sapien
catagtgcagtttttgttaccttaa

SEQ ID NO: 641317 - DNA, 25 bp, Homo sapien
aataattttctatgtgagaccatat

SEQ ID NO: 641318 - DNA, 25 bp, Homo sapien
gccattttggaagtgcaacataaca

SEQ ID NO: 641319 - DNA, 25 bp, Homo sapien
ggtttaacaactatacagcctgtgt

SEQ ID NO: 641320 - DNA, 25 bp, Homo sapien
aacaactatacagcctgtgtctcta

SEQ ID NO: 641321 - DNA, 25 bp, Homo sapien
tgtctctaatccttccctattttaa

SEQ ID NO: 641322 - DNA, 25 bp, Homo sapien
aaaacttcttgcagtagggatgaga

SEQ ID NO: 641323 - DNA, 25 bp, Homo sapien
ggatgagaacctgtgggtttatatt

SEQ ID NO: 641324 - DNA, 25 bp, Homo sapien
tattggcttaatgatggttgttgtt

SEQ ID NO: 641325 - DNA, 25 bp, Homo sapien
ttttccactggaggcaaggtacttc

SEQ ID NO: 641326 - DNA, 25 bp, Homo sapien
tataagggtgctaaccccatttaag

SEQ ID NO: 641327 - DNA, 25 bp, Homo sapien
ttaaggaggtttcccctcataatct

SEQ ID NO: 641328 - DNA, 25 bp, Homo sapien
gaggtttcccctcataatctaatta

SEQ ID NO: 641329 - DNA, 25 bp, Homo sapien
ttcccctcataatctaattatctct

SEQ ID NO: 641330 - DNA, 25 bp, Homo sapien
attatctctcaaaagccataccttt

SEQ ID NO: 641331 - DNA, 25 bp, Homo sapien
aaagccatacctttcaacaccattg

SEQ ID NO: 641332 - DNA, 25 bp, Homo sapien
catacctttcaacaccattgcattg

SEQ ID NO: 641333 - DNA, 25 bp, Homo sapien
aacaccattgcattgaagatcttta

SEQ ID NO: 641334 - DNA, 25 bp, Homo sapien
cattgcattgaagatctttaccatg

SEQ ID NO: 641335 - DNA, 25 bp, Homo sapien
gagaaaagaccatcactaaagcaaa

SEQ ID NO: 641336 - DNA, 25 bp, Homo sapien
gaccatcactaaagcaaatggatca

SEQ ID NO: 641337 - DNA, 25 bp, Homo sapien
ttttaagtttttatttcacagaatg

SEQ ID NO: 641338 - DNA, 25 bp, Homo sapien
tttaagtttttatttcacagaatga

SEQ ID NO: 641339 - DNA, 25 bp, Homo sapien
ttaagtttttatttcacagaatgat

SEQ ID NO: 641340 - DNA, 25 bp, Homo sapien
taagtttttatttcacagaatgatg

SEQ ID NO: 641341 - DNA, 25 bp, Homo sapien
aagtttttatttcacagaatgatgt

SEQ ID NO: 641342 - DNA, 25 bp, Homo sapien
agtttttatttcacagaatgatgtc

SEQ ID NO: 641343 - DNA, 25 bp, Homo sapien
gtttttatttcacagaatgatgtct

SEQ ID NO: 641344 - DNA, 25 bp, Homo sapien
tttttatttcacagaatgatgtctc

SEQ ID NO: 641345 - DNA, 25 bp, Homo sapien
ttttatttcacagaatgatgtctct

SEQ ID NO: 641346 - DNA, 25 bp, Homo sapien
aaagatgaaggatcctcccagtgcc

SEQ ID NO: 641347 - DNA, 25 bp, Homo sapien
gaaggatcctcccagtgccgtcaag

SEQ ID NO: 641348 - DNA, 25 bp, Homo sapien
cggattccacctccctgtaggtgga

SEQ ID NO: 641349 - DNA, 25 bp, Homo sapien
tccctgtaggtggactgccagcgca

SEQ ID NO: 641350 - DNA, 25 bp, Homo sapien
gcaggccctgacaacgcagagaaag

SEQ ID NO: 641351 - DNA, 25 bp, Homo sapien
gcagagaaagacacaggacccagct

SEQ ID NO: 641352 - DNA, 25 bp, Homo sapien
gggtcctggtttagtctacagcagg

SEQ ID NO: 641353 - DNA, 25 bp, Homo sapien
ggtttagtctacagcagggtcttaa

SEQ ID NO: 641354 - DNA, 25 bp, Homo sapien
cagcagggtcttaaaataggatgta

SEQ ID NO: 641355 - DNA, 25 bp, Homo sapien
gtaagtgttacatcttgacacagtg

SEQ ID NO: 641356 - DNA, 25 bp, Homo sapien
catcttgacacagtgtacacatgct

SEQ ID NO: 641357 - DNA, 25 bp, Homo sapien
aatgtttaaggtgattgagattttt

SEQ ID NO: 641358 - DNA, 25 bp, Homo sapien
tacaatggccaagtggtttatgaaa

SEQ ID NO: 641359 - DNA, 25 bp, Homo sapien
acaatggccaagtggtttatgaaaa

SEQ ID NO: 641360 - DNA, 25 bp, Homo sapien
caatggccaagtggtttatgaaaag

SEQ ID NO: 641361 - DNA, 25 bp, Homo sapien
aatggccaagtggtttatgaaaaga

SEQ ID NO: 641362 - DNA, 25 bp, Homo sapien
atggccaagtggtttatgaaaagat

SEQ ID NO: 641363 - DNA, 25 bp, Homo sapien
tggccaagtggtttatgaaaagatg

SEQ ID NO: 641364 - DNA, 25 bp, Homo sapien
ggccaagtggtttatgaaaagatgc

SEQ ID NO: 641365 - DNA, 25 bp, Homo sapien
gccaagtggtttatgaaaagatgct

SEQ ID NO: 641366 - DNA, 25 bp, Homo sapien
ccaagtggtttatgaaaagatgctc

SEQ ID NO: 641367 - DNA, 25 bp, Homo sapien
gtcttccctatcttgagcctgtgga

SEQ ID NO: 641368 - DNA, 25 bp, Homo sapien
tatcttgagcctgtggacagctgtg

SEQ ID NO: 641369 - DNA, 25 bp, Homo sapien
ggacagctgtgcagtggcaagaaaa

SEQ ID NO: 641370 - DNA, 25 bp, Homo sapien
tggcaagaaaaaggccttcagagct

SEQ ID NO: 641371 - DNA, 25 bp, Homo sapien
agagctacgcagacctggcttcaaa

SEQ ID NO: 641372 - DNA, 25 bp, Homo sapien
ctgatgagccctggtggtcttgcat

SEQ ID NO: 641373 - DNA, 25 bp, Homo sapien
tggtcttgcatgcttgcccttggga

SEQ ID NO: 641374 - DNA, 25 bp, Homo sapien
ccaagctacatgcagaggccactat

SEQ ID NO: 641375 - DNA, 25 bp, Homo sapien
atgcagaggccactatagttgttct

SEQ ID NO: 641376 - DNA, 25 bp, Homo sapien
tatagttgttctggccaacagccca

SEQ ID NO: 641377 - DNA, 25 bp, Homo sapien
ccaagcttcagctgccagacatata

SEQ ID NO: 641378 - DNA, 25 bp, Homo sapien
gcagtgagagggacgaaaccatcca

SEQ ID NO: 641379 - DNA, 25 bp, Homo sapien
agggacgaaaccatccagaggacat

SEQ ID NO: 641380 - DNA, 25 bp, Homo sapien
aaccatccagaggacatgcagtgag

SEQ ID NO: 641381 - DNA, 25 bp, Homo sapien
atgcagtgagggtgctccagctgac

SEQ ID NO: 641382 - DNA, 25 bp, Homo sapien
agtgagggtgctccagctgacccaa

SEQ ID NO: 641383 - DNA, 25 bp, Homo sapien
agctgacccaagtgtgggtgcccta

SEQ ID NO: 641384 - DNA, 25 bp, Homo sapien
gggtgccctaggataagacagagct

SEQ ID NO: 641385 - DNA, 25 bp, Homo sapien
taagacagagctaaagcaggtgccc

SEQ ID NO: 641386 - DNA, 25 bp, Homo sapien
tctacagtgtgatatgccagagtcc

SEQ ID NO: 641387 - DNA, 25 bp, Homo sapien
gaactgaaggttgcgatgccttact

SEQ ID NO: 641388 - DNA, 25 bp, Homo sapien
ttgcgatgccttactctgacgggag

SEQ ID NO: 641389 - DNA, 25 bp, Homo sapien
ccgggaacagtcagaatataaaaag

SEQ ID NO: 641390 - DNA, 25 bp, Homo sapien
gggaacagtcagaatataaaaagga

SEQ ID NO: 641391 - DNA, 25 bp, Homo sapien
agcagcaggacacgcccggaagccc

SEQ ID NO: 641392 - DNA, 25 bp, Homo sapien
agcaggacacgcccggaagccctga

SEQ ID NO: 641393 - DNA, 25 bp, Homo sapien
aggacacgcccggaagccctgacca

SEQ ID NO: 641394 - DNA, 25 bp, Homo sapien
cggaagccctgaccacagagacgcg

SEQ ID NO: 641395 - DNA, 25 bp, Homo sapien
ggaagccctgaccacagagacgcgt

SEQ ID NO: 641396 - DNA, 25 bp, Homo sapien
gaagccctgaccacagagacgcgtc

SEQ ID NO: 641397 - DNA, 25 bp, Homo sapien
aagccctgaccacagagacgcgtcc

SEQ ID NO: 641398 - DNA, 25 bp, Homo sapien
agccctgaccacagagacgcgtcca

SEQ ID NO: 641399 - DNA, 25 bp, Homo sapien
gccctgaccacagagacgcgtccag

SEQ ID NO: 641400 - DNA, 25 bp, Homo sapien
atcagggcggatgatataattttca

SEQ ID NO: 641401 - DNA, 25 bp, Homo sapien
gcttttcaagaaacacacatctttc

SEQ ID NO: 641402 - DNA, 25 bp, Homo sapien
atctttcctttatgttgtattctag

SEQ ID NO: 641403 - DNA, 25 bp, Homo sapien
aactgagcaagtatgtcttcacaca

SEQ ID NO: 641404 - DNA, 25 bp, Homo sapien
agtatgtcttcacacagtggacact

SEQ ID NO: 641405 - DNA, 25 bp, Homo sapien
tggacactgaacaaggcaggagata

SEQ ID NO: 641406 - DNA, 25 bp, Homo sapien
gataaaatgctcaacagtgactcag

SEQ ID NO: 641407 - DNA, 25 bp, Homo sapien
aagatctagggctatcctcacgtgg

SEQ ID NO: 641408 - DNA, 25 bp, Homo sapien
tatcctcacgtggagggttctcatg

SEQ ID NO: 641409 - DNA, 25 bp, Homo sapien
ggttctcatgttatccctgcataaa

SEQ ID NO: 641410 - DNA, 25 bp, Homo sapien
ttatccctgcataaacactacagcc

SEQ ID NO: 641411 - DNA, 25 bp, Homo sapien
aagctatcctggcacacaagtatag

SEQ ID NO: 641412 - DNA, 25 bp, Homo sapien
agtatagaatgccaccagagacaag

SEQ ID NO: 641413 - DNA, 25 bp, Homo sapien
gctggaagaaaaagccaggccacca

SEQ ID NO: 641414 - DNA, 25 bp, Homo sapien
aggccaccagcaacagagacaaaga

SEQ ID NO: 641415 - DNA, 25 bp, Homo sapien
gactcagatgcagcagaggctcagt

SEQ ID NO: 641416 - DNA, 25 bp, Homo sapien
ggctcagtggctagacttaggaccc

SEQ ID NO: 641417 - DNA, 25 bp, Homo sapien
ttaggacccagccagggcttattgc

SEQ ID NO: 641418 - DNA, 25 bp, Homo sapien
ccagccagggcttattgcaaaataa

SEQ ID NO: 641419 - DNA, 25 bp, Homo sapien
gcaaaataagcacttggtaactttt

SEQ ID NO: 641420 - DNA, 25 bp, Homo sapien
aactttttatatctttgccttggca

SEQ ID NO: 641421 - DNA, 25 bp, Homo sapien
tttgccttggcaaccaggaaactca

SEQ ID NO: 641422 - DNA, 25 bp, Homo sapien
aaaggagcgaggttgctgctcttct

SEQ ID NO: 641423 - DNA, 25 bp, Homo sapien
accagctcccggtgctgtcaaaaca

SEQ ID NO: 641424 - DNA, 25 bp, Homo sapien
aggctcagagattagcgctgctact

SEQ ID NO: 641425 - DNA, 25 bp, Homo sapien
tgcccaacctgctcagaaagttcca

SEQ ID NO: 641426 - DNA, 25 bp, Homo sapien
gaaagttccattcttttagcaaagt

SEQ ID NO: 641427 - DNA, 25 bp, Homo sapien
ttttagcaaagttcctggcagctgt

SEQ ID NO: 641428 - DNA, 25 bp, Homo sapien
ggcagctgtgaccacttaaacggct

SEQ ID NO: 641429 - DNA, 25 bp, Homo sapien
ccacttaaacggcttttgcttccat

SEQ ID NO: 641430 - DNA, 25 bp, Homo sapien
ggagactcattaagtcacggagctt

SEQ ID NO: 641431 - DNA, 25 bp, Homo sapien
aacagctctaaagggcccagtagtc

SEQ ID NO: 641432 - DNA, 25 bp, Homo sapien
gtcattcctcagtgaaaagtgccaa

SEQ ID NO: 641433 - DNA, 25 bp, Homo sapien
tggcttccaatctgcacccatccaa

SEQ ID NO: 641434 - DNA, 25 bp, Homo sapien
catccaagccctttgtgtcaggcac

SEQ ID NO: 641435 - DNA, 25 bp, Homo sapien
caggcaccatctcatcttcataaat

SEQ ID NO: 641436 - DNA, 25 bp, Homo sapien
caccatctcatcttcataaatcctg

SEQ ID NO: 641437 - DNA, 25 bp, Homo sapien
cccctgttcctaaatgacatttcac

SEQ ID NO: 641438 - DNA, 25 bp, Homo sapien
acccttcagatctcaatgtcacttt

SEQ ID NO: 641439 - DNA, 25 bp, Homo sapien
gtcacttttgacagaaaccttagcc

SEQ ID NO: 641440 - DNA, 25 bp, Homo sapien
cttttgacagaaaccttagccaggc

SEQ ID NO: 641441 - DNA, 25 bp, Homo sapien
tgacagaaaccttagccaggcatgg

SEQ ID NO: 641442 - DNA, 25 bp, Homo sapien
tctgaagactgaggagaaatgatct

SEQ ID NO: 641443 - DNA, 25 bp, Homo sapien
gaggagaaatgatctcttgaagtca

SEQ ID NO: 641444 - DNA, 25 bp, Homo sapien
taataatatcgactctgggaagatt

SEQ ID NO: 641445 - DNA, 25 bp, Homo sapien
tcgactctgggaagattgatttttc

SEQ ID NO: 641446 - DNA, 25 bp, Homo sapien
ttgatttttcaagactccttcccat

SEQ ID NO: 641447 - DNA, 25 bp, Homo sapien
gatttttcaagactccttcccattt

SEQ ID NO: 641448 - DNA, 25 bp, Homo sapien
taggcaaattaagtatgatcaagtc

SEQ ID NO: 641449 - DNA, 25 bp, Homo sapien
gatcaagtcttctttattgtgtgct

SEQ ID NO: 641450 - DNA, 25 bp, Homo sapien
aagtcttctttattgtgtgctgtaa

SEQ ID NO: 641451 - DNA, 25 bp, Homo sapien
gtcttctttattgtgtgctgtaaaa

SEQ ID NO: 641452 - DNA, 25 bp, Homo sapien
ggagtggcggcaagaatgtaataca

SEQ ID NO: 641453 - DNA, 25 bp, Homo sapien
gtaatacagggcatctgactgctga

SEQ ID NO: 641454 - DNA, 25 bp, Homo sapien
atacagggcatctgactgctgagca

SEQ ID NO: 641455 - DNA, 25 bp, Homo sapien
tcaatcctttcttggcctcagtttc

SEQ ID NO: 641456 - DNA, 25 bp, Homo sapien
tcttcaccagtgaattctgaatgct

SEQ ID NO: 641457 - DNA, 25 bp, Homo sapien
atatttcaggttctttccaactgga

SEQ ID NO: 641458 - DNA, 25 bp, Homo sapien
tttccaactggaaatacccatgcta

SEQ ID NO: 641459 - DNA, 25 bp, Homo sapien
gtcaatagccatagaaacctactga

SEQ ID NO: 641460 - DNA, 25 bp, Homo sapien
ggagtcttgctgactgcatgttcca

SEQ ID NO: 641461 - DNA, 25 bp, Homo sapien
gcatgttccaggctccacatttaag

SEQ ID NO: 641462 - DNA, 25 bp, Homo sapien
aggctccacatttaagctccagtga

SEQ ID NO: 641463 - DNA, 25 bp, Homo sapien
gtgactgctgatgactgcatgacct

SEQ ID NO: 641464 - DNA, 25 bp, Homo sapien
gcatgacctaacacatgtcctcaat

SEQ ID NO: 641465 - DNA, 25 bp, Homo sapien
taacacatgtcctcaatcctttctt

SEQ ID NO: 641466 - DNA, 25 bp, Homo sapien
ccagcacatggccttaggctggagt

SEQ ID NO: 641467 - DNA, 25 bp, Homo sapien
agcacatggccttaggctggagtgt

SEQ ID NO: 641468 - DNA, 25 bp, Homo sapien
ggagtacagacacataccatcacgc

SEQ ID NO: 641469 - DNA, 25 bp, Homo sapien
gagtacagacacataccatcacgcc

SEQ ID NO: 641470 - DNA, 25 bp, Homo sapien
gtacagacacataccatcacgcctg

SEQ ID NO: 641471 - DNA, 25 bp, Homo sapien
atttgtagtagggacaaggtttcat

SEQ ID NO: 641472 - DNA, 25 bp, Homo sapien
atgcccagccgagacagggtgcttt

SEQ ID NO: 641473 - DNA, 25 bp, Homo sapien
tgcccagccgagacagggtgcttta

SEQ ID NO: 641474 - DNA, 25 bp, Homo sapien
gcccagccgagacagggtgctttat

SEQ ID NO: 641475 - DNA, 25 bp, Homo sapien
cccagccgagacagggtgctttata

SEQ ID NO: 641476 - DNA, 25 bp, Homo sapien
ccagccgagacagggtgctttatac

SEQ ID NO: 641477 - DNA, 25 bp, Homo sapien
gaaaacctgacatcaacgtacaaag

SEQ ID NO: 641478 - DNA, 25 bp, Homo sapien
aggtaactcttgtggccatgggtgc

SEQ ID NO: 641479 - DNA, 25 bp, Homo sapien
tctgccatgcagaggagaagccgct

SEQ ID NO: 641480 - DNA, 25 bp, Homo sapien
agaagccgctggttgtagcagcaac

SEQ ID NO: 641481 - DNA, 25 bp, Homo sapien
gctggttgtagcagcaacactccag

SEQ ID NO: 641482 - DNA, 25 bp, Homo sapien
ccagcttacctggagcaaagtgcat

SEQ ID NO: 641483 - DNA, 25 bp, Homo sapien
agtgcataaaggaaaggccgtgtga

SEQ ID NO: 641484 - DNA, 25 bp, Homo sapien
tctgcaacctgaccagcaagatctc

SEQ ID NO: 641485 - DNA, 25 bp, Homo sapien
tgaccagcaagatctcaccagaaac

SEQ ID NO: 641486 - DNA, 25 bp, Homo sapien
gcttgcactgtgatcttggaattct

SEQ ID NO: 641487 - DNA, 25 bp, Homo sapien
gcactgtgatcttggaattctagcc

SEQ ID NO: 641488 - DNA, 25 bp, Homo sapien
aagcgcattgctcagctttttcctt

SEQ ID NO: 641489 - DNA, 25 bp, Homo sapien
ttttccttctgcatctctgtatgtg

SEQ ID NO: 641490 - DNA, 25 bp, Homo sapien
cttctgcatctctgtatgtgccatt

SEQ ID NO: 641491 - DNA, 25 bp, Homo sapien
atttcttctacccagcttcctgatc

SEQ ID NO: 641492 - DNA, 25 bp, Homo sapien
cccagcttcctgatctatttattaa

SEQ ID NO: 641493 - DNA, 25 bp, Homo sapien
cctggctcacagatatgagtgaaag

SEQ ID NO: 641494 - DNA, 25 bp, Homo sapien
ggagcaaagaaatggtcacaagaca

SEQ ID NO: 641495 - DNA, 25 bp, Homo sapien
aagacaactaggagacacggtgctg

SEQ ID NO: 641496 - DNA, 25 bp, Homo sapien
ggtcagcccttctgtacgtgcatgg

SEQ ID NO: 641497 - DNA, 25 bp, Homo sapien
acgtgcatggcagctagttgctcaa

SEQ ID NO: 641498 - DNA, 25 bp, Homo sapien
agctagttgctcaagcgcattgctc

SEQ ID NO: 641499 - DNA, 25 bp, Homo sapien
aaacaaacagaaaaatagccaggtg

SEQ ID NO: 641500 - DNA, 25 bp, Homo sapien
agctaccctggaggcctaggcgggg

SEQ ID NO: 641501 - DNA, 25 bp, Homo sapien
taccctggaggcctaggcggggaga

SEQ ID NO: 641502 - DNA, 25 bp, Homo sapien
accctggaggcctaggcggggagat

SEQ ID NO: 641503 - DNA, 25 bp, Homo sapien
tggaggcctaggcggggagatcgct

SEQ ID NO: 641504 - DNA, 25 bp, Homo sapien
gtcgaggcttcagcgaaccaagatc

SEQ ID NO: 641505 - DNA, 25 bp, Homo sapien
cgaggcttcagcgaaccaagatcac

SEQ ID NO: 641506 - DNA, 25 bp, Homo sapien
gaggcttcagcgaaccaagatcacg

SEQ ID NO: 641507 - DNA, 25 bp, Homo sapien
aggcttcagcgaaccaagatcacgc

SEQ ID NO: 641508 - DNA, 25 bp, Homo sapien
ggcttcagcgaaccaagatcacgcc

SEQ ID NO: 641509 - DNA, 25 bp, Homo sapien
gcttcagcgaaccaagatcacgcca

SEQ ID NO: 641510 - DNA, 25 bp, Homo sapien
tacccgtggcaaaggaccgtgggat

SEQ ID NO: 641511 - DNA, 25 bp, Homo sapien
ggaccgtgggatactcaccccttag

SEQ ID NO: 641512 - DNA, 25 bp, Homo sapien
gaccgtgggatactcaccccttagg

SEQ ID NO: 641513 - DNA, 25 bp, Homo sapien
gatactcaccccttagggcccggag

SEQ ID NO: 641514 - DNA, 25 bp, Homo sapien
tcttcctccattttgatctccgtcg

SEQ ID NO: 641515 - DNA, 25 bp, Homo sapien
tccattttgatctccgtcgccgcca

SEQ ID NO: 641516 - DNA, 25 bp, Homo sapien
gcgtctgggctttgtgtgagcgaac

SEQ ID NO: 641517 - DNA, 25 bp, Homo sapien
ctttgtgtgagcgaacgggctgcac

SEQ ID NO: 641518 - DNA, 25 bp, Homo sapien
tttgtgtgagcgaacgggctgcacc

SEQ ID NO: 641519 - DNA, 25 bp, Homo sapien
ccacgtgacccgacgcaaccagtaa

SEQ ID NO: 641520 - DNA, 25 bp, Homo sapien
gacccgacgcaaccagtaacacctg

SEQ ID NO: 641521 - DNA, 25 bp, Homo sapien
cccgccttgacttcccgagtagctg

SEQ ID NO: 641522 - DNA, 25 bp, Homo sapien
agtagctgggtttacggtgcctgcc

SEQ ID NO: 641523 - DNA, 25 bp, Homo sapien
gacctcaggccacccaaggcagagg

SEQ ID NO: 641524 - DNA, 25 bp, Homo sapien
cagaggctcacagatggaactgcag

SEQ ID NO: 641525 - DNA, 25 bp, Homo sapien
gaggctcacagatggaactgcaggc

SEQ ID NO: 641526 - DNA, 25 bp, Homo sapien
gctcacagatggaactgcaggccac

SEQ ID NO: 641527 - DNA, 25 bp, Homo sapien
gatggaactgcaggccacagtatca

SEQ ID NO: 641528 - DNA, 25 bp, Homo sapien
ggaactgcaggccacagtatcaccc

SEQ ID NO: 641529 - DNA, 25 bp, Homo sapien
catccctcactcttatgacaactaa

SEQ ID NO: 641530 - DNA, 25 bp, Homo sapien
tccctcactcttatgacaactaatt

SEQ ID NO: 641531 - DNA, 25 bp, Homo sapien
actcttatgacaactaattatcaag

SEQ ID NO: 641532 - DNA, 25 bp, Homo sapien
gttgggacgcgcctacccggtcact

SEQ ID NO: 641533 - DNA, 25 bp, Homo sapien
atcgtggtcggcgagcgcgcccgag

SEQ ID NO: 641534 - DNA, 25 bp, Homo sapien
agcggagcccgcccgggactacatt

SEQ ID NO: 641535 - DNA, 25 bp, Homo sapien
tacatttcccacaattaccgccatg

SEQ ID NO: 641536 - DNA, 25 bp, Homo sapien
atttcccacaattaccgccatgatg

SEQ ID NO: 641537 - DNA, 25 bp, Homo sapien
aattaccgccatgatgcccattggt

SEQ ID NO: 641538 - DNA, 25 bp, Homo sapien
taccgccatgatgcccattggtggg

SEQ ID NO: 641539 - DNA, 25 bp, Homo sapien
aagccatgggaaccggaggccgtca

SEQ ID NO: 641540 - DNA, 25 bp, Homo sapien
ggccgagactgaggcggttgcggaa

SEQ ID NO: 641541 - DNA, 25 bp, Homo sapien
gttgcggaataggactgctagcccc

SEQ ID NO: 641542 - DNA, 25 bp, Homo sapien
gcggaataggactgctagccccgcc

SEQ ID NO: 641543 - DNA, 25 bp, Homo sapien
gggtgtgctgcttcctatactggtg

SEQ ID NO: 641544 - DNA, 25 bp, Homo sapien
ggtgtgctgcttcctatactggtgg

SEQ ID NO: 641545 - DNA, 25 bp, Homo sapien
gtgtgctgcttcctatactggtggg

SEQ ID NO: 641546 - DNA, 25 bp, Homo sapien
gggtgacttcaggatggtgtgtgga

SEQ ID NO: 641547 - DNA, 25 bp, Homo sapien
ggtgacttcaggatggtgtgtggag

SEQ ID NO: 641548 - DNA, 25 bp, Homo sapien
tgacttcaggatggtgtgtggagga

SEQ ID NO: 641549 - DNA, 25 bp, Homo sapien
gacttcaggatggtgtgtggaggaa

SEQ ID NO: 641550 - DNA, 25 bp, Homo sapien
tcaggatggtgtgtggaggaagtgt

SEQ ID NO: 641551 - DNA, 25 bp, Homo sapien
ggaggaagtgtgtgaatgtagggat

SEQ ID NO: 641552 - DNA, 25 bp, Homo sapien
aatgtagggatgtagaggttttggc

SEQ ID NO: 641553 - DNA, 25 bp, Homo sapien
tagggatgtagaggttttggctgtg

SEQ ID NO: 641554 - DNA, 25 bp, Homo sapien
tgctgccttttggatccaattcttt

SEQ ID NO: 641555 - DNA, 25 bp, Homo sapien
ttttggatccaattctttattactt

SEQ ID NO: 641556 - DNA, 25 bp, Homo sapien
tctttattactttatggcttcagag

SEQ ID NO: 641557 - DNA, 25 bp, Homo sapien
atggcttcagagtttcgtgaccaac

SEQ ID NO: 641558 - DNA, 25 bp, Homo sapien
agagtttcgtgaccaactatcccgc

SEQ ID NO: 641559 - DNA, 25 bp, Homo sapien
aactatcccgccatggcagttctgt

SEQ ID NO: 641560 - DNA, 25 bp, Homo sapien
gctcccgcctcatgagcaaggagag

SEQ ID NO: 641561 - DNA, 25 bp, Homo sapien
gcaaggagagtggttcatcaatgat

SEQ ID NO: 641562 - DNA, 25 bp, Homo sapien
gagtggttcatcaatgattggctaa

SEQ ID NO: 641563 - DNA, 25 bp, Homo sapien
ttccaaaggccagaattgtcaacca

SEQ ID NO: 641564 - DNA, 25 bp, Homo sapien
tgtgtaatattcacagtcaacaggg

SEQ ID NO: 641565 - DNA, 25 bp, Homo sapien
atcctgaaaccaatgtgagtcattg

SEQ ID NO: 641566 - DNA, 25 bp, Homo sapien
cattgtgtgataaggtgtatttctc

SEQ ID NO: 641567 - DNA, 25 bp, Homo sapien
tatcacataatctaacacatgctag

SEQ ID NO: 641568 - DNA, 25 bp, Homo sapien
caggcactatacactgggattcagt

SEQ ID NO: 641569 - DNA, 25 bp, Homo sapien
actgggattcagtggtgtatgagat

SEQ ID NO: 641570 - DNA, 25 bp, Homo sapien
aaaatatctgtcttcccatggacct

SEQ ID NO: 641571 - DNA, 25 bp, Homo sapien
atctgtcttcccatggaccttagtg

SEQ ID NO: 641572 - DNA, 25 bp, Homo sapien
ttcccatggaccttagtgctgagtg

SEQ ID NO: 641573 - DNA, 25 bp, Homo sapien
atggaccttagtgctgagtgggttt

SEQ ID NO: 641574 - DNA, 25 bp, Homo sapien
gacagaagtcacagctatgattggt

SEQ ID NO: 641575 - DNA, 25 bp, Homo sapien
tatgattggtgtggtgatgcacgcc

SEQ ID NO: 641576 - DNA, 25 bp, Homo sapien
agaacttgctgcctcttgctcagtt

SEQ ID NO: 641577 - DNA, 25 bp, Homo sapien
ctcagtttcttcctggagctttcaa

SEQ ID NO: 641578 - DNA, 25 bp, Homo sapien
ttcttcctggagctttcaagcatct

SEQ ID NO: 641579 - DNA, 25 bp, Homo sapien
aagcatctttgcagggaagtcacat

SEQ ID NO: 641580 - DNA, 25 bp, Homo sapien
tgcagggaagtcacatccttcccag

SEQ ID NO: 641581 - DNA, 25 bp, Homo sapien
cagcccgactgaccatgggagaaga

SEQ ID NO: 641582 - DNA, 25 bp, Homo sapien
gatgaggcatcctggaatatccagg

SEQ ID NO: 641583 - DNA, 25 bp, Homo sapien
atatccaggtggcaacatggagtag

SEQ ID NO: 641584 - DNA, 25 bp, Homo sapien
tacttctaggccatgaaaaaccagc

SEQ ID NO: 641585 - DNA, 25 bp, Homo sapien
tgaaaaaccagcaggatccatgatg

SEQ ID NO: 641586 - DNA, 25 bp, Homo sapien
agaagctttattaaattagcctaat

SEQ ID NO: 641587 - DNA, 25 bp, Homo sapien
ttctcaagaagtttcagtcataaaa

SEQ ID NO: 641588 - DNA, 25 bp, Homo sapien
caagaagtttcagtcataaaagcaa

SEQ ID NO: 641589 - DNA, 25 bp, Homo sapien
gaagtttcagtcataaaagcaaata

SEQ ID NO: 641590 - DNA, 25 bp, Homo sapien
agtttcagtcataaaagcaaatact

SEQ ID NO: 641591 - DNA, 25 bp, Homo sapien
gcaaatactttgacagatactactg

SEQ ID NO: 641592 - DNA, 25 bp, Homo sapien
aaatactttgacagatactactgag

SEQ ID NO: 641593 - DNA, 25 bp, Homo sapien
gatactactgagaagctatttaaga

SEQ ID NO: 641594 - DNA, 25 bp, Homo sapien
actactgagaagctatttaagaaaa

SEQ ID NO: 641595 - DNA, 25 bp, Homo sapien
gatatatgtgggaatgtttcaagtt

SEQ ID NO: 641596 - DNA, 25 bp, Homo sapien
ataaatatcatgtatcctcttttac

SEQ ID NO: 641597 - DNA, 25 bp, Homo sapien
aaatatcatgtatcctcttttacaa

SEQ ID NO: 641598 - DNA, 25 bp, Homo sapien
actaccctcaattgcagctctgaag

SEQ ID NO: 641599 - DNA, 25 bp, Homo sapien
ggagtttgggctctgaattactata

SEQ ID NO: 641600 - DNA, 25 bp, Homo sapien
gggctctgaattactatagcagcat

SEQ ID NO: 641601 - DNA, 25 bp, Homo sapien
gtagaaactgatatgctgaatggat

SEQ ID NO: 641602 - DNA, 25 bp, Homo sapien
aagggaacagatcaccacttccaat

SEQ ID NO: 641603 - DNA, 25 bp, Homo sapien
tcaccacttccaatacacgacaatg

SEQ ID NO: 641604 - DNA, 25 bp, Homo sapien
ccaatacacgacaatgcctgttctt

SEQ ID NO: 641605 - DNA, 25 bp, Homo sapien
gactgtaacagaagtatctcgcatt

SEQ ID NO: 641606 - DNA, 25 bp, Homo sapien
atctcgcattgcattttatctggga

SEQ ID NO: 641607 - DNA, 25 bp, Homo sapien
cgcattgcattttatctgggaaaaa

SEQ ID NO: 641608 - DNA, 25 bp, Homo sapien
gggctatgcacactaccctcaattg

SEQ ID NO: 641609 - DNA, 25 bp, Homo sapien
atatagttgtgggttgctcttgtaa

SEQ ID NO: 641610 - DNA, 25 bp, Homo sapien
gggttgctcttgtaaacaggcttta

SEQ ID NO: 641611 - DNA, 25 bp, Homo sapien
caggctttactgactgtgaaacttc

SEQ ID NO: 641612 - DNA, 25 bp, Homo sapien
ttgtaacatgtattttctactctgc

SEQ ID NO: 641613 - DNA, 25 bp, Homo sapien
tttctactctgcacttgatcttagc

SEQ ID NO: 641614 - DNA, 25 bp, Homo sapien
gagaagcgattctaccctggatagt

SEQ ID NO: 641615 - DNA, 25 bp, Homo sapien
tctaccctggatagtatatgctgta

SEQ ID NO: 641616 - DNA, 25 bp, Homo sapien
tatgctgtaattaagtatctccaag

SEQ ID NO: 641617 - DNA, 25 bp, Homo sapien
aggtgtttattagccattctgagta

SEQ ID NO: 641618 - DNA, 25 bp, Homo sapien
gaagtagtatctaactctcatgtag

SEQ ID NO: 641619 - DNA, 25 bp, Homo sapien
aactctcatgtagtcatttgttatg

SEQ ID NO: 641620 - DNA, 25 bp, Homo sapien
acatacttatatgggcttcacctaa

SEQ ID NO: 641621 - DNA, 25 bp, Homo sapien
acttatatgggcttcacctaaactg

SEQ ID NO: 641622 - DNA, 25 bp, Homo sapien
tatatgggcttcacctaaactgagg

SEQ ID NO: 641623 - DNA, 25 bp, Homo sapien
cctaaactgaggtgaattaactaag

SEQ ID NO: 641624 - DNA, 25 bp, Homo sapien
tatacattcaagatacaggaaccat

SEQ ID NO: 641625 - DNA, 25 bp, Homo sapien
caagatacaggaaccatctggtatt

SEQ ID NO: 641626 - DNA, 25 bp, Homo sapien
accatctggtatttgttatagtgac

SEQ ID NO: 641627 - DNA, 25 bp, Homo sapien
tgttatagtgacatactccagaata

SEQ ID NO: 641628 - DNA, 25 bp, Homo sapien
tttcacaactacaagtcataggaat

SEQ ID NO: 641629 - DNA, 25 bp, Homo sapien
aacatttctcaccatgttacataaa

SEQ ID NO: 641630 - DNA, 25 bp, Homo sapien
ttattgtgttctgtttattagtaaa

SEQ ID NO: 641631 - DNA, 25 bp, Homo sapien
taacctattcattgtattgttgcgg

SEQ ID NO: 641632 - DNA, 25 bp, Homo sapien
tgtattgttgcggtagatcgagcta

SEQ ID NO: 641633 - DNA, 25 bp, Homo sapien
gatcgagctacatgctgcacagcaa

SEQ ID NO: 641634 - DNA, 25 bp, Homo sapien
gcaaaagaccttctttgcacttctt

SEQ ID NO: 641635 - DNA, 25 bp, Homo sapien
tgcacttctttcaagcagaattatt

SEQ ID NO: 641636 - DNA, 25 bp, Homo sapien
attgctgtatattcactctgaactg

SEQ ID NO: 641637 - DNA, 25 bp, Homo sapien
attttgtggtggtgcttatgtgtgc

SEQ ID NO: 641638 - DNA, 25 bp, Homo sapien
gtggtgcttatgtgtgcacagacat

SEQ ID NO: 641639 - DNA, 25 bp, Homo sapien
atgcatgaggcctccgcatcttcca

SEQ ID NO: 641640 - DNA, 25 bp, Homo sapien
cctccgcatcttccaaacttggaaa

SEQ ID NO: 641641 - DNA, 25 bp, Homo sapien
ttaacagcacaaatatatctacatg

SEQ ID NO: 641642 - DNA, 25 bp, Homo sapien
accgcacgggcacgctggagttcat

SEQ ID NO: 641643 - DNA, 25 bp, Homo sapien
acgggcacgctggagttcatggctc

SEQ ID NO: 641644 - DNA, 25 bp, Homo sapien
gcacgctggagttcatggctccgga

SEQ ID NO: 641645 - DNA, 25 bp, Homo sapien
cgctggagttcatggctccggagat

SEQ ID NO: 641646 - DNA, 25 bp, Homo sapien
gagttcatggctccggagatggtga

SEQ ID NO: 641647 - DNA, 25 bp, Homo sapien
aagggagaacccatcggctctgcca

SEQ ID NO: 641648 - DNA, 25 bp, Homo sapien
gggagaacccatcggctctgccacg

SEQ ID NO: 641649 - DNA, 25 bp, Homo sapien
catcggctctgccacggacatctgg

SEQ ID NO: 641650 - DNA, 25 bp, Homo sapien
agcgggtgtgctcacttacattatg

SEQ ID NO: 641651 - DNA, 25 bp, Homo sapien
gggtgtgctcacttacattatgctc

SEQ ID NO: 641652 - DNA, 25 bp, Homo sapien
tgtacatccctggagccggccatcc

SEQ ID NO: 641653 - DNA, 25 bp, Homo sapien
tattccatgactctacagggcttaa

SEQ ID NO: 641654 - DNA, 25 bp, Homo sapien
acagggcttaatgcgtgtgacatat

SEQ ID NO: 641655 - DNA, 25 bp, Homo sapien
gtgacatatacttgaatgctgcttc

SEQ ID NO: 641656 - DNA, 25 bp, Homo sapien
gatacaggatttatgatacagcttg

SEQ ID NO: 641657 - DNA, 25 bp, Homo sapien
atacagcttgtggtacgttcgtcat

SEQ ID NO: 641658 - DNA, 25 bp, Homo sapien
ggtacgttcgtcattatctatttga

SEQ ID NO: 641659 - DNA, 25 bp, Homo sapien
atgcatccaaattttacccacacaa

SEQ ID NO: 641660 - DNA, 25 bp, Homo sapien
tcttaacgttgaatatctactggtg

SEQ ID NO: 641661 - DNA, 25 bp, Homo sapien
gtgagaaaattgatcctcagaggaa

SEQ ID NO: 641662 - DNA, 25 bp, Homo sapien
gaagactgcatgcatttagcaggaa

SEQ ID NO: 641663 - DNA, 25 bp, Homo sapien
aaatccactaaaatctgtctcaagg

SEQ ID NO: 641664 - DNA, 25 bp, Homo sapien
tacagctacttggtaattaaacaaa

SEQ ID NO: 641665 - DNA, 25 bp, Homo sapien
tgttaactaattagcttttggcctt

SEQ ID NO: 641666 - DNA, 25 bp, Homo sapien
taattagcttttggcctttgataga

SEQ ID NO: 641667 - DNA, 25 bp, Homo sapien
aattttagaattggtcttgactact

SEQ ID NO: 641668 - DNA, 25 bp, Homo sapien
ggtcttgactactaaactattgcta

SEQ ID NO: 641669 - DNA, 25 bp, Homo sapien
tgactactaaactattgctaaaatt

SEQ ID NO: 641670 - DNA, 25 bp, Homo sapien
ggctaaaagtttttgtctcatctgc

SEQ ID NO: 641671 - DNA, 25 bp, Homo sapien
ttcagtttactagtagctttaatta

SEQ ID NO: 641672 - DNA, 25 bp, Homo sapien
taaagctgagccttttacagctact

SEQ ID NO: 641673 - DNA, 25 bp, Homo sapien
ctgagccttttacagctacttggta

SEQ ID NO: 641674 - DNA, 25 bp, Homo sapien
gagccttttacagctacttggtaat

SEQ ID NO: 641675 - DNA, 25 bp, Homo sapien
tatatatatatggtctgggcatggt

SEQ ID NO: 641676 - DNA, 25 bp, Homo sapien
atatatatatggtctgggcatggtg

SEQ ID NO: 641677 - DNA, 25 bp, Homo sapien
atatatatggtctgggcatggtggc

SEQ ID NO: 641678 - DNA, 25 bp, Homo sapien
gcagtaagccgagagggagccacca

SEQ ID NO: 641679 - DNA, 25 bp, Homo sapien
cagtaagccgagagggagccaccac

SEQ ID NO: 641680 - DNA, 25 bp, Homo sapien
agtaagccgagagggagccaccaca

SEQ ID NO: 641681 - DNA, 25 bp, Homo sapien
gtaagccgagagggagccaccacac

SEQ ID NO: 641682 - DNA, 25 bp, Homo sapien
taagccgagagggagccaccacact

SEQ ID NO: 641683 - DNA, 25 bp, Homo sapien
aagccgagagggagccaccacactc

SEQ ID NO: 641684 - DNA, 25 bp, Homo sapien
gccgagagggagccaccacactcca

SEQ ID NO: 641685 - DNA, 25 bp, Homo sapien
ccgagagggagccaccacactccag

SEQ ID NO: 641686 - DNA, 25 bp, Homo sapien
ggaggtgtgtccagcttcccggaaa

SEQ ID NO: 641687 - DNA, 25 bp, Homo sapien
ttcccggaaagacctcagctgtcta

SEQ ID NO: 641688 - DNA, 25 bp, Homo sapien
cagctgtctagctggtctgggctgc

SEQ ID NO: 641689 - DNA, 25 bp, Homo sapien
tgcccagttcttagcagtgcatcag

SEQ ID NO: 641690 - DNA, 25 bp, Homo sapien
agtgcatcagcaatgagcagccgct

SEQ ID NO: 641691 - DNA, 25 bp, Homo sapien
tttcccgcctgccagagaacgtcag

SEQ ID NO: 641692 - DNA, 25 bp, Homo sapien
agagaacgtcagagccactgcgtct

SEQ ID NO: 641693 - DNA, 25 bp, Homo sapien
agccactgcgtctggaccagctgaa

SEQ ID NO: 641694 - DNA, 25 bp, Homo sapien
tggaccagctgaaggcagccacggt

SEQ ID NO: 641695 - DNA, 25 bp, Homo sapien
aaggcagccacggtgcccaggatgc

SEQ ID NO: 641696 - DNA, 25 bp, Homo sapien
tacagcctggtggttttgttttatg

SEQ ID NO: 641697 - DNA, 25 bp, Homo sapien
cggaggcgtccaagcccaagggcta

SEQ ID NO: 641698 - DNA, 25 bp, Homo sapien
aagcccaagggctacgctgtgagct

SEQ ID NO: 641699 - DNA, 25 bp, Homo sapien
aagggctacgctgtgagctgcacta

SEQ ID NO: 641700 - DNA, 25 bp, Homo sapien
tactcggcgctcagctcgctggctg

SEQ ID NO: 641701 - DNA, 25 bp, Homo sapien
gccctccggagatgctgccgtggaa

SEQ ID NO: 641702 - DNA, 25 bp, Homo sapien
ctccggagatgctgccgtggaagaa

SEQ ID NO: 641703 - DNA, 25 bp, Homo sapien
gatgctgccgtggaagaagcaccaa

SEQ ID NO: 641704 - DNA, 25 bp, Homo sapien
gctgccgtggaagaagcaccaagtc

SEQ ID NO: 641705 - DNA, 25 bp, Homo sapien
ggaagaagcaccaagtccgagctgc

SEQ ID NO: 641706 - DNA, 25 bp, Homo sapien
agaagcaccaagtccgagctgctgg

SEQ ID NO: 641707 - DNA, 25 bp, Homo sapien
caccaagtccgagctgctggcgagg

SEQ ID NO: 641708 - DNA, 25 bp, Homo sapien
gcaggaacaatgtgggcccaacctt

SEQ ID NO: 641709 - DNA, 25 bp, Homo sapien
agtgcctgctaaccagacttcaaca

SEQ ID NO: 641710 - DNA, 25 bp, Homo sapien
taaccagacttcaacatttcccaca

SEQ ID NO: 641711 - DNA, 25 bp, Homo sapien
aggattcaaacatgacccagatctc

SEQ ID NO: 641712 - DNA, 25 bp, Homo sapien
gacccagatctcataaagtcatatt

SEQ ID NO: 641713 - DNA, 25 bp, Homo sapien
atagcccaaaattgcttgacacacg

SEQ ID NO: 641714 - DNA, 25 bp, Homo sapien
ttgcttgacacacgaagaaccacaa

SEQ ID NO: 641715 - DNA, 25 bp, Homo sapien
agaaccacaacatttcaacttgcag

SEQ ID NO: 641716 - DNA, 25 bp, Homo sapien
tcaacttgcagctgggcaccgcggc

SEQ ID NO: 641717 - DNA, 25 bp, Homo sapien
tagttccctgggaggccacggctgc

SEQ ID NO: 641718 - DNA, 25 bp, Homo sapien
tgcagggagcaatcaccgggccact

SEQ ID NO: 641719 - DNA, 25 bp, Homo sapien
attatcacctatttcatgggaagat

SEQ ID NO: 641720 - DNA, 25 bp, Homo sapien
ttatcacctatttcatgggaagatt

SEQ ID NO: 641721 - DNA, 25 bp, Homo sapien
tatcacctatttcatgggaagattt

SEQ ID NO: 641722 - DNA, 25 bp, Homo sapien
atcacctatttcatgggaagattta

SEQ ID NO: 641723 - DNA, 25 bp, Homo sapien
tcacctatttcatgggaagatttag

SEQ ID NO: 641724 - DNA, 25 bp, Homo sapien
cacctatttcatgggaagatttaga

SEQ ID NO: 641725 - DNA, 25 bp, Homo sapien
acctatttcatgggaagatttagat

SEQ ID NO: 641726 - DNA, 25 bp, Homo sapien
tcatgggaagatttagattggtaat

SEQ ID NO: 641727 - DNA, 25 bp, Homo sapien
catgggaagatttagattggtaata

SEQ ID NO: 641728 - DNA, 25 bp, Homo sapien
atgggaagatttagattggtaataa

SEQ ID NO: 641729 - DNA, 25 bp, Homo sapien
tgggaagatttagattggtaataat

SEQ ID NO: 641730 - DNA, 25 bp, Homo sapien
ccagcagttgctaataatatactat

SEQ ID NO: 641731 - DNA, 25 bp, Homo sapien
atactcacgctgcagcgtcacatta

SEQ ID NO: 641732 - DNA, 25 bp, Homo sapien
acgctgcagcgtcacattaatcttt

SEQ ID NO: 641733 - DNA, 25 bp, Homo sapien
gctgcagcgtcacattaatctttgt

SEQ ID NO: 641734 - DNA, 25 bp, Homo sapien
gtcacattaatctttgtgccgccag

SEQ ID NO: 641735 - DNA, 25 bp, Homo sapien
acattaatctttgtgccgccagtgc

SEQ ID NO: 641736 - DNA, 25 bp, Homo sapien
attaatctttgtgccgccagtgcct

SEQ ID NO: 641737 - DNA, 25 bp, Homo sapien
gccagtgcctatgccatgcttagta

SEQ ID NO: 641738 - DNA, 25 bp, Homo sapien
gtgcctatgccatgcttagtatgca

SEQ ID NO: 641739 - DNA, 25 bp, Homo sapien
gccatgcttagtatgcatcaaatat

SEQ ID NO: 641740 - DNA, 25 bp, Homo sapien
caaatatttgagcagtacacaagtg

SEQ ID NO: 641741 - DNA, 25 bp, Homo sapien
gtgacagccaaggtggatcatgaac

SEQ ID NO: 641742 - DNA, 25 bp, Homo sapien
gagggcacagcgcaagcaaagtctt

SEQ ID NO: 641743 - DNA, 25 bp, Homo sapien
cacagcgcaagcaaagtcttggcaa

SEQ ID NO: 641744 - DNA, 25 bp, Homo sapien
aaagagctaatgcatcccagaaatg

SEQ ID NO: 641745 - DNA, 25 bp, Homo sapien
agagctaatgcatcccagaaatggg

SEQ ID NO: 641746 - DNA, 25 bp, Homo sapien
gtggagtactggaagctacaccaag

SEQ ID NO: 641747 - DNA, 25 bp, Homo sapien
gagtactggaagctacaccaagctt

SEQ ID NO: 641748 - DNA, 25 bp, Homo sapien
tacaccaagcttcagagtggtcctg

SEQ ID NO: 641749 - DNA, 25 bp, Homo sapien
aagcttcagagtggtcctgtggcct

SEQ ID NO: 641750 - DNA, 25 bp, Homo sapien
cctgtggcctcggtgtggtagctca

SEQ ID NO: 641751 - DNA, 25 bp, Homo sapien
cctcggtgtggtagctcaggcctat

SEQ ID NO: 641752 - DNA, 25 bp, Homo sapien
gagaatttctgcagcttcacatttt

SEQ ID NO: 641753 - DNA, 25 bp, Homo sapien
tctgcagcttcacattttggacagc

SEQ ID NO: 641754 - DNA, 25 bp, Homo sapien
cagcacttggtctgttcagtttttg

SEQ ID NO: 641755 - DNA, 25 bp, Homo sapien
tcagtttttgttttgccagtgtaat

SEQ ID NO: 641756 - DNA, 25 bp, Homo sapien
gggcattaaatgataacttactatt

SEQ ID NO: 641757 - DNA, 25 bp, Homo sapien
taattacttgtgaggttaagcacct

SEQ ID NO: 641758 - DNA, 25 bp, Homo sapien
gttaagcaccttttcatgttttgtt

SEQ ID NO: 641759 - DNA, 25 bp, Homo sapien
tgctatttgatttctgtacctgtga

SEQ ID NO: 641760 - DNA, 25 bp, Homo sapien
ttgatttctgtacctgtgaacttca

SEQ ID NO: 641761 - DNA, 25 bp, Homo sapien
gtgaacttcaggtttacattcgttt

SEQ ID NO: 641762 - DNA, 25 bp, Homo sapien
ttacattcgtttctatttggatagt

SEQ ID NO: 641763 - DNA, 25 bp, Homo sapien
ttagccaacctaacttccttacatt

SEQ ID NO: 641764 - DNA, 25 bp, Homo sapien
acatttctttagttggattctctta

SEQ ID NO: 641765 - DNA, 25 bp, Homo sapien
gagattggctacattaaagaactgg

SEQ ID NO: 641766 - DNA, 25 bp, Homo sapien
gaactggctttagtattatagcata

SEQ ID NO: 641767 - DNA, 25 bp, Homo sapien
tatagcatagtagttaacaaggcct

SEQ ID NO: 641768 - DNA, 25 bp, Homo sapien
taacaaggcctaactcgttaatcat

SEQ ID NO: 641769 - DNA, 25 bp, Homo sapien
ctcgttaatcatagtgctgtttcac

SEQ ID NO: 641770 - DNA, 25 bp, Homo sapien
atcatagtgctgtttcactgataaa

SEQ ID NO: 641771 - DNA, 25 bp, Homo sapien
taaaattttgcgtaggcctcttatg

SEQ ID NO: 641772 - DNA, 25 bp, Homo sapien
gtaggcctcttatggcagctcatgc

SEQ ID NO: 641773 - DNA, 25 bp, Homo sapien
agataggaggagtacttgaagccag

SEQ ID NO: 641774 - DNA, 25 bp, Homo sapien
gttgccaggcaggcttgagtgcagt

SEQ ID NO: 641775 - DNA, 25 bp, Homo sapien
ttgccaggcaggcttgagtgcagtg

SEQ ID NO: 641776 - DNA, 25 bp, Homo sapien
tattgcaggcgcctgccacgacgcc

SEQ ID NO: 641777 - DNA, 25 bp, Homo sapien
cgtgagccactacacccggccgtta

SEQ ID NO: 641778 - DNA, 25 bp, Homo sapien
gtgagccactacacccggccgttag

SEQ ID NO: 641779 - DNA, 25 bp, Homo sapien
tgagccactacacccggccgttagc

SEQ ID NO: 641780 - DNA, 25 bp, Homo sapien
gagccactacacccggccgttagct

SEQ ID NO: 641781 - DNA, 25 bp, Homo sapien
agccactacacccggccgttagctt

SEQ ID NO: 641782 - DNA, 25 bp, Homo sapien
gccactacacccggccgttagcttt

SEQ ID NO: 641783 - DNA, 25 bp, Homo sapien
catcagttttcccttctgtcaaatg

SEQ ID NO: 641784 - DNA, 25 bp, Homo sapien
cccttctgtcaaatgggaaagcaca

SEQ ID NO: 641785 - DNA, 25 bp, Homo sapien
caaatgggaaagcacaggacctgcc

SEQ ID NO: 641786 - DNA, 25 bp, Homo sapien
atgtatgtgatgcatttagctccat

SEQ ID NO: 641787 - DNA, 25 bp, Homo sapien
gcatttagctccatgtttcagccta

SEQ ID NO: 641788 - DNA, 25 bp, Homo sapien
agctccatgtttcagcctatggtga

SEQ ID NO: 641789 - DNA, 25 bp, Homo sapien
tttcagcctatggtgaaggccaggt

SEQ ID NO: 641790 - DNA, 25 bp, Homo sapien
gaaggccaggtggattttagcccct

SEQ ID NO: 641791 - DNA, 25 bp, Homo sapien
gccaggtggattttagcccctaatt

SEQ ID NO: 641792 - DNA, 25 bp, Homo sapien
gattatcacatatccataatttggg

SEQ ID NO: 641793 - DNA, 25 bp, Homo sapien
aaatgtgcacatttggctgggtgtg

SEQ ID NO: 641794 - DNA, 25 bp, Homo sapien
gaaggtggaccagtaagacaacatg

SEQ ID NO: 641795 - DNA, 25 bp, Homo sapien
ggtggaccagtaagacaacatgaca

SEQ ID NO: 641796 - DNA, 25 bp, Homo sapien
ggaccagtaagacaacatgacacgt

SEQ ID NO: 641797 - DNA, 25 bp, Homo sapien
gtaagacaacatgacacgtaaggca

SEQ ID NO: 641798 - DNA, 25 bp, Homo sapien
agacaacatgacacgtaaggcagga

SEQ ID NO: 641799 - DNA, 25 bp, Homo sapien
acaacatgacacgtaaggcaggaga

SEQ ID NO: 641800 - DNA, 25 bp, Homo sapien
acatgacacgtaaggcaggagaatc

SEQ ID NO: 641801 - DNA, 25 bp, Homo sapien
aacaaagacaatacgacatacctag

SEQ ID NO: 641802 - DNA, 25 bp, Homo sapien
gacaatacgacatacctagattcta

SEQ ID NO: 641803 - DNA, 25 bp, Homo sapien
aatacgacatacctagattctaatt

SEQ ID NO: 641804 - DNA, 25 bp, Homo sapien
cctagattctaattcaacacagaaa

SEQ ID NO: 641805 - DNA, 25 bp, Homo sapien
atcactgcccttgtcagatagtatc

SEQ ID NO: 641806 - DNA, 25 bp, Homo sapien
gtcagatagtatcatgatcacaata

SEQ ID NO: 641807 - DNA, 25 bp, Homo sapien
ataatatttcattgattctcacaaa

SEQ ID NO: 641808 - DNA, 25 bp, Homo sapien
ttctcacaaaaacaggtgggtgcca

SEQ ID NO: 641809 - DNA, 25 bp, Homo sapien
aggtgggtgccacagttatccccat

SEQ ID NO: 641810 - DNA, 25 bp, Homo sapien
gtgccacagttatccccattatatg

SEQ ID NO: 641811 - DNA, 25 bp, Homo sapien
gttatccccattatatgcacaaaat

SEQ ID NO: 641812 - DNA, 25 bp, Homo sapien
aatgagcgatttgcccaagctcacc

SEQ ID NO: 641813 - DNA, 25 bp, Homo sapien
aagctcacctgaatattaagactga

SEQ ID NO: 641814 - DNA, 25 bp, Homo sapien
ctgagtcaaatgttagtctggtctg

SEQ ID NO: 641815 - DNA, 25 bp, Homo sapien
gtcaaatgttagtctggtctgactt

SEQ ID NO: 641816 - DNA, 25 bp, Homo sapien
acctgacagttggataacataaaat

SEQ ID NO: 641817 - DNA, 25 bp, Homo sapien
gaaagagatactgcagacaaaccaa

SEQ ID NO: 641818 - DNA, 25 bp, Homo sapien
gagatactgcagacaaaccaagaga

SEQ ID NO: 641819 - DNA, 25 bp, Homo sapien
atactgcagacaaaccaagagacct

SEQ ID NO: 641820 - DNA, 25 bp, Homo sapien
gacaaaccaagagaccttgatcctg

SEQ ID NO: 641821 - DNA, 25 bp, Homo sapien
aaaccaagagaccttgatcctgaaa

SEQ ID NO: 641822 - DNA, 25 bp, Homo sapien
ccaagagaccttgatcctgaaaaaa

SEQ ID NO: 641823 - DNA, 25 bp, Homo sapien
aaataattggctatgcagacagcag

SEQ ID NO: 641824 - DNA, 25 bp, Homo sapien
attggctatgcagacagcagtggag

SEQ ID NO: 641825 - DNA, 25 bp, Homo sapien
gataaagcagacttggtgttagcaa

SEQ ID NO: 641826 - DNA, 25 bp, Homo sapien
cgggctcttgctttttgctttacta

SEQ ID NO: 641827 - DNA, 25 bp, Homo sapien
gtgactctttacagggtacttaaca

SEQ ID NO: 641828 - DNA, 25 bp, Homo sapien
ggacaaaagtacttcactacccact

SEQ ID NO: 641829 - DNA, 25 bp, Homo sapien
ttcactacccactatcttattcagt

SEQ ID NO: 641830 - DNA, 25 bp, Homo sapien
ttcagtcccttgaatatctgcctgg

SEQ ID NO: 641831 - DNA, 25 bp, Homo sapien
aaatatcttacctaaggtcacccag

SEQ ID NO: 641832 - DNA, 25 bp, Homo sapien
gacttgaatccaagattcctgtctc

SEQ ID NO: 641833 - DNA, 25 bp, Homo sapien
attcctgtctctaaatccaatgctc

SEQ ID NO: 641834 - DNA, 25 bp, Homo sapien
ctttctactctgctaacctttctta

SEQ ID NO: 641835 - DNA, 25 bp, Homo sapien
acctttcttactcatgcctatgtta

SEQ ID NO: 641836 - DNA, 25 bp, Homo sapien
gcctatgttattctttgatctgcat

SEQ ID NO: 641837 - DNA, 25 bp, Homo sapien
atctgcatttgcttgggagaaccaa

SEQ ID NO: 641838 - DNA, 25 bp, Homo sapien
gaagtccagaagcagtttttcctaa

SEQ ID NO: 641839 - DNA, 25 bp, Homo sapien
aacacactatatgtgcccctgtagg

SEQ ID NO: 641840 - DNA, 25 bp, Homo sapien
ctgtaggcatgctggctgactttat

SEQ ID NO: 641841 - DNA, 25 bp, Homo sapien
gctgactttattcccactgtgaatc

SEQ ID NO: 641842 - DNA, 25 bp, Homo sapien
atcttgaagcagtcctaaaacccag

SEQ ID NO: 641843 - DNA, 25 bp, Homo sapien
tccagtccctgtcaactaaagtctg

SEQ ID NO: 641844 - DNA, 25 bp, Homo sapien
tgtcaactaaagtctgggagcagtc

SEQ ID NO: 641845 - DNA, 25 bp, Homo sapien
agggagaaatgccatgaagccagaa

SEQ ID NO: 641846 - DNA, 25 bp, Homo sapien
aagactttggtctcagctgtgtatc

SEQ ID NO: 641847 - DNA, 25 bp, Homo sapien
tcagctgtgtatcctgaagcagccc

SEQ ID NO: 641848 - DNA, 25 bp, Homo sapien
aagcagccctatgaatcagttccac

SEQ ID NO: 641849 - DNA, 25 bp, Homo sapien
aaagtcccactttcaacatgcatgg

SEQ ID NO: 641850 - DNA, 25 bp, Homo sapien
aagtcccactttcaacatgcatggg

SEQ ID NO: 641851 - DNA, 25 bp, Homo sapien
gtcccactttcaacatgcatgggag

SEQ ID NO: 641852 - DNA, 25 bp, Homo sapien
ccactttcaacatgcatgggaggat

SEQ ID NO: 641853 - DNA, 25 bp, Homo sapien
actttcaacatgcatgggaggatga

SEQ ID NO: 641854 - DNA, 25 bp, Homo sapien
catgcatgggaggatgaagtttcca
